United States Patent 7,691,997 (FUNCTIONAL AND HYPERFUNCTIONAL SIRNA) - sequence listing, part 14

SEQ ID NO: 543139 - RNA, 19 nt, Homo sapiens
ugacaaagcuuuuaaaugg

SEQ ID NO: 543140 - RNA, 19 nt, Homo sapiens
gagaaacccuacacaugug

SEQ ID NO: 543141 - RNA, 19 nt, Homo sapiens
gagagaaacccuacacaug

SEQ ID NO: 543142 - RNA, 19 nt, Homo sapiens
aaauggcccucaacccuua

SEQ ID NO: 543143 - RNA, 19 nt, Homo sapiens
ccucaaaccuuacuacaca

SEQ ID NO: 543144 - RNA, 19 nt, Homo sapiens
ggagagaaacccuaugaau

SEQ ID NO: 543145 - RNA, 19 nt, Homo sapiens
ggagagaagccuuacaaau

SEQ ID NO: 543146 - RNA, 19 nt, Homo sapiens
ggagagaaacccuacaaau

SEQ ID NO: 543147 - RNA, 19 nt, Homo sapiens
ggagagaaacccuacaaau

SEQ ID NO: 543148 - RNA, 19 nt, Homo sapiens
aagcaguccucaaaccuua

SEQ ID NO: 543149 - RNA, 19 nt, Homo sapiens
ggagagaaacccuacaaau

SEQ ID NO: 543150 - RNA, 19 nt, Homo sapiens
ggagagaaacccuacaaau

SEQ ID NO: 543151 - RNA, 19 nt, Homo sapiens
gaacaaacuacaagugcaa

SEQ ID NO: 543152 - RNA, 19 nt, Homo sapiens
aaccaguccucaaaucuua

SEQ ID NO: 543153 - RNA, 19 nt, Homo sapiens
acaguuauguguucucauu

SEQ ID NO: 543154 - RNA, 19 nt, Homo sapiens
gaaacccuaugaaugugaa

SEQ ID NO: 543155 - RNA, 19 nt, Homo sapiens
gagaagccuuacaaaucua

SEQ ID NO: 543156 - RNA, 19 nt, Homo sapiens
gagaaaccauacaaaugug

SEQ ID NO: 543157 - RNA, 19 nt, Homo sapiens
ccucaacccuuacuaaaca

SEQ ID NO: 543158 - RNA, 19 nt, Homo sapiens
ggcaaagcuuuaaucaauu

SEQ ID NO: 543159 - RNA, 19 nt, Homo sapiens
gguccucaguccuuacuaa

SEQ ID NO: 543160 - RNA, 19 nt, Homo sapiens
uaaagaaugugguaaagcu

SEQ ID NO: 543161 - RNA, 19 nt, Homo sapiens
uaaagaaugugguaaagcu

SEQ ID NO: 543162 - RNA, 19 nt, Homo sapiens
gaaagaggccuggaguaug

SEQ ID NO: 543163 - RNA, 19 nt, Homo sapiens
gacaacaccucagacuuau

SEQ ID NO: 543164 - RNA, 19 nt, Homo sapiens
gauaauucauaccggagaa

SEQ ID NO: 543165 - RNA, 19 nt, Homo sapiens
gagaauucauacuggagaa

SEQ ID NO: 543166 - RNA, 19 nt, Homo sapiens
agagaaacccuaugaaugu

SEQ ID NO: 543167 - RNA, 19 nt, Homo sapiens
agagaagccuuacaaaucu

SEQ ID NO: 543168 - RNA, 19 nt, Homo sapiens
agagaaacccuacaaaugu

SEQ ID NO: 543169 - RNA, 19 nt, Homo sapiens
agagaaacccuacaaaugu

SEQ ID NO: 543170 - RNA, 19 nt, Homo sapiens
agagaaacccuacaaaugu

SEQ ID NO: 543171 - RNA, 19 nt, Homo sapiens
agagaaacccuacaaaugu

SEQ ID NO: 543172 - RNA, 19 nt, Homo sapiens
gccauagaauucucucuga

SEQ ID NO: 543173 - RNA, 19 nt, Homo sapiens
ugaagaauguggcaaaggu

SEQ ID NO: 543174 - RNA, 19 nt, Homo sapiens
gagaaacccuaugaaugug

SEQ ID NO: 543175 - RNA, 19 nt, Homo sapiens
aaacacucuucaacccuua

SEQ ID NO: 543176 - RNA, 19 nt, Homo sapiens
aaccgauucucaacucuua

SEQ ID NO: 543177 - RNA, 19 nt, Homo sapiens
aaccaguccucaaaccuua

SEQ ID NO: 543178 - RNA, 19 nt, Homo sapiens
uaaccagucugcacaccuu

SEQ ID NO: 543179 - RNA, 19 nt, Homo sapiens
aaccaguccucaaaccuua

SEQ ID NO: 543180 - RNA, 19 nt, Homo sapiens
uagcagaauucauacuaga

SEQ ID NO: 543181 - RNA, 19 nt, Homo sapiens
ggccggagcagaauauaaa

SEQ ID NO: 543182 - RNA, 19 nt, Homo sapiens
aauuuaugcucacaccuua

SEQ ID NO: 543183 - RNA, 19 nt, Homo sapiens
gagaaacuacuaaccugaa

SEQ ID NO: 543184 - RNA, 19 nt, Homo sapiens
aagagaaaccuuacaaaug

SEQ ID NO: 543185 - RNA, 19 nt, Homo sapiens
ggauguggccauagaauuc

SEQ ID NO: 543186 - RNA, 19 nt, Homo sapiens
cuucaacccuuacuaaaca

SEQ ID NO: 543187 - RNA, 19 nt, Homo sapiens
agaaaaggcugugaaagua

SEQ ID NO: 543188 - RNA, 19 nt, Homo sapiens
gaaaagccguuaauaucug

SEQ ID NO: 543189 - RNA, 19 nt, Homo sapiens
gagaaaccuuacaaaugug

SEQ ID NO: 543190 - RNA, 19 nt, Homo sapiens
auacagaagagaaaccuua

SEQ ID NO: 543191 - RNA, 19 nt, Homo sapiens
gagaaaccuuacaaaugug

SEQ ID NO: 543192 - RNA, 19 nt, Homo sapiens
gagaaaccuuacaaaugug

SEQ ID NO: 543193 - RNA, 19 nt, Homo sapiens
agacaugagauaagacaua

SEQ ID NO: 543194 - RNA, 19 nt, Homo sapiens
agagaaaccauacaaaugu

SEQ ID NO: 543195 - RNA, 19 nt, Homo sapiens
agccagaccugaucacuug

SEQ ID NO: 543196 - RNA, 19 nt, Homo sapiens
gaaaguauggaugagugua

SEQ ID NO: 543197 - RNA, 19 nt, Homo sapiens
gaaagaaacucuacaaaug

SEQ ID NO: 543198 - RNA, 19 nt, Homo sapiens
gagaaacccuucaaaugua

SEQ ID NO: 543199 - RNA, 19 nt, Homo sapiens
gagaaacccuucaaaugua

SEQ ID NO: 543200 - RNA, 19 nt, Homo sapiens
ggaaagaaaugcuucaaau

SEQ ID NO: 543201 - RNA, 19 nt, Homo sapiens
ggacauaagagaauucaua

SEQ ID NO: 543202 - RNA, 19 nt, Homo sapiens
gagaaguccuguaaaugua

SEQ ID NO: 543203 - RNA, 19 nt, Homo sapiens
gagaaacccuacaaauuug

SEQ ID NO: 543204 - RNA, 19 nt, Homo sapiens
gagagaaacccuacaaauu

SEQ ID NO: 543205 - RNA, 19 nt, Homo sapiens
aaagagcccuggaauauga

SEQ ID NO: 543206 - RNA, 19 nt, Homo sapiens
gagagaagcccuacaaaug

SEQ ID NO: 543207 - RNA, 19 nt, Homo sapiens
gagagaagcccuacaaaug

SEQ ID NO: 543208 - RNA, 19 nt, Homo sapiens
cuacaaaugugaagaaugu

SEQ ID NO: 543209 - RNA, 19 nt, Homo sapiens
cuacaaaugugaagaaugu

SEQ ID NO: 543210 - RNA, 19 nt, Homo sapiens
cuacaaaugugaagaaugu

SEQ ID NO: 543211 - RNA, 19 nt, Homo sapiens
cuacaaaugugaagaaugu

SEQ ID NO: 543212 - RNA, 19 nt, Homo sapiens
cuacaaaugugaagaaugu

SEQ ID NO: 543213 - RNA, 19 nt, Homo sapiens
cuacaaaugugaagaaugu

SEQ ID NO: 543214 - RNA, 19 nt, Homo sapiens
cuacaaaugugaagaaugu

SEQ ID NO: 543215 - RNA, 19 nt, Homo sapiens
ggaaagaaacucuacaaau

SEQ ID NO: 543216 - RNA, 19 nt, Homo sapiens
cuacaaaugugaagaaugu

SEQ ID NO: 543217 - RNA, 19 nt, Homo sapiens
cuacaaaugugaagaaugu

SEQ ID NO: 543218 - RNA, 19 nt, Homo sapiens
cuacaaaugugaagaaugu

SEQ ID NO: 543219 - RNA, 19 nt, Homo sapiens
cuacaaaugugaagaaugu

SEQ ID NO: 543220 - RNA, 19 nt, Homo sapiens
cuacaaaugugaagaaugu

SEQ ID NO: 543221 - RNA, 19 nt, Homo sapiens
gaagauaaacccuacaaau

SEQ ID NO: 543222 - RNA, 19 nt, Homo sapiens
ggaaugugauguuagagaa

SEQ ID NO: 543223 - RNA, 19 nt, Homo sapiens
ggagagaagucuuacaagu

SEQ ID NO: 543224 - RNA, 19 nt, Homo sapiens
agacaauccuuaacccuua

SEQ ID NO: 543225 - RNA, 19 nt, Homo sapiens
uaaagaauguggcaaagga

SEQ ID NO: 543226 - RNA, 19 nt, Homo sapiens
gcacaaagaagguuauaau

SEQ ID NO: 543227 - RNA, 19 nt, Homo sapiens
agagaaacccuacaaauuu

SEQ ID NO: 543228 - RNA, 19 nt, Homo sapiens
gagagaaacccuacaaaug

SEQ ID NO: 543229 - RNA, 19 nt, Homo sapiens
cuacaaauguggagaaugu

SEQ ID NO: 543230 - RNA, 19 nt, Homo sapiens
gagagaaacccuacaaaug

SEQ ID NO: 543231 - RNA, 19 nt, Homo sapiens
gagagaaacccuacaaaug

SEQ ID NO: 543232 - RNA, 19 nt, Homo sapiens
gcaaagcauuuauaucauc

SEQ ID NO: 543233 - RNA, 19 nt, Homo sapiens
gagagaaacccuacaaaug

SEQ ID NO: 543234 - RNA, 19 nt, Homo sapiens
gagagaaacccuacaaaug

SEQ ID NO: 543235 - RNA, 19 nt, Homo sapiens
gagagaaacccuacaaaug

SEQ ID NO: 543236 - RNA, 19 nt, Homo sapiens
gagagaaacccuacaaaug

SEQ ID NO: 543237 - RNA, 19 nt, Homo sapiens
gagagaaacccuacaaaug

SEQ ID NO: 543238 - RNA, 19 nt, Homo sapiens
gagagaaacccuucaaaug

SEQ ID NO: 543239 - RNA, 19 nt, Homo sapiens
gaagagaaacccuacaaau

SEQ ID NO: 543240 - RNA, 19 nt, Homo sapiens
gagagaaacccuacaaaug

SEQ ID NO: 543241 - RNA, 19 nt, Homo sapiens
gagagaaacccuacaaaug

SEQ ID NO: 543242 - RNA, 19 nt, Homo sapiens
gauacacacuggagagaaa

SEQ ID NO: 543243 - RNA, 19 nt, Homo sapiens
gagagaaacccuacaaaug

SEQ ID NO: 543244 - RNA, 19 nt, Homo sapiens
gagagaaacccuucaaaug

SEQ ID NO: 543245 - RNA, 19 nt, Homo sapiens
gaagagaaacccuacaaau

SEQ ID NO: 543246 - RNA, 19 nt, Homo sapiens
gagagaaacccuacaaaug

SEQ ID NO: 543247 - RNA, 19 nt, Homo sapiens
gagagaaacccuacaaaug

SEQ ID NO: 543248 - RNA, 19 nt, Homo sapiens
gagagaaacccuacaaaug

SEQ ID NO: 543249 - RNA, 19 nt, Homo sapiens
gauacacacuggagagaaa

SEQ ID NO: 543250 - RNA, 19 nt, Homo sapiens
ccucaaagcuuacuacaca

SEQ ID NO: 543251 - RNA, 19 nt, Homo sapiens
agccagaccugauuacuua

SEQ ID NO: 543252 - RNA, 19 nt, Homo sapiens
aagcagcucucaacccuua

SEQ ID NO: 543253 - RNA, 19 nt, Homo sapiens
gagaaacucuacaaaugug

SEQ ID NO: 543254 - RNA, 19 nt, Homo sapiens
gagaaacucuacaaaugug

SEQ ID NO: 543255 - RNA, 19 nt, Homo sapiens
gagaaacucuacaaaugug

SEQ ID NO: 543256 - RNA, 19 nt, Homo sapiens
gauaaacccuacaaaugug

SEQ ID NO: 543257 - RNA, 19 nt, Homo sapiens
gaaagaaaugcuucaaaug

SEQ ID NO: 543258 - RNA, 19 nt, Homo sapiens
agagaaaccuuacaagugu

SEQ ID NO: 543259 - RNA, 19 nt, Homo sapiens
agagaaaccuuacaagugu

SEQ ID NO: 543260 - RNA, 19 nt, Homo sapiens
agagaaaccuuacaagugu

SEQ ID NO: 543261 - RNA, 19 nt, Homo sapiens
gagaaacccuacaaaugug

SEQ ID NO: 543262 - RNA, 19 nt, Homo sapiens
gagaaacccuacaaaugug

SEQ ID NO: 543263 - RNA, 19 nt, Homo sapiens
gagaaacccuacaaaugug

SEQ ID NO: 543264 - RNA, 19 nt, Homo sapiens
gagagaaaccuuacaagug

SEQ ID NO: 543265 - RNA, 19 nt, Homo sapiens
gagaaacccuacaaaugug

SEQ ID NO: 543266 - RNA, 19 nt, Homo sapiens
gagaaacccuacaaaugug

SEQ ID NO: 543267 - RNA, 19 nt, Homo sapiens
gagaaacccuacaaaugug

SEQ ID NO: 543268 - RNA, 19 nt, Homo sapiens
gagaaacccuacaaaugug

SEQ ID NO: 543269 - RNA, 19 nt, Homo sapiens
gcacagcagaauuuauaua

SEQ ID NO: 543270 - RNA, 19 nt, Homo sapiens
gagagaaaccuuacaagug

SEQ ID NO: 543271 - RNA, 19 nt, Homo sapiens
gagaaacccuacaaaugug

SEQ ID NO: 543272 - RNA, 19 nt, Homo sapiens
ucaagucuuucuacacaua

SEQ ID NO: 543273 - RNA, 19 nt, Homo sapiens
gagagaaaccuuacaagug

SEQ ID NO: 543274 - RNA, 19 nt, Homo sapiens
gagaaacccuacaaaugug

SEQ ID NO: 543275 - RNA, 19 nt, Homo sapiens
gagaaacccuacaaaugug

SEQ ID NO: 543276 - RNA, 19 nt, Homo sapiens
gaaaagagcccuggaauau

SEQ ID NO: 543277 - RNA, 19 nt, Homo sapiens
gagagaaaccauacaaaug

SEQ ID NO: 543278 - RNA, 19 nt, Homo sapiens
gcauuuauauggucuucaa

SEQ ID NO: 543279 - RNA, 19 nt, Homo sapiens
uaaagaauguggcaaagca

SEQ ID NO: 543280 - RNA, 19 nt, Homo sapiens
cagcagaauuuauauagga

SEQ ID NO: 543281 - RNA, 19 nt, Homo sapiens
ggauuuauauggucuucaa

SEQ ID NO: 543282 - RNA, 19 nt, Homo sapiens
ccucaacccuuacuaauca

SEQ ID NO: 543283 - RNA, 19 nt, Homo sapiens
ggagagaaaccauacaaau

SEQ ID NO: 543284 - RNA, 19 nt, Homo sapiens
gcauuuaacugguccucaa

SEQ ID NO: 543285 - RNA, 19 nt, Homo sapiens
aagcaauucucaacccuua

SEQ ID NO: 543286 - RNA, 19 nt, Homo sapiens
gcauuuaacugguccucaa

SEQ ID NO: 543287 - RNA, 19 nt, Homo sapiens
gagaagcccuacaaaugug

SEQ ID NO: 543288 - RNA, 19 nt, Homo sapiens
gagaagcccuacaaaugug

SEQ ID NO: 543289 - RNA, 19 nt, Homo sapiens
gagcaaaguauuucaaugu

SEQ ID NO: 543290 - RNA, 19 nt, Homo sapiens
gagcagagcauggaagauu

SEQ ID NO: 543291 - RNA, 19 nt, Homo sapiens
aagcgacucucaacccuua

SEQ ID NO: 543292 - RNA, 19 nt, Homo sapiens
ccucaacccuugcuaauca

SEQ ID NO: 543293 - RNA, 19 nt, Homo sapiens
aaucauuccucaagucuuu

SEQ ID NO: 543294 - RNA, 19 nt, Homo sapiens
aagcgacucucaacccuua

SEQ ID NO: 543295 - RNA, 19 nt, Homo sapiens
ccucaacccuugcuaauca

SEQ ID NO: 543296 - RNA, 19 nt, Homo sapiens
cuacaagugugaagaaugu

SEQ ID NO: 543297 - RNA, 19 nt, Homo sapiens
gagagaagcuguacaaaug

SEQ ID NO: 543298 - RNA, 19 nt, Homo sapiens
gagagaaacuguacaaaug

SEQ ID NO: 543299 - RNA, 19 nt, Homo sapiens
guacaaaugugaagaaugu

SEQ ID NO: 543300 - RNA, 19 nt, Homo sapiens
gaagagacaugagauggua

SEQ ID NO: 543301 - RNA, 19 nt, Homo sapiens
gacaugagaugguagcuaa

SEQ ID NO: 543302 - RNA, 19 nt, Homo sapiens
gaaauucccuacaaaugug

SEQ ID NO: 543303 - RNA, 19 nt, Homo sapiens
aaagagcccuggaauauga

SEQ ID NO: 543304 - RNA, 19 nt, Homo sapiens
ggacuuaaccaauguuuga

SEQ ID NO: 543305 - RNA, 19 nt, Homo sapiens
cuacaaaugugaagaaugu

SEQ ID NO: 543306 - RNA, 19 nt, Homo sapiens
cuacaaaugugaagaaugu

SEQ ID NO: 543307 - RNA, 19 nt, Homo sapiens
cuacaaaugugaagaaugu

SEQ ID NO: 543308 - RNA, 19 nt, Homo sapiens
cuacaaaugugaagcauau

SEQ ID NO: 543309 - RNA, 19 nt, Homo sapiens
gaaagugacccuaagaaga

SEQ ID NO: 543310 - RNA, 19 nt, Homo sapiens
gagcagaacauaagagauu

SEQ ID NO: 543311 - RNA, 19 nt, Homo sapiens
uuacaaaccugaaagaugu

SEQ ID NO: 543312 - RNA, 19 nt, Homo sapiens
gagaaacccugcaaaugug

SEQ ID NO: 543313 - RNA, 19 nt, Homo sapiens
ccacauaagacaauucaua

SEQ ID NO: 543314 - RNA, 19 nt, Homo sapiens
gagagaaacccuacaaaug

SEQ ID NO: 543315 - RNA, 19 nt, Homo sapiens
gaagagaaacccuacaaau

SEQ ID NO: 543316 - RNA, 19 nt, Homo sapiens
ccucaaagcuuacugaaca

SEQ ID NO: 543317 - RNA, 19 nt, Homo sapiens
aaccagaccucacaccuua

SEQ ID NO: 543318 - RNA, 19 nt, Homo sapiens
gagaaacucuacaaaugug

SEQ ID NO: 543319 - RNA, 19 nt, Homo sapiens
acaccuaacucaacauaaa

SEQ ID NO: 543320 - RNA, 19 nt, Homo sapiens
uggcaaugcuuguaacuaa

SEQ ID NO: 543321 - RNA, 19 nt, Homo sapiens
uggcaaagcuaaccuauca

SEQ ID NO: 543322 - RNA, 19 nt, Homo sapiens
ccucaacgcuuacuaaaca

SEQ ID NO: 543323 - RNA, 19 nt, Homo sapiens
gagaaacccuacaaaugug

SEQ ID NO: 543324 - RNA, 19 nt, Homo sapiens
gagaaacccuacaaaugug

SEQ ID NO: 543325 - RNA, 19 nt, Homo sapiens
gaaaagagcccuggaauau

SEQ ID NO: 543326 - RNA, 19 nt, Homo sapiens
ugaaagaugugacaaugau

SEQ ID NO: 543327 - RNA, 19 nt, Homo sapiens
agagaaacguuaugaaugu

SEQ ID NO: 543328 - RNA, 19 nt, Homo sapiens
gcacaaaggagauuauagu

SEQ ID NO: 543329 - RNA, 19 nt, Homo sapiens
ggagagaaacuguacaaau

SEQ ID NO: 543330 - RNA, 19 nt, Homo sapiens
ggagagaaacguuaugaau

SEQ ID NO: 543331 - RNA, 19 nt, Homo sapiens
ucaaauagacacaagauga

SEQ ID NO: 543332 - RNA, 19 nt, Homo sapiens
ggagagaaacccuacaaau

SEQ ID NO: 543333 - RNA, 19 nt, Homo sapiens
ggagagaagcuguacaaau

SEQ ID NO: 543334 - RNA, 19 nt, Homo sapiens
gagagaaacguuaugaaug

SEQ ID NO: 543335 - RNA, 19 nt, Homo sapiens
cuacaaaugugagaaaugu

SEQ ID NO: 543336 - RNA, 19 nt, Homo sapiens
ccucaacccuuaauaaaca

SEQ ID NO: 543337 - RNA, 19 nt, Homo sapiens
gaaacguuaugaaugugaa

SEQ ID NO: 543338 - RNA, 19 nt, Homo sapiens
aaagugugguugaguguaa

SEQ ID NO: 543339 - RNA, 19 nt, Homo sapiens
uaaagaaugugguaaagcu

SEQ ID NO: 543340 - RNA, 19 nt, Homo sapiens
ggagagaacuacagaaacc

SEQ ID NO: 543341 - RNA, 19 nt, Homo sapiens
gagagaaacccugcaaaug

SEQ ID NO: 543342 - RNA, 19 nt, Homo sapiens
gagaagcuguacaaaugug

SEQ ID NO: 543343 - RNA, 19 nt, Homo sapiens
cugcaaaugugaagaaugu

SEQ ID NO: 543344 - RNA, 19 nt, Homo sapiens
agagaaacccuacaaaugu

SEQ ID NO: 543345 - RNA, 19 nt, Homo sapiens
agagaaacccuacaaaugu

SEQ ID NO: 543346 - RNA, 19 nt, Homo sapiens
gagaauucauacuggagaa

SEQ ID NO: 543347 - RNA, 19 nt, Homo sapiens
gaagaaugcggcaaagcuu

SEQ ID NO: 543348 - RNA, 19 nt, Homo sapiens
agaaauguguuagagcuuu

SEQ ID NO: 543349 - RNA, 19 nt, Homo sapiens
ccucacaccuuauuagaca

SEQ ID NO: 543350 - RNA, 19 nt, Homo sapiens
agagaaacccugcaaaugu

SEQ ID NO: 543351 - RNA, 19 nt, Homo sapiens
caucgacccuuacuacaca

SEQ ID NO: 543352 - RNA, 19 nt, Homo sapiens
ggcaaugcuuguaacuaaa

SEQ ID NO: 543353 - RNA, 19 nt, Homo sapiens
uaacucauccucaaaccuu

SEQ ID NO: 543354 - RNA, 19 nt, Homo sapiens
gcauauggaagagccuuua

SEQ ID NO: 543355 - RNA, 19 nt, Homo sapiens
aaaacuaccuugagcaaaa

SEQ ID NO: 543356 - RNA, 19 nt, Homo sapiens
gcaaagcuaaccuaucauc

SEQ ID NO: 543357 - RNA, 19 nt, Homo sapiens
gaagaauguggcaaagcua

SEQ ID NO: 543358 - RNA, 19 nt, Homo sapiens
ggaaaagagcccuggaaua

SEQ ID NO: 543359 - RNA, 19 nt, Homo sapiens
aagagaaacccuacaaaug

SEQ ID NO: 543360 - RNA, 19 nt, Homo sapiens
cauaagagaauucauacug

SEQ ID NO: 543361 - RNA, 19 nt, Homo sapiens
cauaagagaauucauacug

SEQ ID NO: 543362 - RNA, 19 nt, Homo sapiens
gguccucaacccuuaauaa

SEQ ID NO: 543363 - RNA, 19 nt, Homo sapiens
agaaaaggcuguaaaagug

SEQ ID NO: 543364 - RNA, 19 nt, Homo sapiens
aaagugacccuaagaagau

SEQ ID NO: 543365 - RNA, 19 nt, Homo sapiens
ccugaaagaugugacaaug

SEQ ID NO: 543366 - RNA, 19 nt, Homo sapiens
gcaaugcuuguaacuaaau

SEQ ID NO: 543367 - RNA, 19 nt, Homo sapiens
caacgcuuacuaaacauaa

SEQ ID NO: 543368 - RNA, 19 nt, Homo sapiens
caaagcuuacugaacauaa

SEQ ID NO: 543369 - RNA, 19 nt, Homo sapiens
gagaugguagcuaaacauu

SEQ ID NO: 543370 - RNA, 19 nt, Homo sapiens
agacacaagaugagacaua

SEQ ID NO: 543371 - RNA, 19 nt, Homo sapiens
gagauuauaguggacuuaa

SEQ ID NO: 543372 - RNA, 19 nt, Homo sapiens
gaaagaugugacaaugauu

SEQ ID NO: 543373 - RNA, 19 nt, Homo sapiens
uggcaaagcuuuuaacuca

SEQ ID NO: 543374 - RNA, 19 nt, Homo sapiens
ucucacaccuugcuauaca

SEQ ID NO: 543375 - RNA, 19 nt, Homo sapiens
gagaaacguuaugaaugug

SEQ ID NO: 543376 - RNA, 19 nt, Homo sapiens
uaaagaaugucgcaaaaca

SEQ ID NO: 543377 - RNA, 19 nt, Homo sapiens
ugaagaauguggcaaagcu

SEQ ID NO: 543378 - RNA, 19 nt, Homo sapiens
ugaagaauguggcaaagcu

SEQ ID NO: 543379 - RNA, 19 nt, Homo sapiens
gaaacucuacaaaugugaa

SEQ ID NO: 543380 - RNA, 19 nt, Homo sapiens
gcuuguaacuaaaucucaa

SEQ ID NO: 543381 - RNA, 19 nt, Homo sapiens
gaauguggcaaugcuugua

SEQ ID NO: 543382 - RNA, 19 nt, Homo sapiens
gaaauguguuagagcuuuu

SEQ ID NO: 543383 - RNA, 19 nt, Homo sapiens
ucacaccuaacucaacaua

SEQ ID NO: 543384 - RNA, 19 nt, Homo sapiens
gaugagacauacugaaaau

SEQ ID NO: 543385 - RNA, 19 nt, Homo sapiens
auaguggacuuaaccaaug

SEQ ID NO: 543386 - RNA, 19 nt, Homo sapiens
aaccuguccucaacgcuua

SEQ ID NO: 543387 - RNA, 19 nt, Homo sapiens
gaaugugacaaggccuuua

SEQ ID NO: 543388 - RNA, 19 nt, Homo sapiens
ggaauaugaagagacauga

SEQ ID NO: 543389 - RNA, 19 nt, Homo sapiens
ugagagaaacccugcaaau

SEQ ID NO: 543390 - RNA, 19 nt, Homo sapiens
gcaaagcuuuuaacucauc

SEQ ID NO: 543391 - RNA, 19 nt, Homo sapiens
ggccagagcagaacauaag

SEQ ID NO: 543392 - RNA, 19 nt, Homo sapiens
aagaugagacauacugaaa

SEQ ID NO: 543393 - RNA, 19 nt, Homo sapiens
gacacaagaugagacauac

SEQ ID NO: 543394 - RNA, 19 nt, Homo sapiens
ggagauuauaguggacuua

SEQ ID NO: 543395 - RNA, 19 nt, Homo sapiens
aaagcuaaccuaucaucaa

SEQ ID NO: 543396 - RNA, 19 nt, Homo sapiens
aaccagucaucgacccuua

SEQ ID NO: 543397 - RNA, 19 nt, Homo sapiens
ggaagagguuucauugaua

SEQ ID NO: 543398 - RNA, 19 nt, Homo sapiens
gggaagagcuuuagacaug

SEQ ID NO: 543399 - RNA, 19 nt, Homo sapiens
ggacagaaaccauauaauu

SEQ ID NO: 543400 - RNA, 19 nt, Homo sapiens
gggaaaggcuucagaugua

SEQ ID NO: 543401 - RNA, 19 nt, Homo sapiens
aaacugagauggagacuuu

SEQ ID NO: 543402 - RNA, 19 nt, Homo sapiens
gggaagggcuacauuagua

SEQ ID NO: 543403 - RNA, 19 nt, Homo sapiens
gagagaaaccuuauaauug

SEQ ID NO: 543404 - RNA, 19 nt, Homo sapiens
ggagagagaucuuauaacu

SEQ ID NO: 543405 - RNA, 19 nt, Homo sapiens
gaacgagucuccuuuccuu

SEQ ID NO: 543406 - RNA, 19 nt, Homo sapiens
guaaacaguucuucaguga

SEQ ID NO: 543407 - RNA, 19 nt, Homo sapiens
ugucuuaggucaagucuua

SEQ ID NO: 543408 - RNA, 19 nt, Homo sapiens
caagauaccaccauaagua

SEQ ID NO: 543409 - RNA, 19 nt, Homo sapiens
ggucuugacuuccaccaua

SEQ ID NO: 543410 - RNA, 19 nt, Homo sapiens
ggagugaaaugcuauaagu

SEQ ID NO: 543411 - RNA, 19 nt, Homo sapiens
ucagaaacaucacagaauu

SEQ ID NO: 543412 - RNA, 19 nt, Homo sapiens
gcaagacuaucuacaguuc

SEQ ID NO: 543413 - RNA, 19 nt, Homo sapiens
gaagagguuucauugauag

SEQ ID NO: 543414 - RNA, 19 nt, Homo sapiens
cagagaaacuguacaaauc

SEQ ID NO: 543415 - RNA, 19 nt, Homo sapiens
gggaacaaauugcaaguga

SEQ ID NO: 543416 - RNA, 19 nt, Homo sapiens
agacaugcuucuaguauuu

SEQ ID NO: 543417 - RNA, 19 nt, Homo sapiens
agagagaucuuauaacugu

SEQ ID NO: 543418 - RNA, 19 nt, Homo sapiens
gaggcaagauccaaacuga

SEQ ID NO: 543419 - RNA, 19 nt, Homo sapiens
gguaaggaauuuagucaga

SEQ ID NO: 543420 - RNA, 19 nt, Homo sapiens
gacagaaaccauauaauug

SEQ ID NO: 543421 - RNA, 19 nt, Homo sapiens
gcagagaaacuguacaaau

SEQ ID NO: 543422 - RNA, 19 nt, Homo sapiens
ggagagaaaccauucaaau

SEQ ID NO: 543423 - RNA, 19 nt, Homo sapiens
aaacaguucuucagugaug

SEQ ID NO: 543424 - RNA, 19 nt, Homo sapiens
gagcagagcccgaccuuuc

SEQ ID NO: 543425 - RNA, 19 nt, Homo sapiens
aaacuccacugccaaagaa

SEQ ID NO: 543426 - RNA, 19 nt, Homo sapiens
aggaacacaugaagaauuu

SEQ ID NO: 543427 - RNA, 19 nt, Homo sapiens
gcuugaaucuggauauaau

SEQ ID NO: 543428 - RNA, 19 nt, Homo sapiens
caaagaaagccauugaaau

SEQ ID NO: 543429 - RNA, 19 nt, Homo sapiens
ccaaagaaagccauugaaa

SEQ ID NO: 543430 - RNA, 19 nt, Homo sapiens
agauguagaucagcacuua

SEQ ID NO: 543431 - RNA, 19 nt, Homo sapiens
uuaaccaggucucaagaua

SEQ ID NO: 543432 - RNA, 19 nt, Homo sapiens
ugagagagaaaccuuauaa

SEQ ID NO: 543433 - RNA, 19 nt, Homo sapiens
gcgcuugaaucuggauaua

SEQ ID NO: 543434 - RNA, 19 nt, Homo sapiens
guaaagaccaacaaagaga

SEQ ID NO: 543435 - RNA, 19 nt, Homo sapiens
gcucacgucugcaaacuca

SEQ ID NO: 543436 - RNA, 19 nt, Homo sapiens
gaaacuccacugccaaaga

SEQ ID NO: 543437 - RNA, 19 nt, Homo sapiens
gcaaauuacacaugagaga

SEQ ID NO: 543438 - RNA, 19 nt, Homo sapiens
ggaaggcuuucaugcacaa

SEQ ID NO: 543439 - RNA, 19 nt, Homo sapiens
caucucagcccuucauauu

SEQ ID NO: 543440 - RNA, 19 nt, Homo sapiens
aaaugguccucauaucuuu

SEQ ID NO: 543441 - RNA, 19 nt, Homo sapiens
caaaugguccucauaucuu

SEQ ID NO: 543442 - RNA, 19 nt, Homo sapiens
uggaagagguuucauugau

SEQ ID NO: 543443 - RNA, 19 nt, Homo sapiens
ggaaaggcuucagauguag

SEQ ID NO: 543444 - RNA, 19 nt, Homo sapiens
gagaaaagccauacaaaug

SEQ ID NO: 543445 - RNA, 19 nt, Homo sapiens
gagaaaccuuauaauugug

SEQ ID NO: 543446 - RNA, 19 nt, Homo sapiens
gcaagcaaauuugggaaca

SEQ ID NO: 543447 - RNA, 19 nt, Homo sapiens
ggaagggcuacauuaguaa

SEQ ID NO: 543448 - RNA, 19 nt, Homo sapiens
gagaaacuguacaaaucug

SEQ ID NO: 543449 - RNA, 19 nt, Homo sapiens
ucucagcccuucauauuca

SEQ ID NO: 543450 - RNA, 19 nt, Homo sapiens
gauguuuccuucuuugauc

SEQ ID NO: 543451 - RNA, 19 nt, Homo sapiens
gacaaccccucccagauua

SEQ ID NO: 543452 - RNA, 19 nt, Homo sapiens
ucagugauguuuccuucuu

SEQ ID NO: 543453 - RNA, 19 nt, Homo sapiens
aaugaucgauucaggagaa

SEQ ID NO: 543454 - RNA, 19 nt, Homo sapiens
gaacaaauugcaagugacu

SEQ ID NO: 543455 - RNA, 19 nt, Homo sapiens
uauggagugugaaauuuga

SEQ ID NO: 543456 - RNA, 19 nt, Homo sapiens
ucugcaaacucaucaaaga

SEQ ID NO: 543457 - RNA, 19 nt, Homo sapiens
gaaaugcuauaagugugau

SEQ ID NO: 543458 - RNA, 19 nt, Homo sapiens
gaaaagccauacaaaugug

SEQ ID NO: 543459 - RNA, 19 nt, Homo sapiens
gauuaaagcaagacuaucu

SEQ ID NO: 543460 - RNA, 19 nt, Homo sapiens
cauugcaaauuacacauga

SEQ ID NO: 543461 - RNA, 19 nt, Homo sapiens
ggcaagauccaaacugaga

SEQ ID NO: 543462 - RNA, 19 nt, Homo sapiens
gaaaacccauccaaaugug

SEQ ID NO: 543463 - RNA, 19 nt, Homo sapiens
cgggagagagaucuuauaa

SEQ ID NO: 543464 - RNA, 19 nt, Homo sapiens
gaaacuguacaaaucugaa

SEQ ID NO: 543465 - RNA, 19 nt, Homo sapiens
gcucgcaaccacccaauga

SEQ ID NO: 543466 - RNA, 19 nt, Homo sapiens
ugugaaauaugugguaaga

SEQ ID NO: 543467 - RNA, 19 nt, Homo sapiens
ggagaaaacccauccaaau

SEQ ID NO: 543468 - RNA, 19 nt, Homo sapiens
gcagagcccgaccuuucua

SEQ ID NO: 543469 - RNA, 19 nt, Homo sapiens
gauaggcuagauuugcaua

SEQ ID NO: 543470 - RNA, 19 nt, Homo sapiens
cagauuaaagcaagacuau

SEQ ID NO: 543471 - RNA, 19 nt, Homo sapiens
caggaacacaugaagaauu

SEQ ID NO: 543472 - RNA, 19 nt, Homo sapiens
gagaaaacccauccaaaug

SEQ ID NO: 543473 - RNA, 19 nt, Homo sapiens
ugugauaacugcgggaaga

SEQ ID NO: 543474 - RNA, 19 nt, Homo sapiens
auacaaaugugaggagugu

SEQ ID NO: 543475 - RNA, 19 nt, Homo sapiens
caagcaaauuugggaacaa

SEQ ID NO: 543476 - RNA, 19 nt, Homo sapiens
ugugaagacuguggaaaga

SEQ ID NO: 543477 - RNA, 19 nt, Homo sapiens
ucaaaugguccucauaucu

SEQ ID NO: 543478 - RNA, 19 nt, Homo sapiens
cagcagagaaacuguacaa

SEQ ID NO: 543479 - RNA, 19 nt, Homo sapiens
aggcuuucaugcacaauuu

SEQ ID NO: 543480 - RNA, 19 nt, Homo sapiens
gaaaggcuucagauguaga

SEQ ID NO: 543481 - RNA, 19 nt, Homo sapiens
cuauaagugugaugugugu

SEQ ID NO: 543482 - RNA, 19 nt, Homo sapiens
aagcuucuguuacaucuca

SEQ ID NO: 543483 - RNA, 19 nt, Homo sapiens
aagcaagacuaucuacagu

SEQ ID NO: 543484 - RNA, 19 nt, Homo sapiens
gaagagcuuuagacaugcu

SEQ ID NO: 543485 - RNA, 19 nt, Homo sapiens
gagagagaaaccuuauaau

SEQ ID NO: 543486 - RNA, 19 nt, Homo sapiens
ugaaaugcuauaaguguga

SEQ ID NO: 543487 - RNA, 19 nt, Homo sapiens
agaagucucauaccuguga

SEQ ID NO: 543488 - RNA, 19 nt, Homo sapiens
aagauaccaccauaaguaa

SEQ ID NO: 543489 - RNA, 19 nt, Homo sapiens
gaauuuuccugcaagcaaa

SEQ ID NO: 543490 - RNA, 19 nt, Homo sapiens
gggcuacauuaguaaguca

SEQ ID NO: 543491 - RNA, 19 nt, Homo sapiens
ucauugauaggcuagauuu

SEQ ID NO: 543492 - RNA, 19 nt, Homo sapiens
uauggaagagguuucauug

SEQ ID NO: 543493 - RNA, 19 nt, Homo sapiens
guauggaagagguuucauu

SEQ ID NO: 543494 - RNA, 19 nt, Homo sapiens
ugaugugugugguaaggaa

SEQ ID NO: 543495 - RNA, 19 nt, Homo sapiens
cagugauguuuccuucuuu

SEQ ID NO: 543496 - RNA, 19 nt, Homo sapiens
uaucuacaguucacacaag

SEQ ID NO: 543497 - RNA, 19 nt, Homo sapiens
gaagaacccuauccaugua

SEQ ID NO: 543498 - RNA, 19 nt, Homo sapiens
gaaucaaacuggagauaaa

SEQ ID NO: 543499 - RNA, 19 nt, Homo sapiens
gcaauaagguaaagcauuc

SEQ ID NO: 543500 - RNA, 19 nt, Homo sapiens
gagagaaacugugaaugua

SEQ ID NO: 543501 - RNA, 19 nt, Homo sapiens
gguaaaggcuucagauguu

SEQ ID NO: 543502 - RNA, 19 nt, Homo sapiens
gaaaagcccuauaaaugua

SEQ ID NO: 543503 - RNA, 19 nt, Homo sapiens
gcacagaaacccuauguau

SEQ ID NO: 543504 - RNA, 19 nt, Homo sapiens
gauaaacccuaugacuaua

SEQ ID NO: 543505 - RNA, 19 nt, Homo sapiens
gagauaaacccuaugacua

SEQ ID NO: 543506 - RNA, 19 nt, Homo sapiens
ugaaaggacucacugaaga

SEQ ID NO: 543507 - RNA, 19 nt, Homo sapiens
gagaaacccuaugaaugua

SEQ ID NO: 543508 - RNA, 19 nt, Homo sapiens
gagaaacccuaugaaugua

SEQ ID NO: 543509 - RNA, 19 nt, Homo sapiens
gaaacugcauaugagaaua

SEQ ID NO: 543510 - RNA, 19 nt, Homo sapiens
gggaaagccuucagucguu

SEQ ID NO: 543511 - RNA, 19 nt, Homo sapiens
gguaaggccugcaguuguu

SEQ ID NO: 543512 - RNA, 19 nt, Homo sapiens
ucacaaggguucacagaga

SEQ ID NO: 543513 - RNA, 19 nt, Homo sapiens
gagagaaacccuaugaaug

SEQ ID NO: 543514 - RNA, 19 nt, Homo sapiens
gagagaaacccuaugaaug

SEQ ID NO: 543515 - RNA, 19 nt, Homo sapiens
gagagaaacccuaugaaug

SEQ ID NO: 543516 - RNA, 19 nt, Homo sapiens
uugcagaagucauaugaua

SEQ ID NO: 543517 - RNA, 19 nt, Homo sapiens
gaagucauaugauagacau

SEQ ID NO: 543518 - RNA, 19 nt, Homo sapiens
caacaugaggaucaaauuu

SEQ ID NO: 543519 - RNA, 19 nt, Homo sapiens
gguauaacauaacucauuc

SEQ ID NO: 543520 - RNA, 19 nt, Homo sapiens
gagaaaagcccuauaaaug

SEQ ID NO: 543521 - RNA, 19 nt, Homo sapiens
uggcaaagcuuucaguugu

SEQ ID NO: 543522 - RNA, 19 nt, Homo sapiens
ggagagaaaccuuaugugu

SEQ ID NO: 543523 - RNA, 19 nt, Homo sapiens
ggaaagaagccauguacau

SEQ ID NO: 543524 - RNA, 19 nt, Homo sapiens
ugauagacauacuguguaa

SEQ ID NO: 543525 - RNA, 19 nt, Homo sapiens
gaaaggacucacugaagaa

SEQ ID NO: 543526 - RNA, 19 nt, Homo sapiens
ggagagaaacccuaugaau

SEQ ID NO: 543527 - RNA, 19 nt, Homo sapiens
aaacucauauugcacagaa

SEQ ID NO: 543528 - RNA, 19 nt, Homo sapiens
ggagagaaacccuaugaau

SEQ ID NO: 543529 - RNA, 19 nt, Homo sapiens
ggagagaaacccuaugaau

SEQ ID NO: 543530 - RNA, 19 nt, Homo sapiens
guucauucaucccuucaua

SEQ ID NO: 543531 - RNA, 19 nt, Homo sapiens
gcagaagucauaugauaga

SEQ ID NO: 543532 - RNA, 19 nt, Homo sapiens
uaacacauacuccagauug

SEQ ID NO: 543533 - RNA, 19 nt, Homo sapiens
gaagguaucgaaugugaga

SEQ ID NO: 543534 - RNA, 19 nt, Homo sapiens
gagaaacugugaauguaag

SEQ ID NO: 543535 - RNA, 19 nt, Homo sapiens
gaaacccuaugaauguaug

SEQ ID NO: 543536 - RNA, 19 nt, Homo sapiens
ggaucaaauuucagcauga

SEQ ID NO: 543537 - RNA, 19 nt, Homo sapiens
gguauuugaugguauaaca

SEQ ID NO: 543538 - RNA, 19 nt, Homo sapiens
cagaaacccuauguaugua

SEQ ID NO: 543539 - RNA, 19 nt, Homo sapiens
ccaguucccuucagaaaca

SEQ ID NO: 543540 - RNA, 19 nt, Homo sapiens
ggagccauguuguagacua

SEQ ID NO: 543541 - RNA, 19 nt, Homo sapiens
aaacaugaacagucacaua

SEQ ID NO: 543542 - RNA, 19 nt, Homo sapiens
ucacagagacacaguaaug

SEQ ID NO: 543543 - RNA, 19 nt, Homo sapiens
gagccauguuguagacuaa

SEQ ID NO: 543544 - RNA, 19 nt, Homo sapiens
ccaauugccuucauuacca

SEQ ID NO: 543545 - RNA, 19 nt, Homo sapiens
cuaagaaacugcauaugag

SEQ ID NO: 543546 - RNA, 19 nt, Homo sapiens
gaucuuucaggaacuaaua

SEQ ID NO: 543547 - RNA, 19 nt, Homo sapiens
agagaaacccuaugaaugu

SEQ ID NO: 543548 - RNA, 19 nt, Homo sapiens
acagaaacccuauguaugu

SEQ ID NO: 543549 - RNA, 19 nt, Homo sapiens
agagaaacccuaugaaugu

SEQ ID NO: 543550 - RNA, 19 nt, Homo sapiens
agagaaacccuaugaaugu

SEQ ID NO: 543551 - RNA, 19 nt, Homo sapiens
gauauugguagcaguguaa

SEQ ID NO: 543552 - RNA, 19 nt, Homo sapiens
cuuuaaaggucaugugaaa

SEQ ID NO: 543553 - RNA, 19 nt, Homo sapiens
agcgagaagucacucauua

SEQ ID NO: 543554 - RNA, 19 nt, Homo sapiens
gaauguaagguguaggaaa

SEQ ID NO: 543555 - RNA, 19 nt, Homo sapiens
caugaacagucacauacuu

SEQ ID NO: 543556 - RNA, 19 nt, Homo sapiens
ugaagaacccuauccaugu

SEQ ID NO: 543557 - RNA, 19 nt, Homo sapiens
gcuuuaaucacuacaguuu

SEQ ID NO: 543558 - RNA, 19 nt, Homo sapiens
gaacucauacuggagagaa

SEQ ID NO: 543559 - RNA, 19 nt, Homo sapiens
gaaaucacacuggagagaa

SEQ ID NO: 543560 - RNA, 19 nt, Homo sapiens
ucagauacaucagagaaau

SEQ ID NO: 543561 - RNA, 19 nt, Homo sapiens
aaagaaugcccaccagauu

SEQ ID NO: 543562 - RNA, 19 nt, Homo sapiens
ugagagaaacugugaaugu

SEQ ID NO: 543563 - RNA, 19 nt, Homo sapiens
ggaaugugggaaagccuua

SEQ ID NO: 543564 - RNA, 19 nt, Homo sapiens
ugaaugagauguuuuagga

SEQ ID NO: 543565 - RNA, 19 nt, Homo sapiens
ccagugguauuugauggua

SEQ ID NO: 543566 - RNA, 19 nt, Homo sapiens
guaaaggcuucagauguuc

SEQ ID NO: 543567 - RNA, 19 nt, Homo sapiens
gaaacccuaugaauguaag

SEQ ID NO: 543568 - RNA, 19 nt, Homo sapiens
agacacaugguaacacaua

SEQ ID NO: 543569 - RNA, 19 nt, Homo sapiens
agauaaacccuaugacuau

SEQ ID NO: 543570 - RNA, 19 nt, Homo sapiens
acuaagaaacugcauauga

SEQ ID NO: 543571 - RNA, 19 nt, Homo sapiens
gcaaagcuuucaguugucu

SEQ ID NO: 543572 - RNA, 19 nt, Homo sapiens
gaacucacacuggagagaa

SEQ ID NO: 543573 - RNA, 19 nt, Homo sapiens
aaaucacacuggagagaaa

SEQ ID NO: 543574 - RNA, 19 nt, Homo sapiens
guagacuaaucaauccauu

SEQ ID NO: 543575 - RNA, 19 nt, Homo sapiens
uggaaaaccuuauggaaaa

SEQ ID NO: 543576 - RNA, 19 nt, Homo sapiens
ggagauaaacccuaugacu

SEQ ID NO: 543577 - RNA, 19 nt, Homo sapiens
ccagauugaccuuauaaau

SEQ ID NO: 543578 - RNA, 19 nt, Homo sapiens
gagaaacccuaugaauguc

SEQ ID NO: 543579 - RNA, 19 nt, Homo sapiens
guauguaacaauuguggua

SEQ ID NO: 543580 - RNA, 19 nt, Homo sapiens
gaacuaauagagcgagaag

SEQ ID NO: 543581 - RNA, 19 nt, Homo sapiens
uacccaaacuguauucaau

SEQ ID NO: 543582 - RNA, 19 nt, Homo sapiens
gguaacacauacuccagau

SEQ ID NO: 543583 - RNA, 19 nt, Homo sapiens
cuucauacguucauucauc

SEQ ID NO: 543584 - RNA, 19 nt, Homo sapiens
gaugguauaacauaacuca

SEQ ID NO: 543585 - RNA, 19 nt, Homo sapiens
cgaaucaaacuggagauaa

SEQ ID NO: 543586 - RNA, 19 nt, Homo sapiens
gggaaagccuucagauacg

SEQ ID NO: 543587 - RNA, 19 nt, Homo sapiens
gaaauccuagaaauacaga

SEQ ID NO: 543588 - RNA, 19 nt, Homo sapiens
gacuauaagcaauaaggua

SEQ ID NO: 543589 - RNA, 19 nt, Homo sapiens
gugggaaagccuucagaua

SEQ ID NO: 543590 - RNA, 19 nt, Homo sapiens
ggagggagccauguuguag

SEQ ID NO: 543591 - RNA, 19 nt, Homo sapiens
uuaugaagguaucgaaugu

SEQ ID NO: 543592 - RNA, 19 nt, Homo sapiens
uaagaaacugcauaugaga

SEQ ID NO: 543593 - RNA, 19 nt, Homo sapiens
gaaacccuauguauguaac

SEQ ID NO: 543594 - RNA, 19 nt, Homo sapiens
acaugaggaucaaauuuca

SEQ ID NO: 543595 - RNA, 19 nt, Homo sapiens
aauguaagguguaggaaag

SEQ ID NO: 543596 - RNA, 19 nt, Homo sapiens
agagaaacugugaauguaa

SEQ ID NO: 543597 - RNA, 19 nt, Homo sapiens
gaagagaagcagaaacuua

SEQ ID NO: 543598 - RNA, 19 nt, Homo sapiens
gcacagaagccaguaauua

SEQ ID NO: 543599 - RNA, 19 nt, Homo sapiens
gcauggagguugucuauga

SEQ ID NO: 543600 - RNA, 19 nt, Homo sapiens
ugaagacccucaagaguaa

SEQ ID NO: 543601 - RNA, 19 nt, Homo sapiens
acaaagcacuauauuggua

SEQ ID NO: 543602 - RNA, 19 nt, Homo sapiens
gaugugaguugugugaaua

SEQ ID NO: 543603 - RNA, 19 nt, Homo sapiens
gaaaaggacuguucaagug

SEQ ID NO: 543604 - RNA, 19 nt, Homo sapiens
gcugaaagcugaaggucaa

SEQ ID NO: 543605 - RNA, 19 nt, Homo sapiens
auuaugagcuggaagaaua

SEQ ID NO: 543606 - RNA, 19 nt, Homo sapiens
aaccauuccuucuguauua

SEQ ID NO: 543607 - RNA, 19 nt, Homo sapiens
caacaaggccugcagguau

SEQ ID NO: 543608 - RNA, 19 nt, Homo sapiens
gcagaaacuuauucagcaa

SEQ ID NO: 543609 - RNA, 19 nt, Homo sapiens
cugcucaucuguuuguuua

SEQ ID NO: 543610 - RNA, 19 nt, Homo sapiens
ggucuagucugcugagguu

SEQ ID NO: 543611 - RNA, 19 nt, Homo sapiens
gagaagugccagacaguuu

SEQ ID NO: 543612 - RNA, 19 nt, Homo sapiens
ggacuuacaaagcacuaua

SEQ ID NO: 543613 - RNA, 19 nt, Homo sapiens
gaucuuagaggacuuacaa

SEQ ID NO: 543614 - RNA, 19 nt, Homo sapiens
guuaaacugugaugaacuu

SEQ ID NO: 543615 - RNA, 19 nt, Homo sapiens
aaugucagcuuauggcuuu

SEQ ID NO: 543616 - RNA, 19 nt, Homo sapiens
gagagguucuggcaccauu

SEQ ID NO: 543617 - RNA, 19 nt, Homo sapiens
gaagcacacgagaaagaua

SEQ ID NO: 543618 - RNA, 19 nt, Homo sapiens
gugaugaacuugugauuuu

SEQ ID NO: 543619 - RNA, 19 nt, Homo sapiens
gagguucugucgucugcua

SEQ ID NO: 543620 - RNA, 19 nt, Homo sapiens
ggaugugaguugugugaau

SEQ ID NO: 543621 - RNA, 19 nt, Homo sapiens
gaaggagcuugucgugcuu

SEQ ID NO: 543622 - RNA, 19 nt, Homo sapiens
gcaacaaggccugcaggua

SEQ ID NO: 543623 - RNA, 19 nt, Homo sapiens
cgucugcuauugccuguuu

SEQ ID NO: 543624 - RNA, 19 nt, Homo sapiens
uuagccaccuucucauuaa

SEQ ID NO: 543625 - RNA, 19 nt, Homo sapiens
ggagaacugucgcuauucg

SEQ ID NO: 543626 - RNA, 19 nt, Homo sapiens
uggccagucuguuguuuaa

SEQ ID NO: 543627 - RNA, 19 nt, Homo sapiens
gacaaaagaguucaacaua

SEQ ID NO: 543628 - RNA, 19 nt, Homo sapiens
uuacaaagcacuauauugg

SEQ ID NO: 543629 - RNA, 19 nt, Homo sapiens
uuagaggacuuacaaagca

SEQ ID NO: 543630 - RNA, 19 nt, Homo sapiens
gcagaucuuagaggacuua

SEQ ID NO: 543631 - RNA, 19 nt, Homo sapiens
aaacugugaugaacuugug

SEQ ID NO: 543632 - RNA, 19 nt, Homo sapiens
gaacaggaucgucaagucu

SEQ ID NO: 543633 - RNA, 19 nt, Homo sapiens
gcacuauauugguaauucu

SEQ ID NO: 543634 - RNA, 19 nt, Homo sapiens
gagggcaacaugcucuaua

SEQ ID NO: 543635 - RNA, 19 nt, Homo sapiens
cuguuuagcuugacaugaa

SEQ ID NO: 543636 - RNA, 19 nt, Homo sapiens
uacugaauuuccacacuua

SEQ ID NO: 543637 - RNA, 19 nt, Homo sapiens
agugggacuugcuucauua

SEQ ID NO: 543638 - RNA, 19 nt, Homo sapiens
cagugggacuugcuucauu

SEQ ID NO: 543639 - RNA, 19 nt, Homo sapiens
gauauggaacucucguuug

SEQ ID NO: 543640 - RNA, 19 nt, Homo sapiens
gucggaagauggccacuga

SEQ ID NO: 543641 - RNA, 19 nt, Homo sapiens
caaagcacuauauugguaa

SEQ ID NO: 543642 - RNA, 19 nt, Homo sapiens
ugaguugugugaauaaucu

SEQ ID NO: 543643 - RNA, 19 nt, Homo sapiens
gcucaucuguuuguuuaca

SEQ ID NO: 543644 - RNA, 19 nt, Homo sapiens
ucaacaggauuaacucagu

SEQ ID NO: 543645 - RNA, 19 nt, Homo sapiens
caucugcagguauuauaua

SEQ ID NO: 543646 - RNA, 19 nt, Homo sapiens
ccaaagcagccauggaaga

SEQ ID NO: 543647 - RNA, 19 nt, Homo sapiens
gagaagcagaaacuuauuc

SEQ ID NO: 543648 - RNA, 19 nt, Homo sapiens
ucaagugggucuggccaaa

SEQ ID NO: 543649 - RNA, 19 nt, Homo sapiens
ggauuauggugauuaucug

SEQ ID NO: 543650 - RNA, 19 nt, Homo sapiens
cauaugagggccugcauug

SEQ ID NO: 543651 - RNA, 19 nt, Homo sapiens
uuacugaauuuccacacuu

SEQ ID NO: 543652 - RNA, 19 nt, Homo sapiens
gcuggaagaauauuucaau

SEQ ID NO: 543653 - RNA, 19 nt, Homo sapiens
gcaacaugcucuauaaaag

SEQ ID NO: 543654 - RNA, 19 nt, Homo sapiens
aacaaggccugcagguauu

SEQ ID NO: 543655 - RNA, 19 nt, Homo sapiens
gaagugccagacaguuuga

SEQ ID NO: 543656 - RNA, 19 nt, Homo sapiens
cacagugcuuuguauuuga

SEQ ID NO: 543657 - RNA, 19 nt, Homo sapiens
ggggagaacugucgcuauu

SEQ ID NO: 543658 - RNA, 19 nt, Homo sapiens
agggcaacaugcucuauaa

SEQ ID NO: 543659 - RNA, 19 nt, Homo sapiens
aagagaagcagaaacuuau

SEQ ID NO: 543660 - RNA, 19 nt, Homo sapiens
cagggucaccucugaauug

SEQ ID NO: 543661 - RNA, 19 nt, Homo sapiens
cgagaaagauauggaacuc

SEQ ID NO: 543662 - RNA, 19 nt, Homo sapiens
cauugaagcacacgagaaa

SEQ ID NO: 543663 - RNA, 19 nt, Homo sapiens
uaugagggccugcauugaa

SEQ ID NO: 543664 - RNA, 19 nt, Homo sapiens
cuaguguaguguuuacuga

SEQ ID NO: 543665 - RNA, 19 nt, Homo sapiens
ccagacaguuugagaacag

SEQ ID NO: 543666 - RNA, 19 nt, Homo sapiens
caaccauuccuucuguauu

SEQ ID NO: 543667 - RNA, 19 nt, Homo sapiens
gcaaccauuccuucuguau

SEQ ID NO: 543668 - RNA, 19 nt, Homo sapiens
uaaauguggcagagugaaa

SEQ ID NO: 543669 - RNA, 19 nt, Homo sapiens
ggaggaagagaagcagaaa

SEQ ID NO: 543670 - RNA, 19 nt, Homo sapiens
ccucaagcccauaaagaaa

SEQ ID NO: 543671 - RNA, 19 nt, Homo sapiens
gggcggaugccauugaguu

SEQ ID NO: 543672 - RNA, 19 nt, Homo sapiens
ucucuagacuuucccaaca

SEQ ID NO: 543673 - RNA, 19 nt, Homo sapiens
cgaagcagcggcauuugga

SEQ ID NO: 543674 - RNA, 19 nt, Homo sapiens
guaaauacagagcugaaag

SEQ ID NO: 543675 - RNA, 19 nt, Homo sapiens
guccuuaaaguuacuguuu

SEQ ID NO: 543676 - RNA, 19 nt, Homo sapiens
gcauuaagaaggagcuugu

SEQ ID NO: 543677 - RNA, 19 nt, Homo sapiens
uggaggagcagguguagaa

SEQ ID NO: 543678 - RNA, 19 nt, Homo sapiens
gccugcagcucccucagaa

SEQ ID NO: 543679 - RNA, 19 nt, Homo sapiens
gauauacaaagucucuaga

SEQ ID NO: 543680 - RNA, 19 nt, Homo sapiens
cacagaagccaguaauuag

SEQ ID NO: 543681 - RNA, 19 nt, Homo sapiens
cuaggauuauggugauuau

SEQ ID NO: 543682 - RNA, 19 nt, Homo sapiens
ccagagggaagaacauaug

SEQ ID NO: 543683 - RNA, 19 nt, Homo sapiens
gcuauucgcacgaccuuuc

SEQ ID NO: 543684 - RNA, 19 nt, Homo sapiens
guguaguguuuacugaauu

SEQ ID NO: 543685 - RNA, 19 nt, Homo sapiens
ggagacacaugcuuuuaca

SEQ ID NO: 543686 - RNA, 19 nt, Homo sapiens
gcagggucaccucugaauu

SEQ ID NO: 543687 - RNA, 19 nt, Homo sapiens
agaacaggaucgucaaguc

SEQ ID NO: 543688 - RNA, 19 nt, Homo sapiens
ggagaagugccagacaguu

SEQ ID NO: 543689 - RNA, 19 nt, Homo sapiens
gcauugaagcacacgagaa

SEQ ID NO: 543690 - RNA, 19 nt, Homo sapiens
gaucaucugcagguauuau

SEQ ID NO: 543691 - RNA, 19 nt, Homo sapiens
guuuacaguuuguucuuuc

SEQ ID NO: 543692 - RNA, 19 nt, Homo sapiens
uaauagccuuaacaaaugg

SEQ ID NO: 543693 - RNA, 19 nt, Homo sapiens
uugacacucuuacugcuuu

SEQ ID NO: 543694 - RNA, 19 nt, Homo sapiens
gggcaacaugcucuauaaa

SEQ ID NO: 543695 - RNA, 19 nt, Homo sapiens
cggaugccauugaguuugu

SEQ ID NO: 543696 - RNA, 19 nt, Homo sapiens
gccucaagcccauaaagaa

SEQ ID NO: 543697 - RNA, 19 nt, Homo sapiens
gaacauagcaagccauuga

SEQ ID NO: 543698 - RNA, 19 nt, Homo sapiens
cuacagagcuaacuacaaa

SEQ ID NO: 543699 - RNA, 19 nt, Homo sapiens
gcauggagguggucuauga

SEQ ID NO: 543700 - RNA, 19 nt, Homo sapiens
gaacaacagucacaacauc

SEQ ID NO: 543701 - RNA, 19 nt, Homo sapiens
gaagcugagucaagaaauu

SEQ ID NO: 543702 - RNA, 19 nt, Homo sapiens
gaucuagccuuuccaguau

SEQ ID NO: 543703 - RNA, 19 nt, Homo sapiens
uaacaucaaugcagaguug

SEQ ID NO: 543704 - RNA, 19 nt, Homo sapiens
gcccagagaucacagcaua

SEQ ID NO: 543705 - RNA, 19 nt, Homo sapiens
gaaacccugucucuacuaa

SEQ ID NO: 543706 - RNA, 19 nt, Homo sapiens
guagaaagccuugguuuaa

SEQ ID NO: 543707 - RNA, 19 nt, Homo sapiens
ggacaaagcaguauauugg

SEQ ID NO: 543708 - RNA, 19 nt, Homo sapiens
gcaaugaacugagaaugug

SEQ ID NO: 543709 - RNA, 19 nt, Homo sapiens
guucagauuucuacuguuu

SEQ ID NO: 543710 - RNA, 19 nt, Homo sapiens
gaccuaagcuggccaguag

SEQ ID NO: 543711 - RNA, 19 nt, Homo sapiens
aaacgaagcugagucaaga

SEQ ID NO: 543712 - RNA, 19 nt, Homo sapiens
ggacuaaacaggucacuug

SEQ ID NO: 543713 - RNA, 19 nt, Homo sapiens
gaagaacugucucccaaca

SEQ ID NO: 543714 - RNA, 19 nt, Homo sapiens
agaagaggcugucaccuuu

SEQ ID NO: 543715 - RNA, 19 nt, Homo sapiens
ucaagucucucaucaauag

SEQ ID NO: 543716 - RNA, 19 nt, Homo sapiens
ggagauaacugucgcuacu

SEQ ID NO: 543717 - RNA, 19 nt, Homo sapiens
ggagaccgcugcagaugug

SEQ ID NO: 543718 - RNA, 19 nt, Homo sapiens
ggaguuagccauagagguu

SEQ ID NO: 543719 - RNA, 19 nt, Homo sapiens
gguagaaagccuugguuua

SEQ ID NO: 543720 - RNA, 19 nt, Homo sapiens
ucucaaaccugcauagaug

SEQ ID NO: 543721 - RNA, 19 nt, Homo sapiens
gugcugcgguuaagaauau

SEQ ID NO: 543722 - RNA, 19 nt, Homo sapiens
gaagagaagcagaaacuca

SEQ ID NO: 543723 - RNA, 19 nt, Homo sapiens
cuaaacaggucacuuguag

SEQ ID NO: 543724 - RNA, 19 nt, Homo sapiens
acaaagcaguauauuggua

SEQ ID NO: 543725 - RNA, 19 nt, Homo sapiens
cugguuaucccauauauua

SEQ ID NO: 543726 - RNA, 19 nt, Homo sapiens
gcgccuggcuuuaaaguuc

SEQ ID NO: 543727 - RNA, 19 nt, Homo sapiens
gaaagaagagaagcagaaa

SEQ ID NO: 543728 - RNA, 19 nt, Homo sapiens
gacauggaguucucauuug

SEQ ID NO: 543729 - RNA, 19 nt, Homo sapiens
ggucuuggauacacaguug

SEQ ID NO: 543730 - RNA, 19 nt, Homo sapiens
ucaaccagauuguguuuau

SEQ ID NO: 543731 - RNA, 19 nt, Homo sapiens
agauguugcuuaugcuuua

SEQ ID NO: 543732 - RNA, 19 nt, Homo sapiens
gugccuggccuuaaaguua

SEQ ID NO: 543733 - RNA, 19 nt, Homo sapiens
aguacuagcucuguuuaua

SEQ ID NO: 543734 - RNA, 19 nt, Homo sapiens
gcaguacuagcucuguuua

SEQ ID NO: 543735 - RNA, 19 nt, Homo sapiens
auagaaaccuugcguagug

SEQ ID NO: 543736 - RNA, 19 nt, Homo sapiens
gauggaugcugcccagaga

SEQ ID NO: 543737 - RNA, 19 nt, Homo sapiens
acacaagaccuaugaagaa

SEQ ID NO: 543738 - RNA, 19 nt, Homo sapiens
ccucaagucucucaucaau

SEQ ID NO: 543739 - RNA, 19 nt, Homo sapiens
acaggucacuuguagauau

SEQ ID NO: 543740 - RNA, 19 nt, Homo sapiens
agaacugucucccaacaaa

SEQ ID NO: 543741 - RNA, 19 nt, Homo sapiens
ccagagaucacagcauaua

SEQ ID NO: 543742 - RNA, 19 nt, Homo sapiens
caaacugggucuuggauac

SEQ ID NO: 543743 - RNA, 19 nt, Homo sapiens
gguuaaaucugcacaucug

SEQ ID NO: 543744 - RNA, 19 nt, Homo sapiens
ggugagauguugcuuaugc

SEQ ID NO: 543745 - RNA, 19 nt, Homo sapiens
aggcggagcuugcaaugaa

SEQ ID NO: 543746 - RNA, 19 nt, Homo sapiens
gagugugggugugugauaa

SEQ ID NO: 543747 - RNA, 19 nt, Homo sapiens
ggaauucuuugaggaagga

SEQ ID NO: 543748 - RNA, 19 nt, Homo sapiens
agacauggaguucucauuu

SEQ ID NO: 543749 - RNA, 19 nt, Homo sapiens
ggagguggucuaugagaaa

SEQ ID NO: 543750 - RNA, 19 nt, Homo sapiens
cgaucuagccuuuccagua

SEQ ID NO: 543751 - RNA, 19 nt, Homo sapiens
guacuagcucuguuuauau

SEQ ID NO: 543752 - RNA, 19 nt, Homo sapiens
caagaccuaugaagaacug

SEQ ID NO: 543753 - RNA, 19 nt, Homo sapiens
gagcgugggauaagcagua

SEQ ID NO: 543754 - RNA, 19 nt, Homo sapiens
ucccauauauuaacccaaa

SEQ ID NO: 543755 - RNA, 19 nt, Homo sapiens
gugauaagcuucucaaacc

SEQ ID NO: 543756 - RNA, 19 nt, Homo sapiens
ccaaagugcugggauuaca

SEQ ID NO: 543757 - RNA, 19 nt, Homo sapiens
cauugaagcccaugagaaa

SEQ ID NO: 543758 - RNA, 19 nt, Homo sapiens
gguuaaaacuaccugguua

SEQ ID NO: 543759 - RNA, 19 nt, Homo sapiens
uaaaggacaaagcaguaua

SEQ ID NO: 543760 - RNA, 19 nt, Homo sapiens
agucuuauguggugguuaa

SEQ ID NO: 543761 - RNA, 19 nt, Homo sapiens
gaucgagaccauccuguga

SEQ ID NO: 543762 - RNA, 19 nt, Homo sapiens
gagccaagcgugaaugugu

SEQ ID NO: 543763 - RNA, 19 nt, Homo sapiens
gagaggagccacagagaca

SEQ ID NO: 543764 - RNA, 19 nt, Homo sapiens
gcaguauauugguaguuau

SEQ ID NO: 543765 - RNA, 19 nt, Homo sapiens
ggucucucguuuaauugua

SEQ ID NO: 543766 - RNA, 19 nt, Homo sapiens
aaggauacaugcagaagga

SEQ ID NO: 543767 - RNA, 19 nt, Homo sapiens
gguguagugugcaaguauu

SEQ ID NO: 543768 - RNA, 19 nt, Homo sapiens
gugccuauguucucuccua

SEQ ID NO: 543769 - RNA, 19 nt, Homo sapiens
ggcgacagcuggacuaaac

SEQ ID NO: 543770 - RNA, 19 nt, Homo sapiens
ugagguuucugguuaaauc

SEQ ID NO: 543771 - RNA, 19 nt, Homo sapiens
ggacuacaggugcaugcua

SEQ ID NO: 543772 - RNA, 19 nt, Homo sapiens
ccacuucugggaauucuuu

SEQ ID NO: 543773 - RNA, 19 nt, Homo sapiens
gugggaacaucaagcagaa

SEQ ID NO: 543774 - RNA, 19 nt, Homo sapiens
gcauugaagcccaugagaa

SEQ ID NO: 543775 - RNA, 19 nt, Homo sapiens
agcaguauauugguaguua

SEQ ID NO: 543776 - RNA, 19 nt, Homo sapiens
uuuggucucucguuuaauu

SEQ ID NO: 543777 - RNA, 19 nt, Homo sapiens
uacaaugcccagcuaauuu

SEQ ID NO: 543778 - RNA, 19 nt, Homo sapiens
ggaaccacuucugggaauu

SEQ ID NO: 543779 - RNA, 19 nt, Homo sapiens
aaacaggucacuuguagau

SEQ ID NO: 543780 - RNA, 19 nt, Homo sapiens
caauauagcaguacuagcu

SEQ ID NO: 543781 - RNA, 19 nt, Homo sapiens
gcgaaacccugucucuacu

SEQ ID NO: 543782 - RNA, 19 nt, Homo sapiens
uccuugagguuucugguua

SEQ ID NO: 543783 - RNA, 19 nt, Homo sapiens
ggaccuaagcuggccagua

SEQ ID NO: 543784 - RNA, 19 nt, Homo sapiens
ggacaguuaguuuagaugu

SEQ ID NO: 543785 - RNA, 19 nt, Homo sapiens
cuacaaugcccagcuaauu

SEQ ID NO: 543786 - RNA, 19 nt, Homo sapiens
gagauguugcuuaugcuuu

SEQ ID NO: 543787 - RNA, 19 nt, Homo sapiens
uaaggaaggagauaacugu

SEQ ID NO: 543788 - RNA, 19 nt, Homo sapiens
gaucuuaaaggacaaagca

SEQ ID NO: 543789 - RNA, 19 nt, Homo sapiens
uguguugcaucaucuguuu

SEQ ID NO: 543790 - RNA, 19 nt, Homo sapiens
guacagugccuuacuugca

SEQ ID NO: 543791 - RNA, 19 nt, Homo sapiens
aaaccuuuguccucauuug

SEQ ID NO: 543792 - RNA, 19 nt, Homo sapiens
guauaggcacuuccugaaa

SEQ ID NO: 543793 - RNA, 19 nt, Homo sapiens
gcacacaagaccuaugaag

SEQ ID NO: 543794 - RNA, 19 nt, Homo sapiens
ugggugagauguugcuuau

SEQ ID NO: 543795 - RNA, 19 nt, Homo sapiens
gaaauacaaggaggcaaug

SEQ ID NO: 543796 - RNA, 19 nt, Homo sapiens
agagcuaacuacaaaguca

SEQ ID NO: 543797 - RNA, 19 nt, Homo sapiens
gguaaagccuucaguaaua

SEQ ID NO: 543798 - RNA, 19 nt, Homo sapiens
caaguggaauucuuaguua

SEQ ID NO: 543799 - RNA, 19 nt, Homo sapiens
ugaaagaccuuaugagugu

SEQ ID NO: 543800 - RNA, 19 nt, Homo sapiens
ugaaagaucuacacuuguu

SEQ ID NO: 543801 - RNA, 19 nt, Homo sapiens
gaagugguaucucauuaug

SEQ ID NO: 543802 - RNA, 19 nt, Homo sapiens
gcucacagcuccacucuca

SEQ ID NO: 543803 - RNA, 19 nt, Homo sapiens
gaaguggucuuugugagaa

SEQ ID NO: 543804 - RNA, 19 nt, Homo sapiens
gggagagccuuuagcagua

SEQ ID NO: 543805 - RNA, 19 nt, Homo sapiens
gagaaaggccuuacgaaug

SEQ ID NO: 543806 - RNA, 19 nt, Homo sapiens
ggagaaagaccguaugaau

SEQ ID NO: 543807 - RNA, 19 nt, Homo sapiens
uaacagaucacaccucauu

SEQ ID NO: 543808 - RNA, 19 nt, Homo sapiens
gggaaagccuucaguaaca

SEQ ID NO: 543809 - RNA, 19 nt, Homo sapiens
ggagaaacccuacacaugu

SEQ ID NO: 543810 - RNA, 19 nt, Homo sapiens
gaacacagucugaggagaa

SEQ ID NO: 543811 - RNA, 19 nt, Homo sapiens
agaaaucaauccuugguaa

SEQ ID NO: 543812 - RNA, 19 nt, Homo sapiens
gaagagauaccauuuacau

SEQ ID NO: 543813 - RNA, 19 nt, Homo sapiens
gggaaauucuuuagccaaa

SEQ ID NO: 543814 - RNA, 19 nt, Homo sapiens
gugaagugguaucucauua

SEQ ID NO: 543815 - RNA, 19 nt, Homo sapiens
ggugaggucucccuuauuc

SEQ ID NO: 543816 - RNA, 19 nt, Homo sapiens
gaaaggacuuaugagugua

SEQ ID NO: 543817 - RNA, 19 nt, Homo sapiens
agaaaggacuuaugagugu

SEQ ID NO: 543818 - RNA, 19 nt, Homo sapiens
gaugugaagugguaucuca

SEQ ID NO: 543819 - RNA, 19 nt, Homo sapiens
gagaaaagccuuauaaaug

SEQ ID NO: 543820 - RNA, 19 nt, Homo sapiens
gaaaguucauacuggagaa

SEQ ID NO: 543821 - RNA, 19 nt, Homo sapiens
gagaaagaccguaugaaug

SEQ ID NO: 543822 - RNA, 19 nt, Homo sapiens
gagaaacccuacacaugug

SEQ ID NO: 543823 - RNA, 19 nt, Homo sapiens
ggagagccuuuagcaguaa

SEQ ID NO: 543824 - RNA, 19 nt, Homo sapiens
ggacagggacgcacuuaug

SEQ ID NO: 543825 - RNA, 19 nt, Homo sapiens
ggagaaaggccuuacgaau

SEQ ID NO: 543826 - RNA, 19 nt, Homo sapiens
ccgaagcucugcucucauu

SEQ ID NO: 543827 - RNA, 19 nt, Homo sapiens
gcagauccuuccaccaaga

SEQ ID NO: 543828 - RNA, 19 nt, Homo sapiens
gaagccauauuccaaucuu

SEQ ID NO: 543829 - RNA, 19 nt, Homo sapiens
aaaauuaccuccaugcuuu

SEQ ID NO: 543830 - RNA, 19 nt, Homo sapiens
ggaagagcuuuuaacaaua

SEQ ID NO: 543831 - RNA, 19 nt, Homo sapiens
ugaggaagcaccagaaauu

SEQ ID NO: 543832 - RNA, 19 nt, Homo sapiens
ccagagaaaggacuuauga

SEQ ID NO: 543833 - RNA, 19 nt, Homo sapiens
ucagagaguucacacacaa

SEQ ID NO: 543834 - RNA, 19 nt, Homo sapiens
ggaagcaccagaaauuuca

SEQ ID NO: 543835 - RNA, 19 nt, Homo sapiens
uaaggaugcugaacuucuu

SEQ ID NO: 543836 - RNA, 19 nt, Homo sapiens
caagaaaggcccuaugagu

SEQ ID NO: 543837 - RNA, 19 nt, Homo sapiens
guaaagccuucaguaauag

SEQ ID NO: 543838 - RNA, 19 nt, Homo sapiens
caucuaagcugaggaagca

SEQ ID NO: 543839 - RNA, 19 nt, Homo sapiens
ggugugaauuccuggguaa

SEQ ID NO: 543840 - RNA, 19 nt, Homo sapiens
ggaaguggucuuugugaga

SEQ ID NO: 543841 - RNA, 19 nt, Homo sapiens
ucacauuuguucaucauca

SEQ ID NO: 543842 - RNA, 19 nt, Homo sapiens
agaaaggccuuacgaaugc

SEQ ID NO: 543843 - RNA, 19 nt, Homo sapiens
gaaaguucacacacaggua

SEQ ID NO: 543844 - RNA, 19 nt, Homo sapiens
gggaagcccuuuagauggu

SEQ ID NO: 543845 - RNA, 19 nt, Homo sapiens
ggaaauucuuuagccgaaa

SEQ ID NO: 543846 - RNA, 19 nt, Homo sapiens
gaggaagcaccagaaauuu

SEQ ID NO: 543847 - RNA, 19 nt, Homo sapiens
ucauacuccucauguuuaa

SEQ ID NO: 543848 - RNA, 19 nt, Homo sapiens
gggaaggccuuuagucacu

SEQ ID NO: 543849 - RNA, 19 nt, Homo sapiens
gaaaucaauccuugguaau

SEQ ID NO: 543850 - RNA, 19 nt, Homo sapiens
ggaagcccuuuagauggua

SEQ ID NO: 543851 - RNA, 19 nt, Homo sapiens
aaagcuaacuccugugaca

SEQ ID NO: 543852 - RNA, 19 nt, Homo sapiens
ccaaguggaauucuuaguu

SEQ ID NO: 543853 - RNA, 19 nt, Homo sapiens
uaaguccuuugacccauuu

SEQ ID NO: 543854 - RNA, 19 nt, Homo sapiens
gggcaaaggccuuaugagu

SEQ ID NO: 543855 - RNA, 19 nt, Homo sapiens
ggaaauaccccaugugugu

SEQ ID NO: 543856 - RNA, 19 nt, Homo sapiens
aaagaaaggccuuaugagu

SEQ ID NO: 543857 - RNA, 19 nt, Homo sapiens
cagcuccacucucauugaa

SEQ ID NO: 543858 - RNA, 19 nt, Homo sapiens
gcagaagccauauuccaau

SEQ ID NO: 543859 - RNA, 19 nt, Homo sapiens
uaacuccugugacaugugu

SEQ ID NO: 543860 - RNA, 19 nt, Homo sapiens
uuaguuaacuggcauuucu

SEQ ID NO: 543861 - RNA, 19 nt, Homo sapiens
caaacuucaugcagcagaa

SEQ ID NO: 543862 - RNA, 19 nt, Homo sapiens
gaaauucuuuagccgaaaa

SEQ ID NO: 543863 - RNA, 19 nt, Homo sapiens
gcuccacucucauugaaca

SEQ ID NO: 543864 - RNA, 19 nt, Homo sapiens
ccaaagcucccaucuccuu

SEQ ID NO: 543865 - RNA, 19 nt, Homo sapiens
ggugaaagaccuuaugagu

SEQ ID NO: 543866 - RNA, 19 nt, Homo sapiens
guuuaaggaugcugaacuu

SEQ ID NO: 543867 - RNA, 19 nt, Homo sapiens
gagaaaucaauccuuggua

SEQ ID NO: 543868 - RNA, 19 nt, Homo sapiens
gacagggacgcacuuauga

SEQ ID NO: 543869 - RNA, 19 nt, Homo sapiens
uaguggaugugaaguggua

SEQ ID NO: 543870 - RNA, 19 nt, Homo sapiens
gaaugugggagagccuuua

SEQ ID NO: 543871 - RNA, 19 nt, Homo sapiens
caaaagaaaggccuuauga

SEQ ID NO: 543872 - RNA, 19 nt, Homo sapiens
ucacagcuccacucucauu

SEQ ID NO: 543873 - RNA, 19 nt, Homo sapiens
caaccacaaacucacauuu

SEQ ID NO: 543874 - RNA, 19 nt, Homo sapiens
uggaagagcuuuuaacaau

SEQ ID NO: 543875 - RNA, 19 nt, Homo sapiens
cccaacagguggaaauuuc

SEQ ID NO: 543876 - RNA, 19 nt, Homo sapiens
ccuuauaaaugcagugaau

SEQ ID NO: 543877 - RNA, 19 nt, Homo sapiens
ggagaaaagccuuauaaau

SEQ ID NO: 543878 - RNA, 19 nt, Homo sapiens
gaaagaccguaugaaugca

SEQ ID NO: 543879 - RNA, 19 nt, Homo sapiens
gcacuuaugaagagcucua

SEQ ID NO: 543880 - RNA, 19 nt, Homo sapiens
gaauuccuggguaacauuu

SEQ ID NO: 543881 - RNA, 19 nt, Homo sapiens
gaaaguucacaccagagaa

SEQ ID NO: 543882 - RNA, 19 nt, Homo sapiens
gugguaaagccuucaguaa

SEQ ID NO: 543883 - RNA, 19 nt, Homo sapiens
gaaaguucacacuggagaa

SEQ ID NO: 543884 - RNA, 19 nt, Homo sapiens
ccaaagcuccaauuuccuu

SEQ ID NO: 543885 - RNA, 19 nt, Homo sapiens
gaaaguucacacuggagaa

SEQ ID NO: 543886 - RNA, 19 nt, Homo sapiens
uggcauuucucuacuuuca

SEQ ID NO: 543887 - RNA, 19 nt, Homo sapiens
cacaagaaaggcccuauga

SEQ ID NO: 543888 - RNA, 19 nt, Homo sapiens
gaaggccuuuagucacuca

SEQ ID NO: 543889 - RNA, 19 nt, Homo sapiens
gggacgcacuuaugaagag

SEQ ID NO: 543890 - RNA, 19 nt, Homo sapiens
auaccugaguggagccuua

SEQ ID NO: 543891 - RNA, 19 nt, Homo sapiens
gcucagcaccagaaaguuc

SEQ ID NO: 543892 - RNA, 19 nt, Homo sapiens
gaagcucugcucucauuca

SEQ ID NO: 543893 - RNA, 19 nt, Homo sapiens
aaaguucacacacagguaa

SEQ ID NO: 543894 - RNA, 19 nt, Homo sapiens
ccaauuuccuucggcauca

SEQ ID NO: 543895 - RNA, 19 nt, Homo sapiens
ggagaaaucaauccuuggu

SEQ ID NO: 543896 - RNA, 19 nt, Homo sapiens
cagaagccauauuccaauc

SEQ ID NO: 543897 - RNA, 19 nt, Homo sapiens
ggacugggcuuuggcaaua

SEQ ID NO: 543898 - RNA, 19 nt, Homo sapiens
gaagucagcugucgugaga

SEQ ID NO: 543899 - RNA, 19 nt, Homo sapiens
gaaauggaguagagaaaug

SEQ ID NO: 543900 - RNA, 19 nt, Homo sapiens
gaagucaacgcuaaucaua

SEQ ID NO: 543901 - RNA, 19 nt, Homo sapiens
ggauagaagucuuaggauu

SEQ ID NO: 543902 - RNA, 19 nt, Homo sapiens
aaacuuggcuucuuuauac

SEQ ID NO: 543903 - RNA, 19 nt, Homo sapiens
gaagucaaaccucaucaua

SEQ ID NO: 543904 - RNA, 19 nt, Homo sapiens
gauagaagucuuaggauuu

SEQ ID NO: 543905 - RNA, 19 nt, Homo sapiens
gagaguaacgucacaguaa

SEQ ID NO: 543906 - RNA, 19 nt, Homo sapiens
ggccaaggcuuucuccaaa

SEQ ID NO: 543907 - RNA, 19 nt, Homo sapiens
caacagacaccagaacaua

SEQ ID NO: 543908 - RNA, 19 nt, Homo sapiens
gcgcugaucuaccuucuga

SEQ ID NO: 543909 - RNA, 19 nt, Homo sapiens
guaauaaacuuggcuucuu

SEQ ID NO: 543910 - RNA, 19 nt, Homo sapiens
ggacacacuuggaggagaa

SEQ ID NO: 543911 - RNA, 19 nt, Homo sapiens
gaagagaagccuugugugu

SEQ ID NO: 543912 - RNA, 19 nt, Homo sapiens
gggcgaggcuuuagucuca

SEQ ID NO: 543913 - RNA, 19 nt, Homo sapiens
ggcaauaagucagcucuaa

SEQ ID NO: 543914 - RNA, 19 nt, Homo sapiens
ggaaagagaccuggagaga

SEQ ID NO: 543915 - RNA, 19 nt, Homo sapiens
gaaaugcauucuguaagug

SEQ ID NO: 543916 - RNA, 19 nt, Homo sapiens
gucuaaggcuggaaguuua

SEQ ID NO: 543917 - RNA, 19 nt, Homo sapiens
gagaauaggaugcaaagau

SEQ ID NO: 543918 - RNA, 19 nt, Homo sapiens
ggccuucgguuguaauaaa

SEQ ID NO: 543919 - RNA, 19 nt, Homo sapiens
gggagaagccguauguuug

SEQ ID NO: 543920 - RNA, 19 nt, Homo sapiens
caaaggagaagcccuaugu

SEQ ID NO: 543921 - RNA, 19 nt, Homo sapiens
agaauaggaugcaaagaug

SEQ ID NO: 543922 - RNA, 19 nt, Homo sapiens
caccucaccuuacaucaaa

SEQ ID NO: 543923 - RNA, 19 nt, Homo sapiens
aaaggacauuugacuguuu

SEQ ID NO: 543924 - RNA, 19 nt, Homo sapiens
ggagagaagcccauugugu

SEQ ID NO: 543925 - RNA, 19 nt, Homo sapiens
gaggauagaagucuuagga

SEQ ID NO: 543926 - RNA, 19 nt, Homo sapiens
gagaggugaugcuggagaa

SEQ ID NO: 543927 - RNA, 19 nt, Homo sapiens
ggauguggcuguggauuuc

SEQ ID NO: 543928 - RNA, 19 nt, Homo sapiens
ggagaagcccuacgugugu

SEQ ID NO: 543929 - RNA, 19 nt, Homo sapiens
ugaggaaacagacaaauug

SEQ ID NO: 543930 - RNA, 19 nt, Homo sapiens
gggagaagcccuacaugug

SEQ ID NO: 543931 - RNA, 19 nt, Homo sapiens
ggagaagccguauguuugu

SEQ ID NO: 543932 - RNA, 19 nt, Homo sapiens
ggaccacccuugucaacca

SEQ ID NO: 543933 - RNA, 19 nt, Homo sapiens
agucaaaccucaucauaca

SEQ ID NO: 543934 - RNA, 19 nt, Homo sapiens
aaggacauuugacuguuua

SEQ ID NO: 543935 - RNA, 19 nt, Homo sapiens
ugagauaucauccuucuuc

SEQ ID NO: 543936 - RNA, 19 nt, Homo sapiens
gggagacccuggagugauc

SEQ ID NO: 543937 - RNA, 19 nt, Homo sapiens
gcaauaagucagcucuaau

SEQ ID NO: 543938 - RNA, 19 nt, Homo sapiens
gagauaucauccuucuuca

SEQ ID NO: 543939 - RNA, 19 nt, Homo sapiens
gaauaggaugcaaagauga

SEQ ID NO: 543940 - RNA, 19 nt, Homo sapiens
uaacgucacaguaauggaa

SEQ ID NO: 543941 - RNA, 19 nt, Homo sapiens
aaagucacaccucaccuua

SEQ ID NO: 543942 - RNA, 19 nt, Homo sapiens
caccuuacaucaaaugaca

SEQ ID NO: 543943 - RNA, 19 nt, Homo sapiens
gaauucaacccucaucucu

SEQ ID NO: 543944 - RNA, 19 nt, Homo sapiens
ggugagaaaccuuacaugu

SEQ ID NO: 543945 - RNA, 19 nt, Homo sapiens
auagaagucuuaggauuug

SEQ ID NO: 543946 - RNA, 19 nt, Homo sapiens
ucagaauguugacacuuug

SEQ ID NO: 543947 - RNA, 19 nt, Homo sapiens
gcaauccaaccucaucaga

SEQ ID NO: 543948 - RNA, 19 nt, Homo sapiens
gaacgggaagauucuggaa

SEQ ID NO: 543949 - RNA, 19 nt, Homo sapiens
ggacacacucaaaggagaa

SEQ ID NO: 543950 - RNA, 19 nt, Homo sapiens
gaugaaauggaguagagaa

SEQ ID NO: 543951 - RNA, 19 nt, Homo sapiens
gcaaccuucggauuccuua

SEQ ID NO: 543952 - RNA, 19 nt, Homo sapiens
gcuuuagucucaagucaca

SEQ ID NO: 543953 - RNA, 19 nt, Homo sapiens
aaccggaagucaacgcuaa

SEQ ID NO: 543954 - RNA, 19 nt, Homo sapiens
gggauguggcuguggauuu

SEQ ID NO: 543955 - RNA, 19 nt, Homo sapiens
ccaccuagacaacgauuau

SEQ ID NO: 543956 - RNA, 19 nt, Homo sapiens
gaagucaaaccuuguugca

SEQ ID NO: 543957 - RNA, 19 nt, Homo sapiens
gugagaaaccuuacaugug

SEQ ID NO: 543958 - RNA, 19 nt, Homo sapiens
agucaacgcuaaucauaca

SEQ ID NO: 543959 - RNA, 19 nt, Homo sapiens
agaagagccucgccagaca

SEQ ID NO: 543960 - RNA, 19 nt, Homo sapiens
gaagccagcccagcucaga

SEQ ID NO: 543961 - RNA, 19 nt, Homo sapiens
uggaaguagugcuaagaaa

SEQ ID NO: 543962 - RNA, 19 nt, Homo sapiens
ggggaaugcuucaaaaguu

SEQ ID NO: 543963 - RNA, 19 nt, Homo sapiens
agaguaacgucacaguaau

SEQ ID NO: 543964 - RNA, 19 nt, Homo sapiens
aauccaaccucaucagaca

SEQ ID NO: 543965 - RNA, 19 nt, Homo sapiens
guugacacuuugaugaaau

SEQ ID NO: 543966 - RNA, 19 nt, Homo sapiens
gcagggcaaccuucggauu

SEQ ID NO: 543967 - RNA, 19 nt, Homo sapiens
caagucacaccucaacaga

SEQ ID NO: 543968 - RNA, 19 nt, Homo sapiens
gagaagccguauguuugug

SEQ ID NO: 543969 - RNA, 19 nt, Homo sapiens
ggacugaguggccaagaag

SEQ ID NO: 543970 - RNA, 19 nt, Homo sapiens
cacuaagucuucuccaugu

SEQ ID NO: 543971 - RNA, 19 nt, Homo sapiens
gacauuugacuguuuacuu

SEQ ID NO: 543972 - RNA, 19 nt, Homo sapiens
gacacacuccggugagaaa

SEQ ID NO: 543973 - RNA, 19 nt, Homo sapiens
ggaagucaacgcuaaucau

SEQ ID NO: 543974 - RNA, 19 nt, Homo sapiens
gcucaaaggacucuguaca

SEQ ID NO: 543975 - RNA, 19 nt, Homo sapiens
ggaaguagugcuaagaaaa

SEQ ID NO: 543976 - RNA, 19 nt, Homo sapiens
cuaagucuucuccauguuu

SEQ ID NO: 543977 - RNA, 19 nt, Homo sapiens
guaauggaacgggaagauu

SEQ ID NO: 543978 - RNA, 19 nt, Homo sapiens
uaauggaacgggaagauuc

SEQ ID NO: 543979 - RNA, 19 nt, Homo sapiens
agucacaccucaacagaca

SEQ ID NO: 543980 - RNA, 19 nt, Homo sapiens
gaacuguuuucuacauuuc

SEQ ID NO: 543981 - RNA, 19 nt, Homo sapiens
gaauguugacacuuugaug

SEQ ID NO: 543982 - RNA, 19 nt, Homo sapiens
cuaagagucagaauguuga

SEQ ID NO: 543983 - RNA, 19 nt, Homo sapiens
agucacaccucaccuuaca

SEQ ID NO: 543984 - RNA, 19 nt, Homo sapiens
auucaacccucaucucuca

SEQ ID NO: 543985 - RNA, 19 nt, Homo sapiens
gcugaucuaccuucugaga

SEQ ID NO: 543986 - RNA, 19 nt, Homo sapiens
cuucugagauaucauccuu

SEQ ID NO: 543987 - RNA, 19 nt, Homo sapiens
gccaugccuuuguuuggaa

SEQ ID NO: 543988 - RNA, 19 nt, Homo sapiens
gcacagcuucagccagaau

SEQ ID NO: 543989 - RNA, 19 nt, Homo sapiens
caugugcuguguaaucauc

SEQ ID NO: 543990 - RNA, 19 nt, Homo sapiens
gaguguggacgaggcuuua

SEQ ID NO: 543991 - RNA, 19 nt, Homo sapiens
ggaguguggacgaggcuuu

SEQ ID NO: 543992 - RNA, 19 nt, Homo sapiens
gaaguagugcuaagaaaau

SEQ ID NO: 543993 - RNA, 19 nt, Homo sapiens
uuuacuuucuccacacuaa

SEQ ID NO: 543994 - RNA, 19 nt, Homo sapiens
gcuucagccucaagucuca

SEQ ID NO: 543995 - RNA, 19 nt, Homo sapiens
cagaggaccacccuuguca

SEQ ID NO: 543996 - RNA, 19 nt, Homo sapiens
ggacacacuccggugagaa

SEQ ID NO: 543997 - RNA, 19 nt, Homo sapiens
gaacagagcauuucuauag

SEQ ID NO: 543998 - RNA, 19 nt, Homo sapiens
caacaggacucaucaauca

SEQ ID NO: 543999 - RNA, 19 nt, Homo sapiens
gagaagcccuuuacgugua

SEQ ID NO: 544000 - RNA, 19 nt, Homo sapiens
gaaaguacuugccucaugu

SEQ ID NO: 544001 - RNA, 19 nt, Homo sapiens
ggaaaguacuugccucaug

SEQ ID NO: 544002 - RNA, 19 nt, Homo sapiens
gaaaccaucuuaacucuac

SEQ ID NO: 544003 - RNA, 19 nt, Homo sapiens
gagaaaggccuuaugaaug

SEQ ID NO: 544004 - RNA, 19 nt, Homo sapiens
ccagaaguguuacaguaua

SEQ ID NO: 544005 - RNA, 19 nt, Homo sapiens
caaauacacccucauuaaa

SEQ ID NO: 544006 - RNA, 19 nt, Homo sapiens
gagcaaggccuuauaagug

SEQ ID NO: 544007 - RNA, 19 nt, Homo sapiens
ggagaaaggccuuaugaau

SEQ ID NO: 544008 - RNA, 19 nt, Homo sapiens
gggaaauucuuuagucgaa

SEQ ID NO: 544009 - RNA, 19 nt, Homo sapiens
gaacaaaugcauuacaagu

SEQ ID NO: 544010 - RNA, 19 nt, Homo sapiens
gaaggcaggguuuguauug

SEQ ID NO: 544011 - RNA, 19 nt, Homo sapiens
gggaaggccuacagcuuaa

SEQ ID NO: 544012 - RNA, 19 nt, Homo sapiens
acaaauacacccucauuaa

SEQ ID NO: 544013 - RNA, 19 nt, Homo sapiens
agacacaaaucuacacuug

SEQ ID NO: 544014 - RNA, 19 nt, Homo sapiens
gagaaaugccuuauaagug

SEQ ID NO: 544015 - RNA, 19 nt, Homo sapiens
ggagaaaugccuuauaagu

SEQ ID NO: 544016 - RNA, 19 nt, Homo sapiens
uaccagaaguguuacagua

SEQ ID NO: 544017 - RNA, 19 nt, Homo sapiens
cuggagaaaugccuuauaa

SEQ ID NO: 544018 - RNA, 19 nt, Homo sapiens
ggagaaaggccauaugagu

SEQ ID NO: 544019 - RNA, 19 nt, Homo sapiens
ggcaugaagugaaggauga

SEQ ID NO: 544020 - RNA, 19 nt, Homo sapiens
ccagagaguucacaaugga

SEQ ID NO: 544021 - RNA, 19 nt, Homo sapiens
caaugaaugugggaaauau

SEQ ID NO: 544022 - RNA, 19 nt, Homo sapiens
gcaaugaaugugggaaaua

SEQ ID NO: 544023 - RNA, 19 nt, Homo sapiens
gcucugguuugugauaaua

SEQ ID NO: 544024 - RNA, 19 nt, Homo sapiens
gaaauucuuuagucgaagu

SEQ ID NO: 544025 - RNA, 19 nt, Homo sapiens
gugaacaaaugcauuacaa

SEQ ID NO: 544026 - RNA, 19 nt, Homo sapiens
agacggcucucccuuguga

SEQ ID NO: 544027 - RNA, 19 nt, Homo sapiens
gaauucacacugagucaaa

SEQ ID NO: 544028 - RNA, 19 nt, Homo sapiens
agaaaggccuuaugaaugc

SEQ ID NO: 544029 - RNA, 19 nt, Homo sapiens
ccacaaauacacccucauu

SEQ ID NO: 544030 - RNA, 19 nt, Homo sapiens
ucgaaguucugacuauauu

SEQ ID NO: 544031 - RNA, 19 nt, Homo sapiens
gauccucugugguuguuga

SEQ ID NO: 544032 - RNA, 19 nt, Homo sapiens
ggagagaagccuuaugagu

SEQ ID NO: 544033 - RNA, 19 nt, Homo sapiens
agccaucacuccaaucuaa

SEQ ID NO: 544034 - RNA, 19 nt, Homo sapiens
ggaaauccuuuggccacaa

SEQ ID NO: 544035 - RNA, 19 nt, Homo sapiens
ccuuauaagugcagugauu

SEQ ID NO: 544036 - RNA, 19 nt, Homo sapiens
ggagcaaggccuuauaagu

SEQ ID NO: 544037 - RNA, 19 nt, Homo sapiens
ccgcaaagcuacacuuguc

SEQ ID NO: 544038 - RNA, 19 nt, Homo sapiens
caguauagagcaacccuua

SEQ ID NO: 544039 - RNA, 19 nt, Homo sapiens
gaauacaacaggacucauc

SEQ ID NO: 544040 - RNA, 19 nt, Homo sapiens
gugcagugauugugggaaa

SEQ ID NO: 544041 - RNA, 19 nt, Homo sapiens
ugucacauguuaauacuuc

SEQ ID NO: 544042 - RNA, 19 nt, Homo sapiens
uguaucugcugguggcuua

SEQ ID NO: 544043 - RNA, 19 nt, Homo sapiens
ugggaaggccuacagcuua

SEQ ID NO: 544044 - RNA, 19 nt, Homo sapiens
cauuaaacaucagcgaauu

SEQ ID NO: 544045 - RNA, 19 nt, Homo sapiens
guggagagaagccuuauga

SEQ ID NO: 544046 - RNA, 19 nt, Homo sapiens
caagagggucugagcugua

SEQ ID NO: 544047 - RNA, 19 nt, Homo sapiens
guacuugccucauguugcu

SEQ ID NO: 544048 - RNA, 19 nt, Homo sapiens
gcugguggcuuauacaaaa

SEQ ID NO: 544049 - RNA, 19 nt, Homo sapiens
ccauaugagugcagugaau

SEQ ID NO: 544050 - RNA, 19 nt, Homo sapiens
cacaaauacacccucauua

SEQ ID NO: 544051 - RNA, 19 nt, Homo sapiens
gaaugcagcgaauguggaa

SEQ ID NO: 544052 - RNA, 19 nt, Homo sapiens
gggagacaauucugguuca

SEQ ID NO: 544053 - RNA, 19 nt, Homo sapiens
caccuggccugggaaagua

SEQ ID NO: 544054 - RNA, 19 nt, Homo sapiens
ccucugugguuguugaauu

SEQ ID NO: 544055 - RNA, 19 nt, Homo sapiens
ggaaauauuuuagccauca

SEQ ID NO: 544056 - RNA, 19 nt, Homo sapiens
gaaaagacaaccuuacuca

SEQ ID NO: 544057 - RNA, 19 nt, Homo sapiens
auagcagugucacauguua

SEQ ID NO: 544058 - RNA, 19 nt, Homo sapiens
ggaaggcaggguuuguauu

SEQ ID NO: 544059 - RNA, 19 nt, Homo sapiens
cuagggauauguugcacuu

SEQ ID NO: 544060 - RNA, 19 nt, Homo sapiens
ccuuauaagugcaaugaau

SEQ ID NO: 544061 - RNA, 19 nt, Homo sapiens
uaucagaaccucccaccuu

SEQ ID NO: 544062 - RNA, 19 nt, Homo sapiens
gaacucuggcugccugaga

SEQ ID NO: 544063 - RNA, 19 nt, Homo sapiens
cuacacuuguucagcauga

SEQ ID NO: 544064 - RNA, 19 nt, Homo sapiens
agugcaaccuucaucagua

SEQ ID NO: 544065 - RNA, 19 nt, Homo sapiens
aauacacccucauuaaaca

SEQ ID NO: 544066 - RNA, 19 nt, Homo sapiens
caucagagaauccauacug

SEQ ID NO: 544067 - RNA, 19 nt, Homo sapiens
cagaaguguuacaguauag

SEQ ID NO: 544068 - RNA, 19 nt, Homo sapiens
ggagugcuuugaauacaac

SEQ ID NO: 544069 - RNA, 19 nt, Homo sapiens
guaaaugugggaaagacuu

SEQ ID NO: 544070 - RNA, 19 nt, Homo sapiens
cagcaucagagaauccaua

SEQ ID NO: 544071 - RNA, 19 nt, Homo sapiens
ggcucucccuugugacaua

SEQ ID NO: 544072 - RNA, 19 nt, Homo sapiens
gaaccucauccgucagaga

SEQ ID NO: 544073 - RNA, 19 nt, Homo sapiens
ggucucacauacuuguaau

SEQ ID NO: 544074 - RNA, 19 nt, Homo sapiens
agaguuaugucacugucaa

SEQ ID NO: 544075 - RNA, 19 nt, Homo sapiens
aaacaucagcgaauucaca

SEQ ID NO: 544076 - RNA, 19 nt, Homo sapiens
caccagagaauucauagug

SEQ ID NO: 544077 - RNA, 19 nt, Homo sapiens
cauuacaagugcagugaau

SEQ ID NO: 544078 - RNA, 19 nt, Homo sapiens
aaaaggccauccacaguaa

SEQ ID NO: 544079 - RNA, 19 nt, Homo sapiens
uaugacagguauagguaug

SEQ ID NO: 544080 - RNA, 19 nt, Homo sapiens
ccgaaaccaucuuaacucu

SEQ ID NO: 544081 - RNA, 19 nt, Homo sapiens
gcagugucacauguuaaua

SEQ ID NO: 544082 - RNA, 19 nt, Homo sapiens
acagacggcucucccuugu

SEQ ID NO: 544083 - RNA, 19 nt, Homo sapiens
ucuuaacucuaccagcuaa

SEQ ID NO: 544084 - RNA, 19 nt, Homo sapiens
caccagagaguucacaaug

SEQ ID NO: 544085 - RNA, 19 nt, Homo sapiens
agugaaggaugaagaguca

SEQ ID NO: 544086 - RNA, 19 nt, Homo sapiens
cagcaccagagaauucaua

SEQ ID NO: 544087 - RNA, 19 nt, Homo sapiens
caaaaggccauccacagua

SEQ ID NO: 544088 - RNA, 19 nt, Homo sapiens
ggauauucuuggucucaca

SEQ ID NO: 544089 - RNA, 19 nt, Homo sapiens
cuauagcagugucacaugu

SEQ ID NO: 544090 - RNA, 19 nt, Homo sapiens
cugcacaguuagcaaagaa

SEQ ID NO: 544091 - RNA, 19 nt, Homo sapiens
gggaaggcaggguuuguau

SEQ ID NO: 544092 - RNA, 19 nt, Homo sapiens
gauauguugcacuuucuga

SEQ ID NO: 544093 - RNA, 19 nt, Homo sapiens
ugugguuguugaauuguaa

SEQ ID NO: 544094 - RNA, 19 nt, Homo sapiens
gaaaggccuuaugaaugca

SEQ ID NO: 544095 - RNA, 19 nt, Homo sapiens
guauagagcaacccuuaag

SEQ ID NO: 544096 - RNA, 19 nt, Homo sapiens
caccauggacugaaacuuc

SEQ ID NO: 544097 - RNA, 19 nt, Homo sapiens
gaagucagauuugccauua

SEQ ID NO: 544098 - RNA, 19 nt, Homo sapiens
guaaacagcugucuugucu

SEQ ID NO: 544099 - RNA, 19 nt, Homo sapiens
gcacacaccucacccaaca

SEQ ID NO: 544100 - RNA, 19 nt, Homo sapiens
guuaaaccaucgucuuaua

SEQ ID NO: 544101 - RNA, 19 nt, Homo sapiens
caacaaaugccuuucauau

SEQ ID NO: 544102 - RNA, 19 nt, Homo sapiens
gggaaagucuuaugaaugg

SEQ ID NO: 544103 - RNA, 19 nt, Homo sapiens
gagaaacccuaugaaugua

SEQ ID NO: 544104 - RNA, 19 nt, Homo sapiens
gggaggaccuucaaccaaa

SEQ ID NO: 544105 - RNA, 19 nt, Homo sapiens
aaccagagauguucaaauu

SEQ ID NO: 544106 - RNA, 19 nt, Homo sapiens
ggacauaggaagaccuuaa

SEQ ID NO: 544107 - RNA, 19 nt, Homo sapiens
gggaaagccuucagucaga

SEQ ID NO: 544108 - RNA, 19 nt, Homo sapiens
ggagaaacccuaucagugu

SEQ ID NO: 544109 - RNA, 19 nt, Homo sapiens
cggaacagcucggcacuua

SEQ ID NO: 544110 - RNA, 19 nt, Homo sapiens
aggaagaccuuaagccaua

SEQ ID NO: 544111 - RNA, 19 nt, Homo sapiens
gcccauuagugcuauguua

SEQ ID NO: 544112 - RNA, 19 nt, Homo sapiens
gagagaaacccuaugaaug

SEQ ID NO: 544113 - RNA, 19 nt, Homo sapiens
ggagaaacccuauaaaugc

SEQ ID NO: 544114 - RNA, 19 nt, Homo sapiens
gcagaguguuccagaaaug

SEQ ID NO: 544115 - RNA, 19 nt, Homo sapiens
ccaaauugcuccacugauc

SEQ ID NO: 544116 - RNA, 19 nt, Homo sapiens
gggagaaacccuauaaaug

SEQ ID NO: 544117 - RNA, 19 nt, Homo sapiens
gcucagcacuuaucgaaca

SEQ ID NO: 544118 - RNA, 19 nt, Homo sapiens
agucacagcucagcacuua

SEQ ID NO: 544119 - RNA, 19 nt, Homo sapiens
gcagaacucgcguuagaaa

SEQ ID NO: 544120 - RNA, 19 nt, Homo sapiens
gaaucacuguggauacuga

SEQ ID NO: 544121 - RNA, 19 nt, Homo sapiens
ggagagaaacccuaugaau

SEQ ID NO: 544122 - RNA, 19 nt, Homo sapiens
gggagaagcccuaugaaug

SEQ ID NO: 544123 - RNA, 19 nt, Homo sapiens
gagaaacccuauaaaugca

SEQ ID NO: 544124 - RNA, 19 nt, Homo sapiens
cauagagucucacugauuc

SEQ ID NO: 544125 - RNA, 19 nt, Homo sapiens
ccagagauguucaaauugg

SEQ ID NO: 544126 - RNA, 19 nt, Homo sapiens
gggaaauccuucaguuuua

SEQ ID NO: 544127 - RNA, 19 nt, Homo sapiens
gcucggcacuuaccaaaca

SEQ ID NO: 544128 - RNA, 19 nt, Homo sapiens
gagaaacccuacaaauguc

SEQ ID NO: 544129 - RNA, 19 nt, Homo sapiens
gggagaagcccuacgaaug

SEQ ID NO: 544130 - RNA, 19 nt, Homo sapiens
ggaauuacauaugacaaag

SEQ ID NO: 544131 - RNA, 19 nt, Homo sapiens
gagcuacccuucucaucga

SEQ ID NO: 544132 - RNA, 19 nt, Homo sapiens
ggagaagccagaccuaaau

SEQ ID NO: 544133 - RNA, 19 nt, Homo sapiens
gagaccaaaugaagucaga

SEQ ID NO: 544134 - RNA, 19 nt, Homo sapiens
acccacagcuccucccuua

SEQ ID NO: 544135 - RNA, 19 nt, Homo sapiens
aguuaucccugcauuauuu

SEQ ID NO: 544136 - RNA, 19 nt, Homo sapiens
agagaaacccuaugaaugu

SEQ ID NO: 544137 - RNA, 19 nt, Homo sapiens
agagaaacccuacaaaugu

SEQ ID NO: 544138 - RNA, 19 nt, Homo sapiens
cugcagaacucgcguuaga

SEQ ID NO: 544139 - RNA, 19 nt, Homo sapiens
gugagaaacccaacaaaug

SEQ ID NO: 544140 - RNA, 19 nt, Homo sapiens
gaagccagaccuaaauguu

SEQ ID NO: 544141 - RNA, 19 nt, Homo sapiens
gugagaagcccuaugaaug

SEQ ID NO: 544142 - RNA, 19 nt, Homo sapiens
aaaugagaguggcaucuuu

SEQ ID NO: 544143 - RNA, 19 nt, Homo sapiens
gaaaugagaguggcaucuu

SEQ ID NO: 544144 - RNA, 19 nt, Homo sapiens
gaacgcccauuagugcuau

SEQ ID NO: 544145 - RNA, 19 nt, Homo sapiens
gauaaacccacuccacaug

SEQ ID NO: 544146 - RNA, 19 nt, Homo sapiens
gggagaagccagaccuaaa

SEQ ID NO: 544147 - RNA, 19 nt, Homo sapiens
gagaguggcaucuuuaugg

SEQ ID NO: 544148 - RNA, 19 nt, Homo sapiens
ggagaagcccuaugaaugc

SEQ ID NO: 544149 - RNA, 19 nt, Homo sapiens
gcucauccuugaccaaaca

SEQ ID NO: 544150 - RNA, 19 nt, Homo sapiens
ggaggaccuucaaccaaau

SEQ ID NO: 544151 - RNA, 19 nt, Homo sapiens
ccaccaagcucuaggucau

SEQ ID NO: 544152 - RNA, 19 nt, Homo sapiens
ggagagaagcccuaugagu

SEQ ID NO: 544153 - RNA, 19 nt, Homo sapiens
ggagagaagcccuauggau

SEQ ID NO: 544154 - RNA, 19 nt, Homo sapiens
caggagagaagcccuauga

SEQ ID NO: 544155 - RNA, 19 nt, Homo sapiens
gaaugucacgaaugcuuaa

SEQ ID NO: 544156 - RNA, 19 nt, Homo sapiens
aaagagaaacccuacaaau

SEQ ID NO: 544157 - RNA, 19 nt, Homo sapiens
aagagaaacccuacaaaug

SEQ ID NO: 544158 - RNA, 19 nt, Homo sapiens
ucacacugaugggaaauga

SEQ ID NO: 544159 - RNA, 19 nt, Homo sapiens
ggagaagcccuacgaaugc

SEQ ID NO: 544160 - RNA, 19 nt, Homo sapiens
ccauagagucucacugauu

SEQ ID NO: 544161 - RNA, 19 nt, Homo sapiens
caaccaaugacuccugaaa

SEQ ID NO: 544162 - RNA, 19 nt, Homo sapiens
guccaaggauucaccguau

SEQ ID NO: 544163 - RNA, 19 nt, Homo sapiens
guagggaaacguggagaua

SEQ ID NO: 544164 - RNA, 19 nt, Homo sapiens
ggagagaagccauaugcau

SEQ ID NO: 544165 - RNA, 19 nt, Homo sapiens
ugucuugucuguguguaua

SEQ ID NO: 544166 - RNA, 19 nt, Homo sapiens
ucaguaaacagcugucuug

SEQ ID NO: 544167 - RNA, 19 nt, Homo sapiens
ccauuagugcuauguuaua

SEQ ID NO: 544168 - RNA, 19 nt, Homo sapiens
gaagcccuaugaaugcaau

SEQ ID NO: 544169 - RNA, 19 nt, Homo sapiens
accaaugacuccugaaaga

SEQ ID NO: 544170 - RNA, 19 nt, Homo sapiens
gaccaaaugaagucagauu

SEQ ID NO: 544171 - RNA, 19 nt, Homo sapiens
ccaacaaaugccuuucaua

SEQ ID NO: 544172 - RNA, 19 nt, Homo sapiens
ggugagaaacccaacaaau

SEQ ID NO: 544173 - RNA, 19 nt, Homo sapiens
gaaauggaacaaauguagu

SEQ ID NO: 544174 - RNA, 19 nt, Homo sapiens
cuacaaaugucaggaaugc

SEQ ID NO: 544175 - RNA, 19 nt, Homo sapiens
gcaauagcaaauucauguu

SEQ ID NO: 544176 - RNA, 19 nt, Homo sapiens
ggauucaccguauuccaaa

SEQ ID NO: 544177 - RNA, 19 nt, Homo sapiens
uaaacccacuccacaugug

SEQ ID NO: 544178 - RNA, 19 nt, Homo sapiens
gaacaccagaggauucaca

SEQ ID NO: 544179 - RNA, 19 nt, Homo sapiens
gaaacccuaugaauguaac

SEQ ID NO: 544180 - RNA, 19 nt, Homo sapiens
caggagagaaacccuauga

SEQ ID NO: 544181 - RNA, 19 nt, Homo sapiens
gauccacacaggagagaaa

SEQ ID NO: 544182 - RNA, 19 nt, Homo sapiens
gagaagcccuaugaaugca

SEQ ID NO: 544183 - RNA, 19 nt, Homo sapiens
agccacagcucauccuuga

SEQ ID NO: 544184 - RNA, 19 nt, Homo sapiens
gagaagcccuaugaaugca

SEQ ID NO: 544185 - RNA, 19 nt, Homo sapiens
ggaaacguggagauaauca

SEQ ID NO: 544186 - RNA, 19 nt, Homo sapiens
agagaacucacacuggaua

SEQ ID NO: 544187 - RNA, 19 nt, Homo sapiens
gcuccucccuuaccaagca

SEQ ID NO: 544188 - RNA, 19 nt, Homo sapiens
ggcaaggcauucagucaca

SEQ ID NO: 544189 - RNA, 19 nt, Homo sapiens
ggugagaagcccuaugaau

SEQ ID NO: 544190 - RNA, 19 nt, Homo sapiens
caggugagaagcccuauga

SEQ ID NO: 544191 - RNA, 19 nt, Homo sapiens
aaugagaguggcaucuuua

SEQ ID NO: 544192 - RNA, 19 nt, Homo sapiens
cagcucagcacuuaucgaa

SEQ ID NO: 544193 - RNA, 19 nt, Homo sapiens
ggcagaguguuccagaaau

SEQ ID NO: 544194 - RNA, 19 nt, Homo sapiens
agucagauuugccauuaug

SEQ ID NO: 544195 - RNA, 19 nt, Homo sapiens
gcaaugagugugggaaauc

SEQ ID NO: 544196 - RNA, 19 nt, Homo sapiens
gagcaucggaggauucaca

SEQ ID NO: 544197 - RNA, 19 nt, Homo sapiens
gaaagacucuaucaaacua

SEQ ID NO: 544198 - RNA, 19 nt, Homo sapiens
gaaaggaacccauauuuga

SEQ ID NO: 544199 - RNA, 19 nt, Homo sapiens
gaagauggaccaccuuaua

SEQ ID NO: 544200 - RNA, 19 nt, Homo sapiens
gagaaaagcucuugaauau

SEQ ID NO: 544201 - RNA, 19 nt, Homo sapiens
gagaaacccuuugaaugua

SEQ ID NO: 544202 - RNA, 19 nt, Homo sapiens
ggaaggaccagaacauuaa

SEQ ID NO: 544203 - RNA, 19 nt, Homo sapiens
ggacagaaacccuaucauu

SEQ ID NO: 544204 - RNA, 19 nt, Homo sapiens
gagaaacccuucguaugua

SEQ ID NO: 544205 - RNA, 19 nt, Homo sapiens
ugaaagaacucaucaugga

SEQ ID NO: 544206 - RNA, 19 nt, Homo sapiens
gaaaaucccuggagugaaa

SEQ ID NO: 544207 - RNA, 19 nt, Homo sapiens
gagagaaccuugguaaaug

SEQ ID NO: 544208 - RNA, 19 nt, Homo sapiens
gaagacacaugauaaagca

SEQ ID NO: 544209 - RNA, 19 nt, Homo sapiens
agagaaaccuuauguaugu

SEQ ID NO: 544210 - RNA, 19 nt, Homo sapiens
gagaagccauauacaugua

SEQ ID NO: 544211 - RNA, 19 nt, Homo sapiens
gagaaacucuaugauugua

SEQ ID NO: 544212 - RNA, 19 nt, Homo sapiens
ggucagucaucccuuaaua

SEQ ID NO: 544213 - RNA, 19 nt, Homo sapiens
gaaacucugugaaagcauu

SEQ ID NO: 544214 - RNA, 19 nt, Homo sapiens
gguaaagccuucaguuguu

SEQ ID NO: 544215 - RNA, 19 nt, Homo sapiens
gaagacacaucaucacaca

SEQ ID NO: 544216 - RNA, 19 nt, Homo sapiens
ggaaaagccuucacuugua

SEQ ID NO: 544217 - RNA, 19 nt, Homo sapiens
ggagaaaucuaagaaguca

SEQ ID NO: 544218 - RNA, 19 nt, Homo sapiens
ggagagaaaccuuauguau

SEQ ID NO: 544219 - RNA, 19 nt, Homo sapiens
gggagagccuuuagucauu

SEQ ID NO: 544220 - RNA, 19 nt, Homo sapiens
gaagucauauguuagaaag

SEQ ID NO: 544221 - RNA, 19 nt, Homo sapiens
ggaaaggaacccauauuug

SEQ ID NO: 544222 - RNA, 19 nt, Homo sapiens
gagaagcccuaugaaugua

SEQ ID NO: 544223 - RNA, 19 nt, Homo sapiens
gaagagaagcccuaugaau

SEQ ID NO: 544224 - RNA, 19 nt, Homo sapiens
gagagaaaccuuaugaaug

SEQ ID NO: 544225 - RNA, 19 nt, Homo sapiens
ggagauggaccuuauaaau

SEQ ID NO: 544226 - RNA, 19 nt, Homo sapiens
ugaaagaauucuagagaga

SEQ ID NO: 544227 - RNA, 19 nt, Homo sapiens
gaauguaagcgauguggua

SEQ ID NO: 544228 - RNA, 19 nt, Homo sapiens
gagagaaacccuaugaaug

SEQ ID NO: 544229 - RNA, 19 nt, Homo sapiens
gaacacaugagauaauuca

SEQ ID NO: 544230 - RNA, 19 nt, Homo sapiens
gacaugaaccaaaggaaua

SEQ ID NO: 544231 - RNA, 19 nt, Homo sapiens
gaaccuugguaaauguaaa

SEQ ID NO: 544232 - RNA, 19 nt, Homo sapiens
gagagaagccauauacaug

SEQ ID NO: 544233 - RNA, 19 nt, Homo sapiens
guaaagcuuucguuucuuc

SEQ ID NO: 544234 - RNA, 19 nt, Homo sapiens
gagauggaccuuauaaaug

SEQ ID NO: 544235 - RNA, 19 nt, Homo sapiens
ggagagccuuuagucauuu

SEQ ID NO: 544236 - RNA, 19 nt, Homo sapiens
ggagagaaccuugguaaau

SEQ ID NO: 544237 - RNA, 19 nt, Homo sapiens
gggaaagccuucaguuauc

SEQ ID NO: 544238 - RNA, 19 nt, Homo sapiens
ggagagaaaccuuaugaau

SEQ ID NO: 544239 - RNA, 19 nt, Homo sapiens
ucaagugcaugaaagaauu

SEQ ID NO: 544240 - RNA, 19 nt, Homo sapiens
gacagaaacccuaucauug

SEQ ID NO: 544241 - RNA, 19 nt, Homo sapiens
gagaaacccuaugagugua

SEQ ID NO: 544242 - RNA, 19 nt, Homo sapiens
gccaguaccuuucaaauac

SEQ ID NO: 544243 - RNA, 19 nt, Homo sapiens
caaaggaauaucaggaaua

SEQ ID NO: 544244 - RNA, 19 nt, Homo sapiens
gaacccauauuugagagaa

SEQ ID NO: 544245 - RNA, 19 nt, Homo sapiens
gagagaaaccuuauguaug

SEQ ID NO: 544246 - RNA, 19 nt, Homo sapiens
ggagugggcuuugcuagau

SEQ ID NO: 544247 - RNA, 19 nt, Homo sapiens
ggauguagaugugaacuuc

SEQ ID NO: 544248 - RNA, 19 nt, Homo sapiens
ggagagaaacccuaugaau

SEQ ID NO: 544249 - RNA, 19 nt, Homo sapiens
gaaacucuaugauuguaag

SEQ ID NO: 544250 - RNA, 19 nt, Homo sapiens
gguaaaggguguaggaaag

SEQ ID NO: 544251 - RNA, 19 nt, Homo sapiens
ugagaaacccuuugaaugu

SEQ ID NO: 544252 - RNA, 19 nt, Homo sapiens
agagaaaccuuaugaaugc

SEQ ID NO: 544253 - RNA, 19 nt, Homo sapiens
ccagaagaaucucuacaga

SEQ ID NO: 544254 - RNA, 19 nt, Homo sapiens
gaauguacccuggaucaaa

SEQ ID NO: 544255 - RNA, 19 nt, Homo sapiens
guugagguauugaauuuga

SEQ ID NO: 544256 - RNA, 19 nt, Homo sapiens
aacaggagaugcuggauuu

SEQ ID NO: 544257 - RNA, 19 nt, Homo sapiens
ucaacaacauguaagaaug

SEQ ID NO: 544258 - RNA, 19 nt, Homo sapiens
caacaucaauucgaauaca

SEQ ID NO: 544259 - RNA, 19 nt, Homo sapiens
agauggaccuuauaaaugu

SEQ ID NO: 544260 - RNA, 19 nt, Homo sapiens
uaucucaacuccuuucgaa

SEQ ID NO: 544261 - RNA, 19 nt, Homo sapiens
ugagaaacccuucguaugu

SEQ ID NO: 544262 - RNA, 19 nt, Homo sapiens
gaaaagccuucacuuguau

SEQ ID NO: 544263 - RNA, 19 nt, Homo sapiens
gaagacacaugauaaaaca

SEQ ID NO: 544264 - RNA, 19 nt, Homo sapiens
cagcagggccucacuaguu

SEQ ID NO: 544265 - RNA, 19 nt, Homo sapiens
agaaacccuuugaauguaa

SEQ ID NO: 544266 - RNA, 19 nt, Homo sapiens
gagaaaccuuauguaugua

SEQ ID NO: 544267 - RNA, 19 nt, Homo sapiens
guacuugucuggcaaacag

SEQ ID NO: 544268 - RNA, 19 nt, Homo sapiens
ucgaacacaugaaaugauu

SEQ ID NO: 544269 - RNA, 19 nt, Homo sapiens
uaucacaaguguucgaaga

SEQ ID NO: 544270 - RNA, 19 nt, Homo sapiens
agagaaacccuaugaaugu

SEQ ID NO: 544271 - RNA, 19 nt, Homo sapiens
guaagaauguacccuggau

SEQ ID NO: 544272 - RNA, 19 nt, Homo sapiens
ggaaagccuucaguuaucu

SEQ ID NO: 544273 - RNA, 19 nt, Homo sapiens
gauggaccuuauaaaugua

SEQ ID NO: 544274 - RNA, 19 nt, Homo sapiens
ggacaugaaccaaaggaau

SEQ ID NO: 544275 - RNA, 19 nt, Homo sapiens
gugaaagcauuguauaugg

SEQ ID NO: 544276 - RNA, 19 nt, Homo sapiens
uaagcaauguccacacguu

SEQ ID NO: 544277 - RNA, 19 nt, Homo sapiens
guuaacacaugcugaagau

SEQ ID NO: 544278 - RNA, 19 nt, Homo sapiens
ggagagaaacccuaugagu

SEQ ID NO: 544279 - RNA, 19 nt, Homo sapiens
agaaacccuucguauguaa

SEQ ID NO: 544280 - RNA, 19 nt, Homo sapiens
guucgaagacacaugauaa

SEQ ID NO: 544281 - RNA, 19 nt, Homo sapiens
gaccagaacauuaaagauc

SEQ ID NO: 544282 - RNA, 19 nt, Homo sapiens
ugaaagcauuguauaugga

SEQ ID NO: 544283 - RNA, 19 nt, Homo sapiens
ccacaugcuuucaacaaca

SEQ ID NO: 544284 - RNA, 19 nt, Homo sapiens
gggaaagcaugaaauucug

SEQ ID NO: 544285 - RNA, 19 nt, Homo sapiens
gaacucauacuggagagaa

SEQ ID NO: 544286 - RNA, 19 nt, Homo sapiens
ucaguuguaucccaaguau

SEQ ID NO: 544287 - RNA, 19 nt, Homo sapiens
ccaaaggaauaucaggaau

SEQ ID NO: 544288 - RNA, 19 nt, Homo sapiens
gguauugaauuugaacaga

SEQ ID NO: 544289 - RNA, 19 nt, Homo sapiens
gugggaaagccuucaguua

SEQ ID NO: 544290 - RNA, 19 nt, Homo sapiens
gauaaaacauacuggagaa

SEQ ID NO: 544291 - RNA, 19 nt, Homo sapiens
uggaaggaccagaacauua

SEQ ID NO: 544292 - RNA, 19 nt, Homo sapiens
guaaagccuucaguuguuc

SEQ ID NO: 544293 - RNA, 19 nt, Homo sapiens
caugaaagaauucuagaga

SEQ ID NO: 544294 - RNA, 19 nt, Homo sapiens
aagagaagcccuaugaaug

SEQ ID NO: 544295 - RNA, 19 nt, Homo sapiens
gugagaaacccuuugaaug

SEQ ID NO: 544296 - RNA, 19 nt, Homo sapiens
gaacucacacuggagagaa

SEQ ID NO: 544297 - RNA, 19 nt, Homo sapiens
gaucauaucuugcaguuua

SEQ ID NO: 544298 - RNA, 19 nt, Homo sapiens
gagagaaccuuacacauuu

SEQ ID NO: 544299 - RNA, 19 nt, Homo sapiens
gagagaaaccuuacaaaua

SEQ ID NO: 544300 - RNA, 19 nt, Homo sapiens
gaaagaaaccuuacacaug

SEQ ID NO: 544301 - RNA, 19 nt, Homo sapiens
ggagagaaccuuacacauu

SEQ ID NO: 544302 - RNA, 19 nt, Homo sapiens
aaagaaaccuuacacaugu

SEQ ID NO: 544303 - RNA, 19 nt, Homo sapiens
ugagauaacuguuccaaau

SEQ ID NO: 544304 - RNA, 19 nt, Homo sapiens
agacagaucuuacaagugu

SEQ ID NO: 544305 - RNA, 19 nt, Homo sapiens
caaauacagugacuauaga

SEQ ID NO: 544306 - RNA, 19 nt, Homo sapiens
agacaucgaucauaucuug

SEQ ID NO: 544307 - RNA, 19 nt, Homo sapiens
gcaaaucacuggagaaucc

SEQ ID NO: 544308 - RNA, 19 nt, Homo sapiens
gcuauggacuuugagauaa

SEQ ID NO: 544309 - RNA, 19 nt, Homo sapiens
uaaaguaaccuuccuugaa

SEQ ID NO: 544310 - RNA, 19 nt, Homo sapiens
gggaaacuuugcaaaugua

SEQ ID NO: 544311 - RNA, 19 nt, Homo sapiens
gagauaacuguuccaaaua

SEQ ID NO: 544312 - RNA, 19 nt, Homo sapiens
cacaaagucuucaguaaug

SEQ ID NO: 544313 - RNA, 19 nt, Homo sapiens
agagaaaccuuacaagugu

SEQ ID NO: 544314 - RNA, 19 nt, Homo sapiens
gcaagguccuggguuguuu

SEQ ID NO: 544315 - RNA, 19 nt, Homo sapiens
gagagaaaccuuacaagug

SEQ ID NO: 544316 - RNA, 19 nt, Homo sapiens
ggcauugacuugagauuga

SEQ ID NO: 544317 - RNA, 19 nt, Homo sapiens
ccaaauaggcauugacuug

SEQ ID NO: 544318 - RNA, 19 nt, Homo sapiens
agagaaaccucacaagugu

SEQ ID NO: 544319 - RNA, 19 nt, Homo sapiens
ggagagaaaccuuacaaau

SEQ ID NO: 544320 - RNA, 19 nt, Homo sapiens
cuacaaccauugcaaauca

SEQ ID NO: 544321 - RNA, 19 nt, Homo sapiens
ugucuaagguuucuaauca

SEQ ID NO: 544322 - RNA, 19 nt, Homo sapiens
ugacuuaaccuugaguuua

SEQ ID NO: 544323 - RNA, 19 nt, Homo sapiens
gagagaaaccucacaagug

SEQ ID NO: 544324 - RNA, 19 nt, Homo sapiens
ggacuugggagcucucuuu

SEQ ID NO: 544325 - RNA, 19 nt, Homo sapiens
gcaauuagaagggauuauu

SEQ ID NO: 544326 - RNA, 19 nt, Homo sapiens
cuuaauggguuguauagaa

SEQ ID NO: 544327 - RNA, 19 nt, Homo sapiens
gaaaacauguccuuaaugg

SEQ ID NO: 544328 - RNA, 19 nt, Homo sapiens
cuaguuagcugacacagau

SEQ ID NO: 544329 - RNA, 19 nt, Homo sapiens
aaucaaaccuugcacaaca

SEQ ID NO: 544330 - RNA, 19 nt, Homo sapiens
ucaccuccauuaccaagua

SEQ ID NO: 544331 - RNA, 19 nt, Homo sapiens
ugaguugacuuaaccuuga

SEQ ID NO: 544332 - RNA, 19 nt, Homo sapiens
gcaaauguaaugauuguca

SEQ ID NO: 544333 - RNA, 19 nt, Homo sapiens
ggaaagaaaccuuacacau

SEQ ID NO: 544334 - RNA, 19 nt, Homo sapiens
guaggagccucaccagaga

SEQ ID NO: 544335 - RNA, 19 nt, Homo sapiens
ggaucauugucccuucuua

SEQ ID NO: 544336 - RNA, 19 nt, Homo sapiens
gaaaucagccuaggcaaca

SEQ ID NO: 544337 - RNA, 19 nt, Homo sapiens
gaggacugauuaguguuua

SEQ ID NO: 544338 - RNA, 19 nt, Homo sapiens
gcacaacaucagagaguuu

SEQ ID NO: 544339 - RNA, 19 nt, Homo sapiens
ccaaguagagucaggauga

SEQ ID NO: 544340 - RNA, 19 nt, Homo sapiens
uuacagguaugaaccacua

SEQ ID NO: 544341 - RNA, 19 nt, Homo sapiens
ccaaauacagugacuauag

SEQ ID NO: 544342 - RNA, 19 nt, Homo sapiens
ggcaaggucuucagucugu

SEQ ID NO: 544343 - RNA, 19 nt, Homo sapiens
guucacaccucauuagaca

SEQ ID NO: 544344 - RNA, 19 nt, Homo sapiens
caccuugcaugucaucaua

SEQ ID NO: 544345 - RNA, 19 nt, Homo sapiens
cauugucccuucuuaugua

SEQ ID NO: 544346 - RNA, 19 nt, Homo sapiens
ggagagaaaccuuacaagu

SEQ ID NO: 544347 - RNA, 19 nt, Homo sapiens
caacaucagagaguuuaua

SEQ ID NO: 544348 - RNA, 19 nt, Homo sapiens
uaaugaauguggcaagguu

SEQ ID NO: 544349 - RNA, 19 nt, Homo sapiens
ucaaguugcugcagccuau

SEQ ID NO: 544350 - RNA, 19 nt, Homo sapiens
caacaucagagaguucaua

SEQ ID NO: 544351 - RNA, 19 nt, Homo sapiens
caucauagacuucauacug

SEQ ID NO: 544352 - RNA, 19 nt, Homo sapiens
ucaacuauguguccucuuc

SEQ ID NO: 544353 - RNA, 19 nt, Homo sapiens
ggagagaaaccucacaagu

SEQ ID NO: 544354 - RNA, 19 nt, Homo sapiens
gucacaaagucuucaguaa

SEQ ID NO: 544355 - RNA, 19 nt, Homo sapiens
uuaaggcuauggacuuuga

SEQ ID NO: 544356 - RNA, 19 nt, Homo sapiens
ggaaacaguaccuuuaucu

SEQ ID NO: 544357 - RNA, 19 nt, Homo sapiens
gaccucaucucuacuaaaa

SEQ ID NO: 544358 - RNA, 19 nt, Homo sapiens
gcagggaccucgguaaagg

SEQ ID NO: 544359 - RNA, 19 nt, Homo sapiens
gagaaaccuuacaaauauc

SEQ ID NO: 544360 - RNA, 19 nt, Homo sapiens
aagcacaccuugcauguca

SEQ ID NO: 544361 - RNA, 19 nt, Homo sapiens
gaacucauacuggagagaa

SEQ ID NO: 544362 - RNA, 19 nt, Homo sapiens
uuucagacaucgaucauau

SEQ ID NO: 544363 - RNA, 19 nt, Homo sapiens
uagggaaacuuugcaaaug

SEQ ID NO: 544364 - RNA, 19 nt, Homo sapiens
uuacacauuucacgaguau

SEQ ID NO: 544365 - RNA, 19 nt, Homo sapiens
cuugggagcucucuuugaa

SEQ ID NO: 544366 - RNA, 19 nt, Homo sapiens
gagauugaguugacuuaac

SEQ ID NO: 544367 - RNA, 19 nt, Homo sapiens
caaauaggcauugacuuga

SEQ ID NO: 544368 - RNA, 19 nt, Homo sapiens
ggcaaggucuucagucaag

SEQ ID NO: 544369 - RNA, 19 nt, Homo sapiens
ggagaauccauaaugaaga

SEQ ID NO: 544370 - RNA, 19 nt, Homo sapiens
gagucaggaugaacuaugu

SEQ ID NO: 544371 - RNA, 19 nt, Homo sapiens
gaacgcugaucccauucau

SEQ ID NO: 544372 - RNA, 19 nt, Homo sapiens
uagcugggauuacagguau

SEQ ID NO: 544373 - RNA, 19 nt, Homo sapiens
cagucaagcuucauccuau

SEQ ID NO: 544374 - RNA, 19 nt, Homo sapiens
gagaauccauaaugaagac

SEQ ID NO: 544375 - RNA, 19 nt, Homo sapiens
aaacaguaccuuuaucuca

SEQ ID NO: 544376 - RNA, 19 nt, Homo sapiens
aguaagaccucaucucuac

SEQ ID NO: 544377 - RNA, 19 nt, Homo sapiens
gauaacuguuccaaauaca

SEQ ID NO: 544378 - RNA, 19 nt, Homo sapiens
ccugaggacugauuagugu

SEQ ID NO: 544379 - RNA, 19 nt, Homo sapiens
gggaaacaguaccuuuauc

SEQ ID NO: 544380 - RNA, 19 nt, Homo sapiens
ugccucagcuucccgagua

SEQ ID NO: 544381 - RNA, 19 nt, Homo sapiens
uaagaccucaucucuacua

SEQ ID NO: 544382 - RNA, 19 nt, Homo sapiens
ucacaaagucuucaguaau

SEQ ID NO: 544383 - RNA, 19 nt, Homo sapiens
aaauucagcccuuguaaug

SEQ ID NO: 544384 - RNA, 19 nt, Homo sapiens
caaguagagucaggaugaa

SEQ ID NO: 544385 - RNA, 19 nt, Homo sapiens
gaaguguaucuauccguaa

SEQ ID NO: 544386 - RNA, 19 nt, Homo sapiens
ggucuucagucaagcuuca

SEQ ID NO: 544387 - RNA, 19 nt, Homo sapiens
guagggaaacuuugcaaau

SEQ ID NO: 544388 - RNA, 19 nt, Homo sapiens
caucagagaguuuauacug

SEQ ID NO: 544389 - RNA, 19 nt, Homo sapiens
ggaaacuuugcaaauguaa

SEQ ID NO: 544390 - RNA, 19 nt, Homo sapiens
acacugaagcaucugauuu

SEQ ID NO: 544391 - RNA, 19 nt, Homo sapiens
acgcugaucccauucauuu

SEQ ID NO: 544392 - RNA, 19 nt, Homo sapiens
cuaaguagccccagagaua

SEQ ID NO: 544393 - RNA, 19 nt, Homo sapiens
ggcuauggacuuugagaua

SEQ ID NO: 544394 - RNA, 19 nt, Homo sapiens
cagccuaggcaacauagua

SEQ ID NO: 544395 - RNA, 19 nt, Homo sapiens
caucugauuucaaacucuu

SEQ ID NO: 544396 - RNA, 19 nt, Homo sapiens
ucuaagaguuuuccuguaa

SEQ ID NO: 544397 - RNA, 19 nt, Homo sapiens
ggagaaaccuuaugaaugu

SEQ ID NO: 544398 - RNA, 19 nt, Homo sapiens
gaaagaagccuuaugugaa

SEQ ID NO: 544399 - RNA, 19 nt, Homo sapiens
gcucaaaccuugcuaaaca

SEQ ID NO: 544400 - RNA, 19 nt, Homo sapiens
ggaaagaagccuuauguga

SEQ ID NO: 544401 - RNA, 19 nt, Homo sapiens
aaagaagccuuaugugaaa

SEQ ID NO: 544402 - RNA, 19 nt, Homo sapiens
ggacaagggaugagcuuua

SEQ ID NO: 544403 - RNA, 19 nt, Homo sapiens
ggaaagaauucuaagucaa

SEQ ID NO: 544404 - RNA, 19 nt, Homo sapiens
gagaaaagcucuaugaaug

SEQ ID NO: 544405 - RNA, 19 nt, Homo sapiens
gaacaccagugaauuuaca

SEQ ID NO: 544406 - RNA, 19 nt, Homo sapiens
gagaaacccuauguaugua

SEQ ID NO: 544407 - RNA, 19 nt, Homo sapiens
guaggaaacgguucuauuu

SEQ ID NO: 544408 - RNA, 19 nt, Homo sapiens
uaauauggcccacacuuua

SEQ ID NO: 544409 - RNA, 19 nt, Homo sapiens
gagagaaaccuuaugaaug

SEQ ID NO: 544410 - RNA, 19 nt, Homo sapiens
gaaaaucagggauguauua

SEQ ID NO: 544411 - RNA, 19 nt, Homo sapiens
ggagaaagccagagauuag

SEQ ID NO: 544412 - RNA, 19 nt, Homo sapiens
uauaaugccuuacuucaga

SEQ ID NO: 544413 - RNA, 19 nt, Homo sapiens
gaauuuacacugcaaagaa

SEQ ID NO: 544414 - RNA, 19 nt, Homo sapiens
ggagagaaacccuauguau

SEQ ID NO: 544415 - RNA, 19 nt, Homo sapiens
ucaaagaauucacauagga

SEQ ID NO: 544416 - RNA, 19 nt, Homo sapiens
uuacaaagaugaugcacuu

SEQ ID NO: 544417 - RNA, 19 nt, Homo sapiens
gauacauacuggaaagaaa

SEQ ID NO: 544418 - RNA, 19 nt, Homo sapiens
caaccuauaucagagaauu

SEQ ID NO: 544419 - RNA, 19 nt, Homo sapiens
gcaaagugauacaaacaca

SEQ ID NO: 544420 - RNA, 19 nt, Homo sapiens
guaggagucccuuacuuua

SEQ ID NO: 544421 - RNA, 19 nt, Homo sapiens
ggagagaaaccuuaugaau

SEQ ID NO: 544422 - RNA, 19 nt, Homo sapiens
ugaugacugugaaguaaua

SEQ ID NO: 544423 - RNA, 19 nt, Homo sapiens
gagcauccauacaaccaaa

SEQ ID NO: 544424 - RNA, 19 nt, Homo sapiens
gagaauucaugcuggagaa

SEQ ID NO: 544425 - RNA, 19 nt, Homo sapiens
gagaaaccauaugcaugua

SEQ ID NO: 544426 - RNA, 19 nt, Homo sapiens
aaagagauuuguacagaug

SEQ ID NO: 544427 - RNA, 19 nt, Homo sapiens
gauggaaucuguaggaaac

SEQ ID NO: 544428 - RNA, 19 nt, Homo sapiens
gcaacuguauaaaugaaug

SEQ ID NO: 544429 - RNA, 19 nt, Homo sapiens
agagaaaccuuaugaaugc

SEQ ID NO: 544430 - RNA, 19 nt, Homo sapiens
gaaagaauucuaagucaag

SEQ ID NO: 544431 - RNA, 19 nt, Homo sapiens
gagagaaacccuauguaug

SEQ ID NO: 544432 - RNA, 19 nt, Homo sapiens
caucagagcauccauacaa

SEQ ID NO: 544433 - RNA, 19 nt, Homo sapiens
ucagagauguggccauaga

SEQ ID NO: 544434 - RNA, 19 nt, Homo sapiens
gcaauaacaaggugaaauc

SEQ ID NO: 544435 - RNA, 19 nt, Homo sapiens
caaccucacucgacaucaa

SEQ ID NO: 544436 - RNA, 19 nt, Homo sapiens
gggagaaaccuuaugaaug

SEQ ID NO: 544437 - RNA, 19 nt, Homo sapiens
ucaguuaccuuucauuucu

SEQ ID NO: 544438 - RNA, 19 nt, Homo sapiens
gaaaccauaugcauguaag

SEQ ID NO: 544439 - RNA, 19 nt, Homo sapiens
gguaggagucccuuacuuu

SEQ ID NO: 544440 - RNA, 19 nt, Homo sapiens
aaucagggauguauuagga

SEQ ID NO: 544441 - RNA, 19 nt, Homo sapiens
gcaaggaucauacugagau

SEQ ID NO: 544442 - RNA, 19 nt, Homo sapiens
ggacagaaagcauggacaa

SEQ ID NO: 544443 - RNA, 19 nt, Homo sapiens
ugaugaaugugguaaaguu

SEQ ID NO: 544444 - RNA, 19 nt, Homo sapiens
ugucacucauuccuuauua

SEQ ID NO: 544445 - RNA, 19 nt, Homo sapiens
gaaaccuuaugaaugcauu

SEQ ID NO: 544446 - RNA, 19 nt, Homo sapiens
ggaaagaauacauauccaa

SEQ ID NO: 544447 - RNA, 19 nt, Homo sapiens
ggaaagcuuugcguuguca

SEQ ID NO: 544448 - RNA, 19 nt, Homo sapiens
gagaaaccuuaugaaugua

SEQ ID NO: 544449 - RNA, 19 nt, Homo sapiens
caaaugauacauacuggaa

SEQ ID NO: 544450 - RNA, 19 nt, Homo sapiens
auacugagaugcugcaaga

SEQ ID NO: 544451 - RNA, 19 nt, Homo sapiens
guaauauggcccacacuuu

SEQ ID NO: 544452 - RNA, 19 nt, Homo sapiens
ugaaagugaugacugugaa

SEQ ID NO: 544453 - RNA, 19 nt, Homo sapiens
ggacacacacucuugacaa

SEQ ID NO: 544454 - RNA, 19 nt, Homo sapiens
ucagugacauucagagaug

SEQ ID NO: 544455 - RNA, 19 nt, Homo sapiens
agagaaacccuauguaugu

SEQ ID NO: 544456 - RNA, 19 nt, Homo sapiens
guaacagucucucaucaag

SEQ ID NO: 544457 - RNA, 19 nt, Homo sapiens
gaaaguaacagucucucau

SEQ ID NO: 544458 - RNA, 19 nt, Homo sapiens
cagaugugguuuccuuauu

SEQ ID NO: 544459 - RNA, 19 nt, Homo sapiens
ggagaacuauggccaucug

SEQ ID NO: 544460 - RNA, 19 nt, Homo sapiens
gaauucacauaggaaagaa

SEQ ID NO: 544461 - RNA, 19 nt, Homo sapiens
ggaaacgguucuauuuuga

SEQ ID NO: 544462 - RNA, 19 nt, Homo sapiens
gauacaaacacagugauuu

SEQ ID NO: 544463 - RNA, 19 nt, Homo sapiens
ggugaaaucaauauuguug

SEQ ID NO: 544464 - RNA, 19 nt, Homo sapiens
cguugucacucauuccuua

SEQ ID NO: 544465 - RNA, 19 nt, Homo sapiens
gaaggcauuucgccguuuc

SEQ ID NO: 544466 - RNA, 19 nt, Homo sapiens
ggaaggcauuucgccguuu

SEQ ID NO: 544467 - RNA, 19 nt, Homo sapiens
gaucauggaaagaauucua

SEQ ID NO: 544468 - RNA, 19 nt, Homo sapiens
gaaaagccauuaauaacca

SEQ ID NO: 544469 - RNA, 19 nt, Homo sapiens
aauuaccacucauuccuua

SEQ ID NO: 544470 - RNA, 19 nt, Homo sapiens
gagucacacuggagagaaa

SEQ ID NO: 544471 - RNA, 19 nt, Homo sapiens
caucaaagaauucacauag

SEQ ID NO: 544472 - RNA, 19 nt, Homo sapiens
gcacuuuggagaucagaaa

SEQ ID NO: 544473 - RNA, 19 nt, Homo sapiens
caaggugaaaucaauauug

SEQ ID NO: 544474 - RNA, 19 nt, Homo sapiens
gaacucauacuggagagaa

SEQ ID NO: 544475 - RNA, 19 nt, Homo sapiens
gcggaaagcaccacggaaa

SEQ ID NO: 544476 - RNA, 19 nt, Homo sapiens
cuaugaaugugaugaaugu

SEQ ID NO: 544477 - RNA, 19 nt, Homo sapiens
ggauguauuaggaaaguaa

SEQ ID NO: 544478 - RNA, 19 nt, Homo sapiens
guggugagaucaaagacuu

SEQ ID NO: 544479 - RNA, 19 nt, Homo sapiens
gaaacccuauguauguaag

SEQ ID NO: 544480 - RNA, 19 nt, Homo sapiens
gauguguaauguuggagaa

SEQ ID NO: 544481 - RNA, 19 nt, Homo sapiens
cuacaucagagaacucaua

SEQ ID NO: 544482 - RNA, 19 nt, Homo sapiens
uaggaaagcuuugcguugu

SEQ ID NO: 544483 - RNA, 19 nt, Homo sapiens
ugugaaacaccaaaugaua

SEQ ID NO: 544484 - RNA, 19 nt, Homo sapiens
ggagagaaaccauaugcau

SEQ ID NO: 544485 - RNA, 19 nt, Homo sapiens
ucagggauguauuaggaaa

SEQ ID NO: 544486 - RNA, 19 nt, Homo sapiens
aaaggaggcuggaaaugca

SEQ ID NO: 544487 - RNA, 19 nt, Homo sapiens
cgacaucagagcauccaua

SEQ ID NO: 544488 - RNA, 19 nt, Homo sapiens
uaggaaaugugguaaagca

SEQ ID NO: 544489 - RNA, 19 nt, Homo sapiens
aacagucucucaucaagaa

SEQ ID NO: 544490 - RNA, 19 nt, Homo sapiens
uggaaagaauucuaaguca

SEQ ID NO: 544491 - RNA, 19 nt, Homo sapiens
caaagaauucacauaggaa

SEQ ID NO: 544492 - RNA, 19 nt, Homo sapiens
ucacugggucuuuccauuu

SEQ ID NO: 544493 - RNA, 19 nt, Homo sapiens
cauacuggauggaaucugu

SEQ ID NO: 544494 - RNA, 19 nt, Homo sapiens
gagcucaaaccuugcuaaa

SEQ ID NO: 544495 - RNA, 19 nt, Homo sapiens
uggcaugcaucccuuauuc

SEQ ID NO: 544496 - RNA, 19 nt, Homo sapiens
gaguguaaggacuguaaua

SEQ ID NO: 544497 - RNA, 19 nt, Homo sapiens
gaaaggagguuauaaugaa

SEQ ID NO: 544498 - RNA, 19 nt, Homo sapiens
gagaagauaugaaagauga

SEQ ID NO: 544499 - RNA, 19 nt, Homo sapiens
gauaaacccugcaaaugua

SEQ ID NO: 544500 - RNA, 19 nt, Homo sapiens
gaacguaagugaauucaug

SEQ ID NO: 544501 - RNA, 19 nt, Homo sapiens
gagagaaacuguacaaaug

SEQ ID NO: 544502 - RNA, 19 nt, Homo sapiens
gaaaguauauuggugagaa

SEQ ID NO: 544503 - RNA, 19 nt, Homo sapiens
gaagauacauaagaucgua

SEQ ID NO: 544504 - RNA, 19 nt, Homo sapiens
ccacaaaccuuaaugaaca

SEQ ID NO: 544505 - RNA, 19 nt, Homo sapiens
uaaagaauguggcaaauca

SEQ ID NO: 544506 - RNA, 19 nt, Homo sapiens
gagagaaacuucacaugug

SEQ ID NO: 544507 - RNA, 19 nt, Homo sapiens
gagaagauaugagaaaugu

SEQ ID NO: 544508 - RNA, 19 nt, Homo sapiens
ccacaacccuuacuaaaca

SEQ ID NO: 544509 - RNA, 19 nt, Homo sapiens
ggaggaaagucuuacaaau

SEQ ID NO: 544510 - RNA, 19 nt, Homo sapiens
cuacaaaugugaagaaugu

SEQ ID NO: 544511 - RNA, 19 nt, Homo sapiens
cuacaaaugugaugaaugu

SEQ ID NO: 544512 - RNA, 19 nt, Homo sapiens
cuacaaaugugaagaaugu

SEQ ID NO: 544513 - RNA, 19 nt, Homo sapiens
gaaaagagcccuacaaugu

SEQ ID NO: 544514 - RNA, 19 nt, Homo sapiens
gagaaacccuggaaaugug

SEQ ID NO: 544515 - RNA, 19 nt, Homo sapiens
gaauguggcagcaucuuua

SEQ ID NO: 544516 - RNA, 19 nt, Homo sapiens
gagagaaacccuacaaaug

SEQ ID NO: 544517 - RNA, 19 nt, Homo sapiens
gagagaaacccuacaaaug

SEQ ID NO: 544518 - RNA, 19 nt, Homo sapiens
ucacaacccuuacuaaaca

SEQ ID NO: 544519 - RNA, 19 nt, Homo sapiens
uaaagcaagugucaaaguu

SEQ ID NO: 544520 - RNA, 19 nt, Homo sapiens
ccacaaaccuuuaugaaaa

SEQ ID NO: 544521 - RNA, 19 nt, Homo sapiens
gcaaaauacuucaguguaa

SEQ ID NO: 544522 - RNA, 19 nt, Homo sapiens
cuagcaauguucauacuua

SEQ ID NO: 544523 - RNA, 19 nt, Homo sapiens
caaccacacucaaucuauu

SEQ ID NO: 544524 - RNA, 19 nt, Homo sapiens
gagagaaacccuacacuug

SEQ ID NO: 544525 - RNA, 19 nt, Homo sapiens
gagagaaacacuuuaaaga

SEQ ID NO: 544526 - RNA, 19 nt, Homo sapiens
ugucacaucuuacuguaua

SEQ ID NO: 544527 - RNA, 19 nt, Homo sapiens
gguccucaaugcuuaauaa

SEQ ID NO: 544528 - RNA, 19 nt, Homo sapiens
ugaagaacguggcaaaguu

SEQ ID NO: 544529 - RNA, 19 nt, Homo sapiens
guauagagaugugauguug

SEQ ID NO: 544530 - RNA, 19 nt, Homo sapiens
gcacaugauauccuuuaua

SEQ ID NO: 544531 - RNA, 19 nt, Homo sapiens
agucauaucuccucacauu

SEQ ID NO: 544532 - RNA, 19 nt, Homo sapiens
gagaaacccuacaaaugug

SEQ ID NO: 544533 - RNA, 19 nt, Homo sapiens
gagaaacccuacaaaugug

SEQ ID NO: 544534 - RNA, 19 nt, Homo sapiens
gaauguggcagucuuuaaa

SEQ ID NO: 544535 - RNA, 19 nt, Homo sapiens
gaggaaagucuuacaaaug

SEQ ID NO: 544536 - RNA, 19 nt, Homo sapiens
gcaaauguaaagaguguaa

SEQ ID NO: 544537 - RNA, 19 nt, Homo sapiens
ggagagaaacuguacaaau

SEQ ID NO: 544538 - RNA, 19 nt, Homo sapiens
ugagagaaauccuacaaau

SEQ ID NO: 544539 - RNA, 19 nt, Homo sapiens
gcagauaaacccuacaaau

SEQ ID NO: 544540 - RNA, 19 nt, Homo sapiens
caacauaagguaauucaug

SEQ ID NO: 544541 - RNA, 19 nt, Homo sapiens
ggaaauggaacucuuaaca

SEQ ID NO: 544542 - RNA, 19 nt, Homo sapiens
gagagaaacccuacacaug

SEQ ID NO: 544543 - RNA, 19 nt, Homo sapiens
gagaaacccuacacaugug

SEQ ID NO: 544544 - RNA, 19 nt, Homo sapiens
gagagaaacccuacacaug

SEQ ID NO: 544545 - RNA, 19 nt, Homo sapiens
gagagaaacccaucacaug

SEQ ID NO: 544546 - RNA, 19 nt, Homo sapiens
gagaaacccuacacuugug

SEQ ID NO: 544547 - RNA, 19 nt, Homo sapiens
gcagaaaggagguuauaau

SEQ ID NO: 544548 - RNA, 19 nt, Homo sapiens
aaagagcccuacaauguga

SEQ ID NO: 544549 - RNA, 19 nt, Homo sapiens
ccacaaacuuacauugaga

SEQ ID NO: 544550 - RNA, 19 nt, Homo sapiens
ggagagaaacuucacaugu

SEQ ID NO: 544551 - RNA, 19 nt, Homo sapiens
ccacaaacuuauacugaga

SEQ ID NO: 544552 - RNA, 19 nt, Homo sapiens
gagaugugauguuggagaa

SEQ ID NO: 544553 - RNA, 19 nt, Homo sapiens
ggagauaaacccugcaaau

SEQ ID NO: 544554 - RNA, 19 nt, Homo sapiens
ggagagaaacccuacaaau

SEQ ID NO: 544555 - RNA, 19 nt, Homo sapiens
ggagagaaacccuacaaau

SEQ ID NO: 544556 - RNA, 19 nt, Homo sapiens
cagauaaacccuacaaaug

SEQ ID NO: 544557 - RNA, 19 nt, Homo sapiens
gcaagugucaaaguuguua

SEQ ID NO: 544558 - RNA, 19 nt, Homo sapiens
aaugaaugcuugucaacua

SEQ ID NO: 544559 - RNA, 19 nt, Homo sapiens
uagcuaagacucccgaaua

SEQ ID NO: 544560 - RNA, 19 nt, Homo sapiens
gaaagucuuacaaauguga

SEQ ID NO: 544561 - RNA, 19 nt, Homo sapiens
aaacguaagacaagacaua

SEQ ID NO: 544562 - RNA, 19 nt, Homo sapiens
gagauaaacccugcaaaug

SEQ ID NO: 544563 - RNA, 19 nt, Homo sapiens
gagaaacuguacaaaugug

SEQ ID NO: 544564 - RNA, 19 nt, Homo sapiens
gaaauggaacucuuaacau

SEQ ID NO: 544565 - RNA, 19 nt, Homo sapiens
agagaaauccuacaaaugu

SEQ ID NO: 544566 - RNA, 19 nt, Homo sapiens
ccagcuauguguucucauu

SEQ ID NO: 544567 - RNA, 19 nt, Homo sapiens
gaagagaaacugcaaacgu

SEQ ID NO: 544568 - RNA, 19 nt, Homo sapiens
aggaaagucuuacaaaugu

SEQ ID NO: 544569 - RNA, 19 nt, Homo sapiens
uagauaaacccuacaaaug

SEQ ID NO: 544570 - RNA, 19 nt, Homo sapiens
agaaaaggcuguaaaaguu

SEQ ID NO: 544571 - RNA, 19 nt, Homo sapiens
gaagauucauuccacaaac

SEQ ID NO: 544572 - RNA, 19 nt, Homo sapiens
gagagaaauccuacaaaug

SEQ ID NO: 544573 - RNA, 19 nt, Homo sapiens
gguccugaaugaacauaaa

SEQ ID NO: 544574 - RNA, 19 nt, Homo sapiens
ggagagaaacccuacacuu

SEQ ID NO: 544575 - RNA, 19 nt, Homo sapiens
aaacaaacguaagacaaga

SEQ ID NO: 544576 - RNA, 19 nt, Homo sapiens
gggcauagaagauucauuc

SEQ ID NO: 544577 - RNA, 19 nt, Homo sapiens
ucucacaccugaauaaaca

SEQ ID NO: 544578 - RNA, 19 nt, Homo sapiens
agagaaacccuacaaaugu

SEQ ID NO: 544579 - RNA, 19 nt, Homo sapiens
agagaaacccuacaaaugu

SEQ ID NO: 544580 - RNA, 19 nt, Homo sapiens
ggagagaaacacuuuaaag

SEQ ID NO: 544581 - RNA, 19 nt, Homo sapiens
aaaugguccucaacccuua

SEQ ID NO: 544582 - RNA, 19 nt, Homo sapiens
cuacacauguggcagaaug

SEQ ID NO: 544583 - RNA, 19 nt, Homo sapiens
gaauuuguauagagaugug

SEQ ID NO: 544584 - RNA, 19 nt, Homo sapiens
ggagaagugugacaaagcu

SEQ ID NO: 544585 - RNA, 19 nt, Homo sapiens
gaucggagucaacauaaga

SEQ ID NO: 544586 - RNA, 19 nt, Homo sapiens
gugcaaagccuucaaaugc

SEQ ID NO: 544587 - RNA, 19 nt, Homo sapiens
gcacagucuuuaccacauc

SEQ ID NO: 544588 - RNA, 19 nt, Homo sapiens
cagcagaauuuguauagag

SEQ ID NO: 544589 - RNA, 19 nt, Homo sapiens
auauaggccuuuaaaguga

SEQ ID NO: 544590 - RNA, 19 nt, Homo sapiens
gaagaaauccccuggaaau

SEQ ID NO: 544591 - RNA, 19 nt, Homo sapiens
gaacucauacuggaggaaa

SEQ ID NO: 544592 - RNA, 19 nt, Homo sapiens
gaccauccacaaaccuuua

SEQ ID NO: 544593 - RNA, 19 nt, Homo sapiens
guaaagaagugugcaaagc

SEQ ID NO: 544594 - RNA, 19 nt, Homo sapiens
guagagaaacccuggaaau

SEQ ID NO: 544595 - RNA, 19 nt, Homo sapiens
ggauguggccauagaauuc

SEQ ID NO: 544596 - RNA, 19 nt, Homo sapiens
cacacucaaucuauucuaa

SEQ ID NO: 544597 - RNA, 19 nt, Homo sapiens
gcaagucucugauguguga

SEQ ID NO: 544598 - RNA, 19 nt, Homo sapiens
gagagaaccuucacaggaa

SEQ ID NO: 544599 - RNA, 19 nt, Homo sapiens
caugagaacugcaagcaua

SEQ ID NO: 544600 - RNA, 19 nt, Homo sapiens
gaguagagcuggagucugu

SEQ ID NO: 544601 - RNA, 19 nt, Homo sapiens
gcacccaccugcugaagaa

SEQ ID NO: 544602 - RNA, 19 nt, Homo sapiens
ggacauggacuauaacguu

SEQ ID NO: 544603 - RNA, 19 nt, Homo sapiens
gaacaacgcuaauauucac

SEQ ID NO: 544604 - RNA, 19 nt, Homo sapiens
guaggaaccuucaagacaa

SEQ ID NO: 544605 - RNA, 19 nt, Homo sapiens
agagggacauggacuauaa

SEQ ID NO: 544606 - RNA, 19 nt, Homo sapiens
auacaggacugaagccaua

SEQ ID NO: 544607 - RNA, 19 nt, Homo sapiens
ccacagaggcccugaagaa

SEQ ID NO: 544608 - RNA, 19 nt, Homo sapiens
gaagugcccuguucuacuc

SEQ ID NO: 544609 - RNA, 19 nt, Homo sapiens
ugacuugggugcugaagaa

SEQ ID NO: 544610 - RNA, 19 nt, Homo sapiens
cgacacaugcuucuacaua

SEQ ID NO: 544611 - RNA, 19 nt, Homo sapiens
cagcaugcaugaagauauu

SEQ ID NO: 544612 - RNA, 19 nt, Homo sapiens
caaagucccuggcuauaag

SEQ ID NO: 544613 - RNA, 19 nt, Homo sapiens
cacaaauccuccauccuua

SEQ ID NO: 544614 - RNA, 19 nt, Homo sapiens
ggaagaggguauggucuga

SEQ ID NO: 544615 - RNA, 19 nt, Homo sapiens
guacaagggugacuagaac

SEQ ID NO: 544616 - RNA, 19 nt, Homo sapiens
ucccggcucuccucuauua

SEQ ID NO: 544617 - RNA, 19 nt, Homo sapiens
ccacaaauccuccauccuu

SEQ ID NO: 544618 - RNA, 19 nt, Homo sapiens
gcucagagacagcacuuaa

SEQ ID NO: 544619 - RNA, 19 nt, Homo sapiens
gaaacuccuugcccacaga

SEQ ID NO: 544620 - RNA, 19 nt, Homo sapiens
ugaagguucuuaaucuuga

SEQ ID NO: 544621 - RNA, 19 nt, Homo sapiens
cagcugaaauaccacauga

SEQ ID NO: 544622 - RNA, 19 nt, Homo sapiens
gcugaucccucucgucuca

SEQ ID NO: 544623 - RNA, 19 nt, Homo sapiens
ggaaaagccuuaccacugu

SEQ ID NO: 544624 - RNA, 19 nt, Homo sapiens
caucuucucuuuccuucuu

SEQ ID NO: 544625 - RNA, 19 nt, Homo sapiens
gguacuagaucaccaugug

SEQ ID NO: 544626 - RNA, 19 nt, Homo sapiens
gcaccugcaucuccacuuc

SEQ ID NO: 544627 - RNA, 19 nt, Homo sapiens
gaacauggagaucauugug

SEQ ID NO: 544628 - RNA, 19 nt, Homo sapiens
gccaucagcugguacuaga

SEQ ID NO: 544629 - RNA, 19 nt, Homo sapiens
gacuguggcuucaccugua

SEQ ID NO: 544630 - RNA, 19 nt, Homo sapiens
gagggcagcugcacacuac

SEQ ID NO: 544631 - RNA, 19 nt, Homo sapiens
ggaaguaugagcugcagaa

SEQ ID NO: 544632 - RNA, 19 nt, Homo sapiens
gcaaggccuucauuaagca

SEQ ID NO: 544633 - RNA, 19 nt, Homo sapiens
gaaaauccccuucuggaaa

SEQ ID NO: 544634 - RNA, 19 nt, Homo sapiens
caaggcccauggcuaugua

SEQ ID NO: 544635 - RNA, 19 nt, Homo sapiens
gauuacaugugcacugaau

SEQ ID NO: 544636 - RNA, 19 nt, Homo sapiens
gagcugcgcugcaccuucu

SEQ ID NO: 544637 - RNA, 19 nt, Homo sapiens
ccacuucuguccacuuugu

SEQ ID NO: 544638 - RNA, 19 nt, Homo sapiens
gggcaagucucugaugugu

SEQ ID NO: 544639 - RNA, 19 nt, Homo sapiens
ggagaggaaugcacucaac

SEQ ID NO: 544640 - RNA, 19 nt, Homo sapiens
ggugaagguucuuaaucuu

SEQ ID NO: 544641 - RNA, 19 nt, Homo sapiens
ugaaauaccacaugaccaa

SEQ ID NO: 544642 - RNA, 19 nt, Homo sapiens
cuaucuagcuuugaaggua

SEQ ID NO: 544643 - RNA, 19 nt, Homo sapiens
ccacacucuuguuccauaa

SEQ ID NO: 544644 - RNA, 19 nt, Homo sapiens
caggagggcugcagcuaug

SEQ ID NO: 544645 - RNA, 19 nt, Homo sapiens
cagaacaacgcuaauauuc

SEQ ID NO: 544646 - RNA, 19 nt, Homo sapiens
gcuauaagaucuggauuuu

SEQ ID NO: 544647 - RNA, 19 nt, Homo sapiens
uaaaggagcaccucaagag

SEQ ID NO: 544648 - RNA, 19 nt, Homo sapiens
ccaaaaggcuguggauaaa

SEQ ID NO: 544649 - RNA, 19 nt, Homo sapiens
cuaagaagcaccaccuuga

SEQ ID NO: 544650 - RNA, 19 nt, Homo sapiens
gaagacaggagggcaguga

SEQ ID NO: 544651 - RNA, 19 nt, Homo sapiens
agaggagaauguagagaaa

SEQ ID NO: 544652 - RNA, 19 nt, Homo sapiens
ccagaacaacgcuaauauu

SEQ ID NO: 544653 - RNA, 19 nt, Homo sapiens
ucaaccagcugaaauacca

SEQ ID NO: 544654 - RNA, 19 nt, Homo sapiens
gguaggaaccuucaagaca

SEQ ID NO: 544655 - RNA, 19 nt, Homo sapiens
aguaugagcugcagaagca

SEQ ID NO: 544656 - RNA, 19 nt, Homo sapiens
auaagcaccuauuccguaa

SEQ ID NO: 544657 - RNA, 19 nt, Homo sapiens
agaaagaagagaagaguga

SEQ ID NO: 544658 - RNA, 19 nt, Homo sapiens
caacgcuaauauucacauu

SEQ ID NO: 544659 - RNA, 19 nt, Homo sapiens
ucaaagucccuggcuauaa

SEQ ID NO: 544660 - RNA, 19 nt, Homo sapiens
ccuuaaggcuccaccagaa

SEQ ID NO: 544661 - RNA, 19 nt, Homo sapiens
ugucugagcccuccacaaa

SEQ ID NO: 544662 - RNA, 19 nt, Homo sapiens
caccaucacuccaucaaag

SEQ ID NO: 544663 - RNA, 19 nt, Homo sapiens
ggacuauaacguugauuuc

SEQ ID NO: 544664 - RNA, 19 nt, Homo sapiens
gggauacaguucugguuca

SEQ ID NO: 544665 - RNA, 19 nt, Homo sapiens
gaccgcaaggccuucauua

SEQ ID NO: 544666 - RNA, 19 nt, Homo sapiens
ggagacaggacaaagaaca

SEQ ID NO: 544667 - RNA, 19 nt, Homo sapiens
caaaacaccuacccacuuc

SEQ ID NO: 544668 - RNA, 19 nt, Homo sapiens
ggauacaguucugguucaa

SEQ ID NO: 544669 - RNA, 19 nt, Homo sapiens
cagaggcccugaagaagca

SEQ ID NO: 544670 - RNA, 19 nt, Homo sapiens
ccauauguguccagagugu

SEQ ID NO: 544671 - RNA, 19 nt, Homo sapiens
gcccugagcuauugcugau

SEQ ID NO: 544672 - RNA, 19 nt, Homo sapiens
caucaaagucccuggcuau

SEQ ID NO: 544673 - RNA, 19 nt, Homo sapiens
gguacaagggugacuagaa

SEQ ID NO: 544674 - RNA, 19 nt, Homo sapiens
cugaagaagugcccuguuc

SEQ ID NO: 544675 - RNA, 19 nt, Homo sapiens
uaaggagacaggacaaaga

SEQ ID NO: 544676 - RNA, 19 nt, Homo sapiens
uauugggacuucugacuug

SEQ ID NO: 544677 - RNA, 19 nt, Homo sapiens
gacacaugcuucuacauac

SEQ ID NO: 544678 - RNA, 19 nt, Homo sapiens
gcgaagcgacugugucugu

SEQ ID NO: 544679 - RNA, 19 nt, Homo sapiens
ccgggacccugcaccuaua

SEQ ID NO: 544680 - RNA, 19 nt, Homo sapiens
gcacccaccuucgcaagca

SEQ ID NO: 544681 - RNA, 19 nt, Homo sapiens
gggucaaccagcugaaaua

SEQ ID NO: 544682 - RNA, 19 nt, Homo sapiens
gggagaaggcccugaaucu

SEQ ID NO: 544683 - RNA, 19 nt, Homo sapiens
ggaaggaccagagcuaucu

SEQ ID NO: 544684 - RNA, 19 nt, Homo sapiens
gaagagggaccagggaaca

SEQ ID NO: 544685 - RNA, 19 nt, Homo sapiens
cagcaacaccacacucuug

SEQ ID NO: 544686 - RNA, 19 nt, Homo sapiens
ggagaucauuguggagaca

SEQ ID NO: 544687 - RNA, 19 nt, Homo sapiens
gguuaaggguacaugacaa

SEQ ID NO: 544688 - RNA, 19 nt, Homo sapiens
caccagacgguaccgguua

SEQ ID NO: 544689 - RNA, 19 nt, Homo sapiens
guucccggcucuccucuau

SEQ ID NO: 544690 - RNA, 19 nt, Homo sapiens
caaauccuccauccuuaga

SEQ ID NO: 544691 - RNA, 19 nt, Homo sapiens
ggagggcagcugcacacua

SEQ ID NO: 544692 - RNA, 19 nt, Homo sapiens
gccacaagcugcggcauca

SEQ ID NO: 544693 - RNA, 19 nt, Homo sapiens
acagugcgguggagaggaa

SEQ ID NO: 544694 - RNA, 19 nt, Homo sapiens
gcaccgagucccucuucaa

SEQ ID NO: 544695 - RNA, 19 nt, Homo sapiens
gaauguagagaaagaagag

SEQ ID NO: 544696 - RNA, 19 nt, Homo sapiens
ugcccuacaugucccuuua

SEQ ID NO: 544697 - RNA, 19 nt, Homo sapiens
ggaagaagccaucagaaua

SEQ ID NO: 544698 - RNA, 19 nt, Homo sapiens
gcauagccaucacuuagua

SEQ ID NO: 544699 - RNA, 19 nt, Homo sapiens
cagcaaagguguccauuga

SEQ ID NO: 544700 - RNA, 19 nt, Homo sapiens
gcaaagguguccauugaug

SEQ ID NO: 544701 - RNA, 19 nt, Homo sapiens
guauauaacccuuggaaua

SEQ ID NO: 544702 - RNA, 19 nt, Homo sapiens
guaaagccuucagauauuu

SEQ ID NO: 544703 - RNA, 19 nt, Homo sapiens
ucagaacaauggagcaaua

SEQ ID NO: 544704 - RNA, 19 nt, Homo sapiens
caccacaccuccaaagaua

SEQ ID NO: 544705 - RNA, 19 nt, Homo sapiens
caacacaauucuaaagaug

SEQ ID NO: 544706 - RNA, 19 nt, Homo sapiens
cuuaaagggucccagauua

SEQ ID NO: 544707 - RNA, 19 nt, Homo sapiens
gaagaagccaucagaauag

SEQ ID NO: 544708 - RNA, 19 nt, Homo sapiens
aaacacaucagaacucaua

SEQ ID NO: 544709 - RNA, 19 nt, Homo sapiens
ugcaacagguuauggauua

SEQ ID NO: 544710 - RNA, 19 nt, Homo sapiens
gaaauuagggcaauacagu

SEQ ID NO: 544711 - RNA, 19 nt, Homo sapiens
ucaacaaguuacacucaua

SEQ ID NO: 544712 - RNA, 19 nt, Homo sapiens
uguaaagccuucagauauu

SEQ ID NO: 544713 - RNA, 19 nt, Homo sapiens
ggcagauggugacaacuua

SEQ ID NO: 544714 - RNA, 19 nt, Homo sapiens
gagaaggcauuucgaugug

SEQ ID NO: 544715 - RNA, 19 nt, Homo sapiens
ggagucuuaugauggauuu

SEQ ID NO: 544716 - RNA, 19 nt, Homo sapiens
gagaaagaccuuauuacug

SEQ ID NO: 544717 - RNA, 19 nt, Homo sapiens
caacauguacccauaccua

SEQ ID NO: 544718 - RNA, 19 nt, Homo sapiens
gcacccagauugcaguuca

SEQ ID NO: 544719 - RNA, 19 nt, Homo sapiens
ggaacgcacucuguugcua

SEQ ID NO: 544720 - RNA, 19 nt, Homo sapiens
gaaggcauuucgaugugaa

SEQ ID NO: 544721 - RNA, 19 nt, Homo sapiens
ggacaugcuacaagaguaa

SEQ ID NO: 544722 - RNA, 19 nt, Homo sapiens
gaacaauggagcaauaaag

SEQ ID NO: 544723 - RNA, 19 nt, Homo sapiens
caggagaucuacagaaaca

SEQ ID NO: 544724 - RNA, 19 nt, Homo sapiens
gaugguaccacagcauuua

SEQ ID NO: 544725 - RNA, 19 nt, Homo sapiens
gauaauaaaggguguaaag

SEQ ID NO: 544726 - RNA, 19 nt, Homo sapiens
cgccaggguuggaugauua

SEQ ID NO: 544727 - RNA, 19 nt, Homo sapiens
cauacugccucaucagaaa

SEQ ID NO: 544728 - RNA, 19 nt, Homo sapiens
ggagaaagaccuuauuacu

SEQ ID NO: 544729 - RNA, 19 nt, Homo sapiens
aagaguaacugcuaaaucu

SEQ ID NO: 544730 - RNA, 19 nt, Homo sapiens
cuacaagaguaacugcuaa

SEQ ID NO: 544731 - RNA, 19 nt, Homo sapiens
acaaggacaugcuacaaga

SEQ ID NO: 544732 - RNA, 19 nt, Homo sapiens
gguguaaagccuucagaua

SEQ ID NO: 544733 - RNA, 19 nt, Homo sapiens
ggacgacguuguuucuaca

SEQ ID NO: 544734 - RNA, 19 nt, Homo sapiens
gcaacagguuauggauuaa

SEQ ID NO: 544735 - RNA, 19 nt, Homo sapiens
guuguuagcccaaauaaau

SEQ ID NO: 544736 - RNA, 19 nt, Homo sapiens
ggagguagaagauguuguu

SEQ ID NO: 544737 - RNA, 19 nt, Homo sapiens
ggucccagauuacguaugu

SEQ ID NO: 544738 - RNA, 19 nt, Homo sapiens
caggagaaagaccuuauua

SEQ ID NO: 544739 - RNA, 19 nt, Homo sapiens
aaagucuuauggagucuua

SEQ ID NO: 544740 - RNA, 19 nt, Homo sapiens
guacaaggaaguaugaaau

SEQ ID NO: 544741 - RNA, 19 nt, Homo sapiens
cagaauagcgucuagaauc

SEQ ID NO: 544742 - RNA, 19 nt, Homo sapiens
gacaaaagguuuacagaau

SEQ ID NO: 544743 - RNA, 19 nt, Homo sapiens
gcauuucgaugugaauaug

SEQ ID NO: 544744 - RNA, 19 nt, Homo sapiens
guguaaagccuucagauau

SEQ ID NO: 544745 - RNA, 19 nt, Homo sapiens
gaaaagccauauguuugua

SEQ ID NO: 544746 - RNA, 19 nt, Homo sapiens
gcaguacaguuagaagaug

SEQ ID NO: 544747 - RNA, 19 nt, Homo sapiens
ggugacaacuuagaaaaua

SEQ ID NO: 544748 - RNA, 19 nt, Homo sapiens
ggagaaaagccauauguuu

SEQ ID NO: 544749 - RNA, 19 nt, Homo sapiens
ugauggaagugaaagugua

SEQ ID NO: 544750 - RNA, 19 nt, Homo sapiens
ggaacaguaugcagcaaag

SEQ ID NO: 544751 - RNA, 19 nt, Homo sapiens
gaugguaccacagcuuaua

SEQ ID NO: 544752 - RNA, 19 nt, Homo sapiens
gguagaagauguuguuagc

SEQ ID NO: 544753 - RNA, 19 nt, Homo sapiens
ugauggauguggaaaauua

SEQ ID NO: 544754 - RNA, 19 nt, Homo sapiens
ucagagugauucauugugu

SEQ ID NO: 544755 - RNA, 19 nt, Homo sapiens
gcacucuguugcuaugguu

SEQ ID NO: 544756 - RNA, 19 nt, Homo sapiens
gaacgcacucuguugcuau

SEQ ID NO: 544757 - RNA, 19 nt, Homo sapiens
uacagaauauuccaguuug

SEQ ID NO: 544758 - RNA, 19 nt, Homo sapiens
ccagugcaacaaauuauaa

SEQ ID NO: 544759 - RNA, 19 nt, Homo sapiens
ggagaucggccuuaucagu

SEQ ID NO: 544760 - RNA, 19 nt, Homo sapiens
cagagugauucauugugua

SEQ ID NO: 544761 - RNA, 19 nt, Homo sapiens
caacaaguuacacucauau

SEQ ID NO: 544762 - RNA, 19 nt, Homo sapiens
gcagaaggagucuuucauc

SEQ ID NO: 544763 - RNA, 19 nt, Homo sapiens
gcagcauagccaucacuua

SEQ ID NO: 544764 - RNA, 19 nt, Homo sapiens
ggacgaaggaauuguugga

SEQ ID NO: 544765 - RNA, 19 nt, Homo sapiens
gagaaaagccauauguuug

SEQ ID NO: 544766 - RNA, 19 nt, Homo sapiens
ucagugcuuuggaacagua

SEQ ID NO: 544767 - RNA, 19 nt, Homo sapiens
cuacaugcaagacuaguaa

SEQ ID NO: 544768 - RNA, 19 nt, Homo sapiens
guaugaaauuagggcaaua

SEQ ID NO: 544769 - RNA, 19 nt, Homo sapiens
cagaaggagucuuucaucu

SEQ ID NO: 544770 - RNA, 19 nt, Homo sapiens
cagcauagccaucacuuag

SEQ ID NO: 544771 - RNA, 19 nt, Homo sapiens
gauguuguuagcccaaaua

SEQ ID NO: 544772 - RNA, 19 nt, Homo sapiens
gcaggaacgcacucuguug

SEQ ID NO: 544773 - RNA, 19 nt, Homo sapiens
caacagcucaucaucucaa

SEQ ID NO: 544774 - RNA, 19 nt, Homo sapiens
caccaucagugcuuuggaa

SEQ ID NO: 544775 - RNA, 19 nt, Homo sapiens
ggauggaggcgcaacaugu

SEQ ID NO: 544776 - RNA, 19 nt, Homo sapiens
ggagagaaggcauuucgau

SEQ ID NO: 544777 - RNA, 19 nt, Homo sapiens
gcagguacuggaaugauug

SEQ ID NO: 544778 - RNA, 19 nt, Homo sapiens
gacaccaucuuggcaauuc

SEQ ID NO: 544779 - RNA, 19 nt, Homo sapiens
gaagaugguaccacagcuu

SEQ ID NO: 544780 - RNA, 19 nt, Homo sapiens
caaggaaguaugaaauuag

SEQ ID NO: 544781 - RNA, 19 nt, Homo sapiens
ccauauguuuguacaguuc

SEQ ID NO: 544782 - RNA, 19 nt, Homo sapiens
gaggauacacacaggagaa

SEQ ID NO: 544783 - RNA, 19 nt, Homo sapiens
gaaaagccauaucgguguu

SEQ ID NO: 544784 - RNA, 19 nt, Homo sapiens
agaggauggucaagcagua

SEQ ID NO: 544785 - RNA, 19 nt, Homo sapiens
uauggagucuuaugaugga

SEQ ID NO: 544786 - RNA, 19 nt, Homo sapiens
ugauuaauccucagaacaa

SEQ ID NO: 544787 - RNA, 19 nt, Homo sapiens
uuccaaaccuuacaacugu

SEQ ID NO: 544788 - RNA, 19 nt, Homo sapiens
agaaacacaucagaacuca

SEQ ID NO: 544789 - RNA, 19 nt, Homo sapiens
uucaggagaucuacagaaa

SEQ ID NO: 544790 - RNA, 19 nt, Homo sapiens
caggagaucggccuuauca

SEQ ID NO: 544791 - RNA, 19 nt, Homo sapiens
gauggaggcgcaacauguu

SEQ ID NO: 544792 - RNA, 19 nt, Homo sapiens
gcuacaagaguaacugcua

SEQ ID NO: 544793 - RNA, 19 nt, Homo sapiens
gauuaauccucagaacaau

SEQ ID NO: 544794 - RNA, 19 nt, Homo sapiens
acacaaguagccacaguaa

SEQ ID NO: 544795 - RNA, 19 nt, Homo sapiens
cagaauauuccaguuugua

SEQ ID NO: 544796 - RNA, 19 nt, Homo sapiens
ggucgguccuuuacaacau

SEQ ID NO: 544797 - RNA, 19 nt, Homo sapiens
ggaccaaccagauuaauuu

SEQ ID NO: 544798 - RNA, 19 nt, Homo sapiens
gaggagggcuaaggcuuua

SEQ ID NO: 544799 - RNA, 19 nt, Homo sapiens
ggacaucgccuacaucuac

SEQ ID NO: 544800 - RNA, 19 nt, Homo sapiens
ggaagaggguacagcuuug

SEQ ID NO: 544801 - RNA, 19 nt, Homo sapiens
caaggcaggugguguguug

SEQ ID NO: 544802 - RNA, 19 nt, Homo sapiens
ggaaacaaacuuuaugugu

SEQ ID NO: 544803 - RNA, 19 nt, Homo sapiens
ccacuggagucucaauaaa

SEQ ID NO: 544804 - RNA, 19 nt, Homo sapiens
gcacagaucccagacuuug

SEQ ID NO: 544805 - RNA, 19 nt, Homo sapiens
guccagaaauugcuaagaa

SEQ ID NO: 544806 - RNA, 19 nt, Homo sapiens
cuggaagacuuauguuaua

SEQ ID NO: 544807 - RNA, 19 nt, Homo sapiens
gaacagugccuuuuacaaa

SEQ ID NO: 544808 - RNA, 19 nt, Homo sapiens
ccacaggaaacaaacuuua

SEQ ID NO: 544809 - RNA, 19 nt, Homo sapiens
ggagucaguuagaauuguu

SEQ ID NO: 544810 - RNA, 19 nt, Homo sapiens
ggaauuccgccgauacuga

SEQ ID NO: 544811 - RNA, 19 nt, Homo sapiens
caauaaagcucugcaccau

SEQ ID NO: 544812 - RNA, 19 nt, Homo sapiens
gauuccaacuggcugcaua

SEQ ID NO: 544813 - RNA, 19 nt, Homo sapiens
ggaggagggcuaaggcuuu

SEQ ID NO: 544814 - RNA, 19 nt, Homo sapiens
gaccaaccagauuaauuua

SEQ ID NO: 544815 - RNA, 19 nt, Homo sapiens
caucauuuaucuuguggaa

SEQ ID NO: 544816 - RNA, 19 nt, Homo sapiens
caaaacacuucaagacauu

SEQ ID NO: 544817 - RNA, 19 nt, Homo sapiens
guuguugaauguccagaaa

SEQ ID NO: 544818 - RNA, 19 nt, Homo sapiens
cuucagacccaaagcuuua

SEQ ID NO: 544819 - RNA, 19 nt, Homo sapiens
gcaccauccucgcuguuuc

SEQ ID NO: 544820 - RNA, 19 nt, Homo sapiens
gcuggaagacuuauguuau

SEQ ID NO: 544821 - RNA, 19 nt, Homo sapiens
ccaacuggcugcauauagg

SEQ ID NO: 544822 - RNA, 19 nt, Homo sapiens
ggaaucaugcaucggacua

SEQ ID NO: 544823 - RNA, 19 nt, Homo sapiens
gcauauaggagucaguuag

SEQ ID NO: 544824 - RNA, 19 nt, Homo sapiens
uguugaauguccagaaauu

SEQ ID NO: 544825 - RNA, 19 nt, Homo sapiens
ccaagccucuccacuccuu

SEQ ID NO: 544826 - RNA, 19 nt, Homo sapiens
aagcacagaucccagacuu

SEQ ID NO: 544827 - RNA, 19 nt, Homo sapiens
ucccauggcucucccaguu

SEQ ID NO: 544828 - RNA, 19 nt, Homo sapiens
acgagccacugaaggaaua

SEQ ID NO: 544829 - RNA, 19 nt, Homo sapiens
gugcaaagaauagauaguu

SEQ ID NO: 544830 - RNA, 19 nt, Homo sapiens
ggaauacuacacccucaug

SEQ ID NO: 544831 - RNA, 19 nt, Homo sapiens
ccaaguuucuccgcaacaa

SEQ ID NO: 544832 - RNA, 19 nt, Homo sapiens
ucugagugaugaugagauu

SEQ ID NO: 544833 - RNA, 19 nt, Homo sapiens
cuauggaccaaccagauua

SEQ ID NO: 544834 - RNA, 19 nt, Homo sapiens
gccacuggagucucaauaa

SEQ ID NO: 544835 - RNA, 19 nt, Homo sapiens
ggacgagccacugaaggaa

SEQ ID NO: 544836 - RNA, 19 nt, Homo sapiens
agaaauugcuaagaacagu

SEQ ID NO: 544837 - RNA, 19 nt, Homo sapiens
gaauguccagaaauugcua

SEQ ID NO: 544838 - RNA, 19 nt, Homo sapiens
cauauaggagucaguuaga

SEQ ID NO: 544839 - RNA, 19 nt, Homo sapiens
gaagaggguacagcuuugu

SEQ ID NO: 544840 - RNA, 19 nt, Homo sapiens
aggaagaggguacagcuuu

SEQ ID NO: 544841 - RNA, 19 nt, Homo sapiens
uggagugccugcauuccuu

SEQ ID NO: 544842 - RNA, 19 nt, Homo sapiens
gccuggagaugaacuggau

SEQ ID NO: 544843 - RNA, 19 nt, Homo sapiens
acagggaauuccgccgaua

SEQ ID NO: 544844 - RNA, 19 nt, Homo sapiens
uagauaguucugccucuuu

SEQ ID NO: 544845 - RNA, 19 nt, Homo sapiens
caggaaacaaacuuuaugu

SEQ ID NO: 544846 - RNA, 19 nt, Homo sapiens
ucauggacaucgccuacau

SEQ ID NO: 544847 - RNA, 19 nt, Homo sapiens
gaauggggauggggacaaa

SEQ ID NO: 544848 - RNA, 19 nt, Homo sapiens
ggacuacacggaucaaaau

SEQ ID NO: 544849 - RNA, 19 nt, Homo sapiens
caacuggcugcauauagga

SEQ ID NO: 544850 - RNA, 19 nt, Homo sapiens
ugcaaagaauagauaguuc

SEQ ID NO: 544851 - RNA, 19 nt, Homo sapiens
ccagaaauugcuaagaaca

SEQ ID NO: 544852 - RNA, 19 nt, Homo sapiens
cacaggaaacaaacuuuau

SEQ ID NO: 544853 - RNA, 19 nt, Homo sapiens
ugacgugcagguccauaaa

SEQ ID NO: 544854 - RNA, 19 nt, Homo sapiens
cuaagaacagugccuuuua

SEQ ID NO: 544855 - RNA, 19 nt, Homo sapiens
acaggaaacaaacuuuaug

SEQ ID NO: 544856 - RNA, 19 nt, Homo sapiens
ucuccacuccuuccacuuu

SEQ ID NO: 544857 - RNA, 19 nt, Homo sapiens
agauggaugugcccagcaa

SEQ ID NO: 544858 - RNA, 19 nt, Homo sapiens
gccuuugcaucauuuaucu

SEQ ID NO: 544859 - RNA, 19 nt, Homo sapiens
uauaggagucaguuagaau

SEQ ID NO: 544860 - RNA, 19 nt, Homo sapiens
caagguggagguucuguac

SEQ ID NO: 544861 - RNA, 19 nt, Homo sapiens
ugagugaugaugagauugu

SEQ ID NO: 544862 - RNA, 19 nt, Homo sapiens
auauaggagucaguuagaa

SEQ ID NO: 544863 - RNA, 19 nt, Homo sapiens
gcuuuaggcaugauuccaa

SEQ ID NO: 544864 - RNA, 19 nt, Homo sapiens
ggccacuggagucucaaua

SEQ ID NO: 544865 - RNA, 19 nt, Homo sapiens
acaaaacacuucaagacau

SEQ ID NO: 544866 - RNA, 19 nt, Homo sapiens
gcucuuggaggagggcuaa

SEQ ID NO: 544867 - RNA, 19 nt, Homo sapiens
ccaaagcuuuaggcaugau

SEQ ID NO: 544868 - RNA, 19 nt, Homo sapiens
gugacgugcagguccauaa

SEQ ID NO: 544869 - RNA, 19 nt, Homo sapiens
accuggagaccaacaaaua

SEQ ID NO: 544870 - RNA, 19 nt, Homo sapiens
uaagaacagugccuuuuac

SEQ ID NO: 544871 - RNA, 19 nt, Homo sapiens
auaggagucaguuagaauu

SEQ ID NO: 544872 - RNA, 19 nt, Homo sapiens
uauggaccaaccagauuaa

SEQ ID NO: 544873 - RNA, 19 nt, Homo sapiens
ucuauggaccaaccagauu

SEQ ID NO: 544874 - RNA, 19 nt, Homo sapiens
uugcaucauuuaucuugug

SEQ ID NO: 544875 - RNA, 19 nt, Homo sapiens
guguggccuuugcaucauu

SEQ ID NO: 544876 - RNA, 19 nt, Homo sapiens
guguguggccuuugcauca

SEQ ID NO: 544877 - RNA, 19 nt, Homo sapiens
cccaaagcuuuaggcauga

SEQ ID NO: 544878 - RNA, 19 nt, Homo sapiens
uggaccaaccagauuaauu

SEQ ID NO: 544879 - RNA, 19 nt, Homo sapiens
caucgaauucuacgaaggu

SEQ ID NO: 544880 - RNA, 19 nt, Homo sapiens
cagccucuccaucgaauuc

SEQ ID NO: 544881 - RNA, 19 nt, Homo sapiens
uguggccuuugcaucauuu

SEQ ID NO: 544882 - RNA, 19 nt, Homo sapiens
auagauaguucugccucuu

SEQ ID NO: 544883 - RNA, 19 nt, Homo sapiens
gccacaggaaacaaacuuu

SEQ ID NO: 544884 - RNA, 19 nt, Homo sapiens
uaaaugccacaggaaacaa

SEQ ID NO: 544885 - RNA, 19 nt, Homo sapiens
uggaugugcccagcaagua

SEQ ID NO: 544886 - RNA, 19 nt, Homo sapiens
gucagccucuccaucgaau

SEQ ID NO: 544887 - RNA, 19 nt, Homo sapiens
gaaggacuaugacaaauaa

SEQ ID NO: 544888 - RNA, 19 nt, Homo sapiens
ccacaaggcugacgcugua

SEQ ID NO: 544889 - RNA, 19 nt, Homo sapiens
ggaaggacuaugacaaaua

SEQ ID NO: 544890 - RNA, 19 nt, Homo sapiens
ggacaagguugaggaaaga

SEQ ID NO: 544891 - RNA, 19 nt, Homo sapiens
gagaagcccuuugagugua

SEQ ID NO: 544892 - RNA, 19 nt, Homo sapiens
gaaagaagaguuggaguga

SEQ ID NO: 544893 - RNA, 19 nt, Homo sapiens
gggucgagcuuccugauaa

SEQ ID NO: 544894 - RNA, 19 nt, Homo sapiens
gcucucgccuccucuauug

SEQ ID NO: 544895 - RNA, 19 nt, Homo sapiens
gcacugacauggccgucuu

SEQ ID NO: 544896 - RNA, 19 nt, Homo sapiens
gaaggaaggacuaugacaa

SEQ ID NO: 544897 - RNA, 19 nt, Homo sapiens
gaugaaggaaggacuauga

SEQ ID NO: 544898 - RNA, 19 nt, Homo sapiens
gaggaacagugccugaaga

SEQ ID NO: 544899 - RNA, 19 nt, Homo sapiens
aagaagaguuggagugaga

SEQ ID NO: 544900 - RNA, 19 nt, Homo sapiens
acagugggaugaagacgua

SEQ ID NO: 544901 - RNA, 19 nt, Homo sapiens
gcaguggacaguuugauga

SEQ ID NO: 544902 - RNA, 19 nt, Homo sapiens
ugacauggccgucuucugu

SEQ ID NO: 544903 - RNA, 19 nt, Homo sapiens
gaccagagcccuucagucu

SEQ ID NO: 544904 - RNA, 19 nt, Homo sapiens
cuagggagcuacacuaugg

SEQ ID NO: 544905 - RNA, 19 nt, Homo sapiens
ccagcaagauguuugagau

SEQ ID NO: 544906 - RNA, 19 nt, Homo sapiens
gggacaagguugaggaaag

SEQ ID NO: 544907 - RNA, 19 nt, Homo sapiens
caaagaccuuccagcagau

SEQ ID NO: 544908 - RNA, 19 nt, Homo sapiens
gcacuuacuggcucauuca

SEQ ID NO: 544909 - RNA, 19 nt, Homo sapiens
gggcaucuacuccguguug

SEQ ID NO: 544910 - RNA, 19 nt, Homo sapiens
agaagcaucugggcaucua

SEQ ID NO: 544911 - RNA, 19 nt, Homo sapiens
ggacuacucggccaugauc

SEQ ID NO: 544912 - RNA, 19 nt, Homo sapiens
agaagcccuuugaguguaa

SEQ ID NO: 544913 - RNA, 19 nt, Homo sapiens
ucgaguaccuggaggaaca

SEQ ID NO: 544914 - RNA, 19 nt, Homo sapiens
ugaagaugcuggagaccau

SEQ ID NO: 544915 - RNA, 19 nt, Homo sapiens
gcaccagcaagauguuuga

SEQ ID NO: 544916 - RNA, 19 nt, Homo sapiens
gagcccagaaggaaagaaa

SEQ ID NO: 544917 - RNA, 19 nt, Homo sapiens
acacacaggcagacccaua

SEQ ID NO: 544918 - RNA, 19 nt, Homo sapiens
uggaugaccugcuguaugc

SEQ ID NO: 544919 - RNA, 19 nt, Homo sapiens
gcagagcccagaaggaaag

SEQ ID NO: 544920 - RNA, 19 nt, Homo sapiens
ugagaagcccuuugagugu

SEQ ID NO: 544921 - RNA, 19 nt, Homo sapiens
gacuuccucucgccaaaga

SEQ ID NO: 544922 - RNA, 19 nt, Homo sapiens
gcaccauggaucugacaaa

SEQ ID NO: 544923 - RNA, 19 nt, Homo sapiens
gcccuucagucuccacuuc

SEQ ID NO: 544924 - RNA, 19 nt, Homo sapiens
aaggaaggacuaugacaaa

SEQ ID NO: 544925 - RNA, 19 nt, Homo sapiens
gcacaugaagggccacaag

SEQ ID NO: 544926 - RNA, 19 nt, Homo sapiens
gcaaggcucgguaccucaa

SEQ ID NO: 544927 - RNA, 19 nt, Homo sapiens
gaaguucagccucaagcau

SEQ ID NO: 544928 - RNA, 19 nt, Homo sapiens
gugcaaggccaaccagaug

SEQ ID NO: 544929 - RNA, 19 nt, Homo sapiens
aggcugcaguggacaguuu

SEQ ID NO: 544930 - RNA, 19 nt, Homo sapiens
ggaggauagagaagacgua

SEQ ID NO: 544931 - RNA, 19 nt, Homo sapiens
caaggcugacgcuguauug

SEQ ID NO: 544932 - RNA, 19 nt, Homo sapiens
acacuauacuuuggacuuc

SEQ ID NO: 544933 - RNA, 19 nt, Homo sapiens
caggugagaagcccuuuga

SEQ ID NO: 544934 - RNA, 19 nt, Homo sapiens
caccugcgcucacauacag

SEQ ID NO: 544935 - RNA, 19 nt, Homo sapiens
ggugagaagcccuuugagu

SEQ ID NO: 544936 - RNA, 19 nt, Homo sapiens
gauaguuugcggcugagaa

SEQ ID NO: 544937 - RNA, 19 nt, Homo sapiens
gaagaguuggagugagaug

SEQ ID NO: 544938 - RNA, 19 nt, Homo sapiens
guauugagcaugccgucuu

SEQ ID NO: 544939 - RNA, 19 nt, Homo sapiens
ggaggaacagugccugaag

SEQ ID NO: 544940 - RNA, 19 nt, Homo sapiens
agucaacacuauacuuugg

SEQ ID NO: 544941 - RNA, 19 nt, Homo sapiens
ugagaugaaggaaggacua

SEQ ID NO: 544942 - RNA, 19 nt, Homo sapiens
gcagcugcuuccgggauga

SEQ ID NO: 544943 - RNA, 19 nt, Homo sapiens
ccacuucauuuggucuuuc

SEQ ID NO: 544944 - RNA, 19 nt, Homo sapiens
gcaagauguuugagauccu

SEQ ID NO: 544945 - RNA, 19 nt, Homo sapiens
cuacgagugugaguucugu

SEQ ID NO: 544946 - RNA, 19 nt, Homo sapiens
cggccgagauccuggagau

SEQ ID NO: 544947 - RNA, 19 nt, Homo sapiens
gagaugaaggaaggacuau

SEQ ID NO: 544948 - RNA, 19 nt, Homo sapiens
ggauagagaagacguaccu

SEQ ID NO: 544949 - RNA, 19 nt, Homo sapiens
ccacaagcccgaggagauc

SEQ ID NO: 544950 - RNA, 19 nt, Homo sapiens
ccauggacuucagcaccua

SEQ ID NO: 544951 - RNA, 19 nt, Homo sapiens
caccagugcuagggagcua

SEQ ID NO: 544952 - RNA, 19 nt, Homo sapiens
gaggugaagacggagauga

SEQ ID NO: 544953 - RNA, 19 nt, Homo sapiens
gaucgaguaccuggaggaa

SEQ ID NO: 544954 - RNA, 19 nt, Homo sapiens
acgcagagcccagaaggaa

SEQ ID NO: 544955 - RNA, 19 nt, Homo sapiens
gccacaagcccgaggagau

SEQ ID NO: 544956 - RNA, 19 nt, Homo sapiens
cagcuggagacgcacuaua

SEQ ID NO: 544957 - RNA, 19 nt, Homo sapiens
ggaacagugccugaagaug

SEQ ID NO: 544958 - RNA, 19 nt, Homo sapiens
cuaccugugcuauguguga

SEQ ID NO: 544959 - RNA, 19 nt, Homo sapiens
gggagcaccauggaucuga

SEQ ID NO: 544960 - RNA, 19 nt, Homo sapiens
cauccacacgggugagaaa

SEQ ID NO: 544961 - RNA, 19 nt, Homo sapiens
gcuagggagcuacacuaug

SEQ ID NO: 544962 - RNA, 19 nt, Homo sapiens
gugcuagggagcuacacua

SEQ ID NO: 544963 - RNA, 19 nt, Homo sapiens
gauucuggaguaugcauau

SEQ ID NO: 544964 - RNA, 19 nt, Homo sapiens
ggucgagcuuccugauaac

SEQ ID NO: 544965 - RNA, 19 nt, Homo sapiens
aggaaggacuaugacaaau

SEQ ID NO: 544966 - RNA, 19 nt, Homo sapiens
gagccaggaaagaagaguu

SEQ ID NO: 544967 - RNA, 19 nt, Homo sapiens
aggaugcccuggagacaca

SEQ ID NO: 544968 - RNA, 19 nt, Homo sapiens
ucauucagcgggugccaaa

SEQ ID NO: 544969 - RNA, 19 nt, Homo sapiens
gcacaggaagcugcacagu

SEQ ID NO: 544970 - RNA, 19 nt, Homo sapiens
gcaugauccagcugcagaa

SEQ ID NO: 544971 - RNA, 19 nt, Homo sapiens
gcagccgaguccagcaucu

SEQ ID NO: 544972 - RNA, 19 nt, Homo sapiens
gcucgguaccucaagaaca

SEQ ID NO: 544973 - RNA, 19 nt, Homo sapiens
ccacggggcuacugugcaa

SEQ ID NO: 544974 - RNA, 19 nt, Homo sapiens
ggaggaugcccuggagaca

SEQ ID NO: 544975 - RNA, 19 nt, Homo sapiens
gugcacaguuuucgaagga

SEQ ID NO: 544976 - RNA, 19 nt, Homo sapiens
uauugagcaugccgucuuc

SEQ ID NO: 544977 - RNA, 19 nt, Homo sapiens
ggacaguuugaugaccaua

SEQ ID NO: 544978 - RNA, 19 nt, Homo sapiens
agaguuggagugagaugaa

SEQ ID NO: 544979 - RNA, 19 nt, Homo sapiens
caugaucaagcaccugaga

SEQ ID NO: 544980 - RNA, 19 nt, Homo sapiens
gcugagaaugcacuuacug

SEQ ID NO: 544981 - RNA, 19 nt, Homo sapiens
ggugaagacggagaugaug

SEQ ID NO: 544982 - RNA, 19 nt, Homo sapiens
ggaaauaucuucagccaaa

SEQ ID NO: 544983 - RNA, 19 nt, Homo sapiens
caaaugaaauccacaugua

SEQ ID NO: 544984 - RNA, 19 nt, Homo sapiens
gaacaucacuuauuguaca

SEQ ID NO: 544985 - RNA, 19 nt, Homo sapiens
gagaaacccuaugaauuua

SEQ ID NO: 544986 - RNA, 19 nt, Homo sapiens
ucucaaaccuuaucccuua

SEQ ID NO: 544987 - RNA, 19 nt, Homo sapiens
ccacauguauuaacagaaa

SEQ ID NO: 544988 - RNA, 19 nt, Homo sapiens
gaaauacgcacuaggauau

SEQ ID NO: 544989 - RNA, 19 nt, Homo sapiens
gagaagcccuuuguaugua

SEQ ID NO: 544990 - RNA, 19 nt, Homo sapiens
uaccacagcuuacuccuua

SEQ ID NO: 544991 - RNA, 19 nt, Homo sapiens
ggaagaagccugagaagau

SEQ ID NO: 544992 - RNA, 19 nt, Homo sapiens
gagcagagcagaagagauu

SEQ ID NO: 544993 - RNA, 19 nt, Homo sapiens
uguaagagauguggaaaua

SEQ ID NO: 544994 - RNA, 19 nt, Homo sapiens
gauaacauuuccucucaaa

SEQ ID NO: 544995 - RNA, 19 nt, Homo sapiens
gaagaagccugagaagaug

SEQ ID NO: 544996 - RNA, 19 nt, Homo sapiens
gguaauggaugcauauaug

SEQ ID NO: 544997 - RNA, 19 nt, Homo sapiens
gagagaaacccuaugaauu

SEQ ID NO: 544998 - RNA, 19 nt, Homo sapiens
guuuguaccucaucuguua

SEQ ID NO: 544999 - RNA, 19 nt, Homo sapiens
gaaacggauuggaaggaua

SEQ ID NO: 545000 - RNA, 19 nt, Homo sapiens
acagaaagaucccagaauu

SEQ ID NO: 545001 - RNA, 19 nt, Homo sapiens
ggaaauacgcacuaggaua

SEQ ID NO: 545002 - RNA, 19 nt, Homo sapiens
cagaagaaguaccucauaa

SEQ ID NO: 545003 - RNA, 19 nt, Homo sapiens
gagaaagcauugaauauac

SEQ ID NO: 545004 - RNA, 19 nt, Homo sapiens
gcacuaggauauuuacugu

SEQ ID NO: 545005 - RNA, 19 nt, Homo sapiens
agagaaaccuugugaaugu

SEQ ID NO: 545006 - RNA, 19 nt, Homo sapiens
agagaaacccuaugaauuu

SEQ ID NO: 545007 - RNA, 19 nt, Homo sapiens
gagaaagacaugcauauga

SEQ ID NO: 545008 - RNA, 19 nt, Homo sapiens
cagcgaacaucacuuauug

SEQ ID NO: 545009 - RNA, 19 nt, Homo sapiens
gagaaacccuaugaaugua

SEQ ID NO: 545010 - RNA, 19 nt, Homo sapiens
ggaucaaguugcagaauga

SEQ ID NO: 545011 - RNA, 19 nt, Homo sapiens
gcaagaagacaaacuguau

SEQ ID NO: 545012 - RNA, 19 nt, Homo sapiens
gaaagcccaucacgaacaa

SEQ ID NO: 545013 - RNA, 19 nt, Homo sapiens
gaagagaaagacaugcaua

SEQ ID NO: 545014 - RNA, 19 nt, Homo sapiens
gagaagccuuauaaaugua

SEQ ID NO: 545015 - RNA, 19 nt, Homo sapiens
cagagaagccuuauaaaug

SEQ ID NO: 545016 - RNA, 19 nt, Homo sapiens
uaagagauguggaaauauc

SEQ ID NO: 545017 - RNA, 19 nt, Homo sapiens
acacagagaagccuuauaa

SEQ ID NO: 545018 - RNA, 19 nt, Homo sapiens
auagggauaucuugucuua

SEQ ID NO: 545019 - RNA, 19 nt, Homo sapiens
ucacugagcaugagcauuu

SEQ ID NO: 545020 - RNA, 19 nt, Homo sapiens
gagauaauggugaaaguuu

SEQ ID NO: 545021 - RNA, 19 nt, Homo sapiens
gagaagcccuaugguugua

SEQ ID NO: 545022 - RNA, 19 nt, Homo sapiens
gagagaaacccuaugaaug

SEQ ID NO: 545023 - RNA, 19 nt, Homo sapiens
agagaagccuuauaaaugu

SEQ ID NO: 545024 - RNA, 19 nt, Homo sapiens
uaugaaugcucaggaaaua

SEQ ID NO: 545025 - RNA, 19 nt, Homo sapiens
gagagaagcccuuuguaug

SEQ ID NO: 545026 - RNA, 19 nt, Homo sapiens
ggagagaagcccuuuguau

SEQ ID NO: 545027 - RNA, 19 nt, Homo sapiens
gagagaaacuagugaaggu

SEQ ID NO: 545028 - RNA, 19 nt, Homo sapiens
gagcagaagagauuucaaa

SEQ ID NO: 545029 - RNA, 19 nt, Homo sapiens
gaaaugaggaaauaaugga

SEQ ID NO: 545030 - RNA, 19 nt, Homo sapiens
gaagagaaacccugugcuu

SEQ ID NO: 545031 - RNA, 19 nt, Homo sapiens
agaagaugaugcacagaua

SEQ ID NO: 545032 - RNA, 19 nt, Homo sapiens
gaacagccuuuggccagaa

SEQ ID NO: 545033 - RNA, 19 nt, Homo sapiens
gcaaauccaaccuuacuga

SEQ ID NO: 545034 - RNA, 19 nt, Homo sapiens
ucaguacuaucuauuggua

SEQ ID NO: 545035 - RNA, 19 nt, Homo sapiens
ugagaaagcccaucacgaa

SEQ ID NO: 545036 - RNA, 19 nt, Homo sapiens
ggaaaagccuucucucaga

SEQ ID NO: 545037 - RNA, 19 nt, Homo sapiens
ggagagaaacccuaugaau

SEQ ID NO: 545038 - RNA, 19 nt, Homo sapiens
ggagagaaaccuugugaau

SEQ ID NO: 545039 - RNA, 19 nt, Homo sapiens
ggagagaaacccuaugaau

SEQ ID NO: 545040 - RNA, 19 nt, Homo sapiens
ggacuugcucucuauguaa

SEQ ID NO: 545041 - RNA, 19 nt, Homo sapiens
gggauaucuugucuuauuu

SEQ ID NO: 545042 - RNA, 19 nt, Homo sapiens
agggauaucuugucuuauu

SEQ ID NO: 545043 - RNA, 19 nt, Homo sapiens
cagcagagauaauggugaa

SEQ ID NO: 545044 - RNA, 19 nt, Homo sapiens
gcgaacaucacuuauugua

SEQ ID NO: 545045 - RNA, 19 nt, Homo sapiens
gagagaaagcauugaauau

SEQ ID NO: 545046 - RNA, 19 nt, Homo sapiens
cauaugaccuugggaauag

SEQ ID NO: 545047 - RNA, 19 nt, Homo sapiens
gcauaugaccuugggaaua

SEQ ID NO: 545048 - RNA, 19 nt, Homo sapiens
agaaagacaugcauaugau

SEQ ID NO: 545049 - RNA, 19 nt, Homo sapiens
gauucuggauugugguaua

SEQ ID NO: 545050 - RNA, 19 nt, Homo sapiens
gaaagacaugcauaugauu

SEQ ID NO: 545051 - RNA, 19 nt, Homo sapiens
caaacuguaugguggagaa

SEQ ID NO: 545052 - RNA, 19 nt, Homo sapiens
guguaaaugucuuugguuu

SEQ ID NO: 545053 - RNA, 19 nt, Homo sapiens
ugagggagguuguguagga

SEQ ID NO: 545054 - RNA, 19 nt, Homo sapiens
ggauggacuugcucucuau

SEQ ID NO: 545055 - RNA, 19 nt, Homo sapiens
uauuaagacuccuguggua

SEQ ID NO: 545056 - RNA, 19 nt, Homo sapiens
gcccuuagcuagaugacaa

SEQ ID NO: 545057 - RNA, 19 nt, Homo sapiens
ugauaaaccuuacgaaugc

SEQ ID NO: 545058 - RNA, 19 nt, Homo sapiens
gaagucaaaccucaucaga

SEQ ID NO: 545059 - RNA, 19 nt, Homo sapiens
gaacuguuacucauauguu

SEQ ID NO: 545060 - RNA, 19 nt, Homo sapiens
gaguaugaaugcucaggaa

SEQ ID NO: 545061 - RNA, 19 nt, Homo sapiens
gaagucacaccacauuaga

SEQ ID NO: 545062 - RNA, 19 nt, Homo sapiens
guguaaagauugcgggaaa

SEQ ID NO: 545063 - RNA, 19 nt, Homo sapiens
ucucagaucguauuuguuu

SEQ ID NO: 545064 - RNA, 19 nt, Homo sapiens
ggauugugguauagggaua

SEQ ID NO: 545065 - RNA, 19 nt, Homo sapiens
gaaagaucccagaauuguu

SEQ ID NO: 545066 - RNA, 19 nt, Homo sapiens
cgaacaauaugggaaauuc

SEQ ID NO: 545067 - RNA, 19 nt, Homo sapiens
agagaaacccuaugaaugu

SEQ ID NO: 545068 - RNA, 19 nt, Homo sapiens
gagagaagccuuuuaaaug

SEQ ID NO: 545069 - RNA, 19 nt, Homo sapiens
gcagaaugauacagauagu

SEQ ID NO: 545070 - RNA, 19 nt, Homo sapiens
gggaucaaguugcagaaug

SEQ ID NO: 545071 - RNA, 19 nt, Homo sapiens
gauauuuacuguggcuuga

SEQ ID NO: 545072 - RNA, 19 nt, Homo sapiens
ggacuugggaggcauguug

SEQ ID NO: 545073 - RNA, 19 nt, Homo sapiens
gcgagaagcuuuucgaaug

SEQ ID NO: 545074 - RNA, 19 nt, Homo sapiens
guucucagaucguauuugu

SEQ ID NO: 545075 - RNA, 19 nt, Homo sapiens
cauuuccucucaaaccuua

SEQ ID NO: 545076 - RNA, 19 nt, Homo sapiens
guacaugugaggauucauu

SEQ ID NO: 545077 - RNA, 19 nt, Homo sapiens
gaauguaacgaauguggaa

SEQ ID NO: 545078 - RNA, 19 nt, Homo sapiens
gaagaaguaccucauaaaa

SEQ ID NO: 545079 - RNA, 19 nt, Homo sapiens
gagagaaaccuugugaaug

SEQ ID NO: 545080 - RNA, 19 nt, Homo sapiens
agagagaaagcauugaaua

SEQ ID NO: 545081 - RNA, 19 nt, Homo sapiens
gacaagcccuuagcuagau

SEQ ID NO: 545082 - RNA, 19 nt, Homo sapiens
gaacagagccugaccaaga

SEQ ID NO: 545083 - RNA, 19 nt, Homo sapiens
gcagaacucuccuuggaua

SEQ ID NO: 545084 - RNA, 19 nt, Homo sapiens
ugaagaaggucuccaaaga

SEQ ID NO: 545085 - RNA, 19 nt, Homo sapiens
gaacucuccuuggauaauu

SEQ ID NO: 545086 - RNA, 19 nt, Homo sapiens
caaggaagauaaaggaaga

SEQ ID NO: 545087 - RNA, 19 nt, Homo sapiens
gaccgcagcugcacaagaa

SEQ ID NO: 545088 - RNA, 19 nt, Homo sapiens
caaacuaacugucauguac

SEQ ID NO: 545089 - RNA, 19 nt, Homo sapiens
caacaagaauacacggaaa

SEQ ID NO: 545090 - RNA, 19 nt, Homo sapiens
caacaccgcccacaacaaa

SEQ ID NO: 545091 - RNA, 19 nt, Homo sapiens
caacaaagccagucuacau

SEQ ID NO: 545092 - RNA, 19 nt, Homo sapiens
ccagcaagcuucccacguu

SEQ ID NO: 545093 - RNA, 19 nt, Homo sapiens
gcggaugacugcaaacaga

SEQ ID NO: 545094 - RNA, 19 nt, Homo sapiens
cgagagcacuggaugaugu

SEQ ID NO: 545095 - RNA, 19 nt, Homo sapiens
gcaaguuugacaccauuua

SEQ ID NO: 545096 - RNA, 19 nt, Homo sapiens
gaaaagaaauccaagaaac

SEQ ID NO: 545097 - RNA, 19 nt, Homo sapiens
ggaaaugaaggcucucuug

SEQ ID NO: 545098 - RNA, 19 nt, Homo sapiens
gagaccaccucgacaagga

SEQ ID NO: 545099 - RNA, 19 nt, Homo sapiens
ggacuuuacugaggcuuug

SEQ ID NO: 545100 - RNA, 19 nt, Homo sapiens
gaacaguuaguggauuuaa

SEQ ID NO: 545101 - RNA, 19 nt, Homo sapiens
gaacucaacaucucucaag

SEQ ID NO: 545102 - RNA, 19 nt, Homo sapiens
gaaacaggcagcaggaugu

SEQ ID NO: 545103 - RNA, 19 nt, Homo sapiens
caacaaaguggcucuguca

SEQ ID NO: 545104 - RNA, 19 nt, Homo sapiens
gaaggucuccaaagaggaa

SEQ ID NO: 545105 - RNA, 19 nt, Homo sapiens
ugacaccauuuaucagauu

SEQ ID NO: 545106 - RNA, 19 nt, Homo sapiens
cggaacaguuaguggauuu

SEQ ID NO: 545107 - RNA, 19 nt, Homo sapiens
cgaggaaucucaacaaagc

SEQ ID NO: 545108 - RNA, 19 nt, Homo sapiens
gcaacgugguggagcaguu

SEQ ID NO: 545109 - RNA, 19 nt, Homo sapiens
gaagaaggucuccaaagag

SEQ ID NO: 545110 - RNA, 19 nt, Homo sapiens
gggaugaguucgaguuucu

SEQ ID NO: 545111 - RNA, 19 nt, Homo sapiens
ggccugcacugcuacaaga

SEQ ID NO: 545112 - RNA, 19 nt, Homo sapiens
cagcaagcuucccacguuu

SEQ ID NO: 545113 - RNA, 19 nt, Homo sapiens
cgacaaggaagauaaagga

SEQ ID NO: 545114 - RNA, 19 nt, Homo sapiens
cagcaaguuugacaccauu

SEQ ID NO: 545115 - RNA, 19 nt, Homo sapiens
ucagagugcuauacaguag

SEQ ID NO: 545116 - RNA, 19 nt, Homo sapiens
agagugagauccagaccuu

SEQ ID NO: 545117 - RNA, 19 nt, Homo sapiens
caacugugaccacggcuuu

SEQ ID NO: 545118 - RNA, 19 nt, Homo sapiens
agaagagggucaacagcaa

SEQ ID NO: 545119 - RNA, 19 nt, Homo sapiens
aggcagaacucuccuugga

SEQ ID NO: 545120 - RNA, 19 nt, Homo sapiens
ccuggaguauuacauuaaa

SEQ ID NO: 545121 - RNA, 19 nt, Homo sapiens
gcacaaacuaacugucaug

SEQ ID NO: 545122 - RNA, 19 nt, Homo sapiens
gcaaauguucccagcacaa

SEQ ID NO: 545123 - RNA, 19 nt, Homo sapiens
ccacggcuuugucaucuuc

SEQ ID NO: 545124 - RNA, 19 nt, Homo sapiens
gcacaauaacguggagaaa

SEQ ID NO: 545125 - RNA, 19 nt, Homo sapiens
ugagagugauuguguugug

SEQ ID NO: 545126 - RNA, 19 nt, Homo sapiens
uggagcagcuacaacaaga

SEQ ID NO: 545127 - RNA, 19 nt, Homo sapiens
gugcauggccuccuucugu

SEQ ID NO: 545128 - RNA, 19 nt, Homo sapiens
acaaucggcugcgggaauu

SEQ ID NO: 545129 - RNA, 19 nt, Homo sapiens
agguggagcugcagaagaa

SEQ ID NO: 545130 - RNA, 19 nt, Homo sapiens
aagaauacacggaaaugaa

SEQ ID NO: 545131 - RNA, 19 nt, Homo sapiens
caagaauacacggaaauga

SEQ ID NO: 545132 - RNA, 19 nt, Homo sapiens
ggugggaggugggauuuag

SEQ ID NO: 545133 - RNA, 19 nt, Homo sapiens
gaccacggcuuugucaucu

SEQ ID NO: 545134 - RNA, 19 nt, Homo sapiens
ggaacaguuaguggauuua

SEQ ID NO: 545135 - RNA, 19 nt, Homo sapiens
ggagaaagcaucaaaacug

SEQ ID NO: 545136 - RNA, 19 nt, Homo sapiens
gagcagcuacaacaagaau

SEQ ID NO: 545137 - RNA, 19 nt, Homo sapiens
gagugcaucugccacaucu

SEQ ID NO: 545138 - RNA, 19 nt, Homo sapiens
ggaaaagaaauccaagaaa

SEQ ID NO: 545139 - RNA, 19 nt, Homo sapiens
gagggucaacagcaaguuu

SEQ ID NO: 545140 - RNA, 19 nt, Homo sapiens
cauccgaacucaacaucuc

SEQ ID NO: 545141 - RNA, 19 nt, Homo sapiens
gagggaugaguucgaguuu

SEQ ID NO: 545142 - RNA, 19 nt, Homo sapiens
uaucagauucuccucaaga

SEQ ID NO: 545143 - RNA, 19 nt, Homo sapiens
gggcgugcuucucaacugu

SEQ ID NO: 545144 - RNA, 19 nt, Homo sapiens
ugaaggaggagauugaaca

SEQ ID NO: 545145 - RNA, 19 nt, Homo sapiens
caaguuugacaccauuuau

SEQ ID NO: 545146 - RNA, 19 nt, Homo sapiens
ggugggauuuagccaggaa

SEQ ID NO: 545147 - RNA, 19 nt, Homo sapiens
caccugauguauaaguuca

SEQ ID NO: 545148 - RNA, 19 nt, Homo sapiens
gcagcuacaacaagaauac

SEQ ID NO: 545149 - RNA, 19 nt, Homo sapiens
ggaugacugcaaacagaaa

SEQ ID NO: 545150 - RNA, 19 nt, Homo sapiens
ucugggaagugaagucaug

SEQ ID NO: 545151 - RNA, 19 nt, Homo sapiens
ggugagagugauuguguug

SEQ ID NO: 545152 - RNA, 19 nt, Homo sapiens
gcucacauccgaacucaac

SEQ ID NO: 545153 - RNA, 19 nt, Homo sapiens
agaacacggugcugugcaa

SEQ ID NO: 545154 - RNA, 19 nt, Homo sapiens
ucagagaccaccucgacaa

SEQ ID NO: 545155 - RNA, 19 nt, Homo sapiens
ccaagacccuagugaaaau

SEQ ID NO: 545156 - RNA, 19 nt, Homo sapiens
uaaaggaagaggagaagag

SEQ ID NO: 545157 - RNA, 19 nt, Homo sapiens
ugcgaggaaucucaacaaa

SEQ ID NO: 545158 - RNA, 19 nt, Homo sapiens
ugaccaagagggaugaguu

SEQ ID NO: 545159 - RNA, 19 nt, Homo sapiens
ccauagccuucagaucuug

SEQ ID NO: 545160 - RNA, 19 nt, Homo sapiens
agucaugagugcccgauuc

SEQ ID NO: 545161 - RNA, 19 nt, Homo sapiens
gaaaauacagcaggcagaa

SEQ ID NO: 545162 - RNA, 19 nt, Homo sapiens
aaaugaaggcucucuugga

SEQ ID NO: 545163 - RNA, 19 nt, Homo sapiens
gaaagguggagcagcuaca

SEQ ID NO: 545164 - RNA, 19 nt, Homo sapiens
gcgugcuucucaacuguga

SEQ ID NO: 545165 - RNA, 19 nt, Homo sapiens
gagguggagcugcagaaga

SEQ ID NO: 545166 - RNA, 19 nt, Homo sapiens
uagcuucuguggcugagau

SEQ ID NO: 545167 - RNA, 19 nt, Homo sapiens
gagcaccauagaccucaaa

SEQ ID NO: 545168 - RNA, 19 nt, Homo sapiens
gaccaagagggaugaguuc

SEQ ID NO: 545169 - RNA, 19 nt, Homo sapiens
acaaacuaacugucaugua

SEQ ID NO: 545170 - RNA, 19 nt, Homo sapiens
gauaaaggaagaggagaag

SEQ ID NO: 545171 - RNA, 19 nt, Homo sapiens
gacaaggaagauaaaggaa

SEQ ID NO: 545172 - RNA, 19 nt, Homo sapiens
caaauguucccagcacaau

SEQ ID NO: 545173 - RNA, 19 nt, Homo sapiens
gggugagagugauuguguu

SEQ ID NO: 545174 - RNA, 19 nt, Homo sapiens
ucccaagacccuagugaaa

SEQ ID NO: 545175 - RNA, 19 nt, Homo sapiens
cagcucacauccgaacuca

SEQ ID NO: 545176 - RNA, 19 nt, Homo sapiens
gacaccauuuaucagauuc

SEQ ID NO: 545177 - RNA, 19 nt, Homo sapiens
gccuucagaucuugguguu

SEQ ID NO: 545178 - RNA, 19 nt, Homo sapiens
uccauagccuucagaucuu

SEQ ID NO: 545179 - RNA, 19 nt, Homo sapiens
gucagagugcuauacagua

SEQ ID NO: 545180 - RNA, 19 nt, Homo sapiens
gaaaauccauagccuucag

SEQ ID NO: 545181 - RNA, 19 nt, Homo sapiens
gagugcccgauuccucuua

SEQ ID NO: 545182 - RNA, 19 nt, Homo sapiens
ggacaaaucugaccugaaa

SEQ ID NO: 545183 - RNA, 19 nt, Homo sapiens
gagcaaaguuucaaaguau

SEQ ID NO: 545184 - RNA, 19 nt, Homo sapiens
uggaauagcuacucaauuu

SEQ ID NO: 545185 - RNA, 19 nt, Homo sapiens
gaucguguauugaaacaua

SEQ ID NO: 545186 - RNA, 19 nt, Homo sapiens
gaacagaucguguauugaa

SEQ ID NO: 545187 - RNA, 19 nt, Homo sapiens
gaaaugagacaacaggaua

SEQ ID NO: 545188 - RNA, 19 nt, Homo sapiens
gguagaaacucaaccauga

SEQ ID NO: 545189 - RNA, 19 nt, Homo sapiens
ccaccaagcuuaccaaaug

SEQ ID NO: 545190 - RNA, 19 nt, Homo sapiens
ggagugcuguacagauuua

SEQ ID NO: 545191 - RNA, 19 nt, Homo sapiens
cagaacagaucguguauug

SEQ ID NO: 545192 - RNA, 19 nt, Homo sapiens
gaaauaauacuggcacuuu

SEQ ID NO: 545193 - RNA, 19 nt, Homo sapiens
ggaaacacaugaaagacuu

SEQ ID NO: 545194 - RNA, 19 nt, Homo sapiens
gaugaaguguuacaagaaa

SEQ ID NO: 545195 - RNA, 19 nt, Homo sapiens
gauaauaacugcauuucgu

SEQ ID NO: 545196 - RNA, 19 nt, Homo sapiens
gcacugcaaugcugccuuu

SEQ ID NO: 545197 - RNA, 19 nt, Homo sapiens
aaacguaugugccaugaaa

SEQ ID NO: 545198 - RNA, 19 nt, Homo sapiens
ggacuacaguaugcacuua

SEQ ID NO: 545199 - RNA, 19 nt, Homo sapiens
uaagagcaaugcguaauaa

SEQ ID NO: 545200 - RNA, 19 nt, Homo sapiens
gaagaugcgucaggagaaa

SEQ ID NO: 545201 - RNA, 19 nt, Homo sapiens
gcacuuaaugucccuauaa

SEQ ID NO: 545202 - RNA, 19 nt, Homo sapiens
gcaggaauacuccaaguuu

SEQ ID NO: 545203 - RNA, 19 nt, Homo sapiens
gagauauccuucaguguug

SEQ ID NO: 545204 - RNA, 19 nt, Homo sapiens
gaaauacacccaccuaagu

SEQ ID NO: 545205 - RNA, 19 nt, Homo sapiens
ugaggaagauucuggcuuu

SEQ ID NO: 545206 - RNA, 19 nt, Homo sapiens
gaggauggaucacuugguu

SEQ ID NO: 545207 - RNA, 19 nt, Homo sapiens
ggaauagcuacucaauuua

SEQ ID NO: 545208 - RNA, 19 nt, Homo sapiens
agaauaugcuguugaaaug

SEQ ID NO: 545209 - RNA, 19 nt, Homo sapiens
cuggaaggauuguuucuua

SEQ ID NO: 545210 - RNA, 19 nt, Homo sapiens
ggaaucggauggcauaagu

SEQ ID NO: 545211 - RNA, 19 nt, Homo sapiens
gaacaacuccagauaaguc

SEQ ID NO: 545212 - RNA, 19 nt, Homo sapiens
ggacagaacuagccaaaau

SEQ ID NO: 545213 - RNA, 19 nt, Homo sapiens
caagcauccucaucagaua

SEQ ID NO: 545214 - RNA, 19 nt, Homo sapiens
ggaggaaucggauggcaua

SEQ ID NO: 545215 - RNA, 19 nt, Homo sapiens
ggaaucagcagcuuggaaa

SEQ ID NO: 545216 - RNA, 19 nt, Homo sapiens
acaagaaagugaaaugaga

SEQ ID NO: 545217 - RNA, 19 nt, Homo sapiens
cagaugaaguguuacaaga

SEQ ID NO: 545218 - RNA, 19 nt, Homo sapiens
gaauuucccuuggugaaug

SEQ ID NO: 545219 - RNA, 19 nt, Homo sapiens
uaagaacaacuccagauaa

SEQ ID NO: 545220 - RNA, 19 nt, Homo sapiens
agagcaaaguuucaaagua

SEQ ID NO: 545221 - RNA, 19 nt, Homo sapiens
gaacauugacgacaaacug

SEQ ID NO: 545222 - RNA, 19 nt, Homo sapiens
ugaacugccuuacauguug

SEQ ID NO: 545223 - RNA, 19 nt, Homo sapiens
ggaaggauuguuucuuaaa

SEQ ID NO: 545224 - RNA, 19 nt, Homo sapiens
gcaugaacauugacgacaa

SEQ ID NO: 545225 - RNA, 19 nt, Homo sapiens
gaggauuucugaagccuau

SEQ ID NO: 545226 - RNA, 19 nt, Homo sapiens
gauggaaacacaugaaaga

SEQ ID NO: 545227 - RNA, 19 nt, Homo sapiens
gauccuugcugcagaugaa

SEQ ID NO: 545228 - RNA, 19 nt, Homo sapiens
gaucagaaacuugcuauuc

SEQ ID NO: 545229 - RNA, 19 nt, Homo sapiens
uaauagagcugggaugaca

SEQ ID NO: 545230 - RNA, 19 nt, Homo sapiens
gauaauagagcugggauga

SEQ ID NO: 545231 - RNA, 19 nt, Homo sapiens
gcacugaauguggagauua

SEQ ID NO: 545232 - RNA, 19 nt, Homo sapiens
guaaaccugugcauaguag

SEQ ID NO: 545233 - RNA, 19 nt, Homo sapiens
uugaauagcccgagccuua

SEQ ID NO: 545234 - RNA, 19 nt, Homo sapiens
ucagagacaugagaagauu

SEQ ID NO: 545235 - RNA, 19 nt, Homo sapiens
gagacaacaggauaugaua

SEQ ID NO: 545236 - RNA, 19 nt, Homo sapiens
gagcaaugcguaauaacaa

SEQ ID NO: 545237 - RNA, 19 nt, Homo sapiens
gaagagagcaaaguuucaa

SEQ ID NO: 545238 - RNA, 19 nt, Homo sapiens
ggagaaauacacccaccua

SEQ ID NO: 545239 - RNA, 19 nt, Homo sapiens
caucuggaauggacaaaga

SEQ ID NO: 545240 - RNA, 19 nt, Homo sapiens
cagcauuccuuuccuugaa

SEQ ID NO: 545241 - RNA, 19 nt, Homo sapiens
uaugaaagguagaaacuca

SEQ ID NO: 545242 - RNA, 19 nt, Homo sapiens
uagaagcaaugcauuacuu

SEQ ID NO: 545243 - RNA, 19 nt, Homo sapiens
gaauagcuacucaauuuag

SEQ ID NO: 545244 - RNA, 19 nt, Homo sapiens
gggaauaugcgcugaaugu

SEQ ID NO: 545245 - RNA, 19 nt, Homo sapiens
gacaugcguuucauacaga

SEQ ID NO: 545246 - RNA, 19 nt, Homo sapiens
gaacuaucacuuacagaga

SEQ ID NO: 545247 - RNA, 19 nt, Homo sapiens
acucaaccaugauuucuuu

SEQ ID NO: 545248 - RNA, 19 nt, Homo sapiens
gcagcaggcuuuggacaga

SEQ ID NO: 545249 - RNA, 19 nt, Homo sapiens
aaugauuacuugccuguuu

SEQ ID NO: 545250 - RNA, 19 nt, Homo sapiens
ggugaccgcugacgacuuc

SEQ ID NO: 545251 - RNA, 19 nt, Homo sapiens
gcuacaggauucaguacuu

SEQ ID NO: 545252 - RNA, 19 nt, Homo sapiens
gaacugccuuacauguugu

SEQ ID NO: 545253 - RNA, 19 nt, Homo sapiens
ggaucaagcucccaagcau

SEQ ID NO: 545254 - RNA, 19 nt, Homo sapiens
gccaguagacuuacagaaa

SEQ ID NO: 545255 - RNA, 19 nt, Homo sapiens
cagagagccaguagacuua

SEQ ID NO: 545256 - RNA, 19 nt, Homo sapiens
uaccacggcauccauauua

SEQ ID NO: 545257 - RNA, 19 nt, Homo sapiens
agacucuguuggaucauua

SEQ ID NO: 545258 - RNA, 19 nt, Homo sapiens
gagaaauacacccaccuaa

SEQ ID NO: 545259 - RNA, 19 nt, Homo sapiens
cauaagagaacucauagug

SEQ ID NO: 545260 - RNA, 19 nt, Homo sapiens
uagaacgaacuaucacuua

SEQ ID NO: 545261 - RNA, 19 nt, Homo sapiens
cuaagaacaacuccagaua

SEQ ID NO: 545262 - RNA, 19 nt, Homo sapiens
ugagauauccuucaguguu

SEQ ID NO: 545263 - RNA, 19 nt, Homo sapiens
cagaauaugcuguugaaau

SEQ ID NO: 545264 - RNA, 19 nt, Homo sapiens
caugaacauugacgacaaa

SEQ ID NO: 545265 - RNA, 19 nt, Homo sapiens
gaacagauuaaucaagagu

SEQ ID NO: 545266 - RNA, 19 nt, Homo sapiens
gaacgaacuaucacuuaca

SEQ ID NO: 545267 - RNA, 19 nt, Homo sapiens
ggagauccuugcugcagau

SEQ ID NO: 545268 - RNA, 19 nt, Homo sapiens
gcugauauacgaugauaau

SEQ ID NO: 545269 - RNA, 19 nt, Homo sapiens
aaguuaagcugauauacga

SEQ ID NO: 545270 - RNA, 19 nt, Homo sapiens
aaugaauucuccacuaaga

SEQ ID NO: 545271 - RNA, 19 nt, Homo sapiens
gggaugggcguuugccuaa

SEQ ID NO: 545272 - RNA, 19 nt, Homo sapiens
ggagcaaaaucaaacaauu

SEQ ID NO: 545273 - RNA, 19 nt, Homo sapiens
aguauaugguugcagaaua

SEQ ID NO: 545274 - RNA, 19 nt, Homo sapiens
ugaugaaugugguaugaga

SEQ ID NO: 545275 - RNA, 19 nt, Homo sapiens
gaaauucaagcacgugauc

SEQ ID NO: 545276 - RNA, 19 nt, Homo sapiens
ccacaacuggccagacuuu

SEQ ID NO: 545277 - RNA, 19 nt, Homo sapiens
agggacaagugcugaauuu

SEQ ID NO: 545278 - RNA, 19 nt, Homo sapiens
aagaacaacuccagauaag

SEQ ID NO: 545279 - RNA, 19 nt, Homo sapiens
gcccgagccuuaacuuugu

SEQ ID NO: 545280 - RNA, 19 nt, Homo sapiens
cacugaauguggagauuaa

SEQ ID NO: 545281 - RNA, 19 nt, Homo sapiens
ccaguaaaccugugcauag

SEQ ID NO: 545282 - RNA, 19 nt, Homo sapiens
gcaaagcugugaagcaagu

SEQ ID NO: 545283 - RNA, 19 nt, Homo sapiens
gagccaagcuggaguuuac

SEQ ID NO: 545284 - RNA, 19 nt, Homo sapiens
gaacgagaaugaggaguca

SEQ ID NO: 545285 - RNA, 19 nt, Homo sapiens
gguggacgguguucacuuu

SEQ ID NO: 545286 - RNA, 19 nt, Homo sapiens
ggacuucuaucagcaguau

SEQ ID NO: 545287 - RNA, 19 nt, Homo sapiens
ggugggagcugcagugaca

SEQ ID NO: 545288 - RNA, 19 nt, Homo sapiens
ccaagcacaucaucauuca

SEQ ID NO: 545289 - RNA, 19 nt, Homo sapiens
ccuucugacuguuuauuua

SEQ ID NO: 545290 - RNA, 19 nt, Homo sapiens
gcacagccagcaugucuug

SEQ ID NO: 545291 - RNA, 19 nt, Homo sapiens
ggacauggcagguaaugag

SEQ ID NO: 545292 - RNA, 19 nt, Homo sapiens
agagaagccuuaccugugu

SEQ ID NO: 545293 - RNA, 19 nt, Homo sapiens
ggacgcagcacacccauag

SEQ ID NO: 545294 - RNA, 19 nt, Homo sapiens
ugaagcaagugcaggaaga

SEQ ID NO: 545295 - RNA, 19 nt, Homo sapiens
gugcagagcagacagagaa

SEQ ID NO: 545296 - RNA, 19 nt, Homo sapiens
ggacgguguucacuuuaag

SEQ ID NO: 545297 - RNA, 19 nt, Homo sapiens
ccaguuggccaaucauauu

SEQ ID NO: 545298 - RNA, 19 nt, Homo sapiens
gaagagcuaccgccucauc

SEQ ID NO: 545299 - RNA, 19 nt, Homo sapiens
gacagacgcggacuucuau

SEQ ID NO: 545300 - RNA, 19 nt, Homo sapiens
agacagacgcggacuucua

SEQ ID NO: 545301 - RNA, 19 nt, Homo sapiens
gcagcaaggccuucgugaa

SEQ ID NO: 545302 - RNA, 19 nt, Homo sapiens
caagaaguucaaccaggua

SEQ ID NO: 545303 - RNA, 19 nt, Homo sapiens
ccgaggagaacgagaauga

SEQ ID NO: 545304 - RNA, 19 nt, Homo sapiens
ccacuuuccuccaaaugca

SEQ ID NO: 545305 - RNA, 19 nt, Homo sapiens
cuagagagaauaaauugga

SEQ ID NO: 545306 - RNA, 19 nt, Homo sapiens
agccuuaccugugugauaa

SEQ ID NO: 545307 - RNA, 19 nt, Homo sapiens
gcaaggccuucgugaacgu

SEQ ID NO: 545308 - RNA, 19 nt, Homo sapiens
cccuacagcuccugaaugu

SEQ ID NO: 545309 - RNA, 19 nt, Homo sapiens
ggacaagagagccaaagag

SEQ ID NO: 545310 - RNA, 19 nt, Homo sapiens
gaagcaagugcaggaagaa

SEQ ID NO: 545311 - RNA, 19 nt, Homo sapiens
gcaaggcaggcaucaagau

SEQ ID NO: 545312 - RNA, 19 nt, Homo sapiens
caacauccgcccacacaag

SEQ ID NO: 545313 - RNA, 19 nt, Homo sapiens
gacaacauccgcccacaca

SEQ ID NO: 545314 - RNA, 19 nt, Homo sapiens
uggacgguguucacuuuaa

SEQ ID NO: 545315 - RNA, 19 nt, Homo sapiens
gcagagaccuccccuacag

SEQ ID NO: 545316 - RNA, 19 nt, Homo sapiens
aaucugagccauggacuuu

SEQ ID NO: 545317 - RNA, 19 nt, Homo sapiens
gcccugagaacguggauga

SEQ ID NO: 545318 - RNA, 19 nt, Homo sapiens
gugcaaggcccaugagaag

SEQ ID NO: 545319 - RNA, 19 nt, Homo sapiens
ggagccaagcuggaguuua

SEQ ID NO: 545320 - RNA, 19 nt, Homo sapiens
cagccagcaugucuuggaa

SEQ ID NO: 545321 - RNA, 19 nt, Homo sapiens
gggcaaggcaggcaucaag

SEQ ID NO: 545322 - RNA, 19 nt, Homo sapiens
cugagaacguggaugaugu

SEQ ID NO: 545323 - RNA, 19 nt, Homo sapiens
acacuggagagaagccuua

SEQ ID NO: 545324 - RNA, 19 nt, Homo sapiens
gccagcaugucuuggaaca

SEQ ID NO: 545325 - RNA, 19 nt, Homo sapiens
cagcaaggccuucgugaac

SEQ ID NO: 545326 - RNA, 19 nt, Homo sapiens
cggcccuucugacuguuua

SEQ ID NO: 545327 - RNA, 19 nt, Homo sapiens
gaaggccgagaucagcaaa

SEQ ID NO: 545328 - RNA, 19 nt, Homo sapiens
uuaccugugugauaagugu

SEQ ID NO: 545329 - RNA, 19 nt, Homo sapiens
gagagugugggaagcaguu

SEQ ID NO: 545330 - RNA, 19 nt, Homo sapiens
ugcugaaccugcacaagaa

SEQ ID NO: 545331 - RNA, 19 nt, Homo sapiens
gcaaggcccaugagaagac

SEQ ID NO: 545332 - RNA, 19 nt, Homo sapiens
gcagcgaguacuucaagau

SEQ ID NO: 545333 - RNA, 19 nt, Homo sapiens
ccaaaugcaggacaucauc

SEQ ID NO: 545334 - RNA, 19 nt, Homo sapiens
caggcaaacugucagaaaa

SEQ ID NO: 545335 - RNA, 19 nt, Homo sapiens
gggacaagagagccaaaga

SEQ ID NO: 545336 - RNA, 19 nt, Homo sapiens
gccaugcccucaagucacu

SEQ ID NO: 545337 - RNA, 19 nt, Homo sapiens
caaaugcaggacaucauca

SEQ ID NO: 545338 - RNA, 19 nt, Homo sapiens
gcacguccgcauucacaca

SEQ ID NO: 545339 - RNA, 19 nt, Homo sapiens
ggacugcggcaagcucuuc

SEQ ID NO: 545340 - RNA, 19 nt, Homo sapiens
gaacuucaagcggcacauc

SEQ ID NO: 545341 - RNA, 19 nt, Homo sapiens
gcgaguacuucaagaugcu

SEQ ID NO: 545342 - RNA, 19 nt, Homo sapiens
ccuguucccuagagagaau

SEQ ID NO: 545343 - RNA, 19 nt, Homo sapiens
cagcacagccagcaugucu

SEQ ID NO: 545344 - RNA, 19 nt, Homo sapiens
gcagugacagccgaugaga

SEQ ID NO: 545345 - RNA, 19 nt, Homo sapiens
cugcugaaccugcacaaga

SEQ ID NO: 545346 - RNA, 19 nt, Homo sapiens
cagcgaguacuucaagaug

SEQ ID NO: 545347 - RNA, 19 nt, Homo sapiens
ccaacacucacauccucua

SEQ ID NO: 545348 - RNA, 19 nt, Homo sapiens
caaggcaggcaucaagauc

SEQ ID NO: 545349 - RNA, 19 nt, Homo sapiens
ugagaagccaugccagugu

SEQ ID NO: 545350 - RNA, 19 nt, Homo sapiens
uccgggacauggcagguaa

SEQ ID NO: 545351 - RNA, 19 nt, Homo sapiens
gcacaucaucauucacacu

SEQ ID NO: 545352 - RNA, 19 nt, Homo sapiens
ugaaggcccaccugaagau

SEQ ID NO: 545353 - RNA, 19 nt, Homo sapiens
gcuccgucauccacaagug

SEQ ID NO: 545354 - RNA, 19 nt, Homo sapiens
gcaagugcaggaagaagac

SEQ ID NO: 545355 - RNA, 19 nt, Homo sapiens
ccagacagacgcggacuuc

SEQ ID NO: 545356 - RNA, 19 nt, Homo sapiens
aagccuuaccugugugaua

SEQ ID NO: 545357 - RNA, 19 nt, Homo sapiens
aagcacaucaucauucaca

SEQ ID NO: 545358 - RNA, 19 nt, Homo sapiens
guggacgguguucacuuua

SEQ ID NO: 545359 - RNA, 19 nt, Homo sapiens
ccacaagugcgaggacugu

SEQ ID NO: 545360 - RNA, 19 nt, Homo sapiens
ggagugcagcaaggccuuu

SEQ ID NO: 545361 - RNA, 19 nt, Homo sapiens
guccaagcacaucaucauu

SEQ ID NO: 545362 - RNA, 19 nt, Homo sapiens
ccugaaggcccaccugaag

SEQ ID NO: 545363 - RNA, 19 nt, Homo sapiens
gggaagaggagcaaaagga

SEQ ID NO: 545364 - RNA, 19 nt, Homo sapiens
gagccaaagaggagaaggu

SEQ ID NO: 545365 - RNA, 19 nt, Homo sapiens
gauaagagcuuucaucaga

SEQ ID NO: 545366 - RNA, 19 nt, Homo sapiens
ggagagagaccuuauaauu

SEQ ID NO: 545367 - RNA, 19 nt, Homo sapiens
gaacauaagagaauccaua

SEQ ID NO: 545368 - RNA, 19 nt, Homo sapiens
caucagagaucagcacuua

SEQ ID NO: 545369 - RNA, 19 nt, Homo sapiens
gaaagugaaccaguuauua

SEQ ID NO: 545370 - RNA, 19 nt, Homo sapiens
gguaagaccuucuauuuua

SEQ ID NO: 545371 - RNA, 19 nt, Homo sapiens
ggagagaaaccauauaauu

SEQ ID NO: 545372 - RNA, 19 nt, Homo sapiens
ggagagaaaccuuacauuu

SEQ ID NO: 545373 - RNA, 19 nt, Homo sapiens
gaucagcacuuaauguuca

SEQ ID NO: 545374 - RNA, 19 nt, Homo sapiens
gagagaaaccauauaauug

SEQ ID NO: 545375 - RNA, 19 nt, Homo sapiens
gagagaaaccuuacauuug

SEQ ID NO: 545376 - RNA, 19 nt, Homo sapiens
ggacuacccacaauucaua

SEQ ID NO: 545377 - RNA, 19 nt, Homo sapiens
gagagagaccuuauaauug

SEQ ID NO: 545378 - RNA, 19 nt, Homo sapiens
gcacuuaauguucaucaua

SEQ ID NO: 545379 - RNA, 19 nt, Homo sapiens
gcucacaucugcaaacuca

SEQ ID NO: 545380 - RNA, 19 nt, Homo sapiens
cagcaaaucugggaacaaa

SEQ ID NO: 545381 - RNA, 19 nt, Homo sapiens
ucucaggacucuaucauaa

SEQ ID NO: 545382 - RNA, 19 nt, Homo sapiens
gcaaaucugggaacaaauu

SEQ ID NO: 545383 - RNA, 19 nt, Homo sapiens
gaggcaagauccaaacuga

SEQ ID NO: 545384 - RNA, 19 nt, Homo sapiens
agagagaccuuauaauugu

SEQ ID NO: 545385 - RNA, 19 nt, Homo sapiens
agagaaaccuuacauuugu

SEQ ID NO: 545386 - RNA, 19 nt, Homo sapiens
caucucagcucuucauguu

SEQ ID NO: 545387 - RNA, 19 nt, Homo sapiens
gggaagggcuauguuacua

SEQ ID NO: 545388 - RNA, 19 nt, Homo sapiens
ggagagaaaccauucaaau

SEQ ID NO: 545389 - RNA, 19 nt, Homo sapiens
ggcaaggaauuuagucaaa

SEQ ID NO: 545390 - RNA, 19 nt, Homo sapiens
gagagaaaccguacagaug

SEQ ID NO: 545391 - RNA, 19 nt, Homo sapiens
gagagaccuuauaauugua

SEQ ID NO: 545392 - RNA, 19 nt, Homo sapiens
guacagaugugagcagugu

SEQ ID NO: 545393 - RNA, 19 nt, Homo sapiens
aaacaguccuucagugaug

SEQ ID NO: 545394 - RNA, 19 nt, Homo sapiens
agagaagucuuauacaugu

SEQ ID NO: 545395 - RNA, 19 nt, Homo sapiens
guaaacaguccuucaguga

SEQ ID NO: 545396 - RNA, 19 nt, Homo sapiens
guaaagaccagccgagaga

SEQ ID NO: 545397 - RNA, 19 nt, Homo sapiens
gugguaagaccuucuauuu

SEQ ID NO: 545398 - RNA, 19 nt, Homo sapiens
gcgcuugaaucuggauaua

SEQ ID NO: 545399 - RNA, 19 nt, Homo sapiens
ggacagcaacccaaagaga

SEQ ID NO: 545400 - RNA, 19 nt, Homo sapiens
ggaaagaggcuuguacaca

SEQ ID NO: 545401 - RNA, 19 nt, Homo sapiens
gaagggcuauguuacuaag

SEQ ID NO: 545402 - RNA, 19 nt, Homo sapiens
agucguagaucagcacuua

SEQ ID NO: 545403 - RNA, 19 nt, Homo sapiens
gaaugugggaagaacuuua

SEQ ID NO: 545404 - RNA, 19 nt, Homo sapiens
uaagagcuuucaucagaga

SEQ ID NO: 545405 - RNA, 19 nt, Homo sapiens
gcaaggaauuuagucaaag

SEQ ID NO: 545406 - RNA, 19 nt, Homo sapiens
caggagagaaaccauauaa

SEQ ID NO: 545407 - RNA, 19 nt, Homo sapiens
ucaggacucuaucauaaau

SEQ ID NO: 545408 - RNA, 19 nt, Homo sapiens
gguacaacgugcuauuuua

SEQ ID NO: 545409 - RNA, 19 nt, Homo sapiens
gagaaaccguacagaugug

SEQ ID NO: 545410 - RNA, 19 nt, Homo sapiens
ggagagaaaccguacagau

SEQ ID NO: 545411 - RNA, 19 nt, Homo sapiens
gggaaggcuuucauucaug

SEQ ID NO: 545412 - RNA, 19 nt, Homo sapiens
ggaagggcuauguuacuaa

SEQ ID NO: 545413 - RNA, 19 nt, Homo sapiens
gggcuauguuacuaaguuu

SEQ ID NO: 545414 - RNA, 19 nt, Homo sapiens
gaaaagccauauaaaugug

SEQ ID NO: 545415 - RNA, 19 nt, Homo sapiens
gagaaaccuuacauuugug

SEQ ID NO: 545416 - RNA, 19 nt, Homo sapiens
ggaagggauuuuauacaaa

SEQ ID NO: 545417 - RNA, 19 nt, Homo sapiens
gcaggacuacccacaauuc

SEQ ID NO: 545418 - RNA, 19 nt, Homo sapiens
gggaagggauuuuauacaa

SEQ ID NO: 545419 - RNA, 19 nt, Homo sapiens
aagcaucuguuacaucuca

SEQ ID NO: 545420 - RNA, 19 nt, Homo sapiens
ucucagcucuucauguuca

SEQ ID NO: 545421 - RNA, 19 nt, Homo sapiens
ggugggaaguguaaacagu

SEQ ID NO: 545422 - RNA, 19 nt, Homo sapiens
cgaaagugaaccaguuauu

SEQ ID NO: 545423 - RNA, 19 nt, Homo sapiens
caacugucuucccaucaga

SEQ ID NO: 545424 - RNA, 19 nt, Homo sapiens
cauaagagaauccauacug

SEQ ID NO: 545425 - RNA, 19 nt, Homo sapiens
acacaggagagaaaccuua

SEQ ID NO: 545426 - RNA, 19 nt, Homo sapiens
gggaacaaauugcaaaaga

SEQ ID NO: 545427 - RNA, 19 nt, Homo sapiens
gacagcaacccaaagagaa

SEQ ID NO: 545428 - RNA, 19 nt, Homo sapiens
gaaaacccauccaaaugug

SEQ ID NO: 545429 - RNA, 19 nt, Homo sapiens
caaauucacaacugucuuc

SEQ ID NO: 545430 - RNA, 19 nt, Homo sapiens
ucagagaucagcacuuaau

SEQ ID NO: 545431 - RNA, 19 nt, Homo sapiens
ugugauacaugugauaaga

SEQ ID NO: 545432 - RNA, 19 nt, Homo sapiens
ugugauauaugugguaaga

SEQ ID NO: 545433 - RNA, 19 nt, Homo sapiens
cuaaaugacacauaacugu

SEQ ID NO: 545434 - RNA, 19 nt, Homo sapiens
gcuugaaucuggauauacu

SEQ ID NO: 545435 - RNA, 19 nt, Homo sapiens
gaugugagcaguguggaaa

SEQ ID NO: 545436 - RNA, 19 nt, Homo sapiens
gaagcaggacuacccacaa

SEQ ID NO: 545437 - RNA, 19 nt, Homo sapiens
ccaaagagaagggaauuca

SEQ ID NO: 545438 - RNA, 19 nt, Homo sapiens
gugcauacaauuuauagug

SEQ ID NO: 545439 - RNA, 19 nt, Homo sapiens
ugacacauaacuguucaua

SEQ ID NO: 545440 - RNA, 19 nt, Homo sapiens
gauacuugccacuuccuaa

SEQ ID NO: 545441 - RNA, 19 nt, Homo sapiens
caaccguuccaccaagaua

SEQ ID NO: 545442 - RNA, 19 nt, Homo sapiens
cgggagagagaccuuauaa

SEQ ID NO: 545443 - RNA, 19 nt, Homo sapiens
guagaucagcacuuaaugu

SEQ ID NO: 545444 - RNA, 19 nt, Homo sapiens
aaagugaaccaguuauuag

SEQ ID NO: 545445 - RNA, 19 nt, Homo sapiens
gagaucagcacuuaauagg

SEQ ID NO: 545446 - RNA, 19 nt, Homo sapiens
uagaucagcacuuaauguu

SEQ ID NO: 545447 - RNA, 19 nt, Homo sapiens
gcacguuucaggcaggauu

SEQ ID NO: 545448 - RNA, 19 nt, Homo sapiens
ggaaaacccauccaaaugu

SEQ ID NO: 545449 - RNA, 19 nt, Homo sapiens
ccauuuaggugugauacau

SEQ ID NO: 545450 - RNA, 19 nt, Homo sapiens
aagcaggacuacccacaau

SEQ ID NO: 545451 - RNA, 19 nt, Homo sapiens
acacaggacauaccguaaa

SEQ ID NO: 545452 - RNA, 19 nt, Homo sapiens
acacaggagagaaaccaua

SEQ ID NO: 545453 - RNA, 19 nt, Homo sapiens
agagaaaccguacagaugu

SEQ ID NO: 545454 - RNA, 19 nt, Homo sapiens
gagcuuucaucagagauca

SEQ ID NO: 545455 - RNA, 19 nt, Homo sapiens
uaaggaacauaagagaauc

SEQ ID NO: 545456 - RNA, 19 nt, Homo sapiens
auucaugauucccagcuua

SEQ ID NO: 545457 - RNA, 19 nt, Homo sapiens
ucaaagcucacaucugcaa

SEQ ID NO: 545458 - RNA, 19 nt, Homo sapiens
agaaacucuuuauguguga

SEQ ID NO: 545459 - RNA, 19 nt, Homo sapiens
gagaagucuuauacaugug

SEQ ID NO: 545460 - RNA, 19 nt, Homo sapiens
gagugguccugccagcaaa

SEQ ID NO: 545461 - RNA, 19 nt, Homo sapiens
gagacuccacugccagaaa

SEQ ID NO: 545462 - RNA, 19 nt, Homo sapiens
gugaaaagccauauaaaug

SEQ ID NO: 545463 - RNA, 19 nt, Homo sapiens
cagagaucagcacuuaaua

SEQ ID NO: 545464 - RNA, 19 nt, Homo sapiens
ugggaaggcuuucauucau

SEQ ID NO: 545465 - RNA, 19 nt, Homo sapiens
ggaaaugccuucuauguga

SEQ ID NO: 545466 - RNA, 19 nt, Homo sapiens
ggagaaaccuuaugaaugu

SEQ ID NO: 545467 - RNA, 19 nt, Homo sapiens
gaagaaagccucucacuga

SEQ ID NO: 545468 - RNA, 19 nt, Homo sapiens
gaagaugacucucaauaau

SEQ ID NO: 545469 - RNA, 19 nt, Homo sapiens
gcaaagaaaucccuaaauc

SEQ ID NO: 545470 - RNA, 19 nt, Homo sapiens
gagaagagcuguggauauu

SEQ ID NO: 545471 - RNA, 19 nt, Homo sapiens
gaaagccucucacugaaga

SEQ ID NO: 545472 - RNA, 19 nt, Homo sapiens
ggagaaacccuaugaaugu

SEQ ID NO: 545473 - RNA, 19 nt, Homo sapiens
gaagagcuguggauauuag

SEQ ID NO: 545474 - RNA, 19 nt, Homo sapiens
agagaaaccuuaugaaugu

SEQ ID NO: 545475 - RNA, 19 nt, Homo sapiens
gagauucccugcccugauu

SEQ ID NO: 545476 - RNA, 19 nt, Homo sapiens
gaagaaaucccuuugucaa

SEQ ID NO: 545477 - RNA, 19 nt, Homo sapiens
gaaaguacgccucauugaa

SEQ ID NO: 545478 - RNA, 19 nt, Homo sapiens
agagaaaccuuacgaaugu

SEQ ID NO: 545479 - RNA, 19 nt, Homo sapiens
gaaugaagaugacucucaa

SEQ ID NO: 545480 - RNA, 19 nt, Homo sapiens
gggaaaaucuucaguauga

SEQ ID NO: 545481 - RNA, 19 nt, Homo sapiens
gagaaacccuaugaaugua

SEQ ID NO: 545482 - RNA, 19 nt, Homo sapiens
gaaaugccuucuaugugaa

SEQ ID NO: 545483 - RNA, 19 nt, Homo sapiens
gagagaaaccuuaugaaug

SEQ ID NO: 545484 - RNA, 19 nt, Homo sapiens
gagaaacccuacgaaugua

SEQ ID NO: 545485 - RNA, 19 nt, Homo sapiens
gagaggcccuuugaaugua

SEQ ID NO: 545486 - RNA, 19 nt, Homo sapiens
ggagagagacccuaugaau

SEQ ID NO: 545487 - RNA, 19 nt, Homo sapiens
ggagagagacccuaugaau

SEQ ID NO: 545488 - RNA, 19 nt, Homo sapiens
gguaaugcuuucuauguga

SEQ ID NO: 545489 - RNA, 19 nt, Homo sapiens
gagagaaaccuuacgaaug

SEQ ID NO: 545490 - RNA, 19 nt, Homo sapiens
gaaaagcccuaucagugua

SEQ ID NO: 545491 - RNA, 19 nt, Homo sapiens
caacaccacagaacucaua

SEQ ID NO: 545492 - RNA, 19 nt, Homo sapiens
ggagagaaaccuuaugaau

SEQ ID NO: 545493 - RNA, 19 nt, Homo sapiens
aaacuuccgugcaaagaaa

SEQ ID NO: 545494 - RNA, 19 nt, Homo sapiens
ccucauugcucaucagaaa

SEQ ID NO: 545495 - RNA, 19 nt, Homo sapiens
caaaugggcuguucaucuc

SEQ ID NO: 545496 - RNA, 19 nt, Homo sapiens
caucuuaucuguugauugg

SEQ ID NO: 545497 - RNA, 19 nt, Homo sapiens
gaacaucagcgaauucaca

SEQ ID NO: 545498 - RNA, 19 nt, Homo sapiens
gagagaaacccuacgaaug

SEQ ID NO: 545499 - RNA, 19 nt, Homo sapiens
gaaagcacgccuaauugaa

SEQ ID NO: 545500 - RNA, 19 nt, Homo sapiens
ucacaacucauccuacaua

SEQ ID NO: 545501 - RNA, 19 nt, Homo sapiens
ggagaggcccuuugaaugu

SEQ ID NO: 545502 - RNA, 19 nt, Homo sapiens
ggggauagcucauuguuuu

SEQ ID NO: 545503 - RNA, 19 nt, Homo sapiens
caacucauccuacauacaa

SEQ ID NO: 545504 - RNA, 19 nt, Homo sapiens
gaaagcacaccucacagaa

SEQ ID NO: 545505 - RNA, 19 nt, Homo sapiens
gagagacccuaugaaugua

SEQ ID NO: 545506 - RNA, 19 nt, Homo sapiens
ggaaagcacaccucacaga

SEQ ID NO: 545507 - RNA, 19 nt, Homo sapiens
caaagaaaucccuaaauca

SEQ ID NO: 545508 - RNA, 19 nt, Homo sapiens
gcaggacccucuacacaca

SEQ ID NO: 545509 - RNA, 19 nt, Homo sapiens
gaaggcaacccucacgauu

SEQ ID NO: 545510 - RNA, 19 nt, Homo sapiens
gcaagaucauaccucauug

SEQ ID NO: 545511 - RNA, 19 nt, Homo sapiens
ggagagagacccuuugagu

SEQ ID NO: 545512 - RNA, 19 nt, Homo sapiens
gggagaaaccuuaugaaug

SEQ ID NO: 545513 - RNA, 19 nt, Homo sapiens
gaacaucugagaauacaca

SEQ ID NO: 545514 - RNA, 19 nt, Homo sapiens
ugaagaugacucucaauaa

SEQ ID NO: 545515 - RNA, 19 nt, Homo sapiens
ucagaagauucaaacauug

SEQ ID NO: 545516 - RNA, 19 nt, Homo sapiens
gagaaaccuuaugaaugua

SEQ ID NO: 545517 - RNA, 19 nt, Homo sapiens
ggagagaaaccuuacgaau

SEQ ID NO: 545518 - RNA, 19 nt, Homo sapiens
ggauguggcuguggauuuc

SEQ ID NO: 545519 - RNA, 19 nt, Homo sapiens
gggagaaacccuaugaaug

SEQ ID NO: 545520 - RNA, 19 nt, Homo sapiens
ggagaagagcuguggauau

SEQ ID NO: 545521 - RNA, 19 nt, Homo sapiens
gaacaucagagaacucaca

SEQ ID NO: 545522 - RNA, 19 nt, Homo sapiens
guaaugcuuucuaugugaa

SEQ ID NO: 545523 - RNA, 19 nt, Homo sapiens
gagagagacccuaugaaug

SEQ ID NO: 545524 - RNA, 19 nt, Homo sapiens
gagagagacccuaugaaug

SEQ ID NO: 545525 - RNA, 19 nt, Homo sapiens
ggagagaaacccuacgaau

SEQ ID NO: 545526 - RNA, 19 nt, Homo sapiens
gagaaaccuuacgaaugua

SEQ ID NO: 545527 - RNA, 19 nt, Homo sapiens
uauaauggaugcaggaaag

SEQ ID NO: 545528 - RNA, 19 nt, Homo sapiens
agagaaacccuacgaaugu

SEQ ID NO: 545529 - RNA, 19 nt, Homo sapiens
ugaaagcacgccuaauuga

SEQ ID NO: 545530 - RNA, 19 nt, Homo sapiens
ugagaaacccuaugagugu

SEQ ID NO: 545531 - RNA, 19 nt, Homo sapiens
agagagacccuaugaaugu

SEQ ID NO: 545532 - RNA, 19 nt, Homo sapiens
gaaagccuuccaugagaaa

SEQ ID NO: 545533 - RNA, 19 nt, Homo sapiens
gggugaacaugccagcuaa

SEQ ID NO: 545534 - RNA, 19 nt, Homo sapiens
agaugacucucaauaauca

SEQ ID NO: 545535 - RNA, 19 nt, Homo sapiens
gaagucacaacucauccua

SEQ ID NO: 545536 - RNA, 19 nt, Homo sapiens
aagaaagccucucacugaa

SEQ ID NO: 545537 - RNA, 19 nt, Homo sapiens
ggcaggaagucacaacuca

SEQ ID NO: 545538 - RNA, 19 nt, Homo sapiens
agucauauguguugcaaau

SEQ ID NO: 545539 - RNA, 19 nt, Homo sapiens
ugugaaagcacgccuaauu

SEQ ID NO: 545540 - RNA, 19 nt, Homo sapiens
gaaacccuaugaauguagu

SEQ ID NO: 545541 - RNA, 19 nt, Homo sapiens
gggagaggcccuuugaaug

SEQ ID NO: 545542 - RNA, 19 nt, Homo sapiens
agaaaucccuuugucaaca

SEQ ID NO: 545543 - RNA, 19 nt, Homo sapiens
ccuaauuagugguguguga

SEQ ID NO: 545544 - RNA, 19 nt, Homo sapiens
caucagagaacucacauag

SEQ ID NO: 545545 - RNA, 19 nt, Homo sapiens
aagcacaccucacagaaca

SEQ ID NO: 545546 - RNA, 19 nt, Homo sapiens
caggagagaaaccuuauga

SEQ ID NO: 545547 - RNA, 19 nt, Homo sapiens
acacaggagagaaaccuua

SEQ ID NO: 545548 - RNA, 19 nt, Homo sapiens
gugaaagcacgccuaauug

SEQ ID NO: 545549 - RNA, 19 nt, Homo sapiens
acacaggagagaaaccuua

SEQ ID NO: 545550 - RNA, 19 nt, Homo sapiens
ggacaucaccccagagauu

SEQ ID NO: 545551 - RNA, 19 nt, Homo sapiens
gggaaagcuuacuguagga

SEQ ID NO: 545552 - RNA, 19 nt, Homo sapiens
agagagacccuuugagugu

SEQ ID NO: 545553 - RNA, 19 nt, Homo sapiens
gaauguaaugaguguggua

SEQ ID NO: 545554 - RNA, 19 nt, Homo sapiens
agacuucccucaccauugg

SEQ ID NO: 545555 - RNA, 19 nt, Homo sapiens
gaauguagugaauguggaa

SEQ ID NO: 545556 - RNA, 19 nt, Homo sapiens
cgaaugaagaugacucuca

SEQ ID NO: 545557 - RNA, 19 nt, Homo sapiens
cuaaaucagcaucaaagaa

SEQ ID NO: 545558 - RNA, 19 nt, Homo sapiens
gaacacccagaggagauaa

SEQ ID NO: 545559 - RNA, 19 nt, Homo sapiens
ugaaaguacgccucauuga

SEQ ID NO: 545560 - RNA, 19 nt, Homo sapiens
guggaaaugccuucuaugu

SEQ ID NO: 545561 - RNA, 19 nt, Homo sapiens
gaaaccuuaugaauguagu

SEQ ID NO: 545562 - RNA, 19 nt, Homo sapiens
gaaaucccuuugucaacac

SEQ ID NO: 545563 - RNA, 19 nt, Homo sapiens
agauaucccuuacccaaca

SEQ ID NO: 545564 - RNA, 19 nt, Homo sapiens
cuaugaauguagugaaugu

SEQ ID NO: 545565 - RNA, 19 nt, Homo sapiens
ggaagaagcuguuaaagca

SEQ ID NO: 545566 - RNA, 19 nt, Homo sapiens
guaaauacaugcauuguca

SEQ ID NO: 545567 - RNA, 19 nt, Homo sapiens
ggaaggaccggaugacuua

SEQ ID NO: 545568 - RNA, 19 nt, Homo sapiens
gaacauagggcauccugua

SEQ ID NO: 545569 - RNA, 19 nt, Homo sapiens
caagguggauggcugauuu

SEQ ID NO: 545570 - RNA, 19 nt, Homo sapiens
gaaccaugcuugugagaug

SEQ ID NO: 545571 - RNA, 19 nt, Homo sapiens
gaagagaccaguaaccaaa

SEQ ID NO: 545572 - RNA, 19 nt, Homo sapiens
gauaguaguuggcaagaug

SEQ ID NO: 545573 - RNA, 19 nt, Homo sapiens
gaauauagcauuguaguug

SEQ ID NO: 545574 - RNA, 19 nt, Homo sapiens
gauggaauauagcauugua

SEQ ID NO: 545575 - RNA, 19 nt, Homo sapiens
gccaaaguaucaacuguaa

SEQ ID NO: 545576 - RNA, 19 nt, Homo sapiens
cacuuaagcugucauguaa

SEQ ID NO: 545577 - RNA, 19 nt, Homo sapiens
caucacaucuccaaugaau

SEQ ID NO: 545578 - RNA, 19 nt, Homo sapiens
gcaaugagcaugagaaguc

SEQ ID NO: 545579 - RNA, 19 nt, Homo sapiens
ccaguaagccugucaagaa

SEQ ID NO: 545580 - RNA, 19 nt, Homo sapiens
caugagaaguccaguaaau

SEQ ID NO: 545581 - RNA, 19 nt, Homo sapiens
gggcagagccaaaguauca

SEQ ID NO: 545582 - RNA, 19 nt, Homo sapiens
ggugauaccagcucugaua

SEQ ID NO: 545583 - RNA, 19 nt, Homo sapiens
caauuuggcugggauuauu

SEQ ID NO: 545584 - RNA, 19 nt, Homo sapiens
gaacucuucucccuauaca

SEQ ID NO: 545585 - RNA, 19 nt, Homo sapiens
caaaguaggguguguaugu

SEQ ID NO: 545586 - RNA, 19 nt, Homo sapiens
guaaacaaggcaucaguaa

SEQ ID NO: 545587 - RNA, 19 nt, Homo sapiens
guagaauugucuguguuua

SEQ ID NO: 545588 - RNA, 19 nt, Homo sapiens
gaugaaaugccagaauuaa

SEQ ID NO: 545589 - RNA, 19 nt, Homo sapiens
uaacauaaccagcccaaug

SEQ ID NO: 545590 - RNA, 19 nt, Homo sapiens
ccacuuaagcugucaugua

SEQ ID NO: 545591 - RNA, 19 nt, Homo sapiens
guaagccugucaagaagaa

SEQ ID NO: 545592 - RNA, 19 nt, Homo sapiens
gacccagucugucaagaaa

SEQ ID NO: 545593 - RNA, 19 nt, Homo sapiens
aagaugaaaugccagaauu

SEQ ID NO: 545594 - RNA, 19 nt, Homo sapiens
gcaaugagaccuguagaga

SEQ ID NO: 545595 - RNA, 19 nt, Homo sapiens
uccaugaccucuccuuuaa

SEQ ID NO: 545596 - RNA, 19 nt, Homo sapiens
caacaacaacaacauguga

SEQ ID NO: 545597 - RNA, 19 nt, Homo sapiens
gaaggcaagguaucaugua

SEQ ID NO: 545598 - RNA, 19 nt, Homo sapiens
cucaaggccugaccacuua

SEQ ID NO: 545599 - RNA, 19 nt, Homo sapiens
gggaauauguuaauuucag

SEQ ID NO: 545600 - RNA, 19 nt, Homo sapiens
ccugauauuuggagaugua

SEQ ID NO: 545601 - RNA, 19 nt, Homo sapiens
gagagcuaguguagaauug

SEQ ID NO: 545602 - RNA, 19 nt, Homo sapiens
ugacaacauugcuuaaaca

SEQ ID NO: 545603 - RNA, 19 nt, Homo sapiens
cagaaagacccuucaaaug

SEQ ID NO: 545604 - RNA, 19 nt, Homo sapiens
caaggaaucacuuuauugu

SEQ ID NO: 545605 - RNA, 19 nt, Homo sapiens
ccacuuuaguuuaaucaga

SEQ ID NO: 545606 - RNA, 19 nt, Homo sapiens
aaaguaggguguguaugua

SEQ ID NO: 545607 - RNA, 19 nt, Homo sapiens
ggaagaaagaagcugcuaa

SEQ ID NO: 545608 - RNA, 19 nt, Homo sapiens
gcaggcaucuugucaacag

SEQ ID NO: 545609 - RNA, 19 nt, Homo sapiens
cuacaucaccgccuuggua

SEQ ID NO: 545610 - RNA, 19 nt, Homo sapiens
aaacaugcaugagugaaga

SEQ ID NO: 545611 - RNA, 19 nt, Homo sapiens
ggcaagguaucauguaaca

SEQ ID NO: 545612 - RNA, 19 nt, Homo sapiens
gagccaaaguaucaacugu

SEQ ID NO: 545613 - RNA, 19 nt, Homo sapiens
ucaccaaacccuauacuug

SEQ ID NO: 545614 - RNA, 19 nt, Homo sapiens
ugagaaacccuuugagugu

SEQ ID NO: 545615 - RNA, 19 nt, Homo sapiens
cagaaaccauugcuuccaa

SEQ ID NO: 545616 - RNA, 19 nt, Homo sapiens
gaccugauauuuggagaug

SEQ ID NO: 545617 - RNA, 19 nt, Homo sapiens
gaaguccaguaaauguuuc

SEQ ID NO: 545618 - RNA, 19 nt, Homo sapiens
guagagagcaugccuuucu

SEQ ID NO: 545619 - RNA, 19 nt, Homo sapiens
gaagaaagaagcugcuaac

SEQ ID NO: 545620 - RNA, 19 nt, Homo sapiens
caacaacaacaacaacaug

SEQ ID NO: 545621 - RNA, 19 nt, Homo sapiens
auacaucaccagccacuua

SEQ ID NO: 545622 - RNA, 19 nt, Homo sapiens
caugaccucuccuuuaaca

SEQ ID NO: 545623 - RNA, 19 nt, Homo sapiens
gggcauccuguaacuauaa

SEQ ID NO: 545624 - RNA, 19 nt, Homo sapiens
gauugugaccugauauuug

SEQ ID NO: 545625 - RNA, 19 nt, Homo sapiens
gauaccagcucugauaugc

SEQ ID NO: 545626 - RNA, 19 nt, Homo sapiens
auugagagcuaguguagaa

SEQ ID NO: 545627 - RNA, 19 nt, Homo sapiens
ccaaggaaucacuuuauug

SEQ ID NO: 545628 - RNA, 19 nt, Homo sapiens
cccaaggaaucacuuuauu

SEQ ID NO: 545629 - RNA, 19 nt, Homo sapiens
ggaccacuuuaguuuaauc

SEQ ID NO: 545630 - RNA, 19 nt, Homo sapiens
cuggaccacuuuaguuuaa

SEQ ID NO: 545631 - RNA, 19 nt, Homo sapiens
agaagaaccaugcuuguga

SEQ ID NO: 545632 - RNA, 19 nt, Homo sapiens
gcauauuaaucccgaugga

SEQ ID NO: 545633 - RNA, 19 nt, Homo sapiens
uaaacaaggcaucaguaaa

SEQ ID NO: 545634 - RNA, 19 nt, Homo sapiens
agaaagacccuucaaaugc

SEQ ID NO: 545635 - RNA, 19 nt, Homo sapiens
ggaauauagcauuguaguu

SEQ ID NO: 545636 - RNA, 19 nt, Homo sapiens
caacguauaauagggauug

SEQ ID NO: 545637 - RNA, 19 nt, Homo sapiens
cauucuaacuucaacguau

SEQ ID NO: 545638 - RNA, 19 nt, Homo sapiens
uaccagcucugauaugcaa

SEQ ID NO: 545639 - RNA, 19 nt, Homo sapiens
gaacccacuucaaaauaaa

SEQ ID NO: 545640 - RNA, 19 nt, Homo sapiens
uagcugacaacauugcuua

SEQ ID NO: 545641 - RNA, 19 nt, Homo sapiens
ucaagugcaguuaacauaa

SEQ ID NO: 545642 - RNA, 19 nt, Homo sapiens
gagaaguccaguaaauguu

SEQ ID NO: 545643 - RNA, 19 nt, Homo sapiens
ggaagcaaguagaaacacu

SEQ ID NO: 545644 - RNA, 19 nt, Homo sapiens
acagaaagacccuucaaau

SEQ ID NO: 545645 - RNA, 19 nt, Homo sapiens
gaugagaaacccuuugagu

SEQ ID NO: 545646 - RNA, 19 nt, Homo sapiens
ccacgaauccugccacaca

SEQ ID NO: 545647 - RNA, 19 nt, Homo sapiens
aaggcaagguaucauguaa

SEQ ID NO: 545648 - RNA, 19 nt, Homo sapiens
caauaccaauaacucagaa

SEQ ID NO: 545649 - RNA, 19 nt, Homo sapiens
caacagucacuacaucuuc

SEQ ID NO: 545650 - RNA, 19 nt, Homo sapiens
acacagggaucaaguuggu

SEQ ID NO: 545651 - RNA, 19 nt, Homo sapiens
gaagaagcuguuaaagcaa

SEQ ID NO: 545652 - RNA, 19 nt, Homo sapiens
aaacaaggcaucaguaaaa

SEQ ID NO: 545653 - RNA, 19 nt, Homo sapiens
gaaggaggcaucaccaaac

SEQ ID NO: 545654 - RNA, 19 nt, Homo sapiens
guaaucagcgcuucaagag

SEQ ID NO: 545655 - RNA, 19 nt, Homo sapiens
gaccauugcaggcaucuug

SEQ ID NO: 545656 - RNA, 19 nt, Homo sapiens
ggauugugaccugauauuu

SEQ ID NO: 545657 - RNA, 19 nt, Homo sapiens
gagcaugagaaguccagua

SEQ ID NO: 545658 - RNA, 19 nt, Homo sapiens
gggugcaccagaaacauua

SEQ ID NO: 545659 - RNA, 19 nt, Homo sapiens
gcugggauuauucaaagua

SEQ ID NO: 545660 - RNA, 19 nt, Homo sapiens
caacagaaagacccuucaa

SEQ ID NO: 545661 - RNA, 19 nt, Homo sapiens
gagcuaguguagaauuguc

SEQ ID NO: 545662 - RNA, 19 nt, Homo sapiens
ccacacagggaucaaguug

SEQ ID NO: 545663 - RNA, 19 nt, Homo sapiens
ucacuggaccacuuuaguu

SEQ ID NO: 545664 - RNA, 19 nt, Homo sapiens
ugagaaguccaguaaaugu

SEQ ID NO: 545665 - RNA, 19 nt, Homo sapiens
gcagagagcucagaucuua

SEQ ID NO: 545666 - RNA, 19 nt, Homo sapiens
ggagagagaugcuaugaau

SEQ ID NO: 545667 - RNA, 19 nt, Homo sapiens
gaagugaacuccuuaagca

SEQ ID NO: 545668 - RNA, 19 nt, Homo sapiens
agucagagcucaaaccuua

SEQ ID NO: 545669 - RNA, 19 nt, Homo sapiens
agucagaggugaaauaaua

SEQ ID NO: 545670 - RNA, 19 nt, Homo sapiens
gaccagagcuucaaaugga

SEQ ID NO: 545671 - RNA, 19 nt, Homo sapiens
gauagaagaggaagaauuu

SEQ ID NO: 545672 - RNA, 19 nt, Homo sapiens
gaacucaaaugaauucaca

SEQ ID NO: 545673 - RNA, 19 nt, Homo sapiens
ggaaauggcacaauaugaa

SEQ ID NO: 545674 - RNA, 19 nt, Homo sapiens
guaaguaaaugcugaggaa

SEQ ID NO: 545675 - RNA, 19 nt, Homo sapiens
gcucagaucuuacuagaca

SEQ ID NO: 545676 - RNA, 19 nt, Homo sapiens
ccagaaaucuuguaaacau

SEQ ID NO: 545677 - RNA, 19 nt, Homo sapiens
aaccugaacucacaucuua

SEQ ID NO: 545678 - RNA, 19 nt, Homo sapiens
ggaagaaucucaggauaca

SEQ ID NO: 545679 - RNA, 19 nt, Homo sapiens
ggacggaauucuugaagug

SEQ ID NO: 545680 - RNA, 19 nt, Homo sapiens
gaacauggacaagaaauau

SEQ ID NO: 545681 - RNA, 19 nt, Homo sapiens
aaacaaggccucagaagaa

SEQ ID NO: 545682 - RNA, 19 nt, Homo sapiens
gacaagaaauauuccagaa

SEQ ID NO: 545683 - RNA, 19 nt, Homo sapiens
gaagauagaagaggaagaa

SEQ ID NO: 545684 - RNA, 19 nt, Homo sapiens
gagcucagaucuuacuaga

SEQ ID NO: 545685 - RNA, 19 nt, Homo sapiens
gaaauggcacaauaugaaa

SEQ ID NO: 545686 - RNA, 19 nt, Homo sapiens
guaaagagacaaugggaaa

SEQ ID NO: 545687 - RNA, 19 nt, Homo sapiens
gcucaaaccuuagucaaca

SEQ ID NO: 545688 - RNA, 19 nt, Homo sapiens
gggaaaaccuauuaaugua

SEQ ID NO: 545689 - RNA, 19 nt, Homo sapiens
gagagaugcuaugaaugua

SEQ ID NO: 545690 - RNA, 19 nt, Homo sapiens
gagaggcacugaugaagca

SEQ ID NO: 545691 - RNA, 19 nt, Homo sapiens
gagaaacccuacgagugua

SEQ ID NO: 545692 - RNA, 19 nt, Homo sapiens
gaccagcacuuaaugucaa

SEQ ID NO: 545693 - RNA, 19 nt, Homo sapiens
gagaugcuaugaauguaau

SEQ ID NO: 545694 - RNA, 19 nt, Homo sapiens
caagauggcuacagaacca

SEQ ID NO: 545695 - RNA, 19 nt, Homo sapiens
ggagagaggcacugaugaa

SEQ ID NO: 545696 - RNA, 19 nt, Homo sapiens
cugaggaaauggcacaaua

SEQ ID NO: 545697 - RNA, 19 nt, Homo sapiens
uaagaggaguugcccauuc

SEQ ID NO: 545698 - RNA, 19 nt, Homo sapiens
gcaagacacacuacuacaa

SEQ ID NO: 545699 - RNA, 19 nt, Homo sapiens
ucaggagucccuucuguua

SEQ ID NO: 545700 - RNA, 19 nt, Homo sapiens
ccgcuuguccugaaauuua

SEQ ID NO: 545701 - RNA, 19 nt, Homo sapiens
caaacaaggccucagaaga

SEQ ID NO: 545702 - RNA, 19 nt, Homo sapiens
caucuuauucgacacuuua

SEQ ID NO: 545703 - RNA, 19 nt, Homo sapiens
gcaggacacuugcuuacag

SEQ ID NO: 545704 - RNA, 19 nt, Homo sapiens
gacacuugcuuacagagaa

SEQ ID NO: 545705 - RNA, 19 nt, Homo sapiens
guaaacaugguaccuguga

SEQ ID NO: 545706 - RNA, 19 nt, Homo sapiens
ggagucccuucuguuauuu

SEQ ID NO: 545707 - RNA, 19 nt, Homo sapiens
gagcucacaucuuauucga

SEQ ID NO: 545708 - RNA, 19 nt, Homo sapiens
ggacugugauaaugagagu

SEQ ID NO: 545709 - RNA, 19 nt, Homo sapiens
ucacacaccagaaaucuug

SEQ ID NO: 545710 - RNA, 19 nt, Homo sapiens
aagaaucucaggauacaua

SEQ ID NO: 545711 - RNA, 19 nt, Homo sapiens
ugaccauacuagaagauuu

SEQ ID NO: 545712 - RNA, 19 nt, Homo sapiens
caccagaaaucuuguaaac

SEQ ID NO: 545713 - RNA, 19 nt, Homo sapiens
acagagaagugaacuccuu

SEQ ID NO: 545714 - RNA, 19 nt, Homo sapiens
gggaaaagcuuugcagaga

SEQ ID NO: 545715 - RNA, 19 nt, Homo sapiens
ggaugaagguuuugguaaa

SEQ ID NO: 545716 - RNA, 19 nt, Homo sapiens
ccucucauauugccuuuga

SEQ ID NO: 545717 - RNA, 19 nt, Homo sapiens
ugccaaagcuggaaauuuu

SEQ ID NO: 545718 - RNA, 19 nt, Homo sapiens
ucagaggaaucccggagaa

SEQ ID NO: 545719 - RNA, 19 nt, Homo sapiens
caagacacacuacuacaau

SEQ ID NO: 545720 - RNA, 19 nt, Homo sapiens
gaggaaauggcacaauaug

SEQ ID NO: 545721 - RNA, 19 nt, Homo sapiens
caccagagaauucacauga

SEQ ID NO: 545722 - RNA, 19 nt, Homo sapiens
gcagugaccauacuagaag

SEQ ID NO: 545723 - RNA, 19 nt, Homo sapiens
ucucagaucugccauuguc

SEQ ID NO: 545724 - RNA, 19 nt, Homo sapiens
uaucaggcaucagagaauu

SEQ ID NO: 545725 - RNA, 19 nt, Homo sapiens
ugaauucacacaccagaaa

SEQ ID NO: 545726 - RNA, 19 nt, Homo sapiens
uccagucccucucauauug

SEQ ID NO: 545727 - RNA, 19 nt, Homo sapiens
gaccauacuagaagauuug

SEQ ID NO: 545728 - RNA, 19 nt, Homo sapiens
gaagagacccaggaaggau

SEQ ID NO: 545729 - RNA, 19 nt, Homo sapiens
aggagucccuucuguuauu

SEQ ID NO: 545730 - RNA, 19 nt, Homo sapiens
caucuuaucaggcaucaga

SEQ ID NO: 545731 - RNA, 19 nt, Homo sapiens
agagagaugcuaugaaugu

SEQ ID NO: 545732 - RNA, 19 nt, Homo sapiens
gcccaaaacuugcuaaaca

SEQ ID NO: 545733 - RNA, 19 nt, Homo sapiens
gaugugagaggagauuaaa

SEQ ID NO: 545734 - RNA, 19 nt, Homo sapiens
guccugaaauuuauugaca

SEQ ID NO: 545735 - RNA, 19 nt, Homo sapiens
agagaaacccuacgagugu

SEQ ID NO: 545736 - RNA, 19 nt, Homo sapiens
cagaaaucuuguaaacaug

SEQ ID NO: 545737 - RNA, 19 nt, Homo sapiens
agaagcaucuggugagucu

SEQ ID NO: 545738 - RNA, 19 nt, Homo sapiens
gcgcuuacgcauuuaguga

SEQ ID NO: 545739 - RNA, 19 nt, Homo sapiens
ggaugugagaggagauuaa

SEQ ID NO: 545740 - RNA, 19 nt, Homo sapiens
cuggaagaaucucaggaua

SEQ ID NO: 545741 - RNA, 19 nt, Homo sapiens
guagauccaugccaaagcu

SEQ ID NO: 545742 - RNA, 19 nt, Homo sapiens
ggaccagcacuuaauguca

SEQ ID NO: 545743 - RNA, 19 nt, Homo sapiens
gcaagauggaagacugaaa

SEQ ID NO: 545744 - RNA, 19 nt, Homo sapiens
ugaacauggacaagaaaua

SEQ ID NO: 545745 - RNA, 19 nt, Homo sapiens
cagagaagugaacuccuua

SEQ ID NO: 545746 - RNA, 19 nt, Homo sapiens
cuacugauccugaauuugg

SEQ ID NO: 545747 - RNA, 19 nt, Homo sapiens
ccaggaaggauucuuggaa

SEQ ID NO: 545748 - RNA, 19 nt, Homo sapiens
aguaaaugcugaggaaaug

SEQ ID NO: 545749 - RNA, 19 nt, Homo sapiens
gaaaucuuguaaacauggu

SEQ ID NO: 545750 - RNA, 19 nt, Homo sapiens
ggacacuugcuuacagaga

SEQ ID NO: 545751 - RNA, 19 nt, Homo sapiens
aacaaggccucagaagaaa

SEQ ID NO: 545752 - RNA, 19 nt, Homo sapiens
caggacacuugcuuacaga

SEQ ID NO: 545753 - RNA, 19 nt, Homo sapiens
ggaugcaguuaaaccaaca

SEQ ID NO: 545754 - RNA, 19 nt, Homo sapiens
acuagaagauuuggagaga

SEQ ID NO: 545755 - RNA, 19 nt, Homo sapiens
agagauccauaccaaggaa

SEQ ID NO: 545756 - RNA, 19 nt, Homo sapiens
uuggcggucuccauaguua

SEQ ID NO: 545757 - RNA, 19 nt, Homo sapiens
gcagaggagaugaaguuuc

SEQ ID NO: 545758 - RNA, 19 nt, Homo sapiens
ccaaugacagccagugguu

SEQ ID NO: 545759 - RNA, 19 nt, Homo sapiens
gcuaugaauguaaugaaug

SEQ ID NO: 545760 - RNA, 19 nt, Homo sapiens
agccagagauccauaccaa

SEQ ID NO: 545761 - RNA, 19 nt, Homo sapiens
aacacaagauggcuacaga

SEQ ID NO: 545762 - RNA, 19 nt, Homo sapiens
ugccgaggaugcaguuaaa

SEQ ID NO: 545763 - RNA, 19 nt, Homo sapiens
gaaaaguugucugggaaug

SEQ ID NO: 545764 - RNA, 19 nt, Homo sapiens
gaauucacacaccagaaau

SEQ ID NO: 545765 - RNA, 19 nt, Homo sapiens
gagagaagcugcacuacua

SEQ ID NO: 545766 - RNA, 19 nt, Homo sapiens
cagaguaggugcucaauaa

SEQ ID NO: 545767 - RNA, 19 nt, Homo sapiens
ggagcuaucuguggucuua

SEQ ID NO: 545768 - RNA, 19 nt, Homo sapiens
ucucagagcugcccacuuu

SEQ ID NO: 545769 - RNA, 19 nt, Homo sapiens
ugagagacuuggaauauaa

SEQ ID NO: 545770 - RNA, 19 nt, Homo sapiens
ggaguaacaugucuucuca

SEQ ID NO: 545771 - RNA, 19 nt, Homo sapiens
gaacucaucuacaccuuca

SEQ ID NO: 545772 - RNA, 19 nt, Homo sapiens
cagaacaucuugcucuuga

SEQ ID NO: 545773 - RNA, 19 nt, Homo sapiens
gagggcggauaacaucuua

SEQ ID NO: 545774 - RNA, 19 nt, Homo sapiens
gcagcaggaugcaaaguug

SEQ ID NO: 545775 - RNA, 19 nt, Homo sapiens
uaacaugucuucucauugc

SEQ ID NO: 545776 - RNA, 19 nt, Homo sapiens
gaacacgccuccugcuaag

SEQ ID NO: 545777 - RNA, 19 nt, Homo sapiens
gcaucgcccuggauuauga

SEQ ID NO: 545778 - RNA, 19 nt, Homo sapiens
gcaagaagccuuuuaagaa

SEQ ID NO: 545779 - RNA, 19 nt, Homo sapiens
ggaacacgccuccugcuaa

SEQ ID NO: 545780 - RNA, 19 nt, Homo sapiens
gguguuaccucuuauugug

SEQ ID NO: 545781 - RNA, 19 nt, Homo sapiens
ggacgaagaugaggaaucg

SEQ ID NO: 545782 - RNA, 19 nt, Homo sapiens
ucagaugcuucacuucuuu

SEQ ID NO: 545783 - RNA, 19 nt, Homo sapiens
agaauauacugacggcaua

SEQ ID NO: 545784 - RNA, 19 nt, Homo sapiens
cagauaaacuccucucucu

SEQ ID NO: 545785 - RNA, 19 nt, Homo sapiens
caugagggcuccuuuccuu

SEQ ID NO: 545786 - RNA, 19 nt, Homo sapiens
guggaaaccuguugagauc

SEQ ID NO: 545787 - RNA, 19 nt, Homo sapiens
gagacuuccuaaacaggua

SEQ ID NO: 545788 - RNA, 19 nt, Homo sapiens
gcaaagggagaagcugaua

SEQ ID NO: 545789 - RNA, 19 nt, Homo sapiens
agaccucucugaacuaaga

SEQ ID NO: 545790 - RNA, 19 nt, Homo sapiens
gaccagaggcaguacauug

SEQ ID NO: 545791 - RNA, 19 nt, Homo sapiens
guaguugccuuccauggau

SEQ ID NO: 545792 - RNA, 19 nt, Homo sapiens
ggugcgcgcugcuguaguu

SEQ ID NO: 545793 - RNA, 19 nt, Homo sapiens
ggaauggagagaaggguaa

SEQ ID NO: 545794 - RNA, 19 nt, Homo sapiens
gcucugcacucucuggaau

SEQ ID NO: 545795 - RNA, 19 nt, Homo sapiens
gcugagagacuuggaauau

SEQ ID NO: 545796 - RNA, 19 nt, Homo sapiens
caucacaguuuaacacaag

SEQ ID NO: 545797 - RNA, 19 nt, Homo sapiens
caacgaggccugagggaau

SEQ ID NO: 545798 - RNA, 19 nt, Homo sapiens
aguaacaugucuucucauu

SEQ ID NO: 545799 - RNA, 19 nt, Homo sapiens
uacaagcugugaucacuga

SEQ ID NO: 545800 - RNA, 19 nt, Homo sapiens
gaacaucuugcucuugauc

SEQ ID NO: 545801 - RNA, 19 nt, Homo sapiens
ggaagaagaggaggaggaa

SEQ ID NO: 545802 - RNA, 19 nt, Homo sapiens
gggaaacggacgaagauga

SEQ ID NO: 545803 - RNA, 19 nt, Homo sapiens
aguaggugcucaauaaaga

SEQ ID NO: 545804 - RNA, 19 nt, Homo sapiens
aaauugaucucccagucuu

SEQ ID NO: 545805 - RNA, 19 nt, Homo sapiens
caagagagggaguaacaug

SEQ ID NO: 545806 - RNA, 19 nt, Homo sapiens
cagcgcauaucaucucaug

SEQ ID NO: 545807 - RNA, 19 nt, Homo sapiens
cugagagacuuggaauaua

SEQ ID NO: 545808 - RNA, 19 nt, Homo sapiens
gaaaccagggcugagcaua

SEQ ID NO: 545809 - RNA, 19 nt, Homo sapiens
ucaauuacgccuaagauca

SEQ ID NO: 545810 - RNA, 19 nt, Homo sapiens
ggucugaggaugaagaaga

SEQ ID NO: 545811 - RNA, 19 nt, Homo sapiens
ggaagcugcugagagacuu

SEQ ID NO: 545812 - RNA, 19 nt, Homo sapiens
gaaguucuggguugggaaa

SEQ ID NO: 545813 - RNA, 19 nt, Homo sapiens
guacauuguggcugaguuu

SEQ ID NO: 545814 - RNA, 19 nt, Homo sapiens
gagaaggguaaugguguua

SEQ ID NO: 545815 - RNA, 19 nt, Homo sapiens
guugagaucacagagaaua

SEQ ID NO: 545816 - RNA, 19 nt, Homo sapiens
caacgcagagucacaggaa

SEQ ID NO: 545817 - RNA, 19 nt, Homo sapiens
ggaggaagaggaggaaguu

SEQ ID NO: 545818 - RNA, 19 nt, Homo sapiens
gggcuggucugaggaugaa

SEQ ID NO: 545819 - RNA, 19 nt, Homo sapiens
ugagaucacagagaauaua

SEQ ID NO: 545820 - RNA, 19 nt, Homo sapiens
caccaggucuucaugucaa

SEQ ID NO: 545821 - RNA, 19 nt, Homo sapiens
gggaagacagggaaaggaa

SEQ ID NO: 545822 - RNA, 19 nt, Homo sapiens
gcauccagguuccacuuuc

SEQ ID NO: 545823 - RNA, 19 nt, Homo sapiens
aaccagggcugagcauauu

SEQ ID NO: 545824 - RNA, 19 nt, Homo sapiens
aguccaggcuucucugaaa

SEQ ID NO: 545825 - RNA, 19 nt, Homo sapiens
ggacacgagagacuuccua

SEQ ID NO: 545826 - RNA, 19 nt, Homo sapiens
guugggcgaugaagaggaa

SEQ ID NO: 545827 - RNA, 19 nt, Homo sapiens
ggaagugcgugaccuacac

SEQ ID NO: 545828 - RNA, 19 nt, Homo sapiens
gcagggagaaguucaagag

SEQ ID NO: 545829 - RNA, 19 nt, Homo sapiens
caagaagccuuuuaagaag

SEQ ID NO: 545830 - RNA, 19 nt, Homo sapiens
ugaccaccauugucucaga

SEQ ID NO: 545831 - RNA, 19 nt, Homo sapiens
gaucacagagaauauacug

SEQ ID NO: 545832 - RNA, 19 nt, Homo sapiens
gguacaagcugugaucacu

SEQ ID NO: 545833 - RNA, 19 nt, Homo sapiens
caccuucccuggcauuuua

SEQ ID NO: 545834 - RNA, 19 nt, Homo sapiens
cgagagacuuccuaaacag

SEQ ID NO: 545835 - RNA, 19 nt, Homo sapiens
gggagcagcaggaugcaaa

SEQ ID NO: 545836 - RNA, 19 nt, Homo sapiens
gagagggaguaacaugucu

SEQ ID NO: 545837 - RNA, 19 nt, Homo sapiens
ggaggaaguucuggaaagc

SEQ ID NO: 545838 - RNA, 19 nt, Homo sapiens
ggaaacggacgaagaugag

SEQ ID NO: 545839 - RNA, 19 nt, Homo sapiens
gaauauacugacggcauaa

SEQ ID NO: 545840 - RNA, 19 nt, Homo sapiens
ggaggaagagggagaagag

SEQ ID NO: 545841 - RNA, 19 nt, Homo sapiens
gaagcugcacuacuacugu

SEQ ID NO: 545842 - RNA, 19 nt, Homo sapiens
ggaaaccuguugagaucac

SEQ ID NO: 545843 - RNA, 19 nt, Homo sapiens
gggcugagcauauuuccau

SEQ ID NO: 545844 - RNA, 19 nt, Homo sapiens
ggaguaccagcgcauauca

SEQ ID NO: 545845 - RNA, 19 nt, Homo sapiens
ccacucugcugcccaccuu

SEQ ID NO: 545846 - RNA, 19 nt, Homo sapiens
agagaaggguaaugguguu

SEQ ID NO: 545847 - RNA, 19 nt, Homo sapiens
gaguggagaugggaagaca

SEQ ID NO: 545848 - RNA, 19 nt, Homo sapiens
acgagagacuuccuaaaca

SEQ ID NO: 545849 - RNA, 19 nt, Homo sapiens
ugagcagggucaucaguuc

SEQ ID NO: 545850 - RNA, 19 nt, Homo sapiens
caucuuauacuacucuugu

SEQ ID NO: 545851 - RNA, 19 nt, Homo sapiens
caucuuauuucugccucua

SEQ ID NO: 545852 - RNA, 19 nt, Homo sapiens
ccacggacccaaccucugu

SEQ ID NO: 545853 - RNA, 19 nt, Homo sapiens
ggaagaggaggaaguucug

SEQ ID NO: 545854 - RNA, 19 nt, Homo sapiens
gcgaugaagaggaagaaga

SEQ ID NO: 545855 - RNA, 19 nt, Homo sapiens
ggauaugacgacugggaaa

SEQ ID NO: 545856 - RNA, 19 nt, Homo sapiens
ggugcucaauaaagacuug

SEQ ID NO: 545857 - RNA, 19 nt, Homo sapiens
ccauuuaaagccuggagua

SEQ ID NO: 545858 - RNA, 19 nt, Homo sapiens
caauuacgccuaagaucau

SEQ ID NO: 545859 - RNA, 19 nt, Homo sapiens
gaggaggaaguucuggaaa

SEQ ID NO: 545860 - RNA, 19 nt, Homo sapiens
ggaggaacaccugcuggaa

SEQ ID NO: 545861 - RNA, 19 nt, Homo sapiens
gcucaauaaagacuuguug

SEQ ID NO: 545862 - RNA, 19 nt, Homo sapiens
aaaccagggcugagcauau

SEQ ID NO: 545863 - RNA, 19 nt, Homo sapiens
ugccuuccauggaucuaua

SEQ ID NO: 545864 - RNA, 19 nt, Homo sapiens
gggacccugugaccauuga

SEQ ID NO: 545865 - RNA, 19 nt, Homo sapiens
gagcacacuucuuuaauaa

SEQ ID NO: 545866 - RNA, 19 nt, Homo sapiens
caaagaaacccuacaaaug

SEQ ID NO: 545867 - RNA, 19 nt, Homo sapiens
ugagcacacuucuuuaaua

SEQ ID NO: 545868 - RNA, 19 nt, Homo sapiens
gcaaagaaacccuacaaau

SEQ ID NO: 545869 - RNA, 19 nt, Homo sapiens
gcaagagagacacauaaua

SEQ ID NO: 545870 - RNA, 19 nt, Homo sapiens
gcagaauccugaaccaaga

SEQ ID NO: 545871 - RNA, 19 nt, Homo sapiens
cauaauagccaaacuagaa

SEQ ID NO: 545872 - RNA, 19 nt, Homo sapiens
ucacagagcauccaagaaa

SEQ ID NO: 545873 - RNA, 19 nt, Homo sapiens
ucgcuuagcucuaccguuu

SEQ ID NO: 545874 - RNA, 19 nt, Homo sapiens
cuacaaaugugaugacugu

SEQ ID NO: 545875 - RNA, 19 nt, Homo sapiens
aaagaaacccuacaaaugu

SEQ ID NO: 545876 - RNA, 19 nt, Homo sapiens
gcaaagagaacuuaagucu

SEQ ID NO: 545877 - RNA, 19 nt, Homo sapiens
gcacgaggcccuugaggaa

SEQ ID NO: 545878 - RNA, 19 nt, Homo sapiens
caagagagacacauaauag

SEQ ID NO: 545879 - RNA, 19 nt, Homo sapiens
gaugagugaucuaccagaa

SEQ ID NO: 545880 - RNA, 19 nt, Homo sapiens
ggaauggucugcagaaucc

SEQ ID NO: 545881 - RNA, 19 nt, Homo sapiens
ggagguaaacggagucuga

SEQ ID NO: 545882 - RNA, 19 nt, Homo sapiens
gcaaagccaugugcagugu

SEQ ID NO: 545883 - RNA, 19 nt, Homo sapiens
gaaccuucguuucuagaau

SEQ ID NO: 545884 - RNA, 19 nt, Homo sapiens
aggcaucgauguccaauga

SEQ ID NO: 545885 - RNA, 19 nt, Homo sapiens
cgacagcucugccgucagu

SEQ ID NO: 545886 - RNA, 19 nt, Homo sapiens
gcguauugcucauuaaauc

SEQ ID NO: 545887 - RNA, 19 nt, Homo sapiens
aguaaaggcuagcaaguga

SEQ ID NO: 545888 - RNA, 19 nt, Homo sapiens
gcccaaccgugcaugauga

SEQ ID NO: 545889 - RNA, 19 nt, Homo sapiens
ccaaaggcuuaacccguuu

SEQ ID NO: 545890 - RNA, 19 nt, Homo sapiens
uuuaggacguuaugacuuu

SEQ ID NO: 545891 - RNA, 19 nt, Homo sapiens
aaacugacaagaagacaaa

SEQ ID NO: 545892 - RNA, 19 nt, Homo sapiens
caugagcacacuucuuuaa

SEQ ID NO: 545893 - RNA, 19 nt, Homo sapiens
caagcaagagagacacaua

SEQ ID NO: 545894 - RNA, 19 nt, Homo sapiens
uagccaaacuagaagagaa

SEQ ID NO: 545895 - RNA, 19 nt, Homo sapiens
gagagagaaucaggacaau

SEQ ID NO: 545896 - RNA, 19 nt, Homo sapiens
gaaagcacgaggcccuuga

SEQ ID NO: 545897 - RNA, 19 nt, Homo sapiens
gaacaggaacugccagacu

SEQ ID NO: 545898 - RNA, 19 nt, Homo sapiens
caaaauggcagcuaaaaug

SEQ ID NO: 545899 - RNA, 19 nt, Homo sapiens
ccacugagagagcuaaaga

SEQ ID NO: 545900 - RNA, 19 nt, Homo sapiens
gagcauccaagaaaccaaa

SEQ ID NO: 545901 - RNA, 19 nt, Homo sapiens
ggaccgcguugucuugagu

SEQ ID NO: 545902 - RNA, 19 nt, Homo sapiens
gaggaaugaugaugcacau

SEQ ID NO: 545903 - RNA, 19 nt, Homo sapiens
gagcugaagagacacaaga

SEQ ID NO: 545904 - RNA, 19 nt, Homo sapiens
ccucagagaaccuucguuu

SEQ ID NO: 545905 - RNA, 19 nt, Homo sapiens
caagugaggcuuugucucu

SEQ ID NO: 545906 - RNA, 19 nt, Homo sapiens
acacauaauagccaaacua

SEQ ID NO: 545907 - RNA, 19 nt, Homo sapiens
ccugugugcuugcuacuga

SEQ ID NO: 545908 - RNA, 19 nt, Homo sapiens
gaugacagggugcagagaa

SEQ ID NO: 545909 - RNA, 19 nt, Homo sapiens
ggaaaagcuucacguggaa

SEQ ID NO: 545910 - RNA, 19 nt, Homo sapiens
aagaaacccuacaaaugug

SEQ ID NO: 545911 - RNA, 19 nt, Homo sapiens
ugagagagcuaaagaaaag

SEQ ID NO: 545912 - RNA, 19 nt, Homo sapiens
gacauugcaggguggaaua

SEQ ID NO: 545913 - RNA, 19 nt, Homo sapiens
gagaagugacaacaaggaa

SEQ ID NO: 545914 - RNA, 19 nt, Homo sapiens
gaaccaagaggggcaaaua

SEQ ID NO: 545915 - RNA, 19 nt, Homo sapiens
gaaugagaagugacaacaa

SEQ ID NO: 545916 - RNA, 19 nt, Homo sapiens
ugugcuugcuacugaaaua

SEQ ID NO: 545917 - RNA, 19 nt, Homo sapiens
gcuuagcucuaccguuuag

SEQ ID NO: 545918 - RNA, 19 nt, Homo sapiens
aaugagaagugacaacaag

SEQ ID NO: 545919 - RNA, 19 nt, Homo sapiens
cagcaaagaaacccuacaa

SEQ ID NO: 545920 - RNA, 19 nt, Homo sapiens
cuucguuucuagaaucuuu

SEQ ID NO: 545921 - RNA, 19 nt, Homo sapiens
uuaaaucgucccucuguug

SEQ ID NO: 545922 - RNA, 19 nt, Homo sapiens
ugagagagaaucaggacaa

SEQ ID NO: 545923 - RNA, 19 nt, Homo sapiens
ggaacugccagacuuucaa

SEQ ID NO: 545924 - RNA, 19 nt, Homo sapiens
aacaggaacugccagacuu

SEQ ID NO: 545925 - RNA, 19 nt, Homo sapiens
caaaggcuuaacccguuua

SEQ ID NO: 545926 - RNA, 19 nt, Homo sapiens
gaagugacaacaaggaaaa

SEQ ID NO: 545927 - RNA, 19 nt, Homo sapiens
gcuagcaagugaggcuuug

SEQ ID NO: 545928 - RNA, 19 nt, Homo sapiens
ugagugaucuaccagaaaa

SEQ ID NO: 545929 - RNA, 19 nt, Homo sapiens
gagagaaucaggacaaucc

SEQ ID NO: 545930 - RNA, 19 nt, Homo sapiens
cugcagagagcaaggagua

SEQ ID NO: 545931 - RNA, 19 nt, Homo sapiens
gaaaagcaaaggagguaaa

SEQ ID NO: 545932 - RNA, 19 nt, Homo sapiens
uaaaggagcaaagccaugu

SEQ ID NO: 545933 - RNA, 19 nt, Homo sapiens
guuaaaucgucccucuguu

SEQ ID NO: 545934 - RNA, 19 nt, Homo sapiens
gcacuccaugcuuuagauu

SEQ ID NO: 545935 - RNA, 19 nt, Homo sapiens
guaaacggagucugagcaa

SEQ ID NO: 545936 - RNA, 19 nt, Homo sapiens
ccagggucaugaucccaaa

SEQ ID NO: 545937 - RNA, 19 nt, Homo sapiens
aaaaggugcucuuggagaa

SEQ ID NO: 545938 - RNA, 19 nt, Homo sapiens
gauugugacccucguggaa

SEQ ID NO: 545939 - RNA, 19 nt, Homo sapiens
aagcaagagagacacauaa

SEQ ID NO: 545940 - RNA, 19 nt, Homo sapiens
gggaauggucugcagaauc

SEQ ID NO: 545941 - RNA, 19 nt, Homo sapiens
aaagccaugugcaguguca

SEQ ID NO: 545942 - RNA, 19 nt, Homo sapiens
ggcaaaaggugcucuugga

SEQ ID NO: 545943 - RNA, 19 nt, Homo sapiens
gcacaccaaggagcagauu

SEQ ID NO: 545944 - RNA, 19 nt, Homo sapiens
aacccgagcugcacaccaa

SEQ ID NO: 545945 - RNA, 19 nt, Homo sapiens
acgaggcccuugaggaaug

SEQ ID NO: 545946 - RNA, 19 nt, Homo sapiens
acugagagagcuaaagaaa

SEQ ID NO: 545947 - RNA, 19 nt, Homo sapiens
ugacccucguggaagauuu

SEQ ID NO: 545948 - RNA, 19 nt, Homo sapiens
aggcuuaacccguuuacaa

SEQ ID NO: 545949 - RNA, 19 nt, Homo sapiens
gucuugaguuuggcuagua

SEQ ID NO: 545950 - RNA, 19 nt, Homo sapiens
ucaccagcaucaccgacuu

SEQ ID NO: 545951 - RNA, 19 nt, Homo sapiens
guuaugacuuuucuccuuu

SEQ ID NO: 545952 - RNA, 19 nt, Homo sapiens
cuuaacccguuuacaagga

SEQ ID NO: 545953 - RNA, 19 nt, Homo sapiens
gcugugaggaggcccagaa

SEQ ID NO: 545954 - RNA, 19 nt, Homo sapiens
gcuguggccucgcuuagcu

SEQ ID NO: 545955 - RNA, 19 nt, Homo sapiens
caggucagcuccccaaaug

SEQ ID NO: 545956 - RNA, 19 nt, Homo sapiens
acacugaagcuuccuccaa

SEQ ID NO: 545957 - RNA, 19 nt, Homo sapiens
acuccaugcuuuagauuca

SEQ ID NO: 545958 - RNA, 19 nt, Homo sapiens
ggagucugagcaaccguuu

SEQ ID NO: 545959 - RNA, 19 nt, Homo sapiens
ccaggaugcgggagaguug

SEQ ID NO: 545960 - RNA, 19 nt, Homo sapiens
gcucacuaccagagacauu

SEQ ID NO: 545961 - RNA, 19 nt, Homo sapiens
acacuggagagaagccaua

SEQ ID NO: 545962 - RNA, 19 nt, Homo sapiens
gcugaagagacacaagaga

SEQ ID NO: 545963 - RNA, 19 nt, Homo sapiens
ucaugagcacacuucuuua

SEQ ID NO: 545964 - RNA, 19 nt, Homo sapiens
aucaugagcacacuucuuu

SEQ ID NO: 545965 - RNA, 19 nt, Homo sapiens
gaaagaagcccuauaaaug

SEQ ID NO: 545966 - RNA, 19 nt, Homo sapiens
ggaaagccuucacuucuaa

SEQ ID NO: 545967 - RNA, 19 nt, Homo sapiens
gauguaagcagaugaguua

SEQ ID NO: 545968 - RNA, 19 nt, Homo sapiens
ggagaaaccuuaugaaugc

SEQ ID NO: 545969 - RNA, 19 nt, Homo sapiens
gaaacaaccucagaaaugu

SEQ ID NO: 545970 - RNA, 19 nt, Homo sapiens
gaagugauugggaauauua

SEQ ID NO: 545971 - RNA, 19 nt, Homo sapiens
guaagcagaugaguuauuu

SEQ ID NO: 545972 - RNA, 19 nt, Homo sapiens
caucagaggugucaagaaa

SEQ ID NO: 545973 - RNA, 19 nt, Homo sapiens
ggaaaggccuucaacaaca

SEQ ID NO: 545974 - RNA, 19 nt, Homo sapiens
ucaaauaacucacacuaga

SEQ ID NO: 545975 - RNA, 19 nt, Homo sapiens
gagagaagccuuacaaaug

SEQ ID NO: 545976 - RNA, 19 nt, Homo sapiens
gauguuaucucucuucaga

SEQ ID NO: 545977 - RNA, 19 nt, Homo sapiens
gagcaucccuaaucugaaa

SEQ ID NO: 545978 - RNA, 19 nt, Homo sapiens
ggaaaucguucaguaagaa

SEQ ID NO: 545979 - RNA, 19 nt, Homo sapiens
gugagccucuccauaauua

SEQ ID NO: 545980 - RNA, 19 nt, Homo sapiens
gggaaggucuuuauucaga

SEQ ID NO: 545981 - RNA, 19 nt, Homo sapiens
ggaggaggcugaagucuca

SEQ ID NO: 545982 - RNA, 19 nt, Homo sapiens
agaaagaccuuaugugugu

SEQ ID NO: 545983 - RNA, 19 nt, Homo sapiens
gggaaagccuucacuucua

SEQ ID NO: 545984 - RNA, 19 nt, Homo sapiens
guacuggccucauuaagga

SEQ ID NO: 545985 - RNA, 19 nt, Homo sapiens
gaagaaaccagauggaugu

SEQ ID NO: 545986 - RNA, 19 nt, Homo sapiens
ggucagcuauucagccaua

SEQ ID NO: 545987 - RNA, 19 nt, Homo sapiens
caacaaugauuaacuccuu

SEQ ID NO: 545988 - RNA, 19 nt, Homo sapiens
gaaauguccuucugaguac

SEQ ID NO: 545989 - RNA, 19 nt, Homo sapiens
agacaaaucuuacaaaugc

SEQ ID NO: 545990 - RNA, 19 nt, Homo sapiens
ggagaaagaccuuaugugu

SEQ ID NO: 545991 - RNA, 19 nt, Homo sapiens
ggaaagccuucaaccagaa

SEQ ID NO: 545992 - RNA, 19 nt, Homo sapiens
caaccuguauguacguaua

SEQ ID NO: 545993 - RNA, 19 nt, Homo sapiens
ggucaaacuucaauaaaca

SEQ ID NO: 545994 - RNA, 19 nt, Homo sapiens
ggucaaauuuccauaaaca

SEQ ID NO: 545995 - RNA, 19 nt, Homo sapiens
ggcaaaggcuucucccaaa

SEQ ID NO: 545996 - RNA, 19 nt, Homo sapiens
caacagagaauucauagug

SEQ ID NO: 545997 - RNA, 19 nt, Homo sapiens
ggagaugccugcugaugug

SEQ ID NO: 545998 - RNA, 19 nt, Homo sapiens
aaacucaacccucauuaua

SEQ ID NO: 545999 - RNA, 19 nt, Homo sapiens
ggagaaagacaccauguau

SEQ ID NO: 546000 - RNA, 19 nt, Homo sapiens
ucagagaacucacaguaga

SEQ ID NO: 546001 - RNA, 19 nt, Homo sapiens
gggaagaaacccugacuaa

SEQ ID NO: 546002 - RNA, 19 nt, Homo sapiens
gagagaaacccuaugaaug

SEQ ID NO: 546003 - RNA, 19 nt, Homo sapiens
gaacucacaugggagagaa

SEQ ID NO: 546004 - RNA, 19 nt, Homo sapiens
guacguauauuucuguauc

SEQ ID NO: 546005 - RNA, 19 nt, Homo sapiens
gggcagaaguccuaugugu

SEQ ID NO: 546006 - RNA, 19 nt, Homo sapiens
gaagugaacggucagaaug

SEQ ID NO: 546007 - RNA, 19 nt, Homo sapiens
ccaauuagcauuuccuuug

SEQ ID NO: 546008 - RNA, 19 nt, Homo sapiens
ugaaagcaaugacacagaa

SEQ ID NO: 546009 - RNA, 19 nt, Homo sapiens
uaggaaaccuccaugaaug

SEQ ID NO: 546010 - RNA, 19 nt, Homo sapiens
caauuagcauuuccuuuga

SEQ ID NO: 546011 - RNA, 19 nt, Homo sapiens
gguuguuacucgauuauuu

SEQ ID NO: 546012 - RNA, 19 nt, Homo sapiens
gaagaaacccugacuaacg

SEQ ID NO: 546013 - RNA, 19 nt, Homo sapiens
cuagaaagaagcccuauaa

SEQ ID NO: 546014 - RNA, 19 nt, Homo sapiens
ugcaggaucucucuucaua

SEQ ID NO: 546015 - RNA, 19 nt, Homo sapiens
gaaaccagauggauguucu

SEQ ID NO: 546016 - RNA, 19 nt, Homo sapiens
ggagagaaacccuaugaau

SEQ ID NO: 546017 - RNA, 19 nt, Homo sapiens
ggagagaagccuuacaaau

SEQ ID NO: 546018 - RNA, 19 nt, Homo sapiens
gcagaaguccuaugugugu

SEQ ID NO: 546019 - RNA, 19 nt, Homo sapiens
gaacacagaaagcaauugu

SEQ ID NO: 546020 - RNA, 19 nt, Homo sapiens
gggaaaucguucaguaaga

SEQ ID NO: 546021 - RNA, 19 nt, Homo sapiens
caaagagcaucagcgaauu

SEQ ID NO: 546022 - RNA, 19 nt, Homo sapiens
caucagagaacucacagua

SEQ ID NO: 546023 - RNA, 19 nt, Homo sapiens
gaaggucuuuauucagaga

SEQ ID NO: 546024 - RNA, 19 nt, Homo sapiens
ccauuagucucguucauau

SEQ ID NO: 546025 - RNA, 19 nt, Homo sapiens
gaccuuauguguguucuga

SEQ ID NO: 546026 - RNA, 19 nt, Homo sapiens
gggagaaaccuuaugaaug

SEQ ID NO: 546027 - RNA, 19 nt, Homo sapiens
ccucagaaauguugcuuau

SEQ ID NO: 546028 - RNA, 19 nt, Homo sapiens
caagagagaccgagaguag

SEQ ID NO: 546029 - RNA, 19 nt, Homo sapiens
ccaaacaccuauccagcuu

SEQ ID NO: 546030 - RNA, 19 nt, Homo sapiens
acagagaauucauagugua

SEQ ID NO: 546031 - RNA, 19 nt, Homo sapiens
ucaacaaacugugccauug

SEQ ID NO: 546032 - RNA, 19 nt, Homo sapiens
gcaggucaaauuuccauaa

SEQ ID NO: 546033 - RNA, 19 nt, Homo sapiens
acacagaacagcuugauga

SEQ ID NO: 546034 - RNA, 19 nt, Homo sapiens
agaaacaaccucagaaaug

SEQ ID NO: 546035 - RNA, 19 nt, Homo sapiens
gugggaaggucuuuauuca

SEQ ID NO: 546036 - RNA, 19 nt, Homo sapiens
ccaugaauguggcaaaugu

SEQ ID NO: 546037 - RNA, 19 nt, Homo sapiens
gagaauucauaguguagga

SEQ ID NO: 546038 - RNA, 19 nt, Homo sapiens
gaggucaucuucagaaugc

SEQ ID NO: 546039 - RNA, 19 nt, Homo sapiens
gaaaggccuucaacaacag

SEQ ID NO: 546040 - RNA, 19 nt, Homo sapiens
caggucaaauuuccauaaa

SEQ ID NO: 546041 - RNA, 19 nt, Homo sapiens
agaaagaagcccuauaaau

SEQ ID NO: 546042 - RNA, 19 nt, Homo sapiens
guaggaaaccuccaugaau

SEQ ID NO: 546043 - RNA, 19 nt, Homo sapiens
agccauagcucuucugaug

SEQ ID NO: 546044 - RNA, 19 nt, Homo sapiens
auagugagccucuccauaa

SEQ ID NO: 546045 - RNA, 19 nt, Homo sapiens
gauuucagauacuuacaga

SEQ ID NO: 546046 - RNA, 19 nt, Homo sapiens
ucaaagagcaucagcgaau

SEQ ID NO: 546047 - RNA, 19 nt, Homo sapiens
ccagaagucacaccucuuu

SEQ ID NO: 546048 - RNA, 19 nt, Homo sapiens
gguaaaugcauaaaugaga

SEQ ID NO: 546049 - RNA, 19 nt, Homo sapiens
ccagaaggcacaccugauu

SEQ ID NO: 546050 - RNA, 19 nt, Homo sapiens
guuugaagcugaaccuaga

SEQ ID NO: 546051 - RNA, 19 nt, Homo sapiens
ucacagugcuuucuucaac

SEQ ID NO: 546052 - RNA, 19 nt, Homo sapiens
agucacagcuugauauaca

SEQ ID NO: 546053 - RNA, 19 nt, Homo sapiens
ucagaaucaggucuaauua

SEQ ID NO: 546054 - RNA, 19 nt, Homo sapiens
aaacaacucauaccagaga

SEQ ID NO: 546055 - RNA, 19 nt, Homo sapiens
caucaaauaacucacacua

SEQ ID NO: 546056 - RNA, 19 nt, Homo sapiens
cagcaugcaucagagaauu

SEQ ID NO: 546057 - RNA, 19 nt, Homo sapiens
gcaucagcauauucauaaa

SEQ ID NO: 546058 - RNA, 19 nt, Homo sapiens
gagacaaaucuuacaaaug

SEQ ID NO: 546059 - RNA, 19 nt, Homo sapiens
caacaacaggucaaacuuc

SEQ ID NO: 546060 - RNA, 19 nt, Homo sapiens
caaggugcaucagcgaauu

SEQ ID NO: 546061 - RNA, 19 nt, Homo sapiens
ggucaggccacaucauuga

SEQ ID NO: 546062 - RNA, 19 nt, Homo sapiens
gagaaagacaccauguaug

SEQ ID NO: 546063 - RNA, 19 nt, Homo sapiens
aaagguaaccaguguagaa

SEQ ID NO: 546064 - RNA, 19 nt, Homo sapiens
gcaaagguaaccaguguag

SEQ ID NO: 546065 - RNA, 19 nt, Homo sapiens
ggacaaaccuuauaaaugu

SEQ ID NO: 546066 - RNA, 19 nt, Homo sapiens
gaacauauauuggagagaa

SEQ ID NO: 546067 - RNA, 19 nt, Homo sapiens
gagagaagccuuauaaaug

SEQ ID NO: 546068 - RNA, 19 nt, Homo sapiens
gaacacauggucuucaaua

SEQ ID NO: 546069 - RNA, 19 nt, Homo sapiens
gcacuaaccuuauaaugca

SEQ ID NO: 546070 - RNA, 19 nt, Homo sapiens
gggaaggccuuuaggaauu

SEQ ID NO: 546071 - RNA, 19 nt, Homo sapiens
gaaacuccaugaaugaaau

SEQ ID NO: 546072 - RNA, 19 nt, Homo sapiens
gcauaaacaugaacugugu

SEQ ID NO: 546073 - RNA, 19 nt, Homo sapiens
cauaauugcuggacacuga

SEQ ID NO: 546074 - RNA, 19 nt, Homo sapiens
ggagagaagccuuauaaau

SEQ ID NO: 546075 - RNA, 19 nt, Homo sapiens
gaacagaacacauggucuu

SEQ ID NO: 546076 - RNA, 19 nt, Homo sapiens
cacaagcacuaaccuuaua

SEQ ID NO: 546077 - RNA, 19 nt, Homo sapiens
gaucagucaucccuuaaga

SEQ ID NO: 546078 - RNA, 19 nt, Homo sapiens
agagaagccuuauaaaugu

SEQ ID NO: 546079 - RNA, 19 nt, Homo sapiens
gagagaaacccuaugaaug

SEQ ID NO: 546080 - RNA, 19 nt, Homo sapiens
aagaacagcugaagacaga

SEQ ID NO: 546081 - RNA, 19 nt, Homo sapiens
gccagaaacuccaugaaug

SEQ ID NO: 546082 - RNA, 19 nt, Homo sapiens
gagaaacccuaugacugua

SEQ ID NO: 546083 - RNA, 19 nt, Homo sapiens
ggagagaaacccuaugaau

SEQ ID NO: 546084 - RNA, 19 nt, Homo sapiens
gcacaagcacuaaccuuau

SEQ ID NO: 546085 - RNA, 19 nt, Homo sapiens
ggagagaagcccuguuaug

SEQ ID NO: 546086 - RNA, 19 nt, Homo sapiens
ggagagaugcccuaugaau

SEQ ID NO: 546087 - RNA, 19 nt, Homo sapiens
gggacaaaccuuauaaaug

SEQ ID NO: 546088 - RNA, 19 nt, Homo sapiens
cuggagagaugcccuauga

SEQ ID NO: 546089 - RNA, 19 nt, Homo sapiens
ugauggcucugccugcuua

SEQ ID NO: 546090 - RNA, 19 nt, Homo sapiens
acuaguugcugucucaaua

SEQ ID NO: 546091 - RNA, 19 nt, Homo sapiens
ccagaaacuccaugaauga

SEQ ID NO: 546092 - RNA, 19 nt, Homo sapiens
cacaggcucuuaccuuauu

SEQ ID NO: 546093 - RNA, 19 nt, Homo sapiens
ccaaggauggagugaaaua

SEQ ID NO: 546094 - RNA, 19 nt, Homo sapiens
ggaaggccuuuaggaauuc

SEQ ID NO: 546095 - RNA, 19 nt, Homo sapiens
agagaagccuuaugagugu

SEQ ID NO: 546096 - RNA, 19 nt, Homo sapiens
agagaagccuuaugagugu

SEQ ID NO: 546097 - RNA, 19 nt, Homo sapiens
ccucaugccuccuuucuca

SEQ ID NO: 546098 - RNA, 19 nt, Homo sapiens
gaaacucaacuuaaaccaa

SEQ ID NO: 546099 - RNA, 19 nt, Homo sapiens
gagagaagcccuguuaugg

SEQ ID NO: 546100 - RNA, 19 nt, Homo sapiens
ggagagaagccuuaugagu

SEQ ID NO: 546101 - RNA, 19 nt, Homo sapiens
ggagagaagccuuaugagu

SEQ ID NO: 546102 - RNA, 19 nt, Homo sapiens
ccaauggcauaaacaugaa

SEQ ID NO: 546103 - RNA, 19 nt, Homo sapiens
cugggaaacucaacuuaaa

SEQ ID NO: 546104 - RNA, 19 nt, Homo sapiens
gcuggacacugacugaugu

SEQ ID NO: 546105 - RNA, 19 nt, Homo sapiens
auauguagauucuguguga

SEQ ID NO: 546106 - RNA, 19 nt, Homo sapiens
cagaacacauggucuucaa

SEQ ID NO: 546107 - RNA, 19 nt, Homo sapiens
ucacaacuguagauccuau

SEQ ID NO: 546108 - RNA, 19 nt, Homo sapiens
gagagaugcccuaugaaug

SEQ ID NO: 546109 - RNA, 19 nt, Homo sapiens
uaucagcucugcagacaca

SEQ ID NO: 546110 - RNA, 19 nt, Homo sapiens
gggaaggcuuucacuguuc

SEQ ID NO: 546111 - RNA, 19 nt, Homo sapiens
gaagguagccaaggaugga

SEQ ID NO: 546112 - RNA, 19 nt, Homo sapiens
gaacagcugaagacagaug

SEQ ID NO: 546113 - RNA, 19 nt, Homo sapiens
agucaucccuuaagaaaca

SEQ ID NO: 546114 - RNA, 19 nt, Homo sapiens
agaagagucugacgagcaa

SEQ ID NO: 546115 - RNA, 19 nt, Homo sapiens
caagguggaucaagaacag

SEQ ID NO: 546116 - RNA, 19 nt, Homo sapiens
gguaucagcucugcagaca

SEQ ID NO: 546117 - RNA, 19 nt, Homo sapiens
caacucuggaugccuguua

SEQ ID NO: 546118 - RNA, 19 nt, Homo sapiens
ugaaaugacucagggaagu

SEQ ID NO: 546119 - RNA, 19 nt, Homo sapiens
gaacucacacuggagagaa

SEQ ID NO: 546120 - RNA, 19 nt, Homo sapiens
gcacaggcucuuaccuuau

SEQ ID NO: 546121 - RNA, 19 nt, Homo sapiens
cuucaucccuucagaaaca

SEQ ID NO: 546122 - RNA, 19 nt, Homo sapiens
gaagagggccugggagaag

SEQ ID NO: 546123 - RNA, 19 nt, Homo sapiens
gaacucacacuggagagaa

SEQ ID NO: 546124 - RNA, 19 nt, Homo sapiens
aaacaugaacugugucaga

SEQ ID NO: 546125 - RNA, 19 nt, Homo sapiens
caguuuaauugcauuguga

SEQ ID NO: 546126 - RNA, 19 nt, Homo sapiens
gagaaaaccuaugagugua

SEQ ID NO: 546127 - RNA, 19 nt, Homo sapiens
ucagucaucccuuaagaaa

SEQ ID NO: 546128 - RNA, 19 nt, Homo sapiens
gcugaagacagaugaaaga

SEQ ID NO: 546129 - RNA, 19 nt, Homo sapiens
gacacagucugaucuccaa

SEQ ID NO: 546130 - RNA, 19 nt, Homo sapiens
auuccucccuucuuucuua

SEQ ID NO: 546131 - RNA, 19 nt, Homo sapiens
ugccuaggcuggucucaaa

SEQ ID NO: 546132 - RNA, 19 nt, Homo sapiens
agaacuaguugcugucuca

SEQ ID NO: 546133 - RNA, 19 nt, Homo sapiens
gacacugacugauguacug

SEQ ID NO: 546134 - RNA, 19 nt, Homo sapiens
gaaacccuaugacuguaag

SEQ ID NO: 546135 - RNA, 19 nt, Homo sapiens
agagaaacccuaugacugu

SEQ ID NO: 546136 - RNA, 19 nt, Homo sapiens
ggucuucaauauguagauu

SEQ ID NO: 546137 - RNA, 19 nt, Homo sapiens
gaugcggucuugcuguguu

SEQ ID NO: 546138 - RNA, 19 nt, Homo sapiens
gagaaacccuaugaaugca

SEQ ID NO: 546139 - RNA, 19 nt, Homo sapiens
ugggaaggcuuucacuguu

SEQ ID NO: 546140 - RNA, 19 nt, Homo sapiens
gaucaagaacagcugaaga

SEQ ID NO: 546141 - RNA, 19 nt, Homo sapiens
agcacaggcucuuaccuua

SEQ ID NO: 546142 - RNA, 19 nt, Homo sapiens
gagaagccuuaugagugua

SEQ ID NO: 546143 - RNA, 19 nt, Homo sapiens
ggagagaaacccuaugacu

SEQ ID NO: 546144 - RNA, 19 nt, Homo sapiens
gaaaaccuaugaguguaaa

SEQ ID NO: 546145 - RNA, 19 nt, Homo sapiens
ggguauaaguaagcaagaa

SEQ ID NO: 546146 - RNA, 19 nt, Homo sapiens
aaucaaauaccaaggaaga

SEQ ID NO: 546147 - RNA, 19 nt, Homo sapiens
ucaaauaccaaggaagaaa

SEQ ID NO: 546148 - RNA, 19 nt, Homo sapiens
cuggagagaagccuuauaa

SEQ ID NO: 546149 - RNA, 19 nt, Homo sapiens
caauugcuaugcagaacau

SEQ ID NO: 546150 - RNA, 19 nt, Homo sapiens
ucacagaacucaguaaccu

SEQ ID NO: 546151 - RNA, 19 nt, Homo sapiens
ccuccugaguacauuuaua

SEQ ID NO: 546152 - RNA, 19 nt, Homo sapiens
agccaaggauggagugaaa

SEQ ID NO: 546153 - RNA, 19 nt, Homo sapiens
ggccagaaacuccaugaau

SEQ ID NO: 546154 - RNA, 19 nt, Homo sapiens
agagaaacccuaugaaugc

SEQ ID NO: 546155 - RNA, 19 nt, Homo sapiens
uuaggaaccuggccucagu

SEQ ID NO: 546156 - RNA, 19 nt, Homo sapiens
acacauggucuucaauaug

SEQ ID NO: 546157 - RNA, 19 nt, Homo sapiens
cuguagauccuaugaauau

SEQ ID NO: 546158 - RNA, 19 nt, Homo sapiens
gaaaugacucagggaagug

SEQ ID NO: 546159 - RNA, 19 nt, Homo sapiens
gcacaagcgaauccacaau

SEQ ID NO: 546160 - RNA, 19 nt, Homo sapiens
aacaugaacugugucagaa

SEQ ID NO: 546161 - RNA, 19 nt, Homo sapiens
ucaaacuccugcucucaag

SEQ ID NO: 546162 - RNA, 19 nt, Homo sapiens
gaguguaaccaguguggaa

SEQ ID NO: 546163 - RNA, 19 nt, Homo sapiens
gauucugugugacauagau

SEQ ID NO: 546164 - RNA, 19 nt, Homo sapiens
guagauucugugugacaua

SEQ ID NO: 546165 - RNA, 19 nt, Homo sapiens
guaagaagaugcagcuuga

SEQ ID NO: 546166 - RNA, 19 nt, Homo sapiens
ggaagaagguggcgguguu

SEQ ID NO: 546167 - RNA, 19 nt, Homo sapiens
cgagagaccuguucuuuca

SEQ ID NO: 546168 - RNA, 19 nt, Homo sapiens
gcacugcccuggucgaaug

SEQ ID NO: 546169 - RNA, 19 nt, Homo sapiens
gaacaacuucuacccuuaa

SEQ ID NO: 546170 - RNA, 19 nt, Homo sapiens
ccagacagccuuuauacua

SEQ ID NO: 546171 - RNA, 19 nt, Homo sapiens
ugacacagaugaugacuuc

SEQ ID NO: 546172 - RNA, 19 nt, Homo sapiens
ggaaacagcggcaacaguu

SEQ ID NO: 546173 - RNA, 19 nt, Homo sapiens
gcagcuagcucaggaaauc

SEQ ID NO: 546174 - RNA, 19 nt, Homo sapiens
ugaacaacuucuacccuua

SEQ ID NO: 546175 - RNA, 19 nt, Homo sapiens
gcccaaaugcgaaagaaua

SEQ ID NO: 546176 - RNA, 19 nt, Homo sapiens
auacagaccuggacuaucu

SEQ ID NO: 546177 - RNA, 19 nt, Homo sapiens
aaacugacuucuaggcuau

SEQ ID NO: 546178 - RNA, 19 nt, Homo sapiens
ggagagaucagaccuugga

SEQ ID NO: 546179 - RNA, 19 nt, Homo sapiens
gugggcacauuauccuuua

SEQ ID NO: 546180 - RNA, 19 nt, Homo sapiens
gcaccauccuggaagucua

SEQ ID NO: 546181 - RNA, 19 nt, Homo sapiens
gcuaugaaacugacuucua

SEQ ID NO: 546182 - RNA, 19 nt, Homo sapiens
agagggaguucgaggagua

SEQ ID NO: 546183 - RNA, 19 nt, Homo sapiens
ggaaagaagggaagaaggu

SEQ ID NO: 546184 - RNA, 19 nt, Homo sapiens
cuaugaaacugacuucuag

SEQ ID NO: 546185 - RNA, 19 nt, Homo sapiens
gacccuggauuguaggaaa

SEQ ID NO: 546186 - RNA, 19 nt, Homo sapiens
gagcagcacucagggaagu

SEQ ID NO: 546187 - RNA, 19 nt, Homo sapiens
ggcacauuauccuuuauuu

SEQ ID NO: 546188 - RNA, 19 nt, Homo sapiens
ugaugcagcuccucaaaca

SEQ ID NO: 546189 - RNA, 19 nt, Homo sapiens
caacuucuacccuuaaaca

SEQ ID NO: 546190 - RNA, 19 nt, Homo sapiens
gcgcuucuguggccaccua

SEQ ID NO: 546191 - RNA, 19 nt, Homo sapiens
ccacgaugcugagcuccua

SEQ ID NO: 546192 - RNA, 19 nt, Homo sapiens
gguaugggugggcacauua

SEQ ID NO: 546193 - RNA, 19 nt, Homo sapiens
cagacagccuuuauacuag

SEQ ID NO: 546194 - RNA, 19 nt, Homo sapiens
gggcagaaccagagagaug

SEQ ID NO: 546195 - RNA, 19 nt, Homo sapiens
ccucuuaguucgugacuca

SEQ ID NO: 546196 - RNA, 19 nt, Homo sapiens
gaaggaacacugggcagaa

SEQ ID NO: 546197 - RNA, 19 nt, Homo sapiens
gagcugagcagggaaacaa

SEQ ID NO: 546198 - RNA, 19 nt, Homo sapiens
gaagugcccaaaugcgaaa

SEQ ID NO: 546199 - RNA, 19 nt, Homo sapiens
uuucaagccuguuuagaug

SEQ ID NO: 546200 - RNA, 19 nt, Homo sapiens
ccaugacccuucccaaauc

SEQ ID NO: 546201 - RNA, 19 nt, Homo sapiens
gagaaacuuguucccauga

SEQ ID NO: 546202 - RNA, 19 nt, Homo sapiens
ggaaaucaagaaccucuca

SEQ ID NO: 546203 - RNA, 19 nt, Homo sapiens
gggccuacgucucagaugu

SEQ ID NO: 546204 - RNA, 19 nt, Homo sapiens
cgaugacccuggauuguag

SEQ ID NO: 546205 - RNA, 19 nt, Homo sapiens
agacagccuuuauacuaga

SEQ ID NO: 546206 - RNA, 19 nt, Homo sapiens
caaaugcgaaagaauaaca

SEQ ID NO: 546207 - RNA, 19 nt, Homo sapiens
cccaggagcugaaggauac

SEQ ID NO: 546208 - RNA, 19 nt, Homo sapiens
ggauacagaccuggacuau

SEQ ID NO: 546209 - RNA, 19 nt, Homo sapiens
ggacuguggccacgacuuc

SEQ ID NO: 546210 - RNA, 19 nt, Homo sapiens
ucugugaagugcccaaaug

SEQ ID NO: 546211 - RNA, 19 nt, Homo sapiens
gcaggacuaagguggcuuu

SEQ ID NO: 546212 - RNA, 19 nt, Homo sapiens
gcaucuggaccucuuaguu

SEQ ID NO: 546213 - RNA, 19 nt, Homo sapiens
gaagauaugcaagcagaag

SEQ ID NO: 546214 - RNA, 19 nt, Homo sapiens
ggguaugggugggcacauu

SEQ ID NO: 546215 - RNA, 19 nt, Homo sapiens
caucuggaccucuuaguuc

SEQ ID NO: 546216 - RNA, 19 nt, Homo sapiens
agagagaugggacauggua

SEQ ID NO: 546217 - RNA, 19 nt, Homo sapiens
uaugaaacuuacaggguau

SEQ ID NO: 546218 - RNA, 19 nt, Homo sapiens
gaaaaucugacuacuagga

SEQ ID NO: 546219 - RNA, 19 nt, Homo sapiens
ggccacgacuucugcauac

SEQ ID NO: 546220 - RNA, 19 nt, Homo sapiens
gggcacauuauccuuuauu

SEQ ID NO: 546221 - RNA, 19 nt, Homo sapiens
ggugggcacauuauccuuu

SEQ ID NO: 546222 - RNA, 19 nt, Homo sapiens
ugacuucuaggcuaugaaa

SEQ ID NO: 546223 - RNA, 19 nt, Homo sapiens
gaugauugaccaugguguu

SEQ ID NO: 546224 - RNA, 19 nt, Homo sapiens
cccaggagguauugaagga

SEQ ID NO: 546225 - RNA, 19 nt, Homo sapiens
gcaaaggaaaacaaaauga

SEQ ID NO: 546226 - RNA, 19 nt, Homo sapiens
cccaaaugcgaaagaauaa

SEQ ID NO: 546227 - RNA, 19 nt, Homo sapiens
ccgaugacccuggauugua

SEQ ID NO: 546228 - RNA, 19 nt, Homo sapiens
ccaucugccuggagagguu

SEQ ID NO: 546229 - RNA, 19 nt, Homo sapiens
gaggugaugggcaagcauu

SEQ ID NO: 546230 - RNA, 19 nt, Homo sapiens
gcugagcuccuaccagauc

SEQ ID NO: 546231 - RNA, 19 nt, Homo sapiens
gaagaagguggcgguguuc

SEQ ID NO: 546232 - RNA, 19 nt, Homo sapiens
gucgagagaccuguucuuu

SEQ ID NO: 546233 - RNA, 19 nt, Homo sapiens
uuucuugcauucugagcua

SEQ ID NO: 546234 - RNA, 19 nt, Homo sapiens
agacuucuaggcuaugaaa

SEQ ID NO: 546235 - RNA, 19 nt, Homo sapiens
ccaaggcaccgccauguac

SEQ ID NO: 546236 - RNA, 19 nt, Homo sapiens
cuucuaggcuaugaaacuu

SEQ ID NO: 546237 - RNA, 19 nt, Homo sapiens
gcuaagccagacagccuuu

SEQ ID NO: 546238 - RNA, 19 nt, Homo sapiens
gggccucucuugggucugu

SEQ ID NO: 546239 - RNA, 19 nt, Homo sapiens
agagaccuguucuuucaca

SEQ ID NO: 546240 - RNA, 19 nt, Homo sapiens
gaccuuggaggcacuggaa

SEQ ID NO: 546241 - RNA, 19 nt, Homo sapiens
gcugcugguucgcaucaau

SEQ ID NO: 546242 - RNA, 19 nt, Homo sapiens
cuucuacccuuaaacacau

SEQ ID NO: 546243 - RNA, 19 nt, Homo sapiens
ggaagauaugcaagcagaa

SEQ ID NO: 546244 - RNA, 19 nt, Homo sapiens
ccugagugccggaagauau

SEQ ID NO: 546245 - RNA, 19 nt, Homo sapiens
uggagaaggaggaggauga

SEQ ID NO: 546246 - RNA, 19 nt, Homo sapiens
gggaaacagcggcaacagu

SEQ ID NO: 546247 - RNA, 19 nt, Homo sapiens
aagaagaugcagcuugaug

SEQ ID NO: 546248 - RNA, 19 nt, Homo sapiens
aacaacuucuacccuuaaa

SEQ ID NO: 546249 - RNA, 19 nt, Homo sapiens
aagccagacagccuuuaua

SEQ ID NO: 546250 - RNA, 19 nt, Homo sapiens
uaacaccuuuucuugcauu

SEQ ID NO: 546251 - RNA, 19 nt, Homo sapiens
gugcccaaaugcgaaagaa

SEQ ID NO: 546252 - RNA, 19 nt, Homo sapiens
gugagaagccccaggauga

SEQ ID NO: 546253 - RNA, 19 nt, Homo sapiens
ccaccaagcgcauauucuc

SEQ ID NO: 546254 - RNA, 19 nt, Homo sapiens
cagcagcuagcucaggaaa

SEQ ID NO: 546255 - RNA, 19 nt, Homo sapiens
gacagccuuuauacuagau

SEQ ID NO: 546256 - RNA, 19 nt, Homo sapiens
uaagccagacagccuuuau

SEQ ID NO: 546257 - RNA, 19 nt, Homo sapiens
guuggucccauacaccuuu

SEQ ID NO: 546258 - RNA, 19 nt, Homo sapiens
gcccaugcccucugugaag

SEQ ID NO: 546259 - RNA, 19 nt, Homo sapiens
ggaugagaggcuucuggaa

SEQ ID NO: 546260 - RNA, 19 nt, Homo sapiens
cccaugacccuucccaaau

SEQ ID NO: 546261 - RNA, 19 nt, Homo sapiens
uagcucaggaaaucaagaa

SEQ ID NO: 546262 - RNA, 19 nt, Homo sapiens
guggugacacagaugauga

SEQ ID NO: 546263 - RNA, 19 nt, Homo sapiens
gugaugggcaagcauuaug

SEQ ID NO: 546264 - RNA, 19 nt, Homo sapiens
gcagggaaacaaggaucaa

SEQ ID NO: 546265 - RNA, 19 nt, Homo sapiens
ggagaaaccuuaugaaugu

SEQ ID NO: 546266 - RNA, 19 nt, Homo sapiens
gagaaacccuuuacaugua

SEQ ID NO: 546267 - RNA, 19 nt, Homo sapiens
ggaaagcaguuauucauga

SEQ ID NO: 546268 - RNA, 19 nt, Homo sapiens
ccaauuagauagcuuguaa

SEQ ID NO: 546269 - RNA, 19 nt, Homo sapiens
gcucggcccuucaaacuua

SEQ ID NO: 546270 - RNA, 19 nt, Homo sapiens
aggcagagcuauaaacuua

SEQ ID NO: 546271 - RNA, 19 nt, Homo sapiens
agacagaguucaugccuua

SEQ ID NO: 546272 - RNA, 19 nt, Homo sapiens
gcacaucaaagaauucaua

SEQ ID NO: 546273 - RNA, 19 nt, Homo sapiens
gagaaacucuaugaaugua

SEQ ID NO: 546274 - RNA, 19 nt, Homo sapiens
gcacaucaaagaacacaua

SEQ ID NO: 546275 - RNA, 19 nt, Homo sapiens
ggaaagugucuaugauaua

SEQ ID NO: 546276 - RNA, 19 nt, Homo sapiens
gcaauuccauauacaaugu

SEQ ID NO: 546277 - RNA, 19 nt, Homo sapiens
gggaaauccuuuagucaaa

SEQ ID NO: 546278 - RNA, 19 nt, Homo sapiens
gagagaagcccuaugaaug

SEQ ID NO: 546279 - RNA, 19 nt, Homo sapiens
ggagaagccuuaugaaugc

SEQ ID NO: 546280 - RNA, 19 nt, Homo sapiens
aaagguugcuguaguguuu

SEQ ID NO: 546281 - RNA, 19 nt, Homo sapiens
ucucauaguuccucccuua

SEQ ID NO: 546282 - RNA, 19 nt, Homo sapiens
gcauucaccuuauucaguu

SEQ ID NO: 546283 - RNA, 19 nt, Homo sapiens
gugaagaaguggaugauug

SEQ ID NO: 546284 - RNA, 19 nt, Homo sapiens
gagaagcccuaugaaugua

SEQ ID NO: 546285 - RNA, 19 nt, Homo sapiens
caacaucagagaacucaua

SEQ ID NO: 546286 - RNA, 19 nt, Homo sapiens
ggagaagaguggucugaau

SEQ ID NO: 546287 - RNA, 19 nt, Homo sapiens
gagagaaacccuuuacaug

SEQ ID NO: 546288 - RNA, 19 nt, Homo sapiens
gagagaaaccguaugaaug

SEQ ID NO: 546289 - RNA, 19 nt, Homo sapiens
ccucagagcauucaccuua

SEQ ID NO: 546290 - RNA, 19 nt, Homo sapiens
auccagagcuauaaacuua

SEQ ID NO: 546291 - RNA, 19 nt, Homo sapiens
guaaagaccaguuggagaa

SEQ ID NO: 546292 - RNA, 19 nt, Homo sapiens
cuacaugaucuuccaauua

SEQ ID NO: 546293 - RNA, 19 nt, Homo sapiens
ggagagaaaccauuugaau

SEQ ID NO: 546294 - RNA, 19 nt, Homo sapiens
gggagaagccuuaugaaug

SEQ ID NO: 546295 - RNA, 19 nt, Homo sapiens
agaaagggauuauggaugu

SEQ ID NO: 546296 - RNA, 19 nt, Homo sapiens
guacaucagagaacucaua

SEQ ID NO: 546297 - RNA, 19 nt, Homo sapiens
gaaagggauuauggaugua

SEQ ID NO: 546298 - RNA, 19 nt, Homo sapiens
cuagugggcuuauugagaa

SEQ ID NO: 546299 - RNA, 19 nt, Homo sapiens
gagaaaccguaugaaugua

SEQ ID NO: 546300 - RNA, 19 nt, Homo sapiens
ggagagaaaccguaugaau

SEQ ID NO: 546301 - RNA, 19 nt, Homo sapiens
gagaagaguggucugaauu

SEQ ID NO: 546302 - RNA, 19 nt, Homo sapiens
agaaguggaugauuguaaa

SEQ ID NO: 546303 - RNA, 19 nt, Homo sapiens
gguaguacauguaguugga

SEQ ID NO: 546304 - RNA, 19 nt, Homo sapiens
ggucugaauuccagucuau

SEQ ID NO: 546305 - RNA, 19 nt, Homo sapiens
gagaugugauccuggagaa

SEQ ID NO: 546306 - RNA, 19 nt, Homo sapiens
ggagagaagcccuaugaau

SEQ ID NO: 546307 - RNA, 19 nt, Homo sapiens
gggagaaaccuuaugaaug

SEQ ID NO: 546308 - RNA, 19 nt, Homo sapiens
agugaaaccucucauaguu

SEQ ID NO: 546309 - RNA, 19 nt, Homo sapiens
gaacaacagagaauuccuu

SEQ ID NO: 546310 - RNA, 19 nt, Homo sapiens
gaaagcaguuauucaugag

SEQ ID NO: 546311 - RNA, 19 nt, Homo sapiens
ggcauucacucaaaggaaa

SEQ ID NO: 546312 - RNA, 19 nt, Homo sapiens
gagugaagauagaaagguu

SEQ ID NO: 546313 - RNA, 19 nt, Homo sapiens
aagaguaaauggaaugcua

SEQ ID NO: 546314 - RNA, 19 nt, Homo sapiens
guucaugccuuacucaaca

SEQ ID NO: 546315 - RNA, 19 nt, Homo sapiens
uaaagaaugugggcagguu

SEQ ID NO: 546316 - RNA, 19 nt, Homo sapiens
agaaugagacacuauauga

SEQ ID NO: 546317 - RNA, 19 nt, Homo sapiens
aauguacgcuguuaugcua

SEQ ID NO: 546318 - RNA, 19 nt, Homo sapiens
gaauagaaagggauuaugg

SEQ ID NO: 546319 - RNA, 19 nt, Homo sapiens
uacaugaucuuccaauuag

SEQ ID NO: 546320 - RNA, 19 nt, Homo sapiens
gagaaaccuuaugaaugua

SEQ ID NO: 546321 - RNA, 19 nt, Homo sapiens
guuggaagaacuacuauaa

SEQ ID NO: 546322 - RNA, 19 nt, Homo sapiens
gaaacucuaugaauguaac

SEQ ID NO: 546323 - RNA, 19 nt, Homo sapiens
ggagagaaacccuuuacau

SEQ ID NO: 546324 - RNA, 19 nt, Homo sapiens
guaugaauguagugaaugu

SEQ ID NO: 546325 - RNA, 19 nt, Homo sapiens
gagaaaagcccuaugaaug

SEQ ID NO: 546326 - RNA, 19 nt, Homo sapiens
gaaugagacacuauaugaa

SEQ ID NO: 546327 - RNA, 19 nt, Homo sapiens
caacucauacugaagagaa

SEQ ID NO: 546328 - RNA, 19 nt, Homo sapiens
ucagagcauucaccuuauu

SEQ ID NO: 546329 - RNA, 19 nt, Homo sapiens
cuaauggagugaagauaga

SEQ ID NO: 546330 - RNA, 19 nt, Homo sapiens
gcuguaguguuuagaacuu

SEQ ID NO: 546331 - RNA, 19 nt, Homo sapiens
ucucaaauuuguucuggaa

SEQ ID NO: 546332 - RNA, 19 nt, Homo sapiens
gaacucauacuggagagaa

SEQ ID NO: 546333 - RNA, 19 nt, Homo sapiens
gaacucauacuggagagaa

SEQ ID NO: 546334 - RNA, 19 nt, Homo sapiens
gaguuauguucuuguugua

SEQ ID NO: 546335 - RNA, 19 nt, Homo sapiens
gaacucauacuggagagaa

SEQ ID NO: 546336 - RNA, 19 nt, Homo sapiens
gaugauccuugguuaucuu

SEQ ID NO: 546337 - RNA, 19 nt, Homo sapiens
acagggaccuagucucuug

SEQ ID NO: 546338 - RNA, 19 nt, Homo sapiens
ccagaguuauguucuuguu

SEQ ID NO: 546339 - RNA, 19 nt, Homo sapiens
gugaagauagaaagguuua

SEQ ID NO: 546340 - RNA, 19 nt, Homo sapiens
uaggaaagugucuaugaua

SEQ ID NO: 546341 - RNA, 19 nt, Homo sapiens
cagcugggauuucuuccuu

SEQ ID NO: 546342 - RNA, 19 nt, Homo sapiens
gaaacccuuuacauguauu

SEQ ID NO: 546343 - RNA, 19 nt, Homo sapiens
agagaaacccuuuacaugu

SEQ ID NO: 546344 - RNA, 19 nt, Homo sapiens
guaugaauguaaucagugu

SEQ ID NO: 546345 - RNA, 19 nt, Homo sapiens
gaaaccguaugaauguagu

SEQ ID NO: 546346 - RNA, 19 nt, Homo sapiens
aaacagucaucagaagauu

SEQ ID NO: 546347 - RNA, 19 nt, Homo sapiens
uaaauggaaugcuaacacu

SEQ ID NO: 546348 - RNA, 19 nt, Homo sapiens
gaacucacacuggagagaa

SEQ ID NO: 546349 - RNA, 19 nt, Homo sapiens
caucaaagaauucauacug

SEQ ID NO: 546350 - RNA, 19 nt, Homo sapiens
cucaagagauuaucaucaa

SEQ ID NO: 546351 - RNA, 19 nt, Homo sapiens
uaagguaguacauguaguu

SEQ ID NO: 546352 - RNA, 19 nt, Homo sapiens
agagaaaccguaugaaugu

SEQ ID NO: 546353 - RNA, 19 nt, Homo sapiens
gcacaucaaagaacucaca

SEQ ID NO: 546354 - RNA, 19 nt, Homo sapiens
gaagcccuaugaauguaau

SEQ ID NO: 546355 - RNA, 19 nt, Homo sapiens
ccagaguuauguccuuguu

SEQ ID NO: 546356 - RNA, 19 nt, Homo sapiens
agagaaaccuuuugaaugu

SEQ ID NO: 546357 - RNA, 19 nt, Homo sapiens
gagaaugagacacuauaug

SEQ ID NO: 546358 - RNA, 19 nt, Homo sapiens
caucagaagauuaaugaga

SEQ ID NO: 546359 - RNA, 19 nt, Homo sapiens
guaaacagucaucagaaga

SEQ ID NO: 546360 - RNA, 19 nt, Homo sapiens
gaagauagaaagguuuaca

SEQ ID NO: 546361 - RNA, 19 nt, Homo sapiens
aggaaagugucuaugauau

SEQ ID NO: 546362 - RNA, 19 nt, Homo sapiens
guuguuacaugugaagauu

SEQ ID NO: 546363 - RNA, 19 nt, Homo sapiens
gugcaucaaagaacucaua

SEQ ID NO: 546364 - RNA, 19 nt, Homo sapiens
gcaguucucaccuuguuau

SEQ ID NO: 546365 - RNA, 19 nt, Homo sapiens
cgaaagaauugauugcuaa

SEQ ID NO: 546366 - RNA, 19 nt, Homo sapiens
gaaauaccauucaaguguu

SEQ ID NO: 546367 - RNA, 19 nt, Homo sapiens
uuacuuagguuucccauaa

SEQ ID NO: 546368 - RNA, 19 nt, Homo sapiens
ggagaaagcggcagcagua

SEQ ID NO: 546369 - RNA, 19 nt, Homo sapiens
ggaaauaccauucaagugu

SEQ ID NO: 546370 - RNA, 19 nt, Homo sapiens
gcgaaagaauugauugcua

SEQ ID NO: 546371 - RNA, 19 nt, Homo sapiens
gggaagcgaugaugaggaa

SEQ ID NO: 546372 - RNA, 19 nt, Homo sapiens
guaaacagaaggcggcuua

SEQ ID NO: 546373 - RNA, 19 nt, Homo sapiens
ggagacagcugcaaauucc

SEQ ID NO: 546374 - RNA, 19 nt, Homo sapiens
ucuaugagcuggacacaga

SEQ ID NO: 546375 - RNA, 19 nt, Homo sapiens
gacccacaauccaaugaua

SEQ ID NO: 546376 - RNA, 19 nt, Homo sapiens
gaggaugcaauucccauua

SEQ ID NO: 546377 - RNA, 19 nt, Homo sapiens
caaggaggaugacaagauc

SEQ ID NO: 546378 - RNA, 19 nt, Homo sapiens
gcaaggaggaugacaagau

SEQ ID NO: 546379 - RNA, 19 nt, Homo sapiens
gagcagcuuucuccaggaa

SEQ ID NO: 546380 - RNA, 19 nt, Homo sapiens
ggaaucaacaauuaucaga

SEQ ID NO: 546381 - RNA, 19 nt, Homo sapiens
ccaagugcaggcauuauuu

SEQ ID NO: 546382 - RNA, 19 nt, Homo sapiens
gaaagagcgcgaugcacaa

SEQ ID NO: 546383 - RNA, 19 nt, Homo sapiens
gaggaaauaccauucaagu

SEQ ID NO: 546384 - RNA, 19 nt, Homo sapiens
gcaguccucuuccgucagu

SEQ ID NO: 546385 - RNA, 19 nt, Homo sapiens
gaucgaacgugagcuugau

SEQ ID NO: 546386 - RNA, 19 nt, Homo sapiens
aagcgaugaugaggaaaua

SEQ ID NO: 546387 - RNA, 19 nt, Homo sapiens
gcugcaaauuccuccauga

SEQ ID NO: 546388 - RNA, 19 nt, Homo sapiens
acaauccaaugauacagaa

SEQ ID NO: 546389 - RNA, 19 nt, Homo sapiens
gaagcgaugaugaggaaau

SEQ ID NO: 546390 - RNA, 19 nt, Homo sapiens
gcagaucgaacgugagcuu

SEQ ID NO: 546391 - RNA, 19 nt, Homo sapiens
uccaugaccguucagauua

SEQ ID NO: 546392 - RNA, 19 nt, Homo sapiens
ggguggugcuuccgacuug

SEQ ID NO: 546393 - RNA, 19 nt, Homo sapiens
gaauugauugcuaaacuag

SEQ ID NO: 546394 - RNA, 19 nt, Homo sapiens
gcaauucccauuacuuagg

SEQ ID NO: 546395 - RNA, 19 nt, Homo sapiens
gcucaggacucuaaaaugg

SEQ ID NO: 546396 - RNA, 19 nt, Homo sapiens
gaagcgacggccucugcua

SEQ ID NO: 546397 - RNA, 19 nt, Homo sapiens
cgucuucaauccagcgaaa

SEQ ID NO: 546398 - RNA, 19 nt, Homo sapiens
caggaaaggcgguggauca

SEQ ID NO: 546399 - RNA, 19 nt, Homo sapiens
gaugaggaaauaccauuca

SEQ ID NO: 546400 - RNA, 19 nt, Homo sapiens
ugacagugguaaacagaag

SEQ ID NO: 546401 - RNA, 19 nt, Homo sapiens
cagcgaagaggaagaggaa

SEQ ID NO: 546402 - RNA, 19 nt, Homo sapiens
augcaauucccauuacuua

SEQ ID NO: 546403 - RNA, 19 nt, Homo sapiens
gaagugggaagcgaugaug

SEQ ID NO: 546404 - RNA, 19 nt, Homo sapiens
ccaauggcgucuucaaucc

SEQ ID NO: 546405 - RNA, 19 nt, Homo sapiens
uacaugaagcccaaggaua

SEQ ID NO: 546406 - RNA, 19 nt, Homo sapiens
gaccaauggcgucuucaau

SEQ ID NO: 546407 - RNA, 19 nt, Homo sapiens
caauucccauuacuuaggu

SEQ ID NO: 546408 - RNA, 19 nt, Homo sapiens
ucaauccagcgaaagaauu

SEQ ID NO: 546409 - RNA, 19 nt, Homo sapiens
ucaccaagugcaggcauua

SEQ ID NO: 546410 - RNA, 19 nt, Homo sapiens
ccauucaaguguuucaucu

SEQ ID NO: 546411 - RNA, 19 nt, Homo sapiens
gguuucccauaauucuuaa

SEQ ID NO: 546412 - RNA, 19 nt, Homo sapiens
caagugcaggcauuauuuc

SEQ ID NO: 546413 - RNA, 19 nt, Homo sapiens
gagggucgcuauggugucu

SEQ ID NO: 546414 - RNA, 19 nt, Homo sapiens
gaugcaauucccauuacuu

SEQ ID NO: 546415 - RNA, 19 nt, Homo sapiens
cuagagaagcaucgagcua

SEQ ID NO: 546416 - RNA, 19 nt, Homo sapiens
cgacaucuguaaggacuac

SEQ ID NO: 546417 - RNA, 19 nt, Homo sapiens
agagaagcaucgagcuaca

SEQ ID NO: 546418 - RNA, 19 nt, Homo sapiens
auucaaguguuucaucugu

SEQ ID NO: 546419 - RNA, 19 nt, Homo sapiens
cggcagcaguagcgacgaa

SEQ ID NO: 546420 - RNA, 19 nt, Homo sapiens
ccaccgugcgcugggauua

SEQ ID NO: 546421 - RNA, 19 nt, Homo sapiens
ggauacgucuaugggcaau

SEQ ID NO: 546422 - RNA, 19 nt, Homo sapiens
guccuuccuuuguagagaa

SEQ ID NO: 546423 - RNA, 19 nt, Homo sapiens
acuuagguuucccauaauu

SEQ ID NO: 546424 - RNA, 19 nt, Homo sapiens
ggaugcaauucccauuacu

SEQ ID NO: 546425 - RNA, 19 nt, Homo sapiens
ccaugaccguucagauuac

SEQ ID NO: 546426 - RNA, 19 nt, Homo sapiens
gggcaaggaggaugacaag

SEQ ID NO: 546427 - RNA, 19 nt, Homo sapiens
gcccaaggauacgucuaug

SEQ ID NO: 546428 - RNA, 19 nt, Homo sapiens
acaugaagcccaaggauac

SEQ ID NO: 546429 - RNA, 19 nt, Homo sapiens
gggucgcuauggugucuau

SEQ ID NO: 546430 - RNA, 19 nt, Homo sapiens
ucggagcucaggacucuaa

SEQ ID NO: 546431 - RNA, 19 nt, Homo sapiens
gucucggcgugguuuauaa

SEQ ID NO: 546432 - RNA, 19 nt, Homo sapiens
agguuucccauaauucuua

SEQ ID NO: 546433 - RNA, 19 nt, Homo sapiens
cuccaugaccguucagauu

SEQ ID NO: 546434 - RNA, 19 nt, Homo sapiens
acaaagagacuggcuucug

SEQ ID NO: 546435 - RNA, 19 nt, Homo sapiens
gggauuaccagcccgacau

SEQ ID NO: 546436 - RNA, 19 nt, Homo sapiens
cacaauccaaugauacaga

SEQ ID NO: 546437 - RNA, 19 nt, Homo sapiens
gaggaugacaagaucuauc

SEQ ID NO: 546438 - RNA, 19 nt, Homo sapiens
ggaggaugacaagaucuau

SEQ ID NO: 546439 - RNA, 19 nt, Homo sapiens
agucuuacuucguguccuu

SEQ ID NO: 546440 - RNA, 19 nt, Homo sapiens
acagaagacccgugacagu

SEQ ID NO: 546441 - RNA, 19 nt, Homo sapiens
cggagacagcugcaaauuc

SEQ ID NO: 546442 - RNA, 19 nt, Homo sapiens
ccagcgaaagaauugauug

SEQ ID NO: 546443 - RNA, 19 nt, Homo sapiens
cgaaggcugcacugugguu

SEQ ID NO: 546444 - RNA, 19 nt, Homo sapiens
uuucggagcucaggacucu

SEQ ID NO: 546445 - RNA, 19 nt, Homo sapiens
ggaugaaaacuaugaagug

SEQ ID NO: 546446 - RNA, 19 nt, Homo sapiens
ugaugagggucgcuauggu

SEQ ID NO: 546447 - RNA, 19 nt, Homo sapiens
aaaaugagcccgagagucu

SEQ ID NO: 546448 - RNA, 19 nt, Homo sapiens
gagcagcgaagaggaagag

SEQ ID NO: 546449 - RNA, 19 nt, Homo sapiens
agagaaagcuuaugaaugu

SEQ ID NO: 546450 - RNA, 19 nt, Homo sapiens
gcacacaccuuacucaaca

SEQ ID NO: 546451 - RNA, 19 nt, Homo sapiens
gaaacugccuugaaaucuu

SEQ ID NO: 546452 - RNA, 19 nt, Homo sapiens
gggaugagcuccugagaug

SEQ ID NO: 546453 - RNA, 19 nt, Homo sapiens
gaacaucagaauacucaua

SEQ ID NO: 546454 - RNA, 19 nt, Homo sapiens
gguaacugguuccuaauaa

SEQ ID NO: 546455 - RNA, 19 nt, Homo sapiens
gcacucaucugacugaaca

SEQ ID NO: 546456 - RNA, 19 nt, Homo sapiens
gggcugaacuaauccaauu

SEQ ID NO: 546457 - RNA, 19 nt, Homo sapiens
gaaaguacauugggcugaa

SEQ ID NO: 546458 - RNA, 19 nt, Homo sapiens
ggagaaacccuaugauugu

SEQ ID NO: 546459 - RNA, 19 nt, Homo sapiens
gaaauaaagguaaccgaaa

SEQ ID NO: 546460 - RNA, 19 nt, Homo sapiens
agagaaaccuuauaacugu

SEQ ID NO: 546461 - RNA, 19 nt, Homo sapiens
ggaaaggccuucaguuacu

SEQ ID NO: 546462 - RNA, 19 nt, Homo sapiens
guucaaaccuuguaacaca

SEQ ID NO: 546463 - RNA, 19 nt, Homo sapiens
guggaaaggccuucaguua

SEQ ID NO: 546464 - RNA, 19 nt, Homo sapiens
guaacugguuccuaauaaa

SEQ ID NO: 546465 - RNA, 19 nt, Homo sapiens
aaacugccuugaaaucuuu

SEQ ID NO: 546466 - RNA, 19 nt, Homo sapiens
agccagagcucccaucuaa

SEQ ID NO: 546467 - RNA, 19 nt, Homo sapiens
gcucaucccuuacucaaca

SEQ ID NO: 546468 - RNA, 19 nt, Homo sapiens
gcuagaaaguugggaauau

SEQ ID NO: 546469 - RNA, 19 nt, Homo sapiens
guuaaguacugaagaauca

SEQ ID NO: 546470 - RNA, 19 nt, Homo sapiens
gagaaaccuuauaacugua

SEQ ID NO: 546471 - RNA, 19 nt, Homo sapiens
ggagagcauucaaccagaa

SEQ ID NO: 546472 - RNA, 19 nt, Homo sapiens
gagaacacauacuggagaa

SEQ ID NO: 546473 - RNA, 19 nt, Homo sapiens
ggaauaugaaggcaguuua

SEQ ID NO: 546474 - RNA, 19 nt, Homo sapiens
gcauuuacauuguuuaggu

SEQ ID NO: 546475 - RNA, 19 nt, Homo sapiens
gcucugcucucaacaaaca

SEQ ID NO: 546476 - RNA, 19 nt, Homo sapiens
gagagaaaccuuauaacug

SEQ ID NO: 546477 - RNA, 19 nt, Homo sapiens
cgacauuguucaucucuug

SEQ ID NO: 546478 - RNA, 19 nt, Homo sapiens
cagcauaagagaauucaua

SEQ ID NO: 546479 - RNA, 19 nt, Homo sapiens
gggagaaacccuaugauug

SEQ ID NO: 546480 - RNA, 19 nt, Homo sapiens
gggagaagcccuauaagug

SEQ ID NO: 546481 - RNA, 19 nt, Homo sapiens
ggucaucccuugcucaaca

SEQ ID NO: 546482 - RNA, 19 nt, Homo sapiens
aaagaagcaucaaacagaa

SEQ ID NO: 546483 - RNA, 19 nt, Homo sapiens
gacauaaucuacucucauc

SEQ ID NO: 546484 - RNA, 19 nt, Homo sapiens
gagacugcauccuggcaua

SEQ ID NO: 546485 - RNA, 19 nt, Homo sapiens
gcgagaagccauacacuug

SEQ ID NO: 546486 - RNA, 19 nt, Homo sapiens
uauaauagccuaacucagu

SEQ ID NO: 546487 - RNA, 19 nt, Homo sapiens
uuuagaaacugccuugaaa

SEQ ID NO: 546488 - RNA, 19 nt, Homo sapiens
gaauucaaacccaguuaaa

SEQ ID NO: 546489 - RNA, 19 nt, Homo sapiens
agagcuaucuccagaggua

SEQ ID NO: 546490 - RNA, 19 nt, Homo sapiens
auacacaccuggucucuau

SEQ ID NO: 546491 - RNA, 19 nt, Homo sapiens
caauagaauuugugcuuca

SEQ ID NO: 546492 - RNA, 19 nt, Homo sapiens
guucaucucuugcucaaca

SEQ ID NO: 546493 - RNA, 19 nt, Homo sapiens
uagaauuugugcuucagua

SEQ ID NO: 546494 - RNA, 19 nt, Homo sapiens
gaauguguauguuuaugca

SEQ ID NO: 546495 - RNA, 19 nt, Homo sapiens
uguaaugaaugcagaaaga

SEQ ID NO: 546496 - RNA, 19 nt, Homo sapiens
ggagagaaaccuuauaacu

SEQ ID NO: 546497 - RNA, 19 nt, Homo sapiens
gagaaagcuuaugaaugua

SEQ ID NO: 546498 - RNA, 19 nt, Homo sapiens
agaacgaccuuacaagugu

SEQ ID NO: 546499 - RNA, 19 nt, Homo sapiens
gggaaaaccuucaguuaug

SEQ ID NO: 546500 - RNA, 19 nt, Homo sapiens
caagaaccaucuccagaag

SEQ ID NO: 546501 - RNA, 19 nt, Homo sapiens
auaauagccuaacucagua

SEQ ID NO: 546502 - RNA, 19 nt, Homo sapiens
aguuaucucucaaaccuua

SEQ ID NO: 546503 - RNA, 19 nt, Homo sapiens
ccaaaggaaauaaagguaa

SEQ ID NO: 546504 - RNA, 19 nt, Homo sapiens
ugaaggcaguuuagagaga

SEQ ID NO: 546505 - RNA, 19 nt, Homo sapiens
ggagagaaacccuaucagu

SEQ ID NO: 546506 - RNA, 19 nt, Homo sapiens
caagagaaagcuuaugaau

SEQ ID NO: 546507 - RNA, 19 nt, Homo sapiens
gagaaacccuaugauugug

SEQ ID NO: 546508 - RNA, 19 nt, Homo sapiens
ccagagaggccacuuuaug

SEQ ID NO: 546509 - RNA, 19 nt, Homo sapiens
gcaucaaacagaauucaaa

SEQ ID NO: 546510 - RNA, 19 nt, Homo sapiens
ugaugugauuucccaguua

SEQ ID NO: 546511 - RNA, 19 nt, Homo sapiens
gagaacgaccuuacaagug

SEQ ID NO: 546512 - RNA, 19 nt, Homo sapiens
ggagaacgaccuuacaagu

SEQ ID NO: 546513 - RNA, 19 nt, Homo sapiens
gaauucauacuggagauaa

SEQ ID NO: 546514 - RNA, 19 nt, Homo sapiens
gaucauggagccaagcauu

SEQ ID NO: 546515 - RNA, 19 nt, Homo sapiens
guacgaaugcaaugaaugu

SEQ ID NO: 546516 - RNA, 19 nt, Homo sapiens
caacagacacugccaaagg

SEQ ID NO: 546517 - RNA, 19 nt, Homo sapiens
uagccuaacucaguaagaa

SEQ ID NO: 546518 - RNA, 19 nt, Homo sapiens
ugaauggguuuacuauaca

SEQ ID NO: 546519 - RNA, 19 nt, Homo sapiens
cagcauaggaagauccaua

SEQ ID NO: 546520 - RNA, 19 nt, Homo sapiens
cagcaucagagaauucaua

SEQ ID NO: 546521 - RNA, 19 nt, Homo sapiens
caaaggaaauaaagguaac

SEQ ID NO: 546522 - RNA, 19 nt, Homo sapiens
cagaguggauuuagaaacu

SEQ ID NO: 546523 - RNA, 19 nt, Homo sapiens
gagcacauaucucauucag

SEQ ID NO: 546524 - RNA, 19 nt, Homo sapiens
ccagagcacauaucucauu

SEQ ID NO: 546525 - RNA, 19 nt, Homo sapiens
aaccagaacauacaccuua

SEQ ID NO: 546526 - RNA, 19 nt, Homo sapiens
caacaucggagaauucaca

SEQ ID NO: 546527 - RNA, 19 nt, Homo sapiens
cgagauaccagcugaagga

SEQ ID NO: 546528 - RNA, 19 nt, Homo sapiens
aagccacucugugacauua

SEQ ID NO: 546529 - RNA, 19 nt, Homo sapiens
acauugggcugaacuaauc

SEQ ID NO: 546530 - RNA, 19 nt, Homo sapiens
ucacuaucauguuauggaa

SEQ ID NO: 546531 - RNA, 19 nt, Homo sapiens
caucaaagaauucauacug

SEQ ID NO: 546532 - RNA, 19 nt, Homo sapiens
caucaaagaauucauacug

SEQ ID NO: 546533 - RNA, 19 nt, Homo sapiens
gagccaagcauuccaguag

SEQ ID NO: 546534 - RNA, 19 nt, Homo sapiens
gaugugauuucccaguuag

SEQ ID NO: 546535 - RNA, 19 nt, Homo sapiens
ggaaaauccuucagauauc

SEQ ID NO: 546536 - RNA, 19 nt, Homo sapiens
ggaguucaucucuugcuaa

SEQ ID NO: 546537 - RNA, 19 nt, Homo sapiens
guccaucucuuacucaaca

SEQ ID NO: 546538 - RNA, 19 nt, Homo sapiens
cuagaaaguugggaauaug

SEQ ID NO: 546539 - RNA, 19 nt, Homo sapiens
uaacucagcaucaacgaau

SEQ ID NO: 546540 - RNA, 19 nt, Homo sapiens
agagaaacccuaucagugu

SEQ ID NO: 546541 - RNA, 19 nt, Homo sapiens
gaaaauucauacuggagaa

SEQ ID NO: 546542 - RNA, 19 nt, Homo sapiens
caaugugaguucaaaccuu

SEQ ID NO: 546543 - RNA, 19 nt, Homo sapiens
gaaaagacaauacccaguu

SEQ ID NO: 546544 - RNA, 19 nt, Homo sapiens
ggacagagccauggaucau

SEQ ID NO: 546545 - RNA, 19 nt, Homo sapiens
gaugugauaguggacuuua

SEQ ID NO: 546546 - RNA, 19 nt, Homo sapiens
gaugagcuccugagaugga

SEQ ID NO: 546547 - RNA, 19 nt, Homo sapiens
caucagagaauucauacug

SEQ ID NO: 546548 - RNA, 19 nt, Homo sapiens
gaauaugaaggcaguuuag

SEQ ID NO: 546549 - RNA, 19 nt, Homo sapiens
gaacaaccuuagaguauuu

SEQ ID NO: 546550 - RNA, 19 nt, Homo sapiens
cagauuggcuuucuaauga

SEQ ID NO: 546551 - RNA, 19 nt, Homo sapiens
guguuuagcuugucuauuu

SEQ ID NO: 546552 - RNA, 19 nt, Homo sapiens
ucacagacauuaccaaaga

SEQ ID NO: 546553 - RNA, 19 nt, Homo sapiens
gauaauugcuugugugugu

SEQ ID NO: 546554 - RNA, 19 nt, Homo sapiens
gaaaaugccuccaaacuga

SEQ ID NO: 546555 - RNA, 19 nt, Homo sapiens
cauccaauaucguaucuua

SEQ ID NO: 546556 - RNA, 19 nt, Homo sapiens
gaagaacaaccuuagagua

SEQ ID NO: 546557 - RNA, 19 nt, Homo sapiens
gaugaucccugguggguaa

SEQ ID NO: 546558 - RNA, 19 nt, Homo sapiens
aaacaggaauuccaucuug

SEQ ID NO: 546559 - RNA, 19 nt, Homo sapiens
ggaaggauguggccaccaa

SEQ ID NO: 546560 - RNA, 19 nt, Homo sapiens
gcaagacauugaaagaaau

SEQ ID NO: 546561 - RNA, 19 nt, Homo sapiens
gaaccaacaugcaagacau

SEQ ID NO: 546562 - RNA, 19 nt, Homo sapiens
guaaagaggcccaagauag

SEQ ID NO: 546563 - RNA, 19 nt, Homo sapiens
gaacuucacacauaaaucu

SEQ ID NO: 546564 - RNA, 19 nt, Homo sapiens
guaaauugcagacaucaaa

SEQ ID NO: 546565 - RNA, 19 nt, Homo sapiens
ggagggaucuguacuuacu

SEQ ID NO: 546566 - RNA, 19 nt, Homo sapiens
caagagccauuauugacuu

SEQ ID NO: 546567 - RNA, 19 nt, Homo sapiens
gaagagggaugcauuaccu

SEQ ID NO: 546568 - RNA, 19 nt, Homo sapiens
cagccucucucaugucuaa

SEQ ID NO: 546569 - RNA, 19 nt, Homo sapiens
gaucagagagggaacauuc

SEQ ID NO: 546570 - RNA, 19 nt, Homo sapiens
cagcaucacucuguaaguu

SEQ ID NO: 546571 - RNA, 19 nt, Homo sapiens
acauaaaucuucccaagug

SEQ ID NO: 546572 - RNA, 19 nt, Homo sapiens
gcauacauccaauaucgua

SEQ ID NO: 546573 - RNA, 19 nt, Homo sapiens
cgagagaguuguggcagua

SEQ ID NO: 546574 - RNA, 19 nt, Homo sapiens
gaggaagagggaugcauua

SEQ ID NO: 546575 - RNA, 19 nt, Homo sapiens
gccaguaucugcacgcuau

SEQ ID NO: 546576 - RNA, 19 nt, Homo sapiens
ccacugaggauuacaagaa

SEQ ID NO: 546577 - RNA, 19 nt, Homo sapiens
gaaguugcauacauccaau

SEQ ID NO: 546578 - RNA, 19 nt, Homo sapiens
guacgugaaugcuagugaa

SEQ ID NO: 546579 - RNA, 19 nt, Homo sapiens
gguauagucugccuuuaag

SEQ ID NO: 546580 - RNA, 19 nt, Homo sapiens
guccaaagauuacccuaga

SEQ ID NO: 546581 - RNA, 19 nt, Homo sapiens
cagcggaucugagcaauuc

SEQ ID NO: 546582 - RNA, 19 nt, Homo sapiens
ugcaagacauugaaagaaa

SEQ ID NO: 546583 - RNA, 19 nt, Homo sapiens
acaagaagcugugaguaug

SEQ ID NO: 546584 - RNA, 19 nt, Homo sapiens
gcugaugacucguggacaa

SEQ ID NO: 546585 - RNA, 19 nt, Homo sapiens
gcuauugcauugcgcagaa

SEQ ID NO: 546586 - RNA, 19 nt, Homo sapiens
gaugacucguggacaaauu

SEQ ID NO: 546587 - RNA, 19 nt, Homo sapiens
ccaaggagacccagcugua

SEQ ID NO: 546588 - RNA, 19 nt, Homo sapiens
ccaaggagacccagcugua

SEQ ID NO: 546589 - RNA, 19 nt, Homo sapiens
gggcauguacccacacuaa

SEQ ID NO: 546590 - RNA, 19 nt, Homo sapiens
cuacgucuuucuccaguuu

SEQ ID NO: 546591 - RNA, 19 nt, Homo sapiens
agagguggcuauugcauug

SEQ ID NO: 546592 - RNA, 19 nt, Homo sapiens
gguaaagaggcccaagaua

SEQ ID NO: 546593 - RNA, 19 nt, Homo sapiens
gagcagaaggugugaaauc

SEQ ID NO: 546594 - RNA, 19 nt, Homo sapiens
caacaugcaagacauugaa

SEQ ID NO: 546595 - RNA, 19 nt, Homo sapiens
cauguacccacacuaaaua

SEQ ID NO: 546596 - RNA, 19 nt, Homo sapiens
gcauguacccacacuaaau

SEQ ID NO: 546597 - RNA, 19 nt, Homo sapiens
ggcauaggcuugcaaagag

SEQ ID NO: 546598 - RNA, 19 nt, Homo sapiens
uaaauucaguaggauguga

SEQ ID NO: 546599 - RNA, 19 nt, Homo sapiens
gagaagaagccuccaugug

SEQ ID NO: 546600 - RNA, 19 nt, Homo sapiens
gagcagccucacauuuaua

SEQ ID NO: 546601 - RNA, 19 nt, Homo sapiens
ccaaagaggagcuugugaa

SEQ ID NO: 546602 - RNA, 19 nt, Homo sapiens
ggcauaggcuaguguuuag

SEQ ID NO: 546603 - RNA, 19 nt, Homo sapiens
ccaauaucguaucuuaaug

SEQ ID NO: 546604 - RNA, 19 nt, Homo sapiens
ccaaagggauucucuucgu

SEQ ID NO: 546605 - RNA, 19 nt, Homo sapiens
cagcggaucugagcaacuu

SEQ ID NO: 546606 - RNA, 19 nt, Homo sapiens
agaacaaccuuagaguauu

SEQ ID NO: 546607 - RNA, 19 nt, Homo sapiens
ucagagagguggcuauugc

SEQ ID NO: 546608 - RNA, 19 nt, Homo sapiens
uugcagacaucaaaugcua

SEQ ID NO: 546609 - RNA, 19 nt, Homo sapiens
guugaagacuguugaugau

SEQ ID NO: 546610 - RNA, 19 nt, Homo sapiens
caacuugucagacgagaga

SEQ ID NO: 546611 - RNA, 19 nt, Homo sapiens
cauacuuaauccacacuaa

SEQ ID NO: 546612 - RNA, 19 nt, Homo sapiens
cacaggcacucaaugaaug

SEQ ID NO: 546613 - RNA, 19 nt, Homo sapiens
gcuggacucugccaucugu

SEQ ID NO: 546614 - RNA, 19 nt, Homo sapiens
gggccaaguugaagacugu

SEQ ID NO: 546615 - RNA, 19 nt, Homo sapiens
gguaucugcugccaugaau

SEQ ID NO: 546616 - RNA, 19 nt, Homo sapiens
cccaagagguggccaagga

SEQ ID NO: 546617 - RNA, 19 nt, Homo sapiens
ggaagaacaaccuuagagu

SEQ ID NO: 546618 - RNA, 19 nt, Homo sapiens
gaugggcgaucuccuggau

SEQ ID NO: 546619 - RNA, 19 nt, Homo sapiens
ccaugaauauugcuuuaag

SEQ ID NO: 546620 - RNA, 19 nt, Homo sapiens
cuggagggaucuguacuua

SEQ ID NO: 546621 - RNA, 19 nt, Homo sapiens
guagcguguugacugauuu

SEQ ID NO: 546622 - RNA, 19 nt, Homo sapiens
ggguggaggugguggaaga

SEQ ID NO: 546623 - RNA, 19 nt, Homo sapiens
gagccauuauugacuuaga

SEQ ID NO: 546624 - RNA, 19 nt, Homo sapiens
acacacaggcacucaauga

SEQ ID NO: 546625 - RNA, 19 nt, Homo sapiens
aagaacaaccuuagaguau

SEQ ID NO: 546626 - RNA, 19 nt, Homo sapiens
ggagacacaggcaccguuu

SEQ ID NO: 546627 - RNA, 19 nt, Homo sapiens
caaagaggagcuugugaau

SEQ ID NO: 546628 - RNA, 19 nt, Homo sapiens
uggcauaggcuaguguuua

SEQ ID NO: 546629 - RNA, 19 nt, Homo sapiens
agacagauuggcuuucuaa

SEQ ID NO: 546630 - RNA, 19 nt, Homo sapiens
uaagacagauuggcuuucu

SEQ ID NO: 546631 - RNA, 19 nt, Homo sapiens
ugccaugaauauugcuuua

SEQ ID NO: 546632 - RNA, 19 nt, Homo sapiens
aagaggagcuugugaaucc

SEQ ID NO: 546633 - RNA, 19 nt, Homo sapiens
caucccaucuuagacauga

SEQ ID NO: 546634 - RNA, 19 nt, Homo sapiens
ccgagacuguccaaagauu

SEQ ID NO: 546635 - RNA, 19 nt, Homo sapiens
caaaacagccucucucaug

SEQ ID NO: 546636 - RNA, 19 nt, Homo sapiens
uauaaugggccaaguugaa

SEQ ID NO: 546637 - RNA, 19 nt, Homo sapiens
cugacucccuugaggcuua

SEQ ID NO: 546638 - RNA, 19 nt, Homo sapiens
uccaagagguggccaagga

SEQ ID NO: 546639 - RNA, 19 nt, Homo sapiens
gcuuucagcugagaacaga

SEQ ID NO: 546640 - RNA, 19 nt, Homo sapiens
gauauucucaucccaucuu

SEQ ID NO: 546641 - RNA, 19 nt, Homo sapiens
cgagacuguccaaagauua

SEQ ID NO: 546642 - RNA, 19 nt, Homo sapiens
uaaagaggcccaagauagg

SEQ ID NO: 546643 - RNA, 19 nt, Homo sapiens
ggaaaagcagcuaacauuu

SEQ ID NO: 546644 - RNA, 19 nt, Homo sapiens
auauuugaguguucccuua

SEQ ID NO: 546645 - RNA, 19 nt, Homo sapiens
caucaaaugcuagggauug

SEQ ID NO: 546646 - RNA, 19 nt, Homo sapiens
gaucaaacaggaauuccau

SEQ ID NO: 546647 - RNA, 19 nt, Homo sapiens
gccaggcacccuacaauau

SEQ ID NO: 546648 - RNA, 19 nt, Homo sapiens
ugaaugagugaaggaaaua

SEQ ID NO: 546649 - RNA, 19 nt, Homo sapiens
gaacuugccuucaggguua

SEQ ID NO: 546650 - RNA, 19 nt, Homo sapiens
gaacaucucagaauucaua

SEQ ID NO: 546651 - RNA, 19 nt, Homo sapiens
guaaaugucugaugaaaga

SEQ ID NO: 546652 - RNA, 19 nt, Homo sapiens
gaaugaaccuugcugaauu

SEQ ID NO: 546653 - RNA, 19 nt, Homo sapiens
gcaacugucugacuugaua

SEQ ID NO: 546654 - RNA, 19 nt, Homo sapiens
ccacagauuugcaggcuua

SEQ ID NO: 546655 - RNA, 19 nt, Homo sapiens
gaaccuugcugaauuaauc

SEQ ID NO: 546656 - RNA, 19 nt, Homo sapiens
gaacaagggaagauugaua

SEQ ID NO: 546657 - RNA, 19 nt, Homo sapiens
cagaaagccuuccgacuaa

SEQ ID NO: 546658 - RNA, 19 nt, Homo sapiens
agagaaaccuuaucuaugu

SEQ ID NO: 546659 - RNA, 19 nt, Homo sapiens
ugucagaguuccagucuua

SEQ ID NO: 546660 - RNA, 19 nt, Homo sapiens
gcaaacagcacuuuaggaa

SEQ ID NO: 546661 - RNA, 19 nt, Homo sapiens
gaagauacaguccaaagaa

SEQ ID NO: 546662 - RNA, 19 nt, Homo sapiens
ucagagauaucaccacaaa

SEQ ID NO: 546663 - RNA, 19 nt, Homo sapiens
ccaaagagaagauugagua

SEQ ID NO: 546664 - RNA, 19 nt, Homo sapiens
gaugauguuuggaaguaua

SEQ ID NO: 546665 - RNA, 19 nt, Homo sapiens
ggagagaaaccuuaucuau

SEQ ID NO: 546666 - RNA, 19 nt, Homo sapiens
gaauacuguuuccuucuaa

SEQ ID NO: 546667 - RNA, 19 nt, Homo sapiens
uuacaaagccugagaaaga

SEQ ID NO: 546668 - RNA, 19 nt, Homo sapiens
gagaaaccuuaucuaugua

SEQ ID NO: 546669 - RNA, 19 nt, Homo sapiens
ccagaaagccuuccgacua

SEQ ID NO: 546670 - RNA, 19 nt, Homo sapiens
ugucacagaugaagaauau

SEQ ID NO: 546671 - RNA, 19 nt, Homo sapiens
ccacaauaauuucacugua

SEQ ID NO: 546672 - RNA, 19 nt, Homo sapiens
guaacagacucuuguggaa

SEQ ID NO: 546673 - RNA, 19 nt, Homo sapiens
gcgcagcucucaccuuaau

SEQ ID NO: 546674 - RNA, 19 nt, Homo sapiens
aaugaaccuugcugaauua

SEQ ID NO: 546675 - RNA, 19 nt, Homo sapiens
gaaggcacauugacuagca

SEQ ID NO: 546676 - RNA, 19 nt, Homo sapiens
gagguguucucuccuugua

SEQ ID NO: 546677 - RNA, 19 nt, Homo sapiens
gagagaaaccuuaucuaug

SEQ ID NO: 546678 - RNA, 19 nt, Homo sapiens
agagaaaggucaucagugu

SEQ ID NO: 546679 - RNA, 19 nt, Homo sapiens
gaucaaaguuaaacagcau

SEQ ID NO: 546680 - RNA, 19 nt, Homo sapiens
ccucugcaauccauauaua

SEQ ID NO: 546681 - RNA, 19 nt, Homo sapiens
uaacuccagugccaguaua

SEQ ID NO: 546682 - RNA, 19 nt, Homo sapiens
agacaaggauugagaaugg

SEQ ID NO: 546683 - RNA, 19 nt, Homo sapiens
gagcuaagacgcuguuuca

SEQ ID NO: 546684 - RNA, 19 nt, Homo sapiens
gaaugucacagaugaagaa

SEQ ID NO: 546685 - RNA, 19 nt, Homo sapiens
cgacaccacagaauucaua

SEQ ID NO: 546686 - RNA, 19 nt, Homo sapiens
aggcgcagcucucaccuua

SEQ ID NO: 546687 - RNA, 19 nt, Homo sapiens
uauaguggcugcugcauag

SEQ ID NO: 546688 - RNA, 19 nt, Homo sapiens
aaacagcacuuuaggaaaa

SEQ ID NO: 546689 - RNA, 19 nt, Homo sapiens
gagaaugggaagcuuauug

SEQ ID NO: 546690 - RNA, 19 nt, Homo sapiens
cggcaugagugugaaguua

SEQ ID NO: 546691 - RNA, 19 nt, Homo sapiens
uagcagcuuucuccuauga

SEQ ID NO: 546692 - RNA, 19 nt, Homo sapiens
gcaauagagagcuucauga

SEQ ID NO: 546693 - RNA, 19 nt, Homo sapiens
gaugagguguucucuccuu

SEQ ID NO: 546694 - RNA, 19 nt, Homo sapiens
gcuaagacgcuguuucaga

SEQ ID NO: 546695 - RNA, 19 nt, Homo sapiens
caagggaagauugauauuu

SEQ ID NO: 546696 - RNA, 19 nt, Homo sapiens
caucagagaaggcacauug

SEQ ID NO: 546697 - RNA, 19 nt, Homo sapiens
gcagaacaagggaagauug

SEQ ID NO: 546698 - RNA, 19 nt, Homo sapiens
cacaauaauuucacuguag

SEQ ID NO: 546699 - RNA, 19 nt, Homo sapiens
gaacaugcgaguacacaca

SEQ ID NO: 546700 - RNA, 19 nt, Homo sapiens
gaccaggagugucucugaa

SEQ ID NO: 546701 - RNA, 19 nt, Homo sapiens
ugaaucaagugcccacaga

SEQ ID NO: 546702 - RNA, 19 nt, Homo sapiens
gguguucucuccuuguaga

SEQ ID NO: 546703 - RNA, 19 nt, Homo sapiens
guucacaccucgucagaca

SEQ ID NO: 546704 - RNA, 19 nt, Homo sapiens
gaguauaaaugcucagaac

SEQ ID NO: 546705 - RNA, 19 nt, Homo sapiens
gaaugggaagcuuauugua

SEQ ID NO: 546706 - RNA, 19 nt, Homo sapiens
aagauacaguccaaagaaa

SEQ ID NO: 546707 - RNA, 19 nt, Homo sapiens
agagauaucaccacaaaga

SEQ ID NO: 546708 - RNA, 19 nt, Homo sapiens
ccauauauauccuggucuu

SEQ ID NO: 546709 - RNA, 19 nt, Homo sapiens
caguaaaugucugaugaaa

SEQ ID NO: 546710 - RNA, 19 nt, Homo sapiens
guaagaauccacaaugaag

SEQ ID NO: 546711 - RNA, 19 nt, Homo sapiens
uaagaaaguccucucuaga

SEQ ID NO: 546712 - RNA, 19 nt, Homo sapiens
gaacgugagcagagauuca

SEQ ID NO: 546713 - RNA, 19 nt, Homo sapiens
gaagauugaguauaaaugc

SEQ ID NO: 546714 - RNA, 19 nt, Homo sapiens
gagugucucugaagauaca

SEQ ID NO: 546715 - RNA, 19 nt, Homo sapiens
cacuguagaugauaugcua

SEQ ID NO: 546716 - RNA, 19 nt, Homo sapiens
ccucuauucucucuccuuu

SEQ ID NO: 546717 - RNA, 19 nt, Homo sapiens
aagacaaacuggcuugaug

SEQ ID NO: 546718 - RNA, 19 nt, Homo sapiens
gcacuuggaccugauugaa

SEQ ID NO: 546719 - RNA, 19 nt, Homo sapiens
gaagcuuauuguaguaaca

SEQ ID NO: 546720 - RNA, 19 nt, Homo sapiens
gaaguuacaaagccugaga

SEQ ID NO: 546721 - RNA, 19 nt, Homo sapiens
gcaugagugugaaguuaca

SEQ ID NO: 546722 - RNA, 19 nt, Homo sapiens
cugaugauguuuggaagua

SEQ ID NO: 546723 - RNA, 19 nt, Homo sapiens
ccaggagugucucugaaga

SEQ ID NO: 546724 - RNA, 19 nt, Homo sapiens
gaagucagcagugaaucaa

SEQ ID NO: 546725 - RNA, 19 nt, Homo sapiens
uaugcuaggaucaaaguua

SEQ ID NO: 546726 - RNA, 19 nt, Homo sapiens
auaagaaaguccucucuag

SEQ ID NO: 546727 - RNA, 19 nt, Homo sapiens
caugaucuuuauacuguga

SEQ ID NO: 546728 - RNA, 19 nt, Homo sapiens
gaugaaagaaauuggacuu

SEQ ID NO: 546729 - RNA, 19 nt, Homo sapiens
ggguuagcuucauguaauu

SEQ ID NO: 546730 - RNA, 19 nt, Homo sapiens
gcacauugacuagcaaaca

SEQ ID NO: 546731 - RNA, 19 nt, Homo sapiens
gauaucaccacaaagacaa

SEQ ID NO: 546732 - RNA, 19 nt, Homo sapiens
gaggagacaaggauugaga

SEQ ID NO: 546733 - RNA, 19 nt, Homo sapiens
ggagauggccccucugaaa

SEQ ID NO: 546734 - RNA, 19 nt, Homo sapiens
aauagcaacugucugacuu

SEQ ID NO: 546735 - RNA, 19 nt, Homo sapiens
ugagggcucuaacuuggaa

SEQ ID NO: 546736 - RNA, 19 nt, Homo sapiens
aggguuagcuucauguaau

SEQ ID NO: 546737 - RNA, 19 nt, Homo sapiens
ccaguggcuucaccucauu

SEQ ID NO: 546738 - RNA, 19 nt, Homo sapiens
caaacagcacuuuaggaaa

SEQ ID NO: 546739 - RNA, 19 nt, Homo sapiens
agagaaggcacauugacua

SEQ ID NO: 546740 - RNA, 19 nt, Homo sapiens
gaaaccuuaucuauguauc

SEQ ID NO: 546741 - RNA, 19 nt, Homo sapiens
aggagugucucugaagaua

SEQ ID NO: 546742 - RNA, 19 nt, Homo sapiens
guacacacacgggaaagaa

SEQ ID NO: 546743 - RNA, 19 nt, Homo sapiens
ugaaaggaguacaggaaca

SEQ ID NO: 546744 - RNA, 19 nt, Homo sapiens
uagagagcuucaugacuga

SEQ ID NO: 546745 - RNA, 19 nt, Homo sapiens
caucagagaauccauaguc

SEQ ID NO: 546746 - RNA, 19 nt, Homo sapiens
uaaucgacaucagagaauu

SEQ ID NO: 546747 - RNA, 19 nt, Homo sapiens
uggaacaucucagaauuca

SEQ ID NO: 546748 - RNA, 19 nt, Homo sapiens
cauaagaaaguccucucua

SEQ ID NO: 546749 - RNA, 19 nt, Homo sapiens
ggacaaaguuggauuagua

SEQ ID NO: 546750 - RNA, 19 nt, Homo sapiens
gaagagaaaugccauaaau

SEQ ID NO: 546751 - RNA, 19 nt, Homo sapiens
gcacauaccuuauacaaca

SEQ ID NO: 546752 - RNA, 19 nt, Homo sapiens
gagaaagacuugguaauuu

SEQ ID NO: 546753 - RNA, 19 nt, Homo sapiens
gaaagacccuaucagugua

SEQ ID NO: 546754 - RNA, 19 nt, Homo sapiens
gaaauucauugcuuguuga

SEQ ID NO: 546755 - RNA, 19 nt, Homo sapiens
cuaggaagcugagauauuu

SEQ ID NO: 546756 - RNA, 19 nt, Homo sapiens
aagaagagcuuuagucgaa

SEQ ID NO: 546757 - RNA, 19 nt, Homo sapiens
guauaaagaugucaugaug

SEQ ID NO: 546758 - RNA, 19 nt, Homo sapiens
ggagaagacuuauccauac

SEQ ID NO: 546759 - RNA, 19 nt, Homo sapiens
ggaaaucacaccuuauuga

SEQ ID NO: 546760 - RNA, 19 nt, Homo sapiens
gaaaagcccuaucuaugua

SEQ ID NO: 546761 - RNA, 19 nt, Homo sapiens
ccaaauugcagucuuguua

SEQ ID NO: 546762 - RNA, 19 nt, Homo sapiens
gaacaucagaggauccaua

SEQ ID NO: 546763 - RNA, 19 nt, Homo sapiens
agucggagcucauuccuua

SEQ ID NO: 546764 - RNA, 19 nt, Homo sapiens
ugagaaaccuuaucacugu

SEQ ID NO: 546765 - RNA, 19 nt, Homo sapiens
gaaaugccauaaaugugaa

SEQ ID NO: 546766 - RNA, 19 nt, Homo sapiens
agagaaaccuuauaagugu

SEQ ID NO: 546767 - RNA, 19 nt, Homo sapiens
gaaaggcccuaugagugua

SEQ ID NO: 546768 - RNA, 19 nt, Homo sapiens
gcaguucauuuguuauuga

SEQ ID NO: 546769 - RNA, 19 nt, Homo sapiens
acacuaacauuauccguaa

SEQ ID NO: 546770 - RNA, 19 nt, Homo sapiens
caacauggaucagauuuag

SEQ ID NO: 546771 - RNA, 19 nt, Homo sapiens
gagagaaaccuuauaagug

SEQ ID NO: 546772 - RNA, 19 nt, Homo sapiens
agccggagcucauuucuua

SEQ ID NO: 546773 - RNA, 19 nt, Homo sapiens
cagagaauguucagagaaa

SEQ ID NO: 546774 - RNA, 19 nt, Homo sapiens
ccauaaaugugaugaaugu

SEQ ID NO: 546775 - RNA, 19 nt, Homo sapiens
aguagaagcucaggucuua

SEQ ID NO: 546776 - RNA, 19 nt, Homo sapiens
ccauaaaugugaagaaugu

SEQ ID NO: 546777 - RNA, 19 nt, Homo sapiens
gaacagagauaaggaugag

SEQ ID NO: 546778 - RNA, 19 nt, Homo sapiens
gggagaagacuuauccaua

SEQ ID NO: 546779 - RNA, 19 nt, Homo sapiens
gcucaacccuuauuagaca

SEQ ID NO: 546780 - RNA, 19 nt, Homo sapiens
agagaagccuguauaaaga

SEQ ID NO: 546781 - RNA, 19 nt, Homo sapiens
ggagagagacccuaucugu

SEQ ID NO: 546782 - RNA, 19 nt, Homo sapiens
ccauaaauguggugaaugu

SEQ ID NO: 546783 - RNA, 19 nt, Homo sapiens
cgaaauucauugcuuguug

SEQ ID NO: 546784 - RNA, 19 nt, Homo sapiens
agugugagcucaacccuua

SEQ ID NO: 546785 - RNA, 19 nt, Homo sapiens
ggaaaggcccuaugagugu

SEQ ID NO: 546786 - RNA, 19 nt, Homo sapiens
ccaagaaacccaugaaugu

SEQ ID NO: 546787 - RNA, 19 nt, Homo sapiens
ggagagaaaccuuauaagu

SEQ ID NO: 546788 - RNA, 19 nt, Homo sapiens
ccacaggguguaauaguua

SEQ ID NO: 546789 - RNA, 19 nt, Homo sapiens
ucaguuccaugauauguuu

SEQ ID NO: 546790 - RNA, 19 nt, Homo sapiens
ugacuucccuuacucuuug

SEQ ID NO: 546791 - RNA, 19 nt, Homo sapiens
gggaaagccuucaguugga

SEQ ID NO: 546792 - RNA, 19 nt, Homo sapiens
gauccaaauugcagucuug

SEQ ID NO: 546793 - RNA, 19 nt, Homo sapiens
gaagacuuauccauacaau

SEQ ID NO: 546794 - RNA, 19 nt, Homo sapiens
gaagagcuuuagucgaaau

SEQ ID NO: 546795 - RNA, 19 nt, Homo sapiens
gcucagagaagccuguaua

SEQ ID NO: 546796 - RNA, 19 nt, Homo sapiens
gcucauuucuuauugaaca

SEQ ID NO: 546797 - RNA, 19 nt, Homo sapiens
gagcucauuucuuauugaa

SEQ ID NO: 546798 - RNA, 19 nt, Homo sapiens
ggagaaagacccuaucagu

SEQ ID NO: 546799 - RNA, 19 nt, Homo sapiens
caacugcccaugagcauuu

SEQ ID NO: 546800 - RNA, 19 nt, Homo sapiens
caacagcgcagucuuguca

SEQ ID NO: 546801 - RNA, 19 nt, Homo sapiens
gauccauacuggugaaaga

SEQ ID NO: 546802 - RNA, 19 nt, Homo sapiens
gagaaaccuuaucacugua

SEQ ID NO: 546803 - RNA, 19 nt, Homo sapiens
ggaaacaaagcccaaaugu

SEQ ID NO: 546804 - RNA, 19 nt, Homo sapiens
agacuuauccauacaauga

SEQ ID NO: 546805 - RNA, 19 nt, Homo sapiens
gcucauuccuuauugaaca

SEQ ID NO: 546806 - RNA, 19 nt, Homo sapiens
agagauauuuguaguccua

SEQ ID NO: 546807 - RNA, 19 nt, Homo sapiens
agucagcuuuguaaucuua

SEQ ID NO: 546808 - RNA, 19 nt, Homo sapiens
ggagcucauuucuuauuga

SEQ ID NO: 546809 - RNA, 19 nt, Homo sapiens
gagaagacuuauccauaca

SEQ ID NO: 546810 - RNA, 19 nt, Homo sapiens
ggaaagaccccauaaaugu

SEQ ID NO: 546811 - RNA, 19 nt, Homo sapiens
ggaaagccuucaguuggaa

SEQ ID NO: 546812 - RNA, 19 nt, Homo sapiens
gaacaucagagaauucaca

SEQ ID NO: 546813 - RNA, 19 nt, Homo sapiens
ggaaccacaggguguaaua

SEQ ID NO: 546814 - RNA, 19 nt, Homo sapiens
gggcuucccuuaguuaaug

SEQ ID NO: 546815 - RNA, 19 nt, Homo sapiens
cagagaagccuguauaaag

SEQ ID NO: 546816 - RNA, 19 nt, Homo sapiens
gagcucaacccuuauuaga

SEQ ID NO: 546817 - RNA, 19 nt, Homo sapiens
gaugaggagccaacuguaa

SEQ ID NO: 546818 - RNA, 19 nt, Homo sapiens
acaaagguguuaccaagga

SEQ ID NO: 546819 - RNA, 19 nt, Homo sapiens
uaagaaacccuaacaaagg

SEQ ID NO: 546820 - RNA, 19 nt, Homo sapiens
ggcaaauaguuucuaaaga

SEQ ID NO: 546821 - RNA, 19 nt, Homo sapiens
agucgcaguucauuuguua

SEQ ID NO: 546822 - RNA, 19 nt, Homo sapiens
ucaggcaaauaguuucuaa

SEQ ID NO: 546823 - RNA, 19 nt, Homo sapiens
gaacucgggucuuauucag

SEQ ID NO: 546824 - RNA, 19 nt, Homo sapiens
cgaaggaggagugggauua

SEQ ID NO: 546825 - RNA, 19 nt, Homo sapiens
ggagcucauuccuuauuga

SEQ ID NO: 546826 - RNA, 19 nt, Homo sapiens
gaaauugaccaggauccua

SEQ ID NO: 546827 - RNA, 19 nt, Homo sapiens
gccaaagucccagugauua

SEQ ID NO: 546828 - RNA, 19 nt, Homo sapiens
gaucguagagaaagacuug

SEQ ID NO: 546829 - RNA, 19 nt, Homo sapiens
caggagagaaaccuuauaa

SEQ ID NO: 546830 - RNA, 19 nt, Homo sapiens
gagcuuuagucgaaauuca

SEQ ID NO: 546831 - RNA, 19 nt, Homo sapiens
auaaagaugucaugaugga

SEQ ID NO: 546832 - RNA, 19 nt, Homo sapiens
agaaagacccuaucagugu

SEQ ID NO: 546833 - RNA, 19 nt, Homo sapiens
gcuaggaagcugagauauu

SEQ ID NO: 546834 - RNA, 19 nt, Homo sapiens
uauuaugacugccaaguau

SEQ ID NO: 546835 - RNA, 19 nt, Homo sapiens
gagggacaaaguuggauua

SEQ ID NO: 546836 - RNA, 19 nt, Homo sapiens
gcaaggcccauuucauuca

SEQ ID NO: 546837 - RNA, 19 nt, Homo sapiens
ugaagaaauugaggaagaa

SEQ ID NO: 546838 - RNA, 19 nt, Homo sapiens
gccuuuaauugccguauuu

SEQ ID NO: 546839 - RNA, 19 nt, Homo sapiens
ccauaaaugugaggaaugu

SEQ ID NO: 546840 - RNA, 19 nt, Homo sapiens
agaaaugccauaaauguga

SEQ ID NO: 546841 - RNA, 19 nt, Homo sapiens
ugaacuuguugguagguua

SEQ ID NO: 546842 - RNA, 19 nt, Homo sapiens
ccaaagucccagugauuaa

SEQ ID NO: 546843 - RNA, 19 nt, Homo sapiens
agagaaagacuugguaauu

SEQ ID NO: 546844 - RNA, 19 nt, Homo sapiens
gagcauuugacuucccuua

SEQ ID NO: 546845 - RNA, 19 nt, Homo sapiens
ccgcaaggcccauuucauu

SEQ ID NO: 546846 - RNA, 19 nt, Homo sapiens
gaaaucacaccuuauugag

SEQ ID NO: 546847 - RNA, 19 nt, Homo sapiens
ccauaaauguagugacugu

SEQ ID NO: 546848 - RNA, 19 nt, Homo sapiens
uguaaucaguguaaacaga

SEQ ID NO: 546849 - RNA, 19 nt, Homo sapiens
gaaagacccuauaaaugua

SEQ ID NO: 546850 - RNA, 19 nt, Homo sapiens
ggauagcucuuuaguaauu

SEQ ID NO: 546851 - RNA, 19 nt, Homo sapiens
uaacagcacuccagcauuu

SEQ ID NO: 546852 - RNA, 19 nt, Homo sapiens
uaggauagcucuuuaguaa

SEQ ID NO: 546853 - RNA, 19 nt, Homo sapiens
gaaaguggacacauuagua

SEQ ID NO: 546854 - RNA, 19 nt, Homo sapiens
uaaagaaaguggacacauu

SEQ ID NO: 546855 - RNA, 19 nt, Homo sapiens
gagaagcccuaccaaugua

SEQ ID NO: 546856 - RNA, 19 nt, Homo sapiens
caacaguccuuucgauuau

SEQ ID NO: 546857 - RNA, 19 nt, Homo sapiens
guauguagcuuucuaggaa

SEQ ID NO: 546858 - RNA, 19 nt, Homo sapiens
ggagaaagacccuauaaau

SEQ ID NO: 546859 - RNA, 19 nt, Homo sapiens
caaaguacccuuagaaaga

SEQ ID NO: 546860 - RNA, 19 nt, Homo sapiens
gagaaacccuaucagugua

SEQ ID NO: 546861 - RNA, 19 nt, Homo sapiens
aggcggagcucacaucuua

SEQ ID NO: 546862 - RNA, 19 nt, Homo sapiens
gcagaaaggucaucacaac

SEQ ID NO: 546863 - RNA, 19 nt, Homo sapiens
gagaaagacccuauaaaug

SEQ ID NO: 546864 - RNA, 19 nt, Homo sapiens
caagagagacgacauaaau

SEQ ID NO: 546865 - RNA, 19 nt, Homo sapiens
gguaauaucuacuggaauc

SEQ ID NO: 546866 - RNA, 19 nt, Homo sapiens
caucacaacuuuaguguca

SEQ ID NO: 546867 - RNA, 19 nt, Homo sapiens
gaacacuggucucauucaa

SEQ ID NO: 546868 - RNA, 19 nt, Homo sapiens
ggagaaacccuaucagugu

SEQ ID NO: 546869 - RNA, 19 nt, Homo sapiens
ucuaauggcugaagaauca

SEQ ID NO: 546870 - RNA, 19 nt, Homo sapiens
cgaagaugcuuuaggaaga

SEQ ID NO: 546871 - RNA, 19 nt, Homo sapiens
aaagaaaguggacacauua

SEQ ID NO: 546872 - RNA, 19 nt, Homo sapiens
ugagaggucuuucagugua

SEQ ID NO: 546873 - RNA, 19 nt, Homo sapiens
ggagagagacccuaugaau

SEQ ID NO: 546874 - RNA, 19 nt, Homo sapiens
gaacuuacgcauccaaugu

SEQ ID NO: 546875 - RNA, 19 nt, Homo sapiens
caaagaauguauacucauc

SEQ ID NO: 546876 - RNA, 19 nt, Homo sapiens
agacgaagaugcuuuagga

SEQ ID NO: 546877 - RNA, 19 nt, Homo sapiens
ccaacaguccuuucgauua

SEQ ID NO: 546878 - RNA, 19 nt, Homo sapiens
ggcacuauauuucaucuuu

SEQ ID NO: 546879 - RNA, 19 nt, Homo sapiens
caaacucccugacuagaug

SEQ ID NO: 546880 - RNA, 19 nt, Homo sapiens
cuaagaagcugcuguagag

SEQ ID NO: 546881 - RNA, 19 nt, Homo sapiens
gugaguagcuauagguuug

SEQ ID NO: 546882 - RNA, 19 nt, Homo sapiens
agaaagacccuauaaaugu

SEQ ID NO: 546883 - RNA, 19 nt, Homo sapiens
ggagaagauugaagacaug

SEQ ID NO: 546884 - RNA, 19 nt, Homo sapiens
gaaaugacagcuacacuuc

SEQ ID NO: 546885 - RNA, 19 nt, Homo sapiens
gcagauugauauacuagga

SEQ ID NO: 546886 - RNA, 19 nt, Homo sapiens
caacaucaguuagaguuug

SEQ ID NO: 546887 - RNA, 19 nt, Homo sapiens
gaagucaggccuuauugaa

SEQ ID NO: 546888 - RNA, 19 nt, Homo sapiens
cagcaggguuccagacuuu

SEQ ID NO: 546889 - RNA, 19 nt, Homo sapiens
ggaaaggcagauugauaua

SEQ ID NO: 546890 - RNA, 19 nt, Homo sapiens
uugaagagcuuaacuuugu

SEQ ID NO: 546891 - RNA, 19 nt, Homo sapiens
ggagaagcccuaccaaugu

SEQ ID NO: 546892 - RNA, 19 nt, Homo sapiens
ggagaaacccuacaaaugc

SEQ ID NO: 546893 - RNA, 19 nt, Homo sapiens
ggaaaucccacacaagaga

SEQ ID NO: 546894 - RNA, 19 nt, Homo sapiens
gaacagggaauuagcuuca

SEQ ID NO: 546895 - RNA, 19 nt, Homo sapiens
caauguggguugucacuug

SEQ ID NO: 546896 - RNA, 19 nt, Homo sapiens
gcaccagagccuccaaaua

SEQ ID NO: 546897 - RNA, 19 nt, Homo sapiens
guaaugagacugguuuaaa

SEQ ID NO: 546898 - RNA, 19 nt, Homo sapiens
gggagaaacccuacaaaug

SEQ ID NO: 546899 - RNA, 19 nt, Homo sapiens
gagagacccuaugaaugua

SEQ ID NO: 546900 - RNA, 19 nt, Homo sapiens
ggucagcccuucuuucaca

SEQ ID NO: 546901 - RNA, 19 nt, Homo sapiens
gagaagcucugauccaacu

SEQ ID NO: 546902 - RNA, 19 nt, Homo sapiens
ggcaaagccuucagucaga

SEQ ID NO: 546903 - RNA, 19 nt, Homo sapiens
ggaauuagcuucaaaacag

SEQ ID NO: 546904 - RNA, 19 nt, Homo sapiens
ugagacugguuuaaaguaa

SEQ ID NO: 546905 - RNA, 19 nt, Homo sapiens
gcacuauauuucaucuuug

SEQ ID NO: 546906 - RNA, 19 nt, Homo sapiens
gcaccucacucguuauucu

SEQ ID NO: 546907 - RNA, 19 nt, Homo sapiens
gaucuaagaagcugcugua

SEQ ID NO: 546908 - RNA, 19 nt, Homo sapiens
gggaggagguaguacauuc

SEQ ID NO: 546909 - RNA, 19 nt, Homo sapiens
gaagaugcuuuaggaagau

SEQ ID NO: 546910 - RNA, 19 nt, Homo sapiens
aguuagaguuugagcauua

SEQ ID NO: 546911 - RNA, 19 nt, Homo sapiens
gggagaagcccuaccaaug

SEQ ID NO: 546912 - RNA, 19 nt, Homo sapiens
gagaaacccuacaaaugca

SEQ ID NO: 546913 - RNA, 19 nt, Homo sapiens
guaaaacgcuaucacugua

SEQ ID NO: 546914 - RNA, 19 nt, Homo sapiens
ggaaaugacagcuacacuu

SEQ ID NO: 546915 - RNA, 19 nt, Homo sapiens
uaaguuaccauuccuaguu

SEQ ID NO: 546916 - RNA, 19 nt, Homo sapiens
gagcuuggauaguuauaca

SEQ ID NO: 546917 - RNA, 19 nt, Homo sapiens
ggaguaauacagagaaaga

SEQ ID NO: 546918 - RNA, 19 nt, Homo sapiens
ggagaagcccuaugagugu

SEQ ID NO: 546919 - RNA, 19 nt, Homo sapiens
gcaaagccuucagucagaa

SEQ ID NO: 546920 - RNA, 19 nt, Homo sapiens
cgagaggaguggcuucuug

SEQ ID NO: 546921 - RNA, 19 nt, Homo sapiens
gggagggccuucagucaga

SEQ ID NO: 546922 - RNA, 19 nt, Homo sapiens
ccauuugaguagccacuua

SEQ ID NO: 546923 - RNA, 19 nt, Homo sapiens
uaaugagacugguuuaaag

SEQ ID NO: 546924 - RNA, 19 nt, Homo sapiens
uaaagaagguaguggaaac

SEQ ID NO: 546925 - RNA, 19 nt, Homo sapiens
ggauauccacaacaaagua

SEQ ID NO: 546926 - RNA, 19 nt, Homo sapiens
cagguaauaucuacuggaa

SEQ ID NO: 546927 - RNA, 19 nt, Homo sapiens
gaaucuagucugcaugaaa

SEQ ID NO: 546928 - RNA, 19 nt, Homo sapiens
gcaccugugucaguaaaga

SEQ ID NO: 546929 - RNA, 19 nt, Homo sapiens
agaaggaucuguguagaga

SEQ ID NO: 546930 - RNA, 19 nt, Homo sapiens
gguaguacauucagcaucu

SEQ ID NO: 546931 - RNA, 19 nt, Homo sapiens
uuacaauacugcuuucuca

SEQ ID NO: 546932 - RNA, 19 nt, Homo sapiens
gagcuuaacuuugucuuuu

SEQ ID NO: 546933 - RNA, 19 nt, Homo sapiens
gagagagacccuaugaaug

SEQ ID NO: 546934 - RNA, 19 nt, Homo sapiens
caagagagagccaugucua

SEQ ID NO: 546935 - RNA, 19 nt, Homo sapiens
ggagguggugacccuauua

SEQ ID NO: 546936 - RNA, 19 nt, Homo sapiens
ucacaaaguacccuuagaa

SEQ ID NO: 546937 - RNA, 19 nt, Homo sapiens
ugagcauuauucagcauua

SEQ ID NO: 546938 - RNA, 19 nt, Homo sapiens
gugguaaagccuucaguua

SEQ ID NO: 546939 - RNA, 19 nt, Homo sapiens
ucccuucucuuguuucuuu

SEQ ID NO: 546940 - RNA, 19 nt, Homo sapiens
gaagacacccaucacuugu

SEQ ID NO: 546941 - RNA, 19 nt, Homo sapiens
caacuuuagugucagaauc

SEQ ID NO: 546942 - RNA, 19 nt, Homo sapiens
agagagacccuaugaaugu

SEQ ID NO: 546943 - RNA, 19 nt, Homo sapiens
gauggucugucacuccuau

SEQ ID NO: 546944 - RNA, 19 nt, Homo sapiens
ggaacaacaucaguuagag

SEQ ID NO: 546945 - RNA, 19 nt, Homo sapiens
gggaaggcuuucagucaga

SEQ ID NO: 546946 - RNA, 19 nt, Homo sapiens
ugaagaagcccgagaccuu

SEQ ID NO: 546947 - RNA, 19 nt, Homo sapiens
agagacagcugccaaaugc

SEQ ID NO: 546948 - RNA, 19 nt, Homo sapiens
aucaaagucuuacgucaua

SEQ ID NO: 546949 - RNA, 19 nt, Homo sapiens
gaaagacuguccuaagaua

SEQ ID NO: 546950 - RNA, 19 nt, Homo sapiens
gggaagagcuuuacucaga

SEQ ID NO: 546951 - RNA, 19 nt, Homo sapiens
ugaaacaaauccugacuua

SEQ ID NO: 546952 - RNA, 19 nt, Homo sapiens
gacaagaaguccucuguaa

SEQ ID NO: 546953 - RNA, 19 nt, Homo sapiens
agaaagaccuuaugaaugu

SEQ ID NO: 546954 - RNA, 19 nt, Homo sapiens
gcuaaacccuucuaauaau

SEQ ID NO: 546955 - RNA, 19 nt, Homo sapiens
ggagaaagaccuuaugaau

SEQ ID NO: 546956 - RNA, 19 nt, Homo sapiens
gcaagcgccuccaagguuu

SEQ ID NO: 546957 - RNA, 19 nt, Homo sapiens
gggaaagccuucagucgaa

SEQ ID NO: 546958 - RNA, 19 nt, Homo sapiens
gaagugccauucuauugga

SEQ ID NO: 546959 - RNA, 19 nt, Homo sapiens
gagaaagaccuuaugaaug

SEQ ID NO: 546960 - RNA, 19 nt, Homo sapiens
gaaagaccuuaugaaugua

SEQ ID NO: 546961 - RNA, 19 nt, Homo sapiens
gaacauaaggauaggauag

SEQ ID NO: 546962 - RNA, 19 nt, Homo sapiens
caaugaaaguggaagcaaa

SEQ ID NO: 546963 - RNA, 19 nt, Homo sapiens
cgacaucaaagaauucaua

SEQ ID NO: 546964 - RNA, 19 nt, Homo sapiens
gcaggaauccagacugaaa

SEQ ID NO: 546965 - RNA, 19 nt, Homo sapiens
caagaugaauacaaacuca

SEQ ID NO: 546966 - RNA, 19 nt, Homo sapiens
ggagagagagcucgaugaa

SEQ ID NO: 546967 - RNA, 19 nt, Homo sapiens
aaacaaauccugacuuaag

SEQ ID NO: 546968 - RNA, 19 nt, Homo sapiens
gagaguuggugcuaaggaa

SEQ ID NO: 546969 - RNA, 19 nt, Homo sapiens
cugcuaaacccuucuaaua

SEQ ID NO: 546970 - RNA, 19 nt, Homo sapiens
aaaggaaaguuggguguuu

SEQ ID NO: 546971 - RNA, 19 nt, Homo sapiens
ggacagagaguuggugcua

SEQ ID NO: 546972 - RNA, 19 nt, Homo sapiens
caagaaguccucuguaaag

SEQ ID NO: 546973 - RNA, 19 nt, Homo sapiens
gcacaaaggagcagauuuu

SEQ ID NO: 546974 - RNA, 19 nt, Homo sapiens
gagcucaggucucauucga

SEQ ID NO: 546975 - RNA, 19 nt, Homo sapiens
gagaagaggcugugauuuu

SEQ ID NO: 546976 - RNA, 19 nt, Homo sapiens
gaaacaaauccugacuuaa

SEQ ID NO: 546977 - RNA, 19 nt, Homo sapiens
gaaugugggaagagcuuua

SEQ ID NO: 546978 - RNA, 19 nt, Homo sapiens
ggaaagacuguccuaagau

SEQ ID NO: 546979 - RNA, 19 nt, Homo sapiens
ccacagacacagacaagaa

SEQ ID NO: 546980 - RNA, 19 nt, Homo sapiens
gcugugucccucuuauuua

SEQ ID NO: 546981 - RNA, 19 nt, Homo sapiens
gagaaguuggugaacauaa

SEQ ID NO: 546982 - RNA, 19 nt, Homo sapiens
uggaggaucuggagagaga

SEQ ID NO: 546983 - RNA, 19 nt, Homo sapiens
ggaacacuguccagagagu

SEQ ID NO: 546984 - RNA, 19 nt, Homo sapiens
caucaaagaauucauacug

SEQ ID NO: 546985 - RNA, 19 nt, Homo sapiens
ggagagacagaugaaguaa

SEQ ID NO: 546986 - RNA, 19 nt, Homo sapiens
ggagcaguuucuauccauu

SEQ ID NO: 546987 - RNA, 19 nt, Homo sapiens
ggaccaagggaggcucuua

SEQ ID NO: 546988 - RNA, 19 nt, Homo sapiens
gaacuucugacaaugaaag

SEQ ID NO: 546989 - RNA, 19 nt, Homo sapiens
ggucuuauccagcaucaga

SEQ ID NO: 546990 - RNA, 19 nt, Homo sapiens
acucagagcucaggucuca

SEQ ID NO: 546991 - RNA, 19 nt, Homo sapiens
gacagagaguuggugcuaa

SEQ ID NO: 546992 - RNA, 19 nt, Homo sapiens
gcagagcagacaccacuga

SEQ ID NO: 546993 - RNA, 19 nt, Homo sapiens
gcccagggacuuccuuaaa

SEQ ID NO: 546994 - RNA, 19 nt, Homo sapiens
gagaauccacaaaggagaa

SEQ ID NO: 546995 - RNA, 19 nt, Homo sapiens
uggcaggaauccagacuga

SEQ ID NO: 546996 - RNA, 19 nt, Homo sapiens
ggagaagaggcugugauuu

SEQ ID NO: 546997 - RNA, 19 nt, Homo sapiens
ugcuaaacccuucuaauaa

SEQ ID NO: 546998 - RNA, 19 nt, Homo sapiens
gaaaguuggguguuugaag

SEQ ID NO: 546999 - RNA, 19 nt, Homo sapiens
cagcugugcuaccaagaga

SEQ ID NO: 547000 - RNA, 19 nt, Homo sapiens
gaucaccacccaaguugug

SEQ ID NO: 547001 - RNA, 19 nt, Homo sapiens
ccagaucaccacccaaguu

SEQ ID NO: 547002 - RNA, 19 nt, Homo sapiens
ggaauccacaauauacaga

SEQ ID NO: 547003 - RNA, 19 nt, Homo sapiens
ggagaaguuggugaacaua

SEQ ID NO: 547004 - RNA, 19 nt, Homo sapiens
agacaccacugacccuuca

SEQ ID NO: 547005 - RNA, 19 nt, Homo sapiens
acaagaaguccucuguaaa

SEQ ID NO: 547006 - RNA, 19 nt, Homo sapiens
gucuagggcuuggcuauga

SEQ ID NO: 547007 - RNA, 19 nt, Homo sapiens
cgaggaauccacaauauac

SEQ ID NO: 547008 - RNA, 19 nt, Homo sapiens
ccgaggaauccacaauaua

SEQ ID NO: 547009 - RNA, 19 nt, Homo sapiens
aagaaguccucuguaaaga

SEQ ID NO: 547010 - RNA, 19 nt, Homo sapiens
caucagagaauccacaaag

SEQ ID NO: 547011 - RNA, 19 nt, Homo sapiens
ucagagcucaggucucauu

SEQ ID NO: 547012 - RNA, 19 nt, Homo sapiens
agucgaaguucuggucuuu

SEQ ID NO: 547013 - RNA, 19 nt, Homo sapiens
ggcguucauuucucauuga

SEQ ID NO: 547014 - RNA, 19 nt, Homo sapiens
acagagaguuggugcuaag

SEQ ID NO: 547015 - RNA, 19 nt, Homo sapiens
gaugaaccacaacaugaga

SEQ ID NO: 547016 - RNA, 19 nt, Homo sapiens
ucagagaauccacaaagga

SEQ ID NO: 547017 - RNA, 19 nt, Homo sapiens
agguuugucuugaagcaua

SEQ ID NO: 547018 - RNA, 19 nt, Homo sapiens
ggucucauucgacaucaaa

SEQ ID NO: 547019 - RNA, 19 nt, Homo sapiens
agaaguuggugaacauaag

SEQ ID NO: 547020 - RNA, 19 nt, Homo sapiens
gcuggaggaucuggagaga

SEQ ID NO: 547021 - RNA, 19 nt, Homo sapiens
caccgaggaauccacaaua

SEQ ID NO: 547022 - RNA, 19 nt, Homo sapiens
uggagagacagaugaagua

SEQ ID NO: 547023 - RNA, 19 nt, Homo sapiens
ucgaugaaccacaacauga

SEQ ID NO: 547024 - RNA, 19 nt, Homo sapiens
agggaacacuguccagaga

SEQ ID NO: 547025 - RNA, 19 nt, Homo sapiens
gagcacaaaggagcagauu

SEQ ID NO: 547026 - RNA, 19 nt, Homo sapiens
aaaugccucuuucuuccuu

SEQ ID NO: 547027 - RNA, 19 nt, Homo sapiens
cagaucaccacccaaguug

SEQ ID NO: 547028 - RNA, 19 nt, Homo sapiens
cggcguucauuucucauug

SEQ ID NO: 547029 - RNA, 19 nt, Homo sapiens
gagcuacagucggcguuca

SEQ ID NO: 547030 - RNA, 19 nt, Homo sapiens
gaauccacaauauacagaa

SEQ ID NO: 547031 - RNA, 19 nt, Homo sapiens
uggagaaguuggugaacau

SEQ ID NO: 547032 - RNA, 19 nt, Homo sapiens
aaggaaaguuggguguuug

SEQ ID NO: 547033 - RNA, 19 nt, Homo sapiens
cccagggacuuccuuaaag

SEQ ID NO: 547034 - RNA, 19 nt, Homo sapiens
gagcaaguuuuccagauca

SEQ ID NO: 547035 - RNA, 19 nt, Homo sapiens
ccucaccagugcauugaau

SEQ ID NO: 547036 - RNA, 19 nt, Homo sapiens
gaccuuaugaauguaauga

SEQ ID NO: 547037 - RNA, 19 nt, Homo sapiens
cagaugaaguaaccaagac

SEQ ID NO: 547038 - RNA, 19 nt, Homo sapiens
aggucaagaugaauacaaa

SEQ ID NO: 547039 - RNA, 19 nt, Homo sapiens
gagcaguuucuauccauuc

SEQ ID NO: 547040 - RNA, 19 nt, Homo sapiens
gcaggaucccucacaugga

SEQ ID NO: 547041 - RNA, 19 nt, Homo sapiens
ugaauacaaacucaaagga

SEQ ID NO: 547042 - RNA, 19 nt, Homo sapiens
agacaagaaguccucugua

SEQ ID NO: 547043 - RNA, 19 nt, Homo sapiens
ggaaaguuggguguuugaa

SEQ ID NO: 547044 - RNA, 19 nt, Homo sapiens
cgaccucaccagugcauug

SEQ ID NO: 547045 - RNA, 19 nt, Homo sapiens
gaggaauccacaauauaca

SEQ ID NO: 547046 - RNA, 19 nt, Homo sapiens
aagaauucauacuggagaa

SEQ ID NO: 547047 - RNA, 19 nt, Homo sapiens
ggagguaucacagcaggau

SEQ ID NO: 547048 - RNA, 19 nt, Homo sapiens
aaccaagacugaggacaga

SEQ ID NO: 547049 - RNA, 19 nt, Homo sapiens
gcaaauacacuaaauggaa

SEQ ID NO: 547050 - RNA, 19 nt, Homo sapiens
gcucaagccuuucuaauca

SEQ ID NO: 547051 - RNA, 19 nt, Homo sapiens
gagagaagcccuacaaaug

SEQ ID NO: 547052 - RNA, 19 nt, Homo sapiens
gaaagacugggaaaguuua

SEQ ID NO: 547053 - RNA, 19 nt, Homo sapiens
gagaggauauggaaauugu

SEQ ID NO: 547054 - RNA, 19 nt, Homo sapiens
cuacaaaugugacgaaugu

SEQ ID NO: 547055 - RNA, 19 nt, Homo sapiens
gagagaaacccuacaaaug

SEQ ID NO: 547056 - RNA, 19 nt, Homo sapiens
cuacaaaugugacgaaugu

SEQ ID NO: 547057 - RNA, 19 nt, Homo sapiens
caacaucuuuaagcaguua

SEQ ID NO: 547058 - RNA, 19 nt, Homo sapiens
gaaauuguggccuugauaa

SEQ ID NO: 547059 - RNA, 19 nt, Homo sapiens
aaagagcccuggaauguga

SEQ ID NO: 547060 - RNA, 19 nt, Homo sapiens
guacagggaugugauguug

SEQ ID NO: 547061 - RNA, 19 nt, Homo sapiens
ggaaagacugggaaaguuu

SEQ ID NO: 547062 - RNA, 19 nt, Homo sapiens
gcaaagccuucacccaguu

SEQ ID NO: 547063 - RNA, 19 nt, Homo sapiens
agagaaaccuuacaagugu

SEQ ID NO: 547064 - RNA, 19 nt, Homo sapiens
gcacggacacguucagaaa

SEQ ID NO: 547065 - RNA, 19 nt, Homo sapiens
acacuagaguucauacuaa

SEQ ID NO: 547066 - RNA, 19 nt, Homo sapiens
gagaaacccuacaaaugug

SEQ ID NO: 547067 - RNA, 19 nt, Homo sapiens
gagagaaaccuuacaagug

SEQ ID NO: 547068 - RNA, 19 nt, Homo sapiens
ucucagaccuuacuaaaca

SEQ ID NO: 547069 - RNA, 19 nt, Homo sapiens
caucagaguucagacuuaa

SEQ ID NO: 547070 - RNA, 19 nt, Homo sapiens
gagagaaacccuacaagug

SEQ ID NO: 547071 - RNA, 19 nt, Homo sapiens
gagagaaacccuacaagug

SEQ ID NO: 547072 - RNA, 19 nt, Homo sapiens
gagaagcccuacaaaugug

SEQ ID NO: 547073 - RNA, 19 nt, Homo sapiens
uaucagaccucacuaagca

SEQ ID NO: 547074 - RNA, 19 nt, Homo sapiens
gagaaacccuaccaaugug

SEQ ID NO: 547075 - RNA, 19 nt, Homo sapiens
gagagaaacccuaccaaug

SEQ ID NO: 547076 - RNA, 19 nt, Homo sapiens
cuacaagugugaagaaugu

SEQ ID NO: 547077 - RNA, 19 nt, Homo sapiens
auacaaaugugacgaaugu

SEQ ID NO: 547078 - RNA, 19 nt, Homo sapiens
gaaacaugguacaaagguu

SEQ ID NO: 547079 - RNA, 19 nt, Homo sapiens
ggagagaaacccuacaaau

SEQ ID NO: 547080 - RNA, 19 nt, Homo sapiens
aaacauaagcaaacccaua

SEQ ID NO: 547081 - RNA, 19 nt, Homo sapiens
gaacacaggaggauucaca

SEQ ID NO: 547082 - RNA, 19 nt, Homo sapiens
ggaaauuguggccuugaua

SEQ ID NO: 547083 - RNA, 19 nt, Homo sapiens
gcagagccuucaugugguu

SEQ ID NO: 547084 - RNA, 19 nt, Homo sapiens
ccucaaaccuuauuguaca

SEQ ID NO: 547085 - RNA, 19 nt, Homo sapiens
ggagagaagcccuacaaau

SEQ ID NO: 547086 - RNA, 19 nt, Homo sapiens
gagaaaccauacaaaugug

SEQ ID NO: 547087 - RNA, 19 nt, Homo sapiens
uuacaagugucaagaaugu

SEQ ID NO: 547088 - RNA, 19 nt, Homo sapiens
gagcagggcauacaagaug

SEQ ID NO: 547089 - RNA, 19 nt, Homo sapiens
gcucaagccuuucuaacca

SEQ ID NO: 547090 - RNA, 19 nt, Homo sapiens
ggaccucgcucagcagaau

SEQ ID NO: 547091 - RNA, 19 nt, Homo sapiens
gaaaagagcccuggaaugu

SEQ ID NO: 547092 - RNA, 19 nt, Homo sapiens
aaagaauacugagaggaua

SEQ ID NO: 547093 - RNA, 19 nt, Homo sapiens
aguaaacaauggaggauuu

SEQ ID NO: 547094 - RNA, 19 nt, Homo sapiens
ggagagaaaccuuacaagu

SEQ ID NO: 547095 - RNA, 19 nt, Homo sapiens
agagaaacccuacaaaugu

SEQ ID NO: 547096 - RNA, 19 nt, Homo sapiens
cuaccaaugugaagaaugu

SEQ ID NO: 547097 - RNA, 19 nt, Homo sapiens
ugagaaaccauacaaaugu

SEQ ID NO: 547098 - RNA, 19 nt, Homo sapiens
aaccagugcucccaccuua

SEQ ID NO: 547099 - RNA, 19 nt, Homo sapiens
guucagggauguggccaua

SEQ ID NO: 547100 - RNA, 19 nt, Homo sapiens
guagagaaacccaacaaau

SEQ ID NO: 547101 - RNA, 19 nt, Homo sapiens
ucucagacauuaccaaaca

SEQ ID NO: 547102 - RNA, 19 nt, Homo sapiens
uggcaaauccuuucaaaug

SEQ ID NO: 547103 - RNA, 19 nt, Homo sapiens
ucagaguucagacuuaaua

SEQ ID NO: 547104 - RNA, 19 nt, Homo sapiens
ggagagaaacccuacaagu

SEQ ID NO: 547105 - RNA, 19 nt, Homo sapiens
gccaggagaugacucuguu

SEQ ID NO: 547106 - RNA, 19 nt, Homo sapiens
ggagagaaacccuacaagu

SEQ ID NO: 547107 - RNA, 19 nt, Homo sapiens
ggagagaaacccuaccaau

SEQ ID NO: 547108 - RNA, 19 nt, Homo sapiens
gggaaagccuauacacagu

SEQ ID NO: 547109 - RNA, 19 nt, Homo sapiens
ggagaacuacagaaacuug

SEQ ID NO: 547110 - RNA, 19 nt, Homo sapiens
gcagugucuuuaucucuug

SEQ ID NO: 547111 - RNA, 19 nt, Homo sapiens
auaauggacuuaaccaaug

SEQ ID NO: 547112 - RNA, 19 nt, Homo sapiens
gcaaagccguuaguaucug

SEQ ID NO: 547113 - RNA, 19 nt, Homo sapiens
gggaugugauguuggagaa

SEQ ID NO: 547114 - RNA, 19 nt, Homo sapiens
agagaaacccuaccaaugu

SEQ ID NO: 547115 - RNA, 19 nt, Homo sapiens
gcccaaauccuuccaaaca

SEQ ID NO: 547116 - RNA, 19 nt, Homo sapiens
ggacuuaaccaauguucau

SEQ ID NO: 547117 - RNA, 19 nt, Homo sapiens
uauacuagauggaagacuu

SEQ ID NO: 547118 - RNA, 19 nt, Homo sapiens
ggauguggccauagaauuc

SEQ ID NO: 547119 - RNA, 19 nt, Homo sapiens
ccaaacaccagagaaauga

SEQ ID NO: 547120 - RNA, 19 nt, Homo sapiens
gcaaauccuuucaaaugcu

SEQ ID NO: 547121 - RNA, 19 nt, Homo sapiens
gacuguacaugaaagcauu

SEQ ID NO: 547122 - RNA, 19 nt, Homo sapiens
cuacacgugugaagaaugu

SEQ ID NO: 547123 - RNA, 19 nt, Homo sapiens
ccagagaaaugagauugga

SEQ ID NO: 547124 - RNA, 19 nt, Homo sapiens
cauugacacuggagagaaa

SEQ ID NO: 547125 - RNA, 19 nt, Homo sapiens
cuagcuaugucuucucauu

SEQ ID NO: 547126 - RNA, 19 nt, Homo sapiens
ccaaagugcugggauuaca

SEQ ID NO: 547127 - RNA, 19 nt, Homo sapiens
ucagggauguggccauaga

SEQ ID NO: 547128 - RNA, 19 nt, Homo sapiens
cccaacaaaucucauaaau

SEQ ID NO: 547129 - RNA, 19 nt, Homo sapiens
acaccugacuguacaugaa

SEQ ID NO: 547130 - RNA, 19 nt, Homo sapiens
cauaagagaauucauacug

SEQ ID NO: 547131 - RNA, 19 nt, Homo sapiens
cauaagagaauucauacug

SEQ ID NO: 547132 - RNA, 19 nt, Homo sapiens
ucaagccuuucuaaccaua

SEQ ID NO: 547133 - RNA, 19 nt, Homo sapiens
uaaccaauguucaucaacu

SEQ ID NO: 547134 - RNA, 19 nt, Homo sapiens
cagccaggccucaauguuu

SEQ ID NO: 547135 - RNA, 19 nt, Homo sapiens
uagagaaacccaacaaauc

SEQ ID NO: 547136 - RNA, 19 nt, Homo sapiens
gcaacaucuuuaagcaguu

SEQ ID NO: 547137 - RNA, 19 nt, Homo sapiens
gugagaaaccauacaaaug

SEQ ID NO: 547138 - RNA, 19 nt, Homo sapiens
ggugagaaaccauacaaau

SEQ ID NO: 547139 - RNA, 19 nt, Homo sapiens
cacuagaguucauacuaaa

SEQ ID NO: 547140 - RNA, 19 nt, Homo sapiens
acaucagaguucagacuua

SEQ ID NO: 547141 - RNA, 19 nt, Homo sapiens
agagaaacccuacaagugu

SEQ ID NO: 547142 - RNA, 19 nt, Homo sapiens
agagaaacccuacaagugu

SEQ ID NO: 547143 - RNA, 19 nt, Homo sapiens
auuguggccuugauaauuu

SEQ ID NO: 547144 - RNA, 19 nt, Homo sapiens
gaagagugcagcagugucu

SEQ ID NO: 547145 - RNA, 19 nt, Homo sapiens
caauguuucuguggacaaa

SEQ ID NO: 547146 - RNA, 19 nt, Homo sapiens
ccaacaaaucucauaaaug

SEQ ID NO: 547147 - RNA, 19 nt, Homo sapiens
uggaagacuugcaucaguu

SEQ ID NO: 547148 - RNA, 19 nt, Homo sapiens
ucaaaugugaggaauguga

SEQ ID NO: 547149 - RNA, 19 nt, Homo sapiens
gaacaacacuuaagacuuu

SEQ ID NO: 547150 - RNA, 19 nt, Homo sapiens
gaaaggaccugaaaacuua

SEQ ID NO: 547151 - RNA, 19 nt, Homo sapiens
gaagauuccugcagcaauu

SEQ ID NO: 547152 - RNA, 19 nt, Homo sapiens
ccaaagaaacucuguguua

SEQ ID NO: 547153 - RNA, 19 nt, Homo sapiens
gaaugcagcuuuccuuuca

SEQ ID NO: 547154 - RNA, 19 nt, Homo sapiens
gaaauaauguucuggugau

SEQ ID NO: 547155 - RNA, 19 nt, Homo sapiens
caacuagucucacgaaugu

SEQ ID NO: 547156 - RNA, 19 nt, Homo sapiens
acaaagagaugaagaacaa

SEQ ID NO: 547157 - RNA, 19 nt, Homo sapiens
guaggaaacucauuuagug

SEQ ID NO: 547158 - RNA, 19 nt, Homo sapiens
uaacaucacugcagaauac

SEQ ID NO: 547159 - RNA, 19 nt, Homo sapiens
guaaauuucucuggcguua

SEQ ID NO: 547160 - RNA, 19 nt, Homo sapiens
gaacgaagaccuccugaga

SEQ ID NO: 547161 - RNA, 19 nt, Homo sapiens
gagaaugugccauguauaa

SEQ ID NO: 547162 - RNA, 19 nt, Homo sapiens
gaaacucuuuaccucaaua

SEQ ID NO: 547163 - RNA, 19 nt, Homo sapiens
caaagaaacucuguguuau

SEQ ID NO: 547164 - RNA, 19 nt, Homo sapiens
gaagaccuccugagacuaa

SEQ ID NO: 547165 - RNA, 19 nt, Homo sapiens
caauauugguguacuguaa

SEQ ID NO: 547166 - RNA, 19 nt, Homo sapiens
gccaaugguuuaauaauga

SEQ ID NO: 547167 - RNA, 19 nt, Homo sapiens
gaagggagcaacuaaagaa

SEQ ID NO: 547168 - RNA, 19 nt, Homo sapiens
uaacugagauucgccauga

SEQ ID NO: 547169 - RNA, 19 nt, Homo sapiens
ggaagaugaugaugauguu

SEQ ID NO: 547170 - RNA, 19 nt, Homo sapiens
gaugauaguucugacaauu

SEQ ID NO: 547171 - RNA, 19 nt, Homo sapiens
gaaacucuguguuaugugu

SEQ ID NO: 547172 - RNA, 19 nt, Homo sapiens
ggacagcagugagaagauu

SEQ ID NO: 547173 - RNA, 19 nt, Homo sapiens
gaaaguugccauuauucua

SEQ ID NO: 547174 - RNA, 19 nt, Homo sapiens
ugacggauaugaugaguga

SEQ ID NO: 547175 - RNA, 19 nt, Homo sapiens
ccagacagcuuaucaacga

SEQ ID NO: 547176 - RNA, 19 nt, Homo sapiens
gaaccaaugauguggauuu

SEQ ID NO: 547177 - RNA, 19 nt, Homo sapiens
gcccagaccucgaucuaaa

SEQ ID NO: 547178 - RNA, 19 nt, Homo sapiens
uaaaggugcuggaaauaau

SEQ ID NO: 547179 - RNA, 19 nt, Homo sapiens
ugaauacacuguucuacuu

SEQ ID NO: 547180 - RNA, 19 nt, Homo sapiens
gaccaagacuggaguagga

SEQ ID NO: 547181 - RNA, 19 nt, Homo sapiens
guaaauaaucugugaguga

SEQ ID NO: 547182 - RNA, 19 nt, Homo sapiens
uaagagaccuuucuguagu

SEQ ID NO: 547183 - RNA, 19 nt, Homo sapiens
gaacuacaaggaaaugauu

SEQ ID NO: 547184 - RNA, 19 nt, Homo sapiens
agagaaugcugucaauauu

SEQ ID NO: 547185 - RNA, 19 nt, Homo sapiens
gaaugugccauguauaauu

SEQ ID NO: 547186 - RNA, 19 nt, Homo sapiens
gcugcuagaucuuuauuau

SEQ ID NO: 547187 - RNA, 19 nt, Homo sapiens
gacagcaucuauuaccuuu

SEQ ID NO: 547188 - RNA, 19 nt, Homo sapiens
uaagguaaaugcaggaaug

SEQ ID NO: 547189 - RNA, 19 nt, Homo sapiens
caacaucaacaguguaauu

SEQ ID NO: 547190 - RNA, 19 nt, Homo sapiens
caaccaacaucaacagugu

SEQ ID NO: 547191 - RNA, 19 nt, Homo sapiens
ucagacaucucgaaccaaa

SEQ ID NO: 547192 - RNA, 19 nt, Homo sapiens
ugugaaugauggccaauua

SEQ ID NO: 547193 - RNA, 19 nt, Homo sapiens
caaccagaaugcucuaguu

SEQ ID NO: 547194 - RNA, 19 nt, Homo sapiens
cagcuuuccuuucaaauau

SEQ ID NO: 547195 - RNA, 19 nt, Homo sapiens
ggauugagauguguuacuu

SEQ ID NO: 547196 - RNA, 19 nt, Homo sapiens
ccaguuguguggcuaaauu

SEQ ID NO: 547197 - RNA, 19 nt, Homo sapiens
cuaaaggagcucuaaauaa

SEQ ID NO: 547198 - RNA, 19 nt, Homo sapiens
caaacagaauccuacuaaa

SEQ ID NO: 547199 - RNA, 19 nt, Homo sapiens
gcagcuuuccuuucaaaua

SEQ ID NO: 547200 - RNA, 19 nt, Homo sapiens
caacuauuguucucagcua

SEQ ID NO: 547201 - RNA, 19 nt, Homo sapiens
gcgaaacucuuuaccucaa

SEQ ID NO: 547202 - RNA, 19 nt, Homo sapiens
gagugaaaguugccauuau

SEQ ID NO: 547203 - RNA, 19 nt, Homo sapiens
ucaauauucucucgaguug

SEQ ID NO: 547204 - RNA, 19 nt, Homo sapiens
cagaugcucuugauacaga

SEQ ID NO: 547205 - RNA, 19 nt, Homo sapiens
guaaaggugcuggaaauaa

SEQ ID NO: 547206 - RNA, 19 nt, Homo sapiens
uagaauggccaaugguuua

SEQ ID NO: 547207 - RNA, 19 nt, Homo sapiens
gauauagaauggccaaugg

SEQ ID NO: 547208 - RNA, 19 nt, Homo sapiens
gguguaagcucugugaaug

SEQ ID NO: 547209 - RNA, 19 nt, Homo sapiens
ggaugaagacacagacuaa

SEQ ID NO: 547210 - RNA, 19 nt, Homo sapiens
cgaaacaccuuggaaaaua

SEQ ID NO: 547211 - RNA, 19 nt, Homo sapiens
guuaagagaccuuucugua

SEQ ID NO: 547212 - RNA, 19 nt, Homo sapiens
ggccaaugguuuaauaaug

SEQ ID NO: 547213 - RNA, 19 nt, Homo sapiens
gaagacaaacagaauccua

SEQ ID NO: 547214 - RNA, 19 nt, Homo sapiens
gauuagaauugacugauca

SEQ ID NO: 547215 - RNA, 19 nt, Homo sapiens
aaagcaagguuucuucaga

SEQ ID NO: 547216 - RNA, 19 nt, Homo sapiens
guaagaagggagcaacuaa

SEQ ID NO: 547217 - RNA, 19 nt, Homo sapiens
ugaaggcugcaaauuauua

SEQ ID NO: 547218 - RNA, 19 nt, Homo sapiens
gaccacugcuuuaauagau

SEQ ID NO: 547219 - RNA, 19 nt, Homo sapiens
ccacaagccugcuccaaag

SEQ ID NO: 547220 - RNA, 19 nt, Homo sapiens
uugcaaaccuuuaacaaug

SEQ ID NO: 547221 - RNA, 19 nt, Homo sapiens
caacaugacaacucagaaa

SEQ ID NO: 547222 - RNA, 19 nt, Homo sapiens
aggaucagcucaccucuuu

SEQ ID NO: 547223 - RNA, 19 nt, Homo sapiens
gaucaaagaaccauaacau

SEQ ID NO: 547224 - RNA, 19 nt, Homo sapiens
gaauaugaaugagaaugug

SEQ ID NO: 547225 - RNA, 19 nt, Homo sapiens
cuacuucacuggaccgaaa

SEQ ID NO: 547226 - RNA, 19 nt, Homo sapiens
ggccaaauggagagaauua

SEQ ID NO: 547227 - RNA, 19 nt, Homo sapiens
gauacagaguugcuuacaa

SEQ ID NO: 547228 - RNA, 19 nt, Homo sapiens
uagugaaggcugcaaauua

SEQ ID NO: 547229 - RNA, 19 nt, Homo sapiens
agugguagcugaucaaaga

SEQ ID NO: 547230 - RNA, 19 nt, Homo sapiens
gcaacuugaugaagaucuu

SEQ ID NO: 547231 - RNA, 19 nt, Homo sapiens
uacaaucugugguaaacua

SEQ ID NO: 547232 - RNA, 19 nt, Homo sapiens
aagaggacauggaaacaaa

SEQ ID NO: 547233 - RNA, 19 nt, Homo sapiens
ccauguaaauaaucuguga

SEQ ID NO: 547234 - RNA, 19 nt, Homo sapiens
gaauacacuguucuacuuu

SEQ ID NO: 547235 - RNA, 19 nt, Homo sapiens
ccagaugggucaauauucu

SEQ ID NO: 547236 - RNA, 19 nt, Homo sapiens
guaaaugcauggaaacacu

SEQ ID NO: 547237 - RNA, 19 nt, Homo sapiens
caagagaaaggcuguauca

SEQ ID NO: 547238 - RNA, 19 nt, Homo sapiens
auacagaguugcuuacaau

SEQ ID NO: 547239 - RNA, 19 nt, Homo sapiens
ugauaugacucaguguaua

SEQ ID NO: 547240 - RNA, 19 nt, Homo sapiens
aaaguugugucagugaaua

SEQ ID NO: 547241 - RNA, 19 nt, Homo sapiens
gccaugaagucagcuuuaa

SEQ ID NO: 547242 - RNA, 19 nt, Homo sapiens
acaaacagaauccuacuaa

SEQ ID NO: 547243 - RNA, 19 nt, Homo sapiens
caaguuuacuccuucuguu

SEQ ID NO: 547244 - RNA, 19 nt, Homo sapiens
gaacagcccagaccucgau

SEQ ID NO: 547245 - RNA, 19 nt, Homo sapiens
gaagucacguaaagaaggu

SEQ ID NO: 547246 - RNA, 19 nt, Homo sapiens
ccacaaugccugauggaaa

SEQ ID NO: 547247 - RNA, 19 nt, Homo sapiens
caguaaaggugcuggaaau

SEQ ID NO: 547248 - RNA, 19 nt, Homo sapiens
ggcgagauaugaacuuaau

SEQ ID NO: 547249 - RNA, 19 nt, Homo sapiens
ccaaauuacuggcuuguua

SEQ ID NO: 547250 - RNA, 19 nt, Homo sapiens
gggaaaagcuucaaucaua

SEQ ID NO: 547251 - RNA, 19 nt, Homo sapiens
ugaaaguucuuaccucauu

SEQ ID NO: 547252 - RNA, 19 nt, Homo sapiens
gaaaguucuuaccucauuu

SEQ ID NO: 547253 - RNA, 19 nt, Homo sapiens
gaaaaggaacgacuaaaua

SEQ ID NO: 547254 - RNA, 19 nt, Homo sapiens
gggagaagauauuuaagug

SEQ ID NO: 547255 - RNA, 19 nt, Homo sapiens
ccugagagcuuucauaagu

SEQ ID NO: 547256 - RNA, 19 nt, Homo sapiens
ugacuugugucuauugaaa

SEQ ID NO: 547257 - RNA, 19 nt, Homo sapiens
caauaaacaugagcgaauu

SEQ ID NO: 547258 - RNA, 19 nt, Homo sapiens
guagacaucaguauuauug

SEQ ID NO: 547259 - RNA, 19 nt, Homo sapiens
aagaauaccuguuuaaguc

SEQ ID NO: 547260 - RNA, 19 nt, Homo sapiens
gagaaauagugcaaagaug

SEQ ID NO: 547261 - RNA, 19 nt, Homo sapiens
ggaaaagcuucaaucauaa

SEQ ID NO: 547262 - RNA, 19 nt, Homo sapiens
ggaauuguuuacuuuggaa

SEQ ID NO: 547263 - RNA, 19 nt, Homo sapiens
ggagucugcuuacuuggaa

SEQ ID NO: 547264 - RNA, 19 nt, Homo sapiens
ugagaaaucuguuaguuac

SEQ ID NO: 547265 - RNA, 19 nt, Homo sapiens
uggcagauuuccucuagua

SEQ ID NO: 547266 - RNA, 19 nt, Homo sapiens
cagauuuccucuaguaaga

SEQ ID NO: 547267 - RNA, 19 nt, Homo sapiens
acaaggagaugguacacuu

SEQ ID NO: 547268 - RNA, 19 nt, Homo sapiens
ucauauaacccucuaagaa

SEQ ID NO: 547269 - RNA, 19 nt, Homo sapiens
cauaaguaguucugaauuc

SEQ ID NO: 547270 - RNA, 19 nt, Homo sapiens
gagcuuggauccuacucaa

SEQ ID NO: 547271 - RNA, 19 nt, Homo sapiens
gaccuugguuauuaugaaa

SEQ ID NO: 547272 - RNA, 19 nt, Homo sapiens
guuuaagucuugaguguug

SEQ ID NO: 547273 - RNA, 19 nt, Homo sapiens
cccgaaagcagaaguaaua

SEQ ID NO: 547274 - RNA, 19 nt, Homo sapiens
caugaaggaauccauauaa

SEQ ID NO: 547275 - RNA, 19 nt, Homo sapiens
caacaacucacgucagaga

SEQ ID NO: 547276 - RNA, 19 nt, Homo sapiens
ggaaaacaguugaauguca

SEQ ID NO: 547277 - RNA, 19 nt, Homo sapiens
gaauaccuguuuaagucuu

SEQ ID NO: 547278 - RNA, 19 nt, Homo sapiens
ggucggcugucaaacugua

SEQ ID NO: 547279 - RNA, 19 nt, Homo sapiens
cauauaacccucuaagaau

SEQ ID NO: 547280 - RNA, 19 nt, Homo sapiens
aagagugacuugugucuau

SEQ ID NO: 547281 - RNA, 19 nt, Homo sapiens
gaaugauacuccucuagag

SEQ ID NO: 547282 - RNA, 19 nt, Homo sapiens
gucagacucucauuuguau

SEQ ID NO: 547283 - RNA, 19 nt, Homo sapiens
gcucaagccuucagaacag

SEQ ID NO: 547284 - RNA, 19 nt, Homo sapiens
ugaaagaaccaaauuacug

SEQ ID NO: 547285 - RNA, 19 nt, Homo sapiens
uaaaugcccaucuuagcua

SEQ ID NO: 547286 - RNA, 19 nt, Homo sapiens
gagaaaccuuauuccuguu

SEQ ID NO: 547287 - RNA, 19 nt, Homo sapiens
gagggaaccuguagaaaau

SEQ ID NO: 547288 - RNA, 19 nt, Homo sapiens
ccucuaagaauaccuguuu

SEQ ID NO: 547289 - RNA, 19 nt, Homo sapiens
ggcaaagagugacuugugu

SEQ ID NO: 547290 - RNA, 19 nt, Homo sapiens
gaggaacucucaaaauaug

SEQ ID NO: 547291 - RNA, 19 nt, Homo sapiens
caaccugagagcuuucaua

SEQ ID NO: 547292 - RNA, 19 nt, Homo sapiens
ugaaagaugugagcucaag

SEQ ID NO: 547293 - RNA, 19 nt, Homo sapiens
ggauaaaugcccaucuuag

SEQ ID NO: 547294 - RNA, 19 nt, Homo sapiens
cgucagagaaggaagauga

SEQ ID NO: 547295 - RNA, 19 nt, Homo sapiens
cagugucucuguauuugaa

SEQ ID NO: 547296 - RNA, 19 nt, Homo sapiens
gccaacagcuucugauagc

SEQ ID NO: 547297 - RNA, 19 nt, Homo sapiens
gagaaaagucuucagauga

SEQ ID NO: 547298 - RNA, 19 nt, Homo sapiens
ccaacacuuugaagaugaa

SEQ ID NO: 547299 - RNA, 19 nt, Homo sapiens
ggcuauaccucagcaucua

SEQ ID NO: 547300 - RNA, 19 nt, Homo sapiens
ugagagcuuucauaaguag

SEQ ID NO: 547301 - RNA, 19 nt, Homo sapiens
guaauacugggaacccuuu

SEQ ID NO: 547302 - RNA, 19 nt, Homo sapiens
cgaaaucggaggacaagga

SEQ ID NO: 547303 - RNA, 19 nt, Homo sapiens
ugugugagcuuggauccua

SEQ ID NO: 547304 - RNA, 19 nt, Homo sapiens
caauucauauaacccucua

SEQ ID NO: 547305 - RNA, 19 nt, Homo sapiens
caacagcuucugauagcaa

SEQ ID NO: 547306 - RNA, 19 nt, Homo sapiens
gaaggcaaagagugacuug

SEQ ID NO: 547307 - RNA, 19 nt, Homo sapiens
ucuggagucugcuuacuug

SEQ ID NO: 547308 - RNA, 19 nt, Homo sapiens
cugagagcuuucauaagua

SEQ ID NO: 547309 - RNA, 19 nt, Homo sapiens
ucaauaaacaugagcgaau

SEQ ID NO: 547310 - RNA, 19 nt, Homo sapiens
ggagaagauauuuaagugu

SEQ ID NO: 547311 - RNA, 19 nt, Homo sapiens
ggugaaagaaccaaauuac

SEQ ID NO: 547312 - RNA, 19 nt, Homo sapiens
aaccucaaauugcuagaaa

SEQ ID NO: 547313 - RNA, 19 nt, Homo sapiens
gaaugaggaguuugugcuu

SEQ ID NO: 547314 - RNA, 19 nt, Homo sapiens
ugagaaugauacuccucua

SEQ ID NO: 547315 - RNA, 19 nt, Homo sapiens
gaaaucuguuaguuaccau

SEQ ID NO: 547316 - RNA, 19 nt, Homo sapiens
agaccuugguuauuaugaa

SEQ ID NO: 547317 - RNA, 19 nt, Homo sapiens
cccaacacuuugaagauga

SEQ ID NO: 547318 - RNA, 19 nt, Homo sapiens
cccaaagaaugaggaguuu

SEQ ID NO: 547319 - RNA, 19 nt, Homo sapiens
ccauauaagggagaagaua

SEQ ID NO: 547320 - RNA, 19 nt, Homo sapiens
uuauugcccuuacucgaaa

SEQ ID NO: 547321 - RNA, 19 nt, Homo sapiens
ggaaaaggaacgacuaaau

SEQ ID NO: 547322 - RNA, 19 nt, Homo sapiens
ugucagacucucauuugua

SEQ ID NO: 547323 - RNA, 19 nt, Homo sapiens
gcagauuuccucuaguaag

SEQ ID NO: 547324 - RNA, 19 nt, Homo sapiens
gcacuuccucaccuucuug

SEQ ID NO: 547325 - RNA, 19 nt, Homo sapiens
ugagaaauagugcaaagau

SEQ ID NO: 547326 - RNA, 19 nt, Homo sapiens
aaaugcccaucuuagcuaa

SEQ ID NO: 547327 - RNA, 19 nt, Homo sapiens
gauaaaugcccaucuuagc

SEQ ID NO: 547328 - RNA, 19 nt, Homo sapiens
ucaugaaggaauccauaua

SEQ ID NO: 547329 - RNA, 19 nt, Homo sapiens
ugagagggaaccuguagaa

SEQ ID NO: 547330 - RNA, 19 nt, Homo sapiens
cucaacaacucacgucaga

SEQ ID NO: 547331 - RNA, 19 nt, Homo sapiens
cugaggagcugguggucuu

SEQ ID NO: 547332 - RNA, 19 nt, Homo sapiens
gaauauaggaaaacaguug

SEQ ID NO: 547333 - RNA, 19 nt, Homo sapiens
cuucugauagcaauucaua

SEQ ID NO: 547334 - RNA, 19 nt, Homo sapiens
caugauggcugcaaaagug

SEQ ID NO: 547335 - RNA, 19 nt, Homo sapiens
caggagagaaaccuuauuc

SEQ ID NO: 547336 - RNA, 19 nt, Homo sapiens
auacaggagagaaaccuua

SEQ ID NO: 547337 - RNA, 19 nt, Homo sapiens
gauagcaauucauauaacc

SEQ ID NO: 547338 - RNA, 19 nt, Homo sapiens
uggauaaaugcccaucuua

SEQ ID NO: 547339 - RNA, 19 nt, Homo sapiens
aaccugagagcuuucauaa

SEQ ID NO: 547340 - RNA, 19 nt, Homo sapiens
guaagacccgaaagcagaa

SEQ ID NO: 547341 - RNA, 19 nt, Homo sapiens
cgacuaaauacauccauuc

SEQ ID NO: 547342 - RNA, 19 nt, Homo sapiens
gagagggaaccuguagaaa

SEQ ID NO: 547343 - RNA, 19 nt, Homo sapiens
gaaggugaagauccugaga

SEQ ID NO: 547344 - RNA, 19 nt, Homo sapiens
caagaccuacuucgagaug

SEQ ID NO: 547345 - RNA, 19 nt, Homo sapiens
ccaaaggaguccaaaagga

SEQ ID NO: 547346 - RNA, 19 nt, Homo sapiens
caagcugggccaagaccua

SEQ ID NO: 547347 - RNA, 19 nt, Homo sapiens
caaauuacuggcuuguuag

SEQ ID NO: 547348 - RNA, 19 nt, Homo sapiens
gaauccauauaagggagaa

SEQ ID NO: 547349 - RNA, 19 nt, Homo sapiens
ggaaagagcuucacuugua

SEQ ID NO: 547350 - RNA, 19 nt, Homo sapiens
gaaagaagauuugguacua

SEQ ID NO: 547351 - RNA, 19 nt, Homo sapiens
guaaauggcuuucauguau

SEQ ID NO: 547352 - RNA, 19 nt, Homo sapiens
gaugagaucucccagguua

SEQ ID NO: 547353 - RNA, 19 nt, Homo sapiens
gaacgcgccuuacaaauau

SEQ ID NO: 547354 - RNA, 19 nt, Homo sapiens
gaagaagacuguggaauug

SEQ ID NO: 547355 - RNA, 19 nt, Homo sapiens
gaaagagcuucacuuguaa

SEQ ID NO: 547356 - RNA, 19 nt, Homo sapiens
gagaaacccuauaaaugua

SEQ ID NO: 547357 - RNA, 19 nt, Homo sapiens
agaugaggcugaauaauua

SEQ ID NO: 547358 - RNA, 19 nt, Homo sapiens
gaagacaacuggagaacga

SEQ ID NO: 547359 - RNA, 19 nt, Homo sapiens
gaagauacuguccuaauaa

SEQ ID NO: 547360 - RNA, 19 nt, Homo sapiens
gcucagacuuaaccauuua

SEQ ID NO: 547361 - RNA, 19 nt, Homo sapiens
caaaggcacuauaacaauu

SEQ ID NO: 547362 - RNA, 19 nt, Homo sapiens
acacgaagcucacaucuug

SEQ ID NO: 547363 - RNA, 19 nt, Homo sapiens
ggaagaagacuguggaauu

SEQ ID NO: 547364 - RNA, 19 nt, Homo sapiens
gagaugaggcugaauaauu

SEQ ID NO: 547365 - RNA, 19 nt, Homo sapiens
cagaggauaucacuuaauu

SEQ ID NO: 547366 - RNA, 19 nt, Homo sapiens
gaaaguagcaucucaugau

SEQ ID NO: 547367 - RNA, 19 nt, Homo sapiens
caucaucccugacugagua

SEQ ID NO: 547368 - RNA, 19 nt, Homo sapiens
ggacgagccugaaggauuc

SEQ ID NO: 547369 - RNA, 19 nt, Homo sapiens
gagagaaacccuauaaaug

SEQ ID NO: 547370 - RNA, 19 nt, Homo sapiens
agaagauacuguccuaaua

SEQ ID NO: 547371 - RNA, 19 nt, Homo sapiens
ucagaagccucuuuccaua

SEQ ID NO: 547372 - RNA, 19 nt, Homo sapiens
gaucugacauuaccucuuc

SEQ ID NO: 547373 - RNA, 19 nt, Homo sapiens
ggagaaacccuauagaugu

SEQ ID NO: 547374 - RNA, 19 nt, Homo sapiens
cagcagaggauaucacuua

SEQ ID NO: 547375 - RNA, 19 nt, Homo sapiens
gaagagaccuccccuguga

SEQ ID NO: 547376 - RNA, 19 nt, Homo sapiens
caagugagaugguaguguu

SEQ ID NO: 547377 - RNA, 19 nt, Homo sapiens
gaucugaguuuggaggaua

SEQ ID NO: 547378 - RNA, 19 nt, Homo sapiens
ggagagaaacccuauaaau

SEQ ID NO: 547379 - RNA, 19 nt, Homo sapiens
gaacgacuaagaccaaauu

SEQ ID NO: 547380 - RNA, 19 nt, Homo sapiens
gcaagaccaucaagacugu

SEQ ID NO: 547381 - RNA, 19 nt, Homo sapiens
gcaggaagaucugaguuug

SEQ ID NO: 547382 - RNA, 19 nt, Homo sapiens
uuuggaaacugucaacuua

SEQ ID NO: 547383 - RNA, 19 nt, Homo sapiens
gagaaacccuauagaugug

SEQ ID NO: 547384 - RNA, 19 nt, Homo sapiens
ugaacgcgccuuacaaaua

SEQ ID NO: 547385 - RNA, 19 nt, Homo sapiens
caaaguacaaccugaauug

SEQ ID NO: 547386 - RNA, 19 nt, Homo sapiens
caucaugacuguucugugu

SEQ ID NO: 547387 - RNA, 19 nt, Homo sapiens
ggagauaggaguaaagaug

SEQ ID NO: 547388 - RNA, 19 nt, Homo sapiens
gaggagcucuggagacuca

SEQ ID NO: 547389 - RNA, 19 nt, Homo sapiens
uaaaguaggagaacuaaga

SEQ ID NO: 547390 - RNA, 19 nt, Homo sapiens
caaucucuguugccaguua

SEQ ID NO: 547391 - RNA, 19 nt, Homo sapiens
caggauaacugcauagauc

SEQ ID NO: 547392 - RNA, 19 nt, Homo sapiens
ccugaaggauucugucuuu

SEQ ID NO: 547393 - RNA, 19 nt, Homo sapiens
ucauagagcuagaaaguag

SEQ ID NO: 547394 - RNA, 19 nt, Homo sapiens
cgacuaagaccaaauuaug

SEQ ID NO: 547395 - RNA, 19 nt, Homo sapiens
gcacacaguucuggacuca

SEQ ID NO: 547396 - RNA, 19 nt, Homo sapiens
gaugaacgcgccuuacaaa

SEQ ID NO: 547397 - RNA, 19 nt, Homo sapiens
ccagguagacuuaaugaaa

SEQ ID NO: 547398 - RNA, 19 nt, Homo sapiens
ggacugguuuggucuuaau

SEQ ID NO: 547399 - RNA, 19 nt, Homo sapiens
caucaagacuguucugaca

SEQ ID NO: 547400 - RNA, 19 nt, Homo sapiens
gaggauaucacuuaauuag

SEQ ID NO: 547401 - RNA, 19 nt, Homo sapiens
gacaauccagguagacuua

SEQ ID NO: 547402 - RNA, 19 nt, Homo sapiens
gaaacugucaacuuacaaa

SEQ ID NO: 547403 - RNA, 19 nt, Homo sapiens
agagaaacccuauaaaugu

SEQ ID NO: 547404 - RNA, 19 nt, Homo sapiens
gagauaggaguaaagauga

SEQ ID NO: 547405 - RNA, 19 nt, Homo sapiens
ccagaaauccugaguuuua

SEQ ID NO: 547406 - RNA, 19 nt, Homo sapiens
ucucaaggcugcuucaugu

SEQ ID NO: 547407 - RNA, 19 nt, Homo sapiens
gaaggauucugucuuuacu

SEQ ID NO: 547408 - RNA, 19 nt, Homo sapiens
cagaggagacggugcauuu

SEQ ID NO: 547409 - RNA, 19 nt, Homo sapiens
cguccuaccuggagaacua

SEQ ID NO: 547410 - RNA, 19 nt, Homo sapiens
caacagggaaauucucauu

SEQ ID NO: 547411 - RNA, 19 nt, Homo sapiens
ggagaacgacuaagaccaa

SEQ ID NO: 547412 - RNA, 19 nt, Homo sapiens
gagccugagucaccuaaug

SEQ ID NO: 547413 - RNA, 19 nt, Homo sapiens
gccaugggccacuuuauuu

SEQ ID NO: 547414 - RNA, 19 nt, Homo sapiens
uaacaacacaccaaagaau

SEQ ID NO: 547415 - RNA, 19 nt, Homo sapiens
gaauucaccaggaguaaau

SEQ ID NO: 547416 - RNA, 19 nt, Homo sapiens
gccaaacacugcuagaaag

SEQ ID NO: 547417 - RNA, 19 nt, Homo sapiens
gaggacacauacuggagaa

SEQ ID NO: 547418 - RNA, 19 nt, Homo sapiens
gagaugguugcucuucuua

SEQ ID NO: 547419 - RNA, 19 nt, Homo sapiens
ugaaaugucugccacaaaa

SEQ ID NO: 547420 - RNA, 19 nt, Homo sapiens
gcaggcauuucuaaaccaa

SEQ ID NO: 547421 - RNA, 19 nt, Homo sapiens
aagcauaauucggucauaa

SEQ ID NO: 547422 - RNA, 19 nt, Homo sapiens
gguaguguuugagugcuua

SEQ ID NO: 547423 - RNA, 19 nt, Homo sapiens
guauaaaguaggagaacua

SEQ ID NO: 547424 - RNA, 19 nt, Homo sapiens
gaaacccuauaaauguaug

SEQ ID NO: 547425 - RNA, 19 nt, Homo sapiens
cagccaaguucccugguuu

SEQ ID NO: 547426 - RNA, 19 nt, Homo sapiens
gagaacgacuaagaccaaa

SEQ ID NO: 547427 - RNA, 19 nt, Homo sapiens
caggagagaaacccuauaa

SEQ ID NO: 547428 - RNA, 19 nt, Homo sapiens
gaguaaagaugaggaagag

SEQ ID NO: 547429 - RNA, 19 nt, Homo sapiens
ggaguaaagaugaggaaga

SEQ ID NO: 547430 - RNA, 19 nt, Homo sapiens
agccagaaauccugaguuu

SEQ ID NO: 547431 - RNA, 19 nt, Homo sapiens
gcagcaagcccuagagaag

SEQ ID NO: 547432 - RNA, 19 nt, Homo sapiens
uuugagugcuuauugagua

SEQ ID NO: 547433 - RNA, 19 nt, Homo sapiens
gggacgagccugaaggauu

SEQ ID NO: 547434 - RNA, 19 nt, Homo sapiens
agaagacuguggaauuguu

SEQ ID NO: 547435 - RNA, 19 nt, Homo sapiens
uggagaauaugucuuggaa

SEQ ID NO: 547436 - RNA, 19 nt, Homo sapiens
ucuccuagcucagacuuaa

SEQ ID NO: 547437 - RNA, 19 nt, Homo sapiens
gcagccaaguucccugguu

SEQ ID NO: 547438 - RNA, 19 nt, Homo sapiens
gagacguccuccauaagug

SEQ ID NO: 547439 - RNA, 19 nt, Homo sapiens
ccaugggccacuuuauuua

SEQ ID NO: 547440 - RNA, 19 nt, Homo sapiens
uuacuggggucaaaucuua

SEQ ID NO: 547441 - RNA, 19 nt, Homo sapiens
gcuguuacauauccuaaag

SEQ ID NO: 547442 - RNA, 19 nt, Homo sapiens
guuaacaacacaccaaaga

SEQ ID NO: 547443 - RNA, 19 nt, Homo sapiens
gcauaauucggucauaaug

SEQ ID NO: 547444 - RNA, 19 nt, Homo sapiens
uggugaaacuggaagauga

SEQ ID NO: 547445 - RNA, 19 nt, Homo sapiens
aaagacugcucaacagcuu

SEQ ID NO: 547446 - RNA, 19 nt, Homo sapiens
ccucauggguauaaaguag

SEQ ID NO: 547447 - RNA, 19 nt, Homo sapiens
gugaggagaucugcuuuca

SEQ ID NO: 547448 - RNA, 19 nt, Homo sapiens
gacgcacgcugcugaggaa

SEQ ID NO: 547449 - RNA, 19 nt, Homo sapiens
caacucagcuguucuuucu

SEQ ID NO: 547450 - RNA, 19 nt, Homo sapiens
ucacugggcuuucccuuca

SEQ ID NO: 547451 - RNA, 19 nt, Homo sapiens
gggauguccugcagaagaa

SEQ ID NO: 547452 - RNA, 19 nt, Homo sapiens
aggagucacugcacauuaa

SEQ ID NO: 547453 - RNA, 19 nt, Homo sapiens
uaaaggccuuggacuugaa

SEQ ID NO: 547454 - RNA, 19 nt, Homo sapiens
ucgaggauguggccuugua

SEQ ID NO: 547455 - RNA, 19 nt, Homo sapiens
uuaaaggccuuggacuuga

SEQ ID NO: 547456 - RNA, 19 nt, Homo sapiens
ucacggcucuaaggagaaa

SEQ ID NO: 547457 - RNA, 19 nt, Homo sapiens
gccagugacuuucgaggau

SEQ ID NO: 547458 - RNA, 19 nt, Homo sapiens
caggagucacugcacauua

SEQ ID NO: 547459 - RNA, 19 nt, Homo sapiens
caggcacucugcgaauuaa

SEQ ID NO: 547460 - RNA, 19 nt, Homo sapiens
gcacaaccgcacacacaca

SEQ ID NO: 547461 - RNA, 19 nt, Homo sapiens
gcgcacaaccgcacacaca

SEQ ID NO: 547462 - RNA, 19 nt, Homo sapiens
gaccagagaccggcagaug

SEQ ID NO: 547463 - RNA, 19 nt, Homo sapiens
gcucugaaauagaaaaugu

SEQ ID NO: 547464 - RNA, 19 nt, Homo sapiens
acagugaggugggcaggaa

SEQ ID NO: 547465 - RNA, 19 nt, Homo sapiens
aucaggaaaugccuucuaa

SEQ ID NO: 547466 - RNA, 19 nt, Homo sapiens
uggcagcccuugggaaugu

SEQ ID NO: 547467 - RNA, 19 nt, Homo sapiens
acucagcuguucuuucuag

SEQ ID NO: 547468 - RNA, 19 nt, Homo sapiens
caucaggaaaugccuucua

SEQ ID NO: 547469 - RNA, 19 nt, Homo sapiens
gcacacacacaggcgagaa

SEQ ID NO: 547470 - RNA, 19 nt, Homo sapiens
gaucguggacauccucauc

SEQ ID NO: 547471 - RNA, 19 nt, Homo sapiens
ccaccuaggaggccaggaa

SEQ ID NO: 547472 - RNA, 19 nt, Homo sapiens
gcaggcaggagaugagaag

SEQ ID NO: 547473 - RNA, 19 nt, Homo sapiens
uaagauggagcccgaagag

SEQ ID NO: 547474 - RNA, 19 nt, Homo sapiens
uaagucacggcucuaagga

SEQ ID NO: 547475 - RNA, 19 nt, Homo sapiens
aauuaaaggccuuggacuu

SEQ ID NO: 547476 - RNA, 19 nt, Homo sapiens
gcacucugcgaauuaaagg

SEQ ID NO: 547477 - RNA, 19 nt, Homo sapiens
gaacuucuacagggauguc

SEQ ID NO: 547478 - RNA, 19 nt, Homo sapiens
caggaaaugccuucuaagc

SEQ ID NO: 547479 - RNA, 19 nt, Homo sapiens
ggaaauauaugguauggaa

SEQ ID NO: 547480 - RNA, 19 nt, Homo sapiens
gaacauaccacccuaguaa

SEQ ID NO: 547481 - RNA, 19 nt, Homo sapiens
ggaaugagaccuccuguaa

SEQ ID NO: 547482 - RNA, 19 nt, Homo sapiens
gaacagacauagaguugga

SEQ ID NO: 547483 - RNA, 19 nt, Homo sapiens
ccauauaugucacaagaaa

SEQ ID NO: 547484 - RNA, 19 nt, Homo sapiens
ggcaaguucuguaagcuua

SEQ ID NO: 547485 - RNA, 19 nt, Homo sapiens
aacauuaucuucccacaua

SEQ ID NO: 547486 - RNA, 19 nt, Homo sapiens
ggaccuggcuuagcuauuc

SEQ ID NO: 547487 - RNA, 19 nt, Homo sapiens
gcaacaagaugauucugau

SEQ ID NO: 547488 - RNA, 19 nt, Homo sapiens
gcagguacauaaagaaaca

SEQ ID NO: 547489 - RNA, 19 nt, Homo sapiens
ggugagggcuguaacuguu

SEQ ID NO: 547490 - RNA, 19 nt, Homo sapiens
caacuugugcuguuuauau

SEQ ID NO: 547491 - RNA, 19 nt, Homo sapiens
aaugagaccuccuguaaug

SEQ ID NO: 547492 - RNA, 19 nt, Homo sapiens
aggcauaccuccauuaaug

SEQ ID NO: 547493 - RNA, 19 nt, Homo sapiens
gcaugcagguacauaaaga

SEQ ID NO: 547494 - RNA, 19 nt, Homo sapiens
uuacugaucuuacuucauc

SEQ ID NO: 547495 - RNA, 19 nt, Homo sapiens
caacaacuaguacaacaaa

SEQ ID NO: 547496 - RNA, 19 nt, Homo sapiens
gaugaaagacgacgacuuc

SEQ ID NO: 547497 - RNA, 19 nt, Homo sapiens
agacauagaguuggaaaua

SEQ ID NO: 547498 - RNA, 19 nt, Homo sapiens
guaaaggcaaguucuguaa

SEQ ID NO: 547499 - RNA, 19 nt, Homo sapiens
ugaaggcgcuggaauuaca

SEQ ID NO: 547500 - RNA, 19 nt, Homo sapiens
uaaaccagcggcuucaaua

SEQ ID NO: 547501 - RNA, 19 nt, Homo sapiens
gaaagucugucugcaucuu

SEQ ID NO: 547502 - RNA, 19 nt, Homo sapiens
ccaggaaugccaccaguua

SEQ ID NO: 547503 - RNA, 19 nt, Homo sapiens
ucuaauagguuuggagauu

SEQ ID NO: 547504 - RNA, 19 nt, Homo sapiens
gaacgaggccgucgcaucu

SEQ ID NO: 547505 - RNA, 19 nt, Homo sapiens
caaauaguacugcagcuaa

SEQ ID NO: 547506 - RNA, 19 nt, Homo sapiens
aagcuuacauugcuauuug

SEQ ID NO: 547507 - RNA, 19 nt, Homo sapiens
gccaauggguggaaugaug

SEQ ID NO: 547508 - RNA, 19 nt, Homo sapiens
gaagaacagacauagaguu

SEQ ID NO: 547509 - RNA, 19 nt, Homo sapiens
ucaggcagcuguccaagga

SEQ ID NO: 547510 - RNA, 19 nt, Homo sapiens
uagccaagcuuccgucaau

SEQ ID NO: 547511 - RNA, 19 nt, Homo sapiens
gaacagaaaacacaagaaa

SEQ ID NO: 547512 - RNA, 19 nt, Homo sapiens
gacauagaguuggaaauau

SEQ ID NO: 547513 - RNA, 19 nt, Homo sapiens
gaugagaagauccuuauuc

SEQ ID NO: 547514 - RNA, 19 nt, Homo sapiens
acagaugcaugccacagua

SEQ ID NO: 547515 - RNA, 19 nt, Homo sapiens
ugaaagguuuguacagaug

SEQ ID NO: 547516 - RNA, 19 nt, Homo sapiens
ggaauuacaugaacauacc

SEQ ID NO: 547517 - RNA, 19 nt, Homo sapiens
uuccugaaguugcaauuua

SEQ ID NO: 547518 - RNA, 19 nt, Homo sapiens
caacuagugcaaccaguaa

SEQ ID NO: 547519 - RNA, 19 nt, Homo sapiens
ugacuuuucuguacuguua

SEQ ID NO: 547520 - RNA, 19 nt, Homo sapiens
gcaagguggccguuacuga

SEQ ID NO: 547521 - RNA, 19 nt, Homo sapiens
cauccagucuaauagguuu

SEQ ID NO: 547522 - RNA, 19 nt, Homo sapiens
agagagaagggcacaguua

SEQ ID NO: 547523 - RNA, 19 nt, Homo sapiens
aaauaguacugcagcuaaa

SEQ ID NO: 547524 - RNA, 19 nt, Homo sapiens
acaagaugauucugaugaa

SEQ ID NO: 547525 - RNA, 19 nt, Homo sapiens
caauagaugccguaccaaa

SEQ ID NO: 547526 - RNA, 19 nt, Homo sapiens
caaguaagccugcuacacu

SEQ ID NO: 547527 - RNA, 19 nt, Homo sapiens
cggcuucaauaacaaguaa

SEQ ID NO: 547528 - RNA, 19 nt, Homo sapiens
ccugaaagguuuguacaga

SEQ ID NO: 547529 - RNA, 19 nt, Homo sapiens
caacuaguacaacaaauag

SEQ ID NO: 547530 - RNA, 19 nt, Homo sapiens
gaugaugagaagauccuua

SEQ ID NO: 547531 - RNA, 19 nt, Homo sapiens
ugccauauaugucacaaga

SEQ ID NO: 547532 - RNA, 19 nt, Homo sapiens
gaaguugcaauuuauacug

SEQ ID NO: 547533 - RNA, 19 nt, Homo sapiens
gaaugagaccuccuguaau

SEQ ID NO: 547534 - RNA, 19 nt, Homo sapiens
uauaugguauggaagguau

SEQ ID NO: 547535 - RNA, 19 nt, Homo sapiens
ugcaauaccuggaagaaca

SEQ ID NO: 547536 - RNA, 19 nt, Homo sapiens
ccaggaauaccaccucuga

SEQ ID NO: 547537 - RNA, 19 nt, Homo sapiens
gacgacgacuucuugaaca

SEQ ID NO: 547538 - RNA, 19 nt, Homo sapiens
gccaagcuuccgucaauaa

SEQ ID NO: 547539 - RNA, 19 nt, Homo sapiens
gaagagagaagggcacagu

SEQ ID NO: 547540 - RNA, 19 nt, Homo sapiens
cauaguuaccaaugcaaua

SEQ ID NO: 547541 - RNA, 19 nt, Homo sapiens
ccaggcauaccuccauuaa

SEQ ID NO: 547542 - RNA, 19 nt, Homo sapiens
guauuuagaguuccucaug

SEQ ID NO: 547543 - RNA, 19 nt, Homo sapiens
cuguaacuguuuccaagua

SEQ ID NO: 547544 - RNA, 19 nt, Homo sapiens
ugugaaggcgcuggaauua

SEQ ID NO: 547545 - RNA, 19 nt, Homo sapiens
ccaaaugcaauaccuggaa

SEQ ID NO: 547546 - RNA, 19 nt, Homo sapiens
augagaagauccuuauuca

SEQ ID NO: 547547 - RNA, 19 nt, Homo sapiens
guacagcuucauccaauuc

SEQ ID NO: 547548 - RNA, 19 nt, Homo sapiens
aaguacagcuucauccaau

SEQ ID NO: 547549 - RNA, 19 nt, Homo sapiens
aacaauagaugccguacca

SEQ ID NO: 547550 - RNA, 19 nt, Homo sapiens
caagguggccguuacugau

SEQ ID NO: 547551 - RNA, 19 nt, Homo sapiens
aaaccagcggcuucaauaa

SEQ ID NO: 547552 - RNA, 19 nt, Homo sapiens
uacauucccugcuuauaca

SEQ ID NO: 547553 - RNA, 19 nt, Homo sapiens
ggaagaacagacauagagu

SEQ ID NO: 547554 - RNA, 19 nt, Homo sapiens
uggcuuagcuauucauugc

SEQ ID NO: 547555 - RNA, 19 nt, Homo sapiens
gcgcuggaauuacaugaac

SEQ ID NO: 547556 - RNA, 19 nt, Homo sapiens
caugccaccuggaaugaug

SEQ ID NO: 547557 - RNA, 19 nt, Homo sapiens
gaagcaacaagaugauucu

SEQ ID NO: 547558 - RNA, 19 nt, Homo sapiens
gaccacugccugaaagguu

SEQ ID NO: 547559 - RNA, 19 nt, Homo sapiens
guugcaggguuuaagaaau

SEQ ID NO: 547560 - RNA, 19 nt, Homo sapiens
guaugguggucaucaucaa

SEQ ID NO: 547561 - RNA, 19 nt, Homo sapiens
ccacagcaacaaggaauga

SEQ ID NO: 547562 - RNA, 19 nt, Homo sapiens
ggaccaauuggagguauga

SEQ ID NO: 547563 - RNA, 19 nt, Homo sapiens
gucacaagcucaaguacag

SEQ ID NO: 547564 - RNA, 19 nt, Homo sapiens
gaauuccuccaaugacuca

SEQ ID NO: 547565 - RNA, 19 nt, Homo sapiens
gaguuggaaauauauggua

SEQ ID NO: 547566 - RNA, 19 nt, Homo sapiens
ccguggugcugguauugua

SEQ ID NO: 547567 - RNA, 19 nt, Homo sapiens
cauuucagaugcuguugga

SEQ ID NO: 547568 - RNA, 19 nt, Homo sapiens
gauuaaaccuuuucucaac

SEQ ID NO: 547569 - RNA, 19 nt, Homo sapiens
gggaaugagaccuccugua

SEQ ID NO: 547570 - RNA, 19 nt, Homo sapiens
caucgguaauccaccaguu

SEQ ID NO: 547571 - RNA, 19 nt, Homo sapiens
caaguacagcuucauccaa

SEQ ID NO: 547572 - RNA, 19 nt, Homo sapiens
aagguuauauuccuccaau

SEQ ID NO: 547573 - RNA, 19 nt, Homo sapiens
aagaacagacauagaguug

SEQ ID NO: 547574 - RNA, 19 nt, Homo sapiens
uugcaggguuuaagaaauc

SEQ ID NO: 547575 - RNA, 19 nt, Homo sapiens
caucaaggcaugccaggau

SEQ ID NO: 547576 - RNA, 19 nt, Homo sapiens
gagagaagggcacaguuac

SEQ ID NO: 547577 - RNA, 19 nt, Homo sapiens
acgaggccgucgcaucuuu

SEQ ID NO: 547578 - RNA, 19 nt, Homo sapiens
cuacauucccugcuuauac

SEQ ID NO: 547579 - RNA, 19 nt, Homo sapiens
caacaaaugugaagaaugu

SEQ ID NO: 547580 - RNA, 19 nt, Homo sapiens
ccucaacccuuacuuauua

SEQ ID NO: 547581 - RNA, 19 nt, Homo sapiens
gaaaugugauguuagagaa

SEQ ID NO: 547582 - RNA, 19 nt, Homo sapiens
gaucugcaauccuuauuaa

SEQ ID NO: 547583 - RNA, 19 nt, Homo sapiens
ggagagaaauccuacaaau

SEQ ID NO: 547584 - RNA, 19 nt, Homo sapiens
gagagaagcccuacaaaug

SEQ ID NO: 547585 - RNA, 19 nt, Homo sapiens
gagagaagcccuacaaaug

SEQ ID NO: 547586 - RNA, 19 nt, Homo sapiens
gagagaagcccuacaaaug

SEQ ID NO: 547587 - RNA, 19 nt, Homo sapiens
gagagaagcccuacaaaug

SEQ ID NO: 547588 - RNA, 19 nt, Homo sapiens
cuacaaaugugaagaaugu

SEQ ID NO: 547589 - RNA, 19 nt, Homo sapiens
cuacaaaugugaagaaugu

SEQ ID NO: 547590 - RNA, 19 nt, Homo sapiens
cuacaaaugugaagaaugu

SEQ ID NO: 547591 - RNA, 19 nt, Homo sapiens
cuacaaaugugaagaaugu

SEQ ID NO: 547592 - RNA, 19 nt, Homo sapiens
cuacaaaugugaagaaugu

SEQ ID NO: 547593 - RNA, 19 nt, Homo sapiens
cuacaaaugugaagaaugu

SEQ ID NO: 547594 - RNA, 19 nt, Homo sapiens
cuacaaaugugaagaaugu

SEQ ID NO: 547595 - RNA, 19 nt, Homo sapiens
cuacaaaugugaagaaugu

SEQ ID NO: 547596 - RNA, 19 nt, Homo sapiens
cuacaaaugugaagaaugu

SEQ ID NO: 547597 - RNA, 19 nt, Homo sapiens
cuacaaaugugaagaaugu

SEQ ID NO: 547598 - RNA, 19 nt, Homo sapiens
cuacaaaugugaagaaugu

SEQ ID NO: 547599 - RNA, 19 nt, Homo sapiens
cuacaaaugugaagaaugu

SEQ ID NO: 547600 - RNA, 19 nt, Homo sapiens
cuacaaaugugaagaaugu

SEQ ID NO: 547601 - RNA, 19 nt, Homo sapiens
cuacaaaugugaagaaugu

SEQ ID NO: 547602 - RNA, 19 nt, Homo sapiens
cuacaaaugugaagaaugu

SEQ ID NO: 547603 - RNA, 19 nt, Homo sapiens
cuacaaaugugaagaaugu

SEQ ID NO: 547604 - RNA, 19 nt, Homo sapiens
cuacaaaugugaagaaugu

SEQ ID NO: 547605 - RNA, 19 nt, Homo sapiens
cuacaaaugugaagaaugu

SEQ ID NO: 547606 - RNA, 19 nt, Homo sapiens
cuacaaaugugaagaaugu

SEQ ID NO: 547607 - RNA, 19 nt, Homo sapiens
cuacaaaugugaagaaugu

SEQ ID NO: 547608 - RNA, 19 nt, Homo sapiens
cuacaaaugugaagaaugu

SEQ ID NO: 547609 - RNA, 19 nt, Homo sapiens
cuacaaaugugaagaaugu

SEQ ID NO: 547610 - RNA, 19 nt, Homo sapiens
cuacaaaugugaagaaugu

SEQ ID NO: 547611 - RNA, 19 nt, Homo sapiens
cuacaaaugugaagaaugu

SEQ ID NO: 547612 - RNA, 19 nt, Homo sapiens
gcacaaagaagguuauaau

SEQ ID NO: 547613 - RNA, 19 nt, Homo sapiens
gaacauaaggcaacucaug

SEQ ID NO: 547614 - RNA, 19 nt, Homo sapiens
gaacauaaggcaacucaug

SEQ ID NO: 547615 - RNA, 19 nt, Homo sapiens
caucaaaccuuauggaaca

SEQ ID NO: 547616 - RNA, 19 nt, Homo sapiens
ccaguuauauguucucauu

SEQ ID NO: 547617 - RNA, 19 nt, Homo sapiens
gagagaaacccuacaaaug

SEQ ID NO: 547618 - RNA, 19 nt, Homo sapiens
gagagaaacccuacaaaug

SEQ ID NO: 547619 - RNA, 19 nt, Homo sapiens
gagagaaacccuacaaaug

SEQ ID NO: 547620 - RNA, 19 nt, Homo sapiens
gagagaaacccuacaaaug

SEQ ID NO: 547621 - RNA, 19 nt, Homo sapiens
gagagaaacccuacaaaug

SEQ ID NO: 547622 - RNA, 19 nt, Homo sapiens
gagagaaacccuacaaaug

SEQ ID NO: 547623 - RNA, 19 nt, Homo sapiens
gagagaaacccuacaaaug

SEQ ID NO: 547624 - RNA, 19 nt, Homo sapiens
gagagaaacccuacaaaug

SEQ ID NO: 547625 - RNA, 19 nt, Homo sapiens
gagagaaacccuacaaaug

SEQ ID NO: 547626 - RNA, 19 nt, Homo sapiens
gagagaaacccuacaaaug

SEQ ID NO: 547627 - RNA, 19 nt, Homo sapiens
gagagaaacccuacaaaug

SEQ ID NO: 547628 - RNA, 19 nt, Homo sapiens
gagagaaacccuacaaaug

SEQ ID NO: 547629 - RNA, 19 nt, Homo sapiens
gagagaaacccuacaaaug

SEQ ID NO: 547630 - RNA, 19 nt, Homo sapiens
gagagaaacccuacaaaug

SEQ ID NO: 547631 - RNA, 19 nt, Homo sapiens
gacaugagaugguggaaga

SEQ ID NO: 547632 - RNA, 19 nt, Homo sapiens
ucacaccuaucucaacaua

SEQ ID NO: 547633 - RNA, 19 nt, Homo sapiens
aaagaguccuggaauauga

SEQ ID NO: 547634 - RNA, 19 nt, Homo sapiens
gagaaacucuacaaaugug

SEQ ID NO: 547635 - RNA, 19 nt, Homo sapiens
gagaggaacccuacaaaug

SEQ ID NO: 547636 - RNA, 19 nt, Homo sapiens
ggaaaagaguccuggaaua

SEQ ID NO: 547637 - RNA, 19 nt, Homo sapiens
uaaccaaucugcaauucuu

SEQ ID NO: 547638 - RNA, 19 nt, Homo sapiens
acaccuaucucaacauaaa

SEQ ID NO: 547639 - RNA, 19 nt, Homo sapiens
uaaccaaucugcaauccuu

SEQ ID NO: 547640 - RNA, 19 nt, Homo sapiens
gagaaacccuacaaaugug

SEQ ID NO: 547641 - RNA, 19 nt, Homo sapiens
gagaaacccuacaaaugug

SEQ ID NO: 547642 - RNA, 19 nt, Homo sapiens
gagaaacccuacaaaugug

SEQ ID NO: 547643 - RNA, 19 nt, Homo sapiens
gagaaacccuacaaaugug

SEQ ID NO: 547644 - RNA, 19 nt, Homo sapiens
gagaaacccuacaaaugug

SEQ ID NO: 547645 - RNA, 19 nt, Homo sapiens
gcacagcagaauuuauaua

SEQ ID NO: 547646 - RNA, 19 nt, Homo sapiens
gagaaacccuacaaaugug

SEQ ID NO: 547647 - RNA, 19 nt, Homo sapiens
cuacaaaugugaagcaugu

SEQ ID NO: 547648 - RNA, 19 nt, Homo sapiens
gagaaacccuacaaaugug

SEQ ID NO: 547649 - RNA, 19 nt, Homo sapiens
gagaaacccuacaaaugug

SEQ ID NO: 547650 - RNA, 19 nt, Homo sapiens
gagaaacccuacaaaugug

SEQ ID NO: 547651 - RNA, 19 nt, Homo sapiens
gagaaacccuacaaaugug

SEQ ID NO: 547652 - RNA, 19 nt, Homo sapiens
gagaaacccuacaaaugug

SEQ ID NO: 547653 - RNA, 19 nt, Homo sapiens
gagaaacccuacaaaugug

SEQ ID NO: 547654 - RNA, 19 nt, Homo sapiens
gagaaacccuacaaaugug

SEQ ID NO: 547655 - RNA, 19 nt, Homo sapiens
gagaaacccuacaaaugug

SEQ ID NO: 547656 - RNA, 19 nt, Homo sapiens
gagaaacccuacaaaugug

SEQ ID NO: 547657 - RNA, 19 nt, Homo sapiens
gagaaacccuacaaaugug

SEQ ID NO: 547658 - RNA, 19 nt, Homo sapiens
gagaaacccuacaaaugug

SEQ ID NO: 547659 - RNA, 19 nt, Homo sapiens
gagaaacccuacaaaugug

SEQ ID NO: 547660 - RNA, 19 nt, Homo sapiens
gagaaacccuacaaaugug

SEQ ID NO: 547661 - RNA, 19 nt, Homo sapiens
uaaccgaucugcaauccuu

SEQ ID NO: 547662 - RNA, 19 nt, Homo sapiens
gguuaucagucuucaguaa

SEQ ID NO: 547663 - RNA, 19 nt, Homo sapiens
gagagaaacccuacagaug

SEQ ID NO: 547664 - RNA, 19 nt, Homo sapiens
ggaagaauccccaguuaua

SEQ ID NO: 547665 - RNA, 19 nt, Homo sapiens
ccucaaaccuuauggaaca

SEQ ID NO: 547666 - RNA, 19 nt, Homo sapiens
aaauggcccucaacccuua

SEQ ID NO: 547667 - RNA, 19 nt, Homo sapiens
ccucaaaccuuauggaaca

SEQ ID NO: 547668 - RNA, 19 nt, Homo sapiens
ccucaaaccuuauggaaca

SEQ ID NO: 547669 - RNA, 19 nt, Homo sapiens
ggagagaaacccuacaaau

SEQ ID NO: 547670 - RNA, 19 nt, Homo sapiens
ggagagaaacccuacaaau

SEQ ID NO: 547671 - RNA, 19 nt, Homo sapiens
ggagagaaacccuacaaau

SEQ ID NO: 547672 - RNA, 19 nt, Homo sapiens
ggagagaaacccuacaaau

SEQ ID NO: 547673 - RNA, 19 nt, Homo sapiens
ggagagaaacccuacaaau

SEQ ID NO: 547674 - RNA, 19 nt, Homo sapiens
ggagagaaacccuacaaau

SEQ ID NO: 547675 - RNA, 19 nt, Homo sapiens
ggagagaaacccuacaaau

SEQ ID NO: 547676 - RNA, 19 nt, Homo sapiens
ggagagaaacccuacaaau

SEQ ID NO: 547677 - RNA, 19 nt, Homo sapiens
ggagagaaacccuacaaau

SEQ ID NO: 547678 - RNA, 19 nt, Homo sapiens
ggagagaaacccuacaaau

SEQ ID NO: 547679 - RNA, 19 nt, Homo sapiens
ggagagaagucuuauaaau

SEQ ID NO: 547680 - RNA, 19 nt, Homo sapiens
gcucaaaucuucaaauuca

SEQ ID NO: 547681 - RNA, 19 nt, Homo sapiens
gguaaagguuucagucaua

SEQ ID NO: 547682 - RNA, 19 nt, Homo sapiens
guucaaagcuucacacuca

SEQ ID NO: 547683 - RNA, 19 nt, Homo sapiens
gaucauaauucacaucuuc

SEQ ID NO: 547684 - RNA, 19 nt, Homo sapiens
guacggaugugaugaaguu

SEQ ID NO: 547685 - RNA, 19 nt, Homo sapiens
gagagaaaccuuauaaaug

SEQ ID NO: 547686 - RNA, 19 nt, Homo sapiens
ggaguucacuuucaucaga

SEQ ID NO: 547687 - RNA, 19 nt, Homo sapiens
caaaugccgugaauauuau

SEQ ID NO: 547688 - RNA, 19 nt, Homo sapiens
gagagaaaccuuacaaaug

SEQ ID NO: 547689 - RNA, 19 nt, Homo sapiens
gagagaagccuuaucaaug

SEQ ID NO: 547690 - RNA, 19 nt, Homo sapiens
acaaaugccgugaauauua

SEQ ID NO: 547691 - RNA, 19 nt, Homo sapiens
gauaaagaccucaguagaa

SEQ ID NO: 547692 - RNA, 19 nt, Homo sapiens
ggagagaaaccuuauaaau

SEQ ID NO: 547693 - RNA, 19 nt, Homo sapiens
gagcucaaaucuucgaauu

SEQ ID NO: 547694 - RNA, 19 nt, Homo sapiens
gagagaaacccuacaaaug

SEQ ID NO: 547695 - RNA, 19 nt, Homo sapiens
gcucaaaucuucgaauuca

SEQ ID NO: 547696 - RNA, 19 nt, Homo sapiens
gcgcucaaaucuucaaauu

SEQ ID NO: 547697 - RNA, 19 nt, Homo sapiens
caagaaaccacauagguaa

SEQ ID NO: 547698 - RNA, 19 nt, Homo sapiens
guucuaaucuucacauuca

SEQ ID NO: 547699 - RNA, 19 nt, Homo sapiens
gacgguaacuuucaucaga

SEQ ID NO: 547700 - RNA, 19 nt, Homo sapiens
gaucagacuuguauagaca

SEQ ID NO: 547701 - RNA, 19 nt, Homo sapiens
cuacaaaucccaagaagaa

SEQ ID NO: 547702 - RNA, 19 nt, Homo sapiens
gaaacacacagaacuuaaa

SEQ ID NO: 547703 - RNA, 19 nt, Homo sapiens
gagagaagucuuauaaaug

SEQ ID NO: 547704 - RNA, 19 nt, Homo sapiens
gagaagcuacuccgguuua

SEQ ID NO: 547705 - RNA, 19 nt, Homo sapiens
ggacaaaagccaccuaaua

SEQ ID NO: 547706 - RNA, 19 nt, Homo sapiens
cuacaaaugugaagagugu

SEQ ID NO: 547707 - RNA, 19 nt, Homo sapiens
gagaaacccuacaaaugug

SEQ ID NO: 547708 - RNA, 19 nt, Homo sapiens
ggagaaacccuauacuugu

SEQ ID NO: 547709 - RNA, 19 nt, Homo sapiens
gcucagaucuucgcauuca

SEQ ID NO: 547710 - RNA, 19 nt, Homo sapiens
guucacaucuucucauuca

SEQ ID NO: 547711 - RNA, 19 nt, Homo sapiens
ggaaugagagcuacaaauc

SEQ ID NO: 547712 - RNA, 19 nt, Homo sapiens
gcaguaacauuugaagaug

SEQ ID NO: 547713 - RNA, 19 nt, Homo sapiens
ggagagaaaccuuacaaau

SEQ ID NO: 547714 - RNA, 19 nt, Homo sapiens
caucagagcuccggaguuc

SEQ ID NO: 547715 - RNA, 19 nt, Homo sapiens
uaagugacaugaacucuca

SEQ ID NO: 547716 - RNA, 19 nt, Homo sapiens
ccagauggcaguaacauuu

SEQ ID NO: 547717 - RNA, 19 nt, Homo sapiens
ggaaacacacagaacuuaa

SEQ ID NO: 547718 - RNA, 19 nt, Homo sapiens
agagaagccuuaucaaugu

SEQ ID NO: 547719 - RNA, 19 nt, Homo sapiens
caggagagaagucuuauaa

SEQ ID NO: 547720 - RNA, 19 nt, Homo sapiens
auaaagaccucaguagaaa

SEQ ID NO: 547721 - RNA, 19 nt, Homo sapiens
gugaugaaguugacgguaa

SEQ ID NO: 547722 - RNA, 19 nt, Homo sapiens
gagaaaagcccuauaaaug

SEQ ID NO: 547723 - RNA, 19 nt, Homo sapiens
gggagaaacccuauacuug

SEQ ID NO: 547724 - RNA, 19 nt, Homo sapiens
ccaagaaaccacauaggua

SEQ ID NO: 547725 - RNA, 19 nt, Homo sapiens
ggagagaagccuuaucaau

SEQ ID NO: 547726 - RNA, 19 nt, Homo sapiens
ggagagaaacccuacaaau

SEQ ID NO: 547727 - RNA, 19 nt, Homo sapiens
cggcuucucucccacguua

SEQ ID NO: 547728 - RNA, 19 nt, Homo sapiens
agagaaaccuuacaaaugc

SEQ ID NO: 547729 - RNA, 19 nt, Homo sapiens
gagaaacccuauacuuguc

SEQ ID NO: 547730 - RNA, 19 nt, Homo sapiens
gaagaccuacugagagauu

SEQ ID NO: 547731 - RNA, 19 nt, Homo sapiens
ccagagacuucacauagga

SEQ ID NO: 547732 - RNA, 19 nt, Homo sapiens
gaaaccacauagguaagaa

SEQ ID NO: 547733 - RNA, 19 nt, Homo sapiens
gaaaaguacuguggaugua

SEQ ID NO: 547734 - RNA, 19 nt, Homo sapiens
guagaaaacuggaaugaga

SEQ ID NO: 547735 - RNA, 19 nt, Homo sapiens
cuacacaaaugucauguca

SEQ ID NO: 547736 - RNA, 19 nt, Homo sapiens
gaacuacacaaaugucaug

SEQ ID NO: 547737 - RNA, 19 nt, Homo sapiens
gggauuugaucauaauuca

SEQ ID NO: 547738 - RNA, 19 nt, Homo sapiens
gaucuucgcauucaucaga

SEQ ID NO: 547739 - RNA, 19 nt, Homo sapiens
cagauaccgucuuggcaua

SEQ ID NO: 547740 - RNA, 19 nt, Homo sapiens
acacaaaugucaugucagu

SEQ ID NO: 547741 - RNA, 19 nt, Homo sapiens
gacaaaagccaccuaauaa

SEQ ID NO: 547742 - RNA, 19 nt, Homo sapiens
gcucagcucuucgaauuca

SEQ ID NO: 547743 - RNA, 19 nt, Homo sapiens
aagaagaccuacugagaga

SEQ ID NO: 547744 - RNA, 19 nt, Homo sapiens
ucaagacuaugguagagaa

SEQ ID NO: 547745 - RNA, 19 nt, Homo sapiens
uuacaaaugccgugaauau

SEQ ID NO: 547746 - RNA, 19 nt, Homo sapiens
cagcucagaucuucgcauu

SEQ ID NO: 547747 - RNA, 19 nt, Homo sapiens
ccaagcaacauuuauaguu

SEQ ID NO: 547748 - RNA, 19 nt, Homo sapiens
ucauagaagaggaaacuua

SEQ ID NO: 547749 - RNA, 19 nt, Homo sapiens
agagaaacccuacaaaugu

SEQ ID NO: 547750 - RNA, 19 nt, Homo sapiens
gagagaagccuuuuaaaug

SEQ ID NO: 547751 - RNA, 19 nt, Homo sapiens
caaguaaucccaagcaaca

SEQ ID NO: 547752 - RNA, 19 nt, Homo sapiens
cuauaaauccugcuguuaa

SEQ ID NO: 547753 - RNA, 19 nt, Homo sapiens
caggagagaaaccuuauaa

SEQ ID NO: 547754 - RNA, 19 nt, Homo sapiens
agccagagcucaaaucuuc

SEQ ID NO: 547755 - RNA, 19 nt, Homo sapiens
ggaguucaguacuucaugu

SEQ ID NO: 547756 - RNA, 19 nt, Homo sapiens
ucucuagucuucacaauca

SEQ ID NO: 547757 - RNA, 19 nt, Homo sapiens
ucaagaagaccuacugaga

SEQ ID NO: 547758 - RNA, 19 nt, Homo sapiens
gcaagaucguucccagugu

SEQ ID NO: 547759 - RNA, 19 nt, Homo sapiens
uggcaaggcugguggaaug

SEQ ID NO: 547760 - RNA, 19 nt, Homo sapiens
gagaguccauacaggagaa

SEQ ID NO: 547761 - RNA, 19 nt, Homo sapiens
gagaaaccuuauaaaugug

SEQ ID NO: 547762 - RNA, 19 nt, Homo sapiens
ucaaagaguccacacagaa

SEQ ID NO: 547763 - RNA, 19 nt, Homo sapiens
ggaacuaugaacugacuuu

SEQ ID NO: 547764 - RNA, 19 nt, Homo sapiens
caaaugucaugucaguaga

SEQ ID NO: 547765 - RNA, 19 nt, Homo sapiens
ucagagaucagacuuguau

SEQ ID NO: 547766 - RNA, 19 nt, Homo sapiens
acugagagauucaauggaa

SEQ ID NO: 547767 - RNA, 19 nt, Homo sapiens
ugggagaacuacacaaaug

SEQ ID NO: 547768 - RNA, 19 nt, Homo sapiens
acacagaacuuaaaacuca

SEQ ID NO: 547769 - RNA, 19 nt, Homo sapiens
gaaaagcccuauaaauguc

SEQ ID NO: 547770 - RNA, 19 nt, Homo sapiens
acacaggagagaagucuua

SEQ ID NO: 547771 - RNA, 19 nt, Homo sapiens
gcgcccagauguaugagaa

SEQ ID NO: 547772 - RNA, 19 nt, Homo sapiens
uaucucccacuaagaauua

SEQ ID NO: 547773 - RNA, 19 nt, Homo sapiens
gagaagccuuuuaaaugua

SEQ ID NO: 547774 - RNA, 19 nt, Homo sapiens
guauagacauccaagaaac

SEQ ID NO: 547775 - RNA, 19 nt, Homo sapiens
gagaaaaccucugucaaug

SEQ ID NO: 547776 - RNA, 19 nt, Homo sapiens
ggugauaugucaagaagac

SEQ ID NO: 547777 - RNA, 19 nt, Homo sapiens
guaaagguuucagucauag

SEQ ID NO: 547778 - RNA, 19 nt, Homo sapiens
gcucuucgaauucaucaaa

SEQ ID NO: 547779 - RNA, 19 nt, Homo sapiens
gaacuuaacucuuguuugu

SEQ ID NO: 547780 - RNA, 19 nt, Homo sapiens
gaccagagauucauacaaa

SEQ ID NO: 547781 - RNA, 19 nt, Homo sapiens
ggaauaacaggguaaauaa

SEQ ID NO: 547782 - RNA, 19 nt, Homo sapiens
gggaaugacuugaguuuga

SEQ ID NO: 547783 - RNA, 19 nt, Homo sapiens
gauguucagugcagacuua

SEQ ID NO: 547784 - RNA, 19 nt, Homo sapiens
ccauaaggcuuuggaguua

SEQ ID NO: 547785 - RNA, 19 nt, Homo sapiens
ggugagaauugguuauaua

SEQ ID NO: 547786 - RNA, 19 nt, Homo sapiens
uaacuuggcuuaaaucaca

SEQ ID NO: 547787 - RNA, 19 nt, Homo sapiens
ggaaaggccuucaguaaaa

SEQ ID NO: 547788 - RNA, 19 nt, Homo sapiens
gcaaaggccugcacaagca

SEQ ID NO: 547789 - RNA, 19 nt, Homo sapiens
gagaauugguuauauagga

SEQ ID NO: 547790 - RNA, 19 nt, Homo sapiens
gagagaaacccuauaaaug

SEQ ID NO: 547791 - RNA, 19 nt, Homo sapiens
ggacauaaauuugccacaa

SEQ ID NO: 547792 - RNA, 19 nt, Homo sapiens
caacuggacucugcuguaa

SEQ ID NO: 547793 - RNA, 19 nt, Homo sapiens
caaagaagcagauuauaga

SEQ ID NO: 547794 - RNA, 19 nt, Homo sapiens
aaccggagcuccucucuua

SEQ ID NO: 547795 - RNA, 19 nt, Homo sapiens
ggacuugggugaauuuaca

SEQ ID NO: 547796 - RNA, 19 nt, Homo sapiens
ggucagggauuccuaguug

SEQ ID NO: 547797 - RNA, 19 nt, Homo sapiens
uuaagaaggucacaagaaa

SEQ ID NO: 547798 - RNA, 19 nt, Homo sapiens
ccaaacaacaguaaagaua

SEQ ID NO: 547799 - RNA, 19 nt, Homo sapiens
agaaaucucugaaucaaug

SEQ ID NO: 547800 - RNA, 19 nt, Homo sapiens
gagaauuacugcaaucuag

SEQ ID NO: 547801 - RNA, 19 nt, Homo sapiens
guucaucauuugccacuua

SEQ ID NO: 547802 - RNA, 19 nt, Homo sapiens
ggagagaaacccuauaaau

SEQ ID NO: 547803 - RNA, 19 nt, Homo sapiens
ucaguuagcucaauuugug

SEQ ID NO: 547804 - RNA, 19 nt, Homo sapiens
ggaguucuauuuaggaaga

SEQ ID NO: 547805 - RNA, 19 nt, Homo sapiens
gaacucauuuaacaucaug

SEQ ID NO: 547806 - RNA, 19 nt, Homo sapiens
guucagacauuuccaguau

SEQ ID NO: 547807 - RNA, 19 nt, Homo sapiens
gcaguggaauggcuccuaa

SEQ ID NO: 547808 - RNA, 19 nt, Homo sapiens
caacaggaguucaaaccuu

SEQ ID NO: 547809 - RNA, 19 nt, Homo sapiens
ucagacauuuccaguauuu

SEQ ID NO: 547810 - RNA, 19 nt, Homo sapiens
gaaguuugaugauguugug

SEQ ID NO: 547811 - RNA, 19 nt, Homo sapiens
agauaucccucuuaaauga

SEQ ID NO: 547812 - RNA, 19 nt, Homo sapiens
ugacaaggcuuaccgaaag

SEQ ID NO: 547813 - RNA, 19 nt, Homo sapiens
uuaggaaccugaauucauu

SEQ ID NO: 547814 - RNA, 19 nt, Homo sapiens
guccauagccuuagguaua

SEQ ID NO: 547815 - RNA, 19 nt, Homo sapiens
ggagagaaaccauucaaau

SEQ ID NO: 547816 - RNA, 19 nt, Homo sapiens
gggaaaggguuaucaacug

SEQ ID NO: 547817 - RNA, 19 nt, Homo sapiens
gaaaggugagaauugguua

SEQ ID NO: 547818 - RNA, 19 nt, Homo sapiens
ucggaaaucuuaccuaaau

SEQ ID NO: 547819 - RNA, 19 nt, Homo sapiens
uaccagacauuaugaaguu

SEQ ID NO: 547820 - RNA, 19 nt, Homo sapiens
ccuaagaaccuauugauga

SEQ ID NO: 547821 - RNA, 19 nt, Homo sapiens
guuaugauguugaugagaa

SEQ ID NO: 547822 - RNA, 19 nt, Homo sapiens
ucagauaucccucuuaaau

SEQ ID NO: 547823 - RNA, 19 nt, Homo sapiens
ugucagauaucccucuuaa

SEQ ID NO: 547824 - RNA, 19 nt, Homo sapiens
cuuaggaacuuaacucuug

SEQ ID NO: 547825 - RNA, 19 nt, Homo sapiens
aagauuaccuucagucaga

SEQ ID NO: 547826 - RNA, 19 nt, Homo sapiens
gagaaacccuauaaaugca

SEQ ID NO: 547827 - RNA, 19 nt, Homo sapiens
ggaggaagauuuugaaugu

SEQ ID NO: 547828 - RNA, 19 nt, Homo sapiens
gaaauaccaaggaagacua

SEQ ID NO: 547829 - RNA, 19 nt, Homo sapiens
agaaagaaauaccaaggaa

SEQ ID NO: 547830 - RNA, 19 nt, Homo sapiens
ccagugacauucaaagaug

SEQ ID NO: 547831 - RNA, 19 nt, Homo sapiens
caacaguaacagccauuua

SEQ ID NO: 547832 - RNA, 19 nt, Homo sapiens
aaagauggauaauggagaa

SEQ ID NO: 547833 - RNA, 19 nt, Homo sapiens
cauagaagaugugauugaa

SEQ ID NO: 547834 - RNA, 19 nt, Homo sapiens
gcuugaagaugaagauaug

SEQ ID NO: 547835 - RNA, 19 nt, Homo sapiens
ccucggaaaucuuaccuaa

SEQ ID NO: 547836 - RNA, 19 nt, Homo sapiens
gcaaaggccuggucuaccu

SEQ ID NO: 547837 - RNA, 19 nt, Homo sapiens
ggacacccuucuucagaug

SEQ ID NO: 547838 - RNA, 19 nt, Homo sapiens
ugaaaugcuugaagaugaa

SEQ ID NO: 547839 - RNA, 19 nt, Homo sapiens
guggaaaggccuucaguaa

SEQ ID NO: 547840 - RNA, 19 nt, Homo sapiens
uaaagucuccuauacucua

SEQ ID NO: 547841 - RNA, 19 nt, Homo sapiens
cuaagaaccuauugaugau

SEQ ID NO: 547842 - RNA, 19 nt, Homo sapiens
ggaaaggugagaauugguu

SEQ ID NO: 547843 - RNA, 19 nt, Homo sapiens
gauggauaauggagaaaga

SEQ ID NO: 547844 - RNA, 19 nt, Homo sapiens
guaaggcggauuugaacua

SEQ ID NO: 547845 - RNA, 19 nt, Homo sapiens
cgaaguagacauuagcaaa

SEQ ID NO: 547846 - RNA, 19 nt, Homo sapiens
gaaaaucuguuugaaggaa

SEQ ID NO: 547847 - RNA, 19 nt, Homo sapiens
gcagaacucauuuaacauc

SEQ ID NO: 547848 - RNA, 19 nt, Homo sapiens
gaaagauuaccuucaguca

SEQ ID NO: 547849 - RNA, 19 nt, Homo sapiens
cgaaguucaucccuuauuc

SEQ ID NO: 547850 - RNA, 19 nt, Homo sapiens
gggaauuccuucaagaaag

SEQ ID NO: 547851 - RNA, 19 nt, Homo sapiens
uugaaaugcuugaagauga

SEQ ID NO: 547852 - RNA, 19 nt, Homo sapiens
gcuuaaaucacacugcaua

SEQ ID NO: 547853 - RNA, 19 nt, Homo sapiens
guaccugaauauuggcuuu

SEQ ID NO: 547854 - RNA, 19 nt, Homo sapiens
aaagaaauaccaaggaaga

SEQ ID NO: 547855 - RNA, 19 nt, Homo sapiens
gccuuaaguuggagaguaa

SEQ ID NO: 547856 - RNA, 19 nt, Homo sapiens
ggacucugcuguaaagaac

SEQ ID NO: 547857 - RNA, 19 nt, Homo sapiens
gcaacuggacucugcugua

SEQ ID NO: 547858 - RNA, 19 nt, Homo sapiens
gaaaguggacacccuucuu

SEQ ID NO: 547859 - RNA, 19 nt, Homo sapiens
ugauugaaaugcuugaaga

SEQ ID NO: 547860 - RNA, 19 nt, Homo sapiens
caacauccaaacaacagua

SEQ ID NO: 547861 - RNA, 19 nt, Homo sapiens
uggaauaacaggguaaaua

SEQ ID NO: 547862 - RNA, 19 nt, Homo sapiens
gaaguauguauugcuguua

SEQ ID NO: 547863 - RNA, 19 nt, Homo sapiens
uagcaaagccaaacaauac

SEQ ID NO: 547864 - RNA, 19 nt, Homo sapiens
gaaguagacauuagcaaag

SEQ ID NO: 547865 - RNA, 19 nt, Homo sapiens
augcagaacucauuuaaca

SEQ ID NO: 547866 - RNA, 19 nt, Homo sapiens
caggagagaaacccuauaa

SEQ ID NO: 547867 - RNA, 19 nt, Homo sapiens
gcgcuuuguucaucauuug

SEQ ID NO: 547868 - RNA, 19 nt, Homo sapiens
acacugaggaggaagauuu

SEQ ID NO: 547869 - RNA, 19 nt, Homo sapiens
uaaaucacacugcauauag

SEQ ID NO: 547870 - RNA, 19 nt, Homo sapiens
ucugagaacuggcgcuuug

SEQ ID NO: 547871 - RNA, 19 nt, Homo sapiens
ccucuuaaaugauaucaca

SEQ ID NO: 547872 - RNA, 19 nt, Homo sapiens
gagcuccucucuuauucga

SEQ ID NO: 547873 - RNA, 19 nt, Homo sapiens
ugccgaaguucaucccuua

SEQ ID NO: 547874 - RNA, 19 nt, Homo sapiens
ccucauagaagaugugauu

SEQ ID NO: 547875 - RNA, 19 nt, Homo sapiens
aaaccugucucuacgugaa

SEQ ID NO: 547876 - RNA, 19 nt, Homo sapiens
ccagacauuugccuuagga

SEQ ID NO: 547877 - RNA, 19 nt, Homo sapiens
cuaauauccaccugauuua

SEQ ID NO: 547878 - RNA, 19 nt, Homo sapiens
aaaccacaguaucaccaua

SEQ ID NO: 547879 - RNA, 19 nt, Homo sapiens
gcacagaacugcacuagga

SEQ ID NO: 547880 - RNA, 19 nt, Homo sapiens
gaacccggcuuucgcauuu

SEQ ID NO: 547881 - RNA, 19 nt, Homo sapiens
gcacuaggauuaauuuguu

SEQ ID NO: 547882 - RNA, 19 nt, Homo sapiens
gaagaaaugcucauaaaga

SEQ ID NO: 547883 - RNA, 19 nt, Homo sapiens
acacuugucugucuuauaa

SEQ ID NO: 547884 - RNA, 19 nt, Homo sapiens
gaagaugucugcauuacuc

SEQ ID NO: 547885 - RNA, 19 nt, Homo sapiens
ggaauguaaucaagguaua

SEQ ID NO: 547886 - RNA, 19 nt, Homo sapiens
cgaaacugguuauaaguaa

SEQ ID NO: 547887 - RNA, 19 nt, Homo sapiens
ugaaaucucugcauguuug

SEQ ID NO: 547888 - RNA, 19 nt, Homo sapiens
caacauggcugcaguagac

SEQ ID NO: 547889 - RNA, 19 nt, Homo sapiens
caaauaagacauucuguga

SEQ ID NO: 547890 - RNA, 19 nt, Homo sapiens
gcaaagguaucugaauaau

SEQ ID NO: 547891 - RNA, 19 nt, Homo sapiens
cuaaagcugucaaauaaga

SEQ ID NO: 547892 - RNA, 19 nt, Homo sapiens
caucuaaagcugucaaaua

SEQ ID NO: 547893 - RNA, 19 nt, Homo sapiens
gugaagagacugaaacuuu

SEQ ID NO: 547894 - RNA, 19 nt, Homo sapiens
gaacugcacuaggauuaau

SEQ ID NO: 547895 - RNA, 19 nt, Homo sapiens
gagauaaccuuugaagcuu

SEQ ID NO: 547896 - RNA, 19 nt, Homo sapiens
gcagucuacuucuaccaua

SEQ ID NO: 547897 - RNA, 19 nt, Homo sapiens
ugaagagacugaaacuuug

SEQ ID NO: 547898 - RNA, 19 nt, Homo sapiens
cugcagauguguacagaua

SEQ ID NO: 547899 - RNA, 19 nt, Homo sapiens
gacauucugugaaagguaa

SEQ ID NO: 547900 - RNA, 19 nt, Homo sapiens
ucacuucuguguuauaaug

SEQ ID NO: 547901 - RNA, 19 nt, Homo sapiens
uugcaaagguaucugaaua

SEQ ID NO: 547902 - RNA, 19 nt, Homo sapiens
ugaauaacaugcaucugaa

SEQ ID NO: 547903 - RNA, 19 nt, Homo sapiens
acaacagggucuugagaua

SEQ ID NO: 547904 - RNA, 19 nt, Homo sapiens
caucgaaacugguuauaag

SEQ ID NO: 547905 - RNA, 19 nt, Homo sapiens
caaaauaacuaccccgaaa

SEQ ID NO: 547906 - RNA, 19 nt, Homo sapiens
guaauaaucacuucugugu

SEQ ID NO: 547907 - RNA, 19 nt, Homo sapiens
gagagcagacacuagcuua

SEQ ID NO: 547908 - RNA, 19 nt, Homo sapiens
aggaagaaaugcucauaaa

SEQ ID NO: 547909 - RNA, 19 nt, Homo sapiens
gacacuagcuuaaacaacu

SEQ ID NO: 547910 - RNA, 19 nt, Homo sapiens
gagggcugcuuuaucauau

SEQ ID NO: 547911 - RNA, 19 nt, Homo sapiens
guauuuggcgccauauaua

SEQ ID NO: 547912 - RNA, 19 nt, Homo sapiens
aggcagaauuggauagaua

SEQ ID NO: 547913 - RNA, 19 nt, Homo sapiens
aauggaauguguucaguuu

SEQ ID NO: 547914 - RNA, 19 nt, Homo sapiens
caacagggucuugagauaa

SEQ ID NO: 547915 - RNA, 19 nt, Homo sapiens
agacuucaguucuuaaugu

SEQ ID NO: 547916 - RNA, 19 nt, Homo sapiens
acaacuguccguaugauua

SEQ ID NO: 547917 - RNA, 19 nt, Homo sapiens
gagcagacacuagcuuaaa

SEQ ID NO: 547918 - RNA, 19 nt, Homo sapiens
ggacaaauggaauguguuc

SEQ ID NO: 547919 - RNA, 19 nt, Homo sapiens
cacaacauauucuuuggaa

SEQ ID NO: 547920 - RNA, 19 nt, Homo sapiens
gcacaacuguccguaugau

SEQ ID NO: 547921 - RNA, 19 nt, Homo sapiens
gcagauguguacagauagu

SEQ ID NO: 547922 - RNA, 19 nt, Homo sapiens
gauguuuggguguuuguua

SEQ ID NO: 547923 - RNA, 19 nt, Homo sapiens
gcagaugcauggccauuuu

SEQ ID NO: 547924 - RNA, 19 nt, Homo sapiens
gacuucaguucuuaaugua

SEQ ID NO: 547925 - RNA, 19 nt, Homo sapiens
ccauauauaagccugguua

SEQ ID NO: 547926 - RNA, 19 nt, Homo sapiens
gcaauguucaguccuaguu

SEQ ID NO: 547927 - RNA, 19 nt, Homo sapiens
ggaaauccuaggacaaaug

SEQ ID NO: 547928 - RNA, 19 nt, Homo sapiens
uacagcagcucuauugaau

SEQ ID NO: 547929 - RNA, 19 nt, Homo sapiens
cagaacugcacuaggauua

SEQ ID NO: 547930 - RNA, 19 nt, Homo sapiens
agauaaccuuugaagcuua

SEQ ID NO: 547931 - RNA, 19 nt, Homo sapiens
gugaaacacacagauaaua

SEQ ID NO: 547932 - RNA, 19 nt, Homo sapiens
caacaguccuaccucagau

SEQ ID NO: 547933 - RNA, 19 nt, Homo sapiens
gaguauaguuaguguugug

SEQ ID NO: 547934 - RNA, 19 nt, Homo sapiens
gggcugcuuuaucauauug

SEQ ID NO: 547935 - RNA, 19 nt, Homo sapiens
gcaggaagaaaugcucaua

SEQ ID NO: 547936 - RNA, 19 nt, Homo sapiens
aaagugaaacacacagaua

SEQ ID NO: 547937 - RNA, 19 nt, Homo sapiens
guacagagagcagacacua

SEQ ID NO: 547938 - RNA, 19 nt, Homo sapiens
gcacauaaucaugcuauuc

SEQ ID NO: 547939 - RNA, 19 nt, Homo sapiens
gguauaaucuuuggcuagu

SEQ ID NO: 547940 - RNA, 19 nt, Homo sapiens
gauacagcccuacaaaugu

SEQ ID NO: 547941 - RNA, 19 nt, Homo sapiens
guaggacucuaguguucuu

SEQ ID NO: 547942 - RNA, 19 nt, Homo sapiens
cugcauuacucauugcuaa

SEQ ID NO: 547943 - RNA, 19 nt, Homo sapiens
guaaacaucgaaacugguu

SEQ ID NO: 547944 - RNA, 19 nt, Homo sapiens
aagaaaugcucauaaagag

SEQ ID NO: 547945 - RNA, 19 nt, Homo sapiens
aaugaaaucucugcauguu

SEQ ID NO: 547946 - RNA, 19 nt, Homo sapiens
uauaguuaguguuguggua

SEQ ID NO: 547947 - RNA, 19 nt, Homo sapiens
ggauguggcuuuuauggaa

SEQ ID NO: 547948 - RNA, 19 nt, Homo sapiens
ggaagaaaugcucauaaag

SEQ ID NO: 547949 - RNA, 19 nt, Homo sapiens
aaacuucacccucuuuaau

SEQ ID NO: 547950 - RNA, 19 nt, Homo sapiens
caacaacagggucuugaga

SEQ ID NO: 547951 - RNA, 19 nt, Homo sapiens
caaauggaauguguucagu

SEQ ID NO: 547952 - RNA, 19 nt, Homo sapiens
uaacucagcaaaugacaga

SEQ ID NO: 547953 - RNA, 19 nt, Homo sapiens
ugcauuaucuacagcauug

SEQ ID NO: 547954 - RNA, 19 nt, Homo sapiens
caaaauaguggcagaauga

SEQ ID NO: 547955 - RNA, 19 nt, Homo sapiens
gaagagacugaaacuuugu

SEQ ID NO: 547956 - RNA, 19 nt, Homo sapiens
aagcacaacuguccguaug

SEQ ID NO: 547957 - RNA, 19 nt, Homo sapiens
uauaaucuuuggcuagugu

SEQ ID NO: 547958 - RNA, 19 nt, Homo sapiens
gaaaagagaauccaguugu

SEQ ID NO: 547959 - RNA, 19 nt, Homo sapiens
uuuguggacuucaccguua

SEQ ID NO: 547960 - RNA, 19 nt, Homo sapiens
gaauugcccaaaccaaaga

SEQ ID NO: 547961 - RNA, 19 nt, Homo sapiens
guguacagauaguucauau

SEQ ID NO: 547962 - RNA, 19 nt, Homo sapiens
guguaggacucuaguguuc

SEQ ID NO: 547963 - RNA, 19 nt, Homo sapiens
agauacagcccuacaaaug

SEQ ID NO: 547964 - RNA, 19 nt, Homo sapiens
guggcugccuugccuguaa

SEQ ID NO: 547965 - RNA, 19 nt, Homo sapiens
gcugcuuuaucauauugua

SEQ ID NO: 547966 - RNA, 19 nt, Homo sapiens
gaaauccuaggacaaaugg

SEQ ID NO: 547967 - RNA, 19 nt, Homo sapiens
cuacuucuaccauaguuaa

SEQ ID NO: 547968 - RNA, 19 nt, Homo sapiens
gcaaagugaaacacacaga

SEQ ID NO: 547969 - RNA, 19 nt, Homo sapiens
uaggacaaauggaaugugu

SEQ ID NO: 547970 - RNA, 19 nt, Homo sapiens
cagcaaaugacagaaauga

SEQ ID NO: 547971 - RNA, 19 nt, Homo sapiens
acauacagcagcucuauug

SEQ ID NO: 547972 - RNA, 19 nt, Homo sapiens
gaaacacacagauaauagg

SEQ ID NO: 547973 - RNA, 19 nt, Homo sapiens
guacccuucugcauggaaa

SEQ ID NO: 547974 - RNA, 19 nt, Homo sapiens
gcaaaauaguggcagaaug

SEQ ID NO: 547975 - RNA, 19 nt, Homo sapiens
gguuaaauuggucaucuaa

SEQ ID NO: 547976 - RNA, 19 nt, Homo sapiens
ugaaacacacagauaauag

SEQ ID NO: 547977 - RNA, 19 nt, Homo sapiens
gguaaugccuguuuucauc

SEQ ID NO: 547978 - RNA, 19 nt, Homo sapiens
guagacuucuuagugguau

SEQ ID NO: 547979 - RNA, 19 nt, Homo sapiens
gaaauaagcugugauugua

SEQ ID NO: 547980 - RNA, 19 nt, Homo sapiens
ggugaaagcuacugaaaua

SEQ ID NO: 547981 - RNA, 19 nt, Homo sapiens
caacggaacuuugagauua

SEQ ID NO: 547982 - RNA, 19 nt, Homo sapiens
gcuaugaccuucccaagua

SEQ ID NO: 547983 - RNA, 19 nt, Homo sapiens
gcaaauaaccucaucugua

SEQ ID NO: 547984 - RNA, 19 nt, Homo sapiens
gcaaugaagugcuuuguau

SEQ ID NO: 547985 - RNA, 19 nt, Homo sapiens
caaauaaccucaucuguag

SEQ ID NO: 547986 - RNA, 19 nt, Homo sapiens
ggacgcggaucccaaguua

SEQ ID NO: 547987 - RNA, 19 nt, Homo sapiens
gaacagaaccucccaagga

SEQ ID NO: 547988 - RNA, 19 nt, Homo sapiens
gaggaugccuugucaauga

SEQ ID NO: 547989 - RNA, 19 nt, Homo sapiens
agucuuagcuccuguguua

SEQ ID NO: 547990 - RNA, 19 nt, Homo sapiens
ggaagagacuauuucugua

SEQ ID NO: 547991 - RNA, 19 nt, Homo sapiens
ggagagacaucacaaggaa

SEQ ID NO: 547992 - RNA, 19 nt, Homo sapiens
cagaagaccuuaauaaaca

SEQ ID NO: 547993 - RNA, 19 nt, Homo sapiens
gaauuuagcugugagguau

SEQ ID NO: 547994 - RNA, 19 nt, Homo sapiens
ggaagaagccugucagaug

SEQ ID NO: 547995 - RNA, 19 nt, Homo sapiens
gaagacaucucugagguau

SEQ ID NO: 547996 - RNA, 19 nt, Homo sapiens
guguaaaguuguucuguua

SEQ ID NO: 547997 - RNA, 19 nt, Homo sapiens
gaagagacuauuucuguaa

SEQ ID NO: 547998 - RNA, 19 nt, Homo sapiens
uaacacauuugcaagauga

SEQ ID NO: 547999 - RNA, 19 nt, Homo sapiens
cacugaagaugcacuauua

SEQ ID NO: 548000 - RNA, 19 nt, Homo sapiens
uaagauguccuccuugaua

SEQ ID NO: 548001 - RNA, 19 nt, Homo sapiens
ccagcuggcuuccuagaua

SEQ ID NO: 548002 - RNA, 19 nt, Homo sapiens
auagagggcuggaauuuaa

SEQ ID NO: 548003 - RNA, 19 nt, Homo sapiens
gcaaggaacacuacaguug

SEQ ID NO: 548004 - RNA, 19 nt, Homo sapiens
uaaugcagcucaucacuug

SEQ ID NO: 548005 - RNA, 19 nt, Homo sapiens
ugacagugcugauaaagug

SEQ ID NO: 548006 - RNA, 19 nt, Homo sapiens
gaaaagaauugcaaggaaa

SEQ ID NO: 548007 - RNA, 19 nt, Homo sapiens
guauugacccucuaugaua

SEQ ID NO: 548008 - RNA, 19 nt, Homo sapiens
caaaugugcugacuguuca

SEQ ID NO: 548009 - RNA, 19 nt, Homo sapiens
gaaagggaccgcuguuguu

SEQ ID NO: 548010 - RNA, 19 nt, Homo sapiens
uaaauacaauccugacguu

SEQ ID NO: 548011 - RNA, 19 nt, Homo sapiens
caguagacauuacguguuu

SEQ ID NO: 548012 - RNA, 19 nt, Homo sapiens
gaaagugacaggaaacaug

SEQ ID NO: 548013 - RNA, 19 nt, Homo sapiens
aaaccugcuuguucaaaua

SEQ ID NO: 548014 - RNA, 19 nt, Homo sapiens
acaaagauacucaggauuu

SEQ ID NO: 548015 - RNA, 19 nt, Homo sapiens
gagacaacaguacauauaa

SEQ ID NO: 548016 - RNA, 19 nt, Homo sapiens
ucaagagaguguaguuauu

SEQ ID NO: 548017 - RNA, 19 nt, Homo sapiens
gcaaagcuuucagaaccua

SEQ ID NO: 548018 - RNA, 19 nt, Homo sapiens
cgaagaaguuagaggacua

SEQ ID NO: 548019 - RNA, 19 nt, Homo sapiens
gagcaaggguaauccuaga

SEQ ID NO: 548020 - RNA, 19 nt, Homo sapiens
gaucccaaguuacccagua

SEQ ID NO: 548021 - RNA, 19 nt, Homo sapiens
gagcuuggagaaacaaaua

SEQ ID NO: 548022 - RNA, 19 nt, Homo sapiens
gcacaugcaauuuggguuu

SEQ ID NO: 548023 - RNA, 19 nt, Homo sapiens
gggaagagacuauuucugu

SEQ ID NO: 548024 - RNA, 19 nt, Homo sapiens
guacauggaugggccagaa

SEQ ID NO: 548025 - RNA, 19 nt, Homo sapiens
gaaggagcuuggagaaaca

SEQ ID NO: 548026 - RNA, 19 nt, Homo sapiens
gacagacucuccacaagga

SEQ ID NO: 548027 - RNA, 19 nt, Homo sapiens
gaaguuagaggacuauaca

SEQ ID NO: 548028 - RNA, 19 nt, Homo sapiens
ccaaaucuauuguugucuu

SEQ ID NO: 548029 - RNA, 19 nt, Homo sapiens
ggaaacaugccaacucaau

SEQ ID NO: 548030 - RNA, 19 nt, Homo sapiens
gcagcuggcuaccaaagga

SEQ ID NO: 548031 - RNA, 19 nt, Homo sapiens
ggaccgcuguuguuccauu

SEQ ID NO: 548032 - RNA, 19 nt, Homo sapiens
gauggaggaugccuuguca

SEQ ID NO: 548033 - RNA, 19 nt, Homo sapiens
ugagacaacaguacauaua

SEQ ID NO: 548034 - RNA, 19 nt, Homo sapiens
caagggagaacucauuuga

SEQ ID NO: 548035 - RNA, 19 nt, Homo sapiens
cguaagauguccuccuuga

SEQ ID NO: 548036 - RNA, 19 nt, Homo sapiens
gggauggcuuguaggauuu

SEQ ID NO: 548037 - RNA, 19 nt, Homo sapiens
cuauugugcucuuucauuu

SEQ ID NO: 548038 - RNA, 19 nt, Homo sapiens
gaaagcuacugaaauaagc

SEQ ID NO: 548039 - RNA, 19 nt, Homo sapiens
caucuccucuccuuacaaa

SEQ ID NO: 548040 - RNA, 19 nt, Homo sapiens
ccacccaaaucuauuguug

SEQ ID NO: 548041 - RNA, 19 nt, Homo sapiens
acacaaagauacucaggau

SEQ ID NO: 548042 - RNA, 19 nt, Homo sapiens
agacaucucugagguauca

SEQ ID NO: 548043 - RNA, 19 nt, Homo sapiens
ggaaaagaauugcaaggaa

SEQ ID NO: 548044 - RNA, 19 nt, Homo sapiens
ccaacucaaucccucuuaa

SEQ ID NO: 548045 - RNA, 19 nt, Homo sapiens
uauaugcaaucgaaaguga

SEQ ID NO: 548046 - RNA, 19 nt, Homo sapiens
gcaaggagaagcccacuca

SEQ ID NO: 548047 - RNA, 19 nt, Homo sapiens
caggaaacaugccaacuca

SEQ ID NO: 548048 - RNA, 19 nt, Homo sapiens
gauaauagagggcuggaau

SEQ ID NO: 548049 - RNA, 19 nt, Homo sapiens
guccauggcugaguuuauu

SEQ ID NO: 548050 - RNA, 19 nt, Homo sapiens
gcagccacacguuguauaa

SEQ ID NO: 548051 - RNA, 19 nt, Homo sapiens
caaagauacucaggauuuc

SEQ ID NO: 548052 - RNA, 19 nt, Homo sapiens
gccaagaagugaaggaauc

SEQ ID NO: 548053 - RNA, 19 nt, Homo sapiens
gcaaggguaauccuagaaa

SEQ ID NO: 548054 - RNA, 19 nt, Homo sapiens
ugaaauaagcugugauugu

SEQ ID NO: 548055 - RNA, 19 nt, Homo sapiens
cgaggucgauucuccaaau

SEQ ID NO: 548056 - RNA, 19 nt, Homo sapiens
gaaguuagccccaaagaga

SEQ ID NO: 548057 - RNA, 19 nt, Homo sapiens
gugcaggccucucgcaaga

SEQ ID NO: 548058 - RNA, 19 nt, Homo sapiens
ccaaauagcaauacaaacu

SEQ ID NO: 548059 - RNA, 19 nt, Homo sapiens
auugaaaccucuuccagua

SEQ ID NO: 548060 - RNA, 19 nt, Homo sapiens
caagagaguguaguuauug

SEQ ID NO: 548061 - RNA, 19 nt, Homo sapiens
gcagacagacucuccacaa

SEQ ID NO: 548062 - RNA, 19 nt, Homo sapiens
gcuuugugcugauucauau

SEQ ID NO: 548063 - RNA, 19 nt, Homo sapiens
cucaaucccucuuaaugua

SEQ ID NO: 548064 - RNA, 19 nt, Homo sapiens
ugggauggcuuguaggauu

SEQ ID NO: 548065 - RNA, 19 nt, Homo sapiens
ccaaauaagaaguggaauu

SEQ ID NO: 548066 - RNA, 19 nt, Homo sapiens
ccaucaguauuaacuauug

SEQ ID NO: 548067 - RNA, 19 nt, Homo sapiens
uaauagagggcuggaauuu

SEQ ID NO: 548068 - RNA, 19 nt, Homo sapiens
ggacauacuagaguugauu

SEQ ID NO: 548069 - RNA, 19 nt, Homo sapiens
uaaaccugcuuguucaaau

SEQ ID NO: 548070 - RNA, 19 nt, Homo sapiens
aaagagaucagcaguugaa

SEQ ID NO: 548071 - RNA, 19 nt, Homo sapiens
gaguguaguuauuguggaa

SEQ ID NO: 548072 - RNA, 19 nt, Homo sapiens
uaacaugugcggaagaaga

SEQ ID NO: 548073 - RNA, 19 nt, Homo sapiens
agccagaccuucacacauu

SEQ ID NO: 548074 - RNA, 19 nt, Homo sapiens
gcaguccgauggagaugga

SEQ ID NO: 548075 - RNA, 19 nt, Homo sapiens
aaucgaaagugacaggaaa

SEQ ID NO: 548076 - RNA, 19 nt, Homo sapiens
gcccuuggauugcauguuc

SEQ ID NO: 548077 - RNA, 19 nt, Homo sapiens
gguauaugcccuuggauug

SEQ ID NO: 548078 - RNA, 19 nt, Homo sapiens
ccuaauccaaugaguguua

SEQ ID NO: 548079 - RNA, 19 nt, Homo sapiens
ggaagagguuucauugaua

SEQ ID NO: 548080 - RNA, 19 nt, Homo sapiens
ggacagaaaccauauaauu

SEQ ID NO: 548081 - RNA, 19 nt, Homo sapiens
gggaagggcuacauuagua

SEQ ID NO: 548082 - RNA, 19 nt, Homo sapiens
agacaggccucaaguauuu

SEQ ID NO: 548083 - RNA, 19 nt, Homo sapiens
aaacaauccuucagugaua

SEQ ID NO: 548084 - RNA, 19 nt, Homo sapiens
gggaagaaauugcaaguga

SEQ ID NO: 548085 - RNA, 19 nt, Homo sapiens
ugucuuaggucaagucuua

SEQ ID NO: 548086 - RNA, 19 nt, Homo sapiens
gggagaggcuucagaugua

SEQ ID NO: 548087 - RNA, 19 nt, Homo sapiens
ggaauucagucagaguuua

SEQ ID NO: 548088 - RNA, 19 nt, Homo sapiens
gaaggaauaucuauaaugc

SEQ ID NO: 548089 - RNA, 19 nt, Homo sapiens
ggacagaaaccuuccaauu

SEQ ID NO: 548090 - RNA, 19 nt, Homo sapiens
gcgcuugaaucuugauaua

SEQ ID NO: 548091 - RNA, 19 nt, Homo sapiens
ggucuugacuugcaccaua

SEQ ID NO: 548092 - RNA, 19 nt, Homo sapiens
gaucagcacuuacaguuca

SEQ ID NO: 548093 - RNA, 19 nt, Homo sapiens
ccucaagacucuaccauaa

SEQ ID NO: 548094 - RNA, 19 nt, Homo sapiens
gaagagguuucauugauag

SEQ ID NO: 548095 - RNA, 19 nt, Homo sapiens
cagagaaacuguacaaauc

SEQ ID NO: 548096 - RNA, 19 nt, Homo sapiens
caaauacgcucagcagaga

SEQ ID NO: 548097 - RNA, 19 nt, Homo sapiens
gaggaaggaauaucuauaa

SEQ ID NO: 548098 - RNA, 19 nt, Homo sapiens
gcacauuuaucaccucaau

SEQ ID NO: 548099 - RNA, 19 nt, Homo sapiens
gacagaaaccuuccaauug

SEQ ID NO: 548100 - RNA, 19 nt, Homo sapiens
gaagaaauugcaagugauu

SEQ ID NO: 548101 - RNA, 19 nt, Homo sapiens
cagcagaucugggaagaaa

SEQ ID NO: 548102 - RNA, 19 nt, Homo sapiens
agagagaccuuauaacugu

SEQ ID NO: 548103 - RNA, 19 nt, Homo sapiens
acagaaaccuuccaauugu

SEQ ID NO: 548104 - RNA, 19 nt, Homo sapiens
gguacagugugauauuuaa

SEQ ID NO: 548105 - RNA, 19 nt, Homo sapiens
gacagaaaccauauaauug

SEQ ID NO: 548106 - RNA, 19 nt, Homo sapiens
gguaaggaauucagucaga

SEQ ID NO: 548107 - RNA, 19 nt, Homo sapiens
gcagagaaacuguacaaau

SEQ ID NO: 548108 - RNA, 19 nt, Homo sapiens
ggauauagcaacccaaaga

SEQ ID NO: 548109 - RNA, 19 nt, Homo sapiens
ucaccucaauuaucucuuu

SEQ ID NO: 548110 - RNA, 19 nt, Homo sapiens
ggagagagaccuuauaacu

SEQ ID NO: 548111 - RNA, 19 nt, Homo sapiens
ggaagaaauugcaagugau

SEQ ID NO: 548112 - RNA, 19 nt, Homo sapiens
aaccugagaugaagacuuu

SEQ ID NO: 548113 - RNA, 19 nt, Homo sapiens
cuagagcacugucucacua

SEQ ID NO: 548114 - RNA, 19 nt, Homo sapiens
ucagaaacaucagagaauu

SEQ ID NO: 548115 - RNA, 19 nt, Homo sapiens
agauguagaucagcacuua

SEQ ID NO: 548116 - RNA, 19 nt, Homo sapiens
ggaaggaauaucuauaaug

SEQ ID NO: 548117 - RNA, 19 nt, Homo sapiens
gcagaucugggaagaaauu

SEQ ID NO: 548118 - RNA, 19 nt, Homo sapiens
gagaugugaugcuggagaa

SEQ ID NO: 548119 - RNA, 19 nt, Homo sapiens
gggagggccuucauucaug

SEQ ID NO: 548120 - RNA, 19 nt, Homo sapiens
auaaagagcucucaguucu

SEQ ID NO: 548121 - RNA, 19 nt, Homo sapiens
gaaaauccauccaaaugug

SEQ ID NO: 548122 - RNA, 19 nt, Homo sapiens
aaaugguccucauaucuuu

SEQ ID NO: 548123 - RNA, 19 nt, Homo sapiens
caaaugguccucauaucuu

SEQ ID NO: 548124 - RNA, 19 nt, Homo sapiens
guaaacaauccuucaguga

SEQ ID NO: 548125 - RNA, 19 nt, Homo sapiens
gaagcuguaucgagaugug

SEQ ID NO: 548126 - RNA, 19 nt, Homo sapiens
uggaagagguuucauugau

SEQ ID NO: 548127 - RNA, 19 nt, Homo sapiens
cgagauacuuuccacuuuc

SEQ ID NO: 548128 - RNA, 19 nt, Homo sapiens
ccgagauacuuuccacuuu

SEQ ID NO: 548129 - RNA, 19 nt, Homo sapiens
gagaaaagccauacaaaug

SEQ ID NO: 548130 - RNA, 19 nt, Homo sapiens
ucaagacucuaccauaaag

SEQ ID NO: 548131 - RNA, 19 nt, Homo sapiens
gaacuucuuccucuuaucu

SEQ ID NO: 548132 - RNA, 19 nt, Homo sapiens
caggagagagaccuuauaa

SEQ ID NO: 548133 - RNA, 19 nt, Homo sapiens
ggaagggcuacauuaguaa

SEQ ID NO: 548134 - RNA, 19 nt, Homo sapiens
gagaaacuguacaaaucug

SEQ ID NO: 548135 - RNA, 19 nt, Homo sapiens
ugacgugugugguaaggaa

SEQ ID NO: 548136 - RNA, 19 nt, Homo sapiens
guggaaagaagcuuguaua

SEQ ID NO: 548137 - RNA, 19 nt, Homo sapiens
gagagagaccuuauaacug

SEQ ID NO: 548138 - RNA, 19 nt, Homo sapiens
ucagugauauguccaucuu

SEQ ID NO: 548139 - RNA, 19 nt, Homo sapiens
gaugaagacuuuuccagaa

SEQ ID NO: 548140 - RNA, 19 nt, Homo sapiens
aaagaagccuuggcgaaga

SEQ ID NO: 548141 - RNA, 19 nt, Homo sapiens
cguaaguguuguacauauu

SEQ ID NO: 548142 - RNA, 19 nt, Homo sapiens
gauccaaccugagaugaag

SEQ ID NO: 548143 - RNA, 19 nt, Homo sapiens
gaaaagccauacaaaugug

SEQ ID NO: 548144 - RNA, 19 nt, Homo sapiens
ccaauugugggaagaguaa

SEQ ID NO: 548145 - RNA, 19 nt, Homo sapiens
ggguacagugugauauuua

SEQ ID NO: 548146 - RNA, 19 nt, Homo sapiens
gagauacuuuccacuuucu

SEQ ID NO: 548147 - RNA, 19 nt, Homo sapiens
caucagagaauucauacug

SEQ ID NO: 548148 - RNA, 19 nt, Homo sapiens
gauacuuuccacuuucuaa

SEQ ID NO: 548149 - RNA, 19 nt, Homo sapiens
gagaaaauccauccaaaug

SEQ ID NO: 548150 - RNA, 19 nt, Homo sapiens
gaaacuguacaaaucugaa

SEQ ID NO: 548151 - RNA, 19 nt, Homo sapiens
ugugaaauaugugguaaga

SEQ ID NO: 548152 - RNA, 19 nt, Homo sapiens
gcgaagagcagagguuuag

SEQ ID NO: 548153 - RNA, 19 nt, Homo sapiens
ucaaaucaguguaauuagc

SEQ ID NO: 548154 - RNA, 19 nt, Homo sapiens
gcacuuacaguucauugca

SEQ ID NO: 548155 - RNA, 19 nt, Homo sapiens
ggagaggcuucagauguag

SEQ ID NO: 548156 - RNA, 19 nt, Homo sapiens
ccaaagagaagggaauuca

SEQ ID NO: 548157 - RNA, 19 nt, Homo sapiens
caguguaauuagcacauuu

SEQ ID NO: 548158 - RNA, 19 nt, Homo sapiens
gauaggcuagauuugcaua

SEQ ID NO: 548159 - RNA, 19 nt, Homo sapiens
ugggagagaaacauuauaa

SEQ ID NO: 548160 - RNA, 19 nt, Homo sapiens
gaagagcagagguuuagag

SEQ ID NO: 548161 - RNA, 19 nt, Homo sapiens
agugauauguccaucuuug

SEQ ID NO: 548162 - RNA, 19 nt, Homo sapiens
uaaacaauccuucagugau

SEQ ID NO: 548163 - RNA, 19 nt, Homo sapiens
cagaaaccuuccaauugug

SEQ ID NO: 548164 - RNA, 19 nt, Homo sapiens
ugaggaaggaauaucuaua

SEQ ID NO: 548165 - RNA, 19 nt, Homo sapiens
ccauaaagagcucucaguu

SEQ ID NO: 548166 - RNA, 19 nt, Homo sapiens
ggcaagauccaaccugaga

SEQ ID NO: 548167 - RNA, 19 nt, Homo sapiens
caaccauuccaccgagaua

SEQ ID NO: 548168 - RNA, 19 nt, Homo sapiens
cugcaaauucccuaaagua

SEQ ID NO: 548169 - RNA, 19 nt, Homo sapiens
auacaaaugugaggagugu

SEQ ID NO: 548170 - RNA, 19 nt, Homo sapiens
caucagagaguccauacug

SEQ ID NO: 548171 - RNA, 19 nt, Homo sapiens
caaaucaguguaauuagca

SEQ ID NO: 548172 - RNA, 19 nt, Homo sapiens
ucaaaugguccucauaucu

SEQ ID NO: 548173 - RNA, 19 nt, Homo sapiens
cagcagagaaacuguacaa

SEQ ID NO: 548174 - RNA, 19 nt, Homo sapiens
aagcuucuguuacaucuca

SEQ ID NO: 548175 - RNA, 19 nt, Homo sapiens
cauaaagagcucucaguuc

SEQ ID NO: 548176 - RNA, 19 nt, Homo sapiens
gaagcaggaccacaugaag

SEQ ID NO: 548177 - RNA, 19 nt, Homo sapiens
uauagcaacccaaagagaa

SEQ ID NO: 548178 - RNA, 19 nt, Homo sapiens
gaugauagucaccuuuagu

SEQ ID NO: 548179 - RNA, 19 nt, Homo sapiens
ggaaagggcuacaauagua

SEQ ID NO: 548180 - RNA, 19 nt, Homo sapiens
gagagaaacuguauaauug

SEQ ID NO: 548181 - RNA, 19 nt, Homo sapiens
gauaagagcuuucgucaga

SEQ ID NO: 548182 - RNA, 19 nt, Homo sapiens
gguaagagcuucuguggua

SEQ ID NO: 548183 - RNA, 19 nt, Homo sapiens
gggaagagauuuacucaaa

SEQ ID NO: 548184 - RNA, 19 nt, Homo sapiens
gggaaaggcuucagucgua

SEQ ID NO: 548185 - RNA, 19 nt, Homo sapiens
ggaagaacauuguacagaa

SEQ ID NO: 548186 - RNA, 19 nt, Homo sapiens
gcaauaaagucuucacuca

SEQ ID NO: 548187 - RNA, 19 nt, Homo sapiens
gaauaccacuagaaacaua

SEQ ID NO: 548188 - RNA, 19 nt, Homo sapiens
gaucagcacuuaauaguca

SEQ ID NO: 548189 - RNA, 19 nt, Homo sapiens
gagagaaaccuuauaauug

SEQ ID NO: 548190 - RNA, 19 nt, Homo sapiens
ggagagaaacuguauaauu

SEQ ID NO: 548191 - RNA, 19 nt, Homo sapiens
ggagagaaaccuuauaauu

SEQ ID NO: 548192 - RNA, 19 nt, Homo sapiens
ggagagaaaugcuauaagu

SEQ ID NO: 548193 - RNA, 19 nt, Homo sapiens
gagacaagauccaaacuga

SEQ ID NO: 548194 - RNA, 19 nt, Homo sapiens
ggagagagaccauacaauu

SEQ ID NO: 548195 - RNA, 19 nt, Homo sapiens
ucaaagaacugcugaauac

SEQ ID NO: 548196 - RNA, 19 nt, Homo sapiens
gagguuggaucuugacuuu

SEQ ID NO: 548197 - RNA, 19 nt, Homo sapiens
gaucagcacuuaauguuca

SEQ ID NO: 548198 - RNA, 19 nt, Homo sapiens
gaacaucagagaauccaua

SEQ ID NO: 548199 - RNA, 19 nt, Homo sapiens
gaagaacauuguacagaau

SEQ ID NO: 548200 - RNA, 19 nt, Homo sapiens
cgucagagaucagcacuua

SEQ ID NO: 548201 - RNA, 19 nt, Homo sapiens
gaaaagauuuggaugauga

SEQ ID NO: 548202 - RNA, 19 nt, Homo sapiens
aaacaccucucaaauguga

SEQ ID NO: 548203 - RNA, 19 nt, Homo sapiens
ugugguagaucaagacuua

SEQ ID NO: 548204 - RNA, 19 nt, Homo sapiens
gagagaaaccguucaaaug

SEQ ID NO: 548205 - RNA, 19 nt, Homo sapiens
agaaacaccucucaaaugu

SEQ ID NO: 548206 - RNA, 19 nt, Homo sapiens
aaacugagauggagacugu

SEQ ID NO: 548207 - RNA, 19 nt, Homo sapiens
gauggagacuguuucagaa

SEQ ID NO: 548208 - RNA, 19 nt, Homo sapiens
ggacguggcuguggucuuc

SEQ ID NO: 548209 - RNA, 19 nt, Homo sapiens
gagagaaaccauacaaaug

SEQ ID NO: 548210 - RNA, 19 nt, Homo sapiens
gagaaaccguucaaaugug

SEQ ID NO: 548211 - RNA, 19 nt, Homo sapiens
gguaaggaauucagucaga

SEQ ID NO: 548212 - RNA, 19 nt, Homo sapiens
ggagagaaaccauacaaau

SEQ ID NO: 548213 - RNA, 19 nt, Homo sapiens
guucacaucugcaaacuca

SEQ ID NO: 548214 - RNA, 19 nt, Homo sapiens
gggcuacaauaguaaguuu

SEQ ID NO: 548215 - RNA, 19 nt, Homo sapiens
gaaagggcuacaauaguaa

SEQ ID NO: 548216 - RNA, 19 nt, Homo sapiens
gagaaaccauuccgaugug

SEQ ID NO: 548217 - RNA, 19 nt, Homo sapiens
caacucgucugacccauca

SEQ ID NO: 548218 - RNA, 19 nt, Homo sapiens
ggagagaaaccguucaaau

SEQ ID NO: 548219 - RNA, 19 nt, Homo sapiens
caccagagaucccauagug

SEQ ID NO: 548220 - RNA, 19 nt, Homo sapiens
gagcuucugugguagauca

SEQ ID NO: 548221 - RNA, 19 nt, Homo sapiens
gcucucaguucuccaaaga

SEQ ID NO: 548222 - RNA, 19 nt, Homo sapiens
auaaauagcucucaguucu

SEQ ID NO: 548223 - RNA, 19 nt, Homo sapiens
gugaugugauggugcaaua

SEQ ID NO: 548224 - RNA, 19 nt, Homo sapiens
gagaaaacauggaagugua

SEQ ID NO: 548225 - RNA, 19 nt, Homo sapiens
gagagagaccauacaauug

SEQ ID NO: 548226 - RNA, 19 nt, Homo sapiens
gagaugugaugcuggagaa

SEQ ID NO: 548227 - RNA, 19 nt, Homo sapiens
gagaaaccauacaaaugug

SEQ ID NO: 548228 - RNA, 19 nt, Homo sapiens
gcaggacuaucuguaauuc

SEQ ID NO: 548229 - RNA, 19 nt, Homo sapiens
gggaaaagauuuacucaga

SEQ ID NO: 548230 - RNA, 19 nt, Homo sapiens
gguuggaucuugacuuuca

SEQ ID NO: 548231 - RNA, 19 nt, Homo sapiens
agucguagaucagcacuua

SEQ ID NO: 548232 - RNA, 19 nt, Homo sapiens
ccagggcaauggauauaaa

SEQ ID NO: 548233 - RNA, 19 nt, Homo sapiens
gaauguucauguuggagaa

SEQ ID NO: 548234 - RNA, 19 nt, Homo sapiens
auacaaaugugaugagugu

SEQ ID NO: 548235 - RNA, 19 nt, Homo sapiens
ggaaaggauuuuacacaaa

SEQ ID NO: 548236 - RNA, 19 nt, Homo sapiens
gcgcuugaaucuugauaug

SEQ ID NO: 548237 - RNA, 19 nt, Homo sapiens
guucaaauguguggaaugu

SEQ ID NO: 548238 - RNA, 19 nt, Homo sapiens
gacaagauccaaacugaga

SEQ ID NO: 548239 - RNA, 19 nt, Homo sapiens
gaagcuguaucgagaugug

SEQ ID NO: 548240 - RNA, 19 nt, Homo sapiens
caggagagaaacuguauaa

SEQ ID NO: 548241 - RNA, 19 nt, Homo sapiens
uaauaggcauuccaugguu

SEQ ID NO: 548242 - RNA, 19 nt, Homo sapiens
caggagagaaaccuuauaa

SEQ ID NO: 548243 - RNA, 19 nt, Homo sapiens
gaaguaagagggaaaauga

SEQ ID NO: 548244 - RNA, 19 nt, Homo sapiens
gagaaaagccauacaaaug

SEQ ID NO: 548245 - RNA, 19 nt, Homo sapiens
gagaaaagccauacaaaug

SEQ ID NO: 548246 - RNA, 19 nt, Homo sapiens
gaaugugggaagagcuuua

SEQ ID NO: 548247 - RNA, 19 nt, Homo sapiens
uaagagcuuucgucagaga

SEQ ID NO: 548248 - RNA, 19 nt, Homo sapiens
gagaaaccuuauaauugug

SEQ ID NO: 548249 - RNA, 19 nt, Homo sapiens
ggaauucagucagaguuca

SEQ ID NO: 548250 - RNA, 19 nt, Homo sapiens
aauaaagucuucacucagu

SEQ ID NO: 548251 - RNA, 19 nt, Homo sapiens
ugcaggcccuucugaauuu

SEQ ID NO: 548252 - RNA, 19 nt, Homo sapiens
gaagacagcaauccaaagg

SEQ ID NO: 548253 - RNA, 19 nt, Homo sapiens
aacaggcgcuugaaucuug

SEQ ID NO: 548254 - RNA, 19 nt, Homo sapiens
cagcuucauucucaucaaa

SEQ ID NO: 548255 - RNA, 19 nt, Homo sapiens
ggaaaagauuuacucagaa

SEQ ID NO: 548256 - RNA, 19 nt, Homo sapiens
gaugugauacgugugauaa

SEQ ID NO: 548257 - RNA, 19 nt, Homo sapiens
ugacgugugugguaaggaa

SEQ ID NO: 548258 - RNA, 19 nt, Homo sapiens
guaauucacacaagacaga

SEQ ID NO: 548259 - RNA, 19 nt, Homo sapiens
gaagggaauucaggagaca

SEQ ID NO: 548260 - RNA, 19 nt, Homo sapiens
ggaaguguagggaguguga

SEQ ID NO: 548261 - RNA, 19 nt, Homo sapiens
ugaagaaugugggaaagga

SEQ ID NO: 548262 - RNA, 19 nt, Homo sapiens
gaugugauggugcaauaaa

SEQ ID NO: 548263 - RNA, 19 nt, Homo sapiens
aaccagagacagcugauua

SEQ ID NO: 548264 - RNA, 19 nt, Homo sapiens
gaacugcugaauaccacua

SEQ ID NO: 548265 - RNA, 19 nt, Homo sapiens
ggaagagauuuacucaaaa

SEQ ID NO: 548266 - RNA, 19 nt, Homo sapiens
agagaaaccauacaaaugu

SEQ ID NO: 548267 - RNA, 19 nt, Homo sapiens
gagaucagcacuuaauagu

SEQ ID NO: 548268 - RNA, 19 nt, Homo sapiens
agaaaucucauacguguga

SEQ ID NO: 548269 - RNA, 19 nt, Homo sapiens
gaagaaaagauuuggauga

SEQ ID NO: 548270 - RNA, 19 nt, Homo sapiens
gcuugaaucuugauaugca

SEQ ID NO: 548271 - RNA, 19 nt, Homo sapiens
auucacagcuucauucuca

SEQ ID NO: 548272 - RNA, 19 nt, Homo sapiens
aaaggagguuggaucuuga

SEQ ID NO: 548273 - RNA, 19 nt, Homo sapiens
caauuacacucaggagaga

SEQ ID NO: 548274 - RNA, 19 nt, Homo sapiens
gaggcaggacuaucuguaa

SEQ ID NO: 548275 - RNA, 19 nt, Homo sapiens
ggagugugauaugugcuuu

SEQ ID NO: 548276 - RNA, 19 nt, Homo sapiens
gaaaagccauacaaaugug

SEQ ID NO: 548277 - RNA, 19 nt, Homo sapiens
gaaaagccauacaaaugug

SEQ ID NO: 548278 - RNA, 19 nt, Homo sapiens
gaaaagccauacaaaugug

SEQ ID NO: 548279 - RNA, 19 nt, Homo sapiens
ggaaaacgcuucauuuaua

SEQ ID NO: 548280 - RNA, 19 nt, Homo sapiens
gggagaaacucuauaauug

SEQ ID NO: 548281 - RNA, 19 nt, Homo sapiens
ggagagagaccuuauaauu

SEQ ID NO: 548282 - RNA, 19 nt, Homo sapiens
gagaaacccuauaauugua

SEQ ID NO: 548283 - RNA, 19 nt, Homo sapiens
uguaagagcuuccguagua

SEQ ID NO: 548284 - RNA, 19 nt, Homo sapiens
gguaagagcuuuggucuga

SEQ ID NO: 548285 - RNA, 19 nt, Homo sapiens
gggaagagauuuacugaga

SEQ ID NO: 548286 - RNA, 19 nt, Homo sapiens
gcgagacccuucugaauuu

SEQ ID NO: 548287 - RNA, 19 nt, Homo sapiens
gagagaaacccuauaauug

SEQ ID NO: 548288 - RNA, 19 nt, Homo sapiens
ggagagaaacccuauaauu

SEQ ID NO: 548289 - RNA, 19 nt, Homo sapiens
gaacaucaaagaauccaua

SEQ ID NO: 548290 - RNA, 19 nt, Homo sapiens
ggagugaaaccucauauuu

SEQ ID NO: 548291 - RNA, 19 nt, Homo sapiens
gagaagccauauaauugua

SEQ ID NO: 548292 - RNA, 19 nt, Homo sapiens
gaucaggacuuuauguuca

SEQ ID NO: 548293 - RNA, 19 nt, Homo sapiens
gaacaaauuucaagugacu

SEQ ID NO: 548294 - RNA, 19 nt, Homo sapiens
gaagagauuuacugagaau

SEQ ID NO: 548295 - RNA, 19 nt, Homo sapiens
gcaggacuaucuauaauuc

SEQ ID NO: 548296 - RNA, 19 nt, Homo sapiens
guaaacagcuuucaguucu

SEQ ID NO: 548297 - RNA, 19 nt, Homo sapiens
gggaacaaauuucaaguga

SEQ ID NO: 548298 - RNA, 19 nt, Homo sapiens
guacaaaugugaggaaugu

SEQ ID NO: 548299 - RNA, 19 nt, Homo sapiens
uaacauaccuaucacucaa

SEQ ID NO: 548300 - RNA, 19 nt, Homo sapiens
gagagagaccuuauaauug

SEQ ID NO: 548301 - RNA, 19 nt, Homo sapiens
gagaaacucuauaauugug

SEQ ID NO: 548302 - RNA, 19 nt, Homo sapiens
caucaaaccugggaacaaa

SEQ ID NO: 548303 - RNA, 19 nt, Homo sapiens
gggagaagccauauaauug

SEQ ID NO: 548304 - RNA, 19 nt, Homo sapiens
ggcaagaucuuuauaagca

SEQ ID NO: 548305 - RNA, 19 nt, Homo sapiens
ccaaagagaagggaauuua

SEQ ID NO: 548306 - RNA, 19 nt, Homo sapiens
ggaagagauuuacugagaa

SEQ ID NO: 548307 - RNA, 19 nt, Homo sapiens
agagagaccuuauaauugu

SEQ ID NO: 548308 - RNA, 19 nt, Homo sapiens
gaaaucagcacuuaauagu

SEQ ID NO: 548309 - RNA, 19 nt, Homo sapiens
gugcacaguucaugccuua

SEQ ID NO: 548310 - RNA, 19 nt, Homo sapiens
gguaaggaauucaaucaga

SEQ ID NO: 548311 - RNA, 19 nt, Homo sapiens
caacuacagucaagagaga

SEQ ID NO: 548312 - RNA, 19 nt, Homo sapiens
gauggagacuguuucagaa

SEQ ID NO: 548313 - RNA, 19 nt, Homo sapiens
ggacguggcuguggucuuc

SEQ ID NO: 548314 - RNA, 19 nt, Homo sapiens
caacucaucuaacccauca

SEQ ID NO: 548315 - RNA, 19 nt, Homo sapiens
gagaagugaugcuggagaa

SEQ ID NO: 548316 - RNA, 19 nt, Homo sapiens
gaccuugacuuucaucaga

SEQ ID NO: 548317 - RNA, 19 nt, Homo sapiens
caucagagacuccacagua

SEQ ID NO: 548318 - RNA, 19 nt, Homo sapiens
gaggagagaaacccuauaa

SEQ ID NO: 548319 - RNA, 19 nt, Homo sapiens
gagaaaccauucagaugug

SEQ ID NO: 548320 - RNA, 19 nt, Homo sapiens
acacauaacuguuguacuc

SEQ ID NO: 548321 - RNA, 19 nt, Homo sapiens
gaguaaagccauacaaaug

SEQ ID NO: 548322 - RNA, 19 nt, Homo sapiens
gagaaacgguacaaaugug

SEQ ID NO: 548323 - RNA, 19 nt, Homo sapiens
gagagaaacgguacaaaug

SEQ ID NO: 548324 - RNA, 19 nt, Homo sapiens
ggagagaaaccauucaaau

SEQ ID NO: 548325 - RNA, 19 nt, Homo sapiens
gagcucacaucagcaaauu

SEQ ID NO: 548326 - RNA, 19 nt, Homo sapiens
gagagaccuuauaauugua

SEQ ID NO: 548327 - RNA, 19 nt, Homo sapiens
ggagagaaacgguacaaau

SEQ ID NO: 548328 - RNA, 19 nt, Homo sapiens
uaagagcuuuggucugaaa

SEQ ID NO: 548329 - RNA, 19 nt, Homo sapiens
aaucagcacuuaauaguca

SEQ ID NO: 548330 - RNA, 19 nt, Homo sapiens
cguaguagagcaaaucuua

SEQ ID NO: 548331 - RNA, 19 nt, Homo sapiens
gacuuuauguucaucguaa

SEQ ID NO: 548332 - RNA, 19 nt, Homo sapiens
gcacaguucaugccuuaaa

SEQ ID NO: 548333 - RNA, 19 nt, Homo sapiens
gaugcaggacuaucuauaa

SEQ ID NO: 548334 - RNA, 19 nt, Homo sapiens
ggagaaacucuauaauugu

SEQ ID NO: 548335 - RNA, 19 nt, Homo sapiens
caacaaagagaccaaagug

SEQ ID NO: 548336 - RNA, 19 nt, Homo sapiens
guaaagccauacaaaugug

SEQ ID NO: 548337 - RNA, 19 nt, Homo sapiens
gggaaaagauuuacucaga

SEQ ID NO: 548338 - RNA, 19 nt, Homo sapiens
gggaaaagauuuacucaga

SEQ ID NO: 548339 - RNA, 19 nt, Homo sapiens
gagugaaaccucauauuug

SEQ ID NO: 548340 - RNA, 19 nt, Homo sapiens
ggagacuguuucagaauca

SEQ ID NO: 548341 - RNA, 19 nt, Homo sapiens
ggagacagcaacccaaaga

SEQ ID NO: 548342 - RNA, 19 nt, Homo sapiens
gguacagugugauaguuaa

SEQ ID NO: 548343 - RNA, 19 nt, Homo sapiens
auacaaaugugaagagugu

SEQ ID NO: 548344 - RNA, 19 nt, Homo sapiens
ggaguaaagccauacaaau

SEQ ID NO: 548345 - RNA, 19 nt, Homo sapiens
acucagaauucacaacuuu

SEQ ID NO: 548346 - RNA, 19 nt, Homo sapiens
acucagaauucacaacuuu

SEQ ID NO: 548347 - RNA, 19 nt, Homo sapiens
ggagaagccauauaauugu

SEQ ID NO: 548348 - RNA, 19 nt, Homo sapiens
gagagaaaccauucagaug

SEQ ID NO: 548349 - RNA, 19 nt, Homo sapiens
gcucagcucuucguauuca

SEQ ID NO: 548350 - RNA, 19 nt, Homo sapiens
ggagagacaacauucaaau

SEQ ID NO: 548351 - RNA, 19 nt, Homo sapiens
ccuacgcacuggauccuua

SEQ ID NO: 548352 - RNA, 19 nt, Homo sapiens
gguuggaccuugacuuuca

SEQ ID NO: 548353 - RNA, 19 nt, Homo sapiens
agaccaaaguggagagaaa

SEQ ID NO: 548354 - RNA, 19 nt, Homo sapiens
gagauuuacugagaauuca

SEQ ID NO: 548355 - RNA, 19 nt, Homo sapiens
uaauaggcauuccaugguu

SEQ ID NO: 548356 - RNA, 19 nt, Homo sapiens
uuucaagacuccaugguaa

SEQ ID NO: 548357 - RNA, 19 nt, Homo sapiens
gaaugugggaagagcuuua

SEQ ID NO: 548358 - RNA, 19 nt, Homo sapiens
gagcuuuggucugaaauca

SEQ ID NO: 548359 - RNA, 19 nt, Homo sapiens
aaauggagauggagacugu

SEQ ID NO: 548360 - RNA, 19 nt, Homo sapiens
gagacuccauggugaugaa

SEQ ID NO: 548361 - RNA, 19 nt, Homo sapiens
agugaaaccucauauuugu

SEQ ID NO: 548362 - RNA, 19 nt, Homo sapiens
ggaaaagauuuacucagaa

SEQ ID NO: 548363 - RNA, 19 nt, Homo sapiens
ggaaaagauuuacucagaa

SEQ ID NO: 548364 - RNA, 19 nt, Homo sapiens
agagaaacccuauaauugu

SEQ ID NO: 548365 - RNA, 19 nt, Homo sapiens
gaaaacgcuucauuuauag

SEQ ID NO: 548366 - RNA, 19 nt, Homo sapiens
ucaggaacaucaaagaauc

SEQ ID NO: 548367 - RNA, 19 nt, Homo sapiens
gaaacuguaccgagaagug

SEQ ID NO: 548368 - RNA, 19 nt, Homo sapiens
uaauucacguuaagacaga

SEQ ID NO: 548369 - RNA, 19 nt, Homo sapiens
ggaagggauuuuauacaaa

SEQ ID NO: 548370 - RNA, 19 nt, Homo sapiens
gaauuuaggaggcaagauc

SEQ ID NO: 548371 - RNA, 19 nt, Homo sapiens
cagagauacuuuccacuuc

SEQ ID NO: 548372 - RNA, 19 nt, Homo sapiens
cauaacuguuguacucauu

SEQ ID NO: 548373 - RNA, 19 nt, Homo sapiens
acacuggaguaaagccaua

SEQ ID NO: 548374 - RNA, 19 nt, Homo sapiens
ugaaaccucauauuuguga

SEQ ID NO: 548375 - RNA, 19 nt, Homo sapiens
gaagagcauugugcacagu

SEQ ID NO: 548376 - RNA, 19 nt, Homo sapiens
gaaaagccauacaaaugug

SEQ ID NO: 548377 - RNA, 19 nt, Homo sapiens
gaaaagccauauagaugug

SEQ ID NO: 548378 - RNA, 19 nt, Homo sapiens
gagaaaagccauauagaug

SEQ ID NO: 548379 - RNA, 19 nt, Homo sapiens
ggaaagacauggaauaaaa

SEQ ID NO: 548380 - RNA, 19 nt, Homo sapiens
gaagaaauguuggaaguca

SEQ ID NO: 548381 - RNA, 19 nt, Homo sapiens
gaaguuagaagaaauguug

SEQ ID NO: 548382 - RNA, 19 nt, Homo sapiens
gagcagcuuuggauaauga

SEQ ID NO: 548383 - RNA, 19 nt, Homo sapiens
gaaaugagcagcuuuggau

SEQ ID NO: 548384 - RNA, 19 nt, Homo sapiens
caagauguaucaccuauag

SEQ ID NO: 548385 - RNA, 19 nt, Homo sapiens
gauaguaugucaguaguug

SEQ ID NO: 548386 - RNA, 19 nt, Homo sapiens
ugaccuggcucaaacuuaa

SEQ ID NO: 548387 - RNA, 19 nt, Homo sapiens
gcagaacuaucccgagguu

SEQ ID NO: 548388 - RNA, 19 nt, Homo sapiens
ccagaaacuucaaaugugu

SEQ ID NO: 548389 - RNA, 19 nt, Homo sapiens
gagaugugaugguggagaa

SEQ ID NO: 548390 - RNA, 19 nt, Homo sapiens
guaggaaagacauggaaua

SEQ ID NO: 548391 - RNA, 19 nt, Homo sapiens
gaagacagggaaauuuaga

SEQ ID NO: 548392 - RNA, 19 nt, Homo sapiens
uagaagaaauguuggaagu

SEQ ID NO: 548393 - RNA, 19 nt, Homo sapiens
ccgaagacagggaaauuua

SEQ ID NO: 548394 - RNA, 19 nt, Homo sapiens
gcucaaacuuaaacuugga

SEQ ID NO: 548395 - RNA, 19 nt, Homo sapiens
agacagggaaauuuagaua

SEQ ID NO: 548396 - RNA, 19 nt, Homo sapiens
uguaucaccuauagaaaga

SEQ ID NO: 548397 - RNA, 19 nt, Homo sapiens
agaaagaaaugagcagcuu

SEQ ID NO: 548398 - RNA, 19 nt, Homo sapiens
uaggaaagacauggaauaa

SEQ ID NO: 548399 - RNA, 19 nt, Homo sapiens
gcauacauuccuugaguga

SEQ ID NO: 548400 - RNA, 19 nt, Homo sapiens
ggacucauauaugcauaca

SEQ ID NO: 548401 - RNA, 19 nt, Homo sapiens
gaaggacucauauaugcau

SEQ ID NO: 548402 - RNA, 19 nt, Homo sapiens
uggaaggacucauauaugc

SEQ ID NO: 548403 - RNA, 19 nt, Homo sapiens
cuucguagcagccaucuuu

SEQ ID NO: 548404 - RNA, 19 nt, Homo sapiens
ggauuugaaguuagaagaa

SEQ ID NO: 548405 - RNA, 19 nt, Homo sapiens
uuaggaaccugcugucagu

SEQ ID NO: 548406 - RNA, 19 nt, Homo sapiens
caaaagaugagcagaacua

SEQ ID NO: 548407 - RNA, 19 nt, Homo sapiens
gggcugugguuguaaacug

SEQ ID NO: 548408 - RNA, 19 nt, Homo sapiens
cuucugggcugugguugua

SEQ ID NO: 548409 - RNA, 19 nt, Homo sapiens
guuggaaggacucauauau

SEQ ID NO: 548410 - RNA, 19 nt, Homo sapiens
gucaguauguaaaccagaa

SEQ ID NO: 548411 - RNA, 19 nt, Homo sapiens
gggaaauuuagauaccuua

SEQ ID NO: 548412 - RNA, 19 nt, Homo sapiens
gauguaucaccuauagaaa

SEQ ID NO: 548413 - RNA, 19 nt, Homo sapiens
aacaagauguaucaccuau

SEQ ID NO: 548414 - RNA, 19 nt, Homo sapiens
cauccacccuucaaacaag

SEQ ID NO: 548415 - RNA, 19 nt, Homo sapiens
guaaaccagaaacuucaaa

SEQ ID NO: 548416 - RNA, 19 nt, Homo sapiens
aaacaagauguaucaccua

SEQ ID NO: 548417 - RNA, 19 nt, Homo sapiens
accagaaacuucaaaugug

SEQ ID NO: 548418 - RNA, 19 nt, Homo sapiens
ucuaugaccuggcucaaac

SEQ ID NO: 548419 - RNA, 19 nt, Homo sapiens
gcauccacccuucaaacaa

SEQ ID NO: 548420 - RNA, 19 nt, Homo sapiens
aaccagaaacuucaaaugu

SEQ ID NO: 548421 - RNA, 19 nt, Homo sapiens
aaacugugagcacuacaaa

SEQ ID NO: 548422 - RNA, 19 nt, Homo sapiens
aaugagcagcuuuggauaa

SEQ ID NO: 548423 - RNA, 19 nt, Homo sapiens
agauguaucaccuauagaa

SEQ ID NO: 548424 - RNA, 19 nt, Homo sapiens
uauguaaaccagaaacuuc

SEQ ID NO: 548425 - RNA, 19 nt, Homo sapiens
gaagcuguaccgagaugug

SEQ ID NO: 548426 - RNA, 19 nt, Homo sapiens
guaugucaguaguuguguu

SEQ ID NO: 548427 - RNA, 19 nt, Homo sapiens
uagauaguaugucaguagu

SEQ ID NO: 548428 - RNA, 19 nt, Homo sapiens
ggaaggacucauauaugca

SEQ ID NO: 548429 - RNA, 19 nt, Homo sapiens
cuucaaacaagauguauca

SEQ ID NO: 548430 - RNA, 19 nt, Homo sapiens
uaacuucugggcugugguu

SEQ ID NO: 548431 - RNA, 19 nt, Homo sapiens
aauguuggaaggacucaua

SEQ ID NO: 548432 - RNA, 19 nt, Homo sapiens
ccagaaggaagaauuaaaa

SEQ ID NO: 548433 - RNA, 19 nt, Homo sapiens
aaaccagaaacuucaaaug

SEQ ID NO: 548434 - RNA, 19 nt, Homo sapiens
augcauacauuccuugagu

SEQ ID NO: 548435 - RNA, 19 nt, Homo sapiens
cgaagacagggaaauuuag

SEQ ID NO: 548436 - RNA, 19 nt, Homo sapiens
gacgacagcaacccgaaga

SEQ ID NO: 548437 - RNA, 19 nt, Homo sapiens
guauguaaaccagaaacuu

SEQ ID NO: 548438 - RNA, 19 nt, Homo sapiens
auucuucccugacuucuca

SEQ ID NO: 548439 - RNA, 19 nt, Homo sapiens
ucaccuauagaaagaaaug

SEQ ID NO: 548440 - RNA, 19 nt, Homo sapiens
uuagauaguaugucaguag

SEQ ID NO: 548441 - RNA, 19 nt, Homo sapiens
auacauuccuugagugacu

SEQ ID NO: 548442 - RNA, 19 nt, Homo sapiens
uaugucaguaguuguguuu

SEQ ID NO: 548443 - RNA, 19 nt, Homo sapiens
uaaacugugagcacuacaa

SEQ ID NO: 548444 - RNA, 19 nt, Homo sapiens
cuugagugacuaugaauga

SEQ ID NO: 548445 - RNA, 19 nt, Homo sapiens
uuuccuggcuuuggugauu

SEQ ID NO: 548446 - RNA, 19 nt, Homo sapiens
uggcucaaacuuaaacuug

SEQ ID NO: 548447 - RNA, 19 nt, Homo sapiens
ggugauucuucccugacuu

SEQ ID NO: 548448 - RNA, 19 nt, Homo sapiens
gugaugguggagaacuuua

SEQ ID NO: 548449 - RNA, 19 nt, Homo sapiens
ucucuugguuucugucagu

SEQ ID NO: 548450 - RNA, 19 nt, Homo sapiens
ucugggcugugguuguaaa

SEQ ID NO: 548451 - RNA, 19 nt, Homo sapiens
aaaugagcagcuuuggaua

SEQ ID NO: 548452 - RNA, 19 nt, Homo sapiens
gcuuagcaauugggagcuu

SEQ ID NO: 548453 - RNA, 19 nt, Homo sapiens
ggcugugguuguaaacugu

SEQ ID NO: 548454 - RNA, 19 nt, Homo sapiens
gaccuggcucaaacuuaaa

SEQ ID NO: 548455 - RNA, 19 nt, Homo sapiens
ggaaauuuagauaccuuac

SEQ ID NO: 548456 - RNA, 19 nt, Homo sapiens
acaagauguaucaccuaua

SEQ ID NO: 548457 - RNA, 19 nt, Homo sapiens
cccagaaggaagaauuaaa

SEQ ID NO: 548458 - RNA, 19 nt, Homo sapiens
uggguuucauuagugcuua

SEQ ID NO: 548459 - RNA, 19 nt, Homo sapiens
aaggacucauauaugcaua

SEQ ID NO: 548460 - RNA, 19 nt, Homo sapiens
augagcagcuuuggauaau

SEQ ID NO: 548461 - RNA, 19 nt, Homo sapiens
aggaagcuguaccgagaug

SEQ ID NO: 548462 - RNA, 19 nt, Homo sapiens
ggcauccacccuucaaaca

SEQ ID NO: 548463 - RNA, 19 nt, Homo sapiens
gaacagagaucagcaaauu

SEQ ID NO: 548464 - RNA, 19 nt, Homo sapiens
ggagaaaccuuauaaaugu

SEQ ID NO: 548465 - RNA, 19 nt, Homo sapiens
gguaagggcuucauuugua

SEQ ID NO: 548466 - RNA, 19 nt, Homo sapiens
gaucaaaucuuacaguuca

SEQ ID NO: 548467 - RNA, 19 nt, Homo sapiens
ggagagaagucauacauau

SEQ ID NO: 548468 - RNA, 19 nt, Homo sapiens
gcucaaaucuuuacauuca

SEQ ID NO: 548469 - RNA, 19 nt, Homo sapiens
ggagagaaaccauauaauu

SEQ ID NO: 548470 - RNA, 19 nt, Homo sapiens
gcagagaaaccuuauaauu

SEQ ID NO: 548471 - RNA, 19 nt, Homo sapiens
gaaaguacaugugggagaa

SEQ ID NO: 548472 - RNA, 19 nt, Homo sapiens
gaucagcacuuaauguuca

SEQ ID NO: 548473 - RNA, 19 nt, Homo sapiens
gcagauggucccaauaaua

SEQ ID NO: 548474 - RNA, 19 nt, Homo sapiens
gagcagcuuuggauaauga

SEQ ID NO: 548475 - RNA, 19 nt, Homo sapiens
gagagaaaccauauaauug

SEQ ID NO: 548476 - RNA, 19 nt, Homo sapiens
gagagaaacccuauaaaug

SEQ ID NO: 548477 - RNA, 19 nt, Homo sapiens
gagauaagccauacaaaug

SEQ ID NO: 548478 - RNA, 19 nt, Homo sapiens
gaaaugagcagcuuuggau

SEQ ID NO: 548479 - RNA, 19 nt, Homo sapiens
caagauguaucaccuauag

SEQ ID NO: 548480 - RNA, 19 nt, Homo sapiens
ggcaagggauuuagucgua

SEQ ID NO: 548481 - RNA, 19 nt, Homo sapiens
aaucagagcucacgacuuc

SEQ ID NO: 548482 - RNA, 19 nt, Homo sapiens
gagagaagccauacaaaug

SEQ ID NO: 548483 - RNA, 19 nt, Homo sapiens
ggagagaaacccuauaaau

SEQ ID NO: 548484 - RNA, 19 nt, Homo sapiens
cagagaaaccuuauaauug

SEQ ID NO: 548485 - RNA, 19 nt, Homo sapiens
gcaaaucuggcaacaaauu

SEQ ID NO: 548486 - RNA, 19 nt, Homo sapiens
uggcaaaucuggcaacaaa

SEQ ID NO: 548487 - RNA, 19 nt, Homo sapiens
gagaaacccuauaaaugug

SEQ ID NO: 548488 - RNA, 19 nt, Homo sapiens
ucacaaagcagcaacauug

SEQ ID NO: 548489 - RNA, 19 nt, Homo sapiens
gggagaaaccuuauaaaug

SEQ ID NO: 548490 - RNA, 19 nt, Homo sapiens
gagcagaucuuaaaauuca

SEQ ID NO: 548491 - RNA, 19 nt, Homo sapiens
gaauucccauuaucaaguu

SEQ ID NO: 548492 - RNA, 19 nt, Homo sapiens
gagagaaaccauacaaaug

SEQ ID NO: 548493 - RNA, 19 nt, Homo sapiens
gagagaaaccauacaaaug

SEQ ID NO: 548494 - RNA, 19 nt, Homo sapiens
ggagagaaaccauacaaau

SEQ ID NO: 548495 - RNA, 19 nt, Homo sapiens
ggagauaagccauacaaau

SEQ ID NO: 548496 - RNA, 19 nt, Homo sapiens
ggagagaaaccauacaaau

SEQ ID NO: 548497 - RNA, 19 nt, Homo sapiens
gaucagcaaauuuccauaa

SEQ ID NO: 548498 - RNA, 19 nt, Homo sapiens
ggaaaaggcuucuguuaca

SEQ ID NO: 548499 - RNA, 19 nt, Homo sapiens
gaucaauaauucucagugu

SEQ ID NO: 548500 - RNA, 19 nt, Homo sapiens
gagaaaccauauaauugug

SEQ ID NO: 548501 - RNA, 19 nt, Homo sapiens
ggagagaagccauacaaau

SEQ ID NO: 548502 - RNA, 19 nt, Homo sapiens
gcucacgacuucagauuca

SEQ ID NO: 548503 - RNA, 19 nt, Homo sapiens
ucagaaggcccacaguaua

SEQ ID NO: 548504 - RNA, 19 nt, Homo sapiens
ucagaaaguccacgugaua

SEQ ID NO: 548505 - RNA, 19 nt, Homo sapiens
gcgaucaaaucuuacaguu

SEQ ID NO: 548506 - RNA, 19 nt, Homo sapiens
gggcaggguuucaaucaga

SEQ ID NO: 548507 - RNA, 19 nt, Homo sapiens
caucuucaaucccaucaaa

SEQ ID NO: 548508 - RNA, 19 nt, Homo sapiens
uaaagcagauggucccaau

SEQ ID NO: 548509 - RNA, 19 nt, Homo sapiens
gagaugugaugguggagaa

SEQ ID NO: 548510 - RNA, 19 nt, Homo sapiens
gagaaaccauacaaaugug

SEQ ID NO: 548511 - RNA, 19 nt, Homo sapiens
gauaagccauacaaaugug

SEQ ID NO: 548512 - RNA, 19 nt, Homo sapiens
gagaaaccauacaaaugug

SEQ ID NO: 548513 - RNA, 19 nt, Homo sapiens
caaaguucguaucuucaaa

SEQ ID NO: 548514 - RNA, 19 nt, Homo sapiens
gagaaaccauacaaaugug

SEQ ID NO: 548515 - RNA, 19 nt, Homo sapiens
gcagauaggacccagaaau

SEQ ID NO: 548516 - RNA, 19 nt, Homo sapiens
gaauccauguuggugauaa

SEQ ID NO: 548517 - RNA, 19 nt, Homo sapiens
agagaaacccuauaaaugu

SEQ ID NO: 548518 - RNA, 19 nt, Homo sapiens
agucguagaucagcacuua

SEQ ID NO: 548519 - RNA, 19 nt, Homo sapiens
agaagucucuuacaugugu

SEQ ID NO: 548520 - RNA, 19 nt, Homo sapiens
gcggaacccugacuucuca

SEQ ID NO: 548521 - RNA, 19 nt, Homo sapiens
gguaagaacaucagagaau

SEQ ID NO: 548522 - RNA, 19 nt, Homo sapiens
auacaaaugugaugugugu

SEQ ID NO: 548523 - RNA, 19 nt, Homo sapiens
auacaaaugugaugagugu

SEQ ID NO: 548524 - RNA, 19 nt, Homo sapiens
auacaaaugugaagagugu

SEQ ID NO: 548525 - RNA, 19 nt, Homo sapiens
guaagaacaucagagaauc

SEQ ID NO: 548526 - RNA, 19 nt, Homo sapiens
ucagugaucucuccagcuu

SEQ ID NO: 548527 - RNA, 19 nt, Homo sapiens
agacagagaaucagaagaa

SEQ ID NO: 548528 - RNA, 19 nt, Homo sapiens
ccgaagacagggaaauuua

SEQ ID NO: 548529 - RNA, 19 nt, Homo sapiens
ugagaaaccauacaaaugu

SEQ ID NO: 548530 - RNA, 19 nt, Homo sapiens
caggagagaaaccauauaa

SEQ ID NO: 548531 - RNA, 19 nt, Homo sapiens
ggaggaauucccauuauca

SEQ ID NO: 548532 - RNA, 19 nt, Homo sapiens
ggaauucacaucuucaauc

SEQ ID NO: 548533 - RNA, 19 nt, Homo sapiens
gaagaugagaacuauauag

SEQ ID NO: 548534 - RNA, 19 nt, Homo sapiens
gagaaaccuuauaaaugug

SEQ ID NO: 548535 - RNA, 19 nt, Homo sapiens
gagaaaccuuauaauugug

SEQ ID NO: 548536 - RNA, 19 nt, Homo sapiens
cuuauagacccaaugauua

SEQ ID NO: 548537 - RNA, 19 nt, Homo sapiens
aagacuccaugaucaauaa

SEQ ID NO: 548538 - RNA, 19 nt, Homo sapiens
ugucaagacuccaugauca

SEQ ID NO: 548539 - RNA, 19 nt, Homo sapiens
caggaggaauucccauuau

SEQ ID NO: 548540 - RNA, 19 nt, Homo sapiens
guaagggcuucauuuguag

SEQ ID NO: 548541 - RNA, 19 nt, Homo sapiens
caggagagaaacccuauaa

SEQ ID NO: 548542 - RNA, 19 nt, Homo sapiens
ggaauucccauuaucaagu

SEQ ID NO: 548543 - RNA, 19 nt, Homo sapiens
agucaaaguucguaucuuc

SEQ ID NO: 548544 - RNA, 19 nt, Homo sapiens
ucaggaggaauucccauua

SEQ ID NO: 548545 - RNA, 19 nt, Homo sapiens
gauagagaaaccauacaaa

SEQ ID NO: 548546 - RNA, 19 nt, Homo sapiens
agagaaaccauacaaaugu

SEQ ID NO: 548547 - RNA, 19 nt, Homo sapiens
agagaaaccauacaaaugu

SEQ ID NO: 548548 - RNA, 19 nt, Homo sapiens
gaauucacaucuucaaucc

SEQ ID NO: 548549 - RNA, 19 nt, Homo sapiens
agagaaaccauacaaaugu

SEQ ID NO: 548550 - RNA, 19 nt, Homo sapiens
acacaggacagaaaucgua

SEQ ID NO: 548551 - RNA, 19 nt, Homo sapiens
ucaaauuucugaagaugag

SEQ ID NO: 548552 - RNA, 19 nt, Homo sapiens
caagacuccaugaucaaua

SEQ ID NO: 548553 - RNA, 19 nt, Homo sapiens
uguaucaccuauagaaaga

SEQ ID NO: 548554 - RNA, 19 nt, Homo sapiens
guucguaucuucaaaucca

SEQ ID NO: 548555 - RNA, 19 nt, Homo sapiens
gagaagccauacaaaugca

SEQ ID NO: 548556 - RNA, 19 nt, Homo sapiens
aagcagauggucccaauaa

SEQ ID NO: 548557 - RNA, 19 nt, Homo sapiens
aguuggcgaucaaaucuua

SEQ ID NO: 548558 - RNA, 19 nt, Homo sapiens
gugagaaaccauacaaaug

SEQ ID NO: 548559 - RNA, 19 nt, Homo sapiens
ggugagaaaccauacaaau

SEQ ID NO: 548560 - RNA, 19 nt, Homo sapiens
uagagaaaccauacaaaug

SEQ ID NO: 548561 - RNA, 19 nt, Homo sapiens
aaacuuaagugugaugagu

SEQ ID NO: 548562 - RNA, 19 nt, Homo sapiens
agaaagaaaugagcagcuu

SEQ ID NO: 548563 - RNA, 19 nt, Homo sapiens
ggaaagggcuguaauuaua

SEQ ID NO: 548564 - RNA, 19 nt, Homo sapiens
gagaaagccuucagucaua

SEQ ID NO: 548565 - RNA, 19 nt, Homo sapiens
gggaauggcuccaauuaua

SEQ ID NO: 548566 - RNA, 19 nt, Homo sapiens
ggaaagggcuucagucaga

SEQ ID NO: 548567 - RNA, 19 nt, Homo sapiens
ggaaagggcuucagucaga

SEQ ID NO: 548568 - RNA, 19 nt, Homo sapiens
gaucauaccuucagaguca

SEQ ID NO: 548569 - RNA, 19 nt, Homo sapiens
ggagaaauccugcaaguaa

SEQ ID NO: 548570 - RNA, 19 nt, Homo sapiens
gagaaugucuuuaaucaga

SEQ ID NO: 548571 - RNA, 19 nt, Homo sapiens
ggagaaagaccauauauau

SEQ ID NO: 548572 - RNA, 19 nt, Homo sapiens
gcacaacauuuaugagaaa

SEQ ID NO: 548573 - RNA, 19 nt, Homo sapiens
gagaaacuauacacagaua

SEQ ID NO: 548574 - RNA, 19 nt, Homo sapiens
gaagggacuuuguucauug

SEQ ID NO: 548575 - RNA, 19 nt, Homo sapiens
ccaaggagauggugacauu

SEQ ID NO: 548576 - RNA, 19 nt, Homo sapiens
gggaagggcuuuagucaga

SEQ ID NO: 548577 - RNA, 19 nt, Homo sapiens
gagagaaaccuuauaaaug

SEQ ID NO: 548578 - RNA, 19 nt, Homo sapiens
gaagauaucaugaagguau

SEQ ID NO: 548579 - RNA, 19 nt, Homo sapiens
gagcucaggucuucucauu

SEQ ID NO: 548580 - RNA, 19 nt, Homo sapiens
gcuuagaccuuaauaguau

SEQ ID NO: 548581 - RNA, 19 nt, Homo sapiens
gguaagaguuucagucaga

SEQ ID NO: 548582 - RNA, 19 nt, Homo sapiens
gagaagauaucaugaaggu

SEQ ID NO: 548583 - RNA, 19 nt, Homo sapiens
ggcaaagguuucaaucaua

SEQ ID NO: 548584 - RNA, 19 nt, Homo sapiens
ggagagaaaccuuauaaau

SEQ ID NO: 548585 - RNA, 19 nt, Homo sapiens
gcaaagguuucaaucauag

SEQ ID NO: 548586 - RNA, 19 nt, Homo sapiens
agucauagcuuagaccuua

SEQ ID NO: 548587 - RNA, 19 nt, Homo sapiens
guacaaaggguuucaguga

SEQ ID NO: 548588 - RNA, 19 nt, Homo sapiens
gguaaaggcuucaguaagg

SEQ ID NO: 548589 - RNA, 19 nt, Homo sapiens
cgucagaccuggcaacaaa

SEQ ID NO: 548590 - RNA, 19 nt, Homo sapiens
cagagaaucuacacagaaa

SEQ ID NO: 548591 - RNA, 19 nt, Homo sapiens
gcucaggucuucucauuca

SEQ ID NO: 548592 - RNA, 19 nt, Homo sapiens
ggagaaaccaugcaaaugu

SEQ ID NO: 548593 - RNA, 19 nt, Homo sapiens
caucaaagaguccauagua

SEQ ID NO: 548594 - RNA, 19 nt, Homo sapiens
ggacagaagccauacaaau

SEQ ID NO: 548595 - RNA, 19 nt, Homo sapiens
gagagaagaugauauugag

SEQ ID NO: 548596 - RNA, 19 nt, Homo sapiens
gagaagcccuauccauguu

SEQ ID NO: 548597 - RNA, 19 nt, Homo sapiens
gaauggcuccaauuauaua

SEQ ID NO: 548598 - RNA, 19 nt, Homo sapiens
aguaacagcuucagccaua

SEQ ID NO: 548599 - RNA, 19 nt, Homo sapiens
gcauuaugaugaucugaaa

SEQ ID NO: 548600 - RNA, 19 nt, Homo sapiens
gugagaaugucuuuaauca

SEQ ID NO: 548601 - RNA, 19 nt, Homo sapiens
gagagaaaccauacaaaug

SEQ ID NO: 548602 - RNA, 19 nt, Homo sapiens
gagagaaaccauacaaaug

SEQ ID NO: 548603 - RNA, 19 nt, Homo sapiens
ccaaaggguucauguggaa

SEQ ID NO: 548604 - RNA, 19 nt, Homo sapiens
gagaaaccaugcaaaugug

SEQ ID NO: 548605 - RNA, 19 nt, Homo sapiens
gagaugugcugcauuucuu

SEQ ID NO: 548606 - RNA, 19 nt, Homo sapiens
ggagagaaaccauacaaau

SEQ ID NO: 548607 - RNA, 19 nt, Homo sapiens
ggagagaaaccauacaaau

SEQ ID NO: 548608 - RNA, 19 nt, Homo sapiens
gaauaccaguucagauuuc

SEQ ID NO: 548609 - RNA, 19 nt, Homo sapiens
gaagaauucucaguugcaa

SEQ ID NO: 548610 - RNA, 19 nt, Homo sapiens
gagaaauccugcaaguaau

SEQ ID NO: 548611 - RNA, 19 nt, Homo sapiens
agagaaaccuuauaaaugc

SEQ ID NO: 548612 - RNA, 19 nt, Homo sapiens
ggaauaccaguucagauuu

SEQ ID NO: 548613 - RNA, 19 nt, Homo sapiens
gaaugaccguuuccaagga

SEQ ID NO: 548614 - RNA, 19 nt, Homo sapiens
gagagaagccauaccaaug

SEQ ID NO: 548615 - RNA, 19 nt, Homo sapiens
gacagaagccauacaaaug

SEQ ID NO: 548616 - RNA, 19 nt, Homo sapiens
gagaagaugauauugagaa

SEQ ID NO: 548617 - RNA, 19 nt, Homo sapiens
ucacaaugaugaacuggaa

SEQ ID NO: 548618 - RNA, 19 nt, Homo sapiens
aguaaggccucaacacuuu

SEQ ID NO: 548619 - RNA, 19 nt, Homo sapiens
gcucaaaacuuaaagauca

SEQ ID NO: 548620 - RNA, 19 nt, Homo sapiens
caggugagauguccuauag

SEQ ID NO: 548621 - RNA, 19 nt, Homo sapiens
ucaguuggcucucacauca

SEQ ID NO: 548622 - RNA, 19 nt, Homo sapiens
aaacguauuuggaggagaa

SEQ ID NO: 548623 - RNA, 19 nt, Homo sapiens
ccuauaggcacaacauuua

SEQ ID NO: 548624 - RNA, 19 nt, Homo sapiens
gagaugugaugcuggagaa

SEQ ID NO: 548625 - RNA, 19 nt, Homo sapiens
gagaaaccauacaaaugug

SEQ ID NO: 548626 - RNA, 19 nt, Homo sapiens
gagaaaccauacaaaugug

SEQ ID NO: 548627 - RNA, 19 nt, Homo sapiens
ggaauggcuccaauuauau

SEQ ID NO: 548628 - RNA, 19 nt, Homo sapiens
caauguuucugguuaaugu

SEQ ID NO: 548629 - RNA, 19 nt, Homo sapiens
gagugaaaccguauaaaug

SEQ ID NO: 548630 - RNA, 19 nt, Homo sapiens
cuaaggaacaaccauauaa

SEQ ID NO: 548631 - RNA, 19 nt, Homo sapiens
aaucagaguucaugucuuc

SEQ ID NO: 548632 - RNA, 19 nt, Homo sapiens
ggagaagcccuauccaugu

SEQ ID NO: 548633 - RNA, 19 nt, Homo sapiens
aaucaggagucaauucaaa

SEQ ID NO: 548634 - RNA, 19 nt, Homo sapiens
cuaaauccauguucucuag

SEQ ID NO: 548635 - RNA, 19 nt, Homo sapiens
ucaaaugggagcugaaauu

SEQ ID NO: 548636 - RNA, 19 nt, Homo sapiens
auacaaaugugaugcaugu

SEQ ID NO: 548637 - RNA, 19 nt, Homo sapiens
cagcuucagccauaauuua

SEQ ID NO: 548638 - RNA, 19 nt, Homo sapiens
uauaaacgcuaugugugua

SEQ ID NO: 548639 - RNA, 19 nt, Homo sapiens
gaacuggaaguacacagaa

SEQ ID NO: 548640 - RNA, 19 nt, Homo sapiens
cugaaagagucacauaauu

SEQ ID NO: 548641 - RNA, 19 nt, Homo sapiens
ggagaguauucaggaagua

SEQ ID NO: 548642 - RNA, 19 nt, Homo sapiens
ggaaggaagaaucaacaaa

SEQ ID NO: 548643 - RNA, 19 nt, Homo sapiens
agagauggauguucaggaa

SEQ ID NO: 548644 - RNA, 19 nt, Homo sapiens
caauguaggugcucaguac

SEQ ID NO: 548645 - RNA, 19 nt, Homo sapiens
acaaaggguuucagugaga

SEQ ID NO: 548646 - RNA, 19 nt, Homo sapiens
gagcuuuccucccgucaga

SEQ ID NO: 548647 - RNA, 19 nt, Homo sapiens
guucauugcuagucuacaa

SEQ ID NO: 548648 - RNA, 19 nt, Homo sapiens
gagggaaaccauacaaaug

SEQ ID NO: 548649 - RNA, 19 nt, Homo sapiens
gagagcauaucuucaaggu

SEQ ID NO: 548650 - RNA, 19 nt, Homo sapiens
acacagauauagaguaugg

SEQ ID NO: 548651 - RNA, 19 nt, Homo sapiens
aagagaaacuauacacaga

SEQ ID NO: 548652 - RNA, 19 nt, Homo sapiens
ugagagagaagaugauauu

SEQ ID NO: 548653 - RNA, 19 nt, Homo sapiens
gaaaagccuucaguaauga

SEQ ID NO: 548654 - RNA, 19 nt, Homo sapiens
gaauuaaggcagaguuuua

SEQ ID NO: 548655 - RNA, 19 nt, Homo sapiens
ggagggaaaccauacaaau

SEQ ID NO: 548656 - RNA, 19 nt, Homo sapiens
gauauagaguauggaaaga

SEQ ID NO: 548657 - RNA, 19 nt, Homo sapiens
guggaaagggcuguaauua

SEQ ID NO: 548658 - RNA, 19 nt, Homo sapiens
gggaagcccuauacauaca

SEQ ID NO: 548659 - RNA, 19 nt, Homo sapiens
uauaccaucugcugaaguu

SEQ ID NO: 548660 - RNA, 19 nt, Homo sapiens
agaagggacuuuguucauu

SEQ ID NO: 548661 - RNA, 19 nt, Homo sapiens
gagaaucuacacagaaaug

SEQ ID NO: 548662 - RNA, 19 nt, Homo sapiens
gguaaggguuuccguugga

SEQ ID NO: 548663 - RNA, 19 nt, Homo sapiens
gggaaaggcuucagaugua

SEQ ID NO: 548664 - RNA, 19 nt, Homo sapiens
ggagagaaaccuuauauuu

SEQ ID NO: 548665 - RNA, 19 nt, Homo sapiens
ggagagagaccuuauaauu

SEQ ID NO: 548666 - RNA, 19 nt, Homo sapiens
ggaaaaggcuucacugaua

SEQ ID NO: 548667 - RNA, 19 nt, Homo sapiens
gggaagggcuacauuagua

SEQ ID NO: 548668 - RNA, 19 nt, Homo sapiens
ggacagaaaccguacaauu

SEQ ID NO: 548669 - RNA, 19 nt, Homo sapiens
gagagaaaccuuauauuug

SEQ ID NO: 548670 - RNA, 19 nt, Homo sapiens
gcaggacuaucuauaauuc

SEQ ID NO: 548671 - RNA, 19 nt, Homo sapiens
gagagagaccuuauaauug

SEQ ID NO: 548672 - RNA, 19 nt, Homo sapiens
gcucaugucugcaaacuca

SEQ ID NO: 548673 - RNA, 19 nt, Homo sapiens
ggacagaaaccuucacaga

SEQ ID NO: 548674 - RNA, 19 nt, Homo sapiens
cagcaaaucugggaacaaa

SEQ ID NO: 548675 - RNA, 19 nt, Homo sapiens
ucucaagacuccaucauaa

SEQ ID NO: 548676 - RNA, 19 nt, Homo sapiens
agagagaccuuauaauugu

SEQ ID NO: 548677 - RNA, 19 nt, Homo sapiens
gacagaaaccguacaauug

SEQ ID NO: 548678 - RNA, 19 nt, Homo sapiens
gcauaagcaucagauaauu

SEQ ID NO: 548679 - RNA, 19 nt, Homo sapiens
caucucagcucuucguauu

SEQ ID NO: 548680 - RNA, 19 nt, Homo sapiens
ugccuuaggucaagucuua

SEQ ID NO: 548681 - RNA, 19 nt, Homo sapiens
ccagagaguucacuugaga

SEQ ID NO: 548682 - RNA, 19 nt, Homo sapiens
acagaaaccuucacagaau

SEQ ID NO: 548683 - RNA, 19 nt, Homo sapiens
agaggaagcuguaccaaga

SEQ ID NO: 548684 - RNA, 19 nt, Homo sapiens
gguaaggaauucagucaga

SEQ ID NO: 548685 - RNA, 19 nt, Homo sapiens
ggagaaaacucauccaaau

SEQ ID NO: 548686 - RNA, 19 nt, Homo sapiens
gagagaccuuauaauugua

SEQ ID NO: 548687 - RNA, 19 nt, Homo sapiens
ugacaugugugguaaggaa

SEQ ID NO: 548688 - RNA, 19 nt, Homo sapiens
aaacaguccuucagugaug

SEQ ID NO: 548689 - RNA, 19 nt, Homo sapiens
gcuugaaucuggauauaau

SEQ ID NO: 548690 - RNA, 19 nt, Homo sapiens
ggccuucauucacgauuua

SEQ ID NO: 548691 - RNA, 19 nt, Homo sapiens
guaaacaguccuucaguga

SEQ ID NO: 548692 - RNA, 19 nt, Homo sapiens
ccaaagagaaggaaauuca

SEQ ID NO: 548693 - RNA, 19 nt, Homo sapiens
gcgcuugaaucuggauaua

SEQ ID NO: 548694 - RNA, 19 nt, Homo sapiens
gacagaaaccuucacagaa

SEQ ID NO: 548695 - RNA, 19 nt, Homo sapiens
caagacuccaucauaaaua

SEQ ID NO: 548696 - RNA, 19 nt, Homo sapiens
ggagacagcaacccaaaga

SEQ ID NO: 548697 - RNA, 19 nt, Homo sapiens
ucacgaaccugcugucagu

SEQ ID NO: 548698 - RNA, 19 nt, Homo sapiens
gaggcaggacuaucuauaa

SEQ ID NO: 548699 - RNA, 19 nt, Homo sapiens
ggauguggcuguguucuuc

SEQ ID NO: 548700 - RNA, 19 nt, Homo sapiens
caaguucacugcaaguuac

SEQ ID NO: 548701 - RNA, 19 nt, Homo sapiens
ggaaaggcuucagauguag

SEQ ID NO: 548702 - RNA, 19 nt, Homo sapiens
gaaugugggaagagcuuua

SEQ ID NO: 548703 - RNA, 19 nt, Homo sapiens
gagaaaccuuauauuugug

SEQ ID NO: 548704 - RNA, 19 nt, Homo sapiens
ggagagcggaggcacaauu

SEQ ID NO: 548705 - RNA, 19 nt, Homo sapiens
ucaaggauguggcuguguu

SEQ ID NO: 548706 - RNA, 19 nt, Homo sapiens
ggaagggcuacauuaguaa

SEQ ID NO: 548707 - RNA, 19 nt, Homo sapiens
ucacugauagccuagauuu

SEQ ID NO: 548708 - RNA, 19 nt, Homo sapiens
agaguucacuugagagaga

SEQ ID NO: 548709 - RNA, 19 nt, Homo sapiens
gggaacaaacugcaaguga

SEQ ID NO: 548710 - RNA, 19 nt, Homo sapiens
cuucagauguagagcgaua

SEQ ID NO: 548711 - RNA, 19 nt, Homo sapiens
ggaagcaggaccacaugaa

SEQ ID NO: 548712 - RNA, 19 nt, Homo sapiens
gaaacuccacugccggaaa

SEQ ID NO: 548713 - RNA, 19 nt, Homo sapiens
gaaaaggcuucacugauag

SEQ ID NO: 548714 - RNA, 19 nt, Homo sapiens
ucaaguucacugcaaguua

SEQ ID NO: 548715 - RNA, 19 nt, Homo sapiens
cagaaaccuucacagaaug

SEQ ID NO: 548716 - RNA, 19 nt, Homo sapiens
acaccggucuuucuguaaa

SEQ ID NO: 548717 - RNA, 19 nt, Homo sapiens
ccgcguaguuugagccauu

SEQ ID NO: 548718 - RNA, 19 nt, Homo sapiens
cagcagagaaacugucaaa

SEQ ID NO: 548719 - RNA, 19 nt, Homo sapiens
gaacaaacugcaagugacu

SEQ ID NO: 548720 - RNA, 19 nt, Homo sapiens
cuucugaacuugucaccuu

SEQ ID NO: 548721 - RNA, 19 nt, Homo sapiens
gggccuucauucacgauuu

SEQ ID NO: 548722 - RNA, 19 nt, Homo sapiens
acacaggagagaaaccuua

SEQ ID NO: 548723 - RNA, 19 nt, Homo sapiens
gacagcaacccaaagagaa

SEQ ID NO: 548724 - RNA, 19 nt, Homo sapiens
ugugaaauaugugguaaga

SEQ ID NO: 548725 - RNA, 19 nt, Homo sapiens
caggagagaaaccuuauau

SEQ ID NO: 548726 - RNA, 19 nt, Homo sapiens
gcacaauuccaccuuccuu

SEQ ID NO: 548727 - RNA, 19 nt, Homo sapiens
caugagagaguccacacua

SEQ ID NO: 548728 - RNA, 19 nt, Homo sapiens
ucaagacuccaucauaaau

SEQ ID NO: 548729 - RNA, 19 nt, Homo sapiens
gcaaaucugggaacaaacu

SEQ ID NO: 548730 - RNA, 19 nt, Homo sapiens
agacugcccuguccagcaa

SEQ ID NO: 548731 - RNA, 19 nt, Homo sapiens
gcagagaaacugucaaaau

SEQ ID NO: 548732 - RNA, 19 nt, Homo sapiens
guucuucacugaggaggaa

SEQ ID NO: 548733 - RNA, 19 nt, Homo sapiens
acagaaaccguacaauugu

SEQ ID NO: 548734 - RNA, 19 nt, Homo sapiens
cuucagaaacaucagauaa

SEQ ID NO: 548735 - RNA, 19 nt, Homo sapiens
agagagaaaccauucaaau

SEQ ID NO: 548736 - RNA, 19 nt, Homo sapiens
agccugcgguugcuacaua

SEQ ID NO: 548737 - RNA, 19 nt, Homo sapiens
gaaaggcuucagauguaga

SEQ ID NO: 548738 - RNA, 19 nt, Homo sapiens
ucugcaaacucaugagaga

SEQ ID NO: 548739 - RNA, 19 nt, Homo sapiens
aagcuucuguuacaucuca

SEQ ID NO: 548740 - RNA, 19 nt, Homo sapiens
ucacagaaugggaagugua

SEQ ID NO: 548741 - RNA, 19 nt, Homo sapiens
gaagcaggaccacaugaag

SEQ ID NO: 548742 - RNA, 19 nt, Homo sapiens
cgauuuaaagcuucagaaa

SEQ ID NO: 548743 - RNA, 19 nt, Homo sapiens
caccagagaguucacuuga

SEQ ID NO: 548744 - RNA, 19 nt, Homo sapiens
ucucagcucuucguauuca

SEQ ID NO: 548745 - RNA, 19 nt, Homo sapiens
ccauuguucuagcgauuug

SEQ ID NO: 548746 - RNA, 19 nt, Homo sapiens
gggcuacauuaguaaguca

SEQ ID NO: 548747 - RNA, 19 nt, Homo sapiens
auacagaugugaggagugu

SEQ ID NO: 548748 - RNA, 19 nt, Homo sapiens
cacagaaugggaaguguaa

SEQ ID NO: 548749 - RNA, 19 nt, Homo sapiens
ucacuucuuugaacaaggu

SEQ ID NO: 548750 - RNA, 19 nt, Homo sapiens
gaagucucauacaugcaau

SEQ ID NO: 548751 - RNA, 19 nt, Homo sapiens
aggcaggacuaucuauaau

SEQ ID NO: 548752 - RNA, 19 nt, Homo sapiens
ugaggcaggacuaucuaua

SEQ ID NO: 548753 - RNA, 19 nt, Homo sapiens
gaaaacucauccaaaugug

SEQ ID NO: 548754 - RNA, 19 nt, Homo sapiens
ugagagaguccacacuaga

SEQ ID NO: 548755 - RNA, 19 nt, Homo sapiens
gagcucaugucugcaaacu

SEQ ID NO: 548756 - RNA, 19 nt, Homo sapiens
ggcaggacuaucuauaauu

SEQ ID NO: 548757 - RNA, 19 nt, Homo sapiens
cuucaaaugugaggauugu

SEQ ID NO: 548758 - RNA, 19 nt, Homo sapiens
agacagcaacccaaagaga

SEQ ID NO: 548759 - RNA, 19 nt, Homo sapiens
gagagcggaggcacaauuc

SEQ ID NO: 548760 - RNA, 19 nt, Homo sapiens
agucaggucuuaacuugca

SEQ ID NO: 548761 - RNA, 19 nt, Homo sapiens
uguaaagaaugugggaaga

SEQ ID NO: 548762 - RNA, 19 nt, Homo sapiens
uugcauaagcaucagauaa

SEQ ID NO: 548763 - RNA, 19 nt, Homo sapiens
gaagaaagaccaugaaugu

SEQ ID NO: 548764 - RNA, 19 nt, Homo sapiens
agucaaagcucauaucuaa

SEQ ID NO: 548765 - RNA, 19 nt, Homo sapiens
gagaaacccuauaagugua

SEQ ID NO: 548766 - RNA, 19 nt, Homo sapiens
gggaaggccuuuagucaaa

SEQ ID NO: 548767 - RNA, 19 nt, Homo sapiens
gagaaacccuucgaaugua

SEQ ID NO: 548768 - RNA, 19 nt, Homo sapiens
ggaacagucuugugaguau

SEQ ID NO: 548769 - RNA, 19 nt, Homo sapiens
gaaaagagccuucccauug

SEQ ID NO: 548770 - RNA, 19 nt, Homo sapiens
ugacugugcuggaggauuu

SEQ ID NO: 548771 - RNA, 19 nt, Homo sapiens
gaaagaccaugaauguagu

SEQ ID NO: 548772 - RNA, 19 nt, Homo sapiens
gagagaaacccuauaagug

SEQ ID NO: 548773 - RNA, 19 nt, Homo sapiens
uaggauggcuguaucacua

SEQ ID NO: 548774 - RNA, 19 nt, Homo sapiens
gcauccagcuccagccuaa

SEQ ID NO: 548775 - RNA, 19 nt, Homo sapiens
gcuggaggauuuagagaaa

SEQ ID NO: 548776 - RNA, 19 nt, Homo sapiens
gagagaaacccuucgaaug

SEQ ID NO: 548777 - RNA, 19 nt, Homo sapiens
gaagagccaugggagaaga

SEQ ID NO: 548778 - RNA, 19 nt, Homo sapiens
ggagagaaacccuauaagu

SEQ ID NO: 548779 - RNA, 19 nt, Homo sapiens
gaccaugaauguagugaau

SEQ ID NO: 548780 - RNA, 19 nt, Homo sapiens
gagaagcccuaugagugua

SEQ ID NO: 548781 - RNA, 19 nt, Homo sapiens
caagagaagaugaugauga

SEQ ID NO: 548782 - RNA, 19 nt, Homo sapiens
gagugaacagguauauuua

SEQ ID NO: 548783 - RNA, 19 nt, Homo sapiens
gaaccacucuaccagucaa

SEQ ID NO: 548784 - RNA, 19 nt, Homo sapiens
ggaagaaagaccaugaaug

SEQ ID NO: 548785 - RNA, 19 nt, Homo sapiens
agagugaacagguauauuu

SEQ ID NO: 548786 - RNA, 19 nt, Homo sapiens
cuacaucggucuaaucuac

SEQ ID NO: 548787 - RNA, 19 nt, Homo sapiens
ugacaccucuacauuugaa

SEQ ID NO: 548788 - RNA, 19 nt, Homo sapiens
aaucacagguguucucaga

SEQ ID NO: 548789 - RNA, 19 nt, Homo sapiens
agaaacccuucgaauguaa

SEQ ID NO: 548790 - RNA, 19 nt, Homo sapiens
ggagagaaacccuucgaau

SEQ ID NO: 548791 - RNA, 19 nt, Homo sapiens
gagaggaggcugugacugu

SEQ ID NO: 548792 - RNA, 19 nt, Homo sapiens
ggacaagagaagaugauga

SEQ ID NO: 548793 - RNA, 19 nt, Homo sapiens
agagaaacccuucgaaugu

SEQ ID NO: 548794 - RNA, 19 nt, Homo sapiens
gaauguagugaauguggua

SEQ ID NO: 548795 - RNA, 19 nt, Homo sapiens
gaggaacagucuugugagu

SEQ ID NO: 548796 - RNA, 19 nt, Homo sapiens
ggagagaaaccuuuuauau

SEQ ID NO: 548797 - RNA, 19 nt, Homo sapiens
aagagaagaugaugaugau

SEQ ID NO: 548798 - RNA, 19 nt, Homo sapiens
ggagaguucaugccagaaa

SEQ ID NO: 548799 - RNA, 19 nt, Homo sapiens
ggagagaagcccuaugagu

SEQ ID NO: 548800 - RNA, 19 nt, Homo sapiens
cagcaucagagaauucaua

SEQ ID NO: 548801 - RNA, 19 nt, Homo sapiens
uaacucacaucuuguuguc

SEQ ID NO: 548802 - RNA, 19 nt, Homo sapiens
gugaacagguauauuuaca

SEQ ID NO: 548803 - RNA, 19 nt, Homo sapiens
caggagagaagcccuauga

SEQ ID NO: 548804 - RNA, 19 nt, Homo sapiens
agagaaacccuauaagugu

SEQ ID NO: 548805 - RNA, 19 nt, Homo sapiens
gaacagucuugugaguaug

SEQ ID NO: 548806 - RNA, 19 nt, Homo sapiens
ccaugaauguagugaaugu

SEQ ID NO: 548807 - RNA, 19 nt, Homo sapiens
agaaagaccaugaauguag

SEQ ID NO: 548808 - RNA, 19 nt, Homo sapiens
gcccagagcccaaggacaa

SEQ ID NO: 548809 - RNA, 19 nt, Homo sapiens
cccaaagagugaacaggua

SEQ ID NO: 548810 - RNA, 19 nt, Homo sapiens
uuacugaaguggaaucaca

SEQ ID NO: 548811 - RNA, 19 nt, Homo sapiens
aaagagccuucccauugaa

SEQ ID NO: 548812 - RNA, 19 nt, Homo sapiens
ucaaagcucauaucuaagu

SEQ ID NO: 548813 - RNA, 19 nt, Homo sapiens
gacaagagaagaugaugau

SEQ ID NO: 548814 - RNA, 19 nt, Homo sapiens
acugacaccucuacauuug

SEQ ID NO: 548815 - RNA, 19 nt, Homo sapiens
cuacugacaccucuacauu

SEQ ID NO: 548816 - RNA, 19 nt, Homo sapiens
gaugaugggaccaaaggaa

SEQ ID NO: 548817 - RNA, 19 nt, Homo sapiens
aaaagagccuucccauuga

SEQ ID NO: 548818 - RNA, 19 nt, Homo sapiens
caaagagugaacagguaua

SEQ ID NO: 548819 - RNA, 19 nt, Homo sapiens
gagagaaaccuuuuauaug

SEQ ID NO: 548820 - RNA, 19 nt, Homo sapiens
guacacagggacaagagaa

SEQ ID NO: 548821 - RNA, 19 nt, Homo sapiens
uaaagaaugugggaaagcu

SEQ ID NO: 548822 - RNA, 19 nt, Homo sapiens
caaaggaucauugccacaa

SEQ ID NO: 548823 - RNA, 19 nt, Homo sapiens
cagagaaacacacgaagga

SEQ ID NO: 548824 - RNA, 19 nt, Homo sapiens
cuucgaauguaaugaaugu

SEQ ID NO: 548825 - RNA, 19 nt, Homo sapiens
aagaaugugggaaagcuua

SEQ ID NO: 548826 - RNA, 19 nt, Homo sapiens
agacuaggauggcuguauc

SEQ ID NO: 548827 - RNA, 19 nt, Homo sapiens
caaggacaaaggaucauug

SEQ ID NO: 548828 - RNA, 19 nt, Homo sapiens
gcaagauuccagcugguau

SEQ ID NO: 548829 - RNA, 19 nt, Homo sapiens
ccaaagagugaacagguau

SEQ ID NO: 548830 - RNA, 19 nt, Homo sapiens
ugucauccauaaggaaauu

SEQ ID NO: 548831 - RNA, 19 nt, Homo sapiens
cauuagacaucggagaguu

SEQ ID NO: 548832 - RNA, 19 nt, Homo sapiens
gaaccuccugguccuguga

SEQ ID NO: 548833 - RNA, 19 nt, Homo sapiens
ccacaaccacccauuacug

SEQ ID NO: 548834 - RNA, 19 nt, Homo sapiens
gagccuucccauugaauug

SEQ ID NO: 548835 - RNA, 19 nt, Homo sapiens
caucagagaauucauacag

SEQ ID NO: 548836 - RNA, 19 nt, Homo sapiens
cacaaccacccauuacuga

SEQ ID NO: 548837 - RNA, 19 nt, Homo sapiens
ugucaguuguuacagaaga

SEQ ID NO: 548838 - RNA, 19 nt, Homo sapiens
ggauuuagagaaaggacuu

SEQ ID NO: 548839 - RNA, 19 nt, Homo sapiens
ccagacagaauucuacauc

SEQ ID NO: 548840 - RNA, 19 nt, Homo sapiens
gggaagaaagaccaugaau

SEQ ID NO: 548841 - RNA, 19 nt, Homo sapiens
gaccaaaggaagaggaaca

SEQ ID NO: 548842 - RNA, 19 nt, Homo sapiens
agagaagcccuaugagugu

SEQ ID NO: 548843 - RNA, 19 nt, Homo sapiens
agacccagccuuucccaaa

SEQ ID NO: 548844 - RNA, 19 nt, Homo sapiens
caaagcucauaucuaaguc

SEQ ID NO: 548845 - RNA, 19 nt, Homo sapiens
cuggagagaaacccuauaa

SEQ ID NO: 548846 - RNA, 19 nt, Homo sapiens
gugggaaggccuuuaguca

SEQ ID NO: 548847 - RNA, 19 nt, Homo sapiens
cauuugaagcuaccucuga

SEQ ID NO: 548848 - RNA, 19 nt, Homo sapiens
ggccagagaaacacacgaa

SEQ ID NO: 548849 - RNA, 19 nt, Homo sapiens
gagaguucaugccagaaaa

SEQ ID NO: 548850 - RNA, 19 nt, Homo sapiens
ggcuguaaguggcgcgauu

SEQ ID NO: 548851 - RNA, 19 nt, Homo sapiens
gaagcccuaugaguguaau

SEQ ID NO: 548852 - RNA, 19 nt, Homo sapiens
ggucagcaucagagaauuc

SEQ ID NO: 548853 - RNA, 19 nt, Homo sapiens
ggaaucacagguguucuca

SEQ ID NO: 548854 - RNA, 19 nt, Homo sapiens
ggaaccacucuaccaguca

SEQ ID NO: 548855 - RNA, 19 nt, Homo sapiens
gaauucuacaucggucuaa

SEQ ID NO: 548856 - RNA, 19 nt, Homo sapiens
ucagagcucauuagacauc

SEQ ID NO: 548857 - RNA, 19 nt, Homo sapiens
cuauaaguguagugacugu

SEQ ID NO: 548858 - RNA, 19 nt, Homo sapiens
caagauuccagcugguaug

SEQ ID NO: 548859 - RNA, 19 nt, Homo sapiens
aagaaagaccaugaaugua

SEQ ID NO: 548860 - RNA, 19 nt, Homo sapiens
cagcaucggagaauucaca

SEQ ID NO: 548861 - RNA, 19 nt, Homo sapiens
cagggaagaaagaccauga

SEQ ID NO: 548862 - RNA, 19 nt, Homo sapiens
caaccacccauuacugaag

SEQ ID NO: 548863 - RNA, 19 nt, Homo sapiens
gagaggagcucauuucaga

SEQ ID NO: 548864 - RNA, 19 nt, Homo sapiens
gaaaggccguucaaaugua

SEQ ID NO: 548865 - RNA, 19 nt, Homo sapiens
gaacagcucucuccagaca

SEQ ID NO: 548866 - RNA, 19 nt, Homo sapiens
gaacucagguacuacugua

SEQ ID NO: 548867 - RNA, 19 nt, Homo sapiens
ucaagugucugauauguaa

SEQ ID NO: 548868 - RNA, 19 nt, Homo sapiens
gaaauuacccugacuaucu

SEQ ID NO: 548869 - RNA, 19 nt, Homo sapiens
acacaggacugaaaucuuu

SEQ ID NO: 548870 - RNA, 19 nt, Homo sapiens
ucacauugcuucccacuuu

SEQ ID NO: 548871 - RNA, 19 nt, Homo sapiens
gauguuggcugcaccauga

SEQ ID NO: 548872 - RNA, 19 nt, Homo sapiens
cagaauaacuguaauugug

SEQ ID NO: 548873 - RNA, 19 nt, Homo sapiens
gauggaagguucuuuacuu

SEQ ID NO: 548874 - RNA, 19 nt, Homo sapiens
gagaucacccugaccauua

SEQ ID NO: 548875 - RNA, 19 nt, Homo sapiens
ccacagaauucaacaaguu

SEQ ID NO: 548876 - RNA, 19 nt, Homo sapiens
gcagaaagagcgucaguuu

SEQ ID NO: 548877 - RNA, 19 nt, Homo sapiens
ggaaguacaccuuuaagaa

SEQ ID NO: 548878 - RNA, 19 nt, Homo sapiens
ggaaagaguuuuacuguga

SEQ ID NO: 548879 - RNA, 19 nt, Homo sapiens
ggguacagguugaucuuua

SEQ ID NO: 548880 - RNA, 19 nt, Homo sapiens
gcagauugauccaagcauu

SEQ ID NO: 548881 - RNA, 19 nt, Homo sapiens
gaaguggauucacguauuc

SEQ ID NO: 548882 - RNA, 19 nt, Homo sapiens
gaacacuaauuaugccuau

SEQ ID NO: 548883 - RNA, 19 nt, Homo sapiens
agagauggcuggaccaauu

SEQ ID NO: 548884 - RNA, 19 nt, Homo sapiens
caagaguguuuaaauguga

SEQ ID NO: 548885 - RNA, 19 nt, Homo sapiens
gcacaagguucccaguuuc

SEQ ID NO: 548886 - RNA, 19 nt, Homo sapiens
caacacaucagaucccaua

SEQ ID NO: 548887 - RNA, 19 nt, Homo sapiens
guagugugauuucuuugua

SEQ ID NO: 548888 - RNA, 19 nt, Homo sapiens
gcacuuggaaucucuguuu

SEQ ID NO: 548889 - RNA, 19 nt, Homo sapiens
gaaguacaccuuuaagaau

SEQ ID NO: 548890 - RNA, 19 nt, Homo sapiens
gaggaggguuuccgaacua

SEQ ID NO: 548891 - RNA, 19 nt, Homo sapiens
gguccaggguuacauaauu

SEQ ID NO: 548892 - RNA, 19 nt, Homo sapiens
gcaugaagccuuauaagug

SEQ ID NO: 548893 - RNA, 19 nt, Homo sapiens
gaaccaauccucauaacug

SEQ ID NO: 548894 - RNA, 19 nt, Homo sapiens
gcacauggccacacauaug

SEQ ID NO: 548895 - RNA, 19 nt, Homo sapiens
gcauaucugcuuuggaaua

SEQ ID NO: 548896 - RNA, 19 nt, Homo sapiens
gaaagacacacaugcaguu

SEQ ID NO: 548897 - RNA, 19 nt, Homo sapiens
gagccaagcccuucaaaug

SEQ ID NO: 548898 - RNA, 19 nt, Homo sapiens
gcaauuaacugggucuuac

SEQ ID NO: 548899 - RNA, 19 nt, Homo sapiens
gagcaaagcacuuggaauc

SEQ ID NO: 548900 - RNA, 19 nt, Homo sapiens
ggaggagacagcccaguua

SEQ ID NO: 548901 - RNA, 19 nt, Homo sapiens
guccugaggucaucacuuu

SEQ ID NO: 548902 - RNA, 19 nt, Homo sapiens
gcucaaagcacacaucaga

SEQ ID NO: 548903 - RNA, 19 nt, Homo sapiens
gcagauagaccauacaagu

SEQ ID NO: 548904 - RNA, 19 nt, Homo sapiens
ugugaaaucugucuacuau

SEQ ID NO: 548905 - RNA, 19 nt, Homo sapiens
guuccaaacuuccauaaau

SEQ ID NO: 548906 - RNA, 19 nt, Homo sapiens
ggaagaggcuuuguuucug

SEQ ID NO: 548907 - RNA, 19 nt, Homo sapiens
cagaguggcuagucucaaa

SEQ ID NO: 548908 - RNA, 19 nt, Homo sapiens
gauccuaccugcccugugu

SEQ ID NO: 548909 - RNA, 19 nt, Homo sapiens
ggcacaagguucccaguuu

SEQ ID NO: 548910 - RNA, 19 nt, Homo sapiens
uguaacaacucgcuugauu

SEQ ID NO: 548911 - RNA, 19 nt, Homo sapiens
ccauaaaugugaaaucugu

SEQ ID NO: 548912 - RNA, 19 nt, Homo sapiens
cacaugcaguuucauuaua

SEQ ID NO: 548913 - RNA, 19 nt, Homo sapiens
gguccuaccuauaacugua

SEQ ID NO: 548914 - RNA, 19 nt, Homo sapiens
agaaugguccuaccuauaa

SEQ ID NO: 548915 - RNA, 19 nt, Homo sapiens
caagaaugguccuaccuau

SEQ ID NO: 548916 - RNA, 19 nt, Homo sapiens
caugaagccuuauaagugu

SEQ ID NO: 548917 - RNA, 19 nt, Homo sapiens
ccucauaacugacuuaggu

SEQ ID NO: 548918 - RNA, 19 nt, Homo sapiens
ugaaaucugucuacuaucu

SEQ ID NO: 548919 - RNA, 19 nt, Homo sapiens
cauaucugcuuuggaauaa

SEQ ID NO: 548920 - RNA, 19 nt, Homo sapiens
gcacuucagaucaguauug

SEQ ID NO: 548921 - RNA, 19 nt, Homo sapiens
aaacaugucccaaaccaaa

SEQ ID NO: 548922 - RNA, 19 nt, Homo sapiens
caaguacaaggucuuauaa

SEQ ID NO: 548923 - RNA, 19 nt, Homo sapiens
cgucaauggugccacauaa

SEQ ID NO: 548924 - RNA, 19 nt, Homo sapiens
gaagaaagacacacaugca

SEQ ID NO: 548925 - RNA, 19 nt, Homo sapiens
uaacacacgugcacauuac

SEQ ID NO: 548926 - RNA, 19 nt, Homo sapiens
gcacguagaccaguuugaa

SEQ ID NO: 548927 - RNA, 19 nt, Homo sapiens
agaaguggauucacguauu

SEQ ID NO: 548928 - RNA, 19 nt, Homo sapiens
aaaccugacccaccaauaa

SEQ ID NO: 548929 - RNA, 19 nt, Homo sapiens
gaaggaggagacauuugua

SEQ ID NO: 548930 - RNA, 19 nt, Homo sapiens
ucaacaaguucuacagaga

SEQ ID NO: 548931 - RNA, 19 nt, Homo sapiens
ucaaguacaaggucuuaua

SEQ ID NO: 548932 - RNA, 19 nt, Homo sapiens
gaauucaaccugacacuuc

SEQ ID NO: 548933 - RNA, 19 nt, Homo sapiens
uaacugauaccuugagaga

SEQ ID NO: 548934 - RNA, 19 nt, Homo sapiens
caaagcaagcguaagauug

SEQ ID NO: 548935 - RNA, 19 nt, Homo sapiens
gcaaagcacuuggaaucuc

SEQ ID NO: 548936 - RNA, 19 nt, Homo sapiens
ccaagaguguuuaaaugug

SEQ ID NO: 548937 - RNA, 19 nt, Homo sapiens
ucagaucaguauuguauuc

SEQ ID NO: 548938 - RNA, 19 nt, Homo sapiens
ucagggaauucuuuaguau

SEQ ID NO: 548939 - RNA, 19 nt, Homo sapiens
gcaaauaagaagcauaucu

SEQ ID NO: 548940 - RNA, 19 nt, Homo sapiens
gaggagacauuuguaugga

SEQ ID NO: 548941 - RNA, 19 nt, Homo sapiens
gcacacaucagaacacaca

SEQ ID NO: 548942 - RNA, 19 nt, Homo sapiens
ccagauguuuccagcguuu

SEQ ID NO: 548943 - RNA, 19 nt, Homo sapiens
ccucggagcugaaggaaca

SEQ ID NO: 548944 - RNA, 19 nt, Homo sapiens
gcaaacacaagacauuuua

SEQ ID NO: 548945 - RNA, 19 nt, Homo sapiens
cauuucagauuccuaaaga

SEQ ID NO: 548946 - RNA, 19 nt, Homo sapiens
gaggagcucauuucagauu

SEQ ID NO: 548947 - RNA, 19 nt, Homo sapiens
ccaauucucuccaugacau

SEQ ID NO: 548948 - RNA, 19 nt, Homo sapiens
uaacaggacaguuugauca

SEQ ID NO: 548949 - RNA, 19 nt, Homo sapiens
gaaggacugcagccuguaa

SEQ ID NO: 548950 - RNA, 19 nt, Homo sapiens
ccacacauaugagcaugaa

SEQ ID NO: 548951 - RNA, 19 nt, Homo sapiens
ggagucaucccaagaggaa

SEQ ID NO: 548952 - RNA, 19 nt, Homo sapiens
uaacaacucgcuugauuca

SEQ ID NO: 548953 - RNA, 19 nt, Homo sapiens
ccuagaaggcauccaguua

SEQ ID NO: 548954 - RNA, 19 nt, Homo sapiens
agacacacaugcaguuuca

SEQ ID NO: 548955 - RNA, 19 nt, Homo sapiens
gagaaaagccauacaaaug

SEQ ID NO: 548956 - RNA, 19 nt, Homo sapiens
gguacagguugaucuuuau

SEQ ID NO: 548957 - RNA, 19 nt, Homo sapiens
gagguuuccuuccuugaau

SEQ ID NO: 548958 - RNA, 19 nt, Homo sapiens
ggaccaauucucuccauga

SEQ ID NO: 548959 - RNA, 19 nt, Homo sapiens
cgacaaaacuuaacacuac

SEQ ID NO: 548960 - RNA, 19 nt, Homo sapiens
uaagagaggagcucauuuc

SEQ ID NO: 548961 - RNA, 19 nt, Homo sapiens
caaauaagaagcauaucug

SEQ ID NO: 548962 - RNA, 19 nt, Homo sapiens
caggacaguuugaucagaa

SEQ ID NO: 548963 - RNA, 19 nt, Homo sapiens
ugaggaaguucaugaauua

SEQ ID NO: 548964 - RNA, 19 nt, Homo sapiens
gaauggaaaucuugucaga

SEQ ID NO: 548965 - RNA, 19 nt, Homo sapiens
guaacaaucuagagaagaa

SEQ ID NO: 548966 - RNA, 19 nt, Homo sapiens
uuacacaaccuauccauua

SEQ ID NO: 548967 - RNA, 19 nt, Homo sapiens
gcaguuagcauuucuuguu

SEQ ID NO: 548968 - RNA, 19 nt, Homo sapiens
caaacaaccugaaucaucu

SEQ ID NO: 548969 - RNA, 19 nt, Homo sapiens
gaaaagaccccagcaguua

SEQ ID NO: 548970 - RNA, 19 nt, Homo sapiens
cagagaaccugaccauaug

SEQ ID NO: 548971 - RNA, 19 nt, Homo sapiens
gugaagauccaacaucaua

SEQ ID NO: 548972 - RNA, 19 nt, Homo sapiens
gcgcugaccuucauguuca

SEQ ID NO: 548973 - RNA, 19 nt, Homo sapiens
caaccuauccauuacuuaa

SEQ ID NO: 548974 - RNA, 19 nt, Homo sapiens
guaaugguuuguauacuuc

SEQ ID NO: 548975 - RNA, 19 nt, Homo sapiens
gaacuuaguaacaaucuag

SEQ ID NO: 548976 - RNA, 19 nt, Homo sapiens
ggaaguucaugaauuacau

SEQ ID NO: 548977 - RNA, 19 nt, Homo sapiens
caaccugaaucaucuuugu

SEQ ID NO: 548978 - RNA, 19 nt, Homo sapiens
gcagaaucauugccacugu

SEQ ID NO: 548979 - RNA, 19 nt, Homo sapiens
aaacaaacaaccugaauca

SEQ ID NO: 548980 - RNA, 19 nt, Homo sapiens
gcuggaagcagaaucauug

SEQ ID NO: 548981 - RNA, 19 nt, Homo sapiens
ugaaggaguugaggaaguu

SEQ ID NO: 548982 - RNA, 19 nt, Homo sapiens
guacucaugcaucaguuua

SEQ ID NO: 548983 - RNA, 19 nt, Homo sapiens
uaauaguacucaugcauca

SEQ ID NO: 548984 - RNA, 19 nt, Homo sapiens
caaguguaguuccguguga

SEQ ID NO: 548985 - RNA, 19 nt, Homo sapiens
agauagggcuggacaacuu

SEQ ID NO: 548986 - RNA, 19 nt, Homo sapiens
caucccugcuguugugaua

SEQ ID NO: 548987 - RNA, 19 nt, Homo sapiens
ucuacaaacuguuccuaaa

SEQ ID NO: 548988 - RNA, 19 nt, Homo sapiens
gcucuuauucuucuacaaa

SEQ ID NO: 548989 - RNA, 19 nt, Homo sapiens
gaaguacaagugaauggaa

SEQ ID NO: 548990 - RNA, 19 nt, Homo sapiens
caguuagcauuucuuguuu

SEQ ID NO: 548991 - RNA, 19 nt, Homo sapiens
uuacauguuuggcaacuug

SEQ ID NO: 548992 - RNA, 19 nt, Homo sapiens
guaaaugccuuagucuuuu

SEQ ID NO: 548993 - RNA, 19 nt, Homo sapiens
gcaauguugugggacacua

SEQ ID NO: 548994 - RNA, 19 nt, Homo sapiens
cauugccacuguucacaua

SEQ ID NO: 548995 - RNA, 19 nt, Homo sapiens
gauagggcuggacaacuua

SEQ ID NO: 548996 - RNA, 19 nt, Homo sapiens
gauccgagccgagguaaug

SEQ ID NO: 548997 - RNA, 19 nt, Homo sapiens
gaagauccaacaucauaca

SEQ ID NO: 548998 - RNA, 19 nt, Homo sapiens
gcugggugcuauauuuaga

SEQ ID NO: 548999 - RNA, 19 nt, Homo sapiens
uugaggaaguucaugaauu

SEQ ID NO: 549000 - RNA, 19 nt, Homo sapiens
gcagaacccagugugcuuu

SEQ ID NO: 549001 - RNA, 19 nt, Homo sapiens
aguaaaugccuuagucuuu

SEQ ID NO: 549002 - RNA, 19 nt, Homo sapiens
acaagugaauggaaaucuu

SEQ ID NO: 549003 - RNA, 19 nt, Homo sapiens
ggagguggcuaaaaccauu

SEQ ID NO: 549004 - RNA, 19 nt, Homo sapiens
acaaacaaccugaaucauc

SEQ ID NO: 549005 - RNA, 19 nt, Homo sapiens
gaacccagugugcuuugaa

SEQ ID NO: 549006 - RNA, 19 nt, Homo sapiens
auauggaacuggaagaaga

SEQ ID NO: 549007 - RNA, 19 nt, Homo sapiens
auggaaaucuugucagaga

SEQ ID NO: 549008 - RNA, 19 nt, Homo sapiens
aaacaugccaaacaaacaa

SEQ ID NO: 549009 - RNA, 19 nt, Homo sapiens
caggaggacuaaagcugaa

SEQ ID NO: 549010 - RNA, 19 nt, Homo sapiens
cagaaucauugccacuguu

SEQ ID NO: 549011 - RNA, 19 nt, Homo sapiens
gacuaaagcugaaaacauc

SEQ ID NO: 549012 - RNA, 19 nt, Homo sapiens
ggaauucacgcuacuacca

SEQ ID NO: 549013 - RNA, 19 nt, Homo sapiens
cuugcugggugcuauauuu

SEQ ID NO: 549014 - RNA, 19 nt, Homo sapiens
aaagaacuucgaaauguug

SEQ ID NO: 549015 - RNA, 19 nt, Homo sapiens
cacaaccuauccauuacuu

SEQ ID NO: 549016 - RNA, 19 nt, Homo sapiens
uuggaaagguuguucugaa

SEQ ID NO: 549017 - RNA, 19 nt, Homo sapiens
guuagcauuucuuguuuag

SEQ ID NO: 549018 - RNA, 19 nt, Homo sapiens
ggagaugccuuggguucag

SEQ ID NO: 549019 - RNA, 19 nt, Homo sapiens
ccaaacaaacaaccugaau

SEQ ID NO: 549020 - RNA, 19 nt, Homo sapiens
gaagauagggcuggacaac

SEQ ID NO: 549021 - RNA, 19 nt, Homo sapiens
caaacaaacaaccugaauc

SEQ ID NO: 549022 - RNA, 19 nt, Homo sapiens
aguguaggcucuaaaucaa

SEQ ID NO: 549023 - RNA, 19 nt, Homo sapiens
guucagugauuguaguagu

SEQ ID NO: 549024 - RNA, 19 nt, Homo sapiens
ugccuuggguucagugauu

SEQ ID NO: 549025 - RNA, 19 nt, Homo sapiens
ggaaguacaagugaaugga

SEQ ID NO: 549026 - RNA, 19 nt, Homo sapiens
gaguugaggaaguucauga

SEQ ID NO: 549027 - RNA, 19 nt, Homo sapiens
aaucugcucuuauucuucu

SEQ ID NO: 549028 - RNA, 19 nt, Homo sapiens
aguaguaaaugccuuaguc

SEQ ID NO: 549029 - RNA, 19 nt, Homo sapiens
gcuguugugauagagauua

SEQ ID NO: 549030 - RNA, 19 nt, Homo sapiens
gccugaauuugcuagugua

SEQ ID NO: 549031 - RNA, 19 nt, Homo sapiens
ucgaaauguugaaggaguu

SEQ ID NO: 549032 - RNA, 19 nt, Homo sapiens
aaguacaagugaauggaaa

SEQ ID NO: 549033 - RNA, 19 nt, Homo sapiens
uaguguaggcucuaaauca

SEQ ID NO: 549034 - RNA, 19 nt, Homo sapiens
uggaaagguuguucugaag

SEQ ID NO: 549035 - RNA, 19 nt, Homo sapiens
gcuaguguaggcucuaaau

SEQ ID NO: 549036 - RNA, 19 nt, Homo sapiens
guauacuucuuuacacaac

SEQ ID NO: 549037 - RNA, 19 nt, Homo sapiens
uguaguaguaaaugccuua

SEQ ID NO: 549038 - RNA, 19 nt, Homo sapiens
gugauacaguggaaguaca

SEQ ID NO: 549039 - RNA, 19 nt, Homo sapiens
ggugcuauauuuagaucca

SEQ ID NO: 549040 - RNA, 19 nt, Homo sapiens
ggaaaucuugucagagaac

SEQ ID NO: 549041 - RNA, 19 nt, Homo sapiens
uaguaacaaucuagagaag

SEQ ID NO: 549042 - RNA, 19 nt, Homo sapiens
uguaggcucuaaaucaagu

SEQ ID NO: 549043 - RNA, 19 nt, Homo sapiens
gaauucacgcuacuaccau

SEQ ID NO: 549044 - RNA, 19 nt, Homo sapiens
gguccuugcugggugcuau

SEQ ID NO: 549045 - RNA, 19 nt, Homo sapiens
ggacuaaagcugaaaacau

SEQ ID NO: 549046 - RNA, 19 nt, Homo sapiens
uucagugauuguaguagua

SEQ ID NO: 549047 - RNA, 19 nt, Homo sapiens
gugaauggaaaucuuguca

SEQ ID NO: 549048 - RNA, 19 nt, Homo sapiens
aagaagcccaggaggacua

SEQ ID NO: 549049 - RNA, 19 nt, Homo sapiens
cagcaguuagcauuucuug

SEQ ID NO: 549050 - RNA, 19 nt, Homo sapiens
ccagaaaaccccagaagug

SEQ ID NO: 549051 - RNA, 19 nt, Homo sapiens
ggcucuaaaucaaguguag

SEQ ID NO: 549052 - RNA, 19 nt, Homo sapiens
caacuccaacgggcugaaa

SEQ ID NO: 549053 - RNA, 19 nt, Homo sapiens
uacacaaccuauccauuac

SEQ ID NO: 549054 - RNA, 19 nt, Homo sapiens
agauccaacucuuuguguu

SEQ ID NO: 549055 - RNA, 19 nt, Homo sapiens
gagaugccuuggguucagu

SEQ ID NO: 549056 - RNA, 19 nt, Homo sapiens
caguggaaguacaagugaa

SEQ ID NO: 549057 - RNA, 19 nt, Homo sapiens
ggaacuggaagaagauagg

SEQ ID NO: 549058 - RNA, 19 nt, Homo sapiens
gagaaccugaccauaugga

SEQ ID NO: 549059 - RNA, 19 nt, Homo sapiens
uggaaaucuugucagagaa

SEQ ID NO: 549060 - RNA, 19 nt, Homo sapiens
ucacggaauucacgcuacu

SEQ ID NO: 549061 - RNA, 19 nt, Homo sapiens
guguuguaaugguuuguau

SEQ ID NO: 549062 - RNA, 19 nt, Homo sapiens
acucaugcaucaguuuaug

SEQ ID NO: 549063 - RNA, 19 nt, Homo sapiens
gaauagaugugacuaguuc

SEQ ID NO: 549064 - RNA, 19 nt, Homo sapiens
gcacagcgacuaccacauc

SEQ ID NO: 549065 - RNA, 19 nt, Homo sapiens
gcacacagccuggccauca

SEQ ID NO: 549066 - RNA, 19 nt, Homo sapiens
gcacggaggcagcuauaug

SEQ ID NO: 549067 - RNA, 19 nt, Homo sapiens
gggaauagaugugacuagu

SEQ ID NO: 549068 - RNA, 19 nt, Homo sapiens
gcugugcuaugguuucuau

SEQ ID NO: 549069 - RNA, 19 nt, Homo sapiens
ucacuggcauccuccugua

SEQ ID NO: 549070 - RNA, 19 nt, Homo sapiens
ggaauagaugugacuaguu

SEQ ID NO: 549071 - RNA, 19 nt, Homo sapiens
gcaucugccugucuaugug

SEQ ID NO: 549072 - RNA, 19 nt, Homo sapiens
caucagcaccuuccucuuc

SEQ ID NO: 549073 - RNA, 19 nt, Homo sapiens
cgcugcagcuccaccaaua

SEQ ID NO: 549074 - RNA, 19 nt, Homo sapiens
gcccuuggcuaucccugaa

SEQ ID NO: 549075 - RNA, 19 nt, Homo sapiens
gcaguccauuugucugugu

SEQ ID NO: 549076 - RNA, 19 nt, Homo sapiens
gcaccuuccucuucuccau

SEQ ID NO: 549077 - RNA, 19 nt, Homo sapiens
cuucaagccucaauacaag

SEQ ID NO: 549078 - RNA, 19 nt, Homo sapiens
ugucuuagcccugugguuu

SEQ ID NO: 549079 - RNA, 19 nt, Homo sapiens
cugcugcccugaucacaga

SEQ ID NO: 549080 - RNA, 19 nt, Homo sapiens
gaccgaugcagcccacuug

SEQ ID NO: 549081 - RNA, 19 nt, Homo sapiens
ccauccaugugucuguuug

SEQ ID NO: 549082 - RNA, 19 nt, Homo sapiens
ccgagacguucuucgaauc

SEQ ID NO: 549083 - RNA, 19 nt, Homo sapiens
agucugugccaaccuguua

SEQ ID NO: 549084 - RNA, 19 nt, Homo sapiens
cuauguggcugugcuaugg

SEQ ID NO: 549085 - RNA, 19 nt, Homo sapiens
ggaugugggcagcaugaug

SEQ ID NO: 549086 - RNA, 19 nt, Homo sapiens
ccuaccaccugccaguuuc

SEQ ID NO: 549087 - RNA, 19 nt, Homo sapiens
cgaauccucauggaaggua

SEQ ID NO: 549088 - RNA, 19 nt, Homo sapiens
ccuccauccucaucuacuu

SEQ ID NO: 549089 - RNA, 19 nt, Homo sapiens
gugcuaugguuucuaugag

SEQ ID NO: 549090 - RNA, 19 nt, Homo sapiens
gcacuuuguccgugugucu

SEQ ID NO: 549091 - RNA, 19 nt, Homo sapiens
gcggaugugggcagcauga

SEQ ID NO: 549092 - RNA, 19 nt, Homo sapiens
gcugcagcuccaccaauaa

SEQ ID NO: 549093 - RNA, 19 nt, Homo sapiens
cugcacaccuggccaucga

SEQ ID NO: 549094 - RNA, 19 nt, Homo sapiens
uacgcucacuuaccauguu

SEQ ID NO: 549095 - RNA, 19 nt, Homo sapiens
cugcagcuccaccaauaaa

SEQ ID NO: 549096 - RNA, 19 nt, Homo sapiens
ggcccucgcucugucuaug

SEQ ID NO: 549097 - RNA, 19 nt, Homo sapiens
gugcugugcccuuggcuau

SEQ ID NO: 549098 - RNA, 19 nt, Homo sapiens
uaugcugccugugccguuu

SEQ ID NO: 549099 - RNA, 19 nt, Homo sapiens
gagccacgaacauccuuuc

SEQ ID NO: 549100 - RNA, 19 nt, Homo sapiens
gccguuugcuuugucuuca

SEQ ID NO: 549101 - RNA, 19 nt, Homo sapiens
uccgagacguucuucgaau

SEQ ID NO: 549102 - RNA, 19 nt, Homo sapiens
cuccaccgcugacccugaa

SEQ ID NO: 549103 - RNA, 19 nt, Homo sapiens
gggcccuuacgcucacuua

SEQ ID NO: 549104 - RNA, 19 nt, Homo sapiens
cugcaccugugggcccuua

SEQ ID NO: 549105 - RNA, 19 nt, Homo sapiens
caugaugggcagccucuuc

SEQ ID NO: 549106 - RNA, 19 nt, Homo sapiens
ggacagaacuugugcaaau

SEQ ID NO: 549107 - RNA, 19 nt, Homo sapiens
gcaaagaacuauccauaug

SEQ ID NO: 549108 - RNA, 19 nt, Homo sapiens
gcaaauagccuagcaauca

SEQ ID NO: 549109 - RNA, 19 nt, Homo sapiens
gaccaagacuuaccuuuga

SEQ ID NO: 549110 - RNA, 19 nt, Homo sapiens
cuauucagcuucagaguua

SEQ ID NO: 549111 - RNA, 19 nt, Homo sapiens
uuaaauaucuggucucuca

SEQ ID NO: 549112 - RNA, 19 nt, Homo sapiens
ggaagcgccucaaaucuau

SEQ ID NO: 549113 - RNA, 19 nt, Homo sapiens
caaagaagccuugaugaaa

SEQ ID NO: 549114 - RNA, 19 nt, Homo sapiens
gggaacuccugccuuauuu

SEQ ID NO: 549115 - RNA, 19 nt, Homo sapiens
gaacuauccauaugaacua

SEQ ID NO: 549116 - RNA, 19 nt, Homo sapiens
gaaguacaguccaaagcaa

SEQ ID NO: 549117 - RNA, 19 nt, Homo sapiens
agugagagcugcauuugua

SEQ ID NO: 549118 - RNA, 19 nt, Homo sapiens
ggccgacgaugauuccuua

SEQ ID NO: 549119 - RNA, 19 nt, Homo sapiens
ucaaaucuaugcuaaggaa

SEQ ID NO: 549120 - RNA, 19 nt, Homo sapiens
gcacugcccucgagaacug

SEQ ID NO: 549121 - RNA, 19 nt, Homo sapiens
gcaauaaaugcaaaccuaa

SEQ ID NO: 549122 - RNA, 19 nt, Homo sapiens
cagaugcacuucauauguu

SEQ ID NO: 549123 - RNA, 19 nt, Homo sapiens
guccaaagcaaaccauuua

SEQ ID NO: 549124 - RNA, 19 nt, Homo sapiens
guggauacauugcaaauag

SEQ ID NO: 549125 - RNA, 19 nt, Homo sapiens
ggaccaagacuuaccuuug

SEQ ID NO: 549126 - RNA, 19 nt, Homo sapiens
caaagaacuauccauauga

SEQ ID NO: 549127 - RNA, 19 nt, Homo sapiens
gaacuccugccuuauuuau

SEQ ID NO: 549128 - RNA, 19 nt, Homo sapiens
ggagauauaaugcucauca

SEQ ID NO: 549129 - RNA, 19 nt, Homo sapiens
gugcaaagaacuauccaua

SEQ ID NO: 549130 - RNA, 19 nt, Homo sapiens
cauaugggauacaguaguu

SEQ ID NO: 549131 - RNA, 19 nt, Homo sapiens
gacagaacuugugcaaauu

SEQ ID NO: 549132 - RNA, 19 nt, Homo sapiens
ggaguugcaguuaauguaa

SEQ ID NO: 549133 - RNA, 19 nt, Homo sapiens
gaacuugugcaaauuguca

SEQ ID NO: 549134 - RNA, 19 nt, Homo sapiens
aaacagagagagauacuga

SEQ ID NO: 549135 - RNA, 19 nt, Homo sapiens
guacaugcuuugggagauu

SEQ ID NO: 549136 - RNA, 19 nt, Homo sapiens
caaauagccuagcaaucau

SEQ ID NO: 549137 - RNA, 19 nt, Homo sapiens
gaguguuggugugcuaaua

SEQ ID NO: 549138 - RNA, 19 nt, Homo sapiens
ggaacuccugccuuauuua

SEQ ID NO: 549139 - RNA, 19 nt, Homo sapiens
uuugggaacuccugccuua

SEQ ID NO: 549140 - RNA, 19 nt, Homo sapiens
gauguacuauucagcuuca

SEQ ID NO: 549141 - RNA, 19 nt, Homo sapiens
cugcauacaucauacgauu

SEQ ID NO: 549142 - RNA, 19 nt, Homo sapiens
ccaaagcaaaccauuuauu

SEQ ID NO: 549143 - RNA, 19 nt, Homo sapiens
caccgcagcuguuggaguu

SEQ ID NO: 549144 - RNA, 19 nt, Homo sapiens
ggauuccucuuauaugaag

SEQ ID NO: 549145 - RNA, 19 nt, Homo sapiens
ugggauuccucuuauauga

SEQ ID NO: 549146 - RNA, 19 nt, Homo sapiens
ugagagcaauaaaugcaaa

SEQ ID NO: 549147 - RNA, 19 nt, Homo sapiens
ucagaguucuagucccuaa

SEQ ID NO: 549148 - RNA, 19 nt, Homo sapiens
gaaggugugccaagccauu

SEQ ID NO: 549149 - RNA, 19 nt, Homo sapiens
agaugcacuucauauguua

SEQ ID NO: 549150 - RNA, 19 nt, Homo sapiens
aaagccagguugaccauug

SEQ ID NO: 549151 - RNA, 19 nt, Homo sapiens
ccuggaaguucaucuaaau

SEQ ID NO: 549152 - RNA, 19 nt, Homo sapiens
aaagaagccuugaugaaaa

SEQ ID NO: 549153 - RNA, 19 nt, Homo sapiens
gcauacaucauacgauuca

SEQ ID NO: 549154 - RNA, 19 nt, Homo sapiens
gagauuugguacagagugu

SEQ ID NO: 549155 - RNA, 19 nt, Homo sapiens
guagguggauacauugcaa

SEQ ID NO: 549156 - RNA, 19 nt, Homo sapiens
gcaaauugucagaguucua

SEQ ID NO: 549157 - RNA, 19 nt, Homo sapiens
gggauacaguaguuauaau

SEQ ID NO: 549158 - RNA, 19 nt, Homo sapiens
uuucaucgcuuagagguuu

SEQ ID NO: 549159 - RNA, 19 nt, Homo sapiens
aagauucaccuuuggauuu

SEQ ID NO: 549160 - RNA, 19 nt, Homo sapiens
ugaccuaagcgccaucaua

SEQ ID NO: 549161 - RNA, 19 nt, Homo sapiens
ugacagaugcacuucauau

SEQ ID NO: 549162 - RNA, 19 nt, Homo sapiens
gaccauugcugccguucug

SEQ ID NO: 549163 - RNA, 19 nt, Homo sapiens
agagagagauacugaagca

SEQ ID NO: 549164 - RNA, 19 nt, Homo sapiens
cagcaaacagagagagaua

SEQ ID NO: 549165 - RNA, 19 nt, Homo sapiens
agcaauaaaugcaaaccua

SEQ ID NO: 549166 - RNA, 19 nt, Homo sapiens
gaguucuagucccuaauuu

SEQ ID NO: 549167 - RNA, 19 nt, Homo sapiens
ggaaguacaguccaaagca

SEQ ID NO: 549168 - RNA, 19 nt, Homo sapiens
cgacgaugauuccuuacug

SEQ ID NO: 549169 - RNA, 19 nt, Homo sapiens
uaucuggucucucacuuca

SEQ ID NO: 549170 - RNA, 19 nt, Homo sapiens
agauguauauucagucgaa

SEQ ID NO: 549171 - RNA, 19 nt, Homo sapiens
caucuguacauacguauuu

SEQ ID NO: 549172 - RNA, 19 nt, Homo sapiens
gaacuggcgcuccggugaa

SEQ ID NO: 549173 - RNA, 19 nt, Homo sapiens
gaagcugugcaaagaacua

SEQ ID NO: 549174 - RNA, 19 nt, Homo sapiens
uuagugugcuguuggugua

SEQ ID NO: 549175 - RNA, 19 nt, Homo sapiens
gggaggaaguacaguccaa

SEQ ID NO: 549176 - RNA, 19 nt, Homo sapiens
aaucauaugggauacagua

SEQ ID NO: 549177 - RNA, 19 nt, Homo sapiens
acagucagcugaguuugaa

SEQ ID NO: 549178 - RNA, 19 nt, Homo sapiens
augcaaaccuaaaugagaa

SEQ ID NO: 549179 - RNA, 19 nt, Homo sapiens
uggaagcgccucaaaucua

SEQ ID NO: 549180 - RNA, 19 nt, Homo sapiens
uuucauuacuuguggcuuu

SEQ ID NO: 549181 - RNA, 19 nt, Homo sapiens
gcaguuaauguaauaaugg

SEQ ID NO: 549182 - RNA, 19 nt, Homo sapiens
auaugaagcugugcaaaga

SEQ ID NO: 549183 - RNA, 19 nt, Homo sapiens
caacauuucgaaucauaug

SEQ ID NO: 549184 - RNA, 19 nt, Homo sapiens
gaguugugguggccgauga

SEQ ID NO: 549185 - RNA, 19 nt, Homo sapiens
ugucagcuaugauuagugu

SEQ ID NO: 549186 - RNA, 19 nt, Homo sapiens
ccaacagucagcugaguuu

SEQ ID NO: 549187 - RNA, 19 nt, Homo sapiens
ggcaagaaguggacagaac

SEQ ID NO: 549188 - RNA, 19 nt, Homo sapiens
gaguugcaguuaauguaau

SEQ ID NO: 549189 - RNA, 19 nt, Homo sapiens
gaccuaagcgccaucauac

SEQ ID NO: 549190 - RNA, 19 nt, Homo sapiens
uauguuaacugaccuaagc

SEQ ID NO: 549191 - RNA, 19 nt, Homo sapiens
gcucaucaccgcagcuguu

SEQ ID NO: 549192 - RNA, 19 nt, Homo sapiens
caccagcgccuuugacuuc

SEQ ID NO: 549193 - RNA, 19 nt, Homo sapiens
caagccagaauacaagauu

SEQ ID NO: 549194 - RNA, 19 nt, Homo sapiens
cgccucaaaucuaugcuaa

SEQ ID NO: 549195 - RNA, 19 nt, Homo sapiens
cuuaugggauuccucuuau

SEQ ID NO: 549196 - RNA, 19 nt, Homo sapiens
gaaaggugaaagccagguu

SEQ ID NO: 549197 - RNA, 19 nt, Homo sapiens
gacuugagagcaauaaaug

SEQ ID NO: 549198 - RNA, 19 nt, Homo sapiens
ucacagacuugagagcaau

SEQ ID NO: 549199 - RNA, 19 nt, Homo sapiens
gcuguuggaguugcaguua

SEQ ID NO: 549200 - RNA, 19 nt, Homo sapiens
gagaacuuguagguggaua

SEQ ID NO: 549201 - RNA, 19 nt, Homo sapiens
guucuagucccuaauuuua

SEQ ID NO: 549202 - RNA, 19 nt, Homo sapiens
caaauugucagaguucuag

SEQ ID NO: 549203 - RNA, 19 nt, Homo sapiens
uuaugggauuccucuuaua

SEQ ID NO: 549204 - RNA, 19 nt, Homo sapiens
guauauacuuaugggauuc

SEQ ID NO: 549205 - RNA, 19 nt, Homo sapiens
ccucaaaucuaugcuaagg

SEQ ID NO: 549206 - RNA, 19 nt, Homo sapiens
gaacaacagugcugccuua

SEQ ID NO: 549207 - RNA, 19 nt, Homo sapiens
gauauaaguucgaagauga

SEQ ID NO: 549208 - RNA, 19 nt, Homo sapiens
ggaaugacaugcuacuaaa

SEQ ID NO: 549209 - RNA, 19 nt, Homo sapiens
caacagugcugccuuaaga

SEQ ID NO: 549210 - RNA, 19 nt, Homo sapiens
cauaugaccuggacaacua

SEQ ID NO: 549211 - RNA, 19 nt, Homo sapiens
gcacaagacugcuggagau

SEQ ID NO: 549212 - RNA, 19 nt, Homo sapiens
caacaaauggcaugaaauu

SEQ ID NO: 549213 - RNA, 19 nt, Homo sapiens
acacaugacucucaccaua

SEQ ID NO: 549214 - RNA, 19 nt, Homo sapiens
acacggagcugucauguau

SEQ ID NO: 549215 - RNA, 19 nt, Homo sapiens
cuaaaugggcuucuaaaua

SEQ ID NO: 549216 - RNA, 19 nt, Homo sapiens
cugcaaagcuacccagaua

SEQ ID NO: 549217 - RNA, 19 nt, Homo sapiens
acagugaaguguucuuaua

SEQ ID NO: 549218 - RNA, 19 nt, Homo sapiens
gauaaagucgucuaugaaa

SEQ ID NO: 549219 - RNA, 19 nt, Homo sapiens
gacagugaguucagaauga

SEQ ID NO: 549220 - RNA, 19 nt, Homo sapiens
cuacuuagcuucacucaag

SEQ ID NO: 549221 - RNA, 19 nt, Homo sapiens
uaucagagguuugacauga

SEQ ID NO: 549222 - RNA, 19 nt, Homo sapiens
agaaggauuucaugucuuu

SEQ ID NO: 549223 - RNA, 19 nt, Homo sapiens
gaagugagaguccuaaaca

SEQ ID NO: 549224 - RNA, 19 nt, Homo sapiens
gaaugacagugaaguguuc

SEQ ID NO: 549225 - RNA, 19 nt, Homo sapiens
ccauagauguuucucaguu

SEQ ID NO: 549226 - RNA, 19 nt, Homo sapiens
ucagggaacuccauagaug

SEQ ID NO: 549227 - RNA, 19 nt, Homo sapiens
caagacugcuggagauguu

SEQ ID NO: 549228 - RNA, 19 nt, Homo sapiens
gagaagaguaggagugaaa

SEQ ID NO: 549229 - RNA, 19 nt, Homo sapiens
gcagugccuuaaucuguaa

SEQ ID NO: 549230 - RNA, 19 nt, Homo sapiens
ggaaauaacaguggaguuc

SEQ ID NO: 549231 - RNA, 19 nt, Homo sapiens
guucgaagaugauaaaguc

SEQ ID NO: 549232 - RNA, 19 nt, Homo sapiens
uaacagucaucucuacaug

SEQ ID NO: 549233 - RNA, 19 nt, Homo sapiens
cagaugggauggagcauug

SEQ ID NO: 549234 - RNA, 19 nt, Homo sapiens
caacaucaagcuggucuua

SEQ ID NO: 549235 - RNA, 19 nt, Homo sapiens
gcaaagcuacccagauaau

SEQ ID NO: 549236 - RNA, 19 nt, Homo sapiens
ccagucggcuccucuguga

SEQ ID NO: 549237 - RNA, 19 nt, Homo sapiens
cgaguacccucuagugaga

SEQ ID NO: 549238 - RNA, 19 nt, Homo sapiens
gaaaaggacugugucaaau

SEQ ID NO: 549239 - RNA, 19 nt, Homo sapiens
gaucuucucuucacaagcu

SEQ ID NO: 549240 - RNA, 19 nt, Homo sapiens
ccagaaggauuucaugucu

SEQ ID NO: 549241 - RNA, 19 nt, Homo sapiens
gguuugacaugaaggcuuu

SEQ ID NO: 549242 - RNA, 19 nt, Homo sapiens
caaauggcaugaaauugca

SEQ ID NO: 549243 - RNA, 19 nt, Homo sapiens
aaaggacugugucaaauca

SEQ ID NO: 549244 - RNA, 19 nt, Homo sapiens
ucucugaagcuuacauuua

SEQ ID NO: 549245 - RNA, 19 nt, Homo sapiens
guugguaaauccugccuuu

SEQ ID NO: 549246 - RNA, 19 nt, Homo sapiens
ggauguggaacgagauaua

SEQ ID NO: 549247 - RNA, 19 nt, Homo sapiens
caaaauaucuagagacagu

SEQ ID NO: 549248 - RNA, 19 nt, Homo sapiens
gcaaaacucugcucaaaac

SEQ ID NO: 549249 - RNA, 19 nt, Homo sapiens
gagcugucauguaucaguu

SEQ ID NO: 549250 - RNA, 19 nt, Homo sapiens
ucacccguuucuauaguua

SEQ ID NO: 549251 - RNA, 19 nt, Homo sapiens
ggugaucuauccugagugu

SEQ ID NO: 549252 - RNA, 19 nt, Homo sapiens
gcuuaagucugugagcuuu

SEQ ID NO: 549253 - RNA, 19 nt, Homo sapiens
acaucaagcuggucuuaga

SEQ ID NO: 549254 - RNA, 19 nt, Homo sapiens
ucaagcuggucuuagauga

SEQ ID NO: 549255 - RNA, 19 nt, Homo sapiens
gauaauuccuaccaacaac

SEQ ID NO: 549256 - RNA, 19 nt, Homo sapiens
gaaguuggguccauuuacc

SEQ ID NO: 549257 - RNA, 19 nt, Homo sapiens
augauaaagucgucuauga

SEQ ID NO: 549258 - RNA, 19 nt, Homo sapiens
cauagauguuucucaguug

SEQ ID NO: 549259 - RNA, 19 nt, Homo sapiens
ggaacuccauagauguuuc

SEQ ID NO: 549260 - RNA, 19 nt, Homo sapiens
ucuacuaccuguacgagaa

SEQ ID NO: 549261 - RNA, 19 nt, Homo sapiens
gauguggaacgagauauaa

SEQ ID NO: 549262 - RNA, 19 nt, Homo sapiens
ugagucacccguuucuaua

SEQ ID NO: 549263 - RNA, 19 nt, Homo sapiens
gaucuagaagcaacaaaug

SEQ ID NO: 549264 - RNA, 19 nt, Homo sapiens
cugggaagcuuaagucugu

SEQ ID NO: 549265 - RNA, 19 nt, Homo sapiens
cgagauauaaguucgaaga

SEQ ID NO: 549266 - RNA, 19 nt, Homo sapiens
aaacacaaccagcucuuga

SEQ ID NO: 549267 - RNA, 19 nt, Homo sapiens
guggauggcugugcauaug

SEQ ID NO: 549268 - RNA, 19 nt, Homo sapiens
ccaaccaauuuacauggaa

SEQ ID NO: 549269 - RNA, 19 nt, Homo sapiens
ucacuaaaugggcuucuaa

SEQ ID NO: 549270 - RNA, 19 nt, Homo sapiens
gacccauccugaucacuau

SEQ ID NO: 549271 - RNA, 19 nt, Homo sapiens
ccauggauccagacucuuu

SEQ ID NO: 549272 - RNA, 19 nt, Homo sapiens
gcuucagccucuugauuga

SEQ ID NO: 549273 - RNA, 19 nt, Homo sapiens
agaaauggcaugcaucugu

SEQ ID NO: 549274 - RNA, 19 nt, Homo sapiens
ggugucggcucaucugauc

SEQ ID NO: 549275 - RNA, 19 nt, Homo sapiens
ugacagugaaguguucuua

SEQ ID NO: 549276 - RNA, 19 nt, Homo sapiens
gcugguacgguuccacaua

SEQ ID NO: 549277 - RNA, 19 nt, Homo sapiens
caguauccauggugaucua

SEQ ID NO: 549278 - RNA, 19 nt, Homo sapiens
caucaguucuacuuagcuu

SEQ ID NO: 549279 - RNA, 19 nt, Homo sapiens
ugagccagcugcaugacaa

SEQ ID NO: 549280 - RNA, 19 nt, Homo sapiens
ggagaagaguaggagugaa

SEQ ID NO: 549281 - RNA, 19 nt, Homo sapiens
ucucuagccuggucuacuu

SEQ ID NO: 549282 - RNA, 19 nt, Homo sapiens
cucugaagcuuacauuuau

SEQ ID NO: 549283 - RNA, 19 nt, Homo sapiens
caagguaacagucaucucu

SEQ ID NO: 549284 - RNA, 19 nt, Homo sapiens
ugcagugccuuaaucugua

SEQ ID NO: 549285 - RNA, 19 nt, Homo sapiens
ugauaaagucgucuaugaa

SEQ ID NO: 549286 - RNA, 19 nt, Homo sapiens
ugagggcuaccuaugauaa

SEQ ID NO: 549287 - RNA, 19 nt, Homo sapiens
ugugucaaaucacuaaaug

SEQ ID NO: 549288 - RNA, 19 nt, Homo sapiens
gguaaauccugccuuucca

SEQ ID NO: 549289 - RNA, 19 nt, Homo sapiens
caccauggauccagacucu

SEQ ID NO: 549290 - RNA, 19 nt, Homo sapiens
caagaaauggcaugcaucu

SEQ ID NO: 549291 - RNA, 19 nt, Homo sapiens
gccaaccaauuuacaugga

SEQ ID NO: 549292 - RNA, 19 nt, Homo sapiens
caaagcuacccagauaauu

SEQ ID NO: 549293 - RNA, 19 nt, Homo sapiens
agauauaaguucgaagaug

SEQ ID NO: 549294 - RNA, 19 nt, Homo sapiens
ggacugugucaaaucacua

SEQ ID NO: 549295 - RNA, 19 nt, Homo sapiens
aaagcuacccagauaauuc

SEQ ID NO: 549296 - RNA, 19 nt, Homo sapiens
gcaugcaucugugguggau

SEQ ID NO: 549297 - RNA, 19 nt, Homo sapiens
gugaaguuggguccauuua

SEQ ID NO: 549298 - RNA, 19 nt, Homo sapiens
gacaugcuacuaaacauca

SEQ ID NO: 549299 - RNA, 19 nt, Homo sapiens
gcaacaaauggcaugaaau

SEQ ID NO: 549300 - RNA, 19 nt, Homo sapiens
uuaagucugugagcuuuga

SEQ ID NO: 549301 - RNA, 19 nt, Homo sapiens
cagaaggauuucaugucuu

SEQ ID NO: 549302 - RNA, 19 nt, Homo sapiens
gggagaagaguaggaguga

SEQ ID NO: 549303 - RNA, 19 nt, Homo sapiens
aggaaugacaugcuacuaa

SEQ ID NO: 549304 - RNA, 19 nt, Homo sapiens
gugaaguguucuuauagca

SEQ ID NO: 549305 - RNA, 19 nt, Homo sapiens
caugcucucuggacggauu

SEQ ID NO: 549306 - RNA, 19 nt, Homo sapiens
gcuaaugacuccagaaaca

SEQ ID NO: 549307 - RNA, 19 nt, Homo sapiens
ggaccacgguguucucaga

SEQ ID NO: 549308 - RNA, 19 nt, Homo sapiens
ccagaaacaugauauacau

SEQ ID NO: 549309 - RNA, 19 nt, Homo sapiens
cagaagauguggucagguu

SEQ ID NO: 549310 - RNA, 19 nt, Homo sapiens
gcaccuuccugcuccauga

SEQ ID NO: 549311 - RNA, 19 nt, Homo sapiens
gcaggcaugugacagaaga

SEQ ID NO: 549312 - RNA, 19 nt, Homo sapiens
gcgcagagauucccaucga

SEQ ID NO: 549313 - RNA, 19 nt, Homo sapiens
gcuauaggcucuucaucug

SEQ ID NO: 549314 - RNA, 19 nt, Homo sapiens
ggacuuccauggcugucuu

SEQ ID NO: 549315 - RNA, 19 nt, Homo sapiens
gaagauguggucagguuug

SEQ ID NO: 549316 - RNA, 19 nt, Homo sapiens
ggacccagaugaacucaac

SEQ ID NO: 549317 - RNA, 19 nt, Homo sapiens
cagaggagaagcugacuuu

SEQ ID NO: 549318 - RNA, 19 nt, Homo sapiens
ggacuaaccgcgcagagau

SEQ ID NO: 549319 - RNA, 19 nt, Homo sapiens
ggcaacagcaugcagguaa

SEQ ID NO: 549320 - RNA, 19 nt, Homo sapiens
gaacuggaacgcugagaag

SEQ ID NO: 549321 - RNA, 19 nt, Homo sapiens
ugugucugcuuccgaauaa

SEQ ID NO: 549322 - RNA, 19 nt, Homo sapiens
gcagugggcuuugccuucu

SEQ ID NO: 549323 - RNA, 19 nt, Homo sapiens
ugucaaugcuguaacaaag

SEQ ID NO: 549324 - RNA, 19 nt, Homo sapiens
ggaaggcucggcugacauc

SEQ ID NO: 549325 - RNA, 19 nt, Homo sapiens
ccagauacacuccaguuca

SEQ ID NO: 549326 - RNA, 19 nt, Homo sapiens
ggagccagccauccugaga

SEQ ID NO: 549327 - RNA, 19 nt, Homo sapiens
ucaaugcuguaacaaaggu

SEQ ID NO: 549328 - RNA, 19 nt, Homo sapiens
gcaacagcaugcagguaac

SEQ ID NO: 549329 - RNA, 19 nt, Homo sapiens
gcuguuauccugguucuca

SEQ ID NO: 549330 - RNA, 19 nt, Homo sapiens
guggaaggcucggcugaca

SEQ ID NO: 549331 - RNA, 19 nt, Homo sapiens
cguaaccgcaggcauguga

SEQ ID NO: 549332 - RNA, 19 nt, Homo sapiens
ugacagaagaagcagaugu

SEQ ID NO: 549333 - RNA, 19 nt, Homo sapiens
ggccagauacacuccaguu

SEQ ID NO: 549334 - RNA, 19 nt, Homo sapiens
ggucagguuugagguugga

SEQ ID NO: 549335 - RNA, 19 nt, Homo sapiens
gcaugugacagaagaagca

SEQ ID NO: 549336 - RNA, 19 nt, Homo sapiens
guaguacugagcugugcua

SEQ ID NO: 549337 - RNA, 19 nt, Homo sapiens
ccgcaggcaugugacagaa

SEQ ID NO: 549338 - RNA, 19 nt, Homo sapiens
uaaugacuccagaaacaug

SEQ ID NO: 549339 - RNA, 19 nt, Homo sapiens
gacucugacugcuguuauc

SEQ ID NO: 549340 - RNA, 19 nt, Homo sapiens
aggcucggcugacaucugu

SEQ ID NO: 549341 - RNA, 19 nt, Homo sapiens
gcaggacccagaugaacuc

SEQ ID NO: 549342 - RNA, 19 nt, Homo sapiens
cagauacacuccaguucac

SEQ ID NO: 549343 - RNA, 19 nt, Homo sapiens
aagauguggucagguuuga

SEQ ID NO: 549344 - RNA, 19 nt, Homo sapiens
gacuaaccgcgcagagauu

SEQ ID NO: 549345 - RNA, 19 nt, Homo sapiens
ugggaaaccuguccaucgu

SEQ ID NO: 549346 - RNA, 19 nt, Homo sapiens
gagcaggacccagaugaac

SEQ ID NO: 549347 - RNA, 19 nt, Homo sapiens
ugacuccagaaacaugaua

SEQ ID NO: 549348 - RNA, 19 nt, Homo sapiens
cagaaugccuccccuuauc

SEQ ID NO: 549349 - RNA, 19 nt, Homo sapiens
guagagcagugggcuuugc

SEQ ID NO: 549350 - RNA, 19 nt, Homo sapiens
ccacucugauggucauggu

SEQ ID NO: 549351 - RNA, 19 nt, Homo sapiens
guucacaguggaugucuuc

SEQ ID NO: 549352 - RNA, 19 nt, Homo sapiens
ugauggaggagaacuggaa

SEQ ID NO: 549353 - RNA, 19 nt, Homo sapiens
gggugaccaugaaguagag

SEQ ID NO: 549354 - RNA, 19 nt, Homo sapiens
ucagcaagccuuccaacag

SEQ ID NO: 549355 - RNA, 19 nt, Homo sapiens
gugagccucuggucuccau

SEQ ID NO: 549356 - RNA, 19 nt, Homo sapiens
gaugucuuccacuuugcua

SEQ ID NO: 549357 - RNA, 19 nt, Homo sapiens
ugccucuucugcauucaaa

SEQ ID NO: 549358 - RNA, 19 nt, Homo sapiens
ugucgacggucucacugau

SEQ ID NO: 549359 - RNA, 19 nt, Homo sapiens
gcaaugaaccugugucuga

SEQ ID NO: 549360 - RNA, 19 nt, Homo sapiens
ggaaccaccuccuccagua

SEQ ID NO: 549361 - RNA, 19 nt, Homo sapiens
uggagaagcuuaucaagaa

SEQ ID NO: 549362 - RNA, 19 nt, Homo sapiens
guagauuccucagccauua

SEQ ID NO: 549363 - RNA, 19 nt, Homo sapiens
ccacagggaucucaaguca

SEQ ID NO: 549364 - RNA, 19 nt, Homo sapiens
ccaacaaccuguauaugga

SEQ ID NO: 549365 - RNA, 19 nt, Homo sapiens
ccaaggagcugagugacaa

SEQ ID NO: 549366 - RNA, 19 nt, Homo sapiens
gcaccaagauguccuuugc

SEQ ID NO: 549367 - RNA, 19 nt, Homo sapiens
caaagaaaccgacaucaag

SEQ ID NO: 549368 - RNA, 19 nt, Homo sapiens
gaaccggggugcuguuuaa

SEQ ID NO: 549369 - RNA, 19 nt, Homo sapiens
gcacugaauuggacaacuc

SEQ ID NO: 549370 - RNA, 19 nt, Homo sapiens
ucagaaacguggcaucuca

SEQ ID NO: 549371 - RNA, 19 nt, Homo sapiens
gacaagagcaccaagaugu

SEQ ID NO: 549372 - RNA, 19 nt, Homo sapiens
ggucaucccuggcccugaa

SEQ ID NO: 549373 - RNA, 19 nt, Homo sapiens
gggaggagguggcugugaa

SEQ ID NO: 549374 - RNA, 19 nt, Homo sapiens
ggagacugauagcauguga

SEQ ID NO: 549375 - RNA, 19 nt, Homo sapiens
gaacaugcgccagucacua

SEQ ID NO: 549376 - RNA, 19 nt, Homo sapiens
gaagaggaacuggugauga

SEQ ID NO: 549377 - RNA, 19 nt, Homo sapiens
gcagcugggucaccugaga

SEQ ID NO: 549378 - RNA, 19 nt, Homo sapiens
gcucagagaauccaucaga

SEQ ID NO: 549379 - RNA, 19 nt, Homo sapiens
gaaacacaauggagaagcu

SEQ ID NO: 549380 - RNA, 19 nt, Homo sapiens
gaacuuaaugcccucaugu

SEQ ID NO: 549381 - RNA, 19 nt, Homo sapiens
gaucucaagucacccaaca

SEQ ID NO: 549382 - RNA, 19 nt, Homo sapiens
ggagguggcugugaagaag

SEQ ID NO: 549383 - RNA, 19 nt, Homo sapiens
ccuuguacauagagaaaua

SEQ ID NO: 549384 - RNA, 19 nt, Homo sapiens
ccaacaugcuaaucaccua

SEQ ID NO: 549385 - RNA, 19 nt, Homo sapiens
gcacuuuucuguuccguuu

SEQ ID NO: 549386 - RNA, 19 nt, Homo sapiens
aaggagagguagacaguga

SEQ ID NO: 549387 - RNA, 19 nt, Homo sapiens
ggaaggagagguagacagu

SEQ ID NO: 549388 - RNA, 19 nt, Homo sapiens
caauucaccugauaaacuc

SEQ ID NO: 549389 - RNA, 19 nt, Homo sapiens
caugaaagccacucguauu

SEQ ID NO: 549390 - RNA, 19 nt, Homo sapiens
ggaacuuaaugcccucaug

SEQ ID NO: 549391 - RNA, 19 nt, Homo sapiens
gaaguagagcugacaucaa

SEQ ID NO: 549392 - RNA, 19 nt, Homo sapiens
ggacauugccucagcugau

SEQ ID NO: 549393 - RNA, 19 nt, Homo sapiens
ccaggguugucuuuauauu

SEQ ID NO: 549394 - RNA, 19 nt, Homo sapiens
gaaagccacucguauuccu

SEQ ID NO: 549395 - RNA, 19 nt, Homo sapiens
aaaccgacaucaagcacuu

SEQ ID NO: 549396 - RNA, 19 nt, Homo sapiens
ucaaagaaaccgacaucaa

SEQ ID NO: 549397 - RNA, 19 nt, Homo sapiens
gcaaagccuacuccacuga

SEQ ID NO: 549398 - RNA, 19 nt, Homo sapiens
aaguagagcugacaucaag

SEQ ID NO: 549399 - RNA, 19 nt, Homo sapiens
gaugagcggucugaugaca

SEQ ID NO: 549400 - RNA, 19 nt, Homo sapiens
ggaaggcacagcuagugaa

SEQ ID NO: 549401 - RNA, 19 nt, Homo sapiens
agagguagacagugaagua

SEQ ID NO: 549402 - RNA, 19 nt, Homo sapiens
ggagaagcuuaucaagaag

SEQ ID NO: 549403 - RNA, 19 nt, Homo sapiens
gagccaacaaccuguauau

SEQ ID NO: 549404 - RNA, 19 nt, Homo sapiens
gacauugccucagcugaug

SEQ ID NO: 549405 - RNA, 19 nt, Homo sapiens
cccaggagacuuacuuuaa

SEQ ID NO: 549406 - RNA, 19 nt, Homo sapiens
ugacugcacucccgagaag

SEQ ID NO: 549407 - RNA, 19 nt, Homo sapiens
gguagacagugaaguagag

SEQ ID NO: 549408 - RNA, 19 nt, Homo sapiens
caacaaccuguauauggaa

SEQ ID NO: 549409 - RNA, 19 nt, Homo sapiens
gaauagcaaaccacgaaau

SEQ ID NO: 549410 - RNA, 19 nt, Homo sapiens
gcuaaucaccuacgacgau

SEQ ID NO: 549411 - RNA, 19 nt, Homo sapiens
uuucucagguggcaaugua

SEQ ID NO: 549412 - RNA, 19 nt, Homo sapiens
agccaggguugucuuuaua

SEQ ID NO: 549413 - RNA, 19 nt, Homo sapiens
gaccaauucaccugauaaa

SEQ ID NO: 549414 - RNA, 19 nt, Homo sapiens
caagucacccaacaugcua

SEQ ID NO: 549415 - RNA, 19 nt, Homo sapiens
gagguuaggagacugauag

SEQ ID NO: 549416 - RNA, 19 nt, Homo sapiens
ccaauucaccugauaaacu

SEQ ID NO: 549417 - RNA, 19 nt, Homo sapiens
ggccagauauccucaagac

SEQ ID NO: 549418 - RNA, 19 nt, Homo sapiens
gugcgagaccucaaagaaa

SEQ ID NO: 549419 - RNA, 19 nt, Homo sapiens
gauaaacucuagggacacu

SEQ ID NO: 549420 - RNA, 19 nt, Homo sapiens
gccaacaaccuguauaugg

SEQ ID NO: 549421 - RNA, 19 nt, Homo sapiens
gucgacaucugguccuuug

SEQ ID NO: 549422 - RNA, 19 nt, Homo sapiens
uggcagcuguggaaaugaa

SEQ ID NO: 549423 - RNA, 19 nt, Homo sapiens
ugagcggucugaugacaug

SEQ ID NO: 549424 - RNA, 19 nt, Homo sapiens
gaacacccucuccuuccuu

SEQ ID NO: 549425 - RNA, 19 nt, Homo sapiens
gagaagcuuaucaagaaga

SEQ ID NO: 549426 - RNA, 19 nt, Homo sapiens
ggugcgagaccucaaagaa

SEQ ID NO: 549427 - RNA, 19 nt, Homo sapiens
ggacaucagggagcacuau

SEQ ID NO: 549428 - RNA, 19 nt, Homo sapiens
aagccaggguugucuuuau

SEQ ID NO: 549429 - RNA, 19 nt, Homo sapiens
gccagucacuaucuaccuu

SEQ ID NO: 549430 - RNA, 19 nt, Homo sapiens
uuaaugcccucauguugca

SEQ ID NO: 549431 - RNA, 19 nt, Homo sapiens
ggagggaggagcucagaca

SEQ ID NO: 549432 - RNA, 19 nt, Homo sapiens
aagaggaacuggugaugag

SEQ ID NO: 549433 - RNA, 19 nt, Homo sapiens
ggaauagcaaaccacgaaa

SEQ ID NO: 549434 - RNA, 19 nt, Homo sapiens
ccacucguauuccuuguac

SEQ ID NO: 549435 - RNA, 19 nt, Homo sapiens
gcagcuacaugagcaggau

SEQ ID NO: 549436 - RNA, 19 nt, Homo sapiens
caauggagaagcuuaucaa

SEQ ID NO: 549437 - RNA, 19 nt, Homo sapiens
caucagggagcacuaugaa

SEQ ID NO: 549438 - RNA, 19 nt, Homo sapiens
cgaaaucgcccaucauucc

SEQ ID NO: 549439 - RNA, 19 nt, Homo sapiens
cacgaaaucgcccaucauu

SEQ ID NO: 549440 - RNA, 19 nt, Homo sapiens
ccacuuagacugcacuuuu

SEQ ID NO: 549441 - RNA, 19 nt, Homo sapiens
cacauaaucaacagaaaga

SEQ ID NO: 549442 - RNA, 19 nt, Homo sapiens
cguauuccuuguacauaga

SEQ ID NO: 549443 - RNA, 19 nt, Homo sapiens
caaccuguauauggaacuu

SEQ ID NO: 549444 - RNA, 19 nt, Homo sapiens
uggaauagcaaaccacgaa

SEQ ID NO: 549445 - RNA, 19 nt, Homo sapiens
gaacugcugacuggugaga

SEQ ID NO: 549446 - RNA, 19 nt, Homo sapiens
gaggugauccgcaaugaac

SEQ ID NO: 549447 - RNA, 19 nt, Homo sapiens
gcaacaaggcaauagaaaa

SEQ ID NO: 549448 - RNA, 19 nt, Homo sapiens
cauaaucaacagaaagaug

SEQ ID NO: 549449 - RNA, 19 nt, Homo sapiens
gccacauaaucaacagaaa

SEQ ID NO: 549450 - RNA, 19 nt, Homo sapiens
caggcgagagcaagcuuua

SEQ ID NO: 549451 - RNA, 19 nt, Homo sapiens
ccaguugcccagaugguuu

SEQ ID NO: 549452 - RNA, 19 nt, Homo sapiens
gcuacugcauccucaugga

SEQ ID NO: 549453 - RNA, 19 nt, Homo sapiens
ggcuuugugucuacccuaa

SEQ ID NO: 549454 - RNA, 19 nt, Homo sapiens
gcaagcaacaaggcaauag

SEQ ID NO: 549455 - RNA, 19 nt, Homo sapiens
acaagcagcagcaggaaga

SEQ ID NO: 549456 - RNA, 19 nt, Homo sapiens
gaggaaggcacagcuagug

SEQ ID NO: 549457 - RNA, 19 nt, Homo sapiens
ucagggagcacuaugaaag

SEQ ID NO: 549458 - RNA, 19 nt, Homo sapiens
gcacaagcagcagcaggaa

SEQ ID NO: 549459 - RNA, 19 nt, Homo sapiens
cagcagagcuccuuaaaua

SEQ ID NO: 549460 - RNA, 19 nt, Homo sapiens
guaauaaacucuucacauc

SEQ ID NO: 549461 - RNA, 19 nt, Homo sapiens
gaucuccucuuguaauaaa

SEQ ID NO: 549462 - RNA, 19 nt, Homo sapiens
cgagagaccuuuccuuugu

SEQ ID NO: 549463 - RNA, 19 nt, Homo sapiens
uaagugcagucauuucuuu

SEQ ID NO: 549464 - RNA, 19 nt, Homo sapiens
ggugaacucuggaaucuug

SEQ ID NO: 549465 - RNA, 19 nt, Homo sapiens
gcaccucccugcuaauaau

SEQ ID NO: 549466 - RNA, 19 nt, Homo sapiens
gcagagcuccuuaaauaug

SEQ ID NO: 549467 - RNA, 19 nt, Homo sapiens
ucuggaaucuugacuauug

SEQ ID NO: 549468 - RNA, 19 nt, Homo sapiens
gauagugucucucuucucu

SEQ ID NO: 549469 - RNA, 19 nt, Homo sapiens
gggcaaaccuucgccaaga

SEQ ID NO: 549470 - RNA, 19 nt, Homo sapiens
gcaacucuauucauuccuu

SEQ ID NO: 549471 - RNA, 19 nt, Homo sapiens
agaaacaccugcaggaugu

SEQ ID NO: 549472 - RNA, 19 nt, Homo sapiens
ugggaucucuggacucuuu

SEQ ID NO: 549473 - RNA, 19 nt, Homo sapiens
ccgaucuccucuuguaaua

SEQ ID NO: 549474 - RNA, 19 nt, Homo sapiens
ugaagacgcacaugguuaa

SEQ ID NO: 549475 - RNA, 19 nt, Homo sapiens
ggaccuucaccaccucuua

SEQ ID NO: 549476 - RNA, 19 nt, Homo sapiens
gaagcaacucuauucauuc

SEQ ID NO: 549477 - RNA, 19 nt, Homo sapiens
ccaagaagcaccagcugaa

SEQ ID NO: 549478 - RNA, 19 nt, Homo sapiens
ggaaggcugugggaaaucu

SEQ ID NO: 549479 - RNA, 19 nt, Homo sapiens
caagaagacauuuaucaca

SEQ ID NO: 549480 - RNA, 19 nt, Homo sapiens
cagcgacccuccucaaagu

SEQ ID NO: 549481 - RNA, 19 nt, Homo sapiens
ggcgagagaccuuuccuuu

SEQ ID NO: 549482 - RNA, 19 nt, Homo sapiens
guaugaagcaacucuauuc

SEQ ID NO: 549483 - RNA, 19 nt, Homo sapiens
gggcaccucccugcuaaua

SEQ ID NO: 549484 - RNA, 19 nt, Homo sapiens
ggcaaaccuucgccaagaa

SEQ ID NO: 549485 - RNA, 19 nt, Homo sapiens
gaccugcuguugcgcuuug

SEQ ID NO: 549486 - RNA, 19 nt, Homo sapiens
gagagaccuuuccuuugug

SEQ ID NO: 549487 - RNA, 19 nt, Homo sapiens
aaacagugucucagaacua

SEQ ID NO: 549488 - RNA, 19 nt, Homo sapiens
gacagaaugaucucaguga

SEQ ID NO: 549489 - RNA, 19 nt, Homo sapiens
gccagaggcccuucaaaug

SEQ ID NO: 549490 - RNA, 19 nt, Homo sapiens
uagugucucucuucucuga

SEQ ID NO: 549491 - RNA, 19 nt, Homo sapiens
gcacagucacuauccacaa

SEQ ID NO: 549492 - RNA, 19 nt, Homo sapiens
gcgagagaccuuuccuuug

SEQ ID NO: 549493 - RNA, 19 nt, Homo sapiens
guggaaggcugugggaaau

SEQ ID NO: 549494 - RNA, 19 nt, Homo sapiens
uugaggauauucuggacua

SEQ ID NO: 549495 - RNA, 19 nt, Homo sapiens
gguaugaagcaacucuauu

SEQ ID NO: 549496 - RNA, 19 nt, Homo sapiens
aauaaacucuucacaucca

SEQ ID NO: 549497 - RNA, 19 nt, Homo sapiens
ugcccgaucuccucuugua

SEQ ID NO: 549498 - RNA, 19 nt, Homo sapiens
cuauugauguggcuucugu

SEQ ID NO: 549499 - RNA, 19 nt, Homo sapiens
ggacacagcauuggugaac

SEQ ID NO: 549500 - RNA, 19 nt, Homo sapiens
cagcagcccaggugucuga

SEQ ID NO: 549501 - RNA, 19 nt, Homo sapiens
aaucuugacuauugaugug

SEQ ID NO: 549502 - RNA, 19 nt, Homo sapiens
ggugggccaggaucucuua

SEQ ID NO: 549503 - RNA, 19 nt, Homo sapiens
gcaagaagacauuuaucac

SEQ ID NO: 549504 - RNA, 19 nt, Homo sapiens
aggauauucuggacuaaau

SEQ ID NO: 549505 - RNA, 19 nt, Homo sapiens
gaggauauucuggacuaaa

SEQ ID NO: 549506 - RNA, 19 nt, Homo sapiens
cagagcuccuuaaauaugg

SEQ ID NO: 549507 - RNA, 19 nt, Homo sapiens
gaaucuugacuauugaugu

SEQ ID NO: 549508 - RNA, 19 nt, Homo sapiens
acacccagcagugaacuua

SEQ ID NO: 549509 - RNA, 19 nt, Homo sapiens
gaagacgcacaugguuaaa

SEQ ID NO: 549510 - RNA, 19 nt, Homo sapiens
ugcaggauguggacacuug

SEQ ID NO: 549511 - RNA, 19 nt, Homo sapiens
cuacauucacuccaagaaa

SEQ ID NO: 549512 - RNA, 19 nt, Homo sapiens
agagaccuuuccuuuguga

SEQ ID NO: 549513 - RNA, 19 nt, Homo sapiens
guccaggcguggugcugua

SEQ ID NO: 549514 - RNA, 19 nt, Homo sapiens
ugaaaacagugucucagaa

SEQ ID NO: 549515 - RNA, 19 nt, Homo sapiens
gcuuugacacccagcagua

SEQ ID NO: 549516 - RNA, 19 nt, Homo sapiens
acucuggaaucuugacuau

SEQ ID NO: 549517 - RNA, 19 nt, Homo sapiens
ggauguggacacuuggaaa

SEQ ID NO: 549518 - RNA, 19 nt, Homo sapiens
gcugcaagaagacauuuau

SEQ ID NO: 549519 - RNA, 19 nt, Homo sapiens
acacccagcaguaagcuaa

SEQ ID NO: 549520 - RNA, 19 nt, Homo sapiens
agaagacauuuaucacagu

SEQ ID NO: 549521 - RNA, 19 nt, Homo sapiens
caguacuucugcugcauug

SEQ ID NO: 549522 - RNA, 19 nt, Homo sapiens
gaccuuuccuuugugacuu

SEQ ID NO: 549523 - RNA, 19 nt, Homo sapiens
ccagaggcccuucaaaugc

SEQ ID NO: 549524 - RNA, 19 nt, Homo sapiens
caagaaacaccugcaggau

SEQ ID NO: 549525 - RNA, 19 nt, Homo sapiens
ggcuguggcuggaacuuca

SEQ ID NO: 549526 - RNA, 19 nt, Homo sapiens
ucgagcacccuuugugaaa

SEQ ID NO: 549527 - RNA, 19 nt, Homo sapiens
cagaaugaucucagugaug

SEQ ID NO: 549528 - RNA, 19 nt, Homo sapiens
acagaaugaucucagugau

SEQ ID NO: 549529 - RNA, 19 nt, Homo sapiens
uacauucacuccaagaaac

SEQ ID NO: 549530 - RNA, 19 nt, Homo sapiens
guucaugugcccuguggaa

SEQ ID NO: 549531 - RNA, 19 nt, Homo sapiens
gacgaugaccggagguuca

SEQ ID NO: 549532 - RNA, 19 nt, Homo sapiens
aaauucaccugcggaguca

SEQ ID NO: 549533 - RNA, 19 nt, Homo sapiens
acacagcauuggugaacuc

SEQ ID NO: 549534 - RNA, 19 nt, Homo sapiens
cuggauaccucucucuuuu

SEQ ID NO: 549535 - RNA, 19 nt, Homo sapiens
ggaaucuugacuauugaug

SEQ ID NO: 549536 - RNA, 19 nt, Homo sapiens
gggccaggaucucuuagcu

SEQ ID NO: 549537 - RNA, 19 nt, Homo sapiens
ugaggauauucuggacuaa

SEQ ID NO: 549538 - RNA, 19 nt, Homo sapiens
ccauguggcuaacuuuuau

SEQ ID NO: 549539 - RNA, 19 nt, Homo sapiens
gccaugagcaggagaacuc

SEQ ID NO: 549540 - RNA, 19 nt, Homo sapiens
ugcaagaagacauuuauca

SEQ ID NO: 549541 - RNA, 19 nt, Homo sapiens
gugucucucuucucugaug

SEQ ID NO: 549542 - RNA, 19 nt, Homo sapiens
aagaagcaccagcugaaga

SEQ ID NO: 549543 - RNA, 19 nt, Homo sapiens
gcuaacaguggacacagau

SEQ ID NO: 549544 - RNA, 19 nt, Homo sapiens
augaagacgcacaugguua

SEQ ID NO: 549545 - RNA, 19 nt, Homo sapiens
cauccaagcacagcaugaa

SEQ ID NO: 549546 - RNA, 19 nt, Homo sapiens
guugcccgaucuccucuug

SEQ ID NO: 549547 - RNA, 19 nt, Homo sapiens
ccucaaggcgcacaugaag

SEQ ID NO: 549548 - RNA, 19 nt, Homo sapiens
aagcaacucuauucauucc

SEQ ID NO: 549549 - RNA, 19 nt, Homo sapiens
agaagcaccagcugaagau

SEQ ID NO: 549550 - RNA, 19 nt, Homo sapiens
caaugcagcaggaaaccau

SEQ ID NO: 549551 - RNA, 19 nt, Homo sapiens
ccagcgacccuccucaaag

SEQ ID NO: 549552 - RNA, 19 nt, Homo sapiens
gacaguacuucugcugcau

SEQ ID NO: 549553 - RNA, 19 nt, Homo sapiens
ccagccagagacagaauga

SEQ ID NO: 549554 - RNA, 19 nt, Homo sapiens
ucagcuagaagcagcaaau

SEQ ID NO: 549555 - RNA, 19 nt, Homo sapiens
uguggaaggcugugggaaa

SEQ ID NO: 549556 - RNA, 19 nt, Homo sapiens
ggacucuuuggccaugaaa

SEQ ID NO: 549557 - RNA, 19 nt, Homo sapiens
ggcaccucccugcuaauaa

SEQ ID NO: 549558 - RNA, 19 nt, Homo sapiens
cacagucacuauccacaac

SEQ ID NO: 549559 - RNA, 19 nt, Homo sapiens
gacaagaacuuccacauga

SEQ ID NO: 549560 - RNA, 19 nt, Homo sapiens
gaauguggcugucaacgaa

SEQ ID NO: 549561 - RNA, 19 nt, Homo sapiens
caagaaugauccuuucaaa

SEQ ID NO: 549562 - RNA, 19 nt, Homo sapiens
ggacaagaacuuccacaug

SEQ ID NO: 549563 - RNA, 19 nt, Homo sapiens
gggagaaggugagcaguau

SEQ ID NO: 549564 - RNA, 19 nt, Homo sapiens
gaccaagaaugauccuuuc

SEQ ID NO: 549565 - RNA, 19 nt, Homo sapiens
gagaaggugagcaguauug

SEQ ID NO: 549566 - RNA, 19 nt, Homo sapiens
ggugagcaguauugauuug

SEQ ID NO: 549567 - RNA, 19 nt, Homo sapiens
uggaugacaugaccaagaa

SEQ ID NO: 549568 - RNA, 19 nt, Homo sapiens
acaagaacuuccacaugaa

SEQ ID NO: 549569 - RNA, 19 nt, Homo sapiens
ccagugacuccuaaguuua

SEQ ID NO: 549570 - RNA, 19 nt, Homo sapiens
caugaaguguuacaagugu

SEQ ID NO: 549571 - RNA, 19 nt, Homo sapiens
ggugucaucuggauaugug

SEQ ID NO: 549572 - RNA, 19 nt, Homo sapiens
uccagugacuccuaaguuu

SEQ ID NO: 549573 - RNA, 19 nt, Homo sapiens
agacacaguuccauguuca

SEQ ID NO: 549574 - RNA, 19 nt, Homo sapiens
ggaagccccugucgauuga

SEQ ID NO: 549575 - RNA, 19 nt, Homo sapiens
ggaucugggucacaaccaa

SEQ ID NO: 549576 - RNA, 19 nt, Homo sapiens
ugaccaagaaugauccuuu

SEQ ID NO: 549577 - RNA, 19 nt, Homo sapiens
cacaugaaguguuacaagu

SEQ ID NO: 549578 - RNA, 19 nt, Homo sapiens
cugccaaguuguagcuaua

SEQ ID NO: 549579 - RNA, 19 nt, Homo sapiens
aaggugagcaguauugauu

SEQ ID NO: 549580 - RNA, 19 nt, Homo sapiens
ggcagaauguggcugucaa

SEQ ID NO: 549581 - RNA, 19 nt, Homo sapiens
ccaagaaugauccuuucaa

SEQ ID NO: 549582 - RNA, 19 nt, Homo sapiens
uguccucacugcuggauga

SEQ ID NO: 549583 - RNA, 19 nt, Homo sapiens
cagacacaguuccauguuc

SEQ ID NO: 549584 - RNA, 19 nt, Homo sapiens
gaugacaugaccaagaaug

SEQ ID NO: 549585 - RNA, 19 nt, Homo sapiens
guauugauuuggagaucga

SEQ ID NO: 549586 - RNA, 19 nt, Homo sapiens
ccucccagcuucaccuaug

SEQ ID NO: 549587 - RNA, 19 nt, Homo sapiens
gaaggugagcaguauugau

SEQ ID NO: 549588 - RNA, 19 nt, Homo sapiens
guuuagugcugcugcuuuc

SEQ ID NO: 549589 - RNA, 19 nt, Homo sapiens
gaucugggucacaaccaaa

SEQ ID NO: 549590 - RNA, 19 nt, Homo sapiens
gcccaagccucagguccaa

SEQ ID NO: 549591 - RNA, 19 nt, Homo sapiens
ggagaaggugagcaguauu

SEQ ID NO: 549592 - RNA, 19 nt, Homo sapiens
gcugccaaguuguagcuau

SEQ ID NO: 549593 - RNA, 19 nt, Homo sapiens
acacugacacccuggagaa

SEQ ID NO: 549594 - RNA, 19 nt, Homo sapiens
gacccagccugugucuuug

SEQ ID NO: 549595 - RNA, 19 nt, Homo sapiens
ugagcaguauugauuugga

SEQ ID NO: 549596 - RNA, 19 nt, Homo sapiens
uagggcagcuguuccacau

SEQ ID NO: 549597 - RNA, 19 nt, Homo sapiens
ccacaugaaguguuacaag

SEQ ID NO: 549598 - RNA, 19 nt, Homo sapiens
gagccuggccgagaugaga

SEQ ID NO: 549599 - RNA, 19 nt, Homo sapiens
gacaugaccaagaaugauc

SEQ ID NO: 549600 - RNA, 19 nt, Homo sapiens
ccgacuaccacaagcagua

SEQ ID NO: 549601 - RNA, 19 nt, Homo sapiens
ccaccucaguuauuguuuu

SEQ ID NO: 549602 - RNA, 19 nt, Homo sapiens
gccagcaguucuacagucu

SEQ ID NO: 549603 - RNA, 19 nt, Homo sapiens
ccagacacaguuccauguu

SEQ ID NO: 549604 - RNA, 19 nt, Homo sapiens
gggauugcccaccgucuuc

SEQ ID NO: 549605 - RNA, 19 nt, Homo sapiens
ugaaguguuacaaguguga

SEQ ID NO: 549606 - RNA, 19 nt, Homo sapiens
ggucacaaccaaaucaaaa

SEQ ID NO: 549607 - RNA, 19 nt, Homo sapiens
ccacgggcaaggccuauca

SEQ ID NO: 549608 - RNA, 19 nt, Homo sapiens
ccucacugcuggaugacau

SEQ ID NO: 549609 - RNA, 19 nt, Homo sapiens
caccacagcccagggagaa

SEQ ID NO: 549610 - RNA, 19 nt, Homo sapiens
gguuuagugcugcugcuuu

SEQ ID NO: 549611 - RNA, 19 nt, Homo sapiens
cacgugcucugucggaagu

SEQ ID NO: 549612 - RNA, 19 nt, Homo sapiens
cccgaucgaggaaucauuu

SEQ ID NO: 549613 - RNA, 19 nt, Homo sapiens
cgauugaggcagaugacaa

SEQ ID NO: 549614 - RNA, 19 nt, Homo sapiens
cugacacccuggagaagug

SEQ ID NO: 549615 - RNA, 19 nt, Homo sapiens
uuacuccuguggcuuccaa

SEQ ID NO: 549616 - RNA, 19 nt, Homo sapiens
gggaagccccugucgauug

SEQ ID NO: 549617 - RNA, 19 nt, Homo sapiens
uuucuccagugacuccuaa

SEQ ID NO: 549618 - RNA, 19 nt, Homo sapiens
ggugcuccgucugcucuga

SEQ ID NO: 549619 - RNA, 19 nt, Homo sapiens
gacauggagcauccucaga

SEQ ID NO: 549620 - RNA, 19 nt, Homo sapiens
ugacaugaccaagaaugau

SEQ ID NO: 549621 - RNA, 19 nt, Homo sapiens
uccuguggcuuccaaguuc

SEQ ID NO: 549622 - RNA, 19 nt, Homo sapiens
gccagacacaguuccaugu

SEQ ID NO: 549623 - RNA, 19 nt, Homo sapiens
gaaaugaccuacggauuga

SEQ ID NO: 549624 - RNA, 19 nt, Homo sapiens
ucaaagaccuuaaccaaga

SEQ ID NO: 549625 - RNA, 19 nt, Homo sapiens
gggcagggcugguucagua

SEQ ID NO: 549626 - RNA, 19 nt, Homo sapiens
caucaaaccuguuauuguu

SEQ ID NO: 549627 - RNA, 19 nt, Homo sapiens
ggacauagcaucucuuguu

SEQ ID NO: 549628 - RNA, 19 nt, Homo sapiens
gaaccaaggagaauauuaa

SEQ ID NO: 549629 - RNA, 19 nt, Homo sapiens
ggaaaucugucuucucuuc

SEQ ID NO: 549630 - RNA, 19 nt, Homo sapiens
gaacagagacuacguugga

SEQ ID NO: 549631 - RNA, 19 nt, Homo sapiens
gacauagcaucucuuguua

SEQ ID NO: 549632 - RNA, 19 nt, Homo sapiens
gcaaagacgaggaaauuaa

SEQ ID NO: 549633 - RNA, 19 nt, Homo sapiens
gaaacgaauggcugaauua

SEQ ID NO: 549634 - RNA, 19 nt, Homo sapiens
gcagagcucacaucaguua

SEQ ID NO: 549635 - RNA, 19 nt, Homo sapiens
gauaacaguugcccgaauu

SEQ ID NO: 549636 - RNA, 19 nt, Homo sapiens
agagaaaucugaccaagaa

SEQ ID NO: 549637 - RNA, 19 nt, Homo sapiens
ggaagaagagcuuaagaaa

SEQ ID NO: 549638 - RNA, 19 nt, Homo sapiens
uaaagcagguagagaauga

SEQ ID NO: 549639 - RNA, 19 nt, Homo sapiens
ggagaaacuugaagaggaa

SEQ ID NO: 549640 - RNA, 19 nt, Homo sapiens
ugaauuaccuacaugauug

SEQ ID NO: 549641 - RNA, 19 nt, Homo sapiens
gaaccucccuauuugagaa

SEQ ID NO: 549642 - RNA, 19 nt, Homo sapiens
gaguuuagcgucagaguua

SEQ ID NO: 549643 - RNA, 19 nt, Homo sapiens
acacagugcucccuucuuu

SEQ ID NO: 549644 - RNA, 19 nt, Homo sapiens
caaaguagccucacugugu

SEQ ID NO: 549645 - RNA, 19 nt, Homo sapiens
gaagacaacacgaacguuu

SEQ ID NO: 549646 - RNA, 19 nt, Homo sapiens
gaaugaaucugugaaaucu

SEQ ID NO: 549647 - RNA, 19 nt, Homo sapiens
ggaguuugcucucaacaau

SEQ ID NO: 549648 - RNA, 19 nt, Homo sapiens
caagaaacagaaagaguua

SEQ ID NO: 549649 - RNA, 19 nt, Homo sapiens
caagauuccugucucuaaa

SEQ ID NO: 549650 - RNA, 19 nt, Homo sapiens
ugacggaaagcuugaauua

SEQ ID NO: 549651 - RNA, 19 nt, Homo sapiens
gagccaagaucgcaccauu

SEQ ID NO: 549652 - RNA, 19 nt, Homo sapiens
guacuucacuacccacuau

SEQ ID NO: 549653 - RNA, 19 nt, Homo sapiens
gguuugaccuuucuccuaa

SEQ ID NO: 549654 - RNA, 19 nt, Homo sapiens
caaacaaagugacaaguag

SEQ ID NO: 549655 - RNA, 19 nt, Homo sapiens
cagccuaacucuagagaaa

SEQ ID NO: 549656 - RNA, 19 nt, Homo sapiens
gagauaaagcuacaaauca

SEQ ID NO: 549657 - RNA, 19 nt, Homo sapiens
gaggaucugugucgucuga

SEQ ID NO: 549658 - RNA, 19 nt, Homo sapiens
cggaaugccuggaagagua

SEQ ID NO: 549659 - RNA, 19 nt, Homo sapiens
ccuagaaccucccuauuug

SEQ ID NO: 549660 - RNA, 19 nt, Homo sapiens
ugauaaagaugcuggaaug

SEQ ID NO: 549661 - RNA, 19 nt, Homo sapiens
caacggaagucaaguaacu

SEQ ID NO: 549662 - RNA, 19 nt, Homo sapiens
auaacgaccuucaggauaa

SEQ ID NO: 549663 - RNA, 19 nt, Homo sapiens
agacucagaugaugacuug

SEQ ID NO: 549664 - RNA, 19 nt, Homo sapiens
gagaucaggucaagagaca

SEQ ID NO: 549665 - RNA, 19 nt, Homo sapiens
cagaagggcucucuaaagg

SEQ ID NO: 549666 - RNA, 19 nt, Homo sapiens
caagagauugagaaacuua

SEQ ID NO: 549667 - RNA, 19 nt, Homo sapiens
ggcgagacuugaaaucuuu

SEQ ID NO: 549668 - RNA, 19 nt, Homo sapiens
ccaaacaaagugacaagua

SEQ ID NO: 549669 - RNA, 19 nt, Homo sapiens
gagaaugaaucugugaaau

SEQ ID NO: 549670 - RNA, 19 nt, Homo sapiens
gagagaagccagacucaga

SEQ ID NO: 549671 - RNA, 19 nt, Homo sapiens
caugagaggacuaaguuua

SEQ ID NO: 549672 - RNA, 19 nt, Homo sapiens
gguagagaaugaaacaaga

SEQ ID NO: 549673 - RNA, 19 nt, Homo sapiens
gaagagcgaagacuugaau

SEQ ID NO: 549674 - RNA, 19 nt, Homo sapiens
ggacaaaaguacuucacua

SEQ ID NO: 549675 - RNA, 19 nt, Homo sapiens
ugagaaaccugugaugaug

SEQ ID NO: 549676 - RNA, 19 nt, Homo sapiens
ccaauuuguugucuucauu

SEQ ID NO: 549677 - RNA, 19 nt, Homo sapiens
ucagaugccagacauguua

SEQ ID NO: 549678 - RNA, 19 nt, Homo sapiens
ggacucaggagacaaagaa

SEQ ID NO: 549679 - RNA, 19 nt, Homo sapiens
ggagauaaagcuacaaauc

SEQ ID NO: 549680 - RNA, 19 nt, Homo sapiens
ccaaugcucuuucuacucu

SEQ ID NO: 549681 - RNA, 19 nt, Homo sapiens
aaagugacaaguagcauua

SEQ ID NO: 549682 - RNA, 19 nt, Homo sapiens
gaugaugacuuggacauag

SEQ ID NO: 549683 - RNA, 19 nt, Homo sapiens
gcugagaauugaaggcaaa

SEQ ID NO: 549684 - RNA, 19 nt, Homo sapiens
gguagcaacuccagcaugu

SEQ ID NO: 549685 - RNA, 19 nt, Homo sapiens
gucagagccuccaccaaua

SEQ ID NO: 549686 - RNA, 19 nt, Homo sapiens
agagacaacugccuuugaa

SEQ ID NO: 549687 - RNA, 19 nt, Homo sapiens
gugagugacuguuuccaaa

SEQ ID NO: 549688 - RNA, 19 nt, Homo sapiens
ucucggagcagcauuauaa

SEQ ID NO: 549689 - RNA, 19 nt, Homo sapiens
uggcagagcucacaucagu

SEQ ID NO: 549690 - RNA, 19 nt, Homo sapiens
ggagaaccaaggagaauau

SEQ ID NO: 549691 - RNA, 19 nt, Homo sapiens
gcucauuacagcuuugaua

SEQ ID NO: 549692 - RNA, 19 nt, Homo sapiens
gaauggagaaugaaucugu

SEQ ID NO: 549693 - RNA, 19 nt, Homo sapiens
ggaagacaacaaagucaaa

SEQ ID NO: 549694 - RNA, 19 nt, Homo sapiens
uuaccuacaugauugauga

SEQ ID NO: 549695 - RNA, 19 nt, Homo sapiens
caacacgaacguuuaguga

SEQ ID NO: 549696 - RNA, 19 nt, Homo sapiens
gagagugagugacuguuuc

SEQ ID NO: 549697 - RNA, 19 nt, Homo sapiens
ccaagauuccugucucuaa

SEQ ID NO: 549698 - RNA, 19 nt, Homo sapiens
gauaagcguauacccaauu

SEQ ID NO: 549699 - RNA, 19 nt, Homo sapiens
ggagaaugaaucugugaaa

SEQ ID NO: 549700 - RNA, 19 nt, Homo sapiens
agaaaugaccuacggauug

SEQ ID NO: 549701 - RNA, 19 nt, Homo sapiens
agaaacgaauggcugaauu

SEQ ID NO: 549702 - RNA, 19 nt, Homo sapiens
caagagaaagguaaccauu

SEQ ID NO: 549703 - RNA, 19 nt, Homo sapiens
guacuuaacacuggacaaa

SEQ ID NO: 549704 - RNA, 19 nt, Homo sapiens
ggagcagcauuauaaucaa

SEQ ID NO: 549705 - RNA, 19 nt, Homo sapiens
ccauggagcucccagauac

SEQ ID NO: 549706 - RNA, 19 nt, Homo sapiens
ggaacugucuccucagcau

SEQ ID NO: 549707 - RNA, 19 nt, Homo sapiens
gacaugagaggacuaaguu

SEQ ID NO: 549708 - RNA, 19 nt, Homo sapiens
caacaaagucaaagaccuu

SEQ ID NO: 549709 - RNA, 19 nt, Homo sapiens
caaagugaaagaacuagaa

SEQ ID NO: 549710 - RNA, 19 nt, Homo sapiens
gcucagagucaaagugaaa

SEQ ID NO: 549711 - RNA, 19 nt, Homo sapiens
cccgggagcugaaaucuga

SEQ ID NO: 549712 - RNA, 19 nt, Homo sapiens
caguagacauggccgaauu

SEQ ID NO: 549713 - RNA, 19 nt, Homo sapiens
cagcaagcauggugaguuc

SEQ ID NO: 549714 - RNA, 19 nt, Homo sapiens
gcacacauccacuagcaau

SEQ ID NO: 549715 - RNA, 19 nt, Homo sapiens
ucaagaaacagaaagaguu

SEQ ID NO: 549716 - RNA, 19 nt, Homo sapiens
ggaaaugcucagagucaaa

SEQ ID NO: 549717 - RNA, 19 nt, Homo sapiens
gaagaacaggccagaaaca

SEQ ID NO: 549718 - RNA, 19 nt, Homo sapiens
gcaacaggcagguuucuuc

SEQ ID NO: 549719 - RNA, 19 nt, Homo sapiens
gaacugucuccucagcaua

SEQ ID NO: 549720 - RNA, 19 nt, Homo sapiens
cagcagaauuacuggaaga

SEQ ID NO: 549721 - RNA, 19 nt, Homo sapiens
agaugacucuguuaacuug

SEQ ID NO: 549722 - RNA, 19 nt, Homo sapiens
gaugagaaaccugugauga

SEQ ID NO: 549723 - RNA, 19 nt, Homo sapiens
caaauuagcugcaauagga

SEQ ID NO: 549724 - RNA, 19 nt, Homo sapiens
gaucucagguuaagaauaa

SEQ ID NO: 549725 - RNA, 19 nt, Homo sapiens
gaagaggaguuaaaugauu

SEQ ID NO: 549726 - RNA, 19 nt, Homo sapiens
gaagagcgauugugaggaa

SEQ ID NO: 549727 - RNA, 19 nt, Homo sapiens
aauaauggcuucuggaaua

SEQ ID NO: 549728 - RNA, 19 nt, Homo sapiens
gaccuucccuccacucuua

SEQ ID NO: 549729 - RNA, 19 nt, Homo sapiens
gaacaucuuuagugucuga

SEQ ID NO: 549730 - RNA, 19 nt, Homo sapiens
gaagugaccuggaaucagu

SEQ ID NO: 549731 - RNA, 19 nt, Homo sapiens
caacagagccauuuacuau

SEQ ID NO: 549732 - RNA, 19 nt, Homo sapiens
uaaauuagguccuguuugu

SEQ ID NO: 549733 - RNA, 19 nt, Homo sapiens
gaagccagaagauuuauua

SEQ ID NO: 549734 - RNA, 19 nt, Homo sapiens
gaaaggaaguuuacaacca

SEQ ID NO: 549735 - RNA, 19 nt, Homo sapiens
ggaggaggaugaagaagaa

SEQ ID NO: 549736 - RNA, 19 nt, Homo sapiens
uaagaaagguggacacuca

SEQ ID NO: 549737 - RNA, 19 nt, Homo sapiens
gaaauacggugugaugaga

SEQ ID NO: 549738 - RNA, 19 nt, Homo sapiens
gaaacuggcugcgauaugu

SEQ ID NO: 549739 - RNA, 19 nt, Homo sapiens
caaugaguguugugaaaua

SEQ ID NO: 549740 - RNA, 19 nt, Homo sapiens
gcagaaggccgacuugaaa

SEQ ID NO: 549741 - RNA, 19 nt, Homo sapiens
gaacacaacaggaauugaa

SEQ ID NO: 549742 - RNA, 19 nt, Homo sapiens
caacagaggcagugucuuu

SEQ ID NO: 549743 - RNA, 19 nt, Homo sapiens
gaaaaggugucgacaauau

SEQ ID NO: 549744 - RNA, 19 nt, Homo sapiens
gccagaagauccuuuagaa

SEQ ID NO: 549745 - RNA, 19 nt, Homo sapiens
uaacaacacuaguaacugu

SEQ ID NO: 549746 - RNA, 19 nt, Homo sapiens
acagagccauuuacuauaa

SEQ ID NO: 549747 - RNA, 19 nt, Homo sapiens
ggagguaaauauaugaaug

SEQ ID NO: 549748 - RNA, 19 nt, Homo sapiens
caucaaagcucaaacaacu

SEQ ID NO: 549749 - RNA, 19 nt, Homo sapiens
gaagacugcucagagguaa

SEQ ID NO: 549750 - RNA, 19 nt, Homo sapiens
gcaacucuguaaauaugua

SEQ ID NO: 549751 - RNA, 19 nt, Homo sapiens
ggaagcagaugauguguac

SEQ ID NO: 549752 - RNA, 19 nt, Homo sapiens
ggccaauggugauguauuu

SEQ ID NO: 549753 - RNA, 19 nt, Homo sapiens
gcacacaucacgaguuuga

SEQ ID NO: 549754 - RNA, 19 nt, Homo sapiens
ggaagacaacccugagaua

SEQ ID NO: 549755 - RNA, 19 nt, Homo sapiens
acagaccgguucaauauaa

SEQ ID NO: 549756 - RNA, 19 nt, Homo sapiens
gcaaggaauucaaagaaag

SEQ ID NO: 549757 - RNA, 19 nt, Homo sapiens
ucacgaacgucaucugauu

SEQ ID NO: 549758 - RNA, 19 nt, Homo sapiens
gaagcucuguuaccacuug

SEQ ID NO: 549759 - RNA, 19 nt, Homo sapiens
gaagagcuuuacacgacua

SEQ ID NO: 549760 - RNA, 19 nt, Homo sapiens
uaaagaagaagaggaguua

SEQ ID NO: 549761 - RNA, 19 nt, Homo sapiens
gggaauaucuuuguguguu

SEQ ID NO: 549762 - RNA, 19 nt, Homo sapiens
gcaauaucaucuguuguuu

SEQ ID NO: 549763 - RNA, 19 nt, Homo sapiens
ggacauuucuagcaauauc

SEQ ID NO: 549764 - RNA, 19 nt, Homo sapiens
gaucaagaauggaguacga

SEQ ID NO: 549765 - RNA, 19 nt, Homo sapiens
ccauugcucuugagucuuu

SEQ ID NO: 549766 - RNA, 19 nt, Homo sapiens
caacaucucugggaaucaa

SEQ ID NO: 549767 - RNA, 19 nt, Homo sapiens
gaauggcccuucaaaugug

SEQ ID NO: 549768 - RNA, 19 nt, Homo sapiens
gaucaugaauucagagaag

SEQ ID NO: 549769 - RNA, 19 nt, Homo sapiens
caacaggaauugaaaauga

SEQ ID NO: 549770 - RNA, 19 nt, Homo sapiens
gaagauccuuuagaaacuu

SEQ ID NO: 549771 - RNA, 19 nt, Homo sapiens
ggcaaggaauucaaagaaa

SEQ ID NO: 549772 - RNA, 19 nt, Homo sapiens
gcagauuuguaugguauaa

SEQ ID NO: 549773 - RNA, 19 nt, Homo sapiens
ccacaaauuucacuacaca

SEQ ID NO: 549774 - RNA, 19 nt, Homo sapiens
gugcacacaucacgaguuu

SEQ ID NO: 549775 - RNA, 19 nt, Homo sapiens
gguaacaccugccaugcaa

SEQ ID NO: 549776 - RNA, 19 nt, Homo sapiens
ggauggaugugcauugaug

SEQ ID NO: 549777 - RNA, 19 nt, Homo sapiens
gagaaaacguugcuucaaa

SEQ ID NO: 549778 - RNA, 19 nt, Homo sapiens
ggagguguauuacccaaau

SEQ ID NO: 549779 - RNA, 19 nt, Homo sapiens
gcaucaauguugccuguga

SEQ ID NO: 549780 - RNA, 19 nt, Homo sapiens
ggcagugucuuuccacaaa

SEQ ID NO: 549781 - RNA, 19 nt, Homo sapiens
ggaucuggcugauggcaaa

SEQ ID NO: 549782 - RNA, 19 nt, Homo sapiens
ugagaagccagaagauuua

SEQ ID NO: 549783 - RNA, 19 nt, Homo sapiens
ggacuuugcuauaauucug

SEQ ID NO: 549784 - RNA, 19 nt, Homo sapiens
cuaaagcuguggccaagaa

SEQ ID NO: 549785 - RNA, 19 nt, Homo sapiens
ucaaacaacuucuucaaac

SEQ ID NO: 549786 - RNA, 19 nt, Homo sapiens
agaagaagaugaugaugau

SEQ ID NO: 549787 - RNA, 19 nt, Homo sapiens
aggcuuaacuuuaguguug

SEQ ID NO: 549788 - RNA, 19 nt, Homo sapiens
caugauaucuuucaaacag

SEQ ID NO: 549789 - RNA, 19 nt, Homo sapiens
ggacagcuaguucugcuuu

SEQ ID NO: 549790 - RNA, 19 nt, Homo sapiens
agaaaagccuucccaguua

SEQ ID NO: 549791 - RNA, 19 nt, Homo sapiens
uaucacagaucaagaaugg

SEQ ID NO: 549792 - RNA, 19 nt, Homo sapiens
guaccgaccuaucccaguu

SEQ ID NO: 549793 - RNA, 19 nt, Homo sapiens
ccaagcuccuccucuuuaa

SEQ ID NO: 549794 - RNA, 19 nt, Homo sapiens
gagcuuuacacgacuauaa

SEQ ID NO: 549795 - RNA, 19 nt, Homo sapiens
gccagaagauuuauuagag

SEQ ID NO: 549796 - RNA, 19 nt, Homo sapiens
aaaccaagcuccuccucuu

SEQ ID NO: 549797 - RNA, 19 nt, Homo sapiens
ggaugaagaagaagaagaa

SEQ ID NO: 549798 - RNA, 19 nt, Homo sapiens
cuugugaggugaaugauuu

SEQ ID NO: 549799 - RNA, 19 nt, Homo sapiens
aaguauggcucuugggaua

SEQ ID NO: 549800 - RNA, 19 nt, Homo sapiens
gccauucgcugcacaaagu

SEQ ID NO: 549801 - RNA, 19 nt, Homo sapiens
ggaauaucuuuguguguuc

SEQ ID NO: 549802 - RNA, 19 nt, Homo sapiens
gcacaguccugcccuucga

SEQ ID NO: 549803 - RNA, 19 nt, Homo sapiens
aaaggaaguuuacaaccaa

SEQ ID NO: 549804 - RNA, 19 nt, Homo sapiens
gaagccagcaugccaaaug

SEQ ID NO: 549805 - RNA, 19 nt, Homo sapiens
ugauaaggaucuaggagaa

SEQ ID NO: 549806 - RNA, 19 nt, Homo sapiens
gcuccaauuucaagaguga

SEQ ID NO: 549807 - RNA, 19 nt, Homo sapiens
aagaagaggaguuaaauga

SEQ ID NO: 549808 - RNA, 19 nt, Homo sapiens
gcagacacccucccuuuca

SEQ ID NO: 549809 - RNA, 19 nt, Homo sapiens
uggcaucgauuuaccugua

SEQ ID NO: 549810 - RNA, 19 nt, Homo sapiens
gaagacaagugagccagau

SEQ ID NO: 549811 - RNA, 19 nt, Homo sapiens
cagcauuacccaagcuuua

SEQ ID NO: 549812 - RNA, 19 nt, Homo sapiens
gaagaagaggaguuaaaug

SEQ ID NO: 549813 - RNA, 19 nt, Homo sapiens
gaugagagagaaacuguga

SEQ ID NO: 549814 - RNA, 19 nt, Homo sapiens
gaagacaacccugagauag

SEQ ID NO: 549815 - RNA, 19 nt, Homo sapiens
gaggguucauguaaucaaa

SEQ ID NO: 549816 - RNA, 19 nt, Homo sapiens
ucaaucggcugcaguaugg

SEQ ID NO: 549817 - RNA, 19 nt, Homo sapiens
gacaaaagauccagauguu

SEQ ID NO: 549818 - RNA, 19 nt, Homo sapiens
guguagugcuguaaagaaa

SEQ ID NO: 549819 - RNA, 19 nt, Homo sapiens
ccagugggaaucugucuua

SEQ ID NO: 549820 - RNA, 19 nt, Homo sapiens
ccaguuacaguggaaauua

SEQ ID NO: 549821 - RNA, 19 nt, Homo sapiens
uaaagaagacgaagagaag

SEQ ID NO: 549822 - RNA, 19 nt, Homo sapiens
cagcugcgauugaggaaga

SEQ ID NO: 549823 - RNA, 19 nt, Homo sapiens
gcauuuagcugaucucuua

SEQ ID NO: 549824 - RNA, 19 nt, Homo sapiens
gaucucagguuaagaauaa

SEQ ID NO: 549825 - RNA, 19 nt, Homo sapiens
gaagaggaguuaaaugauu

SEQ ID NO: 549826 - RNA, 19 nt, Homo sapiens
gagaaaggauugauuugaa

SEQ ID NO: 549827 - RNA, 19 nt, Homo sapiens
aauaauggcuucuggaaua

SEQ ID NO: 549828 - RNA, 19 nt, Homo sapiens
gaccuucccuccacucuua

SEQ ID NO: 549829 - RNA, 19 nt, Homo sapiens
guauugaacuuugcuguua

SEQ ID NO: 549830 - RNA, 19 nt, Homo sapiens
caacagagccauuuacuau

SEQ ID NO: 549831 - RNA, 19 nt, Homo sapiens
uaaauuagguccuguuugu

SEQ ID NO: 549832 - RNA, 19 nt, Homo sapiens
gaagccagaagauuuauua

SEQ ID NO: 549833 - RNA, 19 nt, Homo sapiens
gaaaggaaguuuacaacca

SEQ ID NO: 549834 - RNA, 19 nt, Homo sapiens
ggaggaggaugaagaagaa

SEQ ID NO: 549835 - RNA, 19 nt, Homo sapiens
uaagaaagguggacacuca

SEQ ID NO: 549836 - RNA, 19 nt, Homo sapiens
gaaauacggugugaugaga

SEQ ID NO: 549837 - RNA, 19 nt, Homo sapiens
gaaacuggcugcgauaugu

SEQ ID NO: 549838 - RNA, 19 nt, Homo sapiens
caaugaguguugugaaaua

SEQ ID NO: 549839 - RNA, 19 nt, Homo sapiens
caaauuggccucuuccuaa

SEQ ID NO: 549840 - RNA, 19 nt, Homo sapiens
gagacuauguagcaauaua

SEQ ID NO: 549841 - RNA, 19 nt, Homo sapiens
gcagaaggccgacuugaaa

SEQ ID NO: 549842 - RNA, 19 nt, Homo sapiens
gaacacaacaggaauugaa

SEQ ID NO: 549843 - RNA, 19 nt, Homo sapiens
caacagaggcagugucuuu

SEQ ID NO: 549844 - RNA, 19 nt, Homo sapiens
agagagagguuaauuauag

SEQ ID NO: 549845 - RNA, 19 nt, Homo sapiens
gcagagaaaggauugauuu

SEQ ID NO: 549846 - RNA, 19 nt, Homo sapiens
gauuggauauggacucuuu

SEQ ID NO: 549847 - RNA, 19 nt, Homo sapiens
gaaaaggugucgacaauau

SEQ ID NO: 549848 - RNA, 19 nt, Homo sapiens
gccagaagauccuuuagaa

SEQ ID NO: 549849 - RNA, 19 nt, Homo sapiens
uaacaacacuaguaacugu

SEQ ID NO: 549850 - RNA, 19 nt, Homo sapiens
acagagccauuuacuauaa

SEQ ID NO: 549851 - RNA, 19 nt, Homo sapiens
ggagguaaauauaugaaug

SEQ ID NO: 549852 - RNA, 19 nt, Homo sapiens
gaggagaauuuaaacaaug

SEQ ID NO: 549853 - RNA, 19 nt, Homo sapiens
caucaaagcucaaacaacu

SEQ ID NO: 549854 - RNA, 19 nt, Homo sapiens
gaagacugcucagagguaa

SEQ ID NO: 549855 - RNA, 19 nt, Homo sapiens
ggaagcagaugauguguac

SEQ ID NO: 549856 - RNA, 19 nt, Homo sapiens
ggccaauggugauguauuu

SEQ ID NO: 549857 - RNA, 19 nt, Homo sapiens
gggcuugucagauguauua

SEQ ID NO: 549858 - RNA, 19 nt, Homo sapiens
gagagagagagguuaauua

SEQ ID NO: 549859 - RNA, 19 nt, Homo sapiens
cagagacuauguagcaaua

SEQ ID NO: 549860 - RNA, 19 nt, Homo sapiens
gcacacaucacgaguuuga

SEQ ID NO: 549861 - RNA, 19 nt, Homo sapiens
ggaagacaacccugagaua

SEQ ID NO: 549862 - RNA, 19 nt, Homo sapiens
gaggaaaccagauuggaua

SEQ ID NO: 549863 - RNA, 19 nt, Homo sapiens
acagaccgguucaauauaa

SEQ ID NO: 549864 - RNA, 19 nt, Homo sapiens
gcaaggaauucaaagaaag

SEQ ID NO: 549865 - RNA, 19 nt, Homo sapiens
ucacgaacgucaucugauu

SEQ ID NO: 549866 - RNA, 19 nt, Homo sapiens
gaagcucuguuaccacuug

SEQ ID NO: 549867 - RNA, 19 nt, Homo sapiens
gaagagcuuuacacgacua

SEQ ID NO: 549868 - RNA, 19 nt, Homo sapiens
uaaagaagaagaggaguua

SEQ ID NO: 549869 - RNA, 19 nt, Homo sapiens
gggaauaucuuuguguguu

SEQ ID NO: 549870 - RNA, 19 nt, Homo sapiens
gcaauaucaucuguuguuu

SEQ ID NO: 549871 - RNA, 19 nt, Homo sapiens
gcaaacacuuaauaacuag

SEQ ID NO: 549872 - RNA, 19 nt, Homo sapiens
ggacauuucuagcaauauc

SEQ ID NO: 549873 - RNA, 19 nt, Homo sapiens
gaucaagaauggaguacga

SEQ ID NO: 549874 - RNA, 19 nt, Homo sapiens
gaauggcccuucaaaugug

SEQ ID NO: 549875 - RNA, 19 nt, Homo sapiens
gaucaugaauucagagaag

SEQ ID NO: 549876 - RNA, 19 nt, Homo sapiens
caacaggaauugaaaauga

SEQ ID NO: 549877 - RNA, 19 nt, Homo sapiens
gaauuugcauaccagguuu

SEQ ID NO: 549878 - RNA, 19 nt, Homo sapiens
gaaaccagauuggauaugg

SEQ ID NO: 549879 - RNA, 19 nt, Homo sapiens
gaagauccuuuagaaacuu

SEQ ID NO: 549880 - RNA, 19 nt, Homo sapiens
ggcaaggaauucaaagaaa

SEQ ID NO: 549881 - RNA, 19 nt, Homo sapiens
gcagauuuguaugguauaa

SEQ ID NO: 549882 - RNA, 19 nt, Homo sapiens
gggacuuuauguugaaaua

SEQ ID NO: 549883 - RNA, 19 nt, Homo sapiens
ccacaaauuucacuacaca

SEQ ID NO: 549884 - RNA, 19 nt, Homo sapiens
gugcacacaucacgaguuu

SEQ ID NO: 549885 - RNA, 19 nt, Homo sapiens
gguaacaccugccaugcaa

SEQ ID NO: 549886 - RNA, 19 nt, Homo sapiens
ggauggaugugcauugaug

SEQ ID NO: 549887 - RNA, 19 nt, Homo sapiens
gagaaaacguugcuucaaa

SEQ ID NO: 549888 - RNA, 19 nt, Homo sapiens
ggagguguauuacccaaau

SEQ ID NO: 549889 - RNA, 19 nt, Homo sapiens
gugaauuugugccacuuua

SEQ ID NO: 549890 - RNA, 19 nt, Homo sapiens
ggacuuugcuauaauucug

SEQ ID NO: 549891 - RNA, 19 nt, Homo sapiens
gcaucaauguugccuguga

SEQ ID NO: 549892 - RNA, 19 nt, Homo sapiens
ggcagugucuuuccacaaa

SEQ ID NO: 549893 - RNA, 19 nt, Homo sapiens
ggaucuggcugauggcaaa

SEQ ID NO: 549894 - RNA, 19 nt, Homo sapiens
ugagaagccagaagauuua

SEQ ID NO: 549895 - RNA, 19 nt, Homo sapiens
gagagagguuaauuauaga

SEQ ID NO: 549896 - RNA, 19 nt, Homo sapiens
cuaaagcuguggccaagaa

SEQ ID NO: 549897 - RNA, 19 nt, Homo sapiens
ucaaacaacuucuucaaac

SEQ ID NO: 549898 - RNA, 19 nt, Homo sapiens
agaagaagaugaugaugau

SEQ ID NO: 549899 - RNA, 19 nt, Homo sapiens
gagagagagguuaauuaua

SEQ ID NO: 549900 - RNA, 19 nt, Homo sapiens
aggcuuaacuuuaguguug

SEQ ID NO: 549901 - RNA, 19 nt, Homo sapiens
caugauaucuuucaaacag

SEQ ID NO: 549902 - RNA, 19 nt, Homo sapiens
ggacagcuaguucugcuuu

SEQ ID NO: 549903 - RNA, 19 nt, Homo sapiens
agaaaagccuucccaguua

SEQ ID NO: 549904 - RNA, 19 nt, Homo sapiens
uaucacagaucaagaaugg

SEQ ID NO: 549905 - RNA, 19 nt, Homo sapiens
ggacgcuucaauuguauua

SEQ ID NO: 549906 - RNA, 19 nt, Homo sapiens
ccaagcuccuccucuuuaa

SEQ ID NO: 549907 - RNA, 19 nt, Homo sapiens
gagcuuuacacgacuauaa

SEQ ID NO: 549908 - RNA, 19 nt, Homo sapiens
gccagaagauuuauuagag

SEQ ID NO: 549909 - RNA, 19 nt, Homo sapiens
aaaguaaucuaccucugaa

SEQ ID NO: 549910 - RNA, 19 nt, Homo sapiens
gcacguagcagagaaagga

SEQ ID NO: 549911 - RNA, 19 nt, Homo sapiens
ugauugagauccaaagaga

SEQ ID NO: 549912 - RNA, 19 nt, Homo sapiens
aaaccaagcuccuccucuu

SEQ ID NO: 549913 - RNA, 19 nt, Homo sapiens
aaguauggcucuugggaua

SEQ ID NO: 549914 - RNA, 19 nt, Homo sapiens
ggaugaagaagaagaagaa

SEQ ID NO: 549915 - RNA, 19 nt, Homo sapiens
cuugugaggugaaugauuu

SEQ ID NO: 549916 - RNA, 19 nt, Homo sapiens
cuuaauaacuagaggagaa

SEQ ID NO: 549917 - RNA, 19 nt, Homo sapiens
uuucagggaugacagauuu

SEQ ID NO: 549918 - RNA, 19 nt, Homo sapiens
gccauucgcugcacaaagu

SEQ ID NO: 549919 - RNA, 19 nt, Homo sapiens
ggaauaucuuuguguguuc

SEQ ID NO: 549920 - RNA, 19 nt, Homo sapiens
gcacaguccugcccuucga

SEQ ID NO: 549921 - RNA, 19 nt, Homo sapiens
aaaggaaguuuacaaccaa

SEQ ID NO: 549922 - RNA, 19 nt, Homo sapiens
gaagccagcaugccaaaug

SEQ ID NO: 549923 - RNA, 19 nt, Homo sapiens
ccaaagaagugauaauuuc

SEQ ID NO: 549924 - RNA, 19 nt, Homo sapiens
cauaagcccuuuguaauaa

SEQ ID NO: 549925 - RNA, 19 nt, Homo sapiens
caucauaagcccuuuguaa

SEQ ID NO: 549926 - RNA, 19 nt, Homo sapiens
gaacucuacucacaguguu

SEQ ID NO: 549927 - RNA, 19 nt, Homo sapiens
ucauaagcccuuuguaaua

SEQ ID NO: 549928 - RNA, 19 nt, Homo sapiens
ggaguuauuuacuguguuc

SEQ ID NO: 549929 - RNA, 19 nt, Homo sapiens
gaagcacaaugaggagauu

SEQ ID NO: 549930 - RNA, 19 nt, Homo sapiens
caacuggaaggcauuauug

SEQ ID NO: 549931 - RNA, 19 nt, Homo sapiens
aaucuugaaugccauacua

SEQ ID NO: 549932 - RNA, 19 nt, Homo sapiens
gcugaaggcccaacuggaa

SEQ ID NO: 549933 - RNA, 19 nt, Homo sapiens
ccacaugauuaauuuccaa

SEQ ID NO: 549934 - RNA, 19 nt, Homo sapiens
gaagugauaauuuccacau

SEQ ID NO: 549935 - RNA, 19 nt, Homo sapiens
ccaggagcaguuagacuua

SEQ ID NO: 549936 - RNA, 19 nt, Homo sapiens
agucagacauggagaggaa

SEQ ID NO: 549937 - RNA, 19 nt, Homo sapiens
agugauaauuuccacauga

SEQ ID NO: 549938 - RNA, 19 nt, Homo sapiens
caccaaagaagugauaauu

SEQ ID NO: 549939 - RNA, 19 nt, Homo sapiens
ugaacgagcagaaggcaaa

SEQ ID NO: 549940 - RNA, 19 nt, Homo sapiens
caggagcaguuagacuuaa

SEQ ID NO: 549941 - RNA, 19 nt, Homo sapiens
gugauaauuuccacaugau

SEQ ID NO: 549942 - RNA, 19 nt, Homo sapiens
gaagacacgcagcuaugga

SEQ ID NO: 549943 - RNA, 19 nt, Homo sapiens
acaaugaggagauucaguu

SEQ ID NO: 549944 - RNA, 19 nt, Homo sapiens
ggaacucuacucacagugu

SEQ ID NO: 549945 - RNA, 19 nt, Homo sapiens
cgcaggaacucuacucaca

SEQ ID NO: 549946 - RNA, 19 nt, Homo sapiens
caggaacucuacucacagu

SEQ ID NO: 549947 - RNA, 19 nt, Homo sapiens
ccaacuggaaggcauuauu

SEQ ID NO: 549948 - RNA, 19 nt, Homo sapiens
gcaccaaagaagugauaau

SEQ ID NO: 549949 - RNA, 19 nt, Homo sapiens
caagggaguggguggaaga

SEQ ID NO: 549950 - RNA, 19 nt, Homo sapiens
caaggucggcuacugaaag

SEQ ID NO: 549951 - RNA, 19 nt, Homo sapiens
aggagaagaagcacaauga

SEQ ID NO: 549952 - RNA, 19 nt, Homo sapiens
gaggagaagaagcacaaug

SEQ ID NO: 549953 - RNA, 19 nt, Homo sapiens
ggaagacacgcagcuaugg

SEQ ID NO: 549954 - RNA, 19 nt, Homo sapiens
gggaguuauuuacuguguu

SEQ ID NO: 549955 - RNA, 19 nt, Homo sapiens
gagagcagcguggcguuug

SEQ ID NO: 549956 - RNA, 19 nt, Homo sapiens
gacacuugggaguuauuua

SEQ ID NO: 549957 - RNA, 19 nt, Homo sapiens
ggucggcuacugaaaguca

SEQ ID NO: 549958 - RNA, 19 nt, Homo sapiens
gaggaaaaucgcagaauug

SEQ ID NO: 549959 - RNA, 19 nt, Homo sapiens
gggagucaccaucaacugu

SEQ ID NO: 549960 - RNA, 19 nt, Homo sapiens
ggcauuauugcaccaaaga

SEQ ID NO: 549961 - RNA, 19 nt, Homo sapiens
ggagaagaagcacaaugag

SEQ ID NO: 549962 - RNA, 19 nt, Homo sapiens
agaggaaaaucgcagaauu

SEQ ID NO: 549963 - RNA, 19 nt, Homo sapiens
aggagcaguuagacuuaaa

SEQ ID NO: 549964 - RNA, 19 nt, Homo sapiens
gcugcuggguugcuacucu

SEQ ID NO: 549965 - RNA, 19 nt, Homo sapiens
gauccgggagucaccauca

SEQ ID NO: 549966 - RNA, 19 nt, Homo sapiens
agaaaucuugaaugccaua

SEQ ID NO: 549967 - RNA, 19 nt, Homo sapiens
gcauuauugcaccaaagaa

SEQ ID NO: 549968 - RNA, 19 nt, Homo sapiens
gcaagugaacgagcagaag

SEQ ID NO: 549969 - RNA, 19 nt, Homo sapiens
gaccuggagaggcaaguga

SEQ ID NO: 549970 - RNA, 19 nt, Homo sapiens
gcagaauuggagacggaaa

SEQ ID NO: 549971 - RNA, 19 nt, Homo sapiens
ucccagauccuacaaagca

SEQ ID NO: 549972 - RNA, 19 nt, Homo sapiens
ugggaguuauuuacugugu

SEQ ID NO: 549973 - RNA, 19 nt, Homo sapiens
cuugggaguuauuuacugu

SEQ ID NO: 549974 - RNA, 19 nt, Homo sapiens
aaggucggcuacugaaagu

SEQ ID NO: 549975 - RNA, 19 nt, Homo sapiens
gcccaacuggaaggcauua

SEQ ID NO: 549976 - RNA, 19 nt, Homo sapiens
caaugaggagauucaguuc

SEQ ID NO: 549977 - RNA, 19 nt, Homo sapiens
cgagagcagcguggcguuu

SEQ ID NO: 549978 - RNA, 19 nt, Homo sapiens
ccaaggucggcuacugaaa

SEQ ID NO: 549979 - RNA, 19 nt, Homo sapiens
caaagaagugauaauuucc

SEQ ID NO: 549980 - RNA, 19 nt, Homo sapiens
uggaagacacgcagcuaug

SEQ ID NO: 549981 - RNA, 19 nt, Homo sapiens
ugucccagauccuacaaag

SEQ ID NO: 549982 - RNA, 19 nt, Homo sapiens
aaugugaagccacugagaa

SEQ ID NO: 549983 - RNA, 19 nt, Homo sapiens
gcagaaggcaaaaugugaa

SEQ ID NO: 549984 - RNA, 19 nt, Homo sapiens
gcaagcaacuucuguauuu

SEQ ID NO: 549985 - RNA, 19 nt, Homo sapiens
uaacacagcucuauaccua

SEQ ID NO: 549986 - RNA, 19 nt, Homo sapiens
gaauugagcacaucuaaua

SEQ ID NO: 549987 - RNA, 19 nt, Homo sapiens
gaaagaagguauccauguu

SEQ ID NO: 549988 - RNA, 19 nt, Homo sapiens
ggacagccuugguuuguaa

SEQ ID NO: 549989 - RNA, 19 nt, Homo sapiens
gugcaaacauguagaauau

SEQ ID NO: 549990 - RNA, 19 nt, Homo sapiens
gaaauacgaagaugcagua

SEQ ID NO: 549991 - RNA, 19 nt, Homo sapiens
gaauugcacuucacuuaau

SEQ ID NO: 549992 - RNA, 19 nt, Homo sapiens
gagauugguuugcuuuaaa

SEQ ID NO: 549993 - RNA, 19 nt, Homo sapiens
uaaugaagcuuccauagga

SEQ ID NO: 549994 - RNA, 19 nt, Homo sapiens
caacuuggcuaaagaaucu

SEQ ID NO: 549995 - RNA, 19 nt, Homo sapiens
gggaccggcuguaugauua

SEQ ID NO: 549996 - RNA, 19 nt, Homo sapiens
gagcugaaacaucuaaaua

SEQ ID NO: 549997 - RNA, 19 nt, Homo sapiens
ggagaaguaucguccuaaa

SEQ ID NO: 549998 - RNA, 19 nt, Homo sapiens
gaggagaaauaauguauag

SEQ ID NO: 549999 - RNA, 19 nt, Homo sapiens
gaccuuaugugguuuauuc

SEQ ID NO: 550000 - RNA, 19 nt, Homo sapiens
gggcauugcucuccuauuc

SEQ ID NO: 550001 - RNA, 19 nt, Homo sapiens
gaauugcugcuucuuguua

SEQ ID NO: 550002 - RNA, 19 nt, Homo sapiens
guaaauaucuacuguuugc

SEQ ID NO: 550003 - RNA, 19 nt, Homo sapiens
gagaugcuuuguuauugua

SEQ ID NO: 550004 - RNA, 19 nt, Homo sapiens
uaacauggcucgaaugaac

SEQ ID NO: 550005 - RNA, 19 nt, Homo sapiens
ggaaguaggugccauuggu

SEQ ID NO: 550006 - RNA, 19 nt, Homo sapiens
caagugaacuguagaaacu

SEQ ID NO: 550007 - RNA, 19 nt, Homo sapiens
aaagggaaguggaaguaua

SEQ ID NO: 550008 - RNA, 19 nt, Homo sapiens
cauaccaguuuaacacuua

SEQ ID NO: 550009 - RNA, 19 nt, Homo sapiens
caaccuauuuggauacuug

SEQ ID NO: 550010 - RNA, 19 nt, Homo sapiens
gcagacaagugaacuguag

SEQ ID NO: 550011 - RNA, 19 nt, Homo sapiens
ccucacaccugaauugaaa

SEQ ID NO: 550012 - RNA, 19 nt, Homo sapiens
gaaaugcagccuagucuug

SEQ ID NO: 550013 - RNA, 19 nt, Homo sapiens
ggaggcccuugguuauuua

SEQ ID NO: 550014 - RNA, 19 nt, Homo sapiens
ggacucaaaguuuaaguaa

SEQ ID NO: 550015 - RNA, 19 nt, Homo sapiens
ccacauucauaccaauaua

SEQ ID NO: 550016 - RNA, 19 nt, Homo sapiens
gccagaaucuuaucaauac

SEQ ID NO: 550017 - RNA, 19 nt, Homo sapiens
guuaugaguugaagucuug

SEQ ID NO: 550018 - RNA, 19 nt, Homo sapiens
ugacaugcauuuaucauca

SEQ ID NO: 550019 - RNA, 19 nt, Homo sapiens
guagagaugcuuuguuauu

SEQ ID NO: 550020 - RNA, 19 nt, Homo sapiens
gcaaacauguagaauaugc

SEQ ID NO: 550021 - RNA, 19 nt, Homo sapiens
guauggaguuaccacaaua

SEQ ID NO: 550022 - RNA, 19 nt, Homo sapiens
agguagagaugcuuuguua

SEQ ID NO: 550023 - RNA, 19 nt, Homo sapiens
gauuguugaugacugguua

SEQ ID NO: 550024 - RNA, 19 nt, Homo sapiens
gaauuuaguuccaccucuu

SEQ ID NO: 550025 - RNA, 19 nt, Homo sapiens
guacugaggagaaauaaug

SEQ ID NO: 550026 - RNA, 19 nt, Homo sapiens
ggaaugaaauacgaagaug

SEQ ID NO: 550027 - RNA, 19 nt, Homo sapiens
gaacuguagaaacugauua

SEQ ID NO: 550028 - RNA, 19 nt, Homo sapiens
caaaauacaugaaguagug

SEQ ID NO: 550029 - RNA, 19 nt, Homo sapiens
gcagucacauuuaaucaca

SEQ ID NO: 550030 - RNA, 19 nt, Homo sapiens
gcauuugcguuuauugaga

SEQ ID NO: 550031 - RNA, 19 nt, Homo sapiens
ccacaaucuucaaugagua

SEQ ID NO: 550032 - RNA, 19 nt, Homo sapiens
ggcaugcagucacauuuaa

SEQ ID NO: 550033 - RNA, 19 nt, Homo sapiens
gggccuacaugguuauuug

SEQ ID NO: 550034 - RNA, 19 nt, Homo sapiens
gaagguauccauguucuug

SEQ ID NO: 550035 - RNA, 19 nt, Homo sapiens
gaagucacauacaagaaca

SEQ ID NO: 550036 - RNA, 19 nt, Homo sapiens
ucaaagcacugagaauuuc

SEQ ID NO: 550037 - RNA, 19 nt, Homo sapiens
gaaguggaaguauaaguga

SEQ ID NO: 550038 - RNA, 19 nt, Homo sapiens
ggagcuguguaaguuaaua

SEQ ID NO: 550039 - RNA, 19 nt, Homo sapiens
acacuacucuuguggagaa

SEQ ID NO: 550040 - RNA, 19 nt, Homo sapiens
cagaaguguugaauugaaa

SEQ ID NO: 550041 - RNA, 19 nt, Homo sapiens
gaagggcaguggagauuac

SEQ ID NO: 550042 - RNA, 19 nt, Homo sapiens
caaaauacccagcacaaua

SEQ ID NO: 550043 - RNA, 19 nt, Homo sapiens
auacgaagaugcaguacaa

SEQ ID NO: 550044 - RNA, 19 nt, Homo sapiens
ucuguuggccucaguauua

SEQ ID NO: 550045 - RNA, 19 nt, Homo sapiens
gcauuuaucaucauugaga

SEQ ID NO: 550046 - RNA, 19 nt, Homo sapiens
cagaagcacaugucuuuaa

SEQ ID NO: 550047 - RNA, 19 nt, Homo sapiens
gaagaugcaguacaauuca

SEQ ID NO: 550048 - RNA, 19 nt, Homo sapiens
ggaaguggaaguauaagug

SEQ ID NO: 550049 - RNA, 19 nt, Homo sapiens
uaccuaggcuugucuauag

SEQ ID NO: 550050 - RNA, 19 nt, Homo sapiens
uagagaugcuuuguuauug

SEQ ID NO: 550051 - RNA, 19 nt, Homo sapiens
ccauguaucucacuuugug

SEQ ID NO: 550052 - RNA, 19 nt, Homo sapiens
gauccacaauaaucccuuu

SEQ ID NO: 550053 - RNA, 19 nt, Homo sapiens
ugagauugguuugcuuuaa

SEQ ID NO: 550054 - RNA, 19 nt, Homo sapiens
acucugaggugcaacuuaa

SEQ ID NO: 550055 - RNA, 19 nt, Homo sapiens
aagauuaggugccaaaaua

SEQ ID NO: 550056 - RNA, 19 nt, Homo sapiens
cuuaagaaguauggaguua

SEQ ID NO: 550057 - RNA, 19 nt, Homo sapiens
caaccaaugcgaccuuaaa

SEQ ID NO: 550058 - RNA, 19 nt, Homo sapiens
acaauaaucccuuugauca

SEQ ID NO: 550059 - RNA, 19 nt, Homo sapiens
ggagguucauuucacuuau

SEQ ID NO: 550060 - RNA, 19 nt, Homo sapiens
caagaguucugaccuggau

SEQ ID NO: 550061 - RNA, 19 nt, Homo sapiens
gauguagucccucaacuug

SEQ ID NO: 550062 - RNA, 19 nt, Homo sapiens
gcaguacaauucauaagac

SEQ ID NO: 550063 - RNA, 19 nt, Homo sapiens
acagaaguguugaauugaa

SEQ ID NO: 550064 - RNA, 19 nt, Homo sapiens
gcaaagaacauaaaagaug

SEQ ID NO: 550065 - RNA, 19 nt, Homo sapiens
guucaaagaguuaugaguu

SEQ ID NO: 550066 - RNA, 19 nt, Homo sapiens
guuaaacuauuaccacaca

SEQ ID NO: 550067 - RNA, 19 nt, Homo sapiens
uguaaaggacucaaaguuu

SEQ ID NO: 550068 - RNA, 19 nt, Homo sapiens
ggugauguguauuaauguu

SEQ ID NO: 550069 - RNA, 19 nt, Homo sapiens
uuacuggauugaagaauug

SEQ ID NO: 550070 - RNA, 19 nt, Homo sapiens
aauagaggcuagcuaccua

SEQ ID NO: 550071 - RNA, 19 nt, Homo sapiens
uuagugggaugauguaaau

SEQ ID NO: 550072 - RNA, 19 nt, Homo sapiens
gauuacugcuccaccaaga

SEQ ID NO: 550073 - RNA, 19 nt, Homo sapiens
gcuaaugaauugagcacau

SEQ ID NO: 550074 - RNA, 19 nt, Homo sapiens
uacagaagcacaugucuuu

SEQ ID NO: 550075 - RNA, 19 nt, Homo sapiens
cacuagaccuuaugugguu

SEQ ID NO: 550076 - RNA, 19 nt, Homo sapiens
aauugaagguggaaugaaa

SEQ ID NO: 550077 - RNA, 19 nt, Homo sapiens
gccaggcauuuaagaauau

SEQ ID NO: 550078 - RNA, 19 nt, Homo sapiens
caccuuguguuucaaagaa

SEQ ID NO: 550079 - RNA, 19 nt, Homo sapiens
ucagaaguguguuuaccaa

SEQ ID NO: 550080 - RNA, 19 nt, Homo sapiens
ccaaugcgaccuuaaacaa

SEQ ID NO: 550081 - RNA, 19 nt, Homo sapiens
gauacuccaccuuguguuu

SEQ ID NO: 550082 - RNA, 19 nt, Homo sapiens
ggagaaagaagguauccau

SEQ ID NO: 550083 - RNA, 19 nt, Homo sapiens
gaagcaacuuaugacacua

SEQ ID NO: 550084 - RNA, 19 nt, Homo sapiens
ggaaagagcccaucccuaa

SEQ ID NO: 550085 - RNA, 19 nt, Homo sapiens
guacagacauuccauggua

SEQ ID NO: 550086 - RNA, 19 nt, Homo sapiens
ggaaauggcauacgcaaua

SEQ ID NO: 550087 - RNA, 19 nt, Homo sapiens
ggacagaccuggagaacga

SEQ ID NO: 550088 - RNA, 19 nt, Homo sapiens
guaccuuacucaucauuua

SEQ ID NO: 550089 - RNA, 19 nt, Homo sapiens
gcacugaccucaagauugg

SEQ ID NO: 550090 - RNA, 19 nt, Homo sapiens
agauaaagaugguggaaua

SEQ ID NO: 550091 - RNA, 19 nt, Homo sapiens
gaauuugguuuacugcuuu

SEQ ID NO: 550092 - RNA, 19 nt, Homo sapiens
gcacaucuauggcuacugu

SEQ ID NO: 550093 - RNA, 19 nt, Homo sapiens
gaagaccuguggcgacauu

SEQ ID NO: 550094 - RNA, 19 nt, Homo sapiens
cgaggacgaugacugcuua

SEQ ID NO: 550095 - RNA, 19 nt, Homo sapiens
gaaauggcauacgcaauau

SEQ ID NO: 550096 - RNA, 19 nt, Homo sapiens
gcggaaagguaaccacaaa

SEQ ID NO: 550097 - RNA, 19 nt, Homo sapiens
ggaauuugguuuacugcuu

SEQ ID NO: 550098 - RNA, 19 nt, Homo sapiens
gaagaugagcuccauauag

SEQ ID NO: 550099 - RNA, 19 nt, Homo sapiens
ucacaucucuuauuucucu

SEQ ID NO: 550100 - RNA, 19 nt, Homo sapiens
caacaacccacaugacauu

SEQ ID NO: 550101 - RNA, 19 nt, Homo sapiens
gcaauaagaccaucucagu

SEQ ID NO: 550102 - RNA, 19 nt, Homo sapiens
gaaggucaguguacagaca

SEQ ID NO: 550103 - RNA, 19 nt, Homo sapiens
cauuaagccuugaagauga

SEQ ID NO: 550104 - RNA, 19 nt, Homo sapiens
gcacuacccaugaggaauu

SEQ ID NO: 550105 - RNA, 19 nt, Homo sapiens
gaaagguaaccacaaaguu

SEQ ID NO: 550106 - RNA, 19 nt, Homo sapiens
gaauggguuucuauauaug

SEQ ID NO: 550107 - RNA, 19 nt, Homo sapiens
guaccagagugcucagaaa

SEQ ID NO: 550108 - RNA, 19 nt, Homo sapiens
ggucacagcugcaccaacu

SEQ ID NO: 550109 - RNA, 19 nt, Homo sapiens
gaaaacaacagaagaagaa

SEQ ID NO: 550110 - RNA, 19 nt, Homo sapiens
ggacugacucgggcaauaa

SEQ ID NO: 550111 - RNA, 19 nt, Homo sapiens
gaucagcccaaguuuacua

SEQ ID NO: 550112 - RNA, 19 nt, Homo sapiens
gcaaaugaagacaguaaga

SEQ ID NO: 550113 - RNA, 19 nt, Homo sapiens
ccagaucagcccaaguuua

SEQ ID NO: 550114 - RNA, 19 nt, Homo sapiens
gaaagucaagauaggauau

SEQ ID NO: 550115 - RNA, 19 nt, Homo sapiens
caaucuaccucaacuacga

SEQ ID NO: 550116 - RNA, 19 nt, Homo sapiens
caccgaaccugcuugaaau

SEQ ID NO: 550117 - RNA, 19 nt, Homo sapiens
gcauuaagccuugaagaug

SEQ ID NO: 550118 - RNA, 19 nt, Homo sapiens
cgacggcgaugacgacugu

SEQ ID NO: 550119 - RNA, 19 nt, Homo sapiens
gacaugcuguggaugaaga

SEQ ID NO: 550120 - RNA, 19 nt, Homo sapiens
uauggcuacuguucaaaua

SEQ ID NO: 550121 - RNA, 19 nt, Homo sapiens
gagaagaggcacaucuaug

SEQ ID NO: 550122 - RNA, 19 nt, Homo sapiens
ggaugaauggguuucuaua

SEQ ID NO: 550123 - RNA, 19 nt, Homo sapiens
agggagaacugcucagauu

SEQ ID NO: 550124 - RNA, 19 nt, Homo sapiens
aagaugggcucaacaguca

SEQ ID NO: 550125 - RNA, 19 nt, Homo sapiens
gcucacacaucugcacuga

SEQ ID NO: 550126 - RNA, 19 nt, Homo sapiens
ggaugaagauaaagauggu

SEQ ID NO: 550127 - RNA, 19 nt, Homo sapiens
ggauauuuauguucacaca

SEQ ID NO: 550128 - RNA, 19 nt, Homo sapiens
ggggaaacauuuuaaggua

SEQ ID NO: 550129 - RNA, 19 nt, Homo sapiens
uaaagaugguggaauaggu

SEQ ID NO: 550130 - RNA, 19 nt, Homo sapiens
guauguguguguuuauaug

SEQ ID NO: 550131 - RNA, 19 nt, Homo sapiens
ggaaagguaaccacaaagu

SEQ ID NO: 550132 - RNA, 19 nt, Homo sapiens
cgagcugccugucgucaaa

SEQ ID NO: 550133 - RNA, 19 nt, Homo sapiens
gaaagagcccaucccuaau

SEQ ID NO: 550134 - RNA, 19 nt, Homo sapiens
uaccaugguuugugcaauu

SEQ ID NO: 550135 - RNA, 19 nt, Homo sapiens
ggguauaucuuguaguuuu

SEQ ID NO: 550136 - RNA, 19 nt, Homo sapiens
gaugaauggguuucuauau

SEQ ID NO: 550137 - RNA, 19 nt, Homo sapiens
aagaugagcuccauauagg

SEQ ID NO: 550138 - RNA, 19 nt, Homo sapiens
uagguuacuuaccaucaua

SEQ ID NO: 550139 - RNA, 19 nt, Homo sapiens
ugacuaacaugaugcacau

SEQ ID NO: 550140 - RNA, 19 nt, Homo sapiens
gcacuacacucuggauggu

SEQ ID NO: 550141 - RNA, 19 nt, Homo sapiens
gcaccucaaucuaccucaa

SEQ ID NO: 550142 - RNA, 19 nt, Homo sapiens
ucaccgaaccugcuugaaa

SEQ ID NO: 550143 - RNA, 19 nt, Homo sapiens
ccagaucugugucaauuac

SEQ ID NO: 550144 - RNA, 19 nt, Homo sapiens
guaugugugugugugauuu

SEQ ID NO: 550145 - RNA, 19 nt, Homo sapiens
guaugugugugacaggaaa

SEQ ID NO: 550146 - RNA, 19 nt, Homo sapiens
gaauggcuacugcugacua

SEQ ID NO: 550147 - RNA, 19 nt, Homo sapiens
guguaugacuggaugaaug

SEQ ID NO: 550148 - RNA, 19 nt, Homo sapiens
ccuugaagaugauggacua

SEQ ID NO: 550149 - RNA, 19 nt, Homo sapiens
gcagucccaagcucaguua

SEQ ID NO: 550150 - RNA, 19 nt, Homo sapiens
uggcauacgcaauauuaua

SEQ ID NO: 550151 - RNA, 19 nt, Homo sapiens
aauggcauacgcaauauua

SEQ ID NO: 550152 - RNA, 19 nt, Homo sapiens
gaagauaaagaugguggaa

SEQ ID NO: 550153 - RNA, 19 nt, Homo sapiens
gauuaugcuuuguggcuau

SEQ ID NO: 550154 - RNA, 19 nt, Homo sapiens
ccaauggcacaguaccuua

SEQ ID NO: 550155 - RNA, 19 nt, Homo sapiens
ucaauuacaagggcuauuu

SEQ ID NO: 550156 - RNA, 19 nt, Homo sapiens
gaacgagugucugcacaac

SEQ ID NO: 550157 - RNA, 19 nt, Homo sapiens
gcucagaaagucaagauag

SEQ ID NO: 550158 - RNA, 19 nt, Homo sapiens
ccaaaggaugugagaguuu

SEQ ID NO: 550159 - RNA, 19 nt, Homo sapiens
gaacugcaaacauccaaag

SEQ ID NO: 550160 - RNA, 19 nt, Homo sapiens
cuucgugccucauggaauu

SEQ ID NO: 550161 - RNA, 19 nt, Homo sapiens
ggcacuagauguggaaguu

SEQ ID NO: 550162 - RNA, 19 nt, Homo sapiens
caucugcacugaccucaag

SEQ ID NO: 550163 - RNA, 19 nt, Homo sapiens
ccagggcuuucuuggcuuu

SEQ ID NO: 550164 - RNA, 19 nt, Homo sapiens
gaaaaucuguagagaagag

SEQ ID NO: 550165 - RNA, 19 nt, Homo sapiens
guguauguguguguuuaua

SEQ ID NO: 550166 - RNA, 19 nt, Homo sapiens
guguguauguguguguuua

SEQ ID NO: 550167 - RNA, 19 nt, Homo sapiens
gcagcaaucagcagcuuug

SEQ ID NO: 550168 - RNA, 19 nt, Homo sapiens
gaacuauucacgccucauc

SEQ ID NO: 550169 - RNA, 19 nt, Homo sapiens
ucucuaccauuuccuuuau

SEQ ID NO: 550170 - RNA, 19 nt, Homo sapiens
cagcccaaguuuacuauag

SEQ ID NO: 550171 - RNA, 19 nt, Homo sapiens
caaaggaugugagaguuuu

SEQ ID NO: 550172 - RNA, 19 nt, Homo sapiens
aaauuuauguugcggaaag

SEQ ID NO: 550173 - RNA, 19 nt, Homo sapiens
ucacacaggaauuugguuu

SEQ ID NO: 550174 - RNA, 19 nt, Homo sapiens
aaauagauaccaugguuug

SEQ ID NO: 550175 - RNA, 19 nt, Homo sapiens
ccagcacuaugcaaaugaa

SEQ ID NO: 550176 - RNA, 19 nt, Homo sapiens
caaggccagugacccgaaa

SEQ ID NO: 550177 - RNA, 19 nt, Homo sapiens
ccucagcuacuccuuguuu

SEQ ID NO: 550178 - RNA, 19 nt, Homo sapiens
ccagagugcucagaaaguc

SEQ ID NO: 550179 - RNA, 19 nt, Homo sapiens
aagaagaccugugcagaca

SEQ ID NO: 550180 - RNA, 19 nt, Homo sapiens
gagccacccuuuugggaua

SEQ ID NO: 550181 - RNA, 19 nt, Homo sapiens
gagcccaucccuaaucuuc

SEQ ID NO: 550182 - RNA, 19 nt, Homo sapiens
gggaaacauuuuaagguaa

SEQ ID NO: 550183 - RNA, 19 nt, Homo sapiens
ccacaaaguuaugaugaac

SEQ ID NO: 550184 - RNA, 19 nt, Homo sapiens
ggacagaccuggagaacga

SEQ ID NO: 550185 - RNA, 19 nt, Homo sapiens
guaccuuacucaucauuua

SEQ ID NO: 550186 - RNA, 19 nt, Homo sapiens
gcacugaccucaagauugg

SEQ ID NO: 550187 - RNA, 19 nt, Homo sapiens
cgaggacgaugacugcuua

SEQ ID NO: 550188 - RNA, 19 nt, Homo sapiens
gcggaaagguaaccacaaa

SEQ ID NO: 550189 - RNA, 19 nt, Homo sapiens
gaagaugagcuccauauag

SEQ ID NO: 550190 - RNA, 19 nt, Homo sapiens
caacaacccacaugacauu

SEQ ID NO: 550191 - RNA, 19 nt, Homo sapiens
gcaauaagaccaucucagu

SEQ ID NO: 550192 - RNA, 19 nt, Homo sapiens
ggcaagagcccaucccuaa

SEQ ID NO: 550193 - RNA, 19 nt, Homo sapiens
gaagacuuguggcgacauu

SEQ ID NO: 550194 - RNA, 19 nt, Homo sapiens
cauuaagccuugaagauga

SEQ ID NO: 550195 - RNA, 19 nt, Homo sapiens
gcacuacccaugaggaauu

SEQ ID NO: 550196 - RNA, 19 nt, Homo sapiens
gaaagguaaccacaaaguu

SEQ ID NO: 550197 - RNA, 19 nt, Homo sapiens
gaauggguuucuauauaug

SEQ ID NO: 550198 - RNA, 19 nt, Homo sapiens
cuaccgagaugcaaaugaa

SEQ ID NO: 550199 - RNA, 19 nt, Homo sapiens
gaaaacaacagaagaagaa

SEQ ID NO: 550200 - RNA, 19 nt, Homo sapiens
ggacugacucgggcaauaa

SEQ ID NO: 550201 - RNA, 19 nt, Homo sapiens
gcaaaugaagacaguaaga

SEQ ID NO: 550202 - RNA, 19 nt, Homo sapiens
caccgaaccugcuugaaau

SEQ ID NO: 550203 - RNA, 19 nt, Homo sapiens
gcauuaagccuugaagaug

SEQ ID NO: 550204 - RNA, 19 nt, Homo sapiens
ggaugaauggguuucuaua

SEQ ID NO: 550205 - RNA, 19 nt, Homo sapiens
agggagaacugcucagauu

SEQ ID NO: 550206 - RNA, 19 nt, Homo sapiens
aagaugggcucaacaguca

SEQ ID NO: 550207 - RNA, 19 nt, Homo sapiens
gcucacacaucugcacuga

SEQ ID NO: 550208 - RNA, 19 nt, Homo sapiens
ggaaagguaaccacaaagu

SEQ ID NO: 550209 - RNA, 19 nt, Homo sapiens
gaugaauggguuucuauau

SEQ ID NO: 550210 - RNA, 19 nt, Homo sapiens
aagaugagcuccauauagg

SEQ ID NO: 550211 - RNA, 19 nt, Homo sapiens
ugacuaacaugaugcacau

SEQ ID NO: 550212 - RNA, 19 nt, Homo sapiens
ccagaucugugucaauuac

SEQ ID NO: 550213 - RNA, 19 nt, Homo sapiens
ucaccgaaccugcuugaaa

SEQ ID NO: 550214 - RNA, 19 nt, Homo sapiens
guaugugugugugugauuu

SEQ ID NO: 550215 - RNA, 19 nt, Homo sapiens
gaagaggugcuaccgagau

SEQ ID NO: 550216 - RNA, 19 nt, Homo sapiens
gaauggcuacugcugacua

SEQ ID NO: 550217 - RNA, 19 nt, Homo sapiens
guguaugacuggaugaaug

SEQ ID NO: 550218 - RNA, 19 nt, Homo sapiens
ccuugaagaugauggacua

SEQ ID NO: 550219 - RNA, 19 nt, Homo sapiens
gauuaugcuuuguggcuau

SEQ ID NO: 550220 - RNA, 19 nt, Homo sapiens
ccaauggcacaguaccuua

SEQ ID NO: 550221 - RNA, 19 nt, Homo sapiens
gcacuacacuccggauggu

SEQ ID NO: 550222 - RNA, 19 nt, Homo sapiens
ucaauuacaagggcuauuu

SEQ ID NO: 550223 - RNA, 19 nt, Homo sapiens
gaacgagugucugcacaac

SEQ ID NO: 550224 - RNA, 19 nt, Homo sapiens
ccaaaggaugugagaguuu

SEQ ID NO: 550225 - RNA, 19 nt, Homo sapiens
gaacugcaaacauccaaag

SEQ ID NO: 550226 - RNA, 19 nt, Homo sapiens
cuucgugccucauggaauu

SEQ ID NO: 550227 - RNA, 19 nt, Homo sapiens
ggcacuagauguggaaguu

SEQ ID NO: 550228 - RNA, 19 nt, Homo sapiens
caucugcacugaccucaag

SEQ ID NO: 550229 - RNA, 19 nt, Homo sapiens
gaacuauucacgccucauc

SEQ ID NO: 550230 - RNA, 19 nt, Homo sapiens
caagagcccaucccuaauc

SEQ ID NO: 550231 - RNA, 19 nt, Homo sapiens
caaaggaugugagaguuuu

SEQ ID NO: 550232 - RNA, 19 nt, Homo sapiens
aaauuuauguugcggaaag

SEQ ID NO: 550233 - RNA, 19 nt, Homo sapiens
caaggccagugacccgaaa

SEQ ID NO: 550234 - RNA, 19 nt, Homo sapiens
gagccacccuuuugggaua

SEQ ID NO: 550235 - RNA, 19 nt, Homo sapiens
gagcccaucccuaaucuuc

SEQ ID NO: 550236 - RNA, 19 nt, Homo sapiens
aagaagaccugugcagaca

SEQ ID NO: 550237 - RNA, 19 nt, Homo sapiens
ccacaaaguuaugaugaac

SEQ ID NO: 550238 - RNA, 19 nt, Homo sapiens
ggagaacugcucagauugg

SEQ ID NO: 550239 - RNA, 19 nt, Homo sapiens
gaucaucgugcccauagug

SEQ ID NO: 550240 - RNA, 19 nt, Homo sapiens
ucaauggccuggaaaucuc

SEQ ID NO: 550241 - RNA, 19 nt, Homo sapiens
gcaagagcccaucccuaau

SEQ ID NO: 550242 - RNA, 19 nt, Homo sapiens
agccagaucugugucaauu

SEQ ID NO: 550243 - RNA, 19 nt, Homo sapiens
uaauggaggcugugaauac

SEQ ID NO: 550244 - RNA, 19 nt, Homo sapiens
uuacagaagauguuugguu

SEQ ID NO: 550245 - RNA, 19 nt, Homo sapiens
caaaugaagacaguaagau

SEQ ID NO: 550246 - RNA, 19 nt, Homo sapiens
guggcuauccaucaacaua

SEQ ID NO: 550247 - RNA, 19 nt, Homo sapiens
caacccagucuacaggaaa

SEQ ID NO: 550248 - RNA, 19 nt, Homo sapiens
acgagugucugcacaacaa

SEQ ID NO: 550249 - RNA, 19 nt, Homo sapiens
cugcgaggguucauguauu

SEQ ID NO: 550250 - RNA, 19 nt, Homo sapiens
caagauuggcuuugaaugc

SEQ ID NO: 550251 - RNA, 19 nt, Homo sapiens
gggaccaggccaagauuga

SEQ ID NO: 550252 - RNA, 19 nt, Homo sapiens
ugcgaggguucauguauug

SEQ ID NO: 550253 - RNA, 19 nt, Homo sapiens
gaccucuccuaccguaaga

SEQ ID NO: 550254 - RNA, 19 nt, Homo sapiens
ggcauuaagccuugaagau

SEQ ID NO: 550255 - RNA, 19 nt, Homo sapiens
ucagauuggccaugucuau

SEQ ID NO: 550256 - RNA, 19 nt, Homo sapiens
ggaagcggaagaacaccaa

SEQ ID NO: 550257 - RNA, 19 nt, Homo sapiens
cauguguccuugcaaucaa

SEQ ID NO: 550258 - RNA, 19 nt, Homo sapiens
aaaugaagacaguaagaug

SEQ ID NO: 550259 - RNA, 19 nt, Homo sapiens
uggacugacucgggcaaua

SEQ ID NO: 550260 - RNA, 19 nt, Homo sapiens
gcagccagaucugugucaa

SEQ ID NO: 550261 - RNA, 19 nt, Homo sapiens
aauggcuacugcugacuaa

SEQ ID NO: 550262 - RNA, 19 nt, Homo sapiens
gggagaacugcucagauug

SEQ ID NO: 550263 - RNA, 19 nt, Homo sapiens
aaacaacagaagaagaaga

SEQ ID NO: 550264 - RNA, 19 nt, Homo sapiens
cagccacucucccaaguac

SEQ ID NO: 550265 - RNA, 19 nt, Homo sapiens
gcacucucuucagccguaa

SEQ ID NO: 550266 - RNA, 19 nt, Homo sapiens
ugauagcccuccugugcau

SEQ ID NO: 550267 - RNA, 19 nt, Homo sapiens
ugggauagcuguguuugag

SEQ ID NO: 550268 - RNA, 19 nt, Homo sapiens
gaucuccuccacugacuuc

SEQ ID NO: 550269 - RNA, 19 nt, Homo sapiens
gaccaggccaagauugaga

SEQ ID NO: 550270 - RNA, 19 nt, Homo sapiens
gaucuauagcgccuacaug

SEQ ID NO: 550271 - RNA, 19 nt, Homo sapiens
ccaccaaucgcaucuacug

SEQ ID NO: 550272 - RNA, 19 nt, Homo sapiens
agauggaccuacugaccaa

SEQ ID NO: 550273 - RNA, 19 nt, Homo sapiens
aagauuggcuuugaaugca

SEQ ID NO: 550274 - RNA, 19 nt, Homo sapiens
ggacgaugacugcuuagac

SEQ ID NO: 550275 - RNA, 19 nt, Homo sapiens
cgaaccugcuugaaaugca

SEQ ID NO: 550276 - RNA, 19 nt, Homo sapiens
caagggcuauuuuaagugu

SEQ ID NO: 550277 - RNA, 19 nt, Homo sapiens
acuaacaugaugcacauaa

SEQ ID NO: 550278 - RNA, 19 nt, Homo sapiens
cuacugcugacuaacauga

SEQ ID NO: 550279 - RNA, 19 nt, Homo sapiens
ccugauggcuccgaugagu

SEQ ID NO: 550280 - RNA, 19 nt, Homo sapiens
gguguguccugcagagaag

SEQ ID NO: 550281 - RNA, 19 nt, Homo sapiens
gggaucaucgugcccauag

SEQ ID NO: 550282 - RNA, 19 nt, Homo sapiens
aagaggugcuaccgagaug

SEQ ID NO: 550283 - RNA, 19 nt, Homo sapiens
gcacuagauguggaaguug

SEQ ID NO: 550284 - RNA, 19 nt, Homo sapiens
ggaaagagcccaucccuaa

SEQ ID NO: 550285 - RNA, 19 nt, Homo sapiens
guacagacauuccauggua

SEQ ID NO: 550286 - RNA, 19 nt, Homo sapiens
ggaaauggcauacgcaaua

SEQ ID NO: 550287 - RNA, 19 nt, Homo sapiens
ggacagaccuggagaacga

SEQ ID NO: 550288 - RNA, 19 nt, Homo sapiens
guaccuuacucaucauuua

SEQ ID NO: 550289 - RNA, 19 nt, Homo sapiens
gcacugaccucaagauugg

SEQ ID NO: 550290 - RNA, 19 nt, Homo sapiens
agauaaagaugguggaaua

SEQ ID NO: 550291 - RNA, 19 nt, Homo sapiens
gaauuugguuuacugcuuu

SEQ ID NO: 550292 - RNA, 19 nt, Homo sapiens
gcacaucuauggcuacugu

SEQ ID NO: 550293 - RNA, 19 nt, Homo sapiens
gaagaccuguggcgacauu

SEQ ID NO: 550294 - RNA, 19 nt, Homo sapiens
cgaggacgaugacugcuua

SEQ ID NO: 550295 - RNA, 19 nt, Homo sapiens
gaaauggcauacgcaauau

SEQ ID NO: 550296 - RNA, 19 nt, Homo sapiens
gcggaaagguaaccacaaa

SEQ ID NO: 550297 - RNA, 19 nt, Homo sapiens
ggaauuugguuuacugcuu

SEQ ID NO: 550298 - RNA, 19 nt, Homo sapiens
gaagaugagcuccauauag

SEQ ID NO: 550299 - RNA, 19 nt, Homo sapiens
ucacaucucuuauuucucu

SEQ ID NO: 550300 - RNA, 19 nt, Homo sapiens
caacaacccacaugacauu

SEQ ID NO: 550301 - RNA, 19 nt, Homo sapiens
gcaauaagaccaucucagu

SEQ ID NO: 550302 - RNA, 19 nt, Homo sapiens
gaaggucaguguacagaca

SEQ ID NO: 550303 - RNA, 19 nt, Homo sapiens
cauuaagccuugaagauga

SEQ ID NO: 550304 - RNA, 19 nt, Homo sapiens
gcacuacccaugaggaauu

SEQ ID NO: 550305 - RNA, 19 nt, Homo sapiens
gaaagguaaccacaaaguu

SEQ ID NO: 550306 - RNA, 19 nt, Homo sapiens
gaauggguuucuauauaug

SEQ ID NO: 550307 - RNA, 19 nt, Homo sapiens
guaccagagugcucagaaa

SEQ ID NO: 550308 - RNA, 19 nt, Homo sapiens
ggucacagcugcaccaacu

SEQ ID NO: 550309 - RNA, 19 nt, Homo sapiens
gaaaacaacagaagaagaa

SEQ ID NO: 550310 - RNA, 19 nt, Homo sapiens
ggacugacucgggcaauaa

SEQ ID NO: 550311 - RNA, 19 nt, Homo sapiens
gaucagcccaaguuuacua

SEQ ID NO: 550312 - RNA, 19 nt, Homo sapiens
gcaaaugaagacaguaaga

SEQ ID NO: 550313 - RNA, 19 nt, Homo sapiens
ccagaucagcccaaguuua

SEQ ID NO: 550314 - RNA, 19 nt, Homo sapiens
gaaagucaagauaggauau

SEQ ID NO: 550315 - RNA, 19 nt, Homo sapiens
caaucuaccucaacuacga

SEQ ID NO: 550316 - RNA, 19 nt, Homo sapiens
caccgaaccugcuugaaau

SEQ ID NO: 550317 - RNA, 19 nt, Homo sapiens
gcauuaagccuugaagaug

SEQ ID NO: 550318 - RNA, 19 nt, Homo sapiens
gacaugcuguggaugaaga

SEQ ID NO: 550319 - RNA, 19 nt, Homo sapiens
uauggcuacuguucaaaua

SEQ ID NO: 550320 - RNA, 19 nt, Homo sapiens
gagaagaggcacaucuaug

SEQ ID NO: 550321 - RNA, 19 nt, Homo sapiens
ggaugaauggguuucuaua

SEQ ID NO: 550322 - RNA, 19 nt, Homo sapiens
agggagaacugcucagauu

SEQ ID NO: 550323 - RNA, 19 nt, Homo sapiens
aagaugggcucaacaguca

SEQ ID NO: 550324 - RNA, 19 nt, Homo sapiens
gcucacacaucugcacuga

SEQ ID NO: 550325 - RNA, 19 nt, Homo sapiens
ggaugaagauaaagauggu

SEQ ID NO: 550326 - RNA, 19 nt, Homo sapiens
ggauauuuauguucacaca

SEQ ID NO: 550327 - RNA, 19 nt, Homo sapiens
ggggaaacauuuuaaggua

SEQ ID NO: 550328 - RNA, 19 nt, Homo sapiens
uaaagaugguggaauaggu

SEQ ID NO: 550329 - RNA, 19 nt, Homo sapiens
guauguguguguuuauaug

SEQ ID NO: 550330 - RNA, 19 nt, Homo sapiens
ggaaagguaaccacaaagu

SEQ ID NO: 550331 - RNA, 19 nt, Homo sapiens
cgagcugccugucgucaaa

SEQ ID NO: 550332 - RNA, 19 nt, Homo sapiens
gaaagagcccaucccuaau

SEQ ID NO: 550333 - RNA, 19 nt, Homo sapiens
uaccaugguuugugcaauu

SEQ ID NO: 550334 - RNA, 19 nt, Homo sapiens
ggguauaucuuguaguuuu

SEQ ID NO: 550335 - RNA, 19 nt, Homo sapiens
gaugaauggguuucuauau

SEQ ID NO: 550336 - RNA, 19 nt, Homo sapiens
aagaugagcuccauauagg

SEQ ID NO: 550337 - RNA, 19 nt, Homo sapiens
uagguuacuuaccaucaua

SEQ ID NO: 550338 - RNA, 19 nt, Homo sapiens
ugacuaacaugaugcacau

SEQ ID NO: 550339 - RNA, 19 nt, Homo sapiens
gcacuacacucuggauggu

SEQ ID NO: 550340 - RNA, 19 nt, Homo sapiens
gcaccucaaucuaccucaa

SEQ ID NO: 550341 - RNA, 19 nt, Homo sapiens
ucaccgaaccugcuugaaa

SEQ ID NO: 550342 - RNA, 19 nt, Homo sapiens
ccagaucugugucaauuac

SEQ ID NO: 550343 - RNA, 19 nt, Homo sapiens
guaugugugugugugauuu

SEQ ID NO: 550344 - RNA, 19 nt, Homo sapiens
guaugugugugacaggaaa

SEQ ID NO: 550345 - RNA, 19 nt, Homo sapiens
gaauggcuacugcugacua

SEQ ID NO: 550346 - RNA, 19 nt, Homo sapiens
guguaugacuggaugaaug

SEQ ID NO: 550347 - RNA, 19 nt, Homo sapiens
ccuugaagaugauggacua

SEQ ID NO: 550348 - RNA, 19 nt, Homo sapiens
gcagucccaagcucaguua

SEQ ID NO: 550349 - RNA, 19 nt, Homo sapiens
uggcauacgcaauauuaua

SEQ ID NO: 550350 - RNA, 19 nt, Homo sapiens
aauggcauacgcaauauua

SEQ ID NO: 550351 - RNA, 19 nt, Homo sapiens
gaacgagugucugcacaac

SEQ ID NO: 550352 - RNA, 19 nt, Homo sapiens
gaagauaaagaugguggaa

SEQ ID NO: 550353 - RNA, 19 nt, Homo sapiens
gauuaugcuuuguggcuau

SEQ ID NO: 550354 - RNA, 19 nt, Homo sapiens
ccaauggcacaguaccuua

SEQ ID NO: 550355 - RNA, 19 nt, Homo sapiens
ucaauuacaagggcuauuu

SEQ ID NO: 550356 - RNA, 19 nt, Homo sapiens
gcucagaaagucaagauag

SEQ ID NO: 550357 - RNA, 19 nt, Homo sapiens
ccaaaggaugugagaguuu

SEQ ID NO: 550358 - RNA, 19 nt, Homo sapiens
gaacugcaaacauccaaag

SEQ ID NO: 550359 - RNA, 19 nt, Homo sapiens
cuucgugccucauggaauu

SEQ ID NO: 550360 - RNA, 19 nt, Homo sapiens
ggcacuagauguggaaguu

SEQ ID NO: 550361 - RNA, 19 nt, Homo sapiens
caucugcacugaccucaag

SEQ ID NO: 550362 - RNA, 19 nt, Homo sapiens
ccagggcuuucuuggcuuu

SEQ ID NO: 550363 - RNA, 19 nt, Homo sapiens
gaaaaucuguagagaagag

SEQ ID NO: 550364 - RNA, 19 nt, Homo sapiens
guguauguguguguuuaua

SEQ ID NO: 550365 - RNA, 19 nt, Homo sapiens
guguguauguguguguuua

SEQ ID NO: 550366 - RNA, 19 nt, Homo sapiens
gcagcaaucagcagcuuug

SEQ ID NO: 550367 - RNA, 19 nt, Homo sapiens
gaacuauucacgccucauc

SEQ ID NO: 550368 - RNA, 19 nt, Homo sapiens
ucucuaccauuuccuuuau

SEQ ID NO: 550369 - RNA, 19 nt, Homo sapiens
cagcccaaguuuacuauag

SEQ ID NO: 550370 - RNA, 19 nt, Homo sapiens
caaaggaugugagaguuuu

SEQ ID NO: 550371 - RNA, 19 nt, Homo sapiens
aaauuuauguugcggaaag

SEQ ID NO: 550372 - RNA, 19 nt, Homo sapiens
ucacacaggaauuugguuu

SEQ ID NO: 550373 - RNA, 19 nt, Homo sapiens
aaauagauaccaugguuug

SEQ ID NO: 550374 - RNA, 19 nt, Homo sapiens
ccagcacuaugcaaaugaa

SEQ ID NO: 550375 - RNA, 19 nt, Homo sapiens
caaggccagugacccgaaa

SEQ ID NO: 550376 - RNA, 19 nt, Homo sapiens
ccucagcuacuccuuguuu

SEQ ID NO: 550377 - RNA, 19 nt, Homo sapiens
ccagagugcucagaaaguc

SEQ ID NO: 550378 - RNA, 19 nt, Homo sapiens
aagaagaccugugcagaca

SEQ ID NO: 550379 - RNA, 19 nt, Homo sapiens
gagccacccuuuugggaua

SEQ ID NO: 550380 - RNA, 19 nt, Homo sapiens
gagcccaucccuaaucuuc

SEQ ID NO: 550381 - RNA, 19 nt, Homo sapiens
gggaaacauuuuaagguaa

SEQ ID NO: 550382 - RNA, 19 nt, Homo sapiens
ccacaaaguuaugaugaac

SEQ ID NO: 550383 - RNA, 19 nt, Homo sapiens
ggagaacugcucagauugg

SEQ ID NO: 550384 - RNA, 19 nt, Homo sapiens
ucaaauagcuugcuuacau

SEQ ID NO: 550385 - RNA, 19 nt, Homo sapiens
caacaaugcuugguuuauu

SEQ ID NO: 550386 - RNA, 19 nt, Homo sapiens
caacaagcuucaaggaauu

SEQ ID NO: 550387 - RNA, 19 nt, Homo sapiens
ggaggaaguuucaauaaag

SEQ ID NO: 550388 - RNA, 19 nt, Homo sapiens
gggaggaaguuucaauaaa

SEQ ID NO: 550389 - RNA, 19 nt, Homo sapiens
ccaagcaacugacaaauca

SEQ ID NO: 550390 - RNA, 19 nt, Homo sapiens
gaagagaaacuccaagaug

SEQ ID NO: 550391 - RNA, 19 nt, Homo sapiens
cugaguggcuguauaauug

SEQ ID NO: 550392 - RNA, 19 nt, Homo sapiens
ccaccuaucucaacuucaa

SEQ ID NO: 550393 - RNA, 19 nt, Homo sapiens
caaaugaacccaucaacug

SEQ ID NO: 550394 - RNA, 19 nt, Homo sapiens
caaauagcuugcuuacaug

SEQ ID NO: 550395 - RNA, 19 nt, Homo sapiens
ucaagaaccgggagaagua

SEQ ID NO: 550396 - RNA, 19 nt, Homo sapiens
acaacaagcuucaaggaau

SEQ ID NO: 550397 - RNA, 19 nt, Homo sapiens
gaucaugagcgucuuguug

SEQ ID NO: 550398 - RNA, 19 nt, Homo sapiens
ccacuugucaguucaguaa

SEQ ID NO: 550399 - RNA, 19 nt, Homo sapiens
gaaaucaggcacaucuguu

SEQ ID NO: 550400 - RNA, 19 nt, Homo sapiens
gauuggccauucuaaaguu

SEQ ID NO: 550401 - RNA, 19 nt, Homo sapiens
gagaagagaaacuccaaga

SEQ ID NO: 550402 - RNA, 19 nt, Homo sapiens
caacugggucaacgcuuua

SEQ ID NO: 550403 - RNA, 19 nt, Homo sapiens
aaacaacagucuauugcau

SEQ ID NO: 550404 - RNA, 19 nt, Homo sapiens
ccaagaugcuccagaaggu

SEQ ID NO: 550405 - RNA, 19 nt, Homo sapiens
cauaaccaguucaucaaga

SEQ ID NO: 550406 - RNA, 19 nt, Homo sapiens
caguucacauagcaauuua

SEQ ID NO: 550407 - RNA, 19 nt, Homo sapiens
gaagugcccaccuaucuca

SEQ ID NO: 550408 - RNA, 19 nt, Homo sapiens
caacaacaagcuucaagga

SEQ ID NO: 550409 - RNA, 19 nt, Homo sapiens
gcugaagaguugucaucaa

SEQ ID NO: 550410 - RNA, 19 nt, Homo sapiens
acaacugggucaacgcuuu

SEQ ID NO: 550411 - RNA, 19 nt, Homo sapiens
auagcuugcuuacaugaua

SEQ ID NO: 550412 - RNA, 19 nt, Homo sapiens
cugcugggcuccuacauug

SEQ ID NO: 550413 - RNA, 19 nt, Homo sapiens
acaacagucuauugcauug

SEQ ID NO: 550414 - RNA, 19 nt, Homo sapiens
gcaacuaucgacuugauca

SEQ ID NO: 550415 - RNA, 19 nt, Homo sapiens
ucacuguccuuaucuucaa

SEQ ID NO: 550416 - RNA, 19 nt, Homo sapiens
ugaacucgguggaggagaa

SEQ ID NO: 550417 - RNA, 19 nt, Homo sapiens
agaauacacagaauaguga

SEQ ID NO: 550418 - RNA, 19 nt, Homo sapiens
uagcuugcuuacaugauaa

SEQ ID NO: 550419 - RNA, 19 nt, Homo sapiens
guucaucgagcacucagua

SEQ ID NO: 550420 - RNA, 19 nt, Homo sapiens
uucagucgauucagucaua

SEQ ID NO: 550421 - RNA, 19 nt, Homo sapiens
caaacugucauucaacaau

SEQ ID NO: 550422 - RNA, 19 nt, Homo sapiens
gaauguaggaccucugagu

SEQ ID NO: 550423 - RNA, 19 nt, Homo sapiens
gaggaaguuucaauaaagc

SEQ ID NO: 550424 - RNA, 19 nt, Homo sapiens
cgacagggaggaaguuuca

SEQ ID NO: 550425 - RNA, 19 nt, Homo sapiens
gcccgaggcuuguggucaa

SEQ ID NO: 550426 - RNA, 19 nt, Homo sapiens
ccucugaguggcuguauaa

SEQ ID NO: 550427 - RNA, 19 nt, Homo sapiens
ccucgggucucuccauaau

SEQ ID NO: 550428 - RNA, 19 nt, Homo sapiens
cuucaucacuguccuuauc

SEQ ID NO: 550429 - RNA, 19 nt, Homo sapiens
acaauccaaugcucaccua

SEQ ID NO: 550430 - RNA, 19 nt, Homo sapiens
ucgggucucuccauaauuc

SEQ ID NO: 550431 - RNA, 19 nt, Homo sapiens
ccucauaaccaguucauca

SEQ ID NO: 550432 - RNA, 19 nt, Homo sapiens
cagggaggaaguuucaaua

SEQ ID NO: 550433 - RNA, 19 nt, Homo sapiens
acacaauuguucugcugaa

SEQ ID NO: 550434 - RNA, 19 nt, Homo sapiens
gcgaauguaggaccucuga

SEQ ID NO: 550435 - RNA, 19 nt, Homo sapiens
cgaggaagcccugucuuug

SEQ ID NO: 550436 - RNA, 19 nt, Homo sapiens
ggccauccauucagucgau

SEQ ID NO: 550437 - RNA, 19 nt, Homo sapiens
caauuguucugcugaagag

SEQ ID NO: 550438 - RNA, 19 nt, Homo sapiens
gaguggcuguauaauuguu

SEQ ID NO: 550439 - RNA, 19 nt, Homo sapiens
ucaguucacauagcaauuu

SEQ ID NO: 550440 - RNA, 19 nt, Homo sapiens
gcccaccuaucucaacuuc

SEQ ID NO: 550441 - RNA, 19 nt, Homo sapiens
uagaauacacagaauagug

SEQ ID NO: 550442 - RNA, 19 nt, Homo sapiens
acacuuguuuagacgauug

SEQ ID NO: 550443 - RNA, 19 nt, Homo sapiens
gcuacagauugaucaagug

SEQ ID NO: 550444 - RNA, 19 nt, Homo sapiens
acagguuaguucagucaaa

SEQ ID NO: 550445 - RNA, 19 nt, Homo sapiens
gaaaggagucauuuuagug

SEQ ID NO: 550446 - RNA, 19 nt, Homo sapiens
ucaacuggaugccaacucu

SEQ ID NO: 550447 - RNA, 19 nt, Homo sapiens
ucaauuagccaaccaugag

SEQ ID NO: 550448 - RNA, 19 nt, Homo sapiens
aagcaacuaucgacuugau

SEQ ID NO: 550449 - RNA, 19 nt, Homo sapiens
acauggaagugcccaccua

SEQ ID NO: 550450 - RNA, 19 nt, Homo sapiens
ggaaguuucaauaaagcaa

SEQ ID NO: 550451 - RNA, 19 nt, Homo sapiens
cagccaagcaacugacaaa

SEQ ID NO: 550452 - RNA, 19 nt, Homo sapiens
acuccaagaugcuccagaa

SEQ ID NO: 550453 - RNA, 19 nt, Homo sapiens
ucaaguccaugaaccacau

SEQ ID NO: 550454 - RNA, 19 nt, Homo sapiens
ggucaaacaacagucuauu

SEQ ID NO: 550455 - RNA, 19 nt, Homo sapiens
gaucaguucagccaagcaa

SEQ ID NO: 550456 - RNA, 19 nt, Homo sapiens
ccugcaagcucucccagau

SEQ ID NO: 550457 - RNA, 19 nt, Homo sapiens
cgugcuagcuccuccaagu

SEQ ID NO: 550458 - RNA, 19 nt, Homo sapiens
ucaugagcgucuuguuguu

SEQ ID NO: 550459 - RNA, 19 nt, Homo sapiens
auaguugucaguucacaua

SEQ ID NO: 550460 - RNA, 19 nt, Homo sapiens
gcucugacacuuguuuaga

SEQ ID NO: 550461 - RNA, 19 nt, Homo sapiens
uaauucagcccaacaaugc

SEQ ID NO: 550462 - RNA, 19 nt, Homo sapiens
uggcggugcuacagauuga

SEQ ID NO: 550463 - RNA, 19 nt, Homo sapiens
ccuccaaaccauuuaauuc

SEQ ID NO: 550464 - RNA, 19 nt, Homo sapiens
acuaucgacuugaucaguu

SEQ ID NO: 550465 - RNA, 19 nt, Homo sapiens
ucaccaugcucuucaucau

SEQ ID NO: 550466 - RNA, 19 nt, Homo sapiens
uaaaguuggugaguuuguc

SEQ ID NO: 550467 - RNA, 19 nt, Homo sapiens
uucuaaaguuggugaguuu

SEQ ID NO: 550468 - RNA, 19 nt, Homo sapiens
gacgauuggccauucuaaa

SEQ ID NO: 550469 - RNA, 19 nt, Homo sapiens
ugagucauuuagaauagug

SEQ ID NO: 550470 - RNA, 19 nt, Homo sapiens
gccaagcaacugacaaauc

SEQ ID NO: 550471 - RNA, 19 nt, Homo sapiens
ugacacuuguuuagacgau

SEQ ID NO: 550472 - RNA, 19 nt, Homo sapiens
ugaaaucaggcacaucugu

SEQ ID NO: 550473 - RNA, 19 nt, Homo sapiens
guggcuguauaauuguuaa

SEQ ID NO: 550474 - RNA, 19 nt, Homo sapiens
guuagccuccaaaccauuu

SEQ ID NO: 550475 - RNA, 19 nt, Homo sapiens
gucaaacaacagucuauug

SEQ ID NO: 550476 - RNA, 19 nt, Homo sapiens
gaggaagcccugucuuugc

SEQ ID NO: 550477 - RNA, 19 nt, Homo sapiens
ucaauaaagcaacaacaag

SEQ ID NO: 550478 - RNA, 19 nt, Homo sapiens
auccaaugcucaccuauuc

SEQ ID NO: 550479 - RNA, 19 nt, Homo sapiens
aacagucccuucaaacaca

SEQ ID NO: 550480 - RNA, 19 nt, Homo sapiens
guugucaguucacauagca

SEQ ID NO: 550481 - RNA, 19 nt, Homo sapiens
ucaaacaacagucuauugc

SEQ ID NO: 550482 - RNA, 19 nt, Homo sapiens
aagcaacugacaaaucaaa

SEQ ID NO: 550483 - RNA, 19 nt, Homo sapiens
acagauugaucaagugcau

SEQ ID NO: 550484 - RNA, 19 nt, Homo sapiens
ggacaaagguggaggagaa

SEQ ID NO: 550485 - RNA, 19 nt, Homo sapiens
gaaagacgccuaacucaga

SEQ ID NO: 550486 - RNA, 19 nt, Homo sapiens
ggaggaaccugagaaggaa

SEQ ID NO: 550487 - RNA, 19 nt, Homo sapiens
gaaauagcccugcccaaca

SEQ ID NO: 550488 - RNA, 19 nt, Homo sapiens
gggaugauauggagguuca

SEQ ID NO: 550489 - RNA, 19 nt, Homo sapiens
ccaagacuuugcccugauu

SEQ ID NO: 550490 - RNA, 19 nt, Homo sapiens
aaauagcccugcccaacaa

SEQ ID NO: 550491 - RNA, 19 nt, Homo sapiens
aggaagaccuguacuaugg

SEQ ID NO: 550492 - RNA, 19 nt, Homo sapiens
gggaggaaccugagaagga

SEQ ID NO: 550493 - RNA, 19 nt, Homo sapiens
gggaggaagccgccuauga

SEQ ID NO: 550494 - RNA, 19 nt, Homo sapiens
ggaucuugcucucccuuga

SEQ ID NO: 550495 - RNA, 19 nt, Homo sapiens
aagaugaccuggacaugga

SEQ ID NO: 550496 - RNA, 19 nt, Homo sapiens
ggcaucaucuggagcaugu

SEQ ID NO: 550497 - RNA, 19 nt, Homo sapiens
caucacagggccucaguuu

SEQ ID NO: 550498 - RNA, 19 nt, Homo sapiens
gaggaagaccuguacuaug

SEQ ID NO: 550499 - RNA, 19 nt, Homo sapiens
ugucuucucucccugugua

SEQ ID NO: 550500 - RNA, 19 nt, Homo sapiens
gggcagcagugggaaauag

SEQ ID NO: 550501 - RNA, 19 nt, Homo sapiens
gggaggggaugaugacuaa

SEQ ID NO: 550502 - RNA, 19 nt, Homo sapiens
ggaccgcuuccaagacuuu

SEQ ID NO: 550503 - RNA, 19 nt, Homo sapiens
acccaaggcugagauguuu

SEQ ID NO: 550504 - RNA, 19 nt, Homo sapiens
gaccagagccugccugacu

SEQ ID NO: 550505 - RNA, 19 nt, Homo sapiens
ugauauggagguucaauga

SEQ ID NO: 550506 - RNA, 19 nt, Homo sapiens
gggaaagacgccuaacuca

SEQ ID NO: 550507 - RNA, 19 nt, Homo sapiens
ggaggaagccgccuaugac

SEQ ID NO: 550508 - RNA, 19 nt, Homo sapiens
ccaugggccugcuggagaa

SEQ ID NO: 550509 - RNA, 19 nt, Homo sapiens
auauggagguucaaugaga

SEQ ID NO: 550510 - RNA, 19 nt, Homo sapiens
gacuggagcgggauugaaa

SEQ ID NO: 550511 - RNA, 19 nt, Homo sapiens
ggaagaggaagaccuguac

SEQ ID NO: 550512 - RNA, 19 nt, Homo sapiens
acaaggagcuggguuuuga

SEQ ID NO: 550513 - RNA, 19 nt, Homo sapiens
ggacacagguggggaggaa

SEQ ID NO: 550514 - RNA, 19 nt, Homo sapiens
ccaaugcaucuccacauga

SEQ ID NO: 550515 - RNA, 19 nt, Homo sapiens
ggccucaguuucccuaucu

SEQ ID NO: 550516 - RNA, 19 nt, Homo sapiens
caguuucccuaucugcaaa

SEQ ID NO: 550517 - RNA, 19 nt, Homo sapiens
caaugcaucuccacaugac

SEQ ID NO: 550518 - RNA, 19 nt, Homo sapiens
cccaaugcaucuccacaug

SEQ ID NO: 550519 - RNA, 19 nt, Homo sapiens
gaucuugcucucccuugaa

SEQ ID NO: 550520 - RNA, 19 nt, Homo sapiens
ggucuacggcaccuucuau

SEQ ID NO: 550521 - RNA, 19 nt, Homo sapiens
ggacuggagcgggauugaa

SEQ ID NO: 550522 - RNA, 19 nt, Homo sapiens
caaagguggaggagaagga

SEQ ID NO: 550523 - RNA, 19 nt, Homo sapiens
uggcagcgguacccaagga

SEQ ID NO: 550524 - RNA, 19 nt, Homo sapiens
uggcuuccuuccaagauga

SEQ ID NO: 550525 - RNA, 19 nt, Homo sapiens
cgauuucagugucuucucu

SEQ ID NO: 550526 - RNA, 19 nt, Homo sapiens
aaccagugauggaggagaa

SEQ ID NO: 550527 - RNA, 19 nt, Homo sapiens
aagaggaagaccuguacua

SEQ ID NO: 550528 - RNA, 19 nt, Homo sapiens
uauggagguucaaugagau

SEQ ID NO: 550529 - RNA, 19 nt, Homo sapiens
agaggaagaccuguacuau

SEQ ID NO: 550530 - RNA, 19 nt, Homo sapiens
gcagcgauuucagugucuu

SEQ ID NO: 550531 - RNA, 19 nt, Homo sapiens
ucacagggccucaguuucc

SEQ ID NO: 550532 - RNA, 19 nt, Homo sapiens
ugacagggaggaagcuugu

SEQ ID NO: 550533 - RNA, 19 nt, Homo sapiens
gaaagucaugagcuacagu

SEQ ID NO: 550534 - RNA, 19 nt, Homo sapiens
gacuuugcccugauugaug

SEQ ID NO: 550535 - RNA, 19 nt, Homo sapiens
ccaaggcugagauguuugu

SEQ ID NO: 550536 - RNA, 19 nt, Homo sapiens
gaaggcagcagccccaaug

SEQ ID NO: 550537 - RNA, 19 nt, Homo sapiens
cucgguacguuccucauga

SEQ ID NO: 550538 - RNA, 19 nt, Homo sapiens
caaaaugggaugauaugga

SEQ ID NO: 550539 - RNA, 19 nt, Homo sapiens
gggccucaguuucccuauc

SEQ ID NO: 550540 - RNA, 19 nt, Homo sapiens
cuccagcccuguugaacug

SEQ ID NO: 550541 - RNA, 19 nt, Homo sapiens
caagggcucagacgagagu

SEQ ID NO: 550542 - RNA, 19 nt, Homo sapiens
gagaaugguaaagaaauac

SEQ ID NO: 550543 - RNA, 19 nt, Homo sapiens
gaugauauggagguucaau

SEQ ID NO: 550544 - RNA, 19 nt, Homo sapiens
cacccaaggcugagauguu

SEQ ID NO: 550545 - RNA, 19 nt, Homo sapiens
gaggggaugaugacuaaaa

SEQ ID NO: 550546 - RNA, 19 nt, Homo sapiens
gauauggagguucaaugag

SEQ ID NO: 550547 - RNA, 19 nt, Homo sapiens
ggacaaggagcuggguuuu

SEQ ID NO: 550548 - RNA, 19 nt, Homo sapiens
cggacaaggagcuggguuu

SEQ ID NO: 550549 - RNA, 19 nt, Homo sapiens
cuucgucccugcugacucu

SEQ ID NO: 550550 - RNA, 19 nt, Homo sapiens
ggacagaaaugguaaagaa

SEQ ID NO: 550551 - RNA, 19 nt, Homo sapiens
gaacaaaccucguaacaac

SEQ ID NO: 550552 - RNA, 19 nt, Homo sapiens
ugaaagaggugauguugua

SEQ ID NO: 550553 - RNA, 19 nt, Homo sapiens
gcauuuggcuuuauugaaa

SEQ ID NO: 550554 - RNA, 19 nt, Homo sapiens
gcacucaguugcauucuuu

SEQ ID NO: 550555 - RNA, 19 nt, Homo sapiens
gagaugauguugaauuuga

SEQ ID NO: 550556 - RNA, 19 nt, Homo sapiens
gagauaagguugaauuuag

SEQ ID NO: 550557 - RNA, 19 nt, Homo sapiens
guaaagaaguugcaacaga

SEQ ID NO: 550558 - RNA, 19 nt, Homo sapiens
ccacaaagcacaccauuaa

SEQ ID NO: 550559 - RNA, 19 nt, Homo sapiens
ggaaacccauugcuguuaa

SEQ ID NO: 550560 - RNA, 19 nt, Homo sapiens
ugaaggaacuguaaccaaa

SEQ ID NO: 550561 - RNA, 19 nt, Homo sapiens
agaccgacgugacaaauua

SEQ ID NO: 550562 - RNA, 19 nt, Homo sapiens
ccaaagaagaguacacuua

SEQ ID NO: 550563 - RNA, 19 nt, Homo sapiens
uaaaguugauggccaaauu

SEQ ID NO: 550564 - RNA, 19 nt, Homo sapiens
gcuggaaacuggagauaaa

SEQ ID NO: 550565 - RNA, 19 nt, Homo sapiens
uaaguauggugcagaauuu

SEQ ID NO: 550566 - RNA, 19 nt, Homo sapiens
ggugaaggguucugaauau

SEQ ID NO: 550567 - RNA, 19 nt, Homo sapiens
gaguauagcuuguccaaag

SEQ ID NO: 550568 - RNA, 19 nt, Homo sapiens
gcgcugagcuguuggguau

SEQ ID NO: 550569 - RNA, 19 nt, Homo sapiens
gagaugagcuuugauccaa

SEQ ID NO: 550570 - RNA, 19 nt, Homo sapiens
caacagaugucagacuauu

SEQ ID NO: 550571 - RNA, 19 nt, Homo sapiens
ggagauaagguugaauuua

SEQ ID NO: 550572 - RNA, 19 nt, Homo sapiens
caaagaagaguacacuuaa

SEQ ID NO: 550573 - RNA, 19 nt, Homo sapiens
ggaugggucugauuucuug

SEQ ID NO: 550574 - RNA, 19 nt, Homo sapiens
gaaggaggcauuuggcuuu

SEQ ID NO: 550575 - RNA, 19 nt, Homo sapiens
gguaugaaguguaacagaa

SEQ ID NO: 550576 - RNA, 19 nt, Homo sapiens
guuaaccucuuacggauuu

SEQ ID NO: 550577 - RNA, 19 nt, Homo sapiens
gaaguucugucaaauacau

SEQ ID NO: 550578 - RNA, 19 nt, Homo sapiens
gauaugcucucugcucaaa

SEQ ID NO: 550579 - RNA, 19 nt, Homo sapiens
gaacuucccuuuggagaca

SEQ ID NO: 550580 - RNA, 19 nt, Homo sapiens
gaacgucaagcuagacuuu

SEQ ID NO: 550581 - RNA, 19 nt, Homo sapiens
ccagcagugugauaauuua

SEQ ID NO: 550582 - RNA, 19 nt, Homo sapiens
uggcaacucugaaggauaa

SEQ ID NO: 550583 - RNA, 19 nt, Homo sapiens
uaaagaaguugcaacagau

SEQ ID NO: 550584 - RNA, 19 nt, Homo sapiens
uagcuucuguucaacuuua

SEQ ID NO: 550585 - RNA, 19 nt, Homo sapiens
gcaaaccauuucuuaaagu

SEQ ID NO: 550586 - RNA, 19 nt, Homo sapiens
gaaacagccaaucaugaua

SEQ ID NO: 550587 - RNA, 19 nt, Homo sapiens
ccacaacaauggacauaau

SEQ ID NO: 550588 - RNA, 19 nt, Homo sapiens
gcaaggaacaaaccucgua

SEQ ID NO: 550589 - RNA, 19 nt, Homo sapiens
gacagcagguugcaacuug

SEQ ID NO: 550590 - RNA, 19 nt, Homo sapiens
gaagaguacacuuaaguug

SEQ ID NO: 550591 - RNA, 19 nt, Homo sapiens
ggaggcauuuggcuuuauu

SEQ ID NO: 550592 - RNA, 19 nt, Homo sapiens
gaaacccauugcuguuaaa

SEQ ID NO: 550593 - RNA, 19 nt, Homo sapiens
cauaauggguacccuaaug

SEQ ID NO: 550594 - RNA, 19 nt, Homo sapiens
acacaacacuugaucugaa

SEQ ID NO: 550595 - RNA, 19 nt, Homo sapiens
gaaagaauggaagcgaaua

SEQ ID NO: 550596 - RNA, 19 nt, Homo sapiens
auaaguagccgccugguua

SEQ ID NO: 550597 - RNA, 19 nt, Homo sapiens
gcauuuaacgcaacuggua

SEQ ID NO: 550598 - RNA, 19 nt, Homo sapiens
aagcugaucccaccauuua

SEQ ID NO: 550599 - RNA, 19 nt, Homo sapiens
ggaaccagcuccauauugc

SEQ ID NO: 550600 - RNA, 19 nt, Homo sapiens
gaagauaucagcauugaac

SEQ ID NO: 550601 - RNA, 19 nt, Homo sapiens
gaauggaugggucugauuu

SEQ ID NO: 550602 - RNA, 19 nt, Homo sapiens
ggugaggucuauccauuug

SEQ ID NO: 550603 - RNA, 19 nt, Homo sapiens
gcuggaaggugaccauguu

SEQ ID NO: 550604 - RNA, 19 nt, Homo sapiens
gaaaucaugcuauuaggau

SEQ ID NO: 550605 - RNA, 19 nt, Homo sapiens
uaaugaagcccgagaaaug

SEQ ID NO: 550606 - RNA, 19 nt, Homo sapiens
guaagugcucgcaacauua

SEQ ID NO: 550607 - RNA, 19 nt, Homo sapiens
gaagaaucagcaaauacua

SEQ ID NO: 550608 - RNA, 19 nt, Homo sapiens
caacuaacaagaccaaaga

SEQ ID NO: 550609 - RNA, 19 nt, Homo sapiens
gagguggaguucucaguga

SEQ ID NO: 550610 - RNA, 19 nt, Homo sapiens
caacagggaguguaugcua

SEQ ID NO: 550611 - RNA, 19 nt, Homo sapiens
gaauaucucccucuucauc

SEQ ID NO: 550612 - RNA, 19 nt, Homo sapiens
ggaggagggcgauaugaaa

SEQ ID NO: 550613 - RNA, 19 nt, Homo sapiens
caacaaagucagugcagaa

SEQ ID NO: 550614 - RNA, 19 nt, Homo sapiens
ucaaauaggagauaagguu

SEQ ID NO: 550615 - RNA, 19 nt, Homo sapiens
caaauaaaggcaaagagaa

SEQ ID NO: 550616 - RNA, 19 nt, Homo sapiens
ccucacaacuuagagagua

SEQ ID NO: 550617 - RNA, 19 nt, Homo sapiens
cagaaaugguaaagaaguu

SEQ ID NO: 550618 - RNA, 19 nt, Homo sapiens
uguaagugcucgcaacauu

SEQ ID NO: 550619 - RNA, 19 nt, Homo sapiens
uaaacauacuggugcugua

SEQ ID NO: 550620 - RNA, 19 nt, Homo sapiens
caagaaauccucccugaag

SEQ ID NO: 550621 - RNA, 19 nt, Homo sapiens
gaguaucacugcgagauga

SEQ ID NO: 550622 - RNA, 19 nt, Homo sapiens
guaaguauggugcagaauu

SEQ ID NO: 550623 - RNA, 19 nt, Homo sapiens
ggaagcugaucccaccauu

SEQ ID NO: 550624 - RNA, 19 nt, Homo sapiens
gaaacugacuauugcuuuu

SEQ ID NO: 550625 - RNA, 19 nt, Homo sapiens
agaguacacuuaaguugaa

SEQ ID NO: 550626 - RNA, 19 nt, Homo sapiens
gaauggaagcgaauaaagu

SEQ ID NO: 550627 - RNA, 19 nt, Homo sapiens
gaaagaaagauccgucaag

SEQ ID NO: 550628 - RNA, 19 nt, Homo sapiens
ugaguucucuggugauguu

SEQ ID NO: 550629 - RNA, 19 nt, Homo sapiens
aaacagccaaucaugauaa

SEQ ID NO: 550630 - RNA, 19 nt, Homo sapiens
ggaucuacuucuccucaaa

SEQ ID NO: 550631 - RNA, 19 nt, Homo sapiens
ccaaauaaaggcaaagaga

SEQ ID NO: 550632 - RNA, 19 nt, Homo sapiens
gaccauguuagguuuaaua

SEQ ID NO: 550633 - RNA, 19 nt, Homo sapiens
gauaucagcauugaacauu

SEQ ID NO: 550634 - RNA, 19 nt, Homo sapiens
gggaaacccauugcuguua

SEQ ID NO: 550635 - RNA, 19 nt, Homo sapiens
ggcaaaccauuucuuaaag

SEQ ID NO: 550636 - RNA, 19 nt, Homo sapiens
uaugaaaggugaggucuau

SEQ ID NO: 550637 - RNA, 19 nt, Homo sapiens
caagggcacgguuucauuu

SEQ ID NO: 550638 - RNA, 19 nt, Homo sapiens
gcagaugaaguagaguuua

SEQ ID NO: 550639 - RNA, 19 nt, Homo sapiens
caaacuugcugcugcuuag

SEQ ID NO: 550640 - RNA, 19 nt, Homo sapiens
gaaggguucugaauaucuc

SEQ ID NO: 550641 - RNA, 19 nt, Homo sapiens
gcaagugcagcgccuguaa

SEQ ID NO: 550642 - RNA, 19 nt, Homo sapiens
gcucaaagaaaucaugcua

SEQ ID NO: 550643 - RNA, 19 nt, Homo sapiens
ggaacaaaccucguaacaa

SEQ ID NO: 550644 - RNA, 19 nt, Homo sapiens
cccgaaaucuggaauacuu

SEQ ID NO: 550645 - RNA, 19 nt, Homo sapiens
gaucaguuuggcuucauua

SEQ ID NO: 550646 - RNA, 19 nt, Homo sapiens
caacucugaaggauaauuu

SEQ ID NO: 550647 - RNA, 19 nt, Homo sapiens
cacaaacuauggcuuacaa

SEQ ID NO: 550648 - RNA, 19 nt, Homo sapiens
gcucucugcucaaagaaau

SEQ ID NO: 550649 - RNA, 19 nt, Homo sapiens
gcugagcuguuggguauga

SEQ ID NO: 550650 - RNA, 19 nt, Homo sapiens
gcacaaaguaugccaauua

SEQ ID NO: 550651 - RNA, 19 nt, Homo sapiens
ucacagaccuuuaagagua

SEQ ID NO: 550652 - RNA, 19 nt, Homo sapiens
gaugacagguuucuacuaa

SEQ ID NO: 550653 - RNA, 19 nt, Homo sapiens
guaaaugggucaagaagaa

SEQ ID NO: 550654 - RNA, 19 nt, Homo sapiens
gaugaugcaugccacauua

SEQ ID NO: 550655 - RNA, 19 nt, Homo sapiens
uagcagagcugaaucauga

SEQ ID NO: 550656 - RNA, 19 nt, Homo sapiens
gagauugaaugcaagaaua

SEQ ID NO: 550657 - RNA, 19 nt, Homo sapiens
caacaccugugaaagaaua

SEQ ID NO: 550658 - RNA, 19 nt, Homo sapiens
aaacugcucuugugcaaua

SEQ ID NO: 550659 - RNA, 19 nt, Homo sapiens
ccagguagccuaaauauuu

SEQ ID NO: 550660 - RNA, 19 nt, Homo sapiens
ggaaacagguggcgacaga

SEQ ID NO: 550661 - RNA, 19 nt, Homo sapiens
caagaaaucugaaugaucu

SEQ ID NO: 550662 - RNA, 19 nt, Homo sapiens
ggacuaggcuuuccagcaa

SEQ ID NO: 550663 - RNA, 19 nt, Homo sapiens
ggaaagaacuccagaaucc

SEQ ID NO: 550664 - RNA, 19 nt, Homo sapiens
guaaguauguuguucaaga

SEQ ID NO: 550665 - RNA, 19 nt, Homo sapiens
ugaagucucuuauuccaua

SEQ ID NO: 550666 - RNA, 19 nt, Homo sapiens
gaguaaagguuauaguuug

SEQ ID NO: 550667 - RNA, 19 nt, Homo sapiens
aaacaagguucuaacagua

SEQ ID NO: 550668 - RNA, 19 nt, Homo sapiens
aaugaaggcuuacucuuua

SEQ ID NO: 550669 - RNA, 19 nt, Homo sapiens
aagaggagaugauagaaua

SEQ ID NO: 550670 - RNA, 19 nt, Homo sapiens
gaaaguuacugcugcucua

SEQ ID NO: 550671 - RNA, 19 nt, Homo sapiens
gauaaagucuuggauauag

SEQ ID NO: 550672 - RNA, 19 nt, Homo sapiens
gcaacaaggauauuugaua

SEQ ID NO: 550673 - RNA, 19 nt, Homo sapiens
gaacuuacccugaacacaa

SEQ ID NO: 550674 - RNA, 19 nt, Homo sapiens
caccacaacuggcuaauuu

SEQ ID NO: 550675 - RNA, 19 nt, Homo sapiens
ggaaagacgacauggauuu

SEQ ID NO: 550676 - RNA, 19 nt, Homo sapiens
uaaaagagaugcaggauaa

SEQ ID NO: 550677 - RNA, 19 nt, Homo sapiens
gaagagcaaguugaaauua

SEQ ID NO: 550678 - RNA, 19 nt, Homo sapiens
ggaauuagguguuaaaaga

SEQ ID NO: 550679 - RNA, 19 nt, Homo sapiens
gagguuauagcacauauua

SEQ ID NO: 550680 - RNA, 19 nt, Homo sapiens
ggaaagacccacccaagaa

SEQ ID NO: 550681 - RNA, 19 nt, Homo sapiens
ccaagaaacauagcaauua

SEQ ID NO: 550682 - RNA, 19 nt, Homo sapiens
gaagcaaaguuauaaugug

SEQ ID NO: 550683 - RNA, 19 nt, Homo sapiens
gaaaagaagucaaagaugu

SEQ ID NO: 550684 - RNA, 19 nt, Homo sapiens
gcuaaauucuggugguuaa

SEQ ID NO: 550685 - RNA, 19 nt, Homo sapiens
ggacuucuguaaauaauag

SEQ ID NO: 550686 - RNA, 19 nt, Homo sapiens
acagauagauagaugagua

SEQ ID NO: 550687 - RNA, 19 nt, Homo sapiens
agacagagauucaguuugu

SEQ ID NO: 550688 - RNA, 19 nt, Homo sapiens
ccagguggcugucuacaaa

SEQ ID NO: 550689 - RNA, 19 nt, Homo sapiens
gaucaacaccugugaaaga

SEQ ID NO: 550690 - RNA, 19 nt, Homo sapiens
gggaagaauuguuaaugaa

SEQ ID NO: 550691 - RNA, 19 nt, Homo sapiens
gauuaggaauuagguguua

SEQ ID NO: 550692 - RNA, 19 nt, Homo sapiens
cagccuaccuugucuguuu

SEQ ID NO: 550693 - RNA, 19 nt, Homo sapiens
gaaagaacuuagacagcaa

SEQ ID NO: 550694 - RNA, 19 nt, Homo sapiens
gaaagaagaaggaaagcuu

SEQ ID NO: 550695 - RNA, 19 nt, Homo sapiens
gaacuacgacaacacauug

SEQ ID NO: 550696 - RNA, 19 nt, Homo sapiens
uagagaagcugaaacacaa

SEQ ID NO: 550697 - RNA, 19 nt, Homo sapiens
gaaagacccacccaagaaa

SEQ ID NO: 550698 - RNA, 19 nt, Homo sapiens
gaaauagaguagaagagau

SEQ ID NO: 550699 - RNA, 19 nt, Homo sapiens
uagguuaacuacagacaua

SEQ ID NO: 550700 - RNA, 19 nt, Homo sapiens
uaagggaucaguuaucaua

SEQ ID NO: 550701 - RNA, 19 nt, Homo sapiens
gaauugggccuuuguaugu

SEQ ID NO: 550702 - RNA, 19 nt, Homo sapiens
gaccuagacuauggauuua

SEQ ID NO: 550703 - RNA, 19 nt, Homo sapiens
gacagcaagucaaggauuu

SEQ ID NO: 550704 - RNA, 19 nt, Homo sapiens
gaaauugcacacuccuaua

SEQ ID NO: 550705 - RNA, 19 nt, Homo sapiens
ggagugcuguggugugauu

SEQ ID NO: 550706 - RNA, 19 nt, Homo sapiens
acacagaaccagaucaaua

SEQ ID NO: 550707 - RNA, 19 nt, Homo sapiens
cacaaaguaugccaauuaa

SEQ ID NO: 550708 - RNA, 19 nt, Homo sapiens
ggaagaacagaauauauug

SEQ ID NO: 550709 - RNA, 19 nt, Homo sapiens
ccagaaagcuaucaauguc

SEQ ID NO: 550710 - RNA, 19 nt, Homo sapiens
ggaguuaagccuucaggua

SEQ ID NO: 550711 - RNA, 19 nt, Homo sapiens
agaaccagaucaauaguaa

SEQ ID NO: 550712 - RNA, 19 nt, Homo sapiens
gauagugccuuugauugaa

SEQ ID NO: 550713 - RNA, 19 nt, Homo sapiens
gaagggacauugcuagaac

SEQ ID NO: 550714 - RNA, 19 nt, Homo sapiens
ccaagaagcaaaguuauaa

SEQ ID NO: 550715 - RNA, 19 nt, Homo sapiens
cuuguuaacucuccagaua

SEQ ID NO: 550716 - RNA, 19 nt, Homo sapiens
ggauacaagugaugugaau

SEQ ID NO: 550717 - RNA, 19 nt, Homo sapiens
caaaaugacugcugccuuu

SEQ ID NO: 550718 - RNA, 19 nt, Homo sapiens
gccugucacugauaaguua

SEQ ID NO: 550719 - RNA, 19 nt, Homo sapiens
gguauaugguuaaugugua

SEQ ID NO: 550720 - RNA, 19 nt, Homo sapiens
gggaucaguuaucauauga

SEQ ID NO: 550721 - RNA, 19 nt, Homo sapiens
ugaaugaguuacaggauga

SEQ ID NO: 550722 - RNA, 19 nt, Homo sapiens
ggauaaagucuuggauaua

SEQ ID NO: 550723 - RNA, 19 nt, Homo sapiens
caacgaagauuuugugcua

SEQ ID NO: 550724 - RNA, 19 nt, Homo sapiens
ggacauugcuagaacuuac

SEQ ID NO: 550725 - RNA, 19 nt, Homo sapiens
cguugaaacucuuguaauu

SEQ ID NO: 550726 - RNA, 19 nt, Homo sapiens
gaguaugcuuuauugagua

SEQ ID NO: 550727 - RNA, 19 nt, Homo sapiens
gcuauuugcuugccugaga

SEQ ID NO: 550728 - RNA, 19 nt, Homo sapiens
ccagagcucuuuguacauu

SEQ ID NO: 550729 - RNA, 19 nt, Homo sapiens
gacaggagguuuuauuuaa

SEQ ID NO: 550730 - RNA, 19 nt, Homo sapiens
ggaaauugcauugaguuaa

SEQ ID NO: 550731 - RNA, 19 nt, Homo sapiens
guucggaguucuauacuau

SEQ ID NO: 550732 - RNA, 19 nt, Homo sapiens
caccacgccuggcuaauuu

SEQ ID NO: 550733 - RNA, 19 nt, Homo sapiens
guagacugguauaugguua

SEQ ID NO: 550734 - RNA, 19 nt, Homo sapiens
uaacaagucugauucuaac

SEQ ID NO: 550735 - RNA, 19 nt, Homo sapiens
ugaaacacaagcagaaaua

SEQ ID NO: 550736 - RNA, 19 nt, Homo sapiens
ggaagagcaaguugaaauu

SEQ ID NO: 550737 - RNA, 19 nt, Homo sapiens
gcagaugccagaagaagaa

SEQ ID NO: 550738 - RNA, 19 nt, Homo sapiens
uaaugaaggcuuacucuuu

SEQ ID NO: 550739 - RNA, 19 nt, Homo sapiens
gaagaagagagucguauuc

SEQ ID NO: 550740 - RNA, 19 nt, Homo sapiens
aagcagagauugaaugcaa

SEQ ID NO: 550741 - RNA, 19 nt, Homo sapiens
aaacaaaggaugauggaaa

SEQ ID NO: 550742 - RNA, 19 nt, Homo sapiens
ccacuuagcucguacuacu

SEQ ID NO: 550743 - RNA, 19 nt, Homo sapiens
auaguuggauuguugcuua

SEQ ID NO: 550744 - RNA, 19 nt, Homo sapiens
ucccaucacuguucuuuaa

SEQ ID NO: 550745 - RNA, 19 nt, Homo sapiens
gaagaacucauugcuguga

SEQ ID NO: 550746 - RNA, 19 nt, Homo sapiens
gauauuaugccuugguuug

SEQ ID NO: 550747 - RNA, 19 nt, Homo sapiens
ucaaauacaccuuagaaga

SEQ ID NO: 550748 - RNA, 19 nt, Homo sapiens
agaugaguaucaacacuua

SEQ ID NO: 550749 - RNA, 19 nt, Homo sapiens
gcaaugggcuaagguccaa

SEQ ID NO: 550750 - RNA, 19 nt, Homo sapiens
caaccuggcugaagaauuu

SEQ ID NO: 550751 - RNA, 19 nt, Homo sapiens
uaacaaggcuuaucucuag

SEQ ID NO: 550752 - RNA, 19 nt, Homo sapiens
gauauucccuuguuccuaa

SEQ ID NO: 550753 - RNA, 19 nt, Homo sapiens
ugagaaagcuccuacagaa

SEQ ID NO: 550754 - RNA, 19 nt, Homo sapiens
gagcugcuguuccuaagua

SEQ ID NO: 550755 - RNA, 19 nt, Homo sapiens
acaauuggcuucaacauga

SEQ ID NO: 550756 - RNA, 19 nt, Homo sapiens
gcgcuuugaucaaccuuua

SEQ ID NO: 550757 - RNA, 19 nt, Homo sapiens
gaaaccagcccuagaacuu

SEQ ID NO: 550758 - RNA, 19 nt, Homo sapiens
gaaagcuccuacagaagaa

SEQ ID NO: 550759 - RNA, 19 nt, Homo sapiens
agaaguaugucuggaauaa

SEQ ID NO: 550760 - RNA, 19 nt, Homo sapiens
cuaagucuuugccauguua

SEQ ID NO: 550761 - RNA, 19 nt, Homo sapiens
caaaugagcgcuuccugaa

SEQ ID NO: 550762 - RNA, 19 nt, Homo sapiens
gggaagaaccacucugaaa

SEQ ID NO: 550763 - RNA, 19 nt, Homo sapiens
aaacaggacuggcugauac

SEQ ID NO: 550764 - RNA, 19 nt, Homo sapiens
gaagcuugccugaugguaa

SEQ ID NO: 550765 - RNA, 19 nt, Homo sapiens
ggaaaggaaggauuugaug

SEQ ID NO: 550766 - RNA, 19 nt, Homo sapiens
gcuauacgauaucuucugu

SEQ ID NO: 550767 - RNA, 19 nt, Homo sapiens
cagugaagcuugccugaug

SEQ ID NO: 550768 - RNA, 19 nt, Homo sapiens
ggaagacaguggacaucug

SEQ ID NO: 550769 - RNA, 19 nt, Homo sapiens
ggaugaugcugaaaggaau

SEQ ID NO: 550770 - RNA, 19 nt, Homo sapiens
uacgauaucuucuguaugg

SEQ ID NO: 550771 - RNA, 19 nt, Homo sapiens
gugcaaggaugaugcugaa

SEQ ID NO: 550772 - RNA, 19 nt, Homo sapiens
gagcuaaagaggcaaaguu

SEQ ID NO: 550773 - RNA, 19 nt, Homo sapiens
gagagaaagcacugagaaa

SEQ ID NO: 550774 - RNA, 19 nt, Homo sapiens
ggagagaagggaacaggaa

SEQ ID NO: 550775 - RNA, 19 nt, Homo sapiens
aaaggaauaacaaggcuua

SEQ ID NO: 550776 - RNA, 19 nt, Homo sapiens
ucucuaggauccauaaguu

SEQ ID NO: 550777 - RNA, 19 nt, Homo sapiens
aaacagcgcuuugaucaac

SEQ ID NO: 550778 - RNA, 19 nt, Homo sapiens
aaguaugucuggaauaaga

SEQ ID NO: 550779 - RNA, 19 nt, Homo sapiens
gauacuacauauuccagau

SEQ ID NO: 550780 - RNA, 19 nt, Homo sapiens
ggauuuggagacuguauuu

SEQ ID NO: 550781 - RNA, 19 nt, Homo sapiens
ggucagcacuacaacaucu

SEQ ID NO: 550782 - RNA, 19 nt, Homo sapiens
gaacgccacagaugcaguu

SEQ ID NO: 550783 - RNA, 19 nt, Homo sapiens
ugaugcaggugaagacauu

SEQ ID NO: 550784 - RNA, 19 nt, Homo sapiens
gauaaaaguucaagagaag

SEQ ID NO: 550785 - RNA, 19 nt, Homo sapiens
agaaagcuccuacagaaga

SEQ ID NO: 550786 - RNA, 19 nt, Homo sapiens
gcacgagggucagcacuac

SEQ ID NO: 550787 - RNA, 19 nt, Homo sapiens
ccaguaagaugaggaaguc

SEQ ID NO: 550788 - RNA, 19 nt, Homo sapiens
gccaggcccuuguaccuau

SEQ ID NO: 550789 - RNA, 19 nt, Homo sapiens
ggaauuagcacuuguucac

SEQ ID NO: 550790 - RNA, 19 nt, Homo sapiens
ggccguggauggaaucaau

SEQ ID NO: 550791 - RNA, 19 nt, Homo sapiens
guucacaacuugaggaaaa

SEQ ID NO: 550792 - RNA, 19 nt, Homo sapiens
ggaagaaccacucugaaaa

SEQ ID NO: 550793 - RNA, 19 nt, Homo sapiens
gagaaguaugucuggaaua

SEQ ID NO: 550794 - RNA, 19 nt, Homo sapiens
gagagaagggaacaggaaa

SEQ ID NO: 550795 - RNA, 19 nt, Homo sapiens
guggacaucugcuuuaugc

SEQ ID NO: 550796 - RNA, 19 nt, Homo sapiens
aaagagcugcuguuccuaa

SEQ ID NO: 550797 - RNA, 19 nt, Homo sapiens
gcauaacacgggugaggaa

SEQ ID NO: 550798 - RNA, 19 nt, Homo sapiens
gcaaggaugaugcugaaag

SEQ ID NO: 550799 - RNA, 19 nt, Homo sapiens
caaggaugaugcugaaagg

SEQ ID NO: 550800 - RNA, 19 nt, Homo sapiens
gugaaugcgugacaauaag

SEQ ID NO: 550801 - RNA, 19 nt, Homo sapiens
cauccugguuuccaacuau

SEQ ID NO: 550802 - RNA, 19 nt, Homo sapiens
gcugggaaaggaaggauuu

SEQ ID NO: 550803 - RNA, 19 nt, Homo sapiens
gaagauaaaagcccgauug

SEQ ID NO: 550804 - RNA, 19 nt, Homo sapiens
gcaguccagcuacaacaaa

SEQ ID NO: 550805 - RNA, 19 nt, Homo sapiens
caacuauaacccaaaggaa

SEQ ID NO: 550806 - RNA, 19 nt, Homo sapiens
gaaaagagaagauaaaagc

SEQ ID NO: 550807 - RNA, 19 nt, Homo sapiens
gagaaagcacugagaaagg

SEQ ID NO: 550808 - RNA, 19 nt, Homo sapiens
agagaaguaugucuggaau

SEQ ID NO: 550809 - RNA, 19 nt, Homo sapiens
ugugaaugcgugacaauaa

SEQ ID NO: 550810 - RNA, 19 nt, Homo sapiens
acaguggacaucugcuuua

SEQ ID NO: 550811 - RNA, 19 nt, Homo sapiens
gacaguggacaucugcuuu

SEQ ID NO: 550812 - RNA, 19 nt, Homo sapiens
gagaguccgagagcuauuu

SEQ ID NO: 550813 - RNA, 19 nt, Homo sapiens
gaugaugcugaaaggaaua

SEQ ID NO: 550814 - RNA, 19 nt, Homo sapiens
gaaaacaauuggcuucaac

SEQ ID NO: 550815 - RNA, 19 nt, Homo sapiens
guuauucauuucugugcaa

SEQ ID NO: 550816 - RNA, 19 nt, Homo sapiens
gaggagccaggcccuugua

SEQ ID NO: 550817 - RNA, 19 nt, Homo sapiens
ccacagaugcaguuggaau

SEQ ID NO: 550818 - RNA, 19 nt, Homo sapiens
uaaggaaaccagcccuaga

SEQ ID NO: 550819 - RNA, 19 nt, Homo sapiens
guugagaguccgagagcua

SEQ ID NO: 550820 - RNA, 19 nt, Homo sapiens
ggaaaacaauuggcuucaa

SEQ ID NO: 550821 - RNA, 19 nt, Homo sapiens
gggaaaggaaggauuugau

SEQ ID NO: 550822 - RNA, 19 nt, Homo sapiens
ggaguccucugggagaagu

SEQ ID NO: 550823 - RNA, 19 nt, Homo sapiens
uggcugauacuacauauuc

SEQ ID NO: 550824 - RNA, 19 nt, Homo sapiens
gacugggucucucuuuaag

SEQ ID NO: 550825 - RNA, 19 nt, Homo sapiens
gccauugugucggcuuuga

SEQ ID NO: 550826 - RNA, 19 nt, Homo sapiens
cgccacagaugcaguugga

SEQ ID NO: 550827 - RNA, 19 nt, Homo sapiens
ugggagaagugguugaaca

SEQ ID NO: 550828 - RNA, 19 nt, Homo sapiens
aaggaaaccagcccuagaa

SEQ ID NO: 550829 - RNA, 19 nt, Homo sapiens
acuauaacccaaaggaauu

SEQ ID NO: 550830 - RNA, 19 nt, Homo sapiens
ccaacuauaacccaaagga

SEQ ID NO: 550831 - RNA, 19 nt, Homo sapiens
gcgccauugugucggcuuu

SEQ ID NO: 550832 - RNA, 19 nt, Homo sapiens
ccagcuauacgauaucuuc

SEQ ID NO: 550833 - RNA, 19 nt, Homo sapiens
gagaaagcuccuacagaag

SEQ ID NO: 550834 - RNA, 19 nt, Homo sapiens
cagaugcaguuggaauugu

SEQ ID NO: 550835 - RNA, 19 nt, Homo sapiens
gaggaacgccacagaugca

SEQ ID NO: 550836 - RNA, 19 nt, Homo sapiens
gugaggaacgccacagaug

SEQ ID NO: 550837 - RNA, 19 nt, Homo sapiens
agagagaaagcacugagaa

SEQ ID NO: 550838 - RNA, 19 nt, Homo sapiens
gcuauuucccgcaccaaug

SEQ ID NO: 550839 - RNA, 19 nt, Homo sapiens
caguggacaucugcuuuau

SEQ ID NO: 550840 - RNA, 19 nt, Homo sapiens
gaagaaccacucugaaaag

SEQ ID NO: 550841 - RNA, 19 nt, Homo sapiens
ggaaaccagcccuagaacu

SEQ ID NO: 550842 - RNA, 19 nt, Homo sapiens
caacaugagaaagcuccua

SEQ ID NO: 550843 - RNA, 19 nt, Homo sapiens
caaggcuuaucucuaggau

SEQ ID NO: 550844 - RNA, 19 nt, Homo sapiens
ccuaagucuuugccauguu

SEQ ID NO: 550845 - RNA, 19 nt, Homo sapiens
aagcuugccugaugguaag

SEQ ID NO: 550846 - RNA, 19 nt, Homo sapiens
aauuauggcucuuuuccua

SEQ ID NO: 550847 - RNA, 19 nt, Homo sapiens
gcuuugugaugcaggugaa

SEQ ID NO: 550848 - RNA, 19 nt, Homo sapiens
gaauuagcacuuguucaca

SEQ ID NO: 550849 - RNA, 19 nt, Homo sapiens
gaaugcgugacaauaagau

SEQ ID NO: 550850 - RNA, 19 nt, Homo sapiens
caaccuggcugaagaauuu

SEQ ID NO: 550851 - RNA, 19 nt, Homo sapiens
uaacaaggcuuaucucuag

SEQ ID NO: 550852 - RNA, 19 nt, Homo sapiens
gauauucccuuguuccuaa

SEQ ID NO: 550853 - RNA, 19 nt, Homo sapiens
ugagaaagcuccuacagaa

SEQ ID NO: 550854 - RNA, 19 nt, Homo sapiens
gagcugcuguuccuaagua

SEQ ID NO: 550855 - RNA, 19 nt, Homo sapiens
acaauuggcuucaacauga

SEQ ID NO: 550856 - RNA, 19 nt, Homo sapiens
gcgcuuugaucaaccuuua

SEQ ID NO: 550857 - RNA, 19 nt, Homo sapiens
gaaaccagcccuagaacuu

SEQ ID NO: 550858 - RNA, 19 nt, Homo sapiens
gaaagcuccuacagaagaa

SEQ ID NO: 550859 - RNA, 19 nt, Homo sapiens
agaaguaugucuggaauaa

SEQ ID NO: 550860 - RNA, 19 nt, Homo sapiens
cuaagucuuugccauguua

SEQ ID NO: 550861 - RNA, 19 nt, Homo sapiens
caaaugagcgcuuccugaa

SEQ ID NO: 550862 - RNA, 19 nt, Homo sapiens
gggaagaaccacucugaaa

SEQ ID NO: 550863 - RNA, 19 nt, Homo sapiens
aaacaggacuggcugauac

SEQ ID NO: 550864 - RNA, 19 nt, Homo sapiens
gaagcuugccugaugguaa

SEQ ID NO: 550865 - RNA, 19 nt, Homo sapiens
ggaaaggaaggauuugaug

SEQ ID NO: 550866 - RNA, 19 nt, Homo sapiens
gcuauacgauaucuucugu

SEQ ID NO: 550867 - RNA, 19 nt, Homo sapiens
cagugaagcuugccugaug

SEQ ID NO: 550868 - RNA, 19 nt, Homo sapiens
ggaagacaguggacaucug

SEQ ID NO: 550869 - RNA, 19 nt, Homo sapiens
ggaugaugcugaaaggaau

SEQ ID NO: 550870 - RNA, 19 nt, Homo sapiens
uacgauaucuucuguaugg

SEQ ID NO: 550871 - RNA, 19 nt, Homo sapiens
gugcaaggaugaugcugaa

SEQ ID NO: 550872 - RNA, 19 nt, Homo sapiens
gagcuaaagaggcaaaguu

SEQ ID NO: 550873 - RNA, 19 nt, Homo sapiens
gagagaaagcacugagaaa

SEQ ID NO: 550874 - RNA, 19 nt, Homo sapiens
ggagagaagggaacaggaa

SEQ ID NO: 550875 - RNA, 19 nt, Homo sapiens
ucucuaggauccauaaguu

SEQ ID NO: 550876 - RNA, 19 nt, Homo sapiens
aaaggaauaacaaggcuua

SEQ ID NO: 550877 - RNA, 19 nt, Homo sapiens
aaacagcgcuuugaucaac

SEQ ID NO: 550878 - RNA, 19 nt, Homo sapiens
aaguaugucuggaauaaga

SEQ ID NO: 550879 - RNA, 19 nt, Homo sapiens
gauacuacauauuccagau

SEQ ID NO: 550880 - RNA, 19 nt, Homo sapiens
ggauuuggagacuguauuu

SEQ ID NO: 550881 - RNA, 19 nt, Homo sapiens
ggucagcacuacaacaucu

SEQ ID NO: 550882 - RNA, 19 nt, Homo sapiens
gaacgccacagaugcaguu

SEQ ID NO: 550883 - RNA, 19 nt, Homo sapiens
ugaugcaggugaagacauu

SEQ ID NO: 550884 - RNA, 19 nt, Homo sapiens
gauaaaaguucaagagaag

SEQ ID NO: 550885 - RNA, 19 nt, Homo sapiens
agaaagcuccuacagaaga

SEQ ID NO: 550886 - RNA, 19 nt, Homo sapiens
gcacgagggucagcacuac

SEQ ID NO: 550887 - RNA, 19 nt, Homo sapiens
ccaguaagaugaggaaguc

SEQ ID NO: 550888 - RNA, 19 nt, Homo sapiens
gccaggcccuuguaccuau

SEQ ID NO: 550889 - RNA, 19 nt, Homo sapiens
ggaauuagcacuuguucac

SEQ ID NO: 550890 - RNA, 19 nt, Homo sapiens
ggccguggauggaaucaau

SEQ ID NO: 550891 - RNA, 19 nt, Homo sapiens
guucacaacuugaggaaaa

SEQ ID NO: 550892 - RNA, 19 nt, Homo sapiens
ggaagaaccacucugaaaa

SEQ ID NO: 550893 - RNA, 19 nt, Homo sapiens
gagaaguaugucuggaaua

SEQ ID NO: 550894 - RNA, 19 nt, Homo sapiens
gagagaagggaacaggaaa

SEQ ID NO: 550895 - RNA, 19 nt, Homo sapiens
guggacaucugcuuuaugc

SEQ ID NO: 550896 - RNA, 19 nt, Homo sapiens
aaagagcugcuguuccuaa

SEQ ID NO: 550897 - RNA, 19 nt, Homo sapiens
gcauaacacgggugaggaa

SEQ ID NO: 550898 - RNA, 19 nt, Homo sapiens
gcaaggaugaugcugaaag

SEQ ID NO: 550899 - RNA, 19 nt, Homo sapiens
caaggaugaugcugaaagg

SEQ ID NO: 550900 - RNA, 19 nt, Homo sapiens
gugaaugcgugacaauaag

SEQ ID NO: 550901 - RNA, 19 nt, Homo sapiens
gaccgacacggguauugua

SEQ ID NO: 550902 - RNA, 19 nt, Homo sapiens
cauccugguuuccaacuau

SEQ ID NO: 550903 - RNA, 19 nt, Homo sapiens
gcugggaaaggaaggauuu

SEQ ID NO: 550904 - RNA, 19 nt, Homo sapiens
gaagauaaaagcccgauug

SEQ ID NO: 550905 - RNA, 19 nt, Homo sapiens
gcaguccagcuacaacaaa

SEQ ID NO: 550906 - RNA, 19 nt, Homo sapiens
caacuauaacccaaaggaa

SEQ ID NO: 550907 - RNA, 19 nt, Homo sapiens
gaaaagagaagauaaaagc

SEQ ID NO: 550908 - RNA, 19 nt, Homo sapiens
gagaaagcacugagaaagg

SEQ ID NO: 550909 - RNA, 19 nt, Homo sapiens
agagaaguaugucuggaau

SEQ ID NO: 550910 - RNA, 19 nt, Homo sapiens
ugugaaugcgugacaauaa

SEQ ID NO: 550911 - RNA, 19 nt, Homo sapiens
acaguggacaucugcuuua

SEQ ID NO: 550912 - RNA, 19 nt, Homo sapiens
gacaguggacaucugcuuu

SEQ ID NO: 550913 - RNA, 19 nt, Homo sapiens
gagaguccgagagcuauuu

SEQ ID NO: 550914 - RNA, 19 nt, Homo sapiens
gaugaugcugaaaggaaua

SEQ ID NO: 550915 - RNA, 19 nt, Homo sapiens
gaaaacaauuggcuucaac

SEQ ID NO: 550916 - RNA, 19 nt, Homo sapiens
guuauucauuucugugcaa

SEQ ID NO: 550917 - RNA, 19 nt, Homo sapiens
gaggagccaggcccuugua

SEQ ID NO: 550918 - RNA, 19 nt, Homo sapiens
ccacagaugcaguuggaau

SEQ ID NO: 550919 - RNA, 19 nt, Homo sapiens
uaaggaaaccagcccuaga

SEQ ID NO: 550920 - RNA, 19 nt, Homo sapiens
ggaaaacaauuggcuucaa

SEQ ID NO: 550921 - RNA, 19 nt, Homo sapiens
gggaaaggaaggauuugau

SEQ ID NO: 550922 - RNA, 19 nt, Homo sapiens
guugagaguccgagagcua

SEQ ID NO: 550923 - RNA, 19 nt, Homo sapiens
ggaguccucugggagaagu

SEQ ID NO: 550924 - RNA, 19 nt, Homo sapiens
uggcugauacuacauauuc

SEQ ID NO: 550925 - RNA, 19 nt, Homo sapiens
gacugggucucucuuuaag

SEQ ID NO: 550926 - RNA, 19 nt, Homo sapiens
gccauugugucggcuuuga

SEQ ID NO: 550927 - RNA, 19 nt, Homo sapiens
cgccacagaugcaguugga

SEQ ID NO: 550928 - RNA, 19 nt, Homo sapiens
ugggagaagugguugaaca

SEQ ID NO: 550929 - RNA, 19 nt, Homo sapiens
aaggaaaccagcccuagaa

SEQ ID NO: 550930 - RNA, 19 nt, Homo sapiens
acuauaacccaaaggaauu

SEQ ID NO: 550931 - RNA, 19 nt, Homo sapiens
ccaacuauaacccaaagga

SEQ ID NO: 550932 - RNA, 19 nt, Homo sapiens
gcgccauugugucggcuuu

SEQ ID NO: 550933 - RNA, 19 nt, Homo sapiens
ccagcuauacgauaucuuc

SEQ ID NO: 550934 - RNA, 19 nt, Homo sapiens
gagaaagcuccuacagaag

SEQ ID NO: 550935 - RNA, 19 nt, Homo sapiens
cagaugcaguuggaauugu

SEQ ID NO: 550936 - RNA, 19 nt, Homo sapiens
gaggaacgccacagaugca

SEQ ID NO: 550937 - RNA, 19 nt, Homo sapiens
gcuauuucccgcaccaaug

SEQ ID NO: 550938 - RNA, 19 nt, Homo sapiens
gugaggaacgccacagaug

SEQ ID NO: 550939 - RNA, 19 nt, Homo sapiens
agagagaaagcacugagaa

SEQ ID NO: 550940 - RNA, 19 nt, Homo sapiens
caguggacaucugcuuuau

SEQ ID NO: 550941 - RNA, 19 nt, Homo sapiens
gaagaaccacucugaaaag

SEQ ID NO: 550942 - RNA, 19 nt, Homo sapiens
ggaccgacacggguauugu

SEQ ID NO: 550943 - RNA, 19 nt, Homo sapiens
ggaaaccagcccuagaacu

SEQ ID NO: 550944 - RNA, 19 nt, Homo sapiens
caaggcuuaucucuaggau

SEQ ID NO: 550945 - RNA, 19 nt, Homo sapiens
caacaugagaaagcuccua

SEQ ID NO: 550946 - RNA, 19 nt, Homo sapiens
ccuaagucuuugccauguu

SEQ ID NO: 550947 - RNA, 19 nt, Homo sapiens
aagcuugccugaugguaag

SEQ ID NO: 550948 - RNA, 19 nt, Homo sapiens
aauuauggcucuuuuccua

SEQ ID NO: 550949 - RNA, 19 nt, Homo sapiens
gcuuugugaugcaggugaa

SEQ ID NO: 550950 - RNA, 19 nt, Homo sapiens
gaaagacucucccauguua

SEQ ID NO: 550951 - RNA, 19 nt, Homo sapiens
gaaaugauguaaugacaga

SEQ ID NO: 550952 - RNA, 19 nt, Homo sapiens
ggagucggauauacaauuu

SEQ ID NO: 550953 - RNA, 19 nt, Homo sapiens
ggagauagaugccauuugc

SEQ ID NO: 550954 - RNA, 19 nt, Homo sapiens
aaagagagauguacuugga

SEQ ID NO: 550955 - RNA, 19 nt, Homo sapiens
ggaaacagcuuuggucaac

SEQ ID NO: 550956 - RNA, 19 nt, Homo sapiens
gaaggcagacaacauguuu

SEQ ID NO: 550957 - RNA, 19 nt, Homo sapiens
gcagucuucucuccaauga

SEQ ID NO: 550958 - RNA, 19 nt, Homo sapiens
ggaagagcaucgcccaaga

SEQ ID NO: 550959 - RNA, 19 nt, Homo sapiens
gcguaaagguuguacaaga

SEQ ID NO: 550960 - RNA, 19 nt, Homo sapiens
gaaucaaaguggagagaau

SEQ ID NO: 550961 - RNA, 19 nt, Homo sapiens
acaagaguaugaaagagua

SEQ ID NO: 550962 - RNA, 19 nt, Homo sapiens
ucacugaaauucuucuaga

SEQ ID NO: 550963 - RNA, 19 nt, Homo sapiens
gcaaagacaagccaaagug

SEQ ID NO: 550964 - RNA, 19 nt, Homo sapiens
acagugaaaugauguaaug

SEQ ID NO: 550965 - RNA, 19 nt, Homo sapiens
gaccaaagacauguuuaua

SEQ ID NO: 550966 - RNA, 19 nt, Homo sapiens
agucuucucuccaaugaua

SEQ ID NO: 550967 - RNA, 19 nt, Homo sapiens
ccacagcccuuccuacaag

SEQ ID NO: 550968 - RNA, 19 nt, Homo sapiens
ggcauaaugugacuguaaa

SEQ ID NO: 550969 - RNA, 19 nt, Homo sapiens
cauuugaccuacugaauug

SEQ ID NO: 550970 - RNA, 19 nt, Homo sapiens
guggagagaauagaaauua

SEQ ID NO: 550971 - RNA, 19 nt, Homo sapiens
uaccaaauccuccggcuua

SEQ ID NO: 550972 - RNA, 19 nt, Homo sapiens
gaaagaauuuugagucuag

SEQ ID NO: 550973 - RNA, 19 nt, Homo sapiens
ucagagcaauuaugggaaa

SEQ ID NO: 550974 - RNA, 19 nt, Homo sapiens
gaggauggcagcugagauu

SEQ ID NO: 550975 - RNA, 19 nt, Homo sapiens
uaaagguuguacaagagua

SEQ ID NO: 550976 - RNA, 19 nt, Homo sapiens
gucuagaugugguuaaauu

SEQ ID NO: 550977 - RNA, 19 nt, Homo sapiens
gggcauaaugugacuguaa

SEQ ID NO: 550978 - RNA, 19 nt, Homo sapiens
aagaaagacucucccaugu

SEQ ID NO: 550979 - RNA, 19 nt, Homo sapiens
caucuagucagagcaauua

SEQ ID NO: 550980 - RNA, 19 nt, Homo sapiens
gagucuagaugugguuaaa

SEQ ID NO: 550981 - RNA, 19 nt, Homo sapiens
agaagacagugaaaugaug

SEQ ID NO: 550982 - RNA, 19 nt, Homo sapiens
caaaguggagagaauagaa

SEQ ID NO: 550983 - RNA, 19 nt, Homo sapiens
gaugcagucuucucuccaa

SEQ ID NO: 550984 - RNA, 19 nt, Homo sapiens
gugaaaugauguaaugaca

SEQ ID NO: 550985 - RNA, 19 nt, Homo sapiens
ggagauaccuuuucaugag

SEQ ID NO: 550986 - RNA, 19 nt, Homo sapiens
guacuuggagucggauaua

SEQ ID NO: 550987 - RNA, 19 nt, Homo sapiens
caaccacacucaaucuuuu

SEQ ID NO: 550988 - RNA, 19 nt, Homo sapiens
gcaggacuccgcacaagga

SEQ ID NO: 550989 - RNA, 19 nt, Homo sapiens
gagaagacagugaaaugau

SEQ ID NO: 550990 - RNA, 19 nt, Homo sapiens
cugaauuccucacaccuaa

SEQ ID NO: 550991 - RNA, 19 nt, Homo sapiens
ggucaacauucuacuuugg

SEQ ID NO: 550992 - RNA, 19 nt, Homo sapiens
aaacagcuuuggucaacau

SEQ ID NO: 550993 - RNA, 19 nt, Homo sapiens
gaagacagugaaaugaugu

SEQ ID NO: 550994 - RNA, 19 nt, Homo sapiens
uaucuaaagcugugcaauu

SEQ ID NO: 550995 - RNA, 19 nt, Homo sapiens
cuacaagcaccuaucauug

SEQ ID NO: 550996 - RNA, 19 nt, Homo sapiens
gaagagcaucgcccaagau

SEQ ID NO: 550997 - RNA, 19 nt, Homo sapiens
ccaaugauacuaccaaguc

SEQ ID NO: 550998 - RNA, 19 nt, Homo sapiens
agaugucccuuucacugua

SEQ ID NO: 550999 - RNA, 19 nt, Homo sapiens
gaucgugaccaaagacaug

SEQ ID NO: 551000 - RNA, 19 nt, Homo sapiens
ggaaagaauuuugagucua

SEQ ID NO: 551001 - RNA, 19 nt, Homo sapiens
ugacagagaaggcagacaa

SEQ ID NO: 551002 - RNA, 19 nt, Homo sapiens
ccauuugaccuacugaauu

SEQ ID NO: 551003 - RNA, 19 nt, Homo sapiens
gauggcagcugagauucug

SEQ ID NO: 551004 - RNA, 19 nt, Homo sapiens
gcggaugauugcugcagaa

SEQ ID NO: 551005 - RNA, 19 nt, Homo sapiens
gaaacagcuuuggucaaca

SEQ ID NO: 551006 - RNA, 19 nt, Homo sapiens
aaaugccucucuucuccua

SEQ ID NO: 551007 - RNA, 19 nt, Homo sapiens
uagaugccauuugcuacua

SEQ ID NO: 551008 - RNA, 19 nt, Homo sapiens
cuuaaauguuucagaguga

SEQ ID NO: 551009 - RNA, 19 nt, Homo sapiens
ccugauaguuaccuaaagu

SEQ ID NO: 551010 - RNA, 19 nt, Homo sapiens
gaugucccuuucacuguau

SEQ ID NO: 551011 - RNA, 19 nt, Homo sapiens
guacaagaguaugaaagag

SEQ ID NO: 551012 - RNA, 19 nt, Homo sapiens
ucaaccacacucaaucuuu

SEQ ID NO: 551013 - RNA, 19 nt, Homo sapiens
ccuacaagcaccuaucauu

SEQ ID NO: 551014 - RNA, 19 nt, Homo sapiens
cguaaagguuguacaagag

SEQ ID NO: 551015 - RNA, 19 nt, Homo sapiens
ucaacauucuacuuuggaa

SEQ ID NO: 551016 - RNA, 19 nt, Homo sapiens
ugagaagacagugaaauga

SEQ ID NO: 551017 - RNA, 19 nt, Homo sapiens
aagacucucccauguuaua

SEQ ID NO: 551018 - RNA, 19 nt, Homo sapiens
uggauucagugaccuguau

SEQ ID NO: 551019 - RNA, 19 nt, Homo sapiens
auaguuaccuaaagugaca

SEQ ID NO: 551020 - RNA, 19 nt, Homo sapiens
gccaaagugcggaugauug

SEQ ID NO: 551021 - RNA, 19 nt, Homo sapiens
aaucaaaguggagagaaua

SEQ ID NO: 551022 - RNA, 19 nt, Homo sapiens
gggcuugucacacucuauu

SEQ ID NO: 551023 - RNA, 19 nt, Homo sapiens
agagaaggcagacaacaug

SEQ ID NO: 551024 - RNA, 19 nt, Homo sapiens
agaaagacucucccauguu

SEQ ID NO: 551025 - RNA, 19 nt, Homo sapiens
cuacugaauugccugucuu

SEQ ID NO: 551026 - RNA, 19 nt, Homo sapiens
cgaggaagguaccaaaucc

SEQ ID NO: 551027 - RNA, 19 nt, Homo sapiens
ggaaucaaaguggagagaa

SEQ ID NO: 551028 - RNA, 19 nt, Homo sapiens
cgcccaagaugcaaagguu

SEQ ID NO: 551029 - RNA, 19 nt, Homo sapiens
agauagaugccauuugcua

SEQ ID NO: 551030 - RNA, 19 nt, Homo sapiens
caacauucuacuuuggaaa

SEQ ID NO: 551031 - RNA, 19 nt, Homo sapiens
cagcuuuggucaacauucu

SEQ ID NO: 551032 - RNA, 19 nt, Homo sapiens
cacaaugcaccauccauga

SEQ ID NO: 551033 - RNA, 19 nt, Homo sapiens
caucgaucccucacugaaa

SEQ ID NO: 551034 - RNA, 19 nt, Homo sapiens
ucauugggcuugucacacu

SEQ ID NO: 551035 - RNA, 19 nt, Homo sapiens
ugaccaaagacauguuuau

SEQ ID NO: 551036 - RNA, 19 nt, Homo sapiens
ucccugcucuucaucauca

SEQ ID NO: 551037 - RNA, 19 nt, Homo sapiens
gguuuuaccuuugccauuu

SEQ ID NO: 551038 - RNA, 19 nt, Homo sapiens
aaaguggagagaauagaaa

SEQ ID NO: 551039 - RNA, 19 nt, Homo sapiens
uaugaagcgucuccuagca

SEQ ID NO: 551040 - RNA, 19 nt, Homo sapiens
acaccuaacccugauaguu

SEQ ID NO: 551041 - RNA, 19 nt, Homo sapiens
caaugcaccauccaugaga

SEQ ID NO: 551042 - RNA, 19 nt, Homo sapiens
gccauggaaugcacgaagu

SEQ ID NO: 551043 - RNA, 19 nt, Homo sapiens
guugagccacuaaauccua

SEQ ID NO: 551044 - RNA, 19 nt, Homo sapiens
gauucagugaccuguauuu

SEQ ID NO: 551045 - RNA, 19 nt, Homo sapiens
caugagaucgugaccaaag

SEQ ID NO: 551046 - RNA, 19 nt, Homo sapiens
caaugauacuaccaagucu

SEQ ID NO: 551047 - RNA, 19 nt, Homo sapiens
guucagaugucccuuucac

SEQ ID NO: 551048 - RNA, 19 nt, Homo sapiens
uguacaagaguaugaaaga

SEQ ID NO: 551049 - RNA, 19 nt, Homo sapiens
gggaaacagcuuuggucaa

SEQ ID NO: 551050 - RNA, 19 nt, Homo sapiens
agacaaagguuacuaauug

SEQ ID NO: 551051 - RNA, 19 nt, Homo sapiens
gaagggaacucugcacaaa

SEQ ID NO: 551052 - RNA, 19 nt, Homo sapiens
ucauagagcuaccguauuu

SEQ ID NO: 551053 - RNA, 19 nt, Homo sapiens
ggacagggcuagggcauuu

SEQ ID NO: 551054 - RNA, 19 nt, Homo sapiens
gaaacucccuuccuucaau

SEQ ID NO: 551055 - RNA, 19 nt, Homo sapiens
ggacaagaguucucaguca

SEQ ID NO: 551056 - RNA, 19 nt, Homo sapiens
gaugauggcuggcuaguca

SEQ ID NO: 551057 - RNA, 19 nt, Homo sapiens
ggagggaacuggagguuau

SEQ ID NO: 551058 - RNA, 19 nt, Homo sapiens
gaacagagaggucgggauu

SEQ ID NO: 551059 - RNA, 19 nt, Homo sapiens
gaaaaggccucuccugauu

SEQ ID NO: 551060 - RNA, 19 nt, Homo sapiens
ggaagaauguacagcuuau

SEQ ID NO: 551061 - RNA, 19 nt, Homo sapiens
aagcacaacucuccucuaa

SEQ ID NO: 551062 - RNA, 19 nt, Homo sapiens
ucucuucucuucuuuauga

SEQ ID NO: 551063 - RNA, 19 nt, Homo sapiens
gacaacaggccaccacaua

SEQ ID NO: 551064 - RNA, 19 nt, Homo sapiens
caaaggugcuauuuaccaa

SEQ ID NO: 551065 - RNA, 19 nt, Homo sapiens
ccaggaaucuaaagcuuug

SEQ ID NO: 551066 - RNA, 19 nt, Homo sapiens
ggacaaauguacaccuuuu

SEQ ID NO: 551067 - RNA, 19 nt, Homo sapiens
gcacaacucuccucuaacc

SEQ ID NO: 551068 - RNA, 19 nt, Homo sapiens
ucacagagcacuacaaaca

SEQ ID NO: 551069 - RNA, 19 nt, Homo sapiens
ggagaaaaguggaaagcua

SEQ ID NO: 551070 - RNA, 19 nt, Homo sapiens
guguauguguggcaaauaa

SEQ ID NO: 551071 - RNA, 19 nt, Homo sapiens
aggccugucucuccuauua

SEQ ID NO: 551072 - RNA, 19 nt, Homo sapiens
guagacuugugcaauauau

SEQ ID NO: 551073 - RNA, 19 nt, Homo sapiens
ucaguacaauccaaauuug

SEQ ID NO: 551074 - RNA, 19 nt, Homo sapiens
gucguagacuugugcaaua

SEQ ID NO: 551075 - RNA, 19 nt, Homo sapiens
gggaaagguugcugucugu

SEQ ID NO: 551076 - RNA, 19 nt, Homo sapiens
ugccuggacuuaaacaaua

SEQ ID NO: 551077 - RNA, 19 nt, Homo sapiens
ggacuuaaacaauacuaug

SEQ ID NO: 551078 - RNA, 19 nt, Homo sapiens
gaagagaggccaaguucag

SEQ ID NO: 551079 - RNA, 19 nt, Homo sapiens
gcuguguucuugcaucuug

SEQ ID NO: 551080 - RNA, 19 nt, Homo sapiens
ccaaauuugucguagacuu

SEQ ID NO: 551081 - RNA, 19 nt, Homo sapiens
acagagaggucgggauuug

SEQ ID NO: 551082 - RNA, 19 nt, Homo sapiens
ggucauagagcuaccguau

SEQ ID NO: 551083 - RNA, 19 nt, Homo sapiens
gaacuccagguccuuuauu

SEQ ID NO: 551084 - RNA, 19 nt, Homo sapiens
ggaaccacaugaaagucuu

SEQ ID NO: 551085 - RNA, 19 nt, Homo sapiens
ggguagaccuagccaagga

SEQ ID NO: 551086 - RNA, 19 nt, Homo sapiens
ccacagacccaagagcuaa

SEQ ID NO: 551087 - RNA, 19 nt, Homo sapiens
acucaaaggugcuauuuac

SEQ ID NO: 551088 - RNA, 19 nt, Homo sapiens
guagggccgacacuaaaua

SEQ ID NO: 551089 - RNA, 19 nt, Homo sapiens
caaauuugucguagacuug

SEQ ID NO: 551090 - RNA, 19 nt, Homo sapiens
guugcugucugucucagua

SEQ ID NO: 551091 - RNA, 19 nt, Homo sapiens
ccaaaccgaaucaccuuaa

SEQ ID NO: 551092 - RNA, 19 nt, Homo sapiens
auucaugccuggacuuaaa

SEQ ID NO: 551093 - RNA, 19 nt, Homo sapiens
gcaggccugucucuccuau

SEQ ID NO: 551094 - RNA, 19 nt, Homo sapiens
aaacucccuuccuucaauu

SEQ ID NO: 551095 - RNA, 19 nt, Homo sapiens
aucccuggcuccucuauua

SEQ ID NO: 551096 - RNA, 19 nt, Homo sapiens
caagcaagguuagcaacug

SEQ ID NO: 551097 - RNA, 19 nt, Homo sapiens
gagccagugucugccuaua

SEQ ID NO: 551098 - RNA, 19 nt, Homo sapiens
gagguguccuaccgcauug

SEQ ID NO: 551099 - RNA, 19 nt, Homo sapiens
ggaagggaacucugcacaa

SEQ ID NO: 551100 - RNA, 19 nt, Homo sapiens
ugccagcucugccuccuuu

SEQ ID NO: 551101 - RNA, 19 nt, Homo sapiens
aagcuacacugggaagaaa

SEQ ID NO: 551102 - RNA, 19 nt, Homo sapiens
aacuccagguccuuuauua

SEQ ID NO: 551103 - RNA, 19 nt, Homo sapiens
aaucuaaagcuuuggguuu

SEQ ID NO: 551104 - RNA, 19 nt, Homo sapiens
gcaagguuagcaacuguga

SEQ ID NO: 551105 - RNA, 19 nt, Homo sapiens
gagggagcaagcaagguua

SEQ ID NO: 551106 - RNA, 19 nt, Homo sapiens
ccaggugccuuuggagaga

SEQ ID NO: 551107 - RNA, 19 nt, Homo sapiens
ucagagcaccugugggaaa

SEQ ID NO: 551108 - RNA, 19 nt, Homo sapiens
ccacaugaaagucuugaug

SEQ ID NO: 551109 - RNA, 19 nt, Homo sapiens
caugacuuguuucuaauuc

SEQ ID NO: 551110 - RNA, 19 nt, Homo sapiens
aaucuugucucucuucucu

SEQ ID NO: 551111 - RNA, 19 nt, Homo sapiens
gagcuaauuuucugguuug

SEQ ID NO: 551112 - RNA, 19 nt, Homo sapiens
cuuuauuacugccuucuuu

SEQ ID NO: 551113 - RNA, 19 nt, Homo sapiens
uggaagaauguacagcuua

SEQ ID NO: 551114 - RNA, 19 nt, Homo sapiens
caaaagaccucgaguuucc

SEQ ID NO: 551115 - RNA, 19 nt, Homo sapiens
gcauucgcaucaaccacaa

SEQ ID NO: 551116 - RNA, 19 nt, Homo sapiens
gccuguagauguugcuuuc

SEQ ID NO: 551117 - RNA, 19 nt, Homo sapiens
caaaccgaaucaccuuaag

SEQ ID NO: 551118 - RNA, 19 nt, Homo sapiens
gaaagguugcugucugucu

SEQ ID NO: 551119 - RNA, 19 nt, Homo sapiens
ggaacuccagguccuuuau

SEQ ID NO: 551120 - RNA, 19 nt, Homo sapiens
gggaacuccagguccuuua

SEQ ID NO: 551121 - RNA, 19 nt, Homo sapiens
guauguguggcaaauaauu

SEQ ID NO: 551122 - RNA, 19 nt, Homo sapiens
gaggaagagaggccaaguu

SEQ ID NO: 551123 - RNA, 19 nt, Homo sapiens
agagaacuguugcgugcuu

SEQ ID NO: 551124 - RNA, 19 nt, Homo sapiens
ggaaaagaaaccaaaaguu

SEQ ID NO: 551125 - RNA, 19 nt, Homo sapiens
cagcuuauggacaaaugua

SEQ ID NO: 551126 - RNA, 19 nt, Homo sapiens
gacucaaaggugcuauuua

SEQ ID NO: 551127 - RNA, 19 nt, Homo sapiens
gcagaggcuuaaggucuuc

SEQ ID NO: 551128 - RNA, 19 nt, Homo sapiens
gccaggaaucuaaagcuuu

SEQ ID NO: 551129 - RNA, 19 nt, Homo sapiens
gagcaagcaagguuagcaa

SEQ ID NO: 551130 - RNA, 19 nt, Homo sapiens
gaaaagacaaagguuacua

SEQ ID NO: 551131 - RNA, 19 nt, Homo sapiens
cuagucagccuugcaugua

SEQ ID NO: 551132 - RNA, 19 nt, Homo sapiens
ggagaagugggagacguuu

SEQ ID NO: 551133 - RNA, 19 nt, Homo sapiens
uaagaaaggaggaaaagaa

SEQ ID NO: 551134 - RNA, 19 nt, Homo sapiens
ugucucuccuauuaaguaa

SEQ ID NO: 551135 - RNA, 19 nt, Homo sapiens
ugacucaaaggugcuauuu

SEQ ID NO: 551136 - RNA, 19 nt, Homo sapiens
gaaccacaugaaagucuug

SEQ ID NO: 551137 - RNA, 19 nt, Homo sapiens
ggaagagaggccaaguuca

SEQ ID NO: 551138 - RNA, 19 nt, Homo sapiens
ugauggcagucuccagcua

SEQ ID NO: 551139 - RNA, 19 nt, Homo sapiens
ucucucuucucuucuuuau

SEQ ID NO: 551140 - RNA, 19 nt, Homo sapiens
ugcaauauauacuguugug

SEQ ID NO: 551141 - RNA, 19 nt, Homo sapiens
cccauguucugcaagacua

SEQ ID NO: 551142 - RNA, 19 nt, Homo sapiens
cugcugccaugaucccuuu

SEQ ID NO: 551143 - RNA, 19 nt, Homo sapiens
ccugauuccuacuguccua

SEQ ID NO: 551144 - RNA, 19 nt, Homo sapiens
aagcaagguuagcaacugu

SEQ ID NO: 551145 - RNA, 19 nt, Homo sapiens
gccagugucugccuauagg

SEQ ID NO: 551146 - RNA, 19 nt, Homo sapiens
gaagaauguacagcuuaug

SEQ ID NO: 551147 - RNA, 19 nt, Homo sapiens
ugagguguccuaccgcauu

SEQ ID NO: 551148 - RNA, 19 nt, Homo sapiens
uuucaacucuccacauuuu

SEQ ID NO: 551149 - RNA, 19 nt, Homo sapiens
ucaaaggugcuauuuacca

SEQ ID NO: 551150 - RNA, 19 nt, Homo sapiens
gcacaugccuggaauauga

SEQ ID NO: 551151 - RNA, 19 nt, Homo sapiens
caacaggucuugccacaua

SEQ ID NO: 551152 - RNA, 19 nt, Homo sapiens
caacaggucuugccacaua

SEQ ID NO: 551153 - RNA, 19 nt, Homo sapiens
caacaggucuugccagaua

SEQ ID NO: 551154 - RNA, 19 nt, Homo sapiens
gaaccaaccuccaaauuau

SEQ ID NO: 551155 - RNA, 19 nt, Homo sapiens
gaaggaaucuacaguaaga

SEQ ID NO: 551156 - RNA, 19 nt, Homo sapiens
gaaauggacucuucccaaa

SEQ ID NO: 551157 - RNA, 19 nt, Homo sapiens
gaacaacucccauuucaaa

SEQ ID NO: 551158 - RNA, 19 nt, Homo sapiens
cagcagaccuuacccaaua

SEQ ID NO: 551159 - RNA, 19 nt, Homo sapiens
caacagaccuugccagaga

SEQ ID NO: 551160 - RNA, 19 nt, Homo sapiens
ggaacaaaguggugauuaa

SEQ ID NO: 551161 - RNA, 19 nt, Homo sapiens
gcacucagcucaaguagga

SEQ ID NO: 551162 - RNA, 19 nt, Homo sapiens
gaagagagucugaaaguuu

SEQ ID NO: 551163 - RNA, 19 nt, Homo sapiens
gagagaagcccauuacuuu

SEQ ID NO: 551164 - RNA, 19 nt, Homo sapiens
ggaaccaaccuccaaauua

SEQ ID NO: 551165 - RNA, 19 nt, Homo sapiens
ggagagaagccgauuguua

SEQ ID NO: 551166 - RNA, 19 nt, Homo sapiens
ggagagaagcccauuguua

SEQ ID NO: 551167 - RNA, 19 nt, Homo sapiens
caacaggaguggccagaua

SEQ ID NO: 551168 - RNA, 19 nt, Homo sapiens
gaacacaaauuucugauac

SEQ ID NO: 551169 - RNA, 19 nt, Homo sapiens
caacaguaccuuuaaguua

SEQ ID NO: 551170 - RNA, 19 nt, Homo sapiens
ccagagaucuuaaacagaa

SEQ ID NO: 551171 - RNA, 19 nt, Homo sapiens
ggaaagaacuguccuuggu

SEQ ID NO: 551172 - RNA, 19 nt, Homo sapiens
caacagcucuuccuaguuc

SEQ ID NO: 551173 - RNA, 19 nt, Homo sapiens
gagagaagccgauuguuaa

SEQ ID NO: 551174 - RNA, 19 nt, Homo sapiens
ggaaguuagugaagcuuua

SEQ ID NO: 551175 - RNA, 19 nt, Homo sapiens
guaccaagauguauuaugu

SEQ ID NO: 551176 - RNA, 19 nt, Homo sapiens
gcagaucgauuaccagaga

SEQ ID NO: 551177 - RNA, 19 nt, Homo sapiens
gaacauccacaacuagaua

SEQ ID NO: 551178 - RNA, 19 nt, Homo sapiens
gaagcagaauccuuacuuu

SEQ ID NO: 551179 - RNA, 19 nt, Homo sapiens
gcaagaaagugcugaauac

SEQ ID NO: 551180 - RNA, 19 nt, Homo sapiens
gaacauguccaaaggcuaa

SEQ ID NO: 551181 - RNA, 19 nt, Homo sapiens
ccagaagacugagacauua

SEQ ID NO: 551182 - RNA, 19 nt, Homo sapiens
cgacagaccuugccagaug

SEQ ID NO: 551183 - RNA, 19 nt, Homo sapiens
gaauaucacucuucagauc

SEQ ID NO: 551184 - RNA, 19 nt, Homo sapiens
gcaaggugcuuucucauca

SEQ ID NO: 551185 - RNA, 19 nt, Homo sapiens
gcagguaacuuggagauug

SEQ ID NO: 551186 - RNA, 19 nt, Homo sapiens
gaaaggaguagcucuguuu

SEQ ID NO: 551187 - RNA, 19 nt, Homo sapiens
gcaaagcuccugucaaguu

SEQ ID NO: 551188 - RNA, 19 nt, Homo sapiens
ccaaaucacuguacauuag

SEQ ID NO: 551189 - RNA, 19 nt, Homo sapiens
ucaagaagcucugaaaguu

SEQ ID NO: 551190 - RNA, 19 nt, Homo sapiens
ugaagaagcucugaaaguu

SEQ ID NO: 551191 - RNA, 19 nt, Homo sapiens
caaauagcauccucuaguu

SEQ ID NO: 551192 - RNA, 19 nt, Homo sapiens
gaagagggucugaaaguuu

SEQ ID NO: 551193 - RNA, 19 nt, Homo sapiens
caacaagaguuaccagaga

SEQ ID NO: 551194 - RNA, 19 nt, Homo sapiens
cagaauagccagauaguaa

SEQ ID NO: 551195 - RNA, 19 nt, Homo sapiens
caacuggcauugcuaggua

SEQ ID NO: 551196 - RNA, 19 nt, Homo sapiens
caaaggcuccuaaacauuu

SEQ ID NO: 551197 - RNA, 19 nt, Homo sapiens
ggaauuccuugcaguuaaa

SEQ ID NO: 551198 - RNA, 19 nt, Homo sapiens
caaccuuucugcauccuua

SEQ ID NO: 551199 - RNA, 19 nt, Homo sapiens
caaauuaccggauuacaaa

SEQ ID NO: 551200 - RNA, 19 nt, Homo sapiens
caacaguacucucuaguuc

SEQ ID NO: 551201 - RNA, 19 nt, Homo sapiens
cagcaaaggucuucgaaug

SEQ ID NO: 551202 - RNA, 19 nt, Homo sapiens
ucuacuagcuacucaaaua

SEQ ID NO: 551203 - RNA, 19 nt, Homo sapiens
gaaaguacacaugaugaua

SEQ ID NO: 551204 - RNA, 19 nt, Homo sapiens
gaucaaggcagaguuauuu

SEQ ID NO: 551205 - RNA, 19 nt, Homo sapiens
gcacacagacgaauuugaa

SEQ ID NO: 551206 - RNA, 19 nt, Homo sapiens
ccacaggaauugccaggua

SEQ ID NO: 551207 - RNA, 19 nt, Homo sapiens
gaagaggcuuuggaaguuu

SEQ ID NO: 551208 - RNA, 19 nt, Homo sapiens
gaagagccuuuggaaguuu

SEQ ID NO: 551209 - RNA, 19 nt, Homo sapiens
ggagaagauuguuccauug

SEQ ID NO: 551210 - RNA, 19 nt, Homo sapiens
gaacaaaguggugauuaaa

SEQ ID NO: 551211 - RNA, 19 nt, Homo sapiens
ucacagaccugacuucauc

SEQ ID NO: 551212 - RNA, 19 nt, Homo sapiens
gcugggaggucuaaucaaa

SEQ ID NO: 551213 - RNA, 19 nt, Homo sapiens
gaucuuccuucuugcauuu

SEQ ID NO: 551214 - RNA, 19 nt, Homo sapiens
gcacugaaacgaugcaauu

SEQ ID NO: 551215 - RNA, 19 nt, Homo sapiens
gagagaagcccauuguuau

SEQ ID NO: 551216 - RNA, 19 nt, Homo sapiens
gagagaagccugguacuuu

SEQ ID NO: 551217 - RNA, 19 nt, Homo sapiens
gacauuggaucucauuuau

SEQ ID NO: 551218 - RNA, 19 nt, Homo sapiens
gagcaacccuucaggaauc

SEQ ID NO: 551219 - RNA, 19 nt, Homo sapiens
caagaagaauucccaugaa

SEQ ID NO: 551220 - RNA, 19 nt, Homo sapiens
caagauauuugccaugaau

SEQ ID NO: 551221 - RNA, 19 nt, Homo sapiens
gaggaugaauagugaguuu

SEQ ID NO: 551222 - RNA, 19 nt, Homo sapiens
caaagucaguauggcauua

SEQ ID NO: 551223 - RNA, 19 nt, Homo sapiens
gaagaugugcugaagguuu

SEQ ID NO: 551224 - RNA, 19 nt, Homo sapiens
aaacaggccuuuccagaug

SEQ ID NO: 551225 - RNA, 19 nt, Homo sapiens
gagagaagcuccuuguuuu

SEQ ID NO: 551226 - RNA, 19 nt, Homo sapiens
guucauauaugucauggaa

SEQ ID NO: 551227 - RNA, 19 nt, Homo sapiens
gaagagaacagugauguga

SEQ ID NO: 551228 - RNA, 19 nt, Homo sapiens
ucagauauauugacccaaa

SEQ ID NO: 551229 - RNA, 19 nt, Homo sapiens
caaagcuccugucaaguuu

SEQ ID NO: 551230 - RNA, 19 nt, Homo sapiens
gaaauuauagagccuggua

SEQ ID NO: 551231 - RNA, 19 nt, Homo sapiens
gauguuggcucugaagaaa

SEQ ID NO: 551232 - RNA, 19 nt, Homo sapiens
cagacuagguuuaauguga

SEQ ID NO: 551233 - RNA, 19 nt, Homo sapiens
gaacauuucagauuucgaa

SEQ ID NO: 551234 - RNA, 19 nt, Homo sapiens
guagaugaccaaaugaaua

SEQ ID NO: 551235 - RNA, 19 nt, Homo sapiens
caauaggacugucuaguuc

SEQ ID NO: 551236 - RNA, 19 nt, Homo sapiens
ugaagaagcucugaagguu

SEQ ID NO: 551237 - RNA, 19 nt, Homo sapiens
cagcaggccuugccaggua

SEQ ID NO: 551238 - RNA, 19 nt, Homo sapiens
ccaaauuauugaccaguaa

SEQ ID NO: 551239 - RNA, 19 nt, Homo sapiens
cagaacaacucccauuuca

SEQ ID NO: 551240 - RNA, 19 nt, Homo sapiens
gauacuccauuucagaauu

SEQ ID NO: 551241 - RNA, 19 nt, Homo sapiens
gaagaggcacagaaaguuu

SEQ ID NO: 551242 - RNA, 19 nt, Homo sapiens
caaagacugugaucguuau

SEQ ID NO: 551243 - RNA, 19 nt, Homo sapiens
gacacaagaccaagaauuu

SEQ ID NO: 551244 - RNA, 19 nt, Homo sapiens
uagagaagcagaauccuua

SEQ ID NO: 551245 - RNA, 19 nt, Homo sapiens
ggaauggagugguagacaa

SEQ ID NO: 551246 - RNA, 19 nt, Homo sapiens
gaacuugccagacacuaaa

SEQ ID NO: 551247 - RNA, 19 nt, Homo sapiens
gccagaagcuguauguaau

SEQ ID NO: 551248 - RNA, 19 nt, Homo sapiens
ugaacuaacugaugugaau

SEQ ID NO: 551249 - RNA, 19 nt, Homo sapiens
gauuucaacugugcauaua

SEQ ID NO: 551250 - RNA, 19 nt, Homo sapiens
guaaagagucgccuaaaua

SEQ ID NO: 551251 - RNA, 19 nt, Homo sapiens
ccauagaguuuguguuuga

SEQ ID NO: 551252 - RNA, 19 nt, Homo sapiens
ugacagagaugguaaagag

SEQ ID NO: 551253 - RNA, 19 nt, Homo sapiens
gguaaagagucgccuaaau

SEQ ID NO: 551254 - RNA, 19 nt, Homo sapiens
gacuggagcuggagaguga

SEQ ID NO: 551255 - RNA, 19 nt, Homo sapiens
ggugacagauggcaaggaa

SEQ ID NO: 551256 - RNA, 19 nt, Homo sapiens
ccucugggcuggaugacua

SEQ ID NO: 551257 - RNA, 19 nt, Homo sapiens
ccacugaguucgucaagag

SEQ ID NO: 551258 - RNA, 19 nt, Homo sapiens
ccuuaaggcucaccacuga

SEQ ID NO: 551259 - RNA, 19 nt, Homo sapiens
gaaugugaauccagagucu

SEQ ID NO: 551260 - RNA, 19 nt, Homo sapiens
agagagcgcuuugagaaga

SEQ ID NO: 551261 - RNA, 19 nt, Homo sapiens
uaaagagucgccuaaauag

SEQ ID NO: 551262 - RNA, 19 nt, Homo sapiens
auucaaaccuuccucauuc

SEQ ID NO: 551263 - RNA, 19 nt, Homo sapiens
ggaccagccuugucuuacu

SEQ ID NO: 551264 - RNA, 19 nt, Homo sapiens
cagcagagagccuggauga

SEQ ID NO: 551265 - RNA, 19 nt, Homo sapiens
aaaccuuccucauucauuc

SEQ ID NO: 551266 - RNA, 19 nt, Homo sapiens
caacgugguaggcaaugua

SEQ ID NO: 551267 - RNA, 19 nt, Homo sapiens
uuagagagcgcuuugagaa

SEQ ID NO: 551268 - RNA, 19 nt, Homo sapiens
guacuucugcccucccuuu

SEQ ID NO: 551269 - RNA, 19 nt, Homo sapiens
caacugcaguauguagaug

SEQ ID NO: 551270 - RNA, 19 nt, Homo sapiens
guaccaggccacaggcuuu

SEQ ID NO: 551271 - RNA, 19 nt, Homo sapiens
uagaugcucuuggcuaugu

SEQ ID NO: 551272 - RNA, 19 nt, Homo sapiens
gcccacugccacuaucuua

SEQ ID NO: 551273 - RNA, 19 nt, Homo sapiens
gaccagccuugucuuacug

SEQ ID NO: 551274 - RNA, 19 nt, Homo sapiens
aaccucaacugcaguaugu

SEQ ID NO: 551275 - RNA, 19 nt, Homo sapiens
uguagaugcucuuggcuau

SEQ ID NO: 551276 - RNA, 19 nt, Homo sapiens
ccucaggacucagguacuu

SEQ ID NO: 551277 - RNA, 19 nt, Homo sapiens
gugaauccagagucuauuu

SEQ ID NO: 551278 - RNA, 19 nt, Homo sapiens
ccgggugccuccagaauuc

SEQ ID NO: 551279 - RNA, 19 nt, Homo sapiens
caaaccuuccucauucauu

SEQ ID NO: 551280 - RNA, 19 nt, Homo sapiens
gcuggagagugacuguaga

SEQ ID NO: 551281 - RNA, 19 nt, Homo sapiens
gaggcuuccuuugggauga

SEQ ID NO: 551282 - RNA, 19 nt, Homo sapiens
gaagacccgcagcccgaaa

SEQ ID NO: 551283 - RNA, 19 nt, Homo sapiens
gguggacccagcccucuuu

SEQ ID NO: 551284 - RNA, 19 nt, Homo sapiens
ggacaagggcugguauugc

SEQ ID NO: 551285 - RNA, 19 nt, Homo sapiens
cauagaguuuguguuugaa

SEQ ID NO: 551286 - RNA, 19 nt, Homo sapiens
uuccauagaguuuguguuu

SEQ ID NO: 551287 - RNA, 19 nt, Homo sapiens
uauggcagcuacaaugucu

SEQ ID NO: 551288 - RNA, 19 nt, Homo sapiens
gcaguugaaguuuaucagu

SEQ ID NO: 551289 - RNA, 19 nt, Homo sapiens
gaaggacaagggacaaagg

SEQ ID NO: 551290 - RNA, 19 nt, Homo sapiens
gcuucacacccuucaguaa

SEQ ID NO: 551291 - RNA, 19 nt, Homo sapiens
ggacccagcccucuuucca

SEQ ID NO: 551292 - RNA, 19 nt, Homo sapiens
ucgccuaaauagcugguuu

SEQ ID NO: 551293 - RNA, 19 nt, Homo sapiens
ugacagauggcaaggaagu

SEQ ID NO: 551294 - RNA, 19 nt, Homo sapiens
ggugcuguguggcucaaug

SEQ ID NO: 551295 - RNA, 19 nt, Homo sapiens
caaaagcaguacagcugaa

SEQ ID NO: 551296 - RNA, 19 nt, Homo sapiens
uagaguuuguguuugaauc

SEQ ID NO: 551297 - RNA, 19 nt, Homo sapiens
caaccucaacugcaguaug

SEQ ID NO: 551298 - RNA, 19 nt, Homo sapiens
cuaccgcccucacgucuac

SEQ ID NO: 551299 - RNA, 19 nt, Homo sapiens
gaaccacacaaaagcagua

SEQ ID NO: 551300 - RNA, 19 nt, Homo sapiens
ccgccugcaugccugguuu

SEQ ID NO: 551301 - RNA, 19 nt, Homo sapiens
ggccacaggcuuucuuugg

SEQ ID NO: 551302 - RNA, 19 nt, Homo sapiens
gcaccuggaccugcgaugu

SEQ ID NO: 551303 - RNA, 19 nt, Homo sapiens
uggugacccugacgacuug

SEQ ID NO: 551304 - RNA, 19 nt, Homo sapiens
ccaaguauggcagcuacaa

SEQ ID NO: 551305 - RNA, 19 nt, Homo sapiens
gcuccgugccaacguggua

SEQ ID NO: 551306 - RNA, 19 nt, Homo sapiens
uguagagccucaggacuca

SEQ ID NO: 551307 - RNA, 19 nt, Homo sapiens
aaaugcugauggcuggauu

SEQ ID NO: 551308 - RNA, 19 nt, Homo sapiens
uaccucggcuugccaggau

SEQ ID NO: 551309 - RNA, 19 nt, Homo sapiens
caaguauggcagcuacaau

SEQ ID NO: 551310 - RNA, 19 nt, Homo sapiens
guucuucuauguggugaca

SEQ ID NO: 551311 - RNA, 19 nt, Homo sapiens
uuugggagcaguacaguga

SEQ ID NO: 551312 - RNA, 19 nt, Homo sapiens
gagagcgcuuugagaagac

SEQ ID NO: 551313 - RNA, 19 nt, Homo sapiens
gagcacuccaccacuaugg

SEQ ID NO: 551314 - RNA, 19 nt, Homo sapiens
caccuggaccugcgauguu

SEQ ID NO: 551315 - RNA, 19 nt, Homo sapiens
aaaucaagcccugccaaga

SEQ ID NO: 551316 - RNA, 19 nt, Homo sapiens
gcuggcaggugucgcuaac

SEQ ID NO: 551317 - RNA, 19 nt, Homo sapiens
gcagcuacaaugucuucug

SEQ ID NO: 551318 - RNA, 19 nt, Homo sapiens
ccaaggggcaguugaaguu

SEQ ID NO: 551319 - RNA, 19 nt, Homo sapiens
gggcuucacacccuucagu

SEQ ID NO: 551320 - RNA, 19 nt, Homo sapiens
gacccugccuuaccaaccu

SEQ ID NO: 551321 - RNA, 19 nt, Homo sapiens
gagcuggagagugacugua

SEQ ID NO: 551322 - RNA, 19 nt, Homo sapiens
gcaggggcaguucuugaua

SEQ ID NO: 551323 - RNA, 19 nt, Homo sapiens
gaauugagccgguuucuua

SEQ ID NO: 551324 - RNA, 19 nt, Homo sapiens
ggacgaagacccugacuua

SEQ ID NO: 551325 - RNA, 19 nt, Homo sapiens
gaaaauggauguuugcuaa

SEQ ID NO: 551326 - RNA, 19 nt, Homo sapiens
guaugaaacuggcaucuuu

SEQ ID NO: 551327 - RNA, 19 nt, Homo sapiens
ggucaugguuuacuaauug

SEQ ID NO: 551328 - RNA, 19 nt, Homo sapiens
ggaaagucaugcuuaaaga

SEQ ID NO: 551329 - RNA, 19 nt, Homo sapiens
gggcggaucugaguuauuu

SEQ ID NO: 551330 - RNA, 19 nt, Homo sapiens
gaacuuuccuguagaaucu

SEQ ID NO: 551331 - RNA, 19 nt, Homo sapiens
cgagguaaaugaucuguuu

SEQ ID NO: 551332 - RNA, 19 nt, Homo sapiens
caacaaugaugaagucaau

SEQ ID NO: 551333 - RNA, 19 nt, Homo sapiens
ggaaauacacauuaugcua

SEQ ID NO: 551334 - RNA, 19 nt, Homo sapiens
cgaagacccugacuuauuc

SEQ ID NO: 551335 - RNA, 19 nt, Homo sapiens
ccacacaggcgaauuuaua

SEQ ID NO: 551336 - RNA, 19 nt, Homo sapiens
caacaagaguuauaugaca

SEQ ID NO: 551337 - RNA, 19 nt, Homo sapiens
caacaacaaugaugaaguc

SEQ ID NO: 551338 - RNA, 19 nt, Homo sapiens
ggaaguauuugaagauaag

SEQ ID NO: 551339 - RNA, 19 nt, Homo sapiens
caucagaauugcauuguga

SEQ ID NO: 551340 - RNA, 19 nt, Homo sapiens
uuaccaauguggcgauuua

SEQ ID NO: 551341 - RNA, 19 nt, Homo sapiens
gcacuguacugaauguguu

SEQ ID NO: 551342 - RNA, 19 nt, Homo sapiens
cgacauuguugcccuguuu

SEQ ID NO: 551343 - RNA, 19 nt, Homo sapiens
ggucauguguuucaucaga

SEQ ID NO: 551344 - RNA, 19 nt, Homo sapiens
ucuaugagcuuguggaaga

SEQ ID NO: 551345 - RNA, 19 nt, Homo sapiens
ucaagaagcugaagaccau

SEQ ID NO: 551346 - RNA, 19 nt, Homo sapiens
uaacuuggccugcugauau

SEQ ID NO: 551347 - RNA, 19 nt, Homo sapiens
gaagauauggaaccugauu

SEQ ID NO: 551348 - RNA, 19 nt, Homo sapiens
uagcaagacuuuacaagau

SEQ ID NO: 551349 - RNA, 19 nt, Homo sapiens
guucaugugccaauaaaua

SEQ ID NO: 551350 - RNA, 19 nt, Homo sapiens
caaccacacuggcuucaug

SEQ ID NO: 551351 - RNA, 19 nt, Homo sapiens
acaaggagcuaccauaaag

SEQ ID NO: 551352 - RNA, 19 nt, Homo sapiens
gagcuugguucuaguuaau

SEQ ID NO: 551353 - RNA, 19 nt, Homo sapiens
gaaggaauuuacagguaug

SEQ ID NO: 551354 - RNA, 19 nt, Homo sapiens
gaacacagacacuuugagu

SEQ ID NO: 551355 - RNA, 19 nt, Homo sapiens
gaaagucaugcuuaaagaa

SEQ ID NO: 551356 - RNA, 19 nt, Homo sapiens
caccagcccuugucaaaug

SEQ ID NO: 551357 - RNA, 19 nt, Homo sapiens
gaaggaaguauuugaagau

SEQ ID NO: 551358 - RNA, 19 nt, Homo sapiens
gcacuuuagggacauauaa

SEQ ID NO: 551359 - RNA, 19 nt, Homo sapiens
gcugugagacaugaaauua

SEQ ID NO: 551360 - RNA, 19 nt, Homo sapiens
cuaaauguuuccucccuuu

SEQ ID NO: 551361 - RNA, 19 nt, Homo sapiens
gaaaaugacucggaaagug

SEQ ID NO: 551362 - RNA, 19 nt, Homo sapiens
gcaacaacaacaaugauga

SEQ ID NO: 551363 - RNA, 19 nt, Homo sapiens
gcugaacacuugaaagaag

SEQ ID NO: 551364 - RNA, 19 nt, Homo sapiens
ccaauaacuuagaaugguu

SEQ ID NO: 551365 - RNA, 19 nt, Homo sapiens
ugaaggaauuuacagguau

SEQ ID NO: 551366 - RNA, 19 nt, Homo sapiens
gcaagacuuuacaagauag

SEQ ID NO: 551367 - RNA, 19 nt, Homo sapiens
ggaucaaauucuaauggaa

SEQ ID NO: 551368 - RNA, 19 nt, Homo sapiens
gagcuaccauaaagcgauu

SEQ ID NO: 551369 - RNA, 19 nt, Homo sapiens
gaauuuacagguauggaaa

SEQ ID NO: 551370 - RNA, 19 nt, Homo sapiens
gacaacaagaguuauauga

SEQ ID NO: 551371 - RNA, 19 nt, Homo sapiens
cauuggaaauucagaaguu

SEQ ID NO: 551372 - RNA, 19 nt, Homo sapiens
gccgguggccuucuuauaa

SEQ ID NO: 551373 - RNA, 19 nt, Homo sapiens
agaaggaaguauuugaaga

SEQ ID NO: 551374 - RNA, 19 nt, Homo sapiens
ucagaacuuuccuguagaa

SEQ ID NO: 551375 - RNA, 19 nt, Homo sapiens
ggaagaguugaguuuauuu

SEQ ID NO: 551376 - RNA, 19 nt, Homo sapiens
gccauugugugguaugaaa

SEQ ID NO: 551377 - RNA, 19 nt, Homo sapiens
uuucagaacuuuccuguag

SEQ ID NO: 551378 - RNA, 19 nt, Homo sapiens
gaaugguuaucaagucugu

SEQ ID NO: 551379 - RNA, 19 nt, Homo sapiens
caacaacaacaaugaugaa

SEQ ID NO: 551380 - RNA, 19 nt, Homo sapiens
gguaaaugaucuguuuguu

SEQ ID NO: 551381 - RNA, 19 nt, Homo sapiens
cugaaggaauuuacaggua

SEQ ID NO: 551382 - RNA, 19 nt, Homo sapiens
uuauaaugcugaacacuug

SEQ ID NO: 551383 - RNA, 19 nt, Homo sapiens
aauaauguaugcugugaga

SEQ ID NO: 551384 - RNA, 19 nt, Homo sapiens
gcaccucuugguuaaauaa

SEQ ID NO: 551385 - RNA, 19 nt, Homo sapiens
caagauaggaucaaauucu

SEQ ID NO: 551386 - RNA, 19 nt, Homo sapiens
gacgggaaauacacauuau

SEQ ID NO: 551387 - RNA, 19 nt, Homo sapiens
ugacgggaaauacacauua

SEQ ID NO: 551388 - RNA, 19 nt, Homo sapiens
ucacaauucuccaggaaca

SEQ ID NO: 551389 - RNA, 19 nt, Homo sapiens
aaaguuuacuggaagaguu

SEQ ID NO: 551390 - RNA, 19 nt, Homo sapiens
gauccacacucauuauguc

SEQ ID NO: 551391 - RNA, 19 nt, Homo sapiens
agcaagacuuuacaagaua

SEQ ID NO: 551392 - RNA, 19 nt, Homo sapiens
uugguugccuuguguguua

SEQ ID NO: 551393 - RNA, 19 nt, Homo sapiens
gcaaagcguacuucacaau

SEQ ID NO: 551394 - RNA, 19 nt, Homo sapiens
cagcuaccuuacuuagaua

SEQ ID NO: 551395 - RNA, 19 nt, Homo sapiens
acacaaggagcuaccauaa

SEQ ID NO: 551396 - RNA, 19 nt, Homo sapiens
aaagggaaagucaugcuua

SEQ ID NO: 551397 - RNA, 19 nt, Homo sapiens
gcacuucuaugagcuugug

SEQ ID NO: 551398 - RNA, 19 nt, Homo sapiens
gugaaaugcacuucuauga

SEQ ID NO: 551399 - RNA, 19 nt, Homo sapiens
guggugaaaugcacuucua

SEQ ID NO: 551400 - RNA, 19 nt, Homo sapiens
gaaauuuauccuagcaaga

SEQ ID NO: 551401 - RNA, 19 nt, Homo sapiens
ggaauuuacagguauggaa

SEQ ID NO: 551402 - RNA, 19 nt, Homo sapiens
uggaagaguugaguuuauu

SEQ ID NO: 551403 - RNA, 19 nt, Homo sapiens
gacgcaagauugaaguaga

SEQ ID NO: 551404 - RNA, 19 nt, Homo sapiens
ccagugaucccagauauug

SEQ ID NO: 551405 - RNA, 19 nt, Homo sapiens
gcugauaugcugcacugua

SEQ ID NO: 551406 - RNA, 19 nt, Homo sapiens
guagugagaaggaaguauu

SEQ ID NO: 551407 - RNA, 19 nt, Homo sapiens
acagcuaccuuacuuagau

SEQ ID NO: 551408 - RNA, 19 nt, Homo sapiens
uggcuuggauggacuuauu

SEQ ID NO: 551409 - RNA, 19 nt, Homo sapiens
aagggaaagucaugcuuaa

SEQ ID NO: 551410 - RNA, 19 nt, Homo sapiens
gauggagggugagcucuau

SEQ ID NO: 551411 - RNA, 19 nt, Homo sapiens
guccagcaccucuugguua

SEQ ID NO: 551412 - RNA, 19 nt, Homo sapiens
ccgguggccuucuuauaaa

SEQ ID NO: 551413 - RNA, 19 nt, Homo sapiens
caaagcguacuucacaauu

SEQ ID NO: 551414 - RNA, 19 nt, Homo sapiens
gccaauaacuuagaauggu

SEQ ID NO: 551415 - RNA, 19 nt, Homo sapiens
ggacaacaagaguuauaug

SEQ ID NO: 551416 - RNA, 19 nt, Homo sapiens
cauuaugucuguuccacaa

SEQ ID NO: 551417 - RNA, 19 nt, Homo sapiens
cagcaccucuugguuaaau

SEQ ID NO: 551418 - RNA, 19 nt, Homo sapiens
gagccgguuucuuauccua

SEQ ID NO: 551419 - RNA, 19 nt, Homo sapiens
aaaccacacaggcgaauuu

SEQ ID NO: 551420 - RNA, 19 nt, Homo sapiens
caucauacauacuuagaac

SEQ ID NO: 551421 - RNA, 19 nt, Homo sapiens
agucaaugccaauaacuua

SEQ ID NO: 551422 - RNA, 19 nt, Homo sapiens
aaagugaucaguauugguu

SEQ ID NO: 551423 - RNA, 19 nt, Homo sapiens
guagaaaccucgauauuga

SEQ ID NO: 551424 - RNA, 19 nt, Homo sapiens
gaacgucucucaguugauu

SEQ ID NO: 551425 - RNA, 19 nt, Homo sapiens
gcaacaaccucuccucuuc

SEQ ID NO: 551426 - RNA, 19 nt, Homo sapiens
caaagaagaugcugccaau

SEQ ID NO: 551427 - RNA, 19 nt, Homo sapiens
ggagaggaauacuaaaguu

SEQ ID NO: 551428 - RNA, 19 nt, Homo sapiens
ggacauggcugcccuugag

SEQ ID NO: 551429 - RNA, 19 nt, Homo sapiens
uaaaguauucccugucuua

SEQ ID NO: 551430 - RNA, 19 nt, Homo sapiens
guuguggucugaucaguua

SEQ ID NO: 551431 - RNA, 19 nt, Homo sapiens
guuaauaggucaaauugug

SEQ ID NO: 551432 - RNA, 19 nt, Homo sapiens
gaucaccaaugcuugcuuu

SEQ ID NO: 551433 - RNA, 19 nt, Homo sapiens
gagaggaauacuaaaguua

SEQ ID NO: 551434 - RNA, 19 nt, Homo sapiens
caaauuguguccuccauca

SEQ ID NO: 551435 - RNA, 19 nt, Homo sapiens
cagggaagcuuauucuguu

SEQ ID NO: 551436 - RNA, 19 nt, Homo sapiens
acaaugaggccaucuauga

SEQ ID NO: 551437 - RNA, 19 nt, Homo sapiens
ggucugaucaguuaauuug

SEQ ID NO: 551438 - RNA, 19 nt, Homo sapiens
aagaagaugcugccaauaa

SEQ ID NO: 551439 - RNA, 19 nt, Homo sapiens
gcagagaucaccaaugcuu

SEQ ID NO: 551440 - RNA, 19 nt, Homo sapiens
ggagaugauuccuucaaca

SEQ ID NO: 551441 - RNA, 19 nt, Homo sapiens
uagcagagaucaccaaugc

SEQ ID NO: 551442 - RNA, 19 nt, Homo sapiens
ccacaaguuugaccugaug

SEQ ID NO: 551443 - RNA, 19 nt, Homo sapiens
ugacagaauuccagaccaa

SEQ ID NO: 551444 - RNA, 19 nt, Homo sapiens
ggaagcuuauucuguuuua

SEQ ID NO: 551445 - RNA, 19 nt, Homo sapiens
caucacugcuucccugaga

SEQ ID NO: 551446 - RNA, 19 nt, Homo sapiens
cgagggcacuacaccauug

SEQ ID NO: 551447 - RNA, 19 nt, Homo sapiens
gauggagcccugaauguug

SEQ ID NO: 551448 - RNA, 19 nt, Homo sapiens
gaaggauuaugaggagguu

SEQ ID NO: 551449 - RNA, 19 nt, Homo sapiens
ggccaucuaugacaucugu

SEQ ID NO: 551450 - RNA, 19 nt, Homo sapiens
cauggaacgucucucaguu

SEQ ID NO: 551451 - RNA, 19 nt, Homo sapiens
ugacgugguucccaaagau

SEQ ID NO: 551452 - RNA, 19 nt, Homo sapiens
caaccuauacuaaccugaa

SEQ ID NO: 551453 - RNA, 19 nt, Homo sapiens
gagcguccaaccuauacua

SEQ ID NO: 551454 - RNA, 19 nt, Homo sapiens
uuacaucgaccgccuaaga

SEQ ID NO: 551455 - RNA, 19 nt, Homo sapiens
cguagaaaccucgauauug

SEQ ID NO: 551456 - RNA, 19 nt, Homo sapiens
gaacccacagucauugaug

SEQ ID NO: 551457 - RNA, 19 nt, Homo sapiens
gggcaguguuuguagacuu

SEQ ID NO: 551458 - RNA, 19 nt, Homo sapiens
gaaaaguuguggucugauc

SEQ ID NO: 551459 - RNA, 19 nt, Homo sapiens
uggaacgucucucaguuga

SEQ ID NO: 551460 - RNA, 19 nt, Homo sapiens
ggcaguguuuguagacuug

SEQ ID NO: 551461 - RNA, 19 nt, Homo sapiens
ucaacaccuucuucaguga

SEQ ID NO: 551462 - RNA, 19 nt, Homo sapiens
ugugauggguuuugaauaa

SEQ ID NO: 551463 - RNA, 19 nt, Homo sapiens
ugaaggagagggugaggaa

SEQ ID NO: 551464 - RNA, 19 nt, Homo sapiens
gcucauggaacgucucuca

SEQ ID NO: 551465 - RNA, 19 nt, Homo sapiens
agaagaugcugccaauaac

SEQ ID NO: 551466 - RNA, 19 nt, Homo sapiens
ccaagugacaagaccauug

SEQ ID NO: 551467 - RNA, 19 nt, Homo sapiens
caccaaugcuugcuuugag

SEQ ID NO: 551468 - RNA, 19 nt, Homo sapiens
ccuaagagucgcgcuguaa

SEQ ID NO: 551469 - RNA, 19 nt, Homo sapiens
ugauugugccuucauggua

SEQ ID NO: 551470 - RNA, 19 nt, Homo sapiens
uaagagucgcgcuguaaga

SEQ ID NO: 551471 - RNA, 19 nt, Homo sapiens
gugacgugguucccaaaga

SEQ ID NO: 551472 - RNA, 19 nt, Homo sapiens
gaagaugcugccaauaacu

SEQ ID NO: 551473 - RNA, 19 nt, Homo sapiens
uacaauuacugaccuaugc

SEQ ID NO: 551474 - RNA, 19 nt, Homo sapiens
gccuaagagucgcgcugua

SEQ ID NO: 551475 - RNA, 19 nt, Homo sapiens
gugccuuuguucacuggua

SEQ ID NO: 551476 - RNA, 19 nt, Homo sapiens
cugcuucccugagauuuga

SEQ ID NO: 551477 - RNA, 19 nt, Homo sapiens
ggagguugguguggauucu

SEQ ID NO: 551478 - RNA, 19 nt, Homo sapiens
gcagcaaccaugcgugagu

SEQ ID NO: 551479 - RNA, 19 nt, Homo sapiens
aagaugcugccaauaacua

SEQ ID NO: 551480 - RNA, 19 nt, Homo sapiens
caugaaugcuuuguuacag

SEQ ID NO: 551481 - RNA, 19 nt, Homo sapiens
caaguuugaccugauguau

SEQ ID NO: 551482 - RNA, 19 nt, Homo sapiens
auguugaccugacagaauu

SEQ ID NO: 551483 - RNA, 19 nt, Homo sapiens
gaauguugaccugacagaa

SEQ ID NO: 551484 - RNA, 19 nt, Homo sapiens
ggagcucuacugccuggaa

SEQ ID NO: 551485 - RNA, 19 nt, Homo sapiens
gugcaucuccauccacguu

SEQ ID NO: 551486 - RNA, 19 nt, Homo sapiens
aguauucccugucuuaaaa

SEQ ID NO: 551487 - RNA, 19 nt, Homo sapiens
ugaggagguugguguggau

SEQ ID NO: 551488 - RNA, 19 nt, Homo sapiens
caagugacaagaccauugg

SEQ ID NO: 551489 - RNA, 19 nt, Homo sapiens
ggccagaugccaagugaca

SEQ ID NO: 551490 - RNA, 19 nt, Homo sapiens
agacccaagcuguccauuu

SEQ ID NO: 551491 - RNA, 19 nt, Homo sapiens
ugauggagcccugaauguu

SEQ ID NO: 551492 - RNA, 19 nt, Homo sapiens
ucacugcuucccugagauu

SEQ ID NO: 551493 - RNA, 19 nt, Homo sapiens
agacaaugaggccaucuau

SEQ ID NO: 551494 - RNA, 19 nt, Homo sapiens
uguggauucuguugaagga

SEQ ID NO: 551495 - RNA, 19 nt, Homo sapiens
ucaccaaugcuugcuuuga

SEQ ID NO: 551496 - RNA, 19 nt, Homo sapiens
auggagcccugaauguuga

SEQ ID NO: 551497 - RNA, 19 nt, Homo sapiens
ugucguagaaaccucgaua

SEQ ID NO: 551498 - RNA, 19 nt, Homo sapiens
aaaguauucccugucuuaa

SEQ ID NO: 551499 - RNA, 19 nt, Homo sapiens
guggucugaucaguuaauu

SEQ ID NO: 551500 - RNA, 19 nt, Homo sapiens
agggaagcuuauucuguuu

SEQ ID NO: 551501 - RNA, 19 nt, Homo sapiens
ugguguggauucuguugaa

SEQ ID NO: 551502 - RNA, 19 nt, Homo sapiens
ucccaaagaugucaaugcu

SEQ ID NO: 551503 - RNA, 19 nt, Homo sapiens
gacaaugaggccaucuaug

SEQ ID NO: 551504 - RNA, 19 nt, Homo sapiens
aaagaagaugcugccaaua

SEQ ID NO: 551505 - RNA, 19 nt, Homo sapiens
auauugagcguccaaccua

SEQ ID NO: 551506 - RNA, 19 nt, Homo sapiens
augaaugcuuuguuacaga

SEQ ID NO: 551507 - RNA, 19 nt, Homo sapiens
ucguagaaaccucgauauu

SEQ ID NO: 551508 - RNA, 19 nt, Homo sapiens
ggaacccacagucauugau

SEQ ID NO: 551509 - RNA, 19 nt, Homo sapiens
gccuggaccacaaguuuga

SEQ ID NO: 551510 - RNA, 19 nt, Homo sapiens
gagaugauuccuucaacac

SEQ ID NO: 551511 - RNA, 19 nt, Homo sapiens
aguuugaccugauguaugc

SEQ ID NO: 551512 - RNA, 19 nt, Homo sapiens
ucgccuggaccacaaguuu

SEQ ID NO: 551513 - RNA, 19 nt, Homo sapiens
uauugagcguccaaccuau

SEQ ID NO: 551514 - RNA, 19 nt, Homo sapiens
uuccacagcuguaguugag

SEQ ID NO: 551515 - RNA, 19 nt, Homo sapiens
uuacagggaagcuuauucu

SEQ ID NO: 551516 - RNA, 19 nt, Homo sapiens
cuucaacaccuucuucagu

SEQ ID NO: 551517 - RNA, 19 nt, Homo sapiens
caggauagcugccgacuaa

SEQ ID NO: 551518 - RNA, 19 nt, Homo sapiens
ccagaacccuaccauguuu

SEQ ID NO: 551519 - RNA, 19 nt, Homo sapiens
agugucagcuccauuaaua

SEQ ID NO: 551520 - RNA, 19 nt, Homo sapiens
caucagaucuggccaugga

SEQ ID NO: 551521 - RNA, 19 nt, Homo sapiens
cauccggccuggagugaua

SEQ ID NO: 551522 - RNA, 19 nt, Homo sapiens
gaaaauggaugacagugau

SEQ ID NO: 551523 - RNA, 19 nt, Homo sapiens
ucacucacccuucgccaua

SEQ ID NO: 551524 - RNA, 19 nt, Homo sapiens
gguggcagauccucacuca

SEQ ID NO: 551525 - RNA, 19 nt, Homo sapiens
ccucacaacuccaucagau

SEQ ID NO: 551526 - RNA, 19 nt, Homo sapiens
ccaaggugguggagaagau

SEQ ID NO: 551527 - RNA, 19 nt, Homo sapiens
ccaaagugcagcaaccauu

SEQ ID NO: 551528 - RNA, 19 nt, Homo sapiens
ggaugacagugaucaggau

SEQ ID NO: 551529 - RNA, 19 nt, Homo sapiens
ggcaggaagugaauacucu

SEQ ID NO: 551530 - RNA, 19 nt, Homo sapiens
gccagaacccuaccauguu

SEQ ID NO: 551531 - RNA, 19 nt, Homo sapiens
guaaggcccugcgacaucu

SEQ ID NO: 551532 - RNA, 19 nt, Homo sapiens
gaugacagugaucaggaua

SEQ ID NO: 551533 - RNA, 19 nt, Homo sapiens
caaagugcagcaaccauuc

SEQ ID NO: 551534 - RNA, 19 nt, Homo sapiens
ggcgcaaccucucgacuca

SEQ ID NO: 551535 - RNA, 19 nt, Homo sapiens
gacuaagcauugacucaca

SEQ ID NO: 551536 - RNA, 19 nt, Homo sapiens
ucagcuccauuaauagaau

SEQ ID NO: 551537 - RNA, 19 nt, Homo sapiens
ccacugccacggccuuuga

SEQ ID NO: 551538 - RNA, 19 nt, Homo sapiens
gagggcgucugugacaaug

SEQ ID NO: 551539 - RNA, 19 nt, Homo sapiens
cauucaaccucccuaugga

SEQ ID NO: 551540 - RNA, 19 nt, Homo sapiens
ugaguuccccauauuauua

SEQ ID NO: 551541 - RNA, 19 nt, Homo sapiens
ccgcugcccuugcucaaca

SEQ ID NO: 551542 - RNA, 19 nt, Homo sapiens
cauuugagcggcagcacua

SEQ ID NO: 551543 - RNA, 19 nt, Homo sapiens
cccagugucagcuccauua

SEQ ID NO: 551544 - RNA, 19 nt, Homo sapiens
uauuacaguuccacaucaa

SEQ ID NO: 551545 - RNA, 19 nt, Homo sapiens
gcacuacccagaggccuau

SEQ ID NO: 551546 - RNA, 19 nt, Homo sapiens
ucacaacuccaucagaucu

SEQ ID NO: 551547 - RNA, 19 nt, Homo sapiens
ccacggccuuugaccaucu

SEQ ID NO: 551548 - RNA, 19 nt, Homo sapiens
gauagcugccgacuaagca

SEQ ID NO: 551549 - RNA, 19 nt, Homo sapiens
ggaaaauggaugacaguga

SEQ ID NO: 551550 - RNA, 19 nt, Homo sapiens
gcugagggcgucugugaca

SEQ ID NO: 551551 - RNA, 19 nt, Homo sapiens
cgccagaacccuaccaugu

SEQ ID NO: 551552 - RNA, 19 nt, Homo sapiens
gaagauuggggacuacaaa

SEQ ID NO: 551553 - RNA, 19 nt, Homo sapiens
uuauuacaguuccacauca

SEQ ID NO: 551554 - RNA, 19 nt, Homo sapiens
uugaccaucuguaguugaa

SEQ ID NO: 551555 - RNA, 19 nt, Homo sapiens
ugucagcuccauuaauaga

SEQ ID NO: 551556 - RNA, 19 nt, Homo sapiens
cccgagguguccaguucua

SEQ ID NO: 551557 - RNA, 19 nt, Homo sapiens
ccgcucgagugcccauuug

SEQ ID NO: 551558 - RNA, 19 nt, Homo sapiens
agaaucauccggaccaaag

SEQ ID NO: 551559 - RNA, 19 nt, Homo sapiens
ggaggggccuuugugaaug

SEQ ID NO: 551560 - RNA, 19 nt, Homo sapiens
gggcgucugugacaaugac

SEQ ID NO: 551561 - RNA, 19 nt, Homo sapiens
ggacuacaaacgccagaac

SEQ ID NO: 551562 - RNA, 19 nt, Homo sapiens
ccuuugaccaucuguaguu

SEQ ID NO: 551563 - RNA, 19 nt, Homo sapiens
ccagugucagcuccauuaa

SEQ ID NO: 551564 - RNA, 19 nt, Homo sapiens
uggcugagggcgucuguga

SEQ ID NO: 551565 - RNA, 19 nt, Homo sapiens
caaggugguggagaagauu

SEQ ID NO: 551566 - RNA, 19 nt, Homo sapiens
caugguggcaggaagugaa

SEQ ID NO: 551567 - RNA, 19 nt, Homo sapiens
acucacccuucgccauaaa

SEQ ID NO: 551568 - RNA, 19 nt, Homo sapiens
caggauagcugccgacuaa

SEQ ID NO: 551569 - RNA, 19 nt, Homo sapiens
ccagaacccuaccauguuu

SEQ ID NO: 551570 - RNA, 19 nt, Homo sapiens
agugucagcuccauuaaua

SEQ ID NO: 551571 - RNA, 19 nt, Homo sapiens
caucagaucuggccaugga

SEQ ID NO: 551572 - RNA, 19 nt, Homo sapiens
cauccggccuggagugaua

SEQ ID NO: 551573 - RNA, 19 nt, Homo sapiens
gaaaauggaugacagugau

SEQ ID NO: 551574 - RNA, 19 nt, Homo sapiens
ccucacaacuccaucagau

SEQ ID NO: 551575 - RNA, 19 nt, Homo sapiens
ccaaggugguggagaagau

SEQ ID NO: 551576 - RNA, 19 nt, Homo sapiens
ccaaagugcagcaaccauu

SEQ ID NO: 551577 - RNA, 19 nt, Homo sapiens
ggaugacagugaucaggau

SEQ ID NO: 551578 - RNA, 19 nt, Homo sapiens
ggcaggaagugaauacucu

SEQ ID NO: 551579 - RNA, 19 nt, Homo sapiens
gccagaacccuaccauguu

SEQ ID NO: 551580 - RNA, 19 nt, Homo sapiens
guaaggcccugcgacaucu

SEQ ID NO: 551581 - RNA, 19 nt, Homo sapiens
gaugacagugaucaggaua

SEQ ID NO: 551582 - RNA, 19 nt, Homo sapiens
caaagugcagcaaccauuc

SEQ ID NO: 551583 - RNA, 19 nt, Homo sapiens
ggcgcaaccucucgacuca

SEQ ID NO: 551584 - RNA, 19 nt, Homo sapiens
gacuaagcauugacucaca

SEQ ID NO: 551585 - RNA, 19 nt, Homo sapiens
ucagcuccauuaauagaau

SEQ ID NO: 551586 - RNA, 19 nt, Homo sapiens
ccacugccacggccuuuga

SEQ ID NO: 551587 - RNA, 19 nt, Homo sapiens
gagggcgucugugacaaug

SEQ ID NO: 551588 - RNA, 19 nt, Homo sapiens
cauucaaccucccuaugga

SEQ ID NO: 551589 - RNA, 19 nt, Homo sapiens
ugaguuccccauauuauua

SEQ ID NO: 551590 - RNA, 19 nt, Homo sapiens
ccgcugcccuugcucaaca

SEQ ID NO: 551591 - RNA, 19 nt, Homo sapiens
cauuugagcggcagcacua

SEQ ID NO: 551592 - RNA, 19 nt, Homo sapiens
cccagugucagcuccauua

SEQ ID NO: 551593 - RNA, 19 nt, Homo sapiens
uauuacaguuccacaucaa

SEQ ID NO: 551594 - RNA, 19 nt, Homo sapiens
gcacuacccagaggccuau

SEQ ID NO: 551595 - RNA, 19 nt, Homo sapiens
ucacaacuccaucagaucu

SEQ ID NO: 551596 - RNA, 19 nt, Homo sapiens
ccacggccuuugaccaucu

SEQ ID NO: 551597 - RNA, 19 nt, Homo sapiens
gauagcugccgacuaagca

SEQ ID NO: 551598 - RNA, 19 nt, Homo sapiens
ggaaaauggaugacaguga

SEQ ID NO: 551599 - RNA, 19 nt, Homo sapiens
gcugagggcgucugugaca

SEQ ID NO: 551600 - RNA, 19 nt, Homo sapiens
cgccagaacccuaccaugu

SEQ ID NO: 551601 - RNA, 19 nt, Homo sapiens
gaagauuggggacuacaaa

SEQ ID NO: 551602 - RNA, 19 nt, Homo sapiens
uuauuacaguuccacauca

SEQ ID NO: 551603 - RNA, 19 nt, Homo sapiens
uugaccaucuguaguugaa

SEQ ID NO: 551604 - RNA, 19 nt, Homo sapiens
ugucagcuccauuaauaga

SEQ ID NO: 551605 - RNA, 19 nt, Homo sapiens
ccgcucgagugcccauuug

SEQ ID NO: 551606 - RNA, 19 nt, Homo sapiens
agaaucauccggaccaaag

SEQ ID NO: 551607 - RNA, 19 nt, Homo sapiens
ggaggggccuuugugaaug

SEQ ID NO: 551608 - RNA, 19 nt, Homo sapiens
gggcgucugugacaaugac

SEQ ID NO: 551609 - RNA, 19 nt, Homo sapiens
ggacuacaaacgccagaac

SEQ ID NO: 551610 - RNA, 19 nt, Homo sapiens
ccuuugaccaucuguaguu

SEQ ID NO: 551611 - RNA, 19 nt, Homo sapiens
ccagugucagcuccauuaa

SEQ ID NO: 551612 - RNA, 19 nt, Homo sapiens
uggcugagggcgucuguga

SEQ ID NO: 551613 - RNA, 19 nt, Homo sapiens
caaggugguggagaagauu

SEQ ID NO: 551614 - RNA, 19 nt, Homo sapiens
caugguggcaggaagugaa

SEQ ID NO: 551615 - RNA, 19 nt, Homo sapiens
caggauagcugccgacuaa

SEQ ID NO: 551616 - RNA, 19 nt, Homo sapiens
ccagaacccuaccauguuu

SEQ ID NO: 551617 - RNA, 19 nt, Homo sapiens
agugucagcuccauuaaua

SEQ ID NO: 551618 - RNA, 19 nt, Homo sapiens
caucagaucuggccaugga

SEQ ID NO: 551619 - RNA, 19 nt, Homo sapiens
cauccggccuggagugaua

SEQ ID NO: 551620 - RNA, 19 nt, Homo sapiens
gaaaauggaugacagugau

SEQ ID NO: 551621 - RNA, 19 nt, Homo sapiens
ccucacaacuccaucagau

SEQ ID NO: 551622 - RNA, 19 nt, Homo sapiens
ccaaggugguggagaagau

SEQ ID NO: 551623 - RNA, 19 nt, Homo sapiens
ccaaagugcagcaaccauu

SEQ ID NO: 551624 - RNA, 19 nt, Homo sapiens
ggaugacagugaucaggau

SEQ ID NO: 551625 - RNA, 19 nt, Homo sapiens
ggcaggaagugaauacucu

SEQ ID NO: 551626 - RNA, 19 nt, Homo sapiens
gccagaacccuaccauguu

SEQ ID NO: 551627 - RNA, 19 nt, Homo sapiens
guaaggcccugcgacaucu

SEQ ID NO: 551628 - RNA, 19 nt, Homo sapiens
gaugacagugaucaggaua

SEQ ID NO: 551629 - RNA, 19 nt, Homo sapiens
caaagugcagcaaccauuc

SEQ ID NO: 551630 - RNA, 19 nt, Homo sapiens
ggcgcaaccucucgacuca

SEQ ID NO: 551631 - RNA, 19 nt, Homo sapiens
gacuaagcauugacucaca

SEQ ID NO: 551632 - RNA, 19 nt, Homo sapiens
ucagcuccauuaauagaau

SEQ ID NO: 551633 - RNA, 19 nt, Homo sapiens
ccacugccacggccuuuga

SEQ ID NO: 551634 - RNA, 19 nt, Homo sapiens
gagggcgucugugacaaug

SEQ ID NO: 551635 - RNA, 19 nt, Homo sapiens
cauucaaccucccuaugga

SEQ ID NO: 551636 - RNA, 19 nt, Homo sapiens
ugaguuccccauauuauua

SEQ ID NO: 551637 - RNA, 19 nt, Homo sapiens
ccgcugcccuugcucaaca

SEQ ID NO: 551638 - RNA, 19 nt, Homo sapiens
cauuugagcggcagcacua

SEQ ID NO: 551639 - RNA, 19 nt, Homo sapiens
cccagugucagcuccauua

SEQ ID NO: 551640 - RNA, 19 nt, Homo sapiens
uauuacaguuccacaucaa

SEQ ID NO: 551641 - RNA, 19 nt, Homo sapiens
gcacuacccagaggccuau

SEQ ID NO: 551642 - RNA, 19 nt, Homo sapiens
ucacaacuccaucagaucu

SEQ ID NO: 551643 - RNA, 19 nt, Homo sapiens
ccacggccuuugaccaucu

SEQ ID NO: 551644 - RNA, 19 nt, Homo sapiens
gauagcugccgacuaagca

SEQ ID NO: 551645 - RNA, 19 nt, Homo sapiens
ggaaaauggaugacaguga

SEQ ID NO: 551646 - RNA, 19 nt, Homo sapiens
gcugagggcgucugugaca

SEQ ID NO: 551647 - RNA, 19 nt, Homo sapiens
cgccagaacccuaccaugu

SEQ ID NO: 551648 - RNA, 19 nt, Homo sapiens
gaagauuggggacuacaaa

SEQ ID NO: 551649 - RNA, 19 nt, Homo sapiens
uuauuacaguuccacauca

SEQ ID NO: 551650 - RNA, 19 nt, Homo sapiens
ugucagcuccauuaauaga

SEQ ID NO: 551651 - RNA, 19 nt, Homo sapiens
ccgcucgagugcccauuug

SEQ ID NO: 551652 - RNA, 19 nt, Homo sapiens
agaaucauccggaccaaag

SEQ ID NO: 551653 - RNA, 19 nt, Homo sapiens
ggaggggccuuugugaaug

SEQ ID NO: 551654 - RNA, 19 nt, Homo sapiens
gggcgucugugacaaugac

SEQ ID NO: 551655 - RNA, 19 nt, Homo sapiens
ggacuacaaacgccagaac

SEQ ID NO: 551656 - RNA, 19 nt, Homo sapiens
ccuuugaccaucuguaguu

SEQ ID NO: 551657 - RNA, 19 nt, Homo sapiens
ccagugucagcuccauuaa

SEQ ID NO: 551658 - RNA, 19 nt, Homo sapiens
uggcugagggcgucuguga

SEQ ID NO: 551659 - RNA, 19 nt, Homo sapiens
caugguggcaggaagugaa

SEQ ID NO: 551660 - RNA, 19 nt, Homo sapiens
caaggugguggagaagauu

SEQ ID NO: 551661 - RNA, 19 nt, Homo sapiens
caggauagcugccgacuaa

SEQ ID NO: 551662 - RNA, 19 nt, Homo sapiens
ccagaacccuaccauguuu

SEQ ID NO: 551663 - RNA, 19 nt, Homo sapiens
agugucagcuccauuaaua

SEQ ID NO: 551664 - RNA, 19 nt, Homo sapiens
caucagaucuggccaugga

SEQ ID NO: 551665 - RNA, 19 nt, Homo sapiens
cauccggccuggagugaua

SEQ ID NO: 551666 - RNA, 19 nt, Homo sapiens
gaaaauggaugacagugau

SEQ ID NO: 551667 - RNA, 19 nt, Homo sapiens
ccucacaacuccaucagau

SEQ ID NO: 551668 - RNA, 19 nt, Homo sapiens
ccaaggugguggagaagau

SEQ ID NO: 551669 - RNA, 19 nt, Homo sapiens
ccaaagugcagcaaccauu

SEQ ID NO: 551670 - RNA, 19 nt, Homo sapiens
ggaugacagugaucaggau

SEQ ID NO: 551671 - RNA, 19 nt, Homo sapiens
ggcaggaagugaauacucu

SEQ ID NO: 551672 - RNA, 19 nt, Homo sapiens
gccagaacccuaccauguu

SEQ ID NO: 551673 - RNA, 19 nt, Homo sapiens
guaaggcccugcgacaucu

SEQ ID NO: 551674 - RNA, 19 nt, Homo sapiens
gaugacagugaucaggaua

SEQ ID NO: 551675 - RNA, 19 nt, Homo sapiens
caaagugcagcaaccauuc

SEQ ID NO: 551676 - RNA, 19 nt, Homo sapiens
gacuaagcauugacucaca

SEQ ID NO: 551677 - RNA, 19 nt, Homo sapiens
ucagcuccauuaauagaau

SEQ ID NO: 551678 - RNA, 19 nt, Homo sapiens
ccacugccacggccuuuga

SEQ ID NO: 551679 - RNA, 19 nt, Homo sapiens
gagggcgucugugacaaug

SEQ ID NO: 551680 - RNA, 19 nt, Homo sapiens
cauucaaccucccuaugga

SEQ ID NO: 551681 - RNA, 19 nt, Homo sapiens
ugaguuccccauauuauua

SEQ ID NO: 551682 - RNA, 19 nt, Homo sapiens
cauuugagcggcagcacua

SEQ ID NO: 551683 - RNA, 19 nt, Homo sapiens
cccagugucagcuccauua

SEQ ID NO: 551684 - RNA, 19 nt, Homo sapiens
uauuacaguuccacaucaa

SEQ ID NO: 551685 - RNA, 19 nt, Homo sapiens
gcacuacccagaggccuau

SEQ ID NO: 551686 - RNA, 19 nt, Homo sapiens
ucacaacuccaucagaucu

SEQ ID NO: 551687 - RNA, 19 nt, Homo sapiens
ccacggccuuugaccaucu

SEQ ID NO: 551688 - RNA, 19 nt, Homo sapiens
gauagcugccgacuaagca

SEQ ID NO: 551689 - RNA, 19 nt, Homo sapiens
ggaaaauggaugacaguga

SEQ ID NO: 551690 - RNA, 19 nt, Homo sapiens
gcugagggcgucugugaca

SEQ ID NO: 551691 - RNA, 19 nt, Homo sapiens
cgccagaacccuaccaugu

SEQ ID NO: 551692 - RNA, 19 nt, Homo sapiens
gaagauuggggacuacaaa

SEQ ID NO: 551693 - RNA, 19 nt, Homo sapiens
uuauuacaguuccacauca

SEQ ID NO: 551694 - RNA, 19 nt, Homo sapiens
ugucagcuccauuaauaga

SEQ ID NO: 551695 - RNA, 19 nt, Homo sapiens
gagcagggcgagagauggu

SEQ ID NO: 551696 - RNA, 19 nt, Homo sapiens
ccgcucgagugcccauuug

SEQ ID NO: 551697 - RNA, 19 nt, Homo sapiens
agaaucauccggaccaaag

SEQ ID NO: 551698 - RNA, 19 nt, Homo sapiens
ggaggggccuuugugaaug

SEQ ID NO: 551699 - RNA, 19 nt, Homo sapiens
gggcgucugugacaaugac

SEQ ID NO: 551700 - RNA, 19 nt, Homo sapiens
ggacuacaaacgccagaac

SEQ ID NO: 551701 - RNA, 19 nt, Homo sapiens
ccuuugaccaucuguaguu

SEQ ID NO: 551702 - RNA, 19 nt, Homo sapiens
ccagugucagcuccauuaa

SEQ ID NO: 551703 - RNA, 19 nt, Homo sapiens
uggcugagggcgucuguga

SEQ ID NO: 551704 - RNA, 19 nt, Homo sapiens
caaggugguggagaagauu

SEQ ID NO: 551705 - RNA, 19 nt, Homo sapiens
caugguggcaggaagugaa

SEQ ID NO: 551706 - RNA, 19 nt, Homo sapiens
caggauagcugccgacuaa

SEQ ID NO: 551707 - RNA, 19 nt, Homo sapiens
ccagaacccuaccauguuu

SEQ ID NO: 551708 - RNA, 19 nt, Homo sapiens
agugucagcuccauuaaua

SEQ ID NO: 551709 - RNA, 19 nt, Homo sapiens
caucagaucuggccaugga

SEQ ID NO: 551710 - RNA, 19 nt, Homo sapiens
cauccggccuggagugaua

SEQ ID NO: 551711 - RNA, 19 nt, Homo sapiens
gaaaauggaugacagugau

SEQ ID NO: 551712 - RNA, 19 nt, Homo sapiens
ccucacaacuccaucagau

SEQ ID NO: 551713 - RNA, 19 nt, Homo sapiens
ccaaggugguggagaagau

SEQ ID NO: 551714 - RNA, 19 nt, Homo sapiens
ccaaagugcagcaaccauu

SEQ ID NO: 551715 - RNA, 19 nt, Homo sapiens
ggaugacagugaucaggau

SEQ ID NO: 551716 - RNA, 19 nt, Homo sapiens
gccagaacccuaccauguu

SEQ ID NO: 551717 - RNA, 19 nt, Homo sapiens
guaaggcccugcgacaucu

SEQ ID NO: 551718 - RNA, 19 nt, Homo sapiens
gaugacagugaucaggaua

SEQ ID NO: 551719 - RNA, 19 nt, Homo sapiens
caaagugcagcaaccauuc

SEQ ID NO: 551720 - RNA, 19 nt, Homo sapiens
gacuaagcauugacucaca

SEQ ID NO: 551721 - RNA, 19 nt, Homo sapiens
ucagcuccauuaauagaau

SEQ ID NO: 551722 - RNA, 19 nt, Homo sapiens
ccacugccacggccuuuga

SEQ ID NO: 551723 - RNA, 19 nt, Homo sapiens
gagggcgucugugacaaug

SEQ ID NO: 551724 - RNA, 19 nt, Homo sapiens
cauucaaccucccuaugga

SEQ ID NO: 551725 - RNA, 19 nt, Homo sapiens
ugaguuccccauauuauua

SEQ ID NO: 551726 - RNA, 19 nt, Homo sapiens
cauuugagcggcagcacua

SEQ ID NO: 551727 - RNA, 19 nt, Homo sapiens
cccagugucagcuccauua

SEQ ID NO: 551728 - RNA, 19 nt, Homo sapiens
uauuacaguuccacaucaa

SEQ ID NO: 551729 - RNA, 19 nt, Homo sapiens
gcacuacccagaggccuau

SEQ ID NO: 551730 - RNA, 19 nt, Homo sapiens
ucacaacuccaucagaucu

SEQ ID NO: 551731 - RNA, 19 nt, Homo sapiens
ccacggccuuugaccaucu

SEQ ID NO: 551732 - RNA, 19 nt, Homo sapiens
gauagcugccgacuaagca

SEQ ID NO: 551733 - RNA, 19 nt, Homo sapiens
ggaaaauggaugacaguga

SEQ ID NO: 551734 - RNA, 19 nt, Homo sapiens
gcugagggcgucugugaca

SEQ ID NO: 551735 - RNA, 19 nt, Homo sapiens
cgccagaacccuaccaugu

SEQ ID NO: 551736 - RNA, 19 nt, Homo sapiens
gaagauuggggacuacaaa

SEQ ID NO: 551737 - RNA, 19 nt, Homo sapiens
uuauuacaguuccacauca

SEQ ID NO: 551738 - RNA, 19 nt, Homo sapiens
gagcaggaagugaauacuc

SEQ ID NO: 551739 - RNA, 19 nt, Homo sapiens
ugucagcuccauuaauaga

SEQ ID NO: 551740 - RNA, 19 nt, Homo sapiens
caaaggcgagcaggaagug

SEQ ID NO: 551741 - RNA, 19 nt, Homo sapiens
caccaaaggcgagcaggaa

SEQ ID NO: 551742 - RNA, 19 nt, Homo sapiens
ccgcucgagugcccauuug

SEQ ID NO: 551743 - RNA, 19 nt, Homo sapiens
agaaucauccggaccaaag

SEQ ID NO: 551744 - RNA, 19 nt, Homo sapiens
ggaggggccuuugugaaug

SEQ ID NO: 551745 - RNA, 19 nt, Homo sapiens
gggcgucugugacaaugac

SEQ ID NO: 551746 - RNA, 19 nt, Homo sapiens
ggacuacaaacgccagaac

SEQ ID NO: 551747 - RNA, 19 nt, Homo sapiens
ccuuugaccaucuguaguu

SEQ ID NO: 551748 - RNA, 19 nt, Homo sapiens
ccagugucagcuccauuaa

SEQ ID NO: 551749 - RNA, 19 nt, Homo sapiens
uggcugagggcgucuguga

SEQ ID NO: 551750 - RNA, 19 nt, Homo sapiens
caaggugguggagaagauu

SEQ ID NO: 551751 - RNA, 19 nt, Homo sapiens
ccaaaggcgagcaggaagu

SEQ ID NO: 551752 - RNA, 19 nt, Homo sapiens
gaagagaccauuccuguga

SEQ ID NO: 551753 - RNA, 19 nt, Homo sapiens
guacaaggauucucuucuu

SEQ ID NO: 551754 - RNA, 19 nt, Homo sapiens
ggaagaugcuggcuauuac

SEQ ID NO: 551755 - RNA, 19 nt, Homo sapiens
ucacuggccuucuugguuu

SEQ ID NO: 551756 - RNA, 19 nt, Homo sapiens
ggauaaagacaaugagaaa

SEQ ID NO: 551757 - RNA, 19 nt, Homo sapiens
gaaaugcuucuuacuguga

SEQ ID NO: 551758 - RNA, 19 nt, Homo sapiens
caacaucacuaggaguauu

SEQ ID NO: 551759 - RNA, 19 nt, Homo sapiens
ggguauaaaucccugcuuu

SEQ ID NO: 551760 - RNA, 19 nt, Homo sapiens
gcuauggccucaucaucaa

SEQ ID NO: 551761 - RNA, 19 nt, Homo sapiens
gccagaagcugccgguuuc

SEQ ID NO: 551762 - RNA, 19 nt, Homo sapiens
gagaggauuugcacaugga

SEQ ID NO: 551763 - RNA, 19 nt, Homo sapiens
gaaguugucaggagcaaug

SEQ ID NO: 551764 - RNA, 19 nt, Homo sapiens
gaccauuccugugaucauu

SEQ ID NO: 551765 - RNA, 19 nt, Homo sapiens
gcccugaccugagugaauu

SEQ ID NO: 551766 - RNA, 19 nt, Homo sapiens
ucaauccuaucccaaguga

SEQ ID NO: 551767 - RNA, 19 nt, Homo sapiens
uacaaggauucucuucuuu

SEQ ID NO: 551768 - RNA, 19 nt, Homo sapiens
uggaagaugcuggcuauua

SEQ ID NO: 551769 - RNA, 19 nt, Homo sapiens
gaagaagagacacggaugu

SEQ ID NO: 551770 - RNA, 19 nt, Homo sapiens
ccaaugacacccacauaga

SEQ ID NO: 551771 - RNA, 19 nt, Homo sapiens
gacugacaaucccguguaa

SEQ ID NO: 551772 - RNA, 19 nt, Homo sapiens
ucaagacuuucaauccuau

SEQ ID NO: 551773 - RNA, 19 nt, Homo sapiens
gcaaacacagaacuggaaa

SEQ ID NO: 551774 - RNA, 19 nt, Homo sapiens
ggaaccggcacacccuuaa

SEQ ID NO: 551775 - RNA, 19 nt, Homo sapiens
caauacaacaucacuagga

SEQ ID NO: 551776 - RNA, 19 nt, Homo sapiens
ccuggaagaugcuggcuau

SEQ ID NO: 551777 - RNA, 19 nt, Homo sapiens
caagagaggauuugcacau

SEQ ID NO: 551778 - RNA, 19 nt, Homo sapiens
ugacaaaacugacgugaag

SEQ ID NO: 551779 - RNA, 19 nt, Homo sapiens
gcaccuacgucugcacuac

SEQ ID NO: 551780 - RNA, 19 nt, Homo sapiens
gggaaccggcacacccuua

SEQ ID NO: 551781 - RNA, 19 nt, Homo sapiens
ggccagcaauacaacauca

SEQ ID NO: 551782 - RNA, 19 nt, Homo sapiens
gaaaucccagcucccaaga

SEQ ID NO: 551783 - RNA, 19 nt, Homo sapiens
ccaggaauauucagaaaau

SEQ ID NO: 551784 - RNA, 19 nt, Homo sapiens
ccaagugaaauaaauggaa

SEQ ID NO: 551785 - RNA, 19 nt, Homo sapiens
aauccuaucccaagugaaa

SEQ ID NO: 551786 - RNA, 19 nt, Homo sapiens
caucaagacuuucaauccu

SEQ ID NO: 551787 - RNA, 19 nt, Homo sapiens
cgucugcacuacuagaaau

SEQ ID NO: 551788 - RNA, 19 nt, Homo sapiens
acacagaacuggaaaagca

SEQ ID NO: 551789 - RNA, 19 nt, Homo sapiens
uacaacaucacuaggagua

SEQ ID NO: 551790 - RNA, 19 nt, Homo sapiens
caaggauucucuucuuuug

SEQ ID NO: 551791 - RNA, 19 nt, Homo sapiens
gcuuguacguguugguaau

SEQ ID NO: 551792 - RNA, 19 nt, Homo sapiens
cgccaggaauauucagaaa

SEQ ID NO: 551793 - RNA, 19 nt, Homo sapiens
cacagacggugcaaacaca

SEQ ID NO: 551794 - RNA, 19 nt, Homo sapiens
ggccaaugacacccacaua

SEQ ID NO: 551795 - RNA, 19 nt, Homo sapiens
gagcuacgcaucaagaaaa

SEQ ID NO: 551796 - RNA, 19 nt, Homo sapiens
ccauugagcucagaguuuu

SEQ ID NO: 551797 - RNA, 19 nt, Homo sapiens
caaccugacauggcauaaa

SEQ ID NO: 551798 - RNA, 19 nt, Homo sapiens
acacuacgcaccacaguca

SEQ ID NO: 551799 - RNA, 19 nt, Homo sapiens
cauaauacccugaguuuuc

SEQ ID NO: 551800 - RNA, 19 nt, Homo sapiens
uccauaauacccugaguuu

SEQ ID NO: 551801 - RNA, 19 nt, Homo sapiens
aagagaggauuugcacaug

SEQ ID NO: 551802 - RNA, 19 nt, Homo sapiens
acauugaagugccauugau

SEQ ID NO: 551803 - RNA, 19 nt, Homo sapiens
gcacacccuuaaccaccau

SEQ ID NO: 551804 - RNA, 19 nt, Homo sapiens
ccauuccugugaucauuuc

SEQ ID NO: 551805 - RNA, 19 nt, Homo sapiens
agacugacaaucccgugua

SEQ ID NO: 551806 - RNA, 19 nt, Homo sapiens
ccugacauuugcccaugaa

SEQ ID NO: 551807 - RNA, 19 nt, Homo sapiens
gaccacucacuuacucgua

SEQ ID NO: 551808 - RNA, 19 nt, Homo sapiens
ucucauacccgcaaauuuu

SEQ ID NO: 551809 - RNA, 19 nt, Homo sapiens
gcgcuuguacguguuggua

SEQ ID NO: 551810 - RNA, 19 nt, Homo sapiens
caaugacacccacauagag

SEQ ID NO: 551811 - RNA, 19 nt, Homo sapiens
gccaaugacacccacauag

SEQ ID NO: 551812 - RNA, 19 nt, Homo sapiens
ggucucaguccuccacuuc

SEQ ID NO: 551813 - RNA, 19 nt, Homo sapiens
caugaaggccagcaauaca

SEQ ID NO: 551814 - RNA, 19 nt, Homo sapiens
gacaccacccgguuaggaa

SEQ ID NO: 551815 - RNA, 19 nt, Homo sapiens
caucucauacccgcaaauu

SEQ ID NO: 551816 - RNA, 19 nt, Homo sapiens
gucaaccucugggguauua

SEQ ID NO: 551817 - RNA, 19 nt, Homo sapiens
gacggucccaggagaagaa

SEQ ID NO: 551818 - RNA, 19 nt, Homo sapiens
aucaagacuuucaauccua

SEQ ID NO: 551819 - RNA, 19 nt, Homo sapiens
ugagaacuacauugaagug

SEQ ID NO: 551820 - RNA, 19 nt, Homo sapiens
gaagccuccuccacguucu

SEQ ID NO: 551821 - RNA, 19 nt, Homo sapiens
cagcaauacaacaucacua

SEQ ID NO: 551822 - RNA, 19 nt, Homo sapiens
cccaugaaggccagcaaua

SEQ ID NO: 551823 - RNA, 19 nt, Homo sapiens
gauguggcccuggaagaug

SEQ ID NO: 551824 - RNA, 19 nt, Homo sapiens
aggauuugcacauggauuu

SEQ ID NO: 551825 - RNA, 19 nt, Homo sapiens
ggccacgccaggaauauuc

SEQ ID NO: 551826 - RNA, 19 nt, Homo sapiens
gaaggccagcaauacaaca

SEQ ID NO: 551827 - RNA, 19 nt, Homo sapiens
gaggauuugcacauggauu

SEQ ID NO: 551828 - RNA, 19 nt, Homo sapiens
cauugaagugccauugauu

SEQ ID NO: 551829 - RNA, 19 nt, Homo sapiens
cacuaggaguauugagcua

SEQ ID NO: 551830 - RNA, 19 nt, Homo sapiens
uggauaaagacaaugagaa

SEQ ID NO: 551831 - RNA, 19 nt, Homo sapiens
aguaugcccugaccugagu

SEQ ID NO: 551832 - RNA, 19 nt, Homo sapiens
caggugcccuacugguugu

SEQ ID NO: 551833 - RNA, 19 nt, Homo sapiens
caucaucaagacuuucaau

SEQ ID NO: 551834 - RNA, 19 nt, Homo sapiens
guugucaggagcaauguug

SEQ ID NO: 551835 - RNA, 19 nt, Homo sapiens
ugagcuacgcaucaagaaa

SEQ ID NO: 551836 - RNA, 19 nt, Homo sapiens
ccacucacuuacucguaca

SEQ ID NO: 551837 - RNA, 19 nt, Homo sapiens
aaccugacauggcauaaaa

SEQ ID NO: 551838 - RNA, 19 nt, Homo sapiens
gggaauauggaugcacaga

SEQ ID NO: 551839 - RNA, 19 nt, Homo sapiens
cacuuucacuggccuucuu

SEQ ID NO: 551840 - RNA, 19 nt, Homo sapiens
ugugguggacggccaauga

SEQ ID NO: 551841 - RNA, 19 nt, Homo sapiens
gaagauucaaugguacaag

SEQ ID NO: 551842 - RNA, 19 nt, Homo sapiens
ugccagaagcugccgguuu

SEQ ID NO: 551843 - RNA, 19 nt, Homo sapiens
ugacaccacccgguuagga

SEQ ID NO: 551844 - RNA, 19 nt, Homo sapiens
gaagagaccauuccuguga

SEQ ID NO: 551845 - RNA, 19 nt, Homo sapiens
guacaaggauucucuucuu

SEQ ID NO: 551846 - RNA, 19 nt, Homo sapiens
ggaagaugcuggcuauuac

SEQ ID NO: 551847 - RNA, 19 nt, Homo sapiens
ucacuggccuucuugguuu

SEQ ID NO: 551848 - RNA, 19 nt, Homo sapiens
ggauaaagacaaugagaaa

SEQ ID NO: 551849 - RNA, 19 nt, Homo sapiens
gaaaugcuucuuacuguga

SEQ ID NO: 551850 - RNA, 19 nt, Homo sapiens
caacaucacuaggaguauu

SEQ ID NO: 551851 - RNA, 19 nt, Homo sapiens
gaaggaagacuuuaaagcu

SEQ ID NO: 551852 - RNA, 19 nt, Homo sapiens
gcuauggccucaucaucaa

SEQ ID NO: 551853 - RNA, 19 nt, Homo sapiens
gccagaagcugccgguuuc

SEQ ID NO: 551854 - RNA, 19 nt, Homo sapiens
gagaggauuugcacaugga

SEQ ID NO: 551855 - RNA, 19 nt, Homo sapiens
gaugggagauacuguugug

SEQ ID NO: 551856 - RNA, 19 nt, Homo sapiens
gaaguugucaggagcaaug

SEQ ID NO: 551857 - RNA, 19 nt, Homo sapiens
gaccauuccugugaucauu

SEQ ID NO: 551858 - RNA, 19 nt, Homo sapiens
gcccugaccugagugaauu

SEQ ID NO: 551859 - RNA, 19 nt, Homo sapiens
ucaauccuaucccaaguga

SEQ ID NO: 551860 - RNA, 19 nt, Homo sapiens
uacaaggauucucuucuuu

SEQ ID NO: 551861 - RNA, 19 nt, Homo sapiens
gaaaauacauucugcuacu

SEQ ID NO: 551862 - RNA, 19 nt, Homo sapiens
uggaagaugcuggcuauua

SEQ ID NO: 551863 - RNA, 19 nt, Homo sapiens
gaagaagagacacggaugu

SEQ ID NO: 551864 - RNA, 19 nt, Homo sapiens
ccaaugacacccacauaga

SEQ ID NO: 551865 - RNA, 19 nt, Homo sapiens
gacugacaaucccguguaa

SEQ ID NO: 551866 - RNA, 19 nt, Homo sapiens
ucaagacuuucaauccuau

SEQ ID NO: 551867 - RNA, 19 nt, Homo sapiens
gcaaacacagaacuggaaa

SEQ ID NO: 551868 - RNA, 19 nt, Homo sapiens
ggaaccggcacacccuuaa

SEQ ID NO: 551869 - RNA, 19 nt, Homo sapiens
caauacaacaucacuagga

SEQ ID NO: 551870 - RNA, 19 nt, Homo sapiens
ccuggaagaugcuggcuau

SEQ ID NO: 551871 - RNA, 19 nt, Homo sapiens
uagugacgcucauacaaau

SEQ ID NO: 551872 - RNA, 19 nt, Homo sapiens
caagagaggauuugcacau

SEQ ID NO: 551873 - RNA, 19 nt, Homo sapiens
ugacaaaacugacgugaag

SEQ ID NO: 551874 - RNA, 19 nt, Homo sapiens
gcaccuacgucugcacuac

SEQ ID NO: 551875 - RNA, 19 nt, Homo sapiens
gggaaccggcacacccuua

SEQ ID NO: 551876 - RNA, 19 nt, Homo sapiens
ggccagcaauacaacauca

SEQ ID NO: 551877 - RNA, 19 nt, Homo sapiens
gcucauacaaaucaacaga

SEQ ID NO: 551878 - RNA, 19 nt, Homo sapiens
ccaggaauauucagaaaau

SEQ ID NO: 551879 - RNA, 19 nt, Homo sapiens
ccaagugaaauaaauggaa

SEQ ID NO: 551880 - RNA, 19 nt, Homo sapiens
aauccuaucccaagugaaa

SEQ ID NO: 551881 - RNA, 19 nt, Homo sapiens
caucaagacuuucaauccu

SEQ ID NO: 551882 - RNA, 19 nt, Homo sapiens
cuagugacgcucauacaaa

SEQ ID NO: 551883 - RNA, 19 nt, Homo sapiens
cgucugcacuacuagaaau

SEQ ID NO: 551884 - RNA, 19 nt, Homo sapiens
acacagaacuggaaaagca

SEQ ID NO: 551885 - RNA, 19 nt, Homo sapiens
uacaacaucacuaggagua

SEQ ID NO: 551886 - RNA, 19 nt, Homo sapiens
caaggauucucuucuuuug

SEQ ID NO: 551887 - RNA, 19 nt, Homo sapiens
gcuuguacguguugguaau

SEQ ID NO: 551888 - RNA, 19 nt, Homo sapiens
cgccaggaauauucagaaa

SEQ ID NO: 551889 - RNA, 19 nt, Homo sapiens
cacagacggugcaaacaca

SEQ ID NO: 551890 - RNA, 19 nt, Homo sapiens
ggccaaugacacccacaua

SEQ ID NO: 551891 - RNA, 19 nt, Homo sapiens
gagcuacgcaucaagaaaa

SEQ ID NO: 551892 - RNA, 19 nt, Homo sapiens
ccauugagcucagaguuuu

SEQ ID NO: 551893 - RNA, 19 nt, Homo sapiens
caaccugacauggcauaaa

SEQ ID NO: 551894 - RNA, 19 nt, Homo sapiens
acacuacgcaccacaguca

SEQ ID NO: 551895 - RNA, 19 nt, Homo sapiens
cauaauacccugaguuuuc

SEQ ID NO: 551896 - RNA, 19 nt, Homo sapiens
uccauaauacccugaguuu

SEQ ID NO: 551897 - RNA, 19 nt, Homo sapiens
aagagaggauuugcacaug

SEQ ID NO: 551898 - RNA, 19 nt, Homo sapiens
acauugaagugccauugau

SEQ ID NO: 551899 - RNA, 19 nt, Homo sapiens
gcacacccuuaaccaccau

SEQ ID NO: 551900 - RNA, 19 nt, Homo sapiens
ccauuccugugaucauuuc

SEQ ID NO: 551901 - RNA, 19 nt, Homo sapiens
agacugacaaucccgugua

SEQ ID NO: 551902 - RNA, 19 nt, Homo sapiens
ccugacauuugcccaugaa

SEQ ID NO: 551903 - RNA, 19 nt, Homo sapiens
gaccacucacuuacucgua

SEQ ID NO: 551904 - RNA, 19 nt, Homo sapiens
ucucauacccgcaaauuuu

SEQ ID NO: 551905 - RNA, 19 nt, Homo sapiens
caaugacacccacauagag

SEQ ID NO: 551906 - RNA, 19 nt, Homo sapiens
acauucugcuacucuuaaa

SEQ ID NO: 551907 - RNA, 19 nt, Homo sapiens
gccaaugacacccacauag

SEQ ID NO: 551908 - RNA, 19 nt, Homo sapiens
ggucucaguccuccacuuc

SEQ ID NO: 551909 - RNA, 19 nt, Homo sapiens
gcgcuuguacguguuggua

SEQ ID NO: 551910 - RNA, 19 nt, Homo sapiens
ggucaccucuggaaaauac

SEQ ID NO: 551911 - RNA, 19 nt, Homo sapiens
caugaaggccagcaauaca

SEQ ID NO: 551912 - RNA, 19 nt, Homo sapiens
caucucauacccgcaaauu

SEQ ID NO: 551913 - RNA, 19 nt, Homo sapiens
ucugaaggaagacuuuaaa

SEQ ID NO: 551914 - RNA, 19 nt, Homo sapiens
gucaaccucugggguauua

SEQ ID NO: 551915 - RNA, 19 nt, Homo sapiens
gacggucccaggagaagaa

SEQ ID NO: 551916 - RNA, 19 nt, Homo sapiens
aucaagacuuucaauccua

SEQ ID NO: 551917 - RNA, 19 nt, Homo sapiens
ugagaacuacauugaagug

SEQ ID NO: 551918 - RNA, 19 nt, Homo sapiens
uacauucugcuacucuuaa

SEQ ID NO: 551919 - RNA, 19 nt, Homo sapiens
gaagccuccuccacguucu

SEQ ID NO: 551920 - RNA, 19 nt, Homo sapiens
cagcaauacaacaucacua

SEQ ID NO: 551921 - RNA, 19 nt, Homo sapiens
cccaugaaggccagcaaua

SEQ ID NO: 551922 - RNA, 19 nt, Homo sapiens
auacauucugcuacucuua

SEQ ID NO: 551923 - RNA, 19 nt, Homo sapiens
gauguggcccuggaagaug

SEQ ID NO: 551924 - RNA, 19 nt, Homo sapiens
aggauuugcacauggauuu

SEQ ID NO: 551925 - RNA, 19 nt, Homo sapiens
ggccacgccaggaauauuc

SEQ ID NO: 551926 - RNA, 19 nt, Homo sapiens
gaaggccagcaauacaaca

SEQ ID NO: 551927 - RNA, 19 nt, Homo sapiens
gaggauuugcacauggauu

SEQ ID NO: 551928 - RNA, 19 nt, Homo sapiens
cauugaagugccauugauu

SEQ ID NO: 551929 - RNA, 19 nt, Homo sapiens
cacuaggaguauugagcua

SEQ ID NO: 551930 - RNA, 19 nt, Homo sapiens
uggauaaagacaaugagaa

SEQ ID NO: 551931 - RNA, 19 nt, Homo sapiens
gugacgcucauacaaauca

SEQ ID NO: 551932 - RNA, 19 nt, Homo sapiens
aguaugcccugaccugagu

SEQ ID NO: 551933 - RNA, 19 nt, Homo sapiens
caggugcccuacugguugu

SEQ ID NO: 551934 - RNA, 19 nt, Homo sapiens
caucaucaagacuuucaau

SEQ ID NO: 551935 - RNA, 19 nt, Homo sapiens
ugagcuacgcaucaagaaa

SEQ ID NO: 551936 - RNA, 19 nt, Homo sapiens
ccacucacuuacucguaca

SEQ ID NO: 551937 - RNA, 19 nt, Homo sapiens
guugucaggagcaauguug

SEQ ID NO: 551938 - RNA, 19 nt, Homo sapiens
aaccugacauggcauaaaa

SEQ ID NO: 551939 - RNA, 19 nt, Homo sapiens
gggaauauggaugcacaga

SEQ ID NO: 551940 - RNA, 19 nt, Homo sapiens
cacuuucacuggccuucuu

SEQ ID NO: 551941 - RNA, 19 nt, Homo sapiens
ugccagaagcugccgguuu

SEQ ID NO: 551942 - RNA, 19 nt, Homo sapiens
ugugguggacggccaauga

SEQ ID NO: 551943 - RNA, 19 nt, Homo sapiens
gaagauucaaugguacaag

SEQ ID NO: 551944 - RNA, 19 nt, Homo sapiens
ggaauuaucugaccaugaa

SEQ ID NO: 551945 - RNA, 19 nt, Homo sapiens
gcacgugccuucugucauu

SEQ ID NO: 551946 - RNA, 19 nt, Homo sapiens
gcaaaguugugcacacuaa

SEQ ID NO: 551947 - RNA, 19 nt, Homo sapiens
gaacguccuugcagacuga

SEQ ID NO: 551948 - RNA, 19 nt, Homo sapiens
cuagacaacucacaucaaa

SEQ ID NO: 551949 - RNA, 19 nt, Homo sapiens
guacaugccacgauuguuu

SEQ ID NO: 551950 - RNA, 19 nt, Homo sapiens
aaacaacugucucuuggaa

SEQ ID NO: 551951 - RNA, 19 nt, Homo sapiens
cagcaucuauuaccacuga

SEQ ID NO: 551952 - RNA, 19 nt, Homo sapiens
gccaaggccuucagaucua

SEQ ID NO: 551953 - RNA, 19 nt, Homo sapiens
caugagcgcugccguccua

SEQ ID NO: 551954 - RNA, 19 nt, Homo sapiens
ccuguugucuuacuuguuu

SEQ ID NO: 551955 - RNA, 19 nt, Homo sapiens
ugauguuccuguugucuua

SEQ ID NO: 551956 - RNA, 19 nt, Homo sapiens
gcuaugggcuucccuagag

SEQ ID NO: 551957 - RNA, 19 nt, Homo sapiens
acaacugucucuuggaauu

SEQ ID NO: 551958 - RNA, 19 nt, Homo sapiens
acaaguacaugccacgauu

SEQ ID NO: 551959 - RNA, 19 nt, Homo sapiens
caagggaaaucugcaugaa

SEQ ID NO: 551960 - RNA, 19 nt, Homo sapiens
cccaagaauuuacuacauu

SEQ ID NO: 551961 - RNA, 19 nt, Homo sapiens
gcagaugcauagaccuugu

SEQ ID NO: 551962 - RNA, 19 nt, Homo sapiens
gcugauauuuggguucuug

SEQ ID NO: 551963 - RNA, 19 nt, Homo sapiens
ccaaagugcugggauuaca

SEQ ID NO: 551964 - RNA, 19 nt, Homo sapiens
aaggaugggugauguaugu

SEQ ID NO: 551965 - RNA, 19 nt, Homo sapiens
ccaaggccuucagaucuaa

SEQ ID NO: 551966 - RNA, 19 nt, Homo sapiens
gaacuugcucuucuagaca

SEQ ID NO: 551967 - RNA, 19 nt, Homo sapiens
caacugucucuuggaauua

SEQ ID NO: 551968 - RNA, 19 nt, Homo sapiens
ccuuuccucuccagcauua

SEQ ID NO: 551969 - RNA, 19 nt, Homo sapiens
ccaugaacuugcucuucua

SEQ ID NO: 551970 - RNA, 19 nt, Homo sapiens
ccacuaaugccaagucugu

SEQ ID NO: 551971 - RNA, 19 nt, Homo sapiens
gcaaggaugggugauguau

SEQ ID NO: 551972 - RNA, 19 nt, Homo sapiens
gguagccgccacccacaua

SEQ ID NO: 551973 - RNA, 19 nt, Homo sapiens
ccacuggcauccuguacau

SEQ ID NO: 551974 - RNA, 19 nt, Homo sapiens
gagcugauauuuggguucu

SEQ ID NO: 551975 - RNA, 19 nt, Homo sapiens
ugucuuacuuguuuggauu

SEQ ID NO: 551976 - RNA, 19 nt, Homo sapiens
ggaaaacaacugucucuug

SEQ ID NO: 551977 - RNA, 19 nt, Homo sapiens
aaacggaagauccacuaaa

SEQ ID NO: 551978 - RNA, 19 nt, Homo sapiens
gaccucaacgggcaaaguu

SEQ ID NO: 551979 - RNA, 19 nt, Homo sapiens
ccacgcugcucuacauucu

SEQ ID NO: 551980 - RNA, 19 nt, Homo sapiens
cugcuggacccaagaauuu

SEQ ID NO: 551981 - RNA, 19 nt, Homo sapiens
ucgcucaccucguuucuca

SEQ ID NO: 551982 - RNA, 19 nt, Homo sapiens
ccacuaauggagaauccua

SEQ ID NO: 551983 - RNA, 19 nt, Homo sapiens
cugaauaggaggaagcuuu

SEQ ID NO: 551984 - RNA, 19 nt, Homo sapiens
gugcuugguuuuaaaguaa

SEQ ID NO: 551985 - RNA, 19 nt, Homo sapiens
gggcaaaguugugcacacu

SEQ ID NO: 551986 - RNA, 19 nt, Homo sapiens
cauuaggauucaagggaaa

SEQ ID NO: 551987 - RNA, 19 nt, Homo sapiens
gugacgcgaucuccacuca

SEQ ID NO: 551988 - RNA, 19 nt, Homo sapiens
caaacggaagauccacuaa

SEQ ID NO: 551989 - RNA, 19 nt, Homo sapiens
gcgcugccguccuacaagu

SEQ ID NO: 551990 - RNA, 19 nt, Homo sapiens
ccacaaccgcauuggaaga

SEQ ID NO: 551991 - RNA, 19 nt, Homo sapiens
ugaacuugcucuucuagac

SEQ ID NO: 551992 - RNA, 19 nt, Homo sapiens
aaagcuguguucuucuguu

SEQ ID NO: 551993 - RNA, 19 nt, Homo sapiens
ucaagggaaaucugcauga

SEQ ID NO: 551994 - RNA, 19 nt, Homo sapiens
ggaccacuggcauccugua

SEQ ID NO: 551995 - RNA, 19 nt, Homo sapiens
aagcuguguucuucuguug

SEQ ID NO: 551996 - RNA, 19 nt, Homo sapiens
caaaguugugcacacuaaa

SEQ ID NO: 551997 - RNA, 19 nt, Homo sapiens
gaaacugcuggacccaaga

SEQ ID NO: 551998 - RNA, 19 nt, Homo sapiens
gagcgcugccguccuacaa

SEQ ID NO: 551999 - RNA, 19 nt, Homo sapiens
gaaagcuguguucuucugu

SEQ ID NO: 552000 - RNA, 19 nt, Homo sapiens
agaaaaggcugccgcaaca

SEQ ID NO: 552001 - RNA, 19 nt, Homo sapiens
ggacugguuccucagaaag

SEQ ID NO: 552002 - RNA, 19 nt, Homo sapiens
ccucguuucucaucuccuu

SEQ ID NO: 552003 - RNA, 19 nt, Homo sapiens
gacgcgaucuccacucacu

SEQ ID NO: 552004 - RNA, 19 nt, Homo sapiens
acaaacggaagauccacua

SEQ ID NO: 552005 - RNA, 19 nt, Homo sapiens
ugcccgagcugauauuugg

SEQ ID NO: 552006 - RNA, 19 nt, Homo sapiens
caaguacaugccacgauug

SEQ ID NO: 552007 - RNA, 19 nt, Homo sapiens
gaccaugaacuugcucuuc

SEQ ID NO: 552008 - RNA, 19 nt, Homo sapiens
ggacauuuaaauucacucu

SEQ ID NO: 552009 - RNA, 19 nt, Homo sapiens
ggugcuugguuuuaaagua

SEQ ID NO: 552010 - RNA, 19 nt, Homo sapiens
caaccgcauuggaagaaaa

SEQ ID NO: 552011 - RNA, 19 nt, Homo sapiens
gcucaccucguuucucauc

SEQ ID NO: 552012 - RNA, 19 nt, Homo sapiens
uagccaggauggucucgau

SEQ ID NO: 552013 - RNA, 19 nt, Homo sapiens
gaguaggucuaggggaaua

SEQ ID NO: 552014 - RNA, 19 nt, Homo sapiens
acuaaugccaagucuguuu

SEQ ID NO: 552015 - RNA, 19 nt, Homo sapiens
uaacugcacgugccuucug

SEQ ID NO: 552016 - RNA, 19 nt, Homo sapiens
ugccucagccucccgagua

SEQ ID NO: 552017 - RNA, 19 nt, Homo sapiens
cugcaaggaugggugaugu

SEQ ID NO: 552018 - RNA, 19 nt, Homo sapiens
ggggaaaugcucuuugaaa

SEQ ID NO: 552019 - RNA, 19 nt, Homo sapiens
ucgccacgcugcucuacau

SEQ ID NO: 552020 - RNA, 19 nt, Homo sapiens
augccacgauuguuucuga

SEQ ID NO: 552021 - RNA, 19 nt, Homo sapiens
aacggaagauccacuaaaa

SEQ ID NO: 552022 - RNA, 19 nt, Homo sapiens
caacguuugccaucuggau

SEQ ID NO: 552023 - RNA, 19 nt, Homo sapiens
gacccaagaauuuacuaca

SEQ ID NO: 552024 - RNA, 19 nt, Homo sapiens
uuugaauccuggagaguuc

SEQ ID NO: 552025 - RNA, 19 nt, Homo sapiens
ggauuaacagaacguccuu

SEQ ID NO: 552026 - RNA, 19 nt, Homo sapiens
ucugacaucucggaaacug

SEQ ID NO: 552027 - RNA, 19 nt, Homo sapiens
acccaagaauuuacuacau

SEQ ID NO: 552028 - RNA, 19 nt, Homo sapiens
aaacugcuggacccaagaa

SEQ ID NO: 552029 - RNA, 19 nt, Homo sapiens
gcuguguucuucuguugac

SEQ ID NO: 552030 - RNA, 19 nt, Homo sapiens
cuaaugccaagucuguuug

SEQ ID NO: 552031 - RNA, 19 nt, Homo sapiens
aaagcccucacuccacuaa

SEQ ID NO: 552032 - RNA, 19 nt, Homo sapiens
agacaacucacaucaaagc

SEQ ID NO: 552033 - RNA, 19 nt, Homo sapiens
accaugaacuugcucuucu

SEQ ID NO: 552034 - RNA, 19 nt, Homo sapiens
uaaaacguccacgggauua

SEQ ID NO: 552035 - RNA, 19 nt, Homo sapiens
ccaaagugguauagaaaug

SEQ ID NO: 552036 - RNA, 19 nt, Homo sapiens
guucuuaguugcuguaugu

SEQ ID NO: 552037 - RNA, 19 nt, Homo sapiens
gaccaauauuguacaguuu

SEQ ID NO: 552038 - RNA, 19 nt, Homo sapiens
uagaagauggcacuuauaa

SEQ ID NO: 552039 - RNA, 19 nt, Homo sapiens
ugaccaauauuguacaguu

SEQ ID NO: 552040 - RNA, 19 nt, Homo sapiens
ccuguuggcugccuuacua

SEQ ID NO: 552041 - RNA, 19 nt, Homo sapiens
ggucauggguuaccagaag

SEQ ID NO: 552042 - RNA, 19 nt, Homo sapiens
ugaggcagaugacagauau

SEQ ID NO: 552043 - RNA, 19 nt, Homo sapiens
gaagcaugacggacaagua

SEQ ID NO: 552044 - RNA, 19 nt, Homo sapiens
uguagaagauggcacuuau

SEQ ID NO: 552045 - RNA, 19 nt, Homo sapiens
gguggacauucaucuguuu

SEQ ID NO: 552046 - RNA, 19 nt, Homo sapiens
caagcaagggugugaguuu

SEQ ID NO: 552047 - RNA, 19 nt, Homo sapiens
aaagcgagguggacauuca

SEQ ID NO: 552048 - RNA, 19 nt, Homo sapiens
ggaaagcgagguggacauu

SEQ ID NO: 552049 - RNA, 19 nt, Homo sapiens
ggccuuauccugccuggua

SEQ ID NO: 552050 - RNA, 19 nt, Homo sapiens
gaagauggcacuuauaacc

SEQ ID NO: 552051 - RNA, 19 nt, Homo sapiens
gaacauuccagagcgugua

SEQ ID NO: 552052 - RNA, 19 nt, Homo sapiens
guagaagauggcacuuaua

SEQ ID NO: 552053 - RNA, 19 nt, Homo sapiens
caucaugguuggccuuauc

SEQ ID NO: 552054 - RNA, 19 nt, Homo sapiens
guauagaaaugcugguuuu

SEQ ID NO: 552055 - RNA, 19 nt, Homo sapiens
gggccugagugcuccagua

SEQ ID NO: 552056 - RNA, 19 nt, Homo sapiens
gcccaaagugguauagaaa

SEQ ID NO: 552057 - RNA, 19 nt, Homo sapiens
gaaaugauccccagcuguu

SEQ ID NO: 552058 - RNA, 19 nt, Homo sapiens
ucacguaaagcuagaaaug

SEQ ID NO: 552059 - RNA, 19 nt, Homo sapiens
ccacugagucugagucuuc

SEQ ID NO: 552060 - RNA, 19 nt, Homo sapiens
gcaaggcaguccaugucau

SEQ ID NO: 552061 - RNA, 19 nt, Homo sapiens
cuucuuaacuggcauugug

SEQ ID NO: 552062 - RNA, 19 nt, Homo sapiens
uaacuacaccgaggaaaug

SEQ ID NO: 552063 - RNA, 19 nt, Homo sapiens
cuacagcaguguccucauc

SEQ ID NO: 552064 - RNA, 19 nt, Homo sapiens
ugagaagcaugacggacaa

SEQ ID NO: 552065 - RNA, 19 nt, Homo sapiens
gagucugagucuucaaguu

SEQ ID NO: 552066 - RNA, 19 nt, Homo sapiens
gauggcacuuauaaccaaa

SEQ ID NO: 552067 - RNA, 19 nt, Homo sapiens
caugucaucuacacaguca

SEQ ID NO: 552068 - RNA, 19 nt, Homo sapiens
ccucuaugcuuuccuugga

SEQ ID NO: 552069 - RNA, 19 nt, Homo sapiens
ucaccgaggcccuagcuuu

SEQ ID NO: 552070 - RNA, 19 nt, Homo sapiens
gaaaagguggucuauguug

SEQ ID NO: 552071 - RNA, 19 nt, Homo sapiens
cagaagaaacugagaagca

SEQ ID NO: 552072 - RNA, 19 nt, Homo sapiens
ugaaucacguaaagcuaga

SEQ ID NO: 552073 - RNA, 19 nt, Homo sapiens
ggaucaguauauacacuuc

SEQ ID NO: 552074 - RNA, 19 nt, Homo sapiens
agaagaaacugagaagcau

SEQ ID NO: 552075 - RNA, 19 nt, Homo sapiens
ggacuaugacuccaugaag

SEQ ID NO: 552076 - RNA, 19 nt, Homo sapiens
gguauagaaaugcugguuu

SEQ ID NO: 552077 - RNA, 19 nt, Homo sapiens
ucaagauccucuccaaagg

SEQ ID NO: 552078 - RNA, 19 nt, Homo sapiens
gcuauugcauuaucaucuc

SEQ ID NO: 552079 - RNA, 19 nt, Homo sapiens
gcaagggugugaguuugag

SEQ ID NO: 552080 - RNA, 19 nt, Homo sapiens
caacgucagugaggcagau

SEQ ID NO: 552081 - RNA, 19 nt, Homo sapiens
gaccuccucuuugucauca

SEQ ID NO: 552082 - RNA, 19 nt, Homo sapiens
agauggcacuuauaaccaa

SEQ ID NO: 552083 - RNA, 19 nt, Homo sapiens
ggcagcagguagcaaagug

SEQ ID NO: 552084 - RNA, 19 nt, Homo sapiens
gaaaagggaacugaacauu

SEQ ID NO: 552085 - RNA, 19 nt, Homo sapiens
uaacacagauguaaaagac

SEQ ID NO: 552086 - RNA, 19 nt, Homo sapiens
auucaucuguuuccacuga

SEQ ID NO: 552087 - RNA, 19 nt, Homo sapiens
ugagaacacugugcacaag

SEQ ID NO: 552088 - RNA, 19 nt, Homo sapiens
aagcaagggugugaguuug

SEQ ID NO: 552089 - RNA, 19 nt, Homo sapiens
agucugagucuucaaguuu

SEQ ID NO: 552090 - RNA, 19 nt, Homo sapiens
ccagcuaacacagauguaa

SEQ ID NO: 552091 - RNA, 19 nt, Homo sapiens
ggacauucaucuguuucca

SEQ ID NO: 552092 - RNA, 19 nt, Homo sapiens
gaacccuguuuccgugaag

SEQ ID NO: 552093 - RNA, 19 nt, Homo sapiens
cagcaucgacuccuucauc

SEQ ID NO: 552094 - RNA, 19 nt, Homo sapiens
acguaaagcuagaaaugau

SEQ ID NO: 552095 - RNA, 19 nt, Homo sapiens
cagcuaacacagauguaaa

SEQ ID NO: 552096 - RNA, 19 nt, Homo sapiens
gagguggacauucaucugu

SEQ ID NO: 552097 - RNA, 19 nt, Homo sapiens
ggaucagcaucgacuccuu

SEQ ID NO: 552098 - RNA, 19 nt, Homo sapiens
ccaugaaggaacccuguuu

SEQ ID NO: 552099 - RNA, 19 nt, Homo sapiens
cauccucuaugcuuuccuu

SEQ ID NO: 552100 - RNA, 19 nt, Homo sapiens
uggccgaccuccucuuugu

SEQ ID NO: 552101 - RNA, 19 nt, Homo sapiens
cagagcguguagugaauca

SEQ ID NO: 552102 - RNA, 19 nt, Homo sapiens
guggccaaguucuuaguug

SEQ ID NO: 552103 - RNA, 19 nt, Homo sapiens
gugaggcagaugacagaua

SEQ ID NO: 552104 - RNA, 19 nt, Homo sapiens
uccaucaucuucuuaacug

SEQ ID NO: 552105 - RNA, 19 nt, Homo sapiens
caucuacuccaucaucuuc

SEQ ID NO: 552106 - RNA, 19 nt, Homo sapiens
gcagcagguagcaaaguga

SEQ ID NO: 552107 - RNA, 19 nt, Homo sapiens
cugaaaagguggucuaugu

SEQ ID NO: 552108 - RNA, 19 nt, Homo sapiens
ggcaguccaugucaucuac

SEQ ID NO: 552109 - RNA, 19 nt, Homo sapiens
caaagcccaaagugguaua

SEQ ID NO: 552110 - RNA, 19 nt, Homo sapiens
caaguucuuaguugcugua

SEQ ID NO: 552111 - RNA, 19 nt, Homo sapiens
ugucuuguguuucuuuagu

SEQ ID NO: 552112 - RNA, 19 nt, Homo sapiens
ucauauugaugugugucua

SEQ ID NO: 552113 - RNA, 19 nt, Homo sapiens
uagcuuucuuccacuguug

SEQ ID NO: 552114 - RNA, 19 nt, Homo sapiens
cuacuccaucaucuucuua

SEQ ID NO: 552115 - RNA, 19 nt, Homo sapiens
guccugcuauugcauuauc

SEQ ID NO: 552116 - RNA, 19 nt, Homo sapiens
gugguuguguuccaguuuc

SEQ ID NO: 552117 - RNA, 19 nt, Homo sapiens
caaggcaguccaugucauc

SEQ ID NO: 552118 - RNA, 19 nt, Homo sapiens
aagaaacugagaagcauga

SEQ ID NO: 552119 - RNA, 19 nt, Homo sapiens
ggguugauuucagcaccua

SEQ ID NO: 552120 - RNA, 19 nt, Homo sapiens
caccgcaucuggagaacca

SEQ ID NO: 552121 - RNA, 19 nt, Homo sapiens
uauccugccugguauuguc

SEQ ID NO: 552122 - RNA, 19 nt, Homo sapiens
ucauccuggucauggguua

SEQ ID NO: 552123 - RNA, 19 nt, Homo sapiens
ggaagcuguuggcugaaaa

SEQ ID NO: 552124 - RNA, 19 nt, Homo sapiens
aggaagcuguuggcugaaa

SEQ ID NO: 552125 - RNA, 19 nt, Homo sapiens
agcccaaagugguauagaa

SEQ ID NO: 552126 - RNA, 19 nt, Homo sapiens
cacguaaagcuagaaauga

SEQ ID NO: 552127 - RNA, 19 nt, Homo sapiens
gaaagcgagguggacauuc

SEQ ID NO: 552128 - RNA, 19 nt, Homo sapiens
gccucaagauccucuccaa

SEQ ID NO: 552129 - RNA, 19 nt, Homo sapiens
ccgaggcccuagcuuucuu

SEQ ID NO: 552130 - RNA, 19 nt, Homo sapiens
gcauuaucaucuccaagcu

SEQ ID NO: 552131 - RNA, 19 nt, Homo sapiens
gggacuaugacuccaugaa

SEQ ID NO: 552132 - RNA, 19 nt, Homo sapiens
ugcuguaugucucguggua

SEQ ID NO: 552133 - RNA, 19 nt, Homo sapiens
aagacugaccaauauugua

SEQ ID NO: 552134 - RNA, 19 nt, Homo sapiens
aaagacugaccaauauugu

SEQ ID NO: 552135 - RNA, 19 nt, Homo sapiens
gcucacguguauucuauuu

SEQ ID NO: 552136 - RNA, 19 nt, Homo sapiens
gaccugcgcuucuuccuau

SEQ ID NO: 552137 - RNA, 19 nt, Homo sapiens
gggcccagcucacguguau

SEQ ID NO: 552138 - RNA, 19 nt, Homo sapiens
caaggucacuuccguuuac

SEQ ID NO: 552139 - RNA, 19 nt, Homo sapiens
gcacaugcccaaccaguuc

SEQ ID NO: 552140 - RNA, 19 nt, Homo sapiens
cagcucacguguauucuau

SEQ ID NO: 552141 - RNA, 19 nt, Homo sapiens
gaacuguguggucucaauu

SEQ ID NO: 552142 - RNA, 19 nt, Homo sapiens
caauuuaccuuugcuuugg

SEQ ID NO: 552143 - RNA, 19 nt, Homo sapiens
cgaagcaguuuaucuuugg

SEQ ID NO: 552144 - RNA, 19 nt, Homo sapiens
ccgaagcaguuuaucuuug

SEQ ID NO: 552145 - RNA, 19 nt, Homo sapiens
gcauugugguggccugcua

SEQ ID NO: 552146 - RNA, 19 nt, Homo sapiens
gaaaucacggugcccaugu

SEQ ID NO: 552147 - RNA, 19 nt, Homo sapiens
uggcaacaauuuaccuuug

SEQ ID NO: 552148 - RNA, 19 nt, Homo sapiens
ucacuuccguuuaccuuca

SEQ ID NO: 552149 - RNA, 19 nt, Homo sapiens
gcuacaaccugacgcacau

SEQ ID NO: 552150 - RNA, 19 nt, Homo sapiens
ccaaggucacuuccguuua

SEQ ID NO: 552151 - RNA, 19 nt, Homo sapiens
gaagcaguuuaucuuugga

SEQ ID NO: 552152 - RNA, 19 nt, Homo sapiens
gcuuuacaauccuaagguu

SEQ ID NO: 552153 - RNA, 19 nt, Homo sapiens
ggaccugcgcuucuuccua

SEQ ID NO: 552154 - RNA, 19 nt, Homo sapiens
ugaacuguguggucucaau

SEQ ID NO: 552155 - RNA, 19 nt, Homo sapiens
gccaaggucacuuccguuu

SEQ ID NO: 552156 - RNA, 19 nt, Homo sapiens
gcacaaccacauccacuac

SEQ ID NO: 552157 - RNA, 19 nt, Homo sapiens
ccaucugucugcccgacua

SEQ ID NO: 552158 - RNA, 19 nt, Homo sapiens
uaagguuggcguuguaaug

SEQ ID NO: 552159 - RNA, 19 nt, Homo sapiens
gcaccaagacggacaagcu

SEQ ID NO: 552160 - RNA, 19 nt, Homo sapiens
guuuaucuuuggacgguuu

SEQ ID NO: 552161 - RNA, 19 nt, Homo sapiens
ucacguguauucuauuuug

SEQ ID NO: 552162 - RNA, 19 nt, Homo sapiens
gcccagcucacguguauuc

SEQ ID NO: 552163 - RNA, 19 nt, Homo sapiens
cagccugucgcuaaacuuu

SEQ ID NO: 552164 - RNA, 19 nt, Homo sapiens
cacacccgcucuacaacaa

SEQ ID NO: 552165 - RNA, 19 nt, Homo sapiens
acaauuuaccuuugcuuug

SEQ ID NO: 552166 - RNA, 19 nt, Homo sapiens
guuucuuacugccuucuuu

SEQ ID NO: 552167 - RNA, 19 nt, Homo sapiens
guucgccaccuucuggaua

SEQ ID NO: 552168 - RNA, 19 nt, Homo sapiens
ggucucaauugggaaaaua

SEQ ID NO: 552169 - RNA, 19 nt, Homo sapiens
ucagguuucuuugaacugu

SEQ ID NO: 552170 - RNA, 19 nt, Homo sapiens
ccacuugguucagguuucu

SEQ ID NO: 552171 - RNA, 19 nt, Homo sapiens
cuuacugccuucuuuaugg

SEQ ID NO: 552172 - RNA, 19 nt, Homo sapiens
ugacgcacaugcccaacca

SEQ ID NO: 552173 - RNA, 19 nt, Homo sapiens
gggugcucaugcucaagua

SEQ ID NO: 552174 - RNA, 19 nt, Homo sapiens
gggacugucugcucuucuc

SEQ ID NO: 552175 - RNA, 19 nt, Homo sapiens
acaaccacauccacuacga

SEQ ID NO: 552176 - RNA, 19 nt, Homo sapiens
gguuggcguuguaaugaag

SEQ ID NO: 552177 - RNA, 19 nt, Homo sapiens
caacaauuuaccuuugcuu

SEQ ID NO: 552178 - RNA, 19 nt, Homo sapiens
ccagcucacguguauucua

SEQ ID NO: 552179 - RNA, 19 nt, Homo sapiens
gcaaccagaaccugaacuc

SEQ ID NO: 552180 - RNA, 19 nt, Homo sapiens
ccaccuuccucaucgacau

SEQ ID NO: 552181 - RNA, 19 nt, Homo sapiens
ggucacuuccguuuaccuu

SEQ ID NO: 552182 - RNA, 19 nt, Homo sapiens
gcauuuuggcaacaauuua

SEQ ID NO: 552183 - RNA, 19 nt, Homo sapiens
guaacuuuguugcauuuug

SEQ ID NO: 552184 - RNA, 19 nt, Homo sapiens
agacggacaagcuggagaa

SEQ ID NO: 552185 - RNA, 19 nt, Homo sapiens
gggcuacgcgcaguacuuc

SEQ ID NO: 552186 - RNA, 19 nt, Homo sapiens
ggucggugcugugcuucau

SEQ ID NO: 552187 - RNA, 19 nt, Homo sapiens
aaaucacggugcccaugug

SEQ ID NO: 552188 - RNA, 19 nt, Homo sapiens
agucacacccgcucuacaa

SEQ ID NO: 552189 - RNA, 19 nt, Homo sapiens
aagguuggcguuguaauga

SEQ ID NO: 552190 - RNA, 19 nt, Homo sapiens
uccuaagguuggcguugua

SEQ ID NO: 552191 - RNA, 19 nt, Homo sapiens
ugucccaggucuucuccaa

SEQ ID NO: 552192 - RNA, 19 nt, Homo sapiens
ccuggaauccgagcccuaa

SEQ ID NO: 552193 - RNA, 19 nt, Homo sapiens
uuucuuacugccuucuuua

SEQ ID NO: 552194 - RNA, 19 nt, Homo sapiens
cgacaaggaucaagaauua

SEQ ID NO: 552195 - RNA, 19 nt, Homo sapiens
gaagagaauuccagggaua

SEQ ID NO: 552196 - RNA, 19 nt, Homo sapiens
gaagaagacuggaugagaa

SEQ ID NO: 552197 - RNA, 19 nt, Homo sapiens
gaugaugucuccaaaguaa

SEQ ID NO: 552198 - RNA, 19 nt, Homo sapiens
gaaaccagcugcuucagaa

SEQ ID NO: 552199 - RNA, 19 nt, Homo sapiens
gcaauucccuccuauguau

SEQ ID NO: 552200 - RNA, 19 nt, Homo sapiens
ggacaugagugaugauuau

SEQ ID NO: 552201 - RNA, 19 nt, Homo sapiens
gaagaaagcagcccagauu

SEQ ID NO: 552202 - RNA, 19 nt, Homo sapiens
gaaagcagcccagauuaua

SEQ ID NO: 552203 - RNA, 19 nt, Homo sapiens
gaauaauacucgaagcuuu

SEQ ID NO: 552204 - RNA, 19 nt, Homo sapiens
gagcuccucugccauauaa

SEQ ID NO: 552205 - RNA, 19 nt, Homo sapiens
ccaaaguaauugccuauuu

SEQ ID NO: 552206 - RNA, 19 nt, Homo sapiens
gcaaagagaauauaggaaa

SEQ ID NO: 552207 - RNA, 19 nt, Homo sapiens
gaagaucuguuaaugaaag

SEQ ID NO: 552208 - RNA, 19 nt, Homo sapiens
ccucugagcuguuaucuug

SEQ ID NO: 552209 - RNA, 19 nt, Homo sapiens
uaaugaaagugcuggaaua

SEQ ID NO: 552210 - RNA, 19 nt, Homo sapiens
ccaggaugcuaguuaaaua

SEQ ID NO: 552211 - RNA, 19 nt, Homo sapiens
caacauuucucuucagugu

SEQ ID NO: 552212 - RNA, 19 nt, Homo sapiens
ccagaagacuuaauugaga

SEQ ID NO: 552213 - RNA, 19 nt, Homo sapiens
aaagaaagcuuaagcacau

SEQ ID NO: 552214 - RNA, 19 nt, Homo sapiens
gagcagcccugucucuuau

SEQ ID NO: 552215 - RNA, 19 nt, Homo sapiens
aaacauggcugaagcaaag

SEQ ID NO: 552216 - RNA, 19 nt, Homo sapiens
ggaugaagaucuguuaaug

SEQ ID NO: 552217 - RNA, 19 nt, Homo sapiens
gcaggaagaggaacaaauu

SEQ ID NO: 552218 - RNA, 19 nt, Homo sapiens
acaacaagcucauaaggaa

SEQ ID NO: 552219 - RNA, 19 nt, Homo sapiens
uaaauacccugagaucauu

SEQ ID NO: 552220 - RNA, 19 nt, Homo sapiens
acagacagauggcauauga

SEQ ID NO: 552221 - RNA, 19 nt, Homo sapiens
gaaagagaguaaagaccaa

SEQ ID NO: 552222 - RNA, 19 nt, Homo sapiens
ggucaaggcucaucugaag

SEQ ID NO: 552223 - RNA, 19 nt, Homo sapiens
uggaauaccucaaucaaga

SEQ ID NO: 552224 - RNA, 19 nt, Homo sapiens
gcuguuaucuuguguaugg

SEQ ID NO: 552225 - RNA, 19 nt, Homo sapiens
ccaagcaaaucccaacauu

SEQ ID NO: 552226 - RNA, 19 nt, Homo sapiens
gaagacuggaugagaauaa

SEQ ID NO: 552227 - RNA, 19 nt, Homo sapiens
ggagcagcccugucucuua

SEQ ID NO: 552228 - RNA, 19 nt, Homo sapiens
gaacaaaucaacgaugaga

SEQ ID NO: 552229 - RNA, 19 nt, Homo sapiens
gaacgacaaggaucaagaa

SEQ ID NO: 552230 - RNA, 19 nt, Homo sapiens
gaucagggcuuuggaguac

SEQ ID NO: 552231 - RNA, 19 nt, Homo sapiens
agaauuaggugaguacuug

SEQ ID NO: 552232 - RNA, 19 nt, Homo sapiens
uaacauugccuaugaagau

SEQ ID NO: 552233 - RNA, 19 nt, Homo sapiens
gagcuguuaucuuguguau

SEQ ID NO: 552234 - RNA, 19 nt, Homo sapiens
ucaaagccuugcuacauug

SEQ ID NO: 552235 - RNA, 19 nt, Homo sapiens
gcuaagagagcaauggaaa

SEQ ID NO: 552236 - RNA, 19 nt, Homo sapiens
gagcuugaccuuccuguug

SEQ ID NO: 552237 - RNA, 19 nt, Homo sapiens
gaugaagaucuguuaauga

SEQ ID NO: 552238 - RNA, 19 nt, Homo sapiens
ucccaaagcugccuggauu

SEQ ID NO: 552239 - RNA, 19 nt, Homo sapiens
gaccaacucucagaugaug

SEQ ID NO: 552240 - RNA, 19 nt, Homo sapiens
guacugggaugaagaucug

SEQ ID NO: 552241 - RNA, 19 nt, Homo sapiens
aagaugaccugcaggaaga

SEQ ID NO: 552242 - RNA, 19 nt, Homo sapiens
gaagcgaguuccuggucaa

SEQ ID NO: 552243 - RNA, 19 nt, Homo sapiens
cagaugaugucuccaaagu

SEQ ID NO: 552244 - RNA, 19 nt, Homo sapiens
guaaagaccaacucucaga

SEQ ID NO: 552245 - RNA, 19 nt, Homo sapiens
acacagcaguggccagaaa

SEQ ID NO: 552246 - RNA, 19 nt, Homo sapiens
gaagugggagguuacagaa

SEQ ID NO: 552247 - RNA, 19 nt, Homo sapiens
gaacaauauacuccucaaa

SEQ ID NO: 552248 - RNA, 19 nt, Homo sapiens
ggaacaauauacuccucaa

SEQ ID NO: 552249 - RNA, 19 nt, Homo sapiens
guuacugucuguagcguuu

SEQ ID NO: 552250 - RNA, 19 nt, Homo sapiens
guauggauauguguaaaug

SEQ ID NO: 552251 - RNA, 19 nt, Homo sapiens
caauggacaugagugauga

SEQ ID NO: 552252 - RNA, 19 nt, Homo sapiens
aaucaacgaugagaugaaa

SEQ ID NO: 552253 - RNA, 19 nt, Homo sapiens
cgagagggauucacugagu

SEQ ID NO: 552254 - RNA, 19 nt, Homo sapiens
guugacuucuauccuguua

SEQ ID NO: 552255 - RNA, 19 nt, Homo sapiens
gaucaagaauuaggugagu

SEQ ID NO: 552256 - RNA, 19 nt, Homo sapiens
cucaaggaauuuacagaua

SEQ ID NO: 552257 - RNA, 19 nt, Homo sapiens
ggaagugggagguuacaga

SEQ ID NO: 552258 - RNA, 19 nt, Homo sapiens
gauggagagugcagcaaau

SEQ ID NO: 552259 - RNA, 19 nt, Homo sapiens
ucaaggaauuuacagauac

SEQ ID NO: 552260 - RNA, 19 nt, Homo sapiens
cauuguugaugcucacaua

SEQ ID NO: 552261 - RNA, 19 nt, Homo sapiens
gaauaccucaaucaagaaa

SEQ ID NO: 552262 - RNA, 19 nt, Homo sapiens
gaaaugaucagggcuuugg

SEQ ID NO: 552263 - RNA, 19 nt, Homo sapiens
agacagauggcauaugaaa

SEQ ID NO: 552264 - RNA, 19 nt, Homo sapiens
gaggauggaugaggagcaa

SEQ ID NO: 552265 - RNA, 19 nt, Homo sapiens
ggaauaccucaaucaagaa

SEQ ID NO: 552266 - RNA, 19 nt, Homo sapiens
acccugagaucauuaauuc

SEQ ID NO: 552267 - RNA, 19 nt, Homo sapiens
gcagcuucauuucagagaa

SEQ ID NO: 552268 - RNA, 19 nt, Homo sapiens
aagaccaacucucagauga

SEQ ID NO: 552269 - RNA, 19 nt, Homo sapiens
cucaaagccuugcuacauu

SEQ ID NO: 552270 - RNA, 19 nt, Homo sapiens
cuaguuaaauacccugaga

SEQ ID NO: 552271 - RNA, 19 nt, Homo sapiens
cagaagacuuaauugagau

SEQ ID NO: 552272 - RNA, 19 nt, Homo sapiens
gacaacaagcucauaagga

SEQ ID NO: 552273 - RNA, 19 nt, Homo sapiens
ggauggagagugcagcaaa

SEQ ID NO: 552274 - RNA, 19 nt, Homo sapiens
cagcaaagagaauauagga

SEQ ID NO: 552275 - RNA, 19 nt, Homo sapiens
cauuuccucugagcuguua

SEQ ID NO: 552276 - RNA, 19 nt, Homo sapiens
ugaaagugcuggaauaccu

SEQ ID NO: 552277 - RNA, 19 nt, Homo sapiens
caagaguggcuacccuaaa

SEQ ID NO: 552278 - RNA, 19 nt, Homo sapiens
ccagaccuguuccaaaaua

SEQ ID NO: 552279 - RNA, 19 nt, Homo sapiens
ugaccuuccuguugaccua

SEQ ID NO: 552280 - RNA, 19 nt, Homo sapiens
gaugcucacauaugauaaa

SEQ ID NO: 552281 - RNA, 19 nt, Homo sapiens
uguugaugcucacauauga

SEQ ID NO: 552282 - RNA, 19 nt, Homo sapiens
ccucugccauauaaacaaa

SEQ ID NO: 552283 - RNA, 19 nt, Homo sapiens
cauauaaccaggagaaagu

SEQ ID NO: 552284 - RNA, 19 nt, Homo sapiens
ggagaagccgaauggauca

SEQ ID NO: 552285 - RNA, 19 nt, Homo sapiens
aaagcagcccagauuauaa

SEQ ID NO: 552286 - RNA, 19 nt, Homo sapiens
aagaaagcagcccagauua

SEQ ID NO: 552287 - RNA, 19 nt, Homo sapiens
ggaaaauguccaaaaguuu

SEQ ID NO: 552288 - RNA, 19 nt, Homo sapiens
cacaugcaauucccuccua

SEQ ID NO: 552289 - RNA, 19 nt, Homo sapiens
aaaagaaaauggcgaugaa

SEQ ID NO: 552290 - RNA, 19 nt, Homo sapiens
acauuucucuucagugugu

SEQ ID NO: 552291 - RNA, 19 nt, Homo sapiens
uuaaauacccugagaucau

SEQ ID NO: 552292 - RNA, 19 nt, Homo sapiens
ggaagaaagcagcccagau

SEQ ID NO: 552293 - RNA, 19 nt, Homo sapiens
augaacaaaucaacgauga

SEQ ID NO: 552294 - RNA, 19 nt, Homo sapiens
gcaacugccucaaguauaa

SEQ ID NO: 552295 - RNA, 19 nt, Homo sapiens
gaacugggcccuuaaagaa

SEQ ID NO: 552296 - RNA, 19 nt, Homo sapiens
caacacagcccaaccuaua

SEQ ID NO: 552297 - RNA, 19 nt, Homo sapiens
gugcaaagaugaucaagaa

SEQ ID NO: 552298 - RNA, 19 nt, Homo sapiens
caaagaugaucaagaaaga

SEQ ID NO: 552299 - RNA, 19 nt, Homo sapiens
ccagagaccucacagcauu

SEQ ID NO: 552300 - RNA, 19 nt, Homo sapiens
gcuggaagcucaccugcua

SEQ ID NO: 552301 - RNA, 19 nt, Homo sapiens
ggagagauucugaggauaa

SEQ ID NO: 552302 - RNA, 19 nt, Homo sapiens
gagaaggagucguacuuug

SEQ ID NO: 552303 - RNA, 19 nt, Homo sapiens
ggaagauccuggcagagaa

SEQ ID NO: 552304 - RNA, 19 nt, Homo sapiens
cgaaaggucuacaagaguu

SEQ ID NO: 552305 - RNA, 19 nt, Homo sapiens
ggaaguagaguaugacaug

SEQ ID NO: 552306 - RNA, 19 nt, Homo sapiens
gaccagcgauagugauuga

SEQ ID NO: 552307 - RNA, 19 nt, Homo sapiens
gaucaagguucagcagauu

SEQ ID NO: 552308 - RNA, 19 nt, Homo sapiens
gacuacaucuggcuggaua

SEQ ID NO: 552309 - RNA, 19 nt, Homo sapiens
ccucugcacugacucauuu

SEQ ID NO: 552310 - RNA, 19 nt, Homo sapiens
gaaaccaaccagugaagaa

SEQ ID NO: 552311 - RNA, 19 nt, Homo sapiens
agacacaccugcaaucuca

SEQ ID NO: 552312 - RNA, 19 nt, Homo sapiens
aagcucaccugcuacauuu

SEQ ID NO: 552313 - RNA, 19 nt, Homo sapiens
gcaacaaggagaacacuga

SEQ ID NO: 552314 - RNA, 19 nt, Homo sapiens
gaaaggucuacaagaguua

SEQ ID NO: 552315 - RNA, 19 nt, Homo sapiens
gaagcucaccugcuacauu

SEQ ID NO: 552316 - RNA, 19 nt, Homo sapiens
cgcaggagaucuuugagua

SEQ ID NO: 552317 - RNA, 19 nt, Homo sapiens
gcaaacauaagaacaagga

SEQ ID NO: 552318 - RNA, 19 nt, Homo sapiens
gcaaagaugaucaagaaag

SEQ ID NO: 552319 - RNA, 19 nt, Homo sapiens
ggacgaggaugcuguuugc

SEQ ID NO: 552320 - RNA, 19 nt, Homo sapiens
gaagacagaggguguaagu

SEQ ID NO: 552321 - RNA, 19 nt, Homo sapiens
ggacacaggcaacaucuuc

SEQ ID NO: 552322 - RNA, 19 nt, Homo sapiens
ggcggaagcuugcccauca

SEQ ID NO: 552323 - RNA, 19 nt, Homo sapiens
ggagaucuuugaguaccua

SEQ ID NO: 552324 - RNA, 19 nt, Homo sapiens
ggacgaggaaguagaguau

SEQ ID NO: 552325 - RNA, 19 nt, Homo sapiens
gccacaaggccaacuguua

SEQ ID NO: 552326 - RNA, 19 nt, Homo sapiens
uacaagaguuacaguggua

SEQ ID NO: 552327 - RNA, 19 nt, Homo sapiens
agaugcagcugacuccuuu

SEQ ID NO: 552328 - RNA, 19 nt, Homo sapiens
gcucagagaaagucaagaa

SEQ ID NO: 552329 - RNA, 19 nt, Homo sapiens
ggagaaggagucguacuuu

SEQ ID NO: 552330 - RNA, 19 nt, Homo sapiens
gccgugaggugaugagcua

SEQ ID NO: 552331 - RNA, 19 nt, Homo sapiens
gcgccagagucauuuggua

SEQ ID NO: 552332 - RNA, 19 nt, Homo sapiens
gggagacgaucaagguuca

SEQ ID NO: 552333 - RNA, 19 nt, Homo sapiens
ccaaggacaccaucuucua

SEQ ID NO: 552334 - RNA, 19 nt, Homo sapiens
ucagacagcgacagugaua

SEQ ID NO: 552335 - RNA, 19 nt, Homo sapiens
gccgaaaggucuacaagag

SEQ ID NO: 552336 - RNA, 19 nt, Homo sapiens
gcuuaccgcuaccugaauu

SEQ ID NO: 552337 - RNA, 19 nt, Homo sapiens
gcaaggacuccaaccauca

SEQ ID NO: 552338 - RNA, 19 nt, Homo sapiens
ccacacgccuccagguuca

SEQ ID NO: 552339 - RNA, 19 nt, Homo sapiens
cgacuaagccaccauacga

SEQ ID NO: 552340 - RNA, 19 nt, Homo sapiens
gaggacagcagugaggaua

SEQ ID NO: 552341 - RNA, 19 nt, Homo sapiens
gaagaaggcacggaagauc

SEQ ID NO: 552342 - RNA, 19 nt, Homo sapiens
gaaccaggaccuagacaag

SEQ ID NO: 552343 - RNA, 19 nt, Homo sapiens
gcucagacagcgacaguga

SEQ ID NO: 552344 - RNA, 19 nt, Homo sapiens
ccaacacggucuuccuaga

SEQ ID NO: 552345 - RNA, 19 nt, Homo sapiens
ccaagucaggcaaacauaa

SEQ ID NO: 552346 - RNA, 19 nt, Homo sapiens
gggcaaacccuccuucucu

SEQ ID NO: 552347 - RNA, 19 nt, Homo sapiens
gcacaacgcccucaaaaca

SEQ ID NO: 552348 - RNA, 19 nt, Homo sapiens
ccacacaccacacugaaga

SEQ ID NO: 552349 - RNA, 19 nt, Homo sapiens
cuaccuagaccacaucaaa

SEQ ID NO: 552350 - RNA, 19 nt, Homo sapiens
gcaaugucauccucuucug

SEQ ID NO: 552351 - RNA, 19 nt, Homo sapiens
caaccuggaugugguguca

SEQ ID NO: 552352 - RNA, 19 nt, Homo sapiens
guggagaccugccgaaagg

SEQ ID NO: 552353 - RNA, 19 nt, Homo sapiens
ugucugagguaccugacua

SEQ ID NO: 552354 - RNA, 19 nt, Homo sapiens
gaaggacacaggcaacauc

SEQ ID NO: 552355 - RNA, 19 nt, Homo sapiens
agaaggagucguacuuuga

SEQ ID NO: 552356 - RNA, 19 nt, Homo sapiens
cagagucauuugguacuaa

SEQ ID NO: 552357 - RNA, 19 nt, Homo sapiens
ccagagucauuugguacua

SEQ ID NO: 552358 - RNA, 19 nt, Homo sapiens
ccaccacacaggcuuagua

SEQ ID NO: 552359 - RNA, 19 nt, Homo sapiens
caacggcaccucuuucagu

SEQ ID NO: 552360 - RNA, 19 nt, Homo sapiens
gaucuuugaguaccuaaug

SEQ ID NO: 552361 - RNA, 19 nt, Homo sapiens
gguggaaaccaaccaguga

SEQ ID NO: 552362 - RNA, 19 nt, Homo sapiens
gauggugagugccagaaca

SEQ ID NO: 552363 - RNA, 19 nt, Homo sapiens
uaauaaaggcgacccuaau

SEQ ID NO: 552364 - RNA, 19 nt, Homo sapiens
acgaggaaguagaguauga

SEQ ID NO: 552365 - RNA, 19 nt, Homo sapiens
ccaggagaauccauaacug

SEQ ID NO: 552366 - RNA, 19 nt, Homo sapiens
gcagcuggacuguacagaa

SEQ ID NO: 552367 - RNA, 19 nt, Homo sapiens
ccagcgauagugauugaua

SEQ ID NO: 552368 - RNA, 19 nt, Homo sapiens
acccagcucugaucauuga

SEQ ID NO: 552369 - RNA, 19 nt, Homo sapiens
ugacaaggaugggcagaca

SEQ ID NO: 552370 - RNA, 19 nt, Homo sapiens
gggagagauucugaggaua

SEQ ID NO: 552371 - RNA, 19 nt, Homo sapiens
gugaggaggaugaagauga

SEQ ID NO: 552372 - RNA, 19 nt, Homo sapiens
gagaccagcgauagugauu

SEQ ID NO: 552373 - RNA, 19 nt, Homo sapiens
gcagugagaccagcgauag

SEQ ID NO: 552374 - RNA, 19 nt, Homo sapiens
caacauccgcaagucagua

SEQ ID NO: 552375 - RNA, 19 nt, Homo sapiens
ugggagagauucugaggau

SEQ ID NO: 552376 - RNA, 19 nt, Homo sapiens
ccacacaggcuuaguaaaa

SEQ ID NO: 552377 - RNA, 19 nt, Homo sapiens
ggacgaggaggacuacauc

SEQ ID NO: 552378 - RNA, 19 nt, Homo sapiens
ggagcuggacgaggaagua

SEQ ID NO: 552379 - RNA, 19 nt, Homo sapiens
gcaucagcaucuuugacaa

SEQ ID NO: 552380 - RNA, 19 nt, Homo sapiens
acuuugaugugaagacuuu

SEQ ID NO: 552381 - RNA, 19 nt, Homo sapiens
ccucaguucuguucuccaa

SEQ ID NO: 552382 - RNA, 19 nt, Homo sapiens
cagcaacugccucaaguau

SEQ ID NO: 552383 - RNA, 19 nt, Homo sapiens
uuaaagaacagcucaaguc

SEQ ID NO: 552384 - RNA, 19 nt, Homo sapiens
gagagauucugaggauaag

SEQ ID NO: 552385 - RNA, 19 nt, Homo sapiens
caaaggaagagccaguuca

SEQ ID NO: 552386 - RNA, 19 nt, Homo sapiens
ggacuuugaugugaagacu

SEQ ID NO: 552387 - RNA, 19 nt, Homo sapiens
gaaggagucguacuuugag

SEQ ID NO: 552388 - RNA, 19 nt, Homo sapiens
cagcuggacuguacagaac

SEQ ID NO: 552389 - RNA, 19 nt, Homo sapiens
auacccagcucugaucauu

SEQ ID NO: 552390 - RNA, 19 nt, Homo sapiens
ggaaaccaaccagugaaga

SEQ ID NO: 552391 - RNA, 19 nt, Homo sapiens
gugauaaguccacagaaga

SEQ ID NO: 552392 - RNA, 19 nt, Homo sapiens
cgaucaagguucagcagau

SEQ ID NO: 552393 - RNA, 19 nt, Homo sapiens
ugacucauuucuggucuug

SEQ ID NO: 552394 - RNA, 19 nt, Homo sapiens
gagggacgcuucggaguua

SEQ ID NO: 552395 - RNA, 19 nt, Homo sapiens
gcucaggccucugggauua

SEQ ID NO: 552396 - RNA, 19 nt, Homo sapiens
gaucuacgcugccuucaag

SEQ ID NO: 552397 - RNA, 19 nt, Homo sapiens
gagaagcaccuguacaaug

SEQ ID NO: 552398 - RNA, 19 nt, Homo sapiens
gcaggaagaccuugaggaa

SEQ ID NO: 552399 - RNA, 19 nt, Homo sapiens
gguggcaucuggacaaaug

SEQ ID NO: 552400 - RNA, 19 nt, Homo sapiens
gcuacuccgugacaucuuu

SEQ ID NO: 552401 - RNA, 19 nt, Homo sapiens
ccauugcacugcucuuuga

SEQ ID NO: 552402 - RNA, 19 nt, Homo sapiens
gaaggaguauguggacugu

SEQ ID NO: 552403 - RNA, 19 nt, Homo sapiens
ugaaugcgaagaagagaua

SEQ ID NO: 552404 - RNA, 19 nt, Homo sapiens
gcagacauccugugaagca

SEQ ID NO: 552405 - RNA, 19 nt, Homo sapiens
caaugcugcugccuucaaa

SEQ ID NO: 552406 - RNA, 19 nt, Homo sapiens
uggcaaagcuaccuggaau

SEQ ID NO: 552407 - RNA, 19 nt, Homo sapiens
ccucugggauuaguaguuu

SEQ ID NO: 552408 - RNA, 19 nt, Homo sapiens
aaagcuaccuggaauggau

SEQ ID NO: 552409 - RNA, 19 nt, Homo sapiens
ccaggaugacccacucuua

SEQ ID NO: 552410 - RNA, 19 nt, Homo sapiens
gaagaggagacuuucuaug

SEQ ID NO: 552411 - RNA, 19 nt, Homo sapiens
gaaagggaagggcgaggaa

SEQ ID NO: 552412 - RNA, 19 nt, Homo sapiens
aggaaaagcugaaggagua

SEQ ID NO: 552413 - RNA, 19 nt, Homo sapiens
gauagugcgcuucggcuuu

SEQ ID NO: 552414 - RNA, 19 nt, Homo sapiens
gggcauugcugcucaccau

SEQ ID NO: 552415 - RNA, 19 nt, Homo sapiens
uaaccaccgugcacuuguu

SEQ ID NO: 552416 - RNA, 19 nt, Homo sapiens
ucucaggccaggcuaaaua

SEQ ID NO: 552417 - RNA, 19 nt, Homo sapiens
agaagcaccuguacaaugc

SEQ ID NO: 552418 - RNA, 19 nt, Homo sapiens
gcuagccgaugcccuggaa

SEQ ID NO: 552419 - RNA, 19 nt, Homo sapiens
gcuuugaggugcucuacau

SEQ ID NO: 552420 - RNA, 19 nt, Homo sapiens
accaguauuugucacuuua

SEQ ID NO: 552421 - RNA, 19 nt, Homo sapiens
caccaguauuugucacuuu

SEQ ID NO: 552422 - RNA, 19 nt, Homo sapiens
ggauuugugugcugauuuu

SEQ ID NO: 552423 - RNA, 19 nt, Homo sapiens
gcaaagcuaccuggaaugg

SEQ ID NO: 552424 - RNA, 19 nt, Homo sapiens
ggaaaagugccucaagaaa

SEQ ID NO: 552425 - RNA, 19 nt, Homo sapiens
cugcaagguuccacgcuuu

SEQ ID NO: 552426 - RNA, 19 nt, Homo sapiens
ugccuugccugcuuagaaa

SEQ ID NO: 552427 - RNA, 19 nt, Homo sapiens
gaaaagugccucaagaaag

SEQ ID NO: 552428 - RNA, 19 nt, Homo sapiens
ccaaaucagccacauccuu

SEQ ID NO: 552429 - RNA, 19 nt, Homo sapiens
cauugugggugcauaguuc

SEQ ID NO: 552430 - RNA, 19 nt, Homo sapiens
ggaugccacugcccugaag

SEQ ID NO: 552431 - RNA, 19 nt, Homo sapiens
uugaggaggaguuuguuua

SEQ ID NO: 552432 - RNA, 19 nt, Homo sapiens
aggaagaccuugaggaaaa

SEQ ID NO: 552433 - RNA, 19 nt, Homo sapiens
ccugaaggccugcaagguu

SEQ ID NO: 552434 - RNA, 19 nt, Homo sapiens
cugaagaggagacuuucua

SEQ ID NO: 552435 - RNA, 19 nt, Homo sapiens
aggaggaguuuguuuacga

SEQ ID NO: 552436 - RNA, 19 nt, Homo sapiens
ucucuugccuugccugcuu

SEQ ID NO: 552437 - RNA, 19 nt, Homo sapiens
gcaagguuccacgcuuuga

SEQ ID NO: 552438 - RNA, 19 nt, Homo sapiens
gcucuuguccagugaaagu

SEQ ID NO: 552439 - RNA, 19 nt, Homo sapiens
cagcucuuguccagugaaa

SEQ ID NO: 552440 - RNA, 19 nt, Homo sapiens
ugaagaggagacuuucuau

SEQ ID NO: 552441 - RNA, 19 nt, Homo sapiens
ucuaagcccuucccauggu

SEQ ID NO: 552442 - RNA, 19 nt, Homo sapiens
ccuguuaucccaagcucua

SEQ ID NO: 552443 - RNA, 19 nt, Homo sapiens
gcauugugggugcauaguu

SEQ ID NO: 552444 - RNA, 19 nt, Homo sapiens
ccaccaguauuugucacuu

SEQ ID NO: 552445 - RNA, 19 nt, Homo sapiens
ccagaacaaugagcuacuc

SEQ ID NO: 552446 - RNA, 19 nt, Homo sapiens
acagaacggucagccuuca

SEQ ID NO: 552447 - RNA, 19 nt, Homo sapiens
gcugccaagugcccugaga

SEQ ID NO: 552448 - RNA, 19 nt, Homo sapiens
agaagacagugcaacaacu

SEQ ID NO: 552449 - RNA, 19 nt, Homo sapiens
auagugcgcuucggcuuug

SEQ ID NO: 552450 - RNA, 19 nt, Homo sapiens
ggaccuugaggaggaguuu

SEQ ID NO: 552451 - RNA, 19 nt, Homo sapiens
gcacccaaaucagccacau

SEQ ID NO: 552452 - RNA, 19 nt, Homo sapiens
ugagggacgcuucggaguu

SEQ ID NO: 552453 - RNA, 19 nt, Homo sapiens
aagaggagacuuucuaugc

SEQ ID NO: 552454 - RNA, 19 nt, Homo sapiens
gcuggucucugugcucagu

SEQ ID NO: 552455 - RNA, 19 nt, Homo sapiens
uaccuggaauggauuugug

SEQ ID NO: 552456 - RNA, 19 nt, Homo sapiens
ggugguggcaucuggacaa

SEQ ID NO: 552457 - RNA, 19 nt, Homo sapiens
caggaugacccacucuuag

SEQ ID NO: 552458 - RNA, 19 nt, Homo sapiens
uugagaagcaccuguacaa

SEQ ID NO: 552459 - RNA, 19 nt, Homo sapiens
aaaagugccucaagaaagg

SEQ ID NO: 552460 - RNA, 19 nt, Homo sapiens
caggaagaccuugaggaaa

SEQ ID NO: 552461 - RNA, 19 nt, Homo sapiens
gugguggcaucuggacaaa

SEQ ID NO: 552462 - RNA, 19 nt, Homo sapiens
gagcuacuccgugacaucu

SEQ ID NO: 552463 - RNA, 19 nt, Homo sapiens
ggaucuacgcugccuucaa

SEQ ID NO: 552464 - RNA, 19 nt, Homo sapiens
agaacggucagccuucaaa

SEQ ID NO: 552465 - RNA, 19 nt, Homo sapiens
gggcggugaaugcgaagaa

SEQ ID NO: 552466 - RNA, 19 nt, Homo sapiens
ccuggcugcugcugugcua

SEQ ID NO: 552467 - RNA, 19 nt, Homo sapiens
aggaguauguggacugucu

SEQ ID NO: 552468 - RNA, 19 nt, Homo sapiens
cugcugaagaggagacuuu

SEQ ID NO: 552469 - RNA, 19 nt, Homo sapiens
gaagccgugugcgggacaa

SEQ ID NO: 552470 - RNA, 19 nt, Homo sapiens
ggcuguugcuccuguuauc

SEQ ID NO: 552471 - RNA, 19 nt, Homo sapiens
uugaggugcucuacaugga

SEQ ID NO: 552472 - RNA, 19 nt, Homo sapiens
guuaaccaccgugcacuug

SEQ ID NO: 552473 - RNA, 19 nt, Homo sapiens
caggccaggcuaaauaugu

SEQ ID NO: 552474 - RNA, 19 nt, Homo sapiens
ggucuccaccaguauuugu

SEQ ID NO: 552475 - RNA, 19 nt, Homo sapiens
cgccagcgcucuacuuucc

SEQ ID NO: 552476 - RNA, 19 nt, Homo sapiens
gaggaggaguuuguuuacg

SEQ ID NO: 552477 - RNA, 19 nt, Homo sapiens
cagaagacagugcaacaac

SEQ ID NO: 552478 - RNA, 19 nt, Homo sapiens
gagagaagcugcagagaua

SEQ ID NO: 552479 - RNA, 19 nt, Homo sapiens
ggacaacacugcuggguuu

SEQ ID NO: 552480 - RNA, 19 nt, Homo sapiens
cuaaguggcuucccauuaa

SEQ ID NO: 552481 - RNA, 19 nt, Homo sapiens
gcaaagugcuggagugcuu

SEQ ID NO: 552482 - RNA, 19 nt, Homo sapiens
ccugaggucucuuucuuua

SEQ ID NO: 552483 - RNA, 19 nt, Homo sapiens
ggagcugccugcugccaua

SEQ ID NO: 552484 - RNA, 19 nt, Homo sapiens
gcagagauaaugcgggaua

SEQ ID NO: 552485 - RNA, 19 nt, Homo sapiens
gcuaaguggcuucccauua

SEQ ID NO: 552486 - RNA, 19 nt, Homo sapiens
ggagaaagacgcagugcuu

SEQ ID NO: 552487 - RNA, 19 nt, Homo sapiens
cauggaagguggugaguug

SEQ ID NO: 552488 - RNA, 19 nt, Homo sapiens
gcagagagggccuuucaug

SEQ ID NO: 552489 - RNA, 19 nt, Homo sapiens
gaaaggcauuggccauugg

SEQ ID NO: 552490 - RNA, 19 nt, Homo sapiens
gagaaagacgcagugcuua

SEQ ID NO: 552491 - RNA, 19 nt, Homo sapiens
gggaaacccuagaccaugu

SEQ ID NO: 552492 - RNA, 19 nt, Homo sapiens
gaccaucacucaguucaug

SEQ ID NO: 552493 - RNA, 19 nt, Homo sapiens
gcuauacucccuauuaugu

SEQ ID NO: 552494 - RNA, 19 nt, Homo sapiens
gagauaaugcgggauauug

SEQ ID NO: 552495 - RNA, 19 nt, Homo sapiens
ggcgggagcccaagaagua

SEQ ID NO: 552496 - RNA, 19 nt, Homo sapiens
cuacacaucuaaggagaaa

SEQ ID NO: 552497 - RNA, 19 nt, Homo sapiens
ccacguugcugccugugaa

SEQ ID NO: 552498 - RNA, 19 nt, Homo sapiens
ggaagguggugaguuguuc

SEQ ID NO: 552499 - RNA, 19 nt, Homo sapiens
cccugaagcuccuguauga

SEQ ID NO: 552500 - RNA, 19 nt, Homo sapiens
ugcuuaagcucaccgauuu

SEQ ID NO: 552501 - RNA, 19 nt, Homo sapiens
gaaagccccucucuguuga

SEQ ID NO: 552502 - RNA, 19 nt, Homo sapiens
ugccauagcagcaccuuua

SEQ ID NO: 552503 - RNA, 19 nt, Homo sapiens
ggaggacccugacccuaag

SEQ ID NO: 552504 - RNA, 19 nt, Homo sapiens
gaccaggcuuucacugaga

SEQ ID NO: 552505 - RNA, 19 nt, Homo sapiens
gagaaaggcauuggccauu

SEQ ID NO: 552506 - RNA, 19 nt, Homo sapiens
gaaagacgcagugcuuaag

SEQ ID NO: 552507 - RNA, 19 nt, Homo sapiens
ggcaggagguagaccauca

SEQ ID NO: 552508 - RNA, 19 nt, Homo sapiens
agaaaggcauuggccauug

SEQ ID NO: 552509 - RNA, 19 nt, Homo sapiens
ucauguacauccuccuuug

SEQ ID NO: 552510 - RNA, 19 nt, Homo sapiens
ccugcuauacucccuauua

SEQ ID NO: 552511 - RNA, 19 nt, Homo sapiens
uaacauugcccaccgagau

SEQ ID NO: 552512 - RNA, 19 nt, Homo sapiens
cauaacagacugaaaugug

SEQ ID NO: 552513 - RNA, 19 nt, Homo sapiens
gaccgacgacuaccaguug

SEQ ID NO: 552514 - RNA, 19 nt, Homo sapiens
gggcagagagggccuuuca

SEQ ID NO: 552515 - RNA, 19 nt, Homo sapiens
ggaaagccccucucuguug

SEQ ID NO: 552516 - RNA, 19 nt, Homo sapiens
gaagaucaaggaccugaag

SEQ ID NO: 552517 - RNA, 19 nt, Homo sapiens
agaaagacgcagugcuuaa

SEQ ID NO: 552518 - RNA, 19 nt, Homo sapiens
ucagcaaggugccacuaga

SEQ ID NO: 552519 - RNA, 19 nt, Homo sapiens
gugcauggccuuagcuuuc

SEQ ID NO: 552520 - RNA, 19 nt, Homo sapiens
acaaccggcuccucaacaa

SEQ ID NO: 552521 - RNA, 19 nt, Homo sapiens
ggggcuaucuuuugguaua

SEQ ID NO: 552522 - RNA, 19 nt, Homo sapiens
acagagaggcugaccauca

SEQ ID NO: 552523 - RNA, 19 nt, Homo sapiens
ugaggucucuuucuuuacu

SEQ ID NO: 552524 - RNA, 19 nt, Homo sapiens
ccacuaugcggguagacua

SEQ ID NO: 552525 - RNA, 19 nt, Homo sapiens
gagaagcugcagagauaau

SEQ ID NO: 552526 - RNA, 19 nt, Homo sapiens
ccagaucucaggcaggaaa

SEQ ID NO: 552527 - RNA, 19 nt, Homo sapiens
gcauggccuuagcuuucua

SEQ ID NO: 552528 - RNA, 19 nt, Homo sapiens
gcucaccgauuuuggcuuu

SEQ ID NO: 552529 - RNA, 19 nt, Homo sapiens
gaagucaggggcuaucuuu

SEQ ID NO: 552530 - RNA, 19 nt, Homo sapiens
acacaucuaaggagaaaga

SEQ ID NO: 552531 - RNA, 19 nt, Homo sapiens
cgagaugucaagccugaaa

SEQ ID NO: 552532 - RNA, 19 nt, Homo sapiens
ccuagaccaugucagauag

SEQ ID NO: 552533 - RNA, 19 nt, Homo sapiens
uggaggacccugacccuaa

SEQ ID NO: 552534 - RNA, 19 nt, Homo sapiens
ccagagaaguaugacaagu

SEQ ID NO: 552535 - RNA, 19 nt, Homo sapiens
gcgaccaggcuuucacuga

SEQ ID NO: 552536 - RNA, 19 nt, Homo sapiens
ccucucagccugcauaaca

SEQ ID NO: 552537 - RNA, 19 nt, Homo sapiens
cugcuauacucccuauuau

SEQ ID NO: 552538 - RNA, 19 nt, Homo sapiens
ccacagagaggcugaccau

SEQ ID NO: 552539 - RNA, 19 nt, Homo sapiens
caagcgcugucuccucauc

SEQ ID NO: 552540 - RNA, 19 nt, Homo sapiens
gugcuuaagcucaccgauu

SEQ ID NO: 552541 - RNA, 19 nt, Homo sapiens
aaccuacucuacacaucua

SEQ ID NO: 552542 - RNA, 19 nt, Homo sapiens
cugcacagccauaacauug

SEQ ID NO: 552543 - RNA, 19 nt, Homo sapiens
gacaaaagccagcauacuu

SEQ ID NO: 552544 - RNA, 19 nt, Homo sapiens
gggcccagggucauucuuu

SEQ ID NO: 552545 - RNA, 19 nt, Homo sapiens
gcugauccgccuccuguug

SEQ ID NO: 552546 - RNA, 19 nt, Homo sapiens
gggaugaagaggaggauuc

SEQ ID NO: 552547 - RNA, 19 nt, Homo sapiens
cagcaaggugccacuagaa

SEQ ID NO: 552548 - RNA, 19 nt, Homo sapiens
caacaaccaguagcucaug

SEQ ID NO: 552549 - RNA, 19 nt, Homo sapiens
gaccugaagaccucuaaca

SEQ ID NO: 552550 - RNA, 19 nt, Homo sapiens
gcuaaggagaccacccaaa

SEQ ID NO: 552551 - RNA, 19 nt, Homo sapiens
ucacuauucccgacccaaa

SEQ ID NO: 552552 - RNA, 19 nt, Homo sapiens
gccugugaaugcugaguga

SEQ ID NO: 552553 - RNA, 19 nt, Homo sapiens
cugcauaacagacugaaau

SEQ ID NO: 552554 - RNA, 19 nt, Homo sapiens
gcaacaaccaguagcucau

SEQ ID NO: 552555 - RNA, 19 nt, Homo sapiens
acagaagugugcccugaag

SEQ ID NO: 552556 - RNA, 19 nt, Homo sapiens
ccacugggacgaagucaag

SEQ ID NO: 552557 - RNA, 19 nt, Homo sapiens
cagacacccugcuauacuc

SEQ ID NO: 552558 - RNA, 19 nt, Homo sapiens
cauggcugaucagagcuua

SEQ ID NO: 552559 - RNA, 19 nt, Homo sapiens
caaagaccacugggacgaa

SEQ ID NO: 552560 - RNA, 19 nt, Homo sapiens
cagagaggcugaccaucac

SEQ ID NO: 552561 - RNA, 19 nt, Homo sapiens
cccuagaccaugucagaua

SEQ ID NO: 552562 - RNA, 19 nt, Homo sapiens
gcauaacagacugaaaugu

SEQ ID NO: 552563 - RNA, 19 nt, Homo sapiens
gaagucaaggaggagauga

SEQ ID NO: 552564 - RNA, 19 nt, Homo sapiens
guccagagaaguaugacaa

SEQ ID NO: 552565 - RNA, 19 nt, Homo sapiens
ggccuuucauggcugauca

SEQ ID NO: 552566 - RNA, 19 nt, Homo sapiens
uugguauacuugugugaaa

SEQ ID NO: 552567 - RNA, 19 nt, Homo sapiens
cccaagaaguacgcaguga

SEQ ID NO: 552568 - RNA, 19 nt, Homo sapiens
ugucaagccugaaaaccua

SEQ ID NO: 552569 - RNA, 19 nt, Homo sapiens
gaggcugauuucucacaca

SEQ ID NO: 552570 - RNA, 19 nt, Homo sapiens
gaagguggugaguuguuca

SEQ ID NO: 552571 - RNA, 19 nt, Homo sapiens
cagagauaaugcgggauau

SEQ ID NO: 552572 - RNA, 19 nt, Homo sapiens
uaaguggcuucccauuaac

SEQ ID NO: 552573 - RNA, 19 nt, Homo sapiens
gucccugggugucaucaug

SEQ ID NO: 552574 - RNA, 19 nt, Homo sapiens
gacagaagugugcccugaa

SEQ ID NO: 552575 - RNA, 19 nt, Homo sapiens
acccuaagccuccuucaga

SEQ ID NO: 552576 - RNA, 19 nt, Homo sapiens
cagagaaguaugacaaguc

SEQ ID NO: 552577 - RNA, 19 nt, Homo sapiens
agagagaagcugcagagau

SEQ ID NO: 552578 - RNA, 19 nt, Homo sapiens
ggaaggacauugguacuga

SEQ ID NO: 552579 - RNA, 19 nt, Homo sapiens
ggauaacccuugaauguag

SEQ ID NO: 552580 - RNA, 19 nt, Homo sapiens
ggacgagacuuuaccaucu

SEQ ID NO: 552581 - RNA, 19 nt, Homo sapiens
gaacccagacgacgacaaa

SEQ ID NO: 552582 - RNA, 19 nt, Homo sapiens
ucaaugagcccaaguuugu

SEQ ID NO: 552583 - RNA, 19 nt, Homo sapiens
caggauaacccuugaaugu

SEQ ID NO: 552584 - RNA, 19 nt, Homo sapiens
gcaugcaaauuucuuccaa

SEQ ID NO: 552585 - RNA, 19 nt, Homo sapiens
gcccaaguuugucaaggua

SEQ ID NO: 552586 - RNA, 19 nt, Homo sapiens
aauuacaccuucacucaaa

SEQ ID NO: 552587 - RNA, 19 nt, Homo sapiens
ccaauuacaccuucacuca

SEQ ID NO: 552588 - RNA, 19 nt, Homo sapiens
ccaaguuugucaagguauu

SEQ ID NO: 552589 - RNA, 19 nt, Homo sapiens
uggaggagcugcacguguu

SEQ ID NO: 552590 - RNA, 19 nt, Homo sapiens
gacgagacuuuaccaucuu

SEQ ID NO: 552591 - RNA, 19 nt, Homo sapiens
guaacgcaauaaacgcauu

SEQ ID NO: 552592 - RNA, 19 nt, Homo sapiens
ccaagaggcaccagcugua

SEQ ID NO: 552593 - RNA, 19 nt, Homo sapiens
ucgaucagcuccaggaugu

SEQ ID NO: 552594 - RNA, 19 nt, Homo sapiens
guacugagugcaugaacuu

SEQ ID NO: 552595 - RNA, 19 nt, Homo sapiens
gcgccuuucuggaguguga

SEQ ID NO: 552596 - RNA, 19 nt, Homo sapiens
gcagggaaggacauuggua

SEQ ID NO: 552597 - RNA, 19 nt, Homo sapiens
uaacgcaauaaacgcauua

SEQ ID NO: 552598 - RNA, 19 nt, Homo sapiens
gcucugcggugugcgugua

SEQ ID NO: 552599 - RNA, 19 nt, Homo sapiens
ucaccagcaugcaaauuuc

SEQ ID NO: 552600 - RNA, 19 nt, Homo sapiens
caggauguguuucuguugu

SEQ ID NO: 552601 - RNA, 19 nt, Homo sapiens
ccacccaaccugugccuuu

SEQ ID NO: 552602 - RNA, 19 nt, Homo sapiens
acccugagcugcugagaug

SEQ ID NO: 552603 - RNA, 19 nt, Homo sapiens
gagagaggagccagacaga

SEQ ID NO: 552604 - RNA, 19 nt, Homo sapiens
gcaagaccuuuggcaccuu

SEQ ID NO: 552605 - RNA, 19 nt, Homo sapiens
ccucaugggacgagacuuu

SEQ ID NO: 552606 - RNA, 19 nt, Homo sapiens
ggagacgacaggcgagaga

SEQ ID NO: 552607 - RNA, 19 nt, Homo sapiens
gucaccagcaugcaaauuu

SEQ ID NO: 552608 - RNA, 19 nt, Homo sapiens
ggacucgggcguguacuug

SEQ ID NO: 552609 - RNA, 19 nt, Homo sapiens
guccaagucuccgaacaga

SEQ ID NO: 552610 - RNA, 19 nt, Homo sapiens
uuaacaggauaacccuuga

SEQ ID NO: 552611 - RNA, 19 nt, Homo sapiens
ggaggagcugcacguguuu

SEQ ID NO: 552612 - RNA, 19 nt, Homo sapiens
ggacuucccagacgauguc

SEQ ID NO: 552613 - RNA, 19 nt, Homo sapiens
gcagccuggucaacaagug

SEQ ID NO: 552614 - RNA, 19 nt, Homo sapiens
agacagacccugaaaagaa

SEQ ID NO: 552615 - RNA, 19 nt, Homo sapiens
ccuaggggcuguaaucuga

SEQ ID NO: 552616 - RNA, 19 nt, Homo sapiens
ccuacaaccgcacccauuu

SEQ ID NO: 552617 - RNA, 19 nt, Homo sapiens
ggcaagacguaaggaaugg

SEQ ID NO: 552618 - RNA, 19 nt, Homo sapiens
caauuacaccuucacucaa

SEQ ID NO: 552619 - RNA, 19 nt, Homo sapiens
caaggcuccuccacacaca

SEQ ID NO: 552620 - RNA, 19 nt, Homo sapiens
gaucagcuccaggaugugu

SEQ ID NO: 552621 - RNA, 19 nt, Homo sapiens
gagcagaaagcugugaaca

SEQ ID NO: 552622 - RNA, 19 nt, Homo sapiens
gacaaaaucuacuucuucu

SEQ ID NO: 552623 - RNA, 19 nt, Homo sapiens
ggaggguucggaaguggaa

SEQ ID NO: 552624 - RNA, 19 nt, Homo sapiens
aggauaacccuugaaugua

SEQ ID NO: 552625 - RNA, 19 nt, Homo sapiens
gccugucgcugcacguguu

SEQ ID NO: 552626 - RNA, 19 nt, Homo sapiens
gcugacuccucuuccagau

SEQ ID NO: 552627 - RNA, 19 nt, Homo sapiens
gcugcucuaugccgucuuc

SEQ ID NO: 552628 - RNA, 19 nt, Homo sapiens
caaguuugucaagguauuu

SEQ ID NO: 552629 - RNA, 19 nt, Homo sapiens
gguggcagcagaccucaug

SEQ ID NO: 552630 - RNA, 19 nt, Homo sapiens
gcgggcuuauuuauuaaca

SEQ ID NO: 552631 - RNA, 19 nt, Homo sapiens
cgaacucccugcgcaugug

SEQ ID NO: 552632 - RNA, 19 nt, Homo sapiens
cggcaagacguaaggaaug

SEQ ID NO: 552633 - RNA, 19 nt, Homo sapiens
uccaggauguguuucuguu

SEQ ID NO: 552634 - RNA, 19 nt, Homo sapiens
cacccaaccugugccuuug

SEQ ID NO: 552635 - RNA, 19 nt, Homo sapiens
cuacaaccgcacccauuug

SEQ ID NO: 552636 - RNA, 19 nt, Homo sapiens
ggagccaauuacaccuuca

SEQ ID NO: 552637 - RNA, 19 nt, Homo sapiens
gggcgacacccacuucgau

SEQ ID NO: 552638 - RNA, 19 nt, Homo sapiens
ccaccuccuuggguaguga

SEQ ID NO: 552639 - RNA, 19 nt, Homo sapiens
aggccuugcugguggauga

SEQ ID NO: 552640 - RNA, 19 nt, Homo sapiens
acgagacuuuaccaucuuu

SEQ ID NO: 552641 - RNA, 19 nt, Homo sapiens
uaacaggauaacccuugaa

SEQ ID NO: 552642 - RNA, 19 nt, Homo sapiens
gacucccgcuggcucaaug

SEQ ID NO: 552643 - RNA, 19 nt, Homo sapiens
gguacugagugcaugaacu

SEQ ID NO: 552644 - RNA, 19 nt, Homo sapiens
gggcagggaaggacauugg

SEQ ID NO: 552645 - RNA, 19 nt, Homo sapiens
gacagacccugaaaagaag

SEQ ID NO: 552646 - RNA, 19 nt, Homo sapiens
gagccagacagacccugaa

SEQ ID NO: 552647 - RNA, 19 nt, Homo sapiens
gcggcaagacguaaggaau

SEQ ID NO: 552648 - RNA, 19 nt, Homo sapiens
ucaacaaguggacgacguu

SEQ ID NO: 552649 - RNA, 19 nt, Homo sapiens
cgacaaaaucuacuucuuc

SEQ ID NO: 552650 - RNA, 19 nt, Homo sapiens
ccgcgcugcuggaacacaa

SEQ ID NO: 552651 - RNA, 19 nt, Homo sapiens
acacuaugacguccucuuc

SEQ ID NO: 552652 - RNA, 19 nt, Homo sapiens
gcuccaggauguguuucug

SEQ ID NO: 552653 - RNA, 19 nt, Homo sapiens
gggaaggacauugguacug

SEQ ID NO: 552654 - RNA, 19 nt, Homo sapiens
ggaaagaacuugagaauca

SEQ ID NO: 552655 - RNA, 19 nt, Homo sapiens
ggaauccacuaaacaaaua

SEQ ID NO: 552656 - RNA, 19 nt, Homo sapiens
gcuaacagcuuuacaagaa

SEQ ID NO: 552657 - RNA, 19 nt, Homo sapiens
cagcagaaguccaagaaua

SEQ ID NO: 552658 - RNA, 19 nt, Homo sapiens
caaaggaugugcagaaaga

SEQ ID NO: 552659 - RNA, 19 nt, Homo sapiens
gaaagcagcgucugaauau

SEQ ID NO: 552660 - RNA, 19 nt, Homo sapiens
ggccagagcuucuccauga

SEQ ID NO: 552661 - RNA, 19 nt, Homo sapiens
ggaaagcagcgucugaaua

SEQ ID NO: 552662 - RNA, 19 nt, Homo sapiens
ugacauugcuucuuuacaa

SEQ ID NO: 552663 - RNA, 19 nt, Homo sapiens
guuuagagcuuaccaguga

SEQ ID NO: 552664 - RNA, 19 nt, Homo sapiens
acacugacauugcuucuuu

SEQ ID NO: 552665 - RNA, 19 nt, Homo sapiens
gauaaugauuucaccaaug

SEQ ID NO: 552666 - RNA, 19 nt, Homo sapiens
gaacugcaacggcaagaaa

SEQ ID NO: 552667 - RNA, 19 nt, Homo sapiens
aagaagagcuuaagaaggu

SEQ ID NO: 552668 - RNA, 19 nt, Homo sapiens
ggauucagcugauuuaaaa

SEQ ID NO: 552669 - RNA, 19 nt, Homo sapiens
gaucucagcauccuucaaa

SEQ ID NO: 552670 - RNA, 19 nt, Homo sapiens
ggagcuagcuagaacaagu

SEQ ID NO: 552671 - RNA, 19 nt, Homo sapiens
gcuguagggucauugcuuu

SEQ ID NO: 552672 - RNA, 19 nt, Homo sapiens
ucaaaugucuaggaaagaa

SEQ ID NO: 552673 - RNA, 19 nt, Homo sapiens
gaaguugaaguuugaaaug

SEQ ID NO: 552674 - RNA, 19 nt, Homo sapiens
gaacagcaucuucgggauu

SEQ ID NO: 552675 - RNA, 19 nt, Homo sapiens
ugaaaugacugagcaggaa

SEQ ID NO: 552676 - RNA, 19 nt, Homo sapiens
cagcuuagaugucaacagu

SEQ ID NO: 552677 - RNA, 19 nt, Homo sapiens
gaaaucacaagucugcaaa

SEQ ID NO: 552678 - RNA, 19 nt, Homo sapiens
agaaagaaaucacaagucu

SEQ ID NO: 552679 - RNA, 19 nt, Homo sapiens
gaaauacagcaucuucgaa

SEQ ID NO: 552680 - RNA, 19 nt, Homo sapiens
gaucgaagcccaggagcua

SEQ ID NO: 552681 - RNA, 19 nt, Homo sapiens
gcagagagaagaagcaaca

SEQ ID NO: 552682 - RNA, 19 nt, Homo sapiens
gguuacacaucgauacuga

SEQ ID NO: 552683 - RNA, 19 nt, Homo sapiens
ucuagaagcuggcaucaca

SEQ ID NO: 552684 - RNA, 19 nt, Homo sapiens
gcaagcugauaaugauuuc

SEQ ID NO: 552685 - RNA, 19 nt, Homo sapiens
gagaagaagcaacaagguu

SEQ ID NO: 552686 - RNA, 19 nt, Homo sapiens
gcuuagaugucaacagugu

SEQ ID NO: 552687 - RNA, 19 nt, Homo sapiens
guagggucauugcuuuaaa

SEQ ID NO: 552688 - RNA, 19 nt, Homo sapiens
gggacaaacagaaccauuu

SEQ ID NO: 552689 - RNA, 19 nt, Homo sapiens
acacaucgauacugagaau

SEQ ID NO: 552690 - RNA, 19 nt, Homo sapiens
aacaggagcuccaggcaaa

SEQ ID NO: 552691 - RNA, 19 nt, Homo sapiens
gcuagaacaaguaaacaaa

SEQ ID NO: 552692 - RNA, 19 nt, Homo sapiens
gaaagaguaugaaaagaca

SEQ ID NO: 552693 - RNA, 19 nt, Homo sapiens
ggagaaggacagugaaauc

SEQ ID NO: 552694 - RNA, 19 nt, Homo sapiens
agucagaaauugaggcaaa

SEQ ID NO: 552695 - RNA, 19 nt, Homo sapiens
gaagcuggcaucacacuca

SEQ ID NO: 552696 - RNA, 19 nt, Homo sapiens
aaucacagaugagcucaaa

SEQ ID NO: 552697 - RNA, 19 nt, Homo sapiens
agagaugaauugcuuagug

SEQ ID NO: 552698 - RNA, 19 nt, Homo sapiens
cuagagaaguugagaaagg

SEQ ID NO: 552699 - RNA, 19 nt, Homo sapiens
aaaugagccucuugccaaa

SEQ ID NO: 552700 - RNA, 19 nt, Homo sapiens
guacaccgccuccucuaga

SEQ ID NO: 552701 - RNA, 19 nt, Homo sapiens
gaaaugacugagcaggaaa

SEQ ID NO: 552702 - RNA, 19 nt, Homo sapiens
gaaaucacaaguacuagag

SEQ ID NO: 552703 - RNA, 19 nt, Homo sapiens
gggauucagcugauuuaaa

SEQ ID NO: 552704 - RNA, 19 nt, Homo sapiens
gagaaggacagugaaauca

SEQ ID NO: 552705 - RNA, 19 nt, Homo sapiens
gggaggagaaggacaguga

SEQ ID NO: 552706 - RNA, 19 nt, Homo sapiens
gaggaauccacuaaacaaa

SEQ ID NO: 552707 - RNA, 19 nt, Homo sapiens
auuccuggcuuuccugaua

SEQ ID NO: 552708 - RNA, 19 nt, Homo sapiens
cgagagaaaggaaauaauc

SEQ ID NO: 552709 - RNA, 19 nt, Homo sapiens
gagcuagcuagaacaagua

SEQ ID NO: 552710 - RNA, 19 nt, Homo sapiens
aaauacagcaucuucgaaa

SEQ ID NO: 552711 - RNA, 19 nt, Homo sapiens
ugaggcaaagcaagaaaua

SEQ ID NO: 552712 - RNA, 19 nt, Homo sapiens
ccaaauggaugagcaagac

SEQ ID NO: 552713 - RNA, 19 nt, Homo sapiens
cuaacagcuuuacaagaaa

SEQ ID NO: 552714 - RNA, 19 nt, Homo sapiens
uagagaaguugagaaagga

SEQ ID NO: 552715 - RNA, 19 nt, Homo sapiens
gaugagcucaaacagugua

SEQ ID NO: 552716 - RNA, 19 nt, Homo sapiens
cuucaaaugucuaggaaag

SEQ ID NO: 552717 - RNA, 19 nt, Homo sapiens
ucaagcagcagcaaagguu

SEQ ID NO: 552718 - RNA, 19 nt, Homo sapiens
cacuacagaugcccaaaug

SEQ ID NO: 552719 - RNA, 19 nt, Homo sapiens
gaggagaaggacagugaaa

SEQ ID NO: 552720 - RNA, 19 nt, Homo sapiens
ggacaaacagaaccauuuu

SEQ ID NO: 552721 - RNA, 19 nt, Homo sapiens
ucacagaugagcucaaaca

SEQ ID NO: 552722 - RNA, 19 nt, Homo sapiens
agaaaggaauggaaugcau

SEQ ID NO: 552723 - RNA, 19 nt, Homo sapiens
gagaaagaaaucacaaguc

SEQ ID NO: 552724 - RNA, 19 nt, Homo sapiens
ccucugagcgggacacuga

SEQ ID NO: 552725 - RNA, 19 nt, Homo sapiens
uacuagagaugaauugcuu

SEQ ID NO: 552726 - RNA, 19 nt, Homo sapiens
gagcuuaccagugaucuca

SEQ ID NO: 552727 - RNA, 19 nt, Homo sapiens
aagcagcgucugaauauga

SEQ ID NO: 552728 - RNA, 19 nt, Homo sapiens
cacaaguacuagagaugaa

SEQ ID NO: 552729 - RNA, 19 nt, Homo sapiens
ugaggaauccacuaaacaa

SEQ ID NO: 552730 - RNA, 19 nt, Homo sapiens
gaaagaaaagccuaucgaa

SEQ ID NO: 552731 - RNA, 19 nt, Homo sapiens
cuacagaugcccaaaugga

SEQ ID NO: 552732 - RNA, 19 nt, Homo sapiens
gacauugcuucuuuacaag

SEQ ID NO: 552733 - RNA, 19 nt, Homo sapiens
ucacaaguacuagagauga

SEQ ID NO: 552734 - RNA, 19 nt, Homo sapiens
gaagcugcuccgagagaaa

SEQ ID NO: 552735 - RNA, 19 nt, Homo sapiens
gugcagaaagaguaugaaa

SEQ ID NO: 552736 - RNA, 19 nt, Homo sapiens
aagcaaaggaugugcagaa

SEQ ID NO: 552737 - RNA, 19 nt, Homo sapiens
cagcauccuucaaaugucu

SEQ ID NO: 552738 - RNA, 19 nt, Homo sapiens
acaaauacagguucuucaa

SEQ ID NO: 552739 - RNA, 19 nt, Homo sapiens
gcagaaagaguaugaaaag

SEQ ID NO: 552740 - RNA, 19 nt, Homo sapiens
uaggaaagaacuugagaau

SEQ ID NO: 552741 - RNA, 19 nt, Homo sapiens
uacaagaagagcuuaagaa

SEQ ID NO: 552742 - RNA, 19 nt, Homo sapiens
aaacaaauacagguucuuc

SEQ ID NO: 552743 - RNA, 19 nt, Homo sapiens
ggugcacagucagaaauug

SEQ ID NO: 552744 - RNA, 19 nt, Homo sapiens
caaguacuagagaugaauu

SEQ ID NO: 552745 - RNA, 19 nt, Homo sapiens
guugaggaauccacuaaac

SEQ ID NO: 552746 - RNA, 19 nt, Homo sapiens
gcagaaguccaagaauaca

SEQ ID NO: 552747 - RNA, 19 nt, Homo sapiens
gaugagcaagaccuaaaug

SEQ ID NO: 552748 - RNA, 19 nt, Homo sapiens
gcaaaggaugugcagaaag

SEQ ID NO: 552749 - RNA, 19 nt, Homo sapiens
gcuaucaucagaacugcaa

SEQ ID NO: 552750 - RNA, 19 nt, Homo sapiens
guugcaaggugaacuagag

SEQ ID NO: 552751 - RNA, 19 nt, Homo sapiens
ugaaaucacaaguacuaga

SEQ ID NO: 552752 - RNA, 19 nt, Homo sapiens
caaauacagguucuucaag

SEQ ID NO: 552753 - RNA, 19 nt, Homo sapiens
cuaaacaaauacagguucu

SEQ ID NO: 552754 - RNA, 19 nt, Homo sapiens
gaagauaaaugaacugaug

SEQ ID NO: 552755 - RNA, 19 nt, Homo sapiens
uaaaugaacugaugccuaa

SEQ ID NO: 552756 - RNA, 19 nt, Homo sapiens
gugagaagcuuaagaagaa

SEQ ID NO: 552757 - RNA, 19 nt, Homo sapiens
uaugugagcuuaaguauga

SEQ ID NO: 552758 - RNA, 19 nt, Homo sapiens
uuaaagagcugaagaagau

SEQ ID NO: 552759 - RNA, 19 nt, Homo sapiens
gaagaaggacagccagaua

SEQ ID NO: 552760 - RNA, 19 nt, Homo sapiens
gaacugaugccuaaauaug

SEQ ID NO: 552761 - RNA, 19 nt, Homo sapiens
ugaagaagcuccgaguuaa

SEQ ID NO: 552762 - RNA, 19 nt, Homo sapiens
caaagugugucugggauuu

SEQ ID NO: 552763 - RNA, 19 nt, Homo sapiens
uaagugggcuccugacaau

SEQ ID NO: 552764 - RNA, 19 nt, Homo sapiens
gaagaucugugagaagcuu

SEQ ID NO: 552765 - RNA, 19 nt, Homo sapiens
gaagaagcuccgaguuaaa

SEQ ID NO: 552766 - RNA, 19 nt, Homo sapiens
gaagcaagaggcaaagaga

SEQ ID NO: 552767 - RNA, 19 nt, Homo sapiens
gcacaguggaccugaagaa

SEQ ID NO: 552768 - RNA, 19 nt, Homo sapiens
gagaaucgguugugcuacu

SEQ ID NO: 552769 - RNA, 19 nt, Homo sapiens
gacuacauccggaagauaa

SEQ ID NO: 552770 - RNA, 19 nt, Homo sapiens
cugaagaagcuccgaguua

SEQ ID NO: 552771 - RNA, 19 nt, Homo sapiens
gccuggagcuuuccugaug

SEQ ID NO: 552772 - RNA, 19 nt, Homo sapiens
gcaaagagaaucgguugug

SEQ ID NO: 552773 - RNA, 19 nt, Homo sapiens
ccagugcaccgaccgauuu

SEQ ID NO: 552774 - RNA, 19 nt, Homo sapiens
gcgaaguuuguauuucuua

SEQ ID NO: 552775 - RNA, 19 nt, Homo sapiens
ccagauaugugagcuuaag

SEQ ID NO: 552776 - RNA, 19 nt, Homo sapiens
gauaugugagcuuaaguau

SEQ ID NO: 552777 - RNA, 19 nt, Homo sapiens
ggaggaggaugaggaggau

SEQ ID NO: 552778 - RNA, 19 nt, Homo sapiens
augaacugaugccuaaaua

SEQ ID NO: 552779 - RNA, 19 nt, Homo sapiens
gaaggacagccagauaugu

SEQ ID NO: 552780 - RNA, 19 nt, Homo sapiens
agccagauaugugagcuua

SEQ ID NO: 552781 - RNA, 19 nt, Homo sapiens
uggagaagaucugugagaa

SEQ ID NO: 552782 - RNA, 19 nt, Homo sapiens
cgacugcgaaguuuguauu

SEQ ID NO: 552783 - RNA, 19 nt, Homo sapiens
guuaaagagcugaagaaga

SEQ ID NO: 552784 - RNA, 19 nt, Homo sapiens
gaguuaaagagcugaagaa

SEQ ID NO: 552785 - RNA, 19 nt, Homo sapiens
gugcaccgaccgauuugua

SEQ ID NO: 552786 - RNA, 19 nt, Homo sapiens
aaucgguugugcuacuaua

SEQ ID NO: 552787 - RNA, 19 nt, Homo sapiens
gagcuuuccugaugaugcu

SEQ ID NO: 552788 - RNA, 19 nt, Homo sapiens
agacaccaccagccaauga

SEQ ID NO: 552789 - RNA, 19 nt, Homo sapiens
aagagaaucgguugugcua

SEQ ID NO: 552790 - RNA, 19 nt, Homo sapiens
ggagaagaucugugagaag

SEQ ID NO: 552791 - RNA, 19 nt, Homo sapiens
agaaucgguugugcuacua

SEQ ID NO: 552792 - RNA, 19 nt, Homo sapiens
gcaagaggcaaagagaauc

SEQ ID NO: 552793 - RNA, 19 nt, Homo sapiens
ucaccagccacuauugaaa

SEQ ID NO: 552794 - RNA, 19 nt, Homo sapiens
agauaugugagcuuaagua

SEQ ID NO: 552795 - RNA, 19 nt, Homo sapiens
caaaggcugugcagaaaag

SEQ ID NO: 552796 - RNA, 19 nt, Homo sapiens
aagaaggacagccagauau

SEQ ID NO: 552797 - RNA, 19 nt, Homo sapiens
cugcgaaguuuguauuucu

SEQ ID NO: 552798 - RNA, 19 nt, Homo sapiens
ggaagcaagaggcaaagag

SEQ ID NO: 552799 - RNA, 19 nt, Homo sapiens
ugugagaagcuuaagaaga

SEQ ID NO: 552800 - RNA, 19 nt, Homo sapiens
gaugcuggcccuacaguac

SEQ ID NO: 552801 - RNA, 19 nt, Homo sapiens
ggauucccuuccuucuguu

SEQ ID NO: 552802 - RNA, 19 nt, Homo sapiens
ugacuacauccggaagaua

SEQ ID NO: 552803 - RNA, 19 nt, Homo sapiens
caguggaccugaagaagcu

SEQ ID NO: 552804 - RNA, 19 nt, Homo sapiens
ucugugagaagcuuaagaa

SEQ ID NO: 552805 - RNA, 19 nt, Homo sapiens
ccuggagcuuuccugauga

SEQ ID NO: 552806 - RNA, 19 nt, Homo sapiens
gagcacaguggaccugaag

SEQ ID NO: 552807 - RNA, 19 nt, Homo sapiens
gcaccgaccgauuuguagu

SEQ ID NO: 552808 - RNA, 19 nt, Homo sapiens
aaucagcggccacaacugu

SEQ ID NO: 552809 - RNA, 19 nt, Homo sapiens
cgaguuaaagagcugaaga

SEQ ID NO: 552810 - RNA, 19 nt, Homo sapiens
agaaggacagccagauaug

SEQ ID NO: 552811 - RNA, 19 nt, Homo sapiens
guggagaagaucugugaga

SEQ ID NO: 552812 - RNA, 19 nt, Homo sapiens
gguguacucuaggacuuca

SEQ ID NO: 552813 - RNA, 19 nt, Homo sapiens
ucaacugcuuacucccaaa

SEQ ID NO: 552814 - RNA, 19 nt, Homo sapiens
gggcgacugcgaaguuugu

SEQ ID NO: 552815 - RNA, 19 nt, Homo sapiens
uuuguagucugcucaaucu

SEQ ID NO: 552816 - RNA, 19 nt, Homo sapiens
ggaagauaaaugaacugau

SEQ ID NO: 552817 - RNA, 19 nt, Homo sapiens
ggaccucaaagacagagau

SEQ ID NO: 552818 - RNA, 19 nt, Homo sapiens
gaagcuccgaguuaaagag

SEQ ID NO: 552819 - RNA, 19 nt, Homo sapiens
ugaggaggaugaggaggau

SEQ ID NO: 552820 - RNA, 19 nt, Homo sapiens
uuaagugggcuccugacaa

SEQ ID NO: 552821 - RNA, 19 nt, Homo sapiens
ugagcacaguggaccugaa

SEQ ID NO: 552822 - RNA, 19 nt, Homo sapiens
ucaaagugugucugggauu

SEQ ID NO: 552823 - RNA, 19 nt, Homo sapiens
ugaugaugcuggcccuaca

SEQ ID NO: 552824 - RNA, 19 nt, Homo sapiens
ugaacugaugccuaaauau

SEQ ID NO: 552825 - RNA, 19 nt, Homo sapiens
uaccaggaccucaaagaca

SEQ ID NO: 552826 - RNA, 19 nt, Homo sapiens
gaaucgguugugcuacuau

SEQ ID NO: 552827 - RNA, 19 nt, Homo sapiens
gacugcgaaguuuguauuu

SEQ ID NO: 552828 - RNA, 19 nt, Homo sapiens
gcaaaggcugugcagaaaa

SEQ ID NO: 552829 - RNA, 19 nt, Homo sapiens
ucaaucagcggccacaacu

SEQ ID NO: 552830 - RNA, 19 nt, Homo sapiens
caucaaugagguaucaaag

SEQ ID NO: 552831 - RNA, 19 nt, Homo sapiens
ggaaugacauguacgauga

SEQ ID NO: 552832 - RNA, 19 nt, Homo sapiens
gagaaaggauuuauagaug

SEQ ID NO: 552833 - RNA, 19 nt, Homo sapiens
gaagauguaugaucccaaa

SEQ ID NO: 552834 - RNA, 19 nt, Homo sapiens
cuaaggacccugcaaauua

SEQ ID NO: 552835 - RNA, 19 nt, Homo sapiens
gaccagcaauguuagauaa

SEQ ID NO: 552836 - RNA, 19 nt, Homo sapiens
gugguuacguuaucaaaua

SEQ ID NO: 552837 - RNA, 19 nt, Homo sapiens
cagagaaacucacaaccua

SEQ ID NO: 552838 - RNA, 19 nt, Homo sapiens
ggagaaagcaucagggaaa

SEQ ID NO: 552839 - RNA, 19 nt, Homo sapiens
gcaggaagcccaucucuau

SEQ ID NO: 552840 - RNA, 19 nt, Homo sapiens
ugacgugucucuugauaaa

SEQ ID NO: 552841 - RNA, 19 nt, Homo sapiens
gaaacucacaaccuaauaa

SEQ ID NO: 552842 - RNA, 19 nt, Homo sapiens
ggacauagacaaagagaau

SEQ ID NO: 552843 - RNA, 19 nt, Homo sapiens
gaagguacuuuaagagauc

SEQ ID NO: 552844 - RNA, 19 nt, Homo sapiens
aagcgucccuuuagcauua

SEQ ID NO: 552845 - RNA, 19 nt, Homo sapiens
gaaaggcuguguacaugau

SEQ ID NO: 552846 - RNA, 19 nt, Homo sapiens
guaauccucuuagacauaa

SEQ ID NO: 552847 - RNA, 19 nt, Homo sapiens
ugacagagcaggauuuauu

SEQ ID NO: 552848 - RNA, 19 nt, Homo sapiens
caaagaguguucuaugaau

SEQ ID NO: 552849 - RNA, 19 nt, Homo sapiens
uaaggacccugcaaauuau

SEQ ID NO: 552850 - RNA, 19 nt, Homo sapiens
gaaggaguuugagaaguuu

SEQ ID NO: 552851 - RNA, 19 nt, Homo sapiens
gagcaggauuuauucaaga

SEQ ID NO: 552852 - RNA, 19 nt, Homo sapiens
ugauugagcucagugauaa

SEQ ID NO: 552853 - RNA, 19 nt, Homo sapiens
cacuaaugcuuacauguua

SEQ ID NO: 552854 - RNA, 19 nt, Homo sapiens
gcacuaaugcuuacauguu

SEQ ID NO: 552855 - RNA, 19 nt, Homo sapiens
gggcauaucuacacaccaa

SEQ ID NO: 552856 - RNA, 19 nt, Homo sapiens
gaagacgaguaugaaguaa

SEQ ID NO: 552857 - RNA, 19 nt, Homo sapiens
agaaggaguuugagaaguu

SEQ ID NO: 552858 - RNA, 19 nt, Homo sapiens
gaugacccaccaagaauua

SEQ ID NO: 552859 - RNA, 19 nt, Homo sapiens
aaacuuaggcugcuagaaa

SEQ ID NO: 552860 - RNA, 19 nt, Homo sapiens
gaauagaggaaaucccuuu

SEQ ID NO: 552861 - RNA, 19 nt, Homo sapiens
gaagaggaaauaacacuau

SEQ ID NO: 552862 - RNA, 19 nt, Homo sapiens
ccuauuuccuucaguuaua

SEQ ID NO: 552863 - RNA, 19 nt, Homo sapiens
uaaaugaagacgaguauga

SEQ ID NO: 552864 - RNA, 19 nt, Homo sapiens
guaaagaaguagacuaucg

SEQ ID NO: 552865 - RNA, 19 nt, Homo sapiens
ggagcgacuuguuacauga

SEQ ID NO: 552866 - RNA, 19 nt, Homo sapiens
gauggcaaaugguguaaau

SEQ ID NO: 552867 - RNA, 19 nt, Homo sapiens
gcaaaaugguguccuauau

SEQ ID NO: 552868 - RNA, 19 nt, Homo sapiens
uauugaggcuguucaguuu

SEQ ID NO: 552869 - RNA, 19 nt, Homo sapiens
ggaagcccaucucuauaug

SEQ ID NO: 552870 - RNA, 19 nt, Homo sapiens
ccagagcaguuaccacuug

SEQ ID NO: 552871 - RNA, 19 nt, Homo sapiens
agagaaaggugugaaauuc

SEQ ID NO: 552872 - RNA, 19 nt, Homo sapiens
uacaaagaguguucuauga

SEQ ID NO: 552873 - RNA, 19 nt, Homo sapiens
gagaagugaugaagcgaau

SEQ ID NO: 552874 - RNA, 19 nt, Homo sapiens
ggaaauaacacuauaucca

SEQ ID NO: 552875 - RNA, 19 nt, Homo sapiens
guucgacacugcacuaaug

SEQ ID NO: 552876 - RNA, 19 nt, Homo sapiens
gcaguuaccacuugaugaa

SEQ ID NO: 552877 - RNA, 19 nt, Homo sapiens
ggagcgaccuuacccaagu

SEQ ID NO: 552878 - RNA, 19 nt, Homo sapiens
caacugaugagauuuaugu

SEQ ID NO: 552879 - RNA, 19 nt, Homo sapiens
gaaaggcaccuguguagag

SEQ ID NO: 552880 - RNA, 19 nt, Homo sapiens
ugauaaaccuguaggaaca

SEQ ID NO: 552881 - RNA, 19 nt, Homo sapiens
gcauagugauaaaccugua

SEQ ID NO: 552882 - RNA, 19 nt, Homo sapiens
gaauuacagcauagugaua

SEQ ID NO: 552883 - RNA, 19 nt, Homo sapiens
cuacaacugaugagauuua

SEQ ID NO: 552884 - RNA, 19 nt, Homo sapiens
uaugauauccagcuaagua

SEQ ID NO: 552885 - RNA, 19 nt, Homo sapiens
gaguguugcucgauaaugu

SEQ ID NO: 552886 - RNA, 19 nt, Homo sapiens
gguaauccucuuagacaua

SEQ ID NO: 552887 - RNA, 19 nt, Homo sapiens
ugauaaagcccuugaugaa

SEQ ID NO: 552888 - RNA, 19 nt, Homo sapiens
aaacgcggagcuugaauua

SEQ ID NO: 552889 - RNA, 19 nt, Homo sapiens
gaggcaaccuuucaguuca

SEQ ID NO: 552890 - RNA, 19 nt, Homo sapiens
gagaacaggcgaaguuuua

SEQ ID NO: 552891 - RNA, 19 nt, Homo sapiens
gcauaucuacacaccaaua

SEQ ID NO: 552892 - RNA, 19 nt, Homo sapiens
cagcaauguuagauaauga

SEQ ID NO: 552893 - RNA, 19 nt, Homo sapiens
gaugaaaggcaccugugua

SEQ ID NO: 552894 - RNA, 19 nt, Homo sapiens
gugcaucuguuaaggcaaa

SEQ ID NO: 552895 - RNA, 19 nt, Homo sapiens
caguuuggcuucucuguau

SEQ ID NO: 552896 - RNA, 19 nt, Homo sapiens
agacgaguaugaaguaaau

SEQ ID NO: 552897 - RNA, 19 nt, Homo sapiens
ugaagacgaguaugaagua

SEQ ID NO: 552898 - RNA, 19 nt, Homo sapiens
cacagaggcucaacacaga

SEQ ID NO: 552899 - RNA, 19 nt, Homo sapiens
uaaagcccuugaugaacua

SEQ ID NO: 552900 - RNA, 19 nt, Homo sapiens
cgacaccaguacauaaaug

SEQ ID NO: 552901 - RNA, 19 nt, Homo sapiens
cagagagaauucaggacua

SEQ ID NO: 552902 - RNA, 19 nt, Homo sapiens
gaaaacccuuggacaauau

SEQ ID NO: 552903 - RNA, 19 nt, Homo sapiens
gaagugaccgauccugaga

SEQ ID NO: 552904 - RNA, 19 nt, Homo sapiens
ggaagaggaaauaacacua

SEQ ID NO: 552905 - RNA, 19 nt, Homo sapiens
uaugacgugucucuugaua

SEQ ID NO: 552906 - RNA, 19 nt, Homo sapiens
aaaccgaauuuaacagaga

SEQ ID NO: 552907 - RNA, 19 nt, Homo sapiens
gcaccauacccaaauuauu

SEQ ID NO: 552908 - RNA, 19 nt, Homo sapiens
caccaagaauuacucagaa

SEQ ID NO: 552909 - RNA, 19 nt, Homo sapiens
acacaccaauauccuguaa

SEQ ID NO: 552910 - RNA, 19 nt, Homo sapiens
ugacauguacgaugaagaa

SEQ ID NO: 552911 - RNA, 19 nt, Homo sapiens
guuaccacuugaugaauuu

SEQ ID NO: 552912 - RNA, 19 nt, Homo sapiens
ggaauguggcccugaguga

SEQ ID NO: 552913 - RNA, 19 nt, Homo sapiens
uguccuauauccaguguaa

SEQ ID NO: 552914 - RNA, 19 nt, Homo sapiens
gggagcgacuuguuacaug

SEQ ID NO: 552915 - RNA, 19 nt, Homo sapiens
gcagugcugaagauaauaa

SEQ ID NO: 552916 - RNA, 19 nt, Homo sapiens
gaaagcaucagggaaacuu

SEQ ID NO: 552917 - RNA, 19 nt, Homo sapiens
ggugugaaauuccuaacau

SEQ ID NO: 552918 - RNA, 19 nt, Homo sapiens
caaagagaaugagaugcuu

SEQ ID NO: 552919 - RNA, 19 nt, Homo sapiens
gagccggacguuucgaaua

SEQ ID NO: 552920 - RNA, 19 nt, Homo sapiens
gaauguuuaucuccugcaa

SEQ ID NO: 552921 - RNA, 19 nt, Homo sapiens
ccaccgcguugaugucauu

SEQ ID NO: 552922 - RNA, 19 nt, Homo sapiens
ccacagcccgguaauaugu

SEQ ID NO: 552923 - RNA, 19 nt, Homo sapiens
gagaaggaguuugagaagu

SEQ ID NO: 552924 - RNA, 19 nt, Homo sapiens
gcgauuacaagaagagaaa

SEQ ID NO: 552925 - RNA, 19 nt, Homo sapiens
cugaugagauuuauguaug

SEQ ID NO: 552926 - RNA, 19 nt, Homo sapiens
caccauacccaaauuauuc

SEQ ID NO: 552927 - RNA, 19 nt, Homo sapiens
gagaaacucacaaccuaau

SEQ ID NO: 552928 - RNA, 19 nt, Homo sapiens
uggcuucucuguaucuauu

SEQ ID NO: 552929 - RNA, 19 nt, Homo sapiens
gacaaccuaagaaacuuua

SEQ ID NO: 552930 - RNA, 19 nt, Homo sapiens
ugaagguacuuuaagagau

SEQ ID NO: 552931 - RNA, 19 nt, Homo sapiens
gggaagacaucacucauga

SEQ ID NO: 552932 - RNA, 19 nt, Homo sapiens
ggaagaaaguguugcugaa

SEQ ID NO: 552933 - RNA, 19 nt, Homo sapiens
gcacagaguccuucacaaa

SEQ ID NO: 552934 - RNA, 19 nt, Homo sapiens
cuagauagcuggagagaug

SEQ ID NO: 552935 - RNA, 19 nt, Homo sapiens
acacagaucugacguaauc

SEQ ID NO: 552936 - RNA, 19 nt, Homo sapiens
guacaaagccacaauagga

SEQ ID NO: 552937 - RNA, 19 nt, Homo sapiens
aaacaacauucccuacuuu

SEQ ID NO: 552938 - RNA, 19 nt, Homo sapiens
aaacggagguggagcugua

SEQ ID NO: 552939 - RNA, 19 nt, Homo sapiens
ggacacagcaggacaggaa

SEQ ID NO: 552940 - RNA, 19 nt, Homo sapiens
acacacagaucugacguaa

SEQ ID NO: 552941 - RNA, 19 nt, Homo sapiens
aaacaagauugaccucgaa

SEQ ID NO: 552942 - RNA, 19 nt, Homo sapiens
gagcugacuuucugaccaa

SEQ ID NO: 552943 - RNA, 19 nt, Homo sapiens
gaucugacguaaucaaacu

SEQ ID NO: 552944 - RNA, 19 nt, Homo sapiens
gaacacacguaggccuuca

SEQ ID NO: 552945 - RNA, 19 nt, Homo sapiens
aauaggagcugacuuucug

SEQ ID NO: 552946 - RNA, 19 nt, Homo sapiens
cuaucaaacuggacaagaa

SEQ ID NO: 552947 - RNA, 19 nt, Homo sapiens
cacaauaggagcugacuuu

SEQ ID NO: 552948 - RNA, 19 nt, Homo sapiens
acagacaaguggccacaaa

SEQ ID NO: 552949 - RNA, 19 nt, Homo sapiens
gaaggaugaccucuaggaa

SEQ ID NO: 552950 - RNA, 19 nt, Homo sapiens
gaaccaguaugugaauaag

SEQ ID NO: 552951 - RNA, 19 nt, Homo sapiens
agacaucacucaugaacca

SEQ ID NO: 552952 - RNA, 19 nt, Homo sapiens
gagagagagagaacuguuu

SEQ ID NO: 552953 - RNA, 19 nt, Homo sapiens
guacaacgaauuuccugaa

SEQ ID NO: 552954 - RNA, 19 nt, Homo sapiens
agagagagagaacuguuua

SEQ ID NO: 552955 - RNA, 19 nt, Homo sapiens
ggaagucauucugauaugg

SEQ ID NO: 552956 - RNA, 19 nt, Homo sapiens
gaugaccucuaggaagaaa

SEQ ID NO: 552957 - RNA, 19 nt, Homo sapiens
gaagacaucacucaugaac

SEQ ID NO: 552958 - RNA, 19 nt, Homo sapiens
aggaugaccucuaggaaga

SEQ ID NO: 552959 - RNA, 19 nt, Homo sapiens
ggagagagagagaacuguu

SEQ ID NO: 552960 - RNA, 19 nt, Homo sapiens
gguggaagucauucugaua

SEQ ID NO: 552961 - RNA, 19 nt, Homo sapiens
ggagagcucgggagaguuc

SEQ ID NO: 552962 - RNA, 19 nt, Homo sapiens
gccaaggccucggcagaaa

SEQ ID NO: 552963 - RNA, 19 nt, Homo sapiens
ggagcuguacaacgaauuu

SEQ ID NO: 552964 - RNA, 19 nt, Homo sapiens
gaaauucagcaaucaguac

SEQ ID NO: 552965 - RNA, 19 nt, Homo sapiens
caucacucaugaaccagua

SEQ ID NO: 552966 - RNA, 19 nt, Homo sapiens
cgaauuuccugaaccuauc

SEQ ID NO: 552967 - RNA, 19 nt, Homo sapiens
gaagucauucugauaugga

SEQ ID NO: 552968 - RNA, 19 nt, Homo sapiens
caacgaauuuccugaaccu

SEQ ID NO: 552969 - RNA, 19 nt, Homo sapiens
guucugguauuugauguga

SEQ ID NO: 552970 - RNA, 19 nt, Homo sapiens
cauuggaagcuuauucuuu

SEQ ID NO: 552971 - RNA, 19 nt, Homo sapiens
gaagaaaguguugcugaag

SEQ ID NO: 552972 - RNA, 19 nt, Homo sapiens
gcugcguucugguauuuga

SEQ ID NO: 552973 - RNA, 19 nt, Homo sapiens
accaguaugugaauaagaa

SEQ ID NO: 552974 - RNA, 19 nt, Homo sapiens
ggacaagccagcgguggaa

SEQ ID NO: 552975 - RNA, 19 nt, Homo sapiens
gagcacagaguccuucaca

SEQ ID NO: 552976 - RNA, 19 nt, Homo sapiens
gaaaacuucccauuuguug

SEQ ID NO: 552977 - RNA, 19 nt, Homo sapiens
ugaaccaguaugugaauaa

SEQ ID NO: 552978 - RNA, 19 nt, Homo sapiens
ccucuccucuuccaaacaa

SEQ ID NO: 552979 - RNA, 19 nt, Homo sapiens
caacauucccuacuuugag

SEQ ID NO: 552980 - RNA, 19 nt, Homo sapiens
ccugaaaacuucccauuug

SEQ ID NO: 552981 - RNA, 19 nt, Homo sapiens
gauauggaguuggcauugg

SEQ ID NO: 552982 - RNA, 19 nt, Homo sapiens
guaucuaucuguuaaugcu

SEQ ID NO: 552983 - RNA, 19 nt, Homo sapiens
ucaaacuggacaagaauga

SEQ ID NO: 552984 - RNA, 19 nt, Homo sapiens
aaaguguugcugaagguua

SEQ ID NO: 552985 - RNA, 19 nt, Homo sapiens
ucaguacaaagccacaaua

SEQ ID NO: 552986 - RNA, 19 nt, Homo sapiens
ggaagacaucacucaugaa

SEQ ID NO: 552987 - RNA, 19 nt, Homo sapiens
ucgcuucuguccuccguuu

SEQ ID NO: 552988 - RNA, 19 nt, Homo sapiens
guggaagucauucugauau

SEQ ID NO: 552989 - RNA, 19 nt, Homo sapiens
gaguauggcagcaggacaa

SEQ ID NO: 552990 - RNA, 19 nt, Homo sapiens
caguuaaucugugucuaau

SEQ ID NO: 552991 - RNA, 19 nt, Homo sapiens
ccaaggaggccaucaacgu

SEQ ID NO: 552992 - RNA, 19 nt, Homo sapiens
aaacuucccauuuguugug

SEQ ID NO: 552993 - RNA, 19 nt, Homo sapiens
uggaagucauucugauaug

SEQ ID NO: 552994 - RNA, 19 nt, Homo sapiens
agaaaguguugcugaaggu

SEQ ID NO: 552995 - RNA, 19 nt, Homo sapiens
gaaaguguugcugaagguu

SEQ ID NO: 552996 - RNA, 19 nt, Homo sapiens
gaaugcacuuaagcaggaa

SEQ ID NO: 552997 - RNA, 19 nt, Homo sapiens
cugcugcguucugguauuu

SEQ ID NO: 552998 - RNA, 19 nt, Homo sapiens
agacugcugcguucuggua

SEQ ID NO: 552999 - RNA, 19 nt, Homo sapiens
gcuagucacaaugcagaua

SEQ ID NO: 553000 - RNA, 19 nt, Homo sapiens
ugaaggaugaccucuagga

SEQ ID NO: 553001 - RNA, 19 nt, Homo sapiens
agaaauucagcaaucagua

SEQ ID NO: 553002 - RNA, 19 nt, Homo sapiens
aacauucccuacuuugaga

SEQ ID NO: 553003 - RNA, 19 nt, Homo sapiens
gcucacacccagucugauc

SEQ ID NO: 553004 - RNA, 19 nt, Homo sapiens
caaaccaagaacacacgua

SEQ ID NO: 553005 - RNA, 19 nt, Homo sapiens
guuaucauccugggagauu

SEQ ID NO: 553006 - RNA, 19 nt, Homo sapiens
auacauugaucucucacau

SEQ ID NO: 553007 - RNA, 19 nt, Homo sapiens
uuugaaggaugaccucuag

SEQ ID NO: 553008 - RNA, 19 nt, Homo sapiens
aaaacaacauucccuacuu

SEQ ID NO: 553009 - RNA, 19 nt, Homo sapiens
gaaccagaacuuggaccuu

SEQ ID NO: 553010 - RNA, 19 nt, Homo sapiens
aaaagaaaaccccaucaaa

SEQ ID NO: 553011 - RNA, 19 nt, Homo sapiens
agguggagcuguacaacga

SEQ ID NO: 553012 - RNA, 19 nt, Homo sapiens
uuuguucacuggagagaga

SEQ ID NO: 553013 - RNA, 19 nt, Homo sapiens
cagaucugacguaaucaaa

SEQ ID NO: 553014 - RNA, 19 nt, Homo sapiens
uagcuggagagaugaguuu

SEQ ID NO: 553015 - RNA, 19 nt, Homo sapiens
aggaggugaugguggauga

SEQ ID NO: 553016 - RNA, 19 nt, Homo sapiens
uaucaaacuggacaagaau

SEQ ID NO: 553017 - RNA, 19 nt, Homo sapiens
gaauuuccugaaccuauca

SEQ ID NO: 553018 - RNA, 19 nt, Homo sapiens
acaacauucccuacuuuga

SEQ ID NO: 553019 - RNA, 19 nt, Homo sapiens
gaaaaccccaucaaacaca

SEQ ID NO: 553020 - RNA, 19 nt, Homo sapiens
cguaggccuucaacacaau

SEQ ID NO: 553021 - RNA, 19 nt, Homo sapiens
aaguguugcugaagguuau

SEQ ID NO: 553022 - RNA, 19 nt, Homo sapiens
caauaggagcugacuuucu

SEQ ID NO: 553023 - RNA, 19 nt, Homo sapiens
gcauuggaagcuuauucuu

SEQ ID NO: 553024 - RNA, 19 nt, Homo sapiens
auucagcaaucaguacaaa

SEQ ID NO: 553025 - RNA, 19 nt, Homo sapiens
ucaugaaccaguaugugaa

SEQ ID NO: 553026 - RNA, 19 nt, Homo sapiens
uuauuggucuuguggucuu

SEQ ID NO: 553027 - RNA, 19 nt, Homo sapiens
gcgguggaagucauucuga

SEQ ID NO: 553028 - RNA, 19 nt, Homo sapiens
caaaagaaaaccccaucaa

SEQ ID NO: 553029 - RNA, 19 nt, Homo sapiens
cauuuguuguguugggaaa

SEQ ID NO: 553030 - RNA, 19 nt, Homo sapiens
gaguuggcauuggaagcuu

SEQ ID NO: 553031 - RNA, 19 nt, Homo sapiens
aaagaaggcuguacagaua

SEQ ID NO: 553032 - RNA, 19 nt, Homo sapiens
gagcugaggugcugucuaa

SEQ ID NO: 553033 - RNA, 19 nt, Homo sapiens
ggaaaggaauugagagauu

SEQ ID NO: 553034 - RNA, 19 nt, Homo sapiens
gcaagacaguucaauauga

SEQ ID NO: 553035 - RNA, 19 nt, Homo sapiens
gaaaggaauugagagauuu

SEQ ID NO: 553036 - RNA, 19 nt, Homo sapiens
gauauguacuucaugguua

SEQ ID NO: 553037 - RNA, 19 nt, Homo sapiens
caaugcagcugauuuauga

SEQ ID NO: 553038 - RNA, 19 nt, Homo sapiens
gaacaugggugacauuugg

SEQ ID NO: 553039 - RNA, 19 nt, Homo sapiens
ggaagaauaagcagaaaua

SEQ ID NO: 553040 - RNA, 19 nt, Homo sapiens
cacagaagcugcaugguua

SEQ ID NO: 553041 - RNA, 19 nt, Homo sapiens
gaaggacuauagaucauaa

SEQ ID NO: 553042 - RNA, 19 nt, Homo sapiens
gaacagaaauauguggaaa

SEQ ID NO: 553043 - RNA, 19 nt, Homo sapiens
gcacugggauuuuauaaua

SEQ ID NO: 553044 - RNA, 19 nt, Homo sapiens
gcaauuagguguucauuuu

SEQ ID NO: 553045 - RNA, 19 nt, Homo sapiens
aaagagggcugucaagaaa

SEQ ID NO: 553046 - RNA, 19 nt, Homo sapiens
cuacuuacccucauuaaua

SEQ ID NO: 553047 - RNA, 19 nt, Homo sapiens
gaaacaugcaucuguauaa

SEQ ID NO: 553048 - RNA, 19 nt, Homo sapiens
gaaagagggcugucaagaa

SEQ ID NO: 553049 - RNA, 19 nt, Homo sapiens
gaaaucacucugagguuua

SEQ ID NO: 553050 - RNA, 19 nt, Homo sapiens
uaaauugacuugccuagug

SEQ ID NO: 553051 - RNA, 19 nt, Homo sapiens
caucacaugugguaaauga

SEQ ID NO: 553052 - RNA, 19 nt, Homo sapiens
acacugcuauggaaacuua

SEQ ID NO: 553053 - RNA, 19 nt, Homo sapiens
gcgaacugcuguauguaua

SEQ ID NO: 553054 - RNA, 19 nt, Homo sapiens
gguguuaaccucuuugaua

SEQ ID NO: 553055 - RNA, 19 nt, Homo sapiens
acuaguaccuguauucuaa

SEQ ID NO: 553056 - RNA, 19 nt, Homo sapiens
uggaaaggcugaagugauu

SEQ ID NO: 553057 - RNA, 19 nt, Homo sapiens
gaugaauacccaaucuuua

SEQ ID NO: 553058 - RNA, 19 nt, Homo sapiens
gaggucaaauuucagauga

SEQ ID NO: 553059 - RNA, 19 nt, Homo sapiens
gauaagagagaucuaaaga

SEQ ID NO: 553060 - RNA, 19 nt, Homo sapiens
ugacaaugcagcugauuua

SEQ ID NO: 553061 - RNA, 19 nt, Homo sapiens
cuaauguuauguccacuua

SEQ ID NO: 553062 - RNA, 19 nt, Homo sapiens
cagaguagauagacuaaau

SEQ ID NO: 553063 - RNA, 19 nt, Homo sapiens
guaagaaacagaguagaua

SEQ ID NO: 553064 - RNA, 19 nt, Homo sapiens
gaaaugaaggugugaguuc

SEQ ID NO: 553065 - RNA, 19 nt, Homo sapiens
gaaauuguccgagccauga

SEQ ID NO: 553066 - RNA, 19 nt, Homo sapiens
cagaaugucuauuaggauu

SEQ ID NO: 553067 - RNA, 19 nt, Homo sapiens
ggaugaauacccaaucuuu

SEQ ID NO: 553068 - RNA, 19 nt, Homo sapiens
guauacaccucaugcuuau

SEQ ID NO: 553069 - RNA, 19 nt, Homo sapiens
gcaacaagcccuacagcaa

SEQ ID NO: 553070 - RNA, 19 nt, Homo sapiens
gcaaaucgaccggacagua

SEQ ID NO: 553071 - RNA, 19 nt, Homo sapiens
ucagaaugauggaaauuga

SEQ ID NO: 553072 - RNA, 19 nt, Homo sapiens
ugggagauaucaagaaauu

SEQ ID NO: 553073 - RNA, 19 nt, Homo sapiens
gggcuacacugcuauggaa

SEQ ID NO: 553074 - RNA, 19 nt, Homo sapiens
caagacaguucaauaugau

SEQ ID NO: 553075 - RNA, 19 nt, Homo sapiens
agaaaucacucugagguuu

SEQ ID NO: 553076 - RNA, 19 nt, Homo sapiens
caaaucgaccggacaguaa

SEQ ID NO: 553077 - RNA, 19 nt, Homo sapiens
ccagauaacccaagguauu

SEQ ID NO: 553078 - RNA, 19 nt, Homo sapiens
caagaaggacuauagauca

SEQ ID NO: 553079 - RNA, 19 nt, Homo sapiens
acagugagucuuaaaguua

SEQ ID NO: 553080 - RNA, 19 nt, Homo sapiens
agaauaugcuggguaaauu

SEQ ID NO: 553081 - RNA, 19 nt, Homo sapiens
gcaagaaggacuauagauc

SEQ ID NO: 553082 - RNA, 19 nt, Homo sapiens
gcagcugauuuaugaaaga

SEQ ID NO: 553083 - RNA, 19 nt, Homo sapiens
caaagaaggcuguacagau

SEQ ID NO: 553084 - RNA, 19 nt, Homo sapiens
caauguaucugcaauuagg

SEQ ID NO: 553085 - RNA, 19 nt, Homo sapiens
caaugugaguugcguaaga

SEQ ID NO: 553086 - RNA, 19 nt, Homo sapiens
cauggaagccuauucugua

SEQ ID NO: 553087 - RNA, 19 nt, Homo sapiens
gcauauuauugaaggauug

SEQ ID NO: 553088 - RNA, 19 nt, Homo sapiens
gaccaucgccuaugaaagu

SEQ ID NO: 553089 - RNA, 19 nt, Homo sapiens
agaaggcuguacagauaua

SEQ ID NO: 553090 - RNA, 19 nt, Homo sapiens
guagcaagacaguucaaua

SEQ ID NO: 553091 - RNA, 19 nt, Homo sapiens
agacuauacugugucaaua

SEQ ID NO: 553092 - RNA, 19 nt, Homo sapiens
gaaaacaagcuaaaccuuu

SEQ ID NO: 553093 - RNA, 19 nt, Homo sapiens
gaaacuuagcuucaaagaa

SEQ ID NO: 553094 - RNA, 19 nt, Homo sapiens
agagagggcuacacugcua

SEQ ID NO: 553095 - RNA, 19 nt, Homo sapiens
gaauggccuuguacaacuu

SEQ ID NO: 553096 - RNA, 19 nt, Homo sapiens
aaacagaguagauagacua

SEQ ID NO: 553097 - RNA, 19 nt, Homo sapiens
gagcagccgaacagaaaua

SEQ ID NO: 553098 - RNA, 19 nt, Homo sapiens
guacuaccuucaggcauuu

SEQ ID NO: 553099 - RNA, 19 nt, Homo sapiens
guacagaaagguguuacua

SEQ ID NO: 553100 - RNA, 19 nt, Homo sapiens
ggaagccuauucuguagca

SEQ ID NO: 553101 - RNA, 19 nt, Homo sapiens
guauguggauguggucuuu

SEQ ID NO: 553102 - RNA, 19 nt, Homo sapiens
gaauaugcuggguaaauug

SEQ ID NO: 553103 - RNA, 19 nt, Homo sapiens
acauacacaugcucaguuu

SEQ ID NO: 553104 - RNA, 19 nt, Homo sapiens
ccacagaagcugcaugguu

SEQ ID NO: 553105 - RNA, 19 nt, Homo sapiens
gaaagaauuguaagugaag

SEQ ID NO: 553106 - RNA, 19 nt, Homo sapiens
caagcugaguaccaucuuu

SEQ ID NO: 553107 - RNA, 19 nt, Homo sapiens
gauguggucuuugcaaauc

SEQ ID NO: 553108 - RNA, 19 nt, Homo sapiens
ucauuaauaucccacuuga

SEQ ID NO: 553109 - RNA, 19 nt, Homo sapiens
ggagcaucaucaagaagaa

SEQ ID NO: 553110 - RNA, 19 nt, Homo sapiens
gucauuaguucuagauaug

SEQ ID NO: 553111 - RNA, 19 nt, Homo sapiens
caacuuauccagaaugucu

SEQ ID NO: 553112 - RNA, 19 nt, Homo sapiens
ugccagagcucuaccacaa

SEQ ID NO: 553113 - RNA, 19 nt, Homo sapiens
ggagucaccuauucuugca

SEQ ID NO: 553114 - RNA, 19 nt, Homo sapiens
aaauugacuugccuaguga

SEQ ID NO: 553115 - RNA, 19 nt, Homo sapiens
uuaauuagcacugggauuu

SEQ ID NO: 553116 - RNA, 19 nt, Homo sapiens
ccauucagguucucccaaa

SEQ ID NO: 553117 - RNA, 19 nt, Homo sapiens
uagcaagacaguucaauau

SEQ ID NO: 553118 - RNA, 19 nt, Homo sapiens
ugacacaugugauaaacca

SEQ ID NO: 553119 - RNA, 19 nt, Homo sapiens
caguaacacucccauggaa

SEQ ID NO: 553120 - RNA, 19 nt, Homo sapiens
ugaaacaugcaucuguaua

SEQ ID NO: 553121 - RNA, 19 nt, Homo sapiens
uguauacaccucaugcuua

SEQ ID NO: 553122 - RNA, 19 nt, Homo sapiens
uaauaucccacuugagaaa

SEQ ID NO: 553123 - RNA, 19 nt, Homo sapiens
gaaacagaguagauagacu

SEQ ID NO: 553124 - RNA, 19 nt, Homo sapiens
ggaaucaucucaggaaaau

SEQ ID NO: 553125 - RNA, 19 nt, Homo sapiens
uggaaaagcugaaacagaa

SEQ ID NO: 553126 - RNA, 19 nt, Homo sapiens
ucaaaagucuugcuuggaa

SEQ ID NO: 553127 - RNA, 19 nt, Homo sapiens
guagauagacuaaauucag

SEQ ID NO: 553128 - RNA, 19 nt, Homo sapiens
gauaacauacugcgcaaca

SEQ ID NO: 553129 - RNA, 19 nt, Homo sapiens
ggagugcuauggagaucau

SEQ ID NO: 553130 - RNA, 19 nt, Homo sapiens
gagacuauacugugucaau

SEQ ID NO: 553131 - RNA, 19 nt, Homo sapiens
aaagaaggcuguacagaua

SEQ ID NO: 553132 - RNA, 19 nt, Homo sapiens
gagcugaggugcugucuaa

SEQ ID NO: 553133 - RNA, 19 nt, Homo sapiens
ggaaaggaauugagagauu

SEQ ID NO: 553134 - RNA, 19 nt, Homo sapiens
gcaagacaguucaauauga

SEQ ID NO: 553135 - RNA, 19 nt, Homo sapiens
gaaaggaauugagagauuu

SEQ ID NO: 553136 - RNA, 19 nt, Homo sapiens
gauauguacuucaugguua

SEQ ID NO: 553137 - RNA, 19 nt, Homo sapiens
caaugcagcugauuuauga

SEQ ID NO: 553138 - RNA, 19 nt, Homo sapiens
gaacaugggugacauuugg

SEQ ID NO: 553139 - RNA, 19 nt, Homo sapiens
ggaagaauaagcagaaaua

SEQ ID NO: 553140 - RNA, 19 nt, Homo sapiens
cacagaagcugcaugguua

SEQ ID NO: 553141 - RNA, 19 nt, Homo sapiens
gaaggacuauagaucauaa

SEQ ID NO: 553142 - RNA, 19 nt, Homo sapiens
gcacagagcacaauuugaa

SEQ ID NO: 553143 - RNA, 19 nt, Homo sapiens
gcacugggauuuuauaaua

SEQ ID NO: 553144 - RNA, 19 nt, Homo sapiens
gcaauuagguguucauuuu

SEQ ID NO: 553145 - RNA, 19 nt, Homo sapiens
aaagagggcugucaagaaa

SEQ ID NO: 553146 - RNA, 19 nt, Homo sapiens
cuacuuacccucauuaaua

SEQ ID NO: 553147 - RNA, 19 nt, Homo sapiens
gaaagagggcugucaagaa

SEQ ID NO: 553148 - RNA, 19 nt, Homo sapiens
gaaaucacucugagguuua

SEQ ID NO: 553149 - RNA, 19 nt, Homo sapiens
uaaauugacuugccuagug

SEQ ID NO: 553150 - RNA, 19 nt, Homo sapiens
caucacaugugguaaauga

SEQ ID NO: 553151 - RNA, 19 nt, Homo sapiens
gcauggauuuggcuguuua

SEQ ID NO: 553152 - RNA, 19 nt, Homo sapiens
acacugcuauggaaacuua

SEQ ID NO: 553153 - RNA, 19 nt, Homo sapiens
gcgaacugcuguauguaua

SEQ ID NO: 553154 - RNA, 19 nt, Homo sapiens
gguguuaaccucuuugaua

SEQ ID NO: 553155 - RNA, 19 nt, Homo sapiens
acuaguaccuguauucuaa

SEQ ID NO: 553156 - RNA, 19 nt, Homo sapiens
uggaaaggcugaagugauu

SEQ ID NO: 553157 - RNA, 19 nt, Homo sapiens
gaugaauacccaaucuuua

SEQ ID NO: 553158 - RNA, 19 nt, Homo sapiens
gaggucaaauuucagauga

SEQ ID NO: 553159 - RNA, 19 nt, Homo sapiens
ugacaaugcagcugauuua

SEQ ID NO: 553160 - RNA, 19 nt, Homo sapiens
cuaauguuauguccacuua

SEQ ID NO: 553161 - RNA, 19 nt, Homo sapiens
cagaguagauagacuaaau

SEQ ID NO: 553162 - RNA, 19 nt, Homo sapiens
gggcuuggcucgaaaguca

SEQ ID NO: 553163 - RNA, 19 nt, Homo sapiens
guaagaaacagaguagaua

SEQ ID NO: 553164 - RNA, 19 nt, Homo sapiens
gaaaugaaggugugaguuc

SEQ ID NO: 553165 - RNA, 19 nt, Homo sapiens
gaaauuguccgagccauga

SEQ ID NO: 553166 - RNA, 19 nt, Homo sapiens
cagaaugucuauuaggauu

SEQ ID NO: 553167 - RNA, 19 nt, Homo sapiens
ggaugaauacccaaucuuu

SEQ ID NO: 553168 - RNA, 19 nt, Homo sapiens
guauacaccucaugcuuau

SEQ ID NO: 553169 - RNA, 19 nt, Homo sapiens
gcaacaagcccuacagcaa

SEQ ID NO: 553170 - RNA, 19 nt, Homo sapiens
gcaaaucgaccggacagua

SEQ ID NO: 553171 - RNA, 19 nt, Homo sapiens
ucagaaugauggaaauuga

SEQ ID NO: 553172 - RNA, 19 nt, Homo sapiens
ugggagauaucaagaaauu

SEQ ID NO: 553173 - RNA, 19 nt, Homo sapiens
gggcuacacugcuauggaa

SEQ ID NO: 553174 - RNA, 19 nt, Homo sapiens
caagacaguucaauaugau

SEQ ID NO: 553175 - RNA, 19 nt, Homo sapiens
agaaaucacucugagguuu

SEQ ID NO: 553176 - RNA, 19 nt, Homo sapiens
caaaucgaccggacaguaa

SEQ ID NO: 553177 - RNA, 19 nt, Homo sapiens
gcucuaggcuucuguaaaa

SEQ ID NO: 553178 - RNA, 19 nt, Homo sapiens
caagaaggacuauagauca

SEQ ID NO: 553179 - RNA, 19 nt, Homo sapiens
agaauaugcuggguaaauu

SEQ ID NO: 553180 - RNA, 19 nt, Homo sapiens
gcaagaaggacuauagauc

SEQ ID NO: 553181 - RNA, 19 nt, Homo sapiens
gcagcugauuuaugaaaga

SEQ ID NO: 553182 - RNA, 19 nt, Homo sapiens
caaagaaggcuguacagau

SEQ ID NO: 553183 - RNA, 19 nt, Homo sapiens
caauguaucugcaauuagg

SEQ ID NO: 553184 - RNA, 19 nt, Homo sapiens
caaugugaguugcguaaga

SEQ ID NO: 553185 - RNA, 19 nt, Homo sapiens
cauggaagccuauucugua

SEQ ID NO: 553186 - RNA, 19 nt, Homo sapiens
gcauauuauugaaggauug

SEQ ID NO: 553187 - RNA, 19 nt, Homo sapiens
gaccaucgccuaugaaagu

SEQ ID NO: 553188 - RNA, 19 nt, Homo sapiens
agaaggcuguacagauaua

SEQ ID NO: 553189 - RNA, 19 nt, Homo sapiens
guagcaagacaguucaaua

SEQ ID NO: 553190 - RNA, 19 nt, Homo sapiens
agacuauacugugucaaua

SEQ ID NO: 553191 - RNA, 19 nt, Homo sapiens
gaaacuuagcuucaaagaa

SEQ ID NO: 553192 - RNA, 19 nt, Homo sapiens
agagagggcuacacugcua

SEQ ID NO: 553193 - RNA, 19 nt, Homo sapiens
gaauggccuuguacaacuu

SEQ ID NO: 553194 - RNA, 19 nt, Homo sapiens
aaacagaguagauagacua

SEQ ID NO: 553195 - RNA, 19 nt, Homo sapiens
aaagcagacuggcaugaaa

SEQ ID NO: 553196 - RNA, 19 nt, Homo sapiens
guacuaccuucaggcauuu

SEQ ID NO: 553197 - RNA, 19 nt, Homo sapiens
guacagaaagguguuacua

SEQ ID NO: 553198 - RNA, 19 nt, Homo sapiens
ggaagccuauucuguagca

SEQ ID NO: 553199 - RNA, 19 nt, Homo sapiens
guauguggauguggucuuu

SEQ ID NO: 553200 - RNA, 19 nt, Homo sapiens
gaauaugcuggguaaauug

SEQ ID NO: 553201 - RNA, 19 nt, Homo sapiens
acauacacaugcucaguuu

SEQ ID NO: 553202 - RNA, 19 nt, Homo sapiens
ccacagaagcugcaugguu

SEQ ID NO: 553203 - RNA, 19 nt, Homo sapiens
gaaagaauuguaagugaag

SEQ ID NO: 553204 - RNA, 19 nt, Homo sapiens
caagcugaguaccaucuuu

SEQ ID NO: 553205 - RNA, 19 nt, Homo sapiens
gauguggucuuugcaaauc

SEQ ID NO: 553206 - RNA, 19 nt, Homo sapiens
agacuggcaugaaauauag

SEQ ID NO: 553207 - RNA, 19 nt, Homo sapiens
ucauuaauaucccacuuga

SEQ ID NO: 553208 - RNA, 19 nt, Homo sapiens
ggagcaucaucaagaagaa

SEQ ID NO: 553209 - RNA, 19 nt, Homo sapiens
gucauuaguucuagauaug

SEQ ID NO: 553210 - RNA, 19 nt, Homo sapiens
caacuuauccagaaugucu

SEQ ID NO: 553211 - RNA, 19 nt, Homo sapiens
ugccagagcucuaccacaa

SEQ ID NO: 553212 - RNA, 19 nt, Homo sapiens
cagacuggcaugaaauaua

SEQ ID NO: 553213 - RNA, 19 nt, Homo sapiens
ggagucaccuauucuugca

SEQ ID NO: 553214 - RNA, 19 nt, Homo sapiens
ucaaagaguccaccgcaaa

SEQ ID NO: 553215 - RNA, 19 nt, Homo sapiens
aaauugacuugccuaguga

SEQ ID NO: 553216 - RNA, 19 nt, Homo sapiens
uuaauuagcacugggauuu

SEQ ID NO: 553217 - RNA, 19 nt, Homo sapiens
ccauucagguucucccaaa

SEQ ID NO: 553218 - RNA, 19 nt, Homo sapiens
uagcaagacaguucaauau

SEQ ID NO: 553219 - RNA, 19 nt, Homo sapiens
ugacacaugugauaaacca

SEQ ID NO: 553220 - RNA, 19 nt, Homo sapiens
caguaacacucccauggaa

SEQ ID NO: 553221 - RNA, 19 nt, Homo sapiens
uguauacaccucaugcuua

SEQ ID NO: 553222 - RNA, 19 nt, Homo sapiens
gcaucacauuucucucaaa

SEQ ID NO: 553223 - RNA, 19 nt, Homo sapiens
ggugaggaccgacuucuga

SEQ ID NO: 553224 - RNA, 19 nt, Homo sapiens
uaauaucccacuugagaaa

SEQ ID NO: 553225 - RNA, 19 nt, Homo sapiens
gaaacagaguagauagacu

SEQ ID NO: 553226 - RNA, 19 nt, Homo sapiens
ggaaucaucucaggaaaau

SEQ ID NO: 553227 - RNA, 19 nt, Homo sapiens
uggaaaagcugaaacagaa

SEQ ID NO: 553228 - RNA, 19 nt, Homo sapiens
ucaaaagucuugcuuggaa

SEQ ID NO: 553229 - RNA, 19 nt, Homo sapiens
guagauagacuaaauucag

SEQ ID NO: 553230 - RNA, 19 nt, Homo sapiens
gauaacauacugcgcaaca

SEQ ID NO: 553231 - RNA, 19 nt, Homo sapiens
aaagaaggcuguacagaua

SEQ ID NO: 553232 - RNA, 19 nt, Homo sapiens
gagaugaacugguaccuaa

SEQ ID NO: 553233 - RNA, 19 nt, Homo sapiens
gagcugaggugcugucuaa

SEQ ID NO: 553234 - RNA, 19 nt, Homo sapiens
ggaaaggaauugagagauu

SEQ ID NO: 553235 - RNA, 19 nt, Homo sapiens
gcaagacaguucaauauga

SEQ ID NO: 553236 - RNA, 19 nt, Homo sapiens
gaaaggaauugagagauuu

SEQ ID NO: 553237 - RNA, 19 nt, Homo sapiens
gauauguacuucaugguua

SEQ ID NO: 553238 - RNA, 19 nt, Homo sapiens
caaugcagcugauuuauga

SEQ ID NO: 553239 - RNA, 19 nt, Homo sapiens
gaacaugggugacauuugg

SEQ ID NO: 553240 - RNA, 19 nt, Homo sapiens
ggaagaauaagcagaaaua

SEQ ID NO: 553241 - RNA, 19 nt, Homo sapiens
agacaaaucucccaagaaa

SEQ ID NO: 553242 - RNA, 19 nt, Homo sapiens
cacagaagcugcaugguua

SEQ ID NO: 553243 - RNA, 19 nt, Homo sapiens
gaaggacuauagaucauaa

SEQ ID NO: 553244 - RNA, 19 nt, Homo sapiens
gcacugggauuuuauaaua

SEQ ID NO: 553245 - RNA, 19 nt, Homo sapiens
gcaauuagguguucauuuu

SEQ ID NO: 553246 - RNA, 19 nt, Homo sapiens
aaagagggcugucaagaaa

SEQ ID NO: 553247 - RNA, 19 nt, Homo sapiens
cuacuuacccucauuaaua

SEQ ID NO: 553248 - RNA, 19 nt, Homo sapiens
gaaagagggcugucaagaa

SEQ ID NO: 553249 - RNA, 19 nt, Homo sapiens
gaaaucacucugagguuua

SEQ ID NO: 553250 - RNA, 19 nt, Homo sapiens
uaaauugacuugccuagug

SEQ ID NO: 553251 - RNA, 19 nt, Homo sapiens
caucacaugugguaaauga

SEQ ID NO: 553252 - RNA, 19 nt, Homo sapiens
acacugcuauggaaacuua

SEQ ID NO: 553253 - RNA, 19 nt, Homo sapiens
gcgaacugcuguauguaua

SEQ ID NO: 553254 - RNA, 19 nt, Homo sapiens
gguguuaaccucuuugaua

SEQ ID NO: 553255 - RNA, 19 nt, Homo sapiens
acuaguaccuguauucuaa

SEQ ID NO: 553256 - RNA, 19 nt, Homo sapiens
uggaaaggcugaagugauu

SEQ ID NO: 553257 - RNA, 19 nt, Homo sapiens
gaugaauacccaaucuuua

SEQ ID NO: 553258 - RNA, 19 nt, Homo sapiens
gaggucaaauuucagauga

SEQ ID NO: 553259 - RNA, 19 nt, Homo sapiens
ugacaaugcagcugauuua

SEQ ID NO: 553260 - RNA, 19 nt, Homo sapiens
cuaauguuauguccacuua

SEQ ID NO: 553261 - RNA, 19 nt, Homo sapiens
cagaguagauagacuaaau

SEQ ID NO: 553262 - RNA, 19 nt, Homo sapiens
guaagaaacagaguagaua

SEQ ID NO: 553263 - RNA, 19 nt, Homo sapiens
gaaaugaaggugugaguuc

SEQ ID NO: 553264 - RNA, 19 nt, Homo sapiens
gaaauuguccgagccauga

SEQ ID NO: 553265 - RNA, 19 nt, Homo sapiens
gaggagaacaccaaguuaa

SEQ ID NO: 553266 - RNA, 19 nt, Homo sapiens
cagaaugucuauuaggauu

SEQ ID NO: 553267 - RNA, 19 nt, Homo sapiens
ggaugaauacccaaucuuu

SEQ ID NO: 553268 - RNA, 19 nt, Homo sapiens
guauacaccucaugcuuau

SEQ ID NO: 553269 - RNA, 19 nt, Homo sapiens
gcaacaagcccuacagcaa

SEQ ID NO: 553270 - RNA, 19 nt, Homo sapiens
gcaaaucgaccggacagua

SEQ ID NO: 553271 - RNA, 19 nt, Homo sapiens
ucagaaugauggaaauuga

SEQ ID NO: 553272 - RNA, 19 nt, Homo sapiens
ugggagauaucaagaaauu

SEQ ID NO: 553273 - RNA, 19 nt, Homo sapiens
gggcuacacugcuauggaa

SEQ ID NO: 553274 - RNA, 19 nt, Homo sapiens
caagacaguucaauaugau

SEQ ID NO: 553275 - RNA, 19 nt, Homo sapiens
gcuaaagacagcagccuua

SEQ ID NO: 553276 - RNA, 19 nt, Homo sapiens
agaaaucacucugagguuu

SEQ ID NO: 553277 - RNA, 19 nt, Homo sapiens
caaaucgaccggacaguaa

SEQ ID NO: 553278 - RNA, 19 nt, Homo sapiens
caagaaggacuauagauca

SEQ ID NO: 553279 - RNA, 19 nt, Homo sapiens
gcacaggaaucuuggaaaa

SEQ ID NO: 553280 - RNA, 19 nt, Homo sapiens
aaagacaaaucucccaaga

SEQ ID NO: 553281 - RNA, 19 nt, Homo sapiens
agaauaugcuggguaaauu

SEQ ID NO: 553282 - RNA, 19 nt, Homo sapiens
gcaagaaggacuauagauc

SEQ ID NO: 553283 - RNA, 19 nt, Homo sapiens
gcagcugauuuaugaaaga

SEQ ID NO: 553284 - RNA, 19 nt, Homo sapiens
caaagaaggcuguacagau

SEQ ID NO: 553285 - RNA, 19 nt, Homo sapiens
caauguaucugcaauuagg

SEQ ID NO: 553286 - RNA, 19 nt, Homo sapiens
caaugugaguugcguaaga

SEQ ID NO: 553287 - RNA, 19 nt, Homo sapiens
cauggaagccuauucugua

SEQ ID NO: 553288 - RNA, 19 nt, Homo sapiens
gcauauuauugaaggauug

SEQ ID NO: 553289 - RNA, 19 nt, Homo sapiens
gaccaucgccuaugaaagu

SEQ ID NO: 553290 - RNA, 19 nt, Homo sapiens
agaaggcuguacagauaua

SEQ ID NO: 553291 - RNA, 19 nt, Homo sapiens
guagcaagacaguucaaua

SEQ ID NO: 553292 - RNA, 19 nt, Homo sapiens
agacuauacugugucaaua

SEQ ID NO: 553293 - RNA, 19 nt, Homo sapiens
gaaacuuagcuucaaagaa

SEQ ID NO: 553294 - RNA, 19 nt, Homo sapiens
agagagggcuacacugcua

SEQ ID NO: 553295 - RNA, 19 nt, Homo sapiens
gaauggccuuguacaacuu

SEQ ID NO: 553296 - RNA, 19 nt, Homo sapiens
aaacagaguagauagacua

SEQ ID NO: 553297 - RNA, 19 nt, Homo sapiens
guacuaccuucaggcauuu

SEQ ID NO: 553298 - RNA, 19 nt, Homo sapiens
guacagaaagguguuacua

SEQ ID NO: 553299 - RNA, 19 nt, Homo sapiens
ggaagccuauucuguagca

SEQ ID NO: 553300 - RNA, 19 nt, Homo sapiens
guauguggauguggucuuu

SEQ ID NO: 553301 - RNA, 19 nt, Homo sapiens
gaauaugcuggguaaauug

SEQ ID NO: 553302 - RNA, 19 nt, Homo sapiens
acauacacaugcucaguuu

SEQ ID NO: 553303 - RNA, 19 nt, Homo sapiens
ccacagaagcugcaugguu

SEQ ID NO: 553304 - RNA, 19 nt, Homo sapiens
gaaagaauuguaagugaag

SEQ ID NO: 553305 - RNA, 19 nt, Homo sapiens
caagcugaguaccaucuuu

SEQ ID NO: 553306 - RNA, 19 nt, Homo sapiens
gauguggucuuugcaaauc

SEQ ID NO: 553307 - RNA, 19 nt, Homo sapiens
ucauuaauaucccacuuga

SEQ ID NO: 553308 - RNA, 19 nt, Homo sapiens
ggagcaucaucaagaagaa

SEQ ID NO: 553309 - RNA, 19 nt, Homo sapiens
gucauuaguucuagauaug

SEQ ID NO: 553310 - RNA, 19 nt, Homo sapiens
caacuuauccagaaugucu

SEQ ID NO: 553311 - RNA, 19 nt, Homo sapiens
ugccagagcucuaccacaa

SEQ ID NO: 553312 - RNA, 19 nt, Homo sapiens
ggagucaccuauucuugca

SEQ ID NO: 553313 - RNA, 19 nt, Homo sapiens
aaauugacuugccuaguga

SEQ ID NO: 553314 - RNA, 19 nt, Homo sapiens
uuaauuagcacugggauuu

SEQ ID NO: 553315 - RNA, 19 nt, Homo sapiens
aaguggagaugaacuggua

SEQ ID NO: 553316 - RNA, 19 nt, Homo sapiens
ccauucagguucucccaaa

SEQ ID NO: 553317 - RNA, 19 nt, Homo sapiens
uagcaagacaguucaauau

SEQ ID NO: 553318 - RNA, 19 nt, Homo sapiens
ugacacaugugauaaacca

SEQ ID NO: 553319 - RNA, 19 nt, Homo sapiens
caguaacacucccauggaa

SEQ ID NO: 553320 - RNA, 19 nt, Homo sapiens
uguauacaccucaugcuua

SEQ ID NO: 553321 - RNA, 19 nt, Homo sapiens
uaauaucccacuugagaaa

SEQ ID NO: 553322 - RNA, 19 nt, Homo sapiens
gagaacaccaaguuaagga

SEQ ID NO: 553323 - RNA, 19 nt, Homo sapiens
gaaacagaguagauagacu

SEQ ID NO: 553324 - RNA, 19 nt, Homo sapiens
ggaaucaucucaggaaaau

SEQ ID NO: 553325 - RNA, 19 nt, Homo sapiens
uggaaaagcugaaacagaa

SEQ ID NO: 553326 - RNA, 19 nt, Homo sapiens
ucaaaagucuugcuuggaa

SEQ ID NO: 553327 - RNA, 19 nt, Homo sapiens
guagauagacuaaauucag

SEQ ID NO: 553328 - RNA, 19 nt, Homo sapiens
gauaacauacugcgcaaca

SEQ ID NO: 553329 - RNA, 19 nt, Homo sapiens
ggagugcuauggagaucau

SEQ ID NO: 553330 - RNA, 19 nt, Homo sapiens
gagacuauacugugucaau

SEQ ID NO: 553331 - RNA, 19 nt, Homo sapiens
gaaaugaggaccagaguua

SEQ ID NO: 553332 - RNA, 19 nt, Homo sapiens
ccacaggcaucuucaguua

SEQ ID NO: 553333 - RNA, 19 nt, Homo sapiens
acaaagaaauggcaagaua

SEQ ID NO: 553334 - RNA, 19 nt, Homo sapiens
guaaauagcacuaguuaga

SEQ ID NO: 553335 - RNA, 19 nt, Homo sapiens
gaccagaguuaacaaagaa

SEQ ID NO: 553336 - RNA, 19 nt, Homo sapiens
ggaagaaggaugugauuug

SEQ ID NO: 553337 - RNA, 19 nt, Homo sapiens
gaacacaauugccuacgau

SEQ ID NO: 553338 - RNA, 19 nt, Homo sapiens
ggaccagaguuaacaaaga

SEQ ID NO: 553339 - RNA, 19 nt, Homo sapiens
gaagucagacauuguuaaa

SEQ ID NO: 553340 - RNA, 19 nt, Homo sapiens
gacagaagcagaucaacua

SEQ ID NO: 553341 - RNA, 19 nt, Homo sapiens
gaugaaaguguccuaauga

SEQ ID NO: 553342 - RNA, 19 nt, Homo sapiens
ucagacaccuuuaauaucu

SEQ ID NO: 553343 - RNA, 19 nt, Homo sapiens
gcaugugugugcacuugua

SEQ ID NO: 553344 - RNA, 19 nt, Homo sapiens
uaacugaacccuugagaga

SEQ ID NO: 553345 - RNA, 19 nt, Homo sapiens
guggagcgauuuagaaaga

SEQ ID NO: 553346 - RNA, 19 nt, Homo sapiens
gaagaaggaugugauuugc

SEQ ID NO: 553347 - RNA, 19 nt, Homo sapiens
ucaaaggagucuaugucua

SEQ ID NO: 553348 - RNA, 19 nt, Homo sapiens
caagugcaguugaagaaga

SEQ ID NO: 553349 - RNA, 19 nt, Homo sapiens
gaagguggcucugcauuuu

SEQ ID NO: 553350 - RNA, 19 nt, Homo sapiens
ggaagguggcucugcauuu

SEQ ID NO: 553351 - RNA, 19 nt, Homo sapiens
acaggcaucuucaguuauu

SEQ ID NO: 553352 - RNA, 19 nt, Homo sapiens
ggaugugauuugcaagaaa

SEQ ID NO: 553353 - RNA, 19 nt, Homo sapiens
ccuggugguuucucuguua

SEQ ID NO: 553354 - RNA, 19 nt, Homo sapiens
gaaguauagucgacguuca

SEQ ID NO: 553355 - RNA, 19 nt, Homo sapiens
uuaaagaagucccaagaca

SEQ ID NO: 553356 - RNA, 19 nt, Homo sapiens
ggagcuaaguccaagaaag

SEQ ID NO: 553357 - RNA, 19 nt, Homo sapiens
agaaggaugugauuugcaa

SEQ ID NO: 553358 - RNA, 19 nt, Homo sapiens
caagaccccuaauaaauuu

SEQ ID NO: 553359 - RNA, 19 nt, Homo sapiens
agaagcagaucaacuaugg

SEQ ID NO: 553360 - RNA, 19 nt, Homo sapiens
gagcuaaguccaagaaagu

SEQ ID NO: 553361 - RNA, 19 nt, Homo sapiens
ggaugaguuugauuuggaa

SEQ ID NO: 553362 - RNA, 19 nt, Homo sapiens
gcaucaaaguauucucaga

SEQ ID NO: 553363 - RNA, 19 nt, Homo sapiens
gaaguucugauucaaagga

SEQ ID NO: 553364 - RNA, 19 nt, Homo sapiens
caaagaaauggcaagauau

SEQ ID NO: 553365 - RNA, 19 nt, Homo sapiens
ggaagcuuguuuaacugaa

SEQ ID NO: 553366 - RNA, 19 nt, Homo sapiens
uguuaagacuguuacguuu

SEQ ID NO: 553367 - RNA, 19 nt, Homo sapiens
ucucagacaccuuuaauau

SEQ ID NO: 553368 - RNA, 19 nt, Homo sapiens
uccauuagcucaugcugaa

SEQ ID NO: 553369 - RNA, 19 nt, Homo sapiens
ugagacacauggacaguca

SEQ ID NO: 553370 - RNA, 19 nt, Homo sapiens
caaaggagucuaugucuac

SEQ ID NO: 553371 - RNA, 19 nt, Homo sapiens
gcagcagaguggagcgauu

SEQ ID NO: 553372 - RNA, 19 nt, Homo sapiens
gcgcagacccgagagcuuu

SEQ ID NO: 553373 - RNA, 19 nt, Homo sapiens
uaacagcauucugaaguca

SEQ ID NO: 553374 - RNA, 19 nt, Homo sapiens
ucaaguggaggaugaguuu

SEQ ID NO: 553375 - RNA, 19 nt, Homo sapiens
gaccuugaaucugcagaaa

SEQ ID NO: 553376 - RNA, 19 nt, Homo sapiens
agaugaaaguguccuaaug

SEQ ID NO: 553377 - RNA, 19 nt, Homo sapiens
gaguggagcgauuuagaaa

SEQ ID NO: 553378 - RNA, 19 nt, Homo sapiens
ugucauaacagcauucuga

SEQ ID NO: 553379 - RNA, 19 nt, Homo sapiens
ggagacagaagcagaucaa

SEQ ID NO: 553380 - RNA, 19 nt, Homo sapiens
ugacacgucuacauaacug

SEQ ID NO: 553381 - RNA, 19 nt, Homo sapiens
aagcugacacgucuacaua

SEQ ID NO: 553382 - RNA, 19 nt, Homo sapiens
ccuacgaucguuauauuaa

SEQ ID NO: 553383 - RNA, 19 nt, Homo sapiens
acagucaaguggaggauga

SEQ ID NO: 553384 - RNA, 19 nt, Homo sapiens
caggaugacuuugaugugu

SEQ ID NO: 553385 - RNA, 19 nt, Homo sapiens
ucaaugacuuuggaagaga

SEQ ID NO: 553386 - RNA, 19 nt, Homo sapiens
cauaacagcauucugaagu

SEQ ID NO: 553387 - RNA, 19 nt, Homo sapiens
uaacaaagaaauggcaaga

SEQ ID NO: 553388 - RNA, 19 nt, Homo sapiens
ggaggaugaguuugauuug

SEQ ID NO: 553389 - RNA, 19 nt, Homo sapiens
cuugucagguggacuguuu

SEQ ID NO: 553390 - RNA, 19 nt, Homo sapiens
gcucucaggaugacuuuga

SEQ ID NO: 553391 - RNA, 19 nt, Homo sapiens
ugccuacgaucguuauauu

SEQ ID NO: 553392 - RNA, 19 nt, Homo sapiens
gaucaacuaugggaagaac

SEQ ID NO: 553393 - RNA, 19 nt, Homo sapiens
agagucagcuacuuuuaua

SEQ ID NO: 553394 - RNA, 19 nt, Homo sapiens
gaggaugaguuugauuugg

SEQ ID NO: 553395 - RNA, 19 nt, Homo sapiens
caucaaugacuuuggaaga

SEQ ID NO: 553396 - RNA, 19 nt, Homo sapiens
gaagcuuguuuaacugaac

SEQ ID NO: 553397 - RNA, 19 nt, Homo sapiens
uuuggaagcuuguuuaacu

SEQ ID NO: 553398 - RNA, 19 nt, Homo sapiens
gauuuggaagcuuguuuaa

SEQ ID NO: 553399 - RNA, 19 nt, Homo sapiens
ugauuuggaagcuuguuua

SEQ ID NO: 553400 - RNA, 19 nt, Homo sapiens
ggcaagugcaguugaagaa

SEQ ID NO: 553401 - RNA, 19 nt, Homo sapiens
ugaagucagacauuguuaa

SEQ ID NO: 553402 - RNA, 19 nt, Homo sapiens
ggaugacuuugauguguac

SEQ ID NO: 553403 - RNA, 19 nt, Homo sapiens
cagaucaacuaugggaaga

SEQ ID NO: 553404 - RNA, 19 nt, Homo sapiens
cggcugacuuugagacaga

SEQ ID NO: 553405 - RNA, 19 nt, Homo sapiens
aggaugacuuugaugugua

SEQ ID NO: 553406 - RNA, 19 nt, Homo sapiens
ccaagaccccuaauaaauu

SEQ ID NO: 553407 - RNA, 19 nt, Homo sapiens
gcugacacgucuacauaac

SEQ ID NO: 553408 - RNA, 19 nt, Homo sapiens
gcacuuguaccuggugguu

SEQ ID NO: 553409 - RNA, 19 nt, Homo sapiens
aggaugaguuugauuugga

SEQ ID NO: 553410 - RNA, 19 nt, Homo sapiens
uuaagacuguuacguuucu

SEQ ID NO: 553411 - RNA, 19 nt, Homo sapiens
uagcucaugcugaauuauu

SEQ ID NO: 553412 - RNA, 19 nt, Homo sapiens
aagcaugugugugcacuug

SEQ ID NO: 553413 - RNA, 19 nt, Homo sapiens
cagcagaguggagcgauuu

SEQ ID NO: 553414 - RNA, 19 nt, Homo sapiens
gaggaccagaguuaacaaa

SEQ ID NO: 553415 - RNA, 19 nt, Homo sapiens
acaauugccuacgaucguu

SEQ ID NO: 553416 - RNA, 19 nt, Homo sapiens
aaauagcacuaguuagacu

SEQ ID NO: 553417 - RNA, 19 nt, Homo sapiens
gcucuacucugcgcucucu

SEQ ID NO: 553418 - RNA, 19 nt, Homo sapiens
gagcuuaauugcguaaucc

SEQ ID NO: 553419 - RNA, 19 nt, Homo sapiens
uggaggaugaguuugauuu

SEQ ID NO: 553420 - RNA, 19 nt, Homo sapiens
gcggaagaaggaugugauu

SEQ ID NO: 553421 - RNA, 19 nt, Homo sapiens
caggaaguucugauucaaa

SEQ ID NO: 553422 - RNA, 19 nt, Homo sapiens
gguggacuguuuuggauuu

SEQ ID NO: 553423 - RNA, 19 nt, Homo sapiens
auuagcucaugcugaauua

SEQ ID NO: 553424 - RNA, 19 nt, Homo sapiens
cauuagcucaugcugaauu

SEQ ID NO: 553425 - RNA, 19 nt, Homo sapiens
ggcaagauauaaaaggaaa

SEQ ID NO: 553426 - RNA, 19 nt, Homo sapiens
acacauggacagucaagug

SEQ ID NO: 553427 - RNA, 19 nt, Homo sapiens
gccuacgaucguuauauua

SEQ ID NO: 553428 - RNA, 19 nt, Homo sapiens
ggagcgauuuagaaagaac

SEQ ID NO: 553429 - RNA, 19 nt, Homo sapiens
gggcaagugcaguugaaga

SEQ ID NO: 553430 - RNA, 19 nt, Homo sapiens
gaagagagagaaaaucauc

SEQ ID NO: 553431 - RNA, 19 nt, Homo sapiens
gaacauacuucguuucuua

SEQ ID NO: 553432 - RNA, 19 nt, Homo sapiens
gcacaggucuucucaugua

SEQ ID NO: 553433 - RNA, 19 nt, Homo sapiens
caacaaaguuccuaucaaa

SEQ ID NO: 553434 - RNA, 19 nt, Homo sapiens
gaaaguguguaaagcaaua

SEQ ID NO: 553435 - RNA, 19 nt, Homo sapiens
guaauaagguguaaucuag

SEQ ID NO: 553436 - RNA, 19 nt, Homo sapiens
gaaaagcggucaaauauca

SEQ ID NO: 553437 - RNA, 19 nt, Homo sapiens
caaggugucucaucugaaa

SEQ ID NO: 553438 - RNA, 19 nt, Homo sapiens
gaaaugagagugacagaga

SEQ ID NO: 553439 - RNA, 19 nt, Homo sapiens
uaaaggacguucaugagaa

SEQ ID NO: 553440 - RNA, 19 nt, Homo sapiens
gaauaaaggacguucauga

SEQ ID NO: 553441 - RNA, 19 nt, Homo sapiens
aaacggagccuuuauauca

SEQ ID NO: 553442 - RNA, 19 nt, Homo sapiens
ggaagcaguuugagcaaug

SEQ ID NO: 553443 - RNA, 19 nt, Homo sapiens
gcaaugaaauccguaagau

SEQ ID NO: 553444 - RNA, 19 nt, Homo sapiens
gaaauuaaaccauccuugu

SEQ ID NO: 553445 - RNA, 19 nt, Homo sapiens
gaaauucaccuguauggau

SEQ ID NO: 553446 - RNA, 19 nt, Homo sapiens
gaaaaucaauuccucuuug

SEQ ID NO: 553447 - RNA, 19 nt, Homo sapiens
gauggugaauugucuuuga

SEQ ID NO: 553448 - RNA, 19 nt, Homo sapiens
caaacaauaugcacuucuu

SEQ ID NO: 553449 - RNA, 19 nt, Homo sapiens
uggacgaucugcacaauaa

SEQ ID NO: 553450 - RNA, 19 nt, Homo sapiens
acuaccagcugaugaaaua

SEQ ID NO: 553451 - RNA, 19 nt, Homo sapiens
gaacugaaaggugaauaaa

SEQ ID NO: 553452 - RNA, 19 nt, Homo sapiens
caacagugcacucaucauu

SEQ ID NO: 553453 - RNA, 19 nt, Homo sapiens
ggaguuugcugcagaugug

SEQ ID NO: 553454 - RNA, 19 nt, Homo sapiens
cagcacaggucuucucaug

SEQ ID NO: 553455 - RNA, 19 nt, Homo sapiens
caaauauguucaucacugu

SEQ ID NO: 553456 - RNA, 19 nt, Homo sapiens
gugcacucaucauuaguua

SEQ ID NO: 553457 - RNA, 19 nt, Homo sapiens
ugagucugaucaugaauuu

SEQ ID NO: 553458 - RNA, 19 nt, Homo sapiens
aaaggacguucaugagaaa

SEQ ID NO: 553459 - RNA, 19 nt, Homo sapiens
gauauugggaugcuuagaa

SEQ ID NO: 553460 - RNA, 19 nt, Homo sapiens
gaagcaguuugagcaauga

SEQ ID NO: 553461 - RNA, 19 nt, Homo sapiens
caagauggaagcaguuuga

SEQ ID NO: 553462 - RNA, 19 nt, Homo sapiens
acucagaccuugggaaauu

SEQ ID NO: 553463 - RNA, 19 nt, Homo sapiens
caacucagaccuugggaaa

SEQ ID NO: 553464 - RNA, 19 nt, Homo sapiens
gaaaauaggauccaaaaca

SEQ ID NO: 553465 - RNA, 19 nt, Homo sapiens
ccaacaaaguuccuaucaa

SEQ ID NO: 553466 - RNA, 19 nt, Homo sapiens
aagaugcgcuccauuagga

SEQ ID NO: 553467 - RNA, 19 nt, Homo sapiens
ccacuaagaauacaguuug

SEQ ID NO: 553468 - RNA, 19 nt, Homo sapiens
aaauucaccuguauggauu

SEQ ID NO: 553469 - RNA, 19 nt, Homo sapiens
cacuaaacauuucucauga

SEQ ID NO: 553470 - RNA, 19 nt, Homo sapiens
cacaaggugucucaucuga

SEQ ID NO: 553471 - RNA, 19 nt, Homo sapiens
gaauguauaaucaguagug

SEQ ID NO: 553472 - RNA, 19 nt, Homo sapiens
guuacuggcugaccaacaa

SEQ ID NO: 553473 - RNA, 19 nt, Homo sapiens
gaaauucuggcauucuguu

SEQ ID NO: 553474 - RNA, 19 nt, Homo sapiens
caauaagucugcuccugau

SEQ ID NO: 553475 - RNA, 19 nt, Homo sapiens
guaaagcaauaaagcacau

SEQ ID NO: 553476 - RNA, 19 nt, Homo sapiens
gacuuuccaugcugaauga

SEQ ID NO: 553477 - RNA, 19 nt, Homo sapiens
gcagaugugggaacuaaau

SEQ ID NO: 553478 - RNA, 19 nt, Homo sapiens
uaagaccugugcaguuguu

SEQ ID NO: 553479 - RNA, 19 nt, Homo sapiens
gaacugccuauccgucauu

SEQ ID NO: 553480 - RNA, 19 nt, Homo sapiens
ugaagaaucgcagguuuaa

SEQ ID NO: 553481 - RNA, 19 nt, Homo sapiens
gaaaggcuggcucuucaau

SEQ ID NO: 553482 - RNA, 19 nt, Homo sapiens
ucgaaaggcuggcucuuca

SEQ ID NO: 553483 - RNA, 19 nt, Homo sapiens
gucaauagcucugauaaaa

SEQ ID NO: 553484 - RNA, 19 nt, Homo sapiens
cccaagaugcgcuccauua

SEQ ID NO: 553485 - RNA, 19 nt, Homo sapiens
ccuaaggauuuaaauggaa

SEQ ID NO: 553486 - RNA, 19 nt, Homo sapiens
uauccgucauugagacuua

SEQ ID NO: 553487 - RNA, 19 nt, Homo sapiens
ucaguaguguuuacaagau

SEQ ID NO: 553488 - RNA, 19 nt, Homo sapiens
aagaaucgcagguuuaaga

SEQ ID NO: 553489 - RNA, 19 nt, Homo sapiens
aaugaagaaucgcagguuu

SEQ ID NO: 553490 - RNA, 19 nt, Homo sapiens
cuaaacauuucucaugauc

SEQ ID NO: 553491 - RNA, 19 nt, Homo sapiens
uaagccuggugaugucaua

SEQ ID NO: 553492 - RNA, 19 nt, Homo sapiens
acagugcacucaucauuag

SEQ ID NO: 553493 - RNA, 19 nt, Homo sapiens
cugcagaugugggaacuaa

SEQ ID NO: 553494 - RNA, 19 nt, Homo sapiens
uuuaagaccugugcaguug

SEQ ID NO: 553495 - RNA, 19 nt, Homo sapiens
acacuaaacauuucucaug

SEQ ID NO: 553496 - RNA, 19 nt, Homo sapiens
caugagaaaucgacuacca

SEQ ID NO: 553497 - RNA, 19 nt, Homo sapiens
acaagauucugugaugaaa

SEQ ID NO: 553498 - RNA, 19 nt, Homo sapiens
caauguagaagguuggaaa

SEQ ID NO: 553499 - RNA, 19 nt, Homo sapiens
uggcagagcuggcgcaaac

SEQ ID NO: 553500 - RNA, 19 nt, Homo sapiens
uggaguggguuaaugcauu

SEQ ID NO: 553501 - RNA, 19 nt, Homo sapiens
uaccaugaauccaucaguu

SEQ ID NO: 553502 - RNA, 19 nt, Homo sapiens
caauagcucugauaaaauc

SEQ ID NO: 553503 - RNA, 19 nt, Homo sapiens
caaagcaaauauguucauc

SEQ ID NO: 553504 - RNA, 19 nt, Homo sapiens
gcacucaucauuaguuaac

SEQ ID NO: 553505 - RNA, 19 nt, Homo sapiens
gagauggugaauugucuuu

SEQ ID NO: 553506 - RNA, 19 nt, Homo sapiens
uaagucugcuccugaucuu

SEQ ID NO: 553507 - RNA, 19 nt, Homo sapiens
caccaagcauauuagaaga

SEQ ID NO: 553508 - RNA, 19 nt, Homo sapiens
caacaccaagcauauuaga

SEQ ID NO: 553509 - RNA, 19 nt, Homo sapiens
uuuggaggcuuucgaaaug

SEQ ID NO: 553510 - RNA, 19 nt, Homo sapiens
auacuucguuucuuagaug

SEQ ID NO: 553511 - RNA, 19 nt, Homo sapiens
guagaagguuggaaaauca

SEQ ID NO: 553512 - RNA, 19 nt, Homo sapiens
gaugaaauaccugcaaagu

SEQ ID NO: 553513 - RNA, 19 nt, Homo sapiens
acugaaaggugaauaaagg

SEQ ID NO: 553514 - RNA, 19 nt, Homo sapiens
ugaacugaaaggugaauaa

SEQ ID NO: 553515 - RNA, 19 nt, Homo sapiens
ucauugagacuuauucaug

SEQ ID NO: 553516 - RNA, 19 nt, Homo sapiens
aaaugagagugacagagaa

SEQ ID NO: 553517 - RNA, 19 nt, Homo sapiens
gaauccaucaguuguacaa

SEQ ID NO: 553518 - RNA, 19 nt, Homo sapiens
gauaaggaagaacauacuu

SEQ ID NO: 553519 - RNA, 19 nt, Homo sapiens
caauuccucuuugguccua

SEQ ID NO: 553520 - RNA, 19 nt, Homo sapiens
auauugggaugcuuagaaa

SEQ ID NO: 553521 - RNA, 19 nt, Homo sapiens
gauucuggcccuucccuaa

SEQ ID NO: 553522 - RNA, 19 nt, Homo sapiens
caaaguuccuaucaaaaga

SEQ ID NO: 553523 - RNA, 19 nt, Homo sapiens
ggucaaaggaggagagaag

SEQ ID NO: 553524 - RNA, 19 nt, Homo sapiens
gcaauaaagcacauuuuga

SEQ ID NO: 553525 - RNA, 19 nt, Homo sapiens
gaaagugcgaacugccuau

SEQ ID NO: 553526 - RNA, 19 nt, Homo sapiens
gagauaaggaagaacauac

SEQ ID NO: 553527 - RNA, 19 nt, Homo sapiens
gucggucacuugucaauag

SEQ ID NO: 553528 - RNA, 19 nt, Homo sapiens
uccaagcucuccucgcauu

SEQ ID NO: 553529 - RNA, 19 nt, Homo sapiens
ugcaagcccucacagaaug

SEQ ID NO: 553530 - RNA, 19 nt, Homo sapiens
aggaagagguggacgaucu

SEQ ID NO: 553531 - RNA, 19 nt, Homo sapiens
gaacauacuucguuucuua

SEQ ID NO: 553532 - RNA, 19 nt, Homo sapiens
gaacauaguuuagcaaguu

SEQ ID NO: 553533 - RNA, 19 nt, Homo sapiens
caaggugucucaucugaaa

SEQ ID NO: 553534 - RNA, 19 nt, Homo sapiens
aaacggagccuuuauauca

SEQ ID NO: 553535 - RNA, 19 nt, Homo sapiens
acagaaacauggauauuga

SEQ ID NO: 553536 - RNA, 19 nt, Homo sapiens
aaaucacacucaagcauua

SEQ ID NO: 553537 - RNA, 19 nt, Homo sapiens
gaaaucacacucaagcauu

SEQ ID NO: 553538 - RNA, 19 nt, Homo sapiens
gaaaaucaauuccucuuug

SEQ ID NO: 553539 - RNA, 19 nt, Homo sapiens
gauggugaauugucuuuga

SEQ ID NO: 553540 - RNA, 19 nt, Homo sapiens
uggacgaucugcacaauaa

SEQ ID NO: 553541 - RNA, 19 nt, Homo sapiens
uaauuaagcgugcauguuu

SEQ ID NO: 553542 - RNA, 19 nt, Homo sapiens
guaagaacauaguuuagca

SEQ ID NO: 553543 - RNA, 19 nt, Homo sapiens
guaauaaggugagcuuucu

SEQ ID NO: 553544 - RNA, 19 nt, Homo sapiens
gaagauauacuggaauaca

SEQ ID NO: 553545 - RNA, 19 nt, Homo sapiens
aagaugcgcuccauuagga

SEQ ID NO: 553546 - RNA, 19 nt, Homo sapiens
cacuaaacauuucucauga

SEQ ID NO: 553547 - RNA, 19 nt, Homo sapiens
cacaaggugucucaucuga

SEQ ID NO: 553548 - RNA, 19 nt, Homo sapiens
cauuuacccuggaauagaa

SEQ ID NO: 553549 - RNA, 19 nt, Homo sapiens
ccugagccauauuucuuua

SEQ ID NO: 553550 - RNA, 19 nt, Homo sapiens
gaaauucuggcauucuguu

SEQ ID NO: 553551 - RNA, 19 nt, Homo sapiens
caauaagucugcuccugau

SEQ ID NO: 553552 - RNA, 19 nt, Homo sapiens
gacagaaacauggauauug

SEQ ID NO: 553553 - RNA, 19 nt, Homo sapiens
aaacucaacaguagaaaug

SEQ ID NO: 553554 - RNA, 19 nt, Homo sapiens
guggaaaacuguuagaaaa

SEQ ID NO: 553555 - RNA, 19 nt, Homo sapiens
uaagaccugugcaguuguu

SEQ ID NO: 553556 - RNA, 19 nt, Homo sapiens
ugaagaaucgcagguuuaa

SEQ ID NO: 553557 - RNA, 19 nt, Homo sapiens
gaaaggcuggcucuucaau

SEQ ID NO: 553558 - RNA, 19 nt, Homo sapiens
ucgaaaggcuggcucuuca

SEQ ID NO: 553559 - RNA, 19 nt, Homo sapiens
gucaauagcucugauaaaa

SEQ ID NO: 553560 - RNA, 19 nt, Homo sapiens
cccaagaugcgcuccauua

SEQ ID NO: 553561 - RNA, 19 nt, Homo sapiens
ggagauaguaagaacauag

SEQ ID NO: 553562 - RNA, 19 nt, Homo sapiens
aagaaucgcagguuuaaga

SEQ ID NO: 553563 - RNA, 19 nt, Homo sapiens
aaugaagaaucgcagguuu

SEQ ID NO: 553564 - RNA, 19 nt, Homo sapiens
cuaaacauuucucaugauc

SEQ ID NO: 553565 - RNA, 19 nt, Homo sapiens
uaagccuggugaugucaua

SEQ ID NO: 553566 - RNA, 19 nt, Homo sapiens
uuuaagaccugugcaguug

SEQ ID NO: 553567 - RNA, 19 nt, Homo sapiens
acacuaaacauuucucaug

SEQ ID NO: 553568 - RNA, 19 nt, Homo sapiens
caauguagaagguuggaaa

SEQ ID NO: 553569 - RNA, 19 nt, Homo sapiens
uggcagagcuggcgcaaac

SEQ ID NO: 553570 - RNA, 19 nt, Homo sapiens
caauagcucugauaaaauc

SEQ ID NO: 553571 - RNA, 19 nt, Homo sapiens
cugcaaacauuuuaccuua

SEQ ID NO: 553572 - RNA, 19 nt, Homo sapiens
gagauggugaauugucuuu

SEQ ID NO: 553573 - RNA, 19 nt, Homo sapiens
uaagucugcuccugaucuu

SEQ ID NO: 553574 - RNA, 19 nt, Homo sapiens
uuacauuuacccuggaaua

SEQ ID NO: 553575 - RNA, 19 nt, Homo sapiens
auacuucguuucuuagaug

SEQ ID NO: 553576 - RNA, 19 nt, Homo sapiens
guagaagguuggaaaauca

SEQ ID NO: 553577 - RNA, 19 nt, Homo sapiens
gauaaggaagaacauacuu

SEQ ID NO: 553578 - RNA, 19 nt, Homo sapiens
caauuccucuuugguccua

SEQ ID NO: 553579 - RNA, 19 nt, Homo sapiens
acucaagcauuaucaagug

SEQ ID NO: 553580 - RNA, 19 nt, Homo sapiens
uuugauauccugagccaua

SEQ ID NO: 553581 - RNA, 19 nt, Homo sapiens
cuuaguaucucuucuucau

SEQ ID NO: 553582 - RNA, 19 nt, Homo sapiens
ugacagaaacauggauauu

SEQ ID NO: 553583 - RNA, 19 nt, Homo sapiens
uaagcgugcauguuuguuu

SEQ ID NO: 553584 - RNA, 19 nt, Homo sapiens
gagauaaggaagaacauac

SEQ ID NO: 553585 - RNA, 19 nt, Homo sapiens
gucggucacuugucaauag

SEQ ID NO: 553586 - RNA, 19 nt, Homo sapiens
caacaguagaaauggaauu

SEQ ID NO: 553587 - RNA, 19 nt, Homo sapiens
ugucauagcaacaagauuc

SEQ ID NO: 553588 - RNA, 19 nt, Homo sapiens
ggugagcuuucuucugcuu

SEQ ID NO: 553589 - RNA, 19 nt, Homo sapiens
uccaagcucuccucgcauu

SEQ ID NO: 553590 - RNA, 19 nt, Homo sapiens
aggaagagguggacgaucu

SEQ ID NO: 553591 - RNA, 19 nt, Homo sapiens
uaucucuucuucauacuca

SEQ ID NO: 553592 - RNA, 19 nt, Homo sapiens
cuggugaugucauacacua

SEQ ID NO: 553593 - RNA, 19 nt, Homo sapiens
aaagaaauagcaagaacug

SEQ ID NO: 553594 - RNA, 19 nt, Homo sapiens
gagccuuuauaucaagaga

SEQ ID NO: 553595 - RNA, 19 nt, Homo sapiens
aaaguaugcugaguugaca

SEQ ID NO: 553596 - RNA, 19 nt, Homo sapiens
gcuaaaugacagaaacaug

SEQ ID NO: 553597 - RNA, 19 nt, Homo sapiens
gcacaaggugucucaucug

SEQ ID NO: 553598 - RNA, 19 nt, Homo sapiens
gccggacacuaaacauuuc

SEQ ID NO: 553599 - RNA, 19 nt, Homo sapiens
ggagcucggccacagaaga

SEQ ID NO: 553600 - RNA, 19 nt, Homo sapiens
augcugaguugacauguug

SEQ ID NO: 553601 - RNA, 19 nt, Homo sapiens
agaaaaguaugcugaguug

SEQ ID NO: 553602 - RNA, 19 nt, Homo sapiens
ccaaaacggagccuuuaua

SEQ ID NO: 553603 - RNA, 19 nt, Homo sapiens
ggacacuaaacauuucuca

SEQ ID NO: 553604 - RNA, 19 nt, Homo sapiens
caaaagaaauagcaagaac

SEQ ID NO: 553605 - RNA, 19 nt, Homo sapiens
uaaaugacagaaacaugga

SEQ ID NO: 553606 - RNA, 19 nt, Homo sapiens
gaugaauuguguguuugau

SEQ ID NO: 553607 - RNA, 19 nt, Homo sapiens
gugcaguuguuggaaauuc

SEQ ID NO: 553608 - RNA, 19 nt, Homo sapiens
ggcuggcucuucaaucuuc

SEQ ID NO: 553609 - RNA, 19 nt, Homo sapiens
gguggacgaucugcacaau

SEQ ID NO: 553610 - RNA, 19 nt, Homo sapiens
cgccggacacuaaacauuu

SEQ ID NO: 553611 - RNA, 19 nt, Homo sapiens
gagauaguaagaacauagu

SEQ ID NO: 553612 - RNA, 19 nt, Homo sapiens
ggaaauucuggcauucugu

SEQ ID NO: 553613 - RNA, 19 nt, Homo sapiens
ccugugcaguuguuggaaa

SEQ ID NO: 553614 - RNA, 19 nt, Homo sapiens
gccuuuauaucaagagaag

SEQ ID NO: 553615 - RNA, 19 nt, Homo sapiens
gauaaaaucauucgaaagg

SEQ ID NO: 553616 - RNA, 19 nt, Homo sapiens
caagcauuaucaagugaag

SEQ ID NO: 553617 - RNA, 19 nt, Homo sapiens
ccaagaugcgcuccauuag

SEQ ID NO: 553618 - RNA, 19 nt, Homo sapiens
aauuaagcgugcauguuug

SEQ ID NO: 553619 - RNA, 19 nt, Homo sapiens
ucuaggagauaguaagaac

SEQ ID NO: 553620 - RNA, 19 nt, Homo sapiens
uguuggaaauucuggcauu

SEQ ID NO: 553621 - RNA, 19 nt, Homo sapiens
caaaacggagccuuuauau

SEQ ID NO: 553622 - RNA, 19 nt, Homo sapiens
cauacuucguuucuuagau

SEQ ID NO: 553623 - RNA, 19 nt, Homo sapiens
aaggcuggcucuucaaucu

SEQ ID NO: 553624 - RNA, 19 nt, Homo sapiens
ugucucaucugaaaagaaa

SEQ ID NO: 553625 - RNA, 19 nt, Homo sapiens
gaauguggaaaggagauug

SEQ ID NO: 553626 - RNA, 19 nt, Homo sapiens
ugaucuacauagccuccua

SEQ ID NO: 553627 - RNA, 19 nt, Homo sapiens
agagauaaggaagaacaua

SEQ ID NO: 553628 - RNA, 19 nt, Homo sapiens
ccagcacaauguagaaggu

SEQ ID NO: 553629 - RNA, 19 nt, Homo sapiens
uugagucggucacuuguca

SEQ ID NO: 553630 - RNA, 19 nt, Homo sapiens
gcauaaauagguaacuacu

SEQ ID NO: 553631 - RNA, 19 nt, Homo sapiens
ggagacagauguucacgua

SEQ ID NO: 553632 - RNA, 19 nt, Homo sapiens
gaagaaaccuaccaacagu

SEQ ID NO: 553633 - RNA, 19 nt, Homo sapiens
gaagagaagcuauuggaaa

SEQ ID NO: 553634 - RNA, 19 nt, Homo sapiens
gacgacagcugcaauguga

SEQ ID NO: 553635 - RNA, 19 nt, Homo sapiens
ggaaagugauucaguucaa

SEQ ID NO: 553636 - RNA, 19 nt, Homo sapiens
gaacaagagagaaaguuaa

SEQ ID NO: 553637 - RNA, 19 nt, Homo sapiens
ggaaagaacagcagaggaa

SEQ ID NO: 553638 - RNA, 19 nt, Homo sapiens
ucagaaaucccaacaauga

SEQ ID NO: 553639 - RNA, 19 nt, Homo sapiens
gcagaaggcacaagaagaa

SEQ ID NO: 553640 - RNA, 19 nt, Homo sapiens
aacaggagcuugcagauuu

SEQ ID NO: 553641 - RNA, 19 nt, Homo sapiens
ggagaaggaucgagcuaau

SEQ ID NO: 553642 - RNA, 19 nt, Homo sapiens
agacagauguucacguaaa

SEQ ID NO: 553643 - RNA, 19 nt, Homo sapiens
ggaacuugcucgacugaga

SEQ ID NO: 553644 - RNA, 19 nt, Homo sapiens
ccaagcagaggaagaaaua

SEQ ID NO: 553645 - RNA, 19 nt, Homo sapiens
gagcauguuuacaacguuu

SEQ ID NO: 553646 - RNA, 19 nt, Homo sapiens
guucagaaaucccaacaau

SEQ ID NO: 553647 - RNA, 19 nt, Homo sapiens
guccuacccuucuuauuaa

SEQ ID NO: 553648 - RNA, 19 nt, Homo sapiens
gaacagcagaggaaagaga

SEQ ID NO: 553649 - RNA, 19 nt, Homo sapiens
gcaacuuucuucauguguu

SEQ ID NO: 553650 - RNA, 19 nt, Homo sapiens
gagaagaggaggagcagaa

SEQ ID NO: 553651 - RNA, 19 nt, Homo sapiens
gggaagaaaucucacaaac

SEQ ID NO: 553652 - RNA, 19 nt, Homo sapiens
ucccauagguuaagaaugu

SEQ ID NO: 553653 - RNA, 19 nt, Homo sapiens
gaaaucccaacaaugaauu

SEQ ID NO: 553654 - RNA, 19 nt, Homo sapiens
ggcgauuugugguuuauuu

SEQ ID NO: 553655 - RNA, 19 nt, Homo sapiens
ggaagaaaccuaccaacag

SEQ ID NO: 553656 - RNA, 19 nt, Homo sapiens
gaaggagaaacgaaagaaa

SEQ ID NO: 553657 - RNA, 19 nt, Homo sapiens
caauguauauguucaguac

SEQ ID NO: 553658 - RNA, 19 nt, Homo sapiens
gcaggagggaugacuauga

SEQ ID NO: 553659 - RNA, 19 nt, Homo sapiens
aaagagagagggaaagauu

SEQ ID NO: 553660 - RNA, 19 nt, Homo sapiens
ggaagucggguaauagaga

SEQ ID NO: 553661 - RNA, 19 nt, Homo sapiens
ggaagaagaaugccaagca

SEQ ID NO: 553662 - RNA, 19 nt, Homo sapiens
ggaaagagagagggaaaga

SEQ ID NO: 553663 - RNA, 19 nt, Homo sapiens
cauauauucccauagguua

SEQ ID NO: 553664 - RNA, 19 nt, Homo sapiens
gaaauacaacaauguccaa

SEQ ID NO: 553665 - RNA, 19 nt, Homo sapiens
aguccuacccuucuuauua

SEQ ID NO: 553666 - RNA, 19 nt, Homo sapiens
gaaagugauucaguucaag

SEQ ID NO: 553667 - RNA, 19 nt, Homo sapiens
gaaagaacagcagaggaaa

SEQ ID NO: 553668 - RNA, 19 nt, Homo sapiens
gaaggcacaagaagaauuc

SEQ ID NO: 553669 - RNA, 19 nt, Homo sapiens
ccaagaagaugacauuucc

SEQ ID NO: 553670 - RNA, 19 nt, Homo sapiens
gcagcccuuucucuguuua

SEQ ID NO: 553671 - RNA, 19 nt, Homo sapiens
gaaacaacaggagaagaaa

SEQ ID NO: 553672 - RNA, 19 nt, Homo sapiens
gaagaggacacuuuuauug

SEQ ID NO: 553673 - RNA, 19 nt, Homo sapiens
cagacuggcuccuccuuug

SEQ ID NO: 553674 - RNA, 19 nt, Homo sapiens
gaacaacaacuagaagaag

SEQ ID NO: 553675 - RNA, 19 nt, Homo sapiens
aagaugacauuuccagaga

SEQ ID NO: 553676 - RNA, 19 nt, Homo sapiens
caacuuucuucauguguuc

SEQ ID NO: 553677 - RNA, 19 nt, Homo sapiens
uaccaacaguuccuagauu

SEQ ID NO: 553678 - RNA, 19 nt, Homo sapiens
gcacaagaagaauucagaa

SEQ ID NO: 553679 - RNA, 19 nt, Homo sapiens
aagagaagcuauuggaaag

SEQ ID NO: 553680 - RNA, 19 nt, Homo sapiens
gaaaguuaaaggaacaaug

SEQ ID NO: 553681 - RNA, 19 nt, Homo sapiens
agaacaagagagaaaguua

SEQ ID NO: 553682 - RNA, 19 nt, Homo sapiens
gcuagaagaacaagagaga

SEQ ID NO: 553683 - RNA, 19 nt, Homo sapiens
gagaagcuauuggaaagag

SEQ ID NO: 553684 - RNA, 19 nt, Homo sapiens
aaagaaacgucggcaggaa

SEQ ID NO: 553685 - RNA, 19 nt, Homo sapiens
aagaugacguuucccaaga

SEQ ID NO: 553686 - RNA, 19 nt, Homo sapiens
caacaggagaagaaagaaa

SEQ ID NO: 553687 - RNA, 19 nt, Homo sapiens
agaaacaacaggagaagaa

SEQ ID NO: 553688 - RNA, 19 nt, Homo sapiens
ugaagaacaacaacuagaa

SEQ ID NO: 553689 - RNA, 19 nt, Homo sapiens
ugaagaaggagaaacgaaa

SEQ ID NO: 553690 - RNA, 19 nt, Homo sapiens
ggaggaggaagucggguaa

SEQ ID NO: 553691 - RNA, 19 nt, Homo sapiens
cacaaacgcacaucaaaga

SEQ ID NO: 553692 - RNA, 19 nt, Homo sapiens
cauaauuucccaacaucua

SEQ ID NO: 553693 - RNA, 19 nt, Homo sapiens
uagaagaacaagagagaaa

SEQ ID NO: 553694 - RNA, 19 nt, Homo sapiens
gaagaacaacaacuagaag

SEQ ID NO: 553695 - RNA, 19 nt, Homo sapiens
gaggaagucggguaauaga

SEQ ID NO: 553696 - RNA, 19 nt, Homo sapiens
caacaauguccaagaggaa

SEQ ID NO: 553697 - RNA, 19 nt, Homo sapiens
aagcagcccuuucucuguu

SEQ ID NO: 553698 - RNA, 19 nt, Homo sapiens
aggaggaagucggguaaua

SEQ ID NO: 553699 - RNA, 19 nt, Homo sapiens
agagaaaguuaaaggaaca

SEQ ID NO: 553700 - RNA, 19 nt, Homo sapiens
gaagaacaagagagaaagu

SEQ ID NO: 553701 - RNA, 19 nt, Homo sapiens
gaagaaggagaaacgaaag

SEQ ID NO: 553702 - RNA, 19 nt, Homo sapiens
caaggucagcugcaauuug

SEQ ID NO: 553703 - RNA, 19 nt, Homo sapiens
aauugucccuucuacagua

SEQ ID NO: 553704 - RNA, 19 nt, Homo sapiens
agaaggaucgagcuaauug

SEQ ID NO: 553705 - RNA, 19 nt, Homo sapiens
ggaaggagaaacccuaguc

SEQ ID NO: 553706 - RNA, 19 nt, Homo sapiens
gcaauguauauguucagua

SEQ ID NO: 553707 - RNA, 19 nt, Homo sapiens
accaacaguuccuagauuu

SEQ ID NO: 553708 - RNA, 19 nt, Homo sapiens
gagaaggaucgagcuaauu

SEQ ID NO: 553709 - RNA, 19 nt, Homo sapiens
uaaaggaacaauggaaaga

SEQ ID NO: 553710 - RNA, 19 nt, Homo sapiens
aacaacaacuagaagaaga

SEQ ID NO: 553711 - RNA, 19 nt, Homo sapiens
guaccagucggaagaagaa

SEQ ID NO: 553712 - RNA, 19 nt, Homo sapiens
gagcuaauugucccuucua

SEQ ID NO: 553713 - RNA, 19 nt, Homo sapiens
ucagaguaauggagaagga

SEQ ID NO: 553714 - RNA, 19 nt, Homo sapiens
guuaaaggaacaauggaaa

SEQ ID NO: 553715 - RNA, 19 nt, Homo sapiens
caagagagaaaguuaaagg

SEQ ID NO: 553716 - RNA, 19 nt, Homo sapiens
ggaggaagucggguaauag

SEQ ID NO: 553717 - RNA, 19 nt, Homo sapiens
gaccacaccuacaaaagaa

SEQ ID NO: 553718 - RNA, 19 nt, Homo sapiens
cuucauguguucagaaauc

SEQ ID NO: 553719 - RNA, 19 nt, Homo sapiens
gaauaaagaaggaaaagga

SEQ ID NO: 553720 - RNA, 19 nt, Homo sapiens
gguaauagagacagaacug

SEQ ID NO: 553721 - RNA, 19 nt, Homo sapiens
ggacgacagcugcaaugug

SEQ ID NO: 553722 - RNA, 19 nt, Homo sapiens
ugcagaagaugcuggauca

SEQ ID NO: 553723 - RNA, 19 nt, Homo sapiens
gagcagaaggcacaagaag

SEQ ID NO: 553724 - RNA, 19 nt, Homo sapiens
ugugaauucugcccaguga

SEQ ID NO: 553725 - RNA, 19 nt, Homo sapiens
agaggaagcugugcagaag

SEQ ID NO: 553726 - RNA, 19 nt, Homo sapiens
uggcugcacuugagaagau

SEQ ID NO: 553727 - RNA, 19 nt, Homo sapiens
ggaagaaaucucacaaacg

SEQ ID NO: 553728 - RNA, 19 nt, Homo sapiens
uagaagaagagaagcuauu

SEQ ID NO: 553729 - RNA, 19 nt, Homo sapiens
auacaacaauguccaagag

SEQ ID NO: 553730 - RNA, 19 nt, Homo sapiens
agagagaaaguuaaaggaa

SEQ ID NO: 553731 - RNA, 19 nt, Homo sapiens
ggagaaacauguugauuua

SEQ ID NO: 553732 - RNA, 19 nt, Homo sapiens
gaagaaagcuaccgugaau

SEQ ID NO: 553733 - RNA, 19 nt, Homo sapiens
guacagaacaguaaaguua

SEQ ID NO: 553734 - RNA, 19 nt, Homo sapiens
ggagcuugauguuauauua

SEQ ID NO: 553735 - RNA, 19 nt, Homo sapiens
ccaaacagcuuaaauucuu

SEQ ID NO: 553736 - RNA, 19 nt, Homo sapiens
gaauaguguuucaaaggua

SEQ ID NO: 553737 - RNA, 19 nt, Homo sapiens
gagcaguucuguugcauga

SEQ ID NO: 553738 - RNA, 19 nt, Homo sapiens
caggagaaguuaagaauug

SEQ ID NO: 553739 - RNA, 19 nt, Homo sapiens
gcugaauucuucucugaua

SEQ ID NO: 553740 - RNA, 19 nt, Homo sapiens
gaauugagcaguucuguug

SEQ ID NO: 553741 - RNA, 19 nt, Homo sapiens
gcaguucuguugcaugauu

SEQ ID NO: 553742 - RNA, 19 nt, Homo sapiens
gguguggucuacuaaauaa

SEQ ID NO: 553743 - RNA, 19 nt, Homo sapiens
ggacugugguauaauuauu

SEQ ID NO: 553744 - RNA, 19 nt, Homo sapiens
aaacggaugucuccauuga

SEQ ID NO: 553745 - RNA, 19 nt, Homo sapiens
gggcugaacugcucuacaa

SEQ ID NO: 553746 - RNA, 19 nt, Homo sapiens
caauuugucuggacuagaa

SEQ ID NO: 553747 - RNA, 19 nt, Homo sapiens
acaagaggcuucccuaguu

SEQ ID NO: 553748 - RNA, 19 nt, Homo sapiens
gaacaaagugagaaaugaa

SEQ ID NO: 553749 - RNA, 19 nt, Homo sapiens
uaaaugcccucauccguau

SEQ ID NO: 553750 - RNA, 19 nt, Homo sapiens
caagaggcuucccuaguuu

SEQ ID NO: 553751 - RNA, 19 nt, Homo sapiens
gcaguuaguuaguuacuca

SEQ ID NO: 553752 - RNA, 19 nt, Homo sapiens
gcauaugaauaccaggaua

SEQ ID NO: 553753 - RNA, 19 nt, Homo sapiens
gguaagaucauaacaaugu

SEQ ID NO: 553754 - RNA, 19 nt, Homo sapiens
agggagcacuuuaaacuua

SEQ ID NO: 553755 - RNA, 19 nt, Homo sapiens
cagccuacaucucaauuaa

SEQ ID NO: 553756 - RNA, 19 nt, Homo sapiens
gaaagcuaccgugaauuua

SEQ ID NO: 553757 - RNA, 19 nt, Homo sapiens
uaacuucuguacaguaaga

SEQ ID NO: 553758 - RNA, 19 nt, Homo sapiens
gacaguaucacucuaauau

SEQ ID NO: 553759 - RNA, 19 nt, Homo sapiens
cagguaagaucauaacaau

SEQ ID NO: 553760 - RNA, 19 nt, Homo sapiens
gucaaucuaucuucaguuu

SEQ ID NO: 553761 - RNA, 19 nt, Homo sapiens
aacaaugucucaugaugua

SEQ ID NO: 553762 - RNA, 19 nt, Homo sapiens
gagauuggccugguuguuu

SEQ ID NO: 553763 - RNA, 19 nt, Homo sapiens
uggaauguguuguaaguuu

SEQ ID NO: 553764 - RNA, 19 nt, Homo sapiens
gugauacacugaauggaaa

SEQ ID NO: 553765 - RNA, 19 nt, Homo sapiens
gaagacuccucuacucaca

SEQ ID NO: 553766 - RNA, 19 nt, Homo sapiens
gagaaugaaaggaaguaua

SEQ ID NO: 553767 - RNA, 19 nt, Homo sapiens
gaaacauguugauuuaguc

SEQ ID NO: 553768 - RNA, 19 nt, Homo sapiens
ugaacaaagugagaaauga

SEQ ID NO: 553769 - RNA, 19 nt, Homo sapiens
ggaauguguuguaaguuuc

SEQ ID NO: 553770 - RNA, 19 nt, Homo sapiens
uuacagaauuccuaccaaa

SEQ ID NO: 553771 - RNA, 19 nt, Homo sapiens
gcacauguacauauggaaa

SEQ ID NO: 553772 - RNA, 19 nt, Homo sapiens
agaaagcuaccgugaauuu

SEQ ID NO: 553773 - RNA, 19 nt, Homo sapiens
gaucagagcauuuauuuug

SEQ ID NO: 553774 - RNA, 19 nt, Homo sapiens
gguuguaugugucauuuau

SEQ ID NO: 553775 - RNA, 19 nt, Homo sapiens
gaaaagauguauguugcua

SEQ ID NO: 553776 - RNA, 19 nt, Homo sapiens
gacaagaugaggagguaua

SEQ ID NO: 553777 - RNA, 19 nt, Homo sapiens
acaaucagguaagaucaua

SEQ ID NO: 553778 - RNA, 19 nt, Homo sapiens
uaaaguaacccauaaucug

SEQ ID NO: 553779 - RNA, 19 nt, Homo sapiens
ucaagaugcuacaauggaa

SEQ ID NO: 553780 - RNA, 19 nt, Homo sapiens
caucauccguccuuucuuc

SEQ ID NO: 553781 - RNA, 19 nt, Homo sapiens
gaaacuuccugcccucucu

SEQ ID NO: 553782 - RNA, 19 nt, Homo sapiens
cagacaagaugaggaggua

SEQ ID NO: 553783 - RNA, 19 nt, Homo sapiens
uauagagagucccaacaaa

SEQ ID NO: 553784 - RNA, 19 nt, Homo sapiens
gaagaugugauacacugaa

SEQ ID NO: 553785 - RNA, 19 nt, Homo sapiens
guuaacagcaggagaaguu

SEQ ID NO: 553786 - RNA, 19 nt, Homo sapiens
uaauauggaucagagcauu

SEQ ID NO: 553787 - RNA, 19 nt, Homo sapiens
uuaauaauguugccuugga

SEQ ID NO: 553788 - RNA, 19 nt, Homo sapiens
gcacacccuucacacuguu

SEQ ID NO: 553789 - RNA, 19 nt, Homo sapiens
gcaacaacaugcuaaugac

SEQ ID NO: 553790 - RNA, 19 nt, Homo sapiens
cggagaaacauguugauuu

SEQ ID NO: 553791 - RNA, 19 nt, Homo sapiens
gagccucucuccucugcaa

SEQ ID NO: 553792 - RNA, 19 nt, Homo sapiens
guuauuaccuauccugaag

SEQ ID NO: 553793 - RNA, 19 nt, Homo sapiens
cuaccaaacagcuuaaauu

SEQ ID NO: 553794 - RNA, 19 nt, Homo sapiens
ugagauaacaaucagguaa

SEQ ID NO: 553795 - RNA, 19 nt, Homo sapiens
gugcugguguggucuacua

SEQ ID NO: 553796 - RNA, 19 nt, Homo sapiens
uagggacugugguauaauu

SEQ ID NO: 553797 - RNA, 19 nt, Homo sapiens
gcaggagaaguuaagaauu

SEQ ID NO: 553798 - RNA, 19 nt, Homo sapiens
gcccucauccguauucuuu

SEQ ID NO: 553799 - RNA, 19 nt, Homo sapiens
gaauuuacugggugaagaa

SEQ ID NO: 553800 - RNA, 19 nt, Homo sapiens
ccauugaucugccaaaucg

SEQ ID NO: 553801 - RNA, 19 nt, Homo sapiens
gauaagcugcacaugacua

SEQ ID NO: 553802 - RNA, 19 nt, Homo sapiens
aauacugucuuaucugcua

SEQ ID NO: 553803 - RNA, 19 nt, Homo sapiens
guuauucccuuaccugaag

SEQ ID NO: 553804 - RNA, 19 nt, Homo sapiens
auaccaggauagcuuuaua

SEQ ID NO: 553805 - RNA, 19 nt, Homo sapiens
gcaagugaacaaagugaga

SEQ ID NO: 553806 - RNA, 19 nt, Homo sapiens
gccuacaucucaauuaaag

SEQ ID NO: 553807 - RNA, 19 nt, Homo sapiens
aaagauguauguugcuauc

SEQ ID NO: 553808 - RNA, 19 nt, Homo sapiens
guuguaaguuucuuugcuu

SEQ ID NO: 553809 - RNA, 19 nt, Homo sapiens
gaucugccaaaucguuaua

SEQ ID NO: 553810 - RNA, 19 nt, Homo sapiens
gaauaccaggauagcuuua

SEQ ID NO: 553811 - RNA, 19 nt, Homo sapiens
agugagaaaugaaaucgaa

SEQ ID NO: 553812 - RNA, 19 nt, Homo sapiens
aaauguuacugucugacua

SEQ ID NO: 553813 - RNA, 19 nt, Homo sapiens
uaauaauguugccuuggaa

SEQ ID NO: 553814 - RNA, 19 nt, Homo sapiens
cagacuggauggaaacuuc

SEQ ID NO: 553815 - RNA, 19 nt, Homo sapiens
gaaaagaagagcaccuaaa

SEQ ID NO: 553816 - RNA, 19 nt, Homo sapiens
caaacagcuuaaauucuuc

SEQ ID NO: 553817 - RNA, 19 nt, Homo sapiens
guugauaagcugcacauga

SEQ ID NO: 553818 - RNA, 19 nt, Homo sapiens
ucacuuguaguccauuuaa

SEQ ID NO: 553819 - RNA, 19 nt, Homo sapiens
cauaaucugcuuggcaaua

SEQ ID NO: 553820 - RNA, 19 nt, Homo sapiens
guuaagaauugagcaguuc

SEQ ID NO: 553821 - RNA, 19 nt, Homo sapiens
gaagguuguaugugucauu

SEQ ID NO: 553822 - RNA, 19 nt, Homo sapiens
uacuggagcuugauguuau

SEQ ID NO: 553823 - RNA, 19 nt, Homo sapiens
guaaguacagaacaguaaa

SEQ ID NO: 553824 - RNA, 19 nt, Homo sapiens
agugauaaaucgggaaauu

SEQ ID NO: 553825 - RNA, 19 nt, Homo sapiens
uauauagggagcacuuuaa

SEQ ID NO: 553826 - RNA, 19 nt, Homo sapiens
gaucaacaacugcuacucu

SEQ ID NO: 553827 - RNA, 19 nt, Homo sapiens
ucaaucauuuggaucaaca

SEQ ID NO: 553828 - RNA, 19 nt, Homo sapiens
uaugguguguucagcauug

SEQ ID NO: 553829 - RNA, 19 nt, Homo sapiens
ucagcaacuucuagcauau

SEQ ID NO: 553830 - RNA, 19 nt, Homo sapiens
ggaaaacaguggugauuac

SEQ ID NO: 553831 - RNA, 19 nt, Homo sapiens
gcagaaacuuugugaaauu

SEQ ID NO: 553832 - RNA, 19 nt, Homo sapiens
guagguaucuuuauaguug

SEQ ID NO: 553833 - RNA, 19 nt, Homo sapiens
gagcuaauuucuugagaua

SEQ ID NO: 553834 - RNA, 19 nt, Homo sapiens
gaaagucaauucagugaug

SEQ ID NO: 553835 - RNA, 19 nt, Homo sapiens
ugacuaaaguaccagauua

SEQ ID NO: 553836 - RNA, 19 nt, Homo sapiens
gaaagugagucugaggaua

SEQ ID NO: 553837 - RNA, 19 nt, Homo sapiens
gaaaugccauguuaaagag

SEQ ID NO: 553838 - RNA, 19 nt, Homo sapiens
ucaccaggauuuauacaua

SEQ ID NO: 553839 - RNA, 19 nt, Homo sapiens
gauauuuacuggaaaccua

SEQ ID NO: 553840 - RNA, 19 nt, Homo sapiens
gaucagguguaaauaguga

SEQ ID NO: 553841 - RNA, 19 nt, Homo sapiens
gaaagggugggauuaagua

SEQ ID NO: 553842 - RNA, 19 nt, Homo sapiens
gcaacuaaaugagaccuaa

SEQ ID NO: 553843 - RNA, 19 nt, Homo sapiens
cuagccagcuucacgauua

SEQ ID NO: 553844 - RNA, 19 nt, Homo sapiens
ccagaucacugaauuggaa

SEQ ID NO: 553845 - RNA, 19 nt, Homo sapiens
gaugaagaguuaaaggaaa

SEQ ID NO: 553846 - RNA, 19 nt, Homo sapiens
gaauuugaguuugcuguuu

SEQ ID NO: 553847 - RNA, 19 nt, Homo sapiens
gcuaauuucuugagauaga

SEQ ID NO: 553848 - RNA, 19 nt, Homo sapiens
ggagagaucagguguaaau

SEQ ID NO: 553849 - RNA, 19 nt, Homo sapiens
guagagagguugacaaugc

SEQ ID NO: 553850 - RNA, 19 nt, Homo sapiens
gaaauugagaggauacauu

SEQ ID NO: 553851 - RNA, 19 nt, Homo sapiens
ggaagaagucacaaugaaa

SEQ ID NO: 553852 - RNA, 19 nt, Homo sapiens
gagaucagguguaaauagu

SEQ ID NO: 553853 - RNA, 19 nt, Homo sapiens
gcaagucucuuccuuacag

SEQ ID NO: 553854 - RNA, 19 nt, Homo sapiens
cagcaaagagaauguauuu

SEQ ID NO: 553855 - RNA, 19 nt, Homo sapiens
aauauuagcuugcuuaagg

SEQ ID NO: 553856 - RNA, 19 nt, Homo sapiens
aaccaaauguccugaaauu

SEQ ID NO: 553857 - RNA, 19 nt, Homo sapiens
aaggaaguguccaauauaa

SEQ ID NO: 553858 - RNA, 19 nt, Homo sapiens
gaaaaccgaugaacuuaga

SEQ ID NO: 553859 - RNA, 19 nt, Homo sapiens
gggcagaaacuuugugaaa

SEQ ID NO: 553860 - RNA, 19 nt, Homo sapiens
agagagccauuuacaauug

SEQ ID NO: 553861 - RNA, 19 nt, Homo sapiens
ucugugagguucuugauuu

SEQ ID NO: 553862 - RNA, 19 nt, Homo sapiens
gaggauaguucagaugaug

SEQ ID NO: 553863 - RNA, 19 nt, Homo sapiens
gaacagugaaagucaauuc

SEQ ID NO: 553864 - RNA, 19 nt, Homo sapiens
uuacagagagagccauuua

SEQ ID NO: 553865 - RNA, 19 nt, Homo sapiens
gaaagguaaauacaaguga

SEQ ID NO: 553866 - RNA, 19 nt, Homo sapiens
gaacaguuacccugcuuug

SEQ ID NO: 553867 - RNA, 19 nt, Homo sapiens
uaucuugaguguuauguga

SEQ ID NO: 553868 - RNA, 19 nt, Homo sapiens
cgaaccaaauguccugaaa

SEQ ID NO: 553869 - RNA, 19 nt, Homo sapiens
gaagaaaaccgaugaacuu

SEQ ID NO: 553870 - RNA, 19 nt, Homo sapiens
gagagagccauuuacaauu

SEQ ID NO: 553871 - RNA, 19 nt, Homo sapiens
ucacagguuuguuucuuga

SEQ ID NO: 553872 - RNA, 19 nt, Homo sapiens
uggaagaagucacaaugaa

SEQ ID NO: 553873 - RNA, 19 nt, Homo sapiens
caaauguccugaaauucug

SEQ ID NO: 553874 - RNA, 19 nt, Homo sapiens
gcuucacgauuaugacuaa

SEQ ID NO: 553875 - RNA, 19 nt, Homo sapiens
gcacauuuggcuuacagua

SEQ ID NO: 553876 - RNA, 19 nt, Homo sapiens
cccuacagaugaagaguua

SEQ ID NO: 553877 - RNA, 19 nt, Homo sapiens
gaaggaagaaauguugaaa

SEQ ID NO: 553878 - RNA, 19 nt, Homo sapiens
cgagaaagaacccgaaaug

SEQ ID NO: 553879 - RNA, 19 nt, Homo sapiens
cagaaacuuugugaaauug

SEQ ID NO: 553880 - RNA, 19 nt, Homo sapiens
caaacaguaugauggaaca

SEQ ID NO: 553881 - RNA, 19 nt, Homo sapiens
ggcagaaacuuugugaaau

SEQ ID NO: 553882 - RNA, 19 nt, Homo sapiens
ggaccacuccugaaugaga

SEQ ID NO: 553883 - RNA, 19 nt, Homo sapiens
gaagaagucacaaugaaac

SEQ ID NO: 553884 - RNA, 19 nt, Homo sapiens
gauagcagcaccaccaaga

SEQ ID NO: 553885 - RNA, 19 nt, Homo sapiens
gaagauaaagaaagugaag

SEQ ID NO: 553886 - RNA, 19 nt, Homo sapiens
aaaggaaguguccaauaua

SEQ ID NO: 553887 - RNA, 19 nt, Homo sapiens
gauucuagaugaucaacau

SEQ ID NO: 553888 - RNA, 19 nt, Homo sapiens
ucacauagguagguaucuu

SEQ ID NO: 553889 - RNA, 19 nt, Homo sapiens
gcaaagagaauguauuucc

SEQ ID NO: 553890 - RNA, 19 nt, Homo sapiens
gaagucacaaugaaacaga

SEQ ID NO: 553891 - RNA, 19 nt, Homo sapiens
agaaaugccauguuaaaga

SEQ ID NO: 553892 - RNA, 19 nt, Homo sapiens
acagguuuguuucuugaua

SEQ ID NO: 553893 - RNA, 19 nt, Homo sapiens
gaacuuacugcugaccuuu

SEQ ID NO: 553894 - RNA, 19 nt, Homo sapiens
ccaaauguccugaaauucu

SEQ ID NO: 553895 - RNA, 19 nt, Homo sapiens
aaaaggaaguguccaauau

SEQ ID NO: 553896 - RNA, 19 nt, Homo sapiens
gcacuguguccucauuaaa

SEQ ID NO: 553897 - RNA, 19 nt, Homo sapiens
uacacaaacugcuuuacaa

SEQ ID NO: 553898 - RNA, 19 nt, Homo sapiens
gaaacuuugugaaauugag

SEQ ID NO: 553899 - RNA, 19 nt, Homo sapiens
ggaaagggugggauuaagu

SEQ ID NO: 553900 - RNA, 19 nt, Homo sapiens
gaacuuuucuccugcaugu

SEQ ID NO: 553901 - RNA, 19 nt, Homo sapiens
gaggaucuugaauuucuua

SEQ ID NO: 553902 - RNA, 19 nt, Homo sapiens
aaagaaggaagaaauguug

SEQ ID NO: 553903 - RNA, 19 nt, Homo sapiens
ggaaagguaaauacaagug

SEQ ID NO: 553904 - RNA, 19 nt, Homo sapiens
cuaaauccuuguuaagcaa

SEQ ID NO: 553905 - RNA, 19 nt, Homo sapiens
gagaauguauuuccuuuuc

SEQ ID NO: 553906 - RNA, 19 nt, Homo sapiens
ggccagugcuaacuuggaa

SEQ ID NO: 553907 - RNA, 19 nt, Homo sapiens
agagagagccauuuacaau

SEQ ID NO: 553908 - RNA, 19 nt, Homo sapiens
gauuaugacuaaaguacca

SEQ ID NO: 553909 - RNA, 19 nt, Homo sapiens
caguguguccaucauauua

SEQ ID NO: 553910 - RNA, 19 nt, Homo sapiens
ggcaguguguccaucauau

SEQ ID NO: 553911 - RNA, 19 nt, Homo sapiens
gaaugugggucaguucagu

SEQ ID NO: 553912 - RNA, 19 nt, Homo sapiens
ggcacuguguccucauuaa

SEQ ID NO: 553913 - RNA, 19 nt, Homo sapiens
uuagcuugcuuaaggcaua

SEQ ID NO: 553914 - RNA, 19 nt, Homo sapiens
gaagaucugauuuauacca

SEQ ID NO: 553915 - RNA, 19 nt, Homo sapiens
ugagauagaggacagagaa

SEQ ID NO: 553916 - RNA, 19 nt, Homo sapiens
gaaccaaauguccugaaau

SEQ ID NO: 553917 - RNA, 19 nt, Homo sapiens
ggaaguguccaauauaaaa

SEQ ID NO: 553918 - RNA, 19 nt, Homo sapiens
ccgaugaacuuagaaaucu

SEQ ID NO: 553919 - RNA, 19 nt, Homo sapiens
aaacucacauagguaggua

SEQ ID NO: 553920 - RNA, 19 nt, Homo sapiens
ggauuuauacauacagaga

SEQ ID NO: 553921 - RNA, 19 nt, Homo sapiens
cauagauucuugagcuguu

SEQ ID NO: 553922 - RNA, 19 nt, Homo sapiens
guucaguggcuuuccauuu

SEQ ID NO: 553923 - RNA, 19 nt, Homo sapiens
aaugagaccuaauaauugg

SEQ ID NO: 553924 - RNA, 19 nt, Homo sapiens
guucuggaauggcaaggaa

SEQ ID NO: 553925 - RNA, 19 nt, Homo sapiens
aauauaaugugcaggcaau

SEQ ID NO: 553926 - RNA, 19 nt, Homo sapiens
ucacgauuaugacuaaagu

SEQ ID NO: 553927 - RNA, 19 nt, Homo sapiens
caaugcaagucucuuccuu

SEQ ID NO: 553928 - RNA, 19 nt, Homo sapiens
gggaaagggugggauuaag

SEQ ID NO: 553929 - RNA, 19 nt, Homo sapiens
uggcaacacugaaggaaca

SEQ ID NO: 553930 - RNA, 19 nt, Homo sapiens
caaugaaacagauuugcaa

SEQ ID NO: 553931 - RNA, 19 nt, Homo sapiens
gcagagagcugugugauua

SEQ ID NO: 553932 - RNA, 19 nt, Homo sapiens
uaaaugagcugaaguguaa

SEQ ID NO: 553933 - RNA, 19 nt, Homo sapiens
gcucauggguucauaaauu

SEQ ID NO: 553934 - RNA, 19 nt, Homo sapiens
gaagugccauuucuuuauu

SEQ ID NO: 553935 - RNA, 19 nt, Homo sapiens
gagcugaucugcaucuguu

SEQ ID NO: 553936 - RNA, 19 nt, Homo sapiens
gcgcguagguaauggauuu

SEQ ID NO: 553937 - RNA, 19 nt, Homo sapiens
ggaggcacauggagaaauu

SEQ ID NO: 553938 - RNA, 19 nt, Homo sapiens
gaaugagugugguaagaaa

SEQ ID NO: 553939 - RNA, 19 nt, Homo sapiens
ggagacuuaucuacauaua

SEQ ID NO: 553940 - RNA, 19 nt, Homo sapiens
gagaggaguucauuacuuc

SEQ ID NO: 553941 - RNA, 19 nt, Homo sapiens
ccaaguagguggagacgaa

SEQ ID NO: 553942 - RNA, 19 nt, Homo sapiens
ggcaugagcccuugaauuu

SEQ ID NO: 553943 - RNA, 19 nt, Homo sapiens
ggagaggaguucauuacuu

SEQ ID NO: 553944 - RNA, 19 nt, Homo sapiens
gaaauuagccacguaacaa

SEQ ID NO: 553945 - RNA, 19 nt, Homo sapiens
gggaagcuaugguugagua

SEQ ID NO: 553946 - RNA, 19 nt, Homo sapiens
gccauggcaucuaaauuua

SEQ ID NO: 553947 - RNA, 19 nt, Homo sapiens
gcacuggguuuacagaaug

SEQ ID NO: 553948 - RNA, 19 nt, Homo sapiens
cuacuugucuccuuaaaga

SEQ ID NO: 553949 - RNA, 19 nt, Homo sapiens
ugagaugugugcaggaaua

SEQ ID NO: 553950 - RNA, 19 nt, Homo sapiens
gacaauaaauagcacagaa

SEQ ID NO: 553951 - RNA, 19 nt, Homo sapiens
gagcugaaguguaaagcaa

SEQ ID NO: 553952 - RNA, 19 nt, Homo sapiens
gagcauagccacacccauu

SEQ ID NO: 553953 - RNA, 19 nt, Homo sapiens
gccagagacucauuguaua

SEQ ID NO: 553954 - RNA, 19 nt, Homo sapiens
gaauacaaaugcuccaaca

SEQ ID NO: 553955 - RNA, 19 nt, Homo sapiens
acucagggcccauuaauua

SEQ ID NO: 553956 - RNA, 19 nt, Homo sapiens
gcauuuauccggcauuauu

SEQ ID NO: 553957 - RNA, 19 nt, Homo sapiens
gauuuaacaucccucauug

SEQ ID NO: 553958 - RNA, 19 nt, Homo sapiens
uuaaagagcugaucugcau

SEQ ID NO: 553959 - RNA, 19 nt, Homo sapiens
gaacuucccagcgaugaua

SEQ ID NO: 553960 - RNA, 19 nt, Homo sapiens
gaaauucaucuccuaguga

SEQ ID NO: 553961 - RNA, 19 nt, Homo sapiens
ggccauggcaucuaaauuu

SEQ ID NO: 553962 - RNA, 19 nt, Homo sapiens
ucagguguauacaauguua

SEQ ID NO: 553963 - RNA, 19 nt, Homo sapiens
gagcuaagaaugguuuaua

SEQ ID NO: 553964 - RNA, 19 nt, Homo sapiens
ggaggaggcuauagcaauc

SEQ ID NO: 553965 - RNA, 19 nt, Homo sapiens
gaaagaaugccaaggaagu

SEQ ID NO: 553966 - RNA, 19 nt, Homo sapiens
gaaauaaagaucagaagca

SEQ ID NO: 553967 - RNA, 19 nt, Homo sapiens
guacaugccauccauuauu

SEQ ID NO: 553968 - RNA, 19 nt, Homo sapiens
caacaccuccugugaagaa

SEQ ID NO: 553969 - RNA, 19 nt, Homo sapiens
ggaugaccuugccagaaua

SEQ ID NO: 553970 - RNA, 19 nt, Homo sapiens
gaaggaggcacauggagaa

SEQ ID NO: 553971 - RNA, 19 nt, Homo sapiens
caguuaaugucuucucuuu

SEQ ID NO: 553972 - RNA, 19 nt, Homo sapiens
ugaaugaugccguuucuaa

SEQ ID NO: 553973 - RNA, 19 nt, Homo sapiens
gagcaaaucuguuuuacug

SEQ ID NO: 553974 - RNA, 19 nt, Homo sapiens
uggcagaguugaauaguug

SEQ ID NO: 553975 - RNA, 19 nt, Homo sapiens
guaagccaguagauucuuu

SEQ ID NO: 553976 - RNA, 19 nt, Homo sapiens
gcaggcagaucacgacauc

SEQ ID NO: 553977 - RNA, 19 nt, Homo sapiens
guaaaugagcugaagugua

SEQ ID NO: 553978 - RNA, 19 nt, Homo sapiens
ggauaaaacuugggaauga

SEQ ID NO: 553979 - RNA, 19 nt, Homo sapiens
ugagucuucuugcauauuu

SEQ ID NO: 553980 - RNA, 19 nt, Homo sapiens
gaaggaagagcugaaauuc

SEQ ID NO: 553981 - RNA, 19 nt, Homo sapiens
ggaguguacuagccacauu

SEQ ID NO: 553982 - RNA, 19 nt, Homo sapiens
cagcucaucauucaaauaa

SEQ ID NO: 553983 - RNA, 19 nt, Homo sapiens
gcacagaagacaccgaaug

SEQ ID NO: 553984 - RNA, 19 nt, Homo sapiens
gaagugguacaauuuaaug

SEQ ID NO: 553985 - RNA, 19 nt, Homo sapiens
uacaugccauccauuauuu

SEQ ID NO: 553986 - RNA, 19 nt, Homo sapiens
guuauucccuguucucgaa

SEQ ID NO: 553987 - RNA, 19 nt, Homo sapiens
ccacacccauucauuuaug

SEQ ID NO: 553988 - RNA, 19 nt, Homo sapiens
aaagaaagacuccguaauc

SEQ ID NO: 553989 - RNA, 19 nt, Homo sapiens
gaaagaaagacuccguaau

SEQ ID NO: 553990 - RNA, 19 nt, Homo sapiens
gaaugaugccguuucuaaa

SEQ ID NO: 553991 - RNA, 19 nt, Homo sapiens
gaccugagccugaguaagu

SEQ ID NO: 553992 - RNA, 19 nt, Homo sapiens
agagcugugugauuaauaa

SEQ ID NO: 553993 - RNA, 19 nt, Homo sapiens
gggaaugagugugguaaga

SEQ ID NO: 553994 - RNA, 19 nt, Homo sapiens
ggccagagacucauuguau

SEQ ID NO: 553995 - RNA, 19 nt, Homo sapiens
agacuccacuuacaucuug

SEQ ID NO: 553996 - RNA, 19 nt, Homo sapiens
gaacucaaguauguguguu

SEQ ID NO: 553997 - RNA, 19 nt, Homo sapiens
gcagaaauaaagaucagaa

SEQ ID NO: 553998 - RNA, 19 nt, Homo sapiens
gucccaaauuuaccacuua

SEQ ID NO: 553999 - RNA, 19 nt, Homo sapiens
gugaagugccauuucuuua

SEQ ID NO: 554000 - RNA, 19 nt, Homo sapiens
cggaagugguacaauuuaa

SEQ ID NO: 554001 - RNA, 19 nt, Homo sapiens
aaaggagacuuaucuacau

SEQ ID NO: 554002 - RNA, 19 nt, Homo sapiens
cggccuugcuccauuuaua

SEQ ID NO: 554003 - RNA, 19 nt, Homo sapiens
gcaaaucuguuuuacuguu

SEQ ID NO: 554004 - RNA, 19 nt, Homo sapiens
ucccagcgaugauaaugua

SEQ ID NO: 554005 - RNA, 19 nt, Homo sapiens
gugggaagaaagagaauua

SEQ ID NO: 554006 - RNA, 19 nt, Homo sapiens
gcaagacccugggcacaca

SEQ ID NO: 554007 - RNA, 19 nt, Homo sapiens
gaacucauccaguccuugu

SEQ ID NO: 554008 - RNA, 19 nt, Homo sapiens
ggaaugagugugguaagaa

SEQ ID NO: 554009 - RNA, 19 nt, Homo sapiens
gcuauacuuugugggauaa

SEQ ID NO: 554010 - RNA, 19 nt, Homo sapiens
cagggauucucauuaaaga

SEQ ID NO: 554011 - RNA, 19 nt, Homo sapiens
augcagggauucucauuaa

SEQ ID NO: 554012 - RNA, 19 nt, Homo sapiens
gaccuuacuugcauuuauc

SEQ ID NO: 554013 - RNA, 19 nt, Homo sapiens
uauacaaccugugagcuaa

SEQ ID NO: 554014 - RNA, 19 nt, Homo sapiens
gauuaccgaugcugagaug

SEQ ID NO: 554015 - RNA, 19 nt, Homo sapiens
aaggagacuuaucuacaua

SEQ ID NO: 554016 - RNA, 19 nt, Homo sapiens
ccaaguauggcauugauga

SEQ ID NO: 554017 - RNA, 19 nt, Homo sapiens
agaauuuccucucccugua

SEQ ID NO: 554018 - RNA, 19 nt, Homo sapiens
gcgaugauaauguacauga

SEQ ID NO: 554019 - RNA, 19 nt, Homo sapiens
ugaccuuacuugcauuuau

SEQ ID NO: 554020 - RNA, 19 nt, Homo sapiens
caacccacuuuguagaaga

SEQ ID NO: 554021 - RNA, 19 nt, Homo sapiens
guaauugccaacccacuuu

SEQ ID NO: 554022 - RNA, 19 nt, Homo sapiens
uuucauuucuguccuguuu

SEQ ID NO: 554023 - RNA, 19 nt, Homo sapiens
gcacucaugaagagacuuu

SEQ ID NO: 554024 - RNA, 19 nt, Homo sapiens
gggaagaaagagaauuauu

SEQ ID NO: 554025 - RNA, 19 nt, Homo sapiens
cuacauauauagguacaug

SEQ ID NO: 554026 - RNA, 19 nt, Homo sapiens
gauguuggguuagcagguu

SEQ ID NO: 554027 - RNA, 19 nt, Homo sapiens
gagucuauuugccuugaaa

SEQ ID NO: 554028 - RNA, 19 nt, Homo sapiens
ggaagugguacaauuuaau

SEQ ID NO: 554029 - RNA, 19 nt, Homo sapiens
ucaaaugauugggcagaaa

SEQ ID NO: 554030 - RNA, 19 nt, Homo sapiens
gcugagaugugugcaggaa

SEQ ID NO: 554031 - RNA, 19 nt, Homo sapiens
gcagagagcugugugauua

SEQ ID NO: 554032 - RNA, 19 nt, Homo sapiens
uaaaugagcugaaguguaa

SEQ ID NO: 554033 - RNA, 19 nt, Homo sapiens
gcucauggguucauaaauu

SEQ ID NO: 554034 - RNA, 19 nt, Homo sapiens
gaagugccauuucuuuauu

SEQ ID NO: 554035 - RNA, 19 nt, Homo sapiens
gagcugaucugcaucuguu

SEQ ID NO: 554036 - RNA, 19 nt, Homo sapiens
gcgcguagguaauggauuu

SEQ ID NO: 554037 - RNA, 19 nt, Homo sapiens
ggaggcacauggagaaauu

SEQ ID NO: 554038 - RNA, 19 nt, Homo sapiens
gaaugagugugguaagaaa

SEQ ID NO: 554039 - RNA, 19 nt, Homo sapiens
ggagacuuaucuacauaua

SEQ ID NO: 554040 - RNA, 19 nt, Homo sapiens
gagaggaguucauuacuuc

SEQ ID NO: 554041 - RNA, 19 nt, Homo sapiens
ccaaguagguggagacgaa

SEQ ID NO: 554042 - RNA, 19 nt, Homo sapiens
ggcaugagcccuugaauuu

SEQ ID NO: 554043 - RNA, 19 nt, Homo sapiens
ggagaggaguucauuacuu

SEQ ID NO: 554044 - RNA, 19 nt, Homo sapiens
gaaauuagccacguaacaa

SEQ ID NO: 554045 - RNA, 19 nt, Homo sapiens
gggaagcuaugguugagua

SEQ ID NO: 554046 - RNA, 19 nt, Homo sapiens
gccauggcaucuaaauuua

SEQ ID NO: 554047 - RNA, 19 nt, Homo sapiens
gcacuggguuuacagaaug

SEQ ID NO: 554048 - RNA, 19 nt, Homo sapiens
cuacuugucuccuuaaaga

SEQ ID NO: 554049 - RNA, 19 nt, Homo sapiens
ugagaugugugcaggaaua

SEQ ID NO: 554050 - RNA, 19 nt, Homo sapiens
gacaauaaauagcacagaa

SEQ ID NO: 554051 - RNA, 19 nt, Homo sapiens
gagcugaaguguaaagcaa

SEQ ID NO: 554052 - RNA, 19 nt, Homo sapiens
gagcauagccacacccauu

SEQ ID NO: 554053 - RNA, 19 nt, Homo sapiens
gccagagacucauuguaua

SEQ ID NO: 554054 - RNA, 19 nt, Homo sapiens
gaauacaaaugcuccaaca

SEQ ID NO: 554055 - RNA, 19 nt, Homo sapiens
acucagggcccauuaauua

SEQ ID NO: 554056 - RNA, 19 nt, Homo sapiens
gcauuuauccggcauuauu

SEQ ID NO: 554057 - RNA, 19 nt, Homo sapiens
gauuuaacaucccucauug

SEQ ID NO: 554058 - RNA, 19 nt, Homo sapiens
uuaaagagcugaucugcau

SEQ ID NO: 554059 - RNA, 19 nt, Homo sapiens
gaacuucccagcgaugaua

SEQ ID NO: 554060 - RNA, 19 nt, Homo sapiens
gaaauucaucuccuaguga

SEQ ID NO: 554061 - RNA, 19 nt, Homo sapiens
ggccauggcaucuaaauuu

SEQ ID NO: 554062 - RNA, 19 nt, Homo sapiens
ucagguguauacaauguua

SEQ ID NO: 554063 - RNA, 19 nt, Homo sapiens
gagcuaagaaugguuuaua

SEQ ID NO: 554064 - RNA, 19 nt, Homo sapiens
ggaggaggcuauagcaauc

SEQ ID NO: 554065 - RNA, 19 nt, Homo sapiens
gaaagaaugccaaggaagu

SEQ ID NO: 554066 - RNA, 19 nt, Homo sapiens
gaaauaaagaucagaagca

SEQ ID NO: 554067 - RNA, 19 nt, Homo sapiens
guacaugccauccauuauu

SEQ ID NO: 554068 - RNA, 19 nt, Homo sapiens
caacaccuccugugaagaa

SEQ ID NO: 554069 - RNA, 19 nt, Homo sapiens
ggaugaccuugccagaaua

SEQ ID NO: 554070 - RNA, 19 nt, Homo sapiens
gaaggaggcacauggagaa

SEQ ID NO: 554071 - RNA, 19 nt, Homo sapiens
caguuaaugucuucucuuu

SEQ ID NO: 554072 - RNA, 19 nt, Homo sapiens
ugaaugaugccguuucuaa

SEQ ID NO: 554073 - RNA, 19 nt, Homo sapiens
gagcaaaucuguuuuacug

SEQ ID NO: 554074 - RNA, 19 nt, Homo sapiens
uggcagaguugaauaguug

SEQ ID NO: 554075 - RNA, 19 nt, Homo sapiens
guaagccaguagauucuuu

SEQ ID NO: 554076 - RNA, 19 nt, Homo sapiens
gcaggcagaucacgacauc

SEQ ID NO: 554077 - RNA, 19 nt, Homo sapiens
guaaaugagcugaagugua

SEQ ID NO: 554078 - RNA, 19 nt, Homo sapiens
ggauaaaacuugggaauga

SEQ ID NO: 554079 - RNA, 19 nt, Homo sapiens
ugagucuucuugcauauuu

SEQ ID NO: 554080 - RNA, 19 nt, Homo sapiens
gaaggaagagcugaaauuc

SEQ ID NO: 554081 - RNA, 19 nt, Homo sapiens
ggaguguacuagccacauu

SEQ ID NO: 554082 - RNA, 19 nt, Homo sapiens
cagcucaucauucaaauaa

SEQ ID NO: 554083 - RNA, 19 nt, Homo sapiens
gcacagaagacaccgaaug

SEQ ID NO: 554084 - RNA, 19 nt, Homo sapiens
gaagugguacaauuuaaug

SEQ ID NO: 554085 - RNA, 19 nt, Homo sapiens
uacaugccauccauuauuu

SEQ ID NO: 554086 - RNA, 19 nt, Homo sapiens
guuauucccuguucucgaa

SEQ ID NO: 554087 - RNA, 19 nt, Homo sapiens
ccacacccauucauuuaug

SEQ ID NO: 554088 - RNA, 19 nt, Homo sapiens
aaagaaagacuccguaauc

SEQ ID NO: 554089 - RNA, 19 nt, Homo sapiens
gaaagaaagacuccguaau

SEQ ID NO: 554090 - RNA, 19 nt, Homo sapiens
gaaugaugccguuucuaaa

SEQ ID NO: 554091 - RNA, 19 nt, Homo sapiens
gaccugagccugaguaagu

SEQ ID NO: 554092 - RNA, 19 nt, Homo sapiens
agagcugugugauuaauaa

SEQ ID NO: 554093 - RNA, 19 nt, Homo sapiens
gggaaugagugugguaaga

SEQ ID NO: 554094 - RNA, 19 nt, Homo sapiens
ggccagagacucauuguau

SEQ ID NO: 554095 - RNA, 19 nt, Homo sapiens
agacuccacuuacaucuug

SEQ ID NO: 554096 - RNA, 19 nt, Homo sapiens
gaacucaaguauguguguu

SEQ ID NO: 554097 - RNA, 19 nt, Homo sapiens
gcagaaauaaagaucagaa

SEQ ID NO: 554098 - RNA, 19 nt, Homo sapiens
gucccaaauuuaccacuua

SEQ ID NO: 554099 - RNA, 19 nt, Homo sapiens
ugauuuggauccauuguug

SEQ ID NO: 554100 - RNA, 19 nt, Homo sapiens
gugaagugccauuucuuua

SEQ ID NO: 554101 - RNA, 19 nt, Homo sapiens
cggaagugguacaauuuaa

SEQ ID NO: 554102 - RNA, 19 nt, Homo sapiens
aaaggagacuuaucuacau

SEQ ID NO: 554103 - RNA, 19 nt, Homo sapiens
cggccuugcuccauuuaua

SEQ ID NO: 554104 - RNA, 19 nt, Homo sapiens
gcaaaucuguuuuacuguu

SEQ ID NO: 554105 - RNA, 19 nt, Homo sapiens
ucccagcgaugauaaugua

SEQ ID NO: 554106 - RNA, 19 nt, Homo sapiens
gugggaagaaagagaauua

SEQ ID NO: 554107 - RNA, 19 nt, Homo sapiens
gcaagacccugggcacaca

SEQ ID NO: 554108 - RNA, 19 nt, Homo sapiens
gaacucauccaguccuugu

SEQ ID NO: 554109 - RNA, 19 nt, Homo sapiens
ggaaugagugugguaagaa

SEQ ID NO: 554110 - RNA, 19 nt, Homo sapiens
gcuauacuuugugggauaa

SEQ ID NO: 554111 - RNA, 19 nt, Homo sapiens
cagggauucucauuaaaga

SEQ ID NO: 554112 - RNA, 19 nt, Homo sapiens
augcagggauucucauuaa

SEQ ID NO: 554113 - RNA, 19 nt, Homo sapiens
gaccuuacuugcauuuauc

SEQ ID NO: 554114 - RNA, 19 nt, Homo sapiens
uauacaaccugugagcuaa

SEQ ID NO: 554115 - RNA, 19 nt, Homo sapiens
gauuaccgaugcugagaug

SEQ ID NO: 554116 - RNA, 19 nt, Homo sapiens
aaggagacuuaucuacaua

SEQ ID NO: 554117 - RNA, 19 nt, Homo sapiens
ccaaguauggcauugauga

SEQ ID NO: 554118 - RNA, 19 nt, Homo sapiens
agaauuuccucucccugua

SEQ ID NO: 554119 - RNA, 19 nt, Homo sapiens
gcgaugauaauguacauga

SEQ ID NO: 554120 - RNA, 19 nt, Homo sapiens
ugaccuuacuugcauuuau

SEQ ID NO: 554121 - RNA, 19 nt, Homo sapiens
caacccacuuuguagaaga

SEQ ID NO: 554122 - RNA, 19 nt, Homo sapiens
guaauugccaacccacuuu

SEQ ID NO: 554123 - RNA, 19 nt, Homo sapiens
uuucauuucuguccuguuu

SEQ ID NO: 554124 - RNA, 19 nt, Homo sapiens
gcacucaugaagagacuuu

SEQ ID NO: 554125 - RNA, 19 nt, Homo sapiens
gggaagaaagagaauuauu

SEQ ID NO: 554126 - RNA, 19 nt, Homo sapiens
cuacauauauagguacaug

SEQ ID NO: 554127 - RNA, 19 nt, Homo sapiens
gauguuggguuagcagguu

SEQ ID NO: 554128 - RNA, 19 nt, Homo sapiens
gagucuauuugccuugaaa

SEQ ID NO: 554129 - RNA, 19 nt, Homo sapiens
ggaagugguacaauuuaau

SEQ ID NO: 554130 - RNA, 19 nt, Homo sapiens
ucaaaugauugggcagaaa

SEQ ID NO: 554131 - RNA, 19 nt, Homo sapiens
ggacaaggcugccaaggaa

SEQ ID NO: 554132 - RNA, 19 nt, Homo sapiens
caaagaggauaaucucaaa

SEQ ID NO: 554133 - RNA, 19 nt, Homo sapiens
gagcgagacuccuccagua

SEQ ID NO: 554134 - RNA, 19 nt, Homo sapiens
gaaaggauggaaagaagua

SEQ ID NO: 554135 - RNA, 19 nt, Homo sapiens
uaaagccguuccaggauua

SEQ ID NO: 554136 - RNA, 19 nt, Homo sapiens
ugacaaggacucagacuua

SEQ ID NO: 554137 - RNA, 19 nt, Homo sapiens
aaacggagcuucucaaguc

SEQ ID NO: 554138 - RNA, 19 nt, Homo sapiens
ggaugaugauuccuccuua

SEQ ID NO: 554139 - RNA, 19 nt, Homo sapiens
gagcgaggguucagaguau

SEQ ID NO: 554140 - RNA, 19 nt, Homo sapiens
ucaugcaccugcuauguua

SEQ ID NO: 554141 - RNA, 19 nt, Homo sapiens
cacccuaucuggccaguua

SEQ ID NO: 554142 - RNA, 19 nt, Homo sapiens
gaaagcagucgucaucuga

SEQ ID NO: 554143 - RNA, 19 nt, Homo sapiens
cgagaacacuccuuugguu

SEQ ID NO: 554144 - RNA, 19 nt, Homo sapiens
acagaacgaucacagcaua

SEQ ID NO: 554145 - RNA, 19 nt, Homo sapiens
gagguugacuacacugaaa

SEQ ID NO: 554146 - RNA, 19 nt, Homo sapiens
ccaaauaucagaagucguu

SEQ ID NO: 554147 - RNA, 19 nt, Homo sapiens
ugaaugcuguuccuuguga

SEQ ID NO: 554148 - RNA, 19 nt, Homo sapiens
ucauagcucuggauucuug

SEQ ID NO: 554149 - RNA, 19 nt, Homo sapiens
ggucgucccucuauucuca

SEQ ID NO: 554150 - RNA, 19 nt, Homo sapiens
gggaaaggauggaaagaag

SEQ ID NO: 554151 - RNA, 19 nt, Homo sapiens
gagccaaggauuugaguaa

SEQ ID NO: 554152 - RNA, 19 nt, Homo sapiens
gaacucagaccaagccaau

SEQ ID NO: 554153 - RNA, 19 nt, Homo sapiens
gcccugcgcuggauaccua

SEQ ID NO: 554154 - RNA, 19 nt, Homo sapiens
gggcugggccuauaaagaa

SEQ ID NO: 554155 - RNA, 19 nt, Homo sapiens
gacccaacauacucaauga

SEQ ID NO: 554156 - RNA, 19 nt, Homo sapiens
ggaaugaugccgccuuuca

SEQ ID NO: 554157 - RNA, 19 nt, Homo sapiens
ggacuauucguaugaaaga

SEQ ID NO: 554158 - RNA, 19 nt, Homo sapiens
gaugauuccuccuuaugug

SEQ ID NO: 554159 - RNA, 19 nt, Homo sapiens
aggauaaucucaaagaguu

SEQ ID NO: 554160 - RNA, 19 nt, Homo sapiens
gggcuuguauauagauuau

SEQ ID NO: 554161 - RNA, 19 nt, Homo sapiens
ccacuagccgaaagaguua

SEQ ID NO: 554162 - RNA, 19 nt, Homo sapiens
gaaguggccaagauacaaa

SEQ ID NO: 554163 - RNA, 19 nt, Homo sapiens
gaugaugauuccuccuuau

SEQ ID NO: 554164 - RNA, 19 nt, Homo sapiens
cuaaagccguuccaggauu

SEQ ID NO: 554165 - RNA, 19 nt, Homo sapiens
gggcucagcagcaggauaa

SEQ ID NO: 554166 - RNA, 19 nt, Homo sapiens
gaaccgcccacuccuaaga

SEQ ID NO: 554167 - RNA, 19 nt, Homo sapiens
gcgaaccgcccacuccuaa

SEQ ID NO: 554168 - RNA, 19 nt, Homo sapiens
gguaggagacagcuugaaa

SEQ ID NO: 554169 - RNA, 19 nt, Homo sapiens
ggagcgaggguucagagua

SEQ ID NO: 554170 - RNA, 19 nt, Homo sapiens
ggagggacuauucguauga

SEQ ID NO: 554171 - RNA, 19 nt, Homo sapiens
cacccucacugcacccuua

SEQ ID NO: 554172 - RNA, 19 nt, Homo sapiens
ccucauagcucuggauucu

SEQ ID NO: 554173 - RNA, 19 nt, Homo sapiens
aaccacaacugcccucaaa

SEQ ID NO: 554174 - RNA, 19 nt, Homo sapiens
caaccuguuugauacguau

SEQ ID NO: 554175 - RNA, 19 nt, Homo sapiens
caauggagguagcaaugug

SEQ ID NO: 554176 - RNA, 19 nt, Homo sapiens
gugaugaaguggccaagau

SEQ ID NO: 554177 - RNA, 19 nt, Homo sapiens
cgaaagcagucgucaucug

SEQ ID NO: 554178 - RNA, 19 nt, Homo sapiens
gaugccgccuuucauguau

SEQ ID NO: 554179 - RNA, 19 nt, Homo sapiens
ccagagagccaaggauuug

SEQ ID NO: 554180 - RNA, 19 nt, Homo sapiens
agacuuacgccuaguggua

SEQ ID NO: 554181 - RNA, 19 nt, Homo sapiens
caagucuccugaucuguca

SEQ ID NO: 554182 - RNA, 19 nt, Homo sapiens
gagcagucgucguggaauc

SEQ ID NO: 554183 - RNA, 19 nt, Homo sapiens
gcagagagagucgcacaga

SEQ ID NO: 554184 - RNA, 19 nt, Homo sapiens
gcaucccucuggccuaguu

SEQ ID NO: 554185 - RNA, 19 nt, Homo sapiens
ggacccaacauacucaaug

SEQ ID NO: 554186 - RNA, 19 nt, Homo sapiens
ucaaagaggauaaucucaa

SEQ ID NO: 554187 - RNA, 19 nt, Homo sapiens
gagcuaacagcaucaguca

SEQ ID NO: 554188 - RNA, 19 nt, Homo sapiens
gggcaaguccuuagagauc

SEQ ID NO: 554189 - RNA, 19 nt, Homo sapiens
ggccaguuauccaggcuuu

SEQ ID NO: 554190 - RNA, 19 nt, Homo sapiens
cuacagagcuggggaaguu

SEQ ID NO: 554191 - RNA, 19 nt, Homo sapiens
caggcagaguccagagaua

SEQ ID NO: 554192 - RNA, 19 nt, Homo sapiens
gagggacuauucguaugaa

SEQ ID NO: 554193 - RNA, 19 nt, Homo sapiens
gaacaggaugggcaagcaa

SEQ ID NO: 554194 - RNA, 19 nt, Homo sapiens
ggaacaggaugggcaagca

SEQ ID NO: 554195 - RNA, 19 nt, Homo sapiens
ccugaaagccgagaacaaa

SEQ ID NO: 554196 - RNA, 19 nt, Homo sapiens
gaaagcagagaaggagcua

SEQ ID NO: 554197 - RNA, 19 nt, Homo sapiens
gccacuagccgaaagaguu

SEQ ID NO: 554198 - RNA, 19 nt, Homo sapiens
ccagacccacucaagauaa

SEQ ID NO: 554199 - RNA, 19 nt, Homo sapiens
guucagcgaugaggaagau

SEQ ID NO: 554200 - RNA, 19 nt, Homo sapiens
ucacaucuggaaccguuua

SEQ ID NO: 554201 - RNA, 19 nt, Homo sapiens
caacccugcuggcauccaa

SEQ ID NO: 554202 - RNA, 19 nt, Homo sapiens
gccgggaauuccgcaguua

SEQ ID NO: 554203 - RNA, 19 nt, Homo sapiens
gccagacccacucaagaua

SEQ ID NO: 554204 - RNA, 19 nt, Homo sapiens
caccugcagucccuaaaga

SEQ ID NO: 554205 - RNA, 19 nt, Homo sapiens
guaaaguccugggcacaag

SEQ ID NO: 554206 - RNA, 19 nt, Homo sapiens
gacaaggacucagacuuac

SEQ ID NO: 554207 - RNA, 19 nt, Homo sapiens
ggaaugggagacugcauca

SEQ ID NO: 554208 - RNA, 19 nt, Homo sapiens
gcaaugugggcauggaaga

SEQ ID NO: 554209 - RNA, 19 nt, Homo sapiens
gaggauaaucucaaagagu

SEQ ID NO: 554210 - RNA, 19 nt, Homo sapiens
gcgagacccaugagaguga

SEQ ID NO: 554211 - RNA, 19 nt, Homo sapiens
gcgacucgaugaaaaguuu

SEQ ID NO: 554212 - RNA, 19 nt, Homo sapiens
caaguucagcgaugaggaa

SEQ ID NO: 554213 - RNA, 19 nt, Homo sapiens
gcgccuguauccugagguu

SEQ ID NO: 554214 - RNA, 19 nt, Homo sapiens
caacagcggccucaguucu

SEQ ID NO: 554215 - RNA, 19 nt, Homo sapiens
ggaaaggauggaaagaagu

SEQ ID NO: 554216 - RNA, 19 nt, Homo sapiens
guccuucucuggccucaau

SEQ ID NO: 554217 - RNA, 19 nt, Homo sapiens
ccugaaugcuguuccuugu

SEQ ID NO: 554218 - RNA, 19 nt, Homo sapiens
ugucaaaccagaacucaga

SEQ ID NO: 554219 - RNA, 19 nt, Homo sapiens
ggaggcagcaauggaggua

SEQ ID NO: 554220 - RNA, 19 nt, Homo sapiens
gaguggguccuaccucuug

SEQ ID NO: 554221 - RNA, 19 nt, Homo sapiens
ccacaaugcaagcuacaga

SEQ ID NO: 554222 - RNA, 19 nt, Homo sapiens
agaccaagccaaugaggaa

SEQ ID NO: 554223 - RNA, 19 nt, Homo sapiens
gcugagggccacagggauu

SEQ ID NO: 554224 - RNA, 19 nt, Homo sapiens
ucaguuggaucaggagaau

SEQ ID NO: 554225 - RNA, 19 nt, Homo sapiens
caagccuacugucacgauu

SEQ ID NO: 554226 - RNA, 19 nt, Homo sapiens
gcacauggagaugguggaa

SEQ ID NO: 554227 - RNA, 19 nt, Homo sapiens
gcuaacagcaucagucacu

SEQ ID NO: 554228 - RNA, 19 nt, Homo sapiens
gccaaggauuugaguaaac

SEQ ID NO: 554229 - RNA, 19 nt, Homo sapiens
gccagagagccaaggauuu

SEQ ID NO: 554230 - RNA, 19 nt, Homo sapiens
caggauaaaccgccucguu

SEQ ID NO: 554231 - RNA, 19 nt, Homo sapiens
ggacaaggcugccaaggaa

SEQ ID NO: 554232 - RNA, 19 nt, Homo sapiens
caaagaggauaaucucaaa

SEQ ID NO: 554233 - RNA, 19 nt, Homo sapiens
gagcgagacuccuccagua

SEQ ID NO: 554234 - RNA, 19 nt, Homo sapiens
gaaaggauggaaagaagua

SEQ ID NO: 554235 - RNA, 19 nt, Homo sapiens
uaaagccguuccaggauua

SEQ ID NO: 554236 - RNA, 19 nt, Homo sapiens
ugacaaggacucagacuua

SEQ ID NO: 554237 - RNA, 19 nt, Homo sapiens
aaacggagcuucucaaguc

SEQ ID NO: 554238 - RNA, 19 nt, Homo sapiens
ggaugaugauuccuccuua

SEQ ID NO: 554239 - RNA, 19 nt, Homo sapiens
gagcgaggguucagaguau

SEQ ID NO: 554240 - RNA, 19 nt, Homo sapiens
ucaugcaccugcuauguua

SEQ ID NO: 554241 - RNA, 19 nt, Homo sapiens
cacccuaucuggccaguua

SEQ ID NO: 554242 - RNA, 19 nt, Homo sapiens
gaaagcagucgucaucuga

SEQ ID NO: 554243 - RNA, 19 nt, Homo sapiens
cgagaacacuccuuugguu

SEQ ID NO: 554244 - RNA, 19 nt, Homo sapiens
acagaacgaucacagcaua

SEQ ID NO: 554245 - RNA, 19 nt, Homo sapiens
gagguugacuacacugaaa

SEQ ID NO: 554246 - RNA, 19 nt, Homo sapiens
ccaaauaucagaagucguu

SEQ ID NO: 554247 - RNA, 19 nt, Homo sapiens
ugaaugcuguuccuuguga

SEQ ID NO: 554248 - RNA, 19 nt, Homo sapiens
ucauagcucuggauucuug

SEQ ID NO: 554249 - RNA, 19 nt, Homo sapiens
ggucgucccucuauucuca

SEQ ID NO: 554250 - RNA, 19 nt, Homo sapiens
gggaaaggauggaaagaag

SEQ ID NO: 554251 - RNA, 19 nt, Homo sapiens
gagccaaggauuugaguaa

SEQ ID NO: 554252 - RNA, 19 nt, Homo sapiens
gaacucagaccaagccaau

SEQ ID NO: 554253 - RNA, 19 nt, Homo sapiens
gcccugcgcuggauaccua

SEQ ID NO: 554254 - RNA, 19 nt, Homo sapiens
gggcugggccuauaaagaa

SEQ ID NO: 554255 - RNA, 19 nt, Homo sapiens
gacccaacauacucaauga

SEQ ID NO: 554256 - RNA, 19 nt, Homo sapiens
ggaaugaugccgccuuuca

SEQ ID NO: 554257 - RNA, 19 nt, Homo sapiens
ggacuauucguaugaaaga

SEQ ID NO: 554258 - RNA, 19 nt, Homo sapiens
gaugauuccuccuuaugug

SEQ ID NO: 554259 - RNA, 19 nt, Homo sapiens
aggauaaucucaaagaguu

SEQ ID NO: 554260 - RNA, 19 nt, Homo sapiens
gggcuuguauauagauuau

SEQ ID NO: 554261 - RNA, 19 nt, Homo sapiens
ccacuagccgaaagaguua

SEQ ID NO: 554262 - RNA, 19 nt, Homo sapiens
gaaguggccaagauacaaa

SEQ ID NO: 554263 - RNA, 19 nt, Homo sapiens
gaugaugauuccuccuuau

SEQ ID NO: 554264 - RNA, 19 nt, Homo sapiens
cuaaagccguuccaggauu

SEQ ID NO: 554265 - RNA, 19 nt, Homo sapiens
gggcucagcagcaggauaa

SEQ ID NO: 554266 - RNA, 19 nt, Homo sapiens
gaaccgcccacuccuaaga

SEQ ID NO: 554267 - RNA, 19 nt, Homo sapiens
gcgaaccgcccacuccuaa

SEQ ID NO: 554268 - RNA, 19 nt, Homo sapiens
gguaggagacagcuugaaa

SEQ ID NO: 554269 - RNA, 19 nt, Homo sapiens
ggagcgaggguucagagua

SEQ ID NO: 554270 - RNA, 19 nt, Homo sapiens
ggagggacuauucguauga

SEQ ID NO: 554271 - RNA, 19 nt, Homo sapiens
cacccucacugcacccuua

SEQ ID NO: 554272 - RNA, 19 nt, Homo sapiens
ccucauagcucuggauucu

SEQ ID NO: 554273 - RNA, 19 nt, Homo sapiens
aaccacaacugcccucaaa

SEQ ID NO: 554274 - RNA, 19 nt, Homo sapiens
caaccuguuugauacguau

SEQ ID NO: 554275 - RNA, 19 nt, Homo sapiens
caauggagguagcaaugug

SEQ ID NO: 554276 - RNA, 19 nt, Homo sapiens
gugaugaaguggccaagau

SEQ ID NO: 554277 - RNA, 19 nt, Homo sapiens
cgaaagcagucgucaucug

SEQ ID NO: 554278 - RNA, 19 nt, Homo sapiens
gaugccgccuuucauguau

SEQ ID NO: 554279 - RNA, 19 nt, Homo sapiens
ccagagagccaaggauuug

SEQ ID NO: 554280 - RNA, 19 nt, Homo sapiens
agacuuacgccuaguggua

SEQ ID NO: 554281 - RNA, 19 nt, Homo sapiens
caagucuccugaucuguca

SEQ ID NO: 554282 - RNA, 19 nt, Homo sapiens
gagcagucgucguggaauc

SEQ ID NO: 554283 - RNA, 19 nt, Homo sapiens
gcagagagagucgcacaga

SEQ ID NO: 554284 - RNA, 19 nt, Homo sapiens
gcaucccucuggccuaguu

SEQ ID NO: 554285 - RNA, 19 nt, Homo sapiens
ggacccaacauacucaaug

SEQ ID NO: 554286 - RNA, 19 nt, Homo sapiens
ucaaagaggauaaucucaa

SEQ ID NO: 554287 - RNA, 19 nt, Homo sapiens
gagcuaacagcaucaguca

SEQ ID NO: 554288 - RNA, 19 nt, Homo sapiens
gggcaaguccuuagagauc

SEQ ID NO: 554289 - RNA, 19 nt, Homo sapiens
ggccaguuauccaggcuuu

SEQ ID NO: 554290 - RNA, 19 nt, Homo sapiens
cuacagagcuggggaaguu

SEQ ID NO: 554291 - RNA, 19 nt, Homo sapiens
caggcagaguccagagaua

SEQ ID NO: 554292 - RNA, 19 nt, Homo sapiens
gagggacuauucguaugaa

SEQ ID NO: 554293 - RNA, 19 nt, Homo sapiens
gaacaggaugggcaagcaa

SEQ ID NO: 554294 - RNA, 19 nt, Homo sapiens
ggaacaggaugggcaagca

SEQ ID NO: 554295 - RNA, 19 nt, Homo sapiens
ccugaaagccgagaacaaa

SEQ ID NO: 554296 - RNA, 19 nt, Homo sapiens
gaaagcagagaaggagcua

SEQ ID NO: 554297 - RNA, 19 nt, Homo sapiens
gccacuagccgaaagaguu

SEQ ID NO: 554298 - RNA, 19 nt, Homo sapiens
ccagacccacucaagauaa

SEQ ID NO: 554299 - RNA, 19 nt, Homo sapiens
guucagcgaugaggaagau

SEQ ID NO: 554300 - RNA, 19 nt, Homo sapiens
ucacaucuggaaccguuua

SEQ ID NO: 554301 - RNA, 19 nt, Homo sapiens
caacccugcuggcauccaa

SEQ ID NO: 554302 - RNA, 19 nt, Homo sapiens
gccgggaauuccgcaguua

SEQ ID NO: 554303 - RNA, 19 nt, Homo sapiens
gccagacccacucaagaua

SEQ ID NO: 554304 - RNA, 19 nt, Homo sapiens
caccugcagucccuaaaga

SEQ ID NO: 554305 - RNA, 19 nt, Homo sapiens
guaaaguccugggcacaag

SEQ ID NO: 554306 - RNA, 19 nt, Homo sapiens
gacaaggacucagacuuac

SEQ ID NO: 554307 - RNA, 19 nt, Homo sapiens
ggaaugggagacugcauca

SEQ ID NO: 554308 - RNA, 19 nt, Homo sapiens
gcaaugugggcauggaaga

SEQ ID NO: 554309 - RNA, 19 nt, Homo sapiens
gaggauaaucucaaagagu

SEQ ID NO: 554310 - RNA, 19 nt, Homo sapiens
gcgagacccaugagaguga

SEQ ID NO: 554311 - RNA, 19 nt, Homo sapiens
gcgacucgaugaaaaguuu

SEQ ID NO: 554312 - RNA, 19 nt, Homo sapiens
caaguucagcgaugaggaa

SEQ ID NO: 554313 - RNA, 19 nt, Homo sapiens
gcgccuguauccugagguu

SEQ ID NO: 554314 - RNA, 19 nt, Homo sapiens
caacagcggccucaguucu

SEQ ID NO: 554315 - RNA, 19 nt, Homo sapiens
ggaaaggauggaaagaagu

SEQ ID NO: 554316 - RNA, 19 nt, Homo sapiens
guccuucucuggccucaau

SEQ ID NO: 554317 - RNA, 19 nt, Homo sapiens
ccugaaugcuguuccuugu

SEQ ID NO: 554318 - RNA, 19 nt, Homo sapiens
ugucaaaccagaacucaga

SEQ ID NO: 554319 - RNA, 19 nt, Homo sapiens
ggaggcagcaauggaggua

SEQ ID NO: 554320 - RNA, 19 nt, Homo sapiens
gaguggguccuaccucuug

SEQ ID NO: 554321 - RNA, 19 nt, Homo sapiens
ccacaaugcaagcuacaga

SEQ ID NO: 554322 - RNA, 19 nt, Homo sapiens
agaccaagccaaugaggaa

SEQ ID NO: 554323 - RNA, 19 nt, Homo sapiens
gcugagggccacagggauu

SEQ ID NO: 554324 - RNA, 19 nt, Homo sapiens
ucaguuggaucaggagaau

SEQ ID NO: 554325 - RNA, 19 nt, Homo sapiens
caagccuacugucacgauu

SEQ ID NO: 554326 - RNA, 19 nt, Homo sapiens
gcacauggagaugguggaa

SEQ ID NO: 554327 - RNA, 19 nt, Homo sapiens
gcuaacagcaucagucacu

SEQ ID NO: 554328 - RNA, 19 nt, Homo sapiens
gccaaggauuugaguaaac

SEQ ID NO: 554329 - RNA, 19 nt, Homo sapiens
gccagagagccaaggauuu

SEQ ID NO: 554330 - RNA, 19 nt, Homo sapiens
caggauaaaccgccucguu

SEQ ID NO: 554331 - RNA, 19 nt, Homo sapiens
ggacaaaccuggaauuucu

SEQ ID NO: 554332 - RNA, 19 nt, Homo sapiens
auaagaagcuucaggaaua

SEQ ID NO: 554333 - RNA, 19 nt, Homo sapiens
caacagcuaugucaugguu

SEQ ID NO: 554334 - RNA, 19 nt, Homo sapiens
cagaaugggucccuauuau

SEQ ID NO: 554335 - RNA, 19 nt, Homo sapiens
caagagcaguuuaauagca

SEQ ID NO: 554336 - RNA, 19 nt, Homo sapiens
gcaggcagccauucccaua

SEQ ID NO: 554337 - RNA, 19 nt, Homo sapiens
guuggaaccuucaaucuuc

SEQ ID NO: 554338 - RNA, 19 nt, Homo sapiens
gacgaguucugcaagauga

SEQ ID NO: 554339 - RNA, 19 nt, Homo sapiens
cagcagcuccggucugaua

SEQ ID NO: 554340 - RNA, 19 nt, Homo sapiens
ccagaaugggucccuauua

SEQ ID NO: 554341 - RNA, 19 nt, Homo sapiens
gauaagaagcuucaggaau

SEQ ID NO: 554342 - RNA, 19 nt, Homo sapiens
cagaaccaguugaaaguga

SEQ ID NO: 554343 - RNA, 19 nt, Homo sapiens
gcuccggucugauauacaa

SEQ ID NO: 554344 - RNA, 19 nt, Homo sapiens
aaguauugcugccuucaua

SEQ ID NO: 554345 - RNA, 19 nt, Homo sapiens
ggugauggcucagcacaug

SEQ ID NO: 554346 - RNA, 19 nt, Homo sapiens
gggcccagaugaauguaaa

SEQ ID NO: 554347 - RNA, 19 nt, Homo sapiens
ugagcuggcugaccacuau

SEQ ID NO: 554348 - RNA, 19 nt, Homo sapiens
aggcaugacugacuucuug

SEQ ID NO: 554349 - RNA, 19 nt, Homo sapiens
ggagcuugcugcuguuauc

SEQ ID NO: 554350 - RNA, 19 nt, Homo sapiens
ggauauacagaccuuacua

SEQ ID NO: 554351 - RNA, 19 nt, Homo sapiens
gauggcaacccacacauug

SEQ ID NO: 554352 - RNA, 19 nt, Homo sapiens
ccaccacggacuacaauaa

SEQ ID NO: 554353 - RNA, 19 nt, Homo sapiens
uugcacagauaguggauuu

SEQ ID NO: 554354 - RNA, 19 nt, Homo sapiens
ucaaacaucagaaccaguu

SEQ ID NO: 554355 - RNA, 19 nt, Homo sapiens
gcacaugaucagggauaua

SEQ ID NO: 554356 - RNA, 19 nt, Homo sapiens
ccauggagccuaaugauag

SEQ ID NO: 554357 - RNA, 19 nt, Homo sapiens
gaugauccuuagcucuuug

SEQ ID NO: 554358 - RNA, 19 nt, Homo sapiens
gauauacagaccuuacuau

SEQ ID NO: 554359 - RNA, 19 nt, Homo sapiens
caaacucguaccuuuauug

SEQ ID NO: 554360 - RNA, 19 nt, Homo sapiens
gcuuggagguguuggugaa

SEQ ID NO: 554361 - RNA, 19 nt, Homo sapiens
ugacggcucugcuguggau

SEQ ID NO: 554362 - RNA, 19 nt, Homo sapiens
ucucaaacucguaccuuua

SEQ ID NO: 554363 - RNA, 19 nt, Homo sapiens
gaacgggcuccuccucaga

SEQ ID NO: 554364 - RNA, 19 nt, Homo sapiens
gcaagaugauaagaagcuu

SEQ ID NO: 554365 - RNA, 19 nt, Homo sapiens
gaaccacugugaccaugac

SEQ ID NO: 554366 - RNA, 19 nt, Homo sapiens
gcucugcuguggauguuca

SEQ ID NO: 554367 - RNA, 19 nt, Homo sapiens
ccuucaaucuuccuaguga

SEQ ID NO: 554368 - RNA, 19 nt, Homo sapiens
uggcagcagugaaaguauu

SEQ ID NO: 554369 - RNA, 19 nt, Homo sapiens
gccauggagccuaaugaua

SEQ ID NO: 554370 - RNA, 19 nt, Homo sapiens
uccaagagcaguuuaauag

SEQ ID NO: 554371 - RNA, 19 nt, Homo sapiens
ggacgaguucugcaagaug

SEQ ID NO: 554372 - RNA, 19 nt, Homo sapiens
gcagcuccggucugauaua

SEQ ID NO: 554373 - RNA, 19 nt, Homo sapiens
uguaggcccugaugccauu

SEQ ID NO: 554374 - RNA, 19 nt, Homo sapiens
uugaaugccuggcccuaaa

SEQ ID NO: 554375 - RNA, 19 nt, Homo sapiens
caucagaaccaguugaaag

SEQ ID NO: 554376 - RNA, 19 nt, Homo sapiens
ucaaacucguaccuuuauu

SEQ ID NO: 554377 - RNA, 19 nt, Homo sapiens
ugaagaccuuggacucuca

SEQ ID NO: 554378 - RNA, 19 nt, Homo sapiens
gcacagauaguggauuugg

SEQ ID NO: 554379 - RNA, 19 nt, Homo sapiens
cuucaggaauacaauguug

SEQ ID NO: 554380 - RNA, 19 nt, Homo sapiens
gaaguucagggagcagaaa

SEQ ID NO: 554381 - RNA, 19 nt, Homo sapiens
ucacggggcuagaagagua

SEQ ID NO: 554382 - RNA, 19 nt, Homo sapiens
ggauggcaacccacacauu

SEQ ID NO: 554383 - RNA, 19 nt, Homo sapiens
gcuucgagauccccaaaua

SEQ ID NO: 554384 - RNA, 19 nt, Homo sapiens
ucagggauauacagaccuu

SEQ ID NO: 554385 - RNA, 19 nt, Homo sapiens
cagcacaugaucagggaua

SEQ ID NO: 554386 - RNA, 19 nt, Homo sapiens
uaaccaaggccuguuugaa

SEQ ID NO: 554387 - RNA, 19 nt, Homo sapiens
ggacuacaauaacaaucac

SEQ ID NO: 554388 - RNA, 19 nt, Homo sapiens
uaagaagcuucaggaauac

SEQ ID NO: 554389 - RNA, 19 nt, Homo sapiens
ugaugauccuuagcucuuu

SEQ ID NO: 554390 - RNA, 19 nt, Homo sapiens
cuauggcccuuccucauca

SEQ ID NO: 554391 - RNA, 19 nt, Homo sapiens
gaaugggucccuauuaucc

SEQ ID NO: 554392 - RNA, 19 nt, Homo sapiens
gauggagcuugcugcuguu

SEQ ID NO: 554393 - RNA, 19 nt, Homo sapiens
accaaggccuguuugaaug

SEQ ID NO: 554394 - RNA, 19 nt, Homo sapiens
gaaaguauugcugccuuca

SEQ ID NO: 554395 - RNA, 19 nt, Homo sapiens
gcccauggaggcagaagaa

SEQ ID NO: 554396 - RNA, 19 nt, Homo sapiens
uguuaucaauggccgaauu

SEQ ID NO: 554397 - RNA, 19 nt, Homo sapiens
gcaacccacacauugauca

SEQ ID NO: 554398 - RNA, 19 nt, Homo sapiens
gauccagcaacaucuuuga

SEQ ID NO: 554399 - RNA, 19 nt, Homo sapiens
agaaccaguugaaagugaa

SEQ ID NO: 554400 - RNA, 19 nt, Homo sapiens
ugucggccauggagccuaa

SEQ ID NO: 554401 - RNA, 19 nt, Homo sapiens
gcuugcugcuguuaucaau

SEQ ID NO: 554402 - RNA, 19 nt, Homo sapiens
ccacggacuacaauaacaa

SEQ ID NO: 554403 - RNA, 19 nt, Homo sapiens
ggaaugccaacagcuaugu

SEQ ID NO: 554404 - RNA, 19 nt, Homo sapiens
gggacgaguucugcaagau

SEQ ID NO: 554405 - RNA, 19 nt, Homo sapiens
ccucuuccuucacaguauu

SEQ ID NO: 554406 - RNA, 19 nt, Homo sapiens
ccuuagcucuuugcucuau

SEQ ID NO: 554407 - RNA, 19 nt, Homo sapiens
aaccaaggccuguuugaau

SEQ ID NO: 554408 - RNA, 19 nt, Homo sapiens
cauggagccuaaugauagu

SEQ ID NO: 554409 - RNA, 19 nt, Homo sapiens
caggagcccacacccagua

SEQ ID NO: 554410 - RNA, 19 nt, Homo sapiens
auacaacgccucaguggau

SEQ ID NO: 554411 - RNA, 19 nt, Homo sapiens
ugguaugccugccaagaga

SEQ ID NO: 554412 - RNA, 19 nt, Homo sapiens
ggaaguucagggagcagaa

SEQ ID NO: 554413 - RNA, 19 nt, Homo sapiens
guaaccaaggccuguuuga

SEQ ID NO: 554414 - RNA, 19 nt, Homo sapiens
ggauuucccaccagagugu

SEQ ID NO: 554415 - RNA, 19 nt, Homo sapiens
ggaaccacugugaccauga

SEQ ID NO: 554416 - RNA, 19 nt, Homo sapiens
cccuaaaccugcacugcuu

SEQ ID NO: 554417 - RNA, 19 nt, Homo sapiens
gggccuugcuuucucuucu

SEQ ID NO: 554418 - RNA, 19 nt, Homo sapiens
uggaggagccugacagcuu

SEQ ID NO: 554419 - RNA, 19 nt, Homo sapiens
aacaacggcucauuuacca

SEQ ID NO: 554420 - RNA, 19 nt, Homo sapiens
cugcgcaugugcugcauug

SEQ ID NO: 554421 - RNA, 19 nt, Homo sapiens
ccgagggucauccggauuu

SEQ ID NO: 554422 - RNA, 19 nt, Homo sapiens
gcagcgcuacuacgagguu

SEQ ID NO: 554423 - RNA, 19 nt, Homo sapiens
aaacaaaugcacccaacca

SEQ ID NO: 554424 - RNA, 19 nt, Homo sapiens
gaccuuggacucucaaacu

SEQ ID NO: 554425 - RNA, 19 nt, Homo sapiens
aaacaucagaaccaguuga

SEQ ID NO: 554426 - RNA, 19 nt, Homo sapiens
ucugcaagaugauaagaag

SEQ ID NO: 554427 - RNA, 19 nt, Homo sapiens
ccaagagacgcaagacgau

SEQ ID NO: 554428 - RNA, 19 nt, Homo sapiens
aaacucguaccuuuauugu

SEQ ID NO: 554429 - RNA, 19 nt, Homo sapiens
gagccugucaccggaguuu

SEQ ID NO: 554430 - RNA, 19 nt, Homo sapiens
caacccggguggugauugc

SEQ ID NO: 554431 - RNA, 19 nt, Homo sapiens
ggacaaaccuggaauuucu

SEQ ID NO: 554432 - RNA, 19 nt, Homo sapiens
auaagaagcuucaggaaua

SEQ ID NO: 554433 - RNA, 19 nt, Homo sapiens
caacagcuaugucaugguu

SEQ ID NO: 554434 - RNA, 19 nt, Homo sapiens
cagaaugggucccuauuau

SEQ ID NO: 554435 - RNA, 19 nt, Homo sapiens
caagagcaguuuaauagca

SEQ ID NO: 554436 - RNA, 19 nt, Homo sapiens
gcaggcagccauucccaua

SEQ ID NO: 554437 - RNA, 19 nt, Homo sapiens
guuggaaccuucaaucuuc

SEQ ID NO: 554438 - RNA, 19 nt, Homo sapiens
gacgaguucugcaagauga

SEQ ID NO: 554439 - RNA, 19 nt, Homo sapiens
cagcagcuccggucugaua

SEQ ID NO: 554440 - RNA, 19 nt, Homo sapiens
ccagaaugggucccuauua

SEQ ID NO: 554441 - RNA, 19 nt, Homo sapiens
gauaagaagcuucaggaau

SEQ ID NO: 554442 - RNA, 19 nt, Homo sapiens
cagaaccaguugaaaguga

SEQ ID NO: 554443 - RNA, 19 nt, Homo sapiens
gcuccggucugauauacaa

SEQ ID NO: 554444 - RNA, 19 nt, Homo sapiens
aaguauugcugccuucaua

SEQ ID NO: 554445 - RNA, 19 nt, Homo sapiens
ggugauggcucagcacaug

SEQ ID NO: 554446 - RNA, 19 nt, Homo sapiens
gggcccagaugaauguaaa

SEQ ID NO: 554447 - RNA, 19 nt, Homo sapiens
ugagcuggcugaccacuau

SEQ ID NO: 554448 - RNA, 19 nt, Homo sapiens
aggcaugacugacuucuug

SEQ ID NO: 554449 - RNA, 19 nt, Homo sapiens
ggagcuugcugcuguuauc

SEQ ID NO: 554450 - RNA, 19 nt, Homo sapiens
ggauauacagaccuuacua

SEQ ID NO: 554451 - RNA, 19 nt, Homo sapiens
gauggcaacccacacauug

SEQ ID NO: 554452 - RNA, 19 nt, Homo sapiens
ccaccacggacuacaauaa

SEQ ID NO: 554453 - RNA, 19 nt, Homo sapiens
uugcacagauaguggauuu

SEQ ID NO: 554454 - RNA, 19 nt, Homo sapiens
ucaaacaucagaaccaguu

SEQ ID NO: 554455 - RNA, 19 nt, Homo sapiens
gcacaugaucagggauaua

SEQ ID NO: 554456 - RNA, 19 nt, Homo sapiens
ccauggagccuaaugauag

SEQ ID NO: 554457 - RNA, 19 nt, Homo sapiens
gaugauccuuagcucuuug

SEQ ID NO: 554458 - RNA, 19 nt, Homo sapiens
gauauacagaccuuacuau

SEQ ID NO: 554459 - RNA, 19 nt, Homo sapiens
caaacucguaccuuuauug

SEQ ID NO: 554460 - RNA, 19 nt, Homo sapiens
gcuuggagguguuggugaa

SEQ ID NO: 554461 - RNA, 19 nt, Homo sapiens
ugacggcucugcuguggau

SEQ ID NO: 554462 - RNA, 19 nt, Homo sapiens
ucucaaacucguaccuuua

SEQ ID NO: 554463 - RNA, 19 nt, Homo sapiens
gaacgggcuccuccucaga

SEQ ID NO: 554464 - RNA, 19 nt, Homo sapiens
gcaagaugauaagaagcuu

SEQ ID NO: 554465 - RNA, 19 nt, Homo sapiens
gaaccacugugaccaugac

SEQ ID NO: 554466 - RNA, 19 nt, Homo sapiens
gcucugcuguggauguuca

SEQ ID NO: 554467 - RNA, 19 nt, Homo sapiens
ccuucaaucuuccuaguga

SEQ ID NO: 554468 - RNA, 19 nt, Homo sapiens
uggcagcagugaaaguauu

SEQ ID NO: 554469 - RNA, 19 nt, Homo sapiens
gccauggagccuaaugaua

SEQ ID NO: 554470 - RNA, 19 nt, Homo sapiens
uccaagagcaguuuaauag

SEQ ID NO: 554471 - RNA, 19 nt, Homo sapiens
ggacgaguucugcaagaug

SEQ ID NO: 554472 - RNA, 19 nt, Homo sapiens
gcagcuccggucugauaua

SEQ ID NO: 554473 - RNA, 19 nt, Homo sapiens
uguaggcccugaugccauu

SEQ ID NO: 554474 - RNA, 19 nt, Homo sapiens
uugaaugccuggcccuaaa

SEQ ID NO: 554475 - RNA, 19 nt, Homo sapiens
caucagaaccaguugaaag

SEQ ID NO: 554476 - RNA, 19 nt, Homo sapiens
ucaaacucguaccuuuauu

SEQ ID NO: 554477 - RNA, 19 nt, Homo sapiens
ugaagaccuuggacucuca

SEQ ID NO: 554478 - RNA, 19 nt, Homo sapiens
gcacagauaguggauuugg

SEQ ID NO: 554479 - RNA, 19 nt, Homo sapiens
cuucaggaauacaauguug

SEQ ID NO: 554480 - RNA, 19 nt, Homo sapiens
gaaguucagggagcagaaa

SEQ ID NO: 554481 - RNA, 19 nt, Homo sapiens
ucacggggcuagaagagua

SEQ ID NO: 554482 - RNA, 19 nt, Homo sapiens
ggauggcaacccacacauu

SEQ ID NO: 554483 - RNA, 19 nt, Homo sapiens
gcuucgagauccccaaaua

SEQ ID NO: 554484 - RNA, 19 nt, Homo sapiens
ucagggauauacagaccuu

SEQ ID NO: 554485 - RNA, 19 nt, Homo sapiens
cagcacaugaucagggaua

SEQ ID NO: 554486 - RNA, 19 nt, Homo sapiens
uaaccaaggccuguuugaa

SEQ ID NO: 554487 - RNA, 19 nt, Homo sapiens
ggacuacaauaacaaucac

SEQ ID NO: 554488 - RNA, 19 nt, Homo sapiens
uaagaagcuucaggaauac

SEQ ID NO: 554489 - RNA, 19 nt, Homo sapiens
ugaugauccuuagcucuuu

SEQ ID NO: 554490 - RNA, 19 nt, Homo sapiens
cuauggcccuuccucauca

SEQ ID NO: 554491 - RNA, 19 nt, Homo sapiens
gaaugggucccuauuaucc

SEQ ID NO: 554492 - RNA, 19 nt, Homo sapiens
gauggagcuugcugcuguu

SEQ ID NO: 554493 - RNA, 19 nt, Homo sapiens
accaaggccuguuugaaug

SEQ ID NO: 554494 - RNA, 19 nt, Homo sapiens
gaaaguauugcugccuuca

SEQ ID NO: 554495 - RNA, 19 nt, Homo sapiens
gcccauggaggcagaagaa

SEQ ID NO: 554496 - RNA, 19 nt, Homo sapiens
uguuaucaauggccgaauu

SEQ ID NO: 554497 - RNA, 19 nt, Homo sapiens
gcaacccacacauugauca

SEQ ID NO: 554498 - RNA, 19 nt, Homo sapiens
gauccagcaacaucuuuga

SEQ ID NO: 554499 - RNA, 19 nt, Homo sapiens
agaaccaguugaaagugaa

SEQ ID NO: 554500 - RNA, 19 nt, Homo sapiens
ugucggccauggagccuaa

SEQ ID NO: 554501 - RNA, 19 nt, Homo sapiens
gcuugcugcuguuaucaau

SEQ ID NO: 554502 - RNA, 19 nt, Homo sapiens
ccacggacuacaauaacaa

SEQ ID NO: 554503 - RNA, 19 nt, Homo sapiens
ggaaugccaacagcuaugu

SEQ ID NO: 554504 - RNA, 19 nt, Homo sapiens
gggacgaguucugcaagau

SEQ ID NO: 554505 - RNA, 19 nt, Homo sapiens
ccucuuccuucacaguauu

SEQ ID NO: 554506 - RNA, 19 nt, Homo sapiens
ccuuagcucuuugcucuau

SEQ ID NO: 554507 - RNA, 19 nt, Homo sapiens
aaccaaggccuguuugaau

SEQ ID NO: 554508 - RNA, 19 nt, Homo sapiens
cauggagccuaaugauagu

SEQ ID NO: 554509 - RNA, 19 nt, Homo sapiens
caggagcccacacccagua

SEQ ID NO: 554510 - RNA, 19 nt, Homo sapiens
auacaacgccucaguggau

SEQ ID NO: 554511 - RNA, 19 nt, Homo sapiens
ugguaugccugccaagaga

SEQ ID NO: 554512 - RNA, 19 nt, Homo sapiens
ggaaguucagggagcagaa

SEQ ID NO: 554513 - RNA, 19 nt, Homo sapiens
guaaccaaggccuguuuga

SEQ ID NO: 554514 - RNA, 19 nt, Homo sapiens
ggauuucccaccagagugu

SEQ ID NO: 554515 - RNA, 19 nt, Homo sapiens
ggaaccacugugaccauga

SEQ ID NO: 554516 - RNA, 19 nt, Homo sapiens
cccuaaaccugcacugcuu

SEQ ID NO: 554517 - RNA, 19 nt, Homo sapiens
gggccuugcuuucucuucu

SEQ ID NO: 554518 - RNA, 19 nt, Homo sapiens
uggaggagccugacagcuu

SEQ ID NO: 554519 - RNA, 19 nt, Homo sapiens
aacaacggcucauuuacca

SEQ ID NO: 554520 - RNA, 19 nt, Homo sapiens
cugcgcaugugcugcauug

SEQ ID NO: 554521 - RNA, 19 nt, Homo sapiens
ccgagggucauccggauuu

SEQ ID NO: 554522 - RNA, 19 nt, Homo sapiens
gcagcgcuacuacgagguu

SEQ ID NO: 554523 - RNA, 19 nt, Homo sapiens
aaacaaaugcacccaacca

SEQ ID NO: 554524 - RNA, 19 nt, Homo sapiens
gaccuuggacucucaaacu

SEQ ID NO: 554525 - RNA, 19 nt, Homo sapiens
aaacaucagaaccaguuga

SEQ ID NO: 554526 - RNA, 19 nt, Homo sapiens
ucugcaagaugauaagaag

SEQ ID NO: 554527 - RNA, 19 nt, Homo sapiens
ccaagagacgcaagacgau

SEQ ID NO: 554528 - RNA, 19 nt, Homo sapiens
aaacucguaccuuuauugu

SEQ ID NO: 554529 - RNA, 19 nt, Homo sapiens
gagccugucaccggaguuu

SEQ ID NO: 554530 - RNA, 19 nt, Homo sapiens
caacccggguggugauugc

SEQ ID NO: 554531 - RNA, 19 nt, Homo sapiens
ggacaaaccuggaauuucu

SEQ ID NO: 554532 - RNA, 19 nt, Homo sapiens
auaagaagcuucaggaaua

SEQ ID NO: 554533 - RNA, 19 nt, Homo sapiens
caacagcuaugucaugguu

SEQ ID NO: 554534 - RNA, 19 nt, Homo sapiens
cagaaugggucccuauuau

SEQ ID NO: 554535 - RNA, 19 nt, Homo sapiens
caagagcaguuuaauagca

SEQ ID NO: 554536 - RNA, 19 nt, Homo sapiens
gcaggcagccauucccaua

SEQ ID NO: 554537 - RNA, 19 nt, Homo sapiens
guuggaaccuucaaucuuc

SEQ ID NO: 554538 - RNA, 19 nt, Homo sapiens
gacgaguucugcaagauga

SEQ ID NO: 554539 - RNA, 19 nt, Homo sapiens
cagcagcuccggucugaua

SEQ ID NO: 554540 - RNA, 19 nt, Homo sapiens
ccagaaugggucccuauua

SEQ ID NO: 554541 - RNA, 19 nt, Homo sapiens
gauaagaagcuucaggaau

SEQ ID NO: 554542 - RNA, 19 nt, Homo sapiens
cagaaccaguugaaaguga

SEQ ID NO: 554543 - RNA, 19 nt, Homo sapiens
gcuccggucugauauacaa

SEQ ID NO: 554544 - RNA, 19 nt, Homo sapiens
aaguauugcugccuucaua

SEQ ID NO: 554545 - RNA, 19 nt, Homo sapiens
ggugauggcucagcacaug

SEQ ID NO: 554546 - RNA, 19 nt, Homo sapiens
gggcccagaugaauguaaa

SEQ ID NO: 554547 - RNA, 19 nt, Homo sapiens
ugagcuggcugaccacuau

SEQ ID NO: 554548 - RNA, 19 nt, Homo sapiens
aggcaugacugacuucuug

SEQ ID NO: 554549 - RNA, 19 nt, Homo sapiens
ggagcuugcugcuguuauc

SEQ ID NO: 554550 - RNA, 19 nt, Homo sapiens
ggauauacagaccuuacua

SEQ ID NO: 554551 - RNA, 19 nt, Homo sapiens
gauggcaacccacacauug

SEQ ID NO: 554552 - RNA, 19 nt, Homo sapiens
ccaccacggacuacaauaa

SEQ ID NO: 554553 - RNA, 19 nt, Homo sapiens
uugcacagauaguggauuu

SEQ ID NO: 554554 - RNA, 19 nt, Homo sapiens
ucaaacaucagaaccaguu

SEQ ID NO: 554555 - RNA, 19 nt, Homo sapiens
gcacaugaucagggauaua

SEQ ID NO: 554556 - RNA, 19 nt, Homo sapiens
ccauggagccuaaugauag

SEQ ID NO: 554557 - RNA, 19 nt, Homo sapiens
gaugauccuuagcucuuug

SEQ ID NO: 554558 - RNA, 19 nt, Homo sapiens
gauauacagaccuuacuau

SEQ ID NO: 554559 - RNA, 19 nt, Homo sapiens
caaacucguaccuuuauug

SEQ ID NO: 554560 - RNA, 19 nt, Homo sapiens
gcuuggagguguuggugaa

SEQ ID NO: 554561 - RNA, 19 nt, Homo sapiens
ugacggcucugcuguggau

SEQ ID NO: 554562 - RNA, 19 nt, Homo sapiens
ucucaaacucguaccuuua

SEQ ID NO: 554563 - RNA, 19 nt, Homo sapiens
gaacgggcuccuccucaga

SEQ ID NO: 554564 - RNA, 19 nt, Homo sapiens
gcaagaugauaagaagcuu

SEQ ID NO: 554565 - RNA, 19 nt, Homo sapiens
gaaccacugugaccaugac

SEQ ID NO: 554566 - RNA, 19 nt, Homo sapiens
gcucugcuguggauguuca

SEQ ID NO: 554567 - RNA, 19 nt, Homo sapiens
ccuucaaucuuccuaguga

SEQ ID NO: 554568 - RNA, 19 nt, Homo sapiens
uggcagcagugaaaguauu

SEQ ID NO: 554569 - RNA, 19 nt, Homo sapiens
gccauggagccuaaugaua

SEQ ID NO: 554570 - RNA, 19 nt, Homo sapiens
uccaagagcaguuuaauag

SEQ ID NO: 554571 - RNA, 19 nt, Homo sapiens
ggacgaguucugcaagaug

SEQ ID NO: 554572 - RNA, 19 nt, Homo sapiens
gcagcuccggucugauaua

SEQ ID NO: 554573 - RNA, 19 nt, Homo sapiens
uguaggcccugaugccauu

SEQ ID NO: 554574 - RNA, 19 nt, Homo sapiens
uugaaugccuggcccuaaa

SEQ ID NO: 554575 - RNA, 19 nt, Homo sapiens
caucagaaccaguugaaag

SEQ ID NO: 554576 - RNA, 19 nt, Homo sapiens
ucaaacucguaccuuuauu

SEQ ID NO: 554577 - RNA, 19 nt, Homo sapiens
ugaagaccuuggacucuca

SEQ ID NO: 554578 - RNA, 19 nt, Homo sapiens
gcacagauaguggauuugg

SEQ ID NO: 554579 - RNA, 19 nt, Homo sapiens
cuucaggaauacaauguug

SEQ ID NO: 554580 - RNA, 19 nt, Homo sapiens
gaaguucagggagcagaaa

SEQ ID NO: 554581 - RNA, 19 nt, Homo sapiens
ucacggggcuagaagagua

SEQ ID NO: 554582 - RNA, 19 nt, Homo sapiens
ggauggcaacccacacauu

SEQ ID NO: 554583 - RNA, 19 nt, Homo sapiens
gcuucgagauccccaaaua

SEQ ID NO: 554584 - RNA, 19 nt, Homo sapiens
ucagggauauacagaccuu

SEQ ID NO: 554585 - RNA, 19 nt, Homo sapiens
cagcacaugaucagggaua

SEQ ID NO: 554586 - RNA, 19 nt, Homo sapiens
uaaccaaggccuguuugaa

SEQ ID NO: 554587 - RNA, 19 nt, Homo sapiens
ggacuacaauaacaaucac

SEQ ID NO: 554588 - RNA, 19 nt, Homo sapiens
uaagaagcuucaggaauac

SEQ ID NO: 554589 - RNA, 19 nt, Homo sapiens
ugaugauccuuagcucuuu

SEQ ID NO: 554590 - RNA, 19 nt, Homo sapiens
cuauggcccuuccucauca

SEQ ID NO: 554591 - RNA, 19 nt, Homo sapiens
gaaugggucccuauuaucc

SEQ ID NO: 554592 - RNA, 19 nt, Homo sapiens
gauggagcuugcugcuguu

SEQ ID NO: 554593 - RNA, 19 nt, Homo sapiens
accaaggccuguuugaaug

SEQ ID NO: 554594 - RNA, 19 nt, Homo sapiens
gaaaguauugcugccuuca

SEQ ID NO: 554595 - RNA, 19 nt, Homo sapiens
gcccauggaggcagaagaa

SEQ ID NO: 554596 - RNA, 19 nt, Homo sapiens
uguuaucaauggccgaauu

SEQ ID NO: 554597 - RNA, 19 nt, Homo sapiens
gcaacccacacauugauca

SEQ ID NO: 554598 - RNA, 19 nt, Homo sapiens
gauccagcaacaucuuuga

SEQ ID NO: 554599 - RNA, 19 nt, Homo sapiens
agaaccaguugaaagugaa

SEQ ID NO: 554600 - RNA, 19 nt, Homo sapiens
ugucggccauggagccuaa

SEQ ID NO: 554601 - RNA, 19 nt, Homo sapiens
gcuugcugcuguuaucaau

SEQ ID NO: 554602 - RNA, 19 nt, Homo sapiens
ccacggacuacaauaacaa

SEQ ID NO: 554603 - RNA, 19 nt, Homo sapiens
ggaaugccaacagcuaugu

SEQ ID NO: 554604 - RNA, 19 nt, Homo sapiens
gggacgaguucugcaagau

SEQ ID NO: 554605 - RNA, 19 nt, Homo sapiens
ccucuuccuucacaguauu

SEQ ID NO: 554606 - RNA, 19 nt, Homo sapiens
ccuuagcucuuugcucuau

SEQ ID NO: 554607 - RNA, 19 nt, Homo sapiens
aaccaaggccuguuugaau

SEQ ID NO: 554608 - RNA, 19 nt, Homo sapiens
cauggagccuaaugauagu

SEQ ID NO: 554609 - RNA, 19 nt, Homo sapiens
caggagcccacacccagua

SEQ ID NO: 554610 - RNA, 19 nt, Homo sapiens
auacaacgccucaguggau

SEQ ID NO: 554611 - RNA, 19 nt, Homo sapiens
ugguaugccugccaagaga

SEQ ID NO: 554612 - RNA, 19 nt, Homo sapiens
ggaaguucagggagcagaa

SEQ ID NO: 554613 - RNA, 19 nt, Homo sapiens
guaaccaaggccuguuuga

SEQ ID NO: 554614 - RNA, 19 nt, Homo sapiens
ggauuucccaccagagugu

SEQ ID NO: 554615 - RNA, 19 nt, Homo sapiens
ggaaccacugugaccauga

SEQ ID NO: 554616 - RNA, 19 nt, Homo sapiens
cccuaaaccugcacugcuu

SEQ ID NO: 554617 - RNA, 19 nt, Homo sapiens
gggccuugcuuucucuucu

SEQ ID NO: 554618 - RNA, 19 nt, Homo sapiens
uggaggagccugacagcuu

SEQ ID NO: 554619 - RNA, 19 nt, Homo sapiens
aacaacggcucauuuacca

SEQ ID NO: 554620 - RNA, 19 nt, Homo sapiens
cugcgcaugugcugcauug

SEQ ID NO: 554621 - RNA, 19 nt, Homo sapiens
ccgagggucauccggauuu

SEQ ID NO: 554622 - RNA, 19 nt, Homo sapiens
gcagcgcuacuacgagguu

SEQ ID NO: 554623 - RNA, 19 nt, Homo sapiens
aaacaaaugcacccaacca

SEQ ID NO: 554624 - RNA, 19 nt, Homo sapiens
gaccuuggacucucaaacu

SEQ ID NO: 554625 - RNA, 19 nt, Homo sapiens
aaacaucagaaccaguuga

SEQ ID NO: 554626 - RNA, 19 nt, Homo sapiens
ucugcaagaugauaagaag

SEQ ID NO: 554627 - RNA, 19 nt, Homo sapiens
ccaagagacgcaagacgau

SEQ ID NO: 554628 - RNA, 19 nt, Homo sapiens
aaacucguaccuuuauugu

SEQ ID NO: 554629 - RNA, 19 nt, Homo sapiens
gagccugucaccggaguuu

SEQ ID NO: 554630 - RNA, 19 nt, Homo sapiens
caacccggguggugauugc

SEQ ID NO: 554631 - RNA, 19 nt, Homo sapiens
gaaaugggaucgcggaaga

SEQ ID NO: 554632 - RNA, 19 nt, Homo sapiens
uaagaugacucaccggaua

SEQ ID NO: 554633 - RNA, 19 nt, Homo sapiens
gagcuuggcuuacuugucu

SEQ ID NO: 554634 - RNA, 19 nt, Homo sapiens
gggagugacccaucuauuu

SEQ ID NO: 554635 - RNA, 19 nt, Homo sapiens
ggagagccauggagagaca

SEQ ID NO: 554636 - RNA, 19 nt, Homo sapiens
gaaggagggaggagaaaga

SEQ ID NO: 554637 - RNA, 19 nt, Homo sapiens
gguaaagucugacccuagu

SEQ ID NO: 554638 - RNA, 19 nt, Homo sapiens
ggacuaggcuacagaucag

SEQ ID NO: 554639 - RNA, 19 nt, Homo sapiens
uaaagggccaggcugauuu

SEQ ID NO: 554640 - RNA, 19 nt, Homo sapiens
gacugaaccugccagagaa

SEQ ID NO: 554641 - RNA, 19 nt, Homo sapiens
ugucaacucuucugauuag

SEQ ID NO: 554642 - RNA, 19 nt, Homo sapiens
gcagaaggagcaucaggaa

SEQ ID NO: 554643 - RNA, 19 nt, Homo sapiens
gaagaggaaacuccgaaau

SEQ ID NO: 554644 - RNA, 19 nt, Homo sapiens
gaaggcaccagcagcagaa

SEQ ID NO: 554645 - RNA, 19 nt, Homo sapiens
gacacccacuuccaagauu

SEQ ID NO: 554646 - RNA, 19 nt, Homo sapiens
cuacacagcaacacguaua

SEQ ID NO: 554647 - RNA, 19 nt, Homo sapiens
agaaggagcaucaggaaga

SEQ ID NO: 554648 - RNA, 19 nt, Homo sapiens
ugugucaacucuucugauu

SEQ ID NO: 554649 - RNA, 19 nt, Homo sapiens
aaacugaacccggagcuuu

SEQ ID NO: 554650 - RNA, 19 nt, Homo sapiens
gaaccugccagagaaagaa

SEQ ID NO: 554651 - RNA, 19 nt, Homo sapiens
gaacugugacacccacuuc

SEQ ID NO: 554652 - RNA, 19 nt, Homo sapiens
agaugcagauccugaaguu

SEQ ID NO: 554653 - RNA, 19 nt, Homo sapiens
gagaaagaaagagaaagaa

SEQ ID NO: 554654 - RNA, 19 nt, Homo sapiens
agacugaaccugccagaga

SEQ ID NO: 554655 - RNA, 19 nt, Homo sapiens
ccacgagcuuggcuuacuu

SEQ ID NO: 554656 - RNA, 19 nt, Homo sapiens
ggaagaggaaacuccgaaa

SEQ ID NO: 554657 - RNA, 19 nt, Homo sapiens
ggaaggacuaggcuacaga

SEQ ID NO: 554658 - RNA, 19 nt, Homo sapiens
ccagagaaagaaagagaaa

SEQ ID NO: 554659 - RNA, 19 nt, Homo sapiens
gucaauaggcucugucuuc

SEQ ID NO: 554660 - RNA, 19 nt, Homo sapiens
agagaaagaaagagaaaga

SEQ ID NO: 554661 - RNA, 19 nt, Homo sapiens
ggagugacccaucuauuuu

SEQ ID NO: 554662 - RNA, 19 nt, Homo sapiens
gaccugggcccuuugacuu

SEQ ID NO: 554663 - RNA, 19 nt, Homo sapiens
gaaaaccggucuccuacuc

SEQ ID NO: 554664 - RNA, 19 nt, Homo sapiens
agaggaaacuccgaaaugg

SEQ ID NO: 554665 - RNA, 19 nt, Homo sapiens
cccgagcccucaaguaaug

SEQ ID NO: 554666 - RNA, 19 nt, Homo sapiens
gcuccugacucccagagau

SEQ ID NO: 554667 - RNA, 19 nt, Homo sapiens
ucccuugccugguaucauu

SEQ ID NO: 554668 - RNA, 19 nt, Homo sapiens
gagagucagaaauaaauca

SEQ ID NO: 554669 - RNA, 19 nt, Homo sapiens
gagacaaggagcccggaaa

SEQ ID NO: 554670 - RNA, 19 nt, Homo sapiens
gaaggagcaucaggaagac

SEQ ID NO: 554671 - RNA, 19 nt, Homo sapiens
ccguguggcuauuugauug

SEQ ID NO: 554672 - RNA, 19 nt, Homo sapiens
ucaccacgagcuuggcuua

SEQ ID NO: 554673 - RNA, 19 nt, Homo sapiens
uacggaagcuacacagcaa

SEQ ID NO: 554674 - RNA, 19 nt, Homo sapiens
gaaggacuaggcuacagau

SEQ ID NO: 554675 - RNA, 19 nt, Homo sapiens
gagaucuucuagggaguga

SEQ ID NO: 554676 - RNA, 19 nt, Homo sapiens
cgcccgagcccucaaguaa

SEQ ID NO: 554677 - RNA, 19 nt, Homo sapiens
aagaggaaacuccgaaaug

SEQ ID NO: 554678 - RNA, 19 nt, Homo sapiens
gagaaggagggaggagaaa

SEQ ID NO: 554679 - RNA, 19 nt, Homo sapiens
cgaguucugacuuugguaa

SEQ ID NO: 554680 - RNA, 19 nt, Homo sapiens
uaauguggguugugguuuu

SEQ ID NO: 554681 - RNA, 19 nt, Homo sapiens
aaccucgaguucugacuuu

SEQ ID NO: 554682 - RNA, 19 nt, Homo sapiens
uuaaagggccaggcugauu

SEQ ID NO: 554683 - RNA, 19 nt, Homo sapiens
ggaaggcgaagggcauugu

SEQ ID NO: 554684 - RNA, 19 nt, Homo sapiens
ggcccuugcucaucaccuu

SEQ ID NO: 554685 - RNA, 19 nt, Homo sapiens
gaaacugaacccggagcuu

SEQ ID NO: 554686 - RNA, 19 nt, Homo sapiens
guaauguggguugugguuu

SEQ ID NO: 554687 - RNA, 19 nt, Homo sapiens
gugucaacucuucugauua

SEQ ID NO: 554688 - RNA, 19 nt, Homo sapiens
cuagucugcugcugaaguc

SEQ ID NO: 554689 - RNA, 19 nt, Homo sapiens
gcuuugcucguuuacuauu

SEQ ID NO: 554690 - RNA, 19 nt, Homo sapiens
acacccacuuccaagauuc

SEQ ID NO: 554691 - RNA, 19 nt, Homo sapiens
ugacacccacuuccaagau

SEQ ID NO: 554692 - RNA, 19 nt, Homo sapiens
gaggaaggcgaagggcauu

SEQ ID NO: 554693 - RNA, 19 nt, Homo sapiens
caaccgacagauccuagug

SEQ ID NO: 554694 - RNA, 19 nt, Homo sapiens
gagcgggaucuaaggacuu

SEQ ID NO: 554695 - RNA, 19 nt, Homo sapiens
agagaaggagggaggagaa

SEQ ID NO: 554696 - RNA, 19 nt, Homo sapiens
auccuucccuugccuggua

SEQ ID NO: 554697 - RNA, 19 nt, Homo sapiens
ccucccaaccuuccacuug

SEQ ID NO: 554698 - RNA, 19 nt, Homo sapiens
ggaccugccagaacuuagg

SEQ ID NO: 554699 - RNA, 19 nt, Homo sapiens
cccuugaggcugaggauaa

SEQ ID NO: 554700 - RNA, 19 nt, Homo sapiens
gaaggcgaagggcauugug

SEQ ID NO: 554701 - RNA, 19 nt, Homo sapiens
uaaagucugacccuagucu

SEQ ID NO: 554702 - RNA, 19 nt, Homo sapiens
gaaagagaaagaaaagaag

SEQ ID NO: 554703 - RNA, 19 nt, Homo sapiens
gguaucauuuucucaguuc

SEQ ID NO: 554704 - RNA, 19 nt, Homo sapiens
cacagcaacacguauagga

SEQ ID NO: 554705 - RNA, 19 nt, Homo sapiens
acaaugagcucuuggacua

SEQ ID NO: 554706 - RNA, 19 nt, Homo sapiens
gaacagacacgguagaaga

SEQ ID NO: 554707 - RNA, 19 nt, Homo sapiens
gggcuuggcuaucacauuu

SEQ ID NO: 554708 - RNA, 19 nt, Homo sapiens
aagaagaacugcccgcaua

SEQ ID NO: 554709 - RNA, 19 nt, Homo sapiens
ggaugaaugugauaagaug

SEQ ID NO: 554710 - RNA, 19 nt, Homo sapiens
cuguuuagcucuucuguua

SEQ ID NO: 554711 - RNA, 19 nt, Homo sapiens
uuagugagcugccugauga

SEQ ID NO: 554712 - RNA, 19 nt, Homo sapiens
uaugagcgcuucucuaaau

SEQ ID NO: 554713 - RNA, 19 nt, Homo sapiens
gaagaggugcugaagaaga

SEQ ID NO: 554714 - RNA, 19 nt, Homo sapiens
cgucagaaguccagcauga

SEQ ID NO: 554715 - RNA, 19 nt, Homo sapiens
agaacgauguggacaauga

SEQ ID NO: 554716 - RNA, 19 nt, Homo sapiens
ugagcugccugaugagaua

SEQ ID NO: 554717 - RNA, 19 nt, Homo sapiens
gugauaagaugcuugaaca

SEQ ID NO: 554718 - RNA, 19 nt, Homo sapiens
gguaucagcaguuuaaaga

SEQ ID NO: 554719 - RNA, 19 nt, Homo sapiens
gcgcuucucuaaauacaug

SEQ ID NO: 554720 - RNA, 19 nt, Homo sapiens
gggaaagacagcaguguuu

SEQ ID NO: 554721 - RNA, 19 nt, Homo sapiens
aauaugagcgcuucucuaa

SEQ ID NO: 554722 - RNA, 19 nt, Homo sapiens
ccaagauccucaaugaugu

SEQ ID NO: 554723 - RNA, 19 nt, Homo sapiens
agaagcaggucaugauguu

SEQ ID NO: 554724 - RNA, 19 nt, Homo sapiens
gccaagauccucaaugaug

SEQ ID NO: 554725 - RNA, 19 nt, Homo sapiens
agacaucuccuccuacauu

SEQ ID NO: 554726 - RNA, 19 nt, Homo sapiens
aagaggugcugaagaagaa

SEQ ID NO: 554727 - RNA, 19 nt, Homo sapiens
augaagaggugcugaagaa

SEQ ID NO: 554728 - RNA, 19 nt, Homo sapiens
gaauaugagcgcuucucua

SEQ ID NO: 554729 - RNA, 19 nt, Homo sapiens
gucaugauguucagugcua

SEQ ID NO: 554730 - RNA, 19 nt, Homo sapiens
gaaagacagcaguguuugu

SEQ ID NO: 554731 - RNA, 19 nt, Homo sapiens
guuuagcucuucuguuaga

SEQ ID NO: 554732 - RNA, 19 nt, Homo sapiens
gaaauaagagccucaaccu

SEQ ID NO: 554733 - RNA, 19 nt, Homo sapiens
ggaaagacagcaguguuug

SEQ ID NO: 554734 - RNA, 19 nt, Homo sapiens
gacaucuccuccuacauug

SEQ ID NO: 554735 - RNA, 19 nt, Homo sapiens
gguggucugucuaucaaga

SEQ ID NO: 554736 - RNA, 19 nt, Homo sapiens
ggaguuggcuuuucagauc

SEQ ID NO: 554737 - RNA, 19 nt, Homo sapiens
ccacagcucuggcuuucgu

SEQ ID NO: 554738 - RNA, 19 nt, Homo sapiens
gucaagggcuccuaugucu

SEQ ID NO: 554739 - RNA, 19 nt, Homo sapiens
gagcgcuucucuaaauaca

SEQ ID NO: 554740 - RNA, 19 nt, Homo sapiens
ggaagugaaggcagauuuc

SEQ ID NO: 554741 - RNA, 19 nt, Homo sapiens
cauacgcgcucucccuguu

SEQ ID NO: 554742 - RNA, 19 nt, Homo sapiens
ugagaaugaugccaagauc

SEQ ID NO: 554743 - RNA, 19 nt, Homo sapiens
ugacaugccugaggauucu

SEQ ID NO: 554744 - RNA, 19 nt, Homo sapiens
ugaaggacaacgagaagaa

SEQ ID NO: 554745 - RNA, 19 nt, Homo sapiens
gcagcaguacuacgugaaa

SEQ ID NO: 554746 - RNA, 19 nt, Homo sapiens
aaagagauccguccagucu

SEQ ID NO: 554747 - RNA, 19 nt, Homo sapiens
caaccucaaacacauuaaa

SEQ ID NO: 554748 - RNA, 19 nt, Homo sapiens
gugcaucccucaggccauu

SEQ ID NO: 554749 - RNA, 19 nt, Homo sapiens
augccaagauccucaauga

SEQ ID NO: 554750 - RNA, 19 nt, Homo sapiens
gcagaacuucccagccauu

SEQ ID NO: 554751 - RNA, 19 nt, Homo sapiens
gagaagcaggucaugaugu

SEQ ID NO: 554752 - RNA, 19 nt, Homo sapiens
gaugaugagacgaaguuga

SEQ ID NO: 554753 - RNA, 19 nt, Homo sapiens
agagaacgauguggacaau

SEQ ID NO: 554754 - RNA, 19 nt, Homo sapiens
gcccaguuauggcagagaa

SEQ ID NO: 554755 - RNA, 19 nt, Homo sapiens
gaauucuuguggcuaccaa

SEQ ID NO: 554756 - RNA, 19 nt, Homo sapiens
uacgcgcucucccuguuua

SEQ ID NO: 554757 - RNA, 19 nt, Homo sapiens
gaagaacugcccgcauauc

SEQ ID NO: 554758 - RNA, 19 nt, Homo sapiens
gaugaagaggugcugaaga

SEQ ID NO: 554759 - RNA, 19 nt, Homo sapiens
gcuuugagcauccgucaga

SEQ ID NO: 554760 - RNA, 19 nt, Homo sapiens
gcuuggcuaucacauuugu

SEQ ID NO: 554761 - RNA, 19 nt, Homo sapiens
ggagcgcacggaucuguau

SEQ ID NO: 554762 - RNA, 19 nt, Homo sapiens
gggugaacauugcuuuuaa

SEQ ID NO: 554763 - RNA, 19 nt, Homo sapiens
guggugaucuuugugaagu

SEQ ID NO: 554764 - RNA, 19 nt, Homo sapiens
ucuuugaccuucuggaugu

SEQ ID NO: 554765 - RNA, 19 nt, Homo sapiens
gccgcaaguucaugcaaga

SEQ ID NO: 554766 - RNA, 19 nt, Homo sapiens
auaagagccucaaccucaa

SEQ ID NO: 554767 - RNA, 19 nt, Homo sapiens
ccaagucgggcaugggaaa

SEQ ID NO: 554768 - RNA, 19 nt, Homo sapiens
gcgagaacccauccagauc

SEQ ID NO: 554769 - RNA, 19 nt, Homo sapiens
caucuccuccuacauugaa

SEQ ID NO: 554770 - RNA, 19 nt, Homo sapiens
auagacaucuccuccuaca

SEQ ID NO: 554771 - RNA, 19 nt, Homo sapiens
uuucaacgacgaauucuug

SEQ ID NO: 554772 - RNA, 19 nt, Homo sapiens
gagcgcacggaucuguaua

SEQ ID NO: 554773 - RNA, 19 nt, Homo sapiens
uaagagccucaaccucaaa

SEQ ID NO: 554774 - RNA, 19 nt, Homo sapiens
ggaauaugagcgcuucucu

SEQ ID NO: 554775 - RNA, 19 nt, Homo sapiens
cggaagugaaggcagauuu

SEQ ID NO: 554776 - RNA, 19 nt, Homo sapiens
gaucagcaaggaauaugag

SEQ ID NO: 554777 - RNA, 19 nt, Homo sapiens
gcuccuaugucuccaucca

SEQ ID NO: 554778 - RNA, 19 nt, Homo sapiens
ucuuguggcuaccaaccua

SEQ ID NO: 554779 - RNA, 19 nt, Homo sapiens
gucgggauguccaggaaau

SEQ ID NO: 554780 - RNA, 19 nt, Homo sapiens
cgagaagcaggucaugaug

SEQ ID NO: 554781 - RNA, 19 nt, Homo sapiens
gcgucgggauguccaggaa

SEQ ID NO: 554782 - RNA, 19 nt, Homo sapiens
ggacuaugaagaugaugag

SEQ ID NO: 554783 - RNA, 19 nt, Homo sapiens
aaugagcucuuggacuaug

SEQ ID NO: 554784 - RNA, 19 nt, Homo sapiens
acgugaaacugaaggacaa

SEQ ID NO: 554785 - RNA, 19 nt, Homo sapiens
aguacuacgugaaacugaa

SEQ ID NO: 554786 - RNA, 19 nt, Homo sapiens
gcgcacggaucuguauaac

SEQ ID NO: 554787 - RNA, 19 nt, Homo sapiens
guucaugcaagauccaaug

SEQ ID NO: 554788 - RNA, 19 nt, Homo sapiens
cgggauguccaggaaauuu

SEQ ID NO: 554789 - RNA, 19 nt, Homo sapiens
cauugucgacuguggcuuu

SEQ ID NO: 554790 - RNA, 19 nt, Homo sapiens
ugaaugugauaagaugcuu

SEQ ID NO: 554791 - RNA, 19 nt, Homo sapiens
gcagauuucccuccuucgu

SEQ ID NO: 554792 - RNA, 19 nt, Homo sapiens
augagcgcuucucuaaaua

SEQ ID NO: 554793 - RNA, 19 nt, Homo sapiens
uuacugggcaggugucugu

SEQ ID NO: 554794 - RNA, 19 nt, Homo sapiens
gaacgauguggacaaugag

SEQ ID NO: 554795 - RNA, 19 nt, Homo sapiens
caagauccucaaugaugug

SEQ ID NO: 554796 - RNA, 19 nt, Homo sapiens
uggaugaugagacgaaguu

SEQ ID NO: 554797 - RNA, 19 nt, Homo sapiens
uuggaugaaugugauaaga

SEQ ID NO: 554798 - RNA, 19 nt, Homo sapiens
cagagaacgauguggacaa

SEQ ID NO: 554799 - RNA, 19 nt, Homo sapiens
ggacaucgagcgggugaac

SEQ ID NO: 554800 - RNA, 19 nt, Homo sapiens
gccgaggcauggacaucga

SEQ ID NO: 554801 - RNA, 19 nt, Homo sapiens
ggugaucuuugugaagucu

SEQ ID NO: 554802 - RNA, 19 nt, Homo sapiens
gcucuuugaccuucuggau

SEQ ID NO: 554803 - RNA, 19 nt, Homo sapiens
gaaggacaacgagaagaac

SEQ ID NO: 554804 - RNA, 19 nt, Homo sapiens
ucagaucagcaaggaauau

SEQ ID NO: 554805 - RNA, 19 nt, Homo sapiens
acaaugagcucuuggacua

SEQ ID NO: 554806 - RNA, 19 nt, Homo sapiens
gaacagacacgguagaaga

SEQ ID NO: 554807 - RNA, 19 nt, Homo sapiens
gggcuuggcuaucacauuu

SEQ ID NO: 554808 - RNA, 19 nt, Homo sapiens
aagaagaacugcccgcaua

SEQ ID NO: 554809 - RNA, 19 nt, Homo sapiens
ggaugaaugugauaagaug

SEQ ID NO: 554810 - RNA, 19 nt, Homo sapiens
uuagugagcugccugauga

SEQ ID NO: 554811 - RNA, 19 nt, Homo sapiens
uaugagcgcuucucuaaau

SEQ ID NO: 554812 - RNA, 19 nt, Homo sapiens
gaagaggugcugaagaaga

SEQ ID NO: 554813 - RNA, 19 nt, Homo sapiens
cgucagaaguccagcauga

SEQ ID NO: 554814 - RNA, 19 nt, Homo sapiens
agaacgauguggacaauga

SEQ ID NO: 554815 - RNA, 19 nt, Homo sapiens
ugagcugccugaugagaua

SEQ ID NO: 554816 - RNA, 19 nt, Homo sapiens
gugauaagaugcuugaaca

SEQ ID NO: 554817 - RNA, 19 nt, Homo sapiens
gguaucagcaguuuaaaga

SEQ ID NO: 554818 - RNA, 19 nt, Homo sapiens
gcgcuucucuaaauacaug

SEQ ID NO: 554819 - RNA, 19 nt, Homo sapiens
gggaaagacagcaguguuu

SEQ ID NO: 554820 - RNA, 19 nt, Homo sapiens
aauaugagcgcuucucuaa

SEQ ID NO: 554821 - RNA, 19 nt, Homo sapiens
ccaagauccucaaugaugu

SEQ ID NO: 554822 - RNA, 19 nt, Homo sapiens
agaagcaggucaugauguu

SEQ ID NO: 554823 - RNA, 19 nt, Homo sapiens
gccaagauccucaaugaug

SEQ ID NO: 554824 - RNA, 19 nt, Homo sapiens
agacaucuccuccuacauu

SEQ ID NO: 554825 - RNA, 19 nt, Homo sapiens
aagaggugcugaagaagaa

SEQ ID NO: 554826 - RNA, 19 nt, Homo sapiens
augaagaggugcugaagaa

SEQ ID NO: 554827 - RNA, 19 nt, Homo sapiens
gaauaugagcgcuucucua

SEQ ID NO: 554828 - RNA, 19 nt, Homo sapiens
gucaugauguucagugcua

SEQ ID NO: 554829 - RNA, 19 nt, Homo sapiens
gaaagacagcaguguuugu

SEQ ID NO: 554830 - RNA, 19 nt, Homo sapiens
gaaauaagagccucaaccu

SEQ ID NO: 554831 - RNA, 19 nt, Homo sapiens
ggaaagacagcaguguuug

SEQ ID NO: 554832 - RNA, 19 nt, Homo sapiens
gacaucuccuccuacauug

SEQ ID NO: 554833 - RNA, 19 nt, Homo sapiens
gguggucugucuaucaaga

SEQ ID NO: 554834 - RNA, 19 nt, Homo sapiens
ggaguuggcuuuucagauc

SEQ ID NO: 554835 - RNA, 19 nt, Homo sapiens
ccacagcucuggcuuucgu

SEQ ID NO: 554836 - RNA, 19 nt, Homo sapiens
gucaagggcuccuaugucu

SEQ ID NO: 554837 - RNA, 19 nt, Homo sapiens
gagcgcuucucuaaauaca

SEQ ID NO: 554838 - RNA, 19 nt, Homo sapiens
ggaagugaaggcagauuuc

SEQ ID NO: 554839 - RNA, 19 nt, Homo sapiens
cauacgcgcucucccuguu

SEQ ID NO: 554840 - RNA, 19 nt, Homo sapiens
ugagaaugaugccaagauc

SEQ ID NO: 554841 - RNA, 19 nt, Homo sapiens
ugacaugccugaggauucu

SEQ ID NO: 554842 - RNA, 19 nt, Homo sapiens
ugaaggacaacgagaagaa

SEQ ID NO: 554843 - RNA, 19 nt, Homo sapiens
gcagcaguacuacgugaaa

SEQ ID NO: 554844 - RNA, 19 nt, Homo sapiens
aaagagauccguccagucu

SEQ ID NO: 554845 - RNA, 19 nt, Homo sapiens
caaccucaaacacauuaaa

SEQ ID NO: 554846 - RNA, 19 nt, Homo sapiens
gugcaucccucaggccauu

SEQ ID NO: 554847 - RNA, 19 nt, Homo sapiens
augccaagauccucaauga

SEQ ID NO: 554848 - RNA, 19 nt, Homo sapiens
gcagaacuucccagccauu

SEQ ID NO: 554849 - RNA, 19 nt, Homo sapiens
gagaagcaggucaugaugu

SEQ ID NO: 554850 - RNA, 19 nt, Homo sapiens
gaugaugagacgaaguuga

SEQ ID NO: 554851 - RNA, 19 nt, Homo sapiens
agagaacgauguggacaau

SEQ ID NO: 554852 - RNA, 19 nt, Homo sapiens
gaauucuuguggcuaccaa

SEQ ID NO: 554853 - RNA, 19 nt, Homo sapiens
uacgcgcucucccuguuua

SEQ ID NO: 554854 - RNA, 19 nt, Homo sapiens
gaagaacugcccgcauauc

SEQ ID NO: 554855 - RNA, 19 nt, Homo sapiens
gaugaagaggugcugaaga

SEQ ID NO: 554856 - RNA, 19 nt, Homo sapiens
cgcucucccuguuuaguua

SEQ ID NO: 554857 - RNA, 19 nt, Homo sapiens
gcuuugagcauccgucaga

SEQ ID NO: 554858 - RNA, 19 nt, Homo sapiens
gcuuggcuaucacauuugu

SEQ ID NO: 554859 - RNA, 19 nt, Homo sapiens
ggagcgcacggaucuguau

SEQ ID NO: 554860 - RNA, 19 nt, Homo sapiens
gggugaacauugcuuuuaa

SEQ ID NO: 554861 - RNA, 19 nt, Homo sapiens
guggugaucuuugugaagu

SEQ ID NO: 554862 - RNA, 19 nt, Homo sapiens
ucuuugaccuucuggaugu

SEQ ID NO: 554863 - RNA, 19 nt, Homo sapiens
gccgcaaguucaugcaaga

SEQ ID NO: 554864 - RNA, 19 nt, Homo sapiens
auaagagccucaaccucaa

SEQ ID NO: 554865 - RNA, 19 nt, Homo sapiens
ccaagucgggcaugggaaa

SEQ ID NO: 554866 - RNA, 19 nt, Homo sapiens
caucuccuccuacauugaa

SEQ ID NO: 554867 - RNA, 19 nt, Homo sapiens
auagacaucuccuccuaca

SEQ ID NO: 554868 - RNA, 19 nt, Homo sapiens
uuucaacgacgaauucuug

SEQ ID NO: 554869 - RNA, 19 nt, Homo sapiens
gagcgcacggaucuguaua

SEQ ID NO: 554870 - RNA, 19 nt, Homo sapiens
uaagagccucaaccucaaa

SEQ ID NO: 554871 - RNA, 19 nt, Homo sapiens
ggaauaugagcgcuucucu

SEQ ID NO: 554872 - RNA, 19 nt, Homo sapiens
cggaagugaaggcagauuu

SEQ ID NO: 554873 - RNA, 19 nt, Homo sapiens
gaucagcaaggaauaugag

SEQ ID NO: 554874 - RNA, 19 nt, Homo sapiens
gcuccuaugucuccaucca

SEQ ID NO: 554875 - RNA, 19 nt, Homo sapiens
ucuuguggcuaccaaccua

SEQ ID NO: 554876 - RNA, 19 nt, Homo sapiens
guuuaguuauggcagagaa

SEQ ID NO: 554877 - RNA, 19 nt, Homo sapiens
gucgggauguccaggaaau

SEQ ID NO: 554878 - RNA, 19 nt, Homo sapiens
gcgcucucccuguuuaguu

SEQ ID NO: 554879 - RNA, 19 nt, Homo sapiens
ggacuaugaagaugaugag

SEQ ID NO: 554880 - RNA, 19 nt, Homo sapiens
aaugagcucuuggacuaug

SEQ ID NO: 554881 - RNA, 19 nt, Homo sapiens
cgagaagcaggucaugaug

SEQ ID NO: 554882 - RNA, 19 nt, Homo sapiens
gcgucgggauguccaggaa

SEQ ID NO: 554883 - RNA, 19 nt, Homo sapiens
gcgcacggaucuguauaac

SEQ ID NO: 554884 - RNA, 19 nt, Homo sapiens
acgugaaacugaaggacaa

SEQ ID NO: 554885 - RNA, 19 nt, Homo sapiens
aguacuacgugaaacugaa

SEQ ID NO: 554886 - RNA, 19 nt, Homo sapiens
guucaugcaagauccaaug

SEQ ID NO: 554887 - RNA, 19 nt, Homo sapiens
cgggauguccaggaaauuu

SEQ ID NO: 554888 - RNA, 19 nt, Homo sapiens
cauugucgacuguggcuuu

SEQ ID NO: 554889 - RNA, 19 nt, Homo sapiens
ugaaugugauaagaugcuu

SEQ ID NO: 554890 - RNA, 19 nt, Homo sapiens
gcagauuucccuccuucgu

SEQ ID NO: 554891 - RNA, 19 nt, Homo sapiens
augagcgcuucucuaaaua

SEQ ID NO: 554892 - RNA, 19 nt, Homo sapiens
uuacugggcaggugucugu

SEQ ID NO: 554893 - RNA, 19 nt, Homo sapiens
gaacgauguggacaaugag

SEQ ID NO: 554894 - RNA, 19 nt, Homo sapiens
caagauccucaaugaugug

SEQ ID NO: 554895 - RNA, 19 nt, Homo sapiens
cagagaacgauguggacaa

SEQ ID NO: 554896 - RNA, 19 nt, Homo sapiens
uggaugaugagacgaaguu

SEQ ID NO: 554897 - RNA, 19 nt, Homo sapiens
uuggaugaaugugauaaga

SEQ ID NO: 554898 - RNA, 19 nt, Homo sapiens
ggacaucgagcgggugaac

SEQ ID NO: 554899 - RNA, 19 nt, Homo sapiens
gccgaggcauggacaucga

SEQ ID NO: 554900 - RNA, 19 nt, Homo sapiens
ggugaucuuugugaagucu

SEQ ID NO: 554901 - RNA, 19 nt, Homo sapiens
gcucuuugaccuucuggau

SEQ ID NO: 554902 - RNA, 19 nt, Homo sapiens
gaaggacaacgagaagaac

SEQ ID NO: 554903 - RNA, 19 nt, Homo sapiens
cauccacagcucuggcuuu

SEQ ID NO: 554904 - RNA, 19 nt, Homo sapiens
ucagaucagcaaggaauau

SEQ ID NO: 554905 - RNA, 19 nt, Homo sapiens
caacauacauccugcauua

SEQ ID NO: 554906 - RNA, 19 nt, Homo sapiens
gaagaggacuggugucugu

SEQ ID NO: 554907 - RNA, 19 nt, Homo sapiens
gcaaugaccuccugcugaa

SEQ ID NO: 554908 - RNA, 19 nt, Homo sapiens
ggaagcaucugcacaacuu

SEQ ID NO: 554909 - RNA, 19 nt, Homo sapiens
ggacaugagugcagaugga

SEQ ID NO: 554910 - RNA, 19 nt, Homo sapiens
uuaagaagcugccuuguca

SEQ ID NO: 554911 - RNA, 19 nt, Homo sapiens
ggacauugcugcuacuucu

SEQ ID NO: 554912 - RNA, 19 nt, Homo sapiens
gaggagacaugaggaaaga

SEQ ID NO: 554913 - RNA, 19 nt, Homo sapiens
caaagcugcuggccuguga

SEQ ID NO: 554914 - RNA, 19 nt, Homo sapiens
gaagcugccuugucagauc

SEQ ID NO: 554915 - RNA, 19 nt, Homo sapiens
ggaaagguuacuugaguuu

SEQ ID NO: 554916 - RNA, 19 nt, Homo sapiens
ucugguccaucucuuauua

SEQ ID NO: 554917 - RNA, 19 nt, Homo sapiens
ccuggaagcuggauauuca

SEQ ID NO: 554918 - RNA, 19 nt, Homo sapiens
caggaaagguuacuugagu

SEQ ID NO: 554919 - RNA, 19 nt, Homo sapiens
ggcagcaucucaaucuaaa

SEQ ID NO: 554920 - RNA, 19 nt, Homo sapiens
gaccaacugggacucauua

SEQ ID NO: 554921 - RNA, 19 nt, Homo sapiens
cggagcagcugugcagaua

SEQ ID NO: 554922 - RNA, 19 nt, Homo sapiens
caacugggacucauuaugg

SEQ ID NO: 554923 - RNA, 19 nt, Homo sapiens
caacuacaacuuugacuuc

SEQ ID NO: 554924 - RNA, 19 nt, Homo sapiens
ucacuaugcugggacauug

SEQ ID NO: 554925 - RNA, 19 nt, Homo sapiens
guacaggaaagguuacuug

SEQ ID NO: 554926 - RNA, 19 nt, Homo sapiens
guguucauguugcuguuua

SEQ ID NO: 554927 - RNA, 19 nt, Homo sapiens
gagauugacaccauguuug

SEQ ID NO: 554928 - RNA, 19 nt, Homo sapiens
aaagguuacuugaguuugu

SEQ ID NO: 554929 - RNA, 19 nt, Homo sapiens
gaggcagcaucucaaucua

SEQ ID NO: 554930 - RNA, 19 nt, Homo sapiens
ggcggcagcuggcuuuguu

SEQ ID NO: 554931 - RNA, 19 nt, Homo sapiens
cggaaccagucuucagaaa

SEQ ID NO: 554932 - RNA, 19 nt, Homo sapiens
gugauucucuguguucaug

SEQ ID NO: 554933 - RNA, 19 nt, Homo sapiens
gcagcuggcuuuguuucug

SEQ ID NO: 554934 - RNA, 19 nt, Homo sapiens
gaaccagucuucagaaaac

SEQ ID NO: 554935 - RNA, 19 nt, Homo sapiens
guuuauaguuuguggaaag

SEQ ID NO: 554936 - RNA, 19 nt, Homo sapiens
cccaggacaucaucaucua

SEQ ID NO: 554937 - RNA, 19 nt, Homo sapiens
ggacagaagcuggugaucu

SEQ ID NO: 554938 - RNA, 19 nt, Homo sapiens
gaaagguuacuugaguuug

SEQ ID NO: 554939 - RNA, 19 nt, Homo sapiens
guccugggcuggaaucauc

SEQ ID NO: 554940 - RNA, 19 nt, Homo sapiens
cauccugcauuacaugaau

SEQ ID NO: 554941 - RNA, 19 nt, Homo sapiens
gauucucuguguucauguu

SEQ ID NO: 554942 - RNA, 19 nt, Homo sapiens
gagaggagacaugaggaaa

SEQ ID NO: 554943 - RNA, 19 nt, Homo sapiens
ggaccaacugggacucauu

SEQ ID NO: 554944 - RNA, 19 nt, Homo sapiens
ucauguugcuguuuauagu

SEQ ID NO: 554945 - RNA, 19 nt, Homo sapiens
ucauguggcuguacuuaac

SEQ ID NO: 554946 - RNA, 19 nt, Homo sapiens
ggauguggugguccaguuu

SEQ ID NO: 554947 - RNA, 19 nt, Homo sapiens
ugagauugacaccauguuu

SEQ ID NO: 554948 - RNA, 19 nt, Homo sapiens
guucaucaccaucuuggaa

SEQ ID NO: 554949 - RNA, 19 nt, Homo sapiens
cuggaugccuccuuugaug

SEQ ID NO: 554950 - RNA, 19 nt, Homo sapiens
gagcuggccagucgacuuc

SEQ ID NO: 554951 - RNA, 19 nt, Homo sapiens
ggagaaccaaggaugagau

SEQ ID NO: 554952 - RNA, 19 nt, Homo sapiens
gcaucucaaucuaaacaac

SEQ ID NO: 554953 - RNA, 19 nt, Homo sapiens
cuugucagaucaccagcua

SEQ ID NO: 554954 - RNA, 19 nt, Homo sapiens
gcaguucaucaccaucuug

SEQ ID NO: 554955 - RNA, 19 nt, Homo sapiens
ucaguauucugguccaucu

SEQ ID NO: 554956 - RNA, 19 nt, Homo sapiens
cagcaucucaaucuaaaca

SEQ ID NO: 554957 - RNA, 19 nt, Homo sapiens
ggaaugcuggguuuuauga

SEQ ID NO: 554958 - RNA, 19 nt, Homo sapiens
gcuccugggauacguacua

SEQ ID NO: 554959 - RNA, 19 nt, Homo sapiens
cauacauccugcauuacau

SEQ ID NO: 554960 - RNA, 19 nt, Homo sapiens
uacuuaaccuucuccaaca

SEQ ID NO: 554961 - RNA, 19 nt, Homo sapiens
guacugcugauccggagaa

SEQ ID NO: 554962 - RNA, 19 nt, Homo sapiens
gagcagcugugcagauacc

SEQ ID NO: 554963 - RNA, 19 nt, Homo sapiens
aggaaagguuacuugaguu

SEQ ID NO: 554964 - RNA, 19 nt, Homo sapiens
gaagcaucugcacaacuuu

SEQ ID NO: 554965 - RNA, 19 nt, Homo sapiens
ggagcuggccagucgacuu

SEQ ID NO: 554966 - RNA, 19 nt, Homo sapiens
guuaagaagcugccuuguc

SEQ ID NO: 554967 - RNA, 19 nt, Homo sapiens
ccaacuacaacuuugacuu

SEQ ID NO: 554968 - RNA, 19 nt, Homo sapiens
ccaaaguggugccguuuuc

SEQ ID NO: 554969 - RNA, 19 nt, Homo sapiens
ucucaccacuguuccucuu

SEQ ID NO: 554970 - RNA, 19 nt, Homo sapiens
ccaacugggacucauuaug

SEQ ID NO: 554971 - RNA, 19 nt, Homo sapiens
gccauguccuacccagaug

SEQ ID NO: 554972 - RNA, 19 nt, Homo sapiens
cagcagacacccuccucaa

SEQ ID NO: 554973 - RNA, 19 nt, Homo sapiens
guucauguugcuguuuaua

SEQ ID NO: 554974 - RNA, 19 nt, Homo sapiens
gagaaccaaggaugagauc

SEQ ID NO: 554975 - RNA, 19 nt, Homo sapiens
ccucauucauguggcugua

SEQ ID NO: 554976 - RNA, 19 nt, Homo sapiens
uauuugugauucucugugu

SEQ ID NO: 554977 - RNA, 19 nt, Homo sapiens
gauguggugguccaguuug

SEQ ID NO: 554978 - RNA, 19 nt, Homo sapiens
aagcugccuugucagauca

SEQ ID NO: 554979 - RNA, 19 nt, Homo sapiens
aagaagcugccuugucaga

SEQ ID NO: 554980 - RNA, 19 nt, Homo sapiens
ggcaguucaucaccaucuu

SEQ ID NO: 554981 - RNA, 19 nt, Homo sapiens
acauacauccugcauuaca

SEQ ID NO: 554982 - RNA, 19 nt, Homo sapiens
ugagaggagacaugaggaa

SEQ ID NO: 554983 - RNA, 19 nt, Homo sapiens
ggacucauuauggaagaau

SEQ ID NO: 554984 - RNA, 19 nt, Homo sapiens
gcuccuaccaggcagaaca

SEQ ID NO: 554985 - RNA, 19 nt, Homo sapiens
uauucugguccaucucuua

SEQ ID NO: 554986 - RNA, 19 nt, Homo sapiens
aggcagcaucucaaucuaa

SEQ ID NO: 554987 - RNA, 19 nt, Homo sapiens
gcuugccaacuacaacuuu

SEQ ID NO: 554988 - RNA, 19 nt, Homo sapiens
ggaaccagucuucagaaaa

SEQ ID NO: 554989 - RNA, 19 nt, Homo sapiens
ccaacauacauccugcauu

SEQ ID NO: 554990 - RNA, 19 nt, Homo sapiens
cuuaaccuucuccaacaua

SEQ ID NO: 554991 - RNA, 19 nt, Homo sapiens
gggacucauuauggaagaa

SEQ ID NO: 554992 - RNA, 19 nt, Homo sapiens
cccgugcccuggagaaaca

SEQ ID NO: 554993 - RNA, 19 nt, Homo sapiens
gcacacaacuucacugaug

SEQ ID NO: 554994 - RNA, 19 nt, Homo sapiens
uaaaguggcuggugaaaga

SEQ ID NO: 554995 - RNA, 19 nt, Homo sapiens
ggauaaacaucaaacauca

SEQ ID NO: 554996 - RNA, 19 nt, Homo sapiens
gaacuagucuugggaacaa

SEQ ID NO: 554997 - RNA, 19 nt, Homo sapiens
caauguaggugggaacuua

SEQ ID NO: 554998 - RNA, 19 nt, Homo sapiens
gaaucuggcugcugacuug

SEQ ID NO: 554999 - RNA, 19 nt, Homo sapiens
gcacucacaugaagauuuc

SEQ ID NO: 555000 - RNA, 19 nt, Homo sapiens
gaucucagcagcuccauuu

SEQ ID NO: 555001 - RNA, 19 nt, Homo sapiens
cggcaucgcucucuacuuc

SEQ ID NO: 555002 - RNA, 19 nt, Homo sapiens
cacaaugacuguccugcua

SEQ ID NO: 555003 - RNA, 19 nt, Homo sapiens
cuucagaucuugcucaguu

SEQ ID NO: 555004 - RNA, 19 nt, Homo sapiens
gcugugcccuucucacuga

SEQ ID NO: 555005 - RNA, 19 nt, Homo sapiens
ggugguaaccggaaauaaa

SEQ ID NO: 555006 - RNA, 19 nt, Homo sapiens
ugacuguccugcuacauga

SEQ ID NO: 555007 - RNA, 19 nt, Homo sapiens
gacaagagcguucuaccaa

SEQ ID NO: 555008 - RNA, 19 nt, Homo sapiens
ggugggaacuuaagggaau

SEQ ID NO: 555009 - RNA, 19 nt, Homo sapiens
ccaaguugcuacacaggaa

SEQ ID NO: 555010 - RNA, 19 nt, Homo sapiens
gacauucacaugaggauuu

SEQ ID NO: 555011 - RNA, 19 nt, Homo sapiens
ggaggugguucgggauaaa

SEQ ID NO: 555012 - RNA, 19 nt, Homo sapiens
gcacgacgaucugcaagag

SEQ ID NO: 555013 - RNA, 19 nt, Homo sapiens
guaaagcggacccugugua

SEQ ID NO: 555014 - RNA, 19 nt, Homo sapiens
ugggagcaaugguuacuuu

SEQ ID NO: 555015 - RNA, 19 nt, Homo sapiens
ggagcacaguacccaaaga

SEQ ID NO: 555016 - RNA, 19 nt, Homo sapiens
ggagaaauuugugagacau

SEQ ID NO: 555017 - RNA, 19 nt, Homo sapiens
ucacgaccauggacauuca

SEQ ID NO: 555018 - RNA, 19 nt, Homo sapiens
gagggaggcaucaccauug

SEQ ID NO: 555019 - RNA, 19 nt, Homo sapiens
gggauaaacaucaaacauc

SEQ ID NO: 555020 - RNA, 19 nt, Homo sapiens
ggacacgcucacagucaua

SEQ ID NO: 555021 - RNA, 19 nt, Homo sapiens
ggaauuguugccuuucuug

SEQ ID NO: 555022 - RNA, 19 nt, Homo sapiens
ggaccuggaugcugucacu

SEQ ID NO: 555023 - RNA, 19 nt, Homo sapiens
gcagagcucagaggaagaa

SEQ ID NO: 555024 - RNA, 19 nt, Homo sapiens
gggaggugguucgggauaa

SEQ ID NO: 555025 - RNA, 19 nt, Homo sapiens
acauucacaugaggauuua

SEQ ID NO: 555026 - RNA, 19 nt, Homo sapiens
ccacaggcacucacaugaa

SEQ ID NO: 555027 - RNA, 19 nt, Homo sapiens
ugacuuggcacacaacuuc

SEQ ID NO: 555028 - RNA, 19 nt, Homo sapiens
ggcacugucugaccauguu

SEQ ID NO: 555029 - RNA, 19 nt, Homo sapiens
gaagcagagcucagaggaa

SEQ ID NO: 555030 - RNA, 19 nt, Homo sapiens
ggagcaacccggacaugga

SEQ ID NO: 555031 - RNA, 19 nt, Homo sapiens
gcauggacauacccacgau

SEQ ID NO: 555032 - RNA, 19 nt, Homo sapiens
caguggaauuguugccuuu

SEQ ID NO: 555033 - RNA, 19 nt, Homo sapiens
ggaggcaucaccauugcaa

SEQ ID NO: 555034 - RNA, 19 nt, Homo sapiens
gagcacaguacccaaagau

SEQ ID NO: 555035 - RNA, 19 nt, Homo sapiens
gcgaggagggagcacagua

SEQ ID NO: 555036 - RNA, 19 nt, Homo sapiens
ggaagacaagagcguucua

SEQ ID NO: 555037 - RNA, 19 nt, Homo sapiens
gcucucuacuucagaucuu

SEQ ID NO: 555038 - RNA, 19 nt, Homo sapiens
ggauaaagagaacuagucu

SEQ ID NO: 555039 - RNA, 19 nt, Homo sapiens
ccagagggaccauaguguu

SEQ ID NO: 555040 - RNA, 19 nt, Homo sapiens
gccaaaggaaggaacugua

SEQ ID NO: 555041 - RNA, 19 nt, Homo sapiens
aaauaaagaccuccgaucu

SEQ ID NO: 555042 - RNA, 19 nt, Homo sapiens
acaggaaguucuccaaggu

SEQ ID NO: 555043 - RNA, 19 nt, Homo sapiens
ccacagaggacauggacau

SEQ ID NO: 555044 - RNA, 19 nt, Homo sapiens
ucaagggcuggcagucuua

SEQ ID NO: 555045 - RNA, 19 nt, Homo sapiens
ccaaaggaaggaacuguag

SEQ ID NO: 555046 - RNA, 19 nt, Homo sapiens
agggacaucugccaaagga

SEQ ID NO: 555047 - RNA, 19 nt, Homo sapiens
ggcuggguccugccauuua

SEQ ID NO: 555048 - RNA, 19 nt, Homo sapiens
cacaggcacucacaugaag

SEQ ID NO: 555049 - RNA, 19 nt, Homo sapiens
ucaaacaucaaucgugugu

SEQ ID NO: 555050 - RNA, 19 nt, Homo sapiens
ggcgaugcgucugcaacua

SEQ ID NO: 555051 - RNA, 19 nt, Homo sapiens
gaucacgaccauggacauu

SEQ ID NO: 555052 - RNA, 19 nt, Homo sapiens
acaugaagauuuccaccau

SEQ ID NO: 555053 - RNA, 19 nt, Homo sapiens
cagagggaccauaguguug

SEQ ID NO: 555054 - RNA, 19 nt, Homo sapiens
caaagaugggccagugaga

SEQ ID NO: 555055 - RNA, 19 nt, Homo sapiens
ggcacucacaugaagauuu

SEQ ID NO: 555056 - RNA, 19 nt, Homo sapiens
aguggcuggugaaagauua

SEQ ID NO: 555057 - RNA, 19 nt, Homo sapiens
gggauaaagagaacuaguc

SEQ ID NO: 555058 - RNA, 19 nt, Homo sapiens
caaugacuguccugcuaca

SEQ ID NO: 555059 - RNA, 19 nt, Homo sapiens
ggacauggacacgcucaca

SEQ ID NO: 555060 - RNA, 19 nt, Homo sapiens
ugugagacaugugaaagga

SEQ ID NO: 555061 - RNA, 19 nt, Homo sapiens
agaaauuugugagacaugu

SEQ ID NO: 555062 - RNA, 19 nt, Homo sapiens
uaaagcggacccuguguag

SEQ ID NO: 555063 - RNA, 19 nt, Homo sapiens
ccucauuccucaugcucuu

SEQ ID NO: 555064 - RNA, 19 nt, Homo sapiens
gucugaccauguugcauuu

SEQ ID NO: 555065 - RNA, 19 nt, Homo sapiens
cuagggauccugaccacaa

SEQ ID NO: 555066 - RNA, 19 nt, Homo sapiens
caagagggguucagaagag

SEQ ID NO: 555067 - RNA, 19 nt, Homo sapiens
gaggacauggucacaguca

SEQ ID NO: 555068 - RNA, 19 nt, Homo sapiens
uggagaaauuugugagaca

SEQ ID NO: 555069 - RNA, 19 nt, Homo sapiens
guauucucauggccugauu

SEQ ID NO: 555070 - RNA, 19 nt, Homo sapiens
gaaauuugugagacaugug

SEQ ID NO: 555071 - RNA, 19 nt, Homo sapiens
aaacaucaaacaucaaucg

SEQ ID NO: 555072 - RNA, 19 nt, Homo sapiens
cuguguagguauagaguug

SEQ ID NO: 555073 - RNA, 19 nt, Homo sapiens
agaaccaaguugcuacaca

SEQ ID NO: 555074 - RNA, 19 nt, Homo sapiens
ggagaaccaaguugcuaca

SEQ ID NO: 555075 - RNA, 19 nt, Homo sapiens
ccagggacaucugccaaag

SEQ ID NO: 555076 - RNA, 19 nt, Homo sapiens
ugagggaggcaucaccauu

SEQ ID NO: 555077 - RNA, 19 nt, Homo sapiens
gugguaaccggaaauaaag

SEQ ID NO: 555078 - RNA, 19 nt, Homo sapiens
gaccauguugcauuuggaa

SEQ ID NO: 555079 - RNA, 19 nt, Homo sapiens
ugucugaccauguugcauu

SEQ ID NO: 555080 - RNA, 19 nt, Homo sapiens
gcuggguccugccauuuac

SEQ ID NO: 555081 - RNA, 19 nt, Homo sapiens
gaagacaagagcguucuac

SEQ ID NO: 555082 - RNA, 19 nt, Homo sapiens
gagaaauuugugagacaug

SEQ ID NO: 555083 - RNA, 19 nt, Homo sapiens
gguucucaguggaauuguu

SEQ ID NO: 555084 - RNA, 19 nt, Homo sapiens
ucaccacacucuggagcaa

SEQ ID NO: 555085 - RNA, 19 nt, Homo sapiens
gcaucgcucucuacuucag

SEQ ID NO: 555086 - RNA, 19 nt, Homo sapiens
ggacauucacaugaggauu

SEQ ID NO: 555087 - RNA, 19 nt, Homo sapiens
gccacaggcacucacauga

SEQ ID NO: 555088 - RNA, 19 nt, Homo sapiens
gcuggagcggugagaauga

SEQ ID NO: 555089 - RNA, 19 nt, Homo sapiens
ggagcaaugguuacuuugg

SEQ ID NO: 555090 - RNA, 19 nt, Homo sapiens
gggauccugaccacaauga

SEQ ID NO: 555091 - RNA, 19 nt, Homo sapiens
uagggauccugaccacaau

SEQ ID NO: 555092 - RNA, 19 nt, Homo sapiens
gaauuguugccuuucuugu

SEQ ID NO: 555093 - RNA, 19 nt, Homo sapiens
caacaucaguagcaucgua

SEQ ID NO: 555094 - RNA, 19 nt, Homo sapiens
ggacaagauuacugaaaug

SEQ ID NO: 555095 - RNA, 19 nt, Homo sapiens
gaagauaguggauacauca

SEQ ID NO: 555096 - RNA, 19 nt, Homo sapiens
ggaagucacuggaggucuu

SEQ ID NO: 555097 - RNA, 19 nt, Homo sapiens
caagauuacugaaaugauc

SEQ ID NO: 555098 - RNA, 19 nt, Homo sapiens
caacacccaugacacagaa

SEQ ID NO: 555099 - RNA, 19 nt, Homo sapiens
gaaagugguggacaagauu

SEQ ID NO: 555100 - RNA, 19 nt, Homo sapiens
gacaugggauccgcuguaa

SEQ ID NO: 555101 - RNA, 19 nt, Homo sapiens
caaaagggguggcagugua

SEQ ID NO: 555102 - RNA, 19 nt, Homo sapiens
acucuaaguucccaggaua

SEQ ID NO: 555103 - RNA, 19 nt, Homo sapiens
gcacaugucugaggaugac

SEQ ID NO: 555104 - RNA, 19 nt, Homo sapiens
gaaagugccacagaaagug

SEQ ID NO: 555105 - RNA, 19 nt, Homo sapiens
agaaagugguggacaagau

SEQ ID NO: 555106 - RNA, 19 nt, Homo sapiens
cacagaaagugccacagaa

SEQ ID NO: 555107 - RNA, 19 nt, Homo sapiens
uggcagauguggucgcauu

SEQ ID NO: 555108 - RNA, 19 nt, Homo sapiens
gcaccuuccuagucacuca

SEQ ID NO: 555109 - RNA, 19 nt, Homo sapiens
uaaguucccaggauacaaa

SEQ ID NO: 555110 - RNA, 19 nt, Homo sapiens
uggacaagauuacugaaau

SEQ ID NO: 555111 - RNA, 19 nt, Homo sapiens
ucaguagcaucguaggaaa

SEQ ID NO: 555112 - RNA, 19 nt, Homo sapiens
gaggaugacugggacaaag

SEQ ID NO: 555113 - RNA, 19 nt, Homo sapiens
cgacaugggauccgcugua

SEQ ID NO: 555114 - RNA, 19 nt, Homo sapiens
cacaagcccugguguccaa

SEQ ID NO: 555115 - RNA, 19 nt, Homo sapiens
cuugugacccuaauaaauu

SEQ ID NO: 555116 - RNA, 19 nt, Homo sapiens
gcaacacccaugacacaga

SEQ ID NO: 555117 - RNA, 19 nt, Homo sapiens
gacaagauuacugaaauga

SEQ ID NO: 555118 - RNA, 19 nt, Homo sapiens
cacagaaagugguggacaa

SEQ ID NO: 555119 - RNA, 19 nt, Homo sapiens
gugcuugugacccuaauaa

SEQ ID NO: 555120 - RNA, 19 nt, Homo sapiens
gcccugguguccaaugguu

SEQ ID NO: 555121 - RNA, 19 nt, Homo sapiens
ugaagauaguggauacauc

SEQ ID NO: 555122 - RNA, 19 nt, Homo sapiens
aaagugguggacaagauua

SEQ ID NO: 555123 - RNA, 19 nt, Homo sapiens
acagaaagugccacagaaa

SEQ ID NO: 555124 - RNA, 19 nt, Homo sapiens
uaaauuccaaguccucuuc

SEQ ID NO: 555125 - RNA, 19 nt, Homo sapiens
gcuugugacccuaauaaau

SEQ ID NO: 555126 - RNA, 19 nt, Homo sapiens
cagauguggucgcauucuu

SEQ ID NO: 555127 - RNA, 19 nt, Homo sapiens
acacagaaagugccacaga

SEQ ID NO: 555128 - RNA, 19 nt, Homo sapiens
gaagucacuggaggucuuu

SEQ ID NO: 555129 - RNA, 19 nt, Homo sapiens
cugaggauguggcagaugu

SEQ ID NO: 555130 - RNA, 19 nt, Homo sapiens
ugucgugguuccaucauca

SEQ ID NO: 555131 - RNA, 19 nt, Homo sapiens
agaaagugccacagaaagu

SEQ ID NO: 555132 - RNA, 19 nt, Homo sapiens
uccaaugguugucgugguu

SEQ ID NO: 555133 - RNA, 19 nt, Homo sapiens
ucauagcugucaaccucaa

SEQ ID NO: 555134 - RNA, 19 nt, Homo sapiens
cugaugaggacucuaaguu

SEQ ID NO: 555135 - RNA, 19 nt, Homo sapiens
guggacaagauuacugaaa

SEQ ID NO: 555136 - RNA, 19 nt, Homo sapiens
ucgcauucuuggcaucuga

SEQ ID NO: 555137 - RNA, 19 nt, Homo sapiens
gugguuccaucaucaacau

SEQ ID NO: 555138 - RNA, 19 nt, Homo sapiens
cagaaagugccacagaaag

SEQ ID NO: 555139 - RNA, 19 nt, Homo sapiens
ugaugaggacucuaaguuc

SEQ ID NO: 555140 - RNA, 19 nt, Homo sapiens
caugggauccgcuguaacu

SEQ ID NO: 555141 - RNA, 19 nt, Homo sapiens
gacucuaaguucccaggau

SEQ ID NO: 555142 - RNA, 19 nt, Homo sapiens
cugcugaugaggacucuaa

SEQ ID NO: 555143 - RNA, 19 nt, Homo sapiens
cacagggaccucaguggaa

SEQ ID NO: 555144 - RNA, 19 nt, Homo sapiens
acaaagucauagcugucaa

SEQ ID NO: 555145 - RNA, 19 nt, Homo sapiens
cuggaggucuuuucaugua

SEQ ID NO: 555146 - RNA, 19 nt, Homo sapiens
gaguuucugcugcacaugu

SEQ ID NO: 555147 - RNA, 19 nt, Homo sapiens
gaaagagacuccagggaaa

SEQ ID NO: 555148 - RNA, 19 nt, Homo sapiens
gaagacaccuccuacaaug

SEQ ID NO: 555149 - RNA, 19 nt, Homo sapiens
gggcagugcugaggauuaa

SEQ ID NO: 555150 - RNA, 19 nt, Homo sapiens
caaagaagaccaucagcuu

SEQ ID NO: 555151 - RNA, 19 nt, Homo sapiens
ucacuuaacccucucguau

SEQ ID NO: 555152 - RNA, 19 nt, Homo sapiens
uaauucgacucuccuguga

SEQ ID NO: 555153 - RNA, 19 nt, Homo sapiens
caaguucuuuggucucuuc

SEQ ID NO: 555154 - RNA, 19 nt, Homo sapiens
guucuuuggucucuucuau

SEQ ID NO: 555155 - RNA, 19 nt, Homo sapiens
ggucccagcucuaauucga

SEQ ID NO: 555156 - RNA, 19 nt, Homo sapiens
gcacucaggagguuacuag

SEQ ID NO: 555157 - RNA, 19 nt, Homo sapiens
gcucagucauugcugucua

SEQ ID NO: 555158 - RNA, 19 nt, Homo sapiens
gugaagacaccuccuacaa

SEQ ID NO: 555159 - RNA, 19 nt, Homo sapiens
gcuccacucuccaauguac

SEQ ID NO: 555160 - RNA, 19 nt, Homo sapiens
ugaagacaccuccuacaau

SEQ ID NO: 555161 - RNA, 19 nt, Homo sapiens
gcaacacacucaucauccu

SEQ ID NO: 555162 - RNA, 19 nt, Homo sapiens
gccucauccuugucucuua

SEQ ID NO: 555163 - RNA, 19 nt, Homo sapiens
gagauaaagcgagcacuca

SEQ ID NO: 555164 - RNA, 19 nt, Homo sapiens
aagcuccacucuccaaugu

SEQ ID NO: 555165 - RNA, 19 nt, Homo sapiens
ggagguuacuagggaagga

SEQ ID NO: 555166 - RNA, 19 nt, Homo sapiens
ugaggucccagcucuaauu

SEQ ID NO: 555167 - RNA, 19 nt, Homo sapiens
ugaggaacaaggagauaaa

SEQ ID NO: 555168 - RNA, 19 nt, Homo sapiens
guauacacccugaggaaca

SEQ ID NO: 555169 - RNA, 19 nt, Homo sapiens
ggacucucuucguggaugu

SEQ ID NO: 555170 - RNA, 19 nt, Homo sapiens
ucuccaaccucuccuucuu

SEQ ID NO: 555171 - RNA, 19 nt, Homo sapiens
gggcaacacacucaucauc

SEQ ID NO: 555172 - RNA, 19 nt, Homo sapiens
cacuuaacccucucguaua

SEQ ID NO: 555173 - RNA, 19 nt, Homo sapiens
uauacacccugaggaacaa

SEQ ID NO: 555174 - RNA, 19 nt, Homo sapiens
gggcacuccuucacuuaac

SEQ ID NO: 555175 - RNA, 19 nt, Homo sapiens
ucacuguggucacccucuu

SEQ ID NO: 555176 - RNA, 19 nt, Homo sapiens
caucacuuccuaccuccua

SEQ ID NO: 555177 - RNA, 19 nt, Homo sapiens
gcagguggaugauuuuguc

SEQ ID NO: 555178 - RNA, 19 nt, Homo sapiens
gugggcacuccuucacuua

SEQ ID NO: 555179 - RNA, 19 nt, Homo sapiens
cuucugggcuucucugaac

SEQ ID NO: 555180 - RNA, 19 nt, Homo sapiens
acuuaacccucucguauac

SEQ ID NO: 555181 - RNA, 19 nt, Homo sapiens
gcaaguucuuuggucucuu

SEQ ID NO: 555182 - RNA, 19 nt, Homo sapiens
ccacuaugccaccaucauc

SEQ ID NO: 555183 - RNA, 19 nt, Homo sapiens
gagugcauccucaugaaag

SEQ ID NO: 555184 - RNA, 19 nt, Homo sapiens
ggcaaguucuuuggucucu

SEQ ID NO: 555185 - RNA, 19 nt, Homo sapiens
ggacaccaagcuccacucu

SEQ ID NO: 555186 - RNA, 19 nt, Homo sapiens
caagcuccacucuccaaug

SEQ ID NO: 555187 - RNA, 19 nt, Homo sapiens
gaucggcagguggaugauu

SEQ ID NO: 555188 - RNA, 19 nt, Homo sapiens
gcagugcugaggauuaacu

SEQ ID NO: 555189 - RNA, 19 nt, Homo sapiens
gacaccuccuacaaugaga

SEQ ID NO: 555190 - RNA, 19 nt, Homo sapiens
ucuguggccugggucauug

SEQ ID NO: 555191 - RNA, 19 nt, Homo sapiens
ccucauccuugucucuuac

SEQ ID NO: 555192 - RNA, 19 nt, Homo sapiens
cgacucuccugugaagaca

SEQ ID NO: 555193 - RNA, 19 nt, Homo sapiens
ugugaggucccagcucuaa

SEQ ID NO: 555194 - RNA, 19 nt, Homo sapiens
gaacagagcuggauuccuu

SEQ ID NO: 555195 - RNA, 19 nt, Homo sapiens
acacugagguggaagcuua

SEQ ID NO: 555196 - RNA, 19 nt, Homo sapiens
gaaagggaauacucucuau

SEQ ID NO: 555197 - RNA, 19 nt, Homo sapiens
caaagcagcuggugaaguc

SEQ ID NO: 555198 - RNA, 19 nt, Homo sapiens
gguggaagcuuacacaucu

SEQ ID NO: 555199 - RNA, 19 nt, Homo sapiens
caacagagcaggcaaagca

SEQ ID NO: 555200 - RNA, 19 nt, Homo sapiens
ggaaagggaauacucucua

SEQ ID NO: 555201 - RNA, 19 nt, Homo sapiens
caaaguagcagcagcacaa

SEQ ID NO: 555202 - RNA, 19 nt, Homo sapiens
cagccaagguggugucaaa

SEQ ID NO: 555203 - RNA, 19 nt, Homo sapiens
ggacccagguggagucugu

SEQ ID NO: 555204 - RNA, 19 nt, Homo sapiens
gaugacgucuacaaggaaa

SEQ ID NO: 555205 - RNA, 19 nt, Homo sapiens
ggacacagccacagcaaca

SEQ ID NO: 555206 - RNA, 19 nt, Homo sapiens
gacaagaggacccagauug

SEQ ID NO: 555207 - RNA, 19 nt, Homo sapiens
gaggaaaucucuguaugag

SEQ ID NO: 555208 - RNA, 19 nt, Homo sapiens
gugaugacgucuacaagga

SEQ ID NO: 555209 - RNA, 19 nt, Homo sapiens
gcauaucugcugaugauga

SEQ ID NO: 555210 - RNA, 19 nt, Homo sapiens
cagauugucuacagugaug

SEQ ID NO: 555211 - RNA, 19 nt, Homo sapiens
ggacccagauugucuacag

SEQ ID NO: 555212 - RNA, 19 nt, Homo sapiens
uaugagagcuuugugucuu

SEQ ID NO: 555213 - RNA, 19 nt, Homo sapiens
ucauugaccucuccaugga

SEQ ID NO: 555214 - RNA, 19 nt, Homo sapiens
ggacaagaggacccagauu

SEQ ID NO: 555215 - RNA, 19 nt, Homo sapiens
gcucugaagaagcaaagua

SEQ ID NO: 555216 - RNA, 19 nt, Homo sapiens
ccaaugcuggucucaguaa

SEQ ID NO: 555217 - RNA, 19 nt, Homo sapiens
gaugaugaccugcaagagu

SEQ ID NO: 555218 - RNA, 19 nt, Homo sapiens
cagguuugaucucagugua

SEQ ID NO: 555219 - RNA, 19 nt, Homo sapiens
cuacagugaugacgucuac

SEQ ID NO: 555220 - RNA, 19 nt, Homo sapiens
aggaggcucugcagaagaa

SEQ ID NO: 555221 - RNA, 19 nt, Homo sapiens
agggaauacucucuaugua

SEQ ID NO: 555222 - RNA, 19 nt, Homo sapiens
gcugucagguuugaucuca

SEQ ID NO: 555223 - RNA, 19 nt, Homo sapiens
ggauugggguuaagccuuu

SEQ ID NO: 555224 - RNA, 19 nt, Homo sapiens
guaaaacacugagguggaa

SEQ ID NO: 555225 - RNA, 19 nt, Homo sapiens
gcagaagaaauucaacaag

SEQ ID NO: 555226 - RNA, 19 nt, Homo sapiens
gaagucaggagccaucagu

SEQ ID NO: 555227 - RNA, 19 nt, Homo sapiens
ugucaaacgcucacuauca

SEQ ID NO: 555228 - RNA, 19 nt, Homo sapiens
agaccgggaucgagacaga

SEQ ID NO: 555229 - RNA, 19 nt, Homo sapiens
caagaacucaggcuucaag

SEQ ID NO: 555230 - RNA, 19 nt, Homo sapiens
caaugcuggucucaguaaa

SEQ ID NO: 555231 - RNA, 19 nt, Homo sapiens
caacauagcccgaaaacag

SEQ ID NO: 555232 - RNA, 19 nt, Homo sapiens
gucaaacgcucacuaucag

SEQ ID NO: 555233 - RNA, 19 nt, Homo sapiens
cagagcagccugucaugga

SEQ ID NO: 555234 - RNA, 19 nt, Homo sapiens
agaagaaauucaacaagcu

SEQ ID NO: 555235 - RNA, 19 nt, Homo sapiens
ggacccacccagaaacugu

SEQ ID NO: 555236 - RNA, 19 nt, Homo sapiens
gcaaagcagcuggugaagu

SEQ ID NO: 555237 - RNA, 19 nt, Homo sapiens
gaaauucaacaagcucaag

SEQ ID NO: 555238 - RNA, 19 nt, Homo sapiens
aggcauugcuggcucugaa

SEQ ID NO: 555239 - RNA, 19 nt, Homo sapiens
gugccuucgucaccuauga

SEQ ID NO: 555240 - RNA, 19 nt, Homo sapiens
ccauggacccacccagaaa

SEQ ID NO: 555241 - RNA, 19 nt, Homo sapiens
ggaucgagacagagacaga

SEQ ID NO: 555242 - RNA, 19 nt, Homo sapiens
ggugucaaacgcucacuau

SEQ ID NO: 555243 - RNA, 19 nt, Homo sapiens
gaggaggcucugcagaaga

SEQ ID NO: 555244 - RNA, 19 nt, Homo sapiens
ucaaggcugagaccaagaa

SEQ ID NO: 555245 - RNA, 19 nt, Homo sapiens
cuguacagcucaaagucaa

SEQ ID NO: 555246 - RNA, 19 nt, Homo sapiens
aaagauggagucagcagau

SEQ ID NO: 555247 - RNA, 19 nt, Homo sapiens
cgagaacuaggaccagaug

SEQ ID NO: 555248 - RNA, 19 nt, Homo sapiens
aggcaaagcagcuggugaa

SEQ ID NO: 555249 - RNA, 19 nt, Homo sapiens
caagaggacccagauuguc

SEQ ID NO: 555250 - RNA, 19 nt, Homo sapiens
aagggaauacucucuaugu

SEQ ID NO: 555251 - RNA, 19 nt, Homo sapiens
uaucagagcagccugucau

SEQ ID NO: 555252 - RNA, 19 nt, Homo sapiens
ggauuccuugugccucaua

SEQ ID NO: 555253 - RNA, 19 nt, Homo sapiens
cccagauugucuacaguga

SEQ ID NO: 555254 - RNA, 19 nt, Homo sapiens
ccgcaggucggauucauuc

SEQ ID NO: 555255 - RNA, 19 nt, Homo sapiens
agaggaaccgggacagaga

SEQ ID NO: 555256 - RNA, 19 nt, Homo sapiens
gcauugcuggcucugaaga

SEQ ID NO: 555257 - RNA, 19 nt, Homo sapiens
cagcaacagagcaggcaaa

SEQ ID NO: 555258 - RNA, 19 nt, Homo sapiens
ugucagguuugaucucagu

SEQ ID NO: 555259 - RNA, 19 nt, Homo sapiens
ccuuguggauggcuucuag

SEQ ID NO: 555260 - RNA, 19 nt, Homo sapiens
cauaucugcugaugaugac

SEQ ID NO: 555261 - RNA, 19 nt, Homo sapiens
gacccagauugucuacagu

SEQ ID NO: 555262 - RNA, 19 nt, Homo sapiens
guacagcucaaagucaaca

SEQ ID NO: 555263 - RNA, 19 nt, Homo sapiens
accaagaacucaggcuuca

SEQ ID NO: 555264 - RNA, 19 nt, Homo sapiens
gguuugaucucaguguaac

SEQ ID NO: 555265 - RNA, 19 nt, Homo sapiens
gaucucaguguaacgacau

SEQ ID NO: 555266 - RNA, 19 nt, Homo sapiens
acacagccacagcaacaga

SEQ ID NO: 555267 - RNA, 19 nt, Homo sapiens
acagugaugacgucuacaa

SEQ ID NO: 555268 - RNA, 19 nt, Homo sapiens
acagcucaaagucaacaua

SEQ ID NO: 555269 - RNA, 19 nt, Homo sapiens
cagcacaaccagccaaggu

SEQ ID NO: 555270 - RNA, 19 nt, Homo sapiens
gagcaggaacuccacuaug

SEQ ID NO: 555271 - RNA, 19 nt, Homo sapiens
cugcauugcugagaacaaa

SEQ ID NO: 555272 - RNA, 19 nt, Homo sapiens
gaacuccacuaugcaucuc

SEQ ID NO: 555273 - RNA, 19 nt, Homo sapiens
ggaacuccacuaugcaucu

SEQ ID NO: 555274 - RNA, 19 nt, Homo sapiens
gcaggaacuccacuaugca

SEQ ID NO: 555275 - RNA, 19 nt, Homo sapiens
caccaaggaggauccaaga

SEQ ID NO: 555276 - RNA, 19 nt, Homo sapiens
agcaggaacuccacuaugc

SEQ ID NO: 555277 - RNA, 19 nt, Homo sapiens
gauccaagagcugacuaug

SEQ ID NO: 555278 - RNA, 19 nt, Homo sapiens
caacaaagcuucauuagca

SEQ ID NO: 555279 - RNA, 19 nt, Homo sapiens
gaucagagauucagaugug

SEQ ID NO: 555280 - RNA, 19 nt, Homo sapiens
ggacacaugcucaaauuaa

SEQ ID NO: 555281 - RNA, 19 nt, Homo sapiens
acagaacucuucaggaaua

SEQ ID NO: 555282 - RNA, 19 nt, Homo sapiens
guacagacuuaauguuuga

SEQ ID NO: 555283 - RNA, 19 nt, Homo sapiens
uuacagaacucuucaggaa

SEQ ID NO: 555284 - RNA, 19 nt, Homo sapiens
caaauuaaagggagacaua

SEQ ID NO: 555285 - RNA, 19 nt, Homo sapiens
ugaaggagaugaugagaau

SEQ ID NO: 555286 - RNA, 19 nt, Homo sapiens
gcauugaccuggcaucuca

SEQ ID NO: 555287 - RNA, 19 nt, Homo sapiens
cuacucaccugauaaagaa

SEQ ID NO: 555288 - RNA, 19 nt, Homo sapiens
cugaaggacucuauugaua

SEQ ID NO: 555289 - RNA, 19 nt, Homo sapiens
ggaacacacuggcuuaugg

SEQ ID NO: 555290 - RNA, 19 nt, Homo sapiens
gacacaugcucaaauuaaa

SEQ ID NO: 555291 - RNA, 19 nt, Homo sapiens
ggagacacauauacgaaau

SEQ ID NO: 555292 - RNA, 19 nt, Homo sapiens
gcaaauuucuuggaacaca

SEQ ID NO: 555293 - RNA, 19 nt, Homo sapiens
gaugaaguauauuccagaa

SEQ ID NO: 555294 - RNA, 19 nt, Homo sapiens
ucucauggguuuauaguug

SEQ ID NO: 555295 - RNA, 19 nt, Homo sapiens
uauaguugcugcuguagaa

SEQ ID NO: 555296 - RNA, 19 nt, Homo sapiens
gaaagccagugaagaaugc

SEQ ID NO: 555297 - RNA, 19 nt, Homo sapiens
ggucuuagcaaauuucuug

SEQ ID NO: 555298 - RNA, 19 nt, Homo sapiens
cuucaggaauagagaaaua

SEQ ID NO: 555299 - RNA, 19 nt, Homo sapiens
ggaccaacauuaacacaac

SEQ ID NO: 555300 - RNA, 19 nt, Homo sapiens
gcgagaagcagucggguuu

SEQ ID NO: 555301 - RNA, 19 nt, Homo sapiens
uuagaacccugaaacaaga

SEQ ID NO: 555302 - RNA, 19 nt, Homo sapiens
uaaauccuguugcccauau

SEQ ID NO: 555303 - RNA, 19 nt, Homo sapiens
caucugcaacuuacuauuu

SEQ ID NO: 555304 - RNA, 19 nt, Homo sapiens
gauggcugcugcaagcuuu

SEQ ID NO: 555305 - RNA, 19 nt, Homo sapiens
caacugaaggacucuauug

SEQ ID NO: 555306 - RNA, 19 nt, Homo sapiens
uagcaacaaagcuucauua

SEQ ID NO: 555307 - RNA, 19 nt, Homo sapiens
gaucuuagcaacaaagcuu

SEQ ID NO: 555308 - RNA, 19 nt, Homo sapiens
caaaauaauuggacacaug

SEQ ID NO: 555309 - RNA, 19 nt, Homo sapiens
ggaaagccagugaagaaug

SEQ ID NO: 555310 - RNA, 19 nt, Homo sapiens
guuuauaguugcugcugua

SEQ ID NO: 555311 - RNA, 19 nt, Homo sapiens
ugacauugaucauggaaag

SEQ ID NO: 555312 - RNA, 19 nt, Homo sapiens
gcaaagagcaaaagaaugu

SEQ ID NO: 555313 - RNA, 19 nt, Homo sapiens
agacacauauacgaaauga

SEQ ID NO: 555314 - RNA, 19 nt, Homo sapiens
uagcaaauuucuuggaaca

SEQ ID NO: 555315 - RNA, 19 nt, Homo sapiens
gaucauggaaagccaguga

SEQ ID NO: 555316 - RNA, 19 nt, Homo sapiens
gaagaucagagauucagau

SEQ ID NO: 555317 - RNA, 19 nt, Homo sapiens
caacuuacuauuucaagga

SEQ ID NO: 555318 - RNA, 19 nt, Homo sapiens
ggagacauagauucaaaug

SEQ ID NO: 555319 - RNA, 19 nt, Homo sapiens
gaggagacacauauacgaa

SEQ ID NO: 555320 - RNA, 19 nt, Homo sapiens
gcuacucaccugauaaaga

SEQ ID NO: 555321 - RNA, 19 nt, Homo sapiens
aaaugcuacucaccugaua

SEQ ID NO: 555322 - RNA, 19 nt, Homo sapiens
ccuggcaucucauggguuu

SEQ ID NO: 555323 - RNA, 19 nt, Homo sapiens
gcauucaggacacuuuauu

SEQ ID NO: 555324 - RNA, 19 nt, Homo sapiens
gcaccuucuugcguuuaua

SEQ ID NO: 555325 - RNA, 19 nt, Homo sapiens
caagaggaggagacacaua

SEQ ID NO: 555326 - RNA, 19 nt, Homo sapiens
cuauugaucuuagcaacaa

SEQ ID NO: 555327 - RNA, 19 nt, Homo sapiens
guucaguccaccagaauuu

SEQ ID NO: 555328 - RNA, 19 nt, Homo sapiens
caacgguuauucagacucu

SEQ ID NO: 555329 - RNA, 19 nt, Homo sapiens
uauacgaaaugagcaggua

SEQ ID NO: 555330 - RNA, 19 nt, Homo sapiens
ugacaacuccugcaaacug

SEQ ID NO: 555331 - RNA, 19 nt, Homo sapiens
gcagugcugucggcgagaa

SEQ ID NO: 555332 - RNA, 19 nt, Homo sapiens
uauauuauccaucccaaga

SEQ ID NO: 555333 - RNA, 19 nt, Homo sapiens
uguacagacuuaauguuug

SEQ ID NO: 555334 - RNA, 19 nt, Homo sapiens
ggaggagacacauauacga

SEQ ID NO: 555335 - RNA, 19 nt, Homo sapiens
agauucagaugugguauug

SEQ ID NO: 555336 - RNA, 19 nt, Homo sapiens
gugaagaaugcauuagauu

SEQ ID NO: 555337 - RNA, 19 nt, Homo sapiens
gaaacaagaggaggagaca

SEQ ID NO: 555338 - RNA, 19 nt, Homo sapiens
gggcauucaggacacuuua

SEQ ID NO: 555339 - RNA, 19 nt, Homo sapiens
gagaagcagucggguuugg

SEQ ID NO: 555340 - RNA, 19 nt, Homo sapiens
uggcugugguuuauccuuu

SEQ ID NO: 555341 - RNA, 19 nt, Homo sapiens
agggagacauagauucaaa

SEQ ID NO: 555342 - RNA, 19 nt, Homo sapiens
cagcaugggucaacaaaau

SEQ ID NO: 555343 - RNA, 19 nt, Homo sapiens
uuggacacaugcucaaauu

SEQ ID NO: 555344 - RNA, 19 nt, Homo sapiens
gagauucagaugugguauu

SEQ ID NO: 555345 - RNA, 19 nt, Homo sapiens
aaagggagacauagauuca

SEQ ID NO: 555346 - RNA, 19 nt, Homo sapiens
uccacugggugaugaagua

SEQ ID NO: 555347 - RNA, 19 nt, Homo sapiens
ggagcaacgguuauucaga

SEQ ID NO: 555348 - RNA, 19 nt, Homo sapiens
gacacuuuauucugcuauu

SEQ ID NO: 555349 - RNA, 19 nt, Homo sapiens
cuuagcaaauuucuuggaa

SEQ ID NO: 555350 - RNA, 19 nt, Homo sapiens
uaaagggagacauagauuc

SEQ ID NO: 555351 - RNA, 19 nt, Homo sapiens
gcaguaauuggacauucuu

SEQ ID NO: 555352 - RNA, 19 nt, Homo sapiens
gaacaacugaaggacucua

SEQ ID NO: 555353 - RNA, 19 nt, Homo sapiens
agucuuggcucuaccuuag

SEQ ID NO: 555354 - RNA, 19 nt, Homo sapiens
gagcagguacggcaaagag

SEQ ID NO: 555355 - RNA, 19 nt, Homo sapiens
uuaaagggagacauagauu

SEQ ID NO: 555356 - RNA, 19 nt, Homo sapiens
caaaauacaaguacugaug

SEQ ID NO: 555357 - RNA, 19 nt, Homo sapiens
gccagugaagaaugcauua

SEQ ID NO: 555358 - RNA, 19 nt, Homo sapiens
gcaacuggcaaaauaauug

SEQ ID NO: 555359 - RNA, 19 nt, Homo sapiens
ugacuggcaauacauaaau

SEQ ID NO: 555360 - RNA, 19 nt, Homo sapiens
uagugaagaucagagauuc

SEQ ID NO: 555361 - RNA, 19 nt, Homo sapiens
caauacauaaauccuguug

SEQ ID NO: 555362 - RNA, 19 nt, Homo sapiens
ccugagagacuaagcugaa

SEQ ID NO: 555363 - RNA, 19 nt, Homo sapiens
cagacuuaauguuugauca

SEQ ID NO: 555364 - RNA, 19 nt, Homo sapiens
caaagcuucauuagcauuc

SEQ ID NO: 555365 - RNA, 19 nt, Homo sapiens
gcaacaaagcuucauuagc

SEQ ID NO: 555366 - RNA, 19 nt, Homo sapiens
cagagauucagauguggua

SEQ ID NO: 555367 - RNA, 19 nt, Homo sapiens
guagaacacagagauagau

SEQ ID NO: 555368 - RNA, 19 nt, Homo sapiens
caaugacaacuccugcaaa

SEQ ID NO: 555369 - RNA, 19 nt, Homo sapiens
ggaucccaaauaaagaaua

SEQ ID NO: 555370 - RNA, 19 nt, Homo sapiens
cacaaccaaucaacacauc

SEQ ID NO: 555371 - RNA, 19 nt, Homo sapiens
caacauuaacacaaccaau

SEQ ID NO: 555372 - RNA, 19 nt, Homo sapiens
caaauguagcuauugaucu

SEQ ID NO: 555373 - RNA, 19 nt, Homo sapiens
agugaagaaugcauuagau

SEQ ID NO: 555374 - RNA, 19 nt, Homo sapiens
aagaggaggagacacauau

SEQ ID NO: 555375 - RNA, 19 nt, Homo sapiens
acacuuuauucugcuauug

SEQ ID NO: 555376 - RNA, 19 nt, Homo sapiens
aaugacaacuccugcaaac

SEQ ID NO: 555377 - RNA, 19 nt, Homo sapiens
gagguuacucuuugguuca

SEQ ID NO: 555378 - RNA, 19 nt, Homo sapiens
gaaagacaaucacaacuua

SEQ ID NO: 555379 - RNA, 19 nt, Homo sapiens
gagauucccugucuucuga

SEQ ID NO: 555380 - RNA, 19 nt, Homo sapiens
gaaaggagacgaagguuca

SEQ ID NO: 555381 - RNA, 19 nt, Homo sapiens
uaaacacugugcuuuguaa

SEQ ID NO: 555382 - RNA, 19 nt, Homo sapiens
gcagccaccugaaugugua

SEQ ID NO: 555383 - RNA, 19 nt, Homo sapiens
cuacaucaauccugaaaug

SEQ ID NO: 555384 - RNA, 19 nt, Homo sapiens
agacgaagguucaacauca

SEQ ID NO: 555385 - RNA, 19 nt, Homo sapiens
ccaaggagcggcagaagaa

SEQ ID NO: 555386 - RNA, 19 nt, Homo sapiens
gaagaaagacaaucacaac

SEQ ID NO: 555387 - RNA, 19 nt, Homo sapiens
ggagggcgaugugcuguga

SEQ ID NO: 555388 - RNA, 19 nt, Homo sapiens
ggaggacgcagugaacaua

SEQ ID NO: 555389 - RNA, 19 nt, Homo sapiens
caaguuugcugcccacauc

SEQ ID NO: 555390 - RNA, 19 nt, Homo sapiens
caacagugcucccaauagc

SEQ ID NO: 555391 - RNA, 19 nt, Homo sapiens
gaagguucaacaucaauga

SEQ ID NO: 555392 - RNA, 19 nt, Homo sapiens
ccacuucuguccaccaugu

SEQ ID NO: 555393 - RNA, 19 nt, Homo sapiens
guaaacacugugcuuugua

SEQ ID NO: 555394 - RNA, 19 nt, Homo sapiens
gacgaagguucaacaucaa

SEQ ID NO: 555395 - RNA, 19 nt, Homo sapiens
ggacgcagugaacauauau

SEQ ID NO: 555396 - RNA, 19 nt, Homo sapiens
ucaaggccucuguggauua

SEQ ID NO: 555397 - RNA, 19 nt, Homo sapiens
gcagugaacauauaugcau

SEQ ID NO: 555398 - RNA, 19 nt, Homo sapiens
ucaaugaccgcaucaagga

SEQ ID NO: 555399 - RNA, 19 nt, Homo sapiens
gagagggaguuggaugaug

SEQ ID NO: 555400 - RNA, 19 nt, Homo sapiens
ggagggagaugaaaacaca

SEQ ID NO: 555401 - RNA, 19 nt, Homo sapiens
gaaaugcagaugcccaaca

SEQ ID NO: 555402 - RNA, 19 nt, Homo sapiens
agagggaguuggaugaugu

SEQ ID NO: 555403 - RNA, 19 nt, Homo sapiens
gcaacagugcucccaauag

SEQ ID NO: 555404 - RNA, 19 nt, Homo sapiens
gccuggagaugaccaacaa

SEQ ID NO: 555405 - RNA, 19 nt, Homo sapiens
agaaagacaaucacaacuu

SEQ ID NO: 555406 - RNA, 19 nt, Homo sapiens
agaaggaucuggaccucau

SEQ ID NO: 555407 - RNA, 19 nt, Homo sapiens
gaagcgagagcucacagau

SEQ ID NO: 555408 - RNA, 19 nt, Homo sapiens
cugcggaccugacccagaa

SEQ ID NO: 555409 - RNA, 19 nt, Homo sapiens
ggcaacagugcucccaaua

SEQ ID NO: 555410 - RNA, 19 nt, Homo sapiens
uggagaaucccacauccua

SEQ ID NO: 555411 - RNA, 19 nt, Homo sapiens
uguugaaggugcaguccua

SEQ ID NO: 555412 - RNA, 19 nt, Homo sapiens
ggagcugccuagcgaagag

SEQ ID NO: 555413 - RNA, 19 nt, Homo sapiens
guccuuggcuacaucaauc

SEQ ID NO: 555414 - RNA, 19 nt, Homo sapiens
ggagauucccugucuucug

SEQ ID NO: 555415 - RNA, 19 nt, Homo sapiens
aggacgcagugaacauaua

SEQ ID NO: 555416 - RNA, 19 nt, Homo sapiens
ucacuuugugccuuuagua

SEQ ID NO: 555417 - RNA, 19 nt, Homo sapiens
ucgggaagcuccucaucug

SEQ ID NO: 555418 - RNA, 19 nt, Homo sapiens
gcuggccucugauccacuu

SEQ ID NO: 555419 - RNA, 19 nt, Homo sapiens
aguaaacacugugcuuugu

SEQ ID NO: 555420 - RNA, 19 nt, Homo sapiens
ggcagaagaaagacaauca

SEQ ID NO: 555421 - RNA, 19 nt, Homo sapiens
ccucaaggccucuguggau

SEQ ID NO: 555422 - RNA, 19 nt, Homo sapiens
caaggccucuguggauuac

SEQ ID NO: 555423 - RNA, 19 nt, Homo sapiens
ggucggaggacgcagugaa

SEQ ID NO: 555424 - RNA, 19 nt, Homo sapiens
aagagggccugguggagau

SEQ ID NO: 555425 - RNA, 19 nt, Homo sapiens
auauaugcauguacagugu

SEQ ID NO: 555426 - RNA, 19 nt, Homo sapiens
agaagaaagacaaucacaa

SEQ ID NO: 555427 - RNA, 19 nt, Homo sapiens
agaaggaccugcaaaaguc

SEQ ID NO: 555428 - RNA, 19 nt, Homo sapiens
gaggacgcagugaacauau

SEQ ID NO: 555429 - RNA, 19 nt, Homo sapiens
gagacgaagguucaacauc

SEQ ID NO: 555430 - RNA, 19 nt, Homo sapiens
gauggugaacucgcaagaa

SEQ ID NO: 555431 - RNA, 19 nt, Homo sapiens
uaguaaacacugugcuuug

SEQ ID NO: 555432 - RNA, 19 nt, Homo sapiens
gggagcgcaugcagcaaca

SEQ ID NO: 555433 - RNA, 19 nt, Homo sapiens
uggcaacagugcucccaau

SEQ ID NO: 555434 - RNA, 19 nt, Homo sapiens
uuaguaaacacugugcuuu

SEQ ID NO: 555435 - RNA, 19 nt, Homo sapiens
cagaagaaagacaaucaca

SEQ ID NO: 555436 - RNA, 19 nt, Homo sapiens
gcaucaaggaguugggaau

SEQ ID NO: 555437 - RNA, 19 nt, Homo sapiens
gccaaggagcggcagaaga

SEQ ID NO: 555438 - RNA, 19 nt, Homo sapiens
ggagacgaagguucaacau

SEQ ID NO: 555439 - RNA, 19 nt, Homo sapiens
cgggaggcgugauggugaa

SEQ ID NO: 555440 - RNA, 19 nt, Homo sapiens
caagggcaccauccucaag

SEQ ID NO: 555441 - RNA, 19 nt, Homo sapiens
caucaaggaguugggaaug

SEQ ID NO: 555442 - RNA, 19 nt, Homo sapiens
caucaaugaccgcaucaag

SEQ ID NO: 555443 - RNA, 19 nt, Homo sapiens
guaccuguccgagaccuau

SEQ ID NO: 555444 - RNA, 19 nt, Homo sapiens
guggagauucccugucuuc

SEQ ID NO: 555445 - RNA, 19 nt, Homo sapiens
ccuucaggcugcacugugu

SEQ ID NO: 555446 - RNA, 19 nt, Homo sapiens
gaggcgugauggugaacuc

SEQ ID NO: 555447 - RNA, 19 nt, Homo sapiens
cagugaaggacaugcuuga

SEQ ID NO: 555448 - RNA, 19 nt, Homo sapiens
ugcuaccgcuggccucuga

SEQ ID NO: 555449 - RNA, 19 nt, Homo sapiens
gaaggaucuggaccucaug

SEQ ID NO: 555450 - RNA, 19 nt, Homo sapiens
cccagcagguggugaagca

SEQ ID NO: 555451 - RNA, 19 nt, Homo sapiens
caguguggauccucaucug

SEQ ID NO: 555452 - RNA, 19 nt, Homo sapiens
cgaagguucaacaucaaug

SEQ ID NO: 555453 - RNA, 19 nt, Homo sapiens
uuaauugaaaggagacgaa

SEQ ID NO: 555454 - RNA, 19 nt, Homo sapiens
gagaggagggagaugaaaa

SEQ ID NO: 555455 - RNA, 19 nt, Homo sapiens
gaaguuaaauugaggcuua

SEQ ID NO: 555456 - RNA, 19 nt, Homo sapiens
ggacacauuuccacuauaa

SEQ ID NO: 555457 - RNA, 19 nt, Homo sapiens
ugaggaaggugcaguauuu

SEQ ID NO: 555458 - RNA, 19 nt, Homo sapiens
gcccuuacuuuccuaauua

SEQ ID NO: 555459 - RNA, 19 nt, Homo sapiens
gaaauacucuacaagaaag

SEQ ID NO: 555460 - RNA, 19 nt, Homo sapiens
caagaaggauacaagguaa

SEQ ID NO: 555461 - RNA, 19 nt, Homo sapiens
uggcucagcucucaauuua

SEQ ID NO: 555462 - RNA, 19 nt, Homo sapiens
uaagaaauccagcuucaua

SEQ ID NO: 555463 - RNA, 19 nt, Homo sapiens
gaaaagauauggaguuaug

SEQ ID NO: 555464 - RNA, 19 nt, Homo sapiens
uaacucaacugucuauugu

SEQ ID NO: 555465 - RNA, 19 nt, Homo sapiens
caacaacccuguguaacaa

SEQ ID NO: 555466 - RNA, 19 nt, Homo sapiens
gaaauccagcuucauaauu

SEQ ID NO: 555467 - RNA, 19 nt, Homo sapiens
ccacaaacacauauugaua

SEQ ID NO: 555468 - RNA, 19 nt, Homo sapiens
caaaugaccuagaaacaag

SEQ ID NO: 555469 - RNA, 19 nt, Homo sapiens
gaccaugaaugauaugcua

SEQ ID NO: 555470 - RNA, 19 nt, Homo sapiens
gcacacaacagacuucuau

SEQ ID NO: 555471 - RNA, 19 nt, Homo sapiens
ugaaugggaugucuaaugu

SEQ ID NO: 555472 - RNA, 19 nt, Homo sapiens
auacagagaugaacaacuu

SEQ ID NO: 555473 - RNA, 19 nt, Homo sapiens
caagaaagcuguggcucaa

SEQ ID NO: 555474 - RNA, 19 nt, Homo sapiens
gauucuaccugaacugaaa

SEQ ID NO: 555475 - RNA, 19 nt, Homo sapiens
gugaugggcuggaaucuga

SEQ ID NO: 555476 - RNA, 19 nt, Homo sapiens
ugaagaaggucucauuauc

SEQ ID NO: 555477 - RNA, 19 nt, Homo sapiens
aaacagaccugcauucaac

SEQ ID NO: 555478 - RNA, 19 nt, Homo sapiens
caauaugccugcaggaguu

SEQ ID NO: 555479 - RNA, 19 nt, Homo sapiens
gccgugagcuggucaaguu

SEQ ID NO: 555480 - RNA, 19 nt, Homo sapiens
gcucagcucucaauuuagu

SEQ ID NO: 555481 - RNA, 19 nt, Homo sapiens
guauucagguaacucauuu

SEQ ID NO: 555482 - RNA, 19 nt, Homo sapiens
caacuguaaugcaggauug

SEQ ID NO: 555483 - RNA, 19 nt, Homo sapiens
ugugcaaggugauauauaa

SEQ ID NO: 555484 - RNA, 19 nt, Homo sapiens
ggaguuauguggauuucau

SEQ ID NO: 555485 - RNA, 19 nt, Homo sapiens
agacgaggccuuugcuuua

SEQ ID NO: 555486 - RNA, 19 nt, Homo sapiens
ugggaugucuaauguauuu

SEQ ID NO: 555487 - RNA, 19 nt, Homo sapiens
gaagaaggucucauuaucu

SEQ ID NO: 555488 - RNA, 19 nt, Homo sapiens
gaaauacagagaugaacaa

SEQ ID NO: 555489 - RNA, 19 nt, Homo sapiens
gagaggaacuauacuacca

SEQ ID NO: 555490 - RNA, 19 nt, Homo sapiens
gaagaagcacgaagcaguu

SEQ ID NO: 555491 - RNA, 19 nt, Homo sapiens
ccaucaaacugaagcauga

SEQ ID NO: 555492 - RNA, 19 nt, Homo sapiens
gauuggaccaugaaugaua

SEQ ID NO: 555493 - RNA, 19 nt, Homo sapiens
gucauaauguguugugaaa

SEQ ID NO: 555494 - RNA, 19 nt, Homo sapiens
gaggaacuauacuaccaaa

SEQ ID NO: 555495 - RNA, 19 nt, Homo sapiens
ggagaugacauuugcuuug

SEQ ID NO: 555496 - RNA, 19 nt, Homo sapiens
gaaacagaccugcauucaa

SEQ ID NO: 555497 - RNA, 19 nt, Homo sapiens
aagaagagcucacuauggu

SEQ ID NO: 555498 - RNA, 19 nt, Homo sapiens
gauauggaguuauguggau

SEQ ID NO: 555499 - RNA, 19 nt, Homo sapiens
uaaugaauuuccagacuga

SEQ ID NO: 555500 - RNA, 19 nt, Homo sapiens
caaaaucacccaaaacuuu

SEQ ID NO: 555501 - RNA, 19 nt, Homo sapiens
caaaaucaguuuaggacua

SEQ ID NO: 555502 - RNA, 19 nt, Homo sapiens
ggacacaccaaugaaauga

SEQ ID NO: 555503 - RNA, 19 nt, Homo sapiens
gccaugcgcuuccgcuuug

SEQ ID NO: 555504 - RNA, 19 nt, Homo sapiens
gaacuauacuaccaaaaga

SEQ ID NO: 555505 - RNA, 19 nt, Homo sapiens
ccaaagaaucuaggaaauu

SEQ ID NO: 555506 - RNA, 19 nt, Homo sapiens
gccaaagaaucuaggaaau

SEQ ID NO: 555507 - RNA, 19 nt, Homo sapiens
caggacacauuuccacuau

SEQ ID NO: 555508 - RNA, 19 nt, Homo sapiens
cacaauauccaaugaagaa

SEQ ID NO: 555509 - RNA, 19 nt, Homo sapiens
acaagaaggauacaaggua

SEQ ID NO: 555510 - RNA, 19 nt, Homo sapiens
caaaggaggaaauaagguu

SEQ ID NO: 555511 - RNA, 19 nt, Homo sapiens
acacaacagacuucuauuu

SEQ ID NO: 555512 - RNA, 19 nt, Homo sapiens
gagaugacauuugcuuugg

SEQ ID NO: 555513 - RNA, 19 nt, Homo sapiens
ggaaauacagagaugaaca

SEQ ID NO: 555514 - RNA, 19 nt, Homo sapiens
caucaugaccguugcugua

SEQ ID NO: 555515 - RNA, 19 nt, Homo sapiens
gagcccaaaugaccaaauc

SEQ ID NO: 555516 - RNA, 19 nt, Homo sapiens
caguuaggcuuguacauca

SEQ ID NO: 555517 - RNA, 19 nt, Homo sapiens
ugggaugacuuucgauuau

SEQ ID NO: 555518 - RNA, 19 nt, Homo sapiens
ggaugauguuggucaaaug

SEQ ID NO: 555519 - RNA, 19 nt, Homo sapiens
ccacuggacacaccaauga

SEQ ID NO: 555520 - RNA, 19 nt, Homo sapiens
caaugaaugggaugucuaa

SEQ ID NO: 555521 - RNA, 19 nt, Homo sapiens
gauagaacuguggcacuua

SEQ ID NO: 555522 - RNA, 19 nt, Homo sapiens
gaaucuaggaaauuaguug

SEQ ID NO: 555523 - RNA, 19 nt, Homo sapiens
gacuuucgauuaugcuuug

SEQ ID NO: 555524 - RNA, 19 nt, Homo sapiens
gggaugauguuggucaaau

SEQ ID NO: 555525 - RNA, 19 nt, Homo sapiens
aaugggaugucuaauguau

SEQ ID NO: 555526 - RNA, 19 nt, Homo sapiens
ucuaagaaauccagcuuca

SEQ ID NO: 555527 - RNA, 19 nt, Homo sapiens
agaagaaagagaaguguuu

SEQ ID NO: 555528 - RNA, 19 nt, Homo sapiens
ccaacaacccuguguaaca

SEQ ID NO: 555529 - RNA, 19 nt, Homo sapiens
ccagaaauuugggaagguu

SEQ ID NO: 555530 - RNA, 19 nt, Homo sapiens
caaacugaagcaugaauug

SEQ ID NO: 555531 - RNA, 19 nt, Homo sapiens
gaaaugaagcacacaacag

SEQ ID NO: 555532 - RNA, 19 nt, Homo sapiens
cauauccaguuuaaucuuc

SEQ ID NO: 555533 - RNA, 19 nt, Homo sapiens
cgugaugcaucccaaagaa

SEQ ID NO: 555534 - RNA, 19 nt, Homo sapiens
gaugauguuggucaaauga

SEQ ID NO: 555535 - RNA, 19 nt, Homo sapiens
aaugggauauuguacagaa

SEQ ID NO: 555536 - RNA, 19 nt, Homo sapiens
ggucugugaauuucuuuaa

SEQ ID NO: 555537 - RNA, 19 nt, Homo sapiens
uagaugaagugagauacaa

SEQ ID NO: 555538 - RNA, 19 nt, Homo sapiens
ucagaaggguuaacucaac

SEQ ID NO: 555539 - RNA, 19 nt, Homo sapiens
ggaaggcaauggaccucau

SEQ ID NO: 555540 - RNA, 19 nt, Homo sapiens
caaagaaggcgcagaacag

SEQ ID NO: 555541 - RNA, 19 nt, Homo sapiens
ucaaaugaccuagaaacaa

SEQ ID NO: 555542 - RNA, 19 nt, Homo sapiens
ggucagaaggguuaacuca

SEQ ID NO: 555543 - RNA, 19 nt, Homo sapiens
caugagaggaacuauacua

SEQ ID NO: 555544 - RNA, 19 nt, Homo sapiens
agaaagcuguggcucaaca

SEQ ID NO: 555545 - RNA, 19 nt, Homo sapiens
uaaggagccugggaugaug

SEQ ID NO: 555546 - RNA, 19 nt, Homo sapiens
cagaauuccucaggcugua

SEQ ID NO: 555547 - RNA, 19 nt, Homo sapiens
gggauauuguacagaauuc

SEQ ID NO: 555548 - RNA, 19 nt, Homo sapiens
aaaaugugcugccuagaaa

SEQ ID NO: 555549 - RNA, 19 nt, Homo sapiens
ccucacaguuguuaaaguc

SEQ ID NO: 555550 - RNA, 19 nt, Homo sapiens
gcaguuaggcuuguacauc

SEQ ID NO: 555551 - RNA, 19 nt, Homo sapiens
gggaugacuuucgauuaug

SEQ ID NO: 555552 - RNA, 19 nt, Homo sapiens
aaaugaagcacacaacaga

SEQ ID NO: 555553 - RNA, 19 nt, Homo sapiens
gagcaccgaaggccgagua

SEQ ID NO: 555554 - RNA, 19 nt, Homo sapiens
gaaugggaugucuaaugua

SEQ ID NO: 555555 - RNA, 19 nt, Homo sapiens
gaacauugcacguuucuug

SEQ ID NO: 555556 - RNA, 19 nt, Homo sapiens
ccaaugcgcuggacuugaa

SEQ ID NO: 555557 - RNA, 19 nt, Homo sapiens
auagauagcuggguagaua

SEQ ID NO: 555558 - RNA, 19 nt, Homo sapiens
cagcugggauucacuuuaa

SEQ ID NO: 555559 - RNA, 19 nt, Homo sapiens
gaauugccguaacugauuu

SEQ ID NO: 555560 - RNA, 19 nt, Homo sapiens
ggacuugaauucagugcuu

SEQ ID NO: 555561 - RNA, 19 nt, Homo sapiens
ugaaagacaucgugaucaa

SEQ ID NO: 555562 - RNA, 19 nt, Homo sapiens
gagggaagcaguaaagaaa

SEQ ID NO: 555563 - RNA, 19 nt, Homo sapiens
guugaaagcugcaguugau

SEQ ID NO: 555564 - RNA, 19 nt, Homo sapiens
cgaagacgcagaugaaauu

SEQ ID NO: 555565 - RNA, 19 nt, Homo sapiens
ggaagaaugugccgaagac

SEQ ID NO: 555566 - RNA, 19 nt, Homo sapiens
uggaugaggucuugugaaa

SEQ ID NO: 555567 - RNA, 19 nt, Homo sapiens
gggauucacuuuaauuugg

SEQ ID NO: 555568 - RNA, 19 nt, Homo sapiens
ggaagagucuaaccugucu

SEQ ID NO: 555569 - RNA, 19 nt, Homo sapiens
gauggccucuccaagauga

SEQ ID NO: 555570 - RNA, 19 nt, Homo sapiens
gaugagcccacgacuuuaa

SEQ ID NO: 555571 - RNA, 19 nt, Homo sapiens
gaugcagacuuggauguaa

SEQ ID NO: 555572 - RNA, 19 nt, Homo sapiens
cggaugagcccacgacuuu

SEQ ID NO: 555573 - RNA, 19 nt, Homo sapiens
caacgcaacccuuauagau

SEQ ID NO: 555574 - RNA, 19 nt, Homo sapiens
gaagggaacauugcacguu

SEQ ID NO: 555575 - RNA, 19 nt, Homo sapiens
guugucaagugucaauaaa

SEQ ID NO: 555576 - RNA, 19 nt, Homo sapiens
gcucuuucaugccuauuau

SEQ ID NO: 555577 - RNA, 19 nt, Homo sapiens
guucugccaugccgaugua

SEQ ID NO: 555578 - RNA, 19 nt, Homo sapiens
aagcgcaucauguaauuua

SEQ ID NO: 555579 - RNA, 19 nt, Homo sapiens
gugaaaaccuggcuccuuu

SEQ ID NO: 555580 - RNA, 19 nt, Homo sapiens
ggauucacuuuaauuugga

SEQ ID NO: 555581 - RNA, 19 nt, Homo sapiens
gucaagagcgugccugaaa

SEQ ID NO: 555582 - RNA, 19 nt, Homo sapiens
ccgccaagaugauauuuua

SEQ ID NO: 555583 - RNA, 19 nt, Homo sapiens
ugaauugccguaacugauu

SEQ ID NO: 555584 - RNA, 19 nt, Homo sapiens
aagggaacauugcacguuu

SEQ ID NO: 555585 - RNA, 19 nt, Homo sapiens
uaaaacgucuguaugaguu

SEQ ID NO: 555586 - RNA, 19 nt, Homo sapiens
ucaugccuauuaucaguaa

SEQ ID NO: 555587 - RNA, 19 nt, Homo sapiens
acgcaacccuuauagauag

SEQ ID NO: 555588 - RNA, 19 nt, Homo sapiens
gcugucaacgcaacccuua

SEQ ID NO: 555589 - RNA, 19 nt, Homo sapiens
uaagugaauugccguaacu

SEQ ID NO: 555590 - RNA, 19 nt, Homo sapiens
ggguagauauugcgauuuu

SEQ ID NO: 555591 - RNA, 19 nt, Homo sapiens
guugauggccucuccaaga

SEQ ID NO: 555592 - RNA, 19 nt, Homo sapiens
ucaagcuccuuaagugaau

SEQ ID NO: 555593 - RNA, 19 nt, Homo sapiens
ugucaacgcaacccuuaua

SEQ ID NO: 555594 - RNA, 19 nt, Homo sapiens
gaaggcgaagggaacauug

SEQ ID NO: 555595 - RNA, 19 nt, Homo sapiens
gcgcuggacuugaauucag

SEQ ID NO: 555596 - RNA, 19 nt, Homo sapiens
uaaggggacuuguauuaga

SEQ ID NO: 555597 - RNA, 19 nt, Homo sapiens
ugacagugccagccaaugu

SEQ ID NO: 555598 - RNA, 19 nt, Homo sapiens
gcugaaagacaucgugauc

SEQ ID NO: 555599 - RNA, 19 nt, Homo sapiens
ggccaguugucaaguguca

SEQ ID NO: 555600 - RNA, 19 nt, Homo sapiens
uccaugaacucugcucuug

SEQ ID NO: 555601 - RNA, 19 nt, Homo sapiens
gcugggauucacuuuaauu

SEQ ID NO: 555602 - RNA, 19 nt, Homo sapiens
ggaugagcccacgacuuua

SEQ ID NO: 555603 - RNA, 19 nt, Homo sapiens
gagcuucccaccugcaugu

SEQ ID NO: 555604 - RNA, 19 nt, Homo sapiens
gaugaggucuugugaaaac

SEQ ID NO: 555605 - RNA, 19 nt, Homo sapiens
agagguggaugaggucuug

SEQ ID NO: 555606 - RNA, 19 nt, Homo sapiens
aaacgucuguaugaguuga

SEQ ID NO: 555607 - RNA, 19 nt, Homo sapiens
aauaaaagcgcaucaugua

SEQ ID NO: 555608 - RNA, 19 nt, Homo sapiens
aaaagcgcaucauguaauu

SEQ ID NO: 555609 - RNA, 19 nt, Homo sapiens
uauuagagucagagucuuu

SEQ ID NO: 555610 - RNA, 19 nt, Homo sapiens
ucagcugggauucacuuua

SEQ ID NO: 555611 - RNA, 19 nt, Homo sapiens
gagcgugccugaaaaccuu

SEQ ID NO: 555612 - RNA, 19 nt, Homo sapiens
aaagagggaagcaguaaag

SEQ ID NO: 555613 - RNA, 19 nt, Homo sapiens
cuggguagauauugcgauu

SEQ ID NO: 555614 - RNA, 19 nt, Homo sapiens
cauugcacguuucuuguuc

SEQ ID NO: 555615 - RNA, 19 nt, Homo sapiens
ccacgacuuuaaccaccaa

SEQ ID NO: 555616 - RNA, 19 nt, Homo sapiens
aacgcaacccuuauagaua

SEQ ID NO: 555617 - RNA, 19 nt, Homo sapiens
caagugcuuuggagaacag

SEQ ID NO: 555618 - RNA, 19 nt, Homo sapiens
cugaaaaccuucucaagug

SEQ ID NO: 555619 - RNA, 19 nt, Homo sapiens
aacaccagaugcagacuug

SEQ ID NO: 555620 - RNA, 19 nt, Homo sapiens
ucuccaagaugauucaaac

SEQ ID NO: 555621 - RNA, 19 nt, Homo sapiens
uuucaugccuauuaucagu

SEQ ID NO: 555622 - RNA, 19 nt, Homo sapiens
agaauggugcucuuucaug

SEQ ID NO: 555623 - RNA, 19 nt, Homo sapiens
ugccguaacugauuuuaaa

SEQ ID NO: 555624 - RNA, 19 nt, Homo sapiens
cccucaagcuccuuaagug

SEQ ID NO: 555625 - RNA, 19 nt, Homo sapiens
uugauggccucuccaagau

SEQ ID NO: 555626 - RNA, 19 nt, Homo sapiens
gaagacgcagaugaaauuc

SEQ ID NO: 555627 - RNA, 19 nt, Homo sapiens
ccucaagcuccuuaaguga

SEQ ID NO: 555628 - RNA, 19 nt, Homo sapiens
agagggaagcaguaaagaa

SEQ ID NO: 555629 - RNA, 19 nt, Homo sapiens
cgugaccucugacgguuuc

SEQ ID NO: 555630 - RNA, 19 nt, Homo sapiens
cgaaggcgaagggaacauu

SEQ ID NO: 555631 - RNA, 19 nt, Homo sapiens
ucaagagcgugccugaaaa

SEQ ID NO: 555632 - RNA, 19 nt, Homo sapiens
uaaaagcgcaucauguaau

SEQ ID NO: 555633 - RNA, 19 nt, Homo sapiens
gugaauugccguaacugau

SEQ ID NO: 555634 - RNA, 19 nt, Homo sapiens
caagcuccuuaagugaauu

SEQ ID NO: 555635 - RNA, 19 nt, Homo sapiens
gaaugaacucaccguagca

SEQ ID NO: 555636 - RNA, 19 nt, Homo sapiens
uaaccugucucugcaagcu

SEQ ID NO: 555637 - RNA, 19 nt, Homo sapiens
gaccucugacgguuucuga

SEQ ID NO: 555638 - RNA, 19 nt, Homo sapiens
ccaccaaugcgcuggacuu

SEQ ID NO: 555639 - RNA, 19 nt, Homo sapiens
ggugcucuuucaugccuau

SEQ ID NO: 555640 - RNA, 19 nt, Homo sapiens
uaaaagagggaagcaguaa

SEQ ID NO: 555641 - RNA, 19 nt, Homo sapiens
gauagcuggguagauauug

SEQ ID NO: 555642 - RNA, 19 nt, Homo sapiens
ucaacgcaacccuuauaga

SEQ ID NO: 555643 - RNA, 19 nt, Homo sapiens
ccgaagacgcagaugaaau

SEQ ID NO: 555644 - RNA, 19 nt, Homo sapiens
gcuuuggagaacagaauaa

SEQ ID NO: 555645 - RNA, 19 nt, Homo sapiens
gaaagacaucgugaucaac

SEQ ID NO: 555646 - RNA, 19 nt, Homo sapiens
gacagugccagccaaugug

SEQ ID NO: 555647 - RNA, 19 nt, Homo sapiens
ucaagugcuuuggagaaca

SEQ ID NO: 555648 - RNA, 19 nt, Homo sapiens
ccaguugucaagugucaau

SEQ ID NO: 555649 - RNA, 19 nt, Homo sapiens
uuaggccaguugucaagug

SEQ ID NO: 555650 - RNA, 19 nt, Homo sapiens
guauuagagucagagucuu

SEQ ID NO: 555651 - RNA, 19 nt, Homo sapiens
aguaaggggacuuguauua

SEQ ID NO: 555652 - RNA, 19 nt, Homo sapiens
uuaagugaauugccguaac

SEQ ID NO: 555653 - RNA, 19 nt, Homo sapiens
gguggaugaggucuuguga

SEQ ID NO: 555654 - RNA, 19 nt, Homo sapiens
gaaaggcccucgggaaguu

SEQ ID NO: 555655 - RNA, 19 nt, Homo sapiens
cauuaaaggucaagaagga

SEQ ID NO: 555656 - RNA, 19 nt, Homo sapiens
caaaccgaauaaggcauua

SEQ ID NO: 555657 - RNA, 19 nt, Homo sapiens
gaaguuccgcguccucugu

SEQ ID NO: 555658 - RNA, 19 nt, Homo sapiens
ccaggaagagacuguauug

SEQ ID NO: 555659 - RNA, 19 nt, Homo sapiens
ucacugggaugcagacucu

SEQ ID NO: 555660 - RNA, 19 nt, Homo sapiens
ucaagcgggugacgcagaa

SEQ ID NO: 555661 - RNA, 19 nt, Homo sapiens
cgaauaaggcauuaaaggu

SEQ ID NO: 555662 - RNA, 19 nt, Homo sapiens
ggagucgggacauauaaug

SEQ ID NO: 555663 - RNA, 19 nt, Homo sapiens
ggaaaggcccucgggaagu

SEQ ID NO: 555664 - RNA, 19 nt, Homo sapiens
ccaaaccgaauaaggcauu

SEQ ID NO: 555665 - RNA, 19 nt, Homo sapiens
uaugacgacuaaucccaaa

SEQ ID NO: 555666 - RNA, 19 nt, Homo sapiens
ugugggaauugguaucuug

SEQ ID NO: 555667 - RNA, 19 nt, Homo sapiens
gagaagcuggcgcgugaga

SEQ ID NO: 555668 - RNA, 19 nt, Homo sapiens
gugggagucgggacauaua

SEQ ID NO: 555669 - RNA, 19 nt, Homo sapiens
gcagcucacaccaggaaga

SEQ ID NO: 555670 - RNA, 19 nt, Homo sapiens
acgaggcgcugcagaccuu

SEQ ID NO: 555671 - RNA, 19 nt, Homo sapiens
acuaaucccaaaccgaaua

SEQ ID NO: 555672 - RNA, 19 nt, Homo sapiens
gucgggacauauaauggaa

SEQ ID NO: 555673 - RNA, 19 nt, Homo sapiens
gaagcuggcgcgugagaac

SEQ ID NO: 555674 - RNA, 19 nt, Homo sapiens
gaugagcugguguccaugu

SEQ ID NO: 555675 - RNA, 19 nt, Homo sapiens
augaugagcugguguccau

SEQ ID NO: 555676 - RNA, 19 nt, Homo sapiens
cuaaucccaaaccgaauaa

SEQ ID NO: 555677 - RNA, 19 nt, Homo sapiens
ggaugcagacucucgacau

SEQ ID NO: 555678 - RNA, 19 nt, Homo sapiens
ccaccagcgucaucaccau

SEQ ID NO: 555679 - RNA, 19 nt, Homo sapiens
ccgaauaaggcauuaaagg

SEQ ID NO: 555680 - RNA, 19 nt, Homo sapiens
cgucggcgcacacucaaga

SEQ ID NO: 555681 - RNA, 19 nt, Homo sapiens
cgggacauauaauggaaag

SEQ ID NO: 555682 - RNA, 19 nt, Homo sapiens
aggaagagacuguauugca

SEQ ID NO: 555683 - RNA, 19 nt, Homo sapiens
gggagucgggacauauaau

SEQ ID NO: 555684 - RNA, 19 nt, Homo sapiens
aaccgaauaaggcauuaaa

SEQ ID NO: 555685 - RNA, 19 nt, Homo sapiens
gcacuugccuugcccaaua

SEQ ID NO: 555686 - RNA, 19 nt, Homo sapiens
acacaaggaucucauaaua

SEQ ID NO: 555687 - RNA, 19 nt, Homo sapiens
gcagagauauucaggguuu

SEQ ID NO: 555688 - RNA, 19 nt, Homo sapiens
gaaccaagauaaauuagug

SEQ ID NO: 555689 - RNA, 19 nt, Homo sapiens
ccucuuagcuggcauuaua

SEQ ID NO: 555690 - RNA, 19 nt, Homo sapiens
ucagagaucucaguaauaa

SEQ ID NO: 555691 - RNA, 19 nt, Homo sapiens
ggagaaccaagauaaauua

SEQ ID NO: 555692 - RNA, 19 nt, Homo sapiens
ccaaaguggugauugauuu

SEQ ID NO: 555693 - RNA, 19 nt, Homo sapiens
caagaacgcugcagagaau

SEQ ID NO: 555694 - RNA, 19 nt, Homo sapiens
gaaaucuugugcuguuuaa

SEQ ID NO: 555695 - RNA, 19 nt, Homo sapiens
gccaagauuugccuuauaa

SEQ ID NO: 555696 - RNA, 19 nt, Homo sapiens
ggaggcauguaauaagaua

SEQ ID NO: 555697 - RNA, 19 nt, Homo sapiens
gagaagaacugucauuugc

SEQ ID NO: 555698 - RNA, 19 nt, Homo sapiens
ccaaauauguacuucagaa

SEQ ID NO: 555699 - RNA, 19 nt, Homo sapiens
gaaacaacguggauacaag

SEQ ID NO: 555700 - RNA, 19 nt, Homo sapiens
ccaaauacuccuaucauaa

SEQ ID NO: 555701 - RNA, 19 nt, Homo sapiens
gaagauauggaaugcagua

SEQ ID NO: 555702 - RNA, 19 nt, Homo sapiens
ucugguagcucaguuaaua

SEQ ID NO: 555703 - RNA, 19 nt, Homo sapiens
caucagagaucucaguaau

SEQ ID NO: 555704 - RNA, 19 nt, Homo sapiens
guaauaaucccaugacuca

SEQ ID NO: 555705 - RNA, 19 nt, Homo sapiens
gcaguagguucccagauug

SEQ ID NO: 555706 - RNA, 19 nt, Homo sapiens
guagcuaaaugaagcauga

SEQ ID NO: 555707 - RNA, 19 nt, Homo sapiens
ggaaaucuugugcuguuua

SEQ ID NO: 555708 - RNA, 19 nt, Homo sapiens
gaauaggccugaucaucug

SEQ ID NO: 555709 - RNA, 19 nt, Homo sapiens
acagaucacuccaggcaua

SEQ ID NO: 555710 - RNA, 19 nt, Homo sapiens
gcagguguauaaauaucua

SEQ ID NO: 555711 - RNA, 19 nt, Homo sapiens
gaaauagcucuucuccuaa

SEQ ID NO: 555712 - RNA, 19 nt, Homo sapiens
gaacaucaaggcauccaaa

SEQ ID NO: 555713 - RNA, 19 nt, Homo sapiens
caacucagcuggcuauggu

SEQ ID NO: 555714 - RNA, 19 nt, Homo sapiens
ccugauggcucucauaguu

SEQ ID NO: 555715 - RNA, 19 nt, Homo sapiens
gcuaaaugaagcaugauua

SEQ ID NO: 555716 - RNA, 19 nt, Homo sapiens
gcacuuguaaccugagaua

SEQ ID NO: 555717 - RNA, 19 nt, Homo sapiens
gugaagcuauugagaagaa

SEQ ID NO: 555718 - RNA, 19 nt, Homo sapiens
gaagagaagaacugucauu

SEQ ID NO: 555719 - RNA, 19 nt, Homo sapiens
ucacuuggguuacuucaga

SEQ ID NO: 555720 - RNA, 19 nt, Homo sapiens
guucgaagcucauggagau

SEQ ID NO: 555721 - RNA, 19 nt, Homo sapiens
uggauugucuucucucuuu

SEQ ID NO: 555722 - RNA, 19 nt, Homo sapiens
ggcaugaaaucaaucagaa

SEQ ID NO: 555723 - RNA, 19 nt, Homo sapiens
caucaaacuuggaacauca

SEQ ID NO: 555724 - RNA, 19 nt, Homo sapiens
cauaucagguuacucaaau

SEQ ID NO: 555725 - RNA, 19 nt, Homo sapiens
acaguaagauacagaagaa

SEQ ID NO: 555726 - RNA, 19 nt, Homo sapiens
gaauaaaagugcaacagaa

SEQ ID NO: 555727 - RNA, 19 nt, Homo sapiens
guggaaaucuugugcuguu

SEQ ID NO: 555728 - RNA, 19 nt, Homo sapiens
ccuauuaccuugaggaugu

SEQ ID NO: 555729 - RNA, 19 nt, Homo sapiens
aaacagaguucgaauugag

SEQ ID NO: 555730 - RNA, 19 nt, Homo sapiens
cgaagaguauuuaacuguu

SEQ ID NO: 555731 - RNA, 19 nt, Homo sapiens
gaugugaucuugccaaagc

SEQ ID NO: 555732 - RNA, 19 nt, Homo sapiens
cagaagaauuugauuaguc

SEQ ID NO: 555733 - RNA, 19 nt, Homo sapiens
gcaugaaucggguuauuga

SEQ ID NO: 555734 - RNA, 19 nt, Homo sapiens
ggcauuauaucccuaaaca

SEQ ID NO: 555735 - RNA, 19 nt, Homo sapiens
guaagauacagaagaagua

SEQ ID NO: 555736 - RNA, 19 nt, Homo sapiens
gaggauagcauuucucaag

SEQ ID NO: 555737 - RNA, 19 nt, Homo sapiens
uauauaaccucaguccaaa

SEQ ID NO: 555738 - RNA, 19 nt, Homo sapiens
gcaguggaauaaagagaug

SEQ ID NO: 555739 - RNA, 19 nt, Homo sapiens
aaugaacagucacgacaua

SEQ ID NO: 555740 - RNA, 19 nt, Homo sapiens
guugaugcauugagauauu

SEQ ID NO: 555741 - RNA, 19 nt, Homo sapiens
ugauugaugucacaagauu

SEQ ID NO: 555742 - RNA, 19 nt, Homo sapiens
ucaccuccuuguccaaaua

SEQ ID NO: 555743 - RNA, 19 nt, Homo sapiens
gaaggauggcuaugacuug

SEQ ID NO: 555744 - RNA, 19 nt, Homo sapiens
gcaaggguauuuuagcuaa

SEQ ID NO: 555745 - RNA, 19 nt, Homo sapiens
ugaaucggguuauugaaga

SEQ ID NO: 555746 - RNA, 19 nt, Homo sapiens
ugaagcaugauuagucuua

SEQ ID NO: 555747 - RNA, 19 nt, Homo sapiens
cuuguaaccugagauauuu

SEQ ID NO: 555748 - RNA, 19 nt, Homo sapiens
uggaaccagugcuuaauuu

SEQ ID NO: 555749 - RNA, 19 nt, Homo sapiens
gaaucggguuauugaagaa

SEQ ID NO: 555750 - RNA, 19 nt, Homo sapiens
ggcagcaugucacgacuaa

SEQ ID NO: 555751 - RNA, 19 nt, Homo sapiens
caaauacuccuaucauaag

SEQ ID NO: 555752 - RNA, 19 nt, Homo sapiens
uccaaauacuccuaucaua

SEQ ID NO: 555753 - RNA, 19 nt, Homo sapiens
guaauuggaugcuacuuuu

SEQ ID NO: 555754 - RNA, 19 nt, Homo sapiens
cuaaacagaguucgaauug

SEQ ID NO: 555755 - RNA, 19 nt, Homo sapiens
gauauggaaugcaguaggu

SEQ ID NO: 555756 - RNA, 19 nt, Homo sapiens
gacagcagcuuuggcaaug

SEQ ID NO: 555757 - RNA, 19 nt, Homo sapiens
ugaaaucaaucagaagaga

SEQ ID NO: 555758 - RNA, 19 nt, Homo sapiens
aaagagaugggcauuguuu

SEQ ID NO: 555759 - RNA, 19 nt, Homo sapiens
gauuagcaguggaauaaag

SEQ ID NO: 555760 - RNA, 19 nt, Homo sapiens
gaagauggaaccagugcuu

SEQ ID NO: 555761 - RNA, 19 nt, Homo sapiens
uaugguggaugaucaaaga

SEQ ID NO: 555762 - RNA, 19 nt, Homo sapiens
ccugaaaggccuauuauau

SEQ ID NO: 555763 - RNA, 19 nt, Homo sapiens
ugccuaaucuucugaauca

SEQ ID NO: 555764 - RNA, 19 nt, Homo sapiens
gcauauaggugggcacagu

SEQ ID NO: 555765 - RNA, 19 nt, Homo sapiens
auaagaaucacuuggguua

SEQ ID NO: 555766 - RNA, 19 nt, Homo sapiens
guggaggcauguaauaaga

SEQ ID NO: 555767 - RNA, 19 nt, Homo sapiens
caguaggacuuuguaguuu

SEQ ID NO: 555768 - RNA, 19 nt, Homo sapiens
uaacaugcuuucagucaag

SEQ ID NO: 555769 - RNA, 19 nt, Homo sapiens
gaaccagugcuuaauuugu

SEQ ID NO: 555770 - RNA, 19 nt, Homo sapiens
ggaaacaacguggauacaa

SEQ ID NO: 555771 - RNA, 19 nt, Homo sapiens
gcacucuacgcuccuauuu

SEQ ID NO: 555772 - RNA, 19 nt, Homo sapiens
gaaaucaaucagaagagaa

SEQ ID NO: 555773 - RNA, 19 nt, Homo sapiens
gaauugguagcuuucuuaa

SEQ ID NO: 555774 - RNA, 19 nt, Homo sapiens
gaaugagagccgacaggua

SEQ ID NO: 555775 - RNA, 19 nt, Homo sapiens
cagcauucuuuaucucgua

SEQ ID NO: 555776 - RNA, 19 nt, Homo sapiens
gaaggugacaauauuagug

SEQ ID NO: 555777 - RNA, 19 nt, Homo sapiens
guagugaagcuauugagaa

SEQ ID NO: 555778 - RNA, 19 nt, Homo sapiens
cugaaaggccuauuauauu

SEQ ID NO: 555779 - RNA, 19 nt, Homo sapiens
gcagagagacuaugguuuu

SEQ ID NO: 555780 - RNA, 19 nt, Homo sapiens
gauggaaucugugguuugg

SEQ ID NO: 555781 - RNA, 19 nt, Homo sapiens
uaauucgucuuucuagguu

SEQ ID NO: 555782 - RNA, 19 nt, Homo sapiens
cuggaaagguaaaugauug

SEQ ID NO: 555783 - RNA, 19 nt, Homo sapiens
uaauuugucuugucuaagg

SEQ ID NO: 555784 - RNA, 19 nt, Homo sapiens
ccauguccauaucagguua

SEQ ID NO: 555785 - RNA, 19 nt, Homo sapiens
ggaaacagauucuccauua

SEQ ID NO: 555786 - RNA, 19 nt, Homo sapiens
gcaacuaaguagaugauua

SEQ ID NO: 555787 - RNA, 19 nt, Homo sapiens
caaaggagcuagcaaagaa

SEQ ID NO: 555788 - RNA, 19 nt, Homo sapiens
ggaaaccucuggcauauga

SEQ ID NO: 555789 - RNA, 19 nt, Homo sapiens
ggagaaagauugugacauc

SEQ ID NO: 555790 - RNA, 19 nt, Homo sapiens
ggugugaagugucauaaua

SEQ ID NO: 555791 - RNA, 19 nt, Homo sapiens
gcaaauagauuaacauagc

SEQ ID NO: 555792 - RNA, 19 nt, Homo sapiens
guacagaaguuugucuuaa

SEQ ID NO: 555793 - RNA, 19 nt, Homo sapiens
ggugaaagcuaacauugaa

SEQ ID NO: 555794 - RNA, 19 nt, Homo sapiens
gggagauuauccugaauua

SEQ ID NO: 555795 - RNA, 19 nt, Homo sapiens
caucagaccuugaaauugu

SEQ ID NO: 555796 - RNA, 19 nt, Homo sapiens
ccucguaccuucuccaaua

SEQ ID NO: 555797 - RNA, 19 nt, Homo sapiens
gaaagauugugacaucaga

SEQ ID NO: 555798 - RNA, 19 nt, Homo sapiens
aaacaucacucuucuaucu

SEQ ID NO: 555799 - RNA, 19 nt, Homo sapiens
ucagagugauccuguauaa

SEQ ID NO: 555800 - RNA, 19 nt, Homo sapiens
guaaaugccuuugucgauu

SEQ ID NO: 555801 - RNA, 19 nt, Homo sapiens
ccaauagucuugaucugaa

SEQ ID NO: 555802 - RNA, 19 nt, Homo sapiens
gggaguagauauugacaug

SEQ ID NO: 555803 - RNA, 19 nt, Homo sapiens
gauguuggaugacucgauu

SEQ ID NO: 555804 - RNA, 19 nt, Homo sapiens
uaacauagcaacuaaguag

SEQ ID NO: 555805 - RNA, 19 nt, Homo sapiens
gaaacagauucuccauuag

SEQ ID NO: 555806 - RNA, 19 nt, Homo sapiens
aagaagagguacagaaguu

SEQ ID NO: 555807 - RNA, 19 nt, Homo sapiens
acaaugaucccgcagauuu

SEQ ID NO: 555808 - RNA, 19 nt, Homo sapiens
uaaaugccuuugucgauug

SEQ ID NO: 555809 - RNA, 19 nt, Homo sapiens
ugaacuaccuaaccauuau

SEQ ID NO: 555810 - RNA, 19 nt, Homo sapiens
ccaagcgggugaaagcuaa

SEQ ID NO: 555811 - RNA, 19 nt, Homo sapiens
ggacaaacaagcauuucaa

SEQ ID NO: 555812 - RNA, 19 nt, Homo sapiens
gugauaauuugcugaagaa

SEQ ID NO: 555813 - RNA, 19 nt, Homo sapiens
gacaucagaccuugaaauu

SEQ ID NO: 555814 - RNA, 19 nt, Homo sapiens
ucaaagaauugguaaaugc

SEQ ID NO: 555815 - RNA, 19 nt, Homo sapiens
gaacugugaauauguuaug

SEQ ID NO: 555816 - RNA, 19 nt, Homo sapiens
ggugggaucuguggagaaa

SEQ ID NO: 555817 - RNA, 19 nt, Homo sapiens
caggaaaccucuggcauau

SEQ ID NO: 555818 - RNA, 19 nt, Homo sapiens
cauuauaggugaaguccaa

SEQ ID NO: 555819 - RNA, 19 nt, Homo sapiens
gagugauccuguauaagaa

SEQ ID NO: 555820 - RNA, 19 nt, Homo sapiens
gguucaagauguuggauga

SEQ ID NO: 555821 - RNA, 19 nt, Homo sapiens
ugagaucaauguccaacuu

SEQ ID NO: 555822 - RNA, 19 nt, Homo sapiens
gcaggcagccgguuuguca

SEQ ID NO: 555823 - RNA, 19 nt, Homo sapiens
guucuggauucaagcauaa

SEQ ID NO: 555824 - RNA, 19 nt, Homo sapiens
gaagagguacagaaguuug

SEQ ID NO: 555825 - RNA, 19 nt, Homo sapiens
gaaaacaucuucaaaucag

SEQ ID NO: 555826 - RNA, 19 nt, Homo sapiens
gagauuauccugaauuacu

SEQ ID NO: 555827 - RNA, 19 nt, Homo sapiens
ugaauaaacagaugguuga

SEQ ID NO: 555828 - RNA, 19 nt, Homo sapiens
uaaaguuccucuacucagu

SEQ ID NO: 555829 - RNA, 19 nt, Homo sapiens
caggaacugugaauauguu

SEQ ID NO: 555830 - RNA, 19 nt, Homo sapiens
gcuguaacuugaguacuuu

SEQ ID NO: 555831 - RNA, 19 nt, Homo sapiens
gcugaaauccuagaccuuu

SEQ ID NO: 555832 - RNA, 19 nt, Homo sapiens
gagaaagauugugacauca

SEQ ID NO: 555833 - RNA, 19 nt, Homo sapiens
gauguuccuucuuuccaaa

SEQ ID NO: 555834 - RNA, 19 nt, Homo sapiens
guagaugauuaguugcauu

SEQ ID NO: 555835 - RNA, 19 nt, Homo sapiens
aaacagauucuccauuaga

SEQ ID NO: 555836 - RNA, 19 nt, Homo sapiens
agagugauccuguauaaga

SEQ ID NO: 555837 - RNA, 19 nt, Homo sapiens
uggagggccuaauauaauu

SEQ ID NO: 555838 - RNA, 19 nt, Homo sapiens
acgcaaacaucaaagagaa

SEQ ID NO: 555839 - RNA, 19 nt, Homo sapiens
agaagaagcuacgcaaaca

SEQ ID NO: 555840 - RNA, 19 nt, Homo sapiens
caaugacuaugccagaaga

SEQ ID NO: 555841 - RNA, 19 nt, Homo sapiens
uaccuacccuucuggaauu

SEQ ID NO: 555842 - RNA, 19 nt, Homo sapiens
uccuagaccuuuccaauga

SEQ ID NO: 555843 - RNA, 19 nt, Homo sapiens
gaaacgacagccuggaguu

SEQ ID NO: 555844 - RNA, 19 nt, Homo sapiens
gaugguaaauuuguguugu

SEQ ID NO: 555845 - RNA, 19 nt, Homo sapiens
ggcuguaacuugaguacuu

SEQ ID NO: 555846 - RNA, 19 nt, Homo sapiens
gguucuggauucaagcaua

SEQ ID NO: 555847 - RNA, 19 nt, Homo sapiens
gacaaacaagcauuucaaa

SEQ ID NO: 555848 - RNA, 19 nt, Homo sapiens
aagcagauuugccuaagga

SEQ ID NO: 555849 - RNA, 19 nt, Homo sapiens
gaaguuugucuuaagcuau

SEQ ID NO: 555850 - RNA, 19 nt, Homo sapiens
gguacagaaguuugucuua

SEQ ID NO: 555851 - RNA, 19 nt, Homo sapiens
ccaauaacaaccuaaacuu

SEQ ID NO: 555852 - RNA, 19 nt, Homo sapiens
gguaaaugcuggcuguaac

SEQ ID NO: 555853 - RNA, 19 nt, Homo sapiens
ggagggaugcagagccuuu

SEQ ID NO: 555854 - RNA, 19 nt, Homo sapiens
gaagaagagguacagaagu

SEQ ID NO: 555855 - RNA, 19 nt, Homo sapiens
ucaguuucauuuaggcuuu

SEQ ID NO: 555856 - RNA, 19 nt, Homo sapiens
agaaguuugucuuaagcua

SEQ ID NO: 555857 - RNA, 19 nt, Homo sapiens
ucacaaugaucccgcagau

SEQ ID NO: 555858 - RNA, 19 nt, Homo sapiens
auaggaugauuaccaauga

SEQ ID NO: 555859 - RNA, 19 nt, Homo sapiens
gauucaagcauaaguacuu

SEQ ID NO: 555860 - RNA, 19 nt, Homo sapiens
gaaagcuaacauugaauuc

SEQ ID NO: 555861 - RNA, 19 nt, Homo sapiens
gaugcagagccuuuccuua

SEQ ID NO: 555862 - RNA, 19 nt, Homo sapiens
gucuugaucugaauaaaca

SEQ ID NO: 555863 - RNA, 19 nt, Homo sapiens
ugaagugucauaauacaga

SEQ ID NO: 555864 - RNA, 19 nt, Homo sapiens
cagaaaacaucuucaaauc

SEQ ID NO: 555865 - RNA, 19 nt, Homo sapiens
agucuuaaaugugugcaua

SEQ ID NO: 555866 - RNA, 19 nt, Homo sapiens
gccuaaggaugccaauguu

SEQ ID NO: 555867 - RNA, 19 nt, Homo sapiens
uagacugccucauggaaga

SEQ ID NO: 555868 - RNA, 19 nt, Homo sapiens
uaaaauagacugccucaug

SEQ ID NO: 555869 - RNA, 19 nt, Homo sapiens
caucaaagagaagcuguuu

SEQ ID NO: 555870 - RNA, 19 nt, Homo sapiens
acggucaacuuucaauuug

SEQ ID NO: 555871 - RNA, 19 nt, Homo sapiens
cauagcaacuaaguagaug

SEQ ID NO: 555872 - RNA, 19 nt, Homo sapiens
acaucacucuucuaucuug

SEQ ID NO: 555873 - RNA, 19 nt, Homo sapiens
aaugcuggcuguaacuuga

SEQ ID NO: 555874 - RNA, 19 nt, Homo sapiens
gcagaaaacaucuucaaau

SEQ ID NO: 555875 - RNA, 19 nt, Homo sapiens
ccacgagcaauaacacgua

SEQ ID NO: 555876 - RNA, 19 nt, Homo sapiens
ggagcuagcaaagaaguga

SEQ ID NO: 555877 - RNA, 19 nt, Homo sapiens
gaagcuacgcaaacaucaa

SEQ ID NO: 555878 - RNA, 19 nt, Homo sapiens
caauagucuugaucugaau

SEQ ID NO: 555879 - RNA, 19 nt, Homo sapiens
ggaacguucuccugaaucc

SEQ ID NO: 555880 - RNA, 19 nt, Homo sapiens
ugggaucuguggagaaaga

SEQ ID NO: 555881 - RNA, 19 nt, Homo sapiens
gcuagcaucauaucaagau

SEQ ID NO: 555882 - RNA, 19 nt, Homo sapiens
ccaaaggagcuagcaaaga

SEQ ID NO: 555883 - RNA, 19 nt, Homo sapiens
ucuggcauaugagaaauaa

SEQ ID NO: 555884 - RNA, 19 nt, Homo sapiens
guaaagucucuauuucuuc

SEQ ID NO: 555885 - RNA, 19 nt, Homo sapiens
cagaagaaguguugaagua

SEQ ID NO: 555886 - RNA, 19 nt, Homo sapiens
gcacaugucugggaggaua

SEQ ID NO: 555887 - RNA, 19 nt, Homo sapiens
ugacuucucuaaucaguua

SEQ ID NO: 555888 - RNA, 19 nt, Homo sapiens
aaacuugaccugcuuaaua

SEQ ID NO: 555889 - RNA, 19 nt, Homo sapiens
gaaacaugguuauaagaug

SEQ ID NO: 555890 - RNA, 19 nt, Homo sapiens
gaggaugacuucucuaauc

SEQ ID NO: 555891 - RNA, 19 nt, Homo sapiens
gagcugaacuagagaaaca

SEQ ID NO: 555892 - RNA, 19 nt, Homo sapiens
guuauaagauggagacuuc

SEQ ID NO: 555893 - RNA, 19 nt, Homo sapiens
gagugaggguuccaacuuu

SEQ ID NO: 555894 - RNA, 19 nt, Homo sapiens
gaagaaguguugaaguaac

SEQ ID NO: 555895 - RNA, 19 nt, Homo sapiens
uggcuuagaugaagaugaa

SEQ ID NO: 555896 - RNA, 19 nt, Homo sapiens
agacugggcuggcuuagau

SEQ ID NO: 555897 - RNA, 19 nt, Homo sapiens
guuacgagcugaacuagag

SEQ ID NO: 555898 - RNA, 19 nt, Homo sapiens
agagaaacaugguuauaag

SEQ ID NO: 555899 - RNA, 19 nt, Homo sapiens
gaggauaauugggaugaug

SEQ ID NO: 555900 - RNA, 19 nt, Homo sapiens
gauggagacuucauagcau

SEQ ID NO: 555901 - RNA, 19 nt, Homo sapiens
gagaaacaugguuauaaga

SEQ ID NO: 555902 - RNA, 19 nt, Homo sapiens
gaacuagagaaacaugguu

SEQ ID NO: 555903 - RNA, 19 nt, Homo sapiens
gaugacuucucuaaucagu

SEQ ID NO: 555904 - RNA, 19 nt, Homo sapiens
caauguagaggaugacuuc

SEQ ID NO: 555905 - RNA, 19 nt, Homo sapiens
cgaagacugggcuggcuua

SEQ ID NO: 555906 - RNA, 19 nt, Homo sapiens
uucauuaucugcuuggauu

SEQ ID NO: 555907 - RNA, 19 nt, Homo sapiens
cagucgagaugucagagaa

SEQ ID NO: 555908 - RNA, 19 nt, Homo sapiens
cuagagaaacaugguuaua

SEQ ID NO: 555909 - RNA, 19 nt, Homo sapiens
aggaugacuucucuaauca

SEQ ID NO: 555910 - RNA, 19 nt, Homo sapiens
cugcuuggauuuauuugug

SEQ ID NO: 555911 - RNA, 19 nt, Homo sapiens
cauuaucugcuuggauuua

SEQ ID NO: 555912 - RNA, 19 nt, Homo sapiens
agaagaaguguugaaguaa

SEQ ID NO: 555913 - RNA, 19 nt, Homo sapiens
agaugaagaugaagaugca

SEQ ID NO: 555914 - RNA, 19 nt, Homo sapiens
agaugaagaugcacauguc

SEQ ID NO: 555915 - RNA, 19 nt, Homo sapiens
uaagauggagacuucauag

SEQ ID NO: 555916 - RNA, 19 nt, Homo sapiens
gggaugaugacaauguaga

SEQ ID NO: 555917 - RNA, 19 nt, Homo sapiens
gggcuggcuuagaugaaga

SEQ ID NO: 555918 - RNA, 19 nt, Homo sapiens
gaaguguugaaguaaccua

SEQ ID NO: 555919 - RNA, 19 nt, Homo sapiens
gcauccagaagaaguguug

SEQ ID NO: 555920 - RNA, 19 nt, Homo sapiens
gaagaugaagaugcacaug

SEQ ID NO: 555921 - RNA, 19 nt, Homo sapiens
gacgguggcguuuccuuga

SEQ ID NO: 555922 - RNA, 19 nt, Homo sapiens
ggaggauaauugggaugau

SEQ ID NO: 555923 - RNA, 19 nt, Homo sapiens
gggaggauaauugggauga

SEQ ID NO: 555924 - RNA, 19 nt, Homo sapiens
gcuuggauuuauuuguguu

SEQ ID NO: 555925 - RNA, 19 nt, Homo sapiens
aacuugaccugcuuaauac

SEQ ID NO: 555926 - RNA, 19 nt, Homo sapiens
auaagauggagacuucaua

SEQ ID NO: 555927 - RNA, 19 nt, Homo sapiens
ugaugacaauguagaggau

SEQ ID NO: 555928 - RNA, 19 nt, Homo sapiens
guuccaacuuuucugcuua

SEQ ID NO: 555929 - RNA, 19 nt, Homo sapiens
ugaccugcuuaauacauuc

SEQ ID NO: 555930 - RNA, 19 nt, Homo sapiens
agagugaggguuccaacuu

SEQ ID NO: 555931 - RNA, 19 nt, Homo sapiens
caacuuuucugcuuaucug

SEQ ID NO: 555932 - RNA, 19 nt, Homo sapiens
uugggaugaugacaaugua

SEQ ID NO: 555933 - RNA, 19 nt, Homo sapiens
gguagugacgguggcguuu

SEQ ID NO: 555934 - RNA, 19 nt, Homo sapiens
uugaccugcuuaauacauu

SEQ ID NO: 555935 - RNA, 19 nt, Homo sapiens
agaguucccugccgaagac

SEQ ID NO: 555936 - RNA, 19 nt, Homo sapiens
uucauagcauccagaagaa

SEQ ID NO: 555937 - RNA, 19 nt, Homo sapiens
gcuuagaugaagaugaaga

SEQ ID NO: 555938 - RNA, 19 nt, Homo sapiens
ccagaagaaguguugaagu

SEQ ID NO: 555939 - RNA, 19 nt, Homo sapiens
ccuaaacuugaccugcuua

SEQ ID NO: 555940 - RNA, 19 nt, Homo sapiens
cauagcauccagaagaagu

SEQ ID NO: 555941 - RNA, 19 nt, Homo sapiens
aacuagagaaacaugguua

SEQ ID NO: 555942 - RNA, 19 nt, Homo sapiens
agauggagacuucauagca

SEQ ID NO: 555943 - RNA, 19 nt, Homo sapiens
gaucauaacugaaacaaca

SEQ ID NO: 555944 - RNA, 19 nt, Homo sapiens
gguuguaucugaagaauaa

SEQ ID NO: 555945 - RNA, 19 nt, Homo sapiens
gaacagguuuccagaugaa

SEQ ID NO: 555946 - RNA, 19 nt, Homo sapiens
gagaacagguuuccagaug

SEQ ID NO: 555947 - RNA, 19 nt, Homo sapiens
agaagaggaucauaacuga

SEQ ID NO: 555948 - RNA, 19 nt, Homo sapiens
caaugugacucgcuauuau

SEQ ID NO: 555949 - RNA, 19 nt, Homo sapiens
ggacugugcucugccaaug

SEQ ID NO: 555950 - RNA, 19 nt, Homo sapiens
gaaauaacgcggagaucug

SEQ ID NO: 555951 - RNA, 19 nt, Homo sapiens
gagacgaauucuugcaaug

SEQ ID NO: 555952 - RNA, 19 nt, Homo sapiens
ccaaugugacucgcuauua

SEQ ID NO: 555953 - RNA, 19 nt, Homo sapiens
gggcaacgccaacaauuuc

SEQ ID NO: 555954 - RNA, 19 nt, Homo sapiens
ggaaauaacgcggagaucu

SEQ ID NO: 555955 - RNA, 19 nt, Homo sapiens
guggagggaaugacaauaa

SEQ ID NO: 555956 - RNA, 19 nt, Homo sapiens
cagaugaagcuacuuguau

SEQ ID NO: 555957 - RNA, 19 nt, Homo sapiens
caucuuguuugucuuuaug

SEQ ID NO: 555958 - RNA, 19 nt, Homo sapiens
gaugcuugcuggaggauag

SEQ ID NO: 555959 - RNA, 19 nt, Homo sapiens
gugacucgcuauuauuuua

SEQ ID NO: 555960 - RNA, 19 nt, Homo sapiens
agaugaagcuacuuguaug

SEQ ID NO: 555961 - RNA, 19 nt, Homo sapiens
agaacagguuuccagauga

SEQ ID NO: 555962 - RNA, 19 nt, Homo sapiens
gggcccuacuucuccguua

SEQ ID NO: 555963 - RNA, 19 nt, Homo sapiens
aagaggaucauaacugaaa

SEQ ID NO: 555964 - RNA, 19 nt, Homo sapiens
ccagaugaagcuacuugua

SEQ ID NO: 555965 - RNA, 19 nt, Homo sapiens
gaagaggaucauaacugaa

SEQ ID NO: 555966 - RNA, 19 nt, Homo sapiens
cagaagaggaucauaacug

SEQ ID NO: 555967 - RNA, 19 nt, Homo sapiens
gggaaugacaauaacuuug

SEQ ID NO: 555968 - RNA, 19 nt, Homo sapiens
gagggaaugacaauaacuu

SEQ ID NO: 555969 - RNA, 19 nt, Homo sapiens
ggaaccggauugagaacag

SEQ ID NO: 555970 - RNA, 19 nt, Homo sapiens
uaaucuaaguuccaugaca

SEQ ID NO: 555971 - RNA, 19 nt, Homo sapiens
gagggcaacgccaacaauu

SEQ ID NO: 555972 - RNA, 19 nt, Homo sapiens
uaugucaucuuguuugucu

SEQ ID NO: 555973 - RNA, 19 nt, Homo sapiens
gcaacgccaacaauuucua

SEQ ID NO: 555974 - RNA, 19 nt, Homo sapiens
uggcuuauuugccuuuaug

SEQ ID NO: 555975 - RNA, 19 nt, Homo sapiens
cagaaccugugaugcuuuc

SEQ ID NO: 555976 - RNA, 19 nt, Homo sapiens
ugagacgaauucuugcaau

SEQ ID NO: 555977 - RNA, 19 nt, Homo sapiens
aaucuaaguuccaugacau

SEQ ID NO: 555978 - RNA, 19 nt, Homo sapiens
uuucagaagaggaucauaa

SEQ ID NO: 555979 - RNA, 19 nt, Homo sapiens
gacagcaugaggaaacaaa

SEQ ID NO: 555980 - RNA, 19 nt, Homo sapiens
ccuuuaugguuguaucuga

SEQ ID NO: 555981 - RNA, 19 nt, Homo sapiens
ggaagaagcaauuuuaaac

SEQ ID NO: 555982 - RNA, 19 nt, Homo sapiens
uagcagggaggauugcaaa

SEQ ID NO: 555983 - RNA, 19 nt, Homo sapiens
gaauaauaugacagcauga

SEQ ID NO: 555984 - RNA, 19 nt, Homo sapiens
aaaagaagaugccaaagcu

SEQ ID NO: 555985 - RNA, 19 nt, Homo sapiens
cagggaggauugcaaacgu

SEQ ID NO: 555986 - RNA, 19 nt, Homo sapiens
caggagccaacaggaaaua

SEQ ID NO: 555987 - RNA, 19 nt, Homo sapiens
uuugugagacgaauucuug

SEQ ID NO: 555988 - RNA, 19 nt, Homo sapiens
cuuauuugccuuuaugguu

SEQ ID NO: 555989 - RNA, 19 nt, Homo sapiens
ugucaucuuguuugucuuu

SEQ ID NO: 555990 - RNA, 19 nt, Homo sapiens
gaugaagcuacuuguaugg

SEQ ID NO: 555991 - RNA, 19 nt, Homo sapiens
aauaugacagcaugaggaa

SEQ ID NO: 555992 - RNA, 19 nt, Homo sapiens
ggucguauuccugauuuca

SEQ ID NO: 555993 - RNA, 19 nt, Homo sapiens
gaggaaacaaaucauuggu

SEQ ID NO: 555994 - RNA, 19 nt, Homo sapiens
gucaucuuguuugucuuua

SEQ ID NO: 555995 - RNA, 19 nt, Homo sapiens
gccaaugugacucgcuauu

SEQ ID NO: 555996 - RNA, 19 nt, Homo sapiens
uauggcuuauuugccuuua

SEQ ID NO: 555997 - RNA, 19 nt, Homo sapiens
aaugugacucgcuauuauu

SEQ ID NO: 555998 - RNA, 19 nt, Homo sapiens
gugagacgaauucuugcaa

SEQ ID NO: 555999 - RNA, 19 nt, Homo sapiens
caacuguuugugagacgaa

SEQ ID NO: 556000 - RNA, 19 nt, Homo sapiens
ugaggaaacaaaucauugg

SEQ ID NO: 556001 - RNA, 19 nt, Homo sapiens
cugggaggcuugcgacgau

SEQ ID NO: 556002 - RNA, 19 nt, Homo sapiens
cuuuaugguuguaucugaa

SEQ ID NO: 556003 - RNA, 19 nt, Homo sapiens
aaauaacgcggagaucugu

SEQ ID NO: 556004 - RNA, 19 nt, Homo sapiens
gauauaagcuuaccaaagu

SEQ ID NO: 556005 - RNA, 19 nt, Homo sapiens
caacaacucuuccaacaau

SEQ ID NO: 556006 - RNA, 19 nt, Homo sapiens
gagcuucccuucuuuauuc

SEQ ID NO: 556007 - RNA, 19 nt, Homo sapiens
gaugagagauuuaaugaag

SEQ ID NO: 556008 - RNA, 19 nt, Homo sapiens
caauaaggcuggagaagga

SEQ ID NO: 556009 - RNA, 19 nt, Homo sapiens
gagagcugcuuccaucuuu

SEQ ID NO: 556010 - RNA, 19 nt, Homo sapiens
ucacuaauaucagggcuua

SEQ ID NO: 556011 - RNA, 19 nt, Homo sapiens
auacggaacuucauucauu

SEQ ID NO: 556012 - RNA, 19 nt, Homo sapiens
ggaauucaauccucaugug

SEQ ID NO: 556013 - RNA, 19 nt, Homo sapiens
gacaacaacucuuccaaca

SEQ ID NO: 556014 - RNA, 19 nt, Homo sapiens
gaagagaggagacagugaa

SEQ ID NO: 556015 - RNA, 19 nt, Homo sapiens
ucauagagcuguggaauuc

SEQ ID NO: 556016 - RNA, 19 nt, Homo sapiens
gcaaauacggaacuucauu

SEQ ID NO: 556017 - RNA, 19 nt, Homo sapiens
cagaaagccuggagagaga

SEQ ID NO: 556018 - RNA, 19 nt, Homo sapiens
ggacucagauuccaauagg

SEQ ID NO: 556019 - RNA, 19 nt, Homo sapiens
ucucuuuacugcuggauua

SEQ ID NO: 556020 - RNA, 19 nt, Homo sapiens
gcauaugcauucuuucauc

SEQ ID NO: 556021 - RNA, 19 nt, Homo sapiens
caugaagccuuggagauaa

SEQ ID NO: 556022 - RNA, 19 nt, Homo sapiens
caccagacauucuuuacuu

SEQ ID NO: 556023 - RNA, 19 nt, Homo sapiens
gcucaaguccugcauaguu

SEQ ID NO: 556024 - RNA, 19 nt, Homo sapiens
gagauuuaaugaaggaguu

SEQ ID NO: 556025 - RNA, 19 nt, Homo sapiens
aaagaaggcuagcaaugug

SEQ ID NO: 556026 - RNA, 19 nt, Homo sapiens
caucauggaucccaguaug

SEQ ID NO: 556027 - RNA, 19 nt, Homo sapiens
uaacacggaucugagagaa

SEQ ID NO: 556028 - RNA, 19 nt, Homo sapiens
uccaugaagucucaguuua

SEQ ID NO: 556029 - RNA, 19 nt, Homo sapiens
gcaguagaggccauucaua

SEQ ID NO: 556030 - RNA, 19 nt, Homo sapiens
ggcaaagugucucagaaug

SEQ ID NO: 556031 - RNA, 19 nt, Homo sapiens
gaaaaucaacgacaacuug

SEQ ID NO: 556032 - RNA, 19 nt, Homo sapiens
ggaaaaggggcaccuauuu

SEQ ID NO: 556033 - RNA, 19 nt, Homo sapiens
ugagagauuuaaugaagga

SEQ ID NO: 556034 - RNA, 19 nt, Homo sapiens
caaagugucucagaaugca

SEQ ID NO: 556035 - RNA, 19 nt, Homo sapiens
gcagagaggagcgcugaaa

SEQ ID NO: 556036 - RNA, 19 nt, Homo sapiens
gaaggggcuuugaaucuuu

SEQ ID NO: 556037 - RNA, 19 nt, Homo sapiens
ucaugaagccuuggagaua

SEQ ID NO: 556038 - RNA, 19 nt, Homo sapiens
cagaacauauccugaagag

SEQ ID NO: 556039 - RNA, 19 nt, Homo sapiens
agacauucuuuacuuguga

SEQ ID NO: 556040 - RNA, 19 nt, Homo sapiens
gaugauauaagcuuaccaa

SEQ ID NO: 556041 - RNA, 19 nt, Homo sapiens
gugugcaacugcuuauauu

SEQ ID NO: 556042 - RNA, 19 nt, Homo sapiens
uaaacuuugucauggagaa

SEQ ID NO: 556043 - RNA, 19 nt, Homo sapiens
aggagacagugaagcaaua

SEQ ID NO: 556044 - RNA, 19 nt, Homo sapiens
gagcacagugagcauguuu

SEQ ID NO: 556045 - RNA, 19 nt, Homo sapiens
gaccagggaagcagugaaa

SEQ ID NO: 556046 - RNA, 19 nt, Homo sapiens
ggcacuuccucacuaauau

SEQ ID NO: 556047 - RNA, 19 nt, Homo sapiens
gagcacagcagagaugaau

SEQ ID NO: 556048 - RNA, 19 nt, Homo sapiens
gaaucucucugcccaagac

SEQ ID NO: 556049 - RNA, 19 nt, Homo sapiens
ggagcuucccuucuuuauu

SEQ ID NO: 556050 - RNA, 19 nt, Homo sapiens
gaccaccagacauucuuua

SEQ ID NO: 556051 - RNA, 19 nt, Homo sapiens
caaauacggaacuucauuc

SEQ ID NO: 556052 - RNA, 19 nt, Homo sapiens
gaaggcacuuuucggauga

SEQ ID NO: 556053 - RNA, 19 nt, Homo sapiens
gcaauagcauaugcauucu

SEQ ID NO: 556054 - RNA, 19 nt, Homo sapiens
gagaggagacagugaagca

SEQ ID NO: 556055 - RNA, 19 nt, Homo sapiens
caaagucagcaacaauaug

SEQ ID NO: 556056 - RNA, 19 nt, Homo sapiens
ccaaagucagcaacaauau

SEQ ID NO: 556057 - RNA, 19 nt, Homo sapiens
cagcucaaguccugcauag

SEQ ID NO: 556058 - RNA, 19 nt, Homo sapiens
cucaaguccugcauaguuu

SEQ ID NO: 556059 - RNA, 19 nt, Homo sapiens
gaggaagcaacaaccauug

SEQ ID NO: 556060 - RNA, 19 nt, Homo sapiens
acaggcacuuccucacuaa

SEQ ID NO: 556061 - RNA, 19 nt, Homo sapiens
uggauuauguuccuucaca

SEQ ID NO: 556062 - RNA, 19 nt, Homo sapiens
gcuuccaucuuuccaugaa

SEQ ID NO: 556063 - RNA, 19 nt, Homo sapiens
ggaaggggcuuugaaucuu

SEQ ID NO: 556064 - RNA, 19 nt, Homo sapiens
gggcuuauuuugauauuug

SEQ ID NO: 556065 - RNA, 19 nt, Homo sapiens
gcacagcagagaugaaugc

SEQ ID NO: 556066 - RNA, 19 nt, Homo sapiens
gcaaagugucucagaaugc

SEQ ID NO: 556067 - RNA, 19 nt, Homo sapiens
aacaggcacuuccucacua

SEQ ID NO: 556068 - RNA, 19 nt, Homo sapiens
gaagaggaagcaacaacca

SEQ ID NO: 556069 - RNA, 19 nt, Homo sapiens
cauuaacaccgaaguucua

SEQ ID NO: 556070 - RNA, 19 nt, Homo sapiens
aaauguucauggacuauuc

SEQ ID NO: 556071 - RNA, 19 nt, Homo sapiens
gagaggagcgcugaaacau

SEQ ID NO: 556072 - RNA, 19 nt, Homo sapiens
uaugcauucuuucaucuug

SEQ ID NO: 556073 - RNA, 19 nt, Homo sapiens
agagaugaaugcaguagag

SEQ ID NO: 556074 - RNA, 19 nt, Homo sapiens
gcaacugcuuauauucucu

SEQ ID NO: 556075 - RNA, 19 nt, Homo sapiens
ucccgcagaugcaauaaug

SEQ ID NO: 556076 - RNA, 19 nt, Homo sapiens
uagcauaugcauucuuuca

SEQ ID NO: 556077 - RNA, 19 nt, Homo sapiens
cuucugaguauguucaaua

SEQ ID NO: 556078 - RNA, 19 nt, Homo sapiens
ugucucagaaugcaaagua

SEQ ID NO: 556079 - RNA, 19 nt, Homo sapiens
uaggcaaagugucucagaa

SEQ ID NO: 556080 - RNA, 19 nt, Homo sapiens
uacggaacuucauucauug

SEQ ID NO: 556081 - RNA, 19 nt, Homo sapiens
aagcuuuccucagcacuuu

SEQ ID NO: 556082 - RNA, 19 nt, Homo sapiens
cauaugcauucuuucaucu

SEQ ID NO: 556083 - RNA, 19 nt, Homo sapiens
gaggagacagugaagcaau

SEQ ID NO: 556084 - RNA, 19 nt, Homo sapiens
gcucucagcagcuacaaca

SEQ ID NO: 556085 - RNA, 19 nt, Homo sapiens
cagacauucuuuacuugug

SEQ ID NO: 556086 - RNA, 19 nt, Homo sapiens
gaagcaauagcauaugcau

SEQ ID NO: 556087 - RNA, 19 nt, Homo sapiens
gugaagcaauagcauaugc

SEQ ID NO: 556088 - RNA, 19 nt, Homo sapiens
acagugaagcaauagcaua

SEQ ID NO: 556089 - RNA, 19 nt, Homo sapiens
guagaggccauucauagag

SEQ ID NO: 556090 - RNA, 19 nt, Homo sapiens
caguagaggccauucauag

SEQ ID NO: 556091 - RNA, 19 nt, Homo sapiens
uauauucucuuggcugaag

SEQ ID NO: 556092 - RNA, 19 nt, Homo sapiens
ggauuucugcagcucauga

SEQ ID NO: 556093 - RNA, 19 nt, Homo sapiens
cccaagaccaccagacauu

SEQ ID NO: 556094 - RNA, 19 nt, Homo sapiens
agcaauagcauaugcauuc

SEQ ID NO: 556095 - RNA, 19 nt, Homo sapiens
auagagcuguggaauucaa

SEQ ID NO: 556096 - RNA, 19 nt, Homo sapiens
uggcgaaauccacuaaauu

SEQ ID NO: 556097 - RNA, 19 nt, Homo sapiens
ugcaaaguauggcgaaauc

SEQ ID NO: 556098 - RNA, 19 nt, Homo sapiens
gaucccuuaucccuuggaa

SEQ ID NO: 556099 - RNA, 19 nt, Homo sapiens
ccaaaauaccuacuagaaa

SEQ ID NO: 556100 - RNA, 19 nt, Homo sapiens
uuaccaaagucagcaacaa

SEQ ID NO: 556101 - RNA, 19 nt, Homo sapiens
agaggaagcaacaaccauu

SEQ ID NO: 556102 - RNA, 19 nt, Homo sapiens
gaaagccuggagagagaga

SEQ ID NO: 556103 - RNA, 19 nt, Homo sapiens
guauggcgaaauccacuaa

SEQ ID NO: 556104 - RNA, 19 nt, Homo sapiens
gaaauuagguccagaguug

SEQ ID NO: 556105 - RNA, 19 nt, Homo sapiens
gauauaagcuuaccaaagu

SEQ ID NO: 556106 - RNA, 19 nt, Homo sapiens
caacaacucuuccaacaau

SEQ ID NO: 556107 - RNA, 19 nt, Homo sapiens
gagcuucccuucuuuauuc

SEQ ID NO: 556108 - RNA, 19 nt, Homo sapiens
gaugagagauuuaaugaag

SEQ ID NO: 556109 - RNA, 19 nt, Homo sapiens
ggaaugcccuucacuguca

SEQ ID NO: 556110 - RNA, 19 nt, Homo sapiens
ucacuucccugcuuaaauu

SEQ ID NO: 556111 - RNA, 19 nt, Homo sapiens
gcaacuaggccuucaguaa

SEQ ID NO: 556112 - RNA, 19 nt, Homo sapiens
caauaaggcuggagaagga

SEQ ID NO: 556113 - RNA, 19 nt, Homo sapiens
gcacaccucugcaccuuug

SEQ ID NO: 556114 - RNA, 19 nt, Homo sapiens
ggagauaaaugaaauuagg

SEQ ID NO: 556115 - RNA, 19 nt, Homo sapiens
gagagcugcuuccaucuuu

SEQ ID NO: 556116 - RNA, 19 nt, Homo sapiens
ucacugcucuucagccaua

SEQ ID NO: 556117 - RNA, 19 nt, Homo sapiens
gcaccucaaucucaacauu

SEQ ID NO: 556118 - RNA, 19 nt, Homo sapiens
ucacuaauaucagggcuua

SEQ ID NO: 556119 - RNA, 19 nt, Homo sapiens
caacuaggccuucaguaaa

SEQ ID NO: 556120 - RNA, 19 nt, Homo sapiens
auacggaacuucauucauu

SEQ ID NO: 556121 - RNA, 19 nt, Homo sapiens
ggaauucaauccucaugug

SEQ ID NO: 556122 - RNA, 19 nt, Homo sapiens
gacaacaacucuuccaaca

SEQ ID NO: 556123 - RNA, 19 nt, Homo sapiens
gaagagaggagacagugaa

SEQ ID NO: 556124 - RNA, 19 nt, Homo sapiens
ucauagagcuguggaauuc

SEQ ID NO: 556125 - RNA, 19 nt, Homo sapiens
gcaaauacggaacuucauu

SEQ ID NO: 556126 - RNA, 19 nt, Homo sapiens
cagaaagccuggagagaga

SEQ ID NO: 556127 - RNA, 19 nt, Homo sapiens
ggacucagauuccaauagg

SEQ ID NO: 556128 - RNA, 19 nt, Homo sapiens
ggacuggaauugcaagagu

SEQ ID NO: 556129 - RNA, 19 nt, Homo sapiens
guucuaaccuccuaagcaa

SEQ ID NO: 556130 - RNA, 19 nt, Homo sapiens
ucucuuuacugcuggauua

SEQ ID NO: 556131 - RNA, 19 nt, Homo sapiens
gcauaugcauucuuucauc

SEQ ID NO: 556132 - RNA, 19 nt, Homo sapiens
caugaagccuuggagauaa

SEQ ID NO: 556133 - RNA, 19 nt, Homo sapiens
gaauggucuuucugaauug

SEQ ID NO: 556134 - RNA, 19 nt, Homo sapiens
caccagacauucuuuacuu

SEQ ID NO: 556135 - RNA, 19 nt, Homo sapiens
gcucaaguccugcauaguu

SEQ ID NO: 556136 - RNA, 19 nt, Homo sapiens
gagauuuaaugaaggaguu

SEQ ID NO: 556137 - RNA, 19 nt, Homo sapiens
aaagaaggcuagcaaugug

SEQ ID NO: 556138 - RNA, 19 nt, Homo sapiens
caucauggaucccaguaug

SEQ ID NO: 556139 - RNA, 19 nt, Homo sapiens
caaagugugcaacugcuua

SEQ ID NO: 556140 - RNA, 19 nt, Homo sapiens
ucccaaagcaucccucuua

SEQ ID NO: 556141 - RNA, 19 nt, Homo sapiens
gcaugucacuucccugcuu

SEQ ID NO: 556142 - RNA, 19 nt, Homo sapiens
uccaugaagucucaguuua

SEQ ID NO: 556143 - RNA, 19 nt, Homo sapiens
gcaguagaggccauucaua

SEQ ID NO: 556144 - RNA, 19 nt, Homo sapiens
aagcaucccucuuagucua

SEQ ID NO: 556145 - RNA, 19 nt, Homo sapiens
ggcaaagugucucagaaug

SEQ ID NO: 556146 - RNA, 19 nt, Homo sapiens
gaaaaucaacgacaacuug

SEQ ID NO: 556147 - RNA, 19 nt, Homo sapiens
gaucaaguccuaguuguuc

SEQ ID NO: 556148 - RNA, 19 nt, Homo sapiens
ugccugaacuccugccaua

SEQ ID NO: 556149 - RNA, 19 nt, Homo sapiens
cacaaucugucaguucuaa

SEQ ID NO: 556150 - RNA, 19 nt, Homo sapiens
ggaaaaggggcaccuauuu

SEQ ID NO: 556151 - RNA, 19 nt, Homo sapiens
ugagagauuuaaugaagga

SEQ ID NO: 556152 - RNA, 19 nt, Homo sapiens
uuaggugucuguccuuuau

SEQ ID NO: 556153 - RNA, 19 nt, Homo sapiens
gcagagaggagcgcugaaa

SEQ ID NO: 556154 - RNA, 19 nt, Homo sapiens
caaagcaucccucuuaguc

SEQ ID NO: 556155 - RNA, 19 nt, Homo sapiens
caaagugucucagaaugca

SEQ ID NO: 556156 - RNA, 19 nt, Homo sapiens
gacuggaauugcaagagua

SEQ ID NO: 556157 - RNA, 19 nt, Homo sapiens
gaaggggcuuugaaucuuu

SEQ ID NO: 556158 - RNA, 19 nt, Homo sapiens
ucaugaagccuuggagaua

SEQ ID NO: 556159 - RNA, 19 nt, Homo sapiens
caugucacuucccugcuua

SEQ ID NO: 556160 - RNA, 19 nt, Homo sapiens
cagaacauauccugaagag

SEQ ID NO: 556161 - RNA, 19 nt, Homo sapiens
agacauucuuuacuuguga

SEQ ID NO: 556162 - RNA, 19 nt, Homo sapiens
gaugauauaagcuuaccaa

SEQ ID NO: 556163 - RNA, 19 nt, Homo sapiens
gugugcaacugcuuauauu

SEQ ID NO: 556164 - RNA, 19 nt, Homo sapiens
aggagacagugaagcaaua

SEQ ID NO: 556165 - RNA, 19 nt, Homo sapiens
gagcacagugagcauguuu

SEQ ID NO: 556166 - RNA, 19 nt, Homo sapiens
guucuucuaagcugaguua

SEQ ID NO: 556167 - RNA, 19 nt, Homo sapiens
gaccagggaagcagugaaa

SEQ ID NO: 556168 - RNA, 19 nt, Homo sapiens
ggcacuuccucacuaauau

SEQ ID NO: 556169 - RNA, 19 nt, Homo sapiens
gagcacagcagagaugaau

SEQ ID NO: 556170 - RNA, 19 nt, Homo sapiens
agucuuaacuggucuccuu

SEQ ID NO: 556171 - RNA, 19 nt, Homo sapiens
gaaucucucugcccaagac

SEQ ID NO: 556172 - RNA, 19 nt, Homo sapiens
ggagcuucccuucuuuauu

SEQ ID NO: 556173 - RNA, 19 nt, Homo sapiens
gaccaccagacauucuuua

SEQ ID NO: 556174 - RNA, 19 nt, Homo sapiens
caaauacggaacuucauuc

SEQ ID NO: 556175 - RNA, 19 nt, Homo sapiens
gaaggcacuuuucggauga

SEQ ID NO: 556176 - RNA, 19 nt, Homo sapiens
gcaauagcauaugcauucu

SEQ ID NO: 556177 - RNA, 19 nt, Homo sapiens
gagaggagacagugaagca

SEQ ID NO: 556178 - RNA, 19 nt, Homo sapiens
cagcucaaguccugcauag

SEQ ID NO: 556179 - RNA, 19 nt, Homo sapiens
caaagucagcaacaauaug

SEQ ID NO: 556180 - RNA, 19 nt, Homo sapiens
ccaaagucagcaacaauau

SEQ ID NO: 556181 - RNA, 19 nt, Homo sapiens
gaggaagcaacaaccauug

SEQ ID NO: 556182 - RNA, 19 nt, Homo sapiens
cucaaguccugcauaguuu

SEQ ID NO: 556183 - RNA, 19 nt, Homo sapiens
acaggcacuuccucacuaa

SEQ ID NO: 556184 - RNA, 19 nt, Homo sapiens
uguugaagaugaacuggaa

SEQ ID NO: 556185 - RNA, 19 nt, Homo sapiens
uggauuauguuccuucaca

SEQ ID NO: 556186 - RNA, 19 nt, Homo sapiens
gcuuccaucuuuccaugaa

SEQ ID NO: 556187 - RNA, 19 nt, Homo sapiens
ggaaggggcuuugaaucuu

SEQ ID NO: 556188 - RNA, 19 nt, Homo sapiens
gggcuuauuuugauauuug

SEQ ID NO: 556189 - RNA, 19 nt, Homo sapiens
gcacagcagagaugaaugc

SEQ ID NO: 556190 - RNA, 19 nt, Homo sapiens
gcaaagugucucagaaugc

SEQ ID NO: 556191 - RNA, 19 nt, Homo sapiens
aacaggcacuuccucacua

SEQ ID NO: 556192 - RNA, 19 nt, Homo sapiens
uggaauugcaagaguauuu

SEQ ID NO: 556193 - RNA, 19 nt, Homo sapiens
cauuaacaccgaaguucua

SEQ ID NO: 556194 - RNA, 19 nt, Homo sapiens
gaagaggaagcaacaacca

SEQ ID NO: 556195 - RNA, 19 nt, Homo sapiens
ggaucaaguccuaguuguu

SEQ ID NO: 556196 - RNA, 19 nt, Homo sapiens
gaacuccugccauagucuu

SEQ ID NO: 556197 - RNA, 19 nt, Homo sapiens
ccucuucuuucccuccuuu

SEQ ID NO: 556198 - RNA, 19 nt, Homo sapiens
gagaggagcgcugaaacau

SEQ ID NO: 556199 - RNA, 19 nt, Homo sapiens
uaugcauucuuucaucuug

SEQ ID NO: 556200 - RNA, 19 nt, Homo sapiens
agagaugaaugcaguagag

SEQ ID NO: 556201 - RNA, 19 nt, Homo sapiens
gcaacugcuuauauucucu

SEQ ID NO: 556202 - RNA, 19 nt, Homo sapiens
ucccgcagaugcaauaaug

SEQ ID NO: 556203 - RNA, 19 nt, Homo sapiens
ugucaguucuaaccuccua

SEQ ID NO: 556204 - RNA, 19 nt, Homo sapiens
gaagagaacuuugagaaca

SEQ ID NO: 556205 - RNA, 19 nt, Homo sapiens
ggccagaguuucagugaua

SEQ ID NO: 556206 - RNA, 19 nt, Homo sapiens
gcacggagacucaaaguga

SEQ ID NO: 556207 - RNA, 19 nt, Homo sapiens
ggacagaggagcuaaucua

SEQ ID NO: 556208 - RNA, 19 nt, Homo sapiens
gccagaagauugaguuuga

SEQ ID NO: 556209 - RNA, 19 nt, Homo sapiens
gaacuaggccuucucaaag

SEQ ID NO: 556210 - RNA, 19 nt, Homo sapiens
ccucuaagguaucuucuaa

SEQ ID NO: 556211 - RNA, 19 nt, Homo sapiens
aaacauagcuguggaucau

SEQ ID NO: 556212 - RNA, 19 nt, Homo sapiens
gggaaccuuucaucauuaa

SEQ ID NO: 556213 - RNA, 19 nt, Homo sapiens
ccaaguaugugacguaguc

SEQ ID NO: 556214 - RNA, 19 nt, Homo sapiens
cuaauaaacuuggcacuuc

SEQ ID NO: 556215 - RNA, 19 nt, Homo sapiens
ucucaaagcuaaggacaaa

SEQ ID NO: 556216 - RNA, 19 nt, Homo sapiens
gauacucucucacucuaau

SEQ ID NO: 556217 - RNA, 19 nt, Homo sapiens
caauggcucuucucucguu

SEQ ID NO: 556218 - RNA, 19 nt, Homo sapiens
ucaaacugcugcuccagaa

SEQ ID NO: 556219 - RNA, 19 nt, Homo sapiens
gugauguuguccugaauaa

SEQ ID NO: 556220 - RNA, 19 nt, Homo sapiens
ccgagagaaugaugaauug

SEQ ID NO: 556221 - RNA, 19 nt, Homo sapiens
uaucuucuccuuccaagua

SEQ ID NO: 556222 - RNA, 19 nt, Homo sapiens
uuucagaccuggaagagaa

SEQ ID NO: 556223 - RNA, 19 nt, Homo sapiens
ugggaaccuuucaucauua

SEQ ID NO: 556224 - RNA, 19 nt, Homo sapiens
acauagcuguggaucauuu

SEQ ID NO: 556225 - RNA, 19 nt, Homo sapiens
caauaacaauguccagagu

SEQ ID NO: 556226 - RNA, 19 nt, Homo sapiens
ggacugcaauaacaauguc

SEQ ID NO: 556227 - RNA, 19 nt, Homo sapiens
gcuccaaacucaucaacuc

SEQ ID NO: 556228 - RNA, 19 nt, Homo sapiens
agugauagccguauguuaa

SEQ ID NO: 556229 - RNA, 19 nt, Homo sapiens
cugggaaccuuucaucauu

SEQ ID NO: 556230 - RNA, 19 nt, Homo sapiens
gagaggaguuggaccuucu

SEQ ID NO: 556231 - RNA, 19 nt, Homo sapiens
gccgauuccugguauuuga

SEQ ID NO: 556232 - RNA, 19 nt, Homo sapiens
ucaagacgcugcuccaaac

SEQ ID NO: 556233 - RNA, 19 nt, Homo sapiens
uuccagagccugaugaaua

SEQ ID NO: 556234 - RNA, 19 nt, Homo sapiens
gcugcaagaggucaaauuu

SEQ ID NO: 556235 - RNA, 19 nt, Homo sapiens
gaacagcaagccuaagucu

SEQ ID NO: 556236 - RNA, 19 nt, Homo sapiens
ccucaaguccuuucugauu

SEQ ID NO: 556237 - RNA, 19 nt, Homo sapiens
caaccagaccuaucaggaa

SEQ ID NO: 556238 - RNA, 19 nt, Homo sapiens
gcucuucucucguuuacag

SEQ ID NO: 556239 - RNA, 19 nt, Homo sapiens
gguagccgauuccugguau

SEQ ID NO: 556240 - RNA, 19 nt, Homo sapiens
gggucuaccugccuuaugu

SEQ ID NO: 556241 - RNA, 19 nt, Homo sapiens
ggaaaagugugaaaugaag

SEQ ID NO: 556242 - RNA, 19 nt, Homo sapiens
gaauagcaacagcaauuuc

SEQ ID NO: 556243 - RNA, 19 nt, Homo sapiens
aagccuaagucuucucuga

SEQ ID NO: 556244 - RNA, 19 nt, Homo sapiens
auaacaauguccagaguau

SEQ ID NO: 556245 - RNA, 19 nt, Homo sapiens
aagagaacuuugagaacaa

SEQ ID NO: 556246 - RNA, 19 nt, Homo sapiens
agagaggccuucuguggau

SEQ ID NO: 556247 - RNA, 19 nt, Homo sapiens
gaucauuuccaacuuucaa

SEQ ID NO: 556248 - RNA, 19 nt, Homo sapiens
uaaucuaccugagccagaa

SEQ ID NO: 556249 - RNA, 19 nt, Homo sapiens
cagaggagcuaaucuaccu

SEQ ID NO: 556250 - RNA, 19 nt, Homo sapiens
gaacuuugagaacaauauc

SEQ ID NO: 556251 - RNA, 19 nt, Homo sapiens
ggaguauagugauguuguc

SEQ ID NO: 556252 - RNA, 19 nt, Homo sapiens
ccaggaguauagugauguu

SEQ ID NO: 556253 - RNA, 19 nt, Homo sapiens
auucagagcuggccagagu

SEQ ID NO: 556254 - RNA, 19 nt, Homo sapiens
gaaagccgacguggugaug

SEQ ID NO: 556255 - RNA, 19 nt, Homo sapiens
uaauaaacuuggcacuucu

SEQ ID NO: 556256 - RNA, 19 nt, Homo sapiens
ucagcccggugaccucuaa

SEQ ID NO: 556257 - RNA, 19 nt, Homo sapiens
gugauagccguauguuaaa

SEQ ID NO: 556258 - RNA, 19 nt, Homo sapiens
gaagaacaagcugcucaug

SEQ ID NO: 556259 - RNA, 19 nt, Homo sapiens
ggaagagaacuuugagaac

SEQ ID NO: 556260 - RNA, 19 nt, Homo sapiens
gcgccacguuccuuucaga

SEQ ID NO: 556261 - RNA, 19 nt, Homo sapiens
gauguuguccugaauaagg

SEQ ID NO: 556262 - RNA, 19 nt, Homo sapiens
aacagaaucucaccucagu

SEQ ID NO: 556263 - RNA, 19 nt, Homo sapiens
agacgcugcuccaaacuca

SEQ ID NO: 556264 - RNA, 19 nt, Homo sapiens
ugaauuggcacuggagaaa

SEQ ID NO: 556265 - RNA, 19 nt, Homo sapiens
uaccugagccagaagauug

SEQ ID NO: 556266 - RNA, 19 nt, Homo sapiens
ucaccaaccagaccuauca

SEQ ID NO: 556267 - RNA, 19 nt, Homo sapiens
uggaagagaacuuugagaa

SEQ ID NO: 556268 - RNA, 19 nt, Homo sapiens
ccugcgcagucuaaacaua

SEQ ID NO: 556269 - RNA, 19 nt, Homo sapiens
acagcaagccuaagucuuc

SEQ ID NO: 556270 - RNA, 19 nt, Homo sapiens
ggaagcucaucgagucaag

SEQ ID NO: 556271 - RNA, 19 nt, Homo sapiens
ggggaaaagugugaaauga

SEQ ID NO: 556272 - RNA, 19 nt, Homo sapiens
uucgugagcugaagaacaa

SEQ ID NO: 556273 - RNA, 19 nt, Homo sapiens
agauugaguuugagugcaa

SEQ ID NO: 556274 - RNA, 19 nt, Homo sapiens
ugaauagcaacagcaauuu

SEQ ID NO: 556275 - RNA, 19 nt, Homo sapiens
uccagagccugaugaauag

SEQ ID NO: 556276 - RNA, 19 nt, Homo sapiens
auagugauguuguccugaa

SEQ ID NO: 556277 - RNA, 19 nt, Homo sapiens
uggaccuucuggaguguua

SEQ ID NO: 556278 - RNA, 19 nt, Homo sapiens
gguggaacagcaagccuaa

SEQ ID NO: 556279 - RNA, 19 nt, Homo sapiens
cacggagacucaaagugaa

SEQ ID NO: 556280 - RNA, 19 nt, Homo sapiens
ucaaguccuuucugauucu

SEQ ID NO: 556281 - RNA, 19 nt, Homo sapiens
gggccacacuuuccaacca

SEQ ID NO: 556282 - RNA, 19 nt, Homo sapiens
uaagagggguuaacacauc

SEQ ID NO: 556283 - RNA, 19 nt, Homo sapiens
ucagagcuggccagaguuu

SEQ ID NO: 556284 - RNA, 19 nt, Homo sapiens
ugacucagcagagcaguga

SEQ ID NO: 556285 - RNA, 19 nt, Homo sapiens
gaaccacgccccagacuuc

SEQ ID NO: 556286 - RNA, 19 nt, Homo sapiens
uaccaggaguauagugaug

SEQ ID NO: 556287 - RNA, 19 nt, Homo sapiens
cagcagguggaguucauuu

SEQ ID NO: 556288 - RNA, 19 nt, Homo sapiens
ugaaaugaagcuacaugga

SEQ ID NO: 556289 - RNA, 19 nt, Homo sapiens
gagccagaagauugaguuu

SEQ ID NO: 556290 - RNA, 19 nt, Homo sapiens
ccuccagggugcagauuca

SEQ ID NO: 556291 - RNA, 19 nt, Homo sapiens
gugcacagaaccugaagga

SEQ ID NO: 556292 - RNA, 19 nt, Homo sapiens
aaaccuguuccgacucuuu

SEQ ID NO: 556293 - RNA, 19 nt, Homo sapiens
ucccucaaguccuuucuga

SEQ ID NO: 556294 - RNA, 19 nt, Homo sapiens
augaauagcaacagcaauu

SEQ ID NO: 556295 - RNA, 19 nt, Homo sapiens
gcaccaauggcucuucucu

SEQ ID NO: 556296 - RNA, 19 nt, Homo sapiens
ggaggugaugggaggcuuu

SEQ ID NO: 556297 - RNA, 19 nt, Homo sapiens
cccgagagaaugaugaauu

SEQ ID NO: 556298 - RNA, 19 nt, Homo sapiens
ccgagaggguagccgauuc

SEQ ID NO: 556299 - RNA, 19 nt, Homo sapiens
uaugugacguaguccugaa

SEQ ID NO: 556300 - RNA, 19 nt, Homo sapiens
ucugagaucuaugucuguu

SEQ ID NO: 556301 - RNA, 19 nt, Homo sapiens
cucaaguccuuucugauuc

SEQ ID NO: 556302 - RNA, 19 nt, Homo sapiens
uccgggaggucuuggagaa

SEQ ID NO: 556303 - RNA, 19 nt, Homo sapiens
ccucccagcugcuuuacca

SEQ ID NO: 556304 - RNA, 19 nt, Homo sapiens
gaagaaagauuccagugaa

SEQ ID NO: 556305 - RNA, 19 nt, Homo sapiens
gaaacgugauggagaguaa

SEQ ID NO: 556306 - RNA, 19 nt, Homo sapiens
agaaggagcucuacagaaa

SEQ ID NO: 556307 - RNA, 19 nt, Homo sapiens
gagaucaccuuccgcuaua

SEQ ID NO: 556308 - RNA, 19 nt, Homo sapiens
gaauacagcccaacacuug

SEQ ID NO: 556309 - RNA, 19 nt, Homo sapiens
gcacacagauggcuugucu

SEQ ID NO: 556310 - RNA, 19 nt, Homo sapiens
gaagaguucugggaaguau

SEQ ID NO: 556311 - RNA, 19 nt, Homo sapiens
ccaaaugcauucugggauu

SEQ ID NO: 556312 - RNA, 19 nt, Homo sapiens
gaauaaaacuugcuacuag

SEQ ID NO: 556313 - RNA, 19 nt, Homo sapiens
gcucucaaauugucucaaa

SEQ ID NO: 556314 - RNA, 19 nt, Homo sapiens
ggauuacaguuuccaaaug

SEQ ID NO: 556315 - RNA, 19 nt, Homo sapiens
gauuugcgguugcuuagaa

SEQ ID NO: 556316 - RNA, 19 nt, Homo sapiens
gcccacugaugcuuacuua

SEQ ID NO: 556317 - RNA, 19 nt, Homo sapiens
ggagaaugauggcgucugu

SEQ ID NO: 556318 - RNA, 19 nt, Homo sapiens
aaacgacgcuccacaccuu

SEQ ID NO: 556319 - RNA, 19 nt, Homo sapiens
gaaagauuccagugaaguu

SEQ ID NO: 556320 - RNA, 19 nt, Homo sapiens
gggcaguucuguccucuug

SEQ ID NO: 556321 - RNA, 19 nt, Homo sapiens
cccaaaggcuguccugaaa

SEQ ID NO: 556322 - RNA, 19 nt, Homo sapiens
gaagagcuuuguccagaag

SEQ ID NO: 556323 - RNA, 19 nt, Homo sapiens
gaagauggccguggaguuc

SEQ ID NO: 556324 - RNA, 19 nt, Homo sapiens
gaaguauaacccuccauuu

SEQ ID NO: 556325 - RNA, 19 nt, Homo sapiens
ccacaucccuuggaggaaa

SEQ ID NO: 556326 - RNA, 19 nt, Homo sapiens
ggaguuggguacagagaug

SEQ ID NO: 556327 - RNA, 19 nt, Homo sapiens
gcagcugccuggaagaguu

SEQ ID NO: 556328 - RNA, 19 nt, Homo sapiens
ggaaguauaacccuccauu

SEQ ID NO: 556329 - RNA, 19 nt, Homo sapiens
aaacaggagcuacaguaua

SEQ ID NO: 556330 - RNA, 19 nt, Homo sapiens
cuacgaauguucugagugu

SEQ ID NO: 556331 - RNA, 19 nt, Homo sapiens
ggacuggaccuacccucua

SEQ ID NO: 556332 - RNA, 19 nt, Homo sapiens
ccaauggccugcuuuaagg

SEQ ID NO: 556333 - RNA, 19 nt, Homo sapiens
gcaguucuguccucuugga

SEQ ID NO: 556334 - RNA, 19 nt, Homo sapiens
ccuauuacaccaauccuua

SEQ ID NO: 556335 - RNA, 19 nt, Homo sapiens
ugaaguugcugaugguaug

SEQ ID NO: 556336 - RNA, 19 nt, Homo sapiens
ucaaacaggagcuacagua

SEQ ID NO: 556337 - RNA, 19 nt, Homo sapiens
gaugauuugcgguugcuua

SEQ ID NO: 556338 - RNA, 19 nt, Homo sapiens
caaaugcauucugggauug

SEQ ID NO: 556339 - RNA, 19 nt, Homo sapiens
ggaaggcccugcggaucuu

SEQ ID NO: 556340 - RNA, 19 nt, Homo sapiens
gcagaaggagcucuacaga

SEQ ID NO: 556341 - RNA, 19 nt, Homo sapiens
gaugcugggugacuuggaa

SEQ ID NO: 556342 - RNA, 19 nt, Homo sapiens
uuacaccaauccuuacuug

SEQ ID NO: 556343 - RNA, 19 nt, Homo sapiens
ugagggcaguuguuuguga

SEQ ID NO: 556344 - RNA, 19 nt, Homo sapiens
gauuacaguuuccaaaugc

SEQ ID NO: 556345 - RNA, 19 nt, Homo sapiens
gcagcccuguugagaagaa

SEQ ID NO: 556346 - RNA, 19 nt, Homo sapiens
gaaaucucauaggcaggua

SEQ ID NO: 556347 - RNA, 19 nt, Homo sapiens
ggaagaguucugggaagua

SEQ ID NO: 556348 - RNA, 19 nt, Homo sapiens
gagcuucagucacccaucu

SEQ ID NO: 556349 - RNA, 19 nt, Homo sapiens
ucucaggaguguugaaugu

SEQ ID NO: 556350 - RNA, 19 nt, Homo sapiens
gagcaggaaugggagaauc

SEQ ID NO: 556351 - RNA, 19 nt, Homo sapiens
gccuggugcucucaaauug

SEQ ID NO: 556352 - RNA, 19 nt, Homo sapiens
ccucaucugugguuacugu

SEQ ID NO: 556353 - RNA, 19 nt, Homo sapiens
ucucaugcauugcugaaga

SEQ ID NO: 556354 - RNA, 19 nt, Homo sapiens
ugauggagaguaacuauga

SEQ ID NO: 556355 - RNA, 19 nt, Homo sapiens
gggcaguuguuugugauug

SEQ ID NO: 556356 - RNA, 19 nt, Homo sapiens
aacaggagcuacaguauac

SEQ ID NO: 556357 - RNA, 19 nt, Homo sapiens
caaacaggagcuacaguau

SEQ ID NO: 556358 - RNA, 19 nt, Homo sapiens
agaaugauggcgucuguuu

SEQ ID NO: 556359 - RNA, 19 nt, Homo sapiens
ucaggaguguugaaugugu

SEQ ID NO: 556360 - RNA, 19 nt, Homo sapiens
gcccgaagcagaaaucuca

SEQ ID NO: 556361 - RNA, 19 nt, Homo sapiens
agaagaaagauuccaguga

SEQ ID NO: 556362 - RNA, 19 nt, Homo sapiens
gcccaaaggcuguccugaa

SEQ ID NO: 556363 - RNA, 19 nt, Homo sapiens
ggaucuuccuggagaguuc

SEQ ID NO: 556364 - RNA, 19 nt, Homo sapiens
ccacaccuuuaacuucuuc

SEQ ID NO: 556365 - RNA, 19 nt, Homo sapiens
agaagagcuuuguccagaa

SEQ ID NO: 556366 - RNA, 19 nt, Homo sapiens
ugagaucaccuuccgcuau

SEQ ID NO: 556367 - RNA, 19 nt, Homo sapiens
gcucuggggucauauguga

SEQ ID NO: 556368 - RNA, 19 nt, Homo sapiens
uuguagaaguuguuccuaa

SEQ ID NO: 556369 - RNA, 19 nt, Homo sapiens
gguaguagaguuccuagca

SEQ ID NO: 556370 - RNA, 19 nt, Homo sapiens
gcuacaguauacacaggaa

SEQ ID NO: 556371 - RNA, 19 nt, Homo sapiens
uaaagaauacagcccaaca

SEQ ID NO: 556372 - RNA, 19 nt, Homo sapiens
gugauugccuucccuuguc

SEQ ID NO: 556373 - RNA, 19 nt, Homo sapiens
gagggcaguuguuugugau

SEQ ID NO: 556374 - RNA, 19 nt, Homo sapiens
cagaaggagcucuacagaa

SEQ ID NO: 556375 - RNA, 19 nt, Homo sapiens
gcuccacaccuuuaacuuc

SEQ ID NO: 556376 - RNA, 19 nt, Homo sapiens
gacuggaccuacccucuag

SEQ ID NO: 556377 - RNA, 19 nt, Homo sapiens
guaccaagccaagcccaaa

SEQ ID NO: 556378 - RNA, 19 nt, Homo sapiens
ggagaguaacuaugagaca

SEQ ID NO: 556379 - RNA, 19 nt, Homo sapiens
uaagaguuguagaaguugu

SEQ ID NO: 556380 - RNA, 19 nt, Homo sapiens
agaguucugggaaguauaa

SEQ ID NO: 556381 - RNA, 19 nt, Homo sapiens
gcugccaaguuugcuguuu

SEQ ID NO: 556382 - RNA, 19 nt, Homo sapiens
ugaaaacccuguggaagaa

SEQ ID NO: 556383 - RNA, 19 nt, Homo sapiens
acacagauggcuugucuca

SEQ ID NO: 556384 - RNA, 19 nt, Homo sapiens
gcugaaaccacagaccaaa

SEQ ID NO: 556385 - RNA, 19 nt, Homo sapiens
auucugggauugccuauuc

SEQ ID NO: 556386 - RNA, 19 nt, Homo sapiens
ucauccugcugccaaguuu

SEQ ID NO: 556387 - RNA, 19 nt, Homo sapiens
guuccuagcagcagcagaa

SEQ ID NO: 556388 - RNA, 19 nt, Homo sapiens
gaaugauggcgucuguuuc

SEQ ID NO: 556389 - RNA, 19 nt, Homo sapiens
gcaacaggaacuucuggau

SEQ ID NO: 556390 - RNA, 19 nt, Homo sapiens
gugguucggauuacaguuu

SEQ ID NO: 556391 - RNA, 19 nt, Homo sapiens
acacuuccuucacaagcaa

SEQ ID NO: 556392 - RNA, 19 nt, Homo sapiens
ccaagcugcaucaguguga

SEQ ID NO: 556393 - RNA, 19 nt, Homo sapiens
ccagugguuauuugaguuu

SEQ ID NO: 556394 - RNA, 19 nt, Homo sapiens
cugcagcccuguugagaag

SEQ ID NO: 556395 - RNA, 19 nt, Homo sapiens
ccacugaugcuuacuuagg

SEQ ID NO: 556396 - RNA, 19 nt, Homo sapiens
cagagaugcugggugacuu

SEQ ID NO: 556397 - RNA, 19 nt, Homo sapiens
ugaguuuguuccuauuaca

SEQ ID NO: 556398 - RNA, 19 nt, Homo sapiens
gugguuauuugaguuuguu

SEQ ID NO: 556399 - RNA, 19 nt, Homo sapiens
gauggagaguaacuaugag

SEQ ID NO: 556400 - RNA, 19 nt, Homo sapiens
aagaaagauuccagugaag

SEQ ID NO: 556401 - RNA, 19 nt, Homo sapiens
ccgaagcagaaaucucaua

SEQ ID NO: 556402 - RNA, 19 nt, Homo sapiens
cgacgcuccacaccuuuaa

SEQ ID NO: 556403 - RNA, 19 nt, Homo sapiens
aaugauggcgucuguuuca

SEQ ID NO: 556404 - RNA, 19 nt, Homo sapiens
caagugagcuacauucaug

SEQ ID NO: 556405 - RNA, 19 nt, Homo sapiens
caacuacucugguaccauu

SEQ ID NO: 556406 - RNA, 19 nt, Homo sapiens
gaacucugcuccuacauuc

SEQ ID NO: 556407 - RNA, 19 nt, Homo sapiens
caaaggaaauaucaaagug

SEQ ID NO: 556408 - RNA, 19 nt, Homo sapiens
ggaugguucuucuaaauga

SEQ ID NO: 556409 - RNA, 19 nt, Homo sapiens
uaagagagcugauacuuuu

SEQ ID NO: 556410 - RNA, 19 nt, Homo sapiens
ggccagauguggaaccaua

SEQ ID NO: 556411 - RNA, 19 nt, Homo sapiens
gauaaacuguuccugacuu

SEQ ID NO: 556412 - RNA, 19 nt, Homo sapiens
gaaaggcgauguuggaaaa

SEQ ID NO: 556413 - RNA, 19 nt, Homo sapiens
gcaagcuaaugaagaauau

SEQ ID NO: 556414 - RNA, 19 nt, Homo sapiens
ccacaggauugaaauaaau

SEQ ID NO: 556415 - RNA, 19 nt, Homo sapiens
caagugggauuugcauaaa

SEQ ID NO: 556416 - RNA, 19 nt, Homo sapiens
gugaucagcuagcuuauuc

SEQ ID NO: 556417 - RNA, 19 nt, Homo sapiens
ccucgaaacuauuccauga

SEQ ID NO: 556418 - RNA, 19 nt, Homo sapiens
cauaagaacccacacaaug

SEQ ID NO: 556419 - RNA, 19 nt, Homo sapiens
aacaagcucuucuucagua

SEQ ID NO: 556420 - RNA, 19 nt, Homo sapiens
guaacaagcucuucuucag

SEQ ID NO: 556421 - RNA, 19 nt, Homo sapiens
uagagcagcugauggaaug

SEQ ID NO: 556422 - RNA, 19 nt, Homo sapiens
auagugaucuggacuuuga

SEQ ID NO: 556423 - RNA, 19 nt, Homo sapiens
caggcaagcuaaugaagaa

SEQ ID NO: 556424 - RNA, 19 nt, Homo sapiens
ccgaaugaauggugauaaa

SEQ ID NO: 556425 - RNA, 19 nt, Homo sapiens
ucagcuagcuuauucuugu

SEQ ID NO: 556426 - RNA, 19 nt, Homo sapiens
uaccacggcuauccuuaua

SEQ ID NO: 556427 - RNA, 19 nt, Homo sapiens
gcuccuacauucaugcauu

SEQ ID NO: 556428 - RNA, 19 nt, Homo sapiens
gaaacuauuccaugauugu

SEQ ID NO: 556429 - RNA, 19 nt, Homo sapiens
guuccugacuuuauacuau

SEQ ID NO: 556430 - RNA, 19 nt, Homo sapiens
ccacccaacuacucuggua

SEQ ID NO: 556431 - RNA, 19 nt, Homo sapiens
ucaguaugguggacuauga

SEQ ID NO: 556432 - RNA, 19 nt, Homo sapiens
gccacaggauugaaauaaa

SEQ ID NO: 556433 - RNA, 19 nt, Homo sapiens
uuucaagccuguuauauuc

SEQ ID NO: 556434 - RNA, 19 nt, Homo sapiens
ccaagugggauuugcauaa

SEQ ID NO: 556435 - RNA, 19 nt, Homo sapiens
gaguucaucuauaacaaga

SEQ ID NO: 556436 - RNA, 19 nt, Homo sapiens
ucgaaacuauuccaugauu

SEQ ID NO: 556437 - RNA, 19 nt, Homo sapiens
ccaugaagauaaacuguuc

SEQ ID NO: 556438 - RNA, 19 nt, Homo sapiens
caauauuucguuccaagua

SEQ ID NO: 556439 - RNA, 19 nt, Homo sapiens
guggcagaaucacacauua

SEQ ID NO: 556440 - RNA, 19 nt, Homo sapiens
ggacaagugagcuacauuc

SEQ ID NO: 556441 - RNA, 19 nt, Homo sapiens
gagguuugcuuuauuugag

SEQ ID NO: 556442 - RNA, 19 nt, Homo sapiens
ggauuugcauaaagugaau

SEQ ID NO: 556443 - RNA, 19 nt, Homo sapiens
cauggugucucuguguaua

SEQ ID NO: 556444 - RNA, 19 nt, Homo sapiens
ggcagaaucacacauuauu

SEQ ID NO: 556445 - RNA, 19 nt, Homo sapiens
gguagcauuuaguaaucua

SEQ ID NO: 556446 - RNA, 19 nt, Homo sapiens
uaauuugccuagugggauu

SEQ ID NO: 556447 - RNA, 19 nt, Homo sapiens
acuuggaguucaucuauaa

SEQ ID NO: 556448 - RNA, 19 nt, Homo sapiens
ggcaagcuaaugaagaaua

SEQ ID NO: 556449 - RNA, 19 nt, Homo sapiens
cgaaacuauuccaugauug

SEQ ID NO: 556450 - RNA, 19 nt, Homo sapiens
ggagguuugcuuuauuuga

SEQ ID NO: 556451 - RNA, 19 nt, Homo sapiens
guuggagguuugcuuuauu

SEQ ID NO: 556452 - RNA, 19 nt, Homo sapiens
cuaagagagcugauacuuu

SEQ ID NO: 556453 - RNA, 19 nt, Homo sapiens
gcaggcaagcuaaugaaga

SEQ ID NO: 556454 - RNA, 19 nt, Homo sapiens
ggugauaaauuccgaaaau

SEQ ID NO: 556455 - RNA, 19 nt, Homo sapiens
ugagugagaagaugugauu

SEQ ID NO: 556456 - RNA, 19 nt, Homo sapiens
gccauggugucucugugua

SEQ ID NO: 556457 - RNA, 19 nt, Homo sapiens
ggcaccaccucgaaacuau

SEQ ID NO: 556458 - RNA, 19 nt, Homo sapiens
ccuguuauauucagugugu

SEQ ID NO: 556459 - RNA, 19 nt, Homo sapiens
gcgaacuccuggcgcuauu

SEQ ID NO: 556460 - RNA, 19 nt, Homo sapiens
aaacuguuccugacuuuau

SEQ ID NO: 556461 - RNA, 19 nt, Homo sapiens
aagugaauguuuaccauga

SEQ ID NO: 556462 - RNA, 19 nt, Homo sapiens
gcaacuagcaaaguggauu

SEQ ID NO: 556463 - RNA, 19 nt, Homo sapiens
caugaacucugcuccuaca

SEQ ID NO: 556464 - RNA, 19 nt, Homo sapiens
gcuagcuuauucuugugua

SEQ ID NO: 556465 - RNA, 19 nt, Homo sapiens
gaugguucuucuaaaugaa

SEQ ID NO: 556466 - RNA, 19 nt, Homo sapiens
gaucagcuagcuuauucuu

SEQ ID NO: 556467 - RNA, 19 nt, Homo sapiens
auaaacuguuccugacuuu

SEQ ID NO: 556468 - RNA, 19 nt, Homo sapiens
gugagaagaugugauuugg

SEQ ID NO: 556469 - RNA, 19 nt, Homo sapiens
ggacuuugagugagaagau

SEQ ID NO: 556470 - RNA, 19 nt, Homo sapiens
uaaaggcaccaccucgaaa

SEQ ID NO: 556471 - RNA, 19 nt, Homo sapiens
uuggagguuugcuuuauuu

SEQ ID NO: 556472 - RNA, 19 nt, Homo sapiens
cagcugagcaacuagcaaa

SEQ ID NO: 556473 - RNA, 19 nt, Homo sapiens
aaaguggauugcugacaga

SEQ ID NO: 556474 - RNA, 19 nt, Homo sapiens
cgaaaggcgauguuggaaa

SEQ ID NO: 556475 - RNA, 19 nt, Homo sapiens
uaagaacccacacaaugga

SEQ ID NO: 556476 - RNA, 19 nt, Homo sapiens
aacaugaacucugcuccua

SEQ ID NO: 556477 - RNA, 19 nt, Homo sapiens
gaacuccuggcgcuauuca

SEQ ID NO: 556478 - RNA, 19 nt, Homo sapiens
cagcggcaguguucugugu

SEQ ID NO: 556479 - RNA, 19 nt, Homo sapiens
guaccacggcuauccuuau

SEQ ID NO: 556480 - RNA, 19 nt, Homo sapiens
ccacacaauggacaaguga

SEQ ID NO: 556481 - RNA, 19 nt, Homo sapiens
caacuagcaaaguggauug

SEQ ID NO: 556482 - RNA, 19 nt, Homo sapiens
cgcucaaucuuccgaauga

SEQ ID NO: 556483 - RNA, 19 nt, Homo sapiens
gaauguuuaccaugaagau

SEQ ID NO: 556484 - RNA, 19 nt, Homo sapiens
ugaaccggaugcucuguca

SEQ ID NO: 556485 - RNA, 19 nt, Homo sapiens
gauugggccugguggucuu

SEQ ID NO: 556486 - RNA, 19 nt, Homo sapiens
gggaugguucuucuaaaug

SEQ ID NO: 556487 - RNA, 19 nt, Homo sapiens
gaacccacacaauggacaa

SEQ ID NO: 556488 - RNA, 19 nt, Homo sapiens
gggauuugcauaaagugaa

SEQ ID NO: 556489 - RNA, 19 nt, Homo sapiens
uuauagugaucuggacuuu

SEQ ID NO: 556490 - RNA, 19 nt, Homo sapiens
ccaaaaggcagaccuaaga

SEQ ID NO: 556491 - RNA, 19 nt, Homo sapiens
uaacaagcucuucuucagu

SEQ ID NO: 556492 - RNA, 19 nt, Homo sapiens
gagaaucuuuuagcugaaa

SEQ ID NO: 556493 - RNA, 19 nt, Homo sapiens
gcaccaccucgaaacuauu

SEQ ID NO: 556494 - RNA, 19 nt, Homo sapiens
ggaguucaucuauaacaag

SEQ ID NO: 556495 - RNA, 19 nt, Homo sapiens
guagagcagcugauggaau

SEQ ID NO: 556496 - RNA, 19 nt, Homo sapiens
gcuuauucuuguguacuuu

SEQ ID NO: 556497 - RNA, 19 nt, Homo sapiens
gacaagugagcuacauuca

SEQ ID NO: 556498 - RNA, 19 nt, Homo sapiens
guucaucuauaacaagacu

SEQ ID NO: 556499 - RNA, 19 nt, Homo sapiens
gcucaaucuuccgaaugaa

SEQ ID NO: 556500 - RNA, 19 nt, Homo sapiens
aacuguuccugacuuuaua

SEQ ID NO: 556501 - RNA, 19 nt, Homo sapiens
acggauaauuugccuagug

SEQ ID NO: 556502 - RNA, 19 nt, Homo sapiens
gauguucauauucggguuu

SEQ ID NO: 556503 - RNA, 19 nt, Homo sapiens
ugaacucugcuccuacauu

SEQ ID NO: 556504 - RNA, 19 nt, Homo sapiens
gcaguaaacuuugaacauu

SEQ ID NO: 556505 - RNA, 19 nt, Homo sapiens
agaaugagguugaaaugua

SEQ ID NO: 556506 - RNA, 19 nt, Homo sapiens
gcucacaggucuuauuuga

SEQ ID NO: 556507 - RNA, 19 nt, Homo sapiens
ggugaagccuggaaauuaa

SEQ ID NO: 556508 - RNA, 19 nt, Homo sapiens
uaacugauguuugcgauuu

SEQ ID NO: 556509 - RNA, 19 nt, Homo sapiens
ccucauggcuuaacucauu

SEQ ID NO: 556510 - RNA, 19 nt, Homo sapiens
gaaugagguugaaauguau

SEQ ID NO: 556511 - RNA, 19 nt, Homo sapiens
ucaaacagcagaagaagua

SEQ ID NO: 556512 - RNA, 19 nt, Homo sapiens
gugacuaccucauggcuua

SEQ ID NO: 556513 - RNA, 19 nt, Homo sapiens
guacaagucagacaucuuu

SEQ ID NO: 556514 - RNA, 19 nt, Homo sapiens
aaacaaacccuuagaacuu

SEQ ID NO: 556515 - RNA, 19 nt, Homo sapiens
gcucauggcaguaaacuuu

SEQ ID NO: 556516 - RNA, 19 nt, Homo sapiens
gaauaacuguggacacugu

SEQ ID NO: 556517 - RNA, 19 nt, Homo sapiens
gaagucaguuaugcuauga

SEQ ID NO: 556518 - RNA, 19 nt, Homo sapiens
guuacaaaguuccaaauga

SEQ ID NO: 556519 - RNA, 19 nt, Homo sapiens
caaaugagaaugagguuga

SEQ ID NO: 556520 - RNA, 19 nt, Homo sapiens
gggugaagccuggaaauua

SEQ ID NO: 556521 - RNA, 19 nt, Homo sapiens
gaggagcgcuuuuaucaaa

SEQ ID NO: 556522 - RNA, 19 nt, Homo sapiens
gagagaaggccagcagaua

SEQ ID NO: 556523 - RNA, 19 nt, Homo sapiens
gagaauuggguaccacaua

SEQ ID NO: 556524 - RNA, 19 nt, Homo sapiens
caugauuuccucaguguua

SEQ ID NO: 556525 - RNA, 19 nt, Homo sapiens
gggugugcauuacaguuua

SEQ ID NO: 556526 - RNA, 19 nt, Homo sapiens
agaaggagcagaccaacua

SEQ ID NO: 556527 - RNA, 19 nt, Homo sapiens
ucacaggucuuauuugacu

SEQ ID NO: 556528 - RNA, 19 nt, Homo sapiens
gugcauuacaguuuacuua

SEQ ID NO: 556529 - RNA, 19 nt, Homo sapiens
caucuuaccacacaauauu

SEQ ID NO: 556530 - RNA, 19 nt, Homo sapiens
ugaaauguaugcaguaagg

SEQ ID NO: 556531 - RNA, 19 nt, Homo sapiens
caguaaacuuugaacauug

SEQ ID NO: 556532 - RNA, 19 nt, Homo sapiens
gagcagaccaacuaggaaa

SEQ ID NO: 556533 - RNA, 19 nt, Homo sapiens
gacaugauuuccucagugu

SEQ ID NO: 556534 - RNA, 19 nt, Homo sapiens
uuacuuaacugauguuugc

SEQ ID NO: 556535 - RNA, 19 nt, Homo sapiens
guugaaauguaugcaguaa

SEQ ID NO: 556536 - RNA, 19 nt, Homo sapiens
agaauuggguaccacauau

SEQ ID NO: 556537 - RNA, 19 nt, Homo sapiens
aacaaacccuuagaacuuu

SEQ ID NO: 556538 - RNA, 19 nt, Homo sapiens
gguaccacauaucucuaua

SEQ ID NO: 556539 - RNA, 19 nt, Homo sapiens
gaaggccagcagauacaua

SEQ ID NO: 556540 - RNA, 19 nt, Homo sapiens
ugaagucaguuaugcuaug

SEQ ID NO: 556541 - RNA, 19 nt, Homo sapiens
ggagauuccugauuuaccu

SEQ ID NO: 556542 - RNA, 19 nt, Homo sapiens
uauacagccuuucuacuuc

SEQ ID NO: 556543 - RNA, 19 nt, Homo sapiens
cuacagcucacaggucuua

SEQ ID NO: 556544 - RNA, 19 nt, Homo sapiens
aaguuuaucugaaggaaga

SEQ ID NO: 556545 - RNA, 19 nt, Homo sapiens
auaauaaucuguggacugu

SEQ ID NO: 556546 - RNA, 19 nt, Homo sapiens
cagcaaagagccagaacuu

SEQ ID NO: 556547 - RNA, 19 nt, Homo sapiens
gcauuacaguuuacuuaac

SEQ ID NO: 556548 - RNA, 19 nt, Homo sapiens
aaacagagaagcagcaaag

SEQ ID NO: 556549 - RNA, 19 nt, Homo sapiens
gccagcagauacauagaga

SEQ ID NO: 556550 - RNA, 19 nt, Homo sapiens
cuuggaggcuuuaaaguuc

SEQ ID NO: 556551 - RNA, 19 nt, Homo sapiens
caauccaucuuaccacaca

SEQ ID NO: 556552 - RNA, 19 nt, Homo sapiens
gcuggaggacauaggaaua

SEQ ID NO: 556553 - RNA, 19 nt, Homo sapiens
cuauacagccuuucuacuu

SEQ ID NO: 556554 - RNA, 19 nt, Homo sapiens
cagcucacaggucuuauuu

SEQ ID NO: 556555 - RNA, 19 nt, Homo sapiens
ugaaacaucaaacagagaa

SEQ ID NO: 556556 - RNA, 19 nt, Homo sapiens
aagcaguggucacaaacuu

SEQ ID NO: 556557 - RNA, 19 nt, Homo sapiens
gagaaggccagcagauaca

SEQ ID NO: 556558 - RNA, 19 nt, Homo sapiens
caaaguuccaaaugaauca

SEQ ID NO: 556559 - RNA, 19 nt, Homo sapiens
uuucccagcugacaugauu

SEQ ID NO: 556560 - RNA, 19 nt, Homo sapiens
caugaagucaguuaugcua

SEQ ID NO: 556561 - RNA, 19 nt, Homo sapiens
gaagguacaagucagacau

SEQ ID NO: 556562 - RNA, 19 nt, Homo sapiens
cuuauacgcaggaauguuu

SEQ ID NO: 556563 - RNA, 19 nt, Homo sapiens
ggauauaggaaucaaggau

SEQ ID NO: 556564 - RNA, 19 nt, Homo sapiens
ggagagaaggccagcagau

SEQ ID NO: 556565 - RNA, 19 nt, Homo sapiens
gagaaugagguugaaaugu

SEQ ID NO: 556566 - RNA, 19 nt, Homo sapiens
uaccacauaucucuauaca

SEQ ID NO: 556567 - RNA, 19 nt, Homo sapiens
ucagacaucuuuugaaaca

SEQ ID NO: 556568 - RNA, 19 nt, Homo sapiens
gaugaagguacaagucaga

SEQ ID NO: 556569 - RNA, 19 nt, Homo sapiens
cagcagauacauagagaau

SEQ ID NO: 556570 - RNA, 19 nt, Homo sapiens
ggaagaagaagaaaagaau

SEQ ID NO: 556571 - RNA, 19 nt, Homo sapiens
ccaaguuuaucugaaggaa

SEQ ID NO: 556572 - RNA, 19 nt, Homo sapiens
cuacugcuugcucuucuua

SEQ ID NO: 556573 - RNA, 19 nt, Homo sapiens
gcagaccaacuaggaaaga

SEQ ID NO: 556574 - RNA, 19 nt, Homo sapiens
cagccuuucuacuuccuuu

SEQ ID NO: 556575 - RNA, 19 nt, Homo sapiens
agaacuugccuaaaccuuu

SEQ ID NO: 556576 - RNA, 19 nt, Homo sapiens
auuaagcaguggucacaaa

SEQ ID NO: 556577 - RNA, 19 nt, Homo sapiens
aaauguaugcaguaaggua

SEQ ID NO: 556578 - RNA, 19 nt, Homo sapiens
ucauggcaguaaacuuuga

SEQ ID NO: 556579 - RNA, 19 nt, Homo sapiens
gaaggaagaagaagaaaag

SEQ ID NO: 556580 - RNA, 19 nt, Homo sapiens
ucuguggacugugccauuu

SEQ ID NO: 556581 - RNA, 19 nt, Homo sapiens
ugcuugcucuucuuacuuu

SEQ ID NO: 556582 - RNA, 19 nt, Homo sapiens
gaccuucuggcacaauaaa

SEQ ID NO: 556583 - RNA, 19 nt, Homo sapiens
cagaccaacuaggaaagaa

SEQ ID NO: 556584 - RNA, 19 nt, Homo sapiens
ggagcagaccaacuaggaa

SEQ ID NO: 556585 - RNA, 19 nt, Homo sapiens
agccagaacuugccuaaac

SEQ ID NO: 556586 - RNA, 19 nt, Homo sapiens
ggaauaggauuagaaaagg

SEQ ID NO: 556587 - RNA, 19 nt, Homo sapiens
ugauuuaccugaagaaccu

SEQ ID NO: 556588 - RNA, 19 nt, Homo sapiens
gcucuuggaggcuuuaaag

SEQ ID NO: 556589 - RNA, 19 nt, Homo sapiens
ugagaaugagguugaaaug

SEQ ID NO: 556590 - RNA, 19 nt, Homo sapiens
guuaugcuaugaccuucug

SEQ ID NO: 556591 - RNA, 19 nt, Homo sapiens
ucaguuaugcuaugaccuu

SEQ ID NO: 556592 - RNA, 19 nt, Homo sapiens
gaauaggauuagaaaagga

SEQ ID NO: 556593 - RNA, 19 nt, Homo sapiens
gaggacauaggaauaacug

SEQ ID NO: 556594 - RNA, 19 nt, Homo sapiens
ggcaguaaacuuugaacau

SEQ ID NO: 556595 - RNA, 19 nt, Homo sapiens
agucagacaucuuuugaaa

SEQ ID NO: 556596 - RNA, 19 nt, Homo sapiens
caccaggaaaugaaauuga

SEQ ID NO: 556597 - RNA, 19 nt, Homo sapiens
aaaugagaaugagguugaa

SEQ ID NO: 556598 - RNA, 19 nt, Homo sapiens
acaacaagaagcacaagga

SEQ ID NO: 556599 - RNA, 19 nt, Homo sapiens
gaaggagcagaccaacuag

SEQ ID NO: 556600 - RNA, 19 nt, Homo sapiens
gaauuggguaccacauauc

SEQ ID NO: 556601 - RNA, 19 nt, Homo sapiens
gacuggaugacgagaauug

SEQ ID NO: 556602 - RNA, 19 nt, Homo sapiens
caggaaaugaaauugagaa

SEQ ID NO: 556603 - RNA, 19 nt, Homo sapiens
gaaaacaaacccuuagaac

SEQ ID NO: 556604 - RNA, 19 nt, Homo sapiens
gaauagagauggucaauua

SEQ ID NO: 556605 - RNA, 19 nt, Homo sapiens
gaagaagacucccacacua

SEQ ID NO: 556606 - RNA, 19 nt, Homo sapiens
ccaaugagauuuacagaaa

SEQ ID NO: 556607 - RNA, 19 nt, Homo sapiens
gaaagucugugucucauga

SEQ ID NO: 556608 - RNA, 19 nt, Homo sapiens
ccucuuagguucuuucuua

SEQ ID NO: 556609 - RNA, 19 nt, Homo sapiens
gauaacgacucuauggaua

SEQ ID NO: 556610 - RNA, 19 nt, Homo sapiens
caacggaccuuacaugaga

SEQ ID NO: 556611 - RNA, 19 nt, Homo sapiens
gaacagcuaucgaaugaca

SEQ ID NO: 556612 - RNA, 19 nt, Homo sapiens
ggaacaauauggagaaugu

SEQ ID NO: 556613 - RNA, 19 nt, Homo sapiens
ggacuacucugagcaauau

SEQ ID NO: 556614 - RNA, 19 nt, Homo sapiens
gaacagcaguuaccauagu

SEQ ID NO: 556615 - RNA, 19 nt, Homo sapiens
gaacaacccaagcuccuua

SEQ ID NO: 556616 - RNA, 19 nt, Homo sapiens
gauaaaggauaaagaggaa

SEQ ID NO: 556617 - RNA, 19 nt, Homo sapiens
gcagguuucucaucgauuu

SEQ ID NO: 556618 - RNA, 19 nt, Homo sapiens
caauuggaguugaguguua

SEQ ID NO: 556619 - RNA, 19 nt, Homo sapiens
gaagaaaggauaugcaaug

SEQ ID NO: 556620 - RNA, 19 nt, Homo sapiens
caaacccgcuuuauacuga

SEQ ID NO: 556621 - RNA, 19 nt, Homo sapiens
gaaagagaauuagagauca

SEQ ID NO: 556622 - RNA, 19 nt, Homo sapiens
ggaauuauuucgugauauc

SEQ ID NO: 556623 - RNA, 19 nt, Homo sapiens
ggaugugucugcauuauuc

SEQ ID NO: 556624 - RNA, 19 nt, Homo sapiens
ggacagaauuuguguaaaa

SEQ ID NO: 556625 - RNA, 19 nt, Homo sapiens
ugaugacacuccuaucuua

SEQ ID NO: 556626 - RNA, 19 nt, Homo sapiens
gaagacauuucaaacaaca

SEQ ID NO: 556627 - RNA, 19 nt, Homo sapiens
gaaagagaguugugagucu

SEQ ID NO: 556628 - RNA, 19 nt, Homo sapiens
gaaacagcguccuucagaa

SEQ ID NO: 556629 - RNA, 19 nt, Homo sapiens
ggaaagagaauuagagauc

SEQ ID NO: 556630 - RNA, 19 nt, Homo sapiens
gaucagcauuaagaaguua

SEQ ID NO: 556631 - RNA, 19 nt, Homo sapiens
gaaaagcacugccaacaga

SEQ ID NO: 556632 - RNA, 19 nt, Homo sapiens
gugagucucuuuccuguuu

SEQ ID NO: 556633 - RNA, 19 nt, Homo sapiens
ggauuggaauaaacugaua

SEQ ID NO: 556634 - RNA, 19 nt, Homo sapiens
uaacgacucuauggauaua

SEQ ID NO: 556635 - RNA, 19 nt, Homo sapiens
gaaauucauugggaaguug

SEQ ID NO: 556636 - RNA, 19 nt, Homo sapiens
gaggaagucuaaagaugaa

SEQ ID NO: 556637 - RNA, 19 nt, Homo sapiens
gauggucaauuaacaauca

SEQ ID NO: 556638 - RNA, 19 nt, Homo sapiens
agaagaagaugaagaguca

SEQ ID NO: 556639 - RNA, 19 nt, Homo sapiens
gaaaagaaaccagaaguua

SEQ ID NO: 556640 - RNA, 19 nt, Homo sapiens
ggaugugccuuccguauca

SEQ ID NO: 556641 - RNA, 19 nt, Homo sapiens
gagaauacuuccgucguuu

SEQ ID NO: 556642 - RNA, 19 nt, Homo sapiens
gagaaaagcuguuugcaau

SEQ ID NO: 556643 - RNA, 19 nt, Homo sapiens
gagaaaccguuaucugauc

SEQ ID NO: 556644 - RNA, 19 nt, Homo sapiens
acucaaggcugcccaaauu

SEQ ID NO: 556645 - RNA, 19 nt, Homo sapiens
gcgcuauacuaauccaaua

SEQ ID NO: 556646 - RNA, 19 nt, Homo sapiens
ggaguugaguguuaaagau

SEQ ID NO: 556647 - RNA, 19 nt, Homo sapiens
gucagacccugcagaguua

SEQ ID NO: 556648 - RNA, 19 nt, Homo sapiens
gaagagauuccucauagug

SEQ ID NO: 556649 - RNA, 19 nt, Homo sapiens
ggccauccauccuguuuaa

SEQ ID NO: 556650 - RNA, 19 nt, Homo sapiens
ggacucaauuccuauaaag

SEQ ID NO: 556651 - RNA, 19 nt, Homo sapiens
gcaaugcugugucuucauc

SEQ ID NO: 556652 - RNA, 19 nt, Homo sapiens
gggaaaagauaaaggauaa

SEQ ID NO: 556653 - RNA, 19 nt, Homo sapiens
aaacggcgcuauacuaauc

SEQ ID NO: 556654 - RNA, 19 nt, Homo sapiens
aaagaaggcagcacagaua

SEQ ID NO: 556655 - RNA, 19 nt, Homo sapiens
gagaagaugagcaagauga

SEQ ID NO: 556656 - RNA, 19 nt, Homo sapiens
gcagaaaguuggagugacu

SEQ ID NO: 556657 - RNA, 19 nt, Homo sapiens
ggaggagccugguguucaa

SEQ ID NO: 556658 - RNA, 19 nt, Homo sapiens
gccaggaaaucaugacuga

SEQ ID NO: 556659 - RNA, 19 nt, Homo sapiens
auauacaucucaaggguua

SEQ ID NO: 556660 - RNA, 19 nt, Homo sapiens
aaaccaggauuuaaguuga

SEQ ID NO: 556661 - RNA, 19 nt, Homo sapiens
acaagcaccucuccuguga

SEQ ID NO: 556662 - RNA, 19 nt, Homo sapiens
ggagauuaaccucuuguuu

SEQ ID NO: 556663 - RNA, 19 nt, Homo sapiens
gcuaauaugcagaagagua

SEQ ID NO: 556664 - RNA, 19 nt, Homo sapiens
ccagauacauccacaccuu

SEQ ID NO: 556665 - RNA, 19 nt, Homo sapiens
ucacaaagcccacgcugaa

SEQ ID NO: 556666 - RNA, 19 nt, Homo sapiens
ugucaaauaugucgaccua

SEQ ID NO: 556667 - RNA, 19 nt, Homo sapiens
gaaggaugugucugcauua

SEQ ID NO: 556668 - RNA, 19 nt, Homo sapiens
gauaagggauaacgacucu

SEQ ID NO: 556669 - RNA, 19 nt, Homo sapiens
ugacacagcccaugaugaa

SEQ ID NO: 556670 - RNA, 19 nt, Homo sapiens
gcacugggaacauaaguau

SEQ ID NO: 556671 - RNA, 19 nt, Homo sapiens
gacaagcagaucagcauua

SEQ ID NO: 556672 - RNA, 19 nt, Homo sapiens
gaacaagcacugcagaaag

SEQ ID NO: 556673 - RNA, 19 nt, Homo sapiens
uggaagacauuucaaacaa

SEQ ID NO: 556674 - RNA, 19 nt, Homo sapiens
gacgaaaacuucuacaaaa

SEQ ID NO: 556675 - RNA, 19 nt, Homo sapiens
gaacaaaaccgagaaaaga

SEQ ID NO: 556676 - RNA, 19 nt, Homo sapiens
gucuaaagaugaagaagaa

SEQ ID NO: 556677 - RNA, 19 nt, Homo sapiens
acaagcagaucagcauuaa

SEQ ID NO: 556678 - RNA, 19 nt, Homo sapiens
ccagaaaacucauaugcua

SEQ ID NO: 556679 - RNA, 19 nt, Homo sapiens
uaacgcaaguucauguguu

SEQ ID NO: 556680 - RNA, 19 nt, Homo sapiens
gaagagauggcgcagaugu

SEQ ID NO: 556681 - RNA, 19 nt, Homo sapiens
aagaugaacuugcaaucaa

SEQ ID NO: 556682 - RNA, 19 nt, Homo sapiens
ugaaugccaugaacagcua

SEQ ID NO: 556683 - RNA, 19 nt, Homo sapiens
cagcuacucucaaccauca

SEQ ID NO: 556684 - RNA, 19 nt, Homo sapiens
ggaagaggaugaaaaugaa

SEQ ID NO: 556685 - RNA, 19 nt, Homo sapiens
gcaaauagccagccaucuc

SEQ ID NO: 556686 - RNA, 19 nt, Homo sapiens
uaagggcuauggcagguuu

SEQ ID NO: 556687 - RNA, 19 nt, Homo sapiens
uggcaaaguuguuucuuga

SEQ ID NO: 556688 - RNA, 19 nt, Homo sapiens
ggaaaucaagcacuucaga

SEQ ID NO: 556689 - RNA, 19 nt, Homo sapiens
gaaguuggaagacauuuca

SEQ ID NO: 556690 - RNA, 19 nt, Homo sapiens
agaaggaugugucugcauu

SEQ ID NO: 556691 - RNA, 19 nt, Homo sapiens
gcgcagaugugugucagaa

SEQ ID NO: 556692 - RNA, 19 nt, Homo sapiens
gacaaaccauugaaacagu

SEQ ID NO: 556693 - RNA, 19 nt, Homo sapiens
cccaagcuccuuaaacuua

SEQ ID NO: 556694 - RNA, 19 nt, Homo sapiens
gaaccagacagcacaguau

SEQ ID NO: 556695 - RNA, 19 nt, Homo sapiens
aaacaaguccuuccucaug

SEQ ID NO: 556696 - RNA, 19 nt, Homo sapiens
ggcagugcaucgaguguaa

SEQ ID NO: 556697 - RNA, 19 nt, Homo sapiens
ggacagcagaauguuauaa

SEQ ID NO: 556698 - RNA, 19 nt, Homo sapiens
cagcugaccaacaccauua

SEQ ID NO: 556699 - RNA, 19 nt, Homo sapiens
uggaagcacugggaacaua

SEQ ID NO: 556700 - RNA, 19 nt, Homo sapiens
ccacgacgcugaugaugag

SEQ ID NO: 556701 - RNA, 19 nt, Homo sapiens
gcagacagcagcaauaguc

SEQ ID NO: 556702 - RNA, 19 nt, Homo sapiens
gaagcgaaagaaaccauuu

SEQ ID NO: 556703 - RNA, 19 nt, Homo sapiens
gaaguuauggcuccaguca

SEQ ID NO: 556704 - RNA, 19 nt, Homo sapiens
gagaugaaguggacugagu

SEQ ID NO: 556705 - RNA, 19 nt, Homo sapiens
acgcaagucugaccaugua

SEQ ID NO: 556706 - RNA, 19 nt, Homo sapiens
ccagcauucuccacccuua

SEQ ID NO: 556707 - RNA, 19 nt, Homo sapiens
gaaguggacugaguagaac

SEQ ID NO: 556708 - RNA, 19 nt, Homo sapiens
gcaaagcccaggugagcaa

SEQ ID NO: 556709 - RNA, 19 nt, Homo sapiens
ugaaguggacugaguagaa

SEQ ID NO: 556710 - RNA, 19 nt, Homo sapiens
gaacugcguggaugacuca

SEQ ID NO: 556711 - RNA, 19 nt, Homo sapiens
caugaaggcugugcugcuu

SEQ ID NO: 556712 - RNA, 19 nt, Homo sapiens
agcaaaggcugcagcuuga

SEQ ID NO: 556713 - RNA, 19 nt, Homo sapiens
cauccuaacgcaagucuga

SEQ ID NO: 556714 - RNA, 19 nt, Homo sapiens
agucugaccauguauguuu

SEQ ID NO: 556715 - RNA, 19 nt, Homo sapiens
gcaagucugaccauguaug

SEQ ID NO: 556716 - RNA, 19 nt, Homo sapiens
gugggagccuguccugguu

SEQ ID NO: 556717 - RNA, 19 nt, Homo sapiens
gcccaccagugaccaugaa

SEQ ID NO: 556718 - RNA, 19 nt, Homo sapiens
uaaaggcugagaugaagug

SEQ ID NO: 556719 - RNA, 19 nt, Homo sapiens
caagucugaccauguaugu

SEQ ID NO: 556720 - RNA, 19 nt, Homo sapiens
gcaaaggcugcagcuugaa

SEQ ID NO: 556721 - RNA, 19 nt, Homo sapiens
gcugugcuacuccugcaaa

SEQ ID NO: 556722 - RNA, 19 nt, Homo sapiens
gcugugacaccgacuugug

SEQ ID NO: 556723 - RNA, 19 nt, Homo sapiens
agaugaaguggacugagua

SEQ ID NO: 556724 - RNA, 19 nt, Homo sapiens
gaugaaguggacugaguag

SEQ ID NO: 556725 - RNA, 19 nt, Homo sapiens
cagcauucuccacccuuaa

SEQ ID NO: 556726 - RNA, 19 nt, Homo sapiens
gaacgaacauucuuccuuu

SEQ ID NO: 556727 - RNA, 19 nt, Homo sapiens
caauggaucucaagaauuu

SEQ ID NO: 556728 - RNA, 19 nt, Homo sapiens
gacaacaaauugcuaagaa

SEQ ID NO: 556729 - RNA, 19 nt, Homo sapiens
gaaagugucucugccauag

SEQ ID NO: 556730 - RNA, 19 nt, Homo sapiens
gcaagaaucagacccaauu

SEQ ID NO: 556731 - RNA, 19 nt, Homo sapiens
gaacgaagguggaaauacg

SEQ ID NO: 556732 - RNA, 19 nt, Homo sapiens
gggaaauucacucauauua

SEQ ID NO: 556733 - RNA, 19 nt, Homo sapiens
ggacauuaguuucgggauu

SEQ ID NO: 556734 - RNA, 19 nt, Homo sapiens
gaaaugaggaaggucuuua

SEQ ID NO: 556735 - RNA, 19 nt, Homo sapiens
gcacuaaacauuacaauac

SEQ ID NO: 556736 - RNA, 19 nt, Homo sapiens
uaaaggcccuccaguuaau

SEQ ID NO: 556737 - RNA, 19 nt, Homo sapiens
gacauuaguuucgggauuu

SEQ ID NO: 556738 - RNA, 19 nt, Homo sapiens
caggaaaguuuacguguau

SEQ ID NO: 556739 - RNA, 19 nt, Homo sapiens
gauacugcacuaaacauua

SEQ ID NO: 556740 - RNA, 19 nt, Homo sapiens
ccaagaagauugauaccau

SEQ ID NO: 556741 - RNA, 19 nt, Homo sapiens
gaccaugucuacaagcaaa

SEQ ID NO: 556742 - RNA, 19 nt, Homo sapiens
gaaaccugauuuguucuuu

SEQ ID NO: 556743 - RNA, 19 nt, Homo sapiens
gcagcaagauuaagucucu

SEQ ID NO: 556744 - RNA, 19 nt, Homo sapiens
ucucagauauggaugauga

SEQ ID NO: 556745 - RNA, 19 nt, Homo sapiens
gacgaaagagaaagaauaa

SEQ ID NO: 556746 - RNA, 19 nt, Homo sapiens
cgaaagagaaagaauaaga

SEQ ID NO: 556747 - RNA, 19 nt, Homo sapiens
cgacgaaagagaaagaaua

SEQ ID NO: 556748 - RNA, 19 nt, Homo sapiens
cauuucaucucacucauuu

SEQ ID NO: 556749 - RNA, 19 nt, Homo sapiens
cagagacgaccauggauua

SEQ ID NO: 556750 - RNA, 19 nt, Homo sapiens
ggaaacagacagugcaaga

SEQ ID NO: 556751 - RNA, 19 nt, Homo sapiens
gugaauaucucuccguauc

SEQ ID NO: 556752 - RNA, 19 nt, Homo sapiens
gccaauguguuuauauguu

SEQ ID NO: 556753 - RNA, 19 nt, Homo sapiens
agauauggaugaugaggua

SEQ ID NO: 556754 - RNA, 19 nt, Homo sapiens
ccauguaaguggaagcuuu

SEQ ID NO: 556755 - RNA, 19 nt, Homo sapiens
gcaaauggucaauucagaa

SEQ ID NO: 556756 - RNA, 19 nt, Homo sapiens
caaugucaccuucugauuu

SEQ ID NO: 556757 - RNA, 19 nt, Homo sapiens
gaaauacgggaaacaacuu

SEQ ID NO: 556758 - RNA, 19 nt, Homo sapiens
ggaggauuguacauauaaa

SEQ ID NO: 556759 - RNA, 19 nt, Homo sapiens
uuuaaaggcccuccaguua

SEQ ID NO: 556760 - RNA, 19 nt, Homo sapiens
gcaaagucaugagaaagau

SEQ ID NO: 556761 - RNA, 19 nt, Homo sapiens
gagaaagaauaagacagaa

SEQ ID NO: 556762 - RNA, 19 nt, Homo sapiens
guuauucuauccuggguuu

SEQ ID NO: 556763 - RNA, 19 nt, Homo sapiens
acaggaaaguuuacgugua

SEQ ID NO: 556764 - RNA, 19 nt, Homo sapiens
gagacacuuucggacauua

SEQ ID NO: 556765 - RNA, 19 nt, Homo sapiens
gaauaucucuccguaucau

SEQ ID NO: 556766 - RNA, 19 nt, Homo sapiens
guaugcagcuguaaauuuu

SEQ ID NO: 556767 - RNA, 19 nt, Homo sapiens
uuucagcacuucuggagua

SEQ ID NO: 556768 - RNA, 19 nt, Homo sapiens
gggguuagauuguacauuu

SEQ ID NO: 556769 - RNA, 19 nt, Homo sapiens
gauuuacgauacugcacua

SEQ ID NO: 556770 - RNA, 19 nt, Homo sapiens
cgucagaaauggaaugauc

SEQ ID NO: 556771 - RNA, 19 nt, Homo sapiens
caagagaucguguuacagu

SEQ ID NO: 556772 - RNA, 19 nt, Homo sapiens
ugaggaaggucuuuaucga

SEQ ID NO: 556773 - RNA, 19 nt, Homo sapiens
gcagagacgaccauggauu

SEQ ID NO: 556774 - RNA, 19 nt, Homo sapiens
cuucagacauuucaucuca

SEQ ID NO: 556775 - RNA, 19 nt, Homo sapiens
agaauaagacagaagcuuu

SEQ ID NO: 556776 - RNA, 19 nt, Homo sapiens
uaaugcaacuggaaagcuu

SEQ ID NO: 556777 - RNA, 19 nt, Homo sapiens
aaaugcaaauggucaauuc

SEQ ID NO: 556778 - RNA, 19 nt, Homo sapiens
ggaguaugcagcuguaaau

SEQ ID NO: 556779 - RNA, 19 nt, Homo sapiens
ggaaagcuuuggguacaca

SEQ ID NO: 556780 - RNA, 19 nt, Homo sapiens
uaugcaaagucaugagaaa

SEQ ID NO: 556781 - RNA, 19 nt, Homo sapiens
uuggaaaccugauuuguuc

SEQ ID NO: 556782 - RNA, 19 nt, Homo sapiens
cuuaggcacuucagacauu

SEQ ID NO: 556783 - RNA, 19 nt, Homo sapiens
ggaaauacgggaaacaacu

SEQ ID NO: 556784 - RNA, 19 nt, Homo sapiens
aauggaggauuguacauau

SEQ ID NO: 556785 - RNA, 19 nt, Homo sapiens
ucgaagugcuccaauguca

SEQ ID NO: 556786 - RNA, 19 nt, Homo sapiens
uaucauggcccacgugaga

SEQ ID NO: 556787 - RNA, 19 nt, Homo sapiens
gguuagcuaugcaaaguca

SEQ ID NO: 556788 - RNA, 19 nt, Homo sapiens
gugggaaauucacucauau

SEQ ID NO: 556789 - RNA, 19 nt, Homo sapiens
cauguaaguggaagcuuua

SEQ ID NO: 556790 - RNA, 19 nt, Homo sapiens
agagaaagaauaagacaga

SEQ ID NO: 556791 - RNA, 19 nt, Homo sapiens
cccagucuccugauuguua

SEQ ID NO: 556792 - RNA, 19 nt, Homo sapiens
gggcaggacaucaggauau

SEQ ID NO: 556793 - RNA, 19 nt, Homo sapiens
ucauauuaauggaggauug

SEQ ID NO: 556794 - RNA, 19 nt, Homo sapiens
gaaagagaaagaauaagac

SEQ ID NO: 556795 - RNA, 19 nt, Homo sapiens
gaaaguuuacguguauaga

SEQ ID NO: 556796 - RNA, 19 nt, Homo sapiens
caacauauucaucaacagu

SEQ ID NO: 556797 - RNA, 19 nt, Homo sapiens
uuuccucugugcaaauuua

SEQ ID NO: 556798 - RNA, 19 nt, Homo sapiens
uaauggaggauuguacaua

SEQ ID NO: 556799 - RNA, 19 nt, Homo sapiens
guauacaaaugaugaccau

SEQ ID NO: 556800 - RNA, 19 nt, Homo sapiens
ucacuacagacaacaaauu

SEQ ID NO: 556801 - RNA, 19 nt, Homo sapiens
cugggaagcagcacuguua

SEQ ID NO: 556802 - RNA, 19 nt, Homo sapiens
aauggucaauucagaagaa

SEQ ID NO: 556803 - RNA, 19 nt, Homo sapiens
gcagaaggacucacuuugc

SEQ ID NO: 556804 - RNA, 19 nt, Homo sapiens
aaaccugauuuguucuuug

SEQ ID NO: 556805 - RNA, 19 nt, Homo sapiens
gaagcagcacuguuacuca

SEQ ID NO: 556806 - RNA, 19 nt, Homo sapiens
ccaauggaucucaagaauu

SEQ ID NO: 556807 - RNA, 19 nt, Homo sapiens
caagaaucagacccaauuu

SEQ ID NO: 556808 - RNA, 19 nt, Homo sapiens
cauauuaauuccaggugau

SEQ ID NO: 556809 - RNA, 19 nt, Homo sapiens
gcacuucagacauuucauc

SEQ ID NO: 556810 - RNA, 19 nt, Homo sapiens
ggaaaguuuacguguauag

SEQ ID NO: 556811 - RNA, 19 nt, Homo sapiens
ucccauggauguacaaaca

SEQ ID NO: 556812 - RNA, 19 nt, Homo sapiens
acacuuuccuguccaaugg

SEQ ID NO: 556813 - RNA, 19 nt, Homo sapiens
ggaaaccugauuuguucuu

SEQ ID NO: 556814 - RNA, 19 nt, Homo sapiens
ugaauauccugacgacucu

SEQ ID NO: 556815 - RNA, 19 nt, Homo sapiens
gaugaugagguaagggaaa

SEQ ID NO: 556816 - RNA, 19 nt, Homo sapiens
aaacagacagugcaagauc

SEQ ID NO: 556817 - RNA, 19 nt, Homo sapiens
aagcaucagucuacaccaa

SEQ ID NO: 556818 - RNA, 19 nt, Homo sapiens
caaaugcaaauggucaauu

SEQ ID NO: 556819 - RNA, 19 nt, Homo sapiens
gaauaagacagaagcuuuu

SEQ ID NO: 556820 - RNA, 19 nt, Homo sapiens
uaaccaccgugcuaacgau

SEQ ID NO: 556821 - RNA, 19 nt, Homo sapiens
gggauaaccaccgugcuaa

SEQ ID NO: 556822 - RNA, 19 nt, Homo sapiens
gguacacaaugaaugaucu

SEQ ID NO: 556823 - RNA, 19 nt, Homo sapiens
cagagugaauaucuuucuu

SEQ ID NO: 556824 - RNA, 19 nt, Homo sapiens
gaaacagacagugcaagau

SEQ ID NO: 556825 - RNA, 19 nt, Homo sapiens
gaagcuuuacugccaaugu

SEQ ID NO: 556826 - RNA, 19 nt, Homo sapiens
gauagaaccuggaauguua

SEQ ID NO: 556827 - RNA, 19 nt, Homo sapiens
gaaauacugugcauacaua

SEQ ID NO: 556828 - RNA, 19 nt, Homo sapiens
caaagaagaucagacauua

SEQ ID NO: 556829 - RNA, 19 nt, Homo sapiens
gaucagacauuacuuauug

SEQ ID NO: 556830 - RNA, 19 nt, Homo sapiens
gaaaguggaucagauuaua

SEQ ID NO: 556831 - RNA, 19 nt, Homo sapiens
ggugaaagauggaggauua

SEQ ID NO: 556832 - RNA, 19 nt, Homo sapiens
caagauagcuucagaccaa

SEQ ID NO: 556833 - RNA, 19 nt, Homo sapiens
ccagagaucuugauuauuc

SEQ ID NO: 556834 - RNA, 19 nt, Homo sapiens
gaagaucagacauuacuua

SEQ ID NO: 556835 - RNA, 19 nt, Homo sapiens
gaagagcuaugcaacaaga

SEQ ID NO: 556836 - RNA, 19 nt, Homo sapiens
gaaguuguccguacagaua

SEQ ID NO: 556837 - RNA, 19 nt, Homo sapiens
ucaaacagcugguaacaga

SEQ ID NO: 556838 - RNA, 19 nt, Homo sapiens
aaacagagcccuagagaaa

SEQ ID NO: 556839 - RNA, 19 nt, Homo sapiens
ucaaacaaaugccaaauga

SEQ ID NO: 556840 - RNA, 19 nt, Homo sapiens
gcaaaugacacguuaauau

SEQ ID NO: 556841 - RNA, 19 nt, Homo sapiens
ggacagcucucuagaaacu

SEQ ID NO: 556842 - RNA, 19 nt, Homo sapiens
gauaagaacaugcaaauca

SEQ ID NO: 556843 - RNA, 19 nt, Homo sapiens
gaagcugaguuacagagua

SEQ ID NO: 556844 - RNA, 19 nt, Homo sapiens
guaacagaaucaagacuaa

SEQ ID NO: 556845 - RNA, 19 nt, Homo sapiens
guaacugacugguauauuc

SEQ ID NO: 556846 - RNA, 19 nt, Homo sapiens
uuaaagugcugucuuacua

SEQ ID NO: 556847 - RNA, 19 nt, Homo sapiens
caagauacccugcagauau

SEQ ID NO: 556848 - RNA, 19 nt, Homo sapiens
ccacuaauauuuaccugaa

SEQ ID NO: 556849 - RNA, 19 nt, Homo sapiens
gagauaauuuguugcauag

SEQ ID NO: 556850 - RNA, 19 nt, Homo sapiens
gaagauaaccaugaguaaa

SEQ ID NO: 556851 - RNA, 19 nt, Homo sapiens
gauaauuuguugcauagug

SEQ ID NO: 556852 - RNA, 19 nt, Homo sapiens
uauaguaacugacugguau

SEQ ID NO: 556853 - RNA, 19 nt, Homo sapiens
guuagcaaaugacacguua

SEQ ID NO: 556854 - RNA, 19 nt, Homo sapiens
uguaauagcuuugccugua

SEQ ID NO: 556855 - RNA, 19 nt, Homo sapiens
gauggaggauuaccuacaa

SEQ ID NO: 556856 - RNA, 19 nt, Homo sapiens
gaagauaaguuuguguucu

SEQ ID NO: 556857 - RNA, 19 nt, Homo sapiens
gcauugcucuuuagugugu

SEQ ID NO: 556858 - RNA, 19 nt, Homo sapiens
gagaaaugcuguuacuuuu

SEQ ID NO: 556859 - RNA, 19 nt, Homo sapiens
gcuaacauuucauacaaga

SEQ ID NO: 556860 - RNA, 19 nt, Homo sapiens
aaaggaggcagucauguua

SEQ ID NO: 556861 - RNA, 19 nt, Homo sapiens
cgggacagcucucuagaaa

SEQ ID NO: 556862 - RNA, 19 nt, Homo sapiens
gguaggaugugucuuaaag

SEQ ID NO: 556863 - RNA, 19 nt, Homo sapiens
ggaaaguuaauccuuguuu

SEQ ID NO: 556864 - RNA, 19 nt, Homo sapiens
gaaucaagacuaagaccua

SEQ ID NO: 556865 - RNA, 19 nt, Homo sapiens
guaugcacguuauauugua

SEQ ID NO: 556866 - RNA, 19 nt, Homo sapiens
aaagauuggucccuugaaa

SEQ ID NO: 556867 - RNA, 19 nt, Homo sapiens
ccagaaaacuugcagagua

SEQ ID NO: 556868 - RNA, 19 nt, Homo sapiens
guaauagcuuugccuguau

SEQ ID NO: 556869 - RNA, 19 nt, Homo sapiens
gaaaauaugcuuccuguau

SEQ ID NO: 556870 - RNA, 19 nt, Homo sapiens
caagaucacaagcaguuua

SEQ ID NO: 556871 - RNA, 19 nt, Homo sapiens
caagucaucuuaucaacuc

SEQ ID NO: 556872 - RNA, 19 nt, Homo sapiens
gcaguacuguuuagcacuu

SEQ ID NO: 556873 - RNA, 19 nt, Homo sapiens
gcagucauguuagcaaaug

SEQ ID NO: 556874 - RNA, 19 nt, Homo sapiens
ccaaagaagaucagacauu

SEQ ID NO: 556875 - RNA, 19 nt, Homo sapiens
ccaaagagcccauuacaac

SEQ ID NO: 556876 - RNA, 19 nt, Homo sapiens
aguaauagguccagauaug

SEQ ID NO: 556877 - RNA, 19 nt, Homo sapiens
ccaagagucauucuaauau

SEQ ID NO: 556878 - RNA, 19 nt, Homo sapiens
cauaguguccuuauuugua

SEQ ID NO: 556879 - RNA, 19 nt, Homo sapiens
uaacaaauggugaaagaug

SEQ ID NO: 556880 - RNA, 19 nt, Homo sapiens
ccuccaaucugcaugauga

SEQ ID NO: 556881 - RNA, 19 nt, Homo sapiens
gaaggaaugaagaagcuuu

SEQ ID NO: 556882 - RNA, 19 nt, Homo sapiens
agagaaaugcuguuacuuu

SEQ ID NO: 556883 - RNA, 19 nt, Homo sapiens
caaaugacacguuaauauc

SEQ ID NO: 556884 - RNA, 19 nt, Homo sapiens
gaugauagaaccuggaaug

SEQ ID NO: 556885 - RNA, 19 nt, Homo sapiens
cacccuaccuuucuaauca

SEQ ID NO: 556886 - RNA, 19 nt, Homo sapiens
caaacacugcugaagauaa

SEQ ID NO: 556887 - RNA, 19 nt, Homo sapiens
gcaagauacccugcagaua

SEQ ID NO: 556888 - RNA, 19 nt, Homo sapiens
gaaaagauuccgggauuua

SEQ ID NO: 556889 - RNA, 19 nt, Homo sapiens
gcaccuccauguacuucaa

SEQ ID NO: 556890 - RNA, 19 nt, Homo sapiens
acaccaagcugaccaugga

SEQ ID NO: 556891 - RNA, 19 nt, Homo sapiens
agacauacagcucggaaua

SEQ ID NO: 556892 - RNA, 19 nt, Homo sapiens
uaaagaugauagcauguuc

SEQ ID NO: 556893 - RNA, 19 nt, Homo sapiens
auugaagggugaagaguua

SEQ ID NO: 556894 - RNA, 19 nt, Homo sapiens
ggcagaaacuuccuuuuaa

SEQ ID NO: 556895 - RNA, 19 nt, Homo sapiens
guacguauguggugcaaac

SEQ ID NO: 556896 - RNA, 19 nt, Homo sapiens
caggguaggaugugucuua

SEQ ID NO: 556897 - RNA, 19 nt, Homo sapiens
ggucaaacacugcugaaga

SEQ ID NO: 556898 - RNA, 19 nt, Homo sapiens
caagagaacagugcagaaa

SEQ ID NO: 556899 - RNA, 19 nt, Homo sapiens
cauacaagauagcuucaga

SEQ ID NO: 556900 - RNA, 19 nt, Homo sapiens
gguaacagaaucaagacua

SEQ ID NO: 556901 - RNA, 19 nt, Homo sapiens
aaacacugcugaagauaag

SEQ ID NO: 556902 - RNA, 19 nt, Homo sapiens
gucgaucccuucugaggua

SEQ ID NO: 556903 - RNA, 19 nt, Homo sapiens
aaaagcagcuccuguagaa

SEQ ID NO: 556904 - RNA, 19 nt, Homo sapiens
gaugauagcauguucuucu

SEQ ID NO: 556905 - RNA, 19 nt, Homo sapiens
acagagcccuagagaaaug

SEQ ID NO: 556906 - RNA, 19 nt, Homo sapiens
gggcugcguuucaacauuc

SEQ ID NO: 556907 - RNA, 19 nt, Homo sapiens
uaagucaguugaguauuug

SEQ ID NO: 556908 - RNA, 19 nt, Homo sapiens
gucaaacacugcugaagau

SEQ ID NO: 556909 - RNA, 19 nt, Homo sapiens
acccagagaucuugauuau

SEQ ID NO: 556910 - RNA, 19 nt, Homo sapiens
caaaguauaacccagauag

SEQ ID NO: 556911 - RNA, 19 nt, Homo sapiens
aaagagagucgaagagcua

SEQ ID NO: 556912 - RNA, 19 nt, Homo sapiens
gugcauacauaaccuucuu

SEQ ID NO: 556913 - RNA, 19 nt, Homo sapiens
aguauuugaucccuagaua

SEQ ID NO: 556914 - RNA, 19 nt, Homo sapiens
uaaaagaccaccagaguaa

SEQ ID NO: 556915 - RNA, 19 nt, Homo sapiens
ucgaagagcuaugcaacaa

SEQ ID NO: 556916 - RNA, 19 nt, Homo sapiens
gagagugccuugcuuuuau

SEQ ID NO: 556917 - RNA, 19 nt, Homo sapiens
ggaagccaccagcuguuaa

SEQ ID NO: 556918 - RNA, 19 nt, Homo sapiens
guccagauaugagugcuaa

SEQ ID NO: 556919 - RNA, 19 nt, Homo sapiens
guaauagguccagauauga

SEQ ID NO: 556920 - RNA, 19 nt, Homo sapiens
caaacaaggcagaaacuuc

SEQ ID NO: 556921 - RNA, 19 nt, Homo sapiens
acaaaugccaaaugaauug

SEQ ID NO: 556922 - RNA, 19 nt, Homo sapiens
ccagggacaauaaggauuu

SEQ ID NO: 556923 - RNA, 19 nt, Homo sapiens
guaagcaccagggacaaua

SEQ ID NO: 556924 - RNA, 19 nt, Homo sapiens
ugacugguauauucauuca

SEQ ID NO: 556925 - RNA, 19 nt, Homo sapiens
aagauacccugcagauaug

SEQ ID NO: 556926 - RNA, 19 nt, Homo sapiens
gauagaaccuggaauguua

SEQ ID NO: 556927 - RNA, 19 nt, Homo sapiens
gaaauacugugcauacaua

SEQ ID NO: 556928 - RNA, 19 nt, Homo sapiens
caaagaagaucagacauua

SEQ ID NO: 556929 - RNA, 19 nt, Homo sapiens
gaucagacauuacuuauug

SEQ ID NO: 556930 - RNA, 19 nt, Homo sapiens
gaaaguggaucagauuaua

SEQ ID NO: 556931 - RNA, 19 nt, Homo sapiens
ggugaaagauggaggauua

SEQ ID NO: 556932 - RNA, 19 nt, Homo sapiens
gaauucagcuuccuuacua

SEQ ID NO: 556933 - RNA, 19 nt, Homo sapiens
caagauagcuucagaccaa

SEQ ID NO: 556934 - RNA, 19 nt, Homo sapiens
ccagagaucuugauuauuc

SEQ ID NO: 556935 - RNA, 19 nt, Homo sapiens
gaagaucagacauuacuua

SEQ ID NO: 556936 - RNA, 19 nt, Homo sapiens
gaagagcuaugcaacaaga

SEQ ID NO: 556937 - RNA, 19 nt, Homo sapiens
gaaguuguccguacagaua

SEQ ID NO: 556938 - RNA, 19 nt, Homo sapiens
ucaaacagcugguaacaga

SEQ ID NO: 556939 - RNA, 19 nt, Homo sapiens
aaacagagcccuagagaaa

SEQ ID NO: 556940 - RNA, 19 nt, Homo sapiens
ucaaacaaaugccaaauga

SEQ ID NO: 556941 - RNA, 19 nt, Homo sapiens
gcaaaugacacguuaauau

SEQ ID NO: 556942 - RNA, 19 nt, Homo sapiens
ggacagcucucuagaaacu

SEQ ID NO: 556943 - RNA, 19 nt, Homo sapiens
gauaagaacaugcaaauca

SEQ ID NO: 556944 - RNA, 19 nt, Homo sapiens
gaagcugaguuacagagua

SEQ ID NO: 556945 - RNA, 19 nt, Homo sapiens
uaacucagguuuacaaauc

SEQ ID NO: 556946 - RNA, 19 nt, Homo sapiens
guaacagaaucaagacuaa

SEQ ID NO: 556947 - RNA, 19 nt, Homo sapiens
guaacugacugguauauuc

SEQ ID NO: 556948 - RNA, 19 nt, Homo sapiens
uuaaagugcugucuuacua

SEQ ID NO: 556949 - RNA, 19 nt, Homo sapiens
gcaagauaguguguauaua

SEQ ID NO: 556950 - RNA, 19 nt, Homo sapiens
ccacuaauauuuaccugaa

SEQ ID NO: 556951 - RNA, 19 nt, Homo sapiens
caaauaaaccacuggcuuu

SEQ ID NO: 556952 - RNA, 19 nt, Homo sapiens
gagauaauuuguugcauag

SEQ ID NO: 556953 - RNA, 19 nt, Homo sapiens
gaagauaaccaugaguaaa

SEQ ID NO: 556954 - RNA, 19 nt, Homo sapiens
gauaauuuguugcauagug

SEQ ID NO: 556955 - RNA, 19 nt, Homo sapiens
uauaguaacugacugguau

SEQ ID NO: 556956 - RNA, 19 nt, Homo sapiens
guuagcaaaugacacguua

SEQ ID NO: 556957 - RNA, 19 nt, Homo sapiens
uguaauagcuuugccugua

SEQ ID NO: 556958 - RNA, 19 nt, Homo sapiens
gauggaggauuaccuacaa

SEQ ID NO: 556959 - RNA, 19 nt, Homo sapiens
gaagauaaguuuguguucu

SEQ ID NO: 556960 - RNA, 19 nt, Homo sapiens
ucucugagcuuaugaggaa

SEQ ID NO: 556961 - RNA, 19 nt, Homo sapiens
gcauugcucuuuagugugu

SEQ ID NO: 556962 - RNA, 19 nt, Homo sapiens
ccaccuagcugacugaagu

SEQ ID NO: 556963 - RNA, 19 nt, Homo sapiens
gagaaaugcuguuacuuuu

SEQ ID NO: 556964 - RNA, 19 nt, Homo sapiens
gcuaacauuucauacaaga

SEQ ID NO: 556965 - RNA, 19 nt, Homo sapiens
cgggacagcucucuagaaa

SEQ ID NO: 556966 - RNA, 19 nt, Homo sapiens
aaaggaggcagucauguua

SEQ ID NO: 556967 - RNA, 19 nt, Homo sapiens
gguaggaugugucuuaaag

SEQ ID NO: 556968 - RNA, 19 nt, Homo sapiens
ggaaaguuaauccuuguuu

SEQ ID NO: 556969 - RNA, 19 nt, Homo sapiens
gaaucaagacuaagaccua

SEQ ID NO: 556970 - RNA, 19 nt, Homo sapiens
guaugcacguuauauugua

SEQ ID NO: 556971 - RNA, 19 nt, Homo sapiens
aaagauuggucccuugaaa

SEQ ID NO: 556972 - RNA, 19 nt, Homo sapiens
ccagaaaacuugcagagua

SEQ ID NO: 556973 - RNA, 19 nt, Homo sapiens
aaacaucucugagcuuaug

SEQ ID NO: 556974 - RNA, 19 nt, Homo sapiens
guaauagcuuugccuguau

SEQ ID NO: 556975 - RNA, 19 nt, Homo sapiens
gaaaauaugcuuccuguau

SEQ ID NO: 556976 - RNA, 19 nt, Homo sapiens
caagaucacaagcaguuua

SEQ ID NO: 556977 - RNA, 19 nt, Homo sapiens
ccucuuuccucccaaauaa

SEQ ID NO: 556978 - RNA, 19 nt, Homo sapiens
caagucaucuuaucaacuc

SEQ ID NO: 556979 - RNA, 19 nt, Homo sapiens
gcaguacuguuuagcacuu

SEQ ID NO: 556980 - RNA, 19 nt, Homo sapiens
gcagucauguuagcaaaug

SEQ ID NO: 556981 - RNA, 19 nt, Homo sapiens
ccaaagaagaucagacauu

SEQ ID NO: 556982 - RNA, 19 nt, Homo sapiens
ccaaagagcccauuacaac

SEQ ID NO: 556983 - RNA, 19 nt, Homo sapiens
aguaauagguccagauaug

SEQ ID NO: 556984 - RNA, 19 nt, Homo sapiens
ccaagagucauucuaauau

SEQ ID NO: 556985 - RNA, 19 nt, Homo sapiens
cauaguguccuuauuugua

SEQ ID NO: 556986 - RNA, 19 nt, Homo sapiens
uaacaaauggugaaagaug

SEQ ID NO: 556987 - RNA, 19 nt, Homo sapiens
ccuccaaucugcaugauga

SEQ ID NO: 556988 - RNA, 19 nt, Homo sapiens
ccacuccaauuaguuuaua

SEQ ID NO: 556989 - RNA, 19 nt, Homo sapiens
gaaggaaugaagaagcuuu

SEQ ID NO: 556990 - RNA, 19 nt, Homo sapiens
agagaaaugcuguuacuuu

SEQ ID NO: 556991 - RNA, 19 nt, Homo sapiens
caaaugacacguuaauauc

SEQ ID NO: 556992 - RNA, 19 nt, Homo sapiens
gggcaagggaggaaagaua

SEQ ID NO: 556993 - RNA, 19 nt, Homo sapiens
gaugauagaaccuggaaug

SEQ ID NO: 556994 - RNA, 19 nt, Homo sapiens
cacccuaccuuucuaauca

SEQ ID NO: 556995 - RNA, 19 nt, Homo sapiens
caaacacugcugaagauaa

SEQ ID NO: 556996 - RNA, 19 nt, Homo sapiens
gaaaagauuccgggauuua

SEQ ID NO: 556997 - RNA, 19 nt, Homo sapiens
gcaccuccauguacuucaa

SEQ ID NO: 556998 - RNA, 19 nt, Homo sapiens
acaccaagcugaccaugga

SEQ ID NO: 556999 - RNA, 19 nt, Homo sapiens
agacauacagcucggaaua

SEQ ID NO: 557000 - RNA, 19 nt, Homo sapiens
uaaagaugauagcauguuc

SEQ ID NO: 557001 - RNA, 19 nt, Homo sapiens
auugaagggugaagaguua

SEQ ID NO: 557002 - RNA, 19 nt, Homo sapiens
ggcagaaacuuccuuuuaa

SEQ ID NO: 557003 - RNA, 19 nt, Homo sapiens
guacguauguggugcaaac

SEQ ID NO: 557004 - RNA, 19 nt, Homo sapiens
caggguaggaugugucuua

SEQ ID NO: 557005 - RNA, 19 nt, Homo sapiens
ggucaaacacugcugaaga

SEQ ID NO: 557006 - RNA, 19 nt, Homo sapiens
caagagaacagugcagaaa

SEQ ID NO: 557007 - RNA, 19 nt, Homo sapiens
cauacaagauagcuucaga

SEQ ID NO: 557008 - RNA, 19 nt, Homo sapiens
gguaacagaaucaagacua

SEQ ID NO: 557009 - RNA, 19 nt, Homo sapiens
aaacacugcugaagauaag

SEQ ID NO: 557010 - RNA, 19 nt, Homo sapiens
aguguuaacuugcuucuga

SEQ ID NO: 557011 - RNA, 19 nt, Homo sapiens
gucgaucccuucugaggua

SEQ ID NO: 557012 - RNA, 19 nt, Homo sapiens
aaaagcagcuccuguagaa

SEQ ID NO: 557013 - RNA, 19 nt, Homo sapiens
gaugauagcauguucuucu

SEQ ID NO: 557014 - RNA, 19 nt, Homo sapiens
acagagcccuagagaaaug

SEQ ID NO: 557015 - RNA, 19 nt, Homo sapiens
gggcugcguuucaacauuc

SEQ ID NO: 557016 - RNA, 19 nt, Homo sapiens
uaagucaguugaguauuug

SEQ ID NO: 557017 - RNA, 19 nt, Homo sapiens
gucaaacacugcugaagau

SEQ ID NO: 557018 - RNA, 19 nt, Homo sapiens
acccagagaucuugauuau

SEQ ID NO: 557019 - RNA, 19 nt, Homo sapiens
caaaguauaacccagauag

SEQ ID NO: 557020 - RNA, 19 nt, Homo sapiens
aaagagagucgaagagcua

SEQ ID NO: 557021 - RNA, 19 nt, Homo sapiens
gaugacacuuccucucugu

SEQ ID NO: 557022 - RNA, 19 nt, Homo sapiens
gaggagaggaugacacuuc

SEQ ID NO: 557023 - RNA, 19 nt, Homo sapiens
gugcauacauaaccuucuu

SEQ ID NO: 557024 - RNA, 19 nt, Homo sapiens
aguauuugaucccuagaua

SEQ ID NO: 557025 - RNA, 19 nt, Homo sapiens
uaaaagaccaccagaguaa

SEQ ID NO: 557026 - RNA, 19 nt, Homo sapiens
ccagagaucuugauuauuc

SEQ ID NO: 557027 - RNA, 19 nt, Homo sapiens
gaaguuguccguacagaua

SEQ ID NO: 557028 - RNA, 19 nt, Homo sapiens
ggacagcucucuagaaacu

SEQ ID NO: 557029 - RNA, 19 nt, Homo sapiens
gcaauucagugcauccauu

SEQ ID NO: 557030 - RNA, 19 nt, Homo sapiens
caagauacccugcagauau

SEQ ID NO: 557031 - RNA, 19 nt, Homo sapiens
cuaaaugccuuaacaagug

SEQ ID NO: 557032 - RNA, 19 nt, Homo sapiens
gcacagacaaacuacaauu

SEQ ID NO: 557033 - RNA, 19 nt, Homo sapiens
cgggacagcucucuagaaa

SEQ ID NO: 557034 - RNA, 19 nt, Homo sapiens
cuaagcaguuuauccaauu

SEQ ID NO: 557035 - RNA, 19 nt, Homo sapiens
ugaucagggucucuauuua

SEQ ID NO: 557036 - RNA, 19 nt, Homo sapiens
gaucagggucucuauuuau

SEQ ID NO: 557037 - RNA, 19 nt, Homo sapiens
ccaaagagcccauuacaac

SEQ ID NO: 557038 - RNA, 19 nt, Homo sapiens
ccuccaaucugcaugauga

SEQ ID NO: 557039 - RNA, 19 nt, Homo sapiens
uaaaugccuuaacaaguga

SEQ ID NO: 557040 - RNA, 19 nt, Homo sapiens
gcaccauguuagacaguuu

SEQ ID NO: 557041 - RNA, 19 nt, Homo sapiens
gcaccuccauguacuucaa

SEQ ID NO: 557042 - RNA, 19 nt, Homo sapiens
acaccaagcugaccaugga

SEQ ID NO: 557043 - RNA, 19 nt, Homo sapiens
agacauacagcucggaaua

SEQ ID NO: 557044 - RNA, 19 nt, Homo sapiens
gcaagauacccugcagaua

SEQ ID NO: 557045 - RNA, 19 nt, Homo sapiens
caagagaacagugcagaaa

SEQ ID NO: 557046 - RNA, 19 nt, Homo sapiens
caggagaacugggauggaa

SEQ ID NO: 557047 - RNA, 19 nt, Homo sapiens
ugauugaccugcugcuuau

SEQ ID NO: 557048 - RNA, 19 nt, Homo sapiens
gcaccugucauacacauug

SEQ ID NO: 557049 - RNA, 19 nt, Homo sapiens
gacaaagugacuacuguuu

SEQ ID NO: 557050 - RNA, 19 nt, Homo sapiens
acccagagaucuugauuau

SEQ ID NO: 557051 - RNA, 19 nt, Homo sapiens
cuauauuucucgcuucauu

SEQ ID NO: 557052 - RNA, 19 nt, Homo sapiens
ucagagggauuagaccauu

SEQ ID NO: 557053 - RNA, 19 nt, Homo sapiens
aagauacccugcagauaug

SEQ ID NO: 557054 - RNA, 19 nt, Homo sapiens
cggcugugcucucccauga

SEQ ID NO: 557055 - RNA, 19 nt, Homo sapiens
ucagaagugucucaguguu

SEQ ID NO: 557056 - RNA, 19 nt, Homo sapiens
ccauucagcgcgcaagaua

SEQ ID NO: 557057 - RNA, 19 nt, Homo sapiens
caaaccaaagagcccauua

SEQ ID NO: 557058 - RNA, 19 nt, Homo sapiens
uaagcaguuuauccaauug

SEQ ID NO: 557059 - RNA, 19 nt, Homo sapiens
uagacaaagugacuacugu

SEQ ID NO: 557060 - RNA, 19 nt, Homo sapiens
acacauuguugcaggauuc

SEQ ID NO: 557061 - RNA, 19 nt, Homo sapiens
gaggucgucugccuuccaa

SEQ ID NO: 557062 - RNA, 19 nt, Homo sapiens
caaagagcccauuacaaca

SEQ ID NO: 557063 - RNA, 19 nt, Homo sapiens
ucucaguguuggaauggua

SEQ ID NO: 557064 - RNA, 19 nt, Homo sapiens
guggaaauggcuacaauau

SEQ ID NO: 557065 - RNA, 19 nt, Homo sapiens
gagccucaaguuauuacua

SEQ ID NO: 557066 - RNA, 19 nt, Homo sapiens
gcugugcucucccaugagu

SEQ ID NO: 557067 - RNA, 19 nt, Homo sapiens
ugucaguacugucgauuuc

SEQ ID NO: 557068 - RNA, 19 nt, Homo sapiens
gagcaacuacgaacucaag

SEQ ID NO: 557069 - RNA, 19 nt, Homo sapiens
agccucaaguuauuacuaa

SEQ ID NO: 557070 - RNA, 19 nt, Homo sapiens
cauauuguguucaaaccau

SEQ ID NO: 557071 - RNA, 19 nt, Homo sapiens
gaccuuggcagcacugaga

SEQ ID NO: 557072 - RNA, 19 nt, Homo sapiens
caguggaaauggcuacaau

SEQ ID NO: 557073 - RNA, 19 nt, Homo sapiens
ucucagcccucuccaccuu

SEQ ID NO: 557074 - RNA, 19 nt, Homo sapiens
aaaccgaugucaguacugu

SEQ ID NO: 557075 - RNA, 19 nt, Homo sapiens
cgaaaccgaugucaguacu

SEQ ID NO: 557076 - RNA, 19 nt, Homo sapiens
gaauacaccacggagauca

SEQ ID NO: 557077 - RNA, 19 nt, Homo sapiens
cacagacaaacuacaauuu

SEQ ID NO: 557078 - RNA, 19 nt, Homo sapiens
cuauuuauggcuacuagua

SEQ ID NO: 557079 - RNA, 19 nt, Homo sapiens
caugaugaaugcucuuguc

SEQ ID NO: 557080 - RNA, 19 nt, Homo sapiens
cagagggauuagaccauug

SEQ ID NO: 557081 - RNA, 19 nt, Homo sapiens
gaccugcugcuuauucaga

SEQ ID NO: 557082 - RNA, 19 nt, Homo sapiens
uugauugaccugcugcuua

SEQ ID NO: 557083 - RNA, 19 nt, Homo sapiens
cuacuaguaauaagaguug

SEQ ID NO: 557084 - RNA, 19 nt, Homo sapiens
guagacaagagacgucgaa

SEQ ID NO: 557085 - RNA, 19 nt, Homo sapiens
acauacagcucggaauaca

SEQ ID NO: 557086 - RNA, 19 nt, Homo sapiens
acuaagcaguuuauccaau

SEQ ID NO: 557087 - RNA, 19 nt, Homo sapiens
caucagcagccauccauuc

SEQ ID NO: 557088 - RNA, 19 nt, Homo sapiens
uggaaauggcuacaauauu

SEQ ID NO: 557089 - RNA, 19 nt, Homo sapiens
caaagcccacugcggaaga

SEQ ID NO: 557090 - RNA, 19 nt, Homo sapiens
gaucuagacaaagugacua

SEQ ID NO: 557091 - RNA, 19 nt, Homo sapiens
cagaagugucucaguguug

SEQ ID NO: 557092 - RNA, 19 nt, Homo sapiens
cccugagccuggacccuua

SEQ ID NO: 557093 - RNA, 19 nt, Homo sapiens
gacaagagacgucgaaacc

SEQ ID NO: 557094 - RNA, 19 nt, Homo sapiens
gaacgccaccucugcuacu

SEQ ID NO: 557095 - RNA, 19 nt, Homo sapiens
gacguccgcuccuccuaca

SEQ ID NO: 557096 - RNA, 19 nt, Homo sapiens
augauuuccugcuuucaaa

SEQ ID NO: 557097 - RNA, 19 nt, Homo sapiens
cuugauuauuccagaguaa

SEQ ID NO: 557098 - RNA, 19 nt, Homo sapiens
ccaaucugcaugaugaaug

SEQ ID NO: 557099 - RNA, 19 nt, Homo sapiens
ggaauacaccacggagauc

SEQ ID NO: 557100 - RNA, 19 nt, Homo sapiens
gaaugaucagggucucuau

SEQ ID NO: 557101 - RNA, 19 nt, Homo sapiens
ugaaugaucagggucucua

SEQ ID NO: 557102 - RNA, 19 nt, Homo sapiens
uuacuaagcaguuuaucca

SEQ ID NO: 557103 - RNA, 19 nt, Homo sapiens
ucuaaaugccuuaacaagu

SEQ ID NO: 557104 - RNA, 19 nt, Homo sapiens
cgucgaaaccgaugucagu

SEQ ID NO: 557105 - RNA, 19 nt, Homo sapiens
ccagcuaccaucaccauca

SEQ ID NO: 557106 - RNA, 19 nt, Homo sapiens
gcucucuccugccuacagu

SEQ ID NO: 557107 - RNA, 19 nt, Homo sapiens
caacacccagagaucuuga

SEQ ID NO: 557108 - RNA, 19 nt, Homo sapiens
cacccagagaucuugauua

SEQ ID NO: 557109 - RNA, 19 nt, Homo sapiens
gcuacuaguaauaagaguu

SEQ ID NO: 557110 - RNA, 19 nt, Homo sapiens
ccuccagguuccaguuaug

SEQ ID NO: 557111 - RNA, 19 nt, Homo sapiens
cggaauacaccacggagau

SEQ ID NO: 557112 - RNA, 19 nt, Homo sapiens
ucaagagaacagugcagaa

SEQ ID NO: 557113 - RNA, 19 nt, Homo sapiens
gcccagcaccuccauguac

SEQ ID NO: 557114 - RNA, 19 nt, Homo sapiens
agacaaagugacuacuguu

SEQ ID NO: 557115 - RNA, 19 nt, Homo sapiens
uuuaugauuuccugcuuuc

SEQ ID NO: 557116 - RNA, 19 nt, Homo sapiens
gauuauuccagaguaaguu

SEQ ID NO: 557117 - RNA, 19 nt, Homo sapiens
aaaagaaguuguccguaca

SEQ ID NO: 557118 - RNA, 19 nt, Homo sapiens
gcuucccgcucuuccacuu

SEQ ID NO: 557119 - RNA, 19 nt, Homo sapiens
augaucagggucucuauuu

SEQ ID NO: 557120 - RNA, 19 nt, Homo sapiens
uaugauuuccugcuuucaa

SEQ ID NO: 557121 - RNA, 19 nt, Homo sapiens
ucuugauuauuccagagua

SEQ ID NO: 557122 - RNA, 19 nt, Homo sapiens
gaaccgccacagcacucaa

SEQ ID NO: 557123 - RNA, 19 nt, Homo sapiens
ucuccugccuacaguggaa

SEQ ID NO: 557124 - RNA, 19 nt, Homo sapiens
ucgcuucauuuagcaauuc

SEQ ID NO: 557125 - RNA, 19 nt, Homo sapiens
aucagggucucuauuuaug

SEQ ID NO: 557126 - RNA, 19 nt, Homo sapiens
gauagaaccuggaauguua

SEQ ID NO: 557127 - RNA, 19 nt, Homo sapiens
gaaauacugugcauacaua

SEQ ID NO: 557128 - RNA, 19 nt, Homo sapiens
caaagaagaucagacauua

SEQ ID NO: 557129 - RNA, 19 nt, Homo sapiens
gaucagacauuacuuauug

SEQ ID NO: 557130 - RNA, 19 nt, Homo sapiens
gaaaguggaucagauuaua

SEQ ID NO: 557131 - RNA, 19 nt, Homo sapiens
ggugaaagauggaggauua

SEQ ID NO: 557132 - RNA, 19 nt, Homo sapiens
caagauagcuucagaccaa

SEQ ID NO: 557133 - RNA, 19 nt, Homo sapiens
ccagagaucuugauuauuc

SEQ ID NO: 557134 - RNA, 19 nt, Homo sapiens
gaagaucagacauuacuua

SEQ ID NO: 557135 - RNA, 19 nt, Homo sapiens
gaagagcuaugcaacaaga

SEQ ID NO: 557136 - RNA, 19 nt, Homo sapiens
gaaguuguccguacagaua

SEQ ID NO: 557137 - RNA, 19 nt, Homo sapiens
ucaaacagcugguaacaga

SEQ ID NO: 557138 - RNA, 19 nt, Homo sapiens
aaacagagcccuagagaaa

SEQ ID NO: 557139 - RNA, 19 nt, Homo sapiens
ucaaacaaaugccaaauga

SEQ ID NO: 557140 - RNA, 19 nt, Homo sapiens
gcaaaugacacguuaauau

SEQ ID NO: 557141 - RNA, 19 nt, Homo sapiens
gauaagaacaugcaaauca

SEQ ID NO: 557142 - RNA, 19 nt, Homo sapiens
gaagcugaguuacagagua

SEQ ID NO: 557143 - RNA, 19 nt, Homo sapiens
guaacagaaucaagacuaa

SEQ ID NO: 557144 - RNA, 19 nt, Homo sapiens
guaacugacugguauauuc

SEQ ID NO: 557145 - RNA, 19 nt, Homo sapiens
uuaaagugcugucuuacua

SEQ ID NO: 557146 - RNA, 19 nt, Homo sapiens
ccacuaauauuuaccugaa

SEQ ID NO: 557147 - RNA, 19 nt, Homo sapiens
gagauaauuuguugcauag

SEQ ID NO: 557148 - RNA, 19 nt, Homo sapiens
gaagauaaccaugaguaaa

SEQ ID NO: 557149 - RNA, 19 nt, Homo sapiens
gauaauuuguugcauagug

SEQ ID NO: 557150 - RNA, 19 nt, Homo sapiens
uauaguaacugacugguau

SEQ ID NO: 557151 - RNA, 19 nt, Homo sapiens
guuagcaaaugacacguua

SEQ ID NO: 557152 - RNA, 19 nt, Homo sapiens
uguaauagcuuugccugua

SEQ ID NO: 557153 - RNA, 19 nt, Homo sapiens
gauggaggauuaccuacaa

SEQ ID NO: 557154 - RNA, 19 nt, Homo sapiens
gaagauaaguuuguguucu

SEQ ID NO: 557155 - RNA, 19 nt, Homo sapiens
gcauugcucuuuagugugu

SEQ ID NO: 557156 - RNA, 19 nt, Homo sapiens
gagaaaugcuguuacuuuu

SEQ ID NO: 557157 - RNA, 19 nt, Homo sapiens
gcuaacauuucauacaaga

SEQ ID NO: 557158 - RNA, 19 nt, Homo sapiens
aaaggaggcagucauguua

SEQ ID NO: 557159 - RNA, 19 nt, Homo sapiens
gguaggaugugucuuaaag

SEQ ID NO: 557160 - RNA, 19 nt, Homo sapiens
ggaaaguuaauccuuguuu

SEQ ID NO: 557161 - RNA, 19 nt, Homo sapiens
gaaucaagacuaagaccua

SEQ ID NO: 557162 - RNA, 19 nt, Homo sapiens
guaugcacguuauauugua

SEQ ID NO: 557163 - RNA, 19 nt, Homo sapiens
aaagauuggucccuugaaa

SEQ ID NO: 557164 - RNA, 19 nt, Homo sapiens
ccagaaaacuugcagagua

SEQ ID NO: 557165 - RNA, 19 nt, Homo sapiens
guaauagcuuugccuguau

SEQ ID NO: 557166 - RNA, 19 nt, Homo sapiens
gaaaauaugcuuccuguau

SEQ ID NO: 557167 - RNA, 19 nt, Homo sapiens
caagaucacaagcaguuua

SEQ ID NO: 557168 - RNA, 19 nt, Homo sapiens
caagucaucuuaucaacuc

SEQ ID NO: 557169 - RNA, 19 nt, Homo sapiens
gcaguacuguuuagcacuu

SEQ ID NO: 557170 - RNA, 19 nt, Homo sapiens
gucaagauuucaucccaua

SEQ ID NO: 557171 - RNA, 19 nt, Homo sapiens
gcagucauguuagcaaaug

SEQ ID NO: 557172 - RNA, 19 nt, Homo sapiens
ccaaagaagaucagacauu

SEQ ID NO: 557173 - RNA, 19 nt, Homo sapiens
ccaaagagcccauuacaac

SEQ ID NO: 557174 - RNA, 19 nt, Homo sapiens
aguaauagguccagauaug

SEQ ID NO: 557175 - RNA, 19 nt, Homo sapiens
ccaagagucauucuaauau

SEQ ID NO: 557176 - RNA, 19 nt, Homo sapiens
cauaguguccuuauuugua

SEQ ID NO: 557177 - RNA, 19 nt, Homo sapiens
uaacaaauggugaaagaug

SEQ ID NO: 557178 - RNA, 19 nt, Homo sapiens
ccuccaaucugcaugauga

SEQ ID NO: 557179 - RNA, 19 nt, Homo sapiens
gaaggaaugaagaagcuuu

SEQ ID NO: 557180 - RNA, 19 nt, Homo sapiens
agagaaaugcuguuacuuu

SEQ ID NO: 557181 - RNA, 19 nt, Homo sapiens
caaaugacacguuaauauc

SEQ ID NO: 557182 - RNA, 19 nt, Homo sapiens
gaugauagaaccuggaaug

SEQ ID NO: 557183 - RNA, 19 nt, Homo sapiens
cacccuaccuuucuaauca

SEQ ID NO: 557184 - RNA, 19 nt, Homo sapiens
caaacacugcugaagauaa

SEQ ID NO: 557185 - RNA, 19 nt, Homo sapiens
acaccaagcugaccaugga

SEQ ID NO: 557186 - RNA, 19 nt, Homo sapiens
agacauacagcucggaaua

SEQ ID NO: 557187 - RNA, 19 nt, Homo sapiens
gaaaagauuccgggauuua

SEQ ID NO: 557188 - RNA, 19 nt, Homo sapiens
gcaccuccauguacuucaa

SEQ ID NO: 557189 - RNA, 19 nt, Homo sapiens
uaaagaugauagcauguuc

SEQ ID NO: 557190 - RNA, 19 nt, Homo sapiens
auugaagggugaagaguua

SEQ ID NO: 557191 - RNA, 19 nt, Homo sapiens
ggcagaaacuuccuuuuaa

SEQ ID NO: 557192 - RNA, 19 nt, Homo sapiens
guacguauguggugcaaac

SEQ ID NO: 557193 - RNA, 19 nt, Homo sapiens
caggguaggaugugucuua

SEQ ID NO: 557194 - RNA, 19 nt, Homo sapiens
ggucaaacacugcugaaga

SEQ ID NO: 557195 - RNA, 19 nt, Homo sapiens
caagagaacagugcagaaa

SEQ ID NO: 557196 - RNA, 19 nt, Homo sapiens
cauacaagauagcuucaga

SEQ ID NO: 557197 - RNA, 19 nt, Homo sapiens
gguaacagaaucaagacua

SEQ ID NO: 557198 - RNA, 19 nt, Homo sapiens
aaacacugcugaagauaag

SEQ ID NO: 557199 - RNA, 19 nt, Homo sapiens
gucgaucccuucugaggua

SEQ ID NO: 557200 - RNA, 19 nt, Homo sapiens
aaaagcagcuccuguagaa

SEQ ID NO: 557201 - RNA, 19 nt, Homo sapiens
gaugauagcauguucuucu

SEQ ID NO: 557202 - RNA, 19 nt, Homo sapiens
acagagcccuagagaaaug

SEQ ID NO: 557203 - RNA, 19 nt, Homo sapiens
gggcugcguuucaacauuc

SEQ ID NO: 557204 - RNA, 19 nt, Homo sapiens
uaagucaguugaguauuug

SEQ ID NO: 557205 - RNA, 19 nt, Homo sapiens
gucaaacacugcugaagau

SEQ ID NO: 557206 - RNA, 19 nt, Homo sapiens
acccagagaucuugauuau

SEQ ID NO: 557207 - RNA, 19 nt, Homo sapiens
caaaguauaacccagauag

SEQ ID NO: 557208 - RNA, 19 nt, Homo sapiens
aaagagagucgaagagcua

SEQ ID NO: 557209 - RNA, 19 nt, Homo sapiens
gugcauacauaaccuucuu

SEQ ID NO: 557210 - RNA, 19 nt, Homo sapiens
aguauuugaucccuagaua

SEQ ID NO: 557211 - RNA, 19 nt, Homo sapiens
uaaaagaccaccagaguaa

SEQ ID NO: 557212 - RNA, 19 nt, Homo sapiens
ucgaagagcuaugcaacaa

SEQ ID NO: 557213 - RNA, 19 nt, Homo sapiens
gagagugccuugcuuuuau

SEQ ID NO: 557214 - RNA, 19 nt, Homo sapiens
ggaagccaccagcuguuaa

SEQ ID NO: 557215 - RNA, 19 nt, Homo sapiens
guccagauaugagugcuaa

SEQ ID NO: 557216 - RNA, 19 nt, Homo sapiens
guaauagguccagauauga

SEQ ID NO: 557217 - RNA, 19 nt, Homo sapiens
caaacaaggcagaaacuuc

SEQ ID NO: 557218 - RNA, 19 nt, Homo sapiens
acaaaugccaaaugaauug

SEQ ID NO: 557219 - RNA, 19 nt, Homo sapiens
ccagggacaauaaggauuu

SEQ ID NO: 557220 - RNA, 19 nt, Homo sapiens
guaagcaccagggacaaua

SEQ ID NO: 557221 - RNA, 19 nt, Homo sapiens
ugacugguauauucauuca

SEQ ID NO: 557222 - RNA, 19 nt, Homo sapiens
gcagaaacuuccuuuuaau

SEQ ID NO: 557223 - RNA, 19 nt, Homo sapiens
aaauaugcuuccuguauca

SEQ ID NO: 557224 - RNA, 19 nt, Homo sapiens
gggaauccaauuauaguug

SEQ ID NO: 557225 - RNA, 19 nt, Homo sapiens
ggacacccuaccuuucuaa

SEQ ID NO: 557226 - RNA, 19 nt, Homo sapiens
gaaagucucuucuucauca

SEQ ID NO: 557227 - RNA, 19 nt, Homo sapiens
ggauauggguacuguauuu

SEQ ID NO: 557228 - RNA, 19 nt, Homo sapiens
gcuaauggcccaagcuuua

SEQ ID NO: 557229 - RNA, 19 nt, Homo sapiens
gcagacagcugaagaaagg

SEQ ID NO: 557230 - RNA, 19 nt, Homo sapiens
ggaaaugucucggauaugg

SEQ ID NO: 557231 - RNA, 19 nt, Homo sapiens
ccaagaggaaguugaauua

SEQ ID NO: 557232 - RNA, 19 nt, Homo sapiens
ggagagauaugucaagucu

SEQ ID NO: 557233 - RNA, 19 nt, Homo sapiens
cgaagaaccuuguggaauc

SEQ ID NO: 557234 - RNA, 19 nt, Homo sapiens
ggcccaagcuuuagagaaa

SEQ ID NO: 557235 - RNA, 19 nt, Homo sapiens
ggacagaacaggacagaug

SEQ ID NO: 557236 - RNA, 19 nt, Homo sapiens
gaacaggacagauggaugu

SEQ ID NO: 557237 - RNA, 19 nt, Homo sapiens
gagaugagguuugccaaga

SEQ ID NO: 557238 - RNA, 19 nt, Homo sapiens
aauugaaccugccggauua

SEQ ID NO: 557239 - RNA, 19 nt, Homo sapiens
caaagaagaagaaggagaa

SEQ ID NO: 557240 - RNA, 19 nt, Homo sapiens
gcauuguccuugucauuug

SEQ ID NO: 557241 - RNA, 19 nt, Homo sapiens
guuaugauaucuuccaguu

SEQ ID NO: 557242 - RNA, 19 nt, Homo sapiens
ggagagcucuucggacuca

SEQ ID NO: 557243 - RNA, 19 nt, Homo sapiens
ggugugaacucugcagaaa

SEQ ID NO: 557244 - RNA, 19 nt, Homo sapiens
cgagauagaaauugacuuu

SEQ ID NO: 557245 - RNA, 19 nt, Homo sapiens
guaaacaaaccaaagaaga

SEQ ID NO: 557246 - RNA, 19 nt, Homo sapiens
ugacagcagugacucagaa

SEQ ID NO: 557247 - RNA, 19 nt, Homo sapiens
gggagaugcuauccaagaa

SEQ ID NO: 557248 - RNA, 19 nt, Homo sapiens
gcccacagaugacauagug

SEQ ID NO: 557249 - RNA, 19 nt, Homo sapiens
gagaugacaacuucaaaug

SEQ ID NO: 557250 - RNA, 19 nt, Homo sapiens
gaacuggcuucggacagaa

SEQ ID NO: 557251 - RNA, 19 nt, Homo sapiens
gauagaaauugacuuugag

SEQ ID NO: 557252 - RNA, 19 nt, Homo sapiens
cggcugauguucucgaauu

SEQ ID NO: 557253 - RNA, 19 nt, Homo sapiens
ucagggagaugcuauccaa

SEQ ID NO: 557254 - RNA, 19 nt, Homo sapiens
gcgaauguaugcaggacuu

SEQ ID NO: 557255 - RNA, 19 nt, Homo sapiens
gaacuggagagauauguca

SEQ ID NO: 557256 - RNA, 19 nt, Homo sapiens
ugaagacgcucuggaaaca

SEQ ID NO: 557257 - RNA, 19 nt, Homo sapiens
caacacgcauuguccuugu

SEQ ID NO: 557258 - RNA, 19 nt, Homo sapiens
aaggaaaugucucggauau

SEQ ID NO: 557259 - RNA, 19 nt, Homo sapiens
gaugacaacuucaaaugcu

SEQ ID NO: 557260 - RNA, 19 nt, Homo sapiens
ccaaccagcugcaguacau

SEQ ID NO: 557261 - RNA, 19 nt, Homo sapiens
gaugagguuugccaagaug

SEQ ID NO: 557262 - RNA, 19 nt, Homo sapiens
caucaagccucccaagaag

SEQ ID NO: 557263 - RNA, 19 nt, Homo sapiens
gcguuagacuugaugagaa

SEQ ID NO: 557264 - RNA, 19 nt, Homo sapiens
ccaagccgcugcugugaca

SEQ ID NO: 557265 - RNA, 19 nt, Homo sapiens
gcuuuuaccucaacuuuaa

SEQ ID NO: 557266 - RNA, 19 nt, Homo sapiens
ugcgggaacuggagagaua

SEQ ID NO: 557267 - RNA, 19 nt, Homo sapiens
gagcgcagguacacagcaa

SEQ ID NO: 557268 - RNA, 19 nt, Homo sapiens
ccgacgagauagaaauuga

SEQ ID NO: 557269 - RNA, 19 nt, Homo sapiens
agaaggagaagaagaagaa

SEQ ID NO: 557270 - RNA, 19 nt, Homo sapiens
agaagaagaaggagaagaa

SEQ ID NO: 557271 - RNA, 19 nt, Homo sapiens
uguggaaucccuuugcuua

SEQ ID NO: 557272 - RNA, 19 nt, Homo sapiens
ggagaugacaacuucaaau

SEQ ID NO: 557273 - RNA, 19 nt, Homo sapiens
gcuucuuaauucaguguua

SEQ ID NO: 557274 - RNA, 19 nt, Homo sapiens
cagcagugacucagaauga

SEQ ID NO: 557275 - RNA, 19 nt, Homo sapiens
caggucugcuucuuaauuc

SEQ ID NO: 557276 - RNA, 19 nt, Homo sapiens
guucucgaauugcuacaaa

SEQ ID NO: 557277 - RNA, 19 nt, Homo sapiens
caaggaaaugucucggaua

SEQ ID NO: 557278 - RNA, 19 nt, Homo sapiens
gaaggcuccugccaagaag

SEQ ID NO: 557279 - RNA, 19 nt, Homo sapiens
gaaggagaagcacaaagug

SEQ ID NO: 557280 - RNA, 19 nt, Homo sapiens
agaaggagaaggagaagaa

SEQ ID NO: 557281 - RNA, 19 nt, Homo sapiens
ccaguaaacaaaccaaaga

SEQ ID NO: 557282 - RNA, 19 nt, Homo sapiens
gaagcuccaggacguguuu

SEQ ID NO: 557283 - RNA, 19 nt, Homo sapiens
auaacaagcccacagauga

SEQ ID NO: 557284 - RNA, 19 nt, Homo sapiens
ugaacuggcuucggacaga

SEQ ID NO: 557285 - RNA, 19 nt, Homo sapiens
ccaucaagccucccaagaa

SEQ ID NO: 557286 - RNA, 19 nt, Homo sapiens
acaccauguuuacaaauug

SEQ ID NO: 557287 - RNA, 19 nt, Homo sapiens
ggcccaaccuggucgauag

SEQ ID NO: 557288 - RNA, 19 nt, Homo sapiens
ggccaacugucgccugguu

SEQ ID NO: 557289 - RNA, 19 nt, Homo sapiens
gcagguuuccauacacuga

SEQ ID NO: 557290 - RNA, 19 nt, Homo sapiens
ugugaacucugcagaaagu

SEQ ID NO: 557291 - RNA, 19 nt, Homo sapiens
cccaugagcuacgaugaaa

SEQ ID NO: 557292 - RNA, 19 nt, Homo sapiens
ccaagcaggcucagcagaa

SEQ ID NO: 557293 - RNA, 19 nt, Homo sapiens
gggcuuugcugcugauguc

SEQ ID NO: 557294 - RNA, 19 nt, Homo sapiens
uaccaaccaucacugcaaa

SEQ ID NO: 557295 - RNA, 19 nt, Homo sapiens
cagaugacauagugcuaau

SEQ ID NO: 557296 - RNA, 19 nt, Homo sapiens
uauggguacuguauuugaa

SEQ ID NO: 557297 - RNA, 19 nt, Homo sapiens
cagcuuagccuggacauca

SEQ ID NO: 557298 - RNA, 19 nt, Homo sapiens
agaaggcuccugccaagaa

SEQ ID NO: 557299 - RNA, 19 nt, Homo sapiens
ggagugcaagcgaauguau

SEQ ID NO: 557300 - RNA, 19 nt, Homo sapiens
gcacgacuaccacgacauc

SEQ ID NO: 557301 - RNA, 19 nt, Homo sapiens
aaauugaaccugccggauu

SEQ ID NO: 557302 - RNA, 19 nt, Homo sapiens
ucaguguuaugauaucuuc

SEQ ID NO: 557303 - RNA, 19 nt, Homo sapiens
agaagaaggacaaggagaa

SEQ ID NO: 557304 - RNA, 19 nt, Homo sapiens
agaagaagaaggacaagga

SEQ ID NO: 557305 - RNA, 19 nt, Homo sapiens
agaagaaggagaaggagaa

SEQ ID NO: 557306 - RNA, 19 nt, Homo sapiens
agaaggagaagaaggagaa

SEQ ID NO: 557307 - RNA, 19 nt, Homo sapiens
agaagaaggagaagaagga

SEQ ID NO: 557308 - RNA, 19 nt, Homo sapiens
gaagaaccuuguggaaucc

SEQ ID NO: 557309 - RNA, 19 nt, Homo sapiens
uugccaagaugccagauga

SEQ ID NO: 557310 - RNA, 19 nt, Homo sapiens
ucgaauugcuacaaauaca

SEQ ID NO: 557311 - RNA, 19 nt, Homo sapiens
ucucgaauugcuacaaaua

SEQ ID NO: 557312 - RNA, 19 nt, Homo sapiens
guaccaaccaucacugcaa

SEQ ID NO: 557313 - RNA, 19 nt, Homo sapiens
ugacaacuucaaaugcuaa

SEQ ID NO: 557314 - RNA, 19 nt, Homo sapiens
gcaaaggaaaccguucuca

SEQ ID NO: 557315 - RNA, 19 nt, Homo sapiens
caagcaggcucagcagaag

SEQ ID NO: 557316 - RNA, 19 nt, Homo sapiens
ggagaaggagaagcacaaa

SEQ ID NO: 557317 - RNA, 19 nt, Homo sapiens
gcugauguccggcugaugu

SEQ ID NO: 557318 - RNA, 19 nt, Homo sapiens
caagcccacagaugacaua

SEQ ID NO: 557319 - RNA, 19 nt, Homo sapiens
ggugaagacgcucuggaaa

SEQ ID NO: 557320 - RNA, 19 nt, Homo sapiens
caaagugaaggccgaggaa

SEQ ID NO: 557321 - RNA, 19 nt, Homo sapiens
acaaggagaaggagaagga

SEQ ID NO: 557322 - RNA, 19 nt, Homo sapiens
gaagaaggacaaggagaag

SEQ ID NO: 557323 - RNA, 19 nt, Homo sapiens
gagaaggagaagaagaaga

SEQ ID NO: 557324 - RNA, 19 nt, Homo sapiens
gaaccugccggauuaucau

SEQ ID NO: 557325 - RNA, 19 nt, Homo sapiens
cccuggagcugcacgacua

SEQ ID NO: 557326 - RNA, 19 nt, Homo sapiens
gaaauuugcuguccaagau

SEQ ID NO: 557327 - RNA, 19 nt, Homo sapiens
ggacaucaguggaaagauu

SEQ ID NO: 557328 - RNA, 19 nt, Homo sapiens
gcacaaugcuugccacgaa

SEQ ID NO: 557329 - RNA, 19 nt, Homo sapiens
ucaaauaccucuaaccuau

SEQ ID NO: 557330 - RNA, 19 nt, Homo sapiens
gaaugucccucaaguggua

SEQ ID NO: 557331 - RNA, 19 nt, Homo sapiens
cagcaagccuuucucauuu

SEQ ID NO: 557332 - RNA, 19 nt, Homo sapiens
gaaaguaugugcaacucuu

SEQ ID NO: 557333 - RNA, 19 nt, Homo sapiens
caagacauuugguggauuu

SEQ ID NO: 557334 - RNA, 19 nt, Homo sapiens
cauagaaucucacaccaaa

SEQ ID NO: 557335 - RNA, 19 nt, Homo sapiens
gugcaggaauugaagaaua

SEQ ID NO: 557336 - RNA, 19 nt, Homo sapiens
gaacuucaguggcuacauc

SEQ ID NO: 557337 - RNA, 19 nt, Homo sapiens
gcacggacguccuguaaag

SEQ ID NO: 557338 - RNA, 19 nt, Homo sapiens
gagcuucuguuuccaaguu

SEQ ID NO: 557339 - RNA, 19 nt, Homo sapiens
ggaaacgucuccagaugug

SEQ ID NO: 557340 - RNA, 19 nt, Homo sapiens
caacaccgucuucuaauuu

SEQ ID NO: 557341 - RNA, 19 nt, Homo sapiens
gaagucagcucaacgucau

SEQ ID NO: 557342 - RNA, 19 nt, Homo sapiens
ggaggagauugcacacuuu

SEQ ID NO: 557343 - RNA, 19 nt, Homo sapiens
gguuaagucucucaucaaa

SEQ ID NO: 557344 - RNA, 19 nt, Homo sapiens
cgacaaagugaucagauua

SEQ ID NO: 557345 - RNA, 19 nt, Homo sapiens
guuaucaucuggugacaaa

SEQ ID NO: 557346 - RNA, 19 nt, Homo sapiens
gcaacacccuccacuaaag

SEQ ID NO: 557347 - RNA, 19 nt, Homo sapiens
gagauauuaugaagacuug

SEQ ID NO: 557348 - RNA, 19 nt, Homo sapiens
gcaaacuucugacucuguu

SEQ ID NO: 557349 - RNA, 19 nt, Homo sapiens
guaaacacuuugacugaau

SEQ ID NO: 557350 - RNA, 19 nt, Homo sapiens
gaugugcuguggauuggua

SEQ ID NO: 557351 - RNA, 19 nt, Homo sapiens
gaaacaggcacaacugaga

SEQ ID NO: 557352 - RNA, 19 nt, Homo sapiens
gaaugauguucuagacuug

SEQ ID NO: 557353 - RNA, 19 nt, Homo sapiens
gaaaucgugacucugguua

SEQ ID NO: 557354 - RNA, 19 nt, Homo sapiens
gaaggaguuggaagaguua

SEQ ID NO: 557355 - RNA, 19 nt, Homo sapiens
gggaggagauugcacacuu

SEQ ID NO: 557356 - RNA, 19 nt, Homo sapiens
gggcaacacccuccacuaa

SEQ ID NO: 557357 - RNA, 19 nt, Homo sapiens
ccaacaccgucuucuaauu

SEQ ID NO: 557358 - RNA, 19 nt, Homo sapiens
ugaaugauguucuagacuu

SEQ ID NO: 557359 - RNA, 19 nt, Homo sapiens
ugaaagaaaucgugacucu

SEQ ID NO: 557360 - RNA, 19 nt, Homo sapiens
gaaaacaacuuuacuugag

SEQ ID NO: 557361 - RNA, 19 nt, Homo sapiens
gaaagauucagauccugua

SEQ ID NO: 557362 - RNA, 19 nt, Homo sapiens
ucaaccagcucaccaacaa

SEQ ID NO: 557363 - RNA, 19 nt, Homo sapiens
gaucagccuuucugucuca

SEQ ID NO: 557364 - RNA, 19 nt, Homo sapiens
gaaaucaucaaccaacaga

SEQ ID NO: 557365 - RNA, 19 nt, Homo sapiens
gcagaguccuggcuuugga

SEQ ID NO: 557366 - RNA, 19 nt, Homo sapiens
gaacagaaucagaugacuu

SEQ ID NO: 557367 - RNA, 19 nt, Homo sapiens
gugcaaugcuuuguugaaa

SEQ ID NO: 557368 - RNA, 19 nt, Homo sapiens
gaacuuccaaagccuguuu

SEQ ID NO: 557369 - RNA, 19 nt, Homo sapiens
gcagggacaucaguggaaa

SEQ ID NO: 557370 - RNA, 19 nt, Homo sapiens
ccucuaaccuauuuggaaa

SEQ ID NO: 557371 - RNA, 19 nt, Homo sapiens
uaauacugguucuguguuu

SEQ ID NO: 557372 - RNA, 19 nt, Homo sapiens
agaaggaguuggaagaguu

SEQ ID NO: 557373 - RNA, 19 nt, Homo sapiens
gcauggugauugauaugaa

SEQ ID NO: 557374 - RNA, 19 nt, Homo sapiens
gaccgacguugccaucaaa

SEQ ID NO: 557375 - RNA, 19 nt, Homo sapiens
ccacaagccuaacuaguac

SEQ ID NO: 557376 - RNA, 19 nt, Homo sapiens
caacagauggugugcuuug

SEQ ID NO: 557377 - RNA, 19 nt, Homo sapiens
caaagccuguuuccaagug

SEQ ID NO: 557378 - RNA, 19 nt, Homo sapiens
ccaagcagaugauucuaca

SEQ ID NO: 557379 - RNA, 19 nt, Homo sapiens
gacaaagugaucagauuaa

SEQ ID NO: 557380 - RNA, 19 nt, Homo sapiens
ggaggcauggugauugaua

SEQ ID NO: 557381 - RNA, 19 nt, Homo sapiens
acacauacacccagaaaga

SEQ ID NO: 557382 - RNA, 19 nt, Homo sapiens
gcaggaggauucggguuug

SEQ ID NO: 557383 - RNA, 19 nt, Homo sapiens
gucagcagcucaggguuua

SEQ ID NO: 557384 - RNA, 19 nt, Homo sapiens
ggugggacaucucuaagug

SEQ ID NO: 557385 - RNA, 19 nt, Homo sapiens
agaaacagcugugacuuca

SEQ ID NO: 557386 - RNA, 19 nt, Homo sapiens
ugaagaaugucccucaagu

SEQ ID NO: 557387 - RNA, 19 nt, Homo sapiens
aagcaaaccuucuuaugag

SEQ ID NO: 557388 - RNA, 19 nt, Homo sapiens
ucagcaagccuuucucauu

SEQ ID NO: 557389 - RNA, 19 nt, Homo sapiens
ugcaggaauugaagaauaa

SEQ ID NO: 557390 - RNA, 19 nt, Homo sapiens
ucagagauauuaugaagac

SEQ ID NO: 557391 - RNA, 19 nt, Homo sapiens
ccaaauccuugcccaaagu

SEQ ID NO: 557392 - RNA, 19 nt, Homo sapiens
aaagucaaccuuagugaaa

SEQ ID NO: 557393 - RNA, 19 nt, Homo sapiens
agagacagcaucauuacua

SEQ ID NO: 557394 - RNA, 19 nt, Homo sapiens
ggaaacagugaaaguaugu

SEQ ID NO: 557395 - RNA, 19 nt, Homo sapiens
ugauugauaugaaguggaa

SEQ ID NO: 557396 - RNA, 19 nt, Homo sapiens
ggaaucacauccgcaucaa

SEQ ID NO: 557397 - RNA, 19 nt, Homo sapiens
uaauuucacugcugcacaa

SEQ ID NO: 557398 - RNA, 19 nt, Homo sapiens
caccaacaccgucuucuaa

SEQ ID NO: 557399 - RNA, 19 nt, Homo sapiens
caccagcuguaaacacuuu

SEQ ID NO: 557400 - RNA, 19 nt, Homo sapiens
caaaguaccagccaaacug

SEQ ID NO: 557401 - RNA, 19 nt, Homo sapiens
gagcgagagacacuguuua

SEQ ID NO: 557402 - RNA, 19 nt, Homo sapiens
acagaaaucacccaggaua

SEQ ID NO: 557403 - RNA, 19 nt, Homo sapiens
cagagcgacuuucauuaga

SEQ ID NO: 557404 - RNA, 19 nt, Homo sapiens
caaauauggucuggucuuc

SEQ ID NO: 557405 - RNA, 19 nt, Homo sapiens
ccaguucucauguuacuuu

SEQ ID NO: 557406 - RNA, 19 nt, Homo sapiens
caggaggcauggugauuga

SEQ ID NO: 557407 - RNA, 19 nt, Homo sapiens
gggcaggccucagucuuug

SEQ ID NO: 557408 - RNA, 19 nt, Homo sapiens
ggaagccaacagaccaaua

SEQ ID NO: 557409 - RNA, 19 nt, Homo sapiens
gcaggggucucuaauaaau

SEQ ID NO: 557410 - RNA, 19 nt, Homo sapiens
gaaacauggugcaccuagu

SEQ ID NO: 557411 - RNA, 19 nt, Homo sapiens
agauauaaguagccugaaa

SEQ ID NO: 557412 - RNA, 19 nt, Homo sapiens
caucauuacuaccucaguu

SEQ ID NO: 557413 - RNA, 19 nt, Homo sapiens
gaagaaugucccucaagug

SEQ ID NO: 557414 - RNA, 19 nt, Homo sapiens
uaaccuauuuggaaacagu

SEQ ID NO: 557415 - RNA, 19 nt, Homo sapiens
ggacagucuucucccaaca

SEQ ID NO: 557416 - RNA, 19 nt, Homo sapiens
gcaagugucuuuuccuuca

SEQ ID NO: 557417 - RNA, 19 nt, Homo sapiens
gaagccaacagaccaauag

SEQ ID NO: 557418 - RNA, 19 nt, Homo sapiens
gcugggagagcuucuguuu

SEQ ID NO: 557419 - RNA, 19 nt, Homo sapiens
gcagaugggacccuggaaa

SEQ ID NO: 557420 - RNA, 19 nt, Homo sapiens
uaaaugugcaggaauugaa

SEQ ID NO: 557421 - RNA, 19 nt, Homo sapiens
agauucagauccuguaaug

SEQ ID NO: 557422 - RNA, 19 nt, Homo sapiens
ggaguugucguagacuaua

SEQ ID NO: 557423 - RNA, 19 nt, Homo sapiens
gcacggagagacagcauca

SEQ ID NO: 557424 - RNA, 19 nt, Homo sapiens
gaggcauggugauugauau

SEQ ID NO: 557425 - RNA, 19 nt, Homo sapiens
aaacagcugugacuucaac

SEQ ID NO: 557426 - RNA, 19 nt, Homo sapiens
gaaauuugcuguccaagau

SEQ ID NO: 557427 - RNA, 19 nt, Homo sapiens
ggacaucaguggaaagauu

SEQ ID NO: 557428 - RNA, 19 nt, Homo sapiens
gcacaaugcuugccacgaa

SEQ ID NO: 557429 - RNA, 19 nt, Homo sapiens
ucaaauaccucuaaccuau

SEQ ID NO: 557430 - RNA, 19 nt, Homo sapiens
gaaugucccucaaguggua

SEQ ID NO: 557431 - RNA, 19 nt, Homo sapiens
cagcaagccuuucucauuu

SEQ ID NO: 557432 - RNA, 19 nt, Homo sapiens
gaaaguaugugcaacucuu

SEQ ID NO: 557433 - RNA, 19 nt, Homo sapiens
caagacauuugguggauuu

SEQ ID NO: 557434 - RNA, 19 nt, Homo sapiens
cauagaaucucacaccaaa

SEQ ID NO: 557435 - RNA, 19 nt, Homo sapiens
gugcaggaauugaagaaua

SEQ ID NO: 557436 - RNA, 19 nt, Homo sapiens
gaacuucaguggcuacauc

SEQ ID NO: 557437 - RNA, 19 nt, Homo sapiens
gcacggacguccuguaaag

SEQ ID NO: 557438 - RNA, 19 nt, Homo sapiens
gagcuucuguuuccaaguu

SEQ ID NO: 557439 - RNA, 19 nt, Homo sapiens
ggaaacgucuccagaugug

SEQ ID NO: 557440 - RNA, 19 nt, Homo sapiens
caacaccgucuucuaauuu

SEQ ID NO: 557441 - RNA, 19 nt, Homo sapiens
gaagucagcucaacgucau

SEQ ID NO: 557442 - RNA, 19 nt, Homo sapiens
ggaggagauugcacacuuu

SEQ ID NO: 557443 - RNA, 19 nt, Homo sapiens
gguuaagucucucaucaaa

SEQ ID NO: 557444 - RNA, 19 nt, Homo sapiens
cgacaaagugaucagauua

SEQ ID NO: 557445 - RNA, 19 nt, Homo sapiens
guuaucaucuggugacaaa

SEQ ID NO: 557446 - RNA, 19 nt, Homo sapiens
gcaacacccuccacuaaag

SEQ ID NO: 557447 - RNA, 19 nt, Homo sapiens
gagauauuaugaagacuug

SEQ ID NO: 557448 - RNA, 19 nt, Homo sapiens
gggagaaaguccaaugaga

SEQ ID NO: 557449 - RNA, 19 nt, Homo sapiens
gcaaacuucugacucuguu

SEQ ID NO: 557450 - RNA, 19 nt, Homo sapiens
guaaacacuuugacugaau

SEQ ID NO: 557451 - RNA, 19 nt, Homo sapiens
gaugugcuguggauuggua

SEQ ID NO: 557452 - RNA, 19 nt, Homo sapiens
gaaacaggcacaacugaga

SEQ ID NO: 557453 - RNA, 19 nt, Homo sapiens
gaaugauguucuagacuug

SEQ ID NO: 557454 - RNA, 19 nt, Homo sapiens
gaaaucgugacucugguua

SEQ ID NO: 557455 - RNA, 19 nt, Homo sapiens
gaaggaguuggaagaguua

SEQ ID NO: 557456 - RNA, 19 nt, Homo sapiens
gggaggagauugcacacuu

SEQ ID NO: 557457 - RNA, 19 nt, Homo sapiens
gggcaacacccuccacuaa

SEQ ID NO: 557458 - RNA, 19 nt, Homo sapiens
ccaacaccgucuucuaauu

SEQ ID NO: 557459 - RNA, 19 nt, Homo sapiens
ugaaugauguucuagacuu

SEQ ID NO: 557460 - RNA, 19 nt, Homo sapiens
ugaaagaaaucgugacucu

SEQ ID NO: 557461 - RNA, 19 nt, Homo sapiens
gaaaacaacuuuacuugag

SEQ ID NO: 557462 - RNA, 19 nt, Homo sapiens
gaaagauucagauccugua

SEQ ID NO: 557463 - RNA, 19 nt, Homo sapiens
gccuugaccucaccauuaa

SEQ ID NO: 557464 - RNA, 19 nt, Homo sapiens
ucaaccagcucaccaacaa

SEQ ID NO: 557465 - RNA, 19 nt, Homo sapiens
gaucagccuuucugucuca

SEQ ID NO: 557466 - RNA, 19 nt, Homo sapiens
gaaaucaucaaccaacaga

SEQ ID NO: 557467 - RNA, 19 nt, Homo sapiens
gcagaguccuggcuuugga

SEQ ID NO: 557468 - RNA, 19 nt, Homo sapiens
gaacagaaucagaugacuu

SEQ ID NO: 557469 - RNA, 19 nt, Homo sapiens
gugcaaugcuuuguugaaa

SEQ ID NO: 557470 - RNA, 19 nt, Homo sapiens
gaacuuccaaagccuguuu

SEQ ID NO: 557471 - RNA, 19 nt, Homo sapiens
gcagggacaucaguggaaa

SEQ ID NO: 557472 - RNA, 19 nt, Homo sapiens
ccucuaaccuauuuggaaa

SEQ ID NO: 557473 - RNA, 19 nt, Homo sapiens
uaauacugguucuguguuu

SEQ ID NO: 557474 - RNA, 19 nt, Homo sapiens
agaaggaguuggaagaguu

SEQ ID NO: 557475 - RNA, 19 nt, Homo sapiens
gcauggugauugauaugaa

SEQ ID NO: 557476 - RNA, 19 nt, Homo sapiens
gaccgacguugccaucaaa

SEQ ID NO: 557477 - RNA, 19 nt, Homo sapiens
ccacaagccuaacuaguac

SEQ ID NO: 557478 - RNA, 19 nt, Homo sapiens
caacagauggugugcuuug

SEQ ID NO: 557479 - RNA, 19 nt, Homo sapiens
caaagccuguuuccaagug

SEQ ID NO: 557480 - RNA, 19 nt, Homo sapiens
ccaagcagaugauucuaca

SEQ ID NO: 557481 - RNA, 19 nt, Homo sapiens
gacaaagugaucagauuaa

SEQ ID NO: 557482 - RNA, 19 nt, Homo sapiens
ggaggcauggugauugaua

SEQ ID NO: 557483 - RNA, 19 nt, Homo sapiens
acacauacacccagaaaga

SEQ ID NO: 557484 - RNA, 19 nt, Homo sapiens
gucagcagcucaggguuua

SEQ ID NO: 557485 - RNA, 19 nt, Homo sapiens
ggugggacaucucuaagug

SEQ ID NO: 557486 - RNA, 19 nt, Homo sapiens
agaaacagcugugacuuca

SEQ ID NO: 557487 - RNA, 19 nt, Homo sapiens
ugaagaaugucccucaagu

SEQ ID NO: 557488 - RNA, 19 nt, Homo sapiens
aagcaaaccuucuuaugag

SEQ ID NO: 557489 - RNA, 19 nt, Homo sapiens
ucagcaagccuuucucauu

SEQ ID NO: 557490 - RNA, 19 nt, Homo sapiens
ugcaggaauugaagaauaa

SEQ ID NO: 557491 - RNA, 19 nt, Homo sapiens
ucagagauauuaugaagac

SEQ ID NO: 557492 - RNA, 19 nt, Homo sapiens
ccaaauccuugcccaaagu

SEQ ID NO: 557493 - RNA, 19 nt, Homo sapiens
aaagucaaccuuagugaaa

SEQ ID NO: 557494 - RNA, 19 nt, Homo sapiens
agagacagcaucauuacua

SEQ ID NO: 557495 - RNA, 19 nt, Homo sapiens
ggaaacagugaaaguaugu

SEQ ID NO: 557496 - RNA, 19 nt, Homo sapiens
ugauugauaugaaguggaa

SEQ ID NO: 557497 - RNA, 19 nt, Homo sapiens
caaauauggucuggucuuc

SEQ ID NO: 557498 - RNA, 19 nt, Homo sapiens
ggaaucacauccgcaucaa

SEQ ID NO: 557499 - RNA, 19 nt, Homo sapiens
uaauuucacugcugcacaa

SEQ ID NO: 557500 - RNA, 19 nt, Homo sapiens
caccaacaccgucuucuaa

SEQ ID NO: 557501 - RNA, 19 nt, Homo sapiens
caccagcuguaaacacuuu

SEQ ID NO: 557502 - RNA, 19 nt, Homo sapiens
caaaguaccagccaaacug

SEQ ID NO: 557503 - RNA, 19 nt, Homo sapiens
gagcgagagacacuguuua

SEQ ID NO: 557504 - RNA, 19 nt, Homo sapiens
acagaaaucacccaggaua

SEQ ID NO: 557505 - RNA, 19 nt, Homo sapiens
cagagcgacuuucauuaga

SEQ ID NO: 557506 - RNA, 19 nt, Homo sapiens
ccaguucucauguuacuuu

SEQ ID NO: 557507 - RNA, 19 nt, Homo sapiens
caggaggcauggugauuga

SEQ ID NO: 557508 - RNA, 19 nt, Homo sapiens
gggcaggccucagucuuug

SEQ ID NO: 557509 - RNA, 19 nt, Homo sapiens
ggaagccaacagaccaaua

SEQ ID NO: 557510 - RNA, 19 nt, Homo sapiens
gcaggggucucuaauaaau

SEQ ID NO: 557511 - RNA, 19 nt, Homo sapiens
gaaacauggugcaccuagu

SEQ ID NO: 557512 - RNA, 19 nt, Homo sapiens
agauauaaguagccugaaa

SEQ ID NO: 557513 - RNA, 19 nt, Homo sapiens
caucauuacuaccucaguu

SEQ ID NO: 557514 - RNA, 19 nt, Homo sapiens
gaagaaugucccucaagug

SEQ ID NO: 557515 - RNA, 19 nt, Homo sapiens
uaaccuauuuggaaacagu

SEQ ID NO: 557516 - RNA, 19 nt, Homo sapiens
ggacagucuucucccaaca

SEQ ID NO: 557517 - RNA, 19 nt, Homo sapiens
gcaagugucuuuuccuuca

SEQ ID NO: 557518 - RNA, 19 nt, Homo sapiens
gaagccaacagaccaauag

SEQ ID NO: 557519 - RNA, 19 nt, Homo sapiens
gcugggagagcuucuguuu

SEQ ID NO: 557520 - RNA, 19 nt, Homo sapiens
gcagaugggacccuggaaa

SEQ ID NO: 557521 - RNA, 19 nt, Homo sapiens
uaaaugugcaggaauugaa

SEQ ID NO: 557522 - RNA, 19 nt, Homo sapiens
agauucagauccuguaaug

SEQ ID NO: 557523 - RNA, 19 nt, Homo sapiens
ggaguugucguagacuaua

SEQ ID NO: 557524 - RNA, 19 nt, Homo sapiens
gcacggagagacagcauca

SEQ ID NO: 557525 - RNA, 19 nt, Homo sapiens
gaggcauggugauugauau

SEQ ID NO: 557526 - RNA, 19 nt, Homo sapiens
ccaauuaacugagcacuug

SEQ ID NO: 557527 - RNA, 19 nt, Homo sapiens
agaagaggcugaagaagga

SEQ ID NO: 557528 - RNA, 19 nt, Homo sapiens
gcaaauuucuccccuuuau

SEQ ID NO: 557529 - RNA, 19 nt, Homo sapiens
caaagucacucccgcaaac

SEQ ID NO: 557530 - RNA, 19 nt, Homo sapiens
ccaggucucuagaucauuc

SEQ ID NO: 557531 - RNA, 19 nt, Homo sapiens
aaaccugaaucucgagcua

SEQ ID NO: 557532 - RNA, 19 nt, Homo sapiens
caucauaauugugcuuuca

SEQ ID NO: 557533 - RNA, 19 nt, Homo sapiens
gcagggaacggacccaguu

SEQ ID NO: 557534 - RNA, 19 nt, Homo sapiens
gggagagcguuuacugcaa

SEQ ID NO: 557535 - RNA, 19 nt, Homo sapiens
ucuccaagcucaauucucu

SEQ ID NO: 557536 - RNA, 19 nt, Homo sapiens
gugaauguucugugucuuu

SEQ ID NO: 557537 - RNA, 19 nt, Homo sapiens
gcacuugcugcuauuucua

SEQ ID NO: 557538 - RNA, 19 nt, Homo sapiens
ggacccaguucugaccuau

SEQ ID NO: 557539 - RNA, 19 nt, Homo sapiens
gcugcuauuucuagacaug

SEQ ID NO: 557540 - RNA, 19 nt, Homo sapiens
gcacagcaagugucucaag

SEQ ID NO: 557541 - RNA, 19 nt, Homo sapiens
gugcaaggcggacuacgaa

SEQ ID NO: 557542 - RNA, 19 nt, Homo sapiens
ucagauccuuugggaagaa

SEQ ID NO: 557543 - RNA, 19 nt, Homo sapiens
gaaucucgagcuaccuauu

SEQ ID NO: 557544 - RNA, 19 nt, Homo sapiens
caugaaaugucaccuugcu

SEQ ID NO: 557545 - RNA, 19 nt, Homo sapiens
caagcucaauucucuaagc

SEQ ID NO: 557546 - RNA, 19 nt, Homo sapiens
cgagcuaccuauugguucu

SEQ ID NO: 557547 - RNA, 19 nt, Homo sapiens
cugaagagcgcuuacaaca

SEQ ID NO: 557548 - RNA, 19 nt, Homo sapiens
ggacaaggacagcguucag

SEQ ID NO: 557549 - RNA, 19 nt, Homo sapiens
gcuccaagucggacaagga

SEQ ID NO: 557550 - RNA, 19 nt, Homo sapiens
gggcaguauuuccgcaaca

SEQ ID NO: 557551 - RNA, 19 nt, Homo sapiens
gcaaggcggacuacgaaac

SEQ ID NO: 557552 - RNA, 19 nt, Homo sapiens
ggugaucagcucuuuccaa

SEQ ID NO: 557553 - RNA, 19 nt, Homo sapiens
gguagaccacgcucaguuc

SEQ ID NO: 557554 - RNA, 19 nt, Homo sapiens
ccuauugguucugugaaug

SEQ ID NO: 557555 - RNA, 19 nt, Homo sapiens
ucaaagucacucccgcaaa

SEQ ID NO: 557556 - RNA, 19 nt, Homo sapiens
uuacugcaaggacgacuuu

SEQ ID NO: 557557 - RNA, 19 nt, Homo sapiens
caguauuuccgcaacauga

SEQ ID NO: 557558 - RNA, 19 nt, Homo sapiens
cacagcaagugucucaagu

SEQ ID NO: 557559 - RNA, 19 nt, Homo sapiens
gcgacgaguucuaccucau

SEQ ID NO: 557560 - RNA, 19 nt, Homo sapiens
aaaacgcuuucaucucuaa

SEQ ID NO: 557561 - RNA, 19 nt, Homo sapiens
aagcaaauuucuccccuuu

SEQ ID NO: 557562 - RNA, 19 nt, Homo sapiens
cgacgaguucuaccucaug

SEQ ID NO: 557563 - RNA, 19 nt, Homo sapiens
aggagaagaggcugaagaa

SEQ ID NO: 557564 - RNA, 19 nt, Homo sapiens
ccaaggagaagaggcugaa

SEQ ID NO: 557565 - RNA, 19 nt, Homo sapiens
uggcaggcccagagcagua

SEQ ID NO: 557566 - RNA, 19 nt, Homo sapiens
gcaguauuuccgcaacaug

SEQ ID NO: 557567 - RNA, 19 nt, Homo sapiens
uccaagcucaauucucuaa

SEQ ID NO: 557568 - RNA, 19 nt, Homo sapiens
gucucuagaucauucuguu

SEQ ID NO: 557569 - RNA, 19 nt, Homo sapiens
ggagaagcuuuccccaauc

SEQ ID NO: 557570 - RNA, 19 nt, Homo sapiens
auaauugugcuuucacuuc

SEQ ID NO: 557571 - RNA, 19 nt, Homo sapiens
ccacgggcgacgaguucua

SEQ ID NO: 557572 - RNA, 19 nt, Homo sapiens
uguaccaccugcacugcuu

SEQ ID NO: 557573 - RNA, 19 nt, Homo sapiens
gauccuuugggaagaaguu

SEQ ID NO: 557574 - RNA, 19 nt, Homo sapiens
aucauucuguucucgagua

SEQ ID NO: 557575 - RNA, 19 nt, Homo sapiens
cuaccuauugguucuguga

SEQ ID NO: 557576 - RNA, 19 nt, Homo sapiens
aaucucgagcuaccuauug

SEQ ID NO: 557577 - RNA, 19 nt, Homo sapiens
acagccggcucgugugcaa

SEQ ID NO: 557578 - RNA, 19 nt, Homo sapiens
guagaacucuccucaauuu

SEQ ID NO: 557579 - RNA, 19 nt, Homo sapiens
gaacgaagauccgauguau

SEQ ID NO: 557580 - RNA, 19 nt, Homo sapiens
gaagaagacgguacaauuu

SEQ ID NO: 557581 - RNA, 19 nt, Homo sapiens
gaaccagccuuuauugaug

SEQ ID NO: 557582 - RNA, 19 nt, Homo sapiens
ccacaaagauccucacguu

SEQ ID NO: 557583 - RNA, 19 nt, Homo sapiens
caacuaccauguuucuuaa

SEQ ID NO: 557584 - RNA, 19 nt, Homo sapiens
cgaagucucuuguaauuau

SEQ ID NO: 557585 - RNA, 19 nt, Homo sapiens
caaccacccuuuccacuuu

SEQ ID NO: 557586 - RNA, 19 nt, Homo sapiens
ucagaacucucagaacuua

SEQ ID NO: 557587 - RNA, 19 nt, Homo sapiens
uaaaggcucuuaugguuga

SEQ ID NO: 557588 - RNA, 19 nt, Homo sapiens
ggaguuacguucccagcua

SEQ ID NO: 557589 - RNA, 19 nt, Homo sapiens
gaaguauguucaagagauu

SEQ ID NO: 557590 - RNA, 19 nt, Homo sapiens
ggaaugaaacuacuuacaa

SEQ ID NO: 557591 - RNA, 19 nt, Homo sapiens
gaaguaagcaacguauuaa

SEQ ID NO: 557592 - RNA, 19 nt, Homo sapiens
ggaaagaaaaccugaauua

SEQ ID NO: 557593 - RNA, 19 nt, Homo sapiens
caaauacaauggucaguuc

SEQ ID NO: 557594 - RNA, 19 nt, Homo sapiens
gauggaggcccuuuccuua

SEQ ID NO: 557595 - RNA, 19 nt, Homo sapiens
ugaaguaagcaacguauua

SEQ ID NO: 557596 - RNA, 19 nt, Homo sapiens
ggcaugacauuucagagua

SEQ ID NO: 557597 - RNA, 19 nt, Homo sapiens
cauccagucucuuaacuaa

SEQ ID NO: 557598 - RNA, 19 nt, Homo sapiens
ggacagaugaauuuaagaa

SEQ ID NO: 557599 - RNA, 19 nt, Homo sapiens
gcacuggaccuaaggauug

SEQ ID NO: 557600 - RNA, 19 nt, Homo sapiens
uaaauaagggucauccuaa

SEQ ID NO: 557601 - RNA, 19 nt, Homo sapiens
gaacucuccucaauuuaca

SEQ ID NO: 557602 - RNA, 19 nt, Homo sapiens
gagcagcugucuucucuca

SEQ ID NO: 557603 - RNA, 19 nt, Homo sapiens
gaaugaaacuacuuacaac

SEQ ID NO: 557604 - RNA, 19 nt, Homo sapiens
cuacagaugcugcaaagua

SEQ ID NO: 557605 - RNA, 19 nt, Homo sapiens
uaacuaaccaccaacauga

SEQ ID NO: 557606 - RNA, 19 nt, Homo sapiens
gaacaaaggcagcagucaa

SEQ ID NO: 557607 - RNA, 19 nt, Homo sapiens
gucaacagguucaaauauu

SEQ ID NO: 557608 - RNA, 19 nt, Homo sapiens
ucucagaacuuaaugugaa

SEQ ID NO: 557609 - RNA, 19 nt, Homo sapiens
gaugggaccucucauugau

SEQ ID NO: 557610 - RNA, 19 nt, Homo sapiens
gauccuaacugguggaaag

SEQ ID NO: 557611 - RNA, 19 nt, Homo sapiens
gcagucaucugguguuucu

SEQ ID NO: 557612 - RNA, 19 nt, Homo sapiens
uacagaaucagccauauua

SEQ ID NO: 557613 - RNA, 19 nt, Homo sapiens
ugaaacccaucaaggcaua

SEQ ID NO: 557614 - RNA, 19 nt, Homo sapiens
gcaaccagcgagaugaaua

SEQ ID NO: 557615 - RNA, 19 nt, Homo sapiens
cagaaucagccauauuaua

SEQ ID NO: 557616 - RNA, 19 nt, Homo sapiens
gcuggaagauauugauaga

SEQ ID NO: 557617 - RNA, 19 nt, Homo sapiens
ugaauggacagaugaauuu

SEQ ID NO: 557618 - RNA, 19 nt, Homo sapiens
uaagggucauccuaaagua

SEQ ID NO: 557619 - RNA, 19 nt, Homo sapiens
ugucuucggucuauuauga

SEQ ID NO: 557620 - RNA, 19 nt, Homo sapiens
ucuaaucccuugcuaguau

SEQ ID NO: 557621 - RNA, 19 nt, Homo sapiens
uaaguacgaucacauucuu

SEQ ID NO: 557622 - RNA, 19 nt, Homo sapiens
acaacuaccauguuucuua

SEQ ID NO: 557623 - RNA, 19 nt, Homo sapiens
gugccaaacuauaacuuaa

SEQ ID NO: 557624 - RNA, 19 nt, Homo sapiens
aaauaagggucauccuaaa

SEQ ID NO: 557625 - RNA, 19 nt, Homo sapiens
uggaggcccuuuccuuaua

SEQ ID NO: 557626 - RNA, 19 nt, Homo sapiens
gaaagcaaccagcgagaug

SEQ ID NO: 557627 - RNA, 19 nt, Homo sapiens
gaagagugaaccacaaaga

SEQ ID NO: 557628 - RNA, 19 nt, Homo sapiens
guguuucaguuucacauua

SEQ ID NO: 557629 - RNA, 19 nt, Homo sapiens
uuucuaagcuguauacugu

SEQ ID NO: 557630 - RNA, 19 nt, Homo sapiens
gcagggaacgcgcagauga

SEQ ID NO: 557631 - RNA, 19 nt, Homo sapiens
aagaagacgguacaauuua

SEQ ID NO: 557632 - RNA, 19 nt, Homo sapiens
agaaggcucugcuauagga

SEQ ID NO: 557633 - RNA, 19 nt, Homo sapiens
uaccagagcugcuucaucu

SEQ ID NO: 557634 - RNA, 19 nt, Homo sapiens
agaagaagacgguacaauu

SEQ ID NO: 557635 - RNA, 19 nt, Homo sapiens
gagcauguguaucaaacug

SEQ ID NO: 557636 - RNA, 19 nt, Homo sapiens
ucaacagguucaaauauuc

SEQ ID NO: 557637 - RNA, 19 nt, Homo sapiens
ggaaccagccuuuauugau

SEQ ID NO: 557638 - RNA, 19 nt, Homo sapiens
gaaaaguucgugcuauaua

SEQ ID NO: 557639 - RNA, 19 nt, Homo sapiens
gcaugacauuucagaguau

SEQ ID NO: 557640 - RNA, 19 nt, Homo sapiens
cagaaugcaggaccuaaua

SEQ ID NO: 557641 - RNA, 19 nt, Homo sapiens
ggaggcccuuuccuuauau

SEQ ID NO: 557642 - RNA, 19 nt, Homo sapiens
ggagaaauuauuacaguuc

SEQ ID NO: 557643 - RNA, 19 nt, Homo sapiens
uaagaaugauccacagcuu

SEQ ID NO: 557644 - RNA, 19 nt, Homo sapiens
uagaggcaauggauagaaa

SEQ ID NO: 557645 - RNA, 19 nt, Homo sapiens
auugugagcuaaagagaua

SEQ ID NO: 557646 - RNA, 19 nt, Homo sapiens
gaauggacagaugaauuua

SEQ ID NO: 557647 - RNA, 19 nt, Homo sapiens
agaaguauguucaagagau

SEQ ID NO: 557648 - RNA, 19 nt, Homo sapiens
gagaagagugaaccacaaa

SEQ ID NO: 557649 - RNA, 19 nt, Homo sapiens
gcagugacaccaaagauag

SEQ ID NO: 557650 - RNA, 19 nt, Homo sapiens
uaagcuguauacuguguuu

SEQ ID NO: 557651 - RNA, 19 nt, Homo sapiens
gugcaauuauagcaaauga

SEQ ID NO: 557652 - RNA, 19 nt, Homo sapiens
uuccauguaugcaaaguua

SEQ ID NO: 557653 - RNA, 19 nt, Homo sapiens
gauugucuucggucuauua

SEQ ID NO: 557654 - RNA, 19 nt, Homo sapiens
gauccgauguauuccaugu

SEQ ID NO: 557655 - RNA, 19 nt, Homo sapiens
ccaaguuaaugaacgaaga

SEQ ID NO: 557656 - RNA, 19 nt, Homo sapiens
auuaaaggcucuuaugguu

SEQ ID NO: 557657 - RNA, 19 nt, Homo sapiens
aagcacauccagucucuua

SEQ ID NO: 557658 - RNA, 19 nt, Homo sapiens
ggucaacagguucaaauau

SEQ ID NO: 557659 - RNA, 19 nt, Homo sapiens
gugaugauguucagguaga

SEQ ID NO: 557660 - RNA, 19 nt, Homo sapiens
caagagauuuugcuaguga

SEQ ID NO: 557661 - RNA, 19 nt, Homo sapiens
gaaaugauguugguuuacc

SEQ ID NO: 557662 - RNA, 19 nt, Homo sapiens
gcagaggaaugaaacuacu

SEQ ID NO: 557663 - RNA, 19 nt, Homo sapiens
cagcaaccauauucucaga

SEQ ID NO: 557664 - RNA, 19 nt, Homo sapiens
gccaaacuauaacuuaaca

SEQ ID NO: 557665 - RNA, 19 nt, Homo sapiens
ggcauaggguuauuuccuu

SEQ ID NO: 557666 - RNA, 19 nt, Homo sapiens
gaaggcgcauuauguuguc

SEQ ID NO: 557667 - RNA, 19 nt, Homo sapiens
uaaaugccacugacaaugu

SEQ ID NO: 557668 - RNA, 19 nt, Homo sapiens
cgaucaggauguugagaaa

SEQ ID NO: 557669 - RNA, 19 nt, Homo sapiens
caccaaagauagaggcaau

SEQ ID NO: 557670 - RNA, 19 nt, Homo sapiens
gugaucgugugaauauauu

SEQ ID NO: 557671 - RNA, 19 nt, Homo sapiens
ugagaagagugaaccacaa

SEQ ID NO: 557672 - RNA, 19 nt, Homo sapiens
ggugccaaacuauaacuua

SEQ ID NO: 557673 - RNA, 19 nt, Homo sapiens
gcugaaccagaaaugauua

SEQ ID NO: 557674 - RNA, 19 nt, Homo sapiens
ugaagcugcugaagacaau

SEQ ID NO: 557675 - RNA, 19 nt, Homo sapiens
cagagcugcuucaucuuga

SEQ ID NO: 557676 - RNA, 19 nt, Homo sapiens
gaagaagaagauuuagcaa

SEQ ID NO: 557677 - RNA, 19 nt, Homo sapiens
gcuguauacuguguuuauu

SEQ ID NO: 557678 - RNA, 19 nt, Homo sapiens
gcagaaaucuccuacauug

SEQ ID NO: 557679 - RNA, 19 nt, Homo sapiens
gcacacaccucuaguggaa

SEQ ID NO: 557680 - RNA, 19 nt, Homo sapiens
ggauaaacaucaugagaaa

SEQ ID NO: 557681 - RNA, 19 nt, Homo sapiens
caacaaggcucaggaguga

SEQ ID NO: 557682 - RNA, 19 nt, Homo sapiens
gcucaggaauggaaguuua

SEQ ID NO: 557683 - RNA, 19 nt, Homo sapiens
guaaccaacuggcaauuaa

SEQ ID NO: 557684 - RNA, 19 nt, Homo sapiens
gacgaggucucccauagua

SEQ ID NO: 557685 - RNA, 19 nt, Homo sapiens
gaaacucaaugcacaacaa

SEQ ID NO: 557686 - RNA, 19 nt, Homo sapiens
agaagaaacuguaaaggaa

SEQ ID NO: 557687 - RNA, 19 nt, Homo sapiens
ccaaggaacuaauuucuuc

SEQ ID NO: 557688 - RNA, 19 nt, Homo sapiens
guaaggcuuugauuaguuu

SEQ ID NO: 557689 - RNA, 19 nt, Homo sapiens
gaagaaacgcaacaagaaa

SEQ ID NO: 557690 - RNA, 19 nt, Homo sapiens
ggacaaacacaaacagaaa

SEQ ID NO: 557691 - RNA, 19 nt, Homo sapiens
gcacaacaaaggauuaauu

SEQ ID NO: 557692 - RNA, 19 nt, Homo sapiens
uaagagcccucauauagga

SEQ ID NO: 557693 - RNA, 19 nt, Homo sapiens
gcucacagcucaggucaaa

SEQ ID NO: 557694 - RNA, 19 nt, Homo sapiens
ggugacaguucuacacuaa

SEQ ID NO: 557695 - RNA, 19 nt, Homo sapiens
ggacuaggauuacuuucug

SEQ ID NO: 557696 - RNA, 19 nt, Homo sapiens
cgacaggcuuuccauguaa

SEQ ID NO: 557697 - RNA, 19 nt, Homo sapiens
uagcaagacuuagugauaa

SEQ ID NO: 557698 - RNA, 19 nt, Homo sapiens
gaucuaauaggucauauga

SEQ ID NO: 557699 - RNA, 19 nt, Homo sapiens
ggaagucucucgccacgau

SEQ ID NO: 557700 - RNA, 19 nt, Homo sapiens
guagcaagacuuagugaua

SEQ ID NO: 557701 - RNA, 19 nt, Homo sapiens
cagcaaugauguagcagua

SEQ ID NO: 557702 - RNA, 19 nt, Homo sapiens
gaauguuucucaucucuca

SEQ ID NO: 557703 - RNA, 19 nt, Homo sapiens
ggucauaugaucaaaguuu

SEQ ID NO: 557704 - RNA, 19 nt, Homo sapiens
cagcaacgacaaauacuua

SEQ ID NO: 557705 - RNA, 19 nt, Homo sapiens
uuacagagccucaguguug

SEQ ID NO: 557706 - RNA, 19 nt, Homo sapiens
uaacagcaaugauguagca

SEQ ID NO: 557707 - RNA, 19 nt, Homo sapiens
gcucuagucugcagaaauc

SEQ ID NO: 557708 - RNA, 19 nt, Homo sapiens
gaagaaacuguaaaggaaa

SEQ ID NO: 557709 - RNA, 19 nt, Homo sapiens
guaaagucaucuucuggaa

SEQ ID NO: 557710 - RNA, 19 nt, Homo sapiens
gccuguagcucaagagaaa

SEQ ID NO: 557711 - RNA, 19 nt, Homo sapiens
gaaugcagccuguaacuuc

SEQ ID NO: 557712 - RNA, 19 nt, Homo sapiens
ggcaauagaucaaauucau

SEQ ID NO: 557713 - RNA, 19 nt, Homo sapiens
cgacagaggugacaguucu

SEQ ID NO: 557714 - RNA, 19 nt, Homo sapiens
gcacagacugcuccuacua

SEQ ID NO: 557715 - RNA, 19 nt, Homo sapiens
gcaguaucguuuccaaaug

SEQ ID NO: 557716 - RNA, 19 nt, Homo sapiens
gcaaugauguagcaguauc

SEQ ID NO: 557717 - RNA, 19 nt, Homo sapiens
ccaaagauguacauaaagg

SEQ ID NO: 557718 - RNA, 19 nt, Homo sapiens
ucuaauaggucauaugauc

SEQ ID NO: 557719 - RNA, 19 nt, Homo sapiens
ccaguugguucagaaauuu

SEQ ID NO: 557720 - RNA, 19 nt, Homo sapiens
caaccaaagauguacauaa

SEQ ID NO: 557721 - RNA, 19 nt, Homo sapiens
agagugagaugugaacuuu

SEQ ID NO: 557722 - RNA, 19 nt, Homo sapiens
uaacagugccucaggacua

SEQ ID NO: 557723 - RNA, 19 nt, Homo sapiens
gcaguaagagcccucauau

SEQ ID NO: 557724 - RNA, 19 nt, Homo sapiens
guuccauccuugacuguua

SEQ ID NO: 557725 - RNA, 19 nt, Homo sapiens
gcagacuccugucacaaug

SEQ ID NO: 557726 - RNA, 19 nt, Homo sapiens
gcaaauacucuaucuggau

SEQ ID NO: 557727 - RNA, 19 nt, Homo sapiens
caacaacuacguucucaga

SEQ ID NO: 557728 - RNA, 19 nt, Homo sapiens
acucagaucugcguaauga

SEQ ID NO: 557729 - RNA, 19 nt, Homo sapiens
ggaguugcauugauucagu

SEQ ID NO: 557730 - RNA, 19 nt, Homo sapiens
ugaagaaacgcaacaagaa

SEQ ID NO: 557731 - RNA, 19 nt, Homo sapiens
gaacaggguacuccuagug

SEQ ID NO: 557732 - RNA, 19 nt, Homo sapiens
gcuuacagauucgcuauga

SEQ ID NO: 557733 - RNA, 19 nt, Homo sapiens
gcaauauguuuaucaacuc

SEQ ID NO: 557734 - RNA, 19 nt, Homo sapiens
gauacuacugcacgauuua

SEQ ID NO: 557735 - RNA, 19 nt, Homo sapiens
uugaagcgcuuggaagaua

SEQ ID NO: 557736 - RNA, 19 nt, Homo sapiens
aaaggaacggcuucaguua

SEQ ID NO: 557737 - RNA, 19 nt, Homo sapiens
ccaauacuguggcuacugu

SEQ ID NO: 557738 - RNA, 19 nt, Homo sapiens
ggaaauaaacaaaguaagc

SEQ ID NO: 557739 - RNA, 19 nt, Homo sapiens
gaguugcauugauucagua

SEQ ID NO: 557740 - RNA, 19 nt, Homo sapiens
uaaugcaagucagaaagua

SEQ ID NO: 557741 - RNA, 19 nt, Homo sapiens
gguaaccaacuggcaauua

SEQ ID NO: 557742 - RNA, 19 nt, Homo sapiens
ugauaauucucuuccugua

SEQ ID NO: 557743 - RNA, 19 nt, Homo sapiens
gaacggcuucaguuauuga

SEQ ID NO: 557744 - RNA, 19 nt, Homo sapiens
ggaacggcuucaguuauug

SEQ ID NO: 557745 - RNA, 19 nt, Homo sapiens
aggaacggcuucaguuauu

SEQ ID NO: 557746 - RNA, 19 nt, Homo sapiens
guucagaaauuuccaugca

SEQ ID NO: 557747 - RNA, 19 nt, Homo sapiens
ucgacaggcuuuccaugua

SEQ ID NO: 557748 - RNA, 19 nt, Homo sapiens
aguaagagcccucauauag

SEQ ID NO: 557749 - RNA, 19 nt, Homo sapiens
ggcaccaucucauauguau

SEQ ID NO: 557750 - RNA, 19 nt, Homo sapiens
ugacaguucuacacuaaca

SEQ ID NO: 557751 - RNA, 19 nt, Homo sapiens
ugauggagcuugcccaaca

SEQ ID NO: 557752 - RNA, 19 nt, Homo sapiens
ggaaaggaaauaaacaaag

SEQ ID NO: 557753 - RNA, 19 nt, Homo sapiens
cauagaagaagaaacugua

SEQ ID NO: 557754 - RNA, 19 nt, Homo sapiens
gagaaacaucuagaaauug

SEQ ID NO: 557755 - RNA, 19 nt, Homo sapiens
ggagauaaugcaagucaga

SEQ ID NO: 557756 - RNA, 19 nt, Homo sapiens
acacaaccguaccaccuaa

SEQ ID NO: 557757 - RNA, 19 nt, Homo sapiens
gcaguggguggaauaauug

SEQ ID NO: 557758 - RNA, 19 nt, Homo sapiens
ggagcuugcccaacaacua

SEQ ID NO: 557759 - RNA, 19 nt, Homo sapiens
ucaccaacaucaucuguag

SEQ ID NO: 557760 - RNA, 19 nt, Homo sapiens
gaaaagaaaaggaaaggaa

SEQ ID NO: 557761 - RNA, 19 nt, Homo sapiens
gcacuagcaacaacucuau

SEQ ID NO: 557762 - RNA, 19 nt, Homo sapiens
gaacaaggaagagaaagca

SEQ ID NO: 557763 - RNA, 19 nt, Homo sapiens
gagagcagccagagugaga

SEQ ID NO: 557764 - RNA, 19 nt, Homo sapiens
ggcucaaacuucuggcaua

SEQ ID NO: 557765 - RNA, 19 nt, Homo sapiens
gauauaagcgggcucaaac

SEQ ID NO: 557766 - RNA, 19 nt, Homo sapiens
guaauggugccgauaaugu

SEQ ID NO: 557767 - RNA, 19 nt, Homo sapiens
gaugaacaaggaagagaaa

SEQ ID NO: 557768 - RNA, 19 nt, Homo sapiens
ccgcaugaucguuauaaua

SEQ ID NO: 557769 - RNA, 19 nt, Homo sapiens
caacaaaggauuaauugcu

SEQ ID NO: 557770 - RNA, 19 nt, Homo sapiens
uggaauaauuggagcuuug

SEQ ID NO: 557771 - RNA, 19 nt, Homo sapiens
gccuguaacuuccaccauu

SEQ ID NO: 557772 - RNA, 19 nt, Homo sapiens
gcuauggcauuguucaagu

SEQ ID NO: 557773 - RNA, 19 nt, Homo sapiens
ugauguagcaguaucguuu

SEQ ID NO: 557774 - RNA, 19 nt, Homo sapiens
gcaggaagcauaacaagcu

SEQ ID NO: 557775 - RNA, 19 nt, Homo sapiens
uguaaggcuuugauuaguu

SEQ ID NO: 557776 - RNA, 19 nt, Homo sapiens
ugcaguggguggaauaauu

SEQ ID NO: 557777 - RNA, 19 nt, Homo sapiens
ccuaguccgucucaucaaa

SEQ ID NO: 557778 - RNA, 19 nt, Homo sapiens
gaacuuggcuggaacguuu

SEQ ID NO: 557779 - RNA, 19 nt, Homo sapiens
ggaaccaucucucacauua

SEQ ID NO: 557780 - RNA, 19 nt, Homo sapiens
uaacagcaauucaccauua

SEQ ID NO: 557781 - RNA, 19 nt, Homo sapiens
agaauaagcugaacuugua

SEQ ID NO: 557782 - RNA, 19 nt, Homo sapiens
gaacuauaccuacgauuua

SEQ ID NO: 557783 - RNA, 19 nt, Homo sapiens
gcauacagcugcaauuuga

SEQ ID NO: 557784 - RNA, 19 nt, Homo sapiens
gcacgugucucccggguua

SEQ ID NO: 557785 - RNA, 19 nt, Homo sapiens
caggagagguuauguauuu

SEQ ID NO: 557786 - RNA, 19 nt, Homo sapiens
ggagacagcauguuuauaa

SEQ ID NO: 557787 - RNA, 19 nt, Homo sapiens
caaaucaggucuucauaaa

SEQ ID NO: 557788 - RNA, 19 nt, Homo sapiens
gauaugcacugucuguaua

SEQ ID NO: 557789 - RNA, 19 nt, Homo sapiens
gaacuucacugacuuugau

SEQ ID NO: 557790 - RNA, 19 nt, Homo sapiens
gaccaaggcuuccauauca

SEQ ID NO: 557791 - RNA, 19 nt, Homo sapiens
gaaaugagcuagcaauucg

SEQ ID NO: 557792 - RNA, 19 nt, Homo sapiens
gaacaugucuuuaccuuuu

SEQ ID NO: 557793 - RNA, 19 nt, Homo sapiens
ggacaauacuguggaaauu

SEQ ID NO: 557794 - RNA, 19 nt, Homo sapiens
gcaaggcaauggauauauu

SEQ ID NO: 557795 - RNA, 19 nt, Homo sapiens
ggaguuugcuuaccuuauu

SEQ ID NO: 557796 - RNA, 19 nt, Homo sapiens
gugaagagcagcaauaaua

SEQ ID NO: 557797 - RNA, 19 nt, Homo sapiens
ggaaacagccucuucuuga

SEQ ID NO: 557798 - RNA, 19 nt, Homo sapiens
gaucauaauugcaccugua

SEQ ID NO: 557799 - RNA, 19 nt, Homo sapiens
gaaaugguccugauaucua

SEQ ID NO: 557800 - RNA, 19 nt, Homo sapiens
caaccuccauuaaaucaua

SEQ ID NO: 557801 - RNA, 19 nt, Homo sapiens
acaaucaucucucauagua

SEQ ID NO: 557802 - RNA, 19 nt, Homo sapiens
guacagacauaccuucauu

SEQ ID NO: 557803 - RNA, 19 nt, Homo sapiens
caacaaagauuaccuugag

SEQ ID NO: 557804 - RNA, 19 nt, Homo sapiens
gcaaagugguguuguugaa

SEQ ID NO: 557805 - RNA, 19 nt, Homo sapiens
ggacauagaagaaauacaa

SEQ ID NO: 557806 - RNA, 19 nt, Homo sapiens
gaaaucaucuggacuucau

SEQ ID NO: 557807 - RNA, 19 nt, Homo sapiens
gaacagccuuuccagauuc

SEQ ID NO: 557808 - RNA, 19 nt, Homo sapiens
gaagauauuuggcaaugau

SEQ ID NO: 557809 - RNA, 19 nt, Homo sapiens
gcacgugacuuuguagaaa

SEQ ID NO: 557810 - RNA, 19 nt, Homo sapiens
ggugaaaccuuacuuggaa

SEQ ID NO: 557811 - RNA, 19 nt, Homo sapiens
ccucaucccucuaacaaua

SEQ ID NO: 557812 - RNA, 19 nt, Homo sapiens
gcaaggauguggugguuau

SEQ ID NO: 557813 - RNA, 19 nt, Homo sapiens
ucaaaccuauggcaucuua

SEQ ID NO: 557814 - RNA, 19 nt, Homo sapiens
gcgaagauaucaaugaaug

SEQ ID NO: 557815 - RNA, 19 nt, Homo sapiens
uagauuaccuggcuguaua

SEQ ID NO: 557816 - RNA, 19 nt, Homo sapiens
gagaggaaauuugguguuu

SEQ ID NO: 557817 - RNA, 19 nt, Homo sapiens
caacaugaauugcaccuau

SEQ ID NO: 557818 - RNA, 19 nt, Homo sapiens
gaagggagcagcuggcuaa

SEQ ID NO: 557819 - RNA, 19 nt, Homo sapiens
ggauauauuugcgaagaua

SEQ ID NO: 557820 - RNA, 19 nt, Homo sapiens
caaccacccucauaauuau

SEQ ID NO: 557821 - RNA, 19 nt, Homo sapiens
gagcugcgguggauauuug

SEQ ID NO: 557822 - RNA, 19 nt, Homo sapiens
ggaaagguccugcguauca

SEQ ID NO: 557823 - RNA, 19 nt, Homo sapiens
guacuugggucauugauuc

SEQ ID NO: 557824 - RNA, 19 nt, Homo sapiens
gagaaacuguguaguagug

SEQ ID NO: 557825 - RNA, 19 nt, Homo sapiens
gaacguacaaugcaacuug

SEQ ID NO: 557826 - RNA, 19 nt, Homo sapiens
caccaucacucucacauuu

SEQ ID NO: 557827 - RNA, 19 nt, Homo sapiens
ccaaccacccucauaauua

SEQ ID NO: 557828 - RNA, 19 nt, Homo sapiens
gauacgagauggagauaau

SEQ ID NO: 557829 - RNA, 19 nt, Homo sapiens
caacuguacuuggcauaua

SEQ ID NO: 557830 - RNA, 19 nt, Homo sapiens
gcagcagacuguugacaaa

SEQ ID NO: 557831 - RNA, 19 nt, Homo sapiens
agucaaaucuaucagcuua

SEQ ID NO: 557832 - RNA, 19 nt, Homo sapiens
gagcucaaguucagugauu

SEQ ID NO: 557833 - RNA, 19 nt, Homo sapiens
ggauucggaugcaccaaua

SEQ ID NO: 557834 - RNA, 19 nt, Homo sapiens
gaaguaacacccaacugua

SEQ ID NO: 557835 - RNA, 19 nt, Homo sapiens
caaaguggccugaccauug

SEQ ID NO: 557836 - RNA, 19 nt, Homo sapiens
uuucaaaucuggaguugua

SEQ ID NO: 557837 - RNA, 19 nt, Homo sapiens
caaaugauaugcacugucu

SEQ ID NO: 557838 - RNA, 19 nt, Homo sapiens
caaacugcacuuuagauua

SEQ ID NO: 557839 - RNA, 19 nt, Homo sapiens
agacaucccuuggaagaua

SEQ ID NO: 557840 - RNA, 19 nt, Homo sapiens
aacagaaacucuagaauga

SEQ ID NO: 557841 - RNA, 19 nt, Homo sapiens
ggagauccgugaaggaaau

SEQ ID NO: 557842 - RNA, 19 nt, Homo sapiens
gcaaaaggcuggaagaugu

SEQ ID NO: 557843 - RNA, 19 nt, Homo sapiens
ugacagauaucaucguguu

SEQ ID NO: 557844 - RNA, 19 nt, Homo sapiens
gagacagcauguuuauaaa

SEQ ID NO: 557845 - RNA, 19 nt, Homo sapiens
gaacuggaauucaaagacu

SEQ ID NO: 557846 - RNA, 19 nt, Homo sapiens
ggugucaacuguacagaaa

SEQ ID NO: 557847 - RNA, 19 nt, Homo sapiens
caacagagacuaucacaag

SEQ ID NO: 557848 - RNA, 19 nt, Homo sapiens
caucagugacuuaacauua

SEQ ID NO: 557849 - RNA, 19 nt, Homo sapiens
caacaaugagcaugugaua

SEQ ID NO: 557850 - RNA, 19 nt, Homo sapiens
gcaaggacguggcuucaag

SEQ ID NO: 557851 - RNA, 19 nt, Homo sapiens
caccaagacugucaauuug

SEQ ID NO: 557852 - RNA, 19 nt, Homo sapiens
ucaccaagacugucaauuu

SEQ ID NO: 557853 - RNA, 19 nt, Homo sapiens
caccaauacuuuccaaauu

SEQ ID NO: 557854 - RNA, 19 nt, Homo sapiens
guucauaucucccaacuac

SEQ ID NO: 557855 - RNA, 19 nt, Homo sapiens
gauugugucuggauuguug

SEQ ID NO: 557856 - RNA, 19 nt, Homo sapiens
gaaugaguuucaccuauca

SEQ ID NO: 557857 - RNA, 19 nt, Homo sapiens
gaguuugcuuaccuuauua

SEQ ID NO: 557858 - RNA, 19 nt, Homo sapiens
cugacaggcucgaauaaua

SEQ ID NO: 557859 - RNA, 19 nt, Homo sapiens
ggaucacccuaauguuuaa

SEQ ID NO: 557860 - RNA, 19 nt, Homo sapiens
gaaacagccucuucuugag

SEQ ID NO: 557861 - RNA, 19 nt, Homo sapiens
caacaaucaucucucauag

SEQ ID NO: 557862 - RNA, 19 nt, Homo sapiens
ggagauuccucuucugcuu

SEQ ID NO: 557863 - RNA, 19 nt, Homo sapiens
gagaucagcuuugacaaca

SEQ ID NO: 557864 - RNA, 19 nt, Homo sapiens
ggacggccauuacucacaa

SEQ ID NO: 557865 - RNA, 19 nt, Homo sapiens
ccaacuauccaaaugcuua

SEQ ID NO: 557866 - RNA, 19 nt, Homo sapiens
ccaauuauccaaacaauca

SEQ ID NO: 557867 - RNA, 19 nt, Homo sapiens
cagaauagcccaacugugu

SEQ ID NO: 557868 - RNA, 19 nt, Homo sapiens
cagaugcagugguuuguuu

SEQ ID NO: 557869 - RNA, 19 nt, Homo sapiens
ggucuggauucucagcuua

SEQ ID NO: 557870 - RNA, 19 nt, Homo sapiens
ccaacaaucaucucucaua

SEQ ID NO: 557871 - RNA, 19 nt, Homo sapiens
gagacuguguccagaacua

SEQ ID NO: 557872 - RNA, 19 nt, Homo sapiens
gcagacuacccaaaugaua

SEQ ID NO: 557873 - RNA, 19 nt, Homo sapiens
gaacugaggagguggacaa

SEQ ID NO: 557874 - RNA, 19 nt, Homo sapiens
ggagauggacauagaagaa

SEQ ID NO: 557875 - RNA, 19 nt, Homo sapiens
gcagugcacuucacaaacu

SEQ ID NO: 557876 - RNA, 19 nt, Homo sapiens
guauugcgguacagacaua

SEQ ID NO: 557877 - RNA, 19 nt, Homo sapiens
uaacguguauccuggagaa

SEQ ID NO: 557878 - RNA, 19 nt, Homo sapiens
aaacagaggucccaaagua

SEQ ID NO: 557879 - RNA, 19 nt, Homo sapiens
gagcuggaaugucuuauua

SEQ ID NO: 557880 - RNA, 19 nt, Homo sapiens
ccacauaaauggauggaua

SEQ ID NO: 557881 - RNA, 19 nt, Homo sapiens
gaacaagaagcacuaguua

SEQ ID NO: 557882 - RNA, 19 nt, Homo sapiens
gaagaagaauuccucacua

SEQ ID NO: 557883 - RNA, 19 nt, Homo sapiens
gaaagaaacccuugcugua

SEQ ID NO: 557884 - RNA, 19 nt, Homo sapiens
cuaaugagcucuccagaaa

SEQ ID NO: 557885 - RNA, 19 nt, Homo sapiens
uaacaugagucgauaaaug

SEQ ID NO: 557886 - RNA, 19 nt, Homo sapiens
caacaguccugacaaauuc

SEQ ID NO: 557887 - RNA, 19 nt, Homo sapiens
gaacagaaaguuagaugaa

SEQ ID NO: 557888 - RNA, 19 nt, Homo sapiens
aaaggaaaguagcacauua

SEQ ID NO: 557889 - RNA, 19 nt, Homo sapiens
ucaacaaacugaugaagaa

SEQ ID NO: 557890 - RNA, 19 nt, Homo sapiens
gggagaagauugaccuuga

SEQ ID NO: 557891 - RNA, 19 nt, Homo sapiens
ggaggaacgucacaugaga

SEQ ID NO: 557892 - RNA, 19 nt, Homo sapiens
gaagaauuccucacuaaug

SEQ ID NO: 557893 - RNA, 19 nt, Homo sapiens
gaaaguagcacauuagcau

SEQ ID NO: 557894 - RNA, 19 nt, Homo sapiens
gcaacaguccugacaaauu

SEQ ID NO: 557895 - RNA, 19 nt, Homo sapiens
gcacuacaauucagaccuu

SEQ ID NO: 557896 - RNA, 19 nt, Homo sapiens
agauagagcuggagaccua

SEQ ID NO: 557897 - RNA, 19 nt, Homo sapiens
ucuaauagccaacucuuua

SEQ ID NO: 557898 - RNA, 19 nt, Homo sapiens
ugacaaccaucucuaauag

SEQ ID NO: 557899 - RNA, 19 nt, Homo sapiens
gaacaaggugcugaagaua

SEQ ID NO: 557900 - RNA, 19 nt, Homo sapiens
gcaggaagaagaauucauu

SEQ ID NO: 557901 - RNA, 19 nt, Homo sapiens
gcaaguguacaaagaagua

SEQ ID NO: 557902 - RNA, 19 nt, Homo sapiens
ggagaagauugaccuugaa

SEQ ID NO: 557903 - RNA, 19 nt, Homo sapiens
aagaagaauuccucacuaa

SEQ ID NO: 557904 - RNA, 19 nt, Homo sapiens
aagaauuccucacuaauga

SEQ ID NO: 557905 - RNA, 19 nt, Homo sapiens
gcuggaaccuucgcuguuu

SEQ ID NO: 557906 - RNA, 19 nt, Homo sapiens
gaaggcagugugauuguaa

SEQ ID NO: 557907 - RNA, 19 nt, Homo sapiens
uauaucaccuggucuauca

SEQ ID NO: 557908 - RNA, 19 nt, Homo sapiens
ugagaugucugcacaagga

SEQ ID NO: 557909 - RNA, 19 nt, Homo sapiens
guauagaaaccuccgauuu

SEQ ID NO: 557910 - RNA, 19 nt, Homo sapiens
gaacuagaacagcaucuug

SEQ ID NO: 557911 - RNA, 19 nt, Homo sapiens
ggaagaagaauucauuagu

SEQ ID NO: 557912 - RNA, 19 nt, Homo sapiens
cagcagcagugugcaauuu

SEQ ID NO: 557913 - RNA, 19 nt, Homo sapiens
gacuagagcuggaaugucu

SEQ ID NO: 557914 - RNA, 19 nt, Homo sapiens
caacuuacauuagaacagu

SEQ ID NO: 557915 - RNA, 19 nt, Homo sapiens
ugagaaaggcgaacuagaa

SEQ ID NO: 557916 - RNA, 19 nt, Homo sapiens
aaagaaacccuugcuguaa

SEQ ID NO: 557917 - RNA, 19 nt, Homo sapiens
aagaaacccuugcuguaaa

SEQ ID NO: 557918 - RNA, 19 nt, Homo sapiens
ccaugacgauuguagauau

SEQ ID NO: 557919 - RNA, 19 nt, Homo sapiens
cuucauuuguguucucuua

SEQ ID NO: 557920 - RNA, 19 nt, Homo sapiens
acaagaauguguaucuguu

SEQ ID NO: 557921 - RNA, 19 nt, Homo sapiens
ugagaaagaagaagaauuc

SEQ ID NO: 557922 - RNA, 19 nt, Homo sapiens
gugacaaccaucucuaaua

SEQ ID NO: 557923 - RNA, 19 nt, Homo sapiens
ggauggauaauuacguaua

SEQ ID NO: 557924 - RNA, 19 nt, Homo sapiens
acaaggugcugaagauaga

SEQ ID NO: 557925 - RNA, 19 nt, Homo sapiens
gcagaaggcagugugauug

SEQ ID NO: 557926 - RNA, 19 nt, Homo sapiens
aaaucuggcuuucagugua

SEQ ID NO: 557927 - RNA, 19 nt, Homo sapiens
caauggagccgucuacuca

SEQ ID NO: 557928 - RNA, 19 nt, Homo sapiens
uaaggaaccaugacgauug

SEQ ID NO: 557929 - RNA, 19 nt, Homo sapiens
ugguuucaauggcuaauua

SEQ ID NO: 557930 - RNA, 19 nt, Homo sapiens
gucgauaaauguuguccua

SEQ ID NO: 557931 - RNA, 19 nt, Homo sapiens
acacuaaccagacgacuuu

SEQ ID NO: 557932 - RNA, 19 nt, Homo sapiens
gcuggaaugucuuauuaca

SEQ ID NO: 557933 - RNA, 19 nt, Homo sapiens
gaacgucacaugagagaag

SEQ ID NO: 557934 - RNA, 19 nt, Homo sapiens
gaaaauacauuggaacaag

SEQ ID NO: 557935 - RNA, 19 nt, Homo sapiens
aagcaacaguccugacaaa

SEQ ID NO: 557936 - RNA, 19 nt, Homo sapiens
ccaccaacuucacugacua

SEQ ID NO: 557937 - RNA, 19 nt, Homo sapiens
agaacaaggugcugaagau

SEQ ID NO: 557938 - RNA, 19 nt, Homo sapiens
gaaaauaaggucuaaagga

SEQ ID NO: 557939 - RNA, 19 nt, Homo sapiens
gggcugagcaggaagaaga

SEQ ID NO: 557940 - RNA, 19 nt, Homo sapiens
aaucagugcccaagacaua

SEQ ID NO: 557941 - RNA, 19 nt, Homo sapiens
gaugucugcacaaggauua

SEQ ID NO: 557942 - RNA, 19 nt, Homo sapiens
gaaguggaacggcugaaga

SEQ ID NO: 557943 - RNA, 19 nt, Homo sapiens
caccuguguuugcauauuu

SEQ ID NO: 557944 - RNA, 19 nt, Homo sapiens
gauaaauguuguccuacuc

SEQ ID NO: 557945 - RNA, 19 nt, Homo sapiens
gaaccuucgcuguuuggua

SEQ ID NO: 557946 - RNA, 19 nt, Homo sapiens
acaagaagcacuaguuaau

SEQ ID NO: 557947 - RNA, 19 nt, Homo sapiens
auaagcaaguguacaaaga

SEQ ID NO: 557948 - RNA, 19 nt, Homo sapiens
ccucuaacaugagucgaua

SEQ ID NO: 557949 - RNA, 19 nt, Homo sapiens
gagagugaguccagcuuag

SEQ ID NO: 557950 - RNA, 19 nt, Homo sapiens
gaggaggaacgucacauga

SEQ ID NO: 557951 - RNA, 19 nt, Homo sapiens
ggaacaagaacaagaagca

SEQ ID NO: 557952 - RNA, 19 nt, Homo sapiens
gacauuaucgcauuaucuu

SEQ ID NO: 557953 - RNA, 19 nt, Homo sapiens
uuccuucucuggcauauuu

SEQ ID NO: 557954 - RNA, 19 nt, Homo sapiens
ccuacaaacugaagugcaa

SEQ ID NO: 557955 - RNA, 19 nt, Homo sapiens
gagaagauugaccuugaaa

SEQ ID NO: 557956 - RNA, 19 nt, Homo sapiens
gaacaagagcaggaauuuc

SEQ ID NO: 557957 - RNA, 19 nt, Homo sapiens
cuggagaccuacaaacuga

SEQ ID NO: 557958 - RNA, 19 nt, Homo sapiens
acagaaaguuagaugaauc

SEQ ID NO: 557959 - RNA, 19 nt, Homo sapiens
gacgaaagguauuuuaaug

SEQ ID NO: 557960 - RNA, 19 nt, Homo sapiens
guuacagcauucagagaaa

SEQ ID NO: 557961 - RNA, 19 nt, Homo sapiens
ucaagaaaauucaggcuuu

SEQ ID NO: 557962 - RNA, 19 nt, Homo sapiens
ggaauuucaggucaacaaa

SEQ ID NO: 557963 - RNA, 19 nt, Homo sapiens
gaaccaugacgauuguaga

SEQ ID NO: 557964 - RNA, 19 nt, Homo sapiens
caagucacacgguugguuu

SEQ ID NO: 557965 - RNA, 19 nt, Homo sapiens
aaccuucgcuguuugguau

SEQ ID NO: 557966 - RNA, 19 nt, Homo sapiens
uaucuaggcuucacuaucc

SEQ ID NO: 557967 - RNA, 19 nt, Homo sapiens
gagaacaaggugcugaaga

SEQ ID NO: 557968 - RNA, 19 nt, Homo sapiens
gaaaggcgaacuagaacag

SEQ ID NO: 557969 - RNA, 19 nt, Homo sapiens
gcaguugcagcaugagaaa

SEQ ID NO: 557970 - RNA, 19 nt, Homo sapiens
cgaaugcaguauuuaagag

SEQ ID NO: 557971 - RNA, 19 nt, Homo sapiens
uauauaugcuguggaugaa

SEQ ID NO: 557972 - RNA, 19 nt, Homo sapiens
agaaggcagugugauugua

SEQ ID NO: 557973 - RNA, 19 nt, Homo sapiens
caggaagaagaauucauua

SEQ ID NO: 557974 - RNA, 19 nt, Homo sapiens
cacuauccauuguguugua

SEQ ID NO: 557975 - RNA, 19 nt, Homo sapiens
ggaaaaggauggauaagcu

SEQ ID NO: 557976 - RNA, 19 nt, Homo sapiens
ugaacaagagcaggaauuu

SEQ ID NO: 557977 - RNA, 19 nt, Homo sapiens
caugacgauuguagauauu

SEQ ID NO: 557978 - RNA, 19 nt, Homo sapiens
gaaggacucaguauuauuu

SEQ ID NO: 557979 - RNA, 19 nt, Homo sapiens
ccaauuagcuuaguucuuc

SEQ ID NO: 557980 - RNA, 19 nt, Homo sapiens
aaacaaagaucuagccaau

SEQ ID NO: 557981 - RNA, 19 nt, Homo sapiens
caaagugagucaucagauu

SEQ ID NO: 557982 - RNA, 19 nt, Homo sapiens
ccacguuaguucuacauua

SEQ ID NO: 557983 - RNA, 19 nt, Homo sapiens
gcagugaggagaaugaaua

SEQ ID NO: 557984 - RNA, 19 nt, Homo sapiens
gagaagugguuauaucgaa

SEQ ID NO: 557985 - RNA, 19 nt, Homo sapiens
ggaagugccugguacugaa

SEQ ID NO: 557986 - RNA, 19 nt, Homo sapiens
acaaagaucuagccaauca

SEQ ID NO: 557987 - RNA, 19 nt, Homo sapiens
ccaaagguguggagauuga

SEQ ID NO: 557988 - RNA, 19 nt, Homo sapiens
caacuguccugcucuuuga

SEQ ID NO: 557989 - RNA, 19 nt, Homo sapiens
guaugcagcuuaaaguuga

SEQ ID NO: 557990 - RNA, 19 nt, Homo sapiens
gaccuuauuuaucagcuua

SEQ ID NO: 557991 - RNA, 19 nt, Homo sapiens
ccagugagcucuuuagaag

SEQ ID NO: 557992 - RNA, 19 nt, Homo sapiens
uagauugggucguuacuaa

SEQ ID NO: 557993 - RNA, 19 nt, Homo sapiens
gagaauggcagucgugaaa

SEQ ID NO: 557994 - RNA, 19 nt, Homo sapiens
ucaauugucuuacucauca

SEQ ID NO: 557995 - RNA, 19 nt, Homo sapiens
uuagaaggacucaguauua

SEQ ID NO: 557996 - RNA, 19 nt, Homo sapiens
aaauuaaccuggucaauag

SEQ ID NO: 557997 - RNA, 19 nt, Homo sapiens
cuacagaugugaaggaaug

SEQ ID NO: 557998 - RNA, 19 nt, Homo sapiens
gaaagaaggcccaggaagu

SEQ ID NO: 557999 - RNA, 19 nt, Homo sapiens
gaagaaagaaggaaaggau

SEQ ID NO: 558000 - RNA, 19 nt, Homo sapiens
gaaggaggcucuguauaag

SEQ ID NO: 558001 - RNA, 19 nt, Homo sapiens
agaaggaggcucuguauaa

SEQ ID NO: 558002 - RNA, 19 nt, Homo sapiens
uuaucaagcuccuuacaua

SEQ ID NO: 558003 - RNA, 19 nt, Homo sapiens
caacuggaguguacccaaa

SEQ ID NO: 558004 - RNA, 19 nt, Homo sapiens
gaaggcccaggaaguauua

SEQ ID NO: 558005 - RNA, 19 nt, Homo sapiens
acaaguggcugcuucgaaa

SEQ ID NO: 558006 - RNA, 19 nt, Homo sapiens
ccuauaaugugaaugauug

SEQ ID NO: 558007 - RNA, 19 nt, Homo sapiens
aaacucagcuacugcaaau

SEQ ID NO: 558008 - RNA, 19 nt, Homo sapiens
gaacuccucuacagaugug

SEQ ID NO: 558009 - RNA, 19 nt, Homo sapiens
gcaaugacuccuucuagaa

SEQ ID NO: 558010 - RNA, 19 nt, Homo sapiens
aaagagaagugguuauauc

SEQ ID NO: 558011 - RNA, 19 nt, Homo sapiens
gagauggaccuaucagauu

SEQ ID NO: 558012 - RNA, 19 nt, Homo sapiens
gaagucagcauccgguauu

SEQ ID NO: 558013 - RNA, 19 nt, Homo sapiens
gaaacuucauggucccaaa

SEQ ID NO: 558014 - RNA, 19 nt, Homo sapiens
agacagagcuggcaaacag

SEQ ID NO: 558015 - RNA, 19 nt, Homo sapiens
gaaagaaggaaaggauaaa

SEQ ID NO: 558016 - RNA, 19 nt, Homo sapiens
aguggcagcuccaguaaua

SEQ ID NO: 558017 - RNA, 19 nt, Homo sapiens
gaagugggguuuauaaugu

SEQ ID NO: 558018 - RNA, 19 nt, Homo sapiens
gagaaugaauaccuuccaa

SEQ ID NO: 558019 - RNA, 19 nt, Homo sapiens
gaaugaauaccuuccaaga

SEQ ID NO: 558020 - RNA, 19 nt, Homo sapiens
gcccaaagguguggagauu

SEQ ID NO: 558021 - RNA, 19 nt, Homo sapiens
gaaagaagaugggcaaccu

SEQ ID NO: 558022 - RNA, 19 nt, Homo sapiens
ccaguuaucuugaguugca

SEQ ID NO: 558023 - RNA, 19 nt, Homo sapiens
caaaagacauguuggaaau

SEQ ID NO: 558024 - RNA, 19 nt, Homo sapiens
aaagugagucaucagauua

SEQ ID NO: 558025 - RNA, 19 nt, Homo sapiens
ccauacagcuucacuagag

SEQ ID NO: 558026 - RNA, 19 nt, Homo sapiens
ggcaaugacuccuucuaga

SEQ ID NO: 558027 - RNA, 19 nt, Homo sapiens
ugagguaauucuagccuuu

SEQ ID NO: 558028 - RNA, 19 nt, Homo sapiens
uagaaggacucaguauuau

SEQ ID NO: 558029 - RNA, 19 nt, Homo sapiens
aaagaaggcccaggaagua

SEQ ID NO: 558030 - RNA, 19 nt, Homo sapiens
gagaagagaggcuguaucu

SEQ ID NO: 558031 - RNA, 19 nt, Homo sapiens
ggccaaacacacuguauuu

SEQ ID NO: 558032 - RNA, 19 nt, Homo sapiens
cagauaucauuuaggagua

SEQ ID NO: 558033 - RNA, 19 nt, Homo sapiens
ugaaacagucacuaucaua

SEQ ID NO: 558034 - RNA, 19 nt, Homo sapiens
agaaggaagucccaaggaa

SEQ ID NO: 558035 - RNA, 19 nt, Homo sapiens
ggacuuggagcuugcuauu

SEQ ID NO: 558036 - RNA, 19 nt, Homo sapiens
gcuuaaaguugauaaagag

SEQ ID NO: 558037 - RNA, 19 nt, Homo sapiens
gagaaggaggcucuguaua

SEQ ID NO: 558038 - RNA, 19 nt, Homo sapiens
ucaaauuccugagcacuug

SEQ ID NO: 558039 - RNA, 19 nt, Homo sapiens
cauaagccgucaccuggaa

SEQ ID NO: 558040 - RNA, 19 nt, Homo sapiens
aagcucagauucacaguug

SEQ ID NO: 558041 - RNA, 19 nt, Homo sapiens
gcugauuccuuccaaguca

SEQ ID NO: 558042 - RNA, 19 nt, Homo sapiens
cuuugaagcugacacaauu

SEQ ID NO: 558043 - RNA, 19 nt, Homo sapiens
cagcagcucuacucguuau

SEQ ID NO: 558044 - RNA, 19 nt, Homo sapiens
gcagcucuguaguuucuug

SEQ ID NO: 558045 - RNA, 19 nt, Homo sapiens
ccugcaauuucuucaauaa

SEQ ID NO: 558046 - RNA, 19 nt, Homo sapiens
cacguuaguucuacauuau

SEQ ID NO: 558047 - RNA, 19 nt, Homo sapiens
ggucaauagugauuaccaa

SEQ ID NO: 558048 - RNA, 19 nt, Homo sapiens
guucuucuccugccuaauu

SEQ ID NO: 558049 - RNA, 19 nt, Homo sapiens
gacugcagcuugccaaauc

SEQ ID NO: 558050 - RNA, 19 nt, Homo sapiens
cagauucacaguugcauaa

SEQ ID NO: 558051 - RNA, 19 nt, Homo sapiens
guauaguacuugaaacagu

SEQ ID NO: 558052 - RNA, 19 nt, Homo sapiens
ccaaacacacuguauuuua

SEQ ID NO: 558053 - RNA, 19 nt, Homo sapiens
gaacuaguaaagcaaagug

SEQ ID NO: 558054 - RNA, 19 nt, Homo sapiens
gaaggaauggacaagaguu

SEQ ID NO: 558055 - RNA, 19 nt, Homo sapiens
agaaagaaggaaaggauaa

SEQ ID NO: 558056 - RNA, 19 nt, Homo sapiens
gguuggagaucaagagcuu

SEQ ID NO: 558057 - RNA, 19 nt, Homo sapiens
uauuguagcugucccuuuc

SEQ ID NO: 558058 - RNA, 19 nt, Homo sapiens
aggauuggcuuguccagaa

SEQ ID NO: 558059 - RNA, 19 nt, Homo sapiens
ggucaaagcucagauucac

SEQ ID NO: 558060 - RNA, 19 nt, Homo sapiens
aaucugaagugccugaaug

SEQ ID NO: 558061 - RNA, 19 nt, Homo sapiens
agauggaccuaucagauug

SEQ ID NO: 558062 - RNA, 19 nt, Homo sapiens
gccagaccaucaccacauu

SEQ ID NO: 558063 - RNA, 19 nt, Homo sapiens
caccuggaaugucuuagaa

SEQ ID NO: 558064 - RNA, 19 nt, Homo sapiens
ggacucaguauuauuucaa

SEQ ID NO: 558065 - RNA, 19 nt, Homo sapiens
ggaaaagguuggagaucaa

SEQ ID NO: 558066 - RNA, 19 nt, Homo sapiens
uguaucugcuuccauuaaa

SEQ ID NO: 558067 - RNA, 19 nt, Homo sapiens
gugagaaguuuaagcucuu

SEQ ID NO: 558068 - RNA, 19 nt, Homo sapiens
ucggugaccuggccuguga

SEQ ID NO: 558069 - RNA, 19 nt, Homo sapiens
cagaguggcagcuccagua

SEQ ID NO: 558070 - RNA, 19 nt, Homo sapiens
gugaaugauuggcuuguca

SEQ ID NO: 558071 - RNA, 19 nt, Homo sapiens
cagcuucacuagaguucuu

SEQ ID NO: 558072 - RNA, 19 nt, Homo sapiens
gcauaccuguaccuccaaa

SEQ ID NO: 558073 - RNA, 19 nt, Homo sapiens
cuaguaaacuucccuaacg

SEQ ID NO: 558074 - RNA, 19 nt, Homo sapiens
gcaaagugagucaucagau

SEQ ID NO: 558075 - RNA, 19 nt, Homo sapiens
uaacagccauuccacuacu

SEQ ID NO: 558076 - RNA, 19 nt, Homo sapiens
gggcaaccucagccaguua

SEQ ID NO: 558077 - RNA, 19 nt, Homo sapiens
aagaugagauggaccuauc

SEQ ID NO: 558078 - RNA, 19 nt, Homo sapiens
gaacaccgcuauacaggaa

SEQ ID NO: 558079 - RNA, 19 nt, Homo sapiens
gacaauauccuacccauuu

SEQ ID NO: 558080 - RNA, 19 nt, Homo sapiens
gaucagaacugcuuaccau

SEQ ID NO: 558081 - RNA, 19 nt, Homo sapiens
gccauuagcuuucgucaug

SEQ ID NO: 558082 - RNA, 19 nt, Homo sapiens
uaaaggaaauggugcaaug

SEQ ID NO: 558083 - RNA, 19 nt, Homo sapiens
uaucgugguuuaucucuua

SEQ ID NO: 558084 - RNA, 19 nt, Homo sapiens
cgccaaacauuauaccuua

SEQ ID NO: 558085 - RNA, 19 nt, Homo sapiens
gaaguagaaacuagcuuua

SEQ ID NO: 558086 - RNA, 19 nt, Homo sapiens
ucacagagccaugguauuu

SEQ ID NO: 558087 - RNA, 19 nt, Homo sapiens
ggucugaugccuacuauuu

SEQ ID NO: 558088 - RNA, 19 nt, Homo sapiens
uuacaagcauuuaggagua

SEQ ID NO: 558089 - RNA, 19 nt, Homo sapiens
ggaaguagaaacuagcuuu

SEQ ID NO: 558090 - RNA, 19 nt, Homo sapiens
gaaggugguuucuuuggau

SEQ ID NO: 558091 - RNA, 19 nt, Homo sapiens
ggaaauggugcaaugauga

SEQ ID NO: 558092 - RNA, 19 nt, Homo sapiens
ggaaggugguuucuuugga

SEQ ID NO: 558093 - RNA, 19 nt, Homo sapiens
gaacugcuuaccauacuuu

SEQ ID NO: 558094 - RNA, 19 nt, Homo sapiens
cuacgaagcugggaauuuc

SEQ ID NO: 558095 - RNA, 19 nt, Homo sapiens
gaaacaguccagccauuga

SEQ ID NO: 558096 - RNA, 19 nt, Homo sapiens
acacuucuuuccuucauuu

SEQ ID NO: 558097 - RNA, 19 nt, Homo sapiens
gcagguaugacagcaguua

SEQ ID NO: 558098 - RNA, 19 nt, Homo sapiens
gcaauagcgcagacaauau

SEQ ID NO: 558099 - RNA, 19 nt, Homo sapiens
gucaugcuguucaaaguuu

SEQ ID NO: 558100 - RNA, 19 nt, Homo sapiens
gagguuggccauuagcuuu

SEQ ID NO: 558101 - RNA, 19 nt, Homo sapiens
uucaagagguuggccauua

SEQ ID NO: 558102 - RNA, 19 nt, Homo sapiens
uuagaugcgccaaacauua

SEQ ID NO: 558103 - RNA, 19 nt, Homo sapiens
ggucaugugcacagauuaa

SEQ ID NO: 558104 - RNA, 19 nt, Homo sapiens
aaaggacucuaucgugguu

SEQ ID NO: 558105 - RNA, 19 nt, Homo sapiens
ucaagagguuggccauuag

SEQ ID NO: 558106 - RNA, 19 nt, Homo sapiens
caucagacaauccuaaugu

SEQ ID NO: 558107 - RNA, 19 nt, Homo sapiens
auaugcagguguuucauuu

SEQ ID NO: 558108 - RNA, 19 nt, Homo sapiens
guacugacccuguugacau

SEQ ID NO: 558109 - RNA, 19 nt, Homo sapiens
gaaauggugcaaugaugau

SEQ ID NO: 558110 - RNA, 19 nt, Homo sapiens
acaauauccuacccauuug

SEQ ID NO: 558111 - RNA, 19 nt, Homo sapiens
caggucaugugcacagauu

SEQ ID NO: 558112 - RNA, 19 nt, Homo sapiens
uuauggcauuugagcauua

SEQ ID NO: 558113 - RNA, 19 nt, Homo sapiens
gaggucugaugccuacuau

SEQ ID NO: 558114 - RNA, 19 nt, Homo sapiens
gugcaaugaugauucgaau

SEQ ID NO: 558115 - RNA, 19 nt, Homo sapiens
acagagccaugguauuuua

SEQ ID NO: 558116 - RNA, 19 nt, Homo sapiens
uaugaaguaugacuaugga

SEQ ID NO: 558117 - RNA, 19 nt, Homo sapiens
caauccaguuuauggcauu

SEQ ID NO: 558118 - RNA, 19 nt, Homo sapiens
caauagcgcagacaauauc

SEQ ID NO: 558119 - RNA, 19 nt, Homo sapiens
aaacacuucuuuccuucau

SEQ ID NO: 558120 - RNA, 19 nt, Homo sapiens
cgugguuuaucucuuaauu

SEQ ID NO: 558121 - RNA, 19 nt, Homo sapiens
aagaaaauaucgcagcuaa

SEQ ID NO: 558122 - RNA, 19 nt, Homo sapiens
uagaugcgccaaacauuau

SEQ ID NO: 558123 - RNA, 19 nt, Homo sapiens
cgaaugcaauuaggaacug

SEQ ID NO: 558124 - RNA, 19 nt, Homo sapiens
ccaaacauuauaccuuaga

SEQ ID NO: 558125 - RNA, 19 nt, Homo sapiens
aagcucacaaucaccauua

SEQ ID NO: 558126 - RNA, 19 nt, Homo sapiens
cagaacugcuuaccauacu

SEQ ID NO: 558127 - RNA, 19 nt, Homo sapiens
aggacucuaucgugguuua

SEQ ID NO: 558128 - RNA, 19 nt, Homo sapiens
ggacaccauggaauucgaa

SEQ ID NO: 558129 - RNA, 19 nt, Homo sapiens
gagcaauagcgcagacaau

SEQ ID NO: 558130 - RNA, 19 nt, Homo sapiens
ucugaugccuacuauuuua

SEQ ID NO: 558131 - RNA, 19 nt, Homo sapiens
uaucuguacugacccuguu

SEQ ID NO: 558132 - RNA, 19 nt, Homo sapiens
auucgaaucuuucccuaug

SEQ ID NO: 558133 - RNA, 19 nt, Homo sapiens
aggaaauggugcaaugaug

SEQ ID NO: 558134 - RNA, 19 nt, Homo sapiens
gcugaugccuggcuaaacc

SEQ ID NO: 558135 - RNA, 19 nt, Homo sapiens
gcgccaaacauuauaccuu

SEQ ID NO: 558136 - RNA, 19 nt, Homo sapiens
agcaauagcgcagacaaua

SEQ ID NO: 558137 - RNA, 19 nt, Homo sapiens
acaccgcuauacaggaauu

SEQ ID NO: 558138 - RNA, 19 nt, Homo sapiens
ugaaacaguccagccauug

SEQ ID NO: 558139 - RNA, 19 nt, Homo sapiens
gagccaugguauuuuagua

SEQ ID NO: 558140 - RNA, 19 nt, Homo sapiens
gaaugcaauuaggaacugu

SEQ ID NO: 558141 - RNA, 19 nt, Homo sapiens
cauaugcagguguuucauu

SEQ ID NO: 558142 - RNA, 19 nt, Homo sapiens
uaccuuagaacauugaaga

SEQ ID NO: 558143 - RNA, 19 nt, Homo sapiens
caauauccuacccauuuga

SEQ ID NO: 558144 - RNA, 19 nt, Homo sapiens
gccaaacauuauaccuuag

SEQ ID NO: 558145 - RNA, 19 nt, Homo sapiens
ugaagaguguugggcuuuc

SEQ ID NO: 558146 - RNA, 19 nt, Homo sapiens
caaaggaaggugguuucuu

SEQ ID NO: 558147 - RNA, 19 nt, Homo sapiens
ggcauuugagcauuauaaa

SEQ ID NO: 558148 - RNA, 19 nt, Homo sapiens
uggcauuugagcauuauaa

SEQ ID NO: 558149 - RNA, 19 nt, Homo sapiens
cccguccgguguucuguaa

SEQ ID NO: 558150 - RNA, 19 nt, Homo sapiens
uacaagcauuuaggaguau

SEQ ID NO: 558151 - RNA, 19 nt, Homo sapiens
uagcgcagacaauauccua

SEQ ID NO: 558152 - RNA, 19 nt, Homo sapiens
uauggugcaauccaguuua

SEQ ID NO: 558153 - RNA, 19 nt, Homo sapiens
guccagccauugacauuuu

SEQ ID NO: 558154 - RNA, 19 nt, Homo sapiens
augaaacaguccagccauu

SEQ ID NO: 558155 - RNA, 19 nt, Homo sapiens
ggauauuuacccugucaca

SEQ ID NO: 558156 - RNA, 19 nt, Homo sapiens
caaucaccauuacaagcau

SEQ ID NO: 558157 - RNA, 19 nt, Homo sapiens
gcaaaggaaggugguuucu

SEQ ID NO: 558158 - RNA, 19 nt, Homo sapiens
caagcauuuaggaguauuu

SEQ ID NO: 558159 - RNA, 19 nt, Homo sapiens
gggaauuucaggucaugug

SEQ ID NO: 558160 - RNA, 19 nt, Homo sapiens
uuccuuggauuguauaaag

SEQ ID NO: 558161 - RNA, 19 nt, Homo sapiens
acaaucaccauuacaagca

SEQ ID NO: 558162 - RNA, 19 nt, Homo sapiens
uauccuacccauuugaugu

SEQ ID NO: 558163 - RNA, 19 nt, Homo sapiens
gaagaguguugggcuuucc

SEQ ID NO: 558164 - RNA, 19 nt, Homo sapiens
gaaaggggaacaccgcuau

SEQ ID NO: 558165 - RNA, 19 nt, Homo sapiens
uauuacaagcucacaauca

SEQ ID NO: 558166 - RNA, 19 nt, Homo sapiens
ggugcaauccaguuuaugg

SEQ ID NO: 558167 - RNA, 19 nt, Homo sapiens
aaaggaaauggugcaauga

SEQ ID NO: 558168 - RNA, 19 nt, Homo sapiens
uagcuuucgucaugcuguu

SEQ ID NO: 558169 - RNA, 19 nt, Homo sapiens
gaaaauaucgcagcuaagc

SEQ ID NO: 558170 - RNA, 19 nt, Homo sapiens
ccuuagaacauugaagaaa

SEQ ID NO: 558171 - RNA, 19 nt, Homo sapiens
ucagaacugcuuaccauac

SEQ ID NO: 558172 - RNA, 19 nt, Homo sapiens
ggauuccuuggauuguaua

SEQ ID NO: 558173 - RNA, 19 nt, Homo sapiens
ggcaguccuucaucagaca

SEQ ID NO: 558174 - RNA, 19 nt, Homo sapiens
ucacaaucaccauuacaag

SEQ ID NO: 558175 - RNA, 19 nt, Homo sapiens
agucagaucagaacugcuu

SEQ ID NO: 558176 - RNA, 19 nt, Homo sapiens
caagcucacaaucaccauu

SEQ ID NO: 558177 - RNA, 19 nt, Homo sapiens
ugccuuaccaugcgggaua

SEQ ID NO: 558178 - RNA, 19 nt, Homo sapiens
caagagaucuauacacaua

SEQ ID NO: 558179 - RNA, 19 nt, Homo sapiens
gaaggcaggugaagauaua

SEQ ID NO: 558180 - RNA, 19 nt, Homo sapiens
ggacagagguaguauaguu

SEQ ID NO: 558181 - RNA, 19 nt, Homo sapiens
uuaaagagcucaacaaaug

SEQ ID NO: 558182 - RNA, 19 nt, Homo sapiens
gaaauugcuuccaguugua

SEQ ID NO: 558183 - RNA, 19 nt, Homo sapiens
gcagugcacuugaagaauu

SEQ ID NO: 558184 - RNA, 19 nt, Homo sapiens
guagguaacuuuaaggauu

SEQ ID NO: 558185 - RNA, 19 nt, Homo sapiens
gcacucaaauucaugacua

SEQ ID NO: 558186 - RNA, 19 nt, Homo sapiens
ggauguagcucacaaucaa

SEQ ID NO: 558187 - RNA, 19 nt, Homo sapiens
gaggugggauguuuaguaa

SEQ ID NO: 558188 - RNA, 19 nt, Homo sapiens
gaagaacuguauuugaaug

SEQ ID NO: 558189 - RNA, 19 nt, Homo sapiens
gagagaaccuacuuacuca

SEQ ID NO: 558190 - RNA, 19 nt, Homo sapiens
uaacaucacuucccuugga

SEQ ID NO: 558191 - RNA, 19 nt, Homo sapiens
ugacggaacucuaaugaau

SEQ ID NO: 558192 - RNA, 19 nt, Homo sapiens
acaacuaccugcugaaauu

SEQ ID NO: 558193 - RNA, 19 nt, Homo sapiens
gcacuggcuucaaacaauu

SEQ ID NO: 558194 - RNA, 19 nt, Homo sapiens
gaaagguauuugcuuguug

SEQ ID NO: 558195 - RNA, 19 nt, Homo sapiens
gagguaguauaguuagaua

SEQ ID NO: 558196 - RNA, 19 nt, Homo sapiens
gaaccuagaagaacuguau

SEQ ID NO: 558197 - RNA, 19 nt, Homo sapiens
cagcagaggugggauguuu

SEQ ID NO: 558198 - RNA, 19 nt, Homo sapiens
cacaauaucuucacacugu

SEQ ID NO: 558199 - RNA, 19 nt, Homo sapiens
gaggaaucauagccauuua

SEQ ID NO: 558200 - RNA, 19 nt, Homo sapiens
gcagcaagcuuucaaucau

SEQ ID NO: 558201 - RNA, 19 nt, Homo sapiens
gaaauugcauaucuuaagg

SEQ ID NO: 558202 - RNA, 19 nt, Homo sapiens
gaauaucugugucuaagca

SEQ ID NO: 558203 - RNA, 19 nt, Homo sapiens
gaagagaaacuugcaguga

SEQ ID NO: 558204 - RNA, 19 nt, Homo sapiens
uaagagaguuggaucuaga

SEQ ID NO: 558205 - RNA, 19 nt, Homo sapiens
cuaaucagcucacaaagau

SEQ ID NO: 558206 - RNA, 19 nt, Homo sapiens
gaaaugggcauagugcuuu

SEQ ID NO: 558207 - RNA, 19 nt, Homo sapiens
uaucuugacuugccuugua

SEQ ID NO: 558208 - RNA, 19 nt, Homo sapiens
uaccuucgcuuuaaucgua

SEQ ID NO: 558209 - RNA, 19 nt, Homo sapiens
caaaggagauuggaaacug

SEQ ID NO: 558210 - RNA, 19 nt, Homo sapiens
ugaauccucugcuaaagaa

SEQ ID NO: 558211 - RNA, 19 nt, Homo sapiens
ucagucaaaucuagaguuu

SEQ ID NO: 558212 - RNA, 19 nt, Homo sapiens
gccaacacauuaugaaguu

SEQ ID NO: 558213 - RNA, 19 nt, Homo sapiens
caucaucaaucaaagaguu

SEQ ID NO: 558214 - RNA, 19 nt, Homo sapiens
caucuuuccuuucuuggua

SEQ ID NO: 558215 - RNA, 19 nt, Homo sapiens
caggauaauugggcaaaua

SEQ ID NO: 558216 - RNA, 19 nt, Homo sapiens
ccacaaaacuaacaggaua

SEQ ID NO: 558217 - RNA, 19 nt, Homo sapiens
gauauacuuucucuuagga

SEQ ID NO: 558218 - RNA, 19 nt, Homo sapiens
gccauggucugauauaaau

SEQ ID NO: 558219 - RNA, 19 nt, Homo sapiens
guauguauguuucaagguu

SEQ ID NO: 558220 - RNA, 19 nt, Homo sapiens
gaagagaacaaauuggaau

SEQ ID NO: 558221 - RNA, 19 nt, Homo sapiens
ggaugugucuggucucguu

SEQ ID NO: 558222 - RNA, 19 nt, Homo sapiens
gaaggacaaucaguuaaca

SEQ ID NO: 558223 - RNA, 19 nt, Homo sapiens
caaaauaccugaagugagu

SEQ ID NO: 558224 - RNA, 19 nt, Homo sapiens
gaacuguauuugaaugaca

SEQ ID NO: 558225 - RNA, 19 nt, Homo sapiens
ggagagaaccuacuuacuc

SEQ ID NO: 558226 - RNA, 19 nt, Homo sapiens
ccacuaaucagcucacaaa

SEQ ID NO: 558227 - RNA, 19 nt, Homo sapiens
gauuaaagagcucaacaaa

SEQ ID NO: 558228 - RNA, 19 nt, Homo sapiens
gcaaugcagaggugauuaa

SEQ ID NO: 558229 - RNA, 19 nt, Homo sapiens
gaaugaaugaucagaaaug

SEQ ID NO: 558230 - RNA, 19 nt, Homo sapiens
acaauucaguucaguauca

SEQ ID NO: 558231 - RNA, 19 nt, Homo sapiens
agagaaacuugcagugaaa

SEQ ID NO: 558232 - RNA, 19 nt, Homo sapiens
gaucagaaaugggcauagu

SEQ ID NO: 558233 - RNA, 19 nt, Homo sapiens
gaacacaaucgaaucaaca

SEQ ID NO: 558234 - RNA, 19 nt, Homo sapiens
gaccuuagcuagaaauugc

SEQ ID NO: 558235 - RNA, 19 nt, Homo sapiens
caccaugaguaguaguuua

SEQ ID NO: 558236 - RNA, 19 nt, Homo sapiens
gauccaacauguaacagau

SEQ ID NO: 558237 - RNA, 19 nt, Homo sapiens
gaaaguugcagauccacaa

SEQ ID NO: 558238 - RNA, 19 nt, Homo sapiens
gcuaauagaggaaucauag

SEQ ID NO: 558239 - RNA, 19 nt, Homo sapiens
gaaccuacuuacucaccuu

SEQ ID NO: 558240 - RNA, 19 nt, Homo sapiens
uuacuaaucucacacaucu

SEQ ID NO: 558241 - RNA, 19 nt, Homo sapiens
uaaccaaccuugacuugca

SEQ ID NO: 558242 - RNA, 19 nt, Homo sapiens
uggaaugaaugaucagaaa

SEQ ID NO: 558243 - RNA, 19 nt, Homo sapiens
agaaauugcuuccaguugu

SEQ ID NO: 558244 - RNA, 19 nt, Homo sapiens
cagugcacuugaagaauua

SEQ ID NO: 558245 - RNA, 19 nt, Homo sapiens
ugagagaaauuccuucagu

SEQ ID NO: 558246 - RNA, 19 nt, Homo sapiens
gaaagaugccaaagaugga

SEQ ID NO: 558247 - RNA, 19 nt, Homo sapiens
aagagaaacuugcagugaa

SEQ ID NO: 558248 - RNA, 19 nt, Homo sapiens
aaagguauuugcuuguuga

SEQ ID NO: 558249 - RNA, 19 nt, Homo sapiens
augcagaggugauuaaaga

SEQ ID NO: 558250 - RNA, 19 nt, Homo sapiens
ggaaagagagcaaagaaaa

SEQ ID NO: 558251 - RNA, 19 nt, Homo sapiens
caaggugcguucuagaugu

SEQ ID NO: 558252 - RNA, 19 nt, Homo sapiens
agaugugcauguacuauuu

SEQ ID NO: 558253 - RNA, 19 nt, Homo sapiens
aaacugcaauguauguaug

SEQ ID NO: 558254 - RNA, 19 nt, Homo sapiens
gacagagguaguauaguua

SEQ ID NO: 558255 - RNA, 19 nt, Homo sapiens
cauuauguguuucugcuaa

SEQ ID NO: 558256 - RNA, 19 nt, Homo sapiens
gcauuggucaccuuacuaa

SEQ ID NO: 558257 - RNA, 19 nt, Homo sapiens
gcaauacccagaucauuag

SEQ ID NO: 558258 - RNA, 19 nt, Homo sapiens
uaugaaggacaaucaguua

SEQ ID NO: 558259 - RNA, 19 nt, Homo sapiens
gaucaacuaagaaauggaa

SEQ ID NO: 558260 - RNA, 19 nt, Homo sapiens
ugacuugccuuguacaucu

SEQ ID NO: 558261 - RNA, 19 nt, Homo sapiens
ugaaagguauuugcuuguu

SEQ ID NO: 558262 - RNA, 19 nt, Homo sapiens
gauagaaauuuggacuguu

SEQ ID NO: 558263 - RNA, 19 nt, Homo sapiens
gaguuugaauccucugcua

SEQ ID NO: 558264 - RNA, 19 nt, Homo sapiens
ggaaucauagccauuuaga

SEQ ID NO: 558265 - RNA, 19 nt, Homo sapiens
gauaaccaaccuugacuug

SEQ ID NO: 558266 - RNA, 19 nt, Homo sapiens
ugauugaccagcacuauuu

SEQ ID NO: 558267 - RNA, 19 nt, Homo sapiens
auagaaauuuggacuguug

SEQ ID NO: 558268 - RNA, 19 nt, Homo sapiens
gcaaggugcguucuagaug

SEQ ID NO: 558269 - RNA, 19 nt, Homo sapiens
ggcacuggcuucaaacaau

SEQ ID NO: 558270 - RNA, 19 nt, Homo sapiens
aaucugauaugccaguuug

SEQ ID NO: 558271 - RNA, 19 nt, Homo sapiens
caguggaaguucuguaaga

SEQ ID NO: 558272 - RNA, 19 nt, Homo sapiens
cagcaagcuuucaaucaug

SEQ ID NO: 558273 - RNA, 19 nt, Homo sapiens
gaaauuagucuugacaaac

SEQ ID NO: 558274 - RNA, 19 nt, Homo sapiens
ggaaggcaggugaagauau

SEQ ID NO: 558275 - RNA, 19 nt, Homo sapiens
gguauuugcuuguugaaaa

SEQ ID NO: 558276 - RNA, 19 nt, Homo sapiens
gauaugccaguuugcuuaa

SEQ ID NO: 558277 - RNA, 19 nt, Homo sapiens
uggaauccuugccaaauga

SEQ ID NO: 558278 - RNA, 19 nt, Homo sapiens
gcaaagaacugaucauaaa

SEQ ID NO: 558279 - RNA, 19 nt, Homo sapiens
gaaaucaacuugcuuauca

SEQ ID NO: 558280 - RNA, 19 nt, Homo sapiens
ggaaugacauggacaaaug

SEQ ID NO: 558281 - RNA, 19 nt, Homo sapiens
gaugagagaugcuaaaugu

SEQ ID NO: 558282 - RNA, 19 nt, Homo sapiens
gaacagauuuguggaagaa

SEQ ID NO: 558283 - RNA, 19 nt, Homo sapiens
cgacugcuguuuacaaaua

SEQ ID NO: 558284 - RNA, 19 nt, Homo sapiens
gaacccagcucuaauacau

SEQ ID NO: 558285 - RNA, 19 nt, Homo sapiens
gaucauaaaucuggaaaga

SEQ ID NO: 558286 - RNA, 19 nt, Homo sapiens
gauagagacuggaacacua

SEQ ID NO: 558287 - RNA, 19 nt, Homo sapiens
ccuuagaucuggcauguua

SEQ ID NO: 558288 - RNA, 19 nt, Homo sapiens
caagagaucccaaguagaa

SEQ ID NO: 558289 - RNA, 19 nt, Homo sapiens
gaaaggaggcugcaucaug

SEQ ID NO: 558290 - RNA, 19 nt, Homo sapiens
ggagauugcugcaguguca

SEQ ID NO: 558291 - RNA, 19 nt, Homo sapiens
caacuuggcugcaggaauc

SEQ ID NO: 558292 - RNA, 19 nt, Homo sapiens
gaucaaggccuuauuggaa

SEQ ID NO: 558293 - RNA, 19 nt, Homo sapiens
guucaugucugcuaucauu

SEQ ID NO: 558294 - RNA, 19 nt, Homo sapiens
ugaaagcuaugucuuagaa

SEQ ID NO: 558295 - RNA, 19 nt, Homo sapiens
aggaagagcugaugaaguu

SEQ ID NO: 558296 - RNA, 19 nt, Homo sapiens
gacaggauguguuugcuuu

SEQ ID NO: 558297 - RNA, 19 nt, Homo sapiens
aaaggaggcugcaucauga

SEQ ID NO: 558298 - RNA, 19 nt, Homo sapiens
cacaaggucuuuaaaguga

SEQ ID NO: 558299 - RNA, 19 nt, Homo sapiens
gaaaaggccugaugaggaa

SEQ ID NO: 558300 - RNA, 19 nt, Homo sapiens
ggacaaaugcucuguaagu

SEQ ID NO: 558301 - RNA, 19 nt, Homo sapiens
gaacaacucggcucacuca

SEQ ID NO: 558302 - RNA, 19 nt, Homo sapiens
gaagacaauugacaacagu

SEQ ID NO: 558303 - RNA, 19 nt, Homo sapiens
acaggaaucuuaaggugua

SEQ ID NO: 558304 - RNA, 19 nt, Homo sapiens
acaguuugcucauuuauug

SEQ ID NO: 558305 - RNA, 19 nt, Homo sapiens
ugaaauauccugcuugaug

SEQ ID NO: 558306 - RNA, 19 nt, Homo sapiens
gacaacaguuacauaauuc

SEQ ID NO: 558307 - RNA, 19 nt, Homo sapiens
guacuaaagccaaacauau

SEQ ID NO: 558308 - RNA, 19 nt, Homo sapiens
caaguagaaucucaguuga

SEQ ID NO: 558309 - RNA, 19 nt, Homo sapiens
caccaaaccucgcugcaaa

SEQ ID NO: 558310 - RNA, 19 nt, Homo sapiens
ccaggaagcuuuggugaga

SEQ ID NO: 558311 - RNA, 19 nt, Homo sapiens
ggcaaagucucgaagaguu

SEQ ID NO: 558312 - RNA, 19 nt, Homo sapiens
caauuaggcagacucuuua

SEQ ID NO: 558313 - RNA, 19 nt, Homo sapiens
gcaaaucaccacaaacugu

SEQ ID NO: 558314 - RNA, 19 nt, Homo sapiens
ggacuuauuguguuugaaa

SEQ ID NO: 558315 - RNA, 19 nt, Homo sapiens
agucugaaccuauuucuua

SEQ ID NO: 558316 - RNA, 19 nt, Homo sapiens
ucagacagaugaggacuuu

SEQ ID NO: 558317 - RNA, 19 nt, Homo sapiens
gcaagcagauaaccaaggu

SEQ ID NO: 558318 - RNA, 19 nt, Homo sapiens
aaaccucgcugcaaagaau

SEQ ID NO: 558319 - RNA, 19 nt, Homo sapiens
caacagauacaaacucuuc

SEQ ID NO: 558320 - RNA, 19 nt, Homo sapiens
gcaccucccuucugugaca

SEQ ID NO: 558321 - RNA, 19 nt, Homo sapiens
gcaugcaucuguuuauucu

SEQ ID NO: 558322 - RNA, 19 nt, Homo sapiens
acuaauggcaugagaaaua

SEQ ID NO: 558323 - RNA, 19 nt, Homo sapiens
caaaucaccacaaacugua

SEQ ID NO: 558324 - RNA, 19 nt, Homo sapiens
ccaaguagaaucucaguug

SEQ ID NO: 558325 - RNA, 19 nt, Homo sapiens
gugagaagccgacaccuuu

SEQ ID NO: 558326 - RNA, 19 nt, Homo sapiens
cuaaucacguugacaaguu

SEQ ID NO: 558327 - RNA, 19 nt, Homo sapiens
aagcagcgauuaauagaga

SEQ ID NO: 558328 - RNA, 19 nt, Homo sapiens
cuuaaacacuugcaaccua

SEQ ID NO: 558329 - RNA, 19 nt, Homo sapiens
agacagaaguuugcacuau

SEQ ID NO: 558330 - RNA, 19 nt, Homo sapiens
ccaaugccguuuccauaga

SEQ ID NO: 558331 - RNA, 19 nt, Homo sapiens
ggaacagauuuguggaaga

SEQ ID NO: 558332 - RNA, 19 nt, Homo sapiens
ucaccagccuccaugaauu

SEQ ID NO: 558333 - RNA, 19 nt, Homo sapiens
ucaacuugcuuaucaacuu

SEQ ID NO: 558334 - RNA, 19 nt, Homo sapiens
caagaaucauccagaagug

SEQ ID NO: 558335 - RNA, 19 nt, Homo sapiens
gaaccuauuucuuaaacac

SEQ ID NO: 558336 - RNA, 19 nt, Homo sapiens
ggauguguuugcuuucuga

SEQ ID NO: 558337 - RNA, 19 nt, Homo sapiens
gcagaauguugauuacagu

SEQ ID NO: 558338 - RNA, 19 nt, Homo sapiens
ccucagaccugcuccacaa

SEQ ID NO: 558339 - RNA, 19 nt, Homo sapiens
gcaagguucaacuuauuaa

SEQ ID NO: 558340 - RNA, 19 nt, Homo sapiens
gaacucuucacucuucaaa

SEQ ID NO: 558341 - RNA, 19 nt, Homo sapiens
aaccagaucuagucaauca

SEQ ID NO: 558342 - RNA, 19 nt, Homo sapiens
caugggaccacaacuauuu

SEQ ID NO: 558343 - RNA, 19 nt, Homo sapiens
gcaagacgguacugauguc

SEQ ID NO: 558344 - RNA, 19 nt, Homo sapiens
acaauuaggcagacucuuu

SEQ ID NO: 558345 - RNA, 19 nt, Homo sapiens
caaugauccuguauucaga

SEQ ID NO: 558346 - RNA, 19 nt, Homo sapiens
gagcaaaucaccacaaacu

SEQ ID NO: 558347 - RNA, 19 nt, Homo sapiens
ccagaggaauguaugaauc

SEQ ID NO: 558348 - RNA, 19 nt, Homo sapiens
gcaaaucccaugacaaugc

SEQ ID NO: 558349 - RNA, 19 nt, Homo sapiens
caacuugcuuaucaacuuc

SEQ ID NO: 558350 - RNA, 19 nt, Homo sapiens
uaaucacguugacaaguuu

SEQ ID NO: 558351 - RNA, 19 nt, Homo sapiens
uaacugauuacacuuggua

SEQ ID NO: 558352 - RNA, 19 nt, Homo sapiens
guagauauuggacaaagaa

SEQ ID NO: 558353 - RNA, 19 nt, Homo sapiens
gcucaagagaucccaagua

SEQ ID NO: 558354 - RNA, 19 nt, Homo sapiens
gaaguuugcacuaucuuuc

SEQ ID NO: 558355 - RNA, 19 nt, Homo sapiens
gacagaaguuugcacuauc

SEQ ID NO: 558356 - RNA, 19 nt, Homo sapiens
gcugaagccugcaggaaca

SEQ ID NO: 558357 - RNA, 19 nt, Homo sapiens
ucaagucuguuuacugcaa

SEQ ID NO: 558358 - RNA, 19 nt, Homo sapiens
ccugggaucugcuuugaga

SEQ ID NO: 558359 - RNA, 19 nt, Homo sapiens
ggcuguagcugucaaaugg

SEQ ID NO: 558360 - RNA, 19 nt, Homo sapiens
gacaaaugcucuguaaguc

SEQ ID NO: 558361 - RNA, 19 nt, Homo sapiens
guaaagccaugcuggaaaa

SEQ ID NO: 558362 - RNA, 19 nt, Homo sapiens
acucuucacucuucaaaug

SEQ ID NO: 558363 - RNA, 19 nt, Homo sapiens
gaaggggucuguaguguca

SEQ ID NO: 558364 - RNA, 19 nt, Homo sapiens
caaggaggccggauucugu

SEQ ID NO: 558365 - RNA, 19 nt, Homo sapiens
ggaaagcaaagaacugauc

SEQ ID NO: 558366 - RNA, 19 nt, Homo sapiens
uagcaugcaucuguuuauu

SEQ ID NO: 558367 - RNA, 19 nt, Homo sapiens
gaaagcaaagaacugauca

SEQ ID NO: 558368 - RNA, 19 nt, Homo sapiens
gcuuggagcugagcaaauc

SEQ ID NO: 558369 - RNA, 19 nt, Homo sapiens
gagcuucgacuccaagaau

SEQ ID NO: 558370 - RNA, 19 nt, Homo sapiens
aagaagaccaccauugaaa

SEQ ID NO: 558371 - RNA, 19 nt, Homo sapiens
guacuugggcgaugacaug

SEQ ID NO: 558372 - RNA, 19 nt, Homo sapiens
gcacucaugucaggaugug

SEQ ID NO: 558373 - RNA, 19 nt, Homo sapiens
gaagugugggaacagauuu

SEQ ID NO: 558374 - RNA, 19 nt, Homo sapiens
gagaaaggaggcugcauca

SEQ ID NO: 558375 - RNA, 19 nt, Homo sapiens
ucggacaguuugcucauuu

SEQ ID NO: 558376 - RNA, 19 nt, Homo sapiens
aaagugcaaccaacagaua

SEQ ID NO: 558377 - RNA, 19 nt, Homo sapiens
cagaagugcugaauauucg

SEQ ID NO: 558378 - RNA, 19 nt, Homo sapiens
gcaaagaacugaucauaaa

SEQ ID NO: 558379 - RNA, 19 nt, Homo sapiens
gaaacaaacuggagaagaa

SEQ ID NO: 558380 - RNA, 19 nt, Homo sapiens
ggaaugacauggacaaaug

SEQ ID NO: 558381 - RNA, 19 nt, Homo sapiens
gaugagagaugcuaaaugu

SEQ ID NO: 558382 - RNA, 19 nt, Homo sapiens
gaacagauuuguggaagaa

SEQ ID NO: 558383 - RNA, 19 nt, Homo sapiens
gaucauaaaucuggaaaga

SEQ ID NO: 558384 - RNA, 19 nt, Homo sapiens
gaaaggaggcugcaucaug

SEQ ID NO: 558385 - RNA, 19 nt, Homo sapiens
ugaaagcuaugucuuagaa

SEQ ID NO: 558386 - RNA, 19 nt, Homo sapiens
gcaacuuaaugcucugaua

SEQ ID NO: 558387 - RNA, 19 nt, Homo sapiens
aggaagagcugaugaaguu

SEQ ID NO: 558388 - RNA, 19 nt, Homo sapiens
aaaggaggcugcaucauga

SEQ ID NO: 558389 - RNA, 19 nt, Homo sapiens
ggacaaaugcucuguaagu

SEQ ID NO: 558390 - RNA, 19 nt, Homo sapiens
acaguuugcucauuuauug

SEQ ID NO: 558391 - RNA, 19 nt, Homo sapiens
caccaaaccucgcugcaaa

SEQ ID NO: 558392 - RNA, 19 nt, Homo sapiens
ggcaaagucucgaagaguu

SEQ ID NO: 558393 - RNA, 19 nt, Homo sapiens
ggugaacucuggcucuuug

SEQ ID NO: 558394 - RNA, 19 nt, Homo sapiens
ggacuuauuguguuugaaa

SEQ ID NO: 558395 - RNA, 19 nt, Homo sapiens
ucaccaacccuucauuuaa

SEQ ID NO: 558396 - RNA, 19 nt, Homo sapiens
aaaccucgcugcaaagaau

SEQ ID NO: 558397 - RNA, 19 nt, Homo sapiens
caucugagcccucccauga

SEQ ID NO: 558398 - RNA, 19 nt, Homo sapiens
caacagauacaaacucuuc

SEQ ID NO: 558399 - RNA, 19 nt, Homo sapiens
gcaccucccuucugugaca

SEQ ID NO: 558400 - RNA, 19 nt, Homo sapiens
cuaaucacguugacaaguu

SEQ ID NO: 558401 - RNA, 19 nt, Homo sapiens
aagcagcgauuaauagaga

SEQ ID NO: 558402 - RNA, 19 nt, Homo sapiens
caacagacacaacacaguu

SEQ ID NO: 558403 - RNA, 19 nt, Homo sapiens
ccaaugccguuuccauaga

SEQ ID NO: 558404 - RNA, 19 nt, Homo sapiens
ggaacagauuuguggaaga

SEQ ID NO: 558405 - RNA, 19 nt, Homo sapiens
ucaccagccuccaugaauu

SEQ ID NO: 558406 - RNA, 19 nt, Homo sapiens
gcagaaacagugcaaggaa

SEQ ID NO: 558407 - RNA, 19 nt, Homo sapiens
caagaaucauccagaagug

SEQ ID NO: 558408 - RNA, 19 nt, Homo sapiens
gcaagacgguacugauguc

SEQ ID NO: 558409 - RNA, 19 nt, Homo sapiens
ccagaggaauguaugaauc

SEQ ID NO: 558410 - RNA, 19 nt, Homo sapiens
gcaaaucccaugacaaugc

SEQ ID NO: 558411 - RNA, 19 nt, Homo sapiens
uaaucacguugacaaguuu

SEQ ID NO: 558412 - RNA, 19 nt, Homo sapiens
caacuuaaugcucugauau

SEQ ID NO: 558413 - RNA, 19 nt, Homo sapiens
gcugaagccugcaggaaca

SEQ ID NO: 558414 - RNA, 19 nt, Homo sapiens
gcagcgacuuccugguuga

SEQ ID NO: 558415 - RNA, 19 nt, Homo sapiens
ccugggaucugcuuugaga

SEQ ID NO: 558416 - RNA, 19 nt, Homo sapiens
ggcuguagcugucaaaugg

SEQ ID NO: 558417 - RNA, 19 nt, Homo sapiens
gacaaaugcucuguaaguc

SEQ ID NO: 558418 - RNA, 19 nt, Homo sapiens
caaggaggccggauucugu

SEQ ID NO: 558419 - RNA, 19 nt, Homo sapiens
guacuugggcgaugacaug

SEQ ID NO: 558420 - RNA, 19 nt, Homo sapiens
gcacucaugucaggaugug

SEQ ID NO: 558421 - RNA, 19 nt, Homo sapiens
gaagugugggaacagauuu

SEQ ID NO: 558422 - RNA, 19 nt, Homo sapiens
gagaaaggaggcugcauca

SEQ ID NO: 558423 - RNA, 19 nt, Homo sapiens
ucggacaguuugcucauuu

SEQ ID NO: 558424 - RNA, 19 nt, Homo sapiens
aaagugcaaccaacagaua

SEQ ID NO: 558425 - RNA, 19 nt, Homo sapiens
gagcuucgacuccaagaau

SEQ ID NO: 558426 - RNA, 19 nt, Homo sapiens
gaaagcaaagaacugauca

SEQ ID NO: 558427 - RNA, 19 nt, Homo sapiens
ggaaagcaaagaacugauc

SEQ ID NO: 558428 - RNA, 19 nt, Homo sapiens
cagcaguacucagguuuga

SEQ ID NO: 558429 - RNA, 19 nt, Homo sapiens
gaccagcaguacucagguu

SEQ ID NO: 558430 - RNA, 19 nt, Homo sapiens
ugguugagcuucugcuaaa

SEQ ID NO: 558431 - RNA, 19 nt, Homo sapiens
caaugccguuuccauagaa

SEQ ID NO: 558432 - RNA, 19 nt, Homo sapiens
cagaagugcugaauauucg

SEQ ID NO: 558433 - RNA, 19 nt, Homo sapiens
ccagaagugcugaauauuc

SEQ ID NO: 558434 - RNA, 19 nt, Homo sapiens
ugacaaguuuggcuuugga

SEQ ID NO: 558435 - RNA, 19 nt, Homo sapiens
cggacaguuugcucauuua

SEQ ID NO: 558436 - RNA, 19 nt, Homo sapiens
ggacggcuacugcuacaau

SEQ ID NO: 558437 - RNA, 19 nt, Homo sapiens
ccugugaccucccagaguu

SEQ ID NO: 558438 - RNA, 19 nt, Homo sapiens
gcucuuugcuguggacaug

SEQ ID NO: 558439 - RNA, 19 nt, Homo sapiens
gauauggcuuuuagcauuu

SEQ ID NO: 558440 - RNA, 19 nt, Homo sapiens
gaagagcugaugaaguugu

SEQ ID NO: 558441 - RNA, 19 nt, Homo sapiens
ggaaacccacuaucugcaa

SEQ ID NO: 558442 - RNA, 19 nt, Homo sapiens
aagcaaagaacugaucaua

SEQ ID NO: 558443 - RNA, 19 nt, Homo sapiens
gaacgaaggaagagcugau

SEQ ID NO: 558444 - RNA, 19 nt, Homo sapiens
gagagcugcugcacugaag

SEQ ID NO: 558445 - RNA, 19 nt, Homo sapiens
ggucucuggcugcaacuua

SEQ ID NO: 558446 - RNA, 19 nt, Homo sapiens
ccaagaaucauccagaagu

SEQ ID NO: 558447 - RNA, 19 nt, Homo sapiens
gggcagcgacuuccugguu

SEQ ID NO: 558448 - RNA, 19 nt, Homo sapiens
gcauugacucuguggcuuu

SEQ ID NO: 558449 - RNA, 19 nt, Homo sapiens
gggcaccucccuucuguga

SEQ ID NO: 558450 - RNA, 19 nt, Homo sapiens
augaaucgcugcugcaaug

SEQ ID NO: 558451 - RNA, 19 nt, Homo sapiens
ggaagaaggagaggagugu

SEQ ID NO: 558452 - RNA, 19 nt, Homo sapiens
gcguggaaguguggaauga

SEQ ID NO: 558453 - RNA, 19 nt, Homo sapiens
ucucagacaugggcaagaa

SEQ ID NO: 558454 - RNA, 19 nt, Homo sapiens
caccaacccuucauuuaac

SEQ ID NO: 558455 - RNA, 19 nt, Homo sapiens
gucaccaacccuucauuua

SEQ ID NO: 558456 - RNA, 19 nt, Homo sapiens
uaccaaugccguuuccaua

SEQ ID NO: 558457 - RNA, 19 nt, Homo sapiens
ccagaagugugggaacaga

SEQ ID NO: 558458 - RNA, 19 nt, Homo sapiens
cacaugagcugggccacaa

SEQ ID NO: 558459 - RNA, 19 nt, Homo sapiens
ucgcaaaucccaugacaau

SEQ ID NO: 558460 - RNA, 19 nt, Homo sapiens
caaagugugcagauggaaa

SEQ ID NO: 558461 - RNA, 19 nt, Homo sapiens
gcaaagucucgaagaguuc

SEQ ID NO: 558462 - RNA, 19 nt, Homo sapiens
ggacaguuugcucauuuau

SEQ ID NO: 558463 - RNA, 19 nt, Homo sapiens
gaaggaagagcugaugaag

SEQ ID NO: 558464 - RNA, 19 nt, Homo sapiens
gcagacaaccgagaguuuc

SEQ ID NO: 558465 - RNA, 19 nt, Homo sapiens
caaggcaacuaaguaugug

SEQ ID NO: 558466 - RNA, 19 nt, Homo sapiens
ucaaggcaacuaaguaugu

SEQ ID NO: 558467 - RNA, 19 nt, Homo sapiens
ugauauggcuuuuagcauu

SEQ ID NO: 558468 - RNA, 19 nt, Homo sapiens
gcugaauauucgacuacaa

SEQ ID NO: 558469 - RNA, 19 nt, Homo sapiens
cgaaggaagagcugaugaa

SEQ ID NO: 558470 - RNA, 19 nt, Homo sapiens
ugucuuagaaccaaugaaa

SEQ ID NO: 558471 - RNA, 19 nt, Homo sapiens
aaugaaagcuaugucuuag

SEQ ID NO: 558472 - RNA, 19 nt, Homo sapiens
guacggggauauucugauu

SEQ ID NO: 558473 - RNA, 19 nt, Homo sapiens
ucccuucugugacaaguuu

SEQ ID NO: 558474 - RNA, 19 nt, Homo sapiens
gcaacaacaggaagaacug

SEQ ID NO: 558475 - RNA, 19 nt, Homo sapiens
gagaugagagaugcuaaau

SEQ ID NO: 558476 - RNA, 19 nt, Homo sapiens
ccaaaugcgagaugagaga

SEQ ID NO: 558477 - RNA, 19 nt, Homo sapiens
auccagaagugcugaauau

SEQ ID NO: 558478 - RNA, 19 nt, Homo sapiens
ggagaugcauggacagugu

SEQ ID NO: 558479 - RNA, 19 nt, Homo sapiens
ccggaacgcugccuaauuc

SEQ ID NO: 558480 - RNA, 19 nt, Homo sapiens
gagagguccuucacugugu

SEQ ID NO: 558481 - RNA, 19 nt, Homo sapiens
guagccagcucggaacuug

SEQ ID NO: 558482 - RNA, 19 nt, Homo sapiens
ugccagcgauguccaguuu

SEQ ID NO: 558483 - RNA, 19 nt, Homo sapiens
guacacagcaagagcaugu

SEQ ID NO: 558484 - RNA, 19 nt, Homo sapiens
gagcaugugugugccacuu

SEQ ID NO: 558485 - RNA, 19 nt, Homo sapiens
gaccacagaaggagaguug

SEQ ID NO: 558486 - RNA, 19 nt, Homo sapiens
cgcacuagcccaagcaaua

SEQ ID NO: 558487 - RNA, 19 nt, Homo sapiens
cugaggagcugggccauga

SEQ ID NO: 558488 - RNA, 19 nt, Homo sapiens
ccagcgauguccaguuugu

SEQ ID NO: 558489 - RNA, 19 nt, Homo sapiens
gcacuagcccaagcaauag

SEQ ID NO: 558490 - RNA, 19 nt, Homo sapiens
gugaaaaccucaauaaacu

SEQ ID NO: 558491 - RNA, 19 nt, Homo sapiens
gugccagccucccuguaaa

SEQ ID NO: 558492 - RNA, 19 nt, Homo sapiens
ggagaaggagcggcaguug

SEQ ID NO: 558493 - RNA, 19 nt, Homo sapiens
gagaguuggcggucacaga

SEQ ID NO: 558494 - RNA, 19 nt, Homo sapiens
gaacuugccaggccccaaa

SEQ ID NO: 558495 - RNA, 19 nt, Homo sapiens
cgugccagccucccuguaa

SEQ ID NO: 558496 - RNA, 19 nt, Homo sapiens
ggccaccugcggacaguuu

SEQ ID NO: 558497 - RNA, 19 nt, Homo sapiens
gggagagguccuucacugu

SEQ ID NO: 558498 - RNA, 19 nt, Homo sapiens
cagcagagcgagccuugca

SEQ ID NO: 558499 - RNA, 19 nt, Homo sapiens
gugggaagcccuggguuug

SEQ ID NO: 558500 - RNA, 19 nt, Homo sapiens
gggagaaggagcggcaguu

SEQ ID NO: 558501 - RNA, 19 nt, Homo sapiens
gcauggacagugugcucaa

SEQ ID NO: 558502 - RNA, 19 nt, Homo sapiens
gaagaggccuuuggaagaa

SEQ ID NO: 558503 - RNA, 19 nt, Homo sapiens
gaagaaauccagugcaaug

SEQ ID NO: 558504 - RNA, 19 nt, Homo sapiens
cagcaacccuuccaaauuc

SEQ ID NO: 558505 - RNA, 19 nt, Homo sapiens
gagaggcaauaaauaaaug

SEQ ID NO: 558506 - RNA, 19 nt, Homo sapiens
cagaagaaauccagugcaa

SEQ ID NO: 558507 - RNA, 19 nt, Homo sapiens
gaagugaucaggucuuuac

SEQ ID NO: 558508 - RNA, 19 nt, Homo sapiens
gcacagaucgauaccuuuc

SEQ ID NO: 558509 - RNA, 19 nt, Homo sapiens
ggagaggcaauaaauaaau

SEQ ID NO: 558510 - RNA, 19 nt, Homo sapiens
cagaagugaucaggucuuu

SEQ ID NO: 558511 - RNA, 19 nt, Homo sapiens
ccagcaacccuuccaaauu

SEQ ID NO: 558512 - RNA, 19 nt, Homo sapiens
caaguaauccugcacagau

SEQ ID NO: 558513 - RNA, 19 nt, Homo sapiens
ccaaagggaucggguaugg

SEQ ID NO: 558514 - RNA, 19 nt, Homo sapiens
ggaaugggagaggcaauaa

SEQ ID NO: 558515 - RNA, 19 nt, Homo sapiens
ggucuuuacugaauguuag

SEQ ID NO: 558516 - RNA, 19 nt, Homo sapiens
gggagaggcaauaaauaaa

SEQ ID NO: 558517 - RNA, 19 nt, Homo sapiens
ugggagaggcaauaaauaa

SEQ ID NO: 558518 - RNA, 19 nt, Homo sapiens
agaagaggccuuuggaaga

SEQ ID NO: 558519 - RNA, 19 nt, Homo sapiens
gagaagugcccucgaugug

SEQ ID NO: 558520 - RNA, 19 nt, Homo sapiens
gaaggaguuuccacaagac

SEQ ID NO: 558521 - RNA, 19 nt, Homo sapiens
cgucuaccaugcagaagaa

SEQ ID NO: 558522 - RNA, 19 nt, Homo sapiens
gacuugaccuugaccagau

SEQ ID NO: 558523 - RNA, 19 nt, Homo sapiens
gaaugggagaggcaauaaa

SEQ ID NO: 558524 - RNA, 19 nt, Homo sapiens
gaagaggugcgccguuucu

SEQ ID NO: 558525 - RNA, 19 nt, Homo sapiens
agucggagaucuacugcaa

SEQ ID NO: 558526 - RNA, 19 nt, Homo sapiens
cugcacagaucgauaccuu

SEQ ID NO: 558527 - RNA, 19 nt, Homo sapiens
caggcagacuugaccuuga

SEQ ID NO: 558528 - RNA, 19 nt, Homo sapiens
gcgcagauauggccccaaa

SEQ ID NO: 558529 - RNA, 19 nt, Homo sapiens
gugcgccguuucucagauu

SEQ ID NO: 558530 - RNA, 19 nt, Homo sapiens
aauagccucuccuuuguag

SEQ ID NO: 558531 - RNA, 19 nt, Homo sapiens
ugacaaagauggggaacuu

SEQ ID NO: 558532 - RNA, 19 nt, Homo sapiens
gcucaugagucggagaucu

SEQ ID NO: 558533 - RNA, 19 nt, Homo sapiens
augaagaggugcgccguuu

SEQ ID NO: 558534 - RNA, 19 nt, Homo sapiens
ggaaaagaaagaaugaaga

SEQ ID NO: 558535 - RNA, 19 nt, Homo sapiens
ccucuccuuuguagucgua

SEQ ID NO: 558536 - RNA, 19 nt, Homo sapiens
gaccgucuaccaugcagaa

SEQ ID NO: 558537 - RNA, 19 nt, Homo sapiens
aaauagccucuccuuugua

SEQ ID NO: 558538 - RNA, 19 nt, Homo sapiens
gaaaagaaagaaugaagag

SEQ ID NO: 558539 - RNA, 19 nt, Homo sapiens
guuagaagaggccuuugga

SEQ ID NO: 558540 - RNA, 19 nt, Homo sapiens
cacaacaaguggaaaagaa

SEQ ID NO: 558541 - RNA, 19 nt, Homo sapiens
ggccugcaguuccaacagu

SEQ ID NO: 558542 - RNA, 19 nt, Homo sapiens
ccacggguauuggguuugg

SEQ ID NO: 558543 - RNA, 19 nt, Homo sapiens
aaugggagaggcaauaaau

SEQ ID NO: 558544 - RNA, 19 nt, Homo sapiens
aaauguggagccugugaaa

SEQ ID NO: 558545 - RNA, 19 nt, Homo sapiens
ccaaguaauccugcacaga

SEQ ID NO: 558546 - RNA, 19 nt, Homo sapiens
uggaaugggagaggcaaua

SEQ ID NO: 558547 - RNA, 19 nt, Homo sapiens
cgauaccuuuccccaaaua

SEQ ID NO: 558548 - RNA, 19 nt, Homo sapiens
uuggaggccuuacacaaca

SEQ ID NO: 558549 - RNA, 19 nt, Homo sapiens
agucuaugcugcugagaag

SEQ ID NO: 558550 - RNA, 19 nt, Homo sapiens
caccagcaacccuuccaaa

SEQ ID NO: 558551 - RNA, 19 nt, Homo sapiens
gcuaugggcgcagauaugg

SEQ ID NO: 558552 - RNA, 19 nt, Homo sapiens
gauguggcaagucagucua

SEQ ID NO: 558553 - RNA, 19 nt, Homo sapiens
aagccggcacgcucaguua

SEQ ID NO: 558554 - RNA, 19 nt, Homo sapiens
gcucaguuaccaccagcaa

SEQ ID NO: 558555 - RNA, 19 nt, Homo sapiens
gaccuugaccagauagucu

SEQ ID NO: 558556 - RNA, 19 nt, Homo sapiens
aagaggccuuuggaagaaa

SEQ ID NO: 558557 - RNA, 19 nt, Homo sapiens
ucaaagagauggccauuaa

SEQ ID NO: 558558 - RNA, 19 nt, Homo sapiens
ggaaauugcugacucugua

SEQ ID NO: 558559 - RNA, 19 nt, Homo sapiens
ggagaugcauuaugugaaa

SEQ ID NO: 558560 - RNA, 19 nt, Homo sapiens
caaagcaacugccauuuau

SEQ ID NO: 558561 - RNA, 19 nt, Homo sapiens
gauaaaggcuuacuuacuc

SEQ ID NO: 558562 - RNA, 19 nt, Homo sapiens
ugaaguggaugaaauguuu

SEQ ID NO: 558563 - RNA, 19 nt, Homo sapiens
ggaaagagaauauuugguu

SEQ ID NO: 558564 - RNA, 19 nt, Homo sapiens
ggcaagaucuggucaaaga

SEQ ID NO: 558565 - RNA, 19 nt, Homo sapiens
gagaauauuugguuacuca

SEQ ID NO: 558566 - RNA, 19 nt, Homo sapiens
uaaaggcucuaucaaagaa

SEQ ID NO: 558567 - RNA, 19 nt, Homo sapiens
cagcuuaguugauucagua

SEQ ID NO: 558568 - RNA, 19 nt, Homo sapiens
gcucuuggguggucuguaa

SEQ ID NO: 558569 - RNA, 19 nt, Homo sapiens
gccaagagauuaacugaau

SEQ ID NO: 558570 - RNA, 19 nt, Homo sapiens
aaacaaacgggcaagauua

SEQ ID NO: 558571 - RNA, 19 nt, Homo sapiens
gaaacaaacgggcaagauu

SEQ ID NO: 558572 - RNA, 19 nt, Homo sapiens
ggcaacagauaaaggcuua

SEQ ID NO: 558573 - RNA, 19 nt, Homo sapiens
ccaaagcaacugccauuua

SEQ ID NO: 558574 - RNA, 19 nt, Homo sapiens
cgaauuuacugcagugauu

SEQ ID NO: 558575 - RNA, 19 nt, Homo sapiens
gaaguugguguucagcuua

SEQ ID NO: 558576 - RNA, 19 nt, Homo sapiens
ggagaagauuggaaacaug

SEQ ID NO: 558577 - RNA, 19 nt, Homo sapiens
agagauggccauuaacuua

SEQ ID NO: 558578 - RNA, 19 nt, Homo sapiens
gaagaaggaaacauuguga

SEQ ID NO: 558579 - RNA, 19 nt, Homo sapiens
guauauguuuggcucauuu

SEQ ID NO: 558580 - RNA, 19 nt, Homo sapiens
gauaagaaguugguguuca

SEQ ID NO: 558581 - RNA, 19 nt, Homo sapiens
caacugccauuuauugaca

SEQ ID NO: 558582 - RNA, 19 nt, Homo sapiens
gauauucacuaaagaggau

SEQ ID NO: 558583 - RNA, 19 nt, Homo sapiens
guaaaccgcuugccuucau

SEQ ID NO: 558584 - RNA, 19 nt, Homo sapiens
acagauaaaggcuuacuua

SEQ ID NO: 558585 - RNA, 19 nt, Homo sapiens
gauaguagaagaaggagaa

SEQ ID NO: 558586 - RNA, 19 nt, Homo sapiens
caucuucaauuuggguuua

SEQ ID NO: 558587 - RNA, 19 nt, Homo sapiens
caaggaggaucuuuuagua

SEQ ID NO: 558588 - RNA, 19 nt, Homo sapiens
uaugugaaauugagacuga

SEQ ID NO: 558589 - RNA, 19 nt, Homo sapiens
guuucuaucugucuuguuu

SEQ ID NO: 558590 - RNA, 19 nt, Homo sapiens
gcucauaacagucacaaug

SEQ ID NO: 558591 - RNA, 19 nt, Homo sapiens
gaagagucauugccaagag

SEQ ID NO: 558592 - RNA, 19 nt, Homo sapiens
gcacugcucuagauauacu

SEQ ID NO: 558593 - RNA, 19 nt, Homo sapiens
ggacguaauuggagauggu

SEQ ID NO: 558594 - RNA, 19 nt, Homo sapiens
uguaaaggcucuaucaaag

SEQ ID NO: 558595 - RNA, 19 nt, Homo sapiens
cuaaagguauccaggaaau

SEQ ID NO: 558596 - RNA, 19 nt, Homo sapiens
gaaggaaacauugugaaau

SEQ ID NO: 558597 - RNA, 19 nt, Homo sapiens
ccucaaagauaagaaguug

SEQ ID NO: 558598 - RNA, 19 nt, Homo sapiens
gaauuuacugcagugauua

SEQ ID NO: 558599 - RNA, 19 nt, Homo sapiens
cagcagcgccagcucauaa

SEQ ID NO: 558600 - RNA, 19 nt, Homo sapiens
guaaaggcucuaucaaaga

SEQ ID NO: 558601 - RNA, 19 nt, Homo sapiens
gaaauugcugacucuguaa

SEQ ID NO: 558602 - RNA, 19 nt, Homo sapiens
gaaaauuguugccugaaga

SEQ ID NO: 558603 - RNA, 19 nt, Homo sapiens
uuaaacaaaugccagaugu

SEQ ID NO: 558604 - RNA, 19 nt, Homo sapiens
uguguuaucucuugccaaa

SEQ ID NO: 558605 - RNA, 19 nt, Homo sapiens
gaaguggaugaaauguuua

SEQ ID NO: 558606 - RNA, 19 nt, Homo sapiens
gaagauuggaaacauguug

SEQ ID NO: 558607 - RNA, 19 nt, Homo sapiens
cuaauugguuugauaguag

SEQ ID NO: 558608 - RNA, 19 nt, Homo sapiens
cggcuagguucacuaauug

SEQ ID NO: 558609 - RNA, 19 nt, Homo sapiens
gccuaguccucaaagauaa

SEQ ID NO: 558610 - RNA, 19 nt, Homo sapiens
uagguucacuaauugguuu

SEQ ID NO: 558611 - RNA, 19 nt, Homo sapiens
ggaagaaggaaacauugug

SEQ ID NO: 558612 - RNA, 19 nt, Homo sapiens
ccgcuugccuucaucuuga

SEQ ID NO: 558613 - RNA, 19 nt, Homo sapiens
ugagaaggccgucaagaug

SEQ ID NO: 558614 - RNA, 19 nt, Homo sapiens
ggagcuguuuuaaaaguua

SEQ ID NO: 558615 - RNA, 19 nt, Homo sapiens
acaaagcugugguuaccuu

SEQ ID NO: 558616 - RNA, 19 nt, Homo sapiens
ucaaagaaagcaagagaug

SEQ ID NO: 558617 - RNA, 19 nt, Homo sapiens
gagaagauuggaaacaugu

SEQ ID NO: 558618 - RNA, 19 nt, Homo sapiens
gguuauggcaacauuauug

SEQ ID NO: 558619 - RNA, 19 nt, Homo sapiens
ggaaaacaacuugguauuu

SEQ ID NO: 558620 - RNA, 19 nt, Homo sapiens
ugaaauucccaaagacgua

SEQ ID NO: 558621 - RNA, 19 nt, Homo sapiens
uaaagcaaaccuagagaau

SEQ ID NO: 558622 - RNA, 19 nt, Homo sapiens
aaagaaagcaagagaugga

SEQ ID NO: 558623 - RNA, 19 nt, Homo sapiens
aaugccagauguuaaugua

SEQ ID NO: 558624 - RNA, 19 nt, Homo sapiens
guguucagcuuaguugauu

SEQ ID NO: 558625 - RNA, 19 nt, Homo sapiens
cuuacuuacuccaaucaua

SEQ ID NO: 558626 - RNA, 19 nt, Homo sapiens
cagggugucuucaucuuca

SEQ ID NO: 558627 - RNA, 19 nt, Homo sapiens
aagcaacugccauuuauug

SEQ ID NO: 558628 - RNA, 19 nt, Homo sapiens
uacuguaccucaugcauau

SEQ ID NO: 558629 - RNA, 19 nt, Homo sapiens
agaaggagaagauuggaaa

SEQ ID NO: 558630 - RNA, 19 nt, Homo sapiens
acggcuagguucacuaauu

SEQ ID NO: 558631 - RNA, 19 nt, Homo sapiens
gaauauuugguuacucaga

SEQ ID NO: 558632 - RNA, 19 nt, Homo sapiens
ggugagugcuggagaugca

SEQ ID NO: 558633 - RNA, 19 nt, Homo sapiens
aguaugaaguggaugaaau

SEQ ID NO: 558634 - RNA, 19 nt, Homo sapiens
ggaggaucuuuuaguauuu

SEQ ID NO: 558635 - RNA, 19 nt, Homo sapiens
aaagguauccaggaaauug

SEQ ID NO: 558636 - RNA, 19 nt, Homo sapiens
uaaaagaugcugcugcuaa

SEQ ID NO: 558637 - RNA, 19 nt, Homo sapiens
agaaggaaacauugugaaa

SEQ ID NO: 558638 - RNA, 19 nt, Homo sapiens
gcccaaagcaacugccauu

SEQ ID NO: 558639 - RNA, 19 nt, Homo sapiens
gaggaugcucucaaacuug

SEQ ID NO: 558640 - RNA, 19 nt, Homo sapiens
acacauacccgggacacua

SEQ ID NO: 558641 - RNA, 19 nt, Homo sapiens
gauggaaucuuggccaaaa

SEQ ID NO: 558642 - RNA, 19 nt, Homo sapiens
ugacaaagcugugguuacc

SEQ ID NO: 558643 - RNA, 19 nt, Homo sapiens
cuuaguugauucaguaguu

SEQ ID NO: 558644 - RNA, 19 nt, Homo sapiens
gaugcauuaugugaaauug

SEQ ID NO: 558645 - RNA, 19 nt, Homo sapiens
gagaauccuauccgacuug

SEQ ID NO: 558646 - RNA, 19 nt, Homo sapiens
gcaaaccuagagaauccua

SEQ ID NO: 558647 - RNA, 19 nt, Homo sapiens
ccagguuucuuaaaaguuu

SEQ ID NO: 558648 - RNA, 19 nt, Homo sapiens
ccuuggagcuguuuuaaaa

SEQ ID NO: 558649 - RNA, 19 nt, Homo sapiens
agagggaaaugccaaacug

SEQ ID NO: 558650 - RNA, 19 nt, Homo sapiens
uaucaaagaaagcaagaga

SEQ ID NO: 558651 - RNA, 19 nt, Homo sapiens
acaaaugccagauguuaau

SEQ ID NO: 558652 - RNA, 19 nt, Homo sapiens
gugguuaccuuagaugcaa

SEQ ID NO: 558653 - RNA, 19 nt, Homo sapiens
gagauggccauuaacuuag

SEQ ID NO: 558654 - RNA, 19 nt, Homo sapiens
guaugaaguggaugaaaug

SEQ ID NO: 558655 - RNA, 19 nt, Homo sapiens
caguaguuguuaccaagaa

SEQ ID NO: 558656 - RNA, 19 nt, Homo sapiens
ccaggaaauugcugacucu

SEQ ID NO: 558657 - RNA, 19 nt, Homo sapiens
ggaaggaacugaccgacuu

SEQ ID NO: 558658 - RNA, 19 nt, Homo sapiens
cagcuggccuggacaguau

SEQ ID NO: 558659 - RNA, 19 nt, Homo sapiens
cugacaaacuggaagauga

SEQ ID NO: 558660 - RNA, 19 nt, Homo sapiens
caaacuggaagaugagaaa

SEQ ID NO: 558661 - RNA, 19 nt, Homo sapiens
gacaguaucccacauccaa

SEQ ID NO: 558662 - RNA, 19 nt, Homo sapiens
gucaggagcugcaguggau

SEQ ID NO: 558663 - RNA, 19 nt, Homo sapiens
gcggagacccauccucuga

SEQ ID NO: 558664 - RNA, 19 nt, Homo sapiens
uugaggagcugcagaagca

SEQ ID NO: 558665 - RNA, 19 nt, Homo sapiens
cuccaacccuccucgcuuu

SEQ ID NO: 558666 - RNA, 19 nt, Homo sapiens
ggaugguacagccucauuu

SEQ ID NO: 558667 - RNA, 19 nt, Homo sapiens
ccaagcaucaacaccauga

SEQ ID NO: 558668 - RNA, 19 nt, Homo sapiens
gcaggaaccggaggaagga

SEQ ID NO: 558669 - RNA, 19 nt, Homo sapiens
gaugguacagccucauuuc

SEQ ID NO: 558670 - RNA, 19 nt, Homo sapiens
gcagaaggagcgccuagag

SEQ ID NO: 558671 - RNA, 19 nt, Homo sapiens
ccaccgacccaucugcaaa

SEQ ID NO: 558672 - RNA, 19 nt, Homo sapiens
ggcggagacugacaaacug

SEQ ID NO: 558673 - RNA, 19 nt, Homo sapiens
gcucaucgcaagaguagca

SEQ ID NO: 558674 - RNA, 19 nt, Homo sapiens
gaccacacccucccuaacu

SEQ ID NO: 558675 - RNA, 19 nt, Homo sapiens
cacccucccuaacuccuuu

SEQ ID NO: 558676 - RNA, 19 nt, Homo sapiens
cgaaggccuugugaacaga

SEQ ID NO: 558677 - RNA, 19 nt, Homo sapiens
caacccuccucgcuuugug

SEQ ID NO: 558678 - RNA, 19 nt, Homo sapiens
ggagacugacaaacuggaa

SEQ ID NO: 558679 - RNA, 19 nt, Homo sapiens
ucgaaggccuugugaacag

SEQ ID NO: 558680 - RNA, 19 nt, Homo sapiens
guacgucgaaggccuugug

SEQ ID NO: 558681 - RNA, 19 nt, Homo sapiens
gcaggcggagacugacaaa

SEQ ID NO: 558682 - RNA, 19 nt, Homo sapiens
guaaggcgcgagcggaaca

SEQ ID NO: 558683 - RNA, 19 nt, Homo sapiens
uaccuuguaucucccuuuc

SEQ ID NO: 558684 - RNA, 19 nt, Homo sapiens
cagcucaucgcaagaguag

SEQ ID NO: 558685 - RNA, 19 nt, Homo sapiens
gaagcccaccgacccaucu

SEQ ID NO: 558686 - RNA, 19 nt, Homo sapiens
ugaccuacccucaguacag

SEQ ID NO: 558687 - RNA, 19 nt, Homo sapiens
guaccuuguaucucccuuu

SEQ ID NO: 558688 - RNA, 19 nt, Homo sapiens
gaucagcccggaggaagag

SEQ ID NO: 558689 - RNA, 19 nt, Homo sapiens
gcagaaaguuguaaaguuu

SEQ ID NO: 558690 - RNA, 19 nt, Homo sapiens
gaaauacguugagcaguua

SEQ ID NO: 558691 - RNA, 19 nt, Homo sapiens
caaaugguguacagaauua

SEQ ID NO: 558692 - RNA, 19 nt, Homo sapiens
guaagagaauccuauguua

SEQ ID NO: 558693 - RNA, 19 nt, Homo sapiens
gaaugaaguuggucaauau

SEQ ID NO: 558694 - RNA, 19 nt, Homo sapiens
gacacgacgucuuauauua

SEQ ID NO: 558695 - RNA, 19 nt, Homo sapiens
gcaaauagaguggcuaaua

SEQ ID NO: 558696 - RNA, 19 nt, Homo sapiens
uaaacaagcuugcuagaau

SEQ ID NO: 558697 - RNA, 19 nt, Homo sapiens
gcaguuacuuacacuauuu

SEQ ID NO: 558698 - RNA, 19 nt, Homo sapiens
gaacuuaggaggacuuuau

SEQ ID NO: 558699 - RNA, 19 nt, Homo sapiens
uaaagguucucuucaguuu

SEQ ID NO: 558700 - RNA, 19 nt, Homo sapiens
caagagaaaugaaacugaa

SEQ ID NO: 558701 - RNA, 19 nt, Homo sapiens
gcacuacguuauuuagaaa

SEQ ID NO: 558702 - RNA, 19 nt, Homo sapiens
gaaccaagcuuuuaaggaa

SEQ ID NO: 558703 - RNA, 19 nt, Homo sapiens
ggagaaacuugcauucaug

SEQ ID NO: 558704 - RNA, 19 nt, Homo sapiens
ggacaaaguuccuaauggu

SEQ ID NO: 558705 - RNA, 19 nt, Homo sapiens
cgucuaaucuguuaaagaa

SEQ ID NO: 558706 - RNA, 19 nt, Homo sapiens
gaaggugaauuuaaugcaa

SEQ ID NO: 558707 - RNA, 19 nt, Homo sapiens
gaaauagcacucuugguuu

SEQ ID NO: 558708 - RNA, 19 nt, Homo sapiens
caaauagaguggcuaauag

SEQ ID NO: 558709 - RNA, 19 nt, Homo sapiens
caagagauaaggcguauaa

SEQ ID NO: 558710 - RNA, 19 nt, Homo sapiens
gaugauccacgauuucuua

SEQ ID NO: 558711 - RNA, 19 nt, Homo sapiens
caaaguuccuaaugguaua

SEQ ID NO: 558712 - RNA, 19 nt, Homo sapiens
ccaggaagcuaucauacaa

SEQ ID NO: 558713 - RNA, 19 nt, Homo sapiens
gaaacaagacgagaaugua

SEQ ID NO: 558714 - RNA, 19 nt, Homo sapiens
ucauaaagcucauuugaca

SEQ ID NO: 558715 - RNA, 19 nt, Homo sapiens
gcagugguuugaucuguuu

SEQ ID NO: 558716 - RNA, 19 nt, Homo sapiens
gaauaaagguucucuucag

SEQ ID NO: 558717 - RNA, 19 nt, Homo sapiens
agaagagaaugaaggaaua

SEQ ID NO: 558718 - RNA, 19 nt, Homo sapiens
gaaauaugcagaugcuaaa

SEQ ID NO: 558719 - RNA, 19 nt, Homo sapiens
ggguaacacuacauucaua

SEQ ID NO: 558720 - RNA, 19 nt, Homo sapiens
gcacaaauacaucagaaga

SEQ ID NO: 558721 - RNA, 19 nt, Homo sapiens
uuaguaaacucgucaaaga

SEQ ID NO: 558722 - RNA, 19 nt, Homo sapiens
agaaauacguugagcaguu

SEQ ID NO: 558723 - RNA, 19 nt, Homo sapiens
gagcacaaauacaucagaa

SEQ ID NO: 558724 - RNA, 19 nt, Homo sapiens
gcugcagacugaauuagua

SEQ ID NO: 558725 - RNA, 19 nt, Homo sapiens
gaacacaagcacccucgua

SEQ ID NO: 558726 - RNA, 19 nt, Homo sapiens
agagaaagguuuauuugga

SEQ ID NO: 558727 - RNA, 19 nt, Homo sapiens
ggcagaaaguuguaaaguu

SEQ ID NO: 558728 - RNA, 19 nt, Homo sapiens
agaaugaaguuggucaaua

SEQ ID NO: 558729 - RNA, 19 nt, Homo sapiens
ucaagaugauccacgauuu

SEQ ID NO: 558730 - RNA, 19 nt, Homo sapiens
ggcaucaucucaugucaaa

SEQ ID NO: 558731 - RNA, 19 nt, Homo sapiens
ggaaugaacagcagcaaau

SEQ ID NO: 558732 - RNA, 19 nt, Homo sapiens
ccaaagacccagagagaaa

SEQ ID NO: 558733 - RNA, 19 nt, Homo sapiens
caagcuugcuagaauguuu

SEQ ID NO: 558734 - RNA, 19 nt, Homo sapiens
gagaaggcauacuuggauu

SEQ ID NO: 558735 - RNA, 19 nt, Homo sapiens
aaacuugcauucaugaaga

SEQ ID NO: 558736 - RNA, 19 nt, Homo sapiens
caacuacgaauacuaagaa

SEQ ID NO: 558737 - RNA, 19 nt, Homo sapiens
cugaagagauugaagcaaa

SEQ ID NO: 558738 - RNA, 19 nt, Homo sapiens
uaaaugcccuggugacauc

SEQ ID NO: 558739 - RNA, 19 nt, Homo sapiens
gaauguaacuccguugaag

SEQ ID NO: 558740 - RNA, 19 nt, Homo sapiens
gcaguuaagugaaaagaaa

SEQ ID NO: 558741 - RNA, 19 nt, Homo sapiens
ccuaugccauuguuaaauu

SEQ ID NO: 558742 - RNA, 19 nt, Homo sapiens
gaaugaacagcagcaaaua

SEQ ID NO: 558743 - RNA, 19 nt, Homo sapiens
agaaauagcacucuugguu

SEQ ID NO: 558744 - RNA, 19 nt, Homo sapiens
cuacugaacuggaggacuu

SEQ ID NO: 558745 - RNA, 19 nt, Homo sapiens
caauuacugugacauguug

SEQ ID NO: 558746 - RNA, 19 nt, Homo sapiens
gcuaccauauuuaaacuug

SEQ ID NO: 558747 - RNA, 19 nt, Homo sapiens
guaaacagggcagcaauaa

SEQ ID NO: 558748 - RNA, 19 nt, Homo sapiens
caacuugauuggacguuug

SEQ ID NO: 558749 - RNA, 19 nt, Homo sapiens
ggcgacgucuaaucuguua

SEQ ID NO: 558750 - RNA, 19 nt, Homo sapiens
ggaggaacauaucauuagu

SEQ ID NO: 558751 - RNA, 19 nt, Homo sapiens
cagcaaauacuguaaaugu

SEQ ID NO: 558752 - RNA, 19 nt, Homo sapiens
ggaaacggcagauguagau

SEQ ID NO: 558753 - RNA, 19 nt, Homo sapiens
acaaauacaucagaagaga

SEQ ID NO: 558754 - RNA, 19 nt, Homo sapiens
caagucaacucacccaaag

SEQ ID NO: 558755 - RNA, 19 nt, Homo sapiens
gaaguuggucaauaugauu

SEQ ID NO: 558756 - RNA, 19 nt, Homo sapiens
guauagagccaauguugaa

SEQ ID NO: 558757 - RNA, 19 nt, Homo sapiens
guacccaccaggagaaaua

SEQ ID NO: 558758 - RNA, 19 nt, Homo sapiens
aaacaagcuugcuagaaug

SEQ ID NO: 558759 - RNA, 19 nt, Homo sapiens
gauccacgauuucuuacug

SEQ ID NO: 558760 - RNA, 19 nt, Homo sapiens
cuacugacucugagaaaua

SEQ ID NO: 558761 - RNA, 19 nt, Homo sapiens
aaacaagacgagaauguaa

SEQ ID NO: 558762 - RNA, 19 nt, Homo sapiens
cggcagauguagauaauuc

SEQ ID NO: 558763 - RNA, 19 nt, Homo sapiens
gcuaauagagcacaaauac

SEQ ID NO: 558764 - RNA, 19 nt, Homo sapiens
cugagcugcuugccaauua

SEQ ID NO: 558765 - RNA, 19 nt, Homo sapiens
ugaaauaugcagaugcuaa

SEQ ID NO: 558766 - RNA, 19 nt, Homo sapiens
cacaagcacccucguauuu

SEQ ID NO: 558767 - RNA, 19 nt, Homo sapiens
gaugauacggcuuugcuaa

SEQ ID NO: 558768 - RNA, 19 nt, Homo sapiens
guucaacuacgaauacuaa

SEQ ID NO: 558769 - RNA, 19 nt, Homo sapiens
gaugagagaagaagagaau

SEQ ID NO: 558770 - RNA, 19 nt, Homo sapiens
gagcaaauagaguggcuaa

SEQ ID NO: 558771 - RNA, 19 nt, Homo sapiens
cagaaaggaugagagaaga

SEQ ID NO: 558772 - RNA, 19 nt, Homo sapiens
caucucaugucaaauggaa

SEQ ID NO: 558773 - RNA, 19 nt, Homo sapiens
ugaaagacuuggaggaaca

SEQ ID NO: 558774 - RNA, 19 nt, Homo sapiens
gcugguacaugcugagaga

SEQ ID NO: 558775 - RNA, 19 nt, Homo sapiens
gcaaauacuguaaauguac

SEQ ID NO: 558776 - RNA, 19 nt, Homo sapiens
agagugagcuggucaaugc

SEQ ID NO: 558777 - RNA, 19 nt, Homo sapiens
uaaaguuugugcugagaga

SEQ ID NO: 558778 - RNA, 19 nt, Homo sapiens
ucaauaugauuuggaggua

SEQ ID NO: 558779 - RNA, 19 nt, Homo sapiens
cugaaacuauuacuacuga

SEQ ID NO: 558780 - RNA, 19 nt, Homo sapiens
ccaggaaucuguuacaaaa

SEQ ID NO: 558781 - RNA, 19 nt, Homo sapiens
aaauagcacucuugguuuc

SEQ ID NO: 558782 - RNA, 19 nt, Homo sapiens
agacaucucugccgauagu

SEQ ID NO: 558783 - RNA, 19 nt, Homo sapiens
gagacuaucuuagcugagu

SEQ ID NO: 558784 - RNA, 19 nt, Homo sapiens
ggaagacaguauuguucga

SEQ ID NO: 558785 - RNA, 19 nt, Homo sapiens
gguaaacagggcagcaaua

SEQ ID NO: 558786 - RNA, 19 nt, Homo sapiens
aaccaggaguucaguuuaa

SEQ ID NO: 558787 - RNA, 19 nt, Homo sapiens
gugcuggccuggcagauau

SEQ ID NO: 558788 - RNA, 19 nt, Homo sapiens
caaaggaggaaacaggaaa

SEQ ID NO: 558789 - RNA, 19 nt, Homo sapiens
ccaaacagcugcuuuauuu

SEQ ID NO: 558790 - RNA, 19 nt, Homo sapiens
gauaguagaugauugguua

SEQ ID NO: 558791 - RNA, 19 nt, Homo sapiens
gaauauacguugcacauuu

SEQ ID NO: 558792 - RNA, 19 nt, Homo sapiens
gagagaagcuucauaagga

SEQ ID NO: 558793 - RNA, 19 nt, Homo sapiens
gaugauaccucacauguug

SEQ ID NO: 558794 - RNA, 19 nt, Homo sapiens
ggagcacacucuuccauua

SEQ ID NO: 558795 - RNA, 19 nt, Homo sapiens
guaaacaaguggaaaguga

SEQ ID NO: 558796 - RNA, 19 nt, Homo sapiens
caacaaugaugccuaguga

SEQ ID NO: 558797 - RNA, 19 nt, Homo sapiens
cgauuacgcuucagagaua

SEQ ID NO: 558798 - RNA, 19 nt, Homo sapiens
ggacuuguacucugaauuu

SEQ ID NO: 558799 - RNA, 19 nt, Homo sapiens
caaugaagcuaagugguua

SEQ ID NO: 558800 - RNA, 19 nt, Homo sapiens
gaagaugcaguucaguuua

SEQ ID NO: 558801 - RNA, 19 nt, Homo sapiens
ugauaaagcuccaguugaa

SEQ ID NO: 558802 - RNA, 19 nt, Homo sapiens
gagacuggccucagaaaua

SEQ ID NO: 558803 - RNA, 19 nt, Homo sapiens
uaagauagaugguguugau

SEQ ID NO: 558804 - RNA, 19 nt, Homo sapiens
gaaaugugaaucuggaaua

SEQ ID NO: 558805 - RNA, 19 nt, Homo sapiens
gagaaaugcuugugguaug

SEQ ID NO: 558806 - RNA, 19 nt, Homo sapiens
ggauucaaguggauucuaa

SEQ ID NO: 558807 - RNA, 19 nt, Homo sapiens
agagaaugcugguagcuua

SEQ ID NO: 558808 - RNA, 19 nt, Homo sapiens
gaaaggguguucauguuag

SEQ ID NO: 558809 - RNA, 19 nt, Homo sapiens
gaggguuggugguauauuu

SEQ ID NO: 558810 - RNA, 19 nt, Homo sapiens
gaugucagauugauuugaa

SEQ ID NO: 558811 - RNA, 19 nt, Homo sapiens
caaaauaggucucuaagga

SEQ ID NO: 558812 - RNA, 19 nt, Homo sapiens
gcaacaauagauuccauua

SEQ ID NO: 558813 - RNA, 19 nt, Homo sapiens
ggagaaggauguauaaagc

SEQ ID NO: 558814 - RNA, 19 nt, Homo sapiens
gcugguagcuuaaaauuuu

SEQ ID NO: 558815 - RNA, 19 nt, Homo sapiens
gaacagaccgggaccuugu

SEQ ID NO: 558816 - RNA, 19 nt, Homo sapiens
aguaaaggcugcuuaaguu

SEQ ID NO: 558817 - RNA, 19 nt, Homo sapiens
auagagagaugucagauug

SEQ ID NO: 558818 - RNA, 19 nt, Homo sapiens
gaagccaguuugacauaga

SEQ ID NO: 558819 - RNA, 19 nt, Homo sapiens
gaauucuucucuucccuaa

SEQ ID NO: 558820 - RNA, 19 nt, Homo sapiens
gcacuugcuuugauugaau

SEQ ID NO: 558821 - RNA, 19 nt, Homo sapiens
gaagagagacaucgugcaa

SEQ ID NO: 558822 - RNA, 19 nt, Homo sapiens
uuugaaaucuccugucuuu

SEQ ID NO: 558823 - RNA, 19 nt, Homo sapiens
agaaggaaauguaaacgaa

SEQ ID NO: 558824 - RNA, 19 nt, Homo sapiens
ucaaguggauucuaaauac

SEQ ID NO: 558825 - RNA, 19 nt, Homo sapiens
caaaggagcagcagcaaau

SEQ ID NO: 558826 - RNA, 19 nt, Homo sapiens
aaauaggucucuaaggaaa

SEQ ID NO: 558827 - RNA, 19 nt, Homo sapiens
cuaaucagauaguagauga

SEQ ID NO: 558828 - RNA, 19 nt, Homo sapiens
ggaaugaaguacgaagaug

SEQ ID NO: 558829 - RNA, 19 nt, Homo sapiens
ggagucucuucucaacuua

SEQ ID NO: 558830 - RNA, 19 nt, Homo sapiens
gagaaauaccgaccuaaga

SEQ ID NO: 558831 - RNA, 19 nt, Homo sapiens
uaacuaaacgcaaaucugu

SEQ ID NO: 558832 - RNA, 19 nt, Homo sapiens
uaugugaacugccuauuuc

SEQ ID NO: 558833 - RNA, 19 nt, Homo sapiens
gcacauuuauggcgauucu

SEQ ID NO: 558834 - RNA, 19 nt, Homo sapiens
caaccacucuccuaaugau

SEQ ID NO: 558835 - RNA, 19 nt, Homo sapiens
gagaaaacacugauugaua

SEQ ID NO: 558836 - RNA, 19 nt, Homo sapiens
guacgaagaugcaguucag

SEQ ID NO: 558837 - RNA, 19 nt, Homo sapiens
gaaguacgaagaugcaguu

SEQ ID NO: 558838 - RNA, 19 nt, Homo sapiens
gaaauaccgaccuaagaug

SEQ ID NO: 558839 - RNA, 19 nt, Homo sapiens
gaagcuucauaaggaauaa

SEQ ID NO: 558840 - RNA, 19 nt, Homo sapiens
ggacuguguugcuugugaa

SEQ ID NO: 558841 - RNA, 19 nt, Homo sapiens
aacgaaggcugacuugauu

SEQ ID NO: 558842 - RNA, 19 nt, Homo sapiens
gcaguucaguuuauaagac

SEQ ID NO: 558843 - RNA, 19 nt, Homo sapiens
cgaagaugcaguucaguuu

SEQ ID NO: 558844 - RNA, 19 nt, Homo sapiens
gagccagguugcuguguug

SEQ ID NO: 558845 - RNA, 19 nt, Homo sapiens
gaauacgggcuuaaaguca

SEQ ID NO: 558846 - RNA, 19 nt, Homo sapiens
gaagcgguguaguagcauu

SEQ ID NO: 558847 - RNA, 19 nt, Homo sapiens
ggaauagaagcccuuguug

SEQ ID NO: 558848 - RNA, 19 nt, Homo sapiens
ucaaaguagugauggauuc

SEQ ID NO: 558849 - RNA, 19 nt, Homo sapiens
ucacagaggaacuuaagaa

SEQ ID NO: 558850 - RNA, 19 nt, Homo sapiens
guaaaggcugcuuaaguuu

SEQ ID NO: 558851 - RNA, 19 nt, Homo sapiens
ccaaugaagcuaagugguu

SEQ ID NO: 558852 - RNA, 19 nt, Homo sapiens
gcauugcuguguucaguag

SEQ ID NO: 558853 - RNA, 19 nt, Homo sapiens
ucucuucccuaaccaauga

SEQ ID NO: 558854 - RNA, 19 nt, Homo sapiens
gauugaauguggaaugaag

SEQ ID NO: 558855 - RNA, 19 nt, Homo sapiens
agagaugucagauugauuu

SEQ ID NO: 558856 - RNA, 19 nt, Homo sapiens
gugaagcgguguaguagca

SEQ ID NO: 558857 - RNA, 19 nt, Homo sapiens
gggacuguguugcuuguga

SEQ ID NO: 558858 - RNA, 19 nt, Homo sapiens
ggacuccaggccaucaaua

SEQ ID NO: 558859 - RNA, 19 nt, Homo sapiens
gaaaaccagcagaacauua

SEQ ID NO: 558860 - RNA, 19 nt, Homo sapiens
ugccaggauugaauuauuu

SEQ ID NO: 558861 - RNA, 19 nt, Homo sapiens
aauauuaccugugucauca

SEQ ID NO: 558862 - RNA, 19 nt, Homo sapiens
gaauauuaccugugucauc

SEQ ID NO: 558863 - RNA, 19 nt, Homo sapiens
ggaaggcaguuaugaucag

SEQ ID NO: 558864 - RNA, 19 nt, Homo sapiens
agaaggauguauaaagcaa

SEQ ID NO: 558865 - RNA, 19 nt, Homo sapiens
gagcuuggagguucuaugu

SEQ ID NO: 558866 - RNA, 19 nt, Homo sapiens
ccaagagccuuuuguuuug

SEQ ID NO: 558867 - RNA, 19 nt, Homo sapiens
gagcacacucuuccauuau

SEQ ID NO: 558868 - RNA, 19 nt, Homo sapiens
gaaggaauccacguucuag

SEQ ID NO: 558869 - RNA, 19 nt, Homo sapiens
ucacuagugccuaaaugua

SEQ ID NO: 558870 - RNA, 19 nt, Homo sapiens
gaccuugucucacacugau

SEQ ID NO: 558871 - RNA, 19 nt, Homo sapiens
uuaguguacugaucuagaa

SEQ ID NO: 558872 - RNA, 19 nt, Homo sapiens
gcaacccaaugaguaguga

SEQ ID NO: 558873 - RNA, 19 nt, Homo sapiens
ugacuugauugugccauuu

SEQ ID NO: 558874 - RNA, 19 nt, Homo sapiens
gaccuacacuuuuaacuug

SEQ ID NO: 558875 - RNA, 19 nt, Homo sapiens
ggagaaauaccgaccuaag

SEQ ID NO: 558876 - RNA, 19 nt, Homo sapiens
auugugggcuguagcguua

SEQ ID NO: 558877 - RNA, 19 nt, Homo sapiens
aagaugcaguucaguuuau

SEQ ID NO: 558878 - RNA, 19 nt, Homo sapiens
uagauuggccauuugauga

SEQ ID NO: 558879 - RNA, 19 nt, Homo sapiens
gugccuaaauguaguaaag

SEQ ID NO: 558880 - RNA, 19 nt, Homo sapiens
ugaacugccuauuuccuau

SEQ ID NO: 558881 - RNA, 19 nt, Homo sapiens
agacuggccucagaaauag

SEQ ID NO: 558882 - RNA, 19 nt, Homo sapiens
aaugaugccuagugaguau

SEQ ID NO: 558883 - RNA, 19 nt, Homo sapiens
gagaaugcugguagcuuaa

SEQ ID NO: 558884 - RNA, 19 nt, Homo sapiens
aaacgaaggcugacuugau

SEQ ID NO: 558885 - RNA, 19 nt, Homo sapiens
aguuguagauggaauagaa

SEQ ID NO: 558886 - RNA, 19 nt, Homo sapiens
gaacauuaggccugugcaa

SEQ ID NO: 558887 - RNA, 19 nt, Homo sapiens
gggcauugcuguguucagu

SEQ ID NO: 558888 - RNA, 19 nt, Homo sapiens
guucuagauuggccauuug

SEQ ID NO: 558889 - RNA, 19 nt, Homo sapiens
ccaaacagcugcuuuauuu

SEQ ID NO: 558890 - RNA, 19 nt, Homo sapiens
gauaguagaugauugguua

SEQ ID NO: 558891 - RNA, 19 nt, Homo sapiens
gaauauacguugcacauuu

SEQ ID NO: 558892 - RNA, 19 nt, Homo sapiens
gagagaagcuucauaagga

SEQ ID NO: 558893 - RNA, 19 nt, Homo sapiens
guaaacaaguggaaaguga

SEQ ID NO: 558894 - RNA, 19 nt, Homo sapiens
cgauuacgcuucagagaua

SEQ ID NO: 558895 - RNA, 19 nt, Homo sapiens
gaagaugcaguucaguuua

SEQ ID NO: 558896 - RNA, 19 nt, Homo sapiens
ugauaaagcuccaguugaa

SEQ ID NO: 558897 - RNA, 19 nt, Homo sapiens
gagacuggccucagaaaua

SEQ ID NO: 558898 - RNA, 19 nt, Homo sapiens
gaaaugugaaucuggaaua

SEQ ID NO: 558899 - RNA, 19 nt, Homo sapiens
ggauucaaguggauucuaa

SEQ ID NO: 558900 - RNA, 19 nt, Homo sapiens
gaggguuggugguauauuu

SEQ ID NO: 558901 - RNA, 19 nt, Homo sapiens
caaaauaggucucuaagga

SEQ ID NO: 558902 - RNA, 19 nt, Homo sapiens
aguaaaggcugcuuaaguu

SEQ ID NO: 558903 - RNA, 19 nt, Homo sapiens
gcacuugcuuugauugaau

SEQ ID NO: 558904 - RNA, 19 nt, Homo sapiens
uuugaaaucuccugucuuu

SEQ ID NO: 558905 - RNA, 19 nt, Homo sapiens
agaaggaaauguaaacgaa

SEQ ID NO: 558906 - RNA, 19 nt, Homo sapiens
ucaaguggauucuaaauac

SEQ ID NO: 558907 - RNA, 19 nt, Homo sapiens
aaauaggucucuaaggaaa

SEQ ID NO: 558908 - RNA, 19 nt, Homo sapiens
cuaaucagauaguagauga

SEQ ID NO: 558909 - RNA, 19 nt, Homo sapiens
ggaaugaaguacgaagaug

SEQ ID NO: 558910 - RNA, 19 nt, Homo sapiens
gagaaauaccgaccuaaga

SEQ ID NO: 558911 - RNA, 19 nt, Homo sapiens
caaccacucuccuaaugau

SEQ ID NO: 558912 - RNA, 19 nt, Homo sapiens
gcacauuuauggcgauucu

SEQ ID NO: 558913 - RNA, 19 nt, Homo sapiens
gagaaaacacugauugaua

SEQ ID NO: 558914 - RNA, 19 nt, Homo sapiens
guacgaagaugcaguucag

SEQ ID NO: 558915 - RNA, 19 nt, Homo sapiens
gaaguacgaagaugcaguu

SEQ ID NO: 558916 - RNA, 19 nt, Homo sapiens
gaaauaccgaccuaagaug

SEQ ID NO: 558917 - RNA, 19 nt, Homo sapiens
gaagcuucauaaggaauaa

SEQ ID NO: 558918 - RNA, 19 nt, Homo sapiens
aacgaaggcugacuugauu

SEQ ID NO: 558919 - RNA, 19 nt, Homo sapiens
gcaguucaguuuauaagac

SEQ ID NO: 558920 - RNA, 19 nt, Homo sapiens
cgaagaugcaguucaguuu

SEQ ID NO: 558921 - RNA, 19 nt, Homo sapiens
gagccagguugcuguguug

SEQ ID NO: 558922 - RNA, 19 nt, Homo sapiens
ggaauagaagcccuuguug

SEQ ID NO: 558923 - RNA, 19 nt, Homo sapiens
ucaaaguagugauggauuc

SEQ ID NO: 558924 - RNA, 19 nt, Homo sapiens
ucacagaggaacuuaagaa

SEQ ID NO: 558925 - RNA, 19 nt, Homo sapiens
guaaaggcugcuuaaguuu

SEQ ID NO: 558926 - RNA, 19 nt, Homo sapiens
gcauugcuguguucaguag

SEQ ID NO: 558927 - RNA, 19 nt, Homo sapiens
gauugaauguggaaugaag

SEQ ID NO: 558928 - RNA, 19 nt, Homo sapiens
gaaaaccagcagaacauua

SEQ ID NO: 558929 - RNA, 19 nt, Homo sapiens
ugccaggauugaauuauuu

SEQ ID NO: 558930 - RNA, 19 nt, Homo sapiens
aauauuaccugugucauca

SEQ ID NO: 558931 - RNA, 19 nt, Homo sapiens
gaauauuaccugugucauc

SEQ ID NO: 558932 - RNA, 19 nt, Homo sapiens
gaaggaauccacguucuag

SEQ ID NO: 558933 - RNA, 19 nt, Homo sapiens
gagcuuggagguucuaugu

SEQ ID NO: 558934 - RNA, 19 nt, Homo sapiens
ucacuagugccuaaaugua

SEQ ID NO: 558935 - RNA, 19 nt, Homo sapiens
ugacuugauugugccauuu

SEQ ID NO: 558936 - RNA, 19 nt, Homo sapiens
ggagaaauaccgaccuaag

SEQ ID NO: 558937 - RNA, 19 nt, Homo sapiens
gaccuacacuuuuaacuug

SEQ ID NO: 558938 - RNA, 19 nt, Homo sapiens
aagaugcaguucaguuuau

SEQ ID NO: 558939 - RNA, 19 nt, Homo sapiens
uagauuggccauuugauga

SEQ ID NO: 558940 - RNA, 19 nt, Homo sapiens
gugccuaaauguaguaaag

SEQ ID NO: 558941 - RNA, 19 nt, Homo sapiens
aaacgaaggcugacuugau

SEQ ID NO: 558942 - RNA, 19 nt, Homo sapiens
agacuggccucagaaauag

SEQ ID NO: 558943 - RNA, 19 nt, Homo sapiens
aguuguagauggaauagaa

SEQ ID NO: 558944 - RNA, 19 nt, Homo sapiens
gcacacucuuggcacauag

SEQ ID NO: 558945 - RNA, 19 nt, Homo sapiens
gaacauuaggccugugcaa

SEQ ID NO: 558946 - RNA, 19 nt, Homo sapiens
gggcauugcuguguucagu

SEQ ID NO: 558947 - RNA, 19 nt, Homo sapiens
guucuagauuggccauuug

SEQ ID NO: 558948 - RNA, 19 nt, Homo sapiens
aguauggagugacgacuuu

SEQ ID NO: 558949 - RNA, 19 nt, Homo sapiens
agagaagcuucauaaggaa

SEQ ID NO: 558950 - RNA, 19 nt, Homo sapiens
ggaauauacguugcacauu

SEQ ID NO: 558951 - RNA, 19 nt, Homo sapiens
gauaaagcuccaguugaaa

SEQ ID NO: 558952 - RNA, 19 nt, Homo sapiens
cgaggugacugaggagaga

SEQ ID NO: 558953 - RNA, 19 nt, Homo sapiens
ccaaugcuacucucaacaa

SEQ ID NO: 558954 - RNA, 19 nt, Homo sapiens
ccaaguuguagauggaaua

SEQ ID NO: 558955 - RNA, 19 nt, Homo sapiens
caccgagacuggccucaga

SEQ ID NO: 558956 - RNA, 19 nt, Homo sapiens
cgacuuugguucgaguuug

SEQ ID NO: 558957 - RNA, 19 nt, Homo sapiens
gaauuucugccaggauuga

SEQ ID NO: 558958 - RNA, 19 nt, Homo sapiens
guaaacgaaggcugacuug

SEQ ID NO: 558959 - RNA, 19 nt, Homo sapiens
aaaccaaauuucgugaaga

SEQ ID NO: 558960 - RNA, 19 nt, Homo sapiens
gaguuugugaugcuacaua

SEQ ID NO: 558961 - RNA, 19 nt, Homo sapiens
caacaaguucacagaggaa

SEQ ID NO: 558962 - RNA, 19 nt, Homo sapiens
gauaauaggcauuuuagug

SEQ ID NO: 558963 - RNA, 19 nt, Homo sapiens
cugccaggauugaauuauu

SEQ ID NO: 558964 - RNA, 19 nt, Homo sapiens
ggaaaugugaaucuggaau

SEQ ID NO: 558965 - RNA, 19 nt, Homo sapiens
ucaguagaaggaaauguaa

SEQ ID NO: 558966 - RNA, 19 nt, Homo sapiens
aagaugcgauuacgcuuca

SEQ ID NO: 558967 - RNA, 19 nt, Homo sapiens
agaaauaccgaccuaagau

SEQ ID NO: 558968 - RNA, 19 nt, Homo sapiens
augcuacucucaacaaguu

SEQ ID NO: 558969 - RNA, 19 nt, Homo sapiens
ucuggaauauuaccugugu

SEQ ID NO: 558970 - RNA, 19 nt, Homo sapiens
gacuugauugugccauuua

SEQ ID NO: 558971 - RNA, 19 nt, Homo sapiens
ccaguaaaauuaagcauca

SEQ ID NO: 558972 - RNA, 19 nt, Homo sapiens
aaacagcugcuuuauuugg

SEQ ID NO: 558973 - RNA, 19 nt, Homo sapiens
agaugcaguucaguuuaua

SEQ ID NO: 558974 - RNA, 19 nt, Homo sapiens
gugaugcuacauaugauaa

SEQ ID NO: 558975 - RNA, 19 nt, Homo sapiens
caaguggauucuaaauacu

SEQ ID NO: 558976 - RNA, 19 nt, Homo sapiens
uauuaccugugucaucaaa

SEQ ID NO: 558977 - RNA, 19 nt, Homo sapiens
caaguaaacaaguggaaag

SEQ ID NO: 558978 - RNA, 19 nt, Homo sapiens
gguugcacuugcuuugauu

SEQ ID NO: 558979 - RNA, 19 nt, Homo sapiens
uaugauaaagcuccaguug

SEQ ID NO: 558980 - RNA, 19 nt, Homo sapiens
cuuaagaaguauggaguga

SEQ ID NO: 558981 - RNA, 19 nt, Homo sapiens
gcgauuacgcuucagagau

SEQ ID NO: 558982 - RNA, 19 nt, Homo sapiens
gaugcaguucaguuuauaa

SEQ ID NO: 558983 - RNA, 19 nt, Homo sapiens
gaugcuacauaugauaaag

SEQ ID NO: 558984 - RNA, 19 nt, Homo sapiens
acacgcacgcucacacuuu

SEQ ID NO: 558985 - RNA, 19 nt, Homo sapiens
uugaauuucugccaggauu

SEQ ID NO: 558986 - RNA, 19 nt, Homo sapiens
cuugguaccuggaaaugug

SEQ ID NO: 558987 - RNA, 19 nt, Homo sapiens
uggaauagaagcccuuguu

SEQ ID NO: 558988 - RNA, 19 nt, Homo sapiens
cucaaccacucuccuaaug

SEQ ID NO: 558989 - RNA, 19 nt, Homo sapiens
ccaaacagcugcuuuauuu

SEQ ID NO: 558990 - RNA, 19 nt, Homo sapiens
gaauauacguugcacauuu

SEQ ID NO: 558991 - RNA, 19 nt, Homo sapiens
gagagaagcuucauaagga

SEQ ID NO: 558992 - RNA, 19 nt, Homo sapiens
guaaacaaguggaaaguga

SEQ ID NO: 558993 - RNA, 19 nt, Homo sapiens
cgauuacgcuucagagaua

SEQ ID NO: 558994 - RNA, 19 nt, Homo sapiens
ugauaaagcuccaguugaa

SEQ ID NO: 558995 - RNA, 19 nt, Homo sapiens
gagacuggccucagaaaua

SEQ ID NO: 558996 - RNA, 19 nt, Homo sapiens
gaaaugugaaucuggaaua

SEQ ID NO: 558997 - RNA, 19 nt, Homo sapiens
ggauucaaguggauucuaa

SEQ ID NO: 558998 - RNA, 19 nt, Homo sapiens
caaaauaggucucuaagga

SEQ ID NO: 558999 - RNA, 19 nt, Homo sapiens
gaaggaauccacguucuaa

SEQ ID NO: 559000 - RNA, 19 nt, Homo sapiens
aguaaaggcugcuuaaguu

SEQ ID NO: 559001 - RNA, 19 nt, Homo sapiens
uuugaaaucuccugucuuu

SEQ ID NO: 559002 - RNA, 19 nt, Homo sapiens
agaaggaaauguaaacgaa

SEQ ID NO: 559003 - RNA, 19 nt, Homo sapiens
ucaaguggauucuaaauac

SEQ ID NO: 559004 - RNA, 19 nt, Homo sapiens
aaauaggucucuaaggaaa

SEQ ID NO: 559005 - RNA, 19 nt, Homo sapiens
gagaaauaccgaccuaaga

SEQ ID NO: 559006 - RNA, 19 nt, Homo sapiens
caaccacucuccuaaugau

SEQ ID NO: 559007 - RNA, 19 nt, Homo sapiens
gcacauuuauggcgauucu

SEQ ID NO: 559008 - RNA, 19 nt, Homo sapiens
gagaaaacacugauugaua

SEQ ID NO: 559009 - RNA, 19 nt, Homo sapiens
gaaauaccgaccuaagaug

SEQ ID NO: 559010 - RNA, 19 nt, Homo sapiens
gaagcuucauaaggaauaa

SEQ ID NO: 559011 - RNA, 19 nt, Homo sapiens
aacgaaggcugacuugauu

SEQ ID NO: 559012 - RNA, 19 nt, Homo sapiens
ucaaaguagugauggauuc

SEQ ID NO: 559013 - RNA, 19 nt, Homo sapiens
ucacagaggaacuuaagaa

SEQ ID NO: 559014 - RNA, 19 nt, Homo sapiens
guaaaggcugcuuaaguuu

SEQ ID NO: 559015 - RNA, 19 nt, Homo sapiens
gcauugcuguguucaguag

SEQ ID NO: 559016 - RNA, 19 nt, Homo sapiens
gaaaaccagcagaacauua

SEQ ID NO: 559017 - RNA, 19 nt, Homo sapiens
ugccaggauugaauuauuu

SEQ ID NO: 559018 - RNA, 19 nt, Homo sapiens
aauauuaccugugucauca

SEQ ID NO: 559019 - RNA, 19 nt, Homo sapiens
gaauauuaccugugucauc

SEQ ID NO: 559020 - RNA, 19 nt, Homo sapiens
ucacuagugccuaaaugua

SEQ ID NO: 559021 - RNA, 19 nt, Homo sapiens
gagcuuggagguucuaugu

SEQ ID NO: 559022 - RNA, 19 nt, Homo sapiens
ugacuugauugugccauuu

SEQ ID NO: 559023 - RNA, 19 nt, Homo sapiens
ggagaaauaccgaccuaag

SEQ ID NO: 559024 - RNA, 19 nt, Homo sapiens
gaccuacacuuuuaacuug

SEQ ID NO: 559025 - RNA, 19 nt, Homo sapiens
gugccuaaauguaguaaag

SEQ ID NO: 559026 - RNA, 19 nt, Homo sapiens
aaacgaaggcugacuugau

SEQ ID NO: 559027 - RNA, 19 nt, Homo sapiens
agacuggccucagaaauag

SEQ ID NO: 559028 - RNA, 19 nt, Homo sapiens
gaacauuaggccugugcaa

SEQ ID NO: 559029 - RNA, 19 nt, Homo sapiens
gggcauugcuguguucagu

SEQ ID NO: 559030 - RNA, 19 nt, Homo sapiens
ggaauauacguugcacauu

SEQ ID NO: 559031 - RNA, 19 nt, Homo sapiens
aguauggagugacgacuuu

SEQ ID NO: 559032 - RNA, 19 nt, Homo sapiens
agagaagcuucauaaggaa

SEQ ID NO: 559033 - RNA, 19 nt, Homo sapiens
cgaggugacugaggagaga

SEQ ID NO: 559034 - RNA, 19 nt, Homo sapiens
gauaaagcuccaguugaaa

SEQ ID NO: 559035 - RNA, 19 nt, Homo sapiens
ccaaugcuacucucaacaa

SEQ ID NO: 559036 - RNA, 19 nt, Homo sapiens
cgacuuugguucgaguuug

SEQ ID NO: 559037 - RNA, 19 nt, Homo sapiens
caccgagacuggccucaga

SEQ ID NO: 559038 - RNA, 19 nt, Homo sapiens
gaauuucugccaggauuga

SEQ ID NO: 559039 - RNA, 19 nt, Homo sapiens
guaaacgaaggcugacuug

SEQ ID NO: 559040 - RNA, 19 nt, Homo sapiens
gaguuugugaugcuacaua

SEQ ID NO: 559041 - RNA, 19 nt, Homo sapiens
caacaaguucacagaggaa

SEQ ID NO: 559042 - RNA, 19 nt, Homo sapiens
gauaauaggcauuuuagug

SEQ ID NO: 559043 - RNA, 19 nt, Homo sapiens
cugccaggauugaauuauu

SEQ ID NO: 559044 - RNA, 19 nt, Homo sapiens
ggaaaugugaaucuggaau

SEQ ID NO: 559045 - RNA, 19 nt, Homo sapiens
ucaguagaaggaaauguaa

SEQ ID NO: 559046 - RNA, 19 nt, Homo sapiens
aagaugcgauuacgcuuca

SEQ ID NO: 559047 - RNA, 19 nt, Homo sapiens
agaaauaccgaccuaagau

SEQ ID NO: 559048 - RNA, 19 nt, Homo sapiens
augcuacucucaacaaguu

SEQ ID NO: 559049 - RNA, 19 nt, Homo sapiens
ucuggaauauuaccugugu

SEQ ID NO: 559050 - RNA, 19 nt, Homo sapiens
gacuugauugugccauuua

SEQ ID NO: 559051 - RNA, 19 nt, Homo sapiens
aaacagcugcuuuauuugg

SEQ ID NO: 559052 - RNA, 19 nt, Homo sapiens
gugaugcuacauaugauaa

SEQ ID NO: 559053 - RNA, 19 nt, Homo sapiens
caaguggauucuaaauacu

SEQ ID NO: 559054 - RNA, 19 nt, Homo sapiens
ccaguaaaauuaagcauca

SEQ ID NO: 559055 - RNA, 19 nt, Homo sapiens
uauuaccugugucaucaaa

SEQ ID NO: 559056 - RNA, 19 nt, Homo sapiens
uaugauaaagcuccaguug

SEQ ID NO: 559057 - RNA, 19 nt, Homo sapiens
cuuaagaaguauggaguga

SEQ ID NO: 559058 - RNA, 19 nt, Homo sapiens
caaguaaacaaguggaaag

SEQ ID NO: 559059 - RNA, 19 nt, Homo sapiens
gcgauuacgcuucagagau

SEQ ID NO: 559060 - RNA, 19 nt, Homo sapiens
gaugcuacauaugauaaag

SEQ ID NO: 559061 - RNA, 19 nt, Homo sapiens
acacgcacgcucacacuuu

SEQ ID NO: 559062 - RNA, 19 nt, Homo sapiens
uugaauuucugccaggauu

SEQ ID NO: 559063 - RNA, 19 nt, Homo sapiens
cuugguaccuggaaaugug

SEQ ID NO: 559064 - RNA, 19 nt, Homo sapiens
cucaaccacucuccuaaug

SEQ ID NO: 559065 - RNA, 19 nt, Homo sapiens
gacuuugguucgaguuugu

SEQ ID NO: 559066 - RNA, 19 nt, Homo sapiens
ucacaacccuaccaaugcu

SEQ ID NO: 559067 - RNA, 19 nt, Homo sapiens
gaacucuugguaccuggaa

SEQ ID NO: 559068 - RNA, 19 nt, Homo sapiens
guccgaauauuuccaucug

SEQ ID NO: 559069 - RNA, 19 nt, Homo sapiens
uaguaaaggcugcuuaagu

SEQ ID NO: 559070 - RNA, 19 nt, Homo sapiens
ggaacaaaagcaaacaaaa

SEQ ID NO: 559071 - RNA, 19 nt, Homo sapiens
uuaccugugucaucaaagu

SEQ ID NO: 559072 - RNA, 19 nt, Homo sapiens
gaccuaagaugcgauuacg

SEQ ID NO: 559073 - RNA, 19 nt, Homo sapiens
agaagcuucauaaggaaua

SEQ ID NO: 559074 - RNA, 19 nt, Homo sapiens
uuauggcgauucugagugu

SEQ ID NO: 559075 - RNA, 19 nt, Homo sapiens
cauuuucgcugacaaguga

SEQ ID NO: 559076 - RNA, 19 nt, Homo sapiens
ucaaccacucuccuaauga

SEQ ID NO: 559077 - RNA, 19 nt, Homo sapiens
caaugcuacucucaacaag

SEQ ID NO: 559078 - RNA, 19 nt, Homo sapiens
caaaguagugauggauuca

SEQ ID NO: 559079 - RNA, 19 nt, Homo sapiens
uaacauugccuugaagacu

SEQ ID NO: 559080 - RNA, 19 nt, Homo sapiens
uuggagaaauaccgaccua

SEQ ID NO: 559081 - RNA, 19 nt, Homo sapiens
gagaagcuucauaaggaau

SEQ ID NO: 559082 - RNA, 19 nt, Homo sapiens
agagagaagcuucauaagg

SEQ ID NO: 559083 - RNA, 19 nt, Homo sapiens
uguaguaaaggcugcuuaa

SEQ ID NO: 559084 - RNA, 19 nt, Homo sapiens
ucaaguaaacaaguggaaa

SEQ ID NO: 559085 - RNA, 19 nt, Homo sapiens
uuugugaugcuacauauga

SEQ ID NO: 559086 - RNA, 19 nt, Homo sapiens
guucgaguuugugaugcua

SEQ ID NO: 559087 - RNA, 19 nt, Homo sapiens
ucucacuagugccuaaaug

SEQ ID NO: 559088 - RNA, 19 nt, Homo sapiens
uaacucacaacccuaccaa

SEQ ID NO: 559089 - RNA, 19 nt, Homo sapiens
gugcaaaccuugacauuaa

SEQ ID NO: 559090 - RNA, 19 nt, Homo sapiens
ggaaauucuuggugcauua

SEQ ID NO: 559091 - RNA, 19 nt, Homo sapiens
caaaauagcuccuacaauu

SEQ ID NO: 559092 - RNA, 19 nt, Homo sapiens
uaaggagacucaaugauuu

SEQ ID NO: 559093 - RNA, 19 nt, Homo sapiens
uagaacaccuuucccaaua

SEQ ID NO: 559094 - RNA, 19 nt, Homo sapiens
gaagauaccucugcaugga

SEQ ID NO: 559095 - RNA, 19 nt, Homo sapiens
ccuaagaggcauuuaauua

SEQ ID NO: 559096 - RNA, 19 nt, Homo sapiens
caacauauuucucuuccuu

SEQ ID NO: 559097 - RNA, 19 nt, Homo sapiens
ggaaauauuauccugcaua

SEQ ID NO: 559098 - RNA, 19 nt, Homo sapiens
gcaggaaucauaauagaaa

SEQ ID NO: 559099 - RNA, 19 nt, Homo sapiens
caaagucgauucaacaaca

SEQ ID NO: 559100 - RNA, 19 nt, Homo sapiens
gggaagagcugucaaaaga

SEQ ID NO: 559101 - RNA, 19 nt, Homo sapiens
ccacugcccuaugcauuua

SEQ ID NO: 559102 - RNA, 19 nt, Homo sapiens
ccuaaaggacaguauauua

SEQ ID NO: 559103 - RNA, 19 nt, Homo sapiens
uaaaugaaguggcaucaag

SEQ ID NO: 559104 - RNA, 19 nt, Homo sapiens
ucacugccaucacauacua

SEQ ID NO: 559105 - RNA, 19 nt, Homo sapiens
gacaguauauuaacaagca

SEQ ID NO: 559106 - RNA, 19 nt, Homo sapiens
ggacauguuauagaaguua

SEQ ID NO: 559107 - RNA, 19 nt, Homo sapiens
agcaguggcucuucgauua

SEQ ID NO: 559108 - RNA, 19 nt, Homo sapiens
gaaaucaggggacauguua

SEQ ID NO: 559109 - RNA, 19 nt, Homo sapiens
uaaaugaccaccuaaagga

SEQ ID NO: 559110 - RNA, 19 nt, Homo sapiens
cagguaaacuagaaauuuc

SEQ ID NO: 559111 - RNA, 19 nt, Homo sapiens
gccuauccuucuauauuua

SEQ ID NO: 559112 - RNA, 19 nt, Homo sapiens
uuccugagcucaagacuuu

SEQ ID NO: 559113 - RNA, 19 nt, Homo sapiens
aaucugcccugcuagaauu

SEQ ID NO: 559114 - RNA, 19 nt, Homo sapiens
gcccuaugcauuuauguua

SEQ ID NO: 559115 - RNA, 19 nt, Homo sapiens
ggacugcucuggguuaggu

SEQ ID NO: 559116 - RNA, 19 nt, Homo sapiens
ggacugguuccuauucuga

SEQ ID NO: 559117 - RNA, 19 nt, Homo sapiens
gaaauucuuggugcauuaa

SEQ ID NO: 559118 - RNA, 19 nt, Homo sapiens
ggugaaaacuugacagcua

SEQ ID NO: 559119 - RNA, 19 nt, Homo sapiens
gaacaccuuucccaauagg

SEQ ID NO: 559120 - RNA, 19 nt, Homo sapiens
gcuccuacaauuucuuaua

SEQ ID NO: 559121 - RNA, 19 nt, Homo sapiens
ccaagcaguucaugauaca

SEQ ID NO: 559122 - RNA, 19 nt, Homo sapiens
cuaccacucuccucaguau

SEQ ID NO: 559123 - RNA, 19 nt, Homo sapiens
ugccuauccuucuauauuu

SEQ ID NO: 559124 - RNA, 19 nt, Homo sapiens
auaaggagacucaaugauu

SEQ ID NO: 559125 - RNA, 19 nt, Homo sapiens
uaaauuccaacucuccuaa

SEQ ID NO: 559126 - RNA, 19 nt, Homo sapiens
gaaauccagagaaggcaaa

SEQ ID NO: 559127 - RNA, 19 nt, Homo sapiens
ucuguuagcuuauccucuu

SEQ ID NO: 559128 - RNA, 19 nt, Homo sapiens
cccaacagguaaacuagaa

SEQ ID NO: 559129 - RNA, 19 nt, Homo sapiens
uagcuuauccucuuuguag

SEQ ID NO: 559130 - RNA, 19 nt, Homo sapiens
gggcauguauggaauuugc

SEQ ID NO: 559131 - RNA, 19 nt, Homo sapiens
gauuucagaggcaacauuu

SEQ ID NO: 559132 - RNA, 19 nt, Homo sapiens
ccucagagccuaucccaau

SEQ ID NO: 559133 - RNA, 19 nt, Homo sapiens
gagggaauccagucuagga

SEQ ID NO: 559134 - RNA, 19 nt, Homo sapiens
uuaaaagcaugucggaaua

SEQ ID NO: 559135 - RNA, 19 nt, Homo sapiens
caagcaaagucgauucaac

SEQ ID NO: 559136 - RNA, 19 nt, Homo sapiens
ccaccuaaaggacaguaua

SEQ ID NO: 559137 - RNA, 19 nt, Homo sapiens
gaaaucggagaucccagaa

SEQ ID NO: 559138 - RNA, 19 nt, Homo sapiens
caucagggguuuucuuuau

SEQ ID NO: 559139 - RNA, 19 nt, Homo sapiens
ugacacaucugggucucaa

SEQ ID NO: 559140 - RNA, 19 nt, Homo sapiens
ugaggcaggaaucauaaua

SEQ ID NO: 559141 - RNA, 19 nt, Homo sapiens
ccuugugccucuccucuuu

SEQ ID NO: 559142 - RNA, 19 nt, Homo sapiens
caucacauacuaaccuuau

SEQ ID NO: 559143 - RNA, 19 nt, Homo sapiens
gcucuucgauuaguuaaaa

SEQ ID NO: 559144 - RNA, 19 nt, Homo sapiens
uaacccaucccucagcaaa

SEQ ID NO: 559145 - RNA, 19 nt, Homo sapiens
uauccucuuuguaguacua

SEQ ID NO: 559146 - RNA, 19 nt, Homo sapiens
cauguggcaguauuuauuu

SEQ ID NO: 559147 - RNA, 19 nt, Homo sapiens
aaacucaacacuaccauca

SEQ ID NO: 559148 - RNA, 19 nt, Homo sapiens
aggcaggaaucauaauaga

SEQ ID NO: 559149 - RNA, 19 nt, Homo sapiens
caacagguaaacuagaaau

SEQ ID NO: 559150 - RNA, 19 nt, Homo sapiens
acgcagcucuucccaagga

SEQ ID NO: 559151 - RNA, 19 nt, Homo sapiens
gcuuauccucuuuguagua

SEQ ID NO: 559152 - RNA, 19 nt, Homo sapiens
uaucucagcuucuguuagc

SEQ ID NO: 559153 - RNA, 19 nt, Homo sapiens
gauacagccucaccuuuug

SEQ ID NO: 559154 - RNA, 19 nt, Homo sapiens
ccuaugcauuuauguuaga

SEQ ID NO: 559155 - RNA, 19 nt, Homo sapiens
gaaggggucucucccaaca

SEQ ID NO: 559156 - RNA, 19 nt, Homo sapiens
gcaugucggaauauaagaa

SEQ ID NO: 559157 - RNA, 19 nt, Homo sapiens
ucauguggcaguauuuauu

SEQ ID NO: 559158 - RNA, 19 nt, Homo sapiens
agauaccucugcauggauu

SEQ ID NO: 559159 - RNA, 19 nt, Homo sapiens
gcauuuaauuaaggcucua

SEQ ID NO: 559160 - RNA, 19 nt, Homo sapiens
aaauuuaucucagcuucug

SEQ ID NO: 559161 - RNA, 19 nt, Homo sapiens
uuauaucccucgucaugug

SEQ ID NO: 559162 - RNA, 19 nt, Homo sapiens
ccacagccaggaacagcua

SEQ ID NO: 559163 - RNA, 19 nt, Homo sapiens
gcucuugucuguggucucu

SEQ ID NO: 559164 - RNA, 19 nt, Homo sapiens
ccucuccucuuuaucacuu

SEQ ID NO: 559165 - RNA, 19 nt, Homo sapiens
ggucucucccaacauauuu

SEQ ID NO: 559166 - RNA, 19 nt, Homo sapiens
gaaauuuccccuucaugaa

SEQ ID NO: 559167 - RNA, 19 nt, Homo sapiens
ggauuucagaggcaacauu

SEQ ID NO: 559168 - RNA, 19 nt, Homo sapiens
uuagggaaauccagagaag

SEQ ID NO: 559169 - RNA, 19 nt, Homo sapiens
uagcuccuacaauuucuua

SEQ ID NO: 559170 - RNA, 19 nt, Homo sapiens
guuuuaagcugaacuugaa

SEQ ID NO: 559171 - RNA, 19 nt, Homo sapiens
agaggaugcuggcuuugug

SEQ ID NO: 559172 - RNA, 19 nt, Homo sapiens
uaacaagcaaagucgauuc

SEQ ID NO: 559173 - RNA, 19 nt, Homo sapiens
uuuccucccucucuuuaaa

SEQ ID NO: 559174 - RNA, 19 nt, Homo sapiens
gggacauguuauagaaguu

SEQ ID NO: 559175 - RNA, 19 nt, Homo sapiens
aaacuugacagcuagacuu

SEQ ID NO: 559176 - RNA, 19 nt, Homo sapiens
gaagagcugucaaaagacu

SEQ ID NO: 559177 - RNA, 19 nt, Homo sapiens
cgaucccacuggcauuuga

SEQ ID NO: 559178 - RNA, 19 nt, Homo sapiens
ucaugaagguagagagaag

SEQ ID NO: 559179 - RNA, 19 nt, Homo sapiens
ugugagaaccaaccuuuga

SEQ ID NO: 559180 - RNA, 19 nt, Homo sapiens
aaaagcaugucggaauaua

SEQ ID NO: 559181 - RNA, 19 nt, Homo sapiens
gaaaaucugcccugcuaga

SEQ ID NO: 559182 - RNA, 19 nt, Homo sapiens
aaacucagccucccuacag

SEQ ID NO: 559183 - RNA, 19 nt, Homo sapiens
ggaagaggaaaucggagau

SEQ ID NO: 559184 - RNA, 19 nt, Homo sapiens
caagaauggccauguggau

SEQ ID NO: 559185 - RNA, 19 nt, Homo sapiens
ccgccuuccucacuccaua

SEQ ID NO: 559186 - RNA, 19 nt, Homo sapiens
aaagcaugucggaauauaa

SEQ ID NO: 559187 - RNA, 19 nt, Homo sapiens
cgucauguggcaguauuua

SEQ ID NO: 559188 - RNA, 19 nt, Homo sapiens
ugugcaaaccuugacauua

SEQ ID NO: 559189 - RNA, 19 nt, Homo sapiens
gcacaaggcucuacucugu

SEQ ID NO: 559190 - RNA, 19 nt, Homo sapiens
gcucucgucuugucuguaa

SEQ ID NO: 559191 - RNA, 19 nt, Homo sapiens
acaaugcauucaucaguua

SEQ ID NO: 559192 - RNA, 19 nt, Homo sapiens
caucaccucugacuggaua

SEQ ID NO: 559193 - RNA, 19 nt, Homo sapiens
ggccaaaucugaaguccuu

SEQ ID NO: 559194 - RNA, 19 nt, Homo sapiens
ggaaagagcagaacaccau

SEQ ID NO: 559195 - RNA, 19 nt, Homo sapiens
gcagagugcugggaugaga

SEQ ID NO: 559196 - RNA, 19 nt, Homo sapiens
cacccaaacugauaacauu

SEQ ID NO: 559197 - RNA, 19 nt, Homo sapiens
gugcugggaugagaaauuu

SEQ ID NO: 559198 - RNA, 19 nt, Homo sapiens
ccagaaacauucacagaag

SEQ ID NO: 559199 - RNA, 19 nt, Homo sapiens
ccaaaggacucgguggaaa

SEQ ID NO: 559200 - RNA, 19 nt, Homo sapiens
guauguacaucgucaacaa

SEQ ID NO: 559201 - RNA, 19 nt, Homo sapiens
gaaagagcagaacaccaua

SEQ ID NO: 559202 - RNA, 19 nt, Homo sapiens
caaaguaggaacagcguaa

SEQ ID NO: 559203 - RNA, 19 nt, Homo sapiens
gaucugcucucgucuuguc

SEQ ID NO: 559204 - RNA, 19 nt, Homo sapiens
gagcagaacaccauagaca

SEQ ID NO: 559205 - RNA, 19 nt, Homo sapiens
guaaggaacacgaagcuau

SEQ ID NO: 559206 - RNA, 19 nt, Homo sapiens
ggaacacgaagcuaugaaa

SEQ ID NO: 559207 - RNA, 19 nt, Homo sapiens
guuaaacaaugcauucauc

SEQ ID NO: 559208 - RNA, 19 nt, Homo sapiens
ugaaugaucccgcuacaga

SEQ ID NO: 559209 - RNA, 19 nt, Homo sapiens
cagaaacauucacagaaga

SEQ ID NO: 559210 - RNA, 19 nt, Homo sapiens
gcagaacaccauagacaau

SEQ ID NO: 559211 - RNA, 19 nt, Homo sapiens
acacgaagcuaugaaagau

SEQ ID NO: 559212 - RNA, 19 nt, Homo sapiens
gaugagcuuugccgucaga

SEQ ID NO: 559213 - RNA, 19 nt, Homo sapiens
ucaagcgacuccagaaaca

SEQ ID NO: 559214 - RNA, 19 nt, Homo sapiens
ccaaggugcugcuguuucu

SEQ ID NO: 559215 - RNA, 19 nt, Homo sapiens
cagcggaggccaaaucuga

SEQ ID NO: 559216 - RNA, 19 nt, Homo sapiens
acgaagcuaugaaagauga

SEQ ID NO: 559217 - RNA, 19 nt, Homo sapiens
gacccaaggugcugcuguu

SEQ ID NO: 559218 - RNA, 19 nt, Homo sapiens
gacaguauuucuuaaacca

SEQ ID NO: 559219 - RNA, 19 nt, Homo sapiens
cagaacaccauagacaaua

SEQ ID NO: 559220 - RNA, 19 nt, Homo sapiens
gaguggcucuguucaucuu

SEQ ID NO: 559221 - RNA, 19 nt, Homo sapiens
gggaguggcucuguucauc

SEQ ID NO: 559222 - RNA, 19 nt, Homo sapiens
auccuaaucuggugaauga

SEQ ID NO: 559223 - RNA, 19 nt, Homo sapiens
ccuuagacaguauuucuua

SEQ ID NO: 559224 - RNA, 19 nt, Homo sapiens
gaacacgaagcuaugaaag

SEQ ID NO: 559225 - RNA, 19 nt, Homo sapiens
uaucauagacacagugaau

SEQ ID NO: 559226 - RNA, 19 nt, Homo sapiens
agaacaccauagacaauau

SEQ ID NO: 559227 - RNA, 19 nt, Homo sapiens
gaggagagagacacauuca

SEQ ID NO: 559228 - RNA, 19 nt, Homo sapiens
ucaagggagacuaaacuuu

SEQ ID NO: 559229 - RNA, 19 nt, Homo sapiens
cacagugaauagaugauga

SEQ ID NO: 559230 - RNA, 19 nt, Homo sapiens
cccaaacugauaacauuua

SEQ ID NO: 559231 - RNA, 19 nt, Homo sapiens
aacaaugcauucaucaguu

SEQ ID NO: 559232 - RNA, 19 nt, Homo sapiens
auauagaucuuaggguuga

SEQ ID NO: 559233 - RNA, 19 nt, Homo sapiens
caauuucaagggagacuaa

SEQ ID NO: 559234 - RNA, 19 nt, Homo sapiens
caguuaugcuucaccaguu

SEQ ID NO: 559235 - RNA, 19 nt, Homo sapiens
gaggagacgaugugacuca

SEQ ID NO: 559236 - RNA, 19 nt, Homo sapiens
aaacaaugcauucaucagu

SEQ ID NO: 559237 - RNA, 19 nt, Homo sapiens
uaaggaacacgaagcuaug

SEQ ID NO: 559238 - RNA, 19 nt, Homo sapiens
cuauugaaucugucugaua

SEQ ID NO: 559239 - RNA, 19 nt, Homo sapiens
uagacacagugaauagaug

SEQ ID NO: 559240 - RNA, 19 nt, Homo sapiens
gagacuccgucgcuccaau

SEQ ID NO: 559241 - RNA, 19 nt, Homo sapiens
ugacuuggccucccucagu

SEQ ID NO: 559242 - RNA, 19 nt, Homo sapiens
cauuguaacacacauucua

SEQ ID NO: 559243 - RNA, 19 nt, Homo sapiens
ggucugugaucauugaaaa

SEQ ID NO: 559244 - RNA, 19 nt, Homo sapiens
caaaggacucgguggaaag

SEQ ID NO: 559245 - RNA, 19 nt, Homo sapiens
cgacuuccucccugugaaa

SEQ ID NO: 559246 - RNA, 19 nt, Homo sapiens
ggugaaugaucccgcuaca

SEQ ID NO: 559247 - RNA, 19 nt, Homo sapiens
uccaauuacuuccgacuuc

SEQ ID NO: 559248 - RNA, 19 nt, Homo sapiens
gaaugaucccgcuacagau

SEQ ID NO: 559249 - RNA, 19 nt, Homo sapiens
ugucugauauagaucuuag

SEQ ID NO: 559250 - RNA, 19 nt, Homo sapiens
cauugacagcuaacccuua

SEQ ID NO: 559251 - RNA, 19 nt, Homo sapiens
cgcuacagaugaaacaguu

SEQ ID NO: 559252 - RNA, 19 nt, Homo sapiens
ucauagacacagugaauag

SEQ ID NO: 559253 - RNA, 19 nt, Homo sapiens
cuccaaccauugacagcua

SEQ ID NO: 559254 - RNA, 19 nt, Homo sapiens
agacacagugaauagauga

SEQ ID NO: 559255 - RNA, 19 nt, Homo sapiens
ggaucuccuucuucuccaa

SEQ ID NO: 559256 - RNA, 19 nt, Homo sapiens
ucccucaucucauuguuuc

SEQ ID NO: 559257 - RNA, 19 nt, Homo sapiens
guuaugcuucaccaguuua

SEQ ID NO: 559258 - RNA, 19 nt, Homo sapiens
caacgaggagacgauguga

SEQ ID NO: 559259 - RNA, 19 nt, Homo sapiens
uugaaucugucugauauag

SEQ ID NO: 559260 - RNA, 19 nt, Homo sapiens
cagcguaagaggagagaga

SEQ ID NO: 559261 - RNA, 19 nt, Homo sapiens
ucaauaucauagacacagu

SEQ ID NO: 559262 - RNA, 19 nt, Homo sapiens
aguuaugcuucaccaguuu

SEQ ID NO: 559263 - RNA, 19 nt, Homo sapiens
uauugcaccuuccacagau

SEQ ID NO: 559264 - RNA, 19 nt, Homo sapiens
gaaacauucacagaagauc

SEQ ID NO: 559265 - RNA, 19 nt, Homo sapiens
gacuccgucgcuccaauua

SEQ ID NO: 559266 - RNA, 19 nt, Homo sapiens
guaagaggagagagacaca

SEQ ID NO: 559267 - RNA, 19 nt, Homo sapiens
aagcgacuccagaaacauu

SEQ ID NO: 559268 - RNA, 19 nt, Homo sapiens
aagaggagagagacacauu

SEQ ID NO: 559269 - RNA, 19 nt, Homo sapiens
auucaucaguuaugcuuca

SEQ ID NO: 559270 - RNA, 19 nt, Homo sapiens
guggcucuguucaucuuau

SEQ ID NO: 559271 - RNA, 19 nt, Homo sapiens
ccagggaguggcucuguuc

SEQ ID NO: 559272 - RNA, 19 nt, Homo sapiens
ccaaaucugaaguccuuuc

SEQ ID NO: 559273 - RNA, 19 nt, Homo sapiens
gauccuaaucuggugaaug

SEQ ID NO: 559274 - RNA, 19 nt, Homo sapiens
gccaaaggacucgguggaa

SEQ ID NO: 559275 - RNA, 19 nt, Homo sapiens
cauagacacagugaauaga

SEQ ID NO: 559276 - RNA, 19 nt, Homo sapiens
uccaaccauugacagcuaa

SEQ ID NO: 559277 - RNA, 19 nt, Homo sapiens
ugaucccgcuacagaugaa

SEQ ID NO: 559278 - RNA, 19 nt, Homo sapiens
uccagaaacauucacagaa

SEQ ID NO: 559279 - RNA, 19 nt, Homo sapiens
ggaguggcucuguucaucu

SEQ ID NO: 559280 - RNA, 19 nt, Homo sapiens
uggcucuguucaucuuauu

SEQ ID NO: 559281 - RNA, 19 nt, Homo sapiens
aaaggacucgguggaaaga

SEQ ID NO: 559282 - RNA, 19 nt, Homo sapiens
gagaaauuuaccugcacaa

SEQ ID NO: 559283 - RNA, 19 nt, Homo sapiens
ucaacgaggagacgaugug

SEQ ID NO: 559284 - RNA, 19 nt, Homo sapiens
gagcugacguguacucaua

SEQ ID NO: 559285 - RNA, 19 nt, Homo sapiens
ggacaacccugcucgaauc

SEQ ID NO: 559286 - RNA, 19 nt, Homo sapiens
ggagagacauuucaauaag

SEQ ID NO: 559287 - RNA, 19 nt, Homo sapiens
gaucuacaaugaccagaaa

SEQ ID NO: 559288 - RNA, 19 nt, Homo sapiens
aagaggagcuucuggagua

SEQ ID NO: 559289 - RNA, 19 nt, Homo sapiens
ccacagagaaggugaagua

SEQ ID NO: 559290 - RNA, 19 nt, Homo sapiens
gagagacauuucaauaaga

SEQ ID NO: 559291 - RNA, 19 nt, Homo sapiens
gaugggugaucuacaauga

SEQ ID NO: 559292 - RNA, 19 nt, Homo sapiens
ggaaguauguggauaagcu

SEQ ID NO: 559293 - RNA, 19 nt, Homo sapiens
ccgcaaagcugucuacuac

SEQ ID NO: 559294 - RNA, 19 nt, Homo sapiens
ugacugaguuggagauaga

SEQ ID NO: 559295 - RNA, 19 nt, Homo sapiens
ggaugcagcccuuaacaaa

SEQ ID NO: 559296 - RNA, 19 nt, Homo sapiens
gaacacguuucugggcuuu

SEQ ID NO: 559297 - RNA, 19 nt, Homo sapiens
uggauaagcuggagaagau

SEQ ID NO: 559298 - RNA, 19 nt, Homo sapiens
gaggagaaguuugaauuag

SEQ ID NO: 559299 - RNA, 19 nt, Homo sapiens
gaaacaguauguggagaga

SEQ ID NO: 559300 - RNA, 19 nt, Homo sapiens
cgaggagaaguuugaauua

SEQ ID NO: 559301 - RNA, 19 nt, Homo sapiens
ggaugguccuggaaaguau

SEQ ID NO: 559302 - RNA, 19 nt, Homo sapiens
gcaaagcugucuacuacac

SEQ ID NO: 559303 - RNA, 19 nt, Homo sapiens
ucaagugccuggccacaga

SEQ ID NO: 559304 - RNA, 19 nt, Homo sapiens
acaagacgaugacugaguu

SEQ ID NO: 559305 - RNA, 19 nt, Homo sapiens
guggagagacauuucaaua

SEQ ID NO: 559306 - RNA, 19 nt, Homo sapiens
gcgcguggguguagcuuug

SEQ ID NO: 559307 - RNA, 19 nt, Homo sapiens
ccucugcucuguacccuuu

SEQ ID NO: 559308 - RNA, 19 nt, Homo sapiens
gcgaggagaaguuugaauu

SEQ ID NO: 559309 - RNA, 19 nt, Homo sapiens
ggagggaugugagggaaau

SEQ ID NO: 559310 - RNA, 19 nt, Homo sapiens
gagagaaccuguggcucaa

SEQ ID NO: 559311 - RNA, 19 nt, Homo sapiens
ccacacgauuugccucauu

SEQ ID NO: 559312 - RNA, 19 nt, Homo sapiens
ggagaaguuugaauuagac

SEQ ID NO: 559313 - RNA, 19 nt, Homo sapiens
gcugcuaccucaacucugu

SEQ ID NO: 559314 - RNA, 19 nt, Homo sapiens
cagauuaccuggagauugc

SEQ ID NO: 559315 - RNA, 19 nt, Homo sapiens
cagaggagcucgacaucuc

SEQ ID NO: 559316 - RNA, 19 nt, Homo sapiens
ugauggagcugacguguac

SEQ ID NO: 559317 - RNA, 19 nt, Homo sapiens
agagacaggcuacccguua

SEQ ID NO: 559318 - RNA, 19 nt, Homo sapiens
ggaagugcuccaaguguga

SEQ ID NO: 559319 - RNA, 19 nt, Homo sapiens
gacaugaaccagcggauug

SEQ ID NO: 559320 - RNA, 19 nt, Homo sapiens
agacgaggaugugaagauu

SEQ ID NO: 559321 - RNA, 19 nt, Homo sapiens
ccaaggaccugggcuacau

SEQ ID NO: 559322 - RNA, 19 nt, Homo sapiens
gaaguacacccagcgaguu

SEQ ID NO: 559323 - RNA, 19 nt, Homo sapiens
cagaggaaguauguggaua

SEQ ID NO: 559324 - RNA, 19 nt, Homo sapiens
uaaggagacuuuguugcuu

SEQ ID NO: 559325 - RNA, 19 nt, Homo sapiens
gggaugguccuggaaagua

SEQ ID NO: 559326 - RNA, 19 nt, Homo sapiens
gcuguggacuggaucuuca

SEQ ID NO: 559327 - RNA, 19 nt, Homo sapiens
gacguguacucauaugaug

SEQ ID NO: 559328 - RNA, 19 nt, Homo sapiens
gagacaggcuacccguuag

SEQ ID NO: 559329 - RNA, 19 nt, Homo sapiens
cagacaagacgaugacuga

SEQ ID NO: 559330 - RNA, 19 nt, Homo sapiens
aggagaaguuugaauuaga

SEQ ID NO: 559331 - RNA, 19 nt, Homo sapiens
gggcaccucuaccaugugu

SEQ ID NO: 559332 - RNA, 19 nt, Homo sapiens
augcagcccuuaacaaaga

SEQ ID NO: 559333 - RNA, 19 nt, Homo sapiens
ggaauugccggagcucuga

SEQ ID NO: 559334 - RNA, 19 nt, Homo sapiens
uggagagacauuucaauaa

SEQ ID NO: 559335 - RNA, 19 nt, Homo sapiens
gaugugaagauugucauuu

SEQ ID NO: 559336 - RNA, 19 nt, Homo sapiens
cacgaacaauaguuuagaa

SEQ ID NO: 559337 - RNA, 19 nt, Homo sapiens
ucauccagaucaagaaguu

SEQ ID NO: 559338 - RNA, 19 nt, Homo sapiens
gagccugccucaccccuua

SEQ ID NO: 559339 - RNA, 19 nt, Homo sapiens
ccagagaguggccagcuaa

SEQ ID NO: 559340 - RNA, 19 nt, Homo sapiens
cagagaaggugaaguacac

SEQ ID NO: 559341 - RNA, 19 nt, Homo sapiens
ggaagaccaccuggcauga

SEQ ID NO: 559342 - RNA, 19 nt, Homo sapiens
ugaacugggucaugucaca

SEQ ID NO: 559343 - RNA, 19 nt, Homo sapiens
uaucagcucuuugccuuca

SEQ ID NO: 559344 - RNA, 19 nt, Homo sapiens
gucaagaccacacgauuug

SEQ ID NO: 559345 - RNA, 19 nt, Homo sapiens
gaggaaguauguggauaag

SEQ ID NO: 559346 - RNA, 19 nt, Homo sapiens
caaaauacacgaugugaau

SEQ ID NO: 559347 - RNA, 19 nt, Homo sapiens
ccagcgaguugacuacauc

SEQ ID NO: 559348 - RNA, 19 nt, Homo sapiens
guggagcacuaccgagaga

SEQ ID NO: 559349 - RNA, 19 nt, Homo sapiens
guaaggagacuuuguugcu

SEQ ID NO: 559350 - RNA, 19 nt, Homo sapiens
gggccacgaacaauaguuu

SEQ ID NO: 559351 - RNA, 19 nt, Homo sapiens
ugucaagaccacacgauuu

SEQ ID NO: 559352 - RNA, 19 nt, Homo sapiens
ucaacaugguggagaggaa

SEQ ID NO: 559353 - RNA, 19 nt, Homo sapiens
agaggaaguauguggauaa

SEQ ID NO: 559354 - RNA, 19 nt, Homo sapiens
gagaguggccagcuaagag

SEQ ID NO: 559355 - RNA, 19 nt, Homo sapiens
ggaccugggcuacaucuac

SEQ ID NO: 559356 - RNA, 19 nt, Homo sapiens
gugcucugcuucucugugu

SEQ ID NO: 559357 - RNA, 19 nt, Homo sapiens
gcucuuugccuucauuagu

SEQ ID NO: 559358 - RNA, 19 nt, Homo sapiens
gaguucuuccuucaccuua

SEQ ID NO: 559359 - RNA, 19 nt, Homo sapiens
ggaaguucaagauggcauu

SEQ ID NO: 559360 - RNA, 19 nt, Homo sapiens
acgaggaugugaagauugu

SEQ ID NO: 559361 - RNA, 19 nt, Homo sapiens
gagcagaggggcagcgaua

SEQ ID NO: 559362 - RNA, 19 nt, Homo sapiens
ccaagucaguagcugucaa

SEQ ID NO: 559363 - RNA, 19 nt, Homo sapiens
ugaagaugcagaagacaga

SEQ ID NO: 559364 - RNA, 19 nt, Homo sapiens
gcggcuggcuauugguguu

SEQ ID NO: 559365 - RNA, 19 nt, Homo sapiens
gaccugggcuacaucuacu

SEQ ID NO: 559366 - RNA, 19 nt, Homo sapiens
ggccacgaacaauaguuua

SEQ ID NO: 559367 - RNA, 19 nt, Homo sapiens
aggaggagcugccagacau

SEQ ID NO: 559368 - RNA, 19 nt, Homo sapiens
uaacaaagaggagcuucug

SEQ ID NO: 559369 - RNA, 19 nt, Homo sapiens
gcugacguguacucauaug

SEQ ID NO: 559370 - RNA, 19 nt, Homo sapiens
gaauuagacgaggauguga

SEQ ID NO: 559371 - RNA, 19 nt, Homo sapiens
ucagcucuuugccuucauu

SEQ ID NO: 559372 - RNA, 19 nt, Homo sapiens
ugaauuagacgaggaugug

SEQ ID NO: 559373 - RNA, 19 nt, Homo sapiens
gcgaguugacuacaucaug

SEQ ID NO: 559374 - RNA, 19 nt, Homo sapiens
gacaagacgaugacugagu

SEQ ID NO: 559375 - RNA, 19 nt, Homo sapiens
gaaguacggcaggugucua

SEQ ID NO: 559376 - RNA, 19 nt, Homo sapiens
cgaccuggaugcugaagcu

SEQ ID NO: 559377 - RNA, 19 nt, Homo sapiens
ccacgaacaauaguuuaga

SEQ ID NO: 559378 - RNA, 19 nt, Homo sapiens
gaaguucaagauggcauug

SEQ ID NO: 559379 - RNA, 19 nt, Homo sapiens
cagaaggaaguucaagaug

SEQ ID NO: 559380 - RNA, 19 nt, Homo sapiens
ggaguauuccaagccagua

SEQ ID NO: 559381 - RNA, 19 nt, Homo sapiens
ccacuucggcaucgacaug

SEQ ID NO: 559382 - RNA, 19 nt, Homo sapiens
ugggcuacaucuacuucua

SEQ ID NO: 559383 - RNA, 19 nt, Homo sapiens
gaggagcugccagacauug

SEQ ID NO: 559384 - RNA, 19 nt, Homo sapiens
gaugaugaaugacaugauu

SEQ ID NO: 559385 - RNA, 19 nt, Homo sapiens
gaauaaaggagaauggaaa

SEQ ID NO: 559386 - RNA, 19 nt, Homo sapiens
guaacuagguguuuaugga

SEQ ID NO: 559387 - RNA, 19 nt, Homo sapiens
ugaaugacaugauuggaaa

SEQ ID NO: 559388 - RNA, 19 nt, Homo sapiens
gaaaucauccccugaauaa

SEQ ID NO: 559389 - RNA, 19 nt, Homo sapiens
ucagguggcuuuggauaua

SEQ ID NO: 559390 - RNA, 19 nt, Homo sapiens
ucuuuaaucuccugguuua

SEQ ID NO: 559391 - RNA, 19 nt, Homo sapiens
ggacauguuugggaugaug

SEQ ID NO: 559392 - RNA, 19 nt, Homo sapiens
gcuauucaccgucagcaua

SEQ ID NO: 559393 - RNA, 19 nt, Homo sapiens
caugacagcuggaggcaau

SEQ ID NO: 559394 - RNA, 19 nt, Homo sapiens
ggaauaaaggagaauggaa

SEQ ID NO: 559395 - RNA, 19 nt, Homo sapiens
gcugagaggcugagaaauc

SEQ ID NO: 559396 - RNA, 19 nt, Homo sapiens
gcccucagccucucuugua

SEQ ID NO: 559397 - RNA, 19 nt, Homo sapiens
ggaggacuguucgggauuc

SEQ ID NO: 559398 - RNA, 19 nt, Homo sapiens
ggggugagcucuggguuua

SEQ ID NO: 559399 - RNA, 19 nt, Homo sapiens
gagugaggccgcagcguuu

SEQ ID NO: 559400 - RNA, 19 nt, Homo sapiens
ugccagaccuucucaucuu

SEQ ID NO: 559401 - RNA, 19 nt, Homo sapiens
uguuugggaugaugaauga

SEQ ID NO: 559402 - RNA, 19 nt, Homo sapiens
ggacuguucgggauucaga

SEQ ID NO: 559403 - RNA, 19 nt, Homo sapiens
uaacuagguguuuauggaa

SEQ ID NO: 559404 - RNA, 19 nt, Homo sapiens
acuagguguuuauggaaua

SEQ ID NO: 559405 - RNA, 19 nt, Homo sapiens
cugagaggcugagaaauca

SEQ ID NO: 559406 - RNA, 19 nt, Homo sapiens
gcucaagcccggaccaauc

SEQ ID NO: 559407 - RNA, 19 nt, Homo sapiens
ccacacacaucaaaagaau

SEQ ID NO: 559408 - RNA, 19 nt, Homo sapiens
ugacuucgccucugcaucu

SEQ ID NO: 559409 - RNA, 19 nt, Homo sapiens
cccaaggucuaccaagaga

SEQ ID NO: 559410 - RNA, 19 nt, Homo sapiens
gauggaucccuuugcuauu

SEQ ID NO: 559411 - RNA, 19 nt, Homo sapiens
gguuuaccauugaugacuu

SEQ ID NO: 559412 - RNA, 19 nt, Homo sapiens
ggacguggagccugaggau

SEQ ID NO: 559413 - RNA, 19 nt, Homo sapiens
guugucagguggcuuugga

SEQ ID NO: 559414 - RNA, 19 nt, Homo sapiens
ugauggaucccuuugcuau

SEQ ID NO: 559415 - RNA, 19 nt, Homo sapiens
gggaaugucgggugguuuc

SEQ ID NO: 559416 - RNA, 19 nt, Homo sapiens
gaggagcggcaggacuaua

SEQ ID NO: 559417 - RNA, 19 nt, Homo sapiens
gucaucuccuacuccaaua

SEQ ID NO: 559418 - RNA, 19 nt, Homo sapiens
gccagaccuucucaucuuc

SEQ ID NO: 559419 - RNA, 19 nt, Homo sapiens
gcaauugccagaccuucuc

SEQ ID NO: 559420 - RNA, 19 nt, Homo sapiens
ccucaccuuucccauccua

SEQ ID NO: 559421 - RNA, 19 nt, Homo sapiens
gccugaggaucccauguuc

SEQ ID NO: 559422 - RNA, 19 nt, Homo sapiens
ggugagcucuggguuuagg

SEQ ID NO: 559423 - RNA, 19 nt, Homo sapiens
ccacugucaucuccuacuc

SEQ ID NO: 559424 - RNA, 19 nt, Homo sapiens
gcaucuacugacuugauuu

SEQ ID NO: 559425 - RNA, 19 nt, Homo sapiens
gagaaaucauccccugaau

SEQ ID NO: 559426 - RNA, 19 nt, Homo sapiens
gagaggcugagaaaucauc

SEQ ID NO: 559427 - RNA, 19 nt, Homo sapiens
gagcggcaggacuauauca

SEQ ID NO: 559428 - RNA, 19 nt, Homo sapiens
gagacacggaggacuguuc

SEQ ID NO: 559429 - RNA, 19 nt, Homo sapiens
uauguugucagguggcuuu

SEQ ID NO: 559430 - RNA, 19 nt, Homo sapiens
uauaucaaccuggaugaga

SEQ ID NO: 559431 - RNA, 19 nt, Homo sapiens
ugucaucuccuacuccaau

SEQ ID NO: 559432 - RNA, 19 nt, Homo sapiens
aaugucgggugguuucaug

SEQ ID NO: 559433 - RNA, 19 nt, Homo sapiens
ugucagguggcuuuggaua

SEQ ID NO: 559434 - RNA, 19 nt, Homo sapiens
aggaggagcggcaggacua

SEQ ID NO: 559435 - RNA, 19 nt, Homo sapiens
ugcaucuacugacuugauu

SEQ ID NO: 559436 - RNA, 19 nt, Homo sapiens
gggaugaugaaugacauga

SEQ ID NO: 559437 - RNA, 19 nt, Homo sapiens
cuucuuuaaucuccugguu

SEQ ID NO: 559438 - RNA, 19 nt, Homo sapiens
aggcugagaggcugagaaa

SEQ ID NO: 559439 - RNA, 19 nt, Homo sapiens
cuuccacugucaucuccua

SEQ ID NO: 559440 - RNA, 19 nt, Homo sapiens
ggaaggccgaggagcucaa

SEQ ID NO: 559441 - RNA, 19 nt, Homo sapiens
cuacuccugccaugcauug

SEQ ID NO: 559442 - RNA, 19 nt, Homo sapiens
gacuucgccucugcaucua

SEQ ID NO: 559443 - RNA, 19 nt, Homo sapiens
auggaucccuuugcuauuc

SEQ ID NO: 559444 - RNA, 19 nt, Homo sapiens
gaggacuguucgggauuca

SEQ ID NO: 559445 - RNA, 19 nt, Homo sapiens
gaaaguagcacauggagua

SEQ ID NO: 559446 - RNA, 19 nt, Homo sapiens
gaacggacauguauucaau

SEQ ID NO: 559447 - RNA, 19 nt, Homo sapiens
gcucagaagucuauuuaau

SEQ ID NO: 559448 - RNA, 19 nt, Homo sapiens
ggugguaguuguauucuaa

SEQ ID NO: 559449 - RNA, 19 nt, Homo sapiens
gcaaaaggcuagauaacua

SEQ ID NO: 559450 - RNA, 19 nt, Homo sapiens
gagcugaaucucuuuauuu

SEQ ID NO: 559451 - RNA, 19 nt, Homo sapiens
gaaagcaagauccaaauug

SEQ ID NO: 559452 - RNA, 19 nt, Homo sapiens
aaagcaagauccaaauuga

SEQ ID NO: 559453 - RNA, 19 nt, Homo sapiens
gcagaggccugaagauucu

SEQ ID NO: 559454 - RNA, 19 nt, Homo sapiens
gaaagguggugguaguugu

SEQ ID NO: 559455 - RNA, 19 nt, Homo sapiens
gcuauuaaauucugaacug

SEQ ID NO: 559456 - RNA, 19 nt, Homo sapiens
uuaaugagcucugacugua

SEQ ID NO: 559457 - RNA, 19 nt, Homo sapiens
gagcauuucuucagguuuc

SEQ ID NO: 559458 - RNA, 19 nt, Homo sapiens
ccagaugauucuuaauuug

SEQ ID NO: 559459 - RNA, 19 nt, Homo sapiens
caaaugcuuuagaugauug

SEQ ID NO: 559460 - RNA, 19 nt, Homo sapiens
agaaauuacucucacaaga

SEQ ID NO: 559461 - RNA, 19 nt, Homo sapiens
guggaucacuugccaaaug

SEQ ID NO: 559462 - RNA, 19 nt, Homo sapiens
gagcagaggccugaagauu

SEQ ID NO: 559463 - RNA, 19 nt, Homo sapiens
acagaacacugaacaagga

SEQ ID NO: 559464 - RNA, 19 nt, Homo sapiens
gcucaaaguugcgagagaa

SEQ ID NO: 559465 - RNA, 19 nt, Homo sapiens
ggacauguauucaauuuuc

SEQ ID NO: 559466 - RNA, 19 nt, Homo sapiens
gcaauauggccuugacuug

SEQ ID NO: 559467 - RNA, 19 nt, Homo sapiens
ccaaaugcuuuagaugauu

SEQ ID NO: 559468 - RNA, 19 nt, Homo sapiens
gaaagaauggcauagaucu

SEQ ID NO: 559469 - RNA, 19 nt, Homo sapiens
uggaguagcugagguuaaa

SEQ ID NO: 559470 - RNA, 19 nt, Homo sapiens
auucugaacuguauccaua

SEQ ID NO: 559471 - RNA, 19 nt, Homo sapiens
ugaggaagauuggguaaug

SEQ ID NO: 559472 - RNA, 19 nt, Homo sapiens
gagcagaguagaaauggaa

SEQ ID NO: 559473 - RNA, 19 nt, Homo sapiens
gguaccaggucuucuaugu

SEQ ID NO: 559474 - RNA, 19 nt, Homo sapiens
uaucuuggcuuguuuaugc

SEQ ID NO: 559475 - RNA, 19 nt, Homo sapiens
gccaaaugcuuuagaugau

SEQ ID NO: 559476 - RNA, 19 nt, Homo sapiens
aaaguuaacagaacacuga

SEQ ID NO: 559477 - RNA, 19 nt, Homo sapiens
gaugaggaccuguaaaaua

SEQ ID NO: 559478 - RNA, 19 nt, Homo sapiens
ucaguaugcuuuguugaaa

SEQ ID NO: 559479 - RNA, 19 nt, Homo sapiens
ggguaaugcugauguguuc

SEQ ID NO: 559480 - RNA, 19 nt, Homo sapiens
uuggagagcuuagaggaua

SEQ ID NO: 559481 - RNA, 19 nt, Homo sapiens
ucgguaagcuagaggauug

SEQ ID NO: 559482 - RNA, 19 nt, Homo sapiens
uuaaagagcagaguagaaa

SEQ ID NO: 559483 - RNA, 19 nt, Homo sapiens
ggaaagaauggcauagauc

SEQ ID NO: 559484 - RNA, 19 nt, Homo sapiens
uaacauucuugcucaaagu

SEQ ID NO: 559485 - RNA, 19 nt, Homo sapiens
gaaugaugaggaccuguaa

SEQ ID NO: 559486 - RNA, 19 nt, Homo sapiens
agaccacacucgacucuug

SEQ ID NO: 559487 - RNA, 19 nt, Homo sapiens
caagaacuuuaucaguaug

SEQ ID NO: 559488 - RNA, 19 nt, Homo sapiens
uagcugagguuaaacaaac

SEQ ID NO: 559489 - RNA, 19 nt, Homo sapiens
cuaugugggugucaggaua

SEQ ID NO: 559490 - RNA, 19 nt, Homo sapiens
gcaaccaaucuauguuuga

SEQ ID NO: 559491 - RNA, 19 nt, Homo sapiens
ucacuugccaaaugcuuua

SEQ ID NO: 559492 - RNA, 19 nt, Homo sapiens
ggcaugaaauagcuuaaag

SEQ ID NO: 559493 - RNA, 19 nt, Homo sapiens
caauucgccucuccgcauu

SEQ ID NO: 559494 - RNA, 19 nt, Homo sapiens
ggcaaccaaucuauguuug

SEQ ID NO: 559495 - RNA, 19 nt, Homo sapiens
caagagcauuuguaauagg

SEQ ID NO: 559496 - RNA, 19 nt, Homo sapiens
caucagcuccucccugcua

SEQ ID NO: 559497 - RNA, 19 nt, Homo sapiens
ccaguuugauggugugaau

SEQ ID NO: 559498 - RNA, 19 nt, Homo sapiens
cagcgucacuggcacuuuc

SEQ ID NO: 559499 - RNA, 19 nt, Homo sapiens
ugggaucauugucugcuua

SEQ ID NO: 559500 - RNA, 19 nt, Homo sapiens
gagaaagcaagauccaaau

SEQ ID NO: 559501 - RNA, 19 nt, Homo sapiens
acggacauguauucaauuu

SEQ ID NO: 559502 - RNA, 19 nt, Homo sapiens
guugaaagcagaaauuaag

SEQ ID NO: 559503 - RNA, 19 nt, Homo sapiens
uagcuuggcuccguaagug

SEQ ID NO: 559504 - RNA, 19 nt, Homo sapiens
gcaugaaauagcuuaaaga

SEQ ID NO: 559505 - RNA, 19 nt, Homo sapiens
caaggcaugaaauagcuua

SEQ ID NO: 559506 - RNA, 19 nt, Homo sapiens
agagaaagcaagauccaaa

SEQ ID NO: 559507 - RNA, 19 nt, Homo sapiens
gaucauugucugcuuagug

SEQ ID NO: 559508 - RNA, 19 nt, Homo sapiens
aauauggccuugacuugga

SEQ ID NO: 559509 - RNA, 19 nt, Homo sapiens
ucagcaggaccuuuguuua

SEQ ID NO: 559510 - RNA, 19 nt, Homo sapiens
cagaauaccaagcagaaug

SEQ ID NO: 559511 - RNA, 19 nt, Homo sapiens
caaccaaucuauguuugag

SEQ ID NO: 559512 - RNA, 19 nt, Homo sapiens
uaacagaacacugaacaag

SEQ ID NO: 559513 - RNA, 19 nt, Homo sapiens
aaaguuacaccaacagaau

SEQ ID NO: 559514 - RNA, 19 nt, Homo sapiens
uaaaggaaagcguuaaguc

SEQ ID NO: 559515 - RNA, 19 nt, Homo sapiens
gaacacugaacaaggaaag

SEQ ID NO: 559516 - RNA, 19 nt, Homo sapiens
ucgcagcucacacaguuua

SEQ ID NO: 559517 - RNA, 19 nt, Homo sapiens
auaccaagcagaaugauga

SEQ ID NO: 559518 - RNA, 19 nt, Homo sapiens
gacgaacggacauguauuc

SEQ ID NO: 559519 - RNA, 19 nt, Homo sapiens
gaggguaguuuuaguuguu

SEQ ID NO: 559520 - RNA, 19 nt, Homo sapiens
gcugauguguuccauucau

SEQ ID NO: 559521 - RNA, 19 nt, Homo sapiens
uggugugaauggugaauuu

SEQ ID NO: 559522 - RNA, 19 nt, Homo sapiens
cuucagguuucuauuguau

SEQ ID NO: 559523 - RNA, 19 nt, Homo sapiens
gaaguucuuauuugagcaa

SEQ ID NO: 559524 - RNA, 19 nt, Homo sapiens
uaauucguaugcuuaguca

SEQ ID NO: 559525 - RNA, 19 nt, Homo sapiens
aggcccaguugcuaaauuu

SEQ ID NO: 559526 - RNA, 19 nt, Homo sapiens
aaagucacucuucuaauug

SEQ ID NO: 559527 - RNA, 19 nt, Homo sapiens
gcagcgccaugggcaagaa

SEQ ID NO: 559528 - RNA, 19 nt, Homo sapiens
agaauaccaagcagaauga

SEQ ID NO: 559529 - RNA, 19 nt, Homo sapiens
ucugaacuguauccauauu

SEQ ID NO: 559530 - RNA, 19 nt, Homo sapiens
aaagagcagaguagaaaug

SEQ ID NO: 559531 - RNA, 19 nt, Homo sapiens
gcaucuuccucuaguccuu

SEQ ID NO: 559532 - RNA, 19 nt, Homo sapiens
aggaaagaauggcauagau

SEQ ID NO: 559533 - RNA, 19 nt, Homo sapiens
agaaagcaagauccaaauu

SEQ ID NO: 559534 - RNA, 19 nt, Homo sapiens
ggccuaucuuggcuuguuu

SEQ ID NO: 559535 - RNA, 19 nt, Homo sapiens
cagcaggaccuuuguuuac

SEQ ID NO: 559536 - RNA, 19 nt, Homo sapiens
cuuagaagaaaguggaaua

SEQ ID NO: 559537 - RNA, 19 nt, Homo sapiens
aagagcauuuguaauagga

SEQ ID NO: 559538 - RNA, 19 nt, Homo sapiens
ugccaaaugcuuuagauga

SEQ ID NO: 559539 - RNA, 19 nt, Homo sapiens
auucgcagcucacacaguu

SEQ ID NO: 559540 - RNA, 19 nt, Homo sapiens
caaaguugcgagagaaagu

SEQ ID NO: 559541 - RNA, 19 nt, Homo sapiens
gaaagcguuaagucgguaa

SEQ ID NO: 559542 - RNA, 19 nt, Homo sapiens
guauaaaggaaagcguuaa

SEQ ID NO: 559543 - RNA, 19 nt, Homo sapiens
cauaaaugguaucaagaac

SEQ ID NO: 559544 - RNA, 19 nt, Homo sapiens
aaggcuagauaacuaacaa

SEQ ID NO: 559545 - RNA, 19 nt, Homo sapiens
aaagagaccuucacaauua

SEQ ID NO: 559546 - RNA, 19 nt, Homo sapiens
gcaaaucgcuagcaucauu

SEQ ID NO: 559547 - RNA, 19 nt, Homo sapiens
gagaggagcuaaccuauga

SEQ ID NO: 559548 - RNA, 19 nt, Homo sapiens
gaaagaagcugcggaagga

SEQ ID NO: 559549 - RNA, 19 nt, Homo sapiens
gcagauaccuuguuuagca

SEQ ID NO: 559550 - RNA, 19 nt, Homo sapiens
ggacaaauuugcugcagaa

SEQ ID NO: 559551 - RNA, 19 nt, Homo sapiens
gaacuuggcaccuuagaaa

SEQ ID NO: 559552 - RNA, 19 nt, Homo sapiens
aaacagagcuggagaagca

SEQ ID NO: 559553 - RNA, 19 nt, Homo sapiens
agaaggagcugcagaagaa

SEQ ID NO: 559554 - RNA, 19 nt, Homo sapiens
auacagaccuggacaaauu

SEQ ID NO: 559555 - RNA, 19 nt, Homo sapiens
gagaacggcugcacauguu

SEQ ID NO: 559556 - RNA, 19 nt, Homo sapiens
caaauuugcugcagaagau

SEQ ID NO: 559557 - RNA, 19 nt, Homo sapiens
gaaccuggcuggugaggau

SEQ ID NO: 559558 - RNA, 19 nt, Homo sapiens
gugaauggcagaauaguua

SEQ ID NO: 559559 - RNA, 19 nt, Homo sapiens
gggaaugacucuaagaugu

SEQ ID NO: 559560 - RNA, 19 nt, Homo sapiens
gcagugcccugaaugcaaa

SEQ ID NO: 559561 - RNA, 19 nt, Homo sapiens
gcgacggacucuccuauaa

SEQ ID NO: 559562 - RNA, 19 nt, Homo sapiens
cagaagaacugcccaagau

SEQ ID NO: 559563 - RNA, 19 nt, Homo sapiens
ggagaaggaugaggaguug

SEQ ID NO: 559564 - RNA, 19 nt, Homo sapiens
gauauuagcuaccacacau

SEQ ID NO: 559565 - RNA, 19 nt, Homo sapiens
gggaugagcuagacaagau

SEQ ID NO: 559566 - RNA, 19 nt, Homo sapiens
gaaagggcacugagggaua

SEQ ID NO: 559567 - RNA, 19 nt, Homo sapiens
caaagagaccuucacaauu

SEQ ID NO: 559568 - RNA, 19 nt, Homo sapiens
gaacaacagucuucaucca

SEQ ID NO: 559569 - RNA, 19 nt, Homo sapiens
ggaggcaucucgucuguuc

SEQ ID NO: 559570 - RNA, 19 nt, Homo sapiens
gcaguuugaugcaguguug

SEQ ID NO: 559571 - RNA, 19 nt, Homo sapiens
caacagcagcagcaaguua

SEQ ID NO: 559572 - RNA, 19 nt, Homo sapiens
gcaugaagccgcagcaauu

SEQ ID NO: 559573 - RNA, 19 nt, Homo sapiens
ugugaugacugugauauua

SEQ ID NO: 559574 - RNA, 19 nt, Homo sapiens
gaaccugaauggcgugaug

SEQ ID NO: 559575 - RNA, 19 nt, Homo sapiens
gaagugaggugucagucau

SEQ ID NO: 559576 - RNA, 19 nt, Homo sapiens
gcaaacaaaucaugaagcu

SEQ ID NO: 559577 - RNA, 19 nt, Homo sapiens
ggacaaggccaucuucuca

SEQ ID NO: 559578 - RNA, 19 nt, Homo sapiens
acacaaugguuaucgagua

SEQ ID NO: 559579 - RNA, 19 nt, Homo sapiens
gaacagccggcaacuggua

SEQ ID NO: 559580 - RNA, 19 nt, Homo sapiens
gaaaagcacacaaugguua

SEQ ID NO: 559581 - RNA, 19 nt, Homo sapiens
gcggagcacugaugaaugu

SEQ ID NO: 559582 - RNA, 19 nt, Homo sapiens
aaaccagagucgaacuuua

SEQ ID NO: 559583 - RNA, 19 nt, Homo sapiens
gaugacaccaugcagaaua

SEQ ID NO: 559584 - RNA, 19 nt, Homo sapiens
ccaaagagaccuucacaau

SEQ ID NO: 559585 - RNA, 19 nt, Homo sapiens
gacaaaggauaccauacuu

SEQ ID NO: 559586 - RNA, 19 nt, Homo sapiens
gcucccagcuucccacuga

SEQ ID NO: 559587 - RNA, 19 nt, Homo sapiens
ggagcuaaccuaugacuau

SEQ ID NO: 559588 - RNA, 19 nt, Homo sapiens
ccagguacauuaaccauuc

SEQ ID NO: 559589 - RNA, 19 nt, Homo sapiens
caaagccucuucaacacuu

SEQ ID NO: 559590 - RNA, 19 nt, Homo sapiens
guccagauauugcagauga

SEQ ID NO: 559591 - RNA, 19 nt, Homo sapiens
gaaugacucuaagauguug

SEQ ID NO: 559592 - RNA, 19 nt, Homo sapiens
ggaaaggagugcgcuggaa

SEQ ID NO: 559593 - RNA, 19 nt, Homo sapiens
ggaaggcccuagaggugaa

SEQ ID NO: 559594 - RNA, 19 nt, Homo sapiens
caucagcccuccaccagaa

SEQ ID NO: 559595 - RNA, 19 nt, Homo sapiens
caaaggaagugagguguca

SEQ ID NO: 559596 - RNA, 19 nt, Homo sapiens
ggaccugauucaaggcuuu

SEQ ID NO: 559597 - RNA, 19 nt, Homo sapiens
ugaaaggcaucaagaaagu

SEQ ID NO: 559598 - RNA, 19 nt, Homo sapiens
caucaaauccgacaucguu

SEQ ID NO: 559599 - RNA, 19 nt, Homo sapiens
gauggagacugagaaaguu

SEQ ID NO: 559600 - RNA, 19 nt, Homo sapiens
ccagauggcugacuuucau

SEQ ID NO: 559601 - RNA, 19 nt, Homo sapiens
gaggaccuaucacagauug

SEQ ID NO: 559602 - RNA, 19 nt, Homo sapiens
ccaagaauaaccugaguaa

SEQ ID NO: 559603 - RNA, 19 nt, Homo sapiens
auugauagcucucccagua

SEQ ID NO: 559604 - RNA, 19 nt, Homo sapiens
ggaaugacucuaagauguu

SEQ ID NO: 559605 - RNA, 19 nt, Homo sapiens
cagcaaagccucuucaaca

SEQ ID NO: 559606 - RNA, 19 nt, Homo sapiens
ggccaagggugaugaugaa

SEQ ID NO: 559607 - RNA, 19 nt, Homo sapiens
ucaugaagcucuggagaaa

SEQ ID NO: 559608 - RNA, 19 nt, Homo sapiens
gauggaggcucagaaagga

SEQ ID NO: 559609 - RNA, 19 nt, Homo sapiens
ggagauggaggcucagaaa

SEQ ID NO: 559610 - RNA, 19 nt, Homo sapiens
cauguucccugcuuacuug

SEQ ID NO: 559611 - RNA, 19 nt, Homo sapiens
gaacaugugauugaugcua

SEQ ID NO: 559612 - RNA, 19 nt, Homo sapiens
gggacgaggugaagcaaau

SEQ ID NO: 559613 - RNA, 19 nt, Homo sapiens
gcaaagaaugugcaacuca

SEQ ID NO: 559614 - RNA, 19 nt, Homo sapiens
gcagcacccuggagcuuug

SEQ ID NO: 559615 - RNA, 19 nt, Homo sapiens
caagggugaugaugaacuu

SEQ ID NO: 559616 - RNA, 19 nt, Homo sapiens
cacauggagugcgaaauua

SEQ ID NO: 559617 - RNA, 19 nt, Homo sapiens
gcuuugaguugccauuuga

SEQ ID NO: 559618 - RNA, 19 nt, Homo sapiens
gaacagcaccagcaugucu

SEQ ID NO: 559619 - RNA, 19 nt, Homo sapiens
cuacugagcccuugguuga

SEQ ID NO: 559620 - RNA, 19 nt, Homo sapiens
gcagggcugucccaucuuc

SEQ ID NO: 559621 - RNA, 19 nt, Homo sapiens
ggagcacacuaaucucaug

SEQ ID NO: 559622 - RNA, 19 nt, Homo sapiens
gcaggagggcccacaacua

SEQ ID NO: 559623 - RNA, 19 nt, Homo sapiens
gcagugcucucagugcuau

SEQ ID NO: 559624 - RNA, 19 nt, Homo sapiens
gcacgugaccucuaugcaa

SEQ ID NO: 559625 - RNA, 19 nt, Homo sapiens
ggaacugccugcucacucu

SEQ ID NO: 559626 - RNA, 19 nt, Homo sapiens
ccaagaugguggcuuugaa

SEQ ID NO: 559627 - RNA, 19 nt, Homo sapiens
ugaugaacuuggcaccuua

SEQ ID NO: 559628 - RNA, 19 nt, Homo sapiens
caucaccucuccugucgaa

SEQ ID NO: 559629 - RNA, 19 nt, Homo sapiens
cgacauagcccguaagacu

SEQ ID NO: 559630 - RNA, 19 nt, Homo sapiens
gcagaggcccuuucuucaa

SEQ ID NO: 559631 - RNA, 19 nt, Homo sapiens
gguaguugcugacauugau

SEQ ID NO: 559632 - RNA, 19 nt, Homo sapiens
ggagaacggcugcacaugu

SEQ ID NO: 559633 - RNA, 19 nt, Homo sapiens
ccaagugcauguucuucaa

SEQ ID NO: 559634 - RNA, 19 nt, Homo sapiens
ccacuggcccugacuacua

SEQ ID NO: 559635 - RNA, 19 nt, Homo sapiens
ggaacaagcagcagcaaca

SEQ ID NO: 559636 - RNA, 19 nt, Homo sapiens
ggagaugaugguccagaua

SEQ ID NO: 559637 - RNA, 19 nt, Homo sapiens
gaagaggaccuacuaaucc

SEQ ID NO: 559638 - RNA, 19 nt, Homo sapiens
uaccauacuuucugccuaa

SEQ ID NO: 559639 - RNA, 19 nt, Homo sapiens
gcaggaaccucgggaagag

SEQ ID NO: 559640 - RNA, 19 nt, Homo sapiens
gcuugcagauaccuuguuu

SEQ ID NO: 559641 - RNA, 19 nt, Homo sapiens
ucagcccucuguuuccuua

SEQ ID NO: 559642 - RNA, 19 nt, Homo sapiens
gaaguugcccugugaggau

SEQ ID NO: 559643 - RNA, 19 nt, Homo sapiens
gaauugaacaacagucuuc

SEQ ID NO: 559644 - RNA, 19 nt, Homo sapiens
ucaacaaggugcagaagca

SEQ ID NO: 559645 - RNA, 19 nt, Homo sapiens
ugccagagcugcauucuua

SEQ ID NO: 559646 - RNA, 19 nt, Homo sapiens
gaagagaugcaucaacauu

SEQ ID NO: 559647 - RNA, 19 nt, Homo sapiens
gaacugccuucauccauca

SEQ ID NO: 559648 - RNA, 19 nt, Homo sapiens
gguggaggcucuauucaug

SEQ ID NO: 559649 - RNA, 19 nt, Homo sapiens
cgacugcuguucacuguau

SEQ ID NO: 559650 - RNA, 19 nt, Homo sapiens
gagcaaguguggaagagau

SEQ ID NO: 559651 - RNA, 19 nt, Homo sapiens
cacaagaacugccuucauc

SEQ ID NO: 559652 - RNA, 19 nt, Homo sapiens
gagguggccuacucuauca

SEQ ID NO: 559653 - RNA, 19 nt, Homo sapiens
gacccuaccuccuugucua

SEQ ID NO: 559654 - RNA, 19 nt, Homo sapiens
ugggagagccacugauuua

SEQ ID NO: 559655 - RNA, 19 nt, Homo sapiens
agagaugcaucaacauuug

SEQ ID NO: 559656 - RNA, 19 nt, Homo sapiens
gaucaaucuuccuguccua

SEQ ID NO: 559657 - RNA, 19 nt, Homo sapiens
gguaugggaugucucaaca

SEQ ID NO: 559658 - RNA, 19 nt, Homo sapiens
gaacgucuggcugugcuua

SEQ ID NO: 559659 - RNA, 19 nt, Homo sapiens
uggaagagaugcaucaaca

SEQ ID NO: 559660 - RNA, 19 nt, Homo sapiens
ccaccucuaagaauaaaua

SEQ ID NO: 559661 - RNA, 19 nt, Homo sapiens
gagagccacugauuuacuc

SEQ ID NO: 559662 - RNA, 19 nt, Homo sapiens
gcccagauguggacuugug

SEQ ID NO: 559663 - RNA, 19 nt, Homo sapiens
gcaaagucagcaacgauug

SEQ ID NO: 559664 - RNA, 19 nt, Homo sapiens
cagaagaagagguguuuga

SEQ ID NO: 559665 - RNA, 19 nt, Homo sapiens
uaugggaugucucaacaga

SEQ ID NO: 559666 - RNA, 19 nt, Homo sapiens
gaagaagagguguuugagu

SEQ ID NO: 559667 - RNA, 19 nt, Homo sapiens
ccacaucccgcuguacuuu

SEQ ID NO: 559668 - RNA, 19 nt, Homo sapiens
uauaugagcacaauaacga

SEQ ID NO: 559669 - RNA, 19 nt, Homo sapiens
ggucaagucacccuauaug

SEQ ID NO: 559670 - RNA, 19 nt, Homo sapiens
gcacaagaacugccuucau

SEQ ID NO: 559671 - RNA, 19 nt, Homo sapiens
caguggcccugcuagauga

SEQ ID NO: 559672 - RNA, 19 nt, Homo sapiens
gaccauggcacaagaacug

SEQ ID NO: 559673 - RNA, 19 nt, Homo sapiens
caacgauuguggcagaucu

SEQ ID NO: 559674 - RNA, 19 nt, Homo sapiens
gcuggaccauggcacaaga

SEQ ID NO: 559675 - RNA, 19 nt, Homo sapiens
gcucaucacuuuccauccu

SEQ ID NO: 559676 - RNA, 19 nt, Homo sapiens
caaucuuccuguccuacaa

SEQ ID NO: 559677 - RNA, 19 nt, Homo sapiens
gaaauugcaaacucagaag

SEQ ID NO: 559678 - RNA, 19 nt, Homo sapiens
ugaaauugcaaacucagaa

SEQ ID NO: 559679 - RNA, 19 nt, Homo sapiens
ggugcuaaaugaaauugca

SEQ ID NO: 559680 - RNA, 19 nt, Homo sapiens
cuccuucccuguggcauua

SEQ ID NO: 559681 - RNA, 19 nt, Homo sapiens
caaggguacaggaugguaa

SEQ ID NO: 559682 - RNA, 19 nt, Homo sapiens
cguuggaggugcaaaguca

SEQ ID NO: 559683 - RNA, 19 nt, Homo sapiens
aagagaugcaucaacauuu

SEQ ID NO: 559684 - RNA, 19 nt, Homo sapiens
aaaccagucauccuccuuu

SEQ ID NO: 559685 - RNA, 19 nt, Homo sapiens
caaagucagcaacgauugu

SEQ ID NO: 559686 - RNA, 19 nt, Homo sapiens
uggcgucucuggccuggaa

SEQ ID NO: 559687 - RNA, 19 nt, Homo sapiens
gacaaaggauccccuaaag

SEQ ID NO: 559688 - RNA, 19 nt, Homo sapiens
ugaauuugcccaagucaca

SEQ ID NO: 559689 - RNA, 19 nt, Homo sapiens
ugauuuacucccugucuuu

SEQ ID NO: 559690 - RNA, 19 nt, Homo sapiens
ggagagccacugauuuacu

SEQ ID NO: 559691 - RNA, 19 nt, Homo sapiens
gccgacugcuguucacugu

SEQ ID NO: 559692 - RNA, 19 nt, Homo sapiens
ugugagagguggccuacuc

SEQ ID NO: 559693 - RNA, 19 nt, Homo sapiens
ucagcugucuuucgagucu

SEQ ID NO: 559694 - RNA, 19 nt, Homo sapiens
uggcugugcuuaugaaagg

SEQ ID NO: 559695 - RNA, 19 nt, Homo sapiens
cauccuuccuucaacaaag

SEQ ID NO: 559696 - RNA, 19 nt, Homo sapiens
acucaguccguguguauaa

SEQ ID NO: 559697 - RNA, 19 nt, Homo sapiens
ucaagucacccuauaugag

SEQ ID NO: 559698 - RNA, 19 nt, Homo sapiens
ggaagagaugcaucaacau

SEQ ID NO: 559699 - RNA, 19 nt, Homo sapiens
cacauucccaccucuaaga

SEQ ID NO: 559700 - RNA, 19 nt, Homo sapiens
auacaccuguuaccagcuu

SEQ ID NO: 559701 - RNA, 19 nt, Homo sapiens
uugcccaagucacaaauug

SEQ ID NO: 559702 - RNA, 19 nt, Homo sapiens
gaauuugcccaagucacaa

SEQ ID NO: 559703 - RNA, 19 nt, Homo sapiens
cccuauaugagcacaauaa

SEQ ID NO: 559704 - RNA, 19 nt, Homo sapiens
gucaagucacccuauauga

SEQ ID NO: 559705 - RNA, 19 nt, Homo sapiens
cuuugucaaugcccaguuu

SEQ ID NO: 559706 - RNA, 19 nt, Homo sapiens
gugcccaagugcugucuca

SEQ ID NO: 559707 - RNA, 19 nt, Homo sapiens
ccgcuguacuuugucaaug

SEQ ID NO: 559708 - RNA, 19 nt, Homo sapiens
gauuguggcagaucugucu

SEQ ID NO: 559709 - RNA, 19 nt, Homo sapiens
caagaacugccuucaucca

SEQ ID NO: 559710 - RNA, 19 nt, Homo sapiens
gggagcaaguguggaagag

SEQ ID NO: 559711 - RNA, 19 nt, Homo sapiens
guggaggcucuauucauga

SEQ ID NO: 559712 - RNA, 19 nt, Homo sapiens
ggugcaaagucagcaacga

SEQ ID NO: 559713 - RNA, 19 nt, Homo sapiens
ucgcugaauuugcccaagu

SEQ ID NO: 559714 - RNA, 19 nt, Homo sapiens
acaucccgcuguacuuugu

SEQ ID NO: 559715 - RNA, 19 nt, Homo sapiens
gagcuggugacgggcagua

SEQ ID NO: 559716 - RNA, 19 nt, Homo sapiens
ccaaggguacaggauggua

SEQ ID NO: 559717 - RNA, 19 nt, Homo sapiens
gagaggcucacuccauggu

SEQ ID NO: 559718 - RNA, 19 nt, Homo sapiens
gugcaaagucagcaacgau

SEQ ID NO: 559719 - RNA, 19 nt, Homo sapiens
ugacaaaggauccccuaaa

SEQ ID NO: 559720 - RNA, 19 nt, Homo sapiens
cacccuauaugagcacaau

SEQ ID NO: 559721 - RNA, 19 nt, Homo sapiens
ccuuagugccucugucuug

SEQ ID NO: 559722 - RNA, 19 nt, Homo sapiens
ggagcaaguguggaagaga

SEQ ID NO: 559723 - RNA, 19 nt, Homo sapiens
ugagacaacaauacagaca

SEQ ID NO: 559724 - RNA, 19 nt, Homo sapiens
gggcauacaccuguuacca

SEQ ID NO: 559725 - RNA, 19 nt, Homo sapiens
ggacaaaucuggugugguu

SEQ ID NO: 559726 - RNA, 19 nt, Homo sapiens
ccauacagcuuacuugaua

SEQ ID NO: 559727 - RNA, 19 nt, Homo sapiens
ugaagaaguuccuaguuua

SEQ ID NO: 559728 - RNA, 19 nt, Homo sapiens
guaaacaucuuaagugaca

SEQ ID NO: 559729 - RNA, 19 nt, Homo sapiens
gaaaugaagaggccacuaa

SEQ ID NO: 559730 - RNA, 19 nt, Homo sapiens
gaguaaacaucuuaaguga

SEQ ID NO: 559731 - RNA, 19 nt, Homo sapiens
gagaugaaguagagguaua

SEQ ID NO: 559732 - RNA, 19 nt, Homo sapiens
ucaaagauguucaugaaga

SEQ ID NO: 559733 - RNA, 19 nt, Homo sapiens
ggaagaggcagaaguguuu

SEQ ID NO: 559734 - RNA, 19 nt, Homo sapiens
gcaauaaacggcccaacua

SEQ ID NO: 559735 - RNA, 19 nt, Homo sapiens
aaacauacuuugacaccua

SEQ ID NO: 559736 - RNA, 19 nt, Homo sapiens
gaacagcugcgacagauug

SEQ ID NO: 559737 - RNA, 19 nt, Homo sapiens
guacgaaguugaugcuuau

SEQ ID NO: 559738 - RNA, 19 nt, Homo sapiens
gaaacaacacagcuaauga

SEQ ID NO: 559739 - RNA, 19 nt, Homo sapiens
caacacagcuaaugauacu

SEQ ID NO: 559740 - RNA, 19 nt, Homo sapiens
gaauauggaucgccagucu

SEQ ID NO: 559741 - RNA, 19 nt, Homo sapiens
gcaauaggaacacauggua

SEQ ID NO: 559742 - RNA, 19 nt, Homo sapiens
cugaagaaguuccuaguuu

SEQ ID NO: 559743 - RNA, 19 nt, Homo sapiens
ugauacagcuucaguuaau

SEQ ID NO: 559744 - RNA, 19 nt, Homo sapiens
caaaagaugugauugaaga

SEQ ID NO: 559745 - RNA, 19 nt, Homo sapiens
cuaggaaucucguuggaaa

SEQ ID NO: 559746 - RNA, 19 nt, Homo sapiens
ccauugagcuagaugaaga

SEQ ID NO: 559747 - RNA, 19 nt, Homo sapiens
gaagaggccacuaagcauu

SEQ ID NO: 559748 - RNA, 19 nt, Homo sapiens
gacaugcauuugcgaagua

SEQ ID NO: 559749 - RNA, 19 nt, Homo sapiens
ggagggauccugaagaaau

SEQ ID NO: 559750 - RNA, 19 nt, Homo sapiens
uguacaagcuugccaaaga

SEQ ID NO: 559751 - RNA, 19 nt, Homo sapiens
gaugaugaaaggagaauuu

SEQ ID NO: 559752 - RNA, 19 nt, Homo sapiens
ugaaggagaugaaguagag

SEQ ID NO: 559753 - RNA, 19 nt, Homo sapiens
ugaagaugcuguucugaug

SEQ ID NO: 559754 - RNA, 19 nt, Homo sapiens
cguacgaaguugaugcuua

SEQ ID NO: 559755 - RNA, 19 nt, Homo sapiens
guacaagcuugccaaagau

SEQ ID NO: 559756 - RNA, 19 nt, Homo sapiens
caagggaaacuuuggcuaa

SEQ ID NO: 559757 - RNA, 19 nt, Homo sapiens
ggaaugacugaaucugaua

SEQ ID NO: 559758 - RNA, 19 nt, Homo sapiens
guaaagacgagcugaguga

SEQ ID NO: 559759 - RNA, 19 nt, Homo sapiens
ggaaguagaacagcuaaga

SEQ ID NO: 559760 - RNA, 19 nt, Homo sapiens
gagcaugguccuucagaaa

SEQ ID NO: 559761 - RNA, 19 nt, Homo sapiens
cagcgaaucucaucacagu

SEQ ID NO: 559762 - RNA, 19 nt, Homo sapiens
cuaauuacaccuccgguua

SEQ ID NO: 559763 - RNA, 19 nt, Homo sapiens
gaagauacuggaacauuca

SEQ ID NO: 559764 - RNA, 19 nt, Homo sapiens
caaauucugagcugucuaa

SEQ ID NO: 559765 - RNA, 19 nt, Homo sapiens
gaagacucccuuacaguug

SEQ ID NO: 559766 - RNA, 19 nt, Homo sapiens
gaaguagaacagcuaagaa

SEQ ID NO: 559767 - RNA, 19 nt, Homo sapiens
uggcaaaguuauucaagaa

SEQ ID NO: 559768 - RNA, 19 nt, Homo sapiens
agagagugcugaugcugua

SEQ ID NO: 559769 - RNA, 19 nt, Homo sapiens
ugaagauacuggaacauuc

SEQ ID NO: 559770 - RNA, 19 nt, Homo sapiens
ggcuagagguuucuuggaa

SEQ ID NO: 559771 - RNA, 19 nt, Homo sapiens
ggaauuuguugugagagaa

SEQ ID NO: 559772 - RNA, 19 nt, Homo sapiens
caagggauuuaucaaagau

SEQ ID NO: 559773 - RNA, 19 nt, Homo sapiens
gagggauccugaagaaauc

SEQ ID NO: 559774 - RNA, 19 nt, Homo sapiens
ucucagagcagacaaagaa

SEQ ID NO: 559775 - RNA, 19 nt, Homo sapiens
ucaguucugugcucaaaga

SEQ ID NO: 559776 - RNA, 19 nt, Homo sapiens
gcaaauccuccaucaguuc

SEQ ID NO: 559777 - RNA, 19 nt, Homo sapiens
ggcaaauccuccaucaguu

SEQ ID NO: 559778 - RNA, 19 nt, Homo sapiens
cuacaagggauuuaucaaa

SEQ ID NO: 559779 - RNA, 19 nt, Homo sapiens
acaagggauuuaucaaaga

SEQ ID NO: 559780 - RNA, 19 nt, Homo sapiens
ugaagcaacugugaagaga

SEQ ID NO: 559781 - RNA, 19 nt, Homo sapiens
caucaguucugugcucaaa

SEQ ID NO: 559782 - RNA, 19 nt, Homo sapiens
ggaggaagaggcagaagug

SEQ ID NO: 559783 - RNA, 19 nt, Homo sapiens
ugaggaauuuguugugaga

SEQ ID NO: 559784 - RNA, 19 nt, Homo sapiens
ccagaaacaacacagcuaa

SEQ ID NO: 559785 - RNA, 19 nt, Homo sapiens
gcagguucuucuagaguau

SEQ ID NO: 559786 - RNA, 19 nt, Homo sapiens
cuagagguuucuuggaauu

SEQ ID NO: 559787 - RNA, 19 nt, Homo sapiens
gcgaugacauuucuaagcu

SEQ ID NO: 559788 - RNA, 19 nt, Homo sapiens
agaaagaaauggcaaaaga

SEQ ID NO: 559789 - RNA, 19 nt, Homo sapiens
cagcuuacuugauaauaca

SEQ ID NO: 559790 - RNA, 19 nt, Homo sapiens
gagaguaaacaucuuaagu

SEQ ID NO: 559791 - RNA, 19 nt, Homo sapiens
gaagaaguuccuaguuuac

SEQ ID NO: 559792 - RNA, 19 nt, Homo sapiens
cagcaauccauacagcuua

SEQ ID NO: 559793 - RNA, 19 nt, Homo sapiens
ucaaagauccagacagcaa

SEQ ID NO: 559794 - RNA, 19 nt, Homo sapiens
aagacgagcugagugauug

SEQ ID NO: 559795 - RNA, 19 nt, Homo sapiens
cuaaagaaagcauuggaaa

SEQ ID NO: 559796 - RNA, 19 nt, Homo sapiens
cagagaagacgguaugguu

SEQ ID NO: 559797 - RNA, 19 nt, Homo sapiens
gaaguagagguauauucaa

SEQ ID NO: 559798 - RNA, 19 nt, Homo sapiens
uggaauuuguggaggauuu

SEQ ID NO: 559799 - RNA, 19 nt, Homo sapiens
gcuagagguuucuuggaau

SEQ ID NO: 559800 - RNA, 19 nt, Homo sapiens
guagagguauauucaagag

SEQ ID NO: 559801 - RNA, 19 nt, Homo sapiens
caugaggaauuuguuguga

SEQ ID NO: 559802 - RNA, 19 nt, Homo sapiens
gaauggaacgccuacagau

SEQ ID NO: 559803 - RNA, 19 nt, Homo sapiens
uacaagggauuuaucaaag

SEQ ID NO: 559804 - RNA, 19 nt, Homo sapiens
caucuuaagugacaugcau

SEQ ID NO: 559805 - RNA, 19 nt, Homo sapiens
gagaggcgugugcuaauga

SEQ ID NO: 559806 - RNA, 19 nt, Homo sapiens
uuacaucgcacuuucaguu

SEQ ID NO: 559807 - RNA, 19 nt, Homo sapiens
gaucgccagucuuuacauc

SEQ ID NO: 559808 - RNA, 19 nt, Homo sapiens
gauaauacagaaucagauc

SEQ ID NO: 559809 - RNA, 19 nt, Homo sapiens
gaaauuagugaaggagaug

SEQ ID NO: 559810 - RNA, 19 nt, Homo sapiens
aaacggaaucugagcguaa

SEQ ID NO: 559811 - RNA, 19 nt, Homo sapiens
ugaagacucccuuacaguu

SEQ ID NO: 559812 - RNA, 19 nt, Homo sapiens
gaaucucguuggaaaagua

SEQ ID NO: 559813 - RNA, 19 nt, Homo sapiens
gaacgacuucggccuguca

SEQ ID NO: 559814 - RNA, 19 nt, Homo sapiens
ugacgcuacuuacaaugaa

SEQ ID NO: 559815 - RNA, 19 nt, Homo sapiens
gcuaaaguucggaugauga

SEQ ID NO: 559816 - RNA, 19 nt, Homo sapiens
acgaaggacugaugaagau

SEQ ID NO: 559817 - RNA, 19 nt, Homo sapiens
gcugagugauuggucauug

SEQ ID NO: 559818 - RNA, 19 nt, Homo sapiens
uagaacagcuaagaaugga

SEQ ID NO: 559819 - RNA, 19 nt, Homo sapiens
cauauugccuaucuaaagg

SEQ ID NO: 559820 - RNA, 19 nt, Homo sapiens
gaaaugugcagguucuucu

SEQ ID NO: 559821 - RNA, 19 nt, Homo sapiens
agaugugccuugagaauag

SEQ ID NO: 559822 - RNA, 19 nt, Homo sapiens
gacgaaggacugaugaaga

SEQ ID NO: 559823 - RNA, 19 nt, Homo sapiens
cgaaguugaugcuuauguc

SEQ ID NO: 559824 - RNA, 19 nt, Homo sapiens
cagaugugccuugagaaua

SEQ ID NO: 559825 - RNA, 19 nt, Homo sapiens
gaaauggacuuacugcaaa

SEQ ID NO: 559826 - RNA, 19 nt, Homo sapiens
guaguaagcuaaacugaaa

SEQ ID NO: 559827 - RNA, 19 nt, Homo sapiens
gacaauauguucaagagaa

SEQ ID NO: 559828 - RNA, 19 nt, Homo sapiens
gacaacaucucgucagcua

SEQ ID NO: 559829 - RNA, 19 nt, Homo sapiens
caugagaacuugguaguaa

SEQ ID NO: 559830 - RNA, 19 nt, Homo sapiens
uauaugauguguccaguaa

SEQ ID NO: 559831 - RNA, 19 nt, Homo sapiens
gcaauaggaauuuguacua

SEQ ID NO: 559832 - RNA, 19 nt, Homo sapiens
gggcuucacuggagaaaug

SEQ ID NO: 559833 - RNA, 19 nt, Homo sapiens
caacagcaaugaugcaaca

SEQ ID NO: 559834 - RNA, 19 nt, Homo sapiens
gaacuugguaguaagcuaa

SEQ ID NO: 559835 - RNA, 19 nt, Homo sapiens
ugaagaagaugaccaagca

SEQ ID NO: 559836 - RNA, 19 nt, Homo sapiens
gcaaugaugcaacaauuau

SEQ ID NO: 559837 - RNA, 19 nt, Homo sapiens
cagcaaugaugcaacaauu

SEQ ID NO: 559838 - RNA, 19 nt, Homo sapiens
uuacuaaaccuccauauga

SEQ ID NO: 559839 - RNA, 19 nt, Homo sapiens
aagaauggaugcuauauag

SEQ ID NO: 559840 - RNA, 19 nt, Homo sapiens
uagaggaacuucauauaca

SEQ ID NO: 559841 - RNA, 19 nt, Homo sapiens
gcaagucgugaaacuauaa

SEQ ID NO: 559842 - RNA, 19 nt, Homo sapiens
caagagaauggccgaauuu

SEQ ID NO: 559843 - RNA, 19 nt, Homo sapiens
ucaagagaauggccgaauu

SEQ ID NO: 559844 - RNA, 19 nt, Homo sapiens
gaccaugaauuucuuagca

SEQ ID NO: 559845 - RNA, 19 nt, Homo sapiens
caaaugcugugauguuucu

SEQ ID NO: 559846 - RNA, 19 nt, Homo sapiens
uuucagaguucuaugauga

SEQ ID NO: 559847 - RNA, 19 nt, Homo sapiens
gugaaaccauauagaaaug

SEQ ID NO: 559848 - RNA, 19 nt, Homo sapiens
ccugaggaguugacgguua

SEQ ID NO: 559849 - RNA, 19 nt, Homo sapiens
ggcaauccuuuaagaguug

SEQ ID NO: 559850 - RNA, 19 nt, Homo sapiens
auacagcuguugaccauga

SEQ ID NO: 559851 - RNA, 19 nt, Homo sapiens
gacagugguuucagaguuc

SEQ ID NO: 559852 - RNA, 19 nt, Homo sapiens
agacagugguuucagaguu

SEQ ID NO: 559853 - RNA, 19 nt, Homo sapiens
gaaaccauauagaaaugag

SEQ ID NO: 559854 - RNA, 19 nt, Homo sapiens
ucagaaaacuugaagaaga

SEQ ID NO: 559855 - RNA, 19 nt, Homo sapiens
agaguucuaugaugaaaug

SEQ ID NO: 559856 - RNA, 19 nt, Homo sapiens
uacuaaaccuccauaugaa

SEQ ID NO: 559857 - RNA, 19 nt, Homo sapiens
gaauggaugcuauauaggu

SEQ ID NO: 559858 - RNA, 19 nt, Homo sapiens
gcugugauguuucuuagag

SEQ ID NO: 559859 - RNA, 19 nt, Homo sapiens
cauauaaacaguucucaug

SEQ ID NO: 559860 - RNA, 19 nt, Homo sapiens
caugaaagcuauggcaauc

SEQ ID NO: 559861 - RNA, 19 nt, Homo sapiens
gugaagaaacuuaaugugu

SEQ ID NO: 559862 - RNA, 19 nt, Homo sapiens
ccuauaagcaugaaacaga

SEQ ID NO: 559863 - RNA, 19 nt, Homo sapiens
cuguaacccuguaucauuu

SEQ ID NO: 559864 - RNA, 19 nt, Homo sapiens
gggacaauauguucaagag

SEQ ID NO: 559865 - RNA, 19 nt, Homo sapiens
cuauaagcaugaaacagaa

SEQ ID NO: 559866 - RNA, 19 nt, Homo sapiens
uaaagcuguuucaaucaga

SEQ ID NO: 559867 - RNA, 19 nt, Homo sapiens
cagcauaugugaagaaaau

SEQ ID NO: 559868 - RNA, 19 nt, Homo sapiens
gguaguaagcuaaacugaa

SEQ ID NO: 559869 - RNA, 19 nt, Homo sapiens
uggcaauccuuuaagaguu

SEQ ID NO: 559870 - RNA, 19 nt, Homo sapiens
aauggaugcuauauaggua

SEQ ID NO: 559871 - RNA, 19 nt, Homo sapiens
aaaacaagcuuugagauug

SEQ ID NO: 559872 - RNA, 19 nt, Homo sapiens
ugcaaaugcugugauguuu

SEQ ID NO: 559873 - RNA, 19 nt, Homo sapiens
gaaauuacugaaacaggau

SEQ ID NO: 559874 - RNA, 19 nt, Homo sapiens
uaugauguguccaguaagu

SEQ ID NO: 559875 - RNA, 19 nt, Homo sapiens
agaaauggacuuacugcaa

SEQ ID NO: 559876 - RNA, 19 nt, Homo sapiens
ccuguaacccuguaucauu

SEQ ID NO: 559877 - RNA, 19 nt, Homo sapiens
ucagaguucuaugaugaaa

SEQ ID NO: 559878 - RNA, 19 nt, Homo sapiens
ugcuaaagcuguuucaauc

SEQ ID NO: 559879 - RNA, 19 nt, Homo sapiens
cuauggcaauccuuuaaga

SEQ ID NO: 559880 - RNA, 19 nt, Homo sapiens
guaauguugcucgguauuu

SEQ ID NO: 559881 - RNA, 19 nt, Homo sapiens
uaaaggguguuacuaucgu

SEQ ID NO: 559882 - RNA, 19 nt, Homo sapiens
gcaaaugcugugauguuuc

SEQ ID NO: 559883 - RNA, 19 nt, Homo sapiens
uauaaacaguucucaugag

SEQ ID NO: 559884 - RNA, 19 nt, Homo sapiens
aaacaagcuuugagauugc

SEQ ID NO: 559885 - RNA, 19 nt, Homo sapiens
acucaucaguggacaguau

SEQ ID NO: 559886 - RNA, 19 nt, Homo sapiens
ccaugaauuucuuagcaau

SEQ ID NO: 559887 - RNA, 19 nt, Homo sapiens
ggacaauauguucaagaga

SEQ ID NO: 559888 - RNA, 19 nt, Homo sapiens
aaagaccuguaacccugua

SEQ ID NO: 559889 - RNA, 19 nt, Homo sapiens
ccuaaugaaagaccuguaa

SEQ ID NO: 559890 - RNA, 19 nt, Homo sapiens
gacaguauaugugaaacca

SEQ ID NO: 559891 - RNA, 19 nt, Homo sapiens
ggcuagaauuagugaagaa

SEQ ID NO: 559892 - RNA, 19 nt, Homo sapiens
guaagaauggaugcuauau

SEQ ID NO: 559893 - RNA, 19 nt, Homo sapiens
gucgugaaacuauaaauug

SEQ ID NO: 559894 - RNA, 19 nt, Homo sapiens
gcaugaaacagaauuugca

SEQ ID NO: 559895 - RNA, 19 nt, Homo sapiens
ggguguuacuaucguuaaa

SEQ ID NO: 559896 - RNA, 19 nt, Homo sapiens
gaagugaaaaccagagaaa

SEQ ID NO: 559897 - RNA, 19 nt, Homo sapiens
gcuaaagcuguuucaauca

SEQ ID NO: 559898 - RNA, 19 nt, Homo sapiens
guguaagaauggaugcuau

SEQ ID NO: 559899 - RNA, 19 nt, Homo sapiens
cuaaagcuguuucaaucag

SEQ ID NO: 559900 - RNA, 19 nt, Homo sapiens
gaauuucuuagcaauagga

SEQ ID NO: 559901 - RNA, 19 nt, Homo sapiens
aagcaagucgugaaacuau

SEQ ID NO: 559902 - RNA, 19 nt, Homo sapiens
cuuagaggaacuucauaua

SEQ ID NO: 559903 - RNA, 19 nt, Homo sapiens
ccauauagaaaugaggaua

SEQ ID NO: 559904 - RNA, 19 nt, Homo sapiens
ugacaggcaucaaaauuuc

SEQ ID NO: 559905 - RNA, 19 nt, Homo sapiens
uguaagaauggaugcuaua

SEQ ID NO: 559906 - RNA, 19 nt, Homo sapiens
gaaagaaaagagaagaaga

SEQ ID NO: 559907 - RNA, 19 nt, Homo sapiens
caacaucucgucagcuaac

SEQ ID NO: 559908 - RNA, 19 nt, Homo sapiens
guauaugauguguccagua

SEQ ID NO: 559909 - RNA, 19 nt, Homo sapiens
auauacagcuguugaccau

SEQ ID NO: 559910 - RNA, 19 nt, Homo sapiens
gucagcauaugugaagaaa

SEQ ID NO: 559911 - RNA, 19 nt, Homo sapiens
agaacuugguaguaagcua

SEQ ID NO: 559912 - RNA, 19 nt, Homo sapiens
aagaagaugaccaagcaaa

SEQ ID NO: 559913 - RNA, 19 nt, Homo sapiens
gaagaagaugaccaagcaa

SEQ ID NO: 559914 - RNA, 19 nt, Homo sapiens
cagaaaacuugaagaagau

SEQ ID NO: 559915 - RNA, 19 nt, Homo sapiens
cuucuuccgugggacaaua

SEQ ID NO: 559916 - RNA, 19 nt, Homo sapiens
gaaacaggauggggugaau

SEQ ID NO: 559917 - RNA, 19 nt, Homo sapiens
cuaaaccuccauaugaaau

SEQ ID NO: 559918 - RNA, 19 nt, Homo sapiens
gauguguccaguaaguauu

SEQ ID NO: 559919 - RNA, 19 nt, Homo sapiens
guauagcuuauuacccuuu

SEQ ID NO: 559920 - RNA, 19 nt, Homo sapiens
uggaugcuauauagguauu

SEQ ID NO: 559921 - RNA, 19 nt, Homo sapiens
agaagaagaugggcacacu

SEQ ID NO: 559922 - RNA, 19 nt, Homo sapiens
aaauggacuuacugcaaau

SEQ ID NO: 559923 - RNA, 19 nt, Homo sapiens
guuacuaucguuaaaccaa

SEQ ID NO: 559924 - RNA, 19 nt, Homo sapiens
ggugaauucgaaauaauca

SEQ ID NO: 559925 - RNA, 19 nt, Homo sapiens
ggaaugaacuuguuacuug

SEQ ID NO: 559926 - RNA, 19 nt, Homo sapiens
ggacacagcuuaacaaugc

SEQ ID NO: 559927 - RNA, 19 nt, Homo sapiens
uaaggaaacuagacaagua

SEQ ID NO: 559928 - RNA, 19 nt, Homo sapiens
ggaaguaagcaaacaaaua

SEQ ID NO: 559929 - RNA, 19 nt, Homo sapiens
gaauaccacuuaccucaaa

SEQ ID NO: 559930 - RNA, 19 nt, Homo sapiens
gaagcaaucuccuuacugu

SEQ ID NO: 559931 - RNA, 19 nt, Homo sapiens
gaagagacauccucacaag

SEQ ID NO: 559932 - RNA, 19 nt, Homo sapiens
gcagaucgcucacuguugu

SEQ ID NO: 559933 - RNA, 19 nt, Homo sapiens
uuaaggagauggacuaauu

SEQ ID NO: 559934 - RNA, 19 nt, Homo sapiens
uaaagaagcaaucuccuua

SEQ ID NO: 559935 - RNA, 19 nt, Homo sapiens
ggaggaaacugaagagaca

SEQ ID NO: 559936 - RNA, 19 nt, Homo sapiens
gaaaucuacuuccuacaga

SEQ ID NO: 559937 - RNA, 19 nt, Homo sapiens
gaauugcugucuaugauug

SEQ ID NO: 559938 - RNA, 19 nt, Homo sapiens
gagacgaaaugcugaugua

SEQ ID NO: 559939 - RNA, 19 nt, Homo sapiens
cagcuucucugcuagauuu

SEQ ID NO: 559940 - RNA, 19 nt, Homo sapiens
ggaagaacgcgguguguaa

SEQ ID NO: 559941 - RNA, 19 nt, Homo sapiens
cagcaggaguaauaaauuu

SEQ ID NO: 559942 - RNA, 19 nt, Homo sapiens
caaaggagcuauggagaga

SEQ ID NO: 559943 - RNA, 19 nt, Homo sapiens
gaaauggccacaacaaguu

SEQ ID NO: 559944 - RNA, 19 nt, Homo sapiens
caccaucucuucauucaaa

SEQ ID NO: 559945 - RNA, 19 nt, Homo sapiens
cauaucagcaggaguaaua

SEQ ID NO: 559946 - RNA, 19 nt, Homo sapiens
gccauggucuuuccacuuu

SEQ ID NO: 559947 - RNA, 19 nt, Homo sapiens
gauaaggacuagauacuac

SEQ ID NO: 559948 - RNA, 19 nt, Homo sapiens
acacaagauuugacuguaa

SEQ ID NO: 559949 - RNA, 19 nt, Homo sapiens
gcugauguauccuuucauu

SEQ ID NO: 559950 - RNA, 19 nt, Homo sapiens
ggugagcccucuccuaaga

SEQ ID NO: 559951 - RNA, 19 nt, Homo sapiens
gaacaguaagaacaucaua

SEQ ID NO: 559952 - RNA, 19 nt, Homo sapiens
aauaaacaguggcucauaa

SEQ ID NO: 559953 - RNA, 19 nt, Homo sapiens
guacugaagccaaaugaaa

SEQ ID NO: 559954 - RNA, 19 nt, Homo sapiens
ggacaacacuucauuuuca

SEQ ID NO: 559955 - RNA, 19 nt, Homo sapiens
aaacaaauauugccaacuc

SEQ ID NO: 559956 - RNA, 19 nt, Homo sapiens
gcgcaacguucgauuucua

SEQ ID NO: 559957 - RNA, 19 nt, Homo sapiens
ggacuguucuuugcuguug

SEQ ID NO: 559958 - RNA, 19 nt, Homo sapiens
ggagaaaucacauaaccuu

SEQ ID NO: 559959 - RNA, 19 nt, Homo sapiens
uaaagcagcucaaaagaaa

SEQ ID NO: 559960 - RNA, 19 nt, Homo sapiens
gcagcuaacccuagucaaa

SEQ ID NO: 559961 - RNA, 19 nt, Homo sapiens
gacacuuacuugaugauuu

SEQ ID NO: 559962 - RNA, 19 nt, Homo sapiens
ccucuuaagucccaguaua

SEQ ID NO: 559963 - RNA, 19 nt, Homo sapiens
gagauggacuaauugacuu

SEQ ID NO: 559964 - RNA, 19 nt, Homo sapiens
ucagggagguaguuucaaa

SEQ ID NO: 559965 - RNA, 19 nt, Homo sapiens
ucauucagcuaacaaacua

SEQ ID NO: 559966 - RNA, 19 nt, Homo sapiens
ggaaauggccacaacaagu

SEQ ID NO: 559967 - RNA, 19 nt, Homo sapiens
ggagcuauggagagaauua

SEQ ID NO: 559968 - RNA, 19 nt, Homo sapiens
uugaaucgcuugcuuguug

SEQ ID NO: 559969 - RNA, 19 nt, Homo sapiens
caacgaauuuacagucuag

SEQ ID NO: 559970 - RNA, 19 nt, Homo sapiens
acacauaucagcaggagua

SEQ ID NO: 559971 - RNA, 19 nt, Homo sapiens
uaauaugucucaaccagau

SEQ ID NO: 559972 - RNA, 19 nt, Homo sapiens
ccuagguucuuaaggauaa

SEQ ID NO: 559973 - RNA, 19 nt, Homo sapiens
agccagagaugcaauauau

SEQ ID NO: 559974 - RNA, 19 nt, Homo sapiens
gcauauguguuacuucaag

SEQ ID NO: 559975 - RNA, 19 nt, Homo sapiens
guagugaauccucuguuua

SEQ ID NO: 559976 - RNA, 19 nt, Homo sapiens
ugucuguucugcacaauaa

SEQ ID NO: 559977 - RNA, 19 nt, Homo sapiens
gcaaucuccuuacuguguu

SEQ ID NO: 559978 - RNA, 19 nt, Homo sapiens
cuuauuacaugcugcuaua

SEQ ID NO: 559979 - RNA, 19 nt, Homo sapiens
augaugaacucaccuaauu

SEQ ID NO: 559980 - RNA, 19 nt, Homo sapiens
gaccacuuauucuguauug

SEQ ID NO: 559981 - RNA, 19 nt, Homo sapiens
gaugaacucaccuaauuau

SEQ ID NO: 559982 - RNA, 19 nt, Homo sapiens
guagacacuuacuugauga

SEQ ID NO: 559983 - RNA, 19 nt, Homo sapiens
gagaaaucacauaaccuua

SEQ ID NO: 559984 - RNA, 19 nt, Homo sapiens
gggaagaggaggaggaauu

SEQ ID NO: 559985 - RNA, 19 nt, Homo sapiens
ugaacucaccuaauuauga

SEQ ID NO: 559986 - RNA, 19 nt, Homo sapiens
gaaaagguacaacagaaua

SEQ ID NO: 559987 - RNA, 19 nt, Homo sapiens
uugagugucuucuaacuuu

SEQ ID NO: 559988 - RNA, 19 nt, Homo sapiens
cagcagcaguuggaucuuu

SEQ ID NO: 559989 - RNA, 19 nt, Homo sapiens
aagcauauguguuacuuca

SEQ ID NO: 559990 - RNA, 19 nt, Homo sapiens
ccucagagcauuuaaggaa

SEQ ID NO: 559991 - RNA, 19 nt, Homo sapiens
agaccuaccuccagacuuc

SEQ ID NO: 559992 - RNA, 19 nt, Homo sapiens
ugccaacucuucuauuuau

SEQ ID NO: 559993 - RNA, 19 nt, Homo sapiens
caaagauaaggacuagaua

SEQ ID NO: 559994 - RNA, 19 nt, Homo sapiens
guuuagaacaccaaagaua

SEQ ID NO: 559995 - RNA, 19 nt, Homo sapiens
caaaaggaaugaacuuguu

SEQ ID NO: 559996 - RNA, 19 nt, Homo sapiens
gaggagcgaaaucuaaauu

SEQ ID NO: 559997 - RNA, 19 nt, Homo sapiens
gaaaugcugauguauccuu

SEQ ID NO: 559998 - RNA, 19 nt, Homo sapiens
uguagugaauccucuguuu

SEQ ID NO: 559999 - RNA, 19 nt, Homo sapiens
caaggcacuuucaaucuca

SEQ ID NO: 560000 - RNA, 19 nt, Homo sapiens
agacuggacauuuaacuuu

SEQ ID NO: 560001 - RNA, 19 nt, Homo sapiens
gccaggagguaguuucuca

SEQ ID NO: 560002 - RNA, 19 nt, Homo sapiens
gacauuugauagaaaggaa

SEQ ID NO: 560003 - RNA, 19 nt, Homo sapiens
cuacacaucacacaagauu

SEQ ID NO: 560004 - RNA, 19 nt, Homo sapiens
acagaauaaugcaugauga

SEQ ID NO: 560005 - RNA, 19 nt, Homo sapiens
uguagacacuuacuugaug

SEQ ID NO: 560006 - RNA, 19 nt, Homo sapiens
ccaaagauaaggacuagau

SEQ ID NO: 560007 - RNA, 19 nt, Homo sapiens
gugcaagacucaggagcua

SEQ ID NO: 560008 - RNA, 19 nt, Homo sapiens
gauagaaaggaacacguuu

SEQ ID NO: 560009 - RNA, 19 nt, Homo sapiens
ugagugucuucuaacuuua

SEQ ID NO: 560010 - RNA, 19 nt, Homo sapiens
acacaucacacaagauuug

SEQ ID NO: 560011 - RNA, 19 nt, Homo sapiens
ccaaggcacuuucaaucuc

SEQ ID NO: 560012 - RNA, 19 nt, Homo sapiens
gggaggagcgaaaucuaaa

SEQ ID NO: 560013 - RNA, 19 nt, Homo sapiens
caacucuucuauuuaugga

SEQ ID NO: 560014 - RNA, 19 nt, Homo sapiens
caaagccucucuuccuucu

SEQ ID NO: 560015 - RNA, 19 nt, Homo sapiens
ugauuuccaucucugguaa

SEQ ID NO: 560016 - RNA, 19 nt, Homo sapiens
cuaauugacuugcaaagac

SEQ ID NO: 560017 - RNA, 19 nt, Homo sapiens
ggagauggacuaauugacu

SEQ ID NO: 560018 - RNA, 19 nt, Homo sapiens
ccaagucuguaccucaaau

SEQ ID NO: 560019 - RNA, 19 nt, Homo sapiens
ccaggaagcagcagcaaga

SEQ ID NO: 560020 - RNA, 19 nt, Homo sapiens
aaauaaagccaaccuucaa

SEQ ID NO: 560021 - RNA, 19 nt, Homo sapiens
gcagaagccacuggagaaa

SEQ ID NO: 560022 - RNA, 19 nt, Homo sapiens
acacacuacuaccucuuaa

SEQ ID NO: 560023 - RNA, 19 nt, Homo sapiens
cacaagauuugacuguaau

SEQ ID NO: 560024 - RNA, 19 nt, Homo sapiens
gggcauucauauaggaaga

SEQ ID NO: 560025 - RNA, 19 nt, Homo sapiens
gaaaggaggucuuccagua

SEQ ID NO: 560026 - RNA, 19 nt, Homo sapiens
ucacgcaacuuauuaaaga

SEQ ID NO: 560027 - RNA, 19 nt, Homo sapiens
ggaacguuauggccaaaua

SEQ ID NO: 560028 - RNA, 19 nt, Homo sapiens
gagaccagcuuaaaugaau

SEQ ID NO: 560029 - RNA, 19 nt, Homo sapiens
acaauaagcugcugugugu

SEQ ID NO: 560030 - RNA, 19 nt, Homo sapiens
gaaccaccuucaccaguuu

SEQ ID NO: 560031 - RNA, 19 nt, Homo sapiens
cagcuuaaaugaauaguug

SEQ ID NO: 560032 - RNA, 19 nt, Homo sapiens
gagcacaccgccaauauuu

SEQ ID NO: 560033 - RNA, 19 nt, Homo sapiens
ggacaugcauuugaaacaa

SEQ ID NO: 560034 - RNA, 19 nt, Homo sapiens
ggauaaaugugauacgaau

SEQ ID NO: 560035 - RNA, 19 nt, Homo sapiens
ugaaagggaugcaagagaa

SEQ ID NO: 560036 - RNA, 19 nt, Homo sapiens
cgacagucuuccaggauua

SEQ ID NO: 560037 - RNA, 19 nt, Homo sapiens
uagaggagcuggagaaagu

SEQ ID NO: 560038 - RNA, 19 nt, Homo sapiens
gaaauaugaucacgcaacu

SEQ ID NO: 560039 - RNA, 19 nt, Homo sapiens
caaagcgucugcaggcaaa

SEQ ID NO: 560040 - RNA, 19 nt, Homo sapiens
uggagacgcuggacaauga

SEQ ID NO: 560041 - RNA, 19 nt, Homo sapiens
ccgaaugucucccgugaaa

SEQ ID NO: 560042 - RNA, 19 nt, Homo sapiens
aauaugaucacgcaacuua

SEQ ID NO: 560043 - RNA, 19 nt, Homo sapiens
gcacaccgccaauauuuca

SEQ ID NO: 560044 - RNA, 19 nt, Homo sapiens
caagagcccuccgaguaaa

SEQ ID NO: 560045 - RNA, 19 nt, Homo sapiens
gucaagauauucagugaga

SEQ ID NO: 560046 - RNA, 19 nt, Homo sapiens
ggauguguaugucagagaa

SEQ ID NO: 560047 - RNA, 19 nt, Homo sapiens
gacacuuccuccuguauga

SEQ ID NO: 560048 - RNA, 19 nt, Homo sapiens
cgaaccaccuucaccaguu

SEQ ID NO: 560049 - RNA, 19 nt, Homo sapiens
ccaaauacaacaagcgaaa

SEQ ID NO: 560050 - RNA, 19 nt, Homo sapiens
ucaagagcccuccgaguaa

SEQ ID NO: 560051 - RNA, 19 nt, Homo sapiens
gcgacagucuuccaggauu

SEQ ID NO: 560052 - RNA, 19 nt, Homo sapiens
gaaugaaccucugaaaaga

SEQ ID NO: 560053 - RNA, 19 nt, Homo sapiens
ccacagauucagaacaauu

SEQ ID NO: 560054 - RNA, 19 nt, Homo sapiens
ggagcacaccgccaauauu

SEQ ID NO: 560055 - RNA, 19 nt, Homo sapiens
gcgagaaguuugcccucaa

SEQ ID NO: 560056 - RNA, 19 nt, Homo sapiens
acgaauguauccagcagua

SEQ ID NO: 560057 - RNA, 19 nt, Homo sapiens
gagcuauggacaacuguaa

SEQ ID NO: 560058 - RNA, 19 nt, Homo sapiens
gaucacgcaacuuauuaaa

SEQ ID NO: 560059 - RNA, 19 nt, Homo sapiens
uaaaggauaccacaauaag

SEQ ID NO: 560060 - RNA, 19 nt, Homo sapiens
ccuccuguaugacaccuua

SEQ ID NO: 560061 - RNA, 19 nt, Homo sapiens
gaagggagagcuggaugaa

SEQ ID NO: 560062 - RNA, 19 nt, Homo sapiens
ggacagcagcgugaacuau

SEQ ID NO: 560063 - RNA, 19 nt, Homo sapiens
ugggaucacuaaaguagaa

SEQ ID NO: 560064 - RNA, 19 nt, Homo sapiens
gaacuaugggaucacuaaa

SEQ ID NO: 560065 - RNA, 19 nt, Homo sapiens
ugcuaaaggucaagauauu

SEQ ID NO: 560066 - RNA, 19 nt, Homo sapiens
ugacagcuacccacagauu

SEQ ID NO: 560067 - RNA, 19 nt, Homo sapiens
guaacauacaguacucuuu

SEQ ID NO: 560068 - RNA, 19 nt, Homo sapiens
uaagaaugaaccucugaaa

SEQ ID NO: 560069 - RNA, 19 nt, Homo sapiens
uaucgcaguucuucgaaug

SEQ ID NO: 560070 - RNA, 19 nt, Homo sapiens
guucugugguuacuucaug

SEQ ID NO: 560071 - RNA, 19 nt, Homo sapiens
ugaacuaugggaucacuaa

SEQ ID NO: 560072 - RNA, 19 nt, Homo sapiens
cucaagagcccuccgagua

SEQ ID NO: 560073 - RNA, 19 nt, Homo sapiens
uucacugacucucuucuua

SEQ ID NO: 560074 - RNA, 19 nt, Homo sapiens
agaccagcuuaaaugaaua

SEQ ID NO: 560075 - RNA, 19 nt, Homo sapiens
gaaugucucccgugaaagg

SEQ ID NO: 560076 - RNA, 19 nt, Homo sapiens
guaugacaccuuauucuca

SEQ ID NO: 560077 - RNA, 19 nt, Homo sapiens
gaauguauccagcaguaag

SEQ ID NO: 560078 - RNA, 19 nt, Homo sapiens
gagcuacgcgacagucuuc

SEQ ID NO: 560079 - RNA, 19 nt, Homo sapiens
uaugaucacgcaacuuauu

SEQ ID NO: 560080 - RNA, 19 nt, Homo sapiens
caaaccaccagaaccaguu

SEQ ID NO: 560081 - RNA, 19 nt, Homo sapiens
ggaaaugcaaguggugguu

SEQ ID NO: 560082 - RNA, 19 nt, Homo sapiens
ucagugagaccagcuuaaa

SEQ ID NO: 560083 - RNA, 19 nt, Homo sapiens
acuaugggaucacuaaagu

SEQ ID NO: 560084 - RNA, 19 nt, Homo sapiens
gugguuacuucaugcaugu

SEQ ID NO: 560085 - RNA, 19 nt, Homo sapiens
cacagauucagaacaauuu

SEQ ID NO: 560086 - RNA, 19 nt, Homo sapiens
acccacagauucagaacaa

SEQ ID NO: 560087 - RNA, 19 nt, Homo sapiens
cgagaaguuugcccucaag

SEQ ID NO: 560088 - RNA, 19 nt, Homo sapiens
gguuacuucaugcauguua

SEQ ID NO: 560089 - RNA, 19 nt, Homo sapiens
gugguucugugguuacuuc

SEQ ID NO: 560090 - RNA, 19 nt, Homo sapiens
gacagcagcgugaacuaug

SEQ ID NO: 560091 - RNA, 19 nt, Homo sapiens
gcugccaccuaugauauau

SEQ ID NO: 560092 - RNA, 19 nt, Homo sapiens
gggauaaaugugauacgaa

SEQ ID NO: 560093 - RNA, 19 nt, Homo sapiens
cuaaaggucaagauauuca

SEQ ID NO: 560094 - RNA, 19 nt, Homo sapiens
acugacagcuacccacaga

SEQ ID NO: 560095 - RNA, 19 nt, Homo sapiens
agggagagcuggaugaacu

SEQ ID NO: 560096 - RNA, 19 nt, Homo sapiens
gaaagggaugcaagagaag

SEQ ID NO: 560097 - RNA, 19 nt, Homo sapiens
guaacagucuccgaauguc

SEQ ID NO: 560098 - RNA, 19 nt, Homo sapiens
gugagaccagcuuaaauga

SEQ ID NO: 560099 - RNA, 19 nt, Homo sapiens
gugaaagggaugcaagaga

SEQ ID NO: 560100 - RNA, 19 nt, Homo sapiens
gcugcuguguguggaauug

SEQ ID NO: 560101 - RNA, 19 nt, Homo sapiens
ccccagcgcucuccaguuu

SEQ ID NO: 560102 - RNA, 19 nt, Homo sapiens
ccagcgcucuccaguuucu

SEQ ID NO: 560103 - RNA, 19 nt, Homo sapiens
gcuaaaggucaagauauuc

SEQ ID NO: 560104 - RNA, 19 nt, Homo sapiens
uggaauugcuaaaggucaa

SEQ ID NO: 560105 - RNA, 19 nt, Homo sapiens
aaggaggucuuccaguauc

SEQ ID NO: 560106 - RNA, 19 nt, Homo sapiens
aaaggaggucuuccaguau

SEQ ID NO: 560107 - RNA, 19 nt, Homo sapiens
cgugacacuuccuccugua

SEQ ID NO: 560108 - RNA, 19 nt, Homo sapiens
gaacguuauggccaaauac

SEQ ID NO: 560109 - RNA, 19 nt, Homo sapiens
gauaaaugugauacgaaug

SEQ ID NO: 560110 - RNA, 19 nt, Homo sapiens
gcaguucuucgaaugaaag

SEQ ID NO: 560111 - RNA, 19 nt, Homo sapiens
agugagaccagcuuaaaug

SEQ ID NO: 560112 - RNA, 19 nt, Homo sapiens
gcuauggacaacuguaaca

SEQ ID NO: 560113 - RNA, 19 nt, Homo sapiens
ucgcaguucuucgaaugaa

SEQ ID NO: 560114 - RNA, 19 nt, Homo sapiens
uaugggaucacuaaaguag

SEQ ID NO: 560115 - RNA, 19 nt, Homo sapiens
cgaagggccaaauggagaa

SEQ ID NO: 560116 - RNA, 19 nt, Homo sapiens
ugagaccagcuuaaaugaa

SEQ ID NO: 560117 - RNA, 19 nt, Homo sapiens
gaucacuaaaguagaagga

SEQ ID NO: 560118 - RNA, 19 nt, Homo sapiens
gacaaugaguccuuuuaca

SEQ ID NO: 560119 - RNA, 19 nt, Homo sapiens
ccaggauuauggaguuucu

SEQ ID NO: 560120 - RNA, 19 nt, Homo sapiens
uguaacagucuccgaaugu

SEQ ID NO: 560121 - RNA, 19 nt, Homo sapiens
gaagggccaaauggagaaa

SEQ ID NO: 560122 - RNA, 19 nt, Homo sapiens
cacgcaacuuauuaaagaa

SEQ ID NO: 560123 - RNA, 19 nt, Homo sapiens
ugaucacgcaacuuauuaa

SEQ ID NO: 560124 - RNA, 19 nt, Homo sapiens
guaucgcaguucuucgaau

SEQ ID NO: 560125 - RNA, 19 nt, Homo sapiens
gauccuagcugccuuguug

SEQ ID NO: 560126 - RNA, 19 nt, Homo sapiens
caauguagguucugcuuaa

SEQ ID NO: 560127 - RNA, 19 nt, Homo sapiens
gaugagaaguuacaguuca

SEQ ID NO: 560128 - RNA, 19 nt, Homo sapiens
gaucucaguucugcguuua

SEQ ID NO: 560129 - RNA, 19 nt, Homo sapiens
guaaguagaucucaguucu

SEQ ID NO: 560130 - RNA, 19 nt, Homo sapiens
aaagaugcacggaaaguua

SEQ ID NO: 560131 - RNA, 19 nt, Homo sapiens
gaaccuacagucucaaaga

SEQ ID NO: 560132 - RNA, 19 nt, Homo sapiens
agaaagugcucuucggauu

SEQ ID NO: 560133 - RNA, 19 nt, Homo sapiens
guuaggaacugcccagguu

SEQ ID NO: 560134 - RNA, 19 nt, Homo sapiens
ucacuuggcucugaaccua

SEQ ID NO: 560135 - RNA, 19 nt, Homo sapiens
ccgaacacuuucauacuaa

SEQ ID NO: 560136 - RNA, 19 nt, Homo sapiens
gcauuugcaugacuauuag

SEQ ID NO: 560137 - RNA, 19 nt, Homo sapiens
uaauaccacuguagggauu

SEQ ID NO: 560138 - RNA, 19 nt, Homo sapiens
gagcaacccaccaaaccua

SEQ ID NO: 560139 - RNA, 19 nt, Homo sapiens
cccgaacacuuucauacua

SEQ ID NO: 560140 - RNA, 19 nt, Homo sapiens
gaaagagcaacccaccaaa

SEQ ID NO: 560141 - RNA, 19 nt, Homo sapiens
gaaagugcucuucggauuc

SEQ ID NO: 560142 - RNA, 19 nt, Homo sapiens
ggaagaaaaugacuaaaac

SEQ ID NO: 560143 - RNA, 19 nt, Homo sapiens
ccaccaaaccuaacaagga

SEQ ID NO: 560144 - RNA, 19 nt, Homo sapiens
ccuacagucucaaagauug

SEQ ID NO: 560145 - RNA, 19 nt, Homo sapiens
uauuagugcuucaaaguca

SEQ ID NO: 560146 - RNA, 19 nt, Homo sapiens
cuagcugccuuguugguuu

SEQ ID NO: 560147 - RNA, 19 nt, Homo sapiens
gaacacuuucauacuaaga

SEQ ID NO: 560148 - RNA, 19 nt, Homo sapiens
uuaagcauuugcaugacua

SEQ ID NO: 560149 - RNA, 19 nt, Homo sapiens
gaaaguuaucuuacagcaa

SEQ ID NO: 560150 - RNA, 19 nt, Homo sapiens
acaccauugucucccuuua

SEQ ID NO: 560151 - RNA, 19 nt, Homo sapiens
uugaaggauuuccaucuuu

SEQ ID NO: 560152 - RNA, 19 nt, Homo sapiens
gcagaaacggaacggaaug

SEQ ID NO: 560153 - RNA, 19 nt, Homo sapiens
guuugcaucuuuguaugua

SEQ ID NO: 560154 - RNA, 19 nt, Homo sapiens
gcacggaaaguuaucuuac

SEQ ID NO: 560155 - RNA, 19 nt, Homo sapiens
uguagguucugcuuaaugu

SEQ ID NO: 560156 - RNA, 19 nt, Homo sapiens
ggcaacgucuucacaguac

SEQ ID NO: 560157 - RNA, 19 nt, Homo sapiens
agaaagagcaacccaccaa

SEQ ID NO: 560158 - RNA, 19 nt, Homo sapiens
ucucaguucugcguuuauu

SEQ ID NO: 560159 - RNA, 19 nt, Homo sapiens
uagguucugcuuaauguaa

SEQ ID NO: 560160 - RNA, 19 nt, Homo sapiens
cacggaaaguuaucuuaca

SEQ ID NO: 560161 - RNA, 19 nt, Homo sapiens
ugaaggauuuccaucuuuu

SEQ ID NO: 560162 - RNA, 19 nt, Homo sapiens
gagcugcuggccaucauug

SEQ ID NO: 560163 - RNA, 19 nt, Homo sapiens
gcacaaguuauaaauacag

SEQ ID NO: 560164 - RNA, 19 nt, Homo sapiens
agcauuugcaugacuauua

SEQ ID NO: 560165 - RNA, 19 nt, Homo sapiens
gcgcggacggccauauuug

SEQ ID NO: 560166 - RNA, 19 nt, Homo sapiens
guaguuugccuccaagaca

SEQ ID NO: 560167 - RNA, 19 nt, Homo sapiens
aagaugagaaguuacaguu

SEQ ID NO: 560168 - RNA, 19 nt, Homo sapiens
cgggagugcuuggcagaaa

SEQ ID NO: 560169 - RNA, 19 nt, Homo sapiens
ggagcaagagugccaugga

SEQ ID NO: 560170 - RNA, 19 nt, Homo sapiens
guagggauuuuguuuugaa

SEQ ID NO: 560171 - RNA, 19 nt, Homo sapiens
guucugcguuuauuguaag

SEQ ID NO: 560172 - RNA, 19 nt, Homo sapiens
ucccuuuaaucuucucuuu

SEQ ID NO: 560173 - RNA, 19 nt, Homo sapiens
uggcaacgucuucacagua

SEQ ID NO: 560174 - RNA, 19 nt, Homo sapiens
uuugaaggauuuccaucuu

SEQ ID NO: 560175 - RNA, 19 nt, Homo sapiens
cauaagcuaauaccacugu

SEQ ID NO: 560176 - RNA, 19 nt, Homo sapiens
caccauugucucccuuuaa

SEQ ID NO: 560177 - RNA, 19 nt, Homo sapiens
ggauuugcauuuuaaguag

SEQ ID NO: 560178 - RNA, 19 nt, Homo sapiens
gcaguuaauuaggauuugc

SEQ ID NO: 560179 - RNA, 19 nt, Homo sapiens
cugcguuuauuguaaguug

SEQ ID NO: 560180 - RNA, 19 nt, Homo sapiens
acaauguagguucugcuua

SEQ ID NO: 560181 - RNA, 19 nt, Homo sapiens
cggcaucauucacgcuaga

SEQ ID NO: 560182 - RNA, 19 nt, Homo sapiens
aguagccgguucccauuug

SEQ ID NO: 560183 - RNA, 19 nt, Homo sapiens
accauugucucccuuuaau

SEQ ID NO: 560184 - RNA, 19 nt, Homo sapiens
uuuaaaagaugcacggaaa

SEQ ID NO: 560185 - RNA, 19 nt, Homo sapiens
cgaacacuuucauacuaag

SEQ ID NO: 560186 - RNA, 19 nt, Homo sapiens
guucccauuugccauacaa

SEQ ID NO: 560187 - RNA, 19 nt, Homo sapiens
ccuuuaaucuucucuuuug

SEQ ID NO: 560188 - RNA, 19 nt, Homo sapiens
ucaaaaugguuacaguuuc

SEQ ID NO: 560189 - RNA, 19 nt, Homo sapiens
agaucucaguucugcguuu

SEQ ID NO: 560190 - RNA, 19 nt, Homo sapiens
caacccaccaaaccuaaca

SEQ ID NO: 560191 - RNA, 19 nt, Homo sapiens
aaccuacagucucaaagau

SEQ ID NO: 560192 - RNA, 19 nt, Homo sapiens
gccagcugcucagugacua

SEQ ID NO: 560193 - RNA, 19 nt, Homo sapiens
ucaguucugcguuuauugu

SEQ ID NO: 560194 - RNA, 19 nt, Homo sapiens
ggcagaaacggaacggaau

SEQ ID NO: 560195 - RNA, 19 nt, Homo sapiens
gcugcuggccaucauugaa

SEQ ID NO: 560196 - RNA, 19 nt, Homo sapiens
gcauggcaacgucuucaca

SEQ ID NO: 560197 - RNA, 19 nt, Homo sapiens
gagaaguuacaguucaucu

SEQ ID NO: 560198 - RNA, 19 nt, Homo sapiens
caagaugagaaguuacagu

SEQ ID NO: 560199 - RNA, 19 nt, Homo sapiens
ccgguucccauuugccaua

SEQ ID NO: 560200 - RNA, 19 nt, Homo sapiens
gggagugcuuggcagaaac

SEQ ID NO: 560201 - RNA, 19 nt, Homo sapiens
aguucugcguuuauuguaa

SEQ ID NO: 560202 - RNA, 19 nt, Homo sapiens
cuaagacuguaaguagauc

SEQ ID NO: 560203 - RNA, 19 nt, Homo sapiens
guagguucugcuuaaugua

SEQ ID NO: 560204 - RNA, 19 nt, Homo sapiens
cauugucucccuuuaaucu

SEQ ID NO: 560205 - RNA, 19 nt, Homo sapiens
gaaagaaauugccuuauga

SEQ ID NO: 560206 - RNA, 19 nt, Homo sapiens
gcacagaucuuggauuaaa

SEQ ID NO: 560207 - RNA, 19 nt, Homo sapiens
ggugaaagcuucucaauau

SEQ ID NO: 560208 - RNA, 19 nt, Homo sapiens
ggaaagaaauugccuuaug

SEQ ID NO: 560209 - RNA, 19 nt, Homo sapiens
ccaaugaucuggaaauaaa

SEQ ID NO: 560210 - RNA, 19 nt, Homo sapiens
cagcagcucuuacuaauaa

SEQ ID NO: 560211 - RNA, 19 nt, Homo sapiens
gaaauugccuuaugagauc

SEQ ID NO: 560212 - RNA, 19 nt, Homo sapiens
gaaagcuucucaauaugua

SEQ ID NO: 560213 - RNA, 19 nt, Homo sapiens
gaaggccgcugaauucuau

SEQ ID NO: 560214 - RNA, 19 nt, Homo sapiens
ccgaagcacuuaacacuua

SEQ ID NO: 560215 - RNA, 19 nt, Homo sapiens
ggaaguaaaugaguuggua

SEQ ID NO: 560216 - RNA, 19 nt, Homo sapiens
gaaaguagcaguaacaaag

SEQ ID NO: 560217 - RNA, 19 nt, Homo sapiens
uaaaugaguugguagaaga

SEQ ID NO: 560218 - RNA, 19 nt, Homo sapiens
ccaaagccauuaaauucua

SEQ ID NO: 560219 - RNA, 19 nt, Homo sapiens
cagcagcuaugcagauaua

SEQ ID NO: 560220 - RNA, 19 nt, Homo sapiens
uaaccaagcuguagagauc

SEQ ID NO: 560221 - RNA, 19 nt, Homo sapiens
caauaguuguggagacuua

SEQ ID NO: 560222 - RNA, 19 nt, Homo sapiens
ggacaaaugaaccuuauga

SEQ ID NO: 560223 - RNA, 19 nt, Homo sapiens
cugcacagaucuuggauua

SEQ ID NO: 560224 - RNA, 19 nt, Homo sapiens
guacugaagcacuuuauaa

SEQ ID NO: 560225 - RNA, 19 nt, Homo sapiens
gaugguagcuaguuguuuc

SEQ ID NO: 560226 - RNA, 19 nt, Homo sapiens
ggaaauaaacaaagcaguu

SEQ ID NO: 560227 - RNA, 19 nt, Homo sapiens
gaaacuaaaucggcuagau

SEQ ID NO: 560228 - RNA, 19 nt, Homo sapiens
caaagcaguuacauacuug

SEQ ID NO: 560229 - RNA, 19 nt, Homo sapiens
cuuaguaacugaagcuaua

SEQ ID NO: 560230 - RNA, 19 nt, Homo sapiens
gagaucauccucauguuaa

SEQ ID NO: 560231 - RNA, 19 nt, Homo sapiens
gcaggaauauugaaaauga

SEQ ID NO: 560232 - RNA, 19 nt, Homo sapiens
caaaugaaccuuaugaaag

SEQ ID NO: 560233 - RNA, 19 nt, Homo sapiens
uuacaaagauacucacaga

SEQ ID NO: 560234 - RNA, 19 nt, Homo sapiens
ucucagcccuguauuauau

SEQ ID NO: 560235 - RNA, 19 nt, Homo sapiens
cagaagaccuccaauaacu

SEQ ID NO: 560236 - RNA, 19 nt, Homo sapiens
ggcagaagaccuccaauaa

SEQ ID NO: 560237 - RNA, 19 nt, Homo sapiens
cauguuaaaccuuggauua

SEQ ID NO: 560238 - RNA, 19 nt, Homo sapiens
gaaggcaggcuacaaccua

SEQ ID NO: 560239 - RNA, 19 nt, Homo sapiens
gcaauuagagaaggaagua

SEQ ID NO: 560240 - RNA, 19 nt, Homo sapiens
ugacuacaauccaaucuau

SEQ ID NO: 560241 - RNA, 19 nt, Homo sapiens
uaucuaagcuaggagaauu

SEQ ID NO: 560242 - RNA, 19 nt, Homo sapiens
gaaaugauucuucuuguac

SEQ ID NO: 560243 - RNA, 19 nt, Homo sapiens
aaacaaagcaguuacauac

SEQ ID NO: 560244 - RNA, 19 nt, Homo sapiens
gcacuuaacacuuaucaag

SEQ ID NO: 560245 - RNA, 19 nt, Homo sapiens
gccagucaguauucaguua

SEQ ID NO: 560246 - RNA, 19 nt, Homo sapiens
caagacaucucuggcauca

SEQ ID NO: 560247 - RNA, 19 nt, Homo sapiens
guagcuaguuguuucagaa

SEQ ID NO: 560248 - RNA, 19 nt, Homo sapiens
acaaagcaguuacauacuu

SEQ ID NO: 560249 - RNA, 19 nt, Homo sapiens
acucauugcuccuguaauu

SEQ ID NO: 560250 - RNA, 19 nt, Homo sapiens
acaaagauacucacagaaa

SEQ ID NO: 560251 - RNA, 19 nt, Homo sapiens
cgaaguucuuuaccagaua

SEQ ID NO: 560252 - RNA, 19 nt, Homo sapiens
ccacuuggcccucaaauag

SEQ ID NO: 560253 - RNA, 19 nt, Homo sapiens
cagaagaagugguaacuac

SEQ ID NO: 560254 - RNA, 19 nt, Homo sapiens
guagagaucuuaaaagugu

SEQ ID NO: 560255 - RNA, 19 nt, Homo sapiens
ggaaagccauggcagaaaa

SEQ ID NO: 560256 - RNA, 19 nt, Homo sapiens
ucuaugauaucgaggaauu

SEQ ID NO: 560257 - RNA, 19 nt, Homo sapiens
gaaggaaguaaaugaguug

SEQ ID NO: 560258 - RNA, 19 nt, Homo sapiens
guaaguguauucuauucug

SEQ ID NO: 560259 - RNA, 19 nt, Homo sapiens
gcuuggagccuauuacauu

SEQ ID NO: 560260 - RNA, 19 nt, Homo sapiens
gaaguucuuuaccagauag

SEQ ID NO: 560261 - RNA, 19 nt, Homo sapiens
guuuagcaaugcaggaaua

SEQ ID NO: 560262 - RNA, 19 nt, Homo sapiens
agacaucucuggcaucauc

SEQ ID NO: 560263 - RNA, 19 nt, Homo sapiens
gcuaguuguuucagaagaa

SEQ ID NO: 560264 - RNA, 19 nt, Homo sapiens
ugugaacucugauagauau

SEQ ID NO: 560265 - RNA, 19 nt, Homo sapiens
gaugaagaauuaggagaug

SEQ ID NO: 560266 - RNA, 19 nt, Homo sapiens
ugagaaggccgcugaauuc

SEQ ID NO: 560267 - RNA, 19 nt, Homo sapiens
gccagcagcuaugcagaua

SEQ ID NO: 560268 - RNA, 19 nt, Homo sapiens
ggauauggguccaagacau

SEQ ID NO: 560269 - RNA, 19 nt, Homo sapiens
ccgcugaauucuauaaaga

SEQ ID NO: 560270 - RNA, 19 nt, Homo sapiens
ugaaauguaugccgaagca

SEQ ID NO: 560271 - RNA, 19 nt, Homo sapiens
agaaggaaguaaaugaguu

SEQ ID NO: 560272 - RNA, 19 nt, Homo sapiens
aaagauagcccagaggaaa

SEQ ID NO: 560273 - RNA, 19 nt, Homo sapiens
ugauuugcuuccagaauaa

SEQ ID NO: 560274 - RNA, 19 nt, Homo sapiens
gcugugaacucugauagau

SEQ ID NO: 560275 - RNA, 19 nt, Homo sapiens
guagaagaaagcuguauug

SEQ ID NO: 560276 - RNA, 19 nt, Homo sapiens
ccagaaaacugaagagguu

SEQ ID NO: 560277 - RNA, 19 nt, Homo sapiens
gcaaauggaacgugaaagg

SEQ ID NO: 560278 - RNA, 19 nt, Homo sapiens
agacagcgagaacaaguua

SEQ ID NO: 560279 - RNA, 19 nt, Homo sapiens
guaaaugaguugguagaag

SEQ ID NO: 560280 - RNA, 19 nt, Homo sapiens
ucaauaggaagaccaauga

SEQ ID NO: 560281 - RNA, 19 nt, Homo sapiens
agaauuaggagaugauuug

SEQ ID NO: 560282 - RNA, 19 nt, Homo sapiens
caaagauacucacagaaaa

SEQ ID NO: 560283 - RNA, 19 nt, Homo sapiens
gaaauggcagcugauggua

SEQ ID NO: 560284 - RNA, 19 nt, Homo sapiens
gcaaauggugauuaugaga

SEQ ID NO: 560285 - RNA, 19 nt, Homo sapiens
gcacaagccagcagcuaug

SEQ ID NO: 560286 - RNA, 19 nt, Homo sapiens
ucgaggaauuggagaauga

SEQ ID NO: 560287 - RNA, 19 nt, Homo sapiens
augauuugcuuccagaaua

SEQ ID NO: 560288 - RNA, 19 nt, Homo sapiens
uaaagcaauuagagaagga

SEQ ID NO: 560289 - RNA, 19 nt, Homo sapiens
agagacagaugaagaugau

SEQ ID NO: 560290 - RNA, 19 nt, Homo sapiens
gaaaaucccagucaagcua

SEQ ID NO: 560291 - RNA, 19 nt, Homo sapiens
guuacauacuugagacaaa

SEQ ID NO: 560292 - RNA, 19 nt, Homo sapiens
gcagaauauuggaguuaca

SEQ ID NO: 560293 - RNA, 19 nt, Homo sapiens
ggagaaugaugcagcuuuu

SEQ ID NO: 560294 - RNA, 19 nt, Homo sapiens
gcuauugaauggcuaaugc

SEQ ID NO: 560295 - RNA, 19 nt, Homo sapiens
caaauggugauuaugagaa

SEQ ID NO: 560296 - RNA, 19 nt, Homo sapiens
aaaggacaguagagugaaa

SEQ ID NO: 560297 - RNA, 19 nt, Homo sapiens
gugaaagcuucucaauaug

SEQ ID NO: 560298 - RNA, 19 nt, Homo sapiens
gcagaagaccuccaauaac

SEQ ID NO: 560299 - RNA, 19 nt, Homo sapiens
ucaagaauaugccagaaaa

SEQ ID NO: 560300 - RNA, 19 nt, Homo sapiens
uaaugcagguggucagugu

SEQ ID NO: 560301 - RNA, 19 nt, Homo sapiens
gaaacuucacgcaauccua

SEQ ID NO: 560302 - RNA, 19 nt, Homo sapiens
auauuggccuuaccuauga

SEQ ID NO: 560303 - RNA, 19 nt, Homo sapiens
gauuacuguuccauuagaa

SEQ ID NO: 560304 - RNA, 19 nt, Homo sapiens
ggcaguuacuagaccuaua

SEQ ID NO: 560305 - RNA, 19 nt, Homo sapiens
gaaagaaauugccuuauga

SEQ ID NO: 560306 - RNA, 19 nt, Homo sapiens
gcacagaucuuggauuaaa

SEQ ID NO: 560307 - RNA, 19 nt, Homo sapiens
ggugaaagcuucucaauau

SEQ ID NO: 560308 - RNA, 19 nt, Homo sapiens
ggaaagaaauugccuuaug

SEQ ID NO: 560309 - RNA, 19 nt, Homo sapiens
ccaaugaucuggaaauaaa

SEQ ID NO: 560310 - RNA, 19 nt, Homo sapiens
cagcagcucuuacuaauaa

SEQ ID NO: 560311 - RNA, 19 nt, Homo sapiens
ucacaaagauggaaacauu

SEQ ID NO: 560312 - RNA, 19 nt, Homo sapiens
gaaauugccuuaugagauc

SEQ ID NO: 560313 - RNA, 19 nt, Homo sapiens
gaaagcuucucaauaugua

SEQ ID NO: 560314 - RNA, 19 nt, Homo sapiens
gaaggccgcugaauucuau

SEQ ID NO: 560315 - RNA, 19 nt, Homo sapiens
ccgaagcacuuaacacuua

SEQ ID NO: 560316 - RNA, 19 nt, Homo sapiens
ggaaguaaaugaguuggua

SEQ ID NO: 560317 - RNA, 19 nt, Homo sapiens
guacuuagccucacaaaga

SEQ ID NO: 560318 - RNA, 19 nt, Homo sapiens
gaaaguagcaguaacaaag

SEQ ID NO: 560319 - RNA, 19 nt, Homo sapiens
uaaaugaguugguagaaga

SEQ ID NO: 560320 - RNA, 19 nt, Homo sapiens
caaauugccugaugaaagu

SEQ ID NO: 560321 - RNA, 19 nt, Homo sapiens
ccaaagccauuaaauucua

SEQ ID NO: 560322 - RNA, 19 nt, Homo sapiens
cagcagcuaugcagauaua

SEQ ID NO: 560323 - RNA, 19 nt, Homo sapiens
uaaccaagcuguagagauc

SEQ ID NO: 560324 - RNA, 19 nt, Homo sapiens
caauaguuguggagacuua

SEQ ID NO: 560325 - RNA, 19 nt, Homo sapiens
ggacaaaugaaccuuauga

SEQ ID NO: 560326 - RNA, 19 nt, Homo sapiens
cugcacagaucuuggauua

SEQ ID NO: 560327 - RNA, 19 nt, Homo sapiens
guacugaagcacuuuauaa

SEQ ID NO: 560328 - RNA, 19 nt, Homo sapiens
gaugguagcuaguuguuuc

SEQ ID NO: 560329 - RNA, 19 nt, Homo sapiens
ggaaauaaacaaagcaguu

SEQ ID NO: 560330 - RNA, 19 nt, Homo sapiens
ccaaggguguccaaucuuu

SEQ ID NO: 560331 - RNA, 19 nt, Homo sapiens
gaaacuaaaucggcuagau

SEQ ID NO: 560332 - RNA, 19 nt, Homo sapiens
caaagcaguuacauacuug

SEQ ID NO: 560333 - RNA, 19 nt, Homo sapiens
cuuaguaacugaagcuaua

SEQ ID NO: 560334 - RNA, 19 nt, Homo sapiens
gagaucauccucauguuaa

SEQ ID NO: 560335 - RNA, 19 nt, Homo sapiens
gcaggaauauugaaaauga

SEQ ID NO: 560336 - RNA, 19 nt, Homo sapiens
caaaugaaccuuaugaaag

SEQ ID NO: 560337 - RNA, 19 nt, Homo sapiens
uuacaaagauacucacaga

SEQ ID NO: 560338 - RNA, 19 nt, Homo sapiens
ucucagcccuguauuauau

SEQ ID NO: 560339 - RNA, 19 nt, Homo sapiens
cagaagaccuccaauaacu

SEQ ID NO: 560340 - RNA, 19 nt, Homo sapiens
ggcagaagaccuccaauaa

SEQ ID NO: 560341 - RNA, 19 nt, Homo sapiens
cauguuaaaccuuggauua

SEQ ID NO: 560342 - RNA, 19 nt, Homo sapiens
gaaggcaggcuacaaccua

SEQ ID NO: 560343 - RNA, 19 nt, Homo sapiens
gcaauuagagaaggaagua

SEQ ID NO: 560344 - RNA, 19 nt, Homo sapiens
ugacuacaauccaaucuau

SEQ ID NO: 560345 - RNA, 19 nt, Homo sapiens
uaucuaagcuaggagaauu

SEQ ID NO: 560346 - RNA, 19 nt, Homo sapiens
gaaaugauucuucuuguac

SEQ ID NO: 560347 - RNA, 19 nt, Homo sapiens
aaacaaagcaguuacauac

SEQ ID NO: 560348 - RNA, 19 nt, Homo sapiens
gcacuuaacacuuaucaag

SEQ ID NO: 560349 - RNA, 19 nt, Homo sapiens
gccagucaguauucaguua

SEQ ID NO: 560350 - RNA, 19 nt, Homo sapiens
caagacaucucuggcauca

SEQ ID NO: 560351 - RNA, 19 nt, Homo sapiens
guagcuaguuguuucagaa

SEQ ID NO: 560352 - RNA, 19 nt, Homo sapiens
acaaagcaguuacauacuu

SEQ ID NO: 560353 - RNA, 19 nt, Homo sapiens
acucauugcuccuguaauu

SEQ ID NO: 560354 - RNA, 19 nt, Homo sapiens
gaccaaggguguccaaucu

SEQ ID NO: 560355 - RNA, 19 nt, Homo sapiens
acaaagauacucacagaaa

SEQ ID NO: 560356 - RNA, 19 nt, Homo sapiens
cgaaguucuuuaccagaua

SEQ ID NO: 560357 - RNA, 19 nt, Homo sapiens
ccacuuggcccucaaauag

SEQ ID NO: 560358 - RNA, 19 nt, Homo sapiens
cagaagaagugguaacuac

SEQ ID NO: 560359 - RNA, 19 nt, Homo sapiens
guagagaucuuaaaagugu

SEQ ID NO: 560360 - RNA, 19 nt, Homo sapiens
ggaaagccauggcagaaaa

SEQ ID NO: 560361 - RNA, 19 nt, Homo sapiens
gaaggaaguaaaugaguug

SEQ ID NO: 560362 - RNA, 19 nt, Homo sapiens
ucuaugauaucgaggaauu

SEQ ID NO: 560363 - RNA, 19 nt, Homo sapiens
guaaguguauucuauucug

SEQ ID NO: 560364 - RNA, 19 nt, Homo sapiens
gcuuggagccuauuacauu

SEQ ID NO: 560365 - RNA, 19 nt, Homo sapiens
gaaguucuuuaccagauag

SEQ ID NO: 560366 - RNA, 19 nt, Homo sapiens
gaaucaggaaugaagauaa

SEQ ID NO: 560367 - RNA, 19 nt, Homo sapiens
guuuagcaaugcaggaaua

SEQ ID NO: 560368 - RNA, 19 nt, Homo sapiens
agacaucucuggcaucauc

SEQ ID NO: 560369 - RNA, 19 nt, Homo sapiens
gaaaguugaaucaggaaug

SEQ ID NO: 560370 - RNA, 19 nt, Homo sapiens
gcuaguuguuucagaagaa

SEQ ID NO: 560371 - RNA, 19 nt, Homo sapiens
ugugaacucugauagauau

SEQ ID NO: 560372 - RNA, 19 nt, Homo sapiens
gaugaagaauuaggagaug

SEQ ID NO: 560373 - RNA, 19 nt, Homo sapiens
ugagaaggccgcugaauuc

SEQ ID NO: 560374 - RNA, 19 nt, Homo sapiens
gccagcagcuaugcagaua

SEQ ID NO: 560375 - RNA, 19 nt, Homo sapiens
ggauauggguccaagacau

SEQ ID NO: 560376 - RNA, 19 nt, Homo sapiens
aaaguugaaucaggaauga

SEQ ID NO: 560377 - RNA, 19 nt, Homo sapiens
ccgcugaauucuauaaaga

SEQ ID NO: 560378 - RNA, 19 nt, Homo sapiens
ugaaauguaugccgaagca

SEQ ID NO: 560379 - RNA, 19 nt, Homo sapiens
agaaggaaguaaaugaguu

SEQ ID NO: 560380 - RNA, 19 nt, Homo sapiens
aaagauagcccagaggaaa

SEQ ID NO: 560381 - RNA, 19 nt, Homo sapiens
ugauuugcuuccagaauaa

SEQ ID NO: 560382 - RNA, 19 nt, Homo sapiens
gcugugaacucugauagau

SEQ ID NO: 560383 - RNA, 19 nt, Homo sapiens
guagaagaaagcuguauug

SEQ ID NO: 560384 - RNA, 19 nt, Homo sapiens
ccagaaaacugaagagguu

SEQ ID NO: 560385 - RNA, 19 nt, Homo sapiens
gcaaauggaacgugaaagg

SEQ ID NO: 560386 - RNA, 19 nt, Homo sapiens
agacagcgagaacaaguua

SEQ ID NO: 560387 - RNA, 19 nt, Homo sapiens
guaaaugaguugguagaag

SEQ ID NO: 560388 - RNA, 19 nt, Homo sapiens
ucaauaggaagaccaauga

SEQ ID NO: 560389 - RNA, 19 nt, Homo sapiens
acacuaagguacaaaugau

SEQ ID NO: 560390 - RNA, 19 nt, Homo sapiens
agaauuaggagaugauuug

SEQ ID NO: 560391 - RNA, 19 nt, Homo sapiens
caaagauacucacagaaaa

SEQ ID NO: 560392 - RNA, 19 nt, Homo sapiens
gaaauggcagcugauggua

SEQ ID NO: 560393 - RNA, 19 nt, Homo sapiens
gcaaauggugauuaugaga

SEQ ID NO: 560394 - RNA, 19 nt, Homo sapiens
gcacaagccagcagcuaug

SEQ ID NO: 560395 - RNA, 19 nt, Homo sapiens
ucgaggaauuggagaauga

SEQ ID NO: 560396 - RNA, 19 nt, Homo sapiens
augauuugcuuccagaaua

SEQ ID NO: 560397 - RNA, 19 nt, Homo sapiens
uaaagcaauuagagaagga

SEQ ID NO: 560398 - RNA, 19 nt, Homo sapiens
gaaaaucccagucaagcua

SEQ ID NO: 560399 - RNA, 19 nt, Homo sapiens
guuacauacuugagacaaa

SEQ ID NO: 560400 - RNA, 19 nt, Homo sapiens
gcagaauauuggaguuaca

SEQ ID NO: 560401 - RNA, 19 nt, Homo sapiens
gcagaaagcgguacuuagc

SEQ ID NO: 560402 - RNA, 19 nt, Homo sapiens
ggagaaugaugcagcuuuu

SEQ ID NO: 560403 - RNA, 19 nt, Homo sapiens
agagacagaugaagaugau

SEQ ID NO: 560404 - RNA, 19 nt, Homo sapiens
gcuauugaauggcuaaugc

SEQ ID NO: 560405 - RNA, 19 nt, Homo sapiens
gaaaugcacuaccuuguuu

SEQ ID NO: 560406 - RNA, 19 nt, Homo sapiens
gaggugcgcuuauuugauu

SEQ ID NO: 560407 - RNA, 19 nt, Homo sapiens
gaaacaacauccacaaagu

SEQ ID NO: 560408 - RNA, 19 nt, Homo sapiens
uaaaggagcuacagaacga

SEQ ID NO: 560409 - RNA, 19 nt, Homo sapiens
acaaaugccuguucaauca

SEQ ID NO: 560410 - RNA, 19 nt, Homo sapiens
ggaacggccuggagucuga

SEQ ID NO: 560411 - RNA, 19 nt, Homo sapiens
uuagaugagucccuauuua

SEQ ID NO: 560412 - RNA, 19 nt, Homo sapiens
cagcguggcgguauuauua

SEQ ID NO: 560413 - RNA, 19 nt, Homo sapiens
ggacagacaggacuuguga

SEQ ID NO: 560414 - RNA, 19 nt, Homo sapiens
gcagaaggccuacgcaaga

SEQ ID NO: 560415 - RNA, 19 nt, Homo sapiens
uaucgaaggccgugauuua

SEQ ID NO: 560416 - RNA, 19 nt, Homo sapiens
cauacugugugacaaauuu

SEQ ID NO: 560417 - RNA, 19 nt, Homo sapiens
guagagaagcagaugaaua

SEQ ID NO: 560418 - RNA, 19 nt, Homo sapiens
ggaaaugcacuaccuuguu

SEQ ID NO: 560419 - RNA, 19 nt, Homo sapiens
aagaugaccuugauggaaa

SEQ ID NO: 560420 - RNA, 19 nt, Homo sapiens
gaagaugaccuugauggaa

SEQ ID NO: 560421 - RNA, 19 nt, Homo sapiens
gagaagcagaugaauauga

SEQ ID NO: 560422 - RNA, 19 nt, Homo sapiens
cgggagagcuaguggauga

SEQ ID NO: 560423 - RNA, 19 nt, Homo sapiens
ggacuuccuuggccuuaga

SEQ ID NO: 560424 - RNA, 19 nt, Homo sapiens
uagagaagcagaugaauau

SEQ ID NO: 560425 - RNA, 19 nt, Homo sapiens
agacaggacuugugacuag

SEQ ID NO: 560426 - RNA, 19 nt, Homo sapiens
ucagggagauggaggaaga

SEQ ID NO: 560427 - RNA, 19 nt, Homo sapiens
gcuggaagcucacuuucau

SEQ ID NO: 560428 - RNA, 19 nt, Homo sapiens
aaacaacauccacaaagua

SEQ ID NO: 560429 - RNA, 19 nt, Homo sapiens
cgagaagaguggaaggaaa

SEQ ID NO: 560430 - RNA, 19 nt, Homo sapiens
caaacuguucugcuuguua

SEQ ID NO: 560431 - RNA, 19 nt, Homo sapiens
ggaaggacaccaaacuguu

SEQ ID NO: 560432 - RNA, 19 nt, Homo sapiens
ggaaacaacauccacaaag

SEQ ID NO: 560433 - RNA, 19 nt, Homo sapiens
caucuaagcagcacaucua

SEQ ID NO: 560434 - RNA, 19 nt, Homo sapiens
gaaggacaccaaacuguuc

SEQ ID NO: 560435 - RNA, 19 nt, Homo sapiens
caauacaaaugccuguuca

SEQ ID NO: 560436 - RNA, 19 nt, Homo sapiens
gcagguacacccaaaggaa

SEQ ID NO: 560437 - RNA, 19 nt, Homo sapiens
ggaggugggagguggauuu

SEQ ID NO: 560438 - RNA, 19 nt, Homo sapiens
ggagguggauuuuguuuau

SEQ ID NO: 560439 - RNA, 19 nt, Homo sapiens
acaccaaacuguucugcuu

SEQ ID NO: 560440 - RNA, 19 nt, Homo sapiens
cuuauuugauugccaagua

SEQ ID NO: 560441 - RNA, 19 nt, Homo sapiens
ggacgcguguugauugaca

SEQ ID NO: 560442 - RNA, 19 nt, Homo sapiens
acuaguagcucuggacuga

SEQ ID NO: 560443 - RNA, 19 nt, Homo sapiens
ccaaauagccccaauacaa

SEQ ID NO: 560444 - RNA, 19 nt, Homo sapiens
aaacagaagaugaccuuga

SEQ ID NO: 560445 - RNA, 19 nt, Homo sapiens
agucaaccguguuaccaua

SEQ ID NO: 560446 - RNA, 19 nt, Homo sapiens
gcaagcaguaguaucaaga

SEQ ID NO: 560447 - RNA, 19 nt, Homo sapiens
uaagcucccuccuggaaug

SEQ ID NO: 560448 - RNA, 19 nt, Homo sapiens
gagaaucccauaacuaacu

SEQ ID NO: 560449 - RNA, 19 nt, Homo sapiens
uaccgggauuugagaauuu

SEQ ID NO: 560450 - RNA, 19 nt, Homo sapiens
gagacugcgaauauaaaua

SEQ ID NO: 560451 - RNA, 19 nt, Homo sapiens
gacuuuaccucgccagcaa

SEQ ID NO: 560452 - RNA, 19 nt, Homo sapiens
gguuugcagugguuugauu

SEQ ID NO: 560453 - RNA, 19 nt, Homo sapiens
cccagcggcuccaguguaa

SEQ ID NO: 560454 - RNA, 19 nt, Homo sapiens
ucacagcguggcgguauua

SEQ ID NO: 560455 - RNA, 19 nt, Homo sapiens
ucaaucaaccaaacaucua

SEQ ID NO: 560456 - RNA, 19 nt, Homo sapiens
caaucaaccaaacaucuaa

SEQ ID NO: 560457 - RNA, 19 nt, Homo sapiens
caaguaauauuccccaaug

SEQ ID NO: 560458 - RNA, 19 nt, Homo sapiens
gccgugagacugcgaauau

SEQ ID NO: 560459 - RNA, 19 nt, Homo sapiens
agaagcagaugaauaugag

SEQ ID NO: 560460 - RNA, 19 nt, Homo sapiens
ggaggaagaagcugagaag

SEQ ID NO: 560461 - RNA, 19 nt, Homo sapiens
uauauagaguucucagaca

SEQ ID NO: 560462 - RNA, 19 nt, Homo sapiens
gggagaagcaggaauaucg

SEQ ID NO: 560463 - RNA, 19 nt, Homo sapiens
gugaggcgaucggaagauu

SEQ ID NO: 560464 - RNA, 19 nt, Homo sapiens
caaccuaguuagcaaacag

SEQ ID NO: 560465 - RNA, 19 nt, Homo sapiens
aaacuguucugcuuguuac

SEQ ID NO: 560466 - RNA, 19 nt, Homo sapiens
ugcaggcgcucacaaccua

SEQ ID NO: 560467 - RNA, 19 nt, Homo sapiens
caaauagccccaauacaaa

SEQ ID NO: 560468 - RNA, 19 nt, Homo sapiens
cuaccgggauuugagaauu

SEQ ID NO: 560469 - RNA, 19 nt, Homo sapiens
ccucggguuucccaaguuu

SEQ ID NO: 560470 - RNA, 19 nt, Homo sapiens
ccuuagaggugcgcuuauu

SEQ ID NO: 560471 - RNA, 19 nt, Homo sapiens
cuaguuagcaaacaguaaa

SEQ ID NO: 560472 - RNA, 19 nt, Homo sapiens
cugcgaauauaaauaggaa

SEQ ID NO: 560473 - RNA, 19 nt, Homo sapiens
aacagaagaugaccuugau

SEQ ID NO: 560474 - RNA, 19 nt, Homo sapiens
agagcgacaucaugguauu

SEQ ID NO: 560475 - RNA, 19 nt, Homo sapiens
uggaugauggugccaauaa

SEQ ID NO: 560476 - RNA, 19 nt, Homo sapiens
ccacuuguccugggaaaug

SEQ ID NO: 560477 - RNA, 19 nt, Homo sapiens
cuagagcgacaucauggua

SEQ ID NO: 560478 - RNA, 19 nt, Homo sapiens
agacugcgaauauaaauag

SEQ ID NO: 560479 - RNA, 19 nt, Homo sapiens
aacaacauccacaaaguaa

SEQ ID NO: 560480 - RNA, 19 nt, Homo sapiens
auauagaguucucagacaa

SEQ ID NO: 560481 - RNA, 19 nt, Homo sapiens
ucauguccauugaggagaa

SEQ ID NO: 560482 - RNA, 19 nt, Homo sapiens
cgugagacugcgaauauaa

SEQ ID NO: 560483 - RNA, 19 nt, Homo sapiens
gugagacugcgaauauaaa

SEQ ID NO: 560484 - RNA, 19 nt, Homo sapiens
gagaagaguggaaggaaac

SEQ ID NO: 560485 - RNA, 19 nt, Homo sapiens
uaccuucccucccgucuuc

SEQ ID NO: 560486 - RNA, 19 nt, Homo sapiens
gguauuccccuuacuaaaa

SEQ ID NO: 560487 - RNA, 19 nt, Homo sapiens
gaugagucccuauuuagag

SEQ ID NO: 560488 - RNA, 19 nt, Homo sapiens
agaacgagguagagaagca

SEQ ID NO: 560489 - RNA, 19 nt, Homo sapiens
ggagcuacagaacgaggua

SEQ ID NO: 560490 - RNA, 19 nt, Homo sapiens
gaccucggguuucccaagu

SEQ ID NO: 560491 - RNA, 19 nt, Homo sapiens
gagauacaaguuuccugaa

SEQ ID NO: 560492 - RNA, 19 nt, Homo sapiens
gaggaaggcaaaucaaggu

SEQ ID NO: 560493 - RNA, 19 nt, Homo sapiens
ccgugagacugcgaauaua

SEQ ID NO: 560494 - RNA, 19 nt, Homo sapiens
uagaugagucccuauuuag

SEQ ID NO: 560495 - RNA, 19 nt, Homo sapiens
ggaugauggugccaauaac

SEQ ID NO: 560496 - RNA, 19 nt, Homo sapiens
gggaaaugcacuaccuugu

SEQ ID NO: 560497 - RNA, 19 nt, Homo sapiens
ggagauggaggaagaagcu

SEQ ID NO: 560498 - RNA, 19 nt, Homo sapiens
gcucacaaccuaguuagca

SEQ ID NO: 560499 - RNA, 19 nt, Homo sapiens
ggcaagcaguaguaucaag

SEQ ID NO: 560500 - RNA, 19 nt, Homo sapiens
ucagcaacaucccaucuac

SEQ ID NO: 560501 - RNA, 19 nt, Homo sapiens
ccaauacaaaugccuguuc

SEQ ID NO: 560502 - RNA, 19 nt, Homo sapiens
ccaaacuguucugcuuguu

SEQ ID NO: 560503 - RNA, 19 nt, Homo sapiens
caucuauguuggcaaugug

SEQ ID NO: 560504 - RNA, 19 nt, Homo sapiens
ccaucuauguuggcaaugu

SEQ ID NO: 560505 - RNA, 19 nt, Homo sapiens
gcagguggcuccuauggua

SEQ ID NO: 560506 - RNA, 19 nt, Homo sapiens
acacugagaucuccaauug

SEQ ID NO: 560507 - RNA, 19 nt, Homo sapiens
gaaaagggcuacagauuug

SEQ ID NO: 560508 - RNA, 19 nt, Homo sapiens
ggaggccacugcaacauuu

SEQ ID NO: 560509 - RNA, 19 nt, Homo sapiens
guaaguauauguagguuuc

SEQ ID NO: 560510 - RNA, 19 nt, Homo sapiens
gagaaaugccuaugaaaga

SEQ ID NO: 560511 - RNA, 19 nt, Homo sapiens
cagaaacacugccugauau

SEQ ID NO: 560512 - RNA, 19 nt, Homo sapiens
gaauucaggugaucucugu

SEQ ID NO: 560513 - RNA, 19 nt, Homo sapiens
gacagcauccucagcauua

SEQ ID NO: 560514 - RNA, 19 nt, Homo sapiens
gcaagagcaugaaaauaua

SEQ ID NO: 560515 - RNA, 19 nt, Homo sapiens
ugagagaaaugccuaugaa

SEQ ID NO: 560516 - RNA, 19 nt, Homo sapiens
ccacucaucugccaugguu

SEQ ID NO: 560517 - RNA, 19 nt, Homo sapiens
gaggaaagcauccaggaaa

SEQ ID NO: 560518 - RNA, 19 nt, Homo sapiens
ggagaccugucgcugauga

SEQ ID NO: 560519 - RNA, 19 nt, Homo sapiens
ggaaagcauccaggaaaua

SEQ ID NO: 560520 - RNA, 19 nt, Homo sapiens
gaagguguaaguauaugua

SEQ ID NO: 560521 - RNA, 19 nt, Homo sapiens
ggaaugaagaagaggauuu

SEQ ID NO: 560522 - RNA, 19 nt, Homo sapiens
gaagugcugugauguuucu

SEQ ID NO: 560523 - RNA, 19 nt, Homo sapiens
gugaagugcugugauguuu

SEQ ID NO: 560524 - RNA, 19 nt, Homo sapiens
cacggaagguguaaguaua

SEQ ID NO: 560525 - RNA, 19 nt, Homo sapiens
ggugaucucuguggaggua

SEQ ID NO: 560526 - RNA, 19 nt, Homo sapiens
gcucgcacguucucaaaga

SEQ ID NO: 560527 - RNA, 19 nt, Homo sapiens
guugacagcauuaggaaua

SEQ ID NO: 560528 - RNA, 19 nt, Homo sapiens
ccacauggcauuugggaaa

SEQ ID NO: 560529 - RNA, 19 nt, Homo sapiens
gcagaugggucaugcuuuu

SEQ ID NO: 560530 - RNA, 19 nt, Homo sapiens
cagaacaacugcuacaucu

SEQ ID NO: 560531 - RNA, 19 nt, Homo sapiens
cugaugagaugaagaaugu

SEQ ID NO: 560532 - RNA, 19 nt, Homo sapiens
caggagaaccuacagauug

SEQ ID NO: 560533 - RNA, 19 nt, Homo sapiens
gcuguuacuggcuaaauua

SEQ ID NO: 560534 - RNA, 19 nt, Homo sapiens
gauuucagcuuugaguuau

SEQ ID NO: 560535 - RNA, 19 nt, Homo sapiens
acagaaacacugccugaua

SEQ ID NO: 560536 - RNA, 19 nt, Homo sapiens
guugaagaagccuaaauua

SEQ ID NO: 560537 - RNA, 19 nt, Homo sapiens
cgggccagcuguauacaua

SEQ ID NO: 560538 - RNA, 19 nt, Homo sapiens
ggcaaaggccucugacuug

SEQ ID NO: 560539 - RNA, 19 nt, Homo sapiens
gauuguaggucaaguaucg

SEQ ID NO: 560540 - RNA, 19 nt, Homo sapiens
gggacucacucuucauuca

SEQ ID NO: 560541 - RNA, 19 nt, Homo sapiens
gccaagacuucucugaaug

SEQ ID NO: 560542 - RNA, 19 nt, Homo sapiens
ggacaugaugguucuguga

SEQ ID NO: 560543 - RNA, 19 nt, Homo sapiens
ggaugcguguuccucagua

SEQ ID NO: 560544 - RNA, 19 nt, Homo sapiens
caacaguggcguauaggaa

SEQ ID NO: 560545 - RNA, 19 nt, Homo sapiens
acaccaaccuugcuuucaa

SEQ ID NO: 560546 - RNA, 19 nt, Homo sapiens
gaaugaagaagaggauuug

SEQ ID NO: 560547 - RNA, 19 nt, Homo sapiens
gagagaaaugccuaugaaa

SEQ ID NO: 560548 - RNA, 19 nt, Homo sapiens
cagagcugcuuguggguuu

SEQ ID NO: 560549 - RNA, 19 nt, Homo sapiens
cagccuaguugcuuuaauc

SEQ ID NO: 560550 - RNA, 19 nt, Homo sapiens
ugaagaagaggauuuggaa

SEQ ID NO: 560551 - RNA, 19 nt, Homo sapiens
gagcagccuucuucuuugg

SEQ ID NO: 560552 - RNA, 19 nt, Homo sapiens
ccacucaccuacuugaaag

SEQ ID NO: 560553 - RNA, 19 nt, Homo sapiens
cgagcagccuucuucuuug

SEQ ID NO: 560554 - RNA, 19 nt, Homo sapiens
cagagacccuggaaacaca

SEQ ID NO: 560555 - RNA, 19 nt, Homo sapiens
gccaagacauggagcaucu

SEQ ID NO: 560556 - RNA, 19 nt, Homo sapiens
gaucagaggcagaaaauga

SEQ ID NO: 560557 - RNA, 19 nt, Homo sapiens
gaaagcauccaggaaauac

SEQ ID NO: 560558 - RNA, 19 nt, Homo sapiens
ucgagcagccuucuucuuu

SEQ ID NO: 560559 - RNA, 19 nt, Homo sapiens
acacagcuuucaugagguu

SEQ ID NO: 560560 - RNA, 19 nt, Homo sapiens
gagccaagacuucucugaa

SEQ ID NO: 560561 - RNA, 19 nt, Homo sapiens
gcaauuuagagaaugugua

SEQ ID NO: 560562 - RNA, 19 nt, Homo sapiens
gcacccaccugaagaucca

SEQ ID NO: 560563 - RNA, 19 nt, Homo sapiens
acagccagauuucagcuuu

SEQ ID NO: 560564 - RNA, 19 nt, Homo sapiens
uauguagguuucucuguug

SEQ ID NO: 560565 - RNA, 19 nt, Homo sapiens
uguaggggcuggaaaauaa

SEQ ID NO: 560566 - RNA, 19 nt, Homo sapiens
aagcaacaguggcguauag

SEQ ID NO: 560567 - RNA, 19 nt, Homo sapiens
cuuguucugugauugguua

SEQ ID NO: 560568 - RNA, 19 nt, Homo sapiens
ccucugacuuggacccuuu

SEQ ID NO: 560569 - RNA, 19 nt, Homo sapiens
cauaaaggaaugaccaaga

SEQ ID NO: 560570 - RNA, 19 nt, Homo sapiens
aaugcuugcuugucucuuu

SEQ ID NO: 560571 - RNA, 19 nt, Homo sapiens
gaaacacugccugauaugu

SEQ ID NO: 560572 - RNA, 19 nt, Homo sapiens
ucccuucccugcacuguuu

SEQ ID NO: 560573 - RNA, 19 nt, Homo sapiens
ggaggaaagcauccaggaa

SEQ ID NO: 560574 - RNA, 19 nt, Homo sapiens
gggaagcuguguguaaugg

SEQ ID NO: 560575 - RNA, 19 nt, Homo sapiens
gaggagaauucaggugauc

SEQ ID NO: 560576 - RNA, 19 nt, Homo sapiens
ggcccuggauggcacauga

SEQ ID NO: 560577 - RNA, 19 nt, Homo sapiens
ggaggcauccagugauuuc

SEQ ID NO: 560578 - RNA, 19 nt, Homo sapiens
gggaccaguucuacaagga

SEQ ID NO: 560579 - RNA, 19 nt, Homo sapiens
aauguugacuacccacgua

SEQ ID NO: 560580 - RNA, 19 nt, Homo sapiens
ggccuuggaugcccucuag

SEQ ID NO: 560581 - RNA, 19 nt, Homo sapiens
gaagcaacaguggcguaua

SEQ ID NO: 560582 - RNA, 19 nt, Homo sapiens
ggaucgagcagccuucuuc

SEQ ID NO: 560583 - RNA, 19 nt, Homo sapiens
ggaaacacacugagaucuc

SEQ ID NO: 560584 - RNA, 19 nt, Homo sapiens
agauuucagcuuugaguua

SEQ ID NO: 560585 - RNA, 19 nt, Homo sapiens
ugacagcauuaggaauaaa

SEQ ID NO: 560586 - RNA, 19 nt, Homo sapiens
ggcuguuacuggcuaaauu

SEQ ID NO: 560587 - RNA, 19 nt, Homo sapiens
aagaagaggauuuggaaga

SEQ ID NO: 560588 - RNA, 19 nt, Homo sapiens
gacucacucuucauucaga

SEQ ID NO: 560589 - RNA, 19 nt, Homo sapiens
guguguaucuguccaugug

SEQ ID NO: 560590 - RNA, 19 nt, Homo sapiens
gccaggugcuugucagauc

SEQ ID NO: 560591 - RNA, 19 nt, Homo sapiens
gaugaccucagccuaguug

SEQ ID NO: 560592 - RNA, 19 nt, Homo sapiens
ucacggaagguguaaguau

SEQ ID NO: 560593 - RNA, 19 nt, Homo sapiens
acuaagcucugccaagcaa

SEQ ID NO: 560594 - RNA, 19 nt, Homo sapiens
agaagaagggaaugaagaa

SEQ ID NO: 560595 - RNA, 19 nt, Homo sapiens
caggaaauacagaggguuu

SEQ ID NO: 560596 - RNA, 19 nt, Homo sapiens
ucucaguguuucaguguug

SEQ ID NO: 560597 - RNA, 19 nt, Homo sapiens
gacagcaacagacaaacaa

SEQ ID NO: 560598 - RNA, 19 nt, Homo sapiens
cauugccucuugcagauga

SEQ ID NO: 560599 - RNA, 19 nt, Homo sapiens
uccaauugcugccuccauu

SEQ ID NO: 560600 - RNA, 19 nt, Homo sapiens
gcgaggcaaugcucuaggu

SEQ ID NO: 560601 - RNA, 19 nt, Homo sapiens
ggaaaaugaacccaucuuu

SEQ ID NO: 560602 - RNA, 19 nt, Homo sapiens
uagaagaagggaaugaaga

SEQ ID NO: 560603 - RNA, 19 nt, Homo sapiens
ugucugcaauuuagagaau

SEQ ID NO: 560604 - RNA, 19 nt, Homo sapiens
gguuagcaauguugacuac

SEQ ID NO: 560605 - RNA, 19 nt, Homo sapiens
gcagacaacuccucgauga

SEQ ID NO: 560606 - RNA, 19 nt, Homo sapiens
gaacaucacugcagacaac

SEQ ID NO: 560607 - RNA, 19 nt, Homo sapiens
ccaacugccugucccucua

SEQ ID NO: 560608 - RNA, 19 nt, Homo sapiens
gugaggagcccgagcuguu

SEQ ID NO: 560609 - RNA, 19 nt, Homo sapiens
gcuguaccaucgaccauac

SEQ ID NO: 560610 - RNA, 19 nt, Homo sapiens
gcauccuccuguacgagaa

SEQ ID NO: 560611 - RNA, 19 nt, Homo sapiens
uuucaacgccuaccacuuc

SEQ ID NO: 560612 - RNA, 19 nt, Homo sapiens
gccgaccucuucuacaucu

SEQ ID NO: 560613 - RNA, 19 nt, Homo sapiens
uggccgaccucuucuacau

SEQ ID NO: 560614 - RNA, 19 nt, Homo sapiens
gaggagcccgagcuguuga

SEQ ID NO: 560615 - RNA, 19 nt, Homo sapiens
uacgagaacaucuacauca

SEQ ID NO: 560616 - RNA, 19 nt, Homo sapiens
guacgagaacaucuacauc

SEQ ID NO: 560617 - RNA, 19 nt, Homo sapiens
gaacgagcugggcguguac

SEQ ID NO: 560618 - RNA, 19 nt, Homo sapiens
ucggcuaccugcagaucaa

SEQ ID NO: 560619 - RNA, 19 nt, Homo sapiens
ggaacaucacugcagacaa

SEQ ID NO: 560620 - RNA, 19 nt, Homo sapiens
agcccgagcuguugaccaa

SEQ ID NO: 560621 - RNA, 19 nt, Homo sapiens
gcucagcaccguggucauc

SEQ ID NO: 560622 - RNA, 19 nt, Homo sapiens
ucagcaccguggucaucuu

SEQ ID NO: 560623 - RNA, 19 nt, Homo sapiens
ggucaucgaggacgagaac

SEQ ID NO: 560624 - RNA, 19 nt, Homo sapiens
gcaaucagcuucuauccuu

SEQ ID NO: 560625 - RNA, 19 nt, Homo sapiens
gggagaaguucguguauuu

SEQ ID NO: 560626 - RNA, 19 nt, Homo sapiens
gcacuaguauuucauguug

SEQ ID NO: 560627 - RNA, 19 nt, Homo sapiens
ccagaugacugauguaugg

SEQ ID NO: 560628 - RNA, 19 nt, Homo sapiens
cgagauaaaggauagguua

SEQ ID NO: 560629 - RNA, 19 nt, Homo sapiens
ucacagcacuaguauuuca

SEQ ID NO: 560630 - RNA, 19 nt, Homo sapiens
ccucacagcacuaguauuu

SEQ ID NO: 560631 - RNA, 19 nt, Homo sapiens
caaggaggauuccauuugg

SEQ ID NO: 560632 - RNA, 19 nt, Homo sapiens
ggcagcaccugucuccuuu

SEQ ID NO: 560633 - RNA, 19 nt, Homo sapiens
gugcuacgccugcauguaa

SEQ ID NO: 560634 - RNA, 19 nt, Homo sapiens
uauguggcaugaauacuuu

SEQ ID NO: 560635 - RNA, 19 nt, Homo sapiens
ccaaggaggauuccauuug

SEQ ID NO: 560636 - RNA, 19 nt, Homo sapiens
gcccuuaaccaucgagaua

SEQ ID NO: 560637 - RNA, 19 nt, Homo sapiens
gauguuguguuucuguuca

SEQ ID NO: 560638 - RNA, 19 nt, Homo sapiens
ggagagaagugagaauagg

SEQ ID NO: 560639 - RNA, 19 nt, Homo sapiens
gcccaagccugcugccuau

SEQ ID NO: 560640 - RNA, 19 nt, Homo sapiens
uaaaggauagguuacaguu

SEQ ID NO: 560641 - RNA, 19 nt, Homo sapiens
ugacugauguauggucuug

SEQ ID NO: 560642 - RNA, 19 nt, Homo sapiens
aaaguuguauguggcauga

SEQ ID NO: 560643 - RNA, 19 nt, Homo sapiens
gauaaaggauagguuacag

SEQ ID NO: 560644 - RNA, 19 nt, Homo sapiens
cagcuucuauccuugacuu

SEQ ID NO: 560645 - RNA, 19 nt, Homo sapiens
caauggggauguuguguuu

SEQ ID NO: 560646 - RNA, 19 nt, Homo sapiens
aaggauagguuacaguuac

SEQ ID NO: 560647 - RNA, 19 nt, Homo sapiens
ccuuaaccaucgagauaaa

SEQ ID NO: 560648 - RNA, 19 nt, Homo sapiens
guggagagaagugagaaua

SEQ ID NO: 560649 - RNA, 19 nt, Homo sapiens
cagcaccugucuccuuuca

SEQ ID NO: 560650 - RNA, 19 nt, Homo sapiens
gcugccagaugacugaugu

SEQ ID NO: 560651 - RNA, 19 nt, Homo sapiens
ggagaaguucguguauuug

SEQ ID NO: 560652 - RNA, 19 nt, Homo sapiens
ggauagagguuggguuucc

SEQ ID NO: 560653 - RNA, 19 nt, Homo sapiens
ccacucagcuccgugaacu

SEQ ID NO: 560654 - RNA, 19 nt, Homo sapiens
gggauguuguguuucuguu

SEQ ID NO: 560655 - RNA, 19 nt, Homo sapiens
aaaggauagguuacaguua

SEQ ID NO: 560656 - RNA, 19 nt, Homo sapiens
ccaucgagauaaaggauag

SEQ ID NO: 560657 - RNA, 19 nt, Homo sapiens
gauccucagacuccaguuu

SEQ ID NO: 560658 - RNA, 19 nt, Homo sapiens
ggaggaauggacagacaga

SEQ ID NO: 560659 - RNA, 19 nt, Homo sapiens
cucuggcucuugcuucuua

SEQ ID NO: 560660 - RNA, 19 nt, Homo sapiens
uggcagcucuacccugaug

SEQ ID NO: 560661 - RNA, 19 nt, Homo sapiens
gagaaguucguguauuugg

SEQ ID NO: 560662 - RNA, 19 nt, Homo sapiens
gagccuggccagccuacaa

SEQ ID NO: 560663 - RNA, 19 nt, Homo sapiens
gacgauaccgauccucaga

SEQ ID NO: 560664 - RNA, 19 nt, Homo sapiens
uaucugugcucaggacuca

SEQ ID NO: 560665 - RNA, 19 nt, Homo sapiens
aaacgcugccugcccguaa

SEQ ID NO: 560666 - RNA, 19 nt, Homo sapiens
aaacgcugccugccgguaa

SEQ ID NO: 560667 - RNA, 19 nt, Homo sapiens
agaaguucguguauuugga

SEQ ID NO: 560668 - RNA, 19 nt, Homo sapiens
ucgagcugcugccagauga

SEQ ID NO: 560669 - RNA, 19 nt, Homo sapiens
ugagaacacagccgauuca

SEQ ID NO: 560670 - RNA, 19 nt, Homo sapiens
uuacuaugccugugucuuc

SEQ ID NO: 560671 - RNA, 19 nt, Homo sapiens
gagcaggaccucugaaacc

SEQ ID NO: 560672 - RNA, 19 nt, Homo sapiens
ugggagaaguucguguauu

SEQ ID NO: 560673 - RNA, 19 nt, Homo sapiens
gauggucuucagccucuuu

SEQ ID NO: 560674 - RNA, 19 nt, Homo sapiens
gccaaggaggauuccauuu

SEQ ID NO: 560675 - RNA, 19 nt, Homo sapiens
caaggaaaggccugaaagg

SEQ ID NO: 560676 - RNA, 19 nt, Homo sapiens
ucagcuggaugauggucuu

SEQ ID NO: 560677 - RNA, 19 nt, Homo sapiens
gcgcuuaguguaccacauc

SEQ ID NO: 560678 - RNA, 19 nt, Homo sapiens
ccaagccugcugccuauca

SEQ ID NO: 560679 - RNA, 19 nt, Homo sapiens
gguaaacacgccugcaaac

SEQ ID NO: 560680 - RNA, 19 nt, Homo sapiens
cauguaaacacgccugcaa

SEQ ID NO: 560681 - RNA, 19 nt, Homo sapiens
cagcacuaguauuucaugu

SEQ ID NO: 560682 - RNA, 19 nt, Homo sapiens
agggauagagguuggguuu

SEQ ID NO: 560683 - RNA, 19 nt, Homo sapiens
gaauggacagacagaggau

SEQ ID NO: 560684 - RNA, 19 nt, Homo sapiens
caagccugcugccuaucau

SEQ ID NO: 560685 - RNA, 19 nt, Homo sapiens
cgauaccgauccucagacu

SEQ ID NO: 560686 - RNA, 19 nt, Homo sapiens
gagauaaaggauagguuac

SEQ ID NO: 560687 - RNA, 19 nt, Homo sapiens
ucaaggaaaggccugaaag

SEQ ID NO: 560688 - RNA, 19 nt, Homo sapiens
gcagcucuacccugaugga

SEQ ID NO: 560689 - RNA, 19 nt, Homo sapiens
ccugggagaaguucgugua

SEQ ID NO: 560690 - RNA, 19 nt, Homo sapiens
ucagcuccgugaacuugug

SEQ ID NO: 560691 - RNA, 19 nt, Homo sapiens
ccacucugcucgccuuagc

SEQ ID NO: 560692 - RNA, 19 nt, Homo sapiens
guucaccuucguuuacuau

SEQ ID NO: 560693 - RNA, 19 nt, Homo sapiens
aaucagcuucuauccuuga

SEQ ID NO: 560694 - RNA, 19 nt, Homo sapiens
aaggaaaggccugaaagga

SEQ ID NO: 560695 - RNA, 19 nt, Homo sapiens
ucacgugcagcucaaggaa

SEQ ID NO: 560696 - RNA, 19 nt, Homo sapiens
gugagaacacagccgauuc

SEQ ID NO: 560697 - RNA, 19 nt, Homo sapiens
acuaguauuucauguugca

SEQ ID NO: 560698 - RNA, 19 nt, Homo sapiens
ugggaggaauggacagaca

SEQ ID NO: 560699 - RNA, 19 nt, Homo sapiens
ucaccuucguuuacuaugc

SEQ ID NO: 560700 - RNA, 19 nt, Homo sapiens
gcugcugccagaugacuga

SEQ ID NO: 560701 - RNA, 19 nt, Homo sapiens
ugaagaagcuugucuaugu

SEQ ID NO: 560702 - RNA, 19 nt, Homo sapiens
gauugcaccugaugucuua

SEQ ID NO: 560703 - RNA, 19 nt, Homo sapiens
caaaugcugugaccuguuu

SEQ ID NO: 560704 - RNA, 19 nt, Homo sapiens
caaaccagcuccagucuug

SEQ ID NO: 560705 - RNA, 19 nt, Homo sapiens
ugaaugagaucacagagaa

SEQ ID NO: 560706 - RNA, 19 nt, Homo sapiens
caacaaggauucucucaag

SEQ ID NO: 560707 - RNA, 19 nt, Homo sapiens
ugaagaacguggccuguaa

SEQ ID NO: 560708 - RNA, 19 nt, Homo sapiens
ugaccaaccuggccaauga

SEQ ID NO: 560709 - RNA, 19 nt, Homo sapiens
gaacgaaucccuacuagag

SEQ ID NO: 560710 - RNA, 19 nt, Homo sapiens
gaccagaacuaugauauuc

SEQ ID NO: 560711 - RNA, 19 nt, Homo sapiens
caacauuccuacuguccua

SEQ ID NO: 560712 - RNA, 19 nt, Homo sapiens
gaugcuagcuaucaaggaa

SEQ ID NO: 560713 - RNA, 19 nt, Homo sapiens
uggcaaagcuuacagacaa

SEQ ID NO: 560714 - RNA, 19 nt, Homo sapiens
gaagaagcuugucuaugug

SEQ ID NO: 560715 - RNA, 19 nt, Homo sapiens
gcagugaguccgacaauga

SEQ ID NO: 560716 - RNA, 19 nt, Homo sapiens
ccaaauaugaccagaacua

SEQ ID NO: 560717 - RNA, 19 nt, Homo sapiens
guaagaacauagaggugaa

SEQ ID NO: 560718 - RNA, 19 nt, Homo sapiens
gaacguggccuguaagaac

SEQ ID NO: 560719 - RNA, 19 nt, Homo sapiens
gucagucucucucaucuuu

SEQ ID NO: 560720 - RNA, 19 nt, Homo sapiens
ccaagcugcugacccagua

SEQ ID NO: 560721 - RNA, 19 nt, Homo sapiens
caccugaugucuuaagaaa

SEQ ID NO: 560722 - RNA, 19 nt, Homo sapiens
ugauagaagucauugagaa

SEQ ID NO: 560723 - RNA, 19 nt, Homo sapiens
gagagugaaucggacagua

SEQ ID NO: 560724 - RNA, 19 nt, Homo sapiens
gcaucgaccugauucacaa

SEQ ID NO: 560725 - RNA, 19 nt, Homo sapiens
gaacauagaggugaagaag

SEQ ID NO: 560726 - RNA, 19 nt, Homo sapiens
gaggaaagaaugcuucaga

SEQ ID NO: 560727 - RNA, 19 nt, Homo sapiens
ggaugaggaugaggagaaa

SEQ ID NO: 560728 - RNA, 19 nt, Homo sapiens
guaagaggaagacaaagaa

SEQ ID NO: 560729 - RNA, 19 nt, Homo sapiens
gaaagcugaugggcaugaa

SEQ ID NO: 560730 - RNA, 19 nt, Homo sapiens
gcaucagcauccaagaauu

SEQ ID NO: 560731 - RNA, 19 nt, Homo sapiens
gguaagaggaagacaaaga

SEQ ID NO: 560732 - RNA, 19 nt, Homo sapiens
gaagagaaaggagaaggaa

SEQ ID NO: 560733 - RNA, 19 nt, Homo sapiens
caucagcauccaagaauuu

SEQ ID NO: 560734 - RNA, 19 nt, Homo sapiens
gaagaaggugccagagaga

SEQ ID NO: 560735 - RNA, 19 nt, Homo sapiens
aauaugaccagaacuauga

SEQ ID NO: 560736 - RNA, 19 nt, Homo sapiens
gcugguaaaggaugugaua

SEQ ID NO: 560737 - RNA, 19 nt, Homo sapiens
gagagaucaucaaacacuu

SEQ ID NO: 560738 - RNA, 19 nt, Homo sapiens
ggagagaucaucaaacacu

SEQ ID NO: 560739 - RNA, 19 nt, Homo sapiens
ccagaacgaaucccuacua

SEQ ID NO: 560740 - RNA, 19 nt, Homo sapiens
ggagaggcagugagaguga

SEQ ID NO: 560741 - RNA, 19 nt, Homo sapiens
caacauggagagaucauca

SEQ ID NO: 560742 - RNA, 19 nt, Homo sapiens
agucaguggucgucauuaa

SEQ ID NO: 560743 - RNA, 19 nt, Homo sapiens
gagaagcgucauccucuga

SEQ ID NO: 560744 - RNA, 19 nt, Homo sapiens
caaaucgggagaagagaaa

SEQ ID NO: 560745 - RNA, 19 nt, Homo sapiens
ggaauuccagaccuauauu

SEQ ID NO: 560746 - RNA, 19 nt, Homo sapiens
gaucacagagaaacucaug

SEQ ID NO: 560747 - RNA, 19 nt, Homo sapiens
ggccaaauaugaccagaac

SEQ ID NO: 560748 - RNA, 19 nt, Homo sapiens
gggaauuccagaccuauau

SEQ ID NO: 560749 - RNA, 19 nt, Homo sapiens
cgugacaccugccucaaug

SEQ ID NO: 560750 - RNA, 19 nt, Homo sapiens
agaccaacauuccuacugu

SEQ ID NO: 560751 - RNA, 19 nt, Homo sapiens
gguaaaggaugugauacag

SEQ ID NO: 560752 - RNA, 19 nt, Homo sapiens
ggaaagcugaugggcauga

SEQ ID NO: 560753 - RNA, 19 nt, Homo sapiens
acagugacccugagucuga

SEQ ID NO: 560754 - RNA, 19 nt, Homo sapiens
gcucaaaucgggagaagag

SEQ ID NO: 560755 - RNA, 19 nt, Homo sapiens
ucaaagaccgggaccacuu

SEQ ID NO: 560756 - RNA, 19 nt, Homo sapiens
cagcagaggaggauauugu

SEQ ID NO: 560757 - RNA, 19 nt, Homo sapiens
cagaacgaaucccuacuag

SEQ ID NO: 560758 - RNA, 19 nt, Homo sapiens
guaccugaauggaccaagu

SEQ ID NO: 560759 - RNA, 19 nt, Homo sapiens
caaauaugaccagaacuau

SEQ ID NO: 560760 - RNA, 19 nt, Homo sapiens
agaaauugcuacagaugca

SEQ ID NO: 560761 - RNA, 19 nt, Homo sapiens
uaagaaauugcuacagaug

SEQ ID NO: 560762 - RNA, 19 nt, Homo sapiens
gcucugacccagugacuuc

SEQ ID NO: 560763 - RNA, 19 nt, Homo sapiens
gcaugaaugagaucacaga

SEQ ID NO: 560764 - RNA, 19 nt, Homo sapiens
gggcaugaaugagaucaca

SEQ ID NO: 560765 - RNA, 19 nt, Homo sapiens
ggucgucauuaagaaauug

SEQ ID NO: 560766 - RNA, 19 nt, Homo sapiens
agaggaagacaaagaagaa

SEQ ID NO: 560767 - RNA, 19 nt, Homo sapiens
gaaugcuucagaccuguuu

SEQ ID NO: 560768 - RNA, 19 nt, Homo sapiens
gagaggcagugagagugaa

SEQ ID NO: 560769 - RNA, 19 nt, Homo sapiens
ggagucauccuucaaagac

SEQ ID NO: 560770 - RNA, 19 nt, Homo sapiens
gauagaagucauugagaag

SEQ ID NO: 560771 - RNA, 19 nt, Homo sapiens
gaugauugcccgaggaaag

SEQ ID NO: 560772 - RNA, 19 nt, Homo sapiens
caacguggagguaccugaa

SEQ ID NO: 560773 - RNA, 19 nt, Homo sapiens
ugcugagucuggccaaaua

SEQ ID NO: 560774 - RNA, 19 nt, Homo sapiens
auggagagaucaucaaaca

SEQ ID NO: 560775 - RNA, 19 nt, Homo sapiens
caucauagugcccaucaug

SEQ ID NO: 560776 - RNA, 19 nt, Homo sapiens
gaaugagaucacagagaaa

SEQ ID NO: 560777 - RNA, 19 nt, Homo sapiens
ggaagacaaagaagaaggu

SEQ ID NO: 560778 - RNA, 19 nt, Homo sapiens
acaaugaagaccaggauga

SEQ ID NO: 560779 - RNA, 19 nt, Homo sapiens
aguaagagcagcagugaga

SEQ ID NO: 560780 - RNA, 19 nt, Homo sapiens
gggagaagagaaaggagaa

SEQ ID NO: 560781 - RNA, 19 nt, Homo sapiens
gaagccgccucggacaugu

SEQ ID NO: 560782 - RNA, 19 nt, Homo sapiens
acauagaggugaagaagcu

SEQ ID NO: 560783 - RNA, 19 nt, Homo sapiens
gcuguggacuacaccuuca

SEQ ID NO: 560784 - RNA, 19 nt, Homo sapiens
agcaguagcucaucagagu

SEQ ID NO: 560785 - RNA, 19 nt, Homo sapiens
gcaccugaugucuuaagaa

SEQ ID NO: 560786 - RNA, 19 nt, Homo sapiens
ucaguggucgucauuaaga

SEQ ID NO: 560787 - RNA, 19 nt, Homo sapiens
ccgaaagcccuaugucaug

SEQ ID NO: 560788 - RNA, 19 nt, Homo sapiens
gaaucugccacugcuguaa

SEQ ID NO: 560789 - RNA, 19 nt, Homo sapiens
agagugaggaggaugguaa

SEQ ID NO: 560790 - RNA, 19 nt, Homo sapiens
agagugaaucggacaguaa

SEQ ID NO: 560791 - RNA, 19 nt, Homo sapiens
ucacugucccaccugcuua

SEQ ID NO: 560792 - RNA, 19 nt, Homo sapiens
ugaccagaacuaugauauu

SEQ ID NO: 560793 - RNA, 19 nt, Homo sapiens
aaacacuuggcaaagcuua

SEQ ID NO: 560794 - RNA, 19 nt, Homo sapiens
acagugaggugcaguacgu

SEQ ID NO: 560795 - RNA, 19 nt, Homo sapiens
ugcuugaucuagaggauuu

SEQ ID NO: 560796 - RNA, 19 nt, Homo sapiens
aaagggagaggcagugaga

SEQ ID NO: 560797 - RNA, 19 nt, Homo sapiens
ucaaaucgggagaagagaa

SEQ ID NO: 560798 - RNA, 19 nt, Homo sapiens
gcagaggaggauauuguca

SEQ ID NO: 560799 - RNA, 19 nt, Homo sapiens
gcagccagcacaacaugga

SEQ ID NO: 560800 - RNA, 19 nt, Homo sapiens
cagcauggacaaggacuuu

SEQ ID NO: 560801 - RNA, 19 nt, Homo sapiens
gaacuggaauucuuaagua

SEQ ID NO: 560802 - RNA, 19 nt, Homo sapiens
gggagaagaugaugacuaa

SEQ ID NO: 560803 - RNA, 19 nt, Homo sapiens
uaaccaaccugaacgacua

SEQ ID NO: 560804 - RNA, 19 nt, Homo sapiens
gcagacggauucauuuaga

SEQ ID NO: 560805 - RNA, 19 nt, Homo sapiens
ugaagaagguuauaacgau

SEQ ID NO: 560806 - RNA, 19 nt, Homo sapiens
ccucacgcaucuaaauuua

SEQ ID NO: 560807 - RNA, 19 nt, Homo sapiens
ugaugaagaugcucaggua

SEQ ID NO: 560808 - RNA, 19 nt, Homo sapiens
ggaggaguaugaugaagau

SEQ ID NO: 560809 - RNA, 19 nt, Homo sapiens
aagaagagcuuggugaaga

SEQ ID NO: 560810 - RNA, 19 nt, Homo sapiens
ccucacagaugaauuugaa

SEQ ID NO: 560811 - RNA, 19 nt, Homo sapiens
uuaagaagcuugaacuaag

SEQ ID NO: 560812 - RNA, 19 nt, Homo sapiens
ggaggaggaugaagaaggu

SEQ ID NO: 560813 - RNA, 19 nt, Homo sapiens
gaaccucacgcaucuaaau

SEQ ID NO: 560814 - RNA, 19 nt, Homo sapiens
cgaggaagaugaagaagag

SEQ ID NO: 560815 - RNA, 19 nt, Homo sapiens
gggcagacggauucauuua

SEQ ID NO: 560816 - RNA, 19 nt, Homo sapiens
agagguagaugacgaggaa

SEQ ID NO: 560817 - RNA, 19 nt, Homo sapiens
uuaaagaccucagcacaau

SEQ ID NO: 560818 - RNA, 19 nt, Homo sapiens
ucgaaggccucacagauga

SEQ ID NO: 560819 - RNA, 19 nt, Homo sapiens
gaaugaaggcaaacucgaa

SEQ ID NO: 560820 - RNA, 19 nt, Homo sapiens
uuauaacgauggagaggua

SEQ ID NO: 560821 - RNA, 19 nt, Homo sapiens
gagaggaggaggaggauga

SEQ ID NO: 560822 - RNA, 19 nt, Homo sapiens
gagaagaugaugacuaagu

SEQ ID NO: 560823 - RNA, 19 nt, Homo sapiens
gcuuagaccuuuucaauug

SEQ ID NO: 560824 - RNA, 19 nt, Homo sapiens
ggacaacagucggucgaau

SEQ ID NO: 560825 - RNA, 19 nt, Homo sapiens
cucaagagcuuagaccuuu

SEQ ID NO: 560826 - RNA, 19 nt, Homo sapiens
ggaacaggacgcccucuga

SEQ ID NO: 560827 - RNA, 19 nt, Homo sapiens
ggaggaggaggaugaagaa

SEQ ID NO: 560828 - RNA, 19 nt, Homo sapiens
ucacgcaucuaaauuuaag

SEQ ID NO: 560829 - RNA, 19 nt, Homo sapiens
gaacaggacgcccucugau

SEQ ID NO: 560830 - RNA, 19 nt, Homo sapiens
gagaugggcagacggauuc

SEQ ID NO: 560831 - RNA, 19 nt, Homo sapiens
agaagaugaugacuaagug

SEQ ID NO: 560832 - RNA, 19 nt, Homo sapiens
cacaauagagccacugaaa

SEQ ID NO: 560833 - RNA, 19 nt, Homo sapiens
ggagaugggcagacggauu

SEQ ID NO: 560834 - RNA, 19 nt, Homo sapiens
gaugaugacuaaguggaau

SEQ ID NO: 560835 - RNA, 19 nt, Homo sapiens
agaagagcuuggugaagaa

SEQ ID NO: 560836 - RNA, 19 nt, Homo sapiens
uggagggccuggaugauga

SEQ ID NO: 560837 - RNA, 19 nt, Homo sapiens
ugaagaugcucagguagug

SEQ ID NO: 560838 - RNA, 19 nt, Homo sapiens
uaaagaccucagcacaaua

SEQ ID NO: 560839 - RNA, 19 nt, Homo sapiens
ucaccucaaucgcaaacuu

SEQ ID NO: 560840 - RNA, 19 nt, Homo sapiens
ugacgaggaagaugaagaa

SEQ ID NO: 560841 - RNA, 19 nt, Homo sapiens
agagagagcgcgagagaug

SEQ ID NO: 560842 - RNA, 19 nt, Homo sapiens
ucacagaugaauuugaaga

SEQ ID NO: 560843 - RNA, 19 nt, Homo sapiens
gaagaugagggagaagaug

SEQ ID NO: 560844 - RNA, 19 nt, Homo sapiens
ugaagaagagcuuggugaa

SEQ ID NO: 560845 - RNA, 19 nt, Homo sapiens
gacgcccucugaugugaaa

SEQ ID NO: 560846 - RNA, 19 nt, Homo sapiens
ggaguaugaugaagaugcu

SEQ ID NO: 560847 - RNA, 19 nt, Homo sapiens
uagaaaaccucaagagcuu

SEQ ID NO: 560848 - RNA, 19 nt, Homo sapiens
ugaacuaagcgauaacaga

SEQ ID NO: 560849 - RNA, 19 nt, Homo sapiens
cagaugaauuugaagaacu

SEQ ID NO: 560850 - RNA, 19 nt, Homo sapiens
gacaacagucggucgaaug

SEQ ID NO: 560851 - RNA, 19 nt, Homo sapiens
aacgagaaccugaagauga

SEQ ID NO: 560852 - RNA, 19 nt, Homo sapiens
gaagaagagcuuggugaag

SEQ ID NO: 560853 - RNA, 19 nt, Homo sapiens
ggaagaugaagaagagcuu

SEQ ID NO: 560854 - RNA, 19 nt, Homo sapiens
gagaaaauguguucaagcu

SEQ ID NO: 560855 - RNA, 19 nt, Homo sapiens
ggaggaggaugaggaugag

SEQ ID NO: 560856 - RNA, 19 nt, Homo sapiens
gcuaugaccgggacgacaa

SEQ ID NO: 560857 - RNA, 19 nt, Homo sapiens
gaacgacuaccgagaaaau

SEQ ID NO: 560858 - RNA, 19 nt, Homo sapiens
guccgaaccucacgcaucu

SEQ ID NO: 560859 - RNA, 19 nt, Homo sapiens
cuuaagaagcuugaacuaa

SEQ ID NO: 560860 - RNA, 19 nt, Homo sapiens
caccucaaucgcaaacuua

SEQ ID NO: 560861 - RNA, 19 nt, Homo sapiens
cuggaauucuuaaguacaa

SEQ ID NO: 560862 - RNA, 19 nt, Homo sapiens
cugaacgacuaccgagaaa

SEQ ID NO: 560863 - RNA, 19 nt, Homo sapiens
gagcuuagaccuuuucaau

SEQ ID NO: 560864 - RNA, 19 nt, Homo sapiens
gcacaauagagccacugaa

SEQ ID NO: 560865 - RNA, 19 nt, Homo sapiens
agagcuuggugaagaagaa

SEQ ID NO: 560866 - RNA, 19 nt, Homo sapiens
ccucugaugugaaagaacu

SEQ ID NO: 560867 - RNA, 19 nt, Homo sapiens
uagaugacgaggaagauga

SEQ ID NO: 560868 - RNA, 19 nt, Homo sapiens
ggaugaagaagguuauaac

SEQ ID NO: 560869 - RNA, 19 nt, Homo sapiens
gaggaugaagaagguuaua

SEQ ID NO: 560870 - RNA, 19 nt, Homo sapiens
ggaggaugaagaagguuau

SEQ ID NO: 560871 - RNA, 19 nt, Homo sapiens
acaacagucggucgaauga

SEQ ID NO: 560872 - RNA, 19 nt, Homo sapiens
agagagagagcgcgagaga

SEQ ID NO: 560873 - RNA, 19 nt, Homo sapiens
aggaugaggaggaguauga

SEQ ID NO: 560874 - RNA, 19 nt, Homo sapiens
aaagaccucagcacaauag

SEQ ID NO: 560875 - RNA, 19 nt, Homo sapiens
ccgaaccucacgcaucuaa

SEQ ID NO: 560876 - RNA, 19 nt, Homo sapiens
acgagaaccugaagaugag

SEQ ID NO: 560877 - RNA, 19 nt, Homo sapiens
ggaggaggaaggugaagag

SEQ ID NO: 560878 - RNA, 19 nt, Homo sapiens
ugaauuugaagaacuggaa

SEQ ID NO: 560879 - RNA, 19 nt, Homo sapiens
agaugaauuugaagaacug

SEQ ID NO: 560880 - RNA, 19 nt, Homo sapiens
acaggacgcccucugaugu

SEQ ID NO: 560881 - RNA, 19 nt, Homo sapiens
gaggaggaguaugaugaag

SEQ ID NO: 560882 - RNA, 19 nt, Homo sapiens
gaaggccucacagaugaau

SEQ ID NO: 560883 - RNA, 19 nt, Homo sapiens
aagaugagggagaagauga

SEQ ID NO: 560884 - RNA, 19 nt, Homo sapiens
ugaggaggaguaugaugaa

SEQ ID NO: 560885 - RNA, 19 nt, Homo sapiens
ucccgcaacucacauaucu

SEQ ID NO: 560886 - RNA, 19 nt, Homo sapiens
ccugaacgacuaccgagaa

SEQ ID NO: 560887 - RNA, 19 nt, Homo sapiens
ggaauucuuaaguacaauc

SEQ ID NO: 560888 - RNA, 19 nt, Homo sapiens
ggagcugguugagccuuca

SEQ ID NO: 560889 - RNA, 19 nt, Homo sapiens
caaacucgaaggccucaca

SEQ ID NO: 560890 - RNA, 19 nt, Homo sapiens
gaugaggaggaguaugaug

SEQ ID NO: 560891 - RNA, 19 nt, Homo sapiens
gaauuugaagaacuggaau

SEQ ID NO: 560892 - RNA, 19 nt, Homo sapiens
gcccucugaugugaaagaa

SEQ ID NO: 560893 - RNA, 19 nt, Homo sapiens
cuggaaguauuggcagaaa

SEQ ID NO: 560894 - RNA, 19 nt, Homo sapiens
guucgggguuuauugauug

SEQ ID NO: 560895 - RNA, 19 nt, Homo sapiens
aacagucggucgaaugaag

SEQ ID NO: 560896 - RNA, 19 nt, Homo sapiens
gggguggaauaaaauacua

SEQ ID NO: 560897 - RNA, 19 nt, Homo sapiens
cacagaugaauuugaagaa

SEQ ID NO: 560898 - RNA, 19 nt, Homo sapiens
aaacgagaaccugaagaug

SEQ ID NO: 560899 - RNA, 19 nt, Homo sapiens
agaagguuauaacgaugga

SEQ ID NO: 560900 - RNA, 19 nt, Homo sapiens
gaugaagaagguuauaacg

SEQ ID NO: 560901 - RNA, 19 nt, Homo sapiens
uaauagagcugaaguugua

SEQ ID NO: 560902 - RNA, 19 nt, Homo sapiens
gagcugaaguuguaauaaa

SEQ ID NO: 560903 - RNA, 19 nt, Homo sapiens
gcaaacaaaucuaccucua

SEQ ID NO: 560904 - RNA, 19 nt, Homo sapiens
caacaaaguccacaucaaa

SEQ ID NO: 560905 - RNA, 19 nt, Homo sapiens
gauacuggcugaccaacaa

SEQ ID NO: 560906 - RNA, 19 nt, Homo sapiens
ucaacgagcuuauccugaa

SEQ ID NO: 560907 - RNA, 19 nt, Homo sapiens
ucaaguaccacuauuauga

SEQ ID NO: 560908 - RNA, 19 nt, Homo sapiens
ggaagcagauuuuaaaguu

SEQ ID NO: 560909 - RNA, 19 nt, Homo sapiens
gugaacagcuuacauagca

SEQ ID NO: 560910 - RNA, 19 nt, Homo sapiens
ccaccggccucuugaugua

SEQ ID NO: 560911 - RNA, 19 nt, Homo sapiens
gaacagcuuacauagcaaa

SEQ ID NO: 560912 - RNA, 19 nt, Homo sapiens
ccugaagccuggagauauu

SEQ ID NO: 560913 - RNA, 19 nt, Homo sapiens
ccaacaaaguccacaucaa

SEQ ID NO: 560914 - RNA, 19 nt, Homo sapiens
gcucaagacagaccuggua

SEQ ID NO: 560915 - RNA, 19 nt, Homo sapiens
gcccacagcuucgucauca

SEQ ID NO: 560916 - RNA, 19 nt, Homo sapiens
ggccacacguuucugcaaa

SEQ ID NO: 560917 - RNA, 19 nt, Homo sapiens
ccaugaaugugucccagaa

SEQ ID NO: 560918 - RNA, 19 nt, Homo sapiens
gaucgagacagcaccauga

SEQ ID NO: 560919 - RNA, 19 nt, Homo sapiens
acaaucagaucagcuguga

SEQ ID NO: 560920 - RNA, 19 nt, Homo sapiens
aagaagaaaucgggaauuc

SEQ ID NO: 560921 - RNA, 19 nt, Homo sapiens
gaagaagaaaucgggaauu

SEQ ID NO: 560922 - RNA, 19 nt, Homo sapiens
guggaucccugccuucaug

SEQ ID NO: 560923 - RNA, 19 nt, Homo sapiens
gaaagcaucaagcacaaca

SEQ ID NO: 560924 - RNA, 19 nt, Homo sapiens
ggaggcagagguacaauca

SEQ ID NO: 560925 - RNA, 19 nt, Homo sapiens
ugacagaaguaaugaaagc

SEQ ID NO: 560926 - RNA, 19 nt, Homo sapiens
cagcuuacauagcaaaucu

SEQ ID NO: 560927 - RNA, 19 nt, Homo sapiens
cgagacagcaccaugaaug

SEQ ID NO: 560928 - RNA, 19 nt, Homo sapiens
aggcagagguacaaucaga

SEQ ID NO: 560929 - RNA, 19 nt, Homo sapiens
guaaugaaagcaucaagca

SEQ ID NO: 560930 - RNA, 19 nt, Homo sapiens
ccagucaaguaccacuauu

SEQ ID NO: 560931 - RNA, 19 nt, Homo sapiens
guugacagaaguaaugaaa

SEQ ID NO: 560932 - RNA, 19 nt, Homo sapiens
gcuuacauagcaaaucuaa

SEQ ID NO: 560933 - RNA, 19 nt, Homo sapiens
gcugugggcaggagauuga

SEQ ID NO: 560934 - RNA, 19 nt, Homo sapiens
gaaccagaacccagucaag

SEQ ID NO: 560935 - RNA, 19 nt, Homo sapiens
caucuucgcagacaucuca

SEQ ID NO: 560936 - RNA, 19 nt, Homo sapiens
aauaagcacuuugggacuu

SEQ ID NO: 560937 - RNA, 19 nt, Homo sapiens
cagccagccucguccaaau

SEQ ID NO: 560938 - RNA, 19 nt, Homo sapiens
uaugacagccucaaguaug

SEQ ID NO: 560939 - RNA, 19 nt, Homo sapiens
cagucaaguaccacuauua

SEQ ID NO: 560940 - RNA, 19 nt, Homo sapiens
gcagagguacaaucagauc

SEQ ID NO: 560941 - RNA, 19 nt, Homo sapiens
caacgagcuuauccugaag

SEQ ID NO: 560942 - RNA, 19 nt, Homo sapiens
gagacagcaccaugaaugu

SEQ ID NO: 560943 - RNA, 19 nt, Homo sapiens
aauaaacggcuccucauca

SEQ ID NO: 560944 - RNA, 19 nt, Homo sapiens
guaauaaacggcuccucau

SEQ ID NO: 560945 - RNA, 19 nt, Homo sapiens
ccaugcccuuggaguuuaa

SEQ ID NO: 560946 - RNA, 19 nt, Homo sapiens
caaacaaaucuaccucuac

SEQ ID NO: 560947 - RNA, 19 nt, Homo sapiens
ucagagaucgaagaagaaa

SEQ ID NO: 560948 - RNA, 19 nt, Homo sapiens
gacagcaccaugaaugugu

SEQ ID NO: 560949 - RNA, 19 nt, Homo sapiens
gaagccuggagauauuauu

SEQ ID NO: 560950 - RNA, 19 nt, Homo sapiens
gaagcagauuuuaaaguuc

SEQ ID NO: 560951 - RNA, 19 nt, Homo sapiens
gaaguaaugaaagcaucaa

SEQ ID NO: 560952 - RNA, 19 nt, Homo sapiens
cgaagaagaaaucgggaau

SEQ ID NO: 560953 - RNA, 19 nt, Homo sapiens
uagagcugaaguuguaaua

SEQ ID NO: 560954 - RNA, 19 nt, Homo sapiens
accaugcccuuggaguuua

SEQ ID NO: 560955 - RNA, 19 nt, Homo sapiens
agagaucgaagaagaaauc

SEQ ID NO: 560956 - RNA, 19 nt, Homo sapiens
guuguugacagaaguaaug

SEQ ID NO: 560957 - RNA, 19 nt, Homo sapiens
uaccaugcccuuggaguuu

SEQ ID NO: 560958 - RNA, 19 nt, Homo sapiens
ccuuuccgcuggaucagaa

SEQ ID NO: 560959 - RNA, 19 nt, Homo sapiens
ucaacgugcgcacugcaua

SEQ ID NO: 560960 - RNA, 19 nt, Homo sapiens
cccaggacuucgccacuga

SEQ ID NO: 560961 - RNA, 19 nt, Homo sapiens
ucaggaagcagauuuuaaa

SEQ ID NO: 560962 - RNA, 19 nt, Homo sapiens
gaguuuaaggcccucaaga

SEQ ID NO: 560963 - RNA, 19 nt, Homo sapiens
ugaagaauaagcacuuugg

SEQ ID NO: 560964 - RNA, 19 nt, Homo sapiens
gaucaggaagcagauuuua

SEQ ID NO: 560965 - RNA, 19 nt, Homo sapiens
ccagaacccagucaaguac

SEQ ID NO: 560966 - RNA, 19 nt, Homo sapiens
uaauaaacggcuccucauc

SEQ ID NO: 560967 - RNA, 19 nt, Homo sapiens
caucaccagcuguuguuga

SEQ ID NO: 560968 - RNA, 19 nt, Homo sapiens
agucaaguaccacuauuau

SEQ ID NO: 560969 - RNA, 19 nt, Homo sapiens
accagaacccagucaagua

SEQ ID NO: 560970 - RNA, 19 nt, Homo sapiens
gaccaacaaaguccacauc

SEQ ID NO: 560971 - RNA, 19 nt, Homo sapiens
ccaaauggagacauaacca

SEQ ID NO: 560972 - RNA, 19 nt, Homo sapiens
acugaagaauaagcacuuu

SEQ ID NO: 560973 - RNA, 19 nt, Homo sapiens
gcaucaagcacaacaucca

SEQ ID NO: 560974 - RNA, 19 nt, Homo sapiens
gccuggagauauuauucau

SEQ ID NO: 560975 - RNA, 19 nt, Homo sapiens
cuaauagagcugaaguugu

SEQ ID NO: 560976 - RNA, 19 nt, Homo sapiens
augaaagcaucaagcacaa

SEQ ID NO: 560977 - RNA, 19 nt, Homo sapiens
gcucguggucuuccucauc

SEQ ID NO: 560978 - RNA, 19 nt, Homo sapiens
auuaugacagccucaagua

SEQ ID NO: 560979 - RNA, 19 nt, Homo sapiens
aaucagaucagcugugaac

SEQ ID NO: 560980 - RNA, 19 nt, Homo sapiens
guucuuggaugcugaaaag

SEQ ID NO: 560981 - RNA, 19 nt, Homo sapiens
ugaacagcuuacauagcaa

SEQ ID NO: 560982 - RNA, 19 nt, Homo sapiens
ggaagcaccuacuaugauu

SEQ ID NO: 560983 - RNA, 19 nt, Homo sapiens
ggacggcgauuccagguuu

SEQ ID NO: 560984 - RNA, 19 nt, Homo sapiens
gugauaaacugucugcaua

SEQ ID NO: 560985 - RNA, 19 nt, Homo sapiens
gcaauaagcugcuguucag

SEQ ID NO: 560986 - RNA, 19 nt, Homo sapiens
gcaaggccaucaucaucua

SEQ ID NO: 560987 - RNA, 19 nt, Homo sapiens
ggacaaagccagcaaaugc

SEQ ID NO: 560988 - RNA, 19 nt, Homo sapiens
ugaagaaugugcagaaaca

SEQ ID NO: 560989 - RNA, 19 nt, Homo sapiens
gauaaugugcgauuuguug

SEQ ID NO: 560990 - RNA, 19 nt, Homo sapiens
gaacugaagauugauaaug

SEQ ID NO: 560991 - RNA, 19 nt, Homo sapiens
ugggugagcuuccuauuga

SEQ ID NO: 560992 - RNA, 19 nt, Homo sapiens
gcagacccgucagugauaa

SEQ ID NO: 560993 - RNA, 19 nt, Homo sapiens
gcccgaagcuuagccugua

SEQ ID NO: 560994 - RNA, 19 nt, Homo sapiens
uggaggagauuauguacaa

SEQ ID NO: 560995 - RNA, 19 nt, Homo sapiens
gacauggguugaucaccua

SEQ ID NO: 560996 - RNA, 19 nt, Homo sapiens
gcucauagccaagcuguga

SEQ ID NO: 560997 - RNA, 19 nt, Homo sapiens
ccacugaaccagaggauga

SEQ ID NO: 560998 - RNA, 19 nt, Homo sapiens
gcaccuacuaugauucuuu

SEQ ID NO: 560999 - RNA, 19 nt, Homo sapiens
gcaaccaagucugaaaugu

SEQ ID NO: 561000 - RNA, 19 nt, Homo sapiens
cauaaccugucccgucgua

SEQ ID NO: 561001 - RNA, 19 nt, Homo sapiens
ccugggagcccgaagcuua

SEQ ID NO: 561002 - RNA, 19 nt, Homo sapiens
gcccaacgcccucagcuuu

SEQ ID NO: 561003 - RNA, 19 nt, Homo sapiens
gcgcagccauccucagugu

SEQ ID NO: 561004 - RNA, 19 nt, Homo sapiens
gcaguucucccaccaguuc

SEQ ID NO: 561005 - RNA, 19 nt, Homo sapiens
cagcucaucugguguacug

SEQ ID NO: 561006 - RNA, 19 nt, Homo sapiens
ccacgaggacccugucauu

SEQ ID NO: 561007 - RNA, 19 nt, Homo sapiens
gagggaagcaccuacuaug

SEQ ID NO: 561008 - RNA, 19 nt, Homo sapiens
aaccaagucugaaaugugu

SEQ ID NO: 561009 - RNA, 19 nt, Homo sapiens
auaagcugcuguucaggua

SEQ ID NO: 561010 - RNA, 19 nt, Homo sapiens
gauaaacugucugcauaac

SEQ ID NO: 561011 - RNA, 19 nt, Homo sapiens
guaagccgcguagcagaua

SEQ ID NO: 561012 - RNA, 19 nt, Homo sapiens
guuauucuggcaacaauuu

SEQ ID NO: 561013 - RNA, 19 nt, Homo sapiens
gagcagauacccucaacca

SEQ ID NO: 561014 - RNA, 19 nt, Homo sapiens
ucauccagcugcacaccua

SEQ ID NO: 561015 - RNA, 19 nt, Homo sapiens
ggaaaugaagguccucagu

SEQ ID NO: 561016 - RNA, 19 nt, Homo sapiens
gggaagcaccuacuaugau

SEQ ID NO: 561017 - RNA, 19 nt, Homo sapiens
ugacagccuuccauuugug

SEQ ID NO: 561018 - RNA, 19 nt, Homo sapiens
guaguucggcuucacauca

SEQ ID NO: 561019 - RNA, 19 nt, Homo sapiens
caaccaagucugaaaugug

SEQ ID NO: 561020 - RNA, 19 nt, Homo sapiens
agacccagcucauccagau

SEQ ID NO: 561021 - RNA, 19 nt, Homo sapiens
gggcaaggccaucaucauc

SEQ ID NO: 561022 - RNA, 19 nt, Homo sapiens
gauugauaaugugcgauuu

SEQ ID NO: 561023 - RNA, 19 nt, Homo sapiens
ucugacagccuuccauuug

SEQ ID NO: 561024 - RNA, 19 nt, Homo sapiens
uaaacugucugcauaaccu

SEQ ID NO: 561025 - RNA, 19 nt, Homo sapiens
ugauaaacugucugcauaa

SEQ ID NO: 561026 - RNA, 19 nt, Homo sapiens
ccacagaagccacaaacag

SEQ ID NO: 561027 - RNA, 19 nt, Homo sapiens
gaccugccguccguucuug

SEQ ID NO: 561028 - RNA, 19 nt, Homo sapiens
gaaugugcagaaacacuug

SEQ ID NO: 561029 - RNA, 19 nt, Homo sapiens
ccugaagaaugugcagaaa

SEQ ID NO: 561030 - RNA, 19 nt, Homo sapiens
uaugcggccuccagucuga

SEQ ID NO: 561031 - RNA, 19 nt, Homo sapiens
ggcaauaagcugcuguuca

SEQ ID NO: 561032 - RNA, 19 nt, Homo sapiens
ccaggcuccuucacuacuu

SEQ ID NO: 561033 - RNA, 19 nt, Homo sapiens
caacuccagcgcagagcua

SEQ ID NO: 561034 - RNA, 19 nt, Homo sapiens
ugagaacaacgucuacaug

SEQ ID NO: 561035 - RNA, 19 nt, Homo sapiens
ggccagggaccucaaggaa

SEQ ID NO: 561036 - RNA, 19 nt, Homo sapiens
caucacauccugcccaagu

SEQ ID NO: 561037 - RNA, 19 nt, Homo sapiens
ggcgagcacuaguggacaa

SEQ ID NO: 561038 - RNA, 19 nt, Homo sapiens
uggccacccugaagaaugu

SEQ ID NO: 561039 - RNA, 19 nt, Homo sapiens
gggcagaucuccaaaacag

SEQ ID NO: 561040 - RNA, 19 nt, Homo sapiens
gcccaguccucaccacagu

SEQ ID NO: 561041 - RNA, 19 nt, Homo sapiens
caugugggcugugcguuuc

SEQ ID NO: 561042 - RNA, 19 nt, Homo sapiens
uugccaggcuccuucacua

SEQ ID NO: 561043 - RNA, 19 nt, Homo sapiens
gaagagggaagcaccuacu

SEQ ID NO: 561044 - RNA, 19 nt, Homo sapiens
ucugaaauguguggccaaa

SEQ ID NO: 561045 - RNA, 19 nt, Homo sapiens
ggaccucaaggaagcuuau

SEQ ID NO: 561046 - RNA, 19 nt, Homo sapiens
gggcugugcguuucucaga

SEQ ID NO: 561047 - RNA, 19 nt, Homo sapiens
ccaugugggcugugcguuu

SEQ ID NO: 561048 - RNA, 19 nt, Homo sapiens
gcagccauccucaguguac

SEQ ID NO: 561049 - RNA, 19 nt, Homo sapiens
ggucuccuugucagaauuu

SEQ ID NO: 561050 - RNA, 19 nt, Homo sapiens
uacaugcugucucccaaug

SEQ ID NO: 561051 - RNA, 19 nt, Homo sapiens
cggcgucccagacaaguaa

SEQ ID NO: 561052 - RNA, 19 nt, Homo sapiens
ccaagccagucccuacucu

SEQ ID NO: 561053 - RNA, 19 nt, Homo sapiens
gcucccagcugcucaugcu

SEQ ID NO: 561054 - RNA, 19 nt, Homo sapiens
ucaucuacccgcuguguga

SEQ ID NO: 561055 - RNA, 19 nt, Homo sapiens
cauggcugauggaaaugaa

SEQ ID NO: 561056 - RNA, 19 nt, Homo sapiens
gagcacuaguggacaaagc

SEQ ID NO: 561057 - RNA, 19 nt, Homo sapiens
gggcgaccaugcugaugag

SEQ ID NO: 561058 - RNA, 19 nt, Homo sapiens
uaguucggcuucacaucaa

SEQ ID NO: 561059 - RNA, 19 nt, Homo sapiens
gaagcaccuacuaugauuc

SEQ ID NO: 561060 - RNA, 19 nt, Homo sapiens
ucaccacaguccacagaag

SEQ ID NO: 561061 - RNA, 19 nt, Homo sapiens
ugcagcagcuagcccaaga

SEQ ID NO: 561062 - RNA, 19 nt, Homo sapiens
gcguuccugugagcagaua

SEQ ID NO: 561063 - RNA, 19 nt, Homo sapiens
gccaccaccuggaggagau

SEQ ID NO: 561064 - RNA, 19 nt, Homo sapiens
gcaggagacccagcucauc

SEQ ID NO: 561065 - RNA, 19 nt, Homo sapiens
cugacagccuuccauuugu

SEQ ID NO: 561066 - RNA, 19 nt, Homo sapiens
cccacaagauccacuaugc

SEQ ID NO: 561067 - RNA, 19 nt, Homo sapiens
acaaguaagccgcguagca

SEQ ID NO: 561068 - RNA, 19 nt, Homo sapiens
acgcuucccuccaguccuu

SEQ ID NO: 561069 - RNA, 19 nt, Homo sapiens
caucgaacggagccugaaa

SEQ ID NO: 561070 - RNA, 19 nt, Homo sapiens
cgcagacccgucagugaua

SEQ ID NO: 561071 - RNA, 19 nt, Homo sapiens
agaaugugcagaaacacuu

SEQ ID NO: 561072 - RNA, 19 nt, Homo sapiens
caugcuguuugacaaguuc

SEQ ID NO: 561073 - RNA, 19 nt, Homo sapiens
accagaggaugacggagaa

SEQ ID NO: 561074 - RNA, 19 nt, Homo sapiens
uaaccugucccgucguauc

SEQ ID NO: 561075 - RNA, 19 nt, Homo sapiens
aaugugguguuugcacuga

SEQ ID NO: 561076 - RNA, 19 nt, Homo sapiens
aaaugcggcguuccuguga

SEQ ID NO: 561077 - RNA, 19 nt, Homo sapiens
caccuacuaugauucuuuu

SEQ ID NO: 561078 - RNA, 19 nt, Homo sapiens
gcucccacacugaugauuc

SEQ ID NO: 561079 - RNA, 19 nt, Homo sapiens
ugucaccugugcacaucuu

SEQ ID NO: 561080 - RNA, 19 nt, Homo sapiens
gacagccuuccauuuguga

SEQ ID NO: 561081 - RNA, 19 nt, Homo sapiens
ucaugcuguuugacaaguu

SEQ ID NO: 561082 - RNA, 19 nt, Homo sapiens
gaagauaccugauaagaga

SEQ ID NO: 561083 - RNA, 19 nt, Homo sapiens
ggagacaguucauuauuua

SEQ ID NO: 561084 - RNA, 19 nt, Homo sapiens
gaagggaacucaugucuga

SEQ ID NO: 561085 - RNA, 19 nt, Homo sapiens
caggauaggucuuaaauuu

SEQ ID NO: 561086 - RNA, 19 nt, Homo sapiens
gaacaggaauuucuucuag

SEQ ID NO: 561087 - RNA, 19 nt, Homo sapiens
gcugagaacuguauuggua

SEQ ID NO: 561088 - RNA, 19 nt, Homo sapiens
gcaauuaacaugcauauga

SEQ ID NO: 561089 - RNA, 19 nt, Homo sapiens
ggacaaagcaaccugauuu

SEQ ID NO: 561090 - RNA, 19 nt, Homo sapiens
gggaacagaugcugaauga

SEQ ID NO: 561091 - RNA, 19 nt, Homo sapiens
uaagaaagguccacaugaa

SEQ ID NO: 561092 - RNA, 19 nt, Homo sapiens
uuacuaugcuccaacauua

SEQ ID NO: 561093 - RNA, 19 nt, Homo sapiens
gggaauugcuaucauguaa

SEQ ID NO: 561094 - RNA, 19 nt, Homo sapiens
caaagaguguagcaauaua

SEQ ID NO: 561095 - RNA, 19 nt, Homo sapiens
agacauaacuucggaauug

SEQ ID NO: 561096 - RNA, 19 nt, Homo sapiens
gcaaauacauggacagcau

SEQ ID NO: 561097 - RNA, 19 nt, Homo sapiens
cagaauaccuggagacuca

SEQ ID NO: 561098 - RNA, 19 nt, Homo sapiens
ccaaggagacaguucauua

SEQ ID NO: 561099 - RNA, 19 nt, Homo sapiens
gaaccuggcaccacacuaa

SEQ ID NO: 561100 - RNA, 19 nt, Homo sapiens
gccagaagauaccugauaa

SEQ ID NO: 561101 - RNA, 19 nt, Homo sapiens
aaagguggaucuaucuuaa

SEQ ID NO: 561102 - RNA, 19 nt, Homo sapiens
guagcgagaugguaacuug

SEQ ID NO: 561103 - RNA, 19 nt, Homo sapiens
gauagcacaugauacagaa

SEQ ID NO: 561104 - RNA, 19 nt, Homo sapiens
gcuccaacauuaaucauga

SEQ ID NO: 561105 - RNA, 19 nt, Homo sapiens
gcuaagugccaaacuguua

SEQ ID NO: 561106 - RNA, 19 nt, Homo sapiens
gaagauacaauccaagaug

SEQ ID NO: 561107 - RNA, 19 nt, Homo sapiens
gcacagucauguaauucaa

SEQ ID NO: 561108 - RNA, 19 nt, Homo sapiens
gaaagaugcugugccuaug

SEQ ID NO: 561109 - RNA, 19 nt, Homo sapiens
uuauggagcuguaccuaua

SEQ ID NO: 561110 - RNA, 19 nt, Homo sapiens
aagagaagguguaagguuu

SEQ ID NO: 561111 - RNA, 19 nt, Homo sapiens
gaaauguccuguacagaac

SEQ ID NO: 561112 - RNA, 19 nt, Homo sapiens
cuuacaaacuugagcuuua

SEQ ID NO: 561113 - RNA, 19 nt, Homo sapiens
ggacagcauugccaccuau

SEQ ID NO: 561114 - RNA, 19 nt, Homo sapiens
gaacagaugcugaaugaac

SEQ ID NO: 561115 - RNA, 19 nt, Homo sapiens
gaagggauaucgguaaugg

SEQ ID NO: 561116 - RNA, 19 nt, Homo sapiens
gcgaaucuguguuaagaau

SEQ ID NO: 561117 - RNA, 19 nt, Homo sapiens
cauauaaccugucugaaag

SEQ ID NO: 561118 - RNA, 19 nt, Homo sapiens
gcacuuggaaggauauauu

SEQ ID NO: 561119 - RNA, 19 nt, Homo sapiens
gucaaagaguguagcaaua

SEQ ID NO: 561120 - RNA, 19 nt, Homo sapiens
ggauaucgguaaugguuau

SEQ ID NO: 561121 - RNA, 19 nt, Homo sapiens
gauugaacuugaagggaua

SEQ ID NO: 561122 - RNA, 19 nt, Homo sapiens
gaagcagcauuuugucuua

SEQ ID NO: 561123 - RNA, 19 nt, Homo sapiens
gaguaaaguuuggcuggua

SEQ ID NO: 561124 - RNA, 19 nt, Homo sapiens
guucuaccaugaugaguuu

SEQ ID NO: 561125 - RNA, 19 nt, Homo sapiens
ugauuuccauggaguguua

SEQ ID NO: 561126 - RNA, 19 nt, Homo sapiens
guacaucaggacaaaguua

SEQ ID NO: 561127 - RNA, 19 nt, Homo sapiens
gaaguauagggauguauuu

SEQ ID NO: 561128 - RNA, 19 nt, Homo sapiens
gaaagcacacaaagucuug

SEQ ID NO: 561129 - RNA, 19 nt, Homo sapiens
gcaaaucaacauauccaaa

SEQ ID NO: 561130 - RNA, 19 nt, Homo sapiens
gaugggaugcuguacauuu

SEQ ID NO: 561131 - RNA, 19 nt, Homo sapiens
caugaaggauguuauguca

SEQ ID NO: 561132 - RNA, 19 nt, Homo sapiens
guacauuaacucuccauuu

SEQ ID NO: 561133 - RNA, 19 nt, Homo sapiens
aaguuuggcugguagaaua

SEQ ID NO: 561134 - RNA, 19 nt, Homo sapiens
ucgcuucuguguugacuua

SEQ ID NO: 561135 - RNA, 19 nt, Homo sapiens
cuaguacucuguccuaaga

SEQ ID NO: 561136 - RNA, 19 nt, Homo sapiens
aaauguggcuguagauguu

SEQ ID NO: 561137 - RNA, 19 nt, Homo sapiens
ucagaaagaucggcugcua

SEQ ID NO: 561138 - RNA, 19 nt, Homo sapiens
gaaguuaaacguuggcaau

SEQ ID NO: 561139 - RNA, 19 nt, Homo sapiens
caacauuaaucaugacucu

SEQ ID NO: 561140 - RNA, 19 nt, Homo sapiens
ucauauaaccugucugaaa

SEQ ID NO: 561141 - RNA, 19 nt, Homo sapiens
gccaguuagucuccauuua

SEQ ID NO: 561142 - RNA, 19 nt, Homo sapiens
ccaagagcaccauaacaua

SEQ ID NO: 561143 - RNA, 19 nt, Homo sapiens
uacaggaugugcagccuua

SEQ ID NO: 561144 - RNA, 19 nt, Homo sapiens
gggcagaucaggcuaaaug

SEQ ID NO: 561145 - RNA, 19 nt, Homo sapiens
gcacaugauacagaaauaa

SEQ ID NO: 561146 - RNA, 19 nt, Homo sapiens
ugaaauguccuguacagaa

SEQ ID NO: 561147 - RNA, 19 nt, Homo sapiens
gagccaguauuuauguuau

SEQ ID NO: 561148 - RNA, 19 nt, Homo sapiens
gcaugugcccucucuauga

SEQ ID NO: 561149 - RNA, 19 nt, Homo sapiens
guuaaacguuggcaaugaa

SEQ ID NO: 561150 - RNA, 19 nt, Homo sapiens
gugccaaacuguuauuuua

SEQ ID NO: 561151 - RNA, 19 nt, Homo sapiens
aaacaucacuuacguucuc

SEQ ID NO: 561152 - RNA, 19 nt, Homo sapiens
caugugaacugaaagaagu

SEQ ID NO: 561153 - RNA, 19 nt, Homo sapiens
ggagccaguauuuauguua

SEQ ID NO: 561154 - RNA, 19 nt, Homo sapiens
uuaagcaugccgagaauua

SEQ ID NO: 561155 - RNA, 19 nt, Homo sapiens
uacgagaaauugucaaaga

SEQ ID NO: 561156 - RNA, 19 nt, Homo sapiens
ccagguguguguuggaauu

SEQ ID NO: 561157 - RNA, 19 nt, Homo sapiens
ggaaggaaauagcugaaaa

SEQ ID NO: 561158 - RNA, 19 nt, Homo sapiens
gaaucuguguuaagaaucu

SEQ ID NO: 561159 - RNA, 19 nt, Homo sapiens
agaaugcgaaucuguguua

SEQ ID NO: 561160 - RNA, 19 nt, Homo sapiens
uuacuacuguuuaggguuu

SEQ ID NO: 561161 - RNA, 19 nt, Homo sapiens
aggagacaguucauuauuu

SEQ ID NO: 561162 - RNA, 19 nt, Homo sapiens
gaacaguaccuuggcauuc

SEQ ID NO: 561163 - RNA, 19 nt, Homo sapiens
gcaaagaaaggaagauuuu

SEQ ID NO: 561164 - RNA, 19 nt, Homo sapiens
gauaagagaagguguaagg

SEQ ID NO: 561165 - RNA, 19 nt, Homo sapiens
caguuagucuccauuuauu

SEQ ID NO: 561166 - RNA, 19 nt, Homo sapiens
cuauggagcuguauguguu

SEQ ID NO: 561167 - RNA, 19 nt, Homo sapiens
auacguagcuuugguaaca

SEQ ID NO: 561168 - RNA, 19 nt, Homo sapiens
ucaguucauugacucuaua

SEQ ID NO: 561169 - RNA, 19 nt, Homo sapiens
ucuagaaacuuccuguaug

SEQ ID NO: 561170 - RNA, 19 nt, Homo sapiens
ccaguuaaauguggcugua

SEQ ID NO: 561171 - RNA, 19 nt, Homo sapiens
uauaggagccaguauuuau

SEQ ID NO: 561172 - RNA, 19 nt, Homo sapiens
acucuuagcucaggagaaa

SEQ ID NO: 561173 - RNA, 19 nt, Homo sapiens
gaaauugucaaagagugua

SEQ ID NO: 561174 - RNA, 19 nt, Homo sapiens
gaaagguccacaugaagga

SEQ ID NO: 561175 - RNA, 19 nt, Homo sapiens
cugcaugacuugguaaauu

SEQ ID NO: 561176 - RNA, 19 nt, Homo sapiens
gaauaaacuaccucaacuu

SEQ ID NO: 561177 - RNA, 19 nt, Homo sapiens
gaaugcgaaucuguguuaa

SEQ ID NO: 561178 - RNA, 19 nt, Homo sapiens
gcccucaugugaacugaaa

SEQ ID NO: 561179 - RNA, 19 nt, Homo sapiens
ucaguaaauugaugaguca

SEQ ID NO: 561180 - RNA, 19 nt, Homo sapiens
gugaguuccuccaguuaaa

SEQ ID NO: 561181 - RNA, 19 nt, Homo sapiens
ggaucaacuuauaagauug

SEQ ID NO: 561182 - RNA, 19 nt, Homo sapiens
gcuaacgucuuacuaauuu

SEQ ID NO: 561183 - RNA, 19 nt, Homo sapiens
ggacaugccucaaggauac

SEQ ID NO: 561184 - RNA, 19 nt, Homo sapiens
ggagaaaccugaugaacag

SEQ ID NO: 561185 - RNA, 19 nt, Homo sapiens
gcugggaccuucuuuauuc

SEQ ID NO: 561186 - RNA, 19 nt, Homo sapiens
gcagaggccaguuaaagua

SEQ ID NO: 561187 - RNA, 19 nt, Homo sapiens
aaacagagcuacugagacu

SEQ ID NO: 561188 - RNA, 19 nt, Homo sapiens
gcagggccauccacuguga

SEQ ID NO: 561189 - RNA, 19 nt, Homo sapiens
gcaaacagagcuacugaga

SEQ ID NO: 561190 - RNA, 19 nt, Homo sapiens
gaacauugugcuggcauua

SEQ ID NO: 561191 - RNA, 19 nt, Homo sapiens
gcacgacgucagccucuua

SEQ ID NO: 561192 - RNA, 19 nt, Homo sapiens
gguaggguguucuggcuuu

SEQ ID NO: 561193 - RNA, 19 nt, Homo sapiens
caacuugacaccacuaaga

SEQ ID NO: 561194 - RNA, 19 nt, Homo sapiens
gcaccaccaucuccaaauc

SEQ ID NO: 561195 - RNA, 19 nt, Homo sapiens
ugaccaaccuggccuacuu

SEQ ID NO: 561196 - RNA, 19 nt, Homo sapiens
acauugugcuggcauuaua

SEQ ID NO: 561197 - RNA, 19 nt, Homo sapiens
gaaacacucaaucauccua

SEQ ID NO: 561198 - RNA, 19 nt, Homo sapiens
gacacccucugccgaguaa

SEQ ID NO: 561199 - RNA, 19 nt, Homo sapiens
ggugauguguccaaucuag

SEQ ID NO: 561200 - RNA, 19 nt, Homo sapiens
ggaacauugugcuggcauu

SEQ ID NO: 561201 - RNA, 19 nt, Homo sapiens
gaggauggaauuacuugaa

SEQ ID NO: 561202 - RNA, 19 nt, Homo sapiens
ggcaccauguuuauuuauu

SEQ ID NO: 561203 - RNA, 19 nt, Homo sapiens
gugcuaacgucuuacuaau

SEQ ID NO: 561204 - RNA, 19 nt, Homo sapiens
ugacaccacuaagaugauu

SEQ ID NO: 561205 - RNA, 19 nt, Homo sapiens
ccacgaccguccuguguca

SEQ ID NO: 561206 - RNA, 19 nt, Homo sapiens
ggcaucggcuucaccauca

SEQ ID NO: 561207 - RNA, 19 nt, Homo sapiens
ucccuucccuccuuuguuu

SEQ ID NO: 561208 - RNA, 19 nt, Homo sapiens
aaagaaacacucaaucauc

SEQ ID NO: 561209 - RNA, 19 nt, Homo sapiens
gcagguggacugacugugu

SEQ ID NO: 561210 - RNA, 19 nt, Homo sapiens
gcaggcagguggacugacu

SEQ ID NO: 561211 - RNA, 19 nt, Homo sapiens
ccucuuggcuauuucuguu

SEQ ID NO: 561212 - RNA, 19 nt, Homo sapiens
gaagggugauguguccaau

SEQ ID NO: 561213 - RNA, 19 nt, Homo sapiens
ggacacccucugccgagua

SEQ ID NO: 561214 - RNA, 19 nt, Homo sapiens
ucucuuggcugcaaauaag

SEQ ID NO: 561215 - RNA, 19 nt, Homo sapiens
aaccaacccugugggcuua

SEQ ID NO: 561216 - RNA, 19 nt, Homo sapiens
ggacagcugcccagacaca

SEQ ID NO: 561217 - RNA, 19 nt, Homo sapiens
ucggcaccauguuuauuua

SEQ ID NO: 561218 - RNA, 19 nt, Homo sapiens
guccuucagucuucuagaa

SEQ ID NO: 561219 - RNA, 19 nt, Homo sapiens
gcugucggcaccauguuua

SEQ ID NO: 561220 - RNA, 19 nt, Homo sapiens
ggaggcaguggacaucgua

SEQ ID NO: 561221 - RNA, 19 nt, Homo sapiens
guccgucucucuugcuuga

SEQ ID NO: 561222 - RNA, 19 nt, Homo sapiens
ccuccuuuguuuacuuaua

SEQ ID NO: 561223 - RNA, 19 nt, Homo sapiens
aguggaggcugcugugaaa

SEQ ID NO: 561224 - RNA, 19 nt, Homo sapiens
ggacaucuucuccgucauc

SEQ ID NO: 561225 - RNA, 19 nt, Homo sapiens
gcaggggacugucucagaa

SEQ ID NO: 561226 - RNA, 19 nt, Homo sapiens
gccagcgucuguuguggaa

SEQ ID NO: 561227 - RNA, 19 nt, Homo sapiens
cagguggacugacuguguu

SEQ ID NO: 561228 - RNA, 19 nt, Homo sapiens
gggcaaacagagcuacuga

SEQ ID NO: 561229 - RNA, 19 nt, Homo sapiens
uuacuugaauuucgucaca

SEQ ID NO: 561230 - RNA, 19 nt, Homo sapiens
gaggaaugaagaccuuuau

SEQ ID NO: 561231 - RNA, 19 nt, Homo sapiens
gucaaugggucccuguuca

SEQ ID NO: 561232 - RNA, 19 nt, Homo sapiens
gugcauugcugugugaauc

SEQ ID NO: 561233 - RNA, 19 nt, Homo sapiens
gcgcagaggccaguuaaag

SEQ ID NO: 561234 - RNA, 19 nt, Homo sapiens
ucacagaggaaaugaucaa

SEQ ID NO: 561235 - RNA, 19 nt, Homo sapiens
gaacaucacgcugcucaac

SEQ ID NO: 561236 - RNA, 19 nt, Homo sapiens
gaacugcuacagcgugaag

SEQ ID NO: 561237 - RNA, 19 nt, Homo sapiens
ugaggaaugaagaccuuua

SEQ ID NO: 561238 - RNA, 19 nt, Homo sapiens
gcccuguccuucagucuuc

SEQ ID NO: 561239 - RNA, 19 nt, Homo sapiens
aaucucaucccucaacuga

SEQ ID NO: 561240 - RNA, 19 nt, Homo sapiens
gaauuucgucacagaggaa

SEQ ID NO: 561241 - RNA, 19 nt, Homo sapiens
gaccuucuuuauucugugu

SEQ ID NO: 561242 - RNA, 19 nt, Homo sapiens
uagaaacagagacaagaaa

SEQ ID NO: 561243 - RNA, 19 nt, Homo sapiens
acaaagcccuguccuucag

SEQ ID NO: 561244 - RNA, 19 nt, Homo sapiens
ggcuauuucuguuccaguu

SEQ ID NO: 561245 - RNA, 19 nt, Homo sapiens
ccugugggcuuaugucucu

SEQ ID NO: 561246 - RNA, 19 nt, Homo sapiens
gacgucagccucuuaccuu

SEQ ID NO: 561247 - RNA, 19 nt, Homo sapiens
gacaagaaaggcagacaca

SEQ ID NO: 561248 - RNA, 19 nt, Homo sapiens
gaaacagagacaagaaagg

SEQ ID NO: 561249 - RNA, 19 nt, Homo sapiens
gagcuacugagacuuggaa

SEQ ID NO: 561250 - RNA, 19 nt, Homo sapiens
ugaaaacucugguacgaau

SEQ ID NO: 561251 - RNA, 19 nt, Homo sapiens
ggaagggugauguguccaa

SEQ ID NO: 561252 - RNA, 19 nt, Homo sapiens
cagcgucuguuguggaaag

SEQ ID NO: 561253 - RNA, 19 nt, Homo sapiens
gggaccuucuuuauucugu

SEQ ID NO: 561254 - RNA, 19 nt, Homo sapiens
ucacagcgucugcucauag

SEQ ID NO: 561255 - RNA, 19 nt, Homo sapiens
ggacucaggaccagauguc

SEQ ID NO: 561256 - RNA, 19 nt, Homo sapiens
cggagaaaccugaugaaca

SEQ ID NO: 561257 - RNA, 19 nt, Homo sapiens
gaggcugaguucugguuca

SEQ ID NO: 561258 - RNA, 19 nt, Homo sapiens
ucccuccuuuguuuacuua

SEQ ID NO: 561259 - RNA, 19 nt, Homo sapiens
gaggccaguuaaaguagau

SEQ ID NO: 561260 - RNA, 19 nt, Homo sapiens
ccuucuuuauucuguguua

SEQ ID NO: 561261 - RNA, 19 nt, Homo sapiens
ccagauguccgucucucuu

SEQ ID NO: 561262 - RNA, 19 nt, Homo sapiens
cuagaaacagagacaagaa

SEQ ID NO: 561263 - RNA, 19 nt, Homo sapiens
acagagcuacugagacuug

SEQ ID NO: 561264 - RNA, 19 nt, Homo sapiens
gguccagucugugauccuu

SEQ ID NO: 561265 - RNA, 19 nt, Homo sapiens
gcuuaugucucugccuuag

SEQ ID NO: 561266 - RNA, 19 nt, Homo sapiens
ccuacaugcuggaggucua

SEQ ID NO: 561267 - RNA, 19 nt, Homo sapiens
aggauggaauuacuugaau

SEQ ID NO: 561268 - RNA, 19 nt, Homo sapiens
gucggcaccauguuuauuu

SEQ ID NO: 561269 - RNA, 19 nt, Homo sapiens
cuugugggcuucagguguu

SEQ ID NO: 561270 - RNA, 19 nt, Homo sapiens
acacugcgcaggucucuuc

SEQ ID NO: 561271 - RNA, 19 nt, Homo sapiens
uguggccucuuggcuauuu

SEQ ID NO: 561272 - RNA, 19 nt, Homo sapiens
caacuucuucagcuucuuc

SEQ ID NO: 561273 - RNA, 19 nt, Homo sapiens
gcuugugacauucgugaaa

SEQ ID NO: 561274 - RNA, 19 nt, Homo sapiens
cauccuggccugccucuuc

SEQ ID NO: 561275 - RNA, 19 nt, Homo sapiens
ggcgucauguccuggauca

SEQ ID NO: 561276 - RNA, 19 nt, Homo sapiens
ugugcuaacgucuuacuaa

SEQ ID NO: 561277 - RNA, 19 nt, Homo sapiens
acacuccacugacaaacgu

SEQ ID NO: 561278 - RNA, 19 nt, Homo sapiens
cgcaagcucucagcaagug

SEQ ID NO: 561279 - RNA, 19 nt, Homo sapiens
ucagucuucuagaaacaga

SEQ ID NO: 561280 - RNA, 19 nt, Homo sapiens
gcccggagaaaccugauga

SEQ ID NO: 561281 - RNA, 19 nt, Homo sapiens
cgaccguccugugucagaa

SEQ ID NO: 561282 - RNA, 19 nt, Homo sapiens
gaacuuugcucgaaggaau

SEQ ID NO: 561283 - RNA, 19 nt, Homo sapiens
agaaaugucuguugagauu

SEQ ID NO: 561284 - RNA, 19 nt, Homo sapiens
ggacaaaguuauucacagu

SEQ ID NO: 561285 - RNA, 19 nt, Homo sapiens
gaagaaacgacuacagaaa

SEQ ID NO: 561286 - RNA, 19 nt, Homo sapiens
uagaagaccugaauucaug

SEQ ID NO: 561287 - RNA, 19 nt, Homo sapiens
caauaaaggcugcuuguuu

SEQ ID NO: 561288 - RNA, 19 nt, Homo sapiens
gcaaaguuauucuaccuau

SEQ ID NO: 561289 - RNA, 19 nt, Homo sapiens
ggagcuaaaugcguuguaa

SEQ ID NO: 561290 - RNA, 19 nt, Homo sapiens
gaugagcagucaaauuaug

SEQ ID NO: 561291 - RNA, 19 nt, Homo sapiens
gcaacagugucauuugaug

SEQ ID NO: 561292 - RNA, 19 nt, Homo sapiens
cagaacagaugcugauuca

SEQ ID NO: 561293 - RNA, 19 nt, Homo sapiens
guagugaaauuaagugaca

SEQ ID NO: 561294 - RNA, 19 nt, Homo sapiens
caaauaagaagaccggaaa

SEQ ID NO: 561295 - RNA, 19 nt, Homo sapiens
gauaacaacacaaucuuug

SEQ ID NO: 561296 - RNA, 19 nt, Homo sapiens
ggacaagcaucacaaagcu

SEQ ID NO: 561297 - RNA, 19 nt, Homo sapiens
ggaagaaacgacuacagaa

SEQ ID NO: 561298 - RNA, 19 nt, Homo sapiens
gauggaagagguccuauga

SEQ ID NO: 561299 - RNA, 19 nt, Homo sapiens
ggacagaggaggcggcuau

SEQ ID NO: 561300 - RNA, 19 nt, Homo sapiens
caugauccauagugaaauu

SEQ ID NO: 561301 - RNA, 19 nt, Homo sapiens
gacaugauccauagugaaa

SEQ ID NO: 561302 - RNA, 19 nt, Homo sapiens
caaccgaccauacugauga

SEQ ID NO: 561303 - RNA, 19 nt, Homo sapiens
augaugagcagucaaauua

SEQ ID NO: 561304 - RNA, 19 nt, Homo sapiens
agaaacgacuacagaaaug

SEQ ID NO: 561305 - RNA, 19 nt, Homo sapiens
gccauugacugguuugaug

SEQ ID NO: 561306 - RNA, 19 nt, Homo sapiens
acaaagcuauucuggcuau

SEQ ID NO: 561307 - RNA, 19 nt, Homo sapiens
gggauuggguuugcccuaa

SEQ ID NO: 561308 - RNA, 19 nt, Homo sapiens
caagaugaccgucgugaug

SEQ ID NO: 561309 - RNA, 19 nt, Homo sapiens
aaacgacugauuccucuua

SEQ ID NO: 561310 - RNA, 19 nt, Homo sapiens
caugauuccuauagucaaa

SEQ ID NO: 561311 - RNA, 19 nt, Homo sapiens
gccagcaaccauauaauaa

SEQ ID NO: 561312 - RNA, 19 nt, Homo sapiens
ccaguuauggacaaaguua

SEQ ID NO: 561313 - RNA, 19 nt, Homo sapiens
aauaugaacuuugcucgaa

SEQ ID NO: 561314 - RNA, 19 nt, Homo sapiens
uggaagagguccuaugaca

SEQ ID NO: 561315 - RNA, 19 nt, Homo sapiens
gcaguccuaucauucacaa

SEQ ID NO: 561316 - RNA, 19 nt, Homo sapiens
gagcagcaaaguuauucua

SEQ ID NO: 561317 - RNA, 19 nt, Homo sapiens
gcggaaauaugaacuuugc

SEQ ID NO: 561318 - RNA, 19 nt, Homo sapiens
ugaccgcgguggcuucaaa

SEQ ID NO: 561319 - RNA, 19 nt, Homo sapiens
ccgccuggcuuucguauuc

SEQ ID NO: 561320 - RNA, 19 nt, Homo sapiens
cuagaaaugucuguugaga

SEQ ID NO: 561321 - RNA, 19 nt, Homo sapiens
gaaacgacuacagaaauga

SEQ ID NO: 561322 - RNA, 19 nt, Homo sapiens
gggagggugugucuacaga

SEQ ID NO: 561323 - RNA, 19 nt, Homo sapiens
gcgaggccguggaggauau

SEQ ID NO: 561324 - RNA, 19 nt, Homo sapiens
caacaucaaggcucauaug

SEQ ID NO: 561325 - RNA, 19 nt, Homo sapiens
aauaaaggcugcuuguuuu

SEQ ID NO: 561326 - RNA, 19 nt, Homo sapiens
gaggagaucgaggagguua

SEQ ID NO: 561327 - RNA, 19 nt, Homo sapiens
gaggagaucgaggagguua

SEQ ID NO: 561328 - RNA, 19 nt, Homo sapiens
gcagucaggcuaugaucaa

SEQ ID NO: 561329 - RNA, 19 nt, Homo sapiens
ccaaggcuauggacaagca

SEQ ID NO: 561330 - RNA, 19 nt, Homo sapiens
ggaggcaacagugucauuu

SEQ ID NO: 561331 - RNA, 19 nt, Homo sapiens
caaaguuauucuaccuaug

SEQ ID NO: 561332 - RNA, 19 nt, Homo sapiens
gcagucaaauuaugaucag

SEQ ID NO: 561333 - RNA, 19 nt, Homo sapiens
gagcucauauagccagcaa

SEQ ID NO: 561334 - RNA, 19 nt, Homo sapiens
cuucuuggguagugaaauu

SEQ ID NO: 561335 - RNA, 19 nt, Homo sapiens
agaccgagguggaggcuau

SEQ ID NO: 561336 - RNA, 19 nt, Homo sapiens
aggcaacagugucauuuga

SEQ ID NO: 561337 - RNA, 19 nt, Homo sapiens
gagggugugucuacagauc

SEQ ID NO: 561338 - RNA, 19 nt, Homo sapiens
ucaacaagauucauaugac

SEQ ID NO: 561339 - RNA, 19 nt, Homo sapiens
gccagacuauggucaacaa

SEQ ID NO: 561340 - RNA, 19 nt, Homo sapiens
cauauagccagcaaccaua

SEQ ID NO: 561341 - RNA, 19 nt, Homo sapiens
gcaauaaaggcugcuuguu

SEQ ID NO: 561342 - RNA, 19 nt, Homo sapiens
cgaccauacugaugacugu

SEQ ID NO: 561343 - RNA, 19 nt, Homo sapiens
ccgaggagguggcuaugga

SEQ ID NO: 561344 - RNA, 19 nt, Homo sapiens
ggauuggguuugcccuaau

SEQ ID NO: 561345 - RNA, 19 nt, Homo sapiens
gcagcaugauuccuauagu

SEQ ID NO: 561346 - RNA, 19 nt, Homo sapiens
agacuauggucaacaagau

SEQ ID NO: 561347 - RNA, 19 nt, Homo sapiens
gagcuaaaugcguuguaaa

SEQ ID NO: 561348 - RNA, 19 nt, Homo sapiens
ucucugacaugauccauag

SEQ ID NO: 561349 - RNA, 19 nt, Homo sapiens
cagcaugauuccuauaguc

SEQ ID NO: 561350 - RNA, 19 nt, Homo sapiens
cauaugaugagcagucaaa

SEQ ID NO: 561351 - RNA, 19 nt, Homo sapiens
agaccgagguggcuaugga

SEQ ID NO: 561352 - RNA, 19 nt, Homo sapiens
gcuaugggcaaacgacuga

SEQ ID NO: 561353 - RNA, 19 nt, Homo sapiens
cagcuaaggcagccauuga

SEQ ID NO: 561354 - RNA, 19 nt, Homo sapiens
aaccagcaguccuaucauu

SEQ ID NO: 561355 - RNA, 19 nt, Homo sapiens
agaauuccauggcaacauc

SEQ ID NO: 561356 - RNA, 19 nt, Homo sapiens
ggggugagcagcaaaguua

SEQ ID NO: 561357 - RNA, 19 nt, Homo sapiens
agaccgaaguggaggcuau

SEQ ID NO: 561358 - RNA, 19 nt, Homo sapiens
ggcaacaucauuaaagugu

SEQ ID NO: 561359 - RNA, 19 nt, Homo sapiens
gggaguucuuuaaacaaau

SEQ ID NO: 561360 - RNA, 19 nt, Homo sapiens
aagaaacgacuacagaaau

SEQ ID NO: 561361 - RNA, 19 nt, Homo sapiens
caaaagcagagcucauaua

SEQ ID NO: 561362 - RNA, 19 nt, Homo sapiens
gcgcaaccgaccauacuga

SEQ ID NO: 561363 - RNA, 19 nt, Homo sapiens
ggagaucgaggagguuaug

SEQ ID NO: 561364 - RNA, 19 nt, Homo sapiens
ggggaguucuuuaaacaaa

SEQ ID NO: 561365 - RNA, 19 nt, Homo sapiens
cgacugauuccucuuaugg

SEQ ID NO: 561366 - RNA, 19 nt, Homo sapiens
gucaacaagauucauauga

SEQ ID NO: 561367 - RNA, 19 nt, Homo sapiens
cagcaaaguuauucuaccu

SEQ ID NO: 561368 - RNA, 19 nt, Homo sapiens
guuauucuaccuauggaaa

SEQ ID NO: 561369 - RNA, 19 nt, Homo sapiens
agccagcaaccauauaaua

SEQ ID NO: 561370 - RNA, 19 nt, Homo sapiens
gaggcaacagugucauuug

SEQ ID NO: 561371 - RNA, 19 nt, Homo sapiens
ggugagcagcaaaguuauu

SEQ ID NO: 561372 - RNA, 19 nt, Homo sapiens
gaccagcagucaggcuaug

SEQ ID NO: 561373 - RNA, 19 nt, Homo sapiens
ccuaugaccagccagacua

SEQ ID NO: 561374 - RNA, 19 nt, Homo sapiens
ucacaguccuauggugguu

SEQ ID NO: 561375 - RNA, 19 nt, Homo sapiens
caggagugguggcggcuau

SEQ ID NO: 561376 - RNA, 19 nt, Homo sapiens
cagaggaggcggcuaugga

SEQ ID NO: 561377 - RNA, 19 nt, Homo sapiens
uagaggucguggaggcuuu

SEQ ID NO: 561378 - RNA, 19 nt, Homo sapiens
gucgugaugugaguaggua

SEQ ID NO: 561379 - RNA, 19 nt, Homo sapiens
aaaguuauucuaccuaugg

SEQ ID NO: 561380 - RNA, 19 nt, Homo sapiens
ucagcagcaugauuccuau

SEQ ID NO: 561381 - RNA, 19 nt, Homo sapiens
uaugaugagcagucaaauu

SEQ ID NO: 561382 - RNA, 19 nt, Homo sapiens
gaacuuugcucgaaggaau

SEQ ID NO: 561383 - RNA, 19 nt, Homo sapiens
agaaaugucuguugagauu

SEQ ID NO: 561384 - RNA, 19 nt, Homo sapiens
gaagaaacgacuacagaaa

SEQ ID NO: 561385 - RNA, 19 nt, Homo sapiens
uagaagaccugaauucaug

SEQ ID NO: 561386 - RNA, 19 nt, Homo sapiens
caauaaaggcugcuuguuu

SEQ ID NO: 561387 - RNA, 19 nt, Homo sapiens
gcaaaguuauucuaccuau

SEQ ID NO: 561388 - RNA, 19 nt, Homo sapiens
ggagcuaaaugcguuguaa

SEQ ID NO: 561389 - RNA, 19 nt, Homo sapiens
gaugagcagucaaauuaug

SEQ ID NO: 561390 - RNA, 19 nt, Homo sapiens
gcaacagugucauuugaug

SEQ ID NO: 561391 - RNA, 19 nt, Homo sapiens
cagaacagaugcugauuca

SEQ ID NO: 561392 - RNA, 19 nt, Homo sapiens
guagugaaauuaagugaca

SEQ ID NO: 561393 - RNA, 19 nt, Homo sapiens
gacaaagucagucagguua

SEQ ID NO: 561394 - RNA, 19 nt, Homo sapiens
caaauaagaagaccggaaa

SEQ ID NO: 561395 - RNA, 19 nt, Homo sapiens
gauaacaacacaaucuuug

SEQ ID NO: 561396 - RNA, 19 nt, Homo sapiens
caaagucagucagguuauu

SEQ ID NO: 561397 - RNA, 19 nt, Homo sapiens
ggacaaagucagucagguu

SEQ ID NO: 561398 - RNA, 19 nt, Homo sapiens
ggacaagcaucacaaagcu

SEQ ID NO: 561399 - RNA, 19 nt, Homo sapiens
ggaagaaacgacuacagaa

SEQ ID NO: 561400 - RNA, 19 nt, Homo sapiens
gauggaagagguccuauga

SEQ ID NO: 561401 - RNA, 19 nt, Homo sapiens
ggacagaggaggcggcuau

SEQ ID NO: 561402 - RNA, 19 nt, Homo sapiens
caugauccauagugaaauu

SEQ ID NO: 561403 - RNA, 19 nt, Homo sapiens
gacaugauccauagugaaa

SEQ ID NO: 561404 - RNA, 19 nt, Homo sapiens
caaccgaccauacugauga

SEQ ID NO: 561405 - RNA, 19 nt, Homo sapiens
augaugagcagucaaauua

SEQ ID NO: 561406 - RNA, 19 nt, Homo sapiens
agaaacgacuacagaaaug

SEQ ID NO: 561407 - RNA, 19 nt, Homo sapiens
gccauugacugguuugaug

SEQ ID NO: 561408 - RNA, 19 nt, Homo sapiens
acaaagcuauucuggcuau

SEQ ID NO: 561409 - RNA, 19 nt, Homo sapiens
gggauuggguuugcccuaa

SEQ ID NO: 561410 - RNA, 19 nt, Homo sapiens
caagaugaccgucgugaug

SEQ ID NO: 561411 - RNA, 19 nt, Homo sapiens
aaacgacugauuccucuua

SEQ ID NO: 561412 - RNA, 19 nt, Homo sapiens
caugauuccuauagucaaa

SEQ ID NO: 561413 - RNA, 19 nt, Homo sapiens
gccagcaaccauauaauaa

SEQ ID NO: 561414 - RNA, 19 nt, Homo sapiens
aauaugaacuuugcucgaa

SEQ ID NO: 561415 - RNA, 19 nt, Homo sapiens
gagcagcaaaguuauucua

SEQ ID NO: 561416 - RNA, 19 nt, Homo sapiens
uggaagagguccuaugaca

SEQ ID NO: 561417 - RNA, 19 nt, Homo sapiens
gcaguccuaucauucacaa

SEQ ID NO: 561418 - RNA, 19 nt, Homo sapiens
gcggaaauaugaacuuugc

SEQ ID NO: 561419 - RNA, 19 nt, Homo sapiens
ugaccgcgguggcuucaaa

SEQ ID NO: 561420 - RNA, 19 nt, Homo sapiens
ccgccuggcuuucguauuc

SEQ ID NO: 561421 - RNA, 19 nt, Homo sapiens
cuagaaaugucuguugaga

SEQ ID NO: 561422 - RNA, 19 nt, Homo sapiens
gaaacgacuacagaaauga

SEQ ID NO: 561423 - RNA, 19 nt, Homo sapiens
gggagggugugucuacaga

SEQ ID NO: 561424 - RNA, 19 nt, Homo sapiens
gcgaggccguggaggauau

SEQ ID NO: 561425 - RNA, 19 nt, Homo sapiens
caacaucaaggcucauaug

SEQ ID NO: 561426 - RNA, 19 nt, Homo sapiens
aauaaaggcugcuuguuuu

SEQ ID NO: 561427 - RNA, 19 nt, Homo sapiens
gaggagaucgaggagguua

SEQ ID NO: 561428 - RNA, 19 nt, Homo sapiens
gaggagaucgaggagguua

SEQ ID NO: 561429 - RNA, 19 nt, Homo sapiens
gcagucaggcuaugaucaa

SEQ ID NO: 561430 - RNA, 19 nt, Homo sapiens
ccaaggcuauggacaagca

SEQ ID NO: 561431 - RNA, 19 nt, Homo sapiens
caaaguuauucuaccuaug

SEQ ID NO: 561432 - RNA, 19 nt, Homo sapiens
ggaggcaacagugucauuu

SEQ ID NO: 561433 - RNA, 19 nt, Homo sapiens
gcagucaaauuaugaucag

SEQ ID NO: 561434 - RNA, 19 nt, Homo sapiens
gagcucauauagccagcaa

SEQ ID NO: 561435 - RNA, 19 nt, Homo sapiens
cuucuuggguagugaaauu

SEQ ID NO: 561436 - RNA, 19 nt, Homo sapiens
agaccgagguggaggcuau

SEQ ID NO: 561437 - RNA, 19 nt, Homo sapiens
aggcaacagugucauuuga

SEQ ID NO: 561438 - RNA, 19 nt, Homo sapiens
gagggugugucuacagauc

SEQ ID NO: 561439 - RNA, 19 nt, Homo sapiens
ucaacaagauucauaugac

SEQ ID NO: 561440 - RNA, 19 nt, Homo sapiens
gccagacuauggucaacaa

SEQ ID NO: 561441 - RNA, 19 nt, Homo sapiens
cauauagccagcaaccaua

SEQ ID NO: 561442 - RNA, 19 nt, Homo sapiens
gcaauaaaggcugcuuguu

SEQ ID NO: 561443 - RNA, 19 nt, Homo sapiens
cgaccauacugaugacugu

SEQ ID NO: 561444 - RNA, 19 nt, Homo sapiens
ccgaggagguggcuaugga

SEQ ID NO: 561445 - RNA, 19 nt, Homo sapiens
ggauuggguuugcccuaau

SEQ ID NO: 561446 - RNA, 19 nt, Homo sapiens
gcagcaugauuccuauagu

SEQ ID NO: 561447 - RNA, 19 nt, Homo sapiens
agacuauggucaacaagau

SEQ ID NO: 561448 - RNA, 19 nt, Homo sapiens
gagcuaaaugcguuguaaa

SEQ ID NO: 561449 - RNA, 19 nt, Homo sapiens
ucucugacaugauccauag

SEQ ID NO: 561450 - RNA, 19 nt, Homo sapiens
cagcaugauuccuauaguc

SEQ ID NO: 561451 - RNA, 19 nt, Homo sapiens
cauaugaugagcagucaaa

SEQ ID NO: 561452 - RNA, 19 nt, Homo sapiens
agaccgagguggcuaugga

SEQ ID NO: 561453 - RNA, 19 nt, Homo sapiens
gcuaugggcaaacgacuga

SEQ ID NO: 561454 - RNA, 19 nt, Homo sapiens
cagcuaaggcagccauuga

SEQ ID NO: 561455 - RNA, 19 nt, Homo sapiens
aaccagcaguccuaucauu

SEQ ID NO: 561456 - RNA, 19 nt, Homo sapiens
agaauuccauggcaacauc

SEQ ID NO: 561457 - RNA, 19 nt, Homo sapiens
ggggugagcagcaaaguua

SEQ ID NO: 561458 - RNA, 19 nt, Homo sapiens
agaccgaaguggaggcuau

SEQ ID NO: 561459 - RNA, 19 nt, Homo sapiens
ggcaacaucauuaaagugu

SEQ ID NO: 561460 - RNA, 19 nt, Homo sapiens
gggaguucuuuaaacaaau

SEQ ID NO: 561461 - RNA, 19 nt, Homo sapiens
aagaaacgacuacagaaau

SEQ ID NO: 561462 - RNA, 19 nt, Homo sapiens
caaaagcagagcucauaua

SEQ ID NO: 561463 - RNA, 19 nt, Homo sapiens
gcgcaaccgaccauacuga

SEQ ID NO: 561464 - RNA, 19 nt, Homo sapiens
ggagaucgaggagguuaug

SEQ ID NO: 561465 - RNA, 19 nt, Homo sapiens
cgacugauuccucuuaugg

SEQ ID NO: 561466 - RNA, 19 nt, Homo sapiens
ggggaguucuuuaaacaaa

SEQ ID NO: 561467 - RNA, 19 nt, Homo sapiens
gucaacaagauucauauga

SEQ ID NO: 561468 - RNA, 19 nt, Homo sapiens
cagcaaaguuauucuaccu

SEQ ID NO: 561469 - RNA, 19 nt, Homo sapiens
guuauucuaccuauggaaa

SEQ ID NO: 561470 - RNA, 19 nt, Homo sapiens
agccagcaaccauauaaua

SEQ ID NO: 561471 - RNA, 19 nt, Homo sapiens
ggugagcagcaaaguuauu

SEQ ID NO: 561472 - RNA, 19 nt, Homo sapiens
gaggcaacagugucauuug

SEQ ID NO: 561473 - RNA, 19 nt, Homo sapiens
gaccagcagucaggcuaug

SEQ ID NO: 561474 - RNA, 19 nt, Homo sapiens
ccuaugaccagccagacua

SEQ ID NO: 561475 - RNA, 19 nt, Homo sapiens
ucacaguccuauggugguu

SEQ ID NO: 561476 - RNA, 19 nt, Homo sapiens
caggagugguggcggcuau

SEQ ID NO: 561477 - RNA, 19 nt, Homo sapiens
cagaggaggcggcuaugga

SEQ ID NO: 561478 - RNA, 19 nt, Homo sapiens
aaaguuauucuaccuaugg

SEQ ID NO: 561479 - RNA, 19 nt, Homo sapiens
uagaggucguggaggcuuu

SEQ ID NO: 561480 - RNA, 19 nt, Homo sapiens
gucgugaugugaguaggua

SEQ ID NO: 561481 - RNA, 19 nt, Homo sapiens
ucagcagcaugauuccuau

SEQ ID NO: 561482 - RNA, 19 nt, Homo sapiens
gaacuacacugcgagcuuu

SEQ ID NO: 561483 - RNA, 19 nt, Homo sapiens
gacauuagccgaccagaaa

SEQ ID NO: 561484 - RNA, 19 nt, Homo sapiens
ggacugaccuggccacacu

SEQ ID NO: 561485 - RNA, 19 nt, Homo sapiens
acacaaggaucgagccaaa

SEQ ID NO: 561486 - RNA, 19 nt, Homo sapiens
ugagggagcuguccaagca

SEQ ID NO: 561487 - RNA, 19 nt, Homo sapiens
ggaaugagggcgagauaca

SEQ ID NO: 561488 - RNA, 19 nt, Homo sapiens
ucagggaugucuuccaugu

SEQ ID NO: 561489 - RNA, 19 nt, Homo sapiens
gcucaucugcuucgacauu

SEQ ID NO: 561490 - RNA, 19 nt, Homo sapiens
ccaccguguuugagaacua

SEQ ID NO: 561491 - RNA, 19 nt, Homo sapiens
acacuucagguuccucuua

SEQ ID NO: 561492 - RNA, 19 nt, Homo sapiens
gcagaggcuuaucccuguu

SEQ ID NO: 561493 - RNA, 19 nt, Homo sapiens
ccucuggccuauccugauu

SEQ ID NO: 561494 - RNA, 19 nt, Homo sapiens
gcuuaucccuguuacacau

SEQ ID NO: 561495 - RNA, 19 nt, Homo sapiens
gcaaggagagacucaagag

SEQ ID NO: 561496 - RNA, 19 nt, Homo sapiens
gcgauccgcucagcuguca

SEQ ID NO: 561497 - RNA, 19 nt, Homo sapiens
caacaugugggacacuuca

SEQ ID NO: 561498 - RNA, 19 nt, Homo sapiens
ucagguuccucuuacuaug

SEQ ID NO: 561499 - RNA, 19 nt, Homo sapiens
cgucagggaugucuuccau

SEQ ID NO: 561500 - RNA, 19 nt, Homo sapiens
cagaggcuuaucccuguua

SEQ ID NO: 561501 - RNA, 19 nt, Homo sapiens
cgacauuagccgaccagaa

SEQ ID NO: 561502 - RNA, 19 nt, Homo sapiens
uggccuauccugauucuga

SEQ ID NO: 561503 - RNA, 19 nt, Homo sapiens
caagaguucugccccaaug

SEQ ID NO: 561504 - RNA, 19 nt, Homo sapiens
cucaucugcuucgacauua

SEQ ID NO: 561505 - RNA, 19 nt, Homo sapiens
cagguuccucuuacuauga

SEQ ID NO: 561506 - RNA, 19 nt, Homo sapiens
ggccuauccugauucugau

SEQ ID NO: 561507 - RNA, 19 nt, Homo sapiens
ccucuuacuaugauaaugu

SEQ ID NO: 561508 - RNA, 19 nt, Homo sapiens
aagcugcaaccucauguga

SEQ ID NO: 561509 - RNA, 19 nt, Homo sapiens
acgccuaucccgggaguua

SEQ ID NO: 561510 - RNA, 19 nt, Homo sapiens
ggcaaggagagacucaaga

SEQ ID NO: 561511 - RNA, 19 nt, Homo sapiens
gaaguggcaaggagagacu

SEQ ID NO: 561512 - RNA, 19 nt, Homo sapiens
gggcuguguccuauguuga

SEQ ID NO: 561513 - RNA, 19 nt, Homo sapiens
cuucagguuccucuuacua

SEQ ID NO: 561514 - RNA, 19 nt, Homo sapiens
gcaauuaaaugacguggua

SEQ ID NO: 561515 - RNA, 19 nt, Homo sapiens
gagagaaccugggaaauuu

SEQ ID NO: 561516 - RNA, 19 nt, Homo sapiens
caaucuaccucaucauuua

SEQ ID NO: 561517 - RNA, 19 nt, Homo sapiens
gaaacaaucuaccucauca

SEQ ID NO: 561518 - RNA, 19 nt, Homo sapiens
ccaaauauauaccgugaaa

SEQ ID NO: 561519 - RNA, 19 nt, Homo sapiens
gaagcgggcauuucaguua

SEQ ID NO: 561520 - RNA, 19 nt, Homo sapiens
ccagaaaugugucaucuug

SEQ ID NO: 561521 - RNA, 19 nt, Homo sapiens
caaggaaggaagaauauua

SEQ ID NO: 561522 - RNA, 19 nt, Homo sapiens
ggaagaacccucuaccaaa

SEQ ID NO: 561523 - RNA, 19 nt, Homo sapiens
gaaccagauugcaaauauu

SEQ ID NO: 561524 - RNA, 19 nt, Homo sapiens
ccaaguaacacaucaagua

SEQ ID NO: 561525 - RNA, 19 nt, Homo sapiens
gaaaguacaggcagugaaa

SEQ ID NO: 561526 - RNA, 19 nt, Homo sapiens
ucacagaucucauuagucu

SEQ ID NO: 561527 - RNA, 19 nt, Homo sapiens
cauuugaguuguuccauua

SEQ ID NO: 561528 - RNA, 19 nt, Homo sapiens
uggagcaucuuguaaauuu

SEQ ID NO: 561529 - RNA, 19 nt, Homo sapiens
gaagaacccucuaccaaaa

SEQ ID NO: 561530 - RNA, 19 nt, Homo sapiens
cagacaaacuggcuauaaa

SEQ ID NO: 561531 - RNA, 19 nt, Homo sapiens
aaauacaacugcagacaaa

SEQ ID NO: 561532 - RNA, 19 nt, Homo sapiens
gugaggaucuugaacagaa

SEQ ID NO: 561533 - RNA, 19 nt, Homo sapiens
uaaagaggauuuggaaguu

SEQ ID NO: 561534 - RNA, 19 nt, Homo sapiens
gagaggaguugcugagaau

SEQ ID NO: 561535 - RNA, 19 nt, Homo sapiens
ugaaccagauugcaaauau

SEQ ID NO: 561536 - RNA, 19 nt, Homo sapiens
ugaagaaacugaaccagau

SEQ ID NO: 561537 - RNA, 19 nt, Homo sapiens
gagccgagguaguggagua

SEQ ID NO: 561538 - RNA, 19 nt, Homo sapiens
cgagagaacaauaacaaua

SEQ ID NO: 561539 - RNA, 19 nt, Homo sapiens
caaagaagcgggcauuuca

SEQ ID NO: 561540 - RNA, 19 nt, Homo sapiens
ggagauugguguuucacuu

SEQ ID NO: 561541 - RNA, 19 nt, Homo sapiens
gcacagugggugaugauaa

SEQ ID NO: 561542 - RNA, 19 nt, Homo sapiens
ccucagaguuaaauuagaa

SEQ ID NO: 561543 - RNA, 19 nt, Homo sapiens
uacagaaccugccugagua

SEQ ID NO: 561544 - RNA, 19 nt, Homo sapiens
gcagacaaacuggcuauaa

SEQ ID NO: 561545 - RNA, 19 nt, Homo sapiens
gacaaugaguuaaggaauc

SEQ ID NO: 561546 - RNA, 19 nt, Homo sapiens
ggacgagggcauccuguuu

SEQ ID NO: 561547 - RNA, 19 nt, Homo sapiens
ucagagaaauuaccaacug

SEQ ID NO: 561548 - RNA, 19 nt, Homo sapiens
guacagaaccugccugagu

SEQ ID NO: 561549 - RNA, 19 nt, Homo sapiens
gacccaagacugauuauug

SEQ ID NO: 561550 - RNA, 19 nt, Homo sapiens
cuacaaggaaggaagaaua

SEQ ID NO: 561551 - RNA, 19 nt, Homo sapiens
guaaauagaagcacugaca

SEQ ID NO: 561552 - RNA, 19 nt, Homo sapiens
caagaccucuggaacaaca

SEQ ID NO: 561553 - RNA, 19 nt, Homo sapiens
caaugaaugugcugcguau

SEQ ID NO: 561554 - RNA, 19 nt, Homo sapiens
gagcaagaucacuguauuu

SEQ ID NO: 561555 - RNA, 19 nt, Homo sapiens
caucuacuauuauccagaa

SEQ ID NO: 561556 - RNA, 19 nt, Homo sapiens
guuaacagguaguuggauu

SEQ ID NO: 561557 - RNA, 19 nt, Homo sapiens
ucacuuuacugcauaggaa

SEQ ID NO: 561558 - RNA, 19 nt, Homo sapiens
ggcaagaccucuggaacaa

SEQ ID NO: 561559 - RNA, 19 nt, Homo sapiens
gaagaaacugaaccagauu

SEQ ID NO: 561560 - RNA, 19 nt, Homo sapiens
gucaguaugugauguuuau

SEQ ID NO: 561561 - RNA, 19 nt, Homo sapiens
ggcaacagcaauuaaauga

SEQ ID NO: 561562 - RNA, 19 nt, Homo sapiens
gaaccugggaaauuugauu

SEQ ID NO: 561563 - RNA, 19 nt, Homo sapiens
ugagagaaccugggaaauu

SEQ ID NO: 561564 - RNA, 19 nt, Homo sapiens
gcaaauauucaaagaagca

SEQ ID NO: 561565 - RNA, 19 nt, Homo sapiens
gcaaagaagcgggcauuuc

SEQ ID NO: 561566 - RNA, 19 nt, Homo sapiens
uaaauggagcaucuuguaa

SEQ ID NO: 561567 - RNA, 19 nt, Homo sapiens
cagagaaauuaccaacuga

SEQ ID NO: 561568 - RNA, 19 nt, Homo sapiens
augaaugucuuguuuguga

SEQ ID NO: 561569 - RNA, 19 nt, Homo sapiens
agagcaagaucacuguauu

SEQ ID NO: 561570 - RNA, 19 nt, Homo sapiens
ccaguaugguuuauuaucu

SEQ ID NO: 561571 - RNA, 19 nt, Homo sapiens
uaacacaucaaguacagaa

SEQ ID NO: 561572 - RNA, 19 nt, Homo sapiens
uuaaauggagcaucuugua

SEQ ID NO: 561573 - RNA, 19 nt, Homo sapiens
cugcguaucuugucucaau

SEQ ID NO: 561574 - RNA, 19 nt, Homo sapiens
cgucacagaucucauuagu

SEQ ID NO: 561575 - RNA, 19 nt, Homo sapiens
ggaaacaaucuaccucauc

SEQ ID NO: 561576 - RNA, 19 nt, Homo sapiens
acccaagacugauuauuga

SEQ ID NO: 561577 - RNA, 19 nt, Homo sapiens
cagaaauuccucagagaaa

SEQ ID NO: 561578 - RNA, 19 nt, Homo sapiens
ugagaauucuguagucauc

SEQ ID NO: 561579 - RNA, 19 nt, Homo sapiens
ggagugaggaucuugaaca

SEQ ID NO: 561580 - RNA, 19 nt, Homo sapiens
gaccagaaaugugucaucu

SEQ ID NO: 561581 - RNA, 19 nt, Homo sapiens
gaccaaugcuugaugucau

SEQ ID NO: 561582 - RNA, 19 nt, Homo sapiens
aagcuaaaauggccaaaua

SEQ ID NO: 561583 - RNA, 19 nt, Homo sapiens
gaaaauaagaugugcguau

SEQ ID NO: 561584 - RNA, 19 nt, Homo sapiens
gccagaaauuccucagaga

SEQ ID NO: 561585 - RNA, 19 nt, Homo sapiens
ggaagagucgagagaacaa

SEQ ID NO: 561586 - RNA, 19 nt, Homo sapiens
caaagaagcauuggaagag

SEQ ID NO: 561587 - RNA, 19 nt, Homo sapiens
ucaaagaagcauuggaaga

SEQ ID NO: 561588 - RNA, 19 nt, Homo sapiens
aaauggagcaucuuguaaa

SEQ ID NO: 561589 - RNA, 19 nt, Homo sapiens
ccagaggcaacagcaauua

SEQ ID NO: 561590 - RNA, 19 nt, Homo sapiens
agagaggaguugcugagaa

SEQ ID NO: 561591 - RNA, 19 nt, Homo sapiens
ucccaagucuccgaaagua

SEQ ID NO: 561592 - RNA, 19 nt, Homo sapiens
aaacugaaccagauugcaa

SEQ ID NO: 561593 - RNA, 19 nt, Homo sapiens
gugagaggauuggcuguga

SEQ ID NO: 561594 - RNA, 19 nt, Homo sapiens
uaucuucacuuuacugcau

SEQ ID NO: 561595 - RNA, 19 nt, Homo sapiens
caacgacugccucagaguu

SEQ ID NO: 561596 - RNA, 19 nt, Homo sapiens
gagaaccugggaaauuuga

SEQ ID NO: 561597 - RNA, 19 nt, Homo sapiens
gcugagaauucuguaguca

SEQ ID NO: 561598 - RNA, 19 nt, Homo sapiens
uauagucuguuaccacugu

SEQ ID NO: 561599 - RNA, 19 nt, Homo sapiens
caaacuggcuauaaaacuu

SEQ ID NO: 561600 - RNA, 19 nt, Homo sapiens
ccagaaauuccucagagaa

SEQ ID NO: 561601 - RNA, 19 nt, Homo sapiens
gaucccuccuucagcugua

SEQ ID NO: 561602 - RNA, 19 nt, Homo sapiens
aaagaggauuuggaaguug

SEQ ID NO: 561603 - RNA, 19 nt, Homo sapiens
gaaugucuuguuugugaaa

SEQ ID NO: 561604 - RNA, 19 nt, Homo sapiens
caagaucacuguauuuugg

SEQ ID NO: 561605 - RNA, 19 nt, Homo sapiens
ggagaaaagauugcauuua

SEQ ID NO: 561606 - RNA, 19 nt, Homo sapiens
ggagugugcugcggguuuc

SEQ ID NO: 561607 - RNA, 19 nt, Homo sapiens
agaaauuccucagagaaau

SEQ ID NO: 561608 - RNA, 19 nt, Homo sapiens
gagcaucuuguaaauuuca

SEQ ID NO: 561609 - RNA, 19 nt, Homo sapiens
ugacuauaacccaaacuuu

SEQ ID NO: 561610 - RNA, 19 nt, Homo sapiens
aacaacaucuuccaguuca

SEQ ID NO: 561611 - RNA, 19 nt, Homo sapiens
gcuaaaauggccaaauaua

SEQ ID NO: 561612 - RNA, 19 nt, Homo sapiens
gagcuucagaccagaaaug

SEQ ID NO: 561613 - RNA, 19 nt, Homo sapiens
uaugaccucuccaccuuau

SEQ ID NO: 561614 - RNA, 19 nt, Homo sapiens
gcagagaaguugccaagua

SEQ ID NO: 561615 - RNA, 19 nt, Homo sapiens
gacaugaacugacuaauug

SEQ ID NO: 561616 - RNA, 19 nt, Homo sapiens
gaggagagcuuggauagaa

SEQ ID NO: 561617 - RNA, 19 nt, Homo sapiens
gaggagagcuuggauagaa

SEQ ID NO: 561618 - RNA, 19 nt, Homo sapiens
gcacucaagucaaagauga

SEQ ID NO: 561619 - RNA, 19 nt, Homo sapiens
gagcugaaccucaccaaua

SEQ ID NO: 561620 - RNA, 19 nt, Homo sapiens
acacagagcuggcaaagga

SEQ ID NO: 561621 - RNA, 19 nt, Homo sapiens
ccgaggagcugguguaauu

SEQ ID NO: 561622 - RNA, 19 nt, Homo sapiens
gaacaaagggaacucaaga

SEQ ID NO: 561623 - RNA, 19 nt, Homo sapiens
ggaaauaacggucaucugu

SEQ ID NO: 561624 - RNA, 19 nt, Homo sapiens
gaggagggcuuggauagaa

SEQ ID NO: 561625 - RNA, 19 nt, Homo sapiens
gaggagggcuuggauagaa

SEQ ID NO: 561626 - RNA, 19 nt, Homo sapiens
gaggagggcuuggauagaa

SEQ ID NO: 561627 - RNA, 19 nt, Homo sapiens
ccaaaucgauuccucuaga

SEQ ID NO: 561628 - RNA, 19 nt, Homo sapiens
gccaaaggauaguguuuaa

SEQ ID NO: 561629 - RNA, 19 nt, Homo sapiens
ggauagaaaugaggagauu

SEQ ID NO: 561630 - RNA, 19 nt, Homo sapiens
caaaucagcugaggugugu

SEQ ID NO: 561631 - RNA, 19 nt, Homo sapiens
gaagacgucugucccaaag

SEQ ID NO: 561632 - RNA, 19 nt, Homo sapiens
gagaugaagugguguugau

SEQ ID NO: 561633 - RNA, 19 nt, Homo sapiens
acaaagcgcugaacuugau

SEQ ID NO: 561634 - RNA, 19 nt, Homo sapiens
ccaggacacugcucagauu

SEQ ID NO: 561635 - RNA, 19 nt, Homo sapiens
gccaagaucuacauuucaa

SEQ ID NO: 561636 - RNA, 19 nt, Homo sapiens
guacuauucuccagcaaau

SEQ ID NO: 561637 - RNA, 19 nt, Homo sapiens
caagugaucucagaagcaa

SEQ ID NO: 561638 - RNA, 19 nt, Homo sapiens
agacgucugucccaaagua

SEQ ID NO: 561639 - RNA, 19 nt, Homo sapiens
ggauguauguugcuugcuu

SEQ ID NO: 561640 - RNA, 19 nt, Homo sapiens
gggagcaugucuuggaauu

SEQ ID NO: 561641 - RNA, 19 nt, Homo sapiens
caacuggucuuccucugau

SEQ ID NO: 561642 - RNA, 19 nt, Homo sapiens
gaagaugccaccuguguca

SEQ ID NO: 561643 - RNA, 19 nt, Homo sapiens
gauaaucucccaagugauc

SEQ ID NO: 561644 - RNA, 19 nt, Homo sapiens
uugcucaggugacaaguua

SEQ ID NO: 561645 - RNA, 19 nt, Homo sapiens
gagcaugucuuggaauugg

SEQ ID NO: 561646 - RNA, 19 nt, Homo sapiens
ugaagaagcucuguugucu

SEQ ID NO: 561647 - RNA, 19 nt, Homo sapiens
cagcuuacauaaaugaguu

SEQ ID NO: 561648 - RNA, 19 nt, Homo sapiens
gauauaagagggugaaagu

SEQ ID NO: 561649 - RNA, 19 nt, Homo sapiens
guccagaucugccacauag

SEQ ID NO: 561650 - RNA, 19 nt, Homo sapiens
ggacacugcucagauucuu

SEQ ID NO: 561651 - RNA, 19 nt, Homo sapiens
guacagcuuacauaaauga

SEQ ID NO: 561652 - RNA, 19 nt, Homo sapiens
guauguugcuugcuugaga

SEQ ID NO: 561653 - RNA, 19 nt, Homo sapiens
caaccagauuguccuauuc

SEQ ID NO: 561654 - RNA, 19 nt, Homo sapiens
gaugaagugguguugauaa

SEQ ID NO: 561655 - RNA, 19 nt, Homo sapiens
gagcugguguaauuacuuc

SEQ ID NO: 561656 - RNA, 19 nt, Homo sapiens
agacaugaacugacuaauu

SEQ ID NO: 561657 - RNA, 19 nt, Homo sapiens
ucaaccagauuguccuauu

SEQ ID NO: 561658 - RNA, 19 nt, Homo sapiens
gugccaagaucuacauuuc

SEQ ID NO: 561659 - RNA, 19 nt, Homo sapiens
cagagaaguugccaaguag

SEQ ID NO: 561660 - RNA, 19 nt, Homo sapiens
ugugcaaacucuguaaaua

SEQ ID NO: 561661 - RNA, 19 nt, Homo sapiens
gaaauggucaucacaucug

SEQ ID NO: 561662 - RNA, 19 nt, Homo sapiens
ggagugugguuggagauga

SEQ ID NO: 561663 - RNA, 19 nt, Homo sapiens
gggaaaaggugcuugaaga

SEQ ID NO: 561664 - RNA, 19 nt, Homo sapiens
cccaaaggguguacuauuc

SEQ ID NO: 561665 - RNA, 19 nt, Homo sapiens
aagauacacuggagaacaa

SEQ ID NO: 561666 - RNA, 19 nt, Homo sapiens
gugcaaacucuguaaauau

SEQ ID NO: 561667 - RNA, 19 nt, Homo sapiens
cagcauggauuccguggau

SEQ ID NO: 561668 - RNA, 19 nt, Homo sapiens
gaaaugaggagagcuugga

SEQ ID NO: 561669 - RNA, 19 nt, Homo sapiens
ggaagacgucugucccaaa

SEQ ID NO: 561670 - RNA, 19 nt, Homo sapiens
gaacuugauugggaagaag

SEQ ID NO: 561671 - RNA, 19 nt, Homo sapiens
uacgugagcugccugaaga

SEQ ID NO: 561672 - RNA, 19 nt, Homo sapiens
ugcaaacucuguaaauaug

SEQ ID NO: 561673 - RNA, 19 nt, Homo sapiens
caucacaucugaccuuggu

SEQ ID NO: 561674 - RNA, 19 nt, Homo sapiens
gaagugguguugauaaacc

SEQ ID NO: 561675 - RNA, 19 nt, Homo sapiens
auagaaggcucucaacauc

SEQ ID NO: 561676 - RNA, 19 nt, Homo sapiens
gcagaucauucaggagguu

SEQ ID NO: 561677 - RNA, 19 nt, Homo sapiens
uaauugguauccacuacuu

SEQ ID NO: 561678 - RNA, 19 nt, Homo sapiens
gaacaucggaauaacaaac

SEQ ID NO: 561679 - RNA, 19 nt, Homo sapiens
ggacuacggcggauauaag

SEQ ID NO: 561680 - RNA, 19 nt, Homo sapiens
agacaaagcgcugaacuug

SEQ ID NO: 561681 - RNA, 19 nt, Homo sapiens
gaaaugaggagggcuugga

SEQ ID NO: 561682 - RNA, 19 nt, Homo sapiens
gaaaugaggagggcuugga

SEQ ID NO: 561683 - RNA, 19 nt, Homo sapiens
gaaaugaggagggcuugga

SEQ ID NO: 561684 - RNA, 19 nt, Homo sapiens
ggaggaagaguauguagca

SEQ ID NO: 561685 - RNA, 19 nt, Homo sapiens
caaacucuguaaauaugug

SEQ ID NO: 561686 - RNA, 19 nt, Homo sapiens
ugaacugacuaauugguau

SEQ ID NO: 561687 - RNA, 19 nt, Homo sapiens
caagacaugaacugacuaa

SEQ ID NO: 561688 - RNA, 19 nt, Homo sapiens
gagcuuggauagaaaugag

SEQ ID NO: 561689 - RNA, 19 nt, Homo sapiens
gagcuuggauagaaaugag

SEQ ID NO: 561690 - RNA, 19 nt, Homo sapiens
gacagguggugaagccaaa

SEQ ID NO: 561691 - RNA, 19 nt, Homo sapiens
ucacagagccuccagaaaa

SEQ ID NO: 561692 - RNA, 19 nt, Homo sapiens
ucaagaagacugagagcuu

SEQ ID NO: 561693 - RNA, 19 nt, Homo sapiens
gaaaguacugugcccuuca

SEQ ID NO: 561694 - RNA, 19 nt, Homo sapiens
acaaagggaacucaagauu

SEQ ID NO: 561695 - RNA, 19 nt, Homo sapiens
gaaccucaccaauaucuac

SEQ ID NO: 561696 - RNA, 19 nt, Homo sapiens
ccagaucugccacauagaa

SEQ ID NO: 561697 - RNA, 19 nt, Homo sapiens
gacaggaacagcauggauu

SEQ ID NO: 561698 - RNA, 19 nt, Homo sapiens
gauagaaaugaggagauua

SEQ ID NO: 561699 - RNA, 19 nt, Homo sapiens
ccucgggcauucuuccuaa

SEQ ID NO: 561700 - RNA, 19 nt, Homo sapiens
gagugugguuggagaugaa

SEQ ID NO: 561701 - RNA, 19 nt, Homo sapiens
agggagaacugggcaauga

SEQ ID NO: 561702 - RNA, 19 nt, Homo sapiens
caagccugguuguaauuug

SEQ ID NO: 561703 - RNA, 19 nt, Homo sapiens
uauaagagggugaaaguag

SEQ ID NO: 561704 - RNA, 19 nt, Homo sapiens
ccacauagaaggcucucaa

SEQ ID NO: 561705 - RNA, 19 nt, Homo sapiens
gacaguaagccaaauaucu

SEQ ID NO: 561706 - RNA, 19 nt, Homo sapiens
uaacaccacagacaugaga

SEQ ID NO: 561707 - RNA, 19 nt, Homo sapiens
ccacuacuuguacagcuua

SEQ ID NO: 561708 - RNA, 19 nt, Homo sapiens
auaagagggugaaaguaga

SEQ ID NO: 561709 - RNA, 19 nt, Homo sapiens
gacaaagcgcugaacuuga

SEQ ID NO: 561710 - RNA, 19 nt, Homo sapiens
acugugaucugggaacuuu

SEQ ID NO: 561711 - RNA, 19 nt, Homo sapiens
gaccauggaugcggaagca

SEQ ID NO: 561712 - RNA, 19 nt, Homo sapiens
guacugugcccuucagcaa

SEQ ID NO: 561713 - RNA, 19 nt, Homo sapiens
ccaaggacaguaagccaaa

SEQ ID NO: 561714 - RNA, 19 nt, Homo sapiens
gcagagaaguugccaagua

SEQ ID NO: 561715 - RNA, 19 nt, Homo sapiens
gacaugaacugacuaauug

SEQ ID NO: 561716 - RNA, 19 nt, Homo sapiens
gaggagagcuuggauagaa

SEQ ID NO: 561717 - RNA, 19 nt, Homo sapiens
gaggagagcuuggauagaa

SEQ ID NO: 561718 - RNA, 19 nt, Homo sapiens
gcacucaagucaaagauga

SEQ ID NO: 561719 - RNA, 19 nt, Homo sapiens
gagcugaaccucaccaaua

SEQ ID NO: 561720 - RNA, 19 nt, Homo sapiens
acacagagcuggcaaagga

SEQ ID NO: 561721 - RNA, 19 nt, Homo sapiens
gaacaaagggaacucaaga

SEQ ID NO: 561722 - RNA, 19 nt, Homo sapiens
ggaaauaacggucaucugu

SEQ ID NO: 561723 - RNA, 19 nt, Homo sapiens
gaggagggcuuggauagaa

SEQ ID NO: 561724 - RNA, 19 nt, Homo sapiens
gaggagggcuuggauagaa

SEQ ID NO: 561725 - RNA, 19 nt, Homo sapiens
gaggagggcuuggauagaa

SEQ ID NO: 561726 - RNA, 19 nt, Homo sapiens
ccaaaucgauuccucuaga

SEQ ID NO: 561727 - RNA, 19 nt, Homo sapiens
gccaaaggauaguguuuaa

SEQ ID NO: 561728 - RNA, 19 nt, Homo sapiens
ggauagaaaugaggagauu

SEQ ID NO: 561729 - RNA, 19 nt, Homo sapiens
caaaucagcugaggugugu

SEQ ID NO: 561730 - RNA, 19 nt, Homo sapiens
gaagacgucugucccaaag

SEQ ID NO: 561731 - RNA, 19 nt, Homo sapiens
gagaugaagugguguugau

SEQ ID NO: 561732 - RNA, 19 nt, Homo sapiens
acaaagcgcugaacuugau

SEQ ID NO: 561733 - RNA, 19 nt, Homo sapiens
ccaggacacugcucagauu

SEQ ID NO: 561734 - RNA, 19 nt, Homo sapiens
gccaagaucuacauuucaa

SEQ ID NO: 561735 - RNA, 19 nt, Homo sapiens
guacuauucuccagcaaau

SEQ ID NO: 561736 - RNA, 19 nt, Homo sapiens
caagugaucucagaagcaa

SEQ ID NO: 561737 - RNA, 19 nt, Homo sapiens
agacgucugucccaaagua

SEQ ID NO: 561738 - RNA, 19 nt, Homo sapiens
ggauguauguugcuugcuu

SEQ ID NO: 561739 - RNA, 19 nt, Homo sapiens
gggagcaugucuuggaauu

SEQ ID NO: 561740 - RNA, 19 nt, Homo sapiens
caacuggucuuccucugau

SEQ ID NO: 561741 - RNA, 19 nt, Homo sapiens
gaagaugccaccuguguca

SEQ ID NO: 561742 - RNA, 19 nt, Homo sapiens
gauaaucucccaagugauc

SEQ ID NO: 561743 - RNA, 19 nt, Homo sapiens
uugcucaggugacaaguua

SEQ ID NO: 561744 - RNA, 19 nt, Homo sapiens
gagcaugucuuggaauugg

SEQ ID NO: 561745 - RNA, 19 nt, Homo sapiens
ugaagaagcucuguugucu

SEQ ID NO: 561746 - RNA, 19 nt, Homo sapiens
cagcuuacauaaaugaguu

SEQ ID NO: 561747 - RNA, 19 nt, Homo sapiens
gauauaagagggugaaagu

SEQ ID NO: 561748 - RNA, 19 nt, Homo sapiens
guccagaucugccacauag

SEQ ID NO: 561749 - RNA, 19 nt, Homo sapiens
gcagaucauucaggaguug

SEQ ID NO: 561750 - RNA, 19 nt, Homo sapiens
ggacacugcucagauucuu

SEQ ID NO: 561751 - RNA, 19 nt, Homo sapiens
guacagcuuacauaaauga

SEQ ID NO: 561752 - RNA, 19 nt, Homo sapiens
guauguugcuugcuugaga

SEQ ID NO: 561753 - RNA, 19 nt, Homo sapiens
caaccagauuguccuauuc

SEQ ID NO: 561754 - RNA, 19 nt, Homo sapiens
gaugaagugguguugauaa

SEQ ID NO: 561755 - RNA, 19 nt, Homo sapiens
agacaugaacugacuaauu

SEQ ID NO: 561756 - RNA, 19 nt, Homo sapiens
ucaaccagauuguccuauu

SEQ ID NO: 561757 - RNA, 19 nt, Homo sapiens
gugccaagaucuacauuuc

SEQ ID NO: 561758 - RNA, 19 nt, Homo sapiens
cagagaaguugccaaguag

SEQ ID NO: 561759 - RNA, 19 nt, Homo sapiens
ugugcaaacucuguaaaua

SEQ ID NO: 561760 - RNA, 19 nt, Homo sapiens
gaaauggucaucacaucug

SEQ ID NO: 561761 - RNA, 19 nt, Homo sapiens
ggagugugguuggagauga

SEQ ID NO: 561762 - RNA, 19 nt, Homo sapiens
gggaaaaggugcuugaaga

SEQ ID NO: 561763 - RNA, 19 nt, Homo sapiens
cccaaaggguguacuauuc

SEQ ID NO: 561764 - RNA, 19 nt, Homo sapiens
aagauacacuggagaacaa

SEQ ID NO: 561765 - RNA, 19 nt, Homo sapiens
gugcaaacucuguaaauau

SEQ ID NO: 561766 - RNA, 19 nt, Homo sapiens
ggaagacgucugucccaaa

SEQ ID NO: 561767 - RNA, 19 nt, Homo sapiens
cagcauggauuccguggau

SEQ ID NO: 561768 - RNA, 19 nt, Homo sapiens
gaaaugaggagagcuugga

SEQ ID NO: 561769 - RNA, 19 nt, Homo sapiens
gaacuugauugggaagaag

SEQ ID NO: 561770 - RNA, 19 nt, Homo sapiens
uacgugagcugccugaaga

SEQ ID NO: 561771 - RNA, 19 nt, Homo sapiens
ugcaaacucuguaaauaug

SEQ ID NO: 561772 - RNA, 19 nt, Homo sapiens
caucacaucugaccuuggu

SEQ ID NO: 561773 - RNA, 19 nt, Homo sapiens
gaagugguguugauaaacc

SEQ ID NO: 561774 - RNA, 19 nt, Homo sapiens
auagaaggcucucaacauc

SEQ ID NO: 561775 - RNA, 19 nt, Homo sapiens
uaauugguauccacuacuu

SEQ ID NO: 561776 - RNA, 19 nt, Homo sapiens
gaacaucggaauaacaaac

SEQ ID NO: 561777 - RNA, 19 nt, Homo sapiens
ggacuacggcggauauaag

SEQ ID NO: 561778 - RNA, 19 nt, Homo sapiens
agacaaagcgcugaacuug

SEQ ID NO: 561779 - RNA, 19 nt, Homo sapiens
gaaaugaggagggcuugga

SEQ ID NO: 561780 - RNA, 19 nt, Homo sapiens
gaaaugaggagggcuugga

SEQ ID NO: 561781 - RNA, 19 nt, Homo sapiens
gaaaugaggagggcuugga

SEQ ID NO: 561782 - RNA, 19 nt, Homo sapiens
ggaggaagaguauguagca

SEQ ID NO: 561783 - RNA, 19 nt, Homo sapiens
caaacucuguaaauaugug

SEQ ID NO: 561784 - RNA, 19 nt, Homo sapiens
ugaacugacuaauugguau

SEQ ID NO: 561785 - RNA, 19 nt, Homo sapiens
caagacaugaacugacuaa

SEQ ID NO: 561786 - RNA, 19 nt, Homo sapiens
gagcuuggauagaaaugag

SEQ ID NO: 561787 - RNA, 19 nt, Homo sapiens
gagcuuggauagaaaugag

SEQ ID NO: 561788 - RNA, 19 nt, Homo sapiens
gacagguggugaagccaaa

SEQ ID NO: 561789 - RNA, 19 nt, Homo sapiens
ucaagaagacugagagcuu

SEQ ID NO: 561790 - RNA, 19 nt, Homo sapiens
gaaaguacugugcccuuca

SEQ ID NO: 561791 - RNA, 19 nt, Homo sapiens
ucacagagccuccagaaaa

SEQ ID NO: 561792 - RNA, 19 nt, Homo sapiens
acaaagggaacucaagauu

SEQ ID NO: 561793 - RNA, 19 nt, Homo sapiens
gaaccucaccaauaucuac

SEQ ID NO: 561794 - RNA, 19 nt, Homo sapiens
ccagaucugccacauagaa

SEQ ID NO: 561795 - RNA, 19 nt, Homo sapiens
gacaggaacagcauggauu

SEQ ID NO: 561796 - RNA, 19 nt, Homo sapiens
gauagaaaugaggagauua

SEQ ID NO: 561797 - RNA, 19 nt, Homo sapiens
ccucgggcauucuuccuaa

SEQ ID NO: 561798 - RNA, 19 nt, Homo sapiens
gagugugguuggagaugaa

SEQ ID NO: 561799 - RNA, 19 nt, Homo sapiens
agggagaacugggcaauga

SEQ ID NO: 561800 - RNA, 19 nt, Homo sapiens
caagccugguuguaauuug

SEQ ID NO: 561801 - RNA, 19 nt, Homo sapiens
uauaagagggugaaaguag

SEQ ID NO: 561802 - RNA, 19 nt, Homo sapiens
ccacauagaaggcucucaa

SEQ ID NO: 561803 - RNA, 19 nt, Homo sapiens
gacaguaagccaaauaucu

SEQ ID NO: 561804 - RNA, 19 nt, Homo sapiens
uaacaccacagacaugaga

SEQ ID NO: 561805 - RNA, 19 nt, Homo sapiens
ccacuacuuguacagcuua

SEQ ID NO: 561806 - RNA, 19 nt, Homo sapiens
auaagagggugaaaguaga

SEQ ID NO: 561807 - RNA, 19 nt, Homo sapiens
gacaaagcgcugaacuuga

SEQ ID NO: 561808 - RNA, 19 nt, Homo sapiens
acugugaucugggaacuuu

SEQ ID NO: 561809 - RNA, 19 nt, Homo sapiens
gaccauggaugcggaagca

SEQ ID NO: 561810 - RNA, 19 nt, Homo sapiens
guacugugcccuucagcaa

SEQ ID NO: 561811 - RNA, 19 nt, Homo sapiens
ccaaggacaguaagccaaa

SEQ ID NO: 561812 - RNA, 19 nt, Homo sapiens
agagagcugugucccaguu

SEQ ID NO: 561813 - RNA, 19 nt, Homo sapiens
ccagcaagguguaauuacu

SEQ ID NO: 561814 - RNA, 19 nt, Homo sapiens
gcacaacacuuaucaaaga

SEQ ID NO: 561815 - RNA, 19 nt, Homo sapiens
gaggagagcucugagauaa

SEQ ID NO: 561816 - RNA, 19 nt, Homo sapiens
ccucauagcucuguucaua

SEQ ID NO: 561817 - RNA, 19 nt, Homo sapiens
ggccaucgcugcaggauuu

SEQ ID NO: 561818 - RNA, 19 nt, Homo sapiens
cauaagagcucccuuugug

SEQ ID NO: 561819 - RNA, 19 nt, Homo sapiens
ggacuugccuugccucaga

SEQ ID NO: 561820 - RNA, 19 nt, Homo sapiens
gggcaucaaucauaacaaa

SEQ ID NO: 561821 - RNA, 19 nt, Homo sapiens
gagagggacuuaaagacaa

SEQ ID NO: 561822 - RNA, 19 nt, Homo sapiens
caaagaagcguguauguag

SEQ ID NO: 561823 - RNA, 19 nt, Homo sapiens
cagaagggcaucaaucaua

SEQ ID NO: 561824 - RNA, 19 nt, Homo sapiens
ccacuuagccuucccuuug

SEQ ID NO: 561825 - RNA, 19 nt, Homo sapiens
gaaguuccaucgauagaag

SEQ ID NO: 561826 - RNA, 19 nt, Homo sapiens
agaagggcaucaaucauaa

SEQ ID NO: 561827 - RNA, 19 nt, Homo sapiens
agacaaaggugacuacuac

SEQ ID NO: 561828 - RNA, 19 nt, Homo sapiens
gcaccuguauucccagcua

SEQ ID NO: 561829 - RNA, 19 nt, Homo sapiens
acccuuagcuuucccauaa

SEQ ID NO: 561830 - RNA, 19 nt, Homo sapiens
acacugcccuucaauauca

SEQ ID NO: 561831 - RNA, 19 nt, Homo sapiens
gcaaagcccucagcuacau

SEQ ID NO: 561832 - RNA, 19 nt, Homo sapiens
aaacaaacauuuccaagac

SEQ ID NO: 561833 - RNA, 19 nt, Homo sapiens
gcagccaucuccaacauca

SEQ ID NO: 561834 - RNA, 19 nt, Homo sapiens
uacgaugucuccuaaguuu

SEQ ID NO: 561835 - RNA, 19 nt, Homo sapiens
ggaaaugccugaagaaaag

SEQ ID NO: 561836 - RNA, 19 nt, Homo sapiens
caaauuguaaucccaguaa

SEQ ID NO: 561837 - RNA, 19 nt, Homo sapiens
ggaggagagcucugagaua

SEQ ID NO: 561838 - RNA, 19 nt, Homo sapiens
ggccuacgaugucuccuaa

SEQ ID NO: 561839 - RNA, 19 nt, Homo sapiens
ggaguacacuggcacuauc

SEQ ID NO: 561840 - RNA, 19 nt, Homo sapiens
ggaucuggcugaaagacaa

SEQ ID NO: 561841 - RNA, 19 nt, Homo sapiens
gaucuccggucuuccaaug

SEQ ID NO: 561842 - RNA, 19 nt, Homo sapiens
gaaaagcggugaagaagag

SEQ ID NO: 561843 - RNA, 19 nt, Homo sapiens
cagaaucccugguggacaa

SEQ ID NO: 561844 - RNA, 19 nt, Homo sapiens
caccacacccugcuaauuu

SEQ ID NO: 561845 - RNA, 19 nt, Homo sapiens
gcacuuggcccuucugucu

SEQ ID NO: 561846 - RNA, 19 nt, Homo sapiens
ggagagcucugagauaaaa

SEQ ID NO: 561847 - RNA, 19 nt, Homo sapiens
gaugaaacuuuggacuuug

SEQ ID NO: 561848 - RNA, 19 nt, Homo sapiens
agaugaaacuuuggacuuu

SEQ ID NO: 561849 - RNA, 19 nt, Homo sapiens
cgaggcacaucucaaguga

SEQ ID NO: 561850 - RNA, 19 nt, Homo sapiens
ggagagggacuuaaagaca

SEQ ID NO: 561851 - RNA, 19 nt, Homo sapiens
cgaaauaagccucauccuu

SEQ ID NO: 561852 - RNA, 19 nt, Homo sapiens
caaaguaucaggccuacga

SEQ ID NO: 561853 - RNA, 19 nt, Homo sapiens
cggagaaguuagacuacua

SEQ ID NO: 561854 - RNA, 19 nt, Homo sapiens
caccaugacuguaaguuuc

SEQ ID NO: 561855 - RNA, 19 nt, Homo sapiens
gaacaccaggaaagacaaa

SEQ ID NO: 561856 - RNA, 19 nt, Homo sapiens
ucauagcucuguucauauc

SEQ ID NO: 561857 - RNA, 19 nt, Homo sapiens
ucacacugcccuucaauau

SEQ ID NO: 561858 - RNA, 19 nt, Homo sapiens
gcacaggaguguauuucac

SEQ ID NO: 561859 - RNA, 19 nt, Homo sapiens
ggaaaugccccugcuguua

SEQ ID NO: 561860 - RNA, 19 nt, Homo sapiens
aauaucaccuggacagaga

SEQ ID NO: 561861 - RNA, 19 nt, Homo sapiens
caaagacccauuucccuau

SEQ ID NO: 561862 - RNA, 19 nt, Homo sapiens
gauagaagaguggcuguga

SEQ ID NO: 561863 - RNA, 19 nt, Homo sapiens
cacaagaucugaugguuuu

SEQ ID NO: 561864 - RNA, 19 nt, Homo sapiens
acacaggccucuggagcua

SEQ ID NO: 561865 - RNA, 19 nt, Homo sapiens
cauguuaucuguguuugga

SEQ ID NO: 561866 - RNA, 19 nt, Homo sapiens
caaguguacggcugugaua

SEQ ID NO: 561867 - RNA, 19 nt, Homo sapiens
gaggaggagcaaaguguuu

SEQ ID NO: 561868 - RNA, 19 nt, Homo sapiens
ucaaagugcugggauuaca

SEQ ID NO: 561869 - RNA, 19 nt, Homo sapiens
acaaagaagcguguaugua

SEQ ID NO: 561870 - RNA, 19 nt, Homo sapiens
gcuagcagcacucacuauu

SEQ ID NO: 561871 - RNA, 19 nt, Homo sapiens
gguaccaucuucagcaagu

SEQ ID NO: 561872 - RNA, 19 nt, Homo sapiens
ggacucagcaggccaaagg

SEQ ID NO: 561873 - RNA, 19 nt, Homo sapiens
caacccagccaucuucaga

SEQ ID NO: 561874 - RNA, 19 nt, Homo sapiens
ugucuucagugcccaauau

SEQ ID NO: 561875 - RNA, 19 nt, Homo sapiens
acucugcccuucaacauug

SEQ ID NO: 561876 - RNA, 19 nt, Homo sapiens
gcagauacaaacuuuacga

SEQ ID NO: 561877 - RNA, 19 nt, Homo sapiens
aaacaacccagccaucuuc

SEQ ID NO: 561878 - RNA, 19 nt, Homo sapiens
uugagaagguccaaguuug

SEQ ID NO: 561879 - RNA, 19 nt, Homo sapiens
gccauuugcuuuugauuuu

SEQ ID NO: 561880 - RNA, 19 nt, Homo sapiens
ucacaagaucugaugguuu

SEQ ID NO: 561881 - RNA, 19 nt, Homo sapiens
gcaucaaucauaacaaagu

SEQ ID NO: 561882 - RNA, 19 nt, Homo sapiens
gaaacagaagggcaucaau

SEQ ID NO: 561883 - RNA, 19 nt, Homo sapiens
uagcagcacucacuauugc

SEQ ID NO: 561884 - RNA, 19 nt, Homo sapiens
gcaccuugcccuccaguuc

SEQ ID NO: 561885 - RNA, 19 nt, Homo sapiens
gcugugacccgaaggaaug

SEQ ID NO: 561886 - RNA, 19 nt, Homo sapiens
aaagaagcguguauguagu

SEQ ID NO: 561887 - RNA, 19 nt, Homo sapiens
ccucaccucucauuugcuu

SEQ ID NO: 561888 - RNA, 19 nt, Homo sapiens
ccucaucugugcccuguuc

SEQ ID NO: 561889 - RNA, 19 nt, Homo sapiens
uacaggaucuggcugaaag

SEQ ID NO: 561890 - RNA, 19 nt, Homo sapiens
ccaccaugacuguaaguuu

SEQ ID NO: 561891 - RNA, 19 nt, Homo sapiens
ccuuuggucuguucuguga

SEQ ID NO: 561892 - RNA, 19 nt, Homo sapiens
ucuacuaccugacagugaa

SEQ ID NO: 561893 - RNA, 19 nt, Homo sapiens
gguagagccugugucuuca

SEQ ID NO: 561894 - RNA, 19 nt, Homo sapiens
uggcuucuguuuccuguga

SEQ ID NO: 561895 - RNA, 19 nt, Homo sapiens
uccagcagauacaaacuuu

SEQ ID NO: 561896 - RNA, 19 nt, Homo sapiens
gcccucuucugcgaaauaa

SEQ ID NO: 561897 - RNA, 19 nt, Homo sapiens
aaacagaagggcaucaauc

SEQ ID NO: 561898 - RNA, 19 nt, Homo sapiens
caaacaacccagccaucuu

SEQ ID NO: 561899 - RNA, 19 nt, Homo sapiens
acauugcagucaccuugua

SEQ ID NO: 561900 - RNA, 19 nt, Homo sapiens
ggauuucacggcuacaaug

SEQ ID NO: 561901 - RNA, 19 nt, Homo sapiens
cgacucggccucucaaagu

SEQ ID NO: 561902 - RNA, 19 nt, Homo sapiens
ccacuacaaccucuucuuc

SEQ ID NO: 561903 - RNA, 19 nt, Homo sapiens
ggaccgcucaggugauguu

SEQ ID NO: 561904 - RNA, 19 nt, Homo sapiens
gcuguucucgugauaguga

SEQ ID NO: 561905 - RNA, 19 nt, Homo sapiens
gcagaaugauaugguuugg

SEQ ID NO: 561906 - RNA, 19 nt, Homo sapiens
gugcugcccuggcuaacau

SEQ ID NO: 561907 - RNA, 19 nt, Homo sapiens
uuacaagccaucccuguug

SEQ ID NO: 561908 - RNA, 19 nt, Homo sapiens
cagaugaaacuuuggacuu

SEQ ID NO: 561909 - RNA, 19 nt, Homo sapiens
guccacaccugaauaucau

SEQ ID NO: 561910 - RNA, 19 nt, Homo sapiens
ggcaacggauugagacucu

SEQ ID NO: 561911 - RNA, 19 nt, Homo sapiens
ucucaaagugcugggauua

SEQ ID NO: 561912 - RNA, 19 nt, Homo sapiens
ggaggaggagcaaaguguu

SEQ ID NO: 561913 - RNA, 19 nt, Homo sapiens
cgggcgacaugaaggagua

SEQ ID NO: 561914 - RNA, 19 nt, Homo sapiens
ugaagaaguuugugaagau

SEQ ID NO: 561915 - RNA, 19 nt, Homo sapiens
ggaagaagcaccagaccaa

SEQ ID NO: 561916 - RNA, 19 nt, Homo sapiens
ggagcuaccuggcacauac

SEQ ID NO: 561917 - RNA, 19 nt, Homo sapiens
gaagaaguuugugaagauc

SEQ ID NO: 561918 - RNA, 19 nt, Homo sapiens
gugaagaaguuugugaaga

SEQ ID NO: 561919 - RNA, 19 nt, Homo sapiens
gccaggugcucuugccuuu

SEQ ID NO: 561920 - RNA, 19 nt, Homo sapiens
gcagagagacucggagaug

SEQ ID NO: 561921 - RNA, 19 nt, Homo sapiens
caccugggcuccuaugaau

SEQ ID NO: 561922 - RNA, 19 nt, Homo sapiens
cagauugacuacccugaga

SEQ ID NO: 561923 - RNA, 19 nt, Homo sapiens
gcuacaaagugaccaagca

SEQ ID NO: 561924 - RNA, 19 nt, Homo sapiens
caacaaggacccguacuuc

SEQ ID NO: 561925 - RNA, 19 nt, Homo sapiens
gggcuccuaugaaugcaaa

SEQ ID NO: 561926 - RNA, 19 nt, Homo sapiens
gcgaaacgaggaggagaua

SEQ ID NO: 561927 - RNA, 19 nt, Homo sapiens
gaaacgaggaggagauaac

SEQ ID NO: 561928 - RNA, 19 nt, Homo sapiens
ccacgucaccgcuucaugu

SEQ ID NO: 561929 - RNA, 19 nt, Homo sapiens
ccaucgacaucaacaagga

SEQ ID NO: 561930 - RNA, 19 nt, Homo sapiens
gagcagagagaucgacaag

SEQ ID NO: 561931 - RNA, 19 nt, Homo sapiens
ugacacuucacaacaauga

SEQ ID NO: 561932 - RNA, 19 nt, Homo sapiens
caaggacccguacuucaug

SEQ ID NO: 561933 - RNA, 19 nt, Homo sapiens
cgaaggcccagggaacaua

SEQ ID NO: 561934 - RNA, 19 nt, Homo sapiens
gaggugaagaaguuuguga

SEQ ID NO: 561935 - RNA, 19 nt, Homo sapiens
gccugacacuucacaacaa

SEQ ID NO: 561936 - RNA, 19 nt, Homo sapiens
caaagugaccaagcagaga

SEQ ID NO: 561937 - RNA, 19 nt, Homo sapiens
ccaguuccacuuuaagaug

SEQ ID NO: 561938 - RNA, 19 nt, Homo sapiens
gcaguucuuccuccaguuc

SEQ ID NO: 561939 - RNA, 19 nt, Homo sapiens
agguggaggugaagaaguu

SEQ ID NO: 561940 - RNA, 19 nt, Homo sapiens
aaacucugccugacacuuc

SEQ ID NO: 561941 - RNA, 19 nt, Homo sapiens
ccaccugggcuccuaugaa

SEQ ID NO: 561942 - RNA, 19 nt, Homo sapiens
gaaggcugcucuuuuguac

SEQ ID NO: 561943 - RNA, 19 nt, Homo sapiens
ucaacaaggacccguacuu

SEQ ID NO: 561944 - RNA, 19 nt, Homo sapiens
gaccaucgacaucaacaag

SEQ ID NO: 561945 - RNA, 19 nt, Homo sapiens
ggcaaguucuggacacacu

SEQ ID NO: 561946 - RNA, 19 nt, Homo sapiens
ccugacacuucacaacaau

SEQ ID NO: 561947 - RNA, 19 nt, Homo sapiens
agaaccaccugggcuccua

SEQ ID NO: 561948 - RNA, 19 nt, Homo sapiens
acaaggacccguacuucau

SEQ ID NO: 561949 - RNA, 19 nt, Homo sapiens
gagccuccucuuccagauu

SEQ ID NO: 561950 - RNA, 19 nt, Homo sapiens
ucaagguggaggugaagaa

SEQ ID NO: 561951 - RNA, 19 nt, Homo sapiens
cgagaccauugccuucaag

SEQ ID NO: 561952 - RNA, 19 nt, Homo sapiens
gaucgccgagggcaucaug

SEQ ID NO: 561953 - RNA, 19 nt, Homo sapiens
uggagaccaucgacaucaa

SEQ ID NO: 561954 - RNA, 19 nt, Homo sapiens
gaaccaccugggcuccuau

SEQ ID NO: 561955 - RNA, 19 nt, Homo sapiens
caccgcugccugagucuuu

SEQ ID NO: 561956 - RNA, 19 nt, Homo sapiens
ggaguucaccccucaaauc

SEQ ID NO: 561957 - RNA, 19 nt, Homo sapiens
aaggacccguacuucauga

SEQ ID NO: 561958 - RNA, 19 nt, Homo sapiens
uuccuccaguuccacuuua

SEQ ID NO: 561959 - RNA, 19 nt, Homo sapiens
agccuccucuuccagauug

SEQ ID NO: 561960 - RNA, 19 nt, Homo sapiens
gcccuaaggccaucaccau

SEQ ID NO: 561961 - RNA, 19 nt, Homo sapiens
gggagcuaccuggcacaua

SEQ ID NO: 561962 - RNA, 19 nt, Homo sapiens
ggagacgccugacuacuug

SEQ ID NO: 561963 - RNA, 19 nt, Homo sapiens
gcaagaagguucaguuucg

SEQ ID NO: 561964 - RNA, 19 nt, Homo sapiens
ggugagagaggauuuauuu

SEQ ID NO: 561965 - RNA, 19 nt, Homo sapiens
gcagcaagcccaagaagaa

SEQ ID NO: 561966 - RNA, 19 nt, Homo sapiens
gaagugccauugucaucaa

SEQ ID NO: 561967 - RNA, 19 nt, Homo sapiens
gcgaguaccugcacagcaa

SEQ ID NO: 561968 - RNA, 19 nt, Homo sapiens
gcagcaaggugucgguguu

SEQ ID NO: 561969 - RNA, 19 nt, Homo sapiens
ccaagaagaaguccaagaa

SEQ ID NO: 561970 - RNA, 19 nt, Homo sapiens
gaggccaucuauccgauuu

SEQ ID NO: 561971 - RNA, 19 nt, Homo sapiens
uuacagaggucgucgaaag

SEQ ID NO: 561972 - RNA, 19 nt, Homo sapiens
ccaagaagcacaaagacaa

SEQ ID NO: 561973 - RNA, 19 nt, Homo sapiens
acaaggaugugcagaagga

SEQ ID NO: 561974 - RNA, 19 nt, Homo sapiens
guacaaggaugugcagaag

SEQ ID NO: 561975 - RNA, 19 nt, Homo sapiens
ggauaucgcacuucacuca

SEQ ID NO: 561976 - RNA, 19 nt, Homo sapiens
gggcaagaagguucaguuu

SEQ ID NO: 561977 - RNA, 19 nt, Homo sapiens
caguaugucuccagucaug

SEQ ID NO: 561978 - RNA, 19 nt, Homo sapiens
ggccugcccugcuauuuca

SEQ ID NO: 561979 - RNA, 19 nt, Homo sapiens
uguccucgguuucccauuu

SEQ ID NO: 561980 - RNA, 19 nt, Homo sapiens
cgacuucaaugccgaguac

SEQ ID NO: 561981 - RNA, 19 nt, Homo sapiens
gcuaaggacggcacgugua

SEQ ID NO: 561982 - RNA, 19 nt, Homo sapiens
gucucuggcucuacguuua

SEQ ID NO: 561983 - RNA, 19 nt, Homo sapiens
gagccgaagugccauuguc

SEQ ID NO: 561984 - RNA, 19 nt, Homo sapiens
gagcucagccugccgucaa

SEQ ID NO: 561985 - RNA, 19 nt, Homo sapiens
gcugcagccuccugauuuc

SEQ ID NO: 561986 - RNA, 19 nt, Homo sapiens
gcagguggccaacaugagu

SEQ ID NO: 561987 - RNA, 19 nt, Homo sapiens
gugagagaggauuuauuua

SEQ ID NO: 561988 - RNA, 19 nt, Homo sapiens
ucuauccgauuucaaggaa

SEQ ID NO: 561989 - RNA, 19 nt, Homo sapiens
caaaagagaagcaaaaucu

SEQ ID NO: 561990 - RNA, 19 nt, Homo sapiens
guacaaaagagaagcaaaa

SEQ ID NO: 561991 - RNA, 19 nt, Homo sapiens
cuacaagaacgacuucaau

SEQ ID NO: 561992 - RNA, 19 nt, Homo sapiens
gagcagcgccagagcuaca

SEQ ID NO: 561993 - RNA, 19 nt, Homo sapiens
ggacaaggacgcgcuggau

SEQ ID NO: 561994 - RNA, 19 nt, Homo sapiens
ggccaucuauccgauuuca

SEQ ID NO: 561995 - RNA, 19 nt, Homo sapiens
gcgcggacguucuccuucu

SEQ ID NO: 561996 - RNA, 19 nt, Homo sapiens
gcucauuccacacuguuga

SEQ ID NO: 561997 - RNA, 19 nt, Homo sapiens
uuucugugcuccaaguuga

SEQ ID NO: 561998 - RNA, 19 nt, Homo sapiens
cggagacgccugacuacuu

SEQ ID NO: 561999 - RNA, 19 nt, Homo sapiens
gcagccuccugauuucauc

SEQ ID NO: 562000 - RNA, 19 nt, Homo sapiens
cgacgacuccuaccagaag

SEQ ID NO: 562001 - RNA, 19 nt, Homo sapiens
aaauaaacccgaggaagau

SEQ ID NO: 562002 - RNA, 19 nt, Homo sapiens
caagcuggcccacaucaag

SEQ ID NO: 562003 - RNA, 19 nt, Homo sapiens
ugacgcaggcggacaagga

SEQ ID NO: 562004 - RNA, 19 nt, Homo sapiens
gcgagugccaucaggaaga

SEQ ID NO: 562005 - RNA, 19 nt, Homo sapiens
aaaauaaacccgaggaaga

SEQ ID NO: 562006 - RNA, 19 nt, Homo sapiens
gcuacaagaacgacuucaa

SEQ ID NO: 562007 - RNA, 19 nt, Homo sapiens
caagaagaaguccaagaag

SEQ ID NO: 562008 - RNA, 19 nt, Homo sapiens
ugaaggaggauaggagcua

SEQ ID NO: 562009 - RNA, 19 nt, Homo sapiens
ugagggccuucgagagcua

SEQ ID NO: 562010 - RNA, 19 nt, Homo sapiens
gccgcuaccugggcaagaa

SEQ ID NO: 562011 - RNA, 19 nt, Homo sapiens
cagcauacaggacaagauc

SEQ ID NO: 562012 - RNA, 19 nt, Homo sapiens
ccagguggcuauuuugaga

SEQ ID NO: 562013 - RNA, 19 nt, Homo sapiens
gcagacaccccagguuuaa

SEQ ID NO: 562014 - RNA, 19 nt, Homo sapiens
agaagaaguccaagaagca

SEQ ID NO: 562015 - RNA, 19 nt, Homo sapiens
cagcagguggccaacauga

SEQ ID NO: 562016 - RNA, 19 nt, Homo sapiens
caagaagcacaaagacaag

SEQ ID NO: 562017 - RNA, 19 nt, Homo sapiens
uggccgaugucagcaauga

SEQ ID NO: 562018 - RNA, 19 nt, Homo sapiens
cuacugcuaaugagacuug

SEQ ID NO: 562019 - RNA, 19 nt, Homo sapiens
gcgccugccuuuucuaguu

SEQ ID NO: 562020 - RNA, 19 nt, Homo sapiens
ccaacuacagccaggagaa

SEQ ID NO: 562021 - RNA, 19 nt, Homo sapiens
ucacugaggccaucuaucc

SEQ ID NO: 562022 - RNA, 19 nt, Homo sapiens
uacaagaacgacuucaaug

SEQ ID NO: 562023 - RNA, 19 nt, Homo sapiens
acgcagccaucuccucuuc

SEQ ID NO: 562024 - RNA, 19 nt, Homo sapiens
ggcaagaagguucaguuuc

SEQ ID NO: 562025 - RNA, 19 nt, Homo sapiens
gcaagcuggcccacaucaa

SEQ ID NO: 562026 - RNA, 19 nt, Homo sapiens
guccucgguuucccauuug

SEQ ID NO: 562027 - RNA, 19 nt, Homo sapiens
ggucucuggcucuacguuu

SEQ ID NO: 562028 - RNA, 19 nt, Homo sapiens
cugcagcguuuccaguguu

SEQ ID NO: 562029 - RNA, 19 nt, Homo sapiens
caacaagaaaccccggaua

SEQ ID NO: 562030 - RNA, 19 nt, Homo sapiens
ggacugcauguacaaggau

SEQ ID NO: 562031 - RNA, 19 nt, Homo sapiens
uggccaacaugagugcuaa

SEQ ID NO: 562032 - RNA, 19 nt, Homo sapiens
gagcuacaagaacgacuuc

SEQ ID NO: 562033 - RNA, 19 nt, Homo sapiens
cgaagugccauugucauca

SEQ ID NO: 562034 - RNA, 19 nt, Homo sapiens
agcaguaugucuccaguca

SEQ ID NO: 562035 - RNA, 19 nt, Homo sapiens
gaagcaccgcugcgaguac

SEQ ID NO: 562036 - RNA, 19 nt, Homo sapiens
gcaagcccaagaagaaguc

SEQ ID NO: 562037 - RNA, 19 nt, Homo sapiens
ccaucuauccgauuucaag

SEQ ID NO: 562038 - RNA, 19 nt, Homo sapiens
gggcagauuuugcaggaau

SEQ ID NO: 562039 - RNA, 19 nt, Homo sapiens
ggacaagaucacggugugu

SEQ ID NO: 562040 - RNA, 19 nt, Homo sapiens
gcugcucauuccacacugu

SEQ ID NO: 562041 - RNA, 19 nt, Homo sapiens
ccuccugucucgccagaag

SEQ ID NO: 562042 - RNA, 19 nt, Homo sapiens
ccuucuaccucuccaacau

SEQ ID NO: 562043 - RNA, 19 nt, Homo sapiens
gaaguccaagaagcacaaa

SEQ ID NO: 562044 - RNA, 19 nt, Homo sapiens
gcagcauacaggacaagau

SEQ ID NO: 562045 - RNA, 19 nt, Homo sapiens
gccaagggcacaucuccau

SEQ ID NO: 562046 - RNA, 19 nt, Homo sapiens
gguaagaacuucagucaaa

SEQ ID NO: 562047 - RNA, 19 nt, Homo sapiens
caagaaagauccucgcuaa

SEQ ID NO: 562048 - RNA, 19 nt, Homo sapiens
ucagagaaccuucaaguua

SEQ ID NO: 562049 - RNA, 19 nt, Homo sapiens
gaaagucucaagccaaaua

SEQ ID NO: 562050 - RNA, 19 nt, Homo sapiens
cagagaaccuucaaguuaa

SEQ ID NO: 562051 - RNA, 19 nt, Homo sapiens
gggaagggcuuuagucaga

SEQ ID NO: 562052 - RNA, 19 nt, Homo sapiens
ggaggaaugugcuuaaugu

SEQ ID NO: 562053 - RNA, 19 nt, Homo sapiens
gagaaacccugugaccaua

SEQ ID NO: 562054 - RNA, 19 nt, Homo sapiens
gcagaugguuguuuguuga

SEQ ID NO: 562055 - RNA, 19 nt, Homo sapiens
gaugacaacucagcaauga

SEQ ID NO: 562056 - RNA, 19 nt, Homo sapiens
gagagaagccuuaccaaug

SEQ ID NO: 562057 - RNA, 19 nt, Homo sapiens
gcucgaaccuucacauuca

SEQ ID NO: 562058 - RNA, 19 nt, Homo sapiens
gcugcaaacuucuucuaua

SEQ ID NO: 562059 - RNA, 19 nt, Homo sapiens
gaaagauccucgcuaacug

SEQ ID NO: 562060 - RNA, 19 nt, Homo sapiens
gaagaaagcacugagagaa

SEQ ID NO: 562061 - RNA, 19 nt, Homo sapiens
caaagugguuguuucgaaa

SEQ ID NO: 562062 - RNA, 19 nt, Homo sapiens
ggauggaaguagccaagua

SEQ ID NO: 562063 - RNA, 19 nt, Homo sapiens
gaugaaauguggcugagau

SEQ ID NO: 562064 - RNA, 19 nt, Homo sapiens
gcagacgucucuuuguaau

SEQ ID NO: 562065 - RNA, 19 nt, Homo sapiens
aagcagacgucucuuugua

SEQ ID NO: 562066 - RNA, 19 nt, Homo sapiens
ucagugaaguucuguaaga

SEQ ID NO: 562067 - RNA, 19 nt, Homo sapiens
gaaacauauuugccuuuga

SEQ ID NO: 562068 - RNA, 19 nt, Homo sapiens
ggaaugugcuuaauguuuu

SEQ ID NO: 562069 - RNA, 19 nt, Homo sapiens
ugagaagccuuauaagugu

SEQ ID NO: 562070 - RNA, 19 nt, Homo sapiens
cagaugagaagccuuauaa

SEQ ID NO: 562071 - RNA, 19 nt, Homo sapiens
gaagguagucaguguggua

SEQ ID NO: 562072 - RNA, 19 nt, Homo sapiens
gagaaacaauacgaaggua

SEQ ID NO: 562073 - RNA, 19 nt, Homo sapiens
gaacuugagcguagauaug

SEQ ID NO: 562074 - RNA, 19 nt, Homo sapiens
gaagagagugacacagaaa

SEQ ID NO: 562075 - RNA, 19 nt, Homo sapiens
ucaaagugguuguuucgaa

SEQ ID NO: 562076 - RNA, 19 nt, Homo sapiens
uaagaaaugugaggucaga

SEQ ID NO: 562077 - RNA, 19 nt, Homo sapiens
uaacugacauuagcccauu

SEQ ID NO: 562078 - RNA, 19 nt, Homo sapiens
cuacaaaugugagcaaugu

SEQ ID NO: 562079 - RNA, 19 nt, Homo sapiens
ggaaguagccaaguaagug

SEQ ID NO: 562080 - RNA, 19 nt, Homo sapiens
ggauuguucuuguuucuca

SEQ ID NO: 562081 - RNA, 19 nt, Homo sapiens
gaauggauuguucuuguuu

SEQ ID NO: 562082 - RNA, 19 nt, Homo sapiens
gcucaaaccugcacaucca

SEQ ID NO: 562083 - RNA, 19 nt, Homo sapiens
gaaacccugugaccauaau

SEQ ID NO: 562084 - RNA, 19 nt, Homo sapiens
aaucacagguggucaguug

SEQ ID NO: 562085 - RNA, 19 nt, Homo sapiens
gagagaggcccuacaagug

SEQ ID NO: 562086 - RNA, 19 nt, Homo sapiens
ggcauggccaguacaauua

SEQ ID NO: 562087 - RNA, 19 nt, Homo sapiens
uggagaaucuucagcagaa

SEQ ID NO: 562088 - RNA, 19 nt, Homo sapiens
ccaaguaagugagaaagga

SEQ ID NO: 562089 - RNA, 19 nt, Homo sapiens
cggcaagaacuuuauauuu

SEQ ID NO: 562090 - RNA, 19 nt, Homo sapiens
ggagagaggcccuacaagu

SEQ ID NO: 562091 - RNA, 19 nt, Homo sapiens
gaaguagccaaguaaguga

SEQ ID NO: 562092 - RNA, 19 nt, Homo sapiens
gauguaaggguuauuuaga

SEQ ID NO: 562093 - RNA, 19 nt, Homo sapiens
gagauguaaggguuauuua

SEQ ID NO: 562094 - RNA, 19 nt, Homo sapiens
gaugagaagccuuauaagu

SEQ ID NO: 562095 - RNA, 19 nt, Homo sapiens
acacagaugagaagccuua

SEQ ID NO: 562096 - RNA, 19 nt, Homo sapiens
caagucugcucauccauca

SEQ ID NO: 562097 - RNA, 19 nt, Homo sapiens
ggagaaacccugugaccau

SEQ ID NO: 562098 - RNA, 19 nt, Homo sapiens
ggaagaaagcacugagaga

SEQ ID NO: 562099 - RNA, 19 nt, Homo sapiens
gggugaagaugacaacuca

SEQ ID NO: 562100 - RNA, 19 nt, Homo sapiens
gaagggauuuagccagagu

SEQ ID NO: 562101 - RNA, 19 nt, Homo sapiens
gaucuucgcauccaucuca

SEQ ID NO: 562102 - RNA, 19 nt, Homo sapiens
ggagagaagccuuaccaau

SEQ ID NO: 562103 - RNA, 19 nt, Homo sapiens
ugaaacauauuugccuuug

SEQ ID NO: 562104 - RNA, 19 nt, Homo sapiens
gauggaaguagccaaguaa

SEQ ID NO: 562105 - RNA, 19 nt, Homo sapiens
gggcauguuucccuuuguu

SEQ ID NO: 562106 - RNA, 19 nt, Homo sapiens
gcuguacaaugaauggauu

SEQ ID NO: 562107 - RNA, 19 nt, Homo sapiens
uggcuuagcucacucagau

SEQ ID NO: 562108 - RNA, 19 nt, Homo sapiens
cuacaaguguggugagugu

SEQ ID NO: 562109 - RNA, 19 nt, Homo sapiens
ucagagagaccacacagaa

SEQ ID NO: 562110 - RNA, 19 nt, Homo sapiens
ggaagucaggauuguauug

SEQ ID NO: 562111 - RNA, 19 nt, Homo sapiens
gcacuguggagauuaagaa

SEQ ID NO: 562112 - RNA, 19 nt, Homo sapiens
ggagagaagcccuaugagu

SEQ ID NO: 562113 - RNA, 19 nt, Homo sapiens
ggagagaagcccuaugagu

SEQ ID NO: 562114 - RNA, 19 nt, Homo sapiens
gaaacaauacgaagguagu

SEQ ID NO: 562115 - RNA, 19 nt, Homo sapiens
gacuguaacugcaaagaca

SEQ ID NO: 562116 - RNA, 19 nt, Homo sapiens
agagaaccuucaaguuaaa

SEQ ID NO: 562117 - RNA, 19 nt, Homo sapiens
acagaaagauucaguagcu

SEQ ID NO: 562118 - RNA, 19 nt, Homo sapiens
gaagaugacaacucagcaa

SEQ ID NO: 562119 - RNA, 19 nt, Homo sapiens
ugaauggauuguucuuguu

SEQ ID NO: 562120 - RNA, 19 nt, Homo sapiens
gcuacuacuucaucagaga

SEQ ID NO: 562121 - RNA, 19 nt, Homo sapiens
gcaaacuucuucuauaccu

SEQ ID NO: 562122 - RNA, 19 nt, Homo sapiens
ucccugagcugcaaacuuc

SEQ ID NO: 562123 - RNA, 19 nt, Homo sapiens
gcucaagucugcucaucca

SEQ ID NO: 562124 - RNA, 19 nt, Homo sapiens
cauaauaacugugggaaaa

SEQ ID NO: 562125 - RNA, 19 nt, Homo sapiens
agaagagagugacacagaa

SEQ ID NO: 562126 - RNA, 19 nt, Homo sapiens
gagagagauguaaggguua

SEQ ID NO: 562127 - RNA, 19 nt, Homo sapiens
gagcuacuacuucaucaga

SEQ ID NO: 562128 - RNA, 19 nt, Homo sapiens
gguagucagugugguaaga

SEQ ID NO: 562129 - RNA, 19 nt, Homo sapiens
agacauucauggauggaaa

SEQ ID NO: 562130 - RNA, 19 nt, Homo sapiens
ggagaaucuucagcagaaa

SEQ ID NO: 562131 - RNA, 19 nt, Homo sapiens
uaacggcaagaacuuuaua

SEQ ID NO: 562132 - RNA, 19 nt, Homo sapiens
cgagucugcuuauccauca

SEQ ID NO: 562133 - RNA, 19 nt, Homo sapiens
uucaggaucuguuacauga

SEQ ID NO: 562134 - RNA, 19 nt, Homo sapiens
gaggaggaaugugcuuaau

SEQ ID NO: 562135 - RNA, 19 nt, Homo sapiens
gauccucgcuaacugacau

SEQ ID NO: 562136 - RNA, 19 nt, Homo sapiens
agagaagccuuaccaaugc

SEQ ID NO: 562137 - RNA, 19 nt, Homo sapiens
aauccacacugcagagaaa

SEQ ID NO: 562138 - RNA, 19 nt, Homo sapiens
ugugaugacucuucaaagu

SEQ ID NO: 562139 - RNA, 19 nt, Homo sapiens
ggaaccaguuacauucaag

SEQ ID NO: 562140 - RNA, 19 nt, Homo sapiens
guaagaacuucagucaaag

SEQ ID NO: 562141 - RNA, 19 nt, Homo sapiens
gaaagugaaacauauuugc

SEQ ID NO: 562142 - RNA, 19 nt, Homo sapiens
gagccugaacuagauauuu

SEQ ID NO: 562143 - RNA, 19 nt, Homo sapiens
cuuggagacuugaaugaaa

SEQ ID NO: 562144 - RNA, 19 nt, Homo sapiens
gaaauguggcugagaucau

SEQ ID NO: 562145 - RNA, 19 nt, Homo sapiens
ccagcggguucacaagaaa

SEQ ID NO: 562146 - RNA, 19 nt, Homo sapiens
gggaguauguggagaaauu

SEQ ID NO: 562147 - RNA, 19 nt, Homo sapiens
ucaaugggcuggagaagaa

SEQ ID NO: 562148 - RNA, 19 nt, Homo sapiens
gagcguggcaucacaguuu

SEQ ID NO: 562149 - RNA, 19 nt, Homo sapiens
ggaggacgaugaggacaaa

SEQ ID NO: 562150 - RNA, 19 nt, Homo sapiens
caacaaagacccacacuac

SEQ ID NO: 562151 - RNA, 19 nt, Homo sapiens
ugaagcagguguggaagua

SEQ ID NO: 562152 - RNA, 19 nt, Homo sapiens
gaaauuugcccucaacuac

SEQ ID NO: 562153 - RNA, 19 nt, Homo sapiens
ggacaucacagcugaguuc

SEQ ID NO: 562154 - RNA, 19 nt, Homo sapiens
ggagaaauuugcccucaac

SEQ ID NO: 562155 - RNA, 19 nt, Homo sapiens
ucaaacgcauguaugagaa

SEQ ID NO: 562156 - RNA, 19 nt, Homo sapiens
gcaaggaggagcccaagga

SEQ ID NO: 562157 - RNA, 19 nt, Homo sapiens
gcagaucuccggccaguca

SEQ ID NO: 562158 - RNA, 19 nt, Homo sapiens
gaucaucgcauuccaagca

SEQ ID NO: 562159 - RNA, 19 nt, Homo sapiens
ccacacuacuggacaacuu

SEQ ID NO: 562160 - RNA, 19 nt, Homo sapiens
gaucaccaaugacucaaag

SEQ ID NO: 562161 - RNA, 19 nt, Homo sapiens
ggagaaaccagaccagaag

SEQ ID NO: 562162 - RNA, 19 nt, Homo sapiens
ggacggaggagacagugaa

SEQ ID NO: 562163 - RNA, 19 nt, Homo sapiens
gcaaguacugcgaggauga

SEQ ID NO: 562164 - RNA, 19 nt, Homo sapiens
ggacaucauccugcuauug

SEQ ID NO: 562165 - RNA, 19 nt, Homo sapiens
gcacggaagcccagaucaa

SEQ ID NO: 562166 - RNA, 19 nt, Homo sapiens
gcaccuaucugggcauguc

SEQ ID NO: 562167 - RNA, 19 nt, Homo sapiens
gagagcuccugaucgcauu

SEQ ID NO: 562168 - RNA, 19 nt, Homo sapiens
gagggaaacucagccuugu

SEQ ID NO: 562169 - RNA, 19 nt, Homo sapiens
ggaugagagucgcaccuau

SEQ ID NO: 562170 - RNA, 19 nt, Homo sapiens
gagaagaugcuaugaagac

SEQ ID NO: 562171 - RNA, 19 nt, Homo sapiens
ugaaauccaucaucaaagc

SEQ ID NO: 562172 - RNA, 19 nt, Homo sapiens
gcucauggccacacagaug

SEQ ID NO: 562173 - RNA, 19 nt, Homo sapiens
ugacccagcucuacaaggu

SEQ ID NO: 562174 - RNA, 19 nt, Homo sapiens
gcacagccucacagacaaa

SEQ ID NO: 562175 - RNA, 19 nt, Homo sapiens
gcccugcaguggaugguaa

SEQ ID NO: 562176 - RNA, 19 nt, Homo sapiens
gcccagguccgcauaaaga

SEQ ID NO: 562177 - RNA, 19 nt, Homo sapiens
gcugacgccugauaaugug

SEQ ID NO: 562178 - RNA, 19 nt, Homo sapiens
uggagaagaugcuaugaag

SEQ ID NO: 562179 - RNA, 19 nt, Homo sapiens
caagcgagacauugaguug

SEQ ID NO: 562180 - RNA, 19 nt, Homo sapiens
acagagagcguccugauca

SEQ ID NO: 562181 - RNA, 19 nt, Homo sapiens
gcacccacgccaucaaguu

SEQ ID NO: 562182 - RNA, 19 nt, Homo sapiens
gagcugacaaggacacaga

SEQ ID NO: 562183 - RNA, 19 nt, Homo sapiens
agaagguggugaagacaga

SEQ ID NO: 562184 - RNA, 19 nt, Homo sapiens
caacauugacuccgugaag

SEQ ID NO: 562185 - RNA, 19 nt, Homo sapiens
guucaugucugaggugauc

SEQ ID NO: 562186 - RNA, 19 nt, Homo sapiens
gcgggugcuuugccuuaaa

SEQ ID NO: 562187 - RNA, 19 nt, Homo sapiens
ggagaagaugcuaugaaga

SEQ ID NO: 562188 - RNA, 19 nt, Homo sapiens
uccagucccugaccaugua

SEQ ID NO: 562189 - RNA, 19 nt, Homo sapiens
accaaugacucaaagauca

SEQ ID NO: 562190 - RNA, 19 nt, Homo sapiens
cgggcucccuggacaagua

SEQ ID NO: 562191 - RNA, 19 nt, Homo sapiens
gauccaggccuaugaaacu

SEQ ID NO: 562192 - RNA, 19 nt, Homo sapiens
gcagcugggagccgucuuu

SEQ ID NO: 562193 - RNA, 19 nt, Homo sapiens
gggagggcuucaucaagug

SEQ ID NO: 562194 - RNA, 19 nt, Homo sapiens
ugggagggcuucaucaagu

SEQ ID NO: 562195 - RNA, 19 nt, Homo sapiens
gcagugugcguaagaaucu

SEQ ID NO: 562196 - RNA, 19 nt, Homo sapiens
ugucuggccugcaggagaa

SEQ ID NO: 562197 - RNA, 19 nt, Homo sapiens
cagagagggugguggaucu

SEQ ID NO: 562198 - RNA, 19 nt, Homo sapiens
cugauaauguggcuaaucu

SEQ ID NO: 562199 - RNA, 19 nt, Homo sapiens
acaaagacccacacuacug

SEQ ID NO: 562200 - RNA, 19 nt, Homo sapiens
gaucgcauuacacaacauu

SEQ ID NO: 562201 - RNA, 19 nt, Homo sapiens
agaaauuugcccucaacua

SEQ ID NO: 562202 - RNA, 19 nt, Homo sapiens
cagagagcguccugaucaa

SEQ ID NO: 562203 - RNA, 19 nt, Homo sapiens
ugccuaaacucaucaaacu

SEQ ID NO: 562204 - RNA, 19 nt, Homo sapiens
agacacuggucacgagaug

SEQ ID NO: 562205 - RNA, 19 nt, Homo sapiens
ggaguauguggagaaauuu

SEQ ID NO: 562206 - RNA, 19 nt, Homo sapiens
gcgggaguauguggagaaa

SEQ ID NO: 562207 - RNA, 19 nt, Homo sapiens
gaugagagucgcaccuauc

SEQ ID NO: 562208 - RNA, 19 nt, Homo sapiens
gaaaccagaccagaaggau

SEQ ID NO: 562209 - RNA, 19 nt, Homo sapiens
ucaugaagcagguguggaa

SEQ ID NO: 562210 - RNA, 19 nt, Homo sapiens
gcugaucaccaaugacuca

SEQ ID NO: 562211 - RNA, 19 nt, Homo sapiens
ccuaaacucaucaaacuca

SEQ ID NO: 562212 - RNA, 19 nt, Homo sapiens
ggugguggaucuucugaac

SEQ ID NO: 562213 - RNA, 19 nt, Homo sapiens
gacccacacuacuggacaa

SEQ ID NO: 562214 - RNA, 19 nt, Homo sapiens
gagcagccgauccgaggaa

SEQ ID NO: 562215 - RNA, 19 nt, Homo sapiens
aggagcagcugcgggagua

SEQ ID NO: 562216 - RNA, 19 nt, Homo sapiens
gcuaaucugguccucauca

SEQ ID NO: 562217 - RNA, 19 nt, Homo sapiens
gcacaccucaggccgagau

SEQ ID NO: 562218 - RNA, 19 nt, Homo sapiens
gacaucauccugcuauugg

SEQ ID NO: 562219 - RNA, 19 nt, Homo sapiens
cggcgcugaucaccaauga

SEQ ID NO: 562220 - RNA, 19 nt, Homo sapiens
aaagaucacagugcucaaa

SEQ ID NO: 562221 - RNA, 19 nt, Homo sapiens
gcaagcgagacauugaguu

SEQ ID NO: 562222 - RNA, 19 nt, Homo sapiens
ggacggugcugagggucau

SEQ ID NO: 562223 - RNA, 19 nt, Homo sapiens
gaagcugggcgcugugaag

SEQ ID NO: 562224 - RNA, 19 nt, Homo sapiens
guguagagcagaccaaaca

SEQ ID NO: 562225 - RNA, 19 nt, Homo sapiens
acauugaguugcugcugaa

SEQ ID NO: 562226 - RNA, 19 nt, Homo sapiens
cugaggaagccauggauuu

SEQ ID NO: 562227 - RNA, 19 nt, Homo sapiens
ggcaugaccaccucagaga

SEQ ID NO: 562228 - RNA, 19 nt, Homo sapiens
guucaucaaacgcauguau

SEQ ID NO: 562229 - RNA, 19 nt, Homo sapiens
cagcccagguccgcauaaa

SEQ ID NO: 562230 - RNA, 19 nt, Homo sapiens
ggacuccacacucaagaag

SEQ ID NO: 562231 - RNA, 19 nt, Homo sapiens
ugcugaaacucauugcaaa

SEQ ID NO: 562232 - RNA, 19 nt, Homo sapiens
ccaccaaccugugcuuugc

SEQ ID NO: 562233 - RNA, 19 nt, Homo sapiens
uggacaacuuccuggauga

SEQ ID NO: 562234 - RNA, 19 nt, Homo sapiens
ugggcucccuugccaauau

SEQ ID NO: 562235 - RNA, 19 nt, Homo sapiens
gggacaucauccugcuauu

SEQ ID NO: 562236 - RNA, 19 nt, Homo sapiens
guacugcgaggaugagagu

SEQ ID NO: 562237 - RNA, 19 nt, Homo sapiens
ucaacaaagacccacacua

SEQ ID NO: 562238 - RNA, 19 nt, Homo sapiens
aggaugggaucuucaccaa

SEQ ID NO: 562239 - RNA, 19 nt, Homo sapiens
gcggagguccuguccuuca

SEQ ID NO: 562240 - RNA, 19 nt, Homo sapiens
aggcggagguccuguccuu

SEQ ID NO: 562241 - RNA, 19 nt, Homo sapiens
gaggagaagguggugaaga

SEQ ID NO: 562242 - RNA, 19 nt, Homo sapiens
uggcuaaucugguccucau

SEQ ID NO: 562243 - RNA, 19 nt, Homo sapiens
caugcaagcgagacauuga

SEQ ID NO: 562244 - RNA, 19 nt, Homo sapiens
ugaggaagccauggauuuc

SEQ ID NO: 562245 - RNA, 19 nt, Homo sapiens
gagccgucuuugacaagug

SEQ ID NO: 562246 - RNA, 19 nt, Homo sapiens
ucagggagauuacuaugga

SEQ ID NO: 562247 - RNA, 19 nt, Homo sapiens
caaagucgaugugaagaca

SEQ ID NO: 562248 - RNA, 19 nt, Homo sapiens
ccugaaaccuggcaaaguc

SEQ ID NO: 562249 - RNA, 19 nt, Homo sapiens
gagaggaccagacccugaa

SEQ ID NO: 562250 - RNA, 19 nt, Homo sapiens
ggagauuacuauggagauc

SEQ ID NO: 562251 - RNA, 19 nt, Homo sapiens
gccgauuccugaccauuca

SEQ ID NO: 562252 - RNA, 19 nt, Homo sapiens
gccaagugguguaugucuu

SEQ ID NO: 562253 - RNA, 19 nt, Homo sapiens
acaaucagcccagugcaaa

SEQ ID NO: 562254 - RNA, 19 nt, Homo sapiens
gcagcguucagggagauua

SEQ ID NO: 562255 - RNA, 19 nt, Homo sapiens
cuccuuggguuuaugcaaa

SEQ ID NO: 562256 - RNA, 19 nt, Homo sapiens
ccaagugguguaugucuuc

SEQ ID NO: 562257 - RNA, 19 nt, Homo sapiens
cugcucgccugggcuauuu

SEQ ID NO: 562258 - RNA, 19 nt, Homo sapiens
gaugugaagacagacaaau

SEQ ID NO: 562259 - RNA, 19 nt, Homo sapiens
ggugugccuuggugucauc

SEQ ID NO: 562260 - RNA, 19 nt, Homo sapiens
gcaaagucgaugugaagac

SEQ ID NO: 562261 - RNA, 19 nt, Homo sapiens
gcagccacccuaucuccau

SEQ ID NO: 562262 - RNA, 19 nt, Homo sapiens
gagugcagccacccuaucu

SEQ ID NO: 562263 - RNA, 19 nt, Homo sapiens
ggguuuaugcaaauacaau

SEQ ID NO: 562264 - RNA, 19 nt, Homo sapiens
ccauggcuguggcccuuca

SEQ ID NO: 562265 - RNA, 19 nt, Homo sapiens
ggagugcagccacccuauc

SEQ ID NO: 562266 - RNA, 19 nt, Homo sapiens
uggcaaagucgaugugaag

SEQ ID NO: 562267 - RNA, 19 nt, Homo sapiens
ugguguaugucuucuccaa

SEQ ID NO: 562268 - RNA, 19 nt, Homo sapiens
ucaagaagcagcucuauaa

SEQ ID NO: 562269 - RNA, 19 nt, Homo sapiens
gaaggagccuguagaagca

SEQ ID NO: 562270 - RNA, 19 nt, Homo sapiens
ccaggaguuuggcaucuua

SEQ ID NO: 562271 - RNA, 19 nt, Homo sapiens
agaagcagcucuauaacau

SEQ ID NO: 562272 - RNA, 19 nt, Homo sapiens
gcagaaggagccuguagaa

SEQ ID NO: 562273 - RNA, 19 nt, Homo sapiens
ucaugaagcucaagaagca

SEQ ID NO: 562274 - RNA, 19 nt, Homo sapiens
gagagggaccgcuacauga

SEQ ID NO: 562275 - RNA, 19 nt, Homo sapiens
ggagagggaccgcuacaug

SEQ ID NO: 562276 - RNA, 19 nt, Homo sapiens
ccacagacauugccaucca

SEQ ID NO: 562277 - RNA, 19 nt, Homo sapiens
cagaggagaucaugaagcu

SEQ ID NO: 562278 - RNA, 19 nt, Homo sapiens
gggccaagccacagacauu

SEQ ID NO: 562279 - RNA, 19 nt, Homo sapiens
ggccuccucuccagaauca

SEQ ID NO: 562280 - RNA, 19 nt, Homo sapiens
agaagcccauccacaugua

SEQ ID NO: 562281 - RNA, 19 nt, Homo sapiens
caagaagcccauccacaug

SEQ ID NO: 562282 - RNA, 19 nt, Homo sapiens
caacucccguaucaugauc

SEQ ID NO: 562283 - RNA, 19 nt, Homo sapiens
acaagaagcccauccacau

SEQ ID NO: 562284 - RNA, 19 nt, Homo sapiens
gagacacugugauuuuaaa

SEQ ID NO: 562285 - RNA, 19 nt, Homo sapiens
gcagcucuauaacaucuac

SEQ ID NO: 562286 - RNA, 19 nt, Homo sapiens
aagcagcucuauaacaucu

SEQ ID NO: 562287 - RNA, 19 nt, Homo sapiens
ccacgcuggugcagaagga

SEQ ID NO: 562288 - RNA, 19 nt, Homo sapiens
gaucaugaagcucaagaag

SEQ ID NO: 562289 - RNA, 19 nt, Homo sapiens
cagcuccucuuccugcaau

SEQ ID NO: 562290 - RNA, 19 nt, Homo sapiens
gaaccugucccagcuagca

SEQ ID NO: 562291 - RNA, 19 nt, Homo sapiens
gcagaaccugucccagcua

SEQ ID NO: 562292 - RNA, 19 nt, Homo sapiens
cauggaggcccaggaguuu

SEQ ID NO: 562293 - RNA, 19 nt, Homo sapiens
gccaagcacaccaaacaga

SEQ ID NO: 562294 - RNA, 19 nt, Homo sapiens
gaguuuggcaucuuagaca

SEQ ID NO: 562295 - RNA, 19 nt, Homo sapiens
ccauggaggcccaggaguu

SEQ ID NO: 562296 - RNA, 19 nt, Homo sapiens
gaagcagcucuauaacauc

SEQ ID NO: 562297 - RNA, 19 nt, Homo sapiens
gcaacaagaagcccaucca

SEQ ID NO: 562298 - RNA, 19 nt, Homo sapiens
gagaucaugaagcucaaga

SEQ ID NO: 562299 - RNA, 19 nt, Homo sapiens
ucgccucgccgcucacuuu

SEQ ID NO: 562300 - RNA, 19 nt, Homo sapiens
aagaagcagcucuauaaca

SEQ ID NO: 562301 - RNA, 19 nt, Homo sapiens
aauccgagagcaacaagaa

SEQ ID NO: 562302 - RNA, 19 nt, Homo sapiens
aggcagaggagaucaugaa

SEQ ID NO: 562303 - RNA, 19 nt, Homo sapiens
ccauccacauguacaucaa

SEQ ID NO: 562304 - RNA, 19 nt, Homo sapiens
gcucaagaagcagcucuau

SEQ ID NO: 562305 - RNA, 19 nt, Homo sapiens
ucuacgacacgaugcagua

SEQ ID NO: 562306 - RNA, 19 nt, Homo sapiens
caagaagcagcucuauaac

SEQ ID NO: 562307 - RNA, 19 nt, Homo sapiens
aagaagcccauccacaugu

SEQ ID NO: 562308 - RNA, 19 nt, Homo sapiens
ggccaagccacagacauug

SEQ ID NO: 562309 - RNA, 19 nt, Homo sapiens
ucgcacagcuccucuuccu

SEQ ID NO: 562310 - RNA, 19 nt, Homo sapiens
gcaauccgagagcaacaag

SEQ ID NO: 562311 - RNA, 19 nt, Homo sapiens
gaacagggccaaaggaaag

SEQ ID NO: 562312 - RNA, 19 nt, Homo sapiens
guaugucugugauaaguuu

SEQ ID NO: 562313 - RNA, 19 nt, Homo sapiens
agaagaagauugagcugaa

SEQ ID NO: 562314 - RNA, 19 nt, Homo sapiens
cgggacagauuuacacgua

SEQ ID NO: 562315 - RNA, 19 nt, Homo sapiens
ggaaacacacagccaagaa

SEQ ID NO: 562316 - RNA, 19 nt, Homo sapiens
cagaacaacugcuacaucu

SEQ ID NO: 562317 - RNA, 19 nt, Homo sapiens
ucuccgagcuccucaauuc

SEQ ID NO: 562318 - RNA, 19 nt, Homo sapiens
ggaaaaggcuucugcuuac

SEQ ID NO: 562319 - RNA, 19 nt, Homo sapiens
gaagaacagggccaaagga

SEQ ID NO: 562320 - RNA, 19 nt, Homo sapiens
gaagaagauugagcugaag

SEQ ID NO: 562321 - RNA, 19 nt, Homo sapiens
ccucgaggcucuacugugu

SEQ ID NO: 562322 - RNA, 19 nt, Homo sapiens
uggaagacuuggaggauga

SEQ ID NO: 562323 - RNA, 19 nt, Homo sapiens
caagaucgacugugaagca

SEQ ID NO: 562324 - RNA, 19 nt, Homo sapiens
aguacaagaucgacuguga

SEQ ID NO: 562325 - RNA, 19 nt, Homo sapiens
gggcauggacagagccuuu

SEQ ID NO: 562326 - RNA, 19 nt, Homo sapiens
caacggcuacugugacuuc

SEQ ID NO: 562327 - RNA, 19 nt, Homo sapiens
gaaacacacagccaagaag

SEQ ID NO: 562328 - RNA, 19 nt, Homo sapiens
cauuauggacugucagaaa

SEQ ID NO: 562329 - RNA, 19 nt, Homo sapiens
ggaagaacagggccaaagg

SEQ ID NO: 562330 - RNA, 19 nt, Homo sapiens
ggaagaaacggagacucaa

SEQ ID NO: 562331 - RNA, 19 nt, Homo sapiens
guacaagaucgacugugaa

SEQ ID NO: 562332 - RNA, 19 nt, Homo sapiens
gaaggaggaggagaccauu

SEQ ID NO: 562333 - RNA, 19 nt, Homo sapiens
gaagaaacggagacucaac

SEQ ID NO: 562334 - RNA, 19 nt, Homo sapiens
agacuuggaggaugacauu

SEQ ID NO: 562335 - RNA, 19 nt, Homo sapiens
gaaacggagacucaacauc

SEQ ID NO: 562336 - RNA, 19 nt, Homo sapiens
ccaaaggaaaggcauaugg

SEQ ID NO: 562337 - RNA, 19 nt, Homo sapiens
ccacauguacugccugagu

SEQ ID NO: 562338 - RNA, 19 nt, Homo sapiens
ggaggaggagaccauuaug

SEQ ID NO: 562339 - RNA, 19 nt, Homo sapiens
ccagaacaacugcuacauc

SEQ ID NO: 562340 - RNA, 19 nt, Homo sapiens
aaaggcuucugcuuacauc

SEQ ID NO: 562341 - RNA, 19 nt, Homo sapiens
gaaaaggcuucugcuuaca

SEQ ID NO: 562342 - RNA, 19 nt, Homo sapiens
gagccuaggcgaggacuuc

SEQ ID NO: 562343 - RNA, 19 nt, Homo sapiens
agccguaugucugugauaa

SEQ ID NO: 562344 - RNA, 19 nt, Homo sapiens
ggaccgagacaagccguau

SEQ ID NO: 562345 - RNA, 19 nt, Homo sapiens
aggaaaaggcuucugcuua

SEQ ID NO: 562346 - RNA, 19 nt, Homo sapiens
ccguaugucugugauaagu

SEQ ID NO: 562347 - RNA, 19 nt, Homo sapiens
gggccaaaggaaaggcaua

SEQ ID NO: 562348 - RNA, 19 nt, Homo sapiens
agaacagggccaaaggaaa

SEQ ID NO: 562349 - RNA, 19 nt, Homo sapiens
aagaacagggccaaaggaa

SEQ ID NO: 562350 - RNA, 19 nt, Homo sapiens
aggaagaaacggagacuca

SEQ ID NO: 562351 - RNA, 19 nt, Homo sapiens
ggccaaaggaaaggcauau

SEQ ID NO: 562352 - RNA, 19 nt, Homo sapiens
aaggaggaggagaccauua

SEQ ID NO: 562353 - RNA, 19 nt, Homo sapiens
ugaaggaggaggagaccau

SEQ ID NO: 562354 - RNA, 19 nt, Homo sapiens
gaaguaagaugucucguuu

SEQ ID NO: 562355 - RNA, 19 nt, Homo sapiens
caaauaaacuagucuguug

SEQ ID NO: 562356 - RNA, 19 nt, Homo sapiens
gaaggcagcuaaucaguga

SEQ ID NO: 562357 - RNA, 19 nt, Homo sapiens
ggacaagauucucuacuuu

SEQ ID NO: 562358 - RNA, 19 nt, Homo sapiens
ggaaagaguuuaauuguac

SEQ ID NO: 562359 - RNA, 19 nt, Homo sapiens
ggagguggcuguacugaaa

SEQ ID NO: 562360 - RNA, 19 nt, Homo sapiens
gaacucaacuggucuuucu

SEQ ID NO: 562361 - RNA, 19 nt, Homo sapiens
ccaguggacuuuaguagua

SEQ ID NO: 562362 - RNA, 19 nt, Homo sapiens
gaugaugaauguacucaaa

SEQ ID NO: 562363 - RNA, 19 nt, Homo sapiens
uaagaugucucguuuggaa

SEQ ID NO: 562364 - RNA, 19 nt, Homo sapiens
guacacugaugcugaagua

SEQ ID NO: 562365 - RNA, 19 nt, Homo sapiens
gagaauagcauguucguau

SEQ ID NO: 562366 - RNA, 19 nt, Homo sapiens
ggugacaucugaacuaaga

SEQ ID NO: 562367 - RNA, 19 nt, Homo sapiens
gcuaaucagugaccacgua

SEQ ID NO: 562368 - RNA, 19 nt, Homo sapiens
ucucaaagaugaugaaugu

SEQ ID NO: 562369 - RNA, 19 nt, Homo sapiens
guacucagauccuccuuug

SEQ ID NO: 562370 - RNA, 19 nt, Homo sapiens
ggucaaagaguuauagauu

SEQ ID NO: 562371 - RNA, 19 nt, Homo sapiens
ggaguacacugaugcugaa

SEQ ID NO: 562372 - RNA, 19 nt, Homo sapiens
ugaagcaguuucucaauau

SEQ ID NO: 562373 - RNA, 19 nt, Homo sapiens
acuaagagcugaagcagaa

SEQ ID NO: 562374 - RNA, 19 nt, Homo sapiens
caaguaaaccugccuguau

SEQ ID NO: 562375 - RNA, 19 nt, Homo sapiens
cugauuagcuucauaaaca

SEQ ID NO: 562376 - RNA, 19 nt, Homo sapiens
ggaaguagcaggcuugcaa

SEQ ID NO: 562377 - RNA, 19 nt, Homo sapiens
gggacaagauucucuacuu

SEQ ID NO: 562378 - RNA, 19 nt, Homo sapiens
ugaagcagcugcacaaugg

SEQ ID NO: 562379 - RNA, 19 nt, Homo sapiens
gaaauucucacugacauga

SEQ ID NO: 562380 - RNA, 19 nt, Homo sapiens
gagcugaagcagaagaaua

SEQ ID NO: 562381 - RNA, 19 nt, Homo sapiens
gcauauaucagacacaaga

SEQ ID NO: 562382 - RNA, 19 nt, Homo sapiens
gcaguuaacacucaaggaa

SEQ ID NO: 562383 - RNA, 19 nt, Homo sapiens
gaaaggaaacagagcaugu

SEQ ID NO: 562384 - RNA, 19 nt, Homo sapiens
aaacggucuucacuaguua

SEQ ID NO: 562385 - RNA, 19 nt, Homo sapiens
uaguugggcucauacauuu

SEQ ID NO: 562386 - RNA, 19 nt, Homo sapiens
ucacugacaugaaguaugg

SEQ ID NO: 562387 - RNA, 19 nt, Homo sapiens
aaacucauuuggcugcaua

SEQ ID NO: 562388 - RNA, 19 nt, Homo sapiens
guucagagauuaggcuuga

SEQ ID NO: 562389 - RNA, 19 nt, Homo sapiens
gugaaccacugacaacuga

SEQ ID NO: 562390 - RNA, 19 nt, Homo sapiens
aaacuagucuguuggcaau

SEQ ID NO: 562391 - RNA, 19 nt, Homo sapiens
gcagugcccuagaaucugu

SEQ ID NO: 562392 - RNA, 19 nt, Homo sapiens
ugaauguacucaaacagaa

SEQ ID NO: 562393 - RNA, 19 nt, Homo sapiens
ggaccacacuuucugucuu

SEQ ID NO: 562394 - RNA, 19 nt, Homo sapiens
ggcuguggauuauacaaua

SEQ ID NO: 562395 - RNA, 19 nt, Homo sapiens
ggacaccuuuggucaguuc

SEQ ID NO: 562396 - RNA, 19 nt, Homo sapiens
gaaagcauucucaaagaug

SEQ ID NO: 562397 - RNA, 19 nt, Homo sapiens
gaagcaguuucucaauaug

SEQ ID NO: 562398 - RNA, 19 nt, Homo sapiens
gucagaaguucaauuaaug

SEQ ID NO: 562399 - RNA, 19 nt, Homo sapiens
gcugaaggccacaucauuu

SEQ ID NO: 562400 - RNA, 19 nt, Homo sapiens
ggucacacaucccauuuua

SEQ ID NO: 562401 - RNA, 19 nt, Homo sapiens
gaccacacuuucugucuug

SEQ ID NO: 562402 - RNA, 19 nt, Homo sapiens
ccaguuggauuagaaagaa

SEQ ID NO: 562403 - RNA, 19 nt, Homo sapiens
aaucugagcuucauaucga

SEQ ID NO: 562404 - RNA, 19 nt, Homo sapiens
ccaccacugucauuagauu

SEQ ID NO: 562405 - RNA, 19 nt, Homo sapiens
gcugggauaucuuucauag

SEQ ID NO: 562406 - RNA, 19 nt, Homo sapiens
gaauauagcagagaagaca

SEQ ID NO: 562407 - RNA, 19 nt, Homo sapiens
aagcacacgucguccauuu

SEQ ID NO: 562408 - RNA, 19 nt, Homo sapiens
ggcucaauauguccuaaua

SEQ ID NO: 562409 - RNA, 19 nt, Homo sapiens
gaucuuguccugugccaaa

SEQ ID NO: 562410 - RNA, 19 nt, Homo sapiens
cugaguaggugacaucuga

SEQ ID NO: 562411 - RNA, 19 nt, Homo sapiens
guagcaggcuugcaaucuu

SEQ ID NO: 562412 - RNA, 19 nt, Homo sapiens
guagagacagccaauuuga

SEQ ID NO: 562413 - RNA, 19 nt, Homo sapiens
cuucagugauuguggcuua

SEQ ID NO: 562414 - RNA, 19 nt, Homo sapiens
gugucaagcuucagugauu

SEQ ID NO: 562415 - RNA, 19 nt, Homo sapiens
aaagcugccuuccacauga

SEQ ID NO: 562416 - RNA, 19 nt, Homo sapiens
guugcuaacuggccagauu

SEQ ID NO: 562417 - RNA, 19 nt, Homo sapiens
ggaaacagagcaugucagu

SEQ ID NO: 562418 - RNA, 19 nt, Homo sapiens
aagaagccaucauugugua

SEQ ID NO: 562419 - RNA, 19 nt, Homo sapiens
gcuaagaagccaucauugu

SEQ ID NO: 562420 - RNA, 19 nt, Homo sapiens
gaacuggcuucuuguagcu

SEQ ID NO: 562421 - RNA, 19 nt, Homo sapiens
uggagagacuacaaaguuu

SEQ ID NO: 562422 - RNA, 19 nt, Homo sapiens
guggagagacuacaaaguu

SEQ ID NO: 562423 - RNA, 19 nt, Homo sapiens
ccucagcucugcucaguca

SEQ ID NO: 562424 - RNA, 19 nt, Homo sapiens
cacaauggcuuuggagguu

SEQ ID NO: 562425 - RNA, 19 nt, Homo sapiens
cuaguuaccaccugaagua

SEQ ID NO: 562426 - RNA, 19 nt, Homo sapiens
aaagcauucucaaagauga

SEQ ID NO: 562427 - RNA, 19 nt, Homo sapiens
ucauuuggcugcauauauc

SEQ ID NO: 562428 - RNA, 19 nt, Homo sapiens
gucaaagaguuauagauuc

SEQ ID NO: 562429 - RNA, 19 nt, Homo sapiens
gcuacgcacuaggaauaua

SEQ ID NO: 562430 - RNA, 19 nt, Homo sapiens
guaggugacaucugaacua

SEQ ID NO: 562431 - RNA, 19 nt, Homo sapiens
ugggauaucuuucauaggu

SEQ ID NO: 562432 - RNA, 19 nt, Homo sapiens
gcugcuaccuucuguuauc

SEQ ID NO: 562433 - RNA, 19 nt, Homo sapiens
ccagcaaccugaccuugga

SEQ ID NO: 562434 - RNA, 19 nt, Homo sapiens
gaacaugauggaggugaaa

SEQ ID NO: 562435 - RNA, 19 nt, Homo sapiens
caacgacccagaaagcauu

SEQ ID NO: 562436 - RNA, 19 nt, Homo sapiens
aguuauagauuccacugua

SEQ ID NO: 562437 - RNA, 19 nt, Homo sapiens
uaggugacaucugaacuaa

SEQ ID NO: 562438 - RNA, 19 nt, Homo sapiens
aaagaguauugaagaguga

SEQ ID NO: 562439 - RNA, 19 nt, Homo sapiens
agagacagccaauuugauu

SEQ ID NO: 562440 - RNA, 19 nt, Homo sapiens
gcacacgucguccauuugu

SEQ ID NO: 562441 - RNA, 19 nt, Homo sapiens
gcaugucagugcuuugauc

SEQ ID NO: 562442 - RNA, 19 nt, Homo sapiens
guuauagauuccacuguau

SEQ ID NO: 562443 - RNA, 19 nt, Homo sapiens
ccuguaugcucaccagaaa

SEQ ID NO: 562444 - RNA, 19 nt, Homo sapiens
ccacugucauuagauuaaa

SEQ ID NO: 562445 - RNA, 19 nt, Homo sapiens
uuucauagguguccaucuu

SEQ ID NO: 562446 - RNA, 19 nt, Homo sapiens
cgacauuccugagcaagau

SEQ ID NO: 562447 - RNA, 19 nt, Homo sapiens
ggguggcagugacuaguuu

SEQ ID NO: 562448 - RNA, 19 nt, Homo sapiens
ggccagauuugcuuucaca

SEQ ID NO: 562449 - RNA, 19 nt, Homo sapiens
agaauaagccauccucugu

SEQ ID NO: 562450 - RNA, 19 nt, Homo sapiens
caaagaugaugaauguacu

SEQ ID NO: 562451 - RNA, 19 nt, Homo sapiens
cuaggaauauagcagagaa

SEQ ID NO: 562452 - RNA, 19 nt, Homo sapiens
guuauggucccuuuaguug

SEQ ID NO: 562453 - RNA, 19 nt, Homo sapiens
gagacagccaauuugauuu

SEQ ID NO: 562454 - RNA, 19 nt, Homo sapiens
gaaguaagaugucucguuu

SEQ ID NO: 562455 - RNA, 19 nt, Homo sapiens
caaauaaacuagucuguug

SEQ ID NO: 562456 - RNA, 19 nt, Homo sapiens
gaaggcagcuaaucaguga

SEQ ID NO: 562457 - RNA, 19 nt, Homo sapiens
ggaaagaguuuaauuguac

SEQ ID NO: 562458 - RNA, 19 nt, Homo sapiens
ggagguggcuguacugaaa

SEQ ID NO: 562459 - RNA, 19 nt, Homo sapiens
gaacucaacuggucuuucu

SEQ ID NO: 562460 - RNA, 19 nt, Homo sapiens
ccaguggacuuuaguagua

SEQ ID NO: 562461 - RNA, 19 nt, Homo sapiens
gaugaugaauguacucaaa

SEQ ID NO: 562462 - RNA, 19 nt, Homo sapiens
uaagaugucucguuuggaa

SEQ ID NO: 562463 - RNA, 19 nt, Homo sapiens
guacacugaugcugaagua

SEQ ID NO: 562464 - RNA, 19 nt, Homo sapiens
gagaauagcauguucguau

SEQ ID NO: 562465 - RNA, 19 nt, Homo sapiens
gcuaaucagugaccacgua

SEQ ID NO: 562466 - RNA, 19 nt, Homo sapiens
ucucaaagaugaugaaugu

SEQ ID NO: 562467 - RNA, 19 nt, Homo sapiens
guacucagauccuccuuug

SEQ ID NO: 562468 - RNA, 19 nt, Homo sapiens
ggucaaagaguuauagauu

SEQ ID NO: 562469 - RNA, 19 nt, Homo sapiens
ugaagcaguuucucaauau

SEQ ID NO: 562470 - RNA, 19 nt, Homo sapiens
caaguaaaccugccuguau

SEQ ID NO: 562471 - RNA, 19 nt, Homo sapiens
cugauuagcuucauaaaca

SEQ ID NO: 562472 - RNA, 19 nt, Homo sapiens
ggaaguagcaggcuugcaa

SEQ ID NO: 562473 - RNA, 19 nt, Homo sapiens
ugaagcagcugcacaaugg

SEQ ID NO: 562474 - RNA, 19 nt, Homo sapiens
gaaauucucacugacauga

SEQ ID NO: 562475 - RNA, 19 nt, Homo sapiens
gcauauaucagacacaaga

SEQ ID NO: 562476 - RNA, 19 nt, Homo sapiens
gcaguuaacacucaaggaa

SEQ ID NO: 562477 - RNA, 19 nt, Homo sapiens
gaaaggaaacagagcaugu

SEQ ID NO: 562478 - RNA, 19 nt, Homo sapiens
aaacggucuucacuaguua

SEQ ID NO: 562479 - RNA, 19 nt, Homo sapiens
uaguugggcucauacauuu

SEQ ID NO: 562480 - RNA, 19 nt, Homo sapiens
ucacugacaugaaguaugg

SEQ ID NO: 562481 - RNA, 19 nt, Homo sapiens
aaacucauuuggcugcaua

SEQ ID NO: 562482 - RNA, 19 nt, Homo sapiens
guucagagauuaggcuuga

SEQ ID NO: 562483 - RNA, 19 nt, Homo sapiens
gugaaccacugacaacuga

SEQ ID NO: 562484 - RNA, 19 nt, Homo sapiens
aaacuagucuguuggcaau

SEQ ID NO: 562485 - RNA, 19 nt, Homo sapiens
gcagugcccuagaaucugu

SEQ ID NO: 562486 - RNA, 19 nt, Homo sapiens
ugaauguacucaaacagaa

SEQ ID NO: 562487 - RNA, 19 nt, Homo sapiens
ggaccacacuuucugucuu

SEQ ID NO: 562488 - RNA, 19 nt, Homo sapiens
ggcuguggauuauacaaua

SEQ ID NO: 562489 - RNA, 19 nt, Homo sapiens
ggacaccuuuggucaguuc

SEQ ID NO: 562490 - RNA, 19 nt, Homo sapiens
gaaagcauucucaaagaug

SEQ ID NO: 562491 - RNA, 19 nt, Homo sapiens
gaagcaguuucucaauaug

SEQ ID NO: 562492 - RNA, 19 nt, Homo sapiens
gucagaaguucaauuaaug

SEQ ID NO: 562493 - RNA, 19 nt, Homo sapiens
gcugaaggccacaucauuu

SEQ ID NO: 562494 - RNA, 19 nt, Homo sapiens
ggucacacaucccauuuua

SEQ ID NO: 562495 - RNA, 19 nt, Homo sapiens
gaccacacuuucugucuug

SEQ ID NO: 562496 - RNA, 19 nt, Homo sapiens
ccaguuggauuagaaagaa

SEQ ID NO: 562497 - RNA, 19 nt, Homo sapiens
aaucugagcuucauaucga

SEQ ID NO: 562498 - RNA, 19 nt, Homo sapiens
ccaccacugucauuagauu

SEQ ID NO: 562499 - RNA, 19 nt, Homo sapiens
gcugggauaucuuucauag

SEQ ID NO: 562500 - RNA, 19 nt, Homo sapiens
aagcacacgucguccauuu

SEQ ID NO: 562501 - RNA, 19 nt, Homo sapiens
ggcucaauauguccuaaua

SEQ ID NO: 562502 - RNA, 19 nt, Homo sapiens
gaucuuguccugugccaaa

SEQ ID NO: 562503 - RNA, 19 nt, Homo sapiens
guagcaggcuugcaaucuu

SEQ ID NO: 562504 - RNA, 19 nt, Homo sapiens
guagagacagccaauuuga

SEQ ID NO: 562505 - RNA, 19 nt, Homo sapiens
cuucagugauuguggcuua

SEQ ID NO: 562506 - RNA, 19 nt, Homo sapiens
gugucaagcuucagugauu

SEQ ID NO: 562507 - RNA, 19 nt, Homo sapiens
aaagcugccuuccacauga

SEQ ID NO: 562508 - RNA, 19 nt, Homo sapiens
guggagagacuacaaaguu

SEQ ID NO: 562509 - RNA, 19 nt, Homo sapiens
guugcuaacuggccagauu

SEQ ID NO: 562510 - RNA, 19 nt, Homo sapiens
uggagagacuacaaaguuu

SEQ ID NO: 562511 - RNA, 19 nt, Homo sapiens
ggaaacagagcaugucagu

SEQ ID NO: 562512 - RNA, 19 nt, Homo sapiens
aagaagccaucauugugua

SEQ ID NO: 562513 - RNA, 19 nt, Homo sapiens
gcuaagaagccaucauugu

SEQ ID NO: 562514 - RNA, 19 nt, Homo sapiens
gaacuggcuucuuguagcu

SEQ ID NO: 562515 - RNA, 19 nt, Homo sapiens
ccucagcucugcucaguca

SEQ ID NO: 562516 - RNA, 19 nt, Homo sapiens
cacaauggcuuuggagguu

SEQ ID NO: 562517 - RNA, 19 nt, Homo sapiens
cuaguuaccaccugaagua

SEQ ID NO: 562518 - RNA, 19 nt, Homo sapiens
aaagcauucucaaagauga

SEQ ID NO: 562519 - RNA, 19 nt, Homo sapiens
ucauuuggcugcauauauc

SEQ ID NO: 562520 - RNA, 19 nt, Homo sapiens
gucaaagaguuauagauuc

SEQ ID NO: 562521 - RNA, 19 nt, Homo sapiens
ugggauaucuuucauaggu

SEQ ID NO: 562522 - RNA, 19 nt, Homo sapiens
ccagcaaccugaccuugga

SEQ ID NO: 562523 - RNA, 19 nt, Homo sapiens
gaacaugauggaggugaaa

SEQ ID NO: 562524 - RNA, 19 nt, Homo sapiens
caacgacccagaaagcauu

SEQ ID NO: 562525 - RNA, 19 nt, Homo sapiens
aguuauagauuccacugua

SEQ ID NO: 562526 - RNA, 19 nt, Homo sapiens
aaagaguauugaagaguga

SEQ ID NO: 562527 - RNA, 19 nt, Homo sapiens
agagacagccaauuugauu

SEQ ID NO: 562528 - RNA, 19 nt, Homo sapiens
gcacacgucguccauuugu

SEQ ID NO: 562529 - RNA, 19 nt, Homo sapiens
gcaugucagugcuuugauc

SEQ ID NO: 562530 - RNA, 19 nt, Homo sapiens
guuauagauuccacuguau

SEQ ID NO: 562531 - RNA, 19 nt, Homo sapiens
ccuguaugcucaccagaaa

SEQ ID NO: 562532 - RNA, 19 nt, Homo sapiens
ccacugucauuagauuaaa

SEQ ID NO: 562533 - RNA, 19 nt, Homo sapiens
uuucauagguguccaucuu

SEQ ID NO: 562534 - RNA, 19 nt, Homo sapiens
cgacauuccugagcaagau

SEQ ID NO: 562535 - RNA, 19 nt, Homo sapiens
ggccagauuugcuuucaca

SEQ ID NO: 562536 - RNA, 19 nt, Homo sapiens
caaagaugaugaauguacu

SEQ ID NO: 562537 - RNA, 19 nt, Homo sapiens
guuauggucccuuuaguug

SEQ ID NO: 562538 - RNA, 19 nt, Homo sapiens
gagacagccaauuugauuu

SEQ ID NO: 562539 - RNA, 19 nt, Homo sapiens
cagguacacugaugcugaa

SEQ ID NO: 562540 - RNA, 19 nt, Homo sapiens
uaagaagccaucauugugu

SEQ ID NO: 562541 - RNA, 19 nt, Homo sapiens
gcaaagcagucuguaaaau

SEQ ID NO: 562542 - RNA, 19 nt, Homo sapiens
caugaaguauggacaccuu

SEQ ID NO: 562543 - RNA, 19 nt, Homo sapiens
agaaucaugugucaagcuu

SEQ ID NO: 562544 - RNA, 19 nt, Homo sapiens
gauccugacagccuccaua

SEQ ID NO: 562545 - RNA, 19 nt, Homo sapiens
gaaccacugacaacugaga

SEQ ID NO: 562546 - RNA, 19 nt, Homo sapiens
cuaagaagccaucauugug

SEQ ID NO: 562547 - RNA, 19 nt, Homo sapiens
cuaagagaauagcauguuc

SEQ ID NO: 562548 - RNA, 19 nt, Homo sapiens
uuuggugcguaguauauua

SEQ ID NO: 562549 - RNA, 19 nt, Homo sapiens
cauacagaaucauguguca

SEQ ID NO: 562550 - RNA, 19 nt, Homo sapiens
acaauggcuuuggagguua

SEQ ID NO: 562551 - RNA, 19 nt, Homo sapiens
caaagcugccuuccacaug

SEQ ID NO: 562552 - RNA, 19 nt, Homo sapiens
guuguuggcucuuuagaac

SEQ ID NO: 562553 - RNA, 19 nt, Homo sapiens
ucaaagaguuauagauucc

SEQ ID NO: 562554 - RNA, 19 nt, Homo sapiens
ccaacaacgugguguauaa

SEQ ID NO: 562555 - RNA, 19 nt, Homo sapiens
aaacagugcuuuccgauga

SEQ ID NO: 562556 - RNA, 19 nt, Homo sapiens
caagaaggaugaacccaaa

SEQ ID NO: 562557 - RNA, 19 nt, Homo sapiens
gaauucaucugcacugugu

SEQ ID NO: 562558 - RNA, 19 nt, Homo sapiens
gcgguuggcuuucuccuuu

SEQ ID NO: 562559 - RNA, 19 nt, Homo sapiens
cuacacagcuugggugaaa

SEQ ID NO: 562560 - RNA, 19 nt, Homo sapiens
ggaaggcacugcaugucaa

SEQ ID NO: 562561 - RNA, 19 nt, Homo sapiens
aaacgggaccuguucuuua

SEQ ID NO: 562562 - RNA, 19 nt, Homo sapiens
ggagagggcuuggauagag

SEQ ID NO: 562563 - RNA, 19 nt, Homo sapiens
gaaacgggaccuguucuuu

SEQ ID NO: 562564 - RNA, 19 nt, Homo sapiens
gcuguuagacuguuagauu

SEQ ID NO: 562565 - RNA, 19 nt, Homo sapiens
gaccuguucuuuaaugaga

SEQ ID NO: 562566 - RNA, 19 nt, Homo sapiens
gauaagaccguguaugagu

SEQ ID NO: 562567 - RNA, 19 nt, Homo sapiens
ugacacagcccaagaagga

SEQ ID NO: 562568 - RNA, 19 nt, Homo sapiens
ggauagaguugaggagugu

SEQ ID NO: 562569 - RNA, 19 nt, Homo sapiens
gcacuggcccucugucuuc

SEQ ID NO: 562570 - RNA, 19 nt, Homo sapiens
aacgggaccuguucuuuaa

SEQ ID NO: 562571 - RNA, 19 nt, Homo sapiens
gaaaggggauuccaauaag

SEQ ID NO: 562572 - RNA, 19 nt, Homo sapiens
auaagaccguguaugagua

SEQ ID NO: 562573 - RNA, 19 nt, Homo sapiens
gagagcauuuccacuaugg

SEQ ID NO: 562574 - RNA, 19 nt, Homo sapiens
ccaaacuccucacuuucuu

SEQ ID NO: 562575 - RNA, 19 nt, Homo sapiens
cuaugggacuggauacaaa

SEQ ID NO: 562576 - RNA, 19 nt, Homo sapiens
gaagcagagguacguguuu

SEQ ID NO: 562577 - RNA, 19 nt, Homo sapiens
guacguguuugacauuagu

SEQ ID NO: 562578 - RNA, 19 nt, Homo sapiens
ucacuuucuugcuuuggua

SEQ ID NO: 562579 - RNA, 19 nt, Homo sapiens
gaggagagggcuuggauag

SEQ ID NO: 562580 - RNA, 19 nt, Homo sapiens
gcucuggccaggacgauaa

SEQ ID NO: 562581 - RNA, 19 nt, Homo sapiens
caagaaacgggaccuguuc

SEQ ID NO: 562582 - RNA, 19 nt, Homo sapiens
cgacccagcaagaaccuua

SEQ ID NO: 562583 - RNA, 19 nt, Homo sapiens
ggaagcagagguacguguu

SEQ ID NO: 562584 - RNA, 19 nt, Homo sapiens
cuguuagacuguuagauuu

SEQ ID NO: 562585 - RNA, 19 nt, Homo sapiens
gggcaagagugggagagaa

SEQ ID NO: 562586 - RNA, 19 nt, Homo sapiens
gaagcugacugggcaagag

SEQ ID NO: 562587 - RNA, 19 nt, Homo sapiens
gagacucagcccaccauuu

SEQ ID NO: 562588 - RNA, 19 nt, Homo sapiens
acgauaagaccguguauga

SEQ ID NO: 562589 - RNA, 19 nt, Homo sapiens
gcugggagguguucgacau

SEQ ID NO: 562590 - RNA, 19 nt, Homo sapiens
gcuguucucuuugguguca

SEQ ID NO: 562591 - RNA, 19 nt, Homo sapiens
agacucagcccaccauuuc

SEQ ID NO: 562592 - RNA, 19 nt, Homo sapiens
gagugugacuugggcuaaa

SEQ ID NO: 562593 - RNA, 19 nt, Homo sapiens
ucagcauccucuucauuga

SEQ ID NO: 562594 - RNA, 19 nt, Homo sapiens
gcaagcgacccagcaagaa

SEQ ID NO: 562595 - RNA, 19 nt, Homo sapiens
cgagagcauuuccacuaug

SEQ ID NO: 562596 - RNA, 19 nt, Homo sapiens
ccaagaaacgggaccuguu

SEQ ID NO: 562597 - RNA, 19 nt, Homo sapiens
gagagggcuuggauagagu

SEQ ID NO: 562598 - RNA, 19 nt, Homo sapiens
uuagugcccuggagaagga

SEQ ID NO: 562599 - RNA, 19 nt, Homo sapiens
uacgagagcauuuccacua

SEQ ID NO: 562600 - RNA, 19 nt, Homo sapiens
gggaccuguucuuuaauga

SEQ ID NO: 562601 - RNA, 19 nt, Homo sapiens
caccagcuuuauugacaaa

SEQ ID NO: 562602 - RNA, 19 nt, Homo sapiens
gccacugccuccucaaauc

SEQ ID NO: 562603 - RNA, 19 nt, Homo sapiens
gcaacagcagcgugaaguu

SEQ ID NO: 562604 - RNA, 19 nt, Homo sapiens
ugaggcuguuagacuguua

SEQ ID NO: 562605 - RNA, 19 nt, Homo sapiens
aagcagagguacguguuug

SEQ ID NO: 562606 - RNA, 19 nt, Homo sapiens
ccaacaccaucaccagcuu

SEQ ID NO: 562607 - RNA, 19 nt, Homo sapiens
caucagcauccucuucauu

SEQ ID NO: 562608 - RNA, 19 nt, Homo sapiens
gagguacguguuugacauu

SEQ ID NO: 562609 - RNA, 19 nt, Homo sapiens
gaggucccguggucaggaa

SEQ ID NO: 562610 - RNA, 19 nt, Homo sapiens
gggacuggauacaaacaca

SEQ ID NO: 562611 - RNA, 19 nt, Homo sapiens
ugaaaggggauuccaauaa

SEQ ID NO: 562612 - RNA, 19 nt, Homo sapiens
cgggaccuguucuuuaaug

SEQ ID NO: 562613 - RNA, 19 nt, Homo sapiens
caccaucaccagcuuuauu

SEQ ID NO: 562614 - RNA, 19 nt, Homo sapiens
ggcaagcgacccagcaaga

SEQ ID NO: 562615 - RNA, 19 nt, Homo sapiens
gggcuuggauagaguugag

SEQ ID NO: 562616 - RNA, 19 nt, Homo sapiens
acgagagcauuuccacuau

SEQ ID NO: 562617 - RNA, 19 nt, Homo sapiens
gccaacaacgugguguaua

SEQ ID NO: 562618 - RNA, 19 nt, Homo sapiens
agagguacguguuugacau

SEQ ID NO: 562619 - RNA, 19 nt, Homo sapiens
caacaccaucaccagcuuu

SEQ ID NO: 562620 - RNA, 19 nt, Homo sapiens
ccaaagcagaggccaagga

SEQ ID NO: 562621 - RNA, 19 nt, Homo sapiens
ggagugugaggcuguuaga

SEQ ID NO: 562622 - RNA, 19 nt, Homo sapiens
ccacugccuccucaaauca

SEQ ID NO: 562623 - RNA, 19 nt, Homo sapiens
gcacagguccagggagaca

SEQ ID NO: 562624 - RNA, 19 nt, Homo sapiens
ggcacugcaugucaacuuc

SEQ ID NO: 562625 - RNA, 19 nt, Homo sapiens
acacacacccggcagacuu

SEQ ID NO: 562626 - RNA, 19 nt, Homo sapiens
gguacguguuugacauuag

SEQ ID NO: 562627 - RNA, 19 nt, Homo sapiens
ucaccagcuuuauugacaa

SEQ ID NO: 562628 - RNA, 19 nt, Homo sapiens
guccacuccuuucaugguu

SEQ ID NO: 562629 - RNA, 19 nt, Homo sapiens
gcaagagugggagagaaga

SEQ ID NO: 562630 - RNA, 19 nt, Homo sapiens
uaagcaguaugaggacaug

SEQ ID NO: 562631 - RNA, 19 nt, Homo sapiens
gcugugcgaguucccauug

SEQ ID NO: 562632 - RNA, 19 nt, Homo sapiens
gcacugcaugucaacuuca

SEQ ID NO: 562633 - RNA, 19 nt, Homo sapiens
guccgaugcugacagaaag

SEQ ID NO: 562634 - RNA, 19 nt, Homo sapiens
ccucuggacucuccuaagc

SEQ ID NO: 562635 - RNA, 19 nt, Homo sapiens
ccuguucuuuaaugagauu

SEQ ID NO: 562636 - RNA, 19 nt, Homo sapiens
aagcucuuccgaaacuuua

SEQ ID NO: 562637 - RNA, 19 nt, Homo sapiens
caaacuccucacuuucuug

SEQ ID NO: 562638 - RNA, 19 nt, Homo sapiens
gaagaggagagggcuugga

SEQ ID NO: 562639 - RNA, 19 nt, Homo sapiens
acaacgugguguauaagca

SEQ ID NO: 562640 - RNA, 19 nt, Homo sapiens
ccacgaaucaugcagucau

SEQ ID NO: 562641 - RNA, 19 nt, Homo sapiens
ggacgauaagaccguguau

SEQ ID NO: 562642 - RNA, 19 nt, Homo sapiens
ugacaaagggcaagaugac

SEQ ID NO: 562643 - RNA, 19 nt, Homo sapiens
ggcuggaccuggaauucau

SEQ ID NO: 562644 - RNA, 19 nt, Homo sapiens
gguuggcuuucuccuuuca

SEQ ID NO: 562645 - RNA, 19 nt, Homo sapiens
caacaacgugguguauaag

SEQ ID NO: 562646 - RNA, 19 nt, Homo sapiens
caagaacgaguuauuuuca

SEQ ID NO: 562647 - RNA, 19 nt, Homo sapiens
ugcugccgcuguucucuuu

SEQ ID NO: 562648 - RNA, 19 nt, Homo sapiens
agucaguugugcaggagaa

SEQ ID NO: 562649 - RNA, 19 nt, Homo sapiens
gcacuccuggaaucacaga

SEQ ID NO: 562650 - RNA, 19 nt, Homo sapiens
cauugacucugccaacaac

SEQ ID NO: 562651 - RNA, 19 nt, Homo sapiens
acuccucacuuucuugcuu

SEQ ID NO: 562652 - RNA, 19 nt, Homo sapiens
gugaggcuguuagacuguu

SEQ ID NO: 562653 - RNA, 19 nt, Homo sapiens
uuccgaaacuuuaagaacu

SEQ ID NO: 562654 - RNA, 19 nt, Homo sapiens
gaaaugagaugacaguauu

SEQ ID NO: 562655 - RNA, 19 nt, Homo sapiens
gaacuaagcacuuuguuaa

SEQ ID NO: 562656 - RNA, 19 nt, Homo sapiens
cacaauaccugcaauauaa

SEQ ID NO: 562657 - RNA, 19 nt, Homo sapiens
gcaaugaugucgucaagaa

SEQ ID NO: 562658 - RNA, 19 nt, Homo sapiens
ggaaaccacuguacaaaug

SEQ ID NO: 562659 - RNA, 19 nt, Homo sapiens
ggaauuggguuucugaaug

SEQ ID NO: 562660 - RNA, 19 nt, Homo sapiens
gaagguguauucagagauu

SEQ ID NO: 562661 - RNA, 19 nt, Homo sapiens
gaaauccuguaacaaauga

SEQ ID NO: 562662 - RNA, 19 nt, Homo sapiens
gaacauccuuugacugguu

SEQ ID NO: 562663 - RNA, 19 nt, Homo sapiens
caggaaagguugucaauau

SEQ ID NO: 562664 - RNA, 19 nt, Homo sapiens
caaggaggcuuucaucuuc

SEQ ID NO: 562665 - RNA, 19 nt, Homo sapiens
ucacugagauccuccauga

SEQ ID NO: 562666 - RNA, 19 nt, Homo sapiens
gaaagguugucaauauaga

SEQ ID NO: 562667 - RNA, 19 nt, Homo sapiens
gaauuguccuuuacuaaug

SEQ ID NO: 562668 - RNA, 19 nt, Homo sapiens
gaacuaauucucuggguuu

SEQ ID NO: 562669 - RNA, 19 nt, Homo sapiens
gaaagacaccagcaguaua

SEQ ID NO: 562670 - RNA, 19 nt, Homo sapiens
ggauaacucucccaauaug

SEQ ID NO: 562671 - RNA, 19 nt, Homo sapiens
gaaaggaaaugagaugaca

SEQ ID NO: 562672 - RNA, 19 nt, Homo sapiens
ugacagagcuuugggcauu

SEQ ID NO: 562673 - RNA, 19 nt, Homo sapiens
gauauaauccgaaggugua

SEQ ID NO: 562674 - RNA, 19 nt, Homo sapiens
caaaauaggccucuucuua

SEQ ID NO: 562675 - RNA, 19 nt, Homo sapiens
ccagagauaugaaacaaug

SEQ ID NO: 562676 - RNA, 19 nt, Homo sapiens
gaaauagaauggugcucuu

SEQ ID NO: 562677 - RNA, 19 nt, Homo sapiens
ggacggaaauguugucaag

SEQ ID NO: 562678 - RNA, 19 nt, Homo sapiens
agacagauacgucaaauaa

SEQ ID NO: 562679 - RNA, 19 nt, Homo sapiens
gaagagacaucccuugacu

SEQ ID NO: 562680 - RNA, 19 nt, Homo sapiens
caagagagauuagaauauc

SEQ ID NO: 562681 - RNA, 19 nt, Homo sapiens
ggaauucccuggaugaucu

SEQ ID NO: 562682 - RNA, 19 nt, Homo sapiens
gagaaagacccuaaaauua

SEQ ID NO: 562683 - RNA, 19 nt, Homo sapiens
gaaaugcgccagagauaug

SEQ ID NO: 562684 - RNA, 19 nt, Homo sapiens
gcugauaucugccaaucuu

SEQ ID NO: 562685 - RNA, 19 nt, Homo sapiens
agaauuggcugagcugaua

SEQ ID NO: 562686 - RNA, 19 nt, Homo sapiens
ccacaggccuggaagaaau

SEQ ID NO: 562687 - RNA, 19 nt, Homo sapiens
ggaguuuccuggacaaaug

SEQ ID NO: 562688 - RNA, 19 nt, Homo sapiens
gaagaagacagaaaggauu

SEQ ID NO: 562689 - RNA, 19 nt, Homo sapiens
caagaugaguggauuagga

SEQ ID NO: 562690 - RNA, 19 nt, Homo sapiens
gaauagauauggggaaaua

SEQ ID NO: 562691 - RNA, 19 nt, Homo sapiens
ccauucauguccuguaaua

SEQ ID NO: 562692 - RNA, 19 nt, Homo sapiens
gagcaggacuggauuuuaa

SEQ ID NO: 562693 - RNA, 19 nt, Homo sapiens
caagaaugauggauaguca

SEQ ID NO: 562694 - RNA, 19 nt, Homo sapiens
ggaaggaguggauaauaaa

SEQ ID NO: 562695 - RNA, 19 nt, Homo sapiens
gagcaggaaaguaaauaua

SEQ ID NO: 562696 - RNA, 19 nt, Homo sapiens
gacaggcacuugaauugaa

SEQ ID NO: 562697 - RNA, 19 nt, Homo sapiens
ggauagcccuguuucuguu

SEQ ID NO: 562698 - RNA, 19 nt, Homo sapiens
uggaaggaguggauaauaa

SEQ ID NO: 562699 - RNA, 19 nt, Homo sapiens
cuaagaagaaggagaauaa

SEQ ID NO: 562700 - RNA, 19 nt, Homo sapiens
gcggcgaguuuccgauuua

SEQ ID NO: 562701 - RNA, 19 nt, Homo sapiens
ccaagaagcagcaguaaug

SEQ ID NO: 562702 - RNA, 19 nt, Homo sapiens
ggaaacaguaagacagaua

SEQ ID NO: 562703 - RNA, 19 nt, Homo sapiens
uaagcaguccgaaauaaua

SEQ ID NO: 562704 - RNA, 19 nt, Homo sapiens
gcaaggaggcuuucaucuu

SEQ ID NO: 562705 - RNA, 19 nt, Homo sapiens
gccaguugcugauguauau

SEQ ID NO: 562706 - RNA, 19 nt, Homo sapiens
gugaugcacucucuaaaga

SEQ ID NO: 562707 - RNA, 19 nt, Homo sapiens
ggaaagcaaaggucauaaa

SEQ ID NO: 562708 - RNA, 19 nt, Homo sapiens
gcaauauucuugaggucuu

SEQ ID NO: 562709 - RNA, 19 nt, Homo sapiens
gcugagugcacuuuauuua

SEQ ID NO: 562710 - RNA, 19 nt, Homo sapiens
ccagaaacgucacuaucaa

SEQ ID NO: 562711 - RNA, 19 nt, Homo sapiens
cuggagacauggaguguua

SEQ ID NO: 562712 - RNA, 19 nt, Homo sapiens
caacagaggguggcuauga

SEQ ID NO: 562713 - RNA, 19 nt, Homo sapiens
aaagcaaacucuuccgaaa

SEQ ID NO: 562714 - RNA, 19 nt, Homo sapiens
ggaaaugagaugacaguau

SEQ ID NO: 562715 - RNA, 19 nt, Homo sapiens
caaacaggaugcuuuccaa

SEQ ID NO: 562716 - RNA, 19 nt, Homo sapiens
agagggaucuggagacuug

SEQ ID NO: 562717 - RNA, 19 nt, Homo sapiens
gaaggagaauaaugcacuu

SEQ ID NO: 562718 - RNA, 19 nt, Homo sapiens
aaagacaccagcaguauaa

SEQ ID NO: 562719 - RNA, 19 nt, Homo sapiens
ccaguaacauagcuucauu

SEQ ID NO: 562720 - RNA, 19 nt, Homo sapiens
cagaaaaugucacacaaua

SEQ ID NO: 562721 - RNA, 19 nt, Homo sapiens
gaaucgagacggaaacauu

SEQ ID NO: 562722 - RNA, 19 nt, Homo sapiens
gggcagggaguuauugaua

SEQ ID NO: 562723 - RNA, 19 nt, Homo sapiens
ggaaagacaccagcaguau

SEQ ID NO: 562724 - RNA, 19 nt, Homo sapiens
caaaugagacccaaagaca

SEQ ID NO: 562725 - RNA, 19 nt, Homo sapiens
gaauaaugcacuucuuaga

SEQ ID NO: 562726 - RNA, 19 nt, Homo sapiens
caagagaagcaccggauuu

SEQ ID NO: 562727 - RNA, 19 nt, Homo sapiens
aggaaagguugucaauaua

SEQ ID NO: 562728 - RNA, 19 nt, Homo sapiens
gaguguuacugaucauaaa

SEQ ID NO: 562729 - RNA, 19 nt, Homo sapiens
caaaugaggccuggugaaa

SEQ ID NO: 562730 - RNA, 19 nt, Homo sapiens
cccaacagcuuaucuuaau

SEQ ID NO: 562731 - RNA, 19 nt, Homo sapiens
gaagauauaauccgaaggu

SEQ ID NO: 562732 - RNA, 19 nt, Homo sapiens
cuagaugucucugaaggua

SEQ ID NO: 562733 - RNA, 19 nt, Homo sapiens
ucagaaggcaggauuauau

SEQ ID NO: 562734 - RNA, 19 nt, Homo sapiens
uagcagagaucaccucagu

SEQ ID NO: 562735 - RNA, 19 nt, Homo sapiens
caaguaaaguaagcaauca

SEQ ID NO: 562736 - RNA, 19 nt, Homo sapiens
ccugagagcuuuauuacca

SEQ ID NO: 562737 - RNA, 19 nt, Homo sapiens
acacaauaccugcaauaua

SEQ ID NO: 562738 - RNA, 19 nt, Homo sapiens
cggaaacauuguauuugua

SEQ ID NO: 562739 - RNA, 19 nt, Homo sapiens
ggcauuggaugguuuccua

SEQ ID NO: 562740 - RNA, 19 nt, Homo sapiens
gacgggagcaggaaaguaa

SEQ ID NO: 562741 - RNA, 19 nt, Homo sapiens
gcagcugagugcacuuuau

SEQ ID NO: 562742 - RNA, 19 nt, Homo sapiens
gcagaaaggaaaugagaug

SEQ ID NO: 562743 - RNA, 19 nt, Homo sapiens
gaauucaccagcugaggua

SEQ ID NO: 562744 - RNA, 19 nt, Homo sapiens
cuacuaaugugaugcuuuc

SEQ ID NO: 562745 - RNA, 19 nt, Homo sapiens
ugacacugcacuaggauua

SEQ ID NO: 562746 - RNA, 19 nt, Homo sapiens
gcaugaguaugucgccaaa

SEQ ID NO: 562747 - RNA, 19 nt, Homo sapiens
caugaggccuggcuuugaa

SEQ ID NO: 562748 - RNA, 19 nt, Homo sapiens
gaaaacaccacaugauauu

SEQ ID NO: 562749 - RNA, 19 nt, Homo sapiens
uaccagaacuaagcacuuu

SEQ ID NO: 562750 - RNA, 19 nt, Homo sapiens
gaguugcucugucccuauu

SEQ ID NO: 562751 - RNA, 19 nt, Homo sapiens
gaaaccacuguacaaauga

SEQ ID NO: 562752 - RNA, 19 nt, Homo sapiens
gcucaaguccuccaguaaa

SEQ ID NO: 562753 - RNA, 19 nt, Homo sapiens
gcagcuaaguccuaagaag

SEQ ID NO: 562754 - RNA, 19 nt, Homo sapiens
caacaaagcuuacaacauu

SEQ ID NO: 562755 - RNA, 19 nt, Homo sapiens
gaacaaaggucaugaguga

SEQ ID NO: 562756 - RNA, 19 nt, Homo sapiens
gaacaagaaucucugcuaa

SEQ ID NO: 562757 - RNA, 19 nt, Homo sapiens
caagauaccucaaagaauu

SEQ ID NO: 562758 - RNA, 19 nt, Homo sapiens
guaaauagcuacuggaaau

SEQ ID NO: 562759 - RNA, 19 nt, Homo sapiens
gcacauuacuggccucuuu

SEQ ID NO: 562760 - RNA, 19 nt, Homo sapiens
caagagagaugaaauuuag

SEQ ID NO: 562761 - RNA, 19 nt, Homo sapiens
ggaagaggcugucugauuc

SEQ ID NO: 562762 - RNA, 19 nt, Homo sapiens
gaagugguuucuaagauuu

SEQ ID NO: 562763 - RNA, 19 nt, Homo sapiens
caaacaggauagcacauua

SEQ ID NO: 562764 - RNA, 19 nt, Homo sapiens
gaaaggguacuacagcuua

SEQ ID NO: 562765 - RNA, 19 nt, Homo sapiens
ggaaggugauaaacugaua

SEQ ID NO: 562766 - RNA, 19 nt, Homo sapiens
gaacuugagaucuguauaa

SEQ ID NO: 562767 - RNA, 19 nt, Homo sapiens
gaugcgaucugcucaguaa

SEQ ID NO: 562768 - RNA, 19 nt, Homo sapiens
gagcugaaauuuagcagaa

SEQ ID NO: 562769 - RNA, 19 nt, Homo sapiens
aaacacagauaaaccgaua

SEQ ID NO: 562770 - RNA, 19 nt, Homo sapiens
uauaagaacucacuggaaa

SEQ ID NO: 562771 - RNA, 19 nt, Homo sapiens
guacgucucucucugauug

SEQ ID NO: 562772 - RNA, 19 nt, Homo sapiens
gggcauacauccacagauu

SEQ ID NO: 562773 - RNA, 19 nt, Homo sapiens
uagagaauguucccaauuu

SEQ ID NO: 562774 - RNA, 19 nt, Homo sapiens
uaacuuaccuagaaggauu

SEQ ID NO: 562775 - RNA, 19 nt, Homo sapiens
gcaagaacaucaucaagca

SEQ ID NO: 562776 - RNA, 19 nt, Homo sapiens
auacaaggaugcacauaua

SEQ ID NO: 562777 - RNA, 19 nt, Homo sapiens
gaaggacacuaaacuagau

SEQ ID NO: 562778 - RNA, 19 nt, Homo sapiens
gaaguuugauagauccuuu

SEQ ID NO: 562779 - RNA, 19 nt, Homo sapiens
gaucugcucaguaauauaa

SEQ ID NO: 562780 - RNA, 19 nt, Homo sapiens
uaagaacaaugccaacaaa

SEQ ID NO: 562781 - RNA, 19 nt, Homo sapiens
gaagucagccuacauaaca

SEQ ID NO: 562782 - RNA, 19 nt, Homo sapiens
gagaagcgcaccugccuua

SEQ ID NO: 562783 - RNA, 19 nt, Homo sapiens
agagagagcuuuaagugaa

SEQ ID NO: 562784 - RNA, 19 nt, Homo sapiens
gcaccaggauucuauuguu

SEQ ID NO: 562785 - RNA, 19 nt, Homo sapiens
gugauuaccugcugcauga

SEQ ID NO: 562786 - RNA, 19 nt, Homo sapiens
gugaguagccuaugaauga

SEQ ID NO: 562787 - RNA, 19 nt, Homo sapiens
ugagaaccaugacuuauga

SEQ ID NO: 562788 - RNA, 19 nt, Homo sapiens
caacagcaaaccugaauuu

SEQ ID NO: 562789 - RNA, 19 nt, Homo sapiens
ugaggaaacuacugaacua

SEQ ID NO: 562790 - RNA, 19 nt, Homo sapiens
gaagcgugcuaacgauaaa

SEQ ID NO: 562791 - RNA, 19 nt, Homo sapiens
gcagaaaugaucuugaauu

SEQ ID NO: 562792 - RNA, 19 nt, Homo sapiens
ggaaugcagucauccaugu

SEQ ID NO: 562793 - RNA, 19 nt, Homo sapiens
gaugugagcaaguucaaua

SEQ ID NO: 562794 - RNA, 19 nt, Homo sapiens
gcaaggauaugcccucagu

SEQ ID NO: 562795 - RNA, 19 nt, Homo sapiens
gauggaaggugauaaacug

SEQ ID NO: 562796 - RNA, 19 nt, Homo sapiens
uaacaaaucagaucagaug

SEQ ID NO: 562797 - RNA, 19 nt, Homo sapiens
gucaugugcugcaagauua

SEQ ID NO: 562798 - RNA, 19 nt, Homo sapiens
gaaugcauccuuaaccuuu

SEQ ID NO: 562799 - RNA, 19 nt, Homo sapiens
uagcagaaaugaucuugaa

SEQ ID NO: 562800 - RNA, 19 nt, Homo sapiens
gauaugcccucagucauga

SEQ ID NO: 562801 - RNA, 19 nt, Homo sapiens
caaaucagaucagauguuc

SEQ ID NO: 562802 - RNA, 19 nt, Homo sapiens
uuaauuguguuccagguua

SEQ ID NO: 562803 - RNA, 19 nt, Homo sapiens
aggaagagcugaaauuuag

SEQ ID NO: 562804 - RNA, 19 nt, Homo sapiens
ucacacaacuacuuucaug

SEQ ID NO: 562805 - RNA, 19 nt, Homo sapiens
ugaagugguuucuaagauu

SEQ ID NO: 562806 - RNA, 19 nt, Homo sapiens
aaccaugacuuaugacuuu

SEQ ID NO: 562807 - RNA, 19 nt, Homo sapiens
cauaguggauuaaugcauu

SEQ ID NO: 562808 - RNA, 19 nt, Homo sapiens
gaucagcacuguggucaga

SEQ ID NO: 562809 - RNA, 19 nt, Homo sapiens
gcucuaggcugcagacugu

SEQ ID NO: 562810 - RNA, 19 nt, Homo sapiens
gaagaggaucagaacuuua

SEQ ID NO: 562811 - RNA, 19 nt, Homo sapiens
gaacacuucuauugaacau

SEQ ID NO: 562812 - RNA, 19 nt, Homo sapiens
cuacagaccuauguguuaa

SEQ ID NO: 562813 - RNA, 19 nt, Homo sapiens
ggaaacuacugaacuagca

SEQ ID NO: 562814 - RNA, 19 nt, Homo sapiens
ggagaagaaugaguaugaa

SEQ ID NO: 562815 - RNA, 19 nt, Homo sapiens
gcauuuaucuugucauugc

SEQ ID NO: 562816 - RNA, 19 nt, Homo sapiens
gcaccugccuuaccagugu

SEQ ID NO: 562817 - RNA, 19 nt, Homo sapiens
ugaagaggaucagaacuuu

SEQ ID NO: 562818 - RNA, 19 nt, Homo sapiens
gaaauggcacuucuagaau

SEQ ID NO: 562819 - RNA, 19 nt, Homo sapiens
ugaaauggcacuucuagaa

SEQ ID NO: 562820 - RNA, 19 nt, Homo sapiens
gcuacagaccuauguguua

SEQ ID NO: 562821 - RNA, 19 nt, Homo sapiens
aaauaaacaugaccacgaa

SEQ ID NO: 562822 - RNA, 19 nt, Homo sapiens
gugaaagacuugcugcuau

SEQ ID NO: 562823 - RNA, 19 nt, Homo sapiens
caagaguaucccaguauua

SEQ ID NO: 562824 - RNA, 19 nt, Homo sapiens
ggacaugacgucugugguu

SEQ ID NO: 562825 - RNA, 19 nt, Homo sapiens
acaauucauucaccagaua

SEQ ID NO: 562826 - RNA, 19 nt, Homo sapiens
gcacauauacgugacagaa

SEQ ID NO: 562827 - RNA, 19 nt, Homo sapiens
caagaaggacacuaaacua

SEQ ID NO: 562828 - RNA, 19 nt, Homo sapiens
ugcaaggacuucugugaua

SEQ ID NO: 562829 - RNA, 19 nt, Homo sapiens
gcaaacugauggcuagcaa

SEQ ID NO: 562830 - RNA, 19 nt, Homo sapiens
acacuucuauugaacauga

SEQ ID NO: 562831 - RNA, 19 nt, Homo sapiens
gagggaaguuugauagauc

SEQ ID NO: 562832 - RNA, 19 nt, Homo sapiens
uagcaauacuggaauauag

SEQ ID NO: 562833 - RNA, 19 nt, Homo sapiens
ccaagaguaucccaguauu

SEQ ID NO: 562834 - RNA, 19 nt, Homo sapiens
acauauacgugacagaauu

SEQ ID NO: 562835 - RNA, 19 nt, Homo sapiens
ggaaacuucuccugaaugc

SEQ ID NO: 562836 - RNA, 19 nt, Homo sapiens
ccaauacagucacacauca

SEQ ID NO: 562837 - RNA, 19 nt, Homo sapiens
gagaaaggacccauuaagu

SEQ ID NO: 562838 - RNA, 19 nt, Homo sapiens
gacaggagucacagaaaua

SEQ ID NO: 562839 - RNA, 19 nt, Homo sapiens
gaugaaaguucuuauucca

SEQ ID NO: 562840 - RNA, 19 nt, Homo sapiens
ggaaugucaagccaucuua

SEQ ID NO: 562841 - RNA, 19 nt, Homo sapiens
ggacuggaaugcagcaaag

SEQ ID NO: 562842 - RNA, 19 nt, Homo sapiens
guaaacuggugagaguaua

SEQ ID NO: 562843 - RNA, 19 nt, Homo sapiens
uagcauucauuaccuguuu

SEQ ID NO: 562844 - RNA, 19 nt, Homo sapiens
gcaacaucauggagaguga

SEQ ID NO: 562845 - RNA, 19 nt, Homo sapiens
uaaauggacugauguacag

SEQ ID NO: 562846 - RNA, 19 nt, Homo sapiens
ugugaugacuuacaaauuc

SEQ ID NO: 562847 - RNA, 19 nt, Homo sapiens
ugacagcaguggugaugaa

SEQ ID NO: 562848 - RNA, 19 nt, Homo sapiens
agaacucacuggaaagaaa

SEQ ID NO: 562849 - RNA, 19 nt, Homo sapiens
ccucagucaugauucuuua

SEQ ID NO: 562850 - RNA, 19 nt, Homo sapiens
gauaaacugauacuccuuu

SEQ ID NO: 562851 - RNA, 19 nt, Homo sapiens
ucucagaucuacagaacaa

SEQ ID NO: 562852 - RNA, 19 nt, Homo sapiens
ggaagcgugcuaacgauaa

SEQ ID NO: 562853 - RNA, 19 nt, Homo sapiens
caggaagagcugaaauuua

SEQ ID NO: 562854 - RNA, 19 nt, Homo sapiens
cuaaggaguugauugauua

SEQ ID NO: 562855 - RNA, 19 nt, Homo sapiens
gcaagaagcuaccggaugu

SEQ ID NO: 562856 - RNA, 19 nt, Homo sapiens
gaaauagccuggcacaaca

SEQ ID NO: 562857 - RNA, 19 nt, Homo sapiens
gaagugacauguguacuga

SEQ ID NO: 562858 - RNA, 19 nt, Homo sapiens
uaacagaagugacaugugu

SEQ ID NO: 562859 - RNA, 19 nt, Homo sapiens
gaacuuggaauuccuuuga

SEQ ID NO: 562860 - RNA, 19 nt, Homo sapiens
cagaagaaauucagucaga

SEQ ID NO: 562861 - RNA, 19 nt, Homo sapiens
aaauauggaugcuguugua

SEQ ID NO: 562862 - RNA, 19 nt, Homo sapiens
ugagaaagaugaacuugga

SEQ ID NO: 562863 - RNA, 19 nt, Homo sapiens
gaaggugaaugauaacaag

SEQ ID NO: 562864 - RNA, 19 nt, Homo sapiens
gaaaagccaucguggaauu

SEQ ID NO: 562865 - RNA, 19 nt, Homo sapiens
guagaacggugcccgagaa

SEQ ID NO: 562866 - RNA, 19 nt, Homo sapiens
ggauaacacagccaucaua

SEQ ID NO: 562867 - RNA, 19 nt, Homo sapiens
gaaagaugaacuuggaauu

SEQ ID NO: 562868 - RNA, 19 nt, Homo sapiens
gaagaugcugucuggaaua

SEQ ID NO: 562869 - RNA, 19 nt, Homo sapiens
gcucauuugugacauuuga

SEQ ID NO: 562870 - RNA, 19 nt, Homo sapiens
uguggaaggugaaugauaa

SEQ ID NO: 562871 - RNA, 19 nt, Homo sapiens
uuaggaagaugagaaagua

SEQ ID NO: 562872 - RNA, 19 nt, Homo sapiens
caugagaacuccugauaca

SEQ ID NO: 562873 - RNA, 19 nt, Homo sapiens
cauaugggaugucagcaaa

SEQ ID NO: 562874 - RNA, 19 nt, Homo sapiens
gaauuaggaagaugagaaa

SEQ ID NO: 562875 - RNA, 19 nt, Homo sapiens
gaagaaauucagucagaga

SEQ ID NO: 562876 - RNA, 19 nt, Homo sapiens
ccacuuagaagauguguau

SEQ ID NO: 562877 - RNA, 19 nt, Homo sapiens
ucuaaggaguugauugauu

SEQ ID NO: 562878 - RNA, 19 nt, Homo sapiens
cgaagaugcugucuggaau

SEQ ID NO: 562879 - RNA, 19 nt, Homo sapiens
gcguguggcuuucaauguu

SEQ ID NO: 562880 - RNA, 19 nt, Homo sapiens
ccaaagccgucaauguugu

SEQ ID NO: 562881 - RNA, 19 nt, Homo sapiens
gaagugauuguuagauuuc

SEQ ID NO: 562882 - RNA, 19 nt, Homo sapiens
ggacgguuacugcucauuu

SEQ ID NO: 562883 - RNA, 19 nt, Homo sapiens
gaagcuaccggauguuuca

SEQ ID NO: 562884 - RNA, 19 nt, Homo sapiens
ggaagaugagaaaguaauu

SEQ ID NO: 562885 - RNA, 19 nt, Homo sapiens
gguuacugcucauuuguga

SEQ ID NO: 562886 - RNA, 19 nt, Homo sapiens
cuggagcgguucaacguua

SEQ ID NO: 562887 - RNA, 19 nt, Homo sapiens
uauggaugcuguuguauuc

SEQ ID NO: 562888 - RNA, 19 nt, Homo sapiens
gauaacacagccaucauau

SEQ ID NO: 562889 - RNA, 19 nt, Homo sapiens
caacugaugggaauuuaau

SEQ ID NO: 562890 - RNA, 19 nt, Homo sapiens
gcagaucgcuuuucaggau

SEQ ID NO: 562891 - RNA, 19 nt, Homo sapiens
caucacuccugcugucaaa

SEQ ID NO: 562892 - RNA, 19 nt, Homo sapiens
ggcaacugaugggaauuua

SEQ ID NO: 562893 - RNA, 19 nt, Homo sapiens
gaacuggacgguugugaag

SEQ ID NO: 562894 - RNA, 19 nt, Homo sapiens
uaccaaagccgucaauguu

SEQ ID NO: 562895 - RNA, 19 nt, Homo sapiens
gggacacacuguaaaugga

SEQ ID NO: 562896 - RNA, 19 nt, Homo sapiens
gacgguuacugcucauuug

SEQ ID NO: 562897 - RNA, 19 nt, Homo sapiens
gcuguccggucuacuuuga

SEQ ID NO: 562898 - RNA, 19 nt, Homo sapiens
gaauaccacuuauguuuuc

SEQ ID NO: 562899 - RNA, 19 nt, Homo sapiens
ggaaggugaaugauaacaa

SEQ ID NO: 562900 - RNA, 19 nt, Homo sapiens
guaccaaccagugugauuu

SEQ ID NO: 562901 - RNA, 19 nt, Homo sapiens
gaacuccugauacagcaaa

SEQ ID NO: 562902 - RNA, 19 nt, Homo sapiens
gaaauauggaugcuguugu

SEQ ID NO: 562903 - RNA, 19 nt, Homo sapiens
ggaaucuggugaaaaugua

SEQ ID NO: 562904 - RNA, 19 nt, Homo sapiens
gucaauauguugcuacucu

SEQ ID NO: 562905 - RNA, 19 nt, Homo sapiens
gcaacugaugggaauuuaa

SEQ ID NO: 562906 - RNA, 19 nt, Homo sapiens
ggacgguugugaagacucu

SEQ ID NO: 562907 - RNA, 19 nt, Homo sapiens
gcccaucgcucaucuucca

SEQ ID NO: 562908 - RNA, 19 nt, Homo sapiens
aaacagguguggagcugau

SEQ ID NO: 562909 - RNA, 19 nt, Homo sapiens
gagcgggacacacuguaaa

SEQ ID NO: 562910 - RNA, 19 nt, Homo sapiens
ggagcgggacacacuguaa

SEQ ID NO: 562911 - RNA, 19 nt, Homo sapiens
cugcaagccuggagcaaga

SEQ ID NO: 562912 - RNA, 19 nt, Homo sapiens
guaaugaauaccacuuaug

SEQ ID NO: 562913 - RNA, 19 nt, Homo sapiens
guucaacguuauccagugu

SEQ ID NO: 562914 - RNA, 19 nt, Homo sapiens
gaacggugcccgagaaacg

SEQ ID NO: 562915 - RNA, 19 nt, Homo sapiens
uugguuacgugucuaauau

SEQ ID NO: 562916 - RNA, 19 nt, Homo sapiens
gagggucacucugaacaca

SEQ ID NO: 562917 - RNA, 19 nt, Homo sapiens
guguggagcugaugagucu

SEQ ID NO: 562918 - RNA, 19 nt, Homo sapiens
cgacggaucuuugcuucuc

SEQ ID NO: 562919 - RNA, 19 nt, Homo sapiens
ucaacguuauccaguguga

SEQ ID NO: 562920 - RNA, 19 nt, Homo sapiens
ugacauguguacugauuuu

SEQ ID NO: 562921 - RNA, 19 nt, Homo sapiens
gcagggagacgguaaagcu

SEQ ID NO: 562922 - RNA, 19 nt, Homo sapiens
gacggacacuccaccaagu

SEQ ID NO: 562923 - RNA, 19 nt, Homo sapiens
caacaaggagcccguguac

SEQ ID NO: 562924 - RNA, 19 nt, Homo sapiens
cagcaaaggacaaaagaua

SEQ ID NO: 562925 - RNA, 19 nt, Homo sapiens
gggcaacugaugggaauuu

SEQ ID NO: 562926 - RNA, 19 nt, Homo sapiens
acaaggagccggagcagau

SEQ ID NO: 562927 - RNA, 19 nt, Homo sapiens
agugacauguguacugauu

SEQ ID NO: 562928 - RNA, 19 nt, Homo sapiens
gacacacuguaaauggauu

SEQ ID NO: 562929 - RNA, 19 nt, Homo sapiens
gaugggaccucggcuucug

SEQ ID NO: 562930 - RNA, 19 nt, Homo sapiens
ugaaauagccuggcacaac

SEQ ID NO: 562931 - RNA, 19 nt, Homo sapiens
aacaugagaacuccugaua

SEQ ID NO: 562932 - RNA, 19 nt, Homo sapiens
cguguggcuuucaauguuu

SEQ ID NO: 562933 - RNA, 19 nt, Homo sapiens
gaugagaaaguaauuugag

SEQ ID NO: 562934 - RNA, 19 nt, Homo sapiens
ggacacacuguaaauggau

SEQ ID NO: 562935 - RNA, 19 nt, Homo sapiens
ccaccaaguucuguaccaa

SEQ ID NO: 562936 - RNA, 19 nt, Homo sapiens
acagggugcugcgaguaua

SEQ ID NO: 562937 - RNA, 19 nt, Homo sapiens
ggacuccuuuucaauaaga

SEQ ID NO: 562938 - RNA, 19 nt, Homo sapiens
gagggacuccuuuucaaua

SEQ ID NO: 562939 - RNA, 19 nt, Homo sapiens
gaacaugagaacuccugau

SEQ ID NO: 562940 - RNA, 19 nt, Homo sapiens
gguuacgugucuaauauac

SEQ ID NO: 562941 - RNA, 19 nt, Homo sapiens
gugcugcgaguauacagua

SEQ ID NO: 562942 - RNA, 19 nt, Homo sapiens
agaauuaggaagaugagaa

SEQ ID NO: 562943 - RNA, 19 nt, Homo sapiens
gaaaagggaccagauggaa

SEQ ID NO: 562944 - RNA, 19 nt, Homo sapiens
ugacauuugagaaagauga

SEQ ID NO: 562945 - RNA, 19 nt, Homo sapiens
caaaggaggcacggaaagu

SEQ ID NO: 562946 - RNA, 19 nt, Homo sapiens
aaagaugaacuuggaauuc

SEQ ID NO: 562947 - RNA, 19 nt, Homo sapiens
uaaaaguuauguccaagga

SEQ ID NO: 562948 - RNA, 19 nt, Homo sapiens
caauauguugcuacucuga

SEQ ID NO: 562949 - RNA, 19 nt, Homo sapiens
cuucuaaggaguugauuga

SEQ ID NO: 562950 - RNA, 19 nt, Homo sapiens
gaaagucuggacccuugau

SEQ ID NO: 562951 - RNA, 19 nt, Homo sapiens
gaaagagaagccaguuuug

SEQ ID NO: 562952 - RNA, 19 nt, Homo sapiens
acgacagcaugaagucuuu

SEQ ID NO: 562953 - RNA, 19 nt, Homo sapiens
ucgaagaugcugucuggaa

SEQ ID NO: 562954 - RNA, 19 nt, Homo sapiens
gcagugagguuucuucaau

SEQ ID NO: 562955 - RNA, 19 nt, Homo sapiens
gaagggaaauaaagugugu

SEQ ID NO: 562956 - RNA, 19 nt, Homo sapiens
gaucaggaaaccagaaaua

SEQ ID NO: 562957 - RNA, 19 nt, Homo sapiens
gaauaaacgccuucccaaa

SEQ ID NO: 562958 - RNA, 19 nt, Homo sapiens
caugaaagguugguucuug

SEQ ID NO: 562959 - RNA, 19 nt, Homo sapiens
ugaagggacuuuugaguua

SEQ ID NO: 562960 - RNA, 19 nt, Homo sapiens
agugagguuucuucaauua

SEQ ID NO: 562961 - RNA, 19 nt, Homo sapiens
ggcgagagcaggaauguuu

SEQ ID NO: 562962 - RNA, 19 nt, Homo sapiens
gaggaucgcccguggcaaa

SEQ ID NO: 562963 - RNA, 19 nt, Homo sapiens
caaggugaauaaagaagug

SEQ ID NO: 562964 - RNA, 19 nt, Homo sapiens
gggcugaaguccagaucuu

SEQ ID NO: 562965 - RNA, 19 nt, Homo sapiens
acaaaucgcagccagcuuu

SEQ ID NO: 562966 - RNA, 19 nt, Homo sapiens
ggaaagauugcaaggugaa

SEQ ID NO: 562967 - RNA, 19 nt, Homo sapiens
gagcaacgcguuuguagag

SEQ ID NO: 562968 - RNA, 19 nt, Homo sapiens
agucucaguucucuuaauu

SEQ ID NO: 562969 - RNA, 19 nt, Homo sapiens
ucacagaccuggccaaccu

SEQ ID NO: 562970 - RNA, 19 nt, Homo sapiens
ggcguucucucucuaagga

SEQ ID NO: 562971 - RNA, 19 nt, Homo sapiens
ggaagaaagggaaauugca

SEQ ID NO: 562972 - RNA, 19 nt, Homo sapiens
gguugguucuugacucuga

SEQ ID NO: 562973 - RNA, 19 nt, Homo sapiens
gaagggacuuuugaguuaa

SEQ ID NO: 562974 - RNA, 19 nt, Homo sapiens
gcagccagcuuuuccagaa

SEQ ID NO: 562975 - RNA, 19 nt, Homo sapiens
gggcugcucucacauacag

SEQ ID NO: 562976 - RNA, 19 nt, Homo sapiens
cagugagguuucuucaauu

SEQ ID NO: 562977 - RNA, 19 nt, Homo sapiens
ugagguuucuucaauuagu

SEQ ID NO: 562978 - RNA, 19 nt, Homo sapiens
ugaggaaggugcuggaacu

SEQ ID NO: 562979 - RNA, 19 nt, Homo sapiens
gguggcaaguggccuuaug

SEQ ID NO: 562980 - RNA, 19 nt, Homo sapiens
caauuagucucaguucucu

SEQ ID NO: 562981 - RNA, 19 nt, Homo sapiens
gcugggcugcucucacaua

SEQ ID NO: 562982 - RNA, 19 nt, Homo sapiens
uaaaguguguuggcguuag

SEQ ID NO: 562983 - RNA, 19 nt, Homo sapiens
gcaggcguucucucucuaa

SEQ ID NO: 562984 - RNA, 19 nt, Homo sapiens
gcaaggugaauaaagaagu

SEQ ID NO: 562985 - RNA, 19 nt, Homo sapiens
gcugaaguccagaucuuug

SEQ ID NO: 562986 - RNA, 19 nt, Homo sapiens
gaauggcagugagguuucu

SEQ ID NO: 562987 - RNA, 19 nt, Homo sapiens
ggaauggcagugagguuuc

SEQ ID NO: 562988 - RNA, 19 nt, Homo sapiens
uggcugggcugcucucaca

SEQ ID NO: 562989 - RNA, 19 nt, Homo sapiens
aagauugcaaggugaauaa

SEQ ID NO: 562990 - RNA, 19 nt, Homo sapiens
aaagauugcaaggugaaua

SEQ ID NO: 562991 - RNA, 19 nt, Homo sapiens
cgucugagguuuuauacuu

SEQ ID NO: 562992 - RNA, 19 nt, Homo sapiens
gcugucggcugcuuuccau

SEQ ID NO: 562993 - RNA, 19 nt, Homo sapiens
gaaggaaguggucgaagcu

SEQ ID NO: 562994 - RNA, 19 nt, Homo sapiens
gagguuucuucaauuaguc

SEQ ID NO: 562995 - RNA, 19 nt, Homo sapiens
gaggagcugucggcugcuu

SEQ ID NO: 562996 - RNA, 19 nt, Homo sapiens
ggaaagugacgcgcaugga

SEQ ID NO: 562997 - RNA, 19 nt, Homo sapiens
aagcucacguggaccagaa

SEQ ID NO: 562998 - RNA, 19 nt, Homo sapiens
auugcaaggugaauaaaga

SEQ ID NO: 562999 - RNA, 19 nt, Homo sapiens
auuagucucaguucucuua

SEQ ID NO: 563000 - RNA, 19 nt, Homo sapiens
augaaagguugguucuuga

SEQ ID NO: 563001 - RNA, 19 nt, Homo sapiens
gaaaccagaaauaccacau

SEQ ID NO: 563002 - RNA, 19 nt, Homo sapiens
aaaccagaaauaccacauu

SEQ ID NO: 563003 - RNA, 19 nt, Homo sapiens
gaaggcgagagcaggaaug

SEQ ID NO: 563004 - RNA, 19 nt, Homo sapiens
caggaaaccagaaauacca

SEQ ID NO: 563005 - RNA, 19 nt, Homo sapiens
ucagugcagccaaccauga

SEQ ID NO: 563006 - RNA, 19 nt, Homo sapiens
ucaggaagaaagggaaauu

SEQ ID NO: 563007 - RNA, 19 nt, Homo sapiens
gaggaauggcagugagguu

SEQ ID NO: 563008 - RNA, 19 nt, Homo sapiens
ucggagccauggugaggaa

SEQ ID NO: 563009 - RNA, 19 nt, Homo sapiens
gaaagauugcaaggugaau

SEQ ID NO: 563010 - RNA, 19 nt, Homo sapiens
ggguucagguguggcagaa

SEQ ID NO: 563011 - RNA, 19 nt, Homo sapiens
ucaauuagucucaguucuc

SEQ ID NO: 563012 - RNA, 19 nt, Homo sapiens
aauaaacgccuucccaaaa

SEQ ID NO: 563013 - RNA, 19 nt, Homo sapiens
gacgagcaacgcguuugua

SEQ ID NO: 563014 - RNA, 19 nt, Homo sapiens
ugcuggaacucacuggaaa

SEQ ID NO: 563015 - RNA, 19 nt, Homo sapiens
gaaagguugguucuugacu

SEQ ID NO: 563016 - RNA, 19 nt, Homo sapiens
caucuuuccaggaggcuuu

SEQ ID NO: 563017 - RNA, 19 nt, Homo sapiens
gguuuuauacuucagguua

SEQ ID NO: 563018 - RNA, 19 nt, Homo sapiens
gggacuugccucacugugu

SEQ ID NO: 563019 - RNA, 19 nt, Homo sapiens
cagcuaggcgccaggacuu

SEQ ID NO: 563020 - RNA, 19 nt, Homo sapiens
cacagggacuugccucacu

SEQ ID NO: 563021 - RNA, 19 nt, Homo sapiens
uacuucagguuaguuaguu

SEQ ID NO: 563022 - RNA, 19 nt, Homo sapiens
ggagcugucggcugcuuuc

SEQ ID NO: 563023 - RNA, 19 nt, Homo sapiens
gugcuggaacucacuggaa

SEQ ID NO: 563024 - RNA, 19 nt, Homo sapiens
caggaagaaagggaaauug

SEQ ID NO: 563025 - RNA, 19 nt, Homo sapiens
cgagcaacgcguuuguaga

SEQ ID NO: 563026 - RNA, 19 nt, Homo sapiens
gggcagaguucaucuucuu

SEQ ID NO: 563027 - RNA, 19 nt, Homo sapiens
gaaauaaagaugccucagu

SEQ ID NO: 563028 - RNA, 19 nt, Homo sapiens
gagcugaugcugcagauga

SEQ ID NO: 563029 - RNA, 19 nt, Homo sapiens
cagcagcgcuuguccuaca

SEQ ID NO: 563030 - RNA, 19 nt, Homo sapiens
gcagaguucaucuucuuga

SEQ ID NO: 563031 - RNA, 19 nt, Homo sapiens
gcagcccugucccaccaua

SEQ ID NO: 563032 - RNA, 19 nt, Homo sapiens
ugugugacccagagaaaua

SEQ ID NO: 563033 - RNA, 19 nt, Homo sapiens
ggaguugcccagcucauuc

SEQ ID NO: 563034 - RNA, 19 nt, Homo sapiens
uacagagccuggugaagga

SEQ ID NO: 563035 - RNA, 19 nt, Homo sapiens
gcugucaaacccuaggaua

SEQ ID NO: 563036 - RNA, 19 nt, Homo sapiens
acccuaggauagucucaua

SEQ ID NO: 563037 - RNA, 19 nt, Homo sapiens
ccuaggauagucucauaaa

SEQ ID NO: 563038 - RNA, 19 nt, Homo sapiens
ucugggacuugcugucaaa

SEQ ID NO: 563039 - RNA, 19 nt, Homo sapiens
cuaggauagucucauaaag

SEQ ID NO: 563040 - RNA, 19 nt, Homo sapiens
agaugaaccugcuggaacu

SEQ ID NO: 563041 - RNA, 19 nt, Homo sapiens
uaggauagucucauaaagg

SEQ ID NO: 563042 - RNA, 19 nt, Homo sapiens
gcuucuacgugaccaccaa

SEQ ID NO: 563043 - RNA, 19 nt, Homo sapiens
ugacccagagaaauaaaga

SEQ ID NO: 563044 - RNA, 19 nt, Homo sapiens
gcagagcacacuggagaag

SEQ ID NO: 563045 - RNA, 19 nt, Homo sapiens
gaaccugcuggaacucauc

SEQ ID NO: 563046 - RNA, 19 nt, Homo sapiens
gcaccguguucgaaaucgu

SEQ ID NO: 563047 - RNA, 19 nt, Homo sapiens
guucaucuucuugaccuuu

SEQ ID NO: 563048 - RNA, 19 nt, Homo sapiens
gucaaacccuaggauaguc

SEQ ID NO: 563049 - RNA, 19 nt, Homo sapiens
aaaagagccuguacaacca

SEQ ID NO: 563050 - RNA, 19 nt, Homo sapiens
ggaagaccaugcucaauga

SEQ ID NO: 563051 - RNA, 19 nt, Homo sapiens
gaacccugaucuagacuua

SEQ ID NO: 563052 - RNA, 19 nt, Homo sapiens
gaagugaccugcucuccuu

SEQ ID NO: 563053 - RNA, 19 nt, Homo sapiens
ccaacgagcugcacugcua

SEQ ID NO: 563054 - RNA, 19 nt, Homo sapiens
ggacacgcaucccaacuga

SEQ ID NO: 563055 - RNA, 19 nt, Homo sapiens
gaaguggccuagugcaaga

SEQ ID NO: 563056 - RNA, 19 nt, Homo sapiens
gcucuuggcuccuguggaa

SEQ ID NO: 563057 - RNA, 19 nt, Homo sapiens
acacagugguggccuauaa

SEQ ID NO: 563058 - RNA, 19 nt, Homo sapiens
ccaacaaccucuuccaguu

SEQ ID NO: 563059 - RNA, 19 nt, Homo sapiens
ucaccaaggucuccaaguu

SEQ ID NO: 563060 - RNA, 19 nt, Homo sapiens
gaucaaauacccacggaaa

SEQ ID NO: 563061 - RNA, 19 nt, Homo sapiens
ggacauuuauuccaauucu

SEQ ID NO: 563062 - RNA, 19 nt, Homo sapiens
ggaagaagccagcaaaguc

SEQ ID NO: 563063 - RNA, 19 nt, Homo sapiens
agacaagccuccauuaaag

SEQ ID NO: 563064 - RNA, 19 nt, Homo sapiens
guaaaggagucccacuuca

SEQ ID NO: 563065 - RNA, 19 nt, Homo sapiens
caacaaccucuuccaguuu

SEQ ID NO: 563066 - RNA, 19 nt, Homo sapiens
gacaagcuguggaucuuug

SEQ ID NO: 563067 - RNA, 19 nt, Homo sapiens
aaaacgaccucuuugaaua

SEQ ID NO: 563068 - RNA, 19 nt, Homo sapiens
cagacaagccuccauuaaa

SEQ ID NO: 563069 - RNA, 19 nt, Homo sapiens
ccucuccucuccacugaua

SEQ ID NO: 563070 - RNA, 19 nt, Homo sapiens
gcaaagcggagccaaaaua

SEQ ID NO: 563071 - RNA, 19 nt, Homo sapiens
caacccaccuggaacuugu

SEQ ID NO: 563072 - RNA, 19 nt, Homo sapiens
gaaaggccauguggaggau

SEQ ID NO: 563073 - RNA, 19 nt, Homo sapiens
caagauguuuguauucucu

SEQ ID NO: 563074 - RNA, 19 nt, Homo sapiens
aaugacauguggacaauug

SEQ ID NO: 563075 - RNA, 19 nt, Homo sapiens
gacauuggcacaucucuga

SEQ ID NO: 563076 - RNA, 19 nt, Homo sapiens
gggccacgguguacaguga

SEQ ID NO: 563077 - RNA, 19 nt, Homo sapiens
gggaagaccaugcucaaug

SEQ ID NO: 563078 - RNA, 19 nt, Homo sapiens
ugacaucacucuguugcuu

SEQ ID NO: 563079 - RNA, 19 nt, Homo sapiens
gguuccaguucuccuguua

SEQ ID NO: 563080 - RNA, 19 nt, Homo sapiens
gagcagcauguuugucuuu

SEQ ID NO: 563081 - RNA, 19 nt, Homo sapiens
acccugaucuagacuuaua

SEQ ID NO: 563082 - RNA, 19 nt, Homo sapiens
gcucuaugcugacccuugu

SEQ ID NO: 563083 - RNA, 19 nt, Homo sapiens
ggccuuaccugucucuauc

SEQ ID NO: 563084 - RNA, 19 nt, Homo sapiens
ugagaagacuaccggcuau

SEQ ID NO: 563085 - RNA, 19 nt, Homo sapiens
ugaaugacauguggacaau

SEQ ID NO: 563086 - RNA, 19 nt, Homo sapiens
ccaggugcauucacucaga

SEQ ID NO: 563087 - RNA, 19 nt, Homo sapiens
ggacucgcucuacuuguuu

SEQ ID NO: 563088 - RNA, 19 nt, Homo sapiens
ccacguagccauugucaca

SEQ ID NO: 563089 - RNA, 19 nt, Homo sapiens
gaagucccgagauguguuu

SEQ ID NO: 563090 - RNA, 19 nt, Homo sapiens
caagaagucccgagaugug

SEQ ID NO: 563091 - RNA, 19 nt, Homo sapiens
gaucuuugcuggcuaugac

SEQ ID NO: 563092 - RNA, 19 nt, Homo sapiens
ggaggaggcuuagcagacu

SEQ ID NO: 563093 - RNA, 19 nt, Homo sapiens
uaaaggagucccacuucaa

SEQ ID NO: 563094 - RNA, 19 nt, Homo sapiens
acaccgacaagaucaaaua

SEQ ID NO: 563095 - RNA, 19 nt, Homo sapiens
gcccagagccuccaaagag

SEQ ID NO: 563096 - RNA, 19 nt, Homo sapiens
ccaaggcuccuccaacaug

SEQ ID NO: 563097 - RNA, 19 nt, Homo sapiens
acaacacgcugcccaacga

SEQ ID NO: 563098 - RNA, 19 nt, Homo sapiens
ccacucggccgucgucuau

SEQ ID NO: 563099 - RNA, 19 nt, Homo sapiens
acagacaagccuccauuaa

SEQ ID NO: 563100 - RNA, 19 nt, Homo sapiens
ucaaccaggugaucaugau

SEQ ID NO: 563101 - RNA, 19 nt, Homo sapiens
gguaaaggagucccacuuc

SEQ ID NO: 563102 - RNA, 19 nt, Homo sapiens
gugacaagcuguggaucuu

SEQ ID NO: 563103 - RNA, 19 nt, Homo sapiens
aagaugagcugggaacaag

SEQ ID NO: 563104 - RNA, 19 nt, Homo sapiens
gcuaacaggagauccauag

SEQ ID NO: 563105 - RNA, 19 nt, Homo sapiens
ucacagacaagccuccauu

SEQ ID NO: 563106 - RNA, 19 nt, Homo sapiens
gcaagcagaaccuggagau

SEQ ID NO: 563107 - RNA, 19 nt, Homo sapiens
ggagcagcauguuugucuu

SEQ ID NO: 563108 - RNA, 19 nt, Homo sapiens
gggagcggaugaugaagca

SEQ ID NO: 563109 - RNA, 19 nt, Homo sapiens
gcacugccugcacaucauu

SEQ ID NO: 563110 - RNA, 19 nt, Homo sapiens
ucaguggccuuaccugucu

SEQ ID NO: 563111 - RNA, 19 nt, Homo sapiens
aagcagaaccuggagauga

SEQ ID NO: 563112 - RNA, 19 nt, Homo sapiens
gcggaauucugugacauca

SEQ ID NO: 563113 - RNA, 19 nt, Homo sapiens
cuacccaguuuccacaaga

SEQ ID NO: 563114 - RNA, 19 nt, Homo sapiens
ccgugucccuugcugagua

SEQ ID NO: 563115 - RNA, 19 nt, Homo sapiens
gcuaugcgcaugccuaugg

SEQ ID NO: 563116 - RNA, 19 nt, Homo sapiens
agcagaaccuggagaugaa

SEQ ID NO: 563117 - RNA, 19 nt, Homo sapiens
ugccugaacuucgugguaa

SEQ ID NO: 563118 - RNA, 19 nt, Homo sapiens
ucgaggugcucaugcaguu

SEQ ID NO: 563119 - RNA, 19 nt, Homo sapiens
gcacgcugcacgaggacua

SEQ ID NO: 563120 - RNA, 19 nt, Homo sapiens
ucgaguaccugacgcucaa

SEQ ID NO: 563121 - RNA, 19 nt, Homo sapiens
acagggagcggaugaugaa

SEQ ID NO: 563122 - RNA, 19 nt, Homo sapiens
gugguggccuauaaagaug

SEQ ID NO: 563123 - RNA, 19 nt, Homo sapiens
gcagggccacguagccauu

SEQ ID NO: 563124 - RNA, 19 nt, Homo sapiens
guucuccuguuacccuaaa

SEQ ID NO: 563125 - RNA, 19 nt, Homo sapiens
aacaaccucuuccaguuug

SEQ ID NO: 563126 - RNA, 19 nt, Homo sapiens
ucacugaacccugaucuag

SEQ ID NO: 563127 - RNA, 19 nt, Homo sapiens
gcccauggcuuagcagaac

SEQ ID NO: 563128 - RNA, 19 nt, Homo sapiens
cccagagccuccaaagaga

SEQ ID NO: 563129 - RNA, 19 nt, Homo sapiens
aggacucgcucuacuuguu

SEQ ID NO: 563130 - RNA, 19 nt, Homo sapiens
gaagaugggcaggugaaca

SEQ ID NO: 563131 - RNA, 19 nt, Homo sapiens
ucauggauguguacaaacu

SEQ ID NO: 563132 - RNA, 19 nt, Homo sapiens
ggagcggguuggcuucaag

SEQ ID NO: 563133 - RNA, 19 nt, Homo sapiens
cacagacaagccuccauua

SEQ ID NO: 563134 - RNA, 19 nt, Homo sapiens
gccccaaacucauuaauuc

SEQ ID NO: 563135 - RNA, 19 nt, Homo sapiens
uaugggagcagcauguuug

SEQ ID NO: 563136 - RNA, 19 nt, Homo sapiens
cgcaggcacuggacaugaa

SEQ ID NO: 563137 - RNA, 19 nt, Homo sapiens
gggaacaagggaagagaga

SEQ ID NO: 563138 - RNA, 19 nt, Homo sapiens
gaggaggcuuagcagacuu

SEQ ID NO: 563139 - RNA, 19 nt, Homo sapiens
ccaaacucauuaauucacu

SEQ ID NO: 563140 - RNA, 19 nt, Homo sapiens
cagggcagccuccuccaaa

SEQ ID NO: 563141 - RNA, 19 nt, Homo sapiens
caagaugagcugggaacaa

SEQ ID NO: 563142 - RNA, 19 nt, Homo sapiens
ggcccugaguggcaaguug

SEQ ID NO: 563143 - RNA, 19 nt, Homo sapiens
guaccugacgcucaacuuc

SEQ ID NO: 563144 - RNA, 19 nt, Homo sapiens
gggaagaagccagcaaagu

SEQ ID NO: 563145 - RNA, 19 nt, Homo sapiens
caccacaacccaccuggaa

SEQ ID NO: 563146 - RNA, 19 nt, Homo sapiens
ugccugcccugccuacuga

SEQ ID NO: 563147 - RNA, 19 nt, Homo sapiens
gcagcauguuugucuuugg

SEQ ID NO: 563148 - RNA, 19 nt, Homo sapiens
ugaacuucgugguaaagga

SEQ ID NO: 563149 - RNA, 19 nt, Homo sapiens
ggacggaguggaaaauuga

SEQ ID NO: 563150 - RNA, 19 nt, Homo sapiens
gcaaagugauccaguguuu

SEQ ID NO: 563151 - RNA, 19 nt, Homo sapiens
gcagagaaguuguuuguga

SEQ ID NO: 563152 - RNA, 19 nt, Homo sapiens
gcaguguacuuccuucuua

SEQ ID NO: 563153 - RNA, 19 nt, Homo sapiens
aaaccaaccucuggaauua

SEQ ID NO: 563154 - RNA, 19 nt, Homo sapiens
gcacacgggucauggagua

SEQ ID NO: 563155 - RNA, 19 nt, Homo sapiens
gggaggaucuaguuaaauu

SEQ ID NO: 563156 - RNA, 19 nt, Homo sapiens
gagagacgguccagaaauu

SEQ ID NO: 563157 - RNA, 19 nt, Homo sapiens
gcacaggaaucuacagaau

SEQ ID NO: 563158 - RNA, 19 nt, Homo sapiens
ccgaguggcuugucaauuu

SEQ ID NO: 563159 - RNA, 19 nt, Homo sapiens
guaagcaacuccuagagaa

SEQ ID NO: 563160 - RNA, 19 nt, Homo sapiens
gaggaggccuucaccguuu

SEQ ID NO: 563161 - RNA, 19 nt, Homo sapiens
gaaagcaguagauguguuu

SEQ ID NO: 563162 - RNA, 19 nt, Homo sapiens
gagagaaugccuacuauga

SEQ ID NO: 563163 - RNA, 19 nt, Homo sapiens
gagaggauaugccgagaga

SEQ ID NO: 563164 - RNA, 19 nt, Homo sapiens
cacccuaccugcagaguua

SEQ ID NO: 563165 - RNA, 19 nt, Homo sapiens
gagagagaaugccuacuau

SEQ ID NO: 563166 - RNA, 19 nt, Homo sapiens
agaaguggcugaaagaaga

SEQ ID NO: 563167 - RNA, 19 nt, Homo sapiens
gcacaucauugaaguugga

SEQ ID NO: 563168 - RNA, 19 nt, Homo sapiens
gauccucccuguucgcuuu

SEQ ID NO: 563169 - RNA, 19 nt, Homo sapiens
gcacaggucacgaucauug

SEQ ID NO: 563170 - RNA, 19 nt, Homo sapiens
cagccgaccugccuaauga

SEQ ID NO: 563171 - RNA, 19 nt, Homo sapiens
gagaaugccuacuaugaca

SEQ ID NO: 563172 - RNA, 19 nt, Homo sapiens
caaccaacgugcuucagaa

SEQ ID NO: 563173 - RNA, 19 nt, Homo sapiens
acaaaggccucuucuacuu

SEQ ID NO: 563174 - RNA, 19 nt, Homo sapiens
guccagaaauuccagagua

SEQ ID NO: 563175 - RNA, 19 nt, Homo sapiens
gaccacaccuggacaguca

SEQ ID NO: 563176 - RNA, 19 nt, Homo sapiens
ggacaucauuaccaagguu

SEQ ID NO: 563177 - RNA, 19 nt, Homo sapiens
gggacgacccuuccucuua

SEQ ID NO: 563178 - RNA, 19 nt, Homo sapiens
ggaccgggcauaugaguuu

SEQ ID NO: 563179 - RNA, 19 nt, Homo sapiens
gaagauaguucuggauaac

SEQ ID NO: 563180 - RNA, 19 nt, Homo sapiens
gcacuacaccgaccucuau

SEQ ID NO: 563181 - RNA, 19 nt, Homo sapiens
caaugcagcucuacucugu

SEQ ID NO: 563182 - RNA, 19 nt, Homo sapiens
uggaggagcugaugugcua

SEQ ID NO: 563183 - RNA, 19 nt, Homo sapiens
gccaucaacuccuauauca

SEQ ID NO: 563184 - RNA, 19 nt, Homo sapiens
cauggaaucugacaaguuc

SEQ ID NO: 563185 - RNA, 19 nt, Homo sapiens
guugguggcugaaguagaa

SEQ ID NO: 563186 - RNA, 19 nt, Homo sapiens
caauuucuuuggcuccuua

SEQ ID NO: 563187 - RNA, 19 nt, Homo sapiens
agacauggcuguuggagau

SEQ ID NO: 563188 - RNA, 19 nt, Homo sapiens
ccacaaguuugauaugaau

SEQ ID NO: 563189 - RNA, 19 nt, Homo sapiens
ccaugaagauguuugauag

SEQ ID NO: 563190 - RNA, 19 nt, Homo sapiens
ucaaggacaucauuaccaa

SEQ ID NO: 563191 - RNA, 19 nt, Homo sapiens
ggacgacccuuccucuuac

SEQ ID NO: 563192 - RNA, 19 nt, Homo sapiens
agaaagauuuggugaagga

SEQ ID NO: 563193 - RNA, 19 nt, Homo sapiens
gcagagagugccaucauga

SEQ ID NO: 563194 - RNA, 19 nt, Homo sapiens
gcucugggcucacguccuu

SEQ ID NO: 563195 - RNA, 19 nt, Homo sapiens
ugacaugagugacccaaug

SEQ ID NO: 563196 - RNA, 19 nt, Homo sapiens
gcccagacauggugcuuga

SEQ ID NO: 563197 - RNA, 19 nt, Homo sapiens
ugauugaacugcuggagaa

SEQ ID NO: 563198 - RNA, 19 nt, Homo sapiens
cuaaugaacugauugaacu

SEQ ID NO: 563199 - RNA, 19 nt, Homo sapiens
uccaugaccuuguccuaua

SEQ ID NO: 563200 - RNA, 19 nt, Homo sapiens
ucaaggagguggagaggau

SEQ ID NO: 563201 - RNA, 19 nt, Homo sapiens
caaaccaaccucuggaauu

SEQ ID NO: 563202 - RNA, 19 nt, Homo sapiens
ggacaccuggacaauauuu

SEQ ID NO: 563203 - RNA, 19 nt, Homo sapiens
acagagcccugcaguucua

SEQ ID NO: 563204 - RNA, 19 nt, Homo sapiens
ccagaaagauuuggugaag

SEQ ID NO: 563205 - RNA, 19 nt, Homo sapiens
gcgcagauccucccuguuc

SEQ ID NO: 563206 - RNA, 19 nt, Homo sapiens
agagguacauugagaucua

SEQ ID NO: 563207 - RNA, 19 nt, Homo sapiens
gaccuuguccuauauuuau

SEQ ID NO: 563208 - RNA, 19 nt, Homo sapiens
uuggaugccuugaagaaua

SEQ ID NO: 563209 - RNA, 19 nt, Homo sapiens
ggacugaugaguaccagaa

SEQ ID NO: 563210 - RNA, 19 nt, Homo sapiens
gaaggagggucaguucaag

SEQ ID NO: 563211 - RNA, 19 nt, Homo sapiens
ggaaggagggucaguucaa

SEQ ID NO: 563212 - RNA, 19 nt, Homo sapiens
ggaaggaggugugcuuugc

SEQ ID NO: 563213 - RNA, 19 nt, Homo sapiens
caucaacuccuauaucaga

SEQ ID NO: 563214 - RNA, 19 nt, Homo sapiens
ugagagagaaugccuacua

SEQ ID NO: 563215 - RNA, 19 nt, Homo sapiens
ugacagagaaggaggacua

SEQ ID NO: 563216 - RNA, 19 nt, Homo sapiens
aaagaaagcaguagaugug

SEQ ID NO: 563217 - RNA, 19 nt, Homo sapiens
agaaguugcugcagugguu

SEQ ID NO: 563218 - RNA, 19 nt, Homo sapiens
gaaggaggacuaucaggau

SEQ ID NO: 563219 - RNA, 19 nt, Homo sapiens
gagcugguguuccucuaug

SEQ ID NO: 563220 - RNA, 19 nt, Homo sapiens
gaauuaauccagcuaacau

SEQ ID NO: 563221 - RNA, 19 nt, Homo sapiens
guacuuccuucuuauugga

SEQ ID NO: 563222 - RNA, 19 nt, Homo sapiens
ccagagagacgguccagaa

SEQ ID NO: 563223 - RNA, 19 nt, Homo sapiens
ucugacaaguucauaugua

SEQ ID NO: 563224 - RNA, 19 nt, Homo sapiens
gcaaaugugccaagcaaag

SEQ ID NO: 563225 - RNA, 19 nt, Homo sapiens
gagaaguuguuugugagaa

SEQ ID NO: 563226 - RNA, 19 nt, Homo sapiens
ccucuuaccuggaaguugu

SEQ ID NO: 563227 - RNA, 19 nt, Homo sapiens
gauccugacugccaucaag

SEQ ID NO: 563228 - RNA, 19 nt, Homo sapiens
cagaggagcucggagacuu

SEQ ID NO: 563229 - RNA, 19 nt, Homo sapiens
ugaggaagauaacauugug

SEQ ID NO: 563230 - RNA, 19 nt, Homo sapiens
gauuggagcuaaacauggu

SEQ ID NO: 563231 - RNA, 19 nt, Homo sapiens
ucaaccaccugcugacaga

SEQ ID NO: 563232 - RNA, 19 nt, Homo sapiens
acaaaccacugcucaucaa

SEQ ID NO: 563233 - RNA, 19 nt, Homo sapiens
gcagguggccucuaaguac

SEQ ID NO: 563234 - RNA, 19 nt, Homo sapiens
uggaugccuugaagaauaa

SEQ ID NO: 563235 - RNA, 19 nt, Homo sapiens
gggcagagaaguuguuugu

SEQ ID NO: 563236 - RNA, 19 nt, Homo sapiens
cugccaagcugcucuauag

SEQ ID NO: 563237 - RNA, 19 nt, Homo sapiens
gaagccaucaacuccuaua

SEQ ID NO: 563238 - RNA, 19 nt, Homo sapiens
aagcccagcuccagaaaga

SEQ ID NO: 563239 - RNA, 19 nt, Homo sapiens
agaaguuguuugugagaaa

SEQ ID NO: 563240 - RNA, 19 nt, Homo sapiens
uuacuaacuucuccaagga

SEQ ID NO: 563241 - RNA, 19 nt, Homo sapiens
ccaggaucguggcuacuuu

SEQ ID NO: 563242 - RNA, 19 nt, Homo sapiens
gaugugcuauuaccaggau

SEQ ID NO: 563243 - RNA, 19 nt, Homo sapiens
acaggaaucuacagaaucu

SEQ ID NO: 563244 - RNA, 19 nt, Homo sapiens
agggacaccuggacaauau

SEQ ID NO: 563245 - RNA, 19 nt, Homo sapiens
gaaugagacccagcugauu

SEQ ID NO: 563246 - RNA, 19 nt, Homo sapiens
acaacaagagugugaauga

SEQ ID NO: 563247 - RNA, 19 nt, Homo sapiens
cugcagagguacauugaga

SEQ ID NO: 563248 - RNA, 19 nt, Homo sapiens
gaagaucaguccggaacag

SEQ ID NO: 563249 - RNA, 19 nt, Homo sapiens
cuagagaaguggcugaaag

SEQ ID NO: 563250 - RNA, 19 nt, Homo sapiens
gcaaagugauccaguguuu

SEQ ID NO: 563251 - RNA, 19 nt, Homo sapiens
gcagagaaguuguuuguga

SEQ ID NO: 563252 - RNA, 19 nt, Homo sapiens
gcaguguacuuccuucuua

SEQ ID NO: 563253 - RNA, 19 nt, Homo sapiens
aaaccaaccucuggaauua

SEQ ID NO: 563254 - RNA, 19 nt, Homo sapiens
gcacacgggucauggagua

SEQ ID NO: 563255 - RNA, 19 nt, Homo sapiens
gggaggaucuaguuaaauu

SEQ ID NO: 563256 - RNA, 19 nt, Homo sapiens
gagagacgguccagaaauu

SEQ ID NO: 563257 - RNA, 19 nt, Homo sapiens
gcacaggaaucuacagaau

SEQ ID NO: 563258 - RNA, 19 nt, Homo sapiens
ccgaguggcuugucaauuu

SEQ ID NO: 563259 - RNA, 19 nt, Homo sapiens
guaagcaacuccuagagaa

SEQ ID NO: 563260 - RNA, 19 nt, Homo sapiens
gaggaggccuucaccguuu

SEQ ID NO: 563261 - RNA, 19 nt, Homo sapiens
gaaagcaguagauguguuu

SEQ ID NO: 563262 - RNA, 19 nt, Homo sapiens
gagagaaugccuacuauga

SEQ ID NO: 563263 - RNA, 19 nt, Homo sapiens
gagaggauaugccgagaga

SEQ ID NO: 563264 - RNA, 19 nt, Homo sapiens
cacccuaccugcagaguua

SEQ ID NO: 563265 - RNA, 19 nt, Homo sapiens
gagagagaaugccuacuau

SEQ ID NO: 563266 - RNA, 19 nt, Homo sapiens
agaaguggcugaaagaaga

SEQ ID NO: 563267 - RNA, 19 nt, Homo sapiens
gcacaucauugaaguugga

SEQ ID NO: 563268 - RNA, 19 nt, Homo sapiens
caagaaggaucaucucuac

SEQ ID NO: 563269 - RNA, 19 nt, Homo sapiens
gauccucccuguucgcuuu

SEQ ID NO: 563270 - RNA, 19 nt, Homo sapiens
gcacaggucacgaucauug

SEQ ID NO: 563271 - RNA, 19 nt, Homo sapiens
cagccgaccugccuaauga

SEQ ID NO: 563272 - RNA, 19 nt, Homo sapiens
gagaaugccuacuaugaca

SEQ ID NO: 563273 - RNA, 19 nt, Homo sapiens
caaccaacgugcuucagaa

SEQ ID NO: 563274 - RNA, 19 nt, Homo sapiens
ggaggacuaucagggcuua

SEQ ID NO: 563275 - RNA, 19 nt, Homo sapiens
acaaaggccucuucuacuu

SEQ ID NO: 563276 - RNA, 19 nt, Homo sapiens
guccagaaauuccagagua

SEQ ID NO: 563277 - RNA, 19 nt, Homo sapiens
gaccacaccuggacaguca

SEQ ID NO: 563278 - RNA, 19 nt, Homo sapiens
ggacaucauuaccaagguu

SEQ ID NO: 563279 - RNA, 19 nt, Homo sapiens
gggacgacccuuccucuua

SEQ ID NO: 563280 - RNA, 19 nt, Homo sapiens
ggaccgggcauaugaguuu

SEQ ID NO: 563281 - RNA, 19 nt, Homo sapiens
gaagauaguucuggauaac

SEQ ID NO: 563282 - RNA, 19 nt, Homo sapiens
gcacuacaccgaccucuau

SEQ ID NO: 563283 - RNA, 19 nt, Homo sapiens
caaugcagcucuacucugu

SEQ ID NO: 563284 - RNA, 19 nt, Homo sapiens
gcaagaaggaucaucucua

SEQ ID NO: 563285 - RNA, 19 nt, Homo sapiens
uggaggagcugaugugcua

SEQ ID NO: 563286 - RNA, 19 nt, Homo sapiens
gccaucaacuccuauauca

SEQ ID NO: 563287 - RNA, 19 nt, Homo sapiens
cauggaaucugacaaguuc

SEQ ID NO: 563288 - RNA, 19 nt, Homo sapiens
guugguggcugaaguagaa

SEQ ID NO: 563289 - RNA, 19 nt, Homo sapiens
caauuucuuuggcuccuua

SEQ ID NO: 563290 - RNA, 19 nt, Homo sapiens
agacauggcuguuggagau

SEQ ID NO: 563291 - RNA, 19 nt, Homo sapiens
ccacaaguuugauaugaau

SEQ ID NO: 563292 - RNA, 19 nt, Homo sapiens
ccaugaagauguuugauag

SEQ ID NO: 563293 - RNA, 19 nt, Homo sapiens
ucaaggacaucauuaccaa

SEQ ID NO: 563294 - RNA, 19 nt, Homo sapiens
ggacgacccuuccucuuac

SEQ ID NO: 563295 - RNA, 19 nt, Homo sapiens
agaaagauuuggugaagga

SEQ ID NO: 563296 - RNA, 19 nt, Homo sapiens
gcagagagugccaucauga

SEQ ID NO: 563297 - RNA, 19 nt, Homo sapiens
gcucugggcucacguccuu

SEQ ID NO: 563298 - RNA, 19 nt, Homo sapiens
ugacaugagugacccaaug

SEQ ID NO: 563299 - RNA, 19 nt, Homo sapiens
gcccagacauggugcuuga

SEQ ID NO: 563300 - RNA, 19 nt, Homo sapiens
ugauugaacugcuggagaa

SEQ ID NO: 563301 - RNA, 19 nt, Homo sapiens
cuaaugaacugauugaacu

SEQ ID NO: 563302 - RNA, 19 nt, Homo sapiens
uccaugaccuuguccuaua

SEQ ID NO: 563303 - RNA, 19 nt, Homo sapiens
ucaaggagguggagaggau

SEQ ID NO: 563304 - RNA, 19 nt, Homo sapiens
caaaccaaccucuggaauu

SEQ ID NO: 563305 - RNA, 19 nt, Homo sapiens
ggacaccuggacaauauuu

SEQ ID NO: 563306 - RNA, 19 nt, Homo sapiens
acagagcccugcaguucua

SEQ ID NO: 563307 - RNA, 19 nt, Homo sapiens
ccagaaagauuuggugaag

SEQ ID NO: 563308 - RNA, 19 nt, Homo sapiens
gcgcagauccucccuguuc

SEQ ID NO: 563309 - RNA, 19 nt, Homo sapiens
agagguacauugagaucua

SEQ ID NO: 563310 - RNA, 19 nt, Homo sapiens
gaccuuguccuauauuuau

SEQ ID NO: 563311 - RNA, 19 nt, Homo sapiens
uuggaugccuugaagaaua

SEQ ID NO: 563312 - RNA, 19 nt, Homo sapiens
ggacugaugaguaccagaa

SEQ ID NO: 563313 - RNA, 19 nt, Homo sapiens
gaaggagggucaguucaag

SEQ ID NO: 563314 - RNA, 19 nt, Homo sapiens
ggaaggagggucaguucaa

SEQ ID NO: 563315 - RNA, 19 nt, Homo sapiens
ggaaggaggugugcuuugc

SEQ ID NO: 563316 - RNA, 19 nt, Homo sapiens
caucaacuccuauaucaga

SEQ ID NO: 563317 - RNA, 19 nt, Homo sapiens
ugagagagaaugccuacua

SEQ ID NO: 563318 - RNA, 19 nt, Homo sapiens
gaaggaucaucucuacaag

SEQ ID NO: 563319 - RNA, 19 nt, Homo sapiens
gcguggagcucugcaagaa

SEQ ID NO: 563320 - RNA, 19 nt, Homo sapiens
aaagaaagcaguagaugug

SEQ ID NO: 563321 - RNA, 19 nt, Homo sapiens
agaaguugcugcagugguu

SEQ ID NO: 563322 - RNA, 19 nt, Homo sapiens
gagcugguguuccucuaug

SEQ ID NO: 563323 - RNA, 19 nt, Homo sapiens
gaauuaauccagcuaacau

SEQ ID NO: 563324 - RNA, 19 nt, Homo sapiens
guacuuccuucuuauugga

SEQ ID NO: 563325 - RNA, 19 nt, Homo sapiens
ccagagagacgguccagaa

SEQ ID NO: 563326 - RNA, 19 nt, Homo sapiens
ucugacaaguucauaugua

SEQ ID NO: 563327 - RNA, 19 nt, Homo sapiens
gcaaaugugccaagcaaag

SEQ ID NO: 563328 - RNA, 19 nt, Homo sapiens
gagaaguuguuugugagaa

SEQ ID NO: 563329 - RNA, 19 nt, Homo sapiens
ccucuuaccuggaaguugu

SEQ ID NO: 563330 - RNA, 19 nt, Homo sapiens
gauccugacugccaucaag

SEQ ID NO: 563331 - RNA, 19 nt, Homo sapiens
cagaggagcucggagacuu

SEQ ID NO: 563332 - RNA, 19 nt, Homo sapiens
ugaggaagauaacauugug

SEQ ID NO: 563333 - RNA, 19 nt, Homo sapiens
gauuggagcuaaacauggu

SEQ ID NO: 563334 - RNA, 19 nt, Homo sapiens
ucaaccaccugcugacaga

SEQ ID NO: 563335 - RNA, 19 nt, Homo sapiens
acaaaccacugcucaucaa

SEQ ID NO: 563336 - RNA, 19 nt, Homo sapiens
gcagguggccucuaaguac

SEQ ID NO: 563337 - RNA, 19 nt, Homo sapiens
uggaugccuugaagaauaa

SEQ ID NO: 563338 - RNA, 19 nt, Homo sapiens
gggcagagaaguuguuugu

SEQ ID NO: 563339 - RNA, 19 nt, Homo sapiens
ugacaacuuugacaacauc

SEQ ID NO: 563340 - RNA, 19 nt, Homo sapiens
cugccaagcugcucuauag

SEQ ID NO: 563341 - RNA, 19 nt, Homo sapiens
gaagccaucaacuccuaua

SEQ ID NO: 563342 - RNA, 19 nt, Homo sapiens
aagcccagcuccagaaaga

SEQ ID NO: 563343 - RNA, 19 nt, Homo sapiens
agaaguuguuugugagaaa

SEQ ID NO: 563344 - RNA, 19 nt, Homo sapiens
uuacuaacuucuccaagga

SEQ ID NO: 563345 - RNA, 19 nt, Homo sapiens
ccaggaucguggcuacuuu

SEQ ID NO: 563346 - RNA, 19 nt, Homo sapiens
gaugugcuauuaccaggau

SEQ ID NO: 563347 - RNA, 19 nt, Homo sapiens
acaggaaucuacagaaucu

SEQ ID NO: 563348 - RNA, 19 nt, Homo sapiens
agggacaccuggacaauau

SEQ ID NO: 563349 - RNA, 19 nt, Homo sapiens
gaaugagacccagcugauu

SEQ ID NO: 563350 - RNA, 19 nt, Homo sapiens
gagaagaggcagaaagaua

SEQ ID NO: 563351 - RNA, 19 nt, Homo sapiens
gcuguuugcuguuuaauug

SEQ ID NO: 563352 - RNA, 19 nt, Homo sapiens
gcgcaaagcuucggacuuc

SEQ ID NO: 563353 - RNA, 19 nt, Homo sapiens
gaacggaugcgccagauug

SEQ ID NO: 563354 - RNA, 19 nt, Homo sapiens
agaauucccucauguacua

SEQ ID NO: 563355 - RNA, 19 nt, Homo sapiens
gaacugucauuaaagaaca

SEQ ID NO: 563356 - RNA, 19 nt, Homo sapiens
gaacacacccuugagaguu

SEQ ID NO: 563357 - RNA, 19 nt, Homo sapiens
ggaaguacaaggccaagaa

SEQ ID NO: 563358 - RNA, 19 nt, Homo sapiens
caagcuguuugcuguuuaa

SEQ ID NO: 563359 - RNA, 19 nt, Homo sapiens
aggagcagcuguuuaagaa

SEQ ID NO: 563360 - RNA, 19 nt, Homo sapiens
agaagaggcagaaagauaa

SEQ ID NO: 563361 - RNA, 19 nt, Homo sapiens
ccaagcuguuugcuguuua

SEQ ID NO: 563362 - RNA, 19 nt, Homo sapiens
gccagaagcuguugaccau

SEQ ID NO: 563363 - RNA, 19 nt, Homo sapiens
cgaggagaauggagacuug

SEQ ID NO: 563364 - RNA, 19 nt, Homo sapiens
ccaagaauucccucaugua

SEQ ID NO: 563365 - RNA, 19 nt, Homo sapiens
gaggaagaguuugagaaga

SEQ ID NO: 563366 - RNA, 19 nt, Homo sapiens
ccagauugccaucaaguuu

SEQ ID NO: 563367 - RNA, 19 nt, Homo sapiens
gccaagcuguuugcuguuu

SEQ ID NO: 563368 - RNA, 19 nt, Homo sapiens
gaggagcagcuguuuaaga

SEQ ID NO: 563369 - RNA, 19 nt, Homo sapiens
gccaagaauucccucaugu

SEQ ID NO: 563370 - RNA, 19 nt, Homo sapiens
ggccaagaauucccucaug

SEQ ID NO: 563371 - RNA, 19 nt, Homo sapiens
gcaggacggccagcaagua

SEQ ID NO: 563372 - RNA, 19 nt, Homo sapiens
gagaggaggaggagaagga

SEQ ID NO: 563373 - RNA, 19 nt, Homo sapiens
guggagaccuggaaguaca

SEQ ID NO: 563374 - RNA, 19 nt, Homo sapiens
ucauggagguggccaagga

SEQ ID NO: 563375 - RNA, 19 nt, Homo sapiens
cagaagcuguugaccauac

SEQ ID NO: 563376 - RNA, 19 nt, Homo sapiens
cuugaacugucauuaaaga

SEQ ID NO: 563377 - RNA, 19 nt, Homo sapiens
cccuugaacugucauuaaa

SEQ ID NO: 563378 - RNA, 19 nt, Homo sapiens
gcaaagcuucggacuucuu

SEQ ID NO: 563379 - RNA, 19 nt, Homo sapiens
gaaguacaaggccaagaau

SEQ ID NO: 563380 - RNA, 19 nt, Homo sapiens
gaagaggcagaaagauaau

SEQ ID NO: 563381 - RNA, 19 nt, Homo sapiens
ggagaauggagacuuggaa

SEQ ID NO: 563382 - RNA, 19 nt, Homo sapiens
ggauuucuuuccugaugug

SEQ ID NO: 563383 - RNA, 19 nt, Homo sapiens
ggagagugacggagaaucu

SEQ ID NO: 563384 - RNA, 19 nt, Homo sapiens
aagaacacgcgcuuccuua

SEQ ID NO: 563385 - RNA, 19 nt, Homo sapiens
acgaggagcagcuguuuaa

SEQ ID NO: 563386 - RNA, 19 nt, Homo sapiens
ggguggauuuggauuuguu

SEQ ID NO: 563387 - RNA, 19 nt, Homo sapiens
ggcaggugguacauaagaa

SEQ ID NO: 563388 - RNA, 19 nt, Homo sapiens
cccggcaggugguacauaa

SEQ ID NO: 563389 - RNA, 19 nt, Homo sapiens
caagaauucccucauguac

SEQ ID NO: 563390 - RNA, 19 nt, Homo sapiens
guugagaacacacccuuga

SEQ ID NO: 563391 - RNA, 19 nt, Homo sapiens
gacgaggagcagcuguuua

SEQ ID NO: 563392 - RNA, 19 nt, Homo sapiens
aggaagaguuugagaagag

SEQ ID NO: 563393 - RNA, 19 nt, Homo sapiens
guggguggauuuggauuug

SEQ ID NO: 563394 - RNA, 19 nt, Homo sapiens
gaacacgcgcuuccuuagg

SEQ ID NO: 563395 - RNA, 19 nt, Homo sapiens
uaagaacacgcgcuuccuu

SEQ ID NO: 563396 - RNA, 19 nt, Homo sapiens
ugagaacacacccuugaga

SEQ ID NO: 563397 - RNA, 19 nt, Homo sapiens
gagaagcuccaggcacaga

SEQ ID NO: 563398 - RNA, 19 nt, Homo sapiens
gggauuucuuuccugaugu

SEQ ID NO: 563399 - RNA, 19 nt, Homo sapiens
ggagguggccaaggagaga

SEQ ID NO: 563400 - RNA, 19 nt, Homo sapiens
cagauugccaucaaguuug

SEQ ID NO: 563401 - RNA, 19 nt, Homo sapiens
caucagcgucguccuuguu

SEQ ID NO: 563402 - RNA, 19 nt, Homo sapiens
aacacacccuugagaguug

SEQ ID NO: 563403 - RNA, 19 nt, Homo sapiens
ucgaguggguggauuugga

SEQ ID NO: 563404 - RNA, 19 nt, Homo sapiens
gaccauaccaggagucacu

SEQ ID NO: 563405 - RNA, 19 nt, Homo sapiens
ucaaugcccagcacaaaca

SEQ ID NO: 563406 - RNA, 19 nt, Homo sapiens
ggacgaggaagaguauauc

SEQ ID NO: 563407 - RNA, 19 nt, Homo sapiens
gcaucagcgucguccuugu

SEQ ID NO: 563408 - RNA, 19 nt, Homo sapiens
ugacuccagccacauuuga

SEQ ID NO: 563409 - RNA, 19 nt, Homo sapiens
ugacgaggagcagcuguuu

SEQ ID NO: 563410 - RNA, 19 nt, Homo sapiens
agggauuucuuuccugaug

SEQ ID NO: 563411 - RNA, 19 nt, Homo sapiens
acagaaggaguaccuggaa

SEQ ID NO: 563412 - RNA, 19 nt, Homo sapiens
gagcggcugggucugaaga

SEQ ID NO: 563413 - RNA, 19 nt, Homo sapiens
gcgcaucagcgucguccuu

SEQ ID NO: 563414 - RNA, 19 nt, Homo sapiens
ugaggaagaguuugagaag

SEQ ID NO: 563415 - RNA, 19 nt, Homo sapiens
ccucaaugcccagcacaaa

SEQ ID NO: 563416 - RNA, 19 nt, Homo sapiens
ggaacggaugcgccagauu

SEQ ID NO: 563417 - RNA, 19 nt, Homo sapiens
cuaccaggcugaggaagag

SEQ ID NO: 563418 - RNA, 19 nt, Homo sapiens
cuacacgagugaggacaau

SEQ ID NO: 563419 - RNA, 19 nt, Homo sapiens
gucugaagauggccaacga

SEQ ID NO: 563420 - RNA, 19 nt, Homo sapiens
aguacaaggccaagaauuc

SEQ ID NO: 563421 - RNA, 19 nt, Homo sapiens
guguggagaccuggaagua

SEQ ID NO: 563422 - RNA, 19 nt, Homo sapiens
cauuaaagaacaccuaggu

SEQ ID NO: 563423 - RNA, 19 nt, Homo sapiens
aggagucacuggagaaagg

SEQ ID NO: 563424 - RNA, 19 nt, Homo sapiens
gcccuacagcgccuuguga

SEQ ID NO: 563425 - RNA, 19 nt, Homo sapiens
cggcaggugguacauaaga

SEQ ID NO: 563426 - RNA, 19 nt, Homo sapiens
gaagccuugcggagaguga

SEQ ID NO: 563427 - RNA, 19 nt, Homo sapiens
uugagaagaggcagaaaga

SEQ ID NO: 563428 - RNA, 19 nt, Homo sapiens
gcggcugggucugaagaug

SEQ ID NO: 563429 - RNA, 19 nt, Homo sapiens
gaacgaguccccgaugaug

SEQ ID NO: 563430 - RNA, 19 nt, Homo sapiens
gcucuaccaggcugaggaa

SEQ ID NO: 563431 - RNA, 19 nt, Homo sapiens
gaaccuagcugccuaugug

SEQ ID NO: 563432 - RNA, 19 nt, Homo sapiens
ggagacgcauuguauauaa

SEQ ID NO: 563433 - RNA, 19 nt, Homo sapiens
gaacauacuuucuaaaugc

SEQ ID NO: 563434 - RNA, 19 nt, Homo sapiens
gauccgaagugcaaugaua

SEQ ID NO: 563435 - RNA, 19 nt, Homo sapiens
gaaggugaauggagagauu

SEQ ID NO: 563436 - RNA, 19 nt, Homo sapiens
gauagucacuucuaguuug

SEQ ID NO: 563437 - RNA, 19 nt, Homo sapiens
gaaaccagacccuguauga

SEQ ID NO: 563438 - RNA, 19 nt, Homo sapiens
gcaagguauugguagguua

SEQ ID NO: 563439 - RNA, 19 nt, Homo sapiens
ggagcaggcugaauucuca

SEQ ID NO: 563440 - RNA, 19 nt, Homo sapiens
ggccaaauauguuuaggaa

SEQ ID NO: 563441 - RNA, 19 nt, Homo sapiens
acucagagcauuauucuua

SEQ ID NO: 563442 - RNA, 19 nt, Homo sapiens
gcaaggauggcagagauua

SEQ ID NO: 563443 - RNA, 19 nt, Homo sapiens
gcaaugauagucacuucua

SEQ ID NO: 563444 - RNA, 19 nt, Homo sapiens
ggacaucugugccgucaag

SEQ ID NO: 563445 - RNA, 19 nt, Homo sapiens
gaaagaggcccuggacuuc

SEQ ID NO: 563446 - RNA, 19 nt, Homo sapiens
ucauuaagaucuuccauuc

SEQ ID NO: 563447 - RNA, 19 nt, Homo sapiens
gaaccgcuguuuguauuuc

SEQ ID NO: 563448 - RNA, 19 nt, Homo sapiens
caaggaaagggucagguua

SEQ ID NO: 563449 - RNA, 19 nt, Homo sapiens
guggacagcugcucggaaa

SEQ ID NO: 563450 - RNA, 19 nt, Homo sapiens
guacagcaagguauuggua

SEQ ID NO: 563451 - RNA, 19 nt, Homo sapiens
ggaaagaucaaaguggaaa

SEQ ID NO: 563452 - RNA, 19 nt, Homo sapiens
uggcagagauuacaucauc

SEQ ID NO: 563453 - RNA, 19 nt, Homo sapiens
guagguuacucaauuucaa

SEQ ID NO: 563454 - RNA, 19 nt, Homo sapiens
gcagaucacagguuauugu

SEQ ID NO: 563455 - RNA, 19 nt, Homo sapiens
ucucucagcucauuaagau

SEQ ID NO: 563456 - RNA, 19 nt, Homo sapiens
cacaaacucuguacagcaa

SEQ ID NO: 563457 - RNA, 19 nt, Homo sapiens
aagggcagaucacagguua

SEQ ID NO: 563458 - RNA, 19 nt, Homo sapiens
agucagaccucagcaauau

SEQ ID NO: 563459 - RNA, 19 nt, Homo sapiens
caaccugccuaauggcuau

SEQ ID NO: 563460 - RNA, 19 nt, Homo sapiens
aaagaaaccagacccugua

SEQ ID NO: 563461 - RNA, 19 nt, Homo sapiens
acagaucaaugacauagga

SEQ ID NO: 563462 - RNA, 19 nt, Homo sapiens
aggaaccgauuaucuauau

SEQ ID NO: 563463 - RNA, 19 nt, Homo sapiens
cagcaaggauggcagagau

SEQ ID NO: 563464 - RNA, 19 nt, Homo sapiens
agaaucaacagaucaauga

SEQ ID NO: 563465 - RNA, 19 nt, Homo sapiens
caauauaggaggcaauaau

SEQ ID NO: 563466 - RNA, 19 nt, Homo sapiens
gaucgaugaugcccauaca

SEQ ID NO: 563467 - RNA, 19 nt, Homo sapiens
ugacauaggauccgaagug

SEQ ID NO: 563468 - RNA, 19 nt, Homo sapiens
gguguucucucagcucauu

SEQ ID NO: 563469 - RNA, 19 nt, Homo sapiens
gaguggagcaggcugaauu

SEQ ID NO: 563470 - RNA, 19 nt, Homo sapiens
gagcauuauucuuauuugg

SEQ ID NO: 563471 - RNA, 19 nt, Homo sapiens
gcugauggccgaccuuguu

SEQ ID NO: 563472 - RNA, 19 nt, Homo sapiens
ggacaugcaggucgugaga

SEQ ID NO: 563473 - RNA, 19 nt, Homo sapiens
gagacgcauuguauauaau

SEQ ID NO: 563474 - RNA, 19 nt, Homo sapiens
gagaaucaacagaucaaug

SEQ ID NO: 563475 - RNA, 19 nt, Homo sapiens
gcccuggacuucccaagga

SEQ ID NO: 563476 - RNA, 19 nt, Homo sapiens
ggaaccgauuaucuauauu

SEQ ID NO: 563477 - RNA, 19 nt, Homo sapiens
ggacagcugcucggaaaug

SEQ ID NO: 563478 - RNA, 19 nt, Homo sapiens
aggaaccgcuguuuguauu

SEQ ID NO: 563479 - RNA, 19 nt, Homo sapiens
gggcagaucacagguuauu

SEQ ID NO: 563480 - RNA, 19 nt, Homo sapiens
gauccaacuacaaggcuua

SEQ ID NO: 563481 - RNA, 19 nt, Homo sapiens
caacagaucaaugacauag

SEQ ID NO: 563482 - RNA, 19 nt, Homo sapiens
gagagaaucaacagaucaa

SEQ ID NO: 563483 - RNA, 19 nt, Homo sapiens
aagacuaguuuacaaagga

SEQ ID NO: 563484 - RNA, 19 nt, Homo sapiens
guaaugccacucauacuca

SEQ ID NO: 563485 - RNA, 19 nt, Homo sapiens
gaccugcaacgcccagaua

SEQ ID NO: 563486 - RNA, 19 nt, Homo sapiens
cagcugcucggaaauguuu

SEQ ID NO: 563487 - RNA, 19 nt, Homo sapiens
cauaggauccgaagugcaa

SEQ ID NO: 563488 - RNA, 19 nt, Homo sapiens
cagagagaaucaacagauc

SEQ ID NO: 563489 - RNA, 19 nt, Homo sapiens
uggagggccugagaacaua

SEQ ID NO: 563490 - RNA, 19 nt, Homo sapiens
agaaagaggcccuggacuu

SEQ ID NO: 563491 - RNA, 19 nt, Homo sapiens
gguaauggacagcucaaug

SEQ ID NO: 563492 - RNA, 19 nt, Homo sapiens
gaacuggaaggccaacaca

SEQ ID NO: 563493 - RNA, 19 nt, Homo sapiens
acaugcaggucgugagaaa

SEQ ID NO: 563494 - RNA, 19 nt, Homo sapiens
gugcaaugauagucacuuc

SEQ ID NO: 563495 - RNA, 19 nt, Homo sapiens
ccagagagaaucaacagau

SEQ ID NO: 563496 - RNA, 19 nt, Homo sapiens
guaggaauaaagacuaguu

SEQ ID NO: 563497 - RNA, 19 nt, Homo sapiens
cgacauccgcauccagaaa

SEQ ID NO: 563498 - RNA, 19 nt, Homo sapiens
ggacaugcccacgcuggaa

SEQ ID NO: 563499 - RNA, 19 nt, Homo sapiens
cauccacagccaugaauuu

SEQ ID NO: 563500 - RNA, 19 nt, Homo sapiens
gaauggagagauugagauc

SEQ ID NO: 563501 - RNA, 19 nt, Homo sapiens
cagacuggucgaaguauuu

SEQ ID NO: 563502 - RNA, 19 nt, Homo sapiens
ccaggaaccgauuaucuau

SEQ ID NO: 563503 - RNA, 19 nt, Homo sapiens
ggaaccgcuguuuguauuu

SEQ ID NO: 563504 - RNA, 19 nt, Homo sapiens
caaugauagucacuucuag

SEQ ID NO: 563505 - RNA, 19 nt, Homo sapiens
cauacagacuggucgaagu

SEQ ID NO: 563506 - RNA, 19 nt, Homo sapiens
cgcagacacuguagucaga

SEQ ID NO: 563507 - RNA, 19 nt, Homo sapiens
ccaaaguggugagcagauc

SEQ ID NO: 563508 - RNA, 19 nt, Homo sapiens
gcauuucacaaacucugua

SEQ ID NO: 563509 - RNA, 19 nt, Homo sapiens
gaaccagagagaaucaaca

SEQ ID NO: 563510 - RNA, 19 nt, Homo sapiens
ccaaggaaagggucagguu

SEQ ID NO: 563511 - RNA, 19 nt, Homo sapiens
caaguggggucuuucagaa

SEQ ID NO: 563512 - RNA, 19 nt, Homo sapiens
guccugaggccaagaaaga

SEQ ID NO: 563513 - RNA, 19 nt, Homo sapiens
gauuggagagcauguggaa

SEQ ID NO: 563514 - RNA, 19 nt, Homo sapiens
cagaucacagguuauugua

SEQ ID NO: 563515 - RNA, 19 nt, Homo sapiens
acucauacucagagcauua

SEQ ID NO: 563516 - RNA, 19 nt, Homo sapiens
cgaccuuguugucuccaaa

SEQ ID NO: 563517 - RNA, 19 nt, Homo sapiens
gacagcugcucggaaaugu

SEQ ID NO: 563518 - RNA, 19 nt, Homo sapiens
gaaugggaaagaucaaagu

SEQ ID NO: 563519 - RNA, 19 nt, Homo sapiens
ggaaugggaaagaucaaag

SEQ ID NO: 563520 - RNA, 19 nt, Homo sapiens
cgugagaaaugggaccaaa

SEQ ID NO: 563521 - RNA, 19 nt, Homo sapiens
gcaauauaggaggcaauaa

SEQ ID NO: 563522 - RNA, 19 nt, Homo sapiens
caggaaccgauuaucuaua

SEQ ID NO: 563523 - RNA, 19 nt, Homo sapiens
gcaaccugaggaagucuuu

SEQ ID NO: 563524 - RNA, 19 nt, Homo sapiens
ggaagccccucccaacaga

SEQ ID NO: 563525 - RNA, 19 nt, Homo sapiens
gcagagauuacaucaucga

SEQ ID NO: 563526 - RNA, 19 nt, Homo sapiens
auacagacuggucgaagua

SEQ ID NO: 563527 - RNA, 19 nt, Homo sapiens
ucuccaggauccagccuuu

SEQ ID NO: 563528 - RNA, 19 nt, Homo sapiens
gcagcaagcccuggguguu

SEQ ID NO: 563529 - RNA, 19 nt, Homo sapiens
ggucaucggccugcaguau

SEQ ID NO: 563530 - RNA, 19 nt, Homo sapiens
ccacgcccauuguucaaag

SEQ ID NO: 563531 - RNA, 19 nt, Homo sapiens
gaaccuagcugccuaugug

SEQ ID NO: 563532 - RNA, 19 nt, Homo sapiens
ggagacgcauuguauauaa

SEQ ID NO: 563533 - RNA, 19 nt, Homo sapiens
gaacauacuuucuaaaugc

SEQ ID NO: 563534 - RNA, 19 nt, Homo sapiens
gauccgaagugcaaugaua

SEQ ID NO: 563535 - RNA, 19 nt, Homo sapiens
gaaggugaauggagagauu

SEQ ID NO: 563536 - RNA, 19 nt, Homo sapiens
gauagucacuucuaguuug

SEQ ID NO: 563537 - RNA, 19 nt, Homo sapiens
gaaaccagacccuguauga

SEQ ID NO: 563538 - RNA, 19 nt, Homo sapiens
gcaagguauugguagguua

SEQ ID NO: 563539 - RNA, 19 nt, Homo sapiens
ggagcaggcugaauucuca

SEQ ID NO: 563540 - RNA, 19 nt, Homo sapiens
ggccaaauauguuuaggaa

SEQ ID NO: 563541 - RNA, 19 nt, Homo sapiens
acucagagcauuauucuua

SEQ ID NO: 563542 - RNA, 19 nt, Homo sapiens
gcaaggauggcagagauua

SEQ ID NO: 563543 - RNA, 19 nt, Homo sapiens
gcaaugauagucacuucua

SEQ ID NO: 563544 - RNA, 19 nt, Homo sapiens
ggacaucugugccgucaag

SEQ ID NO: 563545 - RNA, 19 nt, Homo sapiens
gaaagaggcccuggacuuc

SEQ ID NO: 563546 - RNA, 19 nt, Homo sapiens
ucauuaagaucuuccauuc

SEQ ID NO: 563547 - RNA, 19 nt, Homo sapiens
gaaccgcuguuuguauuuc

SEQ ID NO: 563548 - RNA, 19 nt, Homo sapiens
caaggaaagggucagguua

SEQ ID NO: 563549 - RNA, 19 nt, Homo sapiens
guggacagcugcucggaaa

SEQ ID NO: 563550 - RNA, 19 nt, Homo sapiens
guacagcaagguauuggua

SEQ ID NO: 563551 - RNA, 19 nt, Homo sapiens
ggaaagaucaaaguggaaa

SEQ ID NO: 563552 - RNA, 19 nt, Homo sapiens
uggcagagauuacaucauc

SEQ ID NO: 563553 - RNA, 19 nt, Homo sapiens
guagguuacucaauuucaa

SEQ ID NO: 563554 - RNA, 19 nt, Homo sapiens
gcagaucacagguuauugu

SEQ ID NO: 563555 - RNA, 19 nt, Homo sapiens
ucucucagcucauuaagau

SEQ ID NO: 563556 - RNA, 19 nt, Homo sapiens
cacaaacucuguacagcaa

SEQ ID NO: 563557 - RNA, 19 nt, Homo sapiens
aagggcagaucacagguua

SEQ ID NO: 563558 - RNA, 19 nt, Homo sapiens
agucagaccucagcaauau

SEQ ID NO: 563559 - RNA, 19 nt, Homo sapiens
caaccugccuaauggcuau

SEQ ID NO: 563560 - RNA, 19 nt, Homo sapiens
aaagaaaccagacccugua

SEQ ID NO: 563561 - RNA, 19 nt, Homo sapiens
acagaucaaugacauagga

SEQ ID NO: 563562 - RNA, 19 nt, Homo sapiens
aggaaccgauuaucuauau

SEQ ID NO: 563563 - RNA, 19 nt, Homo sapiens
cagcaaggauggcagagau

SEQ ID NO: 563564 - RNA, 19 nt, Homo sapiens
agaaucaacagaucaauga

SEQ ID NO: 563565 - RNA, 19 nt, Homo sapiens
caauauaggaggcaauaau

SEQ ID NO: 563566 - RNA, 19 nt, Homo sapiens
gaucgaugaugcccauaca

SEQ ID NO: 563567 - RNA, 19 nt, Homo sapiens
ugacauaggauccgaagug

SEQ ID NO: 563568 - RNA, 19 nt, Homo sapiens
gguguucucucagcucauu

SEQ ID NO: 563569 - RNA, 19 nt, Homo sapiens
gaguggagcaggcugaauu

SEQ ID NO: 563570 - RNA, 19 nt, Homo sapiens
gagcauuauucuuauuugg

SEQ ID NO: 563571 - RNA, 19 nt, Homo sapiens
gcugauggccgaccuuguu

SEQ ID NO: 563572 - RNA, 19 nt, Homo sapiens
ggacaugcaggucgugaga

SEQ ID NO: 563573 - RNA, 19 nt, Homo sapiens
gagacgcauuguauauaau

SEQ ID NO: 563574 - RNA, 19 nt, Homo sapiens
gagaaucaacagaucaaug

SEQ ID NO: 563575 - RNA, 19 nt, Homo sapiens
gcccuggacuucccaagga

SEQ ID NO: 563576 - RNA, 19 nt, Homo sapiens
ggaaccgauuaucuauauu

SEQ ID NO: 563577 - RNA, 19 nt, Homo sapiens
ggacagcugcucggaaaug

SEQ ID NO: 563578 - RNA, 19 nt, Homo sapiens
aggaaccgcuguuuguauu

SEQ ID NO: 563579 - RNA, 19 nt, Homo sapiens
gggcagaucacagguuauu

SEQ ID NO: 563580 - RNA, 19 nt, Homo sapiens
gauccaacuacaaggcuua

SEQ ID NO: 563581 - RNA, 19 nt, Homo sapiens
caacagaucaaugacauag

SEQ ID NO: 563582 - RNA, 19 nt, Homo sapiens
gagagaaucaacagaucaa

SEQ ID NO: 563583 - RNA, 19 nt, Homo sapiens
aagacuaguuuacaaagga

SEQ ID NO: 563584 - RNA, 19 nt, Homo sapiens
guaaugccacucauacuca

SEQ ID NO: 563585 - RNA, 19 nt, Homo sapiens
gaccugcaacgcccagaua

SEQ ID NO: 563586 - RNA, 19 nt, Homo sapiens
cagcugcucggaaauguuu

SEQ ID NO: 563587 - RNA, 19 nt, Homo sapiens
cauaggauccgaagugcaa

SEQ ID NO: 563588 - RNA, 19 nt, Homo sapiens
cagagagaaucaacagauc

SEQ ID NO: 563589 - RNA, 19 nt, Homo sapiens
uggagggccugagaacaua

SEQ ID NO: 563590 - RNA, 19 nt, Homo sapiens
agaaagaggcccuggacuu

SEQ ID NO: 563591 - RNA, 19 nt, Homo sapiens
gguaauggacagcucaaug

SEQ ID NO: 563592 - RNA, 19 nt, Homo sapiens
gaacuggaaggccaacaca

SEQ ID NO: 563593 - RNA, 19 nt, Homo sapiens
acaugcaggucgugagaaa

SEQ ID NO: 563594 - RNA, 19 nt, Homo sapiens
gugcaaugauagucacuuc

SEQ ID NO: 563595 - RNA, 19 nt, Homo sapiens
ccagagagaaucaacagau

SEQ ID NO: 563596 - RNA, 19 nt, Homo sapiens
guaggaauaaagacuaguu

SEQ ID NO: 563597 - RNA, 19 nt, Homo sapiens
cgacauccgcauccagaaa

SEQ ID NO: 563598 - RNA, 19 nt, Homo sapiens
ggacaugcccacgcuggaa

SEQ ID NO: 563599 - RNA, 19 nt, Homo sapiens
cauccacagccaugaauuu

SEQ ID NO: 563600 - RNA, 19 nt, Homo sapiens
gaauggagagauugagauc

SEQ ID NO: 563601 - RNA, 19 nt, Homo sapiens
cagacuggucgaaguauuu

SEQ ID NO: 563602 - RNA, 19 nt, Homo sapiens
ccaggaaccgauuaucuau

SEQ ID NO: 563603 - RNA, 19 nt, Homo sapiens
ggaaccgcuguuuguauuu

SEQ ID NO: 563604 - RNA, 19 nt, Homo sapiens
caaugauagucacuucuag

SEQ ID NO: 563605 - RNA, 19 nt, Homo sapiens
cauacagacuggucgaagu

SEQ ID NO: 563606 - RNA, 19 nt, Homo sapiens
cgcagacacuguagucaga

SEQ ID NO: 563607 - RNA, 19 nt, Homo sapiens
ccaaaguggugagcagauc

SEQ ID NO: 563608 - RNA, 19 nt, Homo sapiens
gcauuucacaaacucugua

SEQ ID NO: 563609 - RNA, 19 nt, Homo sapiens
gaaccagagagaaucaaca

SEQ ID NO: 563610 - RNA, 19 nt, Homo sapiens
ccaaggaaagggucagguu

SEQ ID NO: 563611 - RNA, 19 nt, Homo sapiens
caaguggggucuuucagaa

SEQ ID NO: 563612 - RNA, 19 nt, Homo sapiens
guccugaggccaagaaaga

SEQ ID NO: 563613 - RNA, 19 nt, Homo sapiens
gauuggagagcauguggaa

SEQ ID NO: 563614 - RNA, 19 nt, Homo sapiens
cagaucacagguuauugua

SEQ ID NO: 563615 - RNA, 19 nt, Homo sapiens
acucauacucagagcauua

SEQ ID NO: 563616 - RNA, 19 nt, Homo sapiens
cgaccuuguugucuccaaa

SEQ ID NO: 563617 - RNA, 19 nt, Homo sapiens
gacagcugcucggaaaugu

SEQ ID NO: 563618 - RNA, 19 nt, Homo sapiens
gaaugggaaagaucaaagu

SEQ ID NO: 563619 - RNA, 19 nt, Homo sapiens
ggaaugggaaagaucaaag

SEQ ID NO: 563620 - RNA, 19 nt, Homo sapiens
cgugagaaaugggaccaaa

SEQ ID NO: 563621 - RNA, 19 nt, Homo sapiens
gcaauauaggaggcaauaa

SEQ ID NO: 563622 - RNA, 19 nt, Homo sapiens
caggaaccgauuaucuaua

SEQ ID NO: 563623 - RNA, 19 nt, Homo sapiens
gcaaccugaggaagucuuu

SEQ ID NO: 563624 - RNA, 19 nt, Homo sapiens
ggaagccccucccaacaga

SEQ ID NO: 563625 - RNA, 19 nt, Homo sapiens
gcagagauuacaucaucga

SEQ ID NO: 563626 - RNA, 19 nt, Homo sapiens
auacagacuggucgaagua

SEQ ID NO: 563627 - RNA, 19 nt, Homo sapiens
ucuccaggauccagccuuu

SEQ ID NO: 563628 - RNA, 19 nt, Homo sapiens
gcagcaagcccuggguguu

SEQ ID NO: 563629 - RNA, 19 nt, Homo sapiens
ggucaucggccugcaguau

SEQ ID NO: 563630 - RNA, 19 nt, Homo sapiens
ccacgcccauuguucaaag

SEQ ID NO: 563631 - RNA, 19 nt, Homo sapiens
gaaccuagcugccuaugug

SEQ ID NO: 563632 - RNA, 19 nt, Homo sapiens
ggagacgcauuguauauaa

SEQ ID NO: 563633 - RNA, 19 nt, Homo sapiens
gaacauacuuucuaaaugc

SEQ ID NO: 563634 - RNA, 19 nt, Homo sapiens
gauccgaagugcaaugaua

SEQ ID NO: 563635 - RNA, 19 nt, Homo sapiens
gaaggugaauggagagauu

SEQ ID NO: 563636 - RNA, 19 nt, Homo sapiens
gauagucacuucuaguuug

SEQ ID NO: 563637 - RNA, 19 nt, Homo sapiens
gaaaccagacccuguauga

SEQ ID NO: 563638 - RNA, 19 nt, Homo sapiens
gcaagguauugguagguua

SEQ ID NO: 563639 - RNA, 19 nt, Homo sapiens
ggagcaggcugaauucuca

SEQ ID NO: 563640 - RNA, 19 nt, Homo sapiens
ggccaaauauguuuaggaa

SEQ ID NO: 563641 - RNA, 19 nt, Homo sapiens
acucagagcauuauucuua

SEQ ID NO: 563642 - RNA, 19 nt, Homo sapiens
gcaaggauggcagagauua

SEQ ID NO: 563643 - RNA, 19 nt, Homo sapiens
gcaaugauagucacuucua

SEQ ID NO: 563644 - RNA, 19 nt, Homo sapiens
ggacaucugugccgucaag

SEQ ID NO: 563645 - RNA, 19 nt, Homo sapiens
gaaagaggcccuggacuuc

SEQ ID NO: 563646 - RNA, 19 nt, Homo sapiens
ucauuaagaucuuccauuc

SEQ ID NO: 563647 - RNA, 19 nt, Homo sapiens
gaaccgcuguuuguauuuc

SEQ ID NO: 563648 - RNA, 19 nt, Homo sapiens
caaggaaagggucagguua

SEQ ID NO: 563649 - RNA, 19 nt, Homo sapiens
guggacagcugcucggaaa

SEQ ID NO: 563650 - RNA, 19 nt, Homo sapiens
guacagcaagguauuggua

SEQ ID NO: 563651 - RNA, 19 nt, Homo sapiens
ggaaagaucaaaguggaaa

SEQ ID NO: 563652 - RNA, 19 nt, Homo sapiens
uggcagagauuacaucauc

SEQ ID NO: 563653 - RNA, 19 nt, Homo sapiens
guagguuacucaauuucaa

SEQ ID NO: 563654 - RNA, 19 nt, Homo sapiens
gcagaucacagguuauugu

SEQ ID NO: 563655 - RNA, 19 nt, Homo sapiens
ucucucagcucauuaagau

SEQ ID NO: 563656 - RNA, 19 nt, Homo sapiens
cacaaacucuguacagcaa

SEQ ID NO: 563657 - RNA, 19 nt, Homo sapiens
aagggcagaucacagguua

SEQ ID NO: 563658 - RNA, 19 nt, Homo sapiens
agucagaccucagcaauau

SEQ ID NO: 563659 - RNA, 19 nt, Homo sapiens
caaccugccuaauggcuau

SEQ ID NO: 563660 - RNA, 19 nt, Homo sapiens
aaagaaaccagacccugua

SEQ ID NO: 563661 - RNA, 19 nt, Homo sapiens
acagaucaaugacauagga

SEQ ID NO: 563662 - RNA, 19 nt, Homo sapiens
aggaaccgauuaucuauau

SEQ ID NO: 563663 - RNA, 19 nt, Homo sapiens
cagcaaggauggcagagau

SEQ ID NO: 563664 - RNA, 19 nt, Homo sapiens
agaaucaacagaucaauga

SEQ ID NO: 563665 - RNA, 19 nt, Homo sapiens
caauauaggaggcaauaau

SEQ ID NO: 563666 - RNA, 19 nt, Homo sapiens
gaucgaugaugcccauaca

SEQ ID NO: 563667 - RNA, 19 nt, Homo sapiens
ugacauaggauccgaagug

SEQ ID NO: 563668 - RNA, 19 nt, Homo sapiens
gguguucucucagcucauu

SEQ ID NO: 563669 - RNA, 19 nt, Homo sapiens
gaguggagcaggcugaauu

SEQ ID NO: 563670 - RNA, 19 nt, Homo sapiens
gagcauuauucuuauuugg

SEQ ID NO: 563671 - RNA, 19 nt, Homo sapiens
gcugauggccgaccuuguu

SEQ ID NO: 563672 - RNA, 19 nt, Homo sapiens
ggacaugcaggucgugaga

SEQ ID NO: 563673 - RNA, 19 nt, Homo sapiens
gagacgcauuguauauaau

SEQ ID NO: 563674 - RNA, 19 nt, Homo sapiens
gagaaucaacagaucaaug

SEQ ID NO: 563675 - RNA, 19 nt, Homo sapiens
gcccuggacuucccaagga

SEQ ID NO: 563676 - RNA, 19 nt, Homo sapiens
ggaaccgauuaucuauauu

SEQ ID NO: 563677 - RNA, 19 nt, Homo sapiens
ggacagcugcucggaaaug

SEQ ID NO: 563678 - RNA, 19 nt, Homo sapiens
aggaaccgcuguuuguauu

SEQ ID NO: 563679 - RNA, 19 nt, Homo sapiens
gggcagaucacagguuauu

SEQ ID NO: 563680 - RNA, 19 nt, Homo sapiens
gauccaacuacaaggcuua

SEQ ID NO: 563681 - RNA, 19 nt, Homo sapiens
caacagaucaaugacauag

SEQ ID NO: 563682 - RNA, 19 nt, Homo sapiens
gagagaaucaacagaucaa

SEQ ID NO: 563683 - RNA, 19 nt, Homo sapiens
aagacuaguuuacaaagga

SEQ ID NO: 563684 - RNA, 19 nt, Homo sapiens
guaaugccacucauacuca

SEQ ID NO: 563685 - RNA, 19 nt, Homo sapiens
gaccugcaacgcccagaua

SEQ ID NO: 563686 - RNA, 19 nt, Homo sapiens
cagcugcucggaaauguuu

SEQ ID NO: 563687 - RNA, 19 nt, Homo sapiens
cauaggauccgaagugcaa

SEQ ID NO: 563688 - RNA, 19 nt, Homo sapiens
cagagagaaucaacagauc

SEQ ID NO: 563689 - RNA, 19 nt, Homo sapiens
uggagggccugagaacaua

SEQ ID NO: 563690 - RNA, 19 nt, Homo sapiens
agaaagaggcccuggacuu

SEQ ID NO: 563691 - RNA, 19 nt, Homo sapiens
gguaauggacagcucaaug

SEQ ID NO: 563692 - RNA, 19 nt, Homo sapiens
gaacuggaaggccaacaca

SEQ ID NO: 563693 - RNA, 19 nt, Homo sapiens
acaugcaggucgugagaaa

SEQ ID NO: 563694 - RNA, 19 nt, Homo sapiens
gugcaaugauagucacuuc

SEQ ID NO: 563695 - RNA, 19 nt, Homo sapiens
ccagagagaaucaacagau

SEQ ID NO: 563696 - RNA, 19 nt, Homo sapiens
guaggaauaaagacuaguu

SEQ ID NO: 563697 - RNA, 19 nt, Homo sapiens
cgacauccgcauccagaaa

SEQ ID NO: 563698 - RNA, 19 nt, Homo sapiens
ggacaugcccacgcuggaa

SEQ ID NO: 563699 - RNA, 19 nt, Homo sapiens
cauccacagccaugaauuu

SEQ ID NO: 563700 - RNA, 19 nt, Homo sapiens
gaauggagagauugagauc

SEQ ID NO: 563701 - RNA, 19 nt, Homo sapiens
cagacuggucgaaguauuu

SEQ ID NO: 563702 - RNA, 19 nt, Homo sapiens
ccaggaaccgauuaucuau

SEQ ID NO: 563703 - RNA, 19 nt, Homo sapiens
ggaaccgcuguuuguauuu

SEQ ID NO: 563704 - RNA, 19 nt, Homo sapiens
caaugauagucacuucuag

SEQ ID NO: 563705 - RNA, 19 nt, Homo sapiens
cauacagacuggucgaagu

SEQ ID NO: 563706 - RNA, 19 nt, Homo sapiens
cgcagacacuguagucaga

SEQ ID NO: 563707 - RNA, 19 nt, Homo sapiens
ccaaaguggugagcagauc

SEQ ID NO: 563708 - RNA, 19 nt, Homo sapiens
gcauuucacaaacucugua

SEQ ID NO: 563709 - RNA, 19 nt, Homo sapiens
gaaccagagagaaucaaca

SEQ ID NO: 563710 - RNA, 19 nt, Homo sapiens
ccaaggaaagggucagguu

SEQ ID NO: 563711 - RNA, 19 nt, Homo sapiens
caaguggggucuuucagaa

SEQ ID NO: 563712 - RNA, 19 nt, Homo sapiens
guccugaggccaagaaaga

SEQ ID NO: 563713 - RNA, 19 nt, Homo sapiens
gauuggagagcauguggaa

SEQ ID NO: 563714 - RNA, 19 nt, Homo sapiens
cagaucacagguuauugua

SEQ ID NO: 563715 - RNA, 19 nt, Homo sapiens
acucauacucagagcauua

SEQ ID NO: 563716 - RNA, 19 nt, Homo sapiens
cgaccuuguugucuccaaa

SEQ ID NO: 563717 - RNA, 19 nt, Homo sapiens
gacagcugcucggaaaugu

SEQ ID NO: 563718 - RNA, 19 nt, Homo sapiens
gaaugggaaagaucaaagu

SEQ ID NO: 563719 - RNA, 19 nt, Homo sapiens
ggaaugggaaagaucaaag

SEQ ID NO: 563720 - RNA, 19 nt, Homo sapiens
cgugagaaaugggaccaaa

SEQ ID NO: 563721 - RNA, 19 nt, Homo sapiens
gcaauauaggaggcaauaa

SEQ ID NO: 563722 - RNA, 19 nt, Homo sapiens
caggaaccgauuaucuaua

SEQ ID NO: 563723 - RNA, 19 nt, Homo sapiens
gcaaccugaggaagucuuu

SEQ ID NO: 563724 - RNA, 19 nt, Homo sapiens
gcagagauuacaucaucga

SEQ ID NO: 563725 - RNA, 19 nt, Homo sapiens
auacagacuggucgaagua

SEQ ID NO: 563726 - RNA, 19 nt, Homo sapiens
ucuccaggauccagccuuu

SEQ ID NO: 563727 - RNA, 19 nt, Homo sapiens
gcagcaagcccuggguguu

SEQ ID NO: 563728 - RNA, 19 nt, Homo sapiens
ggucaucggccugcaguau

SEQ ID NO: 563729 - RNA, 19 nt, Homo sapiens
ccacgcccauuguucaaag

SEQ ID NO: 563730 - RNA, 19 nt, Homo sapiens
uggccaaccugccuaaugg

SEQ ID NO: 563731 - RNA, 19 nt, Homo sapiens
ggaaagaccacgcugauca

SEQ ID NO: 563732 - RNA, 19 nt, Homo sapiens
ggagacagauccucacucu

SEQ ID NO: 563733 - RNA, 19 nt, Homo sapiens
ggacaggaagcucaucuuu

SEQ ID NO: 563734 - RNA, 19 nt, Homo sapiens
caacucagccuacggcaaa

SEQ ID NO: 563735 - RNA, 19 nt, Homo sapiens
gaagcucuuuccaggauga

SEQ ID NO: 563736 - RNA, 19 nt, Homo sapiens
gcacaggucgaacuugaaa

SEQ ID NO: 563737 - RNA, 19 nt, Homo sapiens
ccacucggaucucaucuug

SEQ ID NO: 563738 - RNA, 19 nt, Homo sapiens
gaacggaagacgacaagga

SEQ ID NO: 563739 - RNA, 19 nt, Homo sapiens
aggcggagcuccagaaaug

SEQ ID NO: 563740 - RNA, 19 nt, Homo sapiens
acaggaagcucaucuuugg

SEQ ID NO: 563741 - RNA, 19 nt, Homo sapiens
ggacauuaaaccuuugauu

SEQ ID NO: 563742 - RNA, 19 nt, Homo sapiens
gaaagaccacgcugaucaa

SEQ ID NO: 563743 - RNA, 19 nt, Homo sapiens
uaacaggacauuaaaccuu

SEQ ID NO: 563744 - RNA, 19 nt, Homo sapiens
aacaggacauuaaaccuuu

SEQ ID NO: 563745 - RNA, 19 nt, Homo sapiens
cugcacaucuuccgcugua

SEQ ID NO: 563746 - RNA, 19 nt, Homo sapiens
gcagcaggguccuccuugu

SEQ ID NO: 563747 - RNA, 19 nt, Homo sapiens
cugcacaggucgaacuuga

SEQ ID NO: 563748 - RNA, 19 nt, Homo sapiens
gacaggaagcucaucuuug

SEQ ID NO: 563749 - RNA, 19 nt, Homo sapiens
gaacuuugagcaccugaca

SEQ ID NO: 563750 - RNA, 19 nt, Homo sapiens
ucacgugcgucuuccugaa

SEQ ID NO: 563751 - RNA, 19 nt, Homo sapiens
gcaaauuccggaagcucuu

SEQ ID NO: 563752 - RNA, 19 nt, Homo sapiens
acgcugcccucacgcauga

SEQ ID NO: 563753 - RNA, 19 nt, Homo sapiens
gaccaagaaagaacuggaa

SEQ ID NO: 563754 - RNA, 19 nt, Homo sapiens
cggaagaugcggacgagaa

SEQ ID NO: 563755 - RNA, 19 nt, Homo sapiens
guauaaggaggccacaguu

SEQ ID NO: 563756 - RNA, 19 nt, Homo sapiens
gguggagguucacaacaag

SEQ ID NO: 563757 - RNA, 19 nt, Homo sapiens
ugguggagguucacaacaa

SEQ ID NO: 563758 - RNA, 19 nt, Homo sapiens
gacgugagggucaucauca

SEQ ID NO: 563759 - RNA, 19 nt, Homo sapiens
gaacgucgugcccgugucu

SEQ ID NO: 563760 - RNA, 19 nt, Homo sapiens
acucggaucucaucuugca

SEQ ID NO: 563761 - RNA, 19 nt, Homo sapiens
uggacaggcuucgcaagaa

SEQ ID NO: 563762 - RNA, 19 nt, Homo sapiens
gguccguggugcagacaau

SEQ ID NO: 563763 - RNA, 19 nt, Homo sapiens
gcaugaccguccuguacgu

SEQ ID NO: 563764 - RNA, 19 nt, Homo sapiens
ccaaaacgccggacaggaa

SEQ ID NO: 563765 - RNA, 19 nt, Homo sapiens
gcggaaagaccacgcugau

SEQ ID NO: 563766 - RNA, 19 nt, Homo sapiens
acaaggaggagccggaaga

SEQ ID NO: 563767 - RNA, 19 nt, Homo sapiens
caaauuccggaagcucuuu

SEQ ID NO: 563768 - RNA, 19 nt, Homo sapiens
ccacgggaccagcuguuug

SEQ ID NO: 563769 - RNA, 19 nt, Homo sapiens
ggaagaugcggacgagaac

SEQ ID NO: 563770 - RNA, 19 nt, Homo sapiens
guacaccaacugcggaaag

SEQ ID NO: 563771 - RNA, 19 nt, Homo sapiens
auaaggaggccacaguuca

SEQ ID NO: 563772 - RNA, 19 nt, Homo sapiens
gcacaucuuccgcuguaac

SEQ ID NO: 563773 - RNA, 19 nt, Homo sapiens
ugagggucaucaucagcaa

SEQ ID NO: 563774 - RNA, 19 nt, Homo sapiens
uacaccaacugcggaaaga

SEQ ID NO: 563775 - RNA, 19 nt, Homo sapiens
acaggacauuaaaccuuug

SEQ ID NO: 563776 - RNA, 19 nt, Homo sapiens
uuugagcaccugacagaaa

SEQ ID NO: 563777 - RNA, 19 nt, Homo sapiens
uuccguaacaggacauuaa

SEQ ID NO: 563778 - RNA, 19 nt, Homo sapiens
ggucaucaucagcaacuca

SEQ ID NO: 563779 - RNA, 19 nt, Homo sapiens
gguucacccugacgucaag

SEQ ID NO: 563780 - RNA, 19 nt, Homo sapiens
uauaaggaggccacaguuc

SEQ ID NO: 563781 - RNA, 19 nt, Homo sapiens
gaacacaacuguaacauuu

SEQ ID NO: 563782 - RNA, 19 nt, Homo sapiens
gaacaaagaugaaacuuga

SEQ ID NO: 563783 - RNA, 19 nt, Homo sapiens
gaauauaugucugcacuuu

SEQ ID NO: 563784 - RNA, 19 nt, Homo sapiens
gaacaucacuucuccuagu

SEQ ID NO: 563785 - RNA, 19 nt, Homo sapiens
acacacaccuccauauaua

SEQ ID NO: 563786 - RNA, 19 nt, Homo sapiens
gauguaaagucccugguua

SEQ ID NO: 563787 - RNA, 19 nt, Homo sapiens
gaacuucugugauuaaucg

SEQ ID NO: 563788 - RNA, 19 nt, Homo sapiens
gaagaaagccaaacgaagu

SEQ ID NO: 563789 - RNA, 19 nt, Homo sapiens
gccgagaucugacaacaaa

SEQ ID NO: 563790 - RNA, 19 nt, Homo sapiens
gaaugucucuggaucuuuc

SEQ ID NO: 563791 - RNA, 19 nt, Homo sapiens
gaagugccuugucuuugaa

SEQ ID NO: 563792 - RNA, 19 nt, Homo sapiens
ggagaagugccuugucuuu

SEQ ID NO: 563793 - RNA, 19 nt, Homo sapiens
gaaaggaaaucagcaacuc

SEQ ID NO: 563794 - RNA, 19 nt, Homo sapiens
agaagugccuugucuuuga

SEQ ID NO: 563795 - RNA, 19 nt, Homo sapiens
ccugguaucuacauccuua

SEQ ID NO: 563796 - RNA, 19 nt, Homo sapiens
gagcacuccuuguuagcua

SEQ ID NO: 563797 - RNA, 19 nt, Homo sapiens
gaugagcacuccuuguuag

SEQ ID NO: 563798 - RNA, 19 nt, Homo sapiens
acauugaacuucugugauu

SEQ ID NO: 563799 - RNA, 19 nt, Homo sapiens
aagaggagcugguggaaga

SEQ ID NO: 563800 - RNA, 19 nt, Homo sapiens
cggcacagauuauaauaga

SEQ ID NO: 563801 - RNA, 19 nt, Homo sapiens
gaaacgaagcccagaacaa

SEQ ID NO: 563802 - RNA, 19 nt, Homo sapiens
gaaaucagcaacucuucaa

SEQ ID NO: 563803 - RNA, 19 nt, Homo sapiens
ccagacaucuuccuagcuu

SEQ ID NO: 563804 - RNA, 19 nt, Homo sapiens
gaaguuaaaggaaguguuc

SEQ ID NO: 563805 - RNA, 19 nt, Homo sapiens
ccauuugccuccuuuaaga

SEQ ID NO: 563806 - RNA, 19 nt, Homo sapiens
uguaaacuguguaugcaua

SEQ ID NO: 563807 - RNA, 19 nt, Homo sapiens
ggacggacuucuucuggau

SEQ ID NO: 563808 - RNA, 19 nt, Homo sapiens
aaacgaagcccagaacaaa

SEQ ID NO: 563809 - RNA, 19 nt, Homo sapiens
gaauuaccaucucagaagu

SEQ ID NO: 563810 - RNA, 19 nt, Homo sapiens
ucacccaccucaucuuuga

SEQ ID NO: 563811 - RNA, 19 nt, Homo sapiens
gaugaaacuugaauuacca

SEQ ID NO: 563812 - RNA, 19 nt, Homo sapiens
cgucauccauaguuuauug

SEQ ID NO: 563813 - RNA, 19 nt, Homo sapiens
gcugggaaauguaaacugu

SEQ ID NO: 563814 - RNA, 19 nt, Homo sapiens
gcugauggaguaugugaua

SEQ ID NO: 563815 - RNA, 19 nt, Homo sapiens
gaaagccaaacgaaguuaa

SEQ ID NO: 563816 - RNA, 19 nt, Homo sapiens
ggaaauguaaacuguguau

SEQ ID NO: 563817 - RNA, 19 nt, Homo sapiens
ugaauucccugcaggacuu

SEQ ID NO: 563818 - RNA, 19 nt, Homo sapiens
gcaugcauguauauguaaa

SEQ ID NO: 563819 - RNA, 19 nt, Homo sapiens
acacacacaccuccauaua

SEQ ID NO: 563820 - RNA, 19 nt, Homo sapiens
caggaacacuuuuggaaua

SEQ ID NO: 563821 - RNA, 19 nt, Homo sapiens
guguaucaguuugguaaua

SEQ ID NO: 563822 - RNA, 19 nt, Homo sapiens
agucuaacguguugauaaa

SEQ ID NO: 563823 - RNA, 19 nt, Homo sapiens
gaguuuccaucccauguug

SEQ ID NO: 563824 - RNA, 19 nt, Homo sapiens
aaacgaaguuaaaggaagu

SEQ ID NO: 563825 - RNA, 19 nt, Homo sapiens
ggaaaucgggagugaagga

SEQ ID NO: 563826 - RNA, 19 nt, Homo sapiens
aagucaagcugauggagua

SEQ ID NO: 563827 - RNA, 19 nt, Homo sapiens
acaaggaguucuucagcuu

SEQ ID NO: 563828 - RNA, 19 nt, Homo sapiens
cauugaacuucugugauua

SEQ ID NO: 563829 - RNA, 19 nt, Homo sapiens
ggcccuggcuauugauuga

SEQ ID NO: 563830 - RNA, 19 nt, Homo sapiens
guggagugauugucuguga

SEQ ID NO: 563831 - RNA, 19 nt, Homo sapiens
uaucagacauugaacuucu

SEQ ID NO: 563832 - RNA, 19 nt, Homo sapiens
uggaguaugugauaaagug

SEQ ID NO: 563833 - RNA, 19 nt, Homo sapiens
gugauaaagugaauguaca

SEQ ID NO: 563834 - RNA, 19 nt, Homo sapiens
uaaucgcuaugacaagaaa

SEQ ID NO: 563835 - RNA, 19 nt, Homo sapiens
ggaaaucagcaacucuuca

SEQ ID NO: 563836 - RNA, 19 nt, Homo sapiens
gagccgagaucugacaaca

SEQ ID NO: 563837 - RNA, 19 nt, Homo sapiens
gaacacuggcugggaaaug

SEQ ID NO: 563838 - RNA, 19 nt, Homo sapiens
ggaaagggaaaggaaauca

SEQ ID NO: 563839 - RNA, 19 nt, Homo sapiens
gagaagugccuugucuuug

SEQ ID NO: 563840 - RNA, 19 nt, Homo sapiens
gaagacaagccgccacaag

SEQ ID NO: 563841 - RNA, 19 nt, Homo sapiens
cuugauggccugaauauau

SEQ ID NO: 563842 - RNA, 19 nt, Homo sapiens
aaccaguuguaacaucuua

SEQ ID NO: 563843 - RNA, 19 nt, Homo sapiens
uguaaucgcuaugacaaga

SEQ ID NO: 563844 - RNA, 19 nt, Homo sapiens
ucaagcugauggaguaugu

SEQ ID NO: 563845 - RNA, 19 nt, Homo sapiens
aguaugaacacaacuguaa

SEQ ID NO: 563846 - RNA, 19 nt, Homo sapiens
gcaaugacaacugauaaag

SEQ ID NO: 563847 - RNA, 19 nt, Homo sapiens
gauggaguaugugauaaag

SEQ ID NO: 563848 - RNA, 19 nt, Homo sapiens
caacaugcaaugacaacug

SEQ ID NO: 563849 - RNA, 19 nt, Homo sapiens
guauaugcuuuauguaugc

SEQ ID NO: 563850 - RNA, 19 nt, Homo sapiens
gauuauaauagacgucuug

SEQ ID NO: 563851 - RNA, 19 nt, Homo sapiens
ccauggaaaucgggaguga

SEQ ID NO: 563852 - RNA, 19 nt, Homo sapiens
ugacauggacggacuucuu

SEQ ID NO: 563853 - RNA, 19 nt, Homo sapiens
ugaugagcacuccuuguua

SEQ ID NO: 563854 - RNA, 19 nt, Homo sapiens
caacugauaaagcgagaug

SEQ ID NO: 563855 - RNA, 19 nt, Homo sapiens
aaacuugaauuaccaucuc

SEQ ID NO: 563856 - RNA, 19 nt, Homo sapiens
agcccgagcuguuugguuu

SEQ ID NO: 563857 - RNA, 19 nt, Homo sapiens
ugaauuaccaucucagaag

SEQ ID NO: 563858 - RNA, 19 nt, Homo sapiens
cuacauccuuaccugcauu

SEQ ID NO: 563859 - RNA, 19 nt, Homo sapiens
aacaugcaaugacaacuga

SEQ ID NO: 563860 - RNA, 19 nt, Homo sapiens
cggagaaacucaucaucca

SEQ ID NO: 563861 - RNA, 19 nt, Homo sapiens
uugauggccugaauauaug

SEQ ID NO: 563862 - RNA, 19 nt, Homo sapiens
ggagugauugucugugaau

SEQ ID NO: 563863 - RNA, 19 nt, Homo sapiens
ggauguaaagucccugguu

SEQ ID NO: 563864 - RNA, 19 nt, Homo sapiens
aaagcgagaugguaguucu

SEQ ID NO: 563865 - RNA, 19 nt, Homo sapiens
gccaaacgaaguuaaagga

SEQ ID NO: 563866 - RNA, 19 nt, Homo sapiens
gcuauugauugauguugca

SEQ ID NO: 563867 - RNA, 19 nt, Homo sapiens
ugaacacaacuguaacauu

SEQ ID NO: 563868 - RNA, 19 nt, Homo sapiens
uuagaggcggcacagauua

SEQ ID NO: 563869 - RNA, 19 nt, Homo sapiens
gaaacuugaauuaccaucu

SEQ ID NO: 563870 - RNA, 19 nt, Homo sapiens
uguauucagugguguuuca

SEQ ID NO: 563871 - RNA, 19 nt, Homo sapiens
ggaaaggaaaucagcaacu

SEQ ID NO: 563872 - RNA, 19 nt, Homo sapiens
ccgcgucguucgauaugaa

SEQ ID NO: 563873 - RNA, 19 nt, Homo sapiens
agacauugaacuucuguga

SEQ ID NO: 563874 - RNA, 19 nt, Homo sapiens
acaaccauuugccuccuuu

SEQ ID NO: 563875 - RNA, 19 nt, Homo sapiens
gaggcggcacagauuauaa

SEQ ID NO: 563876 - RNA, 19 nt, Homo sapiens
ugggaaauguaaacugugu

SEQ ID NO: 563877 - RNA, 19 nt, Homo sapiens
ccaaacgaaguuaaaggaa

SEQ ID NO: 563878 - RNA, 19 nt, Homo sapiens
caugcaaugacaacugaua

SEQ ID NO: 563879 - RNA, 19 nt, Homo sapiens
cugcaucacucuccucagu

SEQ ID NO: 563880 - RNA, 19 nt, Homo sapiens
ggaguuuccaucccauguu

SEQ ID NO: 563881 - RNA, 19 nt, Homo sapiens
caagugaagcucagaaaua

SEQ ID NO: 563882 - RNA, 19 nt, Homo sapiens
ggaaagaugguguuuauuc

SEQ ID NO: 563883 - RNA, 19 nt, Homo sapiens
ucaaacacguaguccuuua

SEQ ID NO: 563884 - RNA, 19 nt, Homo sapiens
uaggaaagaugguguuuau

SEQ ID NO: 563885 - RNA, 19 nt, Homo sapiens
guacuuggcacuucaguuu

SEQ ID NO: 563886 - RNA, 19 nt, Homo sapiens
gaagacaccaugcuuuaga

SEQ ID NO: 563887 - RNA, 19 nt, Homo sapiens
gucaaggaauuaagcauaa

SEQ ID NO: 563888 - RNA, 19 nt, Homo sapiens
agaagcagcugcaggagaa

SEQ ID NO: 563889 - RNA, 19 nt, Homo sapiens
ggaaguccaucuccaacug

SEQ ID NO: 563890 - RNA, 19 nt, Homo sapiens
ggaaggagcaugacaagag

SEQ ID NO: 563891 - RNA, 19 nt, Homo sapiens
gcagagccaaguugugaua

SEQ ID NO: 563892 - RNA, 19 nt, Homo sapiens
guacaaguccuuuaagauc

SEQ ID NO: 563893 - RNA, 19 nt, Homo sapiens
gacauugagucacggauga

SEQ ID NO: 563894 - RNA, 19 nt, Homo sapiens
gcaagugguucgcccugaa

SEQ ID NO: 563895 - RNA, 19 nt, Homo sapiens
gaaagaugguguuuauucc

SEQ ID NO: 563896 - RNA, 19 nt, Homo sapiens
aauguuaacugaucaggaa

SEQ ID NO: 563897 - RNA, 19 nt, Homo sapiens
gacaagaggcugagacaug

SEQ ID NO: 563898 - RNA, 19 nt, Homo sapiens
cagaaugucuccagaaagg

SEQ ID NO: 563899 - RNA, 19 nt, Homo sapiens
gaaggaagacaccaugcuu

SEQ ID NO: 563900 - RNA, 19 nt, Homo sapiens
aagcuuugguuucuaguaa

SEQ ID NO: 563901 - RNA, 19 nt, Homo sapiens
ccucauggcugugaagcua

SEQ ID NO: 563902 - RNA, 19 nt, Homo sapiens
uuaagaagcuguuuugcua

SEQ ID NO: 563903 - RNA, 19 nt, Homo sapiens
ggucugaugcuccuucaaa

SEQ ID NO: 563904 - RNA, 19 nt, Homo sapiens
ggucagaacaggacaagug

SEQ ID NO: 563905 - RNA, 19 nt, Homo sapiens
gaaaggacacccggucaga

SEQ ID NO: 563906 - RNA, 19 nt, Homo sapiens
ggcagaagcuucaggaacu

SEQ ID NO: 563907 - RNA, 19 nt, Homo sapiens
gaacuucgaggccuaugug

SEQ ID NO: 563908 - RNA, 19 nt, Homo sapiens
gaagcacgccuacaaggau

SEQ ID NO: 563909 - RNA, 19 nt, Homo sapiens
gaacaaaagcgcagagaga

SEQ ID NO: 563910 - RNA, 19 nt, Homo sapiens
agugaugccucaauuaaga

SEQ ID NO: 563911 - RNA, 19 nt, Homo sapiens
ugaagggcauggugcagaa

SEQ ID NO: 563912 - RNA, 19 nt, Homo sapiens
acaagaggcugagacaugu

SEQ ID NO: 563913 - RNA, 19 nt, Homo sapiens
gagccaaguugugauaagu

SEQ ID NO: 563914 - RNA, 19 nt, Homo sapiens
cagcagagccaaguuguga

SEQ ID NO: 563915 - RNA, 19 nt, Homo sapiens
gaaucgucgugcugacauu

SEQ ID NO: 563916 - RNA, 19 nt, Homo sapiens
caaacacguaguccuuuaa

SEQ ID NO: 563917 - RNA, 19 nt, Homo sapiens
acaagaagcacgccuacaa

SEQ ID NO: 563918 - RNA, 19 nt, Homo sapiens
cgucaaggaauuaagcaua

SEQ ID NO: 563919 - RNA, 19 nt, Homo sapiens
uacaaguccuuuaagauca

SEQ ID NO: 563920 - RNA, 19 nt, Homo sapiens
gcacgggccaccauaguca

SEQ ID NO: 563921 - RNA, 19 nt, Homo sapiens
aggaagacaccaugcuuua

SEQ ID NO: 563922 - RNA, 19 nt, Homo sapiens
gagcagaaugucuccagaa

SEQ ID NO: 563923 - RNA, 19 nt, Homo sapiens
gcccaguccuuaccucaug

SEQ ID NO: 563924 - RNA, 19 nt, Homo sapiens
cgaccaaacaccugaguga

SEQ ID NO: 563925 - RNA, 19 nt, Homo sapiens
acaagagccuggucaaguc

SEQ ID NO: 563926 - RNA, 19 nt, Homo sapiens
gaagcuguuuugcuaaauu

SEQ ID NO: 563927 - RNA, 19 nt, Homo sapiens
uuacaacgucaaggaauua

SEQ ID NO: 563928 - RNA, 19 nt, Homo sapiens
gaucaggaagugcaguuug

SEQ ID NO: 563929 - RNA, 19 nt, Homo sapiens
gcaaagagaagaacaaaag

SEQ ID NO: 563930 - RNA, 19 nt, Homo sapiens
gaacaagagccuggucaag

SEQ ID NO: 563931 - RNA, 19 nt, Homo sapiens
gaugguguuuauuccaguu

SEQ ID NO: 563932 - RNA, 19 nt, Homo sapiens
gcaacaucaagguuucuuu

SEQ ID NO: 563933 - RNA, 19 nt, Homo sapiens
cgacugggacuccuucuuc

SEQ ID NO: 563934 - RNA, 19 nt, Homo sapiens
aagagaagcuucgcaagag

SEQ ID NO: 563935 - RNA, 19 nt, Homo sapiens
gcaagagggagcagaagca

SEQ ID NO: 563936 - RNA, 19 nt, Homo sapiens
gcagcaaagagaagaacaa

SEQ ID NO: 563937 - RNA, 19 nt, Homo sapiens
gcagaagcuucaggaacug

SEQ ID NO: 563938 - RNA, 19 nt, Homo sapiens
gaagcucagaaauaccuaa

SEQ ID NO: 563939 - RNA, 19 nt, Homo sapiens
aaacacguaguccuuuaaa

SEQ ID NO: 563940 - RNA, 19 nt, Homo sapiens
acaccaugcuuuagagauc

SEQ ID NO: 563941 - RNA, 19 nt, Homo sapiens
guggagcucugcccugcuu

SEQ ID NO: 563942 - RNA, 19 nt, Homo sapiens
gggaacaggagcagaagga

SEQ ID NO: 563943 - RNA, 19 nt, Homo sapiens
gaagagcuggagcgagaga

SEQ ID NO: 563944 - RNA, 19 nt, Homo sapiens
gaacuggagcagcaaagag

SEQ ID NO: 563945 - RNA, 19 nt, Homo sapiens
acaaguccuuuaagaucaa

SEQ ID NO: 563946 - RNA, 19 nt, Homo sapiens
gguacaaguccuuuaagau

SEQ ID NO: 563947 - RNA, 19 nt, Homo sapiens
cagcguacuuggcacuuca

SEQ ID NO: 563948 - RNA, 19 nt, Homo sapiens
agaggaaccugcaguccau

SEQ ID NO: 563949 - RNA, 19 nt, Homo sapiens
gccguggccugcaacauca

SEQ ID NO: 563950 - RNA, 19 nt, Homo sapiens
caagguguuugagaaguuc

SEQ ID NO: 563951 - RNA, 19 nt, Homo sapiens
gauuucaggcugcaaacuu

SEQ ID NO: 563952 - RNA, 19 nt, Homo sapiens
ugaagcccaucaccaagau

SEQ ID NO: 563953 - RNA, 19 nt, Homo sapiens
uuuacaacgucaaggaauu

SEQ ID NO: 563954 - RNA, 19 nt, Homo sapiens
uuucuaaggugucgguaug

SEQ ID NO: 563955 - RNA, 19 nt, Homo sapiens
ggaagacaccaugcuuuag

SEQ ID NO: 563956 - RNA, 19 nt, Homo sapiens
agcagaaugucuccagaaa

SEQ ID NO: 563957 - RNA, 19 nt, Homo sapiens
cagcaaagagaagaacaaa

SEQ ID NO: 563958 - RNA, 19 nt, Homo sapiens
aagugaagcucagaaauac

SEQ ID NO: 563959 - RNA, 19 nt, Homo sapiens
ggaggucccacagcaaaga

SEQ ID NO: 563960 - RNA, 19 nt, Homo sapiens
gaaaagagaagagaagcuu

SEQ ID NO: 563961 - RNA, 19 nt, Homo sapiens
ggaacuggagcagcaaaga

SEQ ID NO: 563962 - RNA, 19 nt, Homo sapiens
uaaaagcuuugguuucuag

SEQ ID NO: 563963 - RNA, 19 nt, Homo sapiens
guuaaaagcuuugguuucu

SEQ ID NO: 563964 - RNA, 19 nt, Homo sapiens
gcagcguacuuggcacuuc

SEQ ID NO: 563965 - RNA, 19 nt, Homo sapiens
caagaagcacgccuacaag

SEQ ID NO: 563966 - RNA, 19 nt, Homo sapiens
gcggaggaaaggaaacaaa

SEQ ID NO: 563967 - RNA, 19 nt, Homo sapiens
gcagaaugucuccagaaag

SEQ ID NO: 563968 - RNA, 19 nt, Homo sapiens
caacaucaagguuucuuuu

SEQ ID NO: 563969 - RNA, 19 nt, Homo sapiens
gggccguucuuucuaaggu

SEQ ID NO: 563970 - RNA, 19 nt, Homo sapiens
caaguccuuuaagaucaaa

SEQ ID NO: 563971 - RNA, 19 nt, Homo sapiens
caagagcaccauggacuuc

SEQ ID NO: 563972 - RNA, 19 nt, Homo sapiens
gcaaagccaagacccuucu

SEQ ID NO: 563973 - RNA, 19 nt, Homo sapiens
cagaacaggacaagugcaa

SEQ ID NO: 563974 - RNA, 19 nt, Homo sapiens
ccaagugaagcucagaaau

SEQ ID NO: 563975 - RNA, 19 nt, Homo sapiens
agguacaaguccuuuaaga

SEQ ID NO: 563976 - RNA, 19 nt, Homo sapiens
gaugaggaagguacaaguc

SEQ ID NO: 563977 - RNA, 19 nt, Homo sapiens
gcguugcccuggugauucu

SEQ ID NO: 563978 - RNA, 19 nt, Homo sapiens
gauccgauagcuuuaaugc

SEQ ID NO: 563979 - RNA, 19 nt, Homo sapiens
ggcguccucuccugcauuc

SEQ ID NO: 563980 - RNA, 19 nt, Homo sapiens
ccaagagcaccauggacuu

SEQ ID NO: 563981 - RNA, 19 nt, Homo sapiens
ggagauagauguucacgua

SEQ ID NO: 563982 - RNA, 19 nt, Homo sapiens
gaagaaaccuaccaacagu

SEQ ID NO: 563983 - RNA, 19 nt, Homo sapiens
gaagagaagcuauuggaaa

SEQ ID NO: 563984 - RNA, 19 nt, Homo sapiens
ggaaagugauucaguucaa

SEQ ID NO: 563985 - RNA, 19 nt, Homo sapiens
gaacaagagagaaaguuaa

SEQ ID NO: 563986 - RNA, 19 nt, Homo sapiens
gacgacagcugcaguguga

SEQ ID NO: 563987 - RNA, 19 nt, Homo sapiens
ucagaaaucccaacaauga

SEQ ID NO: 563988 - RNA, 19 nt, Homo sapiens
gcagaaggcacaagaagaa

SEQ ID NO: 563989 - RNA, 19 nt, Homo sapiens
aacaggagcuugcagauuu

SEQ ID NO: 563990 - RNA, 19 nt, Homo sapiens
ggagaaggaucgagcuaau

SEQ ID NO: 563991 - RNA, 19 nt, Homo sapiens
ggaacuugcucgacugaga

SEQ ID NO: 563992 - RNA, 19 nt, Homo sapiens
gggaagaacuccgaaagga

SEQ ID NO: 563993 - RNA, 19 nt, Homo sapiens
gcaagaagaacaagagaga

SEQ ID NO: 563994 - RNA, 19 nt, Homo sapiens
cgaagcagaggaagaaaua

SEQ ID NO: 563995 - RNA, 19 nt, Homo sapiens
guucagaaaucccaacaau

SEQ ID NO: 563996 - RNA, 19 nt, Homo sapiens
guccuacccuucuuauuaa

SEQ ID NO: 563997 - RNA, 19 nt, Homo sapiens
gaacagcagaggaaagaga

SEQ ID NO: 563998 - RNA, 19 nt, Homo sapiens
gcaacuuucuucauguguu

SEQ ID NO: 563999 - RNA, 19 nt, Homo sapiens
gaaaaugaguuggaaaaug

SEQ ID NO: 564000 - RNA, 19 nt, Homo sapiens
gagaagaggaggagcagaa

SEQ ID NO: 564001 - RNA, 19 nt, Homo sapiens
gggaagaaaucucacaaac

SEQ ID NO: 564002 - RNA, 19 nt, Homo sapiens
gaaaucccaacaaugaauu

SEQ ID NO: 564003 - RNA, 19 nt, Homo sapiens
ggcgauuugugguuuauuu

SEQ ID NO: 564004 - RNA, 19 nt, Homo sapiens
ggaagaaaccuaccaacag

SEQ ID NO: 564005 - RNA, 19 nt, Homo sapiens
gaaggagaaacgaaagaaa

SEQ ID NO: 564006 - RNA, 19 nt, Homo sapiens
caauguauauguucaguac

SEQ ID NO: 564007 - RNA, 19 nt, Homo sapiens
gcaggagggaugacuauga

SEQ ID NO: 564008 - RNA, 19 nt, Homo sapiens
aaagagagaggcaaagauu

SEQ ID NO: 564009 - RNA, 19 nt, Homo sapiens
ggaagaagaaugccaagca

SEQ ID NO: 564010 - RNA, 19 nt, Homo sapiens
caugaggagugguugcuaa

SEQ ID NO: 564011 - RNA, 19 nt, Homo sapiens
ggaaagagagaggcaaaga

SEQ ID NO: 564012 - RNA, 19 nt, Homo sapiens
gaaauacaacaauguccaa

SEQ ID NO: 564013 - RNA, 19 nt, Homo sapiens
aguccuacccuucuuauua

SEQ ID NO: 564014 - RNA, 19 nt, Homo sapiens
gaggaagcuuugcagaaga

SEQ ID NO: 564015 - RNA, 19 nt, Homo sapiens
gaaagugauucaguucaag

SEQ ID NO: 564016 - RNA, 19 nt, Homo sapiens
agauagauguucacguaaa

SEQ ID NO: 564017 - RNA, 19 nt, Homo sapiens
gggaagaacagcagaggaa

SEQ ID NO: 564018 - RNA, 19 nt, Homo sapiens
gaaggcacaagaagaauuc

SEQ ID NO: 564019 - RNA, 19 nt, Homo sapiens
gcagcccuuucucuguuua

SEQ ID NO: 564020 - RNA, 19 nt, Homo sapiens
aggaggaggucggguaaua

SEQ ID NO: 564021 - RNA, 19 nt, Homo sapiens
gcuugcagauuuggagaua

SEQ ID NO: 564022 - RNA, 19 nt, Homo sapiens
gaaagagagaggcaaagau

SEQ ID NO: 564023 - RNA, 19 nt, Homo sapiens
gaacaacaacuagaagaag

SEQ ID NO: 564024 - RNA, 19 nt, Homo sapiens
ggaggacacuuuuauugaa

SEQ ID NO: 564025 - RNA, 19 nt, Homo sapiens
caacuuucuucauguguuc

SEQ ID NO: 564026 - RNA, 19 nt, Homo sapiens
gcacaagaagaauucagaa

SEQ ID NO: 564027 - RNA, 19 nt, Homo sapiens
aagagaagcuauuggaaag

SEQ ID NO: 564028 - RNA, 19 nt, Homo sapiens
gaggaaagcacugcaacuu

SEQ ID NO: 564029 - RNA, 19 nt, Homo sapiens
aaagaaacgucggcaggaa

SEQ ID NO: 564030 - RNA, 19 nt, Homo sapiens
gaaacgacaggagaagaaa

SEQ ID NO: 564031 - RNA, 19 nt, Homo sapiens
gaaaguuaaaggaacaaug

SEQ ID NO: 564032 - RNA, 19 nt, Homo sapiens
agaacaagagagaaaguua

SEQ ID NO: 564033 - RNA, 19 nt, Homo sapiens
gagaagcuauuggaaagag

SEQ ID NO: 564034 - RNA, 19 nt, Homo sapiens
ugaagaaggagaaacgaaa

SEQ ID NO: 564035 - RNA, 19 nt, Homo sapiens
ugaagaacaacaacuagaa

SEQ ID NO: 564036 - RNA, 19 nt, Homo sapiens
cacaaacgcacaucaaaga

SEQ ID NO: 564037 - RNA, 19 nt, Homo sapiens
gaagaacaacaacuagaag

SEQ ID NO: 564038 - RNA, 19 nt, Homo sapiens
cgagaaaccaagccacaaa

SEQ ID NO: 564039 - RNA, 19 nt, Homo sapiens
gagcauguuuacgacguuu

SEQ ID NO: 564040 - RNA, 19 nt, Homo sapiens
caacaauguccaagaggaa

SEQ ID NO: 564041 - RNA, 19 nt, Homo sapiens
aagcagcccuuucucuguu

SEQ ID NO: 564042 - RNA, 19 nt, Homo sapiens
acucaggacucucacagaa

SEQ ID NO: 564043 - RNA, 19 nt, Homo sapiens
gaggagugguugcuaagag

SEQ ID NO: 564044 - RNA, 19 nt, Homo sapiens
gcaggaggaggucggguaa

SEQ ID NO: 564045 - RNA, 19 nt, Homo sapiens
ucacgaagcagaggaagaa

SEQ ID NO: 564046 - RNA, 19 nt, Homo sapiens
gaagaaggagaaacgaaag

SEQ ID NO: 564047 - RNA, 19 nt, Homo sapiens
gauagauguucacguaaac

SEQ ID NO: 564048 - RNA, 19 nt, Homo sapiens
agagaaaguuaaaggaaca

SEQ ID NO: 564049 - RNA, 19 nt, Homo sapiens
gaagaacaagagagaaagu

SEQ ID NO: 564050 - RNA, 19 nt, Homo sapiens
ggaggucggguaauagaga

SEQ ID NO: 564051 - RNA, 19 nt, Homo sapiens
caaggucagcugcaauuug

SEQ ID NO: 564052 - RNA, 19 nt, Homo sapiens
aauugucccuucuacagua

SEQ ID NO: 564053 - RNA, 19 nt, Homo sapiens
agaaggaucgagcuaauug

SEQ ID NO: 564054 - RNA, 19 nt, Homo sapiens
gaggaggucggguaauaga

SEQ ID NO: 564055 - RNA, 19 nt, Homo sapiens
ggaaggagaaacccuaguc

SEQ ID NO: 564056 - RNA, 19 nt, Homo sapiens
aacaacaacuagaagaaga

SEQ ID NO: 564057 - RNA, 19 nt, Homo sapiens
gcaauguauauguucagua

SEQ ID NO: 564058 - RNA, 19 nt, Homo sapiens
gagaaggaucgagcuaauu

SEQ ID NO: 564059 - RNA, 19 nt, Homo sapiens
guaccagucggaagaagaa

SEQ ID NO: 564060 - RNA, 19 nt, Homo sapiens
gagcuaauugucccuucua

SEQ ID NO: 564061 - RNA, 19 nt, Homo sapiens
ucagaguaauggagaagga

SEQ ID NO: 564062 - RNA, 19 nt, Homo sapiens
agaggaagcuuugcagaag

SEQ ID NO: 564063 - RNA, 19 nt, Homo sapiens
ggaagaacagcagaggaaa

SEQ ID NO: 564064 - RNA, 19 nt, Homo sapiens
caagagagaaaguuaaagg

SEQ ID NO: 564065 - RNA, 19 nt, Homo sapiens
cuucauguguucagaaauc

SEQ ID NO: 564066 - RNA, 19 nt, Homo sapiens
gaagaacagcagaggaaag

SEQ ID NO: 564067 - RNA, 19 nt, Homo sapiens
aagaagaacaagagagaaa

SEQ ID NO: 564068 - RNA, 19 nt, Homo sapiens
gaauaaagaaggaaaagga

SEQ ID NO: 564069 - RNA, 19 nt, Homo sapiens
gagagcagaaggcacaaga

SEQ ID NO: 564070 - RNA, 19 nt, Homo sapiens
gguaauagagacagaacug

SEQ ID NO: 564071 - RNA, 19 nt, Homo sapiens
cggacuggcuccuccuuug

SEQ ID NO: 564072 - RNA, 19 nt, Homo sapiens
gagauagauguucacguaa

SEQ ID NO: 564073 - RNA, 19 nt, Homo sapiens
ugcagaagaugcuggauca

SEQ ID NO: 564074 - RNA, 19 nt, Homo sapiens
gagcagaaggcacaagaag

SEQ ID NO: 564075 - RNA, 19 nt, Homo sapiens
gaagaggaggacacuuuua

SEQ ID NO: 564076 - RNA, 19 nt, Homo sapiens
ggaagaaaucucacaaacg

SEQ ID NO: 564077 - RNA, 19 nt, Homo sapiens
gcacugcaacuuucuucau

SEQ ID NO: 564078 - RNA, 19 nt, Homo sapiens
aggaagaggaggacacuuu

SEQ ID NO: 564079 - RNA, 19 nt, Homo sapiens
aaaaugaguuggaaaaugg

SEQ ID NO: 564080 - RNA, 19 nt, Homo sapiens
uagaagaagagaagcuauu

SEQ ID NO: 564081 - RNA, 19 nt, Homo sapiens
ucagaaggcucuuuggaua

SEQ ID NO: 564082 - RNA, 19 nt, Homo sapiens
guucauggauguuaauuga

SEQ ID NO: 564083 - RNA, 19 nt, Homo sapiens
gggcaaaucucacacuguu

SEQ ID NO: 564084 - RNA, 19 nt, Homo sapiens
ugaagaagcguuacuauga

SEQ ID NO: 564085 - RNA, 19 nt, Homo sapiens
gaacaagguuggccauuuu

SEQ ID NO: 564086 - RNA, 19 nt, Homo sapiens
gaugguggcugaugucuuc

SEQ ID NO: 564087 - RNA, 19 nt, Homo sapiens
gaugauaucuucgucuaug

SEQ ID NO: 564088 - RNA, 19 nt, Homo sapiens
caacaaugccacacucuuu

SEQ ID NO: 564089 - RNA, 19 nt, Homo sapiens
gagaagcacugguauaagc

SEQ ID NO: 564090 - RNA, 19 nt, Homo sapiens
gcagugacccucccuucua

SEQ ID NO: 564091 - RNA, 19 nt, Homo sapiens
gcucugaguucauggaugu

SEQ ID NO: 564092 - RNA, 19 nt, Homo sapiens
auccggagcuguacaaaua

SEQ ID NO: 564093 - RNA, 19 nt, Homo sapiens
gaacucagaaggcucuuug

SEQ ID NO: 564094 - RNA, 19 nt, Homo sapiens
gaagaagcguuacuaugac

SEQ ID NO: 564095 - RNA, 19 nt, Homo sapiens
ggaccgugaugauaucuuc

SEQ ID NO: 564096 - RNA, 19 nt, Homo sapiens
ucauagagcugcccaacau

SEQ ID NO: 564097 - RNA, 19 nt, Homo sapiens
uguauaacguccugaugua

SEQ ID NO: 564098 - RNA, 19 nt, Homo sapiens
gcaaaucucacacuguuca

SEQ ID NO: 564099 - RNA, 19 nt, Homo sapiens
ggcaacacgugcuucauga

SEQ ID NO: 564100 - RNA, 19 nt, Homo sapiens
gugaugauaucuucgucua

SEQ ID NO: 564101 - RNA, 19 nt, Homo sapiens
ggacuucucugaguuuguc

SEQ ID NO: 564102 - RNA, 19 nt, Homo sapiens
agaacaagguuggccauuu

SEQ ID NO: 564103 - RNA, 19 nt, Homo sapiens
ugccacagcucaccgagua

SEQ ID NO: 564104 - RNA, 19 nt, Homo sapiens
gcggaacgauucugugauc

SEQ ID NO: 564105 - RNA, 19 nt, Homo sapiens
ggaagacacucggcuuugg

SEQ ID NO: 564106 - RNA, 19 nt, Homo sapiens
ucauggauguuaauugaga

SEQ ID NO: 564107 - RNA, 19 nt, Homo sapiens
gcgcacagcugcaugucau

SEQ ID NO: 564108 - RNA, 19 nt, Homo sapiens
gaaagaacaggucgugucu

SEQ ID NO: 564109 - RNA, 19 nt, Homo sapiens
gaagaugacgaggaggaua

SEQ ID NO: 564110 - RNA, 19 nt, Homo sapiens
uuaaucgggugaagaagaa

SEQ ID NO: 564111 - RNA, 19 nt, Homo sapiens
cucaggagcugcugucauu

SEQ ID NO: 564112 - RNA, 19 nt, Homo sapiens
cagccuauguccucuucua

SEQ ID NO: 564113 - RNA, 19 nt, Homo sapiens
agaaucagaucgaguccaa

SEQ ID NO: 564114 - RNA, 19 nt, Homo sapiens
ggacacuacacaacauuug

SEQ ID NO: 564115 - RNA, 19 nt, Homo sapiens
gaccuggacuucucugagu

SEQ ID NO: 564116 - RNA, 19 nt, Homo sapiens
ugaagaagaaggaguaugu

SEQ ID NO: 564117 - RNA, 19 nt, Homo sapiens
gcacuacuuugaugacaac

SEQ ID NO: 564118 - RNA, 19 nt, Homo sapiens
ucagucaccgcuucuauaa

SEQ ID NO: 564119 - RNA, 19 nt, Homo sapiens
ggucuuggaggucuucuuu

SEQ ID NO: 564120 - RNA, 19 nt, Homo sapiens
gcacaggaggcauggcaaa

SEQ ID NO: 564121 - RNA, 19 nt, Homo sapiens
acaacaacaugucggaaga

SEQ ID NO: 564122 - RNA, 19 nt, Homo sapiens
gccaggcauugcaggcuua

SEQ ID NO: 564123 - RNA, 19 nt, Homo sapiens
gauggacacuacacaacau

SEQ ID NO: 564124 - RNA, 19 nt, Homo sapiens
gcguuacuaugacgaggua

SEQ ID NO: 564125 - RNA, 19 nt, Homo sapiens
caacaugucggaagaggau

SEQ ID NO: 564126 - RNA, 19 nt, Homo sapiens
gggaugagaaagaagauga

SEQ ID NO: 564127 - RNA, 19 nt, Homo sapiens
ggaugaugguggcugaugu

SEQ ID NO: 564128 - RNA, 19 nt, Homo sapiens
cgaaguguacccaguagaa

SEQ ID NO: 564129 - RNA, 19 nt, Homo sapiens
ggucgaaguguacccagua

SEQ ID NO: 564130 - RNA, 19 nt, Homo sapiens
uccagaaggucgaagugua

SEQ ID NO: 564131 - RNA, 19 nt, Homo sapiens
gaugaagaagcguuacuau

SEQ ID NO: 564132 - RNA, 19 nt, Homo sapiens
ggaaggcgaggauuaugug

SEQ ID NO: 564133 - RNA, 19 nt, Homo sapiens
gcugguuccuuguggagaa

SEQ ID NO: 564134 - RNA, 19 nt, Homo sapiens
ugaccaaacccaacucaga

SEQ ID NO: 564135 - RNA, 19 nt, Homo sapiens
uggagaagcacugguauaa

SEQ ID NO: 564136 - RNA, 19 nt, Homo sapiens
aaacccaacucagaugaug

SEQ ID NO: 564137 - RNA, 19 nt, Homo sapiens
gaccaaacccaacucagau

SEQ ID NO: 564138 - RNA, 19 nt, Homo sapiens
gggagggccuguauaacgu

SEQ ID NO: 564139 - RNA, 19 nt, Homo sapiens
ggaccagaauccggaagug

SEQ ID NO: 564140 - RNA, 19 nt, Homo sapiens
ucggguacgugaugaagaa

SEQ ID NO: 564141 - RNA, 19 nt, Homo sapiens
ucuuggaggucuucuuuau

SEQ ID NO: 564142 - RNA, 19 nt, Homo sapiens
gcccagccguacauugcua

SEQ ID NO: 564143 - RNA, 19 nt, Homo sapiens
ugccacauguguucaagaa

SEQ ID NO: 564144 - RNA, 19 nt, Homo sapiens
ccgaguacuuccucaacaa

SEQ ID NO: 564145 - RNA, 19 nt, Homo sapiens
gggcaacacgugcuucaug

SEQ ID NO: 564146 - RNA, 19 nt, Homo sapiens
ccacccagcucugaguuca

SEQ ID NO: 564147 - RNA, 19 nt, Homo sapiens
uaaacuggcgccucaagga

SEQ ID NO: 564148 - RNA, 19 nt, Homo sapiens
uggagacccuggagaagga

SEQ ID NO: 564149 - RNA, 19 nt, Homo sapiens
ggagugcauugagcucuuc

SEQ ID NO: 564150 - RNA, 19 nt, Homo sapiens
gggugaagaagaaggagua

SEQ ID NO: 564151 - RNA, 19 nt, Homo sapiens
uuggauagguuguaugaca

SEQ ID NO: 564152 - RNA, 19 nt, Homo sapiens
cagagaugaagaagcguua

SEQ ID NO: 564153 - RNA, 19 nt, Homo sapiens
ccugggagggccuguauaa

SEQ ID NO: 564154 - RNA, 19 nt, Homo sapiens
gacccucccuucuagucuu

SEQ ID NO: 564155 - RNA, 19 nt, Homo sapiens
cuguguguguguauauaua

SEQ ID NO: 564156 - RNA, 19 nt, Homo sapiens
ggacacccucguggaguuu

SEQ ID NO: 564157 - RNA, 19 nt, Homo sapiens
ccaaacccaacucagauga

SEQ ID NO: 564158 - RNA, 19 nt, Homo sapiens
gaagaagaaggaguaugug

SEQ ID NO: 564159 - RNA, 19 nt, Homo sapiens
gcaacacgugcuucaugaa

SEQ ID NO: 564160 - RNA, 19 nt, Homo sapiens
cauggagacccgcaagaaa

SEQ ID NO: 564161 - RNA, 19 nt, Homo sapiens
ucaaugagaaucagaucga

SEQ ID NO: 564162 - RNA, 19 nt, Homo sapiens
caucgugguuccugucuac

SEQ ID NO: 564163 - RNA, 19 nt, Homo sapiens
caggaagacacucggcuuu

SEQ ID NO: 564164 - RNA, 19 nt, Homo sapiens
guggagaagcacugguaua

SEQ ID NO: 564165 - RNA, 19 nt, Homo sapiens
cagcugguauggucuagag

SEQ ID NO: 564166 - RNA, 19 nt, Homo sapiens
aagaugacgaggaggauaa

SEQ ID NO: 564167 - RNA, 19 nt, Homo sapiens
augcagaccuggugaagca

SEQ ID NO: 564168 - RNA, 19 nt, Homo sapiens
acacacacaucacgguucu

SEQ ID NO: 564169 - RNA, 19 nt, Homo sapiens
ggcacuacuuugaugacaa

SEQ ID NO: 564170 - RNA, 19 nt, Homo sapiens
ggugucaggucgcauugag

SEQ ID NO: 564171 - RNA, 19 nt, Homo sapiens
acaaacggcggaacgauuc

SEQ ID NO: 564172 - RNA, 19 nt, Homo sapiens
cacaaacggcggaacgauu

SEQ ID NO: 564173 - RNA, 19 nt, Homo sapiens
cagugacccucccuucuag

SEQ ID NO: 564174 - RNA, 19 nt, Homo sapiens
gcucuggagucacgaacag

SEQ ID NO: 564175 - RNA, 19 nt, Homo sapiens
ugacgaggaggauaaagau

SEQ ID NO: 564176 - RNA, 19 nt, Homo sapiens
guguggcucuguccaaaca

SEQ ID NO: 564177 - RNA, 19 nt, Homo sapiens
gguggaaggcgaggauuau

SEQ ID NO: 564178 - RNA, 19 nt, Homo sapiens
cacagaguguauuuucuua

SEQ ID NO: 564179 - RNA, 19 nt, Homo sapiens
gauaaacuggcgccucaag

SEQ ID NO: 564180 - RNA, 19 nt, Homo sapiens
cugaguucauggauguuaa

SEQ ID NO: 564181 - RNA, 19 nt, Homo sapiens
guaaagcgcuugcugauua

SEQ ID NO: 564182 - RNA, 19 nt, Homo sapiens
caaaggagauuuacuagaa

SEQ ID NO: 564183 - RNA, 19 nt, Homo sapiens
caacaaauuuggcacuuua

SEQ ID NO: 564184 - RNA, 19 nt, Homo sapiens
gcaaagaucugcccugugu

SEQ ID NO: 564185 - RNA, 19 nt, Homo sapiens
agacacagcuucugaaauu

SEQ ID NO: 564186 - RNA, 19 nt, Homo sapiens
gaaccugcauuuccacaua

SEQ ID NO: 564187 - RNA, 19 nt, Homo sapiens
ggaaguagauauagucaug

SEQ ID NO: 564188 - RNA, 19 nt, Homo sapiens
agaaaucgcugguauaaau

SEQ ID NO: 564189 - RNA, 19 nt, Homo sapiens
gcaaagguguauauaguau

SEQ ID NO: 564190 - RNA, 19 nt, Homo sapiens
ggucaucuuuggucauuua

SEQ ID NO: 564191 - RNA, 19 nt, Homo sapiens
gguagucuaugccuuguua

SEQ ID NO: 564192 - RNA, 19 nt, Homo sapiens
acacgaugcuuuagaauuu

SEQ ID NO: 564193 - RNA, 19 nt, Homo sapiens
caacauugguguccuaaga

SEQ ID NO: 564194 - RNA, 19 nt, Homo sapiens
gcacagcaauaacuacuug

SEQ ID NO: 564195 - RNA, 19 nt, Homo sapiens
gaaagaagaccauauacug

SEQ ID NO: 564196 - RNA, 19 nt, Homo sapiens
gagaugaacuugaaagaag

SEQ ID NO: 564197 - RNA, 19 nt, Homo sapiens
gaagauaaaccagcauuaa

SEQ ID NO: 564198 - RNA, 19 nt, Homo sapiens
cagaaaaccuuguaacuua

SEQ ID NO: 564199 - RNA, 19 nt, Homo sapiens
gcucacagcugaacgaaug

SEQ ID NO: 564200 - RNA, 19 nt, Homo sapiens
ccugauagcucuucugauu

SEQ ID NO: 564201 - RNA, 19 nt, Homo sapiens
gaaagagaaugugcaauca

SEQ ID NO: 564202 - RNA, 19 nt, Homo sapiens
ucaaagagauauacacgaa

SEQ ID NO: 564203 - RNA, 19 nt, Homo sapiens
agacuuagauccugauauu

SEQ ID NO: 564204 - RNA, 19 nt, Homo sapiens
gaacaauucucccuauguc

SEQ ID NO: 564205 - RNA, 19 nt, Homo sapiens
gcagaaauuugcugucaau

SEQ ID NO: 564206 - RNA, 19 nt, Homo sapiens
gaugaggcuucaagauaua

SEQ ID NO: 564207 - RNA, 19 nt, Homo sapiens
ugucuuaucugcagaaauu

SEQ ID NO: 564208 - RNA, 19 nt, Homo sapiens
gcagacagguugaugacuu

SEQ ID NO: 564209 - RNA, 19 nt, Homo sapiens
ggaaacagaacguacaauu

SEQ ID NO: 564210 - RNA, 19 nt, Homo sapiens
gagccuauaugauggauga

SEQ ID NO: 564211 - RNA, 19 nt, Homo sapiens
guaaugugcuucagcuuga

SEQ ID NO: 564212 - RNA, 19 nt, Homo sapiens
ggacaagaagaaacuguua

SEQ ID NO: 564213 - RNA, 19 nt, Homo sapiens
caccacagcuugaagauga

SEQ ID NO: 564214 - RNA, 19 nt, Homo sapiens
gcaauccucaguacacuua

SEQ ID NO: 564215 - RNA, 19 nt, Homo sapiens
ugaaaggaauuccagauga

SEQ ID NO: 564216 - RNA, 19 nt, Homo sapiens
gcugcuagguuccucuuua

SEQ ID NO: 564217 - RNA, 19 nt, Homo sapiens
caccagaccucaucagauu

SEQ ID NO: 564218 - RNA, 19 nt, Homo sapiens
guacgacgauguauucuca

SEQ ID NO: 564219 - RNA, 19 nt, Homo sapiens
ucaaaucgcuucuccgaau

SEQ ID NO: 564220 - RNA, 19 nt, Homo sapiens
guacgaaugugaagaaucu

SEQ ID NO: 564221 - RNA, 19 nt, Homo sapiens
gggaugauguauuuggaua

SEQ ID NO: 564222 - RNA, 19 nt, Homo sapiens
agaaaugguuccacaguuu

SEQ ID NO: 564223 - RNA, 19 nt, Homo sapiens
ugaaggcagugaagaagua

SEQ ID NO: 564224 - RNA, 19 nt, Homo sapiens
caaagacaguguuaauugu

SEQ ID NO: 564225 - RNA, 19 nt, Homo sapiens
cuauagaucuccucaaaga

SEQ ID NO: 564226 - RNA, 19 nt, Homo sapiens
gauaaaccagcauuaagua

SEQ ID NO: 564227 - RNA, 19 nt, Homo sapiens
cuagagaccaugaagauua

SEQ ID NO: 564228 - RNA, 19 nt, Homo sapiens
ggauacagcagaacaauau

SEQ ID NO: 564229 - RNA, 19 nt, Homo sapiens
uaacagagguagucuaugc

SEQ ID NO: 564230 - RNA, 19 nt, Homo sapiens
gaugcucuuucaaugauua

SEQ ID NO: 564231 - RNA, 19 nt, Homo sapiens
caagacugguuuccacuuu

SEQ ID NO: 564232 - RNA, 19 nt, Homo sapiens
gaacaaguuaugugaagaa

SEQ ID NO: 564233 - RNA, 19 nt, Homo sapiens
gaugaugaguugauaagau

SEQ ID NO: 564234 - RNA, 19 nt, Homo sapiens
ggaaagagaaugugcaauc

SEQ ID NO: 564235 - RNA, 19 nt, Homo sapiens
guacaacauugguguccua

SEQ ID NO: 564236 - RNA, 19 nt, Homo sapiens
guagugauguagaugauga

SEQ ID NO: 564237 - RNA, 19 nt, Homo sapiens
ggacaccggccucuacuuu

SEQ ID NO: 564238 - RNA, 19 nt, Homo sapiens
gaacuucgcacaaaugaca

SEQ ID NO: 564239 - RNA, 19 nt, Homo sapiens
gaacaacccucagagaacu

SEQ ID NO: 564240 - RNA, 19 nt, Homo sapiens
gagaacaaguuaugugaag

SEQ ID NO: 564241 - RNA, 19 nt, Homo sapiens
caaaucgcuucuccgaaua

SEQ ID NO: 564242 - RNA, 19 nt, Homo sapiens
guacaugggagaaguguuu

SEQ ID NO: 564243 - RNA, 19 nt, Homo sapiens
ggaacaguaugucaaagga

SEQ ID NO: 564244 - RNA, 19 nt, Homo sapiens
ggaaacaguucaggcuuug

SEQ ID NO: 564245 - RNA, 19 nt, Homo sapiens
agagagagcuaaacacuca

SEQ ID NO: 564246 - RNA, 19 nt, Homo sapiens
gagcaagaguacuuaugaa

SEQ ID NO: 564247 - RNA, 19 nt, Homo sapiens
ccaagaugcuccagaugaa

SEQ ID NO: 564248 - RNA, 19 nt, Homo sapiens
acacagaucaaccaaguua

SEQ ID NO: 564249 - RNA, 19 nt, Homo sapiens
guucgaguauuaacuguuu

SEQ ID NO: 564250 - RNA, 19 nt, Homo sapiens
ggaaaugcuuagcugagaa

SEQ ID NO: 564251 - RNA, 19 nt, Homo sapiens
ugauaaagauggugugaug

SEQ ID NO: 564252 - RNA, 19 nt, Homo sapiens
uaaauggccugaugcuaau

SEQ ID NO: 564253 - RNA, 19 nt, Homo sapiens
guaacuguccuguugcuua

SEQ ID NO: 564254 - RNA, 19 nt, Homo sapiens
caaacucacagaauucaua

SEQ ID NO: 564255 - RNA, 19 nt, Homo sapiens
gcagaagaaaucacuauga

SEQ ID NO: 564256 - RNA, 19 nt, Homo sapiens
ugagagaaguguacggaaa

SEQ ID NO: 564257 - RNA, 19 nt, Homo sapiens
caagacaacuacauaagca

SEQ ID NO: 564258 - RNA, 19 nt, Homo sapiens
gcaaugagccagacuugga

SEQ ID NO: 564259 - RNA, 19 nt, Homo sapiens
gaaagcagccuuaguccau

SEQ ID NO: 564260 - RNA, 19 nt, Homo sapiens
ggagaaagcagccuuaguc

SEQ ID NO: 564261 - RNA, 19 nt, Homo sapiens
gaaugcaguuuaccuuugu

SEQ ID NO: 564262 - RNA, 19 nt, Homo sapiens
ucaaucaacuucaacacaa

SEQ ID NO: 564263 - RNA, 19 nt, Homo sapiens
ggaauggcuuggagaugaa

SEQ ID NO: 564264 - RNA, 19 nt, Homo sapiens
gaaacagaacguacaauuc

SEQ ID NO: 564265 - RNA, 19 nt, Homo sapiens
ccaagaugaugaguugaua

SEQ ID NO: 564266 - RNA, 19 nt, Homo sapiens
agaccaagaugaugaguug

SEQ ID NO: 564267 - RNA, 19 nt, Homo sapiens
cauggaaccuuacacaguu

SEQ ID NO: 564268 - RNA, 19 nt, Homo sapiens
aaacuuaugccgccagaua

SEQ ID NO: 564269 - RNA, 19 nt, Homo sapiens
ggagcaagaguacuuauga

SEQ ID NO: 564270 - RNA, 19 nt, Homo sapiens
gcugauagauccugcagau

SEQ ID NO: 564271 - RNA, 19 nt, Homo sapiens
uaagugguauuccaaguug

SEQ ID NO: 564272 - RNA, 19 nt, Homo sapiens
ucacagaucuacacaaacu

SEQ ID NO: 564273 - RNA, 19 nt, Homo sapiens
ucagagaacuggccaacga

SEQ ID NO: 564274 - RNA, 19 nt, Homo sapiens
caaguuggaugacaugauc

SEQ ID NO: 564275 - RNA, 19 nt, Homo sapiens
uaaagcgauuugacuauga

SEQ ID NO: 564276 - RNA, 19 nt, Homo sapiens
gaacgguauucuugccauu

SEQ ID NO: 564277 - RNA, 19 nt, Homo sapiens
ucacaagugcuauaucuaa

SEQ ID NO: 564278 - RNA, 19 nt, Homo sapiens
acagauaaguuccaauaug

SEQ ID NO: 564279 - RNA, 19 nt, Homo sapiens
gcuugauccuucucuguua

SEQ ID NO: 564280 - RNA, 19 nt, Homo sapiens
ggauagaucgcuuuauaga

SEQ ID NO: 564281 - RNA, 19 nt, Homo sapiens
guaaagcgcuugcugauua

SEQ ID NO: 564282 - RNA, 19 nt, Homo sapiens
caaaggagauuuacuagaa

SEQ ID NO: 564283 - RNA, 19 nt, Homo sapiens
caacaaauuuggcacuuua

SEQ ID NO: 564284 - RNA, 19 nt, Homo sapiens
gcaaagaucugcccugugu

SEQ ID NO: 564285 - RNA, 19 nt, Homo sapiens
agacacagcuucugaaauu

SEQ ID NO: 564286 - RNA, 19 nt, Homo sapiens
gaaccugcauuuccacaua

SEQ ID NO: 564287 - RNA, 19 nt, Homo sapiens
ggaaguagauauagucaug

SEQ ID NO: 564288 - RNA, 19 nt, Homo sapiens
agaaaucgcugguauaaau

SEQ ID NO: 564289 - RNA, 19 nt, Homo sapiens
gcaaagguguauauaguau

SEQ ID NO: 564290 - RNA, 19 nt, Homo sapiens
ggucaucuuuggucauuua

SEQ ID NO: 564291 - RNA, 19 nt, Homo sapiens
gguagucuaugccuuguua

SEQ ID NO: 564292 - RNA, 19 nt, Homo sapiens
acacgaugcuuuagaauuu

SEQ ID NO: 564293 - RNA, 19 nt, Homo sapiens
caacauugguguccuaaga

SEQ ID NO: 564294 - RNA, 19 nt, Homo sapiens
gcacagcaauaacuacuug

SEQ ID NO: 564295 - RNA, 19 nt, Homo sapiens
gaaagaagaccauauacug

SEQ ID NO: 564296 - RNA, 19 nt, Homo sapiens
gagaugaacuugaaagaag

SEQ ID NO: 564297 - RNA, 19 nt, Homo sapiens
gaagauaaaccagcauuaa

SEQ ID NO: 564298 - RNA, 19 nt, Homo sapiens
cagaaaaccuuguaacuua

SEQ ID NO: 564299 - RNA, 19 nt, Homo sapiens
gcucacagcugaacgaaug

SEQ ID NO: 564300 - RNA, 19 nt, Homo sapiens
ccugauagcucuucugauu

SEQ ID NO: 564301 - RNA, 19 nt, Homo sapiens
gaaagagaaugugcaauca

SEQ ID NO: 564302 - RNA, 19 nt, Homo sapiens
ucaaagagauauacacgaa

SEQ ID NO: 564303 - RNA, 19 nt, Homo sapiens
agacuuagauccugauauu

SEQ ID NO: 564304 - RNA, 19 nt, Homo sapiens
gaacaauucucccuauguc

SEQ ID NO: 564305 - RNA, 19 nt, Homo sapiens
gcagaaauuugcugucaau

SEQ ID NO: 564306 - RNA, 19 nt, Homo sapiens
gaugaggcuucaagauaua

SEQ ID NO: 564307 - RNA, 19 nt, Homo sapiens
ugucuuaucugcagaaauu

SEQ ID NO: 564308 - RNA, 19 nt, Homo sapiens
gcagacagguugaugacuu

SEQ ID NO: 564309 - RNA, 19 nt, Homo sapiens
ggaaacagaacguacaauu

SEQ ID NO: 564310 - RNA, 19 nt, Homo sapiens
gagccuauaugauggauga

SEQ ID NO: 564311 - RNA, 19 nt, Homo sapiens
guaaugugcuucagcuuga

SEQ ID NO: 564312 - RNA, 19 nt, Homo sapiens
ggacaagaagaaacuguua

SEQ ID NO: 564313 - RNA, 19 nt, Homo sapiens
caccacagcuugaagauga

SEQ ID NO: 564314 - RNA, 19 nt, Homo sapiens
gcaauccucaguacacuua

SEQ ID NO: 564315 - RNA, 19 nt, Homo sapiens
ugaaaggaauuccagauga

SEQ ID NO: 564316 - RNA, 19 nt, Homo sapiens
gcugcuagguuccucuuua

SEQ ID NO: 564317 - RNA, 19 nt, Homo sapiens
caccagaccucaucagauu

SEQ ID NO: 564318 - RNA, 19 nt, Homo sapiens
guacgacgauguauucuca

SEQ ID NO: 564319 - RNA, 19 nt, Homo sapiens
ucaaaucgcuucuccgaau

SEQ ID NO: 564320 - RNA, 19 nt, Homo sapiens
guacgaaugugaagaaucu

SEQ ID NO: 564321 - RNA, 19 nt, Homo sapiens
gggaugauguauuuggaua

SEQ ID NO: 564322 - RNA, 19 nt, Homo sapiens
agaaaugguuccacaguuu

SEQ ID NO: 564323 - RNA, 19 nt, Homo sapiens
ugaaggcagugaagaagua

SEQ ID NO: 564324 - RNA, 19 nt, Homo sapiens
caaagacaguguuaauugu

SEQ ID NO: 564325 - RNA, 19 nt, Homo sapiens
cuauagaucuccucaaaga

SEQ ID NO: 564326 - RNA, 19 nt, Homo sapiens
gauaaaccagcauuaagua

SEQ ID NO: 564327 - RNA, 19 nt, Homo sapiens
cuagagaccaugaagauua

SEQ ID NO: 564328 - RNA, 19 nt, Homo sapiens
ggauacagcagaacaauau

SEQ ID NO: 564329 - RNA, 19 nt, Homo sapiens
uaacagagguagucuaugc

SEQ ID NO: 564330 - RNA, 19 nt, Homo sapiens
gaugcucuuucaaugauua

SEQ ID NO: 564331 - RNA, 19 nt, Homo sapiens
caagacugguuuccacuuu

SEQ ID NO: 564332 - RNA, 19 nt, Homo sapiens
gaacaaguuaugugaagaa

SEQ ID NO: 564333 - RNA, 19 nt, Homo sapiens
gaugaugaguugauaagau

SEQ ID NO: 564334 - RNA, 19 nt, Homo sapiens
ggaaagagaaugugcaauc

SEQ ID NO: 564335 - RNA, 19 nt, Homo sapiens
guacaacauugguguccua

SEQ ID NO: 564336 - RNA, 19 nt, Homo sapiens
guagugauguagaugauga

SEQ ID NO: 564337 - RNA, 19 nt, Homo sapiens
ggacaccggccucuacuuu

SEQ ID NO: 564338 - RNA, 19 nt, Homo sapiens
gaacuucgcacaaaugaca

SEQ ID NO: 564339 - RNA, 19 nt, Homo sapiens
gaacaacccucagagaacu

SEQ ID NO: 564340 - RNA, 19 nt, Homo sapiens
gagaacaaguuaugugaag

SEQ ID NO: 564341 - RNA, 19 nt, Homo sapiens
caaaucgcuucuccgaaua

SEQ ID NO: 564342 - RNA, 19 nt, Homo sapiens
guacaugggagaaguguuu

SEQ ID NO: 564343 - RNA, 19 nt, Homo sapiens
ggaacaguaugucaaagga

SEQ ID NO: 564344 - RNA, 19 nt, Homo sapiens
ggaaacaguucaggcuuug

SEQ ID NO: 564345 - RNA, 19 nt, Homo sapiens
agagagagcuaaacacuca

SEQ ID NO: 564346 - RNA, 19 nt, Homo sapiens
gagcaagaguacuuaugaa

SEQ ID NO: 564347 - RNA, 19 nt, Homo sapiens
ccaagaugcuccagaugaa

SEQ ID NO: 564348 - RNA, 19 nt, Homo sapiens
acacagaucaaccaaguua

SEQ ID NO: 564349 - RNA, 19 nt, Homo sapiens
guucgaguauuaacuguuu

SEQ ID NO: 564350 - RNA, 19 nt, Homo sapiens
ggaaaugcuuagcugagaa

SEQ ID NO: 564351 - RNA, 19 nt, Homo sapiens
ugauaaagauggugugaug

SEQ ID NO: 564352 - RNA, 19 nt, Homo sapiens
uaaauggccugaugcuaau

SEQ ID NO: 564353 - RNA, 19 nt, Homo sapiens
guaacuguccuguugcuua

SEQ ID NO: 564354 - RNA, 19 nt, Homo sapiens
caaacucacagaauucaua

SEQ ID NO: 564355 - RNA, 19 nt, Homo sapiens
gcagaagaaaucacuauga

SEQ ID NO: 564356 - RNA, 19 nt, Homo sapiens
ugagagaaguguacggaaa

SEQ ID NO: 564357 - RNA, 19 nt, Homo sapiens
caagacaacuacauaagca

SEQ ID NO: 564358 - RNA, 19 nt, Homo sapiens
gcaaugagccagacuugga

SEQ ID NO: 564359 - RNA, 19 nt, Homo sapiens
gaaagcagccuuaguccau

SEQ ID NO: 564360 - RNA, 19 nt, Homo sapiens
ggagaaagcagccuuaguc

SEQ ID NO: 564361 - RNA, 19 nt, Homo sapiens
gaaugcaguuuaccuuugu

SEQ ID NO: 564362 - RNA, 19 nt, Homo sapiens
ucaaucaacuucaacacaa

SEQ ID NO: 564363 - RNA, 19 nt, Homo sapiens
ggaauggcuuggagaugaa

SEQ ID NO: 564364 - RNA, 19 nt, Homo sapiens
gaaacagaacguacaauuc

SEQ ID NO: 564365 - RNA, 19 nt, Homo sapiens
ccaagaugaugaguugaua

SEQ ID NO: 564366 - RNA, 19 nt, Homo sapiens
agaccaagaugaugaguug

SEQ ID NO: 564367 - RNA, 19 nt, Homo sapiens
cauggaaccuuacacaguu

SEQ ID NO: 564368 - RNA, 19 nt, Homo sapiens
aaacuuaugccgccagaua

SEQ ID NO: 564369 - RNA, 19 nt, Homo sapiens
ggagcaagaguacuuauga

SEQ ID NO: 564370 - RNA, 19 nt, Homo sapiens
gcugauagauccugcagau

SEQ ID NO: 564371 - RNA, 19 nt, Homo sapiens
uaagugguauuccaaguug

SEQ ID NO: 564372 - RNA, 19 nt, Homo sapiens
ucacagaucuacacaaacu

SEQ ID NO: 564373 - RNA, 19 nt, Homo sapiens
ucagagaacuggccaacga

SEQ ID NO: 564374 - RNA, 19 nt, Homo sapiens
caaguuggaugacaugauc

SEQ ID NO: 564375 - RNA, 19 nt, Homo sapiens
uaaagcgauuugacuauga

SEQ ID NO: 564376 - RNA, 19 nt, Homo sapiens
gaacgguauucuugccauu

SEQ ID NO: 564377 - RNA, 19 nt, Homo sapiens
ucacaagugcuauaucuaa

SEQ ID NO: 564378 - RNA, 19 nt, Homo sapiens
acagauaaguuccaauaug

SEQ ID NO: 564379 - RNA, 19 nt, Homo sapiens
gcuugauccuucucuguua

SEQ ID NO: 564380 - RNA, 19 nt, Homo sapiens
ggauagaucgcuuuauaga

SEQ ID NO: 564381 - RNA, 19 nt, Homo sapiens
caagacagcucaacagauu

SEQ ID NO: 564382 - RNA, 19 nt, Homo sapiens
gcauggaucucccgaaauu

SEQ ID NO: 564383 - RNA, 19 nt, Homo sapiens
ggacauggccuccaaugaa

SEQ ID NO: 564384 - RNA, 19 nt, Homo sapiens
gcaaagagaagaaggagaa

SEQ ID NO: 564385 - RNA, 19 nt, Homo sapiens
aaauugagguggugacuuu

SEQ ID NO: 564386 - RNA, 19 nt, Homo sapiens
ggacauggaguaugaaaga

SEQ ID NO: 564387 - RNA, 19 nt, Homo sapiens
gcucagagaacgccaauga

SEQ ID NO: 564388 - RNA, 19 nt, Homo sapiens
uagaagcacuagagaagaa

SEQ ID NO: 564389 - RNA, 19 nt, Homo sapiens
cagcauggaucucccgaaa

SEQ ID NO: 564390 - RNA, 19 nt, Homo sapiens
agagagggcuugaccaaau

SEQ ID NO: 564391 - RNA, 19 nt, Homo sapiens
ugacaggacuggccgcuau

SEQ ID NO: 564392 - RNA, 19 nt, Homo sapiens
ggacauggacuaccguuca

SEQ ID NO: 564393 - RNA, 19 nt, Homo sapiens
agaaugacauggagcaaau

SEQ ID NO: 564394 - RNA, 19 nt, Homo sapiens
agaccggccucuacuauga

SEQ ID NO: 564395 - RNA, 19 nt, Homo sapiens
ccacacagcaccauggauu

SEQ ID NO: 564396 - RNA, 19 nt, Homo sapiens
gcaagaagcagggcauugu

SEQ ID NO: 564397 - RNA, 19 nt, Homo sapiens
ggcagaagcuggccugucu

SEQ ID NO: 564398 - RNA, 19 nt, Homo sapiens
ggagaaggccaguaacauc

SEQ ID NO: 564399 - RNA, 19 nt, Homo sapiens
gcaugacuaugacgacuca

SEQ ID NO: 564400 - RNA, 19 nt, Homo sapiens
gcuaugccauccucgagaa

SEQ ID NO: 564401 - RNA, 19 nt, Homo sapiens
ccgcugugcucaaaucuga

SEQ ID NO: 564402 - RNA, 19 nt, Homo sapiens
uggcaucacuggaaccaaa

SEQ ID NO: 564403 - RNA, 19 nt, Homo sapiens
ggcaagaccaucaauguug

SEQ ID NO: 564404 - RNA, 19 nt, Homo sapiens
gccaacagccagucguaua

SEQ ID NO: 564405 - RNA, 19 nt, Homo sapiens
gacauggccuccaaugaag

SEQ ID NO: 564406 - RNA, 19 nt, Homo sapiens
guucauauccucgcgagua

SEQ ID NO: 564407 - RNA, 19 nt, Homo sapiens
gagagggcuugaccaaauc

SEQ ID NO: 564408 - RNA, 19 nt, Homo sapiens
ccagugagcagcuucaaga

SEQ ID NO: 564409 - RNA, 19 nt, Homo sapiens
gcugggcagugacaacauu

SEQ ID NO: 564410 - RNA, 19 nt, Homo sapiens
caagaagcagggcauugua

SEQ ID NO: 564411 - RNA, 19 nt, Homo sapiens
cgaaggagggcaaagagaa

SEQ ID NO: 564412 - RNA, 19 nt, Homo sapiens
gaugagggcuauggcaaca

SEQ ID NO: 564413 - RNA, 19 nt, Homo sapiens
ucucagggcuccacaagca

SEQ ID NO: 564414 - RNA, 19 nt, Homo sapiens
cggcugagcugggagaguu

SEQ ID NO: 564415 - RNA, 19 nt, Homo sapiens
aaucagcacucccucaaca

SEQ ID NO: 564416 - RNA, 19 nt, Homo sapiens
cgagcccacuugucagaaa

SEQ ID NO: 564417 - RNA, 19 nt, Homo sapiens
gagaagcacaagaccaaga

SEQ ID NO: 564418 - RNA, 19 nt, Homo sapiens
gaggacuggcugugcaaua

SEQ ID NO: 564419 - RNA, 19 nt, Homo sapiens
aggacuggcugugcaauaa

SEQ ID NO: 564420 - RNA, 19 nt, Homo sapiens
gccagaaggugucgaugca

SEQ ID NO: 564421 - RNA, 19 nt, Homo sapiens
acauggagcaaaugaagua

SEQ ID NO: 564422 - RNA, 19 nt, Homo sapiens
gggagaggcggaccuaugu

SEQ ID NO: 564423 - RNA, 19 nt, Homo sapiens
caagggcccuggcaucacu

SEQ ID NO: 564424 - RNA, 19 nt, Homo sapiens
gaggagaaggccaguaaca

SEQ ID NO: 564425 - RNA, 19 nt, Homo sapiens
gagcaacuucuccacaugu

SEQ ID NO: 564426 - RNA, 19 nt, Homo sapiens
gcagcugaacgcagagaaa

SEQ ID NO: 564427 - RNA, 19 nt, Homo sapiens
ggagucagccacugcagau

SEQ ID NO: 564428 - RNA, 19 nt, Homo sapiens
gaaggagggcaaagagaag

SEQ ID NO: 564429 - RNA, 19 nt, Homo sapiens
caacgugcgcgucauaaag

SEQ ID NO: 564430 - RNA, 19 nt, Homo sapiens
ggacuaccguucauauccu

SEQ ID NO: 564431 - RNA, 19 nt, Homo sapiens
ggaguaggcggcagugagu

SEQ ID NO: 564432 - RNA, 19 nt, Homo sapiens
ccagagagggcuugaccaa

SEQ ID NO: 564433 - RNA, 19 nt, Homo sapiens
gagaggcggaccuauguuc

SEQ ID NO: 564434 - RNA, 19 nt, Homo sapiens
gaugagaccuccggcuacu

SEQ ID NO: 564435 - RNA, 19 nt, Homo sapiens
cuaccuaccaguacgauga

SEQ ID NO: 564436 - RNA, 19 nt, Homo sapiens
ugaaggcagucgcaucagu

SEQ ID NO: 564437 - RNA, 19 nt, Homo sapiens
gacaagcagacccaacuga

SEQ ID NO: 564438 - RNA, 19 nt, Homo sapiens
ggagggcaagcaugacuau

SEQ ID NO: 564439 - RNA, 19 nt, Homo sapiens
ggaaggacagaguguugga

SEQ ID NO: 564440 - RNA, 19 nt, Homo sapiens
cucaacagauugccaagga

SEQ ID NO: 564441 - RNA, 19 nt, Homo sapiens
ccaacaggaugagggcuau

SEQ ID NO: 564442 - RNA, 19 nt, Homo sapiens
ucagagaacgccaaugaca

SEQ ID NO: 564443 - RNA, 19 nt, Homo sapiens
gaucacguccuguuuugua

SEQ ID NO: 564444 - RNA, 19 nt, Homo sapiens
gcuacuaccaacaggauga

SEQ ID NO: 564445 - RNA, 19 nt, Homo sapiens
gggcaagcaugacuaugac

SEQ ID NO: 564446 - RNA, 19 nt, Homo sapiens
gccaggagggcaagcauga

SEQ ID NO: 564447 - RNA, 19 nt, Homo sapiens
gacauggacuaccguucau

SEQ ID NO: 564448 - RNA, 19 nt, Homo sapiens
ccagaccggccucuacuau

SEQ ID NO: 564449 - RNA, 19 nt, Homo sapiens
ugacauggagcaaaugaag

SEQ ID NO: 564450 - RNA, 19 nt, Homo sapiens
gagaagaagggagcacuag

SEQ ID NO: 564451 - RNA, 19 nt, Homo sapiens
ccaagcccaagaucaauga

SEQ ID NO: 564452 - RNA, 19 nt, Homo sapiens
ccaaucagcacucccucaa

SEQ ID NO: 564453 - RNA, 19 nt, Homo sapiens
ccaguaacaucgucaugcu

SEQ ID NO: 564454 - RNA, 19 nt, Homo sapiens
gagcagagugcggaggauu

SEQ ID NO: 564455 - RNA, 19 nt, Homo sapiens
aagaagcagggcauuguaa

SEQ ID NO: 564456 - RNA, 19 nt, Homo sapiens
agaagaaggagaagcacaa

SEQ ID NO: 564457 - RNA, 19 nt, Homo sapiens
cgacggacauaaggagaca

SEQ ID NO: 564458 - RNA, 19 nt, Homo sapiens
gaccuccggcuacuacuau

SEQ ID NO: 564459 - RNA, 19 nt, Homo sapiens
cgacuacagcuacuaccaa

SEQ ID NO: 564460 - RNA, 19 nt, Homo sapiens
aucaggacauggaguauga

SEQ ID NO: 564461 - RNA, 19 nt, Homo sapiens
aagagcaacuucuccacau

SEQ ID NO: 564462 - RNA, 19 nt, Homo sapiens
ccuaucaggacauggagua

SEQ ID NO: 564463 - RNA, 19 nt, Homo sapiens
gaagaaugacauggagcaa

SEQ ID NO: 564464 - RNA, 19 nt, Homo sapiens
uagagaagaaugacaugga

SEQ ID NO: 564465 - RNA, 19 nt, Homo sapiens
cgagaagaagggagcacua

SEQ ID NO: 564466 - RNA, 19 nt, Homo sapiens
ucagcucccugcgagauga

SEQ ID NO: 564467 - RNA, 19 nt, Homo sapiens
ccaacgugcgcgucauaaa

SEQ ID NO: 564468 - RNA, 19 nt, Homo sapiens
gggacauggccuccaauga

SEQ ID NO: 564469 - RNA, 19 nt, Homo sapiens
ucugggagcccuuccuuga

SEQ ID NO: 564470 - RNA, 19 nt, Homo sapiens
ggacaagcagacccaacug

SEQ ID NO: 564471 - RNA, 19 nt, Homo sapiens
gacuggcugugcaauaagu

SEQ ID NO: 564472 - RNA, 19 nt, Homo sapiens
gcacuagagaagaaugaca

SEQ ID NO: 564473 - RNA, 19 nt, Homo sapiens
ccagucguauaccaucaug

SEQ ID NO: 564474 - RNA, 19 nt, Homo sapiens
uggcaucuaccaacaauca

SEQ ID NO: 564475 - RNA, 19 nt, Homo sapiens
ugggagcccuuccuugaca

SEQ ID NO: 564476 - RNA, 19 nt, Homo sapiens
gcagggaaggacagagugu

SEQ ID NO: 564477 - RNA, 19 nt, Homo sapiens
acaaggagacacugcacaa

SEQ ID NO: 564478 - RNA, 19 nt, Homo sapiens
gaagcacuagagaagaaug

SEQ ID NO: 564479 - RNA, 19 nt, Homo sapiens
ucccgaaauuggccaguga

SEQ ID NO: 564480 - RNA, 19 nt, Homo sapiens
ccaagacagcucaacagau

SEQ ID NO: 564481 - RNA, 19 nt, Homo sapiens
caagacagcucaacagauu

SEQ ID NO: 564482 - RNA, 19 nt, Homo sapiens
gcauggaucucccgaaauu

SEQ ID NO: 564483 - RNA, 19 nt, Homo sapiens
ggacauggccuccaaugaa

SEQ ID NO: 564484 - RNA, 19 nt, Homo sapiens
gcaaagagaagaaggagaa

SEQ ID NO: 564485 - RNA, 19 nt, Homo sapiens
aaauugagguggugacuuu

SEQ ID NO: 564486 - RNA, 19 nt, Homo sapiens
ggacauggaguaugaaaga

SEQ ID NO: 564487 - RNA, 19 nt, Homo sapiens
gcucagagaacgccaauga

SEQ ID NO: 564488 - RNA, 19 nt, Homo sapiens
uagaagcacuagagaagaa

SEQ ID NO: 564489 - RNA, 19 nt, Homo sapiens
cagcauggaucucccgaaa

SEQ ID NO: 564490 - RNA, 19 nt, Homo sapiens
agagagggcuugaccaaau

SEQ ID NO: 564491 - RNA, 19 nt, Homo sapiens
ugacaggacuggccgcuau

SEQ ID NO: 564492 - RNA, 19 nt, Homo sapiens
ggacauggacuaccguuca

SEQ ID NO: 564493 - RNA, 19 nt, Homo sapiens
agaaugacauggagcaaau

SEQ ID NO: 564494 - RNA, 19 nt, Homo sapiens
agaccggccucuacuauga

SEQ ID NO: 564495 - RNA, 19 nt, Homo sapiens
ccacacagcaccauggauu

SEQ ID NO: 564496 - RNA, 19 nt, Homo sapiens
gcaagaagcagggcauugu

SEQ ID NO: 564497 - RNA, 19 nt, Homo sapiens
ggcagaagcuggccugucu

SEQ ID NO: 564498 - RNA, 19 nt, Homo sapiens
gcaugacuaugacgacuca

SEQ ID NO: 564499 - RNA, 19 nt, Homo sapiens
gcuaugccauccucgagaa

SEQ ID NO: 564500 - RNA, 19 nt, Homo sapiens
ccgcugugcucaaaucuga

SEQ ID NO: 564501 - RNA, 19 nt, Homo sapiens
uggcaucacuggaaccaaa

SEQ ID NO: 564502 - RNA, 19 nt, Homo sapiens
ggcaagaccaucaauguug

SEQ ID NO: 564503 - RNA, 19 nt, Homo sapiens
gccaacagccagucguaua

SEQ ID NO: 564504 - RNA, 19 nt, Homo sapiens
gacauggccuccaaugaag

SEQ ID NO: 564505 - RNA, 19 nt, Homo sapiens
guucauauccucgcgagua

SEQ ID NO: 564506 - RNA, 19 nt, Homo sapiens
gagagggcuugaccaaauc

SEQ ID NO: 564507 - RNA, 19 nt, Homo sapiens
ccagugagcagcuucaaga

SEQ ID NO: 564508 - RNA, 19 nt, Homo sapiens
gcugggcagugacaacauu

SEQ ID NO: 564509 - RNA, 19 nt, Homo sapiens
caagaagcagggcauugua

SEQ ID NO: 564510 - RNA, 19 nt, Homo sapiens
cgaaggagggcaaagagaa

SEQ ID NO: 564511 - RNA, 19 nt, Homo sapiens
gaugagggcuauggcaaca

SEQ ID NO: 564512 - RNA, 19 nt, Homo sapiens
ucucagggcuccacaagca

SEQ ID NO: 564513 - RNA, 19 nt, Homo sapiens
cggcugagcugggagaguu

SEQ ID NO: 564514 - RNA, 19 nt, Homo sapiens
aaucagcacucccucaaca

SEQ ID NO: 564515 - RNA, 19 nt, Homo sapiens
cgagcccacuugucagaaa

SEQ ID NO: 564516 - RNA, 19 nt, Homo sapiens
gagaagcacaagaccaaga

SEQ ID NO: 564517 - RNA, 19 nt, Homo sapiens
gaggacuggcugugcaaua

SEQ ID NO: 564518 - RNA, 19 nt, Homo sapiens
aggacuggcugugcaauaa

SEQ ID NO: 564519 - RNA, 19 nt, Homo sapiens
gccagaaggugucgaugca

SEQ ID NO: 564520 - RNA, 19 nt, Homo sapiens
acauggagcaaaugaagua

SEQ ID NO: 564521 - RNA, 19 nt, Homo sapiens
gggagaggcggaccuaugu

SEQ ID NO: 564522 - RNA, 19 nt, Homo sapiens
caagggcccuggcaucacu

SEQ ID NO: 564523 - RNA, 19 nt, Homo sapiens
gagcaacuucuccacaugu

SEQ ID NO: 564524 - RNA, 19 nt, Homo sapiens
gcagcugaacgcagagaaa

SEQ ID NO: 564525 - RNA, 19 nt, Homo sapiens
ggagucagccacugcagau

SEQ ID NO: 564526 - RNA, 19 nt, Homo sapiens
gaaggagggcaaagagaag

SEQ ID NO: 564527 - RNA, 19 nt, Homo sapiens
caacgugcgcgucauaaag

SEQ ID NO: 564528 - RNA, 19 nt, Homo sapiens
ggacuaccguucauauccu

SEQ ID NO: 564529 - RNA, 19 nt, Homo sapiens
ggaguaggcggcagugagu

SEQ ID NO: 564530 - RNA, 19 nt, Homo sapiens
ccagagagggcuugaccaa

SEQ ID NO: 564531 - RNA, 19 nt, Homo sapiens
gagaggcggaccuauguuc

SEQ ID NO: 564532 - RNA, 19 nt, Homo sapiens
gaugagaccuccggcuacu

SEQ ID NO: 564533 - RNA, 19 nt, Homo sapiens
cuaccuaccaguacgauga

SEQ ID NO: 564534 - RNA, 19 nt, Homo sapiens
ugaaggcagucgcaucagu

SEQ ID NO: 564535 - RNA, 19 nt, Homo sapiens
gacaagcagacccaacuga

SEQ ID NO: 564536 - RNA, 19 nt, Homo sapiens
ggagggcaagcaugacuau

SEQ ID NO: 564537 - RNA, 19 nt, Homo sapiens
ggaaggacagaguguugga

SEQ ID NO: 564538 - RNA, 19 nt, Homo sapiens
cucaacagauugccaagga

SEQ ID NO: 564539 - RNA, 19 nt, Homo sapiens
ccaacaggaugagggcuau

SEQ ID NO: 564540 - RNA, 19 nt, Homo sapiens
ucagagaacgccaaugaca

SEQ ID NO: 564541 - RNA, 19 nt, Homo sapiens
gaucacguccuguuuugua

SEQ ID NO: 564542 - RNA, 19 nt, Homo sapiens
gcuacuaccaacaggauga

SEQ ID NO: 564543 - RNA, 19 nt, Homo sapiens
gggcaagcaugacuaugac

SEQ ID NO: 564544 - RNA, 19 nt, Homo sapiens
gccaggagggcaagcauga

SEQ ID NO: 564545 - RNA, 19 nt, Homo sapiens
gacauggacuaccguucau

SEQ ID NO: 564546 - RNA, 19 nt, Homo sapiens
ccagaccggccucuacuau

SEQ ID NO: 564547 - RNA, 19 nt, Homo sapiens
ugacauggagcaaaugaag

SEQ ID NO: 564548 - RNA, 19 nt, Homo sapiens
gagaagaagggagcacuag

SEQ ID NO: 564549 - RNA, 19 nt, Homo sapiens
ccaagcccaagaucaauga

SEQ ID NO: 564550 - RNA, 19 nt, Homo sapiens
ccaaucagcacucccucaa

SEQ ID NO: 564551 - RNA, 19 nt, Homo sapiens
aagaagcagggcauuguaa

SEQ ID NO: 564552 - RNA, 19 nt, Homo sapiens
aucaggacauggaguauga

SEQ ID NO: 564553 - RNA, 19 nt, Homo sapiens
agaagaaggagaagcacaa

SEQ ID NO: 564554 - RNA, 19 nt, Homo sapiens
cgacggacauaaggagaca

SEQ ID NO: 564555 - RNA, 19 nt, Homo sapiens
gaccuccggcuacuacuau

SEQ ID NO: 564556 - RNA, 19 nt, Homo sapiens
cgacuacagcuacuaccaa

SEQ ID NO: 564557 - RNA, 19 nt, Homo sapiens
aagagcaacuucuccacau

SEQ ID NO: 564558 - RNA, 19 nt, Homo sapiens
gaagaaugacauggagcaa

SEQ ID NO: 564559 - RNA, 19 nt, Homo sapiens
uagagaagaaugacaugga

SEQ ID NO: 564560 - RNA, 19 nt, Homo sapiens
cgagaagaagggagcacua

SEQ ID NO: 564561 - RNA, 19 nt, Homo sapiens
ucagcucccugcgagauga

SEQ ID NO: 564562 - RNA, 19 nt, Homo sapiens
ccuaucaggacauggagua

SEQ ID NO: 564563 - RNA, 19 nt, Homo sapiens
ccaacgugcgcgucauaaa

SEQ ID NO: 564564 - RNA, 19 nt, Homo sapiens
ucugggagcccuuccuuga

SEQ ID NO: 564565 - RNA, 19 nt, Homo sapiens
gggacauggccuccaauga

SEQ ID NO: 564566 - RNA, 19 nt, Homo sapiens
ggacaagcagacccaacug

SEQ ID NO: 564567 - RNA, 19 nt, Homo sapiens
gacuggcugugcaauaagu

SEQ ID NO: 564568 - RNA, 19 nt, Homo sapiens
ugggagcccuuccuugaca

SEQ ID NO: 564569 - RNA, 19 nt, Homo sapiens
gcacuagagaagaaugaca

SEQ ID NO: 564570 - RNA, 19 nt, Homo sapiens
ccagucguauaccaucaug

SEQ ID NO: 564571 - RNA, 19 nt, Homo sapiens
uggcaucuaccaacaauca

SEQ ID NO: 564572 - RNA, 19 nt, Homo sapiens
gcagggaaggacagagugu

SEQ ID NO: 564573 - RNA, 19 nt, Homo sapiens
acaaggagacacugcacaa

SEQ ID NO: 564574 - RNA, 19 nt, Homo sapiens
gaagcacuagagaagaaug

SEQ ID NO: 564575 - RNA, 19 nt, Homo sapiens
ucccgaaauuggccaguga

SEQ ID NO: 564576 - RNA, 19 nt, Homo sapiens
ccaagacagcucaacagau

SEQ ID NO: 564577 - RNA, 19 nt, Homo sapiens
gaagaaggagaagcacaag

SEQ ID NO: 564578 - RNA, 19 nt, Homo sapiens
ggagaggcggaccuauguu

SEQ ID NO: 564579 - RNA, 19 nt, Homo sapiens
ccuggcaucuaccaacaau

SEQ ID NO: 564580 - RNA, 19 nt, Homo sapiens
cggcaagaccaucaauguu

SEQ ID NO: 564581 - RNA, 19 nt, Homo sapiens
gagcggagguuuccuaaua

SEQ ID NO: 564582 - RNA, 19 nt, Homo sapiens
gaagauuguugguguguaa

SEQ ID NO: 564583 - RNA, 19 nt, Homo sapiens
gcugacaccugaacuauuu

SEQ ID NO: 564584 - RNA, 19 nt, Homo sapiens
gaaaggcccugcuggagaa

SEQ ID NO: 564585 - RNA, 19 nt, Homo sapiens
ggaggaaggugguuaugaa

SEQ ID NO: 564586 - RNA, 19 nt, Homo sapiens
gagaggagcuagagccaaa

SEQ ID NO: 564587 - RNA, 19 nt, Homo sapiens
ggaaggauccgguuuguug

SEQ ID NO: 564588 - RNA, 19 nt, Homo sapiens
gcacagacccugacagaga

SEQ ID NO: 564589 - RNA, 19 nt, Homo sapiens
ccacagcaaugcccaguuu

SEQ ID NO: 564590 - RNA, 19 nt, Homo sapiens
guggacaacuucagguuua

SEQ ID NO: 564591 - RNA, 19 nt, Homo sapiens
gcaaggauaugccuaaggu

SEQ ID NO: 564592 - RNA, 19 nt, Homo sapiens
gaaccagaauggcuuggaa

SEQ ID NO: 564593 - RNA, 19 nt, Homo sapiens
caaccaaggcuacaacuuu

SEQ ID NO: 564594 - RNA, 19 nt, Homo sapiens
ugacauccauuccaaagaa

SEQ ID NO: 564595 - RNA, 19 nt, Homo sapiens
gagugaaacugaacuacuu

SEQ ID NO: 564596 - RNA, 19 nt, Homo sapiens
gaggagggcucagguaaga

SEQ ID NO: 564597 - RNA, 19 nt, Homo sapiens
uaaauagcauugaggaaga

SEQ ID NO: 564598 - RNA, 19 nt, Homo sapiens
caacaucgccuaagaccuu

SEQ ID NO: 564599 - RNA, 19 nt, Homo sapiens
gauuguugguguguaauua

SEQ ID NO: 564600 - RNA, 19 nt, Homo sapiens
gagcugacauccauuccaa

SEQ ID NO: 564601 - RNA, 19 nt, Homo sapiens
gaagagcggcgucuacgaa

SEQ ID NO: 564602 - RNA, 19 nt, Homo sapiens
ucaaggauccucuuucuga

SEQ ID NO: 564603 - RNA, 19 nt, Homo sapiens
uggaagaagugaugaagaa

SEQ ID NO: 564604 - RNA, 19 nt, Homo sapiens
ccagaacccugcaccaaga

SEQ ID NO: 564605 - RNA, 19 nt, Homo sapiens
ggaggaaacuucacauagc

SEQ ID NO: 564606 - RNA, 19 nt, Homo sapiens
cagagaagcuagaccugaa

SEQ ID NO: 564607 - RNA, 19 nt, Homo sapiens
gcaccaagaugaccaugag

SEQ ID NO: 564608 - RNA, 19 nt, Homo sapiens
uaacacacguccauuugau

SEQ ID NO: 564609 - RNA, 19 nt, Homo sapiens
ccacacaguuuggaagaaa

SEQ ID NO: 564610 - RNA, 19 nt, Homo sapiens
gaugagaaccacagcauau

SEQ ID NO: 564611 - RNA, 19 nt, Homo sapiens
ucaaugaucucugcaagug

SEQ ID NO: 564612 - RNA, 19 nt, Homo sapiens
ccacaucaaugcagauauc

SEQ ID NO: 564613 - RNA, 19 nt, Homo sapiens
gaacugagggcacuagagu

SEQ ID NO: 564614 - RNA, 19 nt, Homo sapiens
cgagauggccgacuccuuu

SEQ ID NO: 564615 - RNA, 19 nt, Homo sapiens
ggaccagauugccaaauuc

SEQ ID NO: 564616 - RNA, 19 nt, Homo sapiens
gagaggauccgcacacuuc

SEQ ID NO: 564617 - RNA, 19 nt, Homo sapiens
gaaggacaaggaauacaaa

SEQ ID NO: 564618 - RNA, 19 nt, Homo sapiens
gcagagcuuuggcgagaug

SEQ ID NO: 564619 - RNA, 19 nt, Homo sapiens
aggaagacauugagaagaa

SEQ ID NO: 564620 - RNA, 19 nt, Homo sapiens
ccuuaaagauucccaaugu

SEQ ID NO: 564621 - RNA, 19 nt, Homo sapiens
caacuugucacccucauga

SEQ ID NO: 564622 - RNA, 19 nt, Homo sapiens
gcaaggaggagcugaguca

SEQ ID NO: 564623 - RNA, 19 nt, Homo sapiens
ggaggcaaccacacaguuu

SEQ ID NO: 564624 - RNA, 19 nt, Homo sapiens
agacaaggccaguguauau

SEQ ID NO: 564625 - RNA, 19 nt, Homo sapiens
gcuacaggcugaaccuaga

SEQ ID NO: 564626 - RNA, 19 nt, Homo sapiens
gggaaugggacaccaaauu

SEQ ID NO: 564627 - RNA, 19 nt, Homo sapiens
ccaagaccuuccucaagaa

SEQ ID NO: 564628 - RNA, 19 nt, Homo sapiens
ggagguuuccuaauaguga

SEQ ID NO: 564629 - RNA, 19 nt, Homo sapiens
gaugagcgccaguguauca

SEQ ID NO: 564630 - RNA, 19 nt, Homo sapiens
gaagcugacaccugaacua

SEQ ID NO: 564631 - RNA, 19 nt, Homo sapiens
gaaggugguuaugaagcua

SEQ ID NO: 564632 - RNA, 19 nt, Homo sapiens
cgaagaggcgguagcagua

SEQ ID NO: 564633 - RNA, 19 nt, Homo sapiens
gaggaggaaacuucacaua

SEQ ID NO: 564634 - RNA, 19 nt, Homo sapiens
cuuuaaagcugacuacuuc

SEQ ID NO: 564635 - RNA, 19 nt, Homo sapiens
uggaggagcucaugaugga

SEQ ID NO: 564636 - RNA, 19 nt, Homo sapiens
gaccaguccugagaaggua

SEQ ID NO: 564637 - RNA, 19 nt, Homo sapiens
gaggaucacuggaguuacu

SEQ ID NO: 564638 - RNA, 19 nt, Homo sapiens
ccacagaggaagacauuga

SEQ ID NO: 564639 - RNA, 19 nt, Homo sapiens
gaacuacuuggaccagauu

SEQ ID NO: 564640 - RNA, 19 nt, Homo sapiens
gggagacgcugacaaacca

SEQ ID NO: 564641 - RNA, 19 nt, Homo sapiens
gagguucucugcccaugug

SEQ ID NO: 564642 - RNA, 19 nt, Homo sapiens
uccaagaccuuccucaaga

SEQ ID NO: 564643 - RNA, 19 nt, Homo sapiens
ugccgaggcugucaacuuu

SEQ ID NO: 564644 - RNA, 19 nt, Homo sapiens
cagcagaacauuuggaaga

SEQ ID NO: 564645 - RNA, 19 nt, Homo sapiens
ggguucauguuguaauaaa

SEQ ID NO: 564646 - RNA, 19 nt, Homo sapiens
uaaaugugaugccgguguu

SEQ ID NO: 564647 - RNA, 19 nt, Homo sapiens
gacaguaaacggcaccuaa

SEQ ID NO: 564648 - RNA, 19 nt, Homo sapiens
gagucaacaucgccuaaga

SEQ ID NO: 564649 - RNA, 19 nt, Homo sapiens
ggaagacauugagaagaau

SEQ ID NO: 564650 - RNA, 19 nt, Homo sapiens
gagaauggagacaguguga

SEQ ID NO: 564651 - RNA, 19 nt, Homo sapiens
ugucaaggguguucuggaa

SEQ ID NO: 564652 - RNA, 19 nt, Homo sapiens
gagauggccgacuccuuua

SEQ ID NO: 564653 - RNA, 19 nt, Homo sapiens
ggaaggugguuaugaagcu

SEQ ID NO: 564654 - RNA, 19 nt, Homo sapiens
gcaaugaacuauuuucucu

SEQ ID NO: 564655 - RNA, 19 nt, Homo sapiens
aaacggagcgggacgaaga

SEQ ID NO: 564656 - RNA, 19 nt, Homo sapiens
gcaggagaguuugucauca

SEQ ID NO: 564657 - RNA, 19 nt, Homo sapiens
gagacaaggccaguguaua

SEQ ID NO: 564658 - RNA, 19 nt, Homo sapiens
ugagggcacuagagucuga

SEQ ID NO: 564659 - RNA, 19 nt, Homo sapiens
aggaagaugugacuguuga

SEQ ID NO: 564660 - RNA, 19 nt, Homo sapiens
ucauaugucugccggaugu

SEQ ID NO: 564661 - RNA, 19 nt, Homo sapiens
acaagacucugcggaagaa

SEQ ID NO: 564662 - RNA, 19 nt, Homo sapiens
gaauccagaggcugaauga

SEQ ID NO: 564663 - RNA, 19 nt, Homo sapiens
gaagcgcagccuugaagaa

SEQ ID NO: 564664 - RNA, 19 nt, Homo sapiens
gaagaggaggaguaugcua

SEQ ID NO: 564665 - RNA, 19 nt, Homo sapiens
ucuggaggcugguaaauag

SEQ ID NO: 564666 - RNA, 19 nt, Homo sapiens
gaagaauccagagcugaaa

SEQ ID NO: 564667 - RNA, 19 nt, Homo sapiens
ggaugagaaccacagcaua

SEQ ID NO: 564668 - RNA, 19 nt, Homo sapiens
ccguugcaaugaacuauuu

SEQ ID NO: 564669 - RNA, 19 nt, Homo sapiens
ugacuuggagggccuagua

SEQ ID NO: 564670 - RNA, 19 nt, Homo sapiens
ugucagcccuggccugcua

SEQ ID NO: 564671 - RNA, 19 nt, Homo sapiens
gagaguuugucaucaccuu

SEQ ID NO: 564672 - RNA, 19 nt, Homo sapiens
agaugugacuguugaguau

SEQ ID NO: 564673 - RNA, 19 nt, Homo sapiens
cuuaaagauucccaaugua

SEQ ID NO: 564674 - RNA, 19 nt, Homo sapiens
uggaccagauugccaaauu

SEQ ID NO: 564675 - RNA, 19 nt, Homo sapiens
gcucuggccucugaagaug

SEQ ID NO: 564676 - RNA, 19 nt, Homo sapiens
aaccaaggcuacaacuuug

SEQ ID NO: 564677 - RNA, 19 nt, Homo sapiens
gcuggcauauugaggauca

SEQ ID NO: 564678 - RNA, 19 nt, Homo sapiens
gaacccugcaccaagauga

SEQ ID NO: 564679 - RNA, 19 nt, Homo sapiens
guaacacacguccauuuga

SEQ ID NO: 564680 - RNA, 19 nt, Homo sapiens
ucacauagccgugcucaca

SEQ ID NO: 564681 - RNA, 19 nt, Homo sapiens
guacauaugugaacucauu

SEQ ID NO: 564682 - RNA, 19 nt, Homo sapiens
gaauggagaugacaagauu

SEQ ID NO: 564683 - RNA, 19 nt, Homo sapiens
gcagaaggcuugaauagau

SEQ ID NO: 564684 - RNA, 19 nt, Homo sapiens
gaucugaggucuaacauug

SEQ ID NO: 564685 - RNA, 19 nt, Homo sapiens
gaaaagccauggauuaaua

SEQ ID NO: 564686 - RNA, 19 nt, Homo sapiens
gaaacaaucugcuuacauc

SEQ ID NO: 564687 - RNA, 19 nt, Homo sapiens
gcaaugcccuugucuguga

SEQ ID NO: 564688 - RNA, 19 nt, Homo sapiens
caucaaagcucguaacuuc

SEQ ID NO: 564689 - RNA, 19 nt, Homo sapiens
ggaguugagucaccaauuu

SEQ ID NO: 564690 - RNA, 19 nt, Homo sapiens
gaacaaagacacaugaaga

SEQ ID NO: 564691 - RNA, 19 nt, Homo sapiens
agaaucaggugaagaaaua

SEQ ID NO: 564692 - RNA, 19 nt, Homo sapiens
ggacagcucuauuugaaga

SEQ ID NO: 564693 - RNA, 19 nt, Homo sapiens
gaggacagcucuauuugaa

SEQ ID NO: 564694 - RNA, 19 nt, Homo sapiens
gcgaugagcucagccuuua

SEQ ID NO: 564695 - RNA, 19 nt, Homo sapiens
guacaagggucgacagauu

SEQ ID NO: 564696 - RNA, 19 nt, Homo sapiens
gaaagaaguuagucaguag

SEQ ID NO: 564697 - RNA, 19 nt, Homo sapiens
gaacuggccucaaagaaca

SEQ ID NO: 564698 - RNA, 19 nt, Homo sapiens
gaagaggacacacaguuua

SEQ ID NO: 564699 - RNA, 19 nt, Homo sapiens
guucuugucuuccuuauuu

SEQ ID NO: 564700 - RNA, 19 nt, Homo sapiens
gcucguaacuuccucguuu

SEQ ID NO: 564701 - RNA, 19 nt, Homo sapiens
ccagucaucucuuuccuua

SEQ ID NO: 564702 - RNA, 19 nt, Homo sapiens
ggugugaacuguuaaggua

SEQ ID NO: 564703 - RNA, 19 nt, Homo sapiens
guuaaggugugaacuguua

SEQ ID NO: 564704 - RNA, 19 nt, Homo sapiens
gaacacaugugcuacaaag

SEQ ID NO: 564705 - RNA, 19 nt, Homo sapiens
gcaaaggccaguaggaaua

SEQ ID NO: 564706 - RNA, 19 nt, Homo sapiens
guacuuccguuuagacuuu

SEQ ID NO: 564707 - RNA, 19 nt, Homo sapiens
cagaagaagugaacguuaa

SEQ ID NO: 564708 - RNA, 19 nt, Homo sapiens
acaagaugguugccaauua

SEQ ID NO: 564709 - RNA, 19 nt, Homo sapiens
gccuguagcuucccuguua

SEQ ID NO: 564710 - RNA, 19 nt, Homo sapiens
gaaacaguaugcaugaaga

SEQ ID NO: 564711 - RNA, 19 nt, Homo sapiens
gaagaagccuccaaaucug

SEQ ID NO: 564712 - RNA, 19 nt, Homo sapiens
gagaaggacucagaauuga

SEQ ID NO: 564713 - RNA, 19 nt, Homo sapiens
ggaagaaaguagagacaga

SEQ ID NO: 564714 - RNA, 19 nt, Homo sapiens
gaagugaacguuaauuaga

SEQ ID NO: 564715 - RNA, 19 nt, Homo sapiens
gaggaaaccuguagcuuca

SEQ ID NO: 564716 - RNA, 19 nt, Homo sapiens
ggagaaggacucagaauug

SEQ ID NO: 564717 - RNA, 19 nt, Homo sapiens
gaugugaacuuaaccuguu

SEQ ID NO: 564718 - RNA, 19 nt, Homo sapiens
ggaagugaaugacaagaau

SEQ ID NO: 564719 - RNA, 19 nt, Homo sapiens
guaaaugcauggcuacaga

SEQ ID NO: 564720 - RNA, 19 nt, Homo sapiens
cagaucagaugugaacuua

SEQ ID NO: 564721 - RNA, 19 nt, Homo sapiens
ggagcucacuguuuaguug

SEQ ID NO: 564722 - RNA, 19 nt, Homo sapiens
gcaaagucauaggauauuu

SEQ ID NO: 564723 - RNA, 19 nt, Homo sapiens
gaucugugcauguuacuua

SEQ ID NO: 564724 - RNA, 19 nt, Homo sapiens
acaaggaacuggccucaaa

SEQ ID NO: 564725 - RNA, 19 nt, Homo sapiens
gaacagaaaccgugagaca

SEQ ID NO: 564726 - RNA, 19 nt, Homo sapiens
uagaagccaugaagcaaua

SEQ ID NO: 564727 - RNA, 19 nt, Homo sapiens
gaugugugcuaauuaugua

SEQ ID NO: 564728 - RNA, 19 nt, Homo sapiens
gaaggaggaccaagauaaa

SEQ ID NO: 564729 - RNA, 19 nt, Homo sapiens
ccaaugagcaguagcagua

SEQ ID NO: 564730 - RNA, 19 nt, Homo sapiens
uacaagaccugaagaauca

SEQ ID NO: 564731 - RNA, 19 nt, Homo sapiens
cagaaggcuugaauagaua

SEQ ID NO: 564732 - RNA, 19 nt, Homo sapiens
caauccaucuucuguaauu

SEQ ID NO: 564733 - RNA, 19 nt, Homo sapiens
caacaaagugguccaacua

SEQ ID NO: 564734 - RNA, 19 nt, Homo sapiens
agaaagaaguuagucagua

SEQ ID NO: 564735 - RNA, 19 nt, Homo sapiens
gaucagaugugaacuuaac

SEQ ID NO: 564736 - RNA, 19 nt, Homo sapiens
ggaagagggucguaaaugc

SEQ ID NO: 564737 - RNA, 19 nt, Homo sapiens
gaaguggaauugcaaaguc

SEQ ID NO: 564738 - RNA, 19 nt, Homo sapiens
ggaguauucuggccucuga

SEQ ID NO: 564739 - RNA, 19 nt, Homo sapiens
caacauugaugagaucuau

SEQ ID NO: 564740 - RNA, 19 nt, Homo sapiens
agaccaagcuugaacagaa

SEQ ID NO: 564741 - RNA, 19 nt, Homo sapiens
guagacaaguugaaagaga

SEQ ID NO: 564742 - RNA, 19 nt, Homo sapiens
gggccaagcuagugauuga

SEQ ID NO: 564743 - RNA, 19 nt, Homo sapiens
gaagagaucaagcaagaga

SEQ ID NO: 564744 - RNA, 19 nt, Homo sapiens
caagaagcguuuggaguuu

SEQ ID NO: 564745 - RNA, 19 nt, Homo sapiens
agaaugaaaucgccaagaa

SEQ ID NO: 564746 - RNA, 19 nt, Homo sapiens
gcagagauuugacguugga

SEQ ID NO: 564747 - RNA, 19 nt, Homo sapiens
agaaggagaucaaggagaa

SEQ ID NO: 564748 - RNA, 19 nt, Homo sapiens
gaaugaguacccaugaaua

SEQ ID NO: 564749 - RNA, 19 nt, Homo sapiens
gaacccaggucuuccaagu

SEQ ID NO: 564750 - RNA, 19 nt, Homo sapiens
gaacucauuggaaauauug

SEQ ID NO: 564751 - RNA, 19 nt, Homo sapiens
ucacagagaauuuccagua

SEQ ID NO: 564752 - RNA, 19 nt, Homo sapiens
ugaaagacuugaaggagaa

SEQ ID NO: 564753 - RNA, 19 nt, Homo sapiens
ggugauaccugaacugagu

SEQ ID NO: 564754 - RNA, 19 nt, Homo sapiens
gaaacugccuucauucacu

SEQ ID NO: 564755 - RNA, 19 nt, Homo sapiens
ggaggagauucguaagaaa

SEQ ID NO: 564756 - RNA, 19 nt, Homo sapiens
uugagaaacuggaggaaua

SEQ ID NO: 564757 - RNA, 19 nt, Homo sapiens
gaaagcugcagaaaccaua

SEQ ID NO: 564758 - RNA, 19 nt, Homo sapiens
gcaucagaaucguuuguaa

SEQ ID NO: 564759 - RNA, 19 nt, Homo sapiens
caauuuggcuggcaucuag

SEQ ID NO: 564760 - RNA, 19 nt, Homo sapiens
ugacaagaaucaugagaug

SEQ ID NO: 564761 - RNA, 19 nt, Homo sapiens
acaaggagaucgagaagga

SEQ ID NO: 564762 - RNA, 19 nt, Homo sapiens
ugaguacagugaggaauua

SEQ ID NO: 564763 - RNA, 19 nt, Homo sapiens
ucaaauggcaaauguauga

SEQ ID NO: 564764 - RNA, 19 nt, Homo sapiens
uaugugaacucauuggaaa

SEQ ID NO: 564765 - RNA, 19 nt, Homo sapiens
gcaaaguccugaccuucga

SEQ ID NO: 564766 - RNA, 19 nt, Homo sapiens
gaccauggcucagcuacaa

SEQ ID NO: 564767 - RNA, 19 nt, Homo sapiens
gaaaacagauuagguuaga

SEQ ID NO: 564768 - RNA, 19 nt, Homo sapiens
acacaaagaugagucaaau

SEQ ID NO: 564769 - RNA, 19 nt, Homo sapiens
gaagaguacuccacaacag

SEQ ID NO: 564770 - RNA, 19 nt, Homo sapiens
ggcaaaugcuggccuuuau

SEQ ID NO: 564771 - RNA, 19 nt, Homo sapiens
gcagucgacuugcaacuuc

SEQ ID NO: 564772 - RNA, 19 nt, Homo sapiens
gacauuaaguugccacugu

SEQ ID NO: 564773 - RNA, 19 nt, Homo sapiens
gguagaggaugagguguuu

SEQ ID NO: 564774 - RNA, 19 nt, Homo sapiens
gaaagcaguagacaaguug

SEQ ID NO: 564775 - RNA, 19 nt, Homo sapiens
gcaguaugcuuguggcaau

SEQ ID NO: 564776 - RNA, 19 nt, Homo sapiens
gagcugcuuuggaucauga

SEQ ID NO: 564777 - RNA, 19 nt, Homo sapiens
gcagaggucaugagacauu

SEQ ID NO: 564778 - RNA, 19 nt, Homo sapiens
gaaggcauccuguagucua

SEQ ID NO: 564779 - RNA, 19 nt, Homo sapiens
caaaggauguggagcucuu

SEQ ID NO: 564780 - RNA, 19 nt, Homo sapiens
cagaagggcuuauaaugag

SEQ ID NO: 564781 - RNA, 19 nt, Homo sapiens
gaacuucaaugccaaauau

SEQ ID NO: 564782 - RNA, 19 nt, Homo sapiens
ccacgagcuuucacaauaa

SEQ ID NO: 564783 - RNA, 19 nt, Homo sapiens
cccacgagcuuucacaaua

SEQ ID NO: 564784 - RNA, 19 nt, Homo sapiens
ggacgagaaugggaagauu

SEQ ID NO: 564785 - RNA, 19 nt, Homo sapiens
ggacauaucaccucauugg

SEQ ID NO: 564786 - RNA, 19 nt, Homo sapiens
agaacuaccagaugaaaua

SEQ ID NO: 564787 - RNA, 19 nt, Homo sapiens
ccaacacccucaacuuuca

SEQ ID NO: 564788 - RNA, 19 nt, Homo sapiens
gaagaggacccagaugaug

SEQ ID NO: 564789 - RNA, 19 nt, Homo sapiens
gaaauacuacuucuaccau

SEQ ID NO: 564790 - RNA, 19 nt, Homo sapiens
gaugaaauacuacuucuac

SEQ ID NO: 564791 - RNA, 19 nt, Homo sapiens
ccacagagagcacagaugu

SEQ ID NO: 564792 - RNA, 19 nt, Homo sapiens
cagaggaccuaaugaacau

SEQ ID NO: 564793 - RNA, 19 nt, Homo sapiens
gaacaagguggagagcaaa

SEQ ID NO: 564794 - RNA, 19 nt, Homo sapiens
ggaagaggacccagaugau

SEQ ID NO: 564795 - RNA, 19 nt, Homo sapiens
agaacaagguggagagcaa

SEQ ID NO: 564796 - RNA, 19 nt, Homo sapiens
ggacgccuaugccaugaag

SEQ ID NO: 564797 - RNA, 19 nt, Homo sapiens
cccgagaacuaccagauga

SEQ ID NO: 564798 - RNA, 19 nt, Homo sapiens
acuaccagaugaaauacua

SEQ ID NO: 564799 - RNA, 19 nt, Homo sapiens
gugaaguggagcccaaaua

SEQ ID NO: 564800 - RNA, 19 nt, Homo sapiens
ggagagcaaaggcaauuca

SEQ ID NO: 564801 - RNA, 19 nt, Homo sapiens
ccagaggaccuaaugaaca

SEQ ID NO: 564802 - RNA, 19 nt, Homo sapiens
gaggacgccuaugccauga

SEQ ID NO: 564803 - RNA, 19 nt, Homo sapiens
gagccaugauagagaacuu

SEQ ID NO: 564804 - RNA, 19 nt, Homo sapiens
cacgagcuuucacaauaaa

SEQ ID NO: 564805 - RNA, 19 nt, Homo sapiens
ggccagaggaccuaaugaa

SEQ ID NO: 564806 - RNA, 19 nt, Homo sapiens
aaguggagcccaaauacua

SEQ ID NO: 564807 - RNA, 19 nt, Homo sapiens
guuaugaacauccgcaaug

SEQ ID NO: 564808 - RNA, 19 nt, Homo sapiens
cagaugaaauacuacuucu

SEQ ID NO: 564809 - RNA, 19 nt, Homo sapiens
gagcuuucacaauaaauuc

SEQ ID NO: 564810 - RNA, 19 nt, Homo sapiens
gcccaaauacuaugcagau

SEQ ID NO: 564811 - RNA, 19 nt, Homo sapiens
uggaagaggacccagauga

SEQ ID NO: 564812 - RNA, 19 nt, Homo sapiens
ccagaugaaauacuacuuc

SEQ ID NO: 564813 - RNA, 19 nt, Homo sapiens
cgagaacuaccagaugaaa

SEQ ID NO: 564814 - RNA, 19 nt, Homo sapiens
caugauagagaacuucaau

SEQ ID NO: 564815 - RNA, 19 nt, Homo sapiens
gaaguggagcccaaauacu

SEQ ID NO: 564816 - RNA, 19 nt, Homo sapiens
gacgagaaugggaagauug

SEQ ID NO: 564817 - RNA, 19 nt, Homo sapiens
gagaacuaccagaugaaau

SEQ ID NO: 564818 - RNA, 19 nt, Homo sapiens
gaacuaccagaugaaauac

SEQ ID NO: 564819 - RNA, 19 nt, Homo sapiens
cgagcuuucacaauaaauu

SEQ ID NO: 564820 - RNA, 19 nt, Homo sapiens
acagagagcacagauguca

SEQ ID NO: 564821 - RNA, 19 nt, Homo sapiens
cugcaugucaggaagagua

SEQ ID NO: 564822 - RNA, 19 nt, Homo sapiens
accuggagcugaaagagaa

SEQ ID NO: 564823 - RNA, 19 nt, Homo sapiens
acccucaacuuucagauca

SEQ ID NO: 564824 - RNA, 19 nt, Homo sapiens
ugaaguggagcccaaauac

SEQ ID NO: 564825 - RNA, 19 nt, Homo sapiens
guggagagcaaaggcaauu

SEQ ID NO: 564826 - RNA, 19 nt, Homo sapiens
uuccaacacccucaacuuu

SEQ ID NO: 564827 - RNA, 19 nt, Homo sapiens
ugauagagaacuucaaugc

SEQ ID NO: 564828 - RNA, 19 nt, Homo sapiens
auggacauaucaccucauu

SEQ ID NO: 564829 - RNA, 19 nt, Homo sapiens
gaggccagaggaccuaaug

SEQ ID NO: 564830 - RNA, 19 nt, Homo sapiens
agaacuucaaugccaaaua

SEQ ID NO: 564831 - RNA, 19 nt, Homo sapiens
ugaaauacuacuucuacca

SEQ ID NO: 564832 - RNA, 19 nt, Homo sapiens
ucaacuuucagaucaguga

SEQ ID NO: 564833 - RNA, 19 nt, Homo sapiens
gguauguccuggccaaaau

SEQ ID NO: 564834 - RNA, 19 nt, Homo sapiens
ccagcucucuuacauugcu

SEQ ID NO: 564835 - RNA, 19 nt, Homo sapiens
aagaggacccagaugaugu

SEQ ID NO: 564836 - RNA, 19 nt, Homo sapiens
ccccagcucucuuacauug

SEQ ID NO: 564837 - RNA, 19 nt, Homo sapiens
ugggugccaucgagaacaa

SEQ ID NO: 564838 - RNA, 19 nt, Homo sapiens
aagcgggaccucacucaga

SEQ ID NO: 564839 - RNA, 19 nt, Homo sapiens
ugauaaagcuacucuugua

SEQ ID NO: 564840 - RNA, 19 nt, Homo sapiens
cagaugacuuugccuguua

SEQ ID NO: 564841 - RNA, 19 nt, Homo sapiens
cuaaauaccuacccuagau

SEQ ID NO: 564842 - RNA, 19 nt, Homo sapiens
ggucauggcuacccacgaa

SEQ ID NO: 564843 - RNA, 19 nt, Homo sapiens
ccauaggaauuauuucguu

SEQ ID NO: 564844 - RNA, 19 nt, Homo sapiens
ggagucauuuuauuccuua

SEQ ID NO: 564845 - RNA, 19 nt, Homo sapiens
ccucacuucuuaacauauu

SEQ ID NO: 564846 - RNA, 19 nt, Homo sapiens
uaccuacccuagaugauuu

SEQ ID NO: 564847 - RNA, 19 nt, Homo sapiens
gagaacacauuuugauaga

SEQ ID NO: 564848 - RNA, 19 nt, Homo sapiens
ccagaugacuuugccuguu

SEQ ID NO: 564849 - RNA, 19 nt, Homo sapiens
ggagauguggccacuguug

SEQ ID NO: 564850 - RNA, 19 nt, Homo sapiens
cuaaauccaugauaaagcu

SEQ ID NO: 564851 - RNA, 19 nt, Homo sapiens
ccucaugcauccacguuug

SEQ ID NO: 564852 - RNA, 19 nt, Homo sapiens
caugauaaagcuacucuug

SEQ ID NO: 564853 - RNA, 19 nt, Homo sapiens
uaaagcuacucuuguacuc

SEQ ID NO: 564854 - RNA, 19 nt, Homo sapiens
gcccuaaauccaugauaaa

SEQ ID NO: 564855 - RNA, 19 nt, Homo sapiens
gagauguggccacuguuga

SEQ ID NO: 564856 - RNA, 19 nt, Homo sapiens
gcuccagucuuuggucaug

SEQ ID NO: 564857 - RNA, 19 nt, Homo sapiens
aagcuacucuuguacucuu

SEQ ID NO: 564858 - RNA, 19 nt, Homo sapiens
ccuccgccuuuguuucaua

SEQ ID NO: 564859 - RNA, 19 nt, Homo sapiens
agcccuaaauccaugauaa

SEQ ID NO: 564860 - RNA, 19 nt, Homo sapiens
ugacuuugccuguuaccaa

SEQ ID NO: 564861 - RNA, 19 nt, Homo sapiens
uaucgaacaagcugaagaa

SEQ ID NO: 564862 - RNA, 19 nt, Homo sapiens
ucagucacguuaaccagau

SEQ ID NO: 564863 - RNA, 19 nt, Homo sapiens
ggacacggaagccaucaag

SEQ ID NO: 564864 - RNA, 19 nt, Homo sapiens
ggacagggagucugaucca

SEQ ID NO: 564865 - RNA, 19 nt, Homo sapiens
ccaccuccuucaccucguu

SEQ ID NO: 564866 - RNA, 19 nt, Homo sapiens
ggccaaauuucuccuucca

SEQ ID NO: 564867 - RNA, 19 nt, Homo sapiens
agacaucguucccgcuucu

SEQ ID NO: 564868 - RNA, 19 nt, Homo sapiens
gauaaagcuacucuuguac

SEQ ID NO: 564869 - RNA, 19 nt, Homo sapiens
uaacauauuccugugucuu

SEQ ID NO: 564870 - RNA, 19 nt, Homo sapiens
cgccuuuguuucauaguga

SEQ ID NO: 564871 - RNA, 19 nt, Homo sapiens
gaaucagaguagaggacau

SEQ ID NO: 564872 - RNA, 19 nt, Homo sapiens
aaauaccuacccuagauga

SEQ ID NO: 564873 - RNA, 19 nt, Homo sapiens
uaaauaccuacccuagaug

SEQ ID NO: 564874 - RNA, 19 nt, Homo sapiens
aacauauuccugugucuuu

SEQ ID NO: 564875 - RNA, 19 nt, Homo sapiens
acauauuccugugucuuug

SEQ ID NO: 564876 - RNA, 19 nt, Homo sapiens
acacggaagccaucaaguc

SEQ ID NO: 564877 - RNA, 19 nt, Homo sapiens
auauuccugugucuuugua

SEQ ID NO: 564878 - RNA, 19 nt, Homo sapiens
guaaccacagcccuaaauc

SEQ ID NO: 564879 - RNA, 19 nt, Homo sapiens
auaccuacccuagaugauu

SEQ ID NO: 564880 - RNA, 19 nt, Homo sapiens
cguucccgcuucugcguuu

SEQ ID NO: 564881 - RNA, 19 nt, Homo sapiens
gccgccauaggaauuauuu

SEQ ID NO: 564882 - RNA, 19 nt, Homo sapiens
ggaaacgacucucggauua

SEQ ID NO: 564883 - RNA, 19 nt, Homo sapiens
aaacgacucucggauuaua

SEQ ID NO: 564884 - RNA, 19 nt, Homo sapiens
gaacagcuacagagggauu

SEQ ID NO: 564885 - RNA, 19 nt, Homo sapiens
cagcugaucuccaaagucu

SEQ ID NO: 564886 - RNA, 19 nt, Homo sapiens
ggagaaggugcuacuagaa

SEQ ID NO: 564887 - RNA, 19 nt, Homo sapiens
ugaagugacugagacaaug

SEQ ID NO: 564888 - RNA, 19 nt, Homo sapiens
gggaaacgacucucggauu

SEQ ID NO: 564889 - RNA, 19 nt, Homo sapiens
agaaggugcuacuagaaga

SEQ ID NO: 564890 - RNA, 19 nt, Homo sapiens
gaaggugcuacuagaagaa

SEQ ID NO: 564891 - RNA, 19 nt, Homo sapiens
uggagaaggugcuacuaga

SEQ ID NO: 564892 - RNA, 19 nt, Homo sapiens
ugacugagacaauggagaa

SEQ ID NO: 564893 - RNA, 19 nt, Homo sapiens
gaaacgacucucggauuau

SEQ ID NO: 564894 - RNA, 19 nt, Homo sapiens
gcugaucuccaaagucuug

SEQ ID NO: 564895 - RNA, 19 nt, Homo sapiens
gagaaggugcuacuagaag

SEQ ID NO: 564896 - RNA, 19 nt, Homo sapiens
ucuggcagcugaucuccaa

SEQ ID NO: 564897 - RNA, 19 nt, Homo sapiens
gaagugacugagacaaugg

SEQ ID NO: 564898 - RNA, 19 nt, Homo sapiens
caacuccaagcucaaccua

SEQ ID NO: 564899 - RNA, 19 nt, Homo sapiens
acuccaagcucaaccuagu

SEQ ID NO: 564900 - RNA, 19 nt, Homo sapiens
gcagaugggaaacgacucu

SEQ ID NO: 564901 - RNA, 19 nt, Homo sapiens
ggcagcugaucuccaaagu

SEQ ID NO: 564902 - RNA, 19 nt, Homo sapiens
gcugugaucucgacaacuu

SEQ ID NO: 564903 - RNA, 19 nt, Homo sapiens
caccucggcuaccuacuua

SEQ ID NO: 564904 - RNA, 19 nt, Homo sapiens
agacugcccuuuccugaga

SEQ ID NO: 564905 - RNA, 19 nt, Homo sapiens
ggaagaaccugcugaaaac

SEQ ID NO: 564906 - RNA, 19 nt, Homo sapiens
gcgucucccuggccaguua

SEQ ID NO: 564907 - RNA, 19 nt, Homo sapiens
ugaaauggacucugagaug

SEQ ID NO: 564908 - RNA, 19 nt, Homo sapiens
ucagacauccuguguguga

SEQ ID NO: 564909 - RNA, 19 nt, Homo sapiens
ggugauagcuggccuuuuc

SEQ ID NO: 564910 - RNA, 19 nt, Homo sapiens
ccucggaaaucacgaaauc

SEQ ID NO: 564911 - RNA, 19 nt, Homo sapiens
gaucucgacaacuuacuuu

SEQ ID NO: 564912 - RNA, 19 nt, Homo sapiens
uuucaacacucacccaaga

SEQ ID NO: 564913 - RNA, 19 nt, Homo sapiens
cgacaguguuuccgugcaa

SEQ ID NO: 564914 - RNA, 19 nt, Homo sapiens
auugaaggcugcucucuga

SEQ ID NO: 564915 - RNA, 19 nt, Homo sapiens
gcaucugccucggaaauca

SEQ ID NO: 564916 - RNA, 19 nt, Homo sapiens
guguguuccugauguaauu

SEQ ID NO: 564917 - RNA, 19 nt, Homo sapiens
gggaagaaccugcugaaaa

SEQ ID NO: 564918 - RNA, 19 nt, Homo sapiens
ggauguguguguuccugau

SEQ ID NO: 564919 - RNA, 19 nt, Homo sapiens
ccaguuccacuuugcguuu

SEQ ID NO: 564920 - RNA, 19 nt, Homo sapiens
gcucacacugcccaucuuu

SEQ ID NO: 564921 - RNA, 19 nt, Homo sapiens
gaaaucacggggcuucuuu

SEQ ID NO: 564922 - RNA, 19 nt, Homo sapiens
guggaaaugacaccaagaa

SEQ ID NO: 564923 - RNA, 19 nt, Homo sapiens
ccugauguaauuugcauaa

SEQ ID NO: 564924 - RNA, 19 nt, Homo sapiens
acacaagacugcccuuucc

SEQ ID NO: 564925 - RNA, 19 nt, Homo sapiens
caacacucacccaagauuc

SEQ ID NO: 564926 - RNA, 19 nt, Homo sapiens
ucaacacucacccaagauu

SEQ ID NO: 564927 - RNA, 19 nt, Homo sapiens
ucugugacgugcuccaguu

SEQ ID NO: 564928 - RNA, 19 nt, Homo sapiens
ggaguggaaaugacaccaa

SEQ ID NO: 564929 - RNA, 19 nt, Homo sapiens
gugcuccaguuccacuuug

SEQ ID NO: 564930 - RNA, 19 nt, Homo sapiens
ccaccucggcuaccuacuu

SEQ ID NO: 564931 - RNA, 19 nt, Homo sapiens
ucgacaacuuacuuucaaa

SEQ ID NO: 564932 - RNA, 19 nt, Homo sapiens
gcaccaccucggcuaccua

SEQ ID NO: 564933 - RNA, 19 nt, Homo sapiens
cagcaucugccucggaaau

SEQ ID NO: 564934 - RNA, 19 nt, Homo sapiens
ggccaugccguucaacuca

SEQ ID NO: 564935 - RNA, 19 nt, Homo sapiens
cucgacaacuuacuuucaa

SEQ ID NO: 564936 - RNA, 19 nt, Homo sapiens
uugcauaacuuuucuguag

SEQ ID NO: 564937 - RNA, 19 nt, Homo sapiens
uguguguguuccugaugua

SEQ ID NO: 564938 - RNA, 19 nt, Homo sapiens
gcacccacaggcacuaugg

SEQ ID NO: 564939 - RNA, 19 nt, Homo sapiens
ggcuguuccucucucuuga

SEQ ID NO: 564940 - RNA, 19 nt, Homo sapiens
gggcaaggucgcagcaucu

SEQ ID NO: 564941 - RNA, 19 nt, Homo sapiens
ucucuugccugggcuuugu

SEQ ID NO: 564942 - RNA, 19 nt, Homo sapiens
gcaaggggaguggaaauga

SEQ ID NO: 564943 - RNA, 19 nt, Homo sapiens
gaauuuccgucaucaacuu

SEQ ID NO: 564944 - RNA, 19 nt, Homo sapiens
ggagcgaggucccacuuug

SEQ ID NO: 564945 - RNA, 19 nt, Homo sapiens
cgaccacggugucuucaaa

SEQ ID NO: 564946 - RNA, 19 nt, Homo sapiens
cuggaaagcugaagacugu

SEQ ID NO: 564947 - RNA, 19 nt, Homo sapiens
gcgcgaaagggcagaguuu

SEQ ID NO: 564948 - RNA, 19 nt, Homo sapiens
ggaaaccgcagccucucaa

SEQ ID NO: 564949 - RNA, 19 nt, Homo sapiens
caacuuucuugaccagcuu

SEQ ID NO: 564950 - RNA, 19 nt, Homo sapiens
aaauaaaacugcgcuacua

SEQ ID NO: 564951 - RNA, 19 nt, Homo sapiens
gcuccgaauuuccgucauc

SEQ ID NO: 564952 - RNA, 19 nt, Homo sapiens
uaaaacugcgcuacuaaaa

SEQ ID NO: 564953 - RNA, 19 nt, Homo sapiens
cacuuugcgucuccuugua

SEQ ID NO: 564954 - RNA, 19 nt, Homo sapiens
ccacuuugcgucuccuugu

SEQ ID NO: 564955 - RNA, 19 nt, Homo sapiens
gcucuggaaucgaguuacg

SEQ ID NO: 564956 - RNA, 19 nt, Homo sapiens
aaagggugguugggaagga

SEQ ID NO: 564957 - RNA, 19 nt, Homo sapiens
gcgcucuggaaucgaguua

SEQ ID NO: 564958 - RNA, 19 nt, Homo sapiens
ucccacaguugcuacuuuc

SEQ ID NO: 564959 - RNA, 19 nt, Homo sapiens
gaagagccaugguguuaau

SEQ ID NO: 564960 - RNA, 19 nt, Homo sapiens
ggacagcccugccaucaag

SEQ ID NO: 564961 - RNA, 19 nt, Homo sapiens
ccaaaguucucaugcacua

SEQ ID NO: 564962 - RNA, 19 nt, Homo sapiens
gcuccugccucuuaucuuu

SEQ ID NO: 564963 - RNA, 19 nt, Homo sapiens
gcucugugauggaguuuga

SEQ ID NO: 564964 - RNA, 19 nt, Homo sapiens
gaacgugagugcuauaacc

SEQ ID NO: 564965 - RNA, 19 nt, Homo sapiens
ggagagacuucugcaucaa

SEQ ID NO: 564966 - RNA, 19 nt, Homo sapiens
gcacaggucccuuaagcau

SEQ ID NO: 564967 - RNA, 19 nt, Homo sapiens
acacagaggugcugaccau

SEQ ID NO: 564968 - RNA, 19 nt, Homo sapiens
gcucugggccucaucauca

SEQ ID NO: 564969 - RNA, 19 nt, Homo sapiens
ggaagagccaugguguuaa

SEQ ID NO: 564970 - RNA, 19 nt, Homo sapiens
caaaguggaacucgagguu

SEQ ID NO: 564971 - RNA, 19 nt, Homo sapiens
cggagagacuucugcauca

SEQ ID NO: 564972 - RNA, 19 nt, Homo sapiens
ucaagaacgugagugcuau

SEQ ID NO: 564973 - RNA, 19 nt, Homo sapiens
ucaccucccuggacacaga

SEQ ID NO: 564974 - RNA, 19 nt, Homo sapiens
cagaggugcugaccaucaa

SEQ ID NO: 564975 - RNA, 19 nt, Homo sapiens
aggaagagccaugguguua

SEQ ID NO: 564976 - RNA, 19 nt, Homo sapiens
ccucuuaucuuugucaaca

SEQ ID NO: 564977 - RNA, 19 nt, Homo sapiens
uaccugcuccugccucuua

SEQ ID NO: 564978 - RNA, 19 nt, Homo sapiens
ccaccaaaguucucaugca

SEQ ID NO: 564979 - RNA, 19 nt, Homo sapiens
caagaacgugagugcuaua

SEQ ID NO: 564980 - RNA, 19 nt, Homo sapiens
cuuguacgcuuuccucaug

SEQ ID NO: 564981 - RNA, 19 nt, Homo sapiens
gcccugccaucaaggaaga

SEQ ID NO: 564982 - RNA, 19 nt, Homo sapiens
ggacccugcuguucauugc

SEQ ID NO: 564983 - RNA, 19 nt, Homo sapiens
ggacagugagggcaucauc

SEQ ID NO: 564984 - RNA, 19 nt, Homo sapiens
gaugcuggccuuggucauu

SEQ ID NO: 564985 - RNA, 19 nt, Homo sapiens
ggccgcuacuugagcauug

SEQ ID NO: 564986 - RNA, 19 nt, Homo sapiens
gagccaugguguuaaugca

SEQ ID NO: 564987 - RNA, 19 nt, Homo sapiens
gcccaggaauggcguaagg

SEQ ID NO: 564988 - RNA, 19 nt, Homo sapiens
ugugauggaguuugaguuu

SEQ ID NO: 564989 - RNA, 19 nt, Homo sapiens
gcacuaugcacucagaaaa

SEQ ID NO: 564990 - RNA, 19 nt, Homo sapiens
ggucauuggccacuucauc

SEQ ID NO: 564991 - RNA, 19 nt, Homo sapiens
ggcggacggucagcauuga

SEQ ID NO: 564992 - RNA, 19 nt, Homo sapiens
aaaguucucaugcacuaug

SEQ ID NO: 564993 - RNA, 19 nt, Homo sapiens
uggcacaggucccuuaagc

SEQ ID NO: 564994 - RNA, 19 nt, Homo sapiens
cuccaugacuuuccucucu

SEQ ID NO: 564995 - RNA, 19 nt, Homo sapiens
gaacccuucucaggacaac

SEQ ID NO: 564996 - RNA, 19 nt, Homo sapiens
gugauggaguuugaguuuc

SEQ ID NO: 564997 - RNA, 19 nt, Homo sapiens
gagauggcucugugaugga

SEQ ID NO: 564998 - RNA, 19 nt, Homo sapiens
gagagacuucugcaucaag

SEQ ID NO: 564999 - RNA, 19 nt, Homo sapiens
gaggugcugaccaucaaga

SEQ ID NO: 565000 - RNA, 19 nt, Homo sapiens
gcgcugcccagaaaauaua

SEQ ID NO: 565001 - RNA, 19 nt, Homo sapiens
ccacacuccaccaaaguuc

SEQ ID NO: 565002 - RNA, 19 nt, Homo sapiens
gacggucagcauugaggua

SEQ ID NO: 565003 - RNA, 19 nt, Homo sapiens
uccaugacuuuccucucua

SEQ ID NO: 565004 - RNA, 19 nt, Homo sapiens
ccaucguacugguggguau

SEQ ID NO: 565005 - RNA, 19 nt, Homo sapiens
ucauuggccacuucaucua

SEQ ID NO: 565006 - RNA, 19 nt, Homo sapiens
ccgagaugcuggccuuggu

SEQ ID NO: 565007 - RNA, 19 nt, Homo sapiens
acagaggugcugaccauca

SEQ ID NO: 565008 - RNA, 19 nt, Homo sapiens
caagauagcuacucggaaa

SEQ ID NO: 565009 - RNA, 19 nt, Homo sapiens
gcaaguaccgcucuaauuu

SEQ ID NO: 565010 - RNA, 19 nt, Homo sapiens
ggaauucccuucgcuguuu

SEQ ID NO: 565011 - RNA, 19 nt, Homo sapiens
gcagaaaguuggcaugcaa

SEQ ID NO: 565012 - RNA, 19 nt, Homo sapiens
ggaauuagugccagacaua

SEQ ID NO: 565013 - RNA, 19 nt, Homo sapiens
gagagcaacaucaacauua

SEQ ID NO: 565014 - RNA, 19 nt, Homo sapiens
gcuaacuacuuacccuuua

SEQ ID NO: 565015 - RNA, 19 nt, Homo sapiens
gcuaacaccuucauucauc

SEQ ID NO: 565016 - RNA, 19 nt, Homo sapiens
gagcuggaauuacugugua

SEQ ID NO: 565017 - RNA, 19 nt, Homo sapiens
gcagucagauccagagaau

SEQ ID NO: 565018 - RNA, 19 nt, Homo sapiens
cagaugccauuaucaaauu

SEQ ID NO: 565019 - RNA, 19 nt, Homo sapiens
guucggaaauucaagcuaa

SEQ ID NO: 565020 - RNA, 19 nt, Homo sapiens
gaucaugucugugcuguuc

SEQ ID NO: 565021 - RNA, 19 nt, Homo sapiens
cagaguuggugacaagaua

SEQ ID NO: 565022 - RNA, 19 nt, Homo sapiens
gcaguguaauuuccuauca

SEQ ID NO: 565023 - RNA, 19 nt, Homo sapiens
ggauauguauggaauuagu

SEQ ID NO: 565024 - RNA, 19 nt, Homo sapiens
gaagccaguugcugugaga

SEQ ID NO: 565025 - RNA, 19 nt, Homo sapiens
cugaugagcuuucgaaaca

SEQ ID NO: 565026 - RNA, 19 nt, Homo sapiens
ugaaaugcauguugcugaa

SEQ ID NO: 565027 - RNA, 19 nt, Homo sapiens
aggaauugcuggauaugua

SEQ ID NO: 565028 - RNA, 19 nt, Homo sapiens
gcagaugccauuaucaaau

SEQ ID NO: 565029 - RNA, 19 nt, Homo sapiens
gagcagaugccauuaucaa

SEQ ID NO: 565030 - RNA, 19 nt, Homo sapiens
agaaagagcagaugccauu

SEQ ID NO: 565031 - RNA, 19 nt, Homo sapiens
ggacaaggacugggaguug

SEQ ID NO: 565032 - RNA, 19 nt, Homo sapiens
gcuguuagccuuggucuuu

SEQ ID NO: 565033 - RNA, 19 nt, Homo sapiens
gaaagagcagaugccauua

SEQ ID NO: 565034 - RNA, 19 nt, Homo sapiens
cuggauauguauggaauua

SEQ ID NO: 565035 - RNA, 19 nt, Homo sapiens
caaagccaaugccgagaga

SEQ ID NO: 565036 - RNA, 19 nt, Homo sapiens
gauaagugguagagguaau

SEQ ID NO: 565037 - RNA, 19 nt, Homo sapiens
gcauguugcugaacuaaaa

SEQ ID NO: 565038 - RNA, 19 nt, Homo sapiens
ggagcaguguaauuuccua

SEQ ID NO: 565039 - RNA, 19 nt, Homo sapiens
cagcagcgaaagcuuguua

SEQ ID NO: 565040 - RNA, 19 nt, Homo sapiens
aaacaaccaccugauagua

SEQ ID NO: 565041 - RNA, 19 nt, Homo sapiens
uuacagaguuggugacaag

SEQ ID NO: 565042 - RNA, 19 nt, Homo sapiens
gccgagcacugcauaaaca

SEQ ID NO: 565043 - RNA, 19 nt, Homo sapiens
uuuaaacugucacugcaua

SEQ ID NO: 565044 - RNA, 19 nt, Homo sapiens
cuaacuacuuacccuuuaa

SEQ ID NO: 565045 - RNA, 19 nt, Homo sapiens
uuaaaucucuacugucaca

SEQ ID NO: 565046 - RNA, 19 nt, Homo sapiens
gugccgaggucgugugcua

SEQ ID NO: 565047 - RNA, 19 nt, Homo sapiens
gaaaauguggauugaagua

SEQ ID NO: 565048 - RNA, 19 nt, Homo sapiens
cuacuuacccuuuaaacug

SEQ ID NO: 565049 - RNA, 19 nt, Homo sapiens
guuauuggagcuggaauua

SEQ ID NO: 565050 - RNA, 19 nt, Homo sapiens
ccacaagaacgcuuugaga

SEQ ID NO: 565051 - RNA, 19 nt, Homo sapiens
cuucugagaucaugucugu

SEQ ID NO: 565052 - RNA, 19 nt, Homo sapiens
agagcaacaucaacauuau

SEQ ID NO: 565053 - RNA, 19 nt, Homo sapiens
gaugagcuuucgaaacaag

SEQ ID NO: 565054 - RNA, 19 nt, Homo sapiens
gagcaacaucaacauuauu

SEQ ID NO: 565055 - RNA, 19 nt, Homo sapiens
ugaccucuccaccugauua

SEQ ID NO: 565056 - RNA, 19 nt, Homo sapiens
ugucugugcuguucuucua

SEQ ID NO: 565057 - RNA, 19 nt, Homo sapiens
aaucucuacugucacauuu

SEQ ID NO: 565058 - RNA, 19 nt, Homo sapiens
ggaauugcuggauauguau

SEQ ID NO: 565059 - RNA, 19 nt, Homo sapiens
gacaaggucacaguuauug

SEQ ID NO: 565060 - RNA, 19 nt, Homo sapiens
gggacacaguggugcauug

SEQ ID NO: 565061 - RNA, 19 nt, Homo sapiens
ccagaaacuaugguuauuu

SEQ ID NO: 565062 - RNA, 19 nt, Homo sapiens
ggaguugcauguggaaugg

SEQ ID NO: 565063 - RNA, 19 nt, Homo sapiens
gugcuguucuucuacauca

SEQ ID NO: 565064 - RNA, 19 nt, Homo sapiens
gaauucccuucgcuguuug

SEQ ID NO: 565065 - RNA, 19 nt, Homo sapiens
ugaaguauagauuccagua

SEQ ID NO: 565066 - RNA, 19 nt, Homo sapiens
gaauaacugguagagguaa

SEQ ID NO: 565067 - RNA, 19 nt, Homo sapiens
ugguagagguaaucaauuc

SEQ ID NO: 565068 - RNA, 19 nt, Homo sapiens
uagcaguucuucugagauc

SEQ ID NO: 565069 - RNA, 19 nt, Homo sapiens
ccgaggaauugcuggauau

SEQ ID NO: 565070 - RNA, 19 nt, Homo sapiens
gaugaccucuccaccugau

SEQ ID NO: 565071 - RNA, 19 nt, Homo sapiens
guggcaaucuuugauguga

SEQ ID NO: 565072 - RNA, 19 nt, Homo sapiens
guguuuccuucgugaauaa

SEQ ID NO: 565073 - RNA, 19 nt, Homo sapiens
ggaauuacuguguaugaag

SEQ ID NO: 565074 - RNA, 19 nt, Homo sapiens
caauggccuuugcuuccua

SEQ ID NO: 565075 - RNA, 19 nt, Homo sapiens
ugugagaaaugaccagugu

SEQ ID NO: 565076 - RNA, 19 nt, Homo sapiens
ugaauaacugguagaggua

SEQ ID NO: 565077 - RNA, 19 nt, Homo sapiens
uaucauaguggccgugaaa

SEQ ID NO: 565078 - RNA, 19 nt, Homo sapiens
cuccauggauccugacauu

SEQ ID NO: 565079 - RNA, 19 nt, Homo sapiens
ccauuaaaccucuggaugu

SEQ ID NO: 565080 - RNA, 19 nt, Homo sapiens
ggacagcuggagcagugua

SEQ ID NO: 565081 - RNA, 19 nt, Homo sapiens
ccaagugcacgaucuucua

SEQ ID NO: 565082 - RNA, 19 nt, Homo sapiens
cgauggugcuucccagaug

SEQ ID NO: 565083 - RNA, 19 nt, Homo sapiens
uagauaagugguagaggua

SEQ ID NO: 565084 - RNA, 19 nt, Homo sapiens
gacaccagguacucuacuu

SEQ ID NO: 565085 - RNA, 19 nt, Homo sapiens
cagagaauccggacaacga

SEQ ID NO: 565086 - RNA, 19 nt, Homo sapiens
gcauguggaauggcauaua

SEQ ID NO: 565087 - RNA, 19 nt, Homo sapiens
acacuguacuguucaaguc

SEQ ID NO: 565088 - RNA, 19 nt, Homo sapiens
agcgaaagcuuguuaggau

SEQ ID NO: 565089 - RNA, 19 nt, Homo sapiens
cagcuaacaccuucauuca

SEQ ID NO: 565090 - RNA, 19 nt, Homo sapiens
ccauggauccugacauuca

SEQ ID NO: 565091 - RNA, 19 nt, Homo sapiens
ggccuuugcuuccuacuac

SEQ ID NO: 565092 - RNA, 19 nt, Homo sapiens
gaauuagugccagacauau

SEQ ID NO: 565093 - RNA, 19 nt, Homo sapiens
uauuggagcuggaauuacu

SEQ ID NO: 565094 - RNA, 19 nt, Homo sapiens
gcugagagcaacaucaaca

SEQ ID NO: 565095 - RNA, 19 nt, Homo sapiens
aagagcagaugccauuauc

SEQ ID NO: 565096 - RNA, 19 nt, Homo sapiens
cauguggaauggcauauac

SEQ ID NO: 565097 - RNA, 19 nt, Homo sapiens
ccuccacacuguacuguuc

SEQ ID NO: 565098 - RNA, 19 nt, Homo sapiens
guaaagaaaauguggauug

SEQ ID NO: 565099 - RNA, 19 nt, Homo sapiens
uagagguaaucaauucuuc

SEQ ID NO: 565100 - RNA, 19 nt, Homo sapiens
caaggucacaguuauugga

SEQ ID NO: 565101 - RNA, 19 nt, Homo sapiens
agauggcccuggaggauau

SEQ ID NO: 565102 - RNA, 19 nt, Homo sapiens
cuacugcuguucccaccuu

SEQ ID NO: 565103 - RNA, 19 nt, Homo sapiens
gaaauucaagcuaacuacu

SEQ ID NO: 565104 - RNA, 19 nt, Homo sapiens
ggaaauucaagcuaacuac

SEQ ID NO: 565105 - RNA, 19 nt, Homo sapiens
uacuguguaugaagccuua

SEQ ID NO: 565106 - RNA, 19 nt, Homo sapiens
caacaucaacauuauuggu

SEQ ID NO: 565107 - RNA, 19 nt, Homo sapiens
gguacucuacuuucucuga

SEQ ID NO: 565108 - RNA, 19 nt, Homo sapiens
gaacauggcuccaggaaag

SEQ ID NO: 565109 - RNA, 19 nt, Homo sapiens
gcaguacuguuuaauauga

SEQ ID NO: 565110 - RNA, 19 nt, Homo sapiens
caacauuccugcuagcaua

SEQ ID NO: 565111 - RNA, 19 nt, Homo sapiens
caacaugccuguacauaug

SEQ ID NO: 565112 - RNA, 19 nt, Homo sapiens
gcagagcgcugggaagaaa

SEQ ID NO: 565113 - RNA, 19 nt, Homo sapiens
gcacauuccuggagagaga

SEQ ID NO: 565114 - RNA, 19 nt, Homo sapiens
caguagaaguugacaauuu

SEQ ID NO: 565115 - RNA, 19 nt, Homo sapiens
caaaauagcuuacaacaca

SEQ ID NO: 565116 - RNA, 19 nt, Homo sapiens
ggacagaauucgcacacuu

SEQ ID NO: 565117 - RNA, 19 nt, Homo sapiens
acaaggagauguucauuau

SEQ ID NO: 565118 - RNA, 19 nt, Homo sapiens
gcagacaucucaggcauga

SEQ ID NO: 565119 - RNA, 19 nt, Homo sapiens
gaacgugucaucaacauug

SEQ ID NO: 565120 - RNA, 19 nt, Homo sapiens
gagcugauauucauuccaa

SEQ ID NO: 565121 - RNA, 19 nt, Homo sapiens
guagaaacguugagaaucu

SEQ ID NO: 565122 - RNA, 19 nt, Homo sapiens
gcaacaauauuucuaaggu

SEQ ID NO: 565123 - RNA, 19 nt, Homo sapiens
gcucagggauuaugucuca

SEQ ID NO: 565124 - RNA, 19 nt, Homo sapiens
gguuaugggugccaagaua

SEQ ID NO: 565125 - RNA, 19 nt, Homo sapiens
ucaaagaagcucugacuaa

SEQ ID NO: 565126 - RNA, 19 nt, Homo sapiens
ucacagcagugcccaguuu

SEQ ID NO: 565127 - RNA, 19 nt, Homo sapiens
caaagaagcucugacuaag

SEQ ID NO: 565128 - RNA, 19 nt, Homo sapiens
uaagggcacuggagucuga

SEQ ID NO: 565129 - RNA, 19 nt, Homo sapiens
ggagaaagcagaccgugaa

SEQ ID NO: 565130 - RNA, 19 nt, Homo sapiens
ggaugaagauaauaagcuu

SEQ ID NO: 565131 - RNA, 19 nt, Homo sapiens
aacaggagcuucagucaaa

SEQ ID NO: 565132 - RNA, 19 nt, Homo sapiens
cauccaggcucucaaagaa

SEQ ID NO: 565133 - RNA, 19 nt, Homo sapiens
caccugagcuguuugauag

SEQ ID NO: 565134 - RNA, 19 nt, Homo sapiens
ccacaucuucugcuuguua

SEQ ID NO: 565135 - RNA, 19 nt, Homo sapiens
ccaaccaugugcaauguaa

SEQ ID NO: 565136 - RNA, 19 nt, Homo sapiens
ucucacagguuuggaaaua

SEQ ID NO: 565137 - RNA, 19 nt, Homo sapiens
caaacuagagugaaauuga

SEQ ID NO: 565138 - RNA, 19 nt, Homo sapiens
acaaacaaaucuugaggaa

SEQ ID NO: 565139 - RNA, 19 nt, Homo sapiens
gaaggcaguggcaacaaua

SEQ ID NO: 565140 - RNA, 19 nt, Homo sapiens
auucaaggcuccucuuuaa

SEQ ID NO: 565141 - RNA, 19 nt, Homo sapiens
cggaaggucucacagguuu

SEQ ID NO: 565142 - RNA, 19 nt, Homo sapiens
gcugacaccugagcuguuu

SEQ ID NO: 565143 - RNA, 19 nt, Homo sapiens
cuagagcccugcacuaaga

SEQ ID NO: 565144 - RNA, 19 nt, Homo sapiens
gcuaaagaaguuacagaua

SEQ ID NO: 565145 - RNA, 19 nt, Homo sapiens
ugaggaagguggcuaugaa

SEQ ID NO: 565146 - RNA, 19 nt, Homo sapiens
gaacuggaggcccaaacua

SEQ ID NO: 565147 - RNA, 19 nt, Homo sapiens
ccaccacccucuuucugua

SEQ ID NO: 565148 - RNA, 19 nt, Homo sapiens
gaccacagcccuuucuuga

SEQ ID NO: 565149 - RNA, 19 nt, Homo sapiens
gggcugagcugcaagaacu

SEQ ID NO: 565150 - RNA, 19 nt, Homo sapiens
gacguuggaucucaaucua

SEQ ID NO: 565151 - RNA, 19 nt, Homo sapiens
gaagguggaucaggguaga

SEQ ID NO: 565152 - RNA, 19 nt, Homo sapiens
ggaucucaaucuagcagua

SEQ ID NO: 565153 - RNA, 19 nt, Homo sapiens
gggaguuugucaucacuuu

SEQ ID NO: 565154 - RNA, 19 nt, Homo sapiens
ucaaugaccucugcaagug

SEQ ID NO: 565155 - RNA, 19 nt, Homo sapiens
gaacgccagugcaucaagu

SEQ ID NO: 565156 - RNA, 19 nt, Homo sapiens
ggcaguggcuuuccuguca

SEQ ID NO: 565157 - RNA, 19 nt, Homo sapiens
ucgcaguacuguuuaauau

SEQ ID NO: 565158 - RNA, 19 nt, Homo sapiens
gauaagacugugcauaaga

SEQ ID NO: 565159 - RNA, 19 nt, Homo sapiens
gaugguggcuguaaaacua

SEQ ID NO: 565160 - RNA, 19 nt, Homo sapiens
gagaagaagaacauuauca

SEQ ID NO: 565161 - RNA, 19 nt, Homo sapiens
gcaagaccgugccagaaag

SEQ ID NO: 565162 - RNA, 19 nt, Homo sapiens
caagaacuacugaccauug

SEQ ID NO: 565163 - RNA, 19 nt, Homo sapiens
caauguacguuguaauuac

SEQ ID NO: 565164 - RNA, 19 nt, Homo sapiens
ccaagugcguaccuuuauu

SEQ ID NO: 565165 - RNA, 19 nt, Homo sapiens
gaauagggacaaacaaauc

SEQ ID NO: 565166 - RNA, 19 nt, Homo sapiens
uccaagaccuuucucaaga

SEQ ID NO: 565167 - RNA, 19 nt, Homo sapiens
ggagguuuccuaauaguga

SEQ ID NO: 565168 - RNA, 19 nt, Homo sapiens
gaguacaguuugcagaguu

SEQ ID NO: 565169 - RNA, 19 nt, Homo sapiens
caagugcguaccuuuauuu

SEQ ID NO: 565170 - RNA, 19 nt, Homo sapiens
ucacaucaaugcagacauc

SEQ ID NO: 565171 - RNA, 19 nt, Homo sapiens
gcagugcccaguuuauuga

SEQ ID NO: 565172 - RNA, 19 nt, Homo sapiens
ugagaagcauccagagcua

SEQ ID NO: 565173 - RNA, 19 nt, Homo sapiens
uagcugggcugaauuccaa

SEQ ID NO: 565174 - RNA, 19 nt, Homo sapiens
ggagugauuuccuaaacca

SEQ ID NO: 565175 - RNA, 19 nt, Homo sapiens
uggaggagcucaugaugga

SEQ ID NO: 565176 - RNA, 19 nt, Homo sapiens
gaacuccggguccuucuug

SEQ ID NO: 565177 - RNA, 19 nt, Homo sapiens
ucaugaaucccaacacuuu

SEQ ID NO: 565178 - RNA, 19 nt, Homo sapiens
gaggaucacuggaguuacu

SEQ ID NO: 565179 - RNA, 19 nt, Homo sapiens
gcuugggccuuauggcuaa

SEQ ID NO: 565180 - RNA, 19 nt, Homo sapiens
cuacagaggaggacauuga

SEQ ID NO: 565181 - RNA, 19 nt, Homo sapiens
ggcccaaacuagagugaaa

SEQ ID NO: 565182 - RNA, 19 nt, Homo sapiens
ggauaagacugugcauaag

SEQ ID NO: 565183 - RNA, 19 nt, Homo sapiens
uaccuguggucuaucuuua

SEQ ID NO: 565184 - RNA, 19 nt, Homo sapiens
gagaauggagacaguguga

SEQ ID NO: 565185 - RNA, 19 nt, Homo sapiens
ucaagaugguggcuguaaa

SEQ ID NO: 565186 - RNA, 19 nt, Homo sapiens
ugcugaagcugucaacuuu

SEQ ID NO: 565187 - RNA, 19 nt, Homo sapiens
gaggaagacgugacaguug

SEQ ID NO: 565188 - RNA, 19 nt, Homo sapiens
ucacauuacgaacgcauua

SEQ ID NO: 565189 - RNA, 19 nt, Homo sapiens
gacccaggcucugugauug

SEQ ID NO: 565190 - RNA, 19 nt, Homo sapiens
uaacauccaggcucucaaa

SEQ ID NO: 565191 - RNA, 19 nt, Homo sapiens
gguggaggauggccguaaa

SEQ ID NO: 565192 - RNA, 19 nt, Homo sapiens
auaagacugugcauaagaa

SEQ ID NO: 565193 - RNA, 19 nt, Homo sapiens
cuuuaaagauucccaaugu

SEQ ID NO: 565194 - RNA, 19 nt, Homo sapiens
ggcaguggcaacaauauuu

SEQ ID NO: 565195 - RNA, 19 nt, Homo sapiens
ggagcgacgucuacgaaag

SEQ ID NO: 565196 - RNA, 19 nt, Homo sapiens
ggaagaucuuggaccucua

SEQ ID NO: 565197 - RNA, 19 nt, Homo sapiens
gcccaagugcguaccuuua

SEQ ID NO: 565198 - RNA, 19 nt, Homo sapiens
gaggagcgacgucuacgaa

SEQ ID NO: 565199 - RNA, 19 nt, Homo sapiens
aaggagauguucauuaugg

SEQ ID NO: 565200 - RNA, 19 nt, Homo sapiens
cacaaggagauguucauua

SEQ ID NO: 565201 - RNA, 19 nt, Homo sapiens
gcacaaggagauguucauu

SEQ ID NO: 565202 - RNA, 19 nt, Homo sapiens
acgaggagcucaucugcaa

SEQ ID NO: 565203 - RNA, 19 nt, Homo sapiens
uggaggaggugaugaagau

SEQ ID NO: 565204 - RNA, 19 nt, Homo sapiens
gaagaccugguauggugua

SEQ ID NO: 565205 - RNA, 19 nt, Homo sapiens
gcacuaagacaaccaugca

SEQ ID NO: 565206 - RNA, 19 nt, Homo sapiens
gaacuauuuggaucagauu

SEQ ID NO: 565207 - RNA, 19 nt, Homo sapiens
ugucagcccuggccugcua

SEQ ID NO: 565208 - RNA, 19 nt, Homo sapiens
gaacuuagcuucaagaauu

SEQ ID NO: 565209 - RNA, 19 nt, Homo sapiens
gaaagagaaugugcaauua

SEQ ID NO: 565210 - RNA, 19 nt, Homo sapiens
guaaagcgccugcuaauua

SEQ ID NO: 565211 - RNA, 19 nt, Homo sapiens
gcagagagcuuggagauaa

SEQ ID NO: 565212 - RNA, 19 nt, Homo sapiens
aaacacagcuucugaaauu

SEQ ID NO: 565213 - RNA, 19 nt, Homo sapiens
ggaaugaaaugcuuugaaa

SEQ ID NO: 565214 - RNA, 19 nt, Homo sapiens
guacggcgauguauuguua

SEQ ID NO: 565215 - RNA, 19 nt, Homo sapiens
caaaggagauuuauuggaa

SEQ ID NO: 565216 - RNA, 19 nt, Homo sapiens
gaauguaccugcuaccuuu

SEQ ID NO: 565217 - RNA, 19 nt, Homo sapiens
gaaauaacuucuugccaaa

SEQ ID NO: 565218 - RNA, 19 nt, Homo sapiens
gcacagcaauuacuacuug

SEQ ID NO: 565219 - RNA, 19 nt, Homo sapiens
gcaaacaccucucucuuau

SEQ ID NO: 565220 - RNA, 19 nt, Homo sapiens
uaacagagcuauagaucuu

SEQ ID NO: 565221 - RNA, 19 nt, Homo sapiens
guggauagaucacuuuaua

SEQ ID NO: 565222 - RNA, 19 nt, Homo sapiens
gcaaagaucugugcugugu

SEQ ID NO: 565223 - RNA, 19 nt, Homo sapiens
ggaaagagaaugugcaauu

SEQ ID NO: 565224 - RNA, 19 nt, Homo sapiens
uaagugguauuccaaguua

SEQ ID NO: 565225 - RNA, 19 nt, Homo sapiens
ggucaucuuuggucauuua

SEQ ID NO: 565226 - RNA, 19 nt, Homo sapiens
gagaugauguauuuggaua

SEQ ID NO: 565227 - RNA, 19 nt, Homo sapiens
gaacaguauucuugcaauu

SEQ ID NO: 565228 - RNA, 19 nt, Homo sapiens
gaauguacaugaucugcua

SEQ ID NO: 565229 - RNA, 19 nt, Homo sapiens
gcagacagguugaugaguu

SEQ ID NO: 565230 - RNA, 19 nt, Homo sapiens
ucaaaucgcuucucugaau

SEQ ID NO: 565231 - RNA, 19 nt, Homo sapiens
gaaagaagaccauauacug

SEQ ID NO: 565232 - RNA, 19 nt, Homo sapiens
gagaugaacuugaaagaag

SEQ ID NO: 565233 - RNA, 19 nt, Homo sapiens
cauaaccgauugcaauaua

SEQ ID NO: 565234 - RNA, 19 nt, Homo sapiens
uaaagcgccugcuaauuaa

SEQ ID NO: 565235 - RNA, 19 nt, Homo sapiens
ggacagaauuacaugaaug

SEQ ID NO: 565236 - RNA, 19 nt, Homo sapiens
guacuucauuccaguuaua

SEQ ID NO: 565237 - RNA, 19 nt, Homo sapiens
ggugguaacuuuugaauua

SEQ ID NO: 565238 - RNA, 19 nt, Homo sapiens
gcuaggagaugaacuugaa

SEQ ID NO: 565239 - RNA, 19 nt, Homo sapiens
caaguuauauucaguagug

SEQ ID NO: 565240 - RNA, 19 nt, Homo sapiens
gauggaugauuuggaauua

SEQ ID NO: 565241 - RNA, 19 nt, Homo sapiens
ucucaaauguggaauagua

SEQ ID NO: 565242 - RNA, 19 nt, Homo sapiens
gcaauccucaguauaguua

SEQ ID NO: 565243 - RNA, 19 nt, Homo sapiens
gcugcuagauuccucuuua

SEQ ID NO: 565244 - RNA, 19 nt, Homo sapiens
guacaugggagaaguauuu

SEQ ID NO: 565245 - RNA, 19 nt, Homo sapiens
agaaaaggcucuuacauua

SEQ ID NO: 565246 - RNA, 19 nt, Homo sapiens
ggaauuagcgagcuugaaa

SEQ ID NO: 565247 - RNA, 19 nt, Homo sapiens
gcaguuguccuguugcuua

SEQ ID NO: 565248 - RNA, 19 nt, Homo sapiens
ggaaagggauaauguaaac

SEQ ID NO: 565249 - RNA, 19 nt, Homo sapiens
ugaacaacaugaugccuua

SEQ ID NO: 565250 - RNA, 19 nt, Homo sapiens
gguggaagaugaacaaguu

SEQ ID NO: 565251 - RNA, 19 nt, Homo sapiens
uaacacagauuaaccaagu

SEQ ID NO: 565252 - RNA, 19 nt, Homo sapiens
gaaaggaaacuaauagcaa

SEQ ID NO: 565253 - RNA, 19 nt, Homo sapiens
gcuaaccacuuuaaagcua

SEQ ID NO: 565254 - RNA, 19 nt, Homo sapiens
ugaaggcaaugaagaagua

SEQ ID NO: 565255 - RNA, 19 nt, Homo sapiens
aaacuuagauuugccauug

SEQ ID NO: 565256 - RNA, 19 nt, Homo sapiens
uauauaggcuaaccacuuu

SEQ ID NO: 565257 - RNA, 19 nt, Homo sapiens
gaaguauccucaccucaga

SEQ ID NO: 565258 - RNA, 19 nt, Homo sapiens
uaaugaggcuucaagauau

SEQ ID NO: 565259 - RNA, 19 nt, Homo sapiens
gguaguuuaugccuuguua

SEQ ID NO: 565260 - RNA, 19 nt, Homo sapiens
uaguggaucucaucaauaa

SEQ ID NO: 565261 - RNA, 19 nt, Homo sapiens
gaagacacaccagauauuu

SEQ ID NO: 565262 - RNA, 19 nt, Homo sapiens
cagaagaggugguggaaug

SEQ ID NO: 565263 - RNA, 19 nt, Homo sapiens
gagagaguguagugauuaa

SEQ ID NO: 565264 - RNA, 19 nt, Homo sapiens
caagagagaaggguaaaua

SEQ ID NO: 565265 - RNA, 19 nt, Homo sapiens
ggacacaggccucugcuuu

SEQ ID NO: 565266 - RNA, 19 nt, Homo sapiens
uaacagagguaguuuaugc

SEQ ID NO: 565267 - RNA, 19 nt, Homo sapiens
ggaaaccaccguaaucauu

SEQ ID NO: 565268 - RNA, 19 nt, Homo sapiens
ggaagucgauacagucaug

SEQ ID NO: 565269 - RNA, 19 nt, Homo sapiens
gguaauuccugcucugaaa

SEQ ID NO: 565270 - RNA, 19 nt, Homo sapiens
aaacaccucucucuuauag

SEQ ID NO: 565271 - RNA, 19 nt, Homo sapiens
caauuggucuccuccagua

SEQ ID NO: 565272 - RNA, 19 nt, Homo sapiens
gagaugggcuguucgauac

SEQ ID NO: 565273 - RNA, 19 nt, Homo sapiens
gaacuucggccauauuuag

SEQ ID NO: 565274 - RNA, 19 nt, Homo sapiens
caaaucgcuucucugaaua

SEQ ID NO: 565275 - RNA, 19 nt, Homo sapiens
cuaaugaggcuucaagaua

SEQ ID NO: 565276 - RNA, 19 nt, Homo sapiens
ccugauagcucuuccgauu

SEQ ID NO: 565277 - RNA, 19 nt, Homo sapiens
ucgaaugguuagaguauua

SEQ ID NO: 565278 - RNA, 19 nt, Homo sapiens
uacaggaccuugauaauau

SEQ ID NO: 565279 - RNA, 19 nt, Homo sapiens
gguuauaucuaguguauca

SEQ ID NO: 565280 - RNA, 19 nt, Homo sapiens
gagccugcauuuccacaua

SEQ ID NO: 565281 - RNA, 19 nt, Homo sapiens
gagacugggucauaaguga

SEQ ID NO: 565282 - RNA, 19 nt, Homo sapiens
gaaacugacccuuguguau

SEQ ID NO: 565283 - RNA, 19 nt, Homo sapiens
uggcagaccuucaucauug

SEQ ID NO: 565284 - RNA, 19 nt, Homo sapiens
ggcaaacaccucucucuua

SEQ ID NO: 565285 - RNA, 19 nt, Homo sapiens
ggucauaagugauuucaag

SEQ ID NO: 565286 - RNA, 19 nt, Homo sapiens
uuagaaagaucacauagug

SEQ ID NO: 565287 - RNA, 19 nt, Homo sapiens
gaacaaguuaugugaagaa

SEQ ID NO: 565288 - RNA, 19 nt, Homo sapiens
ggacaucauuuacagcaau

SEQ ID NO: 565289 - RNA, 19 nt, Homo sapiens
gcagaagaaauuacuauga

SEQ ID NO: 565290 - RNA, 19 nt, Homo sapiens
gaacaaauggauaugauag

SEQ ID NO: 565291 - RNA, 19 nt, Homo sapiens
uaugggaccuuacacagua

SEQ ID NO: 565292 - RNA, 19 nt, Homo sapiens
ggacuagacuaccuuugga

SEQ ID NO: 565293 - RNA, 19 nt, Homo sapiens
guaauguacuucagcuuga

SEQ ID NO: 565294 - RNA, 19 nt, Homo sapiens
gaacuucgcacaaaugaca

SEQ ID NO: 565295 - RNA, 19 nt, Homo sapiens
cagcaucucuuccaacaga

SEQ ID NO: 565296 - RNA, 19 nt, Homo sapiens
gauuucaaguaccagauua

SEQ ID NO: 565297 - RNA, 19 nt, Homo sapiens
caccaauaguuucuuguua

SEQ ID NO: 565298 - RNA, 19 nt, Homo sapiens
gagaacaaguuaugugaag

SEQ ID NO: 565299 - RNA, 19 nt, Homo sapiens
acagaucacugguauaaau

SEQ ID NO: 565300 - RNA, 19 nt, Homo sapiens
ggaaacaguucaggcuuug

SEQ ID NO: 565301 - RNA, 19 nt, Homo sapiens
gaagauaggaaagaguaua

SEQ ID NO: 565302 - RNA, 19 nt, Homo sapiens
uacggcaccuucucaauua

SEQ ID NO: 565303 - RNA, 19 nt, Homo sapiens
gagagaaggguaaauauuc

SEQ ID NO: 565304 - RNA, 19 nt, Homo sapiens
aaacuuaugccaccagaua

SEQ ID NO: 565305 - RNA, 19 nt, Homo sapiens
gagcaagaguacuuaugaa

SEQ ID NO: 565306 - RNA, 19 nt, Homo sapiens
ugacacaauugguucagua

SEQ ID NO: 565307 - RNA, 19 nt, Homo sapiens
gaacgacuaaacuuccuua

SEQ ID NO: 565308 - RNA, 19 nt, Homo sapiens
gagacaaacuguacaauga

SEQ ID NO: 565309 - RNA, 19 nt, Homo sapiens
caaugucacugaugugcua

SEQ ID NO: 565310 - RNA, 19 nt, Homo sapiens
ucacugaugugcuaacaga

SEQ ID NO: 565311 - RNA, 19 nt, Homo sapiens
gagcagaauuuccuugucu

SEQ ID NO: 565312 - RNA, 19 nt, Homo sapiens
gaacaccugacaacauuga

SEQ ID NO: 565313 - RNA, 19 nt, Homo sapiens
uggaacaccugacaacauu

SEQ ID NO: 565314 - RNA, 19 nt, Homo sapiens
gcaaggcccugagcagaau

SEQ ID NO: 565315 - RNA, 19 nt, Homo sapiens
ggagacaaacuguacaaug

SEQ ID NO: 565316 - RNA, 19 nt, Homo sapiens
gcuggcggaucguguauga

SEQ ID NO: 565317 - RNA, 19 nt, Homo sapiens
ccacuuagcucugccuucu

SEQ ID NO: 565318 - RNA, 19 nt, Homo sapiens
ggaauggagacaaacugua

SEQ ID NO: 565319 - RNA, 19 nt, Homo sapiens
agaauuuccuugucucgaa

SEQ ID NO: 565320 - RNA, 19 nt, Homo sapiens
gaauuuccuugucucgaau

SEQ ID NO: 565321 - RNA, 19 nt, Homo sapiens
gagcugagacgccugaauc

SEQ ID NO: 565322 - RNA, 19 nt, Homo sapiens
ucgacaaccugcacgauga

SEQ ID NO: 565323 - RNA, 19 nt, Homo sapiens
uuccuugucucgaauuaua

SEQ ID NO: 565324 - RNA, 19 nt, Homo sapiens
gguggaugcugccuacaau

SEQ ID NO: 565325 - RNA, 19 nt, Homo sapiens
caacauugacaucuggauu

SEQ ID NO: 565326 - RNA, 19 nt, Homo sapiens
ucaacgcgcucaccuccuu

SEQ ID NO: 565327 - RNA, 19 nt, Homo sapiens
ccuggcagcucucaacaug

SEQ ID NO: 565328 - RNA, 19 nt, Homo sapiens
caacucgcaugucccacuu

SEQ ID NO: 565329 - RNA, 19 nt, Homo sapiens
gaauggagacaaacuguac

SEQ ID NO: 565330 - RNA, 19 nt, Homo sapiens
uggcuugucuguucgagaa

SEQ ID NO: 565331 - RNA, 19 nt, Homo sapiens
aaccagcgcuuucaagaca

SEQ ID NO: 565332 - RNA, 19 nt, Homo sapiens
acuuagcucugccuucuuu

SEQ ID NO: 565333 - RNA, 19 nt, Homo sapiens
caaugaggcucggaagauc

SEQ ID NO: 565334 - RNA, 19 nt, Homo sapiens
ccgucaggaugccauguua

SEQ ID NO: 565335 - RNA, 19 nt, Homo sapiens
gccaugcacacccucuuua

SEQ ID NO: 565336 - RNA, 19 nt, Homo sapiens
ggacggugcaacaacaaga

SEQ ID NO: 565337 - RNA, 19 nt, Homo sapiens
ugucucgaauuauauguga

SEQ ID NO: 565338 - RNA, 19 nt, Homo sapiens
gaugcugccuacaauugga

SEQ ID NO: 565339 - RNA, 19 nt, Homo sapiens
caucaccuaccgagacuuu

SEQ ID NO: 565340 - RNA, 19 nt, Homo sapiens
gacacccgaucaacggaaa

SEQ ID NO: 565341 - RNA, 19 nt, Homo sapiens
gaaguuccugaauuuguau

SEQ ID NO: 565342 - RNA, 19 nt, Homo sapiens
gcucucaacaugcaacgaa

SEQ ID NO: 565343 - RNA, 19 nt, Homo sapiens
cugcaggcguugacuguga

SEQ ID NO: 565344 - RNA, 19 nt, Homo sapiens
gcauagcagaggccaaguu

SEQ ID NO: 565345 - RNA, 19 nt, Homo sapiens
gacaaguaccgcaccauca

SEQ ID NO: 565346 - RNA, 19 nt, Homo sapiens
ggccgcagauuauaugcau

SEQ ID NO: 565347 - RNA, 19 nt, Homo sapiens
ggccaucgcugagccucuu

SEQ ID NO: 565348 - RNA, 19 nt, Homo sapiens
ccgguggaauggagacaaa

SEQ ID NO: 565349 - RNA, 19 nt, Homo sapiens
gcagccaccaggacaguug

SEQ ID NO: 565350 - RNA, 19 nt, Homo sapiens
ggagaacccuggggcacua

SEQ ID NO: 565351 - RNA, 19 nt, Homo sapiens
ucaaccagcgcuuucaaga

SEQ ID NO: 565352 - RNA, 19 nt, Homo sapiens
ucaagaucccacccaauga

SEQ ID NO: 565353 - RNA, 19 nt, Homo sapiens
uggcagcucucaacaugca

SEQ ID NO: 565354 - RNA, 19 nt, Homo sapiens
cauagcagaggccaaguug

SEQ ID NO: 565355 - RNA, 19 nt, Homo sapiens
gaccuccuguccuacuuca

SEQ ID NO: 565356 - RNA, 19 nt, Homo sapiens
gaggcgcaauggcuuccuu

SEQ ID NO: 565357 - RNA, 19 nt, Homo sapiens
ggaauuuggcacagcuuag

SEQ ID NO: 565358 - RNA, 19 nt, Homo sapiens
gcuccagcccuucauguuc

SEQ ID NO: 565359 - RNA, 19 nt, Homo sapiens
ccuccuguccuacuucaaa

SEQ ID NO: 565360 - RNA, 19 nt, Homo sapiens
ggaccuggcagcucucaac

SEQ ID NO: 565361 - RNA, 19 nt, Homo sapiens
cuucagagccaacaucuac

SEQ ID NO: 565362 - RNA, 19 nt, Homo sapiens
ccagcuggcggaucgugua

SEQ ID NO: 565363 - RNA, 19 nt, Homo sapiens
cggaauuuggcacagcuua

SEQ ID NO: 565364 - RNA, 19 nt, Homo sapiens
cacccuggccuuccgcuuu

SEQ ID NO: 565365 - RNA, 19 nt, Homo sapiens
acaaugaggcucggaagau

SEQ ID NO: 565366 - RNA, 19 nt, Homo sapiens
uggaugcugccuacaauug

SEQ ID NO: 565367 - RNA, 19 nt, Homo sapiens
gugacugcaucccuuucuu

SEQ ID NO: 565368 - RNA, 19 nt, Homo sapiens
ucuucuggcuugucuguuc

SEQ ID NO: 565369 - RNA, 19 nt, Homo sapiens
acaauuggacccagaagag

SEQ ID NO: 565370 - RNA, 19 nt, Homo sapiens
ggaacaccugacaacauug

SEQ ID NO: 565371 - RNA, 19 nt, Homo sapiens
gccaugguccagaucauca

SEQ ID NO: 565372 - RNA, 19 nt, Homo sapiens
ccaugcacacccucuuuau

SEQ ID NO: 565373 - RNA, 19 nt, Homo sapiens
ugacugcaucccuuucuuc

SEQ ID NO: 565374 - RNA, 19 nt, Homo sapiens
ugagcagaauuuccuuguc

SEQ ID NO: 565375 - RNA, 19 nt, Homo sapiens
cgcaaggcccugagcagaa

SEQ ID NO: 565376 - RNA, 19 nt, Homo sapiens
uuauaugcauguggcuuug

SEQ ID NO: 565377 - RNA, 19 nt, Homo sapiens
uccggacccuucaauguca

SEQ ID NO: 565378 - RNA, 19 nt, Homo sapiens
ccuucaaugucacugaugu

SEQ ID NO: 565379 - RNA, 19 nt, Homo sapiens
caucaaccagcgcuuucaa

SEQ ID NO: 565380 - RNA, 19 nt, Homo sapiens
gguccugcgagacugcaua

SEQ ID NO: 565381 - RNA, 19 nt, Homo sapiens
caagaucccacccaaugac

SEQ ID NO: 565382 - RNA, 19 nt, Homo sapiens
guaaugacaugaccuauaa

SEQ ID NO: 565383 - RNA, 19 nt, Homo sapiens
ggacaagggauuaauagua

SEQ ID NO: 565384 - RNA, 19 nt, Homo sapiens
acaaagcucugccuacaua

SEQ ID NO: 565385 - RNA, 19 nt, Homo sapiens
gacaagggauuaauaguau

SEQ ID NO: 565386 - RNA, 19 nt, Homo sapiens
ggaauuccaugacuccaaa

SEQ ID NO: 565387 - RNA, 19 nt, Homo sapiens
ggaaaccucuggaccucua

SEQ ID NO: 565388 - RNA, 19 nt, Homo sapiens
gaauaccucugacaugaug

SEQ ID NO: 565389 - RNA, 19 nt, Homo sapiens
aggagaagcugaucaguaa

SEQ ID NO: 565390 - RNA, 19 nt, Homo sapiens
caacauggcggacaacaaa

SEQ ID NO: 565391 - RNA, 19 nt, Homo sapiens
gaaccgaacagaugaaaug

SEQ ID NO: 565392 - RNA, 19 nt, Homo sapiens
gcaacgacaugauuccuau

SEQ ID NO: 565393 - RNA, 19 nt, Homo sapiens
gacaugaccuauaauuaug

SEQ ID NO: 565394 - RNA, 19 nt, Homo sapiens
guaaagaucguacagaaga

SEQ ID NO: 565395 - RNA, 19 nt, Homo sapiens
gaaggagauugguggauug

SEQ ID NO: 565396 - RNA, 19 nt, Homo sapiens
ggaagaagaagaggaagua

SEQ ID NO: 565397 - RNA, 19 nt, Homo sapiens
gaauagggccugagggaaa

SEQ ID NO: 565398 - RNA, 19 nt, Homo sapiens
ugaucuaucugguucaaua

SEQ ID NO: 565399 - RNA, 19 nt, Homo sapiens
ggaagaagaagaagaacuu

SEQ ID NO: 565400 - RNA, 19 nt, Homo sapiens
ggaggcggcucacaaugaa

SEQ ID NO: 565401 - RNA, 19 nt, Homo sapiens
gagguuauaugcagaggaa

SEQ ID NO: 565402 - RNA, 19 nt, Homo sapiens
uauaugacguuguacauug

SEQ ID NO: 565403 - RNA, 19 nt, Homo sapiens
gaacuggaccuccuuaugg

SEQ ID NO: 565404 - RNA, 19 nt, Homo sapiens
agacacagcuauuuaaucu

SEQ ID NO: 565405 - RNA, 19 nt, Homo sapiens
ggagauggcugugguacug

SEQ ID NO: 565406 - RNA, 19 nt, Homo sapiens
gcagauuccuccuuaugga

SEQ ID NO: 565407 - RNA, 19 nt, Homo sapiens
gaacuuagaaacugacugu

SEQ ID NO: 565408 - RNA, 19 nt, Homo sapiens
gcacagagccaccggaaca

SEQ ID NO: 565409 - RNA, 19 nt, Homo sapiens
gaggagaagcugaucagua

SEQ ID NO: 565410 - RNA, 19 nt, Homo sapiens
guaaugaugucccucaagu

SEQ ID NO: 565411 - RNA, 19 nt, Homo sapiens
cacagcagauuccuccuua

SEQ ID NO: 565412 - RNA, 19 nt, Homo sapiens
caguaaagaucguacagaa

SEQ ID NO: 565413 - RNA, 19 nt, Homo sapiens
gcccuaacauggccaauau

SEQ ID NO: 565414 - RNA, 19 nt, Homo sapiens
ucaacgggaugccacauuu

SEQ ID NO: 565415 - RNA, 19 nt, Homo sapiens
caaaguuacuguuguuuac

SEQ ID NO: 565416 - RNA, 19 nt, Homo sapiens
gcaaugacuuugagauguc

SEQ ID NO: 565417 - RNA, 19 nt, Homo sapiens
ggaccucuaucgccucuau

SEQ ID NO: 565418 - RNA, 19 nt, Homo sapiens
uauaaugccuugcccaaug

SEQ ID NO: 565419 - RNA, 19 nt, Homo sapiens
caggaugccuuuaaugaug

SEQ ID NO: 565420 - RNA, 19 nt, Homo sapiens
ucaaugaccuccaguaagg

SEQ ID NO: 565421 - RNA, 19 nt, Homo sapiens
gaucagaugggcaagauga

SEQ ID NO: 565422 - RNA, 19 nt, Homo sapiens
gaagaaacacaauugagau

SEQ ID NO: 565423 - RNA, 19 nt, Homo sapiens
ccaaaguuacuguuguuua

SEQ ID NO: 565424 - RNA, 19 nt, Homo sapiens
gugguggacugcucagaua

SEQ ID NO: 565425 - RNA, 19 nt, Homo sapiens
ccaggcagccaaacuauaa

SEQ ID NO: 565426 - RNA, 19 nt, Homo sapiens
acccugagaucaccucuua

SEQ ID NO: 565427 - RNA, 19 nt, Homo sapiens
gagcagcaaguuuccauuu

SEQ ID NO: 565428 - RNA, 19 nt, Homo sapiens
aggcauggcuggaggcaua

SEQ ID NO: 565429 - RNA, 19 nt, Homo sapiens
ugauguaaauuccuccuuu

SEQ ID NO: 565430 - RNA, 19 nt, Homo sapiens
acaacacccugaccucuuu

SEQ ID NO: 565431 - RNA, 19 nt, Homo sapiens
ccacauuucauaacuguuu

SEQ ID NO: 565432 - RNA, 19 nt, Homo sapiens
gagaaguuguauagcacua

SEQ ID NO: 565433 - RNA, 19 nt, Homo sapiens
ugaaggagauugguggauu

SEQ ID NO: 565434 - RNA, 19 nt, Homo sapiens
gagaucaccucuuagaacu

SEQ ID NO: 565435 - RNA, 19 nt, Homo sapiens
ggagaggccugugcaguag

SEQ ID NO: 565436 - RNA, 19 nt, Homo sapiens
ccaagaaguucgcaguugu

SEQ ID NO: 565437 - RNA, 19 nt, Homo sapiens
caacuaguguggacaugau

SEQ ID NO: 565438 - RNA, 19 nt, Homo sapiens
gaagaucaccaaguuguau

SEQ ID NO: 565439 - RNA, 19 nt, Homo sapiens
gaauccaaauccaagaaau

SEQ ID NO: 565440 - RNA, 19 nt, Homo sapiens
ggacaccacugagcauauc

SEQ ID NO: 565441 - RNA, 19 nt, Homo sapiens
ucaacauccugcuguauga

SEQ ID NO: 565442 - RNA, 19 nt, Homo sapiens
cgacagcacuaucccuaug

SEQ ID NO: 565443 - RNA, 19 nt, Homo sapiens
ggcagaaggaggagacuua

SEQ ID NO: 565444 - RNA, 19 nt, Homo sapiens
gagaagaucaccaaguugu

SEQ ID NO: 565445 - RNA, 19 nt, Homo sapiens
ggacauggccucgcagugu

SEQ ID NO: 565446 - RNA, 19 nt, Homo sapiens
gcagcaaguuuccauuugg

SEQ ID NO: 565447 - RNA, 19 nt, Homo sapiens
uaucagcccaguaugaaua

SEQ ID NO: 565448 - RNA, 19 nt, Homo sapiens
gaaccauggccaacaauuc

SEQ ID NO: 565449 - RNA, 19 nt, Homo sapiens
ugaagaaacacaauugaga

SEQ ID NO: 565450 - RNA, 19 nt, Homo sapiens
gcgagacacagcuauuuaa

SEQ ID NO: 565451 - RNA, 19 nt, Homo sapiens
agacaaagcucugccuaca

SEQ ID NO: 565452 - RNA, 19 nt, Homo sapiens
gacgaugccugauugagau

SEQ ID NO: 565453 - RNA, 19 nt, Homo sapiens
guaccugccucgcacauag

SEQ ID NO: 565454 - RNA, 19 nt, Homo sapiens
caauuuccauuccaguuug

SEQ ID NO: 565455 - RNA, 19 nt, Homo sapiens
caacagcaacagcagaauu

SEQ ID NO: 565456 - RNA, 19 nt, Homo sapiens
ccacguguguauauauaug

SEQ ID NO: 565457 - RNA, 19 nt, Homo sapiens
gccaagaaguucgcaguug

SEQ ID NO: 565458 - RNA, 19 nt, Homo sapiens
gacuguugcccuuuauuua

SEQ ID NO: 565459 - RNA, 19 nt, Homo sapiens
ggauggagcuaagaguuca

SEQ ID NO: 565460 - RNA, 19 nt, Homo sapiens
uaaagaucguacagaagaa

SEQ ID NO: 565461 - RNA, 19 nt, Homo sapiens
gaagaggaaguaguugaaa

SEQ ID NO: 565462 - RNA, 19 nt, Homo sapiens
uagagcuccuuguagaaua

SEQ ID NO: 565463 - RNA, 19 nt, Homo sapiens
aaacaugccaccacaaaug

SEQ ID NO: 565464 - RNA, 19 nt, Homo sapiens
cagcuugccugaucuaucu

SEQ ID NO: 565465 - RNA, 19 nt, Homo sapiens
gaucacagccacuauggau

SEQ ID NO: 565466 - RNA, 19 nt, Homo sapiens
gaugaagaaacacaauuga

SEQ ID NO: 565467 - RNA, 19 nt, Homo sapiens
guuaaacguugaggagaaa

SEQ ID NO: 565468 - RNA, 19 nt, Homo sapiens
gacauggccucgcaguguu

SEQ ID NO: 565469 - RNA, 19 nt, Homo sapiens
ggaaguaguugaaaaugau

SEQ ID NO: 565470 - RNA, 19 nt, Homo sapiens
gcacaugggcauuagauac

SEQ ID NO: 565471 - RNA, 19 nt, Homo sapiens
caccaagcaugcagaauca

SEQ ID NO: 565472 - RNA, 19 nt, Homo sapiens
ggagauugguggauugacu

SEQ ID NO: 565473 - RNA, 19 nt, Homo sapiens
agauguggguggaccguua

SEQ ID NO: 565474 - RNA, 19 nt, Homo sapiens
gaaauccaguucuucuacu

SEQ ID NO: 565475 - RNA, 19 nt, Homo sapiens
acacagcuauuuaaucucu

SEQ ID NO: 565476 - RNA, 19 nt, Homo sapiens
ggcaaugacuuugagaugu

SEQ ID NO: 565477 - RNA, 19 nt, Homo sapiens
guucagaggccaucaagga

SEQ ID NO: 565478 - RNA, 19 nt, Homo sapiens
ggagugaucccuucauguc

SEQ ID NO: 565479 - RNA, 19 nt, Homo sapiens
ggcaugagcaggagcaauu

SEQ ID NO: 565480 - RNA, 19 nt, Homo sapiens
cccaaaguaucauguguga

SEQ ID NO: 565481 - RNA, 19 nt, Homo sapiens
guguagacccuuucaugua

SEQ ID NO: 565482 - RNA, 19 nt, Homo sapiens
ggacaagggauuaauagua

SEQ ID NO: 565483 - RNA, 19 nt, Homo sapiens
acaaagcucugccuacaua

SEQ ID NO: 565484 - RNA, 19 nt, Homo sapiens
gacaagggauuaauaguau

SEQ ID NO: 565485 - RNA, 19 nt, Homo sapiens
ggaauuccaugacuccaaa

SEQ ID NO: 565486 - RNA, 19 nt, Homo sapiens
ggaaaccucuggaccucua

SEQ ID NO: 565487 - RNA, 19 nt, Homo sapiens
gaauaccucugacaugaug

SEQ ID NO: 565488 - RNA, 19 nt, Homo sapiens
aggagaagcugaucaguaa

SEQ ID NO: 565489 - RNA, 19 nt, Homo sapiens
caacauggcggacaacaaa

SEQ ID NO: 565490 - RNA, 19 nt, Homo sapiens
gcaacgacaugauuccuau

SEQ ID NO: 565491 - RNA, 19 nt, Homo sapiens
guaaagaucguacagaaga

SEQ ID NO: 565492 - RNA, 19 nt, Homo sapiens
gaaggagauugguggauug

SEQ ID NO: 565493 - RNA, 19 nt, Homo sapiens
ggaagaagaagaggaagua

SEQ ID NO: 565494 - RNA, 19 nt, Homo sapiens
gaauagggccugagggaaa

SEQ ID NO: 565495 - RNA, 19 nt, Homo sapiens
ugaucuaucugguucaaua

SEQ ID NO: 565496 - RNA, 19 nt, Homo sapiens
ggaagaagaagaagaacuu

SEQ ID NO: 565497 - RNA, 19 nt, Homo sapiens
gagguuauaugcagaggaa

SEQ ID NO: 565498 - RNA, 19 nt, Homo sapiens
uauaugacguuguacauug

SEQ ID NO: 565499 - RNA, 19 nt, Homo sapiens
gaacuggaccuccuuaugg

SEQ ID NO: 565500 - RNA, 19 nt, Homo sapiens
agacacagcuauuuaaucu

SEQ ID NO: 565501 - RNA, 19 nt, Homo sapiens
ggagauggcugugguacug

SEQ ID NO: 565502 - RNA, 19 nt, Homo sapiens
gcagauuccuccuuaugga

SEQ ID NO: 565503 - RNA, 19 nt, Homo sapiens
gaacuuagaaacugacugu

SEQ ID NO: 565504 - RNA, 19 nt, Homo sapiens
gcacagagccaccggaaca

SEQ ID NO: 565505 - RNA, 19 nt, Homo sapiens
gaggagaagcugaucagua

SEQ ID NO: 565506 - RNA, 19 nt, Homo sapiens
guaaugaugucccucaagu

SEQ ID NO: 565507 - RNA, 19 nt, Homo sapiens
cacagcagauuccuccuua

SEQ ID NO: 565508 - RNA, 19 nt, Homo sapiens
caguaaagaucguacagaa

SEQ ID NO: 565509 - RNA, 19 nt, Homo sapiens
gcccuaacauggccaauau

SEQ ID NO: 565510 - RNA, 19 nt, Homo sapiens
ucaacgggaugccacauuu

SEQ ID NO: 565511 - RNA, 19 nt, Homo sapiens
ucaacgggaugccacauuu

SEQ ID NO: 565512 - RNA, 19 nt, Homo sapiens
caaaguuacuguuguuuac

SEQ ID NO: 565513 - RNA, 19 nt, Homo sapiens
gcaaugacuuugagauguc

SEQ ID NO: 565514 - RNA, 19 nt, Homo sapiens
ggaccucuaucgccucuau

SEQ ID NO: 565515 - RNA, 19 nt, Homo sapiens
uauaaugccuugcccaaug

SEQ ID NO: 565516 - RNA, 19 nt, Homo sapiens
caggaugccuuuaaugaug

SEQ ID NO: 565517 - RNA, 19 nt, Homo sapiens
ucaaugaccuccaguaagg

SEQ ID NO: 565518 - RNA, 19 nt, Homo sapiens
gaucagaugggcaagauga

SEQ ID NO: 565519 - RNA, 19 nt, Homo sapiens
gaagaaacacaauugagau

SEQ ID NO: 565520 - RNA, 19 nt, Homo sapiens
ccaaaguuacuguuguuua

SEQ ID NO: 565521 - RNA, 19 nt, Homo sapiens
gugguggacugcucagaua

SEQ ID NO: 565522 - RNA, 19 nt, Homo sapiens
ccaggcagccaaacuauaa

SEQ ID NO: 565523 - RNA, 19 nt, Homo sapiens
acccugagaucaccucuua

SEQ ID NO: 565524 - RNA, 19 nt, Homo sapiens
gagcagcaaguuuccauuu

SEQ ID NO: 565525 - RNA, 19 nt, Homo sapiens
aggcauggcuggaggcaua

SEQ ID NO: 565526 - RNA, 19 nt, Homo sapiens
ugauguaaauuccuccuuu

SEQ ID NO: 565527 - RNA, 19 nt, Homo sapiens
acaacacccugaccucuuu

SEQ ID NO: 565528 - RNA, 19 nt, Homo sapiens
ccacauuucauaacuguuu

SEQ ID NO: 565529 - RNA, 19 nt, Homo sapiens
ccacauuucauaacuguuu

SEQ ID NO: 565530 - RNA, 19 nt, Homo sapiens
gagaaguuguauagcacua

SEQ ID NO: 565531 - RNA, 19 nt, Homo sapiens
ugaaggagauugguggauu

SEQ ID NO: 565532 - RNA, 19 nt, Homo sapiens
gagaucaccucuuagaacu

SEQ ID NO: 565533 - RNA, 19 nt, Homo sapiens
ggagaggccugugcaguag

SEQ ID NO: 565534 - RNA, 19 nt, Homo sapiens
ccaagaaguucgcaguugu

SEQ ID NO: 565535 - RNA, 19 nt, Homo sapiens
caacuaguguggacaugau

SEQ ID NO: 565536 - RNA, 19 nt, Homo sapiens
gaagaucaccaaguuguau

SEQ ID NO: 565537 - RNA, 19 nt, Homo sapiens
gaauccaaauccaagaaau

SEQ ID NO: 565538 - RNA, 19 nt, Homo sapiens
ggacaccacugagcauauc

SEQ ID NO: 565539 - RNA, 19 nt, Homo sapiens
ucaacauccugcuguauga

SEQ ID NO: 565540 - RNA, 19 nt, Homo sapiens
cgacagcacuaucccuaug

SEQ ID NO: 565541 - RNA, 19 nt, Homo sapiens
ggcagaaggaggagacuua

SEQ ID NO: 565542 - RNA, 19 nt, Homo sapiens
gagaagaucaccaaguugu

SEQ ID NO: 565543 - RNA, 19 nt, Homo sapiens
ggacauggccucgcagugu

SEQ ID NO: 565544 - RNA, 19 nt, Homo sapiens
gcagcaaguuuccauuugg

SEQ ID NO: 565545 - RNA, 19 nt, Homo sapiens
uaucagcccaguaugaaua

SEQ ID NO: 565546 - RNA, 19 nt, Homo sapiens
gaaccauggccaacaauuc

SEQ ID NO: 565547 - RNA, 19 nt, Homo sapiens
ugaagaaacacaauugaga

SEQ ID NO: 565548 - RNA, 19 nt, Homo sapiens
gcgagacacagcuauuuaa

SEQ ID NO: 565549 - RNA, 19 nt, Homo sapiens
agacaaagcucugccuaca

SEQ ID NO: 565550 - RNA, 19 nt, Homo sapiens
gacgaugccugauugagau

SEQ ID NO: 565551 - RNA, 19 nt, Homo sapiens
ccacguguguauauauaug

SEQ ID NO: 565552 - RNA, 19 nt, Homo sapiens
gccaagaaguucgcaguug

SEQ ID NO: 565553 - RNA, 19 nt, Homo sapiens
gacuguugcccuuuauuua

SEQ ID NO: 565554 - RNA, 19 nt, Homo sapiens
ggauggagcuaagaguuca

SEQ ID NO: 565555 - RNA, 19 nt, Homo sapiens
uaaagaucguacagaagaa

SEQ ID NO: 565556 - RNA, 19 nt, Homo sapiens
gaagaggaaguaguugaaa

SEQ ID NO: 565557 - RNA, 19 nt, Homo sapiens
uagagcuccuuguagaaua

SEQ ID NO: 565558 - RNA, 19 nt, Homo sapiens
cagcuugccugaucuaucu

SEQ ID NO: 565559 - RNA, 19 nt, Homo sapiens
gaucacagccacuauggau

SEQ ID NO: 565560 - RNA, 19 nt, Homo sapiens
gaugaagaaacacaauuga

SEQ ID NO: 565561 - RNA, 19 nt, Homo sapiens
gacauggccucgcaguguu

SEQ ID NO: 565562 - RNA, 19 nt, Homo sapiens
guuaaacguugaggagaaa

SEQ ID NO: 565563 - RNA, 19 nt, Homo sapiens
ggaaguaguugaaaaugau

SEQ ID NO: 565564 - RNA, 19 nt, Homo sapiens
gcacaugggcauuagauac

SEQ ID NO: 565565 - RNA, 19 nt, Homo sapiens
ggagauugguggauugacu

SEQ ID NO: 565566 - RNA, 19 nt, Homo sapiens
agauguggguggaccguua

SEQ ID NO: 565567 - RNA, 19 nt, Homo sapiens
gaaauccaguucuucuacu

SEQ ID NO: 565568 - RNA, 19 nt, Homo sapiens
acacagcuauuuaaucucu

SEQ ID NO: 565569 - RNA, 19 nt, Homo sapiens
ggcaaugacuuugagaugu

SEQ ID NO: 565570 - RNA, 19 nt, Homo sapiens
guucagaggccaucaagga

SEQ ID NO: 565571 - RNA, 19 nt, Homo sapiens
ggagugaucccuucauguc

SEQ ID NO: 565572 - RNA, 19 nt, Homo sapiens
ggcaugagcaggagcaauu

SEQ ID NO: 565573 - RNA, 19 nt, Homo sapiens
cccaaaguaucauguguga

SEQ ID NO: 565574 - RNA, 19 nt, Homo sapiens
guguagacccuuucaugua

SEQ ID NO: 565575 - RNA, 19 nt, Homo sapiens
aaaggugacugcugaacug

SEQ ID NO: 565576 - RNA, 19 nt, Homo sapiens
cauuugugauguacuguuu

SEQ ID NO: 565577 - RNA, 19 nt, Homo sapiens
ccaacaacauggcggacaa

SEQ ID NO: 565578 - RNA, 19 nt, Homo sapiens
ggacugcucagauaagcuu

SEQ ID NO: 565579 - RNA, 19 nt, Homo sapiens
ugacaagcuuccaguaaag

SEQ ID NO: 565580 - RNA, 19 nt, Homo sapiens
agaagaagaggaaguaguu

SEQ ID NO: 565581 - RNA, 19 nt, Homo sapiens
ggaacuggaccuccuuaug

SEQ ID NO: 565582 - RNA, 19 nt, Homo sapiens
ggacaagggauuaauagua

SEQ ID NO: 565583 - RNA, 19 nt, Homo sapiens
acaaagcucugccuacaua

SEQ ID NO: 565584 - RNA, 19 nt, Homo sapiens
gacaagggauuaauaguau

SEQ ID NO: 565585 - RNA, 19 nt, Homo sapiens
ggaauuccaugacuccaaa

SEQ ID NO: 565586 - RNA, 19 nt, Homo sapiens
ggaaaccucuggaccucua

SEQ ID NO: 565587 - RNA, 19 nt, Homo sapiens
gaauaccucugacaugaug

SEQ ID NO: 565588 - RNA, 19 nt, Homo sapiens
aggagaagcugaucaguaa

SEQ ID NO: 565589 - RNA, 19 nt, Homo sapiens
caacauggcggacaacaaa

SEQ ID NO: 565590 - RNA, 19 nt, Homo sapiens
gcaacgacaugauuccuau

SEQ ID NO: 565591 - RNA, 19 nt, Homo sapiens
guaaagaucguacagaaga

SEQ ID NO: 565592 - RNA, 19 nt, Homo sapiens
gaaggagauugguggauug

SEQ ID NO: 565593 - RNA, 19 nt, Homo sapiens
ggaagaagaagaggaagua

SEQ ID NO: 565594 - RNA, 19 nt, Homo sapiens
gaauagggccugagggaaa

SEQ ID NO: 565595 - RNA, 19 nt, Homo sapiens
ugaucuaucugguucaaua

SEQ ID NO: 565596 - RNA, 19 nt, Homo sapiens
ggaagaagaagaagaacuu

SEQ ID NO: 565597 - RNA, 19 nt, Homo sapiens
ggaggcggcucacaaugaa

SEQ ID NO: 565598 - RNA, 19 nt, Homo sapiens
gagguuauaugcagaggaa

SEQ ID NO: 565599 - RNA, 19 nt, Homo sapiens
uauaugacguuguacauug

SEQ ID NO: 565600 - RNA, 19 nt, Homo sapiens
gaacuggaccuccuuaugg

SEQ ID NO: 565601 - RNA, 19 nt, Homo sapiens
agacacagcuauuuaaucu

SEQ ID NO: 565602 - RNA, 19 nt, Homo sapiens
ggagauggcugugguacug

SEQ ID NO: 565603 - RNA, 19 nt, Homo sapiens
gcagauuccuccuuaugga

SEQ ID NO: 565604 - RNA, 19 nt, Homo sapiens
gaacuuagaaacugacugu

SEQ ID NO: 565605 - RNA, 19 nt, Homo sapiens
gcacagagccaccggaaca

SEQ ID NO: 565606 - RNA, 19 nt, Homo sapiens
gaggagaagcugaucagua

SEQ ID NO: 565607 - RNA, 19 nt, Homo sapiens
guaaugaugucccucaagu

SEQ ID NO: 565608 - RNA, 19 nt, Homo sapiens
cacagcagauuccuccuua

SEQ ID NO: 565609 - RNA, 19 nt, Homo sapiens
caguaaagaucguacagaa

SEQ ID NO: 565610 - RNA, 19 nt, Homo sapiens
gcccuaacauggccaauau

SEQ ID NO: 565611 - RNA, 19 nt, Homo sapiens
ucaacgggaugccacauuu

SEQ ID NO: 565612 - RNA, 19 nt, Homo sapiens
caaaguuacuguuguuuac

SEQ ID NO: 565613 - RNA, 19 nt, Homo sapiens
gcaaugacuuugagauguc

SEQ ID NO: 565614 - RNA, 19 nt, Homo sapiens
ggaccucuaucgccucuau

SEQ ID NO: 565615 - RNA, 19 nt, Homo sapiens
uauaaugccuugcccaaug

SEQ ID NO: 565616 - RNA, 19 nt, Homo sapiens
caggaugccuuuaaugaug

SEQ ID NO: 565617 - RNA, 19 nt, Homo sapiens
ucaaugaccuccaguaagg

SEQ ID NO: 565618 - RNA, 19 nt, Homo sapiens
gaucagaugggcaagauga

SEQ ID NO: 565619 - RNA, 19 nt, Homo sapiens
gaagaaacacaauugagau

SEQ ID NO: 565620 - RNA, 19 nt, Homo sapiens
ccaaaguuacuguuguuua

SEQ ID NO: 565621 - RNA, 19 nt, Homo sapiens
gugguggacugcucagaua

SEQ ID NO: 565622 - RNA, 19 nt, Homo sapiens
ccaggcagccaaacuauaa

SEQ ID NO: 565623 - RNA, 19 nt, Homo sapiens
acccugagaucaccucuua

SEQ ID NO: 565624 - RNA, 19 nt, Homo sapiens
gagcagcaaguuuccauuu

SEQ ID NO: 565625 - RNA, 19 nt, Homo sapiens
aggcauggcuggaggcaua

SEQ ID NO: 565626 - RNA, 19 nt, Homo sapiens
ugauguaaauuccuccuuu

SEQ ID NO: 565627 - RNA, 19 nt, Homo sapiens
acaacacccugaccucuuu

SEQ ID NO: 565628 - RNA, 19 nt, Homo sapiens
ccacauuucauaacuguuu

SEQ ID NO: 565629 - RNA, 19 nt, Homo sapiens
gagaaguuguauagcacua

SEQ ID NO: 565630 - RNA, 19 nt, Homo sapiens
ugaaggagauugguggauu

SEQ ID NO: 565631 - RNA, 19 nt, Homo sapiens
gagaucaccucuuagaacu

SEQ ID NO: 565632 - RNA, 19 nt, Homo sapiens
ggagaggccugugcaguag

SEQ ID NO: 565633 - RNA, 19 nt, Homo sapiens
ccaagaaguucgcaguugu

SEQ ID NO: 565634 - RNA, 19 nt, Homo sapiens
caacuaguguggacaugau

SEQ ID NO: 565635 - RNA, 19 nt, Homo sapiens
gaagaucaccaaguuguau

SEQ ID NO: 565636 - RNA, 19 nt, Homo sapiens
gaauccaaauccaagaaau

SEQ ID NO: 565637 - RNA, 19 nt, Homo sapiens
ggacaccacugagcauauc

SEQ ID NO: 565638 - RNA, 19 nt, Homo sapiens
ucaacauccugcuguauga

SEQ ID NO: 565639 - RNA, 19 nt, Homo sapiens
cgacagcacuaucccuaug

SEQ ID NO: 565640 - RNA, 19 nt, Homo sapiens
ggcagaaggaggagacuua

SEQ ID NO: 565641 - RNA, 19 nt, Homo sapiens
gagaagaucaccaaguugu

SEQ ID NO: 565642 - RNA, 19 nt, Homo sapiens
ggacauggccucgcagugu

SEQ ID NO: 565643 - RNA, 19 nt, Homo sapiens
gcagcaaguuuccauuugg

SEQ ID NO: 565644 - RNA, 19 nt, Homo sapiens
uaucagcccaguaugaaua

SEQ ID NO: 565645 - RNA, 19 nt, Homo sapiens
gaaccauggccaacaauuc

SEQ ID NO: 565646 - RNA, 19 nt, Homo sapiens
ugaagaaacacaauugaga

SEQ ID NO: 565647 - RNA, 19 nt, Homo sapiens
gcgagacacagcuauuuaa

SEQ ID NO: 565648 - RNA, 19 nt, Homo sapiens
agacaaagcucugccuaca

SEQ ID NO: 565649 - RNA, 19 nt, Homo sapiens
gacgaugccugauugagau

SEQ ID NO: 565650 - RNA, 19 nt, Homo sapiens
guaccugccucgcacauag

SEQ ID NO: 565651 - RNA, 19 nt, Homo sapiens
ccacguguguauauauaug

SEQ ID NO: 565652 - RNA, 19 nt, Homo sapiens
gccaagaaguucgcaguug

SEQ ID NO: 565653 - RNA, 19 nt, Homo sapiens
gacuguugcccuuuauuua

SEQ ID NO: 565654 - RNA, 19 nt, Homo sapiens
ggauggagcuaagaguuca

SEQ ID NO: 565655 - RNA, 19 nt, Homo sapiens
uaaagaucguacagaagaa

SEQ ID NO: 565656 - RNA, 19 nt, Homo sapiens
gaagaggaaguaguugaaa

SEQ ID NO: 565657 - RNA, 19 nt, Homo sapiens
uagagcuccuuguagaaua

SEQ ID NO: 565658 - RNA, 19 nt, Homo sapiens
cagcuugccugaucuaucu

SEQ ID NO: 565659 - RNA, 19 nt, Homo sapiens
gaucacagccacuauggau

SEQ ID NO: 565660 - RNA, 19 nt, Homo sapiens
gaugaagaaacacaauuga

SEQ ID NO: 565661 - RNA, 19 nt, Homo sapiens
gacauggccucgcaguguu

SEQ ID NO: 565662 - RNA, 19 nt, Homo sapiens
guuaaacguugaggagaaa

SEQ ID NO: 565663 - RNA, 19 nt, Homo sapiens
ggaaguaguugaaaaugau

SEQ ID NO: 565664 - RNA, 19 nt, Homo sapiens
gcacaugggcauuagauac

SEQ ID NO: 565665 - RNA, 19 nt, Homo sapiens
ggagauugguggauugacu

SEQ ID NO: 565666 - RNA, 19 nt, Homo sapiens
agauguggguggaccguua

SEQ ID NO: 565667 - RNA, 19 nt, Homo sapiens
gaaauccaguucuucuacu

SEQ ID NO: 565668 - RNA, 19 nt, Homo sapiens
acacagcuauuuaaucucu

SEQ ID NO: 565669 - RNA, 19 nt, Homo sapiens
ggcaaugacuuugagaugu

SEQ ID NO: 565670 - RNA, 19 nt, Homo sapiens
guucagaggccaucaagga

SEQ ID NO: 565671 - RNA, 19 nt, Homo sapiens
ggagugaucccuucauguc

SEQ ID NO: 565672 - RNA, 19 nt, Homo sapiens
ggcaugagcaggagcaauu

SEQ ID NO: 565673 - RNA, 19 nt, Homo sapiens
ccaacaacauggcggacaa

SEQ ID NO: 565674 - RNA, 19 nt, Homo sapiens
cccaaaguaucauguguga

SEQ ID NO: 565675 - RNA, 19 nt, Homo sapiens
guguagacccuuucaugua

SEQ ID NO: 565676 - RNA, 19 nt, Homo sapiens
aaaggugacugcugaacug

SEQ ID NO: 565677 - RNA, 19 nt, Homo sapiens
cauuugugauguacuguuu

SEQ ID NO: 565678 - RNA, 19 nt, Homo sapiens
ggacugcucagauaagcuu

SEQ ID NO: 565679 - RNA, 19 nt, Homo sapiens
ugacaagcuuccaguaaag

SEQ ID NO: 565680 - RNA, 19 nt, Homo sapiens
agaagaagaggaaguaguu

SEQ ID NO: 565681 - RNA, 19 nt, Homo sapiens
ggaacuggaccuccuuaug

SEQ ID NO: 565682 - RNA, 19 nt, Homo sapiens
gcaagcagcuggccaccaa

SEQ ID NO: 565683 - RNA, 19 nt, Homo sapiens
cgagaucgcucaggacuuu

SEQ ID NO: 565684 - RNA, 19 nt, Homo sapiens
gaaguccacugagcugcua

SEQ ID NO: 565685 - RNA, 19 nt, Homo sapiens
ccaaacgggucaccaucau

SEQ ID NO: 565686 - RNA, 19 nt, Homo sapiens
caaccugugugucauccau

SEQ ID NO: 565687 - RNA, 19 nt, Homo sapiens
caucaugccuaaggacauc

SEQ ID NO: 565688 - RNA, 19 nt, Homo sapiens
gggucaccaucaugccuaa

SEQ ID NO: 565689 - RNA, 19 nt, Homo sapiens
gcuaccagaaguccacuga

SEQ ID NO: 565690 - RNA, 19 nt, Homo sapiens
ucaccaucaugccuaagga

SEQ ID NO: 565691 - RNA, 19 nt, Homo sapiens
gcgcaacguucaccccaaa

SEQ ID NO: 565692 - RNA, 19 nt, Homo sapiens
gccaaacgggucaccauca

SEQ ID NO: 565693 - RNA, 19 nt, Homo sapiens
caaacgggucaccaucaug

SEQ ID NO: 565694 - RNA, 19 nt, Homo sapiens
gaaaugaccuuggagauug

SEQ ID NO: 565695 - RNA, 19 nt, Homo sapiens
gaaccaaagucaucaagaa

SEQ ID NO: 565696 - RNA, 19 nt, Homo sapiens
gagcaagucuguaccauug

SEQ ID NO: 565697 - RNA, 19 nt, Homo sapiens
gagcaaggcugggaguaua

SEQ ID NO: 565698 - RNA, 19 nt, Homo sapiens
gcucagacauauuucagua

SEQ ID NO: 565699 - RNA, 19 nt, Homo sapiens
guacagccgugcagucuuu

SEQ ID NO: 565700 - RNA, 19 nt, Homo sapiens
gaucagcucagacauauuu

SEQ ID NO: 565701 - RNA, 19 nt, Homo sapiens
gaacuaugcugccaugaag

SEQ ID NO: 565702 - RNA, 19 nt, Homo sapiens
ggacaagacugagagcaaa

SEQ ID NO: 565703 - RNA, 19 nt, Homo sapiens
cuagaaagcugcugucaga

SEQ ID NO: 565704 - RNA, 19 nt, Homo sapiens
acacacagcuggagaaugu

SEQ ID NO: 565705 - RNA, 19 nt, Homo sapiens
ggacagaccguguaauguu

SEQ ID NO: 565706 - RNA, 19 nt, Homo sapiens
ggaaacagcccacucuuca

SEQ ID NO: 565707 - RNA, 19 nt, Homo sapiens
gaagaugagcgacauuuau

SEQ ID NO: 565708 - RNA, 19 nt, Homo sapiens
ggaccucccuucaacauca

SEQ ID NO: 565709 - RNA, 19 nt, Homo sapiens
gacagaccguguaauguuu

SEQ ID NO: 565710 - RNA, 19 nt, Homo sapiens
gaagagaaccaaagucauc

SEQ ID NO: 565711 - RNA, 19 nt, Homo sapiens
ggaaaugaccuuggagauu

SEQ ID NO: 565712 - RNA, 19 nt, Homo sapiens
ugaaauauccgauggagaa

SEQ ID NO: 565713 - RNA, 19 nt, Homo sapiens
gaagugcgccuacaucuag

SEQ ID NO: 565714 - RNA, 19 nt, Homo sapiens
gaggaagaguucaucgauu

SEQ ID NO: 565715 - RNA, 19 nt, Homo sapiens
gagaaggaccuaaagauca

SEQ ID NO: 565716 - RNA, 19 nt, Homo sapiens
caucuacgcugcuacaugu

SEQ ID NO: 565717 - RNA, 19 nt, Homo sapiens
ggagggaucucagccaaau

SEQ ID NO: 565718 - RNA, 19 nt, Homo sapiens
caacuacuguggcaagaau

SEQ ID NO: 565719 - RNA, 19 nt, Homo sapiens
uggaagagguguuugagaa

SEQ ID NO: 565720 - RNA, 19 nt, Homo sapiens
agaagacucugcuccauga

SEQ ID NO: 565721 - RNA, 19 nt, Homo sapiens
gagacaagcguguggcaua

SEQ ID NO: 565722 - RNA, 19 nt, Homo sapiens
gggaugagcccaacaugaa

SEQ ID NO: 565723 - RNA, 19 nt, Homo sapiens
gacaaguucuccuuugaug

SEQ ID NO: 565724 - RNA, 19 nt, Homo sapiens
gugaaagguuggaugauug

SEQ ID NO: 565725 - RNA, 19 nt, Homo sapiens
gaaaagaccccucugaaga

SEQ ID NO: 565726 - RNA, 19 nt, Homo sapiens
guacgaccaugacacuuau

SEQ ID NO: 565727 - RNA, 19 nt, Homo sapiens
cguguaauguuucaggaua

SEQ ID NO: 565728 - RNA, 19 nt, Homo sapiens
gcacaacgggccucaccua

SEQ ID NO: 565729 - RNA, 19 nt, Homo sapiens
agaaggaguucaaccaguu

SEQ ID NO: 565730 - RNA, 19 nt, Homo sapiens
gauggacgaugccgugaug

SEQ ID NO: 565731 - RNA, 19 nt, Homo sapiens
ggaaugagggauuugaaug

SEQ ID NO: 565732 - RNA, 19 nt, Homo sapiens
gggagcugcuggccucuuu

SEQ ID NO: 565733 - RNA, 19 nt, Homo sapiens
ccaaauggaagcacugaaa

SEQ ID NO: 565734 - RNA, 19 nt, Homo sapiens
gagaugaggcggagccauu

SEQ ID NO: 565735 - RNA, 19 nt, Homo sapiens
ggagaaggaccuaaagauc

SEQ ID NO: 565736 - RNA, 19 nt, Homo sapiens
ggaagaaaucagugaguga

SEQ ID NO: 565737 - RNA, 19 nt, Homo sapiens
gagcuucggugugaacaga

SEQ ID NO: 565738 - RNA, 19 nt, Homo sapiens
cagaagagggugagaagaa

SEQ ID NO: 565739 - RNA, 19 nt, Homo sapiens
gagaagaugagcgacauuu

SEQ ID NO: 565740 - RNA, 19 nt, Homo sapiens
gaugugggucgaccuauuu

SEQ ID NO: 565741 - RNA, 19 nt, Homo sapiens
aggaagaguucaucgauug

SEQ ID NO: 565742 - RNA, 19 nt, Homo sapiens
gugaacagacccacgauuu

SEQ ID NO: 565743 - RNA, 19 nt, Homo sapiens
gaagugggaagaugaggaa

SEQ ID NO: 565744 - RNA, 19 nt, Homo sapiens
gaagcuacagacaaucuuu

SEQ ID NO: 565745 - RNA, 19 nt, Homo sapiens
uggcucagcugacggauga

SEQ ID NO: 565746 - RNA, 19 nt, Homo sapiens
ggacaucagccauagaauc

SEQ ID NO: 565747 - RNA, 19 nt, Homo sapiens
ccacuuccaucauuuccuu

SEQ ID NO: 565748 - RNA, 19 nt, Homo sapiens
gaugauuggcuuugaagaa

SEQ ID NO: 565749 - RNA, 19 nt, Homo sapiens
gggaagacgugcucaucga

SEQ ID NO: 565750 - RNA, 19 nt, Homo sapiens
ucaggaaccuccggaagaa

SEQ ID NO: 565751 - RNA, 19 nt, Homo sapiens
gaccugggcuggagauugg

SEQ ID NO: 565752 - RNA, 19 nt, Homo sapiens
gcgcaaguacucccuguuu

SEQ ID NO: 565753 - RNA, 19 nt, Homo sapiens
gcuaccaccuaccugagua

SEQ ID NO: 565754 - RNA, 19 nt, Homo sapiens
ggccagaggcuaccugaaa

SEQ ID NO: 565755 - RNA, 19 nt, Homo sapiens
gcauugugguggagcugua

SEQ ID NO: 565756 - RNA, 19 nt, Homo sapiens
gaggacaucagccauagaa

SEQ ID NO: 565757 - RNA, 19 nt, Homo sapiens
ccucagacuuggaugacua

SEQ ID NO: 565758 - RNA, 19 nt, Homo sapiens
cagacaaaccgcaggauuu

SEQ ID NO: 565759 - RNA, 19 nt, Homo sapiens
ggaagaaccccaacuuuga

SEQ ID NO: 565760 - RNA, 19 nt, Homo sapiens
ugcggaacaugaagaguua

SEQ ID NO: 565761 - RNA, 19 nt, Homo sapiens
gugggaagcuacagacaau

SEQ ID NO: 565762 - RNA, 19 nt, Homo sapiens
caacaugaacccuaagcuu

SEQ ID NO: 565763 - RNA, 19 nt, Homo sapiens
agacagacgugcauuaucg

SEQ ID NO: 565764 - RNA, 19 nt, Homo sapiens
uaaagaucacucucuauga

SEQ ID NO: 565765 - RNA, 19 nt, Homo sapiens
gcauggagccacuggagaa

SEQ ID NO: 565766 - RNA, 19 nt, Homo sapiens
gaaggaguucaaccaguuu

SEQ ID NO: 565767 - RNA, 19 nt, Homo sapiens
ggacucuccugcccuguag

SEQ ID NO: 565768 - RNA, 19 nt, Homo sapiens
cauacaagaccaugaaguu

SEQ ID NO: 565769 - RNA, 19 nt, Homo sapiens
agaagagggugagaagaaa

SEQ ID NO: 565770 - RNA, 19 nt, Homo sapiens
ugugaaagguuggaugauu

SEQ ID NO: 565771 - RNA, 19 nt, Homo sapiens
guaacaccuucaagcugua

SEQ ID NO: 565772 - RNA, 19 nt, Homo sapiens
gagcaaccgcccagcauug

SEQ ID NO: 565773 - RNA, 19 nt, Homo sapiens
caaccgggcugucgaugag

SEQ ID NO: 565774 - RNA, 19 nt, Homo sapiens
uagcagagagugagcauga

SEQ ID NO: 565775 - RNA, 19 nt, Homo sapiens
ugagugaccaggauaacua

SEQ ID NO: 565776 - RNA, 19 nt, Homo sapiens
cacacugccugccauguuu

SEQ ID NO: 565777 - RNA, 19 nt, Homo sapiens
gaaagugugauccuuacau

SEQ ID NO: 565778 - RNA, 19 nt, Homo sapiens
cuacaugagugacaacuac

SEQ ID NO: 565779 - RNA, 19 nt, Homo sapiens
ccuaugagaacgagacuaa

SEQ ID NO: 565780 - RNA, 19 nt, Homo sapiens
gaagcugucugucuuugcu

SEQ ID NO: 565781 - RNA, 19 nt, Homo sapiens
cuaaagaucacucucuaug

SEQ ID NO: 565782 - RNA, 19 nt, Homo sapiens
gcacucugccucuggagaa

SEQ ID NO: 565783 - RNA, 19 nt, Homo sapiens
ggaggaagaguucaucgau

SEQ ID NO: 565784 - RNA, 19 nt, Homo sapiens
gggaaccgcuaccaucuac

SEQ ID NO: 565785 - RNA, 19 nt, Homo sapiens
caagaauugugggaagcua

SEQ ID NO: 565786 - RNA, 19 nt, Homo sapiens
ccaccaugcugcaggaugu

SEQ ID NO: 565787 - RNA, 19 nt, Homo sapiens
aaagaucacucucuaugac

SEQ ID NO: 565788 - RNA, 19 nt, Homo sapiens
gcccguauuuggaaagaug

SEQ ID NO: 565789 - RNA, 19 nt, Homo sapiens
agacggugguggugaagaa

SEQ ID NO: 565790 - RNA, 19 nt, Homo sapiens
gggaagcugucugucuuug

SEQ ID NO: 565791 - RNA, 19 nt, Homo sapiens
gaaacagcccacucuucaa

SEQ ID NO: 565792 - RNA, 19 nt, Homo sapiens
uggaucagcucagacauau

SEQ ID NO: 565793 - RNA, 19 nt, Homo sapiens
caaguucuccuuugaugau

SEQ ID NO: 565794 - RNA, 19 nt, Homo sapiens
guacgaagcuauuuaauga

SEQ ID NO: 565795 - RNA, 19 nt, Homo sapiens
cagcagaccucaaguagaa

SEQ ID NO: 565796 - RNA, 19 nt, Homo sapiens
ggaaagacaucuccaaggu

SEQ ID NO: 565797 - RNA, 19 nt, Homo sapiens
gcagcagccuccuuucuaa

SEQ ID NO: 565798 - RNA, 19 nt, Homo sapiens
ggaaaagacuuaacuguga

SEQ ID NO: 565799 - RNA, 19 nt, Homo sapiens
ggacuuggcugagcacugu

SEQ ID NO: 565800 - RNA, 19 nt, Homo sapiens
ggauguggcugcccaggaa

SEQ ID NO: 565801 - RNA, 19 nt, Homo sapiens
caacagcguucuuccaauc

SEQ ID NO: 565802 - RNA, 19 nt, Homo sapiens
ggacaaauuccugcuacua

SEQ ID NO: 565803 - RNA, 19 nt, Homo sapiens
uuaaugagccugugucuug

SEQ ID NO: 565804 - RNA, 19 nt, Homo sapiens
gacaaauuccugcuacuaa

SEQ ID NO: 565805 - RNA, 19 nt, Homo sapiens
gcacacacacacacacaaa

SEQ ID NO: 565806 - RNA, 19 nt, Homo sapiens
caaugacuuugggaauuua

SEQ ID NO: 565807 - RNA, 19 nt, Homo sapiens
ccacuaugaaugugaauaa

SEQ ID NO: 565808 - RNA, 19 nt, Homo sapiens
gagcuuggccgaccaggaa

SEQ ID NO: 565809 - RNA, 19 nt, Homo sapiens
gaagagaaaagcagagaua

SEQ ID NO: 565810 - RNA, 19 nt, Homo sapiens
ugccugagcuccucccuuu

SEQ ID NO: 565811 - RNA, 19 nt, Homo sapiens
ccaaacaaccggcuacaau

SEQ ID NO: 565812 - RNA, 19 nt, Homo sapiens
gaaaagacuuaacugugaa

SEQ ID NO: 565813 - RNA, 19 nt, Homo sapiens
cuacuaagacaugcuguua

SEQ ID NO: 565814 - RNA, 19 nt, Homo sapiens
ccacagcagaccucaagua

SEQ ID NO: 565815 - RNA, 19 nt, Homo sapiens
gcagggaagugggcacguu

SEQ ID NO: 565816 - RNA, 19 nt, Homo sapiens
cuacaaugcucuuccucuu

SEQ ID NO: 565817 - RNA, 19 nt, Homo sapiens
cagcaugguuguccugaau

SEQ ID NO: 565818 - RNA, 19 nt, Homo sapiens
caaacaaccggcuacaaug

SEQ ID NO: 565819 - RNA, 19 nt, Homo sapiens
gaaaggggauaguggaguu

SEQ ID NO: 565820 - RNA, 19 nt, Homo sapiens
gggaauuuaucuucagcuu

SEQ ID NO: 565821 - RNA, 19 nt, Homo sapiens
gcuccucccuuuucaauaa

SEQ ID NO: 565822 - RNA, 19 nt, Homo sapiens
ggaauuuaucuucagcuuu

SEQ ID NO: 565823 - RNA, 19 nt, Homo sapiens
gcacaugggcagcucuguu

SEQ ID NO: 565824 - RNA, 19 nt, Homo sapiens
gugcaggcauucucacuca

SEQ ID NO: 565825 - RNA, 19 nt, Homo sapiens
gcaccaucuugaccucuug

SEQ ID NO: 565826 - RNA, 19 nt, Homo sapiens
gacaugcuguuaacucagu

SEQ ID NO: 565827 - RNA, 19 nt, Homo sapiens
gcaggacaacuuauaaugg

SEQ ID NO: 565828 - RNA, 19 nt, Homo sapiens
gauuauuagucgugcaugu

SEQ ID NO: 565829 - RNA, 19 nt, Homo sapiens
aauaaaggcaguucauuuc

SEQ ID NO: 565830 - RNA, 19 nt, Homo sapiens
ccacaugcccaaccugaga

SEQ ID NO: 565831 - RNA, 19 nt, Homo sapiens
caaauuccugcuacuaaga

SEQ ID NO: 565832 - RNA, 19 nt, Homo sapiens
gcagccuccuuucuaacuu

SEQ ID NO: 565833 - RNA, 19 nt, Homo sapiens
ccaccugcaggacaacuua

SEQ ID NO: 565834 - RNA, 19 nt, Homo sapiens
acaaauuccugcuacuaag

SEQ ID NO: 565835 - RNA, 19 nt, Homo sapiens
acaaugcucuuccucuucu

SEQ ID NO: 565836 - RNA, 19 nt, Homo sapiens
gaauuuaggaccacugcau

SEQ ID NO: 565837 - RNA, 19 nt, Homo sapiens
cuucuccacugucaucaaa

SEQ ID NO: 565838 - RNA, 19 nt, Homo sapiens
gacccacuaugaaugugaa

SEQ ID NO: 565839 - RNA, 19 nt, Homo sapiens
aaacacacgcgcacgcaaa

SEQ ID NO: 565840 - RNA, 19 nt, Homo sapiens
ccaagcagaggcuagagaa

SEQ ID NO: 565841 - RNA, 19 nt, Homo sapiens
aagacaugcuguuaacuca

SEQ ID NO: 565842 - RNA, 19 nt, Homo sapiens
gaguagggcuuaguuuuau

SEQ ID NO: 565843 - RNA, 19 nt, Homo sapiens
ucugugagcugccuuucau

SEQ ID NO: 565844 - RNA, 19 nt, Homo sapiens
ggugucuccuugguccuua

SEQ ID NO: 565845 - RNA, 19 nt, Homo sapiens
gcagcagcuucuccacugu

SEQ ID NO: 565846 - RNA, 19 nt, Homo sapiens
aaacagcagugaggaagag

SEQ ID NO: 565847 - RNA, 19 nt, Homo sapiens
gcaguucauuuccccaaaa

SEQ ID NO: 565848 - RNA, 19 nt, Homo sapiens
cagccuccuuucuaacuug

SEQ ID NO: 565849 - RNA, 19 nt, Homo sapiens
gcagaccucaaguagaaau

SEQ ID NO: 565850 - RNA, 19 nt, Homo sapiens
gagauggucaccggcauga

SEQ ID NO: 565851 - RNA, 19 nt, Homo sapiens
ggacccacuaugaauguga

SEQ ID NO: 565852 - RNA, 19 nt, Homo sapiens
ucaacagcguucuuccaau

SEQ ID NO: 565853 - RNA, 19 nt, Homo sapiens
cagcagugaggaagagaaa

SEQ ID NO: 565854 - RNA, 19 nt, Homo sapiens
acuaagacaugcuguuaac

SEQ ID NO: 565855 - RNA, 19 nt, Homo sapiens
gaggguggcgucuuuagag

SEQ ID NO: 565856 - RNA, 19 nt, Homo sapiens
ugaguagggcuuaguuuua

SEQ ID NO: 565857 - RNA, 19 nt, Homo sapiens
aaaugucccucauguccau

SEQ ID NO: 565858 - RNA, 19 nt, Homo sapiens
uaagacaugcuguuaacuc

SEQ ID NO: 565859 - RNA, 19 nt, Homo sapiens
gaaaagcagagauaagcaa

SEQ ID NO: 565860 - RNA, 19 nt, Homo sapiens
ggagacucaugaggacugu

SEQ ID NO: 565861 - RNA, 19 nt, Homo sapiens
gagcacuguuagacacaca

SEQ ID NO: 565862 - RNA, 19 nt, Homo sapiens
accacugcauccugucuua

SEQ ID NO: 565863 - RNA, 19 nt, Homo sapiens
ugaaauggguccaaaaggu

SEQ ID NO: 565864 - RNA, 19 nt, Homo sapiens
aaagggauccagaggugaa

SEQ ID NO: 565865 - RNA, 19 nt, Homo sapiens
cagccgacuuucaucaaca

SEQ ID NO: 565866 - RNA, 19 nt, Homo sapiens
uuucaugucugcauauugc

SEQ ID NO: 565867 - RNA, 19 nt, Homo sapiens
uuucuuucaugucugcaua

SEQ ID NO: 565868 - RNA, 19 nt, Homo sapiens
gcuccucuucucaguguuu

SEQ ID NO: 565869 - RNA, 19 nt, Homo sapiens
aagcagaggcuagagaaga

SEQ ID NO: 565870 - RNA, 19 nt, Homo sapiens
ucaucaaacuggccauguc

SEQ ID NO: 565871 - RNA, 19 nt, Homo sapiens
cuuucuacccuguggauua

SEQ ID NO: 565872 - RNA, 19 nt, Homo sapiens
caaacagcagugaggaaga

SEQ ID NO: 565873 - RNA, 19 nt, Homo sapiens
uguacgaagcuauuuaaug

SEQ ID NO: 565874 - RNA, 19 nt, Homo sapiens
gaccucaaguagaaauugc

SEQ ID NO: 565875 - RNA, 19 nt, Homo sapiens
ggcaccaucuugaccucuu

SEQ ID NO: 565876 - RNA, 19 nt, Homo sapiens
caccaaccuuugugugaca

SEQ ID NO: 565877 - RNA, 19 nt, Homo sapiens
gcaagcagggacagaaagg

SEQ ID NO: 565878 - RNA, 19 nt, Homo sapiens
gacuuuggcuaccugacau

SEQ ID NO: 565879 - RNA, 19 nt, Homo sapiens
cgcagcagccuccuuucua

SEQ ID NO: 565880 - RNA, 19 nt, Homo sapiens
gaggcaagcagggacagaa

SEQ ID NO: 565881 - RNA, 19 nt, Homo sapiens
ccagcaugguuguccugaa

SEQ ID NO: 565882 - RNA, 19 nt, Homo sapiens
cauauugcauagccuuguc

SEQ ID NO: 565883 - RNA, 19 nt, Homo sapiens
gaaacgugcaggcauucuc

SEQ ID NO: 565884 - RNA, 19 nt, Homo sapiens
ccacaggaagaccaggaaa

SEQ ID NO: 565885 - RNA, 19 nt, Homo sapiens
aaggugaaauggguccaaa

SEQ ID NO: 565886 - RNA, 19 nt, Homo sapiens
gaggaccaaugggcuccaa

SEQ ID NO: 565887 - RNA, 19 nt, Homo sapiens
gcaggcauucucacucaca

SEQ ID NO: 565888 - RNA, 19 nt, Homo sapiens
ugugacggcucugacuuug

SEQ ID NO: 565889 - RNA, 19 nt, Homo sapiens
gggcagaaaggugaaaugg

SEQ ID NO: 565890 - RNA, 19 nt, Homo sapiens
cagcguucuuccaaucuca

SEQ ID NO: 565891 - RNA, 19 nt, Homo sapiens
cggcucuugugguuucaaa

SEQ ID NO: 565892 - RNA, 19 nt, Homo sapiens
acacacacacacacaaaca

SEQ ID NO: 565893 - RNA, 19 nt, Homo sapiens
aaacgugcaggcauucuca

SEQ ID NO: 565894 - RNA, 19 nt, Homo sapiens
guacgaagcuauuuaauga

SEQ ID NO: 565895 - RNA, 19 nt, Homo sapiens
cagcagaccucaaguagaa

SEQ ID NO: 565896 - RNA, 19 nt, Homo sapiens
ggaaagacaucuccaaggu

SEQ ID NO: 565897 - RNA, 19 nt, Homo sapiens
ggaaaagacuuaacuguga

SEQ ID NO: 565898 - RNA, 19 nt, Homo sapiens
ggacuuggcugagcacugu

SEQ ID NO: 565899 - RNA, 19 nt, Homo sapiens
uuucaggacugcucuguua

SEQ ID NO: 565900 - RNA, 19 nt, Homo sapiens
ggauguggcugcccaggaa

SEQ ID NO: 565901 - RNA, 19 nt, Homo sapiens
ggacaaauuccugcuacua

SEQ ID NO: 565902 - RNA, 19 nt, Homo sapiens
uuaaugagccugugucuug

SEQ ID NO: 565903 - RNA, 19 nt, Homo sapiens
gacaaauuccugcuacuaa

SEQ ID NO: 565904 - RNA, 19 nt, Homo sapiens
gcucaucugcucaucauuu

SEQ ID NO: 565905 - RNA, 19 nt, Homo sapiens
ccacuaugaaugugaauaa

SEQ ID NO: 565906 - RNA, 19 nt, Homo sapiens
gagcuuggccgaccaggaa

SEQ ID NO: 565907 - RNA, 19 nt, Homo sapiens
ugccugagcuccucccuuu

SEQ ID NO: 565908 - RNA, 19 nt, Homo sapiens
ccaaacaaccggcuacaau

SEQ ID NO: 565909 - RNA, 19 nt, Homo sapiens
gaaaagacuuaacugugaa

SEQ ID NO: 565910 - RNA, 19 nt, Homo sapiens
cuacuaagacaugcuguua

SEQ ID NO: 565911 - RNA, 19 nt, Homo sapiens
ccacagcagaccucaagua

SEQ ID NO: 565912 - RNA, 19 nt, Homo sapiens
gcagggaagugggcacguu

SEQ ID NO: 565913 - RNA, 19 nt, Homo sapiens
cuacaaugcucuuccucuu

SEQ ID NO: 565914 - RNA, 19 nt, Homo sapiens
caaacaaccggcuacaaug

SEQ ID NO: 565915 - RNA, 19 nt, Homo sapiens
gaaaggggauaguggaguu

SEQ ID NO: 565916 - RNA, 19 nt, Homo sapiens
gcuccucccuuuucaauaa

SEQ ID NO: 565917 - RNA, 19 nt, Homo sapiens
gcacaugggcagcucuguu

SEQ ID NO: 565918 - RNA, 19 nt, Homo sapiens
gugcaggcauucucacuca

SEQ ID NO: 565919 - RNA, 19 nt, Homo sapiens
gcaccaucuugaccucuug

SEQ ID NO: 565920 - RNA, 19 nt, Homo sapiens
gacaugcuguuaacucagu

SEQ ID NO: 565921 - RNA, 19 nt, Homo sapiens
gcaggacaacuuauaaugg

SEQ ID NO: 565922 - RNA, 19 nt, Homo sapiens
gauuauuagucgugcaugu

SEQ ID NO: 565923 - RNA, 19 nt, Homo sapiens
aauaaaggcaguucauuuc

SEQ ID NO: 565924 - RNA, 19 nt, Homo sapiens
ccacaugcccaaccugaga

SEQ ID NO: 565925 - RNA, 19 nt, Homo sapiens
caaauuccugcuacuaaga

SEQ ID NO: 565926 - RNA, 19 nt, Homo sapiens
ccaccugcaggacaacuua

SEQ ID NO: 565927 - RNA, 19 nt, Homo sapiens
acaaauuccugcuacuaag

SEQ ID NO: 565928 - RNA, 19 nt, Homo sapiens
acaaugcucuuccucuucu

SEQ ID NO: 565929 - RNA, 19 nt, Homo sapiens
gaauuuaggaccacugcau

SEQ ID NO: 565930 - RNA, 19 nt, Homo sapiens
cuucuccacugucaucaaa

SEQ ID NO: 565931 - RNA, 19 nt, Homo sapiens
gacccacuaugaaugugaa

SEQ ID NO: 565932 - RNA, 19 nt, Homo sapiens
ccaagcagaggcuagagaa

SEQ ID NO: 565933 - RNA, 19 nt, Homo sapiens
aagacaugcuguuaacuca

SEQ ID NO: 565934 - RNA, 19 nt, Homo sapiens
gaguagggcuuaguuuuau

SEQ ID NO: 565935 - RNA, 19 nt, Homo sapiens
ucugugagcugccuuucau

SEQ ID NO: 565936 - RNA, 19 nt, Homo sapiens
ggugucuccuugguccuua

SEQ ID NO: 565937 - RNA, 19 nt, Homo sapiens
gcagcagcuucuccacugu

SEQ ID NO: 565938 - RNA, 19 nt, Homo sapiens
gcaguucauuuccccaaaa

SEQ ID NO: 565939 - RNA, 19 nt, Homo sapiens
gcagaccucaaguagaaau

SEQ ID NO: 565940 - RNA, 19 nt, Homo sapiens
gagauggucaccggcauga

SEQ ID NO: 565941 - RNA, 19 nt, Homo sapiens
ggacccacuaugaauguga

SEQ ID NO: 565942 - RNA, 19 nt, Homo sapiens
acuaagacaugcuguuaac

SEQ ID NO: 565943 - RNA, 19 nt, Homo sapiens
gaggguggcgucuuuagag

SEQ ID NO: 565944 - RNA, 19 nt, Homo sapiens
ugaguagggcuuaguuuua

SEQ ID NO: 565945 - RNA, 19 nt, Homo sapiens
aaaugucccucauguccau

SEQ ID NO: 565946 - RNA, 19 nt, Homo sapiens
uaagacaugcuguuaacuc

SEQ ID NO: 565947 - RNA, 19 nt, Homo sapiens
ggagacucaugaggacugu

SEQ ID NO: 565948 - RNA, 19 nt, Homo sapiens
gagcacuguuagacacaca

SEQ ID NO: 565949 - RNA, 19 nt, Homo sapiens
accacugcauccugucuua

SEQ ID NO: 565950 - RNA, 19 nt, Homo sapiens
ugaaauggguccaaaaggu

SEQ ID NO: 565951 - RNA, 19 nt, Homo sapiens
aaagggauccagaggugaa

SEQ ID NO: 565952 - RNA, 19 nt, Homo sapiens
uuucaugucugcauauugc

SEQ ID NO: 565953 - RNA, 19 nt, Homo sapiens
uuucuuucaugucugcaua

SEQ ID NO: 565954 - RNA, 19 nt, Homo sapiens
gcuccucuucucaguguuu

SEQ ID NO: 565955 - RNA, 19 nt, Homo sapiens
aagcagaggcuagagaaga

SEQ ID NO: 565956 - RNA, 19 nt, Homo sapiens
ucaucaaacuggccauguc

SEQ ID NO: 565957 - RNA, 19 nt, Homo sapiens
cuuucuacccuguggauua

SEQ ID NO: 565958 - RNA, 19 nt, Homo sapiens
uguacgaagcuauuuaaug

SEQ ID NO: 565959 - RNA, 19 nt, Homo sapiens
gaccucaaguagaaauugc

SEQ ID NO: 565960 - RNA, 19 nt, Homo sapiens
ggcaccaucuugaccucuu

SEQ ID NO: 565961 - RNA, 19 nt, Homo sapiens
caccaaccuuugugugaca

SEQ ID NO: 565962 - RNA, 19 nt, Homo sapiens
gcaagcagggacagaaagg

SEQ ID NO: 565963 - RNA, 19 nt, Homo sapiens
gacuuuggcuaccugacau

SEQ ID NO: 565964 - RNA, 19 nt, Homo sapiens
gaggcaagcagggacagaa

SEQ ID NO: 565965 - RNA, 19 nt, Homo sapiens
cauauugcauagccuuguc

SEQ ID NO: 565966 - RNA, 19 nt, Homo sapiens
gaaacgugcaggcauucuc

SEQ ID NO: 565967 - RNA, 19 nt, Homo sapiens
gaggaccaaugggcuccaa

SEQ ID NO: 565968 - RNA, 19 nt, Homo sapiens
ccacaggaagaccaggaaa

SEQ ID NO: 565969 - RNA, 19 nt, Homo sapiens
aaggugaaauggguccaaa

SEQ ID NO: 565970 - RNA, 19 nt, Homo sapiens
ucgcucaucugcucaucau

SEQ ID NO: 565971 - RNA, 19 nt, Homo sapiens
gcaggcauucucacucaca

SEQ ID NO: 565972 - RNA, 19 nt, Homo sapiens
ugugacggcucugacuuug

SEQ ID NO: 565973 - RNA, 19 nt, Homo sapiens
gggcagaaaggugaaaugg

SEQ ID NO: 565974 - RNA, 19 nt, Homo sapiens
cggcucuugugguuucaaa

SEQ ID NO: 565975 - RNA, 19 nt, Homo sapiens
aaacgugcaggcauucuca

SEQ ID NO: 565976 - RNA, 19 nt, Homo sapiens
ugacaugcgagaccuaucu

SEQ ID NO: 565977 - RNA, 19 nt, Homo sapiens
ccugcaggacaacuuauaa

SEQ ID NO: 565978 - RNA, 19 nt, Homo sapiens
cacaugggcagcucuguuc

SEQ ID NO: 565979 - RNA, 19 nt, Homo sapiens
accgaaacgugcaggcauu

SEQ ID NO: 565980 - RNA, 19 nt, Homo sapiens
aaacaaccggcuacaaugc

SEQ ID NO: 565981 - RNA, 19 nt, Homo sapiens
gagcuugagaggcugaaca

SEQ ID NO: 565982 - RNA, 19 nt, Homo sapiens
ccgaggacccacaggaaga

SEQ ID NO: 565983 - RNA, 19 nt, Homo sapiens
cuaggccuaugaaccacaa

SEQ ID NO: 565984 - RNA, 19 nt, Homo sapiens
ccacugcauccugucuuaa

SEQ ID NO: 565985 - RNA, 19 nt, Homo sapiens
gcuacuaagacaugcuguu

SEQ ID NO: 565986 - RNA, 19 nt, Homo sapiens
gagaggcugaacacccaaa

SEQ ID NO: 565987 - RNA, 19 nt, Homo sapiens
caacaaccaggaggagcuu

SEQ ID NO: 565988 - RNA, 19 nt, Homo sapiens
caaaggggaaagaggauuu

SEQ ID NO: 565989 - RNA, 19 nt, Homo sapiens
cacagcagaccucaaguag

SEQ ID NO: 565990 - RNA, 19 nt, Homo sapiens
gcauauugcauagccuugu

SEQ ID NO: 565991 - RNA, 19 nt, Homo sapiens
aggcuccucuucucagugu

SEQ ID NO: 565992 - RNA, 19 nt, Homo sapiens
cccgcgaguuccugugauu

SEQ ID NO: 565993 - RNA, 19 nt, Homo sapiens
ccagacaugaagaaucuca

SEQ ID NO: 565994 - RNA, 19 nt, Homo sapiens
guacgaagcuauuuaauga

SEQ ID NO: 565995 - RNA, 19 nt, Homo sapiens
cagcagaccucaaguagaa

SEQ ID NO: 565996 - RNA, 19 nt, Homo sapiens
ggaaagacaucuccaaggu

SEQ ID NO: 565997 - RNA, 19 nt, Homo sapiens
gcagcagccuccuuucuaa

SEQ ID NO: 565998 - RNA, 19 nt, Homo sapiens
ggaaaagacuuaacuguga

SEQ ID NO: 565999 - RNA, 19 nt, Homo sapiens
ggacuuggcugagcacugu

SEQ ID NO: 566000 - RNA, 19 nt, Homo sapiens
ggauguggcugcccaggaa

SEQ ID NO: 566001 - RNA, 19 nt, Homo sapiens
ggacaaauuccugcuacua

SEQ ID NO: 566002 - RNA, 19 nt, Homo sapiens
uuaaugagccugugucuug

SEQ ID NO: 566003 - RNA, 19 nt, Homo sapiens
gacaaauuccugcuacuaa

SEQ ID NO: 566004 - RNA, 19 nt, Homo sapiens
gcacacacacacacacaaa

SEQ ID NO: 566005 - RNA, 19 nt, Homo sapiens
caaugacuuugggaauuua

SEQ ID NO: 566006 - RNA, 19 nt, Homo sapiens
ccacuaugaaugugaauaa

SEQ ID NO: 566007 - RNA, 19 nt, Homo sapiens
gagcuuggccgaccaggaa

SEQ ID NO: 566008 - RNA, 19 nt, Homo sapiens
gaagagaaaagcagagaua

SEQ ID NO: 566009 - RNA, 19 nt, Homo sapiens
ugccugagcuccucccuuu

SEQ ID NO: 566010 - RNA, 19 nt, Homo sapiens
ccaaacaaccggcuacaau

SEQ ID NO: 566011 - RNA, 19 nt, Homo sapiens
gaaaagacuuaacugugaa

SEQ ID NO: 566012 - RNA, 19 nt, Homo sapiens
cuacuaagacaugcuguua

SEQ ID NO: 566013 - RNA, 19 nt, Homo sapiens
ccacagcagaccucaagua

SEQ ID NO: 566014 - RNA, 19 nt, Homo sapiens
gcagggaagugggcacguu

SEQ ID NO: 566015 - RNA, 19 nt, Homo sapiens
cuacaaugcucuuccucuu

SEQ ID NO: 566016 - RNA, 19 nt, Homo sapiens
cagcaugguuguccugaau

SEQ ID NO: 566017 - RNA, 19 nt, Homo sapiens
caaacaaccggcuacaaug

SEQ ID NO: 566018 - RNA, 19 nt, Homo sapiens
gaaaggggauaguggaguu

SEQ ID NO: 566019 - RNA, 19 nt, Homo sapiens
gggaauuuaucuucagcuu

SEQ ID NO: 566020 - RNA, 19 nt, Homo sapiens
gcuccucccuuuucaauaa

SEQ ID NO: 566021 - RNA, 19 nt, Homo sapiens
ggaauuuaucuucagcuuu

SEQ ID NO: 566022 - RNA, 19 nt, Homo sapiens
gcacaugggcagcucuguu

SEQ ID NO: 566023 - RNA, 19 nt, Homo sapiens
gugcaggcauucucacuca

SEQ ID NO: 566024 - RNA, 19 nt, Homo sapiens
caacagcguucuuuucuuc

SEQ ID NO: 566025 - RNA, 19 nt, Homo sapiens
gcaccaucuugaccucuug

SEQ ID NO: 566026 - RNA, 19 nt, Homo sapiens
gacaugcuguuaacucagu

SEQ ID NO: 566027 - RNA, 19 nt, Homo sapiens
gcaggacaacuuauaaugg

SEQ ID NO: 566028 - RNA, 19 nt, Homo sapiens
gauuauuagucgugcaugu

SEQ ID NO: 566029 - RNA, 19 nt, Homo sapiens
aauaaaggcaguucauuuc

SEQ ID NO: 566030 - RNA, 19 nt, Homo sapiens
ccacaugcccaaccugaga

SEQ ID NO: 566031 - RNA, 19 nt, Homo sapiens
caaauuccugcuacuaaga

SEQ ID NO: 566032 - RNA, 19 nt, Homo sapiens
gcagccuccuuucuaacuu

SEQ ID NO: 566033 - RNA, 19 nt, Homo sapiens
ccaccugcaggacaacuua

SEQ ID NO: 566034 - RNA, 19 nt, Homo sapiens
acaaauuccugcuacuaag

SEQ ID NO: 566035 - RNA, 19 nt, Homo sapiens
acaaugcucuuccucuucu

SEQ ID NO: 566036 - RNA, 19 nt, Homo sapiens
gaauuuaggaccacugcau

SEQ ID NO: 566037 - RNA, 19 nt, Homo sapiens
aaacacacgcgcacgcaaa

SEQ ID NO: 566038 - RNA, 19 nt, Homo sapiens
cuucuccacugucaucaaa

SEQ ID NO: 566039 - RNA, 19 nt, Homo sapiens
gacccacuaugaaugugaa

SEQ ID NO: 566040 - RNA, 19 nt, Homo sapiens
ccaagcagaggcuagagaa

SEQ ID NO: 566041 - RNA, 19 nt, Homo sapiens
aagacaugcuguuaacuca

SEQ ID NO: 566042 - RNA, 19 nt, Homo sapiens
gaguagggcuuaguuuuau

SEQ ID NO: 566043 - RNA, 19 nt, Homo sapiens
ucugugagcugccuuucau

SEQ ID NO: 566044 - RNA, 19 nt, Homo sapiens
ggugucuccuugguccuua

SEQ ID NO: 566045 - RNA, 19 nt, Homo sapiens
gcagcagcuucuccacugu

SEQ ID NO: 566046 - RNA, 19 nt, Homo sapiens
aaacagcagugaggaagag

SEQ ID NO: 566047 - RNA, 19 nt, Homo sapiens
gcaguucauuuccccaaaa

SEQ ID NO: 566048 - RNA, 19 nt, Homo sapiens
cagccuccuuucuaacuug

SEQ ID NO: 566049 - RNA, 19 nt, Homo sapiens
gcagaccucaaguagaaau

SEQ ID NO: 566050 - RNA, 19 nt, Homo sapiens
gagauggucaccggcauga

SEQ ID NO: 566051 - RNA, 19 nt, Homo sapiens
ggacccacuaugaauguga

SEQ ID NO: 566052 - RNA, 19 nt, Homo sapiens
cagcagugaggaagagaaa

SEQ ID NO: 566053 - RNA, 19 nt, Homo sapiens
acuaagacaugcuguuaac

SEQ ID NO: 566054 - RNA, 19 nt, Homo sapiens
gaggguggcgucuuuagag

SEQ ID NO: 566055 - RNA, 19 nt, Homo sapiens
ugaguagggcuuaguuuua

SEQ ID NO: 566056 - RNA, 19 nt, Homo sapiens
aaaugucccucauguccau

SEQ ID NO: 566057 - RNA, 19 nt, Homo sapiens
uaagacaugcuguuaacuc

SEQ ID NO: 566058 - RNA, 19 nt, Homo sapiens
ggagacucaugaggacugu

SEQ ID NO: 566059 - RNA, 19 nt, Homo sapiens
gaaaagcagagauaagcaa

SEQ ID NO: 566060 - RNA, 19 nt, Homo sapiens
gagcacuguuagacacaca

SEQ ID NO: 566061 - RNA, 19 nt, Homo sapiens
accacugcauccugucuua

SEQ ID NO: 566062 - RNA, 19 nt, Homo sapiens
ugaaauggguccaaaaggu

SEQ ID NO: 566063 - RNA, 19 nt, Homo sapiens
aaagggauccagaggugaa

SEQ ID NO: 566064 - RNA, 19 nt, Homo sapiens
cagccgacuuucaucaaca

SEQ ID NO: 566065 - RNA, 19 nt, Homo sapiens
uuucaugucugcauauugc

SEQ ID NO: 566066 - RNA, 19 nt, Homo sapiens
uuucuuucaugucugcaua

SEQ ID NO: 566067 - RNA, 19 nt, Homo sapiens
gcuccucuucucaguguuu

SEQ ID NO: 566068 - RNA, 19 nt, Homo sapiens
aagcagaggcuagagaaga

SEQ ID NO: 566069 - RNA, 19 nt, Homo sapiens
ucaucaaacuggccauguc

SEQ ID NO: 566070 - RNA, 19 nt, Homo sapiens
cuuucuacccuguggauua

SEQ ID NO: 566071 - RNA, 19 nt, Homo sapiens
caaacagcagugaggaaga

SEQ ID NO: 566072 - RNA, 19 nt, Homo sapiens
uguacgaagcuauuuaaug

SEQ ID NO: 566073 - RNA, 19 nt, Homo sapiens
gaccucaaguagaaauugc

SEQ ID NO: 566074 - RNA, 19 nt, Homo sapiens
ggcaccaucuugaccucuu

SEQ ID NO: 566075 - RNA, 19 nt, Homo sapiens
caccaaccuuugugugaca

SEQ ID NO: 566076 - RNA, 19 nt, Homo sapiens
gcaagcagggacagaaagg

SEQ ID NO: 566077 - RNA, 19 nt, Homo sapiens
gacuuuggcuaccugacau

SEQ ID NO: 566078 - RNA, 19 nt, Homo sapiens
ccagcaugguuguccugaa

SEQ ID NO: 566079 - RNA, 19 nt, Homo sapiens
cgcagcagccuccuuucua

SEQ ID NO: 566080 - RNA, 19 nt, Homo sapiens
gaggcaagcagggacagaa

SEQ ID NO: 566081 - RNA, 19 nt, Homo sapiens
cauauugcauagccuuguc

SEQ ID NO: 566082 - RNA, 19 nt, Homo sapiens
gaaacgugcaggcauucuc

SEQ ID NO: 566083 - RNA, 19 nt, Homo sapiens
ccacaggaagaccaggaaa

SEQ ID NO: 566084 - RNA, 19 nt, Homo sapiens
aaggugaaauggguccaaa

SEQ ID NO: 566085 - RNA, 19 nt, Homo sapiens
gaggaccaaugggcuccaa

SEQ ID NO: 566086 - RNA, 19 nt, Homo sapiens
gcaggcauucucacucaca

SEQ ID NO: 566087 - RNA, 19 nt, Homo sapiens
ugugacggcucugacuuug

SEQ ID NO: 566088 - RNA, 19 nt, Homo sapiens
gggcagaaaggugaaaugg

SEQ ID NO: 566089 - RNA, 19 nt, Homo sapiens
cggcucuugugguuucaaa

SEQ ID NO: 566090 - RNA, 19 nt, Homo sapiens
acacacacacacacaaaca

SEQ ID NO: 566091 - RNA, 19 nt, Homo sapiens
aaacgugcaggcauucuca

SEQ ID NO: 566092 - RNA, 19 nt, Homo sapiens
gacccuggccagcaugguu

SEQ ID NO: 566093 - RNA, 19 nt, Homo sapiens
ugacaugcgagaccuaucu

SEQ ID NO: 566094 - RNA, 19 nt, Homo sapiens
guacgaagcuauuuaauga

SEQ ID NO: 566095 - RNA, 19 nt, Homo sapiens
cagcagaccucaaguagaa

SEQ ID NO: 566096 - RNA, 19 nt, Homo sapiens
ggaaagacaucuccaaggu

SEQ ID NO: 566097 - RNA, 19 nt, Homo sapiens
gcagcagccuccuuucuaa

SEQ ID NO: 566098 - RNA, 19 nt, Homo sapiens
ggaaaagacuuaacuguga

SEQ ID NO: 566099 - RNA, 19 nt, Homo sapiens
ggacuuggcugagcacugu

SEQ ID NO: 566100 - RNA, 19 nt, Homo sapiens
ggauguggcugcccaggaa

SEQ ID NO: 566101 - RNA, 19 nt, Homo sapiens
caacagcguucuuccaauc

SEQ ID NO: 566102 - RNA, 19 nt, Homo sapiens
ggacaaauuccugcuacua

SEQ ID NO: 566103 - RNA, 19 nt, Homo sapiens
uuaaugagccugugucuug

SEQ ID NO: 566104 - RNA, 19 nt, Homo sapiens
gacaaauuccugcuacuaa

SEQ ID NO: 566105 - RNA, 19 nt, Homo sapiens
gcacacacacacacacaaa

SEQ ID NO: 566106 - RNA, 19 nt, Homo sapiens
caaugacuuugggaauuua

SEQ ID NO: 566107 - RNA, 19 nt, Homo sapiens
ccacuaugaaugugaauaa

SEQ ID NO: 566108 - RNA, 19 nt, Homo sapiens
gagcuuggccgaccaggaa

SEQ ID NO: 566109 - RNA, 19 nt, Homo sapiens
gaagagaaaagcagagaua

SEQ ID NO: 566110 - RNA, 19 nt, Homo sapiens
ugccugagcuccucccuuu

SEQ ID NO: 566111 - RNA, 19 nt, Homo sapiens
ccaaacaaccggcuacaau

SEQ ID NO: 566112 - RNA, 19 nt, Homo sapiens
gaaaagacuuaacugugaa

SEQ ID NO: 566113 - RNA, 19 nt, Homo sapiens
cuacuaagacaugcuguua

SEQ ID NO: 566114 - RNA, 19 nt, Homo sapiens
ccacagcagaccucaagua

SEQ ID NO: 566115 - RNA, 19 nt, Homo sapiens
gcagggaagugggcacguu

SEQ ID NO: 566116 - RNA, 19 nt, Homo sapiens
cuacaaugcucuuccucuu

SEQ ID NO: 566117 - RNA, 19 nt, Homo sapiens
cagcaugguuguccugaau

SEQ ID NO: 566118 - RNA, 19 nt, Homo sapiens
gaaguccggacaugaagaa

SEQ ID NO: 566119 - RNA, 19 nt, Homo sapiens
caaacaaccggcuacaaug

SEQ ID NO: 566120 - RNA, 19 nt, Homo sapiens
gaaaggggauaguggaguu

SEQ ID NO: 566121 - RNA, 19 nt, Homo sapiens
gggaauuuaucuucagcuu

SEQ ID NO: 566122 - RNA, 19 nt, Homo sapiens
gcuccucccuuuucaauaa

SEQ ID NO: 566123 - RNA, 19 nt, Homo sapiens
ggaauuuaucuucagcuuu

SEQ ID NO: 566124 - RNA, 19 nt, Homo sapiens
gcacaugggcagcucuguu

SEQ ID NO: 566125 - RNA, 19 nt, Homo sapiens
gugcaggcauucucacuca

SEQ ID NO: 566126 - RNA, 19 nt, Homo sapiens
gcaccaucuugaccucuug

SEQ ID NO: 566127 - RNA, 19 nt, Homo sapiens
gacaugcuguuaacucagu

SEQ ID NO: 566128 - RNA, 19 nt, Homo sapiens
gcaggacaacuuauaaugg

SEQ ID NO: 566129 - RNA, 19 nt, Homo sapiens
gauuauuagucgugcaugu

SEQ ID NO: 566130 - RNA, 19 nt, Homo sapiens
aauaaaggcaguucauuuc

SEQ ID NO: 566131 - RNA, 19 nt, Homo sapiens
ccacaugcccaaccugaga

SEQ ID NO: 566132 - RNA, 19 nt, Homo sapiens
gcagccuccuuucuaacuu

SEQ ID NO: 566133 - RNA, 19 nt, Homo sapiens
caaauuccugcuacuaaga

SEQ ID NO: 566134 - RNA, 19 nt, Homo sapiens
ccaccugcaggacaacuua

SEQ ID NO: 566135 - RNA, 19 nt, Homo sapiens
acaaauuccugcuacuaag

SEQ ID NO: 566136 - RNA, 19 nt, Homo sapiens
acaaugcucuuccucuucu

SEQ ID NO: 566137 - RNA, 19 nt, Homo sapiens
gaauuuaggaccacugcau

SEQ ID NO: 566138 - RNA, 19 nt, Homo sapiens
cuucuccacugucaucaaa

SEQ ID NO: 566139 - RNA, 19 nt, Homo sapiens
gacccacuaugaaugugaa

SEQ ID NO: 566140 - RNA, 19 nt, Homo sapiens
aaacacacgcgcacgcaaa

SEQ ID NO: 566141 - RNA, 19 nt, Homo sapiens
ccaagcagaggcuagagaa

SEQ ID NO: 566142 - RNA, 19 nt, Homo sapiens
aagacaugcuguuaacuca

SEQ ID NO: 566143 - RNA, 19 nt, Homo sapiens
guccggacaugaagaaucu

SEQ ID NO: 566144 - RNA, 19 nt, Homo sapiens
gaguagggcuuaguuuuau

SEQ ID NO: 566145 - RNA, 19 nt, Homo sapiens
ucugugagcugccuuucau

SEQ ID NO: 566146 - RNA, 19 nt, Homo sapiens
ggugucuccuugguccuua

SEQ ID NO: 566147 - RNA, 19 nt, Homo sapiens
gcagcagcuucuccacugu

SEQ ID NO: 566148 - RNA, 19 nt, Homo sapiens
aaacagcagugaggaagag

SEQ ID NO: 566149 - RNA, 19 nt, Homo sapiens
gcaguucauuuccccaaaa

SEQ ID NO: 566150 - RNA, 19 nt, Homo sapiens
cagccuccuuucuaacuug

SEQ ID NO: 566151 - RNA, 19 nt, Homo sapiens
gcagaccucaaguagaaau

SEQ ID NO: 566152 - RNA, 19 nt, Homo sapiens
gagauggucaccggcauga

SEQ ID NO: 566153 - RNA, 19 nt, Homo sapiens
ggacccacuaugaauguga

SEQ ID NO: 566154 - RNA, 19 nt, Homo sapiens
ucaacagcguucuuccaau

SEQ ID NO: 566155 - RNA, 19 nt, Homo sapiens
cagcagugaggaagagaaa

SEQ ID NO: 566156 - RNA, 19 nt, Homo sapiens
acuaagacaugcuguuaac

SEQ ID NO: 566157 - RNA, 19 nt, Homo sapiens
gaggguggcgucuuuagag

SEQ ID NO: 566158 - RNA, 19 nt, Homo sapiens
ugaguagggcuuaguuuua

SEQ ID NO: 566159 - RNA, 19 nt, Homo sapiens
aaaugucccucauguccau

SEQ ID NO: 566160 - RNA, 19 nt, Homo sapiens
uaagacaugcuguuaacuc

SEQ ID NO: 566161 - RNA, 19 nt, Homo sapiens
ggagacucaugaggacugu

SEQ ID NO: 566162 - RNA, 19 nt, Homo sapiens
gaaaagcagagauaagcaa

SEQ ID NO: 566163 - RNA, 19 nt, Homo sapiens
gagcacuguuagacacaca

SEQ ID NO: 566164 - RNA, 19 nt, Homo sapiens
accacugcauccugucuua

SEQ ID NO: 566165 - RNA, 19 nt, Homo sapiens
ugaaauggguccaaaaggu

SEQ ID NO: 566166 - RNA, 19 nt, Homo sapiens
aaagggauccagaggugaa

SEQ ID NO: 566167 - RNA, 19 nt, Homo sapiens
gccgaaguccggacaugaa

SEQ ID NO: 566168 - RNA, 19 nt, Homo sapiens
cagccgacuuucaucaaca

SEQ ID NO: 566169 - RNA, 19 nt, Homo sapiens
uuucaugucugcauauugc

SEQ ID NO: 566170 - RNA, 19 nt, Homo sapiens
uuucuuucaugucugcaua

SEQ ID NO: 566171 - RNA, 19 nt, Homo sapiens
gcuccucuucucaguguuu

SEQ ID NO: 566172 - RNA, 19 nt, Homo sapiens
aagcagaggcuagagaaga

SEQ ID NO: 566173 - RNA, 19 nt, Homo sapiens
ucaucaaacuggccauguc

SEQ ID NO: 566174 - RNA, 19 nt, Homo sapiens
cuuucuacccuguggauua

SEQ ID NO: 566175 - RNA, 19 nt, Homo sapiens
caaacagcagugaggaaga

SEQ ID NO: 566176 - RNA, 19 nt, Homo sapiens
uguacgaagcuauuuaaug

SEQ ID NO: 566177 - RNA, 19 nt, Homo sapiens
gaccucaaguagaaauugc

SEQ ID NO: 566178 - RNA, 19 nt, Homo sapiens
ggcaccaucuugaccucuu

SEQ ID NO: 566179 - RNA, 19 nt, Homo sapiens
caccaaccuuugugugaca

SEQ ID NO: 566180 - RNA, 19 nt, Homo sapiens
gcaagcagggacagaaagg

SEQ ID NO: 566181 - RNA, 19 nt, Homo sapiens
cgcagcagccuccuuucua

SEQ ID NO: 566182 - RNA, 19 nt, Homo sapiens
gacuuuggcuaccugacau

SEQ ID NO: 566183 - RNA, 19 nt, Homo sapiens
ccagcaugguuguccugaa

SEQ ID NO: 566184 - RNA, 19 nt, Homo sapiens
gaggcaagcagggacagaa

SEQ ID NO: 566185 - RNA, 19 nt, Homo sapiens
cauauugcauagccuuguc

SEQ ID NO: 566186 - RNA, 19 nt, Homo sapiens
gaaacgugcaggcauucuc

SEQ ID NO: 566187 - RNA, 19 nt, Homo sapiens
ccacaggaagaccaggaaa

SEQ ID NO: 566188 - RNA, 19 nt, Homo sapiens
aaggugaaauggguccaaa

SEQ ID NO: 566189 - RNA, 19 nt, Homo sapiens
gaggaccaaugggcuccaa

SEQ ID NO: 566190 - RNA, 19 nt, Homo sapiens
gcaggcauucucacucaca

SEQ ID NO: 566191 - RNA, 19 nt, Homo sapiens
ugugacggcucugacuuug

SEQ ID NO: 566192 - RNA, 19 nt, Homo sapiens
gggcagaaaggugaaaugg

SEQ ID NO: 566193 - RNA, 19 nt, Homo sapiens
cagcguucuuccaaucuca

SEQ ID NO: 566194 - RNA, 19 nt, Homo sapiens
guacgaagcuauuuaauga

SEQ ID NO: 566195 - RNA, 19 nt, Homo sapiens
cagcagaccucaaguagaa

SEQ ID NO: 566196 - RNA, 19 nt, Homo sapiens
ggaaagacaucuccaaggu

SEQ ID NO: 566197 - RNA, 19 nt, Homo sapiens
gcagcagccuccuuucuaa

SEQ ID NO: 566198 - RNA, 19 nt, Homo sapiens
ggaaaagacuuaacuguga

SEQ ID NO: 566199 - RNA, 19 nt, Homo sapiens
ggacuuggcugagcacugu

SEQ ID NO: 566200 - RNA, 19 nt, Homo sapiens
ggauguggcugcccaggaa

SEQ ID NO: 566201 - RNA, 19 nt, Homo sapiens
caacagcguucuuccaauc

SEQ ID NO: 566202 - RNA, 19 nt, Homo sapiens
ggacaaauuccugcuacua

SEQ ID NO: 566203 - RNA, 19 nt, Homo sapiens
uuaaugagccugugucuug

SEQ ID NO: 566204 - RNA, 19 nt, Homo sapiens
gacaaauuccugcuacuaa

SEQ ID NO: 566205 - RNA, 19 nt, Homo sapiens
gcacacacacacacacaaa

SEQ ID NO: 566206 - RNA, 19 nt, Homo sapiens
caaugacuuugggaauuua

SEQ ID NO: 566207 - RNA, 19 nt, Homo sapiens
ccacuaugaaugugaauaa

SEQ ID NO: 566208 - RNA, 19 nt, Homo sapiens
gaagagaaaagcagagaua

SEQ ID NO: 566209 - RNA, 19 nt, Homo sapiens
ugccugagcuccucccuuu

SEQ ID NO: 566210 - RNA, 19 nt, Homo sapiens
ccaaacaaccggcuacaau

SEQ ID NO: 566211 - RNA, 19 nt, Homo sapiens
gaaaagacuuaacugugaa

SEQ ID NO: 566212 - RNA, 19 nt, Homo sapiens
cuacuaagacaugcuguua

SEQ ID NO: 566213 - RNA, 19 nt, Homo sapiens
ccacagcagaccucaagua

SEQ ID NO: 566214 - RNA, 19 nt, Homo sapiens
gcagggaagugggcacguu

SEQ ID NO: 566215 - RNA, 19 nt, Homo sapiens
cuacaaugcucuuccucuu

SEQ ID NO: 566216 - RNA, 19 nt, Homo sapiens
cagcaugguuguccugaau

SEQ ID NO: 566217 - RNA, 19 nt, Homo sapiens
caaacaaccggcuacaaug

SEQ ID NO: 566218 - RNA, 19 nt, Homo sapiens
gaaaggggauaguggaguu

SEQ ID NO: 566219 - RNA, 19 nt, Homo sapiens
gggaauuuaucuucagcuu

SEQ ID NO: 566220 - RNA, 19 nt, Homo sapiens
gcuccucccuuuucaauaa

SEQ ID NO: 566221 - RNA, 19 nt, Homo sapiens
ggaauuuaucuucagcuuu

SEQ ID NO: 566222 - RNA, 19 nt, Homo sapiens
gcacaugggcagcucuguu

SEQ ID NO: 566223 - RNA, 19 nt, Homo sapiens
gugcaggcauucucacuca

SEQ ID NO: 566224 - RNA, 19 nt, Homo sapiens
gcaccaucuugaccucuug

SEQ ID NO: 566225 - RNA, 19 nt, Homo sapiens
gacaugcuguuaacucagu

SEQ ID NO: 566226 - RNA, 19 nt, Homo sapiens
gcaggacaacuuauaaugg

SEQ ID NO: 566227 - RNA, 19 nt, Homo sapiens
gauuauuagucgugcaugu

SEQ ID NO: 566228 - RNA, 19 nt, Homo sapiens
aauaaaggcaguucauuuc

SEQ ID NO: 566229 - RNA, 19 nt, Homo sapiens
ccacaugcccaaccugaga

SEQ ID NO: 566230 - RNA, 19 nt, Homo sapiens
caaauuccugcuacuaaga

SEQ ID NO: 566231 - RNA, 19 nt, Homo sapiens
gcagccuccuuucuaacuu

SEQ ID NO: 566232 - RNA, 19 nt, Homo sapiens
ccaccugcaggacaacuua

SEQ ID NO: 566233 - RNA, 19 nt, Homo sapiens
acaaauuccugcuacuaag

SEQ ID NO: 566234 - RNA, 19 nt, Homo sapiens
acaaugcucuuccucuucu

SEQ ID NO: 566235 - RNA, 19 nt, Homo sapiens
gaauuuaggaccacugcau

SEQ ID NO: 566236 - RNA, 19 nt, Homo sapiens
cuucuccacugucaucaaa

SEQ ID NO: 566237 - RNA, 19 nt, Homo sapiens
gacccacuaugaaugugaa

SEQ ID NO: 566238 - RNA, 19 nt, Homo sapiens
aaacacacgcgcacgcaaa

SEQ ID NO: 566239 - RNA, 19 nt, Homo sapiens
ccaagcagaggcuagagaa

SEQ ID NO: 566240 - RNA, 19 nt, Homo sapiens
aagacaugcuguuaacuca

SEQ ID NO: 566241 - RNA, 19 nt, Homo sapiens
gaguagggcuuaguuuuau

SEQ ID NO: 566242 - RNA, 19 nt, Homo sapiens
ucugugagcugccuuucau

SEQ ID NO: 566243 - RNA, 19 nt, Homo sapiens
ggugucuccuugguccuua

SEQ ID NO: 566244 - RNA, 19 nt, Homo sapiens
gcagcagcuucuccacugu

SEQ ID NO: 566245 - RNA, 19 nt, Homo sapiens
aaacagcagugaggaagag

SEQ ID NO: 566246 - RNA, 19 nt, Homo sapiens
gcaguucauuuccccaaaa

SEQ ID NO: 566247 - RNA, 19 nt, Homo sapiens
cagccuccuuucuaacuug

SEQ ID NO: 566248 - RNA, 19 nt, Homo sapiens
gcagaccucaaguagaaau

SEQ ID NO: 566249 - RNA, 19 nt, Homo sapiens
gagauggucaccggcauga

SEQ ID NO: 566250 - RNA, 19 nt, Homo sapiens
ggacccacuaugaauguga

SEQ ID NO: 566251 - RNA, 19 nt, Homo sapiens
ucaacagcguucuuccaau

SEQ ID NO: 566252 - RNA, 19 nt, Homo sapiens
cagcagugaggaagagaaa

SEQ ID NO: 566253 - RNA, 19 nt, Homo sapiens
acuaagacaugcuguuaac

SEQ ID NO: 566254 - RNA, 19 nt, Homo sapiens
gaggguggcgucuuuagag

SEQ ID NO: 566255 - RNA, 19 nt, Homo sapiens
ugaguagggcuuaguuuua

SEQ ID NO: 566256 - RNA, 19 nt, Homo sapiens
aaaugucccucauguccau

SEQ ID NO: 566257 - RNA, 19 nt, Homo sapiens
uaagacaugcuguuaacuc

SEQ ID NO: 566258 - RNA, 19 nt, Homo sapiens
ggagacucaugaggacugu

SEQ ID NO: 566259 - RNA, 19 nt, Homo sapiens
gaaaagcagagauaagcaa

SEQ ID NO: 566260 - RNA, 19 nt, Homo sapiens
gagcacuguuagacacaca

SEQ ID NO: 566261 - RNA, 19 nt, Homo sapiens
accacugcauccugucuua

SEQ ID NO: 566262 - RNA, 19 nt, Homo sapiens
ugaaauggguccaaaaggu

SEQ ID NO: 566263 - RNA, 19 nt, Homo sapiens
aaagggauccagaggugaa

SEQ ID NO: 566264 - RNA, 19 nt, Homo sapiens
cagccgacuuucaucaaca

SEQ ID NO: 566265 - RNA, 19 nt, Homo sapiens
uuucaugucugcauauugc

SEQ ID NO: 566266 - RNA, 19 nt, Homo sapiens
uuucuuucaugucugcaua

SEQ ID NO: 566267 - RNA, 19 nt, Homo sapiens
gcuccucuucucaguguuu

SEQ ID NO: 566268 - RNA, 19 nt, Homo sapiens
aagcagaggcuagagaaga

SEQ ID NO: 566269 - RNA, 19 nt, Homo sapiens
ucaucaaacuggccauguc

SEQ ID NO: 566270 - RNA, 19 nt, Homo sapiens
cuuucuacccuguggauua

SEQ ID NO: 566271 - RNA, 19 nt, Homo sapiens
caaacagcagugaggaaga

SEQ ID NO: 566272 - RNA, 19 nt, Homo sapiens
uguacgaagcuauuuaaug

SEQ ID NO: 566273 - RNA, 19 nt, Homo sapiens
gaccucaaguagaaauugc

SEQ ID NO: 566274 - RNA, 19 nt, Homo sapiens
ggcaccaucuugaccucuu

SEQ ID NO: 566275 - RNA, 19 nt, Homo sapiens
caccaaccuuugugugaca

SEQ ID NO: 566276 - RNA, 19 nt, Homo sapiens
gcaagcagggacagaaagg

SEQ ID NO: 566277 - RNA, 19 nt, Homo sapiens
cgcagcagccuccuuucua

SEQ ID NO: 566278 - RNA, 19 nt, Homo sapiens
ccagcaugguuguccugaa

SEQ ID NO: 566279 - RNA, 19 nt, Homo sapiens
gacuuuggcuaccugacau

SEQ ID NO: 566280 - RNA, 19 nt, Homo sapiens
gaggcaagcagggacagaa

SEQ ID NO: 566281 - RNA, 19 nt, Homo sapiens
cauauugcauagccuuguc

SEQ ID NO: 566282 - RNA, 19 nt, Homo sapiens
gaaacgugcaggcauucuc

SEQ ID NO: 566283 - RNA, 19 nt, Homo sapiens
ccacaggaagaccaggaaa

SEQ ID NO: 566284 - RNA, 19 nt, Homo sapiens
aaggugaaauggguccaaa

SEQ ID NO: 566285 - RNA, 19 nt, Homo sapiens
gaggaccaaugggcuccaa

SEQ ID NO: 566286 - RNA, 19 nt, Homo sapiens
gcaggcauucucacucaca

SEQ ID NO: 566287 - RNA, 19 nt, Homo sapiens
ugugacggcucugacuuug

SEQ ID NO: 566288 - RNA, 19 nt, Homo sapiens
gggcagaaaggugaaaugg

SEQ ID NO: 566289 - RNA, 19 nt, Homo sapiens
cagcguucuuccaaucuca

SEQ ID NO: 566290 - RNA, 19 nt, Homo sapiens
cggcucuugugguuucaaa

SEQ ID NO: 566291 - RNA, 19 nt, Homo sapiens
acacacacacacacaaaca

SEQ ID NO: 566292 - RNA, 19 nt, Homo sapiens
aaacgugcaggcauucuca

SEQ ID NO: 566293 - RNA, 19 nt, Homo sapiens
gacccuggccagcaugguu

SEQ ID NO: 566294 - RNA, 19 nt, Homo sapiens
guacgaagcuauuuaauga

SEQ ID NO: 566295 - RNA, 19 nt, Homo sapiens
cagcagaccucaaguagaa

SEQ ID NO: 566296 - RNA, 19 nt, Homo sapiens
ggaaagacaucuccaaggu

SEQ ID NO: 566297 - RNA, 19 nt, Homo sapiens
gcagcagccuccuuucuaa

SEQ ID NO: 566298 - RNA, 19 nt, Homo sapiens
ggaaaagacuuaacuguga

SEQ ID NO: 566299 - RNA, 19 nt, Homo sapiens
ggacuuggcugagcacugu

SEQ ID NO: 566300 - RNA, 19 nt, Homo sapiens
ugaggaagauuacauuuca

SEQ ID NO: 566301 - RNA, 19 nt, Homo sapiens
ggauguggcugcccaggaa

SEQ ID NO: 566302 - RNA, 19 nt, Homo sapiens
caacagcguucuuccaauc

SEQ ID NO: 566303 - RNA, 19 nt, Homo sapiens
ggacaaauuccugcuacua

SEQ ID NO: 566304 - RNA, 19 nt, Homo sapiens
aagaacuccuugcacauua

SEQ ID NO: 566305 - RNA, 19 nt, Homo sapiens
uuaaugagccugugucuug

SEQ ID NO: 566306 - RNA, 19 nt, Homo sapiens
gacaaauuccugcuacuaa

SEQ ID NO: 566307 - RNA, 19 nt, Homo sapiens
gcacacacacacacacaaa

SEQ ID NO: 566308 - RNA, 19 nt, Homo sapiens
caaugacuuugggaauuua

SEQ ID NO: 566309 - RNA, 19 nt, Homo sapiens
ccacuaugaaugugaauaa

SEQ ID NO: 566310 - RNA, 19 nt, Homo sapiens
gagcuuggccgaccaggaa

SEQ ID NO: 566311 - RNA, 19 nt, Homo sapiens
gaagagaaaagcagagaua

SEQ ID NO: 566312 - RNA, 19 nt, Homo sapiens
ugccugagcuccucccuuu

SEQ ID NO: 566313 - RNA, 19 nt, Homo sapiens
ccaaacaaccggcuacaau

SEQ ID NO: 566314 - RNA, 19 nt, Homo sapiens
gaaaagacuuaacugugaa

SEQ ID NO: 566315 - RNA, 19 nt, Homo sapiens
cuacuaagacaugcuguua

SEQ ID NO: 566316 - RNA, 19 nt, Homo sapiens
ccacagcagaccucaagua

SEQ ID NO: 566317 - RNA, 19 nt, Homo sapiens
gcagggaagugggcacguu

SEQ ID NO: 566318 - RNA, 19 nt, Homo sapiens
cuacaaugcucuuccucuu

SEQ ID NO: 566319 - RNA, 19 nt, Homo sapiens
cagcaugguuguccugaau

SEQ ID NO: 566320 - RNA, 19 nt, Homo sapiens
caaacaaccggcuacaaug

SEQ ID NO: 566321 - RNA, 19 nt, Homo sapiens
gaaaggggauaguggaguu

SEQ ID NO: 566322 - RNA, 19 nt, Homo sapiens
gggaauuuaucuucagcuu

SEQ ID NO: 566323 - RNA, 19 nt, Homo sapiens
gcuccucccuuuucaauaa

SEQ ID NO: 566324 - RNA, 19 nt, Homo sapiens
ggaauuuaucuucagcuuu

SEQ ID NO: 566325 - RNA, 19 nt, Homo sapiens
gcacaugggcagcucuguu

SEQ ID NO: 566326 - RNA, 19 nt, Homo sapiens
gugcaggcauucucacuca

SEQ ID NO: 566327 - RNA, 19 nt, Homo sapiens
ccagauuugaggaagauua

SEQ ID NO: 566328 - RNA, 19 nt, Homo sapiens
gcaccaucuugaccucuug

SEQ ID NO: 566329 - RNA, 19 nt, Homo sapiens
gacaugcuguuaacucagu

SEQ ID NO: 566330 - RNA, 19 nt, Homo sapiens
gcaggacaacuuauaaugg

SEQ ID NO: 566331 - RNA, 19 nt, Homo sapiens
gauuauuagucgugcaugu

SEQ ID NO: 566332 - RNA, 19 nt, Homo sapiens
aauaaaggcaguucauuuc

SEQ ID NO: 566333 - RNA, 19 nt, Homo sapiens
gcagccuccuuucuaacuu

SEQ ID NO: 566334 - RNA, 19 nt, Homo sapiens
ccacaugcccaaccugaga

SEQ ID NO: 566335 - RNA, 19 nt, Homo sapiens
caaauuccugcuacuaaga

SEQ ID NO: 566336 - RNA, 19 nt, Homo sapiens
ccaccugcaggacaacuua

SEQ ID NO: 566337 - RNA, 19 nt, Homo sapiens
acaaauuccugcuacuaag

SEQ ID NO: 566338 - RNA, 19 nt, Homo sapiens
aaacacacgcgcacgcaaa

SEQ ID NO: 566339 - RNA, 19 nt, Homo sapiens
acaaugcucuuccucuucu

SEQ ID NO: 566340 - RNA, 19 nt, Homo sapiens
gaauuuaggaccacugcau

SEQ ID NO: 566341 - RNA, 19 nt, Homo sapiens
cuucuccacugucaucaaa

SEQ ID NO: 566342 - RNA, 19 nt, Homo sapiens
gacccacuaugaaugugaa

SEQ ID NO: 566343 - RNA, 19 nt, Homo sapiens
ggaagauuacauuucauca

SEQ ID NO: 566344 - RNA, 19 nt, Homo sapiens
ccaagcagaggcuagagaa

SEQ ID NO: 566345 - RNA, 19 nt, Homo sapiens
aagacaugcuguuaacuca

SEQ ID NO: 566346 - RNA, 19 nt, Homo sapiens
gaguagggcuuaguuuuau

SEQ ID NO: 566347 - RNA, 19 nt, Homo sapiens
ucugugagcugccuuucau

SEQ ID NO: 566348 - RNA, 19 nt, Homo sapiens
ggugucuccuugguccuua

SEQ ID NO: 566349 - RNA, 19 nt, Homo sapiens
gcagcagcuucuccacugu

SEQ ID NO: 566350 - RNA, 19 nt, Homo sapiens
gaagauuacauuucaucag

SEQ ID NO: 566351 - RNA, 19 nt, Homo sapiens
ggucaccugucaccguugu

SEQ ID NO: 566352 - RNA, 19 nt, Homo sapiens
aaacagcagugaggaagag

SEQ ID NO: 566353 - RNA, 19 nt, Homo sapiens
gcaguucauuuccccaaaa

SEQ ID NO: 566354 - RNA, 19 nt, Homo sapiens
cagccuccuuucuaacuug

SEQ ID NO: 566355 - RNA, 19 nt, Homo sapiens
gcagaccucaaguagaaau

SEQ ID NO: 566356 - RNA, 19 nt, Homo sapiens
gaggaagauuacauuucau

SEQ ID NO: 566357 - RNA, 19 nt, Homo sapiens
gagauggucaccggcauga

SEQ ID NO: 566358 - RNA, 19 nt, Homo sapiens
ggacccacuaugaauguga

SEQ ID NO: 566359 - RNA, 19 nt, Homo sapiens
ucaacagcguucuuccaau

SEQ ID NO: 566360 - RNA, 19 nt, Homo sapiens
cagcagugaggaagagaaa

SEQ ID NO: 566361 - RNA, 19 nt, Homo sapiens
acuaagacaugcuguuaac

SEQ ID NO: 566362 - RNA, 19 nt, Homo sapiens
gaggguggcgucuuuagag

SEQ ID NO: 566363 - RNA, 19 nt, Homo sapiens
ugaguagggcuuaguuuua

SEQ ID NO: 566364 - RNA, 19 nt, Homo sapiens
aaaugucccucauguccau

SEQ ID NO: 566365 - RNA, 19 nt, Homo sapiens
uaagacaugcuguuaacuc

SEQ ID NO: 566366 - RNA, 19 nt, Homo sapiens
gaaaagcagagauaagcaa

SEQ ID NO: 566367 - RNA, 19 nt, Homo sapiens
ggagacucaugaggacugu

SEQ ID NO: 566368 - RNA, 19 nt, Homo sapiens
gagcacuguuagacacaca

SEQ ID NO: 566369 - RNA, 19 nt, Homo sapiens
accacugcauccugucuua

SEQ ID NO: 566370 - RNA, 19 nt, Homo sapiens
aaagggauccagaggugaa

SEQ ID NO: 566371 - RNA, 19 nt, Homo sapiens
cagccgacuuucaucaaca

SEQ ID NO: 566372 - RNA, 19 nt, Homo sapiens
caaacagcagugaggaaga

SEQ ID NO: 566373 - RNA, 19 nt, Homo sapiens
uuucaugucugcauauugc

SEQ ID NO: 566374 - RNA, 19 nt, Homo sapiens
uuucuuucaugucugcaua

SEQ ID NO: 566375 - RNA, 19 nt, Homo sapiens
gcuccucuucucaguguuu

SEQ ID NO: 566376 - RNA, 19 nt, Homo sapiens
aagcagaggcuagagaaga

SEQ ID NO: 566377 - RNA, 19 nt, Homo sapiens
ucaucaaacuggccauguc

SEQ ID NO: 566378 - RNA, 19 nt, Homo sapiens
cuuucuacccuguggauua

SEQ ID NO: 566379 - RNA, 19 nt, Homo sapiens
uguacgaagcuauuuaaug

SEQ ID NO: 566380 - RNA, 19 nt, Homo sapiens
gaccucaaguagaaauugc

SEQ ID NO: 566381 - RNA, 19 nt, Homo sapiens
ggcaccaucuugaccucuu

SEQ ID NO: 566382 - RNA, 19 nt, Homo sapiens
caccaaccuuugugugaca

SEQ ID NO: 566383 - RNA, 19 nt, Homo sapiens
ccagcaugguuguccugaa

SEQ ID NO: 566384 - RNA, 19 nt, Homo sapiens
gacuuuggcuaccugacau

SEQ ID NO: 566385 - RNA, 19 nt, Homo sapiens
cgcagcagccuccuuucua

SEQ ID NO: 566386 - RNA, 19 nt, Homo sapiens
cauauugcauagccuuguc

SEQ ID NO: 566387 - RNA, 19 nt, Homo sapiens
gaaacgugcaggcauucuc

SEQ ID NO: 566388 - RNA, 19 nt, Homo sapiens
ucaccguuguggcuggaaa

SEQ ID NO: 566389 - RNA, 19 nt, Homo sapiens
gaggaccaaugggcuccaa

SEQ ID NO: 566390 - RNA, 19 nt, Homo sapiens
gcaggcauucucacucaca

SEQ ID NO: 566391 - RNA, 19 nt, Homo sapiens
ugugacggcucugacuuug

SEQ ID NO: 566392 - RNA, 19 nt, Homo sapiens
cagcguucuuccaaucuca

SEQ ID NO: 566393 - RNA, 19 nt, Homo sapiens
cggcucuugugguuucaaa

SEQ ID NO: 566394 - RNA, 19 nt, Homo sapiens
guacgaagcuauuuaauga

SEQ ID NO: 566395 - RNA, 19 nt, Homo sapiens
cagcagaccucaaguagaa

SEQ ID NO: 566396 - RNA, 19 nt, Homo sapiens
ggaaagacaucuccaaggu

SEQ ID NO: 566397 - RNA, 19 nt, Homo sapiens
gcagcagccuccuuucuaa

SEQ ID NO: 566398 - RNA, 19 nt, Homo sapiens
ggaaaagacuuaacuguga

SEQ ID NO: 566399 - RNA, 19 nt, Homo sapiens
ggacuuggcugagcacugu

SEQ ID NO: 566400 - RNA, 19 nt, Homo sapiens
ggauguggcugcccaggaa

SEQ ID NO: 566401 - RNA, 19 nt, Homo sapiens
caacagcguucuuccaauc

SEQ ID NO: 566402 - RNA, 19 nt, Homo sapiens
ggacaaauuccugcuacua

SEQ ID NO: 566403 - RNA, 19 nt, Homo sapiens
uuaaugagccugugucuug

SEQ ID NO: 566404 - RNA, 19 nt, Homo sapiens
gacaaauuccugcuacuaa

SEQ ID NO: 566405 - RNA, 19 nt, Homo sapiens
gcacacacacacacacaaa

SEQ ID NO: 566406 - RNA, 19 nt, Homo sapiens
caaugacuuugggaauuua

SEQ ID NO: 566407 - RNA, 19 nt, Homo sapiens
gagcuuggccgaccaggaa

SEQ ID NO: 566408 - RNA, 19 nt, Homo sapiens
gaagagaaaagcagagaua

SEQ ID NO: 566409 - RNA, 19 nt, Homo sapiens
ugccugagcuccucccuuu

SEQ ID NO: 566410 - RNA, 19 nt, Homo sapiens
ccaaacaaccggcuacaau

SEQ ID NO: 566411 - RNA, 19 nt, Homo sapiens
gaaaagacuuaacugugaa

SEQ ID NO: 566412 - RNA, 19 nt, Homo sapiens
cuacuaagacaugcuguua

SEQ ID NO: 566413 - RNA, 19 nt, Homo sapiens
ccacagcagaccucaagua

SEQ ID NO: 566414 - RNA, 19 nt, Homo sapiens
gcagggaagugggcacguu

SEQ ID NO: 566415 - RNA, 19 nt, Homo sapiens
cuacaaugcucuuccucuu

SEQ ID NO: 566416 - RNA, 19 nt, Homo sapiens
cagcaugguuguccugaau

SEQ ID NO: 566417 - RNA, 19 nt, Homo sapiens
caaacaaccggcuacaaug

SEQ ID NO: 566418 - RNA, 19 nt, Homo sapiens
gaaaggggauaguggaguu

SEQ ID NO: 566419 - RNA, 19 nt, Homo sapiens
gggaauuuaucuucagcuu

SEQ ID NO: 566420 - RNA, 19 nt, Homo sapiens
gcuccucccuuuucaauaa

SEQ ID NO: 566421 - RNA, 19 nt, Homo sapiens
ggaauuuaucuucagcuuu

SEQ ID NO: 566422 - RNA, 19 nt, Homo sapiens
gcacaugggcagcucuguu

SEQ ID NO: 566423 - RNA, 19 nt, Homo sapiens
gugcaggcauucucacuca

SEQ ID NO: 566424 - RNA, 19 nt, Homo sapiens
gcaccaucuugaccucuug

SEQ ID NO: 566425 - RNA, 19 nt, Homo sapiens
gacaugcuguuaacucagu

SEQ ID NO: 566426 - RNA, 19 nt, Homo sapiens
gauuauuagucgugcaugu

SEQ ID NO: 566427 - RNA, 19 nt, Homo sapiens
aauaaaggcaguucauuuc

SEQ ID NO: 566428 - RNA, 19 nt, Homo sapiens
ccacaugcccaaccugaga

SEQ ID NO: 566429 - RNA, 19 nt, Homo sapiens
caaauuccugcuacuaaga

SEQ ID NO: 566430 - RNA, 19 nt, Homo sapiens
gcagccuccuuucuaacuu

SEQ ID NO: 566431 - RNA, 19 nt, Homo sapiens
acaaauuccugcuacuaag

SEQ ID NO: 566432 - RNA, 19 nt, Homo sapiens
acaaugcucuuccucuucu

SEQ ID NO: 566433 - RNA, 19 nt, Homo sapiens
gaauuuaggaccacugcau

SEQ ID NO: 566434 - RNA, 19 nt, Homo sapiens
cuucuccacugucaucaaa

SEQ ID NO: 566435 - RNA, 19 nt, Homo sapiens
aaacacacgcgcacgcaaa

SEQ ID NO: 566436 - RNA, 19 nt, Homo sapiens
ccaagcagaggcuagagaa

SEQ ID NO: 566437 - RNA, 19 nt, Homo sapiens
aagacaugcuguuaacuca

SEQ ID NO: 566438 - RNA, 19 nt, Homo sapiens
gaguagggcuuaguuuuau

SEQ ID NO: 566439 - RNA, 19 nt, Homo sapiens
ucugugagcugccuuucau

SEQ ID NO: 566440 - RNA, 19 nt, Homo sapiens
ggugucuccuugguccuua

SEQ ID NO: 566441 - RNA, 19 nt, Homo sapiens
gcagcagcuucuccacugu

SEQ ID NO: 566442 - RNA, 19 nt, Homo sapiens
aaacagcagugaggaagag

SEQ ID NO: 566443 - RNA, 19 nt, Homo sapiens
gcaguucauuuccccaaaa

SEQ ID NO: 566444 - RNA, 19 nt, Homo sapiens
cagccuccuuucuaacuug

SEQ ID NO: 566445 - RNA, 19 nt, Homo sapiens
gcagaccucaaguagaaau

SEQ ID NO: 566446 - RNA, 19 nt, Homo sapiens
gagauggucaccggcauga

SEQ ID NO: 566447 - RNA, 19 nt, Homo sapiens
ucaacagcguucuuccaau

SEQ ID NO: 566448 - RNA, 19 nt, Homo sapiens
cagcagugaggaagagaaa

SEQ ID NO: 566449 - RNA, 19 nt, Homo sapiens
acuaagacaugcuguuaac

SEQ ID NO: 566450 - RNA, 19 nt, Homo sapiens
gaggguggcgucuuuagag

SEQ ID NO: 566451 - RNA, 19 nt, Homo sapiens
ugaguagggcuuaguuuua

SEQ ID NO: 566452 - RNA, 19 nt, Homo sapiens
aaaugucccucauguccau

SEQ ID NO: 566453 - RNA, 19 nt, Homo sapiens
uaagacaugcuguuaacuc

SEQ ID NO: 566454 - RNA, 19 nt, Homo sapiens
ggagacucaugaggacugu

SEQ ID NO: 566455 - RNA, 19 nt, Homo sapiens
gaaaagcagagauaagcaa

SEQ ID NO: 566456 - RNA, 19 nt, Homo sapiens
gagcacuguuagacacaca

SEQ ID NO: 566457 - RNA, 19 nt, Homo sapiens
accacugcauccugucuua

SEQ ID NO: 566458 - RNA, 19 nt, Homo sapiens
ugaaauggguccaaaaggu

SEQ ID NO: 566459 - RNA, 19 nt, Homo sapiens
aaagggauccagaggugaa

SEQ ID NO: 566460 - RNA, 19 nt, Homo sapiens
cagccgacuuucaucaaca

SEQ ID NO: 566461 - RNA, 19 nt, Homo sapiens
uuucaugucugcauauugc

SEQ ID NO: 566462 - RNA, 19 nt, Homo sapiens
uuucuuucaugucugcaua

SEQ ID NO: 566463 - RNA, 19 nt, Homo sapiens
gcuccucuucucaguguuu

SEQ ID NO: 566464 - RNA, 19 nt, Homo sapiens
aagcagaggcuagagaaga

SEQ ID NO: 566465 - RNA, 19 nt, Homo sapiens
ucaucaaacuggccauguc

SEQ ID NO: 566466 - RNA, 19 nt, Homo sapiens
cuuucuacccuguggauua

SEQ ID NO: 566467 - RNA, 19 nt, Homo sapiens
caaacagcagugaggaaga

SEQ ID NO: 566468 - RNA, 19 nt, Homo sapiens
uguacgaagcuauuuaaug

SEQ ID NO: 566469 - RNA, 19 nt, Homo sapiens
gaccucaaguagaaauugc

SEQ ID NO: 566470 - RNA, 19 nt, Homo sapiens
ggcaccaucuugaccucuu

SEQ ID NO: 566471 - RNA, 19 nt, Homo sapiens
caccaaccuuugugugaca

SEQ ID NO: 566472 - RNA, 19 nt, Homo sapiens
gcaagcagggacagaaagg

SEQ ID NO: 566473 - RNA, 19 nt, Homo sapiens
cgcagcagccuccuuucua

SEQ ID NO: 566474 - RNA, 19 nt, Homo sapiens
ccagcaugguuguccugaa

SEQ ID NO: 566475 - RNA, 19 nt, Homo sapiens
gacuuuggcuaccugacau

SEQ ID NO: 566476 - RNA, 19 nt, Homo sapiens
gaggcaagcagggacagaa

SEQ ID NO: 566477 - RNA, 19 nt, Homo sapiens
cauauugcauagccuuguc

SEQ ID NO: 566478 - RNA, 19 nt, Homo sapiens
gaaacgugcaggcauucuc

SEQ ID NO: 566479 - RNA, 19 nt, Homo sapiens
ccacaggaagaccaggaaa

SEQ ID NO: 566480 - RNA, 19 nt, Homo sapiens
aaggugaaauggguccaaa

SEQ ID NO: 566481 - RNA, 19 nt, Homo sapiens
gaggaccaaugggcuccaa

SEQ ID NO: 566482 - RNA, 19 nt, Homo sapiens
gcaggcauucucacucaca

SEQ ID NO: 566483 - RNA, 19 nt, Homo sapiens
ugugacggcucugacuuug

SEQ ID NO: 566484 - RNA, 19 nt, Homo sapiens
gggcagaaaggugaaaugg

SEQ ID NO: 566485 - RNA, 19 nt, Homo sapiens
cagcguucuuccaaucuca

SEQ ID NO: 566486 - RNA, 19 nt, Homo sapiens
cggcucuugugguuucaaa

SEQ ID NO: 566487 - RNA, 19 nt, Homo sapiens
gacccuggccagcaugguu

SEQ ID NO: 566488 - RNA, 19 nt, Homo sapiens
acacacacacacacaaaca

SEQ ID NO: 566489 - RNA, 19 nt, Homo sapiens
aaacgugcaggcauucuca

SEQ ID NO: 566490 - RNA, 19 nt, Homo sapiens
ugacaugcgagaccuaucu

SEQ ID NO: 566491 - RNA, 19 nt, Homo sapiens
cacaugggcagcucuguuc

SEQ ID NO: 566492 - RNA, 19 nt, Homo sapiens
accgaaacgugcaggcauu

SEQ ID NO: 566493 - RNA, 19 nt, Homo sapiens
aaacaaccggcuacaaugc

SEQ ID NO: 566494 - RNA, 19 nt, Homo sapiens
guacgaagcuauuuaauga

SEQ ID NO: 566495 - RNA, 19 nt, Homo sapiens
cagcagaccucaaguagaa

SEQ ID NO: 566496 - RNA, 19 nt, Homo sapiens
ggaaagacaucuccaaggu

SEQ ID NO: 566497 - RNA, 19 nt, Homo sapiens
gcagcagccuccuuucuaa

SEQ ID NO: 566498 - RNA, 19 nt, Homo sapiens
ggaaaagacuuaacuguga

SEQ ID NO: 566499 - RNA, 19 nt, Homo sapiens
ggacuuggcugagcacugu

SEQ ID NO: 566500 - RNA, 19 nt, Homo sapiens
ggauguggcugcccaggaa

SEQ ID NO: 566501 - RNA, 19 nt, Homo sapiens
caacagcguucuuccaauc

SEQ ID NO: 566502 - RNA, 19 nt, Homo sapiens
ggacaaauuccugcuacua

SEQ ID NO: 566503 - RNA, 19 nt, Homo sapiens
uuaaugagccugugucuug

SEQ ID NO: 566504 - RNA, 19 nt, Homo sapiens
gacaaauuccugcuacuaa

SEQ ID NO: 566505 - RNA, 19 nt, Homo sapiens
gcacacacacacacacaaa

SEQ ID NO: 566506 - RNA, 19 nt, Homo sapiens
caaugacuuugggaauuua

SEQ ID NO: 566507 - RNA, 19 nt, Homo sapiens
gagcuuggccgaccaggaa

SEQ ID NO: 566508 - RNA, 19 nt, Homo sapiens
gaagagaaaagcagagaua

SEQ ID NO: 566509 - RNA, 19 nt, Homo sapiens
ugccugagcuccucccuuu

SEQ ID NO: 566510 - RNA, 19 nt, Homo sapiens
ccaaacaaccggcuacaau

SEQ ID NO: 566511 - RNA, 19 nt, Homo sapiens
gaaaagacuuaacugugaa

SEQ ID NO: 566512 - RNA, 19 nt, Homo sapiens
cuacuaagacaugcuguua

SEQ ID NO: 566513 - RNA, 19 nt, Homo sapiens
ccacagcagaccucaagua

SEQ ID NO: 566514 - RNA, 19 nt, Homo sapiens
gcagggaagugggcacguu

SEQ ID NO: 566515 - RNA, 19 nt, Homo sapiens
cuacaaugcucuuccucuu

SEQ ID NO: 566516 - RNA, 19 nt, Homo sapiens
cagcaugguuguccugaau

SEQ ID NO: 566517 - RNA, 19 nt, Homo sapiens
caaacaaccggcuacaaug

SEQ ID NO: 566518 - RNA, 19 nt, Homo sapiens
gaaaggggauaguggaguu

SEQ ID NO: 566519 - RNA, 19 nt, Homo sapiens
gggaauuuaucuucagcuu

SEQ ID NO: 566520 - RNA, 19 nt, Homo sapiens
gcuccucccuuuucaauaa

SEQ ID NO: 566521 - RNA, 19 nt, Homo sapiens
ggaauuuaucuucagcuuu

SEQ ID NO: 566522 - RNA, 19 nt, Homo sapiens
gcacaugggcagcucuguu

SEQ ID NO: 566523 - RNA, 19 nt, Homo sapiens
gugcaggcauucucacuca

SEQ ID NO: 566524 - RNA, 19 nt, Homo sapiens
gcaccaucuugaccucuug

SEQ ID NO: 566525 - RNA, 19 nt, Homo sapiens
gacaugcuguuaacucagu

SEQ ID NO: 566526 - RNA, 19 nt, Homo sapiens
gauuauuagucgugcaugu

SEQ ID NO: 566527 - RNA, 19 nt, Homo sapiens
aauaaaggcaguucauuuc

SEQ ID NO: 566528 - RNA, 19 nt, Homo sapiens
ccacaugcccaaccugaga

SEQ ID NO: 566529 - RNA, 19 nt, Homo sapiens
caaauuccugcuacuaaga

SEQ ID NO: 566530 - RNA, 19 nt, Homo sapiens
gcagccuccuuucuaacuu

SEQ ID NO: 566531 - RNA, 19 nt, Homo sapiens
acaaauuccugcuacuaag

SEQ ID NO: 566532 - RNA, 19 nt, Homo sapiens
acaaugcucuuccucuucu

SEQ ID NO: 566533 - RNA, 19 nt, Homo sapiens
gaauuuaggaccacugcau

SEQ ID NO: 566534 - RNA, 19 nt, Homo sapiens
cuucuccacugucaucaaa

SEQ ID NO: 566535 - RNA, 19 nt, Homo sapiens
aaacacacgcgcacgcaaa

SEQ ID NO: 566536 - RNA, 19 nt, Homo sapiens
ccaagcagaggcuagagaa

SEQ ID NO: 566537 - RNA, 19 nt, Homo sapiens
aagacaugcuguuaacuca

SEQ ID NO: 566538 - RNA, 19 nt, Homo sapiens
gaguagggcuuaguuuuau

SEQ ID NO: 566539 - RNA, 19 nt, Homo sapiens
ucugugagcugccuuucau

SEQ ID NO: 566540 - RNA, 19 nt, Homo sapiens
ggugucuccuugguccuua

SEQ ID NO: 566541 - RNA, 19 nt, Homo sapiens
gcagcagcuucuccacugu

SEQ ID NO: 566542 - RNA, 19 nt, Homo sapiens
aaacagcagugaggaagag

SEQ ID NO: 566543 - RNA, 19 nt, Homo sapiens
gcaguucauuuccccaaaa

SEQ ID NO: 566544 - RNA, 19 nt, Homo sapiens
cagccuccuuucuaacuug

SEQ ID NO: 566545 - RNA, 19 nt, Homo sapiens
gcagaccucaaguagaaau

SEQ ID NO: 566546 - RNA, 19 nt, Homo sapiens
ucaacagcguucuuccaau

SEQ ID NO: 566547 - RNA, 19 nt, Homo sapiens
cagcagugaggaagagaaa

SEQ ID NO: 566548 - RNA, 19 nt, Homo sapiens
acuaagacaugcuguuaac

SEQ ID NO: 566549 - RNA, 19 nt, Homo sapiens
gaggguggcgucuuuagag

SEQ ID NO: 566550 - RNA, 19 nt, Homo sapiens
ugaguagggcuuaguuuua

SEQ ID NO: 566551 - RNA, 19 nt, Homo sapiens
aaaugucccucauguccau

SEQ ID NO: 566552 - RNA, 19 nt, Homo sapiens
uaagacaugcuguuaacuc

SEQ ID NO: 566553 - RNA, 19 nt, Homo sapiens
ggagacucaugaggacugu

SEQ ID NO: 566554 - RNA, 19 nt, Homo sapiens
gaaaagcagagauaagcaa

SEQ ID NO: 566555 - RNA, 19 nt, Homo sapiens
gagcacuguuagacacaca

SEQ ID NO: 566556 - RNA, 19 nt, Homo sapiens
accacugcauccugucuua

SEQ ID NO: 566557 - RNA, 19 nt, Homo sapiens
ugaaauggguccaaaaggu

SEQ ID NO: 566558 - RNA, 19 nt, Homo sapiens
aaagggauccagaggugaa

SEQ ID NO: 566559 - RNA, 19 nt, Homo sapiens
cagccgacuuucaucaaca

SEQ ID NO: 566560 - RNA, 19 nt, Homo sapiens
uuucaugucugcauauugc

SEQ ID NO: 566561 - RNA, 19 nt, Homo sapiens
uuucuuucaugucugcaua

SEQ ID NO: 566562 - RNA, 19 nt, Homo sapiens
gcuccucuucucaguguuu

SEQ ID NO: 566563 - RNA, 19 nt, Homo sapiens
aagcagaggcuagagaaga

SEQ ID NO: 566564 - RNA, 19 nt, Homo sapiens
ucaucaaacuggccauguc

SEQ ID NO: 566565 - RNA, 19 nt, Homo sapiens
caaacagcagugaggaaga

SEQ ID NO: 566566 - RNA, 19 nt, Homo sapiens
uguacgaagcuauuuaaug

SEQ ID NO: 566567 - RNA, 19 nt, Homo sapiens
gaccucaaguagaaauugc

SEQ ID NO: 566568 - RNA, 19 nt, Homo sapiens
ggcaccaucuugaccucuu

SEQ ID NO: 566569 - RNA, 19 nt, Homo sapiens
caccaaccuuugugugaca

SEQ ID NO: 566570 - RNA, 19 nt, Homo sapiens
gcaagcagggacagaaagg

SEQ ID NO: 566571 - RNA, 19 nt, Homo sapiens
cgcagcagccuccuuucua

SEQ ID NO: 566572 - RNA, 19 nt, Homo sapiens
ccagcaugguuguccugaa

SEQ ID NO: 566573 - RNA, 19 nt, Homo sapiens
gaggcaagcagggacagaa

SEQ ID NO: 566574 - RNA, 19 nt, Homo sapiens
cauauugcauagccuuguc

SEQ ID NO: 566575 - RNA, 19 nt, Homo sapiens
gaaacgugcaggcauucuc

SEQ ID NO: 566576 - RNA, 19 nt, Homo sapiens
ccacaggaagaccaggaaa

SEQ ID NO: 566577 - RNA, 19 nt, Homo sapiens
aaggugaaauggguccaaa

SEQ ID NO: 566578 - RNA, 19 nt, Homo sapiens
gaggaccaaugggcuccaa

SEQ ID NO: 566579 - RNA, 19 nt, Homo sapiens
gcaggcauucucacucaca

SEQ ID NO: 566580 - RNA, 19 nt, Homo sapiens
gggcagaaaggugaaaugg

SEQ ID NO: 566581 - RNA, 19 nt, Homo sapiens
cagcguucuuccaaucuca

SEQ ID NO: 566582 - RNA, 19 nt, Homo sapiens
cggcucuugugguuucaaa

SEQ ID NO: 566583 - RNA, 19 nt, Homo sapiens
gacccuggccagcaugguu

SEQ ID NO: 566584 - RNA, 19 nt, Homo sapiens
acacacacacacacaaaca

SEQ ID NO: 566585 - RNA, 19 nt, Homo sapiens
aaacgugcaggcauucuca

SEQ ID NO: 566586 - RNA, 19 nt, Homo sapiens
cacaugggcagcucuguuc

SEQ ID NO: 566587 - RNA, 19 nt, Homo sapiens
accgaaacgugcaggcauu

SEQ ID NO: 566588 - RNA, 19 nt, Homo sapiens
aaacaaccggcuacaaugc

SEQ ID NO: 566589 - RNA, 19 nt, Homo sapiens
ccgaggacccacaggaaga

SEQ ID NO: 566590 - RNA, 19 nt, Homo sapiens
cuaggccuaugaaccacaa

SEQ ID NO: 566591 - RNA, 19 nt, Homo sapiens
ccacugcauccugucuuaa

SEQ ID NO: 566592 - RNA, 19 nt, Homo sapiens
gcuacuaagacaugcuguu

SEQ ID NO: 566593 - RNA, 19 nt, Homo sapiens
cacagcagaccucaaguag

SEQ ID NO: 566594 - RNA, 19 nt, Homo sapiens
ggauuuagguuccauucua

SEQ ID NO: 566595 - RNA, 19 nt, Homo sapiens
gcucaugccuguaaucuga

SEQ ID NO: 566596 - RNA, 19 nt, Homo sapiens
gaaauuggacagcauauga

SEQ ID NO: 566597 - RNA, 19 nt, Homo sapiens
cagcugaucuuccggauug

SEQ ID NO: 566598 - RNA, 19 nt, Homo sapiens
gaaauuagcaagggaaaga

SEQ ID NO: 566599 - RNA, 19 nt, Homo sapiens
ggaaguaugucugaaaugg

SEQ ID NO: 566600 - RNA, 19 nt, Homo sapiens
cagcauaacuccuaucucu

SEQ ID NO: 566601 - RNA, 19 nt, Homo sapiens
gauaugaagagccugguua

SEQ ID NO: 566602 - RNA, 19 nt, Homo sapiens
gaaagaggauagcuugacu

SEQ ID NO: 566603 - RNA, 19 nt, Homo sapiens
guugagcucugguaacuga

SEQ ID NO: 566604 - RNA, 19 nt, Homo sapiens
ggacagauguaucauuuug

SEQ ID NO: 566605 - RNA, 19 nt, Homo sapiens
gccauaauuuagcacuuua

SEQ ID NO: 566606 - RNA, 19 nt, Homo sapiens
acacccagguaauuuauuu

SEQ ID NO: 566607 - RNA, 19 nt, Homo sapiens
ggaaagaggaaagaggaua

SEQ ID NO: 566608 - RNA, 19 nt, Homo sapiens
guaaauaggcccagaaagg

SEQ ID NO: 566609 - RNA, 19 nt, Homo sapiens
cauaucagauggacagaug

SEQ ID NO: 566610 - RNA, 19 nt, Homo sapiens
ggccauaauuuagcacuuu

SEQ ID NO: 566611 - RNA, 19 nt, Homo sapiens
ggaaaucaacgagaacuug

SEQ ID NO: 566612 - RNA, 19 nt, Homo sapiens
ggacugcaguggcgugauc

SEQ ID NO: 566613 - RNA, 19 nt, Homo sapiens
ccaaauaggucacauucac

SEQ ID NO: 566614 - RNA, 19 nt, Homo sapiens
gaagaaaacccaggaaauu

SEQ ID NO: 566615 - RNA, 19 nt, Homo sapiens
ggaagaugcacgaggauau

SEQ ID NO: 566616 - RNA, 19 nt, Homo sapiens
agauguaacuuagcacuuu

SEQ ID NO: 566617 - RNA, 19 nt, Homo sapiens
gguauuacuuggcuuaugg

SEQ ID NO: 566618 - RNA, 19 nt, Homo sapiens
ccuguaaucugagcacuuu

SEQ ID NO: 566619 - RNA, 19 nt, Homo sapiens
ggacagcauaugaagauug

SEQ ID NO: 566620 - RNA, 19 nt, Homo sapiens
gaagauuggacaucacaug

SEQ ID NO: 566621 - RNA, 19 nt, Homo sapiens
ugaagagccugguuacagu

SEQ ID NO: 566622 - RNA, 19 nt, Homo sapiens
uaaagaaauuggacagcau

SEQ ID NO: 566623 - RNA, 19 nt, Homo sapiens
gaaagaggaaagaggauag

SEQ ID NO: 566624 - RNA, 19 nt, Homo sapiens
ccaaagugcugggauuaca

SEQ ID NO: 566625 - RNA, 19 nt, Homo sapiens
ucugguaacugaucuuaau

SEQ ID NO: 566626 - RNA, 19 nt, Homo sapiens
ggccacaccucccucugaa

SEQ ID NO: 566627 - RNA, 19 nt, Homo sapiens
gugaaugcaugauaugaag

SEQ ID NO: 566628 - RNA, 19 nt, Homo sapiens
aaagaaauuggacagcaua

SEQ ID NO: 566629 - RNA, 19 nt, Homo sapiens
gaagaugcacgaggauaug

SEQ ID NO: 566630 - RNA, 19 nt, Homo sapiens
auggacagauguaucauuu

SEQ ID NO: 566631 - RNA, 19 nt, Homo sapiens
uaggucacauucacgcaua

SEQ ID NO: 566632 - RNA, 19 nt, Homo sapiens
gacagcauaugaagauugg

SEQ ID NO: 566633 - RNA, 19 nt, Homo sapiens
gaagagccugguuacaguu

SEQ ID NO: 566634 - RNA, 19 nt, Homo sapiens
caguuggccucugugaaua

SEQ ID NO: 566635 - RNA, 19 nt, Homo sapiens
ccagguauuacuuggcuua

SEQ ID NO: 566636 - RNA, 19 nt, Homo sapiens
gagcgaggcagcugaucuu

SEQ ID NO: 566637 - RNA, 19 nt, Homo sapiens
ccaccacgcccagcuaauu

SEQ ID NO: 566638 - RNA, 19 nt, Homo sapiens
gccacacccagguaauuua

SEQ ID NO: 566639 - RNA, 19 nt, Homo sapiens
gcucugguaacugaucuua

SEQ ID NO: 566640 - RNA, 19 nt, Homo sapiens
gucacuccauuuaucuuaa

SEQ ID NO: 566641 - RNA, 19 nt, Homo sapiens
aaauaggcccagaaaggua

SEQ ID NO: 566642 - RNA, 19 nt, Homo sapiens
uaaauaggcccagaaaggu

SEQ ID NO: 566643 - RNA, 19 nt, Homo sapiens
gauggacagauguaucauu

SEQ ID NO: 566644 - RNA, 19 nt, Homo sapiens
cagauggacagauguauca

SEQ ID NO: 566645 - RNA, 19 nt, Homo sapiens
uaucucugccuuugucuuu

SEQ ID NO: 566646 - RNA, 19 nt, Homo sapiens
ggagaauccuugcuuuccu

SEQ ID NO: 566647 - RNA, 19 nt, Homo sapiens
uaucagauggacagaugua

SEQ ID NO: 566648 - RNA, 19 nt, Homo sapiens
gcaagggaaagaggaaaga

SEQ ID NO: 566649 - RNA, 19 nt, Homo sapiens
uaagggaaguaugucugaa

SEQ ID NO: 566650 - RNA, 19 nt, Homo sapiens
ggaccucacggagaugaaa

SEQ ID NO: 566651 - RNA, 19 nt, Homo sapiens
acuguucucugcaaguaaa

SEQ ID NO: 566652 - RNA, 19 nt, Homo sapiens
cggcauggcccguggaaau

SEQ ID NO: 566653 - RNA, 19 nt, Homo sapiens
ccagagaaccguugcuuuu

SEQ ID NO: 566654 - RNA, 19 nt, Homo sapiens
aauccuugcuuuccucuuc

SEQ ID NO: 566655 - RNA, 19 nt, Homo sapiens
caaguaaauaggcccagaa

SEQ ID NO: 566656 - RNA, 19 nt, Homo sapiens
cuccugaccucgugauuca

SEQ ID NO: 566657 - RNA, 19 nt, Homo sapiens
gcccuggugugcccuuaau

SEQ ID NO: 566658 - RNA, 19 nt, Homo sapiens
caccacgcccagcuaauuu

SEQ ID NO: 566659 - RNA, 19 nt, Homo sapiens
ccacacccagguaauuuau

SEQ ID NO: 566660 - RNA, 19 nt, Homo sapiens
ggaaagaggauagcuugac

SEQ ID NO: 566661 - RNA, 19 nt, Homo sapiens
ccguggaaaucaacgagaa

SEQ ID NO: 566662 - RNA, 19 nt, Homo sapiens
gguaacugaucuuaauagc

SEQ ID NO: 566663 - RNA, 19 nt, Homo sapiens
gacuuuugcuguuggauuu

SEQ ID NO: 566664 - RNA, 19 nt, Homo sapiens
guuggccucugugaauauu

SEQ ID NO: 566665 - RNA, 19 nt, Homo sapiens
gaaugcaugauaugaagag

SEQ ID NO: 566666 - RNA, 19 nt, Homo sapiens
ggagaugaaacggaagaug

SEQ ID NO: 566667 - RNA, 19 nt, Homo sapiens
gauguaacuuagcacuuuu

SEQ ID NO: 566668 - RNA, 19 nt, Homo sapiens
uuugggaagucugaaauga

SEQ ID NO: 566669 - RNA, 19 nt, Homo sapiens
gccagagaaccguugcuuu

SEQ ID NO: 566670 - RNA, 19 nt, Homo sapiens
gagccugguuacaguuucu

SEQ ID NO: 566671 - RNA, 19 nt, Homo sapiens
aagaaaacccaggaaauua

SEQ ID NO: 566672 - RNA, 19 nt, Homo sapiens
agggaaguaugucugaaau

SEQ ID NO: 566673 - RNA, 19 nt, Homo sapiens
auaugaagauuggacauca

SEQ ID NO: 566674 - RNA, 19 nt, Homo sapiens
agucacuccauuuaucuua

SEQ ID NO: 566675 - RNA, 19 nt, Homo sapiens
gcagagcgaggcagcugau

SEQ ID NO: 566676 - RNA, 19 nt, Homo sapiens
gagcucugguaacugaucu

SEQ ID NO: 566677 - RNA, 19 nt, Homo sapiens
cugaguagaugggauuaca

SEQ ID NO: 566678 - RNA, 19 nt, Homo sapiens
uuaagggaaguaugucuga

SEQ ID NO: 566679 - RNA, 19 nt, Homo sapiens
aaauuggacagcauaugaa

SEQ ID NO: 566680 - RNA, 19 nt, Homo sapiens
guuccauucuaaccuagga

SEQ ID NO: 566681 - RNA, 19 nt, Homo sapiens
acaaguugagcucugguaa

SEQ ID NO: 566682 - RNA, 19 nt, Homo sapiens
gcccagaaagguauaagag

SEQ ID NO: 566683 - RNA, 19 nt, Homo sapiens
cacauucacgcauaucaga

SEQ ID NO: 566684 - RNA, 19 nt, Homo sapiens
cuggguagcugggauuaca

SEQ ID NO: 566685 - RNA, 19 nt, Homo sapiens
gggaaguaugucugaaaug

SEQ ID NO: 566686 - RNA, 19 nt, Homo sapiens
caaacuccauuuucuagca

SEQ ID NO: 566687 - RNA, 19 nt, Homo sapiens
gcauggcccguggaaauca

SEQ ID NO: 566688 - RNA, 19 nt, Homo sapiens
gcagcugaucuuccggauu

SEQ ID NO: 566689 - RNA, 19 nt, Homo sapiens
ggauuacaggcgugaguca

SEQ ID NO: 566690 - RNA, 19 nt, Homo sapiens
acuccuaucucugccuuug

SEQ ID NO: 566691 - RNA, 19 nt, Homo sapiens
acgaggauaugaucuccau

SEQ ID NO: 566692 - RNA, 19 nt, Homo sapiens
ccgaguugcucuucuucca

SEQ ID NO: 566693 - RNA, 19 nt, Homo sapiens
cggaagaugcacgaggaua

SEQ ID NO: 566694 - RNA, 19 nt, Homo sapiens
gcaaggugcugcgcgacaa

SEQ ID NO: 566695 - RNA, 19 nt, Homo sapiens
gaagcccagucauucucua

SEQ ID NO: 566696 - RNA, 19 nt, Homo sapiens
gcgcauuucuggccucauc

SEQ ID NO: 566697 - RNA, 19 nt, Homo sapiens
gcgacaacauccaggguau

SEQ ID NO: 566698 - RNA, 19 nt, Homo sapiens
ugaagguguuccuggagaa

SEQ ID NO: 566699 - RNA, 19 nt, Homo sapiens
gacaacauccaggguauca

SEQ ID NO: 566700 - RNA, 19 nt, Homo sapiens
ggacgcggcaaaggaggua

SEQ ID NO: 566701 - RNA, 19 nt, Homo sapiens
gcggaguguugaagguguu

SEQ ID NO: 566702 - RNA, 19 nt, Homo sapiens
gcauuucuggccucaucua

SEQ ID NO: 566703 - RNA, 19 nt, Homo sapiens
gcccagucauucucuaaaa

SEQ ID NO: 566704 - RNA, 19 nt, Homo sapiens
gagcacgccaagcgcaaga

SEQ ID NO: 566705 - RNA, 19 nt, Homo sapiens
gcacaagaauccuaugaaa

SEQ ID NO: 566706 - RNA, 19 nt, Homo sapiens
ggacuuaacuggagagguu

SEQ ID NO: 566707 - RNA, 19 nt, Homo sapiens
gaaaggagcuucugauugc

SEQ ID NO: 566708 - RNA, 19 nt, Homo sapiens
ccaaauuccuucaaugaua

SEQ ID NO: 566709 - RNA, 19 nt, Homo sapiens
gaugaugacuuacauagaa

SEQ ID NO: 566710 - RNA, 19 nt, Homo sapiens
ucaaggagguucagaguaa

SEQ ID NO: 566711 - RNA, 19 nt, Homo sapiens
caauguagcucuggauaua

SEQ ID NO: 566712 - RNA, 19 nt, Homo sapiens
gaucaaauccacacacaua

SEQ ID NO: 566713 - RNA, 19 nt, Homo sapiens
gaauacaccugaugaaaca

SEQ ID NO: 566714 - RNA, 19 nt, Homo sapiens
ggagaagccuguaugagaa

SEQ ID NO: 566715 - RNA, 19 nt, Homo sapiens
ccaaagagacacagauuua

SEQ ID NO: 566716 - RNA, 19 nt, Homo sapiens
agaggaagcugaacuauga

SEQ ID NO: 566717 - RNA, 19 nt, Homo sapiens
ugaauuaaaugcccaguuu

SEQ ID NO: 566718 - RNA, 19 nt, Homo sapiens
caacuucggagaugaauua

SEQ ID NO: 566719 - RNA, 19 nt, Homo sapiens
gcagaauguuuaugaguuu

SEQ ID NO: 566720 - RNA, 19 nt, Homo sapiens
gaaaauggcucgaaaggaa

SEQ ID NO: 566721 - RNA, 19 nt, Homo sapiens
gaaaggaaugcuccaguua

SEQ ID NO: 566722 - RNA, 19 nt, Homo sapiens
cggaagaccuugaauuaaa

SEQ ID NO: 566723 - RNA, 19 nt, Homo sapiens
aagaaugggucaagaauaa

SEQ ID NO: 566724 - RNA, 19 nt, Homo sapiens
gcacuucucuuugucauga

SEQ ID NO: 566725 - RNA, 19 nt, Homo sapiens
gaacaggcgugguaugcaa

SEQ ID NO: 566726 - RNA, 19 nt, Homo sapiens
gugcugagcuuccugcuaa

SEQ ID NO: 566727 - RNA, 19 nt, Homo sapiens
agaaaugguugguaugaua

SEQ ID NO: 566728 - RNA, 19 nt, Homo sapiens
caagugaacuaugggaaua

SEQ ID NO: 566729 - RNA, 19 nt, Homo sapiens
ugaaacagauuuacaagga

SEQ ID NO: 566730 - RNA, 19 nt, Homo sapiens
aaacuacggucccuuauau

SEQ ID NO: 566731 - RNA, 19 nt, Homo sapiens
gcucguacuugaaauaauu

SEQ ID NO: 566732 - RNA, 19 nt, Homo sapiens
ccaggaagcugcacaaauc

SEQ ID NO: 566733 - RNA, 19 nt, Homo sapiens
gggaagcccugacggagua

SEQ ID NO: 566734 - RNA, 19 nt, Homo sapiens
uaacaacgauugcugugaa

SEQ ID NO: 566735 - RNA, 19 nt, Homo sapiens
gaucauugcuuggcacaaa

SEQ ID NO: 566736 - RNA, 19 nt, Homo sapiens
ggaagaccuugaauuaaau

SEQ ID NO: 566737 - RNA, 19 nt, Homo sapiens
cuaauuggcucaggauaua

SEQ ID NO: 566738 - RNA, 19 nt, Homo sapiens
gaacauaucaucccucgau

SEQ ID NO: 566739 - RNA, 19 nt, Homo sapiens
gaagaaugggucaagaaua

SEQ ID NO: 566740 - RNA, 19 nt, Homo sapiens
caaagccaacgcauuauua

SEQ ID NO: 566741 - RNA, 19 nt, Homo sapiens
cgaaggagauggccuggaa

SEQ ID NO: 566742 - RNA, 19 nt, Homo sapiens
gaagaccacuggauucgau

SEQ ID NO: 566743 - RNA, 19 nt, Homo sapiens
gcauuucgcugguguguuc

SEQ ID NO: 566744 - RNA, 19 nt, Homo sapiens
uuacggagauauagaauug

SEQ ID NO: 566745 - RNA, 19 nt, Homo sapiens
gaagucaccucuccaaacu

SEQ ID NO: 566746 - RNA, 19 nt, Homo sapiens
ggagagagccgaagagauc

SEQ ID NO: 566747 - RNA, 19 nt, Homo sapiens
ggaaugcuccaguuacuuu

SEQ ID NO: 566748 - RNA, 19 nt, Homo sapiens
uggcagagcugaaacuuau

SEQ ID NO: 566749 - RNA, 19 nt, Homo sapiens
ccacgacgcuggcagagaa

SEQ ID NO: 566750 - RNA, 19 nt, Homo sapiens
ggcccuagcugugauauuu

SEQ ID NO: 566751 - RNA, 19 nt, Homo sapiens
ccaaggaacccuacaacua

SEQ ID NO: 566752 - RNA, 19 nt, Homo sapiens
ucacgaggcucuucccaaa

SEQ ID NO: 566753 - RNA, 19 nt, Homo sapiens
gcaaugcaagcuuuagaua

SEQ ID NO: 566754 - RNA, 19 nt, Homo sapiens
gaaaggagaccaccaagag

SEQ ID NO: 566755 - RNA, 19 nt, Homo sapiens
gcaaaucgaggaaauacuu

SEQ ID NO: 566756 - RNA, 19 nt, Homo sapiens
caacaggcacgacaaguuu

SEQ ID NO: 566757 - RNA, 19 nt, Homo sapiens
caacagagccgaguacuuc

SEQ ID NO: 566758 - RNA, 19 nt, Homo sapiens
gaagugaaacgcuuuagga

SEQ ID NO: 566759 - RNA, 19 nt, Homo sapiens
gaaaugguugguaugauaa

SEQ ID NO: 566760 - RNA, 19 nt, Homo sapiens
gcacaugaaggaccucuuu

SEQ ID NO: 566761 - RNA, 19 nt, Homo sapiens
gcacaagcgaggcaacaua

SEQ ID NO: 566762 - RNA, 19 nt, Homo sapiens
gaaacuuauuccaagcuuu

SEQ ID NO: 566763 - RNA, 19 nt, Homo sapiens
ggaaauggcagagcugaaa

SEQ ID NO: 566764 - RNA, 19 nt, Homo sapiens
ggaauucguccugcauuua

SEQ ID NO: 566765 - RNA, 19 nt, Homo sapiens
acagacagcugaaguggaa

SEQ ID NO: 566766 - RNA, 19 nt, Homo sapiens
agaggaggauguagagaua

SEQ ID NO: 566767 - RNA, 19 nt, Homo sapiens
cagcaucacuguggaguuu

SEQ ID NO: 566768 - RNA, 19 nt, Homo sapiens
caacauaagcuuuacaaca

SEQ ID NO: 566769 - RNA, 19 nt, Homo sapiens
gaaagggagaauauaguuu

SEQ ID NO: 566770 - RNA, 19 nt, Homo sapiens
caaccguccugucccauuu

SEQ ID NO: 566771 - RNA, 19 nt, Homo sapiens
gaacgacgccugccucaca

SEQ ID NO: 566772 - RNA, 19 nt, Homo sapiens
ggguagagauugugcagaa

SEQ ID NO: 566773 - RNA, 19 nt, Homo sapiens
ggaaauacuuagccaaggu

SEQ ID NO: 566774 - RNA, 19 nt, Homo sapiens
gcuagagguugucaugaaa

SEQ ID NO: 566775 - RNA, 19 nt, Homo sapiens
ggaguuguaugcugacuuc

SEQ ID NO: 566776 - RNA, 19 nt, Homo sapiens
gaauucguccugcauuuaa

SEQ ID NO: 566777 - RNA, 19 nt, Homo sapiens
caacuggacugccaugaag

SEQ ID NO: 566778 - RNA, 19 nt, Homo sapiens
agacacagauuuacaucaa

SEQ ID NO: 566779 - RNA, 19 nt, Homo sapiens
uggacaagcuguuugauga

SEQ ID NO: 566780 - RNA, 19 nt, Homo sapiens
ccacagagcugagaaacca

SEQ ID NO: 566781 - RNA, 19 nt, Homo sapiens
gaagcucguacuugaaaua

SEQ ID NO: 566782 - RNA, 19 nt, Homo sapiens
cuaaaguucugcagcauau

SEQ ID NO: 566783 - RNA, 19 nt, Homo sapiens
gcccugaauuccaccaaua

SEQ ID NO: 566784 - RNA, 19 nt, Homo sapiens
aaucaucgcugcacucuuc

SEQ ID NO: 566785 - RNA, 19 nt, Homo sapiens
cagaugccgucgacaagua

SEQ ID NO: 566786 - RNA, 19 nt, Homo sapiens
gagagcaaaucgaggaaau

SEQ ID NO: 566787 - RNA, 19 nt, Homo sapiens
uaagucggauucauacuau

SEQ ID NO: 566788 - RNA, 19 nt, Homo sapiens
guaacugccuaugagaaua

SEQ ID NO: 566789 - RNA, 19 nt, Homo sapiens
gaccagaccacuuugauga

SEQ ID NO: 566790 - RNA, 19 nt, Homo sapiens
gaaaccagcugcacaugcu

SEQ ID NO: 566791 - RNA, 19 nt, Homo sapiens
ccucaaggcucacgcaaug

SEQ ID NO: 566792 - RNA, 19 nt, Homo sapiens
ugaaaggaaugcuccaguu

SEQ ID NO: 566793 - RNA, 19 nt, Homo sapiens
caaacagccuggacaaucu

SEQ ID NO: 566794 - RNA, 19 nt, Homo sapiens
gcagggccuugaaguuauu

SEQ ID NO: 566795 - RNA, 19 nt, Homo sapiens
caaccaaccugggaaggaa

SEQ ID NO: 566796 - RNA, 19 nt, Homo sapiens
ccuggaaggugaacaugua

SEQ ID NO: 566797 - RNA, 19 nt, Homo sapiens
gaagaugaugacuuacaua

SEQ ID NO: 566798 - RNA, 19 nt, Homo sapiens
gaaagcaucaccagugugu

SEQ ID NO: 566799 - RNA, 19 nt, Homo sapiens
gccacgaucucuuguauca

SEQ ID NO: 566800 - RNA, 19 nt, Homo sapiens
gcuguuugaugaauccaua

SEQ ID NO: 566801 - RNA, 19 nt, Homo sapiens
gaaaguguuggcagaauug

SEQ ID NO: 566802 - RNA, 19 nt, Homo sapiens
gaacauggacagccagcaa

SEQ ID NO: 566803 - RNA, 19 nt, Homo sapiens
gcccaacauuucugaguuu

SEQ ID NO: 566804 - RNA, 19 nt, Homo sapiens
caugaucccaguucaaaua

SEQ ID NO: 566805 - RNA, 19 nt, Homo sapiens
caucaaagcugcccaauga

SEQ ID NO: 566806 - RNA, 19 nt, Homo sapiens
ccaaugaucugcuugauuu

SEQ ID NO: 566807 - RNA, 19 nt, Homo sapiens
gcaaugaacuuacaaaugg

SEQ ID NO: 566808 - RNA, 19 nt, Homo sapiens
gcagacaguuuauuugaaa

SEQ ID NO: 566809 - RNA, 19 nt, Homo sapiens
caacaggcaugauaggaua

SEQ ID NO: 566810 - RNA, 19 nt, Homo sapiens
caaaugagaugaaugugaa

SEQ ID NO: 566811 - RNA, 19 nt, Homo sapiens
ugacuuggauucaucuuua

SEQ ID NO: 566812 - RNA, 19 nt, Homo sapiens
gagcacagauacaguuuau

SEQ ID NO: 566813 - RNA, 19 nt, Homo sapiens
guuaguaucugaugacuug

SEQ ID NO: 566814 - RNA, 19 nt, Homo sapiens
caaccaaccuuaauauaca

SEQ ID NO: 566815 - RNA, 19 nt, Homo sapiens
guucaaagaugccauuaga

SEQ ID NO: 566816 - RNA, 19 nt, Homo sapiens
gaaauggaaccacuaagaa

SEQ ID NO: 566817 - RNA, 19 nt, Homo sapiens
ccucauaccucuuuaacaa

SEQ ID NO: 566818 - RNA, 19 nt, Homo sapiens
ccaaacugcugucucuuaa

SEQ ID NO: 566819 - RNA, 19 nt, Homo sapiens
gcaaggauaugacaugucu

SEQ ID NO: 566820 - RNA, 19 nt, Homo sapiens
uaacuaggaugacaagaau

SEQ ID NO: 566821 - RNA, 19 nt, Homo sapiens
ggaaauggaaccacuaaga

SEQ ID NO: 566822 - RNA, 19 nt, Homo sapiens
gcacaaaugagaugaaugu

SEQ ID NO: 566823 - RNA, 19 nt, Homo sapiens
gcacagauacaguuuaugu

SEQ ID NO: 566824 - RNA, 19 nt, Homo sapiens
gaaccuuccuguugccaaa

SEQ ID NO: 566825 - RNA, 19 nt, Homo sapiens
gaaucuguguuuggaaaua

SEQ ID NO: 566826 - RNA, 19 nt, Homo sapiens
caacuacacuuuccaaugc

SEQ ID NO: 566827 - RNA, 19 nt, Homo sapiens
uaaacucucuucuuccauu

SEQ ID NO: 566828 - RNA, 19 nt, Homo sapiens
gcaccuggacuacuuaauu

SEQ ID NO: 566829 - RNA, 19 nt, Homo sapiens
guaauggccuauccugcua

SEQ ID NO: 566830 - RNA, 19 nt, Homo sapiens
ggaguuaugagaacaauga

SEQ ID NO: 566831 - RNA, 19 nt, Homo sapiens
gauguucaccuuuccauuu

SEQ ID NO: 566832 - RNA, 19 nt, Homo sapiens
ugacagaggugauauacca

SEQ ID NO: 566833 - RNA, 19 nt, Homo sapiens
ucaaauggaugcacuucuu

SEQ ID NO: 566834 - RNA, 19 nt, Homo sapiens
gcaaguuaguaucugauga

SEQ ID NO: 566835 - RNA, 19 nt, Homo sapiens
ugacaagaaucucagaguu

SEQ ID NO: 566836 - RNA, 19 nt, Homo sapiens
aaacugcugucucuuaaau

SEQ ID NO: 566837 - RNA, 19 nt, Homo sapiens
gcagucuucuugaugcuuu

SEQ ID NO: 566838 - RNA, 19 nt, Homo sapiens
cauuacaacucaucauuug

SEQ ID NO: 566839 - RNA, 19 nt, Homo sapiens
uggaugcacuucuugauuu

SEQ ID NO: 566840 - RNA, 19 nt, Homo sapiens
gaacguauucauuacaguu

SEQ ID NO: 566841 - RNA, 19 nt, Homo sapiens
gaaaccucauaccucuuua

SEQ ID NO: 566842 - RNA, 19 nt, Homo sapiens
ggaauugacagaggugaua

SEQ ID NO: 566843 - RNA, 19 nt, Homo sapiens
ucaaaucucucauuacaac

SEQ ID NO: 566844 - RNA, 19 nt, Homo sapiens
gaagaacaggcacguuuga

SEQ ID NO: 566845 - RNA, 19 nt, Homo sapiens
gaaaugagcguuuuauuca

SEQ ID NO: 566846 - RNA, 19 nt, Homo sapiens
cagcuggccuuaauguuga

SEQ ID NO: 566847 - RNA, 19 nt, Homo sapiens
gaacaggcacguuugaaag

SEQ ID NO: 566848 - RNA, 19 nt, Homo sapiens
ugaaauguuuguuggauuc

SEQ ID NO: 566849 - RNA, 19 nt, Homo sapiens
ccacuaagaaugauguaaa

SEQ ID NO: 566850 - RNA, 19 nt, Homo sapiens
ugagaacaaugaacacaga

SEQ ID NO: 566851 - RNA, 19 nt, Homo sapiens
acagacaaguugcauuuga

SEQ ID NO: 566852 - RNA, 19 nt, Homo sapiens
cuucaaaucucucauuaca

SEQ ID NO: 566853 - RNA, 19 nt, Homo sapiens
gcaaccaaccuuaauauac

SEQ ID NO: 566854 - RNA, 19 nt, Homo sapiens
gcaacuacacuuuccaaug

SEQ ID NO: 566855 - RNA, 19 nt, Homo sapiens
aauaaaugcugccuucaug

SEQ ID NO: 566856 - RNA, 19 nt, Homo sapiens
uggaggagcugcagagaug

SEQ ID NO: 566857 - RNA, 19 nt, Homo sapiens
gcgguauaguagauauuua

SEQ ID NO: 566858 - RNA, 19 nt, Homo sapiens
uaaauccuuuccucacaaa

SEQ ID NO: 566859 - RNA, 19 nt, Homo sapiens
aaacucucuucuuccauua

SEQ ID NO: 566860 - RNA, 19 nt, Homo sapiens
uuaauucagugcacaaaug

SEQ ID NO: 566861 - RNA, 19 nt, Homo sapiens
gcaggcagcauuagaggaa

SEQ ID NO: 566862 - RNA, 19 nt, Homo sapiens
ggcaagcacuggucuaucu

SEQ ID NO: 566863 - RNA, 19 nt, Homo sapiens
caugauaggauauggaauu

SEQ ID NO: 566864 - RNA, 19 nt, Homo sapiens
caccagccauugacauauu

SEQ ID NO: 566865 - RNA, 19 nt, Homo sapiens
gaacuagguggacuucuca

SEQ ID NO: 566866 - RNA, 19 nt, Homo sapiens
ggaagaacaggcacguuug

SEQ ID NO: 566867 - RNA, 19 nt, Homo sapiens
aaaguggauugcaaggaua

SEQ ID NO: 566868 - RNA, 19 nt, Homo sapiens
guauuuggcuucaagaaac

SEQ ID NO: 566869 - RNA, 19 nt, Homo sapiens
ggacaccuacucaugaaau

SEQ ID NO: 566870 - RNA, 19 nt, Homo sapiens
gucaacugcuucucaggua

SEQ ID NO: 566871 - RNA, 19 nt, Homo sapiens
ggcagacaguuuauuugaa

SEQ ID NO: 566872 - RNA, 19 nt, Homo sapiens
caaguugcauuugauuuca

SEQ ID NO: 566873 - RNA, 19 nt, Homo sapiens
gaaggcccaugaagggaau

SEQ ID NO: 566874 - RNA, 19 nt, Homo sapiens
caacaguggccucucagaa

SEQ ID NO: 566875 - RNA, 19 nt, Homo sapiens
gccuuaauguugacuuuga

SEQ ID NO: 566876 - RNA, 19 nt, Homo sapiens
ucucagaguuccucaaagu

SEQ ID NO: 566877 - RNA, 19 nt, Homo sapiens
ccacaaaugggaaguguuc

SEQ ID NO: 566878 - RNA, 19 nt, Homo sapiens
acaguuggcagacaguuua

SEQ ID NO: 566879 - RNA, 19 nt, Homo sapiens
gcaaagaaaccucauaccu

SEQ ID NO: 566880 - RNA, 19 nt, Homo sapiens
gucuucaaaucucucauua

SEQ ID NO: 566881 - RNA, 19 nt, Homo sapiens
caccuggacuacuuaauuc

SEQ ID NO: 566882 - RNA, 19 nt, Homo sapiens
ggaaaagcaggcagcauua

SEQ ID NO: 566883 - RNA, 19 nt, Homo sapiens
uuuauuaggcgguauagua

SEQ ID NO: 566884 - RNA, 19 nt, Homo sapiens
ggagcacagauacaguuua

SEQ ID NO: 566885 - RNA, 19 nt, Homo sapiens
gagaggggcugauggaguu

SEQ ID NO: 566886 - RNA, 19 nt, Homo sapiens
gaaccacuaagaaugaugu

SEQ ID NO: 566887 - RNA, 19 nt, Homo sapiens
ccaccuagcaaguuaguau

SEQ ID NO: 566888 - RNA, 19 nt, Homo sapiens
guaguugggugguggucuu

SEQ ID NO: 566889 - RNA, 19 nt, Homo sapiens
gacaagaaucucagaguuc

SEQ ID NO: 566890 - RNA, 19 nt, Homo sapiens
auacagacaaguugcauuu

SEQ ID NO: 566891 - RNA, 19 nt, Homo sapiens
gauguaaauuggagucaac

SEQ ID NO: 566892 - RNA, 19 nt, Homo sapiens
gaaccagaaccuuccuguu

SEQ ID NO: 566893 - RNA, 19 nt, Homo sapiens
agaaaccucauaccucuuu

SEQ ID NO: 566894 - RNA, 19 nt, Homo sapiens
gcagagcaaguuggaauug

SEQ ID NO: 566895 - RNA, 19 nt, Homo sapiens
gaaccaaugcaaagaaggu

SEQ ID NO: 566896 - RNA, 19 nt, Homo sapiens
uauguaacuugauggaaga

SEQ ID NO: 566897 - RNA, 19 nt, Homo sapiens
cagccagccugucaugaga

SEQ ID NO: 566898 - RNA, 19 nt, Homo sapiens
gacgcaaccaaccuuaaua

SEQ ID NO: 566899 - RNA, 19 nt, Homo sapiens
cauccuaugucaacugcuu

SEQ ID NO: 566900 - RNA, 19 nt, Homo sapiens
ugaccaaaguggaugaaag

SEQ ID NO: 566901 - RNA, 19 nt, Homo sapiens
cagagcaaguuggaauuga

SEQ ID NO: 566902 - RNA, 19 nt, Homo sapiens
ugacaucuauaagaaguuc

SEQ ID NO: 566903 - RNA, 19 nt, Homo sapiens
gaacaaugaacacagaaaa

SEQ ID NO: 566904 - RNA, 19 nt, Homo sapiens
ggaaaugagcguuuuauuc

SEQ ID NO: 566905 - RNA, 19 nt, Homo sapiens
gaagaacucugaucugcuu

SEQ ID NO: 566906 - RNA, 19 nt, Homo sapiens
gaaauuaguaccagacuuu

SEQ ID NO: 566907 - RNA, 19 nt, Homo sapiens
ggaaacccaugcuucuaua

SEQ ID NO: 566908 - RNA, 19 nt, Homo sapiens
guauucaacugacuucaua

SEQ ID NO: 566909 - RNA, 19 nt, Homo sapiens
gaagaaaugguaagacgua

SEQ ID NO: 566910 - RNA, 19 nt, Homo sapiens
gaaccaaacaggaaauauu

SEQ ID NO: 566911 - RNA, 19 nt, Homo sapiens
ucacacagcugcagagaug

SEQ ID NO: 566912 - RNA, 19 nt, Homo sapiens
caagacauaucacugcaaa

SEQ ID NO: 566913 - RNA, 19 nt, Homo sapiens
gcagaaagcacgucauugu

SEQ ID NO: 566914 - RNA, 19 nt, Homo sapiens
guagaaaucauccauaugu

SEQ ID NO: 566915 - RNA, 19 nt, Homo sapiens
ggaaugacaagacauauca

SEQ ID NO: 566916 - RNA, 19 nt, Homo sapiens
gaaaugguaagacguaaau

SEQ ID NO: 566917 - RNA, 19 nt, Homo sapiens
aagaagaacuugggaagaa

SEQ ID NO: 566918 - RNA, 19 nt, Homo sapiens
gguaagacguaaauguuuc

SEQ ID NO: 566919 - RNA, 19 nt, Homo sapiens
gcagagaugaauaaacaaa

SEQ ID NO: 566920 - RNA, 19 nt, Homo sapiens
cugcagagaugaauaaaca

SEQ ID NO: 566921 - RNA, 19 nt, Homo sapiens
uaagugcaguuaucauaga

SEQ ID NO: 566922 - RNA, 19 nt, Homo sapiens
caaagaggcagcaaaggaa

SEQ ID NO: 566923 - RNA, 19 nt, Homo sapiens
ggaaauuaguaccagacuu

SEQ ID NO: 566924 - RNA, 19 nt, Homo sapiens
acucugaucugcuuucuau

SEQ ID NO: 566925 - RNA, 19 nt, Homo sapiens
uuaagucuguguaguauuc

SEQ ID NO: 566926 - RNA, 19 nt, Homo sapiens
guaccagacuuuuauauug

SEQ ID NO: 566927 - RNA, 19 nt, Homo sapiens
ccaaagaggcagcaaagga

SEQ ID NO: 566928 - RNA, 19 nt, Homo sapiens
gauuacauauuccaacagu

SEQ ID NO: 566929 - RNA, 19 nt, Homo sapiens
ccugauggccacuguguua

SEQ ID NO: 566930 - RNA, 19 nt, Homo sapiens
acauaucacugcaaagguu

SEQ ID NO: 566931 - RNA, 19 nt, Homo sapiens
gaaacccaugcuucuauaa

SEQ ID NO: 566932 - RNA, 19 nt, Homo sapiens
ccaaguagaauuaaaccuu

SEQ ID NO: 566933 - RNA, 19 nt, Homo sapiens
aggaguggauuacauauuc

SEQ ID NO: 566934 - RNA, 19 nt, Homo sapiens
guucuuauuccuuguauug

SEQ ID NO: 566935 - RNA, 19 nt, Homo sapiens
gcacgucauuguggccauu

SEQ ID NO: 566936 - RNA, 19 nt, Homo sapiens
gaaacuuaagggcaauaaa

SEQ ID NO: 566937 - RNA, 19 nt, Homo sapiens
ucaagggaaugacaagaca

SEQ ID NO: 566938 - RNA, 19 nt, Homo sapiens
ggaaccuacucagaaguga

SEQ ID NO: 566939 - RNA, 19 nt, Homo sapiens
gaacuugggaagaaagagu

SEQ ID NO: 566940 - RNA, 19 nt, Homo sapiens
agaagaacuugggaagaaa

SEQ ID NO: 566941 - RNA, 19 nt, Homo sapiens
gaauagaagaaugcagaaa

SEQ ID NO: 566942 - RNA, 19 nt, Homo sapiens
cuaggaaucauuugcauug

SEQ ID NO: 566943 - RNA, 19 nt, Homo sapiens
gaacucugaucugcuuucu

SEQ ID NO: 566944 - RNA, 19 nt, Homo sapiens
caccacuuauagcuucuua

SEQ ID NO: 566945 - RNA, 19 nt, Homo sapiens
gaggaguggauuacauauu

SEQ ID NO: 566946 - RNA, 19 nt, Homo sapiens
ggaaacuuaagggcaauaa

SEQ ID NO: 566947 - RNA, 19 nt, Homo sapiens
cagcugcagagaugaauaa

SEQ ID NO: 566948 - RNA, 19 nt, Homo sapiens
cuuaagugcaguuaucaua

SEQ ID NO: 566949 - RNA, 19 nt, Homo sapiens
uaaugaggaagaaauggua

SEQ ID NO: 566950 - RNA, 19 nt, Homo sapiens
guacuggagcagaacaauu

SEQ ID NO: 566951 - RNA, 19 nt, Homo sapiens
aagaggaaccuacucagaa

SEQ ID NO: 566952 - RNA, 19 nt, Homo sapiens
gguaaggaaagaagaacuu

SEQ ID NO: 566953 - RNA, 19 nt, Homo sapiens
uacuggagcagaacaauuu

SEQ ID NO: 566954 - RNA, 19 nt, Homo sapiens
aaacccaugcuucuauaaa

SEQ ID NO: 566955 - RNA, 19 nt, Homo sapiens
gagcacagucccugacauc

SEQ ID NO: 566956 - RNA, 19 nt, Homo sapiens
gaagaacuugggaagaaag

SEQ ID NO: 566957 - RNA, 19 nt, Homo sapiens
agaggaaccuacucagaag

SEQ ID NO: 566958 - RNA, 19 nt, Homo sapiens
aaagaggaaccuacucaga

SEQ ID NO: 566959 - RNA, 19 nt, Homo sapiens
cacagucccugacaucaca

SEQ ID NO: 566960 - RNA, 19 nt, Homo sapiens
cuacucagccuccaacaca

SEQ ID NO: 566961 - RNA, 19 nt, Homo sapiens
cacaugcaguuugccuaua

SEQ ID NO: 566962 - RNA, 19 nt, Homo sapiens
gggauccugucaaaauaua

SEQ ID NO: 566963 - RNA, 19 nt, Homo sapiens
cuucuuaagugcaguuauc

SEQ ID NO: 566964 - RNA, 19 nt, Homo sapiens
acaaagaggaaccuacuca

SEQ ID NO: 566965 - RNA, 19 nt, Homo sapiens
gcugagguccuaggaauca

SEQ ID NO: 566966 - RNA, 19 nt, Homo sapiens
cugcugagguccuaggaau

SEQ ID NO: 566967 - RNA, 19 nt, Homo sapiens
ggaaccaaacaggaaauau

SEQ ID NO: 566968 - RNA, 19 nt, Homo sapiens
aacccaugcuucuauaaau

SEQ ID NO: 566969 - RNA, 19 nt, Homo sapiens
guaaggaaagaagaacuug

SEQ ID NO: 566970 - RNA, 19 nt, Homo sapiens
gagguccuaggaaucauuu

SEQ ID NO: 566971 - RNA, 19 nt, Homo sapiens
aggcagcaaaggaaacuua

SEQ ID NO: 566972 - RNA, 19 nt, Homo sapiens
aagaaaugguaagacguaa

SEQ ID NO: 566973 - RNA, 19 nt, Homo sapiens
cugaucugcuuucuauaga

SEQ ID NO: 566974 - RNA, 19 nt, Homo sapiens
gugcuucgaagaacucuga

SEQ ID NO: 566975 - RNA, 19 nt, Homo sapiens
aaacaaagaggaaccuacu

SEQ ID NO: 566976 - RNA, 19 nt, Homo sapiens
cugaggaguggauuacaua

SEQ ID NO: 566977 - RNA, 19 nt, Homo sapiens
aagggaaugacaagacaua

SEQ ID NO: 566978 - RNA, 19 nt, Homo sapiens
guaagacguaaauguuuca

SEQ ID NO: 566979 - RNA, 19 nt, Homo sapiens
gggaaugacaagacauauc

SEQ ID NO: 566980 - RNA, 19 nt, Homo sapiens
aaccaaacaggaaauauuc

SEQ ID NO: 566981 - RNA, 19 nt, Homo sapiens
uggaaacccaugcuucuau

SEQ ID NO: 566982 - RNA, 19 nt, Homo sapiens
cagaaagcacgucauugug

SEQ ID NO: 566983 - RNA, 19 nt, Homo sapiens
uuauauuggucaacagcaa

SEQ ID NO: 566984 - RNA, 19 nt, Homo sapiens
ucaggaaccaaacaggaaa

SEQ ID NO: 566985 - RNA, 19 nt, Homo sapiens
cagcaaaggaaacuuaagg

SEQ ID NO: 566986 - RNA, 19 nt, Homo sapiens
aaagaggcagcaaaggaaa

SEQ ID NO: 566987 - RNA, 19 nt, Homo sapiens
ugguaagacguaaauguuu

SEQ ID NO: 566988 - RNA, 19 nt, Homo sapiens
cuauagauaaugaggaaga

SEQ ID NO: 566989 - RNA, 19 nt, Homo sapiens
ccugaggaguggauuacau

SEQ ID NO: 566990 - RNA, 19 nt, Homo sapiens
acccaugcuucuauaaaug

SEQ ID NO: 566991 - RNA, 19 nt, Homo sapiens
gauggccacuguguuaaaa

SEQ ID NO: 566992 - RNA, 19 nt, Homo sapiens
ggcagcaaaggaaacuuaa

SEQ ID NO: 566993 - RNA, 19 nt, Homo sapiens
ccaugcuucuauaaauguu

SEQ ID NO: 566994 - RNA, 19 nt, Homo sapiens
aaagaagaacuugggaaga

SEQ ID NO: 566995 - RNA, 19 nt, Homo sapiens
gcacauuugguuauuucca

SEQ ID NO: 566996 - RNA, 19 nt, Homo sapiens
acacaugcaguuugccuau

SEQ ID NO: 566997 - RNA, 19 nt, Homo sapiens
acaugcaguuugccuauac

SEQ ID NO: 566998 - RNA, 19 nt, Homo sapiens
gagaugaauaaacaaagag

SEQ ID NO: 566999 - RNA, 19 nt, Homo sapiens
aauagaagaaugcagaaag

SEQ ID NO: 567000 - RNA, 19 nt, Homo sapiens
ucuuauuccuuguauugga

SEQ ID NO: 567001 - RNA, 19 nt, Homo sapiens
cauaucacugcaaagguuu

SEQ ID NO: 567002 - RNA, 19 nt, Homo sapiens
agacauaucacugcaaagg

SEQ ID NO: 567003 - RNA, 19 nt, Homo sapiens
agaaaugguaagacguaaa

SEQ ID NO: 567004 - RNA, 19 nt, Homo sapiens
acacagcugcagagaugaa

SEQ ID NO: 567005 - RNA, 19 nt, Homo sapiens
guagggagcuguucguuua

SEQ ID NO: 567006 - RNA, 19 nt, Homo sapiens
gaagugagaugccaauuug

SEQ ID NO: 567007 - RNA, 19 nt, Homo sapiens
gcacugaccaugucuauua

SEQ ID NO: 567008 - RNA, 19 nt, Homo sapiens
ggacugugcuacuguauuu

SEQ ID NO: 567009 - RNA, 19 nt, Homo sapiens
ggugaucucugcuucauua

SEQ ID NO: 567010 - RNA, 19 nt, Homo sapiens
caucauagcucucacuguu

SEQ ID NO: 567011 - RNA, 19 nt, Homo sapiens
gagaaaagguuguauguuu

SEQ ID NO: 567012 - RNA, 19 nt, Homo sapiens
ucucaaagcuaccaaguuu

SEQ ID NO: 567013 - RNA, 19 nt, Homo sapiens
caacaccucuggcuacuga

SEQ ID NO: 567014 - RNA, 19 nt, Homo sapiens
gggcagaggugaacuugaa

SEQ ID NO: 567015 - RNA, 19 nt, Homo sapiens
ugaccucucuggauuauuu

SEQ ID NO: 567016 - RNA, 19 nt, Homo sapiens
uaacaaaccugugaacugu

SEQ ID NO: 567017 - RNA, 19 nt, Homo sapiens
ggacguaccugggaguuug

SEQ ID NO: 567018 - RNA, 19 nt, Homo sapiens
gaccagcgcucgauuguca

SEQ ID NO: 567019 - RNA, 19 nt, Homo sapiens
gaaaaugcuucuagaauga

SEQ ID NO: 567020 - RNA, 19 nt, Homo sapiens
cuaccaaguuugugcaaua

SEQ ID NO: 567021 - RNA, 19 nt, Homo sapiens
guuaugaccucucuggauu

SEQ ID NO: 567022 - RNA, 19 nt, Homo sapiens
acacucaaauggcuaagua

SEQ ID NO: 567023 - RNA, 19 nt, Homo sapiens
ggaagugagaugccaauuu

SEQ ID NO: 567024 - RNA, 19 nt, Homo sapiens
uuaaauagcaguucuguug

SEQ ID NO: 567025 - RNA, 19 nt, Homo sapiens
ggagggaacucuugacacu

SEQ ID NO: 567026 - RNA, 19 nt, Homo sapiens
ugcauagacucacuuguua

SEQ ID NO: 567027 - RNA, 19 nt, Homo sapiens
acaaaccugugaacuguaa

SEQ ID NO: 567028 - RNA, 19 nt, Homo sapiens
ugucauccuucuucaauaa

SEQ ID NO: 567029 - RNA, 19 nt, Homo sapiens
ucaaauggcuaaguagguu

SEQ ID NO: 567030 - RNA, 19 nt, Homo sapiens
gcccaucccuguaauagau

SEQ ID NO: 567031 - RNA, 19 nt, Homo sapiens
ugauggagcuacuacugua

SEQ ID NO: 567032 - RNA, 19 nt, Homo sapiens
cggaugcgcugcugucuga

SEQ ID NO: 567033 - RNA, 19 nt, Homo sapiens
cacaagcacauacuaauuu

SEQ ID NO: 567034 - RNA, 19 nt, Homo sapiens
gaucucugcuucauuaguc

SEQ ID NO: 567035 - RNA, 19 nt, Homo sapiens
gcagaaggugguaaugaaa

SEQ ID NO: 567036 - RNA, 19 nt, Homo sapiens
gcauucauccuucguauca

SEQ ID NO: 567037 - RNA, 19 nt, Homo sapiens
ccacaagcacauacuaauu

SEQ ID NO: 567038 - RNA, 19 nt, Homo sapiens
gagcagaaggugguaauga

SEQ ID NO: 567039 - RNA, 19 nt, Homo sapiens
gaccgugcguggagagaaa

SEQ ID NO: 567040 - RNA, 19 nt, Homo sapiens
gaggaagggcugacacuug

SEQ ID NO: 567041 - RNA, 19 nt, Homo sapiens
gaacuaacaaaccugugaa

SEQ ID NO: 567042 - RNA, 19 nt, Homo sapiens
caccagagccacacucaaa

SEQ ID NO: 567043 - RNA, 19 nt, Homo sapiens
aaaugucacuuccucauca

SEQ ID NO: 567044 - RNA, 19 nt, Homo sapiens
guguugguguuuccuauuu

SEQ ID NO: 567045 - RNA, 19 nt, Homo sapiens
caauaaaugcugaaugaca

SEQ ID NO: 567046 - RNA, 19 nt, Homo sapiens
ccaaguuugugcaauaagu

SEQ ID NO: 567047 - RNA, 19 nt, Homo sapiens
agacucacuuguuaaauag

SEQ ID NO: 567048 - RNA, 19 nt, Homo sapiens
gcauagacucacuuguuaa

SEQ ID NO: 567049 - RNA, 19 nt, Homo sapiens
gcuaggaucugcauuuuca

SEQ ID NO: 567050 - RNA, 19 nt, Homo sapiens
agggaacucuugacacuga

SEQ ID NO: 567051 - RNA, 19 nt, Homo sapiens
ugaaaaugcuucuagaaug

SEQ ID NO: 567052 - RNA, 19 nt, Homo sapiens
uuaagcagcauacaccuaa

SEQ ID NO: 567053 - RNA, 19 nt, Homo sapiens
cuguugagguucugucuuu

SEQ ID NO: 567054 - RNA, 19 nt, Homo sapiens
ccacuuggcccaggaaaga

SEQ ID NO: 567055 - RNA, 19 nt, Homo sapiens
cauagacucacuuguuaaa

SEQ ID NO: 567056 - RNA, 19 nt, Homo sapiens
uaccaaguuugugcaauaa

SEQ ID NO: 567057 - RNA, 19 nt, Homo sapiens
acacugagccacuaaaaua

SEQ ID NO: 567058 - RNA, 19 nt, Homo sapiens
gagaaaggccaagcugaug

SEQ ID NO: 567059 - RNA, 19 nt, Homo sapiens
uauucuggcuguacuaaug

SEQ ID NO: 567060 - RNA, 19 nt, Homo sapiens
uguaaugcgugaacuaaca

SEQ ID NO: 567061 - RNA, 19 nt, Homo sapiens
gaacugaccagcgcucgau

SEQ ID NO: 567062 - RNA, 19 nt, Homo sapiens
gaacuuccaggcuuucuac

SEQ ID NO: 567063 - RNA, 19 nt, Homo sapiens
gcacgugcuuaagcccuuu

SEQ ID NO: 567064 - RNA, 19 nt, Homo sapiens
caaacggacugugcuacug

SEQ ID NO: 567065 - RNA, 19 nt, Homo sapiens
gcacagggagggaacucuu

SEQ ID NO: 567066 - RNA, 19 nt, Homo sapiens
caaauggcuaaguagguua

SEQ ID NO: 567067 - RNA, 19 nt, Homo sapiens
ccaaaggugccgacuggaa

SEQ ID NO: 567068 - RNA, 19 nt, Homo sapiens
caccucagcugggcucuug

SEQ ID NO: 567069 - RNA, 19 nt, Homo sapiens
gcagcauacaccuaaauug

SEQ ID NO: 567070 - RNA, 19 nt, Homo sapiens
acagagcacuggcccuuca

SEQ ID NO: 567071 - RNA, 19 nt, Homo sapiens
uaaauagcaguucuguuga

SEQ ID NO: 567072 - RNA, 19 nt, Homo sapiens
ccucuucccucuucacauc

SEQ ID NO: 567073 - RNA, 19 nt, Homo sapiens
uagcaguucuguugagagu

SEQ ID NO: 567074 - RNA, 19 nt, Homo sapiens
cagcauacaccuaaauugg

SEQ ID NO: 567075 - RNA, 19 nt, Homo sapiens
ggaggggacuguugagguu

SEQ ID NO: 567076 - RNA, 19 nt, Homo sapiens
ccuccguucuuucugcaua

SEQ ID NO: 567077 - RNA, 19 nt, Homo sapiens
gucacuuccucaucaguuu

SEQ ID NO: 567078 - RNA, 19 nt, Homo sapiens
ccagugaaguuucgguuuu

SEQ ID NO: 567079 - RNA, 19 nt, Homo sapiens
agcagaaggugguaaugaa

SEQ ID NO: 567080 - RNA, 19 nt, Homo sapiens
cacccaagccucuucuaaa

SEQ ID NO: 567081 - RNA, 19 nt, Homo sapiens
cugcauagacucacuuguu

SEQ ID NO: 567082 - RNA, 19 nt, Homo sapiens
ucuugaggcugaccaguug

SEQ ID NO: 567083 - RNA, 19 nt, Homo sapiens
ggucauaggcuuguaaagg

SEQ ID NO: 567084 - RNA, 19 nt, Homo sapiens
acacgggacugguauucug

SEQ ID NO: 567085 - RNA, 19 nt, Homo sapiens
ccugugaacuguaaauagg

SEQ ID NO: 567086 - RNA, 19 nt, Homo sapiens
gaaauuaagcauucauccu

SEQ ID NO: 567087 - RNA, 19 nt, Homo sapiens
uagaaugagugaaccacau

SEQ ID NO: 567088 - RNA, 19 nt, Homo sapiens
caggugaggcugcccauug

SEQ ID NO: 567089 - RNA, 19 nt, Homo sapiens
ucacuuggcuuccuuuccu

SEQ ID NO: 567090 - RNA, 19 nt, Homo sapiens
gcacacgggacugguauuc

SEQ ID NO: 567091 - RNA, 19 nt, Homo sapiens
ugaacuaacaaaccuguga

SEQ ID NO: 567092 - RNA, 19 nt, Homo sapiens
ccacuaaaauauggacuaa

SEQ ID NO: 567093 - RNA, 19 nt, Homo sapiens
uaagcagcauacaccuaaa

SEQ ID NO: 567094 - RNA, 19 nt, Homo sapiens
gcguguaugucaaggaagu

SEQ ID NO: 567095 - RNA, 19 nt, Homo sapiens
gcaggggucucucaugugu

SEQ ID NO: 567096 - RNA, 19 nt, Homo sapiens
uaugaccucucuggauuau

SEQ ID NO: 567097 - RNA, 19 nt, Homo sapiens
agaaggugguaaugaaaca

SEQ ID NO: 567098 - RNA, 19 nt, Homo sapiens
ggagaaguagggagcuguu

SEQ ID NO: 567099 - RNA, 19 nt, Homo sapiens
ucacccaagccucuucuaa

SEQ ID NO: 567100 - RNA, 19 nt, Homo sapiens
ggagggucauaggcuugua

SEQ ID NO: 567101 - RNA, 19 nt, Homo sapiens
gauggagcuacuacuguaa

SEQ ID NO: 567102 - RNA, 19 nt, Homo sapiens
ugagugaaccacaucauag

SEQ ID NO: 567103 - RNA, 19 nt, Homo sapiens
guuugaaucaggcccauuu

SEQ ID NO: 567104 - RNA, 19 nt, Homo sapiens
gaccuugccagugaaguuu

SEQ ID NO: 567105 - RNA, 19 nt, Homo sapiens
gauccaagcuaugaaauaa

SEQ ID NO: 567106 - RNA, 19 nt, Homo sapiens
gcacaggucuugccagaug

SEQ ID NO: 567107 - RNA, 19 nt, Homo sapiens
agaagauggucgugaauua

SEQ ID NO: 567108 - RNA, 19 nt, Homo sapiens
ggacauggcuacucaaagc

SEQ ID NO: 567109 - RNA, 19 nt, Homo sapiens
ggaagugucucuccacagu

SEQ ID NO: 567110 - RNA, 19 nt, Homo sapiens
gaaccagaccacugucaua

SEQ ID NO: 567111 - RNA, 19 nt, Homo sapiens
gacccaagauggacuuuga

SEQ ID NO: 567112 - RNA, 19 nt, Homo sapiens
agacguggccuuaaauaua

SEQ ID NO: 567113 - RNA, 19 nt, Homo sapiens
gcuguaaggacaauuauuu

SEQ ID NO: 567114 - RNA, 19 nt, Homo sapiens
gcaacuaccuucccauggu

SEQ ID NO: 567115 - RNA, 19 nt, Homo sapiens
gcccuuggcuguuaugaug

SEQ ID NO: 567116 - RNA, 19 nt, Homo sapiens
caguaaggcucauaaagga

SEQ ID NO: 567117 - RNA, 19 nt, Homo sapiens
ggacaugggacauaucuuc

SEQ ID NO: 567118 - RNA, 19 nt, Homo sapiens
ggagaacccugccuaugag

SEQ ID NO: 567119 - RNA, 19 nt, Homo sapiens
gcagaaggccugugucauc

SEQ ID NO: 567120 - RNA, 19 nt, Homo sapiens
guuagaagauggucgugaa

SEQ ID NO: 567121 - RNA, 19 nt, Homo sapiens
ggagacguggccuuaaaua

SEQ ID NO: 567122 - RNA, 19 nt, Homo sapiens
gcaggaaaguugagagcau

SEQ ID NO: 567123 - RNA, 19 nt, Homo sapiens
gcacuccgcaggaaaguug

SEQ ID NO: 567124 - RNA, 19 nt, Homo sapiens
ggagauccaagcuaugaaa

SEQ ID NO: 567125 - RNA, 19 nt, Homo sapiens
gcucagaagucaccaacca

SEQ ID NO: 567126 - RNA, 19 nt, Homo sapiens
ggacucagugcagcauuua

SEQ ID NO: 567127 - RNA, 19 nt, Homo sapiens
gcaguaaggcucauaaagg

SEQ ID NO: 567128 - RNA, 19 nt, Homo sapiens
caagauggacuuugaucaa

SEQ ID NO: 567129 - RNA, 19 nt, Homo sapiens
gacguggccuuaaauauac

SEQ ID NO: 567130 - RNA, 19 nt, Homo sapiens
cauggaaucuugacuaacu

SEQ ID NO: 567131 - RNA, 19 nt, Homo sapiens
uacauggaaucuugacuaa

SEQ ID NO: 567132 - RNA, 19 nt, Homo sapiens
ucaguuaugccuuccauuu

SEQ ID NO: 567133 - RNA, 19 nt, Homo sapiens
gaauuaggcuacgcuuaca

SEQ ID NO: 567134 - RNA, 19 nt, Homo sapiens
gaagcaaccagcaccauca

SEQ ID NO: 567135 - RNA, 19 nt, Homo sapiens
ugaaggccaugaugucaga

SEQ ID NO: 567136 - RNA, 19 nt, Homo sapiens
ggccuuaaauauacacaga

SEQ ID NO: 567137 - RNA, 19 nt, Homo sapiens
caacaguauucaagaagca

SEQ ID NO: 567138 - RNA, 19 nt, Homo sapiens
caaccaauacucaggagaa

SEQ ID NO: 567139 - RNA, 19 nt, Homo sapiens
gaacaugcugagucgcuuu

SEQ ID NO: 567140 - RNA, 19 nt, Homo sapiens
agacugaagccaccuauga

SEQ ID NO: 567141 - RNA, 19 nt, Homo sapiens
gcaaccagcaccaucaugu

SEQ ID NO: 567142 - RNA, 19 nt, Homo sapiens
ccagugggcucagaaguca

SEQ ID NO: 567143 - RNA, 19 nt, Homo sapiens
cugcuaaggugcacugcua

SEQ ID NO: 567144 - RNA, 19 nt, Homo sapiens
guacagcacagagcaacua

SEQ ID NO: 567145 - RNA, 19 nt, Homo sapiens
gaacccugccuaugaggaa

SEQ ID NO: 567146 - RNA, 19 nt, Homo sapiens
caacguaugcacagacaga

SEQ ID NO: 567147 - RNA, 19 nt, Homo sapiens
gaagauggucgugaauuag

SEQ ID NO: 567148 - RNA, 19 nt, Homo sapiens
gcaaaugcaccccgacaua

SEQ ID NO: 567149 - RNA, 19 nt, Homo sapiens
gagagcaucauccacaguu

SEQ ID NO: 567150 - RNA, 19 nt, Homo sapiens
cagaagucaccaaccaaua

SEQ ID NO: 567151 - RNA, 19 nt, Homo sapiens
gguauaugcaguccuuuga

SEQ ID NO: 567152 - RNA, 19 nt, Homo sapiens
acacagagucuucgugaga

SEQ ID NO: 567153 - RNA, 19 nt, Homo sapiens
gcuaugaaauaaccaacag

SEQ ID NO: 567154 - RNA, 19 nt, Homo sapiens
gcaguccuuugacguggaa

SEQ ID NO: 567155 - RNA, 19 nt, Homo sapiens
gaucaguguuuaaauucag

SEQ ID NO: 567156 - RNA, 19 nt, Homo sapiens
agagcuaccugcagacuca

SEQ ID NO: 567157 - RNA, 19 nt, Homo sapiens
agagguauaugcaguccuu

SEQ ID NO: 567158 - RNA, 19 nt, Homo sapiens
gagacguggccuuaaauau

SEQ ID NO: 567159 - RNA, 19 nt, Homo sapiens
uaaccaacaguauucaaga

SEQ ID NO: 567160 - RNA, 19 nt, Homo sapiens
cuucaccgaucaguguuua

SEQ ID NO: 567161 - RNA, 19 nt, Homo sapiens
aggagcagauugccaaaug

SEQ ID NO: 567162 - RNA, 19 nt, Homo sapiens
cuggagacguggccuuaaa

SEQ ID NO: 567163 - RNA, 19 nt, Homo sapiens
agagcaucauccacaguua

SEQ ID NO: 567164 - RNA, 19 nt, Homo sapiens
gcgccuggguugguuagaa

SEQ ID NO: 567165 - RNA, 19 nt, Homo sapiens
aggagaacccugccuauga

SEQ ID NO: 567166 - RNA, 19 nt, Homo sapiens
ugacuucaccgaucagugu

SEQ ID NO: 567167 - RNA, 19 nt, Homo sapiens
gacuaacucgggugacuuu

SEQ ID NO: 567168 - RNA, 19 nt, Homo sapiens
uuacagacccugacgcaau

SEQ ID NO: 567169 - RNA, 19 nt, Homo sapiens
gggcacauguggcaguaag

SEQ ID NO: 567170 - RNA, 19 nt, Homo sapiens
gcacugaccaaugcugaga

SEQ ID NO: 567171 - RNA, 19 nt, Homo sapiens
auagagagcgagagguaua

SEQ ID NO: 567172 - RNA, 19 nt, Homo sapiens
ggagcagauugccaaaugg

SEQ ID NO: 567173 - RNA, 19 nt, Homo sapiens
ugacccagaaugagcguua

SEQ ID NO: 567174 - RNA, 19 nt, Homo sapiens
aaccaacaguauucaagaa

SEQ ID NO: 567175 - RNA, 19 nt, Homo sapiens
gugcacugcuacuauguca

SEQ ID NO: 567176 - RNA, 19 nt, Homo sapiens
accgaucaguguuuaaauu

SEQ ID NO: 567177 - RNA, 19 nt, Homo sapiens
cgggugacuuucuccauga

SEQ ID NO: 567178 - RNA, 19 nt, Homo sapiens
uaaggugcacugcuacuau

SEQ ID NO: 567179 - RNA, 19 nt, Homo sapiens
acauagagagcgagaggua

SEQ ID NO: 567180 - RNA, 19 nt, Homo sapiens
cgaucaguguuuaaauuca

SEQ ID NO: 567181 - RNA, 19 nt, Homo sapiens
uaacucgggugacuuucuc

SEQ ID NO: 567182 - RNA, 19 nt, Homo sapiens
gaaaguugagagcaucauc

SEQ ID NO: 567183 - RNA, 19 nt, Homo sapiens
uggagaaacuagaaaauga

SEQ ID NO: 567184 - RNA, 19 nt, Homo sapiens
ccagugacccagaggcaaa

SEQ ID NO: 567185 - RNA, 19 nt, Homo sapiens
uggaacggcucaccaacau

SEQ ID NO: 567186 - RNA, 19 nt, Homo sapiens
ugaauuaggcuacgcuuac

SEQ ID NO: 567187 - RNA, 19 nt, Homo sapiens
auacauggaaucuugacua

SEQ ID NO: 567188 - RNA, 19 nt, Homo sapiens
uggcggacauggcuacuca

SEQ ID NO: 567189 - RNA, 19 nt, Homo sapiens
ccuguuaacugaugcuuuu

SEQ ID NO: 567190 - RNA, 19 nt, Homo sapiens
acaguuacccggaguuuag

SEQ ID NO: 567191 - RNA, 19 nt, Homo sapiens
gcacugcuacuaugucacu

SEQ ID NO: 567192 - RNA, 19 nt, Homo sapiens
guugggacaugggacauau

SEQ ID NO: 567193 - RNA, 19 nt, Homo sapiens
caaguggacauggcaagaa

SEQ ID NO: 567194 - RNA, 19 nt, Homo sapiens
gugaauuaggcuacgcuua

SEQ ID NO: 567195 - RNA, 19 nt, Homo sapiens
uuagcuguaaggacaauua

SEQ ID NO: 567196 - RNA, 19 nt, Homo sapiens
aaauauacacagagucuuc

SEQ ID NO: 567197 - RNA, 19 nt, Homo sapiens
ucaccgaucaguguuuaaa

SEQ ID NO: 567198 - RNA, 19 nt, Homo sapiens
ccagaccacugucauacac

SEQ ID NO: 567199 - RNA, 19 nt, Homo sapiens
uacagacccugacgcaauc

SEQ ID NO: 567200 - RNA, 19 nt, Homo sapiens
gcggacauggcuacucaaa

SEQ ID NO: 567201 - RNA, 19 nt, Homo sapiens
ccacaguuacccggaguuu

SEQ ID NO: 567202 - RNA, 19 nt, Homo sapiens
aaggugcacugcuacuaug

SEQ ID NO: 567203 - RNA, 19 nt, Homo sapiens
cuacgagggugagaacaca

SEQ ID NO: 567204 - RNA, 19 nt, Homo sapiens
gccaugaugucagaauucu

SEQ ID NO: 567205 - RNA, 19 nt, Homo sapiens
gaacaaaccugucauagga

SEQ ID NO: 567206 - RNA, 19 nt, Homo sapiens
gaaaagaaauugcagauug

SEQ ID NO: 567207 - RNA, 19 nt, Homo sapiens
ugaaagacaucucacauau

SEQ ID NO: 567208 - RNA, 19 nt, Homo sapiens
gcagaacggucuagauaau

SEQ ID NO: 567209 - RNA, 19 nt, Homo sapiens
gcaagcggaucuucgagua

SEQ ID NO: 567210 - RNA, 19 nt, Homo sapiens
gaaagacaucucacauaua

SEQ ID NO: 567211 - RNA, 19 nt, Homo sapiens
gaucagcaguuuacaguuc

SEQ ID NO: 567212 - RNA, 19 nt, Homo sapiens
gagcugaacuuccuucgau

SEQ ID NO: 567213 - RNA, 19 nt, Homo sapiens
ccaaguaccuccuccauag

SEQ ID NO: 567214 - RNA, 19 nt, Homo sapiens
ggagauugcugcugcuuuc

SEQ ID NO: 567215 - RNA, 19 nt, Homo sapiens
gggcagaacggucuagaua

SEQ ID NO: 567216 - RNA, 19 nt, Homo sapiens
gcauacaaguggcugguuu

SEQ ID NO: 567217 - RNA, 19 nt, Homo sapiens
acaaguggcugguuugcua

SEQ ID NO: 567218 - RNA, 19 nt, Homo sapiens
uuucgaagcugccaaguuu

SEQ ID NO: 567219 - RNA, 19 nt, Homo sapiens
ggaaggacguggcgcuguu

SEQ ID NO: 567220 - RNA, 19 nt, Homo sapiens
ggagggcaauguccgcuuu

SEQ ID NO: 567221 - RNA, 19 nt, Homo sapiens
gaucgcuccuccugacuuu

SEQ ID NO: 567222 - RNA, 19 nt, Homo sapiens
gaauuaagccacggcagua

SEQ ID NO: 567223 - RNA, 19 nt, Homo sapiens
uaggaagucugaaaucgaa

SEQ ID NO: 567224 - RNA, 19 nt, Homo sapiens
guucuggacucaccgauug

SEQ ID NO: 567225 - RNA, 19 nt, Homo sapiens
gagccgaccuguccuugga

SEQ ID NO: 567226 - RNA, 19 nt, Homo sapiens
gaaacgaagggaacuaauc

SEQ ID NO: 567227 - RNA, 19 nt, Homo sapiens
gcugaaagacgaugcaguu

SEQ ID NO: 567228 - RNA, 19 nt, Homo sapiens
gcaauguccgcuuuaagaa

SEQ ID NO: 567229 - RNA, 19 nt, Homo sapiens
gcagacaagcaacuauuug

SEQ ID NO: 567230 - RNA, 19 nt, Homo sapiens
ggcaauguccgcuuuaaga

SEQ ID NO: 567231 - RNA, 19 nt, Homo sapiens
gauugcugcugcuuucuga

SEQ ID NO: 567232 - RNA, 19 nt, Homo sapiens
agacaucucacauauauuc

SEQ ID NO: 567233 - RNA, 19 nt, Homo sapiens
aaauaccagugcuugagua

SEQ ID NO: 567234 - RNA, 19 nt, Homo sapiens
ccacagaggaggaggaaau

SEQ ID NO: 567235 - RNA, 19 nt, Homo sapiens
gcacaacugcccacuacga

SEQ ID NO: 567236 - RNA, 19 nt, Homo sapiens
gaggaauucaucauacauu

SEQ ID NO: 567237 - RNA, 19 nt, Homo sapiens
gaucuucgaguaugacuuc

SEQ ID NO: 567238 - RNA, 19 nt, Homo sapiens
gaaauaccagugcuugagu

SEQ ID NO: 567239 - RNA, 19 nt, Homo sapiens
uuacaguucugguucugaa

SEQ ID NO: 567240 - RNA, 19 nt, Homo sapiens
aaacgaagggaacuaauca

SEQ ID NO: 567241 - RNA, 19 nt, Homo sapiens
ucagccaagucuaaugaaa

SEQ ID NO: 567242 - RNA, 19 nt, Homo sapiens
cgaugcaguugcccuggua

SEQ ID NO: 567243 - RNA, 19 nt, Homo sapiens
ggaccucaacuucugauuc

SEQ ID NO: 567244 - RNA, 19 nt, Homo sapiens
agugaugguuggcgacaua

SEQ ID NO: 567245 - RNA, 19 nt, Homo sapiens
gggcauguaugacucuucu

SEQ ID NO: 567246 - RNA, 19 nt, Homo sapiens
ugaaaucgaagcucuagug

SEQ ID NO: 567247 - RNA, 19 nt, Homo sapiens
ggaaauaccagugcuugag

SEQ ID NO: 567248 - RNA, 19 nt, Homo sapiens
cugaaagacaucucacaua

SEQ ID NO: 567249 - RNA, 19 nt, Homo sapiens
caauguccgcuuuaagaaa

SEQ ID NO: 567250 - RNA, 19 nt, Homo sapiens
ucacggugguccagagguu

SEQ ID NO: 567251 - RNA, 19 nt, Homo sapiens
ccuuagagaugacaacgau

SEQ ID NO: 567252 - RNA, 19 nt, Homo sapiens
ggcagaacggucuagauaa

SEQ ID NO: 567253 - RNA, 19 nt, Homo sapiens
agaaauugcagauugauca

SEQ ID NO: 567254 - RNA, 19 nt, Homo sapiens
cgacggcgagcucuacaaa

SEQ ID NO: 567255 - RNA, 19 nt, Homo sapiens
gagaaaagaucaggaagca

SEQ ID NO: 567256 - RNA, 19 nt, Homo sapiens
guugaacuguggagugugu

SEQ ID NO: 567257 - RNA, 19 nt, Homo sapiens
gccaaguaccuccuccaua

SEQ ID NO: 567258 - RNA, 19 nt, Homo sapiens
gcgccuaaacugcugauug

SEQ ID NO: 567259 - RNA, 19 nt, Homo sapiens
aaucagacguggaccucaa

SEQ ID NO: 567260 - RNA, 19 nt, Homo sapiens
uuugaggucuccaguguug

SEQ ID NO: 567261 - RNA, 19 nt, Homo sapiens
cagcagacaagcaacuauu

SEQ ID NO: 567262 - RNA, 19 nt, Homo sapiens
uggagugugugggcucuua

SEQ ID NO: 567263 - RNA, 19 nt, Homo sapiens
uuaagccacggcaguaaua

SEQ ID NO: 567264 - RNA, 19 nt, Homo sapiens
gcacauucagccaagucua

SEQ ID NO: 567265 - RNA, 19 nt, Homo sapiens
auacgaaggugacaacaac

SEQ ID NO: 567266 - RNA, 19 nt, Homo sapiens
caacugcacauacgaaggu

SEQ ID NO: 567267 - RNA, 19 nt, Homo sapiens
gcaguuuacaguucugguu

SEQ ID NO: 567268 - RNA, 19 nt, Homo sapiens
cgccuaaacugcugauugg

SEQ ID NO: 567269 - RNA, 19 nt, Homo sapiens
gaccucaacuucugauucc

SEQ ID NO: 567270 - RNA, 19 nt, Homo sapiens
aggaagcagugacuuugaa

SEQ ID NO: 567271 - RNA, 19 nt, Homo sapiens
ggguugaacuguggagugu

SEQ ID NO: 567272 - RNA, 19 nt, Homo sapiens
gcugauuggccucaacuug

SEQ ID NO: 567273 - RNA, 19 nt, Homo sapiens
ccaagucuaaugaaacgaa

SEQ ID NO: 567274 - RNA, 19 nt, Homo sapiens
cacauucagccaagucuaa

SEQ ID NO: 567275 - RNA, 19 nt, Homo sapiens
gcaggaaagcaagguguug

SEQ ID NO: 567276 - RNA, 19 nt, Homo sapiens
agaacggucuagauaaugg

SEQ ID NO: 567277 - RNA, 19 nt, Homo sapiens
ucccaugccuggagugaug

SEQ ID NO: 567278 - RNA, 19 nt, Homo sapiens
ucgcacaacugcccacuac

SEQ ID NO: 567279 - RNA, 19 nt, Homo sapiens
gaaauugcagauugaucau

SEQ ID NO: 567280 - RNA, 19 nt, Homo sapiens
cauaggaagucugaaaucg

SEQ ID NO: 567281 - RNA, 19 nt, Homo sapiens
ugucauaggaagucugaaa

SEQ ID NO: 567282 - RNA, 19 nt, Homo sapiens
gaucccaacugcacauacg

SEQ ID NO: 567283 - RNA, 19 nt, Homo sapiens
aagcggaucuucgaguaug

SEQ ID NO: 567284 - RNA, 19 nt, Homo sapiens
gguuggguguccuuagaga

SEQ ID NO: 567285 - RNA, 19 nt, Homo sapiens
ccgguuggguguccuuaga

SEQ ID NO: 567286 - RNA, 19 nt, Homo sapiens
gcuuagaccauuucuccaa

SEQ ID NO: 567287 - RNA, 19 nt, Homo sapiens
gagcguccuucagcuggaa

SEQ ID NO: 567288 - RNA, 19 nt, Homo sapiens
gcaggcgggagaaguguug

SEQ ID NO: 567289 - RNA, 19 nt, Homo sapiens
ucgaagcaauguucaagag

SEQ ID NO: 567290 - RNA, 19 nt, Homo sapiens
cagucgcccuggcagcaua

SEQ ID NO: 567291 - RNA, 19 nt, Homo sapiens
agaaguaucgcgagcugaa

SEQ ID NO: 567292 - RNA, 19 nt, Homo sapiens
gcacauacgaaggugacaa

SEQ ID NO: 567293 - RNA, 19 nt, Homo sapiens
gagggcaauguccgcuuua

SEQ ID NO: 567294 - RNA, 19 nt, Homo sapiens
gaugcaagcggaucuucga

SEQ ID NO: 567295 - RNA, 19 nt, Homo sapiens
agacguggaccucaacuuc

SEQ ID NO: 567296 - RNA, 19 nt, Homo sapiens
gcagagcuuggacgugaga

SEQ ID NO: 567297 - RNA, 19 nt, Homo sapiens
uagugggacuggcacauuc

SEQ ID NO: 567298 - RNA, 19 nt, Homo sapiens
ucaggaagcagugacuuug

SEQ ID NO: 567299 - RNA, 19 nt, Homo sapiens
gcagcagacaagcaacuau

SEQ ID NO: 567300 - RNA, 19 nt, Homo sapiens
ggaggaaauaccagugcuu

SEQ ID NO: 567301 - RNA, 19 nt, Homo sapiens
gaugguuggcgacauagga

SEQ ID NO: 567302 - RNA, 19 nt, Homo sapiens
ggaccacccagcaaggaau

SEQ ID NO: 567303 - RNA, 19 nt, Homo sapiens
ggccauccuuaaccuaaag

SEQ ID NO: 567304 - RNA, 19 nt, Homo sapiens
ggacgucaggcagcgcuuu

SEQ ID NO: 567305 - RNA, 19 nt, Homo sapiens
caacacagcuugucucuug

SEQ ID NO: 567306 - RNA, 19 nt, Homo sapiens
gaugacacuuguacaauua

SEQ ID NO: 567307 - RNA, 19 nt, Homo sapiens
caaagguacuuggauaaua

SEQ ID NO: 567308 - RNA, 19 nt, Homo sapiens
ggaaagguguuggcauuaa

SEQ ID NO: 567309 - RNA, 19 nt, Homo sapiens
gaaagguguuggcauuaaa

SEQ ID NO: 567310 - RNA, 19 nt, Homo sapiens
gaaagugagcgacgaguuu

SEQ ID NO: 567311 - RNA, 19 nt, Homo sapiens
gaucgauccugccauguuu

SEQ ID NO: 567312 - RNA, 19 nt, Homo sapiens
auaaagggcugcaucauga

SEQ ID NO: 567313 - RNA, 19 nt, Homo sapiens
ucaaggagcugcugaccaa

SEQ ID NO: 567314 - RNA, 19 nt, Homo sapiens
uggagaagguggacugaua

SEQ ID NO: 567315 - RNA, 19 nt, Homo sapiens
ccaggcagaugaccucgua

SEQ ID NO: 567316 - RNA, 19 nt, Homo sapiens
ggacagauugauucacuuu

SEQ ID NO: 567317 - RNA, 19 nt, Homo sapiens
cgaugacacuuguacaauu

SEQ ID NO: 567318 - RNA, 19 nt, Homo sapiens
gcagagaguucagguaugg

SEQ ID NO: 567319 - RNA, 19 nt, Homo sapiens
ggacauggaugaggacgau

SEQ ID NO: 567320 - RNA, 19 nt, Homo sapiens
cgaaaguacauucuugaua

SEQ ID NO: 567321 - RNA, 19 nt, Homo sapiens
gagcaaguuucaccgaaga

SEQ ID NO: 567322 - RNA, 19 nt, Homo sapiens
uuucaaagguacuuggaua

SEQ ID NO: 567323 - RNA, 19 nt, Homo sapiens
cgagagccaucuaccgaaa

SEQ ID NO: 567324 - RNA, 19 nt, Homo sapiens
cgggaaagguguuggcauu

SEQ ID NO: 567325 - RNA, 19 nt, Homo sapiens
gagaacugguguccacaga

SEQ ID NO: 567326 - RNA, 19 nt, Homo sapiens
gaagaucaucggcaaagug

SEQ ID NO: 567327 - RNA, 19 nt, Homo sapiens
gaccuuaaaugaagaugag

SEQ ID NO: 567328 - RNA, 19 nt, Homo sapiens
caaaagaaaugccaagaag

SEQ ID NO: 567329 - RNA, 19 nt, Homo sapiens
ggaagcacguacccaaguc

SEQ ID NO: 567330 - RNA, 19 nt, Homo sapiens
uaaaugaagaugaggaaug

SEQ ID NO: 567331 - RNA, 19 nt, Homo sapiens
ccaccaagagcuucauaaa

SEQ ID NO: 567332 - RNA, 19 nt, Homo sapiens
gcguggagccucagaaguu

SEQ ID NO: 567333 - RNA, 19 nt, Homo sapiens
accaagagcuucauaaagg

SEQ ID NO: 567334 - RNA, 19 nt, Homo sapiens
gcagaugaccucguacuca

SEQ ID NO: 567335 - RNA, 19 nt, Homo sapiens
ggaccacuccucauagcaa

SEQ ID NO: 567336 - RNA, 19 nt, Homo sapiens
ccggaagacucccucagaa

SEQ ID NO: 567337 - RNA, 19 nt, Homo sapiens
cauaaagggcugcaucaug

SEQ ID NO: 567338 - RNA, 19 nt, Homo sapiens
gggaaagguguuggcauua

SEQ ID NO: 567339 - RNA, 19 nt, Homo sapiens
cagauacuacuucaagaaa

SEQ ID NO: 567340 - RNA, 19 nt, Homo sapiens
gcagggccucugucaauug

SEQ ID NO: 567341 - RNA, 19 nt, Homo sapiens
gagaagaaccagaaaauca

SEQ ID NO: 567342 - RNA, 19 nt, Homo sapiens
uaccgaaaguacauucuug

SEQ ID NO: 567343 - RNA, 19 nt, Homo sapiens
aaaugaagaugaggaaugg

SEQ ID NO: 567344 - RNA, 19 nt, Homo sapiens
cuacagauacuacuucaag

SEQ ID NO: 567345 - RNA, 19 nt, Homo sapiens
gggaagggcauaucuggau

SEQ ID NO: 567346 - RNA, 19 nt, Homo sapiens
gcauuaaaggugagacuuc

SEQ ID NO: 567347 - RNA, 19 nt, Homo sapiens
gaccacuccucauagcaau

SEQ ID NO: 567348 - RNA, 19 nt, Homo sapiens
ggagaagguggacugauag

SEQ ID NO: 567349 - RNA, 19 nt, Homo sapiens
gagaagaucaucggcaaag

SEQ ID NO: 567350 - RNA, 19 nt, Homo sapiens
gcaucguuguggcguacua

SEQ ID NO: 567351 - RNA, 19 nt, Homo sapiens
gagcgacgaguuugacugu

SEQ ID NO: 567352 - RNA, 19 nt, Homo sapiens
cagauugauucacuuugga

SEQ ID NO: 567353 - RNA, 19 nt, Homo sapiens
ugcauucccugcuggauga

SEQ ID NO: 567354 - RNA, 19 nt, Homo sapiens
gauaccugccgaccuuaaa

SEQ ID NO: 567355 - RNA, 19 nt, Homo sapiens
ggauaccugccgaccuuaa

SEQ ID NO: 567356 - RNA, 19 nt, Homo sapiens
gaaauccaggccacuaugg

SEQ ID NO: 567357 - RNA, 19 nt, Homo sapiens
acagauugauucacuuugg

SEQ ID NO: 567358 - RNA, 19 nt, Homo sapiens
ggaugaccaagaugggaua

SEQ ID NO: 567359 - RNA, 19 nt, Homo sapiens
gguacuuggauaauaauga

SEQ ID NO: 567360 - RNA, 19 nt, Homo sapiens
ccucauagcaauacuugga

SEQ ID NO: 567361 - RNA, 19 nt, Homo sapiens
gaagaugaggaauggaagu

SEQ ID NO: 567362 - RNA, 19 nt, Homo sapiens
cuggauaccugccgaccuu

SEQ ID NO: 567363 - RNA, 19 nt, Homo sapiens
ccuccuuccuuaagucuga

SEQ ID NO: 567364 - RNA, 19 nt, Homo sapiens
ggagaagaucaucggcaaa

SEQ ID NO: 567365 - RNA, 19 nt, Homo sapiens
gcaaaagaaaugccaagaa

SEQ ID NO: 567366 - RNA, 19 nt, Homo sapiens
accuaucccuccuuccuua

SEQ ID NO: 567367 - RNA, 19 nt, Homo sapiens
ggcagagaguucagguaug

SEQ ID NO: 567368 - RNA, 19 nt, Homo sapiens
gaccaggcccagaccgaaa

SEQ ID NO: 567369 - RNA, 19 nt, Homo sapiens
cagggccucugucaauugu

SEQ ID NO: 567370 - RNA, 19 nt, Homo sapiens
acagauacuacuucaagaa

SEQ ID NO: 567371 - RNA, 19 nt, Homo sapiens
ccagacccuugucccuuga

SEQ ID NO: 567372 - RNA, 19 nt, Homo sapiens
gaagugugaccaggacaug

SEQ ID NO: 567373 - RNA, 19 nt, Homo sapiens
ggacagggaagggcauauc

SEQ ID NO: 567374 - RNA, 19 nt, Homo sapiens
ccuggguccuccuuucuga

SEQ ID NO: 567375 - RNA, 19 nt, Homo sapiens
gauucacuuuggagcugua

SEQ ID NO: 567376 - RNA, 19 nt, Homo sapiens
gggaugcacacgaggagaa

SEQ ID NO: 567377 - RNA, 19 nt, Homo sapiens
caaaaugaauauccaagag

SEQ ID NO: 567378 - RNA, 19 nt, Homo sapiens
uugcuggacuucugguuug

SEQ ID NO: 567379 - RNA, 19 nt, Homo sapiens
gggccucugucaauuguac

SEQ ID NO: 567380 - RNA, 19 nt, Homo sapiens
cggaggaugcggagaagaa

SEQ ID NO: 567381 - RNA, 19 nt, Homo sapiens
cagcgaaggcagagaguuc

SEQ ID NO: 567382 - RNA, 19 nt, Homo sapiens
gggacagauugauucacuu

SEQ ID NO: 567383 - RNA, 19 nt, Homo sapiens
ggaccucggagcaaguuuc

SEQ ID NO: 567384 - RNA, 19 nt, Homo sapiens
gcgaugacacuuguacaau

SEQ ID NO: 567385 - RNA, 19 nt, Homo sapiens
gccuggaccacuccucaua

SEQ ID NO: 567386 - RNA, 19 nt, Homo sapiens
caagaucgcagaggaaggu

SEQ ID NO: 567387 - RNA, 19 nt, Homo sapiens
gguaugugcaggagguuau

SEQ ID NO: 567388 - RNA, 19 nt, Homo sapiens
gaagcacguacccaaguca

SEQ ID NO: 567389 - RNA, 19 nt, Homo sapiens
gggaagcacguacccaagu

SEQ ID NO: 567390 - RNA, 19 nt, Homo sapiens
ggaagcuggagcccuguga

SEQ ID NO: 567391 - RNA, 19 nt, Homo sapiens
cgggacagauugauucacu

SEQ ID NO: 567392 - RNA, 19 nt, Homo sapiens
ucaaagguacuuggauaau

SEQ ID NO: 567393 - RNA, 19 nt, Homo sapiens
gcaaguuucaccgaagaug

SEQ ID NO: 567394 - RNA, 19 nt, Homo sapiens
uacagauacuacuucaaga

SEQ ID NO: 567395 - RNA, 19 nt, Homo sapiens
gcagcuacagauacuacuu

SEQ ID NO: 567396 - RNA, 19 nt, Homo sapiens
cugccgaccuuaaaugaag

SEQ ID NO: 567397 - RNA, 19 nt, Homo sapiens
gggcugagucacugcauuc

SEQ ID NO: 567398 - RNA, 19 nt, Homo sapiens
gaagacucccucagaagcu

SEQ ID NO: 567399 - RNA, 19 nt, Homo sapiens
cgaaauccaggccacuaug

SEQ ID NO: 567400 - RNA, 19 nt, Homo sapiens
gaugggauaagccuguuca

SEQ ID NO: 567401 - RNA, 19 nt, Homo sapiens
ugaccaagaugggauaagc

SEQ ID NO: 567402 - RNA, 19 nt, Homo sapiens
cugcagggccucugucaau

SEQ ID NO: 567403 - RNA, 19 nt, Homo sapiens
ucccgaggcuacucagaga

SEQ ID NO: 567404 - RNA, 19 nt, Homo sapiens
ggagcuguaaguacugaug

SEQ ID NO: 567405 - RNA, 19 nt, Homo sapiens
gagaggaacuggaagaaga

SEQ ID NO: 567406 - RNA, 19 nt, Homo sapiens
aaacacagcuuacaugagu

SEQ ID NO: 567407 - RNA, 19 nt, Homo sapiens
gaaaugcguggauaccuua

SEQ ID NO: 567408 - RNA, 19 nt, Homo sapiens
agaaacagcuccagagaga

SEQ ID NO: 567409 - RNA, 19 nt, Homo sapiens
ggauacagguccuucaaga

SEQ ID NO: 567410 - RNA, 19 nt, Homo sapiens
ggacagcaguguagaugga

SEQ ID NO: 567411 - RNA, 19 nt, Homo sapiens
gaagaggaguggacuugug

SEQ ID NO: 567412 - RNA, 19 nt, Homo sapiens
gagaaacuguguauagcuu

SEQ ID NO: 567413 - RNA, 19 nt, Homo sapiens
gaucugaaauccauaaacu

SEQ ID NO: 567414 - RNA, 19 nt, Homo sapiens
gaagaugcugccuguauuu

SEQ ID NO: 567415 - RNA, 19 nt, Homo sapiens
gugaugcgcugacggauga

SEQ ID NO: 567416 - RNA, 19 nt, Homo sapiens
gcgauccuguuaauccuua

SEQ ID NO: 567417 - RNA, 19 nt, Homo sapiens
gagacugccauacauaaua

SEQ ID NO: 567418 - RNA, 19 nt, Homo sapiens
uagauggaauuccuccuua

SEQ ID NO: 567419 - RNA, 19 nt, Homo sapiens
ucacaaagagccaaagaaa

SEQ ID NO: 567420 - RNA, 19 nt, Homo sapiens
aaagguacauugagaacaa

SEQ ID NO: 567421 - RNA, 19 nt, Homo sapiens
cagaugaaccugaaggaua

SEQ ID NO: 567422 - RNA, 19 nt, Homo sapiens
uaagagaaacuguguauag

SEQ ID NO: 567423 - RNA, 19 nt, Homo sapiens
agaaaagccugaacuauuu

SEQ ID NO: 567424 - RNA, 19 nt, Homo sapiens
gagagacugccauacauaa

SEQ ID NO: 567425 - RNA, 19 nt, Homo sapiens
ugaagaugcugccuguauu

SEQ ID NO: 567426 - RNA, 19 nt, Homo sapiens
gacaaagucuaaggaagaa

SEQ ID NO: 567427 - RNA, 19 nt, Homo sapiens
gaaaugcaucgcaguguga

SEQ ID NO: 567428 - RNA, 19 nt, Homo sapiens
gaaaaugccuaccagaugu

SEQ ID NO: 567429 - RNA, 19 nt, Homo sapiens
uuauggauaugcugcuuua

SEQ ID NO: 567430 - RNA, 19 nt, Homo sapiens
agacggugcucccgaugua

SEQ ID NO: 567431 - RNA, 19 nt, Homo sapiens
acagugagauauccaguga

SEQ ID NO: 567432 - RNA, 19 nt, Homo sapiens
agacugccauacauaauau

SEQ ID NO: 567433 - RNA, 19 nt, Homo sapiens
aaacagcuccagagagaaa

SEQ ID NO: 567434 - RNA, 19 nt, Homo sapiens
gauaugcugcuuuaaacuu

SEQ ID NO: 567435 - RNA, 19 nt, Homo sapiens
gguacugacugagauaaga

SEQ ID NO: 567436 - RNA, 19 nt, Homo sapiens
gcccgaagcucuugugaac

SEQ ID NO: 567437 - RNA, 19 nt, Homo sapiens
ugaccacucuuggcuauug

SEQ ID NO: 567438 - RNA, 19 nt, Homo sapiens
guguauagcuuaccugaac

SEQ ID NO: 567439 - RNA, 19 nt, Homo sapiens
gaaacuguguauagcuuac

SEQ ID NO: 567440 - RNA, 19 nt, Homo sapiens
uaccaaaacuuuacgagua

SEQ ID NO: 567441 - RNA, 19 nt, Homo sapiens
agacggugcuuaccuguuc

SEQ ID NO: 567442 - RNA, 19 nt, Homo sapiens
ccgaagcucuugugaacug

SEQ ID NO: 567443 - RNA, 19 nt, Homo sapiens
agaaaugcguggauaccuu

SEQ ID NO: 567444 - RNA, 19 nt, Homo sapiens
ggaagacccgcagacgaua

SEQ ID NO: 567445 - RNA, 19 nt, Homo sapiens
caccaagaccuacauaaga

SEQ ID NO: 567446 - RNA, 19 nt, Homo sapiens
gaaccugaaggauaccaaa

SEQ ID NO: 567447 - RNA, 19 nt, Homo sapiens
gcgcuauguuggugacuug

SEQ ID NO: 567448 - RNA, 19 nt, Homo sapiens
acaaagagccaaagaaacu

SEQ ID NO: 567449 - RNA, 19 nt, Homo sapiens
ccgagaggaugaagagaga

SEQ ID NO: 567450 - RNA, 19 nt, Homo sapiens
caugaccacucuuggcuau

SEQ ID NO: 567451 - RNA, 19 nt, Homo sapiens
ugaacugucuuggcuguga

SEQ ID NO: 567452 - RNA, 19 nt, Homo sapiens
uaagaaacagcuccagaga

SEQ ID NO: 567453 - RNA, 19 nt, Homo sapiens
gaaaacacagcuuacauga

SEQ ID NO: 567454 - RNA, 19 nt, Homo sapiens
ugagagacugccauacaua

SEQ ID NO: 567455 - RNA, 19 nt, Homo sapiens
gaaaagccugaacuauuua

SEQ ID NO: 567456 - RNA, 19 nt, Homo sapiens
ccaagugucucuaccucau

SEQ ID NO: 567457 - RNA, 19 nt, Homo sapiens
gaucacaaagagccaaaga

SEQ ID NO: 567458 - RNA, 19 nt, Homo sapiens
ggacuugugccgacuucaa

SEQ ID NO: 567459 - RNA, 19 nt, Homo sapiens
ccaaagcgaucuacaaaag

SEQ ID NO: 567460 - RNA, 19 nt, Homo sapiens
uaccuuagacuucugguuu

SEQ ID NO: 567461 - RNA, 19 nt, Homo sapiens
agacgauacuggacgauca

SEQ ID NO: 567462 - RNA, 19 nt, Homo sapiens
aaacuaagagaaacugugu

SEQ ID NO: 567463 - RNA, 19 nt, Homo sapiens
gcaagggccaggucaccaa

SEQ ID NO: 567464 - RNA, 19 nt, Homo sapiens
ugaccaagcagacgacgaa

SEQ ID NO: 567465 - RNA, 19 nt, Homo sapiens
agaugaaccugaaggauac

SEQ ID NO: 567466 - RNA, 19 nt, Homo sapiens
guccuuacacuccuuauug

SEQ ID NO: 567467 - RNA, 19 nt, Homo sapiens
ggaauccuuacugauauuu

SEQ ID NO: 567468 - RNA, 19 nt, Homo sapiens
agugagauauccagugaug

SEQ ID NO: 567469 - RNA, 19 nt, Homo sapiens
ggaaaaugccuaccagaug

SEQ ID NO: 567470 - RNA, 19 nt, Homo sapiens
agaagcagcagauugauuc

SEQ ID NO: 567471 - RNA, 19 nt, Homo sapiens
gcaauggauucaggcagau

SEQ ID NO: 567472 - RNA, 19 nt, Homo sapiens
ucaccaaacccaugucugu

SEQ ID NO: 567473 - RNA, 19 nt, Homo sapiens
gaugcugccuguauuugag

SEQ ID NO: 567474 - RNA, 19 nt, Homo sapiens
guacugacugagauaagaa

SEQ ID NO: 567475 - RNA, 19 nt, Homo sapiens
guagauggaauuccuccuu

SEQ ID NO: 567476 - RNA, 19 nt, Homo sapiens
guuaauccuuaucacauag

SEQ ID NO: 567477 - RNA, 19 nt, Homo sapiens
agagagaccacgccgauug

SEQ ID NO: 567478 - RNA, 19 nt, Homo sapiens
gaaggauaccaaaacuuua

SEQ ID NO: 567479 - RNA, 19 nt, Homo sapiens
caaugaagaagacaaaguc

SEQ ID NO: 567480 - RNA, 19 nt, Homo sapiens
gagcgguguuugaggagau

SEQ ID NO: 567481 - RNA, 19 nt, Homo sapiens
gaccacucuuggcuauuga

SEQ ID NO: 567482 - RNA, 19 nt, Homo sapiens
ugagcuggguacugacuga

SEQ ID NO: 567483 - RNA, 19 nt, Homo sapiens
caaagucuaaggaagaauc

SEQ ID NO: 567484 - RNA, 19 nt, Homo sapiens
uggcuuuggugaacuguug

SEQ ID NO: 567485 - RNA, 19 nt, Homo sapiens
cagagggacaggaaucauu

SEQ ID NO: 567486 - RNA, 19 nt, Homo sapiens
aagugucucuaccucauuu

SEQ ID NO: 567487 - RNA, 19 nt, Homo sapiens
gaagaagaggaguggacuu

SEQ ID NO: 567488 - RNA, 19 nt, Homo sapiens
ccaccaagaccuacauaag

SEQ ID NO: 567489 - RNA, 19 nt, Homo sapiens
uggauaugcugcuuuaaac

SEQ ID NO: 567490 - RNA, 19 nt, Homo sapiens
uucaugagcuggguacuga

SEQ ID NO: 567491 - RNA, 19 nt, Homo sapiens
gacccugggccacuuuaaa

SEQ ID NO: 567492 - RNA, 19 nt, Homo sapiens
gagaggaugaagagagaga

SEQ ID NO: 567493 - RNA, 19 nt, Homo sapiens
agugugagguccacggaaa

SEQ ID NO: 567494 - RNA, 19 nt, Homo sapiens
caacugcgacaaaacauuu

SEQ ID NO: 567495 - RNA, 19 nt, Homo sapiens
uccagaagaucacaaagag

SEQ ID NO: 567496 - RNA, 19 nt, Homo sapiens
ggagcgauccuguuaaucc

SEQ ID NO: 567497 - RNA, 19 nt, Homo sapiens
guggauaccuuagacuucu

SEQ ID NO: 567498 - RNA, 19 nt, Homo sapiens
gcugagaggaacuggaaga

SEQ ID NO: 567499 - RNA, 19 nt, Homo sapiens
agggagaaaugcguggaua

SEQ ID NO: 567500 - RNA, 19 nt, Homo sapiens
gcuccaggccagugaguug

SEQ ID NO: 567501 - RNA, 19 nt, Homo sapiens
ccaagcagacgacgaagca

SEQ ID NO: 567502 - RNA, 19 nt, Homo sapiens
ccaugucugucucuuccaa

SEQ ID NO: 567503 - RNA, 19 nt, Homo sapiens
gagaaaugcaucgcagugu

SEQ ID NO: 567504 - RNA, 19 nt, Homo sapiens
ugaaggauaccaaaacuuu

SEQ ID NO: 567505 - RNA, 19 nt, Homo sapiens
gaauaaaacucuccuaaga

SEQ ID NO: 567506 - RNA, 19 nt, Homo sapiens
gaguucaucugcaccuuua

SEQ ID NO: 567507 - RNA, 19 nt, Homo sapiens
ccacaagucucaagaguca

SEQ ID NO: 567508 - RNA, 19 nt, Homo sapiens
ggauuuaucuuccuguuca

SEQ ID NO: 567509 - RNA, 19 nt, Homo sapiens
gcagagacaggguugcuua

SEQ ID NO: 567510 - RNA, 19 nt, Homo sapiens
guaaauacuggaucaauga

SEQ ID NO: 567511 - RNA, 19 nt, Homo sapiens
caagauugaugaccagaga

SEQ ID NO: 567512 - RNA, 19 nt, Homo sapiens
gaugauacguccgugauug

SEQ ID NO: 567513 - RNA, 19 nt, Homo sapiens
gagacaggguugcuuauag

SEQ ID NO: 567514 - RNA, 19 nt, Homo sapiens
gagcaaaggauaugcgauu

SEQ ID NO: 567515 - RNA, 19 nt, Homo sapiens
aggcugagauugcaaacua

SEQ ID NO: 567516 - RNA, 19 nt, Homo sapiens
ggaggaaccaggccacauu

SEQ ID NO: 567517 - RNA, 19 nt, Homo sapiens
aggaagaaguucaagauug

SEQ ID NO: 567518 - RNA, 19 nt, Homo sapiens
cuggaucaaugaaugaaua

SEQ ID NO: 567519 - RNA, 19 nt, Homo sapiens
cagaaggaccucucaauuc

SEQ ID NO: 567520 - RNA, 19 nt, Homo sapiens
ccagaaggaccucucaauu

SEQ ID NO: 567521 - RNA, 19 nt, Homo sapiens
gugaauaacauguucuuug

SEQ ID NO: 567522 - RNA, 19 nt, Homo sapiens
ugaauaacauguucuuugc

SEQ ID NO: 567523 - RNA, 19 nt, Homo sapiens
gaaccaggccacauuccuu

SEQ ID NO: 567524 - RNA, 19 nt, Homo sapiens
caacaaacccaagcuagug

SEQ ID NO: 567525 - RNA, 19 nt, Homo sapiens
gaagcagaauggccuuagu

SEQ ID NO: 567526 - RNA, 19 nt, Homo sapiens
ggaggcagcaucuggaguu

SEQ ID NO: 567527 - RNA, 19 nt, Homo sapiens
ucaaagagucccagaagga

SEQ ID NO: 567528 - RNA, 19 nt, Homo sapiens
cgugauugaugaugauauu

SEQ ID NO: 567529 - RNA, 19 nt, Homo sapiens
gagaaggacccacaacuac

SEQ ID NO: 567530 - RNA, 19 nt, Homo sapiens
ggagaaggaggucguggaa

SEQ ID NO: 567531 - RNA, 19 nt, Homo sapiens
uguaaauacuggaucaaug

SEQ ID NO: 567532 - RNA, 19 nt, Homo sapiens
ggugaaccgucagacagua

SEQ ID NO: 567533 - RNA, 19 nt, Homo sapiens
gaggaagaaguucaagauu

SEQ ID NO: 567534 - RNA, 19 nt, Homo sapiens
gaaggacccacaacuacga

SEQ ID NO: 567535 - RNA, 19 nt, Homo sapiens
gagaagaggaagaaguuca

SEQ ID NO: 567536 - RNA, 19 nt, Homo sapiens
acucugcccuuagguauaa

SEQ ID NO: 567537 - RNA, 19 nt, Homo sapiens
uggaugggcugaaggucua

SEQ ID NO: 567538 - RNA, 19 nt, Homo sapiens
gcucuucgccuucaguguu

SEQ ID NO: 567539 - RNA, 19 nt, Homo sapiens
guucaagacugcucuccau

SEQ ID NO: 567540 - RNA, 19 nt, Homo sapiens
ccugugaacugucuuccuu

SEQ ID NO: 567541 - RNA, 19 nt, Homo sapiens
agagaaggacccacaacua

SEQ ID NO: 567542 - RNA, 19 nt, Homo sapiens
uagagaagaggaagaaguu

SEQ ID NO: 567543 - RNA, 19 nt, Homo sapiens
caauuccucuguccaucaa

SEQ ID NO: 567544 - RNA, 19 nt, Homo sapiens
gcccugagagcaaaggaua

SEQ ID NO: 567545 - RNA, 19 nt, Homo sapiens
auacguccgugauugauga

SEQ ID NO: 567546 - RNA, 19 nt, Homo sapiens
gauugaugaugauauugug

SEQ ID NO: 567547 - RNA, 19 nt, Homo sapiens
aauacuggaucaaugaaug

SEQ ID NO: 567548 - RNA, 19 nt, Homo sapiens
ccaccagccugucccuguu

SEQ ID NO: 567549 - RNA, 19 nt, Homo sapiens
ucaaggaggagguagagaa

SEQ ID NO: 567550 - RNA, 19 nt, Homo sapiens
gaucggcagugcuuucaac

SEQ ID NO: 567551 - RNA, 19 nt, Homo sapiens
gaaggugaaccgucagaca

SEQ ID NO: 567552 - RNA, 19 nt, Homo sapiens
gcucaaagagucccagaag

SEQ ID NO: 567553 - RNA, 19 nt, Homo sapiens
caacucugcccuuagguau

SEQ ID NO: 567554 - RNA, 19 nt, Homo sapiens
gacuaugcuuucucuccua

SEQ ID NO: 567555 - RNA, 19 nt, Homo sapiens
caaccgugcuguccgugau

SEQ ID NO: 567556 - RNA, 19 nt, Homo sapiens
cagcaguacucagaugaug

SEQ ID NO: 567557 - RNA, 19 nt, Homo sapiens
ggucuucucucuucauucc

SEQ ID NO: 567558 - RNA, 19 nt, Homo sapiens
ggacccacaacuacgauga

SEQ ID NO: 567559 - RNA, 19 nt, Homo sapiens
agaaggaccucucaauucc

SEQ ID NO: 567560 - RNA, 19 nt, Homo sapiens
gacgaggaguggacagaca

SEQ ID NO: 567561 - RNA, 19 nt, Homo sapiens
caggucuucucucuucauu

SEQ ID NO: 567562 - RNA, 19 nt, Homo sapiens
ucuacgaccuucagagcaa

SEQ ID NO: 567563 - RNA, 19 nt, Homo sapiens
caagacugcucuccauagc

SEQ ID NO: 567564 - RNA, 19 nt, Homo sapiens
guagagaagaggaagaagu

SEQ ID NO: 567565 - RNA, 19 nt, Homo sapiens
gcagcccaguggagaagga

SEQ ID NO: 567566 - RNA, 19 nt, Homo sapiens
ccaacucugcccuuaggua

SEQ ID NO: 567567 - RNA, 19 nt, Homo sapiens
cagaugaugaggaugacua

SEQ ID NO: 567568 - RNA, 19 nt, Homo sapiens
ggcccuguauauggauuua

SEQ ID NO: 567569 - RNA, 19 nt, Homo sapiens
gagaagcagaauggccuua

SEQ ID NO: 567570 - RNA, 19 nt, Homo sapiens
gcugauacccaacucuugu

SEQ ID NO: 567571 - RNA, 19 nt, Homo sapiens
agacaggguugcuuauagg

SEQ ID NO: 567572 - RNA, 19 nt, Homo sapiens
gaggaugacgugcagaaca

SEQ ID NO: 567573 - RNA, 19 nt, Homo sapiens
caagucagccagcaacaag

SEQ ID NO: 567574 - RNA, 19 nt, Homo sapiens
gggccuaaauugggcucua

SEQ ID NO: 567575 - RNA, 19 nt, Homo sapiens
cguccgugauugaugauga

SEQ ID NO: 567576 - RNA, 19 nt, Homo sapiens
ucacccugcucguggaaga

SEQ ID NO: 567577 - RNA, 19 nt, Homo sapiens
ccaacaccaucaacgucuu

SEQ ID NO: 567578 - RNA, 19 nt, Homo sapiens
caccaacucugcccuuagg

SEQ ID NO: 567579 - RNA, 19 nt, Homo sapiens
gcaaaggauaugcgauugg

SEQ ID NO: 567580 - RNA, 19 nt, Homo sapiens
ggacagcaggaucaagaca

SEQ ID NO: 567581 - RNA, 19 nt, Homo sapiens
ggaugauacguccgugauu

SEQ ID NO: 567582 - RNA, 19 nt, Homo sapiens
agccaggucuucucucuuc

SEQ ID NO: 567583 - RNA, 19 nt, Homo sapiens
auaaguuccuaccugacua

SEQ ID NO: 567584 - RNA, 19 nt, Homo sapiens
gcugcguguugacugcaua

SEQ ID NO: 567585 - RNA, 19 nt, Homo sapiens
caacaccaucaacgucuug

SEQ ID NO: 567586 - RNA, 19 nt, Homo sapiens
ccaacaaacccaagcuagu

SEQ ID NO: 567587 - RNA, 19 nt, Homo sapiens
agagacaggguugcuuaua

SEQ ID NO: 567588 - RNA, 19 nt, Homo sapiens
ucucuaccuugguggauga

SEQ ID NO: 567589 - RNA, 19 nt, Homo sapiens
cugggcagcagaauauaua

SEQ ID NO: 567590 - RNA, 19 nt, Homo sapiens
auacccaacucuugugcaa

SEQ ID NO: 567591 - RNA, 19 nt, Homo sapiens
gaggcagcaucuggaguug

SEQ ID NO: 567592 - RNA, 19 nt, Homo sapiens
gaaccgucagacaguacua

SEQ ID NO: 567593 - RNA, 19 nt, Homo sapiens
guccagccccucaguauua

SEQ ID NO: 567594 - RNA, 19 nt, Homo sapiens
gcaagguucuagggcucuu

SEQ ID NO: 567595 - RNA, 19 nt, Homo sapiens
gggcccagguccuuguauc

SEQ ID NO: 567596 - RNA, 19 nt, Homo sapiens
agacacggccucugagauc

SEQ ID NO: 567597 - RNA, 19 nt, Homo sapiens
gagggcaaccacacagaug

SEQ ID NO: 567598 - RNA, 19 nt, Homo sapiens
ggacuucaccaaggguuuc

SEQ ID NO: 567599 - RNA, 19 nt, Homo sapiens
gaggaaccaggccacauuc

SEQ ID NO: 567600 - RNA, 19 nt, Homo sapiens
agaggaagaaguucaagau

SEQ ID NO: 567601 - RNA, 19 nt, Homo sapiens
aacaccaacucugcccuua

SEQ ID NO: 567602 - RNA, 19 nt, Homo sapiens
ucaagacugcucuccauag

SEQ ID NO: 567603 - RNA, 19 nt, Homo sapiens
guuccuaccugacuaugcu

SEQ ID NO: 567604 - RNA, 19 nt, Homo sapiens
agaaauacucacccaagga

SEQ ID NO: 567605 - RNA, 19 nt, Homo sapiens
gcacucagcuaaacacaaa

SEQ ID NO: 567606 - RNA, 19 nt, Homo sapiens
caaauaagaugaccuccuu

SEQ ID NO: 567607 - RNA, 19 nt, Homo sapiens
ugacagaugugaucauuga

SEQ ID NO: 567608 - RNA, 19 nt, Homo sapiens
ggaaauccaucaguugaaa

SEQ ID NO: 567609 - RNA, 19 nt, Homo sapiens
caaacuaaaugaucuccua

SEQ ID NO: 567610 - RNA, 19 nt, Homo sapiens
gaaguaaagaucacaguaa

SEQ ID NO: 567611 - RNA, 19 nt, Homo sapiens
caagugaccuucagagcaa

SEQ ID NO: 567612 - RNA, 19 nt, Homo sapiens
ggacacagcagaggaaauu

SEQ ID NO: 567613 - RNA, 19 nt, Homo sapiens
cgacguaauugaacaaaug

SEQ ID NO: 567614 - RNA, 19 nt, Homo sapiens
gagagaaaguagcgauuau

SEQ ID NO: 567615 - RNA, 19 nt, Homo sapiens
ggagauaacuauguucauc

SEQ ID NO: 567616 - RNA, 19 nt, Homo sapiens
ggagagaaaguagcgauua

SEQ ID NO: 567617 - RNA, 19 nt, Homo sapiens
gaaaauagaugccuuacag

SEQ ID NO: 567618 - RNA, 19 nt, Homo sapiens
gauaccacguguccuguuu

SEQ ID NO: 567619 - RNA, 19 nt, Homo sapiens
cuacagcgcugggacgaua

SEQ ID NO: 567620 - RNA, 19 nt, Homo sapiens
gaaagugcacucagcuaaa

SEQ ID NO: 567621 - RNA, 19 nt, Homo sapiens
gcagugccaugcuguguau

SEQ ID NO: 567622 - RNA, 19 nt, Homo sapiens
caagccagcuggaaucuca

SEQ ID NO: 567623 - RNA, 19 nt, Homo sapiens
ugagaagugugauaaucua

SEQ ID NO: 567624 - RNA, 19 nt, Homo sapiens
ggacuaugcuggagauaac

SEQ ID NO: 567625 - RNA, 19 nt, Homo sapiens
gaaaguagcgauuauccau

SEQ ID NO: 567626 - RNA, 19 nt, Homo sapiens
caauauauggugcugauaa

SEQ ID NO: 567627 - RNA, 19 nt, Homo sapiens
gguauuaugcaccuauaua

SEQ ID NO: 567628 - RNA, 19 nt, Homo sapiens
gauuggagcucgcggaaca

SEQ ID NO: 567629 - RNA, 19 nt, Homo sapiens
gaagaccaaguuuaaagaa

SEQ ID NO: 567630 - RNA, 19 nt, Homo sapiens
cagcgaaucuacugggaaa

SEQ ID NO: 567631 - RNA, 19 nt, Homo sapiens
gaccagauuucauucuuca

SEQ ID NO: 567632 - RNA, 19 nt, Homo sapiens
ggaaguugcccuccaggaa

SEQ ID NO: 567633 - RNA, 19 nt, Homo sapiens
aauagaugccuuacaguua

SEQ ID NO: 567634 - RNA, 19 nt, Homo sapiens
gaaggagaccugugaccaa

SEQ ID NO: 567635 - RNA, 19 nt, Homo sapiens
gaagugugauaaucuagag

SEQ ID NO: 567636 - RNA, 19 nt, Homo sapiens
caacaugaagaccaaguuu

SEQ ID NO: 567637 - RNA, 19 nt, Homo sapiens
cagaggaaauuaacaacau

SEQ ID NO: 567638 - RNA, 19 nt, Homo sapiens
uauaagcacuuugaggaaa

SEQ ID NO: 567639 - RNA, 19 nt, Homo sapiens
cugaagugcucaaaucuga

SEQ ID NO: 567640 - RNA, 19 nt, Homo sapiens
guaaagaucacaguaagga

SEQ ID NO: 567641 - RNA, 19 nt, Homo sapiens
gcaaagaaguaaagaucac

SEQ ID NO: 567642 - RNA, 19 nt, Homo sapiens
gugauaaucuagagcacaa

SEQ ID NO: 567643 - RNA, 19 nt, Homo sapiens
caagauaguucggauagag

SEQ ID NO: 567644 - RNA, 19 nt, Homo sapiens
cauaggauguggacgguau

SEQ ID NO: 567645 - RNA, 19 nt, Homo sapiens
gacacuagccucagcugua

SEQ ID NO: 567646 - RNA, 19 nt, Homo sapiens
gaaggacacagcagaggaa

SEQ ID NO: 567647 - RNA, 19 nt, Homo sapiens
gcaccuauauaagacaaau

SEQ ID NO: 567648 - RNA, 19 nt, Homo sapiens
caacccagaugaacuaaaa

SEQ ID NO: 567649 - RNA, 19 nt, Homo sapiens
aagaaacaauugagaagug

SEQ ID NO: 567650 - RNA, 19 nt, Homo sapiens
gagcacaaacuaaaugauc

SEQ ID NO: 567651 - RNA, 19 nt, Homo sapiens
gcuaguguauguggaaaga

SEQ ID NO: 567652 - RNA, 19 nt, Homo sapiens
gcgcaaagaaguaaagauc

SEQ ID NO: 567653 - RNA, 19 nt, Homo sapiens
ucaaagaggagcaggaaau

SEQ ID NO: 567654 - RNA, 19 nt, Homo sapiens
gaaaagcagucuguggaaa

SEQ ID NO: 567655 - RNA, 19 nt, Homo sapiens
acaugaagaccaaguuuaa

SEQ ID NO: 567656 - RNA, 19 nt, Homo sapiens
aaacuacaguggaagaaag

SEQ ID NO: 567657 - RNA, 19 nt, Homo sapiens
gcuguagccuguuuagaag

SEQ ID NO: 567658 - RNA, 19 nt, Homo sapiens
caauugagaagugugauaa

SEQ ID NO: 567659 - RNA, 19 nt, Homo sapiens
ccucagcuguagccuguuu

SEQ ID NO: 567660 - RNA, 19 nt, Homo sapiens
caagucaccaggagagaaa

SEQ ID NO: 567661 - RNA, 19 nt, Homo sapiens
ucaacucaauagaagauga

SEQ ID NO: 567662 - RNA, 19 nt, Homo sapiens
gaccagucaugaccuuaug

SEQ ID NO: 567663 - RNA, 19 nt, Homo sapiens
gaaguuuguugccccauuu

SEQ ID NO: 567664 - RNA, 19 nt, Homo sapiens
gcagcugcgugacgucaug

SEQ ID NO: 567665 - RNA, 19 nt, Homo sapiens
gaccuucagcuaaauguga

SEQ ID NO: 567666 - RNA, 19 nt, Homo sapiens
cagaccagauuucauucuu

SEQ ID NO: 567667 - RNA, 19 nt, Homo sapiens
gaaaugacagaugugauca

SEQ ID NO: 567668 - RNA, 19 nt, Homo sapiens
gcaacagacaucccugaga

SEQ ID NO: 567669 - RNA, 19 nt, Homo sapiens
agaaagugcacucagcuaa

SEQ ID NO: 567670 - RNA, 19 nt, Homo sapiens
acacagcagaggaaauuaa

SEQ ID NO: 567671 - RNA, 19 nt, Homo sapiens
aaacaagauaguucggaua

SEQ ID NO: 567672 - RNA, 19 nt, Homo sapiens
caauagaagaugacguuug

SEQ ID NO: 567673 - RNA, 19 nt, Homo sapiens
gucgagaaaugacagaugu

SEQ ID NO: 567674 - RNA, 19 nt, Homo sapiens
gccaugcuguguauucuca

SEQ ID NO: 567675 - RNA, 19 nt, Homo sapiens
gaaguccaacccagaugaa

SEQ ID NO: 567676 - RNA, 19 nt, Homo sapiens
gggugggcccuaauaagua

SEQ ID NO: 567677 - RNA, 19 nt, Homo sapiens
agacaucccugagacuguu

SEQ ID NO: 567678 - RNA, 19 nt, Homo sapiens
aaggagaccugugaccaaa

SEQ ID NO: 567679 - RNA, 19 nt, Homo sapiens
uuaacaacaugaagaccaa

SEQ ID NO: 567680 - RNA, 19 nt, Homo sapiens
gaggaaauuaacaacauga

SEQ ID NO: 567681 - RNA, 19 nt, Homo sapiens
gcagaggaaauuaacaaca

SEQ ID NO: 567682 - RNA, 19 nt, Homo sapiens
cagcagaggaaauuaacaa

SEQ ID NO: 567683 - RNA, 19 nt, Homo sapiens
uaacaagccagcuggaauc

SEQ ID NO: 567684 - RNA, 19 nt, Homo sapiens
aaauagaugccuuacaguu

SEQ ID NO: 567685 - RNA, 19 nt, Homo sapiens
aauagaagaugacguuugc

SEQ ID NO: 567686 - RNA, 19 nt, Homo sapiens
cacagucccugcugcaaug

SEQ ID NO: 567687 - RNA, 19 nt, Homo sapiens
aaagcagucuguggaaaga

SEQ ID NO: 567688 - RNA, 19 nt, Homo sapiens
uaaucuagagcacaaacua

SEQ ID NO: 567689 - RNA, 19 nt, Homo sapiens
ccaugcagcuuaccaacca

SEQ ID NO: 567690 - RNA, 19 nt, Homo sapiens
agacacagcagaagaucaa

SEQ ID NO: 567691 - RNA, 19 nt, Homo sapiens
auagaugccuuacaguuag

SEQ ID NO: 567692 - RNA, 19 nt, Homo sapiens
ugagugugguguucaggaa

SEQ ID NO: 567693 - RNA, 19 nt, Homo sapiens
aagaggagcaggaaaugaa

SEQ ID NO: 567694 - RNA, 19 nt, Homo sapiens
caaagaggagcaggaaaug

SEQ ID NO: 567695 - RNA, 19 nt, Homo sapiens
ccacugcgcaaagaaguaa

SEQ ID NO: 567696 - RNA, 19 nt, Homo sapiens
ugaagaccaaguuuaaaga

SEQ ID NO: 567697 - RNA, 19 nt, Homo sapiens
ggaaauuaacaacaugaag

SEQ ID NO: 567698 - RNA, 19 nt, Homo sapiens
gcaagucaccaggagagaa

SEQ ID NO: 567699 - RNA, 19 nt, Homo sapiens
ugacugaacuccccaagug

SEQ ID NO: 567700 - RNA, 19 nt, Homo sapiens
gaagugcucaaaucugaag

SEQ ID NO: 567701 - RNA, 19 nt, Homo sapiens
aaguagcgauuauccauca

SEQ ID NO: 567702 - RNA, 19 nt, Homo sapiens
auauggugcugauaaaguu

SEQ ID NO: 567703 - RNA, 19 nt, Homo sapiens
acucuacucccaaccaaua

SEQ ID NO: 567704 - RNA, 19 nt, Homo sapiens
aaacaauugagaaguguga

SEQ ID NO: 567705 - RNA, 19 nt, Homo sapiens
gaagacagauaaugaagua

SEQ ID NO: 567706 - RNA, 19 nt, Homo sapiens
gauaugagcuugugauaau

SEQ ID NO: 567707 - RNA, 19 nt, Homo sapiens
gaagaaugaucauguaguu

SEQ ID NO: 567708 - RNA, 19 nt, Homo sapiens
ggaaugagguaccugauga

SEQ ID NO: 567709 - RNA, 19 nt, Homo sapiens
ggaccaaggugaagauuga

SEQ ID NO: 567710 - RNA, 19 nt, Homo sapiens
gaccagagcaggauuaaua

SEQ ID NO: 567711 - RNA, 19 nt, Homo sapiens
gcugacagauuucccauuu

SEQ ID NO: 567712 - RNA, 19 nt, Homo sapiens
caggaaagguguucacaaa

SEQ ID NO: 567713 - RNA, 19 nt, Homo sapiens
ccacaaaguuucuggaugu

SEQ ID NO: 567714 - RNA, 19 nt, Homo sapiens
cuacacaaaugcacaaauu

SEQ ID NO: 567715 - RNA, 19 nt, Homo sapiens
gggaauauaugcuuaaucu

SEQ ID NO: 567716 - RNA, 19 nt, Homo sapiens
guacgggaauauaugcuua

SEQ ID NO: 567717 - RNA, 19 nt, Homo sapiens
ggacaauacucagggaauu

SEQ ID NO: 567718 - RNA, 19 nt, Homo sapiens
gaagauugauaguccaaau

SEQ ID NO: 567719 - RNA, 19 nt, Homo sapiens
uaacagaugugaugaggau

SEQ ID NO: 567720 - RNA, 19 nt, Homo sapiens
caaagaaguuccagcacaa

SEQ ID NO: 567721 - RNA, 19 nt, Homo sapiens
gacccaagauagagguuua

SEQ ID NO: 567722 - RNA, 19 nt, Homo sapiens
caccagaggucuugacaaa

SEQ ID NO: 567723 - RNA, 19 nt, Homo sapiens
aaauccagcuucaagaaua

SEQ ID NO: 567724 - RNA, 19 nt, Homo sapiens
aaacaaaucccacauaauc

SEQ ID NO: 567725 - RNA, 19 nt, Homo sapiens
gauaaugucaugggaguua

SEQ ID NO: 567726 - RNA, 19 nt, Homo sapiens
cuacgaaaguuaugaauag

SEQ ID NO: 567727 - RNA, 19 nt, Homo sapiens
agagaagacugaccauaaa

SEQ ID NO: 567728 - RNA, 19 nt, Homo sapiens
ucaauuggcuugugaugga

SEQ ID NO: 567729 - RNA, 19 nt, Homo sapiens
ugaaugcucuugaauuugu

SEQ ID NO: 567730 - RNA, 19 nt, Homo sapiens
gcaggugucauauuucuuu

SEQ ID NO: 567731 - RNA, 19 nt, Homo sapiens
caaaacaaaucccacauaa

SEQ ID NO: 567732 - RNA, 19 nt, Homo sapiens
ugagagcccugcagugaaa

SEQ ID NO: 567733 - RNA, 19 nt, Homo sapiens
uacauacacugguugauaa

SEQ ID NO: 567734 - RNA, 19 nt, Homo sapiens
cagagaagacugaccauaa

SEQ ID NO: 567735 - RNA, 19 nt, Homo sapiens
ccagaggucuugacaaagu

SEQ ID NO: 567736 - RNA, 19 nt, Homo sapiens
cuuacuggcuucucaauuu

SEQ ID NO: 567737 - RNA, 19 nt, Homo sapiens
ucaaacaccuccaggacaa

SEQ ID NO: 567738 - RNA, 19 nt, Homo sapiens
caaucaaacuacagcaauu

SEQ ID NO: 567739 - RNA, 19 nt, Homo sapiens
gaacuucagugccuaacag

SEQ ID NO: 567740 - RNA, 19 nt, Homo sapiens
cuagaaaguuagcaacaaa

SEQ ID NO: 567741 - RNA, 19 nt, Homo sapiens
ugacagauuucccauuuag

SEQ ID NO: 567742 - RNA, 19 nt, Homo sapiens
gaucagcaguccaccacaa

SEQ ID NO: 567743 - RNA, 19 nt, Homo sapiens
cagcuagccugaccuguga

SEQ ID NO: 567744 - RNA, 19 nt, Homo sapiens
cacaaaagcuucuguuaaa

SEQ ID NO: 567745 - RNA, 19 nt, Homo sapiens
ugccauaucuggagcauga

SEQ ID NO: 567746 - RNA, 19 nt, Homo sapiens
uaggaagaaugaucaugua

SEQ ID NO: 567747 - RNA, 19 nt, Homo sapiens
gagcauugauaggucagua

SEQ ID NO: 567748 - RNA, 19 nt, Homo sapiens
aguaggaccugaagagaaa

SEQ ID NO: 567749 - RNA, 19 nt, Homo sapiens
gagcagaauuuuaaacuug

SEQ ID NO: 567750 - RNA, 19 nt, Homo sapiens
uuagggacauguauucauu

SEQ ID NO: 567751 - RNA, 19 nt, Homo sapiens
cuggugcucuuaacaauuu

SEQ ID NO: 567752 - RNA, 19 nt, Homo sapiens
gcuuaugaccugcuugaua

SEQ ID NO: 567753 - RNA, 19 nt, Homo sapiens
aguaauagcugugagcauu

SEQ ID NO: 567754 - RNA, 19 nt, Homo sapiens
uguacugucuagaaaguua

SEQ ID NO: 567755 - RNA, 19 nt, Homo sapiens
gauguacugucuagaaagu

SEQ ID NO: 567756 - RNA, 19 nt, Homo sapiens
gaucauguaguuauugcua

SEQ ID NO: 567757 - RNA, 19 nt, Homo sapiens
ggacauguauucauuuugu

SEQ ID NO: 567758 - RNA, 19 nt, Homo sapiens
gaaacuauccaagcugcua

SEQ ID NO: 567759 - RNA, 19 nt, Homo sapiens
uuucagcucuguuuauuug

SEQ ID NO: 567760 - RNA, 19 nt, Homo sapiens
gauguuaagcccagcaauu

SEQ ID NO: 567761 - RNA, 19 nt, Homo sapiens
caagaaguacgggaauaua

SEQ ID NO: 567762 - RNA, 19 nt, Homo sapiens
caagucauccuauaagaau

SEQ ID NO: 567763 - RNA, 19 nt, Homo sapiens
ccaacaagucauccuauaa

SEQ ID NO: 567764 - RNA, 19 nt, Homo sapiens
ccauugaucugucuuaugc

SEQ ID NO: 567765 - RNA, 19 nt, Homo sapiens
gcauugauaggucaguaua

SEQ ID NO: 567766 - RNA, 19 nt, Homo sapiens
gaaauaguuuagggacaug

SEQ ID NO: 567767 - RNA, 19 nt, Homo sapiens
gaaaaggacccaagauaga

SEQ ID NO: 567768 - RNA, 19 nt, Homo sapiens
ugaaguaggcaaagagaaa

SEQ ID NO: 567769 - RNA, 19 nt, Homo sapiens
gguagcugcugaaaggaaa

SEQ ID NO: 567770 - RNA, 19 nt, Homo sapiens
aguuaaaccuaccuaagua

SEQ ID NO: 567771 - RNA, 19 nt, Homo sapiens
gcacuuucagcucuguuua

SEQ ID NO: 567772 - RNA, 19 nt, Homo sapiens
uaccacagcuuaguaaugu

SEQ ID NO: 567773 - RNA, 19 nt, Homo sapiens
gaagucguacucccuuaaa

SEQ ID NO: 567774 - RNA, 19 nt, Homo sapiens
caugaucuucuuugaguua

SEQ ID NO: 567775 - RNA, 19 nt, Homo sapiens
ggacuaacaacaugaucuu

SEQ ID NO: 567776 - RNA, 19 nt, Homo sapiens
uuaaauuuguccagucuga

SEQ ID NO: 567777 - RNA, 19 nt, Homo sapiens
uauaagaauugcagcugaa

SEQ ID NO: 567778 - RNA, 19 nt, Homo sapiens
caguauaucuaccuaaucu

SEQ ID NO: 567779 - RNA, 19 nt, Homo sapiens
gagaaaaggacccaagaua

SEQ ID NO: 567780 - RNA, 19 nt, Homo sapiens
uuagguagcugcugaaagg

SEQ ID NO: 567781 - RNA, 19 nt, Homo sapiens
cagaagucguacucccuua

SEQ ID NO: 567782 - RNA, 19 nt, Homo sapiens
guuuacaguugggaauuua

SEQ ID NO: 567783 - RNA, 19 nt, Homo sapiens
aagaauaacagcagaagaa

SEQ ID NO: 567784 - RNA, 19 nt, Homo sapiens
caacagauaaaguuuguag

SEQ ID NO: 567785 - RNA, 19 nt, Homo sapiens
gucaaagacuguggaugua

SEQ ID NO: 567786 - RNA, 19 nt, Homo sapiens
caacaagucauccuauaag

SEQ ID NO: 567787 - RNA, 19 nt, Homo sapiens
gaaaauugcucuaaaacac

SEQ ID NO: 567788 - RNA, 19 nt, Homo sapiens
gaaugcucuugaauuugua

SEQ ID NO: 567789 - RNA, 19 nt, Homo sapiens
acagauuucccauuuagua

SEQ ID NO: 567790 - RNA, 19 nt, Homo sapiens
agaauugacgguauuauug

SEQ ID NO: 567791 - RNA, 19 nt, Homo sapiens
uaaagcuucuugccucguu

SEQ ID NO: 567792 - RNA, 19 nt, Homo sapiens
gugaugauuuaacugcuuu

SEQ ID NO: 567793 - RNA, 19 nt, Homo sapiens
cuacagcaauugacaugug

SEQ ID NO: 567794 - RNA, 19 nt, Homo sapiens
gcacaaauucagauuaaac

SEQ ID NO: 567795 - RNA, 19 nt, Homo sapiens
aaauacugcuuuaggaaga

SEQ ID NO: 567796 - RNA, 19 nt, Homo sapiens
ucaaugacagcauaucaaa

SEQ ID NO: 567797 - RNA, 19 nt, Homo sapiens
caaaguuucuggauguuuu

SEQ ID NO: 567798 - RNA, 19 nt, Homo sapiens
cagaugugaugaggauuaa

SEQ ID NO: 567799 - RNA, 19 nt, Homo sapiens
agaagaagcuuuguugcau

SEQ ID NO: 567800 - RNA, 19 nt, Homo sapiens
caucucaauuggcuuguga

SEQ ID NO: 567801 - RNA, 19 nt, Homo sapiens
cagcauaucaaacuuccua

SEQ ID NO: 567802 - RNA, 19 nt, Homo sapiens
gaguuaaaccuaccuaagu

SEQ ID NO: 567803 - RNA, 19 nt, Homo sapiens
gauagagguuuauauucag

SEQ ID NO: 567804 - RNA, 19 nt, Homo sapiens
cagaauugacgguauuauu

SEQ ID NO: 567805 - RNA, 19 nt, Homo sapiens
caagaucacucaaaugaaa

SEQ ID NO: 567806 - RNA, 19 nt, Homo sapiens
gcacacggaucuccuuuga

SEQ ID NO: 567807 - RNA, 19 nt, Homo sapiens
gcaaacaccugcucaaguc

SEQ ID NO: 567808 - RNA, 19 nt, Homo sapiens
ugaagagucugcaaauaaa

SEQ ID NO: 567809 - RNA, 19 nt, Homo sapiens
guaacuggcuuucauuuag

SEQ ID NO: 567810 - RNA, 19 nt, Homo sapiens
gacaagaucacucaaauga

SEQ ID NO: 567811 - RNA, 19 nt, Homo sapiens
ggacguggaugcucugugu

SEQ ID NO: 567812 - RNA, 19 nt, Homo sapiens
ugaaauacgugacugaugu

SEQ ID NO: 567813 - RNA, 19 nt, Homo sapiens
uaaacaagaugaugaccuu

SEQ ID NO: 567814 - RNA, 19 nt, Homo sapiens
gagcuaauguagaccuauu

SEQ ID NO: 567815 - RNA, 19 nt, Homo sapiens
ggaaaugauugaagagucu

SEQ ID NO: 567816 - RNA, 19 nt, Homo sapiens
ggaguaaccuggacaagcu

SEQ ID NO: 567817 - RNA, 19 nt, Homo sapiens
ccaaggaccugaaugacau

SEQ ID NO: 567818 - RNA, 19 nt, Homo sapiens
ugaagcaggugaagcagaa

SEQ ID NO: 567819 - RNA, 19 nt, Homo sapiens
uaacuggcuuucauuuaga

SEQ ID NO: 567820 - RNA, 19 nt, Homo sapiens
gagacauccucuuugacua

SEQ ID NO: 567821 - RNA, 19 nt, Homo sapiens
ucaaugucgucaauguaua

SEQ ID NO: 567822 - RNA, 19 nt, Homo sapiens
gcaccaaccucgucaucuc

SEQ ID NO: 567823 - RNA, 19 nt, Homo sapiens
acacggaucuccuuugagu

SEQ ID NO: 567824 - RNA, 19 nt, Homo sapiens
gaacgaggaugaggagaac

SEQ ID NO: 567825 - RNA, 19 nt, Homo sapiens
cugcauuucuugagcauaa

SEQ ID NO: 567826 - RNA, 19 nt, Homo sapiens
gugcagacuuucagcauuc

SEQ ID NO: 567827 - RNA, 19 nt, Homo sapiens
ggaguuccuugcagacaug

SEQ ID NO: 567828 - RNA, 19 nt, Homo sapiens
ggaucuccuuugaguauga

SEQ ID NO: 567829 - RNA, 19 nt, Homo sapiens
gcucaaguccuuugugugu

SEQ ID NO: 567830 - RNA, 19 nt, Homo sapiens
ggacagaucacuucaucca

SEQ ID NO: 567831 - RNA, 19 nt, Homo sapiens
ggaacgaggaugaggagaa

SEQ ID NO: 567832 - RNA, 19 nt, Homo sapiens
gucaauguauacaacgaua

SEQ ID NO: 567833 - RNA, 19 nt, Homo sapiens
caagacaagaucacucaaa

SEQ ID NO: 567834 - RNA, 19 nt, Homo sapiens
cauaaacuguggagcuaau

SEQ ID NO: 567835 - RNA, 19 nt, Homo sapiens
uugaagagucugcaaauaa

SEQ ID NO: 567836 - RNA, 19 nt, Homo sapiens
ccauggacaucuccuugaa

SEQ ID NO: 567837 - RNA, 19 nt, Homo sapiens
guagaccuauuggauauuc

SEQ ID NO: 567838 - RNA, 19 nt, Homo sapiens
gccuggaacucgccaagaa

SEQ ID NO: 567839 - RNA, 19 nt, Homo sapiens
gaaauacgugacugauguu

SEQ ID NO: 567840 - RNA, 19 nt, Homo sapiens
aagacaagaucacucaaau

SEQ ID NO: 567841 - RNA, 19 nt, Homo sapiens
ggccaucguuggacuaaca

SEQ ID NO: 567842 - RNA, 19 nt, Homo sapiens
gauuguaaguuauggacau

SEQ ID NO: 567843 - RNA, 19 nt, Homo sapiens
gagaagcgcacacgguuag

SEQ ID NO: 567844 - RNA, 19 nt, Homo sapiens
ucaaguccuuuguguguuc

SEQ ID NO: 567845 - RNA, 19 nt, Homo sapiens
ccagaucaaauuacucauu

SEQ ID NO: 567846 - RNA, 19 nt, Homo sapiens
gaagagucugcaaauaaau

SEQ ID NO: 567847 - RNA, 19 nt, Homo sapiens
cgucagccauggugauguu

SEQ ID NO: 567848 - RNA, 19 nt, Homo sapiens
gaaguucccgccuaugaag

SEQ ID NO: 567849 - RNA, 19 nt, Homo sapiens
gaugaugaccuugaaguuc

SEQ ID NO: 567850 - RNA, 19 nt, Homo sapiens
ucacucaaaugaaauacgu

SEQ ID NO: 567851 - RNA, 19 nt, Homo sapiens
gagcauaaagaacaguuuc

SEQ ID NO: 567852 - RNA, 19 nt, Homo sapiens
uuauggacaugauuugaga

SEQ ID NO: 567853 - RNA, 19 nt, Homo sapiens
gcuguaccauggccuggaa

SEQ ID NO: 567854 - RNA, 19 nt, Homo sapiens
cagccauggugauguuuga

SEQ ID NO: 567855 - RNA, 19 nt, Homo sapiens
acuacgagcaguaugaaua

SEQ ID NO: 567856 - RNA, 19 nt, Homo sapiens
gggaugaagaggaggauga

SEQ ID NO: 567857 - RNA, 19 nt, Homo sapiens
caacgauacccagaucaaa

SEQ ID NO: 567858 - RNA, 19 nt, Homo sapiens
gaugaagacacuauauucu

SEQ ID NO: 567859 - RNA, 19 nt, Homo sapiens
uguaacuggcuuucauuua

SEQ ID NO: 567860 - RNA, 19 nt, Homo sapiens
gccagucaaugucgucaau

SEQ ID NO: 567861 - RNA, 19 nt, Homo sapiens
ccuauuggauauucuucaa

SEQ ID NO: 567862 - RNA, 19 nt, Homo sapiens
uuauuucccuccuguccua

SEQ ID NO: 567863 - RNA, 19 nt, Homo sapiens
aaggagaauuugcgggaaa

SEQ ID NO: 567864 - RNA, 19 nt, Homo sapiens
uaauguagaccuauuggau

SEQ ID NO: 567865 - RNA, 19 nt, Homo sapiens
gauugaagagucugcaaau

SEQ ID NO: 567866 - RNA, 19 nt, Homo sapiens
aauguagaccuauuggaua

SEQ ID NO: 567867 - RNA, 19 nt, Homo sapiens
ggaugcugcacaaccauuu

SEQ ID NO: 567868 - RNA, 19 nt, Homo sapiens
ugaugaagacacuauauuc

SEQ ID NO: 567869 - RNA, 19 nt, Homo sapiens
aaacuguggagcuaaugua

SEQ ID NO: 567870 - RNA, 19 nt, Homo sapiens
gguucaagcuguggucugu

SEQ ID NO: 567871 - RNA, 19 nt, Homo sapiens
ugagaagcgcacacgguua

SEQ ID NO: 567872 - RNA, 19 nt, Homo sapiens
cgauacccagaucaaauua

SEQ ID NO: 567873 - RNA, 19 nt, Homo sapiens
auacaacgauacccagauc

SEQ ID NO: 567874 - RNA, 19 nt, Homo sapiens
gaugucaugcuguucucua

SEQ ID NO: 567875 - RNA, 19 nt, Homo sapiens
gaagcgcacacgguuagaa

SEQ ID NO: 567876 - RNA, 19 nt, Homo sapiens
cagucaaugucgucaaugu

SEQ ID NO: 567877 - RNA, 19 nt, Homo sapiens
uguuugagcuggcuuggau

SEQ ID NO: 567878 - RNA, 19 nt, Homo sapiens
cuacgagcaguaugaauau

SEQ ID NO: 567879 - RNA, 19 nt, Homo sapiens
gucaaugucgucaauguau

SEQ ID NO: 567880 - RNA, 19 nt, Homo sapiens
uuauguaacuggcuuucau

SEQ ID NO: 567881 - RNA, 19 nt, Homo sapiens
gaggaucggagcaaguuuc

SEQ ID NO: 567882 - RNA, 19 nt, Homo sapiens
gcucggacaggaagaacuu

SEQ ID NO: 567883 - RNA, 19 nt, Homo sapiens
auugaagagucugcaaaua

SEQ ID NO: 567884 - RNA, 19 nt, Homo sapiens
cuauguucguguccgauuu

SEQ ID NO: 567885 - RNA, 19 nt, Homo sapiens
gcucagggacagaucacuu

SEQ ID NO: 567886 - RNA, 19 nt, Homo sapiens
ggccagcgacguggucuuu

SEQ ID NO: 567887 - RNA, 19 nt, Homo sapiens
cgugcagacuuucagcauu

SEQ ID NO: 567888 - RNA, 19 nt, Homo sapiens
gacaugcgcgugcagacuu

SEQ ID NO: 567889 - RNA, 19 nt, Homo sapiens
cucauaaacuguggagcua

SEQ ID NO: 567890 - RNA, 19 nt, Homo sapiens
gaggagauaguggagcaaa

SEQ ID NO: 567891 - RNA, 19 nt, Homo sapiens
ggaugaagaggaggaugaa

SEQ ID NO: 567892 - RNA, 19 nt, Homo sapiens
cuauauucuuuguguguga

SEQ ID NO: 567893 - RNA, 19 nt, Homo sapiens
gcuguggucugugcaugga

SEQ ID NO: 567894 - RNA, 19 nt, Homo sapiens
gcacuggucccuccaugac

SEQ ID NO: 567895 - RNA, 19 nt, Homo sapiens
gcauaaagaacaguuucau

SEQ ID NO: 567896 - RNA, 19 nt, Homo sapiens
uuucuggacgcacuuauuu

SEQ ID NO: 567897 - RNA, 19 nt, Homo sapiens
auacgugacugauguuggu

SEQ ID NO: 567898 - RNA, 19 nt, Homo sapiens
ggauauucuucaaccugau

SEQ ID NO: 567899 - RNA, 19 nt, Homo sapiens
gauauucuucaaccugaug

SEQ ID NO: 567900 - RNA, 19 nt, Homo sapiens
ugaaguucccgccuaugaa

SEQ ID NO: 567901 - RNA, 19 nt, Homo sapiens
cuccagaugucaugcuguu

SEQ ID NO: 567902 - RNA, 19 nt, Homo sapiens
gugaccacgugcaauauac

SEQ ID NO: 567903 - RNA, 19 nt, Homo sapiens
guaaguuauggacaugauu

SEQ ID NO: 567904 - RNA, 19 nt, Homo sapiens
agugugaccacgugcaaua

SEQ ID NO: 567905 - RNA, 19 nt, Homo sapiens
gaaauuggcucuucuugga

SEQ ID NO: 567906 - RNA, 19 nt, Homo sapiens
gcacauugcucccauaugg

SEQ ID NO: 567907 - RNA, 19 nt, Homo sapiens
uauccaagguucuguauuu

SEQ ID NO: 567908 - RNA, 19 nt, Homo sapiens
gaagcaggcugugaacauu

SEQ ID NO: 567909 - RNA, 19 nt, Homo sapiens
gaagauggcagcuggacua

SEQ ID NO: 567910 - RNA, 19 nt, Homo sapiens
gcagguaacugaaacaaac

SEQ ID NO: 567911 - RNA, 19 nt, Homo sapiens
uuacacaacucccuaaaga

SEQ ID NO: 567912 - RNA, 19 nt, Homo sapiens
caacaacacccagaugaua

SEQ ID NO: 567913 - RNA, 19 nt, Homo sapiens
ccaagguucuguauuuauu

SEQ ID NO: 567914 - RNA, 19 nt, Homo sapiens
aaacugagaugaucauuac

SEQ ID NO: 567915 - RNA, 19 nt, Homo sapiens
gcaaauagaagccgagugu

SEQ ID NO: 567916 - RNA, 19 nt, Homo sapiens
ggaagacuuuaagguauuu

SEQ ID NO: 567917 - RNA, 19 nt, Homo sapiens
caacauaaacggacucaau

SEQ ID NO: 567918 - RNA, 19 nt, Homo sapiens
aaauagaagccgaguguua

SEQ ID NO: 567919 - RNA, 19 nt, Homo sapiens
gaauauacuucuagcacau

SEQ ID NO: 567920 - RNA, 19 nt, Homo sapiens
ggagagagcaagcuaagga

SEQ ID NO: 567921 - RNA, 19 nt, Homo sapiens
gcaaaaggcuucagagaca

SEQ ID NO: 567922 - RNA, 19 nt, Homo sapiens
caaagaagcaggcugugaa

SEQ ID NO: 567923 - RNA, 19 nt, Homo sapiens
ugaaacaaaccuagcauuu

SEQ ID NO: 567924 - RNA, 19 nt, Homo sapiens
ggacauuaaugcugaagag

SEQ ID NO: 567925 - RNA, 19 nt, Homo sapiens
gcgcauguuuccuuucuug

SEQ ID NO: 567926 - RNA, 19 nt, Homo sapiens
caaacugagaugaucauua

SEQ ID NO: 567927 - RNA, 19 nt, Homo sapiens
acacuaacccuucaaagaa

SEQ ID NO: 567928 - RNA, 19 nt, Homo sapiens
gaaagugaaagaggaaauu

SEQ ID NO: 567929 - RNA, 19 nt, Homo sapiens
agacaucaguuccuaugaa

SEQ ID NO: 567930 - RNA, 19 nt, Homo sapiens
gcaggcgcauguuuccuuu

SEQ ID NO: 567931 - RNA, 19 nt, Homo sapiens
cauuaaugcugaagaguau

SEQ ID NO: 567932 - RNA, 19 nt, Homo sapiens
ccacuacaauguguucgua

SEQ ID NO: 567933 - RNA, 19 nt, Homo sapiens
ccuagcaacuccaguaaug

SEQ ID NO: 567934 - RNA, 19 nt, Homo sapiens
caagcccgcuauuauaaug

SEQ ID NO: 567935 - RNA, 19 nt, Homo sapiens
gcccagugcuaucagauga

SEQ ID NO: 567936 - RNA, 19 nt, Homo sapiens
aagaucagcucuccaagga

SEQ ID NO: 567937 - RNA, 19 nt, Homo sapiens
ccucaagcccgcuauuaua

SEQ ID NO: 567938 - RNA, 19 nt, Homo sapiens
gacacuaacccuucaaaga

SEQ ID NO: 567939 - RNA, 19 nt, Homo sapiens
gacccaaccuuuccugcaa

SEQ ID NO: 567940 - RNA, 19 nt, Homo sapiens
gacaucaguuccuaugaau

SEQ ID NO: 567941 - RNA, 19 nt, Homo sapiens
uaacaaaggcgcaaauaac

SEQ ID NO: 567942 - RNA, 19 nt, Homo sapiens
cauaaagugugaggacauu

SEQ ID NO: 567943 - RNA, 19 nt, Homo sapiens
gauggcagcuggacuacca

SEQ ID NO: 567944 - RNA, 19 nt, Homo sapiens
gcucccauauggcauuaaa

SEQ ID NO: 567945 - RNA, 19 nt, Homo sapiens
gauaguuucaccugacuuu

SEQ ID NO: 567946 - RNA, 19 nt, Homo sapiens
uaaagugugaggacauuaa

SEQ ID NO: 567947 - RNA, 19 nt, Homo sapiens
gauagucuuacaauccuua

SEQ ID NO: 567948 - RNA, 19 nt, Homo sapiens
gagagaaccgugccacaga

SEQ ID NO: 567949 - RNA, 19 nt, Homo sapiens
cgauauuacucaacuaaag

SEQ ID NO: 567950 - RNA, 19 nt, Homo sapiens
gcauauuguugaaguuaca

SEQ ID NO: 567951 - RNA, 19 nt, Homo sapiens
cacccagagucuccuaaua

SEQ ID NO: 567952 - RNA, 19 nt, Homo sapiens
gacaaagcguccaagaagu

SEQ ID NO: 567953 - RNA, 19 nt, Homo sapiens
uggaagacuuuaagguauu

SEQ ID NO: 567954 - RNA, 19 nt, Homo sapiens
gaaacaaaccuagcauuuu

SEQ ID NO: 567955 - RNA, 19 nt, Homo sapiens
ggagaaagugaaagaggaa

SEQ ID NO: 567956 - RNA, 19 nt, Homo sapiens
cauauggcauuaaauccuu

SEQ ID NO: 567957 - RNA, 19 nt, Homo sapiens
uaacaugcagggcaacaaa

SEQ ID NO: 567958 - RNA, 19 nt, Homo sapiens
ccaaggagaaagugaaaga

SEQ ID NO: 567959 - RNA, 19 nt, Homo sapiens
gaaaauucacccuccauaa

SEQ ID NO: 567960 - RNA, 19 nt, Homo sapiens
ccaccaaacugagaugauc

SEQ ID NO: 567961 - RNA, 19 nt, Homo sapiens
aauggaagacuuuaaggua

SEQ ID NO: 567962 - RNA, 19 nt, Homo sapiens
gcugaagaguauaguaaag

SEQ ID NO: 567963 - RNA, 19 nt, Homo sapiens
ccacuguguucucugaaga

SEQ ID NO: 567964 - RNA, 19 nt, Homo sapiens
agacaaagcguccaagaag

SEQ ID NO: 567965 - RNA, 19 nt, Homo sapiens
aaacaccgauauuacucaa

SEQ ID NO: 567966 - RNA, 19 nt, Homo sapiens
aauagaagccgaguguuaa

SEQ ID NO: 567967 - RNA, 19 nt, Homo sapiens
gggagacacuaacccuuca

SEQ ID NO: 567968 - RNA, 19 nt, Homo sapiens
aauuggcucuucuuggaua

SEQ ID NO: 567969 - RNA, 19 nt, Homo sapiens
ugucaacacuuuaccucaa

SEQ ID NO: 567970 - RNA, 19 nt, Homo sapiens
gagaugaucauuacgaaac

SEQ ID NO: 567971 - RNA, 19 nt, Homo sapiens
gcaaagccgacaauaacau

SEQ ID NO: 567972 - RNA, 19 nt, Homo sapiens
ugagacaggagauuucauu

SEQ ID NO: 567973 - RNA, 19 nt, Homo sapiens
aaacagggcaggcgcaugu

SEQ ID NO: 567974 - RNA, 19 nt, Homo sapiens
acaaagcguccaagaaguu

SEQ ID NO: 567975 - RNA, 19 nt, Homo sapiens
cgaaggcggcugucuccua

SEQ ID NO: 567976 - RNA, 19 nt, Homo sapiens
caacaaacuagacaucagu

SEQ ID NO: 567977 - RNA, 19 nt, Homo sapiens
gaccaacggccuccuuuca

SEQ ID NO: 567978 - RNA, 19 nt, Homo sapiens
gcuaucagaugaguuaaaa

SEQ ID NO: 567979 - RNA, 19 nt, Homo sapiens
gaugauagucuuacaaucc

SEQ ID NO: 567980 - RNA, 19 nt, Homo sapiens
uaacaacaacacccagaug

SEQ ID NO: 567981 - RNA, 19 nt, Homo sapiens
ccacugcccacuacaaugu

SEQ ID NO: 567982 - RNA, 19 nt, Homo sapiens
caaagcguccaagaaguuu

SEQ ID NO: 567983 - RNA, 19 nt, Homo sapiens
gaucauaaccccuuugcaa

SEQ ID NO: 567984 - RNA, 19 nt, Homo sapiens
ucucuagauuccaaugauu

SEQ ID NO: 567985 - RNA, 19 nt, Homo sapiens
ucagagacaacuaugauuc

SEQ ID NO: 567986 - RNA, 19 nt, Homo sapiens
gcguggaggacuugaauga

SEQ ID NO: 567987 - RNA, 19 nt, Homo sapiens
caaagccgacaauaacaug

SEQ ID NO: 567988 - RNA, 19 nt, Homo sapiens
acauuaaugcugaagagua

SEQ ID NO: 567989 - RNA, 19 nt, Homo sapiens
ccaacaaacuagacaucag

SEQ ID NO: 567990 - RNA, 19 nt, Homo sapiens
gaaccgugccacagaccaa

SEQ ID NO: 567991 - RNA, 19 nt, Homo sapiens
caaauuccaccgccaccaa

SEQ ID NO: 567992 - RNA, 19 nt, Homo sapiens
gauguuugccuuccaccuu

SEQ ID NO: 567993 - RNA, 19 nt, Homo sapiens
uagcaacuccaguaaugaa

SEQ ID NO: 567994 - RNA, 19 nt, Homo sapiens
cuuacaauccuuacacaaa

SEQ ID NO: 567995 - RNA, 19 nt, Homo sapiens
ggaugagacaggagauuuc

SEQ ID NO: 567996 - RNA, 19 nt, Homo sapiens
guggcaaagccgacaauaa

SEQ ID NO: 567997 - RNA, 19 nt, Homo sapiens
caucaguuccuaugaaucu

SEQ ID NO: 567998 - RNA, 19 nt, Homo sapiens
cagaugauagucuuacaau

SEQ ID NO: 567999 - RNA, 19 nt, Homo sapiens
auaacaaaggcgcaaauaa

SEQ ID NO: 568000 - RNA, 19 nt, Homo sapiens
caccugacuuugauuccuu

SEQ ID NO: 568001 - RNA, 19 nt, Homo sapiens
gagacacuaacccuucaaa

SEQ ID NO: 568002 - RNA, 19 nt, Homo sapiens
gguacggcguucaauccuu

SEQ ID NO: 568003 - RNA, 19 nt, Homo sapiens
cagaugaguuaaaaccuuu

SEQ ID NO: 568004 - RNA, 19 nt, Homo sapiens
ucaaagaagcaggcuguga

SEQ ID NO: 568005 - RNA, 19 nt, Homo sapiens
ggaaagaugugguuacuga

SEQ ID NO: 568006 - RNA, 19 nt, Homo sapiens
ggagauagcgccugaaaua

SEQ ID NO: 568007 - RNA, 19 nt, Homo sapiens
guaaauagccuguguaaga

SEQ ID NO: 568008 - RNA, 19 nt, Homo sapiens
ggaagagacugaagauaug

SEQ ID NO: 568009 - RNA, 19 nt, Homo sapiens
ccacaaaccuuccaaaucu

SEQ ID NO: 568010 - RNA, 19 nt, Homo sapiens
gcacggacaucgcguacaa

SEQ ID NO: 568011 - RNA, 19 nt, Homo sapiens
gaagccaacucacaguauu

SEQ ID NO: 568012 - RNA, 19 nt, Homo sapiens
ggaccuaaauuuaucuaug

SEQ ID NO: 568013 - RNA, 19 nt, Homo sapiens
gaacuuuccuccaacuuca

SEQ ID NO: 568014 - RNA, 19 nt, Homo sapiens
gagaggagccgagaaagua

SEQ ID NO: 568015 - RNA, 19 nt, Homo sapiens
ugagcugucugaacuauuu

SEQ ID NO: 568016 - RNA, 19 nt, Homo sapiens
gcgaggcgcucaugaacaa

SEQ ID NO: 568017 - RNA, 19 nt, Homo sapiens
gauaaccaaugccaaacuu

SEQ ID NO: 568018 - RNA, 19 nt, Homo sapiens
guacagaacuccacaaacc

SEQ ID NO: 568019 - RNA, 19 nt, Homo sapiens
guucuacccucuagugaaa

SEQ ID NO: 568020 - RNA, 19 nt, Homo sapiens
gguaagauuucaggaggua

SEQ ID NO: 568021 - RNA, 19 nt, Homo sapiens
caacucagcuccugcaaaa

SEQ ID NO: 568022 - RNA, 19 nt, Homo sapiens
cugaagauauggguuauaa

SEQ ID NO: 568023 - RNA, 19 nt, Homo sapiens
caagagaggagccgagaaa

SEQ ID NO: 568024 - RNA, 19 nt, Homo sapiens
uaaauagccuguguaagau

SEQ ID NO: 568025 - RNA, 19 nt, Homo sapiens
gcaccuggauuggcauuug

SEQ ID NO: 568026 - RNA, 19 nt, Homo sapiens
gaaaaugugugcaggucua

SEQ ID NO: 568027 - RNA, 19 nt, Homo sapiens
ccgcugagcucaaguucuu

SEQ ID NO: 568028 - RNA, 19 nt, Homo sapiens
guuaaggaguugauguuug

SEQ ID NO: 568029 - RNA, 19 nt, Homo sapiens
gaacaauucacaccaccaa

SEQ ID NO: 568030 - RNA, 19 nt, Homo sapiens
gaaggauauuucaguguca

SEQ ID NO: 568031 - RNA, 19 nt, Homo sapiens
gagcucauuucauucucua

SEQ ID NO: 568032 - RNA, 19 nt, Homo sapiens
guccagaacuuuccuccaa

SEQ ID NO: 568033 - RNA, 19 nt, Homo sapiens
uaccaggacuguucgcuuu

SEQ ID NO: 568034 - RNA, 19 nt, Homo sapiens
gauagcgccugaaauaaac

SEQ ID NO: 568035 - RNA, 19 nt, Homo sapiens
cuucaugaaucgcaaguuu

SEQ ID NO: 568036 - RNA, 19 nt, Homo sapiens
caauucacaccaccaauaa

SEQ ID NO: 568037 - RNA, 19 nt, Homo sapiens
uguaugggcucauguacuu

SEQ ID NO: 568038 - RNA, 19 nt, Homo sapiens
ggacuucacggucuucaug

SEQ ID NO: 568039 - RNA, 19 nt, Homo sapiens
gagauagcgccugaaauaa

SEQ ID NO: 568040 - RNA, 19 nt, Homo sapiens
ggggugagcucauuucauu

SEQ ID NO: 568041 - RNA, 19 nt, Homo sapiens
gguaggggcucuuaaggua

SEQ ID NO: 568042 - RNA, 19 nt, Homo sapiens
gacgaccgaucacgcguuu

SEQ ID NO: 568043 - RNA, 19 nt, Homo sapiens
uuacugagauuugggaaga

SEQ ID NO: 568044 - RNA, 19 nt, Homo sapiens
acaauucacaccaccaaua

SEQ ID NO: 568045 - RNA, 19 nt, Homo sapiens
gauguuugcuuuccuuaac

SEQ ID NO: 568046 - RNA, 19 nt, Homo sapiens
agacugaagauauggguua

SEQ ID NO: 568047 - RNA, 19 nt, Homo sapiens
gcaccauccucuucaugau

SEQ ID NO: 568048 - RNA, 19 nt, Homo sapiens
uggaagagacugaagauau

SEQ ID NO: 568049 - RNA, 19 nt, Homo sapiens
ugagauaaccaaugccaaa

SEQ ID NO: 568050 - RNA, 19 nt, Homo sapiens
ucacggucuucaugauuaa

SEQ ID NO: 568051 - RNA, 19 nt, Homo sapiens
agauagcgccugaaauaaa

SEQ ID NO: 568052 - RNA, 19 nt, Homo sapiens
aaagaagguggaauaauug

SEQ ID NO: 568053 - RNA, 19 nt, Homo sapiens
gguaaagaagguggaauaa

SEQ ID NO: 568054 - RNA, 19 nt, Homo sapiens
gauuguaaauagccugugu

SEQ ID NO: 568055 - RNA, 19 nt, Homo sapiens
ggcgcgagcugggaacuuu

SEQ ID NO: 568056 - RNA, 19 nt, Homo sapiens
aauagccuguguaagauuu

SEQ ID NO: 568057 - RNA, 19 nt, Homo sapiens
gaaaagcaauccuccugau

SEQ ID NO: 568058 - RNA, 19 nt, Homo sapiens
ugagugagauaaccaaugc

SEQ ID NO: 568059 - RNA, 19 nt, Homo sapiens
gagacagccugcgcuuaga

SEQ ID NO: 568060 - RNA, 19 nt, Homo sapiens
caaccuugccuuugagaau

SEQ ID NO: 568061 - RNA, 19 nt, Homo sapiens
uuacguaccugguggacau

SEQ ID NO: 568062 - RNA, 19 nt, Homo sapiens
ggucuuugaauuugguaua

SEQ ID NO: 568063 - RNA, 19 nt, Homo sapiens
guaaagaagguggaauaau

SEQ ID NO: 568064 - RNA, 19 nt, Homo sapiens
ucacuagacaacucucuuu

SEQ ID NO: 568065 - RNA, 19 nt, Homo sapiens
uucacggucuucaugauua

SEQ ID NO: 568066 - RNA, 19 nt, Homo sapiens
cgucaucgccugcuacuuc

SEQ ID NO: 568067 - RNA, 19 nt, Homo sapiens
acacgaggcucaccaacag

SEQ ID NO: 568068 - RNA, 19 nt, Homo sapiens
cgagugguguguaaugaca

SEQ ID NO: 568069 - RNA, 19 nt, Homo sapiens
ugucauggacuuccucaaa

SEQ ID NO: 568070 - RNA, 19 nt, Homo sapiens
caagguguaugggcucaug

SEQ ID NO: 568071 - RNA, 19 nt, Homo sapiens
ccuccugauuguauuguuu

SEQ ID NO: 568072 - RNA, 19 nt, Homo sapiens
gaagaccgaguggugugua

SEQ ID NO: 568073 - RNA, 19 nt, Homo sapiens
ggaggaggcgccuaagaag

SEQ ID NO: 568074 - RNA, 19 nt, Homo sapiens
gauuucaggagguaaagaa

SEQ ID NO: 568075 - RNA, 19 nt, Homo sapiens
uaagauuucaggagguaaa

SEQ ID NO: 568076 - RNA, 19 nt, Homo sapiens
auucacaccaccaauaaua

SEQ ID NO: 568077 - RNA, 19 nt, Homo sapiens
uuaaggaguugauguuugc

SEQ ID NO: 568078 - RNA, 19 nt, Homo sapiens
uggaaagcuuuguuaagga

SEQ ID NO: 568079 - RNA, 19 nt, Homo sapiens
ucaugaugcucuacuucuu

SEQ ID NO: 568080 - RNA, 19 nt, Homo sapiens
cuggaaagcuuuguuaagg

SEQ ID NO: 568081 - RNA, 19 nt, Homo sapiens
gcaccaagaccgagaagcu

SEQ ID NO: 568082 - RNA, 19 nt, Homo sapiens
gguguguaaugacaaguuc

SEQ ID NO: 568083 - RNA, 19 nt, Homo sapiens
uagccaaucccacagugua

SEQ ID NO: 568084 - RNA, 19 nt, Homo sapiens
caggucuacugcauuaaau

SEQ ID NO: 568085 - RNA, 19 nt, Homo sapiens
aggaguugauguuugcuuu

SEQ ID NO: 568086 - RNA, 19 nt, Homo sapiens
caccuggaaagcuuuguua

SEQ ID NO: 568087 - RNA, 19 nt, Homo sapiens
gauuugggaagaagcauga

SEQ ID NO: 568088 - RNA, 19 nt, Homo sapiens
uagugaaagugcaguguuc

SEQ ID NO: 568089 - RNA, 19 nt, Homo sapiens
ugagacagccugcgcuuag

SEQ ID NO: 568090 - RNA, 19 nt, Homo sapiens
uucauucucuagugucuaa

SEQ ID NO: 568091 - RNA, 19 nt, Homo sapiens
ggccagacacgcucaagug

SEQ ID NO: 568092 - RNA, 19 nt, Homo sapiens
guugauguuugcuuuccuu

SEQ ID NO: 568093 - RNA, 19 nt, Homo sapiens
gaggaggaggcgccuaaga

SEQ ID NO: 568094 - RNA, 19 nt, Homo sapiens
guacaaccagaccaucaug

SEQ ID NO: 568095 - RNA, 19 nt, Homo sapiens
aaagaugugguuacugaga

SEQ ID NO: 568096 - RNA, 19 nt, Homo sapiens
ccuccuaccucaacuacca

SEQ ID NO: 568097 - RNA, 19 nt, Homo sapiens
caugcaugcuaaagggaaa

SEQ ID NO: 568098 - RNA, 19 nt, Homo sapiens
aaagcuuuguuaaggaguu

SEQ ID NO: 568099 - RNA, 19 nt, Homo sapiens
gacugaagauauggguuau

SEQ ID NO: 568100 - RNA, 19 nt, Homo sapiens
ggacuguucgcuuuuauga

SEQ ID NO: 568101 - RNA, 19 nt, Homo sapiens
cgaagccaacucacaguau

SEQ ID NO: 568102 - RNA, 19 nt, Homo sapiens
ccucgcugcuuccagaguu

SEQ ID NO: 568103 - RNA, 19 nt, Homo sapiens
gugcuccucuuuuggauuu

SEQ ID NO: 568104 - RNA, 19 nt, Homo sapiens
agguaaagaagguggaaua

SEQ ID NO: 568105 - RNA, 19 nt, Homo sapiens
uggaagagcugaaauguua

SEQ ID NO: 568106 - RNA, 19 nt, Homo sapiens
ccacaaaucucuugccuuu

SEQ ID NO: 568107 - RNA, 19 nt, Homo sapiens
gaaaugaacugcaaacucu

SEQ ID NO: 568108 - RNA, 19 nt, Homo sapiens
gagcugaaauguuaaguuu

SEQ ID NO: 568109 - RNA, 19 nt, Homo sapiens
gauaaucucuguucuucua

SEQ ID NO: 568110 - RNA, 19 nt, Homo sapiens
gaaaaccccuugcuauuua

SEQ ID NO: 568111 - RNA, 19 nt, Homo sapiens
gcaaagcaaucuauaaaca

SEQ ID NO: 568112 - RNA, 19 nt, Homo sapiens
gaucagaaguggccauuug

SEQ ID NO: 568113 - RNA, 19 nt, Homo sapiens
ccagaagccugauugguua

SEQ ID NO: 568114 - RNA, 19 nt, Homo sapiens
ggaauagacucagggauuu

SEQ ID NO: 568115 - RNA, 19 nt, Homo sapiens
guaaagcccugaaauagau

SEQ ID NO: 568116 - RNA, 19 nt, Homo sapiens
gaaguggccauuuggauua

SEQ ID NO: 568117 - RNA, 19 nt, Homo sapiens
gaugaaauaucggauguaa

SEQ ID NO: 568118 - RNA, 19 nt, Homo sapiens
gaucgauacuugucaauga

SEQ ID NO: 568119 - RNA, 19 nt, Homo sapiens
gacaaucacuuaauucaga

SEQ ID NO: 568120 - RNA, 19 nt, Homo sapiens
caaaugaccuggguuauca

SEQ ID NO: 568121 - RNA, 19 nt, Homo sapiens
guaacuggccuuucucuua

SEQ ID NO: 568122 - RNA, 19 nt, Homo sapiens
ggacaaagacagacaaguu

SEQ ID NO: 568123 - RNA, 19 nt, Homo sapiens
gauuguagcuuccucagaa

SEQ ID NO: 568124 - RNA, 19 nt, Homo sapiens
gcacauuguuggaccauga

SEQ ID NO: 568125 - RNA, 19 nt, Homo sapiens
gaacaaacuagcaacaauu

SEQ ID NO: 568126 - RNA, 19 nt, Homo sapiens
ucacaccgcucauccagua

SEQ ID NO: 568127 - RNA, 19 nt, Homo sapiens
ccagagaccuauugcauug

SEQ ID NO: 568128 - RNA, 19 nt, Homo sapiens
ccaggucggugcaguauuu

SEQ ID NO: 568129 - RNA, 19 nt, Homo sapiens
gaaaugcacagcucuuauu

SEQ ID NO: 568130 - RNA, 19 nt, Homo sapiens
gaucgauucuucuagguuu

SEQ ID NO: 568131 - RNA, 19 nt, Homo sapiens
guaaauggguaugauugua

SEQ ID NO: 568132 - RNA, 19 nt, Homo sapiens
acacaucucucaucccuuu

SEQ ID NO: 568133 - RNA, 19 nt, Homo sapiens
guaguaaagcccugaaaua

SEQ ID NO: 568134 - RNA, 19 nt, Homo sapiens
gacaaagacagacaaguua

SEQ ID NO: 568135 - RNA, 19 nt, Homo sapiens
ccaaggaguucacugauau

SEQ ID NO: 568136 - RNA, 19 nt, Homo sapiens
gcagggaccucuggaauuc

SEQ ID NO: 568137 - RNA, 19 nt, Homo sapiens
gaaaauugcacuucucuua

SEQ ID NO: 568138 - RNA, 19 nt, Homo sapiens
ggaauaaaguguagaccau

SEQ ID NO: 568139 - RNA, 19 nt, Homo sapiens
ucaacuccaucacuucuua

SEQ ID NO: 568140 - RNA, 19 nt, Homo sapiens
ggacuggucuugcuguuag

SEQ ID NO: 568141 - RNA, 19 nt, Homo sapiens
gcaccugauuucugaguuu

SEQ ID NO: 568142 - RNA, 19 nt, Homo sapiens
gauacuccauugccuauga

SEQ ID NO: 568143 - RNA, 19 nt, Homo sapiens
gccaaggaguucacugaua

SEQ ID NO: 568144 - RNA, 19 nt, Homo sapiens
gaaccaauucugaucagua

SEQ ID NO: 568145 - RNA, 19 nt, Homo sapiens
gaaggaaccucuuaaaauc

SEQ ID NO: 568146 - RNA, 19 nt, Homo sapiens
gcacagacuuuggaaggaa

SEQ ID NO: 568147 - RNA, 19 nt, Homo sapiens
gauuaaacauggugcaaug

SEQ ID NO: 568148 - RNA, 19 nt, Homo sapiens
gcauggagguguuucugaa

SEQ ID NO: 568149 - RNA, 19 nt, Homo sapiens
gauaguagcauguuucugu

SEQ ID NO: 568150 - RNA, 19 nt, Homo sapiens
ccuauugguuccuuuauuu

SEQ ID NO: 568151 - RNA, 19 nt, Homo sapiens
caguuuacgucuuguauuu

SEQ ID NO: 568152 - RNA, 19 nt, Homo sapiens
ggacugcacucccaagaag

SEQ ID NO: 568153 - RNA, 19 nt, Homo sapiens
ggugaauucuggaaaggua

SEQ ID NO: 568154 - RNA, 19 nt, Homo sapiens
gcucugcucuggugucuug

SEQ ID NO: 568155 - RNA, 19 nt, Homo sapiens
gaaguaagcauuuccucuu

SEQ ID NO: 568156 - RNA, 19 nt, Homo sapiens
ugaccuggguuaucacuuu

SEQ ID NO: 568157 - RNA, 19 nt, Homo sapiens
gcagagguauccaaagcuu

SEQ ID NO: 568158 - RNA, 19 nt, Homo sapiens
gaaugauagugccuuuaaa

SEQ ID NO: 568159 - RNA, 19 nt, Homo sapiens
gagaagagaggaaaugguu

SEQ ID NO: 568160 - RNA, 19 nt, Homo sapiens
uauuaugucuggcaaauga

SEQ ID NO: 568161 - RNA, 19 nt, Homo sapiens
gcuacuugguugauucaua

SEQ ID NO: 568162 - RNA, 19 nt, Homo sapiens
gcccauaguuugacauuuc

SEQ ID NO: 568163 - RNA, 19 nt, Homo sapiens
ucuaauagcccaggucuua

SEQ ID NO: 568164 - RNA, 19 nt, Homo sapiens
gcacagagaagaucaacau

SEQ ID NO: 568165 - RNA, 19 nt, Homo sapiens
uaacugggucuuucagaua

SEQ ID NO: 568166 - RNA, 19 nt, Homo sapiens
cauggucacugaauuaaau

SEQ ID NO: 568167 - RNA, 19 nt, Homo sapiens
cauguaaagucgauuguau

SEQ ID NO: 568168 - RNA, 19 nt, Homo sapiens
aaauuugguuugagccuua

SEQ ID NO: 568169 - RNA, 19 nt, Homo sapiens
gaacugcaaacucuaauag

SEQ ID NO: 568170 - RNA, 19 nt, Homo sapiens
ugaaauaucggauguaauc

SEQ ID NO: 568171 - RNA, 19 nt, Homo sapiens
aaagguagaugaaauaucg

SEQ ID NO: 568172 - RNA, 19 nt, Homo sapiens
ugacuuggcugugggcuuu

SEQ ID NO: 568173 - RNA, 19 nt, Homo sapiens
ggagagaguugcuauucca

SEQ ID NO: 568174 - RNA, 19 nt, Homo sapiens
ucaaucaacuccaucacuu

SEQ ID NO: 568175 - RNA, 19 nt, Homo sapiens
cauaugaaaugaacugcaa

SEQ ID NO: 568176 - RNA, 19 nt, Homo sapiens
uaacuagcagggagaaaua

SEQ ID NO: 568177 - RNA, 19 nt, Homo sapiens
ggucaaaucuucaaaagga

SEQ ID NO: 568178 - RNA, 19 nt, Homo sapiens
cucaguaugugcuauaaua

SEQ ID NO: 568179 - RNA, 19 nt, Homo sapiens
ggauuugccuggccagaga

SEQ ID NO: 568180 - RNA, 19 nt, Homo sapiens
ggaggacacuggagagagu

SEQ ID NO: 568181 - RNA, 19 nt, Homo sapiens
cauauccucuuuccuuuau

SEQ ID NO: 568182 - RNA, 19 nt, Homo sapiens
acauuucccuuucuucuuu

SEQ ID NO: 568183 - RNA, 19 nt, Homo sapiens
gaauaaaguguagaccaua

SEQ ID NO: 568184 - RNA, 19 nt, Homo sapiens
guucauugcugcagguuug

SEQ ID NO: 568185 - RNA, 19 nt, Homo sapiens
ggagacaaaugacuuacag

SEQ ID NO: 568186 - RNA, 19 nt, Homo sapiens
ucucagcccuagaggaaua

SEQ ID NO: 568187 - RNA, 19 nt, Homo sapiens
cuacuugguugauucauau

SEQ ID NO: 568188 - RNA, 19 nt, Homo sapiens
cguaauuguuuccuaguaa

SEQ ID NO: 568189 - RNA, 19 nt, Homo sapiens
cacaugcccugaaugaauu

SEQ ID NO: 568190 - RNA, 19 nt, Homo sapiens
gaccacagcugcaguuagg

SEQ ID NO: 568191 - RNA, 19 nt, Homo sapiens
aagcuugugugucuagaua

SEQ ID NO: 568192 - RNA, 19 nt, Homo sapiens
caugugacuuguauaggua

SEQ ID NO: 568193 - RNA, 19 nt, Homo sapiens
uaaugaaucuccagaaugc

SEQ ID NO: 568194 - RNA, 19 nt, Homo sapiens
ggaggaaauucuacuaaaa

SEQ ID NO: 568195 - RNA, 19 nt, Homo sapiens
uaucggauguaaucugaaa

SEQ ID NO: 568196 - RNA, 19 nt, Homo sapiens
ggaauucccaucuguuuca

SEQ ID NO: 568197 - RNA, 19 nt, Homo sapiens
ggagaguguuuaugguuuc

SEQ ID NO: 568198 - RNA, 19 nt, Homo sapiens
gcacuucucuuaaaacugu

SEQ ID NO: 568199 - RNA, 19 nt, Homo sapiens
gaacugaggacagcuaauc

SEQ ID NO: 568200 - RNA, 19 nt, Homo sapiens
gaagugguguuagaaucuu

SEQ ID NO: 568201 - RNA, 19 nt, Homo sapiens
ugaacaaacuagcaacaau

SEQ ID NO: 568202 - RNA, 19 nt, Homo sapiens
gcagugaaucucaguuuga

SEQ ID NO: 568203 - RNA, 19 nt, Homo sapiens
aagaugagcucaacagucu

SEQ ID NO: 568204 - RNA, 19 nt, Homo sapiens
uaacuggccuuucucuuac

SEQ ID NO: 568205 - RNA, 19 nt, Homo sapiens
gaaaugugcagguuaauaa

SEQ ID NO: 568206 - RNA, 19 nt, Homo sapiens
caagaaacuuugacagaaa

SEQ ID NO: 568207 - RNA, 19 nt, Homo sapiens
gaaaguauauucugauugc

SEQ ID NO: 568208 - RNA, 19 nt, Homo sapiens
ggacaaggauauaaguuuc

SEQ ID NO: 568209 - RNA, 19 nt, Homo sapiens
caagagagauccaaucagu

SEQ ID NO: 568210 - RNA, 19 nt, Homo sapiens
caccaaacauugaaacuuu

SEQ ID NO: 568211 - RNA, 19 nt, Homo sapiens
gcuugaaugugacagauua

SEQ ID NO: 568212 - RNA, 19 nt, Homo sapiens
acacaaagguuaaugacaa

SEQ ID NO: 568213 - RNA, 19 nt, Homo sapiens
ggacagaguuagaggaauc

SEQ ID NO: 568214 - RNA, 19 nt, Homo sapiens
gaccagaauuggcuuuauu

SEQ ID NO: 568215 - RNA, 19 nt, Homo sapiens
ccagagagaccaauuauau

SEQ ID NO: 568216 - RNA, 19 nt, Homo sapiens
gugcaacucuguucacauu

SEQ ID NO: 568217 - RNA, 19 nt, Homo sapiens
gauauaaguuucugggaau

SEQ ID NO: 568218 - RNA, 19 nt, Homo sapiens
caaggcaucuuaagacuuc

SEQ ID NO: 568219 - RNA, 19 nt, Homo sapiens
uaacuugggucucugauca

SEQ ID NO: 568220 - RNA, 19 nt, Homo sapiens
ccacaucucugcuuguuca

SEQ ID NO: 568221 - RNA, 19 nt, Homo sapiens
acagaaaugugcagguuaa

SEQ ID NO: 568222 - RNA, 19 nt, Homo sapiens
ucacugauccuucugcaua

SEQ ID NO: 568223 - RNA, 19 nt, Homo sapiens
gcaauaaggcagaugagaa

SEQ ID NO: 568224 - RNA, 19 nt, Homo sapiens
cugaggagcuugaauguga

SEQ ID NO: 568225 - RNA, 19 nt, Homo sapiens
gaagaguacuacaggaauc

SEQ ID NO: 568226 - RNA, 19 nt, Homo sapiens
uaaacgaaaucgcaagaga

SEQ ID NO: 568227 - RNA, 19 nt, Homo sapiens
gaacaaguccaaagagaca

SEQ ID NO: 568228 - RNA, 19 nt, Homo sapiens
ucgcaaaucuggaauguuc

SEQ ID NO: 568229 - RNA, 19 nt, Homo sapiens
gaagcaaauuuguguuaca

SEQ ID NO: 568230 - RNA, 19 nt, Homo sapiens
guauuaugcugcucacuga

SEQ ID NO: 568231 - RNA, 19 nt, Homo sapiens
aaacagaaaugugcagguu

SEQ ID NO: 568232 - RNA, 19 nt, Homo sapiens
gaaaauggccuacaacaug

SEQ ID NO: 568233 - RNA, 19 nt, Homo sapiens
acaagaaacuuugacagaa

SEQ ID NO: 568234 - RNA, 19 nt, Homo sapiens
cagaagcaaauuuguguua

SEQ ID NO: 568235 - RNA, 19 nt, Homo sapiens
gaaggaaggauuaguccaa

SEQ ID NO: 568236 - RNA, 19 nt, Homo sapiens
ugacacuucucggauguua

SEQ ID NO: 568237 - RNA, 19 nt, Homo sapiens
gcuuguaucuugugccauu

SEQ ID NO: 568238 - RNA, 19 nt, Homo sapiens
gaaccaagcagccucaaag

SEQ ID NO: 568239 - RNA, 19 nt, Homo sapiens
gcacaggagcuacagcaaa

SEQ ID NO: 568240 - RNA, 19 nt, Homo sapiens
gagcaagugaacaggauua

SEQ ID NO: 568241 - RNA, 19 nt, Homo sapiens
guugggcucucucuucuuu

SEQ ID NO: 568242 - RNA, 19 nt, Homo sapiens
cagaacaaguccaaagaga

SEQ ID NO: 568243 - RNA, 19 nt, Homo sapiens
gacaagaaacuuugacaga

SEQ ID NO: 568244 - RNA, 19 nt, Homo sapiens
gcaauuacuagccaugauu

SEQ ID NO: 568245 - RNA, 19 nt, Homo sapiens
gaccacccauugauuguau

SEQ ID NO: 568246 - RNA, 19 nt, Homo sapiens
caauauaccugaaaacaga

SEQ ID NO: 568247 - RNA, 19 nt, Homo sapiens
ggaugcuucucgcuacuuu

SEQ ID NO: 568248 - RNA, 19 nt, Homo sapiens
guaccuuucucagacauuu

SEQ ID NO: 568249 - RNA, 19 nt, Homo sapiens
ccaagcagccucaaagguu

SEQ ID NO: 568250 - RNA, 19 nt, Homo sapiens
ggaaggauuaguccaaaga

SEQ ID NO: 568251 - RNA, 19 nt, Homo sapiens
guaccaaccugcauagaac

SEQ ID NO: 568252 - RNA, 19 nt, Homo sapiens
ccucaaagguuccacaucu

SEQ ID NO: 568253 - RNA, 19 nt, Homo sapiens
caaagagugauauuacuga

SEQ ID NO: 568254 - RNA, 19 nt, Homo sapiens
ucauggcacuucugcagua

SEQ ID NO: 568255 - RNA, 19 nt, Homo sapiens
cugaugacauuaauuguug

SEQ ID NO: 568256 - RNA, 19 nt, Homo sapiens
cagagagaccaauuauaua

SEQ ID NO: 568257 - RNA, 19 nt, Homo sapiens
gggacaaggauauaaguuu

SEQ ID NO: 568258 - RNA, 19 nt, Homo sapiens
gcagggaggugguugucau

SEQ ID NO: 568259 - RNA, 19 nt, Homo sapiens
caauuacuagccaugauua

SEQ ID NO: 568260 - RNA, 19 nt, Homo sapiens
cacaggagcuacagcaaau

SEQ ID NO: 568261 - RNA, 19 nt, Homo sapiens
cagugaaagucgaagagua

SEQ ID NO: 568262 - RNA, 19 nt, Homo sapiens
gaugagacuguuccuguaa

SEQ ID NO: 568263 - RNA, 19 nt, Homo sapiens
uaaggcagaugagaagcua

SEQ ID NO: 568264 - RNA, 19 nt, Homo sapiens
gauagcacagccugcaaua

SEQ ID NO: 568265 - RNA, 19 nt, Homo sapiens
ugacaacaauauaccugaa

SEQ ID NO: 568266 - RNA, 19 nt, Homo sapiens
cgacaagucauacaacaug

SEQ ID NO: 568267 - RNA, 19 nt, Homo sapiens
gcauagaacaaauucaugu

SEQ ID NO: 568268 - RNA, 19 nt, Homo sapiens
gaaucacuguuacguucuu

SEQ ID NO: 568269 - RNA, 19 nt, Homo sapiens
ccagaauuggcuuuauuua

SEQ ID NO: 568270 - RNA, 19 nt, Homo sapiens
aggauuaccugggagauaa

SEQ ID NO: 568271 - RNA, 19 nt, Homo sapiens
gaacuuggugacacuguug

SEQ ID NO: 568272 - RNA, 19 nt, Homo sapiens
ugaugagacuguuccugua

SEQ ID NO: 568273 - RNA, 19 nt, Homo sapiens
caauuacuguucccagaug

SEQ ID NO: 568274 - RNA, 19 nt, Homo sapiens
gaaugugacagauuacaau

SEQ ID NO: 568275 - RNA, 19 nt, Homo sapiens
ucagauacuugaagaacau

SEQ ID NO: 568276 - RNA, 19 nt, Homo sapiens
guccuaggcucucaaaaua

SEQ ID NO: 568277 - RNA, 19 nt, Homo sapiens
gaugagaagcuagaacuug

SEQ ID NO: 568278 - RNA, 19 nt, Homo sapiens
cauuguaucucuuauguac

SEQ ID NO: 568279 - RNA, 19 nt, Homo sapiens
ccacuuacaguugcuuaua

SEQ ID NO: 568280 - RNA, 19 nt, Homo sapiens
auugauaccuuaccaucua

SEQ ID NO: 568281 - RNA, 19 nt, Homo sapiens
gaagcacuauaaaccaagu

SEQ ID NO: 568282 - RNA, 19 nt, Homo sapiens
acaggaaucaugugaguuu

SEQ ID NO: 568283 - RNA, 19 nt, Homo sapiens
uggcaucucugcugucuuc

SEQ ID NO: 568284 - RNA, 19 nt, Homo sapiens
ucucggauguuacgucuau

SEQ ID NO: 568285 - RNA, 19 nt, Homo sapiens
gaaggagacaacauuagug

SEQ ID NO: 568286 - RNA, 19 nt, Homo sapiens
ggaagaaaauggaguugug

SEQ ID NO: 568287 - RNA, 19 nt, Homo sapiens
ucucuuauguacuucauug

SEQ ID NO: 568288 - RNA, 19 nt, Homo sapiens
ggauuaguccaaagaguga

SEQ ID NO: 568289 - RNA, 19 nt, Homo sapiens
cuacaggaaucaugugagu

SEQ ID NO: 568290 - RNA, 19 nt, Homo sapiens
agagagauccaaucaguga

SEQ ID NO: 568291 - RNA, 19 nt, Homo sapiens
caacauuaguggaguuugc

SEQ ID NO: 568292 - RNA, 19 nt, Homo sapiens
caaccugcauagaacaaau

SEQ ID NO: 568293 - RNA, 19 nt, Homo sapiens
uaacugaaauaaggugcuu

SEQ ID NO: 568294 - RNA, 19 nt, Homo sapiens
gggaggugguugucauuca

SEQ ID NO: 568295 - RNA, 19 nt, Homo sapiens
aagaagcacuauaaaccaa

SEQ ID NO: 568296 - RNA, 19 nt, Homo sapiens
gugaugagcuagaguuugc

SEQ ID NO: 568297 - RNA, 19 nt, Homo sapiens
gaggacagaguuagaggaa

SEQ ID NO: 568298 - RNA, 19 nt, Homo sapiens
ugcauugccuacuguuaua

SEQ ID NO: 568299 - RNA, 19 nt, Homo sapiens
gaaagugcgcggagugaag

SEQ ID NO: 568300 - RNA, 19 nt, Homo sapiens
uggcacagagcaacaauuu

SEQ ID NO: 568301 - RNA, 19 nt, Homo sapiens
gcaggcaguguaucugaaa

SEQ ID NO: 568302 - RNA, 19 nt, Homo sapiens
auccaaaccucaccagaaa

SEQ ID NO: 568303 - RNA, 19 nt, Homo sapiens
uaaaccaaguucacacaag

SEQ ID NO: 568304 - RNA, 19 nt, Homo sapiens
gauguuagaagauucagau

SEQ ID NO: 568305 - RNA, 19 nt, Homo sapiens
ggaaaucucucccuucauu

SEQ ID NO: 568306 - RNA, 19 nt, Homo sapiens
gaaaugugcuggaagacuu

SEQ ID NO: 568307 - RNA, 19 nt, Homo sapiens
gcuggaagacuuaaauuua

SEQ ID NO: 568308 - RNA, 19 nt, Homo sapiens
gcacggacaucgccuacaa

SEQ ID NO: 568309 - RNA, 19 nt, Homo sapiens
ggaaagcgguuuggaugaa

SEQ ID NO: 568310 - RNA, 19 nt, Homo sapiens
gaaguucuuugcagauuug

SEQ ID NO: 568311 - RNA, 19 nt, Homo sapiens
gaacgaagaggaagguuug

SEQ ID NO: 568312 - RNA, 19 nt, Homo sapiens
gcaggaagaugaugauaac

SEQ ID NO: 568313 - RNA, 19 nt, Homo sapiens
gcgaggcgcucaugaacaa

SEQ ID NO: 568314 - RNA, 19 nt, Homo sapiens
caaagcagcgcaaaucuga

SEQ ID NO: 568315 - RNA, 19 nt, Homo sapiens
gaaagcgguuuggaugaaa

SEQ ID NO: 568316 - RNA, 19 nt, Homo sapiens
caugggagcuaaccuuuau

SEQ ID NO: 568317 - RNA, 19 nt, Homo sapiens
gaacacaugauccaacaga

SEQ ID NO: 568318 - RNA, 19 nt, Homo sapiens
acacuacccuccaaucuug

SEQ ID NO: 568319 - RNA, 19 nt, Homo sapiens
ugacuucgcuaaaggaaau

SEQ ID NO: 568320 - RNA, 19 nt, Homo sapiens
ggguaaagcuuagcagaga

SEQ ID NO: 568321 - RNA, 19 nt, Homo sapiens
ucaaagugauucuggaguu

SEQ ID NO: 568322 - RNA, 19 nt, Homo sapiens
gggaggcgaucagcagaua

SEQ ID NO: 568323 - RNA, 19 nt, Homo sapiens
gcgaucagcagauaccaua

SEQ ID NO: 568324 - RNA, 19 nt, Homo sapiens
ucaaguaccugaugaccau

SEQ ID NO: 568325 - RNA, 19 nt, Homo sapiens
agagauaaguacaguaugu

SEQ ID NO: 568326 - RNA, 19 nt, Homo sapiens
ccaacggccugauguacuu

SEQ ID NO: 568327 - RNA, 19 nt, Homo sapiens
gucaaaccauaaucucuuu

SEQ ID NO: 568328 - RNA, 19 nt, Homo sapiens
gaucuuguguuucuucaac

SEQ ID NO: 568329 - RNA, 19 nt, Homo sapiens
gaugauaacggcgauguga

SEQ ID NO: 568330 - RNA, 19 nt, Homo sapiens
aagaagaccuggguggaaa

SEQ ID NO: 568331 - RNA, 19 nt, Homo sapiens
uaaccuuuaucccaccuuu

SEQ ID NO: 568332 - RNA, 19 nt, Homo sapiens
aaagacggguguuuuauuu

SEQ ID NO: 568333 - RNA, 19 nt, Homo sapiens
gguaaagcuuagcagagaa

SEQ ID NO: 568334 - RNA, 19 nt, Homo sapiens
ccagauggguuaauuucca

SEQ ID NO: 568335 - RNA, 19 nt, Homo sapiens
ggucaaaccauaaucucuu

SEQ ID NO: 568336 - RNA, 19 nt, Homo sapiens
cgacuucaccgucuucaug

SEQ ID NO: 568337 - RNA, 19 nt, Homo sapiens
cauagaggguacuguaaag

SEQ ID NO: 568338 - RNA, 19 nt, Homo sapiens
caaagugauucuggaguuc

SEQ ID NO: 568339 - RNA, 19 nt, Homo sapiens
gcauaacugugacgaaagc

SEQ ID NO: 568340 - RNA, 19 nt, Homo sapiens
aggcauaacugugacgaaa

SEQ ID NO: 568341 - RNA, 19 nt, Homo sapiens
guacugcuuucaggucuug

SEQ ID NO: 568342 - RNA, 19 nt, Homo sapiens
aaucauagaggguacugua

SEQ ID NO: 568343 - RNA, 19 nt, Homo sapiens
ucccguugguuguuaauuu

SEQ ID NO: 568344 - RNA, 19 nt, Homo sapiens
gcaaagcagcgcaaaucug

SEQ ID NO: 568345 - RNA, 19 nt, Homo sapiens
guucgucuaccucuucaua

SEQ ID NO: 568346 - RNA, 19 nt, Homo sapiens
cauguacagaucacaaaua

SEQ ID NO: 568347 - RNA, 19 nt, Homo sapiens
cagcagauaccauagugaa

SEQ ID NO: 568348 - RNA, 19 nt, Homo sapiens
uggaaaggcauaacuguga

SEQ ID NO: 568349 - RNA, 19 nt, Homo sapiens
gaaagacggguguuuuauu

SEQ ID NO: 568350 - RNA, 19 nt, Homo sapiens
gucuucagccucauaauaa

SEQ ID NO: 568351 - RNA, 19 nt, Homo sapiens
ugucuucagccucauaaua

SEQ ID NO: 568352 - RNA, 19 nt, Homo sapiens
ugucugcgguggcugcuuu

SEQ ID NO: 568353 - RNA, 19 nt, Homo sapiens
aaaacuaucucaucuguca

SEQ ID NO: 568354 - RNA, 19 nt, Homo sapiens
aaaucgaucuuguguuucu

SEQ ID NO: 568355 - RNA, 19 nt, Homo sapiens
cagagacugcugugaguuu

SEQ ID NO: 568356 - RNA, 19 nt, Homo sapiens
gagaggcacgguagggaaa

SEQ ID NO: 568357 - RNA, 19 nt, Homo sapiens
gcgcaaaucugagguuucc

SEQ ID NO: 568358 - RNA, 19 nt, Homo sapiens
cagcgcaaaucugagguuu

SEQ ID NO: 568359 - RNA, 19 nt, Homo sapiens
cgggccagcuugugccuaa

SEQ ID NO: 568360 - RNA, 19 nt, Homo sapiens
cggaacacaugauccaaca

SEQ ID NO: 568361 - RNA, 19 nt, Homo sapiens
ucauagaggguacuguaaa

SEQ ID NO: 568362 - RNA, 19 nt, Homo sapiens
uuugaaaugugcuggaaga

SEQ ID NO: 568363 - RNA, 19 nt, Homo sapiens
gacaaaagaggaaacaaaa

SEQ ID NO: 568364 - RNA, 19 nt, Homo sapiens
cagcuugugccuaauagaa

SEQ ID NO: 568365 - RNA, 19 nt, Homo sapiens
gaacucggauucuuuugca

SEQ ID NO: 568366 - RNA, 19 nt, Homo sapiens
uguaauagaacucggauuc

SEQ ID NO: 568367 - RNA, 19 nt, Homo sapiens
gaaggcaggaggcagaaag

SEQ ID NO: 568368 - RNA, 19 nt, Homo sapiens
acugagaagugaccuggaa

SEQ ID NO: 568369 - RNA, 19 nt, Homo sapiens
gcaccaagaccgagaagcu

SEQ ID NO: 568370 - RNA, 19 nt, Homo sapiens
gugcaugugaaauuuguaa

SEQ ID NO: 568371 - RNA, 19 nt, Homo sapiens
gacacuacccuccaaucuu

SEQ ID NO: 568372 - RNA, 19 nt, Homo sapiens
cacaugauccaacagacua

SEQ ID NO: 568373 - RNA, 19 nt, Homo sapiens
aaggaaauguaagagguuu

SEQ ID NO: 568374 - RNA, 19 nt, Homo sapiens
gguuucccguugguuguua

SEQ ID NO: 568375 - RNA, 19 nt, Homo sapiens
ggccagcuugugccuaaua

SEQ ID NO: 568376 - RNA, 19 nt, Homo sapiens
gaggguacuguaaagugua

SEQ ID NO: 568377 - RNA, 19 nt, Homo sapiens
agaggguacuguaaagugu

SEQ ID NO: 568378 - RNA, 19 nt, Homo sapiens
cagaaagacggguguuuua

SEQ ID NO: 568379 - RNA, 19 nt, Homo sapiens
ugcgguggcugcuuuguug

SEQ ID NO: 568380 - RNA, 19 nt, Homo sapiens
cauaggcacguccuucuug

SEQ ID NO: 568381 - RNA, 19 nt, Homo sapiens
ucauggugcucuacuucuu

SEQ ID NO: 568382 - RNA, 19 nt, Homo sapiens
ucaaaacuaucucaucugu

SEQ ID NO: 568383 - RNA, 19 nt, Homo sapiens
uauguaauguucacuugag

SEQ ID NO: 568384 - RNA, 19 nt, Homo sapiens
uaucccaccuuugacacua

SEQ ID NO: 568385 - RNA, 19 nt, Homo sapiens
guaaagcuuagcagagaau

SEQ ID NO: 568386 - RNA, 19 nt, Homo sapiens
cagauaccauagugaacga

SEQ ID NO: 568387 - RNA, 19 nt, Homo sapiens
gaucagcagauaccauagu

SEQ ID NO: 568388 - RNA, 19 nt, Homo sapiens
guucugacuucgcuaaagg

SEQ ID NO: 568389 - RNA, 19 nt, Homo sapiens
gagguucugacuucgcuaa

SEQ ID NO: 568390 - RNA, 19 nt, Homo sapiens
gcagaaagacggguguuuu

SEQ ID NO: 568391 - RNA, 19 nt, Homo sapiens
agacguggaguagguauuu

SEQ ID NO: 568392 - RNA, 19 nt, Homo sapiens
ccaaggagacguggaguag

SEQ ID NO: 568393 - RNA, 19 nt, Homo sapiens
gcuuucaggucuuguaaaa

SEQ ID NO: 568394 - RNA, 19 nt, Homo sapiens
gauuucaggcaaagacuug

SEQ ID NO: 568395 - RNA, 19 nt, Homo sapiens
ggccugauguacuuuaagg

SEQ ID NO: 568396 - RNA, 19 nt, Homo sapiens
ucaugggagcuaaccuuua

SEQ ID NO: 568397 - RNA, 19 nt, Homo sapiens
uuuccagggucagacauua

SEQ ID NO: 568398 - RNA, 19 nt, Homo sapiens
ugaacgaagaggaagguuu

SEQ ID NO: 568399 - RNA, 19 nt, Homo sapiens
cauagugaacgaagaggaa

SEQ ID NO: 568400 - RNA, 19 nt, Homo sapiens
guuguuaauuugguugaga

SEQ ID NO: 568401 - RNA, 19 nt, Homo sapiens
aaacacgacggcaccaaga

SEQ ID NO: 568402 - RNA, 19 nt, Homo sapiens
ccuccaaucuugcaacacu

SEQ ID NO: 568403 - RNA, 19 nt, Homo sapiens
auucuggaguucuuugaaa

SEQ ID NO: 568404 - RNA, 19 nt, Homo sapiens
gagguuuuguugucuguuu

SEQ ID NO: 568405 - RNA, 19 nt, Homo sapiens
gauaacaacucucacuuua

SEQ ID NO: 568406 - RNA, 19 nt, Homo sapiens
caaaguaccuggcauugaa

SEQ ID NO: 568407 - RNA, 19 nt, Homo sapiens
gcaaaugccuuaaguaaac

SEQ ID NO: 568408 - RNA, 19 nt, Homo sapiens
ggacuuaaaugacucacuu

SEQ ID NO: 568409 - RNA, 19 nt, Homo sapiens
uaacaacucucacuuuagu

SEQ ID NO: 568410 - RNA, 19 nt, Homo sapiens
gcaugauaaugaacucuua

SEQ ID NO: 568411 - RNA, 19 nt, Homo sapiens
gaacaaaguaccuggcauu

SEQ ID NO: 568412 - RNA, 19 nt, Homo sapiens
gcagucagauacacagauu

SEQ ID NO: 568413 - RNA, 19 nt, Homo sapiens
ccuuaggccuuguuauuua

SEQ ID NO: 568414 - RNA, 19 nt, Homo sapiens
cuucugagcugucaccuuu

SEQ ID NO: 568415 - RNA, 19 nt, Homo sapiens
ggauaacaacucucacuuu

SEQ ID NO: 568416 - RNA, 19 nt, Homo sapiens
uuaaagugcuugcuaagga

SEQ ID NO: 568417 - RNA, 19 nt, Homo sapiens
ccaaagauauaguguguac

SEQ ID NO: 568418 - RNA, 19 nt, Homo sapiens
caaagcagaugccauuguc

SEQ ID NO: 568419 - RNA, 19 nt, Homo sapiens
ccucgacucuuccuacgua

SEQ ID NO: 568420 - RNA, 19 nt, Homo sapiens
auacggguuucuuacauua

SEQ ID NO: 568421 - RNA, 19 nt, Homo sapiens
gcacuuggcuggguuugca

SEQ ID NO: 568422 - RNA, 19 nt, Homo sapiens
gauaaugaacucuuaaugg

SEQ ID NO: 568423 - RNA, 19 nt, Homo sapiens
guuguuagccaaguaaaua

SEQ ID NO: 568424 - RNA, 19 nt, Homo sapiens
cgacuacgccgucuucaug

SEQ ID NO: 568425 - RNA, 19 nt, Homo sapiens
ggauguaaauggaacuucu

SEQ ID NO: 568426 - RNA, 19 nt, Homo sapiens
guaaauggaacuucugcaa

SEQ ID NO: 568427 - RNA, 19 nt, Homo sapiens
ucacaguguugauugcuau

SEQ ID NO: 568428 - RNA, 19 nt, Homo sapiens
acaccuacaugcccaauca

SEQ ID NO: 568429 - RNA, 19 nt, Homo sapiens
ucugagcugucaccuuuaa

SEQ ID NO: 568430 - RNA, 19 nt, Homo sapiens
guuuggguauucuuaauga

SEQ ID NO: 568431 - RNA, 19 nt, Homo sapiens
uccauuagcugggacuuaa

SEQ ID NO: 568432 - RNA, 19 nt, Homo sapiens
caugggagcucuuuucuga

SEQ ID NO: 568433 - RNA, 19 nt, Homo sapiens
acauggagcgcuucaagua

SEQ ID NO: 568434 - RNA, 19 nt, Homo sapiens
ccuuuaaagugcuugcuaa

SEQ ID NO: 568435 - RNA, 19 nt, Homo sapiens
guaagggcaucggcuacaa

SEQ ID NO: 568436 - RNA, 19 nt, Homo sapiens
ggagugggguuaccuguug

SEQ ID NO: 568437 - RNA, 19 nt, Homo sapiens
uuauuuauccugcauggua

SEQ ID NO: 568438 - RNA, 19 nt, Homo sapiens
uuaaguuguuagccaagua

SEQ ID NO: 568439 - RNA, 19 nt, Homo sapiens
gguggacucugcggcguuu

SEQ ID NO: 568440 - RNA, 19 nt, Homo sapiens
uaaauacggguuucuuaca

SEQ ID NO: 568441 - RNA, 19 nt, Homo sapiens
agacaggccagaucgcuaa

SEQ ID NO: 568442 - RNA, 19 nt, Homo sapiens
aauacggguuucuuacauu

SEQ ID NO: 568443 - RNA, 19 nt, Homo sapiens
aaauacggguuucuuacau

SEQ ID NO: 568444 - RNA, 19 nt, Homo sapiens
caaaugccuuaaguaaaca

SEQ ID NO: 568445 - RNA, 19 nt, Homo sapiens
caugguaucacuaaagguu

SEQ ID NO: 568446 - RNA, 19 nt, Homo sapiens
gagcaaggcaacccugaca

SEQ ID NO: 568447 - RNA, 19 nt, Homo sapiens
ucaccgugccgcuguguaa

SEQ ID NO: 568448 - RNA, 19 nt, Homo sapiens
gggcaucggcuacaacuac

SEQ ID NO: 568449 - RNA, 19 nt, Homo sapiens
uaaguuguuagccaaguaa

SEQ ID NO: 568450 - RNA, 19 nt, Homo sapiens
cuacaugcccaaucaguuc

SEQ ID NO: 568451 - RNA, 19 nt, Homo sapiens
ggucaucuaccucuucauc

SEQ ID NO: 568452 - RNA, 19 nt, Homo sapiens
gaccuuaggcauggagaaa

SEQ ID NO: 568453 - RNA, 19 nt, Homo sapiens
ucuugucgcucacaugguu

SEQ ID NO: 568454 - RNA, 19 nt, Homo sapiens
ccaaagcagaugccauugu

SEQ ID NO: 568455 - RNA, 19 nt, Homo sapiens
gcagcgaagggacacuuga

SEQ ID NO: 568456 - RNA, 19 nt, Homo sapiens
gccuagaggacuacaagaa

SEQ ID NO: 568457 - RNA, 19 nt, Homo sapiens
gacuuaaaugacucacuua

SEQ ID NO: 568458 - RNA, 19 nt, Homo sapiens
gcucggucaucaagcaaca

SEQ ID NO: 568459 - RNA, 19 nt, Homo sapiens
cgacauggagcgcuucaag

SEQ ID NO: 568460 - RNA, 19 nt, Homo sapiens
ccaucugccuagaggacua

SEQ ID NO: 568461 - RNA, 19 nt, Homo sapiens
cuuaggccuuguuauuuau

SEQ ID NO: 568462 - RNA, 19 nt, Homo sapiens
gagcugucaccuuuaaagu

SEQ ID NO: 568463 - RNA, 19 nt, Homo sapiens
ugaugggauugcacgguuu

SEQ ID NO: 568464 - RNA, 19 nt, Homo sapiens
ugccuuaaguaaacaaaca

SEQ ID NO: 568465 - RNA, 19 nt, Homo sapiens
cgcccgaucucaaguucuu

SEQ ID NO: 568466 - RNA, 19 nt, Homo sapiens
ccaccuuccuuaucgacau

SEQ ID NO: 568467 - RNA, 19 nt, Homo sapiens
gguuaccuguuggaaguga

SEQ ID NO: 568468 - RNA, 19 nt, Homo sapiens
cuacaacuacaccuacaug

SEQ ID NO: 568469 - RNA, 19 nt, Homo sapiens
auccaaagauauagugugu

SEQ ID NO: 568470 - RNA, 19 nt, Homo sapiens
acaaaguaccuggcauuga

SEQ ID NO: 568471 - RNA, 19 nt, Homo sapiens
caguguugauugcuauuag

SEQ ID NO: 568472 - RNA, 19 nt, Homo sapiens
uauuuauccugcaugguau

SEQ ID NO: 568473 - RNA, 19 nt, Homo sapiens
uuccagaacccgagauuug

SEQ ID NO: 568474 - RNA, 19 nt, Homo sapiens
ugacucacuuagaacaaag

SEQ ID NO: 568475 - RNA, 19 nt, Homo sapiens
gcaccguggucuucuugcu

SEQ ID NO: 568476 - RNA, 19 nt, Homo sapiens
cggcgagcuccgugucuua

SEQ ID NO: 568477 - RNA, 19 nt, Homo sapiens
ggcaucggcuacaacuaca

SEQ ID NO: 568478 - RNA, 19 nt, Homo sapiens
uuaaugaccaggcaaaugc

SEQ ID NO: 568479 - RNA, 19 nt, Homo sapiens
gaugggauugcacgguuug

SEQ ID NO: 568480 - RNA, 19 nt, Homo sapiens
gcauguacacgcccaucug

SEQ ID NO: 568481 - RNA, 19 nt, Homo sapiens
guacuucaugugccuagug

SEQ ID NO: 568482 - RNA, 19 nt, Homo sapiens
caggccagaucgcuaacug

SEQ ID NO: 568483 - RNA, 19 nt, Homo sapiens
gggguuaccuguuggaagu

SEQ ID NO: 568484 - RNA, 19 nt, Homo sapiens
gccauugucccaggucuga

SEQ ID NO: 568485 - RNA, 19 nt, Homo sapiens
cuacaaccgcgucaagaca

SEQ ID NO: 568486 - RNA, 19 nt, Homo sapiens
ccauggauaacaacucuca

SEQ ID NO: 568487 - RNA, 19 nt, Homo sapiens
acggguuucuuacauuaga

SEQ ID NO: 568488 - RNA, 19 nt, Homo sapiens
cuuaaaugacucacuuaga

SEQ ID NO: 568489 - RNA, 19 nt, Homo sapiens
cuacaaccgcaccgaccua

SEQ ID NO: 568490 - RNA, 19 nt, Homo sapiens
ugguaucacuaaagguuuc

SEQ ID NO: 568491 - RNA, 19 nt, Homo sapiens
ccagaacccgagauuugga

SEQ ID NO: 568492 - RNA, 19 nt, Homo sapiens
uaaaugacucacuuagaac

SEQ ID NO: 568493 - RNA, 19 nt, Homo sapiens
uuagcugggacuuaaauga

SEQ ID NO: 568494 - RNA, 19 nt, Homo sapiens
ccaccaagacgcacaagcu

SEQ ID NO: 568495 - RNA, 19 nt, Homo sapiens
cgguuuggguauucuuaau

SEQ ID NO: 568496 - RNA, 19 nt, Homo sapiens
gccacgcguuaauuucugu

SEQ ID NO: 568497 - RNA, 19 nt, Homo sapiens
acaguguugauugcuauua

SEQ ID NO: 568498 - RNA, 19 nt, Homo sapiens
ucgccugccucuucuacga

SEQ ID NO: 568499 - RNA, 19 nt, Homo sapiens
gcacgcacugccacuauaa

SEQ ID NO: 568500 - RNA, 19 nt, Homo sapiens
ucacugugcucaccuucuu

SEQ ID NO: 568501 - RNA, 19 nt, Homo sapiens
uggagaagcucauggucaa

SEQ ID NO: 568502 - RNA, 19 nt, Homo sapiens
acacagagaagcuggagaa

SEQ ID NO: 568503 - RNA, 19 nt, Homo sapiens
cggcagcuauuuccacaug

SEQ ID NO: 568504 - RNA, 19 nt, Homo sapiens
gaagcugugacuggaauaa

SEQ ID NO: 568505 - RNA, 19 nt, Homo sapiens
ggucggcgcugugcuucuu

SEQ ID NO: 568506 - RNA, 19 nt, Homo sapiens
gcucaaaauuuucauguca

SEQ ID NO: 568507 - RNA, 19 nt, Homo sapiens
ccaccugcgucaucguuug

SEQ ID NO: 568508 - RNA, 19 nt, Homo sapiens
gagaagcucauggucaaga

SEQ ID NO: 568509 - RNA, 19 nt, Homo sapiens
agccggaguuuauuuaaug

SEQ ID NO: 568510 - RNA, 19 nt, Homo sapiens
cagccggaguuuauuuaau

SEQ ID NO: 568511 - RNA, 19 nt, Homo sapiens
gccggaguuuauuuaauga

SEQ ID NO: 568512 - RNA, 19 nt, Homo sapiens
cggaguuuauuuaaugaug

SEQ ID NO: 568513 - RNA, 19 nt, Homo sapiens
ugacugggcuuugcuacgu

SEQ ID NO: 568514 - RNA, 19 nt, Homo sapiens
gcaagguggcgggugauga

SEQ ID NO: 568515 - RNA, 19 nt, Homo sapiens
cuacgaacgccucaacaug

SEQ ID NO: 568516 - RNA, 19 nt, Homo sapiens
gcucaagaccaucgucauc

SEQ ID NO: 568517 - RNA, 19 nt, Homo sapiens
cgucaucguuugcuauguc

SEQ ID NO: 568518 - RNA, 19 nt, Homo sapiens
acacaccucuagccacaca

SEQ ID NO: 568519 - RNA, 19 nt, Homo sapiens
ggaagcugugacuggaaua

SEQ ID NO: 568520 - RNA, 19 nt, Homo sapiens
uggaagcugugacuggaau

SEQ ID NO: 568521 - RNA, 19 nt, Homo sapiens
gucaaggucaggcaaguga

SEQ ID NO: 568522 - RNA, 19 nt, Homo sapiens
cugccgagcuagcggaguu

SEQ ID NO: 568523 - RNA, 19 nt, Homo sapiens
ccgagaaguuccaguacgu

SEQ ID NO: 568524 - RNA, 19 nt, Homo sapiens
ccagccggaguuuauuuaa

SEQ ID NO: 568525 - RNA, 19 nt, Homo sapiens
gcacgcuggucuuccuacu

SEQ ID NO: 568526 - RNA, 19 nt, Homo sapiens
gcgagaaccccgagaaguu

SEQ ID NO: 568527 - RNA, 19 nt, Homo sapiens
ccugugcuaccgcaagaua

SEQ ID NO: 568528 - RNA, 19 nt, Homo sapiens
acgaacgccucaacaugga

SEQ ID NO: 568529 - RNA, 19 nt, Homo sapiens
cguuugcuaugucuacgaa

SEQ ID NO: 568530 - RNA, 19 nt, Homo sapiens
accguggucuugcacauga

SEQ ID NO: 568531 - RNA, 19 nt, Homo sapiens
gaugagcugacugggcuuu

SEQ ID NO: 568532 - RNA, 19 nt, Homo sapiens
caagguggcgggugaugag

SEQ ID NO: 568533 - RNA, 19 nt, Homo sapiens
guccagccggaguuuauuu

SEQ ID NO: 568534 - RNA, 19 nt, Homo sapiens
ggguccagccggaguuuau

SEQ ID NO: 568535 - RNA, 19 nt, Homo sapiens
ggucuucuccauccucuac

SEQ ID NO: 568536 - RNA, 19 nt, Homo sapiens
agaagcucauggucaagau

SEQ ID NO: 568537 - RNA, 19 nt, Homo sapiens
gcaccaacacagagaagcu

SEQ ID NO: 568538 - RNA, 19 nt, Homo sapiens
gcaagaaggcucacaccua

SEQ ID NO: 568539 - RNA, 19 nt, Homo sapiens
ggacuggaccaaccucaaa

SEQ ID NO: 568540 - RNA, 19 nt, Homo sapiens
gugcgacgcucccauagug

SEQ ID NO: 568541 - RNA, 19 nt, Homo sapiens
gcaagcguuuccaccagaa

SEQ ID NO: 568542 - RNA, 19 nt, Homo sapiens
gcugugagcugugcaccaa

SEQ ID NO: 568543 - RNA, 19 nt, Homo sapiens
gugagaagccgcacaagug

SEQ ID NO: 568544 - RNA, 19 nt, Homo sapiens
guacggcaguccucuugug

SEQ ID NO: 568545 - RNA, 19 nt, Homo sapiens
ccagcacaaucucaaguga

SEQ ID NO: 568546 - RNA, 19 nt, Homo sapiens
caccagaaguccgacauga

SEQ ID NO: 568547 - RNA, 19 nt, Homo sapiens
gaagaagcacaccuacauc

SEQ ID NO: 568548 - RNA, 19 nt, Homo sapiens
ugaagaagcacaccuacau

SEQ ID NO: 568549 - RNA, 19 nt, Homo sapiens
caaccuauggccacagcua

SEQ ID NO: 568550 - RNA, 19 nt, Homo sapiens
ccagaaguccgacaugaag

SEQ ID NO: 568551 - RNA, 19 nt, Homo sapiens
caugugcgacgcucccaua

SEQ ID NO: 568552 - RNA, 19 nt, Homo sapiens
ggagcaggaccagaacuug

SEQ ID NO: 568553 - RNA, 19 nt, Homo sapiens
gcacaccuacauccacaca

SEQ ID NO: 568554 - RNA, 19 nt, Homo sapiens
gagaccaggcuccaagcaa

SEQ ID NO: 568555 - RNA, 19 nt, Homo sapiens
ggugagaagccgcacaagu

SEQ ID NO: 568556 - RNA, 19 nt, Homo sapiens
gcccuucgccugugacauc

SEQ ID NO: 568557 - RNA, 19 nt, Homo sapiens
uuagcacucuauucccaaa

SEQ ID NO: 568558 - RNA, 19 nt, Homo sapiens
ccacccaccugcucaucca

SEQ ID NO: 568559 - RNA, 19 nt, Homo sapiens
ccagagcuccaaccucauc

SEQ ID NO: 568560 - RNA, 19 nt, Homo sapiens
agaaguccgacaugaagaa

SEQ ID NO: 568561 - RNA, 19 nt, Homo sapiens
gauggggacucuccacugu

SEQ ID NO: 568562 - RNA, 19 nt, Homo sapiens
gcacucuauucccaaacca

SEQ ID NO: 568563 - RNA, 19 nt, Homo sapiens
gcgagagccagcacaaucu

SEQ ID NO: 568564 - RNA, 19 nt, Homo sapiens
acaugaagaagcacaccua

SEQ ID NO: 568565 - RNA, 19 nt, Homo sapiens
ucaagcccuucagcuguga

SEQ ID NO: 568566 - RNA, 19 nt, Homo sapiens
caccuuggccacaaccuau

SEQ ID NO: 568567 - RNA, 19 nt, Homo sapiens
guagaagccuggauuaguu

SEQ ID NO: 568568 - RNA, 19 nt, Homo sapiens
caagaagacucgcaucauc

SEQ ID NO: 568569 - RNA, 19 nt, Homo sapiens
gcaacucaaucccaaagga

SEQ ID NO: 568570 - RNA, 19 nt, Homo sapiens
gcaaguagaagccuggauu

SEQ ID NO: 568571 - RNA, 19 nt, Homo sapiens
caaguagaagccuggauua

SEQ ID NO: 568572 - RNA, 19 nt, Homo sapiens
caacaagcuucugggcaaa

SEQ ID NO: 568573 - RNA, 19 nt, Homo sapiens
caacauccaggccgugcua

SEQ ID NO: 568574 - RNA, 19 nt, Homo sapiens
caacucaaucccaaaggaa

SEQ ID NO: 568575 - RNA, 19 nt, Homo sapiens
uagaagccuggauuaguuu

SEQ ID NO: 568576 - RNA, 19 nt, Homo sapiens
gcagcaacucaaucccaaa

SEQ ID NO: 568577 - RNA, 19 nt, Homo sapiens
guaccugaccgccgagauc

SEQ ID NO: 568578 - RNA, 19 nt, Homo sapiens
acaaggcgaagggcaagua

SEQ ID NO: 568579 - RNA, 19 nt, Homo sapiens
aggcgaagggcaaguagaa

SEQ ID NO: 568580 - RNA, 19 nt, Homo sapiens
gugcuacugcccaagaaga

SEQ ID NO: 568581 - RNA, 19 nt, Homo sapiens
gagcaguucauuacucaua

SEQ ID NO: 568582 - RNA, 19 nt, Homo sapiens
ggugguguccugcccaaua

SEQ ID NO: 568583 - RNA, 19 nt, Homo sapiens
caagaagacccgcaucauc

SEQ ID NO: 568584 - RNA, 19 nt, Homo sapiens
gggcuggagcaguucauua

SEQ ID NO: 568585 - RNA, 19 nt, Homo sapiens
acucauaccucgguccaaa

SEQ ID NO: 568586 - RNA, 19 nt, Homo sapiens
gugguguccugcccaauau

SEQ ID NO: 568587 - RNA, 19 nt, Homo sapiens
guaccuaaccgccgagauc

SEQ ID NO: 568588 - RNA, 19 nt, Homo sapiens
aaacugagagccaccacaa

SEQ ID NO: 568589 - RNA, 19 nt, Homo sapiens
uggagcaguucauuacuca

SEQ ID NO: 568590 - RNA, 19 nt, Homo sapiens
auaccucgguccaaaccaa

SEQ ID NO: 568591 - RNA, 19 nt, Homo sapiens
gcaacgacgaggagcucaa

SEQ ID NO: 568592 - RNA, 19 nt, Homo sapiens
cgacgaggagcucaacaag

SEQ ID NO: 568593 - RNA, 19 nt, Homo sapiens
caagaagacucgcaucauc

SEQ ID NO: 568594 - RNA, 19 nt, Homo sapiens
ccacaagacuaaguaaaga

SEQ ID NO: 568595 - RNA, 19 nt, Homo sapiens
caacaagcuucugggcaaa

SEQ ID NO: 568596 - RNA, 19 nt, Homo sapiens
aaacugagagccaccacaa

SEQ ID NO: 568597 - RNA, 19 nt, Homo sapiens
guaaagaccgaguugaaaa

SEQ ID NO: 568598 - RNA, 19 nt, Homo sapiens
gagagccaccacaagacua

SEQ ID NO: 568599 - RNA, 19 nt, Homo sapiens
aaguaaagaccgaguugaa

SEQ ID NO: 568600 - RNA, 19 nt, Homo sapiens
cuaaguaaagaccgaguug

SEQ ID NO: 568601 - RNA, 19 nt, Homo sapiens
ccaccacaagacuaaguaa

SEQ ID NO: 568602 - RNA, 19 nt, Homo sapiens
guaccugaccgccgagauc

SEQ ID NO: 568603 - RNA, 19 nt, Homo sapiens
aguaaagaccgaguugaaa

SEQ ID NO: 568604 - RNA, 19 nt, Homo sapiens
uaaguaaagaccgaguuga

SEQ ID NO: 568605 - RNA, 19 nt, Homo sapiens
acugagagccaccacaaga

SEQ ID NO: 568606 - RNA, 19 nt, Homo sapiens
caccacaagacuaaguaaa

SEQ ID NO: 568607 - RNA, 19 nt, Homo sapiens
gccaccacaagacuaagua

SEQ ID NO: 568608 - RNA, 19 nt, Homo sapiens
agagccaccacaagacuaa

SEQ ID NO: 568609 - RNA, 19 nt, Homo sapiens
caaauaaugucuccauaga

SEQ ID NO: 568610 - RNA, 19 nt, Homo sapiens
uagaaucacuuuccaauac

SEQ ID NO: 568611 - RNA, 19 nt, Homo sapiens
aggcaaagcucgcgccaaa

SEQ ID NO: 568612 - RNA, 19 nt, Homo sapiens
gcaaauaaugucuccauag

SEQ ID NO: 568613 - RNA, 19 nt, Homo sapiens
ggcaaauaaugucuccaua

SEQ ID NO: 568614 - RNA, 19 nt, Homo sapiens
ccacaaggccaaaggcaaa

SEQ ID NO: 568615 - RNA, 19 nt, Homo sapiens
ccaagaagaccgagaguca

SEQ ID NO: 568616 - RNA, 19 nt, Homo sapiens
gaaucacuuuccaauacaa

SEQ ID NO: 568617 - RNA, 19 nt, Homo sapiens
caagaagacccgcauuauc

SEQ ID NO: 568618 - RNA, 19 nt, Homo sapiens
guaccugacugccgagauc

SEQ ID NO: 568619 - RNA, 19 nt, Homo sapiens
ggccaaaggcaaauaaugu

SEQ ID NO: 568620 - RNA, 19 nt, Homo sapiens
caacauccaggcugugcua

SEQ ID NO: 568621 - RNA, 19 nt, Homo sapiens
caaggccaaaggcaaauaa

SEQ ID NO: 568622 - RNA, 19 nt, Homo sapiens
aacaagaagacccgcauua

SEQ ID NO: 568623 - RNA, 19 nt, Homo sapiens
cauagaaucacuuuccaau

SEQ ID NO: 568624 - RNA, 19 nt, Homo sapiens
gcaaagcucgcgccaaagc

SEQ ID NO: 568625 - RNA, 19 nt, Homo sapiens
uaaugucuccauagaauca

SEQ ID NO: 568626 - RNA, 19 nt, Homo sapiens
gaccgagagucaccacaag

SEQ ID NO: 568627 - RNA, 19 nt, Homo sapiens
caacaagaagacccgcauu

SEQ ID NO: 568628 - RNA, 19 nt, Homo sapiens
agaaucacuuuccaauaca

SEQ ID NO: 568629 - RNA, 19 nt, Homo sapiens
acaagaagacccgcauuau

SEQ ID NO: 568630 - RNA, 19 nt, Homo sapiens
cauccaggcugugcuacug

SEQ ID NO: 568631 - RNA, 19 nt, Homo sapiens
uaucguuucuucgucaugu

SEQ ID NO: 568632 - RNA, 19 nt, Homo sapiens
caagcugcugggcaaagua

SEQ ID NO: 568633 - RNA, 19 nt, Homo sapiens
gcaacgacgaggagcucaa

SEQ ID NO: 568634 - RNA, 19 nt, Homo sapiens
aagaagacccgcauuaucc

SEQ ID NO: 568635 - RNA, 19 nt, Homo sapiens
gccaaaggcaaauaauguc

SEQ ID NO: 568636 - RNA, 19 nt, Homo sapiens
cgacgaggagcucaacaag

SEQ ID NO: 568637 - RNA, 19 nt, Homo sapiens
uacaacggcucuuuucaga

SEQ ID NO: 568638 - RNA, 19 nt, Homo sapiens
gugcuacugcccaagaaga

SEQ ID NO: 568639 - RNA, 19 nt, Homo sapiens
gcugugcuacugcccaaga

SEQ ID NO: 568640 - RNA, 19 nt, Homo sapiens
ccaaaggcaaauaaugucu

SEQ ID NO: 568641 - RNA, 19 nt, Homo sapiens
ggugguguccugcccaaca

SEQ ID NO: 568642 - RNA, 19 nt, Homo sapiens
aagcugcugggcaaaguaa

SEQ ID NO: 568643 - RNA, 19 nt, Homo sapiens
acaagcugcugggcaaagu

SEQ ID NO: 568644 - RNA, 19 nt, Homo sapiens
caacaagcugcugggcaaa

SEQ ID NO: 568645 - RNA, 19 nt, Homo sapiens
gcaagugauuugacaggua

SEQ ID NO: 568646 - RNA, 19 nt, Homo sapiens
caagaagacucgcaucauc

SEQ ID NO: 568647 - RNA, 19 nt, Homo sapiens
gagcuuaggccgcugguuu

SEQ ID NO: 568648 - RNA, 19 nt, Homo sapiens
caagugauuugacagguau

SEQ ID NO: 568649 - RNA, 19 nt, Homo sapiens
aggcaaagcucgcgccaaa

SEQ ID NO: 568650 - RNA, 19 nt, Homo sapiens
uaucugagcucccggaaac

SEQ ID NO: 568651 - RNA, 19 nt, Homo sapiens
cuaagaagaccgagaguca

SEQ ID NO: 568652 - RNA, 19 nt, Homo sapiens
acgaggagcucaacaaacu

SEQ ID NO: 568653 - RNA, 19 nt, Homo sapiens
cgacgaggagcucaacaaa

SEQ ID NO: 568654 - RNA, 19 nt, Homo sapiens
gcaaagcucgcgccaaagc

SEQ ID NO: 568655 - RNA, 19 nt, Homo sapiens
gccaagggcaagugauuug

SEQ ID NO: 568656 - RNA, 19 nt, Homo sapiens
gaccgagagucaccacaag

SEQ ID NO: 568657 - RNA, 19 nt, Homo sapiens
gcaaugucuggacguggua

SEQ ID NO: 568658 - RNA, 19 nt, Homo sapiens
ugauuugacagguaucuga

SEQ ID NO: 568659 - RNA, 19 nt, Homo sapiens
uaacauccaggccgugcuu

SEQ ID NO: 568660 - RNA, 19 nt, Homo sapiens
ggagcucaacaaacugcua

SEQ ID NO: 568661 - RNA, 19 nt, Homo sapiens
ggccaagggcaagugauuu

SEQ ID NO: 568662 - RNA, 19 nt, Homo sapiens
gcaacgacgaggagcucaa

SEQ ID NO: 568663 - RNA, 19 nt, Homo sapiens
ccaagggcaagugauuuga

SEQ ID NO: 568664 - RNA, 19 nt, Homo sapiens
caaggccaagggcaaguga

SEQ ID NO: 568665 - RNA, 19 nt, Homo sapiens
aagggcaagugauuugaca

SEQ ID NO: 568666 - RNA, 19 nt, Homo sapiens
aagggaaagugaagaguua

SEQ ID NO: 568667 - RNA, 19 nt, Homo sapiens
aaacugagagccaucauaa

SEQ ID NO: 568668 - RNA, 19 nt, Homo sapiens
gcaaugacgaggagcuuaa

SEQ ID NO: 568669 - RNA, 19 nt, Homo sapiens
acgaggagcuuaauaaacu

SEQ ID NO: 568670 - RNA, 19 nt, Homo sapiens
caagaagacccgcaucauc

SEQ ID NO: 568671 - RNA, 19 nt, Homo sapiens
ugacgaggagcuuaauaaa

SEQ ID NO: 568672 - RNA, 19 nt, Homo sapiens
caagggaaagugaagaguu

SEQ ID NO: 568673 - RNA, 19 nt, Homo sapiens
ggucuucucgugcagguuu

SEQ ID NO: 568674 - RNA, 19 nt, Homo sapiens
caaacaaggcgguaaagcu

SEQ ID NO: 568675 - RNA, 19 nt, Homo sapiens
aaaucagccuaacagcaaa

SEQ ID NO: 568676 - RNA, 19 nt, Homo sapiens
guaccugaccgccgagauc

SEQ ID NO: 568677 - RNA, 19 nt, Homo sapiens
cggcaaacaaggcgguaaa

SEQ ID NO: 568678 - RNA, 19 nt, Homo sapiens
gcagacaaaaucagccuaa

SEQ ID NO: 568679 - RNA, 19 nt, Homo sapiens
gcggugcugcugccuaaga

SEQ ID NO: 568680 - RNA, 19 nt, Homo sapiens
gacgaggagcuuaauaaac

SEQ ID NO: 568681 - RNA, 19 nt, Homo sapiens
aaaaucagccuaacagcaa

SEQ ID NO: 568682 - RNA, 19 nt, Homo sapiens
augacgaggagcuuaauaa

SEQ ID NO: 568683 - RNA, 19 nt, Homo sapiens
uaaggccaagggaaaguga

SEQ ID NO: 568684 - RNA, 19 nt, Homo sapiens
aguaagggcugaacuuuaa

SEQ ID NO: 568685 - RNA, 19 nt, Homo sapiens
guaccuaacugccgagauc

SEQ ID NO: 568686 - RNA, 19 nt, Homo sapiens
gggcuccaauuuccuguag

SEQ ID NO: 568687 - RNA, 19 nt, Homo sapiens
gagagccaccacaaagcua

SEQ ID NO: 568688 - RNA, 19 nt, Homo sapiens
caaagcuaagggcaaguaa

SEQ ID NO: 568689 - RNA, 19 nt, Homo sapiens
acaaagcuaagggcaagua

SEQ ID NO: 568690 - RNA, 19 nt, Homo sapiens
uaacauccaggccguacug

SEQ ID NO: 568691 - RNA, 19 nt, Homo sapiens
guaagggcugaacuuuaaa

SEQ ID NO: 568692 - RNA, 19 nt, Homo sapiens
agacugagagccaccacaa

SEQ ID NO: 568693 - RNA, 19 nt, Homo sapiens
gcaacgacgaggagcucaa

SEQ ID NO: 568694 - RNA, 19 nt, Homo sapiens
cgacgaggagcucaacaag

SEQ ID NO: 568695 - RNA, 19 nt, Homo sapiens
gugcuggaguaccuaacug

SEQ ID NO: 568696 - RNA, 19 nt, Homo sapiens
guacugcuccccaagaaga

SEQ ID NO: 568697 - RNA, 19 nt, Homo sapiens
gggcaccugugaacucaaa

SEQ ID NO: 568698 - RNA, 19 nt, Homo sapiens
guacugcucccuaagaaga

SEQ ID NO: 568699 - RNA, 19 nt, Homo sapiens
cuaagaagacggagaguca

SEQ ID NO: 568700 - RNA, 19 nt, Homo sapiens
gaguuucucucggugacua

SEQ ID NO: 568701 - RNA, 19 nt, Homo sapiens
uggcugcgguccucgagua

SEQ ID NO: 568702 - RNA, 19 nt, Homo sapiens
caagaagacgcgcaucauc

SEQ ID NO: 568703 - RNA, 19 nt, Homo sapiens
gaacaagcugcugggcaaa

SEQ ID NO: 568704 - RNA, 19 nt, Homo sapiens
caaggcaaagggcaaguga

SEQ ID NO: 568705 - RNA, 19 nt, Homo sapiens
gcaacgacgaggaacugaa

SEQ ID NO: 568706 - RNA, 19 nt, Homo sapiens
ccguacugcucccuaagaa

SEQ ID NO: 568707 - RNA, 19 nt, Homo sapiens
uacuaucgcugucaugucu

SEQ ID NO: 568708 - RNA, 19 nt, Homo sapiens
uaacauccaggccguacug

SEQ ID NO: 568709 - RNA, 19 nt, Homo sapiens
gacggagagucaccacaag

SEQ ID NO: 568710 - RNA, 19 nt, Homo sapiens
acgaggaacugaacaagcu

SEQ ID NO: 568711 - RNA, 19 nt, Homo sapiens
agacggagagucaccacaa

SEQ ID NO: 568712 - RNA, 19 nt, Homo sapiens
caacgacgaggaacugaac

SEQ ID NO: 568713 - RNA, 19 nt, Homo sapiens
gcucgggacaacaagaaga

SEQ ID NO: 568714 - RNA, 19 nt, Homo sapiens
acaagcugcugggcaaagu

SEQ ID NO: 568715 - RNA, 19 nt, Homo sapiens
gcaaauaaaugcagacaaa

SEQ ID NO: 568716 - RNA, 19 nt, Homo sapiens
cauccaggccguucuguua

SEQ ID NO: 568717 - RNA, 19 nt, Homo sapiens
gcagacaaacaaaccaaga

SEQ ID NO: 568718 - RNA, 19 nt, Homo sapiens
gccguucuguuaccaaaga

SEQ ID NO: 568719 - RNA, 19 nt, Homo sapiens
caaacaaaccaagaccaaa

SEQ ID NO: 568720 - RNA, 19 nt, Homo sapiens
ccacaaagccaaaagcaaa

SEQ ID NO: 568721 - RNA, 19 nt, Homo sapiens
aaacaaaccaagaccaaag

SEQ ID NO: 568722 - RNA, 19 nt, Homo sapiens
caagaagacgcgcaucauc

SEQ ID NO: 568723 - RNA, 19 nt, Homo sapiens
cgaaagccacaaagccaaa

SEQ ID NO: 568724 - RNA, 19 nt, Homo sapiens
gaacaagcugcugggcaaa

SEQ ID NO: 568725 - RNA, 19 nt, Homo sapiens
gcaacgacgaggaacugaa

SEQ ID NO: 568726 - RNA, 19 nt, Homo sapiens
acaaacaaaccaagaccaa

SEQ ID NO: 568727 - RNA, 19 nt, Homo sapiens
gaaaaccgaaagccacaaa

SEQ ID NO: 568728 - RNA, 19 nt, Homo sapiens
acgaggaacugaacaagcu

SEQ ID NO: 568729 - RNA, 19 nt, Homo sapiens
guaccugaccgccgagauc

SEQ ID NO: 568730 - RNA, 19 nt, Homo sapiens
caacgacgaggaacugaac

SEQ ID NO: 568731 - RNA, 19 nt, Homo sapiens
gcucgggacaacaagaaga

SEQ ID NO: 568732 - RNA, 19 nt, Homo sapiens
uaaaugcagacaaacaaac

SEQ ID NO: 568733 - RNA, 19 nt, Homo sapiens
uaacauccaggccguucug

SEQ ID NO: 568734 - RNA, 19 nt, Homo sapiens
acaagcugcugggcaaagu

SEQ ID NO: 568735 - RNA, 19 nt, Homo sapiens
gaagaaggauggcaagaag

SEQ ID NO: 568736 - RNA, 19 nt, Homo sapiens
gaagaaggguuccaagaag

SEQ ID NO: 568737 - RNA, 19 nt, Homo sapiens
ccaaguaaaugugugcuua

SEQ ID NO: 568738 - RNA, 19 nt, Homo sapiens
aacaagcgcucgaccauua

SEQ ID NO: 568739 - RNA, 19 nt, Homo sapiens
ccacucaagucucacauaa

SEQ ID NO: 568740 - RNA, 19 nt, Homo sapiens
ccaaggcugucaccaagua

SEQ ID NO: 568741 - RNA, 19 nt, Homo sapiens
uauacaagcuccaaguaaa

SEQ ID NO: 568742 - RNA, 19 nt, Homo sapiens
caucaugaauuccuucguu

SEQ ID NO: 568743 - RNA, 19 nt, Homo sapiens
cgaagaaggguuccaagaa

SEQ ID NO: 568744 - RNA, 19 nt, Homo sapiens
guauacaagcuccaaguaa

SEQ ID NO: 568745 - RNA, 19 nt, Homo sapiens
gugcuuaggugcuuuaaaa

SEQ ID NO: 568746 - RNA, 19 nt, Homo sapiens
gcuacuccguguaugugua

SEQ ID NO: 568747 - RNA, 19 nt, Homo sapiens
ccaagaaggcugugaccaa

SEQ ID NO: 568748 - RNA, 19 nt, Homo sapiens
cagagccacucaagucuca

SEQ ID NO: 568749 - RNA, 19 nt, Homo sapiens
ccaaggcgcagaagaagga

SEQ ID NO: 568750 - RNA, 19 nt, Homo sapiens
ugaccaaggcgcagaagaa

SEQ ID NO: 568751 - RNA, 19 nt, Homo sapiens
guaccaaggcugucaccaa

SEQ ID NO: 568752 - RNA, 19 nt, Homo sapiens
gaagguaccaaggcuguca

SEQ ID NO: 568753 - RNA, 19 nt, Homo sapiens
caacaagcgcucgaccauu

SEQ ID NO: 568754 - RNA, 19 nt, Homo sapiens
aucaugaauuccuucguua

SEQ ID NO: 568755 - RNA, 19 nt, Homo sapiens
agaagaaggauggcaagaa

SEQ ID NO: 568756 - RNA, 19 nt, Homo sapiens
ucaugaauuccuucguuaa

SEQ ID NO: 568757 - RNA, 19 nt, Homo sapiens
auacuggcaucucauccaa

SEQ ID NO: 568758 - RNA, 19 nt, Homo sapiens
gagcuacuccguguaugug

SEQ ID NO: 568759 - RNA, 19 nt, Homo sapiens
ccgaagaaggguuccaaga

SEQ ID NO: 568760 - RNA, 19 nt, Homo sapiens
caaguaaaugugugcuuag

SEQ ID NO: 568761 - RNA, 19 nt, Homo sapiens
gcagucguaaggagagcua

SEQ ID NO: 568762 - RNA, 19 nt, Homo sapiens
gagagcuacuccguguaug

SEQ ID NO: 568763 - RNA, 19 nt, Homo sapiens
gcacgcaguguccgaaggu

SEQ ID NO: 568764 - RNA, 19 nt, Homo sapiens
gccacucaagucucacaua

SEQ ID NO: 568765 - RNA, 19 nt, Homo sapiens
auacaagcuccaaguaaau

SEQ ID NO: 568766 - RNA, 19 nt, Homo sapiens
uuucagagccacucaaguc

SEQ ID NO: 568767 - RNA, 19 nt, Homo sapiens
gaccaaggcgcagaagaag

SEQ ID NO: 568768 - RNA, 19 nt, Homo sapiens
aguauacaagcuccaagua

SEQ ID NO: 568769 - RNA, 19 nt, Homo sapiens
gcugucaccaaguauacaa

SEQ ID NO: 568770 - RNA, 19 nt, Homo sapiens
gauacuggcaucucaucca

SEQ ID NO: 568771 - RNA, 19 nt, Homo sapiens
ccaaguauacaagcuccaa

SEQ ID NO: 568772 - RNA, 19 nt, Homo sapiens
gaagaaggauggcaagaag

SEQ ID NO: 568773 - RNA, 19 nt, Homo sapiens
ccaaggccgucaccaagua

SEQ ID NO: 568774 - RNA, 19 nt, Homo sapiens
gaagaagggcuccaagaag

SEQ ID NO: 568775 - RNA, 19 nt, Homo sapiens
ccaaguaaauucucaagcu

SEQ ID NO: 568776 - RNA, 19 nt, Homo sapiens
guacaccagcuccaaguaa

SEQ ID NO: 568777 - RNA, 19 nt, Homo sapiens
cgaagaagggcuccaagaa

SEQ ID NO: 568778 - RNA, 19 nt, Homo sapiens
ccacuauuguuucauuaug

SEQ ID NO: 568779 - RNA, 19 nt, Homo sapiens
aacaagcgcucgaccauca

SEQ ID NO: 568780 - RNA, 19 nt, Homo sapiens
acaccggcaucucuucuaa

SEQ ID NO: 568781 - RNA, 19 nt, Homo sapiens
gcaccaaggccgucaccaa

SEQ ID NO: 568782 - RNA, 19 nt, Homo sapiens
gcuacuccguguacgugua

SEQ ID NO: 568783 - RNA, 19 nt, Homo sapiens
ccaagaaggcggugaccaa

SEQ ID NO: 568784 - RNA, 19 nt, Homo sapiens
ugaccaaggcccagaagaa

SEQ ID NO: 568785 - RNA, 19 nt, Homo sapiens
uacaccagcuccaaguaaa

SEQ ID NO: 568786 - RNA, 19 nt, Homo sapiens
ccaaggcccagaagaagga

SEQ ID NO: 568787 - RNA, 19 nt, Homo sapiens
ugccacuauuguuucauua

SEQ ID NO: 568788 - RNA, 19 nt, Homo sapiens
agaagaaggauggcaagaa

SEQ ID NO: 568789 - RNA, 19 nt, Homo sapiens
gaccaaggcccagaagaag

SEQ ID NO: 568790 - RNA, 19 nt, Homo sapiens
aguaaauucucaagcucuu

SEQ ID NO: 568791 - RNA, 19 nt, Homo sapiens
caccagcuccaaguaaauu

SEQ ID NO: 568792 - RNA, 19 nt, Homo sapiens
uugccacuauuguuucauu

SEQ ID NO: 568793 - RNA, 19 nt, Homo sapiens
ccgaagaagggcuccaaga

SEQ ID NO: 568794 - RNA, 19 nt, Homo sapiens
ccaaguacaccagcuccaa

SEQ ID NO: 568795 - RNA, 19 nt, Homo sapiens
gacaccggcaucucuucua

SEQ ID NO: 568796 - RNA, 19 nt, Homo sapiens
gcucuuguccaacccaaag

SEQ ID NO: 568797 - RNA, 19 nt, Homo sapiens
caugaacuccuucgucaac

SEQ ID NO: 568798 - RNA, 19 nt, Homo sapiens
gaagaaaggcuccaagaag

SEQ ID NO: 568799 - RNA, 19 nt, Homo sapiens
ccaaggccgucaccaagua

SEQ ID NO: 568800 - RNA, 19 nt, Homo sapiens
guacaccaguuccaaguga

SEQ ID NO: 568801 - RNA, 19 nt, Homo sapiens
ugacaaaggcccagaagaa

SEQ ID NO: 568802 - RNA, 19 nt, Homo sapiens
gaagaaggacggcaagaag

SEQ ID NO: 568803 - RNA, 19 nt, Homo sapiens
ccaagaaggcagugacaaa

SEQ ID NO: 568804 - RNA, 19 nt, Homo sapiens
aacaagcgcucgaccauca

SEQ ID NO: 568805 - RNA, 19 nt, Homo sapiens
ugaacuccuucgucaauga

SEQ ID NO: 568806 - RNA, 19 nt, Homo sapiens
gcaccaaggccgucaccaa

SEQ ID NO: 568807 - RNA, 19 nt, Homo sapiens
cgaagaaaggcuccaagaa

SEQ ID NO: 568808 - RNA, 19 nt, Homo sapiens
caaaggcccagaagaagga

SEQ ID NO: 568809 - RNA, 19 nt, Homo sapiens
gcuacuccguguacgugua

SEQ ID NO: 568810 - RNA, 19 nt, Homo sapiens
caugaacuccuucgucaau

SEQ ID NO: 568811 - RNA, 19 nt, Homo sapiens
gacaaaggcccagaagaag

SEQ ID NO: 568812 - RNA, 19 nt, Homo sapiens
caagaaggcagugacaaag

SEQ ID NO: 568813 - RNA, 19 nt, Homo sapiens
ccaaguacaccaguuccaa

SEQ ID NO: 568814 - RNA, 19 nt, Homo sapiens
ccgaagaaaggcuccaaga

SEQ ID NO: 568815 - RNA, 19 nt, Homo sapiens
agaagaaggacggcaagaa

SEQ ID NO: 568816 - RNA, 19 nt, Homo sapiens
acaccgguaucucguccaa

SEQ ID NO: 568817 - RNA, 19 nt, Homo sapiens
ucaccaaguacaccaguuc

SEQ ID NO: 568818 - RNA, 19 nt, Homo sapiens
gaagaaggauggaaagaag

SEQ ID NO: 568819 - RNA, 19 nt, Homo sapiens
ccaaggccgucaccaagua

SEQ ID NO: 568820 - RNA, 19 nt, Homo sapiens
uaacaaggcucagaagaag

SEQ ID NO: 568821 - RNA, 19 nt, Homo sapiens
ccaagaaggccauuaacaa

SEQ ID NO: 568822 - RNA, 19 nt, Homo sapiens
gagcuacucuguguaugug

SEQ ID NO: 568823 - RNA, 19 nt, Homo sapiens
gcuacucuguguaugugua

SEQ ID NO: 568824 - RNA, 19 nt, Homo sapiens
caagaaggccauuaacaag

SEQ ID NO: 568825 - RNA, 19 nt, Homo sapiens
aacaagcgcucgaccauca

SEQ ID NO: 568826 - RNA, 19 nt, Homo sapiens
gcuccaagaaggccauuaa

SEQ ID NO: 568827 - RNA, 19 nt, Homo sapiens
gcaccaaggccgucaccaa

SEQ ID NO: 568828 - RNA, 19 nt, Homo sapiens
uuaacaaggcucagaagaa

SEQ ID NO: 568829 - RNA, 19 nt, Homo sapiens
agaagaaggauggaaagaa

SEQ ID NO: 568830 - RNA, 19 nt, Homo sapiens
gagccucucgcugcaguaa

SEQ ID NO: 568831 - RNA, 19 nt, Homo sapiens
guauaccagcuccaaguga

SEQ ID NO: 568832 - RNA, 19 nt, Homo sapiens
gccucucgcugcaguaaca

SEQ ID NO: 568833 - RNA, 19 nt, Homo sapiens
ccaaguauaccagcuccaa

SEQ ID NO: 568834 - RNA, 19 nt, Homo sapiens
cgacaucuuugagcguauc

SEQ ID NO: 568835 - RNA, 19 nt, Homo sapiens
acaaggcucagaagaagga

SEQ ID NO: 568836 - RNA, 19 nt, Homo sapiens
ccauuaacaaggcucagaa

SEQ ID NO: 568837 - RNA, 19 nt, Homo sapiens
ccaaggcuaugggaaucau

SEQ ID NO: 568838 - RNA, 19 nt, Homo sapiens
acaccggcaucucuuccaa

SEQ ID NO: 568839 - RNA, 19 nt, Homo sapiens
aaucugcuccagucccuaa

SEQ ID NO: 568840 - RNA, 19 nt, Homo sapiens
cagaagaaggauggaaaga

SEQ ID NO: 568841 - RNA, 19 nt, Homo sapiens
gagcguaucgccggagaag

SEQ ID NO: 568842 - RNA, 19 nt, Homo sapiens
caugaacuccuucgucaac

SEQ ID NO: 568843 - RNA, 19 nt, Homo sapiens
gcucagaagaaggauggaa

SEQ ID NO: 568844 - RNA, 19 nt, Homo sapiens
gcaaacgcagccgcaagga

SEQ ID NO: 568845 - RNA, 19 nt, Homo sapiens
gaagaaggaugguaagaag

SEQ ID NO: 568846 - RNA, 19 nt, Homo sapiens
ccaaggccgucaccaagua

SEQ ID NO: 568847 - RNA, 19 nt, Homo sapiens
ggagagcuauuccguguac

SEQ ID NO: 568848 - RNA, 19 nt, Homo sapiens
gcuauuccguguacgugua

SEQ ID NO: 568849 - RNA, 19 nt, Homo sapiens
guacaccagcucuaaguaa

SEQ ID NO: 568850 - RNA, 19 nt, Homo sapiens
ccaaguacaccagcucuaa

SEQ ID NO: 568851 - RNA, 19 nt, Homo sapiens
aacaagcgcuccaccauca

SEQ ID NO: 568852 - RNA, 19 nt, Homo sapiens
gcaccaaggccgucaccaa

SEQ ID NO: 568853 - RNA, 19 nt, Homo sapiens
ugaccaaggcgcagaagaa

SEQ ID NO: 568854 - RNA, 19 nt, Homo sapiens
ccaaggcgcagaagaagga

SEQ ID NO: 568855 - RNA, 19 nt, Homo sapiens
caccagcucuaaguaauuc

SEQ ID NO: 568856 - RNA, 19 nt, Homo sapiens
uacaccagcucuaaguaau

SEQ ID NO: 568857 - RNA, 19 nt, Homo sapiens
agaagaaggaugguaagaa

SEQ ID NO: 568858 - RNA, 19 nt, Homo sapiens
cuucauacccaaucccaaa

SEQ ID NO: 568859 - RNA, 19 nt, Homo sapiens
gcagaagaaggaugguaag

SEQ ID NO: 568860 - RNA, 19 nt, Homo sapiens
gcgcagaagaaggauggua

SEQ ID NO: 568861 - RNA, 19 nt, Homo sapiens
cgcagaagaaggaugguaa

SEQ ID NO: 568862 - RNA, 19 nt, Homo sapiens
acaccggcaucucauccaa

SEQ ID NO: 568863 - RNA, 19 nt, Homo sapiens
cagaagaaggaugguaaga

SEQ ID NO: 568864 - RNA, 19 nt, Homo sapiens
guaauucuaacgucuucau

SEQ ID NO: 568865 - RNA, 19 nt, Homo sapiens
acaccagcucuaaguaauu

SEQ ID NO: 568866 - RNA, 19 nt, Homo sapiens
gaccaaggcgcagaagaag

SEQ ID NO: 568867 - RNA, 19 nt, Homo sapiens
aaguaauucuaacgucuuc

SEQ ID NO: 568868 - RNA, 19 nt, Homo sapiens
caaguacaccagcucuaag

SEQ ID NO: 568869 - RNA, 19 nt, Homo sapiens
caugaacuccuucgucaac

SEQ ID NO: 568870 - RNA, 19 nt, Homo sapiens
cagcucuaaguaauucuaa

SEQ ID NO: 568871 - RNA, 19 nt, Homo sapiens
ccaaggccguuaccaagua

SEQ ID NO: 568872 - RNA, 19 nt, Homo sapiens
gaucaugaauuccuuuguc

SEQ ID NO: 568873 - RNA, 19 nt, Homo sapiens
gaagaaggacggcaagaag

SEQ ID NO: 568874 - RNA, 19 nt, Homo sapiens
gaagaagggcuccaagaag

SEQ ID NO: 568875 - RNA, 19 nt, Homo sapiens
guacaccagcuccaaguaa

SEQ ID NO: 568876 - RNA, 19 nt, Homo sapiens
cgaagaagggcuccaagaa

SEQ ID NO: 568877 - RNA, 19 nt, Homo sapiens
gcaccaaggccguuaccaa

SEQ ID NO: 568878 - RNA, 19 nt, Homo sapiens
aacaagcgcucgaccauca

SEQ ID NO: 568879 - RNA, 19 nt, Homo sapiens
ccaagaaggccgugaccaa

SEQ ID NO: 568880 - RNA, 19 nt, Homo sapiens
acaccggcaucuccucuaa

SEQ ID NO: 568881 - RNA, 19 nt, Homo sapiens
ugaccaaggcgcagaagaa

SEQ ID NO: 568882 - RNA, 19 nt, Homo sapiens
ccaaggcgcagaagaagga

SEQ ID NO: 568883 - RNA, 19 nt, Homo sapiens
uacaccagcuccaaguaaa

SEQ ID NO: 568884 - RNA, 19 nt, Homo sapiens
uguacaaggugcugaaaca

SEQ ID NO: 568885 - RNA, 19 nt, Homo sapiens
ugaauuccuuugucaacga

SEQ ID NO: 568886 - RNA, 19 nt, Homo sapiens
gcuacuccguauacgugua

SEQ ID NO: 568887 - RNA, 19 nt, Homo sapiens
cccugcaacugccuuagua

SEQ ID NO: 568888 - RNA, 19 nt, Homo sapiens
gcaacugccuuaguaaacc

SEQ ID NO: 568889 - RNA, 19 nt, Homo sapiens
ccaagcacgcugugucaga

SEQ ID NO: 568890 - RNA, 19 nt, Homo sapiens
ccguauacguguacaaggu

SEQ ID NO: 568891 - RNA, 19 nt, Homo sapiens
agaagaaggacggcaagaa

SEQ ID NO: 568892 - RNA, 19 nt, Homo sapiens
ccaaguacaccagcuccaa

SEQ ID NO: 568893 - RNA, 19 nt, Homo sapiens
ccgaagaagggcuccaaga

SEQ ID NO: 568894 - RNA, 19 nt, Homo sapiens
caaggccguuaccaaguac

SEQ ID NO: 568895 - RNA, 19 nt, Homo sapiens
aaacuugucccugcaacug

SEQ ID NO: 568896 - RNA, 19 nt, Homo sapiens
ggccaagcacgcuguguca

SEQ ID NO: 568897 - RNA, 19 nt, Homo sapiens
gaccaaggcgcagaagaag

SEQ ID NO: 568898 - RNA, 19 nt, Homo sapiens
gagggcaccaaggccguua

SEQ ID NO: 568899 - RNA, 19 nt, Homo sapiens
gaagaaggauggcaagaag

SEQ ID NO: 568900 - RNA, 19 nt, Homo sapiens
guacaccagcuccaaauaa

SEQ ID NO: 568901 - RNA, 19 nt, Homo sapiens
gaucaugaauuccuuuguc

SEQ ID NO: 568902 - RNA, 19 nt, Homo sapiens
cuaaggccgucaccaagua

SEQ ID NO: 568903 - RNA, 19 nt, Homo sapiens
gcacuaaggccgucaccaa

SEQ ID NO: 568904 - RNA, 19 nt, Homo sapiens
gaagaagggcuccaagaag

SEQ ID NO: 568905 - RNA, 19 nt, Homo sapiens
gcuacuccguauacguuua

SEQ ID NO: 568906 - RNA, 19 nt, Homo sapiens
gagcuacuccguauacguu

SEQ ID NO: 568907 - RNA, 19 nt, Homo sapiens
cgaagaagggcuccaagaa

SEQ ID NO: 568908 - RNA, 19 nt, Homo sapiens
uacaccagcuccaaauaaa

SEQ ID NO: 568909 - RNA, 19 nt, Homo sapiens
ccaagaaggcggugaccaa

SEQ ID NO: 568910 - RNA, 19 nt, Homo sapiens
ccaaggcgcagaagaagga

SEQ ID NO: 568911 - RNA, 19 nt, Homo sapiens
ugaccaaggcgcagaagaa

SEQ ID NO: 568912 - RNA, 19 nt, Homo sapiens
caaauaaauggacgcaugu

SEQ ID NO: 568913 - RNA, 19 nt, Homo sapiens
uaaauggacgcauguucaa

SEQ ID NO: 568914 - RNA, 19 nt, Homo sapiens
ugaauuccuuugucaacga

SEQ ID NO: 568915 - RNA, 19 nt, Homo sapiens
caaguacaccagcuccaaa

SEQ ID NO: 568916 - RNA, 19 nt, Homo sapiens
gaauuccuuugucaacgau

SEQ ID NO: 568917 - RNA, 19 nt, Homo sapiens
cuucccgccuggcucauua

SEQ ID NO: 568918 - RNA, 19 nt, Homo sapiens
caccagcuccaaauaaaug

SEQ ID NO: 568919 - RNA, 19 nt, Homo sapiens
ccguauacguuuacaaggu

SEQ ID NO: 568920 - RNA, 19 nt, Homo sapiens
agaagaaggauggcaagaa

SEQ ID NO: 568921 - RNA, 19 nt, Homo sapiens
aacaagcguucgaccauca

SEQ ID NO: 568922 - RNA, 19 nt, Homo sapiens
auaaauggacgcauguuca

SEQ ID NO: 568923 - RNA, 19 nt, Homo sapiens
ccgccuggcucauuacaac

SEQ ID NO: 568924 - RNA, 19 nt, Homo sapiens
ccgaagaagggcuccaaga

SEQ ID NO: 568925 - RNA, 19 nt, Homo sapiens
ccaaguacaccagcuccaa

SEQ ID NO: 568926 - RNA, 19 nt, Homo sapiens
gaccaaggcgcagaagaag

SEQ ID NO: 568927 - RNA, 19 nt, Homo sapiens
acaccggcaucuccuccaa

SEQ ID NO: 568928 - RNA, 19 nt, Homo sapiens
gaagaaggauggcaagaag

SEQ ID NO: 568929 - RNA, 19 nt, Homo sapiens
ccaaggcggucaccaagua

SEQ ID NO: 568930 - RNA, 19 nt, Homo sapiens
ggagagcuauuccguguac

SEQ ID NO: 568931 - RNA, 19 nt, Homo sapiens
gcuauuccguguacgugua

SEQ ID NO: 568932 - RNA, 19 nt, Homo sapiens
gaagaagggcuccaagaag

SEQ ID NO: 568933 - RNA, 19 nt, Homo sapiens
guacaccagcuccaaguaa

SEQ ID NO: 568934 - RNA, 19 nt, Homo sapiens
cgaagaagggcuccaagaa

SEQ ID NO: 568935 - RNA, 19 nt, Homo sapiens
aacaagcgcucgaccauca

SEQ ID NO: 568936 - RNA, 19 nt, Homo sapiens
gcaccaaggcggucaccaa

SEQ ID NO: 568937 - RNA, 19 nt, Homo sapiens
gcuccaaguaaacuaguua

SEQ ID NO: 568938 - RNA, 19 nt, Homo sapiens
ccaagaaggcggugaccaa

SEQ ID NO: 568939 - RNA, 19 nt, Homo sapiens
uacaccagcuccaaguaaa

SEQ ID NO: 568940 - RNA, 19 nt, Homo sapiens
gacccaaaggcucuucuaa

SEQ ID NO: 568941 - RNA, 19 nt, Homo sapiens
ccaaggcacagaagaagga

SEQ ID NO: 568942 - RNA, 19 nt, Homo sapiens
ugaccaaggcacagaagaa

SEQ ID NO: 568943 - RNA, 19 nt, Homo sapiens
agaagaaggauggcaagaa

SEQ ID NO: 568944 - RNA, 19 nt, Homo sapiens
gaccaaggcacagaagaag

SEQ ID NO: 568945 - RNA, 19 nt, Homo sapiens
ccaaguacaccagcuccaa

SEQ ID NO: 568946 - RNA, 19 nt, Homo sapiens
ccgaagaagggcuccaaga

SEQ ID NO: 568947 - RNA, 19 nt, Homo sapiens
acaccggcaucucguccaa

SEQ ID NO: 568948 - RNA, 19 nt, Homo sapiens
gaagaaagauggcaagaag

SEQ ID NO: 568949 - RNA, 19 nt, Homo sapiens
caaguaaacauuccaagua

SEQ ID NO: 568950 - RNA, 19 nt, Homo sapiens
ccaaggccgucaccaagua

SEQ ID NO: 568951 - RNA, 19 nt, Homo sapiens
caucaugaauucuuucguu

SEQ ID NO: 568952 - RNA, 19 nt, Homo sapiens
ccaaagcgcagaagaaaga

SEQ ID NO: 568953 - RNA, 19 nt, Homo sapiens
gaagaagggcuccaagaag

SEQ ID NO: 568954 - RNA, 19 nt, Homo sapiens
gaccaaagcgcagaagaaa

SEQ ID NO: 568955 - RNA, 19 nt, Homo sapiens
guacaccagcuccaaguaa

SEQ ID NO: 568956 - RNA, 19 nt, Homo sapiens
cgaagaagggcuccaagaa

SEQ ID NO: 568957 - RNA, 19 nt, Homo sapiens
aacaagcgcucgaccauca

SEQ ID NO: 568958 - RNA, 19 nt, Homo sapiens
gcaccaaggccgucaccaa

SEQ ID NO: 568959 - RNA, 19 nt, Homo sapiens
caagaaggcagugaccaaa

SEQ ID NO: 568960 - RNA, 19 nt, Homo sapiens
uacaccagcuccaaguaaa

SEQ ID NO: 568961 - RNA, 19 nt, Homo sapiens
uguacaaggugcugaaaca

SEQ ID NO: 568962 - RNA, 19 nt, Homo sapiens
guuacucuguguacgugua

SEQ ID NO: 568963 - RNA, 19 nt, Homo sapiens
acacuggcaucucuuccaa

SEQ ID NO: 568964 - RNA, 19 nt, Homo sapiens
ugaccaaagcgcagaagaa

SEQ ID NO: 568965 - RNA, 19 nt, Homo sapiens
ccaagaaggcagugaccaa

SEQ ID NO: 568966 - RNA, 19 nt, Homo sapiens
caugaauucuuucguuaac

SEQ ID NO: 568967 - RNA, 19 nt, Homo sapiens
ccaaguaaacauuccaagu

SEQ ID NO: 568968 - RNA, 19 nt, Homo sapiens
gcagccgcaaggagaguua

SEQ ID NO: 568969 - RNA, 19 nt, Homo sapiens
guaaacauuccaaguaagc

SEQ ID NO: 568970 - RNA, 19 nt, Homo sapiens
ccaaguacaccagcuccaa

SEQ ID NO: 568971 - RNA, 19 nt, Homo sapiens
ccgaagaagggcuccaaga

SEQ ID NO: 568972 - RNA, 19 nt, Homo sapiens
agaagaaagauggcaagaa

SEQ ID NO: 568973 - RNA, 19 nt, Homo sapiens
agaaggcagugaccaaagc

SEQ ID NO: 568974 - RNA, 19 nt, Homo sapiens
ugggcaucaugaauucuuu

SEQ ID NO: 568975 - RNA, 19 nt, Homo sapiens
caaaggccgucaccaagua

SEQ ID NO: 568976 - RNA, 19 nt, Homo sapiens
gcacaaaggccgucaccaa

SEQ ID NO: 568977 - RNA, 19 nt, Homo sapiens
aacaagcgcucgaccauca

SEQ ID NO: 568978 - RNA, 19 nt, Homo sapiens
ugaacuccuucgucaauga

SEQ ID NO: 568979 - RNA, 19 nt, Homo sapiens
guacaccagcuccaaguga

SEQ ID NO: 568980 - RNA, 19 nt, Homo sapiens
guuacucuaucuacgugua

SEQ ID NO: 568981 - RNA, 19 nt, Homo sapiens
ccaagaaagccguaaccaa

SEQ ID NO: 568982 - RNA, 19 nt, Homo sapiens
caugaacuccuucgucaau

SEQ ID NO: 568983 - RNA, 19 nt, Homo sapiens
acaccggcaucucaucgaa

SEQ ID NO: 568984 - RNA, 19 nt, Homo sapiens
aagcgcagccgcaaagaga

SEQ ID NO: 568985 - RNA, 19 nt, Homo sapiens
uuauuugagugcucuuuca

SEQ ID NO: 568986 - RNA, 19 nt, Homo sapiens
gcagccgcaaagagaguua

SEQ ID NO: 568987 - RNA, 19 nt, Homo sapiens
ccaaguacaccagcuccaa

SEQ ID NO: 568988 - RNA, 19 nt, Homo sapiens
acaaaggccgucaccaagu

SEQ ID NO: 568989 - RNA, 19 nt, Homo sapiens
cuaucuacguguacaaggu

SEQ ID NO: 568990 - RNA, 19 nt, Homo sapiens
gaaauugguucgucuguuu

SEQ ID NO: 568991 - RNA, 19 nt, Homo sapiens
gagaggagcuuuuaauuua

SEQ ID NO: 568992 - RNA, 19 nt, Homo sapiens
gaauagaucuuaacugucu

SEQ ID NO: 568993 - RNA, 19 nt, Homo sapiens
gaaaagagcuuguucacuu

SEQ ID NO: 568994 - RNA, 19 nt, Homo sapiens
ggaagacacugaugguuug

SEQ ID NO: 568995 - RNA, 19 nt, Homo sapiens
gagcgugucuuuacucauu

SEQ ID NO: 568996 - RNA, 19 nt, Homo sapiens
gaagggugcuguucauuuc

SEQ ID NO: 568997 - RNA, 19 nt, Homo sapiens
ggaauucgcgccucucaua

SEQ ID NO: 568998 - RNA, 19 nt, Homo sapiens
ccaaggcggucaccaagua

SEQ ID NO: 568999 - RNA, 19 nt, Homo sapiens
caagaaagccgucaccaaa

SEQ ID NO: 569000 - RNA, 19 nt, Homo sapiens
gcgaggcacuuaccaugua

SEQ ID NO: 569001 - RNA, 19 nt, Homo sapiens
gaguucggcugucauuuaa

SEQ ID NO: 569002 - RNA, 19 nt, Homo sapiens
gaagaaagacggcaagaag

SEQ ID NO: 569003 - RNA, 19 nt, Homo sapiens
aggagucgguucucaauua

SEQ ID NO: 569004 - RNA, 19 nt, Homo sapiens
aaugguagauccacccuua

SEQ ID NO: 569005 - RNA, 19 nt, Homo sapiens
gcaggacaauugcauuuua

SEQ ID NO: 569006 - RNA, 19 nt, Homo sapiens
auacuugccugucucauuu

SEQ ID NO: 569007 - RNA, 19 nt, Homo sapiens
aaagagagcuacuccaucu

SEQ ID NO: 569008 - RNA, 19 nt, Homo sapiens
cugaauagaucuuaacugu

SEQ ID NO: 569009 - RNA, 19 nt, Homo sapiens
caauuaggcuguugggaau

SEQ ID NO: 569010 - RNA, 19 nt, Homo sapiens
gaaucuagagcgugucuuu

SEQ ID NO: 569011 - RNA, 19 nt, Homo sapiens
gcacuuaccauguagauac

SEQ ID NO: 569012 - RNA, 19 nt, Homo sapiens
ugaguucggcugucauuua

SEQ ID NO: 569013 - RNA, 19 nt, Homo sapiens
caaaugaggccaagagaag

SEQ ID NO: 569014 - RNA, 19 nt, Homo sapiens
gcaaagagagcuacuccau

SEQ ID NO: 569015 - RNA, 19 nt, Homo sapiens
ccaaagcccagaagaaaga

SEQ ID NO: 569016 - RNA, 19 nt, Homo sapiens
ucacuuauucccuuaguuu

SEQ ID NO: 569017 - RNA, 19 nt, Homo sapiens
gcagaauauuuacucuuuc

SEQ ID NO: 569018 - RNA, 19 nt, Homo sapiens
cuacagaguuaaucuccuu

SEQ ID NO: 569019 - RNA, 19 nt, Homo sapiens
guucggcugucauuuaaga

SEQ ID NO: 569020 - RNA, 19 nt, Homo sapiens
ggaaauggcauacguagcu

SEQ ID NO: 569021 - RNA, 19 nt, Homo sapiens
gaaauggcauacguagcuu

SEQ ID NO: 569022 - RNA, 19 nt, Homo sapiens
caaaauguauccuuaguca

SEQ ID NO: 569023 - RNA, 19 nt, Homo sapiens
ucuagcagcugucugaaau

SEQ ID NO: 569024 - RNA, 19 nt, Homo sapiens
uagcagcugucugaaauug

SEQ ID NO: 569025 - RNA, 19 nt, Homo sapiens
ggagucgguucucaauuag

SEQ ID NO: 569026 - RNA, 19 nt, Homo sapiens
caccaaagcccagaagaaa

SEQ ID NO: 569027 - RNA, 19 nt, Homo sapiens
ggcacauuauggacacuua

SEQ ID NO: 569028 - RNA, 19 nt, Homo sapiens
aagagaagccucauugguu

SEQ ID NO: 569029 - RNA, 19 nt, Homo sapiens
aggcgggacuacagaguua

SEQ ID NO: 569030 - RNA, 19 nt, Homo sapiens
ggagaggagcuuuuaauuu

SEQ ID NO: 569031 - RNA, 19 nt, Homo sapiens
gcagcugucugaaauuggu

SEQ ID NO: 569032 - RNA, 19 nt, Homo sapiens
gcuacuccaucuacgugua

SEQ ID NO: 569033 - RNA, 19 nt, Homo sapiens
ggucugugcuuuaaauggu

SEQ ID NO: 569034 - RNA, 19 nt, Homo sapiens
aacaagcgcuccaccauca

SEQ ID NO: 569035 - RNA, 19 nt, Homo sapiens
gccaagagaagccucauug

SEQ ID NO: 569036 - RNA, 19 nt, Homo sapiens
aaauggaaauguucuugga

SEQ ID NO: 569037 - RNA, 19 nt, Homo sapiens
gauuucaguuuccgucguu

SEQ ID NO: 569038 - RNA, 19 nt, Homo sapiens
gauaccagccguucugugu

SEQ ID NO: 569039 - RNA, 19 nt, Homo sapiens
gcaccaaggcggucaccaa

SEQ ID NO: 569040 - RNA, 19 nt, Homo sapiens
cauuaucacagacugaaua

SEQ ID NO: 569041 - RNA, 19 nt, Homo sapiens
acacuuaccaccucauuug

SEQ ID NO: 569042 - RNA, 19 nt, Homo sapiens
gcuucucaguuuagcauaa

SEQ ID NO: 569043 - RNA, 19 nt, Homo sapiens
cuuaaucgcuuccguggau

SEQ ID NO: 569044 - RNA, 19 nt, Homo sapiens
aaaagagcuuguucacuua

SEQ ID NO: 569045 - RNA, 19 nt, Homo sapiens
ggaaauguucuuggagcua

SEQ ID NO: 569046 - RNA, 19 nt, Homo sapiens
gcacauuauggacacuuaa

SEQ ID NO: 569047 - RNA, 19 nt, Homo sapiens
gugugaaggucaugggaaa

SEQ ID NO: 569048 - RNA, 19 nt, Homo sapiens
guacaccagcuccaaguga

SEQ ID NO: 569049 - RNA, 19 nt, Homo sapiens
gauccacccuuaugcuucu

SEQ ID NO: 569050 - RNA, 19 nt, Homo sapiens
uccauuagauguaugugaa

SEQ ID NO: 569051 - RNA, 19 nt, Homo sapiens
gugcuguucauuuccauua

SEQ ID NO: 569052 - RNA, 19 nt, Homo sapiens
gcguuuguacugugucuua

SEQ ID NO: 569053 - RNA, 19 nt, Homo sapiens
ggucaugggaaauggcaua

SEQ ID NO: 569054 - RNA, 19 nt, Homo sapiens
uuaacugucuccuacaugu

SEQ ID NO: 569055 - RNA, 19 nt, Homo sapiens
cagacugaauagaucuuaa

SEQ ID NO: 569056 - RNA, 19 nt, Homo sapiens
uaucacagacugaauagau

SEQ ID NO: 569057 - RNA, 19 nt, Homo sapiens
ccucauugguucacaguca

SEQ ID NO: 569058 - RNA, 19 nt, Homo sapiens
ccuuaugcuucucaguuua

SEQ ID NO: 569059 - RNA, 19 nt, Homo sapiens
gcuguucauuuccauuaga

SEQ ID NO: 569060 - RNA, 19 nt, Homo sapiens
agacacugaugguuugaug

SEQ ID NO: 569061 - RNA, 19 nt, Homo sapiens
ccacccaccuaaucacuag

SEQ ID NO: 569062 - RNA, 19 nt, Homo sapiens
uggaggugcagaauauuua

SEQ ID NO: 569063 - RNA, 19 nt, Homo sapiens
gcucaaaagucaccucuca

SEQ ID NO: 569064 - RNA, 19 nt, Homo sapiens
gauacgggcucaaaaguca

SEQ ID NO: 569065 - RNA, 19 nt, Homo sapiens
uaccagccguucuguguau

SEQ ID NO: 569066 - RNA, 19 nt, Homo sapiens
cuacauguguguuuucaaa

SEQ ID NO: 569067 - RNA, 19 nt, Homo sapiens
ugaaauugguucgucuguu

SEQ ID NO: 569068 - RNA, 19 nt, Homo sapiens
ccaagaaagccgucaccaa

SEQ ID NO: 569069 - RNA, 19 nt, Homo sapiens
caagagaagccucauuggu

SEQ ID NO: 569070 - RNA, 19 nt, Homo sapiens
ucuucagccuggcacauua

SEQ ID NO: 569071 - RNA, 19 nt, Homo sapiens
gaacuccaggacacaauuc

SEQ ID NO: 569072 - RNA, 19 nt, Homo sapiens
gaauccaaaugagcucuag

SEQ ID NO: 569073 - RNA, 19 nt, Homo sapiens
ucaccaaagcccagaagaa

SEQ ID NO: 569074 - RNA, 19 nt, Homo sapiens
caucaaauucagcguguug

SEQ ID NO: 569075 - RNA, 19 nt, Homo sapiens
aauggucugugcuuuaaau

SEQ ID NO: 569076 - RNA, 19 nt, Homo sapiens
guggaggugcagaauauuu

SEQ ID NO: 569077 - RNA, 19 nt, Homo sapiens
uuuaauggucugugcuuua

SEQ ID NO: 569078 - RNA, 19 nt, Homo sapiens
aggaagacacugaugguuu

SEQ ID NO: 569079 - RNA, 19 nt, Homo sapiens
uggaggccaugcaauauag

SEQ ID NO: 569080 - RNA, 19 nt, Homo sapiens
cccuuaugcuucucaguuu

SEQ ID NO: 569081 - RNA, 19 nt, Homo sapiens
cauacuugccugucucauu

SEQ ID NO: 569082 - RNA, 19 nt, Homo sapiens
ugauugggcgacaagaaua

SEQ ID NO: 569083 - RNA, 19 nt, Homo sapiens
aaacgaaguggcugaguuc

SEQ ID NO: 569084 - RNA, 19 nt, Homo sapiens
caucacaucccgcgagauc

SEQ ID NO: 569085 - RNA, 19 nt, Homo sapiens
uuguggaggugcagaauau

SEQ ID NO: 569086 - RNA, 19 nt, Homo sapiens
cgucauccacucaggaauu

SEQ ID NO: 569087 - RNA, 19 nt, Homo sapiens
aagaggagguggcaauggu

SEQ ID NO: 569088 - RNA, 19 nt, Homo sapiens
acaaagaggagguggcaau

SEQ ID NO: 569089 - RNA, 19 nt, Homo sapiens
ccagugcgucauuggauuu

SEQ ID NO: 569090 - RNA, 19 nt, Homo sapiens
gcaaacaguuggccacuaa

SEQ ID NO: 569091 - RNA, 19 nt, Homo sapiens
gaaguccacugaacugcuu

SEQ ID NO: 569092 - RNA, 19 nt, Homo sapiens
ccacugaacugcuuauucg

SEQ ID NO: 569093 - RNA, 19 nt, Homo sapiens
gagagggcgugauuacugu

SEQ ID NO: 569094 - RNA, 19 nt, Homo sapiens
gagauccgccguuaucaga

SEQ ID NO: 569095 - RNA, 19 nt, Homo sapiens
gugcgaggccuacuuggua

SEQ ID NO: 569096 - RNA, 19 nt, Homo sapiens
gcaaacugcucggaagucu

SEQ ID NO: 569097 - RNA, 19 nt, Homo sapiens
cugaacugcuuauucguaa

SEQ ID NO: 569098 - RNA, 19 nt, Homo sapiens
ggagagagggcgugauuac

SEQ ID NO: 569099 - RNA, 19 nt, Homo sapiens
gccaagcgcgucacuauca

SEQ ID NO: 569100 - RNA, 19 nt, Homo sapiens
gcggagagagggcgugauu

SEQ ID NO: 569101 - RNA, 19 nt, Homo sapiens
ccagagcuccgcugugaug

SEQ ID NO: 569102 - RNA, 19 nt, Homo sapiens
ucacuaucaugcccaagga

SEQ ID NO: 569103 - RNA, 19 nt, Homo sapiens
gauccgccguuaucagaag

SEQ ID NO: 569104 - RNA, 19 nt, Homo sapiens
gaacugcuuauucguaaac

SEQ ID NO: 569105 - RNA, 19 nt, Homo sapiens
gcaaggcgccacgcaaaca

SEQ ID NO: 569106 - RNA, 19 nt, Homo sapiens
uuucagagccaccaccuuu

SEQ ID NO: 569107 - RNA, 19 nt, Homo sapiens
uuccagagcuccgcuguga

SEQ ID NO: 569108 - RNA, 19 nt, Homo sapiens
gagauugcgcaggacuuua

SEQ ID NO: 569109 - RNA, 19 nt, Homo sapiens
agauugcgcaggacuuuaa

SEQ ID NO: 569110 - RNA, 19 nt, Homo sapiens
ugaacugcuuauucguaaa

SEQ ID NO: 569111 - RNA, 19 nt, Homo sapiens
agagagggcgugauuacug

SEQ ID NO: 569112 - RNA, 19 nt, Homo sapiens
ccaagcgcgucacuaucau

SEQ ID NO: 569113 - RNA, 19 nt, Homo sapiens
gcgcaggacuuuaaaacag

SEQ ID NO: 569114 - RNA, 19 nt, Homo sapiens
aaacugcucggaagucuac

SEQ ID NO: 569115 - RNA, 19 nt, Homo sapiens
caaacugcucggaagucua

SEQ ID NO: 569116 - RNA, 19 nt, Homo sapiens
cgcaaacaguuggccacua

SEQ ID NO: 569117 - RNA, 19 nt, Homo sapiens
acugaacugcuuauucgua

SEQ ID NO: 569118 - RNA, 19 nt, Homo sapiens
ugauuacuguggucucucu

SEQ ID NO: 569119 - RNA, 19 nt, Homo sapiens
gcaagcagcuggccaccaa

SEQ ID NO: 569120 - RNA, 19 nt, Homo sapiens
gggcguaaauugucuugug

SEQ ID NO: 569121 - RNA, 19 nt, Homo sapiens
cgaccgagcugcugauucg

SEQ ID NO: 569122 - RNA, 19 nt, Homo sapiens
caccaaggcugcucgaaag

SEQ ID NO: 569123 - RNA, 19 nt, Homo sapiens
gugaaugugugcuaaccaa

SEQ ID NO: 569124 - RNA, 19 nt, Homo sapiens
ggcguaaauugucuuguga

SEQ ID NO: 569125 - RNA, 19 nt, Homo sapiens
ggagagggcguaaauuguc

SEQ ID NO: 569126 - RNA, 19 nt, Homo sapiens
ugaagaagccccaccguua

SEQ ID NO: 569127 - RNA, 19 nt, Homo sapiens
ccaccaaggcugcucgaaa

SEQ ID NO: 569128 - RNA, 19 nt, Homo sapiens
cguaaauugucuugugaau

SEQ ID NO: 569129 - RNA, 19 nt, Homo sapiens
ggaaagcgccacgcaagca

SEQ ID NO: 569130 - RNA, 19 nt, Homo sapiens
gagagggcguaaauugucu

SEQ ID NO: 569131 - RNA, 19 nt, Homo sapiens
ccagcuugcucgccgcauu

SEQ ID NO: 569132 - RNA, 19 nt, Homo sapiens
gggagagggcguaaauugu

SEQ ID NO: 569133 - RNA, 19 nt, Homo sapiens
gccaagcgagugacuauca

SEQ ID NO: 569134 - RNA, 19 nt, Homo sapiens
cgcaggacuucaagacuga

SEQ ID NO: 569135 - RNA, 19 nt, Homo sapiens
guaaauugucuugugaaug

SEQ ID NO: 569136 - RNA, 19 nt, Homo sapiens
ucaagacugaucugcguuu

SEQ ID NO: 569137 - RNA, 19 nt, Homo sapiens
ccaagcgagugacuaucau

SEQ ID NO: 569138 - RNA, 19 nt, Homo sapiens
gaaugugugcuaaccaaaa

SEQ ID NO: 569139 - RNA, 19 nt, Homo sapiens
ggggagagggcguaaauug

SEQ ID NO: 569140 - RNA, 19 nt, Homo sapiens
ugagaucgcgcaggacuuc

SEQ ID NO: 569141 - RNA, 19 nt, Homo sapiens
agacugaucugcguuuuca

SEQ ID NO: 569142 - RNA, 19 nt, Homo sapiens
ggacuucaagacugaucug

SEQ ID NO: 569143 - RNA, 19 nt, Homo sapiens
gcaaacagcucgcaagucu

SEQ ID NO: 569144 - RNA, 19 nt, Homo sapiens
gcauaagucugcccguuuc

SEQ ID NO: 569145 - RNA, 19 nt, Homo sapiens
gcuaaacgcgucaccauca

SEQ ID NO: 569146 - RNA, 19 nt, Homo sapiens
gcccguuucuuccucauug

SEQ ID NO: 569147 - RNA, 19 nt, Homo sapiens
gcaaagcuccgcgcaagca

SEQ ID NO: 569148 - RNA, 19 nt, Homo sapiens
acaccaaucugugcgcuau

SEQ ID NO: 569149 - RNA, 19 nt, Homo sapiens
agaaaucgcccaggacuuc

SEQ ID NO: 569150 - RNA, 19 nt, Homo sapiens
ucaccaucaugcccaaaga

SEQ ID NO: 569151 - RNA, 19 nt, Homo sapiens
cuacuaaagcagcccguaa

SEQ ID NO: 569152 - RNA, 19 nt, Homo sapiens
aaacagcucgcaagucuac

SEQ ID NO: 569153 - RNA, 19 nt, Homo sapiens
caucaugcccaaagauauc

SEQ ID NO: 569154 - RNA, 19 nt, Homo sapiens
uaagucugcccguuucuuc

SEQ ID NO: 569155 - RNA, 19 nt, Homo sapiens
gagaaaucgcccaggacuu

SEQ ID NO: 569156 - RNA, 19 nt, Homo sapiens
gaaaucgcccaggacuuca

SEQ ID NO: 569157 - RNA, 19 nt, Homo sapiens
cuaaacgcgucaccaucau

SEQ ID NO: 569158 - RNA, 19 nt, Homo sapiens
ccaucaugcccaaagauau

SEQ ID NO: 569159 - RNA, 19 nt, Homo sapiens
caaacagcucgcaagucua

SEQ ID NO: 569160 - RNA, 19 nt, Homo sapiens
ugugcgcuauucacgcuaa

SEQ ID NO: 569161 - RNA, 19 nt, Homo sapiens
gcaaacagcuggccacuaa

SEQ ID NO: 569162 - RNA, 19 nt, Homo sapiens
guacaaaccuuaaauccaa

SEQ ID NO: 569163 - RNA, 19 nt, Homo sapiens
gagagggcgugaauuguuu

SEQ ID NO: 569164 - RNA, 19 nt, Homo sapiens
agaaauagcucaggacuuc

SEQ ID NO: 569165 - RNA, 19 nt, Homo sapiens
gaccugcgcuuccagaguu

SEQ ID NO: 569166 - RNA, 19 nt, Homo sapiens
ggagagggcgugaauuguu

SEQ ID NO: 569167 - RNA, 19 nt, Homo sapiens
caucaugccuaaagacauc

SEQ ID NO: 569168 - RNA, 19 nt, Homo sapiens
uccaaaggcucuucucaga

SEQ ID NO: 569169 - RNA, 19 nt, Homo sapiens
ccagaagucuaccgagcuu

SEQ ID NO: 569170 - RNA, 19 nt, Homo sapiens
guaaagcaccgcgcaaaca

SEQ ID NO: 569171 - RNA, 19 nt, Homo sapiens
cuaagcagacggcucguaa

SEQ ID NO: 569172 - RNA, 19 nt, Homo sapiens
gcgugaccaucaugccuaa

SEQ ID NO: 569173 - RNA, 19 nt, Homo sapiens
ugaccaucaugccuaaaga

SEQ ID NO: 569174 - RNA, 19 nt, Homo sapiens
gccaaacgcgugaccauca

SEQ ID NO: 569175 - RNA, 19 nt, Homo sapiens
uccggaagcugccguuuca

SEQ ID NO: 569176 - RNA, 19 nt, Homo sapiens
acaccaaccugugcgcuau

SEQ ID NO: 569177 - RNA, 19 nt, Homo sapiens
gagaaauagcucaggacuu

SEQ ID NO: 569178 - RNA, 19 nt, Homo sapiens
ccaaacgcgugaccaucau

SEQ ID NO: 569179 - RNA, 19 nt, Homo sapiens
gcgccuggugcgagaaaua

SEQ ID NO: 569180 - RNA, 19 nt, Homo sapiens
aagcagacggcucguaaau

SEQ ID NO: 569181 - RNA, 19 nt, Homo sapiens
uaagcagacggcucguaaa

SEQ ID NO: 569182 - RNA, 19 nt, Homo sapiens
aaauagcucaggacuucaa

SEQ ID NO: 569183 - RNA, 19 nt, Homo sapiens
gaaauagcucaggacuuca

SEQ ID NO: 569184 - RNA, 19 nt, Homo sapiens
uaaagcaccgcgcaaacag

SEQ ID NO: 569185 - RNA, 19 nt, Homo sapiens
ugaguacaaaccuuaaauc

SEQ ID NO: 569186 - RNA, 19 nt, Homo sapiens
gcaagcagcuggccaccaa

SEQ ID NO: 569187 - RNA, 19 nt, Homo sapiens
gccaaacgcgucacuauua

SEQ ID NO: 569188 - RNA, 19 nt, Homo sapiens
ggagagggcauaaauauuc

SEQ ID NO: 569189 - RNA, 19 nt, Homo sapiens
ccaaacgcgucacuauuau

SEQ ID NO: 569190 - RNA, 19 nt, Homo sapiens
ggagaucgcacaggacuuu

SEQ ID NO: 569191 - RNA, 19 nt, Homo sapiens
gcauaaauauuccuaucag

SEQ ID NO: 569192 - RNA, 19 nt, Homo sapiens
gggcauaaauauuccuauc

SEQ ID NO: 569193 - RNA, 19 nt, Homo sapiens
ucacuauuaugccuaaaga

SEQ ID NO: 569194 - RNA, 19 nt, Homo sapiens
gggagagggcauaaauauu

SEQ ID NO: 569195 - RNA, 19 nt, Homo sapiens
gaagucgaccgagcugcua

SEQ ID NO: 569196 - RNA, 19 nt, Homo sapiens
gcgucacuauuaugccuaa

SEQ ID NO: 569197 - RNA, 19 nt, Homo sapiens
uauuaugccuaaagacauc

SEQ ID NO: 569198 - RNA, 19 nt, Homo sapiens
ggcauaaauauuccuauca

SEQ ID NO: 569199 - RNA, 19 nt, Homo sapiens
ccuaucagcccaagaaguc

SEQ ID NO: 569200 - RNA, 19 nt, Homo sapiens
gagagggcauaaauauucc

SEQ ID NO: 569201 - RNA, 19 nt, Homo sapiens
caaacgcgucacuauuaug

SEQ ID NO: 569202 - RNA, 19 nt, Homo sapiens
gcacgaacaaagcaaacag

SEQ ID NO: 569203 - RNA, 19 nt, Homo sapiens
gagggcauaaauauuccua

SEQ ID NO: 569204 - RNA, 19 nt, Homo sapiens
gagaucgcacaggacuuua

SEQ ID NO: 569205 - RNA, 19 nt, Homo sapiens
ggggagagggcauaaauau

SEQ ID NO: 569206 - RNA, 19 nt, Homo sapiens
cgccaaacgcgucacuauu

SEQ ID NO: 569207 - RNA, 19 nt, Homo sapiens
gaucgcacaggacuuuaag

SEQ ID NO: 569208 - RNA, 19 nt, Homo sapiens
gcaagcagcuggccacuaa

SEQ ID NO: 569209 - RNA, 19 nt, Homo sapiens
caagacagaucugcgcuuu

SEQ ID NO: 569210 - RNA, 19 nt, Homo sapiens
ggagagagcguagagguuu

SEQ ID NO: 569211 - RNA, 19 nt, Homo sapiens
gagauucgccgcuaucaga

SEQ ID NO: 569212 - RNA, 19 nt, Homo sapiens
agaaaucgcucaggacuuc

SEQ ID NO: 569213 - RNA, 19 nt, Homo sapiens
agacagaucugcgcuuuca

SEQ ID NO: 569214 - RNA, 19 nt, Homo sapiens
gcuaagcgagugacuauca

SEQ ID NO: 569215 - RNA, 19 nt, Homo sapiens
gggcaguaauucuauccaa

SEQ ID NO: 569216 - RNA, 19 nt, Homo sapiens
ucagcucgcucgccgcauu

SEQ ID NO: 569217 - RNA, 19 nt, Homo sapiens
gagagagcguagagguuuc

SEQ ID NO: 569218 - RNA, 19 nt, Homo sapiens
ugacuaucaugcccaagga

SEQ ID NO: 569219 - RNA, 19 nt, Homo sapiens
caaccugugugccauccau

SEQ ID NO: 569220 - RNA, 19 nt, Homo sapiens
caguaauucuauccaacuu

SEQ ID NO: 569221 - RNA, 19 nt, Homo sapiens
gcaguaauucuauccaacu

SEQ ID NO: 569222 - RNA, 19 nt, Homo sapiens
ugugugccauccaugcuaa

SEQ ID NO: 569223 - RNA, 19 nt, Homo sapiens
gagaaaucgcucaggacuu

SEQ ID NO: 569224 - RNA, 19 nt, Homo sapiens
gggagagagcguagagguu

SEQ ID NO: 569225 - RNA, 19 nt, Homo sapiens
caacgccuggugcgagaaa

SEQ ID NO: 569226 - RNA, 19 nt, Homo sapiens
uaucaugcccaaggacauu

SEQ ID NO: 569227 - RNA, 19 nt, Homo sapiens
cuaagcgagugacuaucau

SEQ ID NO: 569228 - RNA, 19 nt, Homo sapiens
ggacuucaagacagaucug

SEQ ID NO: 569229 - RNA, 19 nt, Homo sapiens
ggaagcagcuggccaccaa

SEQ ID NO: 569230 - RNA, 19 nt, Homo sapiens
gccaagcgugucacuauua

SEQ ID NO: 569231 - RNA, 19 nt, Homo sapiens
ccaagcgugucacuauuau

SEQ ID NO: 569232 - RNA, 19 nt, Homo sapiens
gagauccgccguuaucaga

SEQ ID NO: 569233 - RNA, 19 nt, Homo sapiens
ucacuauuaugccuaagga

SEQ ID NO: 569234 - RNA, 19 nt, Homo sapiens
gauccgccguuaucagaag

SEQ ID NO: 569235 - RNA, 19 nt, Homo sapiens
acaccaaccucugugcuau

SEQ ID NO: 569236 - RNA, 19 nt, Homo sapiens
gacaccaaccucugugcua

SEQ ID NO: 569237 - RNA, 19 nt, Homo sapiens
cgccaagcgugucacuauu

SEQ ID NO: 569238 - RNA, 19 nt, Homo sapiens
ucuggugggucucuuugaa

SEQ ID NO: 569239 - RNA, 19 nt, Homo sapiens
ugcgugagauccgccguua

SEQ ID NO: 569240 - RNA, 19 nt, Homo sapiens
cgacuggcggugugaagaa

SEQ ID NO: 569241 - RNA, 19 nt, Homo sapiens
gugucacuauuaugccuaa

SEQ ID NO: 569242 - RNA, 19 nt, Homo sapiens
ugaagacaccaaccucugu

SEQ ID NO: 569243 - RNA, 19 nt, Homo sapiens
ccugcucuaucuuggguuu

SEQ ID NO: 569244 - RNA, 19 nt, Homo sapiens
cgugagauccgccguuauc

SEQ ID NO: 569245 - RNA, 19 nt, Homo sapiens
caaccucugugcuauucac

SEQ ID NO: 569246 - RNA, 19 nt, Homo sapiens
uccgcaaacugccauuuca

SEQ ID NO: 569247 - RNA, 19 nt, Homo sapiens
gcaagcagcuggccaccaa

SEQ ID NO: 569248 - RNA, 19 nt, Homo sapiens
cucaaggacucacugauua

SEQ ID NO: 569249 - RNA, 19 nt, Homo sapiens
aggacucacugauuacaua

SEQ ID NO: 569250 - RNA, 19 nt, Homo sapiens
ccaccgagcugcugaucag

SEQ ID NO: 569251 - RNA, 19 nt, Homo sapiens
ccgagcugcugaucagaaa

SEQ ID NO: 569252 - RNA, 19 nt, Homo sapiens
ucucaaggacucacugauu

SEQ ID NO: 569253 - RNA, 19 nt, Homo sapiens
ugacuaucaugcccaagga

SEQ ID NO: 569254 - RNA, 19 nt, Homo sapiens
ccaagcgggugacuaucau

SEQ ID NO: 569255 - RNA, 19 nt, Homo sapiens
gccaagcgggugacuauca

SEQ ID NO: 569256 - RNA, 19 nt, Homo sapiens
gcauggcgcguacgaagca

SEQ ID NO: 569257 - RNA, 19 nt, Homo sapiens
gaaggcauggcgcguacga

SEQ ID NO: 569258 - RNA, 19 nt, Homo sapiens
ugagaucgcgcaggacuuc

SEQ ID NO: 569259 - RNA, 19 nt, Homo sapiens
cugauuacauacccaaagg

SEQ ID NO: 569260 - RNA, 19 nt, Homo sapiens
caagaagccccaucgcuau

SEQ ID NO: 569261 - RNA, 19 nt, Homo sapiens
gcaagcagcuggcuaccaa

SEQ ID NO: 569262 - RNA, 19 nt, Homo sapiens
gaaagagcguaaauguaaa

SEQ ID NO: 569263 - RNA, 19 nt, Homo sapiens
agaaagagcguaaauguaa

SEQ ID NO: 569264 - RNA, 19 nt, Homo sapiens
gagcguaaauguaaaguca

SEQ ID NO: 569265 - RNA, 19 nt, Homo sapiens
gcuaagcgagugacuauua

SEQ ID NO: 569266 - RNA, 19 nt, Homo sapiens
ggagaaagagcguaaaugu

SEQ ID NO: 569267 - RNA, 19 nt, Homo sapiens
gagaaagagcguaaaugua

SEQ ID NO: 569268 - RNA, 19 nt, Homo sapiens
agaaaucgcccaagacuuc

SEQ ID NO: 569269 - RNA, 19 nt, Homo sapiens
ugacuauuaugcccaaaga

SEQ ID NO: 569270 - RNA, 19 nt, Homo sapiens
cuaagcgagugacuauuau

SEQ ID NO: 569271 - RNA, 19 nt, Homo sapiens
aaacagacagcucggaaau

SEQ ID NO: 569272 - RNA, 19 nt, Homo sapiens
uaaacagacagcucggaaa

SEQ ID NO: 569273 - RNA, 19 nt, Homo sapiens
guaaagcgccacgcaagca

SEQ ID NO: 569274 - RNA, 19 nt, Homo sapiens
gagaaaucgcccaagacuu

SEQ ID NO: 569275 - RNA, 19 nt, Homo sapiens
cgaccgaguugcugauucg

SEQ ID NO: 569276 - RNA, 19 nt, Homo sapiens
gcguaaauguaaagucacu

SEQ ID NO: 569277 - RNA, 19 nt, Homo sapiens
gaaaucgcccaagacuuca

SEQ ID NO: 569278 - RNA, 19 nt, Homo sapiens
gcggagaaagagcguaaau

SEQ ID NO: 569279 - RNA, 19 nt, Homo sapiens
cgagaaaucgcccaagacu

SEQ ID NO: 569280 - RNA, 19 nt, Homo sapiens
acagacagcucggaaaucc

SEQ ID NO: 569281 - RNA, 19 nt, Homo sapiens
cgguuaagguugcugauuu

SEQ ID NO: 569282 - RNA, 19 nt, Homo sapiens
gguuaagguugcugauuuc

SEQ ID NO: 569283 - RNA, 19 nt, Homo sapiens
aagcggaucucuggucuga

SEQ ID NO: 569284 - RNA, 19 nt, Homo sapiens
gacguggucuacgcgcuua

SEQ ID NO: 569285 - RNA, 19 nt, Homo sapiens
gcgggaaggguuuggguaa

SEQ ID NO: 569286 - RNA, 19 nt, Homo sapiens
ucucuggucugaucuacga

SEQ ID NO: 569287 - RNA, 19 nt, Homo sapiens
gggaaggguuuggguaagg

SEQ ID NO: 569288 - RNA, 19 nt, Homo sapiens
gccaagcgcaagacaguca

SEQ ID NO: 569289 - RNA, 19 nt, Homo sapiens
gagcacgccaagcgcaaga

SEQ ID NO: 569290 - RNA, 19 nt, Homo sapiens
gacaacauccagggcauca

SEQ ID NO: 569291 - RNA, 19 nt, Homo sapiens
uuauggcuuuggcgguuaa

SEQ ID NO: 569292 - RNA, 19 nt, Homo sapiens
acgcacccuuuauggcuuu

SEQ ID NO: 569293 - RNA, 19 nt, Homo sapiens
gcgguuaagguugcugauu

SEQ ID NO: 569294 - RNA, 19 nt, Homo sapiens
gagcuuaccucuacaguac

SEQ ID NO: 569295 - RNA, 19 nt, Homo sapiens
cggcugagcuuaccucuac

SEQ ID NO: 569296 - RNA, 19 nt, Homo sapiens
gcggaaagggucuagguaa

SEQ ID NO: 569297 - RNA, 19 nt, Homo sapiens
gaacacgccaaacgcaaga

SEQ ID NO: 569298 - RNA, 19 nt, Homo sapiens
gcguauuucuggccucauu

SEQ ID NO: 569299 - RNA, 19 nt, Homo sapiens
gacaauauccaaggaauca

SEQ ID NO: 569300 - RNA, 19 nt, Homo sapiens
gcgccaagcgucaccguaa

SEQ ID NO: 569301 - RNA, 19 nt, Homo sapiens
guauuucuggccucauuua

SEQ ID NO: 569302 - RNA, 19 nt, Homo sapiens
gccagggacgcacucuuua

SEQ ID NO: 569303 - RNA, 19 nt, Homo sapiens
gugacaauauccaaggaau

SEQ ID NO: 569304 - RNA, 19 nt, Homo sapiens
cguaagguauugcgugaca

SEQ ID NO: 569305 - RNA, 19 nt, Homo sapiens
gcggagugcugaaaguuuu

SEQ ID NO: 569306 - RNA, 19 nt, Homo sapiens
cggaaagggucuagguaag

SEQ ID NO: 569307 - RNA, 19 nt, Homo sapiens
ggaaagggucuagguaagg

SEQ ID NO: 569308 - RNA, 19 nt, Homo sapiens
cgccagggacgcacucuuu

SEQ ID NO: 569309 - RNA, 19 nt, Homo sapiens
gccaaacgcaagacaguca

SEQ ID NO: 569310 - RNA, 19 nt, Homo sapiens
ccagggacgcacucuuuau

SEQ ID NO: 569311 - RNA, 19 nt, Homo sapiens
cagggacgcacucuuuaug

SEQ ID NO: 569312 - RNA, 19 nt, Homo sapiens
gcgugacaauauccaagga

SEQ ID NO: 569313 - RNA, 19 nt, Homo sapiens
ugagcuuaccucuacagua

SEQ ID NO: 569314 - RNA, 19 nt, Homo sapiens
uacaguacacuaccgcaaa

SEQ ID NO: 569315 - RNA, 19 nt, Homo sapiens
ggcggaaagggucuaggua

SEQ ID NO: 569316 - RNA, 19 nt, Homo sapiens
gcgaugcugucaccuacac

SEQ ID NO: 569317 - RNA, 19 nt, Homo sapiens
caagcgucaccguaaggua

SEQ ID NO: 569318 - RNA, 19 nt, Homo sapiens
guaagguauugcgugacaa

SEQ ID NO: 569319 - RNA, 19 nt, Homo sapiens
cuacacggaacacgccaaa

SEQ ID NO: 569320 - RNA, 19 nt, Homo sapiens
aagcgucaccguaagguau

SEQ ID NO: 569321 - RNA, 19 nt, Homo sapiens
uuuaacagcucacccauaa

SEQ ID NO: 569322 - RNA, 19 nt, Homo sapiens
gcaaagugcugcgugacaa

SEQ ID NO: 569323 - RNA, 19 nt, Homo sapiens
gcaaaggugguaaagguuu

SEQ ID NO: 569324 - RNA, 19 nt, Homo sapiens
gcauuucgggccucauuua

SEQ ID NO: 569325 - RNA, 19 nt, Homo sapiens
ucacugcaauggauguugu

SEQ ID NO: 569326 - RNA, 19 nt, Homo sapiens
aggcaaaggugguaaaggu

SEQ ID NO: 569327 - RNA, 19 nt, Homo sapiens
caagcgccaucgcaaagug

SEQ ID NO: 569328 - RNA, 19 nt, Homo sapiens
uaacagcucacccauaaaa

SEQ ID NO: 569329 - RNA, 19 nt, Homo sapiens
gcgguguucuuaagguguu

SEQ ID NO: 569330 - RNA, 19 nt, Homo sapiens
ugcaauggauguugucuac

SEQ ID NO: 569331 - RNA, 19 nt, Homo sapiens
uuaagguguuccuggagaa

SEQ ID NO: 569332 - RNA, 19 nt, Homo sapiens
gguagaggcaaagguggua

SEQ ID NO: 569333 - RNA, 19 nt, Homo sapiens
ggcaaaggugguaaagguu

SEQ ID NO: 569334 - RNA, 19 nt, Homo sapiens
guuccuggagaaugugaua

SEQ ID NO: 569335 - RNA, 19 nt, Homo sapiens
agugcugcgugacaacaua

SEQ ID NO: 569336 - RNA, 19 nt, Homo sapiens
gccaagcgccaucgcaaag

SEQ ID NO: 569337 - RNA, 19 nt, Homo sapiens
gccagggacgcacucugua

SEQ ID NO: 569338 - RNA, 19 nt, Homo sapiens
gagcgucccuuucuaucaa

SEQ ID NO: 569339 - RNA, 19 nt, Homo sapiens
ggaagggucuuggcaaagg

SEQ ID NO: 569340 - RNA, 19 nt, Homo sapiens
guaaaguacugcgcgacaa

SEQ ID NO: 569341 - RNA, 19 nt, Homo sapiens
cgggaagggucuuggcaaa

SEQ ID NO: 569342 - RNA, 19 nt, Homo sapiens
gcuaagcgccaccguaaag

SEQ ID NO: 569343 - RNA, 19 nt, Homo sapiens
ugaagguguuccuggagaa

SEQ ID NO: 569344 - RNA, 19 nt, Homo sapiens
uaagcgccaccguaaagua

SEQ ID NO: 569345 - RNA, 19 nt, Homo sapiens
gacaauauccagggcauca

SEQ ID NO: 569346 - RNA, 19 nt, Homo sapiens
gguugagcgucccuuucua

SEQ ID NO: 569347 - RNA, 19 nt, Homo sapiens
gccgcacccucuacgguuu

SEQ ID NO: 569348 - RNA, 19 nt, Homo sapiens
gggacgccgugaccuauac

SEQ ID NO: 569349 - RNA, 19 nt, Homo sapiens
aaaguacugcgcgacaaua

SEQ ID NO: 569350 - RNA, 19 nt, Homo sapiens
uaaaguacugcgcgacaau

SEQ ID NO: 569351 - RNA, 19 nt, Homo sapiens
guugagcgucccuuucuau

SEQ ID NO: 569352 - RNA, 19 nt, Homo sapiens
gucccuuucuaucaacaaa

SEQ ID NO: 569353 - RNA, 19 nt, Homo sapiens
gagcacgccaagcgcaaga

SEQ ID NO: 569354 - RNA, 19 nt, Homo sapiens
guacugcgcgacaauaucc

SEQ ID NO: 569355 - RNA, 19 nt, Homo sapiens
gcgccaccguaaaguacug

SEQ ID NO: 569356 - RNA, 19 nt, Homo sapiens
ucuccggccucaucuacga

SEQ ID NO: 569357 - RNA, 19 nt, Homo sapiens
gagcgucccuuucuaucaa

SEQ ID NO: 569358 - RNA, 19 nt, Homo sapiens
ggaagggucuuggcaaagg

SEQ ID NO: 569359 - RNA, 19 nt, Homo sapiens
guaaaguacugcgcgacaa

SEQ ID NO: 569360 - RNA, 19 nt, Homo sapiens
cgggaagggucuuggcaaa

SEQ ID NO: 569361 - RNA, 19 nt, Homo sapiens
gcuaagcgccaccguaaag

SEQ ID NO: 569362 - RNA, 19 nt, Homo sapiens
ugaagguguuccuggagaa

SEQ ID NO: 569363 - RNA, 19 nt, Homo sapiens
uaagcgccaccguaaagua

SEQ ID NO: 569364 - RNA, 19 nt, Homo sapiens
gacaauauccagggcauca

SEQ ID NO: 569365 - RNA, 19 nt, Homo sapiens
gguugagcgucccuuucua

SEQ ID NO: 569366 - RNA, 19 nt, Homo sapiens
gccgcacccucuacgguuu

SEQ ID NO: 569367 - RNA, 19 nt, Homo sapiens
gggacgccgugaccuauac

SEQ ID NO: 569368 - RNA, 19 nt, Homo sapiens
aaaguacugcgcgacaaua

SEQ ID NO: 569369 - RNA, 19 nt, Homo sapiens
uaaaguacugcgcgacaau

SEQ ID NO: 569370 - RNA, 19 nt, Homo sapiens
gucccuuucuaucaauaaa

SEQ ID NO: 569371 - RNA, 19 nt, Homo sapiens
gcgucccuuucuaucaaua

SEQ ID NO: 569372 - RNA, 19 nt, Homo sapiens
guugagcgucccuuucuau

SEQ ID NO: 569373 - RNA, 19 nt, Homo sapiens
gagcacgccaagcgcaaga

SEQ ID NO: 569374 - RNA, 19 nt, Homo sapiens
guacugcgcgacaauaucc

SEQ ID NO: 569375 - RNA, 19 nt, Homo sapiens
gcgccaccguaaaguacug

SEQ ID NO: 569376 - RNA, 19 nt, Homo sapiens
ucuccggccucaucuacga

SEQ ID NO: 569377 - RNA, 19 nt, Homo sapiens
guaaggugcuccgggauaa

SEQ ID NO: 569378 - RNA, 19 nt, Homo sapiens
gauaacauccagggcauua

SEQ ID NO: 569379 - RNA, 19 nt, Homo sapiens
gcggcugaaucuaagaaua

SEQ ID NO: 569380 - RNA, 19 nt, Homo sapiens
gugcuaagcgccaucguaa

SEQ ID NO: 569381 - RNA, 19 nt, Homo sapiens
agccauggauguaguauau

SEQ ID NO: 569382 - RNA, 19 nt, Homo sapiens
uuuccggucuuaucuauga

SEQ ID NO: 569383 - RNA, 19 nt, Homo sapiens
ucacagccauggauguagu

SEQ ID NO: 569384 - RNA, 19 nt, Homo sapiens
gaggugugcuuaagguuuu

SEQ ID NO: 569385 - RNA, 19 nt, Homo sapiens
cgaggugugcuuaagguuu

SEQ ID NO: 569386 - RNA, 19 nt, Homo sapiens
cauuuccggucuuaucuau

SEQ ID NO: 569387 - RNA, 19 nt, Homo sapiens
gcuaagcgccaucguaagg

SEQ ID NO: 569388 - RNA, 19 nt, Homo sapiens
gagacucgaggugugcuua

SEQ ID NO: 569389 - RNA, 19 nt, Homo sapiens
aagcgcauuuccggucuua

SEQ ID NO: 569390 - RNA, 19 nt, Homo sapiens
gcauuuccggucuuaucua

SEQ ID NO: 569391 - RNA, 19 nt, Homo sapiens
uaacauccagggcauuaca

SEQ ID NO: 569392 - RNA, 19 nt, Homo sapiens
cguaaggugcuccgggaua

SEQ ID NO: 569393 - RNA, 19 nt, Homo sapiens
ccauggauguaguauaugc

SEQ ID NO: 569394 - RNA, 19 nt, Homo sapiens
ggugcuaagcgccaucgua

SEQ ID NO: 569395 - RNA, 19 nt, Homo sapiens
gcgcauuuccggucuuauc

SEQ ID NO: 569396 - RNA, 19 nt, Homo sapiens
ugucacagccauggaugua

SEQ ID NO: 569397 - RNA, 19 nt, Homo sapiens
ggagcacgccaagcgcaaa

SEQ ID NO: 569398 - RNA, 19 nt, Homo sapiens
caagcgcauuuccggucuu

SEQ ID NO: 569399 - RNA, 19 nt, Homo sapiens
cgacagggacgcacucuuu

SEQ ID NO: 569400 - RNA, 19 nt, Homo sapiens
gcaagaccgugacagcaau

SEQ ID NO: 569401 - RNA, 19 nt, Homo sapiens
gcgaauuucuggccuuauc

SEQ ID NO: 569402 - RNA, 19 nt, Homo sapiens
uuucuggccuuaucuauga

SEQ ID NO: 569403 - RNA, 19 nt, Homo sapiens
ccugcuugcugcacucuua

SEQ ID NO: 569404 - RNA, 19 nt, Homo sapiens
gacagggacgcacucuuua

SEQ ID NO: 569405 - RNA, 19 nt, Homo sapiens
gaauuucuggccuuaucua

SEQ ID NO: 569406 - RNA, 19 nt, Homo sapiens
ugaggagacucgugguguu

SEQ ID NO: 569407 - RNA, 19 nt, Homo sapiens
aagcgaauuucuggccuua

SEQ ID NO: 569408 - RNA, 19 nt, Homo sapiens
ugaagguguuccuggagaa

SEQ ID NO: 569409 - RNA, 19 nt, Homo sapiens
gauaacauccagggcauca

SEQ ID NO: 569410 - RNA, 19 nt, Homo sapiens
uuacacagagcacgccaaa

SEQ ID NO: 569411 - RNA, 19 nt, Homo sapiens
ggagacucgugguguucug

SEQ ID NO: 569412 - RNA, 19 nt, Homo sapiens
gggaggagcuaagcgucau

SEQ ID NO: 569413 - RNA, 19 nt, Homo sapiens
acacagagcacgccaaacg

SEQ ID NO: 569414 - RNA, 19 nt, Homo sapiens
gcuugcugcacucuuauuu

SEQ ID NO: 569415 - RNA, 19 nt, Homo sapiens
gagcacgccaaacgcaaga

SEQ ID NO: 569416 - RNA, 19 nt, Homo sapiens
uaagcgucaucgcaagguu

SEQ ID NO: 569417 - RNA, 19 nt, Homo sapiens
gugguguucugaagguguu

SEQ ID NO: 569418 - RNA, 19 nt, Homo sapiens
ggaaaagguuuggguaagg

SEQ ID NO: 569419 - RNA, 19 nt, Homo sapiens
ggcggugucaagcgaauuu

SEQ ID NO: 569420 - RNA, 19 nt, Homo sapiens
gaggagacucgugguguuc

SEQ ID NO: 569421 - RNA, 19 nt, Homo sapiens
gaccgugacagcaauggau

SEQ ID NO: 569422 - RNA, 19 nt, Homo sapiens
cagcaauggauguggucua

SEQ ID NO: 569423 - RNA, 19 nt, Homo sapiens
gaauuuccgguuugauuua

SEQ ID NO: 569424 - RNA, 19 nt, Homo sapiens
gaaaagugcugcgggauaa

SEQ ID NO: 569425 - RNA, 19 nt, Homo sapiens
gcaaaggcgguaaagguuu

SEQ ID NO: 569426 - RNA, 19 nt, Homo sapiens
gcgaauuuccgguuugauu

SEQ ID NO: 569427 - RNA, 19 nt, Homo sapiens
cgaauuuccgguuugauuu

SEQ ID NO: 569428 - RNA, 19 nt, Homo sapiens
uaagcgaauuuccgguuug

SEQ ID NO: 569429 - RNA, 19 nt, Homo sapiens
ggcaaaggcgguaaagguu

SEQ ID NO: 569430 - RNA, 19 nt, Homo sapiens
uuaagcgaauuuccgguuu

SEQ ID NO: 569431 - RNA, 19 nt, Homo sapiens
gauaacauccaaggcauca

SEQ ID NO: 569432 - RNA, 19 nt, Homo sapiens
gguaaagguuuggguaagg

SEQ ID NO: 569433 - RNA, 19 nt, Homo sapiens
gcgguaaagguuuggguaa

SEQ ID NO: 569434 - RNA, 19 nt, Homo sapiens
guacggcuucggcgguuaa

SEQ ID NO: 569435 - RNA, 19 nt, Homo sapiens
gacugucacugccauggau

SEQ ID NO: 569436 - RNA, 19 nt, Homo sapiens
cggcaaaggcgguaaaggu

SEQ ID NO: 569437 - RNA, 19 nt, Homo sapiens
aagcgaauuuccgguuuga

SEQ ID NO: 569438 - RNA, 19 nt, Homo sapiens
cauccaaggcaucaccaaa

SEQ ID NO: 569439 - RNA, 19 nt, Homo sapiens
gccaagcgcaagacuguca

SEQ ID NO: 569440 - RNA, 19 nt, Homo sapiens
gucaaggacgcacucugua

SEQ ID NO: 569441 - RNA, 19 nt, Homo sapiens
gagcacgccaagcgcaaga

SEQ ID NO: 569442 - RNA, 19 nt, Homo sapiens
uuuccgguuugauuuauga

SEQ ID NO: 569443 - RNA, 19 nt, Homo sapiens
cgaaaagugcugcgggaua

SEQ ID NO: 569444 - RNA, 19 nt, Homo sapiens
gauaacauccagggcauua

SEQ ID NO: 569445 - RNA, 19 nt, Homo sapiens
gaaagggacuggguaaagg

SEQ ID NO: 569446 - RNA, 19 nt, Homo sapiens
guaagguccugcgagauaa

SEQ ID NO: 569447 - RNA, 19 nt, Homo sapiens
cguaagguccugcgagaua

SEQ ID NO: 569448 - RNA, 19 nt, Homo sapiens
agacagggacgcacucuuu

SEQ ID NO: 569449 - RNA, 19 nt, Homo sapiens
gcgcauuucuggucucauc

SEQ ID NO: 569450 - RNA, 19 nt, Homo sapiens
gacagggacgcacucuuua

SEQ ID NO: 569451 - RNA, 19 nt, Homo sapiens
ggaaagggacuggguaaag

SEQ ID NO: 569452 - RNA, 19 nt, Homo sapiens
caucucgacuucccaaauc

SEQ ID NO: 569453 - RNA, 19 nt, Homo sapiens
cggcuaaugcuaccgcuua

SEQ ID NO: 569454 - RNA, 19 nt, Homo sapiens
cgacucagcaucucgacuu

SEQ ID NO: 569455 - RNA, 19 nt, Homo sapiens
ggcuaaugcuaccgcuuaa

SEQ ID NO: 569456 - RNA, 19 nt, Homo sapiens
gccaaacgcaagacaguga

SEQ ID NO: 569457 - RNA, 19 nt, Homo sapiens
gcggaaagggacuggguaa

SEQ ID NO: 569458 - RNA, 19 nt, Homo sapiens
gcauuucuggucucaucua

SEQ ID NO: 569459 - RNA, 19 nt, Homo sapiens
ucuacgcgcugaagagaca

SEQ ID NO: 569460 - RNA, 19 nt, Homo sapiens
gcaucucgacuucccaaau

SEQ ID NO: 569461 - RNA, 19 nt, Homo sapiens
uuucuggucucaucuacga

SEQ ID NO: 569462 - RNA, 19 nt, Homo sapiens
ggucuacgcgcugaagaga

SEQ ID NO: 569463 - RNA, 19 nt, Homo sapiens
gagcacgccaaacgcaaga

SEQ ID NO: 569464 - RNA, 19 nt, Homo sapiens
gaaaacgugauucgugaug

SEQ ID NO: 569465 - RNA, 19 nt, Homo sapiens
gacucagcaucucgacuuc

SEQ ID NO: 569466 - RNA, 19 nt, Homo sapiens
uucgugaugcugugacuua

SEQ ID NO: 569467 - RNA, 19 nt, Homo sapiens
gcgcaucucaggccuuaua

SEQ ID NO: 569468 - RNA, 19 nt, Homo sapiens
gcaaaguucugcgcgacaa

SEQ ID NO: 569469 - RNA, 19 nt, Homo sapiens
gagacacgcggaguucuua

SEQ ID NO: 569470 - RNA, 19 nt, Homo sapiens
ggaagggucugggcaaagg

SEQ ID NO: 569471 - RNA, 19 nt, Homo sapiens
gcggaguucuuaaaguguu

SEQ ID NO: 569472 - RNA, 19 nt, Homo sapiens
ucucaggccuuauauacga

SEQ ID NO: 569473 - RNA, 19 nt, Homo sapiens
aagcgcaucucaggccuua

SEQ ID NO: 569474 - RNA, 19 nt, Homo sapiens
guaauccgcgaugcaguua

SEQ ID NO: 569475 - RNA, 19 nt, Homo sapiens
ggagacacgcggaguucuu

SEQ ID NO: 569476 - RNA, 19 nt, Homo sapiens
acgcggaguucuuaaagug

SEQ ID NO: 569477 - RNA, 19 nt, Homo sapiens
caucucaggccuuauauac

SEQ ID NO: 569478 - RNA, 19 nt, Homo sapiens
gcaucucaggccuuauaua

SEQ ID NO: 569479 - RNA, 19 nt, Homo sapiens
gcuaagcgccaccgcaaag

SEQ ID NO: 569480 - RNA, 19 nt, Homo sapiens
gccaaacgcaagacaguca

SEQ ID NO: 569481 - RNA, 19 nt, Homo sapiens
gaggagacacgcggaguuc

SEQ ID NO: 569482 - RNA, 19 nt, Homo sapiens
gaauguaauccgcgaugca

SEQ ID NO: 569483 - RNA, 19 nt, Homo sapiens
gacacgcggaguucuuaaa

SEQ ID NO: 569484 - RNA, 19 nt, Homo sapiens
gagcacgccaaacgcaaga

SEQ ID NO: 569485 - RNA, 19 nt, Homo sapiens
uuacacgguuccucaaagg

SEQ ID NO: 569486 - RNA, 19 nt, Homo sapiens
gcgaugcaguuaccuacac

SEQ ID NO: 569487 - RNA, 19 nt, Homo sapiens
cggaguucuuaaaguguuu

SEQ ID NO: 569488 - RNA, 19 nt, Homo sapiens
gggcaaaggaggcgcuaag

SEQ ID NO: 569489 - RNA, 19 nt, Homo sapiens
cgggaagggucugggcaaa

SEQ ID NO: 569490 - RNA, 19 nt, Homo sapiens
uaagcgccaccgcaaaguu

SEQ ID NO: 569491 - RNA, 19 nt, Homo sapiens
guucugcgcgacaacauuc

SEQ ID NO: 569492 - RNA, 19 nt, Homo sapiens
cgaggagacacgcggaguu

SEQ ID NO: 569493 - RNA, 19 nt, Homo sapiens
cuacacggagcacgccaaa

SEQ ID NO: 569494 - RNA, 19 nt, Homo sapiens
uguaauccgcgaugcaguu

SEQ ID NO: 569495 - RNA, 19 nt, Homo sapiens
gcaagguacugagcgauaa

SEQ ID NO: 569496 - RNA, 19 nt, Homo sapiens
guacugagcgauaauauuc

SEQ ID NO: 569497 - RNA, 19 nt, Homo sapiens
caagugccaucgcaaggua

SEQ ID NO: 569498 - RNA, 19 nt, Homo sapiens
guaaggcuuuggcgguuaa

SEQ ID NO: 569499 - RNA, 19 nt, Homo sapiens
ggaaaggcggugccaagug

SEQ ID NO: 569500 - RNA, 19 nt, Homo sapiens
caucuugggccucauuuau

SEQ ID NO: 569501 - RNA, 19 nt, Homo sapiens
uggaaaaugugaucuggua

SEQ ID NO: 569502 - RNA, 19 nt, Homo sapiens
gcaucuugggccucauuua

SEQ ID NO: 569503 - RNA, 19 nt, Homo sapiens
gguacugagcgauaauauu

SEQ ID NO: 569504 - RNA, 19 nt, Homo sapiens
ggccuuuccuugcaauauc

SEQ ID NO: 569505 - RNA, 19 nt, Homo sapiens
uguaaggcuuuggcgguua

SEQ ID NO: 569506 - RNA, 19 nt, Homo sapiens
gcucaaacgccagggaaga

SEQ ID NO: 569507 - RNA, 19 nt, Homo sapiens
ggcauuaccaagugcacua

SEQ ID NO: 569508 - RNA, 19 nt, Homo sapiens
cgcaagguacugagcgaua

SEQ ID NO: 569509 - RNA, 19 nt, Homo sapiens
gcgcaucuugggccucauu

SEQ ID NO: 569510 - RNA, 19 nt, Homo sapiens
gagcacgccaagcgcaaga

SEQ ID NO: 569511 - RNA, 19 nt, Homo sapiens
ggcuuuggcgguuaaguga

SEQ ID NO: 569512 - RNA, 19 nt, Homo sapiens
ggaaaaggccuugggaaag

SEQ ID NO: 569513 - RNA, 19 nt, Homo sapiens
cuugcaauaucguuaaugg

SEQ ID NO: 569514 - RNA, 19 nt, Homo sapiens
gccaggccuuuccuugcaa

SEQ ID NO: 569515 - RNA, 19 nt, Homo sapiens
gggaaaggcggugccaagu

SEQ ID NO: 569516 - RNA, 19 nt, Homo sapiens
ggcaauggcuggcauagua

SEQ ID NO: 569517 - RNA, 19 nt, Homo sapiens
gaaggucgguaaagugcua

SEQ ID NO: 569518 - RNA, 19 nt, Homo sapiens
gcuguugucugcacucuuu

SEQ ID NO: 569519 - RNA, 19 nt, Homo sapiens
guaaagugcuaagcuguug

SEQ ID NO: 569520 - RNA, 19 nt, Homo sapiens
gcuggcaucuccaugacua

SEQ ID NO: 569521 - RNA, 19 nt, Homo sapiens
uaaagaagcaguauaaagc

SEQ ID NO: 569522 - RNA, 19 nt, Homo sapiens
gaaccaacucggccucuau

SEQ ID NO: 569523 - RNA, 19 nt, Homo sapiens
gccuaaagaagcaguauaa

SEQ ID NO: 569524 - RNA, 19 nt, Homo sapiens
ucugcacucuuucaucaua

SEQ ID NO: 569525 - RNA, 19 nt, Homo sapiens
ccucugagaucaugugagu

SEQ ID NO: 569526 - RNA, 19 nt, Homo sapiens
ugucugcacucuuucauca

SEQ ID NO: 569527 - RNA, 19 nt, Homo sapiens
caaggccuauacuggcuuu

SEQ ID NO: 569528 - RNA, 19 nt, Homo sapiens
gcaacacucaacugcauug

SEQ ID NO: 569529 - RNA, 19 nt, Homo sapiens
gauggaagccuuucuacac

SEQ ID NO: 569530 - RNA, 19 nt, Homo sapiens
ucuauucaguuuacaguca

SEQ ID NO: 569531 - RNA, 19 nt, Homo sapiens
cuaaagaagcaguauaaag

SEQ ID NO: 569532 - RNA, 19 nt, Homo sapiens
gguaaagugcuaagcuguu

SEQ ID NO: 569533 - RNA, 19 nt, Homo sapiens
gcaauggcuggcauaguau

SEQ ID NO: 569534 - RNA, 19 nt, Homo sapiens
cggccucuaucccuacuuu

SEQ ID NO: 569535 - RNA, 19 nt, Homo sapiens
ccgcaacacucaacugcau

SEQ ID NO: 569536 - RNA, 19 nt, Homo sapiens
gagagucagguuccagcua

SEQ ID NO: 569537 - RNA, 19 nt, Homo sapiens
gaacaugaccauuuucuac

SEQ ID NO: 569538 - RNA, 19 nt, Homo sapiens
gucccacucuugcucuauu

SEQ ID NO: 569539 - RNA, 19 nt, Homo sapiens
aguauggcuuccaacuaua

SEQ ID NO: 569540 - RNA, 19 nt, Homo sapiens
gcaguccauuggugugagu

SEQ ID NO: 569541 - RNA, 19 nt, Homo sapiens
gacggcagccuuggagauu

SEQ ID NO: 569542 - RNA, 19 nt, Homo sapiens
acagauggaagccuuucua

SEQ ID NO: 569543 - RNA, 19 nt, Homo sapiens
cgagguggcgacugaguga

SEQ ID NO: 569544 - RNA, 19 nt, Homo sapiens
uggcgaaggucgguaaagu

SEQ ID NO: 569545 - RNA, 19 nt, Homo sapiens
gcaguuccagggagaguca

SEQ ID NO: 569546 - RNA, 19 nt, Homo sapiens
gaggccagcaucaacaugu

SEQ ID NO: 569547 - RNA, 19 nt, Homo sapiens
ggccuaaagaagcaguaua

SEQ ID NO: 569548 - RNA, 19 nt, Homo sapiens
ggacagauggaagccuuuc

SEQ ID NO: 569549 - RNA, 19 nt, Homo sapiens
ucucugugcuguggaaugu

SEQ ID NO: 569550 - RNA, 19 nt, Homo sapiens
ggagcuaggacgcggaaca

SEQ ID NO: 569551 - RNA, 19 nt, Homo sapiens
ccugagaccuggcuuugcu

SEQ ID NO: 569552 - RNA, 19 nt, Homo sapiens
gucagguuccagcuaguua

SEQ ID NO: 569553 - RNA, 19 nt, Homo sapiens
ggccagcaucaacauguuu

SEQ ID NO: 569554 - RNA, 19 nt, Homo sapiens
gaccuugugcaguccauug

SEQ ID NO: 569555 - RNA, 19 nt, Homo sapiens
ucaacauguuuccauccuu

SEQ ID NO: 569556 - RNA, 19 nt, Homo sapiens
gugcugggaggccuuagaa

SEQ ID NO: 569557 - RNA, 19 nt, Homo sapiens
ccagaggccagcaucaaca

SEQ ID NO: 569558 - RNA, 19 nt, Homo sapiens
cugcacucuuucaucauaa

SEQ ID NO: 569559 - RNA, 19 nt, Homo sapiens
gaucaugugaguccuccau

SEQ ID NO: 569560 - RNA, 19 nt, Homo sapiens
gugcacugauggaggauac

SEQ ID NO: 569561 - RNA, 19 nt, Homo sapiens
agaaccaacucggccucua

SEQ ID NO: 569562 - RNA, 19 nt, Homo sapiens
cuauucaguuuacagucaa

SEQ ID NO: 569563 - RNA, 19 nt, Homo sapiens
ggccuauacuggcuuugag

SEQ ID NO: 569564 - RNA, 19 nt, Homo sapiens
gcucuauucaguuuacagu

SEQ ID NO: 569565 - RNA, 19 nt, Homo sapiens
ccuaaagaagcaguauaaa

SEQ ID NO: 569566 - RNA, 19 nt, Homo sapiens
cuacccagccuguggcaau

SEQ ID NO: 569567 - RNA, 19 nt, Homo sapiens
gagcuaggacgcggaacau

SEQ ID NO: 569568 - RNA, 19 nt, Homo sapiens
cagaagaccuuuccagauu

SEQ ID NO: 569569 - RNA, 19 nt, Homo sapiens
ugaagaacaugaagucuga

SEQ ID NO: 569570 - RNA, 19 nt, Homo sapiens
gcaagaggcugcgugagaa

SEQ ID NO: 569571 - RNA, 19 nt, Homo sapiens
gcucuggacuggauauuuc

SEQ ID NO: 569572 - RNA, 19 nt, Homo sapiens
agagggagcuugccuugaa

SEQ ID NO: 569573 - RNA, 19 nt, Homo sapiens
ugaagaugcugaagucuca

SEQ ID NO: 569574 - RNA, 19 nt, Homo sapiens
gaacugagaauuacaccau

SEQ ID NO: 569575 - RNA, 19 nt, Homo sapiens
uggcagagcugaagaagca

SEQ ID NO: 569576 - RNA, 19 nt, Homo sapiens
gagcagauccguucgaagu

SEQ ID NO: 569577 - RNA, 19 nt, Homo sapiens
ggaaagagcagagcagauc

SEQ ID NO: 569578 - RNA, 19 nt, Homo sapiens
gcaugcagcuggaggaaag

SEQ ID NO: 569579 - RNA, 19 nt, Homo sapiens
ccaggaagccaaucagaaa

SEQ ID NO: 569580 - RNA, 19 nt, Homo sapiens
ccacagggcagcagcauga

SEQ ID NO: 569581 - RNA, 19 nt, Homo sapiens
gaaacaaagagcagacaug

SEQ ID NO: 569582 - RNA, 19 nt, Homo sapiens
uggaagggcugcagaggaa

SEQ ID NO: 569583 - RNA, 19 nt, Homo sapiens
caugaagucugagcuggua

SEQ ID NO: 569584 - RNA, 19 nt, Homo sapiens
gcuuggagcuggagaacga

SEQ ID NO: 569585 - RNA, 19 nt, Homo sapiens
agaccaagauccaggaguu

SEQ ID NO: 569586 - RNA, 19 nt, Homo sapiens
ugagaucuuugaacaacuu

SEQ ID NO: 569587 - RNA, 19 nt, Homo sapiens
ccaaggagcgggacgguau

SEQ ID NO: 569588 - RNA, 19 nt, Homo sapiens
cgaaagcaaccauggaaga

SEQ ID NO: 569589 - RNA, 19 nt, Homo sapiens
gaccagagcaggaccaaag

SEQ ID NO: 569590 - RNA, 19 nt, Homo sapiens
caucaggacuccagaagac

SEQ ID NO: 569591 - RNA, 19 nt, Homo sapiens
gggaggcucuggacuggau

SEQ ID NO: 569592 - RNA, 19 nt, Homo sapiens
uauccacccugagaucuuu

SEQ ID NO: 569593 - RNA, 19 nt, Homo sapiens
gugccgagcugaagaacca

SEQ ID NO: 569594 - RNA, 19 nt, Homo sapiens
gcgggaggcugaggauaug

SEQ ID NO: 569595 - RNA, 19 nt, Homo sapiens
gaagaccuuuccagauucg

SEQ ID NO: 569596 - RNA, 19 nt, Homo sapiens
augcagcgauugugaagaa

SEQ ID NO: 569597 - RNA, 19 nt, Homo sapiens
gaccacgagcagcagauua

SEQ ID NO: 569598 - RNA, 19 nt, Homo sapiens
cagagcagauccguucgaa

SEQ ID NO: 569599 - RNA, 19 nt, Homo sapiens
cugaggauauggugcagaa

SEQ ID NO: 569600 - RNA, 19 nt, Homo sapiens
ccagaagaccuuuccagau

SEQ ID NO: 569601 - RNA, 19 nt, Homo sapiens
agaagaccuuuccagauuc

SEQ ID NO: 569602 - RNA, 19 nt, Homo sapiens
ggagauggagcugaagaug

SEQ ID NO: 569603 - RNA, 19 nt, Homo sapiens
ccaggcgacugcucaucuu

SEQ ID NO: 569604 - RNA, 19 nt, Homo sapiens
cagacaugcuggagaugga

SEQ ID NO: 569605 - RNA, 19 nt, Homo sapiens
agauggagcugagucacaa

SEQ ID NO: 569606 - RNA, 19 nt, Homo sapiens
gaaggucgaggagcuggaa

SEQ ID NO: 569607 - RNA, 19 nt, Homo sapiens
gagcugaagaugcugaagu

SEQ ID NO: 569608 - RNA, 19 nt, Homo sapiens
cuucagacuuggacugugu

SEQ ID NO: 569609 - RNA, 19 nt, Homo sapiens
aaaaucuucuccccuaaaa

SEQ ID NO: 569610 - RNA, 19 nt, Homo sapiens
gccaggaagccaaucagaa

SEQ ID NO: 569611 - RNA, 19 nt, Homo sapiens
caagaggcugcgugagaaa

SEQ ID NO: 569612 - RNA, 19 nt, Homo sapiens
ggcgacugcucaucuucaa

SEQ ID NO: 569613 - RNA, 19 nt, Homo sapiens
gcaucaggacuccagaaga

SEQ ID NO: 569614 - RNA, 19 nt, Homo sapiens
agagcaggaugcagcgauu

SEQ ID NO: 569615 - RNA, 19 nt, Homo sapiens
ccugagaucuuugaacaac

SEQ ID NO: 569616 - RNA, 19 nt, Homo sapiens
gagagugccgagcugaaga

SEQ ID NO: 569617 - RNA, 19 nt, Homo sapiens
gagcaucaggacuccagaa

SEQ ID NO: 569618 - RNA, 19 nt, Homo sapiens
gaaagcaaccauggaagac

SEQ ID NO: 569619 - RNA, 19 nt, Homo sapiens
agauggagcugaagaugcu

SEQ ID NO: 569620 - RNA, 19 nt, Homo sapiens
acccugagaucuuugaaca

SEQ ID NO: 569621 - RNA, 19 nt, Homo sapiens
ucaccacggagaaccagua

SEQ ID NO: 569622 - RNA, 19 nt, Homo sapiens
cggacacgcucagguugaa

SEQ ID NO: 569623 - RNA, 19 nt, Homo sapiens
gagggagcuugccuugaag

SEQ ID NO: 569624 - RNA, 19 nt, Homo sapiens
ggagagugccgagcugaag

SEQ ID NO: 569625 - RNA, 19 nt, Homo sapiens
gaccaucaacgcacugaag

SEQ ID NO: 569626 - RNA, 19 nt, Homo sapiens
gggagaaaaugcagaugga

SEQ ID NO: 569627 - RNA, 19 nt, Homo sapiens
gcggacacgcucagguuga

SEQ ID NO: 569628 - RNA, 19 nt, Homo sapiens
gcgauugugaagaacauga

SEQ ID NO: 569629 - RNA, 19 nt, Homo sapiens
cagcgauugugaagaacau

SEQ ID NO: 569630 - RNA, 19 nt, Homo sapiens
guuccaagaugcagcuacu

SEQ ID NO: 569631 - RNA, 19 nt, Homo sapiens
gcucaccggcuaccagauc

SEQ ID NO: 569632 - RNA, 19 nt, Homo sapiens
gaagaagcagguggagagu

SEQ ID NO: 569633 - RNA, 19 nt, Homo sapiens
guccagcucugccgaacag

SEQ ID NO: 569634 - RNA, 19 nt, Homo sapiens
caggaugcagcgauuguga

SEQ ID NO: 569635 - RNA, 19 nt, Homo sapiens
cagcuggaccugcaacaca

SEQ ID NO: 569636 - RNA, 19 nt, Homo sapiens
gcagagcagauccguucga

SEQ ID NO: 569637 - RNA, 19 nt, Homo sapiens
ggaugcagcgauugugaag

SEQ ID NO: 569638 - RNA, 19 nt, Homo sapiens
gaagcugucccugcaagag

SEQ ID NO: 569639 - RNA, 19 nt, Homo sapiens
gagcaugcagcuggaggaa

SEQ ID NO: 569640 - RNA, 19 nt, Homo sapiens
gaagaaccagcggcucaag

SEQ ID NO: 569641 - RNA, 19 nt, Homo sapiens
ggagguggcagagcugaag

SEQ ID NO: 569642 - RNA, 19 nt, Homo sapiens
ggcagugucagcagaacuu

SEQ ID NO: 569643 - RNA, 19 nt, Homo sapiens
ggcagcagcaugacugaca

SEQ ID NO: 569644 - RNA, 19 nt, Homo sapiens
agaaccagcggcucaagga

SEQ ID NO: 569645 - RNA, 19 nt, Homo sapiens
ccuuuggucuccaggacuu

SEQ ID NO: 569646 - RNA, 19 nt, Homo sapiens
gcagcaugacugacagaca

SEQ ID NO: 569647 - RNA, 19 nt, Homo sapiens
gggaggccagaaacaaaga

SEQ ID NO: 569648 - RNA, 19 nt, Homo sapiens
caacgggcugcuccaggaa

SEQ ID NO: 569649 - RNA, 19 nt, Homo sapiens
gagcaggaugcagcgauug

SEQ ID NO: 569650 - RNA, 19 nt, Homo sapiens
accacgagcagcagauuaa

SEQ ID NO: 569651 - RNA, 19 nt, Homo sapiens
gggcggaggagaagaugca

SEQ ID NO: 569652 - RNA, 19 nt, Homo sapiens
gacauaaagccaucucuua

SEQ ID NO: 569653 - RNA, 19 nt, Homo sapiens
gaggagauacaagauauua

SEQ ID NO: 569654 - RNA, 19 nt, Homo sapiens
caacuuaacagcuuacaug

SEQ ID NO: 569655 - RNA, 19 nt, Homo sapiens
cagcagacccuuugauuug

SEQ ID NO: 569656 - RNA, 19 nt, Homo sapiens
gcacagaugaccuaaggaa

SEQ ID NO: 569657 - RNA, 19 nt, Homo sapiens
ggagacacauccagacagu

SEQ ID NO: 569658 - RNA, 19 nt, Homo sapiens
agccaucucuuauugguua

SEQ ID NO: 569659 - RNA, 19 nt, Homo sapiens
gggaccaaauaauagcuua

SEQ ID NO: 569660 - RNA, 19 nt, Homo sapiens
cgaaagaacaaaucaugaa

SEQ ID NO: 569661 - RNA, 19 nt, Homo sapiens
ugacaaagaggaggagaua

SEQ ID NO: 569662 - RNA, 19 nt, Homo sapiens
ugagcaauguaguaacuuu

SEQ ID NO: 569663 - RNA, 19 nt, Homo sapiens
gaggaggagauacaagaua

SEQ ID NO: 569664 - RNA, 19 nt, Homo sapiens
ugauuuggcuagcugauug

SEQ ID NO: 569665 - RNA, 19 nt, Homo sapiens
cuuaacagcuuacaugagu

SEQ ID NO: 569666 - RNA, 19 nt, Homo sapiens
guacuucuacuguuugaga

SEQ ID NO: 569667 - RNA, 19 nt, Homo sapiens
ccucagauauauguagaaa

SEQ ID NO: 569668 - RNA, 19 nt, Homo sapiens
gaaggacucacagagcuuu

SEQ ID NO: 569669 - RNA, 19 nt, Homo sapiens
ccuaacaaacccaaacuuu

SEQ ID NO: 569670 - RNA, 19 nt, Homo sapiens
uauguuuccugaagugauu

SEQ ID NO: 569671 - RNA, 19 nt, Homo sapiens
ggaaagagaaauacguuuu

SEQ ID NO: 569672 - RNA, 19 nt, Homo sapiens
ggacucacagagcuuugua

SEQ ID NO: 569673 - RNA, 19 nt, Homo sapiens
gacaagcugcuaaggacua

SEQ ID NO: 569674 - RNA, 19 nt, Homo sapiens
gaaagaacaaaucaugaac

SEQ ID NO: 569675 - RNA, 19 nt, Homo sapiens
ccagcagacccuuugauuu

SEQ ID NO: 569676 - RNA, 19 nt, Homo sapiens
caauuuauggcacagauga

SEQ ID NO: 569677 - RNA, 19 nt, Homo sapiens
ccaaauaauagcuuaguag

SEQ ID NO: 569678 - RNA, 19 nt, Homo sapiens
ccacuugucgccaugauau

SEQ ID NO: 569679 - RNA, 19 nt, Homo sapiens
aggaggagauacaagauau

SEQ ID NO: 569680 - RNA, 19 nt, Homo sapiens
ggcuguacuucuacuguuu

SEQ ID NO: 569681 - RNA, 19 nt, Homo sapiens
auaaaaggcuguacuucua

SEQ ID NO: 569682 - RNA, 19 nt, Homo sapiens
gcacuucaugggaguaaug

SEQ ID NO: 569683 - RNA, 19 nt, Homo sapiens
guugagcccauuccaauug

SEQ ID NO: 569684 - RNA, 19 nt, Homo sapiens
gcggaaagagaaauacguu

SEQ ID NO: 569685 - RNA, 19 nt, Homo sapiens
acagaugaccuaaggaaug

SEQ ID NO: 569686 - RNA, 19 nt, Homo sapiens
caugaguucuggaccacuu

SEQ ID NO: 569687 - RNA, 19 nt, Homo sapiens
gauccggauucaccauugu

SEQ ID NO: 569688 - RNA, 19 nt, Homo sapiens
ggaggagauacaagauauu

SEQ ID NO: 569689 - RNA, 19 nt, Homo sapiens
acaaagaggaggagauaca

SEQ ID NO: 569690 - RNA, 19 nt, Homo sapiens
caaagaggaggagauacaa

SEQ ID NO: 569691 - RNA, 19 nt, Homo sapiens
caccucagauauauguaga

SEQ ID NO: 569692 - RNA, 19 nt, Homo sapiens
caaaccagauauuguugac

SEQ ID NO: 569693 - RNA, 19 nt, Homo sapiens
uggcacagaugaccuaagg

SEQ ID NO: 569694 - RNA, 19 nt, Homo sapiens
cauaauggagauaucaaug

SEQ ID NO: 569695 - RNA, 19 nt, Homo sapiens
gcccugagcaauguaguaa

SEQ ID NO: 569696 - RNA, 19 nt, Homo sapiens
uaacagcuuacaugaguuc

SEQ ID NO: 569697 - RNA, 19 nt, Homo sapiens
cugcuaaggacuauuuaaa

SEQ ID NO: 569698 - RNA, 19 nt, Homo sapiens
cagaugaccuaaggaaugc

SEQ ID NO: 569699 - RNA, 19 nt, Homo sapiens
aaagccaucucuuauuggu

SEQ ID NO: 569700 - RNA, 19 nt, Homo sapiens
ccauccaauuguagaagaa

SEQ ID NO: 569701 - RNA, 19 nt, Homo sapiens
ggcaauuuauggcacagau

SEQ ID NO: 569702 - RNA, 19 nt, Homo sapiens
ccuaaggaaugcacuucau

SEQ ID NO: 569703 - RNA, 19 nt, Homo sapiens
aagcugcuaaggacuauuu

SEQ ID NO: 569704 - RNA, 19 nt, Homo sapiens
caauuggacaagcugcuaa

SEQ ID NO: 569705 - RNA, 19 nt, Homo sapiens
aagaggaggagauacaaga

SEQ ID NO: 569706 - RNA, 19 nt, Homo sapiens
gacagucugagggcaauuu

SEQ ID NO: 569707 - RNA, 19 nt, Homo sapiens
ccugagcaauguaguaacu

SEQ ID NO: 569708 - RNA, 19 nt, Homo sapiens
ucgaaagaacaaaucauga

SEQ ID NO: 569709 - RNA, 19 nt, Homo sapiens
gcugcuaaggacuauuuaa

SEQ ID NO: 569710 - RNA, 19 nt, Homo sapiens
uuccugaagugauuguuga

SEQ ID NO: 569711 - RNA, 19 nt, Homo sapiens
ccaauuggacaagcugcua

SEQ ID NO: 569712 - RNA, 19 nt, Homo sapiens
gcaauuuauggcacagaug

SEQ ID NO: 569713 - RNA, 19 nt, Homo sapiens
ggauucaccauuguucaga

SEQ ID NO: 569714 - RNA, 19 nt, Homo sapiens
caucucuuauugguuagaa

SEQ ID NO: 569715 - RNA, 19 nt, Homo sapiens
agacauaaagccaucucuu

SEQ ID NO: 569716 - RNA, 19 nt, Homo sapiens
gaccaaauaauagcuuagu

SEQ ID NO: 569717 - RNA, 19 nt, Homo sapiens
gccaugauauuagcuagac

SEQ ID NO: 569718 - RNA, 19 nt, Homo sapiens
guuuaaguaacuaccagua

SEQ ID NO: 569719 - RNA, 19 nt, Homo sapiens
caauuguagaagaaccuua

SEQ ID NO: 569720 - RNA, 19 nt, Homo sapiens
auucuuagauccggauuca

SEQ ID NO: 569721 - RNA, 19 nt, Homo sapiens
uuacauauaaugccaacuc

SEQ ID NO: 569722 - RNA, 19 nt, Homo sapiens
acaagcugcuaaggacuau

SEQ ID NO: 569723 - RNA, 19 nt, Homo sapiens
gaccacuugucgccaugau

SEQ ID NO: 569724 - RNA, 19 nt, Homo sapiens
caccauuguucagagaaga

SEQ ID NO: 569725 - RNA, 19 nt, Homo sapiens
cuaaggaaugcacuucaug

SEQ ID NO: 569726 - RNA, 19 nt, Homo sapiens
cggaaagagaaauacguuu

SEQ ID NO: 569727 - RNA, 19 nt, Homo sapiens
acagucugagggcaauuua

SEQ ID NO: 569728 - RNA, 19 nt, Homo sapiens
gccuccaccucagauauau

SEQ ID NO: 569729 - RNA, 19 nt, Homo sapiens
agauccggauucaccauug

SEQ ID NO: 569730 - RNA, 19 nt, Homo sapiens
gcuguacuucuacuguuug

SEQ ID NO: 569731 - RNA, 19 nt, Homo sapiens
aggcuguacuucuacuguu

SEQ ID NO: 569732 - RNA, 19 nt, Homo sapiens
ucaccauuguucagagaag

SEQ ID NO: 569733 - RNA, 19 nt, Homo sapiens
ggaccaaauaauagcuuag

SEQ ID NO: 569734 - RNA, 19 nt, Homo sapiens
acuugucgccaugauauua

SEQ ID NO: 569735 - RNA, 19 nt, Homo sapiens
gcagauguauuucaugaua

SEQ ID NO: 569736 - RNA, 19 nt, Homo sapiens
ggucuugggugauuggaaa

SEQ ID NO: 569737 - RNA, 19 nt, Homo sapiens
gcacguauuuccgcccuuu

SEQ ID NO: 569738 - RNA, 19 nt, Homo sapiens
ccacuucacuacacaacaa

SEQ ID NO: 569739 - RNA, 19 nt, Homo sapiens
uaacacagacagcuauauu

SEQ ID NO: 569740 - RNA, 19 nt, Homo sapiens
caacuucuacugugacauu

SEQ ID NO: 569741 - RNA, 19 nt, Homo sapiens
uaacgcagauguauuucau

SEQ ID NO: 569742 - RNA, 19 nt, Homo sapiens
guucugacauccacuuuca

SEQ ID NO: 569743 - RNA, 19 nt, Homo sapiens
ucuuguaucuggcuuauug

SEQ ID NO: 569744 - RNA, 19 nt, Homo sapiens
gaaaauaaccaguccucua

SEQ ID NO: 569745 - RNA, 19 nt, Homo sapiens
ccauuacuaugcaucauug

SEQ ID NO: 569746 - RNA, 19 nt, Homo sapiens
gcagcaaauccaucucuuu

SEQ ID NO: 569747 - RNA, 19 nt, Homo sapiens
ucacgguugucucuuugua

SEQ ID NO: 569748 - RNA, 19 nt, Homo sapiens
acgcagauguauuucauga

SEQ ID NO: 569749 - RNA, 19 nt, Homo sapiens
gccuaacgcagauguauuu

SEQ ID NO: 569750 - RNA, 19 nt, Homo sapiens
ugagaaaucgggacaugaa

SEQ ID NO: 569751 - RNA, 19 nt, Homo sapiens
gcaucauugucuccuauau

SEQ ID NO: 569752 - RNA, 19 nt, Homo sapiens
uggcugcaauggcauauga

SEQ ID NO: 569753 - RNA, 19 nt, Homo sapiens
gcaggaacaggaagauuuc

SEQ ID NO: 569754 - RNA, 19 nt, Homo sapiens
gguugucucuuuguauuau

SEQ ID NO: 569755 - RNA, 19 nt, Homo sapiens
gcagugaccccaauguuaa

SEQ ID NO: 569756 - RNA, 19 nt, Homo sapiens
cagcuagucuguccuucug

SEQ ID NO: 569757 - RNA, 19 nt, Homo sapiens
uuggaaaccugcucauugu

SEQ ID NO: 569758 - RNA, 19 nt, Homo sapiens
ggucuuguaucuggcuuau

SEQ ID NO: 569759 - RNA, 19 nt, Homo sapiens
gcucugauguucgccuuca

SEQ ID NO: 569760 - RNA, 19 nt, Homo sapiens
ugcggaaacucuucaacaa

SEQ ID NO: 569761 - RNA, 19 nt, Homo sapiens
caucauugucuccuauauu

SEQ ID NO: 569762 - RNA, 19 nt, Homo sapiens
gguaacacagacagcuaua

SEQ ID NO: 569763 - RNA, 19 nt, Homo sapiens
gccauuugcucugauguuc

SEQ ID NO: 569764 - RNA, 19 nt, Homo sapiens
cuucacuacacaacaauua

SEQ ID NO: 569765 - RNA, 19 nt, Homo sapiens
cuaagaugcuggccaacca

SEQ ID NO: 569766 - RNA, 19 nt, Homo sapiens
guugacaucuucuucucau

SEQ ID NO: 569767 - RNA, 19 nt, Homo sapiens
caucuacagucugagaaau

SEQ ID NO: 569768 - RNA, 19 nt, Homo sapiens
ccucuacacuggaauucau

SEQ ID NO: 569769 - RNA, 19 nt, Homo sapiens
acgguugucucuuuguauu

SEQ ID NO: 569770 - RNA, 19 nt, Homo sapiens
ccucacgguugucucuuug

SEQ ID NO: 569771 - RNA, 19 nt, Homo sapiens
cagauguauuucaugauag

SEQ ID NO: 569772 - RNA, 19 nt, Homo sapiens
aucauugucuccuauauuc

SEQ ID NO: 569773 - RNA, 19 nt, Homo sapiens
uggccaacuucuacuguga

SEQ ID NO: 569774 - RNA, 19 nt, Homo sapiens
ucacuacacaacaauuaug

SEQ ID NO: 569775 - RNA, 19 nt, Homo sapiens
gcucauuguccuagccauu

SEQ ID NO: 569776 - RNA, 19 nt, Homo sapiens
gaccaauuauagccuaaaa

SEQ ID NO: 569777 - RNA, 19 nt, Homo sapiens
uugcugaaguuauccuguu

SEQ ID NO: 569778 - RNA, 19 nt, Homo sapiens
gauuggaaaccugcucauu

SEQ ID NO: 569779 - RNA, 19 nt, Homo sapiens
ggcagcaaauccaucucuu

SEQ ID NO: 569780 - RNA, 19 nt, Homo sapiens
ucauuguccuagccauuug

SEQ ID NO: 569781 - RNA, 19 nt, Homo sapiens
gaaggcugcccugcggaaa

SEQ ID NO: 569782 - RNA, 19 nt, Homo sapiens
gccauuacuaugcaucauu

SEQ ID NO: 569783 - RNA, 19 nt, Homo sapiens
guuauccuguucugacauc

SEQ ID NO: 569784 - RNA, 19 nt, Homo sapiens
cagcaaauccaucucuuuu

SEQ ID NO: 569785 - RNA, 19 nt, Homo sapiens
ucugagaaaucgggacaug

SEQ ID NO: 569786 - RNA, 19 nt, Homo sapiens
gcccuuugaccaauuauag

SEQ ID NO: 569787 - RNA, 19 nt, Homo sapiens
guucccaccucacgguugu

SEQ ID NO: 569788 - RNA, 19 nt, Homo sapiens
ggcagugaccccaauguua

SEQ ID NO: 569789 - RNA, 19 nt, Homo sapiens
gcggaaacucuucaacaag

SEQ ID NO: 569790 - RNA, 19 nt, Homo sapiens
cuacauccucuuccuguuc

SEQ ID NO: 569791 - RNA, 19 nt, Homo sapiens
guaauguacacggcaguga

SEQ ID NO: 569792 - RNA, 19 nt, Homo sapiens
ccaauuauagccuaaaaga

SEQ ID NO: 569793 - RNA, 19 nt, Homo sapiens
uacauccucuuccuguuca

SEQ ID NO: 569794 - RNA, 19 nt, Homo sapiens
cauuuucucugugccauua

SEQ ID NO: 569795 - RNA, 19 nt, Homo sapiens
cuacacaacaauuaugagu

SEQ ID NO: 569796 - RNA, 19 nt, Homo sapiens
acacagacagcuauauuuu

SEQ ID NO: 569797 - RNA, 19 nt, Homo sapiens
agcaggaacaggaagauuu

SEQ ID NO: 569798 - RNA, 19 nt, Homo sapiens
aacacagacagcuauauuu

SEQ ID NO: 569799 - RNA, 19 nt, Homo sapiens
cgguaaccaucccuaagau

SEQ ID NO: 569800 - RNA, 19 nt, Homo sapiens
guaacacagacagcuauau

SEQ ID NO: 569801 - RNA, 19 nt, Homo sapiens
ggguaacacagacagcuau

SEQ ID NO: 569802 - RNA, 19 nt, Homo sapiens
ucgguaaccaucccuaaga

SEQ ID NO: 569803 - RNA, 19 nt, Homo sapiens
caucgguaaccaucccuaa

SEQ ID NO: 569804 - RNA, 19 nt, Homo sapiens
cgagucuucuccacagucu

SEQ ID NO: 569805 - RNA, 19 nt, Homo sapiens
gccaacuucuacugugaca

SEQ ID NO: 569806 - RNA, 19 nt, Homo sapiens
cacuacacaacaauuauga

SEQ ID NO: 569807 - RNA, 19 nt, Homo sapiens
uccucuuccuguucauuua

SEQ ID NO: 569808 - RNA, 19 nt, Homo sapiens
gagaaaucgggacaugaag

SEQ ID NO: 569809 - RNA, 19 nt, Homo sapiens
ucacauugauuggaaaccu

SEQ ID NO: 569810 - RNA, 19 nt, Homo sapiens
gaacaaagccaucuccuau

SEQ ID NO: 569811 - RNA, 19 nt, Homo sapiens
ucacugaccucuucuuugu

SEQ ID NO: 569812 - RNA, 19 nt, Homo sapiens
ggagauaaccagagugaga

SEQ ID NO: 569813 - RNA, 19 nt, Homo sapiens
ccaagaugcuggugaacuu

SEQ ID NO: 569814 - RNA, 19 nt, Homo sapiens
ggauguuccuguccaugua

SEQ ID NO: 569815 - RNA, 19 nt, Homo sapiens
gaaaugugcucaucauccu

SEQ ID NO: 569816 - RNA, 19 nt, Homo sapiens
caaaugcccucggccucua

SEQ ID NO: 569817 - RNA, 19 nt, Homo sapiens
ggauggagauaaccagagu

SEQ ID NO: 569818 - RNA, 19 nt, Homo sapiens
ucagaaccauccuucaaau

SEQ ID NO: 569819 - RNA, 19 nt, Homo sapiens
cuccauaccuacuccauga

SEQ ID NO: 569820 - RNA, 19 nt, Homo sapiens
ugacacagcucuacuuccu

SEQ ID NO: 569821 - RNA, 19 nt, Homo sapiens
gagauaaccagagugagaa

SEQ ID NO: 569822 - RNA, 19 nt, Homo sapiens
caccuaugaugaacccuuu

SEQ ID NO: 569823 - RNA, 19 nt, Homo sapiens
ucacggugcugggaaaugu

SEQ ID NO: 569824 - RNA, 19 nt, Homo sapiens
gugcugacaccuaugauga

SEQ ID NO: 569825 - RNA, 19 nt, Homo sapiens
acaaagccaucuccuaugc

SEQ ID NO: 569826 - RNA, 19 nt, Homo sapiens
uccacuaccucuucuguga

SEQ ID NO: 569827 - RNA, 19 nt, Homo sapiens
gauggcguaugaucgcuau

SEQ ID NO: 569828 - RNA, 19 nt, Homo sapiens
gauguaugcugugcugaca

SEQ ID NO: 569829 - RNA, 19 nt, Homo sapiens
gcccucggccucuaagaaa

SEQ ID NO: 569830 - RNA, 19 nt, Homo sapiens
gucagaaccauccuucaaa

SEQ ID NO: 569831 - RNA, 19 nt, Homo sapiens
cuauguacguauugucaga

SEQ ID NO: 569832 - RNA, 19 nt, Homo sapiens
ccucggccucuaagaaaua

SEQ ID NO: 569833 - RNA, 19 nt, Homo sapiens
gagauccacuaccucuucu

SEQ ID NO: 569834 - RNA, 19 nt, Homo sapiens
guucaugaccacauccuau

SEQ ID NO: 569835 - RNA, 19 nt, Homo sapiens
caucuuccucacccucuua

SEQ ID NO: 569836 - RNA, 19 nt, Homo sapiens
gaacuuccagucccagaac

SEQ ID NO: 569837 - RNA, 19 nt, Homo sapiens
ggacgcuugcuauggugua

SEQ ID NO: 569838 - RNA, 19 nt, Homo sapiens
agaacaaagccaucuccua

SEQ ID NO: 569839 - RNA, 19 nt, Homo sapiens
gcugggaaaugugcucauc

SEQ ID NO: 569840 - RNA, 19 nt, Homo sapiens
gguguggucucccucuuuu

SEQ ID NO: 569841 - RNA, 19 nt, Homo sapiens
gauccacuaccucuucugu

SEQ ID NO: 569842 - RNA, 19 nt, Homo sapiens
cuauggagacccuuucaga

SEQ ID NO: 569843 - RNA, 19 nt, Homo sapiens
gcugugcugacaccuauga

SEQ ID NO: 569844 - RNA, 19 nt, Homo sapiens
ccucuucugugacauguac

SEQ ID NO: 569845 - RNA, 19 nt, Homo sapiens
ugaccagggugaccuucug

SEQ ID NO: 569846 - RNA, 19 nt, Homo sapiens
ugucagaaccauccuucaa

SEQ ID NO: 569847 - RNA, 19 nt, Homo sapiens
ccaacacccacaucauuca

SEQ ID NO: 569848 - RNA, 19 nt, Homo sapiens
gcagcagcagauccuguuu

SEQ ID NO: 569849 - RNA, 19 nt, Homo sapiens
cuaccugugccucgcauuu

SEQ ID NO: 569850 - RNA, 19 nt, Homo sapiens
ugggaaaugugcucaucau

SEQ ID NO: 569851 - RNA, 19 nt, Homo sapiens
uggccgugauggcguauga

SEQ ID NO: 569852 - RNA, 19 nt, Homo sapiens
cagaaccauccuucaaaug

SEQ ID NO: 569853 - RNA, 19 nt, Homo sapiens
cuccuucacugaccucuuc

SEQ ID NO: 569854 - RNA, 19 nt, Homo sapiens
cauccuauguacguauugu

SEQ ID NO: 569855 - RNA, 19 nt, Homo sapiens
gcugacaccuaugaugaac

SEQ ID NO: 569856 - RNA, 19 nt, Homo sapiens
ggguguggucucccucuuu

SEQ ID NO: 569857 - RNA, 19 nt, Homo sapiens
guacguauugucagaacca

SEQ ID NO: 569858 - RNA, 19 nt, Homo sapiens
ggcguaugaucgcuaugug

SEQ ID NO: 569859 - RNA, 19 nt, Homo sapiens
cagcagauccuguuuugga

SEQ ID NO: 569860 - RNA, 19 nt, Homo sapiens
gaacaaagccaucuccuau

SEQ ID NO: 569861 - RNA, 19 nt, Homo sapiens
ucacugaccucuucuuugu

SEQ ID NO: 569862 - RNA, 19 nt, Homo sapiens
ggagauaaccagagugaga

SEQ ID NO: 569863 - RNA, 19 nt, Homo sapiens
ccaagaugcuggugaacuu

SEQ ID NO: 569864 - RNA, 19 nt, Homo sapiens
ggauguuccuguccaugua

SEQ ID NO: 569865 - RNA, 19 nt, Homo sapiens
gaaaugugcucaucauccu

SEQ ID NO: 569866 - RNA, 19 nt, Homo sapiens
caaaugcccucggccucua

SEQ ID NO: 569867 - RNA, 19 nt, Homo sapiens
ggauggagauaaccagagu

SEQ ID NO: 569868 - RNA, 19 nt, Homo sapiens
ucagaaccauccuucaaau

SEQ ID NO: 569869 - RNA, 19 nt, Homo sapiens
cuccauaccuacuccauga

SEQ ID NO: 569870 - RNA, 19 nt, Homo sapiens
ugacacagcucuacuuccu

SEQ ID NO: 569871 - RNA, 19 nt, Homo sapiens
gagauaaccagagugagaa

SEQ ID NO: 569872 - RNA, 19 nt, Homo sapiens
caccuaugaugaacccuuu

SEQ ID NO: 569873 - RNA, 19 nt, Homo sapiens
ucacggugcugggaaaugu

SEQ ID NO: 569874 - RNA, 19 nt, Homo sapiens
gugcugacaccuaugauga

SEQ ID NO: 569875 - RNA, 19 nt, Homo sapiens
acaaagccaucuccuaugc

SEQ ID NO: 569876 - RNA, 19 nt, Homo sapiens
uccacuaccucuucuguga

SEQ ID NO: 569877 - RNA, 19 nt, Homo sapiens
gauggcguaugaucgcuau

SEQ ID NO: 569878 - RNA, 19 nt, Homo sapiens
gauguaugcugugcugaca

SEQ ID NO: 569879 - RNA, 19 nt, Homo sapiens
gcccucggccucuaagaaa

SEQ ID NO: 569880 - RNA, 19 nt, Homo sapiens
gucagaaccauccuucaaa

SEQ ID NO: 569881 - RNA, 19 nt, Homo sapiens
cuauguacguauugucaga

SEQ ID NO: 569882 - RNA, 19 nt, Homo sapiens
ccucggccucuaagaaaua

SEQ ID NO: 569883 - RNA, 19 nt, Homo sapiens
gagauccacuaccucuucu

SEQ ID NO: 569884 - RNA, 19 nt, Homo sapiens
guucaugaccacauccuau

SEQ ID NO: 569885 - RNA, 19 nt, Homo sapiens
gaacuuccagucccagaac

SEQ ID NO: 569886 - RNA, 19 nt, Homo sapiens
ggacgcuugcuauggugua

SEQ ID NO: 569887 - RNA, 19 nt, Homo sapiens
agaacaaagccaucuccua

SEQ ID NO: 569888 - RNA, 19 nt, Homo sapiens
gcugggaaaugugcucauc

SEQ ID NO: 569889 - RNA, 19 nt, Homo sapiens
gguguggucucccucuuuu

SEQ ID NO: 569890 - RNA, 19 nt, Homo sapiens
gauccacuaccucuucugu

SEQ ID NO: 569891 - RNA, 19 nt, Homo sapiens
cuauggagacccuuucaga

SEQ ID NO: 569892 - RNA, 19 nt, Homo sapiens
gcugugcugacaccuauga

SEQ ID NO: 569893 - RNA, 19 nt, Homo sapiens
ccucuucugugacauguac

SEQ ID NO: 569894 - RNA, 19 nt, Homo sapiens
ugaccagggugaccuucug

SEQ ID NO: 569895 - RNA, 19 nt, Homo sapiens
ucuacaggcugaggaacaa

SEQ ID NO: 569896 - RNA, 19 nt, Homo sapiens
ugucagaaccauccuucaa

SEQ ID NO: 569897 - RNA, 19 nt, Homo sapiens
ccaacacccacaucauuca

SEQ ID NO: 569898 - RNA, 19 nt, Homo sapiens
ugggaaaugugcucaucau

SEQ ID NO: 569899 - RNA, 19 nt, Homo sapiens
cuaccugugccucccauuu

SEQ ID NO: 569900 - RNA, 19 nt, Homo sapiens
uggccgugauggcguauga

SEQ ID NO: 569901 - RNA, 19 nt, Homo sapiens
cagaaccauccuucaaaug

SEQ ID NO: 569902 - RNA, 19 nt, Homo sapiens
cuccuucacugaccucuuc

SEQ ID NO: 569903 - RNA, 19 nt, Homo sapiens
gcugaggaacaaagacaug

SEQ ID NO: 569904 - RNA, 19 nt, Homo sapiens
cauccuauguacguauugu

SEQ ID NO: 569905 - RNA, 19 nt, Homo sapiens
gcagcagcggauccuguuu

SEQ ID NO: 569906 - RNA, 19 nt, Homo sapiens
gcugacaccuaugaugaac

SEQ ID NO: 569907 - RNA, 19 nt, Homo sapiens
ggguguggucucccucuuu

SEQ ID NO: 569908 - RNA, 19 nt, Homo sapiens
guacguauugucagaacca

SEQ ID NO: 569909 - RNA, 19 nt, Homo sapiens
ggcguaugaucgcuaugug

SEQ ID NO: 569910 - RNA, 19 nt, Homo sapiens
uaccugugccucccauuug

SEQ ID NO: 569911 - RNA, 19 nt, Homo sapiens
gcuaauaguucuacucuaa

SEQ ID NO: 569912 - RNA, 19 nt, Homo sapiens
gcagagucauucaucagaa

SEQ ID NO: 569913 - RNA, 19 nt, Homo sapiens
gcacuacaccgccaucaug

SEQ ID NO: 569914 - RNA, 19 nt, Homo sapiens
guuacacacuuuacucaug

SEQ ID NO: 569915 - RNA, 19 nt, Homo sapiens
guuaaugaaugggugauau

SEQ ID NO: 569916 - RNA, 19 nt, Homo sapiens
ccacacgccuauguauuug

SEQ ID NO: 569917 - RNA, 19 nt, Homo sapiens
gggaaccuccucaucauug

SEQ ID NO: 569918 - RNA, 19 nt, Homo sapiens
guacuucuuccuguuauuu

SEQ ID NO: 569919 - RNA, 19 nt, Homo sapiens
ccucaucauuguccucauu

SEQ ID NO: 569920 - RNA, 19 nt, Homo sapiens
ggaaccuccucaucauugu

SEQ ID NO: 569921 - RNA, 19 nt, Homo sapiens
ggagggcucauucuuguca

SEQ ID NO: 569922 - RNA, 19 nt, Homo sapiens
gaccauucccaaguuguua

SEQ ID NO: 569923 - RNA, 19 nt, Homo sapiens
ugcaaggccuucucuacuu

SEQ ID NO: 569924 - RNA, 19 nt, Homo sapiens
acacucgaguuaaugaaug

SEQ ID NO: 569925 - RNA, 19 nt, Homo sapiens
caagaauugucuccuccau

SEQ ID NO: 569926 - RNA, 19 nt, Homo sapiens
ugggagggcucauucuugu

SEQ ID NO: 569927 - RNA, 19 nt, Homo sapiens
gcaacuuguccuucucuga

SEQ ID NO: 569928 - RNA, 19 nt, Homo sapiens
acacgccuauguauuuguu

SEQ ID NO: 569929 - RNA, 19 nt, Homo sapiens
ugacccaaauguacuucuu

SEQ ID NO: 569930 - RNA, 19 nt, Homo sapiens
aaaccagcaucucagacuu

SEQ ID NO: 569931 - RNA, 19 nt, Homo sapiens
aaauguacuucuuccuguu

SEQ ID NO: 569932 - RNA, 19 nt, Homo sapiens
uccacacgccuauguauuu

SEQ ID NO: 569933 - RNA, 19 nt, Homo sapiens
ugagcagagucauucauca

SEQ ID NO: 569934 - RNA, 19 nt, Homo sapiens
aagcuggccuucucugaca

SEQ ID NO: 569935 - RNA, 19 nt, Homo sapiens
uuggagaccuggagagcuu

SEQ ID NO: 569936 - RNA, 19 nt, Homo sapiens
cagagucauucaucagaag

SEQ ID NO: 569937 - RNA, 19 nt, Homo sapiens
aauguacuucuuccuguua

SEQ ID NO: 569938 - RNA, 19 nt, Homo sapiens
cggacugccugacccaaau

SEQ ID NO: 569939 - RNA, 19 nt, Homo sapiens
uggcuaugauguacacugu

SEQ ID NO: 569940 - RNA, 19 nt, Homo sapiens
caaaccagcaucucagacu

SEQ ID NO: 569941 - RNA, 19 nt, Homo sapiens
uacagaacaugcagaacca

SEQ ID NO: 569942 - RNA, 19 nt, Homo sapiens
gagcagagucauucaucag

SEQ ID NO: 569943 - RNA, 19 nt, Homo sapiens
gcccugagcagagucauuc

SEQ ID NO: 569944 - RNA, 19 nt, Homo sapiens
gacacucgaguuaaugaau

SEQ ID NO: 569945 - RNA, 19 nt, Homo sapiens
ggacugccugacccaaaug

SEQ ID NO: 569946 - RNA, 19 nt, Homo sapiens
ccuauguauuuguuucuca

SEQ ID NO: 569947 - RNA, 19 nt, Homo sapiens
ccugugcuaugcccuguuc

SEQ ID NO: 569948 - RNA, 19 nt, Homo sapiens
gcggacugccugacccaaa

SEQ ID NO: 569949 - RNA, 19 nt, Homo sapiens
agucauucaucagaagaaa

SEQ ID NO: 569950 - RNA, 19 nt, Homo sapiens
gaggaacagagacaugaag

SEQ ID NO: 569951 - RNA, 19 nt, Homo sapiens
cagcuaauaguucuacucu

SEQ ID NO: 569952 - RNA, 19 nt, Homo sapiens
cgugaccauucccaaguug

SEQ ID NO: 569953 - RNA, 19 nt, Homo sapiens
ccgugaccauucccaaguu

SEQ ID NO: 569954 - RNA, 19 nt, Homo sapiens
uggguccuaugcaagaauu

SEQ ID NO: 569955 - RNA, 19 nt, Homo sapiens
cauggccuaugaccgcuau

SEQ ID NO: 569956 - RNA, 19 nt, Homo sapiens
uguauuuguuucucagcaa

SEQ ID NO: 569957 - RNA, 19 nt, Homo sapiens
uggugucacuguucuaugg

SEQ ID NO: 569958 - RNA, 19 nt, Homo sapiens
ugucuguggugucacuguu

SEQ ID NO: 569959 - RNA, 19 nt, Homo sapiens
gucaucccauuccuacuca

SEQ ID NO: 569960 - RNA, 19 nt, Homo sapiens
gcuauguggccaucugcuu

SEQ ID NO: 569961 - RNA, 19 nt, Homo sapiens
ugaccauucccaaguuguu

SEQ ID NO: 569962 - RNA, 19 nt, Homo sapiens
gugcuaugcccuguucuug

SEQ ID NO: 569963 - RNA, 19 nt, Homo sapiens
uaucaugggagggcucauu

SEQ ID NO: 569964 - RNA, 19 nt, Homo sapiens
ugucugcucugcugaagcu

SEQ ID NO: 569965 - RNA, 19 nt, Homo sapiens
aaaucaaaccagcaucuca

SEQ ID NO: 569966 - RNA, 19 nt, Homo sapiens
gcuaauaguucuacucuaa

SEQ ID NO: 569967 - RNA, 19 nt, Homo sapiens
uggaaagggucauuuguaa

SEQ ID NO: 569968 - RNA, 19 nt, Homo sapiens
ccaaauugcugcagaacau

SEQ ID NO: 569969 - RNA, 19 nt, Homo sapiens
caaauguacuucuucuugu

SEQ ID NO: 569970 - RNA, 19 nt, Homo sapiens
ccaaauguacuucuucuug

SEQ ID NO: 569971 - RNA, 19 nt, Homo sapiens
gcacuacaccgccaucaug

SEQ ID NO: 569972 - RNA, 19 nt, Homo sapiens
ggaaagggucauuuguaaa

SEQ ID NO: 569973 - RNA, 19 nt, Homo sapiens
gaaagggucauuuguaaaa

SEQ ID NO: 569974 - RNA, 19 nt, Homo sapiens
guuacacacuuuacucaug

SEQ ID NO: 569975 - RNA, 19 nt, Homo sapiens
guuaaugaaugggugauau

SEQ ID NO: 569976 - RNA, 19 nt, Homo sapiens
gggaaccuccucaucauug

SEQ ID NO: 569977 - RNA, 19 nt, Homo sapiens
ccucaucauuguccucauu

SEQ ID NO: 569978 - RNA, 19 nt, Homo sapiens
ggaaccuccucaucauugu

SEQ ID NO: 569979 - RNA, 19 nt, Homo sapiens
ggagggcucauucuuguca

SEQ ID NO: 569980 - RNA, 19 nt, Homo sapiens
ugcaaggccuucucuacuu

SEQ ID NO: 569981 - RNA, 19 nt, Homo sapiens
acacucgaguuaaugaaug

SEQ ID NO: 569982 - RNA, 19 nt, Homo sapiens
caagaauugucuccuccau

SEQ ID NO: 569983 - RNA, 19 nt, Homo sapiens
ugggagggcucauucuugu

SEQ ID NO: 569984 - RNA, 19 nt, Homo sapiens
gcaacuuguccuucucuga

SEQ ID NO: 569985 - RNA, 19 nt, Homo sapiens
gcucugacacucgaguuaa

SEQ ID NO: 569986 - RNA, 19 nt, Homo sapiens
aaaccagcaucucagacuu

SEQ ID NO: 569987 - RNA, 19 nt, Homo sapiens
ugacccaaauguacuucuu

SEQ ID NO: 569988 - RNA, 19 nt, Homo sapiens
gaacaugcagaaccaagac

SEQ ID NO: 569989 - RNA, 19 nt, Homo sapiens
cagucacaaugcccaaauu

SEQ ID NO: 569990 - RNA, 19 nt, Homo sapiens
cuggaaagggucauuugua

SEQ ID NO: 569991 - RNA, 19 nt, Homo sapiens
aagcuggccugcucugaca

SEQ ID NO: 569992 - RNA, 19 nt, Homo sapiens
uggcuaugauguacacugu

SEQ ID NO: 569993 - RNA, 19 nt, Homo sapiens
caaaccagcaucucagacu

SEQ ID NO: 569994 - RNA, 19 nt, Homo sapiens
uuucggaucuagagagcuu

SEQ ID NO: 569995 - RNA, 19 nt, Homo sapiens
gacacucgaguuaaugaau

SEQ ID NO: 569996 - RNA, 19 nt, Homo sapiens
ccugugcuaugcccuguuc

SEQ ID NO: 569997 - RNA, 19 nt, Homo sapiens
gaggaacagagacaugaag

SEQ ID NO: 569998 - RNA, 19 nt, Homo sapiens
cagcuaauaguucuacucu

SEQ ID NO: 569999 - RNA, 19 nt, Homo sapiens
uggguccuaugcaagaauu

SEQ ID NO: 570000 - RNA, 19 nt, Homo sapiens
cauggccuaugaccgcuau

SEQ ID NO: 570001 - RNA, 19 nt, Homo sapiens
uguauuuguuucucagcaa

SEQ ID NO: 570002 - RNA, 19 nt, Homo sapiens
uggugucacuguucuaugg

SEQ ID NO: 570003 - RNA, 19 nt, Homo sapiens
ucucuguggugucacuguu

SEQ ID NO: 570004 - RNA, 19 nt, Homo sapiens
gucaucccauuccuacuca

SEQ ID NO: 570005 - RNA, 19 nt, Homo sapiens
gcuauguggccaucugcuu

SEQ ID NO: 570006 - RNA, 19 nt, Homo sapiens
gugcuaugcccuguucuug

SEQ ID NO: 570007 - RNA, 19 nt, Homo sapiens
uaucaugggagggcucauu

SEQ ID NO: 570008 - RNA, 19 nt, Homo sapiens
ugucugcucugcugaagcu

SEQ ID NO: 570009 - RNA, 19 nt, Homo sapiens
aaaucaaaccagcaucuca

SEQ ID NO: 570010 - RNA, 19 nt, Homo sapiens
uagagagcuuccuccuugu

SEQ ID NO: 570011 - RNA, 19 nt, Homo sapiens
ccaaugagcuggugaucuu

SEQ ID NO: 570012 - RNA, 19 nt, Homo sapiens
aauaaagucuucccugaga

SEQ ID NO: 570013 - RNA, 19 nt, Homo sapiens
ggacucauuugugugcuuu

SEQ ID NO: 570014 - RNA, 19 nt, Homo sapiens
cguggucucucucuucuuu

SEQ ID NO: 570015 - RNA, 19 nt, Homo sapiens
gaaggacacaguugcauca

SEQ ID NO: 570016 - RNA, 19 nt, Homo sapiens
gguccuuccuguucaugua

SEQ ID NO: 570017 - RNA, 19 nt, Homo sapiens
ccacuucauuacauucuga

SEQ ID NO: 570018 - RNA, 19 nt, Homo sapiens
agugguaacuccaauguug

SEQ ID NO: 570019 - RNA, 19 nt, Homo sapiens
gcaggcaaccuccucauca

SEQ ID NO: 570020 - RNA, 19 nt, Homo sapiens
gaaccaagaaauaaagucu

SEQ ID NO: 570021 - RNA, 19 nt, Homo sapiens
ccacccacuucauuacauu

SEQ ID NO: 570022 - RNA, 19 nt, Homo sapiens
caucauuacugacacucaa

SEQ ID NO: 570023 - RNA, 19 nt, Homo sapiens
cuacacacacuucugauga

SEQ ID NO: 570024 - RNA, 19 nt, Homo sapiens
cuaagaugcuggcaaacau

SEQ ID NO: 570025 - RNA, 19 nt, Homo sapiens
acauacagauccagaguca

SEQ ID NO: 570026 - RNA, 19 nt, Homo sapiens
uaagaugcuggcaaacaua

SEQ ID NO: 570027 - RNA, 19 nt, Homo sapiens
uaaagucuucccugagaaa

SEQ ID NO: 570028 - RNA, 19 nt, Homo sapiens
gaaaauucauuccccuuag

SEQ ID NO: 570029 - RNA, 19 nt, Homo sapiens
ugugugcuuugccugauua

SEQ ID NO: 570030 - RNA, 19 nt, Homo sapiens
ucccuaagaugcuggcaaa

SEQ ID NO: 570031 - RNA, 19 nt, Homo sapiens
ugaggaaccaagaaauaaa

SEQ ID NO: 570032 - RNA, 19 nt, Homo sapiens
ugaccagcaucucagaaug

SEQ ID NO: 570033 - RNA, 19 nt, Homo sapiens
ggucucacaggacucauuu

SEQ ID NO: 570034 - RNA, 19 nt, Homo sapiens
gcacagaccccuucaccaa

SEQ ID NO: 570035 - RNA, 19 nt, Homo sapiens
cagggugucuacuacaguu

SEQ ID NO: 570036 - RNA, 19 nt, Homo sapiens
ccaccacagucccuaagau

SEQ ID NO: 570037 - RNA, 19 nt, Homo sapiens
cuacucagggugucuacua

SEQ ID NO: 570038 - RNA, 19 nt, Homo sapiens
gcaaccuccucaucauucu

SEQ ID NO: 570039 - RNA, 19 nt, Homo sapiens
uacacacacuucugaugaa

SEQ ID NO: 570040 - RNA, 19 nt, Homo sapiens
gaggaaccaagaaauaaag

SEQ ID NO: 570041 - RNA, 19 nt, Homo sapiens
cccuuuaucuacaguuuga

SEQ ID NO: 570042 - RNA, 19 nt, Homo sapiens
uaacuccaauguugaaucc

SEQ ID NO: 570043 - RNA, 19 nt, Homo sapiens
gaccagcaucucagaaugu

SEQ ID NO: 570044 - RNA, 19 nt, Homo sapiens
uuugaggaaccaagaaaua

SEQ ID NO: 570045 - RNA, 19 nt, Homo sapiens
uugaaucccuuuaucuaca

SEQ ID NO: 570046 - RNA, 19 nt, Homo sapiens
gauuucaguucucccucaa

SEQ ID NO: 570047 - RNA, 19 nt, Homo sapiens
cagcaucucagaauguuuc

SEQ ID NO: 570048 - RNA, 19 nt, Homo sapiens
caaccucucccuugcagau

SEQ ID NO: 570049 - RNA, 19 nt, Homo sapiens
ccucaucauucuagucauc

SEQ ID NO: 570050 - RNA, 19 nt, Homo sapiens
ugagaucccacacuucuuc

SEQ ID NO: 570051 - RNA, 19 nt, Homo sapiens
agucuucccugagaaaguu

SEQ ID NO: 570052 - RNA, 19 nt, Homo sapiens
acacagugguaacuccaau

SEQ ID NO: 570053 - RNA, 19 nt, Homo sapiens
ggcaaccuccucaucauuc

SEQ ID NO: 570054 - RNA, 19 nt, Homo sapiens
uaugccacccacuucauua

SEQ ID NO: 570055 - RNA, 19 nt, Homo sapiens
ccaauguugaaucccuuua

SEQ ID NO: 570056 - RNA, 19 nt, Homo sapiens
cuucuucugugacaucaau

SEQ ID NO: 570057 - RNA, 19 nt, Homo sapiens
gaucccacacuucuucugu

SEQ ID NO: 570058 - RNA, 19 nt, Homo sapiens
caugagaucccacacuucu

SEQ ID NO: 570059 - RNA, 19 nt, Homo sapiens
ggccauaugccacccacuu

SEQ ID NO: 570060 - RNA, 19 nt, Homo sapiens
gugcuuugccugauuaucu

SEQ ID NO: 570061 - RNA, 19 nt, Homo sapiens
aaacauacagauccagagu

SEQ ID NO: 570062 - RNA, 19 nt, Homo sapiens
caggcaaccuccucaucau

SEQ ID NO: 570063 - RNA, 19 nt, Homo sapiens
guuaaucuggguucggaaa

SEQ ID NO: 570064 - RNA, 19 nt, Homo sapiens
uugaggaaccaagaaauaa

SEQ ID NO: 570065 - RNA, 19 nt, Homo sapiens
uguugaaucccuuuaucua

SEQ ID NO: 570066 - RNA, 19 nt, Homo sapiens
ucucgaccauccugaagau

SEQ ID NO: 570067 - RNA, 19 nt, Homo sapiens
accaugagaucccacacuu

SEQ ID NO: 570068 - RNA, 19 nt, Homo sapiens
cccauguacuucuuucuag

SEQ ID NO: 570069 - RNA, 19 nt, Homo sapiens
auaaagucuucccugagaa

SEQ ID NO: 570070 - RNA, 19 nt, Homo sapiens
aauguugaaucccuuuauc

SEQ ID NO: 570071 - RNA, 19 nt, Homo sapiens
caauguugaaucccuuuau

SEQ ID NO: 570072 - RNA, 19 nt, Homo sapiens
acacacuucugaugaacag

SEQ ID NO: 570073 - RNA, 19 nt, Homo sapiens
ccacucccuucuacacaca

SEQ ID NO: 570074 - RNA, 19 nt, Homo sapiens
agagucaggccaucuccua

SEQ ID NO: 570075 - RNA, 19 nt, Homo sapiens
gcccagaaggacacaguug

SEQ ID NO: 570076 - RNA, 19 nt, Homo sapiens
gcccuccacucccuucuac

SEQ ID NO: 570077 - RNA, 19 nt, Homo sapiens
cauuacauucugaucauga

SEQ ID NO: 570078 - RNA, 19 nt, Homo sapiens
gagcagaagccccucuuug

SEQ ID NO: 570079 - RNA, 19 nt, Homo sapiens
ugacugcuacguggccaua

SEQ ID NO: 570080 - RNA, 19 nt, Homo sapiens
gccacccacuucauuacau

SEQ ID NO: 570081 - RNA, 19 nt, Homo sapiens
ggaaccaagaaauaaaguc

SEQ ID NO: 570082 - RNA, 19 nt, Homo sapiens
caaccuccucaucauucua

SEQ ID NO: 570083 - RNA, 19 nt, Homo sapiens
uuugccugauuaucucuua

SEQ ID NO: 570084 - RNA, 19 nt, Homo sapiens
caccacagucccuaagaug

SEQ ID NO: 570085 - RNA, 19 nt, Homo sapiens
guaacuccaauguugaauc

SEQ ID NO: 570086 - RNA, 19 nt, Homo sapiens
cuucuacacacacuucuga

SEQ ID NO: 570087 - RNA, 19 nt, Homo sapiens
ccuaagaugcuggcaaaca

SEQ ID NO: 570088 - RNA, 19 nt, Homo sapiens
gugguaacuccaauguuga

SEQ ID NO: 570089 - RNA, 19 nt, Homo sapiens
caucauucuagucaucauu

SEQ ID NO: 570090 - RNA, 19 nt, Homo sapiens
uggcaaacauacagaucca

SEQ ID NO: 570091 - RNA, 19 nt, Homo sapiens
ccaaugaggucaaucacuu

SEQ ID NO: 570092 - RNA, 19 nt, Homo sapiens
gaagagaugcagccaguug

SEQ ID NO: 570093 - RNA, 19 nt, Homo sapiens
ggaccgcuguugcugaguu

SEQ ID NO: 570094 - RNA, 19 nt, Homo sapiens
ucccacaaguccacaauuu

SEQ ID NO: 570095 - RNA, 19 nt, Homo sapiens
gaggcuggguucaguggaa

SEQ ID NO: 570096 - RNA, 19 nt, Homo sapiens
ugaccgccauggccuauga

SEQ ID NO: 570097 - RNA, 19 nt, Homo sapiens
gcagccaguugucuuugug

SEQ ID NO: 570098 - RNA, 19 nt, Homo sapiens
aauguugggucgucucuug

SEQ ID NO: 570099 - RNA, 19 nt, Homo sapiens
gaagcugggaccaauagga

SEQ ID NO: 570100 - RNA, 19 nt, Homo sapiens
gaugcagccaguugucuuu

SEQ ID NO: 570101 - RNA, 19 nt, Homo sapiens
ucaguggaaucuucagaca

SEQ ID NO: 570102 - RNA, 19 nt, Homo sapiens
uagcugcugugcugcaaau

SEQ ID NO: 570103 - RNA, 19 nt, Homo sapiens
aguccacaauuuccuauga

SEQ ID NO: 570104 - RNA, 19 nt, Homo sapiens
ugaggucaaucacuucuac

SEQ ID NO: 570105 - RNA, 19 nt, Homo sapiens
ucucccagcucuucuucuu

SEQ ID NO: 570106 - RNA, 19 nt, Homo sapiens
aguggaaucuucagacaag

SEQ ID NO: 570107 - RNA, 19 nt, Homo sapiens
acaggugucuucagcuaca

SEQ ID NO: 570108 - RNA, 19 nt, Homo sapiens
ucacuguuccugcaauguu

SEQ ID NO: 570109 - RNA, 19 nt, Homo sapiens
ggucaaucacuucuacugu

SEQ ID NO: 570110 - RNA, 19 nt, Homo sapiens
cuacugggccuagugcaaa

SEQ ID NO: 570111 - RNA, 19 nt, Homo sapiens
guccuaugcccauguggua

SEQ ID NO: 570112 - RNA, 19 nt, Homo sapiens
cuacagcacccgcaugagu

SEQ ID NO: 570113 - RNA, 19 nt, Homo sapiens
aaucuucagacaaggauaa

SEQ ID NO: 570114 - RNA, 19 nt, Homo sapiens
cagaagcugggaccaauag

SEQ ID NO: 570115 - RNA, 19 nt, Homo sapiens
uggcugggauggacugcuu

SEQ ID NO: 570116 - RNA, 19 nt, Homo sapiens
ugaacccacuuaucuacag

SEQ ID NO: 570117 - RNA, 19 nt, Homo sapiens
gcugaacccacuuaucuac

SEQ ID NO: 570118 - RNA, 19 nt, Homo sapiens
cauccuggcagccgucuug

SEQ ID NO: 570119 - RNA, 19 nt, Homo sapiens
ggaaucuucagacaaggau

SEQ ID NO: 570120 - RNA, 19 nt, Homo sapiens
gguagcugcugugcugcaa

SEQ ID NO: 570121 - RNA, 19 nt, Homo sapiens
aucuacagccucagaaaua

SEQ ID NO: 570122 - RNA, 19 nt, Homo sapiens
uguccacgcucaacuucug

SEQ ID NO: 570123 - RNA, 19 nt, Homo sapiens
gggccuagugcaaacagaa

SEQ ID NO: 570124 - RNA, 19 nt, Homo sapiens
acaaguccacaauuuccua

SEQ ID NO: 570125 - RNA, 19 nt, Homo sapiens
cacuguuccugcaauguug

SEQ ID NO: 570126 - RNA, 19 nt, Homo sapiens
uggguucaguggaaucuuc

SEQ ID NO: 570127 - RNA, 19 nt, Homo sapiens
gaccgcuguugcugaguuc

SEQ ID NO: 570128 - RNA, 19 nt, Homo sapiens
uaucuacagccucagaaau

SEQ ID NO: 570129 - RNA, 19 nt, Homo sapiens
ccagcacccaacucaauga

SEQ ID NO: 570130 - RNA, 19 nt, Homo sapiens
gggcuugugccuucaccaa

SEQ ID NO: 570131 - RNA, 19 nt, Homo sapiens
caaguccacaauuuccuau

SEQ ID NO: 570132 - RNA, 19 nt, Homo sapiens
gauguaucacugucacugu

SEQ ID NO: 570133 - RNA, 19 nt, Homo sapiens
ucacuguggugggcaucuu

SEQ ID NO: 570134 - RNA, 19 nt, Homo sapiens
cuucaucaguguguccuau

SEQ ID NO: 570135 - RNA, 19 nt, Homo sapiens
caacuucuguggccccaau

SEQ ID NO: 570136 - RNA, 19 nt, Homo sapiens
uguagcagcagccuucaug

SEQ ID NO: 570137 - RNA, 19 nt, Homo sapiens
caaugaggucaaucacuuc

SEQ ID NO: 570138 - RNA, 19 nt, Homo sapiens
gaaacucauggagccagaa

SEQ ID NO: 570139 - RNA, 19 nt, Homo sapiens
ccacaaguccacaauuucc

SEQ ID NO: 570140 - RNA, 19 nt, Homo sapiens
ggaaagcccugguacauga

SEQ ID NO: 570141 - RNA, 19 nt, Homo sapiens
ggacuuugcugccuaaauu

SEQ ID NO: 570142 - RNA, 19 nt, Homo sapiens
gaucagaacuccagaagug

SEQ ID NO: 570143 - RNA, 19 nt, Homo sapiens
cagacuagcuggcacauua

SEQ ID NO: 570144 - RNA, 19 nt, Homo sapiens
gaagagccaugguguuuau

SEQ ID NO: 570145 - RNA, 19 nt, Homo sapiens
gaagaauacuccuguaauc

SEQ ID NO: 570146 - RNA, 19 nt, Homo sapiens
gaaccggacucuuaauuuc

SEQ ID NO: 570147 - RNA, 19 nt, Homo sapiens
cugcagagcuucaagauaa

SEQ ID NO: 570148 - RNA, 19 nt, Homo sapiens
gaaaggugccauccaguua

SEQ ID NO: 570149 - RNA, 19 nt, Homo sapiens
ggaaagcgguuaaacuugu

SEQ ID NO: 570150 - RNA, 19 nt, Homo sapiens
agaagcagcuccucuuuaa

SEQ ID NO: 570151 - RNA, 19 nt, Homo sapiens
ggacuuggcagcuuucuuu

SEQ ID NO: 570152 - RNA, 19 nt, Homo sapiens
cagaagaccuggaacaaga

SEQ ID NO: 570153 - RNA, 19 nt, Homo sapiens
gcagugagccgcugauuga

SEQ ID NO: 570154 - RNA, 19 nt, Homo sapiens
gaagagaagaguagugauu

SEQ ID NO: 570155 - RNA, 19 nt, Homo sapiens
gcacacagcacacaauuuc

SEQ ID NO: 570156 - RNA, 19 nt, Homo sapiens
agucagaguucacccauua

SEQ ID NO: 570157 - RNA, 19 nt, Homo sapiens
gaaacacaguacucaguug

SEQ ID NO: 570158 - RNA, 19 nt, Homo sapiens
gaacacaaggcacaaguga

SEQ ID NO: 570159 - RNA, 19 nt, Homo sapiens
gcaacacaguauuuaagaa

SEQ ID NO: 570160 - RNA, 19 nt, Homo sapiens
uuaagaagauucccuugaa

SEQ ID NO: 570161 - RNA, 19 nt, Homo sapiens
gcaagaacauucggauugu

SEQ ID NO: 570162 - RNA, 19 nt, Homo sapiens
gacaagaugccuauucgua

SEQ ID NO: 570163 - RNA, 19 nt, Homo sapiens
ggaaccggacucuuaauuu

SEQ ID NO: 570164 - RNA, 19 nt, Homo sapiens
guucagaaauggcaaauac

SEQ ID NO: 570165 - RNA, 19 nt, Homo sapiens
ucaggcagauuguugaauu

SEQ ID NO: 570166 - RNA, 19 nt, Homo sapiens
caagaugccuauucguaga

SEQ ID NO: 570167 - RNA, 19 nt, Homo sapiens
caaaugcuaacuacaagua

SEQ ID NO: 570168 - RNA, 19 nt, Homo sapiens
ggagagacuuugcaaaugc

SEQ ID NO: 570169 - RNA, 19 nt, Homo sapiens
caggagagacaacauauaa

SEQ ID NO: 570170 - RNA, 19 nt, Homo sapiens
gugaagacuuaccaaauga

SEQ ID NO: 570171 - RNA, 19 nt, Homo sapiens
uuaagacaguccaacauaa

SEQ ID NO: 570172 - RNA, 19 nt, Homo sapiens
gcacauuaucccuaccuua

SEQ ID NO: 570173 - RNA, 19 nt, Homo sapiens
uguaaucucuguaaagguu

SEQ ID NO: 570174 - RNA, 19 nt, Homo sapiens
acacaguacucaguugaua

SEQ ID NO: 570175 - RNA, 19 nt, Homo sapiens
ggucauugcugugccauau

SEQ ID NO: 570176 - RNA, 19 nt, Homo sapiens
ggauaaggguguuuaacca

SEQ ID NO: 570177 - RNA, 19 nt, Homo sapiens
ggaagaauacuccuguaau

SEQ ID NO: 570178 - RNA, 19 nt, Homo sapiens
ggagacugaugaccauaug

SEQ ID NO: 570179 - RNA, 19 nt, Homo sapiens
uaaauucuauggacuguac

SEQ ID NO: 570180 - RNA, 19 nt, Homo sapiens
ugucuuugcugccauguuu

SEQ ID NO: 570181 - RNA, 19 nt, Homo sapiens
ccagaaguguugacaagau

SEQ ID NO: 570182 - RNA, 19 nt, Homo sapiens
gcacaacgagagcccuuaa

SEQ ID NO: 570183 - RNA, 19 nt, Homo sapiens
gaccuagacuucuuacaag

SEQ ID NO: 570184 - RNA, 19 nt, Homo sapiens
uacaaugacuuucguuuca

SEQ ID NO: 570185 - RNA, 19 nt, Homo sapiens
ggaagaaccggauugaaag

SEQ ID NO: 570186 - RNA, 19 nt, Homo sapiens
gaaagcgguuaaacuugug

SEQ ID NO: 570187 - RNA, 19 nt, Homo sapiens
ugugaagacuuaccaaaug

SEQ ID NO: 570188 - RNA, 19 nt, Homo sapiens
cagaagagccaugguguuu

SEQ ID NO: 570189 - RNA, 19 nt, Homo sapiens
gauacuacaugaaccucaa

SEQ ID NO: 570190 - RNA, 19 nt, Homo sapiens
gcagggaaguuggaaaugg

SEQ ID NO: 570191 - RNA, 19 nt, Homo sapiens
uaagacaguccaacauaaa

SEQ ID NO: 570192 - RNA, 19 nt, Homo sapiens
gaaaauaggccauagaagu

SEQ ID NO: 570193 - RNA, 19 nt, Homo sapiens
gaaaguauccccuguggaa

SEQ ID NO: 570194 - RNA, 19 nt, Homo sapiens
cagaagcagcuccucuuua

SEQ ID NO: 570195 - RNA, 19 nt, Homo sapiens
gaauacuccuguaaucucu

SEQ ID NO: 570196 - RNA, 19 nt, Homo sapiens
uaagcuuacucuucuguga

SEQ ID NO: 570197 - RNA, 19 nt, Homo sapiens
gcaacuccugcauuacuua

SEQ ID NO: 570198 - RNA, 19 nt, Homo sapiens
aguggcaacuccugcauua

SEQ ID NO: 570199 - RNA, 19 nt, Homo sapiens
caucugaggugccuuaugc

SEQ ID NO: 570200 - RNA, 19 nt, Homo sapiens
gaagaaccggauugaaaga

SEQ ID NO: 570201 - RNA, 19 nt, Homo sapiens
ggacaugggguaaucuuua

SEQ ID NO: 570202 - RNA, 19 nt, Homo sapiens
gagccaugguguuuaugaa

SEQ ID NO: 570203 - RNA, 19 nt, Homo sapiens
acuaggaaccggacucuua

SEQ ID NO: 570204 - RNA, 19 nt, Homo sapiens
ggcaagaacauucggauug

SEQ ID NO: 570205 - RNA, 19 nt, Homo sapiens
acaugaaccucaaccagaa

SEQ ID NO: 570206 - RNA, 19 nt, Homo sapiens
cacccugccuugauaauau

SEQ ID NO: 570207 - RNA, 19 nt, Homo sapiens
cauuaucccuaccuuaguu

SEQ ID NO: 570208 - RNA, 19 nt, Homo sapiens
gcgcaaagccucagaagac

SEQ ID NO: 570209 - RNA, 19 nt, Homo sapiens
uaacagacaguccauaucu

SEQ ID NO: 570210 - RNA, 19 nt, Homo sapiens
ccuccucucuugaugaauu

SEQ ID NO: 570211 - RNA, 19 nt, Homo sapiens
gccaugguguuuaugaaga

SEQ ID NO: 570212 - RNA, 19 nt, Homo sapiens
caaaggcucaaccuacaaa

SEQ ID NO: 570213 - RNA, 19 nt, Homo sapiens
ccagaacccucggacuuug

SEQ ID NO: 570214 - RNA, 19 nt, Homo sapiens
caagaccuaugcaccuguu

SEQ ID NO: 570215 - RNA, 19 nt, Homo sapiens
guggaaagcgguuaaacuu

SEQ ID NO: 570216 - RNA, 19 nt, Homo sapiens
uuaaccaccucccagcuuu

SEQ ID NO: 570217 - RNA, 19 nt, Homo sapiens
gcaggcagguggcaagaac

SEQ ID NO: 570218 - RNA, 19 nt, Homo sapiens
gcccgaugauuacuuguau

SEQ ID NO: 570219 - RNA, 19 nt, Homo sapiens
aaagagacguugggaagau

SEQ ID NO: 570220 - RNA, 19 nt, Homo sapiens
uuaaacuccuccucucuug

SEQ ID NO: 570221 - RNA, 19 nt, Homo sapiens
cagaaguguugacaagaug

SEQ ID NO: 570222 - RNA, 19 nt, Homo sapiens
ccucccagcuuucuucuuc

SEQ ID NO: 570223 - RNA, 19 nt, Homo sapiens
aggaagaaccggauugaaa

SEQ ID NO: 570224 - RNA, 19 nt, Homo sapiens
agugagggcucgccuauuc

SEQ ID NO: 570225 - RNA, 19 nt, Homo sapiens
ucuacagucuuacagguuu

SEQ ID NO: 570226 - RNA, 19 nt, Homo sapiens
ggagagacaacauauaaaa

SEQ ID NO: 570227 - RNA, 19 nt, Homo sapiens
gagggagggcugggucuua

SEQ ID NO: 570228 - RNA, 19 nt, Homo sapiens
ucuuaaggcugaaggaaug

SEQ ID NO: 570229 - RNA, 19 nt, Homo sapiens
gcuugaaguugcagaguca

SEQ ID NO: 570230 - RNA, 19 nt, Homo sapiens
uaagaagauucccuugaag

SEQ ID NO: 570231 - RNA, 19 nt, Homo sapiens
ggucccagcagccagcuua

SEQ ID NO: 570232 - RNA, 19 nt, Homo sapiens
gguugagaguaucuucuuu

SEQ ID NO: 570233 - RNA, 19 nt, Homo sapiens
gaagacuuaccaaaugaau

SEQ ID NO: 570234 - RNA, 19 nt, Homo sapiens
gaagauucgauuccgagaa

SEQ ID NO: 570235 - RNA, 19 nt, Homo sapiens
aggcacaagugacaacaaa

SEQ ID NO: 570236 - RNA, 19 nt, Homo sapiens
caacacaguauuuaagaag

SEQ ID NO: 570237 - RNA, 19 nt, Homo sapiens
gccauccaguuaggcauua

SEQ ID NO: 570238 - RNA, 19 nt, Homo sapiens
cugccaggcuauaguaauu

SEQ ID NO: 570239 - RNA, 19 nt, Homo sapiens
gaagcagcuccucuuuaaa

SEQ ID NO: 570240 - RNA, 19 nt, Homo sapiens
ggaaagcucuuguuuauga

SEQ ID NO: 570241 - RNA, 19 nt, Homo sapiens
guacauacauugucuuuga

SEQ ID NO: 570242 - RNA, 19 nt, Homo sapiens
ggacuuagauuuccugcaa

SEQ ID NO: 570243 - RNA, 19 nt, Homo sapiens
gcacaaagaagcugaguuu

SEQ ID NO: 570244 - RNA, 19 nt, Homo sapiens
aaagaaaccuggcaaagaa

SEQ ID NO: 570245 - RNA, 19 nt, Homo sapiens
caaccugacuuaagaguuu

SEQ ID NO: 570246 - RNA, 19 nt, Homo sapiens
gcagacagauuucuuaagu

SEQ ID NO: 570247 - RNA, 19 nt, Homo sapiens
gaccagugaugaugaauuu

SEQ ID NO: 570248 - RNA, 19 nt, Homo sapiens
cuagaaagcuucaagauca

SEQ ID NO: 570249 - RNA, 19 nt, Homo sapiens
caacagccauggaaucuau

SEQ ID NO: 570250 - RNA, 19 nt, Homo sapiens
gaaagaaaccuggcaaaga

SEQ ID NO: 570251 - RNA, 19 nt, Homo sapiens
gaaugcacuuuacauauga

SEQ ID NO: 570252 - RNA, 19 nt, Homo sapiens
caacauauguaaucugcuu

SEQ ID NO: 570253 - RNA, 19 nt, Homo sapiens
gcuucaagaucauggauua

SEQ ID NO: 570254 - RNA, 19 nt, Homo sapiens
ggagagaggugaaagaaac

SEQ ID NO: 570255 - RNA, 19 nt, Homo sapiens
ccacacacauugguaaauu

SEQ ID NO: 570256 - RNA, 19 nt, Homo sapiens
gcacaguuauggcagagaa

SEQ ID NO: 570257 - RNA, 19 nt, Homo sapiens
uaagacauacgcuccauua

SEQ ID NO: 570258 - RNA, 19 nt, Homo sapiens
aaagucagcucuguuguuu

SEQ ID NO: 570259 - RNA, 19 nt, Homo sapiens
cgacaggccuacacucuau

SEQ ID NO: 570260 - RNA, 19 nt, Homo sapiens
cuggaaagcucuuguuuau

SEQ ID NO: 570261 - RNA, 19 nt, Homo sapiens
ggccuacacucuauucaaa

SEQ ID NO: 570262 - RNA, 19 nt, Homo sapiens
gagaugggauaaucacaga

SEQ ID NO: 570263 - RNA, 19 nt, Homo sapiens
ggacugggaugcagaaggu

SEQ ID NO: 570264 - RNA, 19 nt, Homo sapiens
ugacuugccauuucauuua

SEQ ID NO: 570265 - RNA, 19 nt, Homo sapiens
ggucugccuucacuuuaua

SEQ ID NO: 570266 - RNA, 19 nt, Homo sapiens
gacauacgcuccauuagca

SEQ ID NO: 570267 - RNA, 19 nt, Homo sapiens
gcaaucauauagguuaaug

SEQ ID NO: 570268 - RNA, 19 nt, Homo sapiens
agaaugcacuuuacauaug

SEQ ID NO: 570269 - RNA, 19 nt, Homo sapiens
gagaaugcacuuuacauau

SEQ ID NO: 570270 - RNA, 19 nt, Homo sapiens
uacccagacuuuagauuua

SEQ ID NO: 570271 - RNA, 19 nt, Homo sapiens
ugacaaugcuucugugcuu

SEQ ID NO: 570272 - RNA, 19 nt, Homo sapiens
agacagauuucuuaaguuc

SEQ ID NO: 570273 - RNA, 19 nt, Homo sapiens
caaccacaauuucaucuuc

SEQ ID NO: 570274 - RNA, 19 nt, Homo sapiens
gcgaagagcaucccguaaa

SEQ ID NO: 570275 - RNA, 19 nt, Homo sapiens
ugacgucuauuuauaagug

SEQ ID NO: 570276 - RNA, 19 nt, Homo sapiens
ugaagaaguuagaacauuc

SEQ ID NO: 570277 - RNA, 19 nt, Homo sapiens
gcacaucacuacccagacu

SEQ ID NO: 570278 - RNA, 19 nt, Homo sapiens
cacacacauugguaaauua

SEQ ID NO: 570279 - RNA, 19 nt, Homo sapiens
gugcaugcauccagugauu

SEQ ID NO: 570280 - RNA, 19 nt, Homo sapiens
guucaugaauuccagaguu

SEQ ID NO: 570281 - RNA, 19 nt, Homo sapiens
acagaugacuugccauuuc

SEQ ID NO: 570282 - RNA, 19 nt, Homo sapiens
gugaagaacugcaugaacu

SEQ ID NO: 570283 - RNA, 19 nt, Homo sapiens
guaaagagagagagaaauc

SEQ ID NO: 570284 - RNA, 19 nt, Homo sapiens
gcacuuuacauaugacuug

SEQ ID NO: 570285 - RNA, 19 nt, Homo sapiens
ugagaaugcacuuuacaua

SEQ ID NO: 570286 - RNA, 19 nt, Homo sapiens
guaaacagcaagcaguuga

SEQ ID NO: 570287 - RNA, 19 nt, Homo sapiens
gcauuaauaucaggauugu

SEQ ID NO: 570288 - RNA, 19 nt, Homo sapiens
ggaguuggaagugcuauuu

SEQ ID NO: 570289 - RNA, 19 nt, Homo sapiens
ggccacccaucacuacuaa

SEQ ID NO: 570290 - RNA, 19 nt, Homo sapiens
agaacugcaugaacuauau

SEQ ID NO: 570291 - RNA, 19 nt, Homo sapiens
cuaucaaccugacuuaaga

SEQ ID NO: 570292 - RNA, 19 nt, Homo sapiens
gaaacuaucaaccugacuu

SEQ ID NO: 570293 - RNA, 19 nt, Homo sapiens
gcaaucaggaggcauuaau

SEQ ID NO: 570294 - RNA, 19 nt, Homo sapiens
ccuauggacuuuugcauua

SEQ ID NO: 570295 - RNA, 19 nt, Homo sapiens
aagaaacggugcaauucaa

SEQ ID NO: 570296 - RNA, 19 nt, Homo sapiens
ucaagaucauggauuauag

SEQ ID NO: 570297 - RNA, 19 nt, Homo sapiens
cgaagagcaucccguaaag

SEQ ID NO: 570298 - RNA, 19 nt, Homo sapiens
ccauuagcauuccgauauu

SEQ ID NO: 570299 - RNA, 19 nt, Homo sapiens
ugccuucacuuuauagaaa

SEQ ID NO: 570300 - RNA, 19 nt, Homo sapiens
caacauuuaccuuggaaga

SEQ ID NO: 570301 - RNA, 19 nt, Homo sapiens
uagcagccuugaugaagaa

SEQ ID NO: 570302 - RNA, 19 nt, Homo sapiens
gcaguugacgggaagacua

SEQ ID NO: 570303 - RNA, 19 nt, Homo sapiens
cagaugacuugccauuuca

SEQ ID NO: 570304 - RNA, 19 nt, Homo sapiens
gaacugcaugaacuauauu

SEQ ID NO: 570305 - RNA, 19 nt, Homo sapiens
gacauucugcaaucauaua

SEQ ID NO: 570306 - RNA, 19 nt, Homo sapiens
caaucaggaggcauuaaua

SEQ ID NO: 570307 - RNA, 19 nt, Homo sapiens
gaugauuacuuguauucca

SEQ ID NO: 570308 - RNA, 19 nt, Homo sapiens
ugcaucaucugcuauuaaa

SEQ ID NO: 570309 - RNA, 19 nt, Homo sapiens
gccauuucauuuacaaaga

SEQ ID NO: 570310 - RNA, 19 nt, Homo sapiens
gcugaacugugaagaacug

SEQ ID NO: 570311 - RNA, 19 nt, Homo sapiens
caccuaagcacauggauga

SEQ ID NO: 570312 - RNA, 19 nt, Homo sapiens
gaaagcucuuguuuaugau

SEQ ID NO: 570313 - RNA, 19 nt, Homo sapiens
auacaacgcgcuuaugaaa

SEQ ID NO: 570314 - RNA, 19 nt, Homo sapiens
gagaaaagcaaagcuauuu

SEQ ID NO: 570315 - RNA, 19 nt, Homo sapiens
gaagaacugcaugaacuau

SEQ ID NO: 570316 - RNA, 19 nt, Homo sapiens
gcuugacgucuauuuauaa

SEQ ID NO: 570317 - RNA, 19 nt, Homo sapiens
gaaggguuguauuuugaua

SEQ ID NO: 570318 - RNA, 19 nt, Homo sapiens
ugaaaggcucaacguauaa

SEQ ID NO: 570319 - RNA, 19 nt, Homo sapiens
cagcagaugggaugugaaa

SEQ ID NO: 570320 - RNA, 19 nt, Homo sapiens
aaacuaucaaccugacuua

SEQ ID NO: 570321 - RNA, 19 nt, Homo sapiens
gaugagacgugagcacagu

SEQ ID NO: 570322 - RNA, 19 nt, Homo sapiens
uaagaaacggugcaauuca

SEQ ID NO: 570323 - RNA, 19 nt, Homo sapiens
caagaaaauucaagcuuug

SEQ ID NO: 570324 - RNA, 19 nt, Homo sapiens
gaagagcaucccguaaaga

SEQ ID NO: 570325 - RNA, 19 nt, Homo sapiens
ucaggaggcauuaauauca

SEQ ID NO: 570326 - RNA, 19 nt, Homo sapiens
cuacccagacuuuagauuu

SEQ ID NO: 570327 - RNA, 19 nt, Homo sapiens
uaaagucagcucuguuguu

SEQ ID NO: 570328 - RNA, 19 nt, Homo sapiens
agucagcucuguuguuuua

SEQ ID NO: 570329 - RNA, 19 nt, Homo sapiens
aaacauacaacgcgcuuau

SEQ ID NO: 570330 - RNA, 19 nt, Homo sapiens
aaacaguucagcacaaaga

SEQ ID NO: 570331 - RNA, 19 nt, Homo sapiens
caucugcagugaaccucua

SEQ ID NO: 570332 - RNA, 19 nt, Homo sapiens
uaaugaacuugcagacugu

SEQ ID NO: 570333 - RNA, 19 nt, Homo sapiens
ucuaagaaacggugcaauu

SEQ ID NO: 570334 - RNA, 19 nt, Homo sapiens
cagacagauuucuuaaguu

SEQ ID NO: 570335 - RNA, 19 nt, Homo sapiens
ggacacuguuucuguucau

SEQ ID NO: 570336 - RNA, 19 nt, Homo sapiens
cagaauccaaggacucuuu

SEQ ID NO: 570337 - RNA, 19 nt, Homo sapiens
gccaggcuauuacaugaau

SEQ ID NO: 570338 - RNA, 19 nt, Homo sapiens
gaucuaguuuauugcuugu

SEQ ID NO: 570339 - RNA, 19 nt, Homo sapiens
gcugcuuucuguaccauug

SEQ ID NO: 570340 - RNA, 19 nt, Homo sapiens
gaacuacgaugcuccagaa

SEQ ID NO: 570341 - RNA, 19 nt, Homo sapiens
cccaucagcucaaacauua

SEQ ID NO: 570342 - RNA, 19 nt, Homo sapiens
ugaccgagauccaugagua

SEQ ID NO: 570343 - RNA, 19 nt, Homo sapiens
caauggaaguggcuuaaga

SEQ ID NO: 570344 - RNA, 19 nt, Homo sapiens
ggaaggcgaucuugacucu

SEQ ID NO: 570345 - RNA, 19 nt, Homo sapiens
ugaccgaccucauccguaa

SEQ ID NO: 570346 - RNA, 19 nt, Homo sapiens
gaagaaacucuccaucguu

SEQ ID NO: 570347 - RNA, 19 nt, Homo sapiens
cagcugaccucguccauuc

SEQ ID NO: 570348 - RNA, 19 nt, Homo sapiens
ucaccaacuuguucucuaa

SEQ ID NO: 570349 - RNA, 19 nt, Homo sapiens
gaaggccugucucccacua

SEQ ID NO: 570350 - RNA, 19 nt, Homo sapiens
gaucuugacucugcugaga

SEQ ID NO: 570351 - RNA, 19 nt, Homo sapiens
ccaaggaacugggcaagau

SEQ ID NO: 570352 - RNA, 19 nt, Homo sapiens
ccaacaaggugaagaaacu

SEQ ID NO: 570353 - RNA, 19 nt, Homo sapiens
gccaugaaguucucucaga

SEQ ID NO: 570354 - RNA, 19 nt, Homo sapiens
caucacagccguaucauca

SEQ ID NO: 570355 - RNA, 19 nt, Homo sapiens
ugaaaggccucaucaucau

SEQ ID NO: 570356 - RNA, 19 nt, Homo sapiens
uaaacaaccuagaacuaca

SEQ ID NO: 570357 - RNA, 19 nt, Homo sapiens
gugaaaggccucaucauca

SEQ ID NO: 570358 - RNA, 19 nt, Homo sapiens
ucaaggcccucaucguguu

SEQ ID NO: 570359 - RNA, 19 nt, Homo sapiens
gcagccagauccacagcaa

SEQ ID NO: 570360 - RNA, 19 nt, Homo sapiens
ugaagaaacucuccaucgu

SEQ ID NO: 570361 - RNA, 19 nt, Homo sapiens
gggcagcuccuacuuacuu

SEQ ID NO: 570362 - RNA, 19 nt, Homo sapiens
guaaguccauggccuacau

SEQ ID NO: 570363 - RNA, 19 nt, Homo sapiens
gcaagggucaggccaacaa

SEQ ID NO: 570364 - RNA, 19 nt, Homo sapiens
ggauggaggaggagugaaa

SEQ ID NO: 570365 - RNA, 19 nt, Homo sapiens
ugguggagcuggugcagua

SEQ ID NO: 570366 - RNA, 19 nt, Homo sapiens
gcagacuugucaccaggaa

SEQ ID NO: 570367 - RNA, 19 nt, Homo sapiens
gaaagacaacguggagaug

SEQ ID NO: 570368 - RNA, 19 nt, Homo sapiens
gaagggcagcugauucugu

SEQ ID NO: 570369 - RNA, 19 nt, Homo sapiens
gagcuggccaagacuguuu

SEQ ID NO: 570370 - RNA, 19 nt, Homo sapiens
ccuaaacaaccuagaacua

SEQ ID NO: 570371 - RNA, 19 nt, Homo sapiens
ggagugaaaggccucauca

SEQ ID NO: 570372 - RNA, 19 nt, Homo sapiens
uagugaauuuccaucagua

SEQ ID NO: 570373 - RNA, 19 nt, Homo sapiens
ucauuuggauucaaguuca

SEQ ID NO: 570374 - RNA, 19 nt, Homo sapiens
cgagauccaugaguacaau

SEQ ID NO: 570375 - RNA, 19 nt, Homo sapiens
caugaaggaugagguguuc

SEQ ID NO: 570376 - RNA, 19 nt, Homo sapiens
ccaccaaggaccuguuuga

SEQ ID NO: 570377 - RNA, 19 nt, Homo sapiens
ggacccuccuuuggauauu

SEQ ID NO: 570378 - RNA, 19 nt, Homo sapiens
ggaggaagggcagcugauu

SEQ ID NO: 570379 - RNA, 19 nt, Homo sapiens
cuacgaugcuccagaaacu

SEQ ID NO: 570380 - RNA, 19 nt, Homo sapiens
gggcugggacuaaagaaau

SEQ ID NO: 570381 - RNA, 19 nt, Homo sapiens
cggcugaacuccaccucuu

SEQ ID NO: 570382 - RNA, 19 nt, Homo sapiens
agauggaugucaccgacua

SEQ ID NO: 570383 - RNA, 19 nt, Homo sapiens
cugcuacccuucuaugaga

SEQ ID NO: 570384 - RNA, 19 nt, Homo sapiens
gcgaggaguuccagaagcu

SEQ ID NO: 570385 - RNA, 19 nt, Homo sapiens
caaccuagaacuacaggau

SEQ ID NO: 570386 - RNA, 19 nt, Homo sapiens
aagggcagcugauucuguu

SEQ ID NO: 570387 - RNA, 19 nt, Homo sapiens
gaaacucuccaucguuguc

SEQ ID NO: 570388 - RNA, 19 nt, Homo sapiens
ucaguggcgucaccaacuu

SEQ ID NO: 570389 - RNA, 19 nt, Homo sapiens
gcaugaaggaugagguguu

SEQ ID NO: 570390 - RNA, 19 nt, Homo sapiens
gcaccugaccgaccucauc

SEQ ID NO: 570391 - RNA, 19 nt, Homo sapiens
cugacgcccuagugaauuu

SEQ ID NO: 570392 - RNA, 19 nt, Homo sapiens
uacaggaucucaugcacau

SEQ ID NO: 570393 - RNA, 19 nt, Homo sapiens
cuacauuccuagccuccaa

SEQ ID NO: 570394 - RNA, 19 nt, Homo sapiens
cgaaagacaacguggagau

SEQ ID NO: 570395 - RNA, 19 nt, Homo sapiens
ugaaccaggugaauaacca

SEQ ID NO: 570396 - RNA, 19 nt, Homo sapiens
ggaguuucuucuucccaau

SEQ ID NO: 570397 - RNA, 19 nt, Homo sapiens
gaggaagggcagcugauuc

SEQ ID NO: 570398 - RNA, 19 nt, Homo sapiens
uggccauucugcacaguaa

SEQ ID NO: 570399 - RNA, 19 nt, Homo sapiens
gaaaggccucaucaucauc

SEQ ID NO: 570400 - RNA, 19 nt, Homo sapiens
ccaccgaucagccuaaaca

SEQ ID NO: 570401 - RNA, 19 nt, Homo sapiens
caucagcugugccaauugc

SEQ ID NO: 570402 - RNA, 19 nt, Homo sapiens
cuagugaauuuccaucagu

SEQ ID NO: 570403 - RNA, 19 nt, Homo sapiens
gucaccaacuuguucucua

SEQ ID NO: 570404 - RNA, 19 nt, Homo sapiens
gcaccuggccaugucgaaa

SEQ ID NO: 570405 - RNA, 19 nt, Homo sapiens
ccgcuucgacugugccaua

SEQ ID NO: 570406 - RNA, 19 nt, Homo sapiens
ggcugggacuaaagaaaug

SEQ ID NO: 570407 - RNA, 19 nt, Homo sapiens
aaagacaacguggagauga

SEQ ID NO: 570408 - RNA, 19 nt, Homo sapiens
ggaugucaccgacuacaag

SEQ ID NO: 570409 - RNA, 19 nt, Homo sapiens
gggaugcccguuggacuuu

SEQ ID NO: 570410 - RNA, 19 nt, Homo sapiens
gcaccucugaguccauaga

SEQ ID NO: 570411 - RNA, 19 nt, Homo sapiens
gcgcaaccgcuucgacugu

SEQ ID NO: 570412 - RNA, 19 nt, Homo sapiens
gaucagccuaaacaaccua

SEQ ID NO: 570413 - RNA, 19 nt, Homo sapiens
gaaccaggugaauaaccaa

SEQ ID NO: 570414 - RNA, 19 nt, Homo sapiens
gugaauuuccaucaguauu

SEQ ID NO: 570415 - RNA, 19 nt, Homo sapiens
aggcaccucugaguccaua

SEQ ID NO: 570416 - RNA, 19 nt, Homo sapiens
guacugccacacucagaug

SEQ ID NO: 570417 - RNA, 19 nt, Homo sapiens
gagccaaaacugaaauaaa

SEQ ID NO: 570418 - RNA, 19 nt, Homo sapiens
cauccaguacuucagauug

SEQ ID NO: 570419 - RNA, 19 nt, Homo sapiens
caaggaacugggcaagaug

SEQ ID NO: 570420 - RNA, 19 nt, Homo sapiens
gccggacccuccuuuggau

SEQ ID NO: 570421 - RNA, 19 nt, Homo sapiens
cuaaacaaccuagaacuac

SEQ ID NO: 570422 - RNA, 19 nt, Homo sapiens
cagccuaaacaaccuagaa

SEQ ID NO: 570423 - RNA, 19 nt, Homo sapiens
gcaaugcucggugcaacau

SEQ ID NO: 570424 - RNA, 19 nt, Homo sapiens
gaggcugacgcccuaguga

SEQ ID NO: 570425 - RNA, 19 nt, Homo sapiens
agauggugguggacuguug

SEQ ID NO: 570426 - RNA, 19 nt, Homo sapiens
ucaggaaacccaaggugau

SEQ ID NO: 570427 - RNA, 19 nt, Homo sapiens
ggccaagaacgcagagaug

SEQ ID NO: 570428 - RNA, 19 nt, Homo sapiens
ugaccuguguggaugucuu

SEQ ID NO: 570429 - RNA, 19 nt, Homo sapiens
aagacaacguggagaugau

SEQ ID NO: 570430 - RNA, 19 nt, Homo sapiens
ccaauugcgcggagaacga

SEQ ID NO: 570431 - RNA, 19 nt, Homo sapiens
auccaguacuucagauuga

SEQ ID NO: 570432 - RNA, 19 nt, Homo sapiens
gcauccaguacuucagauu

SEQ ID NO: 570433 - RNA, 19 nt, Homo sapiens
gacccuccuuuggauauuc

SEQ ID NO: 570434 - RNA, 19 nt, Homo sapiens
gcugacgcccuagugaauu

SEQ ID NO: 570435 - RNA, 19 nt, Homo sapiens
gcucugcagcgccacauca

SEQ ID NO: 570436 - RNA, 19 nt, Homo sapiens
cuucgacugugccauagug

SEQ ID NO: 570437 - RNA, 19 nt, Homo sapiens
ggaugcccguuggacuuug

SEQ ID NO: 570438 - RNA, 19 nt, Homo sapiens
gugggcugcuggccaacaa

SEQ ID NO: 570439 - RNA, 19 nt, Homo sapiens
cuuguucucuaacccauuc

SEQ ID NO: 570440 - RNA, 19 nt, Homo sapiens
ggagauugcuaacugcuua

SEQ ID NO: 570441 - RNA, 19 nt, Homo sapiens
gaacaaaugccaagaacug

SEQ ID NO: 570442 - RNA, 19 nt, Homo sapiens
gaaauaaagcguccucuca

SEQ ID NO: 570443 - RNA, 19 nt, Homo sapiens
uaaagcaaauucaggacua

SEQ ID NO: 570444 - RNA, 19 nt, Homo sapiens
gccaagaacuguugugcaa

SEQ ID NO: 570445 - RNA, 19 nt, Homo sapiens
gaaaugcucuuuugcacaa

SEQ ID NO: 570446 - RNA, 19 nt, Homo sapiens
caaacugaguacaacuuaa

SEQ ID NO: 570447 - RNA, 19 nt, Homo sapiens
caagaacuguugugcaagu

SEQ ID NO: 570448 - RNA, 19 nt, Homo sapiens
uaaagcguccucucaguaa

SEQ ID NO: 570449 - RNA, 19 nt, Homo sapiens
gagaacaaaugccaagaac

SEQ ID NO: 570450 - RNA, 19 nt, Homo sapiens
caagucuucuguucccuuu

SEQ ID NO: 570451 - RNA, 19 nt, Homo sapiens
ccaaacugaguacaacuua

SEQ ID NO: 570452 - RNA, 19 nt, Homo sapiens
ugacuaccuugacuugaaa

SEQ ID NO: 570453 - RNA, 19 nt, Homo sapiens
gcccaagugugacugacua

SEQ ID NO: 570454 - RNA, 19 nt, Homo sapiens
gaaauaugguugcuuuugu

SEQ ID NO: 570455 - RNA, 19 nt, Homo sapiens
ccaaagugcugggauuaca

SEQ ID NO: 570456 - RNA, 19 nt, Homo sapiens
ggcgaggccuccaggauau

SEQ ID NO: 570457 - RNA, 19 nt, Homo sapiens
caaaugccaagaacuguug

SEQ ID NO: 570458 - RNA, 19 nt, Homo sapiens
ugaccaagauacagagauc

SEQ ID NO: 570459 - RNA, 19 nt, Homo sapiens
cugacuaccuugacuugaa

SEQ ID NO: 570460 - RNA, 19 nt, Homo sapiens
ggccacgacuguuguuaca

SEQ ID NO: 570461 - RNA, 19 nt, Homo sapiens
ggaacuguggguuguguug

SEQ ID NO: 570462 - RNA, 19 nt, Homo sapiens
ccacgacuguuguuacacu

SEQ ID NO: 570463 - RNA, 19 nt, Homo sapiens
auaaagcguccucucagua

SEQ ID NO: 570464 - RNA, 19 nt, Homo sapiens
aauaaagcguccucucagu

SEQ ID NO: 570465 - RNA, 19 nt, Homo sapiens
ggcaggaacuguggguugu

SEQ ID NO: 570466 - RNA, 19 nt, Homo sapiens
cgaggccuccaggauauua

SEQ ID NO: 570467 - RNA, 19 nt, Homo sapiens
gcaagugugaccaggagau

SEQ ID NO: 570468 - RNA, 19 nt, Homo sapiens
cggacucgcccaaguguga

SEQ ID NO: 570469 - RNA, 19 nt, Homo sapiens
agagaacaaaugccaagaa

SEQ ID NO: 570470 - RNA, 19 nt, Homo sapiens
ucagugaccaagauacaga

SEQ ID NO: 570471 - RNA, 19 nt, Homo sapiens
gcuuagcccaaacugagua

SEQ ID NO: 570472 - RNA, 19 nt, Homo sapiens
cuuccaaagugcugggauu

SEQ ID NO: 570473 - RNA, 19 nt, Homo sapiens
accaggagauugcuaacug

SEQ ID NO: 570474 - RNA, 19 nt, Homo sapiens
caagugugaccaggagauu

SEQ ID NO: 570475 - RNA, 19 nt, Homo sapiens
gaccggcagagaacaaaug

SEQ ID NO: 570476 - RNA, 19 nt, Homo sapiens
caggaacuguggguugugu

SEQ ID NO: 570477 - RNA, 19 nt, Homo sapiens
gacuugaaaugcucuuuug

SEQ ID NO: 570478 - RNA, 19 nt, Homo sapiens
aaagcguccucucaguaau

SEQ ID NO: 570479 - RNA, 19 nt, Homo sapiens
gccauggccacgacuguug

SEQ ID NO: 570480 - RNA, 19 nt, Homo sapiens
acaaaugccaagaacuguu

SEQ ID NO: 570481 - RNA, 19 nt, Homo sapiens
aagugugacugacuaccuu

SEQ ID NO: 570482 - RNA, 19 nt, Homo sapiens
ggauuacaggcgugaguca

SEQ ID NO: 570483 - RNA, 19 nt, Homo sapiens
cguccucucaguaaugaaa

SEQ ID NO: 570484 - RNA, 19 nt, Homo sapiens
gacugacuaccuugacuug

SEQ ID NO: 570485 - RNA, 19 nt, Homo sapiens
gugaccaggagauugcuaa

SEQ ID NO: 570486 - RNA, 19 nt, Homo sapiens
uaccuugacuugaaaugcu

SEQ ID NO: 570487 - RNA, 19 nt, Homo sapiens
ccaucgccuauaugaaaua

SEQ ID NO: 570488 - RNA, 19 nt, Homo sapiens
ggaguaauaacaucaaaag

SEQ ID NO: 570489 - RNA, 19 nt, Homo sapiens
uaaaggacuuggucuguuc

SEQ ID NO: 570490 - RNA, 19 nt, Homo sapiens
guaaaggacuuggucuguu

SEQ ID NO: 570491 - RNA, 19 nt, Homo sapiens
gcagggagcuggaaaacuu

SEQ ID NO: 570492 - RNA, 19 nt, Homo sapiens
gagcagaagccaucaagau

SEQ ID NO: 570493 - RNA, 19 nt, Homo sapiens
cuacuucucugacaacauc

SEQ ID NO: 570494 - RNA, 19 nt, Homo sapiens
gacgugcuguucaaaguug

SEQ ID NO: 570495 - RNA, 19 nt, Homo sapiens
ggacucaggcuacuucucu

SEQ ID NO: 570496 - RNA, 19 nt, Homo sapiens
gggaugggagcuacaguuu

SEQ ID NO: 570497 - RNA, 19 nt, Homo sapiens
ugaagaaccggaugcaguu

SEQ ID NO: 570498 - RNA, 19 nt, Homo sapiens
cagaacaugcggaugauug

SEQ ID NO: 570499 - RNA, 19 nt, Homo sapiens
ggacgugcuguucaaaguu

SEQ ID NO: 570500 - RNA, 19 nt, Homo sapiens
ucuauaccgugcuguuuga

SEQ ID NO: 570501 - RNA, 19 nt, Homo sapiens
ggaagccggaauacaagaa

SEQ ID NO: 570502 - RNA, 19 nt, Homo sapiens
caacaucuugugccacuuc

SEQ ID NO: 570503 - RNA, 19 nt, Homo sapiens
ccagcgccguggcuacaaa

SEQ ID NO: 570504 - RNA, 19 nt, Homo sapiens
gggaacaccagccgaagug

SEQ ID NO: 570505 - RNA, 19 nt, Homo sapiens
gguaaaggacuuggucugu

SEQ ID NO: 570506 - RNA, 19 nt, Homo sapiens
guccugauccugugauuuc

SEQ ID NO: 570507 - RNA, 19 nt, Homo sapiens
ccaauccaagcaguucuua

SEQ ID NO: 570508 - RNA, 19 nt, Homo sapiens
uuaacgcccugauucgaau

SEQ ID NO: 570509 - RNA, 19 nt, Homo sapiens
uccaugcccucaccaguau

SEQ ID NO: 570510 - RNA, 19 nt, Homo sapiens
cccuggaccuggugaagaa

SEQ ID NO: 570511 - RNA, 19 nt, Homo sapiens
gaagaaccggaugcaguug

SEQ ID NO: 570512 - RNA, 19 nt, Homo sapiens
gaagauccccuuugucagu

SEQ ID NO: 570513 - RNA, 19 nt, Homo sapiens
acacaggacagcagaagau

SEQ ID NO: 570514 - RNA, 19 nt, Homo sapiens
gcacacaggacagcagaag

SEQ ID NO: 570515 - RNA, 19 nt, Homo sapiens
ggauugaugacaccagcaa

SEQ ID NO: 570516 - RNA, 19 nt, Homo sapiens
ggacagggaggagcagaag

SEQ ID NO: 570517 - RNA, 19 nt, Homo sapiens
gaacaugcggaugauugau

SEQ ID NO: 570518 - RNA, 19 nt, Homo sapiens
ccaagacccgaauccagaa

SEQ ID NO: 570519 - RNA, 19 nt, Homo sapiens
caucuauaccgugcuguuu

SEQ ID NO: 570520 - RNA, 19 nt, Homo sapiens
guccuuggcuauucuugca

SEQ ID NO: 570521 - RNA, 19 nt, Homo sapiens
ccucugcgguaaaggacuu

SEQ ID NO: 570522 - RNA, 19 nt, Homo sapiens
gcaucuauaccgugcuguu

SEQ ID NO: 570523 - RNA, 19 nt, Homo sapiens
caggccaccuacaccacua

SEQ ID NO: 570524 - RNA, 19 nt, Homo sapiens
cagaagauccccuuuguca

SEQ ID NO: 570525 - RNA, 19 nt, Homo sapiens
ucaaaguuguccgcuacga

SEQ ID NO: 570526 - RNA, 19 nt, Homo sapiens
uggacgugcuguucaaagu

SEQ ID NO: 570527 - RNA, 19 nt, Homo sapiens
ggagcagaagccaucaaga

SEQ ID NO: 570528 - RNA, 19 nt, Homo sapiens
gagccgagggccauugagu

SEQ ID NO: 570529 - RNA, 19 nt, Homo sapiens
ggaccccucuauuuauuuc

SEQ ID NO: 570530 - RNA, 19 nt, Homo sapiens
gaugaacaaggccuacaag

SEQ ID NO: 570531 - RNA, 19 nt, Homo sapiens
ucaccuucaucuucuugga

SEQ ID NO: 570532 - RNA, 19 nt, Homo sapiens
guccucaccuucaucuucu

SEQ ID NO: 570533 - RNA, 19 nt, Homo sapiens
agaacaugcggaugauuga

SEQ ID NO: 570534 - RNA, 19 nt, Homo sapiens
caucuugugccacuucugu

SEQ ID NO: 570535 - RNA, 19 nt, Homo sapiens
gauccugugauuucucugu

SEQ ID NO: 570536 - RNA, 19 nt, Homo sapiens
caggcuacuucucugacaa

SEQ ID NO: 570537 - RNA, 19 nt, Homo sapiens
ucucuguccuuggcuauuc

SEQ ID NO: 570538 - RNA, 19 nt, Homo sapiens
ggcuggacgugcuguucaa

SEQ ID NO: 570539 - RNA, 19 nt, Homo sapiens
gggaagccggaauacaaga

SEQ ID NO: 570540 - RNA, 19 nt, Homo sapiens
gggcuucacgccguacuau

SEQ ID NO: 570541 - RNA, 19 nt, Homo sapiens
gggcuggacgugcuguuca

SEQ ID NO: 570542 - RNA, 19 nt, Homo sapiens
ccaagaaccugcucaagaa

SEQ ID NO: 570543 - RNA, 19 nt, Homo sapiens
ugaaggagcacccugacua

SEQ ID NO: 570544 - RNA, 19 nt, Homo sapiens
agacuggcauagacccuua

SEQ ID NO: 570545 - RNA, 19 nt, Homo sapiens
gaccaagacuggcauagac

SEQ ID NO: 570546 - RNA, 19 nt, Homo sapiens
gcuacguggugcccuguaa

SEQ ID NO: 570547 - RNA, 19 nt, Homo sapiens
ggagcacccugacuacaag

SEQ ID NO: 570548 - RNA, 19 nt, Homo sapiens
gcagagaagcggccauaca

SEQ ID NO: 570549 - RNA, 19 nt, Homo sapiens
guggugcccuguaacugua

SEQ ID NO: 570550 - RNA, 19 nt, Homo sapiens
cccaagaaccugcucaaga

SEQ ID NO: 570551 - RNA, 19 nt, Homo sapiens
gaaggagcacccugacuac

SEQ ID NO: 570552 - RNA, 19 nt, Homo sapiens
cagagaagcggccauacau

SEQ ID NO: 570553 - RNA, 19 nt, Homo sapiens
ucaagaaggacagguaugu

SEQ ID NO: 570554 - RNA, 19 nt, Homo sapiens
agaaccugcucaagaagga

SEQ ID NO: 570555 - RNA, 19 nt, Homo sapiens
gcucaagaaggacagguau

SEQ ID NO: 570556 - RNA, 19 nt, Homo sapiens
gaagcggccauacaucgau

SEQ ID NO: 570557 - RNA, 19 nt, Homo sapiens
cgagcgccauccagaagau

SEQ ID NO: 570558 - RNA, 19 nt, Homo sapiens
gaucagcaaacgccuaggu

SEQ ID NO: 570559 - RNA, 19 nt, Homo sapiens
gcgcccagcacaugaagga

SEQ ID NO: 570560 - RNA, 19 nt, Homo sapiens
caacucggagaucagcaaa

SEQ ID NO: 570561 - RNA, 19 nt, Homo sapiens
ccacgcuacggccauguaa

SEQ ID NO: 570562 - RNA, 19 nt, Homo sapiens
gcucgagcgccauccagaa

SEQ ID NO: 570563 - RNA, 19 nt, Homo sapiens
ugaccaagacuggcauaga

SEQ ID NO: 570564 - RNA, 19 nt, Homo sapiens
gcaagauggcccaggaaaa

SEQ ID NO: 570565 - RNA, 19 nt, Homo sapiens
acgccuaggugccgaaugg

SEQ ID NO: 570566 - RNA, 19 nt, Homo sapiens
uggcauagacccuuauucg

SEQ ID NO: 570567 - RNA, 19 nt, Homo sapiens
gcagagaacucaucaaaug

SEQ ID NO: 570568 - RNA, 19 nt, Homo sapiens
gcaaaucuauuccuacuug

SEQ ID NO: 570569 - RNA, 19 nt, Homo sapiens
gaagguacauuggacauaa

SEQ ID NO: 570570 - RNA, 19 nt, Homo sapiens
cgagagagcucaauccauu

SEQ ID NO: 570571 - RNA, 19 nt, Homo sapiens
gauagagucuugacacauu

SEQ ID NO: 570572 - RNA, 19 nt, Homo sapiens
ggaaagggauuuaaagagu

SEQ ID NO: 570573 - RNA, 19 nt, Homo sapiens
gagacuggcucaagaauau

SEQ ID NO: 570574 - RNA, 19 nt, Homo sapiens
gaaagggauuuaaagaguu

SEQ ID NO: 570575 - RNA, 19 nt, Homo sapiens
ggaaagccaugaacaguca

SEQ ID NO: 570576 - RNA, 19 nt, Homo sapiens
caccagguauuuaacauua

SEQ ID NO: 570577 - RNA, 19 nt, Homo sapiens
gaacucaacuuuccagcau

SEQ ID NO: 570578 - RNA, 19 nt, Homo sapiens
ucuaaccacuucagaaaua

SEQ ID NO: 570579 - RNA, 19 nt, Homo sapiens
gaacaugcugguuaucuaa

SEQ ID NO: 570580 - RNA, 19 nt, Homo sapiens
gaagacgauucccaccaua

SEQ ID NO: 570581 - RNA, 19 nt, Homo sapiens
ugacagagcagcagaauau

SEQ ID NO: 570582 - RNA, 19 nt, Homo sapiens
gcagagaaauaaagucaag

SEQ ID NO: 570583 - RNA, 19 nt, Homo sapiens
gaacgucaauaagcacauu

SEQ ID NO: 570584 - RNA, 19 nt, Homo sapiens
ggaagagucugaucaacca

SEQ ID NO: 570585 - RNA, 19 nt, Homo sapiens
gagcaggauccaaauauuu

SEQ ID NO: 570586 - RNA, 19 nt, Homo sapiens
caagaacaaccuagaaauu

SEQ ID NO: 570587 - RNA, 19 nt, Homo sapiens
ggccacugcuuuggaauua

SEQ ID NO: 570588 - RNA, 19 nt, Homo sapiens
uaaaugagaagcagagaaa

SEQ ID NO: 570589 - RNA, 19 nt, Homo sapiens
gcaggaggaugaauuugau

SEQ ID NO: 570590 - RNA, 19 nt, Homo sapiens
ccacaaugauaaccaagaa

SEQ ID NO: 570591 - RNA, 19 nt, Homo sapiens
gccaagagcugggauugaa

SEQ ID NO: 570592 - RNA, 19 nt, Homo sapiens
gagaguaauugcuugacaa

SEQ ID NO: 570593 - RNA, 19 nt, Homo sapiens
gaccaacacccuauggaua

SEQ ID NO: 570594 - RNA, 19 nt, Homo sapiens
caagaaaguaucacaaaga

SEQ ID NO: 570595 - RNA, 19 nt, Homo sapiens
aagcagagcuaacgaggaa

SEQ ID NO: 570596 - RNA, 19 nt, Homo sapiens
gacaagacaaugagaguaa

SEQ ID NO: 570597 - RNA, 19 nt, Homo sapiens
gaagaggacauagaugaaa

SEQ ID NO: 570598 - RNA, 19 nt, Homo sapiens
gcccagaaaucauggaguu

SEQ ID NO: 570599 - RNA, 19 nt, Homo sapiens
ucaauaagcacauucaaga

SEQ ID NO: 570600 - RNA, 19 nt, Homo sapiens
gaucaaccaacucaaguaa

SEQ ID NO: 570601 - RNA, 19 nt, Homo sapiens
uaauuucacucucugcauu

SEQ ID NO: 570602 - RNA, 19 nt, Homo sapiens
ccacugcuuuggaauuaaa

SEQ ID NO: 570603 - RNA, 19 nt, Homo sapiens
uaacuccaaugcagaaaug

SEQ ID NO: 570604 - RNA, 19 nt, Homo sapiens
caucaguacuaaagucaaa

SEQ ID NO: 570605 - RNA, 19 nt, Homo sapiens
uuaaagaucuggaaagcau

SEQ ID NO: 570606 - RNA, 19 nt, Homo sapiens
ugcauugacuuaugagaua

SEQ ID NO: 570607 - RNA, 19 nt, Homo sapiens
gaagccaacucugaacaug

SEQ ID NO: 570608 - RNA, 19 nt, Homo sapiens
gcuaguuccugucaucuau

SEQ ID NO: 570609 - RNA, 19 nt, Homo sapiens
gcaugagcuuccaguguaa

SEQ ID NO: 570610 - RNA, 19 nt, Homo sapiens
ggaagacaauacccaaucu

SEQ ID NO: 570611 - RNA, 19 nt, Homo sapiens
gcaccaagaggccaagaaa

SEQ ID NO: 570612 - RNA, 19 nt, Homo sapiens
aaacauagccaaggccuaa

SEQ ID NO: 570613 - RNA, 19 nt, Homo sapiens
ugaacaugcugguuaucua

SEQ ID NO: 570614 - RNA, 19 nt, Homo sapiens
ccacaaagagacagaagaa

SEQ ID NO: 570615 - RNA, 19 nt, Homo sapiens
gcaagaugcaggaggauga

SEQ ID NO: 570616 - RNA, 19 nt, Homo sapiens
gaggaaagggauuuaaaga

SEQ ID NO: 570617 - RNA, 19 nt, Homo sapiens
gcauaacccguuucuuuga

SEQ ID NO: 570618 - RNA, 19 nt, Homo sapiens
ugcaugagcuuccagugua

SEQ ID NO: 570619 - RNA, 19 nt, Homo sapiens
cccgacaaaugcaagauua

SEQ ID NO: 570620 - RNA, 19 nt, Homo sapiens
uaaagaagaggacauagau

SEQ ID NO: 570621 - RNA, 19 nt, Homo sapiens
gcucaagaauauccucaug

SEQ ID NO: 570622 - RNA, 19 nt, Homo sapiens
caagaaagcagagaacuca

SEQ ID NO: 570623 - RNA, 19 nt, Homo sapiens
cagaauaucaacuccagua

SEQ ID NO: 570624 - RNA, 19 nt, Homo sapiens
uacccaaucugaugauauu

SEQ ID NO: 570625 - RNA, 19 nt, Homo sapiens
gacaauacccaaucugaug

SEQ ID NO: 570626 - RNA, 19 nt, Homo sapiens
gcaaaauacuguacauugu

SEQ ID NO: 570627 - RNA, 19 nt, Homo sapiens
caacaaggauaagcacauc

SEQ ID NO: 570628 - RNA, 19 nt, Homo sapiens
cugcauaacccguuucuuu

SEQ ID NO: 570629 - RNA, 19 nt, Homo sapiens
gggcaaagaagcagagcua

SEQ ID NO: 570630 - RNA, 19 nt, Homo sapiens
gaaagcagagaacucauca

SEQ ID NO: 570631 - RNA, 19 nt, Homo sapiens
caagagcaggauccaaaua

SEQ ID NO: 570632 - RNA, 19 nt, Homo sapiens
guuaguuccuucacagauu

SEQ ID NO: 570633 - RNA, 19 nt, Homo sapiens
aaacagcaguauccacaga

SEQ ID NO: 570634 - RNA, 19 nt, Homo sapiens
aaacuggccuagaagcuau

SEQ ID NO: 570635 - RNA, 19 nt, Homo sapiens
aaagaggccacaucuguaa

SEQ ID NO: 570636 - RNA, 19 nt, Homo sapiens
caucgaacgucaauaagca

SEQ ID NO: 570637 - RNA, 19 nt, Homo sapiens
acaagaagauaacuccaau

SEQ ID NO: 570638 - RNA, 19 nt, Homo sapiens
aguaauugcuugacaacaa

SEQ ID NO: 570639 - RNA, 19 nt, Homo sapiens
gaauaucaacuccaguaga

SEQ ID NO: 570640 - RNA, 19 nt, Homo sapiens
ucaagaauauccucaugca

SEQ ID NO: 570641 - RNA, 19 nt, Homo sapiens
aaucagaccuaugcuaguu

SEQ ID NO: 570642 - RNA, 19 nt, Homo sapiens
caagaaagaaagacagaau

SEQ ID NO: 570643 - RNA, 19 nt, Homo sapiens
gaacaggagcaguaaacau

SEQ ID NO: 570644 - RNA, 19 nt, Homo sapiens
cagcugcaaucccgacaaa

SEQ ID NO: 570645 - RNA, 19 nt, Homo sapiens
cauaauaucaugugcacuu

SEQ ID NO: 570646 - RNA, 19 nt, Homo sapiens
ccaggaaucugcaacaaaa

SEQ ID NO: 570647 - RNA, 19 nt, Homo sapiens
uuagugaacuugaccaaca

SEQ ID NO: 570648 - RNA, 19 nt, Homo sapiens
gaugauggcggcacugaug

SEQ ID NO: 570649 - RNA, 19 nt, Homo sapiens
guaauaccacgcccagaaa

SEQ ID NO: 570650 - RNA, 19 nt, Homo sapiens
aacaggagcaguaaacaua

SEQ ID NO: 570651 - RNA, 19 nt, Homo sapiens
ccagggaaauccaggaauc

SEQ ID NO: 570652 - RNA, 19 nt, Homo sapiens
caacuccaguagacuugaa

SEQ ID NO: 570653 - RNA, 19 nt, Homo sapiens
gaugcaggaggaugaauuu

SEQ ID NO: 570654 - RNA, 19 nt, Homo sapiens
caacaagaaaguaucacaa

SEQ ID NO: 570655 - RNA, 19 nt, Homo sapiens
gugaacagaaguuuaauuc

SEQ ID NO: 570656 - RNA, 19 nt, Homo sapiens
aagaagaggacauagauga

SEQ ID NO: 570657 - RNA, 19 nt, Homo sapiens
aaugagaagcagagaaaua

SEQ ID NO: 570658 - RNA, 19 nt, Homo sapiens
caacaaaaccccuugauca

SEQ ID NO: 570659 - RNA, 19 nt, Homo sapiens
agaaagaaagacagaauug

SEQ ID NO: 570660 - RNA, 19 nt, Homo sapiens
guugguacccacaaugaua

SEQ ID NO: 570661 - RNA, 19 nt, Homo sapiens
caaaccaacugcugaaacg

SEQ ID NO: 570662 - RNA, 19 nt, Homo sapiens
gcaccagguauuuaacauu

SEQ ID NO: 570663 - RNA, 19 nt, Homo sapiens
uagcauguaugacaagaca

SEQ ID NO: 570664 - RNA, 19 nt, Homo sapiens
aagcagagaacucaucaaa

SEQ ID NO: 570665 - RNA, 19 nt, Homo sapiens
agagcaggauccaaauauu

SEQ ID NO: 570666 - RNA, 19 nt, Homo sapiens
cgacaaaugcaagauuauu

SEQ ID NO: 570667 - RNA, 19 nt, Homo sapiens
ggagaacgcugcagaaauu

SEQ ID NO: 570668 - RNA, 19 nt, Homo sapiens
gcaagauucugucaacauu

SEQ ID NO: 570669 - RNA, 19 nt, Homo sapiens
guaagacuccguuuaauuu

SEQ ID NO: 570670 - RNA, 19 nt, Homo sapiens
aagauuaccugucacuuua

SEQ ID NO: 570671 - RNA, 19 nt, Homo sapiens
gaaaugguguuugcgagua

SEQ ID NO: 570672 - RNA, 19 nt, Homo sapiens
gcuuaaaggucauguguga

SEQ ID NO: 570673 - RNA, 19 nt, Homo sapiens
gcaaacgccugaagcaauc

SEQ ID NO: 570674 - RNA, 19 nt, Homo sapiens
aagcaaagauuaccuguca

SEQ ID NO: 570675 - RNA, 19 nt, Homo sapiens
ccaaagcuauggagaguca

SEQ ID NO: 570676 - RNA, 19 nt, Homo sapiens
gagaagaaaccaaagcuau

SEQ ID NO: 570677 - RNA, 19 nt, Homo sapiens
ggaaaucucguuuaaccuu

SEQ ID NO: 570678 - RNA, 19 nt, Homo sapiens
ccaaaggguuagaugaaga

SEQ ID NO: 570679 - RNA, 19 nt, Homo sapiens
ccuaagauccugcuuguug

SEQ ID NO: 570680 - RNA, 19 nt, Homo sapiens
gcagcucguucuccgguuu

SEQ ID NO: 570681 - RNA, 19 nt, Homo sapiens
caacgggcauauagguuug

SEQ ID NO: 570682 - RNA, 19 nt, Homo sapiens
gagcaaaugauaaacugaa

SEQ ID NO: 570683 - RNA, 19 nt, Homo sapiens
ugacugagcagaacaaauc

SEQ ID NO: 570684 - RNA, 19 nt, Homo sapiens
guuguaagacuccguuuaa

SEQ ID NO: 570685 - RNA, 19 nt, Homo sapiens
gauccugcuuguuguaaga

SEQ ID NO: 570686 - RNA, 19 nt, Homo sapiens
ggaggacugugggagaauu

SEQ ID NO: 570687 - RNA, 19 nt, Homo sapiens
gugaaauucuccuacaugu

SEQ ID NO: 570688 - RNA, 19 nt, Homo sapiens
gggaagagacugcauugug

SEQ ID NO: 570689 - RNA, 19 nt, Homo sapiens
caagggagaagaaaccaaa

SEQ ID NO: 570690 - RNA, 19 nt, Homo sapiens
uuaaggaaaugaugugcuu

SEQ ID NO: 570691 - RNA, 19 nt, Homo sapiens
ggagaagaaaccaaagcua

SEQ ID NO: 570692 - RNA, 19 nt, Homo sapiens
gagggaaaaugaaaugaaa

SEQ ID NO: 570693 - RNA, 19 nt, Homo sapiens
ccacagugcagaucaguug

SEQ ID NO: 570694 - RNA, 19 nt, Homo sapiens
gaagaaaccaaagcuaugg

SEQ ID NO: 570695 - RNA, 19 nt, Homo sapiens
ggucagcuguccaaagagu

SEQ ID NO: 570696 - RNA, 19 nt, Homo sapiens
ccugucacuuuaccuguua

SEQ ID NO: 570697 - RNA, 19 nt, Homo sapiens
gaugaagaaagcaaagauu

SEQ ID NO: 570698 - RNA, 19 nt, Homo sapiens
aaacucaggcaguggauuu

SEQ ID NO: 570699 - RNA, 19 nt, Homo sapiens
gagauuuucuuuuggauga

SEQ ID NO: 570700 - RNA, 19 nt, Homo sapiens
gaaauucauccguagagau

SEQ ID NO: 570701 - RNA, 19 nt, Homo sapiens
agagggaacagaaaucuuu

SEQ ID NO: 570702 - RNA, 19 nt, Homo sapiens
acacacagaucaagguagu

SEQ ID NO: 570703 - RNA, 19 nt, Homo sapiens
caguggauuucaucaacua

SEQ ID NO: 570704 - RNA, 19 nt, Homo sapiens
agaucaagguagugaaauu

SEQ ID NO: 570705 - RNA, 19 nt, Homo sapiens
gcugagaguuggugcuaca

SEQ ID NO: 570706 - RNA, 19 nt, Homo sapiens
ugucugaguuugauacugu

SEQ ID NO: 570707 - RNA, 19 nt, Homo sapiens
gagagucaacgggcauaua

SEQ ID NO: 570708 - RNA, 19 nt, Homo sapiens
gaagagggaacagaaaucu

SEQ ID NO: 570709 - RNA, 19 nt, Homo sapiens
cuggucagcuguccaaaga

SEQ ID NO: 570710 - RNA, 19 nt, Homo sapiens
uguaagacuccguuuaauu

SEQ ID NO: 570711 - RNA, 19 nt, Homo sapiens
cuuuggaaaucucguuuaa

SEQ ID NO: 570712 - RNA, 19 nt, Homo sapiens
aagauucugucaacauuuc

SEQ ID NO: 570713 - RNA, 19 nt, Homo sapiens
ucaacgggcauauagguuu

SEQ ID NO: 570714 - RNA, 19 nt, Homo sapiens
aaaugguguuugcgaguaa

SEQ ID NO: 570715 - RNA, 19 nt, Homo sapiens
acauguggaccaucaauaa

SEQ ID NO: 570716 - RNA, 19 nt, Homo sapiens
aaauucauccguagagauu

SEQ ID NO: 570717 - RNA, 19 nt, Homo sapiens
caaaggguuagaugaagaa

SEQ ID NO: 570718 - RNA, 19 nt, Homo sapiens
cgaggugaguguugugcaa

SEQ ID NO: 570719 - RNA, 19 nt, Homo sapiens
gaucaagguagugaaauuc

SEQ ID NO: 570720 - RNA, 19 nt, Homo sapiens
gcaguggauuucaucaacu

SEQ ID NO: 570721 - RNA, 19 nt, Homo sapiens
gcuggcagaugaguuagga

SEQ ID NO: 570722 - RNA, 19 nt, Homo sapiens
caagauucugucaacauuu

SEQ ID NO: 570723 - RNA, 19 nt, Homo sapiens
ugacaagcuuacccucuuc

SEQ ID NO: 570724 - RNA, 19 nt, Homo sapiens
ccacugaccaccagguaga

SEQ ID NO: 570725 - RNA, 19 nt, Homo sapiens
uaagauccugcuuguugua

SEQ ID NO: 570726 - RNA, 19 nt, Homo sapiens
cuaagauccugcuuguugu

SEQ ID NO: 570727 - RNA, 19 nt, Homo sapiens
caagaaauucauccguaga

SEQ ID NO: 570728 - RNA, 19 nt, Homo sapiens
gcaaagauuaccugucacu

SEQ ID NO: 570729 - RNA, 19 nt, Homo sapiens
gggaggaaaugggugaagu

SEQ ID NO: 570730 - RNA, 19 nt, Homo sapiens
ggauaucccagcgguggua

SEQ ID NO: 570731 - RNA, 19 nt, Homo sapiens
gaagcagcagccacuguug

SEQ ID NO: 570732 - RNA, 19 nt, Homo sapiens
ggcaguggauuucaucaac

SEQ ID NO: 570733 - RNA, 19 nt, Homo sapiens
gacugcugcuuguguguug

SEQ ID NO: 570734 - RNA, 19 nt, Homo sapiens
uaggaggacugugggagaa

SEQ ID NO: 570735 - RNA, 19 nt, Homo sapiens
guagagauuuucuuuugga

SEQ ID NO: 570736 - RNA, 19 nt, Homo sapiens
agaagaaaccaaagcuaug

SEQ ID NO: 570737 - RNA, 19 nt, Homo sapiens
gaagcaauccuaagauccu

SEQ ID NO: 570738 - RNA, 19 nt, Homo sapiens
uggauuucaucaacuauca

SEQ ID NO: 570739 - RNA, 19 nt, Homo sapiens
cagugcagaucaguugaaa

SEQ ID NO: 570740 - RNA, 19 nt, Homo sapiens
aggaugcccucugcaguaa

SEQ ID NO: 570741 - RNA, 19 nt, Homo sapiens
gcgcuuaaaggucaugugu

SEQ ID NO: 570742 - RNA, 19 nt, Homo sapiens
gauguggagccugaaguuu

SEQ ID NO: 570743 - RNA, 19 nt, Homo sapiens
ggugaagagggaacagaaa

SEQ ID NO: 570744 - RNA, 19 nt, Homo sapiens
gauaaacugaaaugguguu

SEQ ID NO: 570745 - RNA, 19 nt, Homo sapiens
ugaguguugugcaagauuc

SEQ ID NO: 570746 - RNA, 19 nt, Homo sapiens
caacgggcuucucccugau

SEQ ID NO: 570747 - RNA, 19 nt, Homo sapiens
agaaauucauccguagaga

SEQ ID NO: 570748 - RNA, 19 nt, Homo sapiens
agagugaaguucgggcaaa

SEQ ID NO: 570749 - RNA, 19 nt, Homo sapiens
gugaagagggaacagaaau

SEQ ID NO: 570750 - RNA, 19 nt, Homo sapiens
cugaagcaauccuaagauc

SEQ ID NO: 570751 - RNA, 19 nt, Homo sapiens
ggaauuccaggcucacaag

SEQ ID NO: 570752 - RNA, 19 nt, Homo sapiens
gaaugccaagggagaagaa

SEQ ID NO: 570753 - RNA, 19 nt, Homo sapiens
ggagcaaaugauaaacuga

SEQ ID NO: 570754 - RNA, 19 nt, Homo sapiens
acacagaucaagguaguga

SEQ ID NO: 570755 - RNA, 19 nt, Homo sapiens
gaccaucaauaacuuuagc

SEQ ID NO: 570756 - RNA, 19 nt, Homo sapiens
cuacacacagaucaaggua

SEQ ID NO: 570757 - RNA, 19 nt, Homo sapiens
ccggcuggcagaugaguua

SEQ ID NO: 570758 - RNA, 19 nt, Homo sapiens
aaccaaagcuauggagagu

SEQ ID NO: 570759 - RNA, 19 nt, Homo sapiens
gaagaaagcaaagauuacc

SEQ ID NO: 570760 - RNA, 19 nt, Homo sapiens
gauguugcggacaguauga

SEQ ID NO: 570761 - RNA, 19 nt, Homo sapiens
gagggaacagaaaucuuug

SEQ ID NO: 570762 - RNA, 19 nt, Homo sapiens
gcgucacuguguucccuuu

SEQ ID NO: 570763 - RNA, 19 nt, Homo sapiens
acagaucaagguagugaaa

SEQ ID NO: 570764 - RNA, 19 nt, Homo sapiens
ugaaauggaggagagcaaa

SEQ ID NO: 570765 - RNA, 19 nt, Homo sapiens
ccguagagauuuucuuuug

SEQ ID NO: 570766 - RNA, 19 nt, Homo sapiens
gaggaaaugggugaaguca

SEQ ID NO: 570767 - RNA, 19 nt, Homo sapiens
uaagggcacuugcaaauuu

SEQ ID NO: 570768 - RNA, 19 nt, Homo sapiens
gaaaugagccagaccugua

SEQ ID NO: 570769 - RNA, 19 nt, Homo sapiens
ugacagagcugagaauaag

SEQ ID NO: 570770 - RNA, 19 nt, Homo sapiens
ucacauguauggacaacaa

SEQ ID NO: 570771 - RNA, 19 nt, Homo sapiens
cacccuagauauaaagaua

SEQ ID NO: 570772 - RNA, 19 nt, Homo sapiens
cagcgacggugauaauuau

SEQ ID NO: 570773 - RNA, 19 nt, Homo sapiens
cagauggaauucuuacuga

SEQ ID NO: 570774 - RNA, 19 nt, Homo sapiens
gcaaauggaggguuuaagu

SEQ ID NO: 570775 - RNA, 19 nt, Homo sapiens
gagcggaccgucacaugua

SEQ ID NO: 570776 - RNA, 19 nt, Homo sapiens
ggagacacccgaaggaaga

SEQ ID NO: 570777 - RNA, 19 nt, Homo sapiens
guauggugcuaguggauaa

SEQ ID NO: 570778 - RNA, 19 nt, Homo sapiens
gguauucacacccuagaua

SEQ ID NO: 570779 - RNA, 19 nt, Homo sapiens
gagaaugguuacaugaagu

SEQ ID NO: 570780 - RNA, 19 nt, Homo sapiens
gagcuuucuuugcacuuaa

SEQ ID NO: 570781 - RNA, 19 nt, Homo sapiens
caugaugguuccucucuug

SEQ ID NO: 570782 - RNA, 19 nt, Homo sapiens
uguaacaccugacaugaug

SEQ ID NO: 570783 - RNA, 19 nt, Homo sapiens
cagcugcacuucuggauca

SEQ ID NO: 570784 - RNA, 19 nt, Homo sapiens
gaauaagggcacuugcaaa

SEQ ID NO: 570785 - RNA, 19 nt, Homo sapiens
guacacagucuaugacaga

SEQ ID NO: 570786 - RNA, 19 nt, Homo sapiens
gaaggaacgcauugcagaa

SEQ ID NO: 570787 - RNA, 19 nt, Homo sapiens
ucaaggaggauacuacaaa

SEQ ID NO: 570788 - RNA, 19 nt, Homo sapiens
ccucuucauugucuacaua

SEQ ID NO: 570789 - RNA, 19 nt, Homo sapiens
gaagagaugguccuacaag

SEQ ID NO: 570790 - RNA, 19 nt, Homo sapiens
agacacagcagauggaauu

SEQ ID NO: 570791 - RNA, 19 nt, Homo sapiens
gcagaacccaacaaacuga

SEQ ID NO: 570792 - RNA, 19 nt, Homo sapiens
gauauggaaccuccuagaa

SEQ ID NO: 570793 - RNA, 19 nt, Homo sapiens
ccagcgacggugauaauua

SEQ ID NO: 570794 - RNA, 19 nt, Homo sapiens
gcauggcucuucccuacug

SEQ ID NO: 570795 - RNA, 19 nt, Homo sapiens
gaaauuagaacccauaacc

SEQ ID NO: 570796 - RNA, 19 nt, Homo sapiens
ggaaccaggugcgacauuc

SEQ ID NO: 570797 - RNA, 19 nt, Homo sapiens
aaggucaucugcaaacaaa

SEQ ID NO: 570798 - RNA, 19 nt, Homo sapiens
aagaagagaugguccuaca

SEQ ID NO: 570799 - RNA, 19 nt, Homo sapiens
gcagauggaauucuuacug

SEQ ID NO: 570800 - RNA, 19 nt, Homo sapiens
uauggaaccuccuagaauc

SEQ ID NO: 570801 - RNA, 19 nt, Homo sapiens
gccagcaaauggaggguuu

SEQ ID NO: 570802 - RNA, 19 nt, Homo sapiens
gaccauauuuacucuuucu

SEQ ID NO: 570803 - RNA, 19 nt, Homo sapiens
ugagcuuucuuugcacuua

SEQ ID NO: 570804 - RNA, 19 nt, Homo sapiens
caggauaggagcaaagauu

SEQ ID NO: 570805 - RNA, 19 nt, Homo sapiens
gcaaauuucgaguuaaagu

SEQ ID NO: 570806 - RNA, 19 nt, Homo sapiens
gaaucccacucuacuccuu

SEQ ID NO: 570807 - RNA, 19 nt, Homo sapiens
gauaggagcaaagauuaug

SEQ ID NO: 570808 - RNA, 19 nt, Homo sapiens
gauggugccuacuuuaacu

SEQ ID NO: 570809 - RNA, 19 nt, Homo sapiens
gaucugccagucaaacaaa

SEQ ID NO: 570810 - RNA, 19 nt, Homo sapiens
gcuaucaacauguuauuca

SEQ ID NO: 570811 - RNA, 19 nt, Homo sapiens
gagaaauuagaacccauaa

SEQ ID NO: 570812 - RNA, 19 nt, Homo sapiens
agaaucaagugcccaagug

SEQ ID NO: 570813 - RNA, 19 nt, Homo sapiens
uauccuugauguacagauu

SEQ ID NO: 570814 - RNA, 19 nt, Homo sapiens
ccagagaaugguuacauga

SEQ ID NO: 570815 - RNA, 19 nt, Homo sapiens
gauggaauucuuacugaug

SEQ ID NO: 570816 - RNA, 19 nt, Homo sapiens
ggauaggagcaaagauuau

SEQ ID NO: 570817 - RNA, 19 nt, Homo sapiens
cgacggugauaauuaugga

SEQ ID NO: 570818 - RNA, 19 nt, Homo sapiens
acuugcaaauuucgaguua

SEQ ID NO: 570819 - RNA, 19 nt, Homo sapiens
cacagcagauggaauucuu

SEQ ID NO: 570820 - RNA, 19 nt, Homo sapiens
gggagacucaccacuagaa

SEQ ID NO: 570821 - RNA, 19 nt, Homo sapiens
caaauggaggguuuaagug

SEQ ID NO: 570822 - RNA, 19 nt, Homo sapiens
ucaccaggauacacguuga

SEQ ID NO: 570823 - RNA, 19 nt, Homo sapiens
uagauggugccuacuuuaa

SEQ ID NO: 570824 - RNA, 19 nt, Homo sapiens
uauucaaugugacaccuaa

SEQ ID NO: 570825 - RNA, 19 nt, Homo sapiens
cacaggcuaucaacauguu

SEQ ID NO: 570826 - RNA, 19 nt, Homo sapiens
auuaugagcuuucuuugca

SEQ ID NO: 570827 - RNA, 19 nt, Homo sapiens
gcagucccuuggucucuuc

SEQ ID NO: 570828 - RNA, 19 nt, Homo sapiens
caaggaggauacuacaaaa

SEQ ID NO: 570829 - RNA, 19 nt, Homo sapiens
gcucuucccuacugaucug

SEQ ID NO: 570830 - RNA, 19 nt, Homo sapiens
aggauaggagcaaagauua

SEQ ID NO: 570831 - RNA, 19 nt, Homo sapiens
caaacgcuguggcaaacuc

SEQ ID NO: 570832 - RNA, 19 nt, Homo sapiens
gagaauaagggcacuugca

SEQ ID NO: 570833 - RNA, 19 nt, Homo sapiens
ggaagagacacagcagaug

SEQ ID NO: 570834 - RNA, 19 nt, Homo sapiens
acaccuaacucuuuucuau

SEQ ID NO: 570835 - RNA, 19 nt, Homo sapiens
gaacccauaaccauacaca

SEQ ID NO: 570836 - RNA, 19 nt, Homo sapiens
agagaaauuagaacccaua

SEQ ID NO: 570837 - RNA, 19 nt, Homo sapiens
agagaaugguuacaugaag

SEQ ID NO: 570838 - RNA, 19 nt, Homo sapiens
cgaguuaaaguaagaguca

SEQ ID NO: 570839 - RNA, 19 nt, Homo sapiens
agaaggagaccacaagauc

SEQ ID NO: 570840 - RNA, 19 nt, Homo sapiens
ggauauggaaccuccuaga

SEQ ID NO: 570841 - RNA, 19 nt, Homo sapiens
caaacaaacgauggucuga

SEQ ID NO: 570842 - RNA, 19 nt, Homo sapiens
aacaaacgauggucugaca

SEQ ID NO: 570843 - RNA, 19 nt, Homo sapiens
guuccucucuuggcaauuc

SEQ ID NO: 570844 - RNA, 19 nt, Homo sapiens
gaacggcagcugcacuucu

SEQ ID NO: 570845 - RNA, 19 nt, Homo sapiens
cagagaaugguuacaugaa

SEQ ID NO: 570846 - RNA, 19 nt, Homo sapiens
aauaagggcacuugcaaau

SEQ ID NO: 570847 - RNA, 19 nt, Homo sapiens
gagacucaccacuagaaga

SEQ ID NO: 570848 - RNA, 19 nt, Homo sapiens
gugcagccaugaacgucaa

SEQ ID NO: 570849 - RNA, 19 nt, Homo sapiens
gagaccacaagauccagua

SEQ ID NO: 570850 - RNA, 19 nt, Homo sapiens
ggguuuaaguguguagaug

SEQ ID NO: 570851 - RNA, 19 nt, Homo sapiens
aaaugagccagaccuguaa

SEQ ID NO: 570852 - RNA, 19 nt, Homo sapiens
ggagcggaccgucacaugu

SEQ ID NO: 570853 - RNA, 19 nt, Homo sapiens
ggugugaguauuauuguuc

SEQ ID NO: 570854 - RNA, 19 nt, Homo sapiens
uacacaggcuaucaacaug

SEQ ID NO: 570855 - RNA, 19 nt, Homo sapiens
guauucacacccuagauau

SEQ ID NO: 570856 - RNA, 19 nt, Homo sapiens
agaauaagggcacuugcaa

SEQ ID NO: 570857 - RNA, 19 nt, Homo sapiens
caaggucaucugcaaacaa

SEQ ID NO: 570858 - RNA, 19 nt, Homo sapiens
gaaucaagugcccaagugu

SEQ ID NO: 570859 - RNA, 19 nt, Homo sapiens
gcacacgggaaagccuuaa

SEQ ID NO: 570860 - RNA, 19 nt, Homo sapiens
uaugacagagcugagaaua

SEQ ID NO: 570861 - RNA, 19 nt, Homo sapiens
aaacaaaagcgauguccua

SEQ ID NO: 570862 - RNA, 19 nt, Homo sapiens
ggaaccuccuagaaucaag

SEQ ID NO: 570863 - RNA, 19 nt, Homo sapiens
auucacacccuagauauaa

SEQ ID NO: 570864 - RNA, 19 nt, Homo sapiens
cagcaaauggaggguuuaa

SEQ ID NO: 570865 - RNA, 19 nt, Homo sapiens
uucauugucuacauaguga

SEQ ID NO: 570866 - RNA, 19 nt, Homo sapiens
gguccuacaagccgaaaug

SEQ ID NO: 570867 - RNA, 19 nt, Homo sapiens
gaaagaacauggccugugu

SEQ ID NO: 570868 - RNA, 19 nt, Homo sapiens
gaagaugaguuuguugauu

SEQ ID NO: 570869 - RNA, 19 nt, Homo sapiens
gaaacaauaugaugcagau

SEQ ID NO: 570870 - RNA, 19 nt, Homo sapiens
ccucggaacuucucagaua

SEQ ID NO: 570871 - RNA, 19 nt, Homo sapiens
gcagugacauucccagaga

SEQ ID NO: 570872 - RNA, 19 nt, Homo sapiens
gcugagcgcuauggcauua

SEQ ID NO: 570873 - RNA, 19 nt, Homo sapiens
uaacaccacugacaucuuc

SEQ ID NO: 570874 - RNA, 19 nt, Homo sapiens
gcaagcagcugagcgcuau

SEQ ID NO: 570875 - RNA, 19 nt, Homo sapiens
gcaggaacuuaauuuauag

SEQ ID NO: 570876 - RNA, 19 nt, Homo sapiens
ggacuggccuugcuucuac

SEQ ID NO: 570877 - RNA, 19 nt, Homo sapiens
caacuggccucuuccuuuc

SEQ ID NO: 570878 - RNA, 19 nt, Homo sapiens
ccacgaaugguuaauauau

SEQ ID NO: 570879 - RNA, 19 nt, Homo sapiens
uaugugagcucauuaaugc

SEQ ID NO: 570880 - RNA, 19 nt, Homo sapiens
gcagaagauugagaaacaa

SEQ ID NO: 570881 - RNA, 19 nt, Homo sapiens
ggagaauccucggaacuuc

SEQ ID NO: 570882 - RNA, 19 nt, Homo sapiens
ccaacugguucccuaagaa

SEQ ID NO: 570883 - RNA, 19 nt, Homo sapiens
ugaggaagaugaguuuguu

SEQ ID NO: 570884 - RNA, 19 nt, Homo sapiens
ccaacuggccucuuccuuu

SEQ ID NO: 570885 - RNA, 19 nt, Homo sapiens
ccacugacaucuuccaaac

SEQ ID NO: 570886 - RNA, 19 nt, Homo sapiens
ucaagcagauggagcagau

SEQ ID NO: 570887 - RNA, 19 nt, Homo sapiens
caacugguucccuaagaaa

SEQ ID NO: 570888 - RNA, 19 nt, Homo sapiens
gcugcaggaacuuaauuua

SEQ ID NO: 570889 - RNA, 19 nt, Homo sapiens
caagaacgugaucggguua

SEQ ID NO: 570890 - RNA, 19 nt, Homo sapiens
gcgagaacuuccagaacug

SEQ ID NO: 570891 - RNA, 19 nt, Homo sapiens
gcucauuaaugcacuguac

SEQ ID NO: 570892 - RNA, 19 nt, Homo sapiens
ccucguggcuucucauuuu

SEQ ID NO: 570893 - RNA, 19 nt, Homo sapiens
cagauaaccagcugcaaga

SEQ ID NO: 570894 - RNA, 19 nt, Homo sapiens
uaagaaauccaaggagaau

SEQ ID NO: 570895 - RNA, 19 nt, Homo sapiens
uggagcagaucucucaguu

SEQ ID NO: 570896 - RNA, 19 nt, Homo sapiens
agcagaagauugagaaaca

SEQ ID NO: 570897 - RNA, 19 nt, Homo sapiens
ggcaguagcccgagaugau

SEQ ID NO: 570898 - RNA, 19 nt, Homo sapiens
ggugcuaugugagcucauu

SEQ ID NO: 570899 - RNA, 19 nt, Homo sapiens
ggaagaugaguuuguugau

SEQ ID NO: 570900 - RNA, 19 nt, Homo sapiens
gcaguagcccgagaugaug

SEQ ID NO: 570901 - RNA, 19 nt, Homo sapiens
ucccacgaaugguuaauau

SEQ ID NO: 570902 - RNA, 19 nt, Homo sapiens
cuaagaaauccaaggagaa

SEQ ID NO: 570903 - RNA, 19 nt, Homo sapiens
gcuugaggaagaugaguuu

SEQ ID NO: 570904 - RNA, 19 nt, Homo sapiens
acaauaugaugcagaucug

SEQ ID NO: 570905 - RNA, 19 nt, Homo sapiens
acugacaucuuccaaacug

SEQ ID NO: 570906 - RNA, 19 nt, Homo sapiens
gcauuaacaccacugacau

SEQ ID NO: 570907 - RNA, 19 nt, Homo sapiens
caucaaaacuggaccaacu

SEQ ID NO: 570908 - RNA, 19 nt, Homo sapiens
gguucagccuguccuguca

SEQ ID NO: 570909 - RNA, 19 nt, Homo sapiens
gguuacagaugggcaccaa

SEQ ID NO: 570910 - RNA, 19 nt, Homo sapiens
gaggugcagcagaagauug

SEQ ID NO: 570911 - RNA, 19 nt, Homo sapiens
ggcauuaacaccacugaca

SEQ ID NO: 570912 - RNA, 19 nt, Homo sapiens
cugcaggaacuuaauuuau

SEQ ID NO: 570913 - RNA, 19 nt, Homo sapiens
cgcgagaacuuccagaacu

SEQ ID NO: 570914 - RNA, 19 nt, Homo sapiens
cucggaacuucucagauaa

SEQ ID NO: 570915 - RNA, 19 nt, Homo sapiens
cccaacugguucccuaaga

SEQ ID NO: 570916 - RNA, 19 nt, Homo sapiens
gcagcagaagauugagaaa

SEQ ID NO: 570917 - RNA, 19 nt, Homo sapiens
gcccuggccuauucugucu

SEQ ID NO: 570918 - RNA, 19 nt, Homo sapiens
uggaccaacuggccucuuc

SEQ ID NO: 570919 - RNA, 19 nt, Homo sapiens
caugcuuacuaauacauuc

SEQ ID NO: 570920 - RNA, 19 nt, Homo sapiens
gcccucccacgaaugguua

SEQ ID NO: 570921 - RNA, 19 nt, Homo sapiens
gaggaagaugaguuuguug

SEQ ID NO: 570922 - RNA, 19 nt, Homo sapiens
ugagaaacaauaugaugca

SEQ ID NO: 570923 - RNA, 19 nt, Homo sapiens
ggaggugcagcagaagauu

SEQ ID NO: 570924 - RNA, 19 nt, Homo sapiens
gcuaugugagcucauuaau

SEQ ID NO: 570925 - RNA, 19 nt, Homo sapiens
guggaccucugggaaggaa

SEQ ID NO: 570926 - RNA, 19 nt, Homo sapiens
gggaggugcagcagaagau

SEQ ID NO: 570927 - RNA, 19 nt, Homo sapiens
gacgcgagaacuuccagaa

SEQ ID NO: 570928 - RNA, 19 nt, Homo sapiens
aggaagaugaguuuguuga

SEQ ID NO: 570929 - RNA, 19 nt, Homo sapiens
ccuguccugucaccucuga

SEQ ID NO: 570930 - RNA, 19 nt, Homo sapiens
ggagcagaucucucaguuc

SEQ ID NO: 570931 - RNA, 19 nt, Homo sapiens
uauucugucucuccuucuu

SEQ ID NO: 570932 - RNA, 19 nt, Homo sapiens
cuaugugagcucauuaaug

SEQ ID NO: 570933 - RNA, 19 nt, Homo sapiens
gugcuaugugagcucauua

SEQ ID NO: 570934 - RNA, 19 nt, Homo sapiens
ugaaggaacugaaacauga

SEQ ID NO: 570935 - RNA, 19 nt, Homo sapiens
ggacacggcugcagcuuug

SEQ ID NO: 570936 - RNA, 19 nt, Homo sapiens
ucacugaccugcuccuuaa

SEQ ID NO: 570937 - RNA, 19 nt, Homo sapiens
ggaaauaaaccuuuggaau

SEQ ID NO: 570938 - RNA, 19 nt, Homo sapiens
ccacgcaggugcagaacua

SEQ ID NO: 570939 - RNA, 19 nt, Homo sapiens
gggcauguuugaauuuauu

SEQ ID NO: 570940 - RNA, 19 nt, Homo sapiens
ucaagugcauuaacaagaa

SEQ ID NO: 570941 - RNA, 19 nt, Homo sapiens
gcaguggccugguguuugu

SEQ ID NO: 570942 - RNA, 19 nt, Homo sapiens
cccaagcacuuuaugcaua

SEQ ID NO: 570943 - RNA, 19 nt, Homo sapiens
ggauacgucuuguaaucuu

SEQ ID NO: 570944 - RNA, 19 nt, Homo sapiens
guugaauguucucuugaua

SEQ ID NO: 570945 - RNA, 19 nt, Homo sapiens
ccaagcacuuuaugcauau

SEQ ID NO: 570946 - RNA, 19 nt, Homo sapiens
gggaauacuucaugcaaag

SEQ ID NO: 570947 - RNA, 19 nt, Homo sapiens
ugauagugcuggacccuuu

SEQ ID NO: 570948 - RNA, 19 nt, Homo sapiens
gcauggacuucgaugaguu

SEQ ID NO: 570949 - RNA, 19 nt, Homo sapiens
agaagaaccucgccaaguc

SEQ ID NO: 570950 - RNA, 19 nt, Homo sapiens
cuugauggcuuuauucuca

SEQ ID NO: 570951 - RNA, 19 nt, Homo sapiens
gauacgucuuguaaucuuu

SEQ ID NO: 570952 - RNA, 19 nt, Homo sapiens
gagauacccacccagcuuu

SEQ ID NO: 570953 - RNA, 19 nt, Homo sapiens
ucaccuugauggcuuuauu

SEQ ID NO: 570954 - RNA, 19 nt, Homo sapiens
ugaauguucucuugauagu

SEQ ID NO: 570955 - RNA, 19 nt, Homo sapiens
gcgagaagcacgauuugga

SEQ ID NO: 570956 - RNA, 19 nt, Homo sapiens
gaauacuucaugcaaagaa

SEQ ID NO: 570957 - RNA, 19 nt, Homo sapiens
cagaggcaguucuuuguuc

SEQ ID NO: 570958 - RNA, 19 nt, Homo sapiens
ggccugguguuuguacaua

SEQ ID NO: 570959 - RNA, 19 nt, Homo sapiens
ggagaucgcagcccugaag

SEQ ID NO: 570960 - RNA, 19 nt, Homo sapiens
ggacuuagaagaagaaaau

SEQ ID NO: 570961 - RNA, 19 nt, Homo sapiens
gcagaggcaguucuuuguu

SEQ ID NO: 570962 - RNA, 19 nt, Homo sapiens
gugcuuggacuuagaagaa

SEQ ID NO: 570963 - RNA, 19 nt, Homo sapiens
acuuguagguguuuaagaa

SEQ ID NO: 570964 - RNA, 19 nt, Homo sapiens
cuuguaaucuuucacacuu

SEQ ID NO: 570965 - RNA, 19 nt, Homo sapiens
ccacccagcuuugucaauc

SEQ ID NO: 570966 - RNA, 19 nt, Homo sapiens
gaagguggccgagcuacug

SEQ ID NO: 570967 - RNA, 19 nt, Homo sapiens
gcuggacccuuugucuauu

SEQ ID NO: 570968 - RNA, 19 nt, Homo sapiens
gguuagcccugccugaauc

SEQ ID NO: 570969 - RNA, 19 nt, Homo sapiens
uguagguguuuaagaauug

SEQ ID NO: 570970 - RNA, 19 nt, Homo sapiens
cggagagccugcaggagaa

SEQ ID NO: 570971 - RNA, 19 nt, Homo sapiens
gcacagcaaaggcaucauc

SEQ ID NO: 570972 - RNA, 19 nt, Homo sapiens
gaaggaacugaaacaugaa

SEQ ID NO: 570973 - RNA, 19 nt, Homo sapiens
auaccaacguaaggaaaua

SEQ ID NO: 570974 - RNA, 19 nt, Homo sapiens
gguugaauguucucuugau

SEQ ID NO: 570975 - RNA, 19 nt, Homo sapiens
cuugaaauauugccacugu

SEQ ID NO: 570976 - RNA, 19 nt, Homo sapiens
cacccaagcugcccgacuu

SEQ ID NO: 570977 - RNA, 19 nt, Homo sapiens
uccaggaaauggcuaauuc

SEQ ID NO: 570978 - RNA, 19 nt, Homo sapiens
gagaaaacuuguagguguu

SEQ ID NO: 570979 - RNA, 19 nt, Homo sapiens
cuggauacgucuuguaauc

SEQ ID NO: 570980 - RNA, 19 nt, Homo sapiens
auacacauaugcagacaca

SEQ ID NO: 570981 - RNA, 19 nt, Homo sapiens
caagcacuuuaugcauaua

SEQ ID NO: 570982 - RNA, 19 nt, Homo sapiens
ucgagaacgucaccaagug

SEQ ID NO: 570983 - RNA, 19 nt, Homo sapiens
ccacugugcuuggacuuag

SEQ ID NO: 570984 - RNA, 19 nt, Homo sapiens
ggucacacgccacauaaca

SEQ ID NO: 570985 - RNA, 19 nt, Homo sapiens
gcugcugacuggcaucugu

SEQ ID NO: 570986 - RNA, 19 nt, Homo sapiens
gaagaaccucgccaagucu

SEQ ID NO: 570987 - RNA, 19 nt, Homo sapiens
gaggcaccguguucucuca

SEQ ID NO: 570988 - RNA, 19 nt, Homo sapiens
gcagucacccacccaguuc

SEQ ID NO: 570989 - RNA, 19 nt, Homo sapiens
cagcagaggcaccguguuc

SEQ ID NO: 570990 - RNA, 19 nt, Homo sapiens
acacauaugcagacacaug

SEQ ID NO: 570991 - RNA, 19 nt, Homo sapiens
cgagauacccacccagcuu

SEQ ID NO: 570992 - RNA, 19 nt, Homo sapiens
gggcagaaccagcacaucu

SEQ ID NO: 570993 - RNA, 19 nt, Homo sapiens
gcagaacuaccagcgcauu

SEQ ID NO: 570994 - RNA, 19 nt, Homo sapiens
uaaagcgaauuuuguguga

SEQ ID NO: 570995 - RNA, 19 nt, Homo sapiens
caagugcauuaacaagaag

SEQ ID NO: 570996 - RNA, 19 nt, Homo sapiens
gccgucaagugcauuaaca

SEQ ID NO: 570997 - RNA, 19 nt, Homo sapiens
ucaaucacccaagcacuuu

SEQ ID NO: 570998 - RNA, 19 nt, Homo sapiens
aaagugccaucgaccagau

SEQ ID NO: 570999 - RNA, 19 nt, Homo sapiens
cagggucacacgccacaua

SEQ ID NO: 571000 - RNA, 19 nt, Homo sapiens
ggaauacuucaugcaaaga

SEQ ID NO: 571001 - RNA, 19 nt, Homo sapiens
cagagaccgugggcaaguu

SEQ ID NO: 571002 - RNA, 19 nt, Homo sapiens
cacgccaucuccucaaguu

SEQ ID NO: 571003 - RNA, 19 nt, Homo sapiens
gaacuaccagcgcauugag

SEQ ID NO: 571004 - RNA, 19 nt, Homo sapiens
ucacacgccacauaacaga

SEQ ID NO: 571005 - RNA, 19 nt, Homo sapiens
gcugugcccuccuuugacu

SEQ ID NO: 571006 - RNA, 19 nt, Homo sapiens
gaccugaaaccgcagaaca

SEQ ID NO: 571007 - RNA, 19 nt, Homo sapiens
cuggacccuuugucuauuu

SEQ ID NO: 571008 - RNA, 19 nt, Homo sapiens
gcuuuauucucaccuugug

SEQ ID NO: 571009 - RNA, 19 nt, Homo sapiens
gcuuggacuuagaagaaga

SEQ ID NO: 571010 - RNA, 19 nt, Homo sapiens
agaggcaguucuuuguuca

SEQ ID NO: 571011 - RNA, 19 nt, Homo sapiens
aauucugucuaccugguua

SEQ ID NO: 571012 - RNA, 19 nt, Homo sapiens
cugguugaauguucucuug

SEQ ID NO: 571013 - RNA, 19 nt, Homo sapiens
caaucacccaagcacuuua

SEQ ID NO: 571014 - RNA, 19 nt, Homo sapiens
gccgagaggcucaucuuca

SEQ ID NO: 571015 - RNA, 19 nt, Homo sapiens
gcuccuggcccuacugcaa

SEQ ID NO: 571016 - RNA, 19 nt, Homo sapiens
uaauaccaacguaaggaaa

SEQ ID NO: 571017 - RNA, 19 nt, Homo sapiens
gugcuggacccuuugucua

SEQ ID NO: 571018 - RNA, 19 nt, Homo sapiens
ggcagaggcaguucuuugu

SEQ ID NO: 571019 - RNA, 19 nt, Homo sapiens
gaccucagcgggagaacug

SEQ ID NO: 571020 - RNA, 19 nt, Homo sapiens
gcacaucuggagccacaca

SEQ ID NO: 571021 - RNA, 19 nt, Homo sapiens
ccgagaggcucaucuucag

SEQ ID NO: 571022 - RNA, 19 nt, Homo sapiens
gaaccugcuggcccuccua

SEQ ID NO: 571023 - RNA, 19 nt, Homo sapiens
caacagcauccgcgucaag

SEQ ID NO: 571024 - RNA, 19 nt, Homo sapiens
gucaagugcauuaacaaga

SEQ ID NO: 571025 - RNA, 19 nt, Homo sapiens
acaaggaccgcauggacuu

SEQ ID NO: 571026 - RNA, 19 nt, Homo sapiens
uauaauaccaacguaagga

SEQ ID NO: 571027 - RNA, 19 nt, Homo sapiens
cccuuugcguuauauugua

SEQ ID NO: 571028 - RNA, 19 nt, Homo sapiens
cgugacuucuuccucauca

SEQ ID NO: 571029 - RNA, 19 nt, Homo sapiens
gaaauggcuaauucugucu

SEQ ID NO: 571030 - RNA, 19 nt, Homo sapiens
ggggaauacuucaugcaaa

SEQ ID NO: 571031 - RNA, 19 nt, Homo sapiens
ggagaagcccauggagauc

SEQ ID NO: 571032 - RNA, 19 nt, Homo sapiens
cauggacuucgaugaguuu

SEQ ID NO: 571033 - RNA, 19 nt, Homo sapiens
cgcgguaccuccagagcaa

SEQ ID NO: 571034 - RNA, 19 nt, Homo sapiens
uacaaggccugcagaauuu

SEQ ID NO: 571035 - RNA, 19 nt, Homo sapiens
ggcagaagcucucaaguuc

SEQ ID NO: 571036 - RNA, 19 nt, Homo sapiens
gcaacagccucaccaagga

SEQ ID NO: 571037 - RNA, 19 nt, Homo sapiens
caaauaccuucaacugaga

SEQ ID NO: 571038 - RNA, 19 nt, Homo sapiens
agagaagccucaccauuga

SEQ ID NO: 571039 - RNA, 19 nt, Homo sapiens
cagagaagccucaccauug

SEQ ID NO: 571040 - RNA, 19 nt, Homo sapiens
cuacaaggccugcagaauu

SEQ ID NO: 571041 - RNA, 19 nt, Homo sapiens
augagcagcuggccaaaua

SEQ ID NO: 571042 - RNA, 19 nt, Homo sapiens
accaaggacuccaugaaua

SEQ ID NO: 571043 - RNA, 19 nt, Homo sapiens
ucacagagcucagcaacag

SEQ ID NO: 571044 - RNA, 19 nt, Homo sapiens
ccaaggacuccaugaauau

SEQ ID NO: 571045 - RNA, 19 nt, Homo sapiens
cagaagcucucaaguucau

SEQ ID NO: 571046 - RNA, 19 nt, Homo sapiens
gcuguaacuucuucguuga

SEQ ID NO: 571047 - RNA, 19 nt, Homo sapiens
gauuugggcuguaacuucu

SEQ ID NO: 571048 - RNA, 19 nt, Homo sapiens
cuaccaaccguucuuauug

SEQ ID NO: 571049 - RNA, 19 nt, Homo sapiens
ccagagaagccucaccauu

SEQ ID NO: 571050 - RNA, 19 nt, Homo sapiens
caaagcccauauccacaug

SEQ ID NO: 571051 - RNA, 19 nt, Homo sapiens
gaagcucucaaguucauug

SEQ ID NO: 571052 - RNA, 19 nt, Homo sapiens
ggauuugggcuguaacuuc

SEQ ID NO: 571053 - RNA, 19 nt, Homo sapiens
gccaaauaccuucaacuga

SEQ ID NO: 571054 - RNA, 19 nt, Homo sapiens
uauauaugcagguggauuu

SEQ ID NO: 571055 - RNA, 19 nt, Homo sapiens
cagcgggacuugcgaaagg

SEQ ID NO: 571056 - RNA, 19 nt, Homo sapiens
cugcagaauuucccagaga

SEQ ID NO: 571057 - RNA, 19 nt, Homo sapiens
agaaagugcugcgcuacga

SEQ ID NO: 571058 - RNA, 19 nt, Homo sapiens
caaguucauugaucguaag

SEQ ID NO: 571059 - RNA, 19 nt, Homo sapiens
uggcagaagcucucaaguu

SEQ ID NO: 571060 - RNA, 19 nt, Homo sapiens
gcagaagcucucaaguuca

SEQ ID NO: 571061 - RNA, 19 nt, Homo sapiens
acacaguggucccagauac

SEQ ID NO: 571062 - RNA, 19 nt, Homo sapiens
ggccaaauaccuucaacug

SEQ ID NO: 571063 - RNA, 19 nt, Homo sapiens
gcagcuggccaaauaccuu

SEQ ID NO: 571064 - RNA, 19 nt, Homo sapiens
caccaaggacuccaugaau

SEQ ID NO: 571065 - RNA, 19 nt, Homo sapiens
ucaccaaggacuccaugaa

SEQ ID NO: 571066 - RNA, 19 nt, Homo sapiens
ggaguugacacuggcagaa

SEQ ID NO: 571067 - RNA, 19 nt, Homo sapiens
gcuggaccaucgagacaag

SEQ ID NO: 571068 - RNA, 19 nt, Homo sapiens
ggaccaucgagacaaggua

SEQ ID NO: 571069 - RNA, 19 nt, Homo sapiens
ggacuccaugaauaucaaa

SEQ ID NO: 571070 - RNA, 19 nt, Homo sapiens
gaccaucgagacaagguau

SEQ ID NO: 571071 - RNA, 19 nt, Homo sapiens
gacacaguggucccagaua

SEQ ID NO: 571072 - RNA, 19 nt, Homo sapiens
ccuaccaaccguucuuauu

SEQ ID NO: 571073 - RNA, 19 nt, Homo sapiens
ccucaccauugacuucuuc

SEQ ID NO: 571074 - RNA, 19 nt, Homo sapiens
cuacgagaccuucaucagu

SEQ ID NO: 571075 - RNA, 19 nt, Homo sapiens
uaacuucuucguugacaca

SEQ ID NO: 571076 - RNA, 19 nt, Homo sapiens
gagcgacuccaggaagcua

SEQ ID NO: 571077 - RNA, 19 nt, Homo sapiens
gacauuaaagagccugaau

SEQ ID NO: 571078 - RNA, 19 nt, Homo sapiens
ugcagaauuucccagagaa

SEQ ID NO: 571079 - RNA, 19 nt, Homo sapiens
ucaaagcccauauccacau

SEQ ID NO: 571080 - RNA, 19 nt, Homo sapiens
gggcuuagagaacuacaag

SEQ ID NO: 571081 - RNA, 19 nt, Homo sapiens
aagcccauauccacauguu

SEQ ID NO: 571082 - RNA, 19 nt, Homo sapiens
auacuucacgcaucuaugu

SEQ ID NO: 571083 - RNA, 19 nt, Homo sapiens
acgagaccuucaucaguga

SEQ ID NO: 571084 - RNA, 19 nt, Homo sapiens
uaccaaccguucuuauugc

SEQ ID NO: 571085 - RNA, 19 nt, Homo sapiens
gggcuguaacuucuucguu

SEQ ID NO: 571086 - RNA, 19 nt, Homo sapiens
uaccuucaacugagaaaug

SEQ ID NO: 571087 - RNA, 19 nt, Homo sapiens
cauccucagacauuaaaga

SEQ ID NO: 571088 - RNA, 19 nt, Homo sapiens
gcagaauuucccagagaag

SEQ ID NO: 571089 - RNA, 19 nt, Homo sapiens
uacaaggccugcagaauuu

SEQ ID NO: 571090 - RNA, 19 nt, Homo sapiens
ggcagaagcucucaaguuc

SEQ ID NO: 571091 - RNA, 19 nt, Homo sapiens
gcaacagccucaccaagga

SEQ ID NO: 571092 - RNA, 19 nt, Homo sapiens
caaauaccuucaacugaga

SEQ ID NO: 571093 - RNA, 19 nt, Homo sapiens
agagaagccucaccauuga

SEQ ID NO: 571094 - RNA, 19 nt, Homo sapiens
cagagaagccucaccauug

SEQ ID NO: 571095 - RNA, 19 nt, Homo sapiens
cuacaaggccugcagaauu

SEQ ID NO: 571096 - RNA, 19 nt, Homo sapiens
ggguagagaugaacugugu

SEQ ID NO: 571097 - RNA, 19 nt, Homo sapiens
augagcagcuggccaaaua

SEQ ID NO: 571098 - RNA, 19 nt, Homo sapiens
accaaggacuccaugaaua

SEQ ID NO: 571099 - RNA, 19 nt, Homo sapiens
ucacagagcucagcaacag

SEQ ID NO: 571100 - RNA, 19 nt, Homo sapiens
gagccugaaugccuuugaa

SEQ ID NO: 571101 - RNA, 19 nt, Homo sapiens
ccaaggacuccaugaauau

SEQ ID NO: 571102 - RNA, 19 nt, Homo sapiens
cagaagcucucaaguucau

SEQ ID NO: 571103 - RNA, 19 nt, Homo sapiens
gcuguaacuucuucguuga

SEQ ID NO: 571104 - RNA, 19 nt, Homo sapiens
gauuugggcuguaacuucu

SEQ ID NO: 571105 - RNA, 19 nt, Homo sapiens
ccagagaagccucaccauu

SEQ ID NO: 571106 - RNA, 19 nt, Homo sapiens
caaagcccauauccacaug

SEQ ID NO: 571107 - RNA, 19 nt, Homo sapiens
gaagcucucaaguucauug

SEQ ID NO: 571108 - RNA, 19 nt, Homo sapiens
ggauuugggcuguaacuuc

SEQ ID NO: 571109 - RNA, 19 nt, Homo sapiens
gccaaauaccuucaacuga

SEQ ID NO: 571110 - RNA, 19 nt, Homo sapiens
uauauaugcagguggauuu

SEQ ID NO: 571111 - RNA, 19 nt, Homo sapiens
caaacuggaucggucaaca

SEQ ID NO: 571112 - RNA, 19 nt, Homo sapiens
cagcgggacuugcgaaagg

SEQ ID NO: 571113 - RNA, 19 nt, Homo sapiens
cugcagaauuucccagaga

SEQ ID NO: 571114 - RNA, 19 nt, Homo sapiens
caaguucauugaucguaag

SEQ ID NO: 571115 - RNA, 19 nt, Homo sapiens
uggcagaagcucucaaguu

SEQ ID NO: 571116 - RNA, 19 nt, Homo sapiens
agaaagugcugcgcuacga

SEQ ID NO: 571117 - RNA, 19 nt, Homo sapiens
gcagaagcucucaaguuca

SEQ ID NO: 571118 - RNA, 19 nt, Homo sapiens
acacaguggucccagauac

SEQ ID NO: 571119 - RNA, 19 nt, Homo sapiens
agagaugaacuguguguga

SEQ ID NO: 571120 - RNA, 19 nt, Homo sapiens
ggccaaauaccuucaacug

SEQ ID NO: 571121 - RNA, 19 nt, Homo sapiens
gcagcuggccaaauaccuu

SEQ ID NO: 571122 - RNA, 19 nt, Homo sapiens
guagagaugaacugugugu

SEQ ID NO: 571123 - RNA, 19 nt, Homo sapiens
caccaaggacuccaugaau

SEQ ID NO: 571124 - RNA, 19 nt, Homo sapiens
ucaccaaggacuccaugaa

SEQ ID NO: 571125 - RNA, 19 nt, Homo sapiens
ggaguugacacuggcagaa

SEQ ID NO: 571126 - RNA, 19 nt, Homo sapiens
ggaccaucgagacaaggua

SEQ ID NO: 571127 - RNA, 19 nt, Homo sapiens
gcuggaccaucgagacaag

SEQ ID NO: 571128 - RNA, 19 nt, Homo sapiens
ggacuccaugaauaucaaa

SEQ ID NO: 571129 - RNA, 19 nt, Homo sapiens
guugagaggguagagauga

SEQ ID NO: 571130 - RNA, 19 nt, Homo sapiens
gacacaguggucccagaua

SEQ ID NO: 571131 - RNA, 19 nt, Homo sapiens
gaccaucgagacaagguau

SEQ ID NO: 571132 - RNA, 19 nt, Homo sapiens
ccucaccauugacuucuuc

SEQ ID NO: 571133 - RNA, 19 nt, Homo sapiens
uaacuucuucguugacaca

SEQ ID NO: 571134 - RNA, 19 nt, Homo sapiens
gagcgacuccaggaagcua

SEQ ID NO: 571135 - RNA, 19 nt, Homo sapiens
cuacgagaccuucaucagu

SEQ ID NO: 571136 - RNA, 19 nt, Homo sapiens
gacauuaaagagccugaau

SEQ ID NO: 571137 - RNA, 19 nt, Homo sapiens
ugcagaauuucccagagaa

SEQ ID NO: 571138 - RNA, 19 nt, Homo sapiens
ucaaagcccauauccacau

SEQ ID NO: 571139 - RNA, 19 nt, Homo sapiens
gggcuuagagaacuacaag

SEQ ID NO: 571140 - RNA, 19 nt, Homo sapiens
aagcccauauccacauguu

SEQ ID NO: 571141 - RNA, 19 nt, Homo sapiens
auacuucacgcaucuaugu

SEQ ID NO: 571142 - RNA, 19 nt, Homo sapiens
acgagaccuucaucaguga

SEQ ID NO: 571143 - RNA, 19 nt, Homo sapiens
uugagaggguagagaugaa

SEQ ID NO: 571144 - RNA, 19 nt, Homo sapiens
gggcuguaacuucuucguu

SEQ ID NO: 571145 - RNA, 19 nt, Homo sapiens
uaccuucaacugagaaaug

SEQ ID NO: 571146 - RNA, 19 nt, Homo sapiens
cauccucagacauuaaaga

SEQ ID NO: 571147 - RNA, 19 nt, Homo sapiens
gcagaauuucccagagaag

SEQ ID NO: 571148 - RNA, 19 nt, Homo sapiens
agacagagcuugagaauaa

SEQ ID NO: 571149 - RNA, 19 nt, Homo sapiens
gagaagaucuuuaugcaaa

SEQ ID NO: 571150 - RNA, 19 nt, Homo sapiens
gaagagaaaucagcagaua

SEQ ID NO: 571151 - RNA, 19 nt, Homo sapiens
aaacaaagauucagcauga

SEQ ID NO: 571152 - RNA, 19 nt, Homo sapiens
gaaacaaacggaugacuua

SEQ ID NO: 571153 - RNA, 19 nt, Homo sapiens
gaacaagacuauacuaagu

SEQ ID NO: 571154 - RNA, 19 nt, Homo sapiens
ucaaacagcuucaaucuga

SEQ ID NO: 571155 - RNA, 19 nt, Homo sapiens
gaacauaaaugagcuaaag

SEQ ID NO: 571156 - RNA, 19 nt, Homo sapiens
gaaauaguauccaguacaa

SEQ ID NO: 571157 - RNA, 19 nt, Homo sapiens
ggagaaacauaaugaagaa

SEQ ID NO: 571158 - RNA, 19 nt, Homo sapiens
aaagaaagcuggauaauac

SEQ ID NO: 571159 - RNA, 19 nt, Homo sapiens
gaagagcaguugaaggaaa

SEQ ID NO: 571160 - RNA, 19 nt, Homo sapiens
guaaacaacuugaaaugga

SEQ ID NO: 571161 - RNA, 19 nt, Homo sapiens
uaucacaacuucagaguaa

SEQ ID NO: 571162 - RNA, 19 nt, Homo sapiens
uaaguugcauuccgaaaua

SEQ ID NO: 571163 - RNA, 19 nt, Homo sapiens
agaaauaccucucuuuaga

SEQ ID NO: 571164 - RNA, 19 nt, Homo sapiens
cgaaguaacucaacuaaca

SEQ ID NO: 571165 - RNA, 19 nt, Homo sapiens
cagcagaacuacagucuuu

SEQ ID NO: 571166 - RNA, 19 nt, Homo sapiens
gaagcgagaugauguaaca

SEQ ID NO: 571167 - RNA, 19 nt, Homo sapiens
uaaaggagaaggugaaaua

SEQ ID NO: 571168 - RNA, 19 nt, Homo sapiens
gaaaucagcagauacuaaa

SEQ ID NO: 571169 - RNA, 19 nt, Homo sapiens
gaaauuagaacuucaagga

SEQ ID NO: 571170 - RNA, 19 nt, Homo sapiens
cuaaacagcuucuaauuca

SEQ ID NO: 571171 - RNA, 19 nt, Homo sapiens
gagggaaucugaacuucua

SEQ ID NO: 571172 - RNA, 19 nt, Homo sapiens
ugacagagcuuucuacagu

SEQ ID NO: 571173 - RNA, 19 nt, Homo sapiens
ucagagaccugguauagaa

SEQ ID NO: 571174 - RNA, 19 nt, Homo sapiens
uaaaugagcuaaagcaauc

SEQ ID NO: 571175 - RNA, 19 nt, Homo sapiens
gcagucagcuggaaaguca

SEQ ID NO: 571176 - RNA, 19 nt, Homo sapiens
ucaggucacugcaaaguua

SEQ ID NO: 571177 - RNA, 19 nt, Homo sapiens
gcaaagaauuaaagcauca

SEQ ID NO: 571178 - RNA, 19 nt, Homo sapiens
aaacuuaccaugcagauua

SEQ ID NO: 571179 - RNA, 19 nt, Homo sapiens
gaaccuugaagcuuuauua

SEQ ID NO: 571180 - RNA, 19 nt, Homo sapiens
uaauagaggucuuggacua

SEQ ID NO: 571181 - RNA, 19 nt, Homo sapiens
aagcaacgguucagaauaa

SEQ ID NO: 571182 - RNA, 19 nt, Homo sapiens
gagcagaaggcacaucuua

SEQ ID NO: 571183 - RNA, 19 nt, Homo sapiens
aaagacagcugaacacaga

SEQ ID NO: 571184 - RNA, 19 nt, Homo sapiens
gaauuugcaugaccaggua

SEQ ID NO: 571185 - RNA, 19 nt, Homo sapiens
aaucagaccuugacagaaa

SEQ ID NO: 571186 - RNA, 19 nt, Homo sapiens
ggaaguucguguauaugua

SEQ ID NO: 571187 - RNA, 19 nt, Homo sapiens
gaaagaagcuaaguugcau

SEQ ID NO: 571188 - RNA, 19 nt, Homo sapiens
agagacagcuuucaaguga

SEQ ID NO: 571189 - RNA, 19 nt, Homo sapiens
caaagaaagcuggauaaua

SEQ ID NO: 571190 - RNA, 19 nt, Homo sapiens
aagaggagcugaagaaaga

SEQ ID NO: 571191 - RNA, 19 nt, Homo sapiens
gaacagagacagcuuucaa

SEQ ID NO: 571192 - RNA, 19 nt, Homo sapiens
gggugaaauugcaguauua

SEQ ID NO: 571193 - RNA, 19 nt, Homo sapiens
ggcaagaucuuaagucugu

SEQ ID NO: 571194 - RNA, 19 nt, Homo sapiens
gagaagcucagaaugauuu

SEQ ID NO: 571195 - RNA, 19 nt, Homo sapiens
ggagugaacuguccaaagg

SEQ ID NO: 571196 - RNA, 19 nt, Homo sapiens
gaagaagcccaaacagaaa

SEQ ID NO: 571197 - RNA, 19 nt, Homo sapiens
uuccauagcuuacuucuuu

SEQ ID NO: 571198 - RNA, 19 nt, Homo sapiens
ucacuaaacuaaacgaaga

SEQ ID NO: 571199 - RNA, 19 nt, Homo sapiens
gagcuagaaggucaaauua

SEQ ID NO: 571200 - RNA, 19 nt, Homo sapiens
ccaggaaguucguguauau

SEQ ID NO: 571201 - RNA, 19 nt, Homo sapiens
ggaggagagucuaaucuug

SEQ ID NO: 571202 - RNA, 19 nt, Homo sapiens
gcagagauagaagaaauua

SEQ ID NO: 571203 - RNA, 19 nt, Homo sapiens
uaacagagaacgugaagaa

SEQ ID NO: 571204 - RNA, 19 nt, Homo sapiens
acaaguggcugauuuacaa

SEQ ID NO: 571205 - RNA, 19 nt, Homo sapiens
gaacagcaauuagaagaag

SEQ ID NO: 571206 - RNA, 19 nt, Homo sapiens
gaccaaauaggaauuagua

SEQ ID NO: 571207 - RNA, 19 nt, Homo sapiens
gcauaaaggagauaacaaa

SEQ ID NO: 571208 - RNA, 19 nt, Homo sapiens
uaacucaacuaacagagaa

SEQ ID NO: 571209 - RNA, 19 nt, Homo sapiens
caugccaaguuuagaauua

SEQ ID NO: 571210 - RNA, 19 nt, Homo sapiens
ucaaugacuugcaaggaua

SEQ ID NO: 571211 - RNA, 19 nt, Homo sapiens
gcuagaaggucaaauuaag

SEQ ID NO: 571212 - RNA, 19 nt, Homo sapiens
gaaauaccucucuuuagaa

SEQ ID NO: 571213 - RNA, 19 nt, Homo sapiens
gcuggaaagucaucuuaaa

SEQ ID NO: 571214 - RNA, 19 nt, Homo sapiens
ccagaaccuugaagcuuua

SEQ ID NO: 571215 - RNA, 19 nt, Homo sapiens
cuacugaaauugcagauau

SEQ ID NO: 571216 - RNA, 19 nt, Homo sapiens
gcaauuccauagcuuacuu

SEQ ID NO: 571217 - RNA, 19 nt, Homo sapiens
ucugaaaccucacugcaua

SEQ ID NO: 571218 - RNA, 19 nt, Homo sapiens
gguuacaacuccaaaguga

SEQ ID NO: 571219 - RNA, 19 nt, Homo sapiens
ugaagaaucugugaguaaa

SEQ ID NO: 571220 - RNA, 19 nt, Homo sapiens
agaaagaacugguccaagu

SEQ ID NO: 571221 - RNA, 19 nt, Homo sapiens
acacaagcguugaauagaa

SEQ ID NO: 571222 - RNA, 19 nt, Homo sapiens
gaagcaacgguucagaaua

SEQ ID NO: 571223 - RNA, 19 nt, Homo sapiens
uuagugagcuugagaaaca

SEQ ID NO: 571224 - RNA, 19 nt, Homo sapiens
gcaaucaagugaacagaag

SEQ ID NO: 571225 - RNA, 19 nt, Homo sapiens
cagagaacgugaagaauca

SEQ ID NO: 571226 - RNA, 19 nt, Homo sapiens
gcaacagcaucaagaacaa

SEQ ID NO: 571227 - RNA, 19 nt, Homo sapiens
caaagaggcaacuguaauu

SEQ ID NO: 571228 - RNA, 19 nt, Homo sapiens
gaaaaugaggcuaaacuua

SEQ ID NO: 571229 - RNA, 19 nt, Homo sapiens
uacaagacauucagaaaga

SEQ ID NO: 571230 - RNA, 19 nt, Homo sapiens
gcagaaggcacaucuuaga

SEQ ID NO: 571231 - RNA, 19 nt, Homo sapiens
cuacuuggguguucuaaau

SEQ ID NO: 571232 - RNA, 19 nt, Homo sapiens
cgaagacaaugaaguacaa

SEQ ID NO: 571233 - RNA, 19 nt, Homo sapiens
gaacucaagucccacaaac

SEQ ID NO: 571234 - RNA, 19 nt, Homo sapiens
uaagauuacuacucaguug

SEQ ID NO: 571235 - RNA, 19 nt, Homo sapiens
gcgcaggucuggagaguca

SEQ ID NO: 571236 - RNA, 19 nt, Homo sapiens
acucaaagaugaaucgaaa

SEQ ID NO: 571237 - RNA, 19 nt, Homo sapiens
ccaacuugcuacugaaauu

SEQ ID NO: 571238 - RNA, 19 nt, Homo sapiens
ggaauguuauggauaucaa

SEQ ID NO: 571239 - RNA, 19 nt, Homo sapiens
gcacaagaccguguccuuu

SEQ ID NO: 571240 - RNA, 19 nt, Homo sapiens
guucaaacacuaauggaua

SEQ ID NO: 571241 - RNA, 19 nt, Homo sapiens
aaacaaagaggcaacugua

SEQ ID NO: 571242 - RNA, 19 nt, Homo sapiens
ucgagaagcugcugaacaa

SEQ ID NO: 571243 - RNA, 19 nt, Homo sapiens
gaaagugggccgaagacaa

SEQ ID NO: 571244 - RNA, 19 nt, Homo sapiens
gaagaagcaugaagaaaau

SEQ ID NO: 571245 - RNA, 19 nt, Homo sapiens
gaagacagagcuugagaau

SEQ ID NO: 571246 - RNA, 19 nt, Homo sapiens
aaacaaauccugaaacaag

SEQ ID NO: 571247 - RNA, 19 nt, Homo sapiens
gcugauagucuugaaguua

SEQ ID NO: 571248 - RNA, 19 nt, Homo sapiens
gcacagagcacacuuauuu

SEQ ID NO: 571249 - RNA, 19 nt, Homo sapiens
gugcaaaucugacaauaua

SEQ ID NO: 571250 - RNA, 19 nt, Homo sapiens
gaagguaucaguuauauga

SEQ ID NO: 571251 - RNA, 19 nt, Homo sapiens
gagcaaagcuacccucaug

SEQ ID NO: 571252 - RNA, 19 nt, Homo sapiens
cagagaaccuuuagaauau

SEQ ID NO: 571253 - RNA, 19 nt, Homo sapiens
gcagacagcuaccggauga

SEQ ID NO: 571254 - RNA, 19 nt, Homo sapiens
gagaagaccuagcuauguu

SEQ ID NO: 571255 - RNA, 19 nt, Homo sapiens
ccagagaaccuuuagaaua

SEQ ID NO: 571256 - RNA, 19 nt, Homo sapiens
gaccagagcugugaaauca

SEQ ID NO: 571257 - RNA, 19 nt, Homo sapiens
uaacugcccucucgcguaa

SEQ ID NO: 571258 - RNA, 19 nt, Homo sapiens
aaacugccauucucuauga

SEQ ID NO: 571259 - RNA, 19 nt, Homo sapiens
gaaccucgcucagcacuuc

SEQ ID NO: 571260 - RNA, 19 nt, Homo sapiens
ggacccaacuguggaauau

SEQ ID NO: 571261 - RNA, 19 nt, Homo sapiens
gaaaucaugcugaaccauu

SEQ ID NO: 571262 - RNA, 19 nt, Homo sapiens
gcagcgagauggugacuuc

SEQ ID NO: 571263 - RNA, 19 nt, Homo sapiens
cggcagaacucgccuguga

SEQ ID NO: 571264 - RNA, 19 nt, Homo sapiens
guaauaaugugcaaaucug

SEQ ID NO: 571265 - RNA, 19 nt, Homo sapiens
gaacugaacccagcguuug

SEQ ID NO: 571266 - RNA, 19 nt, Homo sapiens
gauggugacuuccuaguuc

SEQ ID NO: 571267 - RNA, 19 nt, Homo sapiens
cagcaaaggugcacaaguc

SEQ ID NO: 571268 - RNA, 19 nt, Homo sapiens
gaaacaugccggugaauca

SEQ ID NO: 571269 - RNA, 19 nt, Homo sapiens
gcugguugcuuucuauuau

SEQ ID NO: 571270 - RNA, 19 nt, Homo sapiens
uauguuggcugguugcuuu

SEQ ID NO: 571271 - RNA, 19 nt, Homo sapiens
ccgggagaguugagaauua

SEQ ID NO: 571272 - RNA, 19 nt, Homo sapiens
ucaaccagaugaagaaaug

SEQ ID NO: 571273 - RNA, 19 nt, Homo sapiens
ucagcaaacuccugcauga

SEQ ID NO: 571274 - RNA, 19 nt, Homo sapiens
ggaccucuauuccuucuca

SEQ ID NO: 571275 - RNA, 19 nt, Homo sapiens
ccgagaaacugaagaagga

SEQ ID NO: 571276 - RNA, 19 nt, Homo sapiens
gagcacacuuauuuaugaa

SEQ ID NO: 571277 - RNA, 19 nt, Homo sapiens
agagcacacuuauuuauga

SEQ ID NO: 571278 - RNA, 19 nt, Homo sapiens
gcaggcagagcuuugauaa

SEQ ID NO: 571279 - RNA, 19 nt, Homo sapiens
ggaaaccuccucagaaaca

SEQ ID NO: 571280 - RNA, 19 nt, Homo sapiens
cagaagguaucaguuauau

SEQ ID NO: 571281 - RNA, 19 nt, Homo sapiens
uaagguaacuacugcuaau

SEQ ID NO: 571282 - RNA, 19 nt, Homo sapiens
ugucuaaaguuacuacuga

SEQ ID NO: 571283 - RNA, 19 nt, Homo sapiens
ccagaaacaugccggugaa

SEQ ID NO: 571284 - RNA, 19 nt, Homo sapiens
cuucucagcucucaugaaa

SEQ ID NO: 571285 - RNA, 19 nt, Homo sapiens
ccagaugccuaucaagaug

SEQ ID NO: 571286 - RNA, 19 nt, Homo sapiens
ggaaagaccuugggaaccu

SEQ ID NO: 571287 - RNA, 19 nt, Homo sapiens
ccagagcugugaaaucaug

SEQ ID NO: 571288 - RNA, 19 nt, Homo sapiens
gcagagaguccacaugugu

SEQ ID NO: 571289 - RNA, 19 nt, Homo sapiens
gguaacuacugcuaauguu

SEQ ID NO: 571290 - RNA, 19 nt, Homo sapiens
agagagauaugagaaauuc

SEQ ID NO: 571291 - RNA, 19 nt, Homo sapiens
gaagagccuugucccucaa

SEQ ID NO: 571292 - RNA, 19 nt, Homo sapiens
gaagagaugaggaggaaca

SEQ ID NO: 571293 - RNA, 19 nt, Homo sapiens
ggcgaaaccuucaccuuca

SEQ ID NO: 571294 - RNA, 19 nt, Homo sapiens
ucaaucagacagagagaua

SEQ ID NO: 571295 - RNA, 19 nt, Homo sapiens
gcugugaaaucaugcugaa

SEQ ID NO: 571296 - RNA, 19 nt, Homo sapiens
gaaagacacaacacaaugg

SEQ ID NO: 571297 - RNA, 19 nt, Homo sapiens
gaucagcaaauuuaagaga

SEQ ID NO: 571298 - RNA, 19 nt, Homo sapiens
gcaaaucugacaauauaca

SEQ ID NO: 571299 - RNA, 19 nt, Homo sapiens
gcgagauggugacuuccua

SEQ ID NO: 571300 - RNA, 19 nt, Homo sapiens
ggucaucgcccagcacgua

SEQ ID NO: 571301 - RNA, 19 nt, Homo sapiens
gcaaagcuacccucaugug

SEQ ID NO: 571302 - RNA, 19 nt, Homo sapiens
caacuacugugaacugaac

SEQ ID NO: 571303 - RNA, 19 nt, Homo sapiens
ccucaaagcccaccaguca

SEQ ID NO: 571304 - RNA, 19 nt, Homo sapiens
gcucagcacuucaaaauca

SEQ ID NO: 571305 - RNA, 19 nt, Homo sapiens
caugaaagcccuggaaaug

SEQ ID NO: 571306 - RNA, 19 nt, Homo sapiens
uaacuacugcuaauguuga

SEQ ID NO: 571307 - RNA, 19 nt, Homo sapiens
ggggaaaccuccucagaaa

SEQ ID NO: 571308 - RNA, 19 nt, Homo sapiens
ccacagaucacaagguuag

SEQ ID NO: 571309 - RNA, 19 nt, Homo sapiens
gaaaugccacagaucacaa

SEQ ID NO: 571310 - RNA, 19 nt, Homo sapiens
gaaaccuccucagaaacaa

SEQ ID NO: 571311 - RNA, 19 nt, Homo sapiens
ucagaagguaucaguuaua

SEQ ID NO: 571312 - RNA, 19 nt, Homo sapiens
uugcaagccuucccagaaa

SEQ ID NO: 571313 - RNA, 19 nt, Homo sapiens
uuucagaagguaucaguua

SEQ ID NO: 571314 - RNA, 19 nt, Homo sapiens
ugaaagacacaacacaaug

SEQ ID NO: 571315 - RNA, 19 nt, Homo sapiens
cccauaagguccugugaug

SEQ ID NO: 571316 - RNA, 19 nt, Homo sapiens
ugggaaagcuuacuguuuu

SEQ ID NO: 571317 - RNA, 19 nt, Homo sapiens
gagaaccuuuagaauaucu

SEQ ID NO: 571318 - RNA, 19 nt, Homo sapiens
gaauuauggcugcaggaaa

SEQ ID NO: 571319 - RNA, 19 nt, Homo sapiens
ggaaccuccuccuguaaag

SEQ ID NO: 571320 - RNA, 19 nt, Homo sapiens
acagagagauaugagaaau

SEQ ID NO: 571321 - RNA, 19 nt, Homo sapiens
caaaggugcacaagucaau

SEQ ID NO: 571322 - RNA, 19 nt, Homo sapiens
cugcaggguugcuaggaua

SEQ ID NO: 571323 - RNA, 19 nt, Homo sapiens
ucacagccaagcagaauga

SEQ ID NO: 571324 - RNA, 19 nt, Homo sapiens
uaagagaagaccuagcuau

SEQ ID NO: 571325 - RNA, 19 nt, Homo sapiens
gaaccgacaugugggaaaa

SEQ ID NO: 571326 - RNA, 19 nt, Homo sapiens
gcucaggccuggaacucau

SEQ ID NO: 571327 - RNA, 19 nt, Homo sapiens
cagcaaauuuaagagaaga

SEQ ID NO: 571328 - RNA, 19 nt, Homo sapiens
gaaaucugcaagacugaau

SEQ ID NO: 571329 - RNA, 19 nt, Homo sapiens
cagaugaagaaaugaauga

SEQ ID NO: 571330 - RNA, 19 nt, Homo sapiens
cagcugcgccuggacauaa

SEQ ID NO: 571331 - RNA, 19 nt, Homo sapiens
cugaagagaugaggaggaa

SEQ ID NO: 571332 - RNA, 19 nt, Homo sapiens
ggaacucuggcgucaacua

SEQ ID NO: 571333 - RNA, 19 nt, Homo sapiens
gcaaggugccguuccucaa

SEQ ID NO: 571334 - RNA, 19 nt, Homo sapiens
cuaucaagaugugucuaua

SEQ ID NO: 571335 - RNA, 19 nt, Homo sapiens
gcccagaugccuaucaaga

SEQ ID NO: 571336 - RNA, 19 nt, Homo sapiens
agacagagagauaugagaa

SEQ ID NO: 571337 - RNA, 19 nt, Homo sapiens
ggaaaugccacagaucaca

SEQ ID NO: 571338 - RNA, 19 nt, Homo sapiens
gcauugcaguggacauucu

SEQ ID NO: 571339 - RNA, 19 nt, Homo sapiens
aggcagagcuuugauaacu

SEQ ID NO: 571340 - RNA, 19 nt, Homo sapiens
ccaaacugccauucucuau

SEQ ID NO: 571341 - RNA, 19 nt, Homo sapiens
gccuggaacucauuaccuu

SEQ ID NO: 571342 - RNA, 19 nt, Homo sapiens
cgggagaguugagaauuau

SEQ ID NO: 571343 - RNA, 19 nt, Homo sapiens
ggcaacagcgcgauucaug

SEQ ID NO: 571344 - RNA, 19 nt, Homo sapiens
ugaugccgcuugugacguu

SEQ ID NO: 571345 - RNA, 19 nt, Homo sapiens
ugccacagaucacaagguu

SEQ ID NO: 571346 - RNA, 19 nt, Homo sapiens
cgguggaacugaaggauuc

SEQ ID NO: 571347 - RNA, 19 nt, Homo sapiens
ucaaagcccaccagucaga

SEQ ID NO: 571348 - RNA, 19 nt, Homo sapiens
ggacguggccauugaaauu

SEQ ID NO: 571349 - RNA, 19 nt, Homo sapiens
agacugaccuucugaguau

SEQ ID NO: 571350 - RNA, 19 nt, Homo sapiens
gaacacaccgcuguacuuu

SEQ ID NO: 571351 - RNA, 19 nt, Homo sapiens
ggcuggaacuguuucuuua

SEQ ID NO: 571352 - RNA, 19 nt, Homo sapiens
gugcagggcugaagacaug

SEQ ID NO: 571353 - RNA, 19 nt, Homo sapiens
cagaacaucucacugauac

SEQ ID NO: 571354 - RNA, 19 nt, Homo sapiens
uagcuucggugaucaagaa

SEQ ID NO: 571355 - RNA, 19 nt, Homo sapiens
ggaggaggcuguccagaac

SEQ ID NO: 571356 - RNA, 19 nt, Homo sapiens
gauugcaccugcugaccua

SEQ ID NO: 571357 - RNA, 19 nt, Homo sapiens
gaaaggggauugccaguca

SEQ ID NO: 571358 - RNA, 19 nt, Homo sapiens
ggaagaaauuugggaaguc

SEQ ID NO: 571359 - RNA, 19 nt, Homo sapiens
gagacugaccuucugagua

SEQ ID NO: 571360 - RNA, 19 nt, Homo sapiens
aaacugagcccaauuacca

SEQ ID NO: 571361 - RNA, 19 nt, Homo sapiens
ucacaucagcuaagagauu

SEQ ID NO: 571362 - RNA, 19 nt, Homo sapiens
ggccagaacaucucacuga

SEQ ID NO: 571363 - RNA, 19 nt, Homo sapiens
ccagaacaucucacugaua

SEQ ID NO: 571364 - RNA, 19 nt, Homo sapiens
gcaaaggcagcucaucuca

SEQ ID NO: 571365 - RNA, 19 nt, Homo sapiens
cacauucucuagcuucuug

SEQ ID NO: 571366 - RNA, 19 nt, Homo sapiens
ccagaaccguuuccaugga

SEQ ID NO: 571367 - RNA, 19 nt, Homo sapiens
ggaccuagcagagaggaaa

SEQ ID NO: 571368 - RNA, 19 nt, Homo sapiens
gaaauucuugccacucgaa

SEQ ID NO: 571369 - RNA, 19 nt, Homo sapiens
cgugacagcuacucuggaa

SEQ ID NO: 571370 - RNA, 19 nt, Homo sapiens
gaauugaggacagcucuga

SEQ ID NO: 571371 - RNA, 19 nt, Homo sapiens
ccuaagagaggucaucuga

SEQ ID NO: 571372 - RNA, 19 nt, Homo sapiens
gaacaucucacugauacuc

SEQ ID NO: 571373 - RNA, 19 nt, Homo sapiens
gcaccacauucucuagcuu

SEQ ID NO: 571374 - RNA, 19 nt, Homo sapiens
ggaccgcagugccauugug

SEQ ID NO: 571375 - RNA, 19 nt, Homo sapiens
gcucacaucagcuaagaga

SEQ ID NO: 571376 - RNA, 19 nt, Homo sapiens
caucaagcccuccaggaaa

SEQ ID NO: 571377 - RNA, 19 nt, Homo sapiens
gcucaucucacgaaacuuc

SEQ ID NO: 571378 - RNA, 19 nt, Homo sapiens
cagcucaucucacgaaacu

SEQ ID NO: 571379 - RNA, 19 nt, Homo sapiens
ugagaccaguggcaucuug

SEQ ID NO: 571380 - RNA, 19 nt, Homo sapiens
cuggaacuguuucuuuaaa

SEQ ID NO: 571381 - RNA, 19 nt, Homo sapiens
ccaggaaacugagcccaau

SEQ ID NO: 571382 - RNA, 19 nt, Homo sapiens
cacaucagcuaagagauug

SEQ ID NO: 571383 - RNA, 19 nt, Homo sapiens
acacaccgcuguacuuugc

SEQ ID NO: 571384 - RNA, 19 nt, Homo sapiens
gcuggaacuguuucuuuaa

SEQ ID NO: 571385 - RNA, 19 nt, Homo sapiens
ucacugagcaccacauucu

SEQ ID NO: 571386 - RNA, 19 nt, Homo sapiens
aggaaacugagcccaauua

SEQ ID NO: 571387 - RNA, 19 nt, Homo sapiens
ccacguacuugcaagaacu

SEQ ID NO: 571388 - RNA, 19 nt, Homo sapiens
ucuccaggaugcagugaaa

SEQ ID NO: 571389 - RNA, 19 nt, Homo sapiens
gccagaacaucucacugau

SEQ ID NO: 571390 - RNA, 19 nt, Homo sapiens
ccagcugggccuccaagua

SEQ ID NO: 571391 - RNA, 19 nt, Homo sapiens
cagcugggccuccaaguag

SEQ ID NO: 571392 - RNA, 19 nt, Homo sapiens
gaugugagacugaccuucu

SEQ ID NO: 571393 - RNA, 19 nt, Homo sapiens
ucaagaacacaccgcugua

SEQ ID NO: 571394 - RNA, 19 nt, Homo sapiens
ucaggaccuucuugaacuu

SEQ ID NO: 571395 - RNA, 19 nt, Homo sapiens
gggcugaagacaugugaga

SEQ ID NO: 571396 - RNA, 19 nt, Homo sapiens
gaacuucagcguggacaag

SEQ ID NO: 571397 - RNA, 19 nt, Homo sapiens
guccugauucgcauccuua

SEQ ID NO: 571398 - RNA, 19 nt, Homo sapiens
gagcauccacguacuugca

SEQ ID NO: 571399 - RNA, 19 nt, Homo sapiens
caauuaccaaguccugauu

SEQ ID NO: 571400 - RNA, 19 nt, Homo sapiens
ucaucaagcccuccaggaa

SEQ ID NO: 571401 - RNA, 19 nt, Homo sapiens
cagaaggaccuagcagaga

SEQ ID NO: 571402 - RNA, 19 nt, Homo sapiens
gcagcccacagcccaguuu

SEQ ID NO: 571403 - RNA, 19 nt, Homo sapiens
acugauacucgaauucuuu

SEQ ID NO: 571404 - RNA, 19 nt, Homo sapiens
cugcuggguucgucccuaa

SEQ ID NO: 571405 - RNA, 19 nt, Homo sapiens
ucucacugauacucgaauu

SEQ ID NO: 571406 - RNA, 19 nt, Homo sapiens
ucacucaucccuccuguac

SEQ ID NO: 571407 - RNA, 19 nt, Homo sapiens
ggaaacugagcccaauuac

SEQ ID NO: 571408 - RNA, 19 nt, Homo sapiens
cggccuagcuucggugauc

SEQ ID NO: 571409 - RNA, 19 nt, Homo sapiens
cugaagacaugugagacuu

SEQ ID NO: 571410 - RNA, 19 nt, Homo sapiens
gcugacaaacuucaucaag

SEQ ID NO: 571411 - RNA, 19 nt, Homo sapiens
cuacugagggccauuacug

SEQ ID NO: 571412 - RNA, 19 nt, Homo sapiens
gcaaccaguagcaccaugu

SEQ ID NO: 571413 - RNA, 19 nt, Homo sapiens
uguugaggcuggaacuguu

SEQ ID NO: 571414 - RNA, 19 nt, Homo sapiens
gggccuccaaguaggauaa

SEQ ID NO: 571415 - RNA, 19 nt, Homo sapiens
gaguucaggaagaaauuug

SEQ ID NO: 571416 - RNA, 19 nt, Homo sapiens
gcagucuacaaacacaauu

SEQ ID NO: 571417 - RNA, 19 nt, Homo sapiens
aggaagaaauuugggaagu

SEQ ID NO: 571418 - RNA, 19 nt, Homo sapiens
ccaauuaccaaguccugau

SEQ ID NO: 571419 - RNA, 19 nt, Homo sapiens
aagagaugcugggcaggaa

SEQ ID NO: 571420 - RNA, 19 nt, Homo sapiens
ucaucugacuggcuguuca

SEQ ID NO: 571421 - RNA, 19 nt, Homo sapiens
cuacucuucucuccaggau

SEQ ID NO: 571422 - RNA, 19 nt, Homo sapiens
agaacacaccgcuguacuu

SEQ ID NO: 571423 - RNA, 19 nt, Homo sapiens
ggucauccagcuccuucuu

SEQ ID NO: 571424 - RNA, 19 nt, Homo sapiens
uccgaguguuugaucagua

SEQ ID NO: 571425 - RNA, 19 nt, Homo sapiens
ccaguagcaccaugucugu

SEQ ID NO: 571426 - RNA, 19 nt, Homo sapiens
aggcuggaacuguuucuuu

SEQ ID NO: 571427 - RNA, 19 nt, Homo sapiens
ccggcaaccuggagaggau

SEQ ID NO: 571428 - RNA, 19 nt, Homo sapiens
ucacacaggcaaucuacca

SEQ ID NO: 571429 - RNA, 19 nt, Homo sapiens
ucugagauuuccguguuug

SEQ ID NO: 571430 - RNA, 19 nt, Homo sapiens
gcucacacaggcaaucuac

SEQ ID NO: 571431 - RNA, 19 nt, Homo sapiens
auccuuaucucucgaugug

SEQ ID NO: 571432 - RNA, 19 nt, Homo sapiens
gcucugcucggccuagcuu

SEQ ID NO: 571433 - RNA, 19 nt, Homo sapiens
ccagcgaaauccugaacac

SEQ ID NO: 571434 - RNA, 19 nt, Homo sapiens
guuugacgcccaggaauug

SEQ ID NO: 571435 - RNA, 19 nt, Homo sapiens
ccaguuugacgcccaggaa

SEQ ID NO: 571436 - RNA, 19 nt, Homo sapiens
caagaacacaccgcuguac

SEQ ID NO: 571437 - RNA, 19 nt, Homo sapiens
gccuggcagucuacaaaca

SEQ ID NO: 571438 - RNA, 19 nt, Homo sapiens
cuguggacguggccauuga

SEQ ID NO: 571439 - RNA, 19 nt, Homo sapiens
caacaucacugacaaacuu

SEQ ID NO: 571440 - RNA, 19 nt, Homo sapiens
gcauaugccuuucauuuau

SEQ ID NO: 571441 - RNA, 19 nt, Homo sapiens
gcacuacauugucuaaauu

SEQ ID NO: 571442 - RNA, 19 nt, Homo sapiens
gauuaucagucucaucaua

SEQ ID NO: 571443 - RNA, 19 nt, Homo sapiens
ccacugaaguuauaaagga

SEQ ID NO: 571444 - RNA, 19 nt, Homo sapiens
ccaaagaaacagauaagua

SEQ ID NO: 571445 - RNA, 19 nt, Homo sapiens
gaaauacaaagaacucuga

SEQ ID NO: 571446 - RNA, 19 nt, Homo sapiens
gaggaucucuucuaacauc

SEQ ID NO: 571447 - RNA, 19 nt, Homo sapiens
acaaggagauguaauagau

SEQ ID NO: 571448 - RNA, 19 nt, Homo sapiens
ccaggugacugcuuagaaa

SEQ ID NO: 571449 - RNA, 19 nt, Homo sapiens
caacagaagcagcaguaua

SEQ ID NO: 571450 - RNA, 19 nt, Homo sapiens
gaaauuagcgaauaagaac

SEQ ID NO: 571451 - RNA, 19 nt, Homo sapiens
caagauguguguuacuuca

SEQ ID NO: 571452 - RNA, 19 nt, Homo sapiens
ggagcacacugucgcacua

SEQ ID NO: 571453 - RNA, 19 nt, Homo sapiens
ugaacaaggagauguaaua

SEQ ID NO: 571454 - RNA, 19 nt, Homo sapiens
caacuugaagcugauauua

SEQ ID NO: 571455 - RNA, 19 nt, Homo sapiens
cuaaccagcuugccaaaga

SEQ ID NO: 571456 - RNA, 19 nt, Homo sapiens
gaggacagcucaaaagaaa

SEQ ID NO: 571457 - RNA, 19 nt, Homo sapiens
acaaagaacucugaaucaa

SEQ ID NO: 571458 - RNA, 19 nt, Homo sapiens
ggugcaggaugaagaaauu

SEQ ID NO: 571459 - RNA, 19 nt, Homo sapiens
caaagaaacagauaaguac

SEQ ID NO: 571460 - RNA, 19 nt, Homo sapiens
agaagcagcaguauacuaa

SEQ ID NO: 571461 - RNA, 19 nt, Homo sapiens
ccacauugcauaugccuuu

SEQ ID NO: 571462 - RNA, 19 nt, Homo sapiens
uugaaccacugaaguuaua

SEQ ID NO: 571463 - RNA, 19 nt, Homo sapiens
ggauugaaccacugaaguu

SEQ ID NO: 571464 - RNA, 19 nt, Homo sapiens
gaacaaggagauguaauag

SEQ ID NO: 571465 - RNA, 19 nt, Homo sapiens
gcuguagauugccuaguaa

SEQ ID NO: 571466 - RNA, 19 nt, Homo sapiens
uaagguguguguauucugu

SEQ ID NO: 571467 - RNA, 19 nt, Homo sapiens
gauugaaccacugaaguua

SEQ ID NO: 571468 - RNA, 19 nt, Homo sapiens
acagaaggaucgcuuagug

SEQ ID NO: 571469 - RNA, 19 nt, Homo sapiens
aaagaacucugaaucaacu

SEQ ID NO: 571470 - RNA, 19 nt, Homo sapiens
cauagaagccaauguggaa

SEQ ID NO: 571471 - RNA, 19 nt, Homo sapiens
uggaacaccucaagauuca

SEQ ID NO: 571472 - RNA, 19 nt, Homo sapiens
cauauggucuauuuaaguc

SEQ ID NO: 571473 - RNA, 19 nt, Homo sapiens
gaugaccuccgucuuauuc

SEQ ID NO: 571474 - RNA, 19 nt, Homo sapiens
cugaugaaauuagcgaaua

SEQ ID NO: 571475 - RNA, 19 nt, Homo sapiens
gcgauuaucagucucauca

SEQ ID NO: 571476 - RNA, 19 nt, Homo sapiens
uaaccagcuugccaaagaa

SEQ ID NO: 571477 - RNA, 19 nt, Homo sapiens
gcaguauacuaaccagcuu

SEQ ID NO: 571478 - RNA, 19 nt, Homo sapiens
caucaucauucuuauccuu

SEQ ID NO: 571479 - RNA, 19 nt, Homo sapiens
gaaccacugaaguuauaaa

SEQ ID NO: 571480 - RNA, 19 nt, Homo sapiens
caaggagauguaauagaua

SEQ ID NO: 571481 - RNA, 19 nt, Homo sapiens
acuugaagcugauauuaug

SEQ ID NO: 571482 - RNA, 19 nt, Homo sapiens
uugauacucuuucugugua

SEQ ID NO: 571483 - RNA, 19 nt, Homo sapiens
gaagcugauauuauggaua

SEQ ID NO: 571484 - RNA, 19 nt, Homo sapiens
gugaacagcgucaaaggaa

SEQ ID NO: 571485 - RNA, 19 nt, Homo sapiens
gcggguuccuuuggauuaa

SEQ ID NO: 571486 - RNA, 19 nt, Homo sapiens
gaguugcgauuaucagucu

SEQ ID NO: 571487 - RNA, 19 nt, Homo sapiens
ugucaagggcagcagauua

SEQ ID NO: 571488 - RNA, 19 nt, Homo sapiens
ugaacagcgucaaaggaaa

SEQ ID NO: 571489 - RNA, 19 nt, Homo sapiens
ugcuguagauugccuagua

SEQ ID NO: 571490 - RNA, 19 nt, Homo sapiens
ggaaauuuaaggugugugu

SEQ ID NO: 571491 - RNA, 19 nt, Homo sapiens
ugcauaugccuuucauuua

SEQ ID NO: 571492 - RNA, 19 nt, Homo sapiens
guuuguugcucgaguaaga

SEQ ID NO: 571493 - RNA, 19 nt, Homo sapiens
uggcagaguucacaacauc

SEQ ID NO: 571494 - RNA, 19 nt, Homo sapiens
uugcauaugccuuucauuu

SEQ ID NO: 571495 - RNA, 19 nt, Homo sapiens
gcaacuugaagcugauauu

SEQ ID NO: 571496 - RNA, 19 nt, Homo sapiens
cccuuggucuucaauuuaa

SEQ ID NO: 571497 - RNA, 19 nt, Homo sapiens
gcaggugcaggaugaagaa

SEQ ID NO: 571498 - RNA, 19 nt, Homo sapiens
aaucuuguauccugggaaa

SEQ ID NO: 571499 - RNA, 19 nt, Homo sapiens
gaaauuuaaggugugugua

SEQ ID NO: 571500 - RNA, 19 nt, Homo sapiens
ucauuggaguugcgauuau

SEQ ID NO: 571501 - RNA, 19 nt, Homo sapiens
aaggagauguaauagauag

SEQ ID NO: 571502 - RNA, 19 nt, Homo sapiens
ugaagaaauuacagaggau

SEQ ID NO: 571503 - RNA, 19 nt, Homo sapiens
cgagagaaagaguuuguug

SEQ ID NO: 571504 - RNA, 19 nt, Homo sapiens
cgaauaagaacaucaacca

SEQ ID NO: 571505 - RNA, 19 nt, Homo sapiens
agaaaggaaucuuguaucc

SEQ ID NO: 571506 - RNA, 19 nt, Homo sapiens
gaacagcgucaaaggaaaa

SEQ ID NO: 571507 - RNA, 19 nt, Homo sapiens
cagaagcagcaguauacua

SEQ ID NO: 571508 - RNA, 19 nt, Homo sapiens
agaguuuguugcucgagua

SEQ ID NO: 571509 - RNA, 19 nt, Homo sapiens
ggcggguuccuuuggauua

SEQ ID NO: 571510 - RNA, 19 nt, Homo sapiens
cgcacuacauugucuaaau

SEQ ID NO: 571511 - RNA, 19 nt, Homo sapiens
caaagaacucugaaucaac

SEQ ID NO: 571512 - RNA, 19 nt, Homo sapiens
uaacucccuuggucuucaa

SEQ ID NO: 571513 - RNA, 19 nt, Homo sapiens
gucaagggcagcagauuau

SEQ ID NO: 571514 - RNA, 19 nt, Homo sapiens
uagcauagaagccaaugug

SEQ ID NO: 571515 - RNA, 19 nt, Homo sapiens
aagccaaacucaaccucaa

SEQ ID NO: 571516 - RNA, 19 nt, Homo sapiens
uaucagcgcaaauccagaa

SEQ ID NO: 571517 - RNA, 19 nt, Homo sapiens
auacaaagaacucugaauc

SEQ ID NO: 571518 - RNA, 19 nt, Homo sapiens
caucaaccaugucuuacac

SEQ ID NO: 571519 - RNA, 19 nt, Homo sapiens
guucacaacagcacaaagu

SEQ ID NO: 571520 - RNA, 19 nt, Homo sapiens
gaauaagaacaucaaccau

SEQ ID NO: 571521 - RNA, 19 nt, Homo sapiens
caagggcagcagauuauca

SEQ ID NO: 571522 - RNA, 19 nt, Homo sapiens
gauguaauagauagcauag

SEQ ID NO: 571523 - RNA, 19 nt, Homo sapiens
ucacaacaucacugacaaa

SEQ ID NO: 571524 - RNA, 19 nt, Homo sapiens
uacaaagaacucugaauca

SEQ ID NO: 571525 - RNA, 19 nt, Homo sapiens
uauuuacccugcuugacuu

SEQ ID NO: 571526 - RNA, 19 nt, Homo sapiens
ucccuuggucuucaauuua

SEQ ID NO: 571527 - RNA, 19 nt, Homo sapiens
gagauguaauagauagcau

SEQ ID NO: 571528 - RNA, 19 nt, Homo sapiens
ggaugaccuccgucuuauu

SEQ ID NO: 571529 - RNA, 19 nt, Homo sapiens
uuaucagucucaucauaug

SEQ ID NO: 571530 - RNA, 19 nt, Homo sapiens
ucaugaacaaggagaugua

SEQ ID NO: 571531 - RNA, 19 nt, Homo sapiens
aaagauuugggaaugauga

SEQ ID NO: 571532 - RNA, 19 nt, Homo sapiens
gcaggaugaagaaauuaca

SEQ ID NO: 571533 - RNA, 19 nt, Homo sapiens
ugagcgagagaaagaguuu

SEQ ID NO: 571534 - RNA, 19 nt, Homo sapiens
ucacaacagcacaaagugu

SEQ ID NO: 571535 - RNA, 19 nt, Homo sapiens
gcacguucagcaagcaaau

SEQ ID NO: 571536 - RNA, 19 nt, Homo sapiens
aggaugaccuccgucuuau

SEQ ID NO: 571537 - RNA, 19 nt, Homo sapiens
guucacaacaucacugaca

SEQ ID NO: 571538 - RNA, 19 nt, Homo sapiens
ugacuuaguuuggggaauu

SEQ ID NO: 571539 - RNA, 19 nt, Homo sapiens
gaacuuggcucucuaucaa

SEQ ID NO: 571540 - RNA, 19 nt, Homo sapiens
gcagaugacuuuaaagaga

SEQ ID NO: 571541 - RNA, 19 nt, Homo sapiens
ggugugagcuggaacaaau

SEQ ID NO: 571542 - RNA, 19 nt, Homo sapiens
gagaggauccuucugcuuu

SEQ ID NO: 571543 - RNA, 19 nt, Homo sapiens
uagaaagucugaaagaaga

SEQ ID NO: 571544 - RNA, 19 nt, Homo sapiens
gagagcggcugauggagaa

SEQ ID NO: 571545 - RNA, 19 nt, Homo sapiens
gagcagaugacuuuaaaga

SEQ ID NO: 571546 - RNA, 19 nt, Homo sapiens
ggaaauuaacucucuguau

SEQ ID NO: 571547 - RNA, 19 nt, Homo sapiens
ggagagagauguugaaaag

SEQ ID NO: 571548 - RNA, 19 nt, Homo sapiens
gcacuggucuggacgacau

SEQ ID NO: 571549 - RNA, 19 nt, Homo sapiens
ugaguagucuguagcuuga

SEQ ID NO: 571550 - RNA, 19 nt, Homo sapiens
ggaccuggagagucaaaua

SEQ ID NO: 571551 - RNA, 19 nt, Homo sapiens
gagcagccauuucgaaagg

SEQ ID NO: 571552 - RNA, 19 nt, Homo sapiens
cggagcagaugacuuuaaa

SEQ ID NO: 571553 - RNA, 19 nt, Homo sapiens
gaggauccuucugcuuuaa

SEQ ID NO: 571554 - RNA, 19 nt, Homo sapiens
agaggauccuucugcuuua

SEQ ID NO: 571555 - RNA, 19 nt, Homo sapiens
aaauggaccuggagaguca

SEQ ID NO: 571556 - RNA, 19 nt, Homo sapiens
ggccggagcagaugacuuu

SEQ ID NO: 571557 - RNA, 19 nt, Homo sapiens
ggaugcaccuggagagcaa

SEQ ID NO: 571558 - RNA, 19 nt, Homo sapiens
uggauucccugguuaauuc

SEQ ID NO: 571559 - RNA, 19 nt, Homo sapiens
gucaggagcuggaaacaca

SEQ ID NO: 571560 - RNA, 19 nt, Homo sapiens
uggaauauauggccaaagu

SEQ ID NO: 571561 - RNA, 19 nt, Homo sapiens
gaggagagcggcugaugga

SEQ ID NO: 571562 - RNA, 19 nt, Homo sapiens
gcaagugccagcugcagaa

SEQ ID NO: 571563 - RNA, 19 nt, Homo sapiens
gaagaacuuggcucucuau

SEQ ID NO: 571564 - RNA, 19 nt, Homo sapiens
caucagcagugucuuccuu

SEQ ID NO: 571565 - RNA, 19 nt, Homo sapiens
gugcgcagcguccaguuua

SEQ ID NO: 571566 - RNA, 19 nt, Homo sapiens
ugaagcugcugcacaaaca

SEQ ID NO: 571567 - RNA, 19 nt, Homo sapiens
gaaacuaugaagaggaugu

SEQ ID NO: 571568 - RNA, 19 nt, Homo sapiens
agaagaacuuggcucucua

SEQ ID NO: 571569 - RNA, 19 nt, Homo sapiens
cucaacagcugacccaaga

SEQ ID NO: 571570 - RNA, 19 nt, Homo sapiens
gaaguugcuugaggagcuu

SEQ ID NO: 571571 - RNA, 19 nt, Homo sapiens
aaacacaacugcggaugca

SEQ ID NO: 571572 - RNA, 19 nt, Homo sapiens
aagaaacuaugaagaggau

SEQ ID NO: 571573 - RNA, 19 nt, Homo sapiens
caaagcagccccagggaua

SEQ ID NO: 571574 - RNA, 19 nt, Homo sapiens
ccuggagagucaaauagaa

SEQ ID NO: 571575 - RNA, 19 nt, Homo sapiens
gagggaccauggugcuguu

SEQ ID NO: 571576 - RNA, 19 nt, Homo sapiens
agagagauguugaaaagaa

SEQ ID NO: 571577 - RNA, 19 nt, Homo sapiens
aagaagaacuuggcucucu

SEQ ID NO: 571578 - RNA, 19 nt, Homo sapiens
ccaaagugcacgcccuuga

SEQ ID NO: 571579 - RNA, 19 nt, Homo sapiens
cagaaggggugaugaguga

SEQ ID NO: 571580 - RNA, 19 nt, Homo sapiens
gucuguagcuugagcaauc

SEQ ID NO: 571581 - RNA, 19 nt, Homo sapiens
gagacgaucagaauucagu

SEQ ID NO: 571582 - RNA, 19 nt, Homo sapiens
gcuuuaaucugaguagucu

SEQ ID NO: 571583 - RNA, 19 nt, Homo sapiens
ggagaacaccuugcacgau

SEQ ID NO: 571584 - RNA, 19 nt, Homo sapiens
gaggcuaauuugacuaaaa

SEQ ID NO: 571585 - RNA, 19 nt, Homo sapiens
gaauucagugggagagaga

SEQ ID NO: 571586 - RNA, 19 nt, Homo sapiens
caaauagaaagucugaaag

SEQ ID NO: 571587 - RNA, 19 nt, Homo sapiens
gguggaauauauggccaaa

SEQ ID NO: 571588 - RNA, 19 nt, Homo sapiens
ggaccauggugcuguugag

SEQ ID NO: 571589 - RNA, 19 nt, Homo sapiens
ggauccuucugcuuuaauc

SEQ ID NO: 571590 - RNA, 19 nt, Homo sapiens
uggagaaacuuccucuuuu

SEQ ID NO: 571591 - RNA, 19 nt, Homo sapiens
ggagaggauccuucugcuu

SEQ ID NO: 571592 - RNA, 19 nt, Homo sapiens
cugcuggauucccugguua

SEQ ID NO: 571593 - RNA, 19 nt, Homo sapiens
gaaaacacccuuccucaac

SEQ ID NO: 571594 - RNA, 19 nt, Homo sapiens
gaaacgaggccuggagaac

SEQ ID NO: 571595 - RNA, 19 nt, Homo sapiens
gcgcagcguccaguuuaaa

SEQ ID NO: 571596 - RNA, 19 nt, Homo sapiens
caacagcugacccaagaag

SEQ ID NO: 571597 - RNA, 19 nt, Homo sapiens
aggcggagcucagggaaau

SEQ ID NO: 571598 - RNA, 19 nt, Homo sapiens
gcugccugguggaauauau

SEQ ID NO: 571599 - RNA, 19 nt, Homo sapiens
ccuccaggcugagacagaa

SEQ ID NO: 571600 - RNA, 19 nt, Homo sapiens
gcuccaagcuaagcaacag

SEQ ID NO: 571601 - RNA, 19 nt, Homo sapiens
cagcugacccaagaaguug

SEQ ID NO: 571602 - RNA, 19 nt, Homo sapiens
ugaugaggcuaauuugacu

SEQ ID NO: 571603 - RNA, 19 nt, Homo sapiens
aaacgaggccuggagaaca

SEQ ID NO: 571604 - RNA, 19 nt, Homo sapiens
gaggaaauuaacucucugu

SEQ ID NO: 571605 - RNA, 19 nt, Homo sapiens
cagaagaggaaauuaacuc

SEQ ID NO: 571606 - RNA, 19 nt, Homo sapiens
gcagaagaggaaauuaacu

SEQ ID NO: 571607 - RNA, 19 nt, Homo sapiens
ggcugagacagaauccuua

SEQ ID NO: 571608 - RNA, 19 nt, Homo sapiens
gaccuggagagucaaauag

SEQ ID NO: 571609 - RNA, 19 nt, Homo sapiens
ggaauauauggccaaagug

SEQ ID NO: 571610 - RNA, 19 nt, Homo sapiens
ccacuggacucuguaaacc

SEQ ID NO: 571611 - RNA, 19 nt, Homo sapiens
auggagaaacuuccucuuu

SEQ ID NO: 571612 - RNA, 19 nt, Homo sapiens
gaugaggcuaauuugacua

SEQ ID NO: 571613 - RNA, 19 nt, Homo sapiens
ggggcugccugguggaaua

SEQ ID NO: 571614 - RNA, 19 nt, Homo sapiens
ggugaggcagucuuggaaa

SEQ ID NO: 571615 - RNA, 19 nt, Homo sapiens
ccugcuggauucccugguu

SEQ ID NO: 571616 - RNA, 19 nt, Homo sapiens
acagcugacccaagaaguu

SEQ ID NO: 571617 - RNA, 19 nt, Homo sapiens
ucagcagugucuuccuuca

SEQ ID NO: 571618 - RNA, 19 nt, Homo sapiens
aaacacccuuccucaacag

SEQ ID NO: 571619 - RNA, 19 nt, Homo sapiens
caggaccaaugccaugagu

SEQ ID NO: 571620 - RNA, 19 nt, Homo sapiens
agucaaauagaaagucuga

SEQ ID NO: 571621 - RNA, 19 nt, Homo sapiens
ggagagucaaauagaaagu

SEQ ID NO: 571622 - RNA, 19 nt, Homo sapiens
ccggagcagaugacuuuaa

SEQ ID NO: 571623 - RNA, 19 nt, Homo sapiens
uaaucugaguagucuguag

SEQ ID NO: 571624 - RNA, 19 nt, Homo sapiens
ccugguuaauucagcuuga

SEQ ID NO: 571625 - RNA, 19 nt, Homo sapiens
caaagugcacgcccuugag

SEQ ID NO: 571626 - RNA, 19 nt, Homo sapiens
agugccagcugcagaagga

SEQ ID NO: 571627 - RNA, 19 nt, Homo sapiens
auagaaagucugaaagaag

SEQ ID NO: 571628 - RNA, 19 nt, Homo sapiens
agagucaaauagaaagucu

SEQ ID NO: 571629 - RNA, 19 nt, Homo sapiens
gggugaggcagucuuggaa

SEQ ID NO: 571630 - RNA, 19 nt, Homo sapiens
auccuuacgugcccugaaa

SEQ ID NO: 571631 - RNA, 19 nt, Homo sapiens
gagugagaggcgaguggua

SEQ ID NO: 571632 - RNA, 19 nt, Homo sapiens
ggcagggugugagcuggaa

SEQ ID NO: 571633 - RNA, 19 nt, Homo sapiens
cuggagagucaaauagaaa

SEQ ID NO: 571634 - RNA, 19 nt, Homo sapiens
gaagucaccuguagauaau

SEQ ID NO: 571635 - RNA, 19 nt, Homo sapiens
gaaaguaggcauaguaaga

SEQ ID NO: 571636 - RNA, 19 nt, Homo sapiens
guagauggguuuaaugugu

SEQ ID NO: 571637 - RNA, 19 nt, Homo sapiens
caagaaaguaggcauagua

SEQ ID NO: 571638 - RNA, 19 nt, Homo sapiens
caggugaugugauuacuuu

SEQ ID NO: 571639 - RNA, 19 nt, Homo sapiens
ggaauuaaaggcuugauau

SEQ ID NO: 571640 - RNA, 19 nt, Homo sapiens
gaacauguaacuucucuca

SEQ ID NO: 571641 - RNA, 19 nt, Homo sapiens
cagcaaagaauccaaguuu

SEQ ID NO: 571642 - RNA, 19 nt, Homo sapiens
uccagaaugucuacaaaua

SEQ ID NO: 571643 - RNA, 19 nt, Homo sapiens
ugaagucaccuguagauaa

SEQ ID NO: 571644 - RNA, 19 nt, Homo sapiens
aaacugaagucaccuguag

SEQ ID NO: 571645 - RNA, 19 nt, Homo sapiens
gcaaagcuccaaagagaau

SEQ ID NO: 571646 - RNA, 19 nt, Homo sapiens
ccucaggcauuccagauuu

SEQ ID NO: 571647 - RNA, 19 nt, Homo sapiens
ugacaaaccaggagaaguu

SEQ ID NO: 571648 - RNA, 19 nt, Homo sapiens
gucaaggcuucguaucuua

SEQ ID NO: 571649 - RNA, 19 nt, Homo sapiens
gcugacaguuucuuuacuu

SEQ ID NO: 571650 - RNA, 19 nt, Homo sapiens
gaccauauuuugugagaua

SEQ ID NO: 571651 - RNA, 19 nt, Homo sapiens
gcaaagaauccaaguuuac

SEQ ID NO: 571652 - RNA, 19 nt, Homo sapiens
caacuagggacacaauauu

SEQ ID NO: 571653 - RNA, 19 nt, Homo sapiens
caaaaucgaugcaaacaau

SEQ ID NO: 571654 - RNA, 19 nt, Homo sapiens
gcaacuagggacacaauau

SEQ ID NO: 571655 - RNA, 19 nt, Homo sapiens
uugcaugccugcucuaauu

SEQ ID NO: 571656 - RNA, 19 nt, Homo sapiens
gaaauuguagauggguuua

SEQ ID NO: 571657 - RNA, 19 nt, Homo sapiens
cagaaugucuacaaauagu

SEQ ID NO: 571658 - RNA, 19 nt, Homo sapiens
ucacagaccaugaucuuug

SEQ ID NO: 571659 - RNA, 19 nt, Homo sapiens
gguggagaauggaaacuga

SEQ ID NO: 571660 - RNA, 19 nt, Homo sapiens
aaguuuaccuucaagauga

SEQ ID NO: 571661 - RNA, 19 nt, Homo sapiens
ggaguggauuacugugauu

SEQ ID NO: 571662 - RNA, 19 nt, Homo sapiens
ggaguuuguugaccucaug

SEQ ID NO: 571663 - RNA, 19 nt, Homo sapiens
caagaugaauccaggugau

SEQ ID NO: 571664 - RNA, 19 nt, Homo sapiens
uuacacaacugggaagcua

SEQ ID NO: 571665 - RNA, 19 nt, Homo sapiens
ccaugaucuuugugauuua

SEQ ID NO: 571666 - RNA, 19 nt, Homo sapiens
gaaacugaagucaccugua

SEQ ID NO: 571667 - RNA, 19 nt, Homo sapiens
gaauccaaguuuaccuuca

SEQ ID NO: 571668 - RNA, 19 nt, Homo sapiens
agcaaagaauccaaguuua

SEQ ID NO: 571669 - RNA, 19 nt, Homo sapiens
ccgaugagcauuacaguga

SEQ ID NO: 571670 - RNA, 19 nt, Homo sapiens
ccuuaacaaugaacaugua

SEQ ID NO: 571671 - RNA, 19 nt, Homo sapiens
uggaagcucuugaugugaa

SEQ ID NO: 571672 - RNA, 19 nt, Homo sapiens
caaugaacauguaacuucu

SEQ ID NO: 571673 - RNA, 19 nt, Homo sapiens
ugagauauggcacauuauu

SEQ ID NO: 571674 - RNA, 19 nt, Homo sapiens
gacagcaucuacuccugaa

SEQ ID NO: 571675 - RNA, 19 nt, Homo sapiens
acaaugaacauguaacuuc

SEQ ID NO: 571676 - RNA, 19 nt, Homo sapiens
augaguaucuccagaaugu

SEQ ID NO: 571677 - RNA, 19 nt, Homo sapiens
acauguaacuucucucaca

SEQ ID NO: 571678 - RNA, 19 nt, Homo sapiens
accaugaucuuugugauuu

SEQ ID NO: 571679 - RNA, 19 nt, Homo sapiens
gcuccaaagagaauuguuu

SEQ ID NO: 571680 - RNA, 19 nt, Homo sapiens
gaugagcauuacagugaau

SEQ ID NO: 571681 - RNA, 19 nt, Homo sapiens
gaccaugaucuuugugauu

SEQ ID NO: 571682 - RNA, 19 nt, Homo sapiens
uaagcuuucacacugauua

SEQ ID NO: 571683 - RNA, 19 nt, Homo sapiens
caaacaauguggcuuacac

SEQ ID NO: 571684 - RNA, 19 nt, Homo sapiens
cauccuuucugcucuguug

SEQ ID NO: 571685 - RNA, 19 nt, Homo sapiens
caaguuuaccuucaagaug

SEQ ID NO: 571686 - RNA, 19 nt, Homo sapiens
ugauaaaggccaagugguu

SEQ ID NO: 571687 - RNA, 19 nt, Homo sapiens
caccggagcaucugacaaa

SEQ ID NO: 571688 - RNA, 19 nt, Homo sapiens
aaacuugucucaaaacaug

SEQ ID NO: 571689 - RNA, 19 nt, Homo sapiens
ugccugcucuaauuucuuu

SEQ ID NO: 571690 - RNA, 19 nt, Homo sapiens
gacaguuucuuuacuugca

SEQ ID NO: 571691 - RNA, 19 nt, Homo sapiens
gagauauggcacauuauuc

SEQ ID NO: 571692 - RNA, 19 nt, Homo sapiens
agucaccuguagauaauuu

SEQ ID NO: 571693 - RNA, 19 nt, Homo sapiens
caacuucaauaacgcaacu

SEQ ID NO: 571694 - RNA, 19 nt, Homo sapiens
ggcagaggguggagaaugg

SEQ ID NO: 571695 - RNA, 19 nt, Homo sapiens
ugucaaggcuucguaucuu

SEQ ID NO: 571696 - RNA, 19 nt, Homo sapiens
ugaagcaggaacugagaua

SEQ ID NO: 571697 - RNA, 19 nt, Homo sapiens
aguggaagcucuugaugug

SEQ ID NO: 571698 - RNA, 19 nt, Homo sapiens
cauguaacuucucucacaa

SEQ ID NO: 571699 - RNA, 19 nt, Homo sapiens
gauaucccgccaucuagaa

SEQ ID NO: 571700 - RNA, 19 nt, Homo sapiens
ggacuuuacagacauugga

SEQ ID NO: 571701 - RNA, 19 nt, Homo sapiens
gcucuccacccucaagaaa

SEQ ID NO: 571702 - RNA, 19 nt, Homo sapiens
guucgcaucaacuucaaua

SEQ ID NO: 571703 - RNA, 19 nt, Homo sapiens
gcuaagcuuucacacugau

SEQ ID NO: 571704 - RNA, 19 nt, Homo sapiens
ggauggguuuccucuaucu

SEQ ID NO: 571705 - RNA, 19 nt, Homo sapiens
gggauguggucaugucaag

SEQ ID NO: 571706 - RNA, 19 nt, Homo sapiens
gauaacuggcgcuuacuuc

SEQ ID NO: 571707 - RNA, 19 nt, Homo sapiens
ggaaacauggcuuguacca

SEQ ID NO: 571708 - RNA, 19 nt, Homo sapiens
aagaaaguaggcauaguaa

SEQ ID NO: 571709 - RNA, 19 nt, Homo sapiens
ugaugaacaugcauacaag

SEQ ID NO: 571710 - RNA, 19 nt, Homo sapiens
ugacggggcucauuugaug

SEQ ID NO: 571711 - RNA, 19 nt, Homo sapiens
gagaauggaaacugaaguc

SEQ ID NO: 571712 - RNA, 19 nt, Homo sapiens
gggacacaauauuugaugu

SEQ ID NO: 571713 - RNA, 19 nt, Homo sapiens
uaacgcaacuagggacaca

SEQ ID NO: 571714 - RNA, 19 nt, Homo sapiens
ccaagugguucgcaucaac

SEQ ID NO: 571715 - RNA, 19 nt, Homo sapiens
cagcaucuacuccugaaga

SEQ ID NO: 571716 - RNA, 19 nt, Homo sapiens
ccggaaacauggcuuguac

SEQ ID NO: 571717 - RNA, 19 nt, Homo sapiens
uguaacuucucucacaaga

SEQ ID NO: 571718 - RNA, 19 nt, Homo sapiens
cacagaccaugaucuuugu

SEQ ID NO: 571719 - RNA, 19 nt, Homo sapiens
aauccaaguuuaccuucaa

SEQ ID NO: 571720 - RNA, 19 nt, Homo sapiens
cgaugagcauuacagugaa

SEQ ID NO: 571721 - RNA, 19 nt, Homo sapiens
ccagaaugucuacaaauag

SEQ ID NO: 571722 - RNA, 19 nt, Homo sapiens
ucuccagaaugucuacaaa

SEQ ID NO: 571723 - RNA, 19 nt, Homo sapiens
gggcucauuugaugcagau

SEQ ID NO: 571724 - RNA, 19 nt, Homo sapiens
gcuguaugguugagagaca

SEQ ID NO: 571725 - RNA, 19 nt, Homo sapiens
ucaaggcuucguaucuuaa

SEQ ID NO: 571726 - RNA, 19 nt, Homo sapiens
gaagcaggaacugagauau

SEQ ID NO: 571727 - RNA, 19 nt, Homo sapiens
gcucugaaggaguuuguug

SEQ ID NO: 571728 - RNA, 19 nt, Homo sapiens
agauauggcacauuauuca

SEQ ID NO: 571729 - RNA, 19 nt, Homo sapiens
ucugauugcuaccuggauu

SEQ ID NO: 571730 - RNA, 19 nt, Homo sapiens
aaauaauccucaggcauuc

SEQ ID NO: 571731 - RNA, 19 nt, Homo sapiens
aaaauaauccucaggcauu

SEQ ID NO: 571732 - RNA, 19 nt, Homo sapiens
uuuccucuaucucacauuu

SEQ ID NO: 571733 - RNA, 19 nt, Homo sapiens
ccucaagaaaguaggcaua

SEQ ID NO: 571734 - RNA, 19 nt, Homo sapiens
gaacaucacuaaacagauc

SEQ ID NO: 571735 - RNA, 19 nt, Homo sapiens
gcacugauguggacgaaug

SEQ ID NO: 571736 - RNA, 19 nt, Homo sapiens
ggagagacguggacgaaug

SEQ ID NO: 571737 - RNA, 19 nt, Homo sapiens
gaaccugccuggcucuuuc

SEQ ID NO: 571738 - RNA, 19 nt, Homo sapiens
caacagcccggaagaguuu

SEQ ID NO: 571739 - RNA, 19 nt, Homo sapiens
gggcuucgguuacugcuuu

SEQ ID NO: 571740 - RNA, 19 nt, Homo sapiens
ggccagagcucuacugaag

SEQ ID NO: 571741 - RNA, 19 nt, Homo sapiens
ggacgaaugucagcucuuc

SEQ ID NO: 571742 - RNA, 19 nt, Homo sapiens
cauaugggccugaguugua

SEQ ID NO: 571743 - RNA, 19 nt, Homo sapiens
cgaguacggcccagacuua

SEQ ID NO: 571744 - RNA, 19 nt, Homo sapiens
gcaccgagacagcugagua

SEQ ID NO: 571745 - RNA, 19 nt, Homo sapiens
caacacggcaggcuccuuu

SEQ ID NO: 571746 - RNA, 19 nt, Homo sapiens
gaggacggcuacucagaug

SEQ ID NO: 571747 - RNA, 19 nt, Homo sapiens
gcagcccgcuuaugcguau

SEQ ID NO: 571748 - RNA, 19 nt, Homo sapiens
gaauauggucccgagauuu

SEQ ID NO: 571749 - RNA, 19 nt, Homo sapiens
gaacuucuguuggcauguc

SEQ ID NO: 571750 - RNA, 19 nt, Homo sapiens
gccaggauguggaugaaug

SEQ ID NO: 571751 - RNA, 19 nt, Homo sapiens
ucaacacugugggcucuua

SEQ ID NO: 571752 - RNA, 19 nt, Homo sapiens
agaauauggucccgagauu

SEQ ID NO: 571753 - RNA, 19 nt, Homo sapiens
gugaagaggauguggauga

SEQ ID NO: 571754 - RNA, 19 nt, Homo sapiens
gguggaagcuaugcugguu

SEQ ID NO: 571755 - RNA, 19 nt, Homo sapiens
gaugugaacgagugugaaa

SEQ ID NO: 571756 - RNA, 19 nt, Homo sapiens
gccaggauguggacgaaug

SEQ ID NO: 571757 - RNA, 19 nt, Homo sapiens
ggagcugcccugugugaaa

SEQ ID NO: 571758 - RNA, 19 nt, Homo sapiens
ggaugagugccaagaauau

SEQ ID NO: 571759 - RNA, 19 nt, Homo sapiens
gcuguucgcugcccauucu

SEQ ID NO: 571760 - RNA, 19 nt, Homo sapiens
uuacaugcccucucccuuu

SEQ ID NO: 571761 - RNA, 19 nt, Homo sapiens
ucacucagccagccucgua

SEQ ID NO: 571762 - RNA, 19 nt, Homo sapiens
ccucuugccucgacguuga

SEQ ID NO: 571763 - RNA, 19 nt, Homo sapiens
caacacugacggcuccuuu

SEQ ID NO: 571764 - RNA, 19 nt, Homo sapiens
gcaggacucagaugacuuc

SEQ ID NO: 571765 - RNA, 19 nt, Homo sapiens
gagccucgaugacaaucug

SEQ ID NO: 571766 - RNA, 19 nt, Homo sapiens
gcagcaacggcuacuacua

SEQ ID NO: 571767 - RNA, 19 nt, Homo sapiens
gccagagccucgaugacaa

SEQ ID NO: 571768 - RNA, 19 nt, Homo sapiens
cgagugcgccgaugaggaa

SEQ ID NO: 571769 - RNA, 19 nt, Homo sapiens
gugcaagaguggcgugugu

SEQ ID NO: 571770 - RNA, 19 nt, Homo sapiens
caggagugcugcuguacug

SEQ ID NO: 571771 - RNA, 19 nt, Homo sapiens
guaaaagcguugcuguuug

SEQ ID NO: 571772 - RNA, 19 nt, Homo sapiens
gcagcugcaucucccaaca

SEQ ID NO: 571773 - RNA, 19 nt, Homo sapiens
guggaugagugccaagaau

SEQ ID NO: 571774 - RNA, 19 nt, Homo sapiens
gcgaccagguggcuuugga

SEQ ID NO: 571775 - RNA, 19 nt, Homo sapiens
uaaaagcguugcuguuugu

SEQ ID NO: 571776 - RNA, 19 nt, Homo sapiens
ggaggacggcuacucagau

SEQ ID NO: 571777 - RNA, 19 nt, Homo sapiens
gcaagaguggcgugugugu

SEQ ID NO: 571778 - RNA, 19 nt, Homo sapiens
gggcaccugugacgaugug

SEQ ID NO: 571779 - RNA, 19 nt, Homo sapiens
gcagcgaggaggaccuuug

SEQ ID NO: 571780 - RNA, 19 nt, Homo sapiens
caccugcgcuugcgacucu

SEQ ID NO: 571781 - RNA, 19 nt, Homo sapiens
gagagacguggacgaaugu

SEQ ID NO: 571782 - RNA, 19 nt, Homo sapiens
cagcugaguaccagucauu

SEQ ID NO: 571783 - RNA, 19 nt, Homo sapiens
aauauggucccgagauuug

SEQ ID NO: 571784 - RNA, 19 nt, Homo sapiens
uggaugagugccaagaaua

SEQ ID NO: 571785 - RNA, 19 nt, Homo sapiens
cccaacacgugaucucaga

SEQ ID NO: 571786 - RNA, 19 nt, Homo sapiens
gcgcaggacucagaugacu

SEQ ID NO: 571787 - RNA, 19 nt, Homo sapiens
cguggcagaugcacugaug

SEQ ID NO: 571788 - RNA, 19 nt, Homo sapiens
cggaacaucacuaaacaga

SEQ ID NO: 571789 - RNA, 19 nt, Homo sapiens
ccaacagcccggaagaguu

SEQ ID NO: 571790 - RNA, 19 nt, Homo sapiens
gagcugcccugugugaaaa

SEQ ID NO: 571791 - RNA, 19 nt, Homo sapiens
caccugcgcuacccuacga

SEQ ID NO: 571792 - RNA, 19 nt, Homo sapiens
uaccagggccucccauaug

SEQ ID NO: 571793 - RNA, 19 nt, Homo sapiens
ugugggcucuuaucacugu

SEQ ID NO: 571794 - RNA, 19 nt, Homo sapiens
cagcaacggcuacuacuac

SEQ ID NO: 571795 - RNA, 19 nt, Homo sapiens
cccuugaucugucacaaug

SEQ ID NO: 571796 - RNA, 19 nt, Homo sapiens
aagaguggcguguguguga

SEQ ID NO: 571797 - RNA, 19 nt, Homo sapiens
ccagggcacccgaugcauu

SEQ ID NO: 571798 - RNA, 19 nt, Homo sapiens
gagaccaggugugcaagag

SEQ ID NO: 571799 - RNA, 19 nt, Homo sapiens
gguccugugucccuugauc

SEQ ID NO: 571800 - RNA, 19 nt, Homo sapiens
cauccuggcucggaaugug

SEQ ID NO: 571801 - RNA, 19 nt, Homo sapiens
gagugcugcugccuguaug

SEQ ID NO: 571802 - RNA, 19 nt, Homo sapiens
gggaggacggcuacucaga

SEQ ID NO: 571803 - RNA, 19 nt, Homo sapiens
ggagugcuauuuugacaca

SEQ ID NO: 571804 - RNA, 19 nt, Homo sapiens
gaugagugccaagaauaug

SEQ ID NO: 571805 - RNA, 19 nt, Homo sapiens
cagggcacccgaugcauug

SEQ ID NO: 571806 - RNA, 19 nt, Homo sapiens
cgacaugccagacuuugag

SEQ ID NO: 571807 - RNA, 19 nt, Homo sapiens
uaauggguccugcgaagau

SEQ ID NO: 571808 - RNA, 19 nt, Homo sapiens
guacggcccagacuuaggu

SEQ ID NO: 571809 - RNA, 19 nt, Homo sapiens
ccaggaggccagagcucua

SEQ ID NO: 571810 - RNA, 19 nt, Homo sapiens
gaggccagagcucuacuga

SEQ ID NO: 571811 - RNA, 19 nt, Homo sapiens
gauguggacgaaugcaguu

SEQ ID NO: 571812 - RNA, 19 nt, Homo sapiens
ugaagaggauguggaugag

SEQ ID NO: 571813 - RNA, 19 nt, Homo sapiens
ggcccaggacgcugcauuu

SEQ ID NO: 571814 - RNA, 19 nt, Homo sapiens
ggacgaugguggccccuau

SEQ ID NO: 571815 - RNA, 19 nt, Homo sapiens
ggcaggcuccuuucacugu

SEQ ID NO: 571816 - RNA, 19 nt, Homo sapiens
ggcacccgaugcauugaug

SEQ ID NO: 571817 - RNA, 19 nt, Homo sapiens
ccuccgaccuccgcuacaa

SEQ ID NO: 571818 - RNA, 19 nt, Homo sapiens
ggaacaucacuaaacagau

SEQ ID NO: 571819 - RNA, 19 nt, Homo sapiens
gcuucgacaugccagacuu

SEQ ID NO: 571820 - RNA, 19 nt, Homo sapiens
ucgaggcccugugcaaugu

SEQ ID NO: 571821 - RNA, 19 nt, Homo sapiens
gagcccagcguugugagaa

SEQ ID NO: 571822 - RNA, 19 nt, Homo sapiens
ucggccaucugcaggcuuu

SEQ ID NO: 571823 - RNA, 19 nt, Homo sapiens
gaccuacggacgccuggaa

SEQ ID NO: 571824 - RNA, 19 nt, Homo sapiens
ugcggaacaucacuaaaca

SEQ ID NO: 571825 - RNA, 19 nt, Homo sapiens
caacauccuggcucggaau

SEQ ID NO: 571826 - RNA, 19 nt, Homo sapiens
gcccagcguugugagaaca

SEQ ID NO: 571827 - RNA, 19 nt, Homo sapiens
gcauccugcagcccgcuua

SEQ ID NO: 571828 - RNA, 19 nt, Homo sapiens
guggagcugcccuguguga

SEQ ID NO: 571829 - RNA, 19 nt, Homo sapiens
uguccaaccggcuuugaaa

SEQ ID NO: 571830 - RNA, 19 nt, Homo sapiens
ccagagccucgaugacaau

SEQ ID NO: 571831 - RNA, 19 nt, Homo sapiens
cguaaaagcguugcuguuu

SEQ ID NO: 571832 - RNA, 19 nt, Homo sapiens
cgagggcaccugugacgau

SEQ ID NO: 571833 - RNA, 19 nt, Homo sapiens
cacggccacugcacuaaca

SEQ ID NO: 571834 - RNA, 19 nt, Homo sapiens
gaacauaucuugccucaug

SEQ ID NO: 571835 - RNA, 19 nt, Homo sapiens
ccagaucgcuacuauauua

SEQ ID NO: 571836 - RNA, 19 nt, Homo sapiens
ggaagaagcugaagaugag

SEQ ID NO: 571837 - RNA, 19 nt, Homo sapiens
ggacagaaauaagaugaaa

SEQ ID NO: 571838 - RNA, 19 nt, Homo sapiens
aaacaaacccugaaaugua

SEQ ID NO: 571839 - RNA, 19 nt, Homo sapiens
gaaagugguugccauaaag

SEQ ID NO: 571840 - RNA, 19 nt, Homo sapiens
gaaggaaacuacaguaaac

SEQ ID NO: 571841 - RNA, 19 nt, Homo sapiens
ggagagugcuuucguuugu

SEQ ID NO: 571842 - RNA, 19 nt, Homo sapiens
ccaagaaucucgagaaugg

SEQ ID NO: 571843 - RNA, 19 nt, Homo sapiens
gccauaaacuugagucuau

SEQ ID NO: 571844 - RNA, 19 nt, Homo sapiens
cauaacagcuauugaacuu

SEQ ID NO: 571845 - RNA, 19 nt, Homo sapiens
guccauauguaaccaaaua

SEQ ID NO: 571846 - RNA, 19 nt, Homo sapiens
guggaggccuguuugaaua

SEQ ID NO: 571847 - RNA, 19 nt, Homo sapiens
ggaaggaaacuacaguaaa

SEQ ID NO: 571848 - RNA, 19 nt, Homo sapiens
ugaaaggacucgauuaucu

SEQ ID NO: 571849 - RNA, 19 nt, Homo sapiens
ggacuggccuugaauaaaa

SEQ ID NO: 571850 - RNA, 19 nt, Homo sapiens
gggagaaacuggagcaugu

SEQ ID NO: 571851 - RNA, 19 nt, Homo sapiens
uuacagaacacuccuauuu

SEQ ID NO: 571852 - RNA, 19 nt, Homo sapiens
gaaccuggcccauuagaug

SEQ ID NO: 571853 - RNA, 19 nt, Homo sapiens
ggagggagcacgaaccuaa

SEQ ID NO: 571854 - RNA, 19 nt, Homo sapiens
uaacgucaguggaguaaau

SEQ ID NO: 571855 - RNA, 19 nt, Homo sapiens
cauaaggaaucacugugua

SEQ ID NO: 571856 - RNA, 19 nt, Homo sapiens
gagaaucgcucugguggau

SEQ ID NO: 571857 - RNA, 19 nt, Homo sapiens
auuagaaccuggcccauua

SEQ ID NO: 571858 - RNA, 19 nt, Homo sapiens
ugaauucugugaccaguga

SEQ ID NO: 571859 - RNA, 19 nt, Homo sapiens
ugaaagacaucccaaagag

SEQ ID NO: 571860 - RNA, 19 nt, Homo sapiens
agaaagugguugccauaaa

SEQ ID NO: 571861 - RNA, 19 nt, Homo sapiens
gaagcgcucucgucugaca

SEQ ID NO: 571862 - RNA, 19 nt, Homo sapiens
aaagaaaacuuccuacuug

SEQ ID NO: 571863 - RNA, 19 nt, Homo sapiens
guggauggguguacagauu

SEQ ID NO: 571864 - RNA, 19 nt, Homo sapiens
gggcauaacagcuauugaa

SEQ ID NO: 571865 - RNA, 19 nt, Homo sapiens
acagaacacuccuauuugu

SEQ ID NO: 571866 - RNA, 19 nt, Homo sapiens
uaaggcaacuaaagacaug

SEQ ID NO: 571867 - RNA, 19 nt, Homo sapiens
uaagagaaauacugaaagg

SEQ ID NO: 571868 - RNA, 19 nt, Homo sapiens
gaucgcuacuauauuaaga

SEQ ID NO: 571869 - RNA, 19 nt, Homo sapiens
aaacccagaucgcuacuau

SEQ ID NO: 571870 - RNA, 19 nt, Homo sapiens
uagaggacauucaacaaga

SEQ ID NO: 571871 - RNA, 19 nt, Homo sapiens
caggguuugucauuaauaa

SEQ ID NO: 571872 - RNA, 19 nt, Homo sapiens
gccaagugcuucuguagau

SEQ ID NO: 571873 - RNA, 19 nt, Homo sapiens
uauuauggauccuaucuga

SEQ ID NO: 571874 - RNA, 19 nt, Homo sapiens
aacaaacccugaaauguau

SEQ ID NO: 571875 - RNA, 19 nt, Homo sapiens
caucggacuuggacagaaa

SEQ ID NO: 571876 - RNA, 19 nt, Homo sapiens
ccaagugcuucuguagaua

SEQ ID NO: 571877 - RNA, 19 nt, Homo sapiens
gaagcacaaguuuauacua

SEQ ID NO: 571878 - RNA, 19 nt, Homo sapiens
uaucaucuuucccaccuaa

SEQ ID NO: 571879 - RNA, 19 nt, Homo sapiens
ucaaacagucggccuauga

SEQ ID NO: 571880 - RNA, 19 nt, Homo sapiens
gcucucgucugacauuugu

SEQ ID NO: 571881 - RNA, 19 nt, Homo sapiens
ucuauugccuugccuuuau

SEQ ID NO: 571882 - RNA, 19 nt, Homo sapiens
acaauuauuucuccucugu

SEQ ID NO: 571883 - RNA, 19 nt, Homo sapiens
uguaguggauucugcauau

SEQ ID NO: 571884 - RNA, 19 nt, Homo sapiens
ggauggguguacagauuug

SEQ ID NO: 571885 - RNA, 19 nt, Homo sapiens
uaaccauagugcacauauu

SEQ ID NO: 571886 - RNA, 19 nt, Homo sapiens
cagaugaagucucucagau

SEQ ID NO: 571887 - RNA, 19 nt, Homo sapiens
cugaaugcuuacacaaaua

SEQ ID NO: 571888 - RNA, 19 nt, Homo sapiens
ccaauacgauuuucuguug

SEQ ID NO: 571889 - RNA, 19 nt, Homo sapiens
cgacaggccauaaacuuga

SEQ ID NO: 571890 - RNA, 19 nt, Homo sapiens
caagugcuucuguagauaa

SEQ ID NO: 571891 - RNA, 19 nt, Homo sapiens
gggacuggaucuucacaau

SEQ ID NO: 571892 - RNA, 19 nt, Homo sapiens
gauguaccguccuuuccaa

SEQ ID NO: 571893 - RNA, 19 nt, Homo sapiens
augaagcgcucucgucuga

SEQ ID NO: 571894 - RNA, 19 nt, Homo sapiens
uugcaggguuugucauuaa

SEQ ID NO: 571895 - RNA, 19 nt, Homo sapiens
gcagccagaugaagucucu

SEQ ID NO: 571896 - RNA, 19 nt, Homo sapiens
ccaacguccugcugucuga

SEQ ID NO: 571897 - RNA, 19 nt, Homo sapiens
gauagaggacauucaacaa

SEQ ID NO: 571898 - RNA, 19 nt, Homo sapiens
ucagaaagugguugccaua

SEQ ID NO: 571899 - RNA, 19 nt, Homo sapiens
gauucugcauaucaucuuu

SEQ ID NO: 571900 - RNA, 19 nt, Homo sapiens
guaccguccuuuccaauac

SEQ ID NO: 571901 - RNA, 19 nt, Homo sapiens
ucgaugguacuauuucuua

SEQ ID NO: 571902 - RNA, 19 nt, Homo sapiens
uuucaucgaugguacuauu

SEQ ID NO: 571903 - RNA, 19 nt, Homo sapiens
gauaacgucaguggaguaa

SEQ ID NO: 571904 - RNA, 19 nt, Homo sapiens
agagugcuuucguuuguuu

SEQ ID NO: 571905 - RNA, 19 nt, Homo sapiens
ggacucgauuaucuccauu

SEQ ID NO: 571906 - RNA, 19 nt, Homo sapiens
ucugaaugcuuacacaaau

SEQ ID NO: 571907 - RNA, 19 nt, Homo sapiens
gcaggguuugucauuaaua

SEQ ID NO: 571908 - RNA, 19 nt, Homo sapiens
gaaucacuguguacaaacu

SEQ ID NO: 571909 - RNA, 19 nt, Homo sapiens
gaauaaggagccgagcuuu

SEQ ID NO: 571910 - RNA, 19 nt, Homo sapiens
ggacauucaacaagaaauc

SEQ ID NO: 571911 - RNA, 19 nt, Homo sapiens
aggaaucacuguguacaaa

SEQ ID NO: 571912 - RNA, 19 nt, Homo sapiens
ggacuuggacagaaauaag

SEQ ID NO: 571913 - RNA, 19 nt, Homo sapiens
cuaaggaguuauugaagca

SEQ ID NO: 571914 - RNA, 19 nt, Homo sapiens
gaaaggacucgauuaucuc

SEQ ID NO: 571915 - RNA, 19 nt, Homo sapiens
gcuccgcacuagaucuauu

SEQ ID NO: 571916 - RNA, 19 nt, Homo sapiens
cagaacacuccuauuugua

SEQ ID NO: 571917 - RNA, 19 nt, Homo sapiens
uguacaaacuggccaagug

SEQ ID NO: 571918 - RNA, 19 nt, Homo sapiens
gcauaaggaaucacugugu

SEQ ID NO: 571919 - RNA, 19 nt, Homo sapiens
ugcagcggcuccagagaua

SEQ ID NO: 571920 - RNA, 19 nt, Homo sapiens
uugcagaguugaaggagaa

SEQ ID NO: 571921 - RNA, 19 nt, Homo sapiens
gccuuucucucaguguuua

SEQ ID NO: 571922 - RNA, 19 nt, Homo sapiens
aauaaggagccgagcuuua

SEQ ID NO: 571923 - RNA, 19 nt, Homo sapiens
ccauaaacuugagucuauu

SEQ ID NO: 571924 - RNA, 19 nt, Homo sapiens
ugacagacacccagaucaa

SEQ ID NO: 571925 - RNA, 19 nt, Homo sapiens
uggaagaagcugaagauga

SEQ ID NO: 571926 - RNA, 19 nt, Homo sapiens
ccucaugaagcuuuaaauu

SEQ ID NO: 571927 - RNA, 19 nt, Homo sapiens
gagagugcuuucguuuguu

SEQ ID NO: 571928 - RNA, 19 nt, Homo sapiens
aagcacaaguuuauacuac

SEQ ID NO: 571929 - RNA, 19 nt, Homo sapiens
cacccgaggucaucaaaca

SEQ ID NO: 571930 - RNA, 19 nt, Homo sapiens
gaaaauccacagagacauu

SEQ ID NO: 571931 - RNA, 19 nt, Homo sapiens
ugagauagaggacauucaa

SEQ ID NO: 571932 - RNA, 19 nt, Homo sapiens
gauaaggcaacuaaagaca

SEQ ID NO: 571933 - RNA, 19 nt, Homo sapiens
guaaaccccucaaggaguu

SEQ ID NO: 571934 - RNA, 19 nt, Homo sapiens
ggaugagaaugaaagcuua

SEQ ID NO: 571935 - RNA, 19 nt, Homo sapiens
gaauaugccugccugaaag

SEQ ID NO: 571936 - RNA, 19 nt, Homo sapiens
ggaauaugccugccugaaa

SEQ ID NO: 571937 - RNA, 19 nt, Homo sapiens
ugacaucgcuggccuucuu

SEQ ID NO: 571938 - RNA, 19 nt, Homo sapiens
gggcaagccuguauagaca

SEQ ID NO: 571939 - RNA, 19 nt, Homo sapiens
gaaagggaccauccucuuc

SEQ ID NO: 571940 - RNA, 19 nt, Homo sapiens
gacagcacuuggcuccuua

SEQ ID NO: 571941 - RNA, 19 nt, Homo sapiens
ccaagaugcugugaccuuu

SEQ ID NO: 571942 - RNA, 19 nt, Homo sapiens
aggaacagcucuucacuca

SEQ ID NO: 571943 - RNA, 19 nt, Homo sapiens
gcagaucccuaaccaugag

SEQ ID NO: 571944 - RNA, 19 nt, Homo sapiens
gagagcagaucccuaacca

SEQ ID NO: 571945 - RNA, 19 nt, Homo sapiens
cguagccgcugccuaugua

SEQ ID NO: 571946 - RNA, 19 nt, Homo sapiens
ccuaucgacuuuauacaga

SEQ ID NO: 571947 - RNA, 19 nt, Homo sapiens
caagccgccucccacauug

SEQ ID NO: 571948 - RNA, 19 nt, Homo sapiens
ccaagccgccucccacauu

SEQ ID NO: 571949 - RNA, 19 nt, Homo sapiens
aagaugcugugaccuuuga

SEQ ID NO: 571950 - RNA, 19 nt, Homo sapiens
gggaugagaaugaaagcuu

SEQ ID NO: 571951 - RNA, 19 nt, Homo sapiens
cauuggacuuccuugguuu

SEQ ID NO: 571952 - RNA, 19 nt, Homo sapiens
acauuggacuuccuugguu

SEQ ID NO: 571953 - RNA, 19 nt, Homo sapiens
agacagcacuuggcuccuu

SEQ ID NO: 571954 - RNA, 19 nt, Homo sapiens
agacuccugucccuucuug

SEQ ID NO: 571955 - RNA, 19 nt, Homo sapiens
ccagcauacucaagaagau

SEQ ID NO: 571956 - RNA, 19 nt, Homo sapiens
agugagagcagaucccuaa

SEQ ID NO: 571957 - RNA, 19 nt, Homo sapiens
gcggugcaguggcuucaau

SEQ ID NO: 571958 - RNA, 19 nt, Homo sapiens
ugaaagggaccauccucuu

SEQ ID NO: 571959 - RNA, 19 nt, Homo sapiens
caagacuccugucccuucu

SEQ ID NO: 571960 - RNA, 19 nt, Homo sapiens
gagcuuagccccaaggaau

SEQ ID NO: 571961 - RNA, 19 nt, Homo sapiens
cuaucgacuuuauacagaa

SEQ ID NO: 571962 - RNA, 19 nt, Homo sapiens
aaagggaccauccucuuca

SEQ ID NO: 571963 - RNA, 19 nt, Homo sapiens
caagaugcugugaccuuug

SEQ ID NO: 571964 - RNA, 19 nt, Homo sapiens
gccauucucuacgcacuuc

SEQ ID NO: 571965 - RNA, 19 nt, Homo sapiens
cgggaggccuuggauguuc

SEQ ID NO: 571966 - RNA, 19 nt, Homo sapiens
cagcauacucaagaagauu

SEQ ID NO: 571967 - RNA, 19 nt, Homo sapiens
gugcccagcauacucaaga

SEQ ID NO: 571968 - RNA, 19 nt, Homo sapiens
gaugagaaugaaagcuuag

SEQ ID NO: 571969 - RNA, 19 nt, Homo sapiens
ccagcuaugugcaccucau

SEQ ID NO: 571970 - RNA, 19 nt, Homo sapiens
gaggcuggcagugcugauu

SEQ ID NO: 571971 - RNA, 19 nt, Homo sapiens
gcuacaaguuccuuaaaga

SEQ ID NO: 571972 - RNA, 19 nt, Homo sapiens
acaaguuccuuaaagacaa

SEQ ID NO: 571973 - RNA, 19 nt, Homo sapiens
caaguuccuuaaagacaag

SEQ ID NO: 571974 - RNA, 19 nt, Homo sapiens
guucuuggguacguucaau

SEQ ID NO: 571975 - RNA, 19 nt, Homo sapiens
ucuuggguacguucaauaa

SEQ ID NO: 571976 - RNA, 19 nt, Homo sapiens
ccgcuacaaguuccuuaaa

SEQ ID NO: 571977 - RNA, 19 nt, Homo sapiens
gaaaugagaugaccacuuu

SEQ ID NO: 571978 - RNA, 19 nt, Homo sapiens
gaagugacauugcaucaaa

SEQ ID NO: 571979 - RNA, 19 nt, Homo sapiens
caagacagcucgcguguga

SEQ ID NO: 571980 - RNA, 19 nt, Homo sapiens
ccacacagcugaaaguauu

SEQ ID NO: 571981 - RNA, 19 nt, Homo sapiens
gcaaacacuucaacaugua

SEQ ID NO: 571982 - RNA, 19 nt, Homo sapiens
gaaaugggcucgguuuguu

SEQ ID NO: 571983 - RNA, 19 nt, Homo sapiens
ggaaguugguuguuauaaa

SEQ ID NO: 571984 - RNA, 19 nt, Homo sapiens
caaagcaucuugcauuaug

SEQ ID NO: 571985 - RNA, 19 nt, Homo sapiens
gaacauccuuuaguauuga

SEQ ID NO: 571986 - RNA, 19 nt, Homo sapiens
guagaaaccuuacuuacug

SEQ ID NO: 571987 - RNA, 19 nt, Homo sapiens
ccacugccauuaaagaaua

SEQ ID NO: 571988 - RNA, 19 nt, Homo sapiens
ggaacauccuuuaguauug

SEQ ID NO: 571989 - RNA, 19 nt, Homo sapiens
aaagcaagcugauuaaaug

SEQ ID NO: 571990 - RNA, 19 nt, Homo sapiens
guagaccacugccauauga

SEQ ID NO: 571991 - RNA, 19 nt, Homo sapiens
gcacaugaaacuuagauuu

SEQ ID NO: 571992 - RNA, 19 nt, Homo sapiens
gaagagccacugccauuaa

SEQ ID NO: 571993 - RNA, 19 nt, Homo sapiens
gaucaugcaugucaaagga

SEQ ID NO: 571994 - RNA, 19 nt, Homo sapiens
caauauaccuguucuugau

SEQ ID NO: 571995 - RNA, 19 nt, Homo sapiens
guagggaacucugcacuaa

SEQ ID NO: 571996 - RNA, 19 nt, Homo sapiens
gaacccaacggauaguuua

SEQ ID NO: 571997 - RNA, 19 nt, Homo sapiens
ccagaagucuuguauuguu

SEQ ID NO: 571998 - RNA, 19 nt, Homo sapiens
gcaagaguuugaucgcuuu

SEQ ID NO: 571999 - RNA, 19 nt, Homo sapiens
gcugggauguuaagaguuu

SEQ ID NO: 572000 - RNA, 19 nt, Homo sapiens
cauggaacauccuuuagua

SEQ ID NO: 572001 - RNA, 19 nt, Homo sapiens
gauuaaaccuugucauagu

SEQ ID NO: 572002 - RNA, 19 nt, Homo sapiens
ugacagagcugaagaccau

SEQ ID NO: 572003 - RNA, 19 nt, Homo sapiens
gcaauauacuggaaagcuu

SEQ ID NO: 572004 - RNA, 19 nt, Homo sapiens
caacggauaguuuauauug

SEQ ID NO: 572005 - RNA, 19 nt, Homo sapiens
ucacaaacuucauuucaga

SEQ ID NO: 572006 - RNA, 19 nt, Homo sapiens
gcacaugucaccucuauuc

SEQ ID NO: 572007 - RNA, 19 nt, Homo sapiens
gaacucugcacuaaacuuu

SEQ ID NO: 572008 - RNA, 19 nt, Homo sapiens
caaaguggacucuuagaaa

SEQ ID NO: 572009 - RNA, 19 nt, Homo sapiens
gaaagauaauucacuguac

SEQ ID NO: 572010 - RNA, 19 nt, Homo sapiens
gaagaauuguauaccuuug

SEQ ID NO: 572011 - RNA, 19 nt, Homo sapiens
gaaaggaagcauaaagaug

SEQ ID NO: 572012 - RNA, 19 nt, Homo sapiens
guagauaaguguucugucu

SEQ ID NO: 572013 - RNA, 19 nt, Homo sapiens
caacuacuguguuaugcaa

SEQ ID NO: 572014 - RNA, 19 nt, Homo sapiens
guauagaccuccagaaguc

SEQ ID NO: 572015 - RNA, 19 nt, Homo sapiens
gggcuaaauugcauuguug

SEQ ID NO: 572016 - RNA, 19 nt, Homo sapiens
caaaagcucugcagauuga

SEQ ID NO: 572017 - RNA, 19 nt, Homo sapiens
cagauuaaaccuugucaua

SEQ ID NO: 572018 - RNA, 19 nt, Homo sapiens
gagaaaggaagcauaaaga

SEQ ID NO: 572019 - RNA, 19 nt, Homo sapiens
aaacggaaauggagauugu

SEQ ID NO: 572020 - RNA, 19 nt, Homo sapiens
agacaaugguugaaauuug

SEQ ID NO: 572021 - RNA, 19 nt, Homo sapiens
caucaaagcaucuugcauu

SEQ ID NO: 572022 - RNA, 19 nt, Homo sapiens
ggagaucccugucuuccau

SEQ ID NO: 572023 - RNA, 19 nt, Homo sapiens
ccaaugagcucugugaagu

SEQ ID NO: 572024 - RNA, 19 nt, Homo sapiens
gcacuuaaagcuuucagaa

SEQ ID NO: 572025 - RNA, 19 nt, Homo sapiens
guauggaaaugcacuguau

SEQ ID NO: 572026 - RNA, 19 nt, Homo sapiens
uaaagaagcagagaagauu

SEQ ID NO: 572027 - RNA, 19 nt, Homo sapiens
ccagagauguggaaagcaa

SEQ ID NO: 572028 - RNA, 19 nt, Homo sapiens
caauaacaguucuggaaau

SEQ ID NO: 572029 - RNA, 19 nt, Homo sapiens
acaacaaucucugcacuuu

SEQ ID NO: 572030 - RNA, 19 nt, Homo sapiens
gcucacuggucacggauuu

SEQ ID NO: 572031 - RNA, 19 nt, Homo sapiens
gguccaagauccuguuugu

SEQ ID NO: 572032 - RNA, 19 nt, Homo sapiens
uggacaaaguggacucuua

SEQ ID NO: 572033 - RNA, 19 nt, Homo sapiens
ugaaugacaugaaguugug

SEQ ID NO: 572034 - RNA, 19 nt, Homo sapiens
gcaagcaggcaucuucaaa

SEQ ID NO: 572035 - RNA, 19 nt, Homo sapiens
gcaagagaauccugauguc

SEQ ID NO: 572036 - RNA, 19 nt, Homo sapiens
caaaaugccugcaagagaa

SEQ ID NO: 572037 - RNA, 19 nt, Homo sapiens
gcaagcugauuaaaugaca

SEQ ID NO: 572038 - RNA, 19 nt, Homo sapiens
gcauuguguuguaaucauu

SEQ ID NO: 572039 - RNA, 19 nt, Homo sapiens
ugauguaugugaacagauu

SEQ ID NO: 572040 - RNA, 19 nt, Homo sapiens
guaugcauguugucuaaga

SEQ ID NO: 572041 - RNA, 19 nt, Homo sapiens
caacaaucucugcacuuua

SEQ ID NO: 572042 - RNA, 19 nt, Homo sapiens
gagcacaguucagaagaug

SEQ ID NO: 572043 - RNA, 19 nt, Homo sapiens
gaacaaauucccugaagac

SEQ ID NO: 572044 - RNA, 19 nt, Homo sapiens
ccaaaugugccgugaugua

SEQ ID NO: 572045 - RNA, 19 nt, Homo sapiens
gacaaugguugaaauuugg

SEQ ID NO: 572046 - RNA, 19 nt, Homo sapiens
gagaagauugagucccuua

SEQ ID NO: 572047 - RNA, 19 nt, Homo sapiens
uaacaguucuggaaauacu

SEQ ID NO: 572048 - RNA, 19 nt, Homo sapiens
aacaaucucugcacuuuau

SEQ ID NO: 572049 - RNA, 19 nt, Homo sapiens
gaguuuggaucaugcaugu

SEQ ID NO: 572050 - RNA, 19 nt, Homo sapiens
ggacaaaguggacucuuag

SEQ ID NO: 572051 - RNA, 19 nt, Homo sapiens
gcgggugcauuguguugua

SEQ ID NO: 572052 - RNA, 19 nt, Homo sapiens
gaacagauuuucuccucaa

SEQ ID NO: 572053 - RNA, 19 nt, Homo sapiens
cuccagaagucuuguauug

SEQ ID NO: 572054 - RNA, 19 nt, Homo sapiens
uagguaacauuguagaaga

SEQ ID NO: 572055 - RNA, 19 nt, Homo sapiens
ggagaaaggaagcauaaag

SEQ ID NO: 572056 - RNA, 19 nt, Homo sapiens
gaucaaggagccaugaaug

SEQ ID NO: 572057 - RNA, 19 nt, Homo sapiens
acacagaguuggcaagagu

SEQ ID NO: 572058 - RNA, 19 nt, Homo sapiens
uagcaugcuuguugcaauu

SEQ ID NO: 572059 - RNA, 19 nt, Homo sapiens
gauguaauacuucuugugu

SEQ ID NO: 572060 - RNA, 19 nt, Homo sapiens
gaaagggagaagugacauu

SEQ ID NO: 572061 - RNA, 19 nt, Homo sapiens
ggacugcugguuuguaguu

SEQ ID NO: 572062 - RNA, 19 nt, Homo sapiens
gcaauaaagaagcagagaa

SEQ ID NO: 572063 - RNA, 19 nt, Homo sapiens
ugucaaaggauccauguaa

SEQ ID NO: 572064 - RNA, 19 nt, Homo sapiens
aaugagcucugugaaguaa

SEQ ID NO: 572065 - RNA, 19 nt, Homo sapiens
guggagaccagaacaaauu

SEQ ID NO: 572066 - RNA, 19 nt, Homo sapiens
aaugggcacuuaaagcuuu

SEQ ID NO: 572067 - RNA, 19 nt, Homo sapiens
gugucaagcugaguauuaa

SEQ ID NO: 572068 - RNA, 19 nt, Homo sapiens
uuacauuuccucaccauaa

SEQ ID NO: 572069 - RNA, 19 nt, Homo sapiens
cuuguucacugcagauuaa

SEQ ID NO: 572070 - RNA, 19 nt, Homo sapiens
ccgggaaccuugccaguug

SEQ ID NO: 572071 - RNA, 19 nt, Homo sapiens
agaauacugucaagccauu

SEQ ID NO: 572072 - RNA, 19 nt, Homo sapiens
gagacaaugguugaaauuu

SEQ ID NO: 572073 - RNA, 19 nt, Homo sapiens
auauguacccucugaaaua

SEQ ID NO: 572074 - RNA, 19 nt, Homo sapiens
gcugcuacuuauauaauug

SEQ ID NO: 572075 - RNA, 19 nt, Homo sapiens
gugaagagccacugccauu

SEQ ID NO: 572076 - RNA, 19 nt, Homo sapiens
gccauaugauuuacauuuc

SEQ ID NO: 572077 - RNA, 19 nt, Homo sapiens
ggaauuauguggccaagaa

SEQ ID NO: 572078 - RNA, 19 nt, Homo sapiens
caaguucucugccugcaaa

SEQ ID NO: 572079 - RNA, 19 nt, Homo sapiens
caacguccuucuccaacua

SEQ ID NO: 572080 - RNA, 19 nt, Homo sapiens
ugauggaggugcagcauuu

SEQ ID NO: 572081 - RNA, 19 nt, Homo sapiens
guucaucgcuggccugugu

SEQ ID NO: 572082 - RNA, 19 nt, Homo sapiens
ggaacguggugguccauga

SEQ ID NO: 572083 - RNA, 19 nt, Homo sapiens
guggguaacugaucacaga

SEQ ID NO: 572084 - RNA, 19 nt, Homo sapiens
ggacugagaucugcagacu

SEQ ID NO: 572085 - RNA, 19 nt, Homo sapiens
gaaaaggguuugguucuug

SEQ ID NO: 572086 - RNA, 19 nt, Homo sapiens
acugagaucugcagacuug

SEQ ID NO: 572087 - RNA, 19 nt, Homo sapiens
ggguuugguucuugacuuu

SEQ ID NO: 572088 - RNA, 19 nt, Homo sapiens
gaggcaaccugcacacaag

SEQ ID NO: 572089 - RNA, 19 nt, Homo sapiens
gggaggcuauacaauccua

SEQ ID NO: 572090 - RNA, 19 nt, Homo sapiens
uaugucagguggaauuaug

SEQ ID NO: 572091 - RNA, 19 nt, Homo sapiens
ggagauggaaacacugaga

SEQ ID NO: 572092 - RNA, 19 nt, Homo sapiens
gcccagacaccaccaaguu

SEQ ID NO: 572093 - RNA, 19 nt, Homo sapiens
guucuucuaucccgucaug

SEQ ID NO: 572094 - RNA, 19 nt, Homo sapiens
gcccaacacucaucuacag

SEQ ID NO: 572095 - RNA, 19 nt, Homo sapiens
gcauggaacgugcugaugu

SEQ ID NO: 572096 - RNA, 19 nt, Homo sapiens
cugauacucuuccuuguca

SEQ ID NO: 572097 - RNA, 19 nt, Homo sapiens
ggaaaaggguuugguucuu

SEQ ID NO: 572098 - RNA, 19 nt, Homo sapiens
caacgccuuugccgagaug

SEQ ID NO: 572099 - RNA, 19 nt, Homo sapiens
ccucuguguuccugucuuu

SEQ ID NO: 572100 - RNA, 19 nt, Homo sapiens
cauggaacgugcugaugug

SEQ ID NO: 572101 - RNA, 19 nt, Homo sapiens
gcaguggcccaugaguaua

SEQ ID NO: 572102 - RNA, 19 nt, Homo sapiens
ugaccagggugacucuuca

SEQ ID NO: 572103 - RNA, 19 nt, Homo sapiens
gacgcuaccugcccagaca

SEQ ID NO: 572104 - RNA, 19 nt, Homo sapiens
gccgagaugcuacgauuug

SEQ ID NO: 572105 - RNA, 19 nt, Homo sapiens
uauacaauccuacccauca

SEQ ID NO: 572106 - RNA, 19 nt, Homo sapiens
ccaauacagcaauaaacuu

SEQ ID NO: 572107 - RNA, 19 nt, Homo sapiens
gauacucuuccuugucauu

SEQ ID NO: 572108 - RNA, 19 nt, Homo sapiens
gaaugugcaaggacugaga

SEQ ID NO: 572109 - RNA, 19 nt, Homo sapiens
gauguggaccaugcuguuu

SEQ ID NO: 572110 - RNA, 19 nt, Homo sapiens
ggaguuugaccuacugauc

SEQ ID NO: 572111 - RNA, 19 nt, Homo sapiens
gacuuuguauuccuuccaa

SEQ ID NO: 572112 - RNA, 19 nt, Homo sapiens
cgaucuugguccugccaua

SEQ ID NO: 572113 - RNA, 19 nt, Homo sapiens
guccaugacuggcuguaca

SEQ ID NO: 572114 - RNA, 19 nt, Homo sapiens
ucugcagacuuguggguaa

SEQ ID NO: 572115 - RNA, 19 nt, Homo sapiens
acaauggacccgacacaug

SEQ ID NO: 572116 - RNA, 19 nt, Homo sapiens
gcucuaugccugcuucauc

SEQ ID NO: 572117 - RNA, 19 nt, Homo sapiens
gcuacuccuuccugagaga

SEQ ID NO: 572118 - RNA, 19 nt, Homo sapiens
ucaucuacagggagacuua

SEQ ID NO: 572119 - RNA, 19 nt, Homo sapiens
ugggguaccuuauggauuu

SEQ ID NO: 572120 - RNA, 19 nt, Homo sapiens
gcgggaggcuauacaaucc

SEQ ID NO: 572121 - RNA, 19 nt, Homo sapiens
ggccaucgacuucauugau

SEQ ID NO: 572122 - RNA, 19 nt, Homo sapiens
uugccgagaugcuacgauu

SEQ ID NO: 572123 - RNA, 19 nt, Homo sapiens
ccuuauggauuugaugaau

SEQ ID NO: 572124 - RNA, 19 nt, Homo sapiens
cgaggcaaccugcacacaa

SEQ ID NO: 572125 - RNA, 19 nt, Homo sapiens
cuacccaucacaagacaaa

SEQ ID NO: 572126 - RNA, 19 nt, Homo sapiens
ggagcaagcgcagggacaa

SEQ ID NO: 572127 - RNA, 19 nt, Homo sapiens
cuuauggauuugaugaaug

SEQ ID NO: 572128 - RNA, 19 nt, Homo sapiens
cagggugacucuucaaucc

SEQ ID NO: 572129 - RNA, 19 nt, Homo sapiens
gcgccaacccuguggagau

SEQ ID NO: 572130 - RNA, 19 nt, Homo sapiens
guacaauggacccgacaca

SEQ ID NO: 572131 - RNA, 19 nt, Homo sapiens
augaguauaucuucugcuu

SEQ ID NO: 572132 - RNA, 19 nt, Homo sapiens
cgcaguggcccaugaguau

SEQ ID NO: 572133 - RNA, 19 nt, Homo sapiens
ccgcaguggcccaugagua

SEQ ID NO: 572134 - RNA, 19 nt, Homo sapiens
ccugggaugugugcucuau

SEQ ID NO: 572135 - RNA, 19 nt, Homo sapiens
aagcuacuccuuccugaga

SEQ ID NO: 572136 - RNA, 19 nt, Homo sapiens
gaguuugaccuacugaucu

SEQ ID NO: 572137 - RNA, 19 nt, Homo sapiens
gcuggaguuugaccuacug

SEQ ID NO: 572138 - RNA, 19 nt, Homo sapiens
guuugguucuugacuuugu

SEQ ID NO: 572139 - RNA, 19 nt, Homo sapiens
gcagacuuguggguaacug

SEQ ID NO: 572140 - RNA, 19 nt, Homo sapiens
uuggaggaauguugaacuu

SEQ ID NO: 572141 - RNA, 19 nt, Homo sapiens
gcccaugaguauaucuucu

SEQ ID NO: 572142 - RNA, 19 nt, Homo sapiens
caccaucuaccacauguuc

SEQ ID NO: 572143 - RNA, 19 nt, Homo sapiens
cgccaacccuguggagaug

SEQ ID NO: 572144 - RNA, 19 nt, Homo sapiens
ccaacccuguggagaugga

SEQ ID NO: 572145 - RNA, 19 nt, Homo sapiens
ggcugcugcuggaguuuga

SEQ ID NO: 572146 - RNA, 19 nt, Homo sapiens
guggagauggaaacacuga

SEQ ID NO: 572147 - RNA, 19 nt, Homo sapiens
gugcaaggacugagaucug

SEQ ID NO: 572148 - RNA, 19 nt, Homo sapiens
ccagcuaccucuacuuccu

SEQ ID NO: 572149 - RNA, 19 nt, Homo sapiens
gaacguggugguccaugac

SEQ ID NO: 572150 - RNA, 19 nt, Homo sapiens
cugugugucuucaucauca

SEQ ID NO: 572151 - RNA, 19 nt, Homo sapiens
gcugauacucuuccuuguc

SEQ ID NO: 572152 - RNA, 19 nt, Homo sapiens
caagcgcagggacaacuga

SEQ ID NO: 572153 - RNA, 19 nt, Homo sapiens
ucaugcugcugcucaucuu

SEQ ID NO: 572154 - RNA, 19 nt, Homo sapiens
guuccugucuuugccaaca

SEQ ID NO: 572155 - RNA, 19 nt, Homo sapiens
uaaacuuugucucccuuuu

SEQ ID NO: 572156 - RNA, 19 nt, Homo sapiens
gaacuggggccaccaaggu

SEQ ID NO: 572157 - RNA, 19 nt, Homo sapiens
cccaaggaaugugcaagga

SEQ ID NO: 572158 - RNA, 19 nt, Homo sapiens
caguggcccaugaguauau

SEQ ID NO: 572159 - RNA, 19 nt, Homo sapiens
ucuccgcaguggcccauga

SEQ ID NO: 572160 - RNA, 19 nt, Homo sapiens
ucagcacccuggccaucga

SEQ ID NO: 572161 - RNA, 19 nt, Homo sapiens
gaaguaagauacguaguaa

SEQ ID NO: 572162 - RNA, 19 nt, Homo sapiens
ggaauaacaugucaucuuc

SEQ ID NO: 572163 - RNA, 19 nt, Homo sapiens
ucaccaagcucuccaagua

SEQ ID NO: 572164 - RNA, 19 nt, Homo sapiens
aaagucagcuaaugaagua

SEQ ID NO: 572165 - RNA, 19 nt, Homo sapiens
guucguauauccuggaaua

SEQ ID NO: 572166 - RNA, 19 nt, Homo sapiens
agaaaucucucacgucaaa

SEQ ID NO: 572167 - RNA, 19 nt, Homo sapiens
ggagagagaagauuaagaa

SEQ ID NO: 572168 - RNA, 19 nt, Homo sapiens
uccauaagcuugcugaaua

SEQ ID NO: 572169 - RNA, 19 nt, Homo sapiens
uagaaugucuccaagauug

SEQ ID NO: 572170 - RNA, 19 nt, Homo sapiens
gagaggagagagaagauua

SEQ ID NO: 572171 - RNA, 19 nt, Homo sapiens
gaaaguggauagccucaag

SEQ ID NO: 572172 - RNA, 19 nt, Homo sapiens
gagagaaacaggaaacaaa

SEQ ID NO: 572173 - RNA, 19 nt, Homo sapiens
gaugaucaguugguuguuu

SEQ ID NO: 572174 - RNA, 19 nt, Homo sapiens
ggaagacagugccgaggaa

SEQ ID NO: 572175 - RNA, 19 nt, Homo sapiens
gaccauauagucauaguaa

SEQ ID NO: 572176 - RNA, 19 nt, Homo sapiens
gugagcagaugccaaauga

SEQ ID NO: 572177 - RNA, 19 nt, Homo sapiens
ggagaaagccaugcagaaa

SEQ ID NO: 572178 - RNA, 19 nt, Homo sapiens
gcucuuagguucuaucucu

SEQ ID NO: 572179 - RNA, 19 nt, Homo sapiens
gcagugagcagaugccaaa

SEQ ID NO: 572180 - RNA, 19 nt, Homo sapiens
ugaagggcauccagaauga

SEQ ID NO: 572181 - RNA, 19 nt, Homo sapiens
uguaugugcuugaaaguaa

SEQ ID NO: 572182 - RNA, 19 nt, Homo sapiens
agaccaggcuuuaccauga

SEQ ID NO: 572183 - RNA, 19 nt, Homo sapiens
cgacuugacuauuguggaa

SEQ ID NO: 572184 - RNA, 19 nt, Homo sapiens
uaagauacguaguaaaguc

SEQ ID NO: 572185 - RNA, 19 nt, Homo sapiens
gcaguaaucauugaccaua

SEQ ID NO: 572186 - RNA, 19 nt, Homo sapiens
gauccagccugaagaaagu

SEQ ID NO: 572187 - RNA, 19 nt, Homo sapiens
uaaagaaguucguauaucc

SEQ ID NO: 572188 - RNA, 19 nt, Homo sapiens
ugaaguaagauacguagua

SEQ ID NO: 572189 - RNA, 19 nt, Homo sapiens
aaacaucuacgaaagguaa

SEQ ID NO: 572190 - RNA, 19 nt, Homo sapiens
aggaggagcuuccggauga

SEQ ID NO: 572191 - RNA, 19 nt, Homo sapiens
ucaaagagcgcauggauag

SEQ ID NO: 572192 - RNA, 19 nt, Homo sapiens
ugaagcggcuggagaacaa

SEQ ID NO: 572193 - RNA, 19 nt, Homo sapiens
gcaagcugcuggagaaguc

SEQ ID NO: 572194 - RNA, 19 nt, Homo sapiens
ucaguugguuguuuacuug

SEQ ID NO: 572195 - RNA, 19 nt, Homo sapiens
ggacuccacuuuuaauuug

SEQ ID NO: 572196 - RNA, 19 nt, Homo sapiens
ggacagcaacaucgacuug

SEQ ID NO: 572197 - RNA, 19 nt, Homo sapiens
caacaucgacuugacuauu

SEQ ID NO: 572198 - RNA, 19 nt, Homo sapiens
gaagaaaacaucuacgaaa

SEQ ID NO: 572199 - RNA, 19 nt, Homo sapiens
caccagaccuccugagcuu

SEQ ID NO: 572200 - RNA, 19 nt, Homo sapiens
gcacagaagguacgcuaug

SEQ ID NO: 572201 - RNA, 19 nt, Homo sapiens
gaacaaacucuugcacauc

SEQ ID NO: 572202 - RNA, 19 nt, Homo sapiens
ugacuauuguggaagauga

SEQ ID NO: 572203 - RNA, 19 nt, Homo sapiens
aaacaaaucccuggaggaa

SEQ ID NO: 572204 - RNA, 19 nt, Homo sapiens
cuaaagaaguucguauauc

SEQ ID NO: 572205 - RNA, 19 nt, Homo sapiens
uaagcuugcugaauagugu

SEQ ID NO: 572206 - RNA, 19 nt, Homo sapiens
gaccaggcuuuaccaugaa

SEQ ID NO: 572207 - RNA, 19 nt, Homo sapiens
guuguuuacuugcuagaaa

SEQ ID NO: 572208 - RNA, 19 nt, Homo sapiens
gaagaaaguagggcagaga

SEQ ID NO: 572209 - RNA, 19 nt, Homo sapiens
gagaugaucaguugguugu

SEQ ID NO: 572210 - RNA, 19 nt, Homo sapiens
ucuccaagauugaagaaga

SEQ ID NO: 572211 - RNA, 19 nt, Homo sapiens
ggaacaggcacagaaggua

SEQ ID NO: 572212 - RNA, 19 nt, Homo sapiens
ucaaagugcucaucuucca

SEQ ID NO: 572213 - RNA, 19 nt, Homo sapiens
gagcagcgacagaucaguu

SEQ ID NO: 572214 - RNA, 19 nt, Homo sapiens
gaaacaggaaacaaagaau

SEQ ID NO: 572215 - RNA, 19 nt, Homo sapiens
gagaaacaggaaacaaaga

SEQ ID NO: 572216 - RNA, 19 nt, Homo sapiens
cacagaagguacgcuauga

SEQ ID NO: 572217 - RNA, 19 nt, Homo sapiens
acaaaucccuggaggaaac

SEQ ID NO: 572218 - RNA, 19 nt, Homo sapiens
agaaugaccucaccaagcu

SEQ ID NO: 572219 - RNA, 19 nt, Homo sapiens
cgaaaagaaugaaaacaga

SEQ ID NO: 572220 - RNA, 19 nt, Homo sapiens
cagcuaaugaaguaagaua

SEQ ID NO: 572221 - RNA, 19 nt, Homo sapiens
gaauaguguaccgguaaua

SEQ ID NO: 572222 - RNA, 19 nt, Homo sapiens
gaugccaaaugaccaggaa

SEQ ID NO: 572223 - RNA, 19 nt, Homo sapiens
ccauaagcuugcugaauag

SEQ ID NO: 572224 - RNA, 19 nt, Homo sapiens
uguagaaugucuccaagau

SEQ ID NO: 572225 - RNA, 19 nt, Homo sapiens
ccauauagucauaguaaga

SEQ ID NO: 572226 - RNA, 19 nt, Homo sapiens
agaacaaacucuugcacau

SEQ ID NO: 572227 - RNA, 19 nt, Homo sapiens
aacaucgacuugacuauug

SEQ ID NO: 572228 - RNA, 19 nt, Homo sapiens
guggauagccucaagaaag

SEQ ID NO: 572229 - RNA, 19 nt, Homo sapiens
guaugugcuugaaaguaaa

SEQ ID NO: 572230 - RNA, 19 nt, Homo sapiens
aaauguaugugcuugaaag

SEQ ID NO: 572231 - RNA, 19 nt, Homo sapiens
gggagaaagccaugcagaa

SEQ ID NO: 572232 - RNA, 19 nt, Homo sapiens
cguauauccuggaauaaca

SEQ ID NO: 572233 - RNA, 19 nt, Homo sapiens
guaccgguaauauauugua

SEQ ID NO: 572234 - RNA, 19 nt, Homo sapiens
guagaaugucuccaagauu

SEQ ID NO: 572235 - RNA, 19 nt, Homo sapiens
ggagaaccagcacaagaug

SEQ ID NO: 572236 - RNA, 19 nt, Homo sapiens
cagaggaggcugcugagaa

SEQ ID NO: 572237 - RNA, 19 nt, Homo sapiens
aaacaggaaacaaagaaug

SEQ ID NO: 572238 - RNA, 19 nt, Homo sapiens
uggacaagcuggugaacau

SEQ ID NO: 572239 - RNA, 19 nt, Homo sapiens
augaucaguugguuguuua

SEQ ID NO: 572240 - RNA, 19 nt, Homo sapiens
gaaaacaucuacgaaaggu

SEQ ID NO: 572241 - RNA, 19 nt, Homo sapiens
guguaccgguaauauauug

SEQ ID NO: 572242 - RNA, 19 nt, Homo sapiens
gagagagaagauuaagaaa

SEQ ID NO: 572243 - RNA, 19 nt, Homo sapiens
ggucaaagagcgcauggau

SEQ ID NO: 572244 - RNA, 19 nt, Homo sapiens
agaggaggcugcugagaag

SEQ ID NO: 572245 - RNA, 19 nt, Homo sapiens
ggaccucuccucagaugau

SEQ ID NO: 572246 - RNA, 19 nt, Homo sapiens
gugaagggcauccagaaug

SEQ ID NO: 572247 - RNA, 19 nt, Homo sapiens
gcuuaacuauuucacucuu

SEQ ID NO: 572248 - RNA, 19 nt, Homo sapiens
caaagaaugccgaaaagaa

SEQ ID NO: 572249 - RNA, 19 nt, Homo sapiens
agaaacaggaaacaaagaa

SEQ ID NO: 572250 - RNA, 19 nt, Homo sapiens
caacuucucacccgagcaa

SEQ ID NO: 572251 - RNA, 19 nt, Homo sapiens
cacgucaaaucaccagaaa

SEQ ID NO: 572252 - RNA, 19 nt, Homo sapiens
guagagaggagagagaaga

SEQ ID NO: 572253 - RNA, 19 nt, Homo sapiens
augcuaaucucuuugacuu

SEQ ID NO: 572254 - RNA, 19 nt, Homo sapiens
gaaaguagggcagagaaaa

SEQ ID NO: 572255 - RNA, 19 nt, Homo sapiens
guggaccucuccucagaug

SEQ ID NO: 572256 - RNA, 19 nt, Homo sapiens
aaacaaagaaugccgaaaa

SEQ ID NO: 572257 - RNA, 19 nt, Homo sapiens
caggagaaccagcacaaga

SEQ ID NO: 572258 - RNA, 19 nt, Homo sapiens
caguaaucauugaccauau

SEQ ID NO: 572259 - RNA, 19 nt, Homo sapiens
aacaaacucuugcacaucu

SEQ ID NO: 572260 - RNA, 19 nt, Homo sapiens
gaagacagugccgaggaaa

SEQ ID NO: 572261 - RNA, 19 nt, Homo sapiens
uaaauggccucacuccuaa

SEQ ID NO: 572262 - RNA, 19 nt, Homo sapiens
aaacuggccucuauccaua

SEQ ID NO: 572263 - RNA, 19 nt, Homo sapiens
caaagacccuccagcagaa

SEQ ID NO: 572264 - RNA, 19 nt, Homo sapiens
ggauacagcuggaccugaa

SEQ ID NO: 572265 - RNA, 19 nt, Homo sapiens
gaaccugacuuauuugacu

SEQ ID NO: 572266 - RNA, 19 nt, Homo sapiens
ccaagucgauggaacaguu

SEQ ID NO: 572267 - RNA, 19 nt, Homo sapiens
ggacccagaugcagaagug

SEQ ID NO: 572268 - RNA, 19 nt, Homo sapiens
ucaccaaacuggccucuau

SEQ ID NO: 572269 - RNA, 19 nt, Homo sapiens
uggcacaucugacccauuu

SEQ ID NO: 572270 - RNA, 19 nt, Homo sapiens
ugaaauuacuggaggauuc

SEQ ID NO: 572271 - RNA, 19 nt, Homo sapiens
gggauugacagcuggauua

SEQ ID NO: 572272 - RNA, 19 nt, Homo sapiens
cuaaauggccucacuccua

SEQ ID NO: 572273 - RNA, 19 nt, Homo sapiens
ccaccuaccuccagugcaa

SEQ ID NO: 572274 - RNA, 19 nt, Homo sapiens
ugaagcaggugacauguag

SEQ ID NO: 572275 - RNA, 19 nt, Homo sapiens
gcccugagcugcuggauac

SEQ ID NO: 572276 - RNA, 19 nt, Homo sapiens
gggacuggcugggcacuuu

SEQ ID NO: 572277 - RNA, 19 nt, Homo sapiens
gcaccugccucuggauuuc

SEQ ID NO: 572278 - RNA, 19 nt, Homo sapiens
agacaucucuggcacaucu

SEQ ID NO: 572279 - RNA, 19 nt, Homo sapiens
gccaggaccuugccaccaa

SEQ ID NO: 572280 - RNA, 19 nt, Homo sapiens
ggaggauucuaacauggau

SEQ ID NO: 572281 - RNA, 19 nt, Homo sapiens
ggacauggugggcaagaau

SEQ ID NO: 572282 - RNA, 19 nt, Homo sapiens
ugaaguaccuggccaucag

SEQ ID NO: 572283 - RNA, 19 nt, Homo sapiens
gcaccaggaugugaaguac

SEQ ID NO: 572284 - RNA, 19 nt, Homo sapiens
ccuuggaccucuuugauuc

SEQ ID NO: 572285 - RNA, 19 nt, Homo sapiens
uuggagaccucaaccauca

SEQ ID NO: 572286 - RNA, 19 nt, Homo sapiens
caguggauuucucuucuug

SEQ ID NO: 572287 - RNA, 19 nt, Homo sapiens
gugauuagccgugucuuug

SEQ ID NO: 572288 - RNA, 19 nt, Homo sapiens
caaacuggccucuauccau

SEQ ID NO: 572289 - RNA, 19 nt, Homo sapiens
ccucuuugauucugugguu

SEQ ID NO: 572290 - RNA, 19 nt, Homo sapiens
cagcagaagccaccuaaag

SEQ ID NO: 572291 - RNA, 19 nt, Homo sapiens
ggauugacagcuggauuaa

SEQ ID NO: 572292 - RNA, 19 nt, Homo sapiens
cgauggaacaguuuaugaa

SEQ ID NO: 572293 - RNA, 19 nt, Homo sapiens
cuaacucccuggcauccaa

SEQ ID NO: 572294 - RNA, 19 nt, Homo sapiens
gugaagguacgccugauug

SEQ ID NO: 572295 - RNA, 19 nt, Homo sapiens
gauucagacuggaguggau

SEQ ID NO: 572296 - RNA, 19 nt, Homo sapiens
gauuagccgugucuuugag

SEQ ID NO: 572297 - RNA, 19 nt, Homo sapiens
ccuucugccuggaaaguuu

SEQ ID NO: 572298 - RNA, 19 nt, Homo sapiens
agacuggaguggauaggau

SEQ ID NO: 572299 - RNA, 19 nt, Homo sapiens
gaaugugaaugagcucaac

SEQ ID NO: 572300 - RNA, 19 nt, Homo sapiens
ccaaggcugugcagagcau

SEQ ID NO: 572301 - RNA, 19 nt, Homo sapiens
guccugaagccugugauua

SEQ ID NO: 572302 - RNA, 19 nt, Homo sapiens
gaaauuacuggaggauucu

SEQ ID NO: 572303 - RNA, 19 nt, Homo sapiens
gauggaacaguuuaugaag

SEQ ID NO: 572304 - RNA, 19 nt, Homo sapiens
gcuaccagccucucaugga

SEQ ID NO: 572305 - RNA, 19 nt, Homo sapiens
gcacaucugacccauuugc

SEQ ID NO: 572306 - RNA, 19 nt, Homo sapiens
ccagaugggcacuaaaugg

SEQ ID NO: 572307 - RNA, 19 nt, Homo sapiens
gaguggauaggauaaggaa

SEQ ID NO: 572308 - RNA, 19 nt, Homo sapiens
uaaggaaaugccagagcua

SEQ ID NO: 572309 - RNA, 19 nt, Homo sapiens
ucaguggauuucucuucuu

SEQ ID NO: 572310 - RNA, 19 nt, Homo sapiens
ggaaggggauguucaaagc

SEQ ID NO: 572311 - RNA, 19 nt, Homo sapiens
ugacagcuggauuaacuug

SEQ ID NO: 572312 - RNA, 19 nt, Homo sapiens
acuggaggauucuaacaug

SEQ ID NO: 572313 - RNA, 19 nt, Homo sapiens
ccaagcuggugaaacucuu

SEQ ID NO: 572314 - RNA, 19 nt, Homo sapiens
ccucaaccaucaagaagac

SEQ ID NO: 572315 - RNA, 19 nt, Homo sapiens
gagcuggaucccugcaaga

SEQ ID NO: 572316 - RNA, 19 nt, Homo sapiens
ccacccaccacuaauacuu

SEQ ID NO: 572317 - RNA, 19 nt, Homo sapiens
gaagguacgccugauugag

SEQ ID NO: 572318 - RNA, 19 nt, Homo sapiens
ugaagguacgccugauuga

SEQ ID NO: 572319 - RNA, 19 nt, Homo sapiens
uccaccagcuggccuucua

SEQ ID NO: 572320 - RNA, 19 nt, Homo sapiens
ggaguggauaggauaagga

SEQ ID NO: 572321 - RNA, 19 nt, Homo sapiens
gacuggaguggauaggaua

SEQ ID NO: 572322 - RNA, 19 nt, Homo sapiens
ggccaucaguggauuucuc

SEQ ID NO: 572323 - RNA, 19 nt, Homo sapiens
gaaccugagcgcccuucug

SEQ ID NO: 572324 - RNA, 19 nt, Homo sapiens
gggacauggugggcaagaa

SEQ ID NO: 572325 - RNA, 19 nt, Homo sapiens
auugacagcuggauuaacu

SEQ ID NO: 572326 - RNA, 19 nt, Homo sapiens
gagaaggcuaucugcugaa

SEQ ID NO: 572327 - RNA, 19 nt, Homo sapiens
caucaguggauuucucuuc

SEQ ID NO: 572328 - RNA, 19 nt, Homo sapiens
uggaacaguuuaugaagcu

SEQ ID NO: 572329 - RNA, 19 nt, Homo sapiens
caagucgauggaacaguuu

SEQ ID NO: 572330 - RNA, 19 nt, Homo sapiens
ggcacuuucuggacuaucu

SEQ ID NO: 572331 - RNA, 19 nt, Homo sapiens
cgacaucaucggcaagauc

SEQ ID NO: 572332 - RNA, 19 nt, Homo sapiens
ggucucuacuucaccaaac

SEQ ID NO: 572333 - RNA, 19 nt, Homo sapiens
ccuacugccuagugaaagu

SEQ ID NO: 572334 - RNA, 19 nt, Homo sapiens
cuucgcaccugccauccuu

SEQ ID NO: 572335 - RNA, 19 nt, Homo sapiens
ccuucuacgugcuggauga

SEQ ID NO: 572336 - RNA, 19 nt, Homo sapiens
ugauuagccgugucuuuga

SEQ ID NO: 572337 - RNA, 19 nt, Homo sapiens
caagcuggugaaacucuuu

SEQ ID NO: 572338 - RNA, 19 nt, Homo sapiens
gcgcccuucugccuggaaa

SEQ ID NO: 572339 - RNA, 19 nt, Homo sapiens
ccacgcgcuuugccuucaa

SEQ ID NO: 572340 - RNA, 19 nt, Homo sapiens
agaccucaaccaucaagaa

SEQ ID NO: 572341 - RNA, 19 nt, Homo sapiens
ggccagccuugcacugagu

SEQ ID NO: 572342 - RNA, 19 nt, Homo sapiens
gcugaggcccagacagugu

SEQ ID NO: 572343 - RNA, 19 nt, Homo sapiens
ccaugcgccucgccuucaa

SEQ ID NO: 572344 - RNA, 19 nt, Homo sapiens
gacaucaucggcaagaucu

SEQ ID NO: 572345 - RNA, 19 nt, Homo sapiens
gaccucaaccaucaagaag

SEQ ID NO: 572346 - RNA, 19 nt, Homo sapiens
gcagaagugcagggugaga

SEQ ID NO: 572347 - RNA, 19 nt, Homo sapiens
gugcaagaaugugaaugag

SEQ ID NO: 572348 - RNA, 19 nt, Homo sapiens
gccacgcgcuuugccuuca

SEQ ID NO: 572349 - RNA, 19 nt, Homo sapiens
gaaguaccuggccaucagu

SEQ ID NO: 572350 - RNA, 19 nt, Homo sapiens
gagcagggaggcgauuaca

SEQ ID NO: 572351 - RNA, 19 nt, Homo sapiens
ucgauggaacaguuuauga

SEQ ID NO: 572352 - RNA, 19 nt, Homo sapiens
ggcacuaaauggccucacu

SEQ ID NO: 572353 - RNA, 19 nt, Homo sapiens
gauucuaacauggauacaa

SEQ ID NO: 572354 - RNA, 19 nt, Homo sapiens
cguacacacucagcuguca

SEQ ID NO: 572355 - RNA, 19 nt, Homo sapiens
gacauggugggcaagaaug

SEQ ID NO: 572356 - RNA, 19 nt, Homo sapiens
ggagaccucaaccaucaag

SEQ ID NO: 572357 - RNA, 19 nt, Homo sapiens
cccauuugcacguguguuu

SEQ ID NO: 572358 - RNA, 19 nt, Homo sapiens
gaauuccugaugcccaugu

SEQ ID NO: 572359 - RNA, 19 nt, Homo sapiens
acagcuggauuaacuugag

SEQ ID NO: 572360 - RNA, 19 nt, Homo sapiens
gcucugggacugggacaug

SEQ ID NO: 572361 - RNA, 19 nt, Homo sapiens
gaacucccauccagaauga

SEQ ID NO: 572362 - RNA, 19 nt, Homo sapiens
agaaugaucugcuugagua

SEQ ID NO: 572363 - RNA, 19 nt, Homo sapiens
guagaacgcuucaauaguc

SEQ ID NO: 572364 - RNA, 19 nt, Homo sapiens
cuaaauaucugccugugaa

SEQ ID NO: 572365 - RNA, 19 nt, Homo sapiens
gugaagaacugguacaaug

SEQ ID NO: 572366 - RNA, 19 nt, Homo sapiens
gaaacucccuguccaugug

SEQ ID NO: 572367 - RNA, 19 nt, Homo sapiens
aaagaagacuugcuauauc

SEQ ID NO: 572368 - RNA, 19 nt, Homo sapiens
cgaauuacacccagacuuu

SEQ ID NO: 572369 - RNA, 19 nt, Homo sapiens
gagcaggucguuuguugua

SEQ ID NO: 572370 - RNA, 19 nt, Homo sapiens
gugaauagaugccugauac

SEQ ID NO: 572371 - RNA, 19 nt, Homo sapiens
ggacagcagucagcaugaa

SEQ ID NO: 572372 - RNA, 19 nt, Homo sapiens
gaagcuagccucagugaca

SEQ ID NO: 572373 - RNA, 19 nt, Homo sapiens
gaacaggaagguugagaga

SEQ ID NO: 572374 - RNA, 19 nt, Homo sapiens
ggaugaagcuagccucagu

SEQ ID NO: 572375 - RNA, 19 nt, Homo sapiens
gaacccagccaaugaugaa

SEQ ID NO: 572376 - RNA, 19 nt, Homo sapiens
cuucugauauccuuucuaa

SEQ ID NO: 572377 - RNA, 19 nt, Homo sapiens
ugagucagcuaaccaauca

SEQ ID NO: 572378 - RNA, 19 nt, Homo sapiens
aagaagggcugcaugaugu

SEQ ID NO: 572379 - RNA, 19 nt, Homo sapiens
uggaaccacugcacugaua

SEQ ID NO: 572380 - RNA, 19 nt, Homo sapiens
ggaagaggaggauggcuuu

SEQ ID NO: 572381 - RNA, 19 nt, Homo sapiens
acaaugagguugggaaaug

SEQ ID NO: 572382 - RNA, 19 nt, Homo sapiens
gcauuuauucgaagcauuu

SEQ ID NO: 572383 - RNA, 19 nt, Homo sapiens
caagaagcauuuugaauug

SEQ ID NO: 572384 - RNA, 19 nt, Homo sapiens
caugaagcauuuauucgaa

SEQ ID NO: 572385 - RNA, 19 nt, Homo sapiens
acaggaagguugagagaga

SEQ ID NO: 572386 - RNA, 19 nt, Homo sapiens
gcagcugugugguggauga

SEQ ID NO: 572387 - RNA, 19 nt, Homo sapiens
gaagcgagccaagguugua

SEQ ID NO: 572388 - RNA, 19 nt, Homo sapiens
gcucuaaucuaugauaagu

SEQ ID NO: 572389 - RNA, 19 nt, Homo sapiens
gcagucagcaugaagcauu

SEQ ID NO: 572390 - RNA, 19 nt, Homo sapiens
gaacugguacaaugagguu

SEQ ID NO: 572391 - RNA, 19 nt, Homo sapiens
gagaugggccuaggaaaga

SEQ ID NO: 572392 - RNA, 19 nt, Homo sapiens
caagaagggcugcaugaug

SEQ ID NO: 572393 - RNA, 19 nt, Homo sapiens
gcacgauguccauuaagaa

SEQ ID NO: 572394 - RNA, 19 nt, Homo sapiens
ggcacgauguccauuaaga

SEQ ID NO: 572395 - RNA, 19 nt, Homo sapiens
ucauccagcucuaaucuau

SEQ ID NO: 572396 - RNA, 19 nt, Homo sapiens
caaaccggcagaagaauug

SEQ ID NO: 572397 - RNA, 19 nt, Homo sapiens
ucagagagagggagugaaa

SEQ ID NO: 572398 - RNA, 19 nt, Homo sapiens
aaagaugccuugguucugu

SEQ ID NO: 572399 - RNA, 19 nt, Homo sapiens
gcaugaagcauuuauucga

SEQ ID NO: 572400 - RNA, 19 nt, Homo sapiens
cagcucuaaucuaugauaa

SEQ ID NO: 572401 - RNA, 19 nt, Homo sapiens
ggacugcccaugaauucaa

SEQ ID NO: 572402 - RNA, 19 nt, Homo sapiens
ggacacaggcucaagaacu

SEQ ID NO: 572403 - RNA, 19 nt, Homo sapiens
gggagaaaaucaucaagaa

SEQ ID NO: 572404 - RNA, 19 nt, Homo sapiens
aagaagacuugcuauaucu

SEQ ID NO: 572405 - RNA, 19 nt, Homo sapiens
ccguagcagugacaaagua

SEQ ID NO: 572406 - RNA, 19 nt, Homo sapiens
gacacaggcucaagaacuc

SEQ ID NO: 572407 - RNA, 19 nt, Homo sapiens
caaaagaagacuugcuaua

SEQ ID NO: 572408 - RNA, 19 nt, Homo sapiens
cagacugaguuauacaaga

SEQ ID NO: 572409 - RNA, 19 nt, Homo sapiens
auacggaggacuucugaua

SEQ ID NO: 572410 - RNA, 19 nt, Homo sapiens
ccuagggacugcccaugaa

SEQ ID NO: 572411 - RNA, 19 nt, Homo sapiens
ugaagaacugguacaauga

SEQ ID NO: 572412 - RNA, 19 nt, Homo sapiens
gaauuacacccagacuuug

SEQ ID NO: 572413 - RNA, 19 nt, Homo sapiens
uauuucagcuugguacauu

SEQ ID NO: 572414 - RNA, 19 nt, Homo sapiens
ucaagaacucugagaauca

SEQ ID NO: 572415 - RNA, 19 nt, Homo sapiens
guacaaugagguugggaaa

SEQ ID NO: 572416 - RNA, 19 nt, Homo sapiens
gaugagaugggccuaggaa

SEQ ID NO: 572417 - RNA, 19 nt, Homo sapiens
gaagggcugcaugauguuu

SEQ ID NO: 572418 - RNA, 19 nt, Homo sapiens
cuaaccggcuggucauguu

SEQ ID NO: 572419 - RNA, 19 nt, Homo sapiens
uagugcuggugucgaauua

SEQ ID NO: 572420 - RNA, 19 nt, Homo sapiens
gguccuggauuauauucug

SEQ ID NO: 572421 - RNA, 19 nt, Homo sapiens
gagugugucuucccuuucu

SEQ ID NO: 572422 - RNA, 19 nt, Homo sapiens
ggaacucccauccagaaug

SEQ ID NO: 572423 - RNA, 19 nt, Homo sapiens
ccaaaccggcagaagaauu

SEQ ID NO: 572424 - RNA, 19 nt, Homo sapiens
augaucugcuugaguauuu

SEQ ID NO: 572425 - RNA, 19 nt, Homo sapiens
agagagagggagugaaauu

SEQ ID NO: 572426 - RNA, 19 nt, Homo sapiens
ggaaccacugcacugauaa

SEQ ID NO: 572427 - RNA, 19 nt, Homo sapiens
ggauguagagcgccacuuc

SEQ ID NO: 572428 - RNA, 19 nt, Homo sapiens
gagcagcugugugguggau

SEQ ID NO: 572429 - RNA, 19 nt, Homo sapiens
uccaucaccucgcuaaaga

SEQ ID NO: 572430 - RNA, 19 nt, Homo sapiens
agacugaguuauacaagag

SEQ ID NO: 572431 - RNA, 19 nt, Homo sapiens
ggacuucugauauccuuuc

SEQ ID NO: 572432 - RNA, 19 nt, Homo sapiens
cagcaugaagcauuuauuc

SEQ ID NO: 572433 - RNA, 19 nt, Homo sapiens
ccagcauucucaugaggaa

SEQ ID NO: 572434 - RNA, 19 nt, Homo sapiens
guuguagaacgcuucaaua

SEQ ID NO: 572435 - RNA, 19 nt, Homo sapiens
caagagguuucugagacaa

SEQ ID NO: 572436 - RNA, 19 nt, Homo sapiens
acaagagguuucugagaca

SEQ ID NO: 572437 - RNA, 19 nt, Homo sapiens
gaagaacugguacaaugag

SEQ ID NO: 572438 - RNA, 19 nt, Homo sapiens
cuuagccgcugccugcuuu

SEQ ID NO: 572439 - RNA, 19 nt, Homo sapiens
gacggccacucucacaguu

SEQ ID NO: 572440 - RNA, 19 nt, Homo sapiens
ggaacccagccaaugauga

SEQ ID NO: 572441 - RNA, 19 nt, Homo sapiens
guaaucauccagcucuaau

SEQ ID NO: 572442 - RNA, 19 nt, Homo sapiens
gaguugaaggagcuguuua

SEQ ID NO: 572443 - RNA, 19 nt, Homo sapiens
cagggaccauugaggagaa

SEQ ID NO: 572444 - RNA, 19 nt, Homo sapiens
agaugcugguccuggauua

SEQ ID NO: 572445 - RNA, 19 nt, Homo sapiens
uugagcaggucguuuguug

SEQ ID NO: 572446 - RNA, 19 nt, Homo sapiens
acacuaaucucugcuuggu

SEQ ID NO: 572447 - RNA, 19 nt, Homo sapiens
gaagauugagcaggucguu

SEQ ID NO: 572448 - RNA, 19 nt, Homo sapiens
gaggaucuaaggaugaaau

SEQ ID NO: 572449 - RNA, 19 nt, Homo sapiens
gcagugagacccagaucca

SEQ ID NO: 572450 - RNA, 19 nt, Homo sapiens
gaggaaggagauagggaaa

SEQ ID NO: 572451 - RNA, 19 nt, Homo sapiens
gaagacuugcuauaucuac

SEQ ID NO: 572452 - RNA, 19 nt, Homo sapiens
agaggaggauggcuuugug

SEQ ID NO: 572453 - RNA, 19 nt, Homo sapiens
aagaagcuuuguaaucauc

SEQ ID NO: 572454 - RNA, 19 nt, Homo sapiens
gagacgcugcugcuaguga

SEQ ID NO: 572455 - RNA, 19 nt, Homo sapiens
guguuggucuggucauaug

SEQ ID NO: 572456 - RNA, 19 nt, Homo sapiens
gagagagggagugaaauuc

SEQ ID NO: 572457 - RNA, 19 nt, Homo sapiens
ccuauucucaguaagguuu

SEQ ID NO: 572458 - RNA, 19 nt, Homo sapiens
cagucagcaugaagcauuu

SEQ ID NO: 572459 - RNA, 19 nt, Homo sapiens
ggucuggguguagcucuua

SEQ ID NO: 572460 - RNA, 19 nt, Homo sapiens
gugcuggugucgaauuaca

SEQ ID NO: 572461 - RNA, 19 nt, Homo sapiens
agaaagcacugaacaauua

SEQ ID NO: 572462 - RNA, 19 nt, Homo sapiens
gagaauagcuaagagauaa

SEQ ID NO: 572463 - RNA, 19 nt, Homo sapiens
gagcaaagaugcauuggaa

SEQ ID NO: 572464 - RNA, 19 nt, Homo sapiens
gcaacgaccucucccagua

SEQ ID NO: 572465 - RNA, 19 nt, Homo sapiens
gaugugagcuuucuaguca

SEQ ID NO: 572466 - RNA, 19 nt, Homo sapiens
ggaaaugccugaaccaaag

SEQ ID NO: 572467 - RNA, 19 nt, Homo sapiens
caauggaucuucaguauuc

SEQ ID NO: 572468 - RNA, 19 nt, Homo sapiens
gcaauuaugugucugaaca

SEQ ID NO: 572469 - RNA, 19 nt, Homo sapiens
ugaaggagguguagacuug

SEQ ID NO: 572470 - RNA, 19 nt, Homo sapiens
gauuagcaguucuuaguaa

SEQ ID NO: 572471 - RNA, 19 nt, Homo sapiens
ggaauaacaucaccaaacu

SEQ ID NO: 572472 - RNA, 19 nt, Homo sapiens
ggaaagcaauuaugugucu

SEQ ID NO: 572473 - RNA, 19 nt, Homo sapiens
gcauagagccaaucacauu

SEQ ID NO: 572474 - RNA, 19 nt, Homo sapiens
gcacugaacaauuaagaaa

SEQ ID NO: 572475 - RNA, 19 nt, Homo sapiens
gaaggcacagugaauauuu

SEQ ID NO: 572476 - RNA, 19 nt, Homo sapiens
ggaagacagacaaauuaua

SEQ ID NO: 572477 - RNA, 19 nt, Homo sapiens
gcaagcacacuguuaguuu

SEQ ID NO: 572478 - RNA, 19 nt, Homo sapiens
cgaguggauugaucuaaua

SEQ ID NO: 572479 - RNA, 19 nt, Homo sapiens
cuaagaaccuggagaagga

SEQ ID NO: 572480 - RNA, 19 nt, Homo sapiens
gaccaaaccgccaugauaa

SEQ ID NO: 572481 - RNA, 19 nt, Homo sapiens
ggagaaggauuagcaguuc

SEQ ID NO: 572482 - RNA, 19 nt, Homo sapiens
ucccagaccuccaguuaua

SEQ ID NO: 572483 - RNA, 19 nt, Homo sapiens
uaaacggacuggugaaugu

SEQ ID NO: 572484 - RNA, 19 nt, Homo sapiens
ggaaauugcaguauuaagu

SEQ ID NO: 572485 - RNA, 19 nt, Homo sapiens
ucuggaaauugcaguauua

SEQ ID NO: 572486 - RNA, 19 nt, Homo sapiens
ggauugaucuaauauuugg

SEQ ID NO: 572487 - RNA, 19 nt, Homo sapiens
cauccugccuugacaaauu

SEQ ID NO: 572488 - RNA, 19 nt, Homo sapiens
gaaauugcaguauuaagug

SEQ ID NO: 572489 - RNA, 19 nt, Homo sapiens
gaagagcaaagaugcauug

SEQ ID NO: 572490 - RNA, 19 nt, Homo sapiens
cagaauggaagauuugaua

SEQ ID NO: 572491 - RNA, 19 nt, Homo sapiens
gcucagaacuagauuuguc

SEQ ID NO: 572492 - RNA, 19 nt, Homo sapiens
ugacgccucuggugacuaa

SEQ ID NO: 572493 - RNA, 19 nt, Homo sapiens
gcuagaacaucauuugaca

SEQ ID NO: 572494 - RNA, 19 nt, Homo sapiens
guauauggaugaaugaaca

SEQ ID NO: 572495 - RNA, 19 nt, Homo sapiens
gagaagguagccaugcuua

SEQ ID NO: 572496 - RNA, 19 nt, Homo sapiens
gaaguuggauuugggaaag

SEQ ID NO: 572497 - RNA, 19 nt, Homo sapiens
gcaaaacacuggccuggaa

SEQ ID NO: 572498 - RNA, 19 nt, Homo sapiens
ugaccaaaccgccaugaua

SEQ ID NO: 572499 - RNA, 19 nt, Homo sapiens
cagaagacaggacuaagua

SEQ ID NO: 572500 - RNA, 19 nt, Homo sapiens
ucaauagccugaaguugga

SEQ ID NO: 572501 - RNA, 19 nt, Homo sapiens
gaaugugcaauguuaguaa

SEQ ID NO: 572502 - RNA, 19 nt, Homo sapiens
gaaaguggaagauguugug

SEQ ID NO: 572503 - RNA, 19 nt, Homo sapiens
gaaagcacugaacaauuaa

SEQ ID NO: 572504 - RNA, 19 nt, Homo sapiens
gaacaguguagcaguauca

SEQ ID NO: 572505 - RNA, 19 nt, Homo sapiens
ggagaugccacugucauaa

SEQ ID NO: 572506 - RNA, 19 nt, Homo sapiens
uggugaaugugcaauguua

SEQ ID NO: 572507 - RNA, 19 nt, Homo sapiens
caaagaaggcacagugaau

SEQ ID NO: 572508 - RNA, 19 nt, Homo sapiens
caagcacacuguuaguuuc

SEQ ID NO: 572509 - RNA, 19 nt, Homo sapiens
uggccgagcuggaacauga

SEQ ID NO: 572510 - RNA, 19 nt, Homo sapiens
gcaaagaugcauuggaaag

SEQ ID NO: 572511 - RNA, 19 nt, Homo sapiens
caagggcagucaccaugaa

SEQ ID NO: 572512 - RNA, 19 nt, Homo sapiens
ggacuaaguagcagagaau

SEQ ID NO: 572513 - RNA, 19 nt, Homo sapiens
gcugugacauguauaugga

SEQ ID NO: 572514 - RNA, 19 nt, Homo sapiens
aaagaaggcacagugaaua

SEQ ID NO: 572515 - RNA, 19 nt, Homo sapiens
acacuggccuggaauaaca

SEQ ID NO: 572516 - RNA, 19 nt, Homo sapiens
ggaaugcaaagcagaaaug

SEQ ID NO: 572517 - RNA, 19 nt, Homo sapiens
gcacauggaaugcaaagca

SEQ ID NO: 572518 - RNA, 19 nt, Homo sapiens
ccaauagacacuucacaaa

SEQ ID NO: 572519 - RNA, 19 nt, Homo sapiens
cgcaauggaucuucaguau

SEQ ID NO: 572520 - RNA, 19 nt, Homo sapiens
gaucuaauauuuggcuaca

SEQ ID NO: 572521 - RNA, 19 nt, Homo sapiens
gugguuacuuucuauaaug

SEQ ID NO: 572522 - RNA, 19 nt, Homo sapiens
aaugaacaguguagcagua

SEQ ID NO: 572523 - RNA, 19 nt, Homo sapiens
uugaagaccugaccgaaga

SEQ ID NO: 572524 - RNA, 19 nt, Homo sapiens
gaaaaucagaggcuccuua

SEQ ID NO: 572525 - RNA, 19 nt, Homo sapiens
ggauuagcaguucuuagua

SEQ ID NO: 572526 - RNA, 19 nt, Homo sapiens
ggaaguauuuugcacagaa

SEQ ID NO: 572527 - RNA, 19 nt, Homo sapiens
acacaaaccuguauuuuca

SEQ ID NO: 572528 - RNA, 19 nt, Homo sapiens
gaaggauuagcaguucuua

SEQ ID NO: 572529 - RNA, 19 nt, Homo sapiens
gcagagaauagcuaagaga

SEQ ID NO: 572530 - RNA, 19 nt, Homo sapiens
gcaauggaucuucaguauu

SEQ ID NO: 572531 - RNA, 19 nt, Homo sapiens
cgacaucuaccuaaaguuc

SEQ ID NO: 572532 - RNA, 19 nt, Homo sapiens
ccagauaacacuccaagau

SEQ ID NO: 572533 - RNA, 19 nt, Homo sapiens
cauuacagcuauucaucuu

SEQ ID NO: 572534 - RNA, 19 nt, Homo sapiens
cagaaagcacugaacaauu

SEQ ID NO: 572535 - RNA, 19 nt, Homo sapiens
gcagucaccaugaaaggaa

SEQ ID NO: 572536 - RNA, 19 nt, Homo sapiens
guucaacaguauugcagaa

SEQ ID NO: 572537 - RNA, 19 nt, Homo sapiens
uaaugcagauagaauguuc

SEQ ID NO: 572538 - RNA, 19 nt, Homo sapiens
ggauugcaccagaguauau

SEQ ID NO: 572539 - RNA, 19 nt, Homo sapiens
agauaacacuccaagaugu

SEQ ID NO: 572540 - RNA, 19 nt, Homo sapiens
gaacgguuuguauuucauu

SEQ ID NO: 572541 - RNA, 19 nt, Homo sapiens
ggacaugaugaugcuguua

SEQ ID NO: 572542 - RNA, 19 nt, Homo sapiens
gaagacgccaggacacguu

SEQ ID NO: 572543 - RNA, 19 nt, Homo sapiens
ggacaccuuuccaacuauc

SEQ ID NO: 572544 - RNA, 19 nt, Homo sapiens
auucagggauuguauguga

SEQ ID NO: 572545 - RNA, 19 nt, Homo sapiens
guuccgacaucuaccuaaa

SEQ ID NO: 572546 - RNA, 19 nt, Homo sapiens
acauguauauggaugaaug

SEQ ID NO: 572547 - RNA, 19 nt, Homo sapiens
gauuccaccuugaagaugu

SEQ ID NO: 572548 - RNA, 19 nt, Homo sapiens
caacggauuuuaaagaguu

SEQ ID NO: 572549 - RNA, 19 nt, Homo sapiens
caacaguauugcagaaacu

SEQ ID NO: 572550 - RNA, 19 nt, Homo sapiens
gauaaugcagauagaaugu

SEQ ID NO: 572551 - RNA, 19 nt, Homo sapiens
aaccaaaguucauguaugg

SEQ ID NO: 572552 - RNA, 19 nt, Homo sapiens
ccucugggcuuggaaguau

SEQ ID NO: 572553 - RNA, 19 nt, Homo sapiens
agacguugcuucagcuuca

SEQ ID NO: 572554 - RNA, 19 nt, Homo sapiens
gggaagacagacaaauuau

SEQ ID NO: 572555 - RNA, 19 nt, Homo sapiens
ugacauguauauggaugaa

SEQ ID NO: 572556 - RNA, 19 nt, Homo sapiens
ucacaacggccaccuuaau

SEQ ID NO: 572557 - RNA, 19 nt, Homo sapiens
ccucacaacggccaccuua

SEQ ID NO: 572558 - RNA, 19 nt, Homo sapiens
ggcuuuaucgucuuguuua

SEQ ID NO: 572559 - RNA, 19 nt, Homo sapiens
ccaguuauaaugcuucuau

SEQ ID NO: 572560 - RNA, 19 nt, Homo sapiens
uauaggaacgguuuguauu

SEQ ID NO: 572561 - RNA, 19 nt, Homo sapiens
caugaaagaugacagaaga

SEQ ID NO: 572562 - RNA, 19 nt, Homo sapiens
caacaggacgggcuaugua

SEQ ID NO: 572563 - RNA, 19 nt, Homo sapiens
ggaagaacagccugaagaa

SEQ ID NO: 572564 - RNA, 19 nt, Homo sapiens
ccauggaggugauugagaa

SEQ ID NO: 572565 - RNA, 19 nt, Homo sapiens
caaagaaggacuccaugaa

SEQ ID NO: 572566 - RNA, 19 nt, Homo sapiens
cagaagaaguuauugugau

SEQ ID NO: 572567 - RNA, 19 nt, Homo sapiens
gaugacagaagaaguuauu

SEQ ID NO: 572568 - RNA, 19 nt, Homo sapiens
aaagaaggacuccaugaaa

SEQ ID NO: 572569 - RNA, 19 nt, Homo sapiens
aaagaugacagaagaaguu

SEQ ID NO: 572570 - RNA, 19 nt, Homo sapiens
gaaccugaaggacacacua

SEQ ID NO: 572571 - RNA, 19 nt, Homo sapiens
aagaaggacuccaugaaag

SEQ ID NO: 572572 - RNA, 19 nt, Homo sapiens
ccaaagaaggacuccauga

SEQ ID NO: 572573 - RNA, 19 nt, Homo sapiens
gcuauguaccguccaacua

SEQ ID NO: 572574 - RNA, 19 nt, Homo sapiens
gaaagaugacagaagaagu

SEQ ID NO: 572575 - RNA, 19 nt, Homo sapiens
gacagaagaaguuauugug

SEQ ID NO: 572576 - RNA, 19 nt, Homo sapiens
aggaggagcucaacuucga

SEQ ID NO: 572577 - RNA, 19 nt, Homo sapiens
gaaggacuccaugaaagau

SEQ ID NO: 572578 - RNA, 19 nt, Homo sapiens
uggacgagcugguggaaca

SEQ ID NO: 572579 - RNA, 19 nt, Homo sapiens
cggaagaacagccugaaga

SEQ ID NO: 572580 - RNA, 19 nt, Homo sapiens
gaagaacagccugaagaag

SEQ ID NO: 572581 - RNA, 19 nt, Homo sapiens
ugaacgagcggcugugguu

SEQ ID NO: 572582 - RNA, 19 nt, Homo sapiens
agaaggacuccaugaaaga

SEQ ID NO: 572583 - RNA, 19 nt, Homo sapiens
ggcaagacgcgcaggaaga

SEQ ID NO: 572584 - RNA, 19 nt, Homo sapiens
ugacagaagaaguuauugu

SEQ ID NO: 572585 - RNA, 19 nt, Homo sapiens
gaagaaguuauugugauag

SEQ ID NO: 572586 - RNA, 19 nt, Homo sapiens
gcugguggaacacuacaaa

SEQ ID NO: 572587 - RNA, 19 nt, Homo sapiens
acagaagaaguuauuguga

SEQ ID NO: 572588 - RNA, 19 nt, Homo sapiens
gggagaccauggaggugau

SEQ ID NO: 572589 - RNA, 19 nt, Homo sapiens
caucuacgaccucaacauc

SEQ ID NO: 572590 - RNA, 19 nt, Homo sapiens
aggacuccaugaaagauga

SEQ ID NO: 572591 - RNA, 19 nt, Homo sapiens
cagggaagaacaaacacuu

SEQ ID NO: 572592 - RNA, 19 nt, Homo sapiens
cgucagggaagaacaaaca

SEQ ID NO: 572593 - RNA, 19 nt, Homo sapiens
acacuaggccucggcaaga

SEQ ID NO: 572594 - RNA, 19 nt, Homo sapiens
aagaugacagaagaaguua

SEQ ID NO: 572595 - RNA, 19 nt, Homo sapiens
cgaggaggagcucaacuuc

SEQ ID NO: 572596 - RNA, 19 nt, Homo sapiens
ucaccgucauggagaagug

SEQ ID NO: 572597 - RNA, 19 nt, Homo sapiens
gcaagacgcgcaggaagac

SEQ ID NO: 572598 - RNA, 19 nt, Homo sapiens
gggcagagagugguacuac

SEQ ID NO: 572599 - RNA, 19 nt, Homo sapiens
ugauugagaagccggagaa

SEQ ID NO: 572600 - RNA, 19 nt, Homo sapiens
agaacaaacacuucaaggu

SEQ ID NO: 572601 - RNA, 19 nt, Homo sapiens
cuuaaagcgucagggaaga

SEQ ID NO: 572602 - RNA, 19 nt, Homo sapiens
uugagaagccggagaacga

SEQ ID NO: 572603 - RNA, 19 nt, Homo sapiens
ccgaggaggagcucaacuu

SEQ ID NO: 572604 - RNA, 19 nt, Homo sapiens
ugaaagaugacagaagaag

SEQ ID NO: 572605 - RNA, 19 nt, Homo sapiens
gcgucaccgucauggagaa

SEQ ID NO: 572606 - RNA, 19 nt, Homo sapiens
ggagcuggacaucaagaag

SEQ ID NO: 572607 - RNA, 19 nt, Homo sapiens
gaaaggaaauacuguguua

SEQ ID NO: 572608 - RNA, 19 nt, Homo sapiens
gacauugacuccuaaauuu

SEQ ID NO: 572609 - RNA, 19 nt, Homo sapiens
gcacaucacucuccucaug

SEQ ID NO: 572610 - RNA, 19 nt, Homo sapiens
uaauaaaccugcugaagaa

SEQ ID NO: 572611 - RNA, 19 nt, Homo sapiens
ggaagugagugagaucuua

SEQ ID NO: 572612 - RNA, 19 nt, Homo sapiens
gaaagaggaugucuacagu

SEQ ID NO: 572613 - RNA, 19 nt, Homo sapiens
caagauacauuccucagaa

SEQ ID NO: 572614 - RNA, 19 nt, Homo sapiens
caagguaccucucaauguu

SEQ ID NO: 572615 - RNA, 19 nt, Homo sapiens
guacuuggcugcagucaga

SEQ ID NO: 572616 - RNA, 19 nt, Homo sapiens
acacaccucuugucuauaa

SEQ ID NO: 572617 - RNA, 19 nt, Homo sapiens
gaagguguguguaaaugaa

SEQ ID NO: 572618 - RNA, 19 nt, Homo sapiens
caagucagcuucucgauca

SEQ ID NO: 572619 - RNA, 19 nt, Homo sapiens
ggagauucauuaugucauu

SEQ ID NO: 572620 - RNA, 19 nt, Homo sapiens
gcaaguaccuuuugaguga

SEQ ID NO: 572621 - RNA, 19 nt, Homo sapiens
uuaaacagcuuuccaagga

SEQ ID NO: 572622 - RNA, 19 nt, Homo sapiens
gaagaaaugcuugguugua

SEQ ID NO: 572623 - RNA, 19 nt, Homo sapiens
gggaugaguuugaagauau

SEQ ID NO: 572624 - RNA, 19 nt, Homo sapiens
gcaguagcauugcagauga

SEQ ID NO: 572625 - RNA, 19 nt, Homo sapiens
gggaagagaugaucauugg

SEQ ID NO: 572626 - RNA, 19 nt, Homo sapiens
cuacacaccucuugucuau

SEQ ID NO: 572627 - RNA, 19 nt, Homo sapiens
gaaacacacuaaaggacuu

SEQ ID NO: 572628 - RNA, 19 nt, Homo sapiens
gaagagaugaucauuggaa

SEQ ID NO: 572629 - RNA, 19 nt, Homo sapiens
ggaaccagcugcucaacau

SEQ ID NO: 572630 - RNA, 19 nt, Homo sapiens
gaaacagucugaggacaug

SEQ ID NO: 572631 - RNA, 19 nt, Homo sapiens
gaagagaggaggcauguca

SEQ ID NO: 572632 - RNA, 19 nt, Homo sapiens
aaauggagcuucugcaaau

SEQ ID NO: 572633 - RNA, 19 nt, Homo sapiens
gccaagacauugacuccua

SEQ ID NO: 572634 - RNA, 19 nt, Homo sapiens
guaguguucucaauucuga

SEQ ID NO: 572635 - RNA, 19 nt, Homo sapiens
gaaagauucucucugaaaa

SEQ ID NO: 572636 - RNA, 19 nt, Homo sapiens
gcugaaagccagaaagauu

SEQ ID NO: 572637 - RNA, 19 nt, Homo sapiens
guaggacucuuuaaaccuu

SEQ ID NO: 572638 - RNA, 19 nt, Homo sapiens
ucacugaaguugccuacaa

SEQ ID NO: 572639 - RNA, 19 nt, Homo sapiens
caacaaacagggaaguaaa

SEQ ID NO: 572640 - RNA, 19 nt, Homo sapiens
ucauuuggccugauaauaa

SEQ ID NO: 572641 - RNA, 19 nt, Homo sapiens
gaaggacucauuacaacaa

SEQ ID NO: 572642 - RNA, 19 nt, Homo sapiens
cgaaagacauccuaguuac

SEQ ID NO: 572643 - RNA, 19 nt, Homo sapiens
aagaaaugcuugguuguaa

SEQ ID NO: 572644 - RNA, 19 nt, Homo sapiens
ggaaauacuguguuagaau

SEQ ID NO: 572645 - RNA, 19 nt, Homo sapiens
ccaagacauugacuccuaa

SEQ ID NO: 572646 - RNA, 19 nt, Homo sapiens
ggaugaguuugaagauauu

SEQ ID NO: 572647 - RNA, 19 nt, Homo sapiens
uaaaccugcugaagaaguu

SEQ ID NO: 572648 - RNA, 19 nt, Homo sapiens
gagcucauauaacuugguu

SEQ ID NO: 572649 - RNA, 19 nt, Homo sapiens
gaaaugcuugguuguaaga

SEQ ID NO: 572650 - RNA, 19 nt, Homo sapiens
ugaaaugagucacaaacug

SEQ ID NO: 572651 - RNA, 19 nt, Homo sapiens
cugaggagauucauuaugu

SEQ ID NO: 572652 - RNA, 19 nt, Homo sapiens
ccauguaaaccaauugaua

SEQ ID NO: 572653 - RNA, 19 nt, Homo sapiens
uguauuaucuucugaugug

SEQ ID NO: 572654 - RNA, 19 nt, Homo sapiens
cauuuggccugauaauaaa

SEQ ID NO: 572655 - RNA, 19 nt, Homo sapiens
aagaggaugucuacaguug

SEQ ID NO: 572656 - RNA, 19 nt, Homo sapiens
ggaaagaggaugucuacag

SEQ ID NO: 572657 - RNA, 19 nt, Homo sapiens
cuacugggcuguauucucu

SEQ ID NO: 572658 - RNA, 19 nt, Homo sapiens
cguaauuacucucaucgaa

SEQ ID NO: 572659 - RNA, 19 nt, Homo sapiens
gacuugaaauuugcaauga

SEQ ID NO: 572660 - RNA, 19 nt, Homo sapiens
gauguauuaucuucugaug

SEQ ID NO: 572661 - RNA, 19 nt, Homo sapiens
ccauacaagugacuacgaa

SEQ ID NO: 572662 - RNA, 19 nt, Homo sapiens
agacauugacuccuaaauu

SEQ ID NO: 572663 - RNA, 19 nt, Homo sapiens
ggaaguaaaggaagagaca

SEQ ID NO: 572664 - RNA, 19 nt, Homo sapiens
guaagacaccaauaggaaa

SEQ ID NO: 572665 - RNA, 19 nt, Homo sapiens
ucagauaauuugcaaguac

SEQ ID NO: 572666 - RNA, 19 nt, Homo sapiens
cauccuaguuacagagaaa

SEQ ID NO: 572667 - RNA, 19 nt, Homo sapiens
gaagcaaucaguuuacucu

SEQ ID NO: 572668 - RNA, 19 nt, Homo sapiens
gaaccugccacaaccaaau

SEQ ID NO: 572669 - RNA, 19 nt, Homo sapiens
gaaagacauccuaguuaca

SEQ ID NO: 572670 - RNA, 19 nt, Homo sapiens
gagccgggauccuguguag

SEQ ID NO: 572671 - RNA, 19 nt, Homo sapiens
aaacagggaaguaaaggaa

SEQ ID NO: 572672 - RNA, 19 nt, Homo sapiens
gagaggaagugagugagau

SEQ ID NO: 572673 - RNA, 19 nt, Homo sapiens
acgaaagacauccuaguua

SEQ ID NO: 572674 - RNA, 19 nt, Homo sapiens
gaaggcuguuaccugcuuu

SEQ ID NO: 572675 - RNA, 19 nt, Homo sapiens
gaaguggucgaugggcuua

SEQ ID NO: 572676 - RNA, 19 nt, Homo sapiens
aagcauccauguguacuuu

SEQ ID NO: 572677 - RNA, 19 nt, Homo sapiens
ccaauuaguaucaguuaug

SEQ ID NO: 572678 - RNA, 19 nt, Homo sapiens
guuaugcuccuguugaauu

SEQ ID NO: 572679 - RNA, 19 nt, Homo sapiens
ccuaauaguugcuguucug

SEQ ID NO: 572680 - RNA, 19 nt, Homo sapiens
gagcuucugcaaauugaaa

SEQ ID NO: 572681 - RNA, 19 nt, Homo sapiens
agucggagcucauauaacu

SEQ ID NO: 572682 - RNA, 19 nt, Homo sapiens
gaaugguuaugcuccuguu

SEQ ID NO: 572683 - RNA, 19 nt, Homo sapiens
guuuguaucugacacuaug

SEQ ID NO: 572684 - RNA, 19 nt, Homo sapiens
aaagugggaugaguuugaa

SEQ ID NO: 572685 - RNA, 19 nt, Homo sapiens
auaauaaaccugcugaaga

SEQ ID NO: 572686 - RNA, 19 nt, Homo sapiens
uaccuugucccaauuagua

SEQ ID NO: 572687 - RNA, 19 nt, Homo sapiens
aggaaucccuucaaucugu

SEQ ID NO: 572688 - RNA, 19 nt, Homo sapiens
caccacggcuuagcaaaga

SEQ ID NO: 572689 - RNA, 19 nt, Homo sapiens
uaagggaauuacuccaugu

SEQ ID NO: 572690 - RNA, 19 nt, Homo sapiens
ggagcaccaccacggcuua

SEQ ID NO: 572691 - RNA, 19 nt, Homo sapiens
gagaaaggaaauacugugu

SEQ ID NO: 572692 - RNA, 19 nt, Homo sapiens
ccaggcauuuggaggguuu

SEQ ID NO: 572693 - RNA, 19 nt, Homo sapiens
gauaauaaaccugcugaag

SEQ ID NO: 572694 - RNA, 19 nt, Homo sapiens
gaaguugccuacaaaaugg

SEQ ID NO: 572695 - RNA, 19 nt, Homo sapiens
gauccugugucacuucgau

SEQ ID NO: 572696 - RNA, 19 nt, Homo sapiens
aauguaguguucucaauuc

SEQ ID NO: 572697 - RNA, 19 nt, Homo sapiens
gaucaagguaccucucaau

SEQ ID NO: 572698 - RNA, 19 nt, Homo sapiens
ucaaagaccaggugauucu

SEQ ID NO: 572699 - RNA, 19 nt, Homo sapiens
uuuggaggguuucucauuu

SEQ ID NO: 572700 - RNA, 19 nt, Homo sapiens
aauaguugcuguucugcuu

SEQ ID NO: 572701 - RNA, 19 nt, Homo sapiens
aagauacauuccucagaaa

SEQ ID NO: 572702 - RNA, 19 nt, Homo sapiens
ugggaugaguuugaagaua

SEQ ID NO: 572703 - RNA, 19 nt, Homo sapiens
gaagaagguauucagaaac

SEQ ID NO: 572704 - RNA, 19 nt, Homo sapiens
acagggaaguaaaggaaga

SEQ ID NO: 572705 - RNA, 19 nt, Homo sapiens
ucacguaauuacucucauc

SEQ ID NO: 572706 - RNA, 19 nt, Homo sapiens
gaaaugcuacacaccucuu

SEQ ID NO: 572707 - RNA, 19 nt, Homo sapiens
gaugauagaugaaaccaaa

SEQ ID NO: 572708 - RNA, 19 nt, Homo sapiens
cuacagagcuccagaaauc

SEQ ID NO: 572709 - RNA, 19 nt, Homo sapiens
gaaaagacauggaguuauu

SEQ ID NO: 572710 - RNA, 19 nt, Homo sapiens
cagaagcucuacacauaua

SEQ ID NO: 572711 - RNA, 19 nt, Homo sapiens
gcacaccaauugacauaug

SEQ ID NO: 572712 - RNA, 19 nt, Homo sapiens
gaaagggugugaugacuac

SEQ ID NO: 572713 - RNA, 19 nt, Homo sapiens
gaacaagcccugaagcaau

SEQ ID NO: 572714 - RNA, 19 nt, Homo sapiens
ggaauagccaauaagcuua

SEQ ID NO: 572715 - RNA, 19 nt, Homo sapiens
uuacaaaccugcaaaugga

SEQ ID NO: 572716 - RNA, 19 nt, Homo sapiens
ccaucuagcuuaucgauau

SEQ ID NO: 572717 - RNA, 19 nt, Homo sapiens
gaggugagaugaagguaga

SEQ ID NO: 572718 - RNA, 19 nt, Homo sapiens
accagaagcucuacacaua

SEQ ID NO: 572719 - RNA, 19 nt, Homo sapiens
gaugacuacuuguuuauag

SEQ ID NO: 572720 - RNA, 19 nt, Homo sapiens
gcgcugagcugcagugucu

SEQ ID NO: 572721 - RNA, 19 nt, Homo sapiens
aacaagcccugaagcaaua

SEQ ID NO: 572722 - RNA, 19 nt, Homo sapiens
gcccagagaugcauaugug

SEQ ID NO: 572723 - RNA, 19 nt, Homo sapiens
uuaagacacccuuggauua

SEQ ID NO: 572724 - RNA, 19 nt, Homo sapiens
ugugaugacuacuuguuua

SEQ ID NO: 572725 - RNA, 19 nt, Homo sapiens
gacaguacguggcccuaaa

SEQ ID NO: 572726 - RNA, 19 nt, Homo sapiens
gauaugaggugcugaaaau

SEQ ID NO: 572727 - RNA, 19 nt, Homo sapiens
gaauagccaauaagcuuaa

SEQ ID NO: 572728 - RNA, 19 nt, Homo sapiens
ucaagaauuuggcaacaga

SEQ ID NO: 572729 - RNA, 19 nt, Homo sapiens
ccagaaaucaucuuaggaa

SEQ ID NO: 572730 - RNA, 19 nt, Homo sapiens
cuaauuaccuaaccagcuu

SEQ ID NO: 572731 - RNA, 19 nt, Homo sapiens
ggucuaugaucacaaacuu

SEQ ID NO: 572732 - RNA, 19 nt, Homo sapiens
acagagauaugcccagaga

SEQ ID NO: 572733 - RNA, 19 nt, Homo sapiens
caauugacauauggaguuu

SEQ ID NO: 572734 - RNA, 19 nt, Homo sapiens
ccagaaauuuacuuuguag

SEQ ID NO: 572735 - RNA, 19 nt, Homo sapiens
ccacccagaagacuaaaua

SEQ ID NO: 572736 - RNA, 19 nt, Homo sapiens
gaccccagcucaagcauua

SEQ ID NO: 572737 - RNA, 19 nt, Homo sapiens
gcacugaaagggugugaug

SEQ ID NO: 572738 - RNA, 19 nt, Homo sapiens
ggauaaaacugguaguaug

SEQ ID NO: 572739 - RNA, 19 nt, Homo sapiens
ucacaaacuucgacaguac

SEQ ID NO: 572740 - RNA, 19 nt, Homo sapiens
guucaaauguacucugcaa

SEQ ID NO: 572741 - RNA, 19 nt, Homo sapiens
uaagcugccuccaguuguu

SEQ ID NO: 572742 - RNA, 19 nt, Homo sapiens
ggaaacggguaguuaaucc

SEQ ID NO: 572743 - RNA, 19 nt, Homo sapiens
ggaugaaggagaccaguug

SEQ ID NO: 572744 - RNA, 19 nt, Homo sapiens
cagggucuaugaucacaaa

SEQ ID NO: 572745 - RNA, 19 nt, Homo sapiens
uaugaccgcugagcaguuu

SEQ ID NO: 572746 - RNA, 19 nt, Homo sapiens
cccagaagacuaaauauga

SEQ ID NO: 572747 - RNA, 19 nt, Homo sapiens
caagugcuuuccagggauu

SEQ ID NO: 572748 - RNA, 19 nt, Homo sapiens
aaacgugccaaguacuuua

SEQ ID NO: 572749 - RNA, 19 nt, Homo sapiens
cagcacaccaauugacaua

SEQ ID NO: 572750 - RNA, 19 nt, Homo sapiens
cgugccaaguacuuuauua

SEQ ID NO: 572751 - RNA, 19 nt, Homo sapiens
uggagcaucuuaagaaaca

SEQ ID NO: 572752 - RNA, 19 nt, Homo sapiens
gcaaugagaagcgcuuuca

SEQ ID NO: 572753 - RNA, 19 nt, Homo sapiens
ucagauugcuugaauacag

SEQ ID NO: 572754 - RNA, 19 nt, Homo sapiens
ccaauugacauauggaguu

SEQ ID NO: 572755 - RNA, 19 nt, Homo sapiens
uugcauggccuuugaauug

SEQ ID NO: 572756 - RNA, 19 nt, Homo sapiens
ucaagcagcugaggagauc

SEQ ID NO: 572757 - RNA, 19 nt, Homo sapiens
ggauggaggugagaugaag

SEQ ID NO: 572758 - RNA, 19 nt, Homo sapiens
caucuggaauaugcauuaa

SEQ ID NO: 572759 - RNA, 19 nt, Homo sapiens
ccagagaugcauaugugua

SEQ ID NO: 572760 - RNA, 19 nt, Homo sapiens
acagcuguuucaagaauuu

SEQ ID NO: 572761 - RNA, 19 nt, Homo sapiens
ccaguuggccugcaugaug

SEQ ID NO: 572762 - RNA, 19 nt, Homo sapiens
gaucacaaacuucgacagu

SEQ ID NO: 572763 - RNA, 19 nt, Homo sapiens
ucagggaaacggguaguua

SEQ ID NO: 572764 - RNA, 19 nt, Homo sapiens
guaugaacguuauccacau

SEQ ID NO: 572765 - RNA, 19 nt, Homo sapiens
gaucuuacaaaccugcaaa

SEQ ID NO: 572766 - RNA, 19 nt, Homo sapiens
gagaccaucuagcuuaucg

SEQ ID NO: 572767 - RNA, 19 nt, Homo sapiens
ccaucuggaauaugcauua

SEQ ID NO: 572768 - RNA, 19 nt, Homo sapiens
uggaauagccaauaagcuu

SEQ ID NO: 572769 - RNA, 19 nt, Homo sapiens
cagggaaacggguaguuaa

SEQ ID NO: 572770 - RNA, 19 nt, Homo sapiens
ccagaagacuaaauaugac

SEQ ID NO: 572771 - RNA, 19 nt, Homo sapiens
gaagcgcuuucaucgucaa

SEQ ID NO: 572772 - RNA, 19 nt, Homo sapiens
uucaagggcuaauuaccua

SEQ ID NO: 572773 - RNA, 19 nt, Homo sapiens
agagaugcauauguguaua

SEQ ID NO: 572774 - RNA, 19 nt, Homo sapiens
gagaucauacucagcacuu

SEQ ID NO: 572775 - RNA, 19 nt, Homo sapiens
caucuuaagaaacaggaua

SEQ ID NO: 572776 - RNA, 19 nt, Homo sapiens
gcauuaagacacccuugga

SEQ ID NO: 572777 - RNA, 19 nt, Homo sapiens
ugaaagggugugaugacua

SEQ ID NO: 572778 - RNA, 19 nt, Homo sapiens
aauccaaacgugccaagua

SEQ ID NO: 572779 - RNA, 19 nt, Homo sapiens
cuacacauauauccagucu

SEQ ID NO: 572780 - RNA, 19 nt, Homo sapiens
ucaaauguacucugcaauc

SEQ ID NO: 572781 - RNA, 19 nt, Homo sapiens
gugccaaguacuuuauuaa

SEQ ID NO: 572782 - RNA, 19 nt, Homo sapiens
gauaaaacugguaguauga

SEQ ID NO: 572783 - RNA, 19 nt, Homo sapiens
gaaccaccuccacccagaa

SEQ ID NO: 572784 - RNA, 19 nt, Homo sapiens
cagagaugcauauguguau

SEQ ID NO: 572785 - RNA, 19 nt, Homo sapiens
aauguacucugcaauccuu

SEQ ID NO: 572786 - RNA, 19 nt, Homo sapiens
cuacuuguuuauagaguuc

SEQ ID NO: 572787 - RNA, 19 nt, Homo sapiens
caaacgugccaaguacuuu

SEQ ID NO: 572788 - RNA, 19 nt, Homo sapiens
uaugaacguuauccacaug

SEQ ID NO: 572789 - RNA, 19 nt, Homo sapiens
gcugaggagauccggauuu

SEQ ID NO: 572790 - RNA, 19 nt, Homo sapiens
ucauguaccucgagaccau

SEQ ID NO: 572791 - RNA, 19 nt, Homo sapiens
agagauaugcccagagaug

SEQ ID NO: 572792 - RNA, 19 nt, Homo sapiens
aagcuaacuuaaugucaga

SEQ ID NO: 572793 - RNA, 19 nt, Homo sapiens
gguaguuaauccugcaagu

SEQ ID NO: 572794 - RNA, 19 nt, Homo sapiens
ccagaccucucaccaccau

SEQ ID NO: 572795 - RNA, 19 nt, Homo sapiens
uaagacacccuuggauuag

SEQ ID NO: 572796 - RNA, 19 nt, Homo sapiens
ccaaacgugccaaguacuu

SEQ ID NO: 572797 - RNA, 19 nt, Homo sapiens
uaacaggacagccucucuu

SEQ ID NO: 572798 - RNA, 19 nt, Homo sapiens
ccagaagcucuacacauau

SEQ ID NO: 572799 - RNA, 19 nt, Homo sapiens
gcagguggccagggucuau

SEQ ID NO: 572800 - RNA, 19 nt, Homo sapiens
ccaguugguacgcaaguuu

SEQ ID NO: 572801 - RNA, 19 nt, Homo sapiens
caaauguacucugcaaucc

SEQ ID NO: 572802 - RNA, 19 nt, Homo sapiens
cagauugcuugaauacagu

SEQ ID NO: 572803 - RNA, 19 nt, Homo sapiens
gcuaguggacagagauaug

SEQ ID NO: 572804 - RNA, 19 nt, Homo sapiens
gauagaugaaaccaaaugu

SEQ ID NO: 572805 - RNA, 19 nt, Homo sapiens
gacuuuggguccagcuguu

SEQ ID NO: 572806 - RNA, 19 nt, Homo sapiens
caucuagcuuaucgauaug

SEQ ID NO: 572807 - RNA, 19 nt, Homo sapiens
gcacagagauuauuguauu

SEQ ID NO: 572808 - RNA, 19 nt, Homo sapiens
guaaagaagccucauauua

SEQ ID NO: 572809 - RNA, 19 nt, Homo sapiens
caaagaagauuuagcagau

SEQ ID NO: 572810 - RNA, 19 nt, Homo sapiens
ggacaaggauaacacaaug

SEQ ID NO: 572811 - RNA, 19 nt, Homo sapiens
gggaaacuaucaacucuuu

SEQ ID NO: 572812 - RNA, 19 nt, Homo sapiens
caaaugggcuuacaacagu

SEQ ID NO: 572813 - RNA, 19 nt, Homo sapiens
ggacagugcucacgacaca

SEQ ID NO: 572814 - RNA, 19 nt, Homo sapiens
ggacaaugcuuuaaguuuu

SEQ ID NO: 572815 - RNA, 19 nt, Homo sapiens
uagaagcgguauuaaagua

SEQ ID NO: 572816 - RNA, 19 nt, Homo sapiens
cagcuacccugaaauauau

SEQ ID NO: 572817 - RNA, 19 nt, Homo sapiens
caauaacucuacucauuug

SEQ ID NO: 572818 - RNA, 19 nt, Homo sapiens
gcaguaagcacacaaugaa

SEQ ID NO: 572819 - RNA, 19 nt, Homo sapiens
guacagauuaggauaagua

SEQ ID NO: 572820 - RNA, 19 nt, Homo sapiens
gcugguaaccugaaagaua

SEQ ID NO: 572821 - RNA, 19 nt, Homo sapiens
uaaagaagccucauauuac

SEQ ID NO: 572822 - RNA, 19 nt, Homo sapiens
ggaagcaggacaaggauaa

SEQ ID NO: 572823 - RNA, 19 nt, Homo sapiens
gcacguggcccuaaagaug

SEQ ID NO: 572824 - RNA, 19 nt, Homo sapiens
ucacguggcuuacagguau

SEQ ID NO: 572825 - RNA, 19 nt, Homo sapiens
gcauuuaguuugucuucuu

SEQ ID NO: 572826 - RNA, 19 nt, Homo sapiens
acaaugagccuuacuguau

SEQ ID NO: 572827 - RNA, 19 nt, Homo sapiens
aaagaagccucauauuaca

SEQ ID NO: 572828 - RNA, 19 nt, Homo sapiens
caaugagccuuacuguauu

SEQ ID NO: 572829 - RNA, 19 nt, Homo sapiens
ggacuaauuuggcgcagau

SEQ ID NO: 572830 - RNA, 19 nt, Homo sapiens
ucacaucuauauccaaguu

SEQ ID NO: 572831 - RNA, 19 nt, Homo sapiens
gcaggccacugauuacuuc

SEQ ID NO: 572832 - RNA, 19 nt, Homo sapiens
cucaauaacucuacucauu

SEQ ID NO: 572833 - RNA, 19 nt, Homo sapiens
cagcuggccuguaugauug

SEQ ID NO: 572834 - RNA, 19 nt, Homo sapiens
caacaaugguggcuaugau

SEQ ID NO: 572835 - RNA, 19 nt, Homo sapiens
gcuuauauaugcacagaga

SEQ ID NO: 572836 - RNA, 19 nt, Homo sapiens
ggagaacggucagaaucaa

SEQ ID NO: 572837 - RNA, 19 nt, Homo sapiens
caaguuaccuccaccuucu

SEQ ID NO: 572838 - RNA, 19 nt, Homo sapiens
aaaguucaaccucaaguua

SEQ ID NO: 572839 - RNA, 19 nt, Homo sapiens
gggaccagcuggccuguau

SEQ ID NO: 572840 - RNA, 19 nt, Homo sapiens
gagcucaucaagaagaaua

SEQ ID NO: 572841 - RNA, 19 nt, Homo sapiens
uaaagauggugcggaauga

SEQ ID NO: 572842 - RNA, 19 nt, Homo sapiens
aacaagcaaugaagcaaua

SEQ ID NO: 572843 - RNA, 19 nt, Homo sapiens
aaagauuucugccuguuug

SEQ ID NO: 572844 - RNA, 19 nt, Homo sapiens
caaguuaaaugguuugacu

SEQ ID NO: 572845 - RNA, 19 nt, Homo sapiens
cacuuuggcuguucaguaa

SEQ ID NO: 572846 - RNA, 19 nt, Homo sapiens
gguagaagcgguauuaaag

SEQ ID NO: 572847 - RNA, 19 nt, Homo sapiens
gaacaagcaaugaagcaau

SEQ ID NO: 572848 - RNA, 19 nt, Homo sapiens
ucaguaaggccaauguuaa

SEQ ID NO: 572849 - RNA, 19 nt, Homo sapiens
ggauaaaugggaauggaaa

SEQ ID NO: 572850 - RNA, 19 nt, Homo sapiens
guaagcacacaaugaauga

SEQ ID NO: 572851 - RNA, 19 nt, Homo sapiens
acagcagccuagcuacuua

SEQ ID NO: 572852 - RNA, 19 nt, Homo sapiens
uaugaucggugagcuguuu

SEQ ID NO: 572853 - RNA, 19 nt, Homo sapiens
ccaaacugaggacuaauuu

SEQ ID NO: 572854 - RNA, 19 nt, Homo sapiens
gauaacacaaugaauguca

SEQ ID NO: 572855 - RNA, 19 nt, Homo sapiens
caugacaccugaacaagca

SEQ ID NO: 572856 - RNA, 19 nt, Homo sapiens
gcagaauaauaacaucagu

SEQ ID NO: 572857 - RNA, 19 nt, Homo sapiens
gagaaaacgucagugaaaa

SEQ ID NO: 572858 - RNA, 19 nt, Homo sapiens
guaguacagauuaggauaa

SEQ ID NO: 572859 - RNA, 19 nt, Homo sapiens
gaguagcucagaccuguuu

SEQ ID NO: 572860 - RNA, 19 nt, Homo sapiens
cagagcuccugacggguua

SEQ ID NO: 572861 - RNA, 19 nt, Homo sapiens
ggauugcacugauuguuuu

SEQ ID NO: 572862 - RNA, 19 nt, Homo sapiens
cagccuagcuacuuaaggu

SEQ ID NO: 572863 - RNA, 19 nt, Homo sapiens
gugauuaugaccauuguuu

SEQ ID NO: 572864 - RNA, 19 nt, Homo sapiens
aaacuguaccuuagagauu

SEQ ID NO: 572865 - RNA, 19 nt, Homo sapiens
ugacuuauucuucguauca

SEQ ID NO: 572866 - RNA, 19 nt, Homo sapiens
gaggagaacggucagaauc

SEQ ID NO: 572867 - RNA, 19 nt, Homo sapiens
gagccuuacuguauuuagu

SEQ ID NO: 572868 - RNA, 19 nt, Homo sapiens
ggagaaaacgucagugaaa

SEQ ID NO: 572869 - RNA, 19 nt, Homo sapiens
caggguagaagcgguauua

SEQ ID NO: 572870 - RNA, 19 nt, Homo sapiens
caaguuugcccacucgauu

SEQ ID NO: 572871 - RNA, 19 nt, Homo sapiens
gcccaacaaugguggcuau

SEQ ID NO: 572872 - RNA, 19 nt, Homo sapiens
gcagaugacagaugccaau

SEQ ID NO: 572873 - RNA, 19 nt, Homo sapiens
gguaguacagauuaggaua

SEQ ID NO: 572874 - RNA, 19 nt, Homo sapiens
ugaggacaaugcuuuaagu

SEQ ID NO: 572875 - RNA, 19 nt, Homo sapiens
gagccuuacuggguugaaa

SEQ ID NO: 572876 - RNA, 19 nt, Homo sapiens
ccugaaagauacgacauug

SEQ ID NO: 572877 - RNA, 19 nt, Homo sapiens
ggugcuaucacaucuauau

SEQ ID NO: 572878 - RNA, 19 nt, Homo sapiens
ggguagaagcgguauuaaa

SEQ ID NO: 572879 - RNA, 19 nt, Homo sapiens
acuaauguaugagcaauga

SEQ ID NO: 572880 - RNA, 19 nt, Homo sapiens
ugaaugaucaccugcaugu

SEQ ID NO: 572881 - RNA, 19 nt, Homo sapiens
gaaagaggguugaaaaucc

SEQ ID NO: 572882 - RNA, 19 nt, Homo sapiens
ugaccauuguuucauauuc

SEQ ID NO: 572883 - RNA, 19 nt, Homo sapiens
uaguguggcagaauaauaa

SEQ ID NO: 572884 - RNA, 19 nt, Homo sapiens
aaugagccuuacuguauuu

SEQ ID NO: 572885 - RNA, 19 nt, Homo sapiens
ccagcuggccuguaugauu

SEQ ID NO: 572886 - RNA, 19 nt, Homo sapiens
uuaccgggcuccagaagug

SEQ ID NO: 572887 - RNA, 19 nt, Homo sapiens
ggccuacgaucacaaaguc

SEQ ID NO: 572888 - RNA, 19 nt, Homo sapiens
ccagugaggccaagaaagu

SEQ ID NO: 572889 - RNA, 19 nt, Homo sapiens
ucacuuuggcuguucagua

SEQ ID NO: 572890 - RNA, 19 nt, Homo sapiens
ucaaagugacauucuaaga

SEQ ID NO: 572891 - RNA, 19 nt, Homo sapiens
uaaauuaaucuggguguug

SEQ ID NO: 572892 - RNA, 19 nt, Homo sapiens
cuuccaaacugaggacuaa

SEQ ID NO: 572893 - RNA, 19 nt, Homo sapiens
gauuaugaccauuguuuca

SEQ ID NO: 572894 - RNA, 19 nt, Homo sapiens
ucggugagcuguuuuguaa

SEQ ID NO: 572895 - RNA, 19 nt, Homo sapiens
caguuagcauucugacauu

SEQ ID NO: 572896 - RNA, 19 nt, Homo sapiens
gagaacggucagaaucaaa

SEQ ID NO: 572897 - RNA, 19 nt, Homo sapiens
gaccagcuggccuguauga

SEQ ID NO: 572898 - RNA, 19 nt, Homo sapiens
uagaagaaccccagagaua

SEQ ID NO: 572899 - RNA, 19 nt, Homo sapiens
gaacagcagccuagcuacu

SEQ ID NO: 572900 - RNA, 19 nt, Homo sapiens
cauuucagcugugauuaug

SEQ ID NO: 572901 - RNA, 19 nt, Homo sapiens
ggcaguaagcacacaauga

SEQ ID NO: 572902 - RNA, 19 nt, Homo sapiens
guaaggccaauguuaacaa

SEQ ID NO: 572903 - RNA, 19 nt, Homo sapiens
gggauuucauaguuccaaa

SEQ ID NO: 572904 - RNA, 19 nt, Homo sapiens
ggccacugauuacuucaug

SEQ ID NO: 572905 - RNA, 19 nt, Homo sapiens
guacaaugagccuuacugu

SEQ ID NO: 572906 - RNA, 19 nt, Homo sapiens
cgacauugcugagccuuac

SEQ ID NO: 572907 - RNA, 19 nt, Homo sapiens
gcacagagauuauuguauu

SEQ ID NO: 572908 - RNA, 19 nt, Homo sapiens
guaaagaagccucauauua

SEQ ID NO: 572909 - RNA, 19 nt, Homo sapiens
caaagaagauuuagcagau

SEQ ID NO: 572910 - RNA, 19 nt, Homo sapiens
ggacaaggauaacacaaug

SEQ ID NO: 572911 - RNA, 19 nt, Homo sapiens
gggaaacuaucaacucuuu

SEQ ID NO: 572912 - RNA, 19 nt, Homo sapiens
caaaugggcuuacaacagu

SEQ ID NO: 572913 - RNA, 19 nt, Homo sapiens
ggacagugcucacgacaca

SEQ ID NO: 572914 - RNA, 19 nt, Homo sapiens
ggacaaugcuuuaaguuuu

SEQ ID NO: 572915 - RNA, 19 nt, Homo sapiens
uagaagcgguauuaaagua

SEQ ID NO: 572916 - RNA, 19 nt, Homo sapiens
cagcuacccugaaauauau

SEQ ID NO: 572917 - RNA, 19 nt, Homo sapiens
caauaacucuacucauuug

SEQ ID NO: 572918 - RNA, 19 nt, Homo sapiens
gcaguaagcacacaaugaa

SEQ ID NO: 572919 - RNA, 19 nt, Homo sapiens
guacagauuaggauaagua

SEQ ID NO: 572920 - RNA, 19 nt, Homo sapiens
gcugguaaccugaaagaua

SEQ ID NO: 572921 - RNA, 19 nt, Homo sapiens
uaaagaagccucauauuac

SEQ ID NO: 572922 - RNA, 19 nt, Homo sapiens
ggaagcaggacaaggauaa

SEQ ID NO: 572923 - RNA, 19 nt, Homo sapiens
gcacguggcccuaaagaug

SEQ ID NO: 572924 - RNA, 19 nt, Homo sapiens
ucacguggcuuacagguau

SEQ ID NO: 572925 - RNA, 19 nt, Homo sapiens
gcauuuaguuugucuucuu

SEQ ID NO: 572926 - RNA, 19 nt, Homo sapiens
acaaugagccuuacuguau

SEQ ID NO: 572927 - RNA, 19 nt, Homo sapiens
aaagaagccucauauuaca

SEQ ID NO: 572928 - RNA, 19 nt, Homo sapiens
caaugagccuuacuguauu

SEQ ID NO: 572929 - RNA, 19 nt, Homo sapiens
ggacuaauuuggcgcagau

SEQ ID NO: 572930 - RNA, 19 nt, Homo sapiens
ucacaucuauauccaaguu

SEQ ID NO: 572931 - RNA, 19 nt, Homo sapiens
gcaggccacugauuacuuc

SEQ ID NO: 572932 - RNA, 19 nt, Homo sapiens
cucaauaacucuacucauu

SEQ ID NO: 572933 - RNA, 19 nt, Homo sapiens
cagcuggccuguaugauug

SEQ ID NO: 572934 - RNA, 19 nt, Homo sapiens
caacaaugguggcuaugau

SEQ ID NO: 572935 - RNA, 19 nt, Homo sapiens
gcuuauauaugcacagaga

SEQ ID NO: 572936 - RNA, 19 nt, Homo sapiens
ggagaacggucagaaucaa

SEQ ID NO: 572937 - RNA, 19 nt, Homo sapiens
caaguuaccuccaccuucu

SEQ ID NO: 572938 - RNA, 19 nt, Homo sapiens
aaaguucaaccucaaguua

SEQ ID NO: 572939 - RNA, 19 nt, Homo sapiens
gggaccagcuggccuguau

SEQ ID NO: 572940 - RNA, 19 nt, Homo sapiens
gagcucaucaagaagaaua

SEQ ID NO: 572941 - RNA, 19 nt, Homo sapiens
uaaagauggugcggaauga

SEQ ID NO: 572942 - RNA, 19 nt, Homo sapiens
aacaagcaaugaagcaaua

SEQ ID NO: 572943 - RNA, 19 nt, Homo sapiens
aaagauuucugccuguuug

SEQ ID NO: 572944 - RNA, 19 nt, Homo sapiens
caaguuaaaugguuugacu

SEQ ID NO: 572945 - RNA, 19 nt, Homo sapiens
cacuuuggcuguucaguaa

SEQ ID NO: 572946 - RNA, 19 nt, Homo sapiens
gguagaagcgguauuaaag

SEQ ID NO: 572947 - RNA, 19 nt, Homo sapiens
gaacaagcaaugaagcaau

SEQ ID NO: 572948 - RNA, 19 nt, Homo sapiens
ucaguaaggccaauguuaa

SEQ ID NO: 572949 - RNA, 19 nt, Homo sapiens
guaagcacacaaugaauga

SEQ ID NO: 572950 - RNA, 19 nt, Homo sapiens
ggauaaaugggaauggaaa

SEQ ID NO: 572951 - RNA, 19 nt, Homo sapiens
acagcagccuagcuacuua

SEQ ID NO: 572952 - RNA, 19 nt, Homo sapiens
uaugaucggugagcuguuu

SEQ ID NO: 572953 - RNA, 19 nt, Homo sapiens
ccaaacugaggacuaauuu

SEQ ID NO: 572954 - RNA, 19 nt, Homo sapiens
gauaacacaaugaauguca

SEQ ID NO: 572955 - RNA, 19 nt, Homo sapiens
caugacaccugaacaagca

SEQ ID NO: 572956 - RNA, 19 nt, Homo sapiens
gcagaauaauaacaucagu

SEQ ID NO: 572957 - RNA, 19 nt, Homo sapiens
gagaaaacgucagugaaaa

SEQ ID NO: 572958 - RNA, 19 nt, Homo sapiens
guaguacagauuaggauaa

SEQ ID NO: 572959 - RNA, 19 nt, Homo sapiens
gaguagcucagaccuguuu

SEQ ID NO: 572960 - RNA, 19 nt, Homo sapiens
cagagcuccugacggguua

SEQ ID NO: 572961 - RNA, 19 nt, Homo sapiens
ggauugcacugauuguuuu

SEQ ID NO: 572962 - RNA, 19 nt, Homo sapiens
cagccuagcuacuuaaggu

SEQ ID NO: 572963 - RNA, 19 nt, Homo sapiens
gugauuaugaccauuguuu

SEQ ID NO: 572964 - RNA, 19 nt, Homo sapiens
aaacuguaccuuagagauu

SEQ ID NO: 572965 - RNA, 19 nt, Homo sapiens
ugacuuauucuucguauca

SEQ ID NO: 572966 - RNA, 19 nt, Homo sapiens
gaggagaacggucagaauc

SEQ ID NO: 572967 - RNA, 19 nt, Homo sapiens
gagccuuacuguauuuagu

SEQ ID NO: 572968 - RNA, 19 nt, Homo sapiens
ggagaaaacgucagugaaa

SEQ ID NO: 572969 - RNA, 19 nt, Homo sapiens
caggguagaagcgguauua

SEQ ID NO: 572970 - RNA, 19 nt, Homo sapiens
caaguuugcccacucgauu

SEQ ID NO: 572971 - RNA, 19 nt, Homo sapiens
gcccaacaaugguggcuau

SEQ ID NO: 572972 - RNA, 19 nt, Homo sapiens
gcagaugacagaugccaau

SEQ ID NO: 572973 - RNA, 19 nt, Homo sapiens
gguaguacagauuaggaua

SEQ ID NO: 572974 - RNA, 19 nt, Homo sapiens
ugaggacaaugcuuuaagu

SEQ ID NO: 572975 - RNA, 19 nt, Homo sapiens
gagccuuacuggguugaaa

SEQ ID NO: 572976 - RNA, 19 nt, Homo sapiens
ccugaaagauacgacauug

SEQ ID NO: 572977 - RNA, 19 nt, Homo sapiens
ggugcuaucacaucuauau

SEQ ID NO: 572978 - RNA, 19 nt, Homo sapiens
ggguagaagcgguauuaaa

SEQ ID NO: 572979 - RNA, 19 nt, Homo sapiens
acuaauguaugagcaauga

SEQ ID NO: 572980 - RNA, 19 nt, Homo sapiens
gaaagaggguugaaaaucc

SEQ ID NO: 572981 - RNA, 19 nt, Homo sapiens
ugaaugaucaccugcaugu

SEQ ID NO: 572982 - RNA, 19 nt, Homo sapiens
ugaccauuguuucauauuc

SEQ ID NO: 572983 - RNA, 19 nt, Homo sapiens
uaguguggcagaauaauaa

SEQ ID NO: 572984 - RNA, 19 nt, Homo sapiens
aaugagccuuacuguauuu

SEQ ID NO: 572985 - RNA, 19 nt, Homo sapiens
ccagcuggccuguaugauu

SEQ ID NO: 572986 - RNA, 19 nt, Homo sapiens
uuaccgggcuccagaagug

SEQ ID NO: 572987 - RNA, 19 nt, Homo sapiens
ggccuacgaucacaaaguc

SEQ ID NO: 572988 - RNA, 19 nt, Homo sapiens
ccagugaggccaagaaagu

SEQ ID NO: 572989 - RNA, 19 nt, Homo sapiens
ucacuuuggcuguucagua

SEQ ID NO: 572990 - RNA, 19 nt, Homo sapiens
ucaaagugacauucuaaga

SEQ ID NO: 572991 - RNA, 19 nt, Homo sapiens
uaaauuaaucuggguguug

SEQ ID NO: 572992 - RNA, 19 nt, Homo sapiens
cuuccaaacugaggacuaa

SEQ ID NO: 572993 - RNA, 19 nt, Homo sapiens
gauuaugaccauuguuuca

SEQ ID NO: 572994 - RNA, 19 nt, Homo sapiens
ucggugagcuguuuuguaa

SEQ ID NO: 572995 - RNA, 19 nt, Homo sapiens
caguuagcauucugacauu

SEQ ID NO: 572996 - RNA, 19 nt, Homo sapiens
gagaacggucagaaucaaa

SEQ ID NO: 572997 - RNA, 19 nt, Homo sapiens
gaccagcuggccuguauga

SEQ ID NO: 572998 - RNA, 19 nt, Homo sapiens
uagaagaaccccagagaua

SEQ ID NO: 572999 - RNA, 19 nt, Homo sapiens
gaacagcagccuagcuacu

SEQ ID NO: 573000 - RNA, 19 nt, Homo sapiens
cauuucagcugugauuaug

SEQ ID NO: 573001 - RNA, 19 nt, Homo sapiens
guaaggccaauguuaacaa

SEQ ID NO: 573002 - RNA, 19 nt, Homo sapiens
gggauuucauaguuccaaa

SEQ ID NO: 573003 - RNA, 19 nt, Homo sapiens
ggccacugauuacuucaug

SEQ ID NO: 573004 - RNA, 19 nt, Homo sapiens
guacaaugagccuuacugu

SEQ ID NO: 573005 - RNA, 19 nt, Homo sapiens
cgacauugcugagccuuac

SEQ ID NO: 573006 - RNA, 19 nt, Homo sapiens
aaacugaggacuaauuugg

SEQ ID NO: 573007 - RNA, 19 nt, Homo sapiens
gaacuucccuugcaaauua

SEQ ID NO: 573008 - RNA, 19 nt, Homo sapiens
gaacuuggacugauuauug

SEQ ID NO: 573009 - RNA, 19 nt, Homo sapiens
gaaacuugcuccagaagaa

SEQ ID NO: 573010 - RNA, 19 nt, Homo sapiens
ggugguauccuuauaauua

SEQ ID NO: 573011 - RNA, 19 nt, Homo sapiens
gaaagacuaucucccaguu

SEQ ID NO: 573012 - RNA, 19 nt, Homo sapiens
gcagauauuugauugaugu

SEQ ID NO: 573013 - RNA, 19 nt, Homo sapiens
ccucuuugcugauaaauuu

SEQ ID NO: 573014 - RNA, 19 nt, Homo sapiens
gaagaacuuggacugauua

SEQ ID NO: 573015 - RNA, 19 nt, Homo sapiens
gcugauaaauuugcaguaa

SEQ ID NO: 573016 - RNA, 19 nt, Homo sapiens
ugacuagacuugugauaug

SEQ ID NO: 573017 - RNA, 19 nt, Homo sapiens
ggucuaaucagguuucuuu

SEQ ID NO: 573018 - RNA, 19 nt, Homo sapiens
auacaaaccuguccuggaa

SEQ ID NO: 573019 - RNA, 19 nt, Homo sapiens
gggaauggacccagugaua

SEQ ID NO: 573020 - RNA, 19 nt, Homo sapiens
aaacaaggaccuagguaua

SEQ ID NO: 573021 - RNA, 19 nt, Homo sapiens
guacccaggucaagugauu

SEQ ID NO: 573022 - RNA, 19 nt, Homo sapiens
ggagaggacuauucacaca

SEQ ID NO: 573023 - RNA, 19 nt, Homo sapiens
ggaccuagguauaaucuac

SEQ ID NO: 573024 - RNA, 19 nt, Homo sapiens
agaaacuguuccuuacuua

SEQ ID NO: 573025 - RNA, 19 nt, Homo sapiens
ugaagaacuuggacugauu

SEQ ID NO: 573026 - RNA, 19 nt, Homo sapiens
ggacucguuucauugcuuu

SEQ ID NO: 573027 - RNA, 19 nt, Homo sapiens
cagagaauccacauguuua

SEQ ID NO: 573028 - RNA, 19 nt, Homo sapiens
ggacauugcuuagaaagac

SEQ ID NO: 573029 - RNA, 19 nt, Homo sapiens
cagaaacuguuccuuacuu

SEQ ID NO: 573030 - RNA, 19 nt, Homo sapiens
aaagaaacuugcuccagaa

SEQ ID NO: 573031 - RNA, 19 nt, Homo sapiens
gaggccagaugaugcaauu

SEQ ID NO: 573032 - RNA, 19 nt, Homo sapiens
gaaacuguuccuuacuuaa

SEQ ID NO: 573033 - RNA, 19 nt, Homo sapiens
ccuuauguauucaagcuua

SEQ ID NO: 573034 - RNA, 19 nt, Homo sapiens
guucaggucuaaucagguu

SEQ ID NO: 573035 - RNA, 19 nt, Homo sapiens
ccagaggauuugccagaaa

SEQ ID NO: 573036 - RNA, 19 nt, Homo sapiens
ccacuguacccaugguuua

SEQ ID NO: 573037 - RNA, 19 nt, Homo sapiens
guagguggcugccgagucu

SEQ ID NO: 573038 - RNA, 19 nt, Homo sapiens
acaaaccuguccuggaauu

SEQ ID NO: 573039 - RNA, 19 nt, Homo sapiens
ucagagaauccacauguuu

SEQ ID NO: 573040 - RNA, 19 nt, Homo sapiens
ucagaaugguccuaucaga

SEQ ID NO: 573041 - RNA, 19 nt, Homo sapiens
ucagguuucuuuauuguuc

SEQ ID NO: 573042 - RNA, 19 nt, Homo sapiens
ucacucagcuccucgacau

SEQ ID NO: 573043 - RNA, 19 nt, Homo sapiens
ggucuuauccuggcauuga

SEQ ID NO: 573044 - RNA, 19 nt, Homo sapiens
gguccuaucagaaagaauu

SEQ ID NO: 573045 - RNA, 19 nt, Homo sapiens
agaaugguccuaucagaaa

SEQ ID NO: 573046 - RNA, 19 nt, Homo sapiens
gccagaaacuguuccuuac

SEQ ID NO: 573047 - RNA, 19 nt, Homo sapiens
gaacugaagcauugagaac

SEQ ID NO: 573048 - RNA, 19 nt, Homo sapiens
cuacuuaggagauaauuuc

SEQ ID NO: 573049 - RNA, 19 nt, Homo sapiens
gaauggacccagugauaca

SEQ ID NO: 573050 - RNA, 19 nt, Homo sapiens
aaacuacauugaagaccuu

SEQ ID NO: 573051 - RNA, 19 nt, Homo sapiens
gauaugcguguguuuaugu

SEQ ID NO: 573052 - RNA, 19 nt, Homo sapiens
gaaaauuacuggugugacu

SEQ ID NO: 573053 - RNA, 19 nt, Homo sapiens
uauaauuacuccagacucu

SEQ ID NO: 573054 - RNA, 19 nt, Homo sapiens
gaaugguccuaucagaaag

SEQ ID NO: 573055 - RNA, 19 nt, Homo sapiens
gccagaugaugcaauugaa

SEQ ID NO: 573056 - RNA, 19 nt, Homo sapiens
ucaagugccugaugaugag

SEQ ID NO: 573057 - RNA, 19 nt, Homo sapiens
guuuaccucuuugcugaua

SEQ ID NO: 573058 - RNA, 19 nt, Homo sapiens
gcauugcuguuuaccucuu

SEQ ID NO: 573059 - RNA, 19 nt, Homo sapiens
ugcaaccaguccacaauaa

SEQ ID NO: 573060 - RNA, 19 nt, Homo sapiens
acaaggaccuagguauaau

SEQ ID NO: 573061 - RNA, 19 nt, Homo sapiens
uaaacaaggaccuagguau

SEQ ID NO: 573062 - RNA, 19 nt, Homo sapiens
ugccagaaacuguuccuua

SEQ ID NO: 573063 - RNA, 19 nt, Homo sapiens
ggccagaugaugcaauuga

SEQ ID NO: 573064 - RNA, 19 nt, Homo sapiens
cacaggagguauucuugga

SEQ ID NO: 573065 - RNA, 19 nt, Homo sapiens
cagaaugguccuaucagaa

SEQ ID NO: 573066 - RNA, 19 nt, Homo sapiens
gccugggacucguuucauu

SEQ ID NO: 573067 - RNA, 19 nt, Homo sapiens
gagaacuucccuugcaaau

SEQ ID NO: 573068 - RNA, 19 nt, Homo sapiens
ggacgcuccucagccaaga

SEQ ID NO: 573069 - RNA, 19 nt, Homo sapiens
aggacuggcuaccucauuu

SEQ ID NO: 573070 - RNA, 19 nt, Homo sapiens
guucuguuauugacccaaa

SEQ ID NO: 573071 - RNA, 19 nt, Homo sapiens
gcaacaaucagucagaaaa

SEQ ID NO: 573072 - RNA, 19 nt, Homo sapiens
ccacaauaagccuguuaaa

SEQ ID NO: 573073 - RNA, 19 nt, Homo sapiens
ggacuggcuaccucauuug

SEQ ID NO: 573074 - RNA, 19 nt, Homo sapiens
ggaauggacccagugauac

SEQ ID NO: 573075 - RNA, 19 nt, Homo sapiens
acacccagacccaaaguuu

SEQ ID NO: 573076 - RNA, 19 nt, Homo sapiens
gggacucguuucauugcuu

SEQ ID NO: 573077 - RNA, 19 nt, Homo sapiens
aacaaggaccuagguauaa

SEQ ID NO: 573078 - RNA, 19 nt, Homo sapiens
agacucagcacaucucaug

SEQ ID NO: 573079 - RNA, 19 nt, Homo sapiens
cuaccucauuugcagauau

SEQ ID NO: 573080 - RNA, 19 nt, Homo sapiens
uuaccucuuugcugauaaa

SEQ ID NO: 573081 - RNA, 19 nt, Homo sapiens
uaccucauuugcagauauu

SEQ ID NO: 573082 - RNA, 19 nt, Homo sapiens
guauucaagcuuaaggaaa

SEQ ID NO: 573083 - RNA, 19 nt, Homo sapiens
ucacacaggagguauucuu

SEQ ID NO: 573084 - RNA, 19 nt, Homo sapiens
cgaaagguggaaagacuau

SEQ ID NO: 573085 - RNA, 19 nt, Homo sapiens
auuguucccuuauguauuc

SEQ ID NO: 573086 - RNA, 19 nt, Homo sapiens
ggauuugccagaaacuguu

SEQ ID NO: 573087 - RNA, 19 nt, Homo sapiens
aacuuggacugauuauuga

SEQ ID NO: 573088 - RNA, 19 nt, Homo sapiens
gugauaugcguguguuuau

SEQ ID NO: 573089 - RNA, 19 nt, Homo sapiens
ugugauaugcguguguuua

SEQ ID NO: 573090 - RNA, 19 nt, Homo sapiens
gagcuggccugaaaauuac

SEQ ID NO: 573091 - RNA, 19 nt, Homo sapiens
gugguauccuuauaauuac

SEQ ID NO: 573092 - RNA, 19 nt, Homo sapiens
ccaagaagaagggcggaaa

SEQ ID NO: 573093 - RNA, 19 nt, Homo sapiens
gcaaccaguccacaauaag

SEQ ID NO: 573094 - RNA, 19 nt, Homo sapiens
agacaaaacuacauugaag

SEQ ID NO: 573095 - RNA, 19 nt, Homo sapiens
ugauaugcguguguuuaug

SEQ ID NO: 573096 - RNA, 19 nt, Homo sapiens
acugaagcauugagaacuu

SEQ ID NO: 573097 - RNA, 19 nt, Homo sapiens
uuacuggugugacuuuuaa

SEQ ID NO: 573098 - RNA, 19 nt, Homo sapiens
uauccagccuguugggaau

SEQ ID NO: 573099 - RNA, 19 nt, Homo sapiens
gacauugcuuagaaagaca

SEQ ID NO: 573100 - RNA, 19 nt, Homo sapiens
cagaggauuugccagaaac

SEQ ID NO: 573101 - RNA, 19 nt, Homo sapiens
agagcuggccugaaaauua

SEQ ID NO: 573102 - RNA, 19 nt, Homo sapiens
gaagacucagcacaucuca

SEQ ID NO: 573103 - RNA, 19 nt, Homo sapiens
gaagggcggaaaccacauc

SEQ ID NO: 573104 - RNA, 19 nt, Homo sapiens
guguguuuauguacagaaa

SEQ ID NO: 573105 - RNA, 19 nt, Homo sapiens
gcuccucagccaagaagaa

SEQ ID NO: 573106 - RNA, 19 nt, Homo sapiens
aaauuacuggugugacuuu

SEQ ID NO: 573107 - RNA, 19 nt, Homo sapiens
caaauaagcucagaacaaa

SEQ ID NO: 573108 - RNA, 19 nt, Homo sapiens
gacaagaaauccaaacaua

SEQ ID NO: 573109 - RNA, 19 nt, Homo sapiens
ggaacgagacccucacuua

SEQ ID NO: 573110 - RNA, 19 nt, Homo sapiens
gaucacagaugaagacaug

SEQ ID NO: 573111 - RNA, 19 nt, Homo sapiens
ggacaagacugaagacaag

SEQ ID NO: 573112 - RNA, 19 nt, Homo sapiens
gcaaauaagcucagaacaa

SEQ ID NO: 573113 - RNA, 19 nt, Homo sapiens
gcacaugcuucacucaaug

SEQ ID NO: 573114 - RNA, 19 nt, Homo sapiens
ggccagauguggacaagaa

SEQ ID NO: 573115 - RNA, 19 nt, Homo sapiens
gagcaaagacccuucuaga

SEQ ID NO: 573116 - RNA, 19 nt, Homo sapiens
uuaaugaggaguucuguua

SEQ ID NO: 573117 - RNA, 19 nt, Homo sapiens
ucaagcagaucuccgacua

SEQ ID NO: 573118 - RNA, 19 nt, Homo sapiens
caagaaagccuaacugcau

SEQ ID NO: 573119 - RNA, 19 nt, Homo sapiens
gcagaucuccgacuacuuc

SEQ ID NO: 573120 - RNA, 19 nt, Homo sapiens
ggaguucuguuacgagauc

SEQ ID NO: 573121 - RNA, 19 nt, Homo sapiens
caagaaauccaaacauaag

SEQ ID NO: 573122 - RNA, 19 nt, Homo sapiens
gaagacaugauccgcaaga

SEQ ID NO: 573123 - RNA, 19 nt, Homo sapiens
gaacgagacccucacuuac

SEQ ID NO: 573124 - RNA, 19 nt, Homo sapiens
ccaagggccugaagccaau

SEQ ID NO: 573125 - RNA, 19 nt, Homo sapiens
uaaauuggcacaugcuuca

SEQ ID NO: 573126 - RNA, 19 nt, Homo sapiens
uaagacagcggugaagaaa

SEQ ID NO: 573127 - RNA, 19 nt, Homo sapiens
ggacaagaaauccaaacau

SEQ ID NO: 573128 - RNA, 19 nt, Homo sapiens
acgagacccucacuuacua

SEQ ID NO: 573129 - RNA, 19 nt, Homo sapiens
gagccaguaaggcaaauaa

SEQ ID NO: 573130 - RNA, 19 nt, Homo sapiens
ggacaaauuccggcacaau

SEQ ID NO: 573131 - RNA, 19 nt, Homo sapiens
gaaauccaaacauaagaca

SEQ ID NO: 573132 - RNA, 19 nt, Homo sapiens
gaggaugggaccuugaaga

SEQ ID NO: 573133 - RNA, 19 nt, Homo sapiens
ggaguuuaaugaggaguuc

SEQ ID NO: 573134 - RNA, 19 nt, Homo sapiens
acaaauuccggcacaauga

SEQ ID NO: 573135 - RNA, 19 nt, Homo sapiens
gggauuacgacauuggaaa

SEQ ID NO: 573136 - RNA, 19 nt, Homo sapiens
gacaaauuccggcacaaug

SEQ ID NO: 573137 - RNA, 19 nt, Homo sapiens
cguuugggauuacgacauu

SEQ ID NO: 573138 - RNA, 19 nt, Homo sapiens
gcaagacccugcggaucuc

SEQ ID NO: 573139 - RNA, 19 nt, Homo sapiens
ggcacaugcuucacucaau

SEQ ID NO: 573140 - RNA, 19 nt, Homo sapiens
cugcaucccucaucuccuu

SEQ ID NO: 573141 - RNA, 19 nt, Homo sapiens
ucaaguacagcucacagaa

SEQ ID NO: 573142 - RNA, 19 nt, Homo sapiens
accaagaccuucaacaucu

SEQ ID NO: 573143 - RNA, 19 nt, Homo sapiens
gaggucaccguuugggauu

SEQ ID NO: 573144 - RNA, 19 nt, Homo sapiens
gcccuccacugcaccauca

SEQ ID NO: 573145 - RNA, 19 nt, Homo sapiens
ccaagaccuucaacaucug

SEQ ID NO: 573146 - RNA, 19 nt, Homo sapiens
ugaagccaauggaccacaa

SEQ ID NO: 573147 - RNA, 19 nt, Homo sapiens
ggccggugguggaaagaga

SEQ ID NO: 573148 - RNA, 19 nt, Homo sapiens
acuacgggaucacagauga

SEQ ID NO: 573149 - RNA, 19 nt, Homo sapiens
uaaggcaaauaagcucaga

SEQ ID NO: 573150 - RNA, 19 nt, Homo sapiens
augcuucacucaaugauuc

SEQ ID NO: 573151 - RNA, 19 nt, Homo sapiens
guacagcucacagaagcaa

SEQ ID NO: 573152 - RNA, 19 nt, Homo sapiens
ggagcaaagacccuucuag

SEQ ID NO: 573153 - RNA, 19 nt, Homo sapiens
caccaagaccuucaacauc

SEQ ID NO: 573154 - RNA, 19 nt, Homo sapiens
uuucauugguggugugguu

SEQ ID NO: 573155 - RNA, 19 nt, Homo sapiens
cugaagcacugguuugacu

SEQ ID NO: 573156 - RNA, 19 nt, Homo sapiens
ugaacccggaguuuaauga

SEQ ID NO: 573157 - RNA, 19 nt, Homo sapiens
caaguacagcucacagaag

SEQ ID NO: 573158 - RNA, 19 nt, Homo sapiens
uguaugaccaggagaacaa

SEQ ID NO: 573159 - RNA, 19 nt, Homo sapiens
caagaggccggugguggaa

SEQ ID NO: 573160 - RNA, 19 nt, Homo sapiens
caacaucugccuggagaag

SEQ ID NO: 573161 - RNA, 19 nt, Homo sapiens
ugguuugacugccugaaga

SEQ ID NO: 573162 - RNA, 19 nt, Homo sapiens
ccucaucucccucaaguac

SEQ ID NO: 573163 - RNA, 19 nt, Homo sapiens
acaccaagaccuucaacau

SEQ ID NO: 573164 - RNA, 19 nt, Homo sapiens
uugacugccugaagaacaa

SEQ ID NO: 573165 - RNA, 19 nt, Homo sapiens
ggagccaguaaggcaaaua

SEQ ID NO: 573166 - RNA, 19 nt, Homo sapiens
gaacccggaguuuaaugag

SEQ ID NO: 573167 - RNA, 19 nt, Homo sapiens
cauaagacagcggugaaga

SEQ ID NO: 573168 - RNA, 19 nt, Homo sapiens
aaacccaaccacaccaaga

SEQ ID NO: 573169 - RNA, 19 nt, Homo sapiens
ucacagaugaagacaugau

SEQ ID NO: 573170 - RNA, 19 nt, Homo sapiens
cuaacugcaucccucaucu

SEQ ID NO: 573171 - RNA, 19 nt, Homo sapiens
ggauguggaccagcucuuc

SEQ ID NO: 573172 - RNA, 19 nt, Homo sapiens
ggucaccguuugggauuac

SEQ ID NO: 573173 - RNA, 19 nt, Homo sapiens
auaagacagcggugaagaa

SEQ ID NO: 573174 - RNA, 19 nt, Homo sapiens
gcgaggacgacgaggaugu

SEQ ID NO: 573175 - RNA, 19 nt, Homo sapiens
ccaguaaggcaaauaagcu

SEQ ID NO: 573176 - RNA, 19 nt, Homo sapiens
cccugaacccggaguuuaa

SEQ ID NO: 573177 - RNA, 19 nt, Homo sapiens
aagcagaucuccgacuacu

SEQ ID NO: 573178 - RNA, 19 nt, Homo sapiens
gaggccagauguggacaag

SEQ ID NO: 573179 - RNA, 19 nt, Homo sapiens
gcugagaggacaggagugu

SEQ ID NO: 573180 - RNA, 19 nt, Homo sapiens
gaagccaauggaccacaau

SEQ ID NO: 573181 - RNA, 19 nt, Homo sapiens
gagguggugagcagacaga

SEQ ID NO: 573182 - RNA, 19 nt, Homo sapiens
cccuggaggucaccguuug

SEQ ID NO: 573183 - RNA, 19 nt, Homo sapiens
gggagaaggcgaccaucag

SEQ ID NO: 573184 - RNA, 19 nt, Homo sapiens
caaauuccggcacaaugag

SEQ ID NO: 573185 - RNA, 19 nt, Homo sapiens
ugugugacgaggacaaauu

SEQ ID NO: 573186 - RNA, 19 nt, Homo sapiens
gacaagaaauccaagcaua

SEQ ID NO: 573187 - RNA, 19 nt, Homo sapiens
ggaaugaggaccugacuua

SEQ ID NO: 573188 - RNA, 19 nt, Homo sapiens
ggaguucuauauucacaua

SEQ ID NO: 573189 - RNA, 19 nt, Homo sapiens
gcuagucccugcaaauaug

SEQ ID NO: 573190 - RNA, 19 nt, Homo sapiens
ccauggacgucaacgguua

SEQ ID NO: 573191 - RNA, 19 nt, Homo sapiens
gugcggagguggacagcua

SEQ ID NO: 573192 - RNA, 19 nt, Homo sapiens
aaacgaagacucagaggaa

SEQ ID NO: 573193 - RNA, 19 nt, Homo sapiens
cauaagacgugugugaaga

SEQ ID NO: 573194 - RNA, 19 nt, Homo sapiens
cgaguguguugcacguuua

SEQ ID NO: 573195 - RNA, 19 nt, Homo sapiens
agacgugugugaagaagaa

SEQ ID NO: 573196 - RNA, 19 nt, Homo sapiens
gaagaagcauuuuaacauc

SEQ ID NO: 573197 - RNA, 19 nt, Homo sapiens
acaagaaauccaagcauaa

SEQ ID NO: 573198 - RNA, 19 nt, Homo sapiens
gacccacggugacuuccua

SEQ ID NO: 573199 - RNA, 19 nt, Homo sapiens
ccuguuaucugaaggacuu

SEQ ID NO: 573200 - RNA, 19 nt, Homo sapiens
ggcccgauguggacaagaa

SEQ ID NO: 573201 - RNA, 19 nt, Homo sapiens
ggcacacccugaccaguga

SEQ ID NO: 573202 - RNA, 19 nt, Homo sapiens
ggacuaugacauuggcaaa

SEQ ID NO: 573203 - RNA, 19 nt, Homo sapiens
gcugcggaguucuauauuc

SEQ ID NO: 573204 - RNA, 19 nt, Homo sapiens
gggcugcggaguucuauau

SEQ ID NO: 573205 - RNA, 19 nt, Homo sapiens
ggcaucuccuguuaucuga

SEQ ID NO: 573206 - RNA, 19 nt, Homo sapiens
acagcgggaucacagauga

SEQ ID NO: 573207 - RNA, 19 nt, Homo sapiens
ugaaucccguguggaauga

SEQ ID NO: 573208 - RNA, 19 nt, Homo sapiens
cugcggaguucuauauuca

SEQ ID NO: 573209 - RNA, 19 nt, Homo sapiens
guaaggccaauaagcuaaa

SEQ ID NO: 573210 - RNA, 19 nt, Homo sapiens
gcggaguucuauauucaca

SEQ ID NO: 573211 - RNA, 19 nt, Homo sapiens
caagaaauccaagcauaag

SEQ ID NO: 573212 - RNA, 19 nt, Homo sapiens
ggacaagaaauccaagcau

SEQ ID NO: 573213 - RNA, 19 nt, Homo sapiens
gcaaaccuccugccugacu

SEQ ID NO: 573214 - RNA, 19 nt, Homo sapiens
gggcaucuccuguuaucug

SEQ ID NO: 573215 - RNA, 19 nt, Homo sapiens
gccucaagcccauggauuu

SEQ ID NO: 573216 - RNA, 19 nt, Homo sapiens
gcauaagacgugugugaag

SEQ ID NO: 573217 - RNA, 19 nt, Homo sapiens
ucaagcccauggauuucaa

SEQ ID NO: 573218 - RNA, 19 nt, Homo sapiens
uggcaaauccaaugacuuc

SEQ ID NO: 573219 - RNA, 19 nt, Homo sapiens
cgucugggacuaugacauu

SEQ ID NO: 573220 - RNA, 19 nt, Homo sapiens
aagcauaagacguguguga

SEQ ID NO: 573221 - RNA, 19 nt, Homo sapiens
ugaagaagaagacucucaa

SEQ ID NO: 573222 - RNA, 19 nt, Homo sapiens
gcgaucgcaugaccaucaa

SEQ ID NO: 573223 - RNA, 19 nt, Homo sapiens
gagucacaaugaguuuauu

SEQ ID NO: 573224 - RNA, 19 nt, Homo sapiens
ggaaggcuccuaggaagag

SEQ ID NO: 573225 - RNA, 19 nt, Homo sapiens
ucgcuagucccugcaaaua

SEQ ID NO: 573226 - RNA, 19 nt, Homo sapiens
acgaguguguugcacguuu

SEQ ID NO: 573227 - RNA, 19 nt, Homo sapiens
caucgagccggguccagua

SEQ ID NO: 573228 - RNA, 19 nt, Homo sapiens
acucucaacccagaauuua

SEQ ID NO: 573229 - RNA, 19 nt, Homo sapiens
ugaggggcaucuccuguua

SEQ ID NO: 573230 - RNA, 19 nt, Homo sapiens
cagaggaacacacugaauc

SEQ ID NO: 573231 - RNA, 19 nt, Homo sapiens
gcaugaccaucaacaucca

SEQ ID NO: 573232 - RNA, 19 nt, Homo sapiens
ggaguuugaccuucucuac

SEQ ID NO: 573233 - RNA, 19 nt, Homo sapiens
gacaagcugagucacaaug

SEQ ID NO: 573234 - RNA, 19 nt, Homo sapiens
gaggacaagcugagucaca

SEQ ID NO: 573235 - RNA, 19 nt, Homo sapiens
ggaucgccgucugugauga

SEQ ID NO: 573236 - RNA, 19 nt, Homo sapiens
ccaccaagacccuggaagu

SEQ ID NO: 573237 - RNA, 19 nt, Homo sapiens
caucuccuguuaucugaag

SEQ ID NO: 573238 - RNA, 19 nt, Homo sapiens
caagcugagucacaaugag

SEQ ID NO: 573239 - RNA, 19 nt, Homo sapiens
ggacaagcugagucacaau

SEQ ID NO: 573240 - RNA, 19 nt, Homo sapiens
caacauccaggagcacaug

SEQ ID NO: 573241 - RNA, 19 nt, Homo sapiens
gaagaagaagacucucaac

SEQ ID NO: 573242 - RNA, 19 nt, Homo sapiens
ggcgaucgcaugaccauca

SEQ ID NO: 573243 - RNA, 19 nt, Homo sapiens
gcugagucacaaugaguuu

SEQ ID NO: 573244 - RNA, 19 nt, Homo sapiens
uguaaggccaauaagcuaa

SEQ ID NO: 573245 - RNA, 19 nt, Homo sapiens
cacccugcacuaccuauuu

SEQ ID NO: 573246 - RNA, 19 nt, Homo sapiens
acuaugacauuggcaaauc

SEQ ID NO: 573247 - RNA, 19 nt, Homo sapiens
gacucucaacccagaauuu

SEQ ID NO: 573248 - RNA, 19 nt, Homo sapiens
uaagacgugugugaagaag

SEQ ID NO: 573249 - RNA, 19 nt, Homo sapiens
ccaagcauaagacgugugu

SEQ ID NO: 573250 - RNA, 19 nt, Homo sapiens
gaucgcaugaccaucaaca

SEQ ID NO: 573251 - RNA, 19 nt, Homo sapiens
aguuugaccuucucuacga

SEQ ID NO: 573252 - RNA, 19 nt, Homo sapiens
aggacaagcugagucacaa

SEQ ID NO: 573253 - RNA, 19 nt, Homo sapiens
gugaagaagaagacucuca

SEQ ID NO: 573254 - RNA, 19 nt, Homo sapiens
ugagucacaaugaguuuau

SEQ ID NO: 573255 - RNA, 19 nt, Homo sapiens
caggaucgccgucugugau

SEQ ID NO: 573256 - RNA, 19 nt, Homo sapiens
gccucaagccuucgcagaa

SEQ ID NO: 573257 - RNA, 19 nt, Homo sapiens
gcucaggaucgccgucugu

SEQ ID NO: 573258 - RNA, 19 nt, Homo sapiens
ucuccacucuggccaccaa

SEQ ID NO: 573259 - RNA, 19 nt, Homo sapiens
gaaugaggaccugacuuac

SEQ ID NO: 573260 - RNA, 19 nt, Homo sapiens
agaauuuaacgaggaguuu

SEQ ID NO: 573261 - RNA, 19 nt, Homo sapiens
cagaauuuaacgaggaguu

SEQ ID NO: 573262 - RNA, 19 nt, Homo sapiens
gaagacucucaacccagaa

SEQ ID NO: 573263 - RNA, 19 nt, Homo sapiens
acaagcugagucacaauga

SEQ ID NO: 573264 - RNA, 19 nt, Homo sapiens
ggcaggagcucaaauauaa

SEQ ID NO: 573265 - RNA, 19 nt, Homo sapiens
gaacauugcugagacauca

SEQ ID NO: 573266 - RNA, 19 nt, Homo sapiens
ggaaacaccucaggaagaa

SEQ ID NO: 573267 - RNA, 19 nt, Homo sapiens
gagaagagcuaggguaaga

SEQ ID NO: 573268 - RNA, 19 nt, Homo sapiens
caagaaggcuuaugaagag

SEQ ID NO: 573269 - RNA, 19 nt, Homo sapiens
gaagcagccuccagaagaa

SEQ ID NO: 573270 - RNA, 19 nt, Homo sapiens
gaagaagcgugaggaagaa

SEQ ID NO: 573271 - RNA, 19 nt, Homo sapiens
ggaagaagcgugaggaaga

SEQ ID NO: 573272 - RNA, 19 nt, Homo sapiens
ggaacaagguaccacgaaa

SEQ ID NO: 573273 - RNA, 19 nt, Homo sapiens
ccaaagaguucaugagaca

SEQ ID NO: 573274 - RNA, 19 nt, Homo sapiens
cuuggaagcuuguguagua

SEQ ID NO: 573275 - RNA, 19 nt, Homo sapiens
caucacugcugguuacuuu

SEQ ID NO: 573276 - RNA, 19 nt, Homo sapiens
ggaagcagccuccagaaga

SEQ ID NO: 573277 - RNA, 19 nt, Homo sapiens
ggaggagcgugaugccuuu

SEQ ID NO: 573278 - RNA, 19 nt, Homo sapiens
guaaacagcagacagagaa

SEQ ID NO: 573279 - RNA, 19 nt, Homo sapiens
gaucuuagccucugagaag

SEQ ID NO: 573280 - RNA, 19 nt, Homo sapiens
agacacugcugcugacuuu

SEQ ID NO: 573281 - RNA, 19 nt, Homo sapiens
gacauucucuuuggauuga

SEQ ID NO: 573282 - RNA, 19 nt, Homo sapiens
ggucagacaagaaggcuua

SEQ ID NO: 573283 - RNA, 19 nt, Homo sapiens
aaacaaggguaugaagauu

SEQ ID NO: 573284 - RNA, 19 nt, Homo sapiens
gaaaggcagugguagaaaa

SEQ ID NO: 573285 - RNA, 19 nt, Homo sapiens
ggaggagaccauugaguuu

SEQ ID NO: 573286 - RNA, 19 nt, Homo sapiens
gacagguacuggagauuga

SEQ ID NO: 573287 - RNA, 19 nt, Homo sapiens
ccacccagaucccgcagua

SEQ ID NO: 573288 - RNA, 19 nt, Homo sapiens
ggaguaaacagcagacaga

SEQ ID NO: 573289 - RNA, 19 nt, Homo sapiens
ccauugagggcaucauuua

SEQ ID NO: 573290 - RNA, 19 nt, Homo sapiens
ggaaugagguuggcuacag

SEQ ID NO: 573291 - RNA, 19 nt, Homo sapiens
ggagaugggugugaagcuu

SEQ ID NO: 573292 - RNA, 19 nt, Homo sapiens
gagaaggacgcaaacagaa

SEQ ID NO: 573293 - RNA, 19 nt, Homo sapiens
acacagacauucucuuugg

SEQ ID NO: 573294 - RNA, 19 nt, Homo sapiens
agccugaccuggcgaguua

SEQ ID NO: 573295 - RNA, 19 nt, Homo sapiens
gugugaagcuugggaauga

SEQ ID NO: 573296 - RNA, 19 nt, Homo sapiens
aggcggagcuggcugauga

SEQ ID NO: 573297 - RNA, 19 nt, Homo sapiens
gguaagagaaggacgcaaa

SEQ ID NO: 573298 - RNA, 19 nt, Homo sapiens
gaagagcuaggguaagaga

SEQ ID NO: 573299 - RNA, 19 nt, Homo sapiens
gaggaggguuauacaaaca

SEQ ID NO: 573300 - RNA, 19 nt, Homo sapiens
gagacaggcucagggaaga

SEQ ID NO: 573301 - RNA, 19 nt, Homo sapiens
agacaucacccaccauuga

SEQ ID NO: 573302 - RNA, 19 nt, Homo sapiens
acacacagacauucucuuu

SEQ ID NO: 573303 - RNA, 19 nt, Homo sapiens
gaacuguccuccgcuacau

SEQ ID NO: 573304 - RNA, 19 nt, Homo sapiens
acaagaaggcuuaugaaga

SEQ ID NO: 573305 - RNA, 19 nt, Homo sapiens
gaacaagguaccacgaaag

SEQ ID NO: 573306 - RNA, 19 nt, Homo sapiens
caacucaggcccagcagaa

SEQ ID NO: 573307 - RNA, 19 nt, Homo sapiens
caaacaaggguaugaagau

SEQ ID NO: 573308 - RNA, 19 nt, Homo sapiens
caacaacuccaucuucuac

SEQ ID NO: 573309 - RNA, 19 nt, Homo sapiens
gcucagaagcgccucaaga

SEQ ID NO: 573310 - RNA, 19 nt, Homo sapiens
ggucguccaugcugacaau

SEQ ID NO: 573311 - RNA, 19 nt, Homo sapiens
ggaagcuuguguaguaucu

SEQ ID NO: 573312 - RNA, 19 nt, Homo sapiens
uccagaggcugacuacuug

SEQ ID NO: 573313 - RNA, 19 nt, Homo sapiens
aaaggacccuacacacaga

SEQ ID NO: 573314 - RNA, 19 nt, Homo sapiens
cgaaaggacccuacacaca

SEQ ID NO: 573315 - RNA, 19 nt, Homo sapiens
gaccuaaugcacuuugauu

SEQ ID NO: 573316 - RNA, 19 nt, Homo sapiens
cagacaagaaggcuuauga

SEQ ID NO: 573317 - RNA, 19 nt, Homo sapiens
caccaaguccucaucauug

SEQ ID NO: 573318 - RNA, 19 nt, Homo sapiens
cggcaggagcucaaauaua

SEQ ID NO: 573319 - RNA, 19 nt, Homo sapiens
gcuccuggcugcuauugca

SEQ ID NO: 573320 - RNA, 19 nt, Homo sapiens
caauggacacugcccguuu

SEQ ID NO: 573321 - RNA, 19 nt, Homo sapiens
cagacauucucuuuggauu

SEQ ID NO: 573322 - RNA, 19 nt, Homo sapiens
cagcgucccugaaguuugg

SEQ ID NO: 573323 - RNA, 19 nt, Homo sapiens
caccaaagaguucaugaga

SEQ ID NO: 573324 - RNA, 19 nt, Homo sapiens
gaaaccacagugccugaga

SEQ ID NO: 573325 - RNA, 19 nt, Homo sapiens
gauccaggguucuguaagc

SEQ ID NO: 573326 - RNA, 19 nt, Homo sapiens
gaggagaccauugaguuug

SEQ ID NO: 573327 - RNA, 19 nt, Homo sapiens
ugaaacagcagcagacagu

SEQ ID NO: 573328 - RNA, 19 nt, Homo sapiens
ggccaucacugcugguuac

SEQ ID NO: 573329 - RNA, 19 nt, Homo sapiens
gggcccugcuggagaagaa

SEQ ID NO: 573330 - RNA, 19 nt, Homo sapiens
cagcaaggccucagccaau

SEQ ID NO: 573331 - RNA, 19 nt, Homo sapiens
ucaccaaguccucaucauu

SEQ ID NO: 573332 - RNA, 19 nt, Homo sapiens
uggcugcuauugcaaauca

SEQ ID NO: 573333 - RNA, 19 nt, Homo sapiens
gggcagcgucccugaaguu

SEQ ID NO: 573334 - RNA, 19 nt, Homo sapiens
ugagacagguacuggagau

SEQ ID NO: 573335 - RNA, 19 nt, Homo sapiens
uccuagaggucccaaggua

SEQ ID NO: 573336 - RNA, 19 nt, Homo sapiens
gcuaccacaugcccaagga

SEQ ID NO: 573337 - RNA, 19 nt, Homo sapiens
ucccugagcugcggaagaa

SEQ ID NO: 573338 - RNA, 19 nt, Homo sapiens
acaaggaucggacucgaaa

SEQ ID NO: 573339 - RNA, 19 nt, Homo sapiens
ggaucggacucgaaauguc

SEQ ID NO: 573340 - RNA, 19 nt, Homo sapiens
cggaaacaccucaggaaga

SEQ ID NO: 573341 - RNA, 19 nt, Homo sapiens
gugaggagacugugaguag

SEQ ID NO: 573342 - RNA, 19 nt, Homo sapiens
ugaggaggguuauacaaac

SEQ ID NO: 573343 - RNA, 19 nt, Homo sapiens
ggaagaagaggaggaagag

SEQ ID NO: 573344 - RNA, 19 nt, Homo sapiens
gucaacaacuccaucuucu

SEQ ID NO: 573345 - RNA, 19 nt, Homo sapiens
ggaccagcuugggcaaugu

SEQ ID NO: 573346 - RNA, 19 nt, Homo sapiens
gcacgucgcccaguuucug

SEQ ID NO: 573347 - RNA, 19 nt, Homo sapiens
gacaagaaggcuuaugaag

SEQ ID NO: 573348 - RNA, 19 nt, Homo sapiens
agagaaggacgcaaacaga

SEQ ID NO: 573349 - RNA, 19 nt, Homo sapiens
ugugagaacuuuguacagu

SEQ ID NO: 573350 - RNA, 19 nt, Homo sapiens
ccaccugguucugcuaaau

SEQ ID NO: 573351 - RNA, 19 nt, Homo sapiens
gugcagcgccuacgagaca

SEQ ID NO: 573352 - RNA, 19 nt, Homo sapiens
gcguggugaugguggauga

SEQ ID NO: 573353 - RNA, 19 nt, Homo sapiens
caugacagaugggaugcuu

SEQ ID NO: 573354 - RNA, 19 nt, Homo sapiens
ggaggguuauacaaacaag

SEQ ID NO: 573355 - RNA, 19 nt, Homo sapiens
acugauaccuuggaucuca

SEQ ID NO: 573356 - RNA, 19 nt, Homo sapiens
gacucgaaauguccuggaa

SEQ ID NO: 573357 - RNA, 19 nt, Homo sapiens
uaaagcuugugggaacauu

SEQ ID NO: 573358 - RNA, 19 nt, Homo sapiens
guggugcugugagaacuuu

SEQ ID NO: 573359 - RNA, 19 nt, Homo sapiens
caaugcccgugucaacuuc

SEQ ID NO: 573360 - RNA, 19 nt, Homo sapiens
cuacuuggaagcuugugua

SEQ ID NO: 573361 - RNA, 19 nt, Homo sapiens
gcuacagcauccgcuuuga

SEQ ID NO: 573362 - RNA, 19 nt, Homo sapiens
gcucuuggaacguguggaa

SEQ ID NO: 573363 - RNA, 19 nt, Homo sapiens
gcuggaagggcucuuggaa

SEQ ID NO: 573364 - RNA, 19 nt, Homo sapiens
uaaauaaccuccuugauga

SEQ ID NO: 573365 - RNA, 19 nt, Homo sapiens
aaagagagguuccugaaua

SEQ ID NO: 573366 - RNA, 19 nt, Homo sapiens
uaaaccagcugaacuuaua

SEQ ID NO: 573367 - RNA, 19 nt, Homo sapiens
uaacaaacgucuagaagaa

SEQ ID NO: 573368 - RNA, 19 nt, Homo sapiens
caaagaagcuacagaugaa

SEQ ID NO: 573369 - RNA, 19 nt, Homo sapiens
ggagaacacugcagucauu

SEQ ID NO: 573370 - RNA, 19 nt, Homo sapiens
gaaagaaacgguugaagaa

SEQ ID NO: 573371 - RNA, 19 nt, Homo sapiens
gaaggaauguuuaaagaca

SEQ ID NO: 573372 - RNA, 19 nt, Homo sapiens
cagacagacuuauuacuua

SEQ ID NO: 573373 - RNA, 19 nt, Homo sapiens
gaagcagacagacuuauua

SEQ ID NO: 573374 - RNA, 19 nt, Homo sapiens
aaacuaaccuguugauuca

SEQ ID NO: 573375 - RNA, 19 nt, Homo sapiens
ucaaugcuguccaaacuua

SEQ ID NO: 573376 - RNA, 19 nt, Homo sapiens
gcagcacuauuguaauuaa

SEQ ID NO: 573377 - RNA, 19 nt, Homo sapiens
gaucagaaagugcagaaua

SEQ ID NO: 573378 - RNA, 19 nt, Homo sapiens
gggcauugcuaaaguguuu

SEQ ID NO: 573379 - RNA, 19 nt, Homo sapiens
gaaagacacuuagccacaa

SEQ ID NO: 573380 - RNA, 19 nt, Homo sapiens
aauagaggauggagaguua

SEQ ID NO: 573381 - RNA, 19 nt, Homo sapiens
ggaaaggaauggugaagca

SEQ ID NO: 573382 - RNA, 19 nt, Homo sapiens
cuaaagacaucaugauuca

SEQ ID NO: 573383 - RNA, 19 nt, Homo sapiens
gaagaagcagacagacuua

SEQ ID NO: 573384 - RNA, 19 nt, Homo sapiens
ggucagcccugcagucuau

SEQ ID NO: 573385 - RNA, 19 nt, Homo sapiens
gaaagaagcauuugaaacg

SEQ ID NO: 573386 - RNA, 19 nt, Homo sapiens
gaaaaucucuguucuuaca

SEQ ID NO: 573387 - RNA, 19 nt, Homo sapiens
ggagaggaguucaguuuag

SEQ ID NO: 573388 - RNA, 19 nt, Homo sapiens
gggcucauauuauaaguga

SEQ ID NO: 573389 - RNA, 19 nt, Homo sapiens
ggacaugggacuggaguua

SEQ ID NO: 573390 - RNA, 19 nt, Homo sapiens
gcucggaccuuagauagaa

SEQ ID NO: 573391 - RNA, 19 nt, Homo sapiens
caaaugaagcaguguaauu

SEQ ID NO: 573392 - RNA, 19 nt, Homo sapiens
gauaucugcuuucugaaga

SEQ ID NO: 573393 - RNA, 19 nt, Homo sapiens
gcagacagacuuauuacuu

SEQ ID NO: 573394 - RNA, 19 nt, Homo sapiens
uaagcaugcugucugauuu

SEQ ID NO: 573395 - RNA, 19 nt, Homo sapiens
gcagacaaaugaucaugau

SEQ ID NO: 573396 - RNA, 19 nt, Homo sapiens
aagcacagauucaucaauu

SEQ ID NO: 573397 - RNA, 19 nt, Homo sapiens
aagauaagguugaccauau

SEQ ID NO: 573398 - RNA, 19 nt, Homo sapiens
gaaacuaaccggcucuaug

SEQ ID NO: 573399 - RNA, 19 nt, Homo sapiens
gaagauggcugaggaaucc

SEQ ID NO: 573400 - RNA, 19 nt, Homo sapiens
aaccuaggcuuaucuguuu

SEQ ID NO: 573401 - RNA, 19 nt, Homo sapiens
uuagacagcucggaccuua

SEQ ID NO: 573402 - RNA, 19 nt, Homo sapiens
caguugaaauuuccaguaa

SEQ ID NO: 573403 - RNA, 19 nt, Homo sapiens
gcaggcaacuggaauagag

SEQ ID NO: 573404 - RNA, 19 nt, Homo sapiens
ggugaacacuuaacagcaa

SEQ ID NO: 573405 - RNA, 19 nt, Homo sapiens
ccaaaccaguacaacuaua

SEQ ID NO: 573406 - RNA, 19 nt, Homo sapiens
gacagacaguaucaaauug

SEQ ID NO: 573407 - RNA, 19 nt, Homo sapiens
gagaggaguucaguuuaga

SEQ ID NO: 573408 - RNA, 19 nt, Homo sapiens
gaagaacaagcaagcacua

SEQ ID NO: 573409 - RNA, 19 nt, Homo sapiens
uguccaaacuuaaacauga

SEQ ID NO: 573410 - RNA, 19 nt, Homo sapiens
ggaaagagugcaucuguag

SEQ ID NO: 573411 - RNA, 19 nt, Homo sapiens
caacaaagaagcuacagau

SEQ ID NO: 573412 - RNA, 19 nt, Homo sapiens
uaaacuaaccuguugauuc

SEQ ID NO: 573413 - RNA, 19 nt, Homo sapiens
caagcaagcacuacagaaa

SEQ ID NO: 573414 - RNA, 19 nt, Homo sapiens
ucaaucaaauccagaugaa

SEQ ID NO: 573415 - RNA, 19 nt, Homo sapiens
cagcaaacuugaaggaaug

SEQ ID NO: 573416 - RNA, 19 nt, Homo sapiens
agauaagguugaccauaua

SEQ ID NO: 573417 - RNA, 19 nt, Homo sapiens
uggcagcacuauuguaauu

SEQ ID NO: 573418 - RNA, 19 nt, Homo sapiens
gcauuuggcagcacuauug

SEQ ID NO: 573419 - RNA, 19 nt, Homo sapiens
ucgaauauaucaaggcauu

SEQ ID NO: 573420 - RNA, 19 nt, Homo sapiens
gaccuuagauagaagaaca

SEQ ID NO: 573421 - RNA, 19 nt, Homo sapiens
caagacagacaguaucaaa

SEQ ID NO: 573422 - RNA, 19 nt, Homo sapiens
gauggagaguuaaggagaa

SEQ ID NO: 573423 - RNA, 19 nt, Homo sapiens
gcuauuggccgacauaugu

SEQ ID NO: 573424 - RNA, 19 nt, Homo sapiens
gagaauaacccaggcuuug

SEQ ID NO: 573425 - RNA, 19 nt, Homo sapiens
acucugagaucguuugaaa

SEQ ID NO: 573426 - RNA, 19 nt, Homo sapiens
aaaccgaauucaagauuug

SEQ ID NO: 573427 - RNA, 19 nt, Homo sapiens
uuaaauaaccuccuugaug

SEQ ID NO: 573428 - RNA, 19 nt, Homo sapiens
uaagacaauugauggcauu

SEQ ID NO: 573429 - RNA, 19 nt, Homo sapiens
ggaguucaguuuagaagag

SEQ ID NO: 573430 - RNA, 19 nt, Homo sapiens
acaaagaagcuacagauga

SEQ ID NO: 573431 - RNA, 19 nt, Homo sapiens
guucaagaauugcuggauu

SEQ ID NO: 573432 - RNA, 19 nt, Homo sapiens
cugcgaagaucacaucaaa

SEQ ID NO: 573433 - RNA, 19 nt, Homo sapiens
uggauaaacuaaccuguug

SEQ ID NO: 573434 - RNA, 19 nt, Homo sapiens
agacagacaguaucaaauu

SEQ ID NO: 573435 - RNA, 19 nt, Homo sapiens
ugaaagaaacgguugaaga

SEQ ID NO: 573436 - RNA, 19 nt, Homo sapiens
gaacuccaggucucucuuu

SEQ ID NO: 573437 - RNA, 19 nt, Homo sapiens
cagaagucauuaauugcua

SEQ ID NO: 573438 - RNA, 19 nt, Homo sapiens
gcauucuucucuugauuga

SEQ ID NO: 573439 - RNA, 19 nt, Homo sapiens
gcacagauucaucaauuca

SEQ ID NO: 573440 - RNA, 19 nt, Homo sapiens
gggacuacauggaaagaga

SEQ ID NO: 573441 - RNA, 19 nt, Homo sapiens
gacaauugauggcauucuu

SEQ ID NO: 573442 - RNA, 19 nt, Homo sapiens
aaaccuggcucugcuaaga

SEQ ID NO: 573443 - RNA, 19 nt, Homo sapiens
gaagacacccuggaguuug

SEQ ID NO: 573444 - RNA, 19 nt, Homo sapiens
guauaacucugagaucguu

SEQ ID NO: 573445 - RNA, 19 nt, Homo sapiens
gaauauaucaaggcauuug

SEQ ID NO: 573446 - RNA, 19 nt, Homo sapiens
ccaagaagagaaaguuaaa

SEQ ID NO: 573447 - RNA, 19 nt, Homo sapiens
gagaugggaaugaugauga

SEQ ID NO: 573448 - RNA, 19 nt, Homo sapiens
gggagaggaguucaguuua

SEQ ID NO: 573449 - RNA, 19 nt, Homo sapiens
aaccaggccucuguuguua

SEQ ID NO: 573450 - RNA, 19 nt, Homo sapiens
gugaauauccugacaaugg

SEQ ID NO: 573451 - RNA, 19 nt, Homo sapiens
ccagcaaacuugaaggaau

SEQ ID NO: 573452 - RNA, 19 nt, Homo sapiens
auugauaucugcuuucuga

SEQ ID NO: 573453 - RNA, 19 nt, Homo sapiens
gauaagguugaccauauaa

SEQ ID NO: 573454 - RNA, 19 nt, Homo sapiens
acccagaagucauuaauug

SEQ ID NO: 573455 - RNA, 19 nt, Homo sapiens
ucccauagguaguauuauu

SEQ ID NO: 573456 - RNA, 19 nt, Homo sapiens
uuaaacagcagcagcagua

SEQ ID NO: 573457 - RNA, 19 nt, Homo sapiens
ugauucaguucaaacagua

SEQ ID NO: 573458 - RNA, 19 nt, Homo sapiens
uguaucagcucuucaguag

SEQ ID NO: 573459 - RNA, 19 nt, Homo sapiens
gaaagagagguuccugaau

SEQ ID NO: 573460 - RNA, 19 nt, Homo sapiens
agagaggauucauuggaua

SEQ ID NO: 573461 - RNA, 19 nt, Homo sapiens
caaacggccuagccaaauc

SEQ ID NO: 573462 - RNA, 19 nt, Homo sapiens
gaccgggacuacauggaaa

SEQ ID NO: 573463 - RNA, 19 nt, Homo sapiens
gggcaaagacauugaagau

SEQ ID NO: 573464 - RNA, 19 nt, Homo sapiens
gcacagauccuuccguuua

SEQ ID NO: 573465 - RNA, 19 nt, Homo sapiens
gaaggaaacuguugaggaa

SEQ ID NO: 573466 - RNA, 19 nt, Homo sapiens
ggaagagacuaauugcuua

SEQ ID NO: 573467 - RNA, 19 nt, Homo sapiens
aaagagagguuccagaaua

SEQ ID NO: 573468 - RNA, 19 nt, Homo sapiens
gcauguggauucaaaguua

SEQ ID NO: 573469 - RNA, 19 nt, Homo sapiens
gaacagcgaucguaaucaa

SEQ ID NO: 573470 - RNA, 19 nt, Homo sapiens
ggagauggcuucagcuuug

SEQ ID NO: 573471 - RNA, 19 nt, Homo sapiens
gaagacagcucgcucagau

SEQ ID NO: 573472 - RNA, 19 nt, Homo sapiens
gaacccauauuauuaguga

SEQ ID NO: 573473 - RNA, 19 nt, Homo sapiens
cagaauaucuuaaccaugu

SEQ ID NO: 573474 - RNA, 19 nt, Homo sapiens
gaucauggcauaaguguuu

SEQ ID NO: 573475 - RNA, 19 nt, Homo sapiens
ugucaaagcucaagcauga

SEQ ID NO: 573476 - RNA, 19 nt, Homo sapiens
gauagaggauagugaauug

SEQ ID NO: 573477 - RNA, 19 nt, Homo sapiens
gcgaguacaucaagacuuu

SEQ ID NO: 573478 - RNA, 19 nt, Homo sapiens
gguaacugcucuuugauuu

SEQ ID NO: 573479 - RNA, 19 nt, Homo sapiens
ucacaaggcucaagacuuc

SEQ ID NO: 573480 - RNA, 19 nt, Homo sapiens
caaagcauguggauucaaa

SEQ ID NO: 573481 - RNA, 19 nt, Homo sapiens
agagaagacucacuagaua

SEQ ID NO: 573482 - RNA, 19 nt, Homo sapiens
cagcugaaauuuccaguaa

SEQ ID NO: 573483 - RNA, 19 nt, Homo sapiens
gcuauuaggagaacauuua

SEQ ID NO: 573484 - RNA, 19 nt, Homo sapiens
gagagaguguuucaggaua

SEQ ID NO: 573485 - RNA, 19 nt, Homo sapiens
guucaaagcuggcgaaugg

SEQ ID NO: 573486 - RNA, 19 nt, Homo sapiens
caacaagccugcagaacug

SEQ ID NO: 573487 - RNA, 19 nt, Homo sapiens
gaaagggcucgaccacuua

SEQ ID NO: 573488 - RNA, 19 nt, Homo sapiens
gagacagaguaaucacuua

SEQ ID NO: 573489 - RNA, 19 nt, Homo sapiens
ggaaguauuuaaggcauuu

SEQ ID NO: 573490 - RNA, 19 nt, Homo sapiens
caugauauguggucuaaga

SEQ ID NO: 573491 - RNA, 19 nt, Homo sapiens
aaacuuugguggcugauuu

SEQ ID NO: 573492 - RNA, 19 nt, Homo sapiens
aaacuucaguggcaaacua

SEQ ID NO: 573493 - RNA, 19 nt, Homo sapiens
gaccuaaagucuugauguu

SEQ ID NO: 573494 - RNA, 19 nt, Homo sapiens
gaaaaucucuguucucaca

SEQ ID NO: 573495 - RNA, 19 nt, Homo sapiens
gcagacaaaugaucaugau

SEQ ID NO: 573496 - RNA, 19 nt, Homo sapiens
gagacuauauggagagaga

SEQ ID NO: 573497 - RNA, 19 nt, Homo sapiens
ggucauaaucuucuaguuu

SEQ ID NO: 573498 - RNA, 19 nt, Homo sapiens
gauagugaauugcgcagaa

SEQ ID NO: 573499 - RNA, 19 nt, Homo sapiens
acaaagacaugguccaaga

SEQ ID NO: 573500 - RNA, 19 nt, Homo sapiens
gaagagggagacagaguaa

SEQ ID NO: 573501 - RNA, 19 nt, Homo sapiens
gcauaaguguuuaaagcaa

SEQ ID NO: 573502 - RNA, 19 nt, Homo sapiens
uaagucagguuucuaagug

SEQ ID NO: 573503 - RNA, 19 nt, Homo sapiens
gacaagaagauguuacuaa

SEQ ID NO: 573504 - RNA, 19 nt, Homo sapiens
gauuagaacuguuuagaac

SEQ ID NO: 573505 - RNA, 19 nt, Homo sapiens
guuaagagcaggcaacaaa

SEQ ID NO: 573506 - RNA, 19 nt, Homo sapiens
ggagaacauuuaacagcaa

SEQ ID NO: 573507 - RNA, 19 nt, Homo sapiens
agaaagggcucgaccacuu

SEQ ID NO: 573508 - RNA, 19 nt, Homo sapiens
uaugacaccuuguggguuu

SEQ ID NO: 573509 - RNA, 19 nt, Homo sapiens
ggagagagacaaagacaau

SEQ ID NO: 573510 - RNA, 19 nt, Homo sapiens
ggaagagggagacagagua

SEQ ID NO: 573511 - RNA, 19 nt, Homo sapiens
gagacuaauugcuuauaug

SEQ ID NO: 573512 - RNA, 19 nt, Homo sapiens
aaaggaaaguucaguagug

SEQ ID NO: 573513 - RNA, 19 nt, Homo sapiens
gcucagaugaucagcauuu

SEQ ID NO: 573514 - RNA, 19 nt, Homo sapiens
cguaaucaauccugagaaa

SEQ ID NO: 573515 - RNA, 19 nt, Homo sapiens
gauaugggauuagaacugu

SEQ ID NO: 573516 - RNA, 19 nt, Homo sapiens
cgaaggacaucaugguuca

SEQ ID NO: 573517 - RNA, 19 nt, Homo sapiens
ggagaaacagcuauuagga

SEQ ID NO: 573518 - RNA, 19 nt, Homo sapiens
caucugggauaugggauua

SEQ ID NO: 573519 - RNA, 19 nt, Homo sapiens
cugcagaacugaucgcaaa

SEQ ID NO: 573520 - RNA, 19 nt, Homo sapiens
gcagguguauaaagauuca

SEQ ID NO: 573521 - RNA, 19 nt, Homo sapiens
agaaagaccaaacagauuu

SEQ ID NO: 573522 - RNA, 19 nt, Homo sapiens
uaagaaagaccaaacagau

SEQ ID NO: 573523 - RNA, 19 nt, Homo sapiens
aauccucacucuuuaauug

SEQ ID NO: 573524 - RNA, 19 nt, Homo sapiens
gcugaaauuuccaguaaag

SEQ ID NO: 573525 - RNA, 19 nt, Homo sapiens
acauggagcuuucgaagga

SEQ ID NO: 573526 - RNA, 19 nt, Homo sapiens
cuuguggguuuccauauua

SEQ ID NO: 573527 - RNA, 19 nt, Homo sapiens
gaaagagccaggguucaaa

SEQ ID NO: 573528 - RNA, 19 nt, Homo sapiens
gucauaaucuucuaguuuc

SEQ ID NO: 573529 - RNA, 19 nt, Homo sapiens
gauauguggucuaagaaag

SEQ ID NO: 573530 - RNA, 19 nt, Homo sapiens
caacauacacgcccaugga

SEQ ID NO: 573531 - RNA, 19 nt, Homo sapiens
gaaggguaacuaugacaaa

SEQ ID NO: 573532 - RNA, 19 nt, Homo sapiens
ggaaaguucaguagugaug

SEQ ID NO: 573533 - RNA, 19 nt, Homo sapiens
ccuaaagucuugauguugu

SEQ ID NO: 573534 - RNA, 19 nt, Homo sapiens
aguaaagccuggagauuug

SEQ ID NO: 573535 - RNA, 19 nt, Homo sapiens
gaagauguuacuaaagaga

SEQ ID NO: 573536 - RNA, 19 nt, Homo sapiens
gaauugaaucucugauaga

SEQ ID NO: 573537 - RNA, 19 nt, Homo sapiens
gcugcuaucgucagaauaa

SEQ ID NO: 573538 - RNA, 19 nt, Homo sapiens
ucaaggacauggagcuuuc

SEQ ID NO: 573539 - RNA, 19 nt, Homo sapiens
gagcggacguuggacaaga

SEQ ID NO: 573540 - RNA, 19 nt, Homo sapiens
acacagaaaccacugauug

SEQ ID NO: 573541 - RNA, 19 nt, Homo sapiens
gaaaggaaaguucaguagu

SEQ ID NO: 573542 - RNA, 19 nt, Homo sapiens
caggaccacugcagacaaa

SEQ ID NO: 573543 - RNA, 19 nt, Homo sapiens
gaaagagagguuccagaau

SEQ ID NO: 573544 - RNA, 19 nt, Homo sapiens
cagcugaguuccuugugaa

SEQ ID NO: 573545 - RNA, 19 nt, Homo sapiens
ggauagaggauagugaauu

SEQ ID NO: 573546 - RNA, 19 nt, Homo sapiens
caucaugguucauuucaag

SEQ ID NO: 573547 - RNA, 19 nt, Homo sapiens
ggauuagaacuguuuagaa

SEQ ID NO: 573548 - RNA, 19 nt, Homo sapiens
guugaacagugaaaggaaa

SEQ ID NO: 573549 - RNA, 19 nt, Homo sapiens
agaauugaaucucugauag

SEQ ID NO: 573550 - RNA, 19 nt, Homo sapiens
caguaaagccuggagauuu

SEQ ID NO: 573551 - RNA, 19 nt, Homo sapiens
gcacuuaaccccagaaaug

SEQ ID NO: 573552 - RNA, 19 nt, Homo sapiens
gagaacauuuaacagcaau

SEQ ID NO: 573553 - RNA, 19 nt, Homo sapiens
ggagacagaguaaucacuu

SEQ ID NO: 573554 - RNA, 19 nt, Homo sapiens
gaauuuugaucauggcaua

SEQ ID NO: 573555 - RNA, 19 nt, Homo sapiens
gaagauuccuuagguaucc

SEQ ID NO: 573556 - RNA, 19 nt, Homo sapiens
gaacauuuaacagcaauuc

SEQ ID NO: 573557 - RNA, 19 nt, Homo sapiens
aagagagguuccagaauau

SEQ ID NO: 573558 - RNA, 19 nt, Homo sapiens
gcuccugggucaucuuuca

SEQ ID NO: 573559 - RNA, 19 nt, Homo sapiens
ccagaaaugauuaaacuuc

SEQ ID NO: 573560 - RNA, 19 nt, Homo sapiens
uaaucaauccugagaaaga

SEQ ID NO: 573561 - RNA, 19 nt, Homo sapiens
gaagagacuaauugcuuau

SEQ ID NO: 573562 - RNA, 19 nt, Homo sapiens
gaacuguuuagaacccaua

SEQ ID NO: 573563 - RNA, 19 nt, Homo sapiens
gggcuaguguguuuguguu

SEQ ID NO: 573564 - RNA, 19 nt, Homo sapiens
ggaaagugauuaagcaaua

SEQ ID NO: 573565 - RNA, 19 nt, Homo sapiens
gaagaugguuucuguuuaa

SEQ ID NO: 573566 - RNA, 19 nt, Homo sapiens
gaaggaauguuuagggaua

SEQ ID NO: 573567 - RNA, 19 nt, Homo sapiens
gaaagaagaugcagcacaa

SEQ ID NO: 573568 - RNA, 19 nt, Homo sapiens
guaaagcucuuguuucuga

SEQ ID NO: 573569 - RNA, 19 nt, Homo sapiens
gaaagaauccuguugacua

SEQ ID NO: 573570 - RNA, 19 nt, Homo sapiens
gaagagacguuaagaaugg

SEQ ID NO: 573571 - RNA, 19 nt, Homo sapiens
gagcacagguuugauauuu

SEQ ID NO: 573572 - RNA, 19 nt, Homo sapiens
ggaaagcuguugcauauca

SEQ ID NO: 573573 - RNA, 19 nt, Homo sapiens
caacuaggaugucuugaaa

SEQ ID NO: 573574 - RNA, 19 nt, Homo sapiens
gaagaucagucuaugaaga

SEQ ID NO: 573575 - RNA, 19 nt, Homo sapiens
ccgaacaucucauaaauaa

SEQ ID NO: 573576 - RNA, 19 nt, Homo sapiens
gaccaucucuucuauuaaa

SEQ ID NO: 573577 - RNA, 19 nt, Homo sapiens
gaaaguagaagcuagaauu

SEQ ID NO: 573578 - RNA, 19 nt, Homo sapiens
gagaucaaguuguacguua

SEQ ID NO: 573579 - RNA, 19 nt, Homo sapiens
caucuguacuguagaauua

SEQ ID NO: 573580 - RNA, 19 nt, Homo sapiens
gagaagauguacuaaauuc

SEQ ID NO: 573581 - RNA, 19 nt, Homo sapiens
guaauucucugccuucauu

SEQ ID NO: 573582 - RNA, 19 nt, Homo sapiens
gcacagguuugauauuuau

SEQ ID NO: 573583 - RNA, 19 nt, Homo sapiens
gguaagauguuuauaggaa

SEQ ID NO: 573584 - RNA, 19 nt, Homo sapiens
gaaaguagacgacgacaga

SEQ ID NO: 573585 - RNA, 19 nt, Homo sapiens
gcgagaagauguacuaaau

SEQ ID NO: 573586 - RNA, 19 nt, Homo sapiens
guaauuugaugcucaguuu

SEQ ID NO: 573587 - RNA, 19 nt, Homo sapiens
uaaggaggguggauacaua

SEQ ID NO: 573588 - RNA, 19 nt, Homo sapiens
gaauguaugucucagaaga

SEQ ID NO: 573589 - RNA, 19 nt, Homo sapiens
gcauguaccuuaaauucaa

SEQ ID NO: 573590 - RNA, 19 nt, Homo sapiens
guuaauacaugaagcauug

SEQ ID NO: 573591 - RNA, 19 nt, Homo sapiens
gaaggaaagcuguugcaua

SEQ ID NO: 573592 - RNA, 19 nt, Homo sapiens
gaacccaaaucaaaggaaa

SEQ ID NO: 573593 - RNA, 19 nt, Homo sapiens
auacagagauuggccauua

SEQ ID NO: 573594 - RNA, 19 nt, Homo sapiens
gcaaaccacuauagauuuc

SEQ ID NO: 573595 - RNA, 19 nt, Homo sapiens
gaccgucucuuuaaacaaa

SEQ ID NO: 573596 - RNA, 19 nt, Homo sapiens
caauuaagaugccaaugaa

SEQ ID NO: 573597 - RNA, 19 nt, Homo sapiens
gcaauuaagaugccaauga

SEQ ID NO: 573598 - RNA, 19 nt, Homo sapiens
gcagcacaauguucuagua

SEQ ID NO: 573599 - RNA, 19 nt, Homo sapiens
ggagaauucugggcuagua

SEQ ID NO: 573600 - RNA, 19 nt, Homo sapiens
gaaauccagcguaagaaua

SEQ ID NO: 573601 - RNA, 19 nt, Homo sapiens
aaggaaagcuguugcauau

SEQ ID NO: 573602 - RNA, 19 nt, Homo sapiens
acacaacgauggaugaauu

SEQ ID NO: 573603 - RNA, 19 nt, Homo sapiens
gaaggaagaucagucuaug

SEQ ID NO: 573604 - RNA, 19 nt, Homo sapiens
caacugaauucuaauaugg

SEQ ID NO: 573605 - RNA, 19 nt, Homo sapiens
ugauugagcuucaggcuuu

SEQ ID NO: 573606 - RNA, 19 nt, Homo sapiens
gcucuacacuggacuaaga

SEQ ID NO: 573607 - RNA, 19 nt, Homo sapiens
gaggagcucuauagaaaug

SEQ ID NO: 573608 - RNA, 19 nt, Homo sapiens
ggaguuggaccuagguuua

SEQ ID NO: 573609 - RNA, 19 nt, Homo sapiens
gaaggaagaagagacguua

SEQ ID NO: 573610 - RNA, 19 nt, Homo sapiens
ccucaaagcagaaauaauu

SEQ ID NO: 573611 - RNA, 19 nt, Homo sapiens
caugucaucucuucaguaa

SEQ ID NO: 573612 - RNA, 19 nt, Homo sapiens
uaaauaaggugcgagaaga

SEQ ID NO: 573613 - RNA, 19 nt, Homo sapiens
gaacaucucauaaauaagg

SEQ ID NO: 573614 - RNA, 19 nt, Homo sapiens
ggacuaagagaaguuguua

SEQ ID NO: 573615 - RNA, 19 nt, Homo sapiens
gaggguggauacauaguuu

SEQ ID NO: 573616 - RNA, 19 nt, Homo sapiens
caaguccaguuguuauuaa

SEQ ID NO: 573617 - RNA, 19 nt, Homo sapiens
ugauaggccuucucuguaa

SEQ ID NO: 573618 - RNA, 19 nt, Homo sapiens
gaauugcaguugaaugguu

SEQ ID NO: 573619 - RNA, 19 nt, Homo sapiens
gcacauacagucuauacuu

SEQ ID NO: 573620 - RNA, 19 nt, Homo sapiens
uaagaaacguauugaagga

SEQ ID NO: 573621 - RNA, 19 nt, Homo sapiens
gcacugccuugacaaauca

SEQ ID NO: 573622 - RNA, 19 nt, Homo sapiens
ggagauugcuggcgaugug

SEQ ID NO: 573623 - RNA, 19 nt, Homo sapiens
ccaguuaucuugcucugaa

SEQ ID NO: 573624 - RNA, 19 nt, Homo sapiens
ggucuucaguguugaugua

SEQ ID NO: 573625 - RNA, 19 nt, Homo sapiens
caagaaauccagcguaaga

SEQ ID NO: 573626 - RNA, 19 nt, Homo sapiens
caacaaugaccgucucuuu

SEQ ID NO: 573627 - RNA, 19 nt, Homo sapiens
gaagaaauagaacgaguga

SEQ ID NO: 573628 - RNA, 19 nt, Homo sapiens
uggagaacgucuacaauuu

SEQ ID NO: 573629 - RNA, 19 nt, Homo sapiens
ggaaggugauugcugcuau

SEQ ID NO: 573630 - RNA, 19 nt, Homo sapiens
ggaaaguaaugguaguuca

SEQ ID NO: 573631 - RNA, 19 nt, Homo sapiens
gaauguggaugucaguuca

SEQ ID NO: 573632 - RNA, 19 nt, Homo sapiens
gcuaacagaacaagaagua

SEQ ID NO: 573633 - RNA, 19 nt, Homo sapiens
gcacaugaagacuauagua

SEQ ID NO: 573634 - RNA, 19 nt, Homo sapiens
gaagaagagacguuaagaa

SEQ ID NO: 573635 - RNA, 19 nt, Homo sapiens
gaaggugauugcugcuauu

SEQ ID NO: 573636 - RNA, 19 nt, Homo sapiens
cuacaucucuagaagacua

SEQ ID NO: 573637 - RNA, 19 nt, Homo sapiens
gaauaacaguggucuuagu

SEQ ID NO: 573638 - RNA, 19 nt, Homo sapiens
gugaagcacuguugauguu

SEQ ID NO: 573639 - RNA, 19 nt, Homo sapiens
gggcaaaccacuauagauu

SEQ ID NO: 573640 - RNA, 19 nt, Homo sapiens
aagcuguggugcacuauua

SEQ ID NO: 573641 - RNA, 19 nt, Homo sapiens
gcuaauaguggauuguaua

SEQ ID NO: 573642 - RNA, 19 nt, Homo sapiens
aagcacauauugcaaguuu

SEQ ID NO: 573643 - RNA, 19 nt, Homo sapiens
uugaggagcucuauagaaa

SEQ ID NO: 573644 - RNA, 19 nt, Homo sapiens
gaugucaguucacgucaaa

SEQ ID NO: 573645 - RNA, 19 nt, Homo sapiens
caugaagacuauaguagaa

SEQ ID NO: 573646 - RNA, 19 nt, Homo sapiens
caaacucuauuggauauga

SEQ ID NO: 573647 - RNA, 19 nt, Homo sapiens
gguguaacauggaaagcua

SEQ ID NO: 573648 - RNA, 19 nt, Homo sapiens
guuggcagcugguuauauu

SEQ ID NO: 573649 - RNA, 19 nt, Homo sapiens
acgaccaucucuucuauua

SEQ ID NO: 573650 - RNA, 19 nt, Homo sapiens
ucaaagggcuaacagaaca

SEQ ID NO: 573651 - RNA, 19 nt, Homo sapiens
aaagaauccuguugacuau

SEQ ID NO: 573652 - RNA, 19 nt, Homo sapiens
ccaagcacaugaagacuau

SEQ ID NO: 573653 - RNA, 19 nt, Homo sapiens
gaaagaaacaaggcagaaa

SEQ ID NO: 573654 - RNA, 19 nt, Homo sapiens
ucaaacaguugcugccaaa

SEQ ID NO: 573655 - RNA, 19 nt, Homo sapiens
ugccagauguuaaugauuu

SEQ ID NO: 573656 - RNA, 19 nt, Homo sapiens
ggcaaacucuauuggauau

SEQ ID NO: 573657 - RNA, 19 nt, Homo sapiens
ggagaacgucuacaauuug

SEQ ID NO: 573658 - RNA, 19 nt, Homo sapiens
caaaagaacccaaaucaaa

SEQ ID NO: 573659 - RNA, 19 nt, Homo sapiens
cagauaggcauguaccuua

SEQ ID NO: 573660 - RNA, 19 nt, Homo sapiens
guugaaggcgcgauucuua

SEQ ID NO: 573661 - RNA, 19 nt, Homo sapiens
gaaacaaggcagaaaguag

SEQ ID NO: 573662 - RNA, 19 nt, Homo sapiens
caaguaacuggcucuaaua

SEQ ID NO: 573663 - RNA, 19 nt, Homo sapiens
acaaguaacuggcucuaau

SEQ ID NO: 573664 - RNA, 19 nt, Homo sapiens
gaaggaaacuuacaugguu

SEQ ID NO: 573665 - RNA, 19 nt, Homo sapiens
gcgcugaucucaacaauaa

SEQ ID NO: 573666 - RNA, 19 nt, Homo sapiens
ggaagugcaugguaaauuu

SEQ ID NO: 573667 - RNA, 19 nt, Homo sapiens
cgaaagggaugacagagaa

SEQ ID NO: 573668 - RNA, 19 nt, Homo sapiens
gaaaaugccuagagauauu

SEQ ID NO: 573669 - RNA, 19 nt, Homo sapiens
ggacugugccuccauaauu

SEQ ID NO: 573670 - RNA, 19 nt, Homo sapiens
gaaagacacaccacaagaa

SEQ ID NO: 573671 - RNA, 19 nt, Homo sapiens
ggacagcacucagaugaau

SEQ ID NO: 573672 - RNA, 19 nt, Homo sapiens
gcagaagauuucaacacua

SEQ ID NO: 573673 - RNA, 19 nt, Homo sapiens
gcaggacugugccuccaua

SEQ ID NO: 573674 - RNA, 19 nt, Homo sapiens
auacuaaggugauucauga

SEQ ID NO: 573675 - RNA, 19 nt, Homo sapiens
ggaggaaauugaugguuga

SEQ ID NO: 573676 - RNA, 19 nt, Homo sapiens
gacugugccuccauaauuu

SEQ ID NO: 573677 - RNA, 19 nt, Homo sapiens
cuacaucaaugcagaaaga

SEQ ID NO: 573678 - RNA, 19 nt, Homo sapiens
ggaaugaccguuucucaga

SEQ ID NO: 573679 - RNA, 19 nt, Homo sapiens
caccugaacugcuugcuaa

SEQ ID NO: 573680 - RNA, 19 nt, Homo sapiens
cauccaaguucauauacua

SEQ ID NO: 573681 - RNA, 19 nt, Homo sapiens
ucucagauaucuaugcuuu

SEQ ID NO: 573682 - RNA, 19 nt, Homo sapiens
gcacaaugcccuuauucaa

SEQ ID NO: 573683 - RNA, 19 nt, Homo sapiens
ggagucagaagaacaagua

SEQ ID NO: 573684 - RNA, 19 nt, Homo sapiens
aagaaugagugaaguauug

SEQ ID NO: 573685 - RNA, 19 nt, Homo sapiens
gcacucagaugaaugaaaa

SEQ ID NO: 573686 - RNA, 19 nt, Homo sapiens
aaaccaagacacaguaaua

SEQ ID NO: 573687 - RNA, 19 nt, Homo sapiens
cagcaagggugcagacuau

SEQ ID NO: 573688 - RNA, 19 nt, Homo sapiens
caacauggaaugaccguuu

SEQ ID NO: 573689 - RNA, 19 nt, Homo sapiens
gagaagacccaaaccagaa

SEQ ID NO: 573690 - RNA, 19 nt, Homo sapiens
guauugaaguucugauaga

SEQ ID NO: 573691 - RNA, 19 nt, Homo sapiens
acaaugcccuuauucaaga

SEQ ID NO: 573692 - RNA, 19 nt, Homo sapiens
gauuaaccaugauucagaa

SEQ ID NO: 573693 - RNA, 19 nt, Homo sapiens
gaaugaaccacuuauggaa

SEQ ID NO: 573694 - RNA, 19 nt, Homo sapiens
ucuccaagcugcuauaguu

SEQ ID NO: 573695 - RNA, 19 nt, Homo sapiens
gaaauggagcagacuagaa

SEQ ID NO: 573696 - RNA, 19 nt, Homo sapiens
gcuggugcguggccucuua

SEQ ID NO: 573697 - RNA, 19 nt, Homo sapiens
aaacaugccaacacuauuu

SEQ ID NO: 573698 - RNA, 19 nt, Homo sapiens
caugcagaaugucauaaua

SEQ ID NO: 573699 - RNA, 19 nt, Homo sapiens
gaugaaacauggaacaaac

SEQ ID NO: 573700 - RNA, 19 nt, Homo sapiens
gaaauucgguuggguacca

SEQ ID NO: 573701 - RNA, 19 nt, Homo sapiens
gcaaaacguuuaauucaug

SEQ ID NO: 573702 - RNA, 19 nt, Homo sapiens
gauaugaaugaaccacuua

SEQ ID NO: 573703 - RNA, 19 nt, Homo sapiens
ggaagauauugaugcagaa

SEQ ID NO: 573704 - RNA, 19 nt, Homo sapiens
acacuacacuugcacaaug

SEQ ID NO: 573705 - RNA, 19 nt, Homo sapiens
gaagaagccaugaucaaca

SEQ ID NO: 573706 - RNA, 19 nt, Homo sapiens
guguacagauguuugaauu

SEQ ID NO: 573707 - RNA, 19 nt, Homo sapiens
gcagaaagacacaccacaa

SEQ ID NO: 573708 - RNA, 19 nt, Homo sapiens
gacagagaaugaaguggaa

SEQ ID NO: 573709 - RNA, 19 nt, Homo sapiens
ggagagcuagcauuggaua

SEQ ID NO: 573710 - RNA, 19 nt, Homo sapiens
caaauacauugaugacaag

SEQ ID NO: 573711 - RNA, 19 nt, Homo sapiens
gcaaauauguacgucuuac

SEQ ID NO: 573712 - RNA, 19 nt, Homo sapiens
gaaugaccguuucucagau

SEQ ID NO: 573713 - RNA, 19 nt, Homo sapiens
gaaagagcaacauggaaug

SEQ ID NO: 573714 - RNA, 19 nt, Homo sapiens
guguacaggugaaguuaaa

SEQ ID NO: 573715 - RNA, 19 nt, Homo sapiens
gacaaggacgucuuucaaa

SEQ ID NO: 573716 - RNA, 19 nt, Homo sapiens
ucaucacaguguucaaaua

SEQ ID NO: 573717 - RNA, 19 nt, Homo sapiens
cugaacugcuugcuaagua

SEQ ID NO: 573718 - RNA, 19 nt, Homo sapiens
gaaccuaagucuguuugca

SEQ ID NO: 573719 - RNA, 19 nt, Homo sapiens
gagcuagcauuggauaugu

SEQ ID NO: 573720 - RNA, 19 nt, Homo sapiens
uaggagagcuagcauugga

SEQ ID NO: 573721 - RNA, 19 nt, Homo sapiens
caagacacaguaauagauu

SEQ ID NO: 573722 - RNA, 19 nt, Homo sapiens
guuaugaguuuaccagcaa

SEQ ID NO: 573723 - RNA, 19 nt, Homo sapiens
caaagaaaaugccuagaga

SEQ ID NO: 573724 - RNA, 19 nt, Homo sapiens
cagaagauuucaacacuac

SEQ ID NO: 573725 - RNA, 19 nt, Homo sapiens
gaucauugccaucaccauu

SEQ ID NO: 573726 - RNA, 19 nt, Homo sapiens
ccaaauggcaguucuucuu

SEQ ID NO: 573727 - RNA, 19 nt, Homo sapiens
aaggaaacuuacaugguua

SEQ ID NO: 573728 - RNA, 19 nt, Homo sapiens
gcagaccacuuacaguuuu

SEQ ID NO: 573729 - RNA, 19 nt, Homo sapiens
gcaagggugcagacuauau

SEQ ID NO: 573730 - RNA, 19 nt, Homo sapiens
gagaagaucauugccauca

SEQ ID NO: 573731 - RNA, 19 nt, Homo sapiens
gaaacauggaacaaacuuu

SEQ ID NO: 573732 - RNA, 19 nt, Homo sapiens
gaugagggccuucgagcaa

SEQ ID NO: 573733 - RNA, 19 nt, Homo sapiens
cuacauccaaguucauaua

SEQ ID NO: 573734 - RNA, 19 nt, Homo sapiens
caaacaagaagcuucaaau

SEQ ID NO: 573735 - RNA, 19 nt, Homo sapiens
gacccaaaccagaaaguaa

SEQ ID NO: 573736 - RNA, 19 nt, Homo sapiens
uagccaugguuacaacaua

SEQ ID NO: 573737 - RNA, 19 nt, Homo sapiens
ugugacaacuuacugaaga

SEQ ID NO: 573738 - RNA, 19 nt, Homo sapiens
ugguuuaccucauaugauu

SEQ ID NO: 573739 - RNA, 19 nt, Homo sapiens
cgaaagagcaacauggaau

SEQ ID NO: 573740 - RNA, 19 nt, Homo sapiens
ggaaggaaacuuacauggu

SEQ ID NO: 573741 - RNA, 19 nt, Homo sapiens
gccaugaucaacaaauuaa

SEQ ID NO: 573742 - RNA, 19 nt, Homo sapiens
ggaaauaggagagcuagca

SEQ ID NO: 573743 - RNA, 19 nt, Homo sapiens
aagcggaccuucaguaugg

SEQ ID NO: 573744 - RNA, 19 nt, Homo sapiens
gucaagagcuagguuuaau

SEQ ID NO: 573745 - RNA, 19 nt, Homo sapiens
caaauggcaguucuucuug

SEQ ID NO: 573746 - RNA, 19 nt, Homo sapiens
aagaagccaugaucaacaa

SEQ ID NO: 573747 - RNA, 19 nt, Homo sapiens
gaagugcaugguaaauuug

SEQ ID NO: 573748 - RNA, 19 nt, Homo sapiens
gaaaacaugccaacacuau

SEQ ID NO: 573749 - RNA, 19 nt, Homo sapiens
aaaggaagauauugaugca

SEQ ID NO: 573750 - RNA, 19 nt, Homo sapiens
cgagcaaccagcaaccuua

SEQ ID NO: 573751 - RNA, 19 nt, Homo sapiens
uaacuccuuuguucauguu

SEQ ID NO: 573752 - RNA, 19 nt, Homo sapiens
guauggcuaugguggugua

SEQ ID NO: 573753 - RNA, 19 nt, Homo sapiens
aaugaccguuucucagaua

SEQ ID NO: 573754 - RNA, 19 nt, Homo sapiens
aaagacacaccacaagaaa

SEQ ID NO: 573755 - RNA, 19 nt, Homo sapiens
uaaagcaagccugugguua

SEQ ID NO: 573756 - RNA, 19 nt, Homo sapiens
gaaaauguaucuccaagcu

SEQ ID NO: 573757 - RNA, 19 nt, Homo sapiens
caagaaauggagcagacua

SEQ ID NO: 573758 - RNA, 19 nt, Homo sapiens
gagaguauuacaaacaaga

SEQ ID NO: 573759 - RNA, 19 nt, Homo sapiens
ccacuucaggccauccuua

SEQ ID NO: 573760 - RNA, 19 nt, Homo sapiens
gacuagaagugcaguugau

SEQ ID NO: 573761 - RNA, 19 nt, Homo sapiens
agacacaccacaagaaaug

SEQ ID NO: 573762 - RNA, 19 nt, Homo sapiens
gaaaccaagaguaguagau

SEQ ID NO: 573763 - RNA, 19 nt, Homo sapiens
caggacagcacucagauga

SEQ ID NO: 573764 - RNA, 19 nt, Homo sapiens
gaacaaguccucauugaaa

SEQ ID NO: 573765 - RNA, 19 nt, Homo sapiens
gcaaauaguucauguugga

SEQ ID NO: 573766 - RNA, 19 nt, Homo sapiens
gaagccagauaccuuaaua

SEQ ID NO: 573767 - RNA, 19 nt, Homo sapiens
ugacaaaucuucuuaagga

SEQ ID NO: 573768 - RNA, 19 nt, Homo sapiens
cgacagcacucaaauuaaa

SEQ ID NO: 573769 - RNA, 19 nt, Homo sapiens
gcaaagggcccuacguuaa

SEQ ID NO: 573770 - RNA, 19 nt, Homo sapiens
gagaagauuugauggauga

SEQ ID NO: 573771 - RNA, 19 nt, Homo sapiens
gcaaagugcugaauggaau

SEQ ID NO: 573772 - RNA, 19 nt, Homo sapiens
ggaaugguacuguauauuu

SEQ ID NO: 573773 - RNA, 19 nt, Homo sapiens
gcauugacauucuaauuga

SEQ ID NO: 573774 - RNA, 19 nt, Homo sapiens
gagcugcugugaauaaauu

SEQ ID NO: 573775 - RNA, 19 nt, Homo sapiens
agaacuagcuguacuuuga

SEQ ID NO: 573776 - RNA, 19 nt, Homo sapiens
gcucuacacucauguuuau

SEQ ID NO: 573777 - RNA, 19 nt, Homo sapiens
ggacgcauguauaaucuug

SEQ ID NO: 573778 - RNA, 19 nt, Homo sapiens
gaaugguacuguauauuuc

SEQ ID NO: 573779 - RNA, 19 nt, Homo sapiens
caacgaagaguucagguuu

SEQ ID NO: 573780 - RNA, 19 nt, Homo sapiens
ccagauauauggagcucua

SEQ ID NO: 573781 - RNA, 19 nt, Homo sapiens
ccagcagucuuguacauuu

SEQ ID NO: 573782 - RNA, 19 nt, Homo sapiens
gaguacaccucuaaacuuc

SEQ ID NO: 573783 - RNA, 19 nt, Homo sapiens
agacacacauucauaauca

SEQ ID NO: 573784 - RNA, 19 nt, Homo sapiens
ggaugagaguguacugaaa

SEQ ID NO: 573785 - RNA, 19 nt, Homo sapiens
guacuaguguucaccaguu

SEQ ID NO: 573786 - RNA, 19 nt, Homo sapiens
ugaggaagguucugaaaca

SEQ ID NO: 573787 - RNA, 19 nt, Homo sapiens
acaaagacguauuucagaa

SEQ ID NO: 573788 - RNA, 19 nt, Homo sapiens
gaaguucuaugcgaagaug

SEQ ID NO: 573789 - RNA, 19 nt, Homo sapiens
gugaacaaguccucauuga

SEQ ID NO: 573790 - RNA, 19 nt, Homo sapiens
gcaaggaaaugugaacaag

SEQ ID NO: 573791 - RNA, 19 nt, Homo sapiens
gaagaccgcaaacuacuga

SEQ ID NO: 573792 - RNA, 19 nt, Homo sapiens
gguuauaucaguugucuaa

SEQ ID NO: 573793 - RNA, 19 nt, Homo sapiens
gaaauucuacacucaacaa

SEQ ID NO: 573794 - RNA, 19 nt, Homo sapiens
agacuuggauuucagcauu

SEQ ID NO: 573795 - RNA, 19 nt, Homo sapiens
guaacuaacugcuucaaaa

SEQ ID NO: 573796 - RNA, 19 nt, Homo sapiens
aaggagaauugguaacuaa

SEQ ID NO: 573797 - RNA, 19 nt, Homo sapiens
caacaaugacgcuggcuuu

SEQ ID NO: 573798 - RNA, 19 nt, Homo sapiens
caagaugaauuagcaagga

SEQ ID NO: 573799 - RNA, 19 nt, Homo sapiens
ccagagagaguacugaauu

SEQ ID NO: 573800 - RNA, 19 nt, Homo sapiens
ccagauggcuauccugcuu

SEQ ID NO: 573801 - RNA, 19 nt, Homo sapiens
caaugacgcuggcuuugug

SEQ ID NO: 573802 - RNA, 19 nt, Homo sapiens
cgaggaagaccgcaaacua

SEQ ID NO: 573803 - RNA, 19 nt, Homo sapiens
gagaauugguaacuaacug

SEQ ID NO: 573804 - RNA, 19 nt, Homo sapiens
agagaguacugaauucuug

SEQ ID NO: 573805 - RNA, 19 nt, Homo sapiens
gaacaagaaaccacacaca

SEQ ID NO: 573806 - RNA, 19 nt, Homo sapiens
agacagugcuugauguuca

SEQ ID NO: 573807 - RNA, 19 nt, Homo sapiens
cagcaugaucuccaaguua

SEQ ID NO: 573808 - RNA, 19 nt, Homo sapiens
cauagaagacaaagacgua

SEQ ID NO: 573809 - RNA, 19 nt, Homo sapiens
gaagacacacucaaucaag

SEQ ID NO: 573810 - RNA, 19 nt, Homo sapiens
ggaaaggaauggugaaacc

SEQ ID NO: 573811 - RNA, 19 nt, Homo sapiens
uaucagcgauucacagcuu

SEQ ID NO: 573812 - RNA, 19 nt, Homo sapiens
ucaaguacauagaagacaa

SEQ ID NO: 573813 - RNA, 19 nt, Homo sapiens
gugaauaaauuuggaaugg

SEQ ID NO: 573814 - RNA, 19 nt, Homo sapiens
aagcacacaagaugaauua

SEQ ID NO: 573815 - RNA, 19 nt, Homo sapiens
ggugaaaccaucaauacaa

SEQ ID NO: 573816 - RNA, 19 nt, Homo sapiens
gcacuggacgacuuuagaa

SEQ ID NO: 573817 - RNA, 19 nt, Homo sapiens
guacagacagugcuugaug

SEQ ID NO: 573818 - RNA, 19 nt, Homo sapiens
caugaaagcacacaagaug

SEQ ID NO: 573819 - RNA, 19 nt, Homo sapiens
cagcaaauaguucauguug

SEQ ID NO: 573820 - RNA, 19 nt, Homo sapiens
gacaaagacguauuucaga

SEQ ID NO: 573821 - RNA, 19 nt, Homo sapiens
uuucugagcugcugugaau

SEQ ID NO: 573822 - RNA, 19 nt, Homo sapiens
ucaguugucuaaaggagaa

SEQ ID NO: 573823 - RNA, 19 nt, Homo sapiens
agcaugaucuccaaguuaa

SEQ ID NO: 573824 - RNA, 19 nt, Homo sapiens
gaacuagcuguacuuugaa

SEQ ID NO: 573825 - RNA, 19 nt, Homo sapiens
acaagaaaccacacacaaa

SEQ ID NO: 573826 - RNA, 19 nt, Homo sapiens
aaaggagaauugguaacua

SEQ ID NO: 573827 - RNA, 19 nt, Homo sapiens
gcacuugacaaacucagaa

SEQ ID NO: 573828 - RNA, 19 nt, Homo sapiens
cgaagaugcucgccaagag

SEQ ID NO: 573829 - RNA, 19 nt, Homo sapiens
guacauagaagacaaagac

SEQ ID NO: 573830 - RNA, 19 nt, Homo sapiens
uaaaugaccccaaaaugua

SEQ ID NO: 573831 - RNA, 19 nt, Homo sapiens
ggacaccuacaguuacuug

SEQ ID NO: 573832 - RNA, 19 nt, Homo sapiens
gaacagugcaagugacgau

SEQ ID NO: 573833 - RNA, 19 nt, Homo sapiens
ccacacagaauuucagaau

SEQ ID NO: 573834 - RNA, 19 nt, Homo sapiens
guggaguuguacagucuua

SEQ ID NO: 573835 - RNA, 19 nt, Homo sapiens
gaaaccaucaauacaagau

SEQ ID NO: 573836 - RNA, 19 nt, Homo sapiens
augggaagauuaucgauuu

SEQ ID NO: 573837 - RNA, 19 nt, Homo sapiens
ggauggagaagauuugaug

SEQ ID NO: 573838 - RNA, 19 nt, Homo sapiens
ggagaacuagcuguacuuu

SEQ ID NO: 573839 - RNA, 19 nt, Homo sapiens
gaaaauugacgugguuaua

SEQ ID NO: 573840 - RNA, 19 nt, Homo sapiens
gauuugggacgcauguaua

SEQ ID NO: 573841 - RNA, 19 nt, Homo sapiens
ugaaagcacacaagaugaa

SEQ ID NO: 573842 - RNA, 19 nt, Homo sapiens
aacgaagaguucagguuua

SEQ ID NO: 573843 - RNA, 19 nt, Homo sapiens
gugaaaccaucaauacaag

SEQ ID NO: 573844 - RNA, 19 nt, Homo sapiens
agaguguacugaaauucua

SEQ ID NO: 573845 - RNA, 19 nt, Homo sapiens
gaugagaguguacugaaau

SEQ ID NO: 573846 - RNA, 19 nt, Homo sapiens
auauggagcucuacacuca

SEQ ID NO: 573847 - RNA, 19 nt, Homo sapiens
uugaugagguggaauugaa

SEQ ID NO: 573848 - RNA, 19 nt, Homo sapiens
ugacgugguuauaucaguu

SEQ ID NO: 573849 - RNA, 19 nt, Homo sapiens
guacuuugaauaaggauug

SEQ ID NO: 573850 - RNA, 19 nt, Homo sapiens
uuuauuggaugcugacaaa

SEQ ID NO: 573851 - RNA, 19 nt, Homo sapiens
cagagagaguacugaauuc

SEQ ID NO: 573852 - RNA, 19 nt, Homo sapiens
gugccuaccucaauagaca

SEQ ID NO: 573853 - RNA, 19 nt, Homo sapiens
gaugaggaagguucugaaa

SEQ ID NO: 573854 - RNA, 19 nt, Homo sapiens
gaacagaagcaggaacaag

SEQ ID NO: 573855 - RNA, 19 nt, Homo sapiens
gcacucaaauuaaaaugga

SEQ ID NO: 573856 - RNA, 19 nt, Homo sapiens
aaauugacgugguuauauc

SEQ ID NO: 573857 - RNA, 19 nt, Homo sapiens
gaacuagaagacacacuca

SEQ ID NO: 573858 - RNA, 19 nt, Homo sapiens
gcccaaucauccaguaaau

SEQ ID NO: 573859 - RNA, 19 nt, Homo sapiens
uguggucgcuucauaaaca

SEQ ID NO: 573860 - RNA, 19 nt, Homo sapiens
cguuaacaguguauaaaga

SEQ ID NO: 573861 - RNA, 19 nt, Homo sapiens
gaaaaggacaccuacaguu

SEQ ID NO: 573862 - RNA, 19 nt, Homo sapiens
gcuguacuuugaauaagga

SEQ ID NO: 573863 - RNA, 19 nt, Homo sapiens
agaagacaaagacguauuu

SEQ ID NO: 573864 - RNA, 19 nt, Homo sapiens
gaacacauggaguauauua

SEQ ID NO: 573865 - RNA, 19 nt, Homo sapiens
gaagauauguccccauuua

SEQ ID NO: 573866 - RNA, 19 nt, Homo sapiens
gauaagaacacauggagua

SEQ ID NO: 573867 - RNA, 19 nt, Homo sapiens
gagaagagaugccuguugu

SEQ ID NO: 573868 - RNA, 19 nt, Homo sapiens
gaaaauaucuguggcauug

SEQ ID NO: 573869 - RNA, 19 nt, Homo sapiens
gaccugaucuccaccauga

SEQ ID NO: 573870 - RNA, 19 nt, Homo sapiens
gaaugugaauguucugaaa

SEQ ID NO: 573871 - RNA, 19 nt, Homo sapiens
guacaaagauaguuucucu

SEQ ID NO: 573872 - RNA, 19 nt, Homo sapiens
caacagauuuggccauuca

SEQ ID NO: 573873 - RNA, 19 nt, Homo sapiens
ggugcaaacugaacaauga

SEQ ID NO: 573874 - RNA, 19 nt, Homo sapiens
gaagagaugccuguuguuu

SEQ ID NO: 573875 - RNA, 19 nt, Homo sapiens
uaagcaaugugcaggaaua

SEQ ID NO: 573876 - RNA, 19 nt, Homo sapiens
aaaccaacauuaaggagua

SEQ ID NO: 573877 - RNA, 19 nt, Homo sapiens
ccacucagauuauaacaug

SEQ ID NO: 573878 - RNA, 19 nt, Homo sapiens
gcaggaauaugauuuggau

SEQ ID NO: 573879 - RNA, 19 nt, Homo sapiens
gcaaugugcaggaauauga

SEQ ID NO: 573880 - RNA, 19 nt, Homo sapiens
uaacaugguucuagcguau

SEQ ID NO: 573881 - RNA, 19 nt, Homo sapiens
ggacagccaaauagaauaa

SEQ ID NO: 573882 - RNA, 19 nt, Homo sapiens
ccacuaaaccguucuguga

SEQ ID NO: 573883 - RNA, 19 nt, Homo sapiens
ccaggaagaugaucgcuau

SEQ ID NO: 573884 - RNA, 19 nt, Homo sapiens
gacuaucaguucaccuuua

SEQ ID NO: 573885 - RNA, 19 nt, Homo sapiens
gaugaucucuaccgauaug

SEQ ID NO: 573886 - RNA, 19 nt, Homo sapiens
gcgauacuguugaauguga

SEQ ID NO: 573887 - RNA, 19 nt, Homo sapiens
gaaaaucgauaccaaggaa

SEQ ID NO: 573888 - RNA, 19 nt, Homo sapiens
gcacagccaacaccaauga

SEQ ID NO: 573889 - RNA, 19 nt, Homo sapiens
gaggauauauguucaacca

SEQ ID NO: 573890 - RNA, 19 nt, Homo sapiens
gaaggacagccaaauagaa

SEQ ID NO: 573891 - RNA, 19 nt, Homo sapiens
caaggagaauuaugacaau

SEQ ID NO: 573892 - RNA, 19 nt, Homo sapiens
ggaagaugaucgcuauuac

SEQ ID NO: 573893 - RNA, 19 nt, Homo sapiens
ccaaaugcuucucuucaga

SEQ ID NO: 573894 - RNA, 19 nt, Homo sapiens
gaggaaacacacacaauga

SEQ ID NO: 573895 - RNA, 19 nt, Homo sapiens
aagaacacauggaguauau

SEQ ID NO: 573896 - RNA, 19 nt, Homo sapiens
caaugugguuguuagauau

SEQ ID NO: 573897 - RNA, 19 nt, Homo sapiens
agacuucguuucaaucauu

SEQ ID NO: 573898 - RNA, 19 nt, Homo sapiens
aaacagggauuuggacaug

SEQ ID NO: 573899 - RNA, 19 nt, Homo sapiens
agaagaagguagaauuugu

SEQ ID NO: 573900 - RNA, 19 nt, Homo sapiens
cagauggaccuggaaauua

SEQ ID NO: 573901 - RNA, 19 nt, Homo sapiens
ucauaaagcuguggucaau

SEQ ID NO: 573902 - RNA, 19 nt, Homo sapiens
gaguguaagaucaguaaua

SEQ ID NO: 573903 - RNA, 19 nt, Homo sapiens
ggaaaugucagccaugcaa

SEQ ID NO: 573904 - RNA, 19 nt, Homo sapiens
gcuaaauuguucuguagga

SEQ ID NO: 573905 - RNA, 19 nt, Homo sapiens
gcuggcaacugaugaacaa

SEQ ID NO: 573906 - RNA, 19 nt, Homo sapiens
ccuaugacauugccuguga

SEQ ID NO: 573907 - RNA, 19 nt, Homo sapiens
ggaggaaacacacacaaug

SEQ ID NO: 573908 - RNA, 19 nt, Homo sapiens
cguaugaccuugcuucuag

SEQ ID NO: 573909 - RNA, 19 nt, Homo sapiens
agagaugccuguuguuuca

SEQ ID NO: 573910 - RNA, 19 nt, Homo sapiens
gcagauacaacuggucuuu

SEQ ID NO: 573911 - RNA, 19 nt, Homo sapiens
gcauuugguuggaaacuca

SEQ ID NO: 573912 - RNA, 19 nt, Homo sapiens
guaguugggaccauuuaua

SEQ ID NO: 573913 - RNA, 19 nt, Homo sapiens
agauggaccuggaaauuau

SEQ ID NO: 573914 - RNA, 19 nt, Homo sapiens
gccaguguauggaauggua

SEQ ID NO: 573915 - RNA, 19 nt, Homo sapiens
gaauaaugcagucaucuca

SEQ ID NO: 573916 - RNA, 19 nt, Homo sapiens
ccagaagaagguagaauuu

SEQ ID NO: 573917 - RNA, 19 nt, Homo sapiens
gaccagggcccuauacguu

SEQ ID NO: 573918 - RNA, 19 nt, Homo sapiens
gcacacauuguuacacuga

SEQ ID NO: 573919 - RNA, 19 nt, Homo sapiens
gaugcuggauucuguggaa

SEQ ID NO: 573920 - RNA, 19 nt, Homo sapiens
gaaugugaccaaugaguug

SEQ ID NO: 573921 - RNA, 19 nt, Homo sapiens
caauucaagugaugucaga

SEQ ID NO: 573922 - RNA, 19 nt, Homo sapiens
gagaguguaagaucaguaa

SEQ ID NO: 573923 - RNA, 19 nt, Homo sapiens
gcuaguugcugcauuuagu

SEQ ID NO: 573924 - RNA, 19 nt, Homo sapiens
gagcaucugugagaagugu

SEQ ID NO: 573925 - RNA, 19 nt, Homo sapiens
ggaauaugauuuggauaag

SEQ ID NO: 573926 - RNA, 19 nt, Homo sapiens
ggaaugugaccaaugaguu

SEQ ID NO: 573927 - RNA, 19 nt, Homo sapiens
cgaggcaucugcaauucaa

SEQ ID NO: 573928 - RNA, 19 nt, Homo sapiens
ggacuccaaugccuaugug

SEQ ID NO: 573929 - RNA, 19 nt, Homo sapiens
ucacugcccucucuaugga

SEQ ID NO: 573930 - RNA, 19 nt, Homo sapiens
cagcgauacuguugaaugu

SEQ ID NO: 573931 - RNA, 19 nt, Homo sapiens
gugaugcugcuuauaauuu

SEQ ID NO: 573932 - RNA, 19 nt, Homo sapiens
ugagagagauggcaaugag

SEQ ID NO: 573933 - RNA, 19 nt, Homo sapiens
ccaagaauuucaaccucaa

SEQ ID NO: 573934 - RNA, 19 nt, Homo sapiens
cagaggaacauguuauuau

SEQ ID NO: 573935 - RNA, 19 nt, Homo sapiens
cuacugccaaggagaauua

SEQ ID NO: 573936 - RNA, 19 nt, Homo sapiens
ggagcaguaugcagugguu

SEQ ID NO: 573937 - RNA, 19 nt, Homo sapiens
uuagugaugcugcuuauaa

SEQ ID NO: 573938 - RNA, 19 nt, Homo sapiens
gggaccauuuauauguuua

SEQ ID NO: 573939 - RNA, 19 nt, Homo sapiens
gggauauaccuaauguuaa

SEQ ID NO: 573940 - RNA, 19 nt, Homo sapiens
gguagaauuuguccuuaag

SEQ ID NO: 573941 - RNA, 19 nt, Homo sapiens
gguccuggauguucaguuc

SEQ ID NO: 573942 - RNA, 19 nt, Homo sapiens
ggaaaggugaagcauguga

SEQ ID NO: 573943 - RNA, 19 nt, Homo sapiens
uagcagcgauacuguugaa

SEQ ID NO: 573944 - RNA, 19 nt, Homo sapiens
gaagaugaucgcuauuaca

SEQ ID NO: 573945 - RNA, 19 nt, Homo sapiens
caguucaccuuuagucuau

SEQ ID NO: 573946 - RNA, 19 nt, Homo sapiens
gcacugcgagaccugcaua

SEQ ID NO: 573947 - RNA, 19 nt, Homo sapiens
agauacaacuggucuuuca

SEQ ID NO: 573948 - RNA, 19 nt, Homo sapiens
gaaccacagcugcucagaa

SEQ ID NO: 573949 - RNA, 19 nt, Homo sapiens
ggcaacugaugaacaagaa

SEQ ID NO: 573950 - RNA, 19 nt, Homo sapiens
gucauucuuuggcauuaua

SEQ ID NO: 573951 - RNA, 19 nt, Homo sapiens
ggagaagagaugccuguug

SEQ ID NO: 573952 - RNA, 19 nt, Homo sapiens
caacuggucuuucauucac

SEQ ID NO: 573953 - RNA, 19 nt, Homo sapiens
ccaaggagaauuaugacaa

SEQ ID NO: 573954 - RNA, 19 nt, Homo sapiens
ggcauuggcuggcauuugg

SEQ ID NO: 573955 - RNA, 19 nt, Homo sapiens
cacaaugacacaucuauga

SEQ ID NO: 573956 - RNA, 19 nt, Homo sapiens
cgaggagaguguaagauca

SEQ ID NO: 573957 - RNA, 19 nt, Homo sapiens
ucaaugccuccaagaauuu

SEQ ID NO: 573958 - RNA, 19 nt, Homo sapiens
cugcauaucuggcuucuac

SEQ ID NO: 573959 - RNA, 19 nt, Homo sapiens
guacuacuguaacaagaag

SEQ ID NO: 573960 - RNA, 19 nt, Homo sapiens
gaaggccagaucuccauuu

SEQ ID NO: 573961 - RNA, 19 nt, Homo sapiens
ucagaggaacauguuauua

SEQ ID NO: 573962 - RNA, 19 nt, Homo sapiens
ccaaggaaacccucucaga

SEQ ID NO: 573963 - RNA, 19 nt, Homo sapiens
cacaguaaaugcaucaauc

SEQ ID NO: 573964 - RNA, 19 nt, Homo sapiens
caagagagccuguauauaa

SEQ ID NO: 573965 - RNA, 19 nt, Homo sapiens
ggaaaggacucauucaugu

SEQ ID NO: 573966 - RNA, 19 nt, Homo sapiens
gaacacauggaguauauua

SEQ ID NO: 573967 - RNA, 19 nt, Homo sapiens
ggagacaccugggaaauaa

SEQ ID NO: 573968 - RNA, 19 nt, Homo sapiens
gaagauauguccccauuua

SEQ ID NO: 573969 - RNA, 19 nt, Homo sapiens
caaacuuccuucugaaaua

SEQ ID NO: 573970 - RNA, 19 nt, Homo sapiens
guacauaacuauacaguag

SEQ ID NO: 573971 - RNA, 19 nt, Homo sapiens
ggagcuaguuuguugauaa

SEQ ID NO: 573972 - RNA, 19 nt, Homo sapiens
gaacaccucuacuuugaga

SEQ ID NO: 573973 - RNA, 19 nt, Homo sapiens
caaggaauuugaaccauaa

SEQ ID NO: 573974 - RNA, 19 nt, Homo sapiens
guagggagcuaguuuguug

SEQ ID NO: 573975 - RNA, 19 nt, Homo sapiens
gauaagaacacauggagua

SEQ ID NO: 573976 - RNA, 19 nt, Homo sapiens
gaaggaaaguacuggacua

SEQ ID NO: 573977 - RNA, 19 nt, Homo sapiens
ggacucagaugccaggaaa

SEQ ID NO: 573978 - RNA, 19 nt, Homo sapiens
gagaagagaugccuguugu

SEQ ID NO: 573979 - RNA, 19 nt, Homo sapiens
gaaaauaucuguggcauug

SEQ ID NO: 573980 - RNA, 19 nt, Homo sapiens
gaccugaucuccaccauga

SEQ ID NO: 573981 - RNA, 19 nt, Homo sapiens
gaaugugaauguucugaaa

SEQ ID NO: 573982 - RNA, 19 nt, Homo sapiens
gauggaguguuuacaagua

SEQ ID NO: 573983 - RNA, 19 nt, Homo sapiens
cagaacaccucuacuuuga

SEQ ID NO: 573984 - RNA, 19 nt, Homo sapiens
ggacuuguuugcccucuuu

SEQ ID NO: 573985 - RNA, 19 nt, Homo sapiens
guacaaagauaguuucucu

SEQ ID NO: 573986 - RNA, 19 nt, Homo sapiens
caacagauuuggccauuca

SEQ ID NO: 573987 - RNA, 19 nt, Homo sapiens
gaagagaugccuguuguuu

SEQ ID NO: 573988 - RNA, 19 nt, Homo sapiens
uaagcaaugugcaggaaua

SEQ ID NO: 573989 - RNA, 19 nt, Homo sapiens
gcacagaacaccucuacuu

SEQ ID NO: 573990 - RNA, 19 nt, Homo sapiens
aaaccaacauuaaggagua

SEQ ID NO: 573991 - RNA, 19 nt, Homo sapiens
ccacucagauuauaacaug

SEQ ID NO: 573992 - RNA, 19 nt, Homo sapiens
gaugugcuauuuauucuug

SEQ ID NO: 573993 - RNA, 19 nt, Homo sapiens
gcaggaauaugauuuggau

SEQ ID NO: 573994 - RNA, 19 nt, Homo sapiens
gauaagcgaucagaggaaa

SEQ ID NO: 573995 - RNA, 19 nt, Homo sapiens
agaaaugaaugaacuguga

SEQ ID NO: 573996 - RNA, 19 nt, Homo sapiens
uauaaagacuguucccaaa

SEQ ID NO: 573997 - RNA, 19 nt, Homo sapiens
gcaaugugcaggaauauga

SEQ ID NO: 573998 - RNA, 19 nt, Homo sapiens
uaacaugguucuagcguau

SEQ ID NO: 573999 - RNA, 19 nt, Homo sapiens
gguagugacugagauguaa

SEQ ID NO: 574000 - RNA, 19 nt, Homo sapiens
gagcuaguuuguugauaaa

SEQ ID NO: 574001 - RNA, 19 nt, Homo sapiens
ggacagccaaauagaauaa

SEQ ID NO: 574002 - RNA, 19 nt, Homo sapiens
ccacuaaaccguucuguga

SEQ ID NO: 574003 - RNA, 19 nt, Homo sapiens
gaggaaagcagaaaugaau

SEQ ID NO: 574004 - RNA, 19 nt, Homo sapiens
ggacauuucucagcagaug

SEQ ID NO: 574005 - RNA, 19 nt, Homo sapiens
ccaggaagaugaucgcuau

SEQ ID NO: 574006 - RNA, 19 nt, Homo sapiens
gacuaucaguucaccuuua

SEQ ID NO: 574007 - RNA, 19 nt, Homo sapiens
gaugaucucuaccgauaug

SEQ ID NO: 574008 - RNA, 19 nt, Homo sapiens
gcgauacuguugaauguga

SEQ ID NO: 574009 - RNA, 19 nt, Homo sapiens
gaucacaagcuuucuuuga

SEQ ID NO: 574010 - RNA, 19 nt, Homo sapiens
gaaaaucgauaccaaggaa

SEQ ID NO: 574011 - RNA, 19 nt, Homo sapiens
uaaaggcaguaauggaauu

SEQ ID NO: 574012 - RNA, 19 nt, Homo sapiens
gagagccuguauauaaauu

SEQ ID NO: 574013 - RNA, 19 nt, Homo sapiens
gaacuaggaaugacacuca

SEQ ID NO: 574014 - RNA, 19 nt, Homo sapiens
gcacagccaacaccaauga

SEQ ID NO: 574015 - RNA, 19 nt, Homo sapiens
gaggauauauguucaacca

SEQ ID NO: 574016 - RNA, 19 nt, Homo sapiens
gaaggacagccaaauagaa

SEQ ID NO: 574017 - RNA, 19 nt, Homo sapiens
aauacaaacuuccuucuga

SEQ ID NO: 574018 - RNA, 19 nt, Homo sapiens
gcacuuguacauaacuaua

SEQ ID NO: 574019 - RNA, 19 nt, Homo sapiens
uaaaugcagugccuagaga

SEQ ID NO: 574020 - RNA, 19 nt, Homo sapiens
ggaaagcagaaaugaauga

SEQ ID NO: 574021 - RNA, 19 nt, Homo sapiens
ggucagcaguguuacuuug

SEQ ID NO: 574022 - RNA, 19 nt, Homo sapiens
caaggagaauuaugacaau

SEQ ID NO: 574023 - RNA, 19 nt, Homo sapiens
agacuaaccuguagcaauc

SEQ ID NO: 574024 - RNA, 19 nt, Homo sapiens
guucaaagacuaaccugua

SEQ ID NO: 574025 - RNA, 19 nt, Homo sapiens
ggaagaugaucgcuauuac

SEQ ID NO: 574026 - RNA, 19 nt, Homo sapiens
gugcaaauccugcuccuuu

SEQ ID NO: 574027 - RNA, 19 nt, Homo sapiens
aagagagccuguauauaaa

SEQ ID NO: 574028 - RNA, 19 nt, Homo sapiens
ugacucaccugcaugauca

SEQ ID NO: 574029 - RNA, 19 nt, Homo sapiens
ccaaaugcuucucuucaga

SEQ ID NO: 574030 - RNA, 19 nt, Homo sapiens
gaggaaacacacacaauga

SEQ ID NO: 574031 - RNA, 19 nt, Homo sapiens
aagaacacauggaguauau

SEQ ID NO: 574032 - RNA, 19 nt, Homo sapiens
gcaguaauggaauugauuu

SEQ ID NO: 574033 - RNA, 19 nt, Homo sapiens
ccugggaucucuggcauua

SEQ ID NO: 574034 - RNA, 19 nt, Homo sapiens
ccaaggaacauuugaucua

SEQ ID NO: 574035 - RNA, 19 nt, Homo sapiens
ucugaagccugcuaucuuu

SEQ ID NO: 574036 - RNA, 19 nt, Homo sapiens
caaugugguuguuagauau

SEQ ID NO: 574037 - RNA, 19 nt, Homo sapiens
agacuucguuucaaucauu

SEQ ID NO: 574038 - RNA, 19 nt, Homo sapiens
gauucaagcuuaguuuguu

SEQ ID NO: 574039 - RNA, 19 nt, Homo sapiens
gaauaacaaacccaagaaa

SEQ ID NO: 574040 - RNA, 19 nt, Homo sapiens
gccaucugguuaugucuua

SEQ ID NO: 574041 - RNA, 19 nt, Homo sapiens
agaauugccuggaaagaug

SEQ ID NO: 574042 - RNA, 19 nt, Homo sapiens
ggaaaacucugccaaaugg

SEQ ID NO: 574043 - RNA, 19 nt, Homo sapiens
cagauggaccuggaaauua

SEQ ID NO: 574044 - RNA, 19 nt, Homo sapiens
aaacagggauuuggacaug

SEQ ID NO: 574045 - RNA, 19 nt, Homo sapiens
agaagaagguagaauuugu

SEQ ID NO: 574046 - RNA, 19 nt, Homo sapiens
ucauaaagcuguggucaau

SEQ ID NO: 574047 - RNA, 19 nt, Homo sapiens
gaguguaagaucaguaaua

SEQ ID NO: 574048 - RNA, 19 nt, Homo sapiens
caacaaguauuugcuaaac

SEQ ID NO: 574049 - RNA, 19 nt, Homo sapiens
caaagccgcuguccucucu

SEQ ID NO: 574050 - RNA, 19 nt, Homo sapiens
guaaaugucgccuuggaaa

SEQ ID NO: 574051 - RNA, 19 nt, Homo sapiens
ggaaaugucagccaugcaa

SEQ ID NO: 574052 - RNA, 19 nt, Homo sapiens
gcuaaauuguucuguagga

SEQ ID NO: 574053 - RNA, 19 nt, Homo sapiens
gcuggcaacugaugaacaa

SEQ ID NO: 574054 - RNA, 19 nt, Homo sapiens
ccuaugacauugccuguga

SEQ ID NO: 574055 - RNA, 19 nt, Homo sapiens
ggaggaaacacacacaaug

SEQ ID NO: 574056 - RNA, 19 nt, Homo sapiens
cguaugaccuugcuucuag

SEQ ID NO: 574057 - RNA, 19 nt, Homo sapiens
gaaaagaccccuccucuca

SEQ ID NO: 574058 - RNA, 19 nt, Homo sapiens
gggcacugcuuggaaauug

SEQ ID NO: 574059 - RNA, 19 nt, Homo sapiens
caaggaacauuugaucuag

SEQ ID NO: 574060 - RNA, 19 nt, Homo sapiens
agagaugccuguuguuuca

SEQ ID NO: 574061 - RNA, 19 nt, Homo sapiens
gcagauacaacuggucuuu

SEQ ID NO: 574062 - RNA, 19 nt, Homo sapiens
gcauuugguuggaaacuca

SEQ ID NO: 574063 - RNA, 19 nt, Homo sapiens
guaguugggaccauuuaua

SEQ ID NO: 574064 - RNA, 19 nt, Homo sapiens
gaacacauggaguauauua

SEQ ID NO: 574065 - RNA, 19 nt, Homo sapiens
gaagauauguccccauuua

SEQ ID NO: 574066 - RNA, 19 nt, Homo sapiens
gauaagaacacauggagua

SEQ ID NO: 574067 - RNA, 19 nt, Homo sapiens
gagaagagaugccuguugu

SEQ ID NO: 574068 - RNA, 19 nt, Homo sapiens
gaaaauaucuguggcauug

SEQ ID NO: 574069 - RNA, 19 nt, Homo sapiens
gaccugaucuccaccauga

SEQ ID NO: 574070 - RNA, 19 nt, Homo sapiens
gaaugugaauguucugaaa

SEQ ID NO: 574071 - RNA, 19 nt, Homo sapiens
guacaaagauaguuucucu

SEQ ID NO: 574072 - RNA, 19 nt, Homo sapiens
caacagauuuggccauuca

SEQ ID NO: 574073 - RNA, 19 nt, Homo sapiens
ggugcaaacugaacaauga

SEQ ID NO: 574074 - RNA, 19 nt, Homo sapiens
gaagagaugccuguuguuu

SEQ ID NO: 574075 - RNA, 19 nt, Homo sapiens
uaagcaaugugcaggaaua

SEQ ID NO: 574076 - RNA, 19 nt, Homo sapiens
aaaccaacauuaaggagua

SEQ ID NO: 574077 - RNA, 19 nt, Homo sapiens
ccacucagauuauaacaug

SEQ ID NO: 574078 - RNA, 19 nt, Homo sapiens
gcaggaauaugauuuggau

SEQ ID NO: 574079 - RNA, 19 nt, Homo sapiens
gcaaugugcaggaauauga

SEQ ID NO: 574080 - RNA, 19 nt, Homo sapiens
uaacaugguucuagcguau

SEQ ID NO: 574081 - RNA, 19 nt, Homo sapiens
ggacagccaaauagaauaa

SEQ ID NO: 574082 - RNA, 19 nt, Homo sapiens
ccacuaaaccguucuguga

SEQ ID NO: 574083 - RNA, 19 nt, Homo sapiens
ccaggaagaugaucgcuau

SEQ ID NO: 574084 - RNA, 19 nt, Homo sapiens
gacuaucaguucaccuuua

SEQ ID NO: 574085 - RNA, 19 nt, Homo sapiens
gaugaucucuaccgauaug

SEQ ID NO: 574086 - RNA, 19 nt, Homo sapiens
gcgauacuguugaauguga

SEQ ID NO: 574087 - RNA, 19 nt, Homo sapiens
gaaaaucgauaccaaggaa

SEQ ID NO: 574088 - RNA, 19 nt, Homo sapiens
gcacagccaacaccaauga

SEQ ID NO: 574089 - RNA, 19 nt, Homo sapiens
gaggauauauguucaacca

SEQ ID NO: 574090 - RNA, 19 nt, Homo sapiens
gaaggacagccaaauagaa

SEQ ID NO: 574091 - RNA, 19 nt, Homo sapiens
caaggagaauuaugacaau

SEQ ID NO: 574092 - RNA, 19 nt, Homo sapiens
ggaagaugaucgcuauuac

SEQ ID NO: 574093 - RNA, 19 nt, Homo sapiens
ccaaaugcuucucuucaga

SEQ ID NO: 574094 - RNA, 19 nt, Homo sapiens
gaggaaacacacacaauga

SEQ ID NO: 574095 - RNA, 19 nt, Homo sapiens
aagaacacauggaguauau

SEQ ID NO: 574096 - RNA, 19 nt, Homo sapiens
caaugugguuguuagauau

SEQ ID NO: 574097 - RNA, 19 nt, Homo sapiens
agacuucguuucaaucauu

SEQ ID NO: 574098 - RNA, 19 nt, Homo sapiens
aaacagggauuuggacaug

SEQ ID NO: 574099 - RNA, 19 nt, Homo sapiens
agaagaagguagaauuugu

SEQ ID NO: 574100 - RNA, 19 nt, Homo sapiens
ucauaaagcuguggucaau

SEQ ID NO: 574101 - RNA, 19 nt, Homo sapiens
gaguguaagaucaguaaua

SEQ ID NO: 574102 - RNA, 19 nt, Homo sapiens
cagauggaccuggaaauua

SEQ ID NO: 574103 - RNA, 19 nt, Homo sapiens
ggaaaugucagccaugcaa

SEQ ID NO: 574104 - RNA, 19 nt, Homo sapiens
gcuaaauuguucuguagga

SEQ ID NO: 574105 - RNA, 19 nt, Homo sapiens
gcuggcaacugaugaacaa

SEQ ID NO: 574106 - RNA, 19 nt, Homo sapiens
ccuaugacauugccuguga

SEQ ID NO: 574107 - RNA, 19 nt, Homo sapiens
ggaggaaacacacacaaug

SEQ ID NO: 574108 - RNA, 19 nt, Homo sapiens
cguaugaccuugcuucuag

SEQ ID NO: 574109 - RNA, 19 nt, Homo sapiens
agagaugccuguuguuuca

SEQ ID NO: 574110 - RNA, 19 nt, Homo sapiens
gcagauacaacuggucuuu

SEQ ID NO: 574111 - RNA, 19 nt, Homo sapiens
gcauuugguuggaaacuca

SEQ ID NO: 574112 - RNA, 19 nt, Homo sapiens
guaguugggaccauuuaua

SEQ ID NO: 574113 - RNA, 19 nt, Homo sapiens
gccaguguauggaauggua

SEQ ID NO: 574114 - RNA, 19 nt, Homo sapiens
gaauaaugcagucaucuca

SEQ ID NO: 574115 - RNA, 19 nt, Homo sapiens
ccagaagaagguagaauuu

SEQ ID NO: 574116 - RNA, 19 nt, Homo sapiens
agauggaccuggaaauuau

SEQ ID NO: 574117 - RNA, 19 nt, Homo sapiens
gaccagggcccuauacguu

SEQ ID NO: 574118 - RNA, 19 nt, Homo sapiens
gcacacauuguuacacuga

SEQ ID NO: 574119 - RNA, 19 nt, Homo sapiens
gaugcuggauucuguggaa

SEQ ID NO: 574120 - RNA, 19 nt, Homo sapiens
gaaugugaccaaugaguug

SEQ ID NO: 574121 - RNA, 19 nt, Homo sapiens
caauucaagugaugucaga

SEQ ID NO: 574122 - RNA, 19 nt, Homo sapiens
gagaguguaagaucaguaa

SEQ ID NO: 574123 - RNA, 19 nt, Homo sapiens
gcuaguugcugcauuuagu

SEQ ID NO: 574124 - RNA, 19 nt, Homo sapiens
gagcaucugugagaagugu

SEQ ID NO: 574125 - RNA, 19 nt, Homo sapiens
ggaauaugauuuggauaag

SEQ ID NO: 574126 - RNA, 19 nt, Homo sapiens
ggaaugugaccaaugaguu

SEQ ID NO: 574127 - RNA, 19 nt, Homo sapiens
cgaggcaucugcaauucaa

SEQ ID NO: 574128 - RNA, 19 nt, Homo sapiens
ggacuccaaugccuaugug

SEQ ID NO: 574129 - RNA, 19 nt, Homo sapiens
ucacugcccucucuaugga

SEQ ID NO: 574130 - RNA, 19 nt, Homo sapiens
cagcgauacuguugaaugu

SEQ ID NO: 574131 - RNA, 19 nt, Homo sapiens
gugaugcugcuuauaauuu

SEQ ID NO: 574132 - RNA, 19 nt, Homo sapiens
ugagagagauggcaaugag

SEQ ID NO: 574133 - RNA, 19 nt, Homo sapiens
ccaagaauuucaaccucaa

SEQ ID NO: 574134 - RNA, 19 nt, Homo sapiens
cagaggaacauguuauuau

SEQ ID NO: 574135 - RNA, 19 nt, Homo sapiens
cuacugccaaggagaauua

SEQ ID NO: 574136 - RNA, 19 nt, Homo sapiens
ggagcaguaugcagugguu

SEQ ID NO: 574137 - RNA, 19 nt, Homo sapiens
uuagugaugcugcuuauaa

SEQ ID NO: 574138 - RNA, 19 nt, Homo sapiens
gggaccauuuauauguuua

SEQ ID NO: 574139 - RNA, 19 nt, Homo sapiens
gggauauaccuaauguuaa

SEQ ID NO: 574140 - RNA, 19 nt, Homo sapiens
gguagaauuuguccuuaag

SEQ ID NO: 574141 - RNA, 19 nt, Homo sapiens
gguccuggauguucaguuc

SEQ ID NO: 574142 - RNA, 19 nt, Homo sapiens
ggaaaggugaagcauguga

SEQ ID NO: 574143 - RNA, 19 nt, Homo sapiens
uagcagcgauacuguugaa

SEQ ID NO: 574144 - RNA, 19 nt, Homo sapiens
gaagaugaucgcuauuaca

SEQ ID NO: 574145 - RNA, 19 nt, Homo sapiens
caguucaccuuuagucuau

SEQ ID NO: 574146 - RNA, 19 nt, Homo sapiens
gcacugcgagaccugcaua

SEQ ID NO: 574147 - RNA, 19 nt, Homo sapiens
agauacaacuggucuuuca

SEQ ID NO: 574148 - RNA, 19 nt, Homo sapiens
gaaccacagcugcucagaa

SEQ ID NO: 574149 - RNA, 19 nt, Homo sapiens
ggcaacugaugaacaagaa

SEQ ID NO: 574150 - RNA, 19 nt, Homo sapiens
gucauucuuuggcauuaua

SEQ ID NO: 574151 - RNA, 19 nt, Homo sapiens
ggagaagagaugccuguug

SEQ ID NO: 574152 - RNA, 19 nt, Homo sapiens
caacuggucuuucauucac

SEQ ID NO: 574153 - RNA, 19 nt, Homo sapiens
ccaaggagaauuaugacaa

SEQ ID NO: 574154 - RNA, 19 nt, Homo sapiens
ggcauuggcuggcauuugg

SEQ ID NO: 574155 - RNA, 19 nt, Homo sapiens
cacaaugacacaucuauga

SEQ ID NO: 574156 - RNA, 19 nt, Homo sapiens
cgaggagaguguaagauca

SEQ ID NO: 574157 - RNA, 19 nt, Homo sapiens
ucaaugccuccaagaauuu

SEQ ID NO: 574158 - RNA, 19 nt, Homo sapiens
cugcauaucuggcuucuac

SEQ ID NO: 574159 - RNA, 19 nt, Homo sapiens
guacuacuguaacaagaag

SEQ ID NO: 574160 - RNA, 19 nt, Homo sapiens
gaaggccagaucuccauuu

SEQ ID NO: 574161 - RNA, 19 nt, Homo sapiens
ucagaggaacauguuauua

SEQ ID NO: 574162 - RNA, 19 nt, Homo sapiens
ccaaggaaacccucucaga

SEQ ID NO: 574163 - RNA, 19 nt, Homo sapiens
cacaguaaaugcaucaauc

SEQ ID NO: 574164 - RNA, 19 nt, Homo sapiens
gaagcgcccuguauuuauu

SEQ ID NO: 574165 - RNA, 19 nt, Homo sapiens
gagcugagcgcuuugcuua

SEQ ID NO: 574166 - RNA, 19 nt, Homo sapiens
ucagcgagaucuacaauuu

SEQ ID NO: 574167 - RNA, 19 nt, Homo sapiens
gggaacaguugaaggauga

SEQ ID NO: 574168 - RNA, 19 nt, Homo sapiens
ugacggagcacuuuccuua

SEQ ID NO: 574169 - RNA, 19 nt, Homo sapiens
gagaacaaaucaggaaguu

SEQ ID NO: 574170 - RNA, 19 nt, Homo sapiens
cagaagcgcccuguauuua

SEQ ID NO: 574171 - RNA, 19 nt, Homo sapiens
gcacuuuccuuacuucaag

SEQ ID NO: 574172 - RNA, 19 nt, Homo sapiens
gcacacacacaaauuauuc

SEQ ID NO: 574173 - RNA, 19 nt, Homo sapiens
ucacacucauccacacuua

SEQ ID NO: 574174 - RNA, 19 nt, Homo sapiens
gcacacacccuccugcuau

SEQ ID NO: 574175 - RNA, 19 nt, Homo sapiens
agacaaguauccuggcuuu

SEQ ID NO: 574176 - RNA, 19 nt, Homo sapiens
gcaagaaggaggagacaga

SEQ ID NO: 574177 - RNA, 19 nt, Homo sapiens
guucagaggucaaagucaa

SEQ ID NO: 574178 - RNA, 19 nt, Homo sapiens
ccacaucgggcucaccuua

SEQ ID NO: 574179 - RNA, 19 nt, Homo sapiens
gaggaaagaucccauugcu

SEQ ID NO: 574180 - RNA, 19 nt, Homo sapiens
gaagaggaaagaucccauu

SEQ ID NO: 574181 - RNA, 19 nt, Homo sapiens
gcagaggccugguguaacg

SEQ ID NO: 574182 - RNA, 19 nt, Homo sapiens
ccagaagcgcccuguauuu

SEQ ID NO: 574183 - RNA, 19 nt, Homo sapiens
cagccucccuugcagcaua

SEQ ID NO: 574184 - RNA, 19 nt, Homo sapiens
gugcugggauguucugcua

SEQ ID NO: 574185 - RNA, 19 nt, Homo sapiens
ccacuaagccaacgugugu

SEQ ID NO: 574186 - RNA, 19 nt, Homo sapiens
gaagguggagaacaaauca

SEQ ID NO: 574187 - RNA, 19 nt, Homo sapiens
cccgauggcuggaagaauu

SEQ ID NO: 574188 - RNA, 19 nt, Homo sapiens
ucgagaagguggagaacaa

SEQ ID NO: 574189 - RNA, 19 nt, Homo sapiens
ccucuacucugccuuuaug

SEQ ID NO: 574190 - RNA, 19 nt, Homo sapiens
cagcagaggccugguguaa

SEQ ID NO: 574191 - RNA, 19 nt, Homo sapiens
gaacaguugaaggaugaua

SEQ ID NO: 574192 - RNA, 19 nt, Homo sapiens
caaccuaucccucaacaag

SEQ ID NO: 574193 - RNA, 19 nt, Homo sapiens
acugagagcugagcgcuuu

SEQ ID NO: 574194 - RNA, 19 nt, Homo sapiens
ggagcacuuuccuuacuuc

SEQ ID NO: 574195 - RNA, 19 nt, Homo sapiens
cccaggagcugcuaauugg

SEQ ID NO: 574196 - RNA, 19 nt, Homo sapiens
caaaacccaucuauuccua

SEQ ID NO: 574197 - RNA, 19 nt, Homo sapiens
acaucgggcucaccuuaaa

SEQ ID NO: 574198 - RNA, 19 nt, Homo sapiens
gcguuugccuggucuggaa

SEQ ID NO: 574199 - RNA, 19 nt, Homo sapiens
cggccaagaucgacaagau

SEQ ID NO: 574200 - RNA, 19 nt, Homo sapiens
gcaagcgucugggcaagag

SEQ ID NO: 574201 - RNA, 19 nt, Homo sapiens
acaagcggccuuuccauga

SEQ ID NO: 574202 - RNA, 19 nt, Homo sapiens
gcuccucacacuaucagua

SEQ ID NO: 574203 - RNA, 19 nt, Homo sapiens
cgugcacacacacaaauua

SEQ ID NO: 574204 - RNA, 19 nt, Homo sapiens
ggagaacaaaucaggaagu

SEQ ID NO: 574205 - RNA, 19 nt, Homo sapiens
ucacugagagcccgacuuc

SEQ ID NO: 574206 - RNA, 19 nt, Homo sapiens
uauccuggcuuuggcuuug

SEQ ID NO: 574207 - RNA, 19 nt, Homo sapiens
ucucuacccauccuuagua

SEQ ID NO: 574208 - RNA, 19 nt, Homo sapiens
caagcggccuuuccaugag

SEQ ID NO: 574209 - RNA, 19 nt, Homo sapiens
ccacucagccauucucuac

SEQ ID NO: 574210 - RNA, 19 nt, Homo sapiens
cagccacagugccaagcua

SEQ ID NO: 574211 - RNA, 19 nt, Homo sapiens
uacaugcucuguccagcuu

SEQ ID NO: 574212 - RNA, 19 nt, Homo sapiens
cacccacccacauaucuua

SEQ ID NO: 574213 - RNA, 19 nt, Homo sapiens
aaacccaucuauuccuaca

SEQ ID NO: 574214 - RNA, 19 nt, Homo sapiens
gcugccagauggagaccuu

SEQ ID NO: 574215 - RNA, 19 nt, Homo sapiens
gagaagguggagaacaaau

SEQ ID NO: 574216 - RNA, 19 nt, Homo sapiens
gaguggugcugggauguuc

SEQ ID NO: 574217 - RNA, 19 nt, Homo sapiens
agaagcgcccuguauuuau

SEQ ID NO: 574218 - RNA, 19 nt, Homo sapiens
gugcacacacacaaauuau

SEQ ID NO: 574219 - RNA, 19 nt, Homo sapiens
guggagaacaaaucaggaa

SEQ ID NO: 574220 - RNA, 19 nt, Homo sapiens
gcucucacccucagacaag

SEQ ID NO: 574221 - RNA, 19 nt, Homo sapiens
gaaccagcacuccaucacu

SEQ ID NO: 574222 - RNA, 19 nt, Homo sapiens
guacacccacccacauauc

SEQ ID NO: 574223 - RNA, 19 nt, Homo sapiens
ucacugacuucgacuucca

SEQ ID NO: 574224 - RNA, 19 nt, Homo sapiens
ggcacaaccuaucccucaa

SEQ ID NO: 574225 - RNA, 19 nt, Homo sapiens
cggagcacuuuccuuacuu

SEQ ID NO: 574226 - RNA, 19 nt, Homo sapiens
agcgagaucuacaauuuua

SEQ ID NO: 574227 - RNA, 19 nt, Homo sapiens
ugagagcccgacuucguuu

SEQ ID NO: 574228 - RNA, 19 nt, Homo sapiens
caagaucgacaagaugcaa

SEQ ID NO: 574229 - RNA, 19 nt, Homo sapiens
uaucuuacagccagaggaa

SEQ ID NO: 574230 - RNA, 19 nt, Homo sapiens
cacacaaauuauucagaug

SEQ ID NO: 574231 - RNA, 19 nt, Homo sapiens
uucgucagcuccagcguuu

SEQ ID NO: 574232 - RNA, 19 nt, Homo sapiens
auggagaccuuggcacuga

SEQ ID NO: 574233 - RNA, 19 nt, Homo sapiens
ucaacaagugcuucgagaa

SEQ ID NO: 574234 - RNA, 19 nt, Homo sapiens
cacaaccuaucccucaaca

SEQ ID NO: 574235 - RNA, 19 nt, Homo sapiens
gucccuagcucacacucau

SEQ ID NO: 574236 - RNA, 19 nt, Homo sapiens
ucauggcccuuaagaacag

SEQ ID NO: 574237 - RNA, 19 nt, Homo sapiens
cuacagcauccucaucuuc

SEQ ID NO: 574238 - RNA, 19 nt, Homo sapiens
cccaacagcccagcaagaa

SEQ ID NO: 574239 - RNA, 19 nt, Homo sapiens
cccagaagcgcccuguauu

SEQ ID NO: 574240 - RNA, 19 nt, Homo sapiens
uaaaggucaaggaaggaaa

SEQ ID NO: 574241 - RNA, 19 nt, Homo sapiens
gcaccucaccacccucuac

SEQ ID NO: 574242 - RNA, 19 nt, Homo sapiens
cacacacccuccugcuaug

SEQ ID NO: 574243 - RNA, 19 nt, Homo sapiens
uaccugggcuccucacacu

SEQ ID NO: 574244 - RNA, 19 nt, Homo sapiens
ggugcugccucucacacau

SEQ ID NO: 574245 - RNA, 19 nt, Homo sapiens
agaauucuguccggcacaa

SEQ ID NO: 574246 - RNA, 19 nt, Homo sapiens
uaagccaacguguguguca

SEQ ID NO: 574247 - RNA, 19 nt, Homo sapiens
agaccacccuggcccucaa

SEQ ID NO: 574248 - RNA, 19 nt, Homo sapiens
cgagaagguggagaacaaa

SEQ ID NO: 574249 - RNA, 19 nt, Homo sapiens
gcacaaccuaucccucaac

SEQ ID NO: 574250 - RNA, 19 nt, Homo sapiens
guacaagcggccuuuccau

SEQ ID NO: 574251 - RNA, 19 nt, Homo sapiens
agggaaaccugugggaaca

SEQ ID NO: 574252 - RNA, 19 nt, Homo sapiens
cugcaggaccuacuuaugg

SEQ ID NO: 574253 - RNA, 19 nt, Homo sapiens
cuuccugccuggcuucuca

SEQ ID NO: 574254 - RNA, 19 nt, Homo sapiens
acaaguauccuggcuuugg

SEQ ID NO: 574255 - RNA, 19 nt, Homo sapiens
cauucucuacccauccuua

SEQ ID NO: 574256 - RNA, 19 nt, Homo sapiens
gcugagcgcuuugcuuacc

SEQ ID NO: 574257 - RNA, 19 nt, Homo sapiens
gcuaccagccucccuugca

SEQ ID NO: 574258 - RNA, 19 nt, Homo sapiens
cacaucgggcucaccuuaa

SEQ ID NO: 574259 - RNA, 19 nt, Homo sapiens
cagcugcucgucauuugug

SEQ ID NO: 574260 - RNA, 19 nt, Homo sapiens
ggcacacacccuccugcua

SEQ ID NO: 574261 - RNA, 19 nt, Homo sapiens
ggccaagaucgacaagaug

SEQ ID NO: 574262 - RNA, 19 nt, Homo sapiens
ccuacagcauccucaucuu

SEQ ID NO: 574263 - RNA, 19 nt, Homo sapiens
gcagaaagauguugucaua

SEQ ID NO: 574264 - RNA, 19 nt, Homo sapiens
ggagaacgguuaaguauuu

SEQ ID NO: 574265 - RNA, 19 nt, Homo sapiens
gagcagagauucaguguga

SEQ ID NO: 574266 - RNA, 19 nt, Homo sapiens
ggaaacagcucaucaaagg

SEQ ID NO: 574267 - RNA, 19 nt, Homo sapiens
gaaaggaggagaacgguua

SEQ ID NO: 574268 - RNA, 19 nt, Homo sapiens
gcacgggacuuucugcuuu

SEQ ID NO: 574269 - RNA, 19 nt, Homo sapiens
ggaugaagcucacaauguu

SEQ ID NO: 574270 - RNA, 19 nt, Homo sapiens
ggaagaagcccuaauaauc

SEQ ID NO: 574271 - RNA, 19 nt, Homo sapiens
gaacuaaugagaagaguaa

SEQ ID NO: 574272 - RNA, 19 nt, Homo sapiens
ggaggaagaugauguuguu

SEQ ID NO: 574273 - RNA, 19 nt, Homo sapiens
ccaaggagauucccacaaa

SEQ ID NO: 574274 - RNA, 19 nt, Homo sapiens
gaacagaagccugaaauga

SEQ ID NO: 574275 - RNA, 19 nt, Homo sapiens
gggaaacgcugguguggaa

SEQ ID NO: 574276 - RNA, 19 nt, Homo sapiens
gcaaggaacuaaugagaag

SEQ ID NO: 574277 - RNA, 19 nt, Homo sapiens
gaaaucaagugguaagagu

SEQ ID NO: 574278 - RNA, 19 nt, Homo sapiens
ggagaugcuuuguagauga

SEQ ID NO: 574279 - RNA, 19 nt, Homo sapiens
gcugaaaguuguagcauug

SEQ ID NO: 574280 - RNA, 19 nt, Homo sapiens
ggucagcucugcaauccua

SEQ ID NO: 574281 - RNA, 19 nt, Homo sapiens
ugacguggcucuccaaaga

SEQ ID NO: 574282 - RNA, 19 nt, Homo sapiens
gacaauggcucaaagaaag

SEQ ID NO: 574283 - RNA, 19 nt, Homo sapiens
cgagagagcaccaagauuu

SEQ ID NO: 574284 - RNA, 19 nt, Homo sapiens
gaacagcaacaaacuaaga

SEQ ID NO: 574285 - RNA, 19 nt, Homo sapiens
caagaaagaauacagauug

SEQ ID NO: 574286 - RNA, 19 nt, Homo sapiens
gcucugcaauccuaucuaa

SEQ ID NO: 574287 - RNA, 19 nt, Homo sapiens
caggagaaaucaaguggua

SEQ ID NO: 574288 - RNA, 19 nt, Homo sapiens
gcagugagcugugauugug

SEQ ID NO: 574289 - RNA, 19 nt, Homo sapiens
gggacuuucugcuuucuua

SEQ ID NO: 574290 - RNA, 19 nt, Homo sapiens
ccagaagaaucaagagaaa

SEQ ID NO: 574291 - RNA, 19 nt, Homo sapiens
caacacaacugaaacaaaa

SEQ ID NO: 574292 - RNA, 19 nt, Homo sapiens
gaaagaauacagauuguuc

SEQ ID NO: 574293 - RNA, 19 nt, Homo sapiens
ucaaggagaugcuuuguag

SEQ ID NO: 574294 - RNA, 19 nt, Homo sapiens
gaacugggaggcuaaagaa

SEQ ID NO: 574295 - RNA, 19 nt, Homo sapiens
ggaccaacaugcugaaagu

SEQ ID NO: 574296 - RNA, 19 nt, Homo sapiens
gaaguacucaguggucuua

SEQ ID NO: 574297 - RNA, 19 nt, Homo sapiens
aaagaaggcugauaagaag

SEQ ID NO: 574298 - RNA, 19 nt, Homo sapiens
gauaagaagcaaagagaaa

SEQ ID NO: 574299 - RNA, 19 nt, Homo sapiens
gagaaacccauucaaggua

SEQ ID NO: 574300 - RNA, 19 nt, Homo sapiens
gcaugcaucugagacauuu

SEQ ID NO: 574301 - RNA, 19 nt, Homo sapiens
ugaagagacuguuuacaau

SEQ ID NO: 574302 - RNA, 19 nt, Homo sapiens
gaacauucuguauccaaua

SEQ ID NO: 574303 - RNA, 19 nt, Homo sapiens
gaaaguagaggcaaccaau

SEQ ID NO: 574304 - RNA, 19 nt, Homo sapiens
gaacagcucagugcuuuga

SEQ ID NO: 574305 - RNA, 19 nt, Homo sapiens
uggcagaccuuuggugaua

SEQ ID NO: 574306 - RNA, 19 nt, Homo sapiens
gugcacaccuguaguccua

SEQ ID NO: 574307 - RNA, 19 nt, Homo sapiens
gagucaagauguccaaaga

SEQ ID NO: 574308 - RNA, 19 nt, Homo sapiens
agaaagauguugucauaca

SEQ ID NO: 574309 - RNA, 19 nt, Homo sapiens
gaagaugaagagacuguuu

SEQ ID NO: 574310 - RNA, 19 nt, Homo sapiens
gaggagaacgguuaaguau

SEQ ID NO: 574311 - RNA, 19 nt, Homo sapiens
ggaggagaacgguuaagua

SEQ ID NO: 574312 - RNA, 19 nt, Homo sapiens
gcaacaaacuaagagucua

SEQ ID NO: 574313 - RNA, 19 nt, Homo sapiens
gaagaguaacagucaagua

SEQ ID NO: 574314 - RNA, 19 nt, Homo sapiens
gaagaagcauggacugacu

SEQ ID NO: 574315 - RNA, 19 nt, Homo sapiens
uguauucgcugcugaaguu

SEQ ID NO: 574316 - RNA, 19 nt, Homo sapiens
ugacucgacucuggacuua

SEQ ID NO: 574317 - RNA, 19 nt, Homo sapiens
gaagagacuguuuacaaug

SEQ ID NO: 574318 - RNA, 19 nt, Homo sapiens
ggcauuggcuugguuacua

SEQ ID NO: 574319 - RNA, 19 nt, Homo sapiens
gucaguguaucauuuagua

SEQ ID NO: 574320 - RNA, 19 nt, Homo sapiens
gagaugcuuuguagaugaa

SEQ ID NO: 574321 - RNA, 19 nt, Homo sapiens
ggacaagaaagaauacaga

SEQ ID NO: 574322 - RNA, 19 nt, Homo sapiens
ugguagagcuucaggguuu

SEQ ID NO: 574323 - RNA, 19 nt, Homo sapiens
ccaucucuaugaagaauaa

SEQ ID NO: 574324 - RNA, 19 nt, Homo sapiens
caucuaaccuccuguggau

SEQ ID NO: 574325 - RNA, 19 nt, Homo sapiens
aagaacagcucagugcuuu

SEQ ID NO: 574326 - RNA, 19 nt, Homo sapiens
ggucagaaguugaucaaac

SEQ ID NO: 574327 - RNA, 19 nt, Homo sapiens
ccaauucccugaucgaagu

SEQ ID NO: 574328 - RNA, 19 nt, Homo sapiens
acagaagccugaaaugaug

SEQ ID NO: 574329 - RNA, 19 nt, Homo sapiens
gaguaucuguuaucauugu

SEQ ID NO: 574330 - RNA, 19 nt, Homo sapiens
gcaggaggaucccuugagu

SEQ ID NO: 574331 - RNA, 19 nt, Homo sapiens
gcaggaggauggcuugaag

SEQ ID NO: 574332 - RNA, 19 nt, Homo sapiens
gcagagaauggacuuggua

SEQ ID NO: 574333 - RNA, 19 nt, Homo sapiens
ggaggcaauucaaagaaau

SEQ ID NO: 574334 - RNA, 19 nt, Homo sapiens
ucugagacauuucaucauu

SEQ ID NO: 574335 - RNA, 19 nt, Homo sapiens
gaagaagcccuaauaaucc

SEQ ID NO: 574336 - RNA, 19 nt, Homo sapiens
agaugacucuugugacuuu

SEQ ID NO: 574337 - RNA, 19 nt, Homo sapiens
caucuggccugguaccaaa

SEQ ID NO: 574338 - RNA, 19 nt, Homo sapiens
gcaugaggacuuuguggua

SEQ ID NO: 574339 - RNA, 19 nt, Homo sapiens
ggauaagggcucagaauag

SEQ ID NO: 574340 - RNA, 19 nt, Homo sapiens
ugaccgaauuuaccgagua

SEQ ID NO: 574341 - RNA, 19 nt, Homo sapiens
gagcaaggaacuaaugaga

SEQ ID NO: 574342 - RNA, 19 nt, Homo sapiens
gaucgaagugugcaaagaa

SEQ ID NO: 574343 - RNA, 19 nt, Homo sapiens
gucaagauguccaaagaga

SEQ ID NO: 574344 - RNA, 19 nt, Homo sapiens
ccucucaucuggccuggua

SEQ ID NO: 574345 - RNA, 19 nt, Homo sapiens
gaagaacagcucagugcuu

SEQ ID NO: 574346 - RNA, 19 nt, Homo sapiens
gaugaagcucacaauguua

SEQ ID NO: 574347 - RNA, 19 nt, Homo sapiens
agacaagggucagaaguug

SEQ ID NO: 574348 - RNA, 19 nt, Homo sapiens
ccucagguguuuccaagaa

SEQ ID NO: 574349 - RNA, 19 nt, Homo sapiens
caguguugcugucaucuuu

SEQ ID NO: 574350 - RNA, 19 nt, Homo sapiens
gugaacagcaacaaacuaa

SEQ ID NO: 574351 - RNA, 19 nt, Homo sapiens
gauaagggcucagaauagc

SEQ ID NO: 574352 - RNA, 19 nt, Homo sapiens
caccuuggcucaccucaga

SEQ ID NO: 574353 - RNA, 19 nt, Homo sapiens
aaaccugacuggaggaaau

SEQ ID NO: 574354 - RNA, 19 nt, Homo sapiens
aauaacaaccuaaccauga

SEQ ID NO: 574355 - RNA, 19 nt, Homo sapiens
gagaaucugucaccaagcu

SEQ ID NO: 574356 - RNA, 19 nt, Homo sapiens
gcauuggcuugguuacuau

SEQ ID NO: 574357 - RNA, 19 nt, Homo sapiens
ucucaacagugccaaggua

SEQ ID NO: 574358 - RNA, 19 nt, Homo sapiens
gaaagauguugucauacac

SEQ ID NO: 574359 - RNA, 19 nt, Homo sapiens
guauggaaaccaauugauu

SEQ ID NO: 574360 - RNA, 19 nt, Homo sapiens
gcagcagacucaccgagau

SEQ ID NO: 574361 - RNA, 19 nt, Homo sapiens
ccuaauaauccauucagua

SEQ ID NO: 574362 - RNA, 19 nt, Homo sapiens
ugacaauggcucaaagaaa

SEQ ID NO: 574363 - RNA, 19 nt, Homo sapiens
gcauauugcuugcuauuaa

SEQ ID NO: 574364 - RNA, 19 nt, Homo sapiens
cagccaaucugaaaggaua

SEQ ID NO: 574365 - RNA, 19 nt, Homo sapiens
gagaagugcuugccugugu

SEQ ID NO: 574366 - RNA, 19 nt, Homo sapiens
gcaccaaccacguggaaua

SEQ ID NO: 574367 - RNA, 19 nt, Homo sapiens
aaacguaccuugaaacucu

SEQ ID NO: 574368 - RNA, 19 nt, Homo sapiens
ggacugccuugguggcuuu

SEQ ID NO: 574369 - RNA, 19 nt, Homo sapiens
ggaauguauuugcauaugu

SEQ ID NO: 574370 - RNA, 19 nt, Homo sapiens
uuaggaagcucgugauuuc

SEQ ID NO: 574371 - RNA, 19 nt, Homo sapiens
ugaggaauguauuugcaua

SEQ ID NO: 574372 - RNA, 19 nt, Homo sapiens
ggaaaucggaccucuaauc

SEQ ID NO: 574373 - RNA, 19 nt, Homo sapiens
gcuaugacccuuaugcaaa

SEQ ID NO: 574374 - RNA, 19 nt, Homo sapiens
uauaugaggcuuucuuuga

SEQ ID NO: 574375 - RNA, 19 nt, Homo sapiens
cagcaccuccucccacuua

SEQ ID NO: 574376 - RNA, 19 nt, Homo sapiens
gauuugccauccuccuuaa

SEQ ID NO: 574377 - RNA, 19 nt, Homo sapiens
gguagagaaugaaggguau

SEQ ID NO: 574378 - RNA, 19 nt, Homo sapiens
aaacaggacugcugaugag

SEQ ID NO: 574379 - RNA, 19 nt, Homo sapiens
gaugaggaauguauuugca

SEQ ID NO: 574380 - RNA, 19 nt, Homo sapiens
ccucaguucuaccuaguuu

SEQ ID NO: 574381 - RNA, 19 nt, Homo sapiens
aaucggaccucuaauccaa

SEQ ID NO: 574382 - RNA, 19 nt, Homo sapiens
guggaaaucggaccucuaa

SEQ ID NO: 574383 - RNA, 19 nt, Homo sapiens
ccgcuaaccugucgcugaa

SEQ ID NO: 574384 - RNA, 19 nt, Homo sapiens
ccucuccuauugacccuua

SEQ ID NO: 574385 - RNA, 19 nt, Homo sapiens
gaaugaaggguauggaagu

SEQ ID NO: 574386 - RNA, 19 nt, Homo sapiens
gagaaugaaggguauggaa

SEQ ID NO: 574387 - RNA, 19 nt, Homo sapiens
gcucggcuaugacccuuau

SEQ ID NO: 574388 - RNA, 19 nt, Homo sapiens
uaugaggcuuucuuugauu

SEQ ID NO: 574389 - RNA, 19 nt, Homo sapiens
uggcucagcucggcuauga

SEQ ID NO: 574390 - RNA, 19 nt, Homo sapiens
gaccucuaauccaagcaua

SEQ ID NO: 574391 - RNA, 19 nt, Homo sapiens
gaaaggggacuauaaaaca

SEQ ID NO: 574392 - RNA, 19 nt, Homo sapiens
gcauggagguaggcaagga

SEQ ID NO: 574393 - RNA, 19 nt, Homo sapiens
gcuuugaccucagcagcua

SEQ ID NO: 574394 - RNA, 19 nt, Homo sapiens
cuauugacccuuacuuuga

SEQ ID NO: 574395 - RNA, 19 nt, Homo sapiens
ugcaaaagcugaaucauug

SEQ ID NO: 574396 - RNA, 19 nt, Homo sapiens
caggacugcugaugaggaa

SEQ ID NO: 574397 - RNA, 19 nt, Homo sapiens
uauugacccuuacuuugaa

SEQ ID NO: 574398 - RNA, 19 nt, Homo sapiens
aaugaaggguauggaagua

SEQ ID NO: 574399 - RNA, 19 nt, Homo sapiens
gcugaugaggaauguauuu

SEQ ID NO: 574400 - RNA, 19 nt, Homo sapiens
acacacagcgggucuugaa

SEQ ID NO: 574401 - RNA, 19 nt, Homo sapiens
gcaacaaggacccauuuac

SEQ ID NO: 574402 - RNA, 19 nt, Homo sapiens
gaaguaguccggcuuuuga

SEQ ID NO: 574403 - RNA, 19 nt, Homo sapiens
ggacugcugaugaggaaug

SEQ ID NO: 574404 - RNA, 19 nt, Homo sapiens
gaaaucggaccucuaaucc

SEQ ID NO: 574405 - RNA, 19 nt, Homo sapiens
gugaacagaggcucauuug

SEQ ID NO: 574406 - RNA, 19 nt, Homo sapiens
gcaaggccaugccgcucau

SEQ ID NO: 574407 - RNA, 19 nt, Homo sapiens
agaagugcuugccugugua

SEQ ID NO: 574408 - RNA, 19 nt, Homo sapiens
caacaaggacccauuuacg

SEQ ID NO: 574409 - RNA, 19 nt, Homo sapiens
ugaaggguauggaaguagu

SEQ ID NO: 574410 - RNA, 19 nt, Homo sapiens
ccaaguuccugcugauggu

SEQ ID NO: 574411 - RNA, 19 nt, Homo sapiens
uugccauccuccuuaauuu

SEQ ID NO: 574412 - RNA, 19 nt, Homo sapiens
ccuauugacccuuacuuug

SEQ ID NO: 574413 - RNA, 19 nt, Homo sapiens
gaggaauguauuugcauau

SEQ ID NO: 574414 - RNA, 19 nt, Homo sapiens
gaucuccgcaaaugacuuc

SEQ ID NO: 574415 - RNA, 19 nt, Homo sapiens
auaugaggcuuucuuugau

SEQ ID NO: 574416 - RNA, 19 nt, Homo sapiens
aggaggagcuggugauggu

SEQ ID NO: 574417 - RNA, 19 nt, Homo sapiens
gcucgugauuuccagaucu

SEQ ID NO: 574418 - RNA, 19 nt, Homo sapiens
caacacacagcgggucuug

SEQ ID NO: 574419 - RNA, 19 nt, Homo sapiens
ccacguggaauaccgcuau

SEQ ID NO: 574420 - RNA, 19 nt, Homo sapiens
uuccagaucuccgcaaaug

SEQ ID NO: 574421 - RNA, 19 nt, Homo sapiens
gacccuuacuuugaauuca

SEQ ID NO: 574422 - RNA, 19 nt, Homo sapiens
gaagagaagaaaaugcauu

SEQ ID NO: 574423 - RNA, 19 nt, Homo sapiens
guuugugccucacuuuaca

SEQ ID NO: 574424 - RNA, 19 nt, Homo sapiens
caaccugugccucuccuau

SEQ ID NO: 574425 - RNA, 19 nt, Homo sapiens
agauuugccauccuccuua

SEQ ID NO: 574426 - RNA, 19 nt, Homo sapiens
cagaggcucauuuguuugu

SEQ ID NO: 574427 - RNA, 19 nt, Homo sapiens
acuccaggguagagaauga

SEQ ID NO: 574428 - RNA, 19 nt, Homo sapiens
aggaauguauuugcauaug

SEQ ID NO: 574429 - RNA, 19 nt, Homo sapiens
ccucuaauccaagcauauu

SEQ ID NO: 574430 - RNA, 19 nt, Homo sapiens
aaacaccagccaaucugaa

SEQ ID NO: 574431 - RNA, 19 nt, Homo sapiens
ucaguucuaccuaguuuca

SEQ ID NO: 574432 - RNA, 19 nt, Homo sapiens
ggccaugccgcucaucuuc

SEQ ID NO: 574433 - RNA, 19 nt, Homo sapiens
acgcuguccuccaccauga

SEQ ID NO: 574434 - RNA, 19 nt, Homo sapiens
gugcuugccuguguacuac

SEQ ID NO: 574435 - RNA, 19 nt, Homo sapiens
cgaggagacccgcaucauc

SEQ ID NO: 574436 - RNA, 19 nt, Homo sapiens
gggcaccaaccacguggaa

SEQ ID NO: 574437 - RNA, 19 nt, Homo sapiens
cuaugacccuuaugcaaac

SEQ ID NO: 574438 - RNA, 19 nt, Homo sapiens
gcucaaguccucggucuac

SEQ ID NO: 574439 - RNA, 19 nt, Homo sapiens
ccuugaaacucucuaucuc

SEQ ID NO: 574440 - RNA, 19 nt, Homo sapiens
ggagguaggcaaggagaag

SEQ ID NO: 574441 - RNA, 19 nt, Homo sapiens
acaaggccaucgaggugau

SEQ ID NO: 574442 - RNA, 19 nt, Homo sapiens
uuugauuccuccucaguuc

SEQ ID NO: 574443 - RNA, 19 nt, Homo sapiens
gcaggaggagcuggugaug

SEQ ID NO: 574444 - RNA, 19 nt, Homo sapiens
gaagugcuugccuguguac

SEQ ID NO: 574445 - RNA, 19 nt, Homo sapiens
ggaaguaguccggcuuuug

SEQ ID NO: 574446 - RNA, 19 nt, Homo sapiens
ggacacuccaggguagaga

SEQ ID NO: 574447 - RNA, 19 nt, Homo sapiens
gaaaacguaccuugaaacu

SEQ ID NO: 574448 - RNA, 19 nt, Homo sapiens
cugcaacaaggacccauuu

SEQ ID NO: 574449 - RNA, 19 nt, Homo sapiens
ccagaucuccgcaaaugac

SEQ ID NO: 574450 - RNA, 19 nt, Homo sapiens
guccggcuuuugaaacuua

SEQ ID NO: 574451 - RNA, 19 nt, Homo sapiens
uccgugcacuccaugauca

SEQ ID NO: 574452 - RNA, 19 nt, Homo sapiens
cuuaggaagcucgugauuu

SEQ ID NO: 574453 - RNA, 19 nt, Homo sapiens
acacagcgggucuugaaag

SEQ ID NO: 574454 - RNA, 19 nt, Homo sapiens
ucaagcucauccucgacuu

SEQ ID NO: 574455 - RNA, 19 nt, Homo sapiens
caugaucacgcgcaaaguc

SEQ ID NO: 574456 - RNA, 19 nt, Homo sapiens
ggaaugccaucaccggaua

SEQ ID NO: 574457 - RNA, 19 nt, Homo sapiens
ggagagaucuacagaccaa

SEQ ID NO: 574458 - RNA, 19 nt, Homo sapiens
ugagaacacucuuaaaguu

SEQ ID NO: 574459 - RNA, 19 nt, Homo sapiens
gauuugaucugaacagcua

SEQ ID NO: 574460 - RNA, 19 nt, Homo sapiens
ggacgcacauccugacauu

SEQ ID NO: 574461 - RNA, 19 nt, Homo sapiens
guauggagguugguuauaa

SEQ ID NO: 574462 - RNA, 19 nt, Homo sapiens
gaacguagccagccaguca

SEQ ID NO: 574463 - RNA, 19 nt, Homo sapiens
ugaaauagguugucuguac

SEQ ID NO: 574464 - RNA, 19 nt, Homo sapiens
gaagauaccgccagauguu

SEQ ID NO: 574465 - RNA, 19 nt, Homo sapiens
gcacagcccugcaguaagg

SEQ ID NO: 574466 - RNA, 19 nt, Homo sapiens
gaacuggccuggaccucaa

SEQ ID NO: 574467 - RNA, 19 nt, Homo sapiens
gaaauagguugucuguaca

SEQ ID NO: 574468 - RNA, 19 nt, Homo sapiens
gcauguugguucacuauga

SEQ ID NO: 574469 - RNA, 19 nt, Homo sapiens
caagauaaccacaucaaga

SEQ ID NO: 574470 - RNA, 19 nt, Homo sapiens
ccaacuaccugacuuucuu

SEQ ID NO: 574471 - RNA, 19 nt, Homo sapiens
gaagcagaacuuacuauug

SEQ ID NO: 574472 - RNA, 19 nt, Homo sapiens
cugagaaguugggaaauua

SEQ ID NO: 574473 - RNA, 19 nt, Homo sapiens
aaaguggaaucgugcuaua

SEQ ID NO: 574474 - RNA, 19 nt, Homo sapiens
gcccugaaaucuuuaacuu

SEQ ID NO: 574475 - RNA, 19 nt, Homo sapiens
aagcagaacuuacuauugg

SEQ ID NO: 574476 - RNA, 19 nt, Homo sapiens
uaagggagaauuccaacua

SEQ ID NO: 574477 - RNA, 19 nt, Homo sapiens
gaugagaacacucuuaaag

SEQ ID NO: 574478 - RNA, 19 nt, Homo sapiens
guugggaaauuaccauuau

SEQ ID NO: 574479 - RNA, 19 nt, Homo sapiens
guaaggagcccagaaggaa

SEQ ID NO: 574480 - RNA, 19 nt, Homo sapiens
guccauggccugaacauuu

SEQ ID NO: 574481 - RNA, 19 nt, Homo sapiens
uuggaaagcugaagcagaa

SEQ ID NO: 574482 - RNA, 19 nt, Homo sapiens
caugcaagccuucuuacua

SEQ ID NO: 574483 - RNA, 19 nt, Homo sapiens
gcagucuccuuuugaaaua

SEQ ID NO: 574484 - RNA, 19 nt, Homo sapiens
ccugaaaucuuuaacuuac

SEQ ID NO: 574485 - RNA, 19 nt, Homo sapiens
uauagggacuguuugacaa

SEQ ID NO: 574486 - RNA, 19 nt, Homo sapiens
gggcaucaguacauucaau

SEQ ID NO: 574487 - RNA, 19 nt, Homo sapiens
ggaugaggcugguguuacu

SEQ ID NO: 574488 - RNA, 19 nt, Homo sapiens
gaccauguauaaccagugu

SEQ ID NO: 574489 - RNA, 19 nt, Homo sapiens
ccaaauuucuccugauggu

SEQ ID NO: 574490 - RNA, 19 nt, Homo sapiens
caacuaccugacuuucuua

SEQ ID NO: 574491 - RNA, 19 nt, Homo sapiens
uagguugucuguacauguu

SEQ ID NO: 574492 - RNA, 19 nt, Homo sapiens
uacuauagcuggauuugau

SEQ ID NO: 574493 - RNA, 19 nt, Homo sapiens
agacugagcaaguggagua

SEQ ID NO: 574494 - RNA, 19 nt, Homo sapiens
gggaagauaccgccagaug

SEQ ID NO: 574495 - RNA, 19 nt, Homo sapiens
uauggagguugguuauaaa

SEQ ID NO: 574496 - RNA, 19 nt, Homo sapiens
uggcaugucuggugauuag

SEQ ID NO: 574497 - RNA, 19 nt, Homo sapiens
ucugagaaguugggaaauu

SEQ ID NO: 574498 - RNA, 19 nt, Homo sapiens
ggaagauaccgccagaugu

SEQ ID NO: 574499 - RNA, 19 nt, Homo sapiens
caauguaggagcucuauca

SEQ ID NO: 574500 - RNA, 19 nt, Homo sapiens
ccugaacgguggaugagaa

SEQ ID NO: 574501 - RNA, 19 nt, Homo sapiens
guagccagccagucaaauu

SEQ ID NO: 574502 - RNA, 19 nt, Homo sapiens
aaacuccucuuguucucuu

SEQ ID NO: 574503 - RNA, 19 nt, Homo sapiens
uguaggagcucuaucaaaa

SEQ ID NO: 574504 - RNA, 19 nt, Homo sapiens
ggagccagccccuuauuua

SEQ ID NO: 574505 - RNA, 19 nt, Homo sapiens
ccaggagccucuuccauac

SEQ ID NO: 574506 - RNA, 19 nt, Homo sapiens
ggaucugccuccugagcaa

SEQ ID NO: 574507 - RNA, 19 nt, Homo sapiens
gagaucuacagaccaagua

SEQ ID NO: 574508 - RNA, 19 nt, Homo sapiens
gaacuuacuauuggcaugu

SEQ ID NO: 574509 - RNA, 19 nt, Homo sapiens
caaguaaucaagccaguca

SEQ ID NO: 574510 - RNA, 19 nt, Homo sapiens
gaaagcugaagcagaacuu

SEQ ID NO: 574511 - RNA, 19 nt, Homo sapiens
aaucaagccagucaaugua

SEQ ID NO: 574512 - RNA, 19 nt, Homo sapiens
gaagagaugauugggaaag

SEQ ID NO: 574513 - RNA, 19 nt, Homo sapiens
ggaccucaaagccaacaaa

SEQ ID NO: 574514 - RNA, 19 nt, Homo sapiens
ggagguguccgcacagcuu

SEQ ID NO: 574515 - RNA, 19 nt, Homo sapiens
uaaucaagccagucaaugu

SEQ ID NO: 574516 - RNA, 19 nt, Homo sapiens
gcaguaaggagcccagaag

SEQ ID NO: 574517 - RNA, 19 nt, Homo sapiens
cggaaaaccugaucccaaa

SEQ ID NO: 574518 - RNA, 19 nt, Homo sapiens
ugaagcagaacuuacuauu

SEQ ID NO: 574519 - RNA, 19 nt, Homo sapiens
cugaugaagugcuggauuc

SEQ ID NO: 574520 - RNA, 19 nt, Homo sapiens
gaggaaaccagggucauuc

SEQ ID NO: 574521 - RNA, 19 nt, Homo sapiens
caaaauggguugggaagau

SEQ ID NO: 574522 - RNA, 19 nt, Homo sapiens
ggaugagaacacucuuaaa

SEQ ID NO: 574523 - RNA, 19 nt, Homo sapiens
gcaugucuggugauuaguu

SEQ ID NO: 574524 - RNA, 19 nt, Homo sapiens
cuacagaccaaguaaucaa

SEQ ID NO: 574525 - RNA, 19 nt, Homo sapiens
gauguugguuaucuuucug

SEQ ID NO: 574526 - RNA, 19 nt, Homo sapiens
uggaugagaacacucuuaa

SEQ ID NO: 574527 - RNA, 19 nt, Homo sapiens
gcuggauucugccaugcaa

SEQ ID NO: 574528 - RNA, 19 nt, Homo sapiens
ccugugcauuugccaguuu

SEQ ID NO: 574529 - RNA, 19 nt, Homo sapiens
accaggagccucuuccaua

SEQ ID NO: 574530 - RNA, 19 nt, Homo sapiens
auaacaagauaaccacauc

SEQ ID NO: 574531 - RNA, 19 nt, Homo sapiens
uggcagugauugcuccuau

SEQ ID NO: 574532 - RNA, 19 nt, Homo sapiens
uacaagacauggcagugau

SEQ ID NO: 574533 - RNA, 19 nt, Homo sapiens
cauggaaccacucaguauu

SEQ ID NO: 574534 - RNA, 19 nt, Homo sapiens
ccauggaaccacucaguau

SEQ ID NO: 574535 - RNA, 19 nt, Homo sapiens
uaaaguuccuccagauucc

SEQ ID NO: 574536 - RNA, 19 nt, Homo sapiens
ugccaaauuucuccugaug

SEQ ID NO: 574537 - RNA, 19 nt, Homo sapiens
augcaagccuucuuacuag

SEQ ID NO: 574538 - RNA, 19 nt, Homo sapiens
aggcugguguuacugauga

SEQ ID NO: 574539 - RNA, 19 nt, Homo sapiens
uugguuaucuuucugaagu

SEQ ID NO: 574540 - RNA, 19 nt, Homo sapiens
uuaaaguuccuccagauuc

SEQ ID NO: 574541 - RNA, 19 nt, Homo sapiens
gaaguugggaaauuaccau

SEQ ID NO: 574542 - RNA, 19 nt, Homo sapiens
acauguguuuccuguuaaa

SEQ ID NO: 574543 - RNA, 19 nt, Homo sapiens
gagccucuuccauacauga

SEQ ID NO: 574544 - RNA, 19 nt, Homo sapiens
guggaugagaacacucuua

SEQ ID NO: 574545 - RNA, 19 nt, Homo sapiens
caaaguggaaucgugcuau

SEQ ID NO: 574546 - RNA, 19 nt, Homo sapiens
aagauaaccacaucaagau

SEQ ID NO: 574547 - RNA, 19 nt, Homo sapiens
gggaaauuaccauuauaca

SEQ ID NO: 574548 - RNA, 19 nt, Homo sapiens
gauccuguaagcagacuug

SEQ ID NO: 574549 - RNA, 19 nt, Homo sapiens
ccauacaugaggaaagauu

SEQ ID NO: 574550 - RNA, 19 nt, Homo sapiens
caagacauggcagugauug

SEQ ID NO: 574551 - RNA, 19 nt, Homo sapiens
aaaauggguugggaagaua

SEQ ID NO: 574552 - RNA, 19 nt, Homo sapiens
guaaucaagccagucaaug

SEQ ID NO: 574553 - RNA, 19 nt, Homo sapiens
uagagaccauguauaacca

SEQ ID NO: 574554 - RNA, 19 nt, Homo sapiens
uagcuggauuugaucugaa

SEQ ID NO: 574555 - RNA, 19 nt, Homo sapiens
gcugaagcagaacuuacua

SEQ ID NO: 574556 - RNA, 19 nt, Homo sapiens
ggacaucacucaugggauu

SEQ ID NO: 574557 - RNA, 19 nt, Homo sapiens
ggucaaagaucccagaaag

SEQ ID NO: 574558 - RNA, 19 nt, Homo sapiens
ucagggagcugugauguug

SEQ ID NO: 574559 - RNA, 19 nt, Homo sapiens
ccugaaagguccauuagga

SEQ ID NO: 574560 - RNA, 19 nt, Homo sapiens
ccaaguaacagauuccaaa

SEQ ID NO: 574561 - RNA, 19 nt, Homo sapiens
ggaauggaacugauggauu

SEQ ID NO: 574562 - RNA, 19 nt, Homo sapiens
gaaggaggaacuauguuug

SEQ ID NO: 574563 - RNA, 19 nt, Homo sapiens
gggagaagccuuucaacug

SEQ ID NO: 574564 - RNA, 19 nt, Homo sapiens
ggugaccuguugcggauaa

SEQ ID NO: 574565 - RNA, 19 nt, Homo sapiens
ggaacuauguuugcagcuu

SEQ ID NO: 574566 - RNA, 19 nt, Homo sapiens
cgaaggaggaacuauguuu

SEQ ID NO: 574567 - RNA, 19 nt, Homo sapiens
ucaccagcauucaaacaaa

SEQ ID NO: 574568 - RNA, 19 nt, Homo sapiens
gcagugaccaccugacgaa

SEQ ID NO: 574569 - RNA, 19 nt, Homo sapiens
uggacaaaguagcauguua

SEQ ID NO: 574570 - RNA, 19 nt, Homo sapiens
cagacuugcucaccaaaga

SEQ ID NO: 574571 - RNA, 19 nt, Homo sapiens
ucgaggcucuuguuuguau

SEQ ID NO: 574572 - RNA, 19 nt, Homo sapiens
gcgcgcaguugacaucaug

SEQ ID NO: 574573 - RNA, 19 nt, Homo sapiens
ggacaaaguagcauguuac

SEQ ID NO: 574574 - RNA, 19 nt, Homo sapiens
gagcccugcugccugcuuu

SEQ ID NO: 574575 - RNA, 19 nt, Homo sapiens
ugucgaggcucuuguuugu

SEQ ID NO: 574576 - RNA, 19 nt, Homo sapiens
gaaaaccaccccucugauu

SEQ ID NO: 574577 - RNA, 19 nt, Homo sapiens
guucagacuugcucaccaa

SEQ ID NO: 574578 - RNA, 19 nt, Homo sapiens
ugucauggcugccgggaau

SEQ ID NO: 574579 - RNA, 19 nt, Homo sapiens
gcucaccaaagaauuauga

SEQ ID NO: 574580 - RNA, 19 nt, Homo sapiens
guuugcagcuucccagguu

SEQ ID NO: 574581 - RNA, 19 nt, Homo sapiens
ugggacacuuugaaacuuu

SEQ ID NO: 574582 - RNA, 19 nt, Homo sapiens
acaguuuacucagcacuaa

SEQ ID NO: 574583 - RNA, 19 nt, Homo sapiens
ccaguccucugccguagug

SEQ ID NO: 574584 - RNA, 19 nt, Homo sapiens
aguaacagauuccaaagca

SEQ ID NO: 574585 - RNA, 19 nt, Homo sapiens
gagaggaagcggcaugaca

SEQ ID NO: 574586 - RNA, 19 nt, Homo sapiens
ucaaagaucccagaaaggu

SEQ ID NO: 574587 - RNA, 19 nt, Homo sapiens
caccagcauucaaacaaau

SEQ ID NO: 574588 - RNA, 19 nt, Homo sapiens
gggacacuuugaaacuuug

SEQ ID NO: 574589 - RNA, 19 nt, Homo sapiens
guggagccaucgacaagga

SEQ ID NO: 574590 - RNA, 19 nt, Homo sapiens
agacuuccauucuuuaucg

SEQ ID NO: 574591 - RNA, 19 nt, Homo sapiens
ccaccacugugcauaugga

SEQ ID NO: 574592 - RNA, 19 nt, Homo sapiens
acaccucacggacaguuua

SEQ ID NO: 574593 - RNA, 19 nt, Homo sapiens
cgacaaggacaccuguuuc

SEQ ID NO: 574594 - RNA, 19 nt, Homo sapiens
ggagcagacagacauggaa

SEQ ID NO: 574595 - RNA, 19 nt, Homo sapiens
cagcagagaaggagaagag

SEQ ID NO: 574596 - RNA, 19 nt, Homo sapiens
ggaugcagccacaccugaa

SEQ ID NO: 574597 - RNA, 19 nt, Homo sapiens
uuggcaagcugaacagaau

SEQ ID NO: 574598 - RNA, 19 nt, Homo sapiens
aaacugugucccucaggua

SEQ ID NO: 574599 - RNA, 19 nt, Homo sapiens
cuaacuugguguccuguca

SEQ ID NO: 574600 - RNA, 19 nt, Homo sapiens
guagcauguuaccagcuuu

SEQ ID NO: 574601 - RNA, 19 nt, Homo sapiens
ugacagcagagaaggagaa

SEQ ID NO: 574602 - RNA, 19 nt, Homo sapiens
guaacagauuccaaagcau

SEQ ID NO: 574603 - RNA, 19 nt, Homo sapiens
gugaccaccugacgaagca

SEQ ID NO: 574604 - RNA, 19 nt, Homo sapiens
gacaaggacaccuguuucu

SEQ ID NO: 574605 - RNA, 19 nt, Homo sapiens
ggagcccacuggugagcau

SEQ ID NO: 574606 - RNA, 19 nt, Homo sapiens
cuugcucaccaaagaauua

SEQ ID NO: 574607 - RNA, 19 nt, Homo sapiens
gacaguuuacucagcacua

SEQ ID NO: 574608 - RNA, 19 nt, Homo sapiens
cauccagacuccagauugc

SEQ ID NO: 574609 - RNA, 19 nt, Homo sapiens
guacagccacggauguucu

SEQ ID NO: 574610 - RNA, 19 nt, Homo sapiens
caccugaacuaccaaaaga

SEQ ID NO: 574611 - RNA, 19 nt, Homo sapiens
caccaccacugugcauaug

SEQ ID NO: 574612 - RNA, 19 nt, Homo sapiens
caugacagcgaaaggucua

SEQ ID NO: 574613 - RNA, 19 nt, Homo sapiens
aaacuuugcaggacacaca

SEQ ID NO: 574614 - RNA, 19 nt, Homo sapiens
gccagccucugccugaaag

SEQ ID NO: 574615 - RNA, 19 nt, Homo sapiens
ccacaugacgaccaagaag

SEQ ID NO: 574616 - RNA, 19 nt, Homo sapiens
gcugggauggcugugauaa

SEQ ID NO: 574617 - RNA, 19 nt, Homo sapiens
uucaucaccucuagccaaa

SEQ ID NO: 574618 - RNA, 19 nt, Homo sapiens
caaguaacagauuccaaag

SEQ ID NO: 574619 - RNA, 19 nt, Homo sapiens
ucgacaaggacaccuguuu

SEQ ID NO: 574620 - RNA, 19 nt, Homo sapiens
gagguuggcaagcugaaca

SEQ ID NO: 574621 - RNA, 19 nt, Homo sapiens
gaggcucuuguuuguauga

SEQ ID NO: 574622 - RNA, 19 nt, Homo sapiens
caguugacaucauggacau

SEQ ID NO: 574623 - RNA, 19 nt, Homo sapiens
uuuaucgacucugugcaua

SEQ ID NO: 574624 - RNA, 19 nt, Homo sapiens
ugggauggcugugauaaaa

SEQ ID NO: 574625 - RNA, 19 nt, Homo sapiens
cuggugcaguucagacuug

SEQ ID NO: 574626 - RNA, 19 nt, Homo sapiens
ucaccaccacugugcauau

SEQ ID NO: 574627 - RNA, 19 nt, Homo sapiens
cauuaggacaucacucaug

SEQ ID NO: 574628 - RNA, 19 nt, Homo sapiens
gacguuucaugcgcaguga

SEQ ID NO: 574629 - RNA, 19 nt, Homo sapiens
uucaaaaguucccaccuua

SEQ ID NO: 574630 - RNA, 19 nt, Homo sapiens
ccauccagacuccagauug

SEQ ID NO: 574631 - RNA, 19 nt, Homo sapiens
gaagcugucgaggcucuug

SEQ ID NO: 574632 - RNA, 19 nt, Homo sapiens
aguagcauguuaccagcuu

SEQ ID NO: 574633 - RNA, 19 nt, Homo sapiens
ccugugacuggacaaagua

SEQ ID NO: 574634 - RNA, 19 nt, Homo sapiens
guggccugcugcucacuga

SEQ ID NO: 574635 - RNA, 19 nt, Homo sapiens
uaucgacucugugcauaac

SEQ ID NO: 574636 - RNA, 19 nt, Homo sapiens
guugacaucauggacauau

SEQ ID NO: 574637 - RNA, 19 nt, Homo sapiens
ccgggaauaccaaguuguu

SEQ ID NO: 574638 - RNA, 19 nt, Homo sapiens
gcgaguaccuggugaauuu

SEQ ID NO: 574639 - RNA, 19 nt, Homo sapiens
ggagagggcugugauguaa

SEQ ID NO: 574640 - RNA, 19 nt, Homo sapiens
ggacaaggcuuuccagaca

SEQ ID NO: 574641 - RNA, 19 nt, Homo sapiens
cagaugcaguugauucuua

SEQ ID NO: 574642 - RNA, 19 nt, Homo sapiens
gcaagcaggugguggagaa

SEQ ID NO: 574643 - RNA, 19 nt, Homo sapiens
gaaauccaguccaaguuga

SEQ ID NO: 574644 - RNA, 19 nt, Homo sapiens
ggagagcgcuaguuacaca

SEQ ID NO: 574645 - RNA, 19 nt, Homo sapiens
cgaaggaaaucaagggaaa

SEQ ID NO: 574646 - RNA, 19 nt, Homo sapiens
gcuagggucuugacuuuau

SEQ ID NO: 574647 - RNA, 19 nt, Homo sapiens
gcccugagcuagacgguuu

SEQ ID NO: 574648 - RNA, 19 nt, Homo sapiens
gugcuagggucuugacuuu

SEQ ID NO: 574649 - RNA, 19 nt, Homo sapiens
gcagaucuacgacaaauuc

SEQ ID NO: 574650 - RNA, 19 nt, Homo sapiens
gaagaugaacccuuucugu

SEQ ID NO: 574651 - RNA, 19 nt, Homo sapiens
caagggaaauccaguccaa

SEQ ID NO: 574652 - RNA, 19 nt, Homo sapiens
ggaaauccaguccaaguug

SEQ ID NO: 574653 - RNA, 19 nt, Homo sapiens
gcucaccucaugcuucuua

SEQ ID NO: 574654 - RNA, 19 nt, Homo sapiens
gggaagacccgaacucgaa

SEQ ID NO: 574655 - RNA, 19 nt, Homo sapiens
caagauguauggucggaau

SEQ ID NO: 574656 - RNA, 19 nt, Homo sapiens
cgacaaauucccugagaaa

SEQ ID NO: 574657 - RNA, 19 nt, Homo sapiens
gacagaggauaaagcuauu

SEQ ID NO: 574658 - RNA, 19 nt, Homo sapiens
gggcccagcaucacauuua

SEQ ID NO: 574659 - RNA, 19 nt, Homo sapiens
ggagugagcagccaguaug

SEQ ID NO: 574660 - RNA, 19 nt, Homo sapiens
gguugcagcugguagaguu

SEQ ID NO: 574661 - RNA, 19 nt, Homo sapiens
ugacagaggauaaagcuau

SEQ ID NO: 574662 - RNA, 19 nt, Homo sapiens
aaacagagacacccaggaa

SEQ ID NO: 574663 - RNA, 19 nt, Homo sapiens
guguugaacuuucuaaucu

SEQ ID NO: 574664 - RNA, 19 nt, Homo sapiens
caagcaguguguugaacuu

SEQ ID NO: 574665 - RNA, 19 nt, Homo sapiens
aagugaagaugaacccuuu

SEQ ID NO: 574666 - RNA, 19 nt, Homo sapiens
ggacugaggaaaggauaaa

SEQ ID NO: 574667 - RNA, 19 nt, Homo sapiens
gggagagggcugugaugua

SEQ ID NO: 574668 - RNA, 19 nt, Homo sapiens
ucucaucccucuccuaagu

SEQ ID NO: 574669 - RNA, 19 nt, Homo sapiens
gagcgcuaguuacacauug

SEQ ID NO: 574670 - RNA, 19 nt, Homo sapiens
ccugagcgauacaugauga

SEQ ID NO: 574671 - RNA, 19 nt, Homo sapiens
gacaaggcuuuccagacaa

SEQ ID NO: 574672 - RNA, 19 nt, Homo sapiens
ccuccaaggucugcucuuu

SEQ ID NO: 574673 - RNA, 19 nt, Homo sapiens
ggaagacccgaacucgaaa

SEQ ID NO: 574674 - RNA, 19 nt, Homo sapiens
caccucaugcuucuuauuu

SEQ ID NO: 574675 - RNA, 19 nt, Homo sapiens
gcuggaggacggcagauuu

SEQ ID NO: 574676 - RNA, 19 nt, Homo sapiens
guugaacuuucuaaucuca

SEQ ID NO: 574677 - RNA, 19 nt, Homo sapiens
gcaguguguugaacuuucu

SEQ ID NO: 574678 - RNA, 19 nt, Homo sapiens
guucucagccuucguggaa

SEQ ID NO: 574679 - RNA, 19 nt, Homo sapiens
ccacuccucugcaugucuu

SEQ ID NO: 574680 - RNA, 19 nt, Homo sapiens
gaugaacagcguccuggaa

SEQ ID NO: 574681 - RNA, 19 nt, Homo sapiens
gaugaaggcaagauguaug

SEQ ID NO: 574682 - RNA, 19 nt, Homo sapiens
gauguauggucggaaugaa

SEQ ID NO: 574683 - RNA, 19 nt, Homo sapiens
cggcagaucuacgacaaau

SEQ ID NO: 574684 - RNA, 19 nt, Homo sapiens
uaucuccgcugcacaagca

SEQ ID NO: 574685 - RNA, 19 nt, Homo sapiens
ccucugagcuuuuccaguu

SEQ ID NO: 574686 - RNA, 19 nt, Homo sapiens
gggaaauccaguccaaguu

SEQ ID NO: 574687 - RNA, 19 nt, Homo sapiens
gaggacggcagauuugugu

SEQ ID NO: 574688 - RNA, 19 nt, Homo sapiens
aaucucaucccucuccuaa

SEQ ID NO: 574689 - RNA, 19 nt, Homo sapiens
guacagcacuggcuuuucu

SEQ ID NO: 574690 - RNA, 19 nt, Homo sapiens
ccguucaccuugucacuga

SEQ ID NO: 574691 - RNA, 19 nt, Homo sapiens
ugaaggaccagguuuccaa

SEQ ID NO: 574692 - RNA, 19 nt, Homo sapiens
gaaaggauaaaccccgaua

SEQ ID NO: 574693 - RNA, 19 nt, Homo sapiens
cagcucaccucaugcuucu

SEQ ID NO: 574694 - RNA, 19 nt, Homo sapiens
cagcagugguggcuucuac

SEQ ID NO: 574695 - RNA, 19 nt, Homo sapiens
ucacagugggugucugaaa

SEQ ID NO: 574696 - RNA, 19 nt, Homo sapiens
gcacuggcuuuucuuuuca

SEQ ID NO: 574697 - RNA, 19 nt, Homo sapiens
acaugacccucaccuguuc

SEQ ID NO: 574698 - RNA, 19 nt, Homo sapiens
uacgacaaauucccugaga

SEQ ID NO: 574699 - RNA, 19 nt, Homo sapiens
acaaggcuuuccagacaau

SEQ ID NO: 574700 - RNA, 19 nt, Homo sapiens
ggaaaucaagggaaaucca

SEQ ID NO: 574701 - RNA, 19 nt, Homo sapiens
ggugggcccuggacauuuu

SEQ ID NO: 574702 - RNA, 19 nt, Homo sapiens
cacagugggugucugaaag

SEQ ID NO: 574703 - RNA, 19 nt, Homo sapiens
gauauugggaccucacagu

SEQ ID NO: 574704 - RNA, 19 nt, Homo sapiens
gcagugaggaaggcaguga

SEQ ID NO: 574705 - RNA, 19 nt, Homo sapiens
agagggcugugauguaaag

SEQ ID NO: 574706 - RNA, 19 nt, Homo sapiens
gcagcugccugagcgauac

SEQ ID NO: 574707 - RNA, 19 nt, Homo sapiens
gugagcagccaguaugaga

SEQ ID NO: 574708 - RNA, 19 nt, Homo sapiens
uuccagaugugaagccauu

SEQ ID NO: 574709 - RNA, 19 nt, Homo sapiens
gaaggaaaucaagggaaau

SEQ ID NO: 574710 - RNA, 19 nt, Homo sapiens
ucaucccucuccuaaguga

SEQ ID NO: 574711 - RNA, 19 nt, Homo sapiens
ugaacuuucuaaucucauc

SEQ ID NO: 574712 - RNA, 19 nt, Homo sapiens
ccucaugcuucuuauuugg

SEQ ID NO: 574713 - RNA, 19 nt, Homo sapiens
ggacggcagauuuguguac

SEQ ID NO: 574714 - RNA, 19 nt, Homo sapiens
ggaggacggcagauuugug

SEQ ID NO: 574715 - RNA, 19 nt, Homo sapiens
caaguugaaggaccagguu

SEQ ID NO: 574716 - RNA, 19 nt, Homo sapiens
ucuuggagagcgcuaguua

SEQ ID NO: 574717 - RNA, 19 nt, Homo sapiens
uaaagggguugaccucaga

SEQ ID NO: 574718 - RNA, 19 nt, Homo sapiens
cacaugacccucaccuguu

SEQ ID NO: 574719 - RNA, 19 nt, Homo sapiens
uaugagagccuggaacaca

SEQ ID NO: 574720 - RNA, 19 nt, Homo sapiens
ggaaccgccagaugcaguu

SEQ ID NO: 574721 - RNA, 19 nt, Homo sapiens
cuaagugagcccugagcua

SEQ ID NO: 574722 - RNA, 19 nt, Homo sapiens
uccaugaccugugagauca

SEQ ID NO: 574723 - RNA, 19 nt, Homo sapiens
gagcgauacaugaugaaca

SEQ ID NO: 574724 - RNA, 19 nt, Homo sapiens
gagugagcagccaguauga

SEQ ID NO: 574725 - RNA, 19 nt, Homo sapiens
gcuagacgguuuccuuccu

SEQ ID NO: 574726 - RNA, 19 nt, Homo sapiens
ucagaggccuaagcaacug

SEQ ID NO: 574727 - RNA, 19 nt, Homo sapiens
gguguggagcccagacauu

SEQ ID NO: 574728 - RNA, 19 nt, Homo sapiens
gagagggcugugauguaaa

SEQ ID NO: 574729 - RNA, 19 nt, Homo sapiens
acaaagcucccggcaacuu

SEQ ID NO: 574730 - RNA, 19 nt, Homo sapiens
gaagccauucucacagaca

SEQ ID NO: 574731 - RNA, 19 nt, Homo sapiens
gaauguuccagaugugaag

SEQ ID NO: 574732 - RNA, 19 nt, Homo sapiens
ugagcuagacgguuuccuu

SEQ ID NO: 574733 - RNA, 19 nt, Homo sapiens
ucuagucacauccagguuu

SEQ ID NO: 574734 - RNA, 19 nt, Homo sapiens
ggauaaaccccgauauugg

SEQ ID NO: 574735 - RNA, 19 nt, Homo sapiens
guaccuggugaauuucuug

SEQ ID NO: 574736 - RNA, 19 nt, Homo sapiens
cugaugaaggcaagaugua

SEQ ID NO: 574737 - RNA, 19 nt, Homo sapiens
cagacaccguucaccuugu

SEQ ID NO: 574738 - RNA, 19 nt, Homo sapiens
gaaagacaaacucgaauua

SEQ ID NO: 574739 - RNA, 19 nt, Homo sapiens
gcaacagaauuacagagua

SEQ ID NO: 574740 - RNA, 19 nt, Homo sapiens
caauggaaaucuuagcaua

SEQ ID NO: 574741 - RNA, 19 nt, Homo sapiens
caacagaauuacagaguau

SEQ ID NO: 574742 - RNA, 19 nt, Homo sapiens
gaaagucgacaauuaaguu

SEQ ID NO: 574743 - RNA, 19 nt, Homo sapiens
gguaaucacuccugaagau

SEQ ID NO: 574744 - RNA, 19 nt, Homo sapiens
guacacacucaguuaauua

SEQ ID NO: 574745 - RNA, 19 nt, Homo sapiens
ggagagagcagaaagacaa

SEQ ID NO: 574746 - RNA, 19 nt, Homo sapiens
ggaaaggcaauguuauauu

SEQ ID NO: 574747 - RNA, 19 nt, Homo sapiens
gcagaaagacaaacucgaa

SEQ ID NO: 574748 - RNA, 19 nt, Homo sapiens
ugacgaaauugaugaaguu

SEQ ID NO: 574749 - RNA, 19 nt, Homo sapiens
aagcagagaugaauaauac

SEQ ID NO: 574750 - RNA, 19 nt, Homo sapiens
guuugaagaugacgaaauu

SEQ ID NO: 574751 - RNA, 19 nt, Homo sapiens
gcagcaguauggagauaaa

SEQ ID NO: 574752 - RNA, 19 nt, Homo sapiens
ggauucagcucaauaugca

SEQ ID NO: 574753 - RNA, 19 nt, Homo sapiens
gaagaugacgaaauugaug

SEQ ID NO: 574754 - RNA, 19 nt, Homo sapiens
caggaaaggcaauguuaua

SEQ ID NO: 574755 - RNA, 19 nt, Homo sapiens
gguacacacucaguuaauu

SEQ ID NO: 574756 - RNA, 19 nt, Homo sapiens
gcaagcugcugaaguuucu

SEQ ID NO: 574757 - RNA, 19 nt, Homo sapiens
cugugaaagucgacaauua

SEQ ID NO: 574758 - RNA, 19 nt, Homo sapiens
caaccuucauucaguauca

SEQ ID NO: 574759 - RNA, 19 nt, Homo sapiens
ggaucuggcucuucuugug

SEQ ID NO: 574760 - RNA, 19 nt, Homo sapiens
uuaaggugauuucuuguga

SEQ ID NO: 574761 - RNA, 19 nt, Homo sapiens
aagacaaacucgaauuaug

SEQ ID NO: 574762 - RNA, 19 nt, Homo sapiens
uagcaauguuugaagauga

SEQ ID NO: 574763 - RNA, 19 nt, Homo sapiens
gcaggaaugggauggcuuu

SEQ ID NO: 574764 - RNA, 19 nt, Homo sapiens
uaucacaacucugcugaga

SEQ ID NO: 574765 - RNA, 19 nt, Homo sapiens
aaagauugcucaggacuuc

SEQ ID NO: 574766 - RNA, 19 nt, Homo sapiens
uauaagcuuugcaacagaa

SEQ ID NO: 574767 - RNA, 19 nt, Homo sapiens
ucaaguaguggaaggagua

SEQ ID NO: 574768 - RNA, 19 nt, Homo sapiens
ugugaaagucgacaauuaa

SEQ ID NO: 574769 - RNA, 19 nt, Homo sapiens
caaacucgaauuauggauu

SEQ ID NO: 574770 - RNA, 19 nt, Homo sapiens
gauguauucuuuaggugau

SEQ ID NO: 574771 - RNA, 19 nt, Homo sapiens
uaaggugauuucuugugaa

SEQ ID NO: 574772 - RNA, 19 nt, Homo sapiens
ccacaggauuggcccacuu

SEQ ID NO: 574773 - RNA, 19 nt, Homo sapiens
ugaggaugaucuucucgaa

SEQ ID NO: 574774 - RNA, 19 nt, Homo sapiens
aagcuuugcaacagaauua

SEQ ID NO: 574775 - RNA, 19 nt, Homo sapiens
gaucuggcucuucuuguga

SEQ ID NO: 574776 - RNA, 19 nt, Homo sapiens
gaccagacaggagaacuuu

SEQ ID NO: 574777 - RNA, 19 nt, Homo sapiens
gcagcuaguccaaugucua

SEQ ID NO: 574778 - RNA, 19 nt, Homo sapiens
cagcaauaaugcgaacaaa

SEQ ID NO: 574779 - RNA, 19 nt, Homo sapiens
guacagggaagucuauaag

SEQ ID NO: 574780 - RNA, 19 nt, Homo sapiens
cugcaaccuucauucagua

SEQ ID NO: 574781 - RNA, 19 nt, Homo sapiens
uauccgagacuacaaauca

SEQ ID NO: 574782 - RNA, 19 nt, Homo sapiens
gaauuacagaguaugaugu

SEQ ID NO: 574783 - RNA, 19 nt, Homo sapiens
agggaagucuauaagcuuu

SEQ ID NO: 574784 - RNA, 19 nt, Homo sapiens
ggaguacagggaagucuau

SEQ ID NO: 574785 - RNA, 19 nt, Homo sapiens
ccaauguugucgcaaugga

SEQ ID NO: 574786 - RNA, 19 nt, Homo sapiens
agaaagacaaacucgaauu

SEQ ID NO: 574787 - RNA, 19 nt, Homo sapiens
gcagcaauaaugcgaacaa

SEQ ID NO: 574788 - RNA, 19 nt, Homo sapiens
ggaaugggauggcuuuucu

SEQ ID NO: 574789 - RNA, 19 nt, Homo sapiens
agacaaacucgaauuaugg

SEQ ID NO: 574790 - RNA, 19 nt, Homo sapiens
ucuauaagcuuugcaacag

SEQ ID NO: 574791 - RNA, 19 nt, Homo sapiens
gagauaaaacccaauguug

SEQ ID NO: 574792 - RNA, 19 nt, Homo sapiens
ggacuuccucaacucuauu

SEQ ID NO: 574793 - RNA, 19 nt, Homo sapiens
gaagacugcuaaaauacau

SEQ ID NO: 574794 - RNA, 19 nt, Homo sapiens
ugaugugccugcaacaaca

SEQ ID NO: 574795 - RNA, 19 nt, Homo sapiens
cugcugaugugacaacugu

SEQ ID NO: 574796 - RNA, 19 nt, Homo sapiens
gagagagcagaaagacaaa

SEQ ID NO: 574797 - RNA, 19 nt, Homo sapiens
gacgaaauugaugaaguua

SEQ ID NO: 574798 - RNA, 19 nt, Homo sapiens
gcaauaaugcgaacaaaag

SEQ ID NO: 574799 - RNA, 19 nt, Homo sapiens
cacacucaguuaauuaauc

SEQ ID NO: 574800 - RNA, 19 nt, Homo sapiens
gguagaagaugugguacac

SEQ ID NO: 574801 - RNA, 19 nt, Homo sapiens
gcugaugugacaacuguga

SEQ ID NO: 574802 - RNA, 19 nt, Homo sapiens
cuuagcauauuuagcguau

SEQ ID NO: 574803 - RNA, 19 nt, Homo sapiens
gacaaacucgaauuaugga

SEQ ID NO: 574804 - RNA, 19 nt, Homo sapiens
gaauggagagagcagaaag

SEQ ID NO: 574805 - RNA, 19 nt, Homo sapiens
caggagaacuuuuagcaau

SEQ ID NO: 574806 - RNA, 19 nt, Homo sapiens
ccagacaggagaacuuuua

SEQ ID NO: 574807 - RNA, 19 nt, Homo sapiens
cuauaagcuuugcaacaga

SEQ ID NO: 574808 - RNA, 19 nt, Homo sapiens
ggaagucuauaagcuuugc

SEQ ID NO: 574809 - RNA, 19 nt, Homo sapiens
gcaauggaaaucuuagcau

SEQ ID NO: 574810 - RNA, 19 nt, Homo sapiens
caaugucuacugcaacuuc

SEQ ID NO: 574811 - RNA, 19 nt, Homo sapiens
caucagagaggccauucga

SEQ ID NO: 574812 - RNA, 19 nt, Homo sapiens
ccaaauuucgagacugguu

SEQ ID NO: 574813 - RNA, 19 nt, Homo sapiens
acagggaagucuauaagcu

SEQ ID NO: 574814 - RNA, 19 nt, Homo sapiens
cagaguaugauguauucuu

SEQ ID NO: 574815 - RNA, 19 nt, Homo sapiens
caacaacaggaaaggcaau

SEQ ID NO: 574816 - RNA, 19 nt, Homo sapiens
ggagauaaaacccaauguu

SEQ ID NO: 574817 - RNA, 19 nt, Homo sapiens
aauuauggauucagcucaa

SEQ ID NO: 574818 - RNA, 19 nt, Homo sapiens
uacggcagcuaguccaaug

SEQ ID NO: 574819 - RNA, 19 nt, Homo sapiens
caacucuauugaccagaca

SEQ ID NO: 574820 - RNA, 19 nt, Homo sapiens
gagacuacaaaucaaagau

SEQ ID NO: 574821 - RNA, 19 nt, Homo sapiens
gaugcgcaaagauaagaaa

SEQ ID NO: 574822 - RNA, 19 nt, Homo sapiens
aaucacuccugaagaucuu

SEQ ID NO: 574823 - RNA, 19 nt, Homo sapiens
ucugcaaccuucauucagu

SEQ ID NO: 574824 - RNA, 19 nt, Homo sapiens
gaauaauacggcagcuagu

SEQ ID NO: 574825 - RNA, 19 nt, Homo sapiens
ggagaacuuuuagcaaugu

SEQ ID NO: 574826 - RNA, 19 nt, Homo sapiens
gugguacacacucaguuaa

SEQ ID NO: 574827 - RNA, 19 nt, Homo sapiens
ggaaggaguacagggaagu

SEQ ID NO: 574828 - RNA, 19 nt, Homo sapiens
uugaagaugacgaaauuga

SEQ ID NO: 574829 - RNA, 19 nt, Homo sapiens
cgaugaggaugaucuucuc

SEQ ID NO: 574830 - RNA, 19 nt, Homo sapiens
caaaggcaucgaugaggau

SEQ ID NO: 574831 - RNA, 19 nt, Homo sapiens
acagaauuacagaguauga

SEQ ID NO: 574832 - RNA, 19 nt, Homo sapiens
ugucgcaauggaaaucuua

SEQ ID NO: 574833 - RNA, 19 nt, Homo sapiens
agaauuacagaguaugaug

SEQ ID NO: 574834 - RNA, 19 nt, Homo sapiens
cagggaagucuauaagcuu

SEQ ID NO: 574835 - RNA, 19 nt, Homo sapiens
ugaagaugacgaaauugau

SEQ ID NO: 574836 - RNA, 19 nt, Homo sapiens
guucuuaaagcagagauga

SEQ ID NO: 574837 - RNA, 19 nt, Homo sapiens
uuagcaauguuugaagaug

SEQ ID NO: 574838 - RNA, 19 nt, Homo sapiens
guacuaaucuucagucaaa

SEQ ID NO: 574839 - RNA, 19 nt, Homo sapiens
gaagagcuauuaacagaaa

SEQ ID NO: 574840 - RNA, 19 nt, Homo sapiens
ggauuaaacuggcucauuu

SEQ ID NO: 574841 - RNA, 19 nt, Homo sapiens
gaacaccucuucagaacaa

SEQ ID NO: 574842 - RNA, 19 nt, Homo sapiens
cagaagaagucauugaaua

SEQ ID NO: 574843 - RNA, 19 nt, Homo sapiens
uaaacuggcucauuucuuu

SEQ ID NO: 574844 - RNA, 19 nt, Homo sapiens
ggaaagaggugcaaagaag

SEQ ID NO: 574845 - RNA, 19 nt, Homo sapiens
gaggagauguaauaccuua

SEQ ID NO: 574846 - RNA, 19 nt, Homo sapiens
ggagaagacuauagagaaa

SEQ ID NO: 574847 - RNA, 19 nt, Homo sapiens
uuacugagcuagaaacaua

SEQ ID NO: 574848 - RNA, 19 nt, Homo sapiens
gagcuguggucacuucuua

SEQ ID NO: 574849 - RNA, 19 nt, Homo sapiens
gauaggagauaaagaacaa

SEQ ID NO: 574850 - RNA, 19 nt, Homo sapiens
gaagauaucgaugguauuu

SEQ ID NO: 574851 - RNA, 19 nt, Homo sapiens
agaaagcacuugacacaaa

SEQ ID NO: 574852 - RNA, 19 nt, Homo sapiens
ggaaugguauacucggaua

SEQ ID NO: 574853 - RNA, 19 nt, Homo sapiens
gagaauggcaucaauggua

SEQ ID NO: 574854 - RNA, 19 nt, Homo sapiens
gaaaugggccuaggaaaga

SEQ ID NO: 574855 - RNA, 19 nt, Homo sapiens
acacagggauuuaccaauu

SEQ ID NO: 574856 - RNA, 19 nt, Homo sapiens
gaaagucgguggcguaggu

SEQ ID NO: 574857 - RNA, 19 nt, Homo sapiens
gaagaucguuuucugauuu

SEQ ID NO: 574858 - RNA, 19 nt, Homo sapiens
caaacaauuucucuucuug

SEQ ID NO: 574859 - RNA, 19 nt, Homo sapiens
gaagcugaaucccuuaaug

SEQ ID NO: 574860 - RNA, 19 nt, Homo sapiens
gauacagagucaaguguuu

SEQ ID NO: 574861 - RNA, 19 nt, Homo sapiens
acagaaagcuccaaagcaa

SEQ ID NO: 574862 - RNA, 19 nt, Homo sapiens
agauuugacugguuucuua

SEQ ID NO: 574863 - RNA, 19 nt, Homo sapiens
ggaccgagcacauagaauu

SEQ ID NO: 574864 - RNA, 19 nt, Homo sapiens
gcaacgagcuccaggacau

SEQ ID NO: 574865 - RNA, 19 nt, Homo sapiens
gaauuaaggcugauguuga

SEQ ID NO: 574866 - RNA, 19 nt, Homo sapiens
uagacaagcugcucccuaa

SEQ ID NO: 574867 - RNA, 19 nt, Homo sapiens
uaucaaagcuaaugagaag

SEQ ID NO: 574868 - RNA, 19 nt, Homo sapiens
ugauaacacuguagaagaa

SEQ ID NO: 574869 - RNA, 19 nt, Homo sapiens
gaaccugguccaccuuaua

SEQ ID NO: 574870 - RNA, 19 nt, Homo sapiens
gaggaaauauuugaugaug

SEQ ID NO: 574871 - RNA, 19 nt, Homo sapiens
aaagaagacugcagagaug

SEQ ID NO: 574872 - RNA, 19 nt, Homo sapiens
agacaagacuccaucaaug

SEQ ID NO: 574873 - RNA, 19 nt, Homo sapiens
gcucaauuguuaugucauu

SEQ ID NO: 574874 - RNA, 19 nt, Homo sapiens
guucagauuugacugguuu

SEQ ID NO: 574875 - RNA, 19 nt, Homo sapiens
gcacuugacacaaagauug

SEQ ID NO: 574876 - RNA, 19 nt, Homo sapiens
gaaaagaguuugccuccaa

SEQ ID NO: 574877 - RNA, 19 nt, Homo sapiens
gaaagcacuugacacaaag

SEQ ID NO: 574878 - RNA, 19 nt, Homo sapiens
caaagaagaauaagcauca

SEQ ID NO: 574879 - RNA, 19 nt, Homo sapiens
gauuauggcucagauugaa

SEQ ID NO: 574880 - RNA, 19 nt, Homo sapiens
cgagauggaggaaauauuu

SEQ ID NO: 574881 - RNA, 19 nt, Homo sapiens
gaccaaagccuucaacaca

SEQ ID NO: 574882 - RNA, 19 nt, Homo sapiens
ggauuuaccaauuggaaua

SEQ ID NO: 574883 - RNA, 19 nt, Homo sapiens
agaaugggauguaugugua

SEQ ID NO: 574884 - RNA, 19 nt, Homo sapiens
guucuuuccuccacguuua

SEQ ID NO: 574885 - RNA, 19 nt, Homo sapiens
gaaccaaacagcacaaagu

SEQ ID NO: 574886 - RNA, 19 nt, Homo sapiens
gauccuaccuaugaagaaa

SEQ ID NO: 574887 - RNA, 19 nt, Homo sapiens
cugaaucccuuaaugauga

SEQ ID NO: 574888 - RNA, 19 nt, Homo sapiens
ugaagacucuccaucguau

SEQ ID NO: 574889 - RNA, 19 nt, Homo sapiens
ugacuuugauuccugguuu

SEQ ID NO: 574890 - RNA, 19 nt, Homo sapiens
gaugaugcgucaccuggaa

SEQ ID NO: 574891 - RNA, 19 nt, Homo sapiens
gaauaagcaucaagaaagc

SEQ ID NO: 574892 - RNA, 19 nt, Homo sapiens
ccuuaaugaugaagaguua

SEQ ID NO: 574893 - RNA, 19 nt, Homo sapiens
caaagaagacugcagagau

SEQ ID NO: 574894 - RNA, 19 nt, Homo sapiens
gacaucagguucaucuguu

SEQ ID NO: 574895 - RNA, 19 nt, Homo sapiens
ccaaagccuucaacacaga

SEQ ID NO: 574896 - RNA, 19 nt, Homo sapiens
aaacauggaacuagaagaa

SEQ ID NO: 574897 - RNA, 19 nt, Homo sapiens
gaagaauaagcaucaagaa

SEQ ID NO: 574898 - RNA, 19 nt, Homo sapiens
gaaagaggugcaaagaaga

SEQ ID NO: 574899 - RNA, 19 nt, Homo sapiens
gauuagacauggagcaaca

SEQ ID NO: 574900 - RNA, 19 nt, Homo sapiens
acacuuagaucuguuuguu

SEQ ID NO: 574901 - RNA, 19 nt, Homo sapiens
uuggguacaugaaacauua

SEQ ID NO: 574902 - RNA, 19 nt, Homo sapiens
caaacugaccgggcaaaua

SEQ ID NO: 574903 - RNA, 19 nt, Homo sapiens
gaugaagaguuagaggaaa

SEQ ID NO: 574904 - RNA, 19 nt, Homo sapiens
cuuagaaacuuuacaaugg

SEQ ID NO: 574905 - RNA, 19 nt, Homo sapiens
caacucagcaggcaagaug

SEQ ID NO: 574906 - RNA, 19 nt, Homo sapiens
caaagggaaugguauacuc

SEQ ID NO: 574907 - RNA, 19 nt, Homo sapiens
uaauucagcagaugacuuu

SEQ ID NO: 574908 - RNA, 19 nt, Homo sapiens
agagaagucuguguucaaa

SEQ ID NO: 574909 - RNA, 19 nt, Homo sapiens
gaagaacagcuuaaaauug

SEQ ID NO: 574910 - RNA, 19 nt, Homo sapiens
ggucuuggcaucaaucuug

SEQ ID NO: 574911 - RNA, 19 nt, Homo sapiens
aauuaaggcugauguugaa

SEQ ID NO: 574912 - RNA, 19 nt, Homo sapiens
augaagagcuauuaacaga

SEQ ID NO: 574913 - RNA, 19 nt, Homo sapiens
ugccagauguguuuaauuc

SEQ ID NO: 574914 - RNA, 19 nt, Homo sapiens
ggaggaugaagagcuauua

SEQ ID NO: 574915 - RNA, 19 nt, Homo sapiens
gcagaacguuugggagugu

SEQ ID NO: 574916 - RNA, 19 nt, Homo sapiens
ggagaggcgagaauucaaa

SEQ ID NO: 574917 - RNA, 19 nt, Homo sapiens
cgaaggagaagacuauaga

SEQ ID NO: 574918 - RNA, 19 nt, Homo sapiens
gagacaagacuccaucaau

SEQ ID NO: 574919 - RNA, 19 nt, Homo sapiens
gagaaugggauguaugugu

SEQ ID NO: 574920 - RNA, 19 nt, Homo sapiens
aaccagauccuaccuauga

SEQ ID NO: 574921 - RNA, 19 nt, Homo sapiens
gagaaaacauggaacuaga

SEQ ID NO: 574922 - RNA, 19 nt, Homo sapiens
ccuggaugcuggcgagaua

SEQ ID NO: 574923 - RNA, 19 nt, Homo sapiens
gaaauccugagcugccuaa

SEQ ID NO: 574924 - RNA, 19 nt, Homo sapiens
ugggaaagaugaaaugcuu

SEQ ID NO: 574925 - RNA, 19 nt, Homo sapiens
gaacaaaauugggaaagau

SEQ ID NO: 574926 - RNA, 19 nt, Homo sapiens
gucagaguguuccgcuuua

SEQ ID NO: 574927 - RNA, 19 nt, Homo sapiens
gugagggaauucaagacua

SEQ ID NO: 574928 - RNA, 19 nt, Homo sapiens
gggguaaacugagagauua

SEQ ID NO: 574929 - RNA, 19 nt, Homo sapiens
ggaugaagagcuauuaaca

SEQ ID NO: 574930 - RNA, 19 nt, Homo sapiens
uaauuuacgggucuucaua

SEQ ID NO: 574931 - RNA, 19 nt, Homo sapiens
ggcgagaauucaaagaaga

SEQ ID NO: 574932 - RNA, 19 nt, Homo sapiens
cagagucaaguguuuauaa

SEQ ID NO: 574933 - RNA, 19 nt, Homo sapiens
gcaaagaagacugcagaga

SEQ ID NO: 574934 - RNA, 19 nt, Homo sapiens
uggaggaaauauuugauga

SEQ ID NO: 574935 - RNA, 19 nt, Homo sapiens
gaagaaagaauaguagaac

SEQ ID NO: 574936 - RNA, 19 nt, Homo sapiens
guggagaaauuaugaguac

SEQ ID NO: 574937 - RNA, 19 nt, Homo sapiens
acaaggguauuggacauuu

SEQ ID NO: 574938 - RNA, 19 nt, Homo sapiens
gaggagagcuggccagguu

SEQ ID NO: 574939 - RNA, 19 nt, Homo sapiens
gagauugcuuuguguauuu

SEQ ID NO: 574940 - RNA, 19 nt, Homo sapiens
gagcaacccuucaaucaug

SEQ ID NO: 574941 - RNA, 19 nt, Homo sapiens
agaaggagcuggagaccua

SEQ ID NO: 574942 - RNA, 19 nt, Homo sapiens
gagaggauauuacauugug

SEQ ID NO: 574943 - RNA, 19 nt, Homo sapiens
gagcaggcuuugaucauug

SEQ ID NO: 574944 - RNA, 19 nt, Homo sapiens
uuacauaccugaagcuaga

SEQ ID NO: 574945 - RNA, 19 nt, Homo sapiens
ggacagacccuucgauucu

SEQ ID NO: 574946 - RNA, 19 nt, Homo sapiens
gggacuauguggauaaaga

SEQ ID NO: 574947 - RNA, 19 nt, Homo sapiens
gaaacuggcuagcuguuac

SEQ ID NO: 574948 - RNA, 19 nt, Homo sapiens
uuaaggcaguuucuuguuu

SEQ ID NO: 574949 - RNA, 19 nt, Homo sapiens
ggauaaagagaaagaaaug

SEQ ID NO: 574950 - RNA, 19 nt, Homo sapiens
auaaugagcugaagaaacu

SEQ ID NO: 574951 - RNA, 19 nt, Homo sapiens
caagaccaauuuccacuuc

SEQ ID NO: 574952 - RNA, 19 nt, Homo sapiens
gagcugugguucuccauca

SEQ ID NO: 574953 - RNA, 19 nt, Homo sapiens
gaaccuguccuuuacauac

SEQ ID NO: 574954 - RNA, 19 nt, Homo sapiens
gaagacagaauuauguuac

SEQ ID NO: 574955 - RNA, 19 nt, Homo sapiens
agauugagcugcuugacuu

SEQ ID NO: 574956 - RNA, 19 nt, Homo sapiens
ccacuguccuguucaagau

SEQ ID NO: 574957 - RNA, 19 nt, Homo sapiens
gacagacccuucgauucua

SEQ ID NO: 574958 - RNA, 19 nt, Homo sapiens
cuucggugcuagugaaaua

SEQ ID NO: 574959 - RNA, 19 nt, Homo sapiens
gaaugucccugagucaaca

SEQ ID NO: 574960 - RNA, 19 nt, Homo sapiens
aaacuuggagaggauauua

SEQ ID NO: 574961 - RNA, 19 nt, Homo sapiens
ucaauaaugagcugaagaa

SEQ ID NO: 574962 - RNA, 19 nt, Homo sapiens
agagauugcuuuguguauu

SEQ ID NO: 574963 - RNA, 19 nt, Homo sapiens
uggagaggauauuacauug

SEQ ID NO: 574964 - RNA, 19 nt, Homo sapiens
cuauguggauaaagagaaa

SEQ ID NO: 574965 - RNA, 19 nt, Homo sapiens
gaaauguggcaccgcaugu

SEQ ID NO: 574966 - RNA, 19 nt, Homo sapiens
gcauggagcugggccuucu

SEQ ID NO: 574967 - RNA, 19 nt, Homo sapiens
acagacccuucgauucuaa

SEQ ID NO: 574968 - RNA, 19 nt, Homo sapiens
gaaggacgucauccgagaa

SEQ ID NO: 574969 - RNA, 19 nt, Homo sapiens
uuuguaggguucucuguuu

SEQ ID NO: 574970 - RNA, 19 nt, Homo sapiens
agagcaggcuuugaucauu

SEQ ID NO: 574971 - RNA, 19 nt, Homo sapiens
ggagagcaggcuuugauca

SEQ ID NO: 574972 - RNA, 19 nt, Homo sapiens
uacgagcgguuaagucaga

SEQ ID NO: 574973 - RNA, 19 nt, Homo sapiens
gcaagaccaauuuccacuu

SEQ ID NO: 574974 - RNA, 19 nt, Homo sapiens
gaugccaaagugagauaua

SEQ ID NO: 574975 - RNA, 19 nt, Homo sapiens
ggacgucauccgagaagga

SEQ ID NO: 574976 - RNA, 19 nt, Homo sapiens
gaaaacuccucggcuaaug

SEQ ID NO: 574977 - RNA, 19 nt, Homo sapiens
ggagcaacccuucaaucau

SEQ ID NO: 574978 - RNA, 19 nt, Homo sapiens
gacccuucgauucuaauua

SEQ ID NO: 574979 - RNA, 19 nt, Homo sapiens
cuccugaaccuguccuuua

SEQ ID NO: 574980 - RNA, 19 nt, Homo sapiens
ggagaggauauuacauugu

SEQ ID NO: 574981 - RNA, 19 nt, Homo sapiens
ggccagguuucuguucaaa

SEQ ID NO: 574982 - RNA, 19 nt, Homo sapiens
gagcuggccagguuucugu

SEQ ID NO: 574983 - RNA, 19 nt, Homo sapiens
gaaacuuggagaggauauu

SEQ ID NO: 574984 - RNA, 19 nt, Homo sapiens
uaaggcaguuucuuguuuu

SEQ ID NO: 574985 - RNA, 19 nt, Homo sapiens
gggaaagcgcagcuacuga

SEQ ID NO: 574986 - RNA, 19 nt, Homo sapiens
cagggacuauguggauaaa

SEQ ID NO: 574987 - RNA, 19 nt, Homo sapiens
gagagcaggcuuugaucau

SEQ ID NO: 574988 - RNA, 19 nt, Homo sapiens
ccgccaagcuuccuguucu

SEQ ID NO: 574989 - RNA, 19 nt, Homo sapiens
agaaacuggcuagcuguua

SEQ ID NO: 574990 - RNA, 19 nt, Homo sapiens
aaagggcccuguugcuucu

SEQ ID NO: 574991 - RNA, 19 nt, Homo sapiens
gaaagcgcagcuacugaca

SEQ ID NO: 574992 - RNA, 19 nt, Homo sapiens
guggauaaagagaaagaaa

SEQ ID NO: 574993 - RNA, 19 nt, Homo sapiens
gcagcaagaccaauuucca

SEQ ID NO: 574994 - RNA, 19 nt, Homo sapiens
gagcagcaagaccaauuuc

SEQ ID NO: 574995 - RNA, 19 nt, Homo sapiens
aaaccgaacuacgccuaug

SEQ ID NO: 574996 - RNA, 19 nt, Homo sapiens
auggauaccuggaacacuu

SEQ ID NO: 574997 - RNA, 19 nt, Homo sapiens
aauagagauugcuuugugu

SEQ ID NO: 574998 - RNA, 19 nt, Homo sapiens
aagcgcagcuacugacaag

SEQ ID NO: 574999 - RNA, 19 nt, Homo sapiens
uacagggacuauguggaua

SEQ ID NO: 575000 - RNA, 19 nt, Homo sapiens
gcuagaccgacccaccaua

SEQ ID NO: 575001 - RNA, 19 nt, Homo sapiens
aaugaaacuuggagaggau

SEQ ID NO: 575002 - RNA, 19 nt, Homo sapiens
uuacagggacuauguggau

SEQ ID NO: 575003 - RNA, 19 nt, Homo sapiens
gcuauggagagcaggcuuu

SEQ ID NO: 575004 - RNA, 19 nt, Homo sapiens
augccaaagugagauauaa

SEQ ID NO: 575005 - RNA, 19 nt, Homo sapiens
gagucaacaccaauagaga

SEQ ID NO: 575006 - RNA, 19 nt, Homo sapiens
guucuucaccuaccaacga

SEQ ID NO: 575007 - RNA, 19 nt, Homo sapiens
cuucaaucaugacaucaau

SEQ ID NO: 575008 - RNA, 19 nt, Homo sapiens
ggagagcuggccagguuuc

SEQ ID NO: 575009 - RNA, 19 nt, Homo sapiens
aaacuccucggcuaaugaa

SEQ ID NO: 575010 - RNA, 19 nt, Homo sapiens
caauaaugagcugaagaaa

SEQ ID NO: 575011 - RNA, 19 nt, Homo sapiens
ugagcugcuugacuuccua

SEQ ID NO: 575012 - RNA, 19 nt, Homo sapiens
acaccacuguccuguucaa

SEQ ID NO: 575013 - RNA, 19 nt, Homo sapiens
uuggagaggauauuacauu

SEQ ID NO: 575014 - RNA, 19 nt, Homo sapiens
gucaacaccaauagagauu

SEQ ID NO: 575015 - RNA, 19 nt, Homo sapiens
gcaggagaaaguugaaggu

SEQ ID NO: 575016 - RNA, 19 nt, Homo sapiens
ggacuauguggauaaagag

SEQ ID NO: 575017 - RNA, 19 nt, Homo sapiens
acagggacuauguggauaa

SEQ ID NO: 575018 - RNA, 19 nt, Homo sapiens
ugagcagcaagaccaauuu

SEQ ID NO: 575019 - RNA, 19 nt, Homo sapiens
caggugcuguuuucuguuu

SEQ ID NO: 575020 - RNA, 19 nt, Homo sapiens
caucaauaaugagcugaag

SEQ ID NO: 575021 - RNA, 19 nt, Homo sapiens
gcgaaugucccugagucaa

SEQ ID NO: 575022 - RNA, 19 nt, Homo sapiens
gcugugguucuccaucauu

SEQ ID NO: 575023 - RNA, 19 nt, Homo sapiens
cuacagcaggagaaaguug

SEQ ID NO: 575024 - RNA, 19 nt, Homo sapiens
uguacgagcgguuaaguca

SEQ ID NO: 575025 - RNA, 19 nt, Homo sapiens
uuucuaugaugccaaagug

SEQ ID NO: 575026 - RNA, 19 nt, Homo sapiens
cuacggaacgggaguuugg

SEQ ID NO: 575027 - RNA, 19 nt, Homo sapiens
gaccaauuuccacuucaga

SEQ ID NO: 575028 - RNA, 19 nt, Homo sapiens
aggagcaacccuucaauca

SEQ ID NO: 575029 - RNA, 19 nt, Homo sapiens
gaucauugaccaaaagaau

SEQ ID NO: 575030 - RNA, 19 nt, Homo sapiens
caaaccgaacuacgccuau

SEQ ID NO: 575031 - RNA, 19 nt, Homo sapiens
ggagggcagcuaggacaug

SEQ ID NO: 575032 - RNA, 19 nt, Homo sapiens
ugaaccuguccuuuacaua

SEQ ID NO: 575033 - RNA, 19 nt, Homo sapiens
gucagaggaugcuggacau

SEQ ID NO: 575034 - RNA, 19 nt, Homo sapiens
uagagauugcuuuguguau

SEQ ID NO: 575035 - RNA, 19 nt, Homo sapiens
ucguuucuaugaugccaaa

SEQ ID NO: 575036 - RNA, 19 nt, Homo sapiens
gaccaaaccuacaagauaa

SEQ ID NO: 575037 - RNA, 19 nt, Homo sapiens
gagaagcuauagccaaaua

SEQ ID NO: 575038 - RNA, 19 nt, Homo sapiens
gaaaggagauacugucuac

SEQ ID NO: 575039 - RNA, 19 nt, Homo sapiens
caaggcaucuucccuguuu

SEQ ID NO: 575040 - RNA, 19 nt, Homo sapiens
cuacagaccucuuuccaaa

SEQ ID NO: 575041 - RNA, 19 nt, Homo sapiens
cuaaggaguugucauuuaa

SEQ ID NO: 575042 - RNA, 19 nt, Homo sapiens
ucuaaggaguugucauuua

SEQ ID NO: 575043 - RNA, 19 nt, Homo sapiens
ggagauagaguuauucuuc

SEQ ID NO: 575044 - RNA, 19 nt, Homo sapiens
ggaucaagcaccacucuua

SEQ ID NO: 575045 - RNA, 19 nt, Homo sapiens
cagagaaagugaugucauu

SEQ ID NO: 575046 - RNA, 19 nt, Homo sapiens
cgaccaaaccuacaagaua

SEQ ID NO: 575047 - RNA, 19 nt, Homo sapiens
caucaauucuucagcauga

SEQ ID NO: 575048 - RNA, 19 nt, Homo sapiens
ucacucaacuccagcauug

SEQ ID NO: 575049 - RNA, 19 nt, Homo sapiens
aaagggagauagaguuauu

SEQ ID NO: 575050 - RNA, 19 nt, Homo sapiens
gcaccacucuuacaaaguc

SEQ ID NO: 575051 - RNA, 19 nt, Homo sapiens
ggaguugucauuuaagaaa

SEQ ID NO: 575052 - RNA, 19 nt, Homo sapiens
gguacaagacgauguuuaa

SEQ ID NO: 575053 - RNA, 19 nt, Homo sapiens
aaacugguaugaagguaaa

SEQ ID NO: 575054 - RNA, 19 nt, Homo sapiens
aaagugaugucauugaugu

SEQ ID NO: 575055 - RNA, 19 nt, Homo sapiens
cggagaagcuauagccaaa

SEQ ID NO: 575056 - RNA, 19 nt, Homo sapiens
ucaaugaggccuccuugua

SEQ ID NO: 575057 - RNA, 19 nt, Homo sapiens
gugaaaguguggauuccua

SEQ ID NO: 575058 - RNA, 19 nt, Homo sapiens
caucuucccuguuuccuau

SEQ ID NO: 575059 - RNA, 19 nt, Homo sapiens
gaucaaaacugguaugaag

SEQ ID NO: 575060 - RNA, 19 nt, Homo sapiens
gcaaagacccaaaccuaca

SEQ ID NO: 575061 - RNA, 19 nt, Homo sapiens
gacacagacauguauaaua

SEQ ID NO: 575062 - RNA, 19 nt, Homo sapiens
ggagaaaucggagaagcua

SEQ ID NO: 575063 - RNA, 19 nt, Homo sapiens
cagaugacauagauuuaga

SEQ ID NO: 575064 - RNA, 19 nt, Homo sapiens
gagaaagugaugucauuga

SEQ ID NO: 575065 - RNA, 19 nt, Homo sapiens
caacagacaaggcaucuuc

SEQ ID NO: 575066 - RNA, 19 nt, Homo sapiens
gucaagaggcugugaauug

SEQ ID NO: 575067 - RNA, 19 nt, Homo sapiens
agaaagggagauagaguua

SEQ ID NO: 575068 - RNA, 19 nt, Homo sapiens
gagaaagggagauagaguu

SEQ ID NO: 575069 - RNA, 19 nt, Homo sapiens
gaucauucuucugguguuu

SEQ ID NO: 575070 - RNA, 19 nt, Homo sapiens
gaacacagggcgugauucu

SEQ ID NO: 575071 - RNA, 19 nt, Homo sapiens
uaacuauacucccaggaau

SEQ ID NO: 575072 - RNA, 19 nt, Homo sapiens
gcccugguauaaauucuuu

SEQ ID NO: 575073 - RNA, 19 nt, Homo sapiens
aaugagcccugguauaaau

SEQ ID NO: 575074 - RNA, 19 nt, Homo sapiens
uaggaaaacugaagacuuu

SEQ ID NO: 575075 - RNA, 19 nt, Homo sapiens
gagauagaguuauucuucu

SEQ ID NO: 575076 - RNA, 19 nt, Homo sapiens
gaaaaugagcccugguaua

SEQ ID NO: 575077 - RNA, 19 nt, Homo sapiens
cauaaauccagaugacaua

SEQ ID NO: 575078 - RNA, 19 nt, Homo sapiens
acacuuggauuggacuuaa

SEQ ID NO: 575079 - RNA, 19 nt, Homo sapiens
ccacagcuauucuagugau

SEQ ID NO: 575080 - RNA, 19 nt, Homo sapiens
gaaagcacagccugcaaga

SEQ ID NO: 575081 - RNA, 19 nt, Homo sapiens
caaugaggccuccuuguau

SEQ ID NO: 575082 - RNA, 19 nt, Homo sapiens
gaucggucuucaacagaaa

SEQ ID NO: 575083 - RNA, 19 nt, Homo sapiens
acaagacgauguuuaagca

SEQ ID NO: 575084 - RNA, 19 nt, Homo sapiens
gauaaaagaucaccaacuc

SEQ ID NO: 575085 - RNA, 19 nt, Homo sapiens
ugacagagacacuuggauu

SEQ ID NO: 575086 - RNA, 19 nt, Homo sapiens
gaaagugaugucauugaug

SEQ ID NO: 575087 - RNA, 19 nt, Homo sapiens
caucuaaggaguugucauu

SEQ ID NO: 575088 - RNA, 19 nt, Homo sapiens
agaaaucggagaagcuaua

SEQ ID NO: 575089 - RNA, 19 nt, Homo sapiens
gaaagacccaugaguucug

SEQ ID NO: 575090 - RNA, 19 nt, Homo sapiens
aagaccaacugaucgcaua

SEQ ID NO: 575091 - RNA, 19 nt, Homo sapiens
ggacuauguucaagaucau

SEQ ID NO: 575092 - RNA, 19 nt, Homo sapiens
agaaagugaugucauugau

SEQ ID NO: 575093 - RNA, 19 nt, Homo sapiens
ucagacaucuaaggaguug

SEQ ID NO: 575094 - RNA, 19 nt, Homo sapiens
ggaaaacagugugcauauu

SEQ ID NO: 575095 - RNA, 19 nt, Homo sapiens
uuaaaccucuggaguucaa

SEQ ID NO: 575096 - RNA, 19 nt, Homo sapiens
gacgggcacuggacuggaa

SEQ ID NO: 575097 - RNA, 19 nt, Homo sapiens
cccaaggacugguacaaga

SEQ ID NO: 575098 - RNA, 19 nt, Homo sapiens
gagaaccaaugggcauguu

SEQ ID NO: 575099 - RNA, 19 nt, Homo sapiens
agcuuucccugcaauauua

SEQ ID NO: 575100 - RNA, 19 nt, Homo sapiens
uaucaguccucuauagaca

SEQ ID NO: 575101 - RNA, 19 nt, Homo sapiens
aaaaugagcccugguauaa

SEQ ID NO: 575102 - RNA, 19 nt, Homo sapiens
gaaccuggcaagucaucaa

SEQ ID NO: 575103 - RNA, 19 nt, Homo sapiens
ugucaugccuuacgguuuc

SEQ ID NO: 575104 - RNA, 19 nt, Homo sapiens
ugucauugaugucauggaa

SEQ ID NO: 575105 - RNA, 19 nt, Homo sapiens
aagacgauguuuaagcaaa

SEQ ID NO: 575106 - RNA, 19 nt, Homo sapiens
agauaacagugaauggaaa

SEQ ID NO: 575107 - RNA, 19 nt, Homo sapiens
gaaaacagugugcauauuc

SEQ ID NO: 575108 - RNA, 19 nt, Homo sapiens
gcauaaauccagaugacau

SEQ ID NO: 575109 - RNA, 19 nt, Homo sapiens
caacugaucgcauaaaucc

SEQ ID NO: 575110 - RNA, 19 nt, Homo sapiens
caugaaagaccaacugauc

SEQ ID NO: 575111 - RNA, 19 nt, Homo sapiens
ggcaagucaucaauucuuc

SEQ ID NO: 575112 - RNA, 19 nt, Homo sapiens
gaaccaaugggcauguuag

SEQ ID NO: 575113 - RNA, 19 nt, Homo sapiens
gaagcuauagccaaauaca

SEQ ID NO: 575114 - RNA, 19 nt, Homo sapiens
uuaaggcucagacaucuaa

SEQ ID NO: 575115 - RNA, 19 nt, Homo sapiens
gacagagacacuuggauug

SEQ ID NO: 575116 - RNA, 19 nt, Homo sapiens
guggagcugucacugagaa

SEQ ID NO: 575117 - RNA, 19 nt, Homo sapiens
gcaucuucccgaucucaua

SEQ ID NO: 575118 - RNA, 19 nt, Homo sapiens
gaagaggaacuccagaaaa

SEQ ID NO: 575119 - RNA, 19 nt, Homo sapiens
ggucugagccaaggaguau

SEQ ID NO: 575120 - RNA, 19 nt, Homo sapiens
gaugacacagacauguaua

SEQ ID NO: 575121 - RNA, 19 nt, Homo sapiens
acacagggcgugauucuca

SEQ ID NO: 575122 - RNA, 19 nt, Homo sapiens
gaaagggagauagaguuau

SEQ ID NO: 575123 - RNA, 19 nt, Homo sapiens
gaaaaguggacacaagaaa

SEQ ID NO: 575124 - RNA, 19 nt, Homo sapiens
cugcaaagacccaaaccua

SEQ ID NO: 575125 - RNA, 19 nt, Homo sapiens
gacgauguuuaagcaaauu

SEQ ID NO: 575126 - RNA, 19 nt, Homo sapiens
auaacaaacucuccaaggu

SEQ ID NO: 575127 - RNA, 19 nt, Homo sapiens
ucaagaggcugugaauugc

SEQ ID NO: 575128 - RNA, 19 nt, Homo sapiens
ggaaagacccaugaguucu

SEQ ID NO: 575129 - RNA, 19 nt, Homo sapiens
guacaacccacccuacagu

SEQ ID NO: 575130 - RNA, 19 nt, Homo sapiens
gcaagcuuucccugcaaua

SEQ ID NO: 575131 - RNA, 19 nt, Homo sapiens
gggaagagagaaccaaugg

SEQ ID NO: 575132 - RNA, 19 nt, Homo sapiens
uucaggcucuguauaacua

SEQ ID NO: 575133 - RNA, 19 nt, Homo sapiens
gauaggauucacagcuuga

SEQ ID NO: 575134 - RNA, 19 nt, Homo sapiens
caacuucaacgcagacaca

SEQ ID NO: 575135 - RNA, 19 nt, Homo sapiens
aaggaguugucauuuaaga

SEQ ID NO: 575136 - RNA, 19 nt, Homo sapiens
gaacggagaugcuacauau

SEQ ID NO: 575137 - RNA, 19 nt, Homo sapiens
gaccaaaccuacaagauaa

SEQ ID NO: 575138 - RNA, 19 nt, Homo sapiens
gagaagcuauagccaaaua

SEQ ID NO: 575139 - RNA, 19 nt, Homo sapiens
gaaaggagauacugucuac

SEQ ID NO: 575140 - RNA, 19 nt, Homo sapiens
caaggcaucuucccuguuu

SEQ ID NO: 575141 - RNA, 19 nt, Homo sapiens
cuacagaccucuuuccaaa

SEQ ID NO: 575142 - RNA, 19 nt, Homo sapiens
cuaaggaguugucauuuaa

SEQ ID NO: 575143 - RNA, 19 nt, Homo sapiens
gcaaggaccugaugaacuc

SEQ ID NO: 575144 - RNA, 19 nt, Homo sapiens
ucuaaggaguugucauuua

SEQ ID NO: 575145 - RNA, 19 nt, Homo sapiens
ggagauagaguuauucuuc

SEQ ID NO: 575146 - RNA, 19 nt, Homo sapiens
agacaucugugaccaaauu

SEQ ID NO: 575147 - RNA, 19 nt, Homo sapiens
ggaucaagcaccacucuua

SEQ ID NO: 575148 - RNA, 19 nt, Homo sapiens
cagagaaagugaugucauu

SEQ ID NO: 575149 - RNA, 19 nt, Homo sapiens
ccacguacaugccguaaau

SEQ ID NO: 575150 - RNA, 19 nt, Homo sapiens
cgaccaaaccuacaagaua

SEQ ID NO: 575151 - RNA, 19 nt, Homo sapiens
caucaauucuucagcauga

SEQ ID NO: 575152 - RNA, 19 nt, Homo sapiens
ucacucaacuccagcauug

SEQ ID NO: 575153 - RNA, 19 nt, Homo sapiens
aaagggagauagaguuauu

SEQ ID NO: 575154 - RNA, 19 nt, Homo sapiens
gcaccacucuuacaaaguc

SEQ ID NO: 575155 - RNA, 19 nt, Homo sapiens
gaaagagccagacacgaaa

SEQ ID NO: 575156 - RNA, 19 nt, Homo sapiens
cgaaagagccagacacgaa

SEQ ID NO: 575157 - RNA, 19 nt, Homo sapiens
ggaguugucauuuaagaaa

SEQ ID NO: 575158 - RNA, 19 nt, Homo sapiens
gcucuggacucugcccuua

SEQ ID NO: 575159 - RNA, 19 nt, Homo sapiens
gguacaagacgauguuuaa

SEQ ID NO: 575160 - RNA, 19 nt, Homo sapiens
gaaauggacccuggccuuu

SEQ ID NO: 575161 - RNA, 19 nt, Homo sapiens
guccaucccuuugcaguua

SEQ ID NO: 575162 - RNA, 19 nt, Homo sapiens
aaacugguaugaagguaaa

SEQ ID NO: 575163 - RNA, 19 nt, Homo sapiens
aaagugaugucauugaugu

SEQ ID NO: 575164 - RNA, 19 nt, Homo sapiens
cggagaagcuauagccaaa

SEQ ID NO: 575165 - RNA, 19 nt, Homo sapiens
cagaaugacugcggaagaa

SEQ ID NO: 575166 - RNA, 19 nt, Homo sapiens
caaagacacuuggauugga

SEQ ID NO: 575167 - RNA, 19 nt, Homo sapiens
gugaaaguguggauuccua

SEQ ID NO: 575168 - RNA, 19 nt, Homo sapiens
caucuucccuguuuccuau

SEQ ID NO: 575169 - RNA, 19 nt, Homo sapiens
ccacacgcaucuccgaauu

SEQ ID NO: 575170 - RNA, 19 nt, Homo sapiens
gcuuggagaucuuacaaug

SEQ ID NO: 575171 - RNA, 19 nt, Homo sapiens
gaucaaaacugguaugaag

SEQ ID NO: 575172 - RNA, 19 nt, Homo sapiens
aaauucggcuccuaagaaa

SEQ ID NO: 575173 - RNA, 19 nt, Homo sapiens
gcaaagacccaaaccuaca

SEQ ID NO: 575174 - RNA, 19 nt, Homo sapiens
gacacagacauguauaaua

SEQ ID NO: 575175 - RNA, 19 nt, Homo sapiens
ggagaaaucggagaagcua

SEQ ID NO: 575176 - RNA, 19 nt, Homo sapiens
aaagacaucugugaccaaa

SEQ ID NO: 575177 - RNA, 19 nt, Homo sapiens
gagaaagugaugucauuga

SEQ ID NO: 575178 - RNA, 19 nt, Homo sapiens
caacagacaaggcaucuuc

SEQ ID NO: 575179 - RNA, 19 nt, Homo sapiens
gucaagaggcugugaauug

SEQ ID NO: 575180 - RNA, 19 nt, Homo sapiens
agaaagggagauagaguua

SEQ ID NO: 575181 - RNA, 19 nt, Homo sapiens
gagaaagggagauagaguu

SEQ ID NO: 575182 - RNA, 19 nt, Homo sapiens
guaaagcaucuguguuuga

SEQ ID NO: 575183 - RNA, 19 nt, Homo sapiens
uaacuauacucccaggaau

SEQ ID NO: 575184 - RNA, 19 nt, Homo sapiens
cgaccacagugacuacauu

SEQ ID NO: 575185 - RNA, 19 nt, Homo sapiens
aagcaugggcucccuguua

SEQ ID NO: 575186 - RNA, 19 nt, Homo sapiens
gagauagaguuauucuucu

SEQ ID NO: 575187 - RNA, 19 nt, Homo sapiens
cacagcagccgacaagaua

SEQ ID NO: 575188 - RNA, 19 nt, Homo sapiens
acacuuggauuggacuuaa

SEQ ID NO: 575189 - RNA, 19 nt, Homo sapiens
gaaugugcccauccaaaga

SEQ ID NO: 575190 - RNA, 19 nt, Homo sapiens
ccacagcuauucuagugau

SEQ ID NO: 575191 - RNA, 19 nt, Homo sapiens
gaaagcacagccugcaaga

SEQ ID NO: 575192 - RNA, 19 nt, Homo sapiens
gcacagcagccgacaagau

SEQ ID NO: 575193 - RNA, 19 nt, Homo sapiens
gaucggucuucaacagaaa

SEQ ID NO: 575194 - RNA, 19 nt, Homo sapiens
acaagacgauguuuaagca

SEQ ID NO: 575195 - RNA, 19 nt, Homo sapiens
gauaaaagaucaccaacuc

SEQ ID NO: 575196 - RNA, 19 nt, Homo sapiens
gaaagugaugucauugaug

SEQ ID NO: 575197 - RNA, 19 nt, Homo sapiens
caucuaaggaguugucauu

SEQ ID NO: 575198 - RNA, 19 nt, Homo sapiens
caagagccauuaguuucaa

SEQ ID NO: 575199 - RNA, 19 nt, Homo sapiens
agaaaucggagaagcuaua

SEQ ID NO: 575200 - RNA, 19 nt, Homo sapiens
gaaagacccaugaguucug

SEQ ID NO: 575201 - RNA, 19 nt, Homo sapiens
ggaaugugcccauccaaag

SEQ ID NO: 575202 - RNA, 19 nt, Homo sapiens
cgauuuaccacaauguuaa

SEQ ID NO: 575203 - RNA, 19 nt, Homo sapiens
gugacgaucuccuaaacga

SEQ ID NO: 575204 - RNA, 19 nt, Homo sapiens
gaaaccgucucucccaaaa

SEQ ID NO: 575205 - RNA, 19 nt, Homo sapiens
agaaagugaugucauugau

SEQ ID NO: 575206 - RNA, 19 nt, Homo sapiens
uuaaaccucuggaguucaa

SEQ ID NO: 575207 - RNA, 19 nt, Homo sapiens
ucagacaucuaaggaguug

SEQ ID NO: 575208 - RNA, 19 nt, Homo sapiens
aagaacggcuggcaaaugg

SEQ ID NO: 575209 - RNA, 19 nt, Homo sapiens
cccaaggacugguacaaga

SEQ ID NO: 575210 - RNA, 19 nt, Homo sapiens
ccaaaccaccagcagagua

SEQ ID NO: 575211 - RNA, 19 nt, Homo sapiens
uaucaguccucuauagaca

SEQ ID NO: 575212 - RNA, 19 nt, Homo sapiens
gaaccuggcaagucaucaa

SEQ ID NO: 575213 - RNA, 19 nt, Homo sapiens
ugucaugccuuacgguuuc

SEQ ID NO: 575214 - RNA, 19 nt, Homo sapiens
ugucauugaugucauggaa

SEQ ID NO: 575215 - RNA, 19 nt, Homo sapiens
uaaagcaucuguguuugag

SEQ ID NO: 575216 - RNA, 19 nt, Homo sapiens
ggucauccuucugcaguga

SEQ ID NO: 575217 - RNA, 19 nt, Homo sapiens
ucgaaaagcugauccagaa

SEQ ID NO: 575218 - RNA, 19 nt, Homo sapiens
caagaacggcuggcaaaug

SEQ ID NO: 575219 - RNA, 19 nt, Homo sapiens
aggaauaccugcccaagca

SEQ ID NO: 575220 - RNA, 19 nt, Homo sapiens
aagacgauguuuaagcaaa

SEQ ID NO: 575221 - RNA, 19 nt, Homo sapiens
agauaacagugaauggaaa

SEQ ID NO: 575222 - RNA, 19 nt, Homo sapiens
gaaugacugcggaagaaug

SEQ ID NO: 575223 - RNA, 19 nt, Homo sapiens
ggcaagucaucaauucuuc

SEQ ID NO: 575224 - RNA, 19 nt, Homo sapiens
gaagcuauagccaaauaca

SEQ ID NO: 575225 - RNA, 19 nt, Homo sapiens
uuaaggcucagacaucuaa

SEQ ID NO: 575226 - RNA, 19 nt, Homo sapiens
caccaagagccauuaguuu

SEQ ID NO: 575227 - RNA, 19 nt, Homo sapiens
ggacucaccaagagccauu

SEQ ID NO: 575228 - RNA, 19 nt, Homo sapiens
guggagcugucacugagaa

SEQ ID NO: 575229 - RNA, 19 nt, Homo sapiens
gcaucuucccgaucucaua

SEQ ID NO: 575230 - RNA, 19 nt, Homo sapiens
gaagaggaacuccagaaaa

SEQ ID NO: 575231 - RNA, 19 nt, Homo sapiens
ucuggacucugcccuuaaa

SEQ ID NO: 575232 - RNA, 19 nt, Homo sapiens
ccuaagaaacagacugaaa

SEQ ID NO: 575233 - RNA, 19 nt, Homo sapiens
gagcugugacgaucuccua

SEQ ID NO: 575234 - RNA, 19 nt, Homo sapiens
ccaagagccauuaguuuca

SEQ ID NO: 575235 - RNA, 19 nt, Homo sapiens
ucaccaagagccauuaguu

SEQ ID NO: 575236 - RNA, 19 nt, Homo sapiens
acaaagaagucuccuauaa

SEQ ID NO: 575237 - RNA, 19 nt, Homo sapiens
ggaagagggugacuacauu

SEQ ID NO: 575238 - RNA, 19 nt, Homo sapiens
gagagugacuacauguuua

SEQ ID NO: 575239 - RNA, 19 nt, Homo sapiens
ccacaaagccguucucaaa

SEQ ID NO: 575240 - RNA, 19 nt, Homo sapiens
ugaaacaggucgaaucuau

SEQ ID NO: 575241 - RNA, 19 nt, Homo sapiens
gaaaaucucugaagaaaag

SEQ ID NO: 575242 - RNA, 19 nt, Homo sapiens
caaagaagaucaggaagga

SEQ ID NO: 575243 - RNA, 19 nt, Homo sapiens
caaaagaggucgguaauuu

SEQ ID NO: 575244 - RNA, 19 nt, Homo sapiens
gcuacagucuacaguguua

SEQ ID NO: 575245 - RNA, 19 nt, Homo sapiens
caacauggacuucacuaaa

SEQ ID NO: 575246 - RNA, 19 nt, Homo sapiens
caaagaagccaaagaagug

SEQ ID NO: 575247 - RNA, 19 nt, Homo sapiens
gagagaagacgcccacaaa

SEQ ID NO: 575248 - RNA, 19 nt, Homo sapiens
uaagagaccuaaccgacuu

SEQ ID NO: 575249 - RNA, 19 nt, Homo sapiens
gaaaggauccgauggugau

SEQ ID NO: 575250 - RNA, 19 nt, Homo sapiens
gagcucgccugucuucuga

SEQ ID NO: 575251 - RNA, 19 nt, Homo sapiens
caaagccguucucaaaguu

SEQ ID NO: 575252 - RNA, 19 nt, Homo sapiens
caaacgaccucucagaucu

SEQ ID NO: 575253 - RNA, 19 nt, Homo sapiens
gcaaagaagccaaagaagu

SEQ ID NO: 575254 - RNA, 19 nt, Homo sapiens
ggagcaguauuucuucuug

SEQ ID NO: 575255 - RNA, 19 nt, Homo sapiens
uaaagaggaugacucaaag

SEQ ID NO: 575256 - RNA, 19 nt, Homo sapiens
aaagauguguggcagguaa

SEQ ID NO: 575257 - RNA, 19 nt, Homo sapiens
ucaagaggguacaugauga

SEQ ID NO: 575258 - RNA, 19 nt, Homo sapiens
caacccaucugcaaaccuu

SEQ ID NO: 575259 - RNA, 19 nt, Homo sapiens
aaagaagucuccuauaacu

SEQ ID NO: 575260 - RNA, 19 nt, Homo sapiens
cuuguaagcuccagugauu

SEQ ID NO: 575261 - RNA, 19 nt, Homo sapiens
caauggagcucgccugucu

SEQ ID NO: 575262 - RNA, 19 nt, Homo sapiens
gagccacccuucuauaaag

SEQ ID NO: 575263 - RNA, 19 nt, Homo sapiens
caaaggacaaugacaguga

SEQ ID NO: 575264 - RNA, 19 nt, Homo sapiens
ggaagauucagacuuuauu

SEQ ID NO: 575265 - RNA, 19 nt, Homo sapiens
ggaaaccagugcucuagag

SEQ ID NO: 575266 - RNA, 19 nt, Homo sapiens
ccaaagaugcagcuucaaa

SEQ ID NO: 575267 - RNA, 19 nt, Homo sapiens
gugaguaugugccaauguu

SEQ ID NO: 575268 - RNA, 19 nt, Homo sapiens
caaaagcaccugauacuaa

SEQ ID NO: 575269 - RNA, 19 nt, Homo sapiens
guaggcagguccacuguca

SEQ ID NO: 575270 - RNA, 19 nt, Homo sapiens
ucugagugcuguauggaua

SEQ ID NO: 575271 - RNA, 19 nt, Homo sapiens
gggcaaagaagaucaggaa

SEQ ID NO: 575272 - RNA, 19 nt, Homo sapiens
gagccgcugucucugcuuu

SEQ ID NO: 575273 - RNA, 19 nt, Homo sapiens
aauguuaccuggaaaguuc

SEQ ID NO: 575274 - RNA, 19 nt, Homo sapiens
gcaaacgaccucucagauc

SEQ ID NO: 575275 - RNA, 19 nt, Homo sapiens
gaccuaaccgacuuucuuu

SEQ ID NO: 575276 - RNA, 19 nt, Homo sapiens
cguccucgcucaccuuaaa

SEQ ID NO: 575277 - RNA, 19 nt, Homo sapiens
gcaaauuaacucaaagcaa

SEQ ID NO: 575278 - RNA, 19 nt, Homo sapiens
ggcaaaggcucaggaagug

SEQ ID NO: 575279 - RNA, 19 nt, Homo sapiens
ggagccacccuucuauaaa

SEQ ID NO: 575280 - RNA, 19 nt, Homo sapiens
acaaagccguucucaaagu

SEQ ID NO: 575281 - RNA, 19 nt, Homo sapiens
gaggaggucguguuuguga

SEQ ID NO: 575282 - RNA, 19 nt, Homo sapiens
gaagagggugacuacauug

SEQ ID NO: 575283 - RNA, 19 nt, Homo sapiens
ggaggaaaccagugcucua

SEQ ID NO: 575284 - RNA, 19 nt, Homo sapiens
aagcggaggugacuacaug

SEQ ID NO: 575285 - RNA, 19 nt, Homo sapiens
cuucaaagccuucagauca

SEQ ID NO: 575286 - RNA, 19 nt, Homo sapiens
gacaaagaagucuccuaua

SEQ ID NO: 575287 - RNA, 19 nt, Homo sapiens
gaagaugagagccuugugu

SEQ ID NO: 575288 - RNA, 19 nt, Homo sapiens
gcgcuacagucuacagugu

SEQ ID NO: 575289 - RNA, 19 nt, Homo sapiens
ggaagaagagcaggagaga

SEQ ID NO: 575290 - RNA, 19 nt, Homo sapiens
auaaagaggaugacucaaa

SEQ ID NO: 575291 - RNA, 19 nt, Homo sapiens
uaauaaagaggaugacuca

SEQ ID NO: 575292 - RNA, 19 nt, Homo sapiens
gaaacaggucgaaucuaug

SEQ ID NO: 575293 - RNA, 19 nt, Homo sapiens
ugagagugacuacauguuu

SEQ ID NO: 575294 - RNA, 19 nt, Homo sapiens
ugacagaggagccacgaaa

SEQ ID NO: 575295 - RNA, 19 nt, Homo sapiens
caagcgacaagaagacuaa

SEQ ID NO: 575296 - RNA, 19 nt, Homo sapiens
gggcaaaggcucaggaagu

SEQ ID NO: 575297 - RNA, 19 nt, Homo sapiens
gugacuacaugccuaugaa

SEQ ID NO: 575298 - RNA, 19 nt, Homo sapiens
gcucagaaggucccgcuuu

SEQ ID NO: 575299 - RNA, 19 nt, Homo sapiens
gagggugacuacauugaag

SEQ ID NO: 575300 - RNA, 19 nt, Homo sapiens
gacagaaugacaacaguga

SEQ ID NO: 575301 - RNA, 19 nt, Homo sapiens
gcaucaccauggcgaguug

SEQ ID NO: 575302 - RNA, 19 nt, Homo sapiens
gcaggaaagcugguacuug

SEQ ID NO: 575303 - RNA, 19 nt, Homo sapiens
gaacgagucggagcaggaa

SEQ ID NO: 575304 - RNA, 19 nt, Homo sapiens
caaagaagucuccuauaac

SEQ ID NO: 575305 - RNA, 19 nt, Homo sapiens
gugccaauguuaccuggaa

SEQ ID NO: 575306 - RNA, 19 nt, Homo sapiens
caccugauacuaauaaaga

SEQ ID NO: 575307 - RNA, 19 nt, Homo sapiens
gaaaccagugcucuagaga

SEQ ID NO: 575308 - RNA, 19 nt, Homo sapiens
cagacagccucgagagaga

SEQ ID NO: 575309 - RNA, 19 nt, Homo sapiens
aaacaggucgaaucuaugu

SEQ ID NO: 575310 - RNA, 19 nt, Homo sapiens
cuacuucucucuaccaaac

SEQ ID NO: 575311 - RNA, 19 nt, Homo sapiens
cuacaugccuaugaacaau

SEQ ID NO: 575312 - RNA, 19 nt, Homo sapiens
ggagagaagacgcccacaa

SEQ ID NO: 575313 - RNA, 19 nt, Homo sapiens
gaaugacaacagugaguau

SEQ ID NO: 575314 - RNA, 19 nt, Homo sapiens
ggguggcucuuccuccaaa

SEQ ID NO: 575315 - RNA, 19 nt, Homo sapiens
gggaagauucagacuuuau

SEQ ID NO: 575316 - RNA, 19 nt, Homo sapiens
gacacucggagcaguauuu

SEQ ID NO: 575317 - RNA, 19 nt, Homo sapiens
gugacuacauugaaguaau

SEQ ID NO: 575318 - RNA, 19 nt, Homo sapiens
agugaaagaugcagagauc

SEQ ID NO: 575319 - RNA, 19 nt, Homo sapiens
cacgaaagaaugcaaagaa

SEQ ID NO: 575320 - RNA, 19 nt, Homo sapiens
ugacaacagugaguaugug

SEQ ID NO: 575321 - RNA, 19 nt, Homo sapiens
gaggagccacgaaagaaug

SEQ ID NO: 575322 - RNA, 19 nt, Homo sapiens
caaagcaagcaacagcaaa

SEQ ID NO: 575323 - RNA, 19 nt, Homo sapiens
aaccagugcucuagagaug

SEQ ID NO: 575324 - RNA, 19 nt, Homo sapiens
caaaaugucucugcuucaa

SEQ ID NO: 575325 - RNA, 19 nt, Homo sapiens
aagaugaggaugacccaua

SEQ ID NO: 575326 - RNA, 19 nt, Homo sapiens
ccacagagccagagcuuuu

SEQ ID NO: 575327 - RNA, 19 nt, Homo sapiens
gcggagccacccuucuaua

SEQ ID NO: 575328 - RNA, 19 nt, Homo sapiens
aaagaggucgguaauuuua

SEQ ID NO: 575329 - RNA, 19 nt, Homo sapiens
gagaagacgcccacaaagc

SEQ ID NO: 575330 - RNA, 19 nt, Homo sapiens
gaagaagagcaggagagaa

SEQ ID NO: 575331 - RNA, 19 nt, Homo sapiens
gaaccaccaccuguagcua

SEQ ID NO: 575332 - RNA, 19 nt, Homo sapiens
ucaaagccuucagaucaug

SEQ ID NO: 575333 - RNA, 19 nt, Homo sapiens
caaagaugcagcuucaaag

SEQ ID NO: 575334 - RNA, 19 nt, Homo sapiens
uuucggagcucaccuuugg

SEQ ID NO: 575335 - RNA, 19 nt, Homo sapiens
acaaugacagugagaguga

SEQ ID NO: 575336 - RNA, 19 nt, Homo sapiens
gcagaugggugauauauaa

SEQ ID NO: 575337 - RNA, 19 nt, Homo sapiens
gcacaauccugauaaauuu

SEQ ID NO: 575338 - RNA, 19 nt, Homo sapiens
gcacuucacugcagcuuua

SEQ ID NO: 575339 - RNA, 19 nt, Homo sapiens
gcaguucgcuuguaucgua

SEQ ID NO: 575340 - RNA, 19 nt, Homo sapiens
caacaaaccugaccacaug

SEQ ID NO: 575341 - RNA, 19 nt, Homo sapiens
uaacacagcucuuaauaug

SEQ ID NO: 575342 - RNA, 19 nt, Homo sapiens
gcacggcucugaaacuuaa

SEQ ID NO: 575343 - RNA, 19 nt, Homo sapiens
cuacucagaucaacaauaa

SEQ ID NO: 575344 - RNA, 19 nt, Homo sapiens
uaacauaccucgaguccaa

SEQ ID NO: 575345 - RNA, 19 nt, Homo sapiens
gauaagcuccuauuaauug

SEQ ID NO: 575346 - RNA, 19 nt, Homo sapiens
ggagacaccuaguuugaaa

SEQ ID NO: 575347 - RNA, 19 nt, Homo sapiens
gcugaugccuacucuaaua

SEQ ID NO: 575348 - RNA, 19 nt, Homo sapiens
gaaauaugguaacggguuu

SEQ ID NO: 575349 - RNA, 19 nt, Homo sapiens
ggaacuagauaacauacuu

SEQ ID NO: 575350 - RNA, 19 nt, Homo sapiens
ugaauaaccuagccaauau

SEQ ID NO: 575351 - RNA, 19 nt, Homo sapiens
uaagagaacuccagcauag

SEQ ID NO: 575352 - RNA, 19 nt, Homo sapiens
caaacuuucuggaugcuua

SEQ ID NO: 575353 - RNA, 19 nt, Homo sapiens
uaaaggagaugcaggaugu

SEQ ID NO: 575354 - RNA, 19 nt, Homo sapiens
gcugggaacugaucuagaa

SEQ ID NO: 575355 - RNA, 19 nt, Homo sapiens
gaacccuguuacacuauua

SEQ ID NO: 575356 - RNA, 19 nt, Homo sapiens
aggaagcucugaugcauua

SEQ ID NO: 575357 - RNA, 19 nt, Homo sapiens
gaacugaucuagaauaccu

SEQ ID NO: 575358 - RNA, 19 nt, Homo sapiens
caaccuggcuuguguauac

SEQ ID NO: 575359 - RNA, 19 nt, Homo sapiens
gcaauggacuggcaacuac

SEQ ID NO: 575360 - RNA, 19 nt, Homo sapiens
gcauagagccuuauagcaa

SEQ ID NO: 575361 - RNA, 19 nt, Homo sapiens
uauuguggcugaccaguua

SEQ ID NO: 575362 - RNA, 19 nt, Homo sapiens
ugaagaaguuggucaguau

SEQ ID NO: 575363 - RNA, 19 nt, Homo sapiens
gaacugaacauggugguuu

SEQ ID NO: 575364 - RNA, 19 nt, Homo sapiens
aauuugagguguucuguua

SEQ ID NO: 575365 - RNA, 19 nt, Homo sapiens
ggaguaaucuuggcugugu

SEQ ID NO: 575366 - RNA, 19 nt, Homo sapiens
ggacagcuaacaugaauug

SEQ ID NO: 575367 - RNA, 19 nt, Homo sapiens
gaaacacucuaaaggagau

SEQ ID NO: 575368 - RNA, 19 nt, Homo sapiens
ugauagaucuggcaauaga

SEQ ID NO: 575369 - RNA, 19 nt, Homo sapiens
ggaaucauccuacuucuca

SEQ ID NO: 575370 - RNA, 19 nt, Homo sapiens
ccacaauucugucaaagau

SEQ ID NO: 575371 - RNA, 19 nt, Homo sapiens
ucagugcuuuguugauuua

SEQ ID NO: 575372 - RNA, 19 nt, Homo sapiens
gcaucgaccucaaagcauu

SEQ ID NO: 575373 - RNA, 19 nt, Homo sapiens
uaaccuagccaauaucaaa

SEQ ID NO: 575374 - RNA, 19 nt, Homo sapiens
gcccguaguuguuuggaua

SEQ ID NO: 575375 - RNA, 19 nt, Homo sapiens
gaugaugacucaagauuuu

SEQ ID NO: 575376 - RNA, 19 nt, Homo sapiens
gagauaagguuuuaagcua

SEQ ID NO: 575377 - RNA, 19 nt, Homo sapiens
gauucagucuucuggauuu

SEQ ID NO: 575378 - RNA, 19 nt, Homo sapiens
ggcaaagucuggaagcaaa

SEQ ID NO: 575379 - RNA, 19 nt, Homo sapiens
ccugauagaucuggcaaua

SEQ ID NO: 575380 - RNA, 19 nt, Homo sapiens
ugagugaaaugcaauguau

SEQ ID NO: 575381 - RNA, 19 nt, Homo sapiens
guugcugacuucuuuauuu

SEQ ID NO: 575382 - RNA, 19 nt, Homo sapiens
caaggaaucuccguagaau

SEQ ID NO: 575383 - RNA, 19 nt, Homo sapiens
gaagggcaguguugcugaa

SEQ ID NO: 575384 - RNA, 19 nt, Homo sapiens
ccaguuaagucccagugua

SEQ ID NO: 575385 - RNA, 19 nt, Homo sapiens
gaacacacuuccggaaaca

SEQ ID NO: 575386 - RNA, 19 nt, Homo sapiens
cugcauguuucccauauua

SEQ ID NO: 575387 - RNA, 19 nt, Homo sapiens
ggucagagaaggaauaaug

SEQ ID NO: 575388 - RNA, 19 nt, Homo sapiens
ccuaguagauggaagcaaa

SEQ ID NO: 575389 - RNA, 19 nt, Homo sapiens
ggacagauucaaauaacaa

SEQ ID NO: 575390 - RNA, 19 nt, Homo sapiens
gcacaaacuuccgagugaa

SEQ ID NO: 575391 - RNA, 19 nt, Homo sapiens
gagcaaggccugauagauc

SEQ ID NO: 575392 - RNA, 19 nt, Homo sapiens
gagaaggaauaaugauauc

SEQ ID NO: 575393 - RNA, 19 nt, Homo sapiens
agacugcacaggagaauua

SEQ ID NO: 575394 - RNA, 19 nt, Homo sapiens
caucguauacuguaacuuu

SEQ ID NO: 575395 - RNA, 19 nt, Homo sapiens
cagaagcaguuauugaaau

SEQ ID NO: 575396 - RNA, 19 nt, Homo sapiens
ggcacaaacuuccgaguga

SEQ ID NO: 575397 - RNA, 19 nt, Homo sapiens
gcggacagcuaacaugaau

SEQ ID NO: 575398 - RNA, 19 nt, Homo sapiens
gcaggaagcucugaugcau

SEQ ID NO: 575399 - RNA, 19 nt, Homo sapiens
ccuaaggcauguuauuuga

SEQ ID NO: 575400 - RNA, 19 nt, Homo sapiens
acaagcaaguuauguaaga

SEQ ID NO: 575401 - RNA, 19 nt, Homo sapiens
aaagucacaugaugagaaa

SEQ ID NO: 575402 - RNA, 19 nt, Homo sapiens
guaauagacauccaaagaa

SEQ ID NO: 575403 - RNA, 19 nt, Homo sapiens
ugauuuagaugaugacuca

SEQ ID NO: 575404 - RNA, 19 nt, Homo sapiens
gauuaagccuguugaaguc

SEQ ID NO: 575405 - RNA, 19 nt, Homo sapiens
gaucuagaauaccugaaga

SEQ ID NO: 575406 - RNA, 19 nt, Homo sapiens
gucuugagcuuauugcuaa

SEQ ID NO: 575407 - RNA, 19 nt, Homo sapiens
gaggacagauucaaauaac

SEQ ID NO: 575408 - RNA, 19 nt, Homo sapiens
cauccuacuucucaccuua

SEQ ID NO: 575409 - RNA, 19 nt, Homo sapiens
ggcaaccugugcuuagaua

SEQ ID NO: 575410 - RNA, 19 nt, Homo sapiens
caaccgaacuuugcaguag

SEQ ID NO: 575411 - RNA, 19 nt, Homo sapiens
gaccuaauauuuggagcua

SEQ ID NO: 575412 - RNA, 19 nt, Homo sapiens
gagccuauaucagucguuu

SEQ ID NO: 575413 - RNA, 19 nt, Homo sapiens
aaauugacccuucuacuuu

SEQ ID NO: 575414 - RNA, 19 nt, Homo sapiens
gcagaagcaguuauugaaa

SEQ ID NO: 575415 - RNA, 19 nt, Homo sapiens
ggaauucauauccuuguaa

SEQ ID NO: 575416 - RNA, 19 nt, Homo sapiens
gaauauuccagaagccaua

SEQ ID NO: 575417 - RNA, 19 nt, Homo sapiens
gaaagaagaguuccauggu

SEQ ID NO: 575418 - RNA, 19 nt, Homo sapiens
gugcaauccugucauguga

SEQ ID NO: 575419 - RNA, 19 nt, Homo sapiens
uuagguugcugacuucuuu

SEQ ID NO: 575420 - RNA, 19 nt, Homo sapiens
gcucuuaauaugccuguua

SEQ ID NO: 575421 - RNA, 19 nt, Homo sapiens
gcugauaaaucuaauuggu

SEQ ID NO: 575422 - RNA, 19 nt, Homo sapiens
gaugaaguguccugaugga

SEQ ID NO: 575423 - RNA, 19 nt, Homo sapiens
uaaggaggcuauucgaauc

SEQ ID NO: 575424 - RNA, 19 nt, Homo sapiens
gaagcucugaugcauuaua

SEQ ID NO: 575425 - RNA, 19 nt, Homo sapiens
ggaauaaugauaucaccuu

SEQ ID NO: 575426 - RNA, 19 nt, Homo sapiens
gugguacugucauugauaa

SEQ ID NO: 575427 - RNA, 19 nt, Homo sapiens
gugauuccauggauugauu

SEQ ID NO: 575428 - RNA, 19 nt, Homo sapiens
gcaguaacacagcucuuaa

SEQ ID NO: 575429 - RNA, 19 nt, Homo sapiens
ccgagaaauuggcuuauau

SEQ ID NO: 575430 - RNA, 19 nt, Homo sapiens
gcucauugccugcagauug

SEQ ID NO: 575431 - RNA, 19 nt, Homo sapiens
aaaccugaccacaugauua

SEQ ID NO: 575432 - RNA, 19 nt, Homo sapiens
caacuacucagaucaacaa

SEQ ID NO: 575433 - RNA, 19 nt, Homo sapiens
caaagcauuucuugauagu

SEQ ID NO: 575434 - RNA, 19 nt, Homo sapiens
gcaguagcuuggaguaauc

SEQ ID NO: 575435 - RNA, 19 nt, Homo sapiens
cagagaaggaauaaugaua

SEQ ID NO: 575436 - RNA, 19 nt, Homo sapiens
gaaaugagaugcagaauca

SEQ ID NO: 575437 - RNA, 19 nt, Homo sapiens
gaagaaggguuauuuguug

SEQ ID NO: 575438 - RNA, 19 nt, Homo sapiens
ggaaacaaaugguuagaaa

SEQ ID NO: 575439 - RNA, 19 nt, Homo sapiens
caccagagcuuuaacauuu

SEQ ID NO: 575440 - RNA, 19 nt, Homo sapiens
gaauacagauccugaaaga

SEQ ID NO: 575441 - RNA, 19 nt, Homo sapiens
gaagauagauugccugaag

SEQ ID NO: 575442 - RNA, 19 nt, Homo sapiens
uaaauaagcuggaaguuca

SEQ ID NO: 575443 - RNA, 19 nt, Homo sapiens
gauuauaucucuccugaaa

SEQ ID NO: 575444 - RNA, 19 nt, Homo sapiens
ggacagggauucaggaguu

SEQ ID NO: 575445 - RNA, 19 nt, Homo sapiens
gaaaucagaguucccuuua

SEQ ID NO: 575446 - RNA, 19 nt, Homo sapiens
aagaauaucugcuguguuu

SEQ ID NO: 575447 - RNA, 19 nt, Homo sapiens
caacagauaugcccuggaa

SEQ ID NO: 575448 - RNA, 19 nt, Homo sapiens
caacagccuuaaccaaaua

SEQ ID NO: 575449 - RNA, 19 nt, Homo sapiens
gaccauacacuaucauuua

SEQ ID NO: 575450 - RNA, 19 nt, Homo sapiens
gcgcaagacucaccaguuu

SEQ ID NO: 575451 - RNA, 19 nt, Homo sapiens
ugaaagaucugcccaugaa

SEQ ID NO: 575452 - RNA, 19 nt, Homo sapiens
gaucggagcuguuuaagag

SEQ ID NO: 575453 - RNA, 19 nt, Homo sapiens
caacagauacaucgaauuu

SEQ ID NO: 575454 - RNA, 19 nt, Homo sapiens
caugagggaugaagaauuu

SEQ ID NO: 575455 - RNA, 19 nt, Homo sapiens
ggaauugauugggauaaua

SEQ ID NO: 575456 - RNA, 19 nt, Homo sapiens
gcacaugaguagagaaaga

SEQ ID NO: 575457 - RNA, 19 nt, Homo sapiens
agaaagaacugcaugauuc

SEQ ID NO: 575458 - RNA, 19 nt, Homo sapiens
gaaauucaagucccauaua

SEQ ID NO: 575459 - RNA, 19 nt, Homo sapiens
gauaauagucggaaacaaa

SEQ ID NO: 575460 - RNA, 19 nt, Homo sapiens
aaaggcagguccucuguua

SEQ ID NO: 575461 - RNA, 19 nt, Homo sapiens
gaagagaaagucaaaguga

SEQ ID NO: 575462 - RNA, 19 nt, Homo sapiens
gaugguggguuuaauaaga

SEQ ID NO: 575463 - RNA, 19 nt, Homo sapiens
uaaccaaacuaaagacuga

SEQ ID NO: 575464 - RNA, 19 nt, Homo sapiens
guaacagcuuugacauuua

SEQ ID NO: 575465 - RNA, 19 nt, Homo sapiens
guuaguagcccaacagaua

SEQ ID NO: 575466 - RNA, 19 nt, Homo sapiens
gaacaucgacuuggucaaa

SEQ ID NO: 575467 - RNA, 19 nt, Homo sapiens
aaacaugucuggagaagug

SEQ ID NO: 575468 - RNA, 19 nt, Homo sapiens
gcaaagccuuaaagaaaga

SEQ ID NO: 575469 - RNA, 19 nt, Homo sapiens
cagcuuagauuaacguuga

SEQ ID NO: 575470 - RNA, 19 nt, Homo sapiens
gcaaauccuuccucuuguu

SEQ ID NO: 575471 - RNA, 19 nt, Homo sapiens
ggguauagauccucagaaa

SEQ ID NO: 575472 - RNA, 19 nt, Homo sapiens
caugacaguuguuugaaua

SEQ ID NO: 575473 - RNA, 19 nt, Homo sapiens
gaacuuaaguauacacaac

SEQ ID NO: 575474 - RNA, 19 nt, Homo sapiens
ugaagaaagggauguauua

SEQ ID NO: 575475 - RNA, 19 nt, Homo sapiens
gaaugaaggagaagaguuu

SEQ ID NO: 575476 - RNA, 19 nt, Homo sapiens
gaaggaaauccauacagua

SEQ ID NO: 575477 - RNA, 19 nt, Homo sapiens
gagaagaucuaaauaagcu

SEQ ID NO: 575478 - RNA, 19 nt, Homo sapiens
gacaauauacugauggaua

SEQ ID NO: 575479 - RNA, 19 nt, Homo sapiens
caagaagaguugaauaaag

SEQ ID NO: 575480 - RNA, 19 nt, Homo sapiens
caagagauaaccaaacuaa

SEQ ID NO: 575481 - RNA, 19 nt, Homo sapiens
aaagagagguuucaguuuc

SEQ ID NO: 575482 - RNA, 19 nt, Homo sapiens
gcacuaugcuuuccaggau

SEQ ID NO: 575483 - RNA, 19 nt, Homo sapiens
gauaaaguguuugccauga

SEQ ID NO: 575484 - RNA, 19 nt, Homo sapiens
caaaugcgauuacauagag

SEQ ID NO: 575485 - RNA, 19 nt, Homo sapiens
gcuacgagauccagaaaug

SEQ ID NO: 575486 - RNA, 19 nt, Homo sapiens
gaaagugaguucaaacaac

SEQ ID NO: 575487 - RNA, 19 nt, Homo sapiens
cagcagaaaucgaagcaaa

SEQ ID NO: 575488 - RNA, 19 nt, Homo sapiens
guauaugggugaaauugaa

SEQ ID NO: 575489 - RNA, 19 nt, Homo sapiens
uguaacagcuuugacauuu

SEQ ID NO: 575490 - RNA, 19 nt, Homo sapiens
agaaucauuucaccaguua

SEQ ID NO: 575491 - RNA, 19 nt, Homo sapiens
gaugugaacuccauggaau

SEQ ID NO: 575492 - RNA, 19 nt, Homo sapiens
gaacuacucucagaaaucg

SEQ ID NO: 575493 - RNA, 19 nt, Homo sapiens
guugauaucuuugauguga

SEQ ID NO: 575494 - RNA, 19 nt, Homo sapiens
gcagagagcacuggcuaua

SEQ ID NO: 575495 - RNA, 19 nt, Homo sapiens
gagaaggaauacaugcaaa

SEQ ID NO: 575496 - RNA, 19 nt, Homo sapiens
agaaagggauguauuagug

SEQ ID NO: 575497 - RNA, 19 nt, Homo sapiens
guggagacauuacuggaua

SEQ ID NO: 575498 - RNA, 19 nt, Homo sapiens
agacaggauucucucuuua

SEQ ID NO: 575499 - RNA, 19 nt, Homo sapiens
aaucagaguucccuuuauu

SEQ ID NO: 575500 - RNA, 19 nt, Homo sapiens
aaagguagcuuaaauagac

SEQ ID NO: 575501 - RNA, 19 nt, Homo sapiens
gaauugauguggccagcaa

SEQ ID NO: 575502 - RNA, 19 nt, Homo sapiens
gaaacuaaagggugucaaa

SEQ ID NO: 575503 - RNA, 19 nt, Homo sapiens
ccauauaacuuguguaaac

SEQ ID NO: 575504 - RNA, 19 nt, Homo sapiens
gggaggaauuugaaaguga

SEQ ID NO: 575505 - RNA, 19 nt, Homo sapiens
uuagacaaaucaaggcuua

SEQ ID NO: 575506 - RNA, 19 nt, Homo sapiens
guaacagaaucaagucauu

SEQ ID NO: 575507 - RNA, 19 nt, Homo sapiens
cggauucguuucaggauua

SEQ ID NO: 575508 - RNA, 19 nt, Homo sapiens
caguugagaucuccaguaa

SEQ ID NO: 575509 - RNA, 19 nt, Homo sapiens
gaacaucagcaagagauaa

SEQ ID NO: 575510 - RNA, 19 nt, Homo sapiens
gauauggaccugaauguga

SEQ ID NO: 575511 - RNA, 19 nt, Homo sapiens
gcaauugacucaguucauc

SEQ ID NO: 575512 - RNA, 19 nt, Homo sapiens
cagcaaauuugaagauaga

SEQ ID NO: 575513 - RNA, 19 nt, Homo sapiens
uaaaguguuugccaugaaa

SEQ ID NO: 575514 - RNA, 19 nt, Homo sapiens
gcaaaucggacuuuauuca

SEQ ID NO: 575515 - RNA, 19 nt, Homo sapiens
gcagggagcugaggcuguu

SEQ ID NO: 575516 - RNA, 19 nt, Homo sapiens
aaaggagccucuuguauuc

SEQ ID NO: 575517 - RNA, 19 nt, Homo sapiens
cagcaaauccuuccucuug

SEQ ID NO: 575518 - RNA, 19 nt, Homo sapiens
gcauugggauauacacuga

SEQ ID NO: 575519 - RNA, 19 nt, Homo sapiens
caacuggcuuuccaccuaa

SEQ ID NO: 575520 - RNA, 19 nt, Homo sapiens
ucaacuggcuuuccaccua

SEQ ID NO: 575521 - RNA, 19 nt, Homo sapiens
ucgaacagcugauaaagga

SEQ ID NO: 575522 - RNA, 19 nt, Homo sapiens
guugagaucuccaguaaag

SEQ ID NO: 575523 - RNA, 19 nt, Homo sapiens
ggaggaaaaugaagaguuu

SEQ ID NO: 575524 - RNA, 19 nt, Homo sapiens
cugaagagcuuagaucuga

SEQ ID NO: 575525 - RNA, 19 nt, Homo sapiens
gaacuuggaacuacucuca

SEQ ID NO: 575526 - RNA, 19 nt, Homo sapiens
gaagaagaacuuggaacua

SEQ ID NO: 575527 - RNA, 19 nt, Homo sapiens
ggauggcaaucuucaguga

SEQ ID NO: 575528 - RNA, 19 nt, Homo sapiens
gaaagaaucaguugcacau

SEQ ID NO: 575529 - RNA, 19 nt, Homo sapiens
gaagcuacgugaacagagu

SEQ ID NO: 575530 - RNA, 19 nt, Homo sapiens
acaguagagucucauuaua

SEQ ID NO: 575531 - RNA, 19 nt, Homo sapiens
gggaaacgaagaaggguua

SEQ ID NO: 575532 - RNA, 19 nt, Homo sapiens
ccaggcagccgcaaucaua

SEQ ID NO: 575533 - RNA, 19 nt, Homo sapiens
gaauaggaacagcauauga

SEQ ID NO: 575534 - RNA, 19 nt, Homo sapiens
gaaaucgaacagcugauaa

SEQ ID NO: 575535 - RNA, 19 nt, Homo sapiens
uuaaagaucuagcagacaa

SEQ ID NO: 575536 - RNA, 19 nt, Homo sapiens
gaauuuaccucuucaguuu

SEQ ID NO: 575537 - RNA, 19 nt, Homo sapiens
caaauacccuuuagagaaa

SEQ ID NO: 575538 - RNA, 19 nt, Homo sapiens
gaagcgaacuuacacaaug

SEQ ID NO: 575539 - RNA, 19 nt, Homo sapiens
gaaggaaagugaacuagga

SEQ ID NO: 575540 - RNA, 19 nt, Homo sapiens
gcacauguauugaagaaca

SEQ ID NO: 575541 - RNA, 19 nt, Homo sapiens
gaaacaggaagauaugaua

SEQ ID NO: 575542 - RNA, 19 nt, Homo sapiens
gaacagcacauguauugaa

SEQ ID NO: 575543 - RNA, 19 nt, Homo sapiens
gaaagugaacuaggaauuu

SEQ ID NO: 575544 - RNA, 19 nt, Homo sapiens
gcaaaucaaccucaacuug

SEQ ID NO: 575545 - RNA, 19 nt, Homo sapiens
ugcauuaacucucccuuua

SEQ ID NO: 575546 - RNA, 19 nt, Homo sapiens
acaaauacccuuuagagaa

SEQ ID NO: 575547 - RNA, 19 nt, Homo sapiens
uuagagaaauggcaaauca

SEQ ID NO: 575548 - RNA, 19 nt, Homo sapiens
uagaaucacgguugcauua

SEQ ID NO: 575549 - RNA, 19 nt, Homo sapiens
ggaaagugaacuaggaauu

SEQ ID NO: 575550 - RNA, 19 nt, Homo sapiens
aauuagagguccuugagua

SEQ ID NO: 575551 - RNA, 19 nt, Homo sapiens
ggaauuuaccucuucaguu

SEQ ID NO: 575552 - RNA, 19 nt, Homo sapiens
cagcacauguauugaagaa

SEQ ID NO: 575553 - RNA, 19 nt, Homo sapiens
ugaccuggaucacuauuug

SEQ ID NO: 575554 - RNA, 19 nt, Homo sapiens
gugggaagaugaaacaguu

SEQ ID NO: 575555 - RNA, 19 nt, Homo sapiens
guauuuggcuguugucuac

SEQ ID NO: 575556 - RNA, 19 nt, Homo sapiens
cagauuuacucuaugcauu

SEQ ID NO: 575557 - RNA, 19 nt, Homo sapiens
cuucaaugcugucauguug

SEQ ID NO: 575558 - RNA, 19 nt, Homo sapiens
gcuguugucuacccuuuga

SEQ ID NO: 575559 - RNA, 19 nt, Homo sapiens
aaaucaaccucaacuuguu

SEQ ID NO: 575560 - RNA, 19 nt, Homo sapiens
caaaucaaccucaacuugu

SEQ ID NO: 575561 - RNA, 19 nt, Homo sapiens
cauuaacucucccuuuaug

SEQ ID NO: 575562 - RNA, 19 nt, Homo sapiens
caugugauguugcugauuc

SEQ ID NO: 575563 - RNA, 19 nt, Homo sapiens
caagaaggaaagugaacua

SEQ ID NO: 575564 - RNA, 19 nt, Homo sapiens
caucuucaaugcugucaug

SEQ ID NO: 575565 - RNA, 19 nt, Homo sapiens
ugucuacccuuugaaguuu

SEQ ID NO: 575566 - RNA, 19 nt, Homo sapiens
guuugucacuaucagauuu

SEQ ID NO: 575567 - RNA, 19 nt, Homo sapiens
ggaauuagagguccuugag

SEQ ID NO: 575568 - RNA, 19 nt, Homo sapiens
gacaaauacccuuuagaga

SEQ ID NO: 575569 - RNA, 19 nt, Homo sapiens
gaaucacgguugcauuaac

SEQ ID NO: 575570 - RNA, 19 nt, Homo sapiens
ucaaugcugucauguugug

SEQ ID NO: 575571 - RNA, 19 nt, Homo sapiens
ugacaaauacccuuuagag

SEQ ID NO: 575572 - RNA, 19 nt, Homo sapiens
gcauuaacucucccuuuau

SEQ ID NO: 575573 - RNA, 19 nt, Homo sapiens
guguacaggcuaugcaaua

SEQ ID NO: 575574 - RNA, 19 nt, Homo sapiens
ggaagcgaacuuacacaau

SEQ ID NO: 575575 - RNA, 19 nt, Homo sapiens
agcaugaccuggaucacua

SEQ ID NO: 575576 - RNA, 19 nt, Homo sapiens
ucccauuguuuacaucuuu

SEQ ID NO: 575577 - RNA, 19 nt, Homo sapiens
gaagaccacagcaauucug

SEQ ID NO: 575578 - RNA, 19 nt, Homo sapiens
cacaguuacuuuugucuua

SEQ ID NO: 575579 - RNA, 19 nt, Homo sapiens
cuugucagcaucacaguua

SEQ ID NO: 575580 - RNA, 19 nt, Homo sapiens
ggaaaagaagagaaucaua

SEQ ID NO: 575581 - RNA, 19 nt, Homo sapiens
gcuaugacaaauacccuuu

SEQ ID NO: 575582 - RNA, 19 nt, Homo sapiens
gauauuggaaaccaucuuc

SEQ ID NO: 575583 - RNA, 19 nt, Homo sapiens
ucaccugcauugccguuga

SEQ ID NO: 575584 - RNA, 19 nt, Homo sapiens
ggagugcuuuucucaugua

SEQ ID NO: 575585 - RNA, 19 nt, Homo sapiens
uaucagauuuacucuaugc

SEQ ID NO: 575586 - RNA, 19 nt, Homo sapiens
gggaagcgaacuuacacaa

SEQ ID NO: 575587 - RNA, 19 nt, Homo sapiens
ggauugauuauacuuggaa

SEQ ID NO: 575588 - RNA, 19 nt, Homo sapiens
aaacgcauacuuucugugu

SEQ ID NO: 575589 - RNA, 19 nt, Homo sapiens
aaucacgguugcauuaaca

SEQ ID NO: 575590 - RNA, 19 nt, Homo sapiens
uuuacucccuuucauguga

SEQ ID NO: 575591 - RNA, 19 nt, Homo sapiens
uaugacaaauacccuuuag

SEQ ID NO: 575592 - RNA, 19 nt, Homo sapiens
caucacaaagacaaagaaa

SEQ ID NO: 575593 - RNA, 19 nt, Homo sapiens
auccaauucuguacuguuu

SEQ ID NO: 575594 - RNA, 19 nt, Homo sapiens
aagcgaacuuacacaaugu

SEQ ID NO: 575595 - RNA, 19 nt, Homo sapiens
gaucgguauuuggcuguug

SEQ ID NO: 575596 - RNA, 19 nt, Homo sapiens
cagcauuccagccaauauu

SEQ ID NO: 575597 - RNA, 19 nt, Homo sapiens
cagcauuccucaccugcau

SEQ ID NO: 575598 - RNA, 19 nt, Homo sapiens
gcacugggagguguaauac

SEQ ID NO: 575599 - RNA, 19 nt, Homo sapiens
gauccaauucuguacuguu

SEQ ID NO: 575600 - RNA, 19 nt, Homo sapiens
uggaaaccaucuucaaugc

SEQ ID NO: 575601 - RNA, 19 nt, Homo sapiens
acuaggaauuuaccucuuc

SEQ ID NO: 575602 - RNA, 19 nt, Homo sapiens
uaccgaaacaggaagauau

SEQ ID NO: 575603 - RNA, 19 nt, Homo sapiens
gugauuauagucagcauuc

SEQ ID NO: 575604 - RNA, 19 nt, Homo sapiens
cacaauaaagccacggaaa

SEQ ID NO: 575605 - RNA, 19 nt, Homo sapiens
gguauuuggcuguugucua

SEQ ID NO: 575606 - RNA, 19 nt, Homo sapiens
ccucuucaguuugucacua

SEQ ID NO: 575607 - RNA, 19 nt, Homo sapiens
cgaaacaggaagauaugau

SEQ ID NO: 575608 - RNA, 19 nt, Homo sapiens
gaaaacaaggaaaagaaga

SEQ ID NO: 575609 - RNA, 19 nt, Homo sapiens
gaauauugcgaugccgaaa

SEQ ID NO: 575610 - RNA, 19 nt, Homo sapiens
gcauuccucaccugcauug

SEQ ID NO: 575611 - RNA, 19 nt, Homo sapiens
acgguugcauuaacaaguu

SEQ ID NO: 575612 - RNA, 19 nt, Homo sapiens
gugugugucuuuccugcaa

SEQ ID NO: 575613 - RNA, 19 nt, Homo sapiens
gcuaugcaauaccuuuggu

SEQ ID NO: 575614 - RNA, 19 nt, Homo sapiens
ccaauucuguacuguuuug

SEQ ID NO: 575615 - RNA, 19 nt, Homo sapiens
gaucucugugugugucuuu

SEQ ID NO: 575616 - RNA, 19 nt, Homo sapiens
guauugaagaacagcauga

SEQ ID NO: 575617 - RNA, 19 nt, Homo sapiens
gaauuagagguccuugagu

SEQ ID NO: 575618 - RNA, 19 nt, Homo sapiens
uacuuucugugucuacaaa

SEQ ID NO: 575619 - RNA, 19 nt, Homo sapiens
gcuuuacucccuuucaugu

SEQ ID NO: 575620 - RNA, 19 nt, Homo sapiens
cuggaucacuauuuguuuc

SEQ ID NO: 575621 - RNA, 19 nt, Homo sapiens
cacuauuuguuucccauug

SEQ ID NO: 575622 - RNA, 19 nt, Homo sapiens
cuaggaauuuaccucuuca

SEQ ID NO: 575623 - RNA, 19 nt, Homo sapiens
gggaagaugaaacaguugu

SEQ ID NO: 575624 - RNA, 19 nt, Homo sapiens
uggcuguugucuacccuuu

SEQ ID NO: 575625 - RNA, 19 nt, Homo sapiens
caauauuggaucucugugu

SEQ ID NO: 575626 - RNA, 19 nt, Homo sapiens
cuauuuguuucccauuguu

SEQ ID NO: 575627 - RNA, 19 nt, Homo sapiens
acgcauacuuucugugucu

SEQ ID NO: 575628 - RNA, 19 nt, Homo sapiens
cuaugacaaauacccuuua

SEQ ID NO: 575629 - RNA, 19 nt, Homo sapiens
ucgaagaccacagcaauuc

SEQ ID NO: 575630 - RNA, 19 nt, Homo sapiens
guaauacaucacaaagaca

SEQ ID NO: 575631 - RNA, 19 nt, Homo sapiens
agaacagcaugaccuggau

SEQ ID NO: 575632 - RNA, 19 nt, Homo sapiens
uaacucucccuuuauggau

SEQ ID NO: 575633 - RNA, 19 nt, Homo sapiens
uugcugauccaauucugua

SEQ ID NO: 575634 - RNA, 19 nt, Homo sapiens
uuguguugcugauccaauu

SEQ ID NO: 575635 - RNA, 19 nt, Homo sapiens
uagagcaugcugugaacuu

SEQ ID NO: 575636 - RNA, 19 nt, Homo sapiens
gcuaaaggcucuagaaaga

SEQ ID NO: 575637 - RNA, 19 nt, Homo sapiens
gaagaaaccugugguaaag

SEQ ID NO: 575638 - RNA, 19 nt, Homo sapiens
caaagaagguggagggaaa

SEQ ID NO: 575639 - RNA, 19 nt, Homo sapiens
gggaagagguugaguggaa

SEQ ID NO: 575640 - RNA, 19 nt, Homo sapiens
ggaagaaaccugugguaaa

SEQ ID NO: 575641 - RNA, 19 nt, Homo sapiens
gaaagaagaggaugaggaa

SEQ ID NO: 575642 - RNA, 19 nt, Homo sapiens
ggagagcagugaugaggaa

SEQ ID NO: 575643 - RNA, 19 nt, Homo sapiens
guacaaagcauacauagca

SEQ ID NO: 575644 - RNA, 19 nt, Homo sapiens
gaagacaaacuggaccuua

SEQ ID NO: 575645 - RNA, 19 nt, Homo sapiens
uaaaggcucuagaaagaug

SEQ ID NO: 575646 - RNA, 19 nt, Homo sapiens
gaagguggagggaaauaaa

SEQ ID NO: 575647 - RNA, 19 nt, Homo sapiens
agaaggagaugcaggaguu

SEQ ID NO: 575648 - RNA, 19 nt, Homo sapiens
aagaagagcuccaggaaag

SEQ ID NO: 575649 - RNA, 19 nt, Homo sapiens
gcuucacgcugucccuuua

SEQ ID NO: 575650 - RNA, 19 nt, Homo sapiens
gcgccgaauugguuucuaa

SEQ ID NO: 575651 - RNA, 19 nt, Homo sapiens
gcagugauggcgagaguaa

SEQ ID NO: 575652 - RNA, 19 nt, Homo sapiens
gauccuagcccagaagaaa

SEQ ID NO: 575653 - RNA, 19 nt, Homo sapiens
gaggacaggacccagcuua

SEQ ID NO: 575654 - RNA, 19 nt, Homo sapiens
agaaaccugugguaaagaa

SEQ ID NO: 575655 - RNA, 19 nt, Homo sapiens
ggcaaggccucagucagua

SEQ ID NO: 575656 - RNA, 19 nt, Homo sapiens
gaugacagugggagagaua

SEQ ID NO: 575657 - RNA, 19 nt, Homo sapiens
gaaacuacaagaagcuguu

SEQ ID NO: 575658 - RNA, 19 nt, Homo sapiens
ugacggaggccgagaagaa

SEQ ID NO: 575659 - RNA, 19 nt, Homo sapiens
aggaggagcugcugaagau

SEQ ID NO: 575660 - RNA, 19 nt, Homo sapiens
ucagcacgcuuacgcauuc

SEQ ID NO: 575661 - RNA, 19 nt, Homo sapiens
aaagugaacaggagaguga

SEQ ID NO: 575662 - RNA, 19 nt, Homo sapiens
ggagggaaauaaaggaacu

SEQ ID NO: 575663 - RNA, 19 nt, Homo sapiens
aaacuggaccuuaccaaga

SEQ ID NO: 575664 - RNA, 19 nt, Homo sapiens
gacggacccuggacucaga

SEQ ID NO: 575665 - RNA, 19 nt, Homo sapiens
acaaggagcgccugaguau

SEQ ID NO: 575666 - RNA, 19 nt, Homo sapiens
uaauguacuuagacacuug

SEQ ID NO: 575667 - RNA, 19 nt, Homo sapiens
caagaagagcuccaggaaa

SEQ ID NO: 575668 - RNA, 19 nt, Homo sapiens
ccaagaagagcuccaggaa

SEQ ID NO: 575669 - RNA, 19 nt, Homo sapiens
cuagaaagauggccagacu

SEQ ID NO: 575670 - RNA, 19 nt, Homo sapiens
guagcgacccggagagaaa

SEQ ID NO: 575671 - RNA, 19 nt, Homo sapiens
gaggagcuguaagcagaaa

SEQ ID NO: 575672 - RNA, 19 nt, Homo sapiens
gcagagagaggaggaagug

SEQ ID NO: 575673 - RNA, 19 nt, Homo sapiens
gaagucagcccagccaaag

SEQ ID NO: 575674 - RNA, 19 nt, Homo sapiens
gaggaugccuuuucucuuc

SEQ ID NO: 575675 - RNA, 19 nt, Homo sapiens
ggacaggacccagcuuaag

SEQ ID NO: 575676 - RNA, 19 nt, Homo sapiens
ccgaauugguuucuaacga

SEQ ID NO: 575677 - RNA, 19 nt, Homo sapiens
ucuucugccuugcgaaaua

SEQ ID NO: 575678 - RNA, 19 nt, Homo sapiens
cuggaacccuuuaggagaa

SEQ ID NO: 575679 - RNA, 19 nt, Homo sapiens
cagcuaaaggcucuagaaa

SEQ ID NO: 575680 - RNA, 19 nt, Homo sapiens
gcgaggaagagcagaaaga

SEQ ID NO: 575681 - RNA, 19 nt, Homo sapiens
gggaggagaggagcuguaa

SEQ ID NO: 575682 - RNA, 19 nt, Homo sapiens
gaagcaggccagggaagaa

SEQ ID NO: 575683 - RNA, 19 nt, Homo sapiens
ggaagcaggccagggaaga

SEQ ID NO: 575684 - RNA, 19 nt, Homo sapiens
aaaaugauccguuccaaaa

SEQ ID NO: 575685 - RNA, 19 nt, Homo sapiens
gaagaugcagguggaugaa

SEQ ID NO: 575686 - RNA, 19 nt, Homo sapiens
ugauuagguuucacccaaa

SEQ ID NO: 575687 - RNA, 19 nt, Homo sapiens
ggaggaggaagagaaagaa

SEQ ID NO: 575688 - RNA, 19 nt, Homo sapiens
ugaagaugcagguggauga

SEQ ID NO: 575689 - RNA, 19 nt, Homo sapiens
gaggaggagcugcugaaga

SEQ ID NO: 575690 - RNA, 19 nt, Homo sapiens
guacagccuggaacccuuu

SEQ ID NO: 575691 - RNA, 19 nt, Homo sapiens
gcagcgaggacgaggaaga

SEQ ID NO: 575692 - RNA, 19 nt, Homo sapiens
ggaagagaaagaagaggau

SEQ ID NO: 575693 - RNA, 19 nt, Homo sapiens
gaacuaaaagccugaagga

SEQ ID NO: 575694 - RNA, 19 nt, Homo sapiens
aacuggaccuuaccaagaa

SEQ ID NO: 575695 - RNA, 19 nt, Homo sapiens
guuccugacucuaauguac

SEQ ID NO: 575696 - RNA, 19 nt, Homo sapiens
ggaugcuacuucucagcuu

SEQ ID NO: 575697 - RNA, 19 nt, Homo sapiens
cagcagugauggcgagagu

SEQ ID NO: 575698 - RNA, 19 nt, Homo sapiens
ggaggaagagaaagaagag

SEQ ID NO: 575699 - RNA, 19 nt, Homo sapiens
gauuagguuucacccaaag

SEQ ID NO: 575700 - RNA, 19 nt, Homo sapiens
guucagaggacagcaaaga

SEQ ID NO: 575701 - RNA, 19 nt, Homo sapiens
uggaagcgcuaggcaugaa

SEQ ID NO: 575702 - RNA, 19 nt, Homo sapiens
agucucgucuggcaaaguu

SEQ ID NO: 575703 - RNA, 19 nt, Homo sapiens
gauacauguacaaagcaua

SEQ ID NO: 575704 - RNA, 19 nt, Homo sapiens
gcgccguuccugacucuaa

SEQ ID NO: 575705 - RNA, 19 nt, Homo sapiens
gacggaggccgagaagaaa

SEQ ID NO: 575706 - RNA, 19 nt, Homo sapiens
cacaaggagcgccugagua

SEQ ID NO: 575707 - RNA, 19 nt, Homo sapiens
gggaaauaaaggaacuaaa

SEQ ID NO: 575708 - RNA, 19 nt, Homo sapiens
aagacaaacuggaccuuac

SEQ ID NO: 575709 - RNA, 19 nt, Homo sapiens
gaggagaagcaggcacuga

SEQ ID NO: 575710 - RNA, 19 nt, Homo sapiens
gaggagaggagcuguaagc

SEQ ID NO: 575711 - RNA, 19 nt, Homo sapiens
agaagaaagagcagagaga

SEQ ID NO: 575712 - RNA, 19 nt, Homo sapiens
gacccuggacucagaugaa

SEQ ID NO: 575713 - RNA, 19 nt, Homo sapiens
gaaagcgccguuccugacu

SEQ ID NO: 575714 - RNA, 19 nt, Homo sapiens
gcaauggccggagaaaguc

SEQ ID NO: 575715 - RNA, 19 nt, Homo sapiens
acaagucucgucuggcaaa

SEQ ID NO: 575716 - RNA, 19 nt, Homo sapiens
gcagugaggaggaggaaaa

SEQ ID NO: 575717 - RNA, 19 nt, Homo sapiens
ggagaagcaggcacugaag

SEQ ID NO: 575718 - RNA, 19 nt, Homo sapiens
ccaaggacacaagcuguug

SEQ ID NO: 575719 - RNA, 19 nt, Homo sapiens
gcagacguacagccuggaa

SEQ ID NO: 575720 - RNA, 19 nt, Homo sapiens
cuucugccuugcgaaauaa

SEQ ID NO: 575721 - RNA, 19 nt, Homo sapiens
gacaggacccagcuuaagg

SEQ ID NO: 575722 - RNA, 19 nt, Homo sapiens
ggaggaaguggaggaggaa

SEQ ID NO: 575723 - RNA, 19 nt, Homo sapiens
cuaaaagccugaaggaaag

SEQ ID NO: 575724 - RNA, 19 nt, Homo sapiens
guucacccguagcuucuuc

SEQ ID NO: 575725 - RNA, 19 nt, Homo sapiens
cuugauacauguacaaagc

SEQ ID NO: 575726 - RNA, 19 nt, Homo sapiens
ggaugacagugggagagau

SEQ ID NO: 575727 - RNA, 19 nt, Homo sapiens
gcccgugaccagugagaaa

SEQ ID NO: 575728 - RNA, 19 nt, Homo sapiens
ccaguggugaggaaaguga

SEQ ID NO: 575729 - RNA, 19 nt, Homo sapiens
uaggaagaaaccuguggua

SEQ ID NO: 575730 - RNA, 19 nt, Homo sapiens
guugggaugcuacuucuca

SEQ ID NO: 575731 - RNA, 19 nt, Homo sapiens
ggaaagugaacaggagagu

SEQ ID NO: 575732 - RNA, 19 nt, Homo sapiens
gcaaggccucagucaguag

SEQ ID NO: 575733 - RNA, 19 nt, Homo sapiens
aaagguuccgcuucaauuc

SEQ ID NO: 575734 - RNA, 19 nt, Homo sapiens
gcuguugggaugcuacuuc

SEQ ID NO: 575735 - RNA, 19 nt, Homo sapiens
gcccaucgaaacuacaaga

SEQ ID NO: 575736 - RNA, 19 nt, Homo sapiens
gauagaaucuccacugaaa

SEQ ID NO: 575737 - RNA, 19 nt, Homo sapiens
gaucaaagcuccaaacuac

SEQ ID NO: 575738 - RNA, 19 nt, Homo sapiens
ggacaaagaugccagaaca

SEQ ID NO: 575739 - RNA, 19 nt, Homo sapiens
caugaaggauauugaagua

SEQ ID NO: 575740 - RNA, 19 nt, Homo sapiens
gagcuaaagcccaggaaua

SEQ ID NO: 575741 - RNA, 19 nt, Homo sapiens
gagaguugcuauucacuau

SEQ ID NO: 575742 - RNA, 19 nt, Homo sapiens
gaacaagccuacugguuuu

SEQ ID NO: 575743 - RNA, 19 nt, Homo sapiens
ccucaucucuguacgaauu

SEQ ID NO: 575744 - RNA, 19 nt, Homo sapiens
uuacugugcugacgugaua

SEQ ID NO: 575745 - RNA, 19 nt, Homo sapiens
gagcugggauaagacuuua

SEQ ID NO: 575746 - RNA, 19 nt, Homo sapiens
caaucacaauggaaacaua

SEQ ID NO: 575747 - RNA, 19 nt, Homo sapiens
gauacucgaucgucaaauc

SEQ ID NO: 575748 - RNA, 19 nt, Homo sapiens
gaguugcuauucacuauau

SEQ ID NO: 575749 - RNA, 19 nt, Homo sapiens
gaaggauauugaaguaaca

SEQ ID NO: 575750 - RNA, 19 nt, Homo sapiens
gaugguagauucagcuucu

SEQ ID NO: 575751 - RNA, 19 nt, Homo sapiens
ugucaucgaucuaauggaa

SEQ ID NO: 575752 - RNA, 19 nt, Homo sapiens
agaacaagccuacugguuu

SEQ ID NO: 575753 - RNA, 19 nt, Homo sapiens
ggucaaagggacaugaauu

SEQ ID NO: 575754 - RNA, 19 nt, Homo sapiens
ggguugagguuauuguaga

SEQ ID NO: 575755 - RNA, 19 nt, Homo sapiens
gaugggagcaaaguguuua

SEQ ID NO: 575756 - RNA, 19 nt, Homo sapiens
caaagggacaugaauuuua

SEQ ID NO: 575757 - RNA, 19 nt, Homo sapiens
ggagaguugcuauucacua

SEQ ID NO: 575758 - RNA, 19 nt, Homo sapiens
ggagcugggauaagacuuu

SEQ ID NO: 575759 - RNA, 19 nt, Homo sapiens
ggaucaaagcuccaaacua

SEQ ID NO: 575760 - RNA, 19 nt, Homo sapiens
cuaaagcccaggaauaaga

SEQ ID NO: 575761 - RNA, 19 nt, Homo sapiens
gucaaagggacaugaauuu

SEQ ID NO: 575762 - RNA, 19 nt, Homo sapiens
ggaaacauauuugcauacg

SEQ ID NO: 575763 - RNA, 19 nt, Homo sapiens
ccaaagauaacuucaccuu

SEQ ID NO: 575764 - RNA, 19 nt, Homo sapiens
ugauaaaacugccaaaaug

SEQ ID NO: 575765 - RNA, 19 nt, Homo sapiens
ugaaggauauugaaguaac

SEQ ID NO: 575766 - RNA, 19 nt, Homo sapiens
gcgcuucaguguacguguu

SEQ ID NO: 575767 - RNA, 19 nt, Homo sapiens
gacaaucacaaucccauga

SEQ ID NO: 575768 - RNA, 19 nt, Homo sapiens
caguguacguguuagagaa

SEQ ID NO: 575769 - RNA, 19 nt, Homo sapiens
gaucagcccaucucagcuu

SEQ ID NO: 575770 - RNA, 19 nt, Homo sapiens
acaaagaugccagaacaaa

SEQ ID NO: 575771 - RNA, 19 nt, Homo sapiens
ugugggaccucagcaguaa

SEQ ID NO: 575772 - RNA, 19 nt, Homo sapiens
ggauagaaucuccacugaa

SEQ ID NO: 575773 - RNA, 19 nt, Homo sapiens
gcaggaucaugggcuaaug

SEQ ID NO: 575774 - RNA, 19 nt, Homo sapiens
aaucuccacugaaacauca

SEQ ID NO: 575775 - RNA, 19 nt, Homo sapiens
caaauccuaugaugguuuu

SEQ ID NO: 575776 - RNA, 19 nt, Homo sapiens
gcugggauaagacuuuaaa

SEQ ID NO: 575777 - RNA, 19 nt, Homo sapiens
aaaaugagccuguuuggaa

SEQ ID NO: 575778 - RNA, 19 nt, Homo sapiens
acacugggccugugcuuga

SEQ ID NO: 575779 - RNA, 19 nt, Homo sapiens
agaaaacgaugucauuguu

SEQ ID NO: 575780 - RNA, 19 nt, Homo sapiens
ugugggaucugaugguaga

SEQ ID NO: 575781 - RNA, 19 nt, Homo sapiens
aaacagaacaagccuacug

SEQ ID NO: 575782 - RNA, 19 nt, Homo sapiens
gcagugcaacuacagacaa

SEQ ID NO: 575783 - RNA, 19 nt, Homo sapiens
ggacagaccauuccaaaag

SEQ ID NO: 575784 - RNA, 19 nt, Homo sapiens
gaugauagcauugguuguc

SEQ ID NO: 575785 - RNA, 19 nt, Homo sapiens
ggauauugaaguaacauca

SEQ ID NO: 575786 - RNA, 19 nt, Homo sapiens
uauuguagacguuagauug

SEQ ID NO: 575787 - RNA, 19 nt, Homo sapiens
gagguuauuguagacguua

SEQ ID NO: 575788 - RNA, 19 nt, Homo sapiens
acugggagcugggauaaga

SEQ ID NO: 575789 - RNA, 19 nt, Homo sapiens
gcaguaaccaagcgauaca

SEQ ID NO: 575790 - RNA, 19 nt, Homo sapiens
caacuacagacaaucacaa

SEQ ID NO: 575791 - RNA, 19 nt, Homo sapiens
aggauagaaucuccacuga

SEQ ID NO: 575792 - RNA, 19 nt, Homo sapiens
gcuucgggcuccugggauu

SEQ ID NO: 575793 - RNA, 19 nt, Homo sapiens
ucaaauccuaugaugguuu

SEQ ID NO: 575794 - RNA, 19 nt, Homo sapiens
uaaccaagcgauacagauc

SEQ ID NO: 575795 - RNA, 19 nt, Homo sapiens
uugcagcgcuucaguguac

SEQ ID NO: 575796 - RNA, 19 nt, Homo sapiens
cagaacaagccuacugguu

SEQ ID NO: 575797 - RNA, 19 nt, Homo sapiens
aaacuacagcugugugaug

SEQ ID NO: 575798 - RNA, 19 nt, Homo sapiens
uagcauugguugucugucu

SEQ ID NO: 575799 - RNA, 19 nt, Homo sapiens
cgucaaauccuaugauggu

SEQ ID NO: 575800 - RNA, 19 nt, Homo sapiens
gggauacucgaucgucaaa

SEQ ID NO: 575801 - RNA, 19 nt, Homo sapiens
cagcaguaaccaagcgaua

SEQ ID NO: 575802 - RNA, 19 nt, Homo sapiens
ccggggaacuuucuuauug

SEQ ID NO: 575803 - RNA, 19 nt, Homo sapiens
ccaggaauaagaaguagug

SEQ ID NO: 575804 - RNA, 19 nt, Homo sapiens
uaaagcccaggaauaagaa

SEQ ID NO: 575805 - RNA, 19 nt, Homo sapiens
guucauggcacccuugcaa

SEQ ID NO: 575806 - RNA, 19 nt, Homo sapiens
uagaaucuccacugaaaca

SEQ ID NO: 575807 - RNA, 19 nt, Homo sapiens
ccaaacuacagcuguguga

SEQ ID NO: 575808 - RNA, 19 nt, Homo sapiens
gcauugguugucugucuuu

SEQ ID NO: 575809 - RNA, 19 nt, Homo sapiens
guguacguguuagagaaua

SEQ ID NO: 575810 - RNA, 19 nt, Homo sapiens
gcaacugugggaucugaug

SEQ ID NO: 575811 - RNA, 19 nt, Homo sapiens
gcagagaggggccugauug

SEQ ID NO: 575812 - RNA, 19 nt, Homo sapiens
gacuugccgucucuccauu

SEQ ID NO: 575813 - RNA, 19 nt, Homo sapiens
aguaguggcuggagacucu

SEQ ID NO: 575814 - RNA, 19 nt, Homo sapiens
cacaauggaaacauauuug

SEQ ID NO: 575815 - RNA, 19 nt, Homo sapiens
aacuacagcugugugauga

SEQ ID NO: 575816 - RNA, 19 nt, Homo sapiens
uuuacggcaucgugugaua

SEQ ID NO: 575817 - RNA, 19 nt, Homo sapiens
caaucacaaucccaugaag

SEQ ID NO: 575818 - RNA, 19 nt, Homo sapiens
gcaacuacagacaaucaca

SEQ ID NO: 575819 - RNA, 19 nt, Homo sapiens
uaauggaaccaacacuuca

SEQ ID NO: 575820 - RNA, 19 nt, Homo sapiens
cuaauggaaccaacacuuc

SEQ ID NO: 575821 - RNA, 19 nt, Homo sapiens
gugcaacuacagacaauca

SEQ ID NO: 575822 - RNA, 19 nt, Homo sapiens
gaaucuccacugaaacauc

SEQ ID NO: 575823 - RNA, 19 nt, Homo sapiens
cagugcaacuacagacaau

SEQ ID NO: 575824 - RNA, 19 nt, Homo sapiens
gaucgucaaauccuaugau

SEQ ID NO: 575825 - RNA, 19 nt, Homo sapiens
ugacugggagcugggauaa

SEQ ID NO: 575826 - RNA, 19 nt, Homo sapiens
gacaguggacagaccauuc

SEQ ID NO: 575827 - RNA, 19 nt, Homo sapiens
ugagguuauuguagacguu

SEQ ID NO: 575828 - RNA, 19 nt, Homo sapiens
caaagaugccagaacaaaa

SEQ ID NO: 575829 - RNA, 19 nt, Homo sapiens
gacaaagaugccagaacaa

SEQ ID NO: 575830 - RNA, 19 nt, Homo sapiens
agcuaaagcccaggaauaa

SEQ ID NO: 575831 - RNA, 19 nt, Homo sapiens
cagagcagguucgcaaacu

SEQ ID NO: 575832 - RNA, 19 nt, Homo sapiens
ccaugaaggauauugaagu

SEQ ID NO: 575833 - RNA, 19 nt, Homo sapiens
gauagcauugguugucugu

SEQ ID NO: 575834 - RNA, 19 nt, Homo sapiens
gcaucgguguguggcuauu

SEQ ID NO: 575835 - RNA, 19 nt, Homo sapiens
aaucaaccuucugaauuca

SEQ ID NO: 575836 - RNA, 19 nt, Homo sapiens
caucaaggaucacaaauua

SEQ ID NO: 575837 - RNA, 19 nt, Homo sapiens
gaaaccagcuaauucauga

SEQ ID NO: 575838 - RNA, 19 nt, Homo sapiens
ucaaagagcuucagcaaga

SEQ ID NO: 575839 - RNA, 19 nt, Homo sapiens
gcucauagcuauuaauuca

SEQ ID NO: 575840 - RNA, 19 nt, Homo sapiens
aaaggaagcucgcguguuu

SEQ ID NO: 575841 - RNA, 19 nt, Homo sapiens
ugaaagaacuugagcuuga

SEQ ID NO: 575842 - RNA, 19 nt, Homo sapiens
gaagaaagaaggcagagua

SEQ ID NO: 575843 - RNA, 19 nt, Homo sapiens
gcagaucacuuacaaagau

SEQ ID NO: 575844 - RNA, 19 nt, Homo sapiens
gaagagaguagaaaugaaa

SEQ ID NO: 575845 - RNA, 19 nt, Homo sapiens
gaagaugaaaggaagaaua

SEQ ID NO: 575846 - RNA, 19 nt, Homo sapiens
cagacaaguucgacauuua

SEQ ID NO: 575847 - RNA, 19 nt, Homo sapiens
ugacaaagucgaaaguuua

SEQ ID NO: 575848 - RNA, 19 nt, Homo sapiens
gaacgaagagaacuagaaa

SEQ ID NO: 575849 - RNA, 19 nt, Homo sapiens
aaagaagccucgaaaguga

SEQ ID NO: 575850 - RNA, 19 nt, Homo sapiens
aaaggaagaugauugaaga

SEQ ID NO: 575851 - RNA, 19 nt, Homo sapiens
gaaagaacuugagcuugaa

SEQ ID NO: 575852 - RNA, 19 nt, Homo sapiens
ggaacucaaucaaucugua

SEQ ID NO: 575853 - RNA, 19 nt, Homo sapiens
gaaguguacugcaauccaa

SEQ ID NO: 575854 - RNA, 19 nt, Homo sapiens
cuacucagguugccgauuu

SEQ ID NO: 575855 - RNA, 19 nt, Homo sapiens
ggaagagaguagaaaugaa

SEQ ID NO: 575856 - RNA, 19 nt, Homo sapiens
aaagagaguuguaauaugg

SEQ ID NO: 575857 - RNA, 19 nt, Homo sapiens
acaaagauguggcuaugaa

SEQ ID NO: 575858 - RNA, 19 nt, Homo sapiens
agacagcccuagagaauga

SEQ ID NO: 575859 - RNA, 19 nt, Homo sapiens
agacaaaucugcucacagu

SEQ ID NO: 575860 - RNA, 19 nt, Homo sapiens
gacaggagcagaauauaaa

SEQ ID NO: 575861 - RNA, 19 nt, Homo sapiens
gcuaaagagaguuguaaua

SEQ ID NO: 575862 - RNA, 19 nt, Homo sapiens
uaacuuacauaccgugaga

SEQ ID NO: 575863 - RNA, 19 nt, Homo sapiens
gaacucaaucaaucuguaa

SEQ ID NO: 575864 - RNA, 19 nt, Homo sapiens
guaucaaguucgaaucuuu

SEQ ID NO: 575865 - RNA, 19 nt, Homo sapiens
cagaauaucaucaagcuaa

SEQ ID NO: 575866 - RNA, 19 nt, Homo sapiens
gcaaagagcccaccaucuc

SEQ ID NO: 575867 - RNA, 19 nt, Homo sapiens
accgaaagcucaagaauga

SEQ ID NO: 575868 - RNA, 19 nt, Homo sapiens
cugcccagcuucuaacuua

SEQ ID NO: 575869 - RNA, 19 nt, Homo sapiens
gugacaaagucgaaaguuu

SEQ ID NO: 575870 - RNA, 19 nt, Homo sapiens
ggagacaggagcagaauau

SEQ ID NO: 575871 - RNA, 19 nt, Homo sapiens
aagcagagcugaagcaaag

SEQ ID NO: 575872 - RNA, 19 nt, Homo sapiens
gaaaaggaguuaaccaugu

SEQ ID NO: 575873 - RNA, 19 nt, Homo sapiens
gaucacaaauuauccaacu

SEQ ID NO: 575874 - RNA, 19 nt, Homo sapiens
accaagagauugaaacaaa

SEQ ID NO: 575875 - RNA, 19 nt, Homo sapiens
gaaaggaagaugauugaag

SEQ ID NO: 575876 - RNA, 19 nt, Homo sapiens
ccucgaaagugaaauguau

SEQ ID NO: 575877 - RNA, 19 nt, Homo sapiens
ggcaagcucugcacaaaca

SEQ ID NO: 575878 - RNA, 19 nt, Homo sapiens
ugaauuagagucugucaaa

SEQ ID NO: 575879 - RNA, 19 nt, Homo sapiens
gcugcaaucuagugacaaa

SEQ ID NO: 575880 - RNA, 19 nt, Homo sapiens
gaacgaaggcagagagaag

SEQ ID NO: 575881 - RNA, 19 nt, Homo sapiens
gaacuugcagucuuucaga

SEQ ID NO: 575882 - RNA, 19 nt, Homo sapiens
gaaaagguauuuacuaugc

SEQ ID NO: 575883 - RNA, 19 nt, Homo sapiens
gacaaagucgaaaguuuaa

SEQ ID NO: 575884 - RNA, 19 nt, Homo sapiens
gaagcucgcguguuugcua

SEQ ID NO: 575885 - RNA, 19 nt, Homo sapiens
uaaccauguuccagaauga

SEQ ID NO: 575886 - RNA, 19 nt, Homo sapiens
gaagagaagcagagcugaa

SEQ ID NO: 575887 - RNA, 19 nt, Homo sapiens
ucagacaaguucgacauuu

SEQ ID NO: 575888 - RNA, 19 nt, Homo sapiens
ggaacgaagagaacuagaa

SEQ ID NO: 575889 - RNA, 19 nt, Homo sapiens
agaaugaaguguacugcaa

SEQ ID NO: 575890 - RNA, 19 nt, Homo sapiens
gcagaaaugugucaaaagu

SEQ ID NO: 575891 - RNA, 19 nt, Homo sapiens
caaguucgaaucuuuagaa

SEQ ID NO: 575892 - RNA, 19 nt, Homo sapiens
uaccguggcugauguguug

SEQ ID NO: 575893 - RNA, 19 nt, Homo sapiens
gaaccaagaauaaucuagu

SEQ ID NO: 575894 - RNA, 19 nt, Homo sapiens
uuacauaccgugagaaguu

SEQ ID NO: 575895 - RNA, 19 nt, Homo sapiens
gcaucaaggaucacaaauu

SEQ ID NO: 575896 - RNA, 19 nt, Homo sapiens
gaaaagaguacccuugaaa

SEQ ID NO: 575897 - RNA, 19 nt, Homo sapiens
guuguaauauggaaacuca

SEQ ID NO: 575898 - RNA, 19 nt, Homo sapiens
gagcagaauauaaagaguu

SEQ ID NO: 575899 - RNA, 19 nt, Homo sapiens
caggaucuauuacaacuca

SEQ ID NO: 575900 - RNA, 19 nt, Homo sapiens
cauagugugugaaccaaga

SEQ ID NO: 575901 - RNA, 19 nt, Homo sapiens
guaaauguuucccuaucau

SEQ ID NO: 575902 - RNA, 19 nt, Homo sapiens
ccaagaaggcucccuagug

SEQ ID NO: 575903 - RNA, 19 nt, Homo sapiens
gcagaguaaccuacaagaa

SEQ ID NO: 575904 - RNA, 19 nt, Homo sapiens
gggaacagcaagugaaaga

SEQ ID NO: 575905 - RNA, 19 nt, Homo sapiens
agagaugagugauuauuca

SEQ ID NO: 575906 - RNA, 19 nt, Homo sapiens
gaugaucaguuugcagaug

SEQ ID NO: 575907 - RNA, 19 nt, Homo sapiens
aaagauguggcuaugaaua

SEQ ID NO: 575908 - RNA, 19 nt, Homo sapiens
uuacaaagauguggcuaug

SEQ ID NO: 575909 - RNA, 19 nt, Homo sapiens
gaucagaaacaaauugaag

SEQ ID NO: 575910 - RNA, 19 nt, Homo sapiens
caaagcuucuguaaagagu

SEQ ID NO: 575911 - RNA, 19 nt, Homo sapiens
gagcugaagcaaagaguug

SEQ ID NO: 575912 - RNA, 19 nt, Homo sapiens
ccagcuaauucaugaguug

SEQ ID NO: 575913 - RNA, 19 nt, Homo sapiens
gaacaauccuuuuaaacag

SEQ ID NO: 575914 - RNA, 19 nt, Homo sapiens
gaucgaucguucugucaau

SEQ ID NO: 575915 - RNA, 19 nt, Homo sapiens
caggcaagcucugcacaaa

SEQ ID NO: 575916 - RNA, 19 nt, Homo sapiens
gaacuugagcuugaauuag

SEQ ID NO: 575917 - RNA, 19 nt, Homo sapiens
ggagaccuaugaccgaaag

SEQ ID NO: 575918 - RNA, 19 nt, Homo sapiens
agacaggagcagaauauaa

SEQ ID NO: 575919 - RNA, 19 nt, Homo sapiens
gauauggauuugcuaagag

SEQ ID NO: 575920 - RNA, 19 nt, Homo sapiens
agaguacccuugaaagaau

SEQ ID NO: 575921 - RNA, 19 nt, Homo sapiens
ggucaaagagcuucagcaa

SEQ ID NO: 575922 - RNA, 19 nt, Homo sapiens
cgaaaaggcuauagugguu

SEQ ID NO: 575923 - RNA, 19 nt, Homo sapiens
ucagaaagaacuacggaaa

SEQ ID NO: 575924 - RNA, 19 nt, Homo sapiens
gaugaaaggaagaauaaag

SEQ ID NO: 575925 - RNA, 19 nt, Homo sapiens
ucacaagcaccaagagauu

SEQ ID NO: 575926 - RNA, 19 nt, Homo sapiens
gaacagcaagugaaagaac

SEQ ID NO: 575927 - RNA, 19 nt, Homo sapiens
ucagacagcccuagagaau

SEQ ID NO: 575928 - RNA, 19 nt, Homo sapiens
gaaaggaagcucgcguguu

SEQ ID NO: 575929 - RNA, 19 nt, Homo sapiens
caacuucgaaaccagcuaa

SEQ ID NO: 575930 - RNA, 19 nt, Homo sapiens
uacauaccgugagaaguua

SEQ ID NO: 575931 - RNA, 19 nt, Homo sapiens
gcaaucuagugacaaaguc

SEQ ID NO: 575932 - RNA, 19 nt, Homo sapiens
uaaggauaaugaggaguuu

SEQ ID NO: 575933 - RNA, 19 nt, Homo sapiens
aagcuucuguaaagaguuu

SEQ ID NO: 575934 - RNA, 19 nt, Homo sapiens
agacaaguucgacauuuaa

SEQ ID NO: 575935 - RNA, 19 nt, Homo sapiens
guagaucagaaacaaauug

SEQ ID NO: 575936 - RNA, 19 nt, Homo sapiens
ggacaauccugacaagaau

SEQ ID NO: 575937 - RNA, 19 nt, Homo sapiens
gggcaucgaugacccaaga

SEQ ID NO: 575938 - RNA, 19 nt, Homo sapiens
gagcacagcuucgccuuca

SEQ ID NO: 575939 - RNA, 19 nt, Homo sapiens
gacaagaucuacuacuucu

SEQ ID NO: 575940 - RNA, 19 nt, Homo sapiens
gcuggaaccuggugaaugg

SEQ ID NO: 575941 - RNA, 19 nt, Homo sapiens
gaacuacucagccgucugu

SEQ ID NO: 575942 - RNA, 19 nt, Homo sapiens
ccaggcagcuccucugugu

SEQ ID NO: 575943 - RNA, 19 nt, Homo sapiens
uaaauaccacuaccagaaa

SEQ ID NO: 575944 - RNA, 19 nt, Homo sapiens
cuaaauaccacuaccagaa

SEQ ID NO: 575945 - RNA, 19 nt, Homo sapiens
ggaauacaaugggaagauc

SEQ ID NO: 575946 - RNA, 19 nt, Homo sapiens
ugaaagccaugcugguaug

SEQ ID NO: 575947 - RNA, 19 nt, Homo sapiens
ggucagugcugcaauccau

SEQ ID NO: 575948 - RNA, 19 nt, Homo sapiens
gagcuguacaccagugaua

SEQ ID NO: 575949 - RNA, 19 nt, Homo sapiens
gaauaucggcuccacaaag

SEQ ID NO: 575950 - RNA, 19 nt, Homo sapiens
ggacagccgccuugcaugu

SEQ ID NO: 575951 - RNA, 19 nt, Homo sapiens
ggaguggguuuggauagga

SEQ ID NO: 575952 - RNA, 19 nt, Homo sapiens
gugauacugucaugcagaa

SEQ ID NO: 575953 - RNA, 19 nt, Homo sapiens
ggacgagaacucccugguu

SEQ ID NO: 575954 - RNA, 19 nt, Homo sapiens
caucuucgccgucuggaaa

SEQ ID NO: 575955 - RNA, 19 nt, Homo sapiens
ggagaccuuucaugugcuu

SEQ ID NO: 575956 - RNA, 19 nt, Homo sapiens
gugcugcaauccauuaauc

SEQ ID NO: 575957 - RNA, 19 nt, Homo sapiens
cagccgccuugcauguuua

SEQ ID NO: 575958 - RNA, 19 nt, Homo sapiens
guacccacauugccuccuu

SEQ ID NO: 575959 - RNA, 19 nt, Homo sapiens
gacuuuaucuucuggaaaa

SEQ ID NO: 575960 - RNA, 19 nt, Homo sapiens
auugaaggauguuugcuuu

SEQ ID NO: 575961 - RNA, 19 nt, Homo sapiens
ucagugcugcaauccauua

SEQ ID NO: 575962 - RNA, 19 nt, Homo sapiens
gaccaaggccgcugcaucu

SEQ ID NO: 575963 - RNA, 19 nt, Homo sapiens
ggaagcaggaauacaaugg

SEQ ID NO: 575964 - RNA, 19 nt, Homo sapiens
aggcuuauuucauguauag

SEQ ID NO: 575965 - RNA, 19 nt, Homo sapiens
cgccuugcauguuuauuga

SEQ ID NO: 575966 - RNA, 19 nt, Homo sapiens
cgccauuguuccacucuaa

SEQ ID NO: 575967 - RNA, 19 nt, Homo sapiens
gugaauaucggcuccacaa

SEQ ID NO: 575968 - RNA, 19 nt, Homo sapiens
cagcuucgccuucaacauc

SEQ ID NO: 575969 - RNA, 19 nt, Homo sapiens
acagccgccuugcauguuu

SEQ ID NO: 575970 - RNA, 19 nt, Homo sapiens
caugugcuuuaccuaacua

SEQ ID NO: 575971 - RNA, 19 nt, Homo sapiens
ugacaagaucuacuacuuc

SEQ ID NO: 575972 - RNA, 19 nt, Homo sapiens
cccaaacucucgcuacuac

SEQ ID NO: 575973 - RNA, 19 nt, Homo sapiens
cggaggaagcuguauguga

SEQ ID NO: 575974 - RNA, 19 nt, Homo sapiens
aauaucggcuccacaaagg

SEQ ID NO: 575975 - RNA, 19 nt, Homo sapiens
ggacugcgagaacuacauc

SEQ ID NO: 575976 - RNA, 19 nt, Homo sapiens
gaaugagggcaccgacugu

SEQ ID NO: 575977 - RNA, 19 nt, Homo sapiens
cauuguuccacucuaaaua

SEQ ID NO: 575978 - RNA, 19 nt, Homo sapiens
augacaagaucuacuacuu

SEQ ID NO: 575979 - RNA, 19 nt, Homo sapiens
gaacuucaacaggcugcaa

SEQ ID NO: 575980 - RNA, 19 nt, Homo sapiens
uggcugguguuccugaaga

SEQ ID NO: 575981 - RNA, 19 nt, Homo sapiens
ucgaugacccaagacuuua

SEQ ID NO: 575982 - RNA, 19 nt, Homo sapiens
cagccgagccacacaagga

SEQ ID NO: 575983 - RNA, 19 nt, Homo sapiens
gagcggaggaagcuguaug

SEQ ID NO: 575984 - RNA, 19 nt, Homo sapiens
ucugaaagccaugcuggua

SEQ ID NO: 575985 - RNA, 19 nt, Homo sapiens
ccaccaucgugcaccaaga

SEQ ID NO: 575986 - RNA, 19 nt, Homo sapiens
gaauaacccaguggaggau

SEQ ID NO: 575987 - RNA, 19 nt, Homo sapiens
ccaacugcauccuguucau

SEQ ID NO: 575988 - RNA, 19 nt, Homo sapiens
gcacagcuucgccuucaac

SEQ ID NO: 575989 - RNA, 19 nt, Homo sapiens
aaauaccacuaccagaaag

SEQ ID NO: 575990 - RNA, 19 nt, Homo sapiens
ggagggacaccagggucua

SEQ ID NO: 575991 - RNA, 19 nt, Homo sapiens
uuucauguauagcuacuuc

SEQ ID NO: 575992 - RNA, 19 nt, Homo sapiens
gaacggucagugcugcaau

SEQ ID NO: 575993 - RNA, 19 nt, Homo sapiens
agaccuuucaugugcuuua

SEQ ID NO: 575994 - RNA, 19 nt, Homo sapiens
uuccguaccuccucacuca

SEQ ID NO: 575995 - RNA, 19 nt, Homo sapiens
ggcuuacgaugacaagauc

SEQ ID NO: 575996 - RNA, 19 nt, Homo sapiens
ucagacucccucaaacuug

SEQ ID NO: 575997 - RNA, 19 nt, Homo sapiens
uuucaugugcuuuaccuaa

SEQ ID NO: 575998 - RNA, 19 nt, Homo sapiens
gcaggaccggguggacuuu

SEQ ID NO: 575999 - RNA, 19 nt, Homo sapiens
agaccaggcuuacgaugac

SEQ ID NO: 576000 - RNA, 19 nt, Homo sapiens
auguuaggcuuauuucaug

SEQ ID NO: 576001 - RNA, 19 nt, Homo sapiens
gggaguggguuuggauagg

SEQ ID NO: 576002 - RNA, 19 nt, Homo sapiens
cuagaacgucucacacuca

SEQ ID NO: 576003 - RNA, 19 nt, Homo sapiens
ggucuaccucuuugacuuc

SEQ ID NO: 576004 - RNA, 19 nt, Homo sapiens
guuaggcuuauuucaugua

SEQ ID NO: 576005 - RNA, 19 nt, Homo sapiens
ccaccaacaagaacuucaa

SEQ ID NO: 576006 - RNA, 19 nt, Homo sapiens
gaugcugccaccaacaaga

SEQ ID NO: 576007 - RNA, 19 nt, Homo sapiens
gcaccaagaccaggcuuac

SEQ ID NO: 576008 - RNA, 19 nt, Homo sapiens
cauguuuauugaaggaugu

SEQ ID NO: 576009 - RNA, 19 nt, Homo sapiens
gcuccuugccugccacuuc

SEQ ID NO: 576010 - RNA, 19 nt, Homo sapiens
ucggugacauugacaaggu

SEQ ID NO: 576011 - RNA, 19 nt, Homo sapiens
ccaacaagaacuucaacag

SEQ ID NO: 576012 - RNA, 19 nt, Homo sapiens
acgaugacaagaucuacua

SEQ ID NO: 576013 - RNA, 19 nt, Homo sapiens
ugaaggauguuugcuuucc

SEQ ID NO: 576014 - RNA, 19 nt, Homo sapiens
gcauccuguucaucgagaa

SEQ ID NO: 576015 - RNA, 19 nt, Homo sapiens
gccgcugcaucuccaucua

SEQ ID NO: 576016 - RNA, 19 nt, Homo sapiens
cagccgauacccacagaga

SEQ ID NO: 576017 - RNA, 19 nt, Homo sapiens
ccgccuugcauguuuauug

SEQ ID NO: 576018 - RNA, 19 nt, Homo sapiens
gacagccgccuugcauguu

SEQ ID NO: 576019 - RNA, 19 nt, Homo sapiens
caggacagccgccuugcau

SEQ ID NO: 576020 - RNA, 19 nt, Homo sapiens
ugagggcaccgacugugaa

SEQ ID NO: 576021 - RNA, 19 nt, Homo sapiens
ggugaggggcugagaauga

SEQ ID NO: 576022 - RNA, 19 nt, Homo sapiens
acucauggcgccacaagga

SEQ ID NO: 576023 - RNA, 19 nt, Homo sapiens
ugcuuuaccuaacuacaga

SEQ ID NO: 576024 - RNA, 19 nt, Homo sapiens
aagaccaggcuuacgauga

SEQ ID NO: 576025 - RNA, 19 nt, Homo sapiens
gguggcugguguuccugaa

SEQ ID NO: 576026 - RNA, 19 nt, Homo sapiens
gggcgagagugagcuguac

SEQ ID NO: 576027 - RNA, 19 nt, Homo sapiens
ugaauaucggcuccacaaa

SEQ ID NO: 576028 - RNA, 19 nt, Homo sapiens
acucagccgucugugugua

SEQ ID NO: 576029 - RNA, 19 nt, Homo sapiens
gugaugcugccaccaacaa

SEQ ID NO: 576030 - RNA, 19 nt, Homo sapiens
ggaggaaggugauuucaaa

SEQ ID NO: 576031 - RNA, 19 nt, Homo sapiens
ggccagaacugcucuaauu

SEQ ID NO: 576032 - RNA, 19 nt, Homo sapiens
gcagugggaugcucuauga

SEQ ID NO: 576033 - RNA, 19 nt, Homo sapiens
gcacauauccacagugaaa

SEQ ID NO: 576034 - RNA, 19 nt, Homo sapiens
gagcacauauccacaguga

SEQ ID NO: 576035 - RNA, 19 nt, Homo sapiens
gcaaauauacuuccucuuc

SEQ ID NO: 576036 - RNA, 19 nt, Homo sapiens
gaagagcaaugugggagua

SEQ ID NO: 576037 - RNA, 19 nt, Homo sapiens
caacgaagaugacccuaug

SEQ ID NO: 576038 - RNA, 19 nt, Homo sapiens
gagcuggacugaagacuau

SEQ ID NO: 576039 - RNA, 19 nt, Homo sapiens
gaaauuggccacugguaaa

SEQ ID NO: 576040 - RNA, 19 nt, Homo sapiens
gugggacgcugcccuguua

SEQ ID NO: 576041 - RNA, 19 nt, Homo sapiens
guugugaucuccgugauua

SEQ ID NO: 576042 - RNA, 19 nt, Homo sapiens
ggccaaagccgauggaauu

SEQ ID NO: 576043 - RNA, 19 nt, Homo sapiens
ggagugccguguuccauga

SEQ ID NO: 576044 - RNA, 19 nt, Homo sapiens
gaacuggcuucuuguccaa

SEQ ID NO: 576045 - RNA, 19 nt, Homo sapiens
gugauaaucugaugcugaa

SEQ ID NO: 576046 - RNA, 19 nt, Homo sapiens
gagauuccauccaggaguu

SEQ ID NO: 576047 - RNA, 19 nt, Homo sapiens
gaucacaaaggucaaguuu

SEQ ID NO: 576048 - RNA, 19 nt, Homo sapiens
caugauugcuuucagaaug

SEQ ID NO: 576049 - RNA, 19 nt, Homo sapiens
gaccugaccugcccaaugg

SEQ ID NO: 576050 - RNA, 19 nt, Homo sapiens
gagagguucuugccuagug

SEQ ID NO: 576051 - RNA, 19 nt, Homo sapiens
caagaugcuucgucggaaa

SEQ ID NO: 576052 - RNA, 19 nt, Homo sapiens
gccauucgcuucuacuaug

SEQ ID NO: 576053 - RNA, 19 nt, Homo sapiens
ccuaugagcuggacugaag

SEQ ID NO: 576054 - RNA, 19 nt, Homo sapiens
gaauuugcuuguuuguuuc

SEQ ID NO: 576055 - RNA, 19 nt, Homo sapiens
ccacaacuauggcaucuac

SEQ ID NO: 576056 - RNA, 19 nt, Homo sapiens
ccaacuccuucuacuauga

SEQ ID NO: 576057 - RNA, 19 nt, Homo sapiens
caaauauacuuccucuucu

SEQ ID NO: 576058 - RNA, 19 nt, Homo sapiens
uaaccuggauguuccugaa

SEQ ID NO: 576059 - RNA, 19 nt, Homo sapiens
gcaagcuggugcugaggaa

SEQ ID NO: 576060 - RNA, 19 nt, Homo sapiens
gaguagcccucaccuucaa

SEQ ID NO: 576061 - RNA, 19 nt, Homo sapiens
ggaagugguuggugaagac

SEQ ID NO: 576062 - RNA, 19 nt, Homo sapiens
ggcagagacuccauacaug

SEQ ID NO: 576063 - RNA, 19 nt, Homo sapiens
caauagugauaaucugaug

SEQ ID NO: 576064 - RNA, 19 nt, Homo sapiens
caaacugucacuugguuaa

SEQ ID NO: 576065 - RNA, 19 nt, Homo sapiens
caagaugccagagcacaua

SEQ ID NO: 576066 - RNA, 19 nt, Homo sapiens
gugcagggcagcaggauaa

SEQ ID NO: 576067 - RNA, 19 nt, Homo sapiens
gccagaacugcucuaauua

SEQ ID NO: 576068 - RNA, 19 nt, Homo sapiens
cagaacugcucuaauuaca

SEQ ID NO: 576069 - RNA, 19 nt, Homo sapiens
gauaaucugaugcugaaga

SEQ ID NO: 576070 - RNA, 19 nt, Homo sapiens
caacaccaccaaagugcua

SEQ ID NO: 576071 - RNA, 19 nt, Homo sapiens
gcaaaagcauccugaagau

SEQ ID NO: 576072 - RNA, 19 nt, Homo sapiens
cuucaacuguacuucauuu

SEQ ID NO: 576073 - RNA, 19 nt, Homo sapiens
cacaaacugucacuugguu

SEQ ID NO: 576074 - RNA, 19 nt, Homo sapiens
gggcagagacuccauacau

SEQ ID NO: 576075 - RNA, 19 nt, Homo sapiens
acauauaaaugguggugaa

SEQ ID NO: 576076 - RNA, 19 nt, Homo sapiens
gcccaccucugcaauagug

SEQ ID NO: 576077 - RNA, 19 nt, Homo sapiens
gaacaaaagagaagacaga

SEQ ID NO: 576078 - RNA, 19 nt, Homo sapiens
gaaggcagccaccaucaag

SEQ ID NO: 576079 - RNA, 19 nt, Homo sapiens
gucaaccacuugccacuug

SEQ ID NO: 576080 - RNA, 19 nt, Homo sapiens
ggaccgcauuccagaguca

SEQ ID NO: 576081 - RNA, 19 nt, Homo sapiens
guaaaacucugcagcuuca

SEQ ID NO: 576082 - RNA, 19 nt, Homo sapiens
gauggcuccuccagaauca

SEQ ID NO: 576083 - RNA, 19 nt, Homo sapiens
aagacagcuuuccagauua

SEQ ID NO: 576084 - RNA, 19 nt, Homo sapiens
ccacagcugcccagacuga

SEQ ID NO: 576085 - RNA, 19 nt, Homo sapiens
uggacaggcugcagaaguu

SEQ ID NO: 576086 - RNA, 19 nt, Homo sapiens
ggugaaugcugacugugau

SEQ ID NO: 576087 - RNA, 19 nt, Homo sapiens
gcacccacaucuaccucuu

SEQ ID NO: 576088 - RNA, 19 nt, Homo sapiens
gcgugucucugugcuguaa

SEQ ID NO: 576089 - RNA, 19 nt, Homo sapiens
ugaugaacccugagacaaa

SEQ ID NO: 576090 - RNA, 19 nt, Homo sapiens
ucacaaugcccaagacuag

SEQ ID NO: 576091 - RNA, 19 nt, Homo sapiens
gcaucuacacugucacuga

SEQ ID NO: 576092 - RNA, 19 nt, Homo sapiens
gggaagugguuggugaaga

SEQ ID NO: 576093 - RNA, 19 nt, Homo sapiens
aagcaugacuggcuacaag

SEQ ID NO: 576094 - RNA, 19 nt, Homo sapiens
caccaacuccuucuacuau

SEQ ID NO: 576095 - RNA, 19 nt, Homo sapiens
gcgggaagggcgacuauga

SEQ ID NO: 576096 - RNA, 19 nt, Homo sapiens
ccaggugaaugcugacugu

SEQ ID NO: 576097 - RNA, 19 nt, Homo sapiens
ggaguagcccucaccuuca

SEQ ID NO: 576098 - RNA, 19 nt, Homo sapiens
ccagaaucaugaagagcaa

SEQ ID NO: 576099 - RNA, 19 nt, Homo sapiens
gugggaugcucuaugauca

SEQ ID NO: 576100 - RNA, 19 nt, Homo sapiens
agacagcuuuccagauuag

SEQ ID NO: 576101 - RNA, 19 nt, Homo sapiens
gaaacucuggucacucaau

SEQ ID NO: 576102 - RNA, 19 nt, Homo sapiens
gcuacacgcuacccaccaa

SEQ ID NO: 576103 - RNA, 19 nt, Homo sapiens
gcagugaggccagcgaaga

SEQ ID NO: 576104 - RNA, 19 nt, Homo sapiens
agaaauuggccacugguaa

SEQ ID NO: 576105 - RNA, 19 nt, Homo sapiens
ggaggaggaaggugauuuc

SEQ ID NO: 576106 - RNA, 19 nt, Homo sapiens
caaagccgauggaauucag

SEQ ID NO: 576107 - RNA, 19 nt, Homo sapiens
ggaucgauaugacuacaac

SEQ ID NO: 576108 - RNA, 19 nt, Homo sapiens
ggacaggcugcagaaguuu

SEQ ID NO: 576109 - RNA, 19 nt, Homo sapiens
ccugagagcuaucuuaucc

SEQ ID NO: 576110 - RNA, 19 nt, Homo sapiens
gcacuucuguuuucgugaa

SEQ ID NO: 576111 - RNA, 19 nt, Homo sapiens
ugacagccauugugagacu

SEQ ID NO: 576112 - RNA, 19 nt, Homo sapiens
cuucugcccucauuucaug

SEQ ID NO: 576113 - RNA, 19 nt, Homo sapiens
ucugagauuuccuagaguu

SEQ ID NO: 576114 - RNA, 19 nt, Homo sapiens
ccaccaacuccuucuacua

SEQ ID NO: 576115 - RNA, 19 nt, Homo sapiens
gaugaacccugagacaaaa

SEQ ID NO: 576116 - RNA, 19 nt, Homo sapiens
cagacucgcacacgcauuu

SEQ ID NO: 576117 - RNA, 19 nt, Homo sapiens
gaccaaggccuggguguuc

SEQ ID NO: 576118 - RNA, 19 nt, Homo sapiens
gugccugccuucugugaug

SEQ ID NO: 576119 - RNA, 19 nt, Homo sapiens
gugcuaccuuucaacaaga

SEQ ID NO: 576120 - RNA, 19 nt, Homo sapiens
ggacgcugcccuguuaaga

SEQ ID NO: 576121 - RNA, 19 nt, Homo sapiens
acugucacuugguuaauuu

SEQ ID NO: 576122 - RNA, 19 nt, Homo sapiens
gcacaaacugucacuuggu

SEQ ID NO: 576123 - RNA, 19 nt, Homo sapiens
uccgauggcuccuccagaa

SEQ ID NO: 576124 - RNA, 19 nt, Homo sapiens
ggaccagcccaaugucuca

SEQ ID NO: 576125 - RNA, 19 nt, Homo sapiens
ggacagggaccagcccaau

SEQ ID NO: 576126 - RNA, 19 nt, Homo sapiens
ccucagcccuaucucaaca

SEQ ID NO: 576127 - RNA, 19 nt, Homo sapiens
ggacgccauucgcuucuac

SEQ ID NO: 576128 - RNA, 19 nt, Homo sapiens
gcccaagacuagccugaag

SEQ ID NO: 576129 - RNA, 19 nt, Homo sapiens
aaaugguggugaaauaaag

SEQ ID NO: 576130 - RNA, 19 nt, Homo sapiens
ucaucuaccucaccaugua

SEQ ID NO: 576131 - RNA, 19 nt, Homo sapiens
gcugaugcccagaacauuu

SEQ ID NO: 576132 - RNA, 19 nt, Homo sapiens
ggucuuugcccuaaucuuc

SEQ ID NO: 576133 - RNA, 19 nt, Homo sapiens
ccacggaccuguucauccu

SEQ ID NO: 576134 - RNA, 19 nt, Homo sapiens
cauguacgccagcagcuuu

SEQ ID NO: 576135 - RNA, 19 nt, Homo sapiens
cuggaugccuggcucuuug

SEQ ID NO: 576136 - RNA, 19 nt, Homo sapiens
ccuguggucuuugcccuaa

SEQ ID NO: 576137 - RNA, 19 nt, Homo sapiens
cgcccuaccucagcuacua

SEQ ID NO: 576138 - RNA, 19 nt, Homo sapiens
ccgugcaccugcucaucua

SEQ ID NO: 576139 - RNA, 19 nt, Homo sapiens
gcuggaugccuggcucuuu

SEQ ID NO: 576140 - RNA, 19 nt, Homo sapiens
gcgcucauccugugcuucu

SEQ ID NO: 576141 - RNA, 19 nt, Homo sapiens
gaagauggcuuuaugcuuu

SEQ ID NO: 576142 - RNA, 19 nt, Homo sapiens
gaagaaggcuggaagaaau

SEQ ID NO: 576143 - RNA, 19 nt, Homo sapiens
caacacaucuucaacacua

SEQ ID NO: 576144 - RNA, 19 nt, Homo sapiens
ggaacuggcugguuugaaa

SEQ ID NO: 576145 - RNA, 19 nt, Homo sapiens
gaauauggguugauuugaa

SEQ ID NO: 576146 - RNA, 19 nt, Homo sapiens
uaacuagugucuuggaaua

SEQ ID NO: 576147 - RNA, 19 nt, Homo sapiens
gagcggaacuggcugguuu

SEQ ID NO: 576148 - RNA, 19 nt, Homo sapiens
gaagauauuucucaugaag

SEQ ID NO: 576149 - RNA, 19 nt, Homo sapiens
gcaagaaggugcucugaag

SEQ ID NO: 576150 - RNA, 19 nt, Homo sapiens
gaagcaaagugugaauauu

SEQ ID NO: 576151 - RNA, 19 nt, Homo sapiens
aaaugaaaguccuggaaua

SEQ ID NO: 576152 - RNA, 19 nt, Homo sapiens
guacagauuucaacacauc

SEQ ID NO: 576153 - RNA, 19 nt, Homo sapiens
uggaauaucugaguaauug

SEQ ID NO: 576154 - RNA, 19 nt, Homo sapiens
gaucgaagcagcucaaugu

SEQ ID NO: 576155 - RNA, 19 nt, Homo sapiens
gacagaaugugaacaaaca

SEQ ID NO: 576156 - RNA, 19 nt, Homo sapiens
gguagagccuugcgacuug

SEQ ID NO: 576157 - RNA, 19 nt, Homo sapiens
ugauguagcugaucucuca

SEQ ID NO: 576158 - RNA, 19 nt, Homo sapiens
agacuuuacuccagaauug

SEQ ID NO: 576159 - RNA, 19 nt, Homo sapiens
caucuuaaccugugcaauu

SEQ ID NO: 576160 - RNA, 19 nt, Homo sapiens
ggaagcaaagugugaauau

SEQ ID NO: 576161 - RNA, 19 nt, Homo sapiens
ugaaaguccuggaauagau

SEQ ID NO: 576162 - RNA, 19 nt, Homo sapiens
gcaacaaguggcacaguuu

SEQ ID NO: 576163 - RNA, 19 nt, Homo sapiens
gcgccuaaggugucuauua

SEQ ID NO: 576164 - RNA, 19 nt, Homo sapiens
gaaaguccuggaauagauu

SEQ ID NO: 576165 - RNA, 19 nt, Homo sapiens
caaagaaguugaaaaggaa

SEQ ID NO: 576166 - RNA, 19 nt, Homo sapiens
ggaaaacaaugccaauuca

SEQ ID NO: 576167 - RNA, 19 nt, Homo sapiens
ugaacaguuugaacaguuu

SEQ ID NO: 576168 - RNA, 19 nt, Homo sapiens
gaauugggaagauggcuuu

SEQ ID NO: 576169 - RNA, 19 nt, Homo sapiens
caaauugacccaaagaagu

SEQ ID NO: 576170 - RNA, 19 nt, Homo sapiens
ccaauucaaguacagauuu

SEQ ID NO: 576171 - RNA, 19 nt, Homo sapiens
ggaccagccacaaaugaaa

SEQ ID NO: 576172 - RNA, 19 nt, Homo sapiens
ccaaagaaguugaaaagga

SEQ ID NO: 576173 - RNA, 19 nt, Homo sapiens
gugaggcucuuaguggaua

SEQ ID NO: 576174 - RNA, 19 nt, Homo sapiens
aagauggcuuuaugcuuua

SEQ ID NO: 576175 - RNA, 19 nt, Homo sapiens
acauagaagucacuggaaa

SEQ ID NO: 576176 - RNA, 19 nt, Homo sapiens
gcagcucaauguccagaug

SEQ ID NO: 576177 - RNA, 19 nt, Homo sapiens
guugaugccucggcuauug

SEQ ID NO: 576178 - RNA, 19 nt, Homo sapiens
cagaauauggguugauuug

SEQ ID NO: 576179 - RNA, 19 nt, Homo sapiens
uuuauuggcuugucuugaa

SEQ ID NO: 576180 - RNA, 19 nt, Homo sapiens
gaggguuccugcuuugaau

SEQ ID NO: 576181 - RNA, 19 nt, Homo sapiens
ucucagggauagaagauau

SEQ ID NO: 576182 - RNA, 19 nt, Homo sapiens
aacaguaacuagugucuug

SEQ ID NO: 576183 - RNA, 19 nt, Homo sapiens
gaaugaaucaggcaacagu

SEQ ID NO: 576184 - RNA, 19 nt, Homo sapiens
ugagaggguuccugcuuug

SEQ ID NO: 576185 - RNA, 19 nt, Homo sapiens
uaauugguuuggagaaaga

SEQ ID NO: 576186 - RNA, 19 nt, Homo sapiens
agaaggugcucugaaguga

SEQ ID NO: 576187 - RNA, 19 nt, Homo sapiens
ggaagauggcuuuaugcuu

SEQ ID NO: 576188 - RNA, 19 nt, Homo sapiens
ugaagaaggcuggaagaaa

SEQ ID NO: 576189 - RNA, 19 nt, Homo sapiens
caauucaaguacagauuuc

SEQ ID NO: 576190 - RNA, 19 nt, Homo sapiens
cagccuaacucugaggaaa

SEQ ID NO: 576191 - RNA, 19 nt, Homo sapiens
gaugaacaguuugaacagu

SEQ ID NO: 576192 - RNA, 19 nt, Homo sapiens
gaugagaggguuccugcuu

SEQ ID NO: 576193 - RNA, 19 nt, Homo sapiens
caaaugaaaguccuggaau

SEQ ID NO: 576194 - RNA, 19 nt, Homo sapiens
guaauugguuuggagaaag

SEQ ID NO: 576195 - RNA, 19 nt, Homo sapiens
ucagauugauacucagaau

SEQ ID NO: 576196 - RNA, 19 nt, Homo sapiens
uuuccucccuugcuuagua

SEQ ID NO: 576197 - RNA, 19 nt, Homo sapiens
ggauaguaaugugacaaug

SEQ ID NO: 576198 - RNA, 19 nt, Homo sapiens
gcucuuaguggauagcaaa

SEQ ID NO: 576199 - RNA, 19 nt, Homo sapiens
aaauugacccaaagaaguu

SEQ ID NO: 576200 - RNA, 19 nt, Homo sapiens
cagcuugcauagaaauugu

SEQ ID NO: 576201 - RNA, 19 nt, Homo sapiens
gguuccugcuuugaauuua

SEQ ID NO: 576202 - RNA, 19 nt, Homo sapiens
aaacaaugccaauucaagu

SEQ ID NO: 576203 - RNA, 19 nt, Homo sapiens
gauugauacucagaauaug

SEQ ID NO: 576204 - RNA, 19 nt, Homo sapiens
gugugaauauuucucuuuc

SEQ ID NO: 576205 - RNA, 19 nt, Homo sapiens
gcagcuugcauagaaauug

SEQ ID NO: 576206 - RNA, 19 nt, Homo sapiens
ggaaaaucccacucaguuu

SEQ ID NO: 576207 - RNA, 19 nt, Homo sapiens
cagauugauacucagaaua

SEQ ID NO: 576208 - RNA, 19 nt, Homo sapiens
cagaaugaaucaggcaaca

SEQ ID NO: 576209 - RNA, 19 nt, Homo sapiens
guagagccuugcgacuuga

SEQ ID NO: 576210 - RNA, 19 nt, Homo sapiens
gaugaagaaggcuggaaga

SEQ ID NO: 576211 - RNA, 19 nt, Homo sapiens
guaaugugacaaugccaaa

SEQ ID NO: 576212 - RNA, 19 nt, Homo sapiens
guuccugcuuugaauuuau

SEQ ID NO: 576213 - RNA, 19 nt, Homo sapiens
gaggcucauucacugauuc

SEQ ID NO: 576214 - RNA, 19 nt, Homo sapiens
aaguacagauuucaacaca

SEQ ID NO: 576215 - RNA, 19 nt, Homo sapiens
uugggaagauggcuuuaug

SEQ ID NO: 576216 - RNA, 19 nt, Homo sapiens
gaauaucugaguaauuggu

SEQ ID NO: 576217 - RNA, 19 nt, Homo sapiens
acaguuggauaguaaugug

SEQ ID NO: 576218 - RNA, 19 nt, Homo sapiens
gcucugaagugaggcucuu

SEQ ID NO: 576219 - RNA, 19 nt, Homo sapiens
gagacuuuacuccagaauu

SEQ ID NO: 576220 - RNA, 19 nt, Homo sapiens
aguaauugguuuggagaaa

SEQ ID NO: 576221 - RNA, 19 nt, Homo sapiens
augaacaguuugaacaguu

SEQ ID NO: 576222 - RNA, 19 nt, Homo sapiens
caucuucaacacuauguga

SEQ ID NO: 576223 - RNA, 19 nt, Homo sapiens
guccuggaauagauuaugu

SEQ ID NO: 576224 - RNA, 19 nt, Homo sapiens
gauaguaaugugacaaugc

SEQ ID NO: 576225 - RNA, 19 nt, Homo sapiens
agcaaagugugaauauuuc

SEQ ID NO: 576226 - RNA, 19 nt, Homo sapiens
aacaaugccaauucaagua

SEQ ID NO: 576227 - RNA, 19 nt, Homo sapiens
augagaggguuccugcuuu

SEQ ID NO: 576228 - RNA, 19 nt, Homo sapiens
cgacuugacggaagguuuc

SEQ ID NO: 576229 - RNA, 19 nt, Homo sapiens
acaaaugaaaguccuggaa

SEQ ID NO: 576230 - RNA, 19 nt, Homo sapiens
gaagucacuggaaaucaca

SEQ ID NO: 576231 - RNA, 19 nt, Homo sapiens
guaacuagugucuuggaau

SEQ ID NO: 576232 - RNA, 19 nt, Homo sapiens
aaaguccuggaauagauua

SEQ ID NO: 576233 - RNA, 19 nt, Homo sapiens
cauagaagucacuggaaau

SEQ ID NO: 576234 - RNA, 19 nt, Homo sapiens
ggguugauuugaauaucug

SEQ ID NO: 576235 - RNA, 19 nt, Homo sapiens
gauuucaacacaucuucaa

SEQ ID NO: 576236 - RNA, 19 nt, Homo sapiens
ucagggauagaagauauuu

SEQ ID NO: 576237 - RNA, 19 nt, Homo sapiens
ggguuccugcuuugaauuu

SEQ ID NO: 576238 - RNA, 19 nt, Homo sapiens
cuuaguggauagcaaagau

SEQ ID NO: 576239 - RNA, 19 nt, Homo sapiens
gaguugaugccucggcuau

SEQ ID NO: 576240 - RNA, 19 nt, Homo sapiens
gaaggguucacaucuuaac

SEQ ID NO: 576241 - RNA, 19 nt, Homo sapiens
gaauguggguuaaguaaua

SEQ ID NO: 576242 - RNA, 19 nt, Homo sapiens
gaaaucauccugugaguua

SEQ ID NO: 576243 - RNA, 19 nt, Homo sapiens
caaaggagcuuaauugauc

SEQ ID NO: 576244 - RNA, 19 nt, Homo sapiens
gaccuaagaucaacaauga

SEQ ID NO: 576245 - RNA, 19 nt, Homo sapiens
caagauggcuauaugcuaa

SEQ ID NO: 576246 - RNA, 19 nt, Homo sapiens
cuaaagaggugaauauuga

SEQ ID NO: 576247 - RNA, 19 nt, Homo sapiens
ggacagaccuauuucaaag

SEQ ID NO: 576248 - RNA, 19 nt, Homo sapiens
ccaaggagauuaagaucaa

SEQ ID NO: 576249 - RNA, 19 nt, Homo sapiens
guaauagauuuccagcuaa

SEQ ID NO: 576250 - RNA, 19 nt, Homo sapiens
caaacuaagccauguauga

SEQ ID NO: 576251 - RNA, 19 nt, Homo sapiens
aguaauagauuuccagcua

SEQ ID NO: 576252 - RNA, 19 nt, Homo sapiens
gauuauaagucuugcuaga

SEQ ID NO: 576253 - RNA, 19 nt, Homo sapiens
acacugcuuuggauacuua

SEQ ID NO: 576254 - RNA, 19 nt, Homo sapiens
caguauuccuucacuauuu

SEQ ID NO: 576255 - RNA, 19 nt, Homo sapiens
gcucugcuguuaagaaguu

SEQ ID NO: 576256 - RNA, 19 nt, Homo sapiens
gaaagggccaaggagauua

SEQ ID NO: 576257 - RNA, 19 nt, Homo sapiens
cuaaggacaucacaaugaa

SEQ ID NO: 576258 - RNA, 19 nt, Homo sapiens
gagauacaaccaugaauau

SEQ ID NO: 576259 - RNA, 19 nt, Homo sapiens
ggaaagggccaaggagauu

SEQ ID NO: 576260 - RNA, 19 nt, Homo sapiens
gagaucaccccucuaauua

SEQ ID NO: 576261 - RNA, 19 nt, Homo sapiens
gagaaggcaaagcaaauuu

SEQ ID NO: 576262 - RNA, 19 nt, Homo sapiens
aaaguuuccugaagucuga

SEQ ID NO: 576263 - RNA, 19 nt, Homo sapiens
gaaggcaaagcaaauuuau

SEQ ID NO: 576264 - RNA, 19 nt, Homo sapiens
ugaagcagccacuguauga

SEQ ID NO: 576265 - RNA, 19 nt, Homo sapiens
aagacuggcucugcuguua

SEQ ID NO: 576266 - RNA, 19 nt, Homo sapiens
ccaccuaaauaucaagaug

SEQ ID NO: 576267 - RNA, 19 nt, Homo sapiens
agacaagacuaugauauca

SEQ ID NO: 576268 - RNA, 19 nt, Homo sapiens
acuauggacuugccaguuu

SEQ ID NO: 576269 - RNA, 19 nt, Homo sapiens
gaaucaaacuaagccaugu

SEQ ID NO: 576270 - RNA, 19 nt, Homo sapiens
agagauacaaccaugaaua

SEQ ID NO: 576271 - RNA, 19 nt, Homo sapiens
gaucaccccucuaauuauu

SEQ ID NO: 576272 - RNA, 19 nt, Homo sapiens
cagaacaacuauggacuug

SEQ ID NO: 576273 - RNA, 19 nt, Homo sapiens
uaaauaauaggccauagga

SEQ ID NO: 576274 - RNA, 19 nt, Homo sapiens
cuauuucgcuuccugcauu

SEQ ID NO: 576275 - RNA, 19 nt, Homo sapiens
gcaaagcaaauuuaugaag

SEQ ID NO: 576276 - RNA, 19 nt, Homo sapiens
gagcuuaauugaucucacu

SEQ ID NO: 576277 - RNA, 19 nt, Homo sapiens
uaaucgagaugaggauauu

SEQ ID NO: 576278 - RNA, 19 nt, Homo sapiens
gagaaaauauggucaaguc

SEQ ID NO: 576279 - RNA, 19 nt, Homo sapiens
aggcaaagcaaauuuauga

SEQ ID NO: 576280 - RNA, 19 nt, Homo sapiens
gcagaacaacuauggacuu

SEQ ID NO: 576281 - RNA, 19 nt, Homo sapiens
uaagagauacaaccaugaa

SEQ ID NO: 576282 - RNA, 19 nt, Homo sapiens
gcccuguuauuaauuaaga

SEQ ID NO: 576283 - RNA, 19 nt, Homo sapiens
cauaauaacccugcauuuc

SEQ ID NO: 576284 - RNA, 19 nt, Homo sapiens
agaaggcaaagcaaauuua

SEQ ID NO: 576285 - RNA, 19 nt, Homo sapiens
gaaaauauggucaagucua

SEQ ID NO: 576286 - RNA, 19 nt, Homo sapiens
ccugcccuguuauuaauua

SEQ ID NO: 576287 - RNA, 19 nt, Homo sapiens
uaucaggaguuaaucaagu

SEQ ID NO: 576288 - RNA, 19 nt, Homo sapiens
agucaaaagugcagauuua

SEQ ID NO: 576289 - RNA, 19 nt, Homo sapiens
ugaaacuguugcuccauug

SEQ ID NO: 576290 - RNA, 19 nt, Homo sapiens
cauguuaguuggguauuau

SEQ ID NO: 576291 - RNA, 19 nt, Homo sapiens
ggagaucaccccucuaauu

SEQ ID NO: 576292 - RNA, 19 nt, Homo sapiens
gcucagugauacccacaug

SEQ ID NO: 576293 - RNA, 19 nt, Homo sapiens
gagaugaggauauuaacuc

SEQ ID NO: 576294 - RNA, 19 nt, Homo sapiens
ucauguuaguuggguauua

SEQ ID NO: 576295 - RNA, 19 nt, Homo sapiens
caaugaauguggguuaagu

SEQ ID NO: 576296 - RNA, 19 nt, Homo sapiens
ggaguuaaucaaguaguaa

SEQ ID NO: 576297 - RNA, 19 nt, Homo sapiens
caaaagaaauagggugauu

SEQ ID NO: 576298 - RNA, 19 nt, Homo sapiens
acaccaaauugucuuuaga

SEQ ID NO: 576299 - RNA, 19 nt, Homo sapiens
uaucaaugaauguggguua

SEQ ID NO: 576300 - RNA, 19 nt, Homo sapiens
ggauguugcuuacucuuuu

SEQ ID NO: 576301 - RNA, 19 nt, Homo sapiens
gcuuugacauggcccagaa

SEQ ID NO: 576302 - RNA, 19 nt, Homo sapiens
acaaacuccugcagaacaa

SEQ ID NO: 576303 - RNA, 19 nt, Homo sapiens
gacaaacuccugcagaaca

SEQ ID NO: 576304 - RNA, 19 nt, Homo sapiens
uggacaaacuccugcagaa

SEQ ID NO: 576305 - RNA, 19 nt, Homo sapiens
guaacagaaucaaacuaag

SEQ ID NO: 576306 - RNA, 19 nt, Homo sapiens
aagcagccacuguaugaua

SEQ ID NO: 576307 - RNA, 19 nt, Homo sapiens
ucacuaaggacaucacaau

SEQ ID NO: 576308 - RNA, 19 nt, Homo sapiens
ggaccaccuucauguuagu

SEQ ID NO: 576309 - RNA, 19 nt, Homo sapiens
uuucaaaggagcuuaauug

SEQ ID NO: 576310 - RNA, 19 nt, Homo sapiens
aagaauccaugcccugaug

SEQ ID NO: 576311 - RNA, 19 nt, Homo sapiens
ggauugccugugaggauua

SEQ ID NO: 576312 - RNA, 19 nt, Homo sapiens
gugagacacuuuuaaggua

SEQ ID NO: 576313 - RNA, 19 nt, Homo sapiens
acagaccuauuucaaagga

SEQ ID NO: 576314 - RNA, 19 nt, Homo sapiens
ccagcuaaauuggucuaaa

SEQ ID NO: 576315 - RNA, 19 nt, Homo sapiens
aacccugcauuucccauua

SEQ ID NO: 576316 - RNA, 19 nt, Homo sapiens
gugauucccuggacaaacu

SEQ ID NO: 576317 - RNA, 19 nt, Homo sapiens
gcccugcaguggcgugauu

SEQ ID NO: 576318 - RNA, 19 nt, Homo sapiens
aauauuaaguguggacaga

SEQ ID NO: 576319 - RNA, 19 nt, Homo sapiens
cagcuaaauuggucuaaaa

SEQ ID NO: 576320 - RNA, 19 nt, Homo sapiens
gcagcuuugcucagugaua

SEQ ID NO: 576321 - RNA, 19 nt, Homo sapiens
aggaguuaaucaaguagua

SEQ ID NO: 576322 - RNA, 19 nt, Homo sapiens
guagucucccaccuaaaua

SEQ ID NO: 576323 - RNA, 19 nt, Homo sapiens
gcccauagucaccaaauuc

SEQ ID NO: 576324 - RNA, 19 nt, Homo sapiens
gggauguugcuuacucuuu

SEQ ID NO: 576325 - RNA, 19 nt, Homo sapiens
gugaguuauuuccuccaua

SEQ ID NO: 576326 - RNA, 19 nt, Homo sapiens
acaaugagaagccagagaa

SEQ ID NO: 576327 - RNA, 19 nt, Homo sapiens
ccuaaagaggugaauauug

SEQ ID NO: 576328 - RNA, 19 nt, Homo sapiens
cacagaauuuaguaacaga

SEQ ID NO: 576329 - RNA, 19 nt, Homo sapiens
ucaagauggcuauaugcua

SEQ ID NO: 576330 - RNA, 19 nt, Homo sapiens
cagccacuguaugauauuu

SEQ ID NO: 576331 - RNA, 19 nt, Homo sapiens
gaucucacuuguuuuaguu

SEQ ID NO: 576332 - RNA, 19 nt, Homo sapiens
gcugagaaggcaaagcaaa

SEQ ID NO: 576333 - RNA, 19 nt, Homo sapiens
agacucaguuggugaccuu

SEQ ID NO: 576334 - RNA, 19 nt, Homo sapiens
ucacagaauuuaguaacag

SEQ ID NO: 576335 - RNA, 19 nt, Homo sapiens
ccagaagccagacucaguu

SEQ ID NO: 576336 - RNA, 19 nt, Homo sapiens
acuaaggacaucacaauga

SEQ ID NO: 576337 - RNA, 19 nt, Homo sapiens
ccacuucacuaaggacauc

SEQ ID NO: 576338 - RNA, 19 nt, Homo sapiens
ggagauuaagaucaaguug

SEQ ID NO: 576339 - RNA, 19 nt, Homo sapiens
uaauaggccauaggacuuu

SEQ ID NO: 576340 - RNA, 19 nt, Homo sapiens
ucaaugaccuaagaucaac

SEQ ID NO: 576341 - RNA, 19 nt, Homo sapiens
gaaauuugauccacccuua

SEQ ID NO: 576342 - RNA, 19 nt, Homo sapiens
gaaaguaggccaacugaua

SEQ ID NO: 576343 - RNA, 19 nt, Homo sapiens
acacaaaccuguugccuua

SEQ ID NO: 576344 - RNA, 19 nt, Homo sapiens
gagauaagcuuuggauuug

SEQ ID NO: 576345 - RNA, 19 nt, Homo sapiens
gaauagcgguaccaugaua

SEQ ID NO: 576346 - RNA, 19 nt, Homo sapiens
gaacagcuauucccucgaa

SEQ ID NO: 576347 - RNA, 19 nt, Homo sapiens
caucagaacucaccuuuga

SEQ ID NO: 576348 - RNA, 19 nt, Homo sapiens
caaacucccugacagaaua

SEQ ID NO: 576349 - RNA, 19 nt, Homo sapiens
ugaacgagauggcucauua

SEQ ID NO: 576350 - RNA, 19 nt, Homo sapiens
caaucgagcuguuggauaa

SEQ ID NO: 576351 - RNA, 19 nt, Homo sapiens
gaaccaaugcagaaauuua

SEQ ID NO: 576352 - RNA, 19 nt, Homo sapiens
agaauucacucaacaagua

SEQ ID NO: 576353 - RNA, 19 nt, Homo sapiens
gagaaacacugcagggauu

SEQ ID NO: 576354 - RNA, 19 nt, Homo sapiens
guacauauaggcaguauuu

SEQ ID NO: 576355 - RNA, 19 nt, Homo sapiens
ucagauagcacaagaauuu

SEQ ID NO: 576356 - RNA, 19 nt, Homo sapiens
ggacaguucagaagaaaua

SEQ ID NO: 576357 - RNA, 19 nt, Homo sapiens
gggaaucacugccauagaa

SEQ ID NO: 576358 - RNA, 19 nt, Homo sapiens
gcaaagccaucccaaguuc

SEQ ID NO: 576359 - RNA, 19 nt, Homo sapiens
ggagaagacuuugcaguug

SEQ ID NO: 576360 - RNA, 19 nt, Homo sapiens
gcaguaaccugucuucagu

SEQ ID NO: 576361 - RNA, 19 nt, Homo sapiens
ugaaggagaugaugaugaa

SEQ ID NO: 576362 - RNA, 19 nt, Homo sapiens
aaacggaagucuuucauug

SEQ ID NO: 576363 - RNA, 19 nt, Homo sapiens
ucauauugcugaagacaua

SEQ ID NO: 576364 - RNA, 19 nt, Homo sapiens
ccacacaagugcuuaauuc

SEQ ID NO: 576365 - RNA, 19 nt, Homo sapiens
ggagagagauaccauccuu

SEQ ID NO: 576366 - RNA, 19 nt, Homo sapiens
ggaguacccuuuaguuugu

SEQ ID NO: 576367 - RNA, 19 nt, Homo sapiens
gaacaggaguacccuuuag

SEQ ID NO: 576368 - RNA, 19 nt, Homo sapiens
caagagaugucccauguca

SEQ ID NO: 576369 - RNA, 19 nt, Homo sapiens
aaaguaagcugugacauug

SEQ ID NO: 576370 - RNA, 19 nt, Homo sapiens
acaguuaacucuagaaaga

SEQ ID NO: 576371 - RNA, 19 nt, Homo sapiens
gaaguguuguguuguaaga

SEQ ID NO: 576372 - RNA, 19 nt, Homo sapiens
aaaguuaccuguugcuauu

SEQ ID NO: 576373 - RNA, 19 nt, Homo sapiens
aaagggagcuaacauucua

SEQ ID NO: 576374 - RNA, 19 nt, Homo sapiens
uguuaacacuggugaauua

SEQ ID NO: 576375 - RNA, 19 nt, Homo sapiens
gacuagcauuguucuauua

SEQ ID NO: 576376 - RNA, 19 nt, Homo sapiens
uaccaaagccuauuaguaa

SEQ ID NO: 576377 - RNA, 19 nt, Homo sapiens
gaggacacgucgcacauuu

SEQ ID NO: 576378 - RNA, 19 nt, Homo sapiens
gaaauauacuacacugcaa

SEQ ID NO: 576379 - RNA, 19 nt, Homo sapiens
ggauaauggucaugugaaa

SEQ ID NO: 576380 - RNA, 19 nt, Homo sapiens
ccagaaguguuguguugua

SEQ ID NO: 576381 - RNA, 19 nt, Homo sapiens
aaagaaagauguaccaaag

SEQ ID NO: 576382 - RNA, 19 nt, Homo sapiens
gcaggaaauugucaucaga

SEQ ID NO: 576383 - RNA, 19 nt, Homo sapiens
gauauuuggugccgaagaa

SEQ ID NO: 576384 - RNA, 19 nt, Homo sapiens
ggagcuaacauucuauuaa

SEQ ID NO: 576385 - RNA, 19 nt, Homo sapiens
cacaagugcuuaauucauu

SEQ ID NO: 576386 - RNA, 19 nt, Homo sapiens
agacaaauguuacucaugu

SEQ ID NO: 576387 - RNA, 19 nt, Homo sapiens
cgagauaagcuuuggauuu

SEQ ID NO: 576388 - RNA, 19 nt, Homo sapiens
gcgguaccaugauagaaua

SEQ ID NO: 576389 - RNA, 19 nt, Homo sapiens
cagaauagcgguaccauga

SEQ ID NO: 576390 - RNA, 19 nt, Homo sapiens
ccuauaccauguccacuua

SEQ ID NO: 576391 - RNA, 19 nt, Homo sapiens
guaccaaagccuauuagua

SEQ ID NO: 576392 - RNA, 19 nt, Homo sapiens
ucuaaacacucaacucuga

SEQ ID NO: 576393 - RNA, 19 nt, Homo sapiens
ccacuuagaauguuugaaa

SEQ ID NO: 576394 - RNA, 19 nt, Homo sapiens
gagaagacuuugcaguugu

SEQ ID NO: 576395 - RNA, 19 nt, Homo sapiens
cugaagaacuguaacauuc

SEQ ID NO: 576396 - RNA, 19 nt, Homo sapiens
cgagauggcucauuauguc

SEQ ID NO: 576397 - RNA, 19 nt, Homo sapiens
gagcuaacauucuauuaac

SEQ ID NO: 576398 - RNA, 19 nt, Homo sapiens
guucaaauuucucuuggaa

SEQ ID NO: 576399 - RNA, 19 nt, Homo sapiens
cuaaugagguaacacaaga

SEQ ID NO: 576400 - RNA, 19 nt, Homo sapiens
gaaauggaaugagcuccuu

SEQ ID NO: 576401 - RNA, 19 nt, Homo sapiens
caccaaagccuaagucuau

SEQ ID NO: 576402 - RNA, 19 nt, Homo sapiens
cacaagaaauuucagauag

SEQ ID NO: 576403 - RNA, 19 nt, Homo sapiens
gcucagagauaaccuuugg

SEQ ID NO: 576404 - RNA, 19 nt, Homo sapiens
acccaaauauuguugcuua

SEQ ID NO: 576405 - RNA, 19 nt, Homo sapiens
guagaaacgugagagaaga

SEQ ID NO: 576406 - RNA, 19 nt, Homo sapiens
gcacaaaguauugauaugu

SEQ ID NO: 576407 - RNA, 19 nt, Homo sapiens
uaacccaacuggagagaga

SEQ ID NO: 576408 - RNA, 19 nt, Homo sapiens
gauaaacccagauacaaga

SEQ ID NO: 576409 - RNA, 19 nt, Homo sapiens
gugaguauauacacuaaga

SEQ ID NO: 576410 - RNA, 19 nt, Homo sapiens
gauagaauacugcaauugu

SEQ ID NO: 576411 - RNA, 19 nt, Homo sapiens
aaacauggaaugcaaggua

SEQ ID NO: 576412 - RNA, 19 nt, Homo sapiens
gccuaagucuaucuucaua

SEQ ID NO: 576413 - RNA, 19 nt, Homo sapiens
gagaauuguugugcuuuga

SEQ ID NO: 576414 - RNA, 19 nt, Homo sapiens
gacaaauguuacucaugua

SEQ ID NO: 576415 - RNA, 19 nt, Homo sapiens
gaaaauggcacuuaccaaa

SEQ ID NO: 576416 - RNA, 19 nt, Homo sapiens
gcacaaagaauuaauuagc

SEQ ID NO: 576417 - RNA, 19 nt, Homo sapiens
gaagacauacacuaagaau

SEQ ID NO: 576418 - RNA, 19 nt, Homo sapiens
ugagguaacacaagaaauu

SEQ ID NO: 576419 - RNA, 19 nt, Homo sapiens
ccaguuaaauggugaacga

SEQ ID NO: 576420 - RNA, 19 nt, Homo sapiens
guaaacacccaaauauugu

SEQ ID NO: 576421 - RNA, 19 nt, Homo sapiens
ggaaccaggagaagacuuu

SEQ ID NO: 576422 - RNA, 19 nt, Homo sapiens
gcuguuggauaaaguaaau

SEQ ID NO: 576423 - RNA, 19 nt, Homo sapiens
aaagaguccucacuaaaca

SEQ ID NO: 576424 - RNA, 19 nt, Homo sapiens
uuaaccacauguuguagua

SEQ ID NO: 576425 - RNA, 19 nt, Homo sapiens
cacuaccacugcaacauua

SEQ ID NO: 576426 - RNA, 19 nt, Homo sapiens
aaaguaggccaacugauaa

SEQ ID NO: 576427 - RNA, 19 nt, Homo sapiens
gaaauugucaucagaacuc

SEQ ID NO: 576428 - RNA, 19 nt, Homo sapiens
agacagaaccacaucauga

SEQ ID NO: 576429 - RNA, 19 nt, Homo sapiens
gaagaacuguaacauucca

SEQ ID NO: 576430 - RNA, 19 nt, Homo sapiens
gaauuacaguaugcacaaa

SEQ ID NO: 576431 - RNA, 19 nt, Homo sapiens
uguaaacacccaaauauug

SEQ ID NO: 576432 - RNA, 19 nt, Homo sapiens
ggaaugcaagguagaaguu

SEQ ID NO: 576433 - RNA, 19 nt, Homo sapiens
gaacucaccuuugauuucc

SEQ ID NO: 576434 - RNA, 19 nt, Homo sapiens
aauaguaaaucuccaagga

SEQ ID NO: 576435 - RNA, 19 nt, Homo sapiens
gaacaauugcuugcuauca

SEQ ID NO: 576436 - RNA, 19 nt, Homo sapiens
gaacauagaggcacaaacc

SEQ ID NO: 576437 - RNA, 19 nt, Homo sapiens
gcaaucgagcuguuggaua

SEQ ID NO: 576438 - RNA, 19 nt, Homo sapiens
uaagcagaauccuguaaga

SEQ ID NO: 576439 - RNA, 19 nt, Homo sapiens
gaaccacacaagugcuuaa

SEQ ID NO: 576440 - RNA, 19 nt, Homo sapiens
caagaaauuucagauagca

SEQ ID NO: 576441 - RNA, 19 nt, Homo sapiens
ggacugagcugaauacaua

SEQ ID NO: 576442 - RNA, 19 nt, Homo sapiens
ggaaugagcuuucaauuga

SEQ ID NO: 576443 - RNA, 19 nt, Homo sapiens
ggaaaucagugguuaaaga

SEQ ID NO: 576444 - RNA, 19 nt, Homo sapiens
gaugauggauggacugaua

SEQ ID NO: 576445 - RNA, 19 nt, Homo sapiens
gagcauaacuguggccaua

SEQ ID NO: 576446 - RNA, 19 nt, Homo sapiens
cagcagagaugacaacaaa

SEQ ID NO: 576447 - RNA, 19 nt, Homo sapiens
ggacgagccuauucaagaa

SEQ ID NO: 576448 - RNA, 19 nt, Homo sapiens
gcaagaaggccucagguaa

SEQ ID NO: 576449 - RNA, 19 nt, Homo sapiens
gcauccaacuguuacauaa

SEQ ID NO: 576450 - RNA, 19 nt, Homo sapiens
gcacagggcccauaugguu

SEQ ID NO: 576451 - RNA, 19 nt, Homo sapiens
ggaagaaauuggaguucaa

SEQ ID NO: 576452 - RNA, 19 nt, Homo sapiens
ggaacaaucugugaugaug

SEQ ID NO: 576453 - RNA, 19 nt, Homo sapiens
cuacagaaaccauaagaua

SEQ ID NO: 576454 - RNA, 19 nt, Homo sapiens
cauauucucuguagccuuu

SEQ ID NO: 576455 - RNA, 19 nt, Homo sapiens
gcauaacuguggccauaaa

SEQ ID NO: 576456 - RNA, 19 nt, Homo sapiens
gaaaucagugguuaaagaa

SEQ ID NO: 576457 - RNA, 19 nt, Homo sapiens
gaaauuggaguucaacaga

SEQ ID NO: 576458 - RNA, 19 nt, Homo sapiens
gagcaagaaccauggcuua

SEQ ID NO: 576459 - RNA, 19 nt, Homo sapiens
gaggaccacucauguguga

SEQ ID NO: 576460 - RNA, 19 nt, Homo sapiens
gaacugagaaccccuuuua

SEQ ID NO: 576461 - RNA, 19 nt, Homo sapiens
caagaaccauggcuuacuu

SEQ ID NO: 576462 - RNA, 19 nt, Homo sapiens
caaagcagcauuuaaacaa

SEQ ID NO: 576463 - RNA, 19 nt, Homo sapiens
gcagcacacuguuucaaga

SEQ ID NO: 576464 - RNA, 19 nt, Homo sapiens
gaucugauauuuggaaaca

SEQ ID NO: 576465 - RNA, 19 nt, Homo sapiens
aaagugaucugauauuugg

SEQ ID NO: 576466 - RNA, 19 nt, Homo sapiens
gaagaugcaggaguuauuu

SEQ ID NO: 576467 - RNA, 19 nt, Homo sapiens
gcagagaugacaacaaaug

SEQ ID NO: 576468 - RNA, 19 nt, Homo sapiens
caagcaagauauuggaaga

SEQ ID NO: 576469 - RNA, 19 nt, Homo sapiens
ucaccaaacuguaauucuu

SEQ ID NO: 576470 - RNA, 19 nt, Homo sapiens
gaaguggucggcuuugauu

SEQ ID NO: 576471 - RNA, 19 nt, Homo sapiens
gugaggaaaucagugguua

SEQ ID NO: 576472 - RNA, 19 nt, Homo sapiens
gccauucccuuacuuccua

SEQ ID NO: 576473 - RNA, 19 nt, Homo sapiens
ggagagagaggccacagaa

SEQ ID NO: 576474 - RNA, 19 nt, Homo sapiens
acuaggagcuaugcuguua

SEQ ID NO: 576475 - RNA, 19 nt, Homo sapiens
ccagauuucuucaguguuc

SEQ ID NO: 576476 - RNA, 19 nt, Homo sapiens
gacgucagcugcucaggaa

SEQ ID NO: 576477 - RNA, 19 nt, Homo sapiens
ggaacugucugugaugaug

SEQ ID NO: 576478 - RNA, 19 nt, Homo sapiens
gggaaugagcuuucaauug

SEQ ID NO: 576479 - RNA, 19 nt, Homo sapiens
cagaggaguuugaggaaga

SEQ ID NO: 576480 - RNA, 19 nt, Homo sapiens
ccgcgaagauguuagcauu

SEQ ID NO: 576481 - RNA, 19 nt, Homo sapiens
caacagcacuaggagcuau

SEQ ID NO: 576482 - RNA, 19 nt, Homo sapiens
caaauggcaagaucuguuu

SEQ ID NO: 576483 - RNA, 19 nt, Homo sapiens
gacaacaaauggcaagauc

SEQ ID NO: 576484 - RNA, 19 nt, Homo sapiens
gaagagcaaugugccagau

SEQ ID NO: 576485 - RNA, 19 nt, Homo sapiens
aaaccuccaugaacacaaa

SEQ ID NO: 576486 - RNA, 19 nt, Homo sapiens
ugacauagcccugguuaga

SEQ ID NO: 576487 - RNA, 19 nt, Homo sapiens
gaaaaggaauagcaaaaca

SEQ ID NO: 576488 - RNA, 19 nt, Homo sapiens
gagaaccccuuuuaauuga

SEQ ID NO: 576489 - RNA, 19 nt, Homo sapiens
acauagcccugguuagauu

SEQ ID NO: 576490 - RNA, 19 nt, Homo sapiens
gaagucaucccauggagau

SEQ ID NO: 576491 - RNA, 19 nt, Homo sapiens
caggaguuauuugugauua

SEQ ID NO: 576492 - RNA, 19 nt, Homo sapiens
ggaugcagcugugaucugu

SEQ ID NO: 576493 - RNA, 19 nt, Homo sapiens
gaggaaaucagugguuaaa

SEQ ID NO: 576494 - RNA, 19 nt, Homo sapiens
cuucaaagcagcauuuaaa

SEQ ID NO: 576495 - RNA, 19 nt, Homo sapiens
acaagcagccauucccuua

SEQ ID NO: 576496 - RNA, 19 nt, Homo sapiens
gaaagcacagggcccauau

SEQ ID NO: 576497 - RNA, 19 nt, Homo sapiens
aguggugucugaaaucaua

SEQ ID NO: 576498 - RNA, 19 nt, Homo sapiens
ggaguuugaggaagaaauu

SEQ ID NO: 576499 - RNA, 19 nt, Homo sapiens
gagggucgcuuggagguau

SEQ ID NO: 576500 - RNA, 19 nt, Homo sapiens
gaaaauauacugcuuugug

SEQ ID NO: 576501 - RNA, 19 nt, Homo sapiens
aaccauggcuuacuuugga

SEQ ID NO: 576502 - RNA, 19 nt, Homo sapiens
uaacuguggccauaaagaa

SEQ ID NO: 576503 - RNA, 19 nt, Homo sapiens
ccacugggaugauucugau

SEQ ID NO: 576504 - RNA, 19 nt, Homo sapiens
ggauucuccugguguuuau

SEQ ID NO: 576505 - RNA, 19 nt, Homo sapiens
gaggacagcgccacaacuu

SEQ ID NO: 576506 - RNA, 19 nt, Homo sapiens
gagucccucucaucuguuu

SEQ ID NO: 576507 - RNA, 19 nt, Homo sapiens
cagugaagaugcaggaguu

SEQ ID NO: 576508 - RNA, 19 nt, Homo sapiens
gcccaguuauguuggauga

SEQ ID NO: 576509 - RNA, 19 nt, Homo sapiens
acaucugccugucacaaua

SEQ ID NO: 576510 - RNA, 19 nt, Homo sapiens
gguuaaagaauuccacuau

SEQ ID NO: 576511 - RNA, 19 nt, Homo sapiens
gaaaaggacccauccaugu

SEQ ID NO: 576512 - RNA, 19 nt, Homo sapiens
cauaaaugcgguacccuuu

SEQ ID NO: 576513 - RNA, 19 nt, Homo sapiens
aaacuucaaagcagcauuu

SEQ ID NO: 576514 - RNA, 19 nt, Homo sapiens
caacagauugugauucauc

SEQ ID NO: 576515 - RNA, 19 nt, Homo sapiens
ggaguucaacagauuguga

SEQ ID NO: 576516 - RNA, 19 nt, Homo sapiens
caguugggauuuaaauaug

SEQ ID NO: 576517 - RNA, 19 nt, Homo sapiens
caacaaauggcaagaucug

SEQ ID NO: 576518 - RNA, 19 nt, Homo sapiens
aagcauggcaucaggcaua

SEQ ID NO: 576519 - RNA, 19 nt, Homo sapiens
guaccaagugcuacagaaa

SEQ ID NO: 576520 - RNA, 19 nt, Homo sapiens
ggacagcgccacaacuuuu

SEQ ID NO: 576521 - RNA, 19 nt, Homo sapiens
gaaggacgaguggagguuu

SEQ ID NO: 576522 - RNA, 19 nt, Homo sapiens
gacaguugggauuuaaaua

SEQ ID NO: 576523 - RNA, 19 nt, Homo sapiens
ugucgacaguugggauuua

SEQ ID NO: 576524 - RNA, 19 nt, Homo sapiens
cauggcaucaggcauauuu

SEQ ID NO: 576525 - RNA, 19 nt, Homo sapiens
uggaagugauaauccuuaa

SEQ ID NO: 576526 - RNA, 19 nt, Homo sapiens
gcuguggagucaaggauuc

SEQ ID NO: 576527 - RNA, 19 nt, Homo sapiens
ggguauggcuguggaguca

SEQ ID NO: 576528 - RNA, 19 nt, Homo sapiens
gcggaucauuggugggaaa

SEQ ID NO: 576529 - RNA, 19 nt, Homo sapiens
gcacugggaaugagcuuuc

SEQ ID NO: 576530 - RNA, 19 nt, Homo sapiens
gaaugagcuuucaauugag

SEQ ID NO: 576531 - RNA, 19 nt, Homo sapiens
aauuggaguucaacagauu

SEQ ID NO: 576532 - RNA, 19 nt, Homo sapiens
gguuggagauuaucauacu

SEQ ID NO: 576533 - RNA, 19 nt, Homo sapiens
ugaagaugcaggaguuauu

SEQ ID NO: 576534 - RNA, 19 nt, Homo sapiens
gcgaagauguuagcauugc

SEQ ID NO: 576535 - RNA, 19 nt, Homo sapiens
ggaugaugccgaugcagaa

SEQ ID NO: 576536 - RNA, 19 nt, Homo sapiens
ggaagugauaauccuuaaa

SEQ ID NO: 576537 - RNA, 19 nt, Homo sapiens
gacccgaccgcagugauua

SEQ ID NO: 576538 - RNA, 19 nt, Homo sapiens
ucagguaacaguaauaaag

SEQ ID NO: 576539 - RNA, 19 nt, Homo sapiens
ggcaagaaggccucaggua

SEQ ID NO: 576540 - RNA, 19 nt, Homo sapiens
guggaagugauaauccuua

SEQ ID NO: 576541 - RNA, 19 nt, Homo sapiens
ggaagaaacuggcggaaug

SEQ ID NO: 576542 - RNA, 19 nt, Homo sapiens
cgaaauggcuuaagucgaa

SEQ ID NO: 576543 - RNA, 19 nt, Homo sapiens
caucagauaugcuuacuaa

SEQ ID NO: 576544 - RNA, 19 nt, Homo sapiens
caagaaaccugugugauga

SEQ ID NO: 576545 - RNA, 19 nt, Homo sapiens
ugagauagcucgagagaau

SEQ ID NO: 576546 - RNA, 19 nt, Homo sapiens
ccagaaguguuucagauuu

SEQ ID NO: 576547 - RNA, 19 nt, Homo sapiens
guacuugcuuguauuguaa

SEQ ID NO: 576548 - RNA, 19 nt, Homo sapiens
aauaauagccuuccaauug

SEQ ID NO: 576549 - RNA, 19 nt, Homo sapiens
ggccaagggugaauucuaa

SEQ ID NO: 576550 - RNA, 19 nt, Homo sapiens
ggaaagagaacgaaucgaa

SEQ ID NO: 576551 - RNA, 19 nt, Homo sapiens
ggacguuacucaaaucguu

SEQ ID NO: 576552 - RNA, 19 nt, Homo sapiens
gaagaagcauagacgaaau

SEQ ID NO: 576553 - RNA, 19 nt, Homo sapiens
ggaaauccuuuacuucauc

SEQ ID NO: 576554 - RNA, 19 nt, Homo sapiens
gaaacgaccucgacucacu

SEQ ID NO: 576555 - RNA, 19 nt, Homo sapiens
cgaaagaacucuguuaaac

SEQ ID NO: 576556 - RNA, 19 nt, Homo sapiens
ugacagcccuuccuauaau

SEQ ID NO: 576557 - RNA, 19 nt, Homo sapiens
cagaagcacaaguauauua

SEQ ID NO: 576558 - RNA, 19 nt, Homo sapiens
aaugaaagcccaagaaauu

SEQ ID NO: 576559 - RNA, 19 nt, Homo sapiens
ccauauaccugcccugguu

SEQ ID NO: 576560 - RNA, 19 nt, Homo sapiens
gauggacuuuggaauauga

SEQ ID NO: 576561 - RNA, 19 nt, Homo sapiens
ccaaugaagaugaguuaua

SEQ ID NO: 576562 - RNA, 19 nt, Homo sapiens
gaccagaaguguuucagau

SEQ ID NO: 576563 - RNA, 19 nt, Homo sapiens
cagauaugcuuacuaaauc

SEQ ID NO: 576564 - RNA, 19 nt, Homo sapiens
cagggaaacuuuaccaaug

SEQ ID NO: 576565 - RNA, 19 nt, Homo sapiens
guauguagcucacguaggu

SEQ ID NO: 576566 - RNA, 19 nt, Homo sapiens
ucaagaagcagaaggguuu

SEQ ID NO: 576567 - RNA, 19 nt, Homo sapiens
ggaaguguguuugccuaaa

SEQ ID NO: 576568 - RNA, 19 nt, Homo sapiens
caaaugaaagcccaagaaa

SEQ ID NO: 576569 - RNA, 19 nt, Homo sapiens
caacaaacacugucaugga

SEQ ID NO: 576570 - RNA, 19 nt, Homo sapiens
uguccaagguguagucaua

SEQ ID NO: 576571 - RNA, 19 nt, Homo sapiens
gcacaguuauugaccagau

SEQ ID NO: 576572 - RNA, 19 nt, Homo sapiens
guuagaaggagcacaguua

SEQ ID NO: 576573 - RNA, 19 nt, Homo sapiens
uaacagauggugcugcuaa

SEQ ID NO: 576574 - RNA, 19 nt, Homo sapiens
ggguauaaguugcuguaaa

SEQ ID NO: 576575 - RNA, 19 nt, Homo sapiens
uaaauuuggugccgauguu

SEQ ID NO: 576576 - RNA, 19 nt, Homo sapiens
ucauguugcugaauuugua

SEQ ID NO: 576577 - RNA, 19 nt, Homo sapiens
gauguuaggguauaaguug

SEQ ID NO: 576578 - RNA, 19 nt, Homo sapiens
gaaauccuuuacuucauca

SEQ ID NO: 576579 - RNA, 19 nt, Homo sapiens
gacagcccuuccuauaaua

SEQ ID NO: 576580 - RNA, 19 nt, Homo sapiens
aaagaacucuguuaaacuc

SEQ ID NO: 576581 - RNA, 19 nt, Homo sapiens
gaaagaacucuguuaaacu

SEQ ID NO: 576582 - RNA, 19 nt, Homo sapiens
gacaauagggcuaaauguu

SEQ ID NO: 576583 - RNA, 19 nt, Homo sapiens
caaugaagaugaguuauac

SEQ ID NO: 576584 - RNA, 19 nt, Homo sapiens
ggacaaucagggaaacuuu

SEQ ID NO: 576585 - RNA, 19 nt, Homo sapiens
cgucgaagauaaacaauag

SEQ ID NO: 576586 - RNA, 19 nt, Homo sapiens
gaacgaaucgaaggacuug

SEQ ID NO: 576587 - RNA, 19 nt, Homo sapiens
aaaccuuagucaucagaua

SEQ ID NO: 576588 - RNA, 19 nt, Homo sapiens
acaauagggcuaaauguuu

SEQ ID NO: 576589 - RNA, 19 nt, Homo sapiens
ccacacaaauucagucucu

SEQ ID NO: 576590 - RNA, 19 nt, Homo sapiens
gguauaaguugcuguaaaa

SEQ ID NO: 576591 - RNA, 19 nt, Homo sapiens
gacaaucagggaaacuuua

SEQ ID NO: 576592 - RNA, 19 nt, Homo sapiens
ggacuuggugggaguguaa

SEQ ID NO: 576593 - RNA, 19 nt, Homo sapiens
gcgaaagaacucuguuaaa

SEQ ID NO: 576594 - RNA, 19 nt, Homo sapiens
gcauagacgaaauggcuua

SEQ ID NO: 576595 - RNA, 19 nt, Homo sapiens
ucaagaaaccugugugaug

SEQ ID NO: 576596 - RNA, 19 nt, Homo sapiens
gugauggacuuuggaauau

SEQ ID NO: 576597 - RNA, 19 nt, Homo sapiens
gagcuaugauuucuucagu

SEQ ID NO: 576598 - RNA, 19 nt, Homo sapiens
gaauaauagccuuccaauu

SEQ ID NO: 576599 - RNA, 19 nt, Homo sapiens
ugaccuguguuucacuuaa

SEQ ID NO: 576600 - RNA, 19 nt, Homo sapiens
aaggauacaugauucuuug

SEQ ID NO: 576601 - RNA, 19 nt, Homo sapiens
ggaggacguuacucaaauc

SEQ ID NO: 576602 - RNA, 19 nt, Homo sapiens
gaaggagcacaguuauuga

SEQ ID NO: 576603 - RNA, 19 nt, Homo sapiens
gaaagaaccccuccaacaa

SEQ ID NO: 576604 - RNA, 19 nt, Homo sapiens
agauaacacuagugccaua

SEQ ID NO: 576605 - RNA, 19 nt, Homo sapiens
aaaugcaucugggaaauga

SEQ ID NO: 576606 - RNA, 19 nt, Homo sapiens
gaacaagucuggggugaau

SEQ ID NO: 576607 - RNA, 19 nt, Homo sapiens
caaguugaguaucccuuau

SEQ ID NO: 576608 - RNA, 19 nt, Homo sapiens
gaaguguguuugccuaaaa

SEQ ID NO: 576609 - RNA, 19 nt, Homo sapiens
uguacuugcuuguauugua

SEQ ID NO: 576610 - RNA, 19 nt, Homo sapiens
gaaacuuuaccaaugaaga

SEQ ID NO: 576611 - RNA, 19 nt, Homo sapiens
gggaaacuuuaccaaugaa

SEQ ID NO: 576612 - RNA, 19 nt, Homo sapiens
ugcaguaucucuuacauca

SEQ ID NO: 576613 - RNA, 19 nt, Homo sapiens
guaaauuuguauccacaca

SEQ ID NO: 576614 - RNA, 19 nt, Homo sapiens
gaaagcccaagaaauugaa

SEQ ID NO: 576615 - RNA, 19 nt, Homo sapiens
agaaggagcacaguuauug

SEQ ID NO: 576616 - RNA, 19 nt, Homo sapiens
ggaguguaaugaacaaguc

SEQ ID NO: 576617 - RNA, 19 nt, Homo sapiens
gcauuuccuuugagcauca

SEQ ID NO: 576618 - RNA, 19 nt, Homo sapiens
cauagaaggaaguguguuu

SEQ ID NO: 576619 - RNA, 19 nt, Homo sapiens
uacuaaaucuucagcauag

SEQ ID NO: 576620 - RNA, 19 nt, Homo sapiens
gaaaugcaucugggaaaug

SEQ ID NO: 576621 - RNA, 19 nt, Homo sapiens
ccaaaugaaagcccaagaa

SEQ ID NO: 576622 - RNA, 19 nt, Homo sapiens
agggaaacuuuaccaauga

SEQ ID NO: 576623 - RNA, 19 nt, Homo sapiens
gaguaucccuuauccaaaa

SEQ ID NO: 576624 - RNA, 19 nt, Homo sapiens
gcugcuaauucccaacauu

SEQ ID NO: 576625 - RNA, 19 nt, Homo sapiens
ugaaaugcaucugggaaau

SEQ ID NO: 576626 - RNA, 19 nt, Homo sapiens
cagcgaaagaacucuguua

SEQ ID NO: 576627 - RNA, 19 nt, Homo sapiens
guggagcuaugauuucuuc

SEQ ID NO: 576628 - RNA, 19 nt, Homo sapiens
ugaagaagcauagacgaaa

SEQ ID NO: 576629 - RNA, 19 nt, Homo sapiens
caguaucucuuacaucagu

SEQ ID NO: 576630 - RNA, 19 nt, Homo sapiens
uaagccacuugucuugaaa

SEQ ID NO: 576631 - RNA, 19 nt, Homo sapiens
guauaagccacuugucuug

SEQ ID NO: 576632 - RNA, 19 nt, Homo sapiens
ugaaagcccaagaaauuga

SEQ ID NO: 576633 - RNA, 19 nt, Homo sapiens
cugcaucucuccagaagug

SEQ ID NO: 576634 - RNA, 19 nt, Homo sapiens
gaccucgacucacucacaa

SEQ ID NO: 576635 - RNA, 19 nt, Homo sapiens
guuagucuugucccaauua

SEQ ID NO: 576636 - RNA, 19 nt, Homo sapiens
guugagccaugcuacaguu

SEQ ID NO: 576637 - RNA, 19 nt, Homo sapiens
ggauacaugauucuuugaa

SEQ ID NO: 576638 - RNA, 19 nt, Homo sapiens
gaaccgacggcugaagaaa

SEQ ID NO: 576639 - RNA, 19 nt, Homo sapiens
gcuugugaaucgagcauug

SEQ ID NO: 576640 - RNA, 19 nt, Homo sapiens
agccagaacuucccaagga

SEQ ID NO: 576641 - RNA, 19 nt, Homo sapiens
gcagaaaccuuuacaguau

SEQ ID NO: 576642 - RNA, 19 nt, Homo sapiens
gcagauggaugguaucaua

SEQ ID NO: 576643 - RNA, 19 nt, Homo sapiens
ccacuggacuugauuauaa

SEQ ID NO: 576644 - RNA, 19 nt, Homo sapiens
gguauaaccuaacugauaa

SEQ ID NO: 576645 - RNA, 19 nt, Homo sapiens
gaaaaucgcugcagcaaaa

SEQ ID NO: 576646 - RNA, 19 nt, Homo sapiens
ggacagagcuccggcagaa

SEQ ID NO: 576647 - RNA, 19 nt, Homo sapiens
gaagauaaguucagagaca

SEQ ID NO: 576648 - RNA, 19 nt, Homo sapiens
ggaaacagaugagaaagaa

SEQ ID NO: 576649 - RNA, 19 nt, Homo sapiens
ccauggagcugccggauua

SEQ ID NO: 576650 - RNA, 19 nt, Homo sapiens
gaugaagacucaaacguuu

SEQ ID NO: 576651 - RNA, 19 nt, Homo sapiens
gagagaagauucgagauuu

SEQ ID NO: 576652 - RNA, 19 nt, Homo sapiens
gaacagucccuuccagaua

SEQ ID NO: 576653 - RNA, 19 nt, Homo sapiens
ggaagauggugaagaauau

SEQ ID NO: 576654 - RNA, 19 nt, Homo sapiens
gcaauuggcugauggaaca

SEQ ID NO: 576655 - RNA, 19 nt, Homo sapiens
gcaccaaacuuagaucgua

SEQ ID NO: 576656 - RNA, 19 nt, Homo sapiens
gaacggagauguguaucaa

SEQ ID NO: 576657 - RNA, 19 nt, Homo sapiens
caccucagcuucccuaaua

SEQ ID NO: 576658 - RNA, 19 nt, Homo sapiens
gaucauugaggcuaaauua

SEQ ID NO: 576659 - RNA, 19 nt, Homo sapiens
cagaaacgcuuguugaaug

SEQ ID NO: 576660 - RNA, 19 nt, Homo sapiens
gcagaaagcaggccauuug

SEQ ID NO: 576661 - RNA, 19 nt, Homo sapiens
gcacugggcccaaauauuc

SEQ ID NO: 576662 - RNA, 19 nt, Homo sapiens
gauaagauguaguucaugu

SEQ ID NO: 576663 - RNA, 19 nt, Homo sapiens
gagaggagguggaccagaa

SEQ ID NO: 576664 - RNA, 19 nt, Homo sapiens
caccaugccuggcuaauuu

SEQ ID NO: 576665 - RNA, 19 nt, Homo sapiens
ggagauguguaucaagaaa

SEQ ID NO: 576666 - RNA, 19 nt, Homo sapiens
gcugaaauaucuaacuuga

SEQ ID NO: 576667 - RNA, 19 nt, Homo sapiens
ccacuaacuugaauacauu

SEQ ID NO: 576668 - RNA, 19 nt, Homo sapiens
gcaaagauggagaauauga

SEQ ID NO: 576669 - RNA, 19 nt, Homo sapiens
gaaggugaaugccacagaa

SEQ ID NO: 576670 - RNA, 19 nt, Homo sapiens
ccaaaguacugggauuaua

SEQ ID NO: 576671 - RNA, 19 nt, Homo sapiens
gagacaggguuucaccaua

SEQ ID NO: 576672 - RNA, 19 nt, Homo sapiens
gugagagacuucaguauga

SEQ ID NO: 576673 - RNA, 19 nt, Homo sapiens
gaagacauuuggccacuca

SEQ ID NO: 576674 - RNA, 19 nt, Homo sapiens
gcacaggguuucagugauc

SEQ ID NO: 576675 - RNA, 19 nt, Homo sapiens
aagaaaggcuggcacguuu

SEQ ID NO: 576676 - RNA, 19 nt, Homo sapiens
gaagaugacauguuuaaag

SEQ ID NO: 576677 - RNA, 19 nt, Homo sapiens
gaaagaagaaacaggaaga

SEQ ID NO: 576678 - RNA, 19 nt, Homo sapiens
caucagaaguucagaagug

SEQ ID NO: 576679 - RNA, 19 nt, Homo sapiens
aggcaaagauggagaauau

SEQ ID NO: 576680 - RNA, 19 nt, Homo sapiens
gcaccuggaugaacauuag

SEQ ID NO: 576681 - RNA, 19 nt, Homo sapiens
gaaaaggaaucugaaguaa

SEQ ID NO: 576682 - RNA, 19 nt, Homo sapiens
cuaaggcucuggaauauuc

SEQ ID NO: 576683 - RNA, 19 nt, Homo sapiens
ggaagugcaucuaagaaag

SEQ ID NO: 576684 - RNA, 19 nt, Homo sapiens
acaggaagauggugaagaa

SEQ ID NO: 576685 - RNA, 19 nt, Homo sapiens
auaagacacuggugaauga

SEQ ID NO: 576686 - RNA, 19 nt, Homo sapiens
gaauauguuuguccaaugg

SEQ ID NO: 576687 - RNA, 19 nt, Homo sapiens
ucaaagugcuggaauuaca

SEQ ID NO: 576688 - RNA, 19 nt, Homo sapiens
ucaugaaacucuuuggaaa

SEQ ID NO: 576689 - RNA, 19 nt, Homo sapiens
ggacauccuuagaaacuca

SEQ ID NO: 576690 - RNA, 19 nt, Homo sapiens
ggagagaagauucgagauu

SEQ ID NO: 576691 - RNA, 19 nt, Homo sapiens
guucuaaggcucuggaaua

SEQ ID NO: 576692 - RNA, 19 nt, Homo sapiens
caccacgccuggcuaauuu

SEQ ID NO: 576693 - RNA, 19 nt, Homo sapiens
gaacagcaagugcaccaaa

SEQ ID NO: 576694 - RNA, 19 nt, Homo sapiens
ccaguuccaucuccucuuu

SEQ ID NO: 576695 - RNA, 19 nt, Homo sapiens
cagaguguuuccauucaua

SEQ ID NO: 576696 - RNA, 19 nt, Homo sapiens
ggaguaaugugccgauucu

SEQ ID NO: 576697 - RNA, 19 nt, Homo sapiens
cagauuggauuaugaagau

SEQ ID NO: 576698 - RNA, 19 nt, Homo sapiens
cuucacaccuggcugauuu

SEQ ID NO: 576699 - RNA, 19 nt, Homo sapiens
gauugucuauuguuuguug

SEQ ID NO: 576700 - RNA, 19 nt, Homo sapiens
ggacaggcaucaggaagug

SEQ ID NO: 576701 - RNA, 19 nt, Homo sapiens
gaacaucccacccaauaag

SEQ ID NO: 576702 - RNA, 19 nt, Homo sapiens
gaaguggacuaaccaucga

SEQ ID NO: 576703 - RNA, 19 nt, Homo sapiens
ggacagauuggauuaugaa

SEQ ID NO: 576704 - RNA, 19 nt, Homo sapiens
gauggaaacagaugagaaa

SEQ ID NO: 576705 - RNA, 19 nt, Homo sapiens
ggacuugauuauaaacugu

SEQ ID NO: 576706 - RNA, 19 nt, Homo sapiens
caccuccacuugccucuua

SEQ ID NO: 576707 - RNA, 19 nt, Homo sapiens
ccugggaucugaagaagaa

SEQ ID NO: 576708 - RNA, 19 nt, Homo sapiens
agacaggguuucaccauau

SEQ ID NO: 576709 - RNA, 19 nt, Homo sapiens
gaagaagaaaccaaucaug

SEQ ID NO: 576710 - RNA, 19 nt, Homo sapiens
cacccuagcugaaacagaa

SEQ ID NO: 576711 - RNA, 19 nt, Homo sapiens
gauucgagauuuggaguuu

SEQ ID NO: 576712 - RNA, 19 nt, Homo sapiens
agaccugcguggauuguua

SEQ ID NO: 576713 - RNA, 19 nt, Homo sapiens
uccaaacacucacaguaua

SEQ ID NO: 576714 - RNA, 19 nt, Homo sapiens
gcagauggaagauucagaa

SEQ ID NO: 576715 - RNA, 19 nt, Homo sapiens
cugaguacauccaagauuu

SEQ ID NO: 576716 - RNA, 19 nt, Homo sapiens
ggaggugggcgguucagua

SEQ ID NO: 576717 - RNA, 19 nt, Homo sapiens
gaaucaauauguggaacuu

SEQ ID NO: 576718 - RNA, 19 nt, Homo sapiens
gaccguagcaccuggauga

SEQ ID NO: 576719 - RNA, 19 nt, Homo sapiens
gaaggcaucaacaaucuga

SEQ ID NO: 576720 - RNA, 19 nt, Homo sapiens
gagaaggacagauuggauu

SEQ ID NO: 576721 - RNA, 19 nt, Homo sapiens
acagaaagcaggaguaaug

SEQ ID NO: 576722 - RNA, 19 nt, Homo sapiens
gaaacaauggcucaguuau

SEQ ID NO: 576723 - RNA, 19 nt, Homo sapiens
caugacuguugaugacuua

SEQ ID NO: 576724 - RNA, 19 nt, Homo sapiens
ucaacaagaucuagagaag

SEQ ID NO: 576725 - RNA, 19 nt, Homo sapiens
uuagugaaauggacaguga

SEQ ID NO: 576726 - RNA, 19 nt, Homo sapiens
gaaaauaccaggaaacugu

SEQ ID NO: 576727 - RNA, 19 nt, Homo sapiens
cagaaaccuuuacaguauu

SEQ ID NO: 576728 - RNA, 19 nt, Homo sapiens
gaagaggucagaaugaucu

SEQ ID NO: 576729 - RNA, 19 nt, Homo sapiens
ccacuugccucuuauuguc

SEQ ID NO: 576730 - RNA, 19 nt, Homo sapiens
gaacuucuuuaagcauuca

SEQ ID NO: 576731 - RNA, 19 nt, Homo sapiens
cgagaaguuuaaacagaaa

SEQ ID NO: 576732 - RNA, 19 nt, Homo sapiens
acagauaggugcauucucu

SEQ ID NO: 576733 - RNA, 19 nt, Homo sapiens
ucuaacagcuacugccaaa

SEQ ID NO: 576734 - RNA, 19 nt, Homo sapiens
uagaaacaauggcucaguu

SEQ ID NO: 576735 - RNA, 19 nt, Homo sapiens
ugacuuggauaugccauuu

SEQ ID NO: 576736 - RNA, 19 nt, Homo sapiens
aaaggaaacuauucagaag

SEQ ID NO: 576737 - RNA, 19 nt, Homo sapiens
auucagugcugcguaauua

SEQ ID NO: 576738 - RNA, 19 nt, Homo sapiens
cuaaacauguucauuguac

SEQ ID NO: 576739 - RNA, 19 nt, Homo sapiens
ggcagcggauugucuauug

SEQ ID NO: 576740 - RNA, 19 nt, Homo sapiens
gaagggacagugagacaga

SEQ ID NO: 576741 - RNA, 19 nt, Homo sapiens
gaguuaagcugauaaauga

SEQ ID NO: 576742 - RNA, 19 nt, Homo sapiens
uuagagaacucaaccaaua

SEQ ID NO: 576743 - RNA, 19 nt, Homo sapiens
ggacagaguuaagcugaua

SEQ ID NO: 576744 - RNA, 19 nt, Homo sapiens
gaacaaacaagaacauuuc

SEQ ID NO: 576745 - RNA, 19 nt, Homo sapiens
ggacacaggucaguuguau

SEQ ID NO: 576746 - RNA, 19 nt, Homo sapiens
guauaucaguuccaguuua

SEQ ID NO: 576747 - RNA, 19 nt, Homo sapiens
gagaagagcauucgcauca

SEQ ID NO: 576748 - RNA, 19 nt, Homo sapiens
cacgagaccucaucauauu

SEQ ID NO: 576749 - RNA, 19 nt, Homo sapiens
gcuguuaacuacuaucuuc

SEQ ID NO: 576750 - RNA, 19 nt, Homo sapiens
gaagagcauucgcaucaca

SEQ ID NO: 576751 - RNA, 19 nt, Homo sapiens
cgaacuauuuccuccagua

SEQ ID NO: 576752 - RNA, 19 nt, Homo sapiens
acagcaagccuuuguauuu

SEQ ID NO: 576753 - RNA, 19 nt, Homo sapiens
ucacacgucucugcuuuaa

SEQ ID NO: 576754 - RNA, 19 nt, Homo sapiens
cagcaagccuuuguauuug

SEQ ID NO: 576755 - RNA, 19 nt, Homo sapiens
cagagaagauggaaauuac

SEQ ID NO: 576756 - RNA, 19 nt, Homo sapiens
gcaagcuguuugucuuuga

SEQ ID NO: 576757 - RNA, 19 nt, Homo sapiens
gacacgagaccucaucaua

SEQ ID NO: 576758 - RNA, 19 nt, Homo sapiens
caaccgcaacgaacuauuu

SEQ ID NO: 576759 - RNA, 19 nt, Homo sapiens
gacgugcuguuaacuacua

SEQ ID NO: 576760 - RNA, 19 nt, Homo sapiens
uaaacgaggucaguucaga

SEQ ID NO: 576761 - RNA, 19 nt, Homo sapiens
agaggaagccugugagaaa

SEQ ID NO: 576762 - RNA, 19 nt, Homo sapiens
cgaacaaacaagaacauuu

SEQ ID NO: 576763 - RNA, 19 nt, Homo sapiens
gaacaugagcgagcgaguu

SEQ ID NO: 576764 - RNA, 19 nt, Homo sapiens
agauaacgcccauguguuu

SEQ ID NO: 576765 - RNA, 19 nt, Homo sapiens
gaagaggaagccugugaga

SEQ ID NO: 576766 - RNA, 19 nt, Homo sapiens
acagagaagauggaaauua

SEQ ID NO: 576767 - RNA, 19 nt, Homo sapiens
ugacagagaagauggaaau

SEQ ID NO: 576768 - RNA, 19 nt, Homo sapiens
aaaugcagcugccgaguca

SEQ ID NO: 576769 - RNA, 19 nt, Homo sapiens
ucagaaggauaaaggacaa

SEQ ID NO: 576770 - RNA, 19 nt, Homo sapiens
gaacuauuuccuccaguau

SEQ ID NO: 576771 - RNA, 19 nt, Homo sapiens
gaacaggcagucucacaag

SEQ ID NO: 576772 - RNA, 19 nt, Homo sapiens
acaccaggcugcugcuuug

SEQ ID NO: 576773 - RNA, 19 nt, Homo sapiens
guauuugggaacuacauua

SEQ ID NO: 576774 - RNA, 19 nt, Homo sapiens
gaugagcgaacaaacaaga

SEQ ID NO: 576775 - RNA, 19 nt, Homo sapiens
gagauaacgcccauguguu

SEQ ID NO: 576776 - RNA, 19 nt, Homo sapiens
ggaaguguuuguuggaaaa

SEQ ID NO: 576777 - RNA, 19 nt, Homo sapiens
ggaccuggcgaacgaagaa

SEQ ID NO: 576778 - RNA, 19 nt, Homo sapiens
gggaacuacauuaaacuuu

SEQ ID NO: 576779 - RNA, 19 nt, Homo sapiens
cgagauaacgcccaugugu

SEQ ID NO: 576780 - RNA, 19 nt, Homo sapiens
guauuuggccagaacauga

SEQ ID NO: 576781 - RNA, 19 nt, Homo sapiens
uauaucaguuccaguuuag

SEQ ID NO: 576782 - RNA, 19 nt, Homo sapiens
caaggacacaggucaguug

SEQ ID NO: 576783 - RNA, 19 nt, Homo sapiens
cgagucagcuggcgagcau

SEQ ID NO: 576784 - RNA, 19 nt, Homo sapiens
acuauuuccuccaguauau

SEQ ID NO: 576785 - RNA, 19 nt, Homo sapiens
acacgagaccucaucauau

SEQ ID NO: 576786 - RNA, 19 nt, Homo sapiens
agaguuaagcugauaaaug

SEQ ID NO: 576787 - RNA, 19 nt, Homo sapiens
gagaagauggaaauuacug

SEQ ID NO: 576788 - RNA, 19 nt, Homo sapiens
ugacgaguacaacgagaua

SEQ ID NO: 576789 - RNA, 19 nt, Homo sapiens
agucacacgucucugcuuu

SEQ ID NO: 576790 - RNA, 19 nt, Homo sapiens
ggagagcaauguguuacag

SEQ ID NO: 576791 - RNA, 19 nt, Homo sapiens
gcggaaguguuuguuggaa

SEQ ID NO: 576792 - RNA, 19 nt, Homo sapiens
cgagaccucaucauauuga

SEQ ID NO: 576793 - RNA, 19 nt, Homo sapiens
ccacacagcaagccuuugu

SEQ ID NO: 576794 - RNA, 19 nt, Homo sapiens
cgacagcgacgaugacgau

SEQ ID NO: 576795 - RNA, 19 nt, Homo sapiens
cggaaguguuuguuggaaa

SEQ ID NO: 576796 - RNA, 19 nt, Homo sapiens
gcaauguguuacagaugca

SEQ ID NO: 576797 - RNA, 19 nt, Homo sapiens
ggagaaagagccccagaaa

SEQ ID NO: 576798 - RNA, 19 nt, Homo sapiens
uaucuucauuucccacuuc

SEQ ID NO: 576799 - RNA, 19 nt, Homo sapiens
cgacaaggccagcgagaag

SEQ ID NO: 576800 - RNA, 19 nt, Homo sapiens
uuacugcccuccugucaag

SEQ ID NO: 576801 - RNA, 19 nt, Homo sapiens
caaacugcuucccgcuguu

SEQ ID NO: 576802 - RNA, 19 nt, Homo sapiens
cagcgacgaugacgauguc

SEQ ID NO: 576803 - RNA, 19 nt, Homo sapiens
caguauaucaguuccaguu

SEQ ID NO: 576804 - RNA, 19 nt, Homo sapiens
gaggaagccugugagaaaa

SEQ ID NO: 576805 - RNA, 19 nt, Homo sapiens
gcaguggcuuccgguugaa

SEQ ID NO: 576806 - RNA, 19 nt, Homo sapiens
gaacugccugaaugugguu

SEQ ID NO: 576807 - RNA, 19 nt, Homo sapiens
gcucagacucaaugacaug

SEQ ID NO: 576808 - RNA, 19 nt, Homo sapiens
gagcaauguguuacagaug

SEQ ID NO: 576809 - RNA, 19 nt, Homo sapiens
gaagaaaagccugccauug

SEQ ID NO: 576810 - RNA, 19 nt, Homo sapiens
uggcgagcaugcccuagaa

SEQ ID NO: 576811 - RNA, 19 nt, Homo sapiens
guuaagcugauaaaugaga

SEQ ID NO: 576812 - RNA, 19 nt, Homo sapiens
agagcaauguguuacagau

SEQ ID NO: 576813 - RNA, 19 nt, Homo sapiens
guccagcaaugccucugaa

SEQ ID NO: 576814 - RNA, 19 nt, Homo sapiens
gcgaacaaacaagaacauu

SEQ ID NO: 576815 - RNA, 19 nt, Homo sapiens
gggcccagaugcagaucga

SEQ ID NO: 576816 - RNA, 19 nt, Homo sapiens
gaugacggcacacuacagu

SEQ ID NO: 576817 - RNA, 19 nt, Homo sapiens
gggcugcucagacucaaug

SEQ ID NO: 576818 - RNA, 19 nt, Homo sapiens
gugcaagcuguuugucuuu

SEQ ID NO: 576819 - RNA, 19 nt, Homo sapiens
acacagcaagccuuuguau

SEQ ID NO: 576820 - RNA, 19 nt, Homo sapiens
agcaguggcuuccgguuga

SEQ ID NO: 576821 - RNA, 19 nt, Homo sapiens
ccauuggacgugcuguuaa

SEQ ID NO: 576822 - RNA, 19 nt, Homo sapiens
gagagcaauguguuacaga

SEQ ID NO: 576823 - RNA, 19 nt, Homo sapiens
aacaugagcgagcgaguuu

SEQ ID NO: 576824 - RNA, 19 nt, Homo sapiens
cgacgccuccagcaacaaa

SEQ ID NO: 576825 - RNA, 19 nt, Homo sapiens
gagcgaacaaacaagaaca

SEQ ID NO: 576826 - RNA, 19 nt, Homo sapiens
ggcggagagcaauguguua

SEQ ID NO: 576827 - RNA, 19 nt, Homo sapiens
ccagcaaugccucugaaga

SEQ ID NO: 576828 - RNA, 19 nt, Homo sapiens
gagaaagagccccagaaaa

SEQ ID NO: 576829 - RNA, 19 nt, Homo sapiens
uacaagcuccgcagccaaa

SEQ ID NO: 576830 - RNA, 19 nt, Homo sapiens
ggagcaggaggccaagaug

SEQ ID NO: 576831 - RNA, 19 nt, Homo sapiens
gacugauccucaacaccaa

SEQ ID NO: 576832 - RNA, 19 nt, Homo sapiens
agugcaagcuguuugucuu

SEQ ID NO: 576833 - RNA, 19 nt, Homo sapiens
gggacagaguuaagcugau

SEQ ID NO: 576834 - RNA, 19 nt, Homo sapiens
guauuugggcagaacuuga

SEQ ID NO: 576835 - RNA, 19 nt, Homo sapiens
gccaggggcuucugugaga

SEQ ID NO: 576836 - RNA, 19 nt, Homo sapiens
cccauuggacgugcuguua

SEQ ID NO: 576837 - RNA, 19 nt, Homo sapiens
guagacacugggcccauug

SEQ ID NO: 576838 - RNA, 19 nt, Homo sapiens
uguagacacugggcccauu

SEQ ID NO: 576839 - RNA, 19 nt, Homo sapiens
ggacccucaccaaaucuug

SEQ ID NO: 576840 - RNA, 19 nt, Homo sapiens
cucgggaacugccugaaug

SEQ ID NO: 576841 - RNA, 19 nt, Homo sapiens
gaguuaagcugauaaauga

SEQ ID NO: 576842 - RNA, 19 nt, Homo sapiens
uuagagaacucaaccaaua

SEQ ID NO: 576843 - RNA, 19 nt, Homo sapiens
ggacagaguuaagcugaua

SEQ ID NO: 576844 - RNA, 19 nt, Homo sapiens
gaacaaacaagaacauuuc

SEQ ID NO: 576845 - RNA, 19 nt, Homo sapiens
ggacacaggucaguuguau

SEQ ID NO: 576846 - RNA, 19 nt, Homo sapiens
guauaucaguuccaguuua

SEQ ID NO: 576847 - RNA, 19 nt, Homo sapiens
gagaagagcauucgcauca

SEQ ID NO: 576848 - RNA, 19 nt, Homo sapiens
cacgagaccucaucauauu

SEQ ID NO: 576849 - RNA, 19 nt, Homo sapiens
gaagagcauucgcaucaca

SEQ ID NO: 576850 - RNA, 19 nt, Homo sapiens
cgaacuauuuccuccagua

SEQ ID NO: 576851 - RNA, 19 nt, Homo sapiens
acagcaagccuuuguauuu

SEQ ID NO: 576852 - RNA, 19 nt, Homo sapiens
cagcaagccuuuguauuug

SEQ ID NO: 576853 - RNA, 19 nt, Homo sapiens
cagagaagauggaaauuac

SEQ ID NO: 576854 - RNA, 19 nt, Homo sapiens
gcaagcuguuugucuuuga

SEQ ID NO: 576855 - RNA, 19 nt, Homo sapiens
gacacgagaccucaucaua

SEQ ID NO: 576856 - RNA, 19 nt, Homo sapiens
caaccgcaacgaacuauuu

SEQ ID NO: 576857 - RNA, 19 nt, Homo sapiens
uaaacgaggucaguucaga

SEQ ID NO: 576858 - RNA, 19 nt, Homo sapiens
agaggaagccugugagaaa

SEQ ID NO: 576859 - RNA, 19 nt, Homo sapiens
cgaacaaacaagaacauuu

SEQ ID NO: 576860 - RNA, 19 nt, Homo sapiens
gaacaugagcgagcgaguu

SEQ ID NO: 576861 - RNA, 19 nt, Homo sapiens
gaugaggugugugcacuug

SEQ ID NO: 576862 - RNA, 19 nt, Homo sapiens
gaagaggaagccugugaga

SEQ ID NO: 576863 - RNA, 19 nt, Homo sapiens
acagagaagauggaaauua

SEQ ID NO: 576864 - RNA, 19 nt, Homo sapiens
ugacagagaagauggaaau

SEQ ID NO: 576865 - RNA, 19 nt, Homo sapiens
aaaugcagcugccgaguca

SEQ ID NO: 576866 - RNA, 19 nt, Homo sapiens
gaacuauuuccuccaguau

SEQ ID NO: 576867 - RNA, 19 nt, Homo sapiens
ucagaaggauaaaggacaa

SEQ ID NO: 576868 - RNA, 19 nt, Homo sapiens
acaccaggcugcugcuuug

SEQ ID NO: 576869 - RNA, 19 nt, Homo sapiens
gaugagcgaacaaacaaga

SEQ ID NO: 576870 - RNA, 19 nt, Homo sapiens
ggaaguguuuguuggaaaa

SEQ ID NO: 576871 - RNA, 19 nt, Homo sapiens
ggaccuggcgaacgaagaa

SEQ ID NO: 576872 - RNA, 19 nt, Homo sapiens
guauuuggccagaacauga

SEQ ID NO: 576873 - RNA, 19 nt, Homo sapiens
uauaucaguuccaguuuag

SEQ ID NO: 576874 - RNA, 19 nt, Homo sapiens
caaggacacaggucaguug

SEQ ID NO: 576875 - RNA, 19 nt, Homo sapiens
acuauuuccuccaguauau

SEQ ID NO: 576876 - RNA, 19 nt, Homo sapiens
acacgagaccucaucauau

SEQ ID NO: 576877 - RNA, 19 nt, Homo sapiens
agaguuaagcugauaaaug

SEQ ID NO: 576878 - RNA, 19 nt, Homo sapiens
gagaagauggaaauuacug

SEQ ID NO: 576879 - RNA, 19 nt, Homo sapiens
ggagagcaauguguuacag

SEQ ID NO: 576880 - RNA, 19 nt, Homo sapiens
gcggaaguguuuguuggaa

SEQ ID NO: 576881 - RNA, 19 nt, Homo sapiens
cgagaccucaucauauuga

SEQ ID NO: 576882 - RNA, 19 nt, Homo sapiens
ccacacagcaagccuuugu

SEQ ID NO: 576883 - RNA, 19 nt, Homo sapiens
cgacagcgacgaugacgau

SEQ ID NO: 576884 - RNA, 19 nt, Homo sapiens
cggaaguguuuguuggaaa

SEQ ID NO: 576885 - RNA, 19 nt, Homo sapiens
gcaauguguuacagaugca

SEQ ID NO: 576886 - RNA, 19 nt, Homo sapiens
ggagaaagagccccagaaa

SEQ ID NO: 576887 - RNA, 19 nt, Homo sapiens
cgacaaggccagcgagaag

SEQ ID NO: 576888 - RNA, 19 nt, Homo sapiens
uuacugcccuccugucaag

SEQ ID NO: 576889 - RNA, 19 nt, Homo sapiens
cagcgacgaugacgauguc

SEQ ID NO: 576890 - RNA, 19 nt, Homo sapiens
caguauaucaguuccaguu

SEQ ID NO: 576891 - RNA, 19 nt, Homo sapiens
gaggaagccugugagaaaa

SEQ ID NO: 576892 - RNA, 19 nt, Homo sapiens
ugugugcacuugaggagaa

SEQ ID NO: 576893 - RNA, 19 nt, Homo sapiens
gcaguggcuuccgguugaa

SEQ ID NO: 576894 - RNA, 19 nt, Homo sapiens
gaacugccugaaugugguu

SEQ ID NO: 576895 - RNA, 19 nt, Homo sapiens
gcucagacucaaugacaug

SEQ ID NO: 576896 - RNA, 19 nt, Homo sapiens
gagcaauguguuacagaug

SEQ ID NO: 576897 - RNA, 19 nt, Homo sapiens
gaagaaaagccugccauug

SEQ ID NO: 576898 - RNA, 19 nt, Homo sapiens
guuaagcugauaaaugaga

SEQ ID NO: 576899 - RNA, 19 nt, Homo sapiens
agagcaauguguuacagau

SEQ ID NO: 576900 - RNA, 19 nt, Homo sapiens
guccagcaaugccucugaa

SEQ ID NO: 576901 - RNA, 19 nt, Homo sapiens
gcgaacaaacaagaacauu

SEQ ID NO: 576902 - RNA, 19 nt, Homo sapiens
gggcccagaugcagaucga

SEQ ID NO: 576903 - RNA, 19 nt, Homo sapiens
gaugacggcacacuacagu

SEQ ID NO: 576904 - RNA, 19 nt, Homo sapiens
gggcugcucagacucaaug

SEQ ID NO: 576905 - RNA, 19 nt, Homo sapiens
gugcaagcuguuugucuuu

SEQ ID NO: 576906 - RNA, 19 nt, Homo sapiens
acacagcaagccuuuguau

SEQ ID NO: 576907 - RNA, 19 nt, Homo sapiens
agcaguggcuuccgguuga

SEQ ID NO: 576908 - RNA, 19 nt, Homo sapiens
gagagcaauguguuacaga

SEQ ID NO: 576909 - RNA, 19 nt, Homo sapiens
aacaugagcgagcgaguuu

SEQ ID NO: 576910 - RNA, 19 nt, Homo sapiens
cgacgccuccagcaacaaa

SEQ ID NO: 576911 - RNA, 19 nt, Homo sapiens
gagcgaacaaacaagaaca

SEQ ID NO: 576912 - RNA, 19 nt, Homo sapiens
ggcggagagcaauguguua

SEQ ID NO: 576913 - RNA, 19 nt, Homo sapiens
ccagcaaugccucugaaga

SEQ ID NO: 576914 - RNA, 19 nt, Homo sapiens
gagaaagagccccagaaaa

SEQ ID NO: 576915 - RNA, 19 nt, Homo sapiens
uacaagcuccgcagccaaa

SEQ ID NO: 576916 - RNA, 19 nt, Homo sapiens
ggagcaggaggccaagaug

SEQ ID NO: 576917 - RNA, 19 nt, Homo sapiens
gacugauccucaacaccaa

SEQ ID NO: 576918 - RNA, 19 nt, Homo sapiens
agugcaagcuguuugucuu

SEQ ID NO: 576919 - RNA, 19 nt, Homo sapiens
gggacagaguuaagcugau

SEQ ID NO: 576920 - RNA, 19 nt, Homo sapiens
guauuugggcagaacuuga

SEQ ID NO: 576921 - RNA, 19 nt, Homo sapiens
cucgggaacugccugaaug

SEQ ID NO: 576922 - RNA, 19 nt, Homo sapiens
ggaggacgacagcgacgau

SEQ ID NO: 576923 - RNA, 19 nt, Homo sapiens
acacaggucaguuguaugc

SEQ ID NO: 576924 - RNA, 19 nt, Homo sapiens
gacagaguuaagcugauaa

SEQ ID NO: 576925 - RNA, 19 nt, Homo sapiens
gacaaggccagcgagaaga

SEQ ID NO: 576926 - RNA, 19 nt, Homo sapiens
ggaggaggcggagagcaau

SEQ ID NO: 576927 - RNA, 19 nt, Homo sapiens
ucagaugccaacagggaaa

SEQ ID NO: 576928 - RNA, 19 nt, Homo sapiens
guuuagagaacucaaccaa

SEQ ID NO: 576929 - RNA, 19 nt, Homo sapiens
caagccagaagcccaagga

SEQ ID NO: 576930 - RNA, 19 nt, Homo sapiens
gagaacucaaccaauagug

SEQ ID NO: 576931 - RNA, 19 nt, Homo sapiens
ucaguuccaguuuagagaa

SEQ ID NO: 576932 - RNA, 19 nt, Homo sapiens
cugaagaggaagccuguga

SEQ ID NO: 576933 - RNA, 19 nt, Homo sapiens
ugaggugugugcacuugag

SEQ ID NO: 576934 - RNA, 19 nt, Homo sapiens
cauccucuuuaacccaguu

SEQ ID NO: 576935 - RNA, 19 nt, Homo sapiens
ggacacgagaccucaucau

SEQ ID NO: 576936 - RNA, 19 nt, Homo sapiens
aaagcagacucgggaacug

SEQ ID NO: 576937 - RNA, 19 nt, Homo sapiens
ccaaggacacaggucaguu

SEQ ID NO: 576938 - RNA, 19 nt, Homo sapiens
ccugaaggcggagaagauu

SEQ ID NO: 576939 - RNA, 19 nt, Homo sapiens
uagagaacucaaccaauag

SEQ ID NO: 576940 - RNA, 19 nt, Homo sapiens
aagccgacauggagaaugc

SEQ ID NO: 576941 - RNA, 19 nt, Homo sapiens
gaguuaagcugauaaauga

SEQ ID NO: 576942 - RNA, 19 nt, Homo sapiens
gcaaagaccucaucauguc

SEQ ID NO: 576943 - RNA, 19 nt, Homo sapiens
uuagagaacucaaccaaua

SEQ ID NO: 576944 - RNA, 19 nt, Homo sapiens
ggacagaguuaagcugaua

SEQ ID NO: 576945 - RNA, 19 nt, Homo sapiens
aaagaucacuuguaacuug

SEQ ID NO: 576946 - RNA, 19 nt, Homo sapiens
caaaguggcagguuuauga

SEQ ID NO: 576947 - RNA, 19 nt, Homo sapiens
gagcuaaggguuaauguuu

SEQ ID NO: 576948 - RNA, 19 nt, Homo sapiens
cgaacuauuuccuccagua

SEQ ID NO: 576949 - RNA, 19 nt, Homo sapiens
acagcaagccuuuguauuu

SEQ ID NO: 576950 - RNA, 19 nt, Homo sapiens
ugacaaaguggcagguuua

SEQ ID NO: 576951 - RNA, 19 nt, Homo sapiens
cagcaagccuuuguauuug

SEQ ID NO: 576952 - RNA, 19 nt, Homo sapiens
gcaagcuguuugucuuuga

SEQ ID NO: 576953 - RNA, 19 nt, Homo sapiens
caucuucucuucaguuuag

SEQ ID NO: 576954 - RNA, 19 nt, Homo sapiens
gggcaaagaccucaucaug

SEQ ID NO: 576955 - RNA, 19 nt, Homo sapiens
cagagucggucucccauga

SEQ ID NO: 576956 - RNA, 19 nt, Homo sapiens
caaccgcaacgaacuauuu

SEQ ID NO: 576957 - RNA, 19 nt, Homo sapiens
uaaacgaggucaguucaga

SEQ ID NO: 576958 - RNA, 19 nt, Homo sapiens
ugugcuaacuggauuaauu

SEQ ID NO: 576959 - RNA, 19 nt, Homo sapiens
gcacaucuucucuucaguu

SEQ ID NO: 576960 - RNA, 19 nt, Homo sapiens
agaggaagccugugagaaa

SEQ ID NO: 576961 - RNA, 19 nt, Homo sapiens
ccaggugucucagaagaaa

SEQ ID NO: 576962 - RNA, 19 nt, Homo sapiens
gaacaugagcgagcgaguu

SEQ ID NO: 576963 - RNA, 19 nt, Homo sapiens
gaugaggugugugcacuug

SEQ ID NO: 576964 - RNA, 19 nt, Homo sapiens
gaagaggaagccugugaga

SEQ ID NO: 576965 - RNA, 19 nt, Homo sapiens
aaaugcagcugccgaguca

SEQ ID NO: 576966 - RNA, 19 nt, Homo sapiens
uuaaagagaggcugucuga

SEQ ID NO: 576967 - RNA, 19 nt, Homo sapiens
ggaguuucauguaaucaca

SEQ ID NO: 576968 - RNA, 19 nt, Homo sapiens
gaacuauuuccuccaguau

SEQ ID NO: 576969 - RNA, 19 nt, Homo sapiens
ggaaguguuuguuggaaaa

SEQ ID NO: 576970 - RNA, 19 nt, Homo sapiens
cuaacuggauuaauucaca

SEQ ID NO: 576971 - RNA, 19 nt, Homo sapiens
guauuuggccagaacauga

SEQ ID NO: 576972 - RNA, 19 nt, Homo sapiens
cacaucuucucuucaguuu

SEQ ID NO: 576973 - RNA, 19 nt, Homo sapiens
ucacugggaguuucaugua

SEQ ID NO: 576974 - RNA, 19 nt, Homo sapiens
gaaagaucacuuguaacuu

SEQ ID NO: 576975 - RNA, 19 nt, Homo sapiens
acuauuuccuccaguauau

SEQ ID NO: 576976 - RNA, 19 nt, Homo sapiens
uuacugugcuaacuggauu

SEQ ID NO: 576977 - RNA, 19 nt, Homo sapiens
cacgagcccuggaaaguuc

SEQ ID NO: 576978 - RNA, 19 nt, Homo sapiens
agaguuaagcugauaaaug

SEQ ID NO: 576979 - RNA, 19 nt, Homo sapiens
ggagagcaauguguuacag

SEQ ID NO: 576980 - RNA, 19 nt, Homo sapiens
gcggaaguguuuguuggaa

SEQ ID NO: 576981 - RNA, 19 nt, Homo sapiens
agaaagaucacuuguaacu

SEQ ID NO: 576982 - RNA, 19 nt, Homo sapiens
ggcaaagaccucaucaugu

SEQ ID NO: 576983 - RNA, 19 nt, Homo sapiens
ccacacagcaagccuuugu

SEQ ID NO: 576984 - RNA, 19 nt, Homo sapiens
cggaaguguuuguuggaaa

SEQ ID NO: 576985 - RNA, 19 nt, Homo sapiens
gugcuucccugcaaagucu

SEQ ID NO: 576986 - RNA, 19 nt, Homo sapiens
gcaauguguuacagaugca

SEQ ID NO: 576987 - RNA, 19 nt, Homo sapiens
ggagaaagagccccagaaa

SEQ ID NO: 576988 - RNA, 19 nt, Homo sapiens
gagugugcccucugucuug

SEQ ID NO: 576989 - RNA, 19 nt, Homo sapiens
gaccucaucauguccuuga

SEQ ID NO: 576990 - RNA, 19 nt, Homo sapiens
gaggaagccugugagaaaa

SEQ ID NO: 576991 - RNA, 19 nt, Homo sapiens
ugugugcacuugaggagaa

SEQ ID NO: 576992 - RNA, 19 nt, Homo sapiens
cacugggaguuucauguaa

SEQ ID NO: 576993 - RNA, 19 nt, Homo sapiens
cugacaaaguggcagguuu

SEQ ID NO: 576994 - RNA, 19 nt, Homo sapiens
ggacuaugcaauuccaaag

SEQ ID NO: 576995 - RNA, 19 nt, Homo sapiens
aagaucacuuguaacuuga

SEQ ID NO: 576996 - RNA, 19 nt, Homo sapiens
ccacgagcccuggaaaguu

SEQ ID NO: 576997 - RNA, 19 nt, Homo sapiens
gcucagacucaaugacaug

SEQ ID NO: 576998 - RNA, 19 nt, Homo sapiens
gagcaauguguuacagaug

SEQ ID NO: 576999 - RNA, 19 nt, Homo sapiens
acauuugccuggccacguu

SEQ ID NO: 577000 - RNA, 19 nt, Homo sapiens
gagcgucguguguucagaa

SEQ ID NO: 577001 - RNA, 19 nt, Homo sapiens
ggagugugcccucugucuu

SEQ ID NO: 577002 - RNA, 19 nt, Homo sapiens
guuaagcugauaaaugaga

SEQ ID NO: 577003 - RNA, 19 nt, Homo sapiens
agagcaauguguuacagau

SEQ ID NO: 577004 - RNA, 19 nt, Homo sapiens
cauugcacaucuucucuuc

SEQ ID NO: 577005 - RNA, 19 nt, Homo sapiens
guccagcaaugccucugaa

SEQ ID NO: 577006 - RNA, 19 nt, Homo sapiens
gcucguccgugacccucuu

SEQ ID NO: 577007 - RNA, 19 nt, Homo sapiens
gaugacggcacacuacagu

SEQ ID NO: 577008 - RNA, 19 nt, Homo sapiens
gggcugcucagacucaaug

SEQ ID NO: 577009 - RNA, 19 nt, Homo sapiens
gugcaagcuguuugucuuu

SEQ ID NO: 577010 - RNA, 19 nt, Homo sapiens
ccacacucauugcacaucu

SEQ ID NO: 577011 - RNA, 19 nt, Homo sapiens
acacagcaagccuuuguau

SEQ ID NO: 577012 - RNA, 19 nt, Homo sapiens
aaauaacaguagccagauc

SEQ ID NO: 577013 - RNA, 19 nt, Homo sapiens
gagagcaauguguuacaga

SEQ ID NO: 577014 - RNA, 19 nt, Homo sapiens
aacaugagcgagcgaguuu

SEQ ID NO: 577015 - RNA, 19 nt, Homo sapiens
cgacgccuccagcaacaaa

SEQ ID NO: 577016 - RNA, 19 nt, Homo sapiens
caaaauggacaaaagucua

SEQ ID NO: 577017 - RNA, 19 nt, Homo sapiens
gggacuaugcaauuccaaa

SEQ ID NO: 577018 - RNA, 19 nt, Homo sapiens
gugcuaacuggauuaauuc

SEQ ID NO: 577019 - RNA, 19 nt, Homo sapiens
ggcggagagcaauguguua

SEQ ID NO: 577020 - RNA, 19 nt, Homo sapiens
ugagacaggaccagaguuc

SEQ ID NO: 577021 - RNA, 19 nt, Homo sapiens
ccagcaaugccucugaaga

SEQ ID NO: 577022 - RNA, 19 nt, Homo sapiens
gagaaagagccccagaaaa

SEQ ID NO: 577023 - RNA, 19 nt, Homo sapiens
uacaagcuccgcagccaaa

SEQ ID NO: 577024 - RNA, 19 nt, Homo sapiens
agugcaagcuguuugucuu

SEQ ID NO: 577025 - RNA, 19 nt, Homo sapiens
gcuaaggguuaauguuuuc

SEQ ID NO: 577026 - RNA, 19 nt, Homo sapiens
gggacagaguuaagcugau

SEQ ID NO: 577027 - RNA, 19 nt, Homo sapiens
guauuugggcagaacuuga

SEQ ID NO: 577028 - RNA, 19 nt, Homo sapiens
cagccugucuguccuucau

SEQ ID NO: 577029 - RNA, 19 nt, Homo sapiens
gcccagcaguagcgcacuu

SEQ ID NO: 577030 - RNA, 19 nt, Homo sapiens
gacagaguuaagcugauaa

SEQ ID NO: 577031 - RNA, 19 nt, Homo sapiens
gacaaaguggcagguuuau

SEQ ID NO: 577032 - RNA, 19 nt, Homo sapiens
acaaaagucuauggaaguu

SEQ ID NO: 577033 - RNA, 19 nt, Homo sapiens
ggaggaggcggagagcaau

SEQ ID NO: 577034 - RNA, 19 nt, Homo sapiens
ucagaugccaacagggaaa

SEQ ID NO: 577035 - RNA, 19 nt, Homo sapiens
guuuagagaacucaaccaa

SEQ ID NO: 577036 - RNA, 19 nt, Homo sapiens
cgagcuaaggguuaauguu

SEQ ID NO: 577037 - RNA, 19 nt, Homo sapiens
cuccaggugucucagaaga

SEQ ID NO: 577038 - RNA, 19 nt, Homo sapiens
ccucaugcccagagcagaa

SEQ ID NO: 577039 - RNA, 19 nt, Homo sapiens
gagaacucaaccaauagug

SEQ ID NO: 577040 - RNA, 19 nt, Homo sapiens
caagccagaagcccaagga

SEQ ID NO: 577041 - RNA, 19 nt, Homo sapiens
gaguuaagcugauaaauga

SEQ ID NO: 577042 - RNA, 19 nt, Homo sapiens
uuagagaacucaaccaaua

SEQ ID NO: 577043 - RNA, 19 nt, Homo sapiens
ggacagaguuaagcugaua

SEQ ID NO: 577044 - RNA, 19 nt, Homo sapiens
gaacaaacaagaacauuuc

SEQ ID NO: 577045 - RNA, 19 nt, Homo sapiens
ggacacaggucaguuguau

SEQ ID NO: 577046 - RNA, 19 nt, Homo sapiens
guauaucaguuccaguuua

SEQ ID NO: 577047 - RNA, 19 nt, Homo sapiens
gagaagagcauucgcauca

SEQ ID NO: 577048 - RNA, 19 nt, Homo sapiens
cacgagaccucaucauauu

SEQ ID NO: 577049 - RNA, 19 nt, Homo sapiens
gcuguuaacuacuaucuuc

SEQ ID NO: 577050 - RNA, 19 nt, Homo sapiens
gaagagcauucgcaucaca

SEQ ID NO: 577051 - RNA, 19 nt, Homo sapiens
cgaacuauuuccuccagua

SEQ ID NO: 577052 - RNA, 19 nt, Homo sapiens
acagcaagccuuuguauuu

SEQ ID NO: 577053 - RNA, 19 nt, Homo sapiens
cagcaagccuuuguauuug

SEQ ID NO: 577054 - RNA, 19 nt, Homo sapiens
cagagaagauggaaauuac

SEQ ID NO: 577055 - RNA, 19 nt, Homo sapiens
gcaagcuguuugucuuuga

SEQ ID NO: 577056 - RNA, 19 nt, Homo sapiens
gacacgagaccucaucaua

SEQ ID NO: 577057 - RNA, 19 nt, Homo sapiens
caaccgcaacgaacuauuu

SEQ ID NO: 577058 - RNA, 19 nt, Homo sapiens
gacgugcuguuaacuacua

SEQ ID NO: 577059 - RNA, 19 nt, Homo sapiens
uaaacgaggucaguucaga

SEQ ID NO: 577060 - RNA, 19 nt, Homo sapiens
agaggaagccugugagaaa

SEQ ID NO: 577061 - RNA, 19 nt, Homo sapiens
cgaacaaacaagaacauuu

SEQ ID NO: 577062 - RNA, 19 nt, Homo sapiens
gaacaugagcgagcgaguu

SEQ ID NO: 577063 - RNA, 19 nt, Homo sapiens
gaugaggugugugcacuug

SEQ ID NO: 577064 - RNA, 19 nt, Homo sapiens
gaagaggaagccugugaga

SEQ ID NO: 577065 - RNA, 19 nt, Homo sapiens
acagagaagauggaaauua

SEQ ID NO: 577066 - RNA, 19 nt, Homo sapiens
ugacagagaagauggaaau

SEQ ID NO: 577067 - RNA, 19 nt, Homo sapiens
aaaugcagcugccgaguca

SEQ ID NO: 577068 - RNA, 19 nt, Homo sapiens
gaacuauuuccuccaguau

SEQ ID NO: 577069 - RNA, 19 nt, Homo sapiens
ucagaaggauaaaggacaa

SEQ ID NO: 577070 - RNA, 19 nt, Homo sapiens
acaccaggcugcugcuuug

SEQ ID NO: 577071 - RNA, 19 nt, Homo sapiens
gaugagcgaacaaacaaga

SEQ ID NO: 577072 - RNA, 19 nt, Homo sapiens
ggaaguguuuguuggaaaa

SEQ ID NO: 577073 - RNA, 19 nt, Homo sapiens
ggaccuggcgaacgaagaa

SEQ ID NO: 577074 - RNA, 19 nt, Homo sapiens
guauuuggccagaacauga

SEQ ID NO: 577075 - RNA, 19 nt, Homo sapiens
uauaucaguuccaguuuag

SEQ ID NO: 577076 - RNA, 19 nt, Homo sapiens
caaggacacaggucaguug

SEQ ID NO: 577077 - RNA, 19 nt, Homo sapiens
cgagucagcuggcgagcau

SEQ ID NO: 577078 - RNA, 19 nt, Homo sapiens
acuauuuccuccaguauau

SEQ ID NO: 577079 - RNA, 19 nt, Homo sapiens
acacgagaccucaucauau

SEQ ID NO: 577080 - RNA, 19 nt, Homo sapiens
agaguuaagcugauaaaug

SEQ ID NO: 577081 - RNA, 19 nt, Homo sapiens
gagaagauggaaauuacug

SEQ ID NO: 577082 - RNA, 19 nt, Homo sapiens
ggagagcaauguguuacag

SEQ ID NO: 577083 - RNA, 19 nt, Homo sapiens
gcggaaguguuuguuggaa

SEQ ID NO: 577084 - RNA, 19 nt, Homo sapiens
cgagaccucaucauauuga

SEQ ID NO: 577085 - RNA, 19 nt, Homo sapiens
ccacacagcaagccuuugu

SEQ ID NO: 577086 - RNA, 19 nt, Homo sapiens
cgacagcgacgaugacgau

SEQ ID NO: 577087 - RNA, 19 nt, Homo sapiens
cggaaguguuuguuggaaa

SEQ ID NO: 577088 - RNA, 19 nt, Homo sapiens
gcaauguguuacagaugca

SEQ ID NO: 577089 - RNA, 19 nt, Homo sapiens
ggagaaagagccccagaaa

SEQ ID NO: 577090 - RNA, 19 nt, Homo sapiens
uaucuucauuucccacuuc

SEQ ID NO: 577091 - RNA, 19 nt, Homo sapiens
cgacaaggccagcgagaag

SEQ ID NO: 577092 - RNA, 19 nt, Homo sapiens
uuacugcccuccugucaag

SEQ ID NO: 577093 - RNA, 19 nt, Homo sapiens
cagcgacgaugacgauguc

SEQ ID NO: 577094 - RNA, 19 nt, Homo sapiens
caguauaucaguuccaguu

SEQ ID NO: 577095 - RNA, 19 nt, Homo sapiens
gaggaagccugugagaaaa

SEQ ID NO: 577096 - RNA, 19 nt, Homo sapiens
ugugugcacuugaggagaa

SEQ ID NO: 577097 - RNA, 19 nt, Homo sapiens
gcaguggcuuccgguugaa

SEQ ID NO: 577098 - RNA, 19 nt, Homo sapiens
gaagaaaagccugccauug

SEQ ID NO: 577099 - RNA, 19 nt, Homo sapiens
gaacugccugaaugugguu

SEQ ID NO: 577100 - RNA, 19 nt, Homo sapiens
gcucagacucaaugacaug

SEQ ID NO: 577101 - RNA, 19 nt, Homo sapiens
gagcaauguguuacagaug

SEQ ID NO: 577102 - RNA, 19 nt, Homo sapiens
uggcgagcaugcccuagaa

SEQ ID NO: 577103 - RNA, 19 nt, Homo sapiens
guuaagcugauaaaugaga

SEQ ID NO: 577104 - RNA, 19 nt, Homo sapiens
agagcaauguguuacagau

SEQ ID NO: 577105 - RNA, 19 nt, Homo sapiens
guccagcaaugccucugaa

SEQ ID NO: 577106 - RNA, 19 nt, Homo sapiens
gcgaacaaacaagaacauu

SEQ ID NO: 577107 - RNA, 19 nt, Homo sapiens
gggcccagaugcagaucga

SEQ ID NO: 577108 - RNA, 19 nt, Homo sapiens
gaugacggcacacuacagu

SEQ ID NO: 577109 - RNA, 19 nt, Homo sapiens
gggcugcucagacucaaug

SEQ ID NO: 577110 - RNA, 19 nt, Homo sapiens
gugcaagcuguuugucuuu

SEQ ID NO: 577111 - RNA, 19 nt, Homo sapiens
acacagcaagccuuuguau

SEQ ID NO: 577112 - RNA, 19 nt, Homo sapiens
agcaguggcuuccgguuga

SEQ ID NO: 577113 - RNA, 19 nt, Homo sapiens
ccauuggacgugcuguuaa

SEQ ID NO: 577114 - RNA, 19 nt, Homo sapiens
gagagcaauguguuacaga

SEQ ID NO: 577115 - RNA, 19 nt, Homo sapiens
aacaugagcgagcgaguuu

SEQ ID NO: 577116 - RNA, 19 nt, Homo sapiens
cgacgccuccagcaacaaa

SEQ ID NO: 577117 - RNA, 19 nt, Homo sapiens
gagcgaacaaacaagaaca

SEQ ID NO: 577118 - RNA, 19 nt, Homo sapiens
ggcggagagcaauguguua

SEQ ID NO: 577119 - RNA, 19 nt, Homo sapiens
ccagcaaugccucugaaga

SEQ ID NO: 577120 - RNA, 19 nt, Homo sapiens
gagaaagagccccagaaaa

SEQ ID NO: 577121 - RNA, 19 nt, Homo sapiens
uacaagcuccgcagccaaa

SEQ ID NO: 577122 - RNA, 19 nt, Homo sapiens
ggagcaggaggccaagaug

SEQ ID NO: 577123 - RNA, 19 nt, Homo sapiens
gacugauccucaacaccaa

SEQ ID NO: 577124 - RNA, 19 nt, Homo sapiens
agugcaagcuguuugucuu

SEQ ID NO: 577125 - RNA, 19 nt, Homo sapiens
gggacagaguuaagcugau

SEQ ID NO: 577126 - RNA, 19 nt, Homo sapiens
guauuugggcagaacuuga

SEQ ID NO: 577127 - RNA, 19 nt, Homo sapiens
cccauuggacgugcuguua

SEQ ID NO: 577128 - RNA, 19 nt, Homo sapiens
guagacacugggcccauug

SEQ ID NO: 577129 - RNA, 19 nt, Homo sapiens
uguagacacugggcccauu

SEQ ID NO: 577130 - RNA, 19 nt, Homo sapiens
cucgggaacugccugaaug

SEQ ID NO: 577131 - RNA, 19 nt, Homo sapiens
ggaggacgacagcgacgau

SEQ ID NO: 577132 - RNA, 19 nt, Homo sapiens
acacaggucaguuguaugc

SEQ ID NO: 577133 - RNA, 19 nt, Homo sapiens
gacagaguuaagcugauaa

SEQ ID NO: 577134 - RNA, 19 nt, Homo sapiens
gacaaggccagcgagaaga

SEQ ID NO: 577135 - RNA, 19 nt, Homo sapiens
ggaggaggcggagagcaau

SEQ ID NO: 577136 - RNA, 19 nt, Homo sapiens
ucagaugccaacagggaaa

SEQ ID NO: 577137 - RNA, 19 nt, Homo sapiens
guuuagagaacucaaccaa

SEQ ID NO: 577138 - RNA, 19 nt, Homo sapiens
gagaacucaaccaauagug

SEQ ID NO: 577139 - RNA, 19 nt, Homo sapiens
caagccagaagcccaagga

SEQ ID NO: 577140 - RNA, 19 nt, Homo sapiens
ccacuuccccucucugauu

SEQ ID NO: 577141 - RNA, 19 nt, Homo sapiens
gaagaaaucucugaacuua

SEQ ID NO: 577142 - RNA, 19 nt, Homo sapiens
gaauagaacucaacagauu

SEQ ID NO: 577143 - RNA, 19 nt, Homo sapiens
ggaauuaugugcuuaaaga

SEQ ID NO: 577144 - RNA, 19 nt, Homo sapiens
gaucugaacuugaccaauu

SEQ ID NO: 577145 - RNA, 19 nt, Homo sapiens
gaaagaaucugaggaagga

SEQ ID NO: 577146 - RNA, 19 nt, Homo sapiens
gcacugaaaucuuuguuug

SEQ ID NO: 577147 - RNA, 19 nt, Homo sapiens
ggacaaagcaacaauuaaa

SEQ ID NO: 577148 - RNA, 19 nt, Homo sapiens
gagagaaucuaccuccaua

SEQ ID NO: 577149 - RNA, 19 nt, Homo sapiens
gaagugaugcccacgauua

SEQ ID NO: 577150 - RNA, 19 nt, Homo sapiens
caacuacacuuaaaggaaa

SEQ ID NO: 577151 - RNA, 19 nt, Homo sapiens
gaagagagacauggaaaua

SEQ ID NO: 577152 - RNA, 19 nt, Homo sapiens
ggagaaagauugcaguugu

SEQ ID NO: 577153 - RNA, 19 nt, Homo sapiens
cgaugaaacuagucaaaua

SEQ ID NO: 577154 - RNA, 19 nt, Homo sapiens
gauggaaccuggacagaaa

SEQ ID NO: 577155 - RNA, 19 nt, Homo sapiens
caugaaagaucacuaagaa

SEQ ID NO: 577156 - RNA, 19 nt, Homo sapiens
ggaaucaagucuucaauag

SEQ ID NO: 577157 - RNA, 19 nt, Homo sapiens
ucaaggcacugaaaucuuu

SEQ ID NO: 577158 - RNA, 19 nt, Homo sapiens
gcaaugaugugugaaguga

SEQ ID NO: 577159 - RNA, 19 nt, Homo sapiens
aaugagaacuggcucuuua

SEQ ID NO: 577160 - RNA, 19 nt, Homo sapiens
caagaaaggaucucauuaa

SEQ ID NO: 577161 - RNA, 19 nt, Homo sapiens
gcacuaccaucuaagaaga

SEQ ID NO: 577162 - RNA, 19 nt, Homo sapiens
gaaucuaccuccauacaug

SEQ ID NO: 577163 - RNA, 19 nt, Homo sapiens
gcuuaaagagguugaauua

SEQ ID NO: 577164 - RNA, 19 nt, Homo sapiens
gaacaaguuuacaauaugg

SEQ ID NO: 577165 - RNA, 19 nt, Homo sapiens
gcaagaaaggaucucauua

SEQ ID NO: 577166 - RNA, 19 nt, Homo sapiens
gugcauggcucacuuauag

SEQ ID NO: 577167 - RNA, 19 nt, Homo sapiens
gaagaguggugccaucaug

SEQ ID NO: 577168 - RNA, 19 nt, Homo sapiens
ucaaagagcuaggcaaaga

SEQ ID NO: 577169 - RNA, 19 nt, Homo sapiens
ggauuuagguuaaccacaa

SEQ ID NO: 577170 - RNA, 19 nt, Homo sapiens
gaagcaagccaacaugaaa

SEQ ID NO: 577171 - RNA, 19 nt, Homo sapiens
gaucuucucucuccaagug

SEQ ID NO: 577172 - RNA, 19 nt, Homo sapiens
agaacuggcucuuuaauug

SEQ ID NO: 577173 - RNA, 19 nt, Homo sapiens
ugaaagggaucgucuucua

SEQ ID NO: 577174 - RNA, 19 nt, Homo sapiens
aagaauggcugcucuagaa

SEQ ID NO: 577175 - RNA, 19 nt, Homo sapiens
gaaagaucacuaagaauga

SEQ ID NO: 577176 - RNA, 19 nt, Homo sapiens
ggaauuugcugcacugaca

SEQ ID NO: 577177 - RNA, 19 nt, Homo sapiens
gaggacaaagcaacaauua

SEQ ID NO: 577178 - RNA, 19 nt, Homo sapiens
ggagaugguuucccuaaca

SEQ ID NO: 577179 - RNA, 19 nt, Homo sapiens
gaucacgaguggaauagaa

SEQ ID NO: 577180 - RNA, 19 nt, Homo sapiens
gagaagcguuuguccaaug

SEQ ID NO: 577181 - RNA, 19 nt, Homo sapiens
gaaaggaucucauuaaaac

SEQ ID NO: 577182 - RNA, 19 nt, Homo sapiens
gaaaagaacuagaaagaag

SEQ ID NO: 577183 - RNA, 19 nt, Homo sapiens
agagagacauggaaauauu

SEQ ID NO: 577184 - RNA, 19 nt, Homo sapiens
caauuggacuucgagaaua

SEQ ID NO: 577185 - RNA, 19 nt, Homo sapiens
caucaagacugcagagguu

SEQ ID NO: 577186 - RNA, 19 nt, Homo sapiens
caucaugucugcuuuaucu

SEQ ID NO: 577187 - RNA, 19 nt, Homo sapiens
ugagaaggaucgaagacua

SEQ ID NO: 577188 - RNA, 19 nt, Homo sapiens
acacugaaaugucugauau

SEQ ID NO: 577189 - RNA, 19 nt, Homo sapiens
ggaaagauuagcagaagaa

SEQ ID NO: 577190 - RNA, 19 nt, Homo sapiens
gacagaaaguccaugagaa

SEQ ID NO: 577191 - RNA, 19 nt, Homo sapiens
aaagugcacuaccaucuaa

SEQ ID NO: 577192 - RNA, 19 nt, Homo sapiens
cgaacaaguuuacaauaug

SEQ ID NO: 577193 - RNA, 19 nt, Homo sapiens
caagugaucugaggaaaca

SEQ ID NO: 577194 - RNA, 19 nt, Homo sapiens
gaacuggcucuuuaauuga

SEQ ID NO: 577195 - RNA, 19 nt, Homo sapiens
gaaaugaacaccaaguauc

SEQ ID NO: 577196 - RNA, 19 nt, Homo sapiens
cagaagaaaugaacaccaa

SEQ ID NO: 577197 - RNA, 19 nt, Homo sapiens
gaacuuaaagcugaaagaa

SEQ ID NO: 577198 - RNA, 19 nt, Homo sapiens
acacugagauccagagaga

SEQ ID NO: 577199 - RNA, 19 nt, Homo sapiens
gaacguaugagacauuuag

SEQ ID NO: 577200 - RNA, 19 nt, Homo sapiens
gaagaacguaugagacauu

SEQ ID NO: 577201 - RNA, 19 nt, Homo sapiens
gcaaggacccgaaaucaca

SEQ ID NO: 577202 - RNA, 19 nt, Homo sapiens
gaaaggcgacuggaugaaa

SEQ ID NO: 577203 - RNA, 19 nt, Homo sapiens
aaucaagucuucaauagga

SEQ ID NO: 577204 - RNA, 19 nt, Homo sapiens
gaccugcuauggcgucuuu

SEQ ID NO: 577205 - RNA, 19 nt, Homo sapiens
gaugacagagaaacaauuu

SEQ ID NO: 577206 - RNA, 19 nt, Homo sapiens
gcugaaaccuugccugaag

SEQ ID NO: 577207 - RNA, 19 nt, Homo sapiens
caggaaagccucucacuug

SEQ ID NO: 577208 - RNA, 19 nt, Homo sapiens
gcaauuggacuucgagaau

SEQ ID NO: 577209 - RNA, 19 nt, Homo sapiens
gagguugaauuaugacaga

SEQ ID NO: 577210 - RNA, 19 nt, Homo sapiens
cgaaguaguuuaucugucu

SEQ ID NO: 577211 - RNA, 19 nt, Homo sapiens
gaaagaagacgggaagcaa

SEQ ID NO: 577212 - RNA, 19 nt, Homo sapiens
agacugcgguugucauuga

SEQ ID NO: 577213 - RNA, 19 nt, Homo sapiens
ccagguaccuccauuacug

SEQ ID NO: 577214 - RNA, 19 nt, Homo sapiens
aaagaaaucaggcuaauuc

SEQ ID NO: 577215 - RNA, 19 nt, Homo sapiens
ugaaagaucacuaagaaug

SEQ ID NO: 577216 - RNA, 19 nt, Homo sapiens
gacuauuacuggagcauuu

SEQ ID NO: 577217 - RNA, 19 nt, Homo sapiens
gagaaggaucgaagacuaa

SEQ ID NO: 577218 - RNA, 19 nt, Homo sapiens
ugucugauauugaugauga

SEQ ID NO: 577219 - RNA, 19 nt, Homo sapiens
guaauaagaagaccaagga

SEQ ID NO: 577220 - RNA, 19 nt, Homo sapiens
gaaucaagaacuucaaaga

SEQ ID NO: 577221 - RNA, 19 nt, Homo sapiens
aaacagacaguuacaagaa

SEQ ID NO: 577222 - RNA, 19 nt, Homo sapiens
ccagcuggauuuagguuaa

SEQ ID NO: 577223 - RNA, 19 nt, Homo sapiens
agaaaggaaucaagucuuc

SEQ ID NO: 577224 - RNA, 19 nt, Homo sapiens
ggaugaaagugaugacaag

SEQ ID NO: 577225 - RNA, 19 nt, Homo sapiens
gaggagagaagaugcugua

SEQ ID NO: 577226 - RNA, 19 nt, Homo sapiens
gagaaagauugcaguugug

SEQ ID NO: 577227 - RNA, 19 nt, Homo sapiens
gagaugagccaaaggugaa

SEQ ID NO: 577228 - RNA, 19 nt, Homo sapiens
cgacaugaaagaucacuaa

SEQ ID NO: 577229 - RNA, 19 nt, Homo sapiens
guuauucgcuggauacaag

SEQ ID NO: 577230 - RNA, 19 nt, Homo sapiens
gagcaaugaccgaguuauu

SEQ ID NO: 577231 - RNA, 19 nt, Homo sapiens
gagaugguuucccuaacaa

SEQ ID NO: 577232 - RNA, 19 nt, Homo sapiens
ugaagaagcucggagaaag

SEQ ID NO: 577233 - RNA, 19 nt, Homo sapiens
gagaacuggcucuuuaauu

SEQ ID NO: 577234 - RNA, 19 nt, Homo sapiens
gggaacaacuucuagaaaa

SEQ ID NO: 577235 - RNA, 19 nt, Homo sapiens
gaagaaaggaaucaagucu

SEQ ID NO: 577236 - RNA, 19 nt, Homo sapiens
gaacuggcucagagaauug

SEQ ID NO: 577237 - RNA, 19 nt, Homo sapiens
ugaacuggcucagagaauu

SEQ ID NO: 577238 - RNA, 19 nt, Homo sapiens
gaagauauggaagaaagaa

SEQ ID NO: 577239 - RNA, 19 nt, Homo sapiens
aaaggaagauauggaagaa

SEQ ID NO: 577240 - RNA, 19 nt, Homo sapiens
ugaaauggcccagaugaaa

SEQ ID NO: 577241 - RNA, 19 nt, Homo sapiens
ggaaagaacuggaaagaaa

SEQ ID NO: 577242 - RNA, 19 nt, Homo sapiens
gaagaaagguuacgacaga

SEQ ID NO: 577243 - RNA, 19 nt, Homo sapiens
gagaauggcugcuuuggaa

SEQ ID NO: 577244 - RNA, 19 nt, Homo sapiens
caucaaaucugaagaaaug

SEQ ID NO: 577245 - RNA, 19 nt, Homo sapiens
gcacugaaguccuuauuug

SEQ ID NO: 577246 - RNA, 19 nt, Homo sapiens
gaaaagaucucaucaaauc

SEQ ID NO: 577247 - RNA, 19 nt, Homo sapiens
ggaauuaugugccugagaa

SEQ ID NO: 577248 - RNA, 19 nt, Homo sapiens
caauuggccuuaaagaaua

SEQ ID NO: 577249 - RNA, 19 nt, Homo sapiens
ggaagaccuugcuaaagua

SEQ ID NO: 577250 - RNA, 19 nt, Homo sapiens
gaacgacacucgccuaugg

SEQ ID NO: 577251 - RNA, 19 nt, Homo sapiens
gaacagagccaaaugaaag

SEQ ID NO: 577252 - RNA, 19 nt, Homo sapiens
caaagaagaugcagaugga

SEQ ID NO: 577253 - RNA, 19 nt, Homo sapiens
ccacaaagcucuggaugaa

SEQ ID NO: 577254 - RNA, 19 nt, Homo sapiens
gaagaaacacaacacgaua

SEQ ID NO: 577255 - RNA, 19 nt, Homo sapiens
gauaaaccaugacaaagga

SEQ ID NO: 577256 - RNA, 19 nt, Homo sapiens
gagaaucacuacucuugaa

SEQ ID NO: 577257 - RNA, 19 nt, Homo sapiens
ggacauaaaccaugaacaa

SEQ ID NO: 577258 - RNA, 19 nt, Homo sapiens
cuaaagaacucaauguaug

SEQ ID NO: 577259 - RNA, 19 nt, Homo sapiens
gagcaaugaucgagugauu

SEQ ID NO: 577260 - RNA, 19 nt, Homo sapiens
agaaauugcugaacugaaa

SEQ ID NO: 577261 - RNA, 19 nt, Homo sapiens
gcuaaagucuccuguuguu

SEQ ID NO: 577262 - RNA, 19 nt, Homo sapiens
uaauugagcuccaagaaau

SEQ ID NO: 577263 - RNA, 19 nt, Homo sapiens
gaagaaagucagagugaaa

SEQ ID NO: 577264 - RNA, 19 nt, Homo sapiens
gagaagagguacgagauga

SEQ ID NO: 577265 - RNA, 19 nt, Homo sapiens
cagcaaucauccugaaaua

SEQ ID NO: 577266 - RNA, 19 nt, Homo sapiens
gcaacgagauguccgugaa

SEQ ID NO: 577267 - RNA, 19 nt, Homo sapiens
uaaaauggcugguguuaaa

SEQ ID NO: 577268 - RNA, 19 nt, Homo sapiens
cauaaaccaugaacaagaa

SEQ ID NO: 577269 - RNA, 19 nt, Homo sapiens
gaacacagagguuggauuc

SEQ ID NO: 577270 - RNA, 19 nt, Homo sapiens
gcagauggacggcaaugua

SEQ ID NO: 577271 - RNA, 19 nt, Homo sapiens
caacauugaagaaagguua

SEQ ID NO: 577272 - RNA, 19 nt, Homo sapiens
gggaacagcuccuugaaag

SEQ ID NO: 577273 - RNA, 19 nt, Homo sapiens
aauaagauguggacugaaa

SEQ ID NO: 577274 - RNA, 19 nt, Homo sapiens
ggagaagaaucaagaacug

SEQ ID NO: 577275 - RNA, 19 nt, Homo sapiens
acaaagagcuaaugauucu

SEQ ID NO: 577276 - RNA, 19 nt, Homo sapiens
gaaagucagagugaaauaa

SEQ ID NO: 577277 - RNA, 19 nt, Homo sapiens
caaagaagcauuaggacaa

SEQ ID NO: 577278 - RNA, 19 nt, Homo sapiens
gaguagcacuugaaagaug

SEQ ID NO: 577279 - RNA, 19 nt, Homo sapiens
cuaauaagauguggacuga

SEQ ID NO: 577280 - RNA, 19 nt, Homo sapiens
caggaugccuugggacuua

SEQ ID NO: 577281 - RNA, 19 nt, Homo sapiens
ugaaagcacugaaguccuu

SEQ ID NO: 577282 - RNA, 19 nt, Homo sapiens
ugacugaccuuaacuguac

SEQ ID NO: 577283 - RNA, 19 nt, Homo sapiens
gagaagaaagucagaguga

SEQ ID NO: 577284 - RNA, 19 nt, Homo sapiens
gauagaagguuugaugaag

SEQ ID NO: 577285 - RNA, 19 nt, Homo sapiens
ggaaagagaauuuaacaac

SEQ ID NO: 577286 - RNA, 19 nt, Homo sapiens
ugcaugaccucaaugauaa

SEQ ID NO: 577287 - RNA, 19 nt, Homo sapiens
gugcaugaccucaaugaua

SEQ ID NO: 577288 - RNA, 19 nt, Homo sapiens
ccaugugcauuauccuuua

SEQ ID NO: 577289 - RNA, 19 nt, Homo sapiens
gcaaacaaucuuauagaga

SEQ ID NO: 577290 - RNA, 19 nt, Homo sapiens
cugaagaaaugaacacaaa

SEQ ID NO: 577291 - RNA, 19 nt, Homo sapiens
caaaguauguacagucuac

SEQ ID NO: 577292 - RNA, 19 nt, Homo sapiens
ggcauuaaguccuccauug

SEQ ID NO: 577293 - RNA, 19 nt, Homo sapiens
ucgcagcacuuacuaaaga

SEQ ID NO: 577294 - RNA, 19 nt, Homo sapiens
gaacgugcccagcaagcua

SEQ ID NO: 577295 - RNA, 19 nt, Homo sapiens
gaagagagaaucacuacuc

SEQ ID NO: 577296 - RNA, 19 nt, Homo sapiens
ugaaagggaagaagaaauu

SEQ ID NO: 577297 - RNA, 19 nt, Homo sapiens
gcaaucauccugaaauaag

SEQ ID NO: 577298 - RNA, 19 nt, Homo sapiens
acacaaagagcuaaugauu

SEQ ID NO: 577299 - RNA, 19 nt, Homo sapiens
ucaacuuccugauuaugua

SEQ ID NO: 577300 - RNA, 19 nt, Homo sapiens
cagccuagcucuacagcaa

SEQ ID NO: 577301 - RNA, 19 nt, Homo sapiens
uuugucaacuuccugauua

SEQ ID NO: 577302 - RNA, 19 nt, Homo sapiens
gcuagugucuuggcaaaug

SEQ ID NO: 577303 - RNA, 19 nt, Homo sapiens
aaaggacauucguggcuua

SEQ ID NO: 577304 - RNA, 19 nt, Homo sapiens
gagcacuucuggccuuaga

SEQ ID NO: 577305 - RNA, 19 nt, Homo sapiens
ucaauuggccuuaaagaau

SEQ ID NO: 577306 - RNA, 19 nt, Homo sapiens
agacaaccauaaaguguga

SEQ ID NO: 577307 - RNA, 19 nt, Homo sapiens
gcacuugaaagauguaguu

SEQ ID NO: 577308 - RNA, 19 nt, Homo sapiens
gacaaaggauuuuacguuu

SEQ ID NO: 577309 - RNA, 19 nt, Homo sapiens
aguggaaucuuuaaucuug

SEQ ID NO: 577310 - RNA, 19 nt, Homo sapiens
cugagaagguuaaauuaug

SEQ ID NO: 577311 - RNA, 19 nt, Homo sapiens
gguacgagaugacaagaca

SEQ ID NO: 577312 - RNA, 19 nt, Homo sapiens
ugacgugucugauggugaa

SEQ ID NO: 577313 - RNA, 19 nt, Homo sapiens
gcaguuagaagaaacacaa

SEQ ID NO: 577314 - RNA, 19 nt, Homo sapiens
guaauugagcuccaagaaa

SEQ ID NO: 577315 - RNA, 19 nt, Homo sapiens
gauguaguuuguuagaaga

SEQ ID NO: 577316 - RNA, 19 nt, Homo sapiens
gcagugcagcucuaauaaa

SEQ ID NO: 577317 - RNA, 19 nt, Homo sapiens
gagagagacucaagaaacg

SEQ ID NO: 577318 - RNA, 19 nt, Homo sapiens
acagaagccaugugcauua

SEQ ID NO: 577319 - RNA, 19 nt, Homo sapiens
caaagaagaaaggcauuaa

SEQ ID NO: 577320 - RNA, 19 nt, Homo sapiens
gaugacaagacaaccauaa

SEQ ID NO: 577321 - RNA, 19 nt, Homo sapiens
gguacaaacucuuaaugag

SEQ ID NO: 577322 - RNA, 19 nt, Homo sapiens
gaagaccuugcuaaaguaa

SEQ ID NO: 577323 - RNA, 19 nt, Homo sapiens
aggaagaccuugcuaaagu

SEQ ID NO: 577324 - RNA, 19 nt, Homo sapiens
caugagcggucucuuagga

SEQ ID NO: 577325 - RNA, 19 nt, Homo sapiens
gaagaaauugcugaacuga

SEQ ID NO: 577326 - RNA, 19 nt, Homo sapiens
cgagguuggucaugaaaga

SEQ ID NO: 577327 - RNA, 19 nt, Homo sapiens
uggacaaacuggcaaagaa

SEQ ID NO: 577328 - RNA, 19 nt, Homo sapiens
ccaaagaagaaaggcauua

SEQ ID NO: 577329 - RNA, 19 nt, Homo sapiens
ggaacagagccaaaugaaa

SEQ ID NO: 577330 - RNA, 19 nt, Homo sapiens
agaccuugcuaaaguaauu

SEQ ID NO: 577331 - RNA, 19 nt, Homo sapiens
gaacugaaagcagaaagga

SEQ ID NO: 577332 - RNA, 19 nt, Homo sapiens
ggaagaagaaauugcugaa

SEQ ID NO: 577333 - RNA, 19 nt, Homo sapiens
aauaucagcuccuaauaag

SEQ ID NO: 577334 - RNA, 19 nt, Homo sapiens
aagcauaccuaauuucaag

SEQ ID NO: 577335 - RNA, 19 nt, Homo sapiens
gaauagagggcuuuuguaa

SEQ ID NO: 577336 - RNA, 19 nt, Homo sapiens
uaaaagacgugcuuguuug

SEQ ID NO: 577337 - RNA, 19 nt, Homo sapiens
gcaaauaaagauucuaugc

SEQ ID NO: 577338 - RNA, 19 nt, Homo sapiens
cuugaaagauguaguuugu

SEQ ID NO: 577339 - RNA, 19 nt, Homo sapiens
gcagggaacagcuccuuga

SEQ ID NO: 577340 - RNA, 19 nt, Homo sapiens
ucaauaaaguacugaagca

SEQ ID NO: 577341 - RNA, 19 nt, Homo sapiens
gcucugaggugaccgcaua

SEQ ID NO: 577342 - RNA, 19 nt, Homo sapiens
cuuccuaccucuucuauua

SEQ ID NO: 577343 - RNA, 19 nt, Homo sapiens
ugaacaagaugcuggagua

SEQ ID NO: 577344 - RNA, 19 nt, Homo sapiens
gaagacagucccuauccua

SEQ ID NO: 577345 - RNA, 19 nt, Homo sapiens
gaaggcagguucccucucu

SEQ ID NO: 577346 - RNA, 19 nt, Homo sapiens
gaaccugcgcuccacguua

SEQ ID NO: 577347 - RNA, 19 nt, Homo sapiens
acacagcccuccuuucaga

SEQ ID NO: 577348 - RNA, 19 nt, Homo sapiens
guuaauggcccucaugauu

SEQ ID NO: 577349 - RNA, 19 nt, Homo sapiens
gaagucaauuacacgaaga

SEQ ID NO: 577350 - RNA, 19 nt, Homo sapiens
gaagcucugucuccguuga

SEQ ID NO: 577351 - RNA, 19 nt, Homo sapiens
aaacacagcccuccuuuca

SEQ ID NO: 577352 - RNA, 19 nt, Homo sapiens
ucaccugucucaucaacaa

SEQ ID NO: 577353 - RNA, 19 nt, Homo sapiens
cuacauggcugcugugaac

SEQ ID NO: 577354 - RNA, 19 nt, Homo sapiens
gagaccagggugccucuua

SEQ ID NO: 577355 - RNA, 19 nt, Homo sapiens
ggcaucaccugucucauca

SEQ ID NO: 577356 - RNA, 19 nt, Homo sapiens
gcaagucuuagaggaaaua

SEQ ID NO: 577357 - RNA, 19 nt, Homo sapiens
ugagacaaaugaacagcaa

SEQ ID NO: 577358 - RNA, 19 nt, Homo sapiens
gccaggagcaugagacaaa

SEQ ID NO: 577359 - RNA, 19 nt, Homo sapiens
ccauggccguagauuuaua

SEQ ID NO: 577360 - RNA, 19 nt, Homo sapiens
agccauggccguagauuua

SEQ ID NO: 577361 - RNA, 19 nt, Homo sapiens
ugaccaaccugcugcuugu

SEQ ID NO: 577362 - RNA, 19 nt, Homo sapiens
aaccugcgcuccacguuaa

SEQ ID NO: 577363 - RNA, 19 nt, Homo sapiens
aaccugggcuucaccauug

SEQ ID NO: 577364 - RNA, 19 nt, Homo sapiens
gcaaugugucuguguaugu

SEQ ID NO: 577365 - RNA, 19 nt, Homo sapiens
caugcaaugugucugugua

SEQ ID NO: 577366 - RNA, 19 nt, Homo sapiens
caaaaggagugccccauau

SEQ ID NO: 577367 - RNA, 19 nt, Homo sapiens
ugagaggucuguccccuua

SEQ ID NO: 577368 - RNA, 19 nt, Homo sapiens
ucaauuacacgaagaagau

SEQ ID NO: 577369 - RNA, 19 nt, Homo sapiens
ccuguaacaugcacauaga

SEQ ID NO: 577370 - RNA, 19 nt, Homo sapiens
ccucaucagugcuguguuc

SEQ ID NO: 577371 - RNA, 19 nt, Homo sapiens
caaaugaacagcaacaaaa

SEQ ID NO: 577372 - RNA, 19 nt, Homo sapiens
gaccaagggaccuggauga

SEQ ID NO: 577373 - RNA, 19 nt, Homo sapiens
agaccacgcuacugcaaga

SEQ ID NO: 577374 - RNA, 19 nt, Homo sapiens
caaccugggcuucaccauu

SEQ ID NO: 577375 - RNA, 19 nt, Homo sapiens
gaacgagggcuucuauucc

SEQ ID NO: 577376 - RNA, 19 nt, Homo sapiens
uaauggcccucaugauugg

SEQ ID NO: 577377 - RNA, 19 nt, Homo sapiens
uuaauggcccucaugauug

SEQ ID NO: 577378 - RNA, 19 nt, Homo sapiens
caaugugucuguguaugug

SEQ ID NO: 577379 - RNA, 19 nt, Homo sapiens
gacagucccuauccuagag

SEQ ID NO: 577380 - RNA, 19 nt, Homo sapiens
gagccauggccguagauuu

SEQ ID NO: 577381 - RNA, 19 nt, Homo sapiens
gaaucugggccuccugcua

SEQ ID NO: 577382 - RNA, 19 nt, Homo sapiens
ucucuaugcugcaguguuc

SEQ ID NO: 577383 - RNA, 19 nt, Homo sapiens
uuacgccucuucugccauu

SEQ ID NO: 577384 - RNA, 19 nt, Homo sapiens
gcucaccaaugccaucagu

SEQ ID NO: 577385 - RNA, 19 nt, Homo sapiens
acaaaugaacagcaacaaa

SEQ ID NO: 577386 - RNA, 19 nt, Homo sapiens
gaggugaccgcauagacuu

SEQ ID NO: 577387 - RNA, 19 nt, Homo sapiens
ggacgggguugcuaccaaa

SEQ ID NO: 577388 - RNA, 19 nt, Homo sapiens
agaccagggugccucuuau

SEQ ID NO: 577389 - RNA, 19 nt, Homo sapiens
gcaaucaaggccugagcaa

SEQ ID NO: 577390 - RNA, 19 nt, Homo sapiens
cagagacaguuggguucua

SEQ ID NO: 577391 - RNA, 19 nt, Homo sapiens
ggacguggaagcucugucu

SEQ ID NO: 577392 - RNA, 19 nt, Homo sapiens
cuaagucaacgcuccauug

SEQ ID NO: 577393 - RNA, 19 nt, Homo sapiens
ggccugcagucccucauca

SEQ ID NO: 577394 - RNA, 19 nt, Homo sapiens
uugcaagucuuagaggaaa

SEQ ID NO: 577395 - RNA, 19 nt, Homo sapiens
guucuacuccuccgucuuc

SEQ ID NO: 577396 - RNA, 19 nt, Homo sapiens
cagcuguugugccuucuca

SEQ ID NO: 577397 - RNA, 19 nt, Homo sapiens
ccaggagcaugagacaaau

SEQ ID NO: 577398 - RNA, 19 nt, Homo sapiens
ccaacaccacccaggauga

SEQ ID NO: 577399 - RNA, 19 nt, Homo sapiens
uuacaccuccaguuuguga

SEQ ID NO: 577400 - RNA, 19 nt, Homo sapiens
ugccuuaucuuucugaacu

SEQ ID NO: 577401 - RNA, 19 nt, Homo sapiens
aaucugggccuccugcuau

SEQ ID NO: 577402 - RNA, 19 nt, Homo sapiens
ccaugagugugcacaacau

SEQ ID NO: 577403 - RNA, 19 nt, Homo sapiens
guucccauccaaccacuuu

SEQ ID NO: 577404 - RNA, 19 nt, Homo sapiens
caucaccugucucaucaac

SEQ ID NO: 577405 - RNA, 19 nt, Homo sapiens
gagcaugagacaaaugaac

SEQ ID NO: 577406 - RNA, 19 nt, Homo sapiens
gaacaagaugcuggaguac

SEQ ID NO: 577407 - RNA, 19 nt, Homo sapiens
uggcugcugugaacaagau

SEQ ID NO: 577408 - RNA, 19 nt, Homo sapiens
gggugccucuuaucuccuu

SEQ ID NO: 577409 - RNA, 19 nt, Homo sapiens
cauggccguagauuuauaa

SEQ ID NO: 577410 - RNA, 19 nt, Homo sapiens
agacagucccuauccuaga

SEQ ID NO: 577411 - RNA, 19 nt, Homo sapiens
uauucucacuccugggauu

SEQ ID NO: 577412 - RNA, 19 nt, Homo sapiens
caccauuguucgagguuuc

SEQ ID NO: 577413 - RNA, 19 nt, Homo sapiens
acuuacaccuccaguuugu

SEQ ID NO: 577414 - RNA, 19 nt, Homo sapiens
acaagaugcuggaguaccu

SEQ ID NO: 577415 - RNA, 19 nt, Homo sapiens
gcggaucaucuucuacaug

SEQ ID NO: 577416 - RNA, 19 nt, Homo sapiens
uaaauaccaagagaaguuc

SEQ ID NO: 577417 - RNA, 19 nt, Homo sapiens
ccaaaaggagugccccaua

SEQ ID NO: 577418 - RNA, 19 nt, Homo sapiens
cuucuucucugcuguacuc

SEQ ID NO: 577419 - RNA, 19 nt, Homo sapiens
ccucauuggcuacaucaug

SEQ ID NO: 577420 - RNA, 19 nt, Homo sapiens
ucacgcugcccaacauguu

SEQ ID NO: 577421 - RNA, 19 nt, Homo sapiens
auagagccauggccguaga

SEQ ID NO: 577422 - RNA, 19 nt, Homo sapiens
ggaaccugcgcuccacguu

SEQ ID NO: 577423 - RNA, 19 nt, Homo sapiens
aacgagggcuucuauucca

SEQ ID NO: 577424 - RNA, 19 nt, Homo sapiens
uggcaucaccugucucauc

SEQ ID NO: 577425 - RNA, 19 nt, Homo sapiens
aaagguggcagagacaguu

SEQ ID NO: 577426 - RNA, 19 nt, Homo sapiens
agacaaaugaacagcaaca

SEQ ID NO: 577427 - RNA, 19 nt, Homo sapiens
ugacccagcugcggaucau

SEQ ID NO: 577428 - RNA, 19 nt, Homo sapiens
ccaagggaccuggaugaca

SEQ ID NO: 577429 - RNA, 19 nt, Homo sapiens
gacaaaugaacagcaacaa

SEQ ID NO: 577430 - RNA, 19 nt, Homo sapiens
gaagaagaucaagcugagu

SEQ ID NO: 577431 - RNA, 19 nt, Homo sapiens
ccucaugauuggcucuuac

SEQ ID NO: 577432 - RNA, 19 nt, Homo sapiens
gcacauuacuccuauauau

SEQ ID NO: 577433 - RNA, 19 nt, Homo sapiens
gcaacagccuugaggaaua

SEQ ID NO: 577434 - RNA, 19 nt, Homo sapiens
ugaaaucgaccacaaauua

SEQ ID NO: 577435 - RNA, 19 nt, Homo sapiens
cagcaaaccuucaccaauu

SEQ ID NO: 577436 - RNA, 19 nt, Homo sapiens
gaacuuugaugcauacaga

SEQ ID NO: 577437 - RNA, 19 nt, Homo sapiens
gaacgaauuggaugacuua

SEQ ID NO: 577438 - RNA, 19 nt, Homo sapiens
gaggaacucuuucuuucua

SEQ ID NO: 577439 - RNA, 19 nt, Homo sapiens
cgaauuggaugacuuacua

SEQ ID NO: 577440 - RNA, 19 nt, Homo sapiens
gaagaauguuggugggaua

SEQ ID NO: 577441 - RNA, 19 nt, Homo sapiens
gaaguaagggagcuuguua

SEQ ID NO: 577442 - RNA, 19 nt, Homo sapiens
caagaugacuccaacagaa

SEQ ID NO: 577443 - RNA, 19 nt, Homo sapiens
ggaagaagcucggaagcaa

SEQ ID NO: 577444 - RNA, 19 nt, Homo sapiens
caacagacgugccaaauac

SEQ ID NO: 577445 - RNA, 19 nt, Homo sapiens
uaaacgaccuucuuauaga

SEQ ID NO: 577446 - RNA, 19 nt, Homo sapiens
ggacugaaaucgaccacaa

SEQ ID NO: 577447 - RNA, 19 nt, Homo sapiens
gagaagaguuaguucaguu

SEQ ID NO: 577448 - RNA, 19 nt, Homo sapiens
ucaagaaguucaacacaaa

SEQ ID NO: 577449 - RNA, 19 nt, Homo sapiens
gagaauggauaacgauaga

SEQ ID NO: 577450 - RNA, 19 nt, Homo sapiens
gagcacagucuccuucuua

SEQ ID NO: 577451 - RNA, 19 nt, Homo sapiens
gaaguacccuuacauacca

SEQ ID NO: 577452 - RNA, 19 nt, Homo sapiens
gaacaaggaacccucuauu

SEQ ID NO: 577453 - RNA, 19 nt, Homo sapiens
ccacuaaacgaccuucuua

SEQ ID NO: 577454 - RNA, 19 nt, Homo sapiens
gcaagacgguggagaacug

SEQ ID NO: 577455 - RNA, 19 nt, Homo sapiens
gaauauggcacuagauguu

SEQ ID NO: 577456 - RNA, 19 nt, Homo sapiens
gcacagguguaucagguau

SEQ ID NO: 577457 - RNA, 19 nt, Homo sapiens
gcaaaggacuguucaugac

SEQ ID NO: 577458 - RNA, 19 nt, Homo sapiens
ggauaacgauagaguuguu

SEQ ID NO: 577459 - RNA, 19 nt, Homo sapiens
ggaguucuuuggaauuuau

SEQ ID NO: 577460 - RNA, 19 nt, Homo sapiens
gaugcucucucaaccuuaa

SEQ ID NO: 577461 - RNA, 19 nt, Homo sapiens
gcuaugaagauccuuauuu

SEQ ID NO: 577462 - RNA, 19 nt, Homo sapiens
gaaaucgaccacaaauuau

SEQ ID NO: 577463 - RNA, 19 nt, Homo sapiens
gcagggaguuuccacaaca

SEQ ID NO: 577464 - RNA, 19 nt, Homo sapiens
caacagcuguauuauaguc

SEQ ID NO: 577465 - RNA, 19 nt, Homo sapiens
uagagaagcuggugaacau

SEQ ID NO: 577466 - RNA, 19 nt, Homo sapiens
caacagccuugaggaauau

SEQ ID NO: 577467 - RNA, 19 nt, Homo sapiens
gcagcaguaugacauuuau

SEQ ID NO: 577468 - RNA, 19 nt, Homo sapiens
caucaacagcuguauuaua

SEQ ID NO: 577469 - RNA, 19 nt, Homo sapiens
gcaaaccuucaccaauuua

SEQ ID NO: 577470 - RNA, 19 nt, Homo sapiens
gagaagcuggugaacauaa

SEQ ID NO: 577471 - RNA, 19 nt, Homo sapiens
gagcaaggcagacaacaga

SEQ ID NO: 577472 - RNA, 19 nt, Homo sapiens
ccagucagcuagaaagaug

SEQ ID NO: 577473 - RNA, 19 nt, Homo sapiens
ggagcgagaccgauucaaa

SEQ ID NO: 577474 - RNA, 19 nt, Homo sapiens
gauggaauaacucuucuuu

SEQ ID NO: 577475 - RNA, 19 nt, Homo sapiens
acagacaucucuccaugaa

SEQ ID NO: 577476 - RNA, 19 nt, Homo sapiens
caggaguucuuuggaauuu

SEQ ID NO: 577477 - RNA, 19 nt, Homo sapiens
ugggauaccugccuuguug

SEQ ID NO: 577478 - RNA, 19 nt, Homo sapiens
gaaugaaugaaguguguuu

SEQ ID NO: 577479 - RNA, 19 nt, Homo sapiens
caauuuacaucaguuccua

SEQ ID NO: 577480 - RNA, 19 nt, Homo sapiens
aaagaggacuccgcaagaa

SEQ ID NO: 577481 - RNA, 19 nt, Homo sapiens
gaauuuauccucaugugau

SEQ ID NO: 577482 - RNA, 19 nt, Homo sapiens
gaucgcagacggcguugua

SEQ ID NO: 577483 - RNA, 19 nt, Homo sapiens
uuacggaguuccuaugcua

SEQ ID NO: 577484 - RNA, 19 nt, Homo sapiens
agacaucucuccaugaaag

SEQ ID NO: 577485 - RNA, 19 nt, Homo sapiens
gguggaaucagaaccauuu

SEQ ID NO: 577486 - RNA, 19 nt, Homo sapiens
gagaagucauuuccuugga

SEQ ID NO: 577487 - RNA, 19 nt, Homo sapiens
uuacaggaguucuuuggaa

SEQ ID NO: 577488 - RNA, 19 nt, Homo sapiens
cuacaggccuauacaauac

SEQ ID NO: 577489 - RNA, 19 nt, Homo sapiens
cgaguucacuuuccagcuu

SEQ ID NO: 577490 - RNA, 19 nt, Homo sapiens
gaagaagcucggaagcaaa

SEQ ID NO: 577491 - RNA, 19 nt, Homo sapiens
gcccaggucuugaauacau

SEQ ID NO: 577492 - RNA, 19 nt, Homo sapiens
caaagacucugagccaagu

SEQ ID NO: 577493 - RNA, 19 nt, Homo sapiens
gaaguggaaaggcagauug

SEQ ID NO: 577494 - RNA, 19 nt, Homo sapiens
gcucugaacacaacagcua

SEQ ID NO: 577495 - RNA, 19 nt, Homo sapiens
aaagugaaguggaaggaau

SEQ ID NO: 577496 - RNA, 19 nt, Homo sapiens
gcagucuccucauagcuau

SEQ ID NO: 577497 - RNA, 19 nt, Homo sapiens
gagcgagaccgauucaaau

SEQ ID NO: 577498 - RNA, 19 nt, Homo sapiens
gaaguuugcagcauauauc

SEQ ID NO: 577499 - RNA, 19 nt, Homo sapiens
uagacucacuguuguaugu

SEQ ID NO: 577500 - RNA, 19 nt, Homo sapiens
gcugguagacucacuguug

SEQ ID NO: 577501 - RNA, 19 nt, Homo sapiens
gaugauggcaccacaagau

SEQ ID NO: 577502 - RNA, 19 nt, Homo sapiens
ccuacaggccuauacaaua

SEQ ID NO: 577503 - RNA, 19 nt, Homo sapiens
ucaacagacgugccaaaua

SEQ ID NO: 577504 - RNA, 19 nt, Homo sapiens
acuaaacgaccuucuuaua

SEQ ID NO: 577505 - RNA, 19 nt, Homo sapiens
gaccacaaauuauguagac

SEQ ID NO: 577506 - RNA, 19 nt, Homo sapiens
ucacauccuuccuugucua

SEQ ID NO: 577507 - RNA, 19 nt, Homo sapiens
ugaggaauauggcacuaga

SEQ ID NO: 577508 - RNA, 19 nt, Homo sapiens
acagcagcauucauucaua

SEQ ID NO: 577509 - RNA, 19 nt, Homo sapiens
gaaguggaaggaaugaaug

SEQ ID NO: 577510 - RNA, 19 nt, Homo sapiens
agccaccuaugcaguauua

SEQ ID NO: 577511 - RNA, 19 nt, Homo sapiens
ggucuugaauacauuaugg

SEQ ID NO: 577512 - RNA, 19 nt, Homo sapiens
gcauagagaagcuggugaa

SEQ ID NO: 577513 - RNA, 19 nt, Homo sapiens
ggauggaguugguccuauc

SEQ ID NO: 577514 - RNA, 19 nt, Homo sapiens
gaccacagccaccacuauu

SEQ ID NO: 577515 - RNA, 19 nt, Homo sapiens
ucucccgacuugcacauua

SEQ ID NO: 577516 - RNA, 19 nt, Homo sapiens
cagcagcaguaugacauuu

SEQ ID NO: 577517 - RNA, 19 nt, Homo sapiens
acaaggaacccucuauuca

SEQ ID NO: 577518 - RNA, 19 nt, Homo sapiens
caccagcacuguuaggaau

SEQ ID NO: 577519 - RNA, 19 nt, Homo sapiens
ggaaguuugcagcauauau

SEQ ID NO: 577520 - RNA, 19 nt, Homo sapiens
uggaauaacucuucuuuug

SEQ ID NO: 577521 - RNA, 19 nt, Homo sapiens
ggaauuuauccucauguga

SEQ ID NO: 577522 - RNA, 19 nt, Homo sapiens
ggagcaggagcuucaguuu

SEQ ID NO: 577523 - RNA, 19 nt, Homo sapiens
cagcagcauucauucauag

SEQ ID NO: 577524 - RNA, 19 nt, Homo sapiens
gaaaugugaaagugaagug

SEQ ID NO: 577525 - RNA, 19 nt, Homo sapiens
cuaaacgaccuucuuauag

SEQ ID NO: 577526 - RNA, 19 nt, Homo sapiens
uauuugcagucuccucaua

SEQ ID NO: 577527 - RNA, 19 nt, Homo sapiens
aucaacagcuguauuauag

SEQ ID NO: 577528 - RNA, 19 nt, Homo sapiens
gagaaaaucuauugaugca

SEQ ID NO: 577529 - RNA, 19 nt, Homo sapiens
gauggagguguguagguua

SEQ ID NO: 577530 - RNA, 19 nt, Homo sapiens
ugaguugccugaggucauu

SEQ ID NO: 577531 - RNA, 19 nt, Homo sapiens
caauagacagcauucagaa

SEQ ID NO: 577532 - RNA, 19 nt, Homo sapiens
gaagauggcuuaguguuua

SEQ ID NO: 577533 - RNA, 19 nt, Homo sapiens
gaagaaggcuguuuagguu

SEQ ID NO: 577534 - RNA, 19 nt, Homo sapiens
gaagaggacugcaauagaa

SEQ ID NO: 577535 - RNA, 19 nt, Homo sapiens
uaaaggcccugcagaaaua

SEQ ID NO: 577536 - RNA, 19 nt, Homo sapiens
ggagguaaaugacaaauug

SEQ ID NO: 577537 - RNA, 19 nt, Homo sapiens
cgacagaacugauauuuua

SEQ ID NO: 577538 - RNA, 19 nt, Homo sapiens
gcagggagauuauacuuug

SEQ ID NO: 577539 - RNA, 19 nt, Homo sapiens
gcagaggacuugcuuuaug

SEQ ID NO: 577540 - RNA, 19 nt, Homo sapiens
gcccauagcuugaaaguuc

SEQ ID NO: 577541 - RNA, 19 nt, Homo sapiens
gagagaagauggcuuagug

SEQ ID NO: 577542 - RNA, 19 nt, Homo sapiens
agaaugaucuguuguuuga

SEQ ID NO: 577543 - RNA, 19 nt, Homo sapiens
gggaggcaauaauaaguua

SEQ ID NO: 577544 - RNA, 19 nt, Homo sapiens
cuacauagacugcuuguuu

SEQ ID NO: 577545 - RNA, 19 nt, Homo sapiens
gcacagaugcccucgcuuu

SEQ ID NO: 577546 - RNA, 19 nt, Homo sapiens
gaaacaagcuuuggacaac

SEQ ID NO: 577547 - RNA, 19 nt, Homo sapiens
ggacugcaauagaagcuuu

SEQ ID NO: 577548 - RNA, 19 nt, Homo sapiens
ggagaagaguaaagaguau

SEQ ID NO: 577549 - RNA, 19 nt, Homo sapiens
ggauaucaaucgaguacaa

SEQ ID NO: 577550 - RNA, 19 nt, Homo sapiens
ggaagggaggcaauaauaa

SEQ ID NO: 577551 - RNA, 19 nt, Homo sapiens
ggacuugcuuuaugggaaa

SEQ ID NO: 577552 - RNA, 19 nt, Homo sapiens
gauggugcauucuuaauuc

SEQ ID NO: 577553 - RNA, 19 nt, Homo sapiens
ggagagcgacuguguagaa

SEQ ID NO: 577554 - RNA, 19 nt, Homo sapiens
gagauugaacgaauuauga

SEQ ID NO: 577555 - RNA, 19 nt, Homo sapiens
ggugagcuuugaaucauaa

SEQ ID NO: 577556 - RNA, 19 nt, Homo sapiens
gacuagaauuugugaguuu

SEQ ID NO: 577557 - RNA, 19 nt, Homo sapiens
gaagaaguauuauguucag

SEQ ID NO: 577558 - RNA, 19 nt, Homo sapiens
ccacgaagaaggcuguuua

SEQ ID NO: 577559 - RNA, 19 nt, Homo sapiens
gaacaucccaggaaauaca

SEQ ID NO: 577560 - RNA, 19 nt, Homo sapiens
uuacacaugugcuuccaua

SEQ ID NO: 577561 - RNA, 19 nt, Homo sapiens
gccaaugacuucagcaguu

SEQ ID NO: 577562 - RNA, 19 nt, Homo sapiens
auauuaggcuugaugguua

SEQ ID NO: 577563 - RNA, 19 nt, Homo sapiens
gagguggucuucuggcauu

SEQ ID NO: 577564 - RNA, 19 nt, Homo sapiens
caagggaggagguaaauga

SEQ ID NO: 577565 - RNA, 19 nt, Homo sapiens
caacauaauuuaggcuuca

SEQ ID NO: 577566 - RNA, 19 nt, Homo sapiens
ucaccgggaugguaaauau

SEQ ID NO: 577567 - RNA, 19 nt, Homo sapiens
ccuaaagaaugaucuguug

SEQ ID NO: 577568 - RNA, 19 nt, Homo sapiens
gaugagggcauucuuucua

SEQ ID NO: 577569 - RNA, 19 nt, Homo sapiens
gaaguauuauguucagaag

SEQ ID NO: 577570 - RNA, 19 nt, Homo sapiens
ggaaucuucugcuccaugu

SEQ ID NO: 577571 - RNA, 19 nt, Homo sapiens
ggccugagguucucuagga

SEQ ID NO: 577572 - RNA, 19 nt, Homo sapiens
ccgcugcacugacauacua

SEQ ID NO: 577573 - RNA, 19 nt, Homo sapiens
gaaaccugauggugcauuc

SEQ ID NO: 577574 - RNA, 19 nt, Homo sapiens
gggaggagguaaaugacaa

SEQ ID NO: 577575 - RNA, 19 nt, Homo sapiens
gagugaagcuaggcaaaug

SEQ ID NO: 577576 - RNA, 19 nt, Homo sapiens
gaacaacauagcaaagaau

SEQ ID NO: 577577 - RNA, 19 nt, Homo sapiens
gagagcgacuguguagaaa

SEQ ID NO: 577578 - RNA, 19 nt, Homo sapiens
ggcuugauauaccaaauaa

SEQ ID NO: 577579 - RNA, 19 nt, Homo sapiens
agaaugggauuugaugaaa

SEQ ID NO: 577580 - RNA, 19 nt, Homo sapiens
gaagugauuuugugaaugu

SEQ ID NO: 577581 - RNA, 19 nt, Homo sapiens
uagaacaucccaggaaaua

SEQ ID NO: 577582 - RNA, 19 nt, Homo sapiens
ggcuugggauuucauuuaa

SEQ ID NO: 577583 - RNA, 19 nt, Homo sapiens
gaaugaggaugcugaugag

SEQ ID NO: 577584 - RNA, 19 nt, Homo sapiens
uaaccacuaucaccaugaa

SEQ ID NO: 577585 - RNA, 19 nt, Homo sapiens
gaagggaggcaauaauaag

SEQ ID NO: 577586 - RNA, 19 nt, Homo sapiens
aaacguggcacucauaguu

SEQ ID NO: 577587 - RNA, 19 nt, Homo sapiens
gguuuaauuucccuucauu

SEQ ID NO: 577588 - RNA, 19 nt, Homo sapiens
aagaauaccacucucagua

SEQ ID NO: 577589 - RNA, 19 nt, Homo sapiens
cggaagggaggcaauaaua

SEQ ID NO: 577590 - RNA, 19 nt, Homo sapiens
gauagaaugggauuugaug

SEQ ID NO: 577591 - RNA, 19 nt, Homo sapiens
caaccgagaaauagauaaa

SEQ ID NO: 577592 - RNA, 19 nt, Homo sapiens
ggacaaccgagaaauagau

SEQ ID NO: 577593 - RNA, 19 nt, Homo sapiens
augaaucucuugcucagua

SEQ ID NO: 577594 - RNA, 19 nt, Homo sapiens
aaugacaaauugcgggaua

SEQ ID NO: 577595 - RNA, 19 nt, Homo sapiens
aagaaaggaugcuaugcuu

SEQ ID NO: 577596 - RNA, 19 nt, Homo sapiens
aaaggagauugaacgaauu

SEQ ID NO: 577597 - RNA, 19 nt, Homo sapiens
agaacaacauagcaaagaa

SEQ ID NO: 577598 - RNA, 19 nt, Homo sapiens
gagaagauggcuuaguguu

SEQ ID NO: 577599 - RNA, 19 nt, Homo sapiens
guggucaggugccucagua

SEQ ID NO: 577600 - RNA, 19 nt, Homo sapiens
gagcgacuguguagaaagg

SEQ ID NO: 577601 - RNA, 19 nt, Homo sapiens
gacagaaacgccugaaugu

SEQ ID NO: 577602 - RNA, 19 nt, Homo sapiens
gguccgagaugccucaaca

SEQ ID NO: 577603 - RNA, 19 nt, Homo sapiens
gcuuuuagauggcuugaua

SEQ ID NO: 577604 - RNA, 19 nt, Homo sapiens
caaaggagugagacagaaa

SEQ ID NO: 577605 - RNA, 19 nt, Homo sapiens
ugagauucaugauagcaaa

SEQ ID NO: 577606 - RNA, 19 nt, Homo sapiens
cugauccucugacauuuaa

SEQ ID NO: 577607 - RNA, 19 nt, Homo sapiens
gcacucauaguugaaugua

SEQ ID NO: 577608 - RNA, 19 nt, Homo sapiens
cgaagaaggcuguuuaggu

SEQ ID NO: 577609 - RNA, 19 nt, Homo sapiens
ccagacacccucaacagaa

SEQ ID NO: 577610 - RNA, 19 nt, Homo sapiens
gcacaacgacucccucaac

SEQ ID NO: 577611 - RNA, 19 nt, Homo sapiens
gagaguagcaagaaaggau

SEQ ID NO: 577612 - RNA, 19 nt, Homo sapiens
gagcaggauuugaagaaac

SEQ ID NO: 577613 - RNA, 19 nt, Homo sapiens
ucaguacaaucccaaacuu

SEQ ID NO: 577614 - RNA, 19 nt, Homo sapiens
agaaugaggaugcugauga

SEQ ID NO: 577615 - RNA, 19 nt, Homo sapiens
ggagauugaacgaauuaug

SEQ ID NO: 577616 - RNA, 19 nt, Homo sapiens
gcaaugcagugcuuuuaga

SEQ ID NO: 577617 - RNA, 19 nt, Homo sapiens
gcuaaauugaucacuguaa

SEQ ID NO: 577618 - RNA, 19 nt, Homo sapiens
cugaagaaguauuauguuc

SEQ ID NO: 577619 - RNA, 19 nt, Homo sapiens
cagaggacuugcuuuaugg

SEQ ID NO: 577620 - RNA, 19 nt, Homo sapiens
gacaaccgagaaauagaua

SEQ ID NO: 577621 - RNA, 19 nt, Homo sapiens
gaugaagaggacugcaaua

SEQ ID NO: 577622 - RNA, 19 nt, Homo sapiens
gauccucugacauuuaauu

SEQ ID NO: 577623 - RNA, 19 nt, Homo sapiens
gauuauacuuugacuuugc

SEQ ID NO: 577624 - RNA, 19 nt, Homo sapiens
cagacacccucaacagaau

SEQ ID NO: 577625 - RNA, 19 nt, Homo sapiens
cagaaacgccugaaugucu

SEQ ID NO: 577626 - RNA, 19 nt, Homo sapiens
uaauauugaugcaguaggu

SEQ ID NO: 577627 - RNA, 19 nt, Homo sapiens
ccaaugacuucagcaguuc

SEQ ID NO: 577628 - RNA, 19 nt, Homo sapiens
ucuggaagcuuuucucuuu

SEQ ID NO: 577629 - RNA, 19 nt, Homo sapiens
ugaaguuggugcuuguaug

SEQ ID NO: 577630 - RNA, 19 nt, Homo sapiens
gauggugagcuuugaauca

SEQ ID NO: 577631 - RNA, 19 nt, Homo sapiens
ggcugggaauuaagaauga

SEQ ID NO: 577632 - RNA, 19 nt, Homo sapiens
caacaacuaugaugaacua

SEQ ID NO: 577633 - RNA, 19 nt, Homo sapiens
ggacagauccauucaguuu

SEQ ID NO: 577634 - RNA, 19 nt, Homo sapiens
caugguaacucuaugaaua

SEQ ID NO: 577635 - RNA, 19 nt, Homo sapiens
gaaguacuguggcuguaua

SEQ ID NO: 577636 - RNA, 19 nt, Homo sapiens
caaacaagcuagaaauaug

SEQ ID NO: 577637 - RNA, 19 nt, Homo sapiens
caauauggcugaguucuuu

SEQ ID NO: 577638 - RNA, 19 nt, Homo sapiens
gagauggccugacagaauu

SEQ ID NO: 577639 - RNA, 19 nt, Homo sapiens
caacuaugaugaacuaugu

SEQ ID NO: 577640 - RNA, 19 nt, Homo sapiens
gaauugaucacugucauua

SEQ ID NO: 577641 - RNA, 19 nt, Homo sapiens
ggauauauuuaccuggaua

SEQ ID NO: 577642 - RNA, 19 nt, Homo sapiens
ugaagaaacuccauuagca

SEQ ID NO: 577643 - RNA, 19 nt, Homo sapiens
ccagaggacuugcaauaug

SEQ ID NO: 577644 - RNA, 19 nt, Homo sapiens
ggagauggccugacagaau

SEQ ID NO: 577645 - RNA, 19 nt, Homo sapiens
ggaaauauggacagaagaa

SEQ ID NO: 577646 - RNA, 19 nt, Homo sapiens
caacagcaguauuuaucaa

SEQ ID NO: 577647 - RNA, 19 nt, Homo sapiens
cagaggacuugcaauauga

SEQ ID NO: 577648 - RNA, 19 nt, Homo sapiens
gguaaaucaccuauacuua

SEQ ID NO: 577649 - RNA, 19 nt, Homo sapiens
ugaauagucuuuccagugu

SEQ ID NO: 577650 - RNA, 19 nt, Homo sapiens
caaugaaacuagagacaug

SEQ ID NO: 577651 - RNA, 19 nt, Homo sapiens
aaacaggccuucaaacaag

SEQ ID NO: 577652 - RNA, 19 nt, Homo sapiens
gcuguuuacucaccuaauu

SEQ ID NO: 577653 - RNA, 19 nt, Homo sapiens
cagcauaagucuucuucuu

SEQ ID NO: 577654 - RNA, 19 nt, Homo sapiens
gauccaaaccuuuauuaug

SEQ ID NO: 577655 - RNA, 19 nt, Homo sapiens
gcacgacgacaauaucauu

SEQ ID NO: 577656 - RNA, 19 nt, Homo sapiens
aaagggaggcugcagaaua

SEQ ID NO: 577657 - RNA, 19 nt, Homo sapiens
guaaaucaccuauacuuag

SEQ ID NO: 577658 - RNA, 19 nt, Homo sapiens
aaagauggauccaaaccuu

SEQ ID NO: 577659 - RNA, 19 nt, Homo sapiens
cagcaguauuuaucaagua

SEQ ID NO: 577660 - RNA, 19 nt, Homo sapiens
ccagcuaccuuucaaaaua

SEQ ID NO: 577661 - RNA, 19 nt, Homo sapiens
gcugaguucuuucgaccua

SEQ ID NO: 577662 - RNA, 19 nt, Homo sapiens
uaaacaagcugugcagaag

SEQ ID NO: 577663 - RNA, 19 nt, Homo sapiens
ggaaagggaggcugcagaa

SEQ ID NO: 577664 - RNA, 19 nt, Homo sapiens
gcuaagauaauuccaauag

SEQ ID NO: 577665 - RNA, 19 nt, Homo sapiens
cgagacauuaccacuauua

SEQ ID NO: 577666 - RNA, 19 nt, Homo sapiens
uaggaaguguuucucuuaa

SEQ ID NO: 577667 - RNA, 19 nt, Homo sapiens
caacaugguaacucuauga

SEQ ID NO: 577668 - RNA, 19 nt, Homo sapiens
gugcaggccuguggacuuu

SEQ ID NO: 577669 - RNA, 19 nt, Homo sapiens
aaacauucuuugucccuuu

SEQ ID NO: 577670 - RNA, 19 nt, Homo sapiens
gcugaggucuguauggaau

SEQ ID NO: 577671 - RNA, 19 nt, Homo sapiens
ucaguguacuuuaccauau

SEQ ID NO: 577672 - RNA, 19 nt, Homo sapiens
gccuuuagcuaagauaauu

SEQ ID NO: 577673 - RNA, 19 nt, Homo sapiens
gugcaaauaucagaauugu

SEQ ID NO: 577674 - RNA, 19 nt, Homo sapiens
gacaauggagcaagugaaa

SEQ ID NO: 577675 - RNA, 19 nt, Homo sapiens
uaaagaugcugaggucugu

SEQ ID NO: 577676 - RNA, 19 nt, Homo sapiens
gaaauauggacagaagaaa

SEQ ID NO: 577677 - RNA, 19 nt, Homo sapiens
ugaaacaccuagucauuuu

SEQ ID NO: 577678 - RNA, 19 nt, Homo sapiens
caauggagcaagugaaaga

SEQ ID NO: 577679 - RNA, 19 nt, Homo sapiens
cuagagacauguuggaaag

SEQ ID NO: 577680 - RNA, 19 nt, Homo sapiens
agacuuugcugcuaaugug

SEQ ID NO: 577681 - RNA, 19 nt, Homo sapiens
gugaaacaccuagucauuu

SEQ ID NO: 577682 - RNA, 19 nt, Homo sapiens
uaagucuucuucuuggauu

SEQ ID NO: 577683 - RNA, 19 nt, Homo sapiens
ucuaggaugugugaaguuu

SEQ ID NO: 577684 - RNA, 19 nt, Homo sapiens
uuaggaaguguuucucuua

SEQ ID NO: 577685 - RNA, 19 nt, Homo sapiens
uagacaauauggcugaguu

SEQ ID NO: 577686 - RNA, 19 nt, Homo sapiens
ucagagaaauacaggaaag

SEQ ID NO: 577687 - RNA, 19 nt, Homo sapiens
ugaauuccaacaacuauga

SEQ ID NO: 577688 - RNA, 19 nt, Homo sapiens
gcaacaugguaacucuaug

SEQ ID NO: 577689 - RNA, 19 nt, Homo sapiens
caguguacuuuaccauauu

SEQ ID NO: 577690 - RNA, 19 nt, Homo sapiens
caggaucuguugacaaugg

SEQ ID NO: 577691 - RNA, 19 nt, Homo sapiens
gcagugaaacaccuaguca

SEQ ID NO: 577692 - RNA, 19 nt, Homo sapiens
cuacagugggauucauuua

SEQ ID NO: 577693 - RNA, 19 nt, Homo sapiens
ugaggucuguauggaauuu

SEQ ID NO: 577694 - RNA, 19 nt, Homo sapiens
gacauuaccacuauuaaac

SEQ ID NO: 577695 - RNA, 19 nt, Homo sapiens
gagacauuaccacuauuaa

SEQ ID NO: 577696 - RNA, 19 nt, Homo sapiens
gaugccagaugaagaaacu

SEQ ID NO: 577697 - RNA, 19 nt, Homo sapiens
aaccagaggacuugcaaua

SEQ ID NO: 577698 - RNA, 19 nt, Homo sapiens
guucuuugcuauuucuuca

SEQ ID NO: 577699 - RNA, 19 nt, Homo sapiens
ggguaaaucaccuauacuu

SEQ ID NO: 577700 - RNA, 19 nt, Homo sapiens
guaaacggacagauccauu

SEQ ID NO: 577701 - RNA, 19 nt, Homo sapiens
agauggauccaaaccuuua

SEQ ID NO: 577702 - RNA, 19 nt, Homo sapiens
aaucagaaaucucguugag

SEQ ID NO: 577703 - RNA, 19 nt, Homo sapiens
guaccuguaugcugguugu

SEQ ID NO: 577704 - RNA, 19 nt, Homo sapiens
ggaggcugcagaauacauu

SEQ ID NO: 577705 - RNA, 19 nt, Homo sapiens
agaugaagaaacuccauua

SEQ ID NO: 577706 - RNA, 19 nt, Homo sapiens
ggucuaggaugugugaagu

SEQ ID NO: 577707 - RNA, 19 nt, Homo sapiens
aagggaggcugcagaauac

SEQ ID NO: 577708 - RNA, 19 nt, Homo sapiens
ccaagcacgacgacaauau

SEQ ID NO: 577709 - RNA, 19 nt, Homo sapiens
cggguccaguuaaacauaa

SEQ ID NO: 577710 - RNA, 19 nt, Homo sapiens
cagcuaccuuucaaaauaa

SEQ ID NO: 577711 - RNA, 19 nt, Homo sapiens
gcuaauguguaugaagcuu

SEQ ID NO: 577712 - RNA, 19 nt, Homo sapiens
ggacuugcaauaugacagu

SEQ ID NO: 577713 - RNA, 19 nt, Homo sapiens
aggaaguguuucucuuaaa

SEQ ID NO: 577714 - RNA, 19 nt, Homo sapiens
gaaauaugggaggaucuga

SEQ ID NO: 577715 - RNA, 19 nt, Homo sapiens
gaugaagaaacuccauuag

SEQ ID NO: 577716 - RNA, 19 nt, Homo sapiens
uaugaugccagaugaagaa

SEQ ID NO: 577717 - RNA, 19 nt, Homo sapiens
ggauccaaaccuuuauuau

SEQ ID NO: 577718 - RNA, 19 nt, Homo sapiens
aaauggcacuacaauucuu

SEQ ID NO: 577719 - RNA, 19 nt, Homo sapiens
uaaugcagcaguuggcaaa

SEQ ID NO: 577720 - RNA, 19 nt, Homo sapiens
gcggguccaguuaaacaua

SEQ ID NO: 577721 - RNA, 19 nt, Homo sapiens
ccucacagcucugcuaaaa

SEQ ID NO: 577722 - RNA, 19 nt, Homo sapiens
ccauauuaauacugaggaa

SEQ ID NO: 577723 - RNA, 19 nt, Homo sapiens
ugagagaggccuuaaugca

SEQ ID NO: 577724 - RNA, 19 nt, Homo sapiens
cucagcaacuggagaaaug

SEQ ID NO: 577725 - RNA, 19 nt, Homo sapiens
gcaggccuguggacuuucu

SEQ ID NO: 577726 - RNA, 19 nt, Homo sapiens
gcagaagguuuuaggaagu

SEQ ID NO: 577727 - RNA, 19 nt, Homo sapiens
uuaaacaagcugugcagaa

SEQ ID NO: 577728 - RNA, 19 nt, Homo sapiens
auauuuaccuggauaaugc

SEQ ID NO: 577729 - RNA, 19 nt, Homo sapiens
uguuacacauggacauuug

SEQ ID NO: 577730 - RNA, 19 nt, Homo sapiens
uucaggaucuguugacaau

SEQ ID NO: 577731 - RNA, 19 nt, Homo sapiens
uaaugcagcaacugaauuc

SEQ ID NO: 577732 - RNA, 19 nt, Homo sapiens
gaaaggaaauguggaauaa

SEQ ID NO: 577733 - RNA, 19 nt, Homo sapiens
aaaggaagaucccuaaaua

SEQ ID NO: 577734 - RNA, 19 nt, Homo sapiens
gcacuggaaugaaugauuu

SEQ ID NO: 577735 - RNA, 19 nt, Homo sapiens
gaccagacaucaagcuuua

SEQ ID NO: 577736 - RNA, 19 nt, Homo sapiens
caucagaucucuugugaaa

SEQ ID NO: 577737 - RNA, 19 nt, Homo sapiens
gaagaucccuaaauacguu

SEQ ID NO: 577738 - RNA, 19 nt, Homo sapiens
gauaagaaguggcuuggaa

SEQ ID NO: 577739 - RNA, 19 nt, Homo sapiens
gaaggaugcuauucugaaa

SEQ ID NO: 577740 - RNA, 19 nt, Homo sapiens
gaaaggaaacucacuguug

SEQ ID NO: 577741 - RNA, 19 nt, Homo sapiens
ccaagagaauugaagauuu

SEQ ID NO: 577742 - RNA, 19 nt, Homo sapiens
caagaaaguugccuaggaa

SEQ ID NO: 577743 - RNA, 19 nt, Homo sapiens
gaacagauugccagucuuu

SEQ ID NO: 577744 - RNA, 19 nt, Homo sapiens
gaaauacaauguggcauau

SEQ ID NO: 577745 - RNA, 19 nt, Homo sapiens
gcacuucucaacaaauuua

SEQ ID NO: 577746 - RNA, 19 nt, Homo sapiens
guaaauguuucucagcuaa

SEQ ID NO: 577747 - RNA, 19 nt, Homo sapiens
agcagaagcucaacauuua

SEQ ID NO: 577748 - RNA, 19 nt, Homo sapiens
gaaaacagauuccaagaga

SEQ ID NO: 577749 - RNA, 19 nt, Homo sapiens
gaaacucacuguuggagau

SEQ ID NO: 577750 - RNA, 19 nt, Homo sapiens
gaaguuagauuacauuucc

SEQ ID NO: 577751 - RNA, 19 nt, Homo sapiens
ccacucaacucuuaauaug

SEQ ID NO: 577752 - RNA, 19 nt, Homo sapiens
gaaaguugccuaggaaauu

SEQ ID NO: 577753 - RNA, 19 nt, Homo sapiens
gacauuaacuucaaucgau

SEQ ID NO: 577754 - RNA, 19 nt, Homo sapiens
ucagaaaguuuggauagua

SEQ ID NO: 577755 - RNA, 19 nt, Homo sapiens
ccaguuggauggacacuaa

SEQ ID NO: 577756 - RNA, 19 nt, Homo sapiens
ccagagacguccuguuuga

SEQ ID NO: 577757 - RNA, 19 nt, Homo sapiens
gcugucagguguaauauau

SEQ ID NO: 577758 - RNA, 19 nt, Homo sapiens
guccaucucucucagguua

SEQ ID NO: 577759 - RNA, 19 nt, Homo sapiens
gaaaggaagaucccuaaau

SEQ ID NO: 577760 - RNA, 19 nt, Homo sapiens
cagaaaguuuggauaguaa

SEQ ID NO: 577761 - RNA, 19 nt, Homo sapiens
gggauaagguacuugaaga

SEQ ID NO: 577762 - RNA, 19 nt, Homo sapiens
ccaggaaucucuuuaacug

SEQ ID NO: 577763 - RNA, 19 nt, Homo sapiens
ucagaucucuugugaaauc

SEQ ID NO: 577764 - RNA, 19 nt, Homo sapiens
ccagagcaguuuaguaaug

SEQ ID NO: 577765 - RNA, 19 nt, Homo sapiens
ucacugaggugcuggauca

SEQ ID NO: 577766 - RNA, 19 nt, Homo sapiens
gaugguaguuccucccaaa

SEQ ID NO: 577767 - RNA, 19 nt, Homo sapiens
gaagguaccauagaagaaa

SEQ ID NO: 577768 - RNA, 19 nt, Homo sapiens
gcaagaagaaauccgcuuu

SEQ ID NO: 577769 - RNA, 19 nt, Homo sapiens
gagaaguuccuaaaccuuu

SEQ ID NO: 577770 - RNA, 19 nt, Homo sapiens
caagagacgcugacauuga

SEQ ID NO: 577771 - RNA, 19 nt, Homo sapiens
ucuaagaaaugggacuuua

SEQ ID NO: 577772 - RNA, 19 nt, Homo sapiens
ggauguggauaauucuaaa

SEQ ID NO: 577773 - RNA, 19 nt, Homo sapiens
ggaagacugugcaaguugu

SEQ ID NO: 577774 - RNA, 19 nt, Homo sapiens
uagagacaaucaacaguuu

SEQ ID NO: 577775 - RNA, 19 nt, Homo sapiens
caagcuuuauccauucaua

SEQ ID NO: 577776 - RNA, 19 nt, Homo sapiens
uuacgaagguaccauagaa

SEQ ID NO: 577777 - RNA, 19 nt, Homo sapiens
ggaaaccggagaaacuuaa

SEQ ID NO: 577778 - RNA, 19 nt, Homo sapiens
agaauagaauccaugauga

SEQ ID NO: 577779 - RNA, 19 nt, Homo sapiens
gaaaugcuaagaugaaauc

SEQ ID NO: 577780 - RNA, 19 nt, Homo sapiens
uuacagcuuugaucgauuu

SEQ ID NO: 577781 - RNA, 19 nt, Homo sapiens
ugaaauacaauguggcaua

SEQ ID NO: 577782 - RNA, 19 nt, Homo sapiens
uaccagagcaguuuaguaa

SEQ ID NO: 577783 - RNA, 19 nt, Homo sapiens
ggaacuucaugcugauuug

SEQ ID NO: 577784 - RNA, 19 nt, Homo sapiens
gaagaaugcagaaacuguu

SEQ ID NO: 577785 - RNA, 19 nt, Homo sapiens
gcaguacagugaauacaca

SEQ ID NO: 577786 - RNA, 19 nt, Homo sapiens
uaagggcggugaaguuaga

SEQ ID NO: 577787 - RNA, 19 nt, Homo sapiens
ggaaacgguacucuacuaa

SEQ ID NO: 577788 - RNA, 19 nt, Homo sapiens
caagacagcggaaucagaa

SEQ ID NO: 577789 - RNA, 19 nt, Homo sapiens
agacugcacuucucaacaa

SEQ ID NO: 577790 - RNA, 19 nt, Homo sapiens
gaauguagaaugcagaaau

SEQ ID NO: 577791 - RNA, 19 nt, Homo sapiens
gcuaaacuaccuggaaaua

SEQ ID NO: 577792 - RNA, 19 nt, Homo sapiens
ggagagagucgcacuggaa

SEQ ID NO: 577793 - RNA, 19 nt, Homo sapiens
cgauggauguggauaauuc

SEQ ID NO: 577794 - RNA, 19 nt, Homo sapiens
acaagaaaguugccuagga

SEQ ID NO: 577795 - RNA, 19 nt, Homo sapiens
ggacuaauguuucuuuugu

SEQ ID NO: 577796 - RNA, 19 nt, Homo sapiens
caauaccacuccugaaaca

SEQ ID NO: 577797 - RNA, 19 nt, Homo sapiens
uaaaaugccuuguucagaa

SEQ ID NO: 577798 - RNA, 19 nt, Homo sapiens
gaaaccaaacaucaaagaa

SEQ ID NO: 577799 - RNA, 19 nt, Homo sapiens
aagagacgcugacauugaa

SEQ ID NO: 577800 - RNA, 19 nt, Homo sapiens
ugaaaggaaauguggaaua

SEQ ID NO: 577801 - RNA, 19 nt, Homo sapiens
guacauaauccacauuugu

SEQ ID NO: 577802 - RNA, 19 nt, Homo sapiens
caccagagacguccuguuu

SEQ ID NO: 577803 - RNA, 19 nt, Homo sapiens
acaucaagcuuuauccauu

SEQ ID NO: 577804 - RNA, 19 nt, Homo sapiens
caucgaugcucuucacuuc

SEQ ID NO: 577805 - RNA, 19 nt, Homo sapiens
gcaugucacuuacgaaggu

SEQ ID NO: 577806 - RNA, 19 nt, Homo sapiens
ggaaaccaaacaucaaaga

SEQ ID NO: 577807 - RNA, 19 nt, Homo sapiens
gcacucugucugccaaaua

SEQ ID NO: 577808 - RNA, 19 nt, Homo sapiens
ggaaagugaacccgaauca

SEQ ID NO: 577809 - RNA, 19 nt, Homo sapiens
aagugaaccucaaacagua

SEQ ID NO: 577810 - RNA, 19 nt, Homo sapiens
uagaauccaugaugaguuc

SEQ ID NO: 577811 - RNA, 19 nt, Homo sapiens
ugucagguguaauauauga

SEQ ID NO: 577812 - RNA, 19 nt, Homo sapiens
ccacgaagaugggagugaa

SEQ ID NO: 577813 - RNA, 19 nt, Homo sapiens
ugaaacagaagaugaauca

SEQ ID NO: 577814 - RNA, 19 nt, Homo sapiens
cagaagcucaacauuuaua

SEQ ID NO: 577815 - RNA, 19 nt, Homo sapiens
caugaugaguucuguacaa

SEQ ID NO: 577816 - RNA, 19 nt, Homo sapiens
uauugaaguuucucuggua

SEQ ID NO: 577817 - RNA, 19 nt, Homo sapiens
caucaagcuuuauccauuc

SEQ ID NO: 577818 - RNA, 19 nt, Homo sapiens
ggaccagacaucaagcuuu

SEQ ID NO: 577819 - RNA, 19 nt, Homo sapiens
gaauugaugagagacauuu

SEQ ID NO: 577820 - RNA, 19 nt, Homo sapiens
gacgcuaccucgaucaguu

SEQ ID NO: 577821 - RNA, 19 nt, Homo sapiens
cuacuggguuggugacauu

SEQ ID NO: 577822 - RNA, 19 nt, Homo sapiens
gagggacguucaucaagga

SEQ ID NO: 577823 - RNA, 19 nt, Homo sapiens
gccaauaccacuccugaaa

SEQ ID NO: 577824 - RNA, 19 nt, Homo sapiens
gcucaacauuuauaucagu

SEQ ID NO: 577825 - RNA, 19 nt, Homo sapiens
aagcagaagcucaacauuu

SEQ ID NO: 577826 - RNA, 19 nt, Homo sapiens
gacaacaaauugauuagac

SEQ ID NO: 577827 - RNA, 19 nt, Homo sapiens
gcaucagacugcagcaaug

SEQ ID NO: 577828 - RNA, 19 nt, Homo sapiens
gccuuccacucaacucuua

SEQ ID NO: 577829 - RNA, 19 nt, Homo sapiens
agcgagaugugguuuauuu

SEQ ID NO: 577830 - RNA, 19 nt, Homo sapiens
gauggacacuaaaggaauc

SEQ ID NO: 577831 - RNA, 19 nt, Homo sapiens
gagagucgcacuggaauga

SEQ ID NO: 577832 - RNA, 19 nt, Homo sapiens
ggacagggaccucauauuu

SEQ ID NO: 577833 - RNA, 19 nt, Homo sapiens
acacagggcuccuuuaauu

SEQ ID NO: 577834 - RNA, 19 nt, Homo sapiens
uauaagggcuccuaccaua

SEQ ID NO: 577835 - RNA, 19 nt, Homo sapiens
ggaagaaccuggccuaucg

SEQ ID NO: 577836 - RNA, 19 nt, Homo sapiens
gcaccuggaugcgcuauaa

SEQ ID NO: 577837 - RNA, 19 nt, Homo sapiens
cagagaugcugcuucauuu

SEQ ID NO: 577838 - RNA, 19 nt, Homo sapiens
gcucagagaugcugcuuca

SEQ ID NO: 577839 - RNA, 19 nt, Homo sapiens
gugcagcgcuuuauucuca

SEQ ID NO: 577840 - RNA, 19 nt, Homo sapiens
cagauagacuuaaugaaga

SEQ ID NO: 577841 - RNA, 19 nt, Homo sapiens
gcacaacucgaccuucuuu

SEQ ID NO: 577842 - RNA, 19 nt, Homo sapiens
ggucacacguuacaugcua

SEQ ID NO: 577843 - RNA, 19 nt, Homo sapiens
ggacauuuggcuccucuua

SEQ ID NO: 577844 - RNA, 19 nt, Homo sapiens
gaauguuggugcucuucua

SEQ ID NO: 577845 - RNA, 19 nt, Homo sapiens
gggacugggucacacguua

SEQ ID NO: 577846 - RNA, 19 nt, Homo sapiens
gaaaugaggagcagcacuu

SEQ ID NO: 577847 - RNA, 19 nt, Homo sapiens
cgauauuggugguuucuuu

SEQ ID NO: 577848 - RNA, 19 nt, Homo sapiens
gauaugcaauggccuuugu

SEQ ID NO: 577849 - RNA, 19 nt, Homo sapiens
ggagaacuguccgaaucua

SEQ ID NO: 577850 - RNA, 19 nt, Homo sapiens
gaacuguccgaaucuaauu

SEQ ID NO: 577851 - RNA, 19 nt, Homo sapiens
gggccugucuacaacguua

SEQ ID NO: 577852 - RNA, 19 nt, Homo sapiens
gggcugaaaucaacgugaa

SEQ ID NO: 577853 - RNA, 19 nt, Homo sapiens
ccacacagggcuccuuuaa

SEQ ID NO: 577854 - RNA, 19 nt, Homo sapiens
ggacaguugugcggcauga

SEQ ID NO: 577855 - RNA, 19 nt, Homo sapiens
caagguggauggucaacug

SEQ ID NO: 577856 - RNA, 19 nt, Homo sapiens
cagcauugaugauguggaa

SEQ ID NO: 577857 - RNA, 19 nt, Homo sapiens
ggaucgaguucuccugcua

SEQ ID NO: 577858 - RNA, 19 nt, Homo sapiens
ucuggaaacuucaccauug

SEQ ID NO: 577859 - RNA, 19 nt, Homo sapiens
ccacacaccuuuguauaag

SEQ ID NO: 577860 - RNA, 19 nt, Homo sapiens
caggaggucauauucuuua

SEQ ID NO: 577861 - RNA, 19 nt, Homo sapiens
gaaccgagcguggacaguu

SEQ ID NO: 577862 - RNA, 19 nt, Homo sapiens
gaaaacuucuggaaacuuc

SEQ ID NO: 577863 - RNA, 19 nt, Homo sapiens
ccagauagacuuaaugaag

SEQ ID NO: 577864 - RNA, 19 nt, Homo sapiens
ggaggucauauucuuuaua

SEQ ID NO: 577865 - RNA, 19 nt, Homo sapiens
gcaccagucccuacgugua

SEQ ID NO: 577866 - RNA, 19 nt, Homo sapiens
gaaccucacaguacacuca

SEQ ID NO: 577867 - RNA, 19 nt, Homo sapiens
gaccugcacuuccacuuca

SEQ ID NO: 577868 - RNA, 19 nt, Homo sapiens
ccaagaggccucaguuuag

SEQ ID NO: 577869 - RNA, 19 nt, Homo sapiens
gcuccuaccauaccaauga

SEQ ID NO: 577870 - RNA, 19 nt, Homo sapiens
ucagagaugcugcuucauu

SEQ ID NO: 577871 - RNA, 19 nt, Homo sapiens
cuacuaccaugaugaagga

SEQ ID NO: 577872 - RNA, 19 nt, Homo sapiens
cuacauggcugugcucauc

SEQ ID NO: 577873 - RNA, 19 nt, Homo sapiens
gccacacaccuuuguauaa

SEQ ID NO: 577874 - RNA, 19 nt, Homo sapiens
ggcugaaccuggacacuga

SEQ ID NO: 577875 - RNA, 19 nt, Homo sapiens
guaccauccuggcagcaaa

SEQ ID NO: 577876 - RNA, 19 nt, Homo sapiens
gcuaugccacgucuuguuu

SEQ ID NO: 577877 - RNA, 19 nt, Homo sapiens
cuacgucaguuccuuuguu

SEQ ID NO: 577878 - RNA, 19 nt, Homo sapiens
gauguggucuucgccuuug

SEQ ID NO: 577879 - RNA, 19 nt, Homo sapiens
gggcacaacucgaccuucu

SEQ ID NO: 577880 - RNA, 19 nt, Homo sapiens
gcuccuggcuguuuaucug

SEQ ID NO: 577881 - RNA, 19 nt, Homo sapiens
ggguggaacucaacacauc

SEQ ID NO: 577882 - RNA, 19 nt, Homo sapiens
acagggaccucauauuucu

SEQ ID NO: 577883 - RNA, 19 nt, Homo sapiens
gaaccuggacacugagaug

SEQ ID NO: 577884 - RNA, 19 nt, Homo sapiens
ggaggcugcuaaacccuau

SEQ ID NO: 577885 - RNA, 19 nt, Homo sapiens
ggagcuaugccacgucuug

SEQ ID NO: 577886 - RNA, 19 nt, Homo sapiens
gaaucuaauugcggagcua

SEQ ID NO: 577887 - RNA, 19 nt, Homo sapiens
gagaacuguccgaaucuaa

SEQ ID NO: 577888 - RNA, 19 nt, Homo sapiens
ggaugucuccuucuacuuc

SEQ ID NO: 577889 - RNA, 19 nt, Homo sapiens
gaagccauuuguaguguac

SEQ ID NO: 577890 - RNA, 19 nt, Homo sapiens
gugcagcccuaacaugugu

SEQ ID NO: 577891 - RNA, 19 nt, Homo sapiens
ggucuucgccuuugaugug

SEQ ID NO: 577892 - RNA, 19 nt, Homo sapiens
ggaaaaccaugcaguuauc

SEQ ID NO: 577893 - RNA, 19 nt, Homo sapiens
gauacgaaccgcuccacuu

SEQ ID NO: 577894 - RNA, 19 nt, Homo sapiens
ggaauccugugaggcuuau

SEQ ID NO: 577895 - RNA, 19 nt, Homo sapiens
gaccaagaggccucaguuu

SEQ ID NO: 577896 - RNA, 19 nt, Homo sapiens
gauggagacaggagucauu

SEQ ID NO: 577897 - RNA, 19 nt, Homo sapiens
guggacaacucgagugaca

SEQ ID NO: 577898 - RNA, 19 nt, Homo sapiens
gacagggaccucauauuuc

SEQ ID NO: 577899 - RNA, 19 nt, Homo sapiens
gaguucuccugcuacaauu

SEQ ID NO: 577900 - RNA, 19 nt, Homo sapiens
accaagaggccucaguuua

SEQ ID NO: 577901 - RNA, 19 nt, Homo sapiens
uacagcagcucccaaccaa

SEQ ID NO: 577902 - RNA, 19 nt, Homo sapiens
gauauuggugguuucuuug

SEQ ID NO: 577903 - RNA, 19 nt, Homo sapiens
gguccgggcugaaaucaac

SEQ ID NO: 577904 - RNA, 19 nt, Homo sapiens
ugaagccauuuguagugua

SEQ ID NO: 577905 - RNA, 19 nt, Homo sapiens
cccaggaggucauauucuu

SEQ ID NO: 577906 - RNA, 19 nt, Homo sapiens
ccaaggcugcccacgagua

SEQ ID NO: 577907 - RNA, 19 nt, Homo sapiens
ggacgcugcuaccagucuu

SEQ ID NO: 577908 - RNA, 19 nt, Homo sapiens
ggaucaccuucgaggguaa

SEQ ID NO: 577909 - RNA, 19 nt, Homo sapiens
caauaucacccguguuuac

SEQ ID NO: 577910 - RNA, 19 nt, Homo sapiens
ggauguggucuucgccuuu

SEQ ID NO: 577911 - RNA, 19 nt, Homo sapiens
cuggaaacuucaccauuga

SEQ ID NO: 577912 - RNA, 19 nt, Homo sapiens
cacguuacaugcuacucua

SEQ ID NO: 577913 - RNA, 19 nt, Homo sapiens
gaaaagcucaauuggcaaa

SEQ ID NO: 577914 - RNA, 19 nt, Homo sapiens
ggaguccaggucugaauga

SEQ ID NO: 577915 - RNA, 19 nt, Homo sapiens
ggaccaggaaccagagaga

SEQ ID NO: 577916 - RNA, 19 nt, Homo sapiens
uggcugugcucaucaagga

SEQ ID NO: 577917 - RNA, 19 nt, Homo sapiens
gaugucuccuucuacuuca

SEQ ID NO: 577918 - RNA, 19 nt, Homo sapiens
aggccgacauacucuauuu

SEQ ID NO: 577919 - RNA, 19 nt, Homo sapiens
agagaugcugcuucauuua

SEQ ID NO: 577920 - RNA, 19 nt, Homo sapiens
gggauuaacaacagagugu

SEQ ID NO: 577921 - RNA, 19 nt, Homo sapiens
gcccuucucaucccuguuu

SEQ ID NO: 577922 - RNA, 19 nt, Homo sapiens
agggagaacuguccgaauc

SEQ ID NO: 577923 - RNA, 19 nt, Homo sapiens
gcugaggcccuucgaguuc

SEQ ID NO: 577924 - RNA, 19 nt, Homo sapiens
gcguggagcgcuauagcua

SEQ ID NO: 577925 - RNA, 19 nt, Homo sapiens
cgaguucuccugcuacaau

SEQ ID NO: 577926 - RNA, 19 nt, Homo sapiens
ucagugcccuugccaaugc

SEQ ID NO: 577927 - RNA, 19 nt, Homo sapiens
ggaaacuucaccauugauc

SEQ ID NO: 577928 - RNA, 19 nt, Homo sapiens
ccagagagagagagagaga

SEQ ID NO: 577929 - RNA, 19 nt, Homo sapiens
caggcggaguccucaauga

SEQ ID NO: 577930 - RNA, 19 nt, Homo sapiens
gccaugaccugcacuucca

SEQ ID NO: 577931 - RNA, 19 nt, Homo sapiens
ccaggaggucauauucuuu

SEQ ID NO: 577932 - RNA, 19 nt, Homo sapiens
ggaaacaucugccuucuua

SEQ ID NO: 577933 - RNA, 19 nt, Homo sapiens
gcacaugguuuaaauauga

SEQ ID NO: 577934 - RNA, 19 nt, Homo sapiens
uaaaugagcuguuggaaga

SEQ ID NO: 577935 - RNA, 19 nt, Homo sapiens
ccaaauugcuuuacaguuu

SEQ ID NO: 577936 - RNA, 19 nt, Homo sapiens
gaacaaaccugugaucuag

SEQ ID NO: 577937 - RNA, 19 nt, Homo sapiens
gcaaguagcacaugguuua

SEQ ID NO: 577938 - RNA, 19 nt, Homo sapiens
uaaagcagguagaacauua

SEQ ID NO: 577939 - RNA, 19 nt, Homo sapiens
guucuugaauccucuauua

SEQ ID NO: 577940 - RNA, 19 nt, Homo sapiens
ggaaaucaguugugaauac

SEQ ID NO: 577941 - RNA, 19 nt, Homo sapiens
cgaaagaugucuggguuua

SEQ ID NO: 577942 - RNA, 19 nt, Homo sapiens
gaacguuucugaacaaugg

SEQ ID NO: 577943 - RNA, 19 nt, Homo sapiens
gugaagagcuggagacaga

SEQ ID NO: 577944 - RNA, 19 nt, Homo sapiens
guaaggaaauuguggaaga

SEQ ID NO: 577945 - RNA, 19 nt, Homo sapiens
uaagaaugcuuugccauaa

SEQ ID NO: 577946 - RNA, 19 nt, Homo sapiens
ccacuggacucuccguuaa

SEQ ID NO: 577947 - RNA, 19 nt, Homo sapiens
gcaccaagcuguacgaacu

SEQ ID NO: 577948 - RNA, 19 nt, Homo sapiens
gaacugcuuucguccaugu

SEQ ID NO: 577949 - RNA, 19 nt, Homo sapiens
gcgauuggcugcaaagugu

SEQ ID NO: 577950 - RNA, 19 nt, Homo sapiens
gaacuaucuuggagaaugu

SEQ ID NO: 577951 - RNA, 19 nt, Homo sapiens
gcaagacuuuggacugcua

SEQ ID NO: 577952 - RNA, 19 nt, Homo sapiens
gagaaagaguaaggaaauu

SEQ ID NO: 577953 - RNA, 19 nt, Homo sapiens
cuaaauaaaugagcuguug

SEQ ID NO: 577954 - RNA, 19 nt, Homo sapiens
gaaaucaguugugaauaca

SEQ ID NO: 577955 - RNA, 19 nt, Homo sapiens
gcaaugcaaaugucuaauu

SEQ ID NO: 577956 - RNA, 19 nt, Homo sapiens
uaacauuucucuccaccuu

SEQ ID NO: 577957 - RNA, 19 nt, Homo sapiens
cugcuacgauccaacauua

SEQ ID NO: 577958 - RNA, 19 nt, Homo sapiens
guauauagggcacaaguaa

SEQ ID NO: 577959 - RNA, 19 nt, Homo sapiens
guagugagugccaaacuua

SEQ ID NO: 577960 - RNA, 19 nt, Homo sapiens
ggacagugaggucaacuuu

SEQ ID NO: 577961 - RNA, 19 nt, Homo sapiens
gcaaaucugccaagagaga

SEQ ID NO: 577962 - RNA, 19 nt, Homo sapiens
guaaaggcauuguccaaag

SEQ ID NO: 577963 - RNA, 19 nt, Homo sapiens
gcaguacauucuaaagaga

SEQ ID NO: 577964 - RNA, 19 nt, Homo sapiens
gaauaguucuguauauagg

SEQ ID NO: 577965 - RNA, 19 nt, Homo sapiens
gaaugugucucagcaacuu

SEQ ID NO: 577966 - RNA, 19 nt, Homo sapiens
guucauauguacuuguuug

SEQ ID NO: 577967 - RNA, 19 nt, Homo sapiens
gaaggaaaauguucauguu

SEQ ID NO: 577968 - RNA, 19 nt, Homo sapiens
gugcacaaguaacacauuu

SEQ ID NO: 577969 - RNA, 19 nt, Homo sapiens
ugaagaagcgcuauugcua

SEQ ID NO: 577970 - RNA, 19 nt, Homo sapiens
cauauguacuuguuugcua

SEQ ID NO: 577971 - RNA, 19 nt, Homo sapiens
gcugauuccuacugcauuu

SEQ ID NO: 577972 - RNA, 19 nt, Homo sapiens
gaaacugaaggucaauaaa

SEQ ID NO: 577973 - RNA, 19 nt, Homo sapiens
ggaaaggaccaaauugcuu

SEQ ID NO: 577974 - RNA, 19 nt, Homo sapiens
gcagaaugacgguguggua

SEQ ID NO: 577975 - RNA, 19 nt, Homo sapiens
guuacaauuuggagcauaa

SEQ ID NO: 577976 - RNA, 19 nt, Homo sapiens
cuaaagagagugagcauga

SEQ ID NO: 577977 - RNA, 19 nt, Homo sapiens
gaaagaguaaggaaauugu

SEQ ID NO: 577978 - RNA, 19 nt, Homo sapiens
guacgagucugcaauuaac

SEQ ID NO: 577979 - RNA, 19 nt, Homo sapiens
cgaacuaucuuggagaaug

SEQ ID NO: 577980 - RNA, 19 nt, Homo sapiens
ggaauaguucuguauauag

SEQ ID NO: 577981 - RNA, 19 nt, Homo sapiens
aaacaucugccuucuuaaa

SEQ ID NO: 577982 - RNA, 19 nt, Homo sapiens
cauagucagugucguuuau

SEQ ID NO: 577983 - RNA, 19 nt, Homo sapiens
guaguugggccuaaauaaa

SEQ ID NO: 577984 - RNA, 19 nt, Homo sapiens
gaaaagaaguugcaagacu

SEQ ID NO: 577985 - RNA, 19 nt, Homo sapiens
ucaggaagaaugaagauuu

SEQ ID NO: 577986 - RNA, 19 nt, Homo sapiens
ccuggaagcuggugacaug

SEQ ID NO: 577987 - RNA, 19 nt, Homo sapiens
cuaagcaugugccgucgua

SEQ ID NO: 577988 - RNA, 19 nt, Homo sapiens
cuaagaaugcuuugccaua

SEQ ID NO: 577989 - RNA, 19 nt, Homo sapiens
cuacagcugucuucacaug

SEQ ID NO: 577990 - RNA, 19 nt, Homo sapiens
aaagaugucuggguuuaug

SEQ ID NO: 577991 - RNA, 19 nt, Homo sapiens
gacagacuuucauguguga

SEQ ID NO: 577992 - RNA, 19 nt, Homo sapiens
gcaugcugcugcugucuga

SEQ ID NO: 577993 - RNA, 19 nt, Homo sapiens
gcauguaucacagauguaa

SEQ ID NO: 577994 - RNA, 19 nt, Homo sapiens
gcacacaaggcgcuuucua

SEQ ID NO: 577995 - RNA, 19 nt, Homo sapiens
gcccuccacuucugguaua

SEQ ID NO: 577996 - RNA, 19 nt, Homo sapiens
gcugguugcuguagaaaca

SEQ ID NO: 577997 - RNA, 19 nt, Homo sapiens
gccagcagcggcuccauua

SEQ ID NO: 577998 - RNA, 19 nt, Homo sapiens
gggcacaaguaaaggcauu

SEQ ID NO: 577999 - RNA, 19 nt, Homo sapiens
ggaccaaagugggagaugu

SEQ ID NO: 578000 - RNA, 19 nt, Homo sapiens
caggaagaaugaagauuuc

SEQ ID NO: 578001 - RNA, 19 nt, Homo sapiens
ggccugaacucauucucuu

SEQ ID NO: 578002 - RNA, 19 nt, Homo sapiens
uaaaggcauuguccaaagu

SEQ ID NO: 578003 - RNA, 19 nt, Homo sapiens
gcuguuaagaaguuuguua

SEQ ID NO: 578004 - RNA, 19 nt, Homo sapiens
ccaggaacguuucugaaca

SEQ ID NO: 578005 - RNA, 19 nt, Homo sapiens
ugaacaaaccugugaucua

SEQ ID NO: 578006 - RNA, 19 nt, Homo sapiens
caagucuaaugaagagaaa

SEQ ID NO: 578007 - RNA, 19 nt, Homo sapiens
ucgaugagauaauaugaga

SEQ ID NO: 578008 - RNA, 19 nt, Homo sapiens
cauuuggucucacuacuug

SEQ ID NO: 578009 - RNA, 19 nt, Homo sapiens
gaaucgauauaggcauuug

SEQ ID NO: 578010 - RNA, 19 nt, Homo sapiens
acagcugucuucacaugua

SEQ ID NO: 578011 - RNA, 19 nt, Homo sapiens
caggaacguuucugaacaa

SEQ ID NO: 578012 - RNA, 19 nt, Homo sapiens
gaggauacuuuggcauuca

SEQ ID NO: 578013 - RNA, 19 nt, Homo sapiens
gaccagaaggccaaagaaa

SEQ ID NO: 578014 - RNA, 19 nt, Homo sapiens
ggaccaaauugcuuuacag

SEQ ID NO: 578015 - RNA, 19 nt, Homo sapiens
ggaggauacuuuggcauuc

SEQ ID NO: 578016 - RNA, 19 nt, Homo sapiens
gcagagaaagaguaaggaa

SEQ ID NO: 578017 - RNA, 19 nt, Homo sapiens
augcaaaucugccaagaga

SEQ ID NO: 578018 - RNA, 19 nt, Homo sapiens
cagugucguuuauauugua

SEQ ID NO: 578019 - RNA, 19 nt, Homo sapiens
uaacuggacaugaaggaaa

SEQ ID NO: 578020 - RNA, 19 nt, Homo sapiens
gagaggccaagucuaauga

SEQ ID NO: 578021 - RNA, 19 nt, Homo sapiens
ggagaggccaagucuaaug

SEQ ID NO: 578022 - RNA, 19 nt, Homo sapiens
aaacaaacucuacgugguu

SEQ ID NO: 578023 - RNA, 19 nt, Homo sapiens
gaaacgucccacacuuuga

SEQ ID NO: 578024 - RNA, 19 nt, Homo sapiens
gugcuagucucaaauaggu

SEQ ID NO: 578025 - RNA, 19 nt, Homo sapiens
ugaaugaacaaaccuguga

SEQ ID NO: 578026 - RNA, 19 nt, Homo sapiens
ccagaaggccaaagaaauc

SEQ ID NO: 578027 - RNA, 19 nt, Homo sapiens
ugaaaauccugcagaauga

SEQ ID NO: 578028 - RNA, 19 nt, Homo sapiens
uggaggaacucaucaccaa

SEQ ID NO: 578029 - RNA, 19 nt, Homo sapiens
ugaaacugaaggucaauaa

SEQ ID NO: 578030 - RNA, 19 nt, Homo sapiens
ucugaaagcaggaugaauu

SEQ ID NO: 578031 - RNA, 19 nt, Homo sapiens
guccuugucuuguaauugu

SEQ ID NO: 578032 - RNA, 19 nt, Homo sapiens
gaagagagguuccuaauac

SEQ ID NO: 578033 - RNA, 19 nt, Homo sapiens
gaacuuggguuucaauugu

SEQ ID NO: 578034 - RNA, 19 nt, Homo sapiens
gaacagagaugacaaaaga

SEQ ID NO: 578035 - RNA, 19 nt, Homo sapiens
gaaaccagcugcuccuuga

SEQ ID NO: 578036 - RNA, 19 nt, Homo sapiens
gaaauccucuguuuagcuu

SEQ ID NO: 578037 - RNA, 19 nt, Homo sapiens
gagaguggcuuggcuguuu

SEQ ID NO: 578038 - RNA, 19 nt, Homo sapiens
gaagguagaacuuagaauu

SEQ ID NO: 578039 - RNA, 19 nt, Homo sapiens
gaauuuggaaucuggaaua

SEQ ID NO: 578040 - RNA, 19 nt, Homo sapiens
gaagaacagagaugacaaa

SEQ ID NO: 578041 - RNA, 19 nt, Homo sapiens
gaaaccagcaaccucuaua

SEQ ID NO: 578042 - RNA, 19 nt, Homo sapiens
gaguucagcuucuggaaug

SEQ ID NO: 578043 - RNA, 19 nt, Homo sapiens
gaagagaggcugggaugaa

SEQ ID NO: 578044 - RNA, 19 nt, Homo sapiens
gaacuuagaauucagaacu

SEQ ID NO: 578045 - RNA, 19 nt, Homo sapiens
ggaagaagaacagagauga

SEQ ID NO: 578046 - RNA, 19 nt, Homo sapiens
ugacaaguucugaggauua

SEQ ID NO: 578047 - RNA, 19 nt, Homo sapiens
gauccaguuucacaaugua

SEQ ID NO: 578048 - RNA, 19 nt, Homo sapiens
ccagcaaccucuauaagau

SEQ ID NO: 578049 - RNA, 19 nt, Homo sapiens
ucuauaagauccaguuuca

SEQ ID NO: 578050 - RNA, 19 nt, Homo sapiens
gaauucagaacuuggguuu

SEQ ID NO: 578051 - RNA, 19 nt, Homo sapiens
gaagggagcggacgcagau

SEQ ID NO: 578052 - RNA, 19 nt, Homo sapiens
ugaagagagguuccuaaua

SEQ ID NO: 578053 - RNA, 19 nt, Homo sapiens
gcaggagacagacacguaa

SEQ ID NO: 578054 - RNA, 19 nt, Homo sapiens
aggaggagguucagacauu

SEQ ID NO: 578055 - RNA, 19 nt, Homo sapiens
gggcagugcucaguucaga

SEQ ID NO: 578056 - RNA, 19 nt, Homo sapiens
gaucucgccucugcaguga

SEQ ID NO: 578057 - RNA, 19 nt, Homo sapiens
gaaaaugucuacuauacag

SEQ ID NO: 578058 - RNA, 19 nt, Homo sapiens
gcaacuggaacacguggua

SEQ ID NO: 578059 - RNA, 19 nt, Homo sapiens
cccaggcccuuucuacuuu

SEQ ID NO: 578060 - RNA, 19 nt, Homo sapiens
caccaucucugggccuaua

SEQ ID NO: 578061 - RNA, 19 nt, Homo sapiens
gaaaacuugugcuggaauu

SEQ ID NO: 578062 - RNA, 19 nt, Homo sapiens
ggaggagguucagacauuc

SEQ ID NO: 578063 - RNA, 19 nt, Homo sapiens
ccuuggaaauccucuguuu

SEQ ID NO: 578064 - RNA, 19 nt, Homo sapiens
aagagaggcugggaugaaa

SEQ ID NO: 578065 - RNA, 19 nt, Homo sapiens
acugaaggcugacaaguuc

SEQ ID NO: 578066 - RNA, 19 nt, Homo sapiens
ggaugaaaaugucuacuau

SEQ ID NO: 578067 - RNA, 19 nt, Homo sapiens
ccacccugcuguccaagaa

SEQ ID NO: 578068 - RNA, 19 nt, Homo sapiens
gaauacagaauugggaaga

SEQ ID NO: 578069 - RNA, 19 nt, Homo sapiens
gcugacaaguucugaggau

SEQ ID NO: 578070 - RNA, 19 nt, Homo sapiens
gggccuuccugcaaccuuu

SEQ ID NO: 578071 - RNA, 19 nt, Homo sapiens
ggaaaccagcaaccucuau

SEQ ID NO: 578072 - RNA, 19 nt, Homo sapiens
ccaguuaucacccuuggaa

SEQ ID NO: 578073 - RNA, 19 nt, Homo sapiens
gagagguuccuaauacuag

SEQ ID NO: 578074 - RNA, 19 nt, Homo sapiens
aacaggaacucggaaggua

SEQ ID NO: 578075 - RNA, 19 nt, Homo sapiens
gcagagcgcgcagaggauu

SEQ ID NO: 578076 - RNA, 19 nt, Homo sapiens
ucaaguaccggcaggagaa

SEQ ID NO: 578077 - RNA, 19 nt, Homo sapiens
gggcucgggccaucaagua

SEQ ID NO: 578078 - RNA, 19 nt, Homo sapiens
uauaagauccaguuucaca

SEQ ID NO: 578079 - RNA, 19 nt, Homo sapiens
gcugauggaaacaauuaaa

SEQ ID NO: 578080 - RNA, 19 nt, Homo sapiens
ccuguucccucacccugua

SEQ ID NO: 578081 - RNA, 19 nt, Homo sapiens
aaaccagcaaccucuauaa

SEQ ID NO: 578082 - RNA, 19 nt, Homo sapiens
ggcaggagacagacacgua

SEQ ID NO: 578083 - RNA, 19 nt, Homo sapiens
gccuucauauaucuucuaa

SEQ ID NO: 578084 - RNA, 19 nt, Homo sapiens
gaacugaaggcugacaagu

SEQ ID NO: 578085 - RNA, 19 nt, Homo sapiens
gcaggcaaauauacaagcu

SEQ ID NO: 578086 - RNA, 19 nt, Homo sapiens
gccaggcccucaggaauuc

SEQ ID NO: 578087 - RNA, 19 nt, Homo sapiens
gacagacacguaacaggaa

SEQ ID NO: 578088 - RNA, 19 nt, Homo sapiens
gcccaggcccuuucuacuu

SEQ ID NO: 578089 - RNA, 19 nt, Homo sapiens
gacaaguucugaggauuac

SEQ ID NO: 578090 - RNA, 19 nt, Homo sapiens
gcaaauauacaagcuagac

SEQ ID NO: 578091 - RNA, 19 nt, Homo sapiens
ggaaauccucuguuuagcu

SEQ ID NO: 578092 - RNA, 19 nt, Homo sapiens
gcagugcucaguucagaca

SEQ ID NO: 578093 - RNA, 19 nt, Homo sapiens
cacauggagucuaggauca

SEQ ID NO: 578094 - RNA, 19 nt, Homo sapiens
uaagauccaguuucacaau

SEQ ID NO: 578095 - RNA, 19 nt, Homo sapiens
uggaauugcugauggaaac

SEQ ID NO: 578096 - RNA, 19 nt, Homo sapiens
gggaagaagaacagagaug

SEQ ID NO: 578097 - RNA, 19 nt, Homo sapiens
auucagaacuuggguuuca

SEQ ID NO: 578098 - RNA, 19 nt, Homo sapiens
guagaacuuagaauucaga

SEQ ID NO: 578099 - RNA, 19 nt, Homo sapiens
gaugggagccaggaaagau

SEQ ID NO: 578100 - RNA, 19 nt, Homo sapiens
uaaaauuccucaucucaag

SEQ ID NO: 578101 - RNA, 19 nt, Homo sapiens
gaugaggacuacccaugcu

SEQ ID NO: 578102 - RNA, 19 nt, Homo sapiens
uugcugauggaaacaauua

SEQ ID NO: 578103 - RNA, 19 nt, Homo sapiens
ggaagagaggcugggauga

SEQ ID NO: 578104 - RNA, 19 nt, Homo sapiens
guaguuccaguccuucuau

SEQ ID NO: 578105 - RNA, 19 nt, Homo sapiens
agagagguuccuaauacua

SEQ ID NO: 578106 - RNA, 19 nt, Homo sapiens
gaacucggaagguagaacu

SEQ ID NO: 578107 - RNA, 19 nt, Homo sapiens
gaaacgcugccuggaggaa

SEQ ID NO: 578108 - RNA, 19 nt, Homo sapiens
caauguaaagccugaauac

SEQ ID NO: 578109 - RNA, 19 nt, Homo sapiens
ccaagaaggaaaccagcaa

SEQ ID NO: 578110 - RNA, 19 nt, Homo sapiens
gaagaagaacagagaugac

SEQ ID NO: 578111 - RNA, 19 nt, Homo sapiens
agguagaacuuagaauuca

SEQ ID NO: 578112 - RNA, 19 nt, Homo sapiens
gggagccaggaaagauuua

SEQ ID NO: 578113 - RNA, 19 nt, Homo sapiens
acaauguaaagccugaaua

SEQ ID NO: 578114 - RNA, 19 nt, Homo sapiens
aagauccaguuucacaaug

SEQ ID NO: 578115 - RNA, 19 nt, Homo sapiens
ccuaauugacauucuauca

SEQ ID NO: 578116 - RNA, 19 nt, Homo sapiens
caaaagaccacuugaagag

SEQ ID NO: 578117 - RNA, 19 nt, Homo sapiens
gaauugggaagaagaacag

SEQ ID NO: 578118 - RNA, 19 nt, Homo sapiens
gaaguaguuucugauuucc

SEQ ID NO: 578119 - RNA, 19 nt, Homo sapiens
uggagacgcccacaggaaa

SEQ ID NO: 578120 - RNA, 19 nt, Homo sapiens
uuucugauuucccugaaug

SEQ ID NO: 578121 - RNA, 19 nt, Homo sapiens
cggcuucuucucacagaua

SEQ ID NO: 578122 - RNA, 19 nt, Homo sapiens
gcaccuguggcgauucuca

SEQ ID NO: 578123 - RNA, 19 nt, Homo sapiens
uaucagcccaacccucauu

SEQ ID NO: 578124 - RNA, 19 nt, Homo sapiens
gguagaacuuagaauucag

SEQ ID NO: 578125 - RNA, 19 nt, Homo sapiens
ggccaccaguccccaguua

SEQ ID NO: 578126 - RNA, 19 nt, Homo sapiens
ucucgccucugcagugaug

SEQ ID NO: 578127 - RNA, 19 nt, Homo sapiens
gcccaagcuucaccuggau

SEQ ID NO: 578128 - RNA, 19 nt, Homo sapiens
gaauugcugauggaaacaa

SEQ ID NO: 578129 - RNA, 19 nt, Homo sapiens
uauccugucuccccuaauu

SEQ ID NO: 578130 - RNA, 19 nt, Homo sapiens
cagagcgcgcagaggauua

SEQ ID NO: 578131 - RNA, 19 nt, Homo sapiens
aauacagaauugggaagaa

SEQ ID NO: 578132 - RNA, 19 nt, Homo sapiens
gcacugauuuccuauuuga

SEQ ID NO: 578133 - RNA, 19 nt, Homo sapiens
ugacccaucuguccaauua

SEQ ID NO: 578134 - RNA, 19 nt, Homo sapiens
gggaagaacugcagcauuc

SEQ ID NO: 578135 - RNA, 19 nt, Homo sapiens
gcaaagaguucuggugguu

SEQ ID NO: 578136 - RNA, 19 nt, Homo sapiens
gaagguggcugauguugag

SEQ ID NO: 578137 - RNA, 19 nt, Homo sapiens
gacaagaggcacaaagaua

SEQ ID NO: 578138 - RNA, 19 nt, Homo sapiens
aaacuuaucuucguugaug

SEQ ID NO: 578139 - RNA, 19 nt, Homo sapiens
cagcacugauuuccuauuu

SEQ ID NO: 578140 - RNA, 19 nt, Homo sapiens
caacuucaccuucaacuug

SEQ ID NO: 578141 - RNA, 19 nt, Homo sapiens
gaacaaacucaggaccuua

SEQ ID NO: 578142 - RNA, 19 nt, Homo sapiens
gcaugaagguggcugaugu

SEQ ID NO: 578143 - RNA, 19 nt, Homo sapiens
gcacagaaguacuuugaac

SEQ ID NO: 578144 - RNA, 19 nt, Homo sapiens
gcagacauguggccucuuc

SEQ ID NO: 578145 - RNA, 19 nt, Homo sapiens
ccaaugagauuucccucuu

SEQ ID NO: 578146 - RNA, 19 nt, Homo sapiens
cuacaacgcuggcugacuu

SEQ ID NO: 578147 - RNA, 19 nt, Homo sapiens
cacacaaucuucuauaaug

SEQ ID NO: 578148 - RNA, 19 nt, Homo sapiens
ccacaaacuuaucuucguu

SEQ ID NO: 578149 - RNA, 19 nt, Homo sapiens
gcuaugucuuggucauuua

SEQ ID NO: 578150 - RNA, 19 nt, Homo sapiens
gagccaagaucaucacagu

SEQ ID NO: 578151 - RNA, 19 nt, Homo sapiens
gcuagaaauguccuuaaua

SEQ ID NO: 578152 - RNA, 19 nt, Homo sapiens
gagauucaguucuucaaca

SEQ ID NO: 578153 - RNA, 19 nt, Homo sapiens
ggacauggccuuuccuucu

SEQ ID NO: 578154 - RNA, 19 nt, Homo sapiens
gaauguauuaguccaauga

SEQ ID NO: 578155 - RNA, 19 nt, Homo sapiens
ggccugagauggcugagaa

SEQ ID NO: 578156 - RNA, 19 nt, Homo sapiens
acaaggguauugacuggua

SEQ ID NO: 578157 - RNA, 19 nt, Homo sapiens
agagacagcucgaacugaa

SEQ ID NO: 578158 - RNA, 19 nt, Homo sapiens
gaaccauaauuuggaguug

SEQ ID NO: 578159 - RNA, 19 nt, Homo sapiens
gaccagcacugaggaguau

SEQ ID NO: 578160 - RNA, 19 nt, Homo sapiens
ggcaagagcugcguaccaa

SEQ ID NO: 578161 - RNA, 19 nt, Homo sapiens
ccaccuacuuugacucuga

SEQ ID NO: 578162 - RNA, 19 nt, Homo sapiens
gaacugcaccgccucauac

SEQ ID NO: 578163 - RNA, 19 nt, Homo sapiens
gacuacagcuauucacuuc

SEQ ID NO: 578164 - RNA, 19 nt, Homo sapiens
ggaacugcaccgccucaua

SEQ ID NO: 578165 - RNA, 19 nt, Homo sapiens
gacacugagucccgucuuu

SEQ ID NO: 578166 - RNA, 19 nt, Homo sapiens
ucacacccuuucugaacua

SEQ ID NO: 578167 - RNA, 19 nt, Homo sapiens
cuacagcuauucacuucuu

SEQ ID NO: 578168 - RNA, 19 nt, Homo sapiens
aaacagggacuacagcuau

SEQ ID NO: 578169 - RNA, 19 nt, Homo sapiens
uggaggcucucgugaacua

SEQ ID NO: 578170 - RNA, 19 nt, Homo sapiens
gcucugaacuauaccuucu

SEQ ID NO: 578171 - RNA, 19 nt, Homo sapiens
ggacuacagcuauucacuu

SEQ ID NO: 578172 - RNA, 19 nt, Homo sapiens
acaaagauaucugguccaa

SEQ ID NO: 578173 - RNA, 19 nt, Homo sapiens
ccgaucagcaucuuuauga

SEQ ID NO: 578174 - RNA, 19 nt, Homo sapiens
ggaauguauuaguccaaug

SEQ ID NO: 578175 - RNA, 19 nt, Homo sapiens
gagcaaaggccggagguau

SEQ ID NO: 578176 - RNA, 19 nt, Homo sapiens
gugaucgucucccgaaguu

SEQ ID NO: 578177 - RNA, 19 nt, Homo sapiens
ugacagugcugcuuaaucc

SEQ ID NO: 578178 - RNA, 19 nt, Homo sapiens
ccgcagcaguguaucuauu

SEQ ID NO: 578179 - RNA, 19 nt, Homo sapiens
ccacaguucugggacaaau

SEQ ID NO: 578180 - RNA, 19 nt, Homo sapiens
cauguggccucuucacuca

SEQ ID NO: 578181 - RNA, 19 nt, Homo sapiens
gacauggccuuuccuucug

SEQ ID NO: 578182 - RNA, 19 nt, Homo sapiens
ggcuagaaauguccuuaau

SEQ ID NO: 578183 - RNA, 19 nt, Homo sapiens
ugaacuauaccuucuauca

SEQ ID NO: 578184 - RNA, 19 nt, Homo sapiens
ugccagcacugauuuccua

SEQ ID NO: 578185 - RNA, 19 nt, Homo sapiens
acaagaggcacaaagauau

SEQ ID NO: 578186 - RNA, 19 nt, Homo sapiens
ccacaccuguuccacaauc

SEQ ID NO: 578187 - RNA, 19 nt, Homo sapiens
ggaagggacccgcaugaag

SEQ ID NO: 578188 - RNA, 19 nt, Homo sapiens
ccacauugacugauaauac

SEQ ID NO: 578189 - RNA, 19 nt, Homo sapiens
gggaauguauuaguccaau

SEQ ID NO: 578190 - RNA, 19 nt, Homo sapiens
cuacuauucuacccaucua

SEQ ID NO: 578191 - RNA, 19 nt, Homo sapiens
cagaaucccugugaugaca

SEQ ID NO: 578192 - RNA, 19 nt, Homo sapiens
ucgggcaaguucuaucaua

SEQ ID NO: 578193 - RNA, 19 nt, Homo sapiens
gcaguguaucuauucuaua

SEQ ID NO: 578194 - RNA, 19 nt, Homo sapiens
gguaucacacccuuucuga

SEQ ID NO: 578195 - RNA, 19 nt, Homo sapiens
ccaaugccagcacugauuu

SEQ ID NO: 578196 - RNA, 19 nt, Homo sapiens
ccucuucacucacacaauc

SEQ ID NO: 578197 - RNA, 19 nt, Homo sapiens
ugggcuuccuggcuuauua

SEQ ID NO: 578198 - RNA, 19 nt, Homo sapiens
ccaugggcuuccuggcuua

SEQ ID NO: 578199 - RNA, 19 nt, Homo sapiens
gaacuauaccuucuaucag

SEQ ID NO: 578200 - RNA, 19 nt, Homo sapiens
gggacgacaugcugcugaa

SEQ ID NO: 578201 - RNA, 19 nt, Homo sapiens
caaugagauuucccucuuc

SEQ ID NO: 578202 - RNA, 19 nt, Homo sapiens
caacccagcagccucaaug

SEQ ID NO: 578203 - RNA, 19 nt, Homo sapiens
gcacauuugaggagauuca

SEQ ID NO: 578204 - RNA, 19 nt, Homo sapiens
cagcacauuugaggagauu

SEQ ID NO: 578205 - RNA, 19 nt, Homo sapiens
guauuaguccaaugagauu

SEQ ID NO: 578206 - RNA, 19 nt, Homo sapiens
ggaaccauaauuuggaguu

SEQ ID NO: 578207 - RNA, 19 nt, Homo sapiens
acacggacccucagguuug

SEQ ID NO: 578208 - RNA, 19 nt, Homo sapiens
aauccgaucagcaucuuua

SEQ ID NO: 578209 - RNA, 19 nt, Homo sapiens
acaaacuuaucuucguuga

SEQ ID NO: 578210 - RNA, 19 nt, Homo sapiens
ggacaugcccacauugacu

SEQ ID NO: 578211 - RNA, 19 nt, Homo sapiens
gcugugggcuagaaauguc

SEQ ID NO: 578212 - RNA, 19 nt, Homo sapiens
cugcagaaccgcugucuug

SEQ ID NO: 578213 - RNA, 19 nt, Homo sapiens
uaucuucguugaugcuguu

SEQ ID NO: 578214 - RNA, 19 nt, Homo sapiens
ggacuugaaggugguaaga

SEQ ID NO: 578215 - RNA, 19 nt, Homo sapiens
uugaggagauucaguucuu

SEQ ID NO: 578216 - RNA, 19 nt, Homo sapiens
ccaauccaaucauaguaca

SEQ ID NO: 578217 - RNA, 19 nt, Homo sapiens
agaaccugcucaaguaugu

SEQ ID NO: 578218 - RNA, 19 nt, Homo sapiens
cacauaauagugcuaggua

SEQ ID NO: 578219 - RNA, 19 nt, Homo sapiens
cuuugacucugaaguugua

SEQ ID NO: 578220 - RNA, 19 nt, Homo sapiens
ggcagaaucccugugauga

SEQ ID NO: 578221 - RNA, 19 nt, Homo sapiens
cucacacaaucuucuauaa

SEQ ID NO: 578222 - RNA, 19 nt, Homo sapiens
ggcaaguucuaucauacug

SEQ ID NO: 578223 - RNA, 19 nt, Homo sapiens
agaacaaacucaggaccuu

SEQ ID NO: 578224 - RNA, 19 nt, Homo sapiens
gggcuagaaauguccuuaa

SEQ ID NO: 578225 - RNA, 19 nt, Homo sapiens
aacgcuggcugacuuacua

SEQ ID NO: 578226 - RNA, 19 nt, Homo sapiens
gucccuggcuacuauucua

SEQ ID NO: 578227 - RNA, 19 nt, Homo sapiens
cuaccgccguggcuucauu

SEQ ID NO: 578228 - RNA, 19 nt, Homo sapiens
guucccaacuucaccuuca

SEQ ID NO: 578229 - RNA, 19 nt, Homo sapiens
uaauacccauggccgcuau

SEQ ID NO: 578230 - RNA, 19 nt, Homo sapiens
acaguucugggacaaauaa

SEQ ID NO: 578231 - RNA, 19 nt, Homo sapiens
cgccguggcuucauucaca

SEQ ID NO: 578232 - RNA, 19 nt, Homo sapiens
gaagauccuccacaagaaa

SEQ ID NO: 578233 - RNA, 19 nt, Homo sapiens
cagaagauccuccacaaga

SEQ ID NO: 578234 - RNA, 19 nt, Homo sapiens
gccagaagauccuccacaa

SEQ ID NO: 578235 - RNA, 19 nt, Homo sapiens
agaagauccuccacaagaa

SEQ ID NO: 578236 - RNA, 19 nt, Homo sapiens
aagggaaaguguacuggua

SEQ ID NO: 578237 - RNA, 19 nt, Homo sapiens
cgacuucugcuacgaauuc

SEQ ID NO: 578238 - RNA, 19 nt, Homo sapiens
caagaaagggaaaguguac

SEQ ID NO: 578239 - RNA, 19 nt, Homo sapiens
acaagaaagggaaagugua

SEQ ID NO: 578240 - RNA, 19 nt, Homo sapiens
cacaagaaagggaaagugu

SEQ ID NO: 578241 - RNA, 19 nt, Homo sapiens
gaggcgcaccugagcauca

SEQ ID NO: 578242 - RNA, 19 nt, Homo sapiens
cgcuacagcuggaagaaag

SEQ ID NO: 578243 - RNA, 19 nt, Homo sapiens
gcgcuacagcuggaagaaa

SEQ ID NO: 578244 - RNA, 19 nt, Homo sapiens
ccacaagaaagggaaagug

SEQ ID NO: 578245 - RNA, 19 nt, Homo sapiens
ucgccaacgccgucaauga

SEQ ID NO: 578246 - RNA, 19 nt, Homo sapiens
gaagauccuccacaagaaa

SEQ ID NO: 578247 - RNA, 19 nt, Homo sapiens
cagaagauccuccacaaga

SEQ ID NO: 578248 - RNA, 19 nt, Homo sapiens
gccagaagauccuccacaa

SEQ ID NO: 578249 - RNA, 19 nt, Homo sapiens
agaagauccuccacaagaa

SEQ ID NO: 578250 - RNA, 19 nt, Homo sapiens
aagggaaaguguacuggua

SEQ ID NO: 578251 - RNA, 19 nt, Homo sapiens
cgacuucugcuacgaauuc

SEQ ID NO: 578252 - RNA, 19 nt, Homo sapiens
caagaaagggaaaguguac

SEQ ID NO: 578253 - RNA, 19 nt, Homo sapiens
acaagaaagggaaagugua

SEQ ID NO: 578254 - RNA, 19 nt, Homo sapiens
cacaagaaagggaaagugu

SEQ ID NO: 578255 - RNA, 19 nt, Homo sapiens
gaggcgcaccugagcauca

SEQ ID NO: 578256 - RNA, 19 nt, Homo sapiens
cgcuacagcuggaagaaag

SEQ ID NO: 578257 - RNA, 19 nt, Homo sapiens
gcgcuacagcuggaagaaa

SEQ ID NO: 578258 - RNA, 19 nt, Homo sapiens
ccacaagaaagggaaagug

SEQ ID NO: 578259 - RNA, 19 nt, Homo sapiens
ucgccaacgccgucaauga

SEQ ID NO: 578260 - RNA, 19 nt, Homo sapiens
gaagaaacuuguacuauuc

SEQ ID NO: 578261 - RNA, 19 nt, Homo sapiens
ccagagaccuguuguguuu

SEQ ID NO: 578262 - RNA, 19 nt, Homo sapiens
gaagugacuaugaacauua

SEQ ID NO: 578263 - RNA, 19 nt, Homo sapiens
gaacauuagucagaugauu

SEQ ID NO: 578264 - RNA, 19 nt, Homo sapiens
gaagugugcucccgugaga

SEQ ID NO: 578265 - RNA, 19 nt, Homo sapiens
ccacacaacuucuuugauc

SEQ ID NO: 578266 - RNA, 19 nt, Homo sapiens
caacagccuugccuucauu

SEQ ID NO: 578267 - RNA, 19 nt, Homo sapiens
cagcaaugccuuauuuaua

SEQ ID NO: 578268 - RNA, 19 nt, Homo sapiens
gacugaagaugguuauauu

SEQ ID NO: 578269 - RNA, 19 nt, Homo sapiens
cgacuucauuguaaagaaa

SEQ ID NO: 578270 - RNA, 19 nt, Homo sapiens
ugaagaauaugaaguugug

SEQ ID NO: 578271 - RNA, 19 nt, Homo sapiens
caaucccucuucaaguuua

SEQ ID NO: 578272 - RNA, 19 nt, Homo sapiens
aauaugaaguugugacuga

SEQ ID NO: 578273 - RNA, 19 nt, Homo sapiens
gacuacacaugguuuguuu

SEQ ID NO: 578274 - RNA, 19 nt, Homo sapiens
agaagcagcuacacuaugu

SEQ ID NO: 578275 - RNA, 19 nt, Homo sapiens
cucaagaaguuuacaauga

SEQ ID NO: 578276 - RNA, 19 nt, Homo sapiens
acacaugguuuguuuggaa

SEQ ID NO: 578277 - RNA, 19 nt, Homo sapiens
gacagaagcagcuacacua

SEQ ID NO: 578278 - RNA, 19 nt, Homo sapiens
caaccucccuacuacaaug

SEQ ID NO: 578279 - RNA, 19 nt, Homo sapiens
ucaauagaauuccuuaugg

SEQ ID NO: 578280 - RNA, 19 nt, Homo sapiens
gaagcccaguucagaauag

SEQ ID NO: 578281 - RNA, 19 nt, Homo sapiens
ccaaaacuccccaaucuua

SEQ ID NO: 578282 - RNA, 19 nt, Homo sapiens
gcccugaagugacuaugaa

SEQ ID NO: 578283 - RNA, 19 nt, Homo sapiens
gcagugcuucuuucuguaa

SEQ ID NO: 578284 - RNA, 19 nt, Homo sapiens
gcagcaaugccuuauuuau

SEQ ID NO: 578285 - RNA, 19 nt, Homo sapiens
ugaaauggcuaaauaugac

SEQ ID NO: 578286 - RNA, 19 nt, Homo sapiens
gaugaaauggcuaaauaug

SEQ ID NO: 578287 - RNA, 19 nt, Homo sapiens
ggaagcccaguucagaaua

SEQ ID NO: 578288 - RNA, 19 nt, Homo sapiens
gucagaugauuacuuauug

SEQ ID NO: 578289 - RNA, 19 nt, Homo sapiens
ugaagugacuaugaacauu

SEQ ID NO: 578290 - RNA, 19 nt, Homo sapiens
gugcuucuuucuguaauuu

SEQ ID NO: 578291 - RNA, 19 nt, Homo sapiens
ugacaugcagugcuucuuu

SEQ ID NO: 578292 - RNA, 19 nt, Homo sapiens
caagaaguuuacaaugaca

SEQ ID NO: 578293 - RNA, 19 nt, Homo sapiens
gacccaggcuguuaagucu

SEQ ID NO: 578294 - RNA, 19 nt, Homo sapiens
uaacacgagucgcuuggau

SEQ ID NO: 578295 - RNA, 19 nt, Homo sapiens
cucaaucccucuucaaguu

SEQ ID NO: 578296 - RNA, 19 nt, Homo sapiens
gacaugcagugcuucuuuc

SEQ ID NO: 578297 - RNA, 19 nt, Homo sapiens
ucaagaaguuuacaaugac

SEQ ID NO: 578298 - RNA, 19 nt, Homo sapiens
auucugggcuuucagcuuu

SEQ ID NO: 578299 - RNA, 19 nt, Homo sapiens
ccagaagaaacuuguacua

SEQ ID NO: 578300 - RNA, 19 nt, Homo sapiens
cagaagaaacuuguacuau

SEQ ID NO: 578301 - RNA, 19 nt, Homo sapiens
ggacuacacaugguuuguu

SEQ ID NO: 578302 - RNA, 19 nt, Homo sapiens
gcuguuaagucugggaaau

SEQ ID NO: 578303 - RNA, 19 nt, Homo sapiens
guguaucuaucacauaauc

SEQ ID NO: 578304 - RNA, 19 nt, Homo sapiens
acagaauccuaacuauuuc

SEQ ID NO: 578305 - RNA, 19 nt, Homo sapiens
ggcagaugcugguuaugau

SEQ ID NO: 578306 - RNA, 19 nt, Homo sapiens
aacaauggcaaguuugaua

SEQ ID NO: 578307 - RNA, 19 nt, Homo sapiens
gucaauagaauuccuuaug

SEQ ID NO: 578308 - RNA, 19 nt, Homo sapiens
gauacccaaaugaagaaua

SEQ ID NO: 578309 - RNA, 19 nt, Homo sapiens
ggacccaggcuguuaaguc

SEQ ID NO: 578310 - RNA, 19 nt, Homo sapiens
ccacugugaaguauacaaa

SEQ ID NO: 578311 - RNA, 19 nt, Homo sapiens
ggacagaagcagcuacacu

SEQ ID NO: 578312 - RNA, 19 nt, Homo sapiens
aaagaaaacuggacagaag

SEQ ID NO: 578313 - RNA, 19 nt, Homo sapiens
gacuuuaucugggcaaugg

SEQ ID NO: 578314 - RNA, 19 nt, Homo sapiens
ccaaucuuauuuaccacaa

SEQ ID NO: 578315 - RNA, 19 nt, Homo sapiens
gggaagcccaguucagaau

SEQ ID NO: 578316 - RNA, 19 nt, Homo sapiens
gaagucaauagaauuccuu

SEQ ID NO: 578317 - RNA, 19 nt, Homo sapiens
gggauacccaaaugaagaa

SEQ ID NO: 578318 - RNA, 19 nt, Homo sapiens
agccaugaauguaccaauu

SEQ ID NO: 578319 - RNA, 19 nt, Homo sapiens
guacuauucaccagauuca

SEQ ID NO: 578320 - RNA, 19 nt, Homo sapiens
gcagaugcugguuaugaug

SEQ ID NO: 578321 - RNA, 19 nt, Homo sapiens
ugacugaagaugguuauau

SEQ ID NO: 578322 - RNA, 19 nt, Homo sapiens
gcuuggauguguaucuauc

SEQ ID NO: 578323 - RNA, 19 nt, Homo sapiens
gauuugacaguaagaacuu

SEQ ID NO: 578324 - RNA, 19 nt, Homo sapiens
cacaugguuuguuuggaaa

SEQ ID NO: 578325 - RNA, 19 nt, Homo sapiens
gccaugaauguaccaauug

SEQ ID NO: 578326 - RNA, 19 nt, Homo sapiens
gaaauuccaagcuuaugac

SEQ ID NO: 578327 - RNA, 19 nt, Homo sapiens
uggcaaguuugauaucugu

SEQ ID NO: 578328 - RNA, 19 nt, Homo sapiens
ucgcuuggauguguaucua

SEQ ID NO: 578329 - RNA, 19 nt, Homo sapiens
cacacaacuucuuugauca

SEQ ID NO: 578330 - RNA, 19 nt, Homo sapiens
gaaguugugacugaagaug

SEQ ID NO: 578331 - RNA, 19 nt, Homo sapiens
guaguucuggauuuaaaga

SEQ ID NO: 578332 - RNA, 19 nt, Homo sapiens
ucaauuucuugcuacugaa

SEQ ID NO: 578333 - RNA, 19 nt, Homo sapiens
uuuccaaccugccgaacaa

SEQ ID NO: 578334 - RNA, 19 nt, Homo sapiens
augcagugcuucuuucugu

SEQ ID NO: 578335 - RNA, 19 nt, Homo sapiens
uguuaagucugggaaauuc

SEQ ID NO: 578336 - RNA, 19 nt, Homo sapiens
cgagucgcuuggaugugua

SEQ ID NO: 578337 - RNA, 19 nt, Homo sapiens
gacaguaagaacuuuaaca

SEQ ID NO: 578338 - RNA, 19 nt, Homo sapiens
ucaaucccucuucaaguuu

SEQ ID NO: 578339 - RNA, 19 nt, Homo sapiens
uggcagaugcugguuauga

SEQ ID NO: 578340 - RNA, 19 nt, Homo sapiens
uaugaacauuagucagaug

SEQ ID NO: 578341 - RNA, 19 nt, Homo sapiens
ucacauaauccagcaggaa

SEQ ID NO: 578342 - RNA, 19 nt, Homo sapiens
ucagaugauuacuuauugg

SEQ ID NO: 578343 - RNA, 19 nt, Homo sapiens
ccuggaagcccugaaguga

SEQ ID NO: 578344 - RNA, 19 nt, Homo sapiens
uggaagcccugaagugacu

SEQ ID NO: 578345 - RNA, 19 nt, Homo sapiens
caaugugacagccaugaau

SEQ ID NO: 578346 - RNA, 19 nt, Homo sapiens
aucaauuucuugcuacuga

SEQ ID NO: 578347 - RNA, 19 nt, Homo sapiens
cagaagcagcuacacuaug

SEQ ID NO: 578348 - RNA, 19 nt, Homo sapiens
ggccagagaccuguugugu

SEQ ID NO: 578349 - RNA, 19 nt, Homo sapiens
gcaaguuugauaucuguac

SEQ ID NO: 578350 - RNA, 19 nt, Homo sapiens
ggaugccccucaagaaguu

SEQ ID NO: 578351 - RNA, 19 nt, Homo sapiens
uuaacaauggcaaguuuga

SEQ ID NO: 578352 - RNA, 19 nt, Homo sapiens
gucccaaccucccuacuac

SEQ ID NO: 578353 - RNA, 19 nt, Homo sapiens
cauuggacccaggcuguua

SEQ ID NO: 578354 - RNA, 19 nt, Homo sapiens
acaauggcaaguuugauau

SEQ ID NO: 578355 - RNA, 19 nt, Homo sapiens
gaauccuaacuauuucuga

SEQ ID NO: 578356 - RNA, 19 nt, Homo sapiens
ccaaaugaagaauaugaag

SEQ ID NO: 578357 - RNA, 19 nt, Homo sapiens
caaguuugauaucuguacu

SEQ ID NO: 578358 - RNA, 19 nt, Homo sapiens
uuuguggauuugacaguaa

SEQ ID NO: 578359 - RNA, 19 nt, Homo sapiens
ggaaacugcagguccaaaa

SEQ ID NO: 578360 - RNA, 19 nt, Homo sapiens
ggaaggcacugguuaggaa

SEQ ID NO: 578361 - RNA, 19 nt, Homo sapiens
gagcaagucuggauaagug

SEQ ID NO: 578362 - RNA, 19 nt, Homo sapiens
gggaucagcuucugcuauu

SEQ ID NO: 578363 - RNA, 19 nt, Homo sapiens
ggaaacaucauuaagaaga

SEQ ID NO: 578364 - RNA, 19 nt, Homo sapiens
gcaauaaacccuacagcaa

SEQ ID NO: 578365 - RNA, 19 nt, Homo sapiens
aaagacagcuccaguuuua

SEQ ID NO: 578366 - RNA, 19 nt, Homo sapiens
guacguggaugugguguuu

SEQ ID NO: 578367 - RNA, 19 nt, Homo sapiens
gggauugacucugcaguuu

SEQ ID NO: 578368 - RNA, 19 nt, Homo sapiens
caauaaacccuacagcaaa

SEQ ID NO: 578369 - RNA, 19 nt, Homo sapiens
gcaccucuguucccgcuuu

SEQ ID NO: 578370 - RNA, 19 nt, Homo sapiens
guacugggaaacaucauua

SEQ ID NO: 578371 - RNA, 19 nt, Homo sapiens
gcccaaagauuuccaaggu

SEQ ID NO: 578372 - RNA, 19 nt, Homo sapiens
ggaaggcccuguggucaug

SEQ ID NO: 578373 - RNA, 19 nt, Homo sapiens
gaagccaagugaagagugu

SEQ ID NO: 578374 - RNA, 19 nt, Homo sapiens
ugggaaacaucauuaagaa

SEQ ID NO: 578375 - RNA, 19 nt, Homo sapiens
gaggccagaucaccgauga

SEQ ID NO: 578376 - RNA, 19 nt, Homo sapiens
ggaucagcuucugcuauua

SEQ ID NO: 578377 - RNA, 19 nt, Homo sapiens
gcgcaugcuuggacccuuu

SEQ ID NO: 578378 - RNA, 19 nt, Homo sapiens
ccacgagauugauaguauu

SEQ ID NO: 578379 - RNA, 19 nt, Homo sapiens
gaaccucucccuggaaaga

SEQ ID NO: 578380 - RNA, 19 nt, Homo sapiens
gcuuggacccuuucaguaa

SEQ ID NO: 578381 - RNA, 19 nt, Homo sapiens
cagccaagauucccaaagu

SEQ ID NO: 578382 - RNA, 19 nt, Homo sapiens
gaucuacaguacucgguau

SEQ ID NO: 578383 - RNA, 19 nt, Homo sapiens
agucaaggcccaaagauuu

SEQ ID NO: 578384 - RNA, 19 nt, Homo sapiens
gaccuuggccuaugauaau

SEQ ID NO: 578385 - RNA, 19 nt, Homo sapiens
gggaugaucuacaguacuc

SEQ ID NO: 578386 - RNA, 19 nt, Homo sapiens
cauaaucgaaggucugaaa

SEQ ID NO: 578387 - RNA, 19 nt, Homo sapiens
ccagaucaccgaugagaug

SEQ ID NO: 578388 - RNA, 19 nt, Homo sapiens
gaagcagcccugugagugu

SEQ ID NO: 578389 - RNA, 19 nt, Homo sapiens
gauugacucugcaguuugg

SEQ ID NO: 578390 - RNA, 19 nt, Homo sapiens
caaagucaaggcccaaaga

SEQ ID NO: 578391 - RNA, 19 nt, Homo sapiens
ggaaaugaucucccaaguc

SEQ ID NO: 578392 - RNA, 19 nt, Homo sapiens
cggaccagcucauggagaa

SEQ ID NO: 578393 - RNA, 19 nt, Homo sapiens
gaggcuggcuccauguauc

SEQ ID NO: 578394 - RNA, 19 nt, Homo sapiens
ggaagggucuuugggguuu

SEQ ID NO: 578395 - RNA, 19 nt, Homo sapiens
ggagcuguuccacaagaua

SEQ ID NO: 578396 - RNA, 19 nt, Homo sapiens
caaaagacagcuccaguuu

SEQ ID NO: 578397 - RNA, 19 nt, Homo sapiens
guagcggugugauuucuag

SEQ ID NO: 578398 - RNA, 19 nt, Homo sapiens
uccacgagauugauaguau

SEQ ID NO: 578399 - RNA, 19 nt, Homo sapiens
ugccggagcuguuccacaa

SEQ ID NO: 578400 - RNA, 19 nt, Homo sapiens
gagugugguuugcauccaa

SEQ ID NO: 578401 - RNA, 19 nt, Homo sapiens
ccaggaagcacauaaucga

SEQ ID NO: 578402 - RNA, 19 nt, Homo sapiens
uccaagggcuccaggaauc

SEQ ID NO: 578403 - RNA, 19 nt, Homo sapiens
gaagugguacugggaaaca

SEQ ID NO: 578404 - RNA, 19 nt, Homo sapiens
gcaggacaggccagaguga

SEQ ID NO: 578405 - RNA, 19 nt, Homo sapiens
aagcguagcggugugauuu

SEQ ID NO: 578406 - RNA, 19 nt, Homo sapiens
ggauugacucugcaguuug

SEQ ID NO: 578407 - RNA, 19 nt, Homo sapiens
ugaagagugugguuugcau

SEQ ID NO: 578408 - RNA, 19 nt, Homo sapiens
ccuggugccugaggaauga

SEQ ID NO: 578409 - RNA, 19 nt, Homo sapiens
caagugaagagugugguuu

SEQ ID NO: 578410 - RNA, 19 nt, Homo sapiens
ugaccuuggccuaugauaa

SEQ ID NO: 578411 - RNA, 19 nt, Homo sapiens
gaucagcuucugcuauuac

SEQ ID NO: 578412 - RNA, 19 nt, Homo sapiens
cuccauguauccagaauca

SEQ ID NO: 578413 - RNA, 19 nt, Homo sapiens
ccucuggccuguggcauug

SEQ ID NO: 578414 - RNA, 19 nt, Homo sapiens
ccggagcuguuccacaaga

SEQ ID NO: 578415 - RNA, 19 nt, Homo sapiens
gcucaugaccuuggccuau

SEQ ID NO: 578416 - RNA, 19 nt, Homo sapiens
gccaaggccugggaaacug

SEQ ID NO: 578417 - RNA, 19 nt, Homo sapiens
gccaagauucccaaaguca

SEQ ID NO: 578418 - RNA, 19 nt, Homo sapiens
uaggaaggauguucaaacg

SEQ ID NO: 578419 - RNA, 19 nt, Homo sapiens
ggccuugucuccggucguu

SEQ ID NO: 578420 - RNA, 19 nt, Homo sapiens
cccaaagauuuccaagguu

SEQ ID NO: 578421 - RNA, 19 nt, Homo sapiens
gacugcagcuggaguacgu

SEQ ID NO: 578422 - RNA, 19 nt, Homo sapiens
caguuuccguucccuccua

SEQ ID NO: 578423 - RNA, 19 nt, Homo sapiens
gcugccugcuucaccagaa

SEQ ID NO: 578424 - RNA, 19 nt, Homo sapiens
gcaagggaugccaguaagu

SEQ ID NO: 578425 - RNA, 19 nt, Homo sapiens
uuuccaagguucccaaagu

SEQ ID NO: 578426 - RNA, 19 nt, Homo sapiens
aauaaacccuacagcaaaa

SEQ ID NO: 578427 - RNA, 19 nt, Homo sapiens
cgagauugauaguauuuug

SEQ ID NO: 578428 - RNA, 19 nt, Homo sapiens
cacgagauugauaguauuu

SEQ ID NO: 578429 - RNA, 19 nt, Homo sapiens
gagcuguuccacaagauag

SEQ ID NO: 578430 - RNA, 19 nt, Homo sapiens
caagauucccaaagucaag

SEQ ID NO: 578431 - RNA, 19 nt, Homo sapiens
aaacugugaaagucagaaa

SEQ ID NO: 578432 - RNA, 19 nt, Homo sapiens
ccaagauucccaaagucaa

SEQ ID NO: 578433 - RNA, 19 nt, Homo sapiens
uccaagaccacccagcuuu

SEQ ID NO: 578434 - RNA, 19 nt, Homo sapiens
accaguggcugaaggacaa

SEQ ID NO: 578435 - RNA, 19 nt, Homo sapiens
caucccacccuacucaaga

SEQ ID NO: 578436 - RNA, 19 nt, Homo sapiens
ccaaggcgcgugcuuugca

SEQ ID NO: 578437 - RNA, 19 nt, Homo sapiens
gcaguacccaggcuuugca

SEQ ID NO: 578438 - RNA, 19 nt, Homo sapiens
agacgggcagggcugguua

SEQ ID NO: 578439 - RNA, 19 nt, Homo sapiens
ggccagaucaccgaugaga

SEQ ID NO: 578440 - RNA, 19 nt, Homo sapiens
cugcuucgccggacaaugu

SEQ ID NO: 578441 - RNA, 19 nt, Homo sapiens
cugggaaacaucauuaaga

SEQ ID NO: 578442 - RNA, 19 nt, Homo sapiens
gaaacugugaaagucagaa

SEQ ID NO: 578443 - RNA, 19 nt, Homo sapiens
ggaaacugugaaagucaga

SEQ ID NO: 578444 - RNA, 19 nt, Homo sapiens
ucaguaaggaagggucuuu

SEQ ID NO: 578445 - RNA, 19 nt, Homo sapiens
auaauggcaucaaccucuu

SEQ ID NO: 578446 - RNA, 19 nt, Homo sapiens
ccaagaccacccagcuuuc

SEQ ID NO: 578447 - RNA, 19 nt, Homo sapiens
caagggaugccaguaaguc

SEQ ID NO: 578448 - RNA, 19 nt, Homo sapiens
ccaagguucccaaagucaa

SEQ ID NO: 578449 - RNA, 19 nt, Homo sapiens
aaaccgagcaagucuggau

SEQ ID NO: 578450 - RNA, 19 nt, Homo sapiens
cugaagugguacugggaaa

SEQ ID NO: 578451 - RNA, 19 nt, Homo sapiens
gggaaggcacugguuagga

SEQ ID NO: 578452 - RNA, 19 nt, Homo sapiens
ucuguucgcucgcuuaagc

SEQ ID NO: 578453 - RNA, 19 nt, Homo sapiens
gguacugggaaacaucauu

SEQ ID NO: 578454 - RNA, 19 nt, Homo sapiens
gccugugucccaagcagua

SEQ ID NO: 578455 - RNA, 19 nt, Homo sapiens
gcguagcggugugauuucu

SEQ ID NO: 578456 - RNA, 19 nt, Homo sapiens
aaucgaaggucugaaagcu

SEQ ID NO: 578457 - RNA, 19 nt, Homo sapiens
gucaaggcccaaagauuuc

SEQ ID NO: 578458 - RNA, 19 nt, Homo sapiens
caggaagcacauaaucgaa

SEQ ID NO: 578459 - RNA, 19 nt, Homo sapiens
ccguucaggagcagaauuu

SEQ ID NO: 578460 - RNA, 19 nt, Homo sapiens
ggaaggcacugguuaggaa

SEQ ID NO: 578461 - RNA, 19 nt, Homo sapiens
gagcaagucuggauaagug

SEQ ID NO: 578462 - RNA, 19 nt, Homo sapiens
gggaucagcuucugcuauu

SEQ ID NO: 578463 - RNA, 19 nt, Homo sapiens
ggaaacaucauuaagaaga

SEQ ID NO: 578464 - RNA, 19 nt, Homo sapiens
gcaauaaacccuacagcaa

SEQ ID NO: 578465 - RNA, 19 nt, Homo sapiens
guacguggaugugguguuu

SEQ ID NO: 578466 - RNA, 19 nt, Homo sapiens
gggauugacucugcaguuu

SEQ ID NO: 578467 - RNA, 19 nt, Homo sapiens
caauaaacccuacagcaaa

SEQ ID NO: 578468 - RNA, 19 nt, Homo sapiens
gcaccucuguucccgcuuu

SEQ ID NO: 578469 - RNA, 19 nt, Homo sapiens
guacugggaaacaucauua

SEQ ID NO: 578470 - RNA, 19 nt, Homo sapiens
gcccaaagauuuccaaggu

SEQ ID NO: 578471 - RNA, 19 nt, Homo sapiens
ggaaggcccuguggucaug

SEQ ID NO: 578472 - RNA, 19 nt, Homo sapiens
gaagccaagugaagagugu

SEQ ID NO: 578473 - RNA, 19 nt, Homo sapiens
ugggaaacaucauuaagaa

SEQ ID NO: 578474 - RNA, 19 nt, Homo sapiens
gaggccagaucaccgauga

SEQ ID NO: 578475 - RNA, 19 nt, Homo sapiens
ggaucagcuucugcuauua

SEQ ID NO: 578476 - RNA, 19 nt, Homo sapiens
gcgcaugcuuggacccuuu

SEQ ID NO: 578477 - RNA, 19 nt, Homo sapiens
ccacgagauugauaguauu

SEQ ID NO: 578478 - RNA, 19 nt, Homo sapiens
gaaccucucccuggaaaga

SEQ ID NO: 578479 - RNA, 19 nt, Homo sapiens
gcuuggacccuuucaguaa

SEQ ID NO: 578480 - RNA, 19 nt, Homo sapiens
cagccaagauucccaaagu

SEQ ID NO: 578481 - RNA, 19 nt, Homo sapiens
agucaaggcccaaagauuu

SEQ ID NO: 578482 - RNA, 19 nt, Homo sapiens
gaccuuggccuaugauaau

SEQ ID NO: 578483 - RNA, 19 nt, Homo sapiens
cauaaucgaaggucugaaa

SEQ ID NO: 578484 - RNA, 19 nt, Homo sapiens
ccagaucaccgaugagaug

SEQ ID NO: 578485 - RNA, 19 nt, Homo sapiens
gaagcagcccugugagugu

SEQ ID NO: 578486 - RNA, 19 nt, Homo sapiens
gauugacucugcaguuugg

SEQ ID NO: 578487 - RNA, 19 nt, Homo sapiens
caaagucaaggcccaaaga

SEQ ID NO: 578488 - RNA, 19 nt, Homo sapiens
ggaaaugaucucccaaguc

SEQ ID NO: 578489 - RNA, 19 nt, Homo sapiens
cggaccagcucauggagaa

SEQ ID NO: 578490 - RNA, 19 nt, Homo sapiens
gaggcuggcuccauguauc

SEQ ID NO: 578491 - RNA, 19 nt, Homo sapiens
ggaagggucuuugggguuu

SEQ ID NO: 578492 - RNA, 19 nt, Homo sapiens
ggagcuguuccacaagaua

SEQ ID NO: 578493 - RNA, 19 nt, Homo sapiens
guagcggugugauuucuag

SEQ ID NO: 578494 - RNA, 19 nt, Homo sapiens
uccacgagauugauaguau

SEQ ID NO: 578495 - RNA, 19 nt, Homo sapiens
ugccggagcuguuccacaa

SEQ ID NO: 578496 - RNA, 19 nt, Homo sapiens
gagugugguuugcauccaa

SEQ ID NO: 578497 - RNA, 19 nt, Homo sapiens
ccaggaagcacauaaucga

SEQ ID NO: 578498 - RNA, 19 nt, Homo sapiens
uccaagggcuccaggaauc

SEQ ID NO: 578499 - RNA, 19 nt, Homo sapiens
gaagugguacugggaaaca

SEQ ID NO: 578500 - RNA, 19 nt, Homo sapiens
gcaggacaggccagaguga

SEQ ID NO: 578501 - RNA, 19 nt, Homo sapiens
aagcguagcggugugauuu

SEQ ID NO: 578502 - RNA, 19 nt, Homo sapiens
ggauugacucugcaguuug

SEQ ID NO: 578503 - RNA, 19 nt, Homo sapiens
ugaagagugugguuugcau

SEQ ID NO: 578504 - RNA, 19 nt, Homo sapiens
ccuggugccugaggaauga

SEQ ID NO: 578505 - RNA, 19 nt, Homo sapiens
caagugaagagugugguuu

SEQ ID NO: 578506 - RNA, 19 nt, Homo sapiens
ugaccuuggccuaugauaa

SEQ ID NO: 578507 - RNA, 19 nt, Homo sapiens
gaucagcuucugcuauuac

SEQ ID NO: 578508 - RNA, 19 nt, Homo sapiens
cuccauguauccagaauca

SEQ ID NO: 578509 - RNA, 19 nt, Homo sapiens
ccucuggccuguggcauug

SEQ ID NO: 578510 - RNA, 19 nt, Homo sapiens
ccggagcuguuccacaaga

SEQ ID NO: 578511 - RNA, 19 nt, Homo sapiens
gcucaugaccuuggccuau

SEQ ID NO: 578512 - RNA, 19 nt, Homo sapiens
gccaaggccugggaaacug

SEQ ID NO: 578513 - RNA, 19 nt, Homo sapiens
gccaagauucccaaaguca

SEQ ID NO: 578514 - RNA, 19 nt, Homo sapiens
uaggaaggauguucaaacg

SEQ ID NO: 578515 - RNA, 19 nt, Homo sapiens
ggccuugucuccggucguu

SEQ ID NO: 578516 - RNA, 19 nt, Homo sapiens
cccaaagauuuccaagguu

SEQ ID NO: 578517 - RNA, 19 nt, Homo sapiens
gacugcagcuggaguacgu

SEQ ID NO: 578518 - RNA, 19 nt, Homo sapiens
caguuuccguucccuccua

SEQ ID NO: 578519 - RNA, 19 nt, Homo sapiens
gcugccugcuucaccagaa

SEQ ID NO: 578520 - RNA, 19 nt, Homo sapiens
gcaagggaugccaguaagu

SEQ ID NO: 578521 - RNA, 19 nt, Homo sapiens
uuuccaagguucccaaagu

SEQ ID NO: 578522 - RNA, 19 nt, Homo sapiens
aauaaacccuacagcaaaa

SEQ ID NO: 578523 - RNA, 19 nt, Homo sapiens
cgagauugauaguauuuug

SEQ ID NO: 578524 - RNA, 19 nt, Homo sapiens
cacgagauugauaguauuu

SEQ ID NO: 578525 - RNA, 19 nt, Homo sapiens
gagcuguuccacaagauag

SEQ ID NO: 578526 - RNA, 19 nt, Homo sapiens
caagauucccaaagucaag

SEQ ID NO: 578527 - RNA, 19 nt, Homo sapiens
aaacugugaaagucagaaa

SEQ ID NO: 578528 - RNA, 19 nt, Homo sapiens
ccaagauucccaaagucaa

SEQ ID NO: 578529 - RNA, 19 nt, Homo sapiens
uccaagaccacccagcuuu

SEQ ID NO: 578530 - RNA, 19 nt, Homo sapiens
accaguggcugaaggacaa

SEQ ID NO: 578531 - RNA, 19 nt, Homo sapiens
caucccacccuacucaaga

SEQ ID NO: 578532 - RNA, 19 nt, Homo sapiens
ccaaggcgcgugcuuugca

SEQ ID NO: 578533 - RNA, 19 nt, Homo sapiens
gcaguacccaggcuuugca

SEQ ID NO: 578534 - RNA, 19 nt, Homo sapiens
ggccagaucaccgaugaga

SEQ ID NO: 578535 - RNA, 19 nt, Homo sapiens
agacgggcagggcugguua

SEQ ID NO: 578536 - RNA, 19 nt, Homo sapiens
cugcuucgccggacaaugu

SEQ ID NO: 578537 - RNA, 19 nt, Homo sapiens
ccgggaugaucuacaggaa

SEQ ID NO: 578538 - RNA, 19 nt, Homo sapiens
cugggaaacaucauuaaga

SEQ ID NO: 578539 - RNA, 19 nt, Homo sapiens
gaaacugugaaagucagaa

SEQ ID NO: 578540 - RNA, 19 nt, Homo sapiens
ggaaacugugaaagucaga

SEQ ID NO: 578541 - RNA, 19 nt, Homo sapiens
ucaguaaggaagggucuuu

SEQ ID NO: 578542 - RNA, 19 nt, Homo sapiens
ccaagaccacccagcuuuc

SEQ ID NO: 578543 - RNA, 19 nt, Homo sapiens
auaauggcaucaaccucuu

SEQ ID NO: 578544 - RNA, 19 nt, Homo sapiens
caagggaugccaguaaguc

SEQ ID NO: 578545 - RNA, 19 nt, Homo sapiens
ccaagguucccaaagucaa

SEQ ID NO: 578546 - RNA, 19 nt, Homo sapiens
gggaaggcacugguuagga

SEQ ID NO: 578547 - RNA, 19 nt, Homo sapiens
cugaagugguacugggaaa

SEQ ID NO: 578548 - RNA, 19 nt, Homo sapiens
ucuguucgcucgcuuaagc

SEQ ID NO: 578549 - RNA, 19 nt, Homo sapiens
gguacugggaaacaucauu

SEQ ID NO: 578550 - RNA, 19 nt, Homo sapiens
aaaccgagcaagucuggau

SEQ ID NO: 578551 - RNA, 19 nt, Homo sapiens
gccugugucccaagcagua

SEQ ID NO: 578552 - RNA, 19 nt, Homo sapiens
gcguagcggugugauuucu

SEQ ID NO: 578553 - RNA, 19 nt, Homo sapiens
aaucgaaggucugaaagcu

SEQ ID NO: 578554 - RNA, 19 nt, Homo sapiens
gucaaggcccaaagauuuc

SEQ ID NO: 578555 - RNA, 19 nt, Homo sapiens
caggaagcacauaaucgaa

SEQ ID NO: 578556 - RNA, 19 nt, Homo sapiens
ccguucaggagcagaauuu

SEQ ID NO: 578557 - RNA, 19 nt, Homo sapiens
cauuguuucuggcaaguac

SEQ ID NO: 578558 - RNA, 19 nt, Homo sapiens
gcagauugguucauacuuu

SEQ ID NO: 578559 - RNA, 19 nt, Homo sapiens
gaauaagggucuagaaagu

SEQ ID NO: 578560 - RNA, 19 nt, Homo sapiens
uggaacaacugaugucuua

SEQ ID NO: 578561 - RNA, 19 nt, Homo sapiens
ggaaagugcugguaucuac

SEQ ID NO: 578562 - RNA, 19 nt, Homo sapiens
gaucaccaauucuacauga

SEQ ID NO: 578563 - RNA, 19 nt, Homo sapiens
gaacaucacccacgccuau

SEQ ID NO: 578564 - RNA, 19 nt, Homo sapiens
aagaagagcuggcaccaaa

SEQ ID NO: 578565 - RNA, 19 nt, Homo sapiens
guucagaccuuccuacgaa

SEQ ID NO: 578566 - RNA, 19 nt, Homo sapiens
caacugaugucuuacuugu

SEQ ID NO: 578567 - RNA, 19 nt, Homo sapiens
ccacuuaggugacuaccaa

SEQ ID NO: 578568 - RNA, 19 nt, Homo sapiens
gaagagaaguuggagcaau

SEQ ID NO: 578569 - RNA, 19 nt, Homo sapiens
ucacagaccuggugcuuca

SEQ ID NO: 578570 - RNA, 19 nt, Homo sapiens
gggagcagauugguucaua

SEQ ID NO: 578571 - RNA, 19 nt, Homo sapiens
gaugagcgauucuucuuca

SEQ ID NO: 578572 - RNA, 19 nt, Homo sapiens
gagcaaugaauguagaaua

SEQ ID NO: 578573 - RNA, 19 nt, Homo sapiens
gaaaaucccugaggaagaa

SEQ ID NO: 578574 - RNA, 19 nt, Homo sapiens
cagccuacauccaauauga

SEQ ID NO: 578575 - RNA, 19 nt, Homo sapiens
gagcgauucuucuucaaug

SEQ ID NO: 578576 - RNA, 19 nt, Homo sapiens
ggaaaugucucagauuggu

SEQ ID NO: 578577 - RNA, 19 nt, Homo sapiens
gaaauggcacccuucaaga

SEQ ID NO: 578578 - RNA, 19 nt, Homo sapiens
ucacccaccucuauacaaa

SEQ ID NO: 578579 - RNA, 19 nt, Homo sapiens
gcaauuacuuccuaucacu

SEQ ID NO: 578580 - RNA, 19 nt, Homo sapiens
gaaccuaggcugcuaugug

SEQ ID NO: 578581 - RNA, 19 nt, Homo sapiens
ggagagcccuguacaugag

SEQ ID NO: 578582 - RNA, 19 nt, Homo sapiens
gcacagaaggguucaguca

SEQ ID NO: 578583 - RNA, 19 nt, Homo sapiens
caagugaccucccguacuc

SEQ ID NO: 578584 - RNA, 19 nt, Homo sapiens
gaaguuggagcaaugaaug

SEQ ID NO: 578585 - RNA, 19 nt, Homo sapiens
ugaggucucuguuggacua

SEQ ID NO: 578586 - RNA, 19 nt, Homo sapiens
gcccuuugcuuccaaguga

SEQ ID NO: 578587 - RNA, 19 nt, Homo sapiens
gcacuaggagaucggauuu

SEQ ID NO: 578588 - RNA, 19 nt, Homo sapiens
ggcuagagaugaggcuuua

SEQ ID NO: 578589 - RNA, 19 nt, Homo sapiens
gaauuuggauacagugucu

SEQ ID NO: 578590 - RNA, 19 nt, Homo sapiens
cagauugguucauacuuug

SEQ ID NO: 578591 - RNA, 19 nt, Homo sapiens
uuagaacuauugccaguga

SEQ ID NO: 578592 - RNA, 19 nt, Homo sapiens
ugucucaagucaucacuaa

SEQ ID NO: 578593 - RNA, 19 nt, Homo sapiens
gcuaaaggaugggauucuu

SEQ ID NO: 578594 - RNA, 19 nt, Homo sapiens
gcccaacgcugcccaacau

SEQ ID NO: 578595 - RNA, 19 nt, Homo sapiens
ggagcuuccugcagcacua

SEQ ID NO: 578596 - RNA, 19 nt, Homo sapiens
aaagacugcccaagcaaua

SEQ ID NO: 578597 - RNA, 19 nt, Homo sapiens
gcagcucugucuucaguuc

SEQ ID NO: 578598 - RNA, 19 nt, Homo sapiens
gaaggaagaaguggugaga

SEQ ID NO: 578599 - RNA, 19 nt, Homo sapiens
gauacagugucuuacaaca

SEQ ID NO: 578600 - RNA, 19 nt, Homo sapiens
ucagagagagagcccaaua

SEQ ID NO: 578601 - RNA, 19 nt, Homo sapiens
caugggagcucuuccugau

SEQ ID NO: 578602 - RNA, 19 nt, Homo sapiens
gagcucugcccauuggaua

SEQ ID NO: 578603 - RNA, 19 nt, Homo sapiens
guucauacuuuggcaguga

SEQ ID NO: 578604 - RNA, 19 nt, Homo sapiens
gucaucgccuuccagcuua

SEQ ID NO: 578605 - RNA, 19 nt, Homo sapiens
gugacagccuggagagaaa

SEQ ID NO: 578606 - RNA, 19 nt, Homo sapiens
cuacaacucuggagaacag

SEQ ID NO: 578607 - RNA, 19 nt, Homo sapiens
cuggaaaugucucagauug

SEQ ID NO: 578608 - RNA, 19 nt, Homo sapiens
gggagagcccuguacauga

SEQ ID NO: 578609 - RNA, 19 nt, Homo sapiens
ggaugcugcuggcuagaga

SEQ ID NO: 578610 - RNA, 19 nt, Homo sapiens
aagagaaguuggagcaaug

SEQ ID NO: 578611 - RNA, 19 nt, Homo sapiens
uacagugucuuacaacaug

SEQ ID NO: 578612 - RNA, 19 nt, Homo sapiens
guuuaucgcugcccuguag

SEQ ID NO: 578613 - RNA, 19 nt, Homo sapiens
gaagccgccucuggacuau

SEQ ID NO: 578614 - RNA, 19 nt, Homo sapiens
caaugaauguagaauaagg

SEQ ID NO: 578615 - RNA, 19 nt, Homo sapiens
caacacacaaacagacuga

SEQ ID NO: 578616 - RNA, 19 nt, Homo sapiens
caagucaucacuaacaaug

SEQ ID NO: 578617 - RNA, 19 nt, Homo sapiens
caagaagcagucugucuga

SEQ ID NO: 578618 - RNA, 19 nt, Homo sapiens
gaacaacugaugucuuacu

SEQ ID NO: 578619 - RNA, 19 nt, Homo sapiens
gcuccucgauuuagacauc

SEQ ID NO: 578620 - RNA, 19 nt, Homo sapiens
ugucuucaguucugggaua

SEQ ID NO: 578621 - RNA, 19 nt, Homo sapiens
gaagagccaaguucaaguc

SEQ ID NO: 578622 - RNA, 19 nt, Homo sapiens
ggucucuguuggacuauug

SEQ ID NO: 578623 - RNA, 19 nt, Homo sapiens
agagagagcccaauaaagg

SEQ ID NO: 578624 - RNA, 19 nt, Homo sapiens
agagagagagcccaauaaa

SEQ ID NO: 578625 - RNA, 19 nt, Homo sapiens
ggccuugacugugaccuuu

SEQ ID NO: 578626 - RNA, 19 nt, Homo sapiens
gaagcugaauuuggauaca

SEQ ID NO: 578627 - RNA, 19 nt, Homo sapiens
gggcucagaugggacaaga

SEQ ID NO: 578628 - RNA, 19 nt, Homo sapiens
ggagcaauacucaguguca

SEQ ID NO: 578629 - RNA, 19 nt, Homo sapiens
gaccucagccuacauccaa

SEQ ID NO: 578630 - RNA, 19 nt, Homo sapiens
ucgcugggaucaccaauuc

SEQ ID NO: 578631 - RNA, 19 nt, Homo sapiens
caggacguguuuaugugua

SEQ ID NO: 578632 - RNA, 19 nt, Homo sapiens
ugaggcugguucacaauga

SEQ ID NO: 578633 - RNA, 19 nt, Homo sapiens
accagaagcugaauuugga

SEQ ID NO: 578634 - RNA, 19 nt, Homo sapiens
acagaaggguucagucagu

SEQ ID NO: 578635 - RNA, 19 nt, Homo sapiens
ugaccuuucugcuagaguu

SEQ ID NO: 578636 - RNA, 19 nt, Homo sapiens
gagccugaguaucaucuuc

SEQ ID NO: 578637 - RNA, 19 nt, Homo sapiens
gaaaaugcuuacaauacga

SEQ ID NO: 578638 - RNA, 19 nt, Homo sapiens
gcacgugcagcauuugaug

SEQ ID NO: 578639 - RNA, 19 nt, Homo sapiens
gcugggaucaccaauucua

SEQ ID NO: 578640 - RNA, 19 nt, Homo sapiens
gaaaggaaaaugcuuacaa

SEQ ID NO: 578641 - RNA, 19 nt, Homo sapiens
ggauacagauagggaugga

SEQ ID NO: 578642 - RNA, 19 nt, Homo sapiens
ccuuccagcuuaagaaaga

SEQ ID NO: 578643 - RNA, 19 nt, Homo sapiens
gggcucacccaccucuaua

SEQ ID NO: 578644 - RNA, 19 nt, Homo sapiens
ugaagggucccaugcagaa

SEQ ID NO: 578645 - RNA, 19 nt, Homo sapiens
uauugaggcugguucacaa

SEQ ID NO: 578646 - RNA, 19 nt, Homo sapiens
gggcaauuacuuccuauca

SEQ ID NO: 578647 - RNA, 19 nt, Homo sapiens
gagagagagcccaauaaag

SEQ ID NO: 578648 - RNA, 19 nt, Homo sapiens
cagagagagagcccaauaa

SEQ ID NO: 578649 - RNA, 19 nt, Homo sapiens
gggaggcucugugcuaugg

SEQ ID NO: 578650 - RNA, 19 nt, Homo sapiens
ccacucaucggcuaaagga

SEQ ID NO: 578651 - RNA, 19 nt, Homo sapiens
cauuguggaugcacuagga

SEQ ID NO: 578652 - RNA, 19 nt, Homo sapiens
ucccagcucuuuccugaga

SEQ ID NO: 578653 - RNA, 19 nt, Homo sapiens
ccuggcagcuuucuucaag

SEQ ID NO: 578654 - RNA, 19 nt, Homo sapiens
agacugaaugggagcaaua

SEQ ID NO: 578655 - RNA, 19 nt, Homo sapiens
ggaaaaugcuuacaauacg

SEQ ID NO: 578656 - RNA, 19 nt, Homo sapiens
gaccuggugcuucaaguga

SEQ ID NO: 578657 - RNA, 19 nt, Homo sapiens
agggagcacuguaccugua

SEQ ID NO: 578658 - RNA, 19 nt, Homo sapiens
ggaaaugccucacauauag

SEQ ID NO: 578659 - RNA, 19 nt, Homo sapiens
gcgaggagcuucugcauuu

SEQ ID NO: 578660 - RNA, 19 nt, Homo sapiens
ggacaaggccucugugaaa

SEQ ID NO: 578661 - RNA, 19 nt, Homo sapiens
gggagaagcuggccgagaa

SEQ ID NO: 578662 - RNA, 19 nt, Homo sapiens
gaaugcagcuggaagaucu

SEQ ID NO: 578663 - RNA, 19 nt, Homo sapiens
gcggcgagcuggacuguuu

SEQ ID NO: 578664 - RNA, 19 nt, Homo sapiens
ccagaccgauguguauuua

SEQ ID NO: 578665 - RNA, 19 nt, Homo sapiens
gcagauggcugaggacaag

SEQ ID NO: 578666 - RNA, 19 nt, Homo sapiens
aacaggaggugaucgauaa

SEQ ID NO: 578667 - RNA, 19 nt, Homo sapiens
ugggagugcugcccucuua

SEQ ID NO: 578668 - RNA, 19 nt, Homo sapiens
uggagaagcucgaucugaa

SEQ ID NO: 578669 - RNA, 19 nt, Homo sapiens
cggaaaugccucacauaua

SEQ ID NO: 578670 - RNA, 19 nt, Homo sapiens
cuaucgaggucguuaaauu

SEQ ID NO: 578671 - RNA, 19 nt, Homo sapiens
aaacuugacugcgcucuau

SEQ ID NO: 578672 - RNA, 19 nt, Homo sapiens
gcagagggaguacagcaaa

SEQ ID NO: 578673 - RNA, 19 nt, Homo sapiens
guuaaauucuucggaaaug

SEQ ID NO: 578674 - RNA, 19 nt, Homo sapiens
gacauauucuguucaccaa

SEQ ID NO: 578675 - RNA, 19 nt, Homo sapiens
gcugcaugcuauuccauuu

SEQ ID NO: 578676 - RNA, 19 nt, Homo sapiens
gcaccugccuucagaacag

SEQ ID NO: 578677 - RNA, 19 nt, Homo sapiens
ggaagagccaacuguguga

SEQ ID NO: 578678 - RNA, 19 nt, Homo sapiens
gcuggaagaucucaaacag

SEQ ID NO: 578679 - RNA, 19 nt, Homo sapiens
guauuuaaccagucacuau

SEQ ID NO: 578680 - RNA, 19 nt, Homo sapiens
aaacaggaggugaucgaua

SEQ ID NO: 578681 - RNA, 19 nt, Homo sapiens
gagcuggacuguuucuacu

SEQ ID NO: 578682 - RNA, 19 nt, Homo sapiens
gagaagcucgaucugaaga

SEQ ID NO: 578683 - RNA, 19 nt, Homo sapiens
ggaaacugguggagagacu

SEQ ID NO: 578684 - RNA, 19 nt, Homo sapiens
gcuuggaggcugccacuaa

SEQ ID NO: 578685 - RNA, 19 nt, Homo sapiens
gacaaggccucugugaaag

SEQ ID NO: 578686 - RNA, 19 nt, Homo sapiens
ggcagcagaucaggacgua

SEQ ID NO: 578687 - RNA, 19 nt, Homo sapiens
ugaauaggcaccucuggaa

SEQ ID NO: 578688 - RNA, 19 nt, Homo sapiens
gcagccagaccgaugugua

SEQ ID NO: 578689 - RNA, 19 nt, Homo sapiens
gcagcuggaagaucucaaa

SEQ ID NO: 578690 - RNA, 19 nt, Homo sapiens
cgaggucguuaaauucuuc

SEQ ID NO: 578691 - RNA, 19 nt, Homo sapiens
gaggaaugcagcuggaaga

SEQ ID NO: 578692 - RNA, 19 nt, Homo sapiens
uggagcaccugaagagaug

SEQ ID NO: 578693 - RNA, 19 nt, Homo sapiens
acauauaguuuggcagcua

SEQ ID NO: 578694 - RNA, 19 nt, Homo sapiens
uaaccagucacuauugaug

SEQ ID NO: 578695 - RNA, 19 nt, Homo sapiens
ccacuugccucgggcuaau

SEQ ID NO: 578696 - RNA, 19 nt, Homo sapiens
gaaaugccucacauauagu

SEQ ID NO: 578697 - RNA, 19 nt, Homo sapiens
cacuauugauggacauuug

SEQ ID NO: 578698 - RNA, 19 nt, Homo sapiens
gggcuaaucccucccucuu

SEQ ID NO: 578699 - RNA, 19 nt, Homo sapiens
cauauucuguucaccaaac

SEQ ID NO: 578700 - RNA, 19 nt, Homo sapiens
uuuaaccagucacuauuga

SEQ ID NO: 578701 - RNA, 19 nt, Homo sapiens
gccagaccgauguguauuu

SEQ ID NO: 578702 - RNA, 19 nt, Homo sapiens
cgauucaggacccagguua

SEQ ID NO: 578703 - RNA, 19 nt, Homo sapiens
gaauacgacaaccacauca

SEQ ID NO: 578704 - RNA, 19 nt, Homo sapiens
gaaucaagagcuccgagau

SEQ ID NO: 578705 - RNA, 19 nt, Homo sapiens
gauggacauuuggguuguu

SEQ ID NO: 578706 - RNA, 19 nt, Homo sapiens
uaucgaggucguuaaauuc

SEQ ID NO: 578707 - RNA, 19 nt, Homo sapiens
ggaucgaggacaugaggaa

SEQ ID NO: 578708 - RNA, 19 nt, Homo sapiens
gaagcuggccgagaagaag

SEQ ID NO: 578709 - RNA, 19 nt, Homo sapiens
cggcagagcaaccagauuc

SEQ ID NO: 578710 - RNA, 19 nt, Homo sapiens
gcuagcccuugcccuguug

SEQ ID NO: 578711 - RNA, 19 nt, Homo sapiens
agaccgauguguauuuaac

SEQ ID NO: 578712 - RNA, 19 nt, Homo sapiens
gggaguacagcaaacugaa

SEQ ID NO: 578713 - RNA, 19 nt, Homo sapiens
ggagaagcucgaucugaag

SEQ ID NO: 578714 - RNA, 19 nt, Homo sapiens
ugaaggcccaggcggauau

SEQ ID NO: 578715 - RNA, 19 nt, Homo sapiens
ccaaacaggaggugaucga

SEQ ID NO: 578716 - RNA, 19 nt, Homo sapiens
caaacuugacugcgcucua

SEQ ID NO: 578717 - RNA, 19 nt, Homo sapiens
cagccagaccgauguguau

SEQ ID NO: 578718 - RNA, 19 nt, Homo sapiens
ucauggagugcauugagua

SEQ ID NO: 578719 - RNA, 19 nt, Homo sapiens
ucggaaaugccucacauau

SEQ ID NO: 578720 - RNA, 19 nt, Homo sapiens
ggugaucgauaagcugaag

SEQ ID NO: 578721 - RNA, 19 nt, Homo sapiens
ggaaugcagcuggaagauc

SEQ ID NO: 578722 - RNA, 19 nt, Homo sapiens
ucaggacccagguuacuug

SEQ ID NO: 578723 - RNA, 19 nt, Homo sapiens
gacccuacuccuuguguga

SEQ ID NO: 578724 - RNA, 19 nt, Homo sapiens
ggaggcugccacuaaggaa

SEQ ID NO: 578725 - RNA, 19 nt, Homo sapiens
uauggacacccugcagaua

SEQ ID NO: 578726 - RNA, 19 nt, Homo sapiens
ggacguacugggcgaagag

SEQ ID NO: 578727 - RNA, 19 nt, Homo sapiens
aauaggcaccucuggaaga

SEQ ID NO: 578728 - RNA, 19 nt, Homo sapiens
ucguuaaauucuucggaaa

SEQ ID NO: 578729 - RNA, 19 nt, Homo sapiens
ggaguacagcaaacugaag

SEQ ID NO: 578730 - RNA, 19 nt, Homo sapiens
ccaggcggauaucuacaag

SEQ ID NO: 578731 - RNA, 19 nt, Homo sapiens
cccuugcccuguuggauga

SEQ ID NO: 578732 - RNA, 19 nt, Homo sapiens
ccgaggagccaccugacuu

SEQ ID NO: 578733 - RNA, 19 nt, Homo sapiens
gagaagcuggccgagaaga

SEQ ID NO: 578734 - RNA, 19 nt, Homo sapiens
agagggaggagaaggaguu

SEQ ID NO: 578735 - RNA, 19 nt, Homo sapiens
gucauggagugcauugagu

SEQ ID NO: 578736 - RNA, 19 nt, Homo sapiens
cgaggagccaccugacuuc

SEQ ID NO: 578737 - RNA, 19 nt, Homo sapiens
aaucaagagcuccgagaug

SEQ ID NO: 578738 - RNA, 19 nt, Homo sapiens
gagccaacugugugagaug

SEQ ID NO: 578739 - RNA, 19 nt, Homo sapiens
cuaguucagagacauauuc

SEQ ID NO: 578740 - RNA, 19 nt, Homo sapiens
guggagcaccugaagagau

SEQ ID NO: 578741 - RNA, 19 nt, Homo sapiens
cgaggagcuucugcauuuc

SEQ ID NO: 578742 - RNA, 19 nt, Homo sapiens
aaaugccucacauauaguu

SEQ ID NO: 578743 - RNA, 19 nt, Homo sapiens
ugauggacauuuggguugu

SEQ ID NO: 578744 - RNA, 19 nt, Homo sapiens
gcucuaucgaggucguuaa

SEQ ID NO: 578745 - RNA, 19 nt, Homo sapiens
uggacacccugcagauaca

SEQ ID NO: 578746 - RNA, 19 nt, Homo sapiens
cuucggaaaugccucacau

SEQ ID NO: 578747 - RNA, 19 nt, Homo sapiens
gaagaacucugguggauuu

SEQ ID NO: 578748 - RNA, 19 nt, Homo sapiens
ggaaguggauuuaaaguuu

SEQ ID NO: 578749 - RNA, 19 nt, Homo sapiens
gaagaggccuugaaauauu

SEQ ID NO: 578750 - RNA, 19 nt, Homo sapiens
ggucaaauguaaucacuua

SEQ ID NO: 578751 - RNA, 19 nt, Homo sapiens
caagaaacguuuauuggua

SEQ ID NO: 578752 - RNA, 19 nt, Homo sapiens
caacagacccugauuauga

SEQ ID NO: 578753 - RNA, 19 nt, Homo sapiens
ccagaaauuuggacucuua

SEQ ID NO: 578754 - RNA, 19 nt, Homo sapiens
gaccauagaccacaaguua

SEQ ID NO: 578755 - RNA, 19 nt, Homo sapiens
gaccaagucaguaguauua

SEQ ID NO: 578756 - RNA, 19 nt, Homo sapiens
gaacauggccugauagaag

SEQ ID NO: 578757 - RNA, 19 nt, Homo sapiens
cauaguaacuccaggauau

SEQ ID NO: 578758 - RNA, 19 nt, Homo sapiens
ggcauuaccucgccuauga

SEQ ID NO: 578759 - RNA, 19 nt, Homo sapiens
gagggaugcuucauuuaaa

SEQ ID NO: 578760 - RNA, 19 nt, Homo sapiens
ggaaguggccgcauuguug

SEQ ID NO: 578761 - RNA, 19 nt, Homo sapiens
gaagauacgcugcaguuga

SEQ ID NO: 578762 - RNA, 19 nt, Homo sapiens
cagaaggccuuugaagaua

SEQ ID NO: 578763 - RNA, 19 nt, Homo sapiens
ccagaaugcuuaaacuuga

SEQ ID NO: 578764 - RNA, 19 nt, Homo sapiens
gaaguggauuuaaaguuug

SEQ ID NO: 578765 - RNA, 19 nt, Homo sapiens
ccucagagauuaaugauuc

SEQ ID NO: 578766 - RNA, 19 nt, Homo sapiens
gcugauggccagauauuua

SEQ ID NO: 578767 - RNA, 19 nt, Homo sapiens
agaaggaucccaaagaaua

SEQ ID NO: 578768 - RNA, 19 nt, Homo sapiens
cgucaaauaucacgucauu

SEQ ID NO: 578769 - RNA, 19 nt, Homo sapiens
acgaagcucugaaguuaua

SEQ ID NO: 578770 - RNA, 19 nt, Homo sapiens
uaucagcgguuuacuauag

SEQ ID NO: 578771 - RNA, 19 nt, Homo sapiens
ucacuuggauugaagaaga

SEQ ID NO: 578772 - RNA, 19 nt, Homo sapiens
guaaugaccuugcuguucu

SEQ ID NO: 578773 - RNA, 19 nt, Homo sapiens
guucagcucuggacuguug

SEQ ID NO: 578774 - RNA, 19 nt, Homo sapiens
uaaaugacuugcucuggaa

SEQ ID NO: 578775 - RNA, 19 nt, Homo sapiens
guacuucccagaaugcuua

SEQ ID NO: 578776 - RNA, 19 nt, Homo sapiens
ugagaaagcugagaaucaa

SEQ ID NO: 578777 - RNA, 19 nt, Homo sapiens
caccuucucuggcuauuaa

SEQ ID NO: 578778 - RNA, 19 nt, Homo sapiens
ggauuuaaaguuugccuua

SEQ ID NO: 578779 - RNA, 19 nt, Homo sapiens
caugcgaaaucugaaauua

SEQ ID NO: 578780 - RNA, 19 nt, Homo sapiens
acagaaggaucccaaagaa

SEQ ID NO: 578781 - RNA, 19 nt, Homo sapiens
gcaccuaugacuuugauuu

SEQ ID NO: 578782 - RNA, 19 nt, Homo sapiens
ucacaacaguaccaggaua

SEQ ID NO: 578783 - RNA, 19 nt, Homo sapiens
cugaagaggccuugaaaua

SEQ ID NO: 578784 - RNA, 19 nt, Homo sapiens
gagguugcgucaaauauca

SEQ ID NO: 578785 - RNA, 19 nt, Homo sapiens
aagaugagguuaagguaaa

SEQ ID NO: 578786 - RNA, 19 nt, Homo sapiens
gaaccgagaguuugcuuug

SEQ ID NO: 578787 - RNA, 19 nt, Homo sapiens
ggagggauccgacagagaa

SEQ ID NO: 578788 - RNA, 19 nt, Homo sapiens
ccaaagaucaacagaagaa

SEQ ID NO: 578789 - RNA, 19 nt, Homo sapiens
ccugagggaugcuucauuu

SEQ ID NO: 578790 - RNA, 19 nt, Homo sapiens
agcaagacauuaagcuuua

SEQ ID NO: 578791 - RNA, 19 nt, Homo sapiens
ccugaaagaugaaguauac

SEQ ID NO: 578792 - RNA, 19 nt, Homo sapiens
ucaccaagcucacaacagu

SEQ ID NO: 578793 - RNA, 19 nt, Homo sapiens
ggagauaauucaagugacu

SEQ ID NO: 578794 - RNA, 19 nt, Homo sapiens
gaaaggucacuuccagaaa

SEQ ID NO: 578795 - RNA, 19 nt, Homo sapiens
uaaauacugccuauccaua

SEQ ID NO: 578796 - RNA, 19 nt, Homo sapiens
guggaaaccuucauuaaac

SEQ ID NO: 578797 - RNA, 19 nt, Homo sapiens
ggaagugguuggacaaacu

SEQ ID NO: 578798 - RNA, 19 nt, Homo sapiens
ccuuagaacuccucauuug

SEQ ID NO: 578799 - RNA, 19 nt, Homo sapiens
gaagaagcacagccucaaa

SEQ ID NO: 578800 - RNA, 19 nt, Homo sapiens
gacaaauacuugaaacgau

SEQ ID NO: 578801 - RNA, 19 nt, Homo sapiens
ggucugucauucaccauuu

SEQ ID NO: 578802 - RNA, 19 nt, Homo sapiens
ggauggaaguggccgcauu

SEQ ID NO: 578803 - RNA, 19 nt, Homo sapiens
caccaaagaucaacagaag

SEQ ID NO: 578804 - RNA, 19 nt, Homo sapiens
gaaauuuggacucuuacuu

SEQ ID NO: 578805 - RNA, 19 nt, Homo sapiens
aaaggucacuuccagaaau

SEQ ID NO: 578806 - RNA, 19 nt, Homo sapiens
gaaggaucccaaagaauau

SEQ ID NO: 578807 - RNA, 19 nt, Homo sapiens
ucacgucauuugcaguaua

SEQ ID NO: 578808 - RNA, 19 nt, Homo sapiens
gaaaagagauacaaaaucc

SEQ ID NO: 578809 - RNA, 19 nt, Homo sapiens
ggugaaagcaaguuuauca

SEQ ID NO: 578810 - RNA, 19 nt, Homo sapiens
ccacaagaaacguuuauug

SEQ ID NO: 578811 - RNA, 19 nt, Homo sapiens
ggaagagugugcccaggau

SEQ ID NO: 578812 - RNA, 19 nt, Homo sapiens
ugaaauauuugcugcaucu

SEQ ID NO: 578813 - RNA, 19 nt, Homo sapiens
cgacagagaagaccauuuc

SEQ ID NO: 578814 - RNA, 19 nt, Homo sapiens
gagcagaggaagcacauug

SEQ ID NO: 578815 - RNA, 19 nt, Homo sapiens
ggguggaaguggauuuaaa

SEQ ID NO: 578816 - RNA, 19 nt, Homo sapiens
gaacuucagcagacaacaa

SEQ ID NO: 578817 - RNA, 19 nt, Homo sapiens
uaacuuaccuuagcauugc

SEQ ID NO: 578818 - RNA, 19 nt, Homo sapiens
caugguagcugagaaguca

SEQ ID NO: 578819 - RNA, 19 nt, Homo sapiens
uacacgagcuucaaggaaa

SEQ ID NO: 578820 - RNA, 19 nt, Homo sapiens
ugcaguauaugaugaguuu

SEQ ID NO: 578821 - RNA, 19 nt, Homo sapiens
acacuucccuuccuuaaag

SEQ ID NO: 578822 - RNA, 19 nt, Homo sapiens
ccagcaggauauuguguuu

SEQ ID NO: 578823 - RNA, 19 nt, Homo sapiens
gcaguuugauugcaucuac

SEQ ID NO: 578824 - RNA, 19 nt, Homo sapiens
uugagucgcuggcuucuuu

SEQ ID NO: 578825 - RNA, 19 nt, Homo sapiens
ugagugaaguggugcagaa

SEQ ID NO: 578826 - RNA, 19 nt, Homo sapiens
guaccaggauaucagcauu

SEQ ID NO: 578827 - RNA, 19 nt, Homo sapiens
aagaggccuugaaauauuu

SEQ ID NO: 578828 - RNA, 19 nt, Homo sapiens
aagcaaaguuuauccuuca

SEQ ID NO: 578829 - RNA, 19 nt, Homo sapiens
cauggacacuuuacacuuc

SEQ ID NO: 578830 - RNA, 19 nt, Homo sapiens
ucagcgagaucauccaaga

SEQ ID NO: 578831 - RNA, 19 nt, Homo sapiens
ucugguagauguuaaugaa

SEQ ID NO: 578832 - RNA, 19 nt, Homo sapiens
ugaagaggccuugaaauau

SEQ ID NO: 578833 - RNA, 19 nt, Homo sapiens
ugagggaugcuucauuuaa

SEQ ID NO: 578834 - RNA, 19 nt, Homo sapiens
gcuauuaaaccauggaaga

SEQ ID NO: 578835 - RNA, 19 nt, Homo sapiens
caacguaaagccuuccauu

SEQ ID NO: 578836 - RNA, 19 nt, Homo sapiens
gaaacuaggccuucucacu

SEQ ID NO: 578837 - RNA, 19 nt, Homo sapiens
gggaagagcaagauugugu

SEQ ID NO: 578838 - RNA, 19 nt, Homo sapiens
caaagugugaagacaagua

SEQ ID NO: 578839 - RNA, 19 nt, Homo sapiens
gaagcacagccucaaagaa

SEQ ID NO: 578840 - RNA, 19 nt, Homo sapiens
aggcaggucuggaugauga

SEQ ID NO: 578841 - RNA, 19 nt, Homo sapiens
ccucauaaauacugccuau

SEQ ID NO: 578842 - RNA, 19 nt, Homo sapiens
gaccuugucugcgaugcua

SEQ ID NO: 578843 - RNA, 19 nt, Homo sapiens
guacuguucucgugggaau

SEQ ID NO: 578844 - RNA, 19 nt, Homo sapiens
aaagcaaguuuaucacugu

SEQ ID NO: 578845 - RNA, 19 nt, Homo sapiens
gcuauuagugcuacauuug

SEQ ID NO: 578846 - RNA, 19 nt, Homo sapiens
gaagacaaguaaaacaaug

SEQ ID NO: 578847 - RNA, 19 nt, Homo sapiens
guaacagucuaccauauua

SEQ ID NO: 578848 - RNA, 19 nt, Homo sapiens
gccagaagaugcacaagga

SEQ ID NO: 578849 - RNA, 19 nt, Homo sapiens
gaaaaccacacuucucaua

SEQ ID NO: 578850 - RNA, 19 nt, Homo sapiens
caagguccaccgugauuaa

SEQ ID NO: 578851 - RNA, 19 nt, Homo sapiens
gcccauagccugcaaccuu

SEQ ID NO: 578852 - RNA, 19 nt, Homo sapiens
gcauucgccuacuccguaa

SEQ ID NO: 578853 - RNA, 19 nt, Homo sapiens
guucaacacccucuucuug

SEQ ID NO: 578854 - RNA, 19 nt, Homo sapiens
ucuacagugucauucaaua

SEQ ID NO: 578855 - RNA, 19 nt, Homo sapiens
ucucauaccuucacucaac

SEQ ID NO: 578856 - RNA, 19 nt, Homo sapiens
cccauagccugcaaccuuu

SEQ ID NO: 578857 - RNA, 19 nt, Homo sapiens
uaccuucacucaacacuuc

SEQ ID NO: 578858 - RNA, 19 nt, Homo sapiens
cuacagugucauucaauaa

SEQ ID NO: 578859 - RNA, 19 nt, Homo sapiens
gguauucggcucuguaaca

SEQ ID NO: 578860 - RNA, 19 nt, Homo sapiens
gcacaaggaggaacaugag

SEQ ID NO: 578861 - RNA, 19 nt, Homo sapiens
cuagauacagcaguuuaua

SEQ ID NO: 578862 - RNA, 19 nt, Homo sapiens
gaagaugcacaaggaggaa

SEQ ID NO: 578863 - RNA, 19 nt, Homo sapiens
aaagugcacgugcuuguga

SEQ ID NO: 578864 - RNA, 19 nt, Homo sapiens
uguaacagucuaccauauu

SEQ ID NO: 578865 - RNA, 19 nt, Homo sapiens
uaaagucuagggacaggaa

SEQ ID NO: 578866 - RNA, 19 nt, Homo sapiens
ccaagguccaccgugauua

SEQ ID NO: 578867 - RNA, 19 nt, Homo sapiens
caauaaagugcacgugcuu

SEQ ID NO: 578868 - RNA, 19 nt, Homo sapiens
gguccaccgugauuaacau

SEQ ID NO: 578869 - RNA, 19 nt, Homo sapiens
ugucuacagugucauucaa

SEQ ID NO: 578870 - RNA, 19 nt, Homo sapiens
acagugucauucaauaaag

SEQ ID NO: 578871 - RNA, 19 nt, Homo sapiens
ccucaugaccauuggauuc

SEQ ID NO: 578872 - RNA, 19 nt, Homo sapiens
cagugucauucaauaaagu

SEQ ID NO: 578873 - RNA, 19 nt, Homo sapiens
aaaccacacuucucauacc

SEQ ID NO: 578874 - RNA, 19 nt, Homo sapiens
ccaccgugauuaacaucca

SEQ ID NO: 578875 - RNA, 19 nt, Homo sapiens
aaaacgggguuacuaguag

SEQ ID NO: 578876 - RNA, 19 nt, Homo sapiens
ggcauccucaugaccauug

SEQ ID NO: 578877 - RNA, 19 nt, Homo sapiens
acaggaagcuugcaaauuu

SEQ ID NO: 578878 - RNA, 19 nt, Homo sapiens
gcaauugcuucccuucuua

SEQ ID NO: 578879 - RNA, 19 nt, Homo sapiens
gcacaaacacgaaugauuu

SEQ ID NO: 578880 - RNA, 19 nt, Homo sapiens
gaauaugcaucuaaaguug

SEQ ID NO: 578881 - RNA, 19 nt, Homo sapiens
gaagauuaccggcguguua

SEQ ID NO: 578882 - RNA, 19 nt, Homo sapiens
cgaaugauuuccuuucuuu

SEQ ID NO: 578883 - RNA, 19 nt, Homo sapiens
gaaccuuacuucauaccua

SEQ ID NO: 578884 - RNA, 19 nt, Homo sapiens
agaagaaacuggcagagua

SEQ ID NO: 578885 - RNA, 19 nt, Homo sapiens
gaacuuucuuuccugagua

SEQ ID NO: 578886 - RNA, 19 nt, Homo sapiens
gcagagagaucuugcuaag

SEQ ID NO: 578887 - RNA, 19 nt, Homo sapiens
gcuacagacuggauauuaa

SEQ ID NO: 578888 - RNA, 19 nt, Homo sapiens
cuaauuagcccauauaaga

SEQ ID NO: 578889 - RNA, 19 nt, Homo sapiens
gaucguagcucggaaaugg

SEQ ID NO: 578890 - RNA, 19 nt, Homo sapiens
caacacagcaauugaacua

SEQ ID NO: 578891 - RNA, 19 nt, Homo sapiens
ugacguggaugaugaaaga

SEQ ID NO: 578892 - RNA, 19 nt, Homo sapiens
gucuaaagauccuguuaua

SEQ ID NO: 578893 - RNA, 19 nt, Homo sapiens
caaaccagaugaaccaaau

SEQ ID NO: 578894 - RNA, 19 nt, Homo sapiens
cagaagaacugacaaacca

SEQ ID NO: 578895 - RNA, 19 nt, Homo sapiens
gcucaagaguaaagauuau

SEQ ID NO: 578896 - RNA, 19 nt, Homo sapiens
gaacugacaaaccagauga

SEQ ID NO: 578897 - RNA, 19 nt, Homo sapiens
gaagcuuugucaagauuug

SEQ ID NO: 578898 - RNA, 19 nt, Homo sapiens
gaagacuaauuagcccaua

SEQ ID NO: 578899 - RNA, 19 nt, Homo sapiens
gaaauuacgagacuuugug

SEQ ID NO: 578900 - RNA, 19 nt, Homo sapiens
acacagcaauugaacuaaa

SEQ ID NO: 578901 - RNA, 19 nt, Homo sapiens
cuagaaggguuuaugaaau

SEQ ID NO: 578902 - RNA, 19 nt, Homo sapiens
ugaaacugcuagcuuuauu

SEQ ID NO: 578903 - RNA, 19 nt, Homo sapiens
guauacccaucaacucuuu

SEQ ID NO: 578904 - RNA, 19 nt, Homo sapiens
gcuagaaggguuuaugaaa

SEQ ID NO: 578905 - RNA, 19 nt, Homo sapiens
caaugaagauauggcgaua

SEQ ID NO: 578906 - RNA, 19 nt, Homo sapiens
uauugaaacugcuagcuuu

SEQ ID NO: 578907 - RNA, 19 nt, Homo sapiens
gcucggaaauggcgggauu

SEQ ID NO: 578908 - RNA, 19 nt, Homo sapiens
gaaacuggcagaguacaaa

SEQ ID NO: 578909 - RNA, 19 nt, Homo sapiens
gucaagauuugcccuguuu

SEQ ID NO: 578910 - RNA, 19 nt, Homo sapiens
gaugaaagauggcacuacu

SEQ ID NO: 578911 - RNA, 19 nt, Homo sapiens
guagaggcuuucgagaaua

SEQ ID NO: 578912 - RNA, 19 nt, Homo sapiens
cagaugaaccaaauagaaa

SEQ ID NO: 578913 - RNA, 19 nt, Homo sapiens
uuacaagggucuaaagauc

SEQ ID NO: 578914 - RNA, 19 nt, Homo sapiens
gugaagcuuugucaagauu

SEQ ID NO: 578915 - RNA, 19 nt, Homo sapiens
gcugguagccugucaacaa

SEQ ID NO: 578916 - RNA, 19 nt, Homo sapiens
ugagugaugccgaacaaua

SEQ ID NO: 578917 - RNA, 19 nt, Homo sapiens
gauaaagcuucugaaauac

SEQ ID NO: 578918 - RNA, 19 nt, Homo sapiens
gaaacugcuagcuuuauug

SEQ ID NO: 578919 - RNA, 19 nt, Homo sapiens
aaacacgaaugauuuccuu

SEQ ID NO: 578920 - RNA, 19 nt, Homo sapiens
ccagaugaaccaaauagaa

SEQ ID NO: 578921 - RNA, 19 nt, Homo sapiens
cuacaguucuugauauuac

SEQ ID NO: 578922 - RNA, 19 nt, Homo sapiens
uguagaggcuuucgagaau

SEQ ID NO: 578923 - RNA, 19 nt, Homo sapiens
gaacuuugacuguguagag

SEQ ID NO: 578924 - RNA, 19 nt, Homo sapiens
ugagaacuuugacugugua

SEQ ID NO: 578925 - RNA, 19 nt, Homo sapiens
gaaauacuacugcaauugc

SEQ ID NO: 578926 - RNA, 19 nt, Homo sapiens
gaacaauacagaagcuaca

SEQ ID NO: 578927 - RNA, 19 nt, Homo sapiens
cuucauaccuacucaguuc

SEQ ID NO: 578928 - RNA, 19 nt, Homo sapiens
cugaagaucuugaaaauga

SEQ ID NO: 578929 - RNA, 19 nt, Homo sapiens
auacugcucuguacaggaa

SEQ ID NO: 578930 - RNA, 19 nt, Homo sapiens
uucggaaccuuacuucaua

SEQ ID NO: 578931 - RNA, 19 nt, Homo sapiens
gguagccugucaacaaugu

SEQ ID NO: 578932 - RNA, 19 nt, Homo sapiens
ggaagagaguuuucaggaa

SEQ ID NO: 578933 - RNA, 19 nt, Homo sapiens
uagaggcuuucgagaauau

SEQ ID NO: 578934 - RNA, 19 nt, Homo sapiens
uguacaaugugcugugaaa

SEQ ID NO: 578935 - RNA, 19 nt, Homo sapiens
uuauugacguggaugauga

SEQ ID NO: 578936 - RNA, 19 nt, Homo sapiens
cuaaagauccuguuauacu

SEQ ID NO: 578937 - RNA, 19 nt, Homo sapiens
caugagugaugccgaacaa

SEQ ID NO: 578938 - RNA, 19 nt, Homo sapiens
gauagaggcacaacagaag

SEQ ID NO: 578939 - RNA, 19 nt, Homo sapiens
gaagaaacuggcagaguac

SEQ ID NO: 578940 - RNA, 19 nt, Homo sapiens
aauguuccguguugaauau

SEQ ID NO: 578941 - RNA, 19 nt, Homo sapiens
gaaagauaaagcuucugaa

SEQ ID NO: 578942 - RNA, 19 nt, Homo sapiens
agagugcaguggagaagaa

SEQ ID NO: 578943 - RNA, 19 nt, Homo sapiens
cuacagacuggauauuaaa

SEQ ID NO: 578944 - RNA, 19 nt, Homo sapiens
aggaacuaguggaagauua

SEQ ID NO: 578945 - RNA, 19 nt, Homo sapiens
gaccagaagaacugacaaa

SEQ ID NO: 578946 - RNA, 19 nt, Homo sapiens
agacuaauuagcccauaua

SEQ ID NO: 578947 - RNA, 19 nt, Homo sapiens
caauguuccguguugaaua

SEQ ID NO: 578948 - RNA, 19 nt, Homo sapiens
guacaggaagcuugcaaau

SEQ ID NO: 578949 - RNA, 19 nt, Homo sapiens
gaagcuacagacuggauau

SEQ ID NO: 578950 - RNA, 19 nt, Homo sapiens
cauagauacuacacugaau

SEQ ID NO: 578951 - RNA, 19 nt, Homo sapiens
cuacaugacagucuauaau

SEQ ID NO: 578952 - RNA, 19 nt, Homo sapiens
aaacugcuagcuuuauuga

SEQ ID NO: 578953 - RNA, 19 nt, Homo sapiens
auauaaggcugacaugaca

SEQ ID NO: 578954 - RNA, 19 nt, Homo sapiens
cugaaauacuacugcaauu

SEQ ID NO: 578955 - RNA, 19 nt, Homo sapiens
ugaauuuccuacaguucuu

SEQ ID NO: 578956 - RNA, 19 nt, Homo sapiens
ugaaauacuacugcaauug

SEQ ID NO: 578957 - RNA, 19 nt, Homo sapiens
ugacaaaccagaugaacca

SEQ ID NO: 578958 - RNA, 19 nt, Homo sapiens
augaagauauggcgauaga

SEQ ID NO: 578959 - RNA, 19 nt, Homo sapiens
ccauggugcucaacuucuu

SEQ ID NO: 578960 - RNA, 19 nt, Homo sapiens
gaaguauaauaaggaugga

SEQ ID NO: 578961 - RNA, 19 nt, Homo sapiens
uaacaccaacacagcaauu

SEQ ID NO: 578962 - RNA, 19 nt, Homo sapiens
aagauuauacugcucugua

SEQ ID NO: 578963 - RNA, 19 nt, Homo sapiens
cgauagaggcacaacagaa

SEQ ID NO: 578964 - RNA, 19 nt, Homo sapiens
gcuacaugacagucuauaa

SEQ ID NO: 578965 - RNA, 19 nt, Homo sapiens
ucgagaauaucaugaaagg

SEQ ID NO: 578966 - RNA, 19 nt, Homo sapiens
ggucuaaagauccuguuau

SEQ ID NO: 578967 - RNA, 19 nt, Homo sapiens
ggaacuaguggaagauuac

SEQ ID NO: 578968 - RNA, 19 nt, Homo sapiens
gaacagcuggaagagaguu

SEQ ID NO: 578969 - RNA, 19 nt, Homo sapiens
guaacugacaugagugaug

SEQ ID NO: 578970 - RNA, 19 nt, Homo sapiens
gagacuuugugcuugugaa

SEQ ID NO: 578971 - RNA, 19 nt, Homo sapiens
gagaagaaacuggcagagu

SEQ ID NO: 578972 - RNA, 19 nt, Homo sapiens
caagccauucggaaccuua

SEQ ID NO: 578973 - RNA, 19 nt, Homo sapiens
uugcuucccuucuuaaaca

SEQ ID NO: 578974 - RNA, 19 nt, Homo sapiens
gggaugaugaaacugcuuu

SEQ ID NO: 578975 - RNA, 19 nt, Homo sapiens
ugaaauucuucgacuacug

SEQ ID NO: 578976 - RNA, 19 nt, Homo sapiens
guuuagaguuuaugagcau

SEQ ID NO: 578977 - RNA, 19 nt, Homo sapiens
gaaaucaucuugcugacaa

SEQ ID NO: 578978 - RNA, 19 nt, Homo sapiens
gggaagggcugaaagaauu

SEQ ID NO: 578979 - RNA, 19 nt, Homo sapiens
gaagagccaugaagaaagu

SEQ ID NO: 578980 - RNA, 19 nt, Homo sapiens
gaaguuagaagcccuagaa

SEQ ID NO: 578981 - RNA, 19 nt, Homo sapiens
gaaccuguguccuuugaga

SEQ ID NO: 578982 - RNA, 19 nt, Homo sapiens
cgacggacgcuuuauauuu

SEQ ID NO: 578983 - RNA, 19 nt, Homo sapiens
gaaaguacauguggauuuu

SEQ ID NO: 578984 - RNA, 19 nt, Homo sapiens
gcacgacggacgcuuuaua

SEQ ID NO: 578985 - RNA, 19 nt, Homo sapiens
gcaagaagagccaugaaga

SEQ ID NO: 578986 - RNA, 19 nt, Homo sapiens
gaaacgcugucccaacugu

SEQ ID NO: 578987 - RNA, 19 nt, Homo sapiens
caagaaccuuugagaacaa

SEQ ID NO: 578988 - RNA, 19 nt, Homo sapiens
guuagaagcugaggcaaga

SEQ ID NO: 578989 - RNA, 19 nt, Homo sapiens
gcugggauauuaaugaugu

SEQ ID NO: 578990 - RNA, 19 nt, Homo sapiens
acaaugauaugcuucugaa

SEQ ID NO: 578991 - RNA, 19 nt, Homo sapiens
ggagccaccugcagccaaa

SEQ ID NO: 578992 - RNA, 19 nt, Homo sapiens
ugacaacuguuauuccaau

SEQ ID NO: 578993 - RNA, 19 nt, Homo sapiens
ccaggaaggcguccaauug

SEQ ID NO: 578994 - RNA, 19 nt, Homo sapiens
caagaagagccaugaagaa

SEQ ID NO: 578995 - RNA, 19 nt, Homo sapiens
ggccugaccuuaucaugga

SEQ ID NO: 578996 - RNA, 19 nt, Homo sapiens
ccaaaucuuucacuaugug

SEQ ID NO: 578997 - RNA, 19 nt, Homo sapiens
uaguuacaguggacauuua

SEQ ID NO: 578998 - RNA, 19 nt, Homo sapiens
ggacuugaaccagcaguaa

SEQ ID NO: 578999 - RNA, 19 nt, Homo sapiens
aggaagaaaugacauacuu

SEQ ID NO: 579000 - RNA, 19 nt, Homo sapiens
ccaugaagcucuaugaaaa

SEQ ID NO: 579001 - RNA, 19 nt, Homo sapiens
gacggacgcuuuauauuuu

SEQ ID NO: 579002 - RNA, 19 nt, Homo sapiens
cauaaccacagauaaauga

SEQ ID NO: 579003 - RNA, 19 nt, Homo sapiens
ggaggaaucacagaucuga

SEQ ID NO: 579004 - RNA, 19 nt, Homo sapiens
ccaauugccugguaguuac

SEQ ID NO: 579005 - RNA, 19 nt, Homo sapiens
ugaaccagcaguaagauuu

SEQ ID NO: 579006 - RNA, 19 nt, Homo sapiens
ccugagaccugccaucugu

SEQ ID NO: 579007 - RNA, 19 nt, Homo sapiens
gaacaaaauucucaagcau

SEQ ID NO: 579008 - RNA, 19 nt, Homo sapiens
ugacccaaaucuuucacua

SEQ ID NO: 579009 - RNA, 19 nt, Homo sapiens
ggaagaaaugacauacuug

SEQ ID NO: 579010 - RNA, 19 nt, Homo sapiens
gcugucugcuucuccguaa

SEQ ID NO: 579011 - RNA, 19 nt, Homo sapiens
ggaagggcugaaagaauuu

SEQ ID NO: 579012 - RNA, 19 nt, Homo sapiens
ggccaaauccagcggguaa

SEQ ID NO: 579013 - RNA, 19 nt, Homo sapiens
gcugacaacuguuauucca

SEQ ID NO: 579014 - RNA, 19 nt, Homo sapiens
gaucuacaagcguggagua

SEQ ID NO: 579015 - RNA, 19 nt, Homo sapiens
aauauucacugccaagcaa

SEQ ID NO: 579016 - RNA, 19 nt, Homo sapiens
agaaaguacauguggauuu

SEQ ID NO: 579017 - RNA, 19 nt, Homo sapiens
acccaaaucuuucacuaug

SEQ ID NO: 579018 - RNA, 19 nt, Homo sapiens
uaagcugggauauuaauga

SEQ ID NO: 579019 - RNA, 19 nt, Homo sapiens
gacaacuguuauuccaauu

SEQ ID NO: 579020 - RNA, 19 nt, Homo sapiens
cgauccagcuauaucaaga

SEQ ID NO: 579021 - RNA, 19 nt, Homo sapiens
ugacauacuuggguuugga

SEQ ID NO: 579022 - RNA, 19 nt, Homo sapiens
aagaagagccaugaagaaa

SEQ ID NO: 579023 - RNA, 19 nt, Homo sapiens
cggaaacgcugucccaacu

SEQ ID NO: 579024 - RNA, 19 nt, Homo sapiens
aaccacagauaaaugagaa

SEQ ID NO: 579025 - RNA, 19 nt, Homo sapiens
guggacauuuaauagcuaa

SEQ ID NO: 579026 - RNA, 19 nt, Homo sapiens
guaguuacaguggacauuu

SEQ ID NO: 579027 - RNA, 19 nt, Homo sapiens
gcaauaccaacaaccacaa

SEQ ID NO: 579028 - RNA, 19 nt, Homo sapiens
ggaguggccagauuccuau

SEQ ID NO: 579029 - RNA, 19 nt, Homo sapiens
cuacaagcguggaguaaaa

SEQ ID NO: 579030 - RNA, 19 nt, Homo sapiens
gagauauuaagcugggaua

SEQ ID NO: 579031 - RNA, 19 nt, Homo sapiens
caacaaugauaugcuucug

SEQ ID NO: 579032 - RNA, 19 nt, Homo sapiens
gugggccgauccagcuaua

SEQ ID NO: 579033 - RNA, 19 nt, Homo sapiens
gagagcaugaucauccaaa

SEQ ID NO: 579034 - RNA, 19 nt, Homo sapiens
agaaucaugauaagcagua

SEQ ID NO: 579035 - RNA, 19 nt, Homo sapiens
cagcggguaaucuuuauga

SEQ ID NO: 579036 - RNA, 19 nt, Homo sapiens
caaagggagagcaugauca

SEQ ID NO: 579037 - RNA, 19 nt, Homo sapiens
cugcaacaaugauaugcuu

SEQ ID NO: 579038 - RNA, 19 nt, Homo sapiens
uuggaucacugcaacaaug

SEQ ID NO: 579039 - RNA, 19 nt, Homo sapiens
uaacagcuacguccagucu

SEQ ID NO: 579040 - RNA, 19 nt, Homo sapiens
gaaucacagaucugacuga

SEQ ID NO: 579041 - RNA, 19 nt, Homo sapiens
caggggaguuuaccuuuaa

SEQ ID NO: 579042 - RNA, 19 nt, Homo sapiens
gacccaaaucuuucacuau

SEQ ID NO: 579043 - RNA, 19 nt, Homo sapiens
cugaaccuguguccuuuga

SEQ ID NO: 579044 - RNA, 19 nt, Homo sapiens
gcauaccauucaccucaag

SEQ ID NO: 579045 - RNA, 19 nt, Homo sapiens
gagaaaguacauguggauu

SEQ ID NO: 579046 - RNA, 19 nt, Homo sapiens
ggacauuuaauagcuaaca

SEQ ID NO: 579047 - RNA, 19 nt, Homo sapiens
ccagaaaccaaguuagaag

SEQ ID NO: 579048 - RNA, 19 nt, Homo sapiens
uccaauugccugguaguua

SEQ ID NO: 579049 - RNA, 19 nt, Homo sapiens
ucaggggaguuuaccuuua

SEQ ID NO: 579050 - RNA, 19 nt, Homo sapiens
gaggcacgacggacgcuuu

SEQ ID NO: 579051 - RNA, 19 nt, Homo sapiens
gcgcaagaucuaccugaga

SEQ ID NO: 579052 - RNA, 19 nt, Homo sapiens
gcaacaaugauaugcuucu

SEQ ID NO: 579053 - RNA, 19 nt, Homo sapiens
caagcaagagcagcaaaug

SEQ ID NO: 579054 - RNA, 19 nt, Homo sapiens
ccuugcagcuucucuccuu

SEQ ID NO: 579055 - RNA, 19 nt, Homo sapiens
ggcguccaauugccuggua

SEQ ID NO: 579056 - RNA, 19 nt, Homo sapiens
gaaccagcaguaagauuuu

SEQ ID NO: 579057 - RNA, 19 nt, Homo sapiens
aagcugggauauuaaugau

SEQ ID NO: 579058 - RNA, 19 nt, Homo sapiens
uaaccacagauaaaugaga

SEQ ID NO: 579059 - RNA, 19 nt, Homo sapiens
ucaucuugcugacaacugu

SEQ ID NO: 579060 - RNA, 19 nt, Homo sapiens
cccaugaagcucuaugaaa

SEQ ID NO: 579061 - RNA, 19 nt, Homo sapiens
guuauggucugggaggaau

SEQ ID NO: 579062 - RNA, 19 nt, Homo sapiens
uggcuggccugaccuuauc

SEQ ID NO: 579063 - RNA, 19 nt, Homo sapiens
cuaacacuccucagcagaa

SEQ ID NO: 579064 - RNA, 19 nt, Homo sapiens
aaccagaaaccaaguuaga

SEQ ID NO: 579065 - RNA, 19 nt, Homo sapiens
gggagagcaugaucaucca

SEQ ID NO: 579066 - RNA, 19 nt, Homo sapiens
gaccugccaucugugacaa

SEQ ID NO: 579067 - RNA, 19 nt, Homo sapiens
gcucggaggacaagaaugc

SEQ ID NO: 579068 - RNA, 19 nt, Homo sapiens
caugauaagcaguagacaa

SEQ ID NO: 579069 - RNA, 19 nt, Homo sapiens
gaaucaugauaagcaguag

SEQ ID NO: 579070 - RNA, 19 nt, Homo sapiens
gauccagcuauaucaagaa

SEQ ID NO: 579071 - RNA, 19 nt, Homo sapiens
gggagucgaauaggugaaa

SEQ ID NO: 579072 - RNA, 19 nt, Homo sapiens
ucacugcaacaaugauaug

SEQ ID NO: 579073 - RNA, 19 nt, Homo sapiens
aaacucuucagaacccuuu

SEQ ID NO: 579074 - RNA, 19 nt, Homo sapiens
caguggacauuuaauagcu

SEQ ID NO: 579075 - RNA, 19 nt, Homo sapiens
ccagcuauaucaagaaccu

SEQ ID NO: 579076 - RNA, 19 nt, Homo sapiens
agacaaagagauauuaagc

SEQ ID NO: 579077 - RNA, 19 nt, Homo sapiens
ggauaaagauugaagaaga

SEQ ID NO: 579078 - RNA, 19 nt, Homo sapiens
gcaaacaaaugcagaagga

SEQ ID NO: 579079 - RNA, 19 nt, Homo sapiens
gggaaaggauaaagauuga

SEQ ID NO: 579080 - RNA, 19 nt, Homo sapiens
caaaccagcucgucucaga

SEQ ID NO: 579081 - RNA, 19 nt, Homo sapiens
gaagaagacuaugcgaaga

SEQ ID NO: 579082 - RNA, 19 nt, Homo sapiens
ggagagagcuggugauucc

SEQ ID NO: 579083 - RNA, 19 nt, Homo sapiens
gaaaacaccaucacaauaa

SEQ ID NO: 579084 - RNA, 19 nt, Homo sapiens
gacagaggcuggaacuuug

SEQ ID NO: 579085 - RNA, 19 nt, Homo sapiens
agaaggaaaugucagaauu

SEQ ID NO: 579086 - RNA, 19 nt, Homo sapiens
agaaagacaugaagaagug

SEQ ID NO: 579087 - RNA, 19 nt, Homo sapiens
cccagaauauggugacuua

SEQ ID NO: 579088 - RNA, 19 nt, Homo sapiens
gaacuuccgugagaacuuc

SEQ ID NO: 579089 - RNA, 19 nt, Homo sapiens
agagagaccuggagaugaa

SEQ ID NO: 579090 - RNA, 19 nt, Homo sapiens
gaagugcgaccaccacauu

SEQ ID NO: 579091 - RNA, 19 nt, Homo sapiens
ggaaggcucugucucuaag

SEQ ID NO: 579092 - RNA, 19 nt, Homo sapiens
gaucaggcgccaucuguaa

SEQ ID NO: 579093 - RNA, 19 nt, Homo sapiens
ggaaaugucagaauucauc

SEQ ID NO: 579094 - RNA, 19 nt, Homo sapiens
ccaaaguucucaguuauca

SEQ ID NO: 579095 - RNA, 19 nt, Homo sapiens
caaguucucugccaagcuu

SEQ ID NO: 579096 - RNA, 19 nt, Homo sapiens
gaaggaaaugucagaauuc

SEQ ID NO: 579097 - RNA, 19 nt, Homo sapiens
uugcagcccuccuucuuua

SEQ ID NO: 579098 - RNA, 19 nt, Homo sapiens
gugagaacuucaagaaaga

SEQ ID NO: 579099 - RNA, 19 nt, Homo sapiens
ucacagagcggcagagaga

SEQ ID NO: 579100 - RNA, 19 nt, Homo sapiens
cuucagggauggaaacaaa

SEQ ID NO: 579101 - RNA, 19 nt, Homo sapiens
uguaaagucuccucuggaa

SEQ ID NO: 579102 - RNA, 19 nt, Homo sapiens
ggaaaacaccaucacaaua

SEQ ID NO: 579103 - RNA, 19 nt, Homo sapiens
uuuccaaaguucucaguua

SEQ ID NO: 579104 - RNA, 19 nt, Homo sapiens
gcccugcccuugucucuga

SEQ ID NO: 579105 - RNA, 19 nt, Homo sapiens
gcuaagcucucucagaacu

SEQ ID NO: 579106 - RNA, 19 nt, Homo sapiens
uggaucagcugcuucgaaa

SEQ ID NO: 579107 - RNA, 19 nt, Homo sapiens
cgugagaacuucaagaaag

SEQ ID NO: 579108 - RNA, 19 nt, Homo sapiens
gauaaagauugaagaagac

SEQ ID NO: 579109 - RNA, 19 nt, Homo sapiens
uaaagucuccucuggaaau

SEQ ID NO: 579110 - RNA, 19 nt, Homo sapiens
agacugagcaucccugauu

SEQ ID NO: 579111 - RNA, 19 nt, Homo sapiens
ggacauggagaucuagaug

SEQ ID NO: 579112 - RNA, 19 nt, Homo sapiens
gcagagagaccuggagaug

SEQ ID NO: 579113 - RNA, 19 nt, Homo sapiens
acacuagguugucgccuuu

SEQ ID NO: 579114 - RNA, 19 nt, Homo sapiens
ggauggaacuacgucauuc

SEQ ID NO: 579115 - RNA, 19 nt, Homo sapiens
agacagaggcuggaacuuu

SEQ ID NO: 579116 - RNA, 19 nt, Homo sapiens
gcacaagacgggcaacauc

SEQ ID NO: 579117 - RNA, 19 nt, Homo sapiens
acagacauguucaaccaaa

SEQ ID NO: 579118 - RNA, 19 nt, Homo sapiens
gaaaggauaaagauugaag

SEQ ID NO: 579119 - RNA, 19 nt, Homo sapiens
aaacaaaugcagaaggaaa

SEQ ID NO: 579120 - RNA, 19 nt, Homo sapiens
cugaugaacuuccgugaga

SEQ ID NO: 579121 - RNA, 19 nt, Homo sapiens
gaacuucaagaaagacaug

SEQ ID NO: 579122 - RNA, 19 nt, Homo sapiens
gcccuucccagucucauua

SEQ ID NO: 579123 - RNA, 19 nt, Homo sapiens
gaaaugccaauccauccuu

SEQ ID NO: 579124 - RNA, 19 nt, Homo sapiens
cagcccuccuucuuuauuu

SEQ ID NO: 579125 - RNA, 19 nt, Homo sapiens
ucaagaaagacaugaagaa

SEQ ID NO: 579126 - RNA, 19 nt, Homo sapiens
gaaguucaccucaaguucu

SEQ ID NO: 579127 - RNA, 19 nt, Homo sapiens
agaauauggugacuuagga

SEQ ID NO: 579128 - RNA, 19 nt, Homo sapiens
cuacaugugagauggguua

SEQ ID NO: 579129 - RNA, 19 nt, Homo sapiens
gcugaaucgugucccauga

SEQ ID NO: 579130 - RNA, 19 nt, Homo sapiens
gguagaaggugccauucag

SEQ ID NO: 579131 - RNA, 19 nt, Homo sapiens
gggaaggcucugucucuaa

SEQ ID NO: 579132 - RNA, 19 nt, Homo sapiens
cagaggaggacaucaagaa

SEQ ID NO: 579133 - RNA, 19 nt, Homo sapiens
agauggcucugucuucuug

SEQ ID NO: 579134 - RNA, 19 nt, Homo sapiens
gaacuacugcuccagaaac

SEQ ID NO: 579135 - RNA, 19 nt, Homo sapiens
ggagaacagcuuugacgau

SEQ ID NO: 579136 - RNA, 19 nt, Homo sapiens
ccagagcccugcaccaaac

SEQ ID NO: 579137 - RNA, 19 nt, Homo sapiens
gcagugucccgccaccuuu

SEQ ID NO: 579138 - RNA, 19 nt, Homo sapiens
aagcagaaguucaccucaa

SEQ ID NO: 579139 - RNA, 19 nt, Homo sapiens
gcacuggacaggcauagca

SEQ ID NO: 579140 - RNA, 19 nt, Homo sapiens
ugaaucgugucccaugaga

SEQ ID NO: 579141 - RNA, 19 nt, Homo sapiens
ggaguccacaucuggcuuu

SEQ ID NO: 579142 - RNA, 19 nt, Homo sapiens
gcagcccuccuucuuuauu

SEQ ID NO: 579143 - RNA, 19 nt, Homo sapiens
gaauucauccgggaaagga

SEQ ID NO: 579144 - RNA, 19 nt, Homo sapiens
aggcuuggcuccugucuuc

SEQ ID NO: 579145 - RNA, 19 nt, Homo sapiens
gagcuacugcgacuacuuc

SEQ ID NO: 579146 - RNA, 19 nt, Homo sapiens
ggacgaagcagaaguucac

SEQ ID NO: 579147 - RNA, 19 nt, Homo sapiens
cgggaaaggauaaagauug

SEQ ID NO: 579148 - RNA, 19 nt, Homo sapiens
caauauggagaacagcuuu

SEQ ID NO: 579149 - RNA, 19 nt, Homo sapiens
gcugaagggcaaacaaaug

SEQ ID NO: 579150 - RNA, 19 nt, Homo sapiens
gcucugucuucuuguguau

SEQ ID NO: 579151 - RNA, 19 nt, Homo sapiens
gcccugcaccaaacccuua

SEQ ID NO: 579152 - RNA, 19 nt, Homo sapiens
cuacgucauucggcaaauu

SEQ ID NO: 579153 - RNA, 19 nt, Homo sapiens
ccagcuggcucccuugucu

SEQ ID NO: 579154 - RNA, 19 nt, Homo sapiens
caaccaggcccaguccaaa

SEQ ID NO: 579155 - RNA, 19 nt, Homo sapiens
caccguggcuggguuugaa

SEQ ID NO: 579156 - RNA, 19 nt, Homo sapiens
caagaaagacaugaagaag

SEQ ID NO: 579157 - RNA, 19 nt, Homo sapiens
aaggaaaugucagaauuca

SEQ ID NO: 579158 - RNA, 19 nt, Homo sapiens
cagcugaagggcaaacaaa

SEQ ID NO: 579159 - RNA, 19 nt, Homo sapiens
agacagaggaggacaucaa

SEQ ID NO: 579160 - RNA, 19 nt, Homo sapiens
caauaaacugugugacguu

SEQ ID NO: 579161 - RNA, 19 nt, Homo sapiens
agaucaagcugagcaacaa

SEQ ID NO: 579162 - RNA, 19 nt, Homo sapiens
gagaucaagcugagcaaca

SEQ ID NO: 579163 - RNA, 19 nt, Homo sapiens
cagaaguucaccucaaguu

SEQ ID NO: 579164 - RNA, 19 nt, Homo sapiens
uuccaaaguucucaguuau

SEQ ID NO: 579165 - RNA, 19 nt, Homo sapiens
caaauugagcgcugaaucg

SEQ ID NO: 579166 - RNA, 19 nt, Homo sapiens
gggcccaggugaagaagag

SEQ ID NO: 579167 - RNA, 19 nt, Homo sapiens
gacuacuucugggcugaua

SEQ ID NO: 579168 - RNA, 19 nt, Homo sapiens
uauggugacuuaggauuca

SEQ ID NO: 579169 - RNA, 19 nt, Homo sapiens
guaaagucuccucuggaaa

SEQ ID NO: 579170 - RNA, 19 nt, Homo sapiens
ccagggcuuuggaggauca

SEQ ID NO: 579171 - RNA, 19 nt, Homo sapiens
gcagaaggaaaugucagaa

SEQ ID NO: 579172 - RNA, 19 nt, Homo sapiens
cagacacgaugccggaaca

SEQ ID NO: 579173 - RNA, 19 nt, Homo sapiens
ggugucaggaucagaauca

SEQ ID NO: 579174 - RNA, 19 nt, Homo sapiens
ggcucugucuucuugugua

SEQ ID NO: 579175 - RNA, 19 nt, Homo sapiens
guguggaucucuacaacca

SEQ ID NO: 579176 - RNA, 19 nt, Homo sapiens
agacuaugcgaagaacuua

SEQ ID NO: 579177 - RNA, 19 nt, Homo sapiens
ggacuuagcuggguuuauu

SEQ ID NO: 579178 - RNA, 19 nt, Homo sapiens
guacuacucugcuucuuua

SEQ ID NO: 579179 - RNA, 19 nt, Homo sapiens
ggauaaagauugaagaaga

SEQ ID NO: 579180 - RNA, 19 nt, Homo sapiens
agaaaccgaugacuuauua

SEQ ID NO: 579181 - RNA, 19 nt, Homo sapiens
gagaauugcuuucguauag

SEQ ID NO: 579182 - RNA, 19 nt, Homo sapiens
gcucacggcuuuaggauaa

SEQ ID NO: 579183 - RNA, 19 nt, Homo sapiens
ccucugggauucuuuauua

SEQ ID NO: 579184 - RNA, 19 nt, Homo sapiens
gcaaacaaaugcagaagga

SEQ ID NO: 579185 - RNA, 19 nt, Homo sapiens
gagagcacuucuaauguua

SEQ ID NO: 579186 - RNA, 19 nt, Homo sapiens
gcuagaaaccgaugacuua

SEQ ID NO: 579187 - RNA, 19 nt, Homo sapiens
gcacaaaggccuucaccua

SEQ ID NO: 579188 - RNA, 19 nt, Homo sapiens
ggagagagcacuucuaaug

SEQ ID NO: 579189 - RNA, 19 nt, Homo sapiens
gcauguaccuccucccuuu

SEQ ID NO: 579190 - RNA, 19 nt, Homo sapiens
uggcaacccugauugauua

SEQ ID NO: 579191 - RNA, 19 nt, Homo sapiens
ugagagagaugccguggua

SEQ ID NO: 579192 - RNA, 19 nt, Homo sapiens
guaauugcuuuguggcuua

SEQ ID NO: 579193 - RNA, 19 nt, Homo sapiens
caaaugguguuccaaguug

SEQ ID NO: 579194 - RNA, 19 nt, Homo sapiens
gcuaugaaauugccaguga

SEQ ID NO: 579195 - RNA, 19 nt, Homo sapiens
gggaaaggauaaagauuga

SEQ ID NO: 579196 - RNA, 19 nt, Homo sapiens
caaaccagcucgucucaga

SEQ ID NO: 579197 - RNA, 19 nt, Homo sapiens
ugaaggcguuugcuauaua

SEQ ID NO: 579198 - RNA, 19 nt, Homo sapiens
cuacucugcuucuuuauuu

SEQ ID NO: 579199 - RNA, 19 nt, Homo sapiens
gugcuuaggugaggacuua

SEQ ID NO: 579200 - RNA, 19 nt, Homo sapiens
ggauugcaguggaauguaa

SEQ ID NO: 579201 - RNA, 19 nt, Homo sapiens
gaagaagacuaugcgaaga

SEQ ID NO: 579202 - RNA, 19 nt, Homo sapiens
caaauuuagugucuuguga

SEQ ID NO: 579203 - RNA, 19 nt, Homo sapiens
ucacguacuuccuuucuuu

SEQ ID NO: 579204 - RNA, 19 nt, Homo sapiens
ggagagagcuggugauucc

SEQ ID NO: 579205 - RNA, 19 nt, Homo sapiens
gaaaacaccaucacaauaa

SEQ ID NO: 579206 - RNA, 19 nt, Homo sapiens
gaagcagcauggacaagaa

SEQ ID NO: 579207 - RNA, 19 nt, Homo sapiens
agaaggaaaugucagaauu

SEQ ID NO: 579208 - RNA, 19 nt, Homo sapiens
ggacaggcgugaagaugga

SEQ ID NO: 579209 - RNA, 19 nt, Homo sapiens
gagcaagacuccaucucaa

SEQ ID NO: 579210 - RNA, 19 nt, Homo sapiens
gaauugcuuucguauaguu

SEQ ID NO: 579211 - RNA, 19 nt, Homo sapiens
agaaagacaugaagaagug

SEQ ID NO: 579212 - RNA, 19 nt, Homo sapiens
ggaaauacaagccauaaca

SEQ ID NO: 579213 - RNA, 19 nt, Homo sapiens
gcucaaggguaaccaguga

SEQ ID NO: 579214 - RNA, 19 nt, Homo sapiens
gaacuuccgugagaacuuc

SEQ ID NO: 579215 - RNA, 19 nt, Homo sapiens
ccaaagacagugcaaguaa

SEQ ID NO: 579216 - RNA, 19 nt, Homo sapiens
cgucugaucuggcugcuaa

SEQ ID NO: 579217 - RNA, 19 nt, Homo sapiens
ggauggaacuaccucauuc

SEQ ID NO: 579218 - RNA, 19 nt, Homo sapiens
agagagaccuggagaugaa

SEQ ID NO: 579219 - RNA, 19 nt, Homo sapiens
gaagugcgaccaccacauu

SEQ ID NO: 579220 - RNA, 19 nt, Homo sapiens
caguuguccugcauuauua

SEQ ID NO: 579221 - RNA, 19 nt, Homo sapiens
gagguaaacacuccacuaa

SEQ ID NO: 579222 - RNA, 19 nt, Homo sapiens
gaaacaguguaccaacgaa

SEQ ID NO: 579223 - RNA, 19 nt, Homo sapiens
ccagugaggcuaugaaauu

SEQ ID NO: 579224 - RNA, 19 nt, Homo sapiens
ccacuaagcugugucuugu

SEQ ID NO: 579225 - RNA, 19 nt, Homo sapiens
uaugagcuguuaagaauga

SEQ ID NO: 579226 - RNA, 19 nt, Homo sapiens
guagacagcaacaagauuu

SEQ ID NO: 579227 - RNA, 19 nt, Homo sapiens
gcacaacucacuggucuuu

SEQ ID NO: 579228 - RNA, 19 nt, Homo sapiens
gaucaggcgccaucuguaa

SEQ ID NO: 579229 - RNA, 19 nt, Homo sapiens
aaacagaggcuggaacuuu

SEQ ID NO: 579230 - RNA, 19 nt, Homo sapiens
ggaaaugucagaauucauc

SEQ ID NO: 579231 - RNA, 19 nt, Homo sapiens
aaccaaacguugucacuuu

SEQ ID NO: 579232 - RNA, 19 nt, Homo sapiens
ccaaaguucucaguuauca

SEQ ID NO: 579233 - RNA, 19 nt, Homo sapiens
caaguucucugccaagcuu

SEQ ID NO: 579234 - RNA, 19 nt, Homo sapiens
ggacucugcuggguugaaa

SEQ ID NO: 579235 - RNA, 19 nt, Homo sapiens
caaagacagugcaaguaau

SEQ ID NO: 579236 - RNA, 19 nt, Homo sapiens
agagagcacuucuaauguu

SEQ ID NO: 579237 - RNA, 19 nt, Homo sapiens
auacaguuguccugcauua

SEQ ID NO: 579238 - RNA, 19 nt, Homo sapiens
gaucuuugauaguauguuc

SEQ ID NO: 579239 - RNA, 19 nt, Homo sapiens
ugugaaagccugauuuaaa

SEQ ID NO: 579240 - RNA, 19 nt, Homo sapiens
guacuuccuuucuuucuuc

SEQ ID NO: 579241 - RNA, 19 nt, Homo sapiens
gaaggaaaugucagaauuc

SEQ ID NO: 579242 - RNA, 19 nt, Homo sapiens
aagugaagcucaaggguaa

SEQ ID NO: 579243 - RNA, 19 nt, Homo sapiens
gauggaagguagacagcaa

SEQ ID NO: 579244 - RNA, 19 nt, Homo sapiens
cauaggcacucuacagaau

SEQ ID NO: 579245 - RNA, 19 nt, Homo sapiens
uugcagcccuccuucuuua

SEQ ID NO: 579246 - RNA, 19 nt, Homo sapiens
gugagaacuucaagaaaga

SEQ ID NO: 579247 - RNA, 19 nt, Homo sapiens
gguaaacacuccacuaagc

SEQ ID NO: 579248 - RNA, 19 nt, Homo sapiens
ucacagagcggcagagaga

SEQ ID NO: 579249 - RNA, 19 nt, Homo sapiens
gacccaggcuucaguguca

SEQ ID NO: 579250 - RNA, 19 nt, Homo sapiens
ucaccaagaucaaccuguu

SEQ ID NO: 579251 - RNA, 19 nt, Homo sapiens
ccaaucaauuacuagauga

SEQ ID NO: 579252 - RNA, 19 nt, Homo sapiens
ggagacugaugcacaagau

SEQ ID NO: 579253 - RNA, 19 nt, Homo sapiens
aaugagaauugcuuucgua

SEQ ID NO: 579254 - RNA, 19 nt, Homo sapiens
gggcagaauucaacaagca

SEQ ID NO: 579255 - RNA, 19 nt, Homo sapiens
uggcccagcucauuacuuu

SEQ ID NO: 579256 - RNA, 19 nt, Homo sapiens
cuucagggauggaaacaaa

SEQ ID NO: 579257 - RNA, 19 nt, Homo sapiens
uguaaagucuccucuggaa

SEQ ID NO: 579258 - RNA, 19 nt, Homo sapiens
ggaaaacaccaucacaaua

SEQ ID NO: 579259 - RNA, 19 nt, Homo sapiens
gcacaucggcaaacccuau

SEQ ID NO: 579260 - RNA, 19 nt, Homo sapiens
gcgauggccuuuggagauu

SEQ ID NO: 579261 - RNA, 19 nt, Homo sapiens
gugaaagccugauuuaaaa

SEQ ID NO: 579262 - RNA, 19 nt, Homo sapiens
uuuccaaaguucucaguua

SEQ ID NO: 579263 - RNA, 19 nt, Homo sapiens
gcccugcccuugucucuga

SEQ ID NO: 579264 - RNA, 19 nt, Homo sapiens
gcuaagcucucucagaacu

SEQ ID NO: 579265 - RNA, 19 nt, Homo sapiens
ccuccucccuuucucauuu

SEQ ID NO: 579266 - RNA, 19 nt, Homo sapiens
ccucugcucuccucuauuc

SEQ ID NO: 579267 - RNA, 19 nt, Homo sapiens
gaucuaaucugaggacacu

SEQ ID NO: 579268 - RNA, 19 nt, Homo sapiens
uggaucagcugcuucgaaa

SEQ ID NO: 579269 - RNA, 19 nt, Homo sapiens
cgugagaacuucaagaaag

SEQ ID NO: 579270 - RNA, 19 nt, Homo sapiens
gauaaagauugaagaagac

SEQ ID NO: 579271 - RNA, 19 nt, Homo sapiens
gaaggcguuugcuauauac

SEQ ID NO: 579272 - RNA, 19 nt, Homo sapiens
cugccuagaucaguaaaua

SEQ ID NO: 579273 - RNA, 19 nt, Homo sapiens
ucccucagcuuaaugcuuu

SEQ ID NO: 579274 - RNA, 19 nt, Homo sapiens
ucacacugaugucgccuuu

SEQ ID NO: 579275 - RNA, 19 nt, Homo sapiens
caggaagagccacuuguua

SEQ ID NO: 579276 - RNA, 19 nt, Homo sapiens
gugacaaccuccaggaaga

SEQ ID NO: 579277 - RNA, 19 nt, Homo sapiens
ggaaagccaucaccaaguc

SEQ ID NO: 579278 - RNA, 19 nt, Homo sapiens
gaaucaggcuccaggaaug

SEQ ID NO: 579279 - RNA, 19 nt, Homo sapiens
ggacagcuuucucugacuu

SEQ ID NO: 579280 - RNA, 19 nt, Homo sapiens
ccaaggaccuggccaagca

SEQ ID NO: 579281 - RNA, 19 nt, Homo sapiens
gaaauucaacagccgcuuu

SEQ ID NO: 579282 - RNA, 19 nt, Homo sapiens
gcacaggaugagauuuaua

SEQ ID NO: 579283 - RNA, 19 nt, Homo sapiens
caaccagggugcaaagauc

SEQ ID NO: 579284 - RNA, 19 nt, Homo sapiens
ccaccucacugccacauuc

SEQ ID NO: 579285 - RNA, 19 nt, Homo sapiens
gcucugccgugcccacauu

SEQ ID NO: 579286 - RNA, 19 nt, Homo sapiens
aacagccgcuuucggaaua

SEQ ID NO: 579287 - RNA, 19 nt, Homo sapiens
gaggaaguccagcaagaaa

SEQ ID NO: 579288 - RNA, 19 nt, Homo sapiens
cggcagcacuaccagauga

SEQ ID NO: 579289 - RNA, 19 nt, Homo sapiens
ggagauguaccgcaaagug

SEQ ID NO: 579290 - RNA, 19 nt, Homo sapiens
aggaggcgcuggagaugua

SEQ ID NO: 579291 - RNA, 19 nt, Homo sapiens
cagaugagccuguguccaa

SEQ ID NO: 579292 - RNA, 19 nt, Homo sapiens
aagauaaauuuccgcugua

SEQ ID NO: 579293 - RNA, 19 nt, Homo sapiens
ucgcacaggaugagauuua

SEQ ID NO: 579294 - RNA, 19 nt, Homo sapiens
gagcagcuggagaagauaa

SEQ ID NO: 579295 - RNA, 19 nt, Homo sapiens
ucaacuaugugacugagau

SEQ ID NO: 579296 - RNA, 19 nt, Homo sapiens
caagguguccugcuucaug

SEQ ID NO: 579297 - RNA, 19 nt, Homo sapiens
ggagcgagucagcgacaua

SEQ ID NO: 579298 - RNA, 19 nt, Homo sapiens
gaagucagugucucgaaga

SEQ ID NO: 579299 - RNA, 19 nt, Homo sapiens
aagaggaaguccagcaaga

SEQ ID NO: 579300 - RNA, 19 nt, Homo sapiens
ucgagcagcuggagaagau

SEQ ID NO: 579301 - RNA, 19 nt, Homo sapiens
ugaaagcaagcaagaagaa

SEQ ID NO: 579302 - RNA, 19 nt, Homo sapiens
agauaaauuuccgcuguaa

SEQ ID NO: 579303 - RNA, 19 nt, Homo sapiens
caagaggaacgacuucugu

SEQ ID NO: 579304 - RNA, 19 nt, Homo sapiens
uggagacccuucaucauca

SEQ ID NO: 579305 - RNA, 19 nt, Homo sapiens
gaucgcacaggaugagauu

SEQ ID NO: 579306 - RNA, 19 nt, Homo sapiens
caacagccgcuuucggaau

SEQ ID NO: 579307 - RNA, 19 nt, Homo sapiens
gcaucgagcagcuggagaa

SEQ ID NO: 579308 - RNA, 19 nt, Homo sapiens
ggagaccuguuugcaccaa

SEQ ID NO: 579309 - RNA, 19 nt, Homo sapiens
gggccucgcucaugaagac

SEQ ID NO: 579310 - RNA, 19 nt, Homo sapiens
gggagcaccacgacuuuga

SEQ ID NO: 579311 - RNA, 19 nt, Homo sapiens
ccaaggaggcgcuggagau

SEQ ID NO: 579312 - RNA, 19 nt, Homo sapiens
gcaagcaagaagaagaaga

SEQ ID NO: 579313 - RNA, 19 nt, Homo sapiens
cacaggaugagauuuauau

SEQ ID NO: 579314 - RNA, 19 nt, Homo sapiens
gcaaccagggugcaaagau

SEQ ID NO: 579315 - RNA, 19 nt, Homo sapiens
gagcggcagauccggagua

SEQ ID NO: 579316 - RNA, 19 nt, Homo sapiens
gcacuggcagcaaggaugu

SEQ ID NO: 579317 - RNA, 19 nt, Homo sapiens
gaggaacgacuucuguaag

SEQ ID NO: 579318 - RNA, 19 nt, Homo sapiens
agaggaacgacuucuguaa

SEQ ID NO: 579319 - RNA, 19 nt, Homo sapiens
aagagggcauccuucaaga

SEQ ID NO: 579320 - RNA, 19 nt, Homo sapiens
gucagugucucgaagaaag

SEQ ID NO: 579321 - RNA, 19 nt, Homo sapiens
cgaguggugugugauggaa

SEQ ID NO: 579322 - RNA, 19 nt, Homo sapiens
aaagcaagcaagaagaaga

SEQ ID NO: 579323 - RNA, 19 nt, Homo sapiens
agacacggcuggguuggau

SEQ ID NO: 579324 - RNA, 19 nt, Homo sapiens
ggaaguccagcaagaaagg

SEQ ID NO: 579325 - RNA, 19 nt, Homo sapiens
gagcgagucagcgacauau

SEQ ID NO: 579326 - RNA, 19 nt, Homo sapiens
caagcaagaagaagaagag

SEQ ID NO: 579327 - RNA, 19 nt, Homo sapiens
gcucuucgggcacaggaaa

SEQ ID NO: 579328 - RNA, 19 nt, Homo sapiens
ggaacgacuucuguaagcu

SEQ ID NO: 579329 - RNA, 19 nt, Homo sapiens
gaaagcaagcaagaagaag

SEQ ID NO: 579330 - RNA, 19 nt, Homo sapiens
gcaccacuggguacacaga

SEQ ID NO: 579331 - RNA, 19 nt, Homo sapiens
ugaaucaggcuccaggaau

SEQ ID NO: 579332 - RNA, 19 nt, Homo sapiens
gggugugacucaguaaagu

SEQ ID NO: 579333 - RNA, 19 nt, Homo sapiens
gcaccgagacgagcagagu

SEQ ID NO: 579334 - RNA, 19 nt, Homo sapiens
uagccaggaugcugaaguc

SEQ ID NO: 579335 - RNA, 19 nt, Homo sapiens
gagaggccaacccagagaa

SEQ ID NO: 579336 - RNA, 19 nt, Homo sapiens
agaagaagagggcauccuu

SEQ ID NO: 579337 - RNA, 19 nt, Homo sapiens
cagcuggagaagauaaauu

SEQ ID NO: 579338 - RNA, 19 nt, Homo sapiens
acuaugaggcccugcacua

SEQ ID NO: 579339 - RNA, 19 nt, Homo sapiens
uggaugucuucaacaacua

SEQ ID NO: 579340 - RNA, 19 nt, Homo sapiens
caaggaggcgcuggagaug

SEQ ID NO: 579341 - RNA, 19 nt, Homo sapiens
aagcaagcaagaagaagaa

SEQ ID NO: 579342 - RNA, 19 nt, Homo sapiens
gaagggauuccagcagaag

SEQ ID NO: 579343 - RNA, 19 nt, Homo sapiens
ucagcaugcacgacuauga

SEQ ID NO: 579344 - RNA, 19 nt, Homo sapiens
ccacgucacccuggaguuc

SEQ ID NO: 579345 - RNA, 19 nt, Homo sapiens
ggagacccuucaucaucag

SEQ ID NO: 579346 - RNA, 19 nt, Homo sapiens
gcgagucagcgacauaugg

SEQ ID NO: 579347 - RNA, 19 nt, Homo sapiens
aagaggaacgacuucugua

SEQ ID NO: 579348 - RNA, 19 nt, Homo sapiens
ucaagaggaaguccagcaa

SEQ ID NO: 579349 - RNA, 19 nt, Homo sapiens
uggagaaccggcagcacua

SEQ ID NO: 579350 - RNA, 19 nt, Homo sapiens
ggccaacccagagaaauuc

SEQ ID NO: 579351 - RNA, 19 nt, Homo sapiens
gaugagccuguguccaaga

SEQ ID NO: 579352 - RNA, 19 nt, Homo sapiens
gcucacagggaacaagaca

SEQ ID NO: 579353 - RNA, 19 nt, Homo sapiens
gcuucaccaugacgucguu

SEQ ID NO: 579354 - RNA, 19 nt, Homo sapiens
ggaccuggccaagcacauc

SEQ ID NO: 579355 - RNA, 19 nt, Homo sapiens
cuggaugucuucaacaacu

SEQ ID NO: 579356 - RNA, 19 nt, Homo sapiens
cggcagauccggaguacag

SEQ ID NO: 579357 - RNA, 19 nt, Homo sapiens
gugaaucaggcuccaggaa

SEQ ID NO: 579358 - RNA, 19 nt, Homo sapiens
cgagaggccaacccagaga

SEQ ID NO: 579359 - RNA, 19 nt, Homo sapiens
ccaggagacggcuguguag

SEQ ID NO: 579360 - RNA, 19 nt, Homo sapiens
gggagcacaucugguucga

SEQ ID NO: 579361 - RNA, 19 nt, Homo sapiens
ccaagaggaacgacuucug

SEQ ID NO: 579362 - RNA, 19 nt, Homo sapiens
caggagacagugaccuaga

SEQ ID NO: 579363 - RNA, 19 nt, Homo sapiens
cccuggaugucuucaacaa

SEQ ID NO: 579364 - RNA, 19 nt, Homo sapiens
acaggaaagccaucaccaa

SEQ ID NO: 579365 - RNA, 19 nt, Homo sapiens
gaaaggaaaugauuacugu

SEQ ID NO: 579366 - RNA, 19 nt, Homo sapiens
ggaagcagauggaauuaaa

SEQ ID NO: 579367 - RNA, 19 nt, Homo sapiens
gaaauucucuaucagcuau

SEQ ID NO: 579368 - RNA, 19 nt, Homo sapiens
gcaagaauguaaagauuug

SEQ ID NO: 579369 - RNA, 19 nt, Homo sapiens
guacucuucucccauauua

SEQ ID NO: 579370 - RNA, 19 nt, Homo sapiens
uaucagcuauucagucuua

SEQ ID NO: 579371 - RNA, 19 nt, Homo sapiens
gcaaggagauuaugcucaa

SEQ ID NO: 579372 - RNA, 19 nt, Homo sapiens
gcaaguagauacauguuca

SEQ ID NO: 579373 - RNA, 19 nt, Homo sapiens
ggaaaugauuacugucaaa

SEQ ID NO: 579374 - RNA, 19 nt, Homo sapiens
ggacgagacuuacccucua

SEQ ID NO: 579375 - RNA, 19 nt, Homo sapiens
uaaacuagaucgauggaaa

SEQ ID NO: 579376 - RNA, 19 nt, Homo sapiens
acagauaagugaauuggua

SEQ ID NO: 579377 - RNA, 19 nt, Homo sapiens
ccaaguguauguauugauu

SEQ ID NO: 579378 - RNA, 19 nt, Homo sapiens
gcaacgaucuauccaauac

SEQ ID NO: 579379 - RNA, 19 nt, Homo sapiens
gaacuuauucagacacgua

SEQ ID NO: 579380 - RNA, 19 nt, Homo sapiens
caagacacaugcaaugaug

SEQ ID NO: 579381 - RNA, 19 nt, Homo sapiens
gaaggcaccaucucuguuu

SEQ ID NO: 579382 - RNA, 19 nt, Homo sapiens
gugcaagaauguaaagauu

SEQ ID NO: 579383 - RNA, 19 nt, Homo sapiens
caaaccaaguguauguauu

SEQ ID NO: 579384 - RNA, 19 nt, Homo sapiens
gaauuuaggaucuuguuga

SEQ ID NO: 579385 - RNA, 19 nt, Homo sapiens
ugaaguaugugcugucuca

SEQ ID NO: 579386 - RNA, 19 nt, Homo sapiens
gcuauucagucuuaauuuc

SEQ ID NO: 579387 - RNA, 19 nt, Homo sapiens
caccauaacucacaagaca

SEQ ID NO: 579388 - RNA, 19 nt, Homo sapiens
gcccugcacugucaccaua

SEQ ID NO: 579389 - RNA, 19 nt, Homo sapiens
aaccaaagauuguuuagug

SEQ ID NO: 579390 - RNA, 19 nt, Homo sapiens
guugaugacaugaagauua

SEQ ID NO: 579391 - RNA, 19 nt, Homo sapiens
gagauuaugcucaagaaug

SEQ ID NO: 579392 - RNA, 19 nt, Homo sapiens
caagggcccugcacuguca

SEQ ID NO: 579393 - RNA, 19 nt, Homo sapiens
gugcucagauucaaguaaa

SEQ ID NO: 579394 - RNA, 19 nt, Homo sapiens
cuagaucgauggaaaguuc

SEQ ID NO: 579395 - RNA, 19 nt, Homo sapiens
ggaaaguucaaguaacaaa

SEQ ID NO: 579396 - RNA, 19 nt, Homo sapiens
aacccaagcuuugcgauua

SEQ ID NO: 579397 - RNA, 19 nt, Homo sapiens
agauuaugcucaagaauga

SEQ ID NO: 579398 - RNA, 19 nt, Homo sapiens
cacauuauaucuccaacaa

SEQ ID NO: 579399 - RNA, 19 nt, Homo sapiens
ggacaggcacauacaguga

SEQ ID NO: 579400 - RNA, 19 nt, Homo sapiens
caaagauuguuuagugcaa

SEQ ID NO: 579401 - RNA, 19 nt, Homo sapiens
gcagauggaauuaaacuag

SEQ ID NO: 579402 - RNA, 19 nt, Homo sapiens
guagauacauguucaucca

SEQ ID NO: 579403 - RNA, 19 nt, Homo sapiens
gagaacaaacagaugauga

SEQ ID NO: 579404 - RNA, 19 nt, Homo sapiens
cccaaggaauucacaauga

SEQ ID NO: 579405 - RNA, 19 nt, Homo sapiens
gaagauuaagggacaagaa

SEQ ID NO: 579406 - RNA, 19 nt, Homo sapiens
ggaugcaguugaugacaug

SEQ ID NO: 579407 - RNA, 19 nt, Homo sapiens
gaaggacuguugggagaau

SEQ ID NO: 579408 - RNA, 19 nt, Homo sapiens
guggaaagaucaaauuaac

SEQ ID NO: 579409 - RNA, 19 nt, Homo sapiens
cagccagccuucaguuauu

SEQ ID NO: 579410 - RNA, 19 nt, Homo sapiens
ucagaugcguaaagacaaa

SEQ ID NO: 579411 - RNA, 19 nt, Homo sapiens
ugugcugucucaugucuua

SEQ ID NO: 579412 - RNA, 19 nt, Homo sapiens
aaacuuacaugagagugaa

SEQ ID NO: 579413 - RNA, 19 nt, Homo sapiens
gagcugcaauucaggaucu

SEQ ID NO: 579414 - RNA, 19 nt, Homo sapiens
gguggaaagaucaaauuaa

SEQ ID NO: 579415 - RNA, 19 nt, Homo sapiens
uaaaggcgacugaauagau

SEQ ID NO: 579416 - RNA, 19 nt, Homo sapiens
ggcgguggcugcagacuau

SEQ ID NO: 579417 - RNA, 19 nt, Homo sapiens
cagcuuggaagguauuaua

SEQ ID NO: 579418 - RNA, 19 nt, Homo sapiens
gaguagcacugcccagcuu

SEQ ID NO: 579419 - RNA, 19 nt, Homo sapiens
cagauggaauuaaacuaga

SEQ ID NO: 579420 - RNA, 19 nt, Homo sapiens
aaaguacauuccacaaguu

SEQ ID NO: 579421 - RNA, 19 nt, Homo sapiens
uuaaucagaugcguaaaga

SEQ ID NO: 579422 - RNA, 19 nt, Homo sapiens
gaucaaauuaaccugcuuu

SEQ ID NO: 579423 - RNA, 19 nt, Homo sapiens
gcugucucaugucuuauuu

SEQ ID NO: 579424 - RNA, 19 nt, Homo sapiens
auauaaaggcgacugaaua

SEQ ID NO: 579425 - RNA, 19 nt, Homo sapiens
ucuguacucuucucccaua

SEQ ID NO: 579426 - RNA, 19 nt, Homo sapiens
gcaguggaccccauuaaua

SEQ ID NO: 579427 - RNA, 19 nt, Homo sapiens
aaaggcgacugaauagaug

SEQ ID NO: 579428 - RNA, 19 nt, Homo sapiens
gaagguauuauaguucuga

SEQ ID NO: 579429 - RNA, 19 nt, Homo sapiens
ucucauggcucucaauuuu

SEQ ID NO: 579430 - RNA, 19 nt, Homo sapiens
ggaauuaaacuagaucgau

SEQ ID NO: 579431 - RNA, 19 nt, Homo sapiens
uaucaaagcccuacaacuc

SEQ ID NO: 579432 - RNA, 19 nt, Homo sapiens
gagaaacagauaagugaau

SEQ ID NO: 579433 - RNA, 19 nt, Homo sapiens
aaaccaaguguauguauug

SEQ ID NO: 579434 - RNA, 19 nt, Homo sapiens
ccagcaugguuaauuguga

SEQ ID NO: 579435 - RNA, 19 nt, Homo sapiens
gauauaaaggcgacugaau

SEQ ID NO: 579436 - RNA, 19 nt, Homo sapiens
uuaauaaggcgguuuacuu

SEQ ID NO: 579437 - RNA, 19 nt, Homo sapiens
gauuacaggugcauuuggu

SEQ ID NO: 579438 - RNA, 19 nt, Homo sapiens
ggaaagaucaaauuaaccu

SEQ ID NO: 579439 - RNA, 19 nt, Homo sapiens
gauggaaaguucaaguaac

SEQ ID NO: 579440 - RNA, 19 nt, Homo sapiens
gaacaggcaacgaucuauc

SEQ ID NO: 579441 - RNA, 19 nt, Homo sapiens
uuauucagcucgaguacuu

SEQ ID NO: 579442 - RNA, 19 nt, Homo sapiens
ccauuaaucagaugcguaa

SEQ ID NO: 579443 - RNA, 19 nt, Homo sapiens
gaaacagauaagugaauug

SEQ ID NO: 579444 - RNA, 19 nt, Homo sapiens
ggguggaaagaucaaauua

SEQ ID NO: 579445 - RNA, 19 nt, Homo sapiens
gaacaaacagaugaugaca

SEQ ID NO: 579446 - RNA, 19 nt, Homo sapiens
uaagaaaacccaaggaauu

SEQ ID NO: 579447 - RNA, 19 nt, Homo sapiens
ggacuguugggagaauuua

SEQ ID NO: 579448 - RNA, 19 nt, Homo sapiens
aagagaaacagauaaguga

SEQ ID NO: 579449 - RNA, 19 nt, Homo sapiens
gggacucacucugaaguau

SEQ ID NO: 579450 - RNA, 19 nt, Homo sapiens
agauacauguucauccaaa

SEQ ID NO: 579451 - RNA, 19 nt, Homo sapiens
ucacaagacacaugcaaug

SEQ ID NO: 579452 - RNA, 19 nt, Homo sapiens
ccacugugcucagauucaa

SEQ ID NO: 579453 - RNA, 19 nt, Homo sapiens
cuuggaagguauuauaguu

SEQ ID NO: 579454 - RNA, 19 nt, Homo sapiens
gcgguuuacuuauucuaug

SEQ ID NO: 579455 - RNA, 19 nt, Homo sapiens
uuuaggaucuuguugaauc

SEQ ID NO: 579456 - RNA, 19 nt, Homo sapiens
ucagagcacuugggauugu

SEQ ID NO: 579457 - RNA, 19 nt, Homo sapiens
ggacacauuauaucuccaa

SEQ ID NO: 579458 - RNA, 19 nt, Homo sapiens
ucacgcaaguagauacaug

SEQ ID NO: 579459 - RNA, 19 nt, Homo sapiens
gaauaggacaggcacauac

SEQ ID NO: 579460 - RNA, 19 nt, Homo sapiens
aaagagaaacagauaagug

SEQ ID NO: 579461 - RNA, 19 nt, Homo sapiens
caacccaaaccaaguguau

SEQ ID NO: 579462 - RNA, 19 nt, Homo sapiens
cgauggaaaguucaaguaa

SEQ ID NO: 579463 - RNA, 19 nt, Homo sapiens
gggaacaggcaacgaucua

SEQ ID NO: 579464 - RNA, 19 nt, Homo sapiens
gauaagugaauugguaaga

SEQ ID NO: 579465 - RNA, 19 nt, Homo sapiens
ggaaggugguuguauguua

SEQ ID NO: 579466 - RNA, 19 nt, Homo sapiens
cagaaacccuagaguauua

SEQ ID NO: 579467 - RNA, 19 nt, Homo sapiens
gaagugcucuguccugaaa

SEQ ID NO: 579468 - RNA, 19 nt, Homo sapiens
gaaaguagcauggauguuu

SEQ ID NO: 579469 - RNA, 19 nt, Homo sapiens
caacacagcuaccuuugaa

SEQ ID NO: 579470 - RNA, 19 nt, Homo sapiens
ggaaggacaucauugaaga

SEQ ID NO: 579471 - RNA, 19 nt, Homo sapiens
gaagauaucccuggacuuu

SEQ ID NO: 579472 - RNA, 19 nt, Homo sapiens
gaaaagaaauggaagauug

SEQ ID NO: 579473 - RNA, 19 nt, Homo sapiens
gcaggaagcucaucuugug

SEQ ID NO: 579474 - RNA, 19 nt, Homo sapiens
gaaggaaaccuaccuguga

SEQ ID NO: 579475 - RNA, 19 nt, Homo sapiens
gcucagaggugcuuguaaa

SEQ ID NO: 579476 - RNA, 19 nt, Homo sapiens
gaacauaacaacacagcua

SEQ ID NO: 579477 - RNA, 19 nt, Homo sapiens
gcucugaacuaguagauga

SEQ ID NO: 579478 - RNA, 19 nt, Homo sapiens
caaggaagaugauacuuuc

SEQ ID NO: 579479 - RNA, 19 nt, Homo sapiens
gaacaaagaagcucacagu

SEQ ID NO: 579480 - RNA, 19 nt, Homo sapiens
ggagaaaugugucaugaac

SEQ ID NO: 579481 - RNA, 19 nt, Homo sapiens
gaucauagaacacacagaa

SEQ ID NO: 579482 - RNA, 19 nt, Homo sapiens
gaacaacuauuuuggcauu

SEQ ID NO: 579483 - RNA, 19 nt, Homo sapiens
gaaagcaauucgucagauc

SEQ ID NO: 579484 - RNA, 19 nt, Homo sapiens
gcacagaaccuacaagaac

SEQ ID NO: 579485 - RNA, 19 nt, Homo sapiens
agauaucccuggacuuuaa

SEQ ID NO: 579486 - RNA, 19 nt, Homo sapiens
uaacaacacagcuaccuuu

SEQ ID NO: 579487 - RNA, 19 nt, Homo sapiens
ucagucgccuguuaauuaa

SEQ ID NO: 579488 - RNA, 19 nt, Homo sapiens
ucucagggaugcacaauug

SEQ ID NO: 579489 - RNA, 19 nt, Homo sapiens
cagaggugcuuguaaaugu

SEQ ID NO: 579490 - RNA, 19 nt, Homo sapiens
agaaaugugucaugaacaa

SEQ ID NO: 579491 - RNA, 19 nt, Homo sapiens
cagcgaggauuccgaggua

SEQ ID NO: 579492 - RNA, 19 nt, Homo sapiens
ccaaacagaacaauucauu

SEQ ID NO: 579493 - RNA, 19 nt, Homo sapiens
gcaaggaguuggguuugga

SEQ ID NO: 579494 - RNA, 19 nt, Homo sapiens
ggagugcucuugccgagau

SEQ ID NO: 579495 - RNA, 19 nt, Homo sapiens
gaaggugguuguauguuac

SEQ ID NO: 579496 - RNA, 19 nt, Homo sapiens
ccaaggaagaugauacuuu

SEQ ID NO: 579497 - RNA, 19 nt, Homo sapiens
agucaucagucgccuguua

SEQ ID NO: 579498 - RNA, 19 nt, Homo sapiens
gggaagagguuucuguaac

SEQ ID NO: 579499 - RNA, 19 nt, Homo sapiens
gaauugcuguccuuaacau

SEQ ID NO: 579500 - RNA, 19 nt, Homo sapiens
ccaagauccuguacccaaa

SEQ ID NO: 579501 - RNA, 19 nt, Homo sapiens
cgaggaggcugaagaugga

SEQ ID NO: 579502 - RNA, 19 nt, Homo sapiens
ggugugaaguuccucagaa

SEQ ID NO: 579503 - RNA, 19 nt, Homo sapiens
gaaauggaagauuggauug

SEQ ID NO: 579504 - RNA, 19 nt, Homo sapiens
cauaaguuguucuguguau

SEQ ID NO: 579505 - RNA, 19 nt, Homo sapiens
caaguuagaaugugaggaa

SEQ ID NO: 579506 - RNA, 19 nt, Homo sapiens
gguggaaggugguuguaug

SEQ ID NO: 579507 - RNA, 19 nt, Homo sapiens
gaggaaggaaugaacauga

SEQ ID NO: 579508 - RNA, 19 nt, Homo sapiens
ggaccacacuggccucgau

SEQ ID NO: 579509 - RNA, 19 nt, Homo sapiens
ccaaagagaaggacagugu

SEQ ID NO: 579510 - RNA, 19 nt, Homo sapiens
ccaaagagaaggacagugu

SEQ ID NO: 579511 - RNA, 19 nt, Homo sapiens
ggcaaagucaaucauauuu

SEQ ID NO: 579512 - RNA, 19 nt, Homo sapiens
ggaguuggguuuggaucaa

SEQ ID NO: 579513 - RNA, 19 nt, Homo sapiens
gggaauugcuguccuuaac

SEQ ID NO: 579514 - RNA, 19 nt, Homo sapiens
ugaaagagaagcuggauuc

SEQ ID NO: 579515 - RNA, 19 nt, Homo sapiens
gcgaugagcacccagagaa

SEQ ID NO: 579516 - RNA, 19 nt, Homo sapiens
ggcgaacgcuuuacuaugc

SEQ ID NO: 579517 - RNA, 19 nt, Homo sapiens
gguggagcgucauggcaua

SEQ ID NO: 579518 - RNA, 19 nt, Homo sapiens
ccagaaguuugacacauuc

SEQ ID NO: 579519 - RNA, 19 nt, Homo sapiens
ccacccagauggaccaguu

SEQ ID NO: 579520 - RNA, 19 nt, Homo sapiens
gaacagggagcacuuugag

SEQ ID NO: 579521 - RNA, 19 nt, Homo sapiens
gcacugacuuugcccuuuu

SEQ ID NO: 579522 - RNA, 19 nt, Homo sapiens
ggaaauggugaauaacuuc

SEQ ID NO: 579523 - RNA, 19 nt, Homo sapiens
gaugugguauggaguucuu

SEQ ID NO: 579524 - RNA, 19 nt, Homo sapiens
gaacgacuuggcccgagua

SEQ ID NO: 579525 - RNA, 19 nt, Homo sapiens
aagauuggauugcagcauu

SEQ ID NO: 579526 - RNA, 19 nt, Homo sapiens
ccacggcagucgcuugguu

SEQ ID NO: 579527 - RNA, 19 nt, Homo sapiens
gugguuguauguuaccuuu

SEQ ID NO: 579528 - RNA, 19 nt, Homo sapiens
gcagacagaggaugugugu

SEQ ID NO: 579529 - RNA, 19 nt, Homo sapiens
gauuguaauuugacgugaa

SEQ ID NO: 579530 - RNA, 19 nt, Homo sapiens
uacagcagauucucuucua

SEQ ID NO: 579531 - RNA, 19 nt, Homo sapiens
ugcgaggugugcaaauuua

SEQ ID NO: 579532 - RNA, 19 nt, Homo sapiens
ggaaggaucccugaagagu

SEQ ID NO: 579533 - RNA, 19 nt, Homo sapiens
gcccgaggcccuuagagua

SEQ ID NO: 579534 - RNA, 19 nt, Homo sapiens
ccagucuuguugauuguaa

SEQ ID NO: 579535 - RNA, 19 nt, Homo sapiens
ucacaguauccgagaaaua

SEQ ID NO: 579536 - RNA, 19 nt, Homo sapiens
ccagaaacccuagaguauu

SEQ ID NO: 579537 - RNA, 19 nt, Homo sapiens
gggaaggccuaugagaaga

SEQ ID NO: 579538 - RNA, 19 nt, Homo sapiens
ugaaguuccucagaagauu

SEQ ID NO: 579539 - RNA, 19 nt, Homo sapiens
caaccagggugugaaguuc

SEQ ID NO: 579540 - RNA, 19 nt, Homo sapiens
agauuggauugcagcauua

SEQ ID NO: 579541 - RNA, 19 nt, Homo sapiens
uacauaaguuguucugugu

SEQ ID NO: 579542 - RNA, 19 nt, Homo sapiens
gaccagagacagggcauuu

SEQ ID NO: 579543 - RNA, 19 nt, Homo sapiens
cacagacacugaccagaga

SEQ ID NO: 579544 - RNA, 19 nt, Homo sapiens
ggccguggcuucucuuugg

SEQ ID NO: 579545 - RNA, 19 nt, Homo sapiens
uggaaauggugaauaacuu

SEQ ID NO: 579546 - RNA, 19 nt, Homo sapiens
acaagaaccuggagcaaaa

SEQ ID NO: 579547 - RNA, 19 nt, Homo sapiens
ugaccaaacagaacaauuc

SEQ ID NO: 579548 - RNA, 19 nt, Homo sapiens
ccacggcucucaacagcau

SEQ ID NO: 579549 - RNA, 19 nt, Homo sapiens
ugagugcuguacauaaguu

SEQ ID NO: 579550 - RNA, 19 nt, Homo sapiens
gacaugaggaggauaaaca

SEQ ID NO: 579551 - RNA, 19 nt, Homo sapiens
acagaaagccuccgugaca

SEQ ID NO: 579552 - RNA, 19 nt, Homo sapiens
ccagagacagggcauuuga

SEQ ID NO: 579553 - RNA, 19 nt, Homo sapiens
uccagaaguuugacacauu

SEQ ID NO: 579554 - RNA, 19 nt, Homo sapiens
cauuaaagacugugcagaa

SEQ ID NO: 579555 - RNA, 19 nt, Homo sapiens
guuagaaugugaggaagga

SEQ ID NO: 579556 - RNA, 19 nt, Homo sapiens
aaaguagcauggauguuuc

SEQ ID NO: 579557 - RNA, 19 nt, Homo sapiens
acaaagaagcucacaguag

SEQ ID NO: 579558 - RNA, 19 nt, Homo sapiens
gcaauucgucagaucauag

SEQ ID NO: 579559 - RNA, 19 nt, Homo sapiens
aauuugacgugaagagaaa

SEQ ID NO: 579560 - RNA, 19 nt, Homo sapiens
aucagucgccuguuaauua

SEQ ID NO: 579561 - RNA, 19 nt, Homo sapiens
cgacuuggcccgaguacug

SEQ ID NO: 579562 - RNA, 19 nt, Homo sapiens
ccacuuggccugugcaaag

SEQ ID NO: 579563 - RNA, 19 nt, Homo sapiens
agaaauggaagauuggauu

SEQ ID NO: 579564 - RNA, 19 nt, Homo sapiens
gggaagacaagcagaagug

SEQ ID NO: 579565 - RNA, 19 nt, Homo sapiens
ggaaggugguuguauguua

SEQ ID NO: 579566 - RNA, 19 nt, Homo sapiens
cagaaacccuagaguauua

SEQ ID NO: 579567 - RNA, 19 nt, Homo sapiens
gaagugcucuguccugaaa

SEQ ID NO: 579568 - RNA, 19 nt, Homo sapiens
gaaaguagcauggauguuu

SEQ ID NO: 579569 - RNA, 19 nt, Homo sapiens
caacacagcuaccuuugaa

SEQ ID NO: 579570 - RNA, 19 nt, Homo sapiens
ggaaggacaucauugaaga

SEQ ID NO: 579571 - RNA, 19 nt, Homo sapiens
gaagauaucccuggacuuu

SEQ ID NO: 579572 - RNA, 19 nt, Homo sapiens
gaaaagaaauggaagauug

SEQ ID NO: 579573 - RNA, 19 nt, Homo sapiens
gcaggaagcucaucuugug

SEQ ID NO: 579574 - RNA, 19 nt, Homo sapiens
gaaggaaaccuaccuguga

SEQ ID NO: 579575 - RNA, 19 nt, Homo sapiens
gcucagaggugcuuguaaa

SEQ ID NO: 579576 - RNA, 19 nt, Homo sapiens
gaacauaacaacacagcua

SEQ ID NO: 579577 - RNA, 19 nt, Homo sapiens
gcucugaacuaguagauga

SEQ ID NO: 579578 - RNA, 19 nt, Homo sapiens
caaggaagaugauacuuuc

SEQ ID NO: 579579 - RNA, 19 nt, Homo sapiens
gaacaaagaagcucacagu

SEQ ID NO: 579580 - RNA, 19 nt, Homo sapiens
ggagaaaugugucaugaac

SEQ ID NO: 579581 - RNA, 19 nt, Homo sapiens
gaucauagaacacacagaa

SEQ ID NO: 579582 - RNA, 19 nt, Homo sapiens
gaacaacuauuuuggcauu

SEQ ID NO: 579583 - RNA, 19 nt, Homo sapiens
gaaagcaauucgucagauc

SEQ ID NO: 579584 - RNA, 19 nt, Homo sapiens
gcacagaaccuacaagaac

SEQ ID NO: 579585 - RNA, 19 nt, Homo sapiens
agauaucccuggacuuuaa

SEQ ID NO: 579586 - RNA, 19 nt, Homo sapiens
uaacaacacagcuaccuuu

SEQ ID NO: 579587 - RNA, 19 nt, Homo sapiens
ucagucgccuguuaauuaa

SEQ ID NO: 579588 - RNA, 19 nt, Homo sapiens
ucucagggaugcacaauug

SEQ ID NO: 579589 - RNA, 19 nt, Homo sapiens
ggucagauccgacagaaga

SEQ ID NO: 579590 - RNA, 19 nt, Homo sapiens
cagaggugcuuguaaaugu

SEQ ID NO: 579591 - RNA, 19 nt, Homo sapiens
agaaaugugucaugaacaa

SEQ ID NO: 579592 - RNA, 19 nt, Homo sapiens
cagcgaggauuccgaggua

SEQ ID NO: 579593 - RNA, 19 nt, Homo sapiens
ccaaacagaacaauucauu

SEQ ID NO: 579594 - RNA, 19 nt, Homo sapiens
gcaaggaguuggguuugga

SEQ ID NO: 579595 - RNA, 19 nt, Homo sapiens
ggagugcucuugccgagau

SEQ ID NO: 579596 - RNA, 19 nt, Homo sapiens
gaaggugguuguauguuac

SEQ ID NO: 579597 - RNA, 19 nt, Homo sapiens
ccaaggaagaugauacuuu

SEQ ID NO: 579598 - RNA, 19 nt, Homo sapiens
agucaucagucgccuguua

SEQ ID NO: 579599 - RNA, 19 nt, Homo sapiens
gggaagagguuucuguaac

SEQ ID NO: 579600 - RNA, 19 nt, Homo sapiens
gaauugcuguccuuaacau

SEQ ID NO: 579601 - RNA, 19 nt, Homo sapiens
ccaagauccuguacccaaa

SEQ ID NO: 579602 - RNA, 19 nt, Homo sapiens
agaagaccaucaucaaaga

SEQ ID NO: 579603 - RNA, 19 nt, Homo sapiens
cgaggaggcugaagaugga

SEQ ID NO: 579604 - RNA, 19 nt, Homo sapiens
ggugugaaguuccucagaa

SEQ ID NO: 579605 - RNA, 19 nt, Homo sapiens
gaaauggaagauuggauug

SEQ ID NO: 579606 - RNA, 19 nt, Homo sapiens
cauaaguuguucuguguau

SEQ ID NO: 579607 - RNA, 19 nt, Homo sapiens
caaguuagaaugugaggaa

SEQ ID NO: 579608 - RNA, 19 nt, Homo sapiens
gguggaaggugguuguaug

SEQ ID NO: 579609 - RNA, 19 nt, Homo sapiens
gaggaaggaaugaacauga

SEQ ID NO: 579610 - RNA, 19 nt, Homo sapiens
ggaccacacuggccucgau

SEQ ID NO: 579611 - RNA, 19 nt, Homo sapiens
ccaaagagaaggacagugu

SEQ ID NO: 579612 - RNA, 19 nt, Homo sapiens
ccaaagagaaggacagugu

SEQ ID NO: 579613 - RNA, 19 nt, Homo sapiens
ggcaaagucaaucauauuu

SEQ ID NO: 579614 - RNA, 19 nt, Homo sapiens
ggaguuggguuuggaucaa

SEQ ID NO: 579615 - RNA, 19 nt, Homo sapiens
gggaauugcuguccuuaac

SEQ ID NO: 579616 - RNA, 19 nt, Homo sapiens
ugaaagagaagcuggauuc

SEQ ID NO: 579617 - RNA, 19 nt, Homo sapiens
ggcgaacgcuuuacuaugc

SEQ ID NO: 579618 - RNA, 19 nt, Homo sapiens
gcgaugagcacccagagaa

SEQ ID NO: 579619 - RNA, 19 nt, Homo sapiens
gguggagcgucauggcaua

SEQ ID NO: 579620 - RNA, 19 nt, Homo sapiens
ccagaaguuugacacauuc

SEQ ID NO: 579621 - RNA, 19 nt, Homo sapiens
ccacccagauggaccaguu

SEQ ID NO: 579622 - RNA, 19 nt, Homo sapiens
gaacagggagcacuuugag

SEQ ID NO: 579623 - RNA, 19 nt, Homo sapiens
gcacugacuuugcccuuuu

SEQ ID NO: 579624 - RNA, 19 nt, Homo sapiens
ggaaauggugaauaacuuc

SEQ ID NO: 579625 - RNA, 19 nt, Homo sapiens
gaugugguauggaguucuu

SEQ ID NO: 579626 - RNA, 19 nt, Homo sapiens
gaacgacuuggcccgagua

SEQ ID NO: 579627 - RNA, 19 nt, Homo sapiens
aagauuggauugcagcauu

SEQ ID NO: 579628 - RNA, 19 nt, Homo sapiens
ccacggcagucgcuugguu

SEQ ID NO: 579629 - RNA, 19 nt, Homo sapiens
gugguuguauguuaccuuu

SEQ ID NO: 579630 - RNA, 19 nt, Homo sapiens
gcagacagaggaugugugu

SEQ ID NO: 579631 - RNA, 19 nt, Homo sapiens
gauuguaauuugacgugaa

SEQ ID NO: 579632 - RNA, 19 nt, Homo sapiens
gacagaagaccaucaucaa

SEQ ID NO: 579633 - RNA, 19 nt, Homo sapiens
uacagcagauucucuucua

SEQ ID NO: 579634 - RNA, 19 nt, Homo sapiens
ugcgaggugugcaaauuua

SEQ ID NO: 579635 - RNA, 19 nt, Homo sapiens
ggaaggaucccugaagagu

SEQ ID NO: 579636 - RNA, 19 nt, Homo sapiens
gcccgaggcccuuagagua

SEQ ID NO: 579637 - RNA, 19 nt, Homo sapiens
ccagucuuguugauuguaa

SEQ ID NO: 579638 - RNA, 19 nt, Homo sapiens
ucacaguauccgagaaaua

SEQ ID NO: 579639 - RNA, 19 nt, Homo sapiens
ccagaaacccuagaguauu

SEQ ID NO: 579640 - RNA, 19 nt, Homo sapiens
gggaaggccuaugagaaga

SEQ ID NO: 579641 - RNA, 19 nt, Homo sapiens
ugaaguuccucagaagauu

SEQ ID NO: 579642 - RNA, 19 nt, Homo sapiens
caaccagggugugaaguuc

SEQ ID NO: 579643 - RNA, 19 nt, Homo sapiens
agauuggauugcagcauua

SEQ ID NO: 579644 - RNA, 19 nt, Homo sapiens
uacauaaguuguucugugu

SEQ ID NO: 579645 - RNA, 19 nt, Homo sapiens
cgacagaagaccaucauca

SEQ ID NO: 579646 - RNA, 19 nt, Homo sapiens
gaccagagacagggcauuu

SEQ ID NO: 579647 - RNA, 19 nt, Homo sapiens
cacagacacugaccagaga

SEQ ID NO: 579648 - RNA, 19 nt, Homo sapiens
ggccguggcuucucuuugg

SEQ ID NO: 579649 - RNA, 19 nt, Homo sapiens
uggaaauggugaauaacuu

SEQ ID NO: 579650 - RNA, 19 nt, Homo sapiens
ugaccaaacagaacaauuc

SEQ ID NO: 579651 - RNA, 19 nt, Homo sapiens
acaagaaccuggagcaaaa

SEQ ID NO: 579652 - RNA, 19 nt, Homo sapiens
ccacggcucucaacagcau

SEQ ID NO: 579653 - RNA, 19 nt, Homo sapiens
ugagugcuguacauaaguu

SEQ ID NO: 579654 - RNA, 19 nt, Homo sapiens
gacaugaggaggauaaaca

SEQ ID NO: 579655 - RNA, 19 nt, Homo sapiens
acagaaagccuccgugaca

SEQ ID NO: 579656 - RNA, 19 nt, Homo sapiens
ccagagacagggcauuuga

SEQ ID NO: 579657 - RNA, 19 nt, Homo sapiens
uccagaaguuugacacauu

SEQ ID NO: 579658 - RNA, 19 nt, Homo sapiens
cauuaaagacugugcagaa

SEQ ID NO: 579659 - RNA, 19 nt, Homo sapiens
guuagaaugugaggaagga

SEQ ID NO: 579660 - RNA, 19 nt, Homo sapiens
aaaguagcauggauguuuc

SEQ ID NO: 579661 - RNA, 19 nt, Homo sapiens
acaaagaagcucacaguag

SEQ ID NO: 579662 - RNA, 19 nt, Homo sapiens
gcaauucgucagaucauag

SEQ ID NO: 579663 - RNA, 19 nt, Homo sapiens
aauuugacgugaagagaaa

SEQ ID NO: 579664 - RNA, 19 nt, Homo sapiens
aucagucgccuguuaauua

SEQ ID NO: 579665 - RNA, 19 nt, Homo sapiens
gcagugggcugacauauau

SEQ ID NO: 579666 - RNA, 19 nt, Homo sapiens
gcaggagacucaaagauuu

SEQ ID NO: 579667 - RNA, 19 nt, Homo sapiens
gaagugguguaacauguaa

SEQ ID NO: 579668 - RNA, 19 nt, Homo sapiens
uuacaacccugaaauguga

SEQ ID NO: 579669 - RNA, 19 nt, Homo sapiens
aggcugagcugaagaaauu

SEQ ID NO: 579670 - RNA, 19 nt, Homo sapiens
guucugggauuucgaaaga

SEQ ID NO: 579671 - RNA, 19 nt, Homo sapiens
gcaaagagacugagagacu

SEQ ID NO: 579672 - RNA, 19 nt, Homo sapiens
gagagacuguugaucaaag

SEQ ID NO: 579673 - RNA, 19 nt, Homo sapiens
ucagagaaaccuuuaauca

SEQ ID NO: 579674 - RNA, 19 nt, Homo sapiens
gacacucacucggcgaaua

SEQ ID NO: 579675 - RNA, 19 nt, Homo sapiens
ccacggagccugcaacauc

SEQ ID NO: 579676 - RNA, 19 nt, Homo sapiens
gaaaauagcagagagauuc

SEQ ID NO: 579677 - RNA, 19 nt, Homo sapiens
gggcugacauauauuuauc

SEQ ID NO: 579678 - RNA, 19 nt, Homo sapiens
ucaaagauuuucccuguaa

SEQ ID NO: 579679 - RNA, 19 nt, Homo sapiens
gaacuucauccguccuuug

SEQ ID NO: 579680 - RNA, 19 nt, Homo sapiens
cauuagaagugguguaaca

SEQ ID NO: 579681 - RNA, 19 nt, Homo sapiens
gagaugcugguguucauuu

SEQ ID NO: 579682 - RNA, 19 nt, Homo sapiens
ugacgugguucugggauuu

SEQ ID NO: 579683 - RNA, 19 nt, Homo sapiens
uuaaucaccucuuugcaau

SEQ ID NO: 579684 - RNA, 19 nt, Homo sapiens
aagcagugguucagagaaa

SEQ ID NO: 579685 - RNA, 19 nt, Homo sapiens
uagaagugguguaacaugu

SEQ ID NO: 579686 - RNA, 19 nt, Homo sapiens
aaucaccucuuugcaauug

SEQ ID NO: 579687 - RNA, 19 nt, Homo sapiens
caucauuucagacaaguuu

SEQ ID NO: 579688 - RNA, 19 nt, Homo sapiens
ggcagugggcugacauaua

SEQ ID NO: 579689 - RNA, 19 nt, Homo sapiens
ccagauaccaccagugaug

SEQ ID NO: 579690 - RNA, 19 nt, Homo sapiens
gcuuauuccucacacuuau

SEQ ID NO: 579691 - RNA, 19 nt, Homo sapiens
ucaaagcacagaacagguu

SEQ ID NO: 579692 - RNA, 19 nt, Homo sapiens
ggaacuucauccguccuuu

SEQ ID NO: 579693 - RNA, 19 nt, Homo sapiens
gacauaaaaugacagcaaa

SEQ ID NO: 579694 - RNA, 19 nt, Homo sapiens
cagcacggauugcaguugu

SEQ ID NO: 579695 - RNA, 19 nt, Homo sapiens
ugacugaggcugagcugaa

SEQ ID NO: 579696 - RNA, 19 nt, Homo sapiens
gccaaguccuccaaguuca

SEQ ID NO: 579697 - RNA, 19 nt, Homo sapiens
ccagauacacccauucaca

SEQ ID NO: 579698 - RNA, 19 nt, Homo sapiens
gcacuccgacugaagaagu

SEQ ID NO: 579699 - RNA, 19 nt, Homo sapiens
cagcaaagagacugagaga

SEQ ID NO: 579700 - RNA, 19 nt, Homo sapiens
ggccaaguccuccaaguuc

SEQ ID NO: 579701 - RNA, 19 nt, Homo sapiens
ggacacagcacggauugca

SEQ ID NO: 579702 - RNA, 19 nt, Homo sapiens
uagaagaccugugggaacu

SEQ ID NO: 579703 - RNA, 19 nt, Homo sapiens
guucagagaaaccuuuaau

SEQ ID NO: 579704 - RNA, 19 nt, Homo sapiens
gaagcagugguucagagaa

SEQ ID NO: 579705 - RNA, 19 nt, Homo sapiens
uccacugcaugaaaguuua

SEQ ID NO: 579706 - RNA, 19 nt, Homo sapiens
cugagagacuguugaucaa

SEQ ID NO: 579707 - RNA, 19 nt, Homo sapiens
gggccaaguccuccaaguu

SEQ ID NO: 579708 - RNA, 19 nt, Homo sapiens
gacaaguuuacuccagaua

SEQ ID NO: 579709 - RNA, 19 nt, Homo sapiens
aaccuuuaaucaccucuuu

SEQ ID NO: 579710 - RNA, 19 nt, Homo sapiens
agaagugguguaacaugua

SEQ ID NO: 579711 - RNA, 19 nt, Homo sapiens
caacauuagaaguggugua

SEQ ID NO: 579712 - RNA, 19 nt, Homo sapiens
gggagaaggugggcuugag

SEQ ID NO: 579713 - RNA, 19 nt, Homo sapiens
cacggagccugcaacauca

SEQ ID NO: 579714 - RNA, 19 nt, Homo sapiens
auucugggcugacgugguu

SEQ ID NO: 579715 - RNA, 19 nt, Homo sapiens
cagguuggcagauauuuca

SEQ ID NO: 579716 - RNA, 19 nt, Homo sapiens
cacgguagcaugccuauag

SEQ ID NO: 579717 - RNA, 19 nt, Homo sapiens
ugcaggagacucaaagauu

SEQ ID NO: 579718 - RNA, 19 nt, Homo sapiens
ccacugcaugaaaguuuaa

SEQ ID NO: 579719 - RNA, 19 nt, Homo sapiens
cugccuaccucccgugguu

SEQ ID NO: 579720 - RNA, 19 nt, Homo sapiens
uaaaaugacagcaaagaga

SEQ ID NO: 579721 - RNA, 19 nt, Homo sapiens
gcgugcgacugcagacaga

SEQ ID NO: 579722 - RNA, 19 nt, Homo sapiens
cgacugaagaagugccauu

SEQ ID NO: 579723 - RNA, 19 nt, Homo sapiens
agacaaguuuacuccagau

SEQ ID NO: 579724 - RNA, 19 nt, Homo sapiens
gcagaagcagugguucaga

SEQ ID NO: 579725 - RNA, 19 nt, Homo sapiens
acugagagacuguugauca

SEQ ID NO: 579726 - RNA, 19 nt, Homo sapiens
caaaccuguagaugacaua

SEQ ID NO: 579727 - RNA, 19 nt, Homo sapiens
ccaagucaaaccuguagau

SEQ ID NO: 579728 - RNA, 19 nt, Homo sapiens
cuucauccguccuuugaca

SEQ ID NO: 579729 - RNA, 19 nt, Homo sapiens
ucugggauuucgaaagaug

SEQ ID NO: 579730 - RNA, 19 nt, Homo sapiens
ggagaugcugguguucauu

SEQ ID NO: 579731 - RNA, 19 nt, Homo sapiens
ucaaaccuguagaugacau

SEQ ID NO: 579732 - RNA, 19 nt, Homo sapiens
caagucaaaccuguagaug

SEQ ID NO: 579733 - RNA, 19 nt, Homo sapiens
caacuguucaggccuugga

SEQ ID NO: 579734 - RNA, 19 nt, Homo sapiens
caaguuuacuccagauacc

SEQ ID NO: 579735 - RNA, 19 nt, Homo sapiens
gagcacuccgacugaagaa

SEQ ID NO: 579736 - RNA, 19 nt, Homo sapiens
uaccaucauuucagacaag

SEQ ID NO: 579737 - RNA, 19 nt, Homo sapiens
gagacugagagacuguuga

SEQ ID NO: 579738 - RNA, 19 nt, Homo sapiens
ccguuaccaucauuucaga

SEQ ID NO: 579739 - RNA, 19 nt, Homo sapiens
gcacgguagcaugccuaua

SEQ ID NO: 579740 - RNA, 19 nt, Homo sapiens
aacauuagaagugguguaa

SEQ ID NO: 579741 - RNA, 19 nt, Homo sapiens
ucacucggcgaauagaaga

SEQ ID NO: 579742 - RNA, 19 nt, Homo sapiens
cagagaaaccuuuaaucac

SEQ ID NO: 579743 - RNA, 19 nt, Homo sapiens
gacugaggcugagcugaag

SEQ ID NO: 579744 - RNA, 19 nt, Homo sapiens
uuuaaucaccucuuugcaa

SEQ ID NO: 579745 - RNA, 19 nt, Homo sapiens
ugagagacuguugaucaaa

SEQ ID NO: 579746 - RNA, 19 nt, Homo sapiens
ugcagaagcuggagaugcu

SEQ ID NO: 579747 - RNA, 19 nt, Homo sapiens
aagucaaaccuguagauga

SEQ ID NO: 579748 - RNA, 19 nt, Homo sapiens
aaaggggacuggaaucugu

SEQ ID NO: 579749 - RNA, 19 nt, Homo sapiens
gugggcugacauauauuua

SEQ ID NO: 579750 - RNA, 19 nt, Homo sapiens
cuccagauaccaccaguga

SEQ ID NO: 579751 - RNA, 19 nt, Homo sapiens
agaugcugguguucauuug

SEQ ID NO: 579752 - RNA, 19 nt, Homo sapiens
acacgcagaagcagugguu

SEQ ID NO: 579753 - RNA, 19 nt, Homo sapiens
uggagaugcugguguucau

SEQ ID NO: 579754 - RNA, 19 nt, Homo sapiens
guggcagccggaaugcuua

SEQ ID NO: 579755 - RNA, 19 nt, Homo sapiens
gaggcugagcugaagaaau

SEQ ID NO: 579756 - RNA, 19 nt, Homo sapiens
gcagugggcugacauauau

SEQ ID NO: 579757 - RNA, 19 nt, Homo sapiens
gcaggagacucaaagauuu

SEQ ID NO: 579758 - RNA, 19 nt, Homo sapiens
gaagugguguaacauguaa

SEQ ID NO: 579759 - RNA, 19 nt, Homo sapiens
gcaaagagacugagagacu

SEQ ID NO: 579760 - RNA, 19 nt, Homo sapiens
gagagacuguugaucaaag

SEQ ID NO: 579761 - RNA, 19 nt, Homo sapiens
ucagagaaaccuuuaauca

SEQ ID NO: 579762 - RNA, 19 nt, Homo sapiens
gacacucacucggcgaaua

SEQ ID NO: 579763 - RNA, 19 nt, Homo sapiens
ccacggagccugcaacauc

SEQ ID NO: 579764 - RNA, 19 nt, Homo sapiens
gaaaauagcagagagauuc

SEQ ID NO: 579765 - RNA, 19 nt, Homo sapiens
gggcugacauauauuuauc

SEQ ID NO: 579766 - RNA, 19 nt, Homo sapiens
ucaaagauuuucccuguaa

SEQ ID NO: 579767 - RNA, 19 nt, Homo sapiens
gaacuucauccguccuuug

SEQ ID NO: 579768 - RNA, 19 nt, Homo sapiens
cauuagaagugguguaaca

SEQ ID NO: 579769 - RNA, 19 nt, Homo sapiens
gagaugcugguguucauuu

SEQ ID NO: 579770 - RNA, 19 nt, Homo sapiens
uuaaucaccucuuugcaau

SEQ ID NO: 579771 - RNA, 19 nt, Homo sapiens
aagcagugguucagagaaa

SEQ ID NO: 579772 - RNA, 19 nt, Homo sapiens
uagaagugguguaacaugu

SEQ ID NO: 579773 - RNA, 19 nt, Homo sapiens
aaucaccucuuugcaauug

SEQ ID NO: 579774 - RNA, 19 nt, Homo sapiens
caucauuucagacaaguuu

SEQ ID NO: 579775 - RNA, 19 nt, Homo sapiens
ggcagugggcugacauaua

SEQ ID NO: 579776 - RNA, 19 nt, Homo sapiens
ccagauaccaccagugaug

SEQ ID NO: 579777 - RNA, 19 nt, Homo sapiens
gcuuauuccucacacuuau

SEQ ID NO: 579778 - RNA, 19 nt, Homo sapiens
ucaaagcacagaacagguu

SEQ ID NO: 579779 - RNA, 19 nt, Homo sapiens
ggaacuucauccguccuuu

SEQ ID NO: 579780 - RNA, 19 nt, Homo sapiens
gacauaaaaugacagcaaa

SEQ ID NO: 579781 - RNA, 19 nt, Homo sapiens
cagcacggauugcaguugu

SEQ ID NO: 579782 - RNA, 19 nt, Homo sapiens
gccaaguccuccaaguuca

SEQ ID NO: 579783 - RNA, 19 nt, Homo sapiens
ccagauacacccauucaca

SEQ ID NO: 579784 - RNA, 19 nt, Homo sapiens
cagcaaagagacugagaga

SEQ ID NO: 579785 - RNA, 19 nt, Homo sapiens
ggccaaguccuccaaguuc

SEQ ID NO: 579786 - RNA, 19 nt, Homo sapiens
ggacacagcacggauugca

SEQ ID NO: 579787 - RNA, 19 nt, Homo sapiens
uagaagaccugugggaacu

SEQ ID NO: 579788 - RNA, 19 nt, Homo sapiens
guucagagaaaccuuuaau

SEQ ID NO: 579789 - RNA, 19 nt, Homo sapiens
gaagcagugguucagagaa

SEQ ID NO: 579790 - RNA, 19 nt, Homo sapiens
uccacugcaugaaaguuua

SEQ ID NO: 579791 - RNA, 19 nt, Homo sapiens
cugagagacuguugaucaa

SEQ ID NO: 579792 - RNA, 19 nt, Homo sapiens
gggccaaguccuccaaguu

SEQ ID NO: 579793 - RNA, 19 nt, Homo sapiens
gacaaguuuacuccagaua

SEQ ID NO: 579794 - RNA, 19 nt, Homo sapiens
aaccuuuaaucaccucuuu

SEQ ID NO: 579795 - RNA, 19 nt, Homo sapiens
agaagugguguaacaugua

SEQ ID NO: 579796 - RNA, 19 nt, Homo sapiens
caacauuagaaguggugua

SEQ ID NO: 579797 - RNA, 19 nt, Homo sapiens
gggagaaggugggcuugag

SEQ ID NO: 579798 - RNA, 19 nt, Homo sapiens
cacggagccugcaacauca

SEQ ID NO: 579799 - RNA, 19 nt, Homo sapiens
cacgguagcaugccuauag

SEQ ID NO: 579800 - RNA, 19 nt, Homo sapiens
ugcaggagacucaaagauu

SEQ ID NO: 579801 - RNA, 19 nt, Homo sapiens
ccacugcaugaaaguuuaa

SEQ ID NO: 579802 - RNA, 19 nt, Homo sapiens
uaaaaugacagcaaagaga

SEQ ID NO: 579803 - RNA, 19 nt, Homo sapiens
gcgugcgacugcagacaga

SEQ ID NO: 579804 - RNA, 19 nt, Homo sapiens
agacaaguuuacuccagau

SEQ ID NO: 579805 - RNA, 19 nt, Homo sapiens
gcagaagcagugguucaga

SEQ ID NO: 579806 - RNA, 19 nt, Homo sapiens
acugagagacuguugauca

SEQ ID NO: 579807 - RNA, 19 nt, Homo sapiens
caaaccuguagaugacaua

SEQ ID NO: 579808 - RNA, 19 nt, Homo sapiens
ccaagucaaaccuguagau

SEQ ID NO: 579809 - RNA, 19 nt, Homo sapiens
cuucauccguccuuugaca

SEQ ID NO: 579810 - RNA, 19 nt, Homo sapiens
ggagaugcugguguucauu

SEQ ID NO: 579811 - RNA, 19 nt, Homo sapiens
ucaaaccuguagaugacau

SEQ ID NO: 579812 - RNA, 19 nt, Homo sapiens
caagucaaaccuguagaug

SEQ ID NO: 579813 - RNA, 19 nt, Homo sapiens
caacuguucaggccuugga

SEQ ID NO: 579814 - RNA, 19 nt, Homo sapiens
caaguuuacuccagauacc

SEQ ID NO: 579815 - RNA, 19 nt, Homo sapiens
gagacugagagacuguuga

SEQ ID NO: 579816 - RNA, 19 nt, Homo sapiens
uaccaucauuucagacaag

SEQ ID NO: 579817 - RNA, 19 nt, Homo sapiens
ccguuaccaucauuucaga

SEQ ID NO: 579818 - RNA, 19 nt, Homo sapiens
gcacgguagcaugccuaua

SEQ ID NO: 579819 - RNA, 19 nt, Homo sapiens
aacauuagaagugguguaa

SEQ ID NO: 579820 - RNA, 19 nt, Homo sapiens
ucacucggcgaauagaaga

SEQ ID NO: 579821 - RNA, 19 nt, Homo sapiens
uuuaaucaccucuuugcaa

SEQ ID NO: 579822 - RNA, 19 nt, Homo sapiens
cagagaaaccuuuaaucac

SEQ ID NO: 579823 - RNA, 19 nt, Homo sapiens
ugagagacuguugaucaaa

SEQ ID NO: 579824 - RNA, 19 nt, Homo sapiens
ugcagaagcuggagaugcu

SEQ ID NO: 579825 - RNA, 19 nt, Homo sapiens
aagucaaaccuguagauga

SEQ ID NO: 579826 - RNA, 19 nt, Homo sapiens
aaaggggacuggaaucugu

SEQ ID NO: 579827 - RNA, 19 nt, Homo sapiens
gugggcugacauauauuua

SEQ ID NO: 579828 - RNA, 19 nt, Homo sapiens
agaugcugguguucauuug

SEQ ID NO: 579829 - RNA, 19 nt, Homo sapiens
uggagaugcugguguucau

SEQ ID NO: 579830 - RNA, 19 nt, Homo sapiens
acacgcagaagcagugguu

SEQ ID NO: 579831 - RNA, 19 nt, Homo sapiens
cuccagauaccaccaguga

SEQ ID NO: 579832 - RNA, 19 nt, Homo sapiens
guggcagccggaaugcuua

SEQ ID NO: 579833 - RNA, 19 nt, Homo sapiens
ggaagaaguuaucugauga

SEQ ID NO: 579834 - RNA, 19 nt, Homo sapiens
ggagaaacccagugaauau

SEQ ID NO: 579835 - RNA, 19 nt, Homo sapiens
gguagugccuguuuggaua

SEQ ID NO: 579836 - RNA, 19 nt, Homo sapiens
gggaagaaguuaucugaug

SEQ ID NO: 579837 - RNA, 19 nt, Homo sapiens
aaagugaagccuagaauua

SEQ ID NO: 579838 - RNA, 19 nt, Homo sapiens
gaaacccagugaauauauu

SEQ ID NO: 579839 - RNA, 19 nt, Homo sapiens
ccagguuguucauauaaua

SEQ ID NO: 579840 - RNA, 19 nt, Homo sapiens
gggacgaccuggcccauuu

SEQ ID NO: 579841 - RNA, 19 nt, Homo sapiens
gaagguagcacgacacugu

SEQ ID NO: 579842 - RNA, 19 nt, Homo sapiens
gcugacaccuuuauguuug

SEQ ID NO: 579843 - RNA, 19 nt, Homo sapiens
cauauugacuuccuguauu

SEQ ID NO: 579844 - RNA, 19 nt, Homo sapiens
ggaccuacgccuucuauga

SEQ ID NO: 579845 - RNA, 19 nt, Homo sapiens
ucagugcccuuguaucaaa

SEQ ID NO: 579846 - RNA, 19 nt, Homo sapiens
gaacaggccaaucugaaga

SEQ ID NO: 579847 - RNA, 19 nt, Homo sapiens
gaaccuugaaugcaugaua

SEQ ID NO: 579848 - RNA, 19 nt, Homo sapiens
gaaaugugucuucagcuuu

SEQ ID NO: 579849 - RNA, 19 nt, Homo sapiens
ggaugaaccuugaaugcau

SEQ ID NO: 579850 - RNA, 19 nt, Homo sapiens
gagaaacccagugaauaua

SEQ ID NO: 579851 - RNA, 19 nt, Homo sapiens
caugagauccuccugcaua

SEQ ID NO: 579852 - RNA, 19 nt, Homo sapiens
ggagcucagugcccuugua

SEQ ID NO: 579853 - RNA, 19 nt, Homo sapiens
gagcacaucagccucauga

SEQ ID NO: 579854 - RNA, 19 nt, Homo sapiens
gagauccuccugcauauug

SEQ ID NO: 579855 - RNA, 19 nt, Homo sapiens
gagcugaguucugcagaga

SEQ ID NO: 579856 - RNA, 19 nt, Homo sapiens
caaaggacaaguucuucua

SEQ ID NO: 579857 - RNA, 19 nt, Homo sapiens
gaaagacgucagaugcaaa

SEQ ID NO: 579858 - RNA, 19 nt, Homo sapiens
gaaggaccgugagccuaaa

SEQ ID NO: 579859 - RNA, 19 nt, Homo sapiens
gacauuaaaucaucuuagg

SEQ ID NO: 579860 - RNA, 19 nt, Homo sapiens
gaggagcgacugcuaauca

SEQ ID NO: 579861 - RNA, 19 nt, Homo sapiens
agcagaagcugacaccuuu

SEQ ID NO: 579862 - RNA, 19 nt, Homo sapiens
gcucagugcccuuguauca

SEQ ID NO: 579863 - RNA, 19 nt, Homo sapiens
ugaauuucgugguauguga

SEQ ID NO: 579864 - RNA, 19 nt, Homo sapiens
ggacuucauugauguacuc

SEQ ID NO: 579865 - RNA, 19 nt, Homo sapiens
cuauugaauuggacacuuu

SEQ ID NO: 579866 - RNA, 19 nt, Homo sapiens
gcacuaaaugcuauugaau

SEQ ID NO: 579867 - RNA, 19 nt, Homo sapiens
ugaaagacgucagaugcaa

SEQ ID NO: 579868 - RNA, 19 nt, Homo sapiens
uugcaaagcacccagaaua

SEQ ID NO: 579869 - RNA, 19 nt, Homo sapiens
gaagcugacaccuuuaugu

SEQ ID NO: 579870 - RNA, 19 nt, Homo sapiens
gagcagaagcugacaccuu

SEQ ID NO: 579871 - RNA, 19 nt, Homo sapiens
aaaugugucuucagcuuug

SEQ ID NO: 579872 - RNA, 19 nt, Homo sapiens
agaaaugugucuucagcuu

SEQ ID NO: 579873 - RNA, 19 nt, Homo sapiens
gaauuggacacuuugaaau

SEQ ID NO: 579874 - RNA, 19 nt, Homo sapiens
gaaaacaaccccaagcuau

SEQ ID NO: 579875 - RNA, 19 nt, Homo sapiens
gcaugauacugaaugaaag

SEQ ID NO: 579876 - RNA, 19 nt, Homo sapiens
ugaaggaccgugagccuaa

SEQ ID NO: 579877 - RNA, 19 nt, Homo sapiens
gugcacgacuucacagaug

SEQ ID NO: 579878 - RNA, 19 nt, Homo sapiens
gcauauugacuuccuguau

SEQ ID NO: 579879 - RNA, 19 nt, Homo sapiens
gaauucuaccucaaucaaa

SEQ ID NO: 579880 - RNA, 19 nt, Homo sapiens
gaggagggcaugagaguuc

SEQ ID NO: 579881 - RNA, 19 nt, Homo sapiens
cuacagaaaugugucuuca

SEQ ID NO: 579882 - RNA, 19 nt, Homo sapiens
gagcaucuuuccaugacau

SEQ ID NO: 579883 - RNA, 19 nt, Homo sapiens
gaaugaaagacgucagaug

SEQ ID NO: 579884 - RNA, 19 nt, Homo sapiens
ugaauuggacacuuugaaa

SEQ ID NO: 579885 - RNA, 19 nt, Homo sapiens
ugagugcacuaaaugcuau

SEQ ID NO: 579886 - RNA, 19 nt, Homo sapiens
cuacuacacuguggaugaa

SEQ ID NO: 579887 - RNA, 19 nt, Homo sapiens
cacaguagccaaacgauga

SEQ ID NO: 579888 - RNA, 19 nt, Homo sapiens
gcugagugcuggugacaag

SEQ ID NO: 579889 - RNA, 19 nt, Homo sapiens
cagcugccauugcaccaaa

SEQ ID NO: 579890 - RNA, 19 nt, Homo sapiens
uguccagguuguucauaua

SEQ ID NO: 579891 - RNA, 19 nt, Homo sapiens
gaagcagugaucccuacua

SEQ ID NO: 579892 - RNA, 19 nt, Homo sapiens
uguauuccauccuagauau

SEQ ID NO: 579893 - RNA, 19 nt, Homo sapiens
aauggugaauuucguggua

SEQ ID NO: 579894 - RNA, 19 nt, Homo sapiens
gcagaagcugacaccuuua

SEQ ID NO: 579895 - RNA, 19 nt, Homo sapiens
ggacauaagagcagaagcu

SEQ ID NO: 579896 - RNA, 19 nt, Homo sapiens
agagaugcauagcggauug

SEQ ID NO: 579897 - RNA, 19 nt, Homo sapiens
cugaagcccuauaugaaga

SEQ ID NO: 579898 - RNA, 19 nt, Homo sapiens
caucuuuccaugacauuaa

SEQ ID NO: 579899 - RNA, 19 nt, Homo sapiens
gaaugcaugauacugaaug

SEQ ID NO: 579900 - RNA, 19 nt, Homo sapiens
gcuauauauuaccagauga

SEQ ID NO: 579901 - RNA, 19 nt, Homo sapiens
ggacagacugcuccugaca

SEQ ID NO: 579902 - RNA, 19 nt, Homo sapiens
gaagacgggaagaaguuau

SEQ ID NO: 579903 - RNA, 19 nt, Homo sapiens
acagacugcuccugacaga

SEQ ID NO: 579904 - RNA, 19 nt, Homo sapiens
gaagcccuauaugaagauu

SEQ ID NO: 579905 - RNA, 19 nt, Homo sapiens
gcuauugaauuggacacuu

SEQ ID NO: 579906 - RNA, 19 nt, Homo sapiens
gcagugaucccuacuacac

SEQ ID NO: 579907 - RNA, 19 nt, Homo sapiens
cagaugaaaggauaaacaa

SEQ ID NO: 579908 - RNA, 19 nt, Homo sapiens
guuaucugaugaggacaua

SEQ ID NO: 579909 - RNA, 19 nt, Homo sapiens
ggaguauuacacagccaua

SEQ ID NO: 579910 - RNA, 19 nt, Homo sapiens
ucaaugagagugugaacau

SEQ ID NO: 579911 - RNA, 19 nt, Homo sapiens
caaaaggucacauagugua

SEQ ID NO: 579912 - RNA, 19 nt, Homo sapiens
aaaaugugguccauccaua

SEQ ID NO: 579913 - RNA, 19 nt, Homo sapiens
gaugaagacgggaagaagu

SEQ ID NO: 579914 - RNA, 19 nt, Homo sapiens
gaauuucgugguaugugaa

SEQ ID NO: 579915 - RNA, 19 nt, Homo sapiens
ggucaccucuggcuuuuau

SEQ ID NO: 579916 - RNA, 19 nt, Homo sapiens
ugaagacgggaagaaguua

SEQ ID NO: 579917 - RNA, 19 nt, Homo sapiens
gagcucagugcccuuguau

SEQ ID NO: 579918 - RNA, 19 nt, Homo sapiens
cgugguaugugaauucuac

SEQ ID NO: 579919 - RNA, 19 nt, Homo sapiens
auuaccagaugaaaggaua

SEQ ID NO: 579920 - RNA, 19 nt, Homo sapiens
ccaggguguugaugacuuc

SEQ ID NO: 579921 - RNA, 19 nt, Homo sapiens
gccaggguguugaugacuu

SEQ ID NO: 579922 - RNA, 19 nt, Homo sapiens
aggagaaacccagugaaua

SEQ ID NO: 579923 - RNA, 19 nt, Homo sapiens
caggagaaacccagugaau

SEQ ID NO: 579924 - RNA, 19 nt, Homo sapiens
ugaauucuaccucaaucaa

SEQ ID NO: 579925 - RNA, 19 nt, Homo sapiens
ccagaugaaaggauaaaca

SEQ ID NO: 579926 - RNA, 19 nt, Homo sapiens
ggacgaccuggcccauuug

SEQ ID NO: 579927 - RNA, 19 nt, Homo sapiens
agaaacccagugaauauau

SEQ ID NO: 579928 - RNA, 19 nt, Homo sapiens
caacgccucagcugccauu

SEQ ID NO: 579929 - RNA, 19 nt, Homo sapiens
uugaaugcaugauacugaa

SEQ ID NO: 579930 - RNA, 19 nt, Homo sapiens
uauauuaccagaugaaagg

SEQ ID NO: 579931 - RNA, 19 nt, Homo sapiens
uaaaaugaccccugauuca

SEQ ID NO: 579932 - RNA, 19 nt, Homo sapiens
caaagcacccagaauacca

SEQ ID NO: 579933 - RNA, 19 nt, Homo sapiens
ugaaaggccugaaauauau

SEQ ID NO: 579934 - RNA, 19 nt, Homo sapiens
gugaaaggccugaaauaua

SEQ ID NO: 579935 - RNA, 19 nt, Homo sapiens
gaucacauuugcuucuaaa

SEQ ID NO: 579936 - RNA, 19 nt, Homo sapiens
gguagcaccuccuaacaga

SEQ ID NO: 579937 - RNA, 19 nt, Homo sapiens
gaacucugcuggccuucug

SEQ ID NO: 579938 - RNA, 19 nt, Homo sapiens
gcagccagauacaguguug

SEQ ID NO: 579939 - RNA, 19 nt, Homo sapiens
gcacaggcacaaaccauug

SEQ ID NO: 579940 - RNA, 19 nt, Homo sapiens
ccuccuaacagauuaaaua

SEQ ID NO: 579941 - RNA, 19 nt, Homo sapiens
gaaauuggcagaacuaccu

SEQ ID NO: 579942 - RNA, 19 nt, Homo sapiens
ggaugacugugacuuccaa

SEQ ID NO: 579943 - RNA, 19 nt, Homo sapiens
guuccaugcugcccaagaa

SEQ ID NO: 579944 - RNA, 19 nt, Homo sapiens
caagggcccuaguucagau

SEQ ID NO: 579945 - RNA, 19 nt, Homo sapiens
gauagugaaaggccugaaa

SEQ ID NO: 579946 - RNA, 19 nt, Homo sapiens
cgagugagcgggugaagug

SEQ ID NO: 579947 - RNA, 19 nt, Homo sapiens
uagcaccuccuaacagauu

SEQ ID NO: 579948 - RNA, 19 nt, Homo sapiens
gaaaggccugaaauauaug

SEQ ID NO: 579949 - RNA, 19 nt, Homo sapiens
ccacagccaugacaaacac

SEQ ID NO: 579950 - RNA, 19 nt, Homo sapiens
aaaccaaccacaccuugaa

SEQ ID NO: 579951 - RNA, 19 nt, Homo sapiens
caaaccaaccacaccuuga

SEQ ID NO: 579952 - RNA, 19 nt, Homo sapiens
agaacuaccugcaagaaaa

SEQ ID NO: 579953 - RNA, 19 nt, Homo sapiens
ucacaagggcccuaguuca

SEQ ID NO: 579954 - RNA, 19 nt, Homo sapiens
gauacaguguugaaaaguu

SEQ ID NO: 579955 - RNA, 19 nt, Homo sapiens
caacugcacgaacgacaug

SEQ ID NO: 579956 - RNA, 19 nt, Homo sapiens
cagaacuaccugcaagaaa

SEQ ID NO: 579957 - RNA, 19 nt, Homo sapiens
caaggagucccgcaucaca

SEQ ID NO: 579958 - RNA, 19 nt, Homo sapiens
ccaagcagccagauacagu

SEQ ID NO: 579959 - RNA, 19 nt, Homo sapiens
uagugaaaggccugaaaua

SEQ ID NO: 579960 - RNA, 19 nt, Homo sapiens
gagcugcuacucugaaguc

SEQ ID NO: 579961 - RNA, 19 nt, Homo sapiens
gcaccuccuaacagauuaa

SEQ ID NO: 579962 - RNA, 19 nt, Homo sapiens
caucacaagggcccuaguu

SEQ ID NO: 579963 - RNA, 19 nt, Homo sapiens
agaucacauuugcuucuaa

SEQ ID NO: 579964 - RNA, 19 nt, Homo sapiens
gacugugacuuccaaacca

SEQ ID NO: 579965 - RNA, 19 nt, Homo sapiens
guggaaauuggcagaacua

SEQ ID NO: 579966 - RNA, 19 nt, Homo sapiens
gguggaaauuggcagaacu

SEQ ID NO: 579967 - RNA, 19 nt, Homo sapiens
caagaccacagccaugaca

SEQ ID NO: 579968 - RNA, 19 nt, Homo sapiens
agugaaaggccugaaauau

SEQ ID NO: 579969 - RNA, 19 nt, Homo sapiens
ggcccuaguucagauagug

SEQ ID NO: 579970 - RNA, 19 nt, Homo sapiens
ccagauacaguguugaaaa

SEQ ID NO: 579971 - RNA, 19 nt, Homo sapiens
caaccacugccuccaacug

SEQ ID NO: 579972 - RNA, 19 nt, Homo sapiens
agaccacagccaugacaaa

SEQ ID NO: 579973 - RNA, 19 nt, Homo sapiens
gcucagcacaggcacaaac

SEQ ID NO: 579974 - RNA, 19 nt, Homo sapiens
aacgacauguucuuguuca

SEQ ID NO: 579975 - RNA, 19 nt, Homo sapiens
gcaauaaaguggaagacua

SEQ ID NO: 579976 - RNA, 19 nt, Homo sapiens
ggaaauaucugcgcagugu

SEQ ID NO: 579977 - RNA, 19 nt, Homo sapiens
gaaaugacaccaaagaaga

SEQ ID NO: 579978 - RNA, 19 nt, Homo sapiens
caccaaagaagauguauuu

SEQ ID NO: 579979 - RNA, 19 nt, Homo sapiens
ggaagacuaaccaagauuu

SEQ ID NO: 579980 - RNA, 19 nt, Homo sapiens
uuacagacguggcuacuau

SEQ ID NO: 579981 - RNA, 19 nt, Homo sapiens
caauaaaguggaagacuaa

SEQ ID NO: 579982 - RNA, 19 nt, Homo sapiens
aaagaaacauccaagcaau

SEQ ID NO: 579983 - RNA, 19 nt, Homo sapiens
uggagaggcugaagauaaa

SEQ ID NO: 579984 - RNA, 19 nt, Homo sapiens
caaagaaacauccaagcaa

SEQ ID NO: 579985 - RNA, 19 nt, Homo sapiens
cggcagcagugaaggauuu

SEQ ID NO: 579986 - RNA, 19 nt, Homo sapiens
agacguggcuacuauggaa

SEQ ID NO: 579987 - RNA, 19 nt, Homo sapiens
gaauaacccacggaaauau

SEQ ID NO: 579988 - RNA, 19 nt, Homo sapiens
agacugccaucaagaagaa

SEQ ID NO: 579989 - RNA, 19 nt, Homo sapiens
cgucagaaauggauaugga

SEQ ID NO: 579990 - RNA, 19 nt, Homo sapiens
aauacaggcuggugagauu

SEQ ID NO: 579991 - RNA, 19 nt, Homo sapiens
gaagaauaacccacggaaa

SEQ ID NO: 579992 - RNA, 19 nt, Homo sapiens
gaagacuaaccaagauuug

SEQ ID NO: 579993 - RNA, 19 nt, Homo sapiens
agaauaacccacggaaaua

SEQ ID NO: 579994 - RNA, 19 nt, Homo sapiens
agaaacauccaagcaauaa

SEQ ID NO: 579995 - RNA, 19 nt, Homo sapiens
gccacaaccuuaaccaaca

SEQ ID NO: 579996 - RNA, 19 nt, Homo sapiens
gaaacauccaagcaauaaa

SEQ ID NO: 579997 - RNA, 19 nt, Homo sapiens
uaacgcuccuucacaagau

SEQ ID NO: 579998 - RNA, 19 nt, Homo sapiens
aagaauaacccacggaaau

SEQ ID NO: 579999 - RNA, 19 nt, Homo sapiens
gaaaaugugcaguaagaaa

SEQ ID NO: 580000 - RNA, 19 nt, Homo sapiens
gcugagaaccugggaauuc

SEQ ID NO: 580001 - RNA, 19 nt, Homo sapiens
aaaucgaaaugacaccaaa

SEQ ID NO: 580002 - RNA, 19 nt, Homo sapiens
guggaagacuaaccaagau

SEQ ID NO: 580003 - RNA, 19 nt, Homo sapiens
aaagcaggccacaaccuua

SEQ ID NO: 580004 - RNA, 19 nt, Homo sapiens
gugcuaaaccuccaagugu

SEQ ID NO: 580005 - RNA, 19 nt, Homo sapiens
uuaugugacucucuuugaa

SEQ ID NO: 580006 - RNA, 19 nt, Homo sapiens
gcacggaagacaagagagu

SEQ ID NO: 580007 - RNA, 19 nt, Homo sapiens
ccaaagaaacauccaagca

SEQ ID NO: 580008 - RNA, 19 nt, Homo sapiens
ggagauggagaaacuguag

SEQ ID NO: 580009 - RNA, 19 nt, Homo sapiens
uguaggagauggagaaacu

SEQ ID NO: 580010 - RNA, 19 nt, Homo sapiens
cgaaaugacaccaaagaag

SEQ ID NO: 580011 - RNA, 19 nt, Homo sapiens
aagaaacauccaagcaaua

SEQ ID NO: 580012 - RNA, 19 nt, Homo sapiens
gaaauaucugcgcagugua

SEQ ID NO: 580013 - RNA, 19 nt, Homo sapiens
gcaguaagaaauuccucaa

SEQ ID NO: 580014 - RNA, 19 nt, Homo sapiens
uuggagaggcugaagauaa

SEQ ID NO: 580015 - RNA, 19 nt, Homo sapiens
aaacauccaagcaauaaag

SEQ ID NO: 580016 - RNA, 19 nt, Homo sapiens
gaggaggaggcaugaguga

SEQ ID NO: 580017 - RNA, 19 nt, Homo sapiens
gaauacaggcuggugagau

SEQ ID NO: 580018 - RNA, 19 nt, Homo sapiens
caacgucagaaauggauau

SEQ ID NO: 580019 - RNA, 19 nt, Homo sapiens
ugacaccaaagaagaugua

SEQ ID NO: 580020 - RNA, 19 nt, Homo sapiens
gugaagcaccaacugagaa

SEQ ID NO: 580021 - RNA, 19 nt, Homo sapiens
gagaggcugaagauaaaga

SEQ ID NO: 580022 - RNA, 19 nt, Homo sapiens
cagcgaagacgcggagaaa

SEQ ID NO: 580023 - RNA, 19 nt, Homo sapiens
ccagagggagcacaacuuc

SEQ ID NO: 580024 - RNA, 19 nt, Homo sapiens
ucagaaauggauauggauu

SEQ ID NO: 580025 - RNA, 19 nt, Homo sapiens
aagcaggccacaaccuuaa

SEQ ID NO: 580026 - RNA, 19 nt, Homo sapiens
caaaugguucaacgucaga

SEQ ID NO: 580027 - RNA, 19 nt, Homo sapiens
agagaagggugcagaagcu

SEQ ID NO: 580028 - RNA, 19 nt, Homo sapiens
uaugugacucucuuugaaa

SEQ ID NO: 580029 - RNA, 19 nt, Homo sapiens
gaggggaggauaacauuuu

SEQ ID NO: 580030 - RNA, 19 nt, Homo sapiens
uaaaguggaagacuaacca

SEQ ID NO: 580031 - RNA, 19 nt, Homo sapiens
ccaaaccagccgucuguuc

SEQ ID NO: 580032 - RNA, 19 nt, Homo sapiens
caucagacugccaucaaga

SEQ ID NO: 580033 - RNA, 19 nt, Homo sapiens
cuaacgcuccuucacaaga

SEQ ID NO: 580034 - RNA, 19 nt, Homo sapiens
uguagaguuugaugugguu

SEQ ID NO: 580035 - RNA, 19 nt, Homo sapiens
ggagaaccccaaccaaaga

SEQ ID NO: 580036 - RNA, 19 nt, Homo sapiens
gcagcgaagacgcggagaa

SEQ ID NO: 580037 - RNA, 19 nt, Homo sapiens
uaaccaacaccaaagaaac

SEQ ID NO: 580038 - RNA, 19 nt, Homo sapiens
uuaaccaacaccaaagaaa

SEQ ID NO: 580039 - RNA, 19 nt, Homo sapiens
cccaguaucgcccucagua

SEQ ID NO: 580040 - RNA, 19 nt, Homo sapiens
ggccaaggcaggugaagca

SEQ ID NO: 580041 - RNA, 19 nt, Homo sapiens
guucaucgaaauccaacuu

SEQ ID NO: 580042 - RNA, 19 nt, Homo sapiens
gggaccgguucaucgaaau

SEQ ID NO: 580043 - RNA, 19 nt, Homo sapiens
guacaucagacugccauca

SEQ ID NO: 580044 - RNA, 19 nt, Homo sapiens
ccuuggcacugucaaaugg

SEQ ID NO: 580045 - RNA, 19 nt, Homo sapiens
caagcaauaaaguggaaga

SEQ ID NO: 580046 - RNA, 19 nt, Homo sapiens
uccuaacgcuccuucacaa

SEQ ID NO: 580047 - RNA, 19 nt, Homo sapiens
caguaagaaauuccucaaa

SEQ ID NO: 580048 - RNA, 19 nt, Homo sapiens
uugaaaaugugcaguaaga

SEQ ID NO: 580049 - RNA, 19 nt, Homo sapiens
aguagccucuccaguuuca

SEQ ID NO: 580050 - RNA, 19 nt, Homo sapiens
guccaaaccagccgucugu

SEQ ID NO: 580051 - RNA, 19 nt, Homo sapiens
ccacgugggacagaccuuu

SEQ ID NO: 580052 - RNA, 19 nt, Homo sapiens
gagcggcagcagugaagga

SEQ ID NO: 580053 - RNA, 19 nt, Homo sapiens
ggagagaagggugcagaag

SEQ ID NO: 580054 - RNA, 19 nt, Homo sapiens
agaguuugaugugguugaa

SEQ ID NO: 580055 - RNA, 19 nt, Homo sapiens
ggugcuaaaccuccaagug

SEQ ID NO: 580056 - RNA, 19 nt, Homo sapiens
uuuggaugcuggugcuaaa

SEQ ID NO: 580057 - RNA, 19 nt, Homo sapiens
caagauuuggacauuggaa

SEQ ID NO: 580058 - RNA, 19 nt, Homo sapiens
aaccuuaaccaacaccaaa

SEQ ID NO: 580059 - RNA, 19 nt, Homo sapiens
aaauaucugcgcaguguag

SEQ ID NO: 580060 - RNA, 19 nt, Homo sapiens
uaaaucgaaaugacaccaa

SEQ ID NO: 580061 - RNA, 19 nt, Homo sapiens
agggaccgguucaucgaaa

SEQ ID NO: 580062 - RNA, 19 nt, Homo sapiens
aguggaagacuaaccaaga

SEQ ID NO: 580063 - RNA, 19 nt, Homo sapiens
ccacaaccuuaaccaacac

SEQ ID NO: 580064 - RNA, 19 nt, Homo sapiens
ggugagauuggagagauga

SEQ ID NO: 580065 - RNA, 19 nt, Homo sapiens
caguguaggagauggagaa

SEQ ID NO: 580066 - RNA, 19 nt, Homo sapiens
ucgaaaugacaccaaagaa

SEQ ID NO: 580067 - RNA, 19 nt, Homo sapiens
cagacugccaucaagaaga

SEQ ID NO: 580068 - RNA, 19 nt, Homo sapiens
caaccuuaaccaacaccaa

SEQ ID NO: 580069 - RNA, 19 nt, Homo sapiens
gagauggagaaacuguaga

SEQ ID NO: 580070 - RNA, 19 nt, Homo sapiens
aaaugacaccaaagaagau

SEQ ID NO: 580071 - RNA, 19 nt, Homo sapiens
ucaucgaaauccaacuuac

SEQ ID NO: 580072 - RNA, 19 nt, Homo sapiens
ccacaaagccgcugccauu

SEQ ID NO: 580073 - RNA, 19 nt, Homo sapiens
caaagccgcugccauuuua

SEQ ID NO: 580074 - RNA, 19 nt, Homo sapiens
caaaggcaaucaugaagug

SEQ ID NO: 580075 - RNA, 19 nt, Homo sapiens
cccaagaacuuuauucaug

SEQ ID NO: 580076 - RNA, 19 nt, Homo sapiens
ccacagacaucccacaaag

SEQ ID NO: 580077 - RNA, 19 nt, Homo sapiens
gaauagguguggaggcaau

SEQ ID NO: 580078 - RNA, 19 nt, Homo sapiens
ucaaagguguggugacaga

SEQ ID NO: 580079 - RNA, 19 nt, Homo sapiens
ggaggcaauuuccugaaga

SEQ ID NO: 580080 - RNA, 19 nt, Homo sapiens
ccaaagucaucaagaaagu

SEQ ID NO: 580081 - RNA, 19 nt, Homo sapiens
ucaacuaccugcacaccaa

SEQ ID NO: 580082 - RNA, 19 nt, Homo sapiens
caucaaagguguggugaca

SEQ ID NO: 580083 - RNA, 19 nt, Homo sapiens
gagcugggcugugugaagu

SEQ ID NO: 580084 - RNA, 19 nt, Homo sapiens
gcuggcugcucaaguacua

SEQ ID NO: 580085 - RNA, 19 nt, Homo sapiens
gcuaugacccgcuggagaa

SEQ ID NO: 580086 - RNA, 19 nt, Homo sapiens
cacgcuggcugcucaagua

SEQ ID NO: 580087 - RNA, 19 nt, Homo sapiens
gcuuugagaucacgguaga

SEQ ID NO: 580088 - RNA, 19 nt, Homo sapiens
agacaaaggcaaucaugaa

SEQ ID NO: 580089 - RNA, 19 nt, Homo sapiens
gcuccuggcucuugauuuu

SEQ ID NO: 580090 - RNA, 19 nt, Homo sapiens
cgggaggcauguccgauuu

SEQ ID NO: 580091 - RNA, 19 nt, Homo sapiens
gagacaaaggcaaucauga

SEQ ID NO: 580092 - RNA, 19 nt, Homo sapiens
ggaggcauguccgauuuca

SEQ ID NO: 580093 - RNA, 19 nt, Homo sapiens
ggagacaaaggcaaucaug

SEQ ID NO: 580094 - RNA, 19 nt, Homo sapiens
cauuaacccugacggcuau

SEQ ID NO: 580095 - RNA, 19 nt, Homo sapiens
ucaucuaccuagcccagua

SEQ ID NO: 580096 - RNA, 19 nt, Homo sapiens
ugaaguggaugcagaccau

SEQ ID NO: 580097 - RNA, 19 nt, Homo sapiens
gaucugaaccgaaauuucc

SEQ ID NO: 580098 - RNA, 19 nt, Homo sapiens
ccagguauccacauuguca

SEQ ID NO: 580099 - RNA, 19 nt, Homo sapiens
aagguguggugacagauaa

SEQ ID NO: 580100 - RNA, 19 nt, Homo sapiens
gaagcucaucggcaacauu

SEQ ID NO: 580101 - RNA, 19 nt, Homo sapiens
cacaccaacugcuuugaga

SEQ ID NO: 580102 - RNA, 19 nt, Homo sapiens
gcauguccgauuucaacua

SEQ ID NO: 580103 - RNA, 19 nt, Homo sapiens
cccaguaccugugcucuga

SEQ ID NO: 580104 - RNA, 19 nt, Homo sapiens
gacccaagaacuuuauuca

SEQ ID NO: 580105 - RNA, 19 nt, Homo sapiens
aaagguguggugacagaua

SEQ ID NO: 580106 - RNA, 19 nt, Homo sapiens
ggaggcagaacgcgcagaa

SEQ ID NO: 580107 - RNA, 19 nt, Homo sapiens
acgccaaagucaucaagaa

SEQ ID NO: 580108 - RNA, 19 nt, Homo sapiens
gaucucagucaaaggcauu

SEQ ID NO: 580109 - RNA, 19 nt, Homo sapiens
gcagcgaugccgccuacaa

SEQ ID NO: 580110 - RNA, 19 nt, Homo sapiens
guagagcugggcuguguga

SEQ ID NO: 580111 - RNA, 19 nt, Homo sapiens
caccugcugcccuccauua

SEQ ID NO: 580112 - RNA, 19 nt, Homo sapiens
gcccggaucucagucaaag

SEQ ID NO: 580113 - RNA, 19 nt, Homo sapiens
gaggcaauuuccugaagag

SEQ ID NO: 580114 - RNA, 19 nt, Homo sapiens
gacaaaggcaaucaugaag

SEQ ID NO: 580115 - RNA, 19 nt, Homo sapiens
ggacccaagaacuuuauuc

SEQ ID NO: 580116 - RNA, 19 nt, Homo sapiens
cgguagagcugggcugugu

SEQ ID NO: 580117 - RNA, 19 nt, Homo sapiens
gaugcagaccauacccuuu

SEQ ID NO: 580118 - RNA, 19 nt, Homo sapiens
gaaguggaugcagaccaua

SEQ ID NO: 580119 - RNA, 19 nt, Homo sapiens
gcacaccaacugcuuugag

SEQ ID NO: 580120 - RNA, 19 nt, Homo sapiens
cauguccgauuucaacuac

SEQ ID NO: 580121 - RNA, 19 nt, Homo sapiens
ugauggagcccgaggugaa

SEQ ID NO: 580122 - RNA, 19 nt, Homo sapiens
gggagcugcuggucaucga

SEQ ID NO: 580123 - RNA, 19 nt, Homo sapiens
ccgcugcugcugcuccuua

SEQ ID NO: 580124 - RNA, 19 nt, Homo sapiens
acgagaagauguucaagcu

SEQ ID NO: 580125 - RNA, 19 nt, Homo sapiens
ggacgagggcugcuaugac

SEQ ID NO: 580126 - RNA, 19 nt, Homo sapiens
ggaggugccagcucuuugg

SEQ ID NO: 580127 - RNA, 19 nt, Homo sapiens
gccaaagucaucaagaaag

SEQ ID NO: 580128 - RNA, 19 nt, Homo sapiens
cgccaaagucaucaagaaa

SEQ ID NO: 580129 - RNA, 19 nt, Homo sapiens
ggacaggucggagaauagg

SEQ ID NO: 580130 - RNA, 19 nt, Homo sapiens
auggacaggucggagaaua

SEQ ID NO: 580131 - RNA, 19 nt, Homo sapiens
ggaucugaaccgaaauuuc

SEQ ID NO: 580132 - RNA, 19 nt, Homo sapiens
gaggccagcuccgaguaca

SEQ ID NO: 580133 - RNA, 19 nt, Homo sapiens
caucaagaaagucaucauc

SEQ ID NO: 580134 - RNA, 19 nt, Homo sapiens
gcugggcugugugaaguuc

SEQ ID NO: 580135 - RNA, 19 nt, Homo sapiens
gcgaccuggugguguccua

SEQ ID NO: 580136 - RNA, 19 nt, Homo sapiens
cacaaagccgcugccauuu

SEQ ID NO: 580137 - RNA, 19 nt, Homo sapiens
aaagucaucaagaaaguca

SEQ ID NO: 580138 - RNA, 19 nt, Homo sapiens
gagaggacgagggcugcua

SEQ ID NO: 580139 - RNA, 19 nt, Homo sapiens
ugacugccaccgcuacuuc

SEQ ID NO: 580140 - RNA, 19 nt, Homo sapiens
gggaggugccagcucuuug

SEQ ID NO: 580141 - RNA, 19 nt, Homo sapiens
gcucaucggcaacauucau

SEQ ID NO: 580142 - RNA, 19 nt, Homo sapiens
ggacuucauucugcaaccu

SEQ ID NO: 580143 - RNA, 19 nt, Homo sapiens
gguauccacauugucauug

SEQ ID NO: 580144 - RNA, 19 nt, Homo sapiens
uggaggcaauuuccugaag

SEQ ID NO: 580145 - RNA, 19 nt, Homo sapiens
gccacagacaucccacaaa

SEQ ID NO: 580146 - RNA, 19 nt, Homo sapiens
gcucucagccagccuucau

SEQ ID NO: 580147 - RNA, 19 nt, Homo sapiens
gauagaagauggugagauu

SEQ ID NO: 580148 - RNA, 19 nt, Homo sapiens
gaaacaaaccauccaguua

SEQ ID NO: 580149 - RNA, 19 nt, Homo sapiens
uaaagucugucguggauuu

SEQ ID NO: 580150 - RNA, 19 nt, Homo sapiens
caaaccagcugaccucaau

SEQ ID NO: 580151 - RNA, 19 nt, Homo sapiens
gaaacagauuugcaaacuu

SEQ ID NO: 580152 - RNA, 19 nt, Homo sapiens
gaaauacguucugcacaug

SEQ ID NO: 580153 - RNA, 19 nt, Homo sapiens
caaaugcacuuguggaaag

SEQ ID NO: 580154 - RNA, 19 nt, Homo sapiens
ggaaacagauuugcaaacu

SEQ ID NO: 580155 - RNA, 19 nt, Homo sapiens
cagcugaccucaauacaug

SEQ ID NO: 580156 - RNA, 19 nt, Homo sapiens
uccgaaaccuggugaauaa

SEQ ID NO: 580157 - RNA, 19 nt, Homo sapiens
ggaaacaaaccauccaguu

SEQ ID NO: 580158 - RNA, 19 nt, Homo sapiens
gacaagaugcagaugaaua

SEQ ID NO: 580159 - RNA, 19 nt, Homo sapiens
gaagaugauucaggaaaca

SEQ ID NO: 580160 - RNA, 19 nt, Homo sapiens
uaaagagaauggagccuau

SEQ ID NO: 580161 - RNA, 19 nt, Homo sapiens
gcaaagaaaggaaacagau

SEQ ID NO: 580162 - RNA, 19 nt, Homo sapiens
aaacaaaccauccaguuau

SEQ ID NO: 580163 - RNA, 19 nt, Homo sapiens
gcacaaguguauucaacca

SEQ ID NO: 580164 - RNA, 19 nt, Homo sapiens
gaauggagccuaugaugca

SEQ ID NO: 580165 - RNA, 19 nt, Homo sapiens
cgaguuagcacaaguguau

SEQ ID NO: 580166 - RNA, 19 nt, Homo sapiens
ggauaucuguaaagagaau

SEQ ID NO: 580167 - RNA, 19 nt, Homo sapiens
gaauuggcauccuuaagca

SEQ ID NO: 580168 - RNA, 19 nt, Homo sapiens
uaacauugaucaggagaug

SEQ ID NO: 580169 - RNA, 19 nt, Homo sapiens
caaugcauaccacgaguua

SEQ ID NO: 580170 - RNA, 19 nt, Homo sapiens
auacugggcugaagaacuu

SEQ ID NO: 580171 - RNA, 19 nt, Homo sapiens
uagacaagaugcagaugaa

SEQ ID NO: 580172 - RNA, 19 nt, Homo sapiens
gggaacuccuugcgaagaa

SEQ ID NO: 580173 - RNA, 19 nt, Homo sapiens
caaagaaaggaaacagauu

SEQ ID NO: 580174 - RNA, 19 nt, Homo sapiens
gaaaggaaacagauuugca

SEQ ID NO: 580175 - RNA, 19 nt, Homo sapiens
gaaaccuggugaauaagca

SEQ ID NO: 580176 - RNA, 19 nt, Homo sapiens
gagaauggagccuaugaug

SEQ ID NO: 580177 - RNA, 19 nt, Homo sapiens
gauaugcaacagacacuuu

SEQ ID NO: 580178 - RNA, 19 nt, Homo sapiens
gggcaaaugacacagcuuu

SEQ ID NO: 580179 - RNA, 19 nt, Homo sapiens
agaugcagaugaauacaaa

SEQ ID NO: 580180 - RNA, 19 nt, Homo sapiens
uacaacagcuaccaaaaua

SEQ ID NO: 580181 - RNA, 19 nt, Homo sapiens
ggucagucauaucauguug

SEQ ID NO: 580182 - RNA, 19 nt, Homo sapiens
ugugucaccuggagacuaa

SEQ ID NO: 580183 - RNA, 19 nt, Homo sapiens
gaguaugggcucacaagaa

SEQ ID NO: 580184 - RNA, 19 nt, Homo sapiens
caacagcuaccaaaauaua

SEQ ID NO: 580185 - RNA, 19 nt, Homo sapiens
ggaauuggcauccuuaagc

SEQ ID NO: 580186 - RNA, 19 nt, Homo sapiens
aacaaaccauccaguuauu

SEQ ID NO: 580187 - RNA, 19 nt, Homo sapiens
auggauaucuguaaagaga

SEQ ID NO: 580188 - RNA, 19 nt, Homo sapiens
gugaauaagcacagugaaa

SEQ ID NO: 580189 - RNA, 19 nt, Homo sapiens
ucgaaacgcuauucucaca

SEQ ID NO: 580190 - RNA, 19 nt, Homo sapiens
gaaggacgguauggucagu

SEQ ID NO: 580191 - RNA, 19 nt, Homo sapiens
caaugcuugucaucucuuu

SEQ ID NO: 580192 - RNA, 19 nt, Homo sapiens
ugauggauaucuguaaaga

SEQ ID NO: 580193 - RNA, 19 nt, Homo sapiens
gccaucagcuaacaaaugc

SEQ ID NO: 580194 - RNA, 19 nt, Homo sapiens
ugucguggauuuauuuauc

SEQ ID NO: 580195 - RNA, 19 nt, Homo sapiens
gaaaccuucacucgcgaua

SEQ ID NO: 580196 - RNA, 19 nt, Homo sapiens
caaauuguggguagauuca

SEQ ID NO: 580197 - RNA, 19 nt, Homo sapiens
ucagucauaucauguugga

SEQ ID NO: 580198 - RNA, 19 nt, Homo sapiens
aaaggaaacagauuugcaa

SEQ ID NO: 580199 - RNA, 19 nt, Homo sapiens
guggguagauucauuaagc

SEQ ID NO: 580200 - RNA, 19 nt, Homo sapiens
gaacaggcuauaacuacuc

SEQ ID NO: 580201 - RNA, 19 nt, Homo sapiens
gaagugcauugagcuggau

SEQ ID NO: 580202 - RNA, 19 nt, Homo sapiens
uugcaaguauuaaccagaa

SEQ ID NO: 580203 - RNA, 19 nt, Homo sapiens
cgaagaacuuaucccaucu

SEQ ID NO: 580204 - RNA, 19 nt, Homo sapiens
gagcacauucgauaugcaa

SEQ ID NO: 580205 - RNA, 19 nt, Homo sapiens
uaucccaucuggacacugu

SEQ ID NO: 580206 - RNA, 19 nt, Homo sapiens
acagugaacccucaguuug

SEQ ID NO: 580207 - RNA, 19 nt, Homo sapiens
acccagccaugcuucauaa

SEQ ID NO: 580208 - RNA, 19 nt, Homo sapiens
gggcuuugccaucagcuaa

SEQ ID NO: 580209 - RNA, 19 nt, Homo sapiens
cagccaugcuucauaacau

SEQ ID NO: 580210 - RNA, 19 nt, Homo sapiens
gcuugucaucucuuuauaa

SEQ ID NO: 580211 - RNA, 19 nt, Homo sapiens
uagcacaaguguauucaac

SEQ ID NO: 580212 - RNA, 19 nt, Homo sapiens
uuuaaagucugucguggau

SEQ ID NO: 580213 - RNA, 19 nt, Homo sapiens
gagaggaccaagccugugu

SEQ ID NO: 580214 - RNA, 19 nt, Homo sapiens
aguaugggcucacaagaag

SEQ ID NO: 580215 - RNA, 19 nt, Homo sapiens
agugaacccucaguuugua

SEQ ID NO: 580216 - RNA, 19 nt, Homo sapiens
ggaggcagagaaauacguu

SEQ ID NO: 580217 - RNA, 19 nt, Homo sapiens
auucagaggcuaacaaaga

SEQ ID NO: 580218 - RNA, 19 nt, Homo sapiens
gggcugaagaacuuugaaa

SEQ ID NO: 580219 - RNA, 19 nt, Homo sapiens
gcaaugcauaccacgaguu

SEQ ID NO: 580220 - RNA, 19 nt, Homo sapiens
gcacauucgauaugcaaca

SEQ ID NO: 580221 - RNA, 19 nt, Homo sapiens
ucucacagguucagcucuu

SEQ ID NO: 580222 - RNA, 19 nt, Homo sapiens
aagaagaugauucaggaaa

SEQ ID NO: 580223 - RNA, 19 nt, Homo sapiens
gcccaguguuccugacuuc

SEQ ID NO: 580224 - RNA, 19 nt, Homo sapiens
caaguguauucaaccaaca

SEQ ID NO: 580225 - RNA, 19 nt, Homo sapiens
ccauggcggucagucauau

SEQ ID NO: 580226 - RNA, 19 nt, Homo sapiens
uaagcaagccauagacaag

SEQ ID NO: 580227 - RNA, 19 nt, Homo sapiens
ggcggucagucauaucaug

SEQ ID NO: 580228 - RNA, 19 nt, Homo sapiens
guuacugcauuaaaucuac

SEQ ID NO: 580229 - RNA, 19 nt, Homo sapiens
gcaagucgugugcaguugu

SEQ ID NO: 580230 - RNA, 19 nt, Homo sapiens
ggcucuggauguacaagaa

SEQ ID NO: 580231 - RNA, 19 nt, Homo sapiens
gaagaacuuaucccaucug

SEQ ID NO: 580232 - RNA, 19 nt, Homo sapiens
uaugaacaggcuauaacua

SEQ ID NO: 580233 - RNA, 19 nt, Homo sapiens
cacagugaacccucaguuu

SEQ ID NO: 580234 - RNA, 19 nt, Homo sapiens
ucccagagcggcagccuuu

SEQ ID NO: 580235 - RNA, 19 nt, Homo sapiens
cucaggaggcagagaaaua

SEQ ID NO: 580236 - RNA, 19 nt, Homo sapiens
aagaauauucagaggcuaa

SEQ ID NO: 580237 - RNA, 19 nt, Homo sapiens
gugaacugaucaacaagag

SEQ ID NO: 580238 - RNA, 19 nt, Homo sapiens
gcucggggcucuggaugua

SEQ ID NO: 580239 - RNA, 19 nt, Homo sapiens
caaaccauccaguuauucu

SEQ ID NO: 580240 - RNA, 19 nt, Homo sapiens
agaagaugauucaggaaac

SEQ ID NO: 580241 - RNA, 19 nt, Homo sapiens
caagucgugugcaguuguc

SEQ ID NO: 580242 - RNA, 19 nt, Homo sapiens
aauuguggguagauucauu

SEQ ID NO: 580243 - RNA, 19 nt, Homo sapiens
ugaacaggcuauaacuacu

SEQ ID NO: 580244 - RNA, 19 nt, Homo sapiens
gaucucugccagcuuuguu

SEQ ID NO: 580245 - RNA, 19 nt, Homo sapiens
ggagcacauucgauaugca

SEQ ID NO: 580246 - RNA, 19 nt, Homo sapiens
aggacgguauggucaguuu

SEQ ID NO: 580247 - RNA, 19 nt, Homo sapiens
ccacuugucucuaauuuau

SEQ ID NO: 580248 - RNA, 19 nt, Homo sapiens
gaggaccacuugucucuaa

SEQ ID NO: 580249 - RNA, 19 nt, Homo sapiens
cuuaugagcuucugauuga

SEQ ID NO: 580250 - RNA, 19 nt, Homo sapiens
gaaaugcuuuaucuguguu

SEQ ID NO: 580251 - RNA, 19 nt, Homo sapiens
gaccacuugucucuaauuu

SEQ ID NO: 580252 - RNA, 19 nt, Homo sapiens
gguaagaggauacaaacaa

SEQ ID NO: 580253 - RNA, 19 nt, Homo sapiens
ggacgucuucuaccuguuu

SEQ ID NO: 580254 - RNA, 19 nt, Homo sapiens
guaagaggauacaaacaag

SEQ ID NO: 580255 - RNA, 19 nt, Homo sapiens
ugaaaugcuuuaucugugu

SEQ ID NO: 580256 - RNA, 19 nt, Homo sapiens
ggaucaguuugcuaaauga

SEQ ID NO: 580257 - RNA, 19 nt, Homo sapiens
ugaugaaucuuaugagcuu

SEQ ID NO: 580258 - RNA, 19 nt, Homo sapiens
gaugacugaugaaucuuau

SEQ ID NO: 580259 - RNA, 19 nt, Homo sapiens
gcucggaacccuaugaaga

SEQ ID NO: 580260 - RNA, 19 nt, Homo sapiens
caagguaagaggauacaaa

SEQ ID NO: 580261 - RNA, 19 nt, Homo sapiens
gaaauuugcacuacgucuu

SEQ ID NO: 580262 - RNA, 19 nt, Homo sapiens
gguggaagacccgcgauua

SEQ ID NO: 580263 - RNA, 19 nt, Homo sapiens
gaguggaucaguuugcuaa

SEQ ID NO: 580264 - RNA, 19 nt, Homo sapiens
gaagaagaccgaggagauc

SEQ ID NO: 580265 - RNA, 19 nt, Homo sapiens
gcccagccaugcaauguuc

SEQ ID NO: 580266 - RNA, 19 nt, Homo sapiens
ggguccaucugugauauuu

SEQ ID NO: 580267 - RNA, 19 nt, Homo sapiens
ugacugaugaaucuuauga

SEQ ID NO: 580268 - RNA, 19 nt, Homo sapiens
uuuacaagcaccacauuua

SEQ ID NO: 580269 - RNA, 19 nt, Homo sapiens
guggaagacccgcgauuaa

SEQ ID NO: 580270 - RNA, 19 nt, Homo sapiens
uggaucaguuugcuaaaug

SEQ ID NO: 580271 - RNA, 19 nt, Homo sapiens
caucugugauauuucuuug

SEQ ID NO: 580272 - RNA, 19 nt, Homo sapiens
ggaagacccgcgauuaaac

SEQ ID NO: 580273 - RNA, 19 nt, Homo sapiens
ucaguuugcuaaaugaaca

SEQ ID NO: 580274 - RNA, 19 nt, Homo sapiens
ggaccacuugucucuaauu

SEQ ID NO: 580275 - RNA, 19 nt, Homo sapiens
gugacaauguuuacaagca

SEQ ID NO: 580276 - RNA, 19 nt, Homo sapiens
cgacugcgaccucuacuuc

SEQ ID NO: 580277 - RNA, 19 nt, Homo sapiens
gcacugucuuacuauucaa

SEQ ID NO: 580278 - RNA, 19 nt, Homo sapiens
ugaagaagaccgaggagau

SEQ ID NO: 580279 - RNA, 19 nt, Homo sapiens
gaacguggaccuguuucug

SEQ ID NO: 580280 - RNA, 19 nt, Homo sapiens
guggaucaguuugcuaaau

SEQ ID NO: 580281 - RNA, 19 nt, Homo sapiens
ugaugacugaugaaucuua

SEQ ID NO: 580282 - RNA, 19 nt, Homo sapiens
agugaugacugaugaaucu

SEQ ID NO: 580283 - RNA, 19 nt, Homo sapiens
ggugaacguggaccuguuu

SEQ ID NO: 580284 - RNA, 19 nt, Homo sapiens
guggucggguaucuaguuu

SEQ ID NO: 580285 - RNA, 19 nt, Homo sapiens
caagggcaaguacauguug

SEQ ID NO: 580286 - RNA, 19 nt, Homo sapiens
ggaggaaacccuacaaccu

SEQ ID NO: 580287 - RNA, 19 nt, Homo sapiens
uacaaccucucccgcaaga

SEQ ID NO: 580288 - RNA, 19 nt, Homo sapiens
ucugugauauuucuuugug

SEQ ID NO: 580289 - RNA, 19 nt, Homo sapiens
ucacuucggugugguugga

SEQ ID NO: 580290 - RNA, 19 nt, Homo sapiens
gcaccuggacgucuucuac

SEQ ID NO: 580291 - RNA, 19 nt, Homo sapiens
gaggcgacuucucaagcuu

SEQ ID NO: 580292 - RNA, 19 nt, Homo sapiens
ggaacccuaugaagaagac

SEQ ID NO: 580293 - RNA, 19 nt, Homo sapiens
gcgaggacuucuccaacuc

SEQ ID NO: 580294 - RNA, 19 nt, Homo sapiens
guccaucugugauauuucu

SEQ ID NO: 580295 - RNA, 19 nt, Homo sapiens
uggaagacccgcgauuaaa

SEQ ID NO: 580296 - RNA, 19 nt, Homo sapiens
ucuacuuccuggagaacua

SEQ ID NO: 580297 - RNA, 19 nt, Homo sapiens
gugguuggaagaagacuuu

SEQ ID NO: 580298 - RNA, 19 nt, Homo sapiens
gaucaguuugcuaaaugaa

SEQ ID NO: 580299 - RNA, 19 nt, Homo sapiens
uaagaggauacaaacaaga

SEQ ID NO: 580300 - RNA, 19 nt, Homo sapiens
caaggugucgguuuugaua

SEQ ID NO: 580301 - RNA, 19 nt, Homo sapiens
cggaggaggagcugaagaa

SEQ ID NO: 580302 - RNA, 19 nt, Homo sapiens
guacggcaccgggaggaaa

SEQ ID NO: 580303 - RNA, 19 nt, Homo sapiens
gaaggugcccagccaugca

SEQ ID NO: 580304 - RNA, 19 nt, Homo sapiens
ggacggugacaauguuuac

SEQ ID NO: 580305 - RNA, 19 nt, Homo sapiens
aaauuugcacuacgucuug

SEQ ID NO: 580306 - RNA, 19 nt, Homo sapiens
gcaagacccacauccucau

SEQ ID NO: 580307 - RNA, 19 nt, Homo sapiens
uauucaagguaagaggaua

SEQ ID NO: 580308 - RNA, 19 nt, Homo sapiens
ugcacugucuuacuauuca

SEQ ID NO: 580309 - RNA, 19 nt, Homo sapiens
guggaccuguuucuguuuc

SEQ ID NO: 580310 - RNA, 19 nt, Homo sapiens
gcaagugcgggcuacucaa

SEQ ID NO: 580311 - RNA, 19 nt, Homo sapiens
ugucuuacuauucaaggua

SEQ ID NO: 580312 - RNA, 19 nt, Homo sapiens
ggugaguggucggguaucu

SEQ ID NO: 580313 - RNA, 19 nt, Homo sapiens
cgaggcgacuucucaagcu

SEQ ID NO: 580314 - RNA, 19 nt, Homo sapiens
gaagaccgaggagaucuac

SEQ ID NO: 580315 - RNA, 19 nt, Homo sapiens
gcucaagggcaaguacaug

SEQ ID NO: 580316 - RNA, 19 nt, Homo sapiens
ucucugaaauuugcacuac

SEQ ID NO: 580317 - RNA, 19 nt, Homo sapiens
ucaagggcaaguacauguu

SEQ ID NO: 580318 - RNA, 19 nt, Homo sapiens
ccaucugugauauuucuuu

SEQ ID NO: 580319 - RNA, 19 nt, Homo sapiens
uuacaagcaccacauuuac

SEQ ID NO: 580320 - RNA, 19 nt, Homo sapiens
guuuacaagcaccacauuu

SEQ ID NO: 580321 - RNA, 19 nt, Homo sapiens
gugcggacggugacaaugu

SEQ ID NO: 580322 - RNA, 19 nt, Homo sapiens
gacgucuucuaccuguuug

SEQ ID NO: 580323 - RNA, 19 nt, Homo sapiens
acguggaccuguuucuguu

SEQ ID NO: 580324 - RNA, 19 nt, Homo sapiens
ucugaaauuugcacuacgu

SEQ ID NO: 580325 - RNA, 19 nt, Homo sapiens
gaagacccgcgauuaaacc

SEQ ID NO: 580326 - RNA, 19 nt, Homo sapiens
gggacugugugcgcaagug

SEQ ID NO: 580327 - RNA, 19 nt, Homo sapiens
gcaagaagcaccaccagua

SEQ ID NO: 580328 - RNA, 19 nt, Homo sapiens
gcuggucgcccaaauauaa

SEQ ID NO: 580329 - RNA, 19 nt, Homo sapiens
uggaguaucuggugaaaug

SEQ ID NO: 580330 - RNA, 19 nt, Homo sapiens
agaccuggaugaacccaua

SEQ ID NO: 580331 - RNA, 19 nt, Homo sapiens
aggagcagcugaugggaua

SEQ ID NO: 580332 - RNA, 19 nt, Homo sapiens
gcgaacugccucaccguua

SEQ ID NO: 580333 - RNA, 19 nt, Homo sapiens
ggaugaacccauagacuug

SEQ ID NO: 580334 - RNA, 19 nt, Homo sapiens
gcaagagcggcaaguacua

SEQ ID NO: 580335 - RNA, 19 nt, Homo sapiens
agaugaagauagucaagaa

SEQ ID NO: 580336 - RNA, 19 nt, Homo sapiens
gaugggauaucggaagaga

SEQ ID NO: 580337 - RNA, 19 nt, Homo sapiens
gaacggacgcaucgugauc

SEQ ID NO: 580338 - RNA, 19 nt, Homo sapiens
ucaagaacaagaacaagaa

SEQ ID NO: 580339 - RNA, 19 nt, Homo sapiens
ugaagauagucaagaacaa

SEQ ID NO: 580340 - RNA, 19 nt, Homo sapiens
gaagauagucaagaacaag

SEQ ID NO: 580341 - RNA, 19 nt, Homo sapiens
gaggcuggucgcccaaaua

SEQ ID NO: 580342 - RNA, 19 nt, Homo sapiens
gcccuucuuugggaauaua

SEQ ID NO: 580343 - RNA, 19 nt, Homo sapiens
gcaagggcagaguggagua

SEQ ID NO: 580344 - RNA, 19 nt, Homo sapiens
aguacgagcucaacagcaa

SEQ ID NO: 580345 - RNA, 19 nt, Homo sapiens
uggagagcaucgagaagaa

SEQ ID NO: 580346 - RNA, 19 nt, Homo sapiens
aggaguacgugacggugua

SEQ ID NO: 580347 - RNA, 19 nt, Homo sapiens
gcgcagaggagaagaaggu

SEQ ID NO: 580348 - RNA, 19 nt, Homo sapiens
cgaacugccucaccguuac

SEQ ID NO: 580349 - RNA, 19 nt, Homo sapiens
cgaguucaagcccuucuuu

SEQ ID NO: 580350 - RNA, 19 nt, Homo sapiens
ccagcucccuccaggugaa

SEQ ID NO: 580351 - RNA, 19 nt, Homo sapiens
gcaugcaggcggugaagau

SEQ ID NO: 580352 - RNA, 19 nt, Homo sapiens
ugaucgugaugagcaaaua

SEQ ID NO: 580353 - RNA, 19 nt, Homo sapiens
gcaagaugaagauagucaa

SEQ ID NO: 580354 - RNA, 19 nt, Homo sapiens
caagaagcaccaccaguac

SEQ ID NO: 580355 - RNA, 19 nt, Homo sapiens
gcugaucgccuuccagaac

SEQ ID NO: 580356 - RNA, 19 nt, Homo sapiens
gucaagaacaagaacaaga

SEQ ID NO: 580357 - RNA, 19 nt, Homo sapiens
uggaugaacccauagacuu

SEQ ID NO: 580358 - RNA, 19 nt, Homo sapiens
aaauguacgaccugcagua

SEQ ID NO: 580359 - RNA, 19 nt, Homo sapiens
acuaccagcucaacagcaa

SEQ ID NO: 580360 - RNA, 19 nt, Homo sapiens
guggagagcaucgagaaga

SEQ ID NO: 580361 - RNA, 19 nt, Homo sapiens
cugaugggauaucggaaga

SEQ ID NO: 580362 - RNA, 19 nt, Homo sapiens
gaggagguguccgggguua

SEQ ID NO: 580363 - RNA, 19 nt, Homo sapiens
ggcaagaugaagauaguca

SEQ ID NO: 580364 - RNA, 19 nt, Homo sapiens
gaguucaagcccuucuuug

SEQ ID NO: 580365 - RNA, 19 nt, Homo sapiens
cgugggaaccggaggagaa

SEQ ID NO: 580366 - RNA, 19 nt, Homo sapiens
gcuagacucagaccuggau

SEQ ID NO: 580367 - RNA, 19 nt, Homo sapiens
gaggucauccugcuagacu

SEQ ID NO: 580368 - RNA, 19 nt, Homo sapiens
caagaugaagauagucaag

SEQ ID NO: 580369 - RNA, 19 nt, Homo sapiens
gggcaagagcggcaaguac

SEQ ID NO: 580370 - RNA, 19 nt, Homo sapiens
gagcaaauacauggagaac

SEQ ID NO: 580371 - RNA, 19 nt, Homo sapiens
ggcaagagcggcaaguacu

SEQ ID NO: 580372 - RNA, 19 nt, Homo sapiens
gaguaucuggugaaaugga

SEQ ID NO: 580373 - RNA, 19 nt, Homo sapiens
ggucauccugcuagacuca

SEQ ID NO: 580374 - RNA, 19 nt, Homo sapiens
ugcaggcggugaagaucaa

SEQ ID NO: 580375 - RNA, 19 nt, Homo sapiens
ggacuccuccacugacaac

SEQ ID NO: 580376 - RNA, 19 nt, Homo sapiens
ggagauacagcucuagaua

SEQ ID NO: 580377 - RNA, 19 nt, Homo sapiens
ggagaaggacccagagaaa

SEQ ID NO: 580378 - RNA, 19 nt, Homo sapiens
gagauacagcucuagauaa

SEQ ID NO: 580379 - RNA, 19 nt, Homo sapiens
gugagcagaucaagaagaa

SEQ ID NO: 580380 - RNA, 19 nt, Homo sapiens
ucaaaugcauugccaagga

SEQ ID NO: 580381 - RNA, 19 nt, Homo sapiens
gaaugaugccaaacucuuu

SEQ ID NO: 580382 - RNA, 19 nt, Homo sapiens
auacagcucuagauaagaa

SEQ ID NO: 580383 - RNA, 19 nt, Homo sapiens
aagaagaacuuugccaaga

SEQ ID NO: 580384 - RNA, 19 nt, Homo sapiens
ugagugagcagaucaagaa

SEQ ID NO: 580385 - RNA, 19 nt, Homo sapiens
gaaggccgaguacgaguuu

SEQ ID NO: 580386 - RNA, 19 nt, Homo sapiens
ugacgagaaugaugccaaa

SEQ ID NO: 580387 - RNA, 19 nt, Homo sapiens
gaugaagacuccaaaauca

SEQ ID NO: 580388 - RNA, 19 nt, Homo sapiens
agauacagcucuagauaag

SEQ ID NO: 580389 - RNA, 19 nt, Homo sapiens
ggugcuggaugcugugaaa

SEQ ID NO: 580390 - RNA, 19 nt, Homo sapiens
ugucaucgccuacaucuug

SEQ ID NO: 580391 - RNA, 19 nt, Homo sapiens
gaaggcagcauggagaaug

SEQ ID NO: 580392 - RNA, 19 nt, Homo sapiens
gcgguuacccucccuucua

SEQ ID NO: 580393 - RNA, 19 nt, Homo sapiens
ggagcucuuugaccguauu

SEQ ID NO: 580394 - RNA, 19 nt, Homo sapiens
gaagcaggcggaggacauu

SEQ ID NO: 580395 - RNA, 19 nt, Homo sapiens
gcagaucaagaagaacuuu

SEQ ID NO: 580396 - RNA, 19 nt, Homo sapiens
cgagaaugaugccaaacuc

SEQ ID NO: 580397 - RNA, 19 nt, Homo sapiens
gaagcugguggccaucaaa

SEQ ID NO: 580398 - RNA, 19 nt, Homo sapiens
agaagaacuuugccaagag

SEQ ID NO: 580399 - RNA, 19 nt, Homo sapiens
ggaggacauuagagacauc

SEQ ID NO: 580400 - RNA, 19 nt, Homo sapiens
gagcagaucaagaagaacu

SEQ ID NO: 580401 - RNA, 19 nt, Homo sapiens
gauuucauccggcacuuga

SEQ ID NO: 580402 - RNA, 19 nt, Homo sapiens
ggaagcaggcggaggacau

SEQ ID NO: 580403 - RNA, 19 nt, Homo sapiens
gcuggaugcugugaaauac

SEQ ID NO: 580404 - RNA, 19 nt, Homo sapiens
ggccaccucuaccucauca

SEQ ID NO: 580405 - RNA, 19 nt, Homo sapiens
cagcauggagaaugagauu

SEQ ID NO: 580406 - RNA, 19 nt, Homo sapiens
aaucaugaucuccgacuuu

SEQ ID NO: 580407 - RNA, 19 nt, Homo sapiens
gauccuggcagaagauaag

SEQ ID NO: 580408 - RNA, 19 nt, Homo sapiens
cgguuacccucccuucuau

SEQ ID NO: 580409 - RNA, 19 nt, Homo sapiens
gcaggcggaggacauuaga

SEQ ID NO: 580410 - RNA, 19 nt, Homo sapiens
aagauaagaggacgcagaa

SEQ ID NO: 580411 - RNA, 19 nt, Homo sapiens
aaggcagcauggagaauga

SEQ ID NO: 580412 - RNA, 19 nt, Homo sapiens
ggcacuugauggagaagga

SEQ ID NO: 580413 - RNA, 19 nt, Homo sapiens
ggacgacaucucugacucu

SEQ ID NO: 580414 - RNA, 19 nt, Homo sapiens
guuacccucccuucuauga

SEQ ID NO: 580415 - RNA, 19 nt, Homo sapiens
gcaaggaaggcagcaugga

SEQ ID NO: 580416 - RNA, 19 nt, Homo sapiens
ugcaggagauacagcucua

SEQ ID NO: 580417 - RNA, 19 nt, Homo sapiens
acaucuugcucugcgguua

SEQ ID NO: 580418 - RNA, 19 nt, Homo sapiens
cccagaagcccuacagcaa

SEQ ID NO: 580419 - RNA, 19 nt, Homo sapiens
acuacagccuggaugaaga

SEQ ID NO: 580420 - RNA, 19 nt, Homo sapiens
guacuacagccuggaugaa

SEQ ID NO: 580421 - RNA, 19 nt, Homo sapiens
gcauggagaaugagauugc

SEQ ID NO: 580422 - RNA, 19 nt, Homo sapiens
uaccacuccucacugcauu

SEQ ID NO: 580423 - RNA, 19 nt, Homo sapiens
agaaugaugccaaacucuu

SEQ ID NO: 580424 - RNA, 19 nt, Homo sapiens
gaucaagcaccccaacauu

SEQ ID NO: 580425 - RNA, 19 nt, Homo sapiens
gaggugauccuggcagaag

SEQ ID NO: 580426 - RNA, 19 nt, Homo sapiens
gcggaggacauuagagaca

SEQ ID NO: 580427 - RNA, 19 nt, Homo sapiens
ggaugaagacuccaaaauc

SEQ ID NO: 580428 - RNA, 19 nt, Homo sapiens
uugcagcacccauggauug

SEQ ID NO: 580429 - RNA, 19 nt, Homo sapiens
gagaaggacccagagaaaa

SEQ ID NO: 580430 - RNA, 19 nt, Homo sapiens
gagaaugaugccaaacucu

SEQ ID NO: 580431 - RNA, 19 nt, Homo sapiens
gcaugaccugggcauugua

SEQ ID NO: 580432 - RNA, 19 nt, Homo sapiens
gcucuuugaccguauugug

SEQ ID NO: 580433 - RNA, 19 nt, Homo sapiens
ccaccucuaccucaucaug

SEQ ID NO: 580434 - RNA, 19 nt, Homo sapiens
gauacagcucuagauaaga

SEQ ID NO: 580435 - RNA, 19 nt, Homo sapiens
caacauuguagcccuggau

SEQ ID NO: 580436 - RNA, 19 nt, Homo sapiens
ggaaggcagcauggagaau

SEQ ID NO: 580437 - RNA, 19 nt, Homo sapiens
caggagauacagcucuaga

SEQ ID NO: 580438 - RNA, 19 nt, Homo sapiens
ugcaugaccugggcauugu

SEQ ID NO: 580439 - RNA, 19 nt, Homo sapiens
uggagaaggacccagagaa

SEQ ID NO: 580440 - RNA, 19 nt, Homo sapiens
ugacucugccaaagauuuc

SEQ ID NO: 580441 - RNA, 19 nt, Homo sapiens
ucucugacucugccaaaga

SEQ ID NO: 580442 - RNA, 19 nt, Homo sapiens
gcugguggccaucaaaugc

SEQ ID NO: 580443 - RNA, 19 nt, Homo sapiens
agaagcugguggccaucaa

SEQ ID NO: 580444 - RNA, 19 nt, Homo sapiens
ugcuggaugcugugaaaua

SEQ ID NO: 580445 - RNA, 19 nt, Homo sapiens
gcaaguaaguuauagaaga

SEQ ID NO: 580446 - RNA, 19 nt, Homo sapiens
caaacacgcuccauguaua

SEQ ID NO: 580447 - RNA, 19 nt, Homo sapiens
gaagagaaaugcugcuaga

SEQ ID NO: 580448 - RNA, 19 nt, Homo sapiens
ggaauuaagcguuguagua

SEQ ID NO: 580449 - RNA, 19 nt, Homo sapiens
gaagaaagcaaaccaagaa

SEQ ID NO: 580450 - RNA, 19 nt, Homo sapiens
ggaaguagaaucagccuua

SEQ ID NO: 580451 - RNA, 19 nt, Homo sapiens
gcaaauaacaguaaagaug

SEQ ID NO: 580452 - RNA, 19 nt, Homo sapiens
ccacacaguucagcacuua

SEQ ID NO: 580453 - RNA, 19 nt, Homo sapiens
gaauuaagcguuguaguaa

SEQ ID NO: 580454 - RNA, 19 nt, Homo sapiens
gaugucagcuccaauaaag

SEQ ID NO: 580455 - RNA, 19 nt, Homo sapiens
ccaaagaguugaagaccaa

SEQ ID NO: 580456 - RNA, 19 nt, Homo sapiens
ucaaauaggguccuuguaa

SEQ ID NO: 580457 - RNA, 19 nt, Homo sapiens
ggaugagguuccuggcuua

SEQ ID NO: 580458 - RNA, 19 nt, Homo sapiens
ggucaggaguucaagacua

SEQ ID NO: 580459 - RNA, 19 nt, Homo sapiens
cgacagagcaagauucuau

SEQ ID NO: 580460 - RNA, 19 nt, Homo sapiens
gauguuggaugcucaagug

SEQ ID NO: 580461 - RNA, 19 nt, Homo sapiens
agagcaagauucuaucaaa

SEQ ID NO: 580462 - RNA, 19 nt, Homo sapiens
ccaagagaaugaaccagaa

SEQ ID NO: 580463 - RNA, 19 nt, Homo sapiens
caaauaggguccuuguaag

SEQ ID NO: 580464 - RNA, 19 nt, Homo sapiens
gagccgaaguugcaccauu

SEQ ID NO: 580465 - RNA, 19 nt, Homo sapiens
gaagucagcagccgagaug

SEQ ID NO: 580466 - RNA, 19 nt, Homo sapiens
caguagagauuauaaaguc

SEQ ID NO: 580467 - RNA, 19 nt, Homo sapiens
caaguaaguuauagaagag

SEQ ID NO: 580468 - RNA, 19 nt, Homo sapiens
gggcagagcaucaagacaa

SEQ ID NO: 580469 - RNA, 19 nt, Homo sapiens
auaggguccuuguaaguua

SEQ ID NO: 580470 - RNA, 19 nt, Homo sapiens
gcagugagccgaaguugca

SEQ ID NO: 580471 - RNA, 19 nt, Homo sapiens
ccuguaaucucagcacuuu

SEQ ID NO: 580472 - RNA, 19 nt, Homo sapiens
gaaugaauaagcguuguuu

SEQ ID NO: 580473 - RNA, 19 nt, Homo sapiens
ucagaagagucgaugauca

SEQ ID NO: 580474 - RNA, 19 nt, Homo sapiens
cgaacucacugcagaaugg

SEQ ID NO: 580475 - RNA, 19 nt, Homo sapiens
uaaauucacaucucaagga

SEQ ID NO: 580476 - RNA, 19 nt, Homo sapiens
gaaggaauuaagcguugua

SEQ ID NO: 580477 - RNA, 19 nt, Homo sapiens
gaaaugcugcuagaaggaa

SEQ ID NO: 580478 - RNA, 19 nt, Homo sapiens
gcucucgccuguaaucuca

SEQ ID NO: 580479 - RNA, 19 nt, Homo sapiens
caagauguguucuccuuac

SEQ ID NO: 580480 - RNA, 19 nt, Homo sapiens
gcaauggguaaccaaauga

SEQ ID NO: 580481 - RNA, 19 nt, Homo sapiens
ggcaguggcaaguaaguua

SEQ ID NO: 580482 - RNA, 19 nt, Homo sapiens
gggaauagaggaauguguu

SEQ ID NO: 580483 - RNA, 19 nt, Homo sapiens
ggaaagggagggaauagag

SEQ ID NO: 580484 - RNA, 19 nt, Homo sapiens
ccaaacacgcuccauguau

SEQ ID NO: 580485 - RNA, 19 nt, Homo sapiens
gagaugaacaagcagaaga

SEQ ID NO: 580486 - RNA, 19 nt, Homo sapiens
ccacucagaagaaauaaau

SEQ ID NO: 580487 - RNA, 19 nt, Homo sapiens
gaaucagccuuacaaacag

SEQ ID NO: 580488 - RNA, 19 nt, Homo sapiens
agaaucagccuuacaaaca

SEQ ID NO: 580489 - RNA, 19 nt, Homo sapiens
gcuauagcagagaauaaua

SEQ ID NO: 580490 - RNA, 19 nt, Homo sapiens
ccuuguaaguuauugauga

SEQ ID NO: 580491 - RNA, 19 nt, Homo sapiens
gcaaacagacccaguaucc

SEQ ID NO: 580492 - RNA, 19 nt, Homo sapiens
gagcaccacagaaggguaa

SEQ ID NO: 580493 - RNA, 19 nt, Homo sapiens
gaucacccacucagaagaa

SEQ ID NO: 580494 - RNA, 19 nt, Homo sapiens
gagcaagauucuaucaaaa

SEQ ID NO: 580495 - RNA, 19 nt, Homo sapiens
gcaggaaagggagggaaua

SEQ ID NO: 580496 - RNA, 19 nt, Homo sapiens
gcaggaagccaaagaacca

SEQ ID NO: 580497 - RNA, 19 nt, Homo sapiens
caacaagcaggaagccaaa

SEQ ID NO: 580498 - RNA, 19 nt, Homo sapiens
gaacuuggaacugcggauu

SEQ ID NO: 580499 - RNA, 19 nt, Homo sapiens
ggcaagaauuccaaaggau

SEQ ID NO: 580500 - RNA, 19 nt, Homo sapiens
cagcagcuauagcagagaa

SEQ ID NO: 580501 - RNA, 19 nt, Homo sapiens
ugagguuccuggcuuauca

SEQ ID NO: 580502 - RNA, 19 nt, Homo sapiens
cggauaauguggccacuuc

SEQ ID NO: 580503 - RNA, 19 nt, Homo sapiens
agcccgagcuguuguauau

SEQ ID NO: 580504 - RNA, 19 nt, Homo sapiens
uuaaaggccugggaccaaa

SEQ ID NO: 580505 - RNA, 19 nt, Homo sapiens
cagccgagaugaacaagca

SEQ ID NO: 580506 - RNA, 19 nt, Homo sapiens
gauuauaaaguccaaggaa

SEQ ID NO: 580507 - RNA, 19 nt, Homo sapiens
ccacuucagcugaccuuaa

SEQ ID NO: 580508 - RNA, 19 nt, Homo sapiens
uaucagggcaguccgauga

SEQ ID NO: 580509 - RNA, 19 nt, Homo sapiens
ggcaccagcugcuaaaucu

SEQ ID NO: 580510 - RNA, 19 nt, Homo sapiens
gaaaccccgucucuacuaa

SEQ ID NO: 580511 - RNA, 19 nt, Homo sapiens
gaaauaaaugggaaagacu

SEQ ID NO: 580512 - RNA, 19 nt, Homo sapiens
aaaccaagaaccucucuga

SEQ ID NO: 580513 - RNA, 19 nt, Homo sapiens
caaaagagaagaaagcaaa

SEQ ID NO: 580514 - RNA, 19 nt, Homo sapiens
gaaguagaaucagccuuac

SEQ ID NO: 580515 - RNA, 19 nt, Homo sapiens
aggagaaugugguguguga

SEQ ID NO: 580516 - RNA, 19 nt, Homo sapiens
ggaggagaauguggugugu

SEQ ID NO: 580517 - RNA, 19 nt, Homo sapiens
ggaaggcaccaaggagaaa

SEQ ID NO: 580518 - RNA, 19 nt, Homo sapiens
uggcaagaauuccaaagga

SEQ ID NO: 580519 - RNA, 19 nt, Homo sapiens
gugacaacggcaaagauua

SEQ ID NO: 580520 - RNA, 19 nt, Homo sapiens
gcacgguucccaccagguu

SEQ ID NO: 580521 - RNA, 19 nt, Homo sapiens
caacgcgucugcucugaac

SEQ ID NO: 580522 - RNA, 19 nt, Homo sapiens
ccacagaagcgaaacucaa

SEQ ID NO: 580523 - RNA, 19 nt, Homo sapiens
gaagacacgggugcugaaa

SEQ ID NO: 580524 - RNA, 19 nt, Homo sapiens
cuaacaaagcugaaacaaa

SEQ ID NO: 580525 - RNA, 19 nt, Homo sapiens
gcagcuauagcagagaaua

SEQ ID NO: 580526 - RNA, 19 nt, Homo sapiens
gcccaaggacuccagcuuu

SEQ ID NO: 580527 - RNA, 19 nt, Homo sapiens
cccgagcuguuguauauug

SEQ ID NO: 580528 - RNA, 19 nt, Homo sapiens
caacaggagcaccacagaa

SEQ ID NO: 580529 - RNA, 19 nt, Homo sapiens
uauaaaguccaaggaagua

SEQ ID NO: 580530 - RNA, 19 nt, Homo sapiens
agacuagccuggccaacau

SEQ ID NO: 580531 - RNA, 19 nt, Homo sapiens
gaggaauguguucggguua

SEQ ID NO: 580532 - RNA, 19 nt, Homo sapiens
gggagggaauagaggaaug

SEQ ID NO: 580533 - RNA, 19 nt, Homo sapiens
aaauuaagcccgagcuguu

SEQ ID NO: 580534 - RNA, 19 nt, Homo sapiens
gccagagccugaaccaaca

SEQ ID NO: 580535 - RNA, 19 nt, Homo sapiens
gaccuuaagucagacaaag

SEQ ID NO: 580536 - RNA, 19 nt, Homo sapiens
gaacugcggauugcucugu

SEQ ID NO: 580537 - RNA, 19 nt, Homo sapiens
gcagggaaggacauaguug

SEQ ID NO: 580538 - RNA, 19 nt, Homo sapiens
ggaaugaauaagcguuguu

SEQ ID NO: 580539 - RNA, 19 nt, Homo sapiens
gucaggaguucaagacuag

SEQ ID NO: 580540 - RNA, 19 nt, Homo sapiens
aagagucgaugaucaccaa

SEQ ID NO: 580541 - RNA, 19 nt, Homo sapiens
aaccagaagcagagacuua

SEQ ID NO: 580542 - RNA, 19 nt, Homo sapiens
agaaauaaaugggaaagac

SEQ ID NO: 580543 - RNA, 19 nt, Homo sapiens
cacagaagcgaaacucaaa

SEQ ID NO: 580544 - RNA, 19 nt, Homo sapiens
agaccaagccgcagauuca

SEQ ID NO: 580545 - RNA, 19 nt, Homo sapiens
gcacuuauuucuguaguuu

SEQ ID NO: 580546 - RNA, 19 nt, Homo sapiens
gugaagaccugguaucaga

SEQ ID NO: 580547 - RNA, 19 nt, Homo sapiens
gauugaagcugaagagaag

SEQ ID NO: 580548 - RNA, 19 nt, Homo sapiens
ccaaggagaccugcgauua

SEQ ID NO: 580549 - RNA, 19 nt, Homo sapiens
cuacaagacuuucaugauc

SEQ ID NO: 580550 - RNA, 19 nt, Homo sapiens
ggaaagugcuuagcucucu

SEQ ID NO: 580551 - RNA, 19 nt, Homo sapiens
gaaaaugguucuuaaaggu

SEQ ID NO: 580552 - RNA, 19 nt, Homo sapiens
ggagaccugcgauuacuuu

SEQ ID NO: 580553 - RNA, 19 nt, Homo sapiens
gaaccgaaagcacgugaug

SEQ ID NO: 580554 - RNA, 19 nt, Homo sapiens
uccagaagcagaaguauuu

SEQ ID NO: 580555 - RNA, 19 nt, Homo sapiens
acucagcacuuauuucugu

SEQ ID NO: 580556 - RNA, 19 nt, Homo sapiens
gcgauuacuuugagaaacu

SEQ ID NO: 580557 - RNA, 19 nt, Homo sapiens
ucaugggccuggagaagaa

SEQ ID NO: 580558 - RNA, 19 nt, Homo sapiens
cagaaucgcaggaugaaau

SEQ ID NO: 580559 - RNA, 19 nt, Homo sapiens
ucuuaaagguggacaggaa

SEQ ID NO: 580560 - RNA, 19 nt, Homo sapiens
gaccugcgauuacuuugag

SEQ ID NO: 580561 - RNA, 19 nt, Homo sapiens
agaagaaauuccagaagca

SEQ ID NO: 580562 - RNA, 19 nt, Homo sapiens
gaagaccugguaucagaau

SEQ ID NO: 580563 - RNA, 19 nt, Homo sapiens
ggacaggaagcacccacaa

SEQ ID NO: 580564 - RNA, 19 nt, Homo sapiens
uaucagaaucgcaggauga

SEQ ID NO: 580565 - RNA, 19 nt, Homo sapiens
gaagcagaaguauuuguca

SEQ ID NO: 580566 - RNA, 19 nt, Homo sapiens
gcuacaagacuuucaugau

SEQ ID NO: 580567 - RNA, 19 nt, Homo sapiens
aagcagaaguauuugucaa

SEQ ID NO: 580568 - RNA, 19 nt, Homo sapiens
ccacaucagaagagauuga

SEQ ID NO: 580569 - RNA, 19 nt, Homo sapiens
gacaggaagcacccacaaa

SEQ ID NO: 580570 - RNA, 19 nt, Homo sapiens
ggagaagaaauuccagaag

SEQ ID NO: 580571 - RNA, 19 nt, Homo sapiens
gaagcugaagagaagauga

SEQ ID NO: 580572 - RNA, 19 nt, Homo sapiens
caaggagaccugcgauuac

SEQ ID NO: 580573 - RNA, 19 nt, Homo sapiens
ugacucagcacuuauuucu

SEQ ID NO: 580574 - RNA, 19 nt, Homo sapiens
agaagagauugaagcugaa

SEQ ID NO: 580575 - RNA, 19 nt, Homo sapiens
gagaaggcagggagaguag

SEQ ID NO: 580576 - RNA, 19 nt, Homo sapiens
gcaggaggagcucugugaa

SEQ ID NO: 580577 - RNA, 19 nt, Homo sapiens
ggcaggaggagcucuguga

SEQ ID NO: 580578 - RNA, 19 nt, Homo sapiens
ugucaucgcaagcauuuga

SEQ ID NO: 580579 - RNA, 19 nt, Homo sapiens
gggagaguagggagagaaa

SEQ ID NO: 580580 - RNA, 19 nt, Homo sapiens
agagaaggcagggagagua

SEQ ID NO: 580581 - RNA, 19 nt, Homo sapiens
ccaccauuaagcuaaagua

SEQ ID NO: 580582 - RNA, 19 nt, Homo sapiens
agaaauuccagaagcagaa

SEQ ID NO: 580583 - RNA, 19 nt, Homo sapiens
uguggaugcccuugauuaa

SEQ ID NO: 580584 - RNA, 19 nt, Homo sapiens
caccauuaagcuaaaguaa

SEQ ID NO: 580585 - RNA, 19 nt, Homo sapiens
uugcaagcccuauauccua

SEQ ID NO: 580586 - RNA, 19 nt, Homo sapiens
acaagacuuucaugaucga

SEQ ID NO: 580587 - RNA, 19 nt, Homo sapiens
cagguuccuugcugacuca

SEQ ID NO: 580588 - RNA, 19 nt, Homo sapiens
ccugucaccuccugaaagg

SEQ ID NO: 580589 - RNA, 19 nt, Homo sapiens
cuguggaugcccuugauua

SEQ ID NO: 580590 - RNA, 19 nt, Homo sapiens
gagauugaagcugaagaga

SEQ ID NO: 580591 - RNA, 19 nt, Homo sapiens
ugaagcacaggaaccgaaa

SEQ ID NO: 580592 - RNA, 19 nt, Homo sapiens
agauugaagcugaagagaa

SEQ ID NO: 580593 - RNA, 19 nt, Homo sapiens
cgauuacuuugagaaacuu

SEQ ID NO: 580594 - RNA, 19 nt, Homo sapiens
gaagagauugaagcugaag

SEQ ID NO: 580595 - RNA, 19 nt, Homo sapiens
cagcacuuauuucuguagu

SEQ ID NO: 580596 - RNA, 19 nt, Homo sapiens
guagggcugggucuauguu

SEQ ID NO: 580597 - RNA, 19 nt, Homo sapiens
gagagaaggcagggagagu

SEQ ID NO: 580598 - RNA, 19 nt, Homo sapiens
ggaggagcucugugaagca

SEQ ID NO: 580599 - RNA, 19 nt, Homo sapiens
aagcugaagagaagaugaa

SEQ ID NO: 580600 - RNA, 19 nt, Homo sapiens
gaaauggaagaaaaugguu

SEQ ID NO: 580601 - RNA, 19 nt, Homo sapiens
aggaugaaauggaagaaaa

SEQ ID NO: 580602 - RNA, 19 nt, Homo sapiens
gaaauuccagaagcagaag

SEQ ID NO: 580603 - RNA, 19 nt, Homo sapiens
aaggagaccugcgauuacu

SEQ ID NO: 580604 - RNA, 19 nt, Homo sapiens
ggaagacucuacugaauaa

SEQ ID NO: 580605 - RNA, 19 nt, Homo sapiens
gcacuuacaugauuauugu

SEQ ID NO: 580606 - RNA, 19 nt, Homo sapiens
gauauuggauggugugaaa

SEQ ID NO: 580607 - RNA, 19 nt, Homo sapiens
uuaaagaacugccucaauu

SEQ ID NO: 580608 - RNA, 19 nt, Homo sapiens
caaaucaacugccugaaug

SEQ ID NO: 580609 - RNA, 19 nt, Homo sapiens
gaacaaugcccuauuaagu

SEQ ID NO: 580610 - RNA, 19 nt, Homo sapiens
gaacaagauuaaagucguu

SEQ ID NO: 580611 - RNA, 19 nt, Homo sapiens
gcgauuagcagcucaauuu

SEQ ID NO: 580612 - RNA, 19 nt, Homo sapiens
cuaguagucugauguauuu

SEQ ID NO: 580613 - RNA, 19 nt, Homo sapiens
cagaaaagcucaaagauuu

SEQ ID NO: 580614 - RNA, 19 nt, Homo sapiens
gagaggacauuguuagaga

SEQ ID NO: 580615 - RNA, 19 nt, Homo sapiens
gaagauacugucuggguua

SEQ ID NO: 580616 - RNA, 19 nt, Homo sapiens
ugaguugacuguucccuua

SEQ ID NO: 580617 - RNA, 19 nt, Homo sapiens
aggaagagaugguauaauu

SEQ ID NO: 580618 - RNA, 19 nt, Homo sapiens
uaaagucguugcauugaaa

SEQ ID NO: 580619 - RNA, 19 nt, Homo sapiens
ucaguuauguggaauguuu

SEQ ID NO: 580620 - RNA, 19 nt, Homo sapiens
caagguuugugacauauuu

SEQ ID NO: 580621 - RNA, 19 nt, Homo sapiens
cagaugaagucuuaacaaa

SEQ ID NO: 580622 - RNA, 19 nt, Homo sapiens
gcaagacaccuguuuauca

SEQ ID NO: 580623 - RNA, 19 nt, Homo sapiens
gauaacaugguaccaauaa

SEQ ID NO: 580624 - RNA, 19 nt, Homo sapiens
gaaauucagucuaguucug

SEQ ID NO: 580625 - RNA, 19 nt, Homo sapiens
gaaaggugguacuaaggaa

SEQ ID NO: 580626 - RNA, 19 nt, Homo sapiens
ugagagcuguucauucuaa

SEQ ID NO: 580627 - RNA, 19 nt, Homo sapiens
cugaaaggcuagaaugaua

SEQ ID NO: 580628 - RNA, 19 nt, Homo sapiens
ggaugucccuuuaaacaga

SEQ ID NO: 580629 - RNA, 19 nt, Homo sapiens
gaugaagucuuaacaaagg

SEQ ID NO: 580630 - RNA, 19 nt, Homo sapiens
gaagaguaauggucaaucu

SEQ ID NO: 580631 - RNA, 19 nt, Homo sapiens
gaagagaacaagauuaaag

SEQ ID NO: 580632 - RNA, 19 nt, Homo sapiens
cagaagagaacaagauuaa

SEQ ID NO: 580633 - RNA, 19 nt, Homo sapiens
aaagaugccuaucaaguga

SEQ ID NO: 580634 - RNA, 19 nt, Homo sapiens
gaguaauggucaaucuuaa

SEQ ID NO: 580635 - RNA, 19 nt, Homo sapiens
caagacaccuguuuaucau

SEQ ID NO: 580636 - RNA, 19 nt, Homo sapiens
ggaagagaugguauaauuu

SEQ ID NO: 580637 - RNA, 19 nt, Homo sapiens
gggaagacucuacugaaua

SEQ ID NO: 580638 - RNA, 19 nt, Homo sapiens
gaacugagcagaagugacu

SEQ ID NO: 580639 - RNA, 19 nt, Homo sapiens
agcaagggauucuaaguua

SEQ ID NO: 580640 - RNA, 19 nt, Homo sapiens
gaggcugaauccguuauua

SEQ ID NO: 580641 - RNA, 19 nt, Homo sapiens
guugagagcuguucauucu

SEQ ID NO: 580642 - RNA, 19 nt, Homo sapiens
ccacauuccuccuucuuau

SEQ ID NO: 580643 - RNA, 19 nt, Homo sapiens
ggcaauagugcacaacuua

SEQ ID NO: 580644 - RNA, 19 nt, Homo sapiens
agugaacaaugcccuauua

SEQ ID NO: 580645 - RNA, 19 nt, Homo sapiens
agaugacucugcagaauuu

SEQ ID NO: 580646 - RNA, 19 nt, Homo sapiens
gcaauuugggcaacuuuaa

SEQ ID NO: 580647 - RNA, 19 nt, Homo sapiens
gcaggugucuucauuacca

SEQ ID NO: 580648 - RNA, 19 nt, Homo sapiens
gcuuagcucuccaggguaa

SEQ ID NO: 580649 - RNA, 19 nt, Homo sapiens
uaaagaacugccucaauuu

SEQ ID NO: 580650 - RNA, 19 nt, Homo sapiens
gugcacaacuuagguuauu

SEQ ID NO: 580651 - RNA, 19 nt, Homo sapiens
gggaugcucucucgguuug

SEQ ID NO: 580652 - RNA, 19 nt, Homo sapiens
gaauguuuguuguacaguu

SEQ ID NO: 580653 - RNA, 19 nt, Homo sapiens
aguggaaggucuugauaua

SEQ ID NO: 580654 - RNA, 19 nt, Homo sapiens
gaagacagcaacuuguaga

SEQ ID NO: 580655 - RNA, 19 nt, Homo sapiens
ccaaagccauuucaaguac

SEQ ID NO: 580656 - RNA, 19 nt, Homo sapiens
agagaaugcugguaaugaa

SEQ ID NO: 580657 - RNA, 19 nt, Homo sapiens
gagcuuauacuaacugaau

SEQ ID NO: 580658 - RNA, 19 nt, Homo sapiens
ggaaguggaagagcuuaua

SEQ ID NO: 580659 - RNA, 19 nt, Homo sapiens
caaguuugauacugaguug

SEQ ID NO: 580660 - RNA, 19 nt, Homo sapiens
ccucuacacugcagaagaa

SEQ ID NO: 580661 - RNA, 19 nt, Homo sapiens
ucaaggaucucuuccacau

SEQ ID NO: 580662 - RNA, 19 nt, Homo sapiens
gugagcagguucucccuaa

SEQ ID NO: 580663 - RNA, 19 nt, Homo sapiens
acaaugcccuauuaaguau

SEQ ID NO: 580664 - RNA, 19 nt, Homo sapiens
gauuaaagucguugcauug

SEQ ID NO: 580665 - RNA, 19 nt, Homo sapiens
gagagaaugcugguaauga

SEQ ID NO: 580666 - RNA, 19 nt, Homo sapiens
gauauacuaacgcaacuuu

SEQ ID NO: 580667 - RNA, 19 nt, Homo sapiens
gauacugaguugacuguuc

SEQ ID NO: 580668 - RNA, 19 nt, Homo sapiens
gaaccuaaacucccuugga

SEQ ID NO: 580669 - RNA, 19 nt, Homo sapiens
ggacauuguuagagaacga

SEQ ID NO: 580670 - RNA, 19 nt, Homo sapiens
ccgaaauucuuuaagcauu

SEQ ID NO: 580671 - RNA, 19 nt, Homo sapiens
uaucagacaacuucgcuua

SEQ ID NO: 580672 - RNA, 19 nt, Homo sapiens
uaacaaaggaaguggaaga

SEQ ID NO: 580673 - RNA, 19 nt, Homo sapiens
uaaagaugccuaucaagug

SEQ ID NO: 580674 - RNA, 19 nt, Homo sapiens
gcaaguuuauaucagacaa

SEQ ID NO: 580675 - RNA, 19 nt, Homo sapiens
uuuaccagaugaagucuua

SEQ ID NO: 580676 - RNA, 19 nt, Homo sapiens
agaguaauggucaaucuua

SEQ ID NO: 580677 - RNA, 19 nt, Homo sapiens
ggagaagaguaauggucaa

SEQ ID NO: 580678 - RNA, 19 nt, Homo sapiens
gucaugagcuuaauauacu

SEQ ID NO: 580679 - RNA, 19 nt, Homo sapiens
aaagagagccagugaagau

SEQ ID NO: 580680 - RNA, 19 nt, Homo sapiens
gaaugcugguaaugaagaa

SEQ ID NO: 580681 - RNA, 19 nt, Homo sapiens
uggaagagcuuauacuaac

SEQ ID NO: 580682 - RNA, 19 nt, Homo sapiens
gcaaaacuccuuuauuaga

SEQ ID NO: 580683 - RNA, 19 nt, Homo sapiens
cuucucagguuauuaauca

SEQ ID NO: 580684 - RNA, 19 nt, Homo sapiens
aaacuugacuacacaacau

SEQ ID NO: 580685 - RNA, 19 nt, Homo sapiens
uaagagcacaguaacacua

SEQ ID NO: 580686 - RNA, 19 nt, Homo sapiens
gcaagugggccagcauaaa

SEQ ID NO: 580687 - RNA, 19 nt, Homo sapiens
gccgaaaacuuccagauuu

SEQ ID NO: 580688 - RNA, 19 nt, Homo sapiens
gaauuuaaccuagugaaca

SEQ ID NO: 580689 - RNA, 19 nt, Homo sapiens
gcauauuuguaaacucaga

SEQ ID NO: 580690 - RNA, 19 nt, Homo sapiens
gagacuacagcuaaauaaa

SEQ ID NO: 580691 - RNA, 19 nt, Homo sapiens
uauagagacuacagcuaaa

SEQ ID NO: 580692 - RNA, 19 nt, Homo sapiens
gcuagaaugauacaaguga

SEQ ID NO: 580693 - RNA, 19 nt, Homo sapiens
gaauugcuguuggugaaau

SEQ ID NO: 580694 - RNA, 19 nt, Homo sapiens
guguguguguguauauaua

SEQ ID NO: 580695 - RNA, 19 nt, Homo sapiens
gggcaguggugcagcauuc

SEQ ID NO: 580696 - RNA, 19 nt, Homo sapiens
aacaaugcccuauuaagua

SEQ ID NO: 580697 - RNA, 19 nt, Homo sapiens
gaaucugaacaaaggaaua

SEQ ID NO: 580698 - RNA, 19 nt, Homo sapiens
aaccuaaacucccuuggaa

SEQ ID NO: 580699 - RNA, 19 nt, Homo sapiens
accaugagcugaaccuaaa

SEQ ID NO: 580700 - RNA, 19 nt, Homo sapiens
gaccaugagcugaaccuaa

SEQ ID NO: 580701 - RNA, 19 nt, Homo sapiens
gcuuugcaccgccuacuua

SEQ ID NO: 580702 - RNA, 19 nt, Homo sapiens
ugaauaagacaucagcauu

SEQ ID NO: 580703 - RNA, 19 nt, Homo sapiens
gaggagcuuuaccgcaauu

SEQ ID NO: 580704 - RNA, 19 nt, Homo sapiens
gaaucuagcuugcaaauau

SEQ ID NO: 580705 - RNA, 19 nt, Homo sapiens
gagaagaaauccuugcuaa

SEQ ID NO: 580706 - RNA, 19 nt, Homo sapiens
guagaucucuguagaaaug

SEQ ID NO: 580707 - RNA, 19 nt, Homo sapiens
gaugagacaagaacaauua

SEQ ID NO: 580708 - RNA, 19 nt, Homo sapiens
gaguaaauguggagcauaa

SEQ ID NO: 580709 - RNA, 19 nt, Homo sapiens
gaagaaauccuugcuaaug

SEQ ID NO: 580710 - RNA, 19 nt, Homo sapiens
ugaaggaacucuuggugua

SEQ ID NO: 580711 - RNA, 19 nt, Homo sapiens
gaaagacagcuuaaagaaa

SEQ ID NO: 580712 - RNA, 19 nt, Homo sapiens
ggaaagacagcuuaaagaa

SEQ ID NO: 580713 - RNA, 19 nt, Homo sapiens
ggcaagaaguuaugaaaug

SEQ ID NO: 580714 - RNA, 19 nt, Homo sapiens
ugaagucugucaaggaaua

SEQ ID NO: 580715 - RNA, 19 nt, Homo sapiens
gcgaauuccugauauaguu

SEQ ID NO: 580716 - RNA, 19 nt, Homo sapiens
aaagacagcuuaaagaaag

SEQ ID NO: 580717 - RNA, 19 nt, Homo sapiens
ucaaggaccucguauguca

SEQ ID NO: 580718 - RNA, 19 nt, Homo sapiens
agagaaggguguucaguuu

SEQ ID NO: 580719 - RNA, 19 nt, Homo sapiens
uaacaucuuuggaaacaga

SEQ ID NO: 580720 - RNA, 19 nt, Homo sapiens
gcugaagucugucaaggaa

SEQ ID NO: 580721 - RNA, 19 nt, Homo sapiens
caacaagcaguuucaguuu

SEQ ID NO: 580722 - RNA, 19 nt, Homo sapiens
ggaguagccuguuuaagag

SEQ ID NO: 580723 - RNA, 19 nt, Homo sapiens
caucaggcaugaagaagaa

SEQ ID NO: 580724 - RNA, 19 nt, Homo sapiens
gacaagaguuggaaagaca

SEQ ID NO: 580725 - RNA, 19 nt, Homo sapiens
gggaaaagguacccucuua

SEQ ID NO: 580726 - RNA, 19 nt, Homo sapiens
ggcagaugaucgaguauuu

SEQ ID NO: 580727 - RNA, 19 nt, Homo sapiens
gaaagaauaacaagggaau

SEQ ID NO: 580728 - RNA, 19 nt, Homo sapiens
gcaagaaguuaugaaaugg

SEQ ID NO: 580729 - RNA, 19 nt, Homo sapiens
ugaggcagcugcuagagaa

SEQ ID NO: 580730 - RNA, 19 nt, Homo sapiens
gcagggugacgcagacuua

SEQ ID NO: 580731 - RNA, 19 nt, Homo sapiens
guuauuugcugaccuaugu

SEQ ID NO: 580732 - RNA, 19 nt, Homo sapiens
ggagggagccugucacauc

SEQ ID NO: 580733 - RNA, 19 nt, Homo sapiens
ggugguagaucucuguaga

SEQ ID NO: 580734 - RNA, 19 nt, Homo sapiens
gaaagugguuauuguacag

SEQ ID NO: 580735 - RNA, 19 nt, Homo sapiens
gcagaugaucgaguauuua

SEQ ID NO: 580736 - RNA, 19 nt, Homo sapiens
uaaaggaaaguaucucuga

SEQ ID NO: 580737 - RNA, 19 nt, Homo sapiens
gagggagccugucacauca

SEQ ID NO: 580738 - RNA, 19 nt, Homo sapiens
caaagaagcggcaagaagu

SEQ ID NO: 580739 - RNA, 19 nt, Homo sapiens
gaaggaacucuugguguaa

SEQ ID NO: 580740 - RNA, 19 nt, Homo sapiens
gcaugaagaagaauaucua

SEQ ID NO: 580741 - RNA, 19 nt, Homo sapiens
gcucagggaaggaauguuu

SEQ ID NO: 580742 - RNA, 19 nt, Homo sapiens
agaggcagaugaucgagua

SEQ ID NO: 580743 - RNA, 19 nt, Homo sapiens
gcuuguaucuacuucuauu

SEQ ID NO: 580744 - RNA, 19 nt, Homo sapiens
ggacagagagguuauuugc

SEQ ID NO: 580745 - RNA, 19 nt, Homo sapiens
ggaguucaguacuguagga

SEQ ID NO: 580746 - RNA, 19 nt, Homo sapiens
ugagcgaauuccugauaua

SEQ ID NO: 580747 - RNA, 19 nt, Homo sapiens
cgaauucucuggguugaug

SEQ ID NO: 580748 - RNA, 19 nt, Homo sapiens
uaagaagggccaaauugaa

SEQ ID NO: 580749 - RNA, 19 nt, Homo sapiens
gauaauggacagagagguu

SEQ ID NO: 580750 - RNA, 19 nt, Homo sapiens
caguagcuuucccuaauuu

SEQ ID NO: 580751 - RNA, 19 nt, Homo sapiens
gaaguuaugaaauggaaug

SEQ ID NO: 580752 - RNA, 19 nt, Homo sapiens
gugcuuguaucuacuucua

SEQ ID NO: 580753 - RNA, 19 nt, Homo sapiens
guuaugaaauggaauggau

SEQ ID NO: 580754 - RNA, 19 nt, Homo sapiens
gcauaaaacuaccucuaaa

SEQ ID NO: 580755 - RNA, 19 nt, Homo sapiens
caacugugguuauacuagu

SEQ ID NO: 580756 - RNA, 19 nt, Homo sapiens
ucaguagcuuucccuaauu

SEQ ID NO: 580757 - RNA, 19 nt, Homo sapiens
ggaccuggugguucauaua

SEQ ID NO: 580758 - RNA, 19 nt, Homo sapiens
guaggaggauggguaucua

SEQ ID NO: 580759 - RNA, 19 nt, Homo sapiens
gaugauguaguuaagauug

SEQ ID NO: 580760 - RNA, 19 nt, Homo sapiens
caaaauacccuuggaguaa

SEQ ID NO: 580761 - RNA, 19 nt, Homo sapiens
gagacuuggcuuuggaaua

SEQ ID NO: 580762 - RNA, 19 nt, Homo sapiens
gaagcaauggcuaaaggaa

SEQ ID NO: 580763 - RNA, 19 nt, Homo sapiens
gcaaagagaaggguguuca

SEQ ID NO: 580764 - RNA, 19 nt, Homo sapiens
agacuuggcuuuggaauac

SEQ ID NO: 580765 - RNA, 19 nt, Homo sapiens
ccaaaaguauggcucagua

SEQ ID NO: 580766 - RNA, 19 nt, Homo sapiens
ggacaagaguuggaaagac

SEQ ID NO: 580767 - RNA, 19 nt, Homo sapiens
acaagggaaugcaaagaga

SEQ ID NO: 580768 - RNA, 19 nt, Homo sapiens
guuggcagcuggagaagau

SEQ ID NO: 580769 - RNA, 19 nt, Homo sapiens
gaccuggugguucauauaa

SEQ ID NO: 580770 - RNA, 19 nt, Homo sapiens
ucuaaagcauccuuaaauc

SEQ ID NO: 580771 - RNA, 19 nt, Homo sapiens
aggaguagccuguuuaaga

SEQ ID NO: 580772 - RNA, 19 nt, Homo sapiens
ugaagaagaauaucuaugg

SEQ ID NO: 580773 - RNA, 19 nt, Homo sapiens
gcagaugagacaagaacaa

SEQ ID NO: 580774 - RNA, 19 nt, Homo sapiens
ugauacaccuccuucuguu

SEQ ID NO: 580775 - RNA, 19 nt, Homo sapiens
guagccacauuacuguuug

SEQ ID NO: 580776 - RNA, 19 nt, Homo sapiens
ccaaaucagcuaaguguag

SEQ ID NO: 580777 - RNA, 19 nt, Homo sapiens
caaggaguagccuguuuaa

SEQ ID NO: 580778 - RNA, 19 nt, Homo sapiens
acaaggaguagccuguuua

SEQ ID NO: 580779 - RNA, 19 nt, Homo sapiens
caauaagaagggccaaauu

SEQ ID NO: 580780 - RNA, 19 nt, Homo sapiens
cauaacaggacaagaguug

SEQ ID NO: 580781 - RNA, 19 nt, Homo sapiens
aaagcauccuuaaauccua

SEQ ID NO: 580782 - RNA, 19 nt, Homo sapiens
gcaaguuacggaagcaaug

SEQ ID NO: 580783 - RNA, 19 nt, Homo sapiens
aagaaauccuugcuaaugg

SEQ ID NO: 580784 - RNA, 19 nt, Homo sapiens
aauaagaagggccaaauug

SEQ ID NO: 580785 - RNA, 19 nt, Homo sapiens
gcauggguuuaccaacauu

SEQ ID NO: 580786 - RNA, 19 nt, Homo sapiens
cuucaugaccuuaaagaaa

SEQ ID NO: 580787 - RNA, 19 nt, Homo sapiens
ccauggagugggcaaguua

SEQ ID NO: 580788 - RNA, 19 nt, Homo sapiens
agaaauccuugcuaaugga

SEQ ID NO: 580789 - RNA, 19 nt, Homo sapiens
gagaaggguguucaguuug

SEQ ID NO: 580790 - RNA, 19 nt, Homo sapiens
gaauaacaagggaaugcaa

SEQ ID NO: 580791 - RNA, 19 nt, Homo sapiens
ccaaagaagcggcaagaag

SEQ ID NO: 580792 - RNA, 19 nt, Homo sapiens
agaaagugguuauuguaca

SEQ ID NO: 580793 - RNA, 19 nt, Homo sapiens
ggguugaugagaacaauuu

SEQ ID NO: 580794 - RNA, 19 nt, Homo sapiens
ugguagaucucuguagaaa

SEQ ID NO: 580795 - RNA, 19 nt, Homo sapiens
acaacaagcaguuucaguu

SEQ ID NO: 580796 - RNA, 19 nt, Homo sapiens
uggcauggguuuaccaaca

SEQ ID NO: 580797 - RNA, 19 nt, Homo sapiens
caugggaucugaaggaacu

SEQ ID NO: 580798 - RNA, 19 nt, Homo sapiens
cucaguagcuuucccuaau

SEQ ID NO: 580799 - RNA, 19 nt, Homo sapiens
gaugaucgaguauuuagag

SEQ ID NO: 580800 - RNA, 19 nt, Homo sapiens
gggaggcucugaguaccaa

SEQ ID NO: 580801 - RNA, 19 nt, Homo sapiens
agaagauaauggacagaga

SEQ ID NO: 580802 - RNA, 19 nt, Homo sapiens
gcucaguagcuuucccuaa

SEQ ID NO: 580803 - RNA, 19 nt, Homo sapiens
ucgaggaccuggugguuca

SEQ ID NO: 580804 - RNA, 19 nt, Homo sapiens
ggagaaagcccaagaguua

SEQ ID NO: 580805 - RNA, 19 nt, Homo sapiens
aaagugagcuugaggauaa

SEQ ID NO: 580806 - RNA, 19 nt, Homo sapiens
ggaagaagcaguuuacuuu

SEQ ID NO: 580807 - RNA, 19 nt, Homo sapiens
gaacauauccaacuuucuu

SEQ ID NO: 580808 - RNA, 19 nt, Homo sapiens
gaagaagcaguuuacuuua

SEQ ID NO: 580809 - RNA, 19 nt, Homo sapiens
ccagagagcaguaucuuua

SEQ ID NO: 580810 - RNA, 19 nt, Homo sapiens
ggaccugucugguuauuau

SEQ ID NO: 580811 - RNA, 19 nt, Homo sapiens
caagacaaaugaucaugaa

SEQ ID NO: 580812 - RNA, 19 nt, Homo sapiens
gacaaaugaucaugaaaga

SEQ ID NO: 580813 - RNA, 19 nt, Homo sapiens
ggacauccgugcccucaga

SEQ ID NO: 580814 - RNA, 19 nt, Homo sapiens
ugaaagcaguuuagcauug

SEQ ID NO: 580815 - RNA, 19 nt, Homo sapiens
ccuguaagcuucuuucuug

SEQ ID NO: 580816 - RNA, 19 nt, Homo sapiens
gagaacauauccaacuuuc

SEQ ID NO: 580817 - RNA, 19 nt, Homo sapiens
uggaggaccugucugguua

SEQ ID NO: 580818 - RNA, 19 nt, Homo sapiens
ccaauaaacucaccuacuc

SEQ ID NO: 580819 - RNA, 19 nt, Homo sapiens
gaaaugagcagaggaguca

SEQ ID NO: 580820 - RNA, 19 nt, Homo sapiens
gaaggaaccagcaaugaga

SEQ ID NO: 580821 - RNA, 19 nt, Homo sapiens
gagccaaucucagcugaaa

SEQ ID NO: 580822 - RNA, 19 nt, Homo sapiens
ggaggaagcucagaucucu

SEQ ID NO: 580823 - RNA, 19 nt, Homo sapiens
ggauaaagagggugaggua

SEQ ID NO: 580824 - RNA, 19 nt, Homo sapiens
ggacaaccuugcaagacaa

SEQ ID NO: 580825 - RNA, 19 nt, Homo sapiens
gagccaaucuucagucagu

SEQ ID NO: 580826 - RNA, 19 nt, Homo sapiens
gcaaugagaaggccaggaa

SEQ ID NO: 580827 - RNA, 19 nt, Homo sapiens
aaucaaagcacuuacauga

SEQ ID NO: 580828 - RNA, 19 nt, Homo sapiens
guacgaaucaaagcacuua

SEQ ID NO: 580829 - RNA, 19 nt, Homo sapiens
gaaagcaguuuagcauugg

SEQ ID NO: 580830 - RNA, 19 nt, Homo sapiens
gcaccaccaucgccaaugu

SEQ ID NO: 580831 - RNA, 19 nt, Homo sapiens
caaaugaucaugaaagaca

SEQ ID NO: 580832 - RNA, 19 nt, Homo sapiens
guaaguaaacagucagaaa

SEQ ID NO: 580833 - RNA, 19 nt, Homo sapiens
gcuaaacauucucaacaau

SEQ ID NO: 580834 - RNA, 19 nt, Homo sapiens
gagucaagcucacggaugu

SEQ ID NO: 580835 - RNA, 19 nt, Homo sapiens
gcaagacaaaugaucauga

SEQ ID NO: 580836 - RNA, 19 nt, Homo sapiens
guuagggacuuuggcauuu

SEQ ID NO: 580837 - RNA, 19 nt, Homo sapiens
gaggagaagcuaaacauuc

SEQ ID NO: 580838 - RNA, 19 nt, Homo sapiens
gagaguaugugagaaccaa

SEQ ID NO: 580839 - RNA, 19 nt, Homo sapiens
ggacuuuggcauuuccaua

SEQ ID NO: 580840 - RNA, 19 nt, Homo sapiens
guaaagcucuggacaaccu

SEQ ID NO: 580841 - RNA, 19 nt, Homo sapiens
aggaugccauuaaguauuu

SEQ ID NO: 580842 - RNA, 19 nt, Homo sapiens
agaagcaguuuacuuuaga

SEQ ID NO: 580843 - RNA, 19 nt, Homo sapiens
ggaaugggaagaagcaguu

SEQ ID NO: 580844 - RNA, 19 nt, Homo sapiens
caaaagccuugacaaauug

SEQ ID NO: 580845 - RNA, 19 nt, Homo sapiens
gagagcaguaucuuuauug

SEQ ID NO: 580846 - RNA, 19 nt, Homo sapiens
aaacucaccuacucaucaa

SEQ ID NO: 580847 - RNA, 19 nt, Homo sapiens
agaaagagcugaaaaugga

SEQ ID NO: 580848 - RNA, 19 nt, Homo sapiens
uaaagagggugagguaaag

SEQ ID NO: 580849 - RNA, 19 nt, Homo sapiens
ccaaagugcugggauuaca

SEQ ID NO: 580850 - RNA, 19 nt, Homo sapiens
gaggaugccauuaaguauu

SEQ ID NO: 580851 - RNA, 19 nt, Homo sapiens
gaauagagaggaggcuuga

SEQ ID NO: 580852 - RNA, 19 nt, Homo sapiens
gcagccaccaggagagaua

SEQ ID NO: 580853 - RNA, 19 nt, Homo sapiens
gugagaacauauccaacuu

SEQ ID NO: 580854 - RNA, 19 nt, Homo sapiens
gcuugaggauaacauaaga

SEQ ID NO: 580855 - RNA, 19 nt, Homo sapiens
agagagcaguaucuuuauu

SEQ ID NO: 580856 - RNA, 19 nt, Homo sapiens
guguguaagucccaauaaa

SEQ ID NO: 580857 - RNA, 19 nt, Homo sapiens
gaaaagaaagagcugaaaa

SEQ ID NO: 580858 - RNA, 19 nt, Homo sapiens
aagaagcaguuuacuuuag

SEQ ID NO: 580859 - RNA, 19 nt, Homo sapiens
cuggagauccucaaaguaa

SEQ ID NO: 580860 - RNA, 19 nt, Homo sapiens
ggagcgagggugcaacaaa

SEQ ID NO: 580861 - RNA, 19 nt, Homo sapiens
agaaacagcggcuccacua

SEQ ID NO: 580862 - RNA, 19 nt, Homo sapiens
gagaggaggcuugaaggaa

SEQ ID NO: 580863 - RNA, 19 nt, Homo sapiens
caccaugcccagcuaauuu

SEQ ID NO: 580864 - RNA, 19 nt, Homo sapiens
ggaggagaagcuaaacauu

SEQ ID NO: 580865 - RNA, 19 nt, Homo sapiens
gauaaaggccagcaguaca

SEQ ID NO: 580866 - RNA, 19 nt, Homo sapiens
gcagaugagcuccguaaag

SEQ ID NO: 580867 - RNA, 19 nt, Homo sapiens
uaaacucaccuacucauca

SEQ ID NO: 580868 - RNA, 19 nt, Homo sapiens
gggaagaagcaguuuacuu

SEQ ID NO: 580869 - RNA, 19 nt, Homo sapiens
gagcgagggugcaacaaaa

SEQ ID NO: 580870 - RNA, 19 nt, Homo sapiens
cugaggagcugaagaaggu

SEQ ID NO: 580871 - RNA, 19 nt, Homo sapiens
ggcaauacuuaccaacuca

SEQ ID NO: 580872 - RNA, 19 nt, Homo sapiens
gagcuugaggauaacauaa

SEQ ID NO: 580873 - RNA, 19 nt, Homo sapiens
ggauugaccuguguguaag

SEQ ID NO: 580874 - RNA, 19 nt, Homo sapiens
ggauacaggagaagaaaca

SEQ ID NO: 580875 - RNA, 19 nt, Homo sapiens
gaaaccccgucucuacuaa

SEQ ID NO: 580876 - RNA, 19 nt, Homo sapiens
aaugggaacuggagagugu

SEQ ID NO: 580877 - RNA, 19 nt, Homo sapiens
cugcugaacugcccaggaa

SEQ ID NO: 580878 - RNA, 19 nt, Homo sapiens
gcagugagccgagauaucg

SEQ ID NO: 580879 - RNA, 19 nt, Homo sapiens
cucaggagcuggaggagaa

SEQ ID NO: 580880 - RNA, 19 nt, Homo sapiens
gaggaccugucugguuauu

SEQ ID NO: 580881 - RNA, 19 nt, Homo sapiens
cagaugagcuccguaaagc

SEQ ID NO: 580882 - RNA, 19 nt, Homo sapiens
gggauggaguugggaauca

SEQ ID NO: 580883 - RNA, 19 nt, Homo sapiens
aaagugagcacacagaauc

SEQ ID NO: 580884 - RNA, 19 nt, Homo sapiens
agagcaguaucuuuauuga

SEQ ID NO: 580885 - RNA, 19 nt, Homo sapiens
ugugagaaccaaccaauga

SEQ ID NO: 580886 - RNA, 19 nt, Homo sapiens
gcaggagaauggcgugaac

SEQ ID NO: 580887 - RNA, 19 nt, Homo sapiens
gaaagaagugguggacaca

SEQ ID NO: 580888 - RNA, 19 nt, Homo sapiens
cccaagaguuagaacaguu

SEQ ID NO: 580889 - RNA, 19 nt, Homo sapiens
gcucagaacagcuggaucu

SEQ ID NO: 580890 - RNA, 19 nt, Homo sapiens
gagcugcuuugcugagagu

SEQ ID NO: 580891 - RNA, 19 nt, Homo sapiens
gauaaagagggugagguaa

SEQ ID NO: 580892 - RNA, 19 nt, Homo sapiens
caacaaaacguuccaagug

SEQ ID NO: 580893 - RNA, 19 nt, Homo sapiens
guaagucccaauaaacuca

SEQ ID NO: 580894 - RNA, 19 nt, Homo sapiens
acaguuggauacaggagaa

SEQ ID NO: 580895 - RNA, 19 nt, Homo sapiens
auaaagagggugagguaaa

SEQ ID NO: 580896 - RNA, 19 nt, Homo sapiens
gaaucaaagcacuuacaug

SEQ ID NO: 580897 - RNA, 19 nt, Homo sapiens
caugaaagcaguuuagcau

SEQ ID NO: 580898 - RNA, 19 nt, Homo sapiens
gaaagcccaagaguuagaa

SEQ ID NO: 580899 - RNA, 19 nt, Homo sapiens
gcagauggcagugcagcaa

SEQ ID NO: 580900 - RNA, 19 nt, Homo sapiens
aacccaaacuucccagaga

SEQ ID NO: 580901 - RNA, 19 nt, Homo sapiens
gaauauauugacggaagaa

SEQ ID NO: 580902 - RNA, 19 nt, Homo sapiens
cagagccaaucuucaguca

SEQ ID NO: 580903 - RNA, 19 nt, Homo sapiens
caacucacacgaggcauug

SEQ ID NO: 580904 - RNA, 19 nt, Homo sapiens
ggagaaagcccaagaguua

SEQ ID NO: 580905 - RNA, 19 nt, Homo sapiens
aaagugagcuugaggauaa

SEQ ID NO: 580906 - RNA, 19 nt, Homo sapiens
ggaagaagcaguuuacuuu

SEQ ID NO: 580907 - RNA, 19 nt, Homo sapiens
gaacauauccaacuuucuu

SEQ ID NO: 580908 - RNA, 19 nt, Homo sapiens
gaagaagcaguuuacuuua

SEQ ID NO: 580909 - RNA, 19 nt, Homo sapiens
ccagagagcaguaucuuua

SEQ ID NO: 580910 - RNA, 19 nt, Homo sapiens
ggaccugucugguuauuau

SEQ ID NO: 580911 - RNA, 19 nt, Homo sapiens
caagacaaaugaucaugaa

SEQ ID NO: 580912 - RNA, 19 nt, Homo sapiens
gacaaaugaucaugaaaga

SEQ ID NO: 580913 - RNA, 19 nt, Homo sapiens
ggacauccgugcccucaga

SEQ ID NO: 580914 - RNA, 19 nt, Homo sapiens
ugaaagcaguuuagcauug

SEQ ID NO: 580915 - RNA, 19 nt, Homo sapiens
ccuguaagcuucuuucuug

SEQ ID NO: 580916 - RNA, 19 nt, Homo sapiens
gagaacauauccaacuuuc

SEQ ID NO: 580917 - RNA, 19 nt, Homo sapiens
uggaggaccugucugguua

SEQ ID NO: 580918 - RNA, 19 nt, Homo sapiens
ccaauaaacucaccuacuc

SEQ ID NO: 580919 - RNA, 19 nt, Homo sapiens
gaaaugagcagaggaguca

SEQ ID NO: 580920 - RNA, 19 nt, Homo sapiens
gaaggaaccagcaaugaga

SEQ ID NO: 580921 - RNA, 19 nt, Homo sapiens
gagccaaucucagcugaaa

SEQ ID NO: 580922 - RNA, 19 nt, Homo sapiens
ggaggaagcucagaucucu

SEQ ID NO: 580923 - RNA, 19 nt, Homo sapiens
ggauaaagagggugaggua

SEQ ID NO: 580924 - RNA, 19 nt, Homo sapiens
ggacaaccuugcaagacaa

SEQ ID NO: 580925 - RNA, 19 nt, Homo sapiens
gagccaaucuucagucagu

SEQ ID NO: 580926 - RNA, 19 nt, Homo sapiens
gcaaugagaaggccaggaa

SEQ ID NO: 580927 - RNA, 19 nt, Homo sapiens
aaucaaagcacuuacauga

SEQ ID NO: 580928 - RNA, 19 nt, Homo sapiens
guacgaaucaaagcacuua

SEQ ID NO: 580929 - RNA, 19 nt, Homo sapiens
gaaagcaguuuagcauugg

SEQ ID NO: 580930 - RNA, 19 nt, Homo sapiens
gcaccaccaucgccaaugu

SEQ ID NO: 580931 - RNA, 19 nt, Homo sapiens
caaaugaucaugaaagaca

SEQ ID NO: 580932 - RNA, 19 nt, Homo sapiens
guaaguaaacagucagaaa

SEQ ID NO: 580933 - RNA, 19 nt, Homo sapiens
gcuaaacauucucaacaau

SEQ ID NO: 580934 - RNA, 19 nt, Homo sapiens
gagucaagcucacggaugu

SEQ ID NO: 580935 - RNA, 19 nt, Homo sapiens
gcaagacaaaugaucauga

SEQ ID NO: 580936 - RNA, 19 nt, Homo sapiens
guuagggacuuuggcauuu

SEQ ID NO: 580937 - RNA, 19 nt, Homo sapiens
gaggagaagcuaaacauuc

SEQ ID NO: 580938 - RNA, 19 nt, Homo sapiens
gagaguaugugagaaccaa

SEQ ID NO: 580939 - RNA, 19 nt, Homo sapiens
gaugccagcuuugcaauca

SEQ ID NO: 580940 - RNA, 19 nt, Homo sapiens
ggacuuuggcauuuccaua

SEQ ID NO: 580941 - RNA, 19 nt, Homo sapiens
guaaagcucuggacaaccu

SEQ ID NO: 580942 - RNA, 19 nt, Homo sapiens
aggaugccauuaaguauuu

SEQ ID NO: 580943 - RNA, 19 nt, Homo sapiens
agaagcaguuuacuuuaga

SEQ ID NO: 580944 - RNA, 19 nt, Homo sapiens
ggaaugggaagaagcaguu

SEQ ID NO: 580945 - RNA, 19 nt, Homo sapiens
caaaagccuugacaaauug

SEQ ID NO: 580946 - RNA, 19 nt, Homo sapiens
gagagcaguaucuuuauug

SEQ ID NO: 580947 - RNA, 19 nt, Homo sapiens
aaacucaccuacucaucaa

SEQ ID NO: 580948 - RNA, 19 nt, Homo sapiens
agaaagagcugaaaaugga

SEQ ID NO: 580949 - RNA, 19 nt, Homo sapiens
uaaagagggugagguaaag

SEQ ID NO: 580950 - RNA, 19 nt, Homo sapiens
ccaaagugcugggauuaca

SEQ ID NO: 580951 - RNA, 19 nt, Homo sapiens
gaggaugccauuaaguauu

SEQ ID NO: 580952 - RNA, 19 nt, Homo sapiens
gaauagagaggaggcuuga

SEQ ID NO: 580953 - RNA, 19 nt, Homo sapiens
gcagccaccaggagagaua

SEQ ID NO: 580954 - RNA, 19 nt, Homo sapiens
gugagaacauauccaacuu

SEQ ID NO: 580955 - RNA, 19 nt, Homo sapiens
gcuugaggauaacauaaga

SEQ ID NO: 580956 - RNA, 19 nt, Homo sapiens
agagagcaguaucuuuauu

SEQ ID NO: 580957 - RNA, 19 nt, Homo sapiens
guguguaagucccaauaaa

SEQ ID NO: 580958 - RNA, 19 nt, Homo sapiens
gaaaagaaagagcugaaaa

SEQ ID NO: 580959 - RNA, 19 nt, Homo sapiens
aagaagcaguuuacuuuag

SEQ ID NO: 580960 - RNA, 19 nt, Homo sapiens
cuggagauccucaaaguaa

SEQ ID NO: 580961 - RNA, 19 nt, Homo sapiens
ggagcgagggugcaacaaa

SEQ ID NO: 580962 - RNA, 19 nt, Homo sapiens
agaaacagcggcuccacua

SEQ ID NO: 580963 - RNA, 19 nt, Homo sapiens
gagaggaggcuugaaggaa

SEQ ID NO: 580964 - RNA, 19 nt, Homo sapiens
caccaugcccagcuaauuu

SEQ ID NO: 580965 - RNA, 19 nt, Homo sapiens
ggaggagaagcuaaacauu

SEQ ID NO: 580966 - RNA, 19 nt, Homo sapiens
gauaaaggccagcaguaca

SEQ ID NO: 580967 - RNA, 19 nt, Homo sapiens
gcagaugagcuccguaaag

SEQ ID NO: 580968 - RNA, 19 nt, Homo sapiens
uaaacucaccuacucauca

SEQ ID NO: 580969 - RNA, 19 nt, Homo sapiens
gggaagaagcaguuuacuu

SEQ ID NO: 580970 - RNA, 19 nt, Homo sapiens
cugaggagcugaagaaggu

SEQ ID NO: 580971 - RNA, 19 nt, Homo sapiens
ggcaauacuuaccaacuca

SEQ ID NO: 580972 - RNA, 19 nt, Homo sapiens
gagcuugaggauaacauaa

SEQ ID NO: 580973 - RNA, 19 nt, Homo sapiens
gagcgagggugcaacaaaa

SEQ ID NO: 580974 - RNA, 19 nt, Homo sapiens
ggauugaccuguguguaag

SEQ ID NO: 580975 - RNA, 19 nt, Homo sapiens
ggauacaggagaagaaaca

SEQ ID NO: 580976 - RNA, 19 nt, Homo sapiens
gaaaccccgucucuacuaa

SEQ ID NO: 580977 - RNA, 19 nt, Homo sapiens
aaugggaacuggagagugu

SEQ ID NO: 580978 - RNA, 19 nt, Homo sapiens
cugcugaacugcccaggaa

SEQ ID NO: 580979 - RNA, 19 nt, Homo sapiens
gcagugagccgagauaucg

SEQ ID NO: 580980 - RNA, 19 nt, Homo sapiens
cucaggagcuggaggagaa

SEQ ID NO: 580981 - RNA, 19 nt, Homo sapiens
gaggaccugucugguuauu

SEQ ID NO: 580982 - RNA, 19 nt, Homo sapiens
cagaugagcuccguaaagc

SEQ ID NO: 580983 - RNA, 19 nt, Homo sapiens
gggauggaguugggaauca

SEQ ID NO: 580984 - RNA, 19 nt, Homo sapiens
aaagugagcacacagaauc

SEQ ID NO: 580985 - RNA, 19 nt, Homo sapiens
agagcaguaucuuuauuga

SEQ ID NO: 580986 - RNA, 19 nt, Homo sapiens
ugugagaaccaaccaauga

SEQ ID NO: 580987 - RNA, 19 nt, Homo sapiens
gcaggagaauggcgugaac

SEQ ID NO: 580988 - RNA, 19 nt, Homo sapiens
gaaagaagugguggacaca

SEQ ID NO: 580989 - RNA, 19 nt, Homo sapiens
cccaagaguuagaacaguu

SEQ ID NO: 580990 - RNA, 19 nt, Homo sapiens
gcucagaacagcuggaucu

SEQ ID NO: 580991 - RNA, 19 nt, Homo sapiens
gauaaagagggugagguaa

SEQ ID NO: 580992 - RNA, 19 nt, Homo sapiens
gagcugcuuugcugagagu

SEQ ID NO: 580993 - RNA, 19 nt, Homo sapiens
caacaaaacguuccaagug

SEQ ID NO: 580994 - RNA, 19 nt, Homo sapiens
guaagucccaauaaacuca

SEQ ID NO: 580995 - RNA, 19 nt, Homo sapiens
acaguuggauacaggagaa

SEQ ID NO: 580996 - RNA, 19 nt, Homo sapiens
auaaagagggugagguaaa

SEQ ID NO: 580997 - RNA, 19 nt, Homo sapiens
gaaucaaagcacuuacaug

SEQ ID NO: 580998 - RNA, 19 nt, Homo sapiens
caugaaagcaguuuagcau

SEQ ID NO: 580999 - RNA, 19 nt, Homo sapiens
gaaagcccaagaguuagaa

SEQ ID NO: 581000 - RNA, 19 nt, Homo sapiens
gcagauggcagugcagcaa

SEQ ID NO: 581001 - RNA, 19 nt, Homo sapiens
aacccaaacuucccagaga

SEQ ID NO: 581002 - RNA, 19 nt, Homo sapiens
gaauauauugacggaagaa

SEQ ID NO: 581003 - RNA, 19 nt, Homo sapiens
cagagccaaucuucaguca

SEQ ID NO: 581004 - RNA, 19 nt, Homo sapiens
ggagaaagcccaagaguua

SEQ ID NO: 581005 - RNA, 19 nt, Homo sapiens
aaagugagcuugaggauaa

SEQ ID NO: 581006 - RNA, 19 nt, Homo sapiens
gaacauauccaacuuucuu

SEQ ID NO: 581007 - RNA, 19 nt, Homo sapiens
ccagagagcaguaucuuua

SEQ ID NO: 581008 - RNA, 19 nt, Homo sapiens
ggaccugucugguuauuau

SEQ ID NO: 581009 - RNA, 19 nt, Homo sapiens
caagacaaaugaucaugaa

SEQ ID NO: 581010 - RNA, 19 nt, Homo sapiens
gacaaaugaucaugaaaga

SEQ ID NO: 581011 - RNA, 19 nt, Homo sapiens
ggacauccgugcccucaga

SEQ ID NO: 581012 - RNA, 19 nt, Homo sapiens
ugaaagcaguuuagcauug

SEQ ID NO: 581013 - RNA, 19 nt, Homo sapiens
ccuguaagcuucuuucuug

SEQ ID NO: 581014 - RNA, 19 nt, Homo sapiens
gagaacauauccaacuuuc

SEQ ID NO: 581015 - RNA, 19 nt, Homo sapiens
uggaggaccugucugguua

SEQ ID NO: 581016 - RNA, 19 nt, Homo sapiens
ccaauaaacucaccuacuc

SEQ ID NO: 581017 - RNA, 19 nt, Homo sapiens
gaaaugagcagaggaguca

SEQ ID NO: 581018 - RNA, 19 nt, Homo sapiens
gaaggaaccagcaaugaga

SEQ ID NO: 581019 - RNA, 19 nt, Homo sapiens
gagccaaucucagcugaaa

SEQ ID NO: 581020 - RNA, 19 nt, Homo sapiens
ggaggaagcucagaucucu

SEQ ID NO: 581021 - RNA, 19 nt, Homo sapiens
ggacaaccuugcaagacaa

SEQ ID NO: 581022 - RNA, 19 nt, Homo sapiens
gagccaaucuucagucagu

SEQ ID NO: 581023 - RNA, 19 nt, Homo sapiens
gcaaugagaaggccaggaa

SEQ ID NO: 581024 - RNA, 19 nt, Homo sapiens
aaucaaagcacuuacauga

SEQ ID NO: 581025 - RNA, 19 nt, Homo sapiens
guacgaaucaaagcacuua

SEQ ID NO: 581026 - RNA, 19 nt, Homo sapiens
gaaagcaguuuagcauugg

SEQ ID NO: 581027 - RNA, 19 nt, Homo sapiens
gcaccaccaucgccaaugu

SEQ ID NO: 581028 - RNA, 19 nt, Homo sapiens
caaaugaucaugaaagaca

SEQ ID NO: 581029 - RNA, 19 nt, Homo sapiens
guaaguaaacagucagaaa

SEQ ID NO: 581030 - RNA, 19 nt, Homo sapiens
gcuaaacauucucaacaau

SEQ ID NO: 581031 - RNA, 19 nt, Homo sapiens
gagucaagcucacggaugu

SEQ ID NO: 581032 - RNA, 19 nt, Homo sapiens
gcaagacaaaugaucauga

SEQ ID NO: 581033 - RNA, 19 nt, Homo sapiens
gaggagaagcuaaacauuc

SEQ ID NO: 581034 - RNA, 19 nt, Homo sapiens
gagaguaugugagaaccaa

SEQ ID NO: 581035 - RNA, 19 nt, Homo sapiens
guaaagcucuggacaaccu

SEQ ID NO: 581036 - RNA, 19 nt, Homo sapiens
aggaugccauuaaguauuu

SEQ ID NO: 581037 - RNA, 19 nt, Homo sapiens
caaaagccuugacaaauug

SEQ ID NO: 581038 - RNA, 19 nt, Homo sapiens
gagagcaguaucuuuauug

SEQ ID NO: 581039 - RNA, 19 nt, Homo sapiens
aaacucaccuacucaucaa

SEQ ID NO: 581040 - RNA, 19 nt, Homo sapiens
agaaagagcugaaaaugga

SEQ ID NO: 581041 - RNA, 19 nt, Homo sapiens
gaggaugccauuaaguauu

SEQ ID NO: 581042 - RNA, 19 nt, Homo sapiens
gaauagagaggaggcuuga

SEQ ID NO: 581043 - RNA, 19 nt, Homo sapiens
gcagccaccaggagagaua

SEQ ID NO: 581044 - RNA, 19 nt, Homo sapiens
gugagaacauauccaacuu

SEQ ID NO: 581045 - RNA, 19 nt, Homo sapiens
gcuugaggauaacauaaga

SEQ ID NO: 581046 - RNA, 19 nt, Homo sapiens
agagagcaguaucuuuauu

SEQ ID NO: 581047 - RNA, 19 nt, Homo sapiens
guguguaagucccaauaaa

SEQ ID NO: 581048 - RNA, 19 nt, Homo sapiens
gaaaagaaagagcugaaaa

SEQ ID NO: 581049 - RNA, 19 nt, Homo sapiens
cuggagauccucaaaguaa

SEQ ID NO: 581050 - RNA, 19 nt, Homo sapiens
ggagcgagggugcaacaaa

SEQ ID NO: 581051 - RNA, 19 nt, Homo sapiens
agaaacagcggcuccacua

SEQ ID NO: 581052 - RNA, 19 nt, Homo sapiens
gagaggaggcuugaaggaa

SEQ ID NO: 581053 - RNA, 19 nt, Homo sapiens
ggaggagaagcuaaacauu

SEQ ID NO: 581054 - RNA, 19 nt, Homo sapiens
gauaaaggccagcaguaca

SEQ ID NO: 581055 - RNA, 19 nt, Homo sapiens
gcagaugagcuccguaaag

SEQ ID NO: 581056 - RNA, 19 nt, Homo sapiens
uaaacucaccuacucauca

SEQ ID NO: 581057 - RNA, 19 nt, Homo sapiens
cugaggagcugaagaaggu

SEQ ID NO: 581058 - RNA, 19 nt, Homo sapiens
ggcaauacuuaccaacuca

SEQ ID NO: 581059 - RNA, 19 nt, Homo sapiens
gagcuugaggauaacauaa

SEQ ID NO: 581060 - RNA, 19 nt, Homo sapiens
gagcgagggugcaacaaaa

SEQ ID NO: 581061 - RNA, 19 nt, Homo sapiens
ggauugaccuguguguaag

SEQ ID NO: 581062 - RNA, 19 nt, Homo sapiens
ggauacaggagaagaaaca

SEQ ID NO: 581063 - RNA, 19 nt, Homo sapiens
cugcugaacugcccaggaa

SEQ ID NO: 581064 - RNA, 19 nt, Homo sapiens
gcagugagccgagauaucg

SEQ ID NO: 581065 - RNA, 19 nt, Homo sapiens
cucaggagcuggaggagaa

SEQ ID NO: 581066 - RNA, 19 nt, Homo sapiens
gaggaccugucugguuauu

SEQ ID NO: 581067 - RNA, 19 nt, Homo sapiens
cagaugagcuccguaaagc

SEQ ID NO: 581068 - RNA, 19 nt, Homo sapiens
gggauggaguugggaauca

SEQ ID NO: 581069 - RNA, 19 nt, Homo sapiens
aaagugagcacacagaauc

SEQ ID NO: 581070 - RNA, 19 nt, Homo sapiens
agagcaguaucuuuauuga

SEQ ID NO: 581071 - RNA, 19 nt, Homo sapiens
ugugagaaccaaccaauga

SEQ ID NO: 581072 - RNA, 19 nt, Homo sapiens
gaaagaagugguggacaca

SEQ ID NO: 581073 - RNA, 19 nt, Homo sapiens
gcucagaacagcuggaucu

SEQ ID NO: 581074 - RNA, 19 nt, Homo sapiens
caacaaaacguuccaagug

SEQ ID NO: 581075 - RNA, 19 nt, Homo sapiens
cccaagaguuagaacaguu

SEQ ID NO: 581076 - RNA, 19 nt, Homo sapiens
gagcugcuuugcugagagu

SEQ ID NO: 581077 - RNA, 19 nt, Homo sapiens
guaagucccaauaaacuca

SEQ ID NO: 581078 - RNA, 19 nt, Homo sapiens
acaguuggauacaggagaa

SEQ ID NO: 581079 - RNA, 19 nt, Homo sapiens
gaaucaaagcacuuacaug

SEQ ID NO: 581080 - RNA, 19 nt, Homo sapiens
caugaaagcaguuuagcau

SEQ ID NO: 581081 - RNA, 19 nt, Homo sapiens
gaaagcccaagaguuagaa

SEQ ID NO: 581082 - RNA, 19 nt, Homo sapiens
aacccaaacuucccagaga

SEQ ID NO: 581083 - RNA, 19 nt, Homo sapiens
gaauauauugacggaagaa

SEQ ID NO: 581084 - RNA, 19 nt, Homo sapiens
cagagccaaucuucaguca

SEQ ID NO: 581085 - RNA, 19 nt, Homo sapiens
caacucacacgaggcauug

SEQ ID NO: 581086 - RNA, 19 nt, Homo sapiens
ccaggaaugaggcagauga

SEQ ID NO: 581087 - RNA, 19 nt, Homo sapiens
aggauugaccuguguguaa

SEQ ID NO: 581088 - RNA, 19 nt, Homo sapiens
ugagaaccaaccaaugaaa

SEQ ID NO: 581089 - RNA, 19 nt, Homo sapiens
ugagaacauauccaacuuu

SEQ ID NO: 581090 - RNA, 19 nt, Homo sapiens
uggacaaccuugcaagaca

SEQ ID NO: 581091 - RNA, 19 nt, Homo sapiens
uugaggaugccauuaagua

SEQ ID NO: 581092 - RNA, 19 nt, Homo sapiens
gauacuggagauccucaaa

SEQ ID NO: 581093 - RNA, 19 nt, Homo sapiens
ucaauguccuccgaagaau

SEQ ID NO: 581094 - RNA, 19 nt, Homo sapiens
gaauuccucgguauaucuu

SEQ ID NO: 581095 - RNA, 19 nt, Homo sapiens
caaccuugcaagacaaaug

SEQ ID NO: 581096 - RNA, 19 nt, Homo sapiens
cuacuccugcugacugaua

SEQ ID NO: 581097 - RNA, 19 nt, Homo sapiens
uuauugaggaugccauuaa

SEQ ID NO: 581098 - RNA, 19 nt, Homo sapiens
guuccaagugggacagaua

SEQ ID NO: 581099 - RNA, 19 nt, Homo sapiens
gggagcugcuuugcugaga

SEQ ID NO: 581100 - RNA, 19 nt, Homo sapiens
agaauauauugacggaaga

SEQ ID NO: 581101 - RNA, 19 nt, Homo sapiens
uauccaacuuucuuuccuu

SEQ ID NO: 581102 - RNA, 19 nt, Homo sapiens
agacaaaugaucaugaaag

SEQ ID NO: 581103 - RNA, 19 nt, Homo sapiens
caauaaacucaccuacuca

SEQ ID NO: 581104 - RNA, 19 nt, Homo sapiens
ggagggaaaugacuaauga

SEQ ID NO: 581105 - RNA, 19 nt, Homo sapiens
gcucuaguaugguguauuu

SEQ ID NO: 581106 - RNA, 19 nt, Homo sapiens
cuacaucaauggcaguuua

SEQ ID NO: 581107 - RNA, 19 nt, Homo sapiens
ggacgaagacugagacuga

SEQ ID NO: 581108 - RNA, 19 nt, Homo sapiens
ggcaauguguaucaucuua

SEQ ID NO: 581109 - RNA, 19 nt, Homo sapiens
ggaaaugacuaaugaagcu

SEQ ID NO: 581110 - RNA, 19 nt, Homo sapiens
ggagaaggacgaagacuga

SEQ ID NO: 581111 - RNA, 19 nt, Homo sapiens
ggagaucgguuucacuaca

SEQ ID NO: 581112 - RNA, 19 nt, Homo sapiens
cuaauuugcugaaugaaga

SEQ ID NO: 581113 - RNA, 19 nt, Homo sapiens
caagucaccuuuguagcua

SEQ ID NO: 581114 - RNA, 19 nt, Homo sapiens
gacauuugcucuaguaugg

SEQ ID NO: 581115 - RNA, 19 nt, Homo sapiens
aaacugaccaugagauaaa

SEQ ID NO: 581116 - RNA, 19 nt, Homo sapiens
cuacccucauuaacaauua

SEQ ID NO: 581117 - RNA, 19 nt, Homo sapiens
cuucuaauuugcugaauga

SEQ ID NO: 581118 - RNA, 19 nt, Homo sapiens
caauguauguaugcaugua

SEQ ID NO: 581119 - RNA, 19 nt, Homo sapiens
caucaauggcaguuuauuu

SEQ ID NO: 581120 - RNA, 19 nt, Homo sapiens
ggaaauagcggugcuugca

SEQ ID NO: 581121 - RNA, 19 nt, Homo sapiens
cggcuucgcucgcauuuca

SEQ ID NO: 581122 - RNA, 19 nt, Homo sapiens
ccaugaaccugggcuaaug

SEQ ID NO: 581123 - RNA, 19 nt, Homo sapiens
gaagccacauugccaaacu

SEQ ID NO: 581124 - RNA, 19 nt, Homo sapiens
gcaugauccuuugcagaaa

SEQ ID NO: 581125 - RNA, 19 nt, Homo sapiens
gcacuggccagaguuugua

SEQ ID NO: 581126 - RNA, 19 nt, Homo sapiens
gcaauguguaucaucuuaa

SEQ ID NO: 581127 - RNA, 19 nt, Homo sapiens
aaagaagcauucaaaucug

SEQ ID NO: 581128 - RNA, 19 nt, Homo sapiens
cgcauuuauugguguauua

SEQ ID NO: 581129 - RNA, 19 nt, Homo sapiens
ggcaugauccuuugcagaa

SEQ ID NO: 581130 - RNA, 19 nt, Homo sapiens
cagaaugcgugccuucauc

SEQ ID NO: 581131 - RNA, 19 nt, Homo sapiens
caauguguaucaucuuaag

SEQ ID NO: 581132 - RNA, 19 nt, Homo sapiens
gagaucgguuucacuacau

SEQ ID NO: 581133 - RNA, 19 nt, Homo sapiens
agacugagacugacacuuc

SEQ ID NO: 581134 - RNA, 19 nt, Homo sapiens
cuacucccauggcaaagaa

SEQ ID NO: 581135 - RNA, 19 nt, Homo sapiens
auucaaaucugcuuucuac

SEQ ID NO: 581136 - RNA, 19 nt, Homo sapiens
ucagagcaauccacuacug

SEQ ID NO: 581137 - RNA, 19 nt, Homo sapiens
gcaaggcaauguguaucau

SEQ ID NO: 581138 - RNA, 19 nt, Homo sapiens
gaaaugacuaaugaagcua

SEQ ID NO: 581139 - RNA, 19 nt, Homo sapiens
gaucccaugugucuucagu

SEQ ID NO: 581140 - RNA, 19 nt, Homo sapiens
gagauaaaggaaagagaug

SEQ ID NO: 581141 - RNA, 19 nt, Homo sapiens
gaguuuguacccuguguuu

SEQ ID NO: 581142 - RNA, 19 nt, Homo sapiens
uuucuacccucauuaacaa

SEQ ID NO: 581143 - RNA, 19 nt, Homo sapiens
gauaaaggaaagagaugug

SEQ ID NO: 581144 - RNA, 19 nt, Homo sapiens
cagagcaacgcgauuuaaa

SEQ ID NO: 581145 - RNA, 19 nt, Homo sapiens
ugauugcccuucccgcauu

SEQ ID NO: 581146 - RNA, 19 nt, Homo sapiens
caugauccuuugcagaaau

SEQ ID NO: 581147 - RNA, 19 nt, Homo sapiens
agauguggcuuuugugaua

SEQ ID NO: 581148 - RNA, 19 nt, Homo sapiens
gaccaugagauaaaggaaa

SEQ ID NO: 581149 - RNA, 19 nt, Homo sapiens
acagguggaucccaugugu

SEQ ID NO: 581150 - RNA, 19 nt, Homo sapiens
gggaauauacaaagugaag

SEQ ID NO: 581151 - RNA, 19 nt, Homo sapiens
ggaccgcuuucugcucuau

SEQ ID NO: 581152 - RNA, 19 nt, Homo sapiens
gcccuucccgcauuuauug

SEQ ID NO: 581153 - RNA, 19 nt, Homo sapiens
ccagagcaacgcgauuuaa

SEQ ID NO: 581154 - RNA, 19 nt, Homo sapiens
gcuaaugggagacuguaga

SEQ ID NO: 581155 - RNA, 19 nt, Homo sapiens
cauugcaccuucuuuaguc

SEQ ID NO: 581156 - RNA, 19 nt, Homo sapiens
ucuaugccauggacagcua

SEQ ID NO: 581157 - RNA, 19 nt, Homo sapiens
caaacuugcagcagcgauu

SEQ ID NO: 581158 - RNA, 19 nt, Homo sapiens
gauugcccuucccgcauuu

SEQ ID NO: 581159 - RNA, 19 nt, Homo sapiens
gaauucacuucagagcaau

SEQ ID NO: 581160 - RNA, 19 nt, Homo sapiens
caaaacugaccaugagaua

SEQ ID NO: 581161 - RNA, 19 nt, Homo sapiens
cgggagaucgguuucacua

SEQ ID NO: 581162 - RNA, 19 nt, Homo sapiens
gcauucaaaucugcuuucu

SEQ ID NO: 581163 - RNA, 19 nt, Homo sapiens
ugagauaaaggaaagagau

SEQ ID NO: 581164 - RNA, 19 nt, Homo sapiens
gggagggaaaugacuaaug

SEQ ID NO: 581165 - RNA, 19 nt, Homo sapiens
gcagaaugcgugccuucau

SEQ ID NO: 581166 - RNA, 19 nt, Homo sapiens
gcuaaaaggucagaguaau

SEQ ID NO: 581167 - RNA, 19 nt, Homo sapiens
acaaagugaagccacauug

SEQ ID NO: 581168 - RNA, 19 nt, Homo sapiens
gcaccuucuuuagucuuga

SEQ ID NO: 581169 - RNA, 19 nt, Homo sapiens
ucagaguaaugcagaaugc

SEQ ID NO: 581170 - RNA, 19 nt, Homo sapiens
aaugggagacuguagagaa

SEQ ID NO: 581171 - RNA, 19 nt, Homo sapiens
ugccauugcaccuucuuua

SEQ ID NO: 581172 - RNA, 19 nt, Homo sapiens
ccacauugccaaacuugca

SEQ ID NO: 581173 - RNA, 19 nt, Homo sapiens
caguagacaagucaccuuu

SEQ ID NO: 581174 - RNA, 19 nt, Homo sapiens
augggagacuguagagaaa

SEQ ID NO: 581175 - RNA, 19 nt, Homo sapiens
ucccaugugucuucaguag

SEQ ID NO: 581176 - RNA, 19 nt, Homo sapiens
gcacguccuguuacaccaa

SEQ ID NO: 581177 - RNA, 19 nt, Homo sapiens
guuuguacccuguguuuua

SEQ ID NO: 581178 - RNA, 19 nt, Homo sapiens
gacugagacugacacuucu

SEQ ID NO: 581179 - RNA, 19 nt, Homo sapiens
ccgcauuuauugguguauu

SEQ ID NO: 581180 - RNA, 19 nt, Homo sapiens
cauucuauuugcucuuugu

SEQ ID NO: 581181 - RNA, 19 nt, Homo sapiens
cgguuucacuacaucaaug

SEQ ID NO: 581182 - RNA, 19 nt, Homo sapiens
gggcgcaaggcaaugugua

SEQ ID NO: 581183 - RNA, 19 nt, Homo sapiens
acacuuauuguaucucugu

SEQ ID NO: 581184 - RNA, 19 nt, Homo sapiens
gagggaaaugacuaaugaa

SEQ ID NO: 581185 - RNA, 19 nt, Homo sapiens
gggcuaaugggagacugua

SEQ ID NO: 581186 - RNA, 19 nt, Homo sapiens
caugagggcgcaaggcaau

SEQ ID NO: 581187 - RNA, 19 nt, Homo sapiens
acauuaaggacuccaugaa

SEQ ID NO: 581188 - RNA, 19 nt, Homo sapiens
ccauugcaccuucuuuagu

SEQ ID NO: 581189 - RNA, 19 nt, Homo sapiens
guggaucccaugugucuuc

SEQ ID NO: 581190 - RNA, 19 nt, Homo sapiens
gugaagccacauugccaaa

SEQ ID NO: 581191 - RNA, 19 nt, Homo sapiens
aaucaaaacugaccaugag

SEQ ID NO: 581192 - RNA, 19 nt, Homo sapiens
cagaguuuguacccugugu

SEQ ID NO: 581193 - RNA, 19 nt, Homo sapiens
caauggcaguuuauuuugu

SEQ ID NO: 581194 - RNA, 19 nt, Homo sapiens
cuacuucuaauuugcugaa

SEQ ID NO: 581195 - RNA, 19 nt, Homo sapiens
accaugagauaaaggaaag

SEQ ID NO: 581196 - RNA, 19 nt, Homo sapiens
gacaucggcacguccuguu

SEQ ID NO: 581197 - RNA, 19 nt, Homo sapiens
caaagugaagccacauugc

SEQ ID NO: 581198 - RNA, 19 nt, Homo sapiens
gccauugcaccuucuuuag

SEQ ID NO: 581199 - RNA, 19 nt, Homo sapiens
cccagagcaacgcgauuua

SEQ ID NO: 581200 - RNA, 19 nt, Homo sapiens
gaacaaggaucccaagaga

SEQ ID NO: 581201 - RNA, 19 nt, Homo sapiens
ggaauaaaguccaagguuu

SEQ ID NO: 581202 - RNA, 19 nt, Homo sapiens
gaacaccaaugaagagauu

SEQ ID NO: 581203 - RNA, 19 nt, Homo sapiens
cuaaagaauuccacacuaa

SEQ ID NO: 581204 - RNA, 19 nt, Homo sapiens
gagaagccacuuugucuua

SEQ ID NO: 581205 - RNA, 19 nt, Homo sapiens
gcacaccaaccuuauauuu

SEQ ID NO: 581206 - RNA, 19 nt, Homo sapiens
gagaagcccugggaauaaa

SEQ ID NO: 581207 - RNA, 19 nt, Homo sapiens
caagaaaguuacucucuca

SEQ ID NO: 581208 - RNA, 19 nt, Homo sapiens
ggagaagcccugggaauaa

SEQ ID NO: 581209 - RNA, 19 nt, Homo sapiens
gaaggcauuccauuucuaa

SEQ ID NO: 581210 - RNA, 19 nt, Homo sapiens
acacuaacgugauaacaug

SEQ ID NO: 581211 - RNA, 19 nt, Homo sapiens
cuacaacuguggguuaauu

SEQ ID NO: 581212 - RNA, 19 nt, Homo sapiens
gagaaccaguuauccaaca

SEQ ID NO: 581213 - RNA, 19 nt, Homo sapiens
gaagccacuuugucuuaau

SEQ ID NO: 581214 - RNA, 19 nt, Homo sapiens
ucuaaagaauuccacacua

SEQ ID NO: 581215 - RNA, 19 nt, Homo sapiens
aauagaaccucaucacaca

SEQ ID NO: 581216 - RNA, 19 nt, Homo sapiens
gcacaugcaaauaaaccua

SEQ ID NO: 581217 - RNA, 19 nt, Homo sapiens
ccauuaagagaaccaguua

SEQ ID NO: 581218 - RNA, 19 nt, Homo sapiens
ugaaggcauuccauuucua

SEQ ID NO: 581219 - RNA, 19 nt, Homo sapiens
ggacaagcuucauuuacac

SEQ ID NO: 581220 - RNA, 19 nt, Homo sapiens
uggacaagcuucauuuaca

SEQ ID NO: 581221 - RNA, 19 nt, Homo sapiens
gggaauaaaguccaagguu

SEQ ID NO: 581222 - RNA, 19 nt, Homo sapiens
caacuguggguuaauuuga

SEQ ID NO: 581223 - RNA, 19 nt, Homo sapiens
gccaaacauucccaaccua

SEQ ID NO: 581224 - RNA, 19 nt, Homo sapiens
uuucugagauugagccauu

SEQ ID NO: 581225 - RNA, 19 nt, Homo sapiens
aagcuucauuuacacgaua

SEQ ID NO: 581226 - RNA, 19 nt, Homo sapiens
gguggacaagcuucauuua

SEQ ID NO: 581227 - RNA, 19 nt, Homo sapiens
agaagccacuuugucuuaa

SEQ ID NO: 581228 - RNA, 19 nt, Homo sapiens
gcccauggccuacaacugu

SEQ ID NO: 581229 - RNA, 19 nt, Homo sapiens
uggagaagcccugggaaua

SEQ ID NO: 581230 - RNA, 19 nt, Homo sapiens
caagagaagccacuuuguc

SEQ ID NO: 581231 - RNA, 19 nt, Homo sapiens
gaucauccacaucgagguu

SEQ ID NO: 581232 - RNA, 19 nt, Homo sapiens
ccuggcacaugcaaauaaa

SEQ ID NO: 581233 - RNA, 19 nt, Homo sapiens
cuugauguguccuagaauu

SEQ ID NO: 581234 - RNA, 19 nt, Homo sapiens
ggccuacaacuguggguua

SEQ ID NO: 581235 - RNA, 19 nt, Homo sapiens
gccaaaaccuggaaaucaa

SEQ ID NO: 581236 - RNA, 19 nt, Homo sapiens
ggagauuugcaguggauga

SEQ ID NO: 581237 - RNA, 19 nt, Homo sapiens
gauaugggguccuccaaga

SEQ ID NO: 581238 - RNA, 19 nt, Homo sapiens
cauugaaggcauuccauuu

SEQ ID NO: 581239 - RNA, 19 nt, Homo sapiens
gcccgaugaugcacaacaa

SEQ ID NO: 581240 - RNA, 19 nt, Homo sapiens
cuacagcucagcaucagaa

SEQ ID NO: 581241 - RNA, 19 nt, Homo sapiens
caguaaggauggugugaca

SEQ ID NO: 581242 - RNA, 19 nt, Homo sapiens
gugaagaaaucccuaaacc

SEQ ID NO: 581243 - RNA, 19 nt, Homo sapiens
gccuacaacuguggguuaa

SEQ ID NO: 581244 - RNA, 19 nt, Homo sapiens
caggagauuugcaguggau

SEQ ID NO: 581245 - RNA, 19 nt, Homo sapiens
gaugaacaccaaugaagag

SEQ ID NO: 581246 - RNA, 19 nt, Homo sapiens
ccaaacauucccaaccuau

SEQ ID NO: 581247 - RNA, 19 nt, Homo sapiens
gaaaucccuaaacccagua

SEQ ID NO: 581248 - RNA, 19 nt, Homo sapiens
gaaccaguuauccaacaug

SEQ ID NO: 581249 - RNA, 19 nt, Homo sapiens
aagccacuuugucuuaauu

SEQ ID NO: 581250 - RNA, 19 nt, Homo sapiens
acaaggaucccaagagaag

SEQ ID NO: 581251 - RNA, 19 nt, Homo sapiens
uaaggauggugugacaguu

SEQ ID NO: 581252 - RNA, 19 nt, Homo sapiens
gucuugauguguccuagaa

SEQ ID NO: 581253 - RNA, 19 nt, Homo sapiens
uaagagaaccaguuaucca

SEQ ID NO: 581254 - RNA, 19 nt, Homo sapiens
gagaacaaggaucccaaga

SEQ ID NO: 581255 - RNA, 19 nt, Homo sapiens
ccuaaaggguggacaagcu

SEQ ID NO: 581256 - RNA, 19 nt, Homo sapiens
guaaggauggugugacagu

SEQ ID NO: 581257 - RNA, 19 nt, Homo sapiens
gaacugaaaagugaagaaa

SEQ ID NO: 581258 - RNA, 19 nt, Homo sapiens
ggagguagaccaggaggau

SEQ ID NO: 581259 - RNA, 19 nt, Homo sapiens
aaagugaagaaaucccuaa

SEQ ID NO: 581260 - RNA, 19 nt, Homo sapiens
ccuuauauuuggacuucaa

SEQ ID NO: 581261 - RNA, 19 nt, Homo sapiens
cuggagauguguauauugg

SEQ ID NO: 581262 - RNA, 19 nt, Homo sapiens
caagcuucauuuacacgau

SEQ ID NO: 581263 - RNA, 19 nt, Homo sapiens
ggguggacaagcuucauuu

SEQ ID NO: 581264 - RNA, 19 nt, Homo sapiens
cacaccaaccuuauauuug

SEQ ID NO: 581265 - RNA, 19 nt, Homo sapiens
gcaucagaacacucucuuu

SEQ ID NO: 581266 - RNA, 19 nt, Homo sapiens
ggacacacugguaaaauga

SEQ ID NO: 581267 - RNA, 19 nt, Homo sapiens
ggcauuccauuucuaaagc

SEQ ID NO: 581268 - RNA, 19 nt, Homo sapiens
ugaugaacaccaaugaaga

SEQ ID NO: 581269 - RNA, 19 nt, Homo sapiens
caucagaacacucucuuuu

SEQ ID NO: 581270 - RNA, 19 nt, Homo sapiens
cuaacgugauaacaugguu

SEQ ID NO: 581271 - RNA, 19 nt, Homo sapiens
auuccacacuaacgugaua

SEQ ID NO: 581272 - RNA, 19 nt, Homo sapiens
caaagauugggaacuagug

SEQ ID NO: 581273 - RNA, 19 nt, Homo sapiens
gugaugaacaccaaugaag

SEQ ID NO: 581274 - RNA, 19 nt, Homo sapiens
gccauuaagagaaccaguu

SEQ ID NO: 581275 - RNA, 19 nt, Homo sapiens
aaccuuauauuuggacuuc

SEQ ID NO: 581276 - RNA, 19 nt, Homo sapiens
ggauauuuccuggcacaug

SEQ ID NO: 581277 - RNA, 19 nt, Homo sapiens
gaggagcucagagaagaug

SEQ ID NO: 581278 - RNA, 19 nt, Homo sapiens
uaacgugauaacaugguuu

SEQ ID NO: 581279 - RNA, 19 nt, Homo sapiens
ccacaucgagguuuugaaa

SEQ ID NO: 581280 - RNA, 19 nt, Homo sapiens
aagagaaccaguuauccaa

SEQ ID NO: 581281 - RNA, 19 nt, Homo sapiens
gacccaggagccaaacauu

SEQ ID NO: 581282 - RNA, 19 nt, Homo sapiens
cacaugcaaauaaaccuaa

SEQ ID NO: 581283 - RNA, 19 nt, Homo sapiens
aaugaacccaggagauuug

SEQ ID NO: 581284 - RNA, 19 nt, Homo sapiens
cauuugugaugaacaccaa

SEQ ID NO: 581285 - RNA, 19 nt, Homo sapiens
aagagaagccacuuugucu

SEQ ID NO: 581286 - RNA, 19 nt, Homo sapiens
ccaagagaagccacuuugu

SEQ ID NO: 581287 - RNA, 19 nt, Homo sapiens
ggacccaggagccaaacau

SEQ ID NO: 581288 - RNA, 19 nt, Homo sapiens
uaaagaauuccacacuaac

SEQ ID NO: 581289 - RNA, 19 nt, Homo sapiens
ccauugaaggcauuccauu

SEQ ID NO: 581290 - RNA, 19 nt, Homo sapiens
gauguguccuagaauuuug

SEQ ID NO: 581291 - RNA, 19 nt, Homo sapiens
cccaagagaagccacuuug

SEQ ID NO: 581292 - RNA, 19 nt, Homo sapiens
ucgcacaccaaccuuauau

SEQ ID NO: 581293 - RNA, 19 nt, Homo sapiens
gacccacacucucuuaacc

SEQ ID NO: 581294 - RNA, 19 nt, Homo sapiens
caaacauucccaaccuauc

SEQ ID NO: 581295 - RNA, 19 nt, Homo sapiens
ggacccacacucucuuaac

SEQ ID NO: 581296 - RNA, 19 nt, Homo sapiens
gcauuccauuucuaaagcu

SEQ ID NO: 581297 - RNA, 19 nt, Homo sapiens
uugaaggcauuccauuucu

SEQ ID NO: 581298 - RNA, 19 nt, Homo sapiens
aaaaugaacccaggagauu

SEQ ID NO: 581299 - RNA, 19 nt, Homo sapiens
agguagaccaggaggauuu

SEQ ID NO: 581300 - RNA, 19 nt, Homo sapiens
gaaaugaucucuguuugaa

SEQ ID NO: 581301 - RNA, 19 nt, Homo sapiens
caacaccacuuaacaguaa

SEQ ID NO: 581302 - RNA, 19 nt, Homo sapiens
gaaccucacuauccuguaa

SEQ ID NO: 581303 - RNA, 19 nt, Homo sapiens
uagcagaaaugacuguuua

SEQ ID NO: 581304 - RNA, 19 nt, Homo sapiens
gaggugagcugcaugaaga

SEQ ID NO: 581305 - RNA, 19 nt, Homo sapiens
gaacguguguacagaaguu

SEQ ID NO: 581306 - RNA, 19 nt, Homo sapiens
gaaggacauuguaaucauu

SEQ ID NO: 581307 - RNA, 19 nt, Homo sapiens
gcaaccauguuuaauuuga

SEQ ID NO: 581308 - RNA, 19 nt, Homo sapiens
gcaaugugguucugaauca

SEQ ID NO: 581309 - RNA, 19 nt, Homo sapiens
gauaguauguccuccagaa

SEQ ID NO: 581310 - RNA, 19 nt, Homo sapiens
ugaggaaauuguucucuua

SEQ ID NO: 581311 - RNA, 19 nt, Homo sapiens
ucacuauccuguaagguua

SEQ ID NO: 581312 - RNA, 19 nt, Homo sapiens
ggaaauuguucucuuaaag

SEQ ID NO: 581313 - RNA, 19 nt, Homo sapiens
caagauaaauguggaguau

SEQ ID NO: 581314 - RNA, 19 nt, Homo sapiens
guagugcucucguugauga

SEQ ID NO: 581315 - RNA, 19 nt, Homo sapiens
acaaagcagugacaaauga

SEQ ID NO: 581316 - RNA, 19 nt, Homo sapiens
guaagaauuugcacaugaa

SEQ ID NO: 581317 - RNA, 19 nt, Homo sapiens
gaucagccauguucaggaa

SEQ ID NO: 581318 - RNA, 19 nt, Homo sapiens
caaaugaggaugucuaaga

SEQ ID NO: 581319 - RNA, 19 nt, Homo sapiens
gaaauuccaugugauucaa

SEQ ID NO: 581320 - RNA, 19 nt, Homo sapiens
cacaaacaguucaucauuu

SEQ ID NO: 581321 - RNA, 19 nt, Homo sapiens
gaguuuaucuaggugaaua

SEQ ID NO: 581322 - RNA, 19 nt, Homo sapiens
gauaugagaaugagaauca

SEQ ID NO: 581323 - RNA, 19 nt, Homo sapiens
uaucauagauuccuuaggu

SEQ ID NO: 581324 - RNA, 19 nt, Homo sapiens
uaugagagccuauauaguu

SEQ ID NO: 581325 - RNA, 19 nt, Homo sapiens
gauuauuccuugugagauu

SEQ ID NO: 581326 - RNA, 19 nt, Homo sapiens
ggaaaugaucucuguuuga

SEQ ID NO: 581327 - RNA, 19 nt, Homo sapiens
caaaugaugcccuguguga

SEQ ID NO: 581328 - RNA, 19 nt, Homo sapiens
uaacaagccugaaggacau

SEQ ID NO: 581329 - RNA, 19 nt, Homo sapiens
gcucgaaaccguucuaaga

SEQ ID NO: 581330 - RNA, 19 nt, Homo sapiens
aggcaaccauguuuaauuu

SEQ ID NO: 581331 - RNA, 19 nt, Homo sapiens
ccauuugacuucagagauu

SEQ ID NO: 581332 - RNA, 19 nt, Homo sapiens
uuuaacagcuggaaacuug

SEQ ID NO: 581333 - RNA, 19 nt, Homo sapiens
uuacuuggauugaagacua

SEQ ID NO: 581334 - RNA, 19 nt, Homo sapiens
gcaagucugccauuaguga

SEQ ID NO: 581335 - RNA, 19 nt, Homo sapiens
ccacaaacaguucaucauu

SEQ ID NO: 581336 - RNA, 19 nt, Homo sapiens
ucagagacccaaauuauau

SEQ ID NO: 581337 - RNA, 19 nt, Homo sapiens
caagaggaaggcagaauuu

SEQ ID NO: 581338 - RNA, 19 nt, Homo sapiens
gguaaccaauuaagcuuga

SEQ ID NO: 581339 - RNA, 19 nt, Homo sapiens
uaucagagacccaaauuau

SEQ ID NO: 581340 - RNA, 19 nt, Homo sapiens
guggaaaacuguucuuaua

SEQ ID NO: 581341 - RNA, 19 nt, Homo sapiens
uguaagaauuugcacauga

SEQ ID NO: 581342 - RNA, 19 nt, Homo sapiens
ggagaccauucccugcuaa

SEQ ID NO: 581343 - RNA, 19 nt, Homo sapiens
ucaauucuuuguuggcuuu

SEQ ID NO: 581344 - RNA, 19 nt, Homo sapiens
uaaacugccuucuucaaca

SEQ ID NO: 581345 - RNA, 19 nt, Homo sapiens
uauauccucuccuuagaaa

SEQ ID NO: 581346 - RNA, 19 nt, Homo sapiens
gcaacaccacuuaacagua

SEQ ID NO: 581347 - RNA, 19 nt, Homo sapiens
acagagaaagucaguguua

SEQ ID NO: 581348 - RNA, 19 nt, Homo sapiens
gaggaaggcagaauuugaa

SEQ ID NO: 581349 - RNA, 19 nt, Homo sapiens
ggaaaacucuucugcacuu

SEQ ID NO: 581350 - RNA, 19 nt, Homo sapiens
gaccauucccugcuaagua

SEQ ID NO: 581351 - RNA, 19 nt, Homo sapiens
cuaauuaauucccacauuc

SEQ ID NO: 581352 - RNA, 19 nt, Homo sapiens
ggaguuaucuuugacuuuu

SEQ ID NO: 581353 - RNA, 19 nt, Homo sapiens
caacaguacugcgcaaaca

SEQ ID NO: 581354 - RNA, 19 nt, Homo sapiens
guucuaagacugccuugua

SEQ ID NO: 581355 - RNA, 19 nt, Homo sapiens
ggagcgauuuguaguaaca

SEQ ID NO: 581356 - RNA, 19 nt, Homo sapiens
caaaucaccuuaaaacaug

SEQ ID NO: 581357 - RNA, 19 nt, Homo sapiens
ggaugauguugcauuagaa

SEQ ID NO: 581358 - RNA, 19 nt, Homo sapiens
gaguggaccuaagcaguaa

SEQ ID NO: 581359 - RNA, 19 nt, Homo sapiens
gaaagugccaggauuugau

SEQ ID NO: 581360 - RNA, 19 nt, Homo sapiens
uaagggcucucugugguuu

SEQ ID NO: 581361 - RNA, 19 nt, Homo sapiens
gcauuuggcccuauugaau

SEQ ID NO: 581362 - RNA, 19 nt, Homo sapiens
uaacaaaugaggaugucua

SEQ ID NO: 581363 - RNA, 19 nt, Homo sapiens
cuaguuaacugugucuaaa

SEQ ID NO: 581364 - RNA, 19 nt, Homo sapiens
gauacacaaucauucuguu

SEQ ID NO: 581365 - RNA, 19 nt, Homo sapiens
ugaugaagcacauguauga

SEQ ID NO: 581366 - RNA, 19 nt, Homo sapiens
aaauaagccugccgccaaa

SEQ ID NO: 581367 - RNA, 19 nt, Homo sapiens
gacaaaugaugcccugugu

SEQ ID NO: 581368 - RNA, 19 nt, Homo sapiens
gcagaaaugacuguuuauu

SEQ ID NO: 581369 - RNA, 19 nt, Homo sapiens
gagcagaaugugagaaaga

SEQ ID NO: 581370 - RNA, 19 nt, Homo sapiens
ggcauaguccauucuguua

SEQ ID NO: 581371 - RNA, 19 nt, Homo sapiens
ccagcuaaguucuaucaga

SEQ ID NO: 581372 - RNA, 19 nt, Homo sapiens
guucgcaagucugccauua

SEQ ID NO: 581373 - RNA, 19 nt, Homo sapiens
gcaugaagauggaggaaaa

SEQ ID NO: 581374 - RNA, 19 nt, Homo sapiens
ugaaguggcuauccuaaac

SEQ ID NO: 581375 - RNA, 19 nt, Homo sapiens
guucaucauuuggugcuua

SEQ ID NO: 581376 - RNA, 19 nt, Homo sapiens
ccuccagaauuucacaaua

SEQ ID NO: 581377 - RNA, 19 nt, Homo sapiens
guacagaaguuuucaaucu

SEQ ID NO: 581378 - RNA, 19 nt, Homo sapiens
ggaaagugccaggauuuga

SEQ ID NO: 581379 - RNA, 19 nt, Homo sapiens
gaggaaauuguucucuuaa

SEQ ID NO: 581380 - RNA, 19 nt, Homo sapiens
ugaaggacauuguaaucau

SEQ ID NO: 581381 - RNA, 19 nt, Homo sapiens
uuuauaaacugccuucuuc

SEQ ID NO: 581382 - RNA, 19 nt, Homo sapiens
ggaaaacuguucuuauauc

SEQ ID NO: 581383 - RNA, 19 nt, Homo sapiens
uggaagaacugcccugcuu

SEQ ID NO: 581384 - RNA, 19 nt, Homo sapiens
ccauugugaucaagauaaa

SEQ ID NO: 581385 - RNA, 19 nt, Homo sapiens
ugagauuguucugaaagua

SEQ ID NO: 581386 - RNA, 19 nt, Homo sapiens
aguauguccuccagaauuu

SEQ ID NO: 581387 - RNA, 19 nt, Homo sapiens
aaauacagcagaaugauug

SEQ ID NO: 581388 - RNA, 19 nt, Homo sapiens
gauuauauccucuccuuag

SEQ ID NO: 581389 - RNA, 19 nt, Homo sapiens
ccuaauuaauucccacauu

SEQ ID NO: 581390 - RNA, 19 nt, Homo sapiens
caccuuaacuaucuuucaa

SEQ ID NO: 581391 - RNA, 19 nt, Homo sapiens
ucagaucccuagcagaaau

SEQ ID NO: 581392 - RNA, 19 nt, Homo sapiens
ggaagaacugcccugcuuu

SEQ ID NO: 581393 - RNA, 19 nt, Homo sapiens
cagaauggagcgauuugua

SEQ ID NO: 581394 - RNA, 19 nt, Homo sapiens
gaaauugcuuuagcuucug

SEQ ID NO: 581395 - RNA, 19 nt, Homo sapiens
gggauuugguauuaauguu

SEQ ID NO: 581396 - RNA, 19 nt, Homo sapiens
gaguagugcucucguugau

SEQ ID NO: 581397 - RNA, 19 nt, Homo sapiens
uaacagcuuuccaugucuu

SEQ ID NO: 581398 - RNA, 19 nt, Homo sapiens
gaagccaacaucccacuug

SEQ ID NO: 581399 - RNA, 19 nt, Homo sapiens
cuaauccgaaccauauuua

SEQ ID NO: 581400 - RNA, 19 nt, Homo sapiens
gaaagagggugaugaauua

SEQ ID NO: 581401 - RNA, 19 nt, Homo sapiens
caacaaagauucugcuaaa

SEQ ID NO: 581402 - RNA, 19 nt, Homo sapiens
gcaaagagauagucuaaau

SEQ ID NO: 581403 - RNA, 19 nt, Homo sapiens
caacagggaugaaauaguu

SEQ ID NO: 581404 - RNA, 19 nt, Homo sapiens
gaaugaaacuucugcugua

SEQ ID NO: 581405 - RNA, 19 nt, Homo sapiens
gaagaagaaugaagaucua

SEQ ID NO: 581406 - RNA, 19 nt, Homo sapiens
gaggaggacucuucugaua

SEQ ID NO: 581407 - RNA, 19 nt, Homo sapiens
gcaacuaugucaauucaaa

SEQ ID NO: 581408 - RNA, 19 nt, Homo sapiens
gauggucucuauacaaaua

SEQ ID NO: 581409 - RNA, 19 nt, Homo sapiens
ugacgaaucuaguucaaua

SEQ ID NO: 581410 - RNA, 19 nt, Homo sapiens
ggaagcuucugcugacuua

SEQ ID NO: 581411 - RNA, 19 nt, Homo sapiens
gaaugaagaucuaaagcaa

SEQ ID NO: 581412 - RNA, 19 nt, Homo sapiens
ggaaagagggugaugaauu

SEQ ID NO: 581413 - RNA, 19 nt, Homo sapiens
ugacaaacuuggcaaauga

SEQ ID NO: 581414 - RNA, 19 nt, Homo sapiens
cugaagaguuucuauguua

SEQ ID NO: 581415 - RNA, 19 nt, Homo sapiens
cauagucucugcaagauuu

SEQ ID NO: 581416 - RNA, 19 nt, Homo sapiens
ugaagaauguggccaguaa

SEQ ID NO: 581417 - RNA, 19 nt, Homo sapiens
agaguucugucaaguauua

SEQ ID NO: 581418 - RNA, 19 nt, Homo sapiens
gaccguacaagauuuauua

SEQ ID NO: 581419 - RNA, 19 nt, Homo sapiens
ucaagaaguugguauaugu

SEQ ID NO: 581420 - RNA, 19 nt, Homo sapiens
gugauaagauggucucuau

SEQ ID NO: 581421 - RNA, 19 nt, Homo sapiens
ugaaauaguuguugcugaa

SEQ ID NO: 581422 - RNA, 19 nt, Homo sapiens
agaauacacucuugacauu

SEQ ID NO: 581423 - RNA, 19 nt, Homo sapiens
ucagaagguuguaaaugua

SEQ ID NO: 581424 - RNA, 19 nt, Homo sapiens
caaaauugcuuacccagua

SEQ ID NO: 581425 - RNA, 19 nt, Homo sapiens
gcaaguauucuuuggcuaa

SEQ ID NO: 581426 - RNA, 19 nt, Homo sapiens
gaaagugugguuguuauaa

SEQ ID NO: 581427 - RNA, 19 nt, Homo sapiens
cuaaaucacuagugcguuu

SEQ ID NO: 581428 - RNA, 19 nt, Homo sapiens
aaccuuaucugaagaguuu

SEQ ID NO: 581429 - RNA, 19 nt, Homo sapiens
aaaugcaucugaacuguuu

SEQ ID NO: 581430 - RNA, 19 nt, Homo sapiens
gcacaacauggugaaauua

SEQ ID NO: 581431 - RNA, 19 nt, Homo sapiens
caaagauguuucacuucua

SEQ ID NO: 581432 - RNA, 19 nt, Homo sapiens
caagagaauucugcuaaga

SEQ ID NO: 581433 - RNA, 19 nt, Homo sapiens
gcuaaaagcuucacuagug

SEQ ID NO: 581434 - RNA, 19 nt, Homo sapiens
gcagcgauuugaagaagaa

SEQ ID NO: 581435 - RNA, 19 nt, Homo sapiens
gaauaacacuacugaucga

SEQ ID NO: 581436 - RNA, 19 nt, Homo sapiens
ggaggacucuucugauagu

SEQ ID NO: 581437 - RNA, 19 nt, Homo sapiens
agaagaagccguauacuau

SEQ ID NO: 581438 - RNA, 19 nt, Homo sapiens
uggcugaucuugaagguuu

SEQ ID NO: 581439 - RNA, 19 nt, Homo sapiens
uauuaaaucucggcaagua

SEQ ID NO: 581440 - RNA, 19 nt, Homo sapiens
gaagcuggcauaauuucua

SEQ ID NO: 581441 - RNA, 19 nt, Homo sapiens
caaagauucugcuaaacug

SEQ ID NO: 581442 - RNA, 19 nt, Homo sapiens
ccaaagauguuucacuucu

SEQ ID NO: 581443 - RNA, 19 nt, Homo sapiens
gagugaaucuggaagugaa

SEQ ID NO: 581444 - RNA, 19 nt, Homo sapiens
gcaaaugaagccaacauau

SEQ ID NO: 581445 - RNA, 19 nt, Homo sapiens
cuacgaaucugaugaugau

SEQ ID NO: 581446 - RNA, 19 nt, Homo sapiens
ucaugaugcuugcuauuaa

SEQ ID NO: 581447 - RNA, 19 nt, Homo sapiens
aagauggucucuauacaaa

SEQ ID NO: 581448 - RNA, 19 nt, Homo sapiens
gcaauagggaggugcagua

SEQ ID NO: 581449 - RNA, 19 nt, Homo sapiens
gauaauauacacagguuug

SEQ ID NO: 581450 - RNA, 19 nt, Homo sapiens
gcggcaauguccagcaaua

SEQ ID NO: 581451 - RNA, 19 nt, Homo sapiens
gaagaagccguauacuaug

SEQ ID NO: 581452 - RNA, 19 nt, Homo sapiens
uaccaaagauguuucacuu

SEQ ID NO: 581453 - RNA, 19 nt, Homo sapiens
gaagacaauggaaagaauu

SEQ ID NO: 581454 - RNA, 19 nt, Homo sapiens
gcaguguugugauggcuuu

SEQ ID NO: 581455 - RNA, 19 nt, Homo sapiens
caucuggacuuuagaaucu

SEQ ID NO: 581456 - RNA, 19 nt, Homo sapiens
uaacaggaaugaaugaaac

SEQ ID NO: 581457 - RNA, 19 nt, Homo sapiens
ccagaagagucacuaagga

SEQ ID NO: 581458 - RNA, 19 nt, Homo sapiens
gcaagagaauucugcuaag

SEQ ID NO: 581459 - RNA, 19 nt, Homo sapiens
ugagaguucugucaaguau

SEQ ID NO: 581460 - RNA, 19 nt, Homo sapiens
ggacccaaaccaacuaauu

SEQ ID NO: 581461 - RNA, 19 nt, Homo sapiens
gcaacaaagauucugcuaa

SEQ ID NO: 581462 - RNA, 19 nt, Homo sapiens
ccaaacuccuggacaguau

SEQ ID NO: 581463 - RNA, 19 nt, Homo sapiens
caacauaucaacucuucuu

SEQ ID NO: 581464 - RNA, 19 nt, Homo sapiens
aguauuagagugccaauua

SEQ ID NO: 581465 - RNA, 19 nt, Homo sapiens
caucagagaccguacaaga

SEQ ID NO: 581466 - RNA, 19 nt, Homo sapiens
auagggaggugcaguauau

SEQ ID NO: 581467 - RNA, 19 nt, Homo sapiens
gagcagaaggaaauguuaa

SEQ ID NO: 581468 - RNA, 19 nt, Homo sapiens
gaaaucuucuucccuacag

SEQ ID NO: 581469 - RNA, 19 nt, Homo sapiens
cgacaaugguagacaugaa

SEQ ID NO: 581470 - RNA, 19 nt, Homo sapiens
gauaagauggucucuauac

SEQ ID NO: 581471 - RNA, 19 nt, Homo sapiens
ugucaguacuccugcauuu

SEQ ID NO: 581472 - RNA, 19 nt, Homo sapiens
ucucauacucucaacauua

SEQ ID NO: 581473 - RNA, 19 nt, Homo sapiens
gccaacauaucaacucuuc

SEQ ID NO: 581474 - RNA, 19 nt, Homo sapiens
uagcaacuaugucaauuca

SEQ ID NO: 581475 - RNA, 19 nt, Homo sapiens
gaaggacccaaaccaacua

SEQ ID NO: 581476 - RNA, 19 nt, Homo sapiens
ccucuggacuggaaccuuu

SEQ ID NO: 581477 - RNA, 19 nt, Homo sapiens
gaaucuggcacacaacaaa

SEQ ID NO: 581478 - RNA, 19 nt, Homo sapiens
gcuuacaucuggacuuuag

SEQ ID NO: 581479 - RNA, 19 nt, Homo sapiens
gcaaugaggacagcaguga

SEQ ID NO: 581480 - RNA, 19 nt, Homo sapiens
gaagaaugaagaucuaaag

SEQ ID NO: 581481 - RNA, 19 nt, Homo sapiens
caaaugaagccaacauauc

SEQ ID NO: 581482 - RNA, 19 nt, Homo sapiens
gaagaucuaaagcaaaugu

SEQ ID NO: 581483 - RNA, 19 nt, Homo sapiens
caccauauguuaggaagaa

SEQ ID NO: 581484 - RNA, 19 nt, Homo sapiens
guauuagagugccaauuau

SEQ ID NO: 581485 - RNA, 19 nt, Homo sapiens
uagcaaagagauagucuaa

SEQ ID NO: 581486 - RNA, 19 nt, Homo sapiens
uaaacuggaugcuaugaag

SEQ ID NO: 581487 - RNA, 19 nt, Homo sapiens
gaagagucacuaaggagaa

SEQ ID NO: 581488 - RNA, 19 nt, Homo sapiens
ccagugagcaggacaguga

SEQ ID NO: 581489 - RNA, 19 nt, Homo sapiens
cagagaccguacaagauuu

SEQ ID NO: 581490 - RNA, 19 nt, Homo sapiens
ucagagaccguacaagauu

SEQ ID NO: 581491 - RNA, 19 nt, Homo sapiens
ugaaacuucugcuguaauc

SEQ ID NO: 581492 - RNA, 19 nt, Homo sapiens
gguuuacacuugucaacuu

SEQ ID NO: 581493 - RNA, 19 nt, Homo sapiens
gcagugacagugagaguga

SEQ ID NO: 581494 - RNA, 19 nt, Homo sapiens
gcuaugaagcggauuguug

SEQ ID NO: 581495 - RNA, 19 nt, Homo sapiens
caacugauccaacuaugau

SEQ ID NO: 581496 - RNA, 19 nt, Homo sapiens
cuagugcguuuacuucgua

SEQ ID NO: 581497 - RNA, 19 nt, Homo sapiens
gcaauguccagcaauaguu

SEQ ID NO: 581498 - RNA, 19 nt, Homo sapiens
uaacacuacugaucgaaag

SEQ ID NO: 581499 - RNA, 19 nt, Homo sapiens
cucauacucucaacauuaa

SEQ ID NO: 581500 - RNA, 19 nt, Homo sapiens
gaaccaagagucugaauuc

SEQ ID NO: 581501 - RNA, 19 nt, Homo sapiens
ggguagagcuggaagacuu

SEQ ID NO: 581502 - RNA, 19 nt, Homo sapiens
uggaagacuuuaaugguaa

SEQ ID NO: 581503 - RNA, 19 nt, Homo sapiens
cuggaagacuuuaauggua

SEQ ID NO: 581504 - RNA, 19 nt, Homo sapiens
ccacaaauauggcauugac

SEQ ID NO: 581505 - RNA, 19 nt, Homo sapiens
gcccuuaucucuccuguac

SEQ ID NO: 581506 - RNA, 19 nt, Homo sapiens
ggugguaugcauccuguua

SEQ ID NO: 581507 - RNA, 19 nt, Homo sapiens
gagaauuugcaccagcuua

SEQ ID NO: 581508 - RNA, 19 nt, Homo sapiens
gcuugccuguccacauuua

SEQ ID NO: 581509 - RNA, 19 nt, Homo sapiens
gcggcuggcugguguuuca

SEQ ID NO: 581510 - RNA, 19 nt, Homo sapiens
ggaggcccuuuaccaccua

SEQ ID NO: 581511 - RNA, 19 nt, Homo sapiens
ggaaccaagagucugaauu

SEQ ID NO: 581512 - RNA, 19 nt, Homo sapiens
cugcuugccuguccacauu

SEQ ID NO: 581513 - RNA, 19 nt, Homo sapiens
gaaacugccgggagcuguu

SEQ ID NO: 581514 - RNA, 19 nt, Homo sapiens
gccaggagauccagugaac

SEQ ID NO: 581515 - RNA, 19 nt, Homo sapiens
ggaugguucuguggauuuc

SEQ ID NO: 581516 - RNA, 19 nt, Homo sapiens
gcccacaaauauggcauug

SEQ ID NO: 581517 - RNA, 19 nt, Homo sapiens
cuaugacgcugaccacgau

SEQ ID NO: 581518 - RNA, 19 nt, Homo sapiens
ggaagacuuuaaugguaac

SEQ ID NO: 581519 - RNA, 19 nt, Homo sapiens
ucggugagguagaccacua

SEQ ID NO: 581520 - RNA, 19 nt, Homo sapiens
gagcuggaagacuuuaaug

SEQ ID NO: 581521 - RNA, 19 nt, Homo sapiens
gaccacgauucaagcaaca

SEQ ID NO: 581522 - RNA, 19 nt, Homo sapiens
caggaugguucuguggauu

SEQ ID NO: 581523 - RNA, 19 nt, Homo sapiens
ccaggaugguucuguggau

SEQ ID NO: 581524 - RNA, 19 nt, Homo sapiens
ucccggagcuccaggaagu

SEQ ID NO: 581525 - RNA, 19 nt, Homo sapiens
gcuggaagacuuuaauggu

SEQ ID NO: 581526 - RNA, 19 nt, Homo sapiens
gguagagcuggaagacuuu

SEQ ID NO: 581527 - RNA, 19 nt, Homo sapiens
guagagcuggaagacuuua

SEQ ID NO: 581528 - RNA, 19 nt, Homo sapiens
cgucagccaccuugccuuu

SEQ ID NO: 581529 - RNA, 19 nt, Homo sapiens
cacagugggaggcccuuua

SEQ ID NO: 581530 - RNA, 19 nt, Homo sapiens
aauucuggcugggaaauga

SEQ ID NO: 581531 - RNA, 19 nt, Homo sapiens
guggauuucuuccgcucuu

SEQ ID NO: 581532 - RNA, 19 nt, Homo sapiens
aaaucucaauggucgcuau

SEQ ID NO: 581533 - RNA, 19 nt, Homo sapiens
gagccaggagauccaguga

SEQ ID NO: 581534 - RNA, 19 nt, Homo sapiens
uguuaccgaucaaaucuca

SEQ ID NO: 581535 - RNA, 19 nt, Homo sapiens
uaucucuccuguacagcuu

SEQ ID NO: 581536 - RNA, 19 nt, Homo sapiens
ccgaucaaaucucaauggu

SEQ ID NO: 581537 - RNA, 19 nt, Homo sapiens
ccgcaggguucggaugaug

SEQ ID NO: 581538 - RNA, 19 nt, Homo sapiens
cacggugccuggugguaug

SEQ ID NO: 581539 - RNA, 19 nt, Homo sapiens
ccuuaucucuccuguacag

SEQ ID NO: 581540 - RNA, 19 nt, Homo sapiens
ucucaauggucgcuaugca

SEQ ID NO: 581541 - RNA, 19 nt, Homo sapiens
gaauucuggcugggaaaug

SEQ ID NO: 581542 - RNA, 19 nt, Homo sapiens
gaaccaagagucugaauuc

SEQ ID NO: 581543 - RNA, 19 nt, Homo sapiens
ggguagagcuggaagacuu

SEQ ID NO: 581544 - RNA, 19 nt, Homo sapiens
uggaagacuuuaaugguaa

SEQ ID NO: 581545 - RNA, 19 nt, Homo sapiens
cuggaagacuuuaauggua

SEQ ID NO: 581546 - RNA, 19 nt, Homo sapiens
ccacaaauauggcauugac

SEQ ID NO: 581547 - RNA, 19 nt, Homo sapiens
gcccuuaucucuccuguac

SEQ ID NO: 581548 - RNA, 19 nt, Homo sapiens
ggugguaugcauccuguua

SEQ ID NO: 581549 - RNA, 19 nt, Homo sapiens
gagaauuugcaccagcuua

SEQ ID NO: 581550 - RNA, 19 nt, Homo sapiens
gcuugccuguccacauuua

SEQ ID NO: 581551 - RNA, 19 nt, Homo sapiens
gcggcuggcugguguuuca

SEQ ID NO: 581552 - RNA, 19 nt, Homo sapiens
ggaggcccuuuaccaccua

SEQ ID NO: 581553 - RNA, 19 nt, Homo sapiens
ggaaccaagagucugaauu

SEQ ID NO: 581554 - RNA, 19 nt, Homo sapiens
cugcuugccuguccacauu

SEQ ID NO: 581555 - RNA, 19 nt, Homo sapiens
gaaacugccgggagcuguu

SEQ ID NO: 581556 - RNA, 19 nt, Homo sapiens
ggaugguucuguggauuuc

SEQ ID NO: 581557 - RNA, 19 nt, Homo sapiens
gcccacaaauauggcauug

SEQ ID NO: 581558 - RNA, 19 nt, Homo sapiens
cuaugacgcugaccacgau

SEQ ID NO: 581559 - RNA, 19 nt, Homo sapiens
ggaagacuuuaaugguaac

SEQ ID NO: 581560 - RNA, 19 nt, Homo sapiens
ucggugagguagaccacua

SEQ ID NO: 581561 - RNA, 19 nt, Homo sapiens
gagcuggaagacuuuaaug

SEQ ID NO: 581562 - RNA, 19 nt, Homo sapiens
gaccacgauucaagcaaca

SEQ ID NO: 581563 - RNA, 19 nt, Homo sapiens
caggaugguucuguggauu

SEQ ID NO: 581564 - RNA, 19 nt, Homo sapiens
ccaggaugguucuguggau

SEQ ID NO: 581565 - RNA, 19 nt, Homo sapiens
ucccggagcuccaggaagu

SEQ ID NO: 581566 - RNA, 19 nt, Homo sapiens
gcuggaagacuuuaauggu

SEQ ID NO: 581567 - RNA, 19 nt, Homo sapiens
gguagagcuggaagacuuu

SEQ ID NO: 581568 - RNA, 19 nt, Homo sapiens
guagagcuggaagacuuua

SEQ ID NO: 581569 - RNA, 19 nt, Homo sapiens
cgucagccaccuugccuuu

SEQ ID NO: 581570 - RNA, 19 nt, Homo sapiens
cacagugggaggcccuuua

SEQ ID NO: 581571 - RNA, 19 nt, Homo sapiens
aauucuggcugggaaauga

SEQ ID NO: 581572 - RNA, 19 nt, Homo sapiens
guggauuucuuccgcucuu

SEQ ID NO: 581573 - RNA, 19 nt, Homo sapiens
aaaucucaauggucgcuau

SEQ ID NO: 581574 - RNA, 19 nt, Homo sapiens
uguuaccgaucaaaucuca

SEQ ID NO: 581575 - RNA, 19 nt, Homo sapiens
uaucucuccuguacagcuu

SEQ ID NO: 581576 - RNA, 19 nt, Homo sapiens
ccgaucaaaucucaauggu

SEQ ID NO: 581577 - RNA, 19 nt, Homo sapiens
ccgcaggguucggaugaug

SEQ ID NO: 581578 - RNA, 19 nt, Homo sapiens
cacggugccuggugguaug

SEQ ID NO: 581579 - RNA, 19 nt, Homo sapiens
ccuuaucucuccuguacag

SEQ ID NO: 581580 - RNA, 19 nt, Homo sapiens
ucucaauggucgcuaugca

SEQ ID NO: 581581 - RNA, 19 nt, Homo sapiens
gaauucuggcugggaaaug

SEQ ID NO: 581582 - RNA, 19 nt, Homo sapiens
agacaaaccuggucaaaua

SEQ ID NO: 581583 - RNA, 19 nt, Homo sapiens
guagaaaucuguccgcuuu

SEQ ID NO: 581584 - RNA, 19 nt, Homo sapiens
aaagagaguucaccugaua

SEQ ID NO: 581585 - RNA, 19 nt, Homo sapiens
gaagaaagcaguuccauca

SEQ ID NO: 581586 - RNA, 19 nt, Homo sapiens
ugagagagcugcuggauau

SEQ ID NO: 581587 - RNA, 19 nt, Homo sapiens
gguaauggcagaugaguua

SEQ ID NO: 581588 - RNA, 19 nt, Homo sapiens
gagaacugauugcccuuua

SEQ ID NO: 581589 - RNA, 19 nt, Homo sapiens
gaaauacggagaauaagaa

SEQ ID NO: 581590 - RNA, 19 nt, Homo sapiens
agagguaaaucgugaguua

SEQ ID NO: 581591 - RNA, 19 nt, Homo sapiens
gcucaagaauucugaaaga

SEQ ID NO: 581592 - RNA, 19 nt, Homo sapiens
caaaccuggucaaauaaua

SEQ ID NO: 581593 - RNA, 19 nt, Homo sapiens
uacaagaucuccuaaguga

SEQ ID NO: 581594 - RNA, 19 nt, Homo sapiens
gagauggaauggaaacuga

SEQ ID NO: 581595 - RNA, 19 nt, Homo sapiens
gauacaauccgacauauau

SEQ ID NO: 581596 - RNA, 19 nt, Homo sapiens
gguaaagaauguauuggaa

SEQ ID NO: 581597 - RNA, 19 nt, Homo sapiens
gagaauacuuuccaagcaa

SEQ ID NO: 581598 - RNA, 19 nt, Homo sapiens
ccaguuaccugcaaagaga

SEQ ID NO: 581599 - RNA, 19 nt, Homo sapiens
gcaguaaauucucaucuuc

SEQ ID NO: 581600 - RNA, 19 nt, Homo sapiens
ggaaaaugcucacugaaaa

SEQ ID NO: 581601 - RNA, 19 nt, Homo sapiens
ggaguuauagaaccuaaua

SEQ ID NO: 581602 - RNA, 19 nt, Homo sapiens
gagcuagcauuaacaaauc

SEQ ID NO: 581603 - RNA, 19 nt, Homo sapiens
aaugauagcuacccagaaa

SEQ ID NO: 581604 - RNA, 19 nt, Homo sapiens
cgaaguaaauuccuugcaa

SEQ ID NO: 581605 - RNA, 19 nt, Homo sapiens
gaagaggucugugagaagu

SEQ ID NO: 581606 - RNA, 19 nt, Homo sapiens
gaagcgaaacccugaguaa

SEQ ID NO: 581607 - RNA, 19 nt, Homo sapiens
gaccucaauucuaaaguaa

SEQ ID NO: 581608 - RNA, 19 nt, Homo sapiens
ugaccucaauucuaaagua

SEQ ID NO: 581609 - RNA, 19 nt, Homo sapiens
cgaagagccuaucaaguga

SEQ ID NO: 581610 - RNA, 19 nt, Homo sapiens
uauacgcacugcagaauuu

SEQ ID NO: 581611 - RNA, 19 nt, Homo sapiens
uuucugaccucaauucuaa

SEQ ID NO: 581612 - RNA, 19 nt, Homo sapiens
guacuagacuccagauuac

SEQ ID NO: 581613 - RNA, 19 nt, Homo sapiens
gaaaccaaagucaccguua

SEQ ID NO: 581614 - RNA, 19 nt, Homo sapiens
ggaacaguuucgucaagaa

SEQ ID NO: 581615 - RNA, 19 nt, Homo sapiens
aaagaggccuugcagaaau

SEQ ID NO: 581616 - RNA, 19 nt, Homo sapiens
ccaaccaccuuacuugcua

SEQ ID NO: 581617 - RNA, 19 nt, Homo sapiens
cagcagauccuuuacagaa

SEQ ID NO: 581618 - RNA, 19 nt, Homo sapiens
gaagagagcaaacuuacuc

SEQ ID NO: 581619 - RNA, 19 nt, Homo sapiens
gcucuuaguuuccuugcaa

SEQ ID NO: 581620 - RNA, 19 nt, Homo sapiens
gcccauugcuuggccuuua

SEQ ID NO: 581621 - RNA, 19 nt, Homo sapiens
caaauuuguugcagaagug

SEQ ID NO: 581622 - RNA, 19 nt, Homo sapiens
gaaauggggugaagggauu

SEQ ID NO: 581623 - RNA, 19 nt, Homo sapiens
ggacuuucuuucccuuuau

SEQ ID NO: 581624 - RNA, 19 nt, Homo sapiens
ggaaccaccuaaaucuguu

SEQ ID NO: 581625 - RNA, 19 nt, Homo sapiens
gaucuucaguaucacuuug

SEQ ID NO: 581626 - RNA, 19 nt, Homo sapiens
gaagguuacuacaggacaa

SEQ ID NO: 581627 - RNA, 19 nt, Homo sapiens
ucucagagguaaagaaugu

SEQ ID NO: 581628 - RNA, 19 nt, Homo sapiens
uaacaaguacuucaggaaa

SEQ ID NO: 581629 - RNA, 19 nt, Homo sapiens
cagcagagcuagcauuaac

SEQ ID NO: 581630 - RNA, 19 nt, Homo sapiens
caacucaagagcagcuuua

SEQ ID NO: 581631 - RNA, 19 nt, Homo sapiens
gcaggguaauggcagauga

SEQ ID NO: 581632 - RNA, 19 nt, Homo sapiens
auacaaagguuaagucucu

SEQ ID NO: 581633 - RNA, 19 nt, Homo sapiens
gaaguuaaagcuguaagaa

SEQ ID NO: 581634 - RNA, 19 nt, Homo sapiens
gcacugcagaauuuguuua

SEQ ID NO: 581635 - RNA, 19 nt, Homo sapiens
caguguguguucuguguua

SEQ ID NO: 581636 - RNA, 19 nt, Homo sapiens
ccaccuuacuugcuacaaa

SEQ ID NO: 581637 - RNA, 19 nt, Homo sapiens
agaaagcaguuccaucaga

SEQ ID NO: 581638 - RNA, 19 nt, Homo sapiens
ccugaaauacggagaauaa

SEQ ID NO: 581639 - RNA, 19 nt, Homo sapiens
cauaauguauacacccaaa

SEQ ID NO: 581640 - RNA, 19 nt, Homo sapiens
uggaggagcucuuaguuuc

SEQ ID NO: 581641 - RNA, 19 nt, Homo sapiens
guuagaacguaugucaaua

SEQ ID NO: 581642 - RNA, 19 nt, Homo sapiens
ccgaagagccuaucaagug

SEQ ID NO: 581643 - RNA, 19 nt, Homo sapiens
ggugaagggauuaaucuuu

SEQ ID NO: 581644 - RNA, 19 nt, Homo sapiens
gauagcuacccagaaauua

SEQ ID NO: 581645 - RNA, 19 nt, Homo sapiens
uauacaagaucuccuaagu

SEQ ID NO: 581646 - RNA, 19 nt, Homo sapiens
gcuuggccuuuaagaauaa

SEQ ID NO: 581647 - RNA, 19 nt, Homo sapiens
uguacuagacuccagauua

SEQ ID NO: 581648 - RNA, 19 nt, Homo sapiens
ugugauguauggcgaagua

SEQ ID NO: 581649 - RNA, 19 nt, Homo sapiens
uggaaaagcucaagaauuc

SEQ ID NO: 581650 - RNA, 19 nt, Homo sapiens
gaauggaagaggucuguga

SEQ ID NO: 581651 - RNA, 19 nt, Homo sapiens
uacccaagagucauuauua

SEQ ID NO: 581652 - RNA, 19 nt, Homo sapiens
caaagagaguucaccugau

SEQ ID NO: 581653 - RNA, 19 nt, Homo sapiens
gacaaaccuggucaaauaa

SEQ ID NO: 581654 - RNA, 19 nt, Homo sapiens
agacaagaauauccaacuu

SEQ ID NO: 581655 - RNA, 19 nt, Homo sapiens
ccagauuacccuuucuuaa

SEQ ID NO: 581656 - RNA, 19 nt, Homo sapiens
ucccaaagcugcuauaacu

SEQ ID NO: 581657 - RNA, 19 nt, Homo sapiens
caaaugcaacagacaagaa

SEQ ID NO: 581658 - RNA, 19 nt, Homo sapiens
agagccaaguuaacaagua

SEQ ID NO: 581659 - RNA, 19 nt, Homo sapiens
cugcagaguugaauagaug

SEQ ID NO: 581660 - RNA, 19 nt, Homo sapiens
gcacagcagagcuagcauu

SEQ ID NO: 581661 - RNA, 19 nt, Homo sapiens
gggaacaguuucgucaaga

SEQ ID NO: 581662 - RNA, 19 nt, Homo sapiens
agaggucugugagaaguua

SEQ ID NO: 581663 - RNA, 19 nt, Homo sapiens
gauuagccaucauaaaugc

SEQ ID NO: 581664 - RNA, 19 nt, Homo sapiens
gcagagcuagcauuaacaa

SEQ ID NO: 581665 - RNA, 19 nt, Homo sapiens
gaacaguuagaacguaugu

SEQ ID NO: 581666 - RNA, 19 nt, Homo sapiens
gaacgucuagcccgugaga

SEQ ID NO: 581667 - RNA, 19 nt, Homo sapiens
ccaaagcugcuauaacuca

SEQ ID NO: 581668 - RNA, 19 nt, Homo sapiens
guauacacccaaagauauu

SEQ ID NO: 581669 - RNA, 19 nt, Homo sapiens
uaagugaacgggaacaguu

SEQ ID NO: 581670 - RNA, 19 nt, Homo sapiens
gaauauuaguucccaaagc

SEQ ID NO: 581671 - RNA, 19 nt, Homo sapiens
gaaagcaucauagucuuca

SEQ ID NO: 581672 - RNA, 19 nt, Homo sapiens
ugaaauacggagaauaaga

SEQ ID NO: 581673 - RNA, 19 nt, Homo sapiens
gcagauccuuuacagaaaa

SEQ ID NO: 581674 - RNA, 19 nt, Homo sapiens
gaauacuuuccaagcaaua

SEQ ID NO: 581675 - RNA, 19 nt, Homo sapiens
ccacagcacagcagagcua

SEQ ID NO: 581676 - RNA, 19 nt, Homo sapiens
uggaagaggucugugagaa

SEQ ID NO: 581677 - RNA, 19 nt, Homo sapiens
gcuguaagaauauuaguuc

SEQ ID NO: 581678 - RNA, 19 nt, Homo sapiens
cuaaaucuguugaaguuac

SEQ ID NO: 581679 - RNA, 19 nt, Homo sapiens
gagccaaguuaacaaguac

SEQ ID NO: 581680 - RNA, 19 nt, Homo sapiens
gugaagggauuaaucuuuu

SEQ ID NO: 581681 - RNA, 19 nt, Homo sapiens
ggaaguuaaagcuguaaga

SEQ ID NO: 581682 - RNA, 19 nt, Homo sapiens
gaaagaugcuggaauguuu

SEQ ID NO: 581683 - RNA, 19 nt, Homo sapiens
gagaaugccuauaagauuu

SEQ ID NO: 581684 - RNA, 19 nt, Homo sapiens
gaacuaggauuucauagca

SEQ ID NO: 581685 - RNA, 19 nt, Homo sapiens
uaagaaagaugcuggaaug

SEQ ID NO: 581686 - RNA, 19 nt, Homo sapiens
ccuagagacuuuagauuua

SEQ ID NO: 581687 - RNA, 19 nt, Homo sapiens
gaauggugccucacaaaua

SEQ ID NO: 581688 - RNA, 19 nt, Homo sapiens
gcucucaucuugcucaauu

SEQ ID NO: 581689 - RNA, 19 nt, Homo sapiens
gagcguggguucucuguga

SEQ ID NO: 581690 - RNA, 19 nt, Homo sapiens
ggacgaccuucauaagaaa

SEQ ID NO: 581691 - RNA, 19 nt, Homo sapiens
gacaaugcguuaacagaaa

SEQ ID NO: 581692 - RNA, 19 nt, Homo sapiens
gaaacgcucugacauacau

SEQ ID NO: 581693 - RNA, 19 nt, Homo sapiens
uaauaaagcuggaccuauc

SEQ ID NO: 581694 - RNA, 19 nt, Homo sapiens
acugagagcugccaucuuu

SEQ ID NO: 581695 - RNA, 19 nt, Homo sapiens
gaacucaagguuauagaaa

SEQ ID NO: 581696 - RNA, 19 nt, Homo sapiens
uaagaacacugacucugaa

SEQ ID NO: 581697 - RNA, 19 nt, Homo sapiens
guaggcaacccuucucuua

SEQ ID NO: 581698 - RNA, 19 nt, Homo sapiens
aagaagagcugaggugaaa

SEQ ID NO: 581699 - RNA, 19 nt, Homo sapiens
uuacagagcuugauaucau

SEQ ID NO: 581700 - RNA, 19 nt, Homo sapiens
gaacgugaccuugaagauu

SEQ ID NO: 581701 - RNA, 19 nt, Homo sapiens
ucaauuaacucugaugaug

SEQ ID NO: 581702 - RNA, 19 nt, Homo sapiens
ggcaacccuucucuuauua

SEQ ID NO: 581703 - RNA, 19 nt, Homo sapiens
uagaaaugccuuaugcuua

SEQ ID NO: 581704 - RNA, 19 nt, Homo sapiens
cauggucgcucucaucuug

SEQ ID NO: 581705 - RNA, 19 nt, Homo sapiens
gaucucaucucuuccucaa

SEQ ID NO: 581706 - RNA, 19 nt, Homo sapiens
aauggugccucacaaauaa

SEQ ID NO: 581707 - RNA, 19 nt, Homo sapiens
acauuuaccugaacuaaga

SEQ ID NO: 581708 - RNA, 19 nt, Homo sapiens
gcaaucaguuaccuaaucu

SEQ ID NO: 581709 - RNA, 19 nt, Homo sapiens
cuacaucuccauaacaaua

SEQ ID NO: 581710 - RNA, 19 nt, Homo sapiens
uagaagauuuacccaguuu

SEQ ID NO: 581711 - RNA, 19 nt, Homo sapiens
caauaaccuugaugaauuc

SEQ ID NO: 581712 - RNA, 19 nt, Homo sapiens
gccaaaagcuucagaaaau

SEQ ID NO: 581713 - RNA, 19 nt, Homo sapiens
gcagaauaaucagcuaaga

SEQ ID NO: 581714 - RNA, 19 nt, Homo sapiens
ugucccaugucucuaauua

SEQ ID NO: 581715 - RNA, 19 nt, Homo sapiens
gcuccagcaucacuuauga

SEQ ID NO: 581716 - RNA, 19 nt, Homo sapiens
acaccaagcucuacugcaa

SEQ ID NO: 581717 - RNA, 19 nt, Homo sapiens
aacaggaaaucaugccuua

SEQ ID NO: 581718 - RNA, 19 nt, Homo sapiens
gaccuaagacauaaugaaa

SEQ ID NO: 581719 - RNA, 19 nt, Homo sapiens
gaacaaaauacaccacaua

SEQ ID NO: 581720 - RNA, 19 nt, Homo sapiens
agggagaccuggagaauau

SEQ ID NO: 581721 - RNA, 19 nt, Homo sapiens
aacgugaccuugaagauuu

SEQ ID NO: 581722 - RNA, 19 nt, Homo sapiens
guaaugcuuuggugacuuc

SEQ ID NO: 581723 - RNA, 19 nt, Homo sapiens
ccuaagacauaaugaaauc

SEQ ID NO: 581724 - RNA, 19 nt, Homo sapiens
gggaaacgcucugacauac

SEQ ID NO: 581725 - RNA, 19 nt, Homo sapiens
guccuucuccucuuuaaua

SEQ ID NO: 581726 - RNA, 19 nt, Homo sapiens
ugagaaugccuauaagauu

SEQ ID NO: 581727 - RNA, 19 nt, Homo sapiens
uggacgaccuucauaagaa

SEQ ID NO: 581728 - RNA, 19 nt, Homo sapiens
ucaguuaccuaaucuccaa

SEQ ID NO: 581729 - RNA, 19 nt, Homo sapiens
gaacacugacucugaaugg

SEQ ID NO: 581730 - RNA, 19 nt, Homo sapiens
ugacaaucccauccaauuu

SEQ ID NO: 581731 - RNA, 19 nt, Homo sapiens
aggcaacccuucucuuauu

SEQ ID NO: 581732 - RNA, 19 nt, Homo sapiens
gccuagagacuuuagauuu

SEQ ID NO: 581733 - RNA, 19 nt, Homo sapiens
uaacucugaugaugucgaa

SEQ ID NO: 581734 - RNA, 19 nt, Homo sapiens
agaaaugccuuaugcuuac

SEQ ID NO: 581735 - RNA, 19 nt, Homo sapiens
ccucacaaauaacugaauu

SEQ ID NO: 581736 - RNA, 19 nt, Homo sapiens
gacaaucccauccaauuug

SEQ ID NO: 581737 - RNA, 19 nt, Homo sapiens
gaguauaucagagcaguaa

SEQ ID NO: 581738 - RNA, 19 nt, Homo sapiens
caacauuuaccugaacuaa

SEQ ID NO: 581739 - RNA, 19 nt, Homo sapiens
gcaacaauaucaggucgau

SEQ ID NO: 581740 - RNA, 19 nt, Homo sapiens
gaaaaugugagauugagua

SEQ ID NO: 581741 - RNA, 19 nt, Homo sapiens
ucucggagcugccuuccaa

SEQ ID NO: 581742 - RNA, 19 nt, Homo sapiens
ugaugucaauuaacucuga

SEQ ID NO: 581743 - RNA, 19 nt, Homo sapiens
uaagacacguacccacaga

SEQ ID NO: 581744 - RNA, 19 nt, Homo sapiens
guccugaaguaauuaaguu

SEQ ID NO: 581745 - RNA, 19 nt, Homo sapiens
ggaaaucaugccuuacaga

SEQ ID NO: 581746 - RNA, 19 nt, Homo sapiens
cuaagaacacugacucuga

SEQ ID NO: 581747 - RNA, 19 nt, Homo sapiens
uaaacugcccuguggcuuu

SEQ ID NO: 581748 - RNA, 19 nt, Homo sapiens
ggagaccuggagaauauuu

SEQ ID NO: 581749 - RNA, 19 nt, Homo sapiens
ccaaccuccugucgucuuu

SEQ ID NO: 581750 - RNA, 19 nt, Homo sapiens
caaaccgucugcaaucagu

SEQ ID NO: 581751 - RNA, 19 nt, Homo sapiens
ugacaaugcguuaacagaa

SEQ ID NO: 581752 - RNA, 19 nt, Homo sapiens
ucccaugucucuaauuaau

SEQ ID NO: 581753 - RNA, 19 nt, Homo sapiens
guucaauccucacuuuaag

SEQ ID NO: 581754 - RNA, 19 nt, Homo sapiens
ggacugcucuaugguaaaa

SEQ ID NO: 581755 - RNA, 19 nt, Homo sapiens
gaucugcuuuucaacauuu

SEQ ID NO: 581756 - RNA, 19 nt, Homo sapiens
aggacacucuccaaccuua

SEQ ID NO: 581757 - RNA, 19 nt, Homo sapiens
guauaucagagcaguaauu

SEQ ID NO: 581758 - RNA, 19 nt, Homo sapiens
gaagauuuccugcuugacu

SEQ ID NO: 581759 - RNA, 19 nt, Homo sapiens
cgggaaacgcucugacaua

SEQ ID NO: 581760 - RNA, 19 nt, Homo sapiens
ggauuucauagcaacaaua

SEQ ID NO: 581761 - RNA, 19 nt, Homo sapiens
gaccuuggcccugaacaaa

SEQ ID NO: 581762 - RNA, 19 nt, Homo sapiens
gagcauucacuggccuuua

SEQ ID NO: 581763 - RNA, 19 nt, Homo sapiens
uuccagaacucaagguuau

SEQ ID NO: 581764 - RNA, 19 nt, Homo sapiens
cugcaaaccuggagagucu

SEQ ID NO: 581765 - RNA, 19 nt, Homo sapiens
ccuuaaagaacuaggauuu

SEQ ID NO: 581766 - RNA, 19 nt, Homo sapiens
gcugccaucuuuccucugu

SEQ ID NO: 581767 - RNA, 19 nt, Homo sapiens
gaaacgaaagcuccauuuu

SEQ ID NO: 581768 - RNA, 19 nt, Homo sapiens
ggaauaaaggugacaacag

SEQ ID NO: 581769 - RNA, 19 nt, Homo sapiens
ugugugagaaugccuauaa

SEQ ID NO: 581770 - RNA, 19 nt, Homo sapiens
caacccuucucuuauuaca

SEQ ID NO: 581771 - RNA, 19 nt, Homo sapiens
ggaugacaaugcguuaaca

SEQ ID NO: 581772 - RNA, 19 nt, Homo sapiens
ccaacugcauccuaaacug

SEQ ID NO: 581773 - RNA, 19 nt, Homo sapiens
ccagugcugugcauuugga

SEQ ID NO: 581774 - RNA, 19 nt, Homo sapiens
gaagagcugaggugaaacu

SEQ ID NO: 581775 - RNA, 19 nt, Homo sapiens
cuuguucaauccucacuuu

SEQ ID NO: 581776 - RNA, 19 nt, Homo sapiens
aaacugcccuguggcuuuc

SEQ ID NO: 581777 - RNA, 19 nt, Homo sapiens
ugaaacgaaagcuccauuu

SEQ ID NO: 581778 - RNA, 19 nt, Homo sapiens
agaugaacgugaccuugaa

SEQ ID NO: 581779 - RNA, 19 nt, Homo sapiens
acucaagguuauagaaaug

SEQ ID NO: 581780 - RNA, 19 nt, Homo sapiens
uuagaagauuuacccaguu

SEQ ID NO: 581781 - RNA, 19 nt, Homo sapiens
cuuacaaccuauuagaaga

SEQ ID NO: 581782 - RNA, 19 nt, Homo sapiens
ggagaaaucuggcaucaua

SEQ ID NO: 581783 - RNA, 19 nt, Homo sapiens
gauuaaagcugcuguauag

SEQ ID NO: 581784 - RNA, 19 nt, Homo sapiens
gaaacugaaugaaguaaug

SEQ ID NO: 581785 - RNA, 19 nt, Homo sapiens
ggaauuagugguccaguua

SEQ ID NO: 581786 - RNA, 19 nt, Homo sapiens
ggacaaagccaucaaggaa

SEQ ID NO: 581787 - RNA, 19 nt, Homo sapiens
ggucguggauucacagaua

SEQ ID NO: 581788 - RNA, 19 nt, Homo sapiens
ccaaagauguugugaggaa

SEQ ID NO: 581789 - RNA, 19 nt, Homo sapiens
guaaagaaaucuacucaag

SEQ ID NO: 581790 - RNA, 19 nt, Homo sapiens
gaagcaagccagccaagua

SEQ ID NO: 581791 - RNA, 19 nt, Homo sapiens
ccacgaaucccaauaauga

SEQ ID NO: 581792 - RNA, 19 nt, Homo sapiens
ggagagcuauuucacagaa

SEQ ID NO: 581793 - RNA, 19 nt, Homo sapiens
auaccgaccuuucugauua

SEQ ID NO: 581794 - RNA, 19 nt, Homo sapiens
caaaggauaugcgaagaaa

SEQ ID NO: 581795 - RNA, 19 nt, Homo sapiens
aaugacagcuucagacuuu

SEQ ID NO: 581796 - RNA, 19 nt, Homo sapiens
gcccgacucuuaauuguaa

SEQ ID NO: 581797 - RNA, 19 nt, Homo sapiens
gcucaguucuagagacaua

SEQ ID NO: 581798 - RNA, 19 nt, Homo sapiens
gugcaggacuuaauaauag

SEQ ID NO: 581799 - RNA, 19 nt, Homo sapiens
uaaagcugcuguauagauu

SEQ ID NO: 581800 - RNA, 19 nt, Homo sapiens
ccaaacauaguucagauua

SEQ ID NO: 581801 - RNA, 19 nt, Homo sapiens
gcaggaggcuuggaaguau

SEQ ID NO: 581802 - RNA, 19 nt, Homo sapiens
cgaccuuucugauuaguaa

SEQ ID NO: 581803 - RNA, 19 nt, Homo sapiens
gaaugaagaugagaaacug

SEQ ID NO: 581804 - RNA, 19 nt, Homo sapiens
ugaagcaggugauagaaga

SEQ ID NO: 581805 - RNA, 19 nt, Homo sapiens
gcugggagcuggaauuagu

SEQ ID NO: 581806 - RNA, 19 nt, Homo sapiens
gaggaagaguggagucaga

SEQ ID NO: 581807 - RNA, 19 nt, Homo sapiens
ccaguuagagucuguguaa

SEQ ID NO: 581808 - RNA, 19 nt, Homo sapiens
gcggcacugucacuuguua

SEQ ID NO: 581809 - RNA, 19 nt, Homo sapiens
aagcugcuguauagauuua

SEQ ID NO: 581810 - RNA, 19 nt, Homo sapiens
gauaaaguagaucgacuaa

SEQ ID NO: 581811 - RNA, 19 nt, Homo sapiens
caccgacgcccuacacuua

SEQ ID NO: 581812 - RNA, 19 nt, Homo sapiens
gaaggcaucagaaggagaa

SEQ ID NO: 581813 - RNA, 19 nt, Homo sapiens
uagagucuguguaaagaaa

SEQ ID NO: 581814 - RNA, 19 nt, Homo sapiens
ggugcaggacuuaauaaua

SEQ ID NO: 581815 - RNA, 19 nt, Homo sapiens
ggaaugcaaacuccuaaga

SEQ ID NO: 581816 - RNA, 19 nt, Homo sapiens
guuagagucuguguaaaga

SEQ ID NO: 581817 - RNA, 19 nt, Homo sapiens
gcaaagaaggcaucagaag

SEQ ID NO: 581818 - RNA, 19 nt, Homo sapiens
ccaccgaggcccuggauaa

SEQ ID NO: 581819 - RNA, 19 nt, Homo sapiens
gcgcaaagaaggcaucaga

SEQ ID NO: 581820 - RNA, 19 nt, Homo sapiens
uuuguaagaugacagauga

SEQ ID NO: 581821 - RNA, 19 nt, Homo sapiens
gcaaaccacgucccacgaa

SEQ ID NO: 581822 - RNA, 19 nt, Homo sapiens
gaugagaaacugaaugaag

SEQ ID NO: 581823 - RNA, 19 nt, Homo sapiens
ccaaguaacaaagcagaua

SEQ ID NO: 581824 - RNA, 19 nt, Homo sapiens
caggaggcuuggaaguaua

SEQ ID NO: 581825 - RNA, 19 nt, Homo sapiens
gaagaugagaaacugaaug

SEQ ID NO: 581826 - RNA, 19 nt, Homo sapiens
gauaugcgaagaaagauca

SEQ ID NO: 581827 - RNA, 19 nt, Homo sapiens
aaagaaggcaucagaagga

SEQ ID NO: 581828 - RNA, 19 nt, Homo sapiens
gaaucaaggacucuggaaa

SEQ ID NO: 581829 - RNA, 19 nt, Homo sapiens
ggacuguguaguuguauau

SEQ ID NO: 581830 - RNA, 19 nt, Homo sapiens
uuaggacuguguaguugua

SEQ ID NO: 581831 - RNA, 19 nt, Homo sapiens
ccgaggcccuggauaaugu

SEQ ID NO: 581832 - RNA, 19 nt, Homo sapiens
gacaaagccaucaaggaaa

SEQ ID NO: 581833 - RNA, 19 nt, Homo sapiens
gauuuagggugcaggacuu

SEQ ID NO: 581834 - RNA, 19 nt, Homo sapiens
caccggcacuuuacagaga

SEQ ID NO: 581835 - RNA, 19 nt, Homo sapiens
uggcagaaauugugaagca

SEQ ID NO: 581836 - RNA, 19 nt, Homo sapiens
ugcaaacuccuaagagaua

SEQ ID NO: 581837 - RNA, 19 nt, Homo sapiens
ggaagcuccugaaggucaa

SEQ ID NO: 581838 - RNA, 19 nt, Homo sapiens
gcccuacacuuacaacaag

SEQ ID NO: 581839 - RNA, 19 nt, Homo sapiens
gacauacuauuacuuuagg

SEQ ID NO: 581840 - RNA, 19 nt, Homo sapiens
aaugcaaacuccuaagaga

SEQ ID NO: 581841 - RNA, 19 nt, Homo sapiens
gcaggacuuaauaauagua

SEQ ID NO: 581842 - RNA, 19 nt, Homo sapiens
gagccgaggauuccaaugu

SEQ ID NO: 581843 - RNA, 19 nt, Homo sapiens
ugauuaaagcugcuguaua

SEQ ID NO: 581844 - RNA, 19 nt, Homo sapiens
caaaccacgucccacgaau

SEQ ID NO: 581845 - RNA, 19 nt, Homo sapiens
ggagagcgacauggacaaa

SEQ ID NO: 581846 - RNA, 19 nt, Homo sapiens
uggauucacagauaaagua

SEQ ID NO: 581847 - RNA, 19 nt, Homo sapiens
gagaaacugaaugaaguaa

SEQ ID NO: 581848 - RNA, 19 nt, Homo sapiens
gagagaaugaagaugagaa

SEQ ID NO: 581849 - RNA, 19 nt, Homo sapiens
ucacuugccagcaguagaa

SEQ ID NO: 581850 - RNA, 19 nt, Homo sapiens
ggaaguauaaccgggaaug

SEQ ID NO: 581851 - RNA, 19 nt, Homo sapiens
ugagaaacugaaugaagua

SEQ ID NO: 581852 - RNA, 19 nt, Homo sapiens
ccagugaaguugugugacu

SEQ ID NO: 581853 - RNA, 19 nt, Homo sapiens
gagguacgucugcacauga

SEQ ID NO: 581854 - RNA, 19 nt, Homo sapiens
gccgaggauuccaauguug

SEQ ID NO: 581855 - RNA, 19 nt, Homo sapiens
cugcucagcugaugaugga

SEQ ID NO: 581856 - RNA, 19 nt, Homo sapiens
aagcaagccagccaaguaa

SEQ ID NO: 581857 - RNA, 19 nt, Homo sapiens
acaaagccaucaaggaaac

SEQ ID NO: 581858 - RNA, 19 nt, Homo sapiens
gcaaacuccuaagagauac

SEQ ID NO: 581859 - RNA, 19 nt, Homo sapiens
aagaugagaaacugaauga

SEQ ID NO: 581860 - RNA, 19 nt, Homo sapiens
aaggauaugcgaagaaaga

SEQ ID NO: 581861 - RNA, 19 nt, Homo sapiens
ccaaaggauaugcgaagaa

SEQ ID NO: 581862 - RNA, 19 nt, Homo sapiens
guacuggaggcgcaaagaa

SEQ ID NO: 581863 - RNA, 19 nt, Homo sapiens
guucaccccuuauuaugua

SEQ ID NO: 581864 - RNA, 19 nt, Homo sapiens
gcaagccagccaaguaaca

SEQ ID NO: 581865 - RNA, 19 nt, Homo sapiens
ggacaaggcagugguugca

SEQ ID NO: 581866 - RNA, 19 nt, Homo sapiens
gauaaugugcugccuucug

SEQ ID NO: 581867 - RNA, 19 nt, Homo sapiens
ggucaaaccggaggagaga

SEQ ID NO: 581868 - RNA, 19 nt, Homo sapiens
agagauggccaaagauguu

SEQ ID NO: 581869 - RNA, 19 nt, Homo sapiens
gaagaguggagucagaucu

SEQ ID NO: 581870 - RNA, 19 nt, Homo sapiens
gaaugcaaacuccuaagag

SEQ ID NO: 581871 - RNA, 19 nt, Homo sapiens
ccacacacccaaacauagu

SEQ ID NO: 581872 - RNA, 19 nt, Homo sapiens
cuguguaguuguauauuug

SEQ ID NO: 581873 - RNA, 19 nt, Homo sapiens
cuagagacauacuauuacu

SEQ ID NO: 581874 - RNA, 19 nt, Homo sapiens
gacuaaaacuggcagaaau

SEQ ID NO: 581875 - RNA, 19 nt, Homo sapiens
augagaaacugaaugaagu

SEQ ID NO: 581876 - RNA, 19 nt, Homo sapiens
gaugugauugcucagugua

SEQ ID NO: 581877 - RNA, 19 nt, Homo sapiens
gagaauggagccgaggauu

SEQ ID NO: 581878 - RNA, 19 nt, Homo sapiens
ugagguacgucugcacaug

SEQ ID NO: 581879 - RNA, 19 nt, Homo sapiens
gaaaagcucaguucuagag

SEQ ID NO: 581880 - RNA, 19 nt, Homo sapiens
aaacaccacagccggacua

SEQ ID NO: 581881 - RNA, 19 nt, Homo sapiens
uuaaagcugcuguauagau

SEQ ID NO: 581882 - RNA, 19 nt, Homo sapiens
ggagaaaucuggcaucaua

SEQ ID NO: 581883 - RNA, 19 nt, Homo sapiens
gauuaaagcugcuguauag

SEQ ID NO: 581884 - RNA, 19 nt, Homo sapiens
gaaacugaaugaaguaaug

SEQ ID NO: 581885 - RNA, 19 nt, Homo sapiens
ggaauuagugguccaguua

SEQ ID NO: 581886 - RNA, 19 nt, Homo sapiens
ggacaaagccaucaaggaa

SEQ ID NO: 581887 - RNA, 19 nt, Homo sapiens
ggucguggauucacagaua

SEQ ID NO: 581888 - RNA, 19 nt, Homo sapiens
ccaaagauguugugaggaa

SEQ ID NO: 581889 - RNA, 19 nt, Homo sapiens
guaaagaaaucuacucaag

SEQ ID NO: 581890 - RNA, 19 nt, Homo sapiens
gaagcaagccagccaagua

SEQ ID NO: 581891 - RNA, 19 nt, Homo sapiens
ccacgaaucccaauaauga

SEQ ID NO: 581892 - RNA, 19 nt, Homo sapiens
ggagagcuauuucacagaa

SEQ ID NO: 581893 - RNA, 19 nt, Homo sapiens
auaccgaccuuucugauua

SEQ ID NO: 581894 - RNA, 19 nt, Homo sapiens
caaaggauaugcgaagaaa

SEQ ID NO: 581895 - RNA, 19 nt, Homo sapiens
aaugacagcuucagacuuu

SEQ ID NO: 581896 - RNA, 19 nt, Homo sapiens
gcccgacucuuaauuguaa

SEQ ID NO: 581897 - RNA, 19 nt, Homo sapiens
gcucaguucuagagacaua

SEQ ID NO: 581898 - RNA, 19 nt, Homo sapiens
gugcaggacuuaauaauag

SEQ ID NO: 581899 - RNA, 19 nt, Homo sapiens
uaaagcugcuguauagauu

SEQ ID NO: 581900 - RNA, 19 nt, Homo sapiens
ccaaacauaguucagauua

SEQ ID NO: 581901 - RNA, 19 nt, Homo sapiens
gcaggaggcuuggaaguau

SEQ ID NO: 581902 - RNA, 19 nt, Homo sapiens
cgaccuuucugauuaguaa

SEQ ID NO: 581903 - RNA, 19 nt, Homo sapiens
gaaugaagaugagaaacug

SEQ ID NO: 581904 - RNA, 19 nt, Homo sapiens
ugaagcaggugauagaaga

SEQ ID NO: 581905 - RNA, 19 nt, Homo sapiens
gcugggagcuggaauuagu

SEQ ID NO: 581906 - RNA, 19 nt, Homo sapiens
gaggaagaguggagucaga

SEQ ID NO: 581907 - RNA, 19 nt, Homo sapiens
ccaguuagagucuguguaa

SEQ ID NO: 581908 - RNA, 19 nt, Homo sapiens
gcggcacugucacuuguua

SEQ ID NO: 581909 - RNA, 19 nt, Homo sapiens
aagcugcuguauagauuua

SEQ ID NO: 581910 - RNA, 19 nt, Homo sapiens
gauaaaguagaucgacuaa

SEQ ID NO: 581911 - RNA, 19 nt, Homo sapiens
caccgacgcccuacacuua

SEQ ID NO: 581912 - RNA, 19 nt, Homo sapiens
gaaggcaucagaaggagaa

SEQ ID NO: 581913 - RNA, 19 nt, Homo sapiens
uagagucuguguaaagaaa

SEQ ID NO: 581914 - RNA, 19 nt, Homo sapiens
ggugcaggacuuaauaaua

SEQ ID NO: 581915 - RNA, 19 nt, Homo sapiens
ggaaugcaaacuccuaaga

SEQ ID NO: 581916 - RNA, 19 nt, Homo sapiens
guuagagucuguguaaaga

SEQ ID NO: 581917 - RNA, 19 nt, Homo sapiens
gcaaagaaggcaucagaag

SEQ ID NO: 581918 - RNA, 19 nt, Homo sapiens
ccaccgaggcccuggauaa

SEQ ID NO: 581919 - RNA, 19 nt, Homo sapiens
gcgcaaagaaggcaucaga

SEQ ID NO: 581920 - RNA, 19 nt, Homo sapiens
uuuguaagaugacagauga

SEQ ID NO: 581921 - RNA, 19 nt, Homo sapiens
gcaaaccacgucccacgaa

SEQ ID NO: 581922 - RNA, 19 nt, Homo sapiens
gaugagaaacugaaugaag

SEQ ID NO: 581923 - RNA, 19 nt, Homo sapiens
ccaaguaacaaagcagaua

SEQ ID NO: 581924 - RNA, 19 nt, Homo sapiens
caggaggcuuggaaguaua

SEQ ID NO: 581925 - RNA, 19 nt, Homo sapiens
gaagaugagaaacugaaug

SEQ ID NO: 581926 - RNA, 19 nt, Homo sapiens
guaaaggagagaaugaaga

SEQ ID NO: 581927 - RNA, 19 nt, Homo sapiens
gauaugcgaagaaagauca

SEQ ID NO: 581928 - RNA, 19 nt, Homo sapiens
aaagaaggcaucagaagga

SEQ ID NO: 581929 - RNA, 19 nt, Homo sapiens
gaaucaaggacucuggaaa

SEQ ID NO: 581930 - RNA, 19 nt, Homo sapiens
ggacuguguaguuguauau

SEQ ID NO: 581931 - RNA, 19 nt, Homo sapiens
uuaggacuguguaguugua

SEQ ID NO: 581932 - RNA, 19 nt, Homo sapiens
ccgaggcccuggauaaugu

SEQ ID NO: 581933 - RNA, 19 nt, Homo sapiens
gacaaagccaucaaggaaa

SEQ ID NO: 581934 - RNA, 19 nt, Homo sapiens
gauuuagggugcaggacuu

SEQ ID NO: 581935 - RNA, 19 nt, Homo sapiens
caccggcacuuuacagaga

SEQ ID NO: 581936 - RNA, 19 nt, Homo sapiens
uggcagaaauugugaagca

SEQ ID NO: 581937 - RNA, 19 nt, Homo sapiens
ugcaaacuccuaagagaua

SEQ ID NO: 581938 - RNA, 19 nt, Homo sapiens
uaaaggagagaaugaagau

SEQ ID NO: 581939 - RNA, 19 nt, Homo sapiens
ggaagcuccugaaggucaa

SEQ ID NO: 581940 - RNA, 19 nt, Homo sapiens
gcccuacacuuacaacaag

SEQ ID NO: 581941 - RNA, 19 nt, Homo sapiens
gacauacuauuacuuuagg

SEQ ID NO: 581942 - RNA, 19 nt, Homo sapiens
aaugcaaacuccuaagaga

SEQ ID NO: 581943 - RNA, 19 nt, Homo sapiens
gcaggacuuaauaauagua

SEQ ID NO: 581944 - RNA, 19 nt, Homo sapiens
gagccgaggauuccaaugu

SEQ ID NO: 581945 - RNA, 19 nt, Homo sapiens
ugauuaaagcugcuguaua

SEQ ID NO: 581946 - RNA, 19 nt, Homo sapiens
caaaccacgucccacgaau

SEQ ID NO: 581947 - RNA, 19 nt, Homo sapiens
ggagagcgacauggacaaa

SEQ ID NO: 581948 - RNA, 19 nt, Homo sapiens
uggauucacagauaaagua

SEQ ID NO: 581949 - RNA, 19 nt, Homo sapiens
gagaaacugaaugaaguaa

SEQ ID NO: 581950 - RNA, 19 nt, Homo sapiens
gagagaaugaagaugagaa

SEQ ID NO: 581951 - RNA, 19 nt, Homo sapiens
ucacuugccagcaguagaa

SEQ ID NO: 581952 - RNA, 19 nt, Homo sapiens
ggaaguauaaccgggaaug

SEQ ID NO: 581953 - RNA, 19 nt, Homo sapiens
ugagaaacugaaugaagua

SEQ ID NO: 581954 - RNA, 19 nt, Homo sapiens
ccagugaaguugugugacu

SEQ ID NO: 581955 - RNA, 19 nt, Homo sapiens
gagguacgucugcacauga

SEQ ID NO: 581956 - RNA, 19 nt, Homo sapiens
aaggagagaaugaagauga

SEQ ID NO: 581957 - RNA, 19 nt, Homo sapiens
gccgaggauuccaauguug

SEQ ID NO: 581958 - RNA, 19 nt, Homo sapiens
cugcucagcugaugaugga

SEQ ID NO: 581959 - RNA, 19 nt, Homo sapiens
aagcaagccagccaaguaa

SEQ ID NO: 581960 - RNA, 19 nt, Homo sapiens
acaaagccaucaaggaaac

SEQ ID NO: 581961 - RNA, 19 nt, Homo sapiens
gcaaacuccuaagagauac

SEQ ID NO: 581962 - RNA, 19 nt, Homo sapiens
aagaugagaaacugaauga

SEQ ID NO: 581963 - RNA, 19 nt, Homo sapiens
aaggauaugcgaagaaaga

SEQ ID NO: 581964 - RNA, 19 nt, Homo sapiens
ccaaaggauaugcgaagaa

SEQ ID NO: 581965 - RNA, 19 nt, Homo sapiens
guacuggaggcgcaaagaa

SEQ ID NO: 581966 - RNA, 19 nt, Homo sapiens
guucaccccuuauuaugua

SEQ ID NO: 581967 - RNA, 19 nt, Homo sapiens
gcaagccagccaaguaaca

SEQ ID NO: 581968 - RNA, 19 nt, Homo sapiens
ggacaaggcagugguugca

SEQ ID NO: 581969 - RNA, 19 nt, Homo sapiens
gauaaugugcugccuucug

SEQ ID NO: 581970 - RNA, 19 nt, Homo sapiens
ggucaaaccggaggagaga

SEQ ID NO: 581971 - RNA, 19 nt, Homo sapiens
agagauggccaaagauguu

SEQ ID NO: 581972 - RNA, 19 nt, Homo sapiens
gaagaguggagucagaucu

SEQ ID NO: 581973 - RNA, 19 nt, Homo sapiens
gaaugcaaacuccuaagag

SEQ ID NO: 581974 - RNA, 19 nt, Homo sapiens
ccacacacccaaacauagu

SEQ ID NO: 581975 - RNA, 19 nt, Homo sapiens
cuguguaguuguauauuug

SEQ ID NO: 581976 - RNA, 19 nt, Homo sapiens
cuagagacauacuauuacu

SEQ ID NO: 581977 - RNA, 19 nt, Homo sapiens
gacuaaaacuggcagaaau

SEQ ID NO: 581978 - RNA, 19 nt, Homo sapiens
augagaaacugaaugaagu

SEQ ID NO: 581979 - RNA, 19 nt, Homo sapiens
gaugugauugcucagugua

SEQ ID NO: 581980 - RNA, 19 nt, Homo sapiens
gagaauggagccgaggauu

SEQ ID NO: 581981 - RNA, 19 nt, Homo sapiens
ugagguacgucugcacaug

SEQ ID NO: 581982 - RNA, 19 nt, Homo sapiens
gcaaagaccucaaggauau

SEQ ID NO: 581983 - RNA, 19 nt, Homo sapiens
gaacggacagcaaacaaua

SEQ ID NO: 581984 - RNA, 19 nt, Homo sapiens
gagaaugguuuguaguauu

SEQ ID NO: 581985 - RNA, 19 nt, Homo sapiens
ggagggacguggcccaauu

SEQ ID NO: 581986 - RNA, 19 nt, Homo sapiens
gaaaggauccugcuugucu

SEQ ID NO: 581987 - RNA, 19 nt, Homo sapiens
ggaagagccugcgcaaaga

SEQ ID NO: 581988 - RNA, 19 nt, Homo sapiens
gcaaacaauagacacaaua

SEQ ID NO: 581989 - RNA, 19 nt, Homo sapiens
acaauacgaucgugaggua

SEQ ID NO: 581990 - RNA, 19 nt, Homo sapiens
ggagaaugguuuguaguau

SEQ ID NO: 581991 - RNA, 19 nt, Homo sapiens
agaaugguuuguaguauug

SEQ ID NO: 581992 - RNA, 19 nt, Homo sapiens
gggagaaugguuuguagua

SEQ ID NO: 581993 - RNA, 19 nt, Homo sapiens
ucagggagccaacucauuu

SEQ ID NO: 581994 - RNA, 19 nt, Homo sapiens
gcagugagccgugaucaug

SEQ ID NO: 581995 - RNA, 19 nt, Homo sapiens
gcagacagcccuuuauagg

SEQ ID NO: 581996 - RNA, 19 nt, Homo sapiens
ucaaggauaugagggacua

SEQ ID NO: 581997 - RNA, 19 nt, Homo sapiens
ccucaaaggaaacaacuaa

SEQ ID NO: 581998 - RNA, 19 nt, Homo sapiens
ggacagcaaacaauagaca

SEQ ID NO: 581999 - RNA, 19 nt, Homo sapiens
gaucgugagguauauaguu

SEQ ID NO: 582000 - RNA, 19 nt, Homo sapiens
gcuggagccugggaaguug

SEQ ID NO: 582001 - RNA, 19 nt, Homo sapiens
ggaacggacagcaaacaau

SEQ ID NO: 582002 - RNA, 19 nt, Homo sapiens
gagggacguggcccaauuu

SEQ ID NO: 582003 - RNA, 19 nt, Homo sapiens
ugaugacaaugguuaagga

SEQ ID NO: 582004 - RNA, 19 nt, Homo sapiens
aucgugagguauauaguua

SEQ ID NO: 582005 - RNA, 19 nt, Homo sapiens
uagcagguguuagacgaaa

SEQ ID NO: 582006 - RNA, 19 nt, Homo sapiens
uuaaggaaggccugaguuu

SEQ ID NO: 582007 - RNA, 19 nt, Homo sapiens
gaagagccugcgcaaagau

SEQ ID NO: 582008 - RNA, 19 nt, Homo sapiens
gaaguugaggcugcaguga

SEQ ID NO: 582009 - RNA, 19 nt, Homo sapiens
ucaggcagacagcccuuua

SEQ ID NO: 582010 - RNA, 19 nt, Homo sapiens
ggauccugcuugucugugu

SEQ ID NO: 582011 - RNA, 19 nt, Homo sapiens
ugcaaagaccucaaggaua

SEQ ID NO: 582012 - RNA, 19 nt, Homo sapiens
uaaggaaggccugaguuug

SEQ ID NO: 582013 - RNA, 19 nt, Homo sapiens
cagggagaaugguuuguag

SEQ ID NO: 582014 - RNA, 19 nt, Homo sapiens
cugcuagccuccuaacuca

SEQ ID NO: 582015 - RNA, 19 nt, Homo sapiens
gaugucuggcccauuguuu

SEQ ID NO: 582016 - RNA, 19 nt, Homo sapiens
uggaagagccugcgcaaag

SEQ ID NO: 582017 - RNA, 19 nt, Homo sapiens
gaaggccugaguuugcaaa

SEQ ID NO: 582018 - RNA, 19 nt, Homo sapiens
uaguuaauguuggugauga

SEQ ID NO: 582019 - RNA, 19 nt, Homo sapiens
gcagguguuagacgaaaga

SEQ ID NO: 582020 - RNA, 19 nt, Homo sapiens
ggccugaguuugcaaagac

SEQ ID NO: 582021 - RNA, 19 nt, Homo sapiens
aggcagacagcccuuuaua

SEQ ID NO: 582022 - RNA, 19 nt, Homo sapiens
cgugagguauauaguuaau

SEQ ID NO: 582023 - RNA, 19 nt, Homo sapiens
caaacaauagacacaauac

SEQ ID NO: 582024 - RNA, 19 nt, Homo sapiens
gaugacaaugguuaaggaa

SEQ ID NO: 582025 - RNA, 19 nt, Homo sapiens
ccuguaaucccagcucuuu

SEQ ID NO: 582026 - RNA, 19 nt, Homo sapiens
ccacaugcaucaucauccu

SEQ ID NO: 582027 - RNA, 19 nt, Homo sapiens
ucagggagaaugguuugua

SEQ ID NO: 582028 - RNA, 19 nt, Homo sapiens
ugggugcuguuaccugaaa

SEQ ID NO: 582029 - RNA, 19 nt, Homo sapiens
uugaaaggauccugcuugu

SEQ ID NO: 582030 - RNA, 19 nt, Homo sapiens
ucuuugagcucaggaguuc

SEQ ID NO: 582031 - RNA, 19 nt, Homo sapiens
gggaacggacagcaaacaa

SEQ ID NO: 582032 - RNA, 19 nt, Homo sapiens
ccugugugauggagagaga

SEQ ID NO: 582033 - RNA, 19 nt, Homo sapiens
acaauagacacaauacgau

SEQ ID NO: 582034 - RNA, 19 nt, Homo sapiens
ggcagacagcccuuuauag

SEQ ID NO: 582035 - RNA, 19 nt, Homo sapiens
ggauaugagggacuagagu

SEQ ID NO: 582036 - RNA, 19 nt, Homo sapiens
aacaauagacacaauacga

SEQ ID NO: 582037 - RNA, 19 nt, Homo sapiens
guuaaggaaggccugaguu

SEQ ID NO: 582038 - RNA, 19 nt, Homo sapiens
cagcaaacaauagacacaa

SEQ ID NO: 582039 - RNA, 19 nt, Homo sapiens
gagcucaggaguucaagac

SEQ ID NO: 582040 - RNA, 19 nt, Homo sapiens
gcauuaaguaaaucagucu

SEQ ID NO: 582041 - RNA, 19 nt, Homo sapiens
ucaauccugggugcuguua

SEQ ID NO: 582042 - RNA, 19 nt, Homo sapiens
uguaaucccagcucuuugu

SEQ ID NO: 582043 - RNA, 19 nt, Homo sapiens
uugcaaagaccucaaggau

SEQ ID NO: 582044 - RNA, 19 nt, Homo sapiens
aaagaccucaaggauauga

SEQ ID NO: 582045 - RNA, 19 nt, Homo sapiens
gaaaggaucggcgcaauua

SEQ ID NO: 582046 - RNA, 19 nt, Homo sapiens
gcaaggagaccuacaaauu

SEQ ID NO: 582047 - RNA, 19 nt, Homo sapiens
ggaugcagcuuucggauga

SEQ ID NO: 582048 - RNA, 19 nt, Homo sapiens
ggaguguccuuauugcuaa

SEQ ID NO: 582049 - RNA, 19 nt, Homo sapiens
cgaaacaggucaagagaug

SEQ ID NO: 582050 - RNA, 19 nt, Homo sapiens
agaccgagcuuucugcuaa

SEQ ID NO: 582051 - RNA, 19 nt, Homo sapiens
gaacaucucaaacuuacaa

SEQ ID NO: 582052 - RNA, 19 nt, Homo sapiens
gagguacaguguuuauauu

SEQ ID NO: 582053 - RNA, 19 nt, Homo sapiens
aaacagaacuagacucagu

SEQ ID NO: 582054 - RNA, 19 nt, Homo sapiens
caaggagaccuacaaauug

SEQ ID NO: 582055 - RNA, 19 nt, Homo sapiens
gcacuaacaaaccuaauug

SEQ ID NO: 582056 - RNA, 19 nt, Homo sapiens
gauccuuucuguaggcuaa

SEQ ID NO: 582057 - RNA, 19 nt, Homo sapiens
aaagagacgugaccggauu

SEQ ID NO: 582058 - RNA, 19 nt, Homo sapiens
gagauguucugcucagguu

SEQ ID NO: 582059 - RNA, 19 nt, Homo sapiens
cauauggaguguccuuauu

SEQ ID NO: 582060 - RNA, 19 nt, Homo sapiens
gugauggacuucaaggaaa

SEQ ID NO: 582061 - RNA, 19 nt, Homo sapiens
gaaccaaaccaaggucuga

SEQ ID NO: 582062 - RNA, 19 nt, Homo sapiens
ggaagaauaaagagaaugu

SEQ ID NO: 582063 - RNA, 19 nt, Homo sapiens
caagauuguugcauugugu

SEQ ID NO: 582064 - RNA, 19 nt, Homo sapiens
cgucgacucuucugucuug

SEQ ID NO: 582065 - RNA, 19 nt, Homo sapiens
ggacacagacaguggcuau

SEQ ID NO: 582066 - RNA, 19 nt, Homo sapiens
uuaagucguugccuuuauu

SEQ ID NO: 582067 - RNA, 19 nt, Homo sapiens
gggaggugcuucaguaucu

SEQ ID NO: 582068 - RNA, 19 nt, Homo sapiens
gucguugccuuuauuugua

SEQ ID NO: 582069 - RNA, 19 nt, Homo sapiens
uuucuaggccuaaccauua

SEQ ID NO: 582070 - RNA, 19 nt, Homo sapiens
gaucagaagguacuuucaa

SEQ ID NO: 582071 - RNA, 19 nt, Homo sapiens
gagaaaggaucggcgcaau

SEQ ID NO: 582072 - RNA, 19 nt, Homo sapiens
gaugcacuaugccugauug

SEQ ID NO: 582073 - RNA, 19 nt, Homo sapiens
gagcucagacucagaggaa

SEQ ID NO: 582074 - RNA, 19 nt, Homo sapiens
ugugaaugcugcaagauug

SEQ ID NO: 582075 - RNA, 19 nt, Homo sapiens
gcucagguuuccagacaug

SEQ ID NO: 582076 - RNA, 19 nt, Homo sapiens
gcagagugguuuacaagcu

SEQ ID NO: 582077 - RNA, 19 nt, Homo sapiens
aaaccaaggucugagaaau

SEQ ID NO: 582078 - RNA, 19 nt, Homo sapiens
ggagagguacaguguuuau

SEQ ID NO: 582079 - RNA, 19 nt, Homo sapiens
agggagagguacaguguuu

SEQ ID NO: 582080 - RNA, 19 nt, Homo sapiens
ucaaagucuuggucuguga

SEQ ID NO: 582081 - RNA, 19 nt, Homo sapiens
agacccagcucccaaagug

SEQ ID NO: 582082 - RNA, 19 nt, Homo sapiens
guauuaagucguugccuuu

SEQ ID NO: 582083 - RNA, 19 nt, Homo sapiens
cauuguguauacugagaua

SEQ ID NO: 582084 - RNA, 19 nt, Homo sapiens
gaaggccauuucacuagca

SEQ ID NO: 582085 - RNA, 19 nt, Homo sapiens
ucaaacagaacuagacuca

SEQ ID NO: 582086 - RNA, 19 nt, Homo sapiens
gagcugggucuguggcuuu

SEQ ID NO: 582087 - RNA, 19 nt, Homo sapiens
ccgaacaucucaaacuuac

SEQ ID NO: 582088 - RNA, 19 nt, Homo sapiens
gcauauggaguguccuuau

SEQ ID NO: 582089 - RNA, 19 nt, Homo sapiens
gcauagcacgguagugguu

SEQ ID NO: 582090 - RNA, 19 nt, Homo sapiens
auacacaucagcuggauuu

SEQ ID NO: 582091 - RNA, 19 nt, Homo sapiens
gaaagcacuaacaaaccua

SEQ ID NO: 582092 - RNA, 19 nt, Homo sapiens
ccgcagcccucucuagcuu

SEQ ID NO: 582093 - RNA, 19 nt, Homo sapiens
uaagcaagaguccgaagaa

SEQ ID NO: 582094 - RNA, 19 nt, Homo sapiens
cccgggaggugcuucagua

SEQ ID NO: 582095 - RNA, 19 nt, Homo sapiens
gagagguacaguguuuaua

SEQ ID NO: 582096 - RNA, 19 nt, Homo sapiens
gcagucagaccgagcuuuc

SEQ ID NO: 582097 - RNA, 19 nt, Homo sapiens
gcagcccucucuagcuuca

SEQ ID NO: 582098 - RNA, 19 nt, Homo sapiens
ccugauugcugaucguguu

SEQ ID NO: 582099 - RNA, 19 nt, Homo sapiens
gugccugcguguugguaua

SEQ ID NO: 582100 - RNA, 19 nt, Homo sapiens
cuaacaaaccuaauugauc

SEQ ID NO: 582101 - RNA, 19 nt, Homo sapiens
gguagcaggcacuggcaua

SEQ ID NO: 582102 - RNA, 19 nt, Homo sapiens
ugaaagcacuaacaaaccu

SEQ ID NO: 582103 - RNA, 19 nt, Homo sapiens
caaaccaaggucugagaaa

SEQ ID NO: 582104 - RNA, 19 nt, Homo sapiens
ggaguucccugggcuucug

SEQ ID NO: 582105 - RNA, 19 nt, Homo sapiens
cgagcuuucugcuaacaug

SEQ ID NO: 582106 - RNA, 19 nt, Homo sapiens
cacgaaggauugcuugaca

SEQ ID NO: 582107 - RNA, 19 nt, Homo sapiens
gaucggcgcaauuaagcaa

SEQ ID NO: 582108 - RNA, 19 nt, Homo sapiens
agagguacaguguuuauau

SEQ ID NO: 582109 - RNA, 19 nt, Homo sapiens
agggagaaaugucgaaaca

SEQ ID NO: 582110 - RNA, 19 nt, Homo sapiens
auagggaagucacgaagga

SEQ ID NO: 582111 - RNA, 19 nt, Homo sapiens
cuuccucgcuacuuccuaa

SEQ ID NO: 582112 - RNA, 19 nt, Homo sapiens
gcccacauguaccaagugu

SEQ ID NO: 582113 - RNA, 19 nt, Homo sapiens
caucucaaacuuacaacuu

SEQ ID NO: 582114 - RNA, 19 nt, Homo sapiens
gggaagucacgaaggauug

SEQ ID NO: 582115 - RNA, 19 nt, Homo sapiens
ggugagcugucagggagaa

SEQ ID NO: 582116 - RNA, 19 nt, Homo sapiens
gggcuucuggcaccuguuu

SEQ ID NO: 582117 - RNA, 19 nt, Homo sapiens
cagcaaggagaccuacaaa

SEQ ID NO: 582118 - RNA, 19 nt, Homo sapiens
guugguauaggacuuuaaa

SEQ ID NO: 582119 - RNA, 19 nt, Homo sapiens
ccucagugccagugcuaua

SEQ ID NO: 582120 - RNA, 19 nt, Homo sapiens
uaagucguugccuuuauuu

SEQ ID NO: 582121 - RNA, 19 nt, Homo sapiens
ggauuccgucuccuucaaa

SEQ ID NO: 582122 - RNA, 19 nt, Homo sapiens
gaaugcugcaagauuguug

SEQ ID NO: 582123 - RNA, 19 nt, Homo sapiens
ggauccugcugcuuugcuu

SEQ ID NO: 582124 - RNA, 19 nt, Homo sapiens
gcugguaucccaccucagu

SEQ ID NO: 582125 - RNA, 19 nt, Homo sapiens
gaguguccuuauugcuaaa

SEQ ID NO: 582126 - RNA, 19 nt, Homo sapiens
uggaguguccuuauugcua

SEQ ID NO: 582127 - RNA, 19 nt, Homo sapiens
aaggagaccuacaaauugc

SEQ ID NO: 582128 - RNA, 19 nt, Homo sapiens
gguauaggacuuuaaagcu

SEQ ID NO: 582129 - RNA, 19 nt, Homo sapiens
ccaaagacuaaacucucua

SEQ ID NO: 582130 - RNA, 19 nt, Homo sapiens
uccaagcucugaagccaau

SEQ ID NO: 582131 - RNA, 19 nt, Homo sapiens
gauugcugaucguguuuua

SEQ ID NO: 582132 - RNA, 19 nt, Homo sapiens
aucagaagguacuuucaaa

SEQ ID NO: 582133 - RNA, 19 nt, Homo sapiens
caaagacuaaacucucuag

SEQ ID NO: 582134 - RNA, 19 nt, Homo sapiens
agaaaggaucggcgcaauu

SEQ ID NO: 582135 - RNA, 19 nt, Homo sapiens
gggagagguacaguguuua

SEQ ID NO: 582136 - RNA, 19 nt, Homo sapiens
ccaaaccaaggucugagaa

SEQ ID NO: 582137 - RNA, 19 nt, Homo sapiens
uggcuuugaucagaaggua

SEQ ID NO: 582138 - RNA, 19 nt, Homo sapiens
gaaggauugcuugacauca

SEQ ID NO: 582139 - RNA, 19 nt, Homo sapiens
gacgugaccggauuaacga

SEQ ID NO: 582140 - RNA, 19 nt, Homo sapiens
caugugugccugcguguug

SEQ ID NO: 582141 - RNA, 19 nt, Homo sapiens
gauuguugcauuguguaua

SEQ ID NO: 582142 - RNA, 19 nt, Homo sapiens
aggaacaucugcggagaga

SEQ ID NO: 582143 - RNA, 19 nt, Homo sapiens
caacuuugggucacuugga

SEQ ID NO: 582144 - RNA, 19 nt, Homo sapiens
ucguugccuuuauuuguaa

SEQ ID NO: 582145 - RNA, 19 nt, Homo sapiens
gacacaagcuacauuaaua

SEQ ID NO: 582146 - RNA, 19 nt, Homo sapiens
gaacuaaagcaaaugguua

SEQ ID NO: 582147 - RNA, 19 nt, Homo sapiens
uaagaaggcuccauaugaa

SEQ ID NO: 582148 - RNA, 19 nt, Homo sapiens
gaacuuggcagaaagaaga

SEQ ID NO: 582149 - RNA, 19 nt, Homo sapiens
cgaaugaacuuggcagaaa

SEQ ID NO: 582150 - RNA, 19 nt, Homo sapiens
ccacaucaccacuaaauaa

SEQ ID NO: 582151 - RNA, 19 nt, Homo sapiens
ugacgcaacucuuuacauu

SEQ ID NO: 582152 - RNA, 19 nt, Homo sapiens
guuaugagccuuagaguuu

SEQ ID NO: 582153 - RNA, 19 nt, Homo sapiens
cgacccagccgaccaauua

SEQ ID NO: 582154 - RNA, 19 nt, Homo sapiens
ucacagauguuucuugauc

SEQ ID NO: 582155 - RNA, 19 nt, Homo sapiens
gauguuucuugaucaguua

SEQ ID NO: 582156 - RNA, 19 nt, Homo sapiens
guucucaucuacaauguuu

SEQ ID NO: 582157 - RNA, 19 nt, Homo sapiens
gaagagccaucugccaaga

SEQ ID NO: 582158 - RNA, 19 nt, Homo sapiens
cagcagcaguuucagauga

SEQ ID NO: 582159 - RNA, 19 nt, Homo sapiens
caucauaccagacauuauu

SEQ ID NO: 582160 - RNA, 19 nt, Homo sapiens
caagaaaguagaagugauu

SEQ ID NO: 582161 - RNA, 19 nt, Homo sapiens
gcuaaaggcuggcuguagu

SEQ ID NO: 582162 - RNA, 19 nt, Homo sapiens
caucaagcaucuccaguau

SEQ ID NO: 582163 - RNA, 19 nt, Homo sapiens
ccucacagauguuucuuga

SEQ ID NO: 582164 - RNA, 19 nt, Homo sapiens
ccuaaggguuucucuacua

SEQ ID NO: 582165 - RNA, 19 nt, Homo sapiens
acccaugccuuacgacuua

SEQ ID NO: 582166 - RNA, 19 nt, Homo sapiens
caccaccaguccucaaaua

SEQ ID NO: 582167 - RNA, 19 nt, Homo sapiens
guaguuccauggauauuuc

SEQ ID NO: 582168 - RNA, 19 nt, Homo sapiens
uaagacugccugugugaua

SEQ ID NO: 582169 - RNA, 19 nt, Homo sapiens
ccauaugaacaccuuauua

SEQ ID NO: 582170 - RNA, 19 nt, Homo sapiens
gcaaagggaauaaggaauc

SEQ ID NO: 582171 - RNA, 19 nt, Homo sapiens
gaaugaacuuggcagaaag

SEQ ID NO: 582172 - RNA, 19 nt, Homo sapiens
caggagacaaucagcauua

SEQ ID NO: 582173 - RNA, 19 nt, Homo sapiens
ggaucauucuagagcuuua

SEQ ID NO: 582174 - RNA, 19 nt, Homo sapiens
gagcaaagggaauaaggaa

SEQ ID NO: 582175 - RNA, 19 nt, Homo sapiens
gcaacuuugucuccaucua

SEQ ID NO: 582176 - RNA, 19 nt, Homo sapiens
gauaagaaggcuccauaug

SEQ ID NO: 582177 - RNA, 19 nt, Homo sapiens
ggacagugcggaacuaaag

SEQ ID NO: 582178 - RNA, 19 nt, Homo sapiens
ggaaguuucugccucuuac

SEQ ID NO: 582179 - RNA, 19 nt, Homo sapiens
gaaauguacagagaacaaa

SEQ ID NO: 582180 - RNA, 19 nt, Homo sapiens
gugcggaacuaaagcaaau

SEQ ID NO: 582181 - RNA, 19 nt, Homo sapiens
auaagaaggcuccauauga

SEQ ID NO: 582182 - RNA, 19 nt, Homo sapiens
gaauaaggaauccggauca

SEQ ID NO: 582183 - RNA, 19 nt, Homo sapiens
caaaugguuaugagccuua

SEQ ID NO: 582184 - RNA, 19 nt, Homo sapiens
caacaagugcagcaaauca

SEQ ID NO: 582185 - RNA, 19 nt, Homo sapiens
gagacaaucagcauuacaa

SEQ ID NO: 582186 - RNA, 19 nt, Homo sapiens
gggcaccgaugagaucaaa

SEQ ID NO: 582187 - RNA, 19 nt, Homo sapiens
gugugaaagugaauacaaa

SEQ ID NO: 582188 - RNA, 19 nt, Homo sapiens
ggauauuucugggaccaaa

SEQ ID NO: 582189 - RNA, 19 nt, Homo sapiens
gaacuggaacucccacauc

SEQ ID NO: 582190 - RNA, 19 nt, Homo sapiens
ggaacuaaagcaaaugguu

SEQ ID NO: 582191 - RNA, 19 nt, Homo sapiens
uaaagcaaaugguuaugag

SEQ ID NO: 582192 - RNA, 19 nt, Homo sapiens
agacugugaugaaauacaa

SEQ ID NO: 582193 - RNA, 19 nt, Homo sapiens
gaacaccuuauuauugaug

SEQ ID NO: 582194 - RNA, 19 nt, Homo sapiens
gcaacucuuuacauucaga

SEQ ID NO: 582195 - RNA, 19 nt, Homo sapiens
ggauccagacagugaaaua

SEQ ID NO: 582196 - RNA, 19 nt, Homo sapiens
ugauugaccuaaccauaga

SEQ ID NO: 582197 - RNA, 19 nt, Homo sapiens
acgcaacucuuuacauuca

SEQ ID NO: 582198 - RNA, 19 nt, Homo sapiens
cuucagagguuacgagcaa

SEQ ID NO: 582199 - RNA, 19 nt, Homo sapiens
caugacgccugcagacuug

SEQ ID NO: 582200 - RNA, 19 nt, Homo sapiens
ccguauaccuccucacaga

SEQ ID NO: 582201 - RNA, 19 nt, Homo sapiens
ccaccaguccucaaauaaa

SEQ ID NO: 582202 - RNA, 19 nt, Homo sapiens
gugauaagaaggcuccaua

SEQ ID NO: 582203 - RNA, 19 nt, Homo sapiens
aacacgaacuucucacaaa

SEQ ID NO: 582204 - RNA, 19 nt, Homo sapiens
gcacggacgcaaacacgaa

SEQ ID NO: 582205 - RNA, 19 nt, Homo sapiens
ggauuagauuucuuuccuu

SEQ ID NO: 582206 - RNA, 19 nt, Homo sapiens
gcccuuacauguucucauc

SEQ ID NO: 582207 - RNA, 19 nt, Homo sapiens
caauuaauaucaccucacu

SEQ ID NO: 582208 - RNA, 19 nt, Homo sapiens
cuaaggguuucucuacuau

SEQ ID NO: 582209 - RNA, 19 nt, Homo sapiens
ggcaguauaucuuguaaaa

SEQ ID NO: 582210 - RNA, 19 nt, Homo sapiens
ccaccagucuagcaucaga

SEQ ID NO: 582211 - RNA, 19 nt, Homo sapiens
uuuacuggaugaacugaua

SEQ ID NO: 582212 - RNA, 19 nt, Homo sapiens
caucuuacaucagcucuuc

SEQ ID NO: 582213 - RNA, 19 nt, Homo sapiens
ggaaguacaggaaguuucu

SEQ ID NO: 582214 - RNA, 19 nt, Homo sapiens
gaaauccuaaaguacugua

SEQ ID NO: 582215 - RNA, 19 nt, Homo sapiens
cugcagaaauuggaagaaa

SEQ ID NO: 582216 - RNA, 19 nt, Homo sapiens
acacgauuguuguuucuug

SEQ ID NO: 582217 - RNA, 19 nt, Homo sapiens
agacaacagucagcgcuuu

SEQ ID NO: 582218 - RNA, 19 nt, Homo sapiens
aaagaaauguacagagaac

SEQ ID NO: 582219 - RNA, 19 nt, Homo sapiens
gaaguugacugcggaucca

SEQ ID NO: 582220 - RNA, 19 nt, Homo sapiens
cacaguacagguccaguua

SEQ ID NO: 582221 - RNA, 19 nt, Homo sapiens
cacaacaagugcagcaaau

SEQ ID NO: 582222 - RNA, 19 nt, Homo sapiens
cuggaacucccacaucuua

SEQ ID NO: 582223 - RNA, 19 nt, Homo sapiens
gaucaagaccuccuacacu

SEQ ID NO: 582224 - RNA, 19 nt, Homo sapiens
guacagagaacaaaacuau

SEQ ID NO: 582225 - RNA, 19 nt, Homo sapiens
aaacaagcacggacgcaaa

SEQ ID NO: 582226 - RNA, 19 nt, Homo sapiens
ucaagcaucuccaguaucc

SEQ ID NO: 582227 - RNA, 19 nt, Homo sapiens
gaccuguccuucccuaucu

SEQ ID NO: 582228 - RNA, 19 nt, Homo sapiens
ucucuacuauguccacuug

SEQ ID NO: 582229 - RNA, 19 nt, Homo sapiens
ccucaacaguucuucuuca

SEQ ID NO: 582230 - RNA, 19 nt, Homo sapiens
acuauuccauggcaguaua

SEQ ID NO: 582231 - RNA, 19 nt, Homo sapiens
caagugcagcaaaucagua

SEQ ID NO: 582232 - RNA, 19 nt, Homo sapiens
agaacuuugugcucuguuu

SEQ ID NO: 582233 - RNA, 19 nt, Homo sapiens
cgacuuacaaggauuagau

SEQ ID NO: 582234 - RNA, 19 nt, Homo sapiens
ccauagacaguucaucuga

SEQ ID NO: 582235 - RNA, 19 nt, Homo sapiens
aaacaagaaaguagaagug

SEQ ID NO: 582236 - RNA, 19 nt, Homo sapiens
guacagguccaguuaaggu

SEQ ID NO: 582237 - RNA, 19 nt, Homo sapiens
ugacacccaugccuuacga

SEQ ID NO: 582238 - RNA, 19 nt, Homo sapiens
gaaaguagaagugauugac

SEQ ID NO: 582239 - RNA, 19 nt, Homo sapiens
gauggcuuguuuauggaaa

SEQ ID NO: 582240 - RNA, 19 nt, Homo sapiens
gcagaaauuggaagaaacu

SEQ ID NO: 582241 - RNA, 19 nt, Homo sapiens
ccacaacaagugcagcaaa

SEQ ID NO: 582242 - RNA, 19 nt, Homo sapiens
aagacugccugugugauaa

SEQ ID NO: 582243 - RNA, 19 nt, Homo sapiens
ggcaucauaccagacauua

SEQ ID NO: 582244 - RNA, 19 nt, Homo sapiens
ggaagcaguaguggcagua

SEQ ID NO: 582245 - RNA, 19 nt, Homo sapiens
ggagagacauccuauauuc

SEQ ID NO: 582246 - RNA, 19 nt, Homo sapiens
aaacagcaaucccaaauaa

SEQ ID NO: 582247 - RNA, 19 nt, Homo sapiens
gaccagagcugaaggaaga

SEQ ID NO: 582248 - RNA, 19 nt, Homo sapiens
caucuucacuugacuauuu

SEQ ID NO: 582249 - RNA, 19 nt, Homo sapiens
gauaauaccagaccgauuu

SEQ ID NO: 582250 - RNA, 19 nt, Homo sapiens
gaugcuacaugguuauaua

SEQ ID NO: 582251 - RNA, 19 nt, Homo sapiens
gaauugaugugcugcuaaa

SEQ ID NO: 582252 - RNA, 19 nt, Homo sapiens
caguauggcuuccuuaauu

SEQ ID NO: 582253 - RNA, 19 nt, Homo sapiens
caacagaaauuagcacaau

SEQ ID NO: 582254 - RNA, 19 nt, Homo sapiens
cagcauagauaaugaacuu

SEQ ID NO: 582255 - RNA, 19 nt, Homo sapiens
gaaacagcaaucccaaaua

SEQ ID NO: 582256 - RNA, 19 nt, Homo sapiens
guacagugaugaugacgaa

SEQ ID NO: 582257 - RNA, 19 nt, Homo sapiens
gaaucaagaucagcaagaa

SEQ ID NO: 582258 - RNA, 19 nt, Homo sapiens
gucaaagaauuccuagaua

SEQ ID NO: 582259 - RNA, 19 nt, Homo sapiens
gcaaugguuuacagauauu

SEQ ID NO: 582260 - RNA, 19 nt, Homo sapiens
ugaaauaccacuacucuga

SEQ ID NO: 582261 - RNA, 19 nt, Homo sapiens
uaaagaaggcaaugcagua

SEQ ID NO: 582262 - RNA, 19 nt, Homo sapiens
ccuaagaaguugaucaaug

SEQ ID NO: 582263 - RNA, 19 nt, Homo sapiens
ggaucucacuguugccuuu

SEQ ID NO: 582264 - RNA, 19 nt, Homo sapiens
gcuacaucaugaagcauua

SEQ ID NO: 582265 - RNA, 19 nt, Homo sapiens
gaccaaagagugcaucaaa

SEQ ID NO: 582266 - RNA, 19 nt, Homo sapiens
ggaaacagcaaucccaaau

SEQ ID NO: 582267 - RNA, 19 nt, Homo sapiens
gauacuauuuggcuuaauc

SEQ ID NO: 582268 - RNA, 19 nt, Homo sapiens
ggcaaugguuuacagauau

SEQ ID NO: 582269 - RNA, 19 nt, Homo sapiens
cgaaaucaauggagugaca

SEQ ID NO: 582270 - RNA, 19 nt, Homo sapiens
guugcaagaucaauaagaa

SEQ ID NO: 582271 - RNA, 19 nt, Homo sapiens
uggcaaugguuuacagaua

SEQ ID NO: 582272 - RNA, 19 nt, Homo sapiens
gguacuuucuguaauuuga

SEQ ID NO: 582273 - RNA, 19 nt, Homo sapiens
cuaagaaguugaucaaugg

SEQ ID NO: 582274 - RNA, 19 nt, Homo sapiens
caaauaaugucggcuuaca

SEQ ID NO: 582275 - RNA, 19 nt, Homo sapiens
ggaagaaacacacuauugg

SEQ ID NO: 582276 - RNA, 19 nt, Homo sapiens
uuacacuucuugacuguuu

SEQ ID NO: 582277 - RNA, 19 nt, Homo sapiens
gacacaaggugauagacuu

SEQ ID NO: 582278 - RNA, 19 nt, Homo sapiens
ccaaagagugcaucaaaug

SEQ ID NO: 582279 - RNA, 19 nt, Homo sapiens
uuagaguccuucccuguaa

SEQ ID NO: 582280 - RNA, 19 nt, Homo sapiens
gcaagagaauauuaauggu

SEQ ID NO: 582281 - RNA, 19 nt, Homo sapiens
guuggaugcuacaugguua

SEQ ID NO: 582282 - RNA, 19 nt, Homo sapiens
gcauagauaaugaacuuga

SEQ ID NO: 582283 - RNA, 19 nt, Homo sapiens
guacauuauuucagcauag

SEQ ID NO: 582284 - RNA, 19 nt, Homo sapiens
ggaagacucuaggacugaa

SEQ ID NO: 582285 - RNA, 19 nt, Homo sapiens
guccuucccuguaacauug

SEQ ID NO: 582286 - RNA, 19 nt, Homo sapiens
cauauuuccuuccaugaau

SEQ ID NO: 582287 - RNA, 19 nt, Homo sapiens
guuguaauguuaacucugu

SEQ ID NO: 582288 - RNA, 19 nt, Homo sapiens
aaagagugcaucaaaugua

SEQ ID NO: 582289 - RNA, 19 nt, Homo sapiens
gaaauaccacuacucugau

SEQ ID NO: 582290 - RNA, 19 nt, Homo sapiens
gaagaaacacacuauuggu

SEQ ID NO: 582291 - RNA, 19 nt, Homo sapiens
gaauugaggaucugaugga

SEQ ID NO: 582292 - RNA, 19 nt, Homo sapiens
guugaugacauuuccauaa

SEQ ID NO: 582293 - RNA, 19 nt, Homo sapiens
gaacuucuacgcagauuuu

SEQ ID NO: 582294 - RNA, 19 nt, Homo sapiens
caaaaggcauuacugaaau

SEQ ID NO: 582295 - RNA, 19 nt, Homo sapiens
cuaaaacagucuugcguua

SEQ ID NO: 582296 - RNA, 19 nt, Homo sapiens
ggagugacacaaggugaua

SEQ ID NO: 582297 - RNA, 19 nt, Homo sapiens
caaagaauuccuagauauc

SEQ ID NO: 582298 - RNA, 19 nt, Homo sapiens
uuucagagaugcugccuau

SEQ ID NO: 582299 - RNA, 19 nt, Homo sapiens
ccacuacucugaucguuuu

SEQ ID NO: 582300 - RNA, 19 nt, Homo sapiens
gaagauguugcaagucguu

SEQ ID NO: 582301 - RNA, 19 nt, Homo sapiens
guuggaagauguugcaagu

SEQ ID NO: 582302 - RNA, 19 nt, Homo sapiens
ucaccgaucgccuuuguuu

SEQ ID NO: 582303 - RNA, 19 nt, Homo sapiens
caucaccgaucgccuuugu

SEQ ID NO: 582304 - RNA, 19 nt, Homo sapiens
cccaaauaaugucggcuua

SEQ ID NO: 582305 - RNA, 19 nt, Homo sapiens
cagagcagccuucuccaaa

SEQ ID NO: 582306 - RNA, 19 nt, Homo sapiens
gaacuugaauaugagaacu

SEQ ID NO: 582307 - RNA, 19 nt, Homo sapiens
cagagaugcugccuaugga

SEQ ID NO: 582308 - RNA, 19 nt, Homo sapiens
cagaauugaugugcugcua

SEQ ID NO: 582309 - RNA, 19 nt, Homo sapiens
ccaugaagcaguuacagaa

SEQ ID NO: 582310 - RNA, 19 nt, Homo sapiens
caaagagugcaucaaaugu

SEQ ID NO: 582311 - RNA, 19 nt, Homo sapiens
aaugguagcuuuagaagac

SEQ ID NO: 582312 - RNA, 19 nt, Homo sapiens
gcuuaaucaucuucacuug

SEQ ID NO: 582313 - RNA, 19 nt, Homo sapiens
cuauuuggcuuaaucaucu

SEQ ID NO: 582314 - RNA, 19 nt, Homo sapiens
uaaauggggucgagaauca

SEQ ID NO: 582315 - RNA, 19 nt, Homo sapiens
gagcagccuucuccaaacu

SEQ ID NO: 582316 - RNA, 19 nt, Homo sapiens
aguauggcuuccuuaauuu

SEQ ID NO: 582317 - RNA, 19 nt, Homo sapiens
ugaagcaguuacagaaaca

SEQ ID NO: 582318 - RNA, 19 nt, Homo sapiens
gaauggaagaaacacacua

SEQ ID NO: 582319 - RNA, 19 nt, Homo sapiens
ucagaagaauugaggaucu

SEQ ID NO: 582320 - RNA, 19 nt, Homo sapiens
ccacuggaguuugaauaau

SEQ ID NO: 582321 - RNA, 19 nt, Homo sapiens
caacucauuuaaccuugau

SEQ ID NO: 582322 - RNA, 19 nt, Homo sapiens
cuauggaaguugcaauuuc

SEQ ID NO: 582323 - RNA, 19 nt, Homo sapiens
ccagaagaagcauauagaa

SEQ ID NO: 582324 - RNA, 19 nt, Homo sapiens
aauaaugucggcuuacaaa

SEQ ID NO: 582325 - RNA, 19 nt, Homo sapiens
gggaggcugcccauuguuu

SEQ ID NO: 582326 - RNA, 19 nt, Homo sapiens
caagcugaaugacaaacau

SEQ ID NO: 582327 - RNA, 19 nt, Homo sapiens
ggagaauggacaacacaga

SEQ ID NO: 582328 - RNA, 19 nt, Homo sapiens
gaaguugcaauuucuacau

SEQ ID NO: 582329 - RNA, 19 nt, Homo sapiens
gacccugugucaaaauuua

SEQ ID NO: 582330 - RNA, 19 nt, Homo sapiens
cacuggaguuugaauaaug

SEQ ID NO: 582331 - RNA, 19 nt, Homo sapiens
gaaguugaucaauggagaa

SEQ ID NO: 582332 - RNA, 19 nt, Homo sapiens
agaccuggcucggugauug

SEQ ID NO: 582333 - RNA, 19 nt, Homo sapiens
agaaggcaaugcaguaugg

SEQ ID NO: 582334 - RNA, 19 nt, Homo sapiens
cagaagaagcauauagaau

SEQ ID NO: 582335 - RNA, 19 nt, Homo sapiens
ucacuguugccuuugguua

SEQ ID NO: 582336 - RNA, 19 nt, Homo sapiens
acagcaaucccaaauaaug

SEQ ID NO: 582337 - RNA, 19 nt, Homo sapiens
uggaagaaacacacuauug

SEQ ID NO: 582338 - RNA, 19 nt, Homo sapiens
cugcuugucuuccaccaaa

SEQ ID NO: 582339 - RNA, 19 nt, Homo sapiens
caaaauugcaaaagccuua

SEQ ID NO: 582340 - RNA, 19 nt, Homo sapiens
gcagccuucuccaaacuuc

SEQ ID NO: 582341 - RNA, 19 nt, Homo sapiens
gcaguauggcuuccuuaau

SEQ ID NO: 582342 - RNA, 19 nt, Homo sapiens
uauauuccuuucagagaug

SEQ ID NO: 582343 - RNA, 19 nt, Homo sapiens
gagacauccuauauuccuu

SEQ ID NO: 582344 - RNA, 19 nt, Homo sapiens
gcaguuacagaaacagaau

SEQ ID NO: 582345 - RNA, 19 nt, Homo sapiens
gaagaggcauuccuuguaa

SEQ ID NO: 582346 - RNA, 19 nt, Homo sapiens
ggagagacauccuauauuc

SEQ ID NO: 582347 - RNA, 19 nt, Homo sapiens
aaacagcaaucccaaauaa

SEQ ID NO: 582348 - RNA, 19 nt, Homo sapiens
gaccagagcugaaggaaga

SEQ ID NO: 582349 - RNA, 19 nt, Homo sapiens
gcagacuacucuucaauaa

SEQ ID NO: 582350 - RNA, 19 nt, Homo sapiens
caucuucacuugacuauuu

SEQ ID NO: 582351 - RNA, 19 nt, Homo sapiens
ggaaacaaaugcccuccua

SEQ ID NO: 582352 - RNA, 19 nt, Homo sapiens
gaacacaacuaguaacucu

SEQ ID NO: 582353 - RNA, 19 nt, Homo sapiens
gauaauaccagaccgauuu

SEQ ID NO: 582354 - RNA, 19 nt, Homo sapiens
gaugcuacaugguuauaua

SEQ ID NO: 582355 - RNA, 19 nt, Homo sapiens
gaauugaugugcugccaaa

SEQ ID NO: 582356 - RNA, 19 nt, Homo sapiens
caguauggcuuccuuaauu

SEQ ID NO: 582357 - RNA, 19 nt, Homo sapiens
caacagaaauuagcacaau

SEQ ID NO: 582358 - RNA, 19 nt, Homo sapiens
uagaagaccuuguugcuau

SEQ ID NO: 582359 - RNA, 19 nt, Homo sapiens
cagcauagauaaugaacuu

SEQ ID NO: 582360 - RNA, 19 nt, Homo sapiens
gaaacagcaaucccaaaua

SEQ ID NO: 582361 - RNA, 19 nt, Homo sapiens
uuaaauagcccugaaagua

SEQ ID NO: 582362 - RNA, 19 nt, Homo sapiens
guacagugaugaugacgaa

SEQ ID NO: 582363 - RNA, 19 nt, Homo sapiens
gaaucaagaucagcaagaa

SEQ ID NO: 582364 - RNA, 19 nt, Homo sapiens
ggaaaugaauaggcacaaa

SEQ ID NO: 582365 - RNA, 19 nt, Homo sapiens
gucaaagaauuccuagaua

SEQ ID NO: 582366 - RNA, 19 nt, Homo sapiens
gcaaugguuuacagauauu

SEQ ID NO: 582367 - RNA, 19 nt, Homo sapiens
gaacauuccuuuugcuauu

SEQ ID NO: 582368 - RNA, 19 nt, Homo sapiens
uaaagaaggcaaugcagua

SEQ ID NO: 582369 - RNA, 19 nt, Homo sapiens
uaaacugccucuucauguu

SEQ ID NO: 582370 - RNA, 19 nt, Homo sapiens
gaaugagccuccugguguu

SEQ ID NO: 582371 - RNA, 19 nt, Homo sapiens
gagcugagacaauauaaau

SEQ ID NO: 582372 - RNA, 19 nt, Homo sapiens
ccuaagaaguugaucaaug

SEQ ID NO: 582373 - RNA, 19 nt, Homo sapiens
gaaaagcaguguuaaaagu

SEQ ID NO: 582374 - RNA, 19 nt, Homo sapiens
caacugaaaccacaaacaa

SEQ ID NO: 582375 - RNA, 19 nt, Homo sapiens
ucugaucccuucuuaguuu

SEQ ID NO: 582376 - RNA, 19 nt, Homo sapiens
gaagugggugguuuaauga

SEQ ID NO: 582377 - RNA, 19 nt, Homo sapiens
agaagugggugguuuaaug

SEQ ID NO: 582378 - RNA, 19 nt, Homo sapiens
ggaucucacuguugccuuu

SEQ ID NO: 582379 - RNA, 19 nt, Homo sapiens
gcuacaucaugaagcauua

SEQ ID NO: 582380 - RNA, 19 nt, Homo sapiens
gaccaaagagugcaucaaa

SEQ ID NO: 582381 - RNA, 19 nt, Homo sapiens
cauaagaagugggugguuu

SEQ ID NO: 582382 - RNA, 19 nt, Homo sapiens
ggaaacagcaaucccaaau

SEQ ID NO: 582383 - RNA, 19 nt, Homo sapiens
gauacuauuuggcuuaauc

SEQ ID NO: 582384 - RNA, 19 nt, Homo sapiens
ggcaaugguuuacagauau

SEQ ID NO: 582385 - RNA, 19 nt, Homo sapiens
guaauaaccaaaugacuug

SEQ ID NO: 582386 - RNA, 19 nt, Homo sapiens
cgaaaucaauggagugaca

SEQ ID NO: 582387 - RNA, 19 nt, Homo sapiens
guugcaagaucaauaagaa

SEQ ID NO: 582388 - RNA, 19 nt, Homo sapiens
uggcaaugguuuacagaua

SEQ ID NO: 582389 - RNA, 19 nt, Homo sapiens
gguacuuucuguaauuuga

SEQ ID NO: 582390 - RNA, 19 nt, Homo sapiens
cuaagaaguugaucaaugg

SEQ ID NO: 582391 - RNA, 19 nt, Homo sapiens
cuucuggaauucugacuua

SEQ ID NO: 582392 - RNA, 19 nt, Homo sapiens
caaauaaugucggcuuaca

SEQ ID NO: 582393 - RNA, 19 nt, Homo sapiens
ggaagaaacacacuauugg

SEQ ID NO: 582394 - RNA, 19 nt, Homo sapiens
uuacacuucuugacuguuu

SEQ ID NO: 582395 - RNA, 19 nt, Homo sapiens
gguuugcgauggaauuaaa

SEQ ID NO: 582396 - RNA, 19 nt, Homo sapiens
ccaaagagugcaucaaaug

SEQ ID NO: 582397 - RNA, 19 nt, Homo sapiens
gacacaaggugauagacuu

SEQ ID NO: 582398 - RNA, 19 nt, Homo sapiens
uagagucguuguuauagaa

SEQ ID NO: 582399 - RNA, 19 nt, Homo sapiens
cauguugccugcucaaguu

SEQ ID NO: 582400 - RNA, 19 nt, Homo sapiens
gaaaguucuuccugcuaug

SEQ ID NO: 582401 - RNA, 19 nt, Homo sapiens
ugaagaggcauuccuugua

SEQ ID NO: 582402 - RNA, 19 nt, Homo sapiens
gaaacaaaugcccuccuaa

SEQ ID NO: 582403 - RNA, 19 nt, Homo sapiens
uuagaguccuucccuguaa

SEQ ID NO: 582404 - RNA, 19 nt, Homo sapiens
gcauagauaaugaacuuga

SEQ ID NO: 582405 - RNA, 19 nt, Homo sapiens
guacauuauuucagcauag

SEQ ID NO: 582406 - RNA, 19 nt, Homo sapiens
ucacaaaacuggaagaaau

SEQ ID NO: 582407 - RNA, 19 nt, Homo sapiens
gcaagagaauauuaauggu

SEQ ID NO: 582408 - RNA, 19 nt, Homo sapiens
caucugaaccuaacauuuc

SEQ ID NO: 582409 - RNA, 19 nt, Homo sapiens
guuggaugcuacaugguua

SEQ ID NO: 582410 - RNA, 19 nt, Homo sapiens
uaggugcucuugaagcuuu

SEQ ID NO: 582411 - RNA, 19 nt, Homo sapiens
caaacugugccaugcauaa

SEQ ID NO: 582412 - RNA, 19 nt, Homo sapiens
guaggcaacuccauuuuaa

SEQ ID NO: 582413 - RNA, 19 nt, Homo sapiens
ggaagacucuaggacugaa

SEQ ID NO: 582414 - RNA, 19 nt, Homo sapiens
ucacugaaauuagucauag

SEQ ID NO: 582415 - RNA, 19 nt, Homo sapiens
guacucaccucaguuccuu

SEQ ID NO: 582416 - RNA, 19 nt, Homo sapiens
guccuucccuguaacauug

SEQ ID NO: 582417 - RNA, 19 nt, Homo sapiens
cauauuuccuuccaugaau

SEQ ID NO: 582418 - RNA, 19 nt, Homo sapiens
guuguaauguuaacucugu

SEQ ID NO: 582419 - RNA, 19 nt, Homo sapiens
gcagugcaggcauuacuaa

SEQ ID NO: 582420 - RNA, 19 nt, Homo sapiens
aaagagugcaucaaaugua

SEQ ID NO: 582421 - RNA, 19 nt, Homo sapiens
gaagaaacacacuauuggu

SEQ ID NO: 582422 - RNA, 19 nt, Homo sapiens
gaauugaggaucugaugga

SEQ ID NO: 582423 - RNA, 19 nt, Homo sapiens
gaacuucuacgcagauuuu

SEQ ID NO: 582424 - RNA, 19 nt, Homo sapiens
ucuaucugaucccuucuua

SEQ ID NO: 582425 - RNA, 19 nt, Homo sapiens
gaaaugaauaggcacaaag

SEQ ID NO: 582426 - RNA, 19 nt, Homo sapiens
cagaucugcuucaaggaaa

SEQ ID NO: 582427 - RNA, 19 nt, Homo sapiens
guugaugacauuuccauaa

SEQ ID NO: 582428 - RNA, 19 nt, Homo sapiens
caccucaguuccuuccaua

SEQ ID NO: 582429 - RNA, 19 nt, Homo sapiens
caaaaggcauuacugaaau

SEQ ID NO: 582430 - RNA, 19 nt, Homo sapiens
cuaaaacagucuugcguua

SEQ ID NO: 582431 - RNA, 19 nt, Homo sapiens
ucacaguaauucuucaauc

SEQ ID NO: 582432 - RNA, 19 nt, Homo sapiens
ggagugacacaaggugaua

SEQ ID NO: 582433 - RNA, 19 nt, Homo sapiens
caaagaauuccuagauauc

SEQ ID NO: 582434 - RNA, 19 nt, Homo sapiens
uuucagagaugcugccuau

SEQ ID NO: 582435 - RNA, 19 nt, Homo sapiens
ucaccgaucgccuuuguuu

SEQ ID NO: 582436 - RNA, 19 nt, Homo sapiens
gcucaaguuuccaccuaga

SEQ ID NO: 582437 - RNA, 19 nt, Homo sapiens
uuagggaacacaacuagua

SEQ ID NO: 582438 - RNA, 19 nt, Homo sapiens
caucaccgaucgccuuugu

SEQ ID NO: 582439 - RNA, 19 nt, Homo sapiens
gaagauguugcaagucguu

SEQ ID NO: 582440 - RNA, 19 nt, Homo sapiens
guuggaagauguugcaagu

SEQ ID NO: 582441 - RNA, 19 nt, Homo sapiens
uaaauagcccugaaaguac

SEQ ID NO: 582442 - RNA, 19 nt, Homo sapiens
aaaucgugcuucuaucuga

SEQ ID NO: 582443 - RNA, 19 nt, Homo sapiens
gcauaaagcauugaauucu

SEQ ID NO: 582444 - RNA, 19 nt, Homo sapiens
uaaaagcgguuggaauaaa

SEQ ID NO: 582445 - RNA, 19 nt, Homo sapiens
gaaauggucugaagucuga

SEQ ID NO: 582446 - RNA, 19 nt, Homo sapiens
ggagagacauccuauauuc

SEQ ID NO: 582447 - RNA, 19 nt, Homo sapiens
ggagagaagauaacauuua

SEQ ID NO: 582448 - RNA, 19 nt, Homo sapiens
gauaauaccagaccgauuu

SEQ ID NO: 582449 - RNA, 19 nt, Homo sapiens
gaugcuacaugguuauaua

SEQ ID NO: 582450 - RNA, 19 nt, Homo sapiens
caguauggcuuccuuaauu

SEQ ID NO: 582451 - RNA, 19 nt, Homo sapiens
caaagccacugacucauga

SEQ ID NO: 582452 - RNA, 19 nt, Homo sapiens
cagaaagggugcaaacaaa

SEQ ID NO: 582453 - RNA, 19 nt, Homo sapiens
gagcgaauaccaaccuuua

SEQ ID NO: 582454 - RNA, 19 nt, Homo sapiens
acacagcccugauguugua

SEQ ID NO: 582455 - RNA, 19 nt, Homo sapiens
gcagucaacuccugauuca

SEQ ID NO: 582456 - RNA, 19 nt, Homo sapiens
aagcaaacauagcccauua

SEQ ID NO: 582457 - RNA, 19 nt, Homo sapiens
cagcauagauaaugaacuu

SEQ ID NO: 582458 - RNA, 19 nt, Homo sapiens
gcacuuggguuccaguuca

SEQ ID NO: 582459 - RNA, 19 nt, Homo sapiens
guacagugaugaugacgaa

SEQ ID NO: 582460 - RNA, 19 nt, Homo sapiens
gaaucaagaucagcaagaa

SEQ ID NO: 582461 - RNA, 19 nt, Homo sapiens
gagagaagauaacauuuac

SEQ ID NO: 582462 - RNA, 19 nt, Homo sapiens
caugaucccuuuccauuug

SEQ ID NO: 582463 - RNA, 19 nt, Homo sapiens
uaacugacccuaacgugua

SEQ ID NO: 582464 - RNA, 19 nt, Homo sapiens
gucaaagaauuccuagaua

SEQ ID NO: 582465 - RNA, 19 nt, Homo sapiens
gcaaugguuuacagauauu

SEQ ID NO: 582466 - RNA, 19 nt, Homo sapiens
uaaagaaggcaaugcagua

SEQ ID NO: 582467 - RNA, 19 nt, Homo sapiens
cugaguagcugggauuaua

SEQ ID NO: 582468 - RNA, 19 nt, Homo sapiens
ggaggagucuauacuaucu

SEQ ID NO: 582469 - RNA, 19 nt, Homo sapiens
gcuacaucaugaagcauua

SEQ ID NO: 582470 - RNA, 19 nt, Homo sapiens
gaccaaagagugcaucaaa

SEQ ID NO: 582471 - RNA, 19 nt, Homo sapiens
ggcaaugguuuacagauau

SEQ ID NO: 582472 - RNA, 19 nt, Homo sapiens
uuaaucugcuugagucuaa

SEQ ID NO: 582473 - RNA, 19 nt, Homo sapiens
cgaaaucaauggagugaca

SEQ ID NO: 582474 - RNA, 19 nt, Homo sapiens
guugcaagaucaauaagaa

SEQ ID NO: 582475 - RNA, 19 nt, Homo sapiens
uggcaaugguuuacagaua

SEQ ID NO: 582476 - RNA, 19 nt, Homo sapiens
guacgcagcugccgaacuc

SEQ ID NO: 582477 - RNA, 19 nt, Homo sapiens
uuacacuucuugacuguuu

SEQ ID NO: 582478 - RNA, 19 nt, Homo sapiens
gcggaggagucuauacuau

SEQ ID NO: 582479 - RNA, 19 nt, Homo sapiens
gacacaaggugauagacuu

SEQ ID NO: 582480 - RNA, 19 nt, Homo sapiens
ccaaagagugcaucaaaug

SEQ ID NO: 582481 - RNA, 19 nt, Homo sapiens
gcacagauccugggaccaa

SEQ ID NO: 582482 - RNA, 19 nt, Homo sapiens
ugauaaaccuuaguacuca

SEQ ID NO: 582483 - RNA, 19 nt, Homo sapiens
ucacaacacuaaaggaaag

SEQ ID NO: 582484 - RNA, 19 nt, Homo sapiens
gcaccgcacaguacaguuu

SEQ ID NO: 582485 - RNA, 19 nt, Homo sapiens
acacagaaaccacgaggua

SEQ ID NO: 582486 - RNA, 19 nt, Homo sapiens
cauaugaacugugugacaa

SEQ ID NO: 582487 - RNA, 19 nt, Homo sapiens
guuggaugcuacaugguua

SEQ ID NO: 582488 - RNA, 19 nt, Homo sapiens
gcauagauaaugaacuuga

SEQ ID NO: 582489 - RNA, 19 nt, Homo sapiens
guacauuauuucagcauag

SEQ ID NO: 582490 - RNA, 19 nt, Homo sapiens
aacaguaagugcaauugua

SEQ ID NO: 582491 - RNA, 19 nt, Homo sapiens
gagcauaugaacuguguga

SEQ ID NO: 582492 - RNA, 19 nt, Homo sapiens
gcugugggcuuuucaagua

SEQ ID NO: 582493 - RNA, 19 nt, Homo sapiens
ggaccaagguucagauucc

SEQ ID NO: 582494 - RNA, 19 nt, Homo sapiens
ccauuugauuggcagguua

SEQ ID NO: 582495 - RNA, 19 nt, Homo sapiens
gcgagcauaugaacugugu

SEQ ID NO: 582496 - RNA, 19 nt, Homo sapiens
aagcaaacauccuuaacug

SEQ ID NO: 582497 - RNA, 19 nt, Homo sapiens
ggucugacaugcagcuuag

SEQ ID NO: 582498 - RNA, 19 nt, Homo sapiens
ggcauggacuugcugauca

SEQ ID NO: 582499 - RNA, 19 nt, Homo sapiens
aaagagugcaucaaaugua

SEQ ID NO: 582500 - RNA, 19 nt, Homo sapiens
caggagagaagauaacauu

SEQ ID NO: 582501 - RNA, 19 nt, Homo sapiens
ccaaagcaaacauccuuaa

SEQ ID NO: 582502 - RNA, 19 nt, Homo sapiens
gaagaaaacacucaguuga

SEQ ID NO: 582503 - RNA, 19 nt, Homo sapiens
ccaaagugcugggauuaca

SEQ ID NO: 582504 - RNA, 19 nt, Homo sapiens
ugugacugcuuuccauuaa

SEQ ID NO: 582505 - RNA, 19 nt, Homo sapiens
ugacacagcccugauguug

SEQ ID NO: 582506 - RNA, 19 nt, Homo sapiens
ccagaaagggugcaaacaa

SEQ ID NO: 582507 - RNA, 19 nt, Homo sapiens
agacaggguuucaccaugu

SEQ ID NO: 582508 - RNA, 19 nt, Homo sapiens
guugaugacauuuccauaa

SEQ ID NO: 582509 - RNA, 19 nt, Homo sapiens
gaacuucuacgcagauuuu

SEQ ID NO: 582510 - RNA, 19 nt, Homo sapiens
guguauggauucaacuuug

SEQ ID NO: 582511 - RNA, 19 nt, Homo sapiens
gcauggacuugcugaucaa

SEQ ID NO: 582512 - RNA, 19 nt, Homo sapiens
ggagugacacaaggugaua

SEQ ID NO: 582513 - RNA, 19 nt, Homo sapiens
caaagaauuccuagauauc

SEQ ID NO: 582514 - RNA, 19 nt, Homo sapiens
uuucagagaugcugccuau

SEQ ID NO: 582515 - RNA, 19 nt, Homo sapiens
ucaccgaucgccuuuguuu

SEQ ID NO: 582516 - RNA, 19 nt, Homo sapiens
uaacguguauggauucaac

SEQ ID NO: 582517 - RNA, 19 nt, Homo sapiens
gcaaacauagcccauuaca

SEQ ID NO: 582518 - RNA, 19 nt, Homo sapiens
ccggcuaauuucuguauuu

SEQ ID NO: 582519 - RNA, 19 nt, Homo sapiens
agaaggaaauggucugaag

SEQ ID NO: 582520 - RNA, 19 nt, Homo sapiens
caucaccgaucgccuuugu

SEQ ID NO: 582521 - RNA, 19 nt, Homo sapiens
aaacacagucaccauuaaa

SEQ ID NO: 582522 - RNA, 19 nt, Homo sapiens
guaaacaguaagugcaauu

SEQ ID NO: 582523 - RNA, 19 nt, Homo sapiens
gccaugaucccuuuccauu

SEQ ID NO: 582524 - RNA, 19 nt, Homo sapiens
ccuuaguacucagauaaua

SEQ ID NO: 582525 - RNA, 19 nt, Homo sapiens
aaaccuuaguacucagaua

SEQ ID NO: 582526 - RNA, 19 nt, Homo sapiens
gaacuugaauaugagaacu

SEQ ID NO: 582527 - RNA, 19 nt, Homo sapiens
cagagcagccuucuccaaa

SEQ ID NO: 582528 - RNA, 19 nt, Homo sapiens
cagagaugcugccuaugga

SEQ ID NO: 582529 - RNA, 19 nt, Homo sapiens
ugacugcuuuccauuaaca

SEQ ID NO: 582530 - RNA, 19 nt, Homo sapiens
uugauuggcagguuaaaua

SEQ ID NO: 582531 - RNA, 19 nt, Homo sapiens
caaagagugcaucaaaugu

SEQ ID NO: 582532 - RNA, 19 nt, Homo sapiens
agaaaacacucaguugaua

SEQ ID NO: 582533 - RNA, 19 nt, Homo sapiens
gaaaucagggcacuugcau

SEQ ID NO: 582534 - RNA, 19 nt, Homo sapiens
caacacuaaaggaaaguuu

SEQ ID NO: 582535 - RNA, 19 nt, Homo sapiens
uaaauggggucgagaauca

SEQ ID NO: 582536 - RNA, 19 nt, Homo sapiens
gagcagccuucuccaaacu

SEQ ID NO: 582537 - RNA, 19 nt, Homo sapiens
aguauggcuuccuuaauuu

SEQ ID NO: 582538 - RNA, 19 nt, Homo sapiens
guucaaagcauccaacucu

SEQ ID NO: 582539 - RNA, 19 nt, Homo sapiens
caccuugcguggaaugaaa

SEQ ID NO: 582540 - RNA, 19 nt, Homo sapiens
gucccaggcugucaccuuu

SEQ ID NO: 582541 - RNA, 19 nt, Homo sapiens
caacucauuuaaccuugau

SEQ ID NO: 582542 - RNA, 19 nt, Homo sapiens
caaaagcaauaaagaggaa

SEQ ID NO: 582543 - RNA, 19 nt, Homo sapiens
gaaaacacucaguugauaa

SEQ ID NO: 582544 - RNA, 19 nt, Homo sapiens
ggaauggcauggacuugcu

SEQ ID NO: 582545 - RNA, 19 nt, Homo sapiens
gaauaucucugccuucuua

SEQ ID NO: 582546 - RNA, 19 nt, Homo sapiens
ggacauugauagccuguua

SEQ ID NO: 582547 - RNA, 19 nt, Homo sapiens
ggaaucauguugacaguuu

SEQ ID NO: 582548 - RNA, 19 nt, Homo sapiens
gaaagcuguucuucucuua

SEQ ID NO: 582549 - RNA, 19 nt, Homo sapiens
ucacagcccuuucauguaa

SEQ ID NO: 582550 - RNA, 19 nt, Homo sapiens
guaagaagcuuuuccauaa

SEQ ID NO: 582551 - RNA, 19 nt, Homo sapiens
gcauuuaggucagaugaua

SEQ ID NO: 582552 - RNA, 19 nt, Homo sapiens
gcaggucaguucauucuuu

SEQ ID NO: 582553 - RNA, 19 nt, Homo sapiens
gaaacuauguuauggagau

SEQ ID NO: 582554 - RNA, 19 nt, Homo sapiens
gaggguaccuugagucuau

SEQ ID NO: 582555 - RNA, 19 nt, Homo sapiens
gaacuugaaugcugcaaca

SEQ ID NO: 582556 - RNA, 19 nt, Homo sapiens
gaggauaacuuagaagaug

SEQ ID NO: 582557 - RNA, 19 nt, Homo sapiens
gaaguaagggagaaaguuu

SEQ ID NO: 582558 - RNA, 19 nt, Homo sapiens
gcaaggaucugcaguuacu

SEQ ID NO: 582559 - RNA, 19 nt, Homo sapiens
gcaaugguguacagauauu

SEQ ID NO: 582560 - RNA, 19 nt, Homo sapiens
ggcaugggauggcuuauuu

SEQ ID NO: 582561 - RNA, 19 nt, Homo sapiens
gaaauuacccugagcucaa

SEQ ID NO: 582562 - RNA, 19 nt, Homo sapiens
ugaaagugcuaguuaaaug

SEQ ID NO: 582563 - RNA, 19 nt, Homo sapiens
uaaaugcacugaaacuaug

SEQ ID NO: 582564 - RNA, 19 nt, Homo sapiens
gugcguaucucgcuuaaga

SEQ ID NO: 582565 - RNA, 19 nt, Homo sapiens
caugaaagaucgguuauau

SEQ ID NO: 582566 - RNA, 19 nt, Homo sapiens
gaagaauacacugcuaaua

SEQ ID NO: 582567 - RNA, 19 nt, Homo sapiens
guaguucucuguauuaaag

SEQ ID NO: 582568 - RNA, 19 nt, Homo sapiens
acccugagcucaacaauaa

SEQ ID NO: 582569 - RNA, 19 nt, Homo sapiens
gcacugaaacuauguuaug

SEQ ID NO: 582570 - RNA, 19 nt, Homo sapiens
gaucugcaguuacuuugaa

SEQ ID NO: 582571 - RNA, 19 nt, Homo sapiens
cgaauuguaugauuuagga

SEQ ID NO: 582572 - RNA, 19 nt, Homo sapiens
gaucugauauuuaggucuu

SEQ ID NO: 582573 - RNA, 19 nt, Homo sapiens
agaaagggauuacaacaug

SEQ ID NO: 582574 - RNA, 19 nt, Homo sapiens
gaagucuccuccuccauga

SEQ ID NO: 582575 - RNA, 19 nt, Homo sapiens
ggaaagggaaucauguuga

SEQ ID NO: 582576 - RNA, 19 nt, Homo sapiens
guuuacacaugcugaaaua

SEQ ID NO: 582577 - RNA, 19 nt, Homo sapiens
cauuugauguggaugaaua

SEQ ID NO: 582578 - RNA, 19 nt, Homo sapiens
cuaaguaguucucuguauu

SEQ ID NO: 582579 - RNA, 19 nt, Homo sapiens
gauagccuguuauguaaug

SEQ ID NO: 582580 - RNA, 19 nt, Homo sapiens
gagaaugguuauccucuuc

SEQ ID NO: 582581 - RNA, 19 nt, Homo sapiens
ggaagaacagggacauuga

SEQ ID NO: 582582 - RNA, 19 nt, Homo sapiens
gaagccuacuuuccuuauu

SEQ ID NO: 582583 - RNA, 19 nt, Homo sapiens
guagaagaauacacugcua

SEQ ID NO: 582584 - RNA, 19 nt, Homo sapiens
uaagauaacaccuucaaga

SEQ ID NO: 582585 - RNA, 19 nt, Homo sapiens
ggacaauucccuuuccuau

SEQ ID NO: 582586 - RNA, 19 nt, Homo sapiens
gcugcaaacuaaacaagaa

SEQ ID NO: 582587 - RNA, 19 nt, Homo sapiens
gaaagggaaucauguugac

SEQ ID NO: 582588 - RNA, 19 nt, Homo sapiens
gcuaaguaguucucuguau

SEQ ID NO: 582589 - RNA, 19 nt, Homo sapiens
caacagaugauccagagaa

SEQ ID NO: 582590 - RNA, 19 nt, Homo sapiens
augaggagcuggucuauga

SEQ ID NO: 582591 - RNA, 19 nt, Homo sapiens
gaaaacugguuaaugacua

SEQ ID NO: 582592 - RNA, 19 nt, Homo sapiens
acagaaaacugguuaauga

SEQ ID NO: 582593 - RNA, 19 nt, Homo sapiens
gucccagccuuucagauua

SEQ ID NO: 582594 - RNA, 19 nt, Homo sapiens
cugcaaagcuggucuugga

SEQ ID NO: 582595 - RNA, 19 nt, Homo sapiens
ccuaugcaguaaucuauuu

SEQ ID NO: 582596 - RNA, 19 nt, Homo sapiens
uggcaaugguguacagaua

SEQ ID NO: 582597 - RNA, 19 nt, Homo sapiens
ugacucagguuuguuaaau

SEQ ID NO: 582598 - RNA, 19 nt, Homo sapiens
ugggauggcuuauuuagga

SEQ ID NO: 582599 - RNA, 19 nt, Homo sapiens
gaaaacagaaaacugguua

SEQ ID NO: 582600 - RNA, 19 nt, Homo sapiens
ucauacaguuugucaagaa

SEQ ID NO: 582601 - RNA, 19 nt, Homo sapiens
ccaagaaguggauguauau

SEQ ID NO: 582602 - RNA, 19 nt, Homo sapiens
uugauagccuguuauguaa

SEQ ID NO: 582603 - RNA, 19 nt, Homo sapiens
gggauuacaacauggauuu

SEQ ID NO: 582604 - RNA, 19 nt, Homo sapiens
ucaccauucucgacuguuu

SEQ ID NO: 582605 - RNA, 19 nt, Homo sapiens
uaaagaagacaccagaaga

SEQ ID NO: 582606 - RNA, 19 nt, Homo sapiens
aaauuacacucaacugaug

SEQ ID NO: 582607 - RNA, 19 nt, Homo sapiens
ucagaagccuguagguuuc

SEQ ID NO: 582608 - RNA, 19 nt, Homo sapiens
gcaguuacuuugaagacau

SEQ ID NO: 582609 - RNA, 19 nt, Homo sapiens
caaacuacgugccuuaaaa

SEQ ID NO: 582610 - RNA, 19 nt, Homo sapiens
gcugagccaauuugaguua

SEQ ID NO: 582611 - RNA, 19 nt, Homo sapiens
ggaacgauuuggagaggau

SEQ ID NO: 582612 - RNA, 19 nt, Homo sapiens
aagccuacuuuccuuauuu

SEQ ID NO: 582613 - RNA, 19 nt, Homo sapiens
guaaaguugacuacuguaa

SEQ ID NO: 582614 - RNA, 19 nt, Homo sapiens
auaggaagaugacaguauu

SEQ ID NO: 582615 - RNA, 19 nt, Homo sapiens
guucuuaacccaauuagga

SEQ ID NO: 582616 - RNA, 19 nt, Homo sapiens
ugaaaugacucaauauucc

SEQ ID NO: 582617 - RNA, 19 nt, Homo sapiens
gagccaauuugaguuaguu

SEQ ID NO: 582618 - RNA, 19 nt, Homo sapiens
acaccgggcuuucuucuuc

SEQ ID NO: 582619 - RNA, 19 nt, Homo sapiens
ucaccauccugugcauuua

SEQ ID NO: 582620 - RNA, 19 nt, Homo sapiens
gagaggauaacuuagaaga

SEQ ID NO: 582621 - RNA, 19 nt, Homo sapiens
accaagaaguggauguaua

SEQ ID NO: 582622 - RNA, 19 nt, Homo sapiens
acacugaguuuauccaagu

SEQ ID NO: 582623 - RNA, 19 nt, Homo sapiens
ugaaagcuguucuucucuu

SEQ ID NO: 582624 - RNA, 19 nt, Homo sapiens
uuaccaaccucuugaaugg

SEQ ID NO: 582625 - RNA, 19 nt, Homo sapiens
gcacuaugaccucuucuuc

SEQ ID NO: 582626 - RNA, 19 nt, Homo sapiens
ugauguggaugaauaugaa

SEQ ID NO: 582627 - RNA, 19 nt, Homo sapiens
cauaugaagugcuuuacuc

SEQ ID NO: 582628 - RNA, 19 nt, Homo sapiens
gcagugaaagaucagaauu

SEQ ID NO: 582629 - RNA, 19 nt, Homo sapiens
ccaagaggaucaacagaac

SEQ ID NO: 582630 - RNA, 19 nt, Homo sapiens
cuacauagacacaccaaga

SEQ ID NO: 582631 - RNA, 19 nt, Homo sapiens
guaauucagaugacauuug

SEQ ID NO: 582632 - RNA, 19 nt, Homo sapiens
ucuggaaccuacuaugaaa

SEQ ID NO: 582633 - RNA, 19 nt, Homo sapiens
gcucaacaauaaucaguac

SEQ ID NO: 582634 - RNA, 19 nt, Homo sapiens
agaagaugaugauguggaa

SEQ ID NO: 582635 - RNA, 19 nt, Homo sapiens
aaagaagacaccagaagaa

SEQ ID NO: 582636 - RNA, 19 nt, Homo sapiens
cagcagccgaguccaaaua

SEQ ID NO: 582637 - RNA, 19 nt, Homo sapiens
cugaauauuucuucugaga

SEQ ID NO: 582638 - RNA, 19 nt, Homo sapiens
aaguuuaucucuaccaaga

SEQ ID NO: 582639 - RNA, 19 nt, Homo sapiens
gcacaguaaauacccacua

SEQ ID NO: 582640 - RNA, 19 nt, Homo sapiens
uaaugugacugcaguugug

SEQ ID NO: 582641 - RNA, 19 nt, Homo sapiens
guucaugaaagaucgguua

SEQ ID NO: 582642 - RNA, 19 nt, Homo sapiens
guaccuugagucuauuaua

SEQ ID NO: 582643 - RNA, 19 nt, Homo sapiens
gaaagugcuaguuaaaugg

SEQ ID NO: 582644 - RNA, 19 nt, Homo sapiens
gacucaauauuccaaaugu

SEQ ID NO: 582645 - RNA, 19 nt, Homo sapiens
ggacauugauagccuguua

SEQ ID NO: 582646 - RNA, 19 nt, Homo sapiens
guaagaagcuuuuccauaa

SEQ ID NO: 582647 - RNA, 19 nt, Homo sapiens
gcauuuaggucagaugaua

SEQ ID NO: 582648 - RNA, 19 nt, Homo sapiens
gaacuugaaugcugcaaca

SEQ ID NO: 582649 - RNA, 19 nt, Homo sapiens
gaggauaacuuagaagaug

SEQ ID NO: 582650 - RNA, 19 nt, Homo sapiens
gcaaggaucugcaguuacu

SEQ ID NO: 582651 - RNA, 19 nt, Homo sapiens
gcaaugguguacagauauu

SEQ ID NO: 582652 - RNA, 19 nt, Homo sapiens
gaaauuacccugagcucaa

SEQ ID NO: 582653 - RNA, 19 nt, Homo sapiens
gugcguaucucgcuuaaga

SEQ ID NO: 582654 - RNA, 19 nt, Homo sapiens
caugaaagaucgguuauau

SEQ ID NO: 582655 - RNA, 19 nt, Homo sapiens
acccugagcucaacaauaa

SEQ ID NO: 582656 - RNA, 19 nt, Homo sapiens
gaucugcaguuacuuugaa

SEQ ID NO: 582657 - RNA, 19 nt, Homo sapiens
agaaagggauuacaacaug

SEQ ID NO: 582658 - RNA, 19 nt, Homo sapiens
gaagucuccuccuccauga

SEQ ID NO: 582659 - RNA, 19 nt, Homo sapiens
guuuacacaugcugaaaua

SEQ ID NO: 582660 - RNA, 19 nt, Homo sapiens
cauuugauguggaugaaua

SEQ ID NO: 582661 - RNA, 19 nt, Homo sapiens
gauagccuguuauguaaug

SEQ ID NO: 582662 - RNA, 19 nt, Homo sapiens
gagaaugguuauccucuuc

SEQ ID NO: 582663 - RNA, 19 nt, Homo sapiens
ggaagaacagggacauuga

SEQ ID NO: 582664 - RNA, 19 nt, Homo sapiens
gaagccuacuuuccuuauu

SEQ ID NO: 582665 - RNA, 19 nt, Homo sapiens
gcuagcuccucuucaagua

SEQ ID NO: 582666 - RNA, 19 nt, Homo sapiens
gcugcaaacuaaacaagaa

SEQ ID NO: 582667 - RNA, 19 nt, Homo sapiens
caacagaugauccagagaa

SEQ ID NO: 582668 - RNA, 19 nt, Homo sapiens
augaggagcuggucuauga

SEQ ID NO: 582669 - RNA, 19 nt, Homo sapiens
gucccagccuuucagauua

SEQ ID NO: 582670 - RNA, 19 nt, Homo sapiens
cugcaaagcuggucuugga

SEQ ID NO: 582671 - RNA, 19 nt, Homo sapiens
ccuaugcaguaaucuauuu

SEQ ID NO: 582672 - RNA, 19 nt, Homo sapiens
uggcaaugguguacagaua

SEQ ID NO: 582673 - RNA, 19 nt, Homo sapiens
ucauacaguuugucaagaa

SEQ ID NO: 582674 - RNA, 19 nt, Homo sapiens
uugauagccuguuauguaa

SEQ ID NO: 582675 - RNA, 19 nt, Homo sapiens
gggauuacaacauggauuu

SEQ ID NO: 582676 - RNA, 19 nt, Homo sapiens
ucaccauucucgacuguuu

SEQ ID NO: 582677 - RNA, 19 nt, Homo sapiens
uaaagaagacaccagaaga

SEQ ID NO: 582678 - RNA, 19 nt, Homo sapiens
gcaguuacuuugaagacau

SEQ ID NO: 582679 - RNA, 19 nt, Homo sapiens
caaacuacgugccuuaaaa

SEQ ID NO: 582680 - RNA, 19 nt, Homo sapiens
ggaacgauuuggagaggau

SEQ ID NO: 582681 - RNA, 19 nt, Homo sapiens
aagccuacuuuccuuauuu

SEQ ID NO: 582682 - RNA, 19 nt, Homo sapiens
acaccgggcuuucuucuuc

SEQ ID NO: 582683 - RNA, 19 nt, Homo sapiens
ucaccauccugugcauuua

SEQ ID NO: 582684 - RNA, 19 nt, Homo sapiens
gagaggauaacuuagaaga

SEQ ID NO: 582685 - RNA, 19 nt, Homo sapiens
gaaacugucuaugcacuac

SEQ ID NO: 582686 - RNA, 19 nt, Homo sapiens
uuaccaaccucuugaaugg

SEQ ID NO: 582687 - RNA, 19 nt, Homo sapiens
gcacuaugaccucuucuuc

SEQ ID NO: 582688 - RNA, 19 nt, Homo sapiens
ugauguggaugaauaugaa

SEQ ID NO: 582689 - RNA, 19 nt, Homo sapiens
ccaagaggaucaacagaac

SEQ ID NO: 582690 - RNA, 19 nt, Homo sapiens
gcucaacaauaaucaguac

SEQ ID NO: 582691 - RNA, 19 nt, Homo sapiens
agaagaugaugauguggaa

SEQ ID NO: 582692 - RNA, 19 nt, Homo sapiens
aaagaagacaccagaagaa

SEQ ID NO: 582693 - RNA, 19 nt, Homo sapiens
uagcuccucuucaaguaaa

SEQ ID NO: 582694 - RNA, 19 nt, Homo sapiens
cagcagccgaguccaaaua

SEQ ID NO: 582695 - RNA, 19 nt, Homo sapiens
uaaugugacugcaguugug

SEQ ID NO: 582696 - RNA, 19 nt, Homo sapiens
gcacaguaaauacccacua

SEQ ID NO: 582697 - RNA, 19 nt, Homo sapiens
guucaugaaagaucgguua

SEQ ID NO: 582698 - RNA, 19 nt, Homo sapiens
agacaaacuacgugccuua

SEQ ID NO: 582699 - RNA, 19 nt, Homo sapiens
cuuagaagaugaugaugug

SEQ ID NO: 582700 - RNA, 19 nt, Homo sapiens
cacaguaaauacccacuau

SEQ ID NO: 582701 - RNA, 19 nt, Homo sapiens
auugauagccuguuaugua

SEQ ID NO: 582702 - RNA, 19 nt, Homo sapiens
gaagaacagggacauugau

SEQ ID NO: 582703 - RNA, 19 nt, Homo sapiens
gccaagaggaucaacagaa

SEQ ID NO: 582704 - RNA, 19 nt, Homo sapiens
uggagaggauaacuuagaa

SEQ ID NO: 582705 - RNA, 19 nt, Homo sapiens
gaacagggacauugauagc

SEQ ID NO: 582706 - RNA, 19 nt, Homo sapiens
gaccucuucuucauagaug

SEQ ID NO: 582707 - RNA, 19 nt, Homo sapiens
cauacaguuugucaagaaa

SEQ ID NO: 582708 - RNA, 19 nt, Homo sapiens
ucaaguaaacgccaaguca

SEQ ID NO: 582709 - RNA, 19 nt, Homo sapiens
cuugugaguucaugaaaga

SEQ ID NO: 582710 - RNA, 19 nt, Homo sapiens
guaaacgccaagucacaaa

SEQ ID NO: 582711 - RNA, 19 nt, Homo sapiens
gagccguucuaucccugua

SEQ ID NO: 582712 - RNA, 19 nt, Homo sapiens
cagaugauccagagaacaa

SEQ ID NO: 582713 - RNA, 19 nt, Homo sapiens
ccuccuccaugaucacuuu

SEQ ID NO: 582714 - RNA, 19 nt, Homo sapiens
uaaugaaacacuacagguu

SEQ ID NO: 582715 - RNA, 19 nt, Homo sapiens
auucagggaugcuuccuuu

SEQ ID NO: 582716 - RNA, 19 nt, Homo sapiens
gaggagcuggucuaugaaa

SEQ ID NO: 582717 - RNA, 19 nt, Homo sapiens
aaacauggaacgauuugga

SEQ ID NO: 582718 - RNA, 19 nt, Homo sapiens
gagcagugucccagccuuu

SEQ ID NO: 582719 - RNA, 19 nt, Homo sapiens
gaacauuaugagcgaguug

SEQ ID NO: 582720 - RNA, 19 nt, Homo sapiens
gcacuuacaaucucaccau

SEQ ID NO: 582721 - RNA, 19 nt, Homo sapiens
caacaauaaucaguacaac

SEQ ID NO: 582722 - RNA, 19 nt, Homo sapiens
ccacguaccucaccauccu

SEQ ID NO: 582723 - RNA, 19 nt, Homo sapiens
cacuacagguuuacacaug

SEQ ID NO: 582724 - RNA, 19 nt, Homo sapiens
ugagaaugguuauccucuu

SEQ ID NO: 582725 - RNA, 19 nt, Homo sapiens
cagggaugcuuccuuugga

SEQ ID NO: 582726 - RNA, 19 nt, Homo sapiens
gaacuuggcaaugguguac

SEQ ID NO: 582727 - RNA, 19 nt, Homo sapiens
ucugcuagcuccucuucaa

SEQ ID NO: 582728 - RNA, 19 nt, Homo sapiens
ucccagccuuucagauuaa

SEQ ID NO: 582729 - RNA, 19 nt, Homo sapiens
gacaaacuacgugccuuaa

SEQ ID NO: 582730 - RNA, 19 nt, Homo sapiens
aagaacagggacauugaua

SEQ ID NO: 582731 - RNA, 19 nt, Homo sapiens
gcaaaauugagaaugguua

SEQ ID NO: 582732 - RNA, 19 nt, Homo sapiens
ccgcugaacuuggcaaugg

SEQ ID NO: 582733 - RNA, 19 nt, Homo sapiens
gagcuggucuaugaaaauu

SEQ ID NO: 582734 - RNA, 19 nt, Homo sapiens
ccagccaacuaccagaaau

SEQ ID NO: 582735 - RNA, 19 nt, Homo sapiens
cgagcacuaugaccucuuc

SEQ ID NO: 582736 - RNA, 19 nt, Homo sapiens
caucgccguucacugcaaa

SEQ ID NO: 582737 - RNA, 19 nt, Homo sapiens
aggcaaagcgcuucacaga

SEQ ID NO: 582738 - RNA, 19 nt, Homo sapiens
augaugauguggaaaugaa

SEQ ID NO: 582739 - RNA, 19 nt, Homo sapiens
aggauaacuuagaagauga

SEQ ID NO: 582740 - RNA, 19 nt, Homo sapiens
gcaguugugaggcuaaaca

SEQ ID NO: 582741 - RNA, 19 nt, Homo sapiens
guggaugaauaugaacauu

SEQ ID NO: 582742 - RNA, 19 nt, Homo sapiens
uacaguuugucaagaaaga

SEQ ID NO: 582743 - RNA, 19 nt, Homo sapiens
ccugaagccuacuuuccuu

SEQ ID NO: 582744 - RNA, 19 nt, Homo sapiens
ugaaugcugcaacagauga

SEQ ID NO: 582745 - RNA, 19 nt, Homo sapiens
ggacauugauagccuguua

SEQ ID NO: 582746 - RNA, 19 nt, Homo sapiens
aaacugauguucugcauuu

SEQ ID NO: 582747 - RNA, 19 nt, Homo sapiens
ggaacgauuuggagaggua

SEQ ID NO: 582748 - RNA, 19 nt, Homo sapiens
gaaaccaauugcccuuaaa

SEQ ID NO: 582749 - RNA, 19 nt, Homo sapiens
gcaaugguguacagauauu

SEQ ID NO: 582750 - RNA, 19 nt, Homo sapiens
gugcguaucucgcuuaaga

SEQ ID NO: 582751 - RNA, 19 nt, Homo sapiens
caugaaagaucgguuauau

SEQ ID NO: 582752 - RNA, 19 nt, Homo sapiens
gcaagaagcagaggaaaga

SEQ ID NO: 582753 - RNA, 19 nt, Homo sapiens
agaaagggauuacaacaug

SEQ ID NO: 582754 - RNA, 19 nt, Homo sapiens
gaagucuccuccuccauga

SEQ ID NO: 582755 - RNA, 19 nt, Homo sapiens
aaaggaggcuacucuggua

SEQ ID NO: 582756 - RNA, 19 nt, Homo sapiens
guuuacacaugcugaaaua

SEQ ID NO: 582757 - RNA, 19 nt, Homo sapiens
cauuugauguggaugaaua

SEQ ID NO: 582758 - RNA, 19 nt, Homo sapiens
gauagccuguuauguaaug

SEQ ID NO: 582759 - RNA, 19 nt, Homo sapiens
gagaaugguuauccucuuc

SEQ ID NO: 582760 - RNA, 19 nt, Homo sapiens
ggaagaacagggacauuga

SEQ ID NO: 582761 - RNA, 19 nt, Homo sapiens
gaagccuacuuuccuuauu

SEQ ID NO: 582762 - RNA, 19 nt, Homo sapiens
gcugcaaacuaaacaagaa

SEQ ID NO: 582763 - RNA, 19 nt, Homo sapiens
augaggagcuggucuauga

SEQ ID NO: 582764 - RNA, 19 nt, Homo sapiens
cugcaaagcuggucuugga

SEQ ID NO: 582765 - RNA, 19 nt, Homo sapiens
ccuaugcaguaaucuauuu

SEQ ID NO: 582766 - RNA, 19 nt, Homo sapiens
uggcaaugguguacagaua

SEQ ID NO: 582767 - RNA, 19 nt, Homo sapiens
ucauacaguuugucaagaa

SEQ ID NO: 582768 - RNA, 19 nt, Homo sapiens
agaaaccaauugcccuuaa

SEQ ID NO: 582769 - RNA, 19 nt, Homo sapiens
uugauagccuguuauguaa

SEQ ID NO: 582770 - RNA, 19 nt, Homo sapiens
gggauuacaacauggauuu

SEQ ID NO: 582771 - RNA, 19 nt, Homo sapiens
ucaccauucucgacuguuu

SEQ ID NO: 582772 - RNA, 19 nt, Homo sapiens
uaaagaagacaccagaaga

SEQ ID NO: 582773 - RNA, 19 nt, Homo sapiens
aagccuacuuuccuuauuu

SEQ ID NO: 582774 - RNA, 19 nt, Homo sapiens
gcacuaugaccucuucuuc

SEQ ID NO: 582775 - RNA, 19 nt, Homo sapiens
ugauguggaugaauaugaa

SEQ ID NO: 582776 - RNA, 19 nt, Homo sapiens
aaagaagacaccagaagaa

SEQ ID NO: 582777 - RNA, 19 nt, Homo sapiens
uaaugugacugcaguugug

SEQ ID NO: 582778 - RNA, 19 nt, Homo sapiens
cagcagccgaguccaaaua

SEQ ID NO: 582779 - RNA, 19 nt, Homo sapiens
gcacaguaaauacccacua

SEQ ID NO: 582780 - RNA, 19 nt, Homo sapiens
guucaugaaagaucgguua

SEQ ID NO: 582781 - RNA, 19 nt, Homo sapiens
cacaguaaauacccacuau

SEQ ID NO: 582782 - RNA, 19 nt, Homo sapiens
auugauagccuguuaugua

SEQ ID NO: 582783 - RNA, 19 nt, Homo sapiens
gaagaacagggacauugau

SEQ ID NO: 582784 - RNA, 19 nt, Homo sapiens
gaacagggacauugauagc

SEQ ID NO: 582785 - RNA, 19 nt, Homo sapiens
gaccucuucuucauagaug

SEQ ID NO: 582786 - RNA, 19 nt, Homo sapiens
cauacaguuugucaagaaa

SEQ ID NO: 582787 - RNA, 19 nt, Homo sapiens
cuugugaguucaugaaaga

SEQ ID NO: 582788 - RNA, 19 nt, Homo sapiens
gguaagggguaauauuuau

SEQ ID NO: 582789 - RNA, 19 nt, Homo sapiens
ccuccuccaugaucacuuu

SEQ ID NO: 582790 - RNA, 19 nt, Homo sapiens
uaaugaaacacuacagguu

SEQ ID NO: 582791 - RNA, 19 nt, Homo sapiens
auucagggaugcuuccuuu

SEQ ID NO: 582792 - RNA, 19 nt, Homo sapiens
gaggagcuggucuaugaaa

SEQ ID NO: 582793 - RNA, 19 nt, Homo sapiens
aaacauggaacgauuugga

SEQ ID NO: 582794 - RNA, 19 nt, Homo sapiens
gaacauuaugagcgaguug

SEQ ID NO: 582795 - RNA, 19 nt, Homo sapiens
gcacuuacaaucucaccau

SEQ ID NO: 582796 - RNA, 19 nt, Homo sapiens
uaacauagcagugucuuuu

SEQ ID NO: 582797 - RNA, 19 nt, Homo sapiens
guucugcauuuguuucuca

SEQ ID NO: 582798 - RNA, 19 nt, Homo sapiens
cacuacagguuuacacaug

SEQ ID NO: 582799 - RNA, 19 nt, Homo sapiens
ugagaaugguuauccucuu

SEQ ID NO: 582800 - RNA, 19 nt, Homo sapiens
cagggaugcuuccuuugga

SEQ ID NO: 582801 - RNA, 19 nt, Homo sapiens
gaacuuggcaaugguguac

SEQ ID NO: 582802 - RNA, 19 nt, Homo sapiens
gcagaggaaagaaaccaau

SEQ ID NO: 582803 - RNA, 19 nt, Homo sapiens
agagccauccgucuauaua

SEQ ID NO: 582804 - RNA, 19 nt, Homo sapiens
uuucucaguuggaccuaua

SEQ ID NO: 582805 - RNA, 19 nt, Homo sapiens
aagaacagggacauugaua

SEQ ID NO: 582806 - RNA, 19 nt, Homo sapiens
gcaaaauugagaaugguua

SEQ ID NO: 582807 - RNA, 19 nt, Homo sapiens
ccgcugaacuuggcaaugg

SEQ ID NO: 582808 - RNA, 19 nt, Homo sapiens
gagcuggucuaugaaaauu

SEQ ID NO: 582809 - RNA, 19 nt, Homo sapiens
cgagcacuaugaccucuuc

SEQ ID NO: 582810 - RNA, 19 nt, Homo sapiens
gauuuggagagguaaguuu

SEQ ID NO: 582811 - RNA, 19 nt, Homo sapiens
caucgccguucacugcaaa

SEQ ID NO: 582812 - RNA, 19 nt, Homo sapiens
aggcaaagcgcuucacaga

SEQ ID NO: 582813 - RNA, 19 nt, Homo sapiens
gcaguugugaggcuaaaca

SEQ ID NO: 582814 - RNA, 19 nt, Homo sapiens
guggaugaauaugaacauu

SEQ ID NO: 582815 - RNA, 19 nt, Homo sapiens
uacaguuugucaagaaaga

SEQ ID NO: 582816 - RNA, 19 nt, Homo sapiens
ccugaagccuacuuuccuu

SEQ ID NO: 582817 - RNA, 19 nt, Homo sapiens
cagaggaaagaaaccaauu

SEQ ID NO: 582818 - RNA, 19 nt, Homo sapiens
cugauguucugcauuuguu

SEQ ID NO: 582819 - RNA, 19 nt, Homo sapiens
uggccuagaugauaugucu

SEQ ID NO: 582820 - RNA, 19 nt, Homo sapiens
uaagauggcagcggaguca

SEQ ID NO: 582821 - RNA, 19 nt, Homo sapiens
cuuacaaucucaccauucu

SEQ ID NO: 582822 - RNA, 19 nt, Homo sapiens
cacaaaacauggaacgauu

SEQ ID NO: 582823 - RNA, 19 nt, Homo sapiens
uuucuggccuagaugauau

SEQ ID NO: 582824 - RNA, 19 nt, Homo sapiens
uccagugaaggaaguauua

SEQ ID NO: 582825 - RNA, 19 nt, Homo sapiens
gacaacaucgugcgaaggu

SEQ ID NO: 582826 - RNA, 19 nt, Homo sapiens
cagaaagggauuacaacau

SEQ ID NO: 582827 - RNA, 19 nt, Homo sapiens
ggcaaugguguacagauau

SEQ ID NO: 582828 - RNA, 19 nt, Homo sapiens
cugcauuuguuucucaguu

SEQ ID NO: 582829 - RNA, 19 nt, Homo sapiens
ucagaaagggauuacaaca

SEQ ID NO: 582830 - RNA, 19 nt, Homo sapiens
gaaaggaaacagaaaagca

SEQ ID NO: 582831 - RNA, 19 nt, Homo sapiens
gaggaaagaaaccaauugc

SEQ ID NO: 582832 - RNA, 19 nt, Homo sapiens
gaacgauuuggagagguaa

SEQ ID NO: 582833 - RNA, 19 nt, Homo sapiens
gcacacccagugacaacau

SEQ ID NO: 582834 - RNA, 19 nt, Homo sapiens
gcuugugaguucaugaaag

SEQ ID NO: 582835 - RNA, 19 nt, Homo sapiens
gcacuccugucuggcucaa

SEQ ID NO: 582836 - RNA, 19 nt, Homo sapiens
acacaugcugaaauaauug

SEQ ID NO: 582837 - RNA, 19 nt, Homo sapiens
cugaacaucugugagaaca

SEQ ID NO: 582838 - RNA, 19 nt, Homo sapiens
agaggaaagaaaccaauug

SEQ ID NO: 582839 - RNA, 19 nt, Homo sapiens
aagaagcagaggaaagaaa

SEQ ID NO: 582840 - RNA, 19 nt, Homo sapiens
gagccauccgucuauauag

SEQ ID NO: 582841 - RNA, 19 nt, Homo sapiens
ucuauugguggaaaucuuu

SEQ ID NO: 582842 - RNA, 19 nt, Homo sapiens
ccagugaaggaaguauuaa

SEQ ID NO: 582843 - RNA, 19 nt, Homo sapiens
ugagagcuggucugcguuu

SEQ ID NO: 582844 - RNA, 19 nt, Homo sapiens
cagccgaguccaaauagga

SEQ ID NO: 582845 - RNA, 19 nt, Homo sapiens
ggccauggcugcuuuguag

SEQ ID NO: 582846 - RNA, 19 nt, Homo sapiens
cgcaauaaaugcucaauca

SEQ ID NO: 582847 - RNA, 19 nt, Homo sapiens
ggagguggcugagaucaca

SEQ ID NO: 582848 - RNA, 19 nt, Homo sapiens
caauaaaugcucaaucaug

SEQ ID NO: 582849 - RNA, 19 nt, Homo sapiens
gcacuaaggguggagaguu

SEQ ID NO: 582850 - RNA, 19 nt, Homo sapiens
ugagagggacugugacuug

SEQ ID NO: 582851 - RNA, 19 nt, Homo sapiens
uggcugagaucacaaagca

SEQ ID NO: 582852 - RNA, 19 nt, Homo sapiens
cacuaaggguggagaguug

SEQ ID NO: 582853 - RNA, 19 nt, Homo sapiens
cauggcugcuuuguaguuu

SEQ ID NO: 582854 - RNA, 19 nt, Homo sapiens
gaggacacccagagacaug

SEQ ID NO: 582855 - RNA, 19 nt, Homo sapiens
gcaauaaaugcucaaucau

SEQ ID NO: 582856 - RNA, 19 nt, Homo sapiens
guuagugccgcaauaaaug

SEQ ID NO: 582857 - RNA, 19 nt, Homo sapiens
ggagaagggacaaaaggua

SEQ ID NO: 582858 - RNA, 19 nt, Homo sapiens
ggaacgcucuaggcagaag

SEQ ID NO: 582859 - RNA, 19 nt, Homo sapiens
ccagcacccucuguuagug

SEQ ID NO: 582860 - RNA, 19 nt, Homo sapiens
ugucggaggagaacuguga

SEQ ID NO: 582861 - RNA, 19 nt, Homo sapiens
ccauggcugcuuuguaguu

SEQ ID NO: 582862 - RNA, 19 nt, Homo sapiens
gcucuaggcagaagaagcu

SEQ ID NO: 582863 - RNA, 19 nt, Homo sapiens
gggcagaauggaaggaucu

SEQ ID NO: 582864 - RNA, 19 nt, Homo sapiens
guacugccgcugcccaucu

SEQ ID NO: 582865 - RNA, 19 nt, Homo sapiens
gaaauaagcgugucgagaa

SEQ ID NO: 582866 - RNA, 19 nt, Homo sapiens
ggaagcagcccuacaacaa

SEQ ID NO: 582867 - RNA, 19 nt, Homo sapiens
uauaggcucuuguuggaua

SEQ ID NO: 582868 - RNA, 19 nt, Homo sapiens
gcuauaggcucuuguugga

SEQ ID NO: 582869 - RNA, 19 nt, Homo sapiens
cgucugaaguguauucgua

SEQ ID NO: 582870 - RNA, 19 nt, Homo sapiens
ggacaagagggacaaggua

SEQ ID NO: 582871 - RNA, 19 nt, Homo sapiens
gaucaguggugucugugaa

SEQ ID NO: 582872 - RNA, 19 nt, Homo sapiens
ggacgaugccggaguguga

SEQ ID NO: 582873 - RNA, 19 nt, Homo sapiens
ggaagugugacaaggauuu

SEQ ID NO: 582874 - RNA, 19 nt, Homo sapiens
gcacaggaacuucauuauc

SEQ ID NO: 582875 - RNA, 19 nt, Homo sapiens
gaacauccuccacugacuu

SEQ ID NO: 582876 - RNA, 19 nt, Homo sapiens
acaacaaccugaagcacaa

SEQ ID NO: 582877 - RNA, 19 nt, Homo sapiens
gaggguaccuacggcauug

SEQ ID NO: 582878 - RNA, 19 nt, Homo sapiens
ggaaccaccuggagagcau

SEQ ID NO: 582879 - RNA, 19 nt, Homo sapiens
gaugagagggcccagaaga

SEQ ID NO: 582880 - RNA, 19 nt, Homo sapiens
gaacugcuguugggaacca

SEQ ID NO: 582881 - RNA, 19 nt, Homo sapiens
gaacacaggcugggacgau

SEQ ID NO: 582882 - RNA, 19 nt, Homo sapiens
gaagcuauaggcucuuguu

SEQ ID NO: 582883 - RNA, 19 nt, Homo sapiens
gagauugucgcacugaaga

SEQ ID NO: 582884 - RNA, 19 nt, Homo sapiens
ggccuauggugucccagua

SEQ ID NO: 582885 - RNA, 19 nt, Homo sapiens
ccugaagguuuccaacuug

SEQ ID NO: 582886 - RNA, 19 nt, Homo sapiens
ugaagaaggugcggaugga

SEQ ID NO: 582887 - RNA, 19 nt, Homo sapiens
uccaguaucugcacaggaa

SEQ ID NO: 582888 - RNA, 19 nt, Homo sapiens
ugaaggaguuugagaagcu

SEQ ID NO: 582889 - RNA, 19 nt, Homo sapiens
ugaaguguauucguaagga

SEQ ID NO: 582890 - RNA, 19 nt, Homo sapiens
gcgaagcuauaggcucuug

SEQ ID NO: 582891 - RNA, 19 nt, Homo sapiens
gagccacaauugaggauac

SEQ ID NO: 582892 - RNA, 19 nt, Homo sapiens
cacaggaacuucauuaucc

SEQ ID NO: 582893 - RNA, 19 nt, Homo sapiens
ggauuuggacacccagaaa

SEQ ID NO: 582894 - RNA, 19 nt, Homo sapiens
ggagugugaaggaguuuga

SEQ ID NO: 582895 - RNA, 19 nt, Homo sapiens
gacaagagggacaagguau

SEQ ID NO: 582896 - RNA, 19 nt, Homo sapiens
ggaacauccuccacugacu

SEQ ID NO: 582897 - RNA, 19 nt, Homo sapiens
ggccagagcaagcgcugua

SEQ ID NO: 582898 - RNA, 19 nt, Homo sapiens
cauguacgacccuaagaaa

SEQ ID NO: 582899 - RNA, 19 nt, Homo sapiens
ccuauggugucccaguaaa

SEQ ID NO: 582900 - RNA, 19 nt, Homo sapiens
gggaugagagggcccagaa

SEQ ID NO: 582901 - RNA, 19 nt, Homo sapiens
guaccuacggcauugugua

SEQ ID NO: 582902 - RNA, 19 nt, Homo sapiens
guuuccaacuugcucauga

SEQ ID NO: 582903 - RNA, 19 nt, Homo sapiens
caggaagugugacaaggau

SEQ ID NO: 582904 - RNA, 19 nt, Homo sapiens
gagaagcugaaccgcauug

SEQ ID NO: 582905 - RNA, 19 nt, Homo sapiens
gaugcugagcgaagcuaua

SEQ ID NO: 582906 - RNA, 19 nt, Homo sapiens
aaauaagcgugucgagaag

SEQ ID NO: 582907 - RNA, 19 nt, Homo sapiens
gaagugugacaaggauuug

SEQ ID NO: 582908 - RNA, 19 nt, Homo sapiens
gaagcagcccuacaacaac

SEQ ID NO: 582909 - RNA, 19 nt, Homo sapiens
ccaccagcaucgacaugug

SEQ ID NO: 582910 - RNA, 19 nt, Homo sapiens
cugcacaggaacuucauua

SEQ ID NO: 582911 - RNA, 19 nt, Homo sapiens
gaacaucguggagcugaag

SEQ ID NO: 582912 - RNA, 19 nt, Homo sapiens
ggauggacaaggagaagga

SEQ ID NO: 582913 - RNA, 19 nt, Homo sapiens
gaagcugaaccgcauugga

SEQ ID NO: 582914 - RNA, 19 nt, Homo sapiens
gcuggaggcugagcuggau

SEQ ID NO: 582915 - RNA, 19 nt, Homo sapiens
gaugagauugucgcacuga

SEQ ID NO: 582916 - RNA, 19 nt, Homo sapiens
gccggagugugaaggaguu

SEQ ID NO: 582917 - RNA, 19 nt, Homo sapiens
gggacacccagacagauga

SEQ ID NO: 582918 - RNA, 19 nt, Homo sapiens
uggcaggacuccagaugag

SEQ ID NO: 582919 - RNA, 19 nt, Homo sapiens
cugcugcacuuccuguuca

SEQ ID NO: 582920 - RNA, 19 nt, Homo sapiens
caaccugaagcacaaguuc

SEQ ID NO: 582921 - RNA, 19 nt, Homo sapiens
gugugaagacagcggauuu

SEQ ID NO: 582922 - RNA, 19 nt, Homo sapiens
ccagagcaagcgcuguaaa

SEQ ID NO: 582923 - RNA, 19 nt, Homo sapiens
caccaggucuuccgaucag

SEQ ID NO: 582924 - RNA, 19 nt, Homo sapiens
gcacuuccuguucauguac

SEQ ID NO: 582925 - RNA, 19 nt, Homo sapiens
ucaggaagugugacaagga

SEQ ID NO: 582926 - RNA, 19 nt, Homo sapiens
cgaacaucguggagcugaa

SEQ ID NO: 582927 - RNA, 19 nt, Homo sapiens
caagagggacaagguaugg

SEQ ID NO: 582928 - RNA, 19 nt, Homo sapiens
ggacuccagaugaggacaa

SEQ ID NO: 582929 - RNA, 19 nt, Homo sapiens
ccuggcauuucuuugaguu

SEQ ID NO: 582930 - RNA, 19 nt, Homo sapiens
ggccuggcauuucuuugag

SEQ ID NO: 582931 - RNA, 19 nt, Homo sapiens
ucauguacgacccuaagaa

SEQ ID NO: 582932 - RNA, 19 nt, Homo sapiens
ugcacuuccuguucaugua

SEQ ID NO: 582933 - RNA, 19 nt, Homo sapiens
cuuccgagauccaccagau

SEQ ID NO: 582934 - RNA, 19 nt, Homo sapiens
ggagccacaauugaggaua

SEQ ID NO: 582935 - RNA, 19 nt, Homo sapiens
ccuccucgcuauguuggaa

SEQ ID NO: 582936 - RNA, 19 nt, Homo sapiens
uggcauuucuuugaguuca

SEQ ID NO: 582937 - RNA, 19 nt, Homo sapiens
agauccgucugaaguguau

SEQ ID NO: 582938 - RNA, 19 nt, Homo sapiens
caaggguugugugaagaca

SEQ ID NO: 582939 - RNA, 19 nt, Homo sapiens
ucacggugccuccggaaca

SEQ ID NO: 582940 - RNA, 19 nt, Homo sapiens
uggccuggcauuucuuuga

SEQ ID NO: 582941 - RNA, 19 nt, Homo sapiens
ccacgcagaccaccagcau

SEQ ID NO: 582942 - RNA, 19 nt, Homo sapiens
acaggaacuucauuaucca

SEQ ID NO: 582943 - RNA, 19 nt, Homo sapiens
ggaagcagcccuacaacaa

SEQ ID NO: 582944 - RNA, 19 nt, Homo sapiens
uauaggcucuuguuggaua

SEQ ID NO: 582945 - RNA, 19 nt, Homo sapiens
gcuauaggcucuuguugga

SEQ ID NO: 582946 - RNA, 19 nt, Homo sapiens
ggacaagagggacaaggua

SEQ ID NO: 582947 - RNA, 19 nt, Homo sapiens
gaucaguggugucugugaa

SEQ ID NO: 582948 - RNA, 19 nt, Homo sapiens
ggacgaugccggaguguga

SEQ ID NO: 582949 - RNA, 19 nt, Homo sapiens
gcacaggaacuucauuauc

SEQ ID NO: 582950 - RNA, 19 nt, Homo sapiens
gaacauccuccacugacuu

SEQ ID NO: 582951 - RNA, 19 nt, Homo sapiens
acaacaaccugaagcacaa

SEQ ID NO: 582952 - RNA, 19 nt, Homo sapiens
gaggguaccuacggcauug

SEQ ID NO: 582953 - RNA, 19 nt, Homo sapiens
ggaaccaccuggagagcau

SEQ ID NO: 582954 - RNA, 19 nt, Homo sapiens
gaugagagggcccagaaga

SEQ ID NO: 582955 - RNA, 19 nt, Homo sapiens
gaacugcuguugggaacca

SEQ ID NO: 582956 - RNA, 19 nt, Homo sapiens
gaagcuauaggcucuuguu

SEQ ID NO: 582957 - RNA, 19 nt, Homo sapiens
gagauugucgcacugaaga

SEQ ID NO: 582958 - RNA, 19 nt, Homo sapiens
ggccuauggugucccagua

SEQ ID NO: 582959 - RNA, 19 nt, Homo sapiens
ccugaagguuuccaacuug

SEQ ID NO: 582960 - RNA, 19 nt, Homo sapiens
ugaagaaggugcggaugga

SEQ ID NO: 582961 - RNA, 19 nt, Homo sapiens
uccaguaucugcacaggaa

SEQ ID NO: 582962 - RNA, 19 nt, Homo sapiens
ugaaggaguuugagaagcu

SEQ ID NO: 582963 - RNA, 19 nt, Homo sapiens
gcgaagcuauaggcucuug

SEQ ID NO: 582964 - RNA, 19 nt, Homo sapiens
gagccacaauugaggauac

SEQ ID NO: 582965 - RNA, 19 nt, Homo sapiens
cacaggaacuucauuaucc

SEQ ID NO: 582966 - RNA, 19 nt, Homo sapiens
ggagugugaaggaguuuga

SEQ ID NO: 582967 - RNA, 19 nt, Homo sapiens
gacaagagggacaagguau

SEQ ID NO: 582968 - RNA, 19 nt, Homo sapiens
ggaacauccuccacugacu

SEQ ID NO: 582969 - RNA, 19 nt, Homo sapiens
cauguacgacccuaagaaa

SEQ ID NO: 582970 - RNA, 19 nt, Homo sapiens
ccuauggugucccaguaaa

SEQ ID NO: 582971 - RNA, 19 nt, Homo sapiens
gggaugagagggcccagaa

SEQ ID NO: 582972 - RNA, 19 nt, Homo sapiens
guaccuacggcauugugua

SEQ ID NO: 582973 - RNA, 19 nt, Homo sapiens
guuuccaacuugcucauga

SEQ ID NO: 582974 - RNA, 19 nt, Homo sapiens
gagaagcugaaccgcauug

SEQ ID NO: 582975 - RNA, 19 nt, Homo sapiens
gaugcugagcgaagcuaua

SEQ ID NO: 582976 - RNA, 19 nt, Homo sapiens
gaagcugaaccgcauugga

SEQ ID NO: 582977 - RNA, 19 nt, Homo sapiens
gaagcagcccuacaacaac

SEQ ID NO: 582978 - RNA, 19 nt, Homo sapiens
ccaccagcaucgacaugug

SEQ ID NO: 582979 - RNA, 19 nt, Homo sapiens
cugcacaggaacuucauua

SEQ ID NO: 582980 - RNA, 19 nt, Homo sapiens
gaacaucguggagcugaag

SEQ ID NO: 582981 - RNA, 19 nt, Homo sapiens
ggauggacaaggagaagga

SEQ ID NO: 582982 - RNA, 19 nt, Homo sapiens
gcuggaggcugagcuggau

SEQ ID NO: 582983 - RNA, 19 nt, Homo sapiens
gccggagugugaaggaguu

SEQ ID NO: 582984 - RNA, 19 nt, Homo sapiens
gaugagauugucgcacuga

SEQ ID NO: 582985 - RNA, 19 nt, Homo sapiens
gggacacccagacagauga

SEQ ID NO: 582986 - RNA, 19 nt, Homo sapiens
uggcaggacuccagaugag

SEQ ID NO: 582987 - RNA, 19 nt, Homo sapiens
cugcugcacuuccuguuca

SEQ ID NO: 582988 - RNA, 19 nt, Homo sapiens
caaccugaagcacaaguuc

SEQ ID NO: 582989 - RNA, 19 nt, Homo sapiens
gugugaagacagcggauuu

SEQ ID NO: 582990 - RNA, 19 nt, Homo sapiens
gcacuuccuguucauguac

SEQ ID NO: 582991 - RNA, 19 nt, Homo sapiens
cgaacaucguggagcugaa

SEQ ID NO: 582992 - RNA, 19 nt, Homo sapiens
caagagggacaagguaugg

SEQ ID NO: 582993 - RNA, 19 nt, Homo sapiens
ggacuccagaugaggacaa

SEQ ID NO: 582994 - RNA, 19 nt, Homo sapiens
ucauguacgacccuaagaa

SEQ ID NO: 582995 - RNA, 19 nt, Homo sapiens
ugcacuuccuguucaugua

SEQ ID NO: 582996 - RNA, 19 nt, Homo sapiens
cuuccgagauccaccagau

SEQ ID NO: 582997 - RNA, 19 nt, Homo sapiens
ggagccacaauugaggaua

SEQ ID NO: 582998 - RNA, 19 nt, Homo sapiens
ccuccucgcuauguuggaa

SEQ ID NO: 582999 - RNA, 19 nt, Homo sapiens
agauccgucugaaguguau

SEQ ID NO: 583000 - RNA, 19 nt, Homo sapiens
caaggguugugugaagaca

SEQ ID NO: 583001 - RNA, 19 nt, Homo sapiens
ccacgcagaccaccagcau

SEQ ID NO: 583002 - RNA, 19 nt, Homo sapiens
acaggaacuucauuaucca

SEQ ID NO: 583003 - RNA, 19 nt, Homo sapiens
ggaagcagcccuacaacaa

SEQ ID NO: 583004 - RNA, 19 nt, Homo sapiens
uauaggcucuuguuggaua

SEQ ID NO: 583005 - RNA, 19 nt, Homo sapiens
gcuauaggcucuuguugga

SEQ ID NO: 583006 - RNA, 19 nt, Homo sapiens
cgucugaaguguauucgua

SEQ ID NO: 583007 - RNA, 19 nt, Homo sapiens
ggacaagagggacaaggua

SEQ ID NO: 583008 - RNA, 19 nt, Homo sapiens
gaucaguggugucugugaa

SEQ ID NO: 583009 - RNA, 19 nt, Homo sapiens
gcacaggaacuucauuauc

SEQ ID NO: 583010 - RNA, 19 nt, Homo sapiens
gaacauccuccacugacuu

SEQ ID NO: 583011 - RNA, 19 nt, Homo sapiens
acaacaaccugaagcacaa

SEQ ID NO: 583012 - RNA, 19 nt, Homo sapiens
ggaaccaccuggagagcau

SEQ ID NO: 583013 - RNA, 19 nt, Homo sapiens
gaugagagggcccagaaga

SEQ ID NO: 583014 - RNA, 19 nt, Homo sapiens
gaacugcuguugggaacca

SEQ ID NO: 583015 - RNA, 19 nt, Homo sapiens
gaagcuauaggcucuuguu

SEQ ID NO: 583016 - RNA, 19 nt, Homo sapiens
uccauuaucugcacaggaa

SEQ ID NO: 583017 - RNA, 19 nt, Homo sapiens
gagauugucgcacugaaga

SEQ ID NO: 583018 - RNA, 19 nt, Homo sapiens
ggccuauggugucccagua

SEQ ID NO: 583019 - RNA, 19 nt, Homo sapiens
ccugaagguuuccaacuug

SEQ ID NO: 583020 - RNA, 19 nt, Homo sapiens
ugaagaaggugcggaugga

SEQ ID NO: 583021 - RNA, 19 nt, Homo sapiens
ugaaguguauucguaagga

SEQ ID NO: 583022 - RNA, 19 nt, Homo sapiens
gcgaagcuauaggcucuug

SEQ ID NO: 583023 - RNA, 19 nt, Homo sapiens
gagccacaauugaggauac

SEQ ID NO: 583024 - RNA, 19 nt, Homo sapiens
cacaggaacuucauuaucc

SEQ ID NO: 583025 - RNA, 19 nt, Homo sapiens
gacaagagggacaagguau

SEQ ID NO: 583026 - RNA, 19 nt, Homo sapiens
ggaacauccuccacugacu

SEQ ID NO: 583027 - RNA, 19 nt, Homo sapiens
ggccagagcaagcgcugua

SEQ ID NO: 583028 - RNA, 19 nt, Homo sapiens
cauguacgacccuaagaaa

SEQ ID NO: 583029 - RNA, 19 nt, Homo sapiens
ccuauggugucccaguaaa

SEQ ID NO: 583030 - RNA, 19 nt, Homo sapiens
gggaugagagggcccagaa

SEQ ID NO: 583031 - RNA, 19 nt, Homo sapiens
guuuccaacuugcucauga

SEQ ID NO: 583032 - RNA, 19 nt, Homo sapiens
gaugcugagcgaagcuaua

SEQ ID NO: 583033 - RNA, 19 nt, Homo sapiens
gaagcagcccuacaacaac

SEQ ID NO: 583034 - RNA, 19 nt, Homo sapiens
ccaccagcaucgacaugug

SEQ ID NO: 583035 - RNA, 19 nt, Homo sapiens
gauggcacuuggugacaca

SEQ ID NO: 583036 - RNA, 19 nt, Homo sapiens
cugcacaggaacuucauua

SEQ ID NO: 583037 - RNA, 19 nt, Homo sapiens
gaacaucguggagcugaag

SEQ ID NO: 583038 - RNA, 19 nt, Homo sapiens
ggauggacaaggagaagga

SEQ ID NO: 583039 - RNA, 19 nt, Homo sapiens
gcuggaggcugagcuggau

SEQ ID NO: 583040 - RNA, 19 nt, Homo sapiens
gaugagauugucgcacuga

SEQ ID NO: 583041 - RNA, 19 nt, Homo sapiens
gggacacccagacagauga

SEQ ID NO: 583042 - RNA, 19 nt, Homo sapiens
uggcaggacuccagaugag

SEQ ID NO: 583043 - RNA, 19 nt, Homo sapiens
cugcugcacuuccuguuca

SEQ ID NO: 583044 - RNA, 19 nt, Homo sapiens
caaccugaagcacaaguuc

SEQ ID NO: 583045 - RNA, 19 nt, Homo sapiens
ccagagcaagcgcuguaaa

SEQ ID NO: 583046 - RNA, 19 nt, Homo sapiens
caccaggucuuccgaucag

SEQ ID NO: 583047 - RNA, 19 nt, Homo sapiens
gcacuuccuguucauguac

SEQ ID NO: 583048 - RNA, 19 nt, Homo sapiens
cgaacaucguggagcugaa

SEQ ID NO: 583049 - RNA, 19 nt, Homo sapiens
caagagggacaagguaugg

SEQ ID NO: 583050 - RNA, 19 nt, Homo sapiens
ggacuccagaugaggacaa

SEQ ID NO: 583051 - RNA, 19 nt, Homo sapiens
ucauguacgacccuaagaa

SEQ ID NO: 583052 - RNA, 19 nt, Homo sapiens
ugcacuuccuguucaugua

SEQ ID NO: 583053 - RNA, 19 nt, Homo sapiens
cuuccgagauccaccagau

SEQ ID NO: 583054 - RNA, 19 nt, Homo sapiens
ggagccacaauugaggaua

SEQ ID NO: 583055 - RNA, 19 nt, Homo sapiens
ccuccucgcuauguuggaa

SEQ ID NO: 583056 - RNA, 19 nt, Homo sapiens
aucagcagcuugcgggaaa

SEQ ID NO: 583057 - RNA, 19 nt, Homo sapiens
agauccgucugaaguguau

SEQ ID NO: 583058 - RNA, 19 nt, Homo sapiens
gacaggugggugcaacuug

SEQ ID NO: 583059 - RNA, 19 nt, Homo sapiens
caaggguugugugaagaca

SEQ ID NO: 583060 - RNA, 19 nt, Homo sapiens
ucacggugccuccggaaca

SEQ ID NO: 583061 - RNA, 19 nt, Homo sapiens
ccacgcagaccaccagcau

SEQ ID NO: 583062 - RNA, 19 nt, Homo sapiens
acaggaacuucauuaucca

SEQ ID NO: 583063 - RNA, 19 nt, Homo sapiens
gaaaggcgaugaucauaaa

SEQ ID NO: 583064 - RNA, 19 nt, Homo sapiens
ggaaauauauucagggauu

SEQ ID NO: 583065 - RNA, 19 nt, Homo sapiens
gagaauacgugaaggcaaa

SEQ ID NO: 583066 - RNA, 19 nt, Homo sapiens
cagagaagauuaugugaaa

SEQ ID NO: 583067 - RNA, 19 nt, Homo sapiens
gaaccaaucagacuauuug

SEQ ID NO: 583068 - RNA, 19 nt, Homo sapiens
gaaggcaaaugaugcuuau

SEQ ID NO: 583069 - RNA, 19 nt, Homo sapiens
gaaacucagcggaaauaua

SEQ ID NO: 583070 - RNA, 19 nt, Homo sapiens
ggaguacaaugcacuguga

SEQ ID NO: 583071 - RNA, 19 nt, Homo sapiens
gcgggaaacuggagcuuaa

SEQ ID NO: 583072 - RNA, 19 nt, Homo sapiens
caacaggaaugaggaaaga

SEQ ID NO: 583073 - RNA, 19 nt, Homo sapiens
ggaaaggcgaugaucauaa

SEQ ID NO: 583074 - RNA, 19 nt, Homo sapiens
ccaaauguguggaguacaa

SEQ ID NO: 583075 - RNA, 19 nt, Homo sapiens
gaggauggacuuaauuauu

SEQ ID NO: 583076 - RNA, 19 nt, Homo sapiens
caccacaauugaagaguua

SEQ ID NO: 583077 - RNA, 19 nt, Homo sapiens
gaaacuggagcuuaaauuc

SEQ ID NO: 583078 - RNA, 19 nt, Homo sapiens
gcuguggacuucuggaauu

SEQ ID NO: 583079 - RNA, 19 nt, Homo sapiens
aaacucagcggaaauauau

SEQ ID NO: 583080 - RNA, 19 nt, Homo sapiens
gaacagugcgacccagaaa

SEQ ID NO: 583081 - RNA, 19 nt, Homo sapiens
gaaucuuccugcugauauu

SEQ ID NO: 583082 - RNA, 19 nt, Homo sapiens
gaaauauauucagggauug

SEQ ID NO: 583083 - RNA, 19 nt, Homo sapiens
ugaaagauguggcuacaag

SEQ ID NO: 583084 - RNA, 19 nt, Homo sapiens
gaucagcaguaccucaaug

SEQ ID NO: 583085 - RNA, 19 nt, Homo sapiens
gaaagaggagaaccaauca

SEQ ID NO: 583086 - RNA, 19 nt, Homo sapiens
ggaauuaccaacaggaaug

SEQ ID NO: 583087 - RNA, 19 nt, Homo sapiens
ugacgaaacucagcggaaa

SEQ ID NO: 583088 - RNA, 19 nt, Homo sapiens
ggcaagaggucaucagaag

SEQ ID NO: 583089 - RNA, 19 nt, Homo sapiens
ggaagcauauuuugaaaga

SEQ ID NO: 583090 - RNA, 19 nt, Homo sapiens
ggaaacuggagcuuaaauu

SEQ ID NO: 583091 - RNA, 19 nt, Homo sapiens
caaaugaugcuuaucuuca

SEQ ID NO: 583092 - RNA, 19 nt, Homo sapiens
ccaaauuccugaaguuucu

SEQ ID NO: 583093 - RNA, 19 nt, Homo sapiens
gcuacaagauacagccaaa

SEQ ID NO: 583094 - RNA, 19 nt, Homo sapiens
cgaaaguugugguuagaug

SEQ ID NO: 583095 - RNA, 19 nt, Homo sapiens
ggauugaagagguuaauga

SEQ ID NO: 583096 - RNA, 19 nt, Homo sapiens
gaaagcagccuuggauaag

SEQ ID NO: 583097 - RNA, 19 nt, Homo sapiens
ugaaagcagccuuggauaa

SEQ ID NO: 583098 - RNA, 19 nt, Homo sapiens
gaccagaaaccauuaacuu

SEQ ID NO: 583099 - RNA, 19 nt, Homo sapiens
gaaaguugugguuagauga

SEQ ID NO: 583100 - RNA, 19 nt, Homo sapiens
gaaguuaacaagggauuga

SEQ ID NO: 583101 - RNA, 19 nt, Homo sapiens
ggauggacuuaauuauuuc

SEQ ID NO: 583102 - RNA, 19 nt, Homo sapiens
gaacuuuguuggccuucau

SEQ ID NO: 583103 - RNA, 19 nt, Homo sapiens
gcagagagaauacgugaag

SEQ ID NO: 583104 - RNA, 19 nt, Homo sapiens
ucaccaaauuccugaaguu

SEQ ID NO: 583105 - RNA, 19 nt, Homo sapiens
ggaaugaggaaagaagaaa

SEQ ID NO: 583106 - RNA, 19 nt, Homo sapiens
cuacagacccauccaaaug

SEQ ID NO: 583107 - RNA, 19 nt, Homo sapiens
aagaagaggaagcauauuu

SEQ ID NO: 583108 - RNA, 19 nt, Homo sapiens
agaauugaaugccagagaa

SEQ ID NO: 583109 - RNA, 19 nt, Homo sapiens
ggacaucaucaccaaauuc

SEQ ID NO: 583110 - RNA, 19 nt, Homo sapiens
gagaaccaaucagacuauu

SEQ ID NO: 583111 - RNA, 19 nt, Homo sapiens
ggaggaccagaaaccauua

SEQ ID NO: 583112 - RNA, 19 nt, Homo sapiens
gcaaaugaugcuuaucuuc

SEQ ID NO: 583113 - RNA, 19 nt, Homo sapiens
ggagaaccaaucagacuau

SEQ ID NO: 583114 - RNA, 19 nt, Homo sapiens
ugauguaacucuugauugg

SEQ ID NO: 583115 - RNA, 19 nt, Homo sapiens
ggaagcaggcuguggacuu

SEQ ID NO: 583116 - RNA, 19 nt, Homo sapiens
gcccaucggugucacuaug

SEQ ID NO: 583117 - RNA, 19 nt, Homo sapiens
gaccgaguccuaccuaaga

SEQ ID NO: 583118 - RNA, 19 nt, Homo sapiens
gggaaaggcgaugaucaua

SEQ ID NO: 583119 - RNA, 19 nt, Homo sapiens
ccagaaaccauuaacuuca

SEQ ID NO: 583120 - RNA, 19 nt, Homo sapiens
ggcaaaugaugcuuaucuu

SEQ ID NO: 583121 - RNA, 19 nt, Homo sapiens
gagauggacauucugaaau

SEQ ID NO: 583122 - RNA, 19 nt, Homo sapiens
cgagauggacauucugaaa

SEQ ID NO: 583123 - RNA, 19 nt, Homo sapiens
cguuugggcuaaagaauug

SEQ ID NO: 583124 - RNA, 19 nt, Homo sapiens
gaagacacacagaaugauc

SEQ ID NO: 583125 - RNA, 19 nt, Homo sapiens
gaggucaucagaagauuga

SEQ ID NO: 583126 - RNA, 19 nt, Homo sapiens
caagaggucaucagaagau

SEQ ID NO: 583127 - RNA, 19 nt, Homo sapiens
ugaaggcaaaugaugcuua

SEQ ID NO: 583128 - RNA, 19 nt, Homo sapiens
agaaacagaccgaguccua

SEQ ID NO: 583129 - RNA, 19 nt, Homo sapiens
cagaaaccauuaacuucau

SEQ ID NO: 583130 - RNA, 19 nt, Homo sapiens
gaggaagacacacagaaug

SEQ ID NO: 583131 - RNA, 19 nt, Homo sapiens
gagaggaagacacacagaa

SEQ ID NO: 583132 - RNA, 19 nt, Homo sapiens
cagcaguaccucaaugaaa

SEQ ID NO: 583133 - RNA, 19 nt, Homo sapiens
gaaagauguggcuacaaga

SEQ ID NO: 583134 - RNA, 19 nt, Homo sapiens
ggagaguccuuagggaaag

SEQ ID NO: 583135 - RNA, 19 nt, Homo sapiens
aacaagggauugaggaaug

SEQ ID NO: 583136 - RNA, 19 nt, Homo sapiens
gcaagaggucaucagaaga

SEQ ID NO: 583137 - RNA, 19 nt, Homo sapiens
ugaaugccagagaagauua

SEQ ID NO: 583138 - RNA, 19 nt, Homo sapiens
gaggaaugauuugaaagca

SEQ ID NO: 583139 - RNA, 19 nt, Homo sapiens
auaaagacauggacaucau

SEQ ID NO: 583140 - RNA, 19 nt, Homo sapiens
gauggacauucugaaauca

SEQ ID NO: 583141 - RNA, 19 nt, Homo sapiens
caucgaauccaguguuaga

SEQ ID NO: 583142 - RNA, 19 nt, Homo sapiens
ucaguugacccgaaaguug

SEQ ID NO: 583143 - RNA, 19 nt, Homo sapiens
agauggacauucugaaauc

SEQ ID NO: 583144 - RNA, 19 nt, Homo sapiens
gaggaaaacaccacaauug

SEQ ID NO: 583145 - RNA, 19 nt, Homo sapiens
aaagcagccuuggauaaga

SEQ ID NO: 583146 - RNA, 19 nt, Homo sapiens
gauccucacaccagaaguu

SEQ ID NO: 583147 - RNA, 19 nt, Homo sapiens
uuggagagacugauuauga

SEQ ID NO: 583148 - RNA, 19 nt, Homo sapiens
gaauuaccaacaggaauga

SEQ ID NO: 583149 - RNA, 19 nt, Homo sapiens
ucagauggccauuggaaau

SEQ ID NO: 583150 - RNA, 19 nt, Homo sapiens
cugcugauauuaaagaauc

SEQ ID NO: 583151 - RNA, 19 nt, Homo sapiens
acaccacaauugaagaguu

SEQ ID NO: 583152 - RNA, 19 nt, Homo sapiens
aucagaagauugagagaaa

SEQ ID NO: 583153 - RNA, 19 nt, Homo sapiens
ccauuaacuucaucgaauc

SEQ ID NO: 583154 - RNA, 19 nt, Homo sapiens
uguguaugguguguuaaua

SEQ ID NO: 583155 - RNA, 19 nt, Homo sapiens
ccagagaagauuaugugaa

SEQ ID NO: 583156 - RNA, 19 nt, Homo sapiens
agcaguaccucaaugaaau

SEQ ID NO: 583157 - RNA, 19 nt, Homo sapiens
ggagagacugauuaugaug

SEQ ID NO: 583158 - RNA, 19 nt, Homo sapiens
agaaagaggagaaccaauc

SEQ ID NO: 583159 - RNA, 19 nt, Homo sapiens
gaggaagcauauuuugaaa

SEQ ID NO: 583160 - RNA, 19 nt, Homo sapiens
ggaaaacaccacaauugaa

SEQ ID NO: 583161 - RNA, 19 nt, Homo sapiens
acaagggauugaggaauga

SEQ ID NO: 583162 - RNA, 19 nt, Homo sapiens
gaaaauagagauccucaca

SEQ ID NO: 583163 - RNA, 19 nt, Homo sapiens
gagauaaaguccuugauga

SEQ ID NO: 583164 - RNA, 19 nt, Homo sapiens
ggaauuaaauccuuagucu

SEQ ID NO: 583165 - RNA, 19 nt, Homo sapiens
gaugaaaccugaucccaau

SEQ ID NO: 583166 - RNA, 19 nt, Homo sapiens
gggauuccauauucaauuu

SEQ ID NO: 583167 - RNA, 19 nt, Homo sapiens
acaggaaacuugugacuug

SEQ ID NO: 583168 - RNA, 19 nt, Homo sapiens
gagagauggugcuggagua

SEQ ID NO: 583169 - RNA, 19 nt, Homo sapiens
ugugauggaugauacaaua

SEQ ID NO: 583170 - RNA, 19 nt, Homo sapiens
ucacuacaauuccuggaua

SEQ ID NO: 583171 - RNA, 19 nt, Homo sapiens
gggagauccuggcaaagua

SEQ ID NO: 583172 - RNA, 19 nt, Homo sapiens
gaaaccugaucccaauuug

SEQ ID NO: 583173 - RNA, 19 nt, Homo sapiens
cagccuuacucauaaauaa

SEQ ID NO: 583174 - RNA, 19 nt, Homo sapiens
uuacguaucuggaaguuau

SEQ ID NO: 583175 - RNA, 19 nt, Homo sapiens
gauaaaguccuugaugaaa

SEQ ID NO: 583176 - RNA, 19 nt, Homo sapiens
guacagccuuacucauaaa

SEQ ID NO: 583177 - RNA, 19 nt, Homo sapiens
caaccucccucacuacaau

SEQ ID NO: 583178 - RNA, 19 nt, Homo sapiens
gaaaauagcagcugaauac

SEQ ID NO: 583179 - RNA, 19 nt, Homo sapiens
uggaaucgcugguuuggaa

SEQ ID NO: 583180 - RNA, 19 nt, Homo sapiens
caaugacucuggcuauuca

SEQ ID NO: 583181 - RNA, 19 nt, Homo sapiens
acuugugacuuguguauua

SEQ ID NO: 583182 - RNA, 19 nt, Homo sapiens
ggaaacuugugacuugugu

SEQ ID NO: 583183 - RNA, 19 nt, Homo sapiens
caauuuccuuuaagaggua

SEQ ID NO: 583184 - RNA, 19 nt, Homo sapiens
gagcauuacauguucuuaa

SEQ ID NO: 583185 - RNA, 19 nt, Homo sapiens
gguaucacauggaucauca

SEQ ID NO: 583186 - RNA, 19 nt, Homo sapiens
ucacucaugucugucauuu

SEQ ID NO: 583187 - RNA, 19 nt, Homo sapiens
ggauaaaaguacuguauga

SEQ ID NO: 583188 - RNA, 19 nt, Homo sapiens
ccaaaccaauuacguaucu

SEQ ID NO: 583189 - RNA, 19 nt, Homo sapiens
uaagagguaucacauggau

SEQ ID NO: 583190 - RNA, 19 nt, Homo sapiens
gcaaagcaauguggaaucg

SEQ ID NO: 583191 - RNA, 19 nt, Homo sapiens
uguacagccuuacucauaa

SEQ ID NO: 583192 - RNA, 19 nt, Homo sapiens
gaggauguuucacucaugu

SEQ ID NO: 583193 - RNA, 19 nt, Homo sapiens
caaagggauucuucuccaa

SEQ ID NO: 583194 - RNA, 19 nt, Homo sapiens
uacaauaagucccuacuca

SEQ ID NO: 583195 - RNA, 19 nt, Homo sapiens
gcguuuggcaguugcauua

SEQ ID NO: 583196 - RNA, 19 nt, Homo sapiens
ugaauccuguacagccuua

SEQ ID NO: 583197 - RNA, 19 nt, Homo sapiens
uggcacaauuucagaguaa

SEQ ID NO: 583198 - RNA, 19 nt, Homo sapiens
cauguuggcagcaucuuua

SEQ ID NO: 583199 - RNA, 19 nt, Homo sapiens
cuauaugggacccgaauua

SEQ ID NO: 583200 - RNA, 19 nt, Homo sapiens
gguuuggaauguuugcuaa

SEQ ID NO: 583201 - RNA, 19 nt, Homo sapiens
uuacugaauuuccaccauu

SEQ ID NO: 583202 - RNA, 19 nt, Homo sapiens
uggcgucgauguagauauu

SEQ ID NO: 583203 - RNA, 19 nt, Homo sapiens
cuauugggauuccauauuc

SEQ ID NO: 583204 - RNA, 19 nt, Homo sapiens
gaaaccccaucucuacuaa

SEQ ID NO: 583205 - RNA, 19 nt, Homo sapiens
acucaugucugucauuuua

SEQ ID NO: 583206 - RNA, 19 nt, Homo sapiens
auaagucccuacucaagaa

SEQ ID NO: 583207 - RNA, 19 nt, Homo sapiens
gccgggagauccuggcaaa

SEQ ID NO: 583208 - RNA, 19 nt, Homo sapiens
uuaugggccucugaauuua

SEQ ID NO: 583209 - RNA, 19 nt, Homo sapiens
uagcugagcauuacauguu

SEQ ID NO: 583210 - RNA, 19 nt, Homo sapiens
ggacuggaaaugggucaua

SEQ ID NO: 583211 - RNA, 19 nt, Homo sapiens
ggaguaaauaucauuagug

SEQ ID NO: 583212 - RNA, 19 nt, Homo sapiens
gauggaugauacaauaagu

SEQ ID NO: 583213 - RNA, 19 nt, Homo sapiens
ugaaaccugaucccaauuu

SEQ ID NO: 583214 - RNA, 19 nt, Homo sapiens
cgaauuagacacugcugaa

SEQ ID NO: 583215 - RNA, 19 nt, Homo sapiens
uaaaagacuuggacuggaa

SEQ ID NO: 583216 - RNA, 19 nt, Homo sapiens
gaccagugaugcucagaag

SEQ ID NO: 583217 - RNA, 19 nt, Homo sapiens
gaucccaauuugauaugga

SEQ ID NO: 583218 - RNA, 19 nt, Homo sapiens
ccuauaaucccagcacuuu

SEQ ID NO: 583219 - RNA, 19 nt, Homo sapiens
gcacaauuucagaguaaga

SEQ ID NO: 583220 - RNA, 19 nt, Homo sapiens
gccgacagcuagucugcaa

SEQ ID NO: 583221 - RNA, 19 nt, Homo sapiens
aaauagcagcugaauacua

SEQ ID NO: 583222 - RNA, 19 nt, Homo sapiens
gagggcugguucuucugua

SEQ ID NO: 583223 - RNA, 19 nt, Homo sapiens
uagauauuccuaccgauuu

SEQ ID NO: 583224 - RNA, 19 nt, Homo sapiens
gcuggaguaaauaucauua

SEQ ID NO: 583225 - RNA, 19 nt, Homo sapiens
auuaugggccucugaauuu

SEQ ID NO: 583226 - RNA, 19 nt, Homo sapiens
cacgguggcucaugccuau

SEQ ID NO: 583227 - RNA, 19 nt, Homo sapiens
aguaagagcucggugauac

SEQ ID NO: 583228 - RNA, 19 nt, Homo sapiens
caauaagucccuacucaag

SEQ ID NO: 583229 - RNA, 19 nt, Homo sapiens
cuguacagccuuacucaua

SEQ ID NO: 583230 - RNA, 19 nt, Homo sapiens
gaagugaaucuggcuuuua

SEQ ID NO: 583231 - RNA, 19 nt, Homo sapiens
agauggugcuggaguaaau

SEQ ID NO: 583232 - RNA, 19 nt, Homo sapiens
gcagcugaauacuaugaca

SEQ ID NO: 583233 - RNA, 19 nt, Homo sapiens
ggagauccuggcaaaguau

SEQ ID NO: 583234 - RNA, 19 nt, Homo sapiens
ucgcugguuuggaauguuu

SEQ ID NO: 583235 - RNA, 19 nt, Homo sapiens
cacaguguauuaguauuug

SEQ ID NO: 583236 - RNA, 19 nt, Homo sapiens
gcuauuaaucacaguguau

SEQ ID NO: 583237 - RNA, 19 nt, Homo sapiens
cacuacaauuccuggauaa

SEQ ID NO: 583238 - RNA, 19 nt, Homo sapiens
gagcgagagccgacagcua

SEQ ID NO: 583239 - RNA, 19 nt, Homo sapiens
uugcuaaucuuccuauugg

SEQ ID NO: 583240 - RNA, 19 nt, Homo sapiens
aaacuugugacuuguguau

SEQ ID NO: 583241 - RNA, 19 nt, Homo sapiens
gaguaagagcucggugaua

SEQ ID NO: 583242 - RNA, 19 nt, Homo sapiens
gacuggaaaugggucauau

SEQ ID NO: 583243 - RNA, 19 nt, Homo sapiens
cauuacauguucuuaaagg

SEQ ID NO: 583244 - RNA, 19 nt, Homo sapiens
gcacccaauuucuggacau

SEQ ID NO: 583245 - RNA, 19 nt, Homo sapiens
gagcugauggcgucgaugu

SEQ ID NO: 583246 - RNA, 19 nt, Homo sapiens
aauguggaaucgcugguuu

SEQ ID NO: 583247 - RNA, 19 nt, Homo sapiens
ccugagguaugauauagca

SEQ ID NO: 583248 - RNA, 19 nt, Homo sapiens
aggcugaggugggagaauu

SEQ ID NO: 583249 - RNA, 19 nt, Homo sapiens
ggugauaccaagaagugaa

SEQ ID NO: 583250 - RNA, 19 nt, Homo sapiens
gaaugaagaggcaccaaaa

SEQ ID NO: 583251 - RNA, 19 nt, Homo sapiens
agauaaaguccuugaugaa

SEQ ID NO: 583252 - RNA, 19 nt, Homo sapiens
gaauuagacacugcugaau

SEQ ID NO: 583253 - RNA, 19 nt, Homo sapiens
agagauaaaguccuugaug

SEQ ID NO: 583254 - RNA, 19 nt, Homo sapiens
aaagggauucuucuccaaa

SEQ ID NO: 583255 - RNA, 19 nt, Homo sapiens
gggccucugaauuuacuua

SEQ ID NO: 583256 - RNA, 19 nt, Homo sapiens
ccagagauaaaguccuuga

SEQ ID NO: 583257 - RNA, 19 nt, Homo sapiens
gcagugacccaagauugug

SEQ ID NO: 583258 - RNA, 19 nt, Homo sapiens
auaaaguccuugaugaaac

SEQ ID NO: 583259 - RNA, 19 nt, Homo sapiens
ggaaaauagcagcugaaua

SEQ ID NO: 583260 - RNA, 19 nt, Homo sapiens
uauuaugggccucugaauu

SEQ ID NO: 583261 - RNA, 19 nt, Homo sapiens
guucuuaaagggucaugaa

SEQ ID NO: 583262 - RNA, 19 nt, Homo sapiens
uggaauguuugcuaaucuu

SEQ ID NO: 583263 - RNA, 19 nt, Homo sapiens
gagauaaaguccuugauga

SEQ ID NO: 583264 - RNA, 19 nt, Homo sapiens
ggaauuaaauccuuagucu

SEQ ID NO: 583265 - RNA, 19 nt, Homo sapiens
gaugaaaccugaucccaau

SEQ ID NO: 583266 - RNA, 19 nt, Homo sapiens
gggauuccauauucaauuu

SEQ ID NO: 583267 - RNA, 19 nt, Homo sapiens
gagagauggugcuggagua

SEQ ID NO: 583268 - RNA, 19 nt, Homo sapiens
ugugauggaugauacaaua

SEQ ID NO: 583269 - RNA, 19 nt, Homo sapiens
ucacuacaauuccuggaua

SEQ ID NO: 583270 - RNA, 19 nt, Homo sapiens
gggagauccuggcaaagua

SEQ ID NO: 583271 - RNA, 19 nt, Homo sapiens
gaaaccugaucccaauuug

SEQ ID NO: 583272 - RNA, 19 nt, Homo sapiens
cagccuuacucauaaauaa

SEQ ID NO: 583273 - RNA, 19 nt, Homo sapiens
uuacguaucuggaaguuau

SEQ ID NO: 583274 - RNA, 19 nt, Homo sapiens
gauaaaguccuugaugaaa

SEQ ID NO: 583275 - RNA, 19 nt, Homo sapiens
guacagccuuacucauaaa

SEQ ID NO: 583276 - RNA, 19 nt, Homo sapiens
caaccucccucacuacaau

SEQ ID NO: 583277 - RNA, 19 nt, Homo sapiens
gaaaauagcagcugaauac

SEQ ID NO: 583278 - RNA, 19 nt, Homo sapiens
uggaaucgcugguuuggaa

SEQ ID NO: 583279 - RNA, 19 nt, Homo sapiens
caaugacucuggcuauuca

SEQ ID NO: 583280 - RNA, 19 nt, Homo sapiens
caauuuccuuuaagaggua

SEQ ID NO: 583281 - RNA, 19 nt, Homo sapiens
gagcauuacauguucuuaa

SEQ ID NO: 583282 - RNA, 19 nt, Homo sapiens
gguaucacauggaucauca

SEQ ID NO: 583283 - RNA, 19 nt, Homo sapiens
ggauaaaaguacuguauga

SEQ ID NO: 583284 - RNA, 19 nt, Homo sapiens
ccaaaccaauuacguaucu

SEQ ID NO: 583285 - RNA, 19 nt, Homo sapiens
uaagagguaucacauggau

SEQ ID NO: 583286 - RNA, 19 nt, Homo sapiens
gcaaagcaauguggaaucg

SEQ ID NO: 583287 - RNA, 19 nt, Homo sapiens
uguacagccuuacucauaa

SEQ ID NO: 583288 - RNA, 19 nt, Homo sapiens
caaagggauucuucuccaa

SEQ ID NO: 583289 - RNA, 19 nt, Homo sapiens
uacaauaagucccuacuca

SEQ ID NO: 583290 - RNA, 19 nt, Homo sapiens
gcguuuggcaguugcauua

SEQ ID NO: 583291 - RNA, 19 nt, Homo sapiens
ugaauccuguacagccuua

SEQ ID NO: 583292 - RNA, 19 nt, Homo sapiens
cauguuggcagcaucuuua

SEQ ID NO: 583293 - RNA, 19 nt, Homo sapiens
cuauaugggacccgaauua

SEQ ID NO: 583294 - RNA, 19 nt, Homo sapiens
gguuuggaauguuugcuaa

SEQ ID NO: 583295 - RNA, 19 nt, Homo sapiens
uuacugaauuuccaccauu

SEQ ID NO: 583296 - RNA, 19 nt, Homo sapiens
uggcgucgauguagauauu

SEQ ID NO: 583297 - RNA, 19 nt, Homo sapiens
cuauugggauuccauauuc

SEQ ID NO: 583298 - RNA, 19 nt, Homo sapiens
auaagucccuacucaagaa

SEQ ID NO: 583299 - RNA, 19 nt, Homo sapiens
uuaugggccucugaauuua

SEQ ID NO: 583300 - RNA, 19 nt, Homo sapiens
uagcugagcauuacauguu

SEQ ID NO: 583301 - RNA, 19 nt, Homo sapiens
gccgggagauccuggcaaa

SEQ ID NO: 583302 - RNA, 19 nt, Homo sapiens
ggacuggaaaugggucaua

SEQ ID NO: 583303 - RNA, 19 nt, Homo sapiens
ggaguaaauaucauuagug

SEQ ID NO: 583304 - RNA, 19 nt, Homo sapiens
gauggaugauacaauaagu

SEQ ID NO: 583305 - RNA, 19 nt, Homo sapiens
ugaaaccugaucccaauuu

SEQ ID NO: 583306 - RNA, 19 nt, Homo sapiens
cgaauuagacacugcugaa

SEQ ID NO: 583307 - RNA, 19 nt, Homo sapiens
uaaaagacuuggacuggaa

SEQ ID NO: 583308 - RNA, 19 nt, Homo sapiens
gaucccaauuugauaugga

SEQ ID NO: 583309 - RNA, 19 nt, Homo sapiens
gccgacagcuagucugcaa

SEQ ID NO: 583310 - RNA, 19 nt, Homo sapiens
aaauagcagcugaauacua

SEQ ID NO: 583311 - RNA, 19 nt, Homo sapiens
gagggcugguucuucugua

SEQ ID NO: 583312 - RNA, 19 nt, Homo sapiens
uagauauuccuaccgauuu

SEQ ID NO: 583313 - RNA, 19 nt, Homo sapiens
gcuggaguaaauaucauua

SEQ ID NO: 583314 - RNA, 19 nt, Homo sapiens
auuaugggccucugaauuu

SEQ ID NO: 583315 - RNA, 19 nt, Homo sapiens
caauaagucccuacucaag

SEQ ID NO: 583316 - RNA, 19 nt, Homo sapiens
cuguacagccuuacucaua

SEQ ID NO: 583317 - RNA, 19 nt, Homo sapiens
agauggugcuggaguaaau

SEQ ID NO: 583318 - RNA, 19 nt, Homo sapiens
gcagcugaauacuaugaca

SEQ ID NO: 583319 - RNA, 19 nt, Homo sapiens
ggagauccuggcaaaguau

SEQ ID NO: 583320 - RNA, 19 nt, Homo sapiens
ucgcugguuuggaauguuu

SEQ ID NO: 583321 - RNA, 19 nt, Homo sapiens
cacaguguauuaguauuug

SEQ ID NO: 583322 - RNA, 19 nt, Homo sapiens
gcuauuaaucacaguguau

SEQ ID NO: 583323 - RNA, 19 nt, Homo sapiens
gagcgagagccgacagcua

SEQ ID NO: 583324 - RNA, 19 nt, Homo sapiens
cacuacaauuccuggauaa

SEQ ID NO: 583325 - RNA, 19 nt, Homo sapiens
uugcuaaucuuccuauugg

SEQ ID NO: 583326 - RNA, 19 nt, Homo sapiens
gacuggaaaugggucauau

SEQ ID NO: 583327 - RNA, 19 nt, Homo sapiens
cauuacauguucuuaaagg

SEQ ID NO: 583328 - RNA, 19 nt, Homo sapiens
gcacccaauuucuggacau

SEQ ID NO: 583329 - RNA, 19 nt, Homo sapiens
gagcugauggcgucgaugu

SEQ ID NO: 583330 - RNA, 19 nt, Homo sapiens
aauguggaaucgcugguuu

SEQ ID NO: 583331 - RNA, 19 nt, Homo sapiens
ccugagguaugauauagca

SEQ ID NO: 583332 - RNA, 19 nt, Homo sapiens
aggcugaggugggagaauu

SEQ ID NO: 583333 - RNA, 19 nt, Homo sapiens
gaaugaagaggcaccaaaa

SEQ ID NO: 583334 - RNA, 19 nt, Homo sapiens
agauaaaguccuugaugaa

SEQ ID NO: 583335 - RNA, 19 nt, Homo sapiens
gaauuagacacugcugaau

SEQ ID NO: 583336 - RNA, 19 nt, Homo sapiens
aaagggauucuucuccaaa

SEQ ID NO: 583337 - RNA, 19 nt, Homo sapiens
gggccucugaauuuacuua

SEQ ID NO: 583338 - RNA, 19 nt, Homo sapiens
agagauaaaguccuugaug

SEQ ID NO: 583339 - RNA, 19 nt, Homo sapiens
ccagagauaaaguccuuga

SEQ ID NO: 583340 - RNA, 19 nt, Homo sapiens
gcagugacccaagauugug

SEQ ID NO: 583341 - RNA, 19 nt, Homo sapiens
ggaaaauagcagcugaaua

SEQ ID NO: 583342 - RNA, 19 nt, Homo sapiens
uauuaugggccucugaauu

SEQ ID NO: 583343 - RNA, 19 nt, Homo sapiens
guucuuaaagggucaugaa

SEQ ID NO: 583344 - RNA, 19 nt, Homo sapiens
uggaauguuugcuaaucuu

SEQ ID NO: 583345 - RNA, 19 nt, Homo sapiens
auaaaguccuugaugaaac

SEQ ID NO: 583346 - RNA, 19 nt, Homo sapiens
gcaagaccccaucucaaaa

SEQ ID NO: 583347 - RNA, 19 nt, Homo sapiens
ugaugguucucacccaguu

SEQ ID NO: 583348 - RNA, 19 nt, Homo sapiens
agagguaucacauggauca

SEQ ID NO: 583349 - RNA, 19 nt, Homo sapiens
ccuauugggauuccauauu

SEQ ID NO: 583350 - RNA, 19 nt, Homo sapiens
cccaauuugauauggauua

SEQ ID NO: 583351 - RNA, 19 nt, Homo sapiens
gauggugcuggaguaaaua

SEQ ID NO: 583352 - RNA, 19 nt, Homo sapiens
agaaugaagaggcaccaaa

SEQ ID NO: 583353 - RNA, 19 nt, Homo sapiens
augacaaccucccucacua

SEQ ID NO: 583354 - RNA, 19 nt, Homo sapiens
uagcagcugaauacuauga

SEQ ID NO: 583355 - RNA, 19 nt, Homo sapiens
ggaauguuugcuaaucuuc

SEQ ID NO: 583356 - RNA, 19 nt, Homo sapiens
uaaaguccuugaugaaacc

SEQ ID NO: 583357 - RNA, 19 nt, Homo sapiens
gagauggugcuggaguaaa

SEQ ID NO: 583358 - RNA, 19 nt, Homo sapiens
aauaagucccuacucaaga

SEQ ID NO: 583359 - RNA, 19 nt, Homo sapiens
ccuaugcguuuggcaguug

SEQ ID NO: 583360 - RNA, 19 nt, Homo sapiens
guuggcagcaucuuuacuu

SEQ ID NO: 583361 - RNA, 19 nt, Homo sapiens
ugacucuggcuauucauga

SEQ ID NO: 583362 - RNA, 19 nt, Homo sapiens
acaauaagucccuacucaa

SEQ ID NO: 583363 - RNA, 19 nt, Homo sapiens
gaagaaauaugugacaaga

SEQ ID NO: 583364 - RNA, 19 nt, Homo sapiens
ggaaauagcaauugaaaca

SEQ ID NO: 583365 - RNA, 19 nt, Homo sapiens
ugaauuugcuguguuguua

SEQ ID NO: 583366 - RNA, 19 nt, Homo sapiens
ggaaaugguuaaagaagug

SEQ ID NO: 583367 - RNA, 19 nt, Homo sapiens
gagcaaagaagaaauaugu

SEQ ID NO: 583368 - RNA, 19 nt, Homo sapiens
guacacccaugcucaauau

SEQ ID NO: 583369 - RNA, 19 nt, Homo sapiens
caucgaagaucuuggagaa

SEQ ID NO: 583370 - RNA, 19 nt, Homo sapiens
gagcuauucuggagauuau

SEQ ID NO: 583371 - RNA, 19 nt, Homo sapiens
gcaaagaagaaauauguga

SEQ ID NO: 583372 - RNA, 19 nt, Homo sapiens
acaagaagcuggaauuagu

SEQ ID NO: 583373 - RNA, 19 nt, Homo sapiens
caaguuagaugccgauuac

SEQ ID NO: 583374 - RNA, 19 nt, Homo sapiens
aaacaugucuucucacaag

SEQ ID NO: 583375 - RNA, 19 nt, Homo sapiens
ggaagcauguuugguaaug

SEQ ID NO: 583376 - RNA, 19 nt, Homo sapiens
ccaaagugcugguauuaca

SEQ ID NO: 583377 - RNA, 19 nt, Homo sapiens
ggccagagguagaugauga

SEQ ID NO: 583378 - RNA, 19 nt, Homo sapiens
gauggugcauuguguggua

SEQ ID NO: 583379 - RNA, 19 nt, Homo sapiens
gaucuaaagcugagugauu

SEQ ID NO: 583380 - RNA, 19 nt, Homo sapiens
uaauagaucugugguugaa

SEQ ID NO: 583381 - RNA, 19 nt, Homo sapiens
gugaauauaugccugaugu

SEQ ID NO: 583382 - RNA, 19 nt, Homo sapiens
gacaaugguuagagaagaa

SEQ ID NO: 583383 - RNA, 19 nt, Homo sapiens
aaagaagacuugugguguu

SEQ ID NO: 583384 - RNA, 19 nt, Homo sapiens
gaaauaaucagccuugcau

SEQ ID NO: 583385 - RNA, 19 nt, Homo sapiens
ggaaugcaguggugugauc

SEQ ID NO: 583386 - RNA, 19 nt, Homo sapiens
agaaauaugugacaagagu

SEQ ID NO: 583387 - RNA, 19 nt, Homo sapiens
aaggaacagugccaaguua

SEQ ID NO: 583388 - RNA, 19 nt, Homo sapiens
ggaagaagaggagaagaaa

SEQ ID NO: 583389 - RNA, 19 nt, Homo sapiens
gaauauaugccugauguug

SEQ ID NO: 583390 - RNA, 19 nt, Homo sapiens
caaauaaacgggagacugu

SEQ ID NO: 583391 - RNA, 19 nt, Homo sapiens
uauguggccuugcaacuuu

SEQ ID NO: 583392 - RNA, 19 nt, Homo sapiens
guucacaguucuuagcaaa

SEQ ID NO: 583393 - RNA, 19 nt, Homo sapiens
uaagucaggugcugcaaau

SEQ ID NO: 583394 - RNA, 19 nt, Homo sapiens
ggagagaggccuuuuaaaa

SEQ ID NO: 583395 - RNA, 19 nt, Homo sapiens
ccagagcaaagaagaaaua

SEQ ID NO: 583396 - RNA, 19 nt, Homo sapiens
aaacaagaagcuggaauua

SEQ ID NO: 583397 - RNA, 19 nt, Homo sapiens
caaacaagaagcuggaauu

SEQ ID NO: 583398 - RNA, 19 nt, Homo sapiens
ggaauucuccauuaacugu

SEQ ID NO: 583399 - RNA, 19 nt, Homo sapiens
gaagacuugugguguuuua

SEQ ID NO: 583400 - RNA, 19 nt, Homo sapiens
cacccaugcucaauauaua

SEQ ID NO: 583401 - RNA, 19 nt, Homo sapiens
guaagccacuucuuugaca

SEQ ID NO: 583402 - RNA, 19 nt, Homo sapiens
agagaggccuuuuaaaaua

SEQ ID NO: 583403 - RNA, 19 nt, Homo sapiens
ccaggaaaaugcaggauua

SEQ ID NO: 583404 - RNA, 19 nt, Homo sapiens
ugaaacaugucuucucaca

SEQ ID NO: 583405 - RNA, 19 nt, Homo sapiens
ggagacgaguugcaugugu

SEQ ID NO: 583406 - RNA, 19 nt, Homo sapiens
cgaagaucuuggagaagua

SEQ ID NO: 583407 - RNA, 19 nt, Homo sapiens
caguuacaauccauagaua

SEQ ID NO: 583408 - RNA, 19 nt, Homo sapiens
ucacaguucuuagcaaaug

SEQ ID NO: 583409 - RNA, 19 nt, Homo sapiens
gggaaaugguuaaagaagu

SEQ ID NO: 583410 - RNA, 19 nt, Homo sapiens
gaacaauugggaaaugguu

SEQ ID NO: 583411 - RNA, 19 nt, Homo sapiens
gagacgaguugcauguguu

SEQ ID NO: 583412 - RNA, 19 nt, Homo sapiens
ccacuucuuugacauuaga

SEQ ID NO: 583413 - RNA, 19 nt, Homo sapiens
uuaauggccugaacugaga

SEQ ID NO: 583414 - RNA, 19 nt, Homo sapiens
ccaaguaggugggauuaca

SEQ ID NO: 583415 - RNA, 19 nt, Homo sapiens
guacugacuuucucucucu

SEQ ID NO: 583416 - RNA, 19 nt, Homo sapiens
ggaaaaugcaggauuaaaa

SEQ ID NO: 583417 - RNA, 19 nt, Homo sapiens
gaacagugccaaguuagau

SEQ ID NO: 583418 - RNA, 19 nt, Homo sapiens
gacauuagaagacauuaga

SEQ ID NO: 583419 - RNA, 19 nt, Homo sapiens
gaaauaugugacaagagua

SEQ ID NO: 583420 - RNA, 19 nt, Homo sapiens
gggaagaagaggagaagaa

SEQ ID NO: 583421 - RNA, 19 nt, Homo sapiens
aaacuuagaacccauggaa

SEQ ID NO: 583422 - RNA, 19 nt, Homo sapiens
gcaauugaaacaugucuuc

SEQ ID NO: 583423 - RNA, 19 nt, Homo sapiens
ccaguaagccacuucuuug

SEQ ID NO: 583424 - RNA, 19 nt, Homo sapiens
ggaguuguuugagcuauuc

SEQ ID NO: 583425 - RNA, 19 nt, Homo sapiens
gaagaucuuggagaaguaa

SEQ ID NO: 583426 - RNA, 19 nt, Homo sapiens
gcaaaggagacccaaggaa

SEQ ID NO: 583427 - RNA, 19 nt, Homo sapiens
caaaugcaguuacaaucca

SEQ ID NO: 583428 - RNA, 19 nt, Homo sapiens
gguaaugucaaguggagua

SEQ ID NO: 583429 - RNA, 19 nt, Homo sapiens
aagaagugauggugcauug

SEQ ID NO: 583430 - RNA, 19 nt, Homo sapiens
gcaguuacaauccauagau

SEQ ID NO: 583431 - RNA, 19 nt, Homo sapiens
caucgagacuaucugguau

SEQ ID NO: 583432 - RNA, 19 nt, Homo sapiens
aagaagacuugugguguuu

SEQ ID NO: 583433 - RNA, 19 nt, Homo sapiens
caauauauaguccuggaaa

SEQ ID NO: 583434 - RNA, 19 nt, Homo sapiens
gaagugauggugcauugug

SEQ ID NO: 583435 - RNA, 19 nt, Homo sapiens
ccauguaugugcgcuguuu

SEQ ID NO: 583436 - RNA, 19 nt, Homo sapiens
auagaucugugguugaauu

SEQ ID NO: 583437 - RNA, 19 nt, Homo sapiens
ccacuucgaguccuuuauu

SEQ ID NO: 583438 - RNA, 19 nt, Homo sapiens
gguugaauuugcuguguug

SEQ ID NO: 583439 - RNA, 19 nt, Homo sapiens
gaguuucucuuucucucuu

SEQ ID NO: 583440 - RNA, 19 nt, Homo sapiens
gguaugcguuauguaugua

SEQ ID NO: 583441 - RNA, 19 nt, Homo sapiens
ccauggaacccuuguuuau

SEQ ID NO: 583442 - RNA, 19 nt, Homo sapiens
caaggaacagugccaaguu

SEQ ID NO: 583443 - RNA, 19 nt, Homo sapiens
aauaaucagccuugcauaa

SEQ ID NO: 583444 - RNA, 19 nt, Homo sapiens
aagaagaccguaccacaaa

SEQ ID NO: 583445 - RNA, 19 nt, Homo sapiens
uagaauuacuggugaagca

SEQ ID NO: 583446 - RNA, 19 nt, Homo sapiens
gaagcauguuugguaaugu

SEQ ID NO: 583447 - RNA, 19 nt, Homo sapiens
ugcauugugugguagaaua

SEQ ID NO: 583448 - RNA, 19 nt, Homo sapiens
gcuauucuggagauuauuu

SEQ ID NO: 583449 - RNA, 19 nt, Homo sapiens
gaucugugguugaauuugc

SEQ ID NO: 583450 - RNA, 19 nt, Homo sapiens
ccaaguuagaugccgauua

SEQ ID NO: 583451 - RNA, 19 nt, Homo sapiens
gaggcuagagguucuuauu

SEQ ID NO: 583452 - RNA, 19 nt, Homo sapiens
agaguacugugaauauaug

SEQ ID NO: 583453 - RNA, 19 nt, Homo sapiens
gcacccagccugaguuucu

SEQ ID NO: 583454 - RNA, 19 nt, Homo sapiens
gaguugauauggccaaagg

SEQ ID NO: 583455 - RNA, 19 nt, Homo sapiens
ggaacagugccaaguuaga

SEQ ID NO: 583456 - RNA, 19 nt, Homo sapiens
gcuagagguucuuauucug

SEQ ID NO: 583457 - RNA, 19 nt, Homo sapiens
ggcuagagguucuuauucu

SEQ ID NO: 583458 - RNA, 19 nt, Homo sapiens
gaugggugagaaucuaaua

SEQ ID NO: 583459 - RNA, 19 nt, Homo sapiens
gugcugguauuacagaugu

SEQ ID NO: 583460 - RNA, 19 nt, Homo sapiens
aaagguuacuauagccaaa

SEQ ID NO: 583461 - RNA, 19 nt, Homo sapiens
ggagauuauuugguaaagu

SEQ ID NO: 583462 - RNA, 19 nt, Homo sapiens
agacaaugguuagagaaga

SEQ ID NO: 583463 - RNA, 19 nt, Homo sapiens
uaaagaagcuuaaccgauu

SEQ ID NO: 583464 - RNA, 19 nt, Homo sapiens
gaacaaccaugucaucaga

SEQ ID NO: 583465 - RNA, 19 nt, Homo sapiens
ccauaaaggucuucacaua

SEQ ID NO: 583466 - RNA, 19 nt, Homo sapiens
ggaugaagccauuuaaaua

SEQ ID NO: 583467 - RNA, 19 nt, Homo sapiens
gaaaguagaugccuaucau

SEQ ID NO: 583468 - RNA, 19 nt, Homo sapiens
gcaaggauguggcaauaga

SEQ ID NO: 583469 - RNA, 19 nt, Homo sapiens
caaagacaccagccaauua

SEQ ID NO: 583470 - RNA, 19 nt, Homo sapiens
gcacugggcuucugcuuuc

SEQ ID NO: 583471 - RNA, 19 nt, Homo sapiens
gcaaggagaugcugaagag

SEQ ID NO: 583472 - RNA, 19 nt, Homo sapiens
gaaacccugucucuacuaa

SEQ ID NO: 583473 - RNA, 19 nt, Homo sapiens
aaauugaucuggucaguuu

SEQ ID NO: 583474 - RNA, 19 nt, Homo sapiens
ucacagagaguaauucuaa

SEQ ID NO: 583475 - RNA, 19 nt, Homo sapiens
cagcaacgaugacaacauu

SEQ ID NO: 583476 - RNA, 19 nt, Homo sapiens
agaaggagaucaccaaaug

SEQ ID NO: 583477 - RNA, 19 nt, Homo sapiens
ccaaagugcuaggauuaua

SEQ ID NO: 583478 - RNA, 19 nt, Homo sapiens
caaauugucucugaucguu

SEQ ID NO: 583479 - RNA, 19 nt, Homo sapiens
ggaaaaggcuggcagagaa

SEQ ID NO: 583480 - RNA, 19 nt, Homo sapiens
gcagagacuaugaguuaua

SEQ ID NO: 583481 - RNA, 19 nt, Homo sapiens
uggcagagacuaugaguua

SEQ ID NO: 583482 - RNA, 19 nt, Homo sapiens
gaaauuggcugggcauggu

SEQ ID NO: 583483 - RNA, 19 nt, Homo sapiens
ucaaucacauacagagaua

SEQ ID NO: 583484 - RNA, 19 nt, Homo sapiens
gagagugccuaucuaacaa

SEQ ID NO: 583485 - RNA, 19 nt, Homo sapiens
aaagaagcuuaaccgauua

SEQ ID NO: 583486 - RNA, 19 nt, Homo sapiens
gcaggaagguaaauacuac

SEQ ID NO: 583487 - RNA, 19 nt, Homo sapiens
caaaguaaaggauggcaua

SEQ ID NO: 583488 - RNA, 19 nt, Homo sapiens
agaaguggaucaccauaaa

SEQ ID NO: 583489 - RNA, 19 nt, Homo sapiens
ggauguggcaauagaaaua

SEQ ID NO: 583490 - RNA, 19 nt, Homo sapiens
gcaggagaauugcuugaau

SEQ ID NO: 583491 - RNA, 19 nt, Homo sapiens
guucagagaucaacuguac

SEQ ID NO: 583492 - RNA, 19 nt, Homo sapiens
gcacuucaccaaagacauu

SEQ ID NO: 583493 - RNA, 19 nt, Homo sapiens
gaccugaagugcaaagaug

SEQ ID NO: 583494 - RNA, 19 nt, Homo sapiens
ccagaggacucccaagaug

SEQ ID NO: 583495 - RNA, 19 nt, Homo sapiens
gucaaagcaugaagaaauu

SEQ ID NO: 583496 - RNA, 19 nt, Homo sapiens
cacaguggcuuacgccuuu

SEQ ID NO: 583497 - RNA, 19 nt, Homo sapiens
gagaccagguaacauuuga

SEQ ID NO: 583498 - RNA, 19 nt, Homo sapiens
gaguagagucuuuaaggua

SEQ ID NO: 583499 - RNA, 19 nt, Homo sapiens
caccauuucuggcuaguuu

SEQ ID NO: 583500 - RNA, 19 nt, Homo sapiens
gcagugagcuauucaucgu

SEQ ID NO: 583501 - RNA, 19 nt, Homo sapiens
gaccaguaguaugcuauua

SEQ ID NO: 583502 - RNA, 19 nt, Homo sapiens
ggacaccaaucucuacuac

SEQ ID NO: 583503 - RNA, 19 nt, Homo sapiens
gagcugcacuucaccaaag

SEQ ID NO: 583504 - RNA, 19 nt, Homo sapiens
gggcaggccugugauaaga

SEQ ID NO: 583505 - RNA, 19 nt, Homo sapiens
uccagaaccuguuguauga

SEQ ID NO: 583506 - RNA, 19 nt, Homo sapiens
gagaaucaaucacauacag

SEQ ID NO: 583507 - RNA, 19 nt, Homo sapiens
gcagagaaguaccgagagu

SEQ ID NO: 583508 - RNA, 19 nt, Homo sapiens
gagaguaauucuaagucuu

SEQ ID NO: 583509 - RNA, 19 nt, Homo sapiens
ccacagaguccaaacuauu

SEQ ID NO: 583510 - RNA, 19 nt, Homo sapiens
caucaguacuccauucuuc

SEQ ID NO: 583511 - RNA, 19 nt, Homo sapiens
ccacaugugacucuugaua

SEQ ID NO: 583512 - RNA, 19 nt, Homo sapiens
ccacgaggcuaagcagaaa

SEQ ID NO: 583513 - RNA, 19 nt, Homo sapiens
gcuuacgccuuuaauauca

SEQ ID NO: 583514 - RNA, 19 nt, Homo sapiens
guaauacuccugcaaguca

SEQ ID NO: 583515 - RNA, 19 nt, Homo sapiens
gcgagucccuaucucuaaa

SEQ ID NO: 583516 - RNA, 19 nt, Homo sapiens
acucaugacuguaauccua

SEQ ID NO: 583517 - RNA, 19 nt, Homo sapiens
aguagagucuuuaagguaa

SEQ ID NO: 583518 - RNA, 19 nt, Homo sapiens
gaggcaggcaccacuguua

SEQ ID NO: 583519 - RNA, 19 nt, Homo sapiens
aaagacaccagccaauuaa

SEQ ID NO: 583520 - RNA, 19 nt, Homo sapiens
gcagaaaguagaugccuau

SEQ ID NO: 583521 - RNA, 19 nt, Homo sapiens
gaaggaaagcggaaucgau

SEQ ID NO: 583522 - RNA, 19 nt, Homo sapiens
cgagagugguguuggagaa

SEQ ID NO: 583523 - RNA, 19 nt, Homo sapiens
gcaggcaccacuguuauuu

SEQ ID NO: 583524 - RNA, 19 nt, Homo sapiens
uggcaaggauguggcaaua

SEQ ID NO: 583525 - RNA, 19 nt, Homo sapiens
uaaaggauggcauagacua

SEQ ID NO: 583526 - RNA, 19 nt, Homo sapiens
ugacaaaagugccucaaaa

SEQ ID NO: 583527 - RNA, 19 nt, Homo sapiens
acaugugacucuugauauu

SEQ ID NO: 583528 - RNA, 19 nt, Homo sapiens
aaacggaagcccaaaguga

SEQ ID NO: 583529 - RNA, 19 nt, Homo sapiens
gcugauggcugagauccaa

SEQ ID NO: 583530 - RNA, 19 nt, Homo sapiens
caaaagugccucaaaauau

SEQ ID NO: 583531 - RNA, 19 nt, Homo sapiens
gcaaacagaagacaaacuc

SEQ ID NO: 583532 - RNA, 19 nt, Homo sapiens
gcccacaugugacucuuga

SEQ ID NO: 583533 - RNA, 19 nt, Homo sapiens
gaugaagccauuuaaauac

SEQ ID NO: 583534 - RNA, 19 nt, Homo sapiens
acaccaaucucuacuacau

SEQ ID NO: 583535 - RNA, 19 nt, Homo sapiens
gggagacccucaccagcaa

SEQ ID NO: 583536 - RNA, 19 nt, Homo sapiens
acuaauagccugcuguuga

SEQ ID NO: 583537 - RNA, 19 nt, Homo sapiens
gcaggaugaagccauuuaa

SEQ ID NO: 583538 - RNA, 19 nt, Homo sapiens
gaauccagccaaucaguau

SEQ ID NO: 583539 - RNA, 19 nt, Homo sapiens
agauugaggugaagaagga

SEQ ID NO: 583540 - RNA, 19 nt, Homo sapiens
ggcaauagaaauagaagaa

SEQ ID NO: 583541 - RNA, 19 nt, Homo sapiens
caagguggcuuugcagucu

SEQ ID NO: 583542 - RNA, 19 nt, Homo sapiens
ccaaagacaccagccaauu

SEQ ID NO: 583543 - RNA, 19 nt, Homo sapiens
gguugccgauggacaaauu

SEQ ID NO: 583544 - RNA, 19 nt, Homo sapiens
gaggcgggaucccacuauu

SEQ ID NO: 583545 - RNA, 19 nt, Homo sapiens
gaucguuggauguuauaaa

SEQ ID NO: 583546 - RNA, 19 nt, Homo sapiens
gaaagcggaaucgaucuga

SEQ ID NO: 583547 - RNA, 19 nt, Homo sapiens
ggacagugagaccagguaa

SEQ ID NO: 583548 - RNA, 19 nt, Homo sapiens
gagaucaacuguacuucac

SEQ ID NO: 583549 - RNA, 19 nt, Homo sapiens
ccaaguuccugcuguuaag

SEQ ID NO: 583550 - RNA, 19 nt, Homo sapiens
cuacauggcgcucaucgaa

SEQ ID NO: 583551 - RNA, 19 nt, Homo sapiens
gagcgacuauguacuugag

SEQ ID NO: 583552 - RNA, 19 nt, Homo sapiens
gccaaucaguaucaguuug

SEQ ID NO: 583553 - RNA, 19 nt, Homo sapiens
caacugccauggagcugau

SEQ ID NO: 583554 - RNA, 19 nt, Homo sapiens
caggagaauugcuugaauc

SEQ ID NO: 583555 - RNA, 19 nt, Homo sapiens
gaaaccccgucucuacuaa

SEQ ID NO: 583556 - RNA, 19 nt, Homo sapiens
uauaauagacccacagagu

SEQ ID NO: 583557 - RNA, 19 nt, Homo sapiens
ccaguaguaugcuauuagu

SEQ ID NO: 583558 - RNA, 19 nt, Homo sapiens
ccucuucccugccaagguu

SEQ ID NO: 583559 - RNA, 19 nt, Homo sapiens
ucaccugacuuucuacuac

SEQ ID NO: 583560 - RNA, 19 nt, Homo sapiens
gacguuaucuguggcaauc

SEQ ID NO: 583561 - RNA, 19 nt, Homo sapiens
cgagagugccuaucuaaca

SEQ ID NO: 583562 - RNA, 19 nt, Homo sapiens
gaaauugaucuggucaguu

SEQ ID NO: 583563 - RNA, 19 nt, Homo sapiens
gaaccuagauuccuaaaug

SEQ ID NO: 583564 - RNA, 19 nt, Homo sapiens
gaacaaauuuccaaucuca

SEQ ID NO: 583565 - RNA, 19 nt, Homo sapiens
guaaugaugugguagauuu

SEQ ID NO: 583566 - RNA, 19 nt, Homo sapiens
gaagaaaccucgcuuugau

SEQ ID NO: 583567 - RNA, 19 nt, Homo sapiens
gcacuaaugucaucaacaa

SEQ ID NO: 583568 - RNA, 19 nt, Homo sapiens
gaagauaguguucugcuua

SEQ ID NO: 583569 - RNA, 19 nt, Homo sapiens
gaacaaaucauucacaugu

SEQ ID NO: 583570 - RNA, 19 nt, Homo sapiens
gguacaacaucgaauaaua

SEQ ID NO: 583571 - RNA, 19 nt, Homo sapiens
uaaagcacccguugaauua

SEQ ID NO: 583572 - RNA, 19 nt, Homo sapiens
ggacaaagucucaguauau

SEQ ID NO: 583573 - RNA, 19 nt, Homo sapiens
gaagaagaguugaaaguca

SEQ ID NO: 583574 - RNA, 19 nt, Homo sapiens
gaucucaccugaugaagaa

SEQ ID NO: 583575 - RNA, 19 nt, Homo sapiens
guaaagugcucuucauuuc

SEQ ID NO: 583576 - RNA, 19 nt, Homo sapiens
gaaccuaauuaucugcaua

SEQ ID NO: 583577 - RNA, 19 nt, Homo sapiens
ugacaaggauucaaaguug

SEQ ID NO: 583578 - RNA, 19 nt, Homo sapiens
gaguaucucuguauguuaa

SEQ ID NO: 583579 - RNA, 19 nt, Homo sapiens
ggacucaucugucauucaa

SEQ ID NO: 583580 - RNA, 19 nt, Homo sapiens
gaacuuggauuacaucaac

SEQ ID NO: 583581 - RNA, 19 nt, Homo sapiens
gaguuacccucuaaagaua

SEQ ID NO: 583582 - RNA, 19 nt, Homo sapiens
ggaaaggguuuuauucaua

SEQ ID NO: 583583 - RNA, 19 nt, Homo sapiens
gcucagaucuaccuaaauc

SEQ ID NO: 583584 - RNA, 19 nt, Homo sapiens
gaaauguaauccagaggaa

SEQ ID NO: 583585 - RNA, 19 nt, Homo sapiens
gaccugaaaugagcaauaa

SEQ ID NO: 583586 - RNA, 19 nt, Homo sapiens
gaucaggucucacucuguu

SEQ ID NO: 583587 - RNA, 19 nt, Homo sapiens
gaaaaucuccaacacauua

SEQ ID NO: 583588 - RNA, 19 nt, Homo sapiens
gcucagacuuacuagauaa

SEQ ID NO: 583589 - RNA, 19 nt, Homo sapiens
gaagacugcuugguauuug

SEQ ID NO: 583590 - RNA, 19 nt, Homo sapiens
ccacaagguucuguugaua

SEQ ID NO: 583591 - RNA, 19 nt, Homo sapiens
gacaaagucucaguauauu

SEQ ID NO: 583592 - RNA, 19 nt, Homo sapiens
guaaagcacccguugaauu

SEQ ID NO: 583593 - RNA, 19 nt, Homo sapiens
gaucagauauaggacauga

SEQ ID NO: 583594 - RNA, 19 nt, Homo sapiens
ugacaaaguucccaaagau

SEQ ID NO: 583595 - RNA, 19 nt, Homo sapiens
ggaagaagcauuaacuuag

SEQ ID NO: 583596 - RNA, 19 nt, Homo sapiens
gaaaugagcaauaaacucu

SEQ ID NO: 583597 - RNA, 19 nt, Homo sapiens
ggagacaacuuuuauagaa

SEQ ID NO: 583598 - RNA, 19 nt, Homo sapiens
ugacuaagauccuucacuu

SEQ ID NO: 583599 - RNA, 19 nt, Homo sapiens
ugaauagaguccaacagua

SEQ ID NO: 583600 - RNA, 19 nt, Homo sapiens
gcucuucauuucacuuuaa

SEQ ID NO: 583601 - RNA, 19 nt, Homo sapiens
gggacaaagucucaguaua

SEQ ID NO: 583602 - RNA, 19 nt, Homo sapiens
aaaguggcauccaauuuaa

SEQ ID NO: 583603 - RNA, 19 nt, Homo sapiens
agaagaacauggagagauu

SEQ ID NO: 583604 - RNA, 19 nt, Homo sapiens
gcuuggaucugacaaaguu

SEQ ID NO: 583605 - RNA, 19 nt, Homo sapiens
ggacgaacuuggauuacau

SEQ ID NO: 583606 - RNA, 19 nt, Homo sapiens
gaaacuccucuuugucaua

SEQ ID NO: 583607 - RNA, 19 nt, Homo sapiens
gaccuuaguuugugucuuc

SEQ ID NO: 583608 - RNA, 19 nt, Homo sapiens
ccagauugauguauaugaa

SEQ ID NO: 583609 - RNA, 19 nt, Homo sapiens
cgacaaagaacaguaaauu

SEQ ID NO: 583610 - RNA, 19 nt, Homo sapiens
gaaaguaaggcccuagaug

SEQ ID NO: 583611 - RNA, 19 nt, Homo sapiens
gauaguguucugcuuauaa

SEQ ID NO: 583612 - RNA, 19 nt, Homo sapiens
gaagaagcauuaacuuagc

SEQ ID NO: 583613 - RNA, 19 nt, Homo sapiens
gaacugugaccugaaauga

SEQ ID NO: 583614 - RNA, 19 nt, Homo sapiens
ccacugugcuauaauuaga

SEQ ID NO: 583615 - RNA, 19 nt, Homo sapiens
gagcugauuuaaguuguuu

SEQ ID NO: 583616 - RNA, 19 nt, Homo sapiens
caguugagcugauuuaagu

SEQ ID NO: 583617 - RNA, 19 nt, Homo sapiens
gagaaaaucuaaacaagga

SEQ ID NO: 583618 - RNA, 19 nt, Homo sapiens
cagauuguaucccaaggua

SEQ ID NO: 583619 - RNA, 19 nt, Homo sapiens
acacuagagucauauaaga

SEQ ID NO: 583620 - RNA, 19 nt, Homo sapiens
agaaauccuucaaacauga

SEQ ID NO: 583621 - RNA, 19 nt, Homo sapiens
cagaaauccuucaaacaug

SEQ ID NO: 583622 - RNA, 19 nt, Homo sapiens
gaauggaacuuaccuaacc

SEQ ID NO: 583623 - RNA, 19 nt, Homo sapiens
gagcacaugucaacucaag

SEQ ID NO: 583624 - RNA, 19 nt, Homo sapiens
ucacagugcuuggaucuga

SEQ ID NO: 583625 - RNA, 19 nt, Homo sapiens
gcagguacaacuauuaaga

SEQ ID NO: 583626 - RNA, 19 nt, Homo sapiens
guaccuaccuacuuauaca

SEQ ID NO: 583627 - RNA, 19 nt, Homo sapiens
agaugcagcucaugcuaua

SEQ ID NO: 583628 - RNA, 19 nt, Homo sapiens
aaacaaggaucuauugacu

SEQ ID NO: 583629 - RNA, 19 nt, Homo sapiens
gauucaaaguugucucuga

SEQ ID NO: 583630 - RNA, 19 nt, Homo sapiens
gaguuugccuuguagauuc

SEQ ID NO: 583631 - RNA, 19 nt, Homo sapiens
gaaacacuagagucauaua

SEQ ID NO: 583632 - RNA, 19 nt, Homo sapiens
gaacauggagagauuucuu

SEQ ID NO: 583633 - RNA, 19 nt, Homo sapiens
ggauuaacauucgaggaaa

SEQ ID NO: 583634 - RNA, 19 nt, Homo sapiens
acaagguucuguugauauu

SEQ ID NO: 583635 - RNA, 19 nt, Homo sapiens
agaacucccuggcuuauau

SEQ ID NO: 583636 - RNA, 19 nt, Homo sapiens
aaagacagauugacaagag

SEQ ID NO: 583637 - RNA, 19 nt, Homo sapiens
guacagggauuagaguugu

SEQ ID NO: 583638 - RNA, 19 nt, Homo sapiens
ugacugcugcugagaaaua

SEQ ID NO: 583639 - RNA, 19 nt, Homo sapiens
uauggacuuucucagauua

SEQ ID NO: 583640 - RNA, 19 nt, Homo sapiens
guuauggacucaucuguca

SEQ ID NO: 583641 - RNA, 19 nt, Homo sapiens
uggcuugguuggcucauua

SEQ ID NO: 583642 - RNA, 19 nt, Homo sapiens
uauauagcaucgacaaaga

SEQ ID NO: 583643 - RNA, 19 nt, Homo sapiens
ggaagauaguguucugcuu

SEQ ID NO: 583644 - RNA, 19 nt, Homo sapiens
uuucagaccuauccaugua

SEQ ID NO: 583645 - RNA, 19 nt, Homo sapiens
gaaagcuguuggccuggaa

SEQ ID NO: 583646 - RNA, 19 nt, Homo sapiens
agaaaccucgcuuugauua

SEQ ID NO: 583647 - RNA, 19 nt, Homo sapiens
aaaggacgaacuuggauua

SEQ ID NO: 583648 - RNA, 19 nt, Homo sapiens
uaugggaguuugccuugua

SEQ ID NO: 583649 - RNA, 19 nt, Homo sapiens
agaaugauccacucucuuu

SEQ ID NO: 583650 - RNA, 19 nt, Homo sapiens
gccuaaagaucauaauauc

SEQ ID NO: 583651 - RNA, 19 nt, Homo sapiens
gaauagaguccaacaguac

SEQ ID NO: 583652 - RNA, 19 nt, Homo sapiens
uggaagaagcauuaacuua

SEQ ID NO: 583653 - RNA, 19 nt, Homo sapiens
aaucacaacuuaacuagca

SEQ ID NO: 583654 - RNA, 19 nt, Homo sapiens
ggaacuggauagcucacuu

SEQ ID NO: 583655 - RNA, 19 nt, Homo sapiens
ucuauacaauggucacuuu

SEQ ID NO: 583656 - RNA, 19 nt, Homo sapiens
guaacgaccuuaguuugug

SEQ ID NO: 583657 - RNA, 19 nt, Homo sapiens
cuugguauuugaugaguua

SEQ ID NO: 583658 - RNA, 19 nt, Homo sapiens
gaacucccuggcuuauaua

SEQ ID NO: 583659 - RNA, 19 nt, Homo sapiens
agacaguaaucaugccuuu

SEQ ID NO: 583660 - RNA, 19 nt, Homo sapiens
cauauuugauucacuagug

SEQ ID NO: 583661 - RNA, 19 nt, Homo sapiens
caagaaugauccacucucu

SEQ ID NO: 583662 - RNA, 19 nt, Homo sapiens
cagccacugugcuauaauu

SEQ ID NO: 583663 - RNA, 19 nt, Homo sapiens
gaagagaaacugcaccuua

SEQ ID NO: 583664 - RNA, 19 nt, Homo sapiens
gaagaggaguccaagauug

SEQ ID NO: 583665 - RNA, 19 nt, Homo sapiens
gaagaauucuguugaaguc

SEQ ID NO: 583666 - RNA, 19 nt, Homo sapiens
ggacuuugcugcugagguu

SEQ ID NO: 583667 - RNA, 19 nt, Homo sapiens
gaaggaggaugugaagaaa

SEQ ID NO: 583668 - RNA, 19 nt, Homo sapiens
ggaaggaggaugugaagaa

SEQ ID NO: 583669 - RNA, 19 nt, Homo sapiens
gagcugaggugguaaagca

SEQ ID NO: 583670 - RNA, 19 nt, Homo sapiens
caaaggcccugccaagaau

SEQ ID NO: 583671 - RNA, 19 nt, Homo sapiens
gaaaugggguggaaacaaa

SEQ ID NO: 583672 - RNA, 19 nt, Homo sapiens
aaaaguagaugcccaauuu

SEQ ID NO: 583673 - RNA, 19 nt, Homo sapiens
ugaaggagauacugaagga

SEQ ID NO: 583674 - RNA, 19 nt, Homo sapiens
caggaaauguggagaacaa

SEQ ID NO: 583675 - RNA, 19 nt, Homo sapiens
ugaaggagcgggaacuuaa

SEQ ID NO: 583676 - RNA, 19 nt, Homo sapiens
gcaaagaguacacacuaga

SEQ ID NO: 583677 - RNA, 19 nt, Homo sapiens
ccaaaggcccugccaagaa

SEQ ID NO: 583678 - RNA, 19 nt, Homo sapiens
ugucaaagauugcagacuu

SEQ ID NO: 583679 - RNA, 19 nt, Homo sapiens
aagagaaacugcaccuuau

SEQ ID NO: 583680 - RNA, 19 nt, Homo sapiens
aagagaagcugaaggagau

SEQ ID NO: 583681 - RNA, 19 nt, Homo sapiens
cuggagaccugaagaauuc

SEQ ID NO: 583682 - RNA, 19 nt, Homo sapiens
cagcaaagaguacacacua

SEQ ID NO: 583683 - RNA, 19 nt, Homo sapiens
guugcaggcugacuucaaa

SEQ ID NO: 583684 - RNA, 19 nt, Homo sapiens
gggaagagaagcugaagga

SEQ ID NO: 583685 - RNA, 19 nt, Homo sapiens
gaaggagcgggaacuuaaa

SEQ ID NO: 583686 - RNA, 19 nt, Homo sapiens
gaaauguggagaacaaugg

SEQ ID NO: 583687 - RNA, 19 nt, Homo sapiens
gagaaacugcaccuuauca

SEQ ID NO: 583688 - RNA, 19 nt, Homo sapiens
gaagcucaaguucaucaaa

SEQ ID NO: 583689 - RNA, 19 nt, Homo sapiens
uggagaagcucaaguucau

SEQ ID NO: 583690 - RNA, 19 nt, Homo sapiens
acgcauaccuggauaacau

SEQ ID NO: 583691 - RNA, 19 nt, Homo sapiens
gaaaagggccaaccagaug

SEQ ID NO: 583692 - RNA, 19 nt, Homo sapiens
ggaaauguggagaacaaug

SEQ ID NO: 583693 - RNA, 19 nt, Homo sapiens
acaaguugcuggauccaau

SEQ ID NO: 583694 - RNA, 19 nt, Homo sapiens
ccugaagaauucuguugaa

SEQ ID NO: 583695 - RNA, 19 nt, Homo sapiens
ucccagcccugaagagaaa

SEQ ID NO: 583696 - RNA, 19 nt, Homo sapiens
gagaagcucaaguucauca

SEQ ID NO: 583697 - RNA, 19 nt, Homo sapiens
ggugugagguaacaauucu

SEQ ID NO: 583698 - RNA, 19 nt, Homo sapiens
gauccuacgagaugagaaa

SEQ ID NO: 583699 - RNA, 19 nt, Homo sapiens
gcacuuggcuauucaaaac

SEQ ID NO: 583700 - RNA, 19 nt, Homo sapiens
ggcuggagcugagguggua

SEQ ID NO: 583701 - RNA, 19 nt, Homo sapiens
ucacacagcacgauuccaa

SEQ ID NO: 583702 - RNA, 19 nt, Homo sapiens
caugggaacuucuagaacu

SEQ ID NO: 583703 - RNA, 19 nt, Homo sapiens
aaaccaacuucaugaccaa

SEQ ID NO: 583704 - RNA, 19 nt, Homo sapiens
ggugagcacguguuuguga

SEQ ID NO: 583705 - RNA, 19 nt, Homo sapiens
cgagucaguuacuaugaga

SEQ ID NO: 583706 - RNA, 19 nt, Homo sapiens
cagaagaggaguccaagau

SEQ ID NO: 583707 - RNA, 19 nt, Homo sapiens
gcauuggugugcccuugga

SEQ ID NO: 583708 - RNA, 19 nt, Homo sapiens
gagaaugugaucaaagcaa

SEQ ID NO: 583709 - RNA, 19 nt, Homo sapiens
acauguggcuuacuuugug

SEQ ID NO: 583710 - RNA, 19 nt, Homo sapiens
ugagucaucugcugucucu

SEQ ID NO: 583711 - RNA, 19 nt, Homo sapiens
gagcucaagcccaagaaga

SEQ ID NO: 583712 - RNA, 19 nt, Homo sapiens
ggcuuuggaugaagaguau

SEQ ID NO: 583713 - RNA, 19 nt, Homo sapiens
gugcccaugucaaagauug

SEQ ID NO: 583714 - RNA, 19 nt, Homo sapiens
agaaugugaucaaagcaau

SEQ ID NO: 583715 - RNA, 19 nt, Homo sapiens
cuccauccaucacccauuu

SEQ ID NO: 583716 - RNA, 19 nt, Homo sapiens
aagcaaaccaacuucauga

SEQ ID NO: 583717 - RNA, 19 nt, Homo sapiens
gcuucugugugcuucuaua

SEQ ID NO: 583718 - RNA, 19 nt, Homo sapiens
ccucaaagcagaagccaau

SEQ ID NO: 583719 - RNA, 19 nt, Homo sapiens
gagcgggaacuuaaaauuu

SEQ ID NO: 583720 - RNA, 19 nt, Homo sapiens
ucugaugaauccuaugguu

SEQ ID NO: 583721 - RNA, 19 nt, Homo sapiens
caaagaguacacacuagau

SEQ ID NO: 583722 - RNA, 19 nt, Homo sapiens
auaccuggauaacaugaaa

SEQ ID NO: 583723 - RNA, 19 nt, Homo sapiens
caucugcugucucuucagu

SEQ ID NO: 583724 - RNA, 19 nt, Homo sapiens
gcucaagcccaagaagaaa

SEQ ID NO: 583725 - RNA, 19 nt, Homo sapiens
gugagcacguguuugugaa

SEQ ID NO: 583726 - RNA, 19 nt, Homo sapiens
ugagcggccugguacaguu

SEQ ID NO: 583727 - RNA, 19 nt, Homo sapiens
gauugcagacuucuuaaag

SEQ ID NO: 583728 - RNA, 19 nt, Homo sapiens
gggcuccauuuccuguaaa

SEQ ID NO: 583729 - RNA, 19 nt, Homo sapiens
caggcugacuucaaaauuu

SEQ ID NO: 583730 - RNA, 19 nt, Homo sapiens
gucaaagauugcagacuuc

SEQ ID NO: 583731 - RNA, 19 nt, Homo sapiens
aagaggaguccaagauuga

SEQ ID NO: 583732 - RNA, 19 nt, Homo sapiens
agaagaggaguccaagauu

SEQ ID NO: 583733 - RNA, 19 nt, Homo sapiens
gcauugaucagagaaagau

SEQ ID NO: 583734 - RNA, 19 nt, Homo sapiens
aaaggcagggugugaggua

SEQ ID NO: 583735 - RNA, 19 nt, Homo sapiens
gaccugaagaauucuguug

SEQ ID NO: 583736 - RNA, 19 nt, Homo sapiens
ugaccaagcugggcuccau

SEQ ID NO: 583737 - RNA, 19 nt, Homo sapiens
gaagucgcacugaacaagu

SEQ ID NO: 583738 - RNA, 19 nt, Homo sapiens
ggagaagcacccagaugca

SEQ ID NO: 583739 - RNA, 19 nt, Homo sapiens
aaucaucacuguggagaag

SEQ ID NO: 583740 - RNA, 19 nt, Homo sapiens
cuacccagaucccucaaag

SEQ ID NO: 583741 - RNA, 19 nt, Homo sapiens
gccaaaggcccugccaaga

SEQ ID NO: 583742 - RNA, 19 nt, Homo sapiens
ugaagaauucuguugaagu

SEQ ID NO: 583743 - RNA, 19 nt, Homo sapiens
ccuacgagaugagaaaugg

SEQ ID NO: 583744 - RNA, 19 nt, Homo sapiens
caaaaugagcucuucagaa

SEQ ID NO: 583745 - RNA, 19 nt, Homo sapiens
gaggagcucaagcccaaga

SEQ ID NO: 583746 - RNA, 19 nt, Homo sapiens
aagcucaaguucaucaaag

SEQ ID NO: 583747 - RNA, 19 nt, Homo sapiens
gaaugugaucaaagcaaug

SEQ ID NO: 583748 - RNA, 19 nt, Homo sapiens
cuaugagaaugugaucaaa

SEQ ID NO: 583749 - RNA, 19 nt, Homo sapiens
ccuggagaccugaagaauu

SEQ ID NO: 583750 - RNA, 19 nt, Homo sapiens
gaugagaaaugggguggaa

SEQ ID NO: 583751 - RNA, 19 nt, Homo sapiens
gacugcaggcuuuggauga

SEQ ID NO: 583752 - RNA, 19 nt, Homo sapiens
aaagaguacacacuagaug

SEQ ID NO: 583753 - RNA, 19 nt, Homo sapiens
ugggcuccauuuccuguaa

SEQ ID NO: 583754 - RNA, 19 nt, Homo sapiens
cagccuguauguagagaag

SEQ ID NO: 583755 - RNA, 19 nt, Homo sapiens
uuugcugaguggccucuua

SEQ ID NO: 583756 - RNA, 19 nt, Homo sapiens
acacagcacgauuccaaga

SEQ ID NO: 583757 - RNA, 19 nt, Homo sapiens
cuagauguguacagacucu

SEQ ID NO: 583758 - RNA, 19 nt, Homo sapiens
ucaaaggcacugauuacca

SEQ ID NO: 583759 - RNA, 19 nt, Homo sapiens
ucaguuacuaugagaaugu

SEQ ID NO: 583760 - RNA, 19 nt, Homo sapiens
gcauaccuggauaacauga

SEQ ID NO: 583761 - RNA, 19 nt, Homo sapiens
uaauaccccugcccugaaa

SEQ ID NO: 583762 - RNA, 19 nt, Homo sapiens
aagucgcacugaacaaguu

SEQ ID NO: 583763 - RNA, 19 nt, Homo sapiens
gaccgaaacuugauauuuu

SEQ ID NO: 583764 - RNA, 19 nt, Homo sapiens
auaacaaaguggucacaaa

SEQ ID NO: 583765 - RNA, 19 nt, Homo sapiens
ggcagcaacuaccugauug

SEQ ID NO: 583766 - RNA, 19 nt, Homo sapiens
cugcuggucuucauuguga

SEQ ID NO: 583767 - RNA, 19 nt, Homo sapiens
ggauggacauucgcaaagu

SEQ ID NO: 583768 - RNA, 19 nt, Homo sapiens
gggcagcaacuaccugauu

SEQ ID NO: 583769 - RNA, 19 nt, Homo sapiens
ugaccgaaacuugauauuu

SEQ ID NO: 583770 - RNA, 19 nt, Homo sapiens
gcagaggaccauccagugu

SEQ ID NO: 583771 - RNA, 19 nt, Homo sapiens
gauggacauucgcaaagug

SEQ ID NO: 583772 - RNA, 19 nt, Homo sapiens
caagguggccugugagaag

SEQ ID NO: 583773 - RNA, 19 nt, Homo sapiens
acuacgugcucacagguua

SEQ ID NO: 583774 - RNA, 19 nt, Homo sapiens
acauguaacgucugccuua

SEQ ID NO: 583775 - RNA, 19 nt, Homo sapiens
ccaguuugaggccgaguua

SEQ ID NO: 583776 - RNA, 19 nt, Homo sapiens
gauccagucuugggugaca

SEQ ID NO: 583777 - RNA, 19 nt, Homo sapiens
cgggugcucuccauacaga

SEQ ID NO: 583778 - RNA, 19 nt, Homo sapiens
uaacaaaguggucacaaaa

SEQ ID NO: 583779 - RNA, 19 nt, Homo sapiens
gagccaugaccgaaacuug

SEQ ID NO: 583780 - RNA, 19 nt, Homo sapiens
ggacaugcugcacucuaug

SEQ ID NO: 583781 - RNA, 19 nt, Homo sapiens
ggaccuccuucccgucuac

SEQ ID NO: 583782 - RNA, 19 nt, Homo sapiens
ggcugaacaacaugaauaa

SEQ ID NO: 583783 - RNA, 19 nt, Homo sapiens
uggacaugcugcacucuau

SEQ ID NO: 583784 - RNA, 19 nt, Homo sapiens
uaucacgcccaaccaguuu

SEQ ID NO: 583785 - RNA, 19 nt, Homo sapiens
ggaagggccaagugcugaa

SEQ ID NO: 583786 - RNA, 19 nt, Homo sapiens
cgugugugauccagucuug

SEQ ID NO: 583787 - RNA, 19 nt, Homo sapiens
aggcugaacaacaugaaua

SEQ ID NO: 583788 - RNA, 19 nt, Homo sapiens
uguaacgucugccuuagag

SEQ ID NO: 583789 - RNA, 19 nt, Homo sapiens
guuggugucuccguguuug

SEQ ID NO: 583790 - RNA, 19 nt, Homo sapiens
ccauggugguggacauugu

SEQ ID NO: 583791 - RNA, 19 nt, Homo sapiens
ccagucgugcuuugugaaa

SEQ ID NO: 583792 - RNA, 19 nt, Homo sapiens
caucugcuggucuucauug

SEQ ID NO: 583793 - RNA, 19 nt, Homo sapiens
ggagucagaggaggaggaa

SEQ ID NO: 583794 - RNA, 19 nt, Homo sapiens
gccgggugcucuccauaca

SEQ ID NO: 583795 - RNA, 19 nt, Homo sapiens
gcugaacaacaugaauaaa

SEQ ID NO: 583796 - RNA, 19 nt, Homo sapiens
aaacgugccagucgugcuu

SEQ ID NO: 583797 - RNA, 19 nt, Homo sapiens
cauguaacgucugccuuag

SEQ ID NO: 583798 - RNA, 19 nt, Homo sapiens
caucgaggacccagagauc

SEQ ID NO: 583799 - RNA, 19 nt, Homo sapiens
ugccagucgugcuuuguga

SEQ ID NO: 583800 - RNA, 19 nt, Homo sapiens
gcguuggugucuccguguu

SEQ ID NO: 583801 - RNA, 19 nt, Homo sapiens
gcagcaacuaccugauugu

SEQ ID NO: 583802 - RNA, 19 nt, Homo sapiens
gaagggccaagugcugaau

SEQ ID NO: 583803 - RNA, 19 nt, Homo sapiens
uuagagccaugaccgaaac

SEQ ID NO: 583804 - RNA, 19 nt, Homo sapiens
ggcaucugcuggucuucau

SEQ ID NO: 583805 - RNA, 19 nt, Homo sapiens
ccaugaccgaaacuugaua

SEQ ID NO: 583806 - RNA, 19 nt, Homo sapiens
aagguggccugugagaaga

SEQ ID NO: 583807 - RNA, 19 nt, Homo sapiens
gagauaaacugaugaauug

SEQ ID NO: 583808 - RNA, 19 nt, Homo sapiens
gaagucaucugucauuaaa

SEQ ID NO: 583809 - RNA, 19 nt, Homo sapiens
gaagagaaguccaacagaa

SEQ ID NO: 583810 - RNA, 19 nt, Homo sapiens
gaaguucuguccucgguua

SEQ ID NO: 583811 - RNA, 19 nt, Homo sapiens
cuacggagauggaugauaa

SEQ ID NO: 583812 - RNA, 19 nt, Homo sapiens
gcaaugauguggauucugu

SEQ ID NO: 583813 - RNA, 19 nt, Homo sapiens
gcagugauaguauggauua

SEQ ID NO: 583814 - RNA, 19 nt, Homo sapiens
uaauggagauuguuacuga

SEQ ID NO: 583815 - RNA, 19 nt, Homo sapiens
ggaagcgccuggaagauga

SEQ ID NO: 583816 - RNA, 19 nt, Homo sapiens
caagugcccuucugcauga

SEQ ID NO: 583817 - RNA, 19 nt, Homo sapiens
ggacagacgucaggcagaa

SEQ ID NO: 583818 - RNA, 19 nt, Homo sapiens
ccaaagcgcacuucgauuu

SEQ ID NO: 583819 - RNA, 19 nt, Homo sapiens
caaaaugccugaugaugua

SEQ ID NO: 583820 - RNA, 19 nt, Homo sapiens
aaacacagcccaacaguga

SEQ ID NO: 583821 - RNA, 19 nt, Homo sapiens
ggcaagaaaugacuguaaa

SEQ ID NO: 583822 - RNA, 19 nt, Homo sapiens
gaaaucugcuacuccguau

SEQ ID NO: 583823 - RNA, 19 nt, Homo sapiens
ccucagggcucaagaaugu

SEQ ID NO: 583824 - RNA, 19 nt, Homo sapiens
ucagugaaaugaugaaaug

SEQ ID NO: 583825 - RNA, 19 nt, Homo sapiens
gaguauauguuuccuguca

SEQ ID NO: 583826 - RNA, 19 nt, Homo sapiens
gugauaguauggauuauga

SEQ ID NO: 583827 - RNA, 19 nt, Homo sapiens
cgauauggcaucuguguua

SEQ ID NO: 583828 - RNA, 19 nt, Homo sapiens
ccacugcgcuccagcucua

SEQ ID NO: 583829 - RNA, 19 nt, Homo sapiens
gugaaaugaugaaauguga

SEQ ID NO: 583830 - RNA, 19 nt, Homo sapiens
gaugauaguggcagugaua

SEQ ID NO: 583831 - RNA, 19 nt, Homo sapiens
aaacagaggccugaaguaa

SEQ ID NO: 583832 - RNA, 19 nt, Homo sapiens
gcaaaucaaugaggugcuu

SEQ ID NO: 583833 - RNA, 19 nt, Homo sapiens
caccagaaguuuaaaggaa

SEQ ID NO: 583834 - RNA, 19 nt, Homo sapiens
ggacagcaauagggugauu

SEQ ID NO: 583835 - RNA, 19 nt, Homo sapiens
uauuaugucucuucucgua

SEQ ID NO: 583836 - RNA, 19 nt, Homo sapiens
caacagaaaguguaaauac

SEQ ID NO: 583837 - RNA, 19 nt, Homo sapiens
caagcuggcuccuuucuag

SEQ ID NO: 583838 - RNA, 19 nt, Homo sapiens
gugcuaaccugcauucugu

SEQ ID NO: 583839 - RNA, 19 nt, Homo sapiens
gauauggcaucuguguuaa

SEQ ID NO: 583840 - RNA, 19 nt, Homo sapiens
ugaaauaaauguccucaac

SEQ ID NO: 583841 - RNA, 19 nt, Homo sapiens
guacguggcugcaguucau

SEQ ID NO: 583842 - RNA, 19 nt, Homo sapiens
ucaaauucaugcacaauca

SEQ ID NO: 583843 - RNA, 19 nt, Homo sapiens
agacccagcucaacaaguu

SEQ ID NO: 583844 - RNA, 19 nt, Homo sapiens
gauaguggcagugauagua

SEQ ID NO: 583845 - RNA, 19 nt, Homo sapiens
gaaagaccaagcuggguuu

SEQ ID NO: 583846 - RNA, 19 nt, Homo sapiens
ucauagagcugaaucacau

SEQ ID NO: 583847 - RNA, 19 nt, Homo sapiens
gagcuguacuacuguguga

SEQ ID NO: 583848 - RNA, 19 nt, Homo sapiens
guacaugcagggacagaua

SEQ ID NO: 583849 - RNA, 19 nt, Homo sapiens
gaagcagacauuuguggua

SEQ ID NO: 583850 - RNA, 19 nt, Homo sapiens
ccagcgagguggagauuga

SEQ ID NO: 583851 - RNA, 19 nt, Homo sapiens
gagaggaagggaagaauug

SEQ ID NO: 583852 - RNA, 19 nt, Homo sapiens
gcucugaccuuugcucuuc

SEQ ID NO: 583853 - RNA, 19 nt, Homo sapiens
ugaauuggguggcgaguuc

SEQ ID NO: 583854 - RNA, 19 nt, Homo sapiens
agacgaagguguugugcuu

SEQ ID NO: 583855 - RNA, 19 nt, Homo sapiens
gagaagggauggguaugga

SEQ ID NO: 583856 - RNA, 19 nt, Homo sapiens
gcacgaugcugcugugacu

SEQ ID NO: 583857 - RNA, 19 nt, Homo sapiens
ucaagaauguguacagucu

SEQ ID NO: 583858 - RNA, 19 nt, Homo sapiens
gaagggaucaaccucaaau

SEQ ID NO: 583859 - RNA, 19 nt, Homo sapiens
ugaagaagcagacauuugu

SEQ ID NO: 583860 - RNA, 19 nt, Homo sapiens
acagaggccugaaguaauc

SEQ ID NO: 583861 - RNA, 19 nt, Homo sapiens
ggaucaaccucaaauucau

SEQ ID NO: 583862 - RNA, 19 nt, Homo sapiens
gcacuucgauuuucagaau

SEQ ID NO: 583863 - RNA, 19 nt, Homo sapiens
gaaaugaugaaaugugaca

SEQ ID NO: 583864 - RNA, 19 nt, Homo sapiens
cagaaucacuagagcugaa

SEQ ID NO: 583865 - RNA, 19 nt, Homo sapiens
gcaucuguguuaacuucua

SEQ ID NO: 583866 - RNA, 19 nt, Homo sapiens
gcaugagccuucgggauga

SEQ ID NO: 583867 - RNA, 19 nt, Homo sapiens
gcuguggcuugguugguua

SEQ ID NO: 583868 - RNA, 19 nt, Homo sapiens
ggacugaucaagacucugu

SEQ ID NO: 583869 - RNA, 19 nt, Homo sapiens
gaacaagcaccaggaagug

SEQ ID NO: 583870 - RNA, 19 nt, Homo sapiens
aguaccagcuucagucuuu

SEQ ID NO: 583871 - RNA, 19 nt, Homo sapiens
acacuggagucacgcgaua

SEQ ID NO: 583872 - RNA, 19 nt, Homo sapiens
ggcccagacuccugaauug

SEQ ID NO: 583873 - RNA, 19 nt, Homo sapiens
gggcaagaaaugacuguaa

SEQ ID NO: 583874 - RNA, 19 nt, Homo sapiens
aaucugcuacuccguauua

SEQ ID NO: 583875 - RNA, 19 nt, Homo sapiens
ggaacaagcaccaggaagu

SEQ ID NO: 583876 - RNA, 19 nt, Homo sapiens
gcccagacccacuacuaua

SEQ ID NO: 583877 - RNA, 19 nt, Homo sapiens
cagggucgauccagcaauu

SEQ ID NO: 583878 - RNA, 19 nt, Homo sapiens
gaaaagagaaccuccauca

SEQ ID NO: 583879 - RNA, 19 nt, Homo sapiens
gauucacccuaguggauuu

SEQ ID NO: 583880 - RNA, 19 nt, Homo sapiens
gcaugaccuucgagagauu

SEQ ID NO: 583881 - RNA, 19 nt, Homo sapiens
agaaugacauccgcaagaa

SEQ ID NO: 583882 - RNA, 19 nt, Homo sapiens
cuucuuagaugcugugaug

SEQ ID NO: 583883 - RNA, 19 nt, Homo sapiens
ccagacuccugaauugcua

SEQ ID NO: 583884 - RNA, 19 nt, Homo sapiens
gagcagcaaugcaggugau

SEQ ID NO: 583885 - RNA, 19 nt, Homo sapiens
uagcaucuauugaauugug

SEQ ID NO: 583886 - RNA, 19 nt, Homo sapiens
gauucaagcucuucuuacu

SEQ ID NO: 583887 - RNA, 19 nt, Homo sapiens
ccuggaagaugaugaagau

SEQ ID NO: 583888 - RNA, 19 nt, Homo sapiens
gaaguaaucaaaccugucu

SEQ ID NO: 583889 - RNA, 19 nt, Homo sapiens
ccaacgugcugcagggauu

SEQ ID NO: 583890 - RNA, 19 nt, Homo sapiens
caucaaacccggaccugaa

SEQ ID NO: 583891 - RNA, 19 nt, Homo sapiens
acgagaagcucaucaacau

SEQ ID NO: 583892 - RNA, 19 nt, Homo sapiens
ccagaggacugaucaagac

SEQ ID NO: 583893 - RNA, 19 nt, Homo sapiens
ggugugagccugacgucua

SEQ ID NO: 583894 - RNA, 19 nt, Homo sapiens
guacaaagggacaccaugu

SEQ ID NO: 583895 - RNA, 19 nt, Homo sapiens
gaagaggguggcacugaga

SEQ ID NO: 583896 - RNA, 19 nt, Homo sapiens
aaauaaauguccucaacuc

SEQ ID NO: 583897 - RNA, 19 nt, Homo sapiens
gcaagaaaugacuguaaau

SEQ ID NO: 583898 - RNA, 19 nt, Homo sapiens
gggaucaaccucaaauuca

SEQ ID NO: 583899 - RNA, 19 nt, Homo sapiens
gaguccagcuguuaugauc

SEQ ID NO: 583900 - RNA, 19 nt, Homo sapiens
ggagggcguuaguggauca

SEQ ID NO: 583901 - RNA, 19 nt, Homo sapiens
gaaccauggugcaaaagaa

SEQ ID NO: 583902 - RNA, 19 nt, Homo sapiens
gaugauaccucuuuugucu

SEQ ID NO: 583903 - RNA, 19 nt, Homo sapiens
ggagagacagccuggguau

SEQ ID NO: 583904 - RNA, 19 nt, Homo sapiens
agacauuuguguugugguu

SEQ ID NO: 583905 - RNA, 19 nt, Homo sapiens
uaacaucggaacaguguau

SEQ ID NO: 583906 - RNA, 19 nt, Homo sapiens
caaaggcuauggcacaacu

SEQ ID NO: 583907 - RNA, 19 nt, Homo sapiens
gagauaaacugaugaauug

SEQ ID NO: 583908 - RNA, 19 nt, Homo sapiens
gaagucaucugucauuaaa

SEQ ID NO: 583909 - RNA, 19 nt, Homo sapiens
gaagagaaguccaacagaa

SEQ ID NO: 583910 - RNA, 19 nt, Homo sapiens
gaaguucuguccucgguua

SEQ ID NO: 583911 - RNA, 19 nt, Homo sapiens
gaauauauguuuccuguca

SEQ ID NO: 583912 - RNA, 19 nt, Homo sapiens
cuacggagauggaugauaa

SEQ ID NO: 583913 - RNA, 19 nt, Homo sapiens
gcaaugauguggauucugu

SEQ ID NO: 583914 - RNA, 19 nt, Homo sapiens
gcagugauaguauggauua

SEQ ID NO: 583915 - RNA, 19 nt, Homo sapiens
ggaagcgccuggaagauga

SEQ ID NO: 583916 - RNA, 19 nt, Homo sapiens
caagugcccuucugcauga

SEQ ID NO: 583917 - RNA, 19 nt, Homo sapiens
ggacagacgucaggcagaa

SEQ ID NO: 583918 - RNA, 19 nt, Homo sapiens
caaaaugccugaugaugua

SEQ ID NO: 583919 - RNA, 19 nt, Homo sapiens
aaacacagcccaacaguga

SEQ ID NO: 583920 - RNA, 19 nt, Homo sapiens
ggcaagaaaugacuguaaa

SEQ ID NO: 583921 - RNA, 19 nt, Homo sapiens
gaaaucugcuacuccguau

SEQ ID NO: 583922 - RNA, 19 nt, Homo sapiens
ccucagggcucaagaaugu

SEQ ID NO: 583923 - RNA, 19 nt, Homo sapiens
ucagugaaaugaugaaaug

SEQ ID NO: 583924 - RNA, 19 nt, Homo sapiens
gugauaguauggauuauga

SEQ ID NO: 583925 - RNA, 19 nt, Homo sapiens
cgauauggcaucuguguua

SEQ ID NO: 583926 - RNA, 19 nt, Homo sapiens
ccacugcgcuccagcucua

SEQ ID NO: 583927 - RNA, 19 nt, Homo sapiens
gugaaaugaugaaauguga

SEQ ID NO: 583928 - RNA, 19 nt, Homo sapiens
gaugauaguggcagugaua

SEQ ID NO: 583929 - RNA, 19 nt, Homo sapiens
gcaaaucaaugaggugcuu

SEQ ID NO: 583930 - RNA, 19 nt, Homo sapiens
caccagaaguuuaaaggaa

SEQ ID NO: 583931 - RNA, 19 nt, Homo sapiens
ggacagcaauagggugauu

SEQ ID NO: 583932 - RNA, 19 nt, Homo sapiens
uauuaugucucuucucgua

SEQ ID NO: 583933 - RNA, 19 nt, Homo sapiens
caacagaaaguguaaauac

SEQ ID NO: 583934 - RNA, 19 nt, Homo sapiens
caagcuggcuccuuucuag

SEQ ID NO: 583935 - RNA, 19 nt, Homo sapiens
gugcuaaccugcauucugu

SEQ ID NO: 583936 - RNA, 19 nt, Homo sapiens
gauauggcaucuguguuaa

SEQ ID NO: 583937 - RNA, 19 nt, Homo sapiens
ugaaauaaauguccucaac

SEQ ID NO: 583938 - RNA, 19 nt, Homo sapiens
guacguggcugcaguucau

SEQ ID NO: 583939 - RNA, 19 nt, Homo sapiens
ucaaauucaugcacaauca

SEQ ID NO: 583940 - RNA, 19 nt, Homo sapiens
agacccagcucaacaaguu

SEQ ID NO: 583941 - RNA, 19 nt, Homo sapiens
gauaguggcagugauagua

SEQ ID NO: 583942 - RNA, 19 nt, Homo sapiens
gaaagaccaagcuggguuu

SEQ ID NO: 583943 - RNA, 19 nt, Homo sapiens
ucauagagcugaaucacau

SEQ ID NO: 583944 - RNA, 19 nt, Homo sapiens
gagcuguacuacuguguga

SEQ ID NO: 583945 - RNA, 19 nt, Homo sapiens
guacaugcagggacagaua

SEQ ID NO: 583946 - RNA, 19 nt, Homo sapiens
gaagcagacauuuguggua

SEQ ID NO: 583947 - RNA, 19 nt, Homo sapiens
ccagcgagguggagauuga

SEQ ID NO: 583948 - RNA, 19 nt, Homo sapiens
gagaggaagggaagaauug

SEQ ID NO: 583949 - RNA, 19 nt, Homo sapiens
gcucugaccuuugcucuuc

SEQ ID NO: 583950 - RNA, 19 nt, Homo sapiens
ugaauuggguggcgaguuc

SEQ ID NO: 583951 - RNA, 19 nt, Homo sapiens
agacgaagguguugugcuu

SEQ ID NO: 583952 - RNA, 19 nt, Homo sapiens
gagaagggauggguaugga

SEQ ID NO: 583953 - RNA, 19 nt, Homo sapiens
gcacgaugcugcugugacu

SEQ ID NO: 583954 - RNA, 19 nt, Homo sapiens
ucaagaauguguacagucu

SEQ ID NO: 583955 - RNA, 19 nt, Homo sapiens
gaagggaucaaccucaaau

SEQ ID NO: 583956 - RNA, 19 nt, Homo sapiens
ugaagaagcagacauuugu

SEQ ID NO: 583957 - RNA, 19 nt, Homo sapiens
ggaucaaccucaaauucau

SEQ ID NO: 583958 - RNA, 19 nt, Homo sapiens
gaaaugaugaaaugugaca

SEQ ID NO: 583959 - RNA, 19 nt, Homo sapiens
cagaaucacuagagcugaa

SEQ ID NO: 583960 - RNA, 19 nt, Homo sapiens
gcaucuguguuaacuucua

SEQ ID NO: 583961 - RNA, 19 nt, Homo sapiens
gcaugagccuucgggauga

SEQ ID NO: 583962 - RNA, 19 nt, Homo sapiens
gcuguggcuugguugguua

SEQ ID NO: 583963 - RNA, 19 nt, Homo sapiens
ggacugaucaagacucugu

SEQ ID NO: 583964 - RNA, 19 nt, Homo sapiens
aguaccagcuucagucuuu

SEQ ID NO: 583965 - RNA, 19 nt, Homo sapiens
acacuggagucacgcgaua

SEQ ID NO: 583966 - RNA, 19 nt, Homo sapiens
ggcccagacuccugaauug

SEQ ID NO: 583967 - RNA, 19 nt, Homo sapiens
gggcaagaaaugacuguaa

SEQ ID NO: 583968 - RNA, 19 nt, Homo sapiens
aaucugcuacuccguauua

SEQ ID NO: 583969 - RNA, 19 nt, Homo sapiens
gcccagacccacuacuaua

SEQ ID NO: 583970 - RNA, 19 nt, Homo sapiens
cagggucgauccagcaauu

SEQ ID NO: 583971 - RNA, 19 nt, Homo sapiens
gaaaagagaaccuccauca

SEQ ID NO: 583972 - RNA, 19 nt, Homo sapiens
gauucacccuaguggauuu

SEQ ID NO: 583973 - RNA, 19 nt, Homo sapiens
gcaugaccuucgagagauu

SEQ ID NO: 583974 - RNA, 19 nt, Homo sapiens
agaaugacauccgcaagaa

SEQ ID NO: 583975 - RNA, 19 nt, Homo sapiens
cuucuuagaugcugugaug

SEQ ID NO: 583976 - RNA, 19 nt, Homo sapiens
gagcagcaaugcaggugau

SEQ ID NO: 583977 - RNA, 19 nt, Homo sapiens
gauucaagcucuucuuacu

SEQ ID NO: 583978 - RNA, 19 nt, Homo sapiens
ccagacuccugaauugcua

SEQ ID NO: 583979 - RNA, 19 nt, Homo sapiens
ccuggaagaugaugaagau

SEQ ID NO: 583980 - RNA, 19 nt, Homo sapiens
gaaguaaucaaaccugucu

SEQ ID NO: 583981 - RNA, 19 nt, Homo sapiens
ccaacgugcugcagggauu

SEQ ID NO: 583982 - RNA, 19 nt, Homo sapiens
caucaaacccggaccugaa

SEQ ID NO: 583983 - RNA, 19 nt, Homo sapiens
acgagaagcucaucaacau

SEQ ID NO: 583984 - RNA, 19 nt, Homo sapiens
ccagaggacugaucaagac

SEQ ID NO: 583985 - RNA, 19 nt, Homo sapiens
ggugugagccugacgucua

SEQ ID NO: 583986 - RNA, 19 nt, Homo sapiens
guacaaagggacaccaugu

SEQ ID NO: 583987 - RNA, 19 nt, Homo sapiens
gaagaggguggcacugaga

SEQ ID NO: 583988 - RNA, 19 nt, Homo sapiens
aaauaaauguccucaacuc

SEQ ID NO: 583989 - RNA, 19 nt, Homo sapiens
gcaagaaaugacuguaaau

SEQ ID NO: 583990 - RNA, 19 nt, Homo sapiens
gggaucaaccucaaauuca

SEQ ID NO: 583991 - RNA, 19 nt, Homo sapiens
gaguccagcuguuaugauc

SEQ ID NO: 583992 - RNA, 19 nt, Homo sapiens
gaaccauggugcaaaagaa

SEQ ID NO: 583993 - RNA, 19 nt, Homo sapiens
ggagggcguuaguggauca

SEQ ID NO: 583994 - RNA, 19 nt, Homo sapiens
gaugauaccucuuuugucu

SEQ ID NO: 583995 - RNA, 19 nt, Homo sapiens
ggagagacagccuggguau

SEQ ID NO: 583996 - RNA, 19 nt, Homo sapiens
agacauuuguguugugguu

SEQ ID NO: 583997 - RNA, 19 nt, Homo sapiens
uaacaucggaacaguguau

SEQ ID NO: 583998 - RNA, 19 nt, Homo sapiens
caaaggcuauggcacaacu

SEQ ID NO: 583999 - RNA, 19 nt, Homo sapiens
ggaagagaaguccaacaga

SEQ ID NO: 584000 - RNA, 19 nt, Homo sapiens
gguguacaagggaauguua

SEQ ID NO: 584001 - RNA, 19 nt, Homo sapiens
ccacggagccaacucugaa

SEQ ID NO: 584002 - RNA, 19 nt, Homo sapiens
uugacgagcugcagaauca

SEQ ID NO: 584003 - RNA, 19 nt, Homo sapiens
ccacuggaauauauguuuc

SEQ ID NO: 584004 - RNA, 19 nt, Homo sapiens
ccagccagcucugaccuuu

SEQ ID NO: 584005 - RNA, 19 nt, Homo sapiens
ccuugucccuggcguuaua

SEQ ID NO: 584006 - RNA, 19 nt, Homo sapiens
cucaacaaguucuauacua

SEQ ID NO: 584007 - RNA, 19 nt, Homo sapiens
gagauaaacugaugaauug

SEQ ID NO: 584008 - RNA, 19 nt, Homo sapiens
gaagucaucugucauuaaa

SEQ ID NO: 584009 - RNA, 19 nt, Homo sapiens
gaagagaaguccaacagaa

SEQ ID NO: 584010 - RNA, 19 nt, Homo sapiens
gaaguucuguccucgguua

SEQ ID NO: 584011 - RNA, 19 nt, Homo sapiens
cuacggagauggaugauaa

SEQ ID NO: 584012 - RNA, 19 nt, Homo sapiens
gcaaugauguggauucugu

SEQ ID NO: 584013 - RNA, 19 nt, Homo sapiens
gcagugauaguauggauua

SEQ ID NO: 584014 - RNA, 19 nt, Homo sapiens
uaauggagauuguuacuga

SEQ ID NO: 584015 - RNA, 19 nt, Homo sapiens
ggaagcgccuggaagauga

SEQ ID NO: 584016 - RNA, 19 nt, Homo sapiens
caagugcccuucugcauga

SEQ ID NO: 584017 - RNA, 19 nt, Homo sapiens
ggacagacgucaggcagaa

SEQ ID NO: 584018 - RNA, 19 nt, Homo sapiens
ccaaagcgcacuucgauuu

SEQ ID NO: 584019 - RNA, 19 nt, Homo sapiens
caaaaugccugaugaugua

SEQ ID NO: 584020 - RNA, 19 nt, Homo sapiens
aaacacagcccaacaguga

SEQ ID NO: 584021 - RNA, 19 nt, Homo sapiens
ggcaagaaaugacuguaaa

SEQ ID NO: 584022 - RNA, 19 nt, Homo sapiens
gaaaucugcuacuccguau

SEQ ID NO: 584023 - RNA, 19 nt, Homo sapiens
ccucagggcucaagaaugu

SEQ ID NO: 584024 - RNA, 19 nt, Homo sapiens
ucagugaaaugaugaaaug

SEQ ID NO: 584025 - RNA, 19 nt, Homo sapiens
gaguauauguuuccuguca

SEQ ID NO: 584026 - RNA, 19 nt, Homo sapiens
gugauaguauggauuauga

SEQ ID NO: 584027 - RNA, 19 nt, Homo sapiens
cgauauggcaucuguguua

SEQ ID NO: 584028 - RNA, 19 nt, Homo sapiens
ccacugcgcuccagcucua

SEQ ID NO: 584029 - RNA, 19 nt, Homo sapiens
gugaaaugaugaaauguga

SEQ ID NO: 584030 - RNA, 19 nt, Homo sapiens
gaugauaguggcagugaua

SEQ ID NO: 584031 - RNA, 19 nt, Homo sapiens
gcaaaucaaugaggugcuu

SEQ ID NO: 584032 - RNA, 19 nt, Homo sapiens
caccagaaguuuaaaggaa

SEQ ID NO: 584033 - RNA, 19 nt, Homo sapiens
ggacagcaauagggugauu

SEQ ID NO: 584034 - RNA, 19 nt, Homo sapiens
uauuaugucucuucucgua

SEQ ID NO: 584035 - RNA, 19 nt, Homo sapiens
caacagaaaguguaaauac

SEQ ID NO: 584036 - RNA, 19 nt, Homo sapiens
caagcuggcuccuuucuag

SEQ ID NO: 584037 - RNA, 19 nt, Homo sapiens
gugcuaaccugcauucugu

SEQ ID NO: 584038 - RNA, 19 nt, Homo sapiens
gauauggcaucuguguuaa

SEQ ID NO: 584039 - RNA, 19 nt, Homo sapiens
ugaaauaaauguccucaac

SEQ ID NO: 584040 - RNA, 19 nt, Homo sapiens
guacguggcugcaguucau

SEQ ID NO: 584041 - RNA, 19 nt, Homo sapiens
ucaaauucaugcacaauca

SEQ ID NO: 584042 - RNA, 19 nt, Homo sapiens
agacccagcucaacaaguu

SEQ ID NO: 584043 - RNA, 19 nt, Homo sapiens
gauaguggcagugauagua

SEQ ID NO: 584044 - RNA, 19 nt, Homo sapiens
gaaagaccaagcuggguuu

SEQ ID NO: 584045 - RNA, 19 nt, Homo sapiens
ucauagagcugaaucacau

SEQ ID NO: 584046 - RNA, 19 nt, Homo sapiens
gagcuguacuacuguguga

SEQ ID NO: 584047 - RNA, 19 nt, Homo sapiens
guacaugcagggacagaua

SEQ ID NO: 584048 - RNA, 19 nt, Homo sapiens
gaagcagacauuuguggua

SEQ ID NO: 584049 - RNA, 19 nt, Homo sapiens
ccagcgagguggagauuga

SEQ ID NO: 584050 - RNA, 19 nt, Homo sapiens
gagaggaagggaagaauug

SEQ ID NO: 584051 - RNA, 19 nt, Homo sapiens
gcucugaccuuugcucuuc

SEQ ID NO: 584052 - RNA, 19 nt, Homo sapiens
ugaauuggguggcgaguuc

SEQ ID NO: 584053 - RNA, 19 nt, Homo sapiens
agacgaagguguugugcuu

SEQ ID NO: 584054 - RNA, 19 nt, Homo sapiens
gagaagggauggguaugga

SEQ ID NO: 584055 - RNA, 19 nt, Homo sapiens
gcacgaugcugcugugacu

SEQ ID NO: 584056 - RNA, 19 nt, Homo sapiens
ucaagaauguguacagucu

SEQ ID NO: 584057 - RNA, 19 nt, Homo sapiens
gaagggaucaaccucaaau

SEQ ID NO: 584058 - RNA, 19 nt, Homo sapiens
ugaagaagcagacauuugu

SEQ ID NO: 584059 - RNA, 19 nt, Homo sapiens
ggaucaaccucaaauucau

SEQ ID NO: 584060 - RNA, 19 nt, Homo sapiens
gcacuucgauuuucagaau

SEQ ID NO: 584061 - RNA, 19 nt, Homo sapiens
gaaaugaugaaaugugaca

SEQ ID NO: 584062 - RNA, 19 nt, Homo sapiens
cagaaucacuagagcugaa

SEQ ID NO: 584063 - RNA, 19 nt, Homo sapiens
gcaucuguguuaacuucua

SEQ ID NO: 584064 - RNA, 19 nt, Homo sapiens
gcaugagccuucgggauga

SEQ ID NO: 584065 - RNA, 19 nt, Homo sapiens
gcuguggcuugguugguua

SEQ ID NO: 584066 - RNA, 19 nt, Homo sapiens
ggacugaucaagacucugu

SEQ ID NO: 584067 - RNA, 19 nt, Homo sapiens
aguaccagcuucagucuuu

SEQ ID NO: 584068 - RNA, 19 nt, Homo sapiens
acacuggagucacgcgaua

SEQ ID NO: 584069 - RNA, 19 nt, Homo sapiens
ggcccagacuccugaauug

SEQ ID NO: 584070 - RNA, 19 nt, Homo sapiens
gggcaagaaaugacuguaa

SEQ ID NO: 584071 - RNA, 19 nt, Homo sapiens
aaucugcuacuccguauua

SEQ ID NO: 584072 - RNA, 19 nt, Homo sapiens
gcccagacccacuacuaua

SEQ ID NO: 584073 - RNA, 19 nt, Homo sapiens
cagggucgauccagcaauu

SEQ ID NO: 584074 - RNA, 19 nt, Homo sapiens
gaaaagagaaccuccauca

SEQ ID NO: 584075 - RNA, 19 nt, Homo sapiens
gauucacccuaguggauuu

SEQ ID NO: 584076 - RNA, 19 nt, Homo sapiens
gcaugaccuucgagagauu

SEQ ID NO: 584077 - RNA, 19 nt, Homo sapiens
agaaugacauccgcaagaa

SEQ ID NO: 584078 - RNA, 19 nt, Homo sapiens
cuucuuagaugcugugaug

SEQ ID NO: 584079 - RNA, 19 nt, Homo sapiens
gagcagcaaugcaggugau

SEQ ID NO: 584080 - RNA, 19 nt, Homo sapiens
gauucaagcucuucuuacu

SEQ ID NO: 584081 - RNA, 19 nt, Homo sapiens
ccagacuccugaauugcua

SEQ ID NO: 584082 - RNA, 19 nt, Homo sapiens
ccuggaagaugaugaagau

SEQ ID NO: 584083 - RNA, 19 nt, Homo sapiens
gaaguaaucaaaccugucu

SEQ ID NO: 584084 - RNA, 19 nt, Homo sapiens
ccaacgugcugcagggauu

SEQ ID NO: 584085 - RNA, 19 nt, Homo sapiens
caucaaacccggaccugaa

SEQ ID NO: 584086 - RNA, 19 nt, Homo sapiens
acgagaagcucaucaacau

SEQ ID NO: 584087 - RNA, 19 nt, Homo sapiens
ccagaggacugaucaagac

SEQ ID NO: 584088 - RNA, 19 nt, Homo sapiens
ggugugagccugacgucua

SEQ ID NO: 584089 - RNA, 19 nt, Homo sapiens
guacaaagggacaccaugu

SEQ ID NO: 584090 - RNA, 19 nt, Homo sapiens
gaagaggguggcacugaga

SEQ ID NO: 584091 - RNA, 19 nt, Homo sapiens
aaauaaauguccucaacuc

SEQ ID NO: 584092 - RNA, 19 nt, Homo sapiens
gcaagaaaugacuguaaau

SEQ ID NO: 584093 - RNA, 19 nt, Homo sapiens
gggaucaaccucaaauuca

SEQ ID NO: 584094 - RNA, 19 nt, Homo sapiens
gaaccauggugcaaaagaa

SEQ ID NO: 584095 - RNA, 19 nt, Homo sapiens
gaguccagcuguuaugauc

SEQ ID NO: 584096 - RNA, 19 nt, Homo sapiens
ggagggcguuaguggauca

SEQ ID NO: 584097 - RNA, 19 nt, Homo sapiens
gaugauaccucuuuugucu

SEQ ID NO: 584098 - RNA, 19 nt, Homo sapiens
ggagagacagccuggguau

SEQ ID NO: 584099 - RNA, 19 nt, Homo sapiens
agacauuuguguugugguu

SEQ ID NO: 584100 - RNA, 19 nt, Homo sapiens
uaacaucggaacaguguau

SEQ ID NO: 584101 - RNA, 19 nt, Homo sapiens
caaaggcuauggcacaacu

SEQ ID NO: 584102 - RNA, 19 nt, Homo sapiens
ggaagagaaguccaacaga

SEQ ID NO: 584103 - RNA, 19 nt, Homo sapiens
gguguacaagggaauguua

SEQ ID NO: 584104 - RNA, 19 nt, Homo sapiens
ccacggagccaacucugaa

SEQ ID NO: 584105 - RNA, 19 nt, Homo sapiens
uugacgagcugcagaauca

SEQ ID NO: 584106 - RNA, 19 nt, Homo sapiens
ccagccagcucugaccuuu

SEQ ID NO: 584107 - RNA, 19 nt, Homo sapiens
gagauaaacugaugaauug

SEQ ID NO: 584108 - RNA, 19 nt, Homo sapiens
gaagucaucugucauuaaa

SEQ ID NO: 584109 - RNA, 19 nt, Homo sapiens
gaagagaaguccaacagaa

SEQ ID NO: 584110 - RNA, 19 nt, Homo sapiens
gaaguucuguccucgguua

SEQ ID NO: 584111 - RNA, 19 nt, Homo sapiens
cuacggagauggaugauaa

SEQ ID NO: 584112 - RNA, 19 nt, Homo sapiens
gcaaugauguggauucugu

SEQ ID NO: 584113 - RNA, 19 nt, Homo sapiens
gcagugauaguauggauua

SEQ ID NO: 584114 - RNA, 19 nt, Homo sapiens
ggaagcgccuggaagauga

SEQ ID NO: 584115 - RNA, 19 nt, Homo sapiens
caagugcccuucugcauga

SEQ ID NO: 584116 - RNA, 19 nt, Homo sapiens
ggacagacgucaggcagaa

SEQ ID NO: 584117 - RNA, 19 nt, Homo sapiens
ccaaagcgcacuucgauuu

SEQ ID NO: 584118 - RNA, 19 nt, Homo sapiens
caaaaugccugaugaugua

SEQ ID NO: 584119 - RNA, 19 nt, Homo sapiens
aaacacagcccaacaguga

SEQ ID NO: 584120 - RNA, 19 nt, Homo sapiens
ggcaagaaaugacuguaaa

SEQ ID NO: 584121 - RNA, 19 nt, Homo sapiens
gaaaucugcuacuccguau

SEQ ID NO: 584122 - RNA, 19 nt, Homo sapiens
ccucagggcucaagaaugu

SEQ ID NO: 584123 - RNA, 19 nt, Homo sapiens
ucagugaaaugaugaaaug

SEQ ID NO: 584124 - RNA, 19 nt, Homo sapiens
gaguauauguuuccuguca

SEQ ID NO: 584125 - RNA, 19 nt, Homo sapiens
gugauaguauggauuauga

SEQ ID NO: 584126 - RNA, 19 nt, Homo sapiens
cgauauggcaucuguguua

SEQ ID NO: 584127 - RNA, 19 nt, Homo sapiens
ccacugcgcuccagcucua

SEQ ID NO: 584128 - RNA, 19 nt, Homo sapiens
gugaaaugaugaaauguga

SEQ ID NO: 584129 - RNA, 19 nt, Homo sapiens
gaugauaguggcagugaua

SEQ ID NO: 584130 - RNA, 19 nt, Homo sapiens
gcaaaucaaugaggugcuu

SEQ ID NO: 584131 - RNA, 19 nt, Homo sapiens
caccagaaguuuaaaggaa

SEQ ID NO: 584132 - RNA, 19 nt, Homo sapiens
ggacagcaauagggugauu

SEQ ID NO: 584133 - RNA, 19 nt, Homo sapiens
uauuaugucucuucucgua

SEQ ID NO: 584134 - RNA, 19 nt, Homo sapiens
caacagaaaguguaaauac

SEQ ID NO: 584135 - RNA, 19 nt, Homo sapiens
caagcuggcuccuuucuag

SEQ ID NO: 584136 - RNA, 19 nt, Homo sapiens
gugcuaaccugcauucugu

SEQ ID NO: 584137 - RNA, 19 nt, Homo sapiens
gauauggcaucuguguuaa

SEQ ID NO: 584138 - RNA, 19 nt, Homo sapiens
ugaaauaaauguccucaac

SEQ ID NO: 584139 - RNA, 19 nt, Homo sapiens
guacguggcugcaguucau

SEQ ID NO: 584140 - RNA, 19 nt, Homo sapiens
ucaaauucaugcacaauca

SEQ ID NO: 584141 - RNA, 19 nt, Homo sapiens
agacccagcucaacaaguu

SEQ ID NO: 584142 - RNA, 19 nt, Homo sapiens
gauaguggcagugauagua

SEQ ID NO: 584143 - RNA, 19 nt, Homo sapiens
gaaagaccaagcuggguuu

SEQ ID NO: 584144 - RNA, 19 nt, Homo sapiens
ucauagagcugaaucacau

SEQ ID NO: 584145 - RNA, 19 nt, Homo sapiens
gagcuguacuacuguguga

SEQ ID NO: 584146 - RNA, 19 nt, Homo sapiens
guacaugcagggacagaua

SEQ ID NO: 584147 - RNA, 19 nt, Homo sapiens
gaagcagacauuuguggua

SEQ ID NO: 584148 - RNA, 19 nt, Homo sapiens
ccagcgagguggagauuga

SEQ ID NO: 584149 - RNA, 19 nt, Homo sapiens
gagaggaagggaagaauug

SEQ ID NO: 584150 - RNA, 19 nt, Homo sapiens
gcucugaccuuugcucuuc

SEQ ID NO: 584151 - RNA, 19 nt, Homo sapiens
ugaauuggguggcgaguuc

SEQ ID NO: 584152 - RNA, 19 nt, Homo sapiens
agacgaagguguugugcuu

SEQ ID NO: 584153 - RNA, 19 nt, Homo sapiens
gagaagggauggguaugga

SEQ ID NO: 584154 - RNA, 19 nt, Homo sapiens
gcacgaugcugcugugacu

SEQ ID NO: 584155 - RNA, 19 nt, Homo sapiens
ucaagaauguguacagucu

SEQ ID NO: 584156 - RNA, 19 nt, Homo sapiens
gaagggaucaaccucaaau

SEQ ID NO: 584157 - RNA, 19 nt, Homo sapiens
ugaagaagcagacauuugu

SEQ ID NO: 584158 - RNA, 19 nt, Homo sapiens
gcacuucgauuuucagaau

SEQ ID NO: 584159 - RNA, 19 nt, Homo sapiens
ggaucaaccucaaauucau

SEQ ID NO: 584160 - RNA, 19 nt, Homo sapiens
gaaaugaugaaaugugaca

SEQ ID NO: 584161 - RNA, 19 nt, Homo sapiens
cagaaucacuagagcugaa

SEQ ID NO: 584162 - RNA, 19 nt, Homo sapiens
gcaucuguguuaacuucua

SEQ ID NO: 584163 - RNA, 19 nt, Homo sapiens
gcaugagccuucgggauga

SEQ ID NO: 584164 - RNA, 19 nt, Homo sapiens
gcuguggcuugguugguua

SEQ ID NO: 584165 - RNA, 19 nt, Homo sapiens
ggacugaucaagacucugu

SEQ ID NO: 584166 - RNA, 19 nt, Homo sapiens
aguaccagcuucagucuuu

SEQ ID NO: 584167 - RNA, 19 nt, Homo sapiens
acacuggagucacgcgaua

SEQ ID NO: 584168 - RNA, 19 nt, Homo sapiens
ggcccagacuccugaauug

SEQ ID NO: 584169 - RNA, 19 nt, Homo sapiens
gggcaagaaaugacuguaa

SEQ ID NO: 584170 - RNA, 19 nt, Homo sapiens
aaucugcuacuccguauua

SEQ ID NO: 584171 - RNA, 19 nt, Homo sapiens
gcccagacccacuacuaua

SEQ ID NO: 584172 - RNA, 19 nt, Homo sapiens
cagggucgauccagcaauu

SEQ ID NO: 584173 - RNA, 19 nt, Homo sapiens
gaaaagagaaccuccauca

SEQ ID NO: 584174 - RNA, 19 nt, Homo sapiens
gauucacccuaguggauuu

SEQ ID NO: 584175 - RNA, 19 nt, Homo sapiens
gcaugaccuucgagagauu

SEQ ID NO: 584176 - RNA, 19 nt, Homo sapiens
agaaugacauccgcaagaa

SEQ ID NO: 584177 - RNA, 19 nt, Homo sapiens
cuucuuagaugcugugaug

SEQ ID NO: 584178 - RNA, 19 nt, Homo sapiens
gagcagcaaugcaggugau

SEQ ID NO: 584179 - RNA, 19 nt, Homo sapiens
gauucaagcucuucuuacu

SEQ ID NO: 584180 - RNA, 19 nt, Homo sapiens
ccagacuccugaauugcua

SEQ ID NO: 584181 - RNA, 19 nt, Homo sapiens
ccuggaagaugaugaagau

SEQ ID NO: 584182 - RNA, 19 nt, Homo sapiens
gaaguaaucaaaccugucu

SEQ ID NO: 584183 - RNA, 19 nt, Homo sapiens
ccaacgugcugcagggauu

SEQ ID NO: 584184 - RNA, 19 nt, Homo sapiens
caucaaacccggaccugaa

SEQ ID NO: 584185 - RNA, 19 nt, Homo sapiens
acgagaagcucaucaacau

SEQ ID NO: 584186 - RNA, 19 nt, Homo sapiens
ccagaggacugaucaagac

SEQ ID NO: 584187 - RNA, 19 nt, Homo sapiens
ggugugagccugacgucua

SEQ ID NO: 584188 - RNA, 19 nt, Homo sapiens
guacaaagggacaccaugu

SEQ ID NO: 584189 - RNA, 19 nt, Homo sapiens
gaagaggguggcacugaga

SEQ ID NO: 584190 - RNA, 19 nt, Homo sapiens
aaauaaauguccucaacuc

SEQ ID NO: 584191 - RNA, 19 nt, Homo sapiens
gcaagaaaugacuguaaau

SEQ ID NO: 584192 - RNA, 19 nt, Homo sapiens
gggaucaaccucaaauuca

SEQ ID NO: 584193 - RNA, 19 nt, Homo sapiens
gaaccauggugcaaaagaa

SEQ ID NO: 584194 - RNA, 19 nt, Homo sapiens
gaguccagcuguuaugauc

SEQ ID NO: 584195 - RNA, 19 nt, Homo sapiens
ggagggcguuaguggauca

SEQ ID NO: 584196 - RNA, 19 nt, Homo sapiens
gaugauaccucuuuugucu

SEQ ID NO: 584197 - RNA, 19 nt, Homo sapiens
ggagagacagccuggguau

SEQ ID NO: 584198 - RNA, 19 nt, Homo sapiens
agacauuuguguugugguu

SEQ ID NO: 584199 - RNA, 19 nt, Homo sapiens
uaacaucggaacaguguau

SEQ ID NO: 584200 - RNA, 19 nt, Homo sapiens
caaaggcuauggcacaacu

SEQ ID NO: 584201 - RNA, 19 nt, Homo sapiens
ggaagagaaguccaacaga

SEQ ID NO: 584202 - RNA, 19 nt, Homo sapiens
gguguacaagggaauguua

SEQ ID NO: 584203 - RNA, 19 nt, Homo sapiens
ccacggagccaacucugaa

SEQ ID NO: 584204 - RNA, 19 nt, Homo sapiens
uugacgagcugcagaauca

SEQ ID NO: 584205 - RNA, 19 nt, Homo sapiens
ccagccagcucugaccuuu

SEQ ID NO: 584206 - RNA, 19 nt, Homo sapiens
gauaaacugaugaauugga

SEQ ID NO: 584207 - RNA, 19 nt, Homo sapiens
gagauaaacugaugaauug

SEQ ID NO: 584208 - RNA, 19 nt, Homo sapiens
gaagucaucugucauuaaa

SEQ ID NO: 584209 - RNA, 19 nt, Homo sapiens
gaagagaaguccaacagaa

SEQ ID NO: 584210 - RNA, 19 nt, Homo sapiens
gaaguucuguccucgguua

SEQ ID NO: 584211 - RNA, 19 nt, Homo sapiens
cuacggagauggaugauaa

SEQ ID NO: 584212 - RNA, 19 nt, Homo sapiens
gcaaugauguggauucugu

SEQ ID NO: 584213 - RNA, 19 nt, Homo sapiens
gcagugauaguauggauua

SEQ ID NO: 584214 - RNA, 19 nt, Homo sapiens
uaauggagauuguuacuga

SEQ ID NO: 584215 - RNA, 19 nt, Homo sapiens
ggaagcgccuggaagauga

SEQ ID NO: 584216 - RNA, 19 nt, Homo sapiens
caagugcccuucugcauga

SEQ ID NO: 584217 - RNA, 19 nt, Homo sapiens
ggacagacgucaggcagaa

SEQ ID NO: 584218 - RNA, 19 nt, Homo sapiens
ccaaagcgcacuucgauuu

SEQ ID NO: 584219 - RNA, 19 nt, Homo sapiens
caaaaugccugaugaugua

SEQ ID NO: 584220 - RNA, 19 nt, Homo sapiens
aaacacagcccaacaguga

SEQ ID NO: 584221 - RNA, 19 nt, Homo sapiens
ggcaagaaaugacuguaaa

SEQ ID NO: 584222 - RNA, 19 nt, Homo sapiens
gaaaucugcuacuccguau

SEQ ID NO: 584223 - RNA, 19 nt, Homo sapiens
ccucagggcucaagaaugu

SEQ ID NO: 584224 - RNA, 19 nt, Homo sapiens
ucagugaaaugaugaaaug

SEQ ID NO: 584225 - RNA, 19 nt, Homo sapiens
gaguauauguuuccuguca

SEQ ID NO: 584226 - RNA, 19 nt, Homo sapiens
gugauaguauggauuauga

SEQ ID NO: 584227 - RNA, 19 nt, Homo sapiens
cgauauggcaucuguguua

SEQ ID NO: 584228 - RNA, 19 nt, Homo sapiens
ccacugcgcuccagcucua

SEQ ID NO: 584229 - RNA, 19 nt, Homo sapiens
gugaaaugaugaaauguga

SEQ ID NO: 584230 - RNA, 19 nt, Homo sapiens
gaugauaguggcagugaua

SEQ ID NO: 584231 - RNA, 19 nt, Homo sapiens
gcaaaucaaugaggugcuu

SEQ ID NO: 584232 - RNA, 19 nt, Homo sapiens
caccagaaguuuaaaggaa

SEQ ID NO: 584233 - RNA, 19 nt, Homo sapiens
ggacagcaauagggugauu

SEQ ID NO: 584234 - RNA, 19 nt, Homo sapiens
uauuaugucucuucucgua

SEQ ID NO: 584235 - RNA, 19 nt, Homo sapiens
caacagaaaguguaaauac

SEQ ID NO: 584236 - RNA, 19 nt, Homo sapiens
caagcuggcuccuuucuag

SEQ ID NO: 584237 - RNA, 19 nt, Homo sapiens
gugcuaaccugcauucugu

SEQ ID NO: 584238 - RNA, 19 nt, Homo sapiens
gauauggcaucuguguuaa

SEQ ID NO: 584239 - RNA, 19 nt, Homo sapiens
ugaaauaaauguccucaac

SEQ ID NO: 584240 - RNA, 19 nt, Homo sapiens
guacguggcugcaguucau

SEQ ID NO: 584241 - RNA, 19 nt, Homo sapiens
ucaaauucaugcacaauca

SEQ ID NO: 584242 - RNA, 19 nt, Homo sapiens
agacccagcucaacaaguu

SEQ ID NO: 584243 - RNA, 19 nt, Homo sapiens
gauaguggcagugauagua

SEQ ID NO: 584244 - RNA, 19 nt, Homo sapiens
gaaagaccaagcuggguuu

SEQ ID NO: 584245 - RNA, 19 nt, Homo sapiens
ucauagagcugaaucacau

SEQ ID NO: 584246 - RNA, 19 nt, Homo sapiens
gagcuguacuacuguguga

SEQ ID NO: 584247 - RNA, 19 nt, Homo sapiens
guacaugcagggacagaua

SEQ ID NO: 584248 - RNA, 19 nt, Homo sapiens
gaagcagacauuuguggua

SEQ ID NO: 584249 - RNA, 19 nt, Homo sapiens
ccagcgagguggagauuga

SEQ ID NO: 584250 - RNA, 19 nt, Homo sapiens
gagaggaagggaagaauug

SEQ ID NO: 584251 - RNA, 19 nt, Homo sapiens
gcucugaccuuugcucuuc

SEQ ID NO: 584252 - RNA, 19 nt, Homo sapiens
ugaauuggguggcgaguuc

SEQ ID NO: 584253 - RNA, 19 nt, Homo sapiens
agacgaagguguugugcuu

SEQ ID NO: 584254 - RNA, 19 nt, Homo sapiens
gagaagggauggguaugga

SEQ ID NO: 584255 - RNA, 19 nt, Homo sapiens
gcacgaugcugcugugacu

SEQ ID NO: 584256 - RNA, 19 nt, Homo sapiens
ucaagaauguguacagucu

SEQ ID NO: 584257 - RNA, 19 nt, Homo sapiens
gaagggaucaaccucaaau

SEQ ID NO: 584258 - RNA, 19 nt, Homo sapiens
ugaagaagcagacauuugu

SEQ ID NO: 584259 - RNA, 19 nt, Homo sapiens
ggaucaaccucaaauucau

SEQ ID NO: 584260 - RNA, 19 nt, Homo sapiens
gcacuucgauuuucagaau

SEQ ID NO: 584261 - RNA, 19 nt, Homo sapiens
gaaaugaugaaaugugaca

SEQ ID NO: 584262 - RNA, 19 nt, Homo sapiens
cagaaucacuagagcugaa

SEQ ID NO: 584263 - RNA, 19 nt, Homo sapiens
gcaucuguguuaacuucua

SEQ ID NO: 584264 - RNA, 19 nt, Homo sapiens
gcaugagccuucgggauga

SEQ ID NO: 584265 - RNA, 19 nt, Homo sapiens
gcuguggcuugguugguua

SEQ ID NO: 584266 - RNA, 19 nt, Homo sapiens
ggacugaucaagacucugu

SEQ ID NO: 584267 - RNA, 19 nt, Homo sapiens
aguaccagcuucagucuuu

SEQ ID NO: 584268 - RNA, 19 nt, Homo sapiens
acacuggagucacgcgaua

SEQ ID NO: 584269 - RNA, 19 nt, Homo sapiens
ggcccagacuccugaauug

SEQ ID NO: 584270 - RNA, 19 nt, Homo sapiens
gggcaagaaaugacuguaa

SEQ ID NO: 584271 - RNA, 19 nt, Homo sapiens
aaucugcuacuccguauua

SEQ ID NO: 584272 - RNA, 19 nt, Homo sapiens
gcccagacccacuacuaua

SEQ ID NO: 584273 - RNA, 19 nt, Homo sapiens
cagggucgauccagcaauu

SEQ ID NO: 584274 - RNA, 19 nt, Homo sapiens
gaaaagagaaccuccauca

SEQ ID NO: 584275 - RNA, 19 nt, Homo sapiens
gauucacccuaguggauuu

SEQ ID NO: 584276 - RNA, 19 nt, Homo sapiens
gcaugaccuucgagagauu

SEQ ID NO: 584277 - RNA, 19 nt, Homo sapiens
agaaugacauccgcaagaa

SEQ ID NO: 584278 - RNA, 19 nt, Homo sapiens
cuucuuagaugcugugaug

SEQ ID NO: 584279 - RNA, 19 nt, Homo sapiens
gagcagcaaugcaggugau

SEQ ID NO: 584280 - RNA, 19 nt, Homo sapiens
gauucaagcucuucuuacu

SEQ ID NO: 584281 - RNA, 19 nt, Homo sapiens
ccagacuccugaauugcua

SEQ ID NO: 584282 - RNA, 19 nt, Homo sapiens
ccuggaagaugaugaagau

SEQ ID NO: 584283 - RNA, 19 nt, Homo sapiens
gaaguaaucaaaccugucu

SEQ ID NO: 584284 - RNA, 19 nt, Homo sapiens
ccaacgugcugcagggauu

SEQ ID NO: 584285 - RNA, 19 nt, Homo sapiens
caucaaacccggaccugaa

SEQ ID NO: 584286 - RNA, 19 nt, Homo sapiens
acgagaagcucaucaacau

SEQ ID NO: 584287 - RNA, 19 nt, Homo sapiens
ccagaggacugaucaagac

SEQ ID NO: 584288 - RNA, 19 nt, Homo sapiens
ggugugagccugacgucua

SEQ ID NO: 584289 - RNA, 19 nt, Homo sapiens
guacaaagggacaccaugu

SEQ ID NO: 584290 - RNA, 19 nt, Homo sapiens
gaagaggguggcacugaga

SEQ ID NO: 584291 - RNA, 19 nt, Homo sapiens
aaauaaauguccucaacuc

SEQ ID NO: 584292 - RNA, 19 nt, Homo sapiens
gcaagaaaugacuguaaau

SEQ ID NO: 584293 - RNA, 19 nt, Homo sapiens
gggaucaaccucaaauuca

SEQ ID NO: 584294 - RNA, 19 nt, Homo sapiens
gaaccauggugcaaaagaa

SEQ ID NO: 584295 - RNA, 19 nt, Homo sapiens
gaguccagcuguuaugauc

SEQ ID NO: 584296 - RNA, 19 nt, Homo sapiens
ggagggcguuaguggauca

SEQ ID NO: 584297 - RNA, 19 nt, Homo sapiens
gaugauaccucuuuugucu

SEQ ID NO: 584298 - RNA, 19 nt, Homo sapiens
ggagagacagccuggguau

SEQ ID NO: 584299 - RNA, 19 nt, Homo sapiens
agacauuuguguugugguu

SEQ ID NO: 584300 - RNA, 19 nt, Homo sapiens
uaacaucggaacaguguau

SEQ ID NO: 584301 - RNA, 19 nt, Homo sapiens
caaaggcuauggcacaacu

SEQ ID NO: 584302 - RNA, 19 nt, Homo sapiens
ggaagagaaguccaacaga

SEQ ID NO: 584303 - RNA, 19 nt, Homo sapiens
gguguacaagggaauguua

SEQ ID NO: 584304 - RNA, 19 nt, Homo sapiens
ccacggagccaacucugaa

SEQ ID NO: 584305 - RNA, 19 nt, Homo sapiens
uugacgagcugcagaauca

SEQ ID NO: 584306 - RNA, 19 nt, Homo sapiens
ccagccagcucugaccuuu

SEQ ID NO: 584307 - RNA, 19 nt, Homo sapiens
gagauaaacugaugaauug

SEQ ID NO: 584308 - RNA, 19 nt, Homo sapiens
gaagucaucugucauuaaa

SEQ ID NO: 584309 - RNA, 19 nt, Homo sapiens
gaagagaaguccaacagaa

SEQ ID NO: 584310 - RNA, 19 nt, Homo sapiens
gaaguucuguccucgguua

SEQ ID NO: 584311 - RNA, 19 nt, Homo sapiens
cuacggagauggaugauaa

SEQ ID NO: 584312 - RNA, 19 nt, Homo sapiens
gcaaugauguggauucugu

SEQ ID NO: 584313 - RNA, 19 nt, Homo sapiens
gcagugauaguauggauua

SEQ ID NO: 584314 - RNA, 19 nt, Homo sapiens
ggaagcgccuggaagauga

SEQ ID NO: 584315 - RNA, 19 nt, Homo sapiens
caagugcccuucugcauga

SEQ ID NO: 584316 - RNA, 19 nt, Homo sapiens
ggacagacgucaggcagaa

SEQ ID NO: 584317 - RNA, 19 nt, Homo sapiens
ccaaagcgcacuucgauuu

SEQ ID NO: 584318 - RNA, 19 nt, Homo sapiens
caaaaugccugaugaugua

SEQ ID NO: 584319 - RNA, 19 nt, Homo sapiens
aaacacagcccaacaguga

SEQ ID NO: 584320 - RNA, 19 nt, Homo sapiens
ggcaagaaaugacuguaaa

SEQ ID NO: 584321 - RNA, 19 nt, Homo sapiens
gaaaucugcuacuccguau

SEQ ID NO: 584322 - RNA, 19 nt, Homo sapiens
ccucagggcucaagaaugu

SEQ ID NO: 584323 - RNA, 19 nt, Homo sapiens
ucagugaaaugaugaaaug

SEQ ID NO: 584324 - RNA, 19 nt, Homo sapiens
gaguauauguuuccuguca

SEQ ID NO: 584325 - RNA, 19 nt, Homo sapiens
gugauaguauggauuauga

SEQ ID NO: 584326 - RNA, 19 nt, Homo sapiens
cgauauggcaucuguguua

SEQ ID NO: 584327 - RNA, 19 nt, Homo sapiens
ccacugcgcuccagcucua

SEQ ID NO: 584328 - RNA, 19 nt, Homo sapiens
gugaaaugaugaaauguga

SEQ ID NO: 584329 - RNA, 19 nt, Homo sapiens
gaugauaguggcagugaua

SEQ ID NO: 584330 - RNA, 19 nt, Homo sapiens
gcaaaucaaugaggugcuu

SEQ ID NO: 584331 - RNA, 19 nt, Homo sapiens
caccagaaguuuaaaggaa

SEQ ID NO: 584332 - RNA, 19 nt, Homo sapiens
ggacagcaauagggugauu

SEQ ID NO: 584333 - RNA, 19 nt, Homo sapiens
uauuaugucucuucucgua

SEQ ID NO: 584334 - RNA, 19 nt, Homo sapiens
caacagaaaguguaaauac

SEQ ID NO: 584335 - RNA, 19 nt, Homo sapiens
caagcuggcuccuuucuag

SEQ ID NO: 584336 - RNA, 19 nt, Homo sapiens
gugcuaaccugcauucugu

SEQ ID NO: 584337 - RNA, 19 nt, Homo sapiens
gauauggcaucuguguuaa

SEQ ID NO: 584338 - RNA, 19 nt, Homo sapiens
ugaaauaaauguccucaac

SEQ ID NO: 584339 - RNA, 19 nt, Homo sapiens
guacguggcugcaguucau

SEQ ID NO: 584340 - RNA, 19 nt, Homo sapiens
ucaaauucaugcacaauca

SEQ ID NO: 584341 - RNA, 19 nt, Homo sapiens
agacccagcucaacaaguu

SEQ ID NO: 584342 - RNA, 19 nt, Homo sapiens
gauaguggcagugauagua

SEQ ID NO: 584343 - RNA, 19 nt, Homo sapiens
gaaagaccaagcuggguuu

SEQ ID NO: 584344 - RNA, 19 nt, Homo sapiens
gagcuguacuacuguguga

SEQ ID NO: 584345 - RNA, 19 nt, Homo sapiens
guacaugcagggacagaua

SEQ ID NO: 584346 - RNA, 19 nt, Homo sapiens
gaagcagacauuuguggua

SEQ ID NO: 584347 - RNA, 19 nt, Homo sapiens
ccagcgagguggagauuga

SEQ ID NO: 584348 - RNA, 19 nt, Homo sapiens
gagaggaagggaagaauug

SEQ ID NO: 584349 - RNA, 19 nt, Homo sapiens
gcucugaccuuugcucuuc

SEQ ID NO: 584350 - RNA, 19 nt, Homo sapiens
ugaauuggguggcgaguuc

SEQ ID NO: 584351 - RNA, 19 nt, Homo sapiens
agacgaagguguugugcuu

SEQ ID NO: 584352 - RNA, 19 nt, Homo sapiens
gagaagggauggguaugga

SEQ ID NO: 584353 - RNA, 19 nt, Homo sapiens
gcacgaugcugcugugacu

SEQ ID NO: 584354 - RNA, 19 nt, Homo sapiens
ucaagaauguguacagucu

SEQ ID NO: 584355 - RNA, 19 nt, Homo sapiens
gaagggaucaaccucaaau

SEQ ID NO: 584356 - RNA, 19 nt, Homo sapiens
ugaagaagcagacauuugu

SEQ ID NO: 584357 - RNA, 19 nt, Homo sapiens
gcacuucgauuuucagaau

SEQ ID NO: 584358 - RNA, 19 nt, Homo sapiens
ggaucaaccucaaauucau

SEQ ID NO: 584359 - RNA, 19 nt, Homo sapiens
gaaaugaugaaaugugaca

SEQ ID NO: 584360 - RNA, 19 nt, Homo sapiens
cagaaucacuagagcugaa

SEQ ID NO: 584361 - RNA, 19 nt, Homo sapiens
gcaucuguguuaacuucua

SEQ ID NO: 584362 - RNA, 19 nt, Homo sapiens
gcaugagccuucgggauga

SEQ ID NO: 584363 - RNA, 19 nt, Homo sapiens
gcuguggcuugguugguua

SEQ ID NO: 584364 - RNA, 19 nt, Homo sapiens
ggacugaucaagacucugu

SEQ ID NO: 584365 - RNA, 19 nt, Homo sapiens
aguaccagcuucagucuuu

SEQ ID NO: 584366 - RNA, 19 nt, Homo sapiens
acacuggagucacgcgaua

SEQ ID NO: 584367 - RNA, 19 nt, Homo sapiens
ggcccagacuccugaauug

SEQ ID NO: 584368 - RNA, 19 nt, Homo sapiens
gggcaagaaaugacuguaa

SEQ ID NO: 584369 - RNA, 19 nt, Homo sapiens
aaucugcuacuccguauua

SEQ ID NO: 584370 - RNA, 19 nt, Homo sapiens
gcccagacccacuacuaua

SEQ ID NO: 584371 - RNA, 19 nt, Homo sapiens
cagggucgauccagcaauu

SEQ ID NO: 584372 - RNA, 19 nt, Homo sapiens
gaaaagagaaccuccauca

SEQ ID NO: 584373 - RNA, 19 nt, Homo sapiens
gauucacccuaguggauuu

SEQ ID NO: 584374 - RNA, 19 nt, Homo sapiens
gcaugaccuucgagagauu

SEQ ID NO: 584375 - RNA, 19 nt, Homo sapiens
agaaugacauccgcaagaa

SEQ ID NO: 584376 - RNA, 19 nt, Homo sapiens
cuucuuagaugcugugaug

SEQ ID NO: 584377 - RNA, 19 nt, Homo sapiens
gagcagcaaugcaggugau

SEQ ID NO: 584378 - RNA, 19 nt, Homo sapiens
gauucaagcucuucuuacu

SEQ ID NO: 584379 - RNA, 19 nt, Homo sapiens
ccagacuccugaauugcua

SEQ ID NO: 584380 - RNA, 19 nt, Homo sapiens
ccuggaagaugaugaagau

SEQ ID NO: 584381 - RNA, 19 nt, Homo sapiens
gaaguaaucaaaccugucu

SEQ ID NO: 584382 - RNA, 19 nt, Homo sapiens
ccaacgugcugcagggauu

SEQ ID NO: 584383 - RNA, 19 nt, Homo sapiens
caucaaacccggaccugaa

SEQ ID NO: 584384 - RNA, 19 nt, Homo sapiens
acgagaagcucaucaacau

SEQ ID NO: 584385 - RNA, 19 nt, Homo sapiens
ccagaggacugaucaagac

SEQ ID NO: 584386 - RNA, 19 nt, Homo sapiens
ggugugagccugacgucua

SEQ ID NO: 584387 - RNA, 19 nt, Homo sapiens
guacaaagggacaccaugu

SEQ ID NO: 584388 - RNA, 19 nt, Homo sapiens
gaagaggguggcacugaga

SEQ ID NO: 584389 - RNA, 19 nt, Homo sapiens
aaauaaauguccucaacuc

SEQ ID NO: 584390 - RNA, 19 nt, Homo sapiens
gcaagaaaugacuguaaau

SEQ ID NO: 584391 - RNA, 19 nt, Homo sapiens
gggaucaaccucaaauuca

SEQ ID NO: 584392 - RNA, 19 nt, Homo sapiens
gaaccauggugcaaaagaa

SEQ ID NO: 584393 - RNA, 19 nt, Homo sapiens
gaguccagcuguuaugauc

SEQ ID NO: 584394 - RNA, 19 nt, Homo sapiens
ggagggcguuaguggauca

SEQ ID NO: 584395 - RNA, 19 nt, Homo sapiens
gaugauaccucuuuugucu

SEQ ID NO: 584396 - RNA, 19 nt, Homo sapiens
ggagagacagccuggguau

SEQ ID NO: 584397 - RNA, 19 nt, Homo sapiens
agacauuuguguugugguu

SEQ ID NO: 584398 - RNA, 19 nt, Homo sapiens
uaacaucggaacaguguau

SEQ ID NO: 584399 - RNA, 19 nt, Homo sapiens
caaaggcuauggcacaacu

SEQ ID NO: 584400 - RNA, 19 nt, Homo sapiens
ggaagagaaguccaacaga

SEQ ID NO: 584401 - RNA, 19 nt, Homo sapiens
gguguacaagggaauguua

SEQ ID NO: 584402 - RNA, 19 nt, Homo sapiens
ccacggagccaacucugaa

SEQ ID NO: 584403 - RNA, 19 nt, Homo sapiens
uugacgagcugcagaauca

SEQ ID NO: 584404 - RNA, 19 nt, Homo sapiens
ccagccagcucugaccuuu

SEQ ID NO: 584405 - RNA, 19 nt, Homo sapiens
gauaaacugaugaauugga

SEQ ID NO: 584406 - RNA, 19 nt, Homo sapiens
ccuugucccuggcguuaua

SEQ ID NO: 584407 - RNA, 19 nt, Homo sapiens
gagauaaacugaugaauug

SEQ ID NO: 584408 - RNA, 19 nt, Homo sapiens
gaagucaucugucauuaaa

SEQ ID NO: 584409 - RNA, 19 nt, Homo sapiens
gaagagaaguccaacagaa

SEQ ID NO: 584410 - RNA, 19 nt, Homo sapiens
gaaguucuguccucgguua

SEQ ID NO: 584411 - RNA, 19 nt, Homo sapiens
gaauauauguuuccuguca

SEQ ID NO: 584412 - RNA, 19 nt, Homo sapiens
cuacggagauggaugauaa

SEQ ID NO: 584413 - RNA, 19 nt, Homo sapiens
gcagugauaguauggauua

SEQ ID NO: 584414 - RNA, 19 nt, Homo sapiens
uaauggagauuguuacuga

SEQ ID NO: 584415 - RNA, 19 nt, Homo sapiens
ggaagcgccuggaagauga

SEQ ID NO: 584416 - RNA, 19 nt, Homo sapiens
caagugcccuucugcauga

SEQ ID NO: 584417 - RNA, 19 nt, Homo sapiens
ggacagacgucaggcagaa

SEQ ID NO: 584418 - RNA, 19 nt, Homo sapiens
caaaaugccugaugaugua

SEQ ID NO: 584419 - RNA, 19 nt, Homo sapiens
aaacacagcccaacaguga

SEQ ID NO: 584420 - RNA, 19 nt, Homo sapiens
gcaacgauguggauucugu

SEQ ID NO: 584421 - RNA, 19 nt, Homo sapiens
ggcaagaaaugacuguaaa

SEQ ID NO: 584422 - RNA, 19 nt, Homo sapiens
gaaaucugcuacuccguau

SEQ ID NO: 584423 - RNA, 19 nt, Homo sapiens
ccucagggcucaagaaugu

SEQ ID NO: 584424 - RNA, 19 nt, Homo sapiens
ucagugaaaugaugaaaug

SEQ ID NO: 584425 - RNA, 19 nt, Homo sapiens
gugauaguauggauuauga

SEQ ID NO: 584426 - RNA, 19 nt, Homo sapiens
cgauauggcaucuguguua

SEQ ID NO: 584427 - RNA, 19 nt, Homo sapiens
ccacugcgcuccagcucua

SEQ ID NO: 584428 - RNA, 19 nt, Homo sapiens
gugaaaugaugaaauguga

SEQ ID NO: 584429 - RNA, 19 nt, Homo sapiens
gaugauaguggcagugaua

SEQ ID NO: 584430 - RNA, 19 nt, Homo sapiens
aaacagaggccugaaguaa

SEQ ID NO: 584431 - RNA, 19 nt, Homo sapiens
gcaaaucaaugaggugcuu

SEQ ID NO: 584432 - RNA, 19 nt, Homo sapiens
caccagaaguuuaaaggaa

SEQ ID NO: 584433 - RNA, 19 nt, Homo sapiens
ggacagcaauagggugauu

SEQ ID NO: 584434 - RNA, 19 nt, Homo sapiens
uauuaugucucuucucgua

SEQ ID NO: 584435 - RNA, 19 nt, Homo sapiens
caacagaaaguguaaauac

SEQ ID NO: 584436 - RNA, 19 nt, Homo sapiens
caagcuggcuccuuucuag

SEQ ID NO: 584437 - RNA, 19 nt, Homo sapiens
gugcuaaccugcauucugu

SEQ ID NO: 584438 - RNA, 19 nt, Homo sapiens
gauauggcaucuguguuaa

SEQ ID NO: 584439 - RNA, 19 nt, Homo sapiens
ugaaauaaauguccucaac

SEQ ID NO: 584440 - RNA, 19 nt, Homo sapiens
guacguggcugcaguucau

SEQ ID NO: 584441 - RNA, 19 nt, Homo sapiens
ucaaauucaugcacaauca

SEQ ID NO: 584442 - RNA, 19 nt, Homo sapiens
agacccagcucaacaaguu

SEQ ID NO: 584443 - RNA, 19 nt, Homo sapiens
gauaguggcagugauagua

SEQ ID NO: 584444 - RNA, 19 nt, Homo sapiens
gaaagaccaagcuggguuu

SEQ ID NO: 584445 - RNA, 19 nt, Homo sapiens
gagcuguacuacuguguga

SEQ ID NO: 584446 - RNA, 19 nt, Homo sapiens
guacaugcagggacagaua

SEQ ID NO: 584447 - RNA, 19 nt, Homo sapiens
gaagcagacauuuguggua

SEQ ID NO: 584448 - RNA, 19 nt, Homo sapiens
ccagcgagguggagauuga

SEQ ID NO: 584449 - RNA, 19 nt, Homo sapiens
gagaggaagggaagaauug

SEQ ID NO: 584450 - RNA, 19 nt, Homo sapiens
gcucugaccuuugcucuuc

SEQ ID NO: 584451 - RNA, 19 nt, Homo sapiens
ugaauuggguggcgaguuc

SEQ ID NO: 584452 - RNA, 19 nt, Homo sapiens
agacgaagguguugugcuu

SEQ ID NO: 584453 - RNA, 19 nt, Homo sapiens
gagaagggauggguaugga

SEQ ID NO: 584454 - RNA, 19 nt, Homo sapiens
gcacgaugcugcugugacu

SEQ ID NO: 584455 - RNA, 19 nt, Homo sapiens
ucaagaauguguacagucu

SEQ ID NO: 584456 - RNA, 19 nt, Homo sapiens
gaagggaucaaccucaaau

SEQ ID NO: 584457 - RNA, 19 nt, Homo sapiens
ugaagaagcagacauuugu

SEQ ID NO: 584458 - RNA, 19 nt, Homo sapiens
acagaggccugaaguaauc

SEQ ID NO: 584459 - RNA, 19 nt, Homo sapiens
ggaucaaccucaaauucau

SEQ ID NO: 584460 - RNA, 19 nt, Homo sapiens
gaaaugaugaaaugugaca

SEQ ID NO: 584461 - RNA, 19 nt, Homo sapiens
cagaaucacuagagcugaa

SEQ ID NO: 584462 - RNA, 19 nt, Homo sapiens
gcaucuguguuaacuucua

SEQ ID NO: 584463 - RNA, 19 nt, Homo sapiens
gcaugagccuucgggauga

SEQ ID NO: 584464 - RNA, 19 nt, Homo sapiens
gcuguggcuugguugguua

SEQ ID NO: 584465 - RNA, 19 nt, Homo sapiens
ggacugaucaagacucugu

SEQ ID NO: 584466 - RNA, 19 nt, Homo sapiens
gaacaagcaccaggaagug

SEQ ID NO: 584467 - RNA, 19 nt, Homo sapiens
aguaccagcuucagucuuu

SEQ ID NO: 584468 - RNA, 19 nt, Homo sapiens
acacuggagucacgcgaua

SEQ ID NO: 584469 - RNA, 19 nt, Homo sapiens
ggcccagacuccugaauug

SEQ ID NO: 584470 - RNA, 19 nt, Homo sapiens
gggcaagaaaugacuguaa

SEQ ID NO: 584471 - RNA, 19 nt, Homo sapiens
aaucugcuacuccguauua

SEQ ID NO: 584472 - RNA, 19 nt, Homo sapiens
ggaacaagcaccaggaagu

SEQ ID NO: 584473 - RNA, 19 nt, Homo sapiens
gcccagacccacuacuaua

SEQ ID NO: 584474 - RNA, 19 nt, Homo sapiens
cagggucgauccagcaauu

SEQ ID NO: 584475 - RNA, 19 nt, Homo sapiens
gaaaagagaaccuccauca

SEQ ID NO: 584476 - RNA, 19 nt, Homo sapiens
gauucacccuaguggauuu

SEQ ID NO: 584477 - RNA, 19 nt, Homo sapiens
gcaugaccuucgagagauu

SEQ ID NO: 584478 - RNA, 19 nt, Homo sapiens
agaaugacauccgcaagaa

SEQ ID NO: 584479 - RNA, 19 nt, Homo sapiens
cuucuuagaugcugugaug

SEQ ID NO: 584480 - RNA, 19 nt, Homo sapiens
gagcagcaaugcaggugau

SEQ ID NO: 584481 - RNA, 19 nt, Homo sapiens
ccagacuccugaauugcua

SEQ ID NO: 584482 - RNA, 19 nt, Homo sapiens
uagcaucuauugaauugug

SEQ ID NO: 584483 - RNA, 19 nt, Homo sapiens
gauucaagcucuucuuacu

SEQ ID NO: 584484 - RNA, 19 nt, Homo sapiens
ccuggaagaugaugaagau

SEQ ID NO: 584485 - RNA, 19 nt, Homo sapiens
gaaguaaucaaaccugucu

SEQ ID NO: 584486 - RNA, 19 nt, Homo sapiens
ccaacgugcugcagggauu

SEQ ID NO: 584487 - RNA, 19 nt, Homo sapiens
caucaaacccggaccugaa

SEQ ID NO: 584488 - RNA, 19 nt, Homo sapiens
acgagaagcucaucaacau

SEQ ID NO: 584489 - RNA, 19 nt, Homo sapiens
ccagaggacugaucaagac

SEQ ID NO: 584490 - RNA, 19 nt, Homo sapiens
ggugugagccugacgucua

SEQ ID NO: 584491 - RNA, 19 nt, Homo sapiens
guacaaagggacaccaugu

SEQ ID NO: 584492 - RNA, 19 nt, Homo sapiens
gaagaggguggcacugaga

SEQ ID NO: 584493 - RNA, 19 nt, Homo sapiens
aaauaaauguccucaacuc

SEQ ID NO: 584494 - RNA, 19 nt, Homo sapiens
gcaagaaaugacuguaaau

SEQ ID NO: 584495 - RNA, 19 nt, Homo sapiens
gggaucaaccucaaauuca

SEQ ID NO: 584496 - RNA, 19 nt, Homo sapiens
gaguccagcuguuaugauc

SEQ ID NO: 584497 - RNA, 19 nt, Homo sapiens
ggagggcguuaguggauca

SEQ ID NO: 584498 - RNA, 19 nt, Homo sapiens
gaaccauggugcaaaagaa

SEQ ID NO: 584499 - RNA, 19 nt, Homo sapiens
gaugauaccucuuuugucu

SEQ ID NO: 584500 - RNA, 19 nt, Homo sapiens
ggagagacagccuggguau

SEQ ID NO: 584501 - RNA, 19 nt, Homo sapiens
agacauuuguguugugguu

SEQ ID NO: 584502 - RNA, 19 nt, Homo sapiens
uaacaucggaacaguguau

SEQ ID NO: 584503 - RNA, 19 nt, Homo sapiens
caaaggcuauggcacaacu

SEQ ID NO: 584504 - RNA, 19 nt, Homo sapiens
ggaagagaaguccaacaga

SEQ ID NO: 584505 - RNA, 19 nt, Homo sapiens
gguguacaagggaauguua

SEQ ID NO: 584506 - RNA, 19 nt, Homo sapiens
ccacggagccaacucugaa

SEQ ID NO: 584507 - RNA, 19 nt, Homo sapiens
gagauaaacugaugaauug

SEQ ID NO: 584508 - RNA, 19 nt, Homo sapiens
gaagucaucugucauuaaa

SEQ ID NO: 584509 - RNA, 19 nt, Homo sapiens
gaagagaaguccaacagaa

SEQ ID NO: 584510 - RNA, 19 nt, Homo sapiens
gaaguucuguccucgguua

SEQ ID NO: 584511 - RNA, 19 nt, Homo sapiens
gaauauauguuuccuguca

SEQ ID NO: 584512 - RNA, 19 nt, Homo sapiens
cuacggagauggaugauaa

SEQ ID NO: 584513 - RNA, 19 nt, Homo sapiens
gcagugauaguauggauua

SEQ ID NO: 584514 - RNA, 19 nt, Homo sapiens
ggaagcgccuggaagauga

SEQ ID NO: 584515 - RNA, 19 nt, Homo sapiens
caagugcccuucugcauga

SEQ ID NO: 584516 - RNA, 19 nt, Homo sapiens
ggacagacgucaggcagaa

SEQ ID NO: 584517 - RNA, 19 nt, Homo sapiens
caaaaugccugaugaugua

SEQ ID NO: 584518 - RNA, 19 nt, Homo sapiens
aaacacagcccaacaguga

SEQ ID NO: 584519 - RNA, 19 nt, Homo sapiens
gcaacgauguggauucugu

SEQ ID NO: 584520 - RNA, 19 nt, Homo sapiens
ggcaagaaaugacuguaaa

SEQ ID NO: 584521 - RNA, 19 nt, Homo sapiens
gaaaucugcuacuccguau

SEQ ID NO: 584522 - RNA, 19 nt, Homo sapiens
ccucagggcucaagaaugu

SEQ ID NO: 584523 - RNA, 19 nt, Homo sapiens
ucagugaaaugaugaaaug

SEQ ID NO: 584524 - RNA, 19 nt, Homo sapiens
gugauaguauggauuauga

SEQ ID NO: 584525 - RNA, 19 nt, Homo sapiens
cgauauggcaucuguguua

SEQ ID NO: 584526 - RNA, 19 nt, Homo sapiens
ccacugcgcuccagcucua

SEQ ID NO: 584527 - RNA, 19 nt, Homo sapiens
gugaaaugaugaaauguga

SEQ ID NO: 584528 - RNA, 19 nt, Homo sapiens
gaugauaguggcagugaua

SEQ ID NO: 584529 - RNA, 19 nt, Homo sapiens
gcaaaucaaugaggugcuu

SEQ ID NO: 584530 - RNA, 19 nt, Homo sapiens
caccagaaguuuaaaggaa

SEQ ID NO: 584531 - RNA, 19 nt, Homo sapiens
ggacagcaauagggugauu

SEQ ID NO: 584532 - RNA, 19 nt, Homo sapiens
uauuaugucucuucucgua

SEQ ID NO: 584533 - RNA, 19 nt, Homo sapiens
caacagaaaguguaaauac

SEQ ID NO: 584534 - RNA, 19 nt, Homo sapiens
caagcuggcuccuuucuag

SEQ ID NO: 584535 - RNA, 19 nt, Homo sapiens
gugcuaaccugcauucugu

SEQ ID NO: 584536 - RNA, 19 nt, Homo sapiens
gauauggcaucuguguuaa

SEQ ID NO: 584537 - RNA, 19 nt, Homo sapiens
ugaaauaaauguccucaac

SEQ ID NO: 584538 - RNA, 19 nt, Homo sapiens
guacguggcugcaguucau

SEQ ID NO: 584539 - RNA, 19 nt, Homo sapiens
ucaaauucaugcacaauca

SEQ ID NO: 584540 - RNA, 19 nt, Homo sapiens
agacccagcucaacaaguu

SEQ ID NO: 584541 - RNA, 19 nt, Homo sapiens
gauaguggcagugauagua

SEQ ID NO: 584542 - RNA, 19 nt, Homo sapiens
gaaagaccaagcuggguuu

SEQ ID NO: 584543 - RNA, 19 nt, Homo sapiens
ucauagagcugaaucacau

SEQ ID NO: 584544 - RNA, 19 nt, Homo sapiens
gagcuguacuacuguguga

SEQ ID NO: 584545 - RNA, 19 nt, Homo sapiens
guacaugcagggacagaua

SEQ ID NO: 584546 - RNA, 19 nt, Homo sapiens
gaagcagacauuuguggua

SEQ ID NO: 584547 - RNA, 19 nt, Homo sapiens
ccagcgagguggagauuga

SEQ ID NO: 584548 - RNA, 19 nt, Homo sapiens
gagaggaagggaagaauug

SEQ ID NO: 584549 - RNA, 19 nt, Homo sapiens
gcucugaccuuugcucuuc

SEQ ID NO: 584550 - RNA, 19 nt, Homo sapiens
ugaauuggguggcgaguuc

SEQ ID NO: 584551 - RNA, 19 nt, Homo sapiens
agacgaagguguugugcuu

SEQ ID NO: 584552 - RNA, 19 nt, Homo sapiens
gagaagggauggguaugga

SEQ ID NO: 584553 - RNA, 19 nt, Homo sapiens
gcacgaugcugcugugacu

SEQ ID NO: 584554 - RNA, 19 nt, Homo sapiens
ucaagaauguguacagucu

SEQ ID NO: 584555 - RNA, 19 nt, Homo sapiens
gaagggaucaaccucaaau

SEQ ID NO: 584556 - RNA, 19 nt, Homo sapiens
ugaagaagcagacauuugu

SEQ ID NO: 584557 - RNA, 19 nt, Homo sapiens
ggaucaaccucaaauucau

SEQ ID NO: 584558 - RNA, 19 nt, Homo sapiens
gaaaugaugaaaugugaca

SEQ ID NO: 584559 - RNA, 19 nt, Homo sapiens
cagaaucacuagagcugaa

SEQ ID NO: 584560 - RNA, 19 nt, Homo sapiens
gcaucuguguuaacuucua

SEQ ID NO: 584561 - RNA, 19 nt, Homo sapiens
gcaugagccuucgggauga

SEQ ID NO: 584562 - RNA, 19 nt, Homo sapiens
gcuguggcuugguugguua

SEQ ID NO: 584563 - RNA, 19 nt, Homo sapiens
ggacugaucaagacucugu

SEQ ID NO: 584564 - RNA, 19 nt, Homo sapiens
aguaccagcuucagucuuu

SEQ ID NO: 584565 - RNA, 19 nt, Homo sapiens
acacuggagucacgcgaua

SEQ ID NO: 584566 - RNA, 19 nt, Homo sapiens
ggcccagacuccugaauug

SEQ ID NO: 584567 - RNA, 19 nt, Homo sapiens
gggcaagaaaugacuguaa

SEQ ID NO: 584568 - RNA, 19 nt, Homo sapiens
aaucugcuacuccguauua

SEQ ID NO: 584569 - RNA, 19 nt, Homo sapiens
gcccagacccacuacuaua

SEQ ID NO: 584570 - RNA, 19 nt, Homo sapiens
cagggucgauccagcaauu

SEQ ID NO: 584571 - RNA, 19 nt, Homo sapiens
gaaaagagaaccuccauca

SEQ ID NO: 584572 - RNA, 19 nt, Homo sapiens
gauucacccuaguggauuu

SEQ ID NO: 584573 - RNA, 19 nt, Homo sapiens
gcaugaccuucgagagauu

SEQ ID NO: 584574 - RNA, 19 nt, Homo sapiens
agaaugacauccgcaagaa

SEQ ID NO: 584575 - RNA, 19 nt, Homo sapiens
cuucuuagaugcugugaug

SEQ ID NO: 584576 - RNA, 19 nt, Homo sapiens
gagcagcaaugcaggugau

SEQ ID NO: 584577 - RNA, 19 nt, Homo sapiens
gauucaagcucuucuuacu

SEQ ID NO: 584578 - RNA, 19 nt, Homo sapiens
ccagacuccugaauugcua

SEQ ID NO: 584579 - RNA, 19 nt, Homo sapiens
ccuggaagaugaugaagau

SEQ ID NO: 584580 - RNA, 19 nt, Homo sapiens
gaaguaaucaaaccugucu

SEQ ID NO: 584581 - RNA, 19 nt, Homo sapiens
ccaacgugcugcagggauu

SEQ ID NO: 584582 - RNA, 19 nt, Homo sapiens
caucaaacccggaccugaa

SEQ ID NO: 584583 - RNA, 19 nt, Homo sapiens
acgagaagcucaucaacau

SEQ ID NO: 584584 - RNA, 19 nt, Homo sapiens
ccagaggacugaucaagac

SEQ ID NO: 584585 - RNA, 19 nt, Homo sapiens
ggugugagccugacgucua

SEQ ID NO: 584586 - RNA, 19 nt, Homo sapiens
guacaaagggacaccaugu

SEQ ID NO: 584587 - RNA, 19 nt, Homo sapiens
gaagaggguggcacugaga

SEQ ID NO: 584588 - RNA, 19 nt, Homo sapiens
aaauaaauguccucaacuc

SEQ ID NO: 584589 - RNA, 19 nt, Homo sapiens
gcaagaaaugacuguaaau

SEQ ID NO: 584590 - RNA, 19 nt, Homo sapiens
gggaucaaccucaaauuca

SEQ ID NO: 584591 - RNA, 19 nt, Homo sapiens
gaaccauggugcaaaagaa

SEQ ID NO: 584592 - RNA, 19 nt, Homo sapiens
gaguccagcuguuaugauc

SEQ ID NO: 584593 - RNA, 19 nt, Homo sapiens
ggagggcguuaguggauca

SEQ ID NO: 584594 - RNA, 19 nt, Homo sapiens
gaugauaccucuuuugucu

SEQ ID NO: 584595 - RNA, 19 nt, Homo sapiens
ggagagacagccuggguau

SEQ ID NO: 584596 - RNA, 19 nt, Homo sapiens
agacauuuguguugugguu

SEQ ID NO: 584597 - RNA, 19 nt, Homo sapiens
uaacaucggaacaguguau

SEQ ID NO: 584598 - RNA, 19 nt, Homo sapiens
caaaggcuauggcacaacu

SEQ ID NO: 584599 - RNA, 19 nt, Homo sapiens
ggaagagaaguccaacaga

SEQ ID NO: 584600 - RNA, 19 nt, Homo sapiens
gguguacaagggaauguua

SEQ ID NO: 584601 - RNA, 19 nt, Homo sapiens
ccacggagccaacucugaa

SEQ ID NO: 584602 - RNA, 19 nt, Homo sapiens
uugacgagcugcagaauca

SEQ ID NO: 584603 - RNA, 19 nt, Homo sapiens
ccacuggaauauauguuuc

SEQ ID NO: 584604 - RNA, 19 nt, Homo sapiens
ccagccagcucugaccuuu

SEQ ID NO: 584605 - RNA, 19 nt, Homo sapiens
ccuugucccuggcguuaua

SEQ ID NO: 584606 - RNA, 19 nt, Homo sapiens
cucaacaaguucuauacua

SEQ ID NO: 584607 - RNA, 19 nt, Homo sapiens
gagcuaagaucacgccauu

SEQ ID NO: 584608 - RNA, 19 nt, Homo sapiens
ugaggaagcuccggaaaua

SEQ ID NO: 584609 - RNA, 19 nt, Homo sapiens
gaaagcgucucuacaaagu

SEQ ID NO: 584610 - RNA, 19 nt, Homo sapiens
ggaaaggacuguuuuauug

SEQ ID NO: 584611 - RNA, 19 nt, Homo sapiens
gcaguguggugguuuauau

SEQ ID NO: 584612 - RNA, 19 nt, Homo sapiens
gaauucagcuccaguaagg

SEQ ID NO: 584613 - RNA, 19 nt, Homo sapiens
gaauuaggaaggacuauuu

SEQ ID NO: 584614 - RNA, 19 nt, Homo sapiens
ccaaagcccugcugcauuc

SEQ ID NO: 584615 - RNA, 19 nt, Homo sapiens
uugaagaccuccugaauga

SEQ ID NO: 584616 - RNA, 19 nt, Homo sapiens
ugaaugaacuggacacaca

SEQ ID NO: 584617 - RNA, 19 nt, Homo sapiens
cagaaagcgucucuacaaa

SEQ ID NO: 584618 - RNA, 19 nt, Homo sapiens
gaagggaggcggcagaaga

SEQ ID NO: 584619 - RNA, 19 nt, Homo sapiens
gagacgcgcugucccagaa

SEQ ID NO: 584620 - RNA, 19 nt, Homo sapiens
gaacagaaagcgucucuac

SEQ ID NO: 584621 - RNA, 19 nt, Homo sapiens
caagacauuucuccuuuca

SEQ ID NO: 584622 - RNA, 19 nt, Homo sapiens
gcaagacauuucuccuuuc

SEQ ID NO: 584623 - RNA, 19 nt, Homo sapiens
aagaugagaucccagagaa

SEQ ID NO: 584624 - RNA, 19 nt, Homo sapiens
uggaggagcugaccaaagu

SEQ ID NO: 584625 - RNA, 19 nt, Homo sapiens
ugcaagacauuucuccuuu

SEQ ID NO: 584626 - RNA, 19 nt, Homo sapiens
cgagcaguguggugguuua

SEQ ID NO: 584627 - RNA, 19 nt, Homo sapiens
gaagaugagaucccagaga

SEQ ID NO: 584628 - RNA, 19 nt, Homo sapiens
gaagaaacgcagggaguga

SEQ ID NO: 584629 - RNA, 19 nt, Homo sapiens
ugaccgggcuguucuguag

SEQ ID NO: 584630 - RNA, 19 nt, Homo sapiens
gaagaauuaggaaggacua

SEQ ID NO: 584631 - RNA, 19 nt, Homo sapiens
acagaaagcgucucuacaa

SEQ ID NO: 584632 - RNA, 19 nt, Homo sapiens
ggacggggcucuuuugcuu

SEQ ID NO: 584633 - RNA, 19 nt, Homo sapiens
agacauuucuccuuucaca

SEQ ID NO: 584634 - RNA, 19 nt, Homo sapiens
gaccguggcuccagaacuc

SEQ ID NO: 584635 - RNA, 19 nt, Homo sapiens
gggcuguucuguagacuca

SEQ ID NO: 584636 - RNA, 19 nt, Homo sapiens
gcaaggcugggaagaaaga

SEQ ID NO: 584637 - RNA, 19 nt, Homo sapiens
gcaggagaauugcuugaac

SEQ ID NO: 584638 - RNA, 19 nt, Homo sapiens
gaaaccccaucucuacuaa

SEQ ID NO: 584639 - RNA, 19 nt, Homo sapiens
aagcgucucuacaaaguga

SEQ ID NO: 584640 - RNA, 19 nt, Homo sapiens
uagagcugcugaugacuga

SEQ ID NO: 584641 - RNA, 19 nt, Homo sapiens
gaaggucaaacuccgaaga

SEQ ID NO: 584642 - RNA, 19 nt, Homo sapiens
gaagaccuccugaaugaac

SEQ ID NO: 584643 - RNA, 19 nt, Homo sapiens
agaagcgucugcucagguu

SEQ ID NO: 584644 - RNA, 19 nt, Homo sapiens
ggcagaagaagacgaagaa

SEQ ID NO: 584645 - RNA, 19 nt, Homo sapiens
gucaaacuccgaagacuga

SEQ ID NO: 584646 - RNA, 19 nt, Homo sapiens
cgacggagagcugacagua

SEQ ID NO: 584647 - RNA, 19 nt, Homo sapiens
agaagaagacgaagaagca

SEQ ID NO: 584648 - RNA, 19 nt, Homo sapiens
ccccaucucuacuaaaaua

SEQ ID NO: 584649 - RNA, 19 nt, Homo sapiens
caggaagaauuaggaagga

SEQ ID NO: 584650 - RNA, 19 nt, Homo sapiens
ugaagguucugaagaugca

SEQ ID NO: 584651 - RNA, 19 nt, Homo sapiens
cagagguuguggugagcua

SEQ ID NO: 584652 - RNA, 19 nt, Homo sapiens
ggaauucagcuccaguaag

SEQ ID NO: 584653 - RNA, 19 nt, Homo sapiens
augcaaggcugggaagaaa

SEQ ID NO: 584654 - RNA, 19 nt, Homo sapiens
ggcugcgccuggauaaauu

SEQ ID NO: 584655 - RNA, 19 nt, Homo sapiens
gcuaagaucacgccauugc

SEQ ID NO: 584656 - RNA, 19 nt, Homo sapiens
gagggaaaggugagaagga

SEQ ID NO: 584657 - RNA, 19 nt, Homo sapiens
agaccagacugaccaacau

SEQ ID NO: 584658 - RNA, 19 nt, Homo sapiens
ggaccaggaaggaccucua

SEQ ID NO: 584659 - RNA, 19 nt, Homo sapiens
ggccacagccugcauaggu

SEQ ID NO: 584660 - RNA, 19 nt, Homo sapiens
uccaggagccggagaagaa

SEQ ID NO: 584661 - RNA, 19 nt, Homo sapiens
gaugcaaggcugggaagaa

SEQ ID NO: 584662 - RNA, 19 nt, Homo sapiens
gcgccuggauaaauucuac

SEQ ID NO: 584663 - RNA, 19 nt, Homo sapiens
ccuguaaucccagcacuuu

SEQ ID NO: 584664 - RNA, 19 nt, Homo sapiens
ggugguuuauauucauguu

SEQ ID NO: 584665 - RNA, 19 nt, Homo sapiens
gagcugcugaugacugaga

SEQ ID NO: 584666 - RNA, 19 nt, Homo sapiens
gagaccagacugaccaaca

SEQ ID NO: 584667 - RNA, 19 nt, Homo sapiens
gguguggaaaggacuguuu

SEQ ID NO: 584668 - RNA, 19 nt, Homo sapiens
gaccagugcccgagcaaag

SEQ ID NO: 584669 - RNA, 19 nt, Homo sapiens
acgacgagcugcugaaggu

SEQ ID NO: 584670 - RNA, 19 nt, Homo sapiens
agaagacgaagaagcagaa

SEQ ID NO: 584671 - RNA, 19 nt, Homo sapiens
cauugaagaccuccugaau

SEQ ID NO: 584672 - RNA, 19 nt, Homo sapiens
gcgaguggacgggcauuga

SEQ ID NO: 584673 - RNA, 19 nt, Homo sapiens
cggcagaccagaaccugaa

SEQ ID NO: 584674 - RNA, 19 nt, Homo sapiens
gcccgcaucuucuguucca

SEQ ID NO: 584675 - RNA, 19 nt, Homo sapiens
gugaggaagcuccggaaau

SEQ ID NO: 584676 - RNA, 19 nt, Homo sapiens
caaacuccgaagacugaaa

SEQ ID NO: 584677 - RNA, 19 nt, Homo sapiens
cgcagcaccuguuccuuca

SEQ ID NO: 584678 - RNA, 19 nt, Homo sapiens
guguggugguuuauauuca

SEQ ID NO: 584679 - RNA, 19 nt, Homo sapiens
gggaggcggcagaagaaga

SEQ ID NO: 584680 - RNA, 19 nt, Homo sapiens
agaaagcgucucuacaaag

SEQ ID NO: 584681 - RNA, 19 nt, Homo sapiens
gacgcgcugucccagaaga

SEQ ID NO: 584682 - RNA, 19 nt, Homo sapiens
acagugaugaguccucuga

SEQ ID NO: 584683 - RNA, 19 nt, Homo sapiens
ggcugaggcaggagaauug

SEQ ID NO: 584684 - RNA, 19 nt, Homo sapiens
acauuucuccuuucacaga

SEQ ID NO: 584685 - RNA, 19 nt, Homo sapiens
ugaccaacauggagaaacc

SEQ ID NO: 584686 - RNA, 19 nt, Homo sapiens
gaguuugagaccagacuga

SEQ ID NO: 584687 - RNA, 19 nt, Homo sapiens
gaccaggaaggaccucuag

SEQ ID NO: 584688 - RNA, 19 nt, Homo sapiens
cagaccagaaccugaaguu

SEQ ID NO: 584689 - RNA, 19 nt, Homo sapiens
caguggcucacaccuguaa

SEQ ID NO: 584690 - RNA, 19 nt, Homo sapiens
cccaaagcccugcugcauu

SEQ ID NO: 584691 - RNA, 19 nt, Homo sapiens
gaaacgcagggagugaugu

SEQ ID NO: 584692 - RNA, 19 nt, Homo sapiens
ggaagcuccggaaauacau

SEQ ID NO: 584693 - RNA, 19 nt, Homo sapiens
ucaugcggaugguccugaa

SEQ ID NO: 584694 - RNA, 19 nt, Homo sapiens
guggugguuuauauucaug

SEQ ID NO: 584695 - RNA, 19 nt, Homo sapiens
ggugaggaagcuccggaaa

SEQ ID NO: 584696 - RNA, 19 nt, Homo sapiens
gggaagaaagacagaucga

SEQ ID NO: 584697 - RNA, 19 nt, Homo sapiens
ggcaggagaauugcuugaa

SEQ ID NO: 584698 - RNA, 19 nt, Homo sapiens
gaccagacugaccaacaug

SEQ ID NO: 584699 - RNA, 19 nt, Homo sapiens
gcacgacgagcugcugaag

SEQ ID NO: 584700 - RNA, 19 nt, Homo sapiens
gagagggaaaggugagaag

SEQ ID NO: 584701 - RNA, 19 nt, Homo sapiens
gcagcaggagagagggaaa

SEQ ID NO: 584702 - RNA, 19 nt, Homo sapiens
gcaaggagguuccaucuua

SEQ ID NO: 584703 - RNA, 19 nt, Homo sapiens
gcacagaucugggcaguua

SEQ ID NO: 584704 - RNA, 19 nt, Homo sapiens
cagcaaagaugauaccuua

SEQ ID NO: 584705 - RNA, 19 nt, Homo sapiens
ggaaagcaaucacuucuca

SEQ ID NO: 584706 - RNA, 19 nt, Homo sapiens
ccaaagaccucaucuccaa

SEQ ID NO: 584707 - RNA, 19 nt, Homo sapiens
aaucagcaguucccuauua

SEQ ID NO: 584708 - RNA, 19 nt, Homo sapiens
gcacacaucuccagugaag

SEQ ID NO: 584709 - RNA, 19 nt, Homo sapiens
gcaaagaugauaccuuaaa

SEQ ID NO: 584710 - RNA, 19 nt, Homo sapiens
caaagaguaugccgucaaa

SEQ ID NO: 584711 - RNA, 19 nt, Homo sapiens
ugaaauguaucccucguuu

SEQ ID NO: 584712 - RNA, 19 nt, Homo sapiens
gacaggagcuuuauuucau

SEQ ID NO: 584713 - RNA, 19 nt, Homo sapiens
caggaaaguuugaagauau

SEQ ID NO: 584714 - RNA, 19 nt, Homo sapiens
ucagauaaguggaacuauu

SEQ ID NO: 584715 - RNA, 19 nt, Homo sapiens
ccaggaaaguuugaagaua

SEQ ID NO: 584716 - RNA, 19 nt, Homo sapiens
gcaaucacuucucacuuug

SEQ ID NO: 584717 - RNA, 19 nt, Homo sapiens
gaaaaggugucuccaguga

SEQ ID NO: 584718 - RNA, 19 nt, Homo sapiens
aaaggugucuccagugaaa

SEQ ID NO: 584719 - RNA, 19 nt, Homo sapiens
gcacgaagagaacgaacua

SEQ ID NO: 584720 - RNA, 19 nt, Homo sapiens
gggcacacaucuccaguga

SEQ ID NO: 584721 - RNA, 19 nt, Homo sapiens
ggaugaaacugaacaacuc

SEQ ID NO: 584722 - RNA, 19 nt, Homo sapiens
gcaugaagguacagccauu

SEQ ID NO: 584723 - RNA, 19 nt, Homo sapiens
gaaauguaucccucguuua

SEQ ID NO: 584724 - RNA, 19 nt, Homo sapiens
gcccuugacuuccugcaua

SEQ ID NO: 584725 - RNA, 19 nt, Homo sapiens
guacagccauucagauaag

SEQ ID NO: 584726 - RNA, 19 nt, Homo sapiens
ggaaggcaaguaugaguuu

SEQ ID NO: 584727 - RNA, 19 nt, Homo sapiens
uguacaagcugaccucuga

SEQ ID NO: 584728 - RNA, 19 nt, Homo sapiens
cauuugggauuucaaguuu

SEQ ID NO: 584729 - RNA, 19 nt, Homo sapiens
gcacuucaaugagcgagaa

SEQ ID NO: 584730 - RNA, 19 nt, Homo sapiens
ggaaaucaaaucagucuuc

SEQ ID NO: 584731 - RNA, 19 nt, Homo sapiens
gaacggcuugcucuucuuu

SEQ ID NO: 584732 - RNA, 19 nt, Homo sapiens
uaaagucaguaguaucguu

SEQ ID NO: 584733 - RNA, 19 nt, Homo sapiens
gaagguacagccauucaga

SEQ ID NO: 584734 - RNA, 19 nt, Homo sapiens
gaagcaagaagcaucaguu

SEQ ID NO: 584735 - RNA, 19 nt, Homo sapiens
ggaaaccuguguggcuaaa

SEQ ID NO: 584736 - RNA, 19 nt, Homo sapiens
gcaggaacaucucuucacu

SEQ ID NO: 584737 - RNA, 19 nt, Homo sapiens
caccuaggcuggagugcua

SEQ ID NO: 584738 - RNA, 19 nt, Homo sapiens
gcaguucccuauuauucug

SEQ ID NO: 584739 - RNA, 19 nt, Homo sapiens
agcaaucacuucucacuuu

SEQ ID NO: 584740 - RNA, 19 nt, Homo sapiens
gauuucaaguuuacagaug

SEQ ID NO: 584741 - RNA, 19 nt, Homo sapiens
gaugcaaagcagagacuua

SEQ ID NO: 584742 - RNA, 19 nt, Homo sapiens
caagcugaccucugaauug

SEQ ID NO: 584743 - RNA, 19 nt, Homo sapiens
gcacauaaucuuucuuugc

SEQ ID NO: 584744 - RNA, 19 nt, Homo sapiens
caauggaccugacgcucuu

SEQ ID NO: 584745 - RNA, 19 nt, Homo sapiens
caaagaugauaccuuaaac

SEQ ID NO: 584746 - RNA, 19 nt, Homo sapiens
gcaagaagcaucaguugac

SEQ ID NO: 584747 - RNA, 19 nt, Homo sapiens
ucacuucucacuuugcaua

SEQ ID NO: 584748 - RNA, 19 nt, Homo sapiens
gcccugagguucccaucaa

SEQ ID NO: 584749 - RNA, 19 nt, Homo sapiens
caggagcuuuauuucauuu

SEQ ID NO: 584750 - RNA, 19 nt, Homo sapiens
cagauaaguggaacuauug

SEQ ID NO: 584751 - RNA, 19 nt, Homo sapiens
ccacagcacucugaaaugc

SEQ ID NO: 584752 - RNA, 19 nt, Homo sapiens
cagcgaagguuuccauguc

SEQ ID NO: 584753 - RNA, 19 nt, Homo sapiens
caccucagccucccaagua

SEQ ID NO: 584754 - RNA, 19 nt, Homo sapiens
gcagggcacagucggagua

SEQ ID NO: 584755 - RNA, 19 nt, Homo sapiens
gcaaagaguaugccgucaa

SEQ ID NO: 584756 - RNA, 19 nt, Homo sapiens
aagccucacuucccuguuu

SEQ ID NO: 584757 - RNA, 19 nt, Homo sapiens
cccaugaacuucccagaga

SEQ ID NO: 584758 - RNA, 19 nt, Homo sapiens
gcugaccucugaauugcuu

SEQ ID NO: 584759 - RNA, 19 nt, Homo sapiens
aaauguaucccucguuuau

SEQ ID NO: 584760 - RNA, 19 nt, Homo sapiens
caaggagguuccaucuuag

SEQ ID NO: 584761 - RNA, 19 nt, Homo sapiens
ggagcugauugaguucuuu

SEQ ID NO: 584762 - RNA, 19 nt, Homo sapiens
gggagccuaugccaaaguu

SEQ ID NO: 584763 - RNA, 19 nt, Homo sapiens
gaugguaucuucucaaaag

SEQ ID NO: 584764 - RNA, 19 nt, Homo sapiens
caagaagcaucaguugaca

SEQ ID NO: 584765 - RNA, 19 nt, Homo sapiens
caaaggccauugagacacu

SEQ ID NO: 584766 - RNA, 19 nt, Homo sapiens
gauggagaacugaagauug

SEQ ID NO: 584767 - RNA, 19 nt, Homo sapiens
aaacugaacaacuccugua

SEQ ID NO: 584768 - RNA, 19 nt, Homo sapiens
gaagaugacacaagguuuu

SEQ ID NO: 584769 - RNA, 19 nt, Homo sapiens
gaaacaagcagggcacagu

SEQ ID NO: 584770 - RNA, 19 nt, Homo sapiens
agagggagccuaugccaaa

SEQ ID NO: 584771 - RNA, 19 nt, Homo sapiens
gguacagccauucagauaa

SEQ ID NO: 584772 - RNA, 19 nt, Homo sapiens
cagcaguucccuauuauuc

SEQ ID NO: 584773 - RNA, 19 nt, Homo sapiens
ccagcuaucucagcacgaa

SEQ ID NO: 584774 - RNA, 19 nt, Homo sapiens
gaaggcaaguaugaguuuc

SEQ ID NO: 584775 - RNA, 19 nt, Homo sapiens
ugacaggagcuuuauuuca

SEQ ID NO: 584776 - RNA, 19 nt, Homo sapiens
gcaaagccauccccucaau

SEQ ID NO: 584777 - RNA, 19 nt, Homo sapiens
ggagaagcaagaagcauca

SEQ ID NO: 584778 - RNA, 19 nt, Homo sapiens
gcuccagucacaccuuaua

SEQ ID NO: 584779 - RNA, 19 nt, Homo sapiens
gacaaggacugggcacaca

SEQ ID NO: 584780 - RNA, 19 nt, Homo sapiens
ucacggaccaggccacauu

SEQ ID NO: 584781 - RNA, 19 nt, Homo sapiens
gauagugcucugugccuaa

SEQ ID NO: 584782 - RNA, 19 nt, Homo sapiens
ggaacggcuugcucuucuu

SEQ ID NO: 584783 - RNA, 19 nt, Homo sapiens
acaggagcuuuauuucauu

SEQ ID NO: 584784 - RNA, 19 nt, Homo sapiens
cacauaaucuuucuuugcu

SEQ ID NO: 584785 - RNA, 19 nt, Homo sapiens
aaaccuguguggcuaaagu

SEQ ID NO: 584786 - RNA, 19 nt, Homo sapiens
gacaggaggaggaagaaga

SEQ ID NO: 584787 - RNA, 19 nt, Homo sapiens
cagggaaacaagaacauuu

SEQ ID NO: 584788 - RNA, 19 nt, Homo sapiens
gccgugagccuacagaaug

SEQ ID NO: 584789 - RNA, 19 nt, Homo sapiens
cuucucacuuugcauaauu

SEQ ID NO: 584790 - RNA, 19 nt, Homo sapiens
cuacgaaggcccugagguu

SEQ ID NO: 584791 - RNA, 19 nt, Homo sapiens
gaaaaucugugacuuugac

SEQ ID NO: 584792 - RNA, 19 nt, Homo sapiens
ggcagacguuuauacaaca

SEQ ID NO: 584793 - RNA, 19 nt, Homo sapiens
gcugcuaaagucaguagua

SEQ ID NO: 584794 - RNA, 19 nt, Homo sapiens
ggagcuuuauuucauuugg

SEQ ID NO: 584795 - RNA, 19 nt, Homo sapiens
caucuccagugaagccaaa

SEQ ID NO: 584796 - RNA, 19 nt, Homo sapiens
cuauagagaugggcaguag

SEQ ID NO: 584797 - RNA, 19 nt, Homo sapiens
ccauguggcucugcagaau

SEQ ID NO: 584798 - RNA, 19 nt, Homo sapiens
gcccacagcacucugaaau

SEQ ID NO: 584799 - RNA, 19 nt, Homo sapiens
gcccuuaaccgccagcuau

SEQ ID NO: 584800 - RNA, 19 nt, Homo sapiens
ggaccaggccacauucuac

SEQ ID NO: 584801 - RNA, 19 nt, Homo sapiens
gcuaaagucaguaguaucg

SEQ ID NO: 584802 - RNA, 19 nt, Homo sapiens
gaagauugcucauauaaug

SEQ ID NO: 584803 - RNA, 19 nt, Homo sapiens
ggacuggucuguugucuuu

SEQ ID NO: 584804 - RNA, 19 nt, Homo sapiens
gagcaaagcagaacuuaua

SEQ ID NO: 584805 - RNA, 19 nt, Homo sapiens
ucaagaagauccagaauga

SEQ ID NO: 584806 - RNA, 19 nt, Homo sapiens
cagaggaggugaacaaauu

SEQ ID NO: 584807 - RNA, 19 nt, Homo sapiens
gaaugaaugugaacuucuu

SEQ ID NO: 584808 - RNA, 19 nt, Homo sapiens
gagaagauugcucauauaa

SEQ ID NO: 584809 - RNA, 19 nt, Homo sapiens
guggagagaugaucaagaa

SEQ ID NO: 584810 - RNA, 19 nt, Homo sapiens
cgagaagauugcucauaua

SEQ ID NO: 584811 - RNA, 19 nt, Homo sapiens
aagaggagauugaaacuga

SEQ ID NO: 584812 - RNA, 19 nt, Homo sapiens
ggauacaguucaagcaaga

SEQ ID NO: 584813 - RNA, 19 nt, Homo sapiens
guacagauuucuccagaca

SEQ ID NO: 584814 - RNA, 19 nt, Homo sapiens
uaacagcacuccugauuuu

SEQ ID NO: 584815 - RNA, 19 nt, Homo sapiens
gcagcaggcucaaugaauc

SEQ ID NO: 584816 - RNA, 19 nt, Homo sapiens
ccgagaagauugcucauau

SEQ ID NO: 584817 - RNA, 19 nt, Homo sapiens
caggacggaucucagaaua

SEQ ID NO: 584818 - RNA, 19 nt, Homo sapiens
ggaacgcgcuggagugaag

SEQ ID NO: 584819 - RNA, 19 nt, Homo sapiens
ccaagaugaugcuggauga

SEQ ID NO: 584820 - RNA, 19 nt, Homo sapiens
gagagaugaucaagaagau

SEQ ID NO: 584821 - RNA, 19 nt, Homo sapiens
ggauucaggcugcaaagua

SEQ ID NO: 584822 - RNA, 19 nt, Homo sapiens
gcagcaagccugugagaug

SEQ ID NO: 584823 - RNA, 19 nt, Homo sapiens
gaauacgaauguggacaaa

SEQ ID NO: 584824 - RNA, 19 nt, Homo sapiens
ggagagaugaucaagaaga

SEQ ID NO: 584825 - RNA, 19 nt, Homo sapiens
gcaaagcagaacuuauaaa

SEQ ID NO: 584826 - RNA, 19 nt, Homo sapiens
gaguacggaucucggauug

SEQ ID NO: 584827 - RNA, 19 nt, Homo sapiens
gguccucucugcccaguug

SEQ ID NO: 584828 - RNA, 19 nt, Homo sapiens
ggaagaggccaaggcaauu

SEQ ID NO: 584829 - RNA, 19 nt, Homo sapiens
gaucucagaauacgaaugu

SEQ ID NO: 584830 - RNA, 19 nt, Homo sapiens
gaucuaaaucucugccaaa

SEQ ID NO: 584831 - RNA, 19 nt, Homo sapiens
ggacggaucucagaauacg

SEQ ID NO: 584832 - RNA, 19 nt, Homo sapiens
cagggagacucaaucaguu

SEQ ID NO: 584833 - RNA, 19 nt, Homo sapiens
guuggaagauggagaucaa

SEQ ID NO: 584834 - RNA, 19 nt, Homo sapiens
cagagaagauagcgagauc

SEQ ID NO: 584835 - RNA, 19 nt, Homo sapiens
gaagaggccaaggcaauug

SEQ ID NO: 584836 - RNA, 19 nt, Homo sapiens
acagacagcaggccgcuua

SEQ ID NO: 584837 - RNA, 19 nt, Homo sapiens
aauaacagcacuccugauu

SEQ ID NO: 584838 - RNA, 19 nt, Homo sapiens
gacagcaggccgcuuacua

SEQ ID NO: 584839 - RNA, 19 nt, Homo sapiens
gaugcuggaugacauugug

SEQ ID NO: 584840 - RNA, 19 nt, Homo sapiens
gaggugaacaaauuaacaa

SEQ ID NO: 584841 - RNA, 19 nt, Homo sapiens
gaccagguguuguauugca

SEQ ID NO: 584842 - RNA, 19 nt, Homo sapiens
gcagacgggagccuucgua

SEQ ID NO: 584843 - RNA, 19 nt, Homo sapiens
gagaucaaccggagagcaa

SEQ ID NO: 584844 - RNA, 19 nt, Homo sapiens
uggaccagguguuguauug

SEQ ID NO: 584845 - RNA, 19 nt, Homo sapiens
ccagaaagccaagaugaug

SEQ ID NO: 584846 - RNA, 19 nt, Homo sapiens
gauucaggcugcaaaguac

SEQ ID NO: 584847 - RNA, 19 nt, Homo sapiens
ugaaucgaaugaaugugaa

SEQ ID NO: 584848 - RNA, 19 nt, Homo sapiens
caaugaaucgaaugaaugu

SEQ ID NO: 584849 - RNA, 19 nt, Homo sapiens
gggaggaguacuacaagaa

SEQ ID NO: 584850 - RNA, 19 nt, Homo sapiens
gaggaggugaacaaauuaa

SEQ ID NO: 584851 - RNA, 19 nt, Homo sapiens
aaaagucacucuugcuauu

SEQ ID NO: 584852 - RNA, 19 nt, Homo sapiens
ucaaugaaucgaaugaaug

SEQ ID NO: 584853 - RNA, 19 nt, Homo sapiens
ccugugagauggugaugga

SEQ ID NO: 584854 - RNA, 19 nt, Homo sapiens
aaaccucuccgcaucauug

SEQ ID NO: 584855 - RNA, 19 nt, Homo sapiens
gcagaggaggugaacaaau

SEQ ID NO: 584856 - RNA, 19 nt, Homo sapiens
aagaagauccagaaugaug

SEQ ID NO: 584857 - RNA, 19 nt, Homo sapiens
ccacgacagugaauaacag

SEQ ID NO: 584858 - RNA, 19 nt, Homo sapiens
gcgcuggagugaagaugau

SEQ ID NO: 584859 - RNA, 19 nt, Homo sapiens
cccaaggacuucaaugaca

SEQ ID NO: 584860 - RNA, 19 nt, Homo sapiens
gaggagauugaaacugaaa

SEQ ID NO: 584861 - RNA, 19 nt, Homo sapiens
ggaggugaacaaauuaaca

SEQ ID NO: 584862 - RNA, 19 nt, Homo sapiens
aguuagagguggaacauuc

SEQ ID NO: 584863 - RNA, 19 nt, Homo sapiens
gacagcagcaggcucaaug

SEQ ID NO: 584864 - RNA, 19 nt, Homo sapiens
gagaaugugaaagccauaa

SEQ ID NO: 584865 - RNA, 19 nt, Homo sapiens
caggacaguuccacgacaa

SEQ ID NO: 584866 - RNA, 19 nt, Homo sapiens
gcugcaaaguacagauuuc

SEQ ID NO: 584867 - RNA, 19 nt, Homo sapiens
gacgggagccuucguagag

SEQ ID NO: 584868 - RNA, 19 nt, Homo sapiens
ccagggagacucaaucagu

SEQ ID NO: 584869 - RNA, 19 nt, Homo sapiens
gagccagccagagaagaua

SEQ ID NO: 584870 - RNA, 19 nt, Homo sapiens
ggaggaguacuacaagaag

SEQ ID NO: 584871 - RNA, 19 nt, Homo sapiens
gaugaugcuggaugacauu

SEQ ID NO: 584872 - RNA, 19 nt, Homo sapiens
agaggaggugaacaaauua

SEQ ID NO: 584873 - RNA, 19 nt, Homo sapiens
cgagguggcgagaauguga

SEQ ID NO: 584874 - RNA, 19 nt, Homo sapiens
ucgaaugaaugugaacuuc

SEQ ID NO: 584875 - RNA, 19 nt, Homo sapiens
guccagaaagccaagauga

SEQ ID NO: 584876 - RNA, 19 nt, Homo sapiens
ucacucuugcuauuucuuu

SEQ ID NO: 584877 - RNA, 19 nt, Homo sapiens
gaucaaccggagagcaaga

SEQ ID NO: 584878 - RNA, 19 nt, Homo sapiens
cucaaugaaucgaaugaau

SEQ ID NO: 584879 - RNA, 19 nt, Homo sapiens
gcggauacaguucaagcaa

SEQ ID NO: 584880 - RNA, 19 nt, Homo sapiens
aaagucacucuugcuauuu

SEQ ID NO: 584881 - RNA, 19 nt, Homo sapiens
gagcgcaguguguccuuga

SEQ ID NO: 584882 - RNA, 19 nt, Homo sapiens
aaagagcaaagcagaacuu

SEQ ID NO: 584883 - RNA, 19 nt, Homo sapiens
gaaugugaaagccauaaac

SEQ ID NO: 584884 - RNA, 19 nt, Homo sapiens
gaugcugccacgacaguga

SEQ ID NO: 584885 - RNA, 19 nt, Homo sapiens
ggaguggagagaugaucaa

SEQ ID NO: 584886 - RNA, 19 nt, Homo sapiens
acacuaaggccugggaaga

SEQ ID NO: 584887 - RNA, 19 nt, Homo sapiens
gacaaaccucuccgcauca

SEQ ID NO: 584888 - RNA, 19 nt, Homo sapiens
uggcagaggaggugaacaa

SEQ ID NO: 584889 - RNA, 19 nt, Homo sapiens
agaggagauugaaacugaa

SEQ ID NO: 584890 - RNA, 19 nt, Homo sapiens
ucucucgccuguucugugu

SEQ ID NO: 584891 - RNA, 19 nt, Homo sapiens
ggacagcagcaggcucaau

SEQ ID NO: 584892 - RNA, 19 nt, Homo sapiens
gaauaacagcacuccugau

SEQ ID NO: 584893 - RNA, 19 nt, Homo sapiens
acaagaagcaagcgcaagu

SEQ ID NO: 584894 - RNA, 19 nt, Homo sapiens
cgaaggcuugggaggagua

SEQ ID NO: 584895 - RNA, 19 nt, Homo sapiens
ccucaugacccaagcaaag

SEQ ID NO: 584896 - RNA, 19 nt, Homo sapiens
cagcagcaggcucaaugaa

SEQ ID NO: 584897 - RNA, 19 nt, Homo sapiens
cugggaagaguauuacaaa

SEQ ID NO: 584898 - RNA, 19 nt, Homo sapiens
agaauacgaauguggacaa

SEQ ID NO: 584899 - RNA, 19 nt, Homo sapiens
caggaacgcgcuggaguga

SEQ ID NO: 584900 - RNA, 19 nt, Homo sapiens
ugggauccuuccauguuga

SEQ ID NO: 584901 - RNA, 19 nt, Homo sapiens
cagcccggaucaucaacga

SEQ ID NO: 584902 - RNA, 19 nt, Homo sapiens
gaaggaagguuuagaaaga

SEQ ID NO: 584903 - RNA, 19 nt, Homo sapiens
gcacagagcucaugacaca

SEQ ID NO: 584904 - RNA, 19 nt, Homo sapiens
gcacuucuguuccagguuu

SEQ ID NO: 584905 - RNA, 19 nt, Homo sapiens
guacaguaguaucugcuua

SEQ ID NO: 584906 - RNA, 19 nt, Homo sapiens
ggaucuacccucuaguuua

SEQ ID NO: 584907 - RNA, 19 nt, Homo sapiens
gaucuacccucuaguuuac

SEQ ID NO: 584908 - RNA, 19 nt, Homo sapiens
gagaagaaacugacucguu

SEQ ID NO: 584909 - RNA, 19 nt, Homo sapiens
gcagcgugguuacuucuuu

SEQ ID NO: 584910 - RNA, 19 nt, Homo sapiens
gcugagaacuaagagauga

SEQ ID NO: 584911 - RNA, 19 nt, Homo sapiens
cgggccagcucuaguaaua

SEQ ID NO: 584912 - RNA, 19 nt, Homo sapiens
gcgcuuaaauuuccagaca

SEQ ID NO: 584913 - RNA, 19 nt, Homo sapiens
caacgggccagcucuagua

SEQ ID NO: 584914 - RNA, 19 nt, Homo sapiens
caauucacauucaucauca

SEQ ID NO: 584915 - RNA, 19 nt, Homo sapiens
gcacgagacccauuuccuu

SEQ ID NO: 584916 - RNA, 19 nt, Homo sapiens
gcuuaaauuuccagacaga

SEQ ID NO: 584917 - RNA, 19 nt, Homo sapiens
aggcagaccugaaucacaa

SEQ ID NO: 584918 - RNA, 19 nt, Homo sapiens
ccagaaggaagguuuagaa

SEQ ID NO: 584919 - RNA, 19 nt, Homo sapiens
gcuccgagguguacaggau

SEQ ID NO: 584920 - RNA, 19 nt, Homo sapiens
ggaaggcagaccugaauca

SEQ ID NO: 584921 - RNA, 19 nt, Homo sapiens
caagcagcgugguuacuuc

SEQ ID NO: 584922 - RNA, 19 nt, Homo sapiens
cagaguaacguacauuugu

SEQ ID NO: 584923 - RNA, 19 nt, Homo sapiens
guaccaugcugcccugaag

SEQ ID NO: 584924 - RNA, 19 nt, Homo sapiens
caagguggaacucgucuga

SEQ ID NO: 584925 - RNA, 19 nt, Homo sapiens
uugccagucuguuaaguaa

SEQ ID NO: 584926 - RNA, 19 nt, Homo sapiens
gcuguucacucccgaggau

SEQ ID NO: 584927 - RNA, 19 nt, Homo sapiens
cagaaggaagguuuagaaa

SEQ ID NO: 584928 - RNA, 19 nt, Homo sapiens
gagaccagaaggaagguuu

SEQ ID NO: 584929 - RNA, 19 nt, Homo sapiens
agacagagaccagaaggaa

SEQ ID NO: 584930 - RNA, 19 nt, Homo sapiens
cacccugucccucuaauaa

SEQ ID NO: 584931 - RNA, 19 nt, Homo sapiens
gcguggaucuacccucuag

SEQ ID NO: 584932 - RNA, 19 nt, Homo sapiens
gcucccgaguacaguagua

SEQ ID NO: 584933 - RNA, 19 nt, Homo sapiens
cgagacccauuuccuugug

SEQ ID NO: 584934 - RNA, 19 nt, Homo sapiens
aaggaagguuuagaaagaa

SEQ ID NO: 584935 - RNA, 19 nt, Homo sapiens
ucaauucacauucaucauc

SEQ ID NO: 584936 - RNA, 19 nt, Homo sapiens
agaguaacguacauuugug

SEQ ID NO: 584937 - RNA, 19 nt, Homo sapiens
ccagaguaacguacauuug

SEQ ID NO: 584938 - RNA, 19 nt, Homo sapiens
ggaacugugugugcaaagg

SEQ ID NO: 584939 - RNA, 19 nt, Homo sapiens
gagaugagggaggcacaaa

SEQ ID NO: 584940 - RNA, 19 nt, Homo sapiens
gccagucuguuaaguaaaa

SEQ ID NO: 584941 - RNA, 19 nt, Homo sapiens
cagcucaggauauuauguu

SEQ ID NO: 584942 - RNA, 19 nt, Homo sapiens
guacauuugugcuguuuuc

SEQ ID NO: 584943 - RNA, 19 nt, Homo sapiens
aggaagguuuagaaagaaa

SEQ ID NO: 584944 - RNA, 19 nt, Homo sapiens
gaacugugugugcaaaggu

SEQ ID NO: 584945 - RNA, 19 nt, Homo sapiens
ucacaacgggccagcucua

SEQ ID NO: 584946 - RNA, 19 nt, Homo sapiens
guggaucuacccucuaguu

SEQ ID NO: 584947 - RNA, 19 nt, Homo sapiens
cagcgugguuacuucuuuc

SEQ ID NO: 584948 - RNA, 19 nt, Homo sapiens
caucaagggcugccacgau

SEQ ID NO: 584949 - RNA, 19 nt, Homo sapiens
ggagagggugauugagugu

SEQ ID NO: 584950 - RNA, 19 nt, Homo sapiens
gaugagggaggcacaaacu

SEQ ID NO: 584951 - RNA, 19 nt, Homo sapiens
guggaaggcagaccugaau

SEQ ID NO: 584952 - RNA, 19 nt, Homo sapiens
ucaagcagcgugguuacuu

SEQ ID NO: 584953 - RNA, 19 nt, Homo sapiens
ccuccugucucuaagucaa

SEQ ID NO: 584954 - RNA, 19 nt, Homo sapiens
agaccagaaggaagguuua

SEQ ID NO: 584955 - RNA, 19 nt, Homo sapiens
uuaaauuuccagacagaga

SEQ ID NO: 584956 - RNA, 19 nt, Homo sapiens
gaugagcacccugcaugug

SEQ ID NO: 584957 - RNA, 19 nt, Homo sapiens
uagcugagaacuaagagau

SEQ ID NO: 584958 - RNA, 19 nt, Homo sapiens
augcauggcucccgaguac

SEQ ID NO: 584959 - RNA, 19 nt, Homo sapiens
caucagcacgagacccauu

SEQ ID NO: 584960 - RNA, 19 nt, Homo sapiens
guguuugccuugggccuuu

SEQ ID NO: 584961 - RNA, 19 nt, Homo sapiens
cgucugcacuucuguucca

SEQ ID NO: 584962 - RNA, 19 nt, Homo sapiens
cucaggauauuauguuucu

SEQ ID NO: 584963 - RNA, 19 nt, Homo sapiens
gcucaggauauuauguuuc

SEQ ID NO: 584964 - RNA, 19 nt, Homo sapiens
ggccagcucuaguaauacg

SEQ ID NO: 584965 - RNA, 19 nt, Homo sapiens
gguggaaggcagaccugaa

SEQ ID NO: 584966 - RNA, 19 nt, Homo sapiens
agaaggaagguuuagaaag

SEQ ID NO: 584967 - RNA, 19 nt, Homo sapiens
cacgaucaccucacacugu

SEQ ID NO: 584968 - RNA, 19 nt, Homo sapiens
gugauugaguguggagauc

SEQ ID NO: 584969 - RNA, 19 nt, Homo sapiens
ucacccugucccucuaaua

SEQ ID NO: 584970 - RNA, 19 nt, Homo sapiens
agccugggaucuccauaug

SEQ ID NO: 584971 - RNA, 19 nt, Homo sapiens
gacggcagcccaacaacca

SEQ ID NO: 584972 - RNA, 19 nt, Homo sapiens
gcucgggagaagaaacuga

SEQ ID NO: 584973 - RNA, 19 nt, Homo sapiens
gcgacgacaggagguauga

SEQ ID NO: 584974 - RNA, 19 nt, Homo sapiens
caucccgagugcuucaugu

SEQ ID NO: 584975 - RNA, 19 nt, Homo sapiens
gaaggagucugacaucuua

SEQ ID NO: 584976 - RNA, 19 nt, Homo sapiens
gaacacagaugaaccaaug

SEQ ID NO: 584977 - RNA, 19 nt, Homo sapiens
gagcacaauuugaauauga

SEQ ID NO: 584978 - RNA, 19 nt, Homo sapiens
caaaggaacuaaagcguau

SEQ ID NO: 584979 - RNA, 19 nt, Homo sapiens
uaaagaagcuggcauucga

SEQ ID NO: 584980 - RNA, 19 nt, Homo sapiens
gaacauaugcacacuacuu

SEQ ID NO: 584981 - RNA, 19 nt, Homo sapiens
gacaucauccagauuauua

SEQ ID NO: 584982 - RNA, 19 nt, Homo sapiens
gcugaaacauccacacauu

SEQ ID NO: 584983 - RNA, 19 nt, Homo sapiens
ugcaagacaucucuaauaa

SEQ ID NO: 584984 - RNA, 19 nt, Homo sapiens
ucaagauugugccaaguua

SEQ ID NO: 584985 - RNA, 19 nt, Homo sapiens
cugaaaggaucacuguuua

SEQ ID NO: 584986 - RNA, 19 nt, Homo sapiens
cuacuucgaucucacaauu

SEQ ID NO: 584987 - RNA, 19 nt, Homo sapiens
augcagaucuugucacaua

SEQ ID NO: 584988 - RNA, 19 nt, Homo sapiens
cauguuacccugagaauaa

SEQ ID NO: 584989 - RNA, 19 nt, Homo sapiens
gaaacuaaagggugcagua

SEQ ID NO: 584990 - RNA, 19 nt, Homo sapiens
aaagagagccuuacggaaa

SEQ ID NO: 584991 - RNA, 19 nt, Homo sapiens
ugucacauaugaagaagua

SEQ ID NO: 584992 - RNA, 19 nt, Homo sapiens
ggaaugcuuuacaugguuu

SEQ ID NO: 584993 - RNA, 19 nt, Homo sapiens
ggaaaacacuagucuuauu

SEQ ID NO: 584994 - RNA, 19 nt, Homo sapiens
guaaggaugaucauaauug

SEQ ID NO: 584995 - RNA, 19 nt, Homo sapiens
ggaagaaauuucauguuac

SEQ ID NO: 584996 - RNA, 19 nt, Homo sapiens
guacgacgauguaucaaca

SEQ ID NO: 584997 - RNA, 19 nt, Homo sapiens
ucaauccuuuggaauguua

SEQ ID NO: 584998 - RNA, 19 nt, Homo sapiens
ggugacaucauccagauua

SEQ ID NO: 584999 - RNA, 19 nt, Homo sapiens
gaauaacgacgcaaaggaa

SEQ ID NO: 585000 - RNA, 19 nt, Homo sapiens
gaaaggaucacuguuuaug

SEQ ID NO: 585001 - RNA, 19 nt, Homo sapiens
gagaacauaugcacacuac

SEQ ID NO: 585002 - RNA, 19 nt, Homo sapiens
caagacaucucuaauaacg

SEQ ID NO: 585003 - RNA, 19 nt, Homo sapiens
aguauuaccuucaagauug

SEQ ID NO: 585004 - RNA, 19 nt, Homo sapiens
ggucauagcagcacuaaca

SEQ ID NO: 585005 - RNA, 19 nt, Homo sapiens
caaugggaaucacuuuaaa

SEQ ID NO: 585006 - RNA, 19 nt, Homo sapiens
ccaaggcaguggagccaua

SEQ ID NO: 585007 - RNA, 19 nt, Homo sapiens
ggacgacagaucuauguaa

SEQ ID NO: 585008 - RNA, 19 nt, Homo sapiens
gaaauucgagaaaucaaug

SEQ ID NO: 585009 - RNA, 19 nt, Homo sapiens
cacaugaaguuuacaguga

SEQ ID NO: 585010 - RNA, 19 nt, Homo sapiens
uagagcagcugaggaaauu

SEQ ID NO: 585011 - RNA, 19 nt, Homo sapiens
gcugaaaggaucacuguuu

SEQ ID NO: 585012 - RNA, 19 nt, Homo sapiens
ggcauucgauucagaguug

SEQ ID NO: 585013 - RNA, 19 nt, Homo sapiens
uuaaggagcgggaucguua

SEQ ID NO: 585014 - RNA, 19 nt, Homo sapiens
gaagagauucaugcgcuua

SEQ ID NO: 585015 - RNA, 19 nt, Homo sapiens
gaaacugggcaacaauuug

SEQ ID NO: 585016 - RNA, 19 nt, Homo sapiens
aagaagcaguacaaagaua

SEQ ID NO: 585017 - RNA, 19 nt, Homo sapiens
caagguacacuucauguug

SEQ ID NO: 585018 - RNA, 19 nt, Homo sapiens
ccaaugggaaucacuuuaa

SEQ ID NO: 585019 - RNA, 19 nt, Homo sapiens
uuacagugaugaagcauug

SEQ ID NO: 585020 - RNA, 19 nt, Homo sapiens
gaagaaauuucauguuacc

SEQ ID NO: 585021 - RNA, 19 nt, Homo sapiens
gagcagaucuguguuuuga

SEQ ID NO: 585022 - RNA, 19 nt, Homo sapiens
acauauagcucagauggaa

SEQ ID NO: 585023 - RNA, 19 nt, Homo sapiens
gaaacauccacacauugua

SEQ ID NO: 585024 - RNA, 19 nt, Homo sapiens
gacgauguaucaacagaga

SEQ ID NO: 585025 - RNA, 19 nt, Homo sapiens
acagagagccaaagaggua

SEQ ID NO: 585026 - RNA, 19 nt, Homo sapiens
acuaaagggugcaguacua

SEQ ID NO: 585027 - RNA, 19 nt, Homo sapiens
ugucauguccgaauagaua

SEQ ID NO: 585028 - RNA, 19 nt, Homo sapiens
gaggaaaacacuagucuua

SEQ ID NO: 585029 - RNA, 19 nt, Homo sapiens
cacaucaaguccaggguua

SEQ ID NO: 585030 - RNA, 19 nt, Homo sapiens
cgacagaucuauguaagag

SEQ ID NO: 585031 - RNA, 19 nt, Homo sapiens
cugaagaguuaccagauuu

SEQ ID NO: 585032 - RNA, 19 nt, Homo sapiens
gcagaucuguguuuugaaa

SEQ ID NO: 585033 - RNA, 19 nt, Homo sapiens
gcucagauggaaugcuuua

SEQ ID NO: 585034 - RNA, 19 nt, Homo sapiens
ggagacauauagcucagau

SEQ ID NO: 585035 - RNA, 19 nt, Homo sapiens
gccaguaucugucauaugc

SEQ ID NO: 585036 - RNA, 19 nt, Homo sapiens
agugugaccuacauuuaua

SEQ ID NO: 585037 - RNA, 19 nt, Homo sapiens
gcacacuacuucgaucuca

SEQ ID NO: 585038 - RNA, 19 nt, Homo sapiens
ggacaaaacuggagaccau

SEQ ID NO: 585039 - RNA, 19 nt, Homo sapiens
cagagaaacugggcaacaa

SEQ ID NO: 585040 - RNA, 19 nt, Homo sapiens
ucccaccucucccuauuua

SEQ ID NO: 585041 - RNA, 19 nt, Homo sapiens
aaagagguauuggaagaaa

SEQ ID NO: 585042 - RNA, 19 nt, Homo sapiens
aaggaucacuguuuaugaa

SEQ ID NO: 585043 - RNA, 19 nt, Homo sapiens
gaagccaguaucugucaua

SEQ ID NO: 585044 - RNA, 19 nt, Homo sapiens
cugcagaguuugcuccuuu

SEQ ID NO: 585045 - RNA, 19 nt, Homo sapiens
gcacugaagguccugagaa

SEQ ID NO: 585046 - RNA, 19 nt, Homo sapiens
cacaaagucuucaccacaa

SEQ ID NO: 585047 - RNA, 19 nt, Homo sapiens
gcuacugccaugauaauaa

SEQ ID NO: 585048 - RNA, 19 nt, Homo sapiens
gaauagauaggaggagaaa

SEQ ID NO: 585049 - RNA, 19 nt, Homo sapiens
ccacgaggaugcgauguau

SEQ ID NO: 585050 - RNA, 19 nt, Homo sapiens
gaagcuggcauucgauuca

SEQ ID NO: 585051 - RNA, 19 nt, Homo sapiens
gagaaacugggcaacaauu

SEQ ID NO: 585052 - RNA, 19 nt, Homo sapiens
aaggaaagauuguuugaag

SEQ ID NO: 585053 - RNA, 19 nt, Homo sapiens
cuacgcuacugccaugaua

SEQ ID NO: 585054 - RNA, 19 nt, Homo sapiens
caaugcagaucuugucaca

SEQ ID NO: 585055 - RNA, 19 nt, Homo sapiens
uguaagagcacaauuugaa

SEQ ID NO: 585056 - RNA, 19 nt, Homo sapiens
cauagcagcacuaacaauu

SEQ ID NO: 585057 - RNA, 19 nt, Homo sapiens
gaguucggcugguacaguu

SEQ ID NO: 585058 - RNA, 19 nt, Homo sapiens
guagccagccauuauauga

SEQ ID NO: 585059 - RNA, 19 nt, Homo sapiens
ugggguagcuauucaauua

SEQ ID NO: 585060 - RNA, 19 nt, Homo sapiens
ggauggagcagaucugugu

SEQ ID NO: 585061 - RNA, 19 nt, Homo sapiens
gaaccaaugggaaucacuu

SEQ ID NO: 585062 - RNA, 19 nt, Homo sapiens
uaacacaaccucauuucau

SEQ ID NO: 585063 - RNA, 19 nt, Homo sapiens
gaagcaguacaaagauaaa

SEQ ID NO: 585064 - RNA, 19 nt, Homo sapiens
agaaaucaauggcaucagu

SEQ ID NO: 585065 - RNA, 19 nt, Homo sapiens
ccaccucucccuauuuaaa

SEQ ID NO: 585066 - RNA, 19 nt, Homo sapiens
ccugaagaguuaccagauu

SEQ ID NO: 585067 - RNA, 19 nt, Homo sapiens
caacuauuacuccagguuu

SEQ ID NO: 585068 - RNA, 19 nt, Homo sapiens
gacgacagaucuauguaag

SEQ ID NO: 585069 - RNA, 19 nt, Homo sapiens
gaguauuaccuucaagauu

SEQ ID NO: 585070 - RNA, 19 nt, Homo sapiens
ggacagccuggaagagauu

SEQ ID NO: 585071 - RNA, 19 nt, Homo sapiens
uaacugggagcaccucauu

SEQ ID NO: 585072 - RNA, 19 nt, Homo sapiens
uaaaugaggaugaaucucu

SEQ ID NO: 585073 - RNA, 19 nt, Homo sapiens
ggccagcuguacuugguuu

SEQ ID NO: 585074 - RNA, 19 nt, Homo sapiens
uaaggaugaucauaauugg

SEQ ID NO: 585075 - RNA, 19 nt, Homo sapiens
gaauaaagcaggcacuuga

SEQ ID NO: 585076 - RNA, 19 nt, Homo sapiens
cuagauccaugcauuauuu

SEQ ID NO: 585077 - RNA, 19 nt, Homo sapiens
gggaauagcugggcugaga

SEQ ID NO: 585078 - RNA, 19 nt, Homo sapiens
gagcagaacuuggcagcaa

SEQ ID NO: 585079 - RNA, 19 nt, Homo sapiens
uagccuaggucuugaguga

SEQ ID NO: 585080 - RNA, 19 nt, Homo sapiens
gcauuugguugcucacgaa

SEQ ID NO: 585081 - RNA, 19 nt, Homo sapiens
gcugagaccuacaggaauc

SEQ ID NO: 585082 - RNA, 19 nt, Homo sapiens
ggacacggccuucauguac

SEQ ID NO: 585083 - RNA, 19 nt, Homo sapiens
ccuauucacuuuacacugu

SEQ ID NO: 585084 - RNA, 19 nt, Homo sapiens
ucacgaaugucccaacuac

SEQ ID NO: 585085 - RNA, 19 nt, Homo sapiens
ggaaguggccgagaucugu

SEQ ID NO: 585086 - RNA, 19 nt, Homo sapiens
gagcgcuuccuguugaaua

SEQ ID NO: 585087 - RNA, 19 nt, Homo sapiens
gggcugagaccuacaggaa

SEQ ID NO: 585088 - RNA, 19 nt, Homo sapiens
guacaaguaugaggacaag

SEQ ID NO: 585089 - RNA, 19 nt, Homo sapiens
guggaugccuuuaaucaag

SEQ ID NO: 585090 - RNA, 19 nt, Homo sapiens
uggagcagcuggagcagaa

SEQ ID NO: 585091 - RNA, 19 nt, Homo sapiens
gaaguggccgagaucugua

SEQ ID NO: 585092 - RNA, 19 nt, Homo sapiens
cuugagcgcuuccuguuga

SEQ ID NO: 585093 - RNA, 19 nt, Homo sapiens
gguggcgacugcagaguga

SEQ ID NO: 585094 - RNA, 19 nt, Homo sapiens
ugaccagucuuggccuuaa

SEQ ID NO: 585095 - RNA, 19 nt, Homo sapiens
aaucaagccuggcauuugg

SEQ ID NO: 585096 - RNA, 19 nt, Homo sapiens
ugacuggcaaguacaagua

SEQ ID NO: 585097 - RNA, 19 nt, Homo sapiens
gcacuugaccuggcuguag

SEQ ID NO: 585098 - RNA, 19 nt, Homo sapiens
ugucguggaugccuuuaau

SEQ ID NO: 585099 - RNA, 19 nt, Homo sapiens
cuggagacgucauugaaga

SEQ ID NO: 585100 - RNA, 19 nt, Homo sapiens
gcccaaggcuuuucuguca

SEQ ID NO: 585101 - RNA, 19 nt, Homo sapiens
ccauugcguugguggagaa

SEQ ID NO: 585102 - RNA, 19 nt, Homo sapiens
gagguucuaugccuacaac

SEQ ID NO: 585103 - RNA, 19 nt, Homo sapiens
gcugggaaguggccgagau

SEQ ID NO: 585104 - RNA, 19 nt, Homo sapiens
uaaucaagccuggcauuug

SEQ ID NO: 585105 - RNA, 19 nt, Homo sapiens
ggauguaccaccacucaca

SEQ ID NO: 585106 - RNA, 19 nt, Homo sapiens
gacacggccuucauguaca

SEQ ID NO: 585107 - RNA, 19 nt, Homo sapiens
gaacuggacacggccuuca

SEQ ID NO: 585108 - RNA, 19 nt, Homo sapiens
gcaccaggagggcaaguuc

SEQ ID NO: 585109 - RNA, 19 nt, Homo sapiens
ugucuagauccaugcauua

SEQ ID NO: 585110 - RNA, 19 nt, Homo sapiens
ccaaguggaccucuucuac

SEQ ID NO: 585111 - RNA, 19 nt, Homo sapiens
ggccgcuucuuugggaaua

SEQ ID NO: 585112 - RNA, 19 nt, Homo sapiens
ggacaaggacgggaaacag

SEQ ID NO: 585113 - RNA, 19 nt, Homo sapiens
gcuggauccugcccacugu

SEQ ID NO: 585114 - RNA, 19 nt, Homo sapiens
gcuguagccuaggucuuga

SEQ ID NO: 585115 - RNA, 19 nt, Homo sapiens
acaggaaucgcuucuggaa

SEQ ID NO: 585116 - RNA, 19 nt, Homo sapiens
gcucacgaaugucccaacu

SEQ ID NO: 585117 - RNA, 19 nt, Homo sapiens
acaaguaugaggacaagga

SEQ ID NO: 585118 - RNA, 19 nt, Homo sapiens
acgaaugucccaacuacuu

SEQ ID NO: 585119 - RNA, 19 nt, Homo sapiens
ugaauaaagcaggcacuug

SEQ ID NO: 585120 - RNA, 19 nt, Homo sapiens
cuugcucccuauucacuuu

SEQ ID NO: 585121 - RNA, 19 nt, Homo sapiens
cgaaugucccaacuacuuc

SEQ ID NO: 585122 - RNA, 19 nt, Homo sapiens
uuugguugcucacgaaugu

SEQ ID NO: 585123 - RNA, 19 nt, Homo sapiens
gccuaggucuugagugaac

SEQ ID NO: 585124 - RNA, 19 nt, Homo sapiens
gaccagucuuggccuuaag

SEQ ID NO: 585125 - RNA, 19 nt, Homo sapiens
uuaaucaagccuggcauuu

SEQ ID NO: 585126 - RNA, 19 nt, Homo sapiens
gcagaacuuggcagcaaca

SEQ ID NO: 585127 - RNA, 19 nt, Homo sapiens
uuucugaauugucuagauc

SEQ ID NO: 585128 - RNA, 19 nt, Homo sapiens
gauggaaaaucacuaaagc

SEQ ID NO: 585129 - RNA, 19 nt, Homo sapiens
gcagcuggagcagaacuug

SEQ ID NO: 585130 - RNA, 19 nt, Homo sapiens
cagcuggagacgucauuga

SEQ ID NO: 585131 - RNA, 19 nt, Homo sapiens
gcuuuucugucaccucuuu

SEQ ID NO: 585132 - RNA, 19 nt, Homo sapiens
ucaggcugcccaaggcuuu

SEQ ID NO: 585133 - RNA, 19 nt, Homo sapiens
cugccuugcucccuauuca

SEQ ID NO: 585134 - RNA, 19 nt, Homo sapiens
gagugaaaauugccaccaa

SEQ ID NO: 585135 - RNA, 19 nt, Homo sapiens
ggauccugcccacugugua

SEQ ID NO: 585136 - RNA, 19 nt, Homo sapiens
caucaacacuccagauuua

SEQ ID NO: 585137 - RNA, 19 nt, Homo sapiens
guaagaagcuggcgaaaca

SEQ ID NO: 585138 - RNA, 19 nt, Homo sapiens
ccaagaacaucccaguuua

SEQ ID NO: 585139 - RNA, 19 nt, Homo sapiens
uaacaggccuuuauuaagu

SEQ ID NO: 585140 - RNA, 19 nt, Homo sapiens
aggaagcccuuuagaauua

SEQ ID NO: 585141 - RNA, 19 nt, Homo sapiens
ugaaagaucugaugugcaa

SEQ ID NO: 585142 - RNA, 19 nt, Homo sapiens
gaacaucccaguuuaugaa

SEQ ID NO: 585143 - RNA, 19 nt, Homo sapiens
gcuggagacuuccugaaua

SEQ ID NO: 585144 - RNA, 19 nt, Homo sapiens
ggaagaugauaacagcuaa

SEQ ID NO: 585145 - RNA, 19 nt, Homo sapiens
aaagaagccuccuuaguau

SEQ ID NO: 585146 - RNA, 19 nt, Homo sapiens
caucauggcuggagacuuc

SEQ ID NO: 585147 - RNA, 19 nt, Homo sapiens
gauaauagcagaaagaaag

SEQ ID NO: 585148 - RNA, 19 nt, Homo sapiens
gaaugcugcugagaaauuu

SEQ ID NO: 585149 - RNA, 19 nt, Homo sapiens
gaucugaugugcaaauaca

SEQ ID NO: 585150 - RNA, 19 nt, Homo sapiens
uaaagggaauucaaaggaa

SEQ ID NO: 585151 - RNA, 19 nt, Homo sapiens
gaaccacauuucuuuaaca

SEQ ID NO: 585152 - RNA, 19 nt, Homo sapiens
ggaaugcugcugagaaauu

SEQ ID NO: 585153 - RNA, 19 nt, Homo sapiens
aaacaccgauucagguauu

SEQ ID NO: 585154 - RNA, 19 nt, Homo sapiens
acaaugcuuugcaguauuu

SEQ ID NO: 585155 - RNA, 19 nt, Homo sapiens
ucacaaugcuuugcaguau

SEQ ID NO: 585156 - RNA, 19 nt, Homo sapiens
gagcgccaauggacaauau

SEQ ID NO: 585157 - RNA, 19 nt, Homo sapiens
ccaaagaaccagcuuaauc

SEQ ID NO: 585158 - RNA, 19 nt, Homo sapiens
uuuaauggcuucaacuuug

SEQ ID NO: 585159 - RNA, 19 nt, Homo sapiens
gaaaagaucaacuuacuga

SEQ ID NO: 585160 - RNA, 19 nt, Homo sapiens
gggaggaccugcucauaag

SEQ ID NO: 585161 - RNA, 19 nt, Homo sapiens
aaauacacgugcccacuuu

SEQ ID NO: 585162 - RNA, 19 nt, Homo sapiens
ggucugcuguguauuugaa

SEQ ID NO: 585163 - RNA, 19 nt, Homo sapiens
gcauguuuguuguugauga

SEQ ID NO: 585164 - RNA, 19 nt, Homo sapiens
aaaagaagccuccuuagua

SEQ ID NO: 585165 - RNA, 19 nt, Homo sapiens
caacacuccagauuuaauu

SEQ ID NO: 585166 - RNA, 19 nt, Homo sapiens
gauuacauccagcugcuua

SEQ ID NO: 585167 - RNA, 19 nt, Homo sapiens
gcucauaagagagaauaua

SEQ ID NO: 585168 - RNA, 19 nt, Homo sapiens
gaugggauucugcucauuu

SEQ ID NO: 585169 - RNA, 19 nt, Homo sapiens
gaacuguuacgaugggauu

SEQ ID NO: 585170 - RNA, 19 nt, Homo sapiens
aaggaaugcugcugagaaa

SEQ ID NO: 585171 - RNA, 19 nt, Homo sapiens
uguuagccauugugaauaa

SEQ ID NO: 585172 - RNA, 19 nt, Homo sapiens
gggaagaugauaacagcua

SEQ ID NO: 585173 - RNA, 19 nt, Homo sapiens
ugauuggucugcuguguau

SEQ ID NO: 585174 - RNA, 19 nt, Homo sapiens
uguaguaggacauucuuua

SEQ ID NO: 585175 - RNA, 19 nt, Homo sapiens
gagaguguagcacccauuu

SEQ ID NO: 585176 - RNA, 19 nt, Homo sapiens
uuagugaaauugccaagga

SEQ ID NO: 585177 - RNA, 19 nt, Homo sapiens
caaccaaagaaccagcuua

SEQ ID NO: 585178 - RNA, 19 nt, Homo sapiens
cuucaacuuuguaucagua

SEQ ID NO: 585179 - RNA, 19 nt, Homo sapiens
acuaacaggccuuuauuaa

SEQ ID NO: 585180 - RNA, 19 nt, Homo sapiens
gaaaacaccgauucaggua

SEQ ID NO: 585181 - RNA, 19 nt, Homo sapiens
caucccaguuuaugaaugu

SEQ ID NO: 585182 - RNA, 19 nt, Homo sapiens
gcaugaagaccaagaacau

SEQ ID NO: 585183 - RNA, 19 nt, Homo sapiens
gaagcuggcgaaacauaga

SEQ ID NO: 585184 - RNA, 19 nt, Homo sapiens
caagaacaucccaguuuau

SEQ ID NO: 585185 - RNA, 19 nt, Homo sapiens
cuucauagauuccaucaac

SEQ ID NO: 585186 - RNA, 19 nt, Homo sapiens
acauccagcugcuuaguga

SEQ ID NO: 585187 - RNA, 19 nt, Homo sapiens
cuagagucauuuauggaaa

SEQ ID NO: 585188 - RNA, 19 nt, Homo sapiens
gcuagagucauuuauggaa

SEQ ID NO: 585189 - RNA, 19 nt, Homo sapiens
aguaaccguuggugacaua

SEQ ID NO: 585190 - RNA, 19 nt, Homo sapiens
aguaggacauucuuuagga

SEQ ID NO: 585191 - RNA, 19 nt, Homo sapiens
gaggcugccauaaacauuu

SEQ ID NO: 585192 - RNA, 19 nt, Homo sapiens
gaguguagcacccauuuua

SEQ ID NO: 585193 - RNA, 19 nt, Homo sapiens
caaagaaccagcuuaaucc

SEQ ID NO: 585194 - RNA, 19 nt, Homo sapiens
caaauacacgugcccacuu

SEQ ID NO: 585195 - RNA, 19 nt, Homo sapiens
aacaggccuuuauuaagua

SEQ ID NO: 585196 - RNA, 19 nt, Homo sapiens
cacaaugcuuugcaguauu

SEQ ID NO: 585197 - RNA, 19 nt, Homo sapiens
caauggacaauaucaaugu

SEQ ID NO: 585198 - RNA, 19 nt, Homo sapiens
gaaaagaagccuccuuagu

SEQ ID NO: 585199 - RNA, 19 nt, Homo sapiens
gagggaggaccugcucaua

SEQ ID NO: 585200 - RNA, 19 nt, Homo sapiens
ggagacuuccugaauauac

SEQ ID NO: 585201 - RNA, 19 nt, Homo sapiens
cuggagacuuccugaauau

SEQ ID NO: 585202 - RNA, 19 nt, Homo sapiens
guaggacauucuuuaggau

SEQ ID NO: 585203 - RNA, 19 nt, Homo sapiens
gaaugugaaagaucugaug

SEQ ID NO: 585204 - RNA, 19 nt, Homo sapiens
gaagcccuuuagaauuaga

SEQ ID NO: 585205 - RNA, 19 nt, Homo sapiens
aaaggaaugcugcugagaa

SEQ ID NO: 585206 - RNA, 19 nt, Homo sapiens
acagugggaccuucaguuu

SEQ ID NO: 585207 - RNA, 19 nt, Homo sapiens
caggugaagguacaaguaa

SEQ ID NO: 585208 - RNA, 19 nt, Homo sapiens
acuuucaccuucagaguaa

SEQ ID NO: 585209 - RNA, 19 nt, Homo sapiens
aagaucugaugugcaaaua

SEQ ID NO: 585210 - RNA, 19 nt, Homo sapiens
ggaagcccuuuagaauuag

SEQ ID NO: 585211 - RNA, 19 nt, Homo sapiens
gcacaucagagaaagaaac

SEQ ID NO: 585212 - RNA, 19 nt, Homo sapiens
gugcuuaagcucuucuuug

SEQ ID NO: 585213 - RNA, 19 nt, Homo sapiens
ugucauggcuccgguaucu

SEQ ID NO: 585214 - RNA, 19 nt, Homo sapiens
ggauucugcucauuuuauu

SEQ ID NO: 585215 - RNA, 19 nt, Homo sapiens
uaaauuucagggaacauga

SEQ ID NO: 585216 - RNA, 19 nt, Homo sapiens
ccaucaacacuccagauuu

SEQ ID NO: 585217 - RNA, 19 nt, Homo sapiens
ccaauggacaauaucaaug

SEQ ID NO: 585218 - RNA, 19 nt, Homo sapiens
guacuuggcauuccuugag

SEQ ID NO: 585219 - RNA, 19 nt, Homo sapiens
gaccugcucauaagagaga

SEQ ID NO: 585220 - RNA, 19 nt, Homo sapiens
aaccaaagaaccagcuuaa

SEQ ID NO: 585221 - RNA, 19 nt, Homo sapiens
ggugaagguacaaguaaga

SEQ ID NO: 585222 - RNA, 19 nt, Homo sapiens
uuaauggcuucaacuuugu

SEQ ID NO: 585223 - RNA, 19 nt, Homo sapiens
ccagcugcuuagugaaauu

SEQ ID NO: 585224 - RNA, 19 nt, Homo sapiens
agaagccuccuuaguauuc

SEQ ID NO: 585225 - RNA, 19 nt, Homo sapiens
guaguaggacauucuuuag

SEQ ID NO: 585226 - RNA, 19 nt, Homo sapiens
aagaagcuggcgaaacaua

SEQ ID NO: 585227 - RNA, 19 nt, Homo sapiens
gccaugcacaucagagaaa

SEQ ID NO: 585228 - RNA, 19 nt, Homo sapiens
gccaauggacaauaucaau

SEQ ID NO: 585229 - RNA, 19 nt, Homo sapiens
gagaaagaaacugcauguu

SEQ ID NO: 585230 - RNA, 19 nt, Homo sapiens
accaagaacaucccaguuu

SEQ ID NO: 585231 - RNA, 19 nt, Homo sapiens
cuaacaggccuuuauuaag

SEQ ID NO: 585232 - RNA, 19 nt, Homo sapiens
auaaagggaauucaaagga

SEQ ID NO: 585233 - RNA, 19 nt, Homo sapiens
aauuaucuccucauaguug

SEQ ID NO: 585234 - RNA, 19 nt, Homo sapiens
gaaauugccaaggaacaag

SEQ ID NO: 585235 - RNA, 19 nt, Homo sapiens
ggaggaccugcucauaaga

SEQ ID NO: 585236 - RNA, 19 nt, Homo sapiens
gaggaugacugagacauua

SEQ ID NO: 585237 - RNA, 19 nt, Homo sapiens
ggacuuggguuccaugaau

SEQ ID NO: 585238 - RNA, 19 nt, Homo sapiens
gagguacgcuguggaauga

SEQ ID NO: 585239 - RNA, 19 nt, Homo sapiens
ggaagcagguugguguaaa

SEQ ID NO: 585240 - RNA, 19 nt, Homo sapiens
gagaauguguaacaagaau

SEQ ID NO: 585241 - RNA, 19 nt, Homo sapiens
caacauacuacccaaauug

SEQ ID NO: 585242 - RNA, 19 nt, Homo sapiens
uagaaaggcugaaggacaa

SEQ ID NO: 585243 - RNA, 19 nt, Homo sapiens
caacucagcaucccacaaa

SEQ ID NO: 585244 - RNA, 19 nt, Homo sapiens
ggaaacugguggauaugga

SEQ ID NO: 585245 - RNA, 19 nt, Homo sapiens
ggaccuaguggaaggguua

SEQ ID NO: 585246 - RNA, 19 nt, Homo sapiens
cgacaugcaucgccucuuc

SEQ ID NO: 585247 - RNA, 19 nt, Homo sapiens
gcaggacaaucaucucagu

SEQ ID NO: 585248 - RNA, 19 nt, Homo sapiens
ccaacauacuacccaaauu

SEQ ID NO: 585249 - RNA, 19 nt, Homo sapiens
gcaggagaauguguaacaa

SEQ ID NO: 585250 - RNA, 19 nt, Homo sapiens
aagggaaacugguggauau

SEQ ID NO: 585251 - RNA, 19 nt, Homo sapiens
cagcgcaucuccuggaaga

SEQ ID NO: 585252 - RNA, 19 nt, Homo sapiens
guggaaggguuacaugaug

SEQ ID NO: 585253 - RNA, 19 nt, Homo sapiens
gaggguggguucagcuaug

SEQ ID NO: 585254 - RNA, 19 nt, Homo sapiens
ggacuguugagcucacaua

SEQ ID NO: 585255 - RNA, 19 nt, Homo sapiens
gaagcagguugguguaaaa

SEQ ID NO: 585256 - RNA, 19 nt, Homo sapiens
gcucuucgguagccucaga

SEQ ID NO: 585257 - RNA, 19 nt, Homo sapiens
caaauugggagcaggagaa

SEQ ID NO: 585258 - RNA, 19 nt, Homo sapiens
gaaacugguggauauggaa

SEQ ID NO: 585259 - RNA, 19 nt, Homo sapiens
gcaucagcguccucacauu

SEQ ID NO: 585260 - RNA, 19 nt, Homo sapiens
cuccugaacucgaugauga

SEQ ID NO: 585261 - RNA, 19 nt, Homo sapiens
aauaagcgcuaccucuuca

SEQ ID NO: 585262 - RNA, 19 nt, Homo sapiens
ggagaauguguaacaagaa

SEQ ID NO: 585263 - RNA, 19 nt, Homo sapiens
cauacuacccaaauugaaa

SEQ ID NO: 585264 - RNA, 19 nt, Homo sapiens
aggagaauguguaacaaga

SEQ ID NO: 585265 - RNA, 19 nt, Homo sapiens
caaggguuaugcccacaga

SEQ ID NO: 585266 - RNA, 19 nt, Homo sapiens
gcuccuggccaacauacua

SEQ ID NO: 585267 - RNA, 19 nt, Homo sapiens
gacuugaagcccaccaaua

SEQ ID NO: 585268 - RNA, 19 nt, Homo sapiens
gcuguggaaugagauagaa

SEQ ID NO: 585269 - RNA, 19 nt, Homo sapiens
gguacgcuguggaaugaga

SEQ ID NO: 585270 - RNA, 19 nt, Homo sapiens
gcgagaagccgacaugcau

SEQ ID NO: 585271 - RNA, 19 nt, Homo sapiens
guucagcuauguggaccua

SEQ ID NO: 585272 - RNA, 19 nt, Homo sapiens
ggagcaggagaauguguaa

SEQ ID NO: 585273 - RNA, 19 nt, Homo sapiens
cuguugagcucacauagug

SEQ ID NO: 585274 - RNA, 19 nt, Homo sapiens
ccacaaagccccaggcauu

SEQ ID NO: 585275 - RNA, 19 nt, Homo sapiens
gaaucaagcaugcauccau

SEQ ID NO: 585276 - RNA, 19 nt, Homo sapiens
ugaagcgaauccuguguca

SEQ ID NO: 585277 - RNA, 19 nt, Homo sapiens
gagcucacauaguguucug

SEQ ID NO: 585278 - RNA, 19 nt, Homo sapiens
gcuauaugccaugauguuu

SEQ ID NO: 585279 - RNA, 19 nt, Homo sapiens
ccauucaugccaaggguua

SEQ ID NO: 585280 - RNA, 19 nt, Homo sapiens
caauaagcgcuaccucuuc

SEQ ID NO: 585281 - RNA, 19 nt, Homo sapiens
gggagcaggagaaugugua

SEQ ID NO: 585282 - RNA, 19 nt, Homo sapiens
uauaugccaugauguuugg

SEQ ID NO: 585283 - RNA, 19 nt, Homo sapiens
acaauaagcgcuaccucuu

SEQ ID NO: 585284 - RNA, 19 nt, Homo sapiens
aaagggaaacugguggaua

SEQ ID NO: 585285 - RNA, 19 nt, Homo sapiens
caggcauucuucagcauug

SEQ ID NO: 585286 - RNA, 19 nt, Homo sapiens
auauauugcuuggagauga

SEQ ID NO: 585287 - RNA, 19 nt, Homo sapiens
caucagcguccucacauuc

SEQ ID NO: 585288 - RNA, 19 nt, Homo sapiens
guuacaugauggacacuuc

SEQ ID NO: 585289 - RNA, 19 nt, Homo sapiens
gccaacauacuacccaaau

SEQ ID NO: 585290 - RNA, 19 nt, Homo sapiens
ugaagcccaccaauauauu

SEQ ID NO: 585291 - RNA, 19 nt, Homo sapiens
auaguguucugacuccaaa

SEQ ID NO: 585292 - RNA, 19 nt, Homo sapiens
gggcaggacaaucaucuca

SEQ ID NO: 585293 - RNA, 19 nt, Homo sapiens
cgugcuauaugccaugaug

SEQ ID NO: 585294 - RNA, 19 nt, Homo sapiens
gcagagucacugugucauc

SEQ ID NO: 585295 - RNA, 19 nt, Homo sapiens
acuugaagcccaccaauau

SEQ ID NO: 585296 - RNA, 19 nt, Homo sapiens
ggggaacugucaucauuga

SEQ ID NO: 585297 - RNA, 19 nt, Homo sapiens
cuugaagcccaccaauaua

SEQ ID NO: 585298 - RNA, 19 nt, Homo sapiens
ggaaggguuacaugaugga

SEQ ID NO: 585299 - RNA, 19 nt, Homo sapiens
gcagcauguugagaagaug

SEQ ID NO: 585300 - RNA, 19 nt, Homo sapiens
gugcagagucacuguguca

SEQ ID NO: 585301 - RNA, 19 nt, Homo sapiens
ggaugacugagacauuaug

SEQ ID NO: 585302 - RNA, 19 nt, Homo sapiens
ugcaucgccucuucaauca

SEQ ID NO: 585303 - RNA, 19 nt, Homo sapiens
uccauggacuucucuuaca

SEQ ID NO: 585304 - RNA, 19 nt, Homo sapiens
aaagcagcauguugagaag

SEQ ID NO: 585305 - RNA, 19 nt, Homo sapiens
gacuuggguuccaugaauc
